United States Patent 7,901,882 (ANALYSIS OF METHYLATION USING NUCLEIC ACID ARRAYS) - sequence listing, part 17

SEQ ID NO: 621259 - DNA, 25 bp, Rattus norvegicus
ctcggctgtgctgtgctgagctcct

SEQ ID NO: 621260 - DNA, 25 bp, Rattus norvegicus
gcagaccgcggtgtagccgcagcct

SEQ ID NO: 621261 - DNA, 25 bp, Rattus norvegicus
cggccaagcagaccgcggtgtagcc

SEQ ID NO: 621262 - DNA, 25 bp, Rattus norvegicus
tgtgctgtgctgagctcctggctgc

SEQ ID NO: 621263 - DNA, 25 bp, Rattus norvegicus
agtgcctggcgctcacattggcgaa

SEQ ID NO: 621264 - DNA, 25 bp, Rattus norvegicus
ctgcacgacaggtgtagttgccata

SEQ ID NO: 621265 - DNA, 25 bp, Rattus norvegicus
gctcacattggcgaagagaagcata

SEQ ID NO: 621266 - DNA, 25 bp, Rattus norvegicus
tctgcaccttgaggccttccgcaga

SEQ ID NO: 621267 - DNA, 25 bp, Rattus norvegicus
gtgcgctcggtctgcaccttgaggc

SEQ ID NO: 621268 - DNA, 25 bp, Rattus norvegicus
cattggcgaagagaagcatagagcg

SEQ ID NO: 621269 - DNA, 25 bp, Rattus norvegicus
ctggcgctcacattggcgaagagaa

SEQ ID NO: 621270 - DNA, 25 bp, Rattus norvegicus
gccatagtgcctggcgctcacattg

SEQ ID NO: 621271 - DNA, 25 bp, Rattus norvegicus
cgacaggtgtagttgccatagtgcc

SEQ ID NO: 621272 - DNA, 25 bp, Rattus norvegicus
ctccgagccggttggctgcacgaca

SEQ ID NO: 621273 - DNA, 25 bp, Rattus norvegicus
acgcacgcagaagccgcatggaggc

SEQ ID NO: 621274 - DNA, 25 bp, Rattus norvegicus
cgcagacgcacgcagaagccgcatg

SEQ ID NO: 621275 - DNA, 25 bp, Rattus norvegicus
ctgccgggcgcagacgcacgcagaa

SEQ ID NO: 621276 - DNA, 25 bp, Rattus norvegicus
tagttgccatagtgcctggcgctca

SEQ ID NO: 621277 - DNA, 25 bp, Rattus norvegicus
cagtgaggaccgtctctgtggaccc

SEQ ID NO: 621278 - DNA, 25 bp, Rattus norvegicus
cccaccggtgtctgccctcaacttc

SEQ ID NO: 621279 - DNA, 25 bp, Rattus norvegicus
ctctcccagggatcgctctactacc

SEQ ID NO: 621280 - DNA, 25 bp, Rattus norvegicus
ttggcggctctagctgcagcctcct

SEQ ID NO: 621281 - DNA, 25 bp, Rattus norvegicus
ccgatcccgtttggcggctctagct

SEQ ID NO: 621282 - DNA, 25 bp, Rattus norvegicus
ggcccgatcccgtttggcggctcta

SEQ ID NO: 621283 - DNA, 25 bp, Rattus norvegicus
catccggcatgcaggtgtctatcgc

SEQ ID NO: 621284 - DNA, 25 bp, Rattus norvegicus
agccggagcagtgaggaccgtctct

SEQ ID NO: 621285 - DNA, 25 bp, Rattus norvegicus
ccttcgcagccggagcagtgaggac

SEQ ID NO: 621286 - DNA, 25 bp, Rattus norvegicus
gcagaaccttcgcagccggagcagt

SEQ ID NO: 621287 - DNA, 25 bp, Rattus norvegicus
catgcaggtgtctatcgcgtgtacc

SEQ ID NO: 621288 - DNA, 25 bp, Rattus norvegicus
tcgcgtgtaccgagcagaaccttcg

SEQ ID NO: 621289 - DNA, 25 bp, Rattus norvegicus
gtgtctatcgcgtgtaccgagcaga

SEQ ID NO: 621290 - DNA, 25 bp, Rattus norvegicus
ggccatccggcatgcaggtgtctat

SEQ ID NO: 621291 - DNA, 25 bp, Rattus norvegicus
tgatgacggccaggccggccagggc

SEQ ID NO: 621292 - DNA, 25 bp, Rattus norvegicus
cagctaaggactgccgctcaggtct

SEQ ID NO: 621293 - DNA, 25 bp, Rattus norvegicus
acctcggctgatgacggccaggccg

SEQ ID NO: 621294 - DNA, 25 bp, Rattus norvegicus
gtacctcggctgatgacggccaggc

SEQ ID NO: 621295 - DNA, 25 bp, Rattus norvegicus
tgcccagctaaggactgccgctcag

SEQ ID NO: 621296 - DNA, 25 bp, Rattus norvegicus
ggtctccggctccagacctccgcaa

SEQ ID NO: 621297 - DNA, 25 bp, Rattus norvegicus
cgcgcatccatgcacccaagaaccc

SEQ ID NO: 621298 - DNA, 25 bp, Rattus norvegicus
cccagctaaggactgccgctcaggt

SEQ ID NO: 621299 - DNA, 25 bp, Rattus norvegicus
aaggactgccgctcaggtctccggc

SEQ ID NO: 621300 - DNA, 25 bp, Rattus norvegicus
ctccggctccagacctccgcaaccc

SEQ ID NO: 621301 - DNA, 25 bp, Rattus norvegicus
gcggtacctcggctgatgacggcca

SEQ ID NO: 621302 - DNA, 25 bp, Rattus norvegicus
gcgctgcggtacctcggctgatgac

SEQ ID NO: 621303 - DNA, 25 bp, Rattus norvegicus
caggatctcggggttccccgccgag

SEQ ID NO: 621304 - DNA, 25 bp, Rattus norvegicus
ccagcgcgcatccatgcacccaaga

SEQ ID NO: 621305 - DNA, 25 bp, Rattus norvegicus
tggagcggtcatatccgcttaaatc

SEQ ID NO: 621306 - DNA, 25 bp, Rattus norvegicus
cgcgagagtttggattctaacactg

SEQ ID NO: 621307 - DNA, 25 bp, Rattus norvegicus
ctgcgtgtcctgtgcagagttctgc

SEQ ID NO: 621308 - DNA, 25 bp, Rattus norvegicus
ccctgcgcgagagtttggattctaa

SEQ ID NO: 621309 - DNA, 25 bp, Rattus norvegicus
ttctgtaattgttgcccgccctgcg

SEQ ID NO: 621310 - DNA, 25 bp, Rattus norvegicus
ccgcgcagatcggttctgtaattgt

SEQ ID NO: 621311 - DNA, 25 bp, Rattus norvegicus
tccgcttaaatctccgcgcagatcg

SEQ ID NO: 621312 - DNA, 25 bp, Rattus norvegicus
gagtttggattctaacactgagagc

SEQ ID NO: 621313 - DNA, 25 bp, Rattus norvegicus
tgtcctgtgcagagttctgcggtgc

SEQ ID NO: 621314 - DNA, 25 bp, Rattus norvegicus
atgcgcttcaccatccgccacaaga

SEQ ID NO: 621315 - DNA, 25 bp, Rattus norvegicus
gaagtggtctggagcggtcatatcc

SEQ ID NO: 621316 - DNA, 25 bp, Rattus norvegicus
ggggagaaccctgattcgctgtaaa

SEQ ID NO: 621317 - DNA, 25 bp, Rattus norvegicus
tcgctgtaaacggaagtggtctgga

SEQ ID NO: 621318 - DNA, 25 bp, Rattus norvegicus
aatctccgcgcagatcggttctgta

SEQ ID NO: 621319 - DNA, 25 bp, Rattus norvegicus
ggtcgttcggttcgctttcattctg

SEQ ID NO: 621320 - DNA, 25 bp, Rattus norvegicus
tctgcagggtgttgccgtgtataaa

SEQ ID NO: 621321 - DNA, 25 bp, Rattus norvegicus
ctgagtgatggttgaatcgtctgca

SEQ ID NO: 621322 - DNA, 25 bp, Rattus norvegicus
agcttctctaaggtgcagtgtgcgg

SEQ ID NO: 621323 - DNA, 25 bp, Rattus norvegicus
cggaagtctcgcatccctggcgtgc

SEQ ID NO: 621324 - DNA, 25 bp, Rattus norvegicus
atccgaacccttggaattgtgggtg

SEQ ID NO: 621325 - DNA, 25 bp, Rattus norvegicus
cagcgtgggtgtttggaatccgaac

SEQ ID NO: 621326 - DNA, 25 bp, Rattus norvegicus
aagtagttcgcctctgctgtcgttg

SEQ ID NO: 621327 - DNA, 25 bp, Rattus norvegicus
tccgctcagatcttaaagtagttcg

SEQ ID NO: 621328 - DNA, 25 bp, Rattus norvegicus
tggcttagagtgatcacatccgctc

SEQ ID NO: 621329 - DNA, 25 bp, Rattus norvegicus
ccttattcaaatcggaagtggctta

SEQ ID NO: 621330 - DNA, 25 bp, Rattus norvegicus
tggtaatgtactgagggaaccctta

SEQ ID NO: 621331 - DNA, 25 bp, Rattus norvegicus
catgcgggctacgtggtaatgtact

SEQ ID NO: 621332 - DNA, 25 bp, Rattus norvegicus
ttcattctgttcctgcgggttttcc

SEQ ID NO: 621333 - DNA, 25 bp, Rattus norvegicus
ccggaaggatgctgtactgctgagc

SEQ ID NO: 621334 - DNA, 25 bp, Rattus norvegicus
tgagtgatgactgacgcagctgctg

SEQ ID NO: 621335 - DNA, 25 bp, Rattus norvegicus
gttcattttaaccagaagtgtccta

SEQ ID NO: 621336 - DNA, 25 bp, Rattus norvegicus
ctggtttgtgttgagtgatgactga

SEQ ID NO: 621337 - DNA, 25 bp, Rattus norvegicus
ccgtgtgcagagctttctgagtgca

SEQ ID NO: 621338 - DNA, 25 bp, Rattus norvegicus
aatcctagcgtctacccgggtgtgc

SEQ ID NO: 621339 - DNA, 25 bp, Rattus norvegicus
ctgaacaccggggaatcctagcgtc

SEQ ID NO: 621340 - DNA, 25 bp, Rattus norvegicus
cgagggagtttggattctgaacacc

SEQ ID NO: 621341 - DNA, 25 bp, Rattus norvegicus
ttatcgttaccaggacgccgaggga

SEQ ID NO: 621342 - DNA, 25 bp, Rattus norvegicus
tcacgtggttggttgttatcgttac

SEQ ID NO: 621343 - DNA, 25 bp, Rattus norvegicus
tccgcttagatcttcacgtggttgg

SEQ ID NO: 621344 - DNA, 25 bp, Rattus norvegicus
tagagcgtcgatttccgcttagatc

SEQ ID NO: 621345 - DNA, 25 bp, Rattus norvegicus
ccagaagtgtcctagagcgtcgatt

SEQ ID NO: 621346 - DNA, 25 bp, Rattus norvegicus
gcagagctttctgagtgcagtgtga

SEQ ID NO: 621347 - DNA, 25 bp, Rattus norvegicus
tgagcttgcaccacgcttgggcatc

SEQ ID NO: 621348 - DNA, 25 bp, Rattus norvegicus
acaatggacgctgtggcccgcagca

SEQ ID NO: 621349 - DNA, 25 bp, Rattus norvegicus
ctgctgcaccttctgcggggtgctg

SEQ ID NO: 621350 - DNA, 25 bp, Rattus norvegicus
catcgtggcctatgaagatctcttc

SEQ ID NO: 621351 - DNA, 25 bp, Rattus norvegicus
tgccgctcaccatcgtggcctatga

SEQ ID NO: 621352 - DNA, 25 bp, Rattus norvegicus
gcataggcggctaccgcgacgctgc

SEQ ID NO: 621353 - DNA, 25 bp, Rattus norvegicus
ttctgtgctgcctttgaggctgagg

SEQ ID NO: 621354 - DNA, 25 bp, Rattus norvegicus
ttgggcatcacactgcacctggtgg

SEQ ID NO: 621355 - DNA, 25 bp, Rattus norvegicus
agatctcttcggaggctggacaatg

SEQ ID NO: 621356 - DNA, 25 bp, Rattus norvegicus
ggcacacgtgctgcgtgagcttgca

SEQ ID NO: 621357 - DNA, 25 bp, Rattus norvegicus
gcaaggactccacggtgctggcaca

SEQ ID NO: 621358 - DNA, 25 bp, Rattus norvegicus
ttctcctgtcacaaggcccgtgctg

SEQ ID NO: 621359 - DNA, 25 bp, Rattus norvegicus
tgcgtacggtgcttgctgggcacct

SEQ ID NO: 621360 - DNA, 25 bp, Rattus norvegicus
ccgacgtgcttctcctgtcacaagg

SEQ ID NO: 621361 - DNA, 25 bp, Rattus norvegicus
gcactcctggatggcctcaaccgag

SEQ ID NO: 621362 - DNA, 25 bp, Rattus norvegicus
ctgcagtttgcctcgcagaaggagg

SEQ ID NO: 621363 - DNA, 25 bp, Rattus norvegicus
tggtgctgtacgcacatttccgcca

SEQ ID NO: 621364 - DNA, 25 bp, Rattus norvegicus
acctccgctacttctccgaggagtg

SEQ ID NO: 621365 - DNA, 25 bp, Rattus norvegicus
ttctccgaggagtgtgtgtatgccc

SEQ ID NO: 621366 - DNA, 25 bp, Rattus norvegicus
ccctgaggctttccgtggccatgct

SEQ ID NO: 621367 - DNA, 25 bp, Rattus norvegicus
gccatgctcgggacctgcttaagct

SEQ ID NO: 621368 - DNA, 25 bp, Rattus norvegicus
ggacctgcttaagctcctggaggca

SEQ ID NO: 621369 - DNA, 25 bp, Rattus norvegicus
agctcctggaggcagccagaccatc

SEQ ID NO: 621370 - DNA, 25 bp, Rattus norvegicus
cagccagaccatcggccgtgctgga

SEQ ID NO: 621371 - DNA, 25 bp, Rattus norvegicus
cgtgctggacctcgtgcactcggca

SEQ ID NO: 621372 - DNA, 25 bp, Rattus norvegicus
tgcactcggcagagcgcctagctct

SEQ ID NO: 621373 - DNA, 25 bp, Rattus norvegicus
ctgcggagcgctggccagcaacaag

SEQ ID NO: 621374 - DNA, 25 bp, Rattus norvegicus
agagcgcctagctctggctccggca

SEQ ID NO: 621375 - DNA, 25 bp, Rattus norvegicus
ccggtgagttttctcgaggttggct

SEQ ID NO: 621376 - DNA, 25 bp, Rattus norvegicus
tcacgtcgcgggtcttgtccgccat

SEQ ID NO: 621377 - DNA, 25 bp, Rattus norvegicus
cgggccttcctttgtcttgccttag

SEQ ID NO: 621378 - DNA, 25 bp, Rattus norvegicus
cctttcgccaggtttgtggagcttg

SEQ ID NO: 621379 - DNA, 25 bp, Rattus norvegicus
tacttttgggacgatgcctttcgcc

SEQ ID NO: 621380 - DNA, 25 bp, Rattus norvegicus
cacgggtgtacctgtcgcgtggaca

SEQ ID NO: 621381 - DNA, 25 bp, Rattus norvegicus
tcccgaggtatccatggcctggtca

SEQ ID NO: 621382 - DNA, 25 bp, Rattus norvegicus
tgggaatctcgtgtcccgaggtatc

SEQ ID NO: 621383 - DNA, 25 bp, Rattus norvegicus
ggcgccttccagtcagtggtgctac

SEQ ID NO: 621384 - DNA, 25 bp, Rattus norvegicus
cggcgcgcgctataaagtgggacac

SEQ ID NO: 621385 - DNA, 25 bp, Rattus norvegicus
caggcgtaggtgtaggctgcctcaa

SEQ ID NO: 621386 - DNA, 25 bp, Rattus norvegicus
cgggctacgccatttctgctgctca

SEQ ID NO: 621387 - DNA, 25 bp, Rattus norvegicus
ctactgtgcgccctgggaatctcgt

SEQ ID NO: 621388 - DNA, 25 bp, Rattus norvegicus
ttgtcttgccttagccgggctacgc

SEQ ID NO: 621389 - DNA, 25 bp, Rattus norvegicus
cagacgaagtagaggcgccgctcac

SEQ ID NO: 621390 - DNA, 25 bp, Rattus norvegicus
gccgcctgtgtctcgaagtctcgcg

SEQ ID NO: 621391 - DNA, 25 bp, Rattus norvegicus
gcggtccgcaggctgcgctaaactc

SEQ ID NO: 621392 - DNA, 25 bp, Rattus norvegicus
agcatccatttgctggcggtccgca

SEQ ID NO: 621393 - DNA, 25 bp, Rattus norvegicus
gtaccggcttagagcatccatttgc

SEQ ID NO: 621394 - DNA, 25 bp, Rattus norvegicus
agagcagctcgtaagtaccggctta

SEQ ID NO: 621395 - DNA, 25 bp, Rattus norvegicus
cgctggccgttctcgaaaaggtaga

SEQ ID NO: 621396 - DNA, 25 bp, Rattus norvegicus
cggtgccaggcgaagaatgacacgc

SEQ ID NO: 621397 - DNA, 25 bp, Rattus norvegicus
gcagttctccaggatgccgccattg

SEQ ID NO: 621398 - DNA, 25 bp, Rattus norvegicus
gctcacagtcatggtcccaccagga

SEQ ID NO: 621399 - DNA, 25 bp, Rattus norvegicus
gctctctagaaagggaactcgcaga

SEQ ID NO: 621400 - DNA, 25 bp, Rattus norvegicus
cgcggcagagacctgctctctagaa

SEQ ID NO: 621401 - DNA, 25 bp, Rattus norvegicus
cggtgcagaatgtgcgctagagctc

SEQ ID NO: 621402 - DNA, 25 bp, Rattus norvegicus
caccaggagccgtcgtctgaggcct

SEQ ID NO: 621403 - DNA, 25 bp, Rattus norvegicus
cgtcccagatcgtatccttgctagg

SEQ ID NO: 621404 - DNA, 25 bp, Rattus norvegicus
gctgcgtgccagctattcttagccg

SEQ ID NO: 621405 - DNA, 25 bp, Rattus norvegicus
ctccggcctgggtgtacatttaggg

SEQ ID NO: 621406 - DNA, 25 bp, Rattus norvegicus
catcaaattgggttgcgacccggtc

SEQ ID NO: 621407 - DNA, 25 bp, Rattus norvegicus
ttcttagccgccgagcttttgattc

SEQ ID NO: 621408 - DNA, 25 bp, Rattus norvegicus
gtatccttgctaggagggtgtgccc

SEQ ID NO: 621409 - DNA, 25 bp, Rattus norvegicus
ccctaagccgtactggtctccgagg

SEQ ID NO: 621410 - DNA, 25 bp, Rattus norvegicus
caaccactctaacccagggtctggg

SEQ ID NO: 621411 - DNA, 25 bp, Rattus norvegicus
cagggtctgggccagagtctcccac

SEQ ID NO: 621412 - DNA, 25 bp, Rattus norvegicus
agtctcccacgacgactggacctgg

SEQ ID NO: 621413 - DNA, 25 bp, Rattus norvegicus
ccttccaggcgtctatagttccttc

SEQ ID NO: 621414 - DNA, 25 bp, Rattus norvegicus
cgacccagggctattctttcaccaa

SEQ ID NO: 621415 - DNA, 25 bp, Rattus norvegicus
agcccgtctcggtaccagctgcgtg

SEQ ID NO: 621416 - DNA, 25 bp, Rattus norvegicus
ctacgggtaacatcaaattgggttg

SEQ ID NO: 621417 - DNA, 25 bp, Rattus norvegicus
ttctgcgtgctgatgtggcccgcaa

SEQ ID NO: 621418 - DNA, 25 bp, Rattus norvegicus
gctgcgtccagcctggcttctcgga

SEQ ID NO: 621419 - DNA, 25 bp, Rattus norvegicus
acagccttggacagcaaggccacca

SEQ ID NO: 621420 - DNA, 25 bp, Rattus norvegicus
gatcgctgacacagccttggacagc

SEQ ID NO: 621421 - DNA, 25 bp, Rattus norvegicus
acaacgctgcttgatcgctgacaca

SEQ ID NO: 621422 - DNA, 25 bp, Rattus norvegicus
tggcccgcaagctgacaacgctgct

SEQ ID NO: 621423 - DNA, 25 bp, Rattus norvegicus
atctctgcttgatggttctgcgtgc

SEQ ID NO: 621424 - DNA, 25 bp, Rattus norvegicus
cctccaaaatccgtatctctgcttg

SEQ ID NO: 621425 - DNA, 25 bp, Rattus norvegicus
acttcctttggtgctccgcaaatga

SEQ ID NO: 621426 - DNA, 25 bp, Rattus norvegicus
gccgctctttctgttacttcctttg

SEQ ID NO: 621427 - DNA, 25 bp, Rattus norvegicus
aggaagccgccgctctttctgttac

SEQ ID NO: 621428 - DNA, 25 bp, Rattus norvegicus
ggcggagccaccaacaggaagccgc

SEQ ID NO: 621429 - DNA, 25 bp, Rattus norvegicus
cctagacctgggaagaatggagcga

SEQ ID NO: 621430 - DNA, 25 bp, Rattus norvegicus
cgcaaatgagcctgcccggtgctca

SEQ ID NO: 621431 - DNA, 25 bp, Rattus norvegicus
cgccgcggcagaatcagggtagccc

SEQ ID NO: 621432 - DNA, 25 bp, Rattus norvegicus
aacgagtcccggcttcgagtagcga

SEQ ID NO: 621433 - DNA, 25 bp, Rattus norvegicus
tgcatcctgcaatcagctctggatc

SEQ ID NO: 621434 - DNA, 25 bp, Rattus norvegicus
ccaagaaatagtccgttgtgggcgc

SEQ ID NO: 621435 - DNA, 25 bp, Rattus norvegicus
gaaaaccactttcctgcatcctgca

SEQ ID NO: 621436 - DNA, 25 bp, Rattus norvegicus
cgcgggaacccaacgcggagtgatt

SEQ ID NO: 621437 - DNA, 25 bp, Rattus norvegicus
tgattgcaccctttggaaaaccact

SEQ ID NO: 621438 - DNA, 25 bp, Rattus norvegicus
acgcggagtgattgcaccctttgga

SEQ ID NO: 621439 - DNA, 25 bp, Rattus norvegicus
tcgcattccaagaaatagtccgttg

SEQ ID NO: 621440 - DNA, 25 bp, Rattus norvegicus
cgctcttggggaacaaatcgcattc

SEQ ID NO: 621441 - DNA, 25 bp, Rattus norvegicus
tagatgcgctcttggggaacaaatc

SEQ ID NO: 621442 - DNA, 25 bp, Rattus norvegicus
cggtgatggaaatagatgcgctctt

SEQ ID NO: 621443 - DNA, 25 bp, Rattus norvegicus
ccgcaaacggtgatggaaatagatg

SEQ ID NO: 621444 - DNA, 25 bp, Rattus norvegicus
agtcccggcttcgagtagcgattcg

SEQ ID NO: 621445 - DNA, 25 bp, Rattus norvegicus
gggggctcagaatcggacagctccc

SEQ ID NO: 621446 - DNA, 25 bp, Rattus norvegicus
gacgctccatgtctgtccctgacga

SEQ ID NO: 621447 - DNA, 25 bp, Rattus norvegicus
aggcctccagggacgctccatgtct

SEQ ID NO: 621448 - DNA, 25 bp, Rattus norvegicus
tggcctctacccgaggcctccaggg

SEQ ID NO: 621449 - DNA, 25 bp, Rattus norvegicus
gagcacctggtaacctggcctctac

SEQ ID NO: 621450 - DNA, 25 bp, Rattus norvegicus
ggagcacctggtaacctggcctcta

SEQ ID NO: 621451 - DNA, 25 bp, Rattus norvegicus
gcagcggagcacctggtaacctggc

SEQ ID NO: 621452 - DNA, 25 bp, Rattus norvegicus
cacagtgccagcgagtgtcccgagg

SEQ ID NO: 621453 - DNA, 25 bp, Rattus norvegicus
gccacagtgccagcgagtgtcccga

SEQ ID NO: 621454 - DNA, 25 bp, Rattus norvegicus
gaggacgaggaacgccacagtgcca

SEQ ID NO: 621455 - DNA, 25 bp, Rattus norvegicus
acaagcgaggacgaggaacgccaca

SEQ ID NO: 621456 - DNA, 25 bp, Rattus norvegicus
cccgcgacaagcgaggacgaggaac

SEQ ID NO: 621457 - DNA, 25 bp, Rattus norvegicus
ctccccagacggaccaggaagaggc

SEQ ID NO: 621458 - DNA, 25 bp, Rattus norvegicus
gctcagaatcggacagctccccaga

SEQ ID NO: 621459 - DNA, 25 bp, Rattus norvegicus
ggcgttgcctcggtctgaaccacct

SEQ ID NO: 621460 - DNA, 25 bp, Rattus norvegicus
ggagaaggcccttaccgccagtcca

SEQ ID NO: 621461 - DNA, 25 bp, Rattus norvegicus
gctgttcctgtccaccgacgcagga

SEQ ID NO: 621462 - DNA, 25 bp, Rattus norvegicus
gtcggagaaaaattccatccctatc

SEQ ID NO: 621463 - DNA, 25 bp, Rattus norvegicus
atctaccagtagcagcggccgcagc

SEQ ID NO: 621464 - DNA, 25 bp, Rattus norvegicus
accctggatttcactagccagtttg

SEQ ID NO: 621465 - DNA, 25 bp, Rattus norvegicus
ccagtttggagcagccctagtaggc

SEQ ID NO: 621466 - DNA, 25 bp, Rattus norvegicus
tccaccgacgcaggagatgaggatg

SEQ ID NO: 621467 - DNA, 25 bp, Rattus norvegicus
cggctgcgccattccaaatccattg

SEQ ID NO: 621468 - DNA, 25 bp, Rattus norvegicus
atccattgacgaaggcatgttctcc

SEQ ID NO: 621469 - DNA, 25 bp, Rattus norvegicus
gcatgttctccgcagagccgtacct

SEQ ID NO: 621470 - DNA, 25 bp, Rattus norvegicus
ccgctgaccggcaaagccttggatc

SEQ ID NO: 621471 - DNA, 25 bp, Rattus norvegicus
cctagggagtcaggagaaggccctt

SEQ ID NO: 621472 - DNA, 25 bp, Rattus norvegicus
cacatgcgcgtcacgagccagtgtt

SEQ ID NO: 621473 - DNA, 25 bp, Rattus norvegicus
gggcctcttcgacatccgtagctct

SEQ ID NO: 621474 - DNA, 25 bp, Rattus norvegicus
agcgcccaggccttcctctttgccc

SEQ ID NO: 621475 - DNA, 25 bp, Rattus norvegicus
aggagccttgtctggggcctctcgc

SEQ ID NO: 621476 - DNA, 25 bp, Rattus norvegicus
acgtcgccgattggctagagtggct

SEQ ID NO: 621477 - DNA, 25 bp, Rattus norvegicus
caagtttgacgtcgccgattggcta

SEQ ID NO: 621478 - DNA, 25 bp, Rattus norvegicus
gttctggaccaagtttgacgtcgcc

SEQ ID NO: 621479 - DNA, 25 bp, Rattus norvegicus
cgccaagcctctagggttctggacc

SEQ ID NO: 621480 - DNA, 25 bp, Rattus norvegicus
gttcggcgccaagcctctagggttc

SEQ ID NO: 621481 - DNA, 25 bp, Rattus norvegicus
ttgtctggggcctctcgctccctat

SEQ ID NO: 621482 - DNA, 25 bp, Rattus norvegicus
tcgctcccgtctttgtgccaccaca

SEQ ID NO: 621483 - DNA, 25 bp, Rattus norvegicus
ctctttgcccatcctgccttcagga

SEQ ID NO: 621484 - DNA, 25 bp, Rattus norvegicus
tcggatcacaaggtcagcccagcgc

SEQ ID NO: 621485 - DNA, 25 bp, Rattus norvegicus
tgctgcctgcctcggatcacaaggt

SEQ ID NO: 621486 - DNA, 25 bp, Rattus norvegicus
caggacccatctacccgggcctctt

SEQ ID NO: 621487 - DNA, 25 bp, Rattus norvegicus
gagacgtctttgagattcaccctga

SEQ ID NO: 621488 - DNA, 25 bp, Rattus norvegicus
gcgaagcgaatacggagagacgtct

SEQ ID NO: 621489 - DNA, 25 bp, Rattus norvegicus
cctcaccagggaatgtatcaggtcc

SEQ ID NO: 621490 - DNA, 25 bp, Rattus norvegicus
cccgagggcttcgagcatgcgccgt

SEQ ID NO: 621491 - DNA, 25 bp, Rattus norvegicus
agcagtagatcgtcgtggcgcacaa

SEQ ID NO: 621492 - DNA, 25 bp, Rattus norvegicus
gcgcacaagtgggtacgcgactcct

SEQ ID NO: 621493 - DNA, 25 bp, Rattus norvegicus
aagtctgtgacggtgatgagccacc

SEQ ID NO: 621494 - DNA, 25 bp, Rattus norvegicus
ttgagattcaccctgaccaccttcg

SEQ ID NO: 621495 - DNA, 25 bp, Rattus norvegicus
tgaccaccttcgcttgcgggcatca

SEQ ID NO: 621496 - DNA, 25 bp, Rattus norvegicus
ttgcgggcatcactgcagtcttttc

SEQ ID NO: 621497 - DNA, 25 bp, Rattus norvegicus
ctgcagtcttttcggccggatcttt

SEQ ID NO: 621498 - DNA, 25 bp, Rattus norvegicus
gccggatctttcacctcaccaggga

SEQ ID NO: 621499 - DNA, 25 bp, Rattus norvegicus
aatgtatcaggtcccgccctcgcta

SEQ ID NO: 621500 - DNA, 25 bp, Rattus norvegicus
gtgatgagccacctgcaggcgaagc

SEQ ID NO: 621501 - DNA, 25 bp, Rattus norvegicus
cccagcatcggccacaatgaagtga

SEQ ID NO: 621502 - DNA, 25 bp, Rattus norvegicus
tctgaagaaacggaagacctccatt

SEQ ID NO: 621503 - DNA, 25 bp, Rattus norvegicus
tccattaagaagaacacgctgaacc

SEQ ID NO: 621504 - DNA, 25 bp, Rattus norvegicus
cacatacaacgaggccctggtgttc

SEQ ID NO: 621505 - DNA, 25 bp, Rattus norvegicus
tgggtctcagtatcgcagtggtaga

SEQ ID NO: 621506 - DNA, 25 bp, Rattus norvegicus
cagtatcgcagtggtagactatgac

SEQ ID NO: 621507 - DNA, 25 bp, Rattus norvegicus
tagactatgactggtgagagcaccc

SEQ ID NO: 621508 - DNA, 25 bp, Rattus norvegicus
gcggcgtctgaagaaacggaagacc

SEQ ID NO: 621509 - DNA, 25 bp, Rattus norvegicus
tgagagcacccatgaggtgggacaa

SEQ ID NO: 621510 - DNA, 25 bp, Rattus norvegicus
cggaagacctccattaagaagaaca

SEQ ID NO: 621511 - DNA, 25 bp, Rattus norvegicus
catcggccacaatgaagtgatcggg

SEQ ID NO: 621512 - DNA, 25 bp, Rattus norvegicus
cacaatgaagtgatcggggtgtgcc

SEQ ID NO: 621513 - DNA, 25 bp, Rattus norvegicus
ctatgactggtgagagcacccatga

SEQ ID NO: 621514 - DNA, 25 bp, Rattus norvegicus
cccacatacaacgaggccctggtgt

SEQ ID NO: 621515 - DNA, 25 bp, Rattus norvegicus
tgactggagagggaggcagctttag

SEQ ID NO: 621516 - DNA, 25 bp, Rattus norvegicus
agctggcggaccgagctgcggacca

SEQ ID NO: 621517 - DNA, 25 bp, Rattus norvegicus
cgcgggtcccgcctctccctctgcc

SEQ ID NO: 621518 - DNA, 25 bp, Rattus norvegicus
cccagcaccgatcctcctccctctg

SEQ ID NO: 621519 - DNA, 25 bp, Rattus norvegicus
ggcagctttagatcccactccccag

SEQ ID NO: 621520 - DNA, 25 bp, Rattus norvegicus
accagcatcaggattccgctcgcgg

SEQ ID NO: 621521 - DNA, 25 bp, Rattus norvegicus
agcatcaggattccgctcgcggccg

SEQ ID NO: 621522 - DNA, 25 bp, Rattus norvegicus
tttgggaagtgaacatgggaaagcc

SEQ ID NO: 621523 - DNA, 25 bp, Rattus norvegicus
gcgaccgcagctggcggaccgagct

SEQ ID NO: 621524 - DNA, 25 bp, Rattus norvegicus
gtttccttggtgaccgcgcctggca

SEQ ID NO: 621525 - DNA, 25 bp, Rattus norvegicus
aagtgaacatgggaaagccaagagg

SEQ ID NO: 621526 - DNA, 25 bp, Rattus norvegicus
gttgccgtggcaaccagggagaacc

SEQ ID NO: 621527 - DNA, 25 bp, Rattus norvegicus
ttgccgtggcaaccagggagaaccg

SEQ ID NO: 621528 - DNA, 25 bp, Rattus norvegicus
gccgggggaatctcggcttctctcg

SEQ ID NO: 621529 - DNA, 25 bp, Rattus norvegicus
cgtcaatacccgctacctgaacttg

SEQ ID NO: 621530 - DNA, 25 bp, Rattus norvegicus
cggtgtggccgtgacttcagccgcc

SEQ ID NO: 621531 - DNA, 25 bp, Rattus norvegicus
tgtggccgtgacttcagccgccgga

SEQ ID NO: 621532 - DNA, 25 bp, Rattus norvegicus
agcagcctgctcctgcagcaaccag

SEQ ID NO: 621533 - DNA, 25 bp, Rattus norvegicus
cagcaaccaggccagccgggtgatc

SEQ ID NO: 621534 - DNA, 25 bp, Rattus norvegicus
caggccagccgggtgatctgcacgc

SEQ ID NO: 621535 - DNA, 25 bp, Rattus norvegicus
gagcacgcctccgtcgctggttggc

SEQ ID NO: 621536 - DNA, 25 bp, Rattus norvegicus
ttcaggtgagcacgcctccgtcgct

SEQ ID NO: 621537 - DNA, 25 bp, Rattus norvegicus
agcattcaggtgagcacgcctccgt

SEQ ID NO: 621538 - DNA, 25 bp, Rattus norvegicus
aacagcattcaggtgagcacgcctc

SEQ ID NO: 621539 - DNA, 25 bp, Rattus norvegicus
agagaacagcattcaggtgagcacg

SEQ ID NO: 621540 - DNA, 25 bp, Rattus norvegicus
ttgcaagagaacagcattcaggtga

SEQ ID NO: 621541 - DNA, 25 bp, Rattus norvegicus
atacccgctacctgaacttgcaaga

SEQ ID NO: 621542 - DNA, 25 bp, Rattus norvegicus
tggccgaggtgccagccagtatccc

SEQ ID NO: 621543 - DNA, 25 bp, Rattus norvegicus
ctgatgcatgcccaagtggccacca

SEQ ID NO: 621544 - DNA, 25 bp, Rattus norvegicus
aacaacctgatgtcgctgccgcacg

SEQ ID NO: 621545 - DNA, 25 bp, Rattus norvegicus
gtgtgccctcattgcgccgcctgga

SEQ ID NO: 621546 - DNA, 25 bp, Rattus norvegicus
tcgacgacctcaagtcgctggagga

SEQ ID NO: 621547 - DNA, 25 bp, Rattus norvegicus
tggccaccatcgagcgaaacgcctt

SEQ ID NO: 621548 - DNA, 25 bp, Rattus norvegicus
gagtacatatcggaggcggccttcg

SEQ ID NO: 621549 - DNA, 25 bp, Rattus norvegicus
gaacctgtcccacaacaacctgatg

SEQ ID NO: 621550 - DNA, 25 bp, Rattus norvegicus
agcctgcgcaagctgtggctgatgc

SEQ ID NO: 621551 - DNA, 25 bp, Rattus norvegicus
tcacagcacttgtgcgcctggaaga

SEQ ID NO: 621552 - DNA, 25 bp, Rattus norvegicus
ctgggcatgtgcaacctaaaggaca

SEQ ID NO: 621553 - DNA, 25 bp, Rattus norvegicus
tgcgctacctcaacctgggcatgtg

SEQ ID NO: 621554 - DNA, 25 bp, Rattus norvegicus
ggctggtgaacctgcgctacctcaa

SEQ ID NO: 621555 - DNA, 25 bp, Rattus norvegicus
cgagctgaagcgtctggagtacata

SEQ ID NO: 621556 - DNA, 25 bp, Rattus norvegicus
cgaaacgccttcgacgacctcaagt

SEQ ID NO: 621557 - DNA, 25 bp, Rattus norvegicus
tggcggctgccttcaaggcgcacta

SEQ ID NO: 621558 - DNA, 25 bp, Rattus norvegicus
tgactgtggagacgctggagacaca

SEQ ID NO: 621559 - DNA, 25 bp, Rattus norvegicus
aggctttcacggtgcccatcacgga

SEQ ID NO: 621560 - DNA, 25 bp, Rattus norvegicus
gacggagaacgcacttaaggaccta

SEQ ID NO: 621561 - DNA, 25 bp, Rattus norvegicus
agaccaccaaaatcatcatcggctg

SEQ ID NO: 621562 - DNA, 25 bp, Rattus norvegicus
ggtggccttctacaagctgcgcaag

SEQ ID NO: 621563 - DNA, 25 bp, Rattus norvegicus
agcaccagctgcacaagcaccatgg

SEQ ID NO: 621564 - DNA, 25 bp, Rattus norvegicus
acgcgcactgtggagatcatcaacg

SEQ ID NO: 621565 - DNA, 25 bp, Rattus norvegicus
ggctacacctacttcaccacggtga

SEQ ID NO: 621566 - DNA, 25 bp, Rattus norvegicus
ggcgctggagcgagaccacctcaac

SEQ ID NO: 621567 - DNA, 25 bp, Rattus norvegicus
cctagacgatgtcatgaagaccacc

SEQ ID NO: 621568 - DNA, 25 bp, Rattus norvegicus
atccacgaacctctgctcttcaaga

SEQ ID NO: 621569 - DNA, 25 bp, Rattus norvegicus
tcatcaacgtggaggacgagctgcc

SEQ ID NO: 621570 - DNA, 25 bp, Rattus norvegicus
ctgcttcgtggccatcacctttatg

SEQ ID NO: 621571 - DNA, 25 bp, Rattus norvegicus
cttcgggaatcgcagtccggcgcgc

SEQ ID NO: 621572 - DNA, 25 bp, Rattus norvegicus
cccgaaagccgcctagggaatgcga

SEQ ID NO: 621573 - DNA, 25 bp, Rattus norvegicus
gtagtcccatgtggcagagcggccc

SEQ ID NO: 621574 - DNA, 25 bp, Rattus norvegicus
cggacttccggactgagcgttctat

SEQ ID NO: 621575 - DNA, 25 bp, Rattus norvegicus
tccggactgagcgttctatttagtc

SEQ ID NO: 621576 - DNA, 25 bp, Rattus norvegicus
gcgttctatttagtcgccctacgga

SEQ ID NO: 621577 - DNA, 25 bp, Rattus norvegicus
cctacggaggccttcgggaatcgca

SEQ ID NO: 621578 - DNA, 25 bp, Rattus norvegicus
agctgtagtccgttccgcctgctca

SEQ ID NO: 621579 - DNA, 25 bp, Rattus norvegicus
cgcctgctcagtcagcgtggtacca

SEQ ID NO: 621580 - DNA, 25 bp, Rattus norvegicus
tgctcagtcagcgtggtaccacccg

SEQ ID NO: 621581 - DNA, 25 bp, Rattus norvegicus
tcagcgtggtaccacccgaaagccg

SEQ ID NO: 621582 - DNA, 25 bp, Rattus norvegicus
gagttgtagtcccatgtggcagagc

SEQ ID NO: 621583 - DNA, 25 bp, Rattus norvegicus
cgcgcgcaagttgccgggagctgta

SEQ ID NO: 621584 - DNA, 25 bp, Rattus norvegicus
ccgcctagggaatgcgaaagcggcc

SEQ ID NO: 621585 - DNA, 25 bp, Rattus norvegicus
gcggccacacgttgtgcaccgcttg

SEQ ID NO: 621586 - DNA, 25 bp, Rattus norvegicus
gcccaaagtgggctcgtttgttctg

SEQ ID NO: 621587 - DNA, 25 bp, Rattus norvegicus
tttgttctgtgtcctagccaccgcg

SEQ ID NO: 621588 - DNA, 25 bp, Rattus norvegicus
gatcgaagtcctcgagccacggcga

SEQ ID NO: 621589 - DNA, 25 bp, Rattus norvegicus
cccaggctgagtgtgaaggagaccc

SEQ ID NO: 621590 - DNA, 25 bp, Rattus norvegicus
ctctcttcccgagctgggtgagctg

SEQ ID NO: 621591 - DNA, 25 bp, Rattus norvegicus
cagctcctgatgagagtgccctctc

SEQ ID NO: 621592 - DNA, 25 bp, Rattus norvegicus
cggcatcacggagatcgcgctagat

SEQ ID NO: 621593 - DNA, 25 bp, Rattus norvegicus
cgcgctagatcctgacttgtggtca

SEQ ID NO: 621594 - DNA, 25 bp, Rattus norvegicus
cggcgaccacgatgcagctcctgat

SEQ ID NO: 621595 - DNA, 25 bp, Rattus norvegicus
cttgcggcgtccgttgcctagcaat

SEQ ID NO: 621596 - DNA, 25 bp, Rattus norvegicus
cctagcaatggtgagggaccgtgta

SEQ ID NO: 621597 - DNA, 25 bp, Rattus norvegicus
tgagctggactgcaacatctgcttc

SEQ ID NO: 621598 - DNA, 25 bp, Rattus norvegicus
tcgccgaattttggacagggtcctg

SEQ ID NO: 621599 - DNA, 25 bp, Rattus norvegicus
aaacggccgcgagctggagtctcca

SEQ ID NO: 621600 - DNA, 25 bp, Rattus norvegicus
ttcctgcaagggttcgtagggtgcc

SEQ ID NO: 621601 - DNA, 25 bp, Rattus norvegicus
ttcgtagggtgccacgatcgccggc

SEQ ID NO: 621602 - DNA, 25 bp, Rattus norvegicus
tggaagttaaagacacgcccacgtc

SEQ ID NO: 621603 - DNA, 25 bp, Rattus norvegicus
gcccacgtcagggacccaaaatagc

SEQ ID NO: 621604 - DNA, 25 bp, Rattus norvegicus
tcagggacccaaaatagcccacgcg

SEQ ID NO: 621605 - DNA, 25 bp, Rattus norvegicus
gcccagggcccgaaatcagacagga

SEQ ID NO: 621606 - DNA, 25 bp, Rattus norvegicus
cagacaggaagccaaataaccgggg

SEQ ID NO: 621607 - DNA, 25 bp, Rattus norvegicus
gcaccagagagcgtgggctcctcct

SEQ ID NO: 621608 - DNA, 25 bp, Rattus norvegicus
agcctattaaagctcggccggcggg

SEQ ID NO: 621609 - DNA, 25 bp, Rattus norvegicus
aacacctacaaagtgctgtcgctgg

SEQ ID NO: 621610 - DNA, 25 bp, Rattus norvegicus
atagaagagaacacgggcagcaccc

SEQ ID NO: 621611 - DNA, 25 bp, Rattus norvegicus
ggcagcacccggcaccagagagcgt

SEQ ID NO: 621612 - DNA, 25 bp, Rattus norvegicus
gcggggctgcgagcctattaaagct

SEQ ID NO: 621613 - DNA, 25 bp, Rattus norvegicus
gcggacgagatcttaagccggcttc

SEQ ID NO: 621614 - DNA, 25 bp, Rattus norvegicus
cccggtcagagtacaggtacctggc

SEQ ID NO: 621615 - DNA, 25 bp, Rattus norvegicus
cgctgggccacctattgtaaagtca

SEQ ID NO: 621616 - DNA, 25 bp, Rattus norvegicus
ggaaccgcggctaccatcaacaaga

SEQ ID NO: 621617 - DNA, 25 bp, Rattus norvegicus
cgagttcgaccagctgcgcgacttt

SEQ ID NO: 621618 - DNA, 25 bp, Rattus norvegicus
atcctggagtggatgccaacccttc

SEQ ID NO: 621619 - DNA, 25 bp, Rattus norvegicus
gcgcgactttcccatctttgagagc

SEQ ID NO: 621620 - DNA, 25 bp, Rattus norvegicus
ctttatctgtctgtcccaggcttca

SEQ ID NO: 621621 - DNA, 25 bp, Rattus norvegicus
tcatgacgtcaaggaacgctgggcc

SEQ ID NO: 621622 - DNA, 25 bp, Rattus norvegicus
cctcggagagaggtgacgttcatga

SEQ ID NO: 621623 - DNA, 25 bp, Rattus norvegicus
ctcccgcagttaggatggccatttc

SEQ ID NO: 621624 - DNA, 25 bp, Rattus norvegicus
cgagcgccatacagcaccctaggaa

SEQ ID NO: 621625 - DNA, 25 bp, Rattus norvegicus
ggccaccataccgaagcgctgggaa

SEQ ID NO: 621626 - DNA, 25 bp, Rattus norvegicus
aagagcactagcagctgggtcacgc

SEQ ID NO: 621627 - DNA, 25 bp, Rattus norvegicus
cagcttctgatacgtcatgcgtttg

SEQ ID NO: 621628 - DNA, 25 bp, Rattus norvegicus
gccaacaactccttgtgcttggagg

SEQ ID NO: 621629 - DNA, 25 bp, Rattus norvegicus
agcggcgagccaacaactccttgtg

SEQ ID NO: 621630 - DNA, 25 bp, Rattus norvegicus
atgcgtttgcggttgcccttctgct

SEQ ID NO: 621631 - DNA, 25 bp, Rattus norvegicus
atacgtcatgcgtttgcggttgccc

SEQ ID NO: 621632 - DNA, 25 bp, Rattus norvegicus
gagaactggaagacgccagcacctg

SEQ ID NO: 621633 - DNA, 25 bp, Rattus norvegicus
gctcgggccagcttctgatacgtca

SEQ ID NO: 621634 - DNA, 25 bp, Rattus norvegicus
gtcttggcatagttgcgcagcgctc

SEQ ID NO: 621635 - DNA, 25 bp, Rattus norvegicus
ttcgcctgtcttggcatagttgcgc

SEQ ID NO: 621636 - DNA, 25 bp, Rattus norvegicus
gaccttgcggatttcgcctgtcttg

SEQ ID NO: 621637 - DNA, 25 bp, Rattus norvegicus
gcagcagcgcgctgtcaaactggta

SEQ ID NO: 621638 - DNA, 25 bp, Rattus norvegicus
agcgcgctgtcaaactggtaggtga

SEQ ID NO: 621639 - DNA, 25 bp, Rattus norvegicus
actggtaggtgagcttgcgtttgac

SEQ ID NO: 621640 - DNA, 25 bp, Rattus norvegicus
gcttgcgtttgaccttgcggatttc

SEQ ID NO: 621641 - DNA, 25 bp, Rattus norvegicus
gcgtgcacgagcaacccatactcta

SEQ ID NO: 621642 - DNA, 25 bp, Rattus norvegicus
gagctctccgctcgaggtatcagtt

SEQ ID NO: 621643 - DNA, 25 bp, Rattus norvegicus
tgacgctaacggcacgaggacacac

SEQ ID NO: 621644 - DNA, 25 bp, Rattus norvegicus
agcatccaggctcagggagccggct

SEQ ID NO: 621645 - DNA, 25 bp, Rattus norvegicus
acgtcccttccagggaggatccaca

SEQ ID NO: 621646 - DNA, 25 bp, Rattus norvegicus
cagagctgaggcacgcccgctaggc

SEQ ID NO: 621647 - DNA, 25 bp, Rattus norvegicus
aggtacgccgccgtgacccatgaac

SEQ ID NO: 621648 - DNA, 25 bp, Rattus norvegicus
atactctactttcttacttaccgcg

SEQ ID NO: 621649 - DNA, 25 bp, Rattus norvegicus
agggaggatccacaaccacgcctct

SEQ ID NO: 621650 - DNA, 25 bp, Rattus norvegicus
agctgcggatatcccgcgagctctc

SEQ ID NO: 621651 - DNA, 25 bp, Rattus norvegicus
ctcgaggtatcagttgcgtgcacga

SEQ ID NO: 621652 - DNA, 25 bp, Rattus norvegicus
cagctcctggggtccgtcctttgca

SEQ ID NO: 621653 - DNA, 25 bp, Rattus norvegicus
cgcctttgcgctcacacccggacaa

SEQ ID NO: 621654 - DNA, 25 bp, Rattus norvegicus
tacttaccgcgtcaaacagcttttc

SEQ ID NO: 621655 - DNA, 25 bp, Rattus norvegicus
gaagcctttgcagccttcacaactg

SEQ ID NO: 621656 - DNA, 25 bp, Rattus norvegicus
tagtggaagcccgaggccttgtccc

SEQ ID NO: 621657 - DNA, 25 bp, Rattus norvegicus
cacattgtagtggaagcccgaggcc

SEQ ID NO: 621658 - DNA, 25 bp, Rattus norvegicus
actgagcacattgtagtggaagccc

SEQ ID NO: 621659 - DNA, 25 bp, Rattus norvegicus
ggcacagctcatggcccagcatctt

SEQ ID NO: 621660 - DNA, 25 bp, Rattus norvegicus
atggcccagcatcttcggggccgga

SEQ ID NO: 621661 - DNA, 25 bp, Rattus norvegicus
gcagccttcacaactgagcacattg

SEQ ID NO: 621662 - DNA, 25 bp, Rattus norvegicus
agcctccttgcacttgcgcagtctg

SEQ ID NO: 621663 - DNA, 25 bp, Rattus norvegicus
catggaccacgctacgccggaagaa

SEQ ID NO: 621664 - DNA, 25 bp, Rattus norvegicus
gcatccatctggcaggttccgctgc

SEQ ID NO: 621665 - DNA, 25 bp, Rattus norvegicus
tgaaggcatccatctggcaggttcc

SEQ ID NO: 621666 - DNA, 25 bp, Rattus norvegicus
cttgcgccgcatgaaggcatccatc

SEQ ID NO: 621667 - DNA, 25 bp, Rattus norvegicus
gagctggcacttgcgccgcatgaag

SEQ ID NO: 621668 - DNA, 25 bp, Rattus norvegicus
tgacgaggacccacgctctgtctag

SEQ ID NO: 621669 - DNA, 25 bp, Rattus norvegicus
agtaacttcgccacttcttccggca

SEQ ID NO: 621670 - DNA, 25 bp, Rattus norvegicus
ctcatgactgcaccggcgatcgtga

SEQ ID NO: 621671 - DNA, 25 bp, Rattus norvegicus
cttcgttaccctggaaatggctgtg

SEQ ID NO: 621672 - DNA, 25 bp, Rattus norvegicus
gcgcgcgttaagctggacccgcaaa

SEQ ID NO: 621673 - DNA, 25 bp, Rattus norvegicus
gcaaagatccgcgtaccggtcccaa

SEQ ID NO: 621674 - DNA, 25 bp, Rattus norvegicus
cctggtgcacttgcctctgtgtccg

SEQ ID NO: 621675 - DNA, 25 bp, Rattus norvegicus
ctctgtgtccgcaccggtgattgct

SEQ ID NO: 621676 - DNA, 25 bp, Rattus norvegicus
ggtgattgctcctccacagcacttc

SEQ ID NO: 621677 - DNA, 25 bp, Rattus norvegicus
aagtaacttcagaagcctgggagta

SEQ ID NO: 621678 - DNA, 25 bp, Rattus norvegicus
cctgggagtagctcggagcaacagc

SEQ ID NO: 621679 - DNA, 25 bp, Rattus norvegicus
ctgagcgaaaagcaaaagtaacttc

SEQ ID NO: 621680 - DNA, 25 bp, Rattus norvegicus
agacttccggtctgcctaggcgcca

SEQ ID NO: 621681 - DNA, 25 bp, Rattus norvegicus
ggcgccaccgaatgagatgccttgg

SEQ ID NO: 621682 - DNA, 25 bp, Rattus norvegicus
agcaacagcgcttgctgagcgaaaa

SEQ ID NO: 621683 - DNA, 25 bp, Rattus norvegicus
tgcggccactgcactcgcgcactgc

SEQ ID NO: 621684 - DNA, 25 bp, Rattus norvegicus
gactggagatgggaatacgaacccg

SEQ ID NO: 621685 - DNA, 25 bp, Rattus norvegicus
ggagatgggaatacgaacccgtgta

SEQ ID NO: 621686 - DNA, 25 bp, Rattus norvegicus
tgggaatacgaacccgtgtagagcc

SEQ ID NO: 621687 - DNA, 25 bp, Rattus norvegicus
tacgaacccgtgtagagcctgcaga

SEQ ID NO: 621688 - DNA, 25 bp, Rattus norvegicus
aacccgtgtagagcctgcagaggaa

SEQ ID NO: 621689 - DNA, 25 bp, Rattus norvegicus
aaggcaaggagccagcgaccgccgc

SEQ ID NO: 621690 - DNA, 25 bp, Rattus norvegicus
cagcgaccgccgcagcccgtgaccc

SEQ ID NO: 621691 - DNA, 25 bp, Rattus norvegicus
gtgacccgccctcttcgttcccgca

SEQ ID NO: 621692 - DNA, 25 bp, Rattus norvegicus
ttcgttcccgcaggcgcctcctctt

SEQ ID NO: 621693 - DNA, 25 bp, Rattus norvegicus
cctgcgcctaggaccgcctagaggg

SEQ ID NO: 621694 - DNA, 25 bp, Rattus norvegicus
ctgcagcccttgctgcggccactgc

SEQ ID NO: 621695 - DNA, 25 bp, Rattus norvegicus
cactcgcgcactgccggccctgcgc

SEQ ID NO: 621696 - DNA, 25 bp, Rattus norvegicus
gcctcctcttgctgcagcccttgct

SEQ ID NO: 621697 - DNA, 25 bp, Rattus norvegicus
gggcacggacgagttcttctttgac

SEQ ID NO: 621698 - DNA, 25 bp, Rattus norvegicus
gctttgactacgacccgggcacgga

SEQ ID NO: 621699 - DNA, 25 bp, Rattus norvegicus
gagacgtaccgctccacgttgcgca

SEQ ID NO: 621700 - DNA, 25 bp, Rattus norvegicus
gtgcgccatgagacgtaccgctcca

SEQ ID NO: 621701 - DNA, 25 bp, Rattus norvegicus
taagatcgtgatcaacgtgggcggc

SEQ ID NO: 621702 - DNA, 25 bp, Rattus norvegicus
cggcgacagcggtaagatcgtgatc

SEQ ID NO: 621703 - DNA, 25 bp, Rattus norvegicus
actggactccttcgaggctccggac

SEQ ID NO: 621704 - DNA, 25 bp, Rattus norvegicus
cggacgagttcttctttgaccgtca

SEQ ID NO: 621705 - DNA, 25 bp, Rattus norvegicus
tgccgaagaggcactggactccttc

SEQ ID NO: 621706 - DNA, 25 bp, Rattus norvegicus
gcgagctcaagcgtctgtgttttca

SEQ ID NO: 621707 - DNA, 25 bp, Rattus norvegicus
gccaacgccggaggcgcccatgatg

SEQ ID NO: 621708 - DNA, 25 bp, Rattus norvegicus
gcgctctccgagcactcctaattat

SEQ ID NO: 621709 - DNA, 25 bp, Rattus norvegicus
accgccagcaccgtgatgccgaaga

SEQ ID NO: 621710 - DNA, 25 bp, Rattus norvegicus
tcctaattatcccaaccgctctgtt

SEQ ID NO: 621711 - DNA, 25 bp, Rattus norvegicus
agcacttgctgcgacccgttcggac

SEQ ID NO: 621712 - DNA, 25 bp, Rattus norvegicus
cccggacactcaccggcgcccaggg

SEQ ID NO: 621713 - DNA, 25 bp, Rattus norvegicus
cggtccagaggcctcggcctggaca

SEQ ID NO: 621714 - DNA, 25 bp, Rattus norvegicus
aggcctcggcctggacagaaaagga

SEQ ID NO: 621715 - DNA, 25 bp, Rattus norvegicus
cccgcccacaggtggacattacgga

SEQ ID NO: 621716 - DNA, 25 bp, Rattus norvegicus
ggaccaatcagcacttgctgcgacc

SEQ ID NO: 621717 - DNA, 25 bp, Rattus norvegicus
ttcggacctcgcccatggggcgcag

SEQ ID NO: 621718 - DNA, 25 bp, Rattus norvegicus
cgcagcgctgcccaatcaaaaagag

SEQ ID NO: 621719 - DNA, 25 bp, Rattus norvegicus
tgcccaatcaaaaagagcggctggc

SEQ ID NO: 621720 - DNA, 25 bp, Rattus norvegicus
aaaaagagcggctggcgcgccaagc

SEQ ID NO: 621721 - DNA, 25 bp, Rattus norvegicus
ggctggcgcgccaagccaatcagaa

SEQ ID NO: 621722 - DNA, 25 bp, Rattus norvegicus
gcaaagcgtgccaggcgtgggaaaa

SEQ ID NO: 621723 - DNA, 25 bp, Rattus norvegicus
gcgtgggaaaagaacctggccgaga

SEQ ID NO: 621724 - DNA, 25 bp, Rattus norvegicus
acaggtggacattacggaccaatca

SEQ ID NO: 621725 - DNA, 25 bp, Rattus norvegicus
caagtacagtgatgaggagcggctc

SEQ ID NO: 621726 - DNA, 25 bp, Rattus norvegicus
agcggctcgaccgaacagcctgtga

SEQ ID NO: 621727 - DNA, 25 bp, Rattus norvegicus
tgaggagtggcagacgctctgcctc

SEQ ID NO: 621728 - DNA, 25 bp, Rattus norvegicus
cgagagtccgcgctgtgagaaactc

SEQ ID NO: 621729 - DNA, 25 bp, Rattus norvegicus
ccggatgaggaagtaggccgcttct

SEQ ID NO: 621730 - DNA, 25 bp, Rattus norvegicus
tgggaagcacccacttgcgctgttt

SEQ ID NO: 621731 - DNA, 25 bp, Rattus norvegicus
ccacggcttttcctcaagtacagtg

SEQ ID NO: 621732 - DNA, 25 bp, Rattus norvegicus
tctgctccggatcggaacgagagtc

SEQ ID NO: 621733 - DNA, 25 bp, Rattus norvegicus
aaaggtgagtccaagtttctgctcc

SEQ ID NO: 621734 - DNA, 25 bp, Rattus norvegicus
tttccgctgggcaactgaaaaggtg

SEQ ID NO: 621735 - DNA, 25 bp, Rattus norvegicus
cggaagtttccgctgggcaactgaa

SEQ ID NO: 621736 - DNA, 25 bp, Rattus norvegicus
ttctgcacgctgttgacagggccgg

SEQ ID NO: 621737 - DNA, 25 bp, Rattus norvegicus
ggccgcttctgcacgctgttgacag

SEQ ID NO: 621738 - DNA, 25 bp, Rattus norvegicus
cacttgcgctgttttttccgggagg

SEQ ID NO: 621739 - DNA, 25 bp, Rattus norvegicus
atcaatgtcattgtcagctacgcga

SEQ ID NO: 621740 - DNA, 25 bp, Rattus norvegicus
actccggcaggtgagttttgaacgg

SEQ ID NO: 621741 - DNA, 25 bp, Rattus norvegicus
tcagctacgcgacagagaactcaga

SEQ ID NO: 621742 - DNA, 25 bp, Rattus norvegicus
ccacggattccagcgctttctgctt

SEQ ID NO: 621743 - DNA, 25 bp, Rattus norvegicus
gttggcaacgatcggaatcaatgtc

SEQ ID NO: 621744 - DNA, 25 bp, Rattus norvegicus
gaacgggctcgttatagttggcaac

SEQ ID NO: 621745 - DNA, 25 bp, Rattus norvegicus
ggcctttgtatcctcgcagctagcg

SEQ ID NO: 621746 - DNA, 25 bp, Rattus norvegicus
actcgcgagctgaggcctttgtatc

SEQ ID NO: 621747 - DNA, 25 bp, Rattus norvegicus
gtgcctaccgcagtgcctgacgggc

SEQ ID NO: 621748 - DNA, 25 bp, Rattus norvegicus
tccaaacgtccgtcaagccaggatc

SEQ ID NO: 621749 - DNA, 25 bp, Rattus norvegicus
taagcgcggtaaacggcttggtcca

SEQ ID NO: 621750 - DNA, 25 bp, Rattus norvegicus
gccaaggatgtaagcgcggtaaacg

SEQ ID NO: 621751 - DNA, 25 bp, Rattus norvegicus
gaggactgtcgctcaccacggattc

SEQ ID NO: 621752 - DNA, 25 bp, Rattus norvegicus
cgcagctagcgcttcttggtataag

SEQ ID NO: 621753 - DNA, 25 bp, Rattus norvegicus
agtcaaacgtcccttgcgcctaaga

SEQ ID NO: 621754 - DNA, 25 bp, Rattus norvegicus
ctcggggattttcgatttcgcagtc

SEQ ID NO: 621755 - DNA, 25 bp, Rattus norvegicus
atacttccctgtgtggcttcaacgc

SEQ ID NO: 621756 - DNA, 25 bp, Rattus norvegicus
caacgcactacggttcccagagggc

SEQ ID NO: 621757 - DNA, 25 bp, Rattus norvegicus
tacgtcgtgctgacgcgcaacgcta

SEQ ID NO: 621758 - DNA, 25 bp, Rattus norvegicus
cactgcttgggaggcgaagacttaa

SEQ ID NO: 621759 - DNA, 25 bp, Rattus norvegicus
gccacagctggagaagctctgcctc

SEQ ID NO: 621760 - DNA, 25 bp, Rattus norvegicus
tcgtgagtcctaggccaatgctggt

SEQ ID NO: 621761 - DNA, 25 bp, Rattus norvegicus
ccagatgttcttttgtcccatgcca

SEQ ID NO: 621762 - DNA, 25 bp, Rattus norvegicus
acagcattgcgcgaggctgattctc

SEQ ID NO: 621763 - DNA, 25 bp, Rattus norvegicus
gattctcgcctttgctctacctggg

SEQ ID NO: 621764 - DNA, 25 bp, Rattus norvegicus
tcgccctcttccgtctttcaggtgg

SEQ ID NO: 621765 - DNA, 25 bp, Rattus norvegicus
cgagcttcggacctgttggtatttc

SEQ ID NO: 621766 - DNA, 25 bp, Rattus norvegicus
ttcagcagacgttgcagcttcggta

SEQ ID NO: 621767 - DNA, 25 bp, Rattus norvegicus
ttccctgccagcgactccttggaga

SEQ ID NO: 621768 - DNA, 25 bp, Rattus norvegicus
ttacccttgtgcaggacagcgttgg

SEQ ID NO: 621769 - DNA, 25 bp, Rattus norvegicus
tggctggcttgttccctgccagcga

SEQ ID NO: 621770 - DNA, 25 bp, Rattus norvegicus
taggcactcggcctcggcaaagcgg

SEQ ID NO: 621771 - DNA, 25 bp, Rattus norvegicus
cctgccagcgactccttggagaggt

SEQ ID NO: 621772 - DNA, 25 bp, Rattus norvegicus
tggctctcggctaggcactcggcct

SEQ ID NO: 621773 - DNA, 25 bp, Rattus norvegicus
gcggcccttacccttgtgcaggaca

SEQ ID NO: 621774 - DNA, 25 bp, Rattus norvegicus
acttacgcagcgttgtgggccctcc

SEQ ID NO: 621775 - DNA, 25 bp, Rattus norvegicus
aagacttacgcagcgttgtgggccc

SEQ ID NO: 621776 - DNA, 25 bp, Rattus norvegicus
gccgcagctgctcctcgatcaccag

SEQ ID NO: 621777 - DNA, 25 bp, Rattus norvegicus
gacagcgttggctggcttgttccct

SEQ ID NO: 621778 - DNA, 25 bp, Rattus norvegicus
cctgtgacaggttcaggtaggccgc

SEQ ID NO: 621779 - DNA, 25 bp, Rattus norvegicus
cgccggctcctgtgacaggttcagg

SEQ ID NO: 621780 - DNA, 25 bp, Rattus norvegicus
acaggttcaggtaggccgcccgccg

SEQ ID NO: 621781 - DNA, 25 bp, Rattus norvegicus
gggcccggactctgtttcctgtatc

SEQ ID NO: 621782 - DNA, 25 bp, Rattus norvegicus
ccctggaccggattcattgttacgc

SEQ ID NO: 621783 - DNA, 25 bp, Rattus norvegicus
cctgtatcggttggatcctattcga

SEQ ID NO: 621784 - DNA, 25 bp, Rattus norvegicus
ccgcaagacgaaagctcagaccctg

SEQ ID NO: 621785 - DNA, 25 bp, Rattus norvegicus
tgccaccagtccctaaaaccgatgt

SEQ ID NO: 621786 - DNA, 25 bp, Rattus norvegicus
attgttacgccactaccctcctggg

SEQ ID NO: 621787 - DNA, 25 bp, Rattus norvegicus
cagtgcgtgtgtttagccaattacc

SEQ ID NO: 621788 - DNA, 25 bp, Rattus norvegicus
gccgggaataaggtaatgcgcatgc

SEQ ID NO: 621789 - DNA, 25 bp, Rattus norvegicus
cgcaatagagtgtgggttcgtatcc

SEQ ID NO: 621790 - DNA, 25 bp, Rattus norvegicus
atggcgcgcgaaccgaccttaaaag

SEQ ID NO: 621791 - DNA, 25 bp, Rattus norvegicus
ggttactcactccatggctgcgaaa

SEQ ID NO: 621792 - DNA, 25 bp, Rattus norvegicus
cgcgaccgtggttcctcatatcgtc

SEQ ID NO: 621793 - DNA, 25 bp, Rattus norvegicus
gctgattgctcgctaagccgcaaga

SEQ ID NO: 621794 - DNA, 25 bp, Rattus norvegicus
ctcgtgggttaagctcatcgcggaa

SEQ ID NO: 621795 - DNA, 25 bp, Rattus norvegicus
acccttgtgtgggtcgcagggatca

SEQ ID NO: 621796 - DNA, 25 bp, Rattus norvegicus
agggatcacgctccgtgcacagttc

SEQ ID NO: 621797 - DNA, 25 bp, Rattus norvegicus
gccgaagtcgcagaagagacccttg

SEQ ID NO: 621798 - DNA, 25 bp, Rattus norvegicus
ggtggcgctggcttttatacgctcc

SEQ ID NO: 621799 - DNA, 25 bp, Rattus norvegicus
ccgtctggaggaggtcggtctccta

SEQ ID NO: 621800 - DNA, 25 bp, Rattus norvegicus
ccggacgctccaggtggtggctcct

SEQ ID NO: 621801 - DNA, 25 bp, Rattus norvegicus
gcaccaaggcgaggctaacgggacc

SEQ ID NO: 621802 - DNA, 25 bp, Rattus norvegicus
ctggcttttatacgctccgggcggc

SEQ ID NO: 621803 - DNA, 25 bp, Rattus norvegicus
tcctgtccgtcagtcctggagctta

SEQ ID NO: 621804 - DNA, 25 bp, Rattus norvegicus
tgagatcgcagctcactttgccctc

SEQ ID NO: 621805 - DNA, 25 bp, Rattus norvegicus
gcggtcagtctgagatcgcagctca

SEQ ID NO: 621806 - DNA, 25 bp, Rattus norvegicus
ttctcccagctgcttggcgcagacg

SEQ ID NO: 621807 - DNA, 25 bp, Rattus norvegicus
tcctggagcttacccgggtgcagag

SEQ ID NO: 621808 - DNA, 25 bp, Rattus norvegicus
tgacactgcgcgctgcagtcctggc

SEQ ID NO: 621809 - DNA, 25 bp, Rattus norvegicus
gccgcatttacttcgcaggcgagca

SEQ ID NO: 621810 - DNA, 25 bp, Rattus norvegicus
ggccttaagagctgtgtttcgactg

SEQ ID NO: 621811 - DNA, 25 bp, Rattus norvegicus
cttctttgcccgttctgtaggtaca

SEQ ID NO: 621812 - DNA, 25 bp, Rattus norvegicus
aatgcgccagtggtgtcgatctctc

SEQ ID NO: 621813 - DNA, 25 bp, Rattus norvegicus
tacgtggcagccagcaaggtttttc

SEQ ID NO: 621814 - DNA, 25 bp, Rattus norvegicus
gcctttctggcacgaggagcacatc

SEQ ID NO: 621815 - DNA, 25 bp, Rattus norvegicus
ggctcactgcttctggcctcctata

SEQ ID NO: 621816 - DNA, 25 bp, Rattus norvegicus
ctcctatacgtggtcggacgctgca

SEQ ID NO: 621817 - DNA, 25 bp, Rattus norvegicus
ccttcgctggactgagcactgaaca

SEQ ID NO: 621818 - DNA, 25 bp, Rattus norvegicus
gccgccattgtttgggcaagggacc

SEQ ID NO: 621819 - DNA, 25 bp, Rattus norvegicus
ccgcgctgaggatcaatagtaacta

SEQ ID NO: 621820 - DNA, 25 bp, Rattus norvegicus
acctcgagacgctggagcatgcact

SEQ ID NO: 621821 - DNA, 25 bp, Rattus norvegicus
atgcactcgcagaggccagctttgc

SEQ ID NO: 621822 - DNA, 25 bp, Rattus norvegicus
agaccctgcatttggtgctcaagga

SEQ ID NO: 621823 - DNA, 25 bp, Rattus norvegicus
agccaatactatgccgttttcctcg

SEQ ID NO: 621824 - DNA, 25 bp, Rattus norvegicus
gcagtacgccactctcgacacgaag

SEQ ID NO: 621825 - DNA, 25 bp, Rattus norvegicus
ctcgacacgaagtaaacaagtaggc

SEQ ID NO: 621826 - DNA, 25 bp, Rattus norvegicus
caagtaggcggacccatgttctcaa

SEQ ID NO: 621827 - DNA, 25 bp, Rattus norvegicus
atgttctcaacccaactcgtgatcc

SEQ ID NO: 621828 - DNA, 25 bp, Rattus norvegicus
gtgatccctcgggaacgcctccttg

SEQ ID NO: 621829 - DNA, 25 bp, Rattus norvegicus
catattttatactggcaccgaagcc

SEQ ID NO: 621830 - DNA, 25 bp, Rattus norvegicus
tactatgccgttttcctcgaggaca

SEQ ID NO: 621831 - DNA, 25 bp, Rattus norvegicus
ctcgaggacaaaccatagaggcttg

SEQ ID NO: 621832 - DNA, 25 bp, Rattus norvegicus
tagaggcttgttgggagccatgtta

SEQ ID NO: 621833 - DNA, 25 bp, Rattus norvegicus
agccatgttaatgcggggcactatc

SEQ ID NO: 621834 - DNA, 25 bp, Rattus norvegicus
aatgcggggcactatcatctctttg

SEQ ID NO: 621835 - DNA, 25 bp, Rattus norvegicus
actatcatctctttgcggggcacga

SEQ ID NO: 621836 - DNA, 25 bp, Rattus norvegicus
tccttggccctctccatattttata

SEQ ID NO: 621837 - DNA, 25 bp, Rattus norvegicus
agaagccgccatgccttttgagggc

SEQ ID NO: 621838 - DNA, 25 bp, Rattus norvegicus
tttcttggacatcccgctccgtgtc

SEQ ID NO: 621839 - DNA, 25 bp, Rattus norvegicus
tcggtggtaggatctttcttggaca

SEQ ID NO: 621840 - DNA, 25 bp, Rattus norvegicus
gcggccttacttcggtggtaggatc

SEQ ID NO: 621841 - DNA, 25 bp, Rattus norvegicus
ggatttcctgttttcttcctagaga

SEQ ID NO: 621842 - DNA, 25 bp, Rattus norvegicus
tggcggtgaaccatgtccatatggc

SEQ ID NO: 621843 - DNA, 25 bp, Rattus norvegicus
gctggaaccctcacactggcggtga

SEQ ID NO: 621844 - DNA, 25 bp, Rattus norvegicus
cgcgacgaatcatagacgagcttca

SEQ ID NO: 621845 - DNA, 25 bp, Rattus norvegicus
ccatgtgtctgactcgcgacgaatc

SEQ ID NO: 621846 - DNA, 25 bp, Rattus norvegicus
ctgctgaaatggctaacgctcaacc

SEQ ID NO: 621847 - DNA, 25 bp, Rattus norvegicus
tgcgacccttggctgactgctgaaa

SEQ ID NO: 621848 - DNA, 25 bp, Rattus norvegicus
agccgccatgggaagggtacaatct

SEQ ID NO: 621849 - DNA, 25 bp, Rattus norvegicus
ggaagtgacgcaagaagccgccatg

SEQ ID NO: 621850 - DNA, 25 bp, Rattus norvegicus
gggcagtgaccgtcctgcgaccctt

SEQ ID NO: 621851 - DNA, 25 bp, Rattus norvegicus
gctctgcccagcaacagaacaattc

SEQ ID NO: 621852 - DNA, 25 bp, Rattus norvegicus
tcttgcctagcaacagaagctttgc

SEQ ID NO: 621853 - DNA, 25 bp, Rattus norvegicus
ctcagagggtcaactccgtttcttg

SEQ ID NO: 621854 - DNA, 25 bp, Rattus norvegicus
aattctttacgggattggctcgctc

SEQ ID NO: 621855 - DNA, 25 bp, Rattus norvegicus
caatcaggtcttcggggaccttccg

SEQ ID NO: 621856 - DNA, 25 bp, Rattus norvegicus
tcggcacacgcgaggccactgtctg

SEQ ID NO: 621857 - DNA, 25 bp, Rattus norvegicus
agcgtgcagaatgcctcggcacacg

SEQ ID NO: 621858 - DNA, 25 bp, Rattus norvegicus
ctgaagcgaaaatattaagcgtgca

SEQ ID NO: 621859 - DNA, 25 bp, Rattus norvegicus
accagcgactttcagaagctgaagc

SEQ ID NO: 621860 - DNA, 25 bp, Rattus norvegicus
ggccgcggctcaataccagcgactt

SEQ ID NO: 621861 - DNA, 25 bp, Rattus norvegicus
gcccgacctagaccgaatagcggct

SEQ ID NO: 621862 - DNA, 25 bp, Rattus norvegicus
aatagcggctagcatgcgcgcgcta

SEQ ID NO: 621863 - DNA, 25 bp, Rattus norvegicus
ggaggctgaggacaatcaggtcttc

SEQ ID NO: 621864 - DNA, 25 bp, Rattus norvegicus
gcggggctagttctaaactctcaga

SEQ ID NO: 621865 - DNA, 25 bp, Rattus norvegicus
ccggtgtgactctattgggaaatca

SEQ ID NO: 621866 - DNA, 25 bp, Rattus norvegicus
tcccacagcgtggatgagctttaga

SEQ ID NO: 621867 - DNA, 25 bp, Rattus norvegicus
tgtggtagcctaggaaacgtcgaac

SEQ ID NO: 621868 - DNA, 25 bp, Rattus norvegicus
ctctagcgtagggattaagcgccta

SEQ ID NO: 621869 - DNA, 25 bp, Rattus norvegicus
tgggaggagccaaattttcggagtc

SEQ ID NO: 621870 - DNA, 25 bp, Rattus norvegicus
gcccataggcaaagggcgggatttc

SEQ ID NO: 621871 - DNA, 25 bp, Rattus norvegicus
gctcatacgcattgcaaccattgtg

SEQ ID NO: 621872 - DNA, 25 bp, Rattus norvegicus
gatactcttaactatgcaatgctca

SEQ ID NO: 621873 - DNA, 25 bp, Rattus norvegicus
cgtggatgagctttagaatgaattc

SEQ ID NO: 621874 - DNA, 25 bp, Rattus norvegicus
ttgggaaatcaggacttccggtggc

SEQ ID NO: 621875 - DNA, 25 bp, Rattus norvegicus
ttttcggagtctttcccacagcgtg

SEQ ID NO: 621876 - DNA, 25 bp, Rattus norvegicus
ccgcaagcgagtcgggactgcgcat

SEQ ID NO: 621877 - DNA, 25 bp, Rattus norvegicus
taagcgcctatggatccgagttacc

SEQ ID NO: 621878 - DNA, 25 bp, Rattus norvegicus
gcgggatttccggtgtgactctatt

SEQ ID NO: 621879 - DNA, 25 bp, Rattus norvegicus
ggccgcgcagtcagcagtaattcga

SEQ ID NO: 621880 - DNA, 25 bp, Rattus norvegicus
ccacgaatctactgcgctgaatgtt

SEQ ID NO: 621881 - DNA, 25 bp, Rattus norvegicus
cttaaggcttaaggtctgggctcgc

SEQ ID NO: 621882 - DNA, 25 bp, Rattus norvegicus
ggtatgcaaatagagggactgtcca

SEQ ID NO: 621883 - DNA, 25 bp, Rattus norvegicus
ggactgtccacagttgccatctggc

SEQ ID NO: 621884 - DNA, 25 bp, Rattus norvegicus
gagcaacagctggacgcgcgtgtat

SEQ ID NO: 621885 - DNA, 25 bp, Rattus norvegicus
ccggaggccaaggaccaactttgca

SEQ ID NO: 621886 - DNA, 25 bp, Rattus norvegicus
gaaacaggccgtgggactcaccatg

SEQ ID NO: 621887 - DNA, 25 bp, Rattus norvegicus
cgcggccgaaccactgcagggaaca

SEQ ID NO: 621888 - DNA, 25 bp, Rattus norvegicus
ggctggcgcctaccaacgtggaaga

SEQ ID NO: 621889 - DNA, 25 bp, Rattus norvegicus
ggagccggcgctaaccaacagacta

SEQ ID NO: 621890 - DNA, 25 bp, Rattus norvegicus
aacagactatggagctggggagcca

SEQ ID NO: 621891 - DNA, 25 bp, Rattus norvegicus
gcccagagccgaccaaggactgatc

SEQ ID NO: 621892 - DNA, 25 bp, Rattus norvegicus
tcgcgaatttccagacccggaggcc

SEQ ID NO: 621893 - DNA, 25 bp, Rattus norvegicus
ccgggacgaacagaagtgcgcttgc

SEQ ID NO: 621894 - DNA, 25 bp, Rattus norvegicus
gccgtcccgggacgaacagaagtgc

SEQ ID NO: 621895 - DNA, 25 bp, Rattus norvegicus
tcgatcacaaacaccacatcagcga

SEQ ID NO: 621896 - DNA, 25 bp, Rattus norvegicus
tgcggagtccctcgaagtacggccc

SEQ ID NO: 621897 - DNA, 25 bp, Rattus norvegicus
cagcaggtagtgcttgcggagtccc

SEQ ID NO: 621898 - DNA, 25 bp, Rattus norvegicus
cactcactctatggcgggcagcagg

SEQ ID NO: 621899 - DNA, 25 bp, Rattus norvegicus
ggcgatgtagggtctcactcactct

SEQ ID NO: 621900 - DNA, 25 bp, Rattus norvegicus
cacaagccttaggttagggcagcgg

SEQ ID NO: 621901 - DNA, 25 bp, Rattus norvegicus
cagcgtcggcacaagccttaggtta

SEQ ID NO: 621902 - DNA, 25 bp, Rattus norvegicus
aggaaaggcagcgtcggcacaagcc

SEQ ID NO: 621903 - DNA, 25 bp, Rattus norvegicus
tacctgcgaagacggaggaaaggca

SEQ ID NO: 621904 - DNA, 25 bp, Rattus norvegicus
ggtggtcctccgttgaagtacctgc

SEQ ID NO: 621905 - DNA, 25 bp, Rattus norvegicus
cccaaagtccgtctctgcgggtggt

SEQ ID NO: 621906 - DNA, 25 bp, Rattus norvegicus
tcctccgttgaagtacctgcgaaga

SEQ ID NO: 621907 - DNA, 25 bp, Rattus norvegicus
cgagagtctccaggggcgtgacttt

SEQ ID NO: 621908 - DNA, 25 bp, Rattus norvegicus
cctgttctgtcggagcagcagcgga

SEQ ID NO: 621909 - DNA, 25 bp, Rattus norvegicus
ttggaggggctgaattgatgatccc

SEQ ID NO: 621910 - DNA, 25 bp, Rattus norvegicus
acgggccaggaagcacggtgcatct

SEQ ID NO: 621911 - DNA, 25 bp, Rattus norvegicus
tgaattgatgatcccgcttctcgcc

SEQ ID NO: 621912 - DNA, 25 bp, Rattus norvegicus
gccctttggcggctccaaacagcag

SEQ ID NO: 621913 - DNA, 25 bp, Rattus norvegicus
gcaggccactttgcctacccgcatg

SEQ ID NO: 621914 - DNA, 25 bp, Rattus norvegicus
ctcccgtcaacaggtgggggcattc

SEQ ID NO: 621915 - DNA, 25 bp, Rattus norvegicus
atgctcccagatccacaccgagagt

SEQ ID NO: 621916 - DNA, 25 bp, Rattus norvegicus
cagatccacaccgagagtctccagg

SEQ ID NO: 621917 - DNA, 25 bp, Rattus norvegicus
actttccgggtgcgggcttcgagat

SEQ ID NO: 621918 - DNA, 25 bp, Rattus norvegicus
aagcacggtgcatctgctgtgcctc

SEQ ID NO: 621919 - DNA, 25 bp, Rattus norvegicus
atctgctgtgcctcgcagcctctag

SEQ ID NO: 621920 - DNA, 25 bp, Rattus norvegicus
gctgtgcctcgcagcctctagcggg

SEQ ID NO: 621921 - DNA, 25 bp, Rattus norvegicus
gcgccaggttctatgtgcacgatgg

SEQ ID NO: 621922 - DNA, 25 bp, Rattus norvegicus
gcgcagcctctgcagtaccgggcaa

SEQ ID NO: 621923 - DNA, 25 bp, Rattus norvegicus
tacagcccaacggtgcagacgcgga

SEQ ID NO: 621924 - DNA, 25 bp, Rattus norvegicus
ctagagctgagccttgagtgcggat

SEQ ID NO: 621925 - DNA, 25 bp, Rattus norvegicus
aaaggcaaatacagcccaacggtgc

SEQ ID NO: 621926 - DNA, 25 bp, Rattus norvegicus
cactcgctcttcaggaagaaaaaca

SEQ ID NO: 621927 - DNA, 25 bp, Rattus norvegicus
accatgcactcgctcttcaggaaga

SEQ ID NO: 621928 - DNA, 25 bp, Rattus norvegicus
tccgccgccgcttttcacctgagcc

SEQ ID NO: 621929 - DNA, 25 bp, Rattus norvegicus
cctgttcctgtagtgacccagtgcc

SEQ ID NO: 621930 - DNA, 25 bp, Rattus norvegicus
cgcctgcaaggtaagcgccaccttc

SEQ ID NO: 621931 - DNA, 25 bp, Rattus norvegicus
agcctctgcagtaccgggcaaccgg

SEQ ID NO: 621932 - DNA, 25 bp, Rattus norvegicus
tatgtgcacgatgggcgcggcctct

SEQ ID NO: 621933 - DNA, 25 bp, Rattus norvegicus
cccggtcggccaggttctggcgaca

SEQ ID NO: 621934 - DNA, 25 bp, Rattus norvegicus
cctgtagtgacccagtgccgcggca

SEQ ID NO: 621935 - DNA, 25 bp, Rattus norvegicus
cagtactgggctatttccgttcgga

SEQ ID NO: 621936 - DNA, 25 bp, Rattus norvegicus
ttgccctagagacaggcggagttcg

SEQ ID NO: 621937 - DNA, 25 bp, Rattus norvegicus
ttcgatgacacactctggaaccgcc

SEQ ID NO: 621938 - DNA, 25 bp, Rattus norvegicus
ccaacgctaattggatggaccatca

SEQ ID NO: 621939 - DNA, 25 bp, Rattus norvegicus
ggaaatcgcactccgcaaggctctg

SEQ ID NO: 621940 - DNA, 25 bp, Rattus norvegicus
gcgactcgccggaagcgtcatactt

SEQ ID NO: 621941 - DNA, 25 bp, Rattus norvegicus
agcgtcatacttccgccctcgaagg

SEQ ID NO: 621942 - DNA, 25 bp, Rattus norvegicus
gtcatccgggaacgtactccacttg

SEQ ID NO: 621943 - DNA, 25 bp, Rattus norvegicus
tgccatcgcctttggatacagccgg

SEQ ID NO: 621944 - DNA, 25 bp, Rattus norvegicus
tgtcggagatgaacacggcaagccc

SEQ ID NO: 621945 - DNA, 25 bp, Rattus norvegicus
tcgtgagctcacagttccggatgtc

SEQ ID NO: 621946 - DNA, 25 bp, Rattus norvegicus
agccctgccgctcacaatagaatgc

SEQ ID NO: 621947 - DNA, 25 bp, Rattus norvegicus
tcctctctctttgattggctgaata

SEQ ID NO: 621948 - DNA, 25 bp, Rattus norvegicus
ctccacttgttagctgaaagccctg

SEQ ID NO: 621949 - DNA, 25 bp, Rattus norvegicus
caaatagagctggagtcgtggcgcc

SEQ ID NO: 621950 - DNA, 25 bp, Rattus norvegicus
cgcacgttgaaagctgaagagcctc

SEQ ID NO: 621951 - DNA, 25 bp, Rattus norvegicus
aagctgaagagcctcgggtgcctcc

SEQ ID NO: 621952 - DNA, 25 bp, Rattus norvegicus
ttgcgcacggtctcttgcgctccgg

SEQ ID NO: 621953 - DNA, 25 bp, Rattus norvegicus
aacaaggacaggagcgtcaaggccc

SEQ ID NO: 621954 - DNA, 25 bp, Rattus norvegicus
ggactctaggtactacaagcaaaca

SEQ ID NO: 621955 - DNA, 25 bp, Rattus norvegicus
gggcgcatggactctaggtactaca

SEQ ID NO: 621956 - DNA, 25 bp, Rattus norvegicus
cgtcgtctcggagcacagggcgcat

SEQ ID NO: 621957 - DNA, 25 bp, Rattus norvegicus
acgctgtcgaaagcgtcgtctcgga

SEQ ID NO: 621958 - DNA, 25 bp, Rattus norvegicus
caacctcaggaagtcgtttgccagc

SEQ ID NO: 621959 - DNA, 25 bp, Rattus norvegicus
ccaggacttgagttgcaaatagagc

SEQ ID NO: 621960 - DNA, 25 bp, Rattus norvegicus
ttggaagcgcaccaggacttgagtt

SEQ ID NO: 621961 - DNA, 25 bp, Rattus norvegicus
ccgaactcacgtagttggaagcgca

SEQ ID NO: 621962 - DNA, 25 bp, Rattus norvegicus
tttgccagcgccacaacgctgtcga

SEQ ID NO: 621963 - DNA, 25 bp, Rattus norvegicus
gaagccgaagcccacgtagccgtta

SEQ ID NO: 621964 - DNA, 25 bp, Rattus norvegicus
cggagccagtgtcagcctcgtgctt

SEQ ID NO: 621965 - DNA, 25 bp, Rattus norvegicus
agccgtacatccttgtgtcccgcag

SEQ ID NO: 621966 - DNA, 25 bp, Rattus norvegicus
cagcggccagccgtacatccttgtg

SEQ ID NO: 621967 - DNA, 25 bp, Rattus norvegicus
acagcactagcagcggccagccgta

SEQ ID NO: 621968 - DNA, 25 bp, Rattus norvegicus
gggagcagcgcacacagcactagca

SEQ ID NO: 621969 - DNA, 25 bp, Rattus norvegicus
ttgccttcggggtcgagaaccacgc

SEQ ID NO: 621970 - DNA, 25 bp, Rattus norvegicus
gcagccagtacttgccttcggggtc

SEQ ID NO: 621971 - DNA, 25 bp, Rattus norvegicus
acgtagccgttagtgcgcacctcca

SEQ ID NO: 621972 - DNA, 25 bp, Rattus norvegicus
accacgatgtctgctgccgccatgg

SEQ ID NO: 621973 - DNA, 25 bp, Rattus norvegicus
tcccggagcgatcccagctcaggga

SEQ ID NO: 621974 - DNA, 25 bp, Rattus norvegicus
ttggatggactctgccgcccatcga

SEQ ID NO: 621975 - DNA, 25 bp, Rattus norvegicus
tcagcctcgtgcttggatggactct

SEQ ID NO: 621976 - DNA, 25 bp, Rattus norvegicus
acctccaggcggaaggcaagcctct

SEQ ID NO: 621977 - DNA, 25 bp, Rattus norvegicus
ccgccttttaccagagggtccacag

SEQ ID NO: 621978 - DNA, 25 bp, Rattus norvegicus
cacgtgtggcgattgggtaatatcc

SEQ ID NO: 621979 - DNA, 25 bp, Rattus norvegicus
ggacccaaagcaccgaaagccgtga

SEQ ID NO: 621980 - DNA, 25 bp, Rattus norvegicus
aagccgtgatcgctctcgtcacatc

SEQ ID NO: 621981 - DNA, 25 bp, Rattus norvegicus
gaccaacgggagaccaggtacatca

SEQ ID NO: 621982 - DNA, 25 bp, Rattus norvegicus
tcacctccatgatgcagttcgcggc

SEQ ID NO: 621983 - DNA, 25 bp, Rattus norvegicus
agggtccacagtccagccctcgata

SEQ ID NO: 621984 - DNA, 25 bp, Rattus norvegicus
gtccgctaggaagggaacaactgtc

SEQ ID NO: 621985 - DNA, 25 bp, Rattus norvegicus
ggtaatatccaccagatcgtcccgc

SEQ ID NO: 621986 - DNA, 25 bp, Rattus norvegicus
ccgcgctaagcggacgtctagaaac

SEQ ID NO: 621987 - DNA, 25 bp, Rattus norvegicus
ccctcgttgctattggctgagtcaa

SEQ ID NO: 621988 - DNA, 25 bp, Rattus norvegicus
ggtgacgttcgcgactcttactcta

SEQ ID NO: 621989 - DNA, 25 bp, Rattus norvegicus
gttctcattggtctgtaacgccgtc

SEQ ID NO: 621990 - DNA, 25 bp, Rattus norvegicus
gccgtccatctgacagcttcacatt

SEQ ID NO: 621991 - DNA, 25 bp, Rattus norvegicus
cacgtcgctgggttaggatcttgcg

SEQ ID NO: 621992 - DNA, 25 bp, Rattus norvegicus
ctcttcgagccttcttccgagcagg

SEQ ID NO: 621993 - DNA, 25 bp, Rattus norvegicus
ccagggccttccgtcgagacgcttt

SEQ ID NO: 621994 - DNA, 25 bp, Rattus norvegicus
gagacgctttctcccttgaggacga

SEQ ID NO: 621995 - DNA, 25 bp, Rattus norvegicus
acgcctgcgatctttgtcacccttg

SEQ ID NO: 621996 - DNA, 25 bp, Rattus norvegicus
ctcagaccctcagagtcatacagga

SEQ ID NO: 621997 - DNA, 25 bp, Rattus norvegicus
gacctcccgctttggggacacagca

SEQ ID NO: 621998 - DNA, 25 bp, Rattus norvegicus
tgcttcttagcttcccaggtgggcg

SEQ ID NO: 621999 - DNA, 25 bp, Rattus norvegicus
tcttgtctgggcgacccactgtgat

SEQ ID NO: 622000 - DNA, 25 bp, Rattus norvegicus
cactgtgatggttcgtttgatggca

SEQ ID NO: 622001 - DNA, 25 bp, Rattus norvegicus
caaacaagtcgtggtccgtgaggtc

SEQ ID NO: 622002 - DNA, 25 bp, Rattus norvegicus
acaggtgcgggcagcttctctaagt

SEQ ID NO: 622003 - DNA, 25 bp, Rattus norvegicus
gccgctcacgtctcgaggaagatga

SEQ ID NO: 622004 - DNA, 25 bp, Rattus norvegicus
cgctcacgtgaacggtgcttcttag

SEQ ID NO: 622005 - DNA, 25 bp, Rattus norvegicus
gaagtgatgtaaaaaaggcgctccg

SEQ ID NO: 622006 - DNA, 25 bp, Rattus norvegicus
gtccaggccatacgaacgccctctg

SEQ ID NO: 622007 - DNA, 25 bp, Rattus norvegicus
tactcagagactgccttgcccgctg

SEQ ID NO: 622008 - DNA, 25 bp, Rattus norvegicus
catacgggcgacactcggggacgac

SEQ ID NO: 622009 - DNA, 25 bp, Rattus norvegicus
cggggacgactagcgactcgactcc

SEQ ID NO: 622010 - DNA, 25 bp, Rattus norvegicus
cggaaccaaattgccgcggagcttg

SEQ ID NO: 622011 - DNA, 25 bp, Rattus norvegicus
ccgcggagcttgtcgggatttcaag

SEQ ID NO: 622012 - DNA, 25 bp, Rattus norvegicus
tcgggatttcaagtacccagctggg

SEQ ID NO: 622013 - DNA, 25 bp, Rattus norvegicus
tacccagctgggtttccaaagggca

SEQ ID NO: 622014 - DNA, 25 bp, Rattus norvegicus
tccgtttcccagaaatcaattcgtc

SEQ ID NO: 622015 - DNA, 25 bp, Rattus norvegicus
tcaattcgtcacatggaggtggagt

SEQ ID NO: 622016 - DNA, 25 bp, Rattus norvegicus
atgtagtccgtgtgaagccttcgtc

SEQ ID NO: 622017 - DNA, 25 bp, Rattus norvegicus
cggcggatcaggaagtgatgtaaaa

SEQ ID NO: 622018 - DNA, 25 bp, Rattus norvegicus
gaagccttcgtcacgcggggacagt

SEQ ID NO: 622019 - DNA, 25 bp, Rattus norvegicus
ctgcgcatacagcttcttgggcgtc

SEQ ID NO: 622020 - DNA, 25 bp, Rattus norvegicus
tcaaactcgtactcctgcgcataca

SEQ ID NO: 622021 - DNA, 25 bp, Rattus norvegicus
tagcaggtggaaagaggacgtcttc

SEQ ID NO: 622022 - DNA, 25 bp, Rattus norvegicus
cgtcttcagcagcttctttggcttg

SEQ ID NO: 622023 - DNA, 25 bp, Rattus norvegicus
agcttctttggcttggttgagcaga

SEQ ID NO: 622024 - DNA, 25 bp, Rattus norvegicus
gtgaggccacccttgggctcagaga

SEQ ID NO: 622025 - DNA, 25 bp, Rattus norvegicus
tcggctttgtcctcatcggcctcaa

SEQ ID NO: 622026 - DNA, 25 bp, Rattus norvegicus
ccacgacgacgagggccatcagggc

SEQ ID NO: 622027 - DNA, 25 bp, Rattus norvegicus
gttgggtgggcagaagtctatatct

SEQ ID NO: 622028 - DNA, 25 bp, Rattus norvegicus
agaagtctatatctcccagcggtga

SEQ ID NO: 622029 - DNA, 25 bp, Rattus norvegicus
cgggagcgacaactagacaccaggt

SEQ ID NO: 622030 - DNA, 25 bp, Rattus norvegicus
gcctcgggtttaggcggatatctgc

SEQ ID NO: 622031 - DNA, 25 bp, Rattus norvegicus
atatctgcgggtacgtcggctttgt

SEQ ID NO: 622032 - DNA, 25 bp, Rattus norvegicus
tagacaccaggtcgggcagacgcct

SEQ ID NO: 622033 - DNA, 25 bp, Rattus norvegicus
tcccacaatcccgtgcaaatgcaaa

SEQ ID NO: 622034 - DNA, 25 bp, Rattus norvegicus
ccatctttatgctggattacgaacc

SEQ ID NO: 622035 - DNA, 25 bp, Rattus norvegicus
tacgaaccgcccatgtgcacgagtg

SEQ ID NO: 622036 - DNA, 25 bp, Rattus norvegicus
tgcacgagtggggaaatacaccaag

SEQ ID NO: 622037 - DNA, 25 bp, Rattus norvegicus
aagggcctggttccctgagtgtacg

SEQ ID NO: 622038 - DNA, 25 bp, Rattus norvegicus
gggcagctcagatcaactccattta

SEQ ID NO: 622039 - DNA, 25 bp, Rattus norvegicus
ccgcgcgtaaatgcgcccagtaagg

SEQ ID NO: 622040 - DNA, 25 bp, Rattus norvegicus
cgctggggtagttcctgtccatgaa

SEQ ID NO: 622041 - DNA, 25 bp, Rattus norvegicus
ggcacagcaccggtacccagatatt

SEQ ID NO: 622042 - DNA, 25 bp, Rattus norvegicus
ccatctttgcacaaggcggctgggg

SEQ ID NO: 622043 - DNA, 25 bp, Rattus norvegicus
gcgttcacggtgcagccatctttgc

SEQ ID NO: 622044 - DNA, 25 bp, Rattus norvegicus
ctgtccatgaattggccgcggtgga

SEQ ID NO: 622045 - DNA, 25 bp, Rattus norvegicus
ttacccgggtgcaacacaagcgttg

SEQ ID NO: 622046 - DNA, 25 bp, Rattus norvegicus
cagatattctgctccaccgcgcgta

SEQ ID NO: 622047 - DNA, 25 bp, Rattus norvegicus
ctgcccgatgtctgggaagccactg

SEQ ID NO: 622048 - DNA, 25 bp, Rattus norvegicus
aagccactgcgcatgtcggacctga

SEQ ID NO: 622049 - DNA, 25 bp, Rattus norvegicus
tcggacctgacgtcagtgcgcttca

SEQ ID NO: 622050 - DNA, 25 bp, Rattus norvegicus
cgcttcacacagctggacgactctg

SEQ ID NO: 622051 - DNA, 25 bp, Rattus norvegicus
actctgtggaccgagtggggctcat

SEQ ID NO: 622052 - DNA, 25 bp, Rattus norvegicus
tcatcacgcgcagtgagcgctacgt

SEQ ID NO: 622053 - DNA, 25 bp, Rattus norvegicus
agcgctacgtgtgcgcagtgacccg

SEQ ID NO: 622054 - DNA, 25 bp, Rattus norvegicus
tgacccgagacagcctgagcaacgc

SEQ ID NO: 622055 - DNA, 25 bp, Rattus norvegicus
tgagcaacgccacgccgtgtgcggt

SEQ ID NO: 622056 - DNA, 25 bp, Rattus norvegicus
ttgcactgtcttccactgtagcggg

SEQ ID NO: 622057 - DNA, 25 bp, Rattus norvegicus
ctggagtgtgtggagaaactgatcc

SEQ ID NO: 622058 - DNA, 25 bp, Rattus norvegicus
ctgatccggaaggacatggtggacc

SEQ ID NO: 622059 - DNA, 25 bp, Rattus norvegicus
tacgctgacggagcgggacatcatc

SEQ ID NO: 622060 - DNA, 25 bp, Rattus norvegicus
agcgggacatcatcgtgctgcagcg

SEQ ID NO: 622061 - DNA, 25 bp, Rattus norvegicus
ttcccggcagcctgagaaaaagaga

SEQ ID NO: 622062 - DNA, 25 bp, Rattus norvegicus
gcagctggtttcacgtgggatttag

SEQ ID NO: 622063 - DNA, 25 bp, Rattus norvegicus
tatttctgcggtagcgcgcttgagc

SEQ ID NO: 622064 - DNA, 25 bp, Rattus norvegicus
ccagactttcgatccgcctatcaga

SEQ ID NO: 622065 - DNA, 25 bp, Rattus norvegicus
cgcaggcatcctcgcttcagctaat

SEQ ID NO: 622066 - DNA, 25 bp, Rattus norvegicus
taagctccacactgaagcgccgggg

SEQ ID NO: 622067 - DNA, 25 bp, Rattus norvegicus
tgctcgaacctgaatgtccgccatc

SEQ ID NO: 622068 - DNA, 25 bp, Rattus norvegicus
ccttattcactacgcgaggtccgga

SEQ ID NO: 622069 - DNA, 25 bp, Rattus norvegicus
tagtactgtccgtacgccgccatga

SEQ ID NO: 622070 - DNA, 25 bp, Rattus norvegicus
ctcgcgagatctcaggagtccattg

SEQ ID NO: 622071 - DNA, 25 bp, Rattus norvegicus
agtccattgttgagcgttctgtctg

SEQ ID NO: 622072 - DNA, 25 bp, Rattus norvegicus
gcatcatgtggtatcgcgagccata

SEQ ID NO: 622073 - DNA, 25 bp, Rattus norvegicus
ccggcaagaacacgcgattctagta

SEQ ID NO: 622074 - DNA, 25 bp, Rattus norvegicus
ccatagggcggagtagtttcttctg

SEQ ID NO: 622075 - DNA, 25 bp, Rattus norvegicus
gcctcggctccgcagaaccgtaggt

SEQ ID NO: 622076 - DNA, 25 bp, Rattus norvegicus
gtgccactgcacacccctaagttgg

SEQ ID NO: 622077 - DNA, 25 bp, Rattus norvegicus
gggcaccgaagtccctgcaggtgga

SEQ ID NO: 622078 - DNA, 25 bp, Rattus norvegicus
tcccacctctgcctgcccaagtccc

SEQ ID NO: 622079 - DNA, 25 bp, Rattus norvegicus
tcgggtggcggtcagcgccacacac

SEQ ID NO: 622080 - DNA, 25 bp, Rattus norvegicus
gccacacaccgaacccactcagctt

SEQ ID NO: 622081 - DNA, 25 bp, Rattus norvegicus
tcagcttcagtttgaccccaccggg

SEQ ID NO: 622082 - DNA, 25 bp, Rattus norvegicus
tcgccacggccgtttcctgactacc

SEQ ID NO: 622083 - DNA, 25 bp, Rattus norvegicus
ggagtcggaccgacgcttacctggc

SEQ ID NO: 622084 - DNA, 25 bp, Rattus norvegicus
ctggaccggccaagcgcccgggact

SEQ ID NO: 622085 - DNA, 25 bp, Rattus norvegicus
gtcagccgctacaaacattcgcacg

SEQ ID NO: 622086 - DNA, 25 bp, Rattus norvegicus
tccgcagaaccgtaggtgccgggcc

SEQ ID NO: 622087 - DNA, 25 bp, Rattus norvegicus
ggtccgcgcgagcagctcgctccca

SEQ ID NO: 622088 - DNA, 25 bp, Rattus norvegicus
gtcggaccgacgcttacctggcggc

SEQ ID NO: 622089 - DNA, 25 bp, Rattus norvegicus
tcaaaacgtttgcttaagtcccatc

SEQ ID NO: 622090 - DNA, 25 bp, Rattus norvegicus
tgtccgtgatgtggagcgccattac

SEQ ID NO: 622091 - DNA, 25 bp, Rattus norvegicus
cacgtctcggttcaggtgtccgtga

SEQ ID NO: 622092 - DNA, 25 bp, Rattus norvegicus
ccatattttggagggattgcacgtc

SEQ ID NO: 622093 - DNA, 25 bp, Rattus norvegicus
gcgtctttagccgtacaaggccatc

SEQ ID NO: 622094 - DNA, 25 bp, Rattus norvegicus
cacgtggttctcgaggcgtctttag

SEQ ID NO: 622095 - DNA, 25 bp, Rattus norvegicus
ggcgggccactttcatattgtccaa

SEQ ID NO: 622096 - DNA, 25 bp, Rattus norvegicus
cagatggctcgaactgaagggtttc

SEQ ID NO: 622097 - DNA, 25 bp, Rattus norvegicus
agggtttcttatcccttgctgcagg

SEQ ID NO: 622098 - DNA, 25 bp, Rattus norvegicus
taagtcccatcgcacaagcagagtg

SEQ ID NO: 622099 - DNA, 25 bp, Rattus norvegicus
gcggctggttatgcccacgttacac

SEQ ID NO: 622100 - DNA, 25 bp, Rattus norvegicus
ccatacctaaagactgccgcggctg

SEQ ID NO: 622101 - DNA, 25 bp, Rattus norvegicus
aacgctaggctttcatcgtcccata

SEQ ID NO: 622102 - DNA, 25 bp, Rattus norvegicus
ccgcctaggaaaggaagaggtcttg

SEQ ID NO: 622103 - DNA, 25 bp, Rattus norvegicus
aagctttggggtagacagtgccagg

SEQ ID NO: 622104 - DNA, 25 bp, Rattus norvegicus
acctagtggtaacaagtggcgcggc

SEQ ID NO: 622105 - DNA, 25 bp, Rattus norvegicus
tgggacgcgccacctagtggtaaca

SEQ ID NO: 622106 - DNA, 25 bp, Rattus norvegicus
ccgcccttgatgtgggtgcgtttcc

SEQ ID NO: 622107 - DNA, 25 bp, Rattus norvegicus
gacagccaaagaccgaaagtgaaag

SEQ ID NO: 622108 - DNA, 25 bp, Rattus norvegicus
ggatgacagccaaagaccgaaagtg

SEQ ID NO: 622109 - DNA, 25 bp, Rattus norvegicus
tggaaagaccgaactggatgacagc

SEQ ID NO: 622110 - DNA, 25 bp, Rattus norvegicus
ccagctgggtgtggaaagaccgaac

SEQ ID NO: 622111 - DNA, 25 bp, Rattus norvegicus
cctctgccccggagtggggaccttg

SEQ ID NO: 622112 - DNA, 25 bp, Rattus norvegicus
cagtgacggtgaaaagtcatctccc

SEQ ID NO: 622113 - DNA, 25 bp, Rattus norvegicus
gcctcagtgacggtgaaaagtcatc

SEQ ID NO: 622114 - DNA, 25 bp, Rattus norvegicus
gcatgagcctcagtgacggtgaaaa

SEQ ID NO: 622115 - DNA, 25 bp, Rattus norvegicus
aggcttcctgcatgagcctcagtga

SEQ ID NO: 622116 - DNA, 25 bp, Rattus norvegicus
acgcgccacctagtggtaacaagtg

SEQ ID NO: 622117 - DNA, 25 bp, Rattus norvegicus
agggcaagccctcaccagtgcgcat

SEQ ID NO: 622118 - DNA, 25 bp, Rattus norvegicus
ccgcctactttagagtcacaggatg

SEQ ID NO: 622119 - DNA, 25 bp, Rattus norvegicus
cgaactataggatgtgacccgccta

SEQ ID NO: 622120 - DNA, 25 bp, Rattus norvegicus
tgacgggagcccgtgcgcctaaagc

SEQ ID NO: 622121 - DNA, 25 bp, Rattus norvegicus
atttagggactaggcagccgccaca

SEQ ID NO: 622122 - DNA, 25 bp, Rattus norvegicus
ggtccgtactccagcgtcgtgaaaa

SEQ ID NO: 622123 - DNA, 25 bp, Rattus norvegicus
atctcacgggtagagggctgtatac

SEQ ID NO: 622124 - DNA, 25 bp, Rattus norvegicus
gctgtatacgcgtagccgccatctc

SEQ ID NO: 622125 - DNA, 25 bp, Rattus norvegicus
gccgaacgccttccgcgaaggactg

SEQ ID NO: 622126 - DNA, 25 bp, Rattus norvegicus
ccgcgaaggactgctgaacgttcta

SEQ ID NO: 622127 - DNA, 25 bp, Rattus norvegicus
tctacctagaggaacttggaggtcc

SEQ ID NO: 622128 - DNA, 25 bp, Rattus norvegicus
actccaatcattggggcggggtcaa

SEQ ID NO: 622129 - DNA, 25 bp, Rattus norvegicus
cagtagggctaagcagcgaactata

SEQ ID NO: 622130 - DNA, 25 bp, Rattus norvegicus
agcggcccagaggatttagggacta

SEQ ID NO: 622131 - DNA, 25 bp, Rattus norvegicus
cagccagtctcagcgaatgggcggt

SEQ ID NO: 622132 - DNA, 25 bp, Rattus norvegicus
ggttctggagtgtcccttccgcgcc

SEQ ID NO: 622133 - DNA, 25 bp, Rattus norvegicus
cgcgcttgggtgctcgttcccgagt

SEQ ID NO: 622134 - DNA, 25 bp, Rattus norvegicus
tgggtgctcgttcccgagtccgcct

SEQ ID NO: 622135 - DNA, 25 bp, Rattus norvegicus
accaccggcgagcagtggttctgga

SEQ ID NO: 622136 - DNA, 25 bp, Rattus norvegicus
gagcagtggttctggagtgtccctt

SEQ ID NO: 622137 - DNA, 25 bp, Rattus norvegicus
gcctctgcagtctcctcttaccctg

SEQ ID NO: 622138 - DNA, 25 bp, Rattus norvegicus
ctcttaccctgacctcgttggcttc

SEQ ID NO: 622139 - DNA, 25 bp, Rattus norvegicus
tcgttggcttcctctgtcacctcca

SEQ ID NO: 622140 - DNA, 25 bp, Rattus norvegicus
cctgcgcagccagtctcagcgaatg

SEQ ID NO: 622141 - DNA, 25 bp, Rattus norvegicus
cgaggctccattgccgcgcgcttgg

SEQ ID NO: 622142 - DNA, 25 bp, Rattus norvegicus
ggcgcaagcactcccaatgcgcatg

SEQ ID NO: 622143 - DNA, 25 bp, Rattus norvegicus
catgcgcagggccaaagccccagga

SEQ ID NO: 622144 - DNA, 25 bp, Rattus norvegicus
agctgctgtcaccgagggcccacgg

SEQ ID NO: 622145 - DNA, 25 bp, Rattus norvegicus
gcggctcagcctgctgccctcctcc

SEQ ID NO: 622146 - DNA, 25 bp, Rattus norvegicus
ttcttccgttctccgtcgccatggt

SEQ ID NO: 622147 - DNA, 25 bp, Rattus norvegicus
ttccgttctccgtcgccatggtgat

SEQ ID NO: 622148 - DNA, 25 bp, Rattus norvegicus
ttctccgtcgccatggtgatggtgc

SEQ ID NO: 622149 - DNA, 25 bp, Rattus norvegicus
accatctgctcctccctcacacctg

SEQ ID NO: 622150 - DNA, 25 bp, Rattus norvegicus
tccctcacacctggccgcgagccgc

SEQ ID NO: 622151 - DNA, 25 bp, Rattus norvegicus
gcgagccgcggacgcctcctccgca

SEQ ID NO: 622152 - DNA, 25 bp, Rattus norvegicus
cagtcccgggctccacggccaccag

SEQ ID NO: 622153 - DNA, 25 bp, Rattus norvegicus
tccccggggacgtgtcaatcagaga

SEQ ID NO: 622154 - DNA, 25 bp, Rattus norvegicus
tcaatcagagacagaactgagaccc

SEQ ID NO: 622155 - DNA, 25 bp, Rattus norvegicus
cagagacagaactgagaccctcagc

SEQ ID NO: 622156 - DNA, 25 bp, Rattus norvegicus
acagaactgagaccctcagcgaccg

SEQ ID NO: 622157 - DNA, 25 bp, Rattus norvegicus
accgcccgccgctcgatcgacttcg

SEQ ID NO: 622158 - DNA, 25 bp, Rattus norvegicus
acgcctcctccgcacgcagtcccgg

SEQ ID NO: 622159 - DNA, 25 bp, Rattus norvegicus
tctgcagctcggtcgtcagacgaag

SEQ ID NO: 622160 - DNA, 25 bp, Rattus norvegicus
tgcagctcggtcgtcagacgaagtt

SEQ ID NO: 622161 - DNA, 25 bp, Rattus norvegicus
cagctcggtcgtcagacgaagttgg

SEQ ID NO: 622162 - DNA, 25 bp, Rattus norvegicus
agcgcggccggcgacagggcttcaa

SEQ ID NO: 622163 - DNA, 25 bp, Rattus norvegicus
acagggcttcaaggcgctgcggccc

SEQ ID NO: 622164 - DNA, 25 bp, Rattus norvegicus
cttcaaggcgctgcggcccgcgagg

SEQ ID NO: 622165 - DNA, 25 bp, Rattus norvegicus
gatgtgcgagggcacccacgcatcg

SEQ ID NO: 622166 - DNA, 25 bp, Rattus norvegicus
atgtgcgagggcacccacgcatcgg

SEQ ID NO: 622167 - DNA, 25 bp, Rattus norvegicus
gcacccacgcatcgggggcgtagaa

SEQ ID NO: 622168 - DNA, 25 bp, Rattus norvegicus
cgtagaagtagagatccaacgggtc

SEQ ID NO: 622169 - DNA, 25 bp, Rattus norvegicus
agaagtagagatccaacgggtcctt

SEQ ID NO: 622170 - DNA, 25 bp, Rattus norvegicus
aagtagagatccaacgggtccttcg

SEQ ID NO: 622171 - DNA, 25 bp, Rattus norvegicus
tggctgctgcgtggcgatgtgcgag

SEQ ID NO: 622172 - DNA, 25 bp, Rattus norvegicus
cgggtctgcagctcggtcgtcagac

SEQ ID NO: 622173 - DNA, 25 bp, Rattus norvegicus
cctaatgagcgtggggtggagtgac

SEQ ID NO: 622174 - DNA, 25 bp, Rattus norvegicus
cgagcccactgcacggtaggggggc

SEQ ID NO: 622175 - DNA, 25 bp, Rattus norvegicus
gcgtgagcatagctgcccgagccca

SEQ ID NO: 622176 - DNA, 25 bp, Rattus norvegicus
ccagcccagcctgcgtcactgccgc

SEQ ID NO: 622177 - DNA, 25 bp, Rattus norvegicus
cggctcctaatgagcgtggggtgga

SEQ ID NO: 622178 - DNA, 25 bp, Rattus norvegicus
ccgctggcggctcctaatgagcgtg

SEQ ID NO: 622179 - DNA, 25 bp, Rattus norvegicus
accgctggcggctcctaatgagcgt

SEQ ID NO: 622180 - DNA, 25 bp, Rattus norvegicus
taccgctggcggctcctaatgagcg

SEQ ID NO: 622181 - DNA, 25 bp, Rattus norvegicus
ctcattaccgctggcggctcctaat

SEQ ID NO: 622182 - DNA, 25 bp, Rattus norvegicus
tctcattaccgctggcggctcctaa

SEQ ID NO: 622183 - DNA, 25 bp, Rattus norvegicus
ttctcattaccgctggcggctccta

SEQ ID NO: 622184 - DNA, 25 bp, Rattus norvegicus
ggcttctcattaccgctggcggctc

SEQ ID NO: 622185 - DNA, 25 bp, Rattus norvegicus
aggcttctcattaccgctggcggct

SEQ ID NO: 622186 - DNA, 25 bp, Rattus norvegicus
ccgcgggggctgtgagggtatataa

SEQ ID NO: 622187 - DNA, 25 bp, Rattus norvegicus
ggactcttacatgcagaagctgttg

SEQ ID NO: 622188 - DNA, 25 bp, Rattus norvegicus
gtctcactgcaacccggaccctccg

SEQ ID NO: 622189 - DNA, 25 bp, Rattus norvegicus
tccttgctacgcctctctcttgtgg

SEQ ID NO: 622190 - DNA, 25 bp, Rattus norvegicus
ctgcgactgcgcctccttgctacgc

SEQ ID NO: 622191 - DNA, 25 bp, Rattus norvegicus
aagagcctgtcacactgcgactgcg

SEQ ID NO: 622192 - DNA, 25 bp, Rattus norvegicus
gcctaataaagagcctgtcacactg

SEQ ID NO: 622193 - DNA, 25 bp, Rattus norvegicus
ccctgagcctaataaagagcctgtc

SEQ ID NO: 622194 - DNA, 25 bp, Rattus norvegicus
cgcgccctgagcctaataaagagcc

SEQ ID NO: 622195 - DNA, 25 bp, Rattus norvegicus
ggacgcgccctgagcctaataaaga

SEQ ID NO: 622196 - DNA, 25 bp, Rattus norvegicus
gctgttgctactggacgcgccctga

SEQ ID NO: 622197 - DNA, 25 bp, Rattus norvegicus
gctacgcctctctcttgtgggtgtg

SEQ ID NO: 622198 - DNA, 25 bp, Rattus norvegicus
ctcttacatgcagaagctgttgcta

SEQ ID NO: 622199 - DNA, 25 bp, Rattus norvegicus
tggctggactcttacatgcagaagc

SEQ ID NO: 622200 - DNA, 25 bp, Rattus norvegicus
tacatgcagaagctgttgctactgg

SEQ ID NO: 622201 - DNA, 25 bp, Rattus norvegicus
gagaccgccctccaaaatttgcatt

SEQ ID NO: 622202 - DNA, 25 bp, Rattus norvegicus
aatttgcattttctggaggcggacc

SEQ ID NO: 622203 - DNA, 25 bp, Rattus norvegicus
tttgcattttctggaggcggaccga

SEQ ID NO: 622204 - DNA, 25 bp, Rattus norvegicus
gcattttctggaggcggaccgagtc

SEQ ID NO: 622205 - DNA, 25 bp, Rattus norvegicus
tcattggtttttatgttgtgagggc

SEQ ID NO: 622206 - DNA, 25 bp, Rattus norvegicus
agggcggagatgcctcctgctgctc

SEQ ID NO: 622207 - DNA, 25 bp, Rattus norvegicus
tgctctccctcggtctaccgcgcag

SEQ ID NO: 622208 - DNA, 25 bp, Rattus norvegicus
cggagaccgccctccaaaatttgca

SEQ ID NO: 622209 - DNA, 25 bp, Rattus norvegicus
cagaagcggttaccaggcggcgctc

SEQ ID NO: 622210 - DNA, 25 bp, Rattus norvegicus
taccgcgcagaagcggttaccaggc

SEQ ID NO: 622211 - DNA, 25 bp, Rattus norvegicus
taccaggcggcgctcgctggaatcc

SEQ ID NO: 622212 - DNA, 25 bp, Rattus norvegicus
cgctcgctggaatccggggtttcgc

SEQ ID NO: 622213 - DNA, 25 bp, Rattus norvegicus
cggtctaccgcgcagaagcggttac

SEQ ID NO: 622214 - DNA, 25 bp, Rattus norvegicus
aagcggttaccaggcggcgctcgct

SEQ ID NO: 622215 - DNA, 25 bp, Rattus norvegicus
ttgagggccaccctcgacgaacggc

SEQ ID NO: 622216 - DNA, 25 bp, Rattus norvegicus
aacggcggttgcgactggcacagaa

SEQ ID NO: 622217 - DNA, 25 bp, Rattus norvegicus
gatcagagaaatgagcgcatgcgca

SEQ ID NO: 622218 - DNA, 25 bp, Rattus norvegicus
actctcgggactcagttgagggcca

SEQ ID NO: 622219 - DNA, 25 bp, Rattus norvegicus
acctggagtcgggactctcgggact

SEQ ID NO: 622220 - DNA, 25 bp, Rattus norvegicus
atagcggtgatggtgcgatattatc

SEQ ID NO: 622221 - DNA, 25 bp, Rattus norvegicus
ggcacagaagaagcgtgttcacacg

SEQ ID NO: 622222 - DNA, 25 bp, Rattus norvegicus
gcctttcccgccagaaatgcaaatg

SEQ ID NO: 622223 - DNA, 25 bp, Rattus norvegicus
gaaatgcaaatgagccagcctcctc

SEQ ID NO: 622224 - DNA, 25 bp, Rattus norvegicus
gccctctcaggctcttgaattcacg

SEQ ID NO: 622225 - DNA, 25 bp, Rattus norvegicus
tgaattcacgcaagcgcactccggg

SEQ ID NO: 622226 - DNA, 25 bp, Rattus norvegicus
gcatgcgtagaacttcccgggacga

SEQ ID NO: 622227 - DNA, 25 bp, Rattus norvegicus
cgggacgaccgcttagatcagagaa

SEQ ID NO: 622228 - DNA, 25 bp, Rattus norvegicus
catgcgcactagtggtggtggaata

SEQ ID NO: 622229 - DNA, 25 bp, Rattus norvegicus
gggtgcttgtcctgccctagcagga

SEQ ID NO: 622230 - DNA, 25 bp, Rattus norvegicus
acactagtcggctgcttcctgtgca

SEQ ID NO: 622231 - DNA, 25 bp, Rattus norvegicus
tcgtatgacagacggaaggacacta

SEQ ID NO: 622232 - DNA, 25 bp, Rattus norvegicus
tgctcaacaagaccatgcgtattcg

SEQ ID NO: 622233 - DNA, 25 bp, Rattus norvegicus
cctagcaggactctgatggggaaca

SEQ ID NO: 622234 - DNA, 25 bp, Rattus norvegicus
actgtagttctacgggcgtgctgcc

SEQ ID NO: 622235 - DNA, 25 bp, Rattus norvegicus
actacgagaggagaatggctgttgc

SEQ ID NO: 622236 - DNA, 25 bp, Rattus norvegicus
ctgggccgaccatgctactacgaga

SEQ ID NO: 622237 - DNA, 25 bp, Rattus norvegicus
cccaaaggaggtcccagggccaatg

SEQ ID NO: 622238 - DNA, 25 bp, Rattus norvegicus
gcactcgcgagatctgacgcgccga

SEQ ID NO: 622239 - DNA, 25 bp, Rattus norvegicus
ctcacgaaagagcttgggagcactc

SEQ ID NO: 622240 - DNA, 25 bp, Rattus norvegicus
ccggagatgaggaattgtgatctca

SEQ ID NO: 622241 - DNA, 25 bp, Rattus norvegicus
gcagttcccggcagcccatgagctt

SEQ ID NO: 622242 - DNA, 25 bp, Rattus norvegicus
cggcagcagctagaggcattgctca

SEQ ID NO: 622243 - DNA, 25 bp, Rattus norvegicus
cgggctcgtctgactctttgtctgg

SEQ ID NO: 622244 - DNA, 25 bp, Rattus norvegicus
atgtccatctgtcttgccgggctcg

SEQ ID NO: 622245 - DNA, 25 bp, Rattus norvegicus
gggcaggagattagagatgtccatc

SEQ ID NO: 622246 - DNA, 25 bp, Rattus norvegicus
cattggtcttccgaggattggggac

SEQ ID NO: 622247 - DNA, 25 bp, Rattus norvegicus
cctcggaccttcgtgcattggtctt

SEQ ID NO: 622248 - DNA, 25 bp, Rattus norvegicus
caagtgtccgccctgtgggcatgtg

SEQ ID NO: 622249 - DNA, 25 bp, Rattus norvegicus
cctgggccatccttcctgcaagtgt

SEQ ID NO: 622250 - DNA, 25 bp, Rattus norvegicus
gatcttctgttagttcgagcgcgcc

SEQ ID NO: 622251 - DNA, 25 bp, Rattus norvegicus
aatcgggatcctgcttggggtttgt

SEQ ID NO: 622252 - DNA, 25 bp, Rattus norvegicus
taaccgaagtgtggagctggaactt

SEQ ID NO: 622253 - DNA, 25 bp, Rattus norvegicus
tgactctttgtctggccacatgggg

SEQ ID NO: 622254 - DNA, 25 bp, Rattus norvegicus
gaaatgcactccgtcctttttctgc

SEQ ID NO: 622255 - DNA, 25 bp, Rattus norvegicus
cctgagatcgcgtgggaaatgcact

SEQ ID NO: 622256 - DNA, 25 bp, Rattus norvegicus
ggcagccgcggatcttctgttagtt

SEQ ID NO: 622257 - DNA, 25 bp, Rattus norvegicus
ctccgcccagcggttcgcgcgctga

SEQ ID NO: 622258 - DNA, 25 bp, Rattus norvegicus
tgcgggccgggttgtctaggtctcc

SEQ ID NO: 622259 - DNA, 25 bp, Rattus norvegicus
gtacggaccactgcgtccgcccggc

SEQ ID NO: 622260 - DNA, 25 bp, Rattus norvegicus
agccctgcccacttggaagctggtc

SEQ ID NO: 622261 - DNA, 25 bp, Rattus norvegicus
gcccacttggaagctggtcctcggt

SEQ ID NO: 622262 - DNA, 25 bp, Rattus norvegicus
gaggctgctgttcccttccgggcct

SEQ ID NO: 622263 - DNA, 25 bp, Rattus norvegicus
agagagggaatagccgcttcccgcg

SEQ ID NO: 622264 - DNA, 25 bp, Rattus norvegicus
gacgacgtgggactctccgcccagc

SEQ ID NO: 622265 - DNA, 25 bp, Rattus norvegicus
aggccgcgacgacgtgggactctcc

SEQ ID NO: 622266 - DNA, 25 bp, Rattus norvegicus
cttcccgcgcggcttctcggaccac

SEQ ID NO: 622267 - DNA, 25 bp, Rattus norvegicus
ggacagagagggaatagccgcttcc

SEQ ID NO: 622268 - DNA, 25 bp, Rattus norvegicus
tcacgggtcagctcgttgggacaga

SEQ ID NO: 622269 - DNA, 25 bp, Rattus norvegicus
atgtcacgggtcagctcgttgggac

SEQ ID NO: 622270 - DNA, 25 bp, Rattus norvegicus
ttctcggaccacgaggccgcgacga

SEQ ID NO: 622271 - DNA, 25 bp, Rattus norvegicus
ccaaaccacggatcgggtcggcttg

SEQ ID NO: 622272 - DNA, 25 bp, Rattus norvegicus
tggggctccgtgtatttctctcagc

SEQ ID NO: 622273 - DNA, 25 bp, Rattus norvegicus
gcgctgtgcgatacctgctctttct

SEQ ID NO: 622274 - DNA, 25 bp, Rattus norvegicus
ctcggtctgggaactcctggttcag

SEQ ID NO: 622275 - DNA, 25 bp, Rattus norvegicus
gggacacattgggaactcctccctc

SEQ ID NO: 622276 - DNA, 25 bp, Rattus norvegicus
agacccacgggattcgaagacagcc

SEQ ID NO: 622277 - DNA, 25 bp, Rattus norvegicus
tctgagaaccggaacaagaagggca

SEQ ID NO: 622278 - DNA, 25 bp, Rattus norvegicus
tcttagggatccaactctgagaacc

SEQ ID NO: 622279 - DNA, 25 bp, Rattus norvegicus
gaacgtcgtgcacaccttcttcctg

SEQ ID NO: 622280 - DNA, 25 bp, Rattus norvegicus
ggaggtccactatgaacgtcgtgca

SEQ ID NO: 622281 - DNA, 25 bp, Rattus norvegicus
cccgcatcatcgtggaggtccacta

SEQ ID NO: 622282 - DNA, 25 bp, Rattus norvegicus
ctgccaggtcagcagccgcgaactg

SEQ ID NO: 622283 - DNA, 25 bp, Rattus norvegicus
agggcccgcgaacctaagctgccag

SEQ ID NO: 622284 - DNA, 25 bp, Rattus norvegicus
cagggacagactctgctgccaaacc

SEQ ID NO: 622285 - DNA, 25 bp, Rattus norvegicus
cagggcgcctggctcccattcgaaa

SEQ ID NO: 622286 - DNA, 25 bp, Rattus norvegicus
agggtcagggaaccccgcttgcaga

SEQ ID NO: 622287 - DNA, 25 bp, Rattus norvegicus
accccgaggactggcgacaagacgc

SEQ ID NO: 622288 - DNA, 25 bp, Rattus norvegicus
gggcgcctggctcccattcgaaacg

SEQ ID NO: 622289 - DNA, 25 bp, Rattus norvegicus
ttccacaggtgcagggcgcctggct

SEQ ID NO: 622290 - DNA, 25 bp, Rattus norvegicus
cctttccacaggtgcagggcgcctg

SEQ ID NO: 622291 - DNA, 25 bp, Rattus norvegicus
aatagaaaggggaggggtggcatct

SEQ ID NO: 622292 - DNA, 25 bp, Rattus norvegicus
ccgcgactgggcaatagaaagggga

SEQ ID NO: 622293 - DNA, 25 bp, Rattus norvegicus
ttgggccccgcgactgggcaataga

SEQ ID NO: 622294 - DNA, 25 bp, Rattus norvegicus
ctagcggacggaaaaggaagacttg

SEQ ID NO: 622295 - DNA, 25 bp, Rattus norvegicus
cgaggcttgtagcagcgagtctccc

SEQ ID NO: 622296 - DNA, 25 bp, Rattus norvegicus
gagaacacgagacagggaggagggt

SEQ ID NO: 622297 - DNA, 25 bp, Rattus norvegicus
gggaggcctcggagaacacgagaca

SEQ ID NO: 622298 - DNA, 25 bp, Rattus norvegicus
ccgcttgcagatgaccccgaggact

SEQ ID NO: 622299 - DNA, 25 bp, Rattus norvegicus
ttcagtttagcttctctgcagcggc

SEQ ID NO: 622300 - DNA, 25 bp, Rattus norvegicus
actgatgtctcagggcgcgccacag

SEQ ID NO: 622301 - DNA, 25 bp, Rattus norvegicus
gcactgatgtctcagggcgcgccac

SEQ ID NO: 622302 - DNA, 25 bp, Rattus norvegicus
tgctgtgcagggcactgatgtctca

SEQ ID NO: 622303 - DNA, 25 bp, Rattus norvegicus
cttgagagttgctgtgcagggcact

SEQ ID NO: 622304 - DNA, 25 bp, Rattus norvegicus
cgcagcgcttgagagttgctgtgca

SEQ ID NO: 622305 - DNA, 25 bp, Rattus norvegicus
aatgctggcttggagggcgcagcgc

SEQ ID NO: 622306 - DNA, 25 bp, Rattus norvegicus
ggtgcctctggcaccacggtcaccc

SEQ ID NO: 622307 - DNA, 25 bp, Rattus norvegicus
ccagacggcccgcttcagtttagct

SEQ ID NO: 622308 - DNA, 25 bp, Rattus norvegicus
gtgtcccacgaacacccagacggcc

SEQ ID NO: 622309 - DNA, 25 bp, Rattus norvegicus
accaactgcccgtgtcccacgaaca

SEQ ID NO: 622310 - DNA, 25 bp, Rattus norvegicus
ccctggactgaaccaactgcccgtg

SEQ ID NO: 622311 - DNA, 25 bp, Rattus norvegicus
agtttagcttctctgcagcggccgg

SEQ ID NO: 622312 - DNA, 25 bp, Rattus norvegicus
agcttctctgcagcggccgggtgcc

SEQ ID NO: 622313 - DNA, 25 bp, Rattus norvegicus
gctgccgctccagtgcctcctccag

SEQ ID NO: 622314 - DNA, 25 bp, Rattus norvegicus
tcgcggtgagcagtgcccagctcct

SEQ ID NO: 622315 - DNA, 25 bp, Rattus norvegicus
tcacctccttgaggtcgcgctgcag

SEQ ID NO: 622316 - DNA, 25 bp, Rattus norvegicus
cctccttgaggtcgcgctgcagctt

SEQ ID NO: 622317 - DNA, 25 bp, Rattus norvegicus
cttggagttagcttcctccgcctta

SEQ ID NO: 622318 - DNA, 25 bp, Rattus norvegicus
tggagttagcttcctccgccttacc

SEQ ID NO: 622319 - DNA, 25 bp, Rattus norvegicus
ccttacccagctcgcggtgagcagt

SEQ ID NO: 622320 - DNA, 25 bp, Rattus norvegicus
tccagctggctcatctgacggcaca

SEQ ID NO: 622321 - DNA, 25 bp, Rattus norvegicus
gacggcacagcaccgccaggcgctc

SEQ ID NO: 622322 - DNA, 25 bp, Rattus norvegicus
tggcacacctctgcacgctgccgct

SEQ ID NO: 622323 - DNA, 25 bp, Rattus norvegicus
cagctctgccgtgcgccggctggat

SEQ ID NO: 622324 - DNA, 25 bp, Rattus norvegicus
cgtgcgccggctggattctccaacg

SEQ ID NO: 622325 - DNA, 25 bp, Rattus norvegicus
ccaggcgctccctcagctggcacac

SEQ ID NO: 622326 - DNA, 25 bp, Rattus norvegicus
tggctcatctgacggcacagcaccg

SEQ ID NO: 622327 - DNA, 25 bp, Rattus norvegicus
gtaggcatcacctcgcacatcatgg

SEQ ID NO: 622328 - DNA, 25 bp, Rattus norvegicus
ctcgcacatcatggcggcggtgccg

SEQ ID NO: 622329 - DNA, 25 bp, Rattus norvegicus
tcctcgctgatggtaggcatcacct

SEQ ID NO: 622330 - DNA, 25 bp, Rattus norvegicus
cgccggccatcctcgctgatggtag

SEQ ID NO: 622331 - DNA, 25 bp, Rattus norvegicus
atcgtgaccatgaggcgctccagct

SEQ ID NO: 622332 - DNA, 25 bp, Rattus norvegicus
cgctccgtgagcatcgtgaccatga

SEQ ID NO: 622333 - DNA, 25 bp, Rattus norvegicus
gcagtcgtagctgcgctgtcgccaa

SEQ ID NO: 622334 - DNA, 25 bp, Rattus norvegicus
agtccttctcgtggccgagctcgcg

SEQ ID NO: 622335 - DNA, 25 bp, Rattus norvegicus
tgccgctgcagcgagtccttctcgt

SEQ ID NO: 622336 - DNA, 25 bp, Rattus norvegicus
gcagagcaatgctgagctgccgctg

SEQ ID NO: 622337 - DNA, 25 bp, Rattus norvegicus
ccgcccaacctgaggcagagcaatg

SEQ ID NO: 622338 - DNA, 25 bp, Rattus norvegicus
ttcagaacagccctcgcctttaggc

SEQ ID NO: 622339 - DNA, 25 bp, Rattus norvegicus
ggcccgcccaccgaacgcaatccaa

SEQ ID NO: 622340 - DNA, 25 bp, Rattus norvegicus
gccgagctcgcgcagtcgtagctgc

SEQ ID NO: 622341 - DNA, 25 bp, Rattus norvegicus
gcgaggctaccgagagagctgacca

SEQ ID NO: 622342 - DNA, 25 bp, Rattus norvegicus
ccggctgttccaaccagaaggtggg

SEQ ID NO: 622343 - DNA, 25 bp, Rattus norvegicus
cgccggctgttccaaccagaaggtg

SEQ ID NO: 622344 - DNA, 25 bp, Rattus norvegicus
cgtcgccggctgttccaaccagaag

SEQ ID NO: 622345 - DNA, 25 bp, Rattus norvegicus
gaacgtcgccggctgttccaaccag

SEQ ID NO: 622346 - DNA, 25 bp, Rattus norvegicus
cctggaccgaggaacgtcgccggct

SEQ ID NO: 622347 - DNA, 25 bp, Rattus norvegicus
tgtccagggcgagccggcctggacc

SEQ ID NO: 622348 - DNA, 25 bp, Rattus norvegicus
gagagctgaccatggacagctccgg

SEQ ID NO: 622349 - DNA, 25 bp, Rattus norvegicus
ccgagagagctgaccatggacagct

SEQ ID NO: 622350 - DNA, 25 bp, Rattus norvegicus
gaggctaccgagagagctgaccatg

SEQ ID NO: 622351 - DNA, 25 bp, Rattus norvegicus
caaccagaaggtgggggacgcaaat

SEQ ID NO: 622352 - DNA, 25 bp, Rattus norvegicus
gatccccaggtcaaaggcgcggtga

SEQ ID NO: 622353 - DNA, 25 bp, Rattus norvegicus
ctaccgagagagctgaccatggaca

SEQ ID NO: 622354 - DNA, 25 bp, Rattus norvegicus
gggagggattcccacaccacctgca

SEQ ID NO: 622355 - DNA, 25 bp, Rattus norvegicus
tgcgcccgtctagggaactgcatgc

SEQ ID NO: 622356 - DNA, 25 bp, Rattus norvegicus
gggctcagcgtctcttgctccggct

SEQ ID NO: 622357 - DNA, 25 bp, Rattus norvegicus
cagccttcttactccctaaaatagc

SEQ ID NO: 622358 - DNA, 25 bp, Rattus norvegicus
ccgcaatcgccagatccaggggtgc

SEQ ID NO: 622359 - DNA, 25 bp, Rattus norvegicus
ttaacagaagactgacggacggcgc

SEQ ID NO: 622360 - DNA, 25 bp, Rattus norvegicus
gacggcgctgaatggccaatgagaa

SEQ ID NO: 622361 - DNA, 25 bp, Rattus norvegicus
aatgagaattgtcgtccgtgccggc

SEQ ID NO: 622362 - DNA, 25 bp, Rattus norvegicus
actcgtggtgcagcgaccaataggc

SEQ ID NO: 622363 - DNA, 25 bp, Rattus norvegicus
accaataggcatgcagcgtgcggcg

SEQ ID NO: 622364 - DNA, 25 bp, Rattus norvegicus
gagtccggcagaggatgatgtcacc

SEQ ID NO: 622365 - DNA, 25 bp, Rattus norvegicus
cctgaatctagtagcgcgcagcgtg

SEQ ID NO: 622366 - DNA, 25 bp, Rattus norvegicus
tggcgagtgcgtgttactctgcacc

SEQ ID NO: 622367 - DNA, 25 bp, Rattus norvegicus
caatgatcaggcttctgctgcgttt

SEQ ID NO: 622368 - DNA, 25 bp, Rattus norvegicus
cggcgggatgggaattcaacattca

SEQ ID NO: 622369 - DNA, 25 bp, Rattus norvegicus
ccgaggtcattctggaagcgatcca

SEQ ID NO: 622370 - DNA, 25 bp, Rattus norvegicus
gccgcggagtgcaaggaaactacaa

SEQ ID NO: 622371 - DNA, 25 bp, Rattus norvegicus
tacaacttatacagtaccgaggtgc

SEQ ID NO: 622372 - DNA, 25 bp, Rattus norvegicus
tatacagtaccgaggtgctcacctc

SEQ ID NO: 622373 - DNA, 25 bp, Rattus norvegicus
tcacctcgcggatggcggagcagaa

SEQ ID NO: 622374 - DNA, 25 bp, Rattus norvegicus
cagaagcggctctgcaggacccgct

SEQ ID NO: 622375 - DNA, 25 bp, Rattus norvegicus
cgggacacgtctgcagaaagcggca

SEQ ID NO: 622376 - DNA, 25 bp, Rattus norvegicus
agggaccgcgagaacacacgccagc

SEQ ID NO: 622377 - DNA, 25 bp, Rattus norvegicus
gcaagaagggcaaccgaggtcattc

SEQ ID NO: 622378 - DNA, 25 bp, Rattus norvegicus
ctcgcatctgcaaggcctgtcgcgg

SEQ ID NO: 622379 - DNA, 25 bp, Rattus norvegicus
ctgtcgcggcccaatggagcccaga

SEQ ID NO: 622380 - DNA, 25 bp, Rattus norvegicus
ggactggaccctcggagcgcttacc

SEQ ID NO: 622381 - DNA, 25 bp, Rattus norvegicus
gcgcagccatatctcctctaatgca

SEQ ID NO: 622382 - DNA, 25 bp, Rattus norvegicus
gaacacacgccagcagcaagaaggg

SEQ ID NO: 622383 - DNA, 25 bp, Rattus norvegicus
tcgcagtgcaccaggtacgtgtttc

SEQ ID NO: 622384 - DNA, 25 bp, Rattus norvegicus
ctaggtccagcccaggcgtgtgctg

SEQ ID NO: 622385 - DNA, 25 bp, Rattus norvegicus
tgtgaaggcatcataggcctgtgcc

SEQ ID NO: 622386 - DNA, 25 bp, Rattus norvegicus
ctcaccagtgtgaaggcatcatagg

SEQ ID NO: 622387 - DNA, 25 bp, Rattus norvegicus
tcccggcgctctcaccagtgtgaag

SEQ ID NO: 622388 - DNA, 25 bp, Rattus norvegicus
gtccggcctcatcgcgacgtgctgg

SEQ ID NO: 622389 - DNA, 25 bp, Rattus norvegicus
tgtgccagctcctctgtgcggtact

SEQ ID NO: 622390 - DNA, 25 bp, Rattus norvegicus
tcctctgtgcggtactgctctagca

SEQ ID NO: 622391 - DNA, 25 bp, Rattus norvegicus
gtgcggtactgctctagcaccacca

SEQ ID NO: 622392 - DNA, 25 bp, Rattus norvegicus
agccctcgcagtgcaccaggtacgt

SEQ ID NO: 622393 - DNA, 25 bp, Rattus norvegicus
ccagaggcgggacctaggtccagcc

SEQ ID NO: 622394 - DNA, 25 bp, Rattus norvegicus
tcataggcctgtgccagctcctctg

SEQ ID NO: 622395 - DNA, 25 bp, Rattus norvegicus
caccacgccctgtaggcccgcactg

SEQ ID NO: 622396 - DNA, 25 bp, Rattus norvegicus
ctcatcgcgacgtgctggcaggagc

SEQ ID NO: 622397 - DNA, 25 bp, Rattus norvegicus
aggcccatcatcaggagctccatca

SEQ ID NO: 622398 - DNA, 25 bp, Rattus norvegicus
tgtgctctctatcccggtcacggtc

SEQ ID NO: 622399 - DNA, 25 bp, Rattus norvegicus
acggcgttccctctcacttcggtga

SEQ ID NO: 622400 - DNA, 25 bp, Rattus norvegicus
tcacttcggtgacttcgacgcctct

SEQ ID NO: 622401 - DNA, 25 bp, Rattus norvegicus
gctcatccttgtctcgactccgaga

SEQ ID NO: 622402 - DNA, 25 bp, Rattus norvegicus
agctctccaggaggcccatcatcag

SEQ ID NO: 622403 - DNA, 25 bp, Rattus norvegicus
atcaccagcttcagagggttcagcc

SEQ ID NO: 622404 - DNA, 25 bp, Rattus norvegicus
agagggttcagccatgtcgcctcca

SEQ ID NO: 622405 - DNA, 25 bp, Rattus norvegicus
gctccgactacttcgacgctttcga

SEQ ID NO: 622406 - DNA, 25 bp, Rattus norvegicus
tcgacgctttcgatctctgtctttg

SEQ ID NO: 622407 - DNA, 25 bp, Rattus norvegicus
atctctgtctttgtccttgcttcgc

SEQ ID NO: 622408 - DNA, 25 bp, Rattus norvegicus
tcagggccttcagggccaagctctc

SEQ ID NO: 622409 - DNA, 25 bp, Rattus norvegicus
tccttgcttcgctctctggatcggc

SEQ ID NO: 622410 - DNA, 25 bp, Rattus norvegicus
gagagcgggagcgtctcctttctct

SEQ ID NO: 622411 - DNA, 25 bp, Rattus norvegicus
cgcatgcgttatcggacctaagtca

SEQ ID NO: 622412 - DNA, 25 bp, Rattus norvegicus
cggcccagcgaccttattacgcatg

SEQ ID NO: 622413 - DNA, 25 bp, Rattus norvegicus
ttaaatgcctaagcttccgcggccc

SEQ ID NO: 622414 - DNA, 25 bp, Rattus norvegicus
tgcgcacgcgcaaaagctataggcc

SEQ ID NO: 622415 - DNA, 25 bp, Rattus norvegicus
tatgaccgcgagacacttacagatg

SEQ ID NO: 622416 - DNA, 25 bp, Rattus norvegicus
accgggagtgaatgcgactcgaatc

SEQ ID NO: 622417 - DNA, 25 bp, Rattus norvegicus
agtcagtctcaacctcgcgctctag

SEQ ID NO: 622418 - DNA, 25 bp, Rattus norvegicus
tcgcggccgccgttcacaaacaaaa

SEQ ID NO: 622419 - DNA, 25 bp, Rattus norvegicus
cgcctttctcactgcgcatgtgtta

SEQ ID NO: 622420 - DNA, 25 bp, Rattus norvegicus
ctcttctcggcctgacgttagtctc

SEQ ID NO: 622421 - DNA, 25 bp, Rattus norvegicus
ccgcgtcaggtatccactgtggtcc

SEQ ID NO: 622422 - DNA, 25 bp, Rattus norvegicus
tcgacgcatgcgtctaggtaatgca

SEQ ID NO: 622423 - DNA, 25 bp, Rattus norvegicus
cctcagctcgcgatcagaaccggga

SEQ ID NO: 622424 - DNA, 25 bp, Rattus norvegicus
tcgcgctctagctaaccgcctatga

SEQ ID NO: 622425 - DNA, 25 bp, Rattus norvegicus
cgccggtagcggctgctactggctc

SEQ ID NO: 622426 - DNA, 25 bp, Rattus norvegicus
ccctggccggactttccatgctatt

SEQ ID NO: 622427 - DNA, 25 bp, Rattus norvegicus
gcgcgccgcgagtatttcttcgacc

SEQ ID NO: 622428 - DNA, 25 bp, Rattus norvegicus
gagtatttcttcgaccgacaccggc

SEQ ID NO: 622429 - DNA, 25 bp, Rattus norvegicus
gcccagcttcgatgcggtgctctac

SEQ ID NO: 622430 - DNA, 25 bp, Rattus norvegicus
tcgatgcggtgctctactactacca

SEQ ID NO: 622431 - DNA, 25 bp, Rattus norvegicus
tactactaccagtcaggcggccggc

SEQ ID NO: 622432 - DNA, 25 bp, Rattus norvegicus
ccctcgacgtcttcctggaggaggt

SEQ ID NO: 622433 - DNA, 25 bp, Rattus norvegicus
cgtcatcctggtctccatcgtggtc

SEQ ID NO: 622434 - DNA, 25 bp, Rattus norvegicus
tccatcgtggtcttttgcctggaga

SEQ ID NO: 622435 - DNA, 25 bp, Rattus norvegicus
cagacttccgcgacgaccgcgatga

SEQ ID NO: 622436 - DNA, 25 bp, Rattus norvegicus
atgctatttttacgcgcggacaccg

SEQ ID NO: 622437 - DNA, 25 bp, Rattus norvegicus
cgtggtctccgtgctcgtcatcctg

SEQ ID NO: 622438 - DNA, 25 bp, Rattus norvegicus
tgcctggagacgctgccagacttcc

SEQ ID NO: 622439 - DNA, 25 bp, Rattus norvegicus
aggtaagagctccgcgcctcctctg

SEQ ID NO: 622440 - DNA, 25 bp, Rattus norvegicus
tcccaagcgcaaacggcgagcagcc

SEQ ID NO: 622441 - DNA, 25 bp, Rattus norvegicus
tcctcccagacccaggccctcccaa

SEQ ID NO: 622442 - DNA, 25 bp, Rattus norvegicus
gacccaggccctcccaagcgcaaac

SEQ ID NO: 622443 - DNA, 25 bp, Rattus norvegicus
aaacggcgagcagccggcgagcagc

SEQ ID NO: 622444 - DNA, 25 bp, Rattus norvegicus
cagcgggcgtccgagctgctagcga

SEQ ID NO: 622445 - DNA, 25 bp, Rattus norvegicus
gaagggcgccccaggtaagagctcc

SEQ ID NO: 622446 - DNA, 25 bp, Rattus norvegicus
gcctcctctggcagattcggtccag

SEQ ID NO: 622447 - DNA, 25 bp, Rattus norvegicus
tcctctggcagattcggtccaggtc

SEQ ID NO: 622448 - DNA, 25 bp, Rattus norvegicus
ctctggcagattcggtccaggtcgc

SEQ ID NO: 622449 - DNA, 25 bp, Rattus norvegicus
ctggcagattcggtccaggtcgccc

SEQ ID NO: 622450 - DNA, 25 bp, Rattus norvegicus
gcagattcggtccaggtcgcccggc

SEQ ID NO: 622451 - DNA, 25 bp, Rattus norvegicus
gcccgcgcgtgctaggcgggatccg

SEQ ID NO: 622452 - DNA, 25 bp, Rattus norvegicus
tccgagctgctagcgagccggagga

SEQ ID NO: 622453 - DNA, 25 bp, Rattus norvegicus
tctgcacgctcctcagccgaacagg

SEQ ID NO: 622454 - DNA, 25 bp, Rattus norvegicus
aacaggccgtgcctgacgtccaggc

SEQ ID NO: 622455 - DNA, 25 bp, Rattus norvegicus
agtgagacggcaccggcaagccgcc

SEQ ID NO: 622456 - DNA, 25 bp, Rattus norvegicus
ctggcgctggattcggatcgacacc

SEQ ID NO: 622457 - DNA, 25 bp, Rattus norvegicus
cgtgcctgacgtccaggcttgggaa

SEQ ID NO: 622458 - DNA, 25 bp, Rattus norvegicus
ttcggatcgacaccgcttgcgtctg

SEQ ID NO: 622459 - DNA, 25 bp, Rattus norvegicus
cgggcgttgactgcagactctcagg

SEQ ID NO: 622460 - DNA, 25 bp, Rattus norvegicus
aaacagtcctatgtgcgggcgttga

SEQ ID NO: 622461 - DNA, 25 bp, Rattus norvegicus
cggaggcactggctctcagaatgca

SEQ ID NO: 622462 - DNA, 25 bp, Rattus norvegicus
gacgcgctgcaaggccgaaagcgct

SEQ ID NO: 622463 - DNA, 25 bp, Rattus norvegicus
agtacttcttcgagacgcgctgcaa

SEQ ID NO: 622464 - DNA, 25 bp, Rattus norvegicus
ccctgcgtcagtacttcttcgagac

SEQ ID NO: 622465 - DNA, 25 bp, Rattus norvegicus
accgaccggcggacagctgtggact

SEQ ID NO: 622466 - DNA, 25 bp, Rattus norvegicus
tctcagaatgcaaggctaaacagtc

SEQ ID NO: 622467 - DNA, 25 bp, Rattus norvegicus
tgcagaaaccgtagtcccggaggga

SEQ ID NO: 622468 - DNA, 25 bp, Rattus norvegicus
atggacgctggttggcatcccacct

SEQ ID NO: 622469 - DNA, 25 bp, Rattus norvegicus
cctgcggactgcctggagtgcagta

SEQ ID NO: 622470 - DNA, 25 bp, Rattus norvegicus
acgggtacgagacctcaggacttgg

SEQ ID NO: 622471 - DNA, 25 bp, Rattus norvegicus
ctggccggccgtctgcacatggaga

SEQ ID NO: 622472 - DNA, 25 bp, Rattus norvegicus
ccaggcagaagaccagcagcgtagc

SEQ ID NO: 622473 - DNA, 25 bp, Rattus norvegicus
ggatccggcgcttgcagctgcccag

SEQ ID NO: 622474 - DNA, 25 bp, Rattus norvegicus
gcagcgtagccatgcagaaaccgta

SEQ ID NO: 622475 - DNA, 25 bp, Rattus norvegicus
tttcttacccaaatactgccgcagg

SEQ ID NO: 622476 - DNA, 25 bp, Rattus norvegicus
cccgggccaggaagaggtcacccat

SEQ ID NO: 622477 - DNA, 25 bp, Rattus norvegicus
ggcgcagtcctttcttacccaaata

SEQ ID NO: 622478 - DNA, 25 bp, Rattus norvegicus
ctgccgcaggtcgagtagaaaacga

SEQ ID NO: 622479 - DNA, 25 bp, Rattus norvegicus
ctgagctggtagaaaagggagccca

SEQ ID NO: 622480 - DNA, 25 bp, Rattus norvegicus
tggccgtgacagctttagagatttc

SEQ ID NO: 622481 - DNA, 25 bp, Rattus norvegicus
atccgactctgcattccagtccaga

SEQ ID NO: 622482 - DNA, 25 bp, Rattus norvegicus
gccgggacaagaaacctcgctgatc

SEQ ID NO: 622483 - DNA, 25 bp, Rattus norvegicus
accggcggactgcagtcaccttctg

SEQ ID NO: 622484 - DNA, 25 bp, Rattus norvegicus
gctgatccctggaaccggggaccca

SEQ ID NO: 622485 - DNA, 25 bp, Rattus norvegicus
gacaagaaacctcgctgatccctgg

SEQ ID NO: 622486 - DNA, 25 bp, Rattus norvegicus
agctgcggggatccgactctgcatt

SEQ ID NO: 622487 - DNA, 25 bp, Rattus norvegicus
atcggagccgggacaagaaacctcg

SEQ ID NO: 622488 - DNA, 25 bp, Rattus norvegicus
cagtccagaggtggaaatcggagcc

SEQ ID NO: 622489 - DNA, 25 bp, Rattus norvegicus
tctgcattccagtccagaggtggaa

SEQ ID NO: 622490 - DNA, 25 bp, Rattus norvegicus
cggggatccgactctgcattccagt

SEQ ID NO: 622491 - DNA, 25 bp, Rattus norvegicus
ctctcctggtcctccggcgctccgg

SEQ ID NO: 622492 - DNA, 25 bp, Rattus norvegicus
gccgtgtccatgagctgctctcctg

SEQ ID NO: 622493 - DNA, 25 bp, Rattus norvegicus
ggcggactgcagtcaccttctgtcc

SEQ ID NO: 622494 - DNA, 25 bp, Rattus norvegicus
gaaacctcgctgatccctggaaccg

SEQ ID NO: 622495 - DNA, 25 bp, Rattus norvegicus
gctcctcctcccgttacctagcgtc

SEQ ID NO: 622496 - DNA, 25 bp, Rattus norvegicus
tccagtcatctctatggttcataaa

SEQ ID NO: 622497 - DNA, 25 bp, Rattus norvegicus
gccaatgcctcagcggaaacggaaa

SEQ ID NO: 622498 - DNA, 25 bp, Rattus norvegicus
cctcagcggaaacggaaatgggcta

SEQ ID NO: 622499 - DNA, 25 bp, Rattus norvegicus
gcggccttcgtgctctctaggctcc

SEQ ID NO: 622500 - DNA, 25 bp, Rattus norvegicus
taggctcccggtcatccagtcatct

SEQ ID NO: 622501 - DNA, 25 bp, Rattus norvegicus
tcccggtcatccagtcatctctatg

SEQ ID NO: 622502 - DNA, 25 bp, Rattus norvegicus
tcataaactatgtaaaactgtcctg

SEQ ID NO: 622503 - DNA, 25 bp, Rattus norvegicus
ggggcgtacactagaccgcgcccaa

SEQ ID NO: 622504 - DNA, 25 bp, Rattus norvegicus
caacccgagaggctaaattggaaag

SEQ ID NO: 622505 - DNA, 25 bp, Rattus norvegicus
ctaaattggaaagcgggtgttctga

SEQ ID NO: 622506 - DNA, 25 bp, Rattus norvegicus
aaagcgggtgttctgaatccagggt

SEQ ID NO: 622507 - DNA, 25 bp, Rattus norvegicus
gggttcgtgacgtctcctgctcctc

SEQ ID NO: 622508 - DNA, 25 bp, Rattus norvegicus
aatccagggtgggttcgtgacgtct

SEQ ID NO: 622509 - DNA, 25 bp, Rattus norvegicus
actccgattcggacggggacagagc

SEQ ID NO: 622510 - DNA, 25 bp, Rattus norvegicus
caacaagggtgagaacatcagcgtc

SEQ ID NO: 622511 - DNA, 25 bp, Rattus norvegicus
tcccttgaccaaggagggaagacga

SEQ ID NO: 622512 - DNA, 25 bp, Rattus norvegicus
agtagccatgcctctcagccgcagt

SEQ ID NO: 622513 - DNA, 25 bp, Rattus norvegicus
agaacatcagcgtcggtcccttgac

SEQ ID NO: 622514 - DNA, 25 bp, Rattus norvegicus
ggtggccaacaagggtgagaacatc

SEQ ID NO: 622515 - DNA, 25 bp, Rattus norvegicus
aacgcagtgcttttcgaggtggcct

SEQ ID NO: 622516 - DNA, 25 bp, Rattus norvegicus
acccggagaacgcagtgcttttcga

SEQ ID NO: 622517 - DNA, 25 bp, Rattus norvegicus
attcgacccggagaacgcagtgctt

SEQ ID NO: 622518 - DNA, 25 bp, Rattus norvegicus
actgggaggatgaattcgacccgga

SEQ ID NO: 622519 - DNA, 25 bp, Rattus norvegicus
cgcttccaggattggaagactggga

SEQ ID NO: 622520 - DNA, 25 bp, Rattus norvegicus
ctatgtcctcgcttccaggattgga

SEQ ID NO: 622521 - DNA, 25 bp, Rattus norvegicus
agtctctctatgtcctcgcttccag

SEQ ID NO: 622522 - DNA, 25 bp, Rattus norvegicus
atcagcgtcggtcccttgaccaagg

SEQ ID NO: 622523 - DNA, 25 bp, Rattus norvegicus
ccgagctactcaccagagagaggta

SEQ ID NO: 622524 - DNA, 25 bp, Rattus norvegicus
cccacccagtcccatgagttgaagt

SEQ ID NO: 622525 - DNA, 25 bp, Rattus norvegicus
gtatacctgaccaatcccgagctga

SEQ ID NO: 622526 - DNA, 25 bp, Rattus norvegicus
gcccgagactaaccaatcggcggtg

SEQ ID NO: 622527 - DNA, 25 bp, Rattus norvegicus
tttatagtatgctggcctccggagg

SEQ ID NO: 622528 - DNA, 25 bp, Rattus norvegicus
ctgctcagataagagcgcgaggacc

SEQ ID NO: 622529 - DNA, 25 bp, Rattus norvegicus
ccatgagttgaagtcacgcgccttg

SEQ ID NO: 622530 - DNA, 25 bp, Rattus norvegicus
ctgaacaaagaaggcccgcgcatgc

SEQ ID NO: 622531 - DNA, 25 bp, Rattus norvegicus
ggagccgtctccgtactgaacaaag

SEQ ID NO: 622532 - DNA, 25 bp, Rattus norvegicus
ggtctgctcagtgagttccagtcag

SEQ ID NO: 622533 - DNA, 25 bp, Rattus norvegicus
ttcaaccgcaacactcaagaagagg

SEQ ID NO: 622534 - DNA, 25 bp, Rattus norvegicus
gcggtggcgaacactttaaacttca

SEQ ID NO: 622535 - DNA, 25 bp, Rattus norvegicus
gccctgcgggaagaagtgttacaaa

SEQ ID NO: 622536 - DNA, 25 bp, Rattus norvegicus
cgcgaggaccgctccttttatagta

SEQ ID NO: 622537 - DNA, 25 bp, Rattus norvegicus
ccgagaagtctgcaccgtgaggaaa

SEQ ID NO: 622538 - DNA, 25 bp, Rattus norvegicus
taggaccttgcgttccgcggactac

SEQ ID NO: 622539 - DNA, 25 bp, Rattus norvegicus
ctacatacagatcccgcaggctgct

SEQ ID NO: 622540 - DNA, 25 bp, Rattus norvegicus
cgtgaaagtgcttggaccctacata

SEQ ID NO: 622541 - DNA, 25 bp, Rattus norvegicus
caaggtcatctgtgcgtgaaagtgc

SEQ ID NO: 622542 - DNA, 25 bp, Rattus norvegicus
ttccctcccgctggggcaaggtcat

SEQ ID NO: 622543 - DNA, 25 bp, Rattus norvegicus
ggactactcagttcacgcggagctc

SEQ ID NO: 622544 - DNA, 25 bp, Rattus norvegicus
gaggaaatttccaaccagcccacaa

SEQ ID NO: 622545 - DNA, 25 bp, Rattus norvegicus
gaaagttcgccttggccgagaagtc

SEQ ID NO: 622546 - DNA, 25 bp, Rattus norvegicus
ggctagcgctccagctggagaaagc

SEQ ID NO: 622547 - DNA, 25 bp, Rattus norvegicus
gcgagaggctagtgtcgagtacaaa

SEQ ID NO: 622548 - DNA, 25 bp, Rattus norvegicus
ccgggatcggtccattgagagtcta

SEQ ID NO: 622549 - DNA, 25 bp, Rattus norvegicus
gtctagagtacaaagagcggcgaga

SEQ ID NO: 622550 - DNA, 25 bp, Rattus norvegicus
tttctggcgaaaacagtcttccctc

SEQ ID NO: 622551 - DNA, 25 bp, Rattus norvegicus
gccattaaattcacgcatgcgcggc

SEQ ID NO: 622552 - DNA, 25 bp, Rattus norvegicus
cctcaccgccgcctccgagatgatc

SEQ ID NO: 622553 - DNA, 25 bp, Rattus norvegicus
cggggcctctgccattaaattcacg

SEQ ID NO: 622554 - DNA, 25 bp, Rattus norvegicus
tcacgtgatcgtcgcgcgctttcgg

SEQ ID NO: 622555 - DNA, 25 bp, Rattus norvegicus
tagtcacgtgatcgtcgcgcgcttt

SEQ ID NO: 622556 - DNA, 25 bp, Rattus norvegicus
cccgcagaactagtcacgtgatcgt

SEQ ID NO: 622557 - DNA, 25 bp, Rattus norvegicus
aaattcacgcatgcgcggcgctacc

SEQ ID NO: 622558 - DNA, 25 bp, Rattus norvegicus
ccggacccgtccatcactgccgctg

SEQ ID NO: 622559 - DNA, 25 bp, Rattus norvegicus
tggacccggcctagttctccgcctc

SEQ ID NO: 622560 - DNA, 25 bp, Rattus norvegicus
cccgcccgagcccacagccggaggg

SEQ ID NO: 622561 - DNA, 25 bp, Rattus norvegicus
gtcggaatggatccgcgcgccccag

SEQ ID NO: 622562 - DNA, 25 bp, Rattus norvegicus
tccgctcacagggtgcggatgcgcc

SEQ ID NO: 622563 - DNA, 25 bp, Rattus norvegicus
gcgcacgcggatgtccgctcacagg

SEQ ID NO: 622564 - DNA, 25 bp, Rattus norvegicus
ggtcacgtgactccccgcagacgtg

SEQ ID NO: 622565 - DNA, 25 bp, Rattus norvegicus
gccgtgaagccctcccgggtactga

SEQ ID NO: 622566 - DNA, 25 bp, Rattus norvegicus
cccagaagcacggtaagaagaacgt

SEQ ID NO: 622567 - DNA, 25 bp, Rattus norvegicus
gcacggtaagaagaacgttgcttca

SEQ ID NO: 622568 - DNA, 25 bp, Rattus norvegicus
gaacgttgcttcaactctaggcctc

SEQ ID NO: 622569 - DNA, 25 bp, Rattus norvegicus
cccgggtactgaagtagtacgctga

SEQ ID NO: 622570 - DNA, 25 bp, Rattus norvegicus
ggcacttggccatgcgccgtctcac

SEQ ID NO: 622571 - DNA, 25 bp, Rattus norvegicus
ctgcaggtgaagctgccgtgaagcc

SEQ ID NO: 622572 - DNA, 25 bp, Rattus norvegicus
accattcacgtacgctgtgttgggg

SEQ ID NO: 622573 - DNA, 25 bp, Rattus norvegicus
atgcccttggtaccattcacgtacg

SEQ ID NO: 622574 - DNA, 25 bp, Rattus norvegicus
ctgggaagaaggcacgagtgagccc

SEQ ID NO: 622575 - DNA, 25 bp, Rattus norvegicus
tgggccatgcccttggtaccattca

SEQ ID NO: 622576 - DNA, 25 bp, Rattus norvegicus
tctcacctgggccatgcccttggta

SEQ ID NO: 622577 - DNA, 25 bp, Rattus norvegicus
actgaagtagtacgctgaccgtgtc

SEQ ID NO: 622578 - DNA, 25 bp, Rattus norvegicus
tgaccgtgtcatccactcctgggaa

SEQ ID NO: 622579 - DNA, 25 bp, Rattus norvegicus
caggtttctggtgatttccctccta

SEQ ID NO: 622580 - DNA, 25 bp, Rattus norvegicus
tcacctctcctagcgcagagggcgt

SEQ ID NO: 622581 - DNA, 25 bp, Rattus norvegicus
gcgacctccgccaggtttctggtga

SEQ ID NO: 622582 - DNA, 25 bp, Rattus norvegicus
ggtgatttccctcctaagtcacgcc

SEQ ID NO: 622583 - DNA, 25 bp, Rattus norvegicus
acgcccacttttccaccgcagaggg

SEQ ID NO: 622584 - DNA, 25 bp, Rattus norvegicus
agggcccgcctccagaatactgatt

SEQ ID NO: 622585 - DNA, 25 bp, Rattus norvegicus
ccagaatactgattggtccacgctg

SEQ ID NO: 622586 - DNA, 25 bp, Rattus norvegicus
tggctctgagcttccgctcgtgtta

SEQ ID NO: 622587 - DNA, 25 bp, Rattus norvegicus
tgagcttccgctcgtgttagcgccc

SEQ ID NO: 622588 - DNA, 25 bp, Rattus norvegicus
gaaggcctgacaccggacaagtatc

SEQ ID NO: 622589 - DNA, 25 bp, Rattus norvegicus
gaccgcgaaggcctgacaccggaca

SEQ ID NO: 622590 - DNA, 25 bp, Rattus norvegicus
tgacaccggacaagtatcacccgct

SEQ ID NO: 622591 - DNA, 25 bp, Rattus norvegicus
attggtccacgctggctctgagctt

SEQ ID NO: 622592 - DNA, 25 bp, Rattus norvegicus
gcagagggcgttttcccagcccgcg

SEQ ID NO: 622593 - DNA, 25 bp, Rattus norvegicus
cgcaaaggctgtcccggcaaaggga

SEQ ID NO: 622594 - DNA, 25 bp, Rattus norvegicus
gctctcaaggccagcgcgttcatgt

SEQ ID NO: 622595 - DNA, 25 bp, Rattus norvegicus
cacccgggagtttatagtctgacgc

SEQ ID NO: 622596 - DNA, 25 bp, Rattus norvegicus
gcgcgttcatgtcgccctcaggcgt

SEQ ID NO: 622597 - DNA, 25 bp, Rattus norvegicus
tctcacgggctgtcgcaaaggctgt

SEQ ID NO: 622598 - DNA, 25 bp, Rattus norvegicus
ggtccggattgctctcaaggccagc

SEQ ID NO: 622599 - DNA, 25 bp, Rattus norvegicus
gcggggtctcgcatgtaatcttcca

SEQ ID NO: 622600 - DNA, 25 bp, Rattus norvegicus
gtctcgcatgtaatcttccacaagc

SEQ ID NO: 622601 - DNA, 25 bp, Rattus norvegicus
ccacaagctgcgaactgagtcaatc

SEQ ID NO: 622602 - DNA, 25 bp, Rattus norvegicus
actgagtcaatctgcgccaacacga

SEQ ID NO: 622603 - DNA, 25 bp, Rattus norvegicus
tgcgccaacacgatcacccgggagt

SEQ ID NO: 622604 - DNA, 25 bp, Rattus norvegicus
gagtttatagtctgacgcagcgcta

SEQ ID NO: 622605 - DNA, 25 bp, Rattus norvegicus
tctgacgcagcgctatgctgacgtc

SEQ ID NO: 622606 - DNA, 25 bp, Rattus norvegicus
acgtgatgtctcacgggctgtcgca

SEQ ID NO: 622607 - DNA, 25 bp, Rattus norvegicus
tggaccactggcgtgcagcctttcc

SEQ ID NO: 622608 - DNA, 25 bp, Rattus norvegicus
ggccggaatgcctttcaccaggccg

SEQ ID NO: 622609 - DNA, 25 bp, Rattus norvegicus
agttaccggccgcacgggatcatgg

SEQ ID NO: 622610 - DNA, 25 bp, Rattus norvegicus
ccgcacgggatcatggctgcagcta

SEQ ID NO: 622611 - DNA, 25 bp, Rattus norvegicus
atggctgcagctatactaggacagg

SEQ ID NO: 622612 - DNA, 25 bp, Rattus norvegicus
tgcagctatactaggacaggtgggt

SEQ ID NO: 622613 - DNA, 25 bp, Rattus norvegicus
gggttggcgtcattcctctgtgccc

SEQ ID NO: 622614 - DNA, 25 bp, Rattus norvegicus
gagtaccgggctttaacgagcggca

SEQ ID NO: 622615 - DNA, 25 bp, Rattus norvegicus
ccgggctttaacgagcggcaaaatg

SEQ ID NO: 622616 - DNA, 25 bp, Rattus norvegicus
gcggcaaaatgggtagacacgagtc

SEQ ID NO: 622617 - DNA, 25 bp, Rattus norvegicus
caaaatgggtagacacgagtcgggt

SEQ ID NO: 622618 - DNA, 25 bp, Rattus norvegicus
tgcgagaggtatctgaaccgcgagc

SEQ ID NO: 622619 - DNA, 25 bp, Rattus norvegicus
cggggccggaatgcctttcaccagg

SEQ ID NO: 622620 - DNA, 25 bp, Rattus norvegicus
cagcctttccgggttggcgtcattc

SEQ ID NO: 622621 - DNA, 25 bp, Rattus norvegicus
agcaggtgcccaggcttcgctccgt

SEQ ID NO: 622622 - DNA, 25 bp, Rattus norvegicus
agcgcccatccacctgggcggagga

SEQ ID NO: 622623 - DNA, 25 bp, Rattus norvegicus
ccagaagaagagacagggccgcagc

SEQ ID NO: 622624 - DNA, 25 bp, Rattus norvegicus
tcgtggagtcagagaacccagaaga

SEQ ID NO: 622625 - DNA, 25 bp, Rattus norvegicus
aactgggttgtccatcgtggagtca

SEQ ID NO: 622626 - DNA, 25 bp, Rattus norvegicus
gcttctggatacgaactgggttgtc

SEQ ID NO: 622627 - DNA, 25 bp, Rattus norvegicus
cagaggatacggcagcttctggata

SEQ ID NO: 622628 - DNA, 25 bp, Rattus norvegicus
ccctggtccatacagaggatacggc

SEQ ID NO: 622629 - DNA, 25 bp, Rattus norvegicus
aacgcacatgggacctgagctcctg

SEQ ID NO: 622630 - DNA, 25 bp, Rattus norvegicus
cggcaccggagagggaaacgcacat

SEQ ID NO: 622631 - DNA, 25 bp, Rattus norvegicus
taagggaagcagaagtcccggcacc

SEQ ID NO: 622632 - DNA, 25 bp, Rattus norvegicus
cccagagcatccagctaagggaagc

SEQ ID NO: 622633 - DNA, 25 bp, Rattus norvegicus
ggcgtggctactcccagagcatcca

SEQ ID NO: 622634 - DNA, 25 bp, Rattus norvegicus
gccaggtaggatgcggctccgcctc

SEQ ID NO: 622635 - DNA, 25 bp, Rattus norvegicus
tgctcaagatcttcgcggccgggct

SEQ ID NO: 622636 - DNA, 25 bp, Rattus norvegicus
acagcggctgcgtggacgcctacgc

SEQ ID NO: 622637 - DNA, 25 bp, Rattus norvegicus
tgctgcggatgcagacggtcagccg

SEQ ID NO: 622638 - DNA, 25 bp, Rattus norvegicus
tacgcgctttgcgacgctctgggcc

SEQ ID NO: 622639 - DNA, 25 bp, Rattus norvegicus
cggagcgatctaccgcgcgcgagct

SEQ ID NO: 622640 - DNA, 25 bp, Rattus norvegicus
tgctggctacggagcgatctaccgc

SEQ ID NO: 622641 - DNA, 25 bp, Rattus norvegicus
gtcgggcgccaactacaagagcgtg

SEQ ID NO: 622642 - DNA, 25 bp, Rattus norvegicus
cccgggagtgctcaagatcttcgcg

SEQ ID NO: 622643 - DNA, 25 bp, Rattus norvegicus
cagcgctgggccagcgagaagaagc

SEQ ID NO: 622644 - DNA, 25 bp, Rattus norvegicus
catctcgcagctgtttcggggctcg

SEQ ID NO: 622645 - DNA, 25 bp, Rattus norvegicus
gccaagcgcatctcgcagctgtttc

SEQ ID NO: 622646 - DNA, 25 bp, Rattus norvegicus
tcgggcagccgagccaagcgcatct

SEQ ID NO: 622647 - DNA, 25 bp, Rattus norvegicus
cgtggacgcctacgcgctttgcgac

SEQ ID NO: 622648 - DNA, 25 bp, Rattus norvegicus
actacaagagcgtgctggctacgga

SEQ ID NO: 622649 - DNA, 25 bp, Rattus norvegicus
gtgagtccgaactaaacctgtacgc

SEQ ID NO: 622650 - DNA, 25 bp, Rattus norvegicus
ctgcccgttgtaatgcctgctggaa

SEQ ID NO: 622651 - DNA, 25 bp, Rattus norvegicus
tgctggaaatccagacgcgttctta

SEQ ID NO: 622652 - DNA, 25 bp, Rattus norvegicus
gcgttcttaccacggacgctcctga

SEQ ID NO: 622653 - DNA, 25 bp, Rattus norvegicus
ctcctgaaggcggaagtggaaactc

SEQ ID NO: 622654 - DNA, 25 bp, Rattus norvegicus
gtggaaactcctaaggcccggcatc

SEQ ID NO: 622655 - DNA, 25 bp, Rattus norvegicus
agcagagcgcttaaataccgtcatg

SEQ ID NO: 622656 - DNA, 25 bp, Rattus norvegicus
tcgcgtcccatagaagcagatcgtg

SEQ ID NO: 622657 - DNA, 25 bp, Rattus norvegicus
tgtacgccgcataccgcgtgttctg

SEQ ID NO: 622658 - DNA, 25 bp, Rattus norvegicus
gtgttctgtgcgctttggtttcaaa

SEQ ID NO: 622659 - DNA, 25 bp, Rattus norvegicus
gagaagtgcttgtgttctaacaggc

SEQ ID NO: 622660 - DNA, 25 bp, Rattus norvegicus
acaggcaatttactggcgttttgtc

SEQ ID NO: 622661 - DNA, 25 bp, Rattus norvegicus
tatagtgcgttcaagattcggcgtc

SEQ ID NO: 622662 - DNA, 25 bp, Rattus norvegicus
cctctctagtgggaggagtcgcaca

SEQ ID NO: 622663 - DNA, 25 bp, Rattus norvegicus
acctgctaggcctgggagagcattt

SEQ ID NO: 622664 - DNA, 25 bp, Rattus norvegicus
atttcctgttcatgtataaggaccc

SEQ ID NO: 622665 - DNA, 25 bp, Rattus norvegicus
ggctgggccttttcttgtcgcctgt

SEQ ID NO: 622666 - DNA, 25 bp, Rattus norvegicus
cgaggcactggctgcctacctggac

SEQ ID NO: 622667 - DNA, 25 bp, Rattus norvegicus
ccgccactctgctggcactgtgtgt

SEQ ID NO: 622668 - DNA, 25 bp, Rattus norvegicus
cgaggcagagttgcatcccggagac

SEQ ID NO: 622669 - DNA, 25 bp, Rattus norvegicus
acaatggctgccttttgctgcgcga

SEQ ID NO: 622670 - DNA, 25 bp, Rattus norvegicus
cactgtgtgtgcagcattcggcgag

SEQ ID NO: 622671 - DNA, 25 bp, Rattus norvegicus
gcctggcccggctcatcaaagaggc

SEQ ID NO: 622672 - DNA, 25 bp, Rattus norvegicus
gctcatcaaagaggccgtttgggtg

SEQ ID NO: 622673 - DNA, 25 bp, Rattus norvegicus
acattgcacggtgcgcgcgggtcct

SEQ ID NO: 622674 - DNA, 25 bp, Rattus norvegicus
agacatcctgcctcgacattgcacg

SEQ ID NO: 622675 - DNA, 25 bp, Rattus norvegicus
ccggtcacacacaatggctgccttt

SEQ ID NO: 622676 - DNA, 25 bp, Rattus norvegicus
tgctgcgctttagaccacgagagga

SEQ ID NO: 622677 - DNA, 25 bp, Rattus norvegicus
cacgtggtcatgcagggtgaactcc

SEQ ID NO: 622678 - DNA, 25 bp, Rattus norvegicus
ggcgcacatggacacccacaaaagt

SEQ ID NO: 622679 - DNA, 25 bp, Rattus norvegicus
acgctcctccatccagtcgttgaga

SEQ ID NO: 622680 - DNA, 25 bp, Rattus norvegicus
caccacgtctcctcgggaagcatta

SEQ ID NO: 622681 - DNA, 25 bp, Rattus norvegicus
cggcaccaggccataccgttgcttg

SEQ ID NO: 622682 - DNA, 25 bp, Rattus norvegicus
aaaagtactcggctggctcccattc

SEQ ID NO: 622683 - DNA, 25 bp, Rattus norvegicus
ggtatcccgtgaagcgcacaaagtg

SEQ ID NO: 622684 - DNA, 25 bp, Rattus norvegicus
atctttttggccgtgtcgctgtgta

SEQ ID NO: 622685 - DNA, 25 bp, Rattus norvegicus
tgtaacaccgggaggctgatcctga

SEQ ID NO: 622686 - DNA, 25 bp, Rattus norvegicus
agccgtccgttcatcctggccagtg

SEQ ID NO: 622687 - DNA, 25 bp, Rattus norvegicus
cccagccggccaatggaattgatcg

SEQ ID NO: 622688 - DNA, 25 bp, Rattus norvegicus
cgcatctctgggctttctgtgtttc

SEQ ID NO: 622689 - DNA, 25 bp, Rattus norvegicus
tcccgaggacatttgagtcgtcatc

SEQ ID NO: 622690 - DNA, 25 bp, Rattus norvegicus
gcattaatgttctcccggcaccagg

SEQ ID NO: 622691 - DNA, 25 bp, Rattus norvegicus
gcctgcgacctgcaagtagacattg

SEQ ID NO: 622692 - DNA, 25 bp, Rattus norvegicus
ccactctcgctttgaggcaggaatg

SEQ ID NO: 622693 - DNA, 25 bp, Rattus norvegicus
catcgagaagtgacagtgctggccc

SEQ ID NO: 622694 - DNA, 25 bp, Rattus norvegicus
aagttaccggctcgcttctcacctg

SEQ ID NO: 622695 - DNA, 25 bp, Rattus norvegicus
cgacatggcggaagctactaagtta

SEQ ID NO: 622696 - DNA, 25 bp, Rattus norvegicus
cgaggtcttctttcgacatggcgga

SEQ ID NO: 622697 - DNA, 25 bp, Rattus norvegicus
ccagtgctcatactaaccaagggga

SEQ ID NO: 622698 - DNA, 25 bp, Rattus norvegicus
cccgcagaccgattttttctgaaca

SEQ ID NO: 622699 - DNA, 25 bp, Rattus norvegicus
acttaactctctctgggctcgggtc

SEQ ID NO: 622700 - DNA, 25 bp, Rattus norvegicus
ccgggatctggactccaggacttta

SEQ ID NO: 622701 - DNA, 25 bp, Rattus norvegicus
tgccgcccagaaagggttaattcca

SEQ ID NO: 622702 - DNA, 25 bp, Rattus norvegicus
cgacacacttctgaggctgacaatc

SEQ ID NO: 622703 - DNA, 25 bp, Rattus norvegicus
gccagcctggatggccgacacactt

SEQ ID NO: 622704 - DNA, 25 bp, Rattus norvegicus
tgaacacgcatttagccagcaccca

SEQ ID NO: 622705 - DNA, 25 bp, Rattus norvegicus
gcctaggaactaaagtgagctactc

SEQ ID NO: 622706 - DNA, 25 bp, Rattus norvegicus
cgtcgttgtcctcgttgtccgaggc

SEQ ID NO: 622707 - DNA, 25 bp, Rattus norvegicus
gctgactacctcctcctgggcagag

SEQ ID NO: 622708 - DNA, 25 bp, Rattus norvegicus
tcctcgttgtccgaggcggtaggac

SEQ ID NO: 622709 - DNA, 25 bp, Rattus norvegicus
gagctgcggagaaccacactgaccc

SEQ ID NO: 622710 - DNA, 25 bp, Rattus norvegicus
tgcacgtgctggctgtgttcaagca

SEQ ID NO: 622711 - DNA, 25 bp, Rattus norvegicus
tgttcaagcagcgtgcgtggcccgt

SEQ ID NO: 622712 - DNA, 25 bp, Rattus norvegicus
tgagctactctgtaaggtgtgagtc

SEQ ID NO: 622713 - DNA, 25 bp, Rattus norvegicus
gtgtgagtcagcagagccaatcaga

SEQ ID NO: 622714 - DNA, 25 bp, Rattus norvegicus
gccaatcagaagcagcagcgctcgt

SEQ ID NO: 622715 - DNA, 25 bp, Rattus norvegicus
agcagcgctcgtgactccgcatgcg

SEQ ID NO: 622716 - DNA, 25 bp, Rattus norvegicus
atgcgcctctgccacgtggacgcga

SEQ ID NO: 622717 - DNA, 25 bp, Rattus norvegicus
cagagtccgcacaggtttcagcatc

SEQ ID NO: 622718 - DNA, 25 bp, Rattus norvegicus
ccactcggagccctgggcctaggaa

SEQ ID NO: 622719 - DNA, 25 bp, Rattus norvegicus
cgatcgcagcttcgggaggtagaaa

SEQ ID NO: 622720 - DNA, 25 bp, Rattus norvegicus
tgtgcattggcaccgagagggaccc

SEQ ID NO: 622721 - DNA, 25 bp, Rattus norvegicus
agggtcgctccgaggcctcttggat

SEQ ID NO: 622722 - DNA, 25 bp, Rattus norvegicus
cagcccttgcatctcgggagctggg

SEQ ID NO: 622723 - DNA, 25 bp, Rattus norvegicus
atctcgggagctggggctcccgttc

SEQ ID NO: 622724 - DNA, 25 bp, Rattus norvegicus
gccgggttcgctggttgagagcgaa

SEQ ID NO: 622725 - DNA, 25 bp, Rattus norvegicus
agccaggctggaagtcccaggagaa

SEQ ID NO: 622726 - DNA, 25 bp, Rattus norvegicus
ttgcatctcgggagctggggctccc

SEQ ID NO: 622727 - DNA, 25 bp, Rattus norvegicus
cctcaagcgctggtactctgggccg

SEQ ID NO: 622728 - DNA, 25 bp, Rattus norvegicus
aagcgctggtactctgggccgcact

SEQ ID NO: 622729 - DNA, 25 bp, Rattus norvegicus
ggtcccagcccttgcatctcgggag

SEQ ID NO: 622730 - DNA, 25 bp, Rattus norvegicus
ctggggtgcacggtcccagcccttg

SEQ ID NO: 622731 - DNA, 25 bp, Rattus norvegicus
aggagtgagcgtcaaacgggctctg

SEQ ID NO: 622732 - DNA, 25 bp, Rattus norvegicus
gacagccaggctggaagtcccagga

SEQ ID NO: 622733 - DNA, 25 bp, Rattus norvegicus
ttggccatatgtaggtcagtgtccc

SEQ ID NO: 622734 - DNA, 25 bp, Rattus norvegicus
tagcacgcgcagagccatgtgcttc

SEQ ID NO: 622735 - DNA, 25 bp, Rattus norvegicus
catccggtagcacgcgcagagccat

SEQ ID NO: 622736 - DNA, 25 bp, Rattus norvegicus
ccttcttcctgtctcattggctcga

SEQ ID NO: 622737 - DNA, 25 bp, Rattus norvegicus
tcctgtctcattggctcgaagtggg

SEQ ID NO: 622738 - DNA, 25 bp, Rattus norvegicus
tctcattggctcgaagtgggtcacg

SEQ ID NO: 622739 - DNA, 25 bp, Rattus norvegicus
aagtgggtcacggtcccgcctccag

SEQ ID NO: 622740 - DNA, 25 bp, Rattus norvegicus
catcccattggccatatgtaggtca

SEQ ID NO: 622741 - DNA, 25 bp, Rattus norvegicus
ggcgaggcaattccacaagttcagc

SEQ ID NO: 622742 - DNA, 25 bp, Rattus norvegicus
atatgtaggtcagtgtcccgccttc

SEQ ID NO: 622743 - DNA, 25 bp, Rattus norvegicus
tgtaggtcagtgtcccgccttcttc

SEQ ID NO: 622744 - DNA, 25 bp, Rattus norvegicus
ccttcttccaaaggcgaggcaattc

SEQ ID NO: 622745 - DNA, 25 bp, Rattus norvegicus
cttccaaaggcgaggcaattccaca

SEQ ID NO: 622746 - DNA, 25 bp, Rattus norvegicus
agcgcctcatcccattggccatatg

SEQ ID NO: 622747 - DNA, 25 bp, Rattus norvegicus
ttctgatactggaggcttgctcgcc

SEQ ID NO: 622748 - DNA, 25 bp, Rattus norvegicus
gcgcggcctctgagcgacaggaccc

SEQ ID NO: 622749 - DNA, 25 bp, Rattus norvegicus
tttgaagcgttctgatactggaggc

SEQ ID NO: 622750 - DNA, 25 bp, Rattus norvegicus
atactggaggcttgctcgccgcgct

SEQ ID NO: 622751 - DNA, 25 bp, Rattus norvegicus
tcgcccgactctgggacacattcgt

SEQ ID NO: 622752 - DNA, 25 bp, Rattus norvegicus
ctgggacacattcgtccgagccaca

SEQ ID NO: 622753 - DNA, 25 bp, Rattus norvegicus
attcgtccgagccacaggagtgtgc

SEQ ID NO: 622754 - DNA, 25 bp, Rattus norvegicus
gtgtgcgggtgactgacatatcatc

SEQ ID NO: 622755 - DNA, 25 bp, Rattus norvegicus
aacctgggagcaggtgcccggaaat

SEQ ID NO: 622756 - DNA, 25 bp, Rattus norvegicus
ggtgactgacatatcatctcttcga

SEQ ID NO: 622757 - DNA, 25 bp, Rattus norvegicus
gacatatcatctcttcgactctcca

SEQ ID NO: 622758 - DNA, 25 bp, Rattus norvegicus
ccatgagctcatgaacctgggagca

SEQ ID NO: 622759 - DNA, 25 bp, Rattus norvegicus
ctcttcgactctccatgagctcatg

SEQ ID NO: 622760 - DNA, 25 bp, Rattus norvegicus
agtgctcgtaggatttgaagcgttc

SEQ ID NO: 622761 - DNA, 25 bp, Rattus norvegicus
tggacgccttcttgctggagcacgg

SEQ ID NO: 622762 - DNA, 25 bp, Rattus norvegicus
cgccgctgctgtgggaacgcacttt

SEQ ID NO: 622763 - DNA, 25 bp, Rattus norvegicus
ctgctgtgggaacgcactttgcctt

SEQ ID NO: 622764 - DNA, 25 bp, Rattus norvegicus
tgtgggaacgcactttgcctttcgg

SEQ ID NO: 622765 - DNA, 25 bp, Rattus norvegicus
acgcactttgcctttcggggacgtg

SEQ ID NO: 622766 - DNA, 25 bp, Rattus norvegicus
gcactttgcctttcggggacgtgga

SEQ ID NO: 622767 - DNA, 25 bp, Rattus norvegicus
acgtggaatacgtggacctggacgc

SEQ ID NO: 622768 - DNA, 25 bp, Rattus norvegicus
acctggacgccttcttgctggagca

SEQ ID NO: 622769 - DNA, 25 bp, Rattus norvegicus
gcctgtcgccggcaccctctccagc

SEQ ID NO: 622770 - DNA, 25 bp, Rattus norvegicus
tggagcacgggctaccgccgagccc

SEQ ID NO: 622771 - DNA, 25 bp, Rattus norvegicus
cccgagtctttttgcgccgctgctg

SEQ ID NO: 622772 - DNA, 25 bp, Rattus norvegicus
tggctggcccgagtctttttgcgcc

SEQ ID NO: 622773 - DNA, 25 bp, Rattus norvegicus
gcaccctctccagcgcgcactcccg

SEQ ID NO: 622774 - DNA, 25 bp, Rattus norvegicus
aatacgtggacctggacgccttctt

SEQ ID NO: 622775 - DNA, 25 bp, Rattus norvegicus
tagaacgtcctgtgttgcgtcacga

SEQ ID NO: 622776 - DNA, 25 bp, Rattus norvegicus
gtcgcgctcatgaggcgtcaccagt

SEQ ID NO: 622777 - DNA, 25 bp, Rattus norvegicus
gcgtcaccagtgtaccatagagaca

SEQ ID NO: 622778 - DNA, 25 bp, Rattus norvegicus
gacactcagttcaggatagaacgtc

SEQ ID NO: 622779 - DNA, 25 bp, Rattus norvegicus
actggaggatagtctggggccttca

SEQ ID NO: 622780 - DNA, 25 bp, Rattus norvegicus
tgttgcgtcacgagtgcgtctcgca

SEQ ID NO: 622781 - DNA, 25 bp, Rattus norvegicus
agtgcgtctcgcaggctgctctttc

SEQ ID NO: 622782 - DNA, 25 bp, Rattus norvegicus
gttccgtctttctggacctggtcta

SEQ ID NO: 622783 - DNA, 25 bp, Rattus norvegicus
acctggtctagcaggaggcgccatc

SEQ ID NO: 622784 - DNA, 25 bp, Rattus norvegicus
gccatcatggtaagcgcgcttagta

SEQ ID NO: 622785 - DNA, 25 bp, Rattus norvegicus
gcgcttagtagcgtctgcgagtgtc

SEQ ID NO: 622786 - DNA, 25 bp, Rattus norvegicus
tgcgagtgtcccatccgttgccatc

SEQ ID NO: 622787 - DNA, 25 bp, Rattus norvegicus
ttgccatcctcagcgagaccggatc

SEQ ID NO: 622788 - DNA, 25 bp, Rattus norvegicus
cagccgggacttatcggaaccgata

SEQ ID NO: 622789 - DNA, 25 bp, Rattus norvegicus
cctttgtagttcaggtgagcaccga

SEQ ID NO: 622790 - DNA, 25 bp, Rattus norvegicus
accctcagacgactactcttgtgtg

SEQ ID NO: 622791 - DNA, 25 bp, Rattus norvegicus
acgactactcttgtgtgcgtgcaga

SEQ ID NO: 622792 - DNA, 25 bp, Rattus norvegicus
gtcggccctggccagtccaggctca

SEQ ID NO: 622793 - DNA, 25 bp, Rattus norvegicus
agtccaggctcaggcctctcgtctc

SEQ ID NO: 622794 - DNA, 25 bp, Rattus norvegicus
gggacagcggctacgagaccgagac

SEQ ID NO: 622795 - DNA, 25 bp, Rattus norvegicus
cccgagccacccgacccaggagcgc

SEQ ID NO: 622796 - DNA, 25 bp, Rattus norvegicus
tcccagggtcccaggagaagccaac

SEQ ID NO: 622797 - DNA, 25 bp, Rattus norvegicus
caggagaagccaacctttgtagttc

SEQ ID NO: 622798 - DNA, 25 bp, Rattus norvegicus
tgacaaagaacctcctaggggacaa

SEQ ID NO: 622799 - DNA, 25 bp, Rattus norvegicus
gggaggatgtgacaaagaacctcct

SEQ ID NO: 622800 - DNA, 25 bp, Rattus norvegicus
ttcaggtgagcaccgagcagctgct

SEQ ID NO: 622801 - DNA, 25 bp, Rattus norvegicus
gtcccaggagaagccaacctttgta

SEQ ID NO: 622802 - DNA, 25 bp, Rattus norvegicus
ctgctgatgtccctacgggaggatg

SEQ ID NO: 622803 - DNA, 25 bp, Rattus norvegicus
gcctcgcccggcctaccgtagacac

SEQ ID NO: 622804 - DNA, 25 bp, Rattus norvegicus
agactctcccttcacggcccaaccg

SEQ ID NO: 622805 - DNA, 25 bp, Rattus norvegicus
cgctttgacaccacccaatccgctg

SEQ ID NO: 622806 - DNA, 25 bp, Rattus norvegicus
ttaagcctaggtctgcaggaagaaa

SEQ ID NO: 622807 - DNA, 25 bp, Rattus norvegicus
cgtttccgccggctgggcctgcgtc

SEQ ID NO: 622808 - DNA, 25 bp, Rattus norvegicus
cgttaagcctaggtctgcaggaaga

SEQ ID NO: 622809 - DNA, 25 bp, Rattus norvegicus
cggcgttaagcctaggtctgcagga

SEQ ID NO: 622810 - DNA, 25 bp, Rattus norvegicus
ggacggcgttaagcctaggtctgca

SEQ ID NO: 622811 - DNA, 25 bp, Rattus norvegicus
gcgcccgtcctcagcgccgaaaaga

SEQ ID NO: 622812 - DNA, 25 bp, Rattus norvegicus
ggcctaccgtagacaccgtcctcca

SEQ ID NO: 622813 - DNA, 25 bp, Rattus norvegicus
accgtcctccatggcggctaggaag

SEQ ID NO: 622814 - DNA, 25 bp, Rattus norvegicus
ctccatggcggctaggaaggcccgc

SEQ ID NO: 622815 - DNA, 25 bp, Rattus norvegicus
gggctcgagtgagcccgctcaaacg

SEQ ID NO: 622816 - DNA, 25 bp, Rattus norvegicus
tcagcgccgaaaagactctcccttc

SEQ ID NO: 622817 - DNA, 25 bp, Rattus norvegicus
cccagacgagatttcaagccattta

SEQ ID NO: 622818 - DNA, 25 bp, Rattus norvegicus
gattaaatacgtcgatgagtcagtc

SEQ ID NO: 622819 - DNA, 25 bp, Rattus norvegicus
gctaagcgagccgatacattctggc

SEQ ID NO: 622820 - DNA, 25 bp, Rattus norvegicus
gggttcgtgcgtgattaaatacgtc

SEQ ID NO: 622821 - DNA, 25 bp, Rattus norvegicus
acattctggctgatagggttcgtgc

SEQ ID NO: 622822 - DNA, 25 bp, Rattus norvegicus
ccaagatgccgtctctcggctgtca

SEQ ID NO: 622823 - DNA, 25 bp, Rattus norvegicus
tgagtcagtcaataaatcgaacacg

SEQ ID NO: 622824 - DNA, 25 bp, Rattus norvegicus
accagaacggttcacccaagatgcc

SEQ ID NO: 622825 - DNA, 25 bp, Rattus norvegicus
tcgggcacaaagcaccagaacggtt

SEQ ID NO: 622826 - DNA, 25 bp, Rattus norvegicus
ctcctcatgtcagcgacaacttcgg

SEQ ID NO: 622827 - DNA, 25 bp, Rattus norvegicus
gttgaacctactcccggctgacaaa

SEQ ID NO: 622828 - DNA, 25 bp, Rattus norvegicus
taataaccgtgtgagttgaacctac

SEQ ID NO: 622829 - DNA, 25 bp, Rattus norvegicus
gccatttaaatgctaagcgagccga

SEQ ID NO: 622830 - DNA, 25 bp, Rattus norvegicus
tcggctgtcacccagacgagatttc

SEQ ID NO: 622831 - DNA, 25 bp, Rattus norvegicus
gccagcgcacgtccacacatgtggt

SEQ ID NO: 622832 - DNA, 25 bp, Rattus norvegicus
gtgcgcctccaccaggtgacttcgg

SEQ ID NO: 622833 - DNA, 25 bp, Rattus norvegicus
ccacatgagacagagccggcggtct

SEQ ID NO: 622834 - DNA, 25 bp, Rattus norvegicus
cagcagctggacactcttcggtgac

SEQ ID NO: 622835 - DNA, 25 bp, Rattus norvegicus
gtgacgctgcgcacaccatagccta

SEQ ID NO: 622836 - DNA, 25 bp, Rattus norvegicus
catagcctatggacgtctgtgtctc

SEQ ID NO: 622837 - DNA, 25 bp, Rattus norvegicus
gacgtctgtgtctccagtgcaaaga

SEQ ID NO: 622838 - DNA, 25 bp, Rattus norvegicus
tcaggccgaagagcaaccaggaggc

SEQ ID NO: 622839 - DNA, 25 bp, Rattus norvegicus
acaggtcacttaggtagcgcgcgcc

SEQ ID NO: 622840 - DNA, 25 bp, Rattus norvegicus
ttcacgaagcgcacattgcagtgcc

SEQ ID NO: 622841 - DNA, 25 bp, Rattus norvegicus
tgcagtgcccatcttttttgacgaa

SEQ ID NO: 622842 - DNA, 25 bp, Rattus norvegicus
ttttgacgaagcgtccacggcgccg

SEQ ID NO: 622843 - DNA, 25 bp, Rattus norvegicus
tcatcaccagctcgactgtttcctg

SEQ ID NO: 622844 - DNA, 25 bp, Rattus norvegicus
ggaagctggccacttgcgagaaaca

SEQ ID NO: 622845 - DNA, 25 bp, Rattus norvegicus
ttaatttgaacgaccgctgggtcca

SEQ ID NO: 622846 - DNA, 25 bp, Rattus norvegicus
tttctctcggagttcgcatcgcccg

SEQ ID NO: 622847 - DNA, 25 bp, Rattus norvegicus
cctcagttacttcttttctctcgga

SEQ ID NO: 622848 - DNA, 25 bp, Rattus norvegicus
agtcgacgtccgctaaagcggattg

SEQ ID NO: 622849 - DNA, 25 bp, Rattus norvegicus
gaccgctgggtccattcctatcgca

SEQ ID NO: 622850 - DNA, 25 bp, Rattus norvegicus
cccgctttaatttgaacgaccgctg

SEQ ID NO: 622851 - DNA, 25 bp, Rattus norvegicus
caacggagatccgacccgctttaat

SEQ ID NO: 622852 - DNA, 25 bp, Rattus norvegicus
cccttgcgagcaacggagatccgac

SEQ ID NO: 622853 - DNA, 25 bp, Rattus norvegicus
gcaaacaacccttgcgagcaacgga

SEQ ID NO: 622854 - DNA, 25 bp, Rattus norvegicus
ctggcaactgggcaaacaacccttg

SEQ ID NO: 622855 - DNA, 25 bp, Rattus norvegicus
ggcctgttactctggcaactgggca

SEQ ID NO: 622856 - DNA, 25 bp, Rattus norvegicus
tggacgttcgttggcctgttactct

SEQ ID NO: 622857 - DNA, 25 bp, Rattus norvegicus
ccgctaaagcggattggactggagt

SEQ ID NO: 622858 - DNA, 25 bp, Rattus norvegicus
gtccattcctatcgcacctcagtta

SEQ ID NO: 622859 - DNA, 25 bp, Rattus norvegicus
ttgctctcaggatgggtgagatttg

SEQ ID NO: 622860 - DNA, 25 bp, Rattus norvegicus
tcccgccaatcaggtgacgttaaaa

SEQ ID NO: 622861 - DNA, 25 bp, Rattus norvegicus
ccgccaatcaggtgacgttaaaaag

SEQ ID NO: 622862 - DNA, 25 bp, Rattus norvegicus
gccaatcaggtgacgttaaaaagcc

SEQ ID NO: 622863 - DNA, 25 bp, Rattus norvegicus
caatcaggtgacgttaaaaagccct

SEQ ID NO: 622864 - DNA, 25 bp, Rattus norvegicus
cccttgctctcaggatgggtgagat

SEQ ID NO: 622865 - DNA, 25 bp, Rattus norvegicus
ccttgctctcaggatgggtgagatt

SEQ ID NO: 622866 - DNA, 25 bp, Rattus norvegicus
tttgggcgaccaagtcccctctggc

SEQ ID NO: 622867 - DNA, 25 bp, Rattus norvegicus
gaccaagtcccctctggctcatagt

SEQ ID NO: 622868 - DNA, 25 bp, Rattus norvegicus
tggctcatagttcccccaaggcgaa

SEQ ID NO: 622869 - DNA, 25 bp, Rattus norvegicus
ggggcgcacggacgctgctcccagg

SEQ ID NO: 622870 - DNA, 25 bp, Rattus norvegicus
gcgcggcgtgactcccccacacctc

SEQ ID NO: 622871 - DNA, 25 bp, Rattus norvegicus
ctcccgccaatcaggtgacgttaaa

SEQ ID NO: 622872 - DNA, 25 bp, Rattus norvegicus
ggtgagatttgggcgaccaagtccc

SEQ ID NO: 622873 - DNA, 25 bp, Rattus norvegicus
ccgagcttgtcgaccgaccagtagc

SEQ ID NO: 622874 - DNA, 25 bp, Rattus norvegicus
cagaggctggctctcgggatctgaa

SEQ ID NO: 622875 - DNA, 25 bp, Rattus norvegicus
aagtcggcgaaccaccagggctcca

SEQ ID NO: 622876 - DNA, 25 bp, Rattus norvegicus
tccgaaggcgaaggctcgaggtcca

SEQ ID NO: 622877 - DNA, 25 bp, Rattus norvegicus
ctctcgggatctgaacgcggccagc

SEQ ID NO: 622878 - DNA, 25 bp, Rattus norvegicus
ggcgggctttcgtcctcgaaagcca

SEQ ID NO: 622879 - DNA, 25 bp, Rattus norvegicus
cctcgaaagccaggcgacacagtgg

SEQ ID NO: 622880 - DNA, 25 bp, Rattus norvegicus
tcctgctcgcgcacgatggcgaagt

SEQ ID NO: 622881 - DNA, 25 bp, Rattus norvegicus
agtatcggtggaagccgtcggctat

SEQ ID NO: 622882 - DNA, 25 bp, Rattus norvegicus
cagctgcgcgctctcggggcacgaa

SEQ ID NO: 622883 - DNA, 25 bp, Rattus norvegicus
gcaggtagtcccagctaccagcgcg

SEQ ID NO: 622884 - DNA, 25 bp, Rattus norvegicus
agccgccgtctaagccgtcgtgcga

SEQ ID NO: 622885 - DNA, 25 bp, Rattus norvegicus
tgaggtcgcggacaaccacagcgcg

SEQ ID NO: 622886 - DNA, 25 bp, Rattus norvegicus
gctctccgagtcctcggagtccgaa

SEQ ID NO: 622887 - DNA, 25 bp, Rattus norvegicus
aagcgccacgttgagtggccgcgcc

SEQ ID NO: 622888 - DNA, 25 bp, Rattus norvegicus
tcggagccgttgagcaccagcgcca

SEQ ID NO: 622889 - DNA, 25 bp, Rattus norvegicus
tctgccgcatatgccgggccggaga

SEQ ID NO: 622890 - DNA, 25 bp, Rattus norvegicus
cccaagttaatcaaaactacgtctg

SEQ ID NO: 622891 - DNA, 25 bp, Rattus norvegicus
agccgttgagcaccagcgccacggg

SEQ ID NO: 622892 - DNA, 25 bp, Rattus norvegicus
tcgcagagctgcagcacaaggctgc

SEQ ID NO: 622893 - DNA, 25 bp, Rattus norvegicus
cccgacagcaggtcgcagagctgca

SEQ ID NO: 622894 - DNA, 25 bp, Rattus norvegicus
agtcgtcctcgaacaccacgccgtg

SEQ ID NO: 622895 - DNA, 25 bp, Rattus norvegicus
tctgcgcggacaggaagtcgagaat

SEQ ID NO: 622896 - DNA, 25 bp, Rattus norvegicus
ccgccgtgcacggctacgatgggca

SEQ ID NO: 622897 - DNA, 25 bp, Rattus norvegicus
tcgcgcgcaccttgggtgtgagcac

SEQ ID NO: 622898 - DNA, 25 bp, Rattus norvegicus
cgcaagacccgcctccgagctgcaa

SEQ ID NO: 622899 - DNA, 25 bp, Rattus norvegicus
tcaaaactacgtctgatcccggacc

SEQ ID NO: 622900 - DNA, 25 bp, Rattus norvegicus
ggccggagaagacaagcgccacgtt

SEQ ID NO: 622901 - DNA, 25 bp, Rattus norvegicus
ccagccttcaggcagtggcgtctac

SEQ ID NO: 622902 - DNA, 25 bp, Rattus norvegicus
cacttccggctctgccctacgtgtc

SEQ ID NO: 622903 - DNA, 25 bp, Rattus norvegicus
aggagcgctgcatcgcagccacttc

SEQ ID NO: 622904 - DNA, 25 bp, Rattus norvegicus
ctcccacaggaaaccgcaggcgttg

SEQ ID NO: 622905 - DNA, 25 bp, Rattus norvegicus
gcaggcgttgggcacacccagcctt

SEQ ID NO: 622906 - DNA, 25 bp, Rattus norvegicus
atgggaccgctggaggttccgccca

SEQ ID NO: 622907 - DNA, 25 bp, Rattus norvegicus
ccttcaggcagtggcgtctacaacc

SEQ ID NO: 622908 - DNA, 25 bp, Rattus norvegicus
tcaggcagtggcgtctacaacccgc

SEQ ID NO: 622909 - DNA, 25 bp, Rattus norvegicus
tggcgtctacaacccgcatgcacga

SEQ ID NO: 622910 - DNA, 25 bp, Rattus norvegicus
aacccgcatgcacgacgaacacgtg

SEQ ID NO: 622911 - DNA, 25 bp, Rattus norvegicus
gcacgacgaacacgtgggatgaaga

SEQ ID NO: 622912 - DNA, 25 bp, Rattus norvegicus
atgaagagcttggtcagatgggacc

SEQ ID NO: 622913 - DNA, 25 bp, Rattus norvegicus
aagagcttggtcagatgggaccgct

SEQ ID NO: 622914 - DNA, 25 bp, Rattus norvegicus
gaaaccgcaggcgttgggcacaccc

SEQ ID NO: 622915 - DNA, 25 bp, Rattus norvegicus
gctgacttgcgcactctgaggctag

SEQ ID NO: 622916 - DNA, 25 bp, Rattus norvegicus
tccttgaagggtcgaggctcagaga

SEQ ID NO: 622917 - DNA, 25 bp, Rattus norvegicus
aggagcgcccgctccgaagaaggaa

SEQ ID NO: 622918 - DNA, 25 bp, Rattus norvegicus
caagatgcgtttgggtctgtcctcc

SEQ ID NO: 622919 - DNA, 25 bp, Rattus norvegicus
ccactacatccaagatgcgtttggg

SEQ ID NO: 622920 - DNA, 25 bp, Rattus norvegicus
agggacgccaccactacatccaaga

SEQ ID NO: 622921 - DNA, 25 bp, Rattus norvegicus
ttgcgcactctgaggctagtgtccc

SEQ ID NO: 622922 - DNA, 25 bp, Rattus norvegicus
cccagggaccgagtcagagtcaagc

SEQ ID NO: 622923 - DNA, 25 bp, Rattus norvegicus
ctgttggtcgctgtgtgcgctgact

SEQ ID NO: 622924 - DNA, 25 bp, Rattus norvegicus
tgagcgatgtagtccttgaagggtc

SEQ ID NO: 622925 - DNA, 25 bp, Rattus norvegicus
cgcaggacccagattgtgtgtgttt

SEQ ID NO: 622926 - DNA, 25 bp, Rattus norvegicus
tcaagccgcaggacccagattgtgt

SEQ ID NO: 622927 - DNA, 25 bp, Rattus norvegicus
cgagtcagagtcaagccgcaggacc

SEQ ID NO: 622928 - DNA, 25 bp, Rattus norvegicus
cgctgtgtgcgctgacttgcgcact

SEQ ID NO: 622929 - DNA, 25 bp, Rattus norvegicus
atgcagattaacgtagcgcagaccc

SEQ ID NO: 622930 - DNA, 25 bp, Rattus norvegicus
atcgaggcgttgcaagagcagaacc

SEQ ID NO: 622931 - DNA, 25 bp, Rattus norvegicus
ggcccaggtgcagatcgaaatcgag

SEQ ID NO: 622932 - DNA, 25 bp, Rattus norvegicus
atcttctcaagtgccgggcccaggt

SEQ ID NO: 622933 - DNA, 25 bp, Rattus norvegicus
atggaccatcttctcaagtgccggg

SEQ ID NO: 622934 - DNA, 25 bp, Rattus norvegicus
gccacttgcttgtgtggaccgcccg

SEQ ID NO: 622935 - DNA, 25 bp, Rattus norvegicus
aagcgtttggcggacatggaccatc

SEQ ID NO: 622936 - DNA, 25 bp, Rattus norvegicus
ttgtcgggagctgccacttgcttgt

SEQ ID NO: 622937 - DNA, 25 bp, Rattus norvegicus
gcgcagacccaggtcaagcgactgg

SEQ ID NO: 622938 - DNA, 25 bp, Rattus norvegicus
cgagccaagctccagatgcagatta

SEQ ID NO: 622939 - DNA, 25 bp, Rattus norvegicus
cagctggagatgcttcgagccaagc

SEQ ID NO: 622940 - DNA, 25 bp, Rattus norvegicus
gctcctcccgcatggacagcgagga

SEQ ID NO: 622941 - DNA, 25 bp, Rattus norvegicus
gctcactcaatgaggggcgccggct

SEQ ID NO: 622942 - DNA, 25 bp, Rattus norvegicus
agcgactgggagacaagaagcgttt

SEQ ID NO: 622943 - DNA, 25 bp, Rattus norvegicus
atactcagcggagccggtgtcttgt

SEQ ID NO: 622944 - DNA, 25 bp, Rattus norvegicus
gccggtgtcttgtccgtctttctta

SEQ ID NO: 622945 - DNA, 25 bp, Rattus norvegicus
ctccaggacgccagaggcgcaagcg

SEQ ID NO: 622946 - DNA, 25 bp, Rattus norvegicus
ctgtcatactcagcggagccggtgt

SEQ ID NO: 622947 - DNA, 25 bp, Rattus norvegicus
cttgtccgtctttcttaggggcgtg

SEQ ID NO: 622948 - DNA, 25 bp, Rattus norvegicus
ctccgaggacatcgtggtaggctgc

SEQ ID NO: 622949 - DNA, 25 bp, Rattus norvegicus
ttcgtgaagtcggacgtggagatca

SEQ ID NO: 622950 - DNA, 25 bp, Rattus norvegicus
agtcggacgtggagatcaactactc

SEQ ID NO: 622951 - DNA, 25 bp, Rattus norvegicus
cgtggagatcaactactcgctcatc

SEQ ID NO: 622952 - DNA, 25 bp, Rattus norvegicus
cagagtcctccaggacgccagaggc

SEQ ID NO: 622953 - DNA, 25 bp, Rattus norvegicus
tactcgctcatcgaggtgaaccgcc

SEQ ID NO: 622954 - DNA, 25 bp, Rattus norvegicus
ctcatcgaggtgaaccgccgcgcgt

SEQ ID NO: 622955 - DNA, 25 bp, Rattus norvegicus
aggcgcaagcggctgtcatactcag

SEQ ID NO: 622956 - DNA, 25 bp, Rattus norvegicus
cgggtcctgggcttgtcagcccagc

SEQ ID NO: 622957 - DNA, 25 bp, Rattus norvegicus
ggcctaggcgcaagctccgcccaca

SEQ ID NO: 622958 - DNA, 25 bp, Rattus norvegicus
acagaagattctcgtcccgccctcg

SEQ ID NO: 622959 - DNA, 25 bp, Rattus norvegicus
agggcgccagatcggctcccaagag

SEQ ID NO: 622960 - DNA, 25 bp, Rattus norvegicus
cagagggcgccagatcggctcccaa

SEQ ID NO: 622961 - DNA, 25 bp, Rattus norvegicus
gctcctgagagcaagtgcagcctcc

SEQ ID NO: 622962 - DNA, 25 bp, Rattus norvegicus
tcccacttcgggtgctcactcccgg

SEQ ID NO: 622963 - DNA, 25 bp, Rattus norvegicus
cctgctcgtgctgctcaagctgcgg

SEQ ID NO: 622964 - DNA, 25 bp, Rattus norvegicus
tgctgtcctaccgaccgcccgcagc

SEQ ID NO: 622965 - DNA, 25 bp, Rattus norvegicus
cctgcaaccgtctacgctcgggatc

SEQ ID NO: 622966 - DNA, 25 bp, Rattus norvegicus
gcccttcgagtcaccctgcaaccgt

SEQ ID NO: 622967 - DNA, 25 bp, Rattus norvegicus
tctttgtctccttgggatcccgcgc

SEQ ID NO: 622968 - DNA, 25 bp, Rattus norvegicus
tcgtcctctttgtctccttgggatc

SEQ ID NO: 622969 - DNA, 25 bp, Rattus norvegicus
gcacctgctcgtgctgctcaagctg

SEQ ID NO: 622970 - DNA, 25 bp, Rattus norvegicus
agctctcgtcctctttgtctccttg

SEQ ID NO: 622971 - DNA, 25 bp, Rattus norvegicus
acccacagcaggagacccaggaaga

SEQ ID NO: 622972 - DNA, 25 bp, Rattus norvegicus
gaggctgagtccctcgcgacctttt

SEQ ID NO: 622973 - DNA, 25 bp, Rattus norvegicus
aaactctatctcctcgcagcgtgga

SEQ ID NO: 622974 - DNA, 25 bp, Rattus norvegicus
ccattccggatcaggctctgcggta

SEQ ID NO: 622975 - DNA, 25 bp, Rattus norvegicus
taagatcgctagtgcccatcgtgtc

SEQ ID NO: 622976 - DNA, 25 bp, Rattus norvegicus
aaccaagatgatccggtgagcccga

SEQ ID NO: 622977 - DNA, 25 bp, Rattus norvegicus
cgcgcgctcaccgatgaagaggatg

SEQ ID NO: 622978 - DNA, 25 bp, Rattus norvegicus
gagcagaaagacatgtggcaccaca

SEQ ID NO: 622979 - DNA, 25 bp, Rattus norvegicus
ggcaccacattgagcgcgtccacga

SEQ ID NO: 622980 - DNA, 25 bp, Rattus norvegicus
gcgtccacgaagcagccgttgttga

SEQ ID NO: 622981 - DNA, 25 bp, Rattus norvegicus
ccgttgttgaggacgccttggtcca

SEQ ID NO: 622982 - DNA, 25 bp, Rattus norvegicus
tggggtctcacccaatgcgcacgtg

SEQ ID NO: 622983 - DNA, 25 bp, Rattus norvegicus
cgtggatctgggattcccgaatgta

SEQ ID NO: 622984 - DNA, 25 bp, Rattus norvegicus
tctgcggtagcaaaacttggggatc

SEQ ID NO: 622985 - DNA, 25 bp, Rattus norvegicus
cgggcgagcacatgacaccttagca

SEQ ID NO: 622986 - DNA, 25 bp, Rattus norvegicus
gggtgccagcgccatttccgctgtc

SEQ ID NO: 622987 - DNA, 25 bp, Rattus norvegicus
aggctcaagactacccttccctggg

SEQ ID NO: 622988 - DNA, 25 bp, Rattus norvegicus
ctccaagctggacactctcaggctg

SEQ ID NO: 622989 - DNA, 25 bp, Rattus norvegicus
cgcacctgaggcagatcctggccaa

SEQ ID NO: 622990 - DNA, 25 bp, Rattus norvegicus
tcctggccaacgacaagtacgagaa

SEQ ID NO: 622991 - DNA, 25 bp, Rattus norvegicus
cgagaatggttacattcacccagtc

SEQ ID NO: 622992 - DNA, 25 bp, Rattus norvegicus
tcaacctggtgagtcctactgcgcc

SEQ ID NO: 622993 - DNA, 25 bp, Rattus norvegicus
tggctctctgcactgagcgccgcta

SEQ ID NO: 622994 - DNA, 25 bp, Rattus norvegicus
cgctagcccgcgaatgatttgtgca

SEQ ID NO: 622995 - DNA, 25 bp, Rattus norvegicus
tgtgcaagcttttgacgtggcaccc

SEQ ID NO: 622996 - DNA, 25 bp, Rattus norvegicus
tccgaggttattcagttggcaaaga

SEQ ID NO: 622997 - DNA, 25 bp, Rattus norvegicus
ttggcaaagacctgcgatccctgcg

SEQ ID NO: 622998 - DNA, 25 bp, Rattus norvegicus
cctagcatctctgggtacctcggcg

SEQ ID NO: 622999 - DNA, 25 bp, Rattus norvegicus
atttgaggatcaagctggaagggct

SEQ ID NO: 623000 - DNA, 25 bp, Rattus norvegicus
tgggtcacaccaaccaagaagctgc

SEQ ID NO: 623001 - DNA, 25 bp, Rattus norvegicus
cgcctgcatgcacgcgtcgccatgg

SEQ ID NO: 623002 - DNA, 25 bp, Rattus norvegicus
cacgagagtctttcacgcgtggatc

SEQ ID NO: 623003 - DNA, 25 bp, Rattus norvegicus
tctttcacgcgtggatctgagacta

SEQ ID NO: 623004 - DNA, 25 bp, Rattus norvegicus
agggtttcgagaactactaaatctg

SEQ ID NO: 623005 - DNA, 25 bp, Rattus norvegicus
tcgagaactactaaatctgggagcc

SEQ ID NO: 623006 - DNA, 25 bp, Rattus norvegicus
actaaatctgggagccgaaggtgtg

SEQ ID NO: 623007 - DNA, 25 bp, Rattus norvegicus
aagggctgggactgaaaacgagact

SEQ ID NO: 623008 - DNA, 25 bp, Rattus norvegicus
tgggactgaaaacgagactcggtct

SEQ ID NO: 623009 - DNA, 25 bp, Rattus norvegicus
actcggtctcgcaggatgtggaaaa

SEQ ID NO: 623010 - DNA, 25 bp, Rattus norvegicus
tctcgcaggatgtggaaaagacccg

SEQ ID NO: 623011 - DNA, 25 bp, Rattus norvegicus
tcccgcctggatttgaggatcaagc

SEQ ID NO: 623012 - DNA, 25 bp, Rattus norvegicus
tggggaacagctcccgcctggattt

SEQ ID NO: 623013 - DNA, 25 bp, Rattus norvegicus
ctgcggctgttgctgatggccaccg

SEQ ID NO: 623014 - DNA, 25 bp, Rattus norvegicus
gggccttgtaggcagtcatgaagat

SEQ ID NO: 623015 - DNA, 25 bp, Rattus norvegicus
cagtcatgaagatgcttagagtcca

SEQ ID NO: 623016 - DNA, 25 bp, Rattus norvegicus
tgaagatgcttagagtccaggttgg

SEQ ID NO: 623017 - DNA, 25 bp, Rattus norvegicus
aaggattatgggcagtggccgcacc

SEQ ID NO: 623018 - DNA, 25 bp, Rattus norvegicus
gcacaggctcagtggccttccgctg

SEQ ID NO: 623019 - DNA, 25 bp, Rattus norvegicus
atggccaccggctgcgcgagcctga

SEQ ID NO: 623020 - DNA, 25 bp, Rattus norvegicus
agtacggctgctgggatagccatcc

SEQ ID NO: 623021 - DNA, 25 bp, Rattus norvegicus
tagccatccgaagggtctcactgtg

SEQ ID NO: 623022 - DNA, 25 bp, Rattus norvegicus
gtctcactgtgttgagggtcaatta

SEQ ID NO: 623023 - DNA, 25 bp, Rattus norvegicus
ttgagggtcaattacaggccacttg

SEQ ID NO: 623024 - DNA, 25 bp, Rattus norvegicus
ggccacttgattgtgtgttcttgta

SEQ ID NO: 623025 - DNA, 25 bp, Rattus norvegicus
tgtgttcttgtattgtgtagaagtc

SEQ ID NO: 623026 - DNA, 25 bp, Rattus norvegicus
ttgtgtagaagtcactatgggtagt

SEQ ID NO: 623027 - DNA, 25 bp, Rattus norvegicus
gtgaacgaggccttcgagaccctta

SEQ ID NO: 623028 - DNA, 25 bp, Rattus norvegicus
cgctacattgaaggtctgcaggctc

SEQ ID NO: 623029 - DNA, 25 bp, Rattus norvegicus
tgcgcaacgccatccgctacattga

SEQ ID NO: 623030 - DNA, 25 bp, Rattus norvegicus
acccaaggtggagatcctgcgcaac

SEQ ID NO: 623031 - DNA, 25 bp, Rattus norvegicus
tcgagacccttaagcgctgcacgtc

SEQ ID NO: 623032 - DNA, 25 bp, Rattus norvegicus
cactaacgctgatcgccgcaaggca

SEQ ID NO: 623033 - DNA, 25 bp, Rattus norvegicus
ggcgtgcaagcgcaagaccactaac

SEQ ID NO: 623034 - DNA, 25 bp, Rattus norvegicus
ctgcgcttttttgaggacctggacc

SEQ ID NO: 623035 - DNA, 25 bp, Rattus norvegicus
atgatccgtgtttcgactcaccaga

SEQ ID NO: 623036 - DNA, 25 bp, Rattus norvegicus
actacagcggcgactcagacgcgtc

SEQ ID NO: 623037 - DNA, 25 bp, Rattus norvegicus
tttgcgacagccgatgacttctatg

SEQ ID NO: 623038 - DNA, 25 bp, Rattus norvegicus
ccactccgggacacagacttgctag

SEQ ID NO: 623039 - DNA, 25 bp, Rattus norvegicus
ggctctctctgctcctttgcgacag

SEQ ID NO: 623040 - DNA, 25 bp, Rattus norvegicus
cgaaccagcggctacccaaggtgga

SEQ ID NO: 623041 - DNA, 25 bp, Rattus norvegicus
agcttcacccgccaccgaggggagt

SEQ ID NO: 623042 - DNA, 25 bp, Rattus norvegicus
ccgccaagcaaaacgggctgagaga

SEQ ID NO: 623043 - DNA, 25 bp, Rattus norvegicus
agtgtgtgtgcttcgtgctctccgt

SEQ ID NO: 623044 - DNA, 25 bp, Rattus norvegicus
aggggacctgccatctcctccggga

SEQ ID NO: 623045 - DNA, 25 bp, Rattus norvegicus
taggcagacaagcaaggagatccga

SEQ ID NO: 623046 - DNA, 25 bp, Rattus norvegicus
agatccgaaggggatcggtcacgca

SEQ ID NO: 623047 - DNA, 25 bp, Rattus norvegicus
ggaggagagcaagccgcatccgtcc

SEQ ID NO: 623048 - DNA, 25 bp, Rattus norvegicus
agccaagcgcggatttctcgtaacc

SEQ ID NO: 623049 - DNA, 25 bp, Rattus norvegicus
ctaaaaagctttgtgtcgatttctc

SEQ ID NO: 623050 - DNA, 25 bp, Rattus norvegicus
gtcgatttctccatttttcccgctg

SEQ ID NO: 623051 - DNA, 25 bp, Rattus norvegicus
atttttcccgctgagatggtaccgg

SEQ ID NO: 623052 - DNA, 25 bp, Rattus norvegicus
cctctcacactaggcgccttaaaga

SEQ ID NO: 623053 - DNA, 25 bp, Rattus norvegicus
ttaaagaccctaaggagcccgcgca

SEQ ID NO: 623054 - DNA, 25 bp, Rattus norvegicus
tgagagaacctacgctcggcccagc

SEQ ID NO: 623055 - DNA, 25 bp, Rattus norvegicus
ccgccttgcgctcccgcagatgggt

SEQ ID NO: 623056 - DNA, 25 bp, Rattus norvegicus
tcctcttatcaaccggggagtacgc

SEQ ID NO: 623057 - DNA, 25 bp, Rattus norvegicus
gaggatctcggagctctctgcattg

SEQ ID NO: 623058 - DNA, 25 bp, Rattus norvegicus
gagctctctgcattggccgggcccg

SEQ ID NO: 623059 - DNA, 25 bp, Rattus norvegicus
tgagaaagggtatgtagaggatctc

SEQ ID NO: 623060 - DNA, 25 bp, Rattus norvegicus
gccgcgctggcgaacgaagactgcc

SEQ ID NO: 623061 - DNA, 25 bp, Rattus norvegicus
atcaaccggggagtacgcgtgcccg

SEQ ID NO: 623062 - DNA, 25 bp, Rattus norvegicus
cgagagatacggaccctgcttcctc

SEQ ID NO: 623063 - DNA, 25 bp, Rattus norvegicus
ccgcgagagatacggaccctgcttc

SEQ ID NO: 623064 - DNA, 25 bp, Rattus norvegicus
ggcctgccctttacccgctcgggca

SEQ ID NO: 623065 - DNA, 25 bp, Rattus norvegicus
tcgggcacccgcgagagatacggac

SEQ ID NO: 623066 - DNA, 25 bp, Rattus norvegicus
cactcccgatgagggcctgcccttt

SEQ ID NO: 623067 - DNA, 25 bp, Rattus norvegicus
tagaccaggccctcactcccgatga

SEQ ID NO: 623068 - DNA, 25 bp, Rattus norvegicus
cccgcctggtggaggaatgagaaag

SEQ ID NO: 623069 - DNA, 25 bp, Rattus norvegicus
cggagccacgtacccaggcgaagag

SEQ ID NO: 623070 - DNA, 25 bp, Rattus norvegicus
tacccaggcgaagagcacggcagcg

SEQ ID NO: 623071 - DNA, 25 bp, Rattus norvegicus
cgtacccaggcgaagagcacggcag

SEQ ID NO: 623072 - DNA, 25 bp, Rattus norvegicus
acgtacccaggcgaagagcacggca

SEQ ID NO: 623073 - DNA, 25 bp, Rattus norvegicus
gccacgtacccaggcgaagagcacg

SEQ ID NO: 623074 - DNA, 25 bp, Rattus norvegicus
caccaccggcgcttccgggagggct

SEQ ID NO: 623075 - DNA, 25 bp, Rattus norvegicus
agacagcctccgaggcgcaggactc

SEQ ID NO: 623076 - DNA, 25 bp, Rattus norvegicus
gagccacgtacccaggcgaagagca

SEQ ID NO: 623077 - DNA, 25 bp, Rattus norvegicus
aggcgcaggactcccgcgccatgca

SEQ ID NO: 623078 - DNA, 25 bp, Rattus norvegicus
gcggagccacgtacccaggcgaaga

SEQ ID NO: 623079 - DNA, 25 bp, Rattus norvegicus
cgcgccccttagtctctgccggagt

SEQ ID NO: 623080 - DNA, 25 bp, Rattus norvegicus
tgcacacgcaccaccggcgcttccg

SEQ ID NO: 623081 - DNA, 25 bp, Rattus norvegicus
cgcgccatgcacacgcaccaccggc

SEQ ID NO: 623082 - DNA, 25 bp, Rattus norvegicus
ctaggaggcgggacgagttcgggag

SEQ ID NO: 623083 - DNA, 25 bp, Rattus norvegicus
ctccggtcgaatggccggcctgtgc

SEQ ID NO: 623084 - DNA, 25 bp, Rattus norvegicus
cactccggtcgaatggccggcctgt

SEQ ID NO: 623085 - DNA, 25 bp, Rattus norvegicus
attgcactccggtcgaatggccggc

SEQ ID NO: 623086 - DNA, 25 bp, Rattus norvegicus
ctatgctggcttcgcttgtggtcac

SEQ ID NO: 623087 - DNA, 25 bp, Rattus norvegicus
tgccggctatgctggcttcgcttgt

SEQ ID NO: 623088 - DNA, 25 bp, Rattus norvegicus
gcttcgcttgtggtcactttgagta

SEQ ID NO: 623089 - DNA, 25 bp, Rattus norvegicus
tcgcttgtggtcactttgagtatcc

SEQ ID NO: 623090 - DNA, 25 bp, Rattus norvegicus
ttgtggtcactttgagtatccctgg

SEQ ID NO: 623091 - DNA, 25 bp, Rattus norvegicus
gtcactttgagtatccctggaacgc

SEQ ID NO: 623092 - DNA, 25 bp, Rattus norvegicus
cactttgagtatccctggaacgcag

SEQ ID NO: 623093 - DNA, 25 bp, Rattus norvegicus
gggcacggccggctagtatccattt

SEQ ID NO: 623094 - DNA, 25 bp, Rattus norvegicus
acggccggctagtatccatttggtg

SEQ ID NO: 623095 - DNA, 25 bp, Rattus norvegicus
ggcctgtgccggctatgctggcttc

SEQ ID NO: 623096 - DNA, 25 bp, Rattus norvegicus
ctggcttcgcttgtggtcactttga

SEQ ID NO: 623097 - DNA, 25 bp, Rattus norvegicus
ggagttcagagggtcacctgcggac

SEQ ID NO: 623098 - DNA, 25 bp, Rattus norvegicus
tgccgcgagacctctgatccggggt

SEQ ID NO: 623099 - DNA, 25 bp, Rattus norvegicus
cgagacctctgatccggggtcccgg

SEQ ID NO: 623100 - DNA, 25 bp, Rattus norvegicus
cctcttataggagaagcgcatcctc

SEQ ID NO: 623101 - DNA, 25 bp, Rattus norvegicus
ccgcctcttataggagaagcgcatc

SEQ ID NO: 623102 - DNA, 25 bp, Rattus norvegicus
agcgcatcctcagaatggccaatgg

SEQ ID NO: 623103 - DNA, 25 bp, Rattus norvegicus
gcggacgggagctgccgcctcttat

SEQ ID NO: 623104 - DNA, 25 bp, Rattus norvegicus
ggagctgccgcctcttataggagaa

SEQ ID NO: 623105 - DNA, 25 bp, Rattus norvegicus
aggagaagcgcatcctcagaatggc

SEQ ID NO: 623106 - DNA, 25 bp, Rattus norvegicus
catcctcagaatggccaatgggcgc

SEQ ID NO: 623107 - DNA, 25 bp, Rattus norvegicus
caggggaaggcagctaatgaggatg

SEQ ID NO: 623108 - DNA, 25 bp, Rattus norvegicus
cctgcactgacctcttagtcgctga

SEQ ID NO: 623109 - DNA, 25 bp, Rattus norvegicus
tgacctcttagtcgctgacctcagc

SEQ ID NO: 623110 - DNA, 25 bp, Rattus norvegicus
ttagtcgctgacctcagcccaggcg

SEQ ID NO: 623111 - DNA, 25 bp, Rattus norvegicus
gcgtgatcgggaacctgcaggatcc

SEQ ID NO: 623112 - DNA, 25 bp, Rattus norvegicus
cgccgaagagccagtgcttgctgta

SEQ ID NO: 623113 - DNA, 25 bp, Rattus norvegicus
aggagacgggttgcgatccatgcca

SEQ ID NO: 623114 - DNA, 25 bp, Rattus norvegicus
ctgcagtcagactcccgcgtgatcg

SEQ ID NO: 623115 - DNA, 25 bp, Rattus norvegicus
gaggacgcgccagagagcccaacgc

SEQ ID NO: 623116 - DNA, 25 bp, Rattus norvegicus
agcgcgcgccaacagaaccggaagc

SEQ ID NO: 623117 - DNA, 25 bp, Rattus norvegicus
ggttgcgatccatgccagcgcgcgc

SEQ ID NO: 623118 - DNA, 25 bp, Rattus norvegicus
tgcgtggtgtagttctggcaagtta

SEQ ID NO: 623119 - DNA, 25 bp, Rattus norvegicus
atcttcctgatcacagctaggcggc

SEQ ID NO: 623120 - DNA, 25 bp, Rattus norvegicus
agtgcttgctgtagaccgtgttgcc

SEQ ID NO: 623121 - DNA, 25 bp, Rattus norvegicus
tctggcaagttagtaaatcggcacc

SEQ ID NO: 623122 - DNA, 25 bp, Rattus norvegicus
atgagcccgctaaggacgccgaaga

SEQ ID NO: 623123 - DNA, 25 bp, Rattus norvegicus
tagtaaatcggcacccgcgaacttc

SEQ ID NO: 623124 - DNA, 25 bp, Rattus norvegicus
accgtgttgccgatgcggtctccac

SEQ ID NO: 623125 - DNA, 25 bp, Rattus norvegicus
acggcacttccttgtcacgtgacgg

SEQ ID NO: 623126 - DNA, 25 bp, Rattus norvegicus
tgtcatttccggtcacgtgccctca

SEQ ID NO: 623127 - DNA, 25 bp, Rattus norvegicus
gctcttcgctgtagtagtctccacg

SEQ ID NO: 623128 - DNA, 25 bp, Rattus norvegicus
ggcagcgcggattgagctcttcgct

SEQ ID NO: 623129 - DNA, 25 bp, Rattus norvegicus
cctggtaagttcagaccgaagaatg

SEQ ID NO: 623130 - DNA, 25 bp, Rattus norvegicus
gagacagtagctcccacctggtaag

SEQ ID NO: 623131 - DNA, 25 bp, Rattus norvegicus
gatccgacaggacgcggttcacgca

SEQ ID NO: 623132 - DNA, 25 bp, Rattus norvegicus
ggcgagccaaactgaatcccgaaac

SEQ ID NO: 623133 - DNA, 25 bp, Rattus norvegicus
ctctctagggagaaaggcgagccaa

SEQ ID NO: 623134 - DNA, 25 bp, Rattus norvegicus
atccggaccggatgctctctaggga

SEQ ID NO: 623135 - DNA, 25 bp, Rattus norvegicus
ggacgcatcatcgatccggaccgga

SEQ ID NO: 623136 - DNA, 25 bp, Rattus norvegicus
ctccctgcggcctgcagtcagagaa

SEQ ID NO: 623137 - DNA, 25 bp, Rattus norvegicus
ctccgccactcgagaccgaagagga

SEQ ID NO: 623138 - DNA, 25 bp, Rattus norvegicus
gggaaagcgctgttaacggcacttc

SEQ ID NO: 623139 - DNA, 25 bp, Rattus norvegicus
tgggttcccgcacgtccgctgggct

SEQ ID NO: 623140 - DNA, 25 bp, Rattus norvegicus
cctgaaggtcgggagccaccgaaca

SEQ ID NO: 623141 - DNA, 25 bp, Rattus norvegicus
tcagacctgggcacgcgtgggctac

SEQ ID NO: 623142 - DNA, 25 bp, Rattus norvegicus
aagcggtacggtcgggacccatgct

SEQ ID NO: 623143 - DNA, 25 bp, Rattus norvegicus
ccatcgtgcactaagcggtacggtc

SEQ ID NO: 623144 - DNA, 25 bp, Rattus norvegicus
tggagccactgtcgccgatctcgcg

SEQ ID NO: 623145 - DNA, 25 bp, Rattus norvegicus
cagctctgcgtgctggagccactgt

SEQ ID NO: 623146 - DNA, 25 bp, Rattus norvegicus
ctgggcttccactctgacgtcagca

SEQ ID NO: 623147 - DNA, 25 bp, Rattus norvegicus
ctactgtgctctggggaacggagca

SEQ ID NO: 623148 - DNA, 25 bp, Rattus norvegicus
caccgaacagggaccagagagccgt

SEQ ID NO: 623149 - DNA, 25 bp, Rattus norvegicus
ggggccgaaagagcctcagcccgtc

SEQ ID NO: 623150 - DNA, 25 bp, Rattus norvegicus
attaagagccttcgtgcggtttgca

SEQ ID NO: 623151 - DNA, 25 bp, Rattus norvegicus
ttgcattttcccttgcgtgggctcg

SEQ ID NO: 623152 - DNA, 25 bp, Rattus norvegicus
gacgtcagcacggagcttccattta

SEQ ID NO: 623153 - DNA, 25 bp, Rattus norvegicus
tagaacccttgcaggggccgtctgc

SEQ ID NO: 623154 - DNA, 25 bp, Rattus norvegicus
agcgggcgtcgcatcccgcggccca

SEQ ID NO: 623155 - DNA, 25 bp, Rattus norvegicus
ggagagcatggtggagggaaaaacc

SEQ ID NO: 623156 - DNA, 25 bp, Rattus norvegicus
cccagcctcgccgggattgagggca

SEQ ID NO: 623157 - DNA, 25 bp, Rattus norvegicus
aagaaggagacaccgagctggagcc

SEQ ID NO: 623158 - DNA, 25 bp, Rattus norvegicus
gcagcgaagaaggagacaccgagct

SEQ ID NO: 623159 - DNA, 25 bp, Rattus norvegicus
gcaaggcagcgaagaaggagacacc

SEQ ID NO: 623160 - DNA, 25 bp, Rattus norvegicus
acctcgggatttgtgcgccgggcta

SEQ ID NO: 623161 - DNA, 25 bp, Rattus norvegicus
gggccgtctgcaggcgccctatgca

SEQ ID NO: 623162 - DNA, 25 bp, Rattus norvegicus
cactagaacccttgcaggggccgtc

SEQ ID NO: 623163 - DNA, 25 bp, Rattus norvegicus
ggaaaaaccggagctggagctcagt

SEQ ID NO: 623164 - DNA, 25 bp, Rattus norvegicus
cacacctccctcacctcgcgcacct

SEQ ID NO: 623165 - DNA, 25 bp, Rattus norvegicus
acgcgccgcacctcgggatttgtgc

SEQ ID NO: 623166 - DNA, 25 bp, Rattus norvegicus
gaggaaaccagtcccgagcccagga

SEQ ID NO: 623167 - DNA, 25 bp, Rattus norvegicus
aaccctgcgctctcgagggcagtgg

SEQ ID NO: 623168 - DNA, 25 bp, Rattus norvegicus
cctgaccttggaggtgtgagtctgg

SEQ ID NO: 623169 - DNA, 25 bp, Rattus norvegicus
tgtgagtctgggaaccctgcgctct

SEQ ID NO: 623170 - DNA, 25 bp, Rattus norvegicus
agtctgggaaccctgcgctctcgag

SEQ ID NO: 623171 - DNA, 25 bp, Rattus norvegicus
cccgtctctgctgccgccttgcatc

SEQ ID NO: 623172 - DNA, 25 bp, Rattus norvegicus
gccttgcatcgctcctctccctatc

SEQ ID NO: 623173 - DNA, 25 bp, Rattus norvegicus
caagaacacttaactgcgacgagga

SEQ ID NO: 623174 - DNA, 25 bp, Rattus norvegicus
acacttaactgcgacgaggagattc

SEQ ID NO: 623175 - DNA, 25 bp, Rattus norvegicus
gcgacgaggagattcgtttccaaac

SEQ ID NO: 623176 - DNA, 25 bp, Rattus norvegicus
aaccaccgcatcctgaccttggagg

SEQ ID NO: 623177 - DNA, 25 bp, Rattus norvegicus
gtggaaccaccgcatcctgaccttg

SEQ ID NO: 623178 - DNA, 25 bp, Rattus norvegicus
cttgtgtggaaccaccgcatcctga

SEQ ID NO: 623179 - DNA, 25 bp, Rattus norvegicus
gcgagccgcttgtgtggaaccaccg

SEQ ID NO: 623180 - DNA, 25 bp, Rattus norvegicus
taactgcgacgaggagattcgtttc

SEQ ID NO: 623181 - DNA, 25 bp, Rattus norvegicus
cacctactggcgctcggaaggtcct

SEQ ID NO: 623182 - DNA, 25 bp, Rattus norvegicus
cccaggagttgcttttaggtgacga

SEQ ID NO: 623183 - DNA, 25 bp, Rattus norvegicus
agctcgtggacattctagacccagg

SEQ ID NO: 623184 - DNA, 25 bp, Rattus norvegicus
ggctcgcgtcactcacggaactagc

SEQ ID NO: 623185 - DNA, 25 bp, Rattus norvegicus
tgctagcgagctttgccacctactg

SEQ ID NO: 623186 - DNA, 25 bp, Rattus norvegicus
gacccttaagaatcccggcctgcta

SEQ ID NO: 623187 - DNA, 25 bp, Rattus norvegicus
tggtgcagatgttggttatcctttc

SEQ ID NO: 623188 - DNA, 25 bp, Rattus norvegicus
tgagctcggatctgttccacaggtg

SEQ ID NO: 623189 - DNA, 25 bp, Rattus norvegicus
tcacttccagggacgctggtctgcg

SEQ ID NO: 623190 - DNA, 25 bp, Rattus norvegicus
ttcttcagctgactctcggacaccg

SEQ ID NO: 623191 - DNA, 25 bp, Rattus norvegicus
gcgggctcaccttggacatcatctt

SEQ ID NO: 623192 - DNA, 25 bp, Rattus norvegicus
cctagcccgcgggtacgtctagtag

SEQ ID NO: 623193 - DNA, 25 bp, Rattus norvegicus
gaaggtggcctcaacctagcccgcg

SEQ ID NO: 623194 - DNA, 25 bp, Rattus norvegicus
gcccgcaggacaagacggcaactgg

SEQ ID NO: 623195 - DNA, 25 bp, Rattus norvegicus
gcgctgcagccgaatacaatatatg

SEQ ID NO: 623196 - DNA, 25 bp, Rattus norvegicus
tgttgctcgctgagcctaagctcta

SEQ ID NO: 623197 - DNA, 25 bp, Rattus norvegicus
ctgagcctaagctctactgactggc

SEQ ID NO: 623198 - DNA, 25 bp, Rattus norvegicus
taagctctactgactggcttgcctt

SEQ ID NO: 623199 - DNA, 25 bp, Rattus norvegicus
actggcttgccttggtggcccttct

SEQ ID NO: 623200 - DNA, 25 bp, Rattus norvegicus
acttccggcgccttctaatgccgtg

SEQ ID NO: 623201 - DNA, 25 bp, Rattus norvegicus
acacaaaactcagcgactccgcagc

SEQ ID NO: 623202 - DNA, 25 bp, Rattus norvegicus
ggcgccttctaatgccgtgtaccgc

SEQ ID NO: 623203 - DNA, 25 bp, Rattus norvegicus
cgcagcgctcgcgagtatttgcgca

SEQ ID NO: 623204 - DNA, 25 bp, Rattus norvegicus
gccgaatacaatatatgtgtatgtg

SEQ ID NO: 623205 - DNA, 25 bp, Rattus norvegicus
cgagtcttgttgctcgctgagccta

SEQ ID NO: 623206 - DNA, 25 bp, Rattus norvegicus
gcgcaacttccgctttcggaggtaa

SEQ ID NO: 623207 - DNA, 25 bp, Rattus norvegicus
ctcgcgagtatttgcgcaacttccg

SEQ ID NO: 623208 - DNA, 25 bp, Rattus norvegicus
tccgctttcggaggtaagacacgta

SEQ ID NO: 623209 - DNA, 25 bp, Rattus norvegicus
gaaaacattgtgcacgtgactcgga

SEQ ID NO: 623210 - DNA, 25 bp, Rattus norvegicus
atccatgtgtgtctggagcgggtct

SEQ ID NO: 623211 - DNA, 25 bp, Rattus norvegicus
tgggccctcagagaagcattcgaga

SEQ ID NO: 623212 - DNA, 25 bp, Rattus norvegicus
gcgtgactctgttgatccatgtgtg

SEQ ID NO: 623213 - DNA, 25 bp, Rattus norvegicus
tgactcggaagcgtgactctgttga

SEQ ID NO: 623214 - DNA, 25 bp, Rattus norvegicus
tcacgttccgggatgccctggcacg

SEQ ID NO: 623215 - DNA, 25 bp, Rattus norvegicus
gcgcgggaggtattgtgcttcaccc

SEQ ID NO: 623216 - DNA, 25 bp, Rattus norvegicus
tgacgtcgtcgggttcacagacagt

SEQ ID NO: 623217 - DNA, 25 bp, Rattus norvegicus
caaggcagcggcaagccgggcaacc

SEQ ID NO: 623218 - DNA, 25 bp, Rattus norvegicus
gttcacagacagtactccaagcgcc

SEQ ID NO: 623219 - DNA, 25 bp, Rattus norvegicus
ccagctttgttcagtcgtctgctca

SEQ ID NO: 623220 - DNA, 25 bp, Rattus norvegicus
tcgtctgctcacctagctctgggtg

SEQ ID NO: 623221 - DNA, 25 bp, Rattus norvegicus
ccgccatggtgtctccggtcactgt

SEQ ID NO: 623222 - DNA, 25 bp, Rattus norvegicus
gcctccctaagaggcgtggcctttc

SEQ ID NO: 623223 - DNA, 25 bp, Rattus norvegicus
cctatgccaaggttgcctggactga

SEQ ID NO: 623224 - DNA, 25 bp, Rattus norvegicus
gagatgtcaatttcactgcccgccc

SEQ ID NO: 623225 - DNA, 25 bp, Rattus norvegicus
tgggttggaggagatgtcaatttca

SEQ ID NO: 623226 - DNA, 25 bp, Rattus norvegicus
atccgccgcaactctgtgcggagtc

SEQ ID NO: 623227 - DNA, 25 bp, Rattus norvegicus
ttaacatcggatcccatctcctgtg

SEQ ID NO: 623228 - DNA, 25 bp, Rattus norvegicus
tcggggctgcgcgactacggcaacc

SEQ ID NO: 623229 - DNA, 25 bp, Rattus norvegicus
gggagcgccgcatccatttcattca

SEQ ID NO: 623230 - DNA, 25 bp, Rattus norvegicus
gtggaccacagacccttaacatcgg

SEQ ID NO: 623231 - DNA, 25 bp, Rattus norvegicus
ctccggcatcgcctagagctctagg

SEQ ID NO: 623232 - DNA, 25 bp, Rattus norvegicus
cacagctgccgggtccgtttggcac

SEQ ID NO: 623233 - DNA, 25 bp, Rattus norvegicus
cctggactacagagtcgcgggcaca

SEQ ID NO: 623234 - DNA, 25 bp, Rattus norvegicus
ggtctgtccgcggagtcctcagtcc

SEQ ID NO: 623235 - DNA, 25 bp, Rattus norvegicus
agtgtgcgtgtctgcgtgtgtccct

SEQ ID NO: 623236 - DNA, 25 bp, Rattus norvegicus
gccgcatccatttcattcatgattt

SEQ ID NO: 623237 - DNA, 25 bp, Rattus norvegicus
ctaggaaagatgctggctgtccttt

SEQ ID NO: 623238 - DNA, 25 bp, Rattus norvegicus
attggcttctcgtggcggattggca

SEQ ID NO: 623239 - DNA, 25 bp, Rattus norvegicus
gattggcagctctaggatgcgcgca

SEQ ID NO: 623240 - DNA, 25 bp, Rattus norvegicus
gcggccgccactttgcgtaggagct

SEQ ID NO: 623241 - DNA, 25 bp, Rattus norvegicus
gccactttgcgtaggagctgcggcc

SEQ ID NO: 623242 - DNA, 25 bp, Rattus norvegicus
caagtcccggtcaggtgaggcgatt

SEQ ID NO: 623243 - DNA, 25 bp, Rattus norvegicus
tcccggtcaggtgaggcgattccgc

SEQ ID NO: 623244 - DNA, 25 bp, Rattus norvegicus
cttggccacactaggaaagatgctg

SEQ ID NO: 623245 - DNA, 25 bp, Rattus norvegicus
gctgtccttttgaggtagccgcaaa

SEQ ID NO: 623246 - DNA, 25 bp, Rattus norvegicus
tactcctgccgcctccattgggcgg

SEQ ID NO: 623247 - DNA, 25 bp, Rattus norvegicus
aagcgaggccgggtactcctgccgc

SEQ ID NO: 623248 - DNA, 25 bp, Rattus norvegicus
cagggtgtcgcgcaccggcgcctta

SEQ ID NO: 623249 - DNA, 25 bp, Rattus norvegicus
tagccgcaaagcgaggccgggtact

SEQ ID NO: 623250 - DNA, 25 bp, Rattus norvegicus
tgggccttggccacactaggaaaga

SEQ ID NO: 623251 - DNA, 25 bp, Rattus norvegicus
caggctctctagtacattcacgatg

SEQ ID NO: 623252 - DNA, 25 bp, Rattus norvegicus
cgatgtcataaatccgccgacgttc

SEQ ID NO: 623253 - DNA, 25 bp, Rattus norvegicus
cgccgacgttcgacatctgccaaga

SEQ ID NO: 623254 - DNA, 25 bp, Rattus norvegicus
gggccaagaaagaagcggctctctc

SEQ ID NO: 623255 - DNA, 25 bp, Rattus norvegicus
gcaggcgtaccttaataatacagta

SEQ ID NO: 623256 - DNA, 25 bp, Rattus norvegicus
agtgcaatggcgcttcctaccagtg

SEQ ID NO: 623257 - DNA, 25 bp, Rattus norvegicus
agaaggcacacactttcaccgcatg

SEQ ID NO: 623258 - DNA, 25 bp, Rattus norvegicus
cggctcaccatgtgcaggctctcta

SEQ ID NO: 623259 - DNA, 25 bp, Rattus norvegicus
tcaccgcatgttcgcagtgcaatgg

SEQ ID NO: 623260 - DNA, 25 bp, Rattus norvegicus
cctaccagtgagcaggcgtacctta

SEQ ID NO: 623261 - DNA, 25 bp, Rattus norvegicus
aacaagtgcacaccgcgagcgctgc

SEQ ID NO: 623262 - DNA, 25 bp, Rattus norvegicus
gccgtgccaagtgtacctgtttttg

SEQ ID NO: 623263 - DNA, 25 bp, Rattus norvegicus
aatacagtaacaagtgcacaccgcg

SEQ ID NO: 623264 - DNA, 25 bp, Rattus norvegicus
ctgtttttggcgaggcggctcacca

SEQ ID NO: 623265 - DNA, 25 bp, Rattus norvegicus
cgtagcctgtgtctcttcctaagga

SEQ ID NO: 623266 - DNA, 25 bp, Rattus norvegicus
agagcggccaccagctcgctttgta

SEQ ID NO: 623267 - DNA, 25 bp, Rattus norvegicus
agctcgctttgtacttgcggccaag

SEQ ID NO: 623268 - DNA, 25 bp, Rattus norvegicus
ggtgatcgactgtcacgcccagaca

SEQ ID NO: 623269 - DNA, 25 bp, Rattus norvegicus
gcgttttcagagtgacagccgcctc

SEQ ID NO: 623270 - DNA, 25 bp, Rattus norvegicus
ctcgcggttgagacatcttgggctc

SEQ ID NO: 623271 - DNA, 25 bp, Rattus norvegicus
cctccgctcttttgctcgaagattc

SEQ ID NO: 623272 - DNA, 25 bp, Rattus norvegicus
tcgaagattcacaccggcaggctcc

SEQ ID NO: 623273 - DNA, 25 bp, Rattus norvegicus
aaggagccttctcacttcggagacg

SEQ ID NO: 623274 - DNA, 25 bp, Rattus norvegicus
tcggagacgcaatgacaagttaata

SEQ ID NO: 623275 - DNA, 25 bp, Rattus norvegicus
acaagttaatatgggcgtccacgcc

SEQ ID NO: 623276 - DNA, 25 bp, Rattus norvegicus
gtttcccaggagaagaattgccaga

SEQ ID NO: 623277 - DNA, 25 bp, Rattus norvegicus
ggcaggcgcactcactggatttccc

SEQ ID NO: 623278 - DNA, 25 bp, Rattus norvegicus
ttcttccactgttggtgggcgcctc

SEQ ID NO: 623279 - DNA, 25 bp, Rattus norvegicus
gggtggacggagaaatacgacttca

SEQ ID NO: 623280 - DNA, 25 bp, Rattus norvegicus
tgccaacagctcctcgccgggaagg

SEQ ID NO: 623281 - DNA, 25 bp, Rattus norvegicus
atgcggaccatgacaattcttgcta

SEQ ID NO: 623282 - DNA, 25 bp, Rattus norvegicus
gtgcgtagtgtcaagcagtcactgc

SEQ ID NO: 623283 - DNA, 25 bp, Rattus norvegicus
cactgcttgtgctaaatggggtatc

SEQ ID NO: 623284 - DNA, 25 bp, Rattus norvegicus
tcgtgaatgttgtacgcctcgcaac

SEQ ID NO: 623285 - DNA, 25 bp, Rattus norvegicus
tgcaccaactctgtgggaaacggcg

SEQ ID NO: 623286 - DNA, 25 bp, Rattus norvegicus
ctacctggaaaataggaggatctga

SEQ ID NO: 623287 - DNA, 25 bp, Rattus norvegicus
ttggaacgagccttcgaagtatgga

SEQ ID NO: 623288 - DNA, 25 bp, Rattus norvegicus
ctctgcagcaaagccggcgaagttt

SEQ ID NO: 623289 - DNA, 25 bp, Rattus norvegicus
tgcttgatcactgcgtagcgcgtca

SEQ ID NO: 623290 - DNA, 25 bp, Rattus norvegicus
acggtgctgagacctttgtggcgaa

SEQ ID NO: 623291 - DNA, 25 bp, Rattus norvegicus
gctggccaattggtcacggtgctga

SEQ ID NO: 623292 - DNA, 25 bp, Rattus norvegicus
gggtatcaaattggcgcgacggatt

SEQ ID NO: 623293 - DNA, 25 bp, Rattus norvegicus
accttgcaagcgctggctgcctcag

SEQ ID NO: 623294 - DNA, 25 bp, Rattus norvegicus
aagtagcgttcaaccttgcaagcgc

SEQ ID NO: 623295 - DNA, 25 bp, Rattus norvegicus
cgactgattgacaaggggctgttcc

SEQ ID NO: 623296 - DNA, 25 bp, Rattus norvegicus
tgacaaggggctgttcctgtggtcc

SEQ ID NO: 623297 - DNA, 25 bp, Rattus norvegicus
agcgctggctgcctcagttgcgcaa

SEQ ID NO: 623298 - DNA, 25 bp, Rattus norvegicus
ctcagttgcgcaagcgtcgatgctg

SEQ ID NO: 623299 - DNA, 25 bp, Rattus norvegicus
aagcgcttcccagccggttcacggt

SEQ ID NO: 623300 - DNA, 25 bp, Rattus norvegicus
ccagccggttcacggtccgcgtgtt

SEQ ID NO: 623301 - DNA, 25 bp, Rattus norvegicus
gctgcgacaagtagcgttcaacctt

SEQ ID NO: 623302 - DNA, 25 bp, Rattus norvegicus
cagtgtgtgctctgcaggacaaggc

SEQ ID NO: 623303 - DNA, 25 bp, Rattus norvegicus
ccggagcccttggagctgtcggaca

SEQ ID NO: 623304 - DNA, 25 bp, Rattus norvegicus
tgttctgtgacaggttcgtgcccgt

SEQ ID NO: 623305 - DNA, 25 bp, Rattus norvegicus
ccctcgggtgacgactgattgacaa

SEQ ID NO: 623306 - DNA, 25 bp, Rattus norvegicus
tcccggtgctgacagtgtgtgctct

SEQ ID NO: 623307 - DNA, 25 bp, Rattus norvegicus
gcattgacatgaacgcggtgagccc

SEQ ID NO: 623308 - DNA, 25 bp, Rattus norvegicus
aagagtatttccagcacgcctggtc

SEQ ID NO: 623309 - DNA, 25 bp, Rattus norvegicus
agcccttatgtacgccagcatcttt

SEQ ID NO: 623310 - DNA, 25 bp, Rattus norvegicus
cgccagcatctttggcaacgtgtcg

SEQ ID NO: 623311 - DNA, 25 bp, Rattus norvegicus
atccaacgcctgtactcgggcactg

SEQ ID NO: 623312 - DNA, 25 bp, Rattus norvegicus
cagatgctgcgtgtcaaggagttca

SEQ ID NO: 623313 - DNA, 25 bp, Rattus norvegicus
ggagttcatccgcttccaccagatc

SEQ ID NO: 623314 - DNA, 25 bp, Rattus norvegicus
tgagctgcccgactcatgacctggg

SEQ ID NO: 623315 - DNA, 25 bp, Rattus norvegicus
gcttccctgagtgcctgcaggcgga

SEQ ID NO: 623316 - DNA, 25 bp, Rattus norvegicus
aggcggacatctgcctgcacctgca

SEQ ID NO: 623317 - DNA, 25 bp, Rattus norvegicus
gcgcgctcgcggtcaagttcaagac

SEQ ID NO: 623318 - DNA, 25 bp, Rattus norvegicus
tgggcgacgtgctctccacgctcta

SEQ ID NO: 623319 - DNA, 25 bp, Rattus norvegicus
cggctccatcgagatcctgcgcgat

SEQ ID NO: 623320 - DNA, 25 bp, Rattus norvegicus
cggcagcgcctggaagagtatttcc

SEQ ID NO: 623321 - DNA, 25 bp, Rattus norvegicus
gggtcccggcgcagaactgcacagc

SEQ ID NO: 623322 - DNA, 25 bp, Rattus norvegicus
agtttcttactctcgcgggagtcgg

SEQ ID NO: 623323 - DNA, 25 bp, Rattus norvegicus
ggcgtagctcctccgacgtcttcat

SEQ ID NO: 623324 - DNA, 25 bp, Rattus norvegicus
cttcattctgcagacttagctagcg

SEQ ID NO: 623325 - DNA, 25 bp, Rattus norvegicus
cttagctagcggaaggcagagacta

SEQ ID NO: 623326 - DNA, 25 bp, Rattus norvegicus
gcctcgttgagccagctaccagctg

SEQ ID NO: 623327 - DNA, 25 bp, Rattus norvegicus
cagctgccgaggctagactgcatta

SEQ ID NO: 623328 - DNA, 25 bp, Rattus norvegicus
gactgcattaccgttcccaggggtc

SEQ ID NO: 623329 - DNA, 25 bp, Rattus norvegicus
tcttccggaaagagtaagctgaacc

SEQ ID NO: 623330 - DNA, 25 bp, Rattus norvegicus
cccgcaaccaaaagcaaacagagga

SEQ ID NO: 623331 - DNA, 25 bp, Rattus norvegicus
aggcgccgccagagtttcttactct

SEQ ID NO: 623332 - DNA, 25 bp, Rattus norvegicus
agtcgggccaccttccgataggctc

SEQ ID NO: 623333 - DNA, 25 bp, Rattus norvegicus
acgaaggtccaaagcgaagcgccta

SEQ ID NO: 623334 - DNA, 25 bp, Rattus norvegicus
ccgagtctgctttcctcttccggaa

SEQ ID NO: 623335 - DNA, 25 bp, Rattus norvegicus
gcccaaactttccagtctgcggatg

SEQ ID NO: 623336 - DNA, 25 bp, Rattus norvegicus
cgggtgcacgtatgctgatgttgaa

SEQ ID NO: 623337 - DNA, 25 bp, Rattus norvegicus
ccattccggtaagcaggtcacaagc

SEQ ID NO: 623338 - DNA, 25 bp, Rattus norvegicus
gggcagcgtggccaccactaccatt

SEQ ID NO: 623339 - DNA, 25 bp, Rattus norvegicus
tgttgggtaccgatggaatcgcgtc

SEQ ID NO: 623340 - DNA, 25 bp, Rattus norvegicus
ccagagcacagtggtgttgggtacc

SEQ ID NO: 623341 - DNA, 25 bp, Rattus norvegicus
gggcacgctggagcacaacaatacc

SEQ ID NO: 623342 - DNA, 25 bp, Rattus norvegicus
ctgcaagattccagctctgcgtggc

SEQ ID NO: 623343 - DNA, 25 bp, Rattus norvegicus
gggctggcaacgctttacactgcaa

SEQ ID NO: 623344 - DNA, 25 bp, Rattus norvegicus
gatagccctcgagcacctaggacca

SEQ ID NO: 623345 - DNA, 25 bp, Rattus norvegicus
ctccgggacttaagcgaagggcaca

SEQ ID NO: 623346 - DNA, 25 bp, Rattus norvegicus
accagccctgagcaggatcttcctg

SEQ ID NO: 623347 - DNA, 25 bp, Rattus norvegicus
gctgctcaccaaccgcgcgaaggga

SEQ ID NO: 623348 - DNA, 25 bp, Rattus norvegicus
aagggcacagcgcacaggccaatcc

SEQ ID NO: 623349 - DNA, 25 bp, Rattus norvegicus
cctctctgaggccttgaaacttccg

SEQ ID NO: 623350 - DNA, 25 bp, Rattus norvegicus
ttgcgttaagctcccgccaagactt

SEQ ID NO: 623351 - DNA, 25 bp, Rattus norvegicus
tgcgtttaccgcttgcgttaagctc

SEQ ID NO: 623352 - DNA, 25 bp, Rattus norvegicus
ggccttgaaacttccgcttcgcttg

SEQ ID NO: 623353 - DNA, 25 bp, Rattus norvegicus
gtgcctgcttttcgggtgcgtttac

SEQ ID NO: 623354 - DNA, 25 bp, Rattus norvegicus
ttatactgttatccctctctgaggc

SEQ ID NO: 623355 - DNA, 25 bp, Rattus norvegicus
aagacgccctcggttatttatactg

SEQ ID NO: 623356 - DNA, 25 bp, Rattus norvegicus
gcagtgtttacaagacgccctcggt

SEQ ID NO: 623357 - DNA, 25 bp, Rattus norvegicus
ttcggggttatgaccgcagtgttta

SEQ ID NO: 623358 - DNA, 25 bp, Rattus norvegicus
gccaccgcggctgtttaatgttcgg

SEQ ID NO: 623359 - DNA, 25 bp, Rattus norvegicus
gaggaacagcacataggggaagatt

SEQ ID NO: 623360 - DNA, 25 bp, Rattus norvegicus
aaacatcttccagactgagtgagga

SEQ ID NO: 623361 - DNA, 25 bp, Rattus norvegicus
gcggtcgtaacttaaacatcttcca

SEQ ID NO: 623362 - DNA, 25 bp, Rattus norvegicus
cgcttcgcttgctctttcttttcga

SEQ ID NO: 623363 - DNA, 25 bp, Rattus norvegicus
tcctggttgctgtaacccgggatta

SEQ ID NO: 623364 - DNA, 25 bp, Rattus norvegicus
cgcacccttgtgtggctagctagta

SEQ ID NO: 623365 - DNA, 25 bp, Rattus norvegicus
cagcagcatgcttgggtctctgatc

SEQ ID NO: 623366 - DNA, 25 bp, Rattus norvegicus
cgcggaaactagctctgacgggcta

SEQ ID NO: 623367 - DNA, 25 bp, Rattus norvegicus
acccgggattactctggctgtgaga

SEQ ID NO: 623368 - DNA, 25 bp, Rattus norvegicus
agcgatgccgatggatgtgatttta

SEQ ID NO: 623369 - DNA, 25 bp, Rattus norvegicus
cacggctttctgaagcactggtttc

SEQ ID NO: 623370 - DNA, 25 bp, Rattus norvegicus
ttcgagcccagagagccacggcttt

SEQ ID NO: 623371 - DNA, 25 bp, Rattus norvegicus
acccggaggcgaaaggatccgcaca

SEQ ID NO: 623372 - DNA, 25 bp, Rattus norvegicus
gatcctcgaagctccggagacccgg

SEQ ID NO: 623373 - DNA, 25 bp, Rattus norvegicus
actgttgcaacttgggcagcccgca

SEQ ID NO: 623374 - DNA, 25 bp, Rattus norvegicus
agcgatccctacatccttgaacttg

SEQ ID NO: 623375 - DNA, 25 bp, Rattus norvegicus
ggcgcgtgtaaccaggatcctcgaa

SEQ ID NO: 623376 - DNA, 25 bp, Rattus norvegicus
cacagctcggggtaaaagcgctaga

SEQ ID NO: 623377 - DNA, 25 bp, Rattus norvegicus
gtgtcactaccgtttcgggcgtctg

SEQ ID NO: 623378 - DNA, 25 bp, Rattus norvegicus
accgcgcggactttgctttacgctc

SEQ ID NO: 623379 - DNA, 25 bp, Rattus norvegicus
gagtcgcacaattcgggcaccttga

SEQ ID NO: 623380 - DNA, 25 bp, Rattus norvegicus
caccttgaggaaggagagctccggc

SEQ ID NO: 623381 - DNA, 25 bp, Rattus norvegicus
ccggctacatactggagtcggatca

SEQ ID NO: 623382 - DNA, 25 bp, Rattus norvegicus
agcaggcggcagaccatacgcttca

SEQ ID NO: 623383 - DNA, 25 bp, Rattus norvegicus
gcaggcacctgtgtctcgctcatca

SEQ ID NO: 623384 - DNA, 25 bp, Rattus norvegicus
tgcttacaacgagctggcaaagctg

SEQ ID NO: 623385 - DNA, 25 bp, Rattus norvegicus
agcaggcgcgtgaaccttcttcgcg

SEQ ID NO: 623386 - DNA, 25 bp, Rattus norvegicus
acgttggcagctgtaggtttctgtc

SEQ ID NO: 623387 - DNA, 25 bp, Rattus norvegicus
ctgtcccgggaaagttcttagtgtg

SEQ ID NO: 623388 - DNA, 25 bp, Rattus norvegicus
aagttcttagtgtggtgaggcccgc

SEQ ID NO: 623389 - DNA, 25 bp, Rattus norvegicus
caggcgatgggtgacattctgtgcc

SEQ ID NO: 623390 - DNA, 25 bp, Rattus norvegicus
gtctcgctcatcagtgcttacaacg

SEQ ID NO: 623391 - DNA, 25 bp, Rattus norvegicus
tctagaccgccctggggaatttgga

SEQ ID NO: 623392 - DNA, 25 bp, Rattus norvegicus
ggggcagctgtaagacgcacaacta

SEQ ID NO: 623393 - DNA, 25 bp, Rattus norvegicus
aggcggccctagtgccttcgagtag

SEQ ID NO: 623394 - DNA, 25 bp, Rattus norvegicus
caagattgttagagaggcggcccta

SEQ ID NO: 623395 - DNA, 25 bp, Rattus norvegicus
aggagtctgctacgttaggccattc

SEQ ID NO: 623396 - DNA, 25 bp, Rattus norvegicus
agggctctagcgctccaagatttgc

SEQ ID NO: 623397 - DNA, 25 bp, Rattus norvegicus
cccgcagtgccttctgtagcattga

SEQ ID NO: 623398 - DNA, 25 bp, Rattus norvegicus
tccctgagggcgtttccttgtagct

SEQ ID NO: 623399 - DNA, 25 bp, Rattus norvegicus
ccgttcttgtttgtgcggggatcta

SEQ ID NO: 623400 - DNA, 25 bp, Rattus norvegicus
atcaacgagtgtggttgggtctccc

SEQ ID NO: 623401 - DNA, 25 bp, Rattus norvegicus
gcgactggctgctaaccggtaatca

SEQ ID NO: 623402 - DNA, 25 bp, Rattus norvegicus
attccgggcggatacatcgcatcgc

SEQ ID NO: 623403 - DNA, 25 bp, Rattus norvegicus
tggggctatatcatcacgcagattc

SEQ ID NO: 623404 - DNA, 25 bp, Rattus norvegicus
tttccttgtagctggacacgccttc

SEQ ID NO: 623405 - DNA, 25 bp, Rattus norvegicus
acggtcgtgtcagtctcgcaacatg

SEQ ID NO: 623406 - DNA, 25 bp, Rattus norvegicus
gtacctcggtactttctagaagcca

SEQ ID NO: 623407 - DNA, 25 bp, Rattus norvegicus
tcccacagcgtatccaggagtttgc

SEQ ID NO: 623408 - DNA, 25 bp, Rattus norvegicus
ccagtgcagtagtttttgtgtttca

SEQ ID NO: 623409 - DNA, 25 bp, Rattus norvegicus
gtgtttcatccgctcccgcagagtc

SEQ ID NO: 623410 - DNA, 25 bp, Rattus norvegicus
cttagctggcagatggcggcaaaaa

SEQ ID NO: 623411 - DNA, 25 bp, Rattus norvegicus
agagcttccgccatcacgctgagca

SEQ ID NO: 623412 - DNA, 25 bp, Rattus norvegicus
ggctcgcaaagcgtcggtacacgtg

SEQ ID NO: 623413 - DNA, 25 bp, Rattus norvegicus
tacacgtggaacaaatagcgcgccc

SEQ ID NO: 623414 - DNA, 25 bp, Rattus norvegicus
gcagctctgagaagcgctctgtata

SEQ ID NO: 623415 - DNA, 25 bp, Rattus norvegicus
gcaaaaagcggccagtacctcggta

SEQ ID NO: 623416 - DNA, 25 bp, Rattus norvegicus
tgtatactgcacaagcggctccatg

SEQ ID NO: 623417 - DNA, 25 bp, Rattus norvegicus
cgcaacatgttttccggggcaaatt

SEQ ID NO: 623418 - DNA, 25 bp, Rattus norvegicus
cacgtcgtctacgttgtctgcggca

SEQ ID NO: 623419 - DNA, 25 bp, Rattus norvegicus
ggccgccgcgagcaagacttgcacg

SEQ ID NO: 623420 - DNA, 25 bp, Rattus norvegicus
ccaccgcaagctccgcccaacttta

SEQ ID NO: 623421 - DNA, 25 bp, Rattus norvegicus
cctgtcccgagcaccaccgcaagct

SEQ ID NO: 623422 - DNA, 25 bp, Rattus norvegicus
agacgggcctcgcagtaagacccgc

SEQ ID NO: 623423 - DNA, 25 bp, Rattus norvegicus
cggagacgggcctcgcagtaagacc

SEQ ID NO: 623424 - DNA, 25 bp, Rattus norvegicus
cacctgacctgctgcaaagctcggc

SEQ ID NO: 623425 - DNA, 25 bp, Rattus norvegicus
aacccgaatcctggctgggggctgc

SEQ ID NO: 623426 - DNA, 25 bp, Rattus norvegicus
gacgcaggcaccctgggccgggaac

SEQ ID NO: 623427 - DNA, 25 bp, Rattus norvegicus
ctccgcgggacacgggaagcacagc

SEQ ID NO: 623428 - DNA, 25 bp, Rattus norvegicus
agaccggctactcaccgggctcggg

SEQ ID NO: 623429 - DNA, 25 bp, Rattus norvegicus
ttgcacggggagaccggctactcac

SEQ ID NO: 623430 - DNA, 25 bp, Rattus norvegicus
cgagcaagacttgcacggggagacc

SEQ ID NO: 623431 - DNA, 25 bp, Rattus norvegicus
cgccctaatcgacttagcaacaagc

SEQ ID NO: 623432 - DNA, 25 bp, Rattus norvegicus
gactccgcgggacacgggaagcaca

SEQ ID NO: 623433 - DNA, 25 bp, Rattus norvegicus
gactctatgacacagctggacagga

SEQ ID NO: 623434 - DNA, 25 bp, Rattus norvegicus
gcttctctgtggtaaatccagcctc

SEQ ID NO: 623435 - DNA, 25 bp, Rattus norvegicus
tctgtggtaaatccagcctcatttc

SEQ ID NO: 623436 - DNA, 25 bp, Rattus norvegicus
ccagcctcatttcaaaatgtaaagg

SEQ ID NO: 623437 - DNA, 25 bp, Rattus norvegicus
gggaccatgccctgaggccgaatgg

SEQ ID NO: 623438 - DNA, 25 bp, Rattus norvegicus
actgtcttcgacagcgtcaccgtgg

SEQ ID NO: 623439 - DNA, 25 bp, Rattus norvegicus
ggggacaagcagtacctcttgggac

SEQ ID NO: 623440 - DNA, 25 bp, Rattus norvegicus
ctcatatgcttctctgtggtaaatc

SEQ ID NO: 623441 - DNA, 25 bp, Rattus norvegicus
cttgggactctatgacacagctgga

SEQ ID NO: 623442 - DNA, 25 bp, Rattus norvegicus
cagctggacaggaagactatgatcg

SEQ ID NO: 623443 - DNA, 25 bp, Rattus norvegicus
actatgatcgtctgaggcctttatc

SEQ ID NO: 623444 - DNA, 25 bp, Rattus norvegicus
gacgtcttcctcatatgcttctctg

SEQ ID NO: 623445 - DNA, 25 bp, Rattus norvegicus
atcgtctgaggcctttatcttaccc

SEQ ID NO: 623446 - DNA, 25 bp, Rattus norvegicus
acctcttgggactctatgacacagc

SEQ ID NO: 623447 - DNA, 25 bp, Rattus norvegicus
ttcgcctggtccaacttcaggtgtg

SEQ ID NO: 623448 - DNA, 25 bp, Rattus norvegicus
tgcctgaacgctcccggaaacagtc

SEQ ID NO: 623449 - DNA, 25 bp, Rattus norvegicus
ggcggattccaacttccaaatggcc

SEQ ID NO: 623450 - DNA, 25 bp, Rattus norvegicus
cctgcaggatgaggcggattccaac

SEQ ID NO: 623451 - DNA, 25 bp, Rattus norvegicus
tcgtccggcaggtcactggcctgca

SEQ ID NO: 623452 - DNA, 25 bp, Rattus norvegicus
aacacgatgtgcgtgagctcgtccg

SEQ ID NO: 623453 - DNA, 25 bp, Rattus norvegicus
tggacagacaactggaacacgatgt

SEQ ID NO: 623454 - DNA, 25 bp, Rattus norvegicus
tccgggagccggatggacagacaac

SEQ ID NO: 623455 - DNA, 25 bp, Rattus norvegicus
ccgcttagcggagacctgataggta

SEQ ID NO: 623456 - DNA, 25 bp, Rattus norvegicus
ctctcgcgagaacagtcgccgctta

SEQ ID NO: 623457 - DNA, 25 bp, Rattus norvegicus
agtgccgcgacaagcagaactctcg

SEQ ID NO: 623458 - DNA, 25 bp, Rattus norvegicus
tcgaaagcccagtgccgcgacaagc

SEQ ID NO: 623459 - DNA, 25 bp, Rattus norvegicus
gtctccaaatctcgaaagcccagtg

SEQ ID NO: 623460 - DNA, 25 bp, Rattus norvegicus
aggagtgcggcctcctggaaaccgc

SEQ ID NO: 623461 - DNA, 25 bp, Rattus norvegicus
cacctgcactgcattgtgggctgga

SEQ ID NO: 623462 - DNA, 25 bp, Rattus norvegicus
tccatctacttctacctgggtcagg

SEQ ID NO: 623463 - DNA, 25 bp, Rattus norvegicus
tgagaccaaacactccatctacttc

SEQ ID NO: 623464 - DNA, 25 bp, Rattus norvegicus
gcactgcattgtgggctggaacttc

SEQ ID NO: 623465 - DNA, 25 bp, Rattus norvegicus
aaggagtctgacaagaagtacaacc

SEQ ID NO: 623466 - DNA, 25 bp, Rattus norvegicus
cccatatcaagaaggagtctgacaa

SEQ ID NO: 623467 - DNA, 25 bp, Rattus norvegicus
tcaggcgtcagagaagtacagcgta

SEQ ID NO: 623468 - DNA, 25 bp, Rattus norvegicus
tcgccttgggagatgcgccacggct

SEQ ID NO: 623469 - DNA, 25 bp, Rattus norvegicus
ttgcctttataagagtcgccttggg

SEQ ID NO: 623470 - DNA, 25 bp, Rattus norvegicus
aataccatgcttcctgctatgatga

SEQ ID NO: 623471 - DNA, 25 bp, Rattus norvegicus
tgcttgcacaataccatgcttcctg

SEQ ID NO: 623472 - DNA, 25 bp, Rattus norvegicus
cagcaccatttctgcttgcacaata

SEQ ID NO: 623473 - DNA, 25 bp, Rattus norvegicus
acttcggtagctacgtgacacatga

SEQ ID NO: 623474 - DNA, 25 bp, Rattus norvegicus
ctggaacttcggtagctacgtgaca

SEQ ID NO: 623475 - DNA, 25 bp, Rattus norvegicus
cccgaaatccgagatgtaaagaggc

SEQ ID NO: 623476 - DNA, 25 bp, Rattus norvegicus
ccatgaactggtgcgtccgaggatt

SEQ ID NO: 623477 - DNA, 25 bp, Rattus norvegicus
acggcgacagccacaccacagttgg

SEQ ID NO: 623478 - DNA, 25 bp, Rattus norvegicus
gcgtccgaggattccacacgaactc

SEQ ID NO: 623479 - DNA, 25 bp, Rattus norvegicus
ttggatgaccatcttggaggcacgg

SEQ ID NO: 623480 - DNA, 25 bp, Rattus norvegicus
cgggcaggcagtgacctactttctc

SEQ ID NO: 623481 - DNA, 25 bp, Rattus norvegicus
tgaagccctccacgcaccgaatgag

SEQ ID NO: 623482 - DNA, 25 bp, Rattus norvegicus
gagggagactccgatcacagatatg

SEQ ID NO: 623483 - DNA, 25 bp, Rattus norvegicus
tcccgatccaaagcccgacagtggg

SEQ ID NO: 623484 - DNA, 25 bp, Rattus norvegicus
gggtgcaaaaccagacggctccaaa

SEQ ID NO: 623485 - DNA, 25 bp, Rattus norvegicus
gcaggtggccgattaaggctcctcc

SEQ ID NO: 623486 - DNA, 25 bp, Rattus norvegicus
aggctcctccgacaaacggcgacag

SEQ ID NO: 623487 - DNA, 25 bp, Rattus norvegicus
agcggccagtcagagagattagacc

SEQ ID NO: 623488 - DNA, 25 bp, Rattus norvegicus
cagctgttgcaaattccggggtgca

SEQ ID NO: 623489 - DNA, 25 bp, Rattus norvegicus
gggtctctgcatggcagctcccgag

SEQ ID NO: 623490 - DNA, 25 bp, Rattus norvegicus
tggagtccaccaagcaaatcccggc

SEQ ID NO: 623491 - DNA, 25 bp, Rattus norvegicus
ttgccttctgggctctggagtctcc

SEQ ID NO: 623492 - DNA, 25 bp, Rattus norvegicus
cgagcctgcagacggtctctgcaca

SEQ ID NO: 623493 - DNA, 25 bp, Rattus norvegicus
ctctactcgtagtctggtggggcga

SEQ ID NO: 623494 - DNA, 25 bp, Rattus norvegicus
ggggtccttgctctactcgtagtct

SEQ ID NO: 623495 - DNA, 25 bp, Rattus norvegicus
taaatccctgttccctctgcggtgc

SEQ ID NO: 623496 - DNA, 25 bp, Rattus norvegicus
ctcagaccaggtaagggcggtcgcc

SEQ ID NO: 623497 - DNA, 25 bp, Rattus norvegicus
cctggacaaccgaaggcggctcaga

SEQ ID NO: 623498 - DNA, 25 bp, Rattus norvegicus
actcactggggtaggaaagctcccg

SEQ ID NO: 623499 - DNA, 25 bp, Rattus norvegicus
cccgcccgagtgactcactggggta

SEQ ID NO: 623500 - DNA, 25 bp, Rattus norvegicus
ggtgtttcctggtgcattcccgacc

SEQ ID NO: 623501 - DNA, 25 bp, Rattus norvegicus
ctcccgggaatcacattccagaatc

SEQ ID NO: 623502 - DNA, 25 bp, Rattus norvegicus
aatcccggcttgctttgctgcggtg

SEQ ID NO: 623503 - DNA, 25 bp, Rattus norvegicus
acggacttcctcactgcggatcaca

SEQ ID NO: 623504 - DNA, 25 bp, Rattus norvegicus
tggagcccttctcagacctcaggcg

SEQ ID NO: 623505 - DNA, 25 bp, Rattus norvegicus
agcccagccctggtgcttgcttaca

SEQ ID NO: 623506 - DNA, 25 bp, Rattus norvegicus
aagtagctaccttagggccgtcgca

SEQ ID NO: 623507 - DNA, 25 bp, Rattus norvegicus
gagcgccgccttctccataggagag

SEQ ID NO: 623508 - DNA, 25 bp, Rattus norvegicus
aggagcctacctcggacagccttcg

SEQ ID NO: 623509 - DNA, 25 bp, Rattus norvegicus
cctggacgcagagtagtgacgtaaa

SEQ ID NO: 623510 - DNA, 25 bp, Rattus norvegicus
tgcgtccacctcagaacatgcgaaa

SEQ ID NO: 623511 - DNA, 25 bp, Rattus norvegicus
ggacagggccaaccagccagacttc

SEQ ID NO: 623512 - DNA, 25 bp, Rattus norvegicus
cggatcacaagggaagctgcgtcca

SEQ ID NO: 623513 - DNA, 25 bp, Rattus norvegicus
cttccgccagactgaatggcaatca

SEQ ID NO: 623514 - DNA, 25 bp, Rattus norvegicus
cgtaaaaccgcgtacgcactgggcg

SEQ ID NO: 623515 - DNA, 25 bp, Rattus norvegicus
gaacctgccgggaaacctggacgca

SEQ ID NO: 623516 - DNA, 25 bp, Rattus norvegicus
tggcaatcatccgactcaccacgga

SEQ ID NO: 623517 - DNA, 25 bp, Rattus norvegicus
cccatttgtgctatgctgctcgcca

SEQ ID NO: 623518 - DNA, 25 bp, Rattus norvegicus
ctgtacccggaacaacaaagcgaga

SEQ ID NO: 623519 - DNA, 25 bp, Rattus norvegicus
tgctcccgagcgtctagtctattta

SEQ ID NO: 623520 - DNA, 25 bp, Rattus norvegicus
gaggactttgccagcggcttctgga

SEQ ID NO: 623521 - DNA, 25 bp, Rattus norvegicus
agaaaacatgcacggggcttccaac

SEQ ID NO: 623522 - DNA, 25 bp, Rattus norvegicus
tcgccagcgatgagcagaaaacatg

SEQ ID NO: 623523 - DNA, 25 bp, Rattus norvegicus
agcgagaaacggagctcgagccttg

SEQ ID NO: 623524 - DNA, 25 bp, Rattus norvegicus
gggtgctaggcacagttctggttta

SEQ ID NO: 623525 - DNA, 25 bp, Rattus norvegicus
ctgtataaacgattgggtgctaggc

SEQ ID NO: 623526 - DNA, 25 bp, Rattus norvegicus
gctagctgagcttgtctgtataaac

SEQ ID NO: 623527 - DNA, 25 bp, Rattus norvegicus
cggccgttcaaaccggcgagtgtgc

SEQ ID NO: 623528 - DNA, 25 bp, Rattus norvegicus
ccaccggctagtacagaggacaggc

SEQ ID NO: 623529 - DNA, 25 bp, Rattus norvegicus
gagcgaacccgtttcatcttcatcc

SEQ ID NO: 623530 - DNA, 25 bp, Rattus norvegicus
cggttcgggcatcccagtagggata

SEQ ID NO: 623531 - DNA, 25 bp, Rattus norvegicus
atgcgtcagtctgcgcttcaggcca

SEQ ID NO: 623532 - DNA, 25 bp, Rattus norvegicus
caagaaggaagatgagtcgcgttga

SEQ ID NO: 623533 - DNA, 25 bp, Rattus norvegicus
tgagcctcaagaaggaagatgagtc

SEQ ID NO: 623534 - DNA, 25 bp, Rattus norvegicus
ggacgtgcggcgctgctcgttcatt

SEQ ID NO: 623535 - DNA, 25 bp, Rattus norvegicus
ctcgttcattggctggagccgtctc

SEQ ID NO: 623536 - DNA, 25 bp, Rattus norvegicus
tcattggctggagccgtctctcaac

SEQ ID NO: 623537 - DNA, 25 bp, Rattus norvegicus
cgtctctcaacctcgcgctattggg

SEQ ID NO: 623538 - DNA, 25 bp, Rattus norvegicus
aacctcgcgctattgggcgggcgcc

SEQ ID NO: 623539 - DNA, 25 bp, Rattus norvegicus
cgccgtcatgcgtcagtctgcgctt

SEQ ID NO: 623540 - DNA, 25 bp, Rattus norvegicus
tgcgcttcaggccacagactggatc

SEQ ID NO: 623541 - DNA, 25 bp, Rattus norvegicus
cacagactggatcgcgagcgccggc

SEQ ID NO: 623542 - DNA, 25 bp, Rattus norvegicus
agtgttccctcagccggctggcgga

SEQ ID NO: 623543 - DNA, 25 bp, Rattus norvegicus
gaaactagggcctgtgcgctttgga

SEQ ID NO: 623544 - DNA, 25 bp, Rattus norvegicus
tgcgtgcgcacaagtcccgcctccc

SEQ ID NO: 623545 - DNA, 25 bp, Rattus norvegicus
actagactaccacgggctgcagcgc

SEQ ID NO: 623546 - DNA, 25 bp, Rattus norvegicus
tgcactggggcagctgcgctccgaa

SEQ ID NO: 623547 - DNA, 25 bp, Rattus norvegicus
agcgccctggttctgcggaccgaga

SEQ ID NO: 623548 - DNA, 25 bp, Rattus norvegicus
cttggcaacgccaggcgaaggcagc

SEQ ID NO: 623549 - DNA, 25 bp, Rattus norvegicus
accgagagggacaggtgtctgctcc

SEQ ID NO: 623550 - DNA, 25 bp, Rattus norvegicus
cgcacacgagctggggtgcgtccac

SEQ ID NO: 623551 - DNA, 25 bp, Rattus norvegicus
ctcgggcgcttactagactaccacg

SEQ ID NO: 623552 - DNA, 25 bp, Rattus norvegicus
tccgaggcctctgccgggcttggtc

SEQ ID NO: 623553 - DNA, 25 bp, Rattus norvegicus
cactctcgggagtgatcagcacggg

SEQ ID NO: 623554 - DNA, 25 bp, Rattus norvegicus
taacacgcttggcaacgccaggcga

SEQ ID NO: 623555 - DNA, 25 bp, Rattus norvegicus
ttggtctccactcgctcgggcgctt

SEQ ID NO: 623556 - DNA, 25 bp, Rattus norvegicus
gggcgccctcctcccgaagcaccag

SEQ ID NO: 623557 - DNA, 25 bp, Rattus norvegicus
aaggcagcgaggtttgaatggactc

SEQ ID NO: 623558 - DNA, 25 bp, Rattus norvegicus
gtgcgtccactctcgggagtgatca

SEQ ID NO: 623559 - DNA, 25 bp, Rattus norvegicus
cgggcaaagtttgcgctgcggtatc

SEQ ID NO: 623560 - DNA, 25 bp, Rattus norvegicus
gaggaacgtccctctgcctaggcgc

SEQ ID NO: 623561 - DNA, 25 bp, Rattus norvegicus
ggtttgaggaacgtccctctgccta

SEQ ID NO: 623562 - DNA, 25 bp, Rattus norvegicus
gcgagctcaccagtgctggcgcaca

SEQ ID NO: 623563 - DNA, 25 bp, Rattus norvegicus
agcgccacccgatacctctagtggt

SEQ ID NO: 623564 - DNA, 25 bp, Rattus norvegicus
gatacctctagtggtccggccctca

SEQ ID NO: 623565 - DNA, 25 bp, Rattus norvegicus
gctatcgggcgggagcctccttcca

SEQ ID NO: 623566 - DNA, 25 bp, Rattus norvegicus
aggcagcggctatctgctgtctaca

SEQ ID NO: 623567 - DNA, 25 bp, Rattus norvegicus
gcctccgcagtctccgggcaaagtt

SEQ ID NO: 623568 - DNA, 25 bp, Rattus norvegicus
aaagtttgcgctgcggtatccgcga

SEQ ID NO: 623569 - DNA, 25 bp, Rattus norvegicus
tcggcgaaggcgcatcctgcttcgc

SEQ ID NO: 623570 - DNA, 25 bp, Rattus norvegicus
cgccacatgtcgtctctgggtttga

SEQ ID NO: 623571 - DNA, 25 bp, Rattus norvegicus
tccaaagcgccacatgtcgtctctg

SEQ ID NO: 623572 - DNA, 25 bp, Rattus norvegicus
ctgtctacagcgaaccgggaggcgc

SEQ ID NO: 623573 - DNA, 25 bp, Rattus norvegicus
gagccctggagcgaccgcggaccca

SEQ ID NO: 623574 - DNA, 25 bp, Rattus norvegicus
ctcggctgcagtgtccatctcggac

SEQ ID NO: 623575 - DNA, 25 bp, Rattus norvegicus
gtccatctcggacctgcggccgcag

SEQ ID NO: 623576 - DNA, 25 bp, Rattus norvegicus
tctcggacctgcggccgcaggcaag

SEQ ID NO: 623577 - DNA, 25 bp, Rattus norvegicus
tggccgtggcaagctcggaggtctt

SEQ ID NO: 623578 - DNA, 25 bp, Rattus norvegicus
ccggtgcggccgctgccgacggttg

SEQ ID NO: 623579 - DNA, 25 bp, Rattus norvegicus
cctgcaaggcgccacgcagtcgtgg

SEQ ID NO: 623580 - DNA, 25 bp, Rattus norvegicus
agcgaccgcggacccagaaggggcg

SEQ ID NO: 623581 - DNA, 25 bp, Rattus norvegicus
tggccctcggctgcagtgtccatct

SEQ ID NO: 623582 - DNA, 25 bp, Rattus norvegicus
cgtggccctcggctgcagtgtccat

SEQ ID NO: 623583 - DNA, 25 bp, Rattus norvegicus
cagtcgtggccctcggctgcagtgt

SEQ ID NO: 623584 - DNA, 25 bp, Rattus norvegicus
gaggtcttggtttcgtggcccatcc

SEQ ID NO: 623585 - DNA, 25 bp, Rattus norvegicus
tgcaaggcgccacgcagtcgtggcc

SEQ ID NO: 623586 - DNA, 25 bp, Rattus norvegicus
cggaggtcttggtttcgtggcccat

SEQ ID NO: 623587 - DNA, 25 bp, Rattus norvegicus
cccgggaacatgtcctttgtgaagg

SEQ ID NO: 623588 - DNA, 25 bp, Rattus norvegicus
agtctctattctgaggcccggcttc

SEQ ID NO: 623589 - DNA, 25 bp, Rattus norvegicus
ctcagcttctctggtgggtttccca

SEQ ID NO: 623590 - DNA, 25 bp, Rattus norvegicus
tggccgtagtctgtgtctcagcttc

SEQ ID NO: 623591 - DNA, 25 bp, Rattus norvegicus
catttggaaattgctgcggatcgcc

SEQ ID NO: 623592 - DNA, 25 bp, Rattus norvegicus
ctcccttagcaacaggcgccgagga

SEQ ID NO: 623593 - DNA, 25 bp, Rattus norvegicus
caggcatttcaggagggctgtcacc

SEQ ID NO: 623594 - DNA, 25 bp, Rattus norvegicus
cgctacccgatgcacacaggcattt

SEQ ID NO: 623595 - DNA, 25 bp, Rattus norvegicus
cgaccgcctggagccatacgtatct

SEQ ID NO: 623596 - DNA, 25 bp, Rattus norvegicus
atcgccagcatcgacatggtttctg

SEQ ID NO: 623597 - DNA, 25 bp, Rattus norvegicus
cccagtctgcgtggggatgaacatc

SEQ ID NO: 623598 - DNA, 25 bp, Rattus norvegicus
ctgatcacggtatgctgcgcttccc

SEQ ID NO: 623599 - DNA, 25 bp, Rattus norvegicus
cgacattcgcctgagaccggacttc

SEQ ID NO: 623600 - DNA, 25 bp, Rattus norvegicus
ctgtcctaggtgctgacggatcctt

SEQ ID NO: 623601 - DNA, 25 bp, Rattus norvegicus
actctgctgtccttcttgcccaaga

SEQ ID NO: 623602 - DNA, 25 bp, Rattus norvegicus
atcaaggacctgtgggaggactaca

SEQ ID NO: 623603 - DNA, 25 bp, Rattus norvegicus
gctctttttgtttcccgctatccgc

SEQ ID NO: 623604 - DNA, 25 bp, Rattus norvegicus
cagaggagccacctcggcggaaacc

SEQ ID NO: 623605 - DNA, 25 bp, Rattus norvegicus
cgggcaatgatcacctaggaggctg

SEQ ID NO: 623606 - DNA, 25 bp, Rattus norvegicus
tgggcaccgaagactccactgccgg

SEQ ID NO: 623607 - DNA, 25 bp, Rattus norvegicus
cctccaagggcgaacggctgctgat

SEQ ID NO: 623608 - DNA, 25 bp, Rattus norvegicus
gcccaagaatctcttcgaacagttc

SEQ ID NO: 623609 - DNA, 25 bp, Rattus norvegicus
tgtgtacttcgtcttcatcgcgcta

SEQ ID NO: 623610 - DNA, 25 bp, Rattus norvegicus
atcgcgctactcaactttgtgccgg

SEQ ID NO: 623611 - DNA, 25 bp, Rattus norvegicus
ggcagtgaacgctttccagccggtc

SEQ ID NO: 623612 - DNA, 25 bp, Rattus norvegicus
actggcgcctgtgctctttattctg

SEQ ID NO: 623613 - DNA, 25 bp, Rattus norvegicus
agttccaccgcctagccaatgtgta

SEQ ID NO: 623614 - DNA, 25 bp, Rattus norvegicus
tgctctttattctggcggtcactgc

SEQ ID NO: 623615 - DNA, 25 bp, Rattus norvegicus
ctcgttcgcgagatccgtgtttctc

SEQ ID NO: 623616 - DNA, 25 bp, Rattus norvegicus
aactgtcagtgctggctgagcgcaa

SEQ ID NO: 623617 - DNA, 25 bp, Rattus norvegicus
ggctgctgcagccttaactgtcagt

SEQ ID NO: 623618 - DNA, 25 bp, Rattus norvegicus
cgttcagcgccgacttcaaggttgc

SEQ ID NO: 623619 - DNA, 25 bp, Rattus norvegicus
ccaccgtggacagatcgcggcagca

SEQ ID NO: 623620 - DNA, 25 bp, Rattus norvegicus
tgcttctcttcggagttgctcgcca

SEQ ID NO: 623621 - DNA, 25 bp, Rattus norvegicus
tcctcgttcgaccagtcgcggacgg

SEQ ID NO: 623622 - DNA, 25 bp, Rattus norvegicus
acagggcctttcgtcttcgcaagta

SEQ ID NO: 623623 - DNA, 25 bp, Rattus norvegicus
tgactacaggagacgacagggcctt

SEQ ID NO: 623624 - DNA, 25 bp, Rattus norvegicus
gcgctcctctttgggtgactacagg

SEQ ID NO: 623625 - DNA, 25 bp, Rattus norvegicus
atccgtgtttctcccaagatggtgg

SEQ ID NO: 623626 - DNA, 25 bp, Rattus norvegicus
ctagtcttctcgtcctcgttcgcga

SEQ ID NO: 623627 - DNA, 25 bp, Rattus norvegicus
ggagacagtcgtcgtcccacgcacg

SEQ ID NO: 623628 - DNA, 25 bp, Rattus norvegicus
gtagggccctgcagagatgcaatcc

SEQ ID NO: 623629 - DNA, 25 bp, Rattus norvegicus
ctgaggagtcgggaatcaaaataaa

SEQ ID NO: 623630 - DNA, 25 bp, Rattus norvegicus
ctgaggtgagtcttctgtcagttca

SEQ ID NO: 623631 - DNA, 25 bp, Rattus norvegicus
tgtcagttcagggactccactcggg

SEQ ID NO: 623632 - DNA, 25 bp, Rattus norvegicus
cactcgggcgcaccgggtgctctga

SEQ ID NO: 623633 - DNA, 25 bp, Rattus norvegicus
cgggtgctctgaccagcaacgtagc

SEQ ID NO: 623634 - DNA, 25 bp, Rattus norvegicus
ccagcaacgtagctgatctgggagc

SEQ ID NO: 623635 - DNA, 25 bp, Rattus norvegicus
gctgatctgggagcggcgctttttc

SEQ ID NO: 623636 - DNA, 25 bp, Rattus norvegicus
cccagactgatggtcctggtgttgg

SEQ ID NO: 623637 - DNA, 25 bp, Rattus norvegicus
ggccgcgcgaaaaagtcggtctcca

SEQ ID NO: 623638 - DNA, 25 bp, Rattus norvegicus
aagtcggtctccagtgttctccagg

SEQ ID NO: 623639 - DNA, 25 bp, Rattus norvegicus
ctcttccggggcgtttagctcctag

SEQ ID NO: 623640 - DNA, 25 bp, Rattus norvegicus
ttagctcctagcttgcgcttgtctc

SEQ ID NO: 623641 - DNA, 25 bp, Rattus norvegicus
tagcttgcgcttgtctccctggtcg

SEQ ID NO: 623642 - DNA, 25 bp, Rattus norvegicus
tgttctccaggtctcttccggggcg

SEQ ID NO: 623643 - DNA, 25 bp, Rattus norvegicus
gcgaacctctcagggccatcgtgcg

SEQ ID NO: 623644 - DNA, 25 bp, Rattus norvegicus
cccagctggtgcagaaggcgcacga

SEQ ID NO: 623645 - DNA, 25 bp, Rattus norvegicus
aaggcgcacgagctcatgtggtacg

SEQ ID NO: 623646 - DNA, 25 bp, Rattus norvegicus
cggaaggcgcagtgctcagtaaagc

SEQ ID NO: 623647 - DNA, 25 bp, Rattus norvegicus
agatgcaggtcagcgatgctgttcc

SEQ ID NO: 623648 - DNA, 25 bp, Rattus norvegicus
gcgaccctaactttgccgctgagga

SEQ ID NO: 623649 - DNA, 25 bp, Rattus norvegicus
gtaaagcgcacttcctctgctagta

SEQ ID NO: 623650 - DNA, 25 bp, Rattus norvegicus
agacgcagaatgtcggaacaaagta

SEQ ID NO: 623651 - DNA, 25 bp, Rattus norvegicus
cagcggtcctgctctgatcaaaaga

SEQ ID NO: 623652 - DNA, 25 bp, Rattus norvegicus
caggctccgagagctccgagtcgca

SEQ ID NO: 623653 - DNA, 25 bp, Rattus norvegicus
aggttgaccctaagatcctgcagca

SEQ ID NO: 623654 - DNA, 25 bp, Rattus norvegicus
tctgctagtatccactgaggcagtg

SEQ ID NO: 623655 - DNA, 25 bp, Rattus norvegicus
caaagtaaggacctgagcgacccta

SEQ ID NO: 623656 - DNA, 25 bp, Rattus norvegicus
cgccaccacctgcagaacggtttga

SEQ ID NO: 623657 - DNA, 25 bp, Rattus norvegicus
tcctggacagccacgtcggcatgct

SEQ ID NO: 623658 - DNA, 25 bp, Rattus norvegicus
ggagagaacccgcagcactcgctga

SEQ ID NO: 623659 - DNA, 25 bp, Rattus norvegicus
ctcgctgagagcagtggaacaagcc

SEQ ID NO: 623660 - DNA, 25 bp, Rattus norvegicus
tggaacaagccagtcggcaaccgct

SEQ ID NO: 623661 - DNA, 25 bp, Rattus norvegicus
agtcggcaaccgcttcctattcagc

SEQ ID NO: 623662 - DNA, 25 bp, Rattus norvegicus
gcttcctattcagctttcaagctgg

SEQ ID NO: 623663 - DNA, 25 bp, Rattus norvegicus
tcagcactggaagaaaaagcgtagc

SEQ ID NO: 623664 - DNA, 25 bp, Rattus norvegicus
agaaaaagcgtagcaaccggagacg

SEQ ID NO: 623665 - DNA, 25 bp, Rattus norvegicus
gccgccgccagtcaagcaagggaca

SEQ ID NO: 623666 - DNA, 25 bp, Rattus norvegicus
gcaagggacatgtcgcagctaagta

SEQ ID NO: 623667 - DNA, 25 bp, Rattus norvegicus
tcgcagctaagtacgaatctgggtg

SEQ ID NO: 623668 - DNA, 25 bp, Rattus norvegicus
atagccgccctacggttctgatgcg

SEQ ID NO: 623669 - DNA, 25 bp, Rattus norvegicus
cacgtcggcatgctcagcactggaa

SEQ ID NO: 623670 - DNA, 25 bp, Rattus norvegicus
aatctgggtgattccagccctccgg

SEQ ID NO: 623671 - DNA, 25 bp, Rattus norvegicus
cgcctgtagctgtagccttcgtgaa

SEQ ID NO: 623672 - DNA, 25 bp, Rattus norvegicus
cttggacacggaagccgggaccact

SEQ ID NO: 623673 - DNA, 25 bp, Rattus norvegicus
ttgctggaggcttctttgcccgcag

SEQ ID NO: 623674 - DNA, 25 bp, Rattus norvegicus
aggaagctgtcgttgtcctcctccc

SEQ ID NO: 623675 - DNA, 25 bp, Rattus norvegicus
tgtccagctgcagcgtctcgccgat

SEQ ID NO: 623676 - DNA, 25 bp, Rattus norvegicus
cgatctctgccacgctgtagggcgc

SEQ ID NO: 623677 - DNA, 25 bp, Rattus norvegicus
gatgcttaatttgccggttccctgg

SEQ ID NO: 623678 - DNA, 25 bp, Rattus norvegicus
tctccagatgagatccgcgtcgctg

SEQ ID NO: 623679 - DNA, 25 bp, Rattus norvegicus
gtttcccgaaagtaagagctgctgc

SEQ ID NO: 623680 - DNA, 25 bp, Rattus norvegicus
gtgaatgaagtctccgcaccgcctc

SEQ ID NO: 623681 - DNA, 25 bp, Rattus norvegicus
tcccgggtgaaagtggctcatgcac

SEQ ID NO: 623682 - DNA, 25 bp, Rattus norvegicus
tcacacaagcgccagggtcgctgca

SEQ ID NO: 623683 - DNA, 25 bp, Rattus norvegicus
ccgcctccttgatgaggtttcccga

SEQ ID NO: 623684 - DNA, 25 bp, Rattus norvegicus
acagaggctccaagaacgggtgtgc

SEQ ID NO: 623685 - DNA, 25 bp, Rattus norvegicus
actccgcgtcgcactgaaccctgca

SEQ ID NO: 623686 - DNA, 25 bp, Rattus norvegicus
atgccggccgccactggctccacag

SEQ ID NO: 623687 - DNA, 25 bp, Rattus norvegicus
ctttacctcccgcgcaggcaggatg

SEQ ID NO: 623688 - DNA, 25 bp, Rattus norvegicus
cagcccggccgtctcactttacctc

SEQ ID NO: 623689 - DNA, 25 bp, Rattus norvegicus
tagcggtcacccgagccagcccggc

SEQ ID NO: 623690 - DNA, 25 bp, Rattus norvegicus
cacgcacagtccgaaggggctcgcg

SEQ ID NO: 623691 - DNA, 25 bp, Rattus norvegicus
gcacacgcacagtccgaaggggctc

SEQ ID NO: 623692 - DNA, 25 bp, Rattus norvegicus
cacgcacacgcacagtccgaagggg

SEQ ID NO: 623693 - DNA, 25 bp, Rattus norvegicus
acgctcccgggttgcgcgcgcacac

SEQ ID NO: 623694 - DNA, 25 bp, Rattus norvegicus
tgaaccctgcattcccgtctccacg

SEQ ID NO: 623695 - DNA, 25 bp, Rattus norvegicus
ccgcgtgtttggctctgggtcactc

SEQ ID NO: 623696 - DNA, 25 bp, Rattus norvegicus
ggctccacagctgccgtcggtctcc

SEQ ID NO: 623697 - DNA, 25 bp, Rattus norvegicus
tggctctgggtcactccgcgtcgca

SEQ ID NO: 623698 - DNA, 25 bp, Rattus norvegicus
cgtctccacgcacccggcacgctcc

SEQ ID NO: 623699 - DNA, 25 bp, Rattus norvegicus
tgcgtagcccgagagccgcgccaga

SEQ ID NO: 623700 - DNA, 25 bp, Rattus norvegicus
acaagaaggtgcgtagcccgagagc

SEQ ID NO: 623701 - DNA, 25 bp, Rattus norvegicus
ctcgtccaggacaagaaggtgcgta

SEQ ID NO: 623702 - DNA, 25 bp, Rattus norvegicus
agactcaccacatccatgatctgca

SEQ ID NO: 623703 - DNA, 25 bp, Rattus norvegicus
ccatgatctgcaggagactcaggga

SEQ ID NO: 623704 - DNA, 25 bp, Rattus norvegicus
actcagggagaagtacacggtgagc

SEQ ID NO: 623705 - DNA, 25 bp, Rattus norvegicus
gctgcgagtcgttggccaccggcct

SEQ ID NO: 623706 - DNA, 25 bp, Rattus norvegicus
ttgtacagcctcctctggaactcgc

SEQ ID NO: 623707 - DNA, 25 bp, Rattus norvegicus
gaactcgccttgcagggacacttgg

SEQ ID NO: 623708 - DNA, 25 bp, Rattus norvegicus
gccttgcagggacacttgggaagca

SEQ ID NO: 623709 - DNA, 25 bp, Rattus norvegicus
gcccgccgaggggagtatagccaaa

SEQ ID NO: 623710 - DNA, 25 bp, Rattus norvegicus
tagccaaagccgagctgcggttacc

SEQ ID NO: 623711 - DNA, 25 bp, Rattus norvegicus
tgcggttaccgtgcagcagcgccgc

SEQ ID NO: 623712 - DNA, 25 bp, Rattus norvegicus
ctctccagcgggttgtagttcttga

SEQ ID NO: 623713 - DNA, 25 bp, Rattus norvegicus
actggaacgtgatggcaagcgcgcc

SEQ ID NO: 623714 - DNA, 25 bp, Rattus norvegicus
ggtctgactggccaagcgagaaacg

SEQ ID NO: 623715 - DNA, 25 bp, Rattus norvegicus
ctactctgggtctgactggccaagc

SEQ ID NO: 623716 - DNA, 25 bp, Rattus norvegicus
gtagggtcagctcagagaggcgcct

SEQ ID NO: 623717 - DNA, 25 bp, Rattus norvegicus
tccgcactggaacgtgatggcaagc

SEQ ID NO: 623718 - DNA, 25 bp, Rattus norvegicus
gcccttttcgcggttccgcactgga

SEQ ID NO: 623719 - DNA, 25 bp, Rattus norvegicus
tccggcttcagcccggcgacggtag

SEQ ID NO: 623720 - DNA, 25 bp, Rattus norvegicus
cacggccaccggctccggcttcagc

SEQ ID NO: 623721 - DNA, 25 bp, Rattus norvegicus
atcgttcgggatctcgtgggcgcca

SEQ ID NO: 623722 - DNA, 25 bp, Rattus norvegicus
cattgcgggaatcgttcgggatctc

SEQ ID NO: 623723 - DNA, 25 bp, Rattus norvegicus
tgcgtctgcattgcgggaatcgttc

SEQ ID NO: 623724 - DNA, 25 bp, Rattus norvegicus
actgtgcgtctgcattgcgggaatc

SEQ ID NO: 623725 - DNA, 25 bp, Rattus norvegicus
gcagggctcactgtgcgtctgcatt

SEQ ID NO: 623726 - DNA, 25 bp, Rattus norvegicus
ccgcgtactactctgggtctgactg

SEQ ID NO: 623727 - DNA, 25 bp, Rattus norvegicus
caaattcatcttcgccggcctgctg

SEQ ID NO: 623728 - DNA, 25 bp, Rattus norvegicus
gcctggaagtacagcacggacgtaa

SEQ ID NO: 623729 - DNA, 25 bp, Rattus norvegicus
gtcgcagacctacagcaacggcttc

SEQ ID NO: 623730 - DNA, 25 bp, Rattus norvegicus
ccgcggagcacaagtcgcagaccta

SEQ ID NO: 623731 - DNA, 25 bp, Rattus norvegicus
tctgtggtcgcagagctacagccca

SEQ ID NO: 623732 - DNA, 25 bp, Rattus norvegicus
cagctggtgctcaagctcaaggagc

SEQ ID NO: 623733 - DNA, 25 bp, Rattus norvegicus
cgctttagcgcggagcaagaacagc

SEQ ID NO: 623734 - DNA, 25 bp, Rattus norvegicus
gatcggctactacctgaccagcgcg

SEQ ID NO: 623735 - DNA, 25 bp, Rattus norvegicus
ccagttccacgaagagatgatcggc

SEQ ID NO: 623736 - DNA, 25 bp, Rattus norvegicus
gccatgcaaggcgagcgcaaattca

SEQ ID NO: 623737 - DNA, 25 bp, Rattus norvegicus
agcacctcgccgtcggagaagacca

SEQ ID NO: 623738 - DNA, 25 bp, Rattus norvegicus
tctggagcatcagctagcacctcgc

SEQ ID NO: 623739 - DNA, 25 bp, Rattus norvegicus
atccaagtcgcgcaagggcagcaaa

SEQ ID NO: 623740 - DNA, 25 bp, Rattus norvegicus
acggacgtaaagctgagcctcaaca

SEQ ID NO: 623741 - DNA, 25 bp, Rattus norvegicus
cagcatgccgggatggaagttggcg

SEQ ID NO: 623742 - DNA, 25 bp, Rattus norvegicus
tgcgatagtgtcgggccagctcgtc

SEQ ID NO: 623743 - DNA, 25 bp, Rattus norvegicus
agctgaacttcttctcgcccgtgtg

SEQ ID NO: 623744 - DNA, 25 bp, Rattus norvegicus
gcagctgaacttcttctcgcccgtg

SEQ ID NO: 623745 - DNA, 25 bp, Rattus norvegicus
atggggcagctgaacttcttctcgc

SEQ ID NO: 623746 - DNA, 25 bp, Rattus norvegicus
aagcgcttctcgcagatggggcagc

SEQ ID NO: 623747 - DNA, 25 bp, Rattus norvegicus
gtcgctccgcatgaagcgcttctcg

SEQ ID NO: 623748 - DNA, 25 bp, Rattus norvegicus
tgcgtgcttcgtcaggtggtcgctc

SEQ ID NO: 623749 - DNA, 25 bp, Rattus norvegicus
cacgccgctgcagcatgccgggatg

SEQ ID NO: 623750 - DNA, 25 bp, Rattus norvegicus
agtcgctgagcgagccggtcctcga

SEQ ID NO: 623751 - DNA, 25 bp, Rattus norvegicus
ctgtagtcgctgagcgagccggtcc

SEQ ID NO: 623752 - DNA, 25 bp, Rattus norvegicus
atccgagcggctgtagtcgctgagc

SEQ ID NO: 623753 - DNA, 25 bp, Rattus norvegicus
ctgctggcatccgagcggctgtagt

SEQ ID NO: 623754 - DNA, 25 bp, Rattus norvegicus
tggtcgctccgcatgaagcgcttct

SEQ ID NO: 623755 - DNA, 25 bp, Rattus norvegicus
cgtaaactttctcgcagcccgcgta

SEQ ID NO: 623756 - DNA, 25 bp, Rattus norvegicus
ccactgacctgtgtgagttctcagg

SEQ ID NO: 623757 - DNA, 25 bp, Rattus norvegicus
tgcaagttgcggtcgcagttccacc

SEQ ID NO: 623758 - DNA, 25 bp, Rattus norvegicus
cagcccgcgtagtggcacttgtact

SEQ ID NO: 623759 - DNA, 25 bp, Rattus norvegicus
ttgtacttcctctgcggggactcga

SEQ ID NO: 623760 - DNA, 25 bp, Rattus norvegicus
aggtccgctaggatccgagctacca

SEQ ID NO: 623761 - DNA, 25 bp, Rattus norvegicus
ctaccacgaaaagagaggcgctgtc

SEQ ID NO: 623762 - DNA, 25 bp, Rattus norvegicus
tggacatggacacgaggcactcggc

SEQ ID NO: 623763 - DNA, 25 bp, Rattus norvegicus
ccttgaggtgcgaagatttcccgta

SEQ ID NO: 623764 - DNA, 25 bp, Rattus norvegicus
aaagtggtccacataggcggcggct

SEQ ID NO: 623765 - DNA, 25 bp, Rattus norvegicus
tgctctcgcaggagtcgtcagcggc

SEQ ID NO: 623766 - DNA, 25 bp, Rattus norvegicus
cagaaccggcctgtcctagggacgt

SEQ ID NO: 623767 - DNA, 25 bp, Rattus norvegicus
agttccaccgtgcattgtggcaggc

SEQ ID NO: 623768 - DNA, 25 bp, Rattus norvegicus
gcactcggcggcaaagtggtccaca

SEQ ID NO: 623769 - DNA, 25 bp, Rattus norvegicus
cagtcgtccagcgatgagcgcatcc

SEQ ID NO: 623770 - DNA, 25 bp, Rattus norvegicus
agctaaaccgatccttctcgcgtgg

SEQ ID NO: 623771 - DNA, 25 bp, Rattus norvegicus
accgatccttctcgcgtggttcttg

SEQ ID NO: 623772 - DNA, 25 bp, Rattus norvegicus
acacagagctgttcctcagcgacga

SEQ ID NO: 623773 - DNA, 25 bp, Rattus norvegicus
cctcagcgacgaggaactgaaaaaa

SEQ ID NO: 623774 - DNA, 25 bp, Rattus norvegicus
actgcatgagtttgaggagcagtgc

SEQ ID NO: 623775 - DNA, 25 bp, Rattus norvegicus
tgcaggagcacttccgagaaaagga

SEQ ID NO: 623776 - DNA, 25 bp, Rattus norvegicus
tccttctcgcgtggttcttgacgtg

SEQ ID NO: 623777 - DNA, 25 bp, Rattus norvegicus
atgagcagcagtcgtccagcgatga

SEQ ID NO: 623778 - DNA, 25 bp, Rattus norvegicus
cagcgatgagcgcatccgggttaca

SEQ ID NO: 623779 - DNA, 25 bp, Rattus norvegicus
gcatccgggttacaagcgagaggta

SEQ ID NO: 623780 - DNA, 25 bp, Rattus norvegicus
tacaagcgagaggtacgccctgctc

SEQ ID NO: 623781 - DNA, 25 bp, Rattus norvegicus
cctgctctgcgctccactctgtgcg

SEQ ID NO: 623782 - DNA, 25 bp, Rattus norvegicus
aaaaggaggatgagcagcagtcgtc

SEQ ID NO: 623783 - DNA, 25 bp, Rattus norvegicus
tcctggccaccagagctgaacgaaa

SEQ ID NO: 623784 - DNA, 25 bp, Rattus norvegicus
cgcgaagctgcttttcctggtcgca

SEQ ID NO: 623785 - DNA, 25 bp, Rattus norvegicus
gcacccgtcacgtggttaggccaac

SEQ ID NO: 623786 - DNA, 25 bp, Rattus norvegicus
ccgagatatgccaagtccacgtcca

SEQ ID NO: 623787 - DNA, 25 bp, Rattus norvegicus
agctggcccaggagttgttttatta

SEQ ID NO: 623788 - DNA, 25 bp, Rattus norvegicus
ctgaacgaaagacggcgcgaagctg

SEQ ID NO: 623789 - DNA, 25 bp, Rattus norvegicus
ttaggccaactccaatgggcggtgc

SEQ ID NO: 623790 - DNA, 25 bp, Rattus norvegicus
tggcggatgacagcaagcacccgtc

SEQ ID NO: 623791 - DNA, 25 bp, Rattus norvegicus
tcacgtgcctccgagcagtccaatg

SEQ ID NO: 623792 - DNA, 25 bp, Rattus norvegicus
gaccgcggatgcttcgttgtcacga

SEQ ID NO: 623793 - DNA, 25 bp, Rattus norvegicus
gggtagcacagtcggctccctttcg

SEQ ID NO: 623794 - DNA, 25 bp, Rattus norvegicus
gcgcctgtctaacggccgtaacgga

SEQ ID NO: 623795 - DNA, 25 bp, Rattus norvegicus
gtcagggcagcacccggacttcaac

SEQ ID NO: 623796 - DNA, 25 bp, Rattus norvegicus
gttttattatgagctccggacggca

SEQ ID NO: 623797 - DNA, 25 bp, Rattus norvegicus
ggcatgaccctcgtgagtcgcagta

SEQ ID NO: 623798 - DNA, 25 bp, Rattus norvegicus
aacttgtagagttcggcggcggcca

SEQ ID NO: 623799 - DNA, 25 bp, Rattus norvegicus
attctctggccgaagtcctgcggtc

SEQ ID NO: 623800 - DNA, 25 bp, Rattus norvegicus
cctagtcttgccttgggacgagatc

SEQ ID NO: 623801 - DNA, 25 bp, Rattus norvegicus
ctcgggacttagaccggagccaagc

SEQ ID NO: 623802 - DNA, 25 bp, Rattus norvegicus
gcggtggcaccatgttctctctcaa

SEQ ID NO: 623803 - DNA, 25 bp, Rattus norvegicus
cagctgcaccgggaacgctgaaccg

SEQ ID NO: 623804 - DNA, 25 bp, Rattus norvegicus
gggcgggcactcctcttcatcggtc

SEQ ID NO: 623805 - DNA, 25 bp, Rattus norvegicus
gacagtgcggcctagagacaactcc

SEQ ID NO: 623806 - DNA, 25 bp, Rattus norvegicus
tctagcgtcgcgctccgcgacagtg

SEQ ID NO: 623807 - DNA, 25 bp, Rattus norvegicus
gcgcgttctcaagatggcctctcgg

SEQ ID NO: 623808 - DNA, 25 bp, Rattus norvegicus
ggcctccgtagaagcgcgttctcaa

SEQ ID NO: 623809 - DNA, 25 bp, Rattus norvegicus
agccacgggcgcagtagaaacttgt

SEQ ID NO: 623810 - DNA, 25 bp, Rattus norvegicus
taggaccgtgaaagccgccatgacc

SEQ ID NO: 623811 - DNA, 25 bp, Rattus norvegicus
ggaccaagctgcacttactttcagg

SEQ ID NO: 623812 - DNA, 25 bp, Rattus norvegicus
ggaactcactgcagcggaaccggct

SEQ ID NO: 623813 - DNA, 25 bp, Rattus norvegicus
agactctccggaactcactgcagcg

SEQ ID NO: 623814 - DNA, 25 bp, Rattus norvegicus
ctcggtgtccctcgctccggaagga

SEQ ID NO: 623815 - DNA, 25 bp, Rattus norvegicus
tgactcgctcagactctccggaact

SEQ ID NO: 623816 - DNA, 25 bp, Rattus norvegicus
agaggacgctgactcgctcagactc

SEQ ID NO: 623817 - DNA, 25 bp, Rattus norvegicus
acgagcccgagcaccgagctacagg

SEQ ID NO: 623818 - DNA, 25 bp, Rattus norvegicus
tgcacttactttcaggacctttcta

SEQ ID NO: 623819 - DNA, 25 bp, Rattus norvegicus
cggaaccggctcagttgctctcaaa

SEQ ID NO: 623820 - DNA, 25 bp, Rattus norvegicus
ctccggaaggaccaagctgcactta

SEQ ID NO: 623821 - DNA, 25 bp, Rattus norvegicus
gctcagttgctctcaaagggccaca

SEQ ID NO: 623822 - DNA, 25 bp, Rattus norvegicus
gttgctctcaaagggccacaaggca

SEQ ID NO: 623823 - DNA, 25 bp, Rattus norvegicus
ggccacaaggcaggcagctgctctg

SEQ ID NO: 623824 - DNA, 25 bp, Rattus norvegicus
cgttcgtcttaaaaagaggacgctg

SEQ ID NO: 623825 - DNA, 25 bp, Rattus norvegicus
gcggggcgccatagctatacactac

SEQ ID NO: 623826 - DNA, 25 bp, Rattus norvegicus
ttcagccgtctagctctctaaaggg

SEQ ID NO: 623827 - DNA, 25 bp, Rattus norvegicus
gctgcaggcgctacaggtgaatacc

SEQ ID NO: 623828 - DNA, 25 bp, Rattus norvegicus
tctgcacttacgtgaggaaacactc

SEQ ID NO: 623829 - DNA, 25 bp, Rattus norvegicus
gctctctgccagagttggatctgca

SEQ ID NO: 623830 - DNA, 25 bp, Rattus norvegicus
ctctaaagggtattggggcactgcc

SEQ ID NO: 623831 - DNA, 25 bp, Rattus norvegicus
agaaggtcaccctatgcggcgtccg

SEQ ID NO: 623832 - DNA, 25 bp, Rattus norvegicus
cgtggtcgctttctgcttttgcatt

SEQ ID NO: 623833 - DNA, 25 bp, Rattus norvegicus
tttctaagagaaccgcagtggtgtc

SEQ ID NO: 623834 - DNA, 25 bp, Rattus norvegicus
ccgaaaagggctattggtcatctca

SEQ ID NO: 623835 - DNA, 25 bp, Rattus norvegicus
agagcctaaggttccgccacacaca

SEQ ID NO: 623836 - DNA, 25 bp, Rattus norvegicus
tgcctcaagcaacctgcagctcaga

SEQ ID NO: 623837 - DNA, 25 bp, Rattus norvegicus
caccgttcaagggtctgtcgacgaa

SEQ ID NO: 623838 - DNA, 25 bp, Rattus norvegicus
actctcctagttgtctttgcccggg

SEQ ID NO: 623839 - DNA, 25 bp, Rattus norvegicus
catcgtcgatagagtgggccgccgc

SEQ ID NO: 623840 - DNA, 25 bp, Rattus norvegicus
ctggccaggcttctagtgcgttccg

SEQ ID NO: 623841 - DNA, 25 bp, Rattus norvegicus
ctctacgctggccaggcttctagtg

SEQ ID NO: 623842 - DNA, 25 bp, Rattus norvegicus
atgctgtggtcccaacgctcccttt

SEQ ID NO: 623843 - DNA, 25 bp, Rattus norvegicus
agatagtcactcgtccgggtccctc

SEQ ID NO: 623844 - DNA, 25 bp, Rattus norvegicus
gtacctggtctatggccagaggaga

SEQ ID NO: 623845 - DNA, 25 bp, Rattus norvegicus
cggccaggttatcaggggcttgcaa

SEQ ID NO: 623846 - DNA, 25 bp, Rattus norvegicus
tcccagctactgaccagcggtcggg

SEQ ID NO: 623847 - DNA, 25 bp, Rattus norvegicus
gggtgctacggaccagcgcccttct

SEQ ID NO: 623848 - DNA, 25 bp, Rattus norvegicus
gctcggatgctgtggtcccaacgct

SEQ ID NO: 623849 - DNA, 25 bp, Rattus norvegicus
ctttcggaccgtgtggagctctgga

SEQ ID NO: 623850 - DNA, 25 bp, Rattus norvegicus
ctccctttcggaccgtgtggagctc

SEQ ID NO: 623851 - DNA, 25 bp, Rattus norvegicus
tggccagaggagatagtcactcgtc

SEQ ID NO: 623852 - DNA, 25 bp, Rattus norvegicus
acccgccggaccctcccagctactg

SEQ ID NO: 623853 - DNA, 25 bp, Rattus norvegicus
acaaatggcccttgtgcacggccga

SEQ ID NO: 623854 - DNA, 25 bp, Rattus norvegicus
agttgctgccgtgtcctgagcgatt

SEQ ID NO: 623855 - DNA, 25 bp, Rattus norvegicus
tcctgagcgattcgtgccagtcgcc

SEQ ID NO: 623856 - DNA, 25 bp, Rattus norvegicus
aggcagaaccgaggcttccacaggc

SEQ ID NO: 623857 - DNA, 25 bp, Rattus norvegicus
gagcaggaccctgccgggatgcact

SEQ ID NO: 623858 - DNA, 25 bp, Rattus norvegicus
agcctcggtgattttccatttcctc

SEQ ID NO: 623859 - DNA, 25 bp, Rattus norvegicus
tgcccgagtggacaccgcaatgcac

SEQ ID NO: 623860 - DNA, 25 bp, Rattus norvegicus
gcacttacccagtccgcttagcagg

SEQ ID NO: 623861 - DNA, 25 bp, Rattus norvegicus
tagcaggacggactcgctccttttc

SEQ ID NO: 623862 - DNA, 25 bp, Rattus norvegicus
tccactcgctttttgtggcggggcc

SEQ ID NO: 623863 - DNA, 25 bp, Rattus norvegicus
gggcgagcactgacgtttccttgaa

SEQ ID NO: 623864 - DNA, 25 bp, Rattus norvegicus
gactcaggccggcaagatttcctgc

SEQ ID NO: 623865 - DNA, 25 bp, Rattus norvegicus
gcacggccgagtcgcttccgaaaac

SEQ ID NO: 623866 - DNA, 25 bp, Rattus norvegicus
tttccttgaaggagccgccgtgact

SEQ ID NO: 623867 - DNA, 25 bp, Rattus norvegicus
agcgcgcctgaaaagctctaggaga

SEQ ID NO: 623868 - DNA, 25 bp, Rattus norvegicus
ggggcagcttcacagctactgcgca

SEQ ID NO: 623869 - DNA, 25 bp, Rattus norvegicus
cgggatcttcttctggtccttaatc

SEQ ID NO: 623870 - DNA, 25 bp, Rattus norvegicus
ggtccttaatcagcaggaactgcac

SEQ ID NO: 623871 - DNA, 25 bp, Rattus norvegicus
agttcggccaccttcagctctagct

SEQ ID NO: 623872 - DNA, 25 bp, Rattus norvegicus
agctctagctgcttctgtgtgcgcg

SEQ ID NO: 623873 - DNA, 25 bp, Rattus norvegicus
cagaagattggggtacacgtcccgg

SEQ ID NO: 623874 - DNA, 25 bp, Rattus norvegicus
ggtttctgcagcatgtcaccggtcg

SEQ ID NO: 623875 - DNA, 25 bp, Rattus norvegicus
ctgcgcatgcgaaagccttggcggc

SEQ ID NO: 623876 - DNA, 25 bp, Rattus norvegicus
ccagaatcttctacaagcgcgcctg

SEQ ID NO: 623877 - DNA, 25 bp, Rattus norvegicus
agcgatacgactgggcaccaccctg

SEQ ID NO: 623878 - DNA, 25 bp, Rattus norvegicus
tcggtgcgcttgatcgggatcttct

SEQ ID NO: 623879 - DNA, 25 bp, Rattus norvegicus
accacgtgcttcaggatgtcggtgc

SEQ ID NO: 623880 - DNA, 25 bp, Rattus norvegicus
ttaaggagcagtaaccgccagaatc

SEQ ID NO: 623881 - DNA, 25 bp, Rattus norvegicus
cgtccgcataaacatctcccgggga

SEQ ID NO: 623882 - DNA, 25 bp, Rattus norvegicus
catcagatcgaaactatagggtttc

SEQ ID NO: 623883 - DNA, 25 bp, Rattus norvegicus
gggtaccaaccactcctccagagat

SEQ ID NO: 623884 - DNA, 25 bp, Rattus norvegicus
ctaagaatcctcacccggggcgact

SEQ ID NO: 623885 - DNA, 25 bp, Rattus norvegicus
ggacctgttgcatgtcgcctcccag

SEQ ID NO: 623886 - DNA, 25 bp, Rattus norvegicus
gccctggcggacatcttgtctctct

SEQ ID NO: 623887 - DNA, 25 bp, Rattus norvegicus
acatctcccggggacaagcggggca

SEQ ID NO: 623888 - DNA, 25 bp, Rattus norvegicus
aggcggccacgcaaaacctgccgga

SEQ ID NO: 623889 - DNA, 25 bp, Rattus norvegicus
cgcgcggaaggaaaagctcagctac

SEQ ID NO: 623890 - DNA, 25 bp, Rattus norvegicus
gctcagctacccaagtaacttgcta

SEQ ID NO: 623891 - DNA, 25 bp, Rattus norvegicus
agtaacttgctaggcggtttccgct

SEQ ID NO: 623892 - DNA, 25 bp, Rattus norvegicus
gcgcgatccatcctgtttgttttta

SEQ ID NO: 623893 - DNA, 25 bp, Rattus norvegicus
cgcagcgggtgacatcagatcgaaa

SEQ ID NO: 623894 - DNA, 25 bp, Rattus norvegicus
tgaggttctcaccttagcggccgcg

SEQ ID NO: 623895 - DNA, 25 bp, Rattus norvegicus
ggtatttctggtacttcatcttgtc

SEQ ID NO: 623896 - DNA, 25 bp, Rattus norvegicus
gagaacctcgcaacacgcaggtccg

SEQ ID NO: 623897 - DNA, 25 bp, Rattus norvegicus
gcggcgctaagagaacctcgcaaca

SEQ ID NO: 623898 - DNA, 25 bp, Rattus norvegicus
ctggaggcggcgctaagagaacctc

SEQ ID NO: 623899 - DNA, 25 bp, Rattus norvegicus
tccaagcgccgcatagatcagctct

SEQ ID NO: 623900 - DNA, 25 bp, Rattus norvegicus
gcagcaccgtcaggtatttctggta

SEQ ID NO: 623901 - DNA, 25 bp, Rattus norvegicus
tggccatctgcagcaccgtcaggta

SEQ ID NO: 623902 - DNA, 25 bp, Rattus norvegicus
ggtgacgccgatggccatctgcagc

SEQ ID NO: 623903 - DNA, 25 bp, Rattus norvegicus
gcttcctcttgagcggcaggaggct

SEQ ID NO: 623904 - DNA, 25 bp, Rattus norvegicus
gagtccttaccacagcttcctcttg

SEQ ID NO: 623905 - DNA, 25 bp, Rattus norvegicus
ggcgatggctgctccaccagctctg

SEQ ID NO: 623906 - DNA, 25 bp, Rattus norvegicus
ggttgcgtgcaattcccagccagca

SEQ ID NO: 623907 - DNA, 25 bp, Rattus norvegicus
cagagctcggcggttgcgtgcaatt

SEQ ID NO: 623908 - DNA, 25 bp, Rattus norvegicus
atagatcagctctgggccatccgcc

SEQ ID NO: 623909 - DNA, 25 bp, Rattus norvegicus
cccaggagcacgcactcagcgggtt

SEQ ID NO: 623910 - DNA, 25 bp, Rattus norvegicus
ctcaggtggcacaaggaggctgcca

SEQ ID NO: 623911 - DNA, 25 bp, Rattus norvegicus
cctcgcgcctgcagcggcaggagga

SEQ ID NO: 623912 - DNA, 25 bp, Rattus norvegicus
caggaggaggacattcgctggctgt

SEQ ID NO: 623913 - DNA, 25 bp, Rattus norvegicus
tgcagcgcctgagggacgagcagct

SEQ ID NO: 623914 - DNA, 25 bp, Rattus norvegicus
tgacgcgcgaggtggcacagctcca

SEQ ID NO: 623915 - DNA, 25 bp, Rattus norvegicus
tgcaccagcgcctgtgtgacctgcg

SEQ ID NO: 623916 - DNA, 25 bp, Rattus norvegicus
cctgtgtgacctgcggctgcgcctg

SEQ ID NO: 623917 - DNA, 25 bp, Rattus norvegicus
gagcacgcactcagcgggttccaac

SEQ ID NO: 623918 - DNA, 25 bp, Rattus norvegicus
gcactcagcgggttccaactctgta

SEQ ID NO: 623919 - DNA, 25 bp, Rattus norvegicus
tcagcgggttccaactctgtacccg

SEQ ID NO: 623920 - DNA, 25 bp, Rattus norvegicus
caactctgtacccgggtgccggcag

SEQ ID NO: 623921 - DNA, 25 bp, Rattus norvegicus
ctcgcactgcccactgcccacggcc

SEQ ID NO: 623922 - DNA, 25 bp, Rattus norvegicus
accagcgcctgtgtgacctgcggct

SEQ ID NO: 623923 - DNA, 25 bp, Rattus norvegicus
gccgcaccgagcgagctggtgacaa

SEQ ID NO: 623924 - DNA, 25 bp, Rattus norvegicus
tgctcttcctgtcccagtgctacat

SEQ ID NO: 623925 - DNA, 25 bp, Rattus norvegicus
tgcggcagtagtccagaacccgatc

SEQ ID NO: 623926 - DNA, 25 bp, Rattus norvegicus
ctggcggagcccagcaacagtgcgc

SEQ ID NO: 623927 - DNA, 25 bp, Rattus norvegicus
agcccagcaacagtgcgcctgcggg

SEQ ID NO: 623928 - DNA, 25 bp, Rattus norvegicus
cccggacacgccctcttcggcgcgc

SEQ ID NO: 623929 - DNA, 25 bp, Rattus norvegicus
cacgcgcaccggcaagatggaggct

SEQ ID NO: 623930 - DNA, 25 bp, Rattus norvegicus
cacctgtcccgcgtgctgctcttcc

SEQ ID NO: 623931 - DNA, 25 bp, Rattus norvegicus
tgtcccagtgctacattctgtcggg

SEQ ID NO: 623932 - DNA, 25 bp, Rattus norvegicus
agtgctacattctgtcgggcgatgg

SEQ ID NO: 623933 - DNA, 25 bp, Rattus norvegicus
ttctgtcgggcgatggtgagttcaa

SEQ ID NO: 623934 - DNA, 25 bp, Rattus norvegicus
gaaagcccgtttccctgcggcagta

SEQ ID NO: 623935 - DNA, 25 bp, Rattus norvegicus
gcagtagtccagaacccgatcgacc

SEQ ID NO: 623936 - DNA, 25 bp, Rattus norvegicus
agccgctgcggtctgtccgccacct

SEQ ID NO: 623937 - DNA, 25 bp, Rattus norvegicus
cttgattggtttgcttccagtgttg

SEQ ID NO: 623938 - DNA, 25 bp, Rattus norvegicus
gagcgctcatctcgttctgcgcaag

SEQ ID NO: 623939 - DNA, 25 bp, Rattus norvegicus
tagagcgctcatctcgttctgcgca

SEQ ID NO: 623940 - DNA, 25 bp, Rattus norvegicus
agatagagcgctcatctcgttctgc

SEQ ID NO: 623941 - DNA, 25 bp, Rattus norvegicus
gcggtacagatagagcgctcatctc

SEQ ID NO: 623942 - DNA, 25 bp, Rattus norvegicus
ttggagcggtacagatagagcgctc

SEQ ID NO: 623943 - DNA, 25 bp, Rattus norvegicus
attggtttgcttccagtgttgtggg

SEQ ID NO: 623944 - DNA, 25 bp, Rattus norvegicus
gcgctcatctcgttctgcgcaagcg

SEQ ID NO: 623945 - DNA, 25 bp, Rattus norvegicus
tcccttgattggtttgcttccagtg

SEQ ID NO: 623946 - DNA, 25 bp, Rattus norvegicus
ctcttcccttgattggtttgcttcc

SEQ ID NO: 623947 - DNA, 25 bp, Rattus norvegicus
ccctctcttcccttgattggtttgc

SEQ ID NO: 623948 - DNA, 25 bp, Rattus norvegicus
agtccaatccgacggagcgagcgcg

SEQ ID NO: 623949 - DNA, 25 bp, Rattus norvegicus
gaagtccaatccgacggagcgagcg

SEQ ID NO: 623950 - DNA, 25 bp, Rattus norvegicus
gacagtggaaggttggagcggtaca

SEQ ID NO: 623951 - DNA, 25 bp, Rattus norvegicus
ttagcaaatgcgttaatatggcacg

SEQ ID NO: 623952 - DNA, 25 bp, Rattus norvegicus
tacgtcttcgattgctttagcctgg

SEQ ID NO: 623953 - DNA, 25 bp, Rattus norvegicus
gctctgattgatgctgtctggcggc

SEQ ID NO: 623954 - DNA, 25 bp, Rattus norvegicus
cgagcaggcggcacagtacaccaat

SEQ ID NO: 623955 - DNA, 25 bp, Rattus norvegicus
gtacaccaatgctgtgcgggaccgt

SEQ ID NO: 623956 - DNA, 25 bp, Rattus norvegicus
acctccgcggtgagttagacggagc

SEQ ID NO: 623957 - DNA, 25 bp, Rattus norvegicus
tgggcctggggtatctccaatcgat

SEQ ID NO: 623958 - DNA, 25 bp, Rattus norvegicus
ctccaatcgatggtcccgcagggac

SEQ ID NO: 623959 - DNA, 25 bp, Rattus norvegicus
tgggactgttacctgctagcaaacg

SEQ ID NO: 623960 - DNA, 25 bp, Rattus norvegicus
tccggtccttactcattaggctttg

SEQ ID NO: 623961 - DNA, 25 bp, Rattus norvegicus
tgcctcgcgtgctgagcagccttaa

SEQ ID NO: 623962 - DNA, 25 bp, Rattus norvegicus
agcagccttaactgtttgaggacta

SEQ ID NO: 623963 - DNA, 25 bp, Rattus norvegicus
tgctacgtacagaacggcggccgac

SEQ ID NO: 623964 - DNA, 25 bp, Rattus norvegicus
gcggccgactggtttttagcaaatg

SEQ ID NO: 623965 - DNA, 25 bp, Rattus norvegicus
ccctctgtgattggtcgatcgtcga

SEQ ID NO: 623966 - DNA, 25 bp, Rattus norvegicus
aagtcgccctagttgggccggcgct

SEQ ID NO: 623967 - DNA, 25 bp, Rattus norvegicus
cgagcggcgataggtcagtactgcc

SEQ ID NO: 623968 - DNA, 25 bp, Rattus norvegicus
gataggtcagtactgccacggccgg

SEQ ID NO: 623969 - DNA, 25 bp, Rattus norvegicus
cgccacgtgtacatagggcagaacc

SEQ ID NO: 623970 - DNA, 25 bp, Rattus norvegicus
agggcagaaccggaagcgcagaacc

SEQ ID NO: 623971 - DNA, 25 bp, Rattus norvegicus
aggaacctctgtccgcgaggccggc

SEQ ID NO: 623972 - DNA, 25 bp, Rattus norvegicus
cgattcctgcacgtcacaggtgaga

SEQ ID NO: 623973 - DNA, 25 bp, Rattus norvegicus
cggcctccaggaagcttggcgttaa

SEQ ID NO: 623974 - DNA, 25 bp, Rattus norvegicus
cttggcgttaatgccgtgggctgac

SEQ ID NO: 623975 - DNA, 25 bp, Rattus norvegicus
tgggcccgagctcagctttctcgaa

SEQ ID NO: 623976 - DNA, 25 bp, Rattus norvegicus
agctttctcgaagtcgccctagttg

SEQ ID NO: 623977 - DNA, 25 bp, Rattus norvegicus
gagcctgcgattcctgcacgtcaca

SEQ ID NO: 623978 - DNA, 25 bp, Rattus norvegicus
cgcagaaccgagtgaagggctagtc

SEQ ID NO: 623979 - DNA, 25 bp, Rattus norvegicus
tgggcttcgtgctggcctcgcgact

SEQ ID NO: 623980 - DNA, 25 bp, Rattus norvegicus
cccagcagcggggactagagtccgc

SEQ ID NO: 623981 - DNA, 25 bp, Rattus norvegicus
actctcggtaaactttggccacgtg

SEQ ID NO: 623982 - DNA, 25 bp, Rattus norvegicus
taaactttggccacgtgaactgccc

SEQ ID NO: 623983 - DNA, 25 bp, Rattus norvegicus
ccattcagcttttgcgccaatcacg

SEQ ID NO: 623984 - DNA, 25 bp, Rattus norvegicus
ccaatcccgagggatgccggccagg

SEQ ID NO: 623985 - DNA, 25 bp, Rattus norvegicus
cgccaatcacgaggcgcggacggat

SEQ ID NO: 623986 - DNA, 25 bp, Rattus norvegicus
ggctcagcatgctgctcgggctcgt

SEQ ID NO: 623987 - DNA, 25 bp, Rattus norvegicus
gccgcaggagctgctgttgcctcgc

SEQ ID NO: 623988 - DNA, 25 bp, Rattus norvegicus
ctaagccggaggatgtgcagctgca

SEQ ID NO: 623989 - DNA, 25 bp, Rattus norvegicus
gctcctttgcaatggcgcgctaagc

SEQ ID NO: 623990 - DNA, 25 bp, Rattus norvegicus
tgacgtgaggggctcctttgcaatg

SEQ ID NO: 623991 - DNA, 25 bp, Rattus norvegicus
tcttaacgcgcggtgcgtgacgtga

SEQ ID NO: 623992 - DNA, 25 bp, Rattus norvegicus
cggtgccgcttcttaacgcgcggtg

SEQ ID NO: 623993 - DNA, 25 bp, Rattus norvegicus
cgggttccagaaccgcactcgatta

SEQ ID NO: 623994 - DNA, 25 bp, Rattus norvegicus
ccgcactcgattaacccttcaaggg

SEQ ID NO: 623995 - DNA, 25 bp, Rattus norvegicus
gcgcgggtcggagcagtaattacct

SEQ ID NO: 623996 - DNA, 25 bp, Rattus norvegicus
cggagcagtaattacctgcggcggc

SEQ ID NO: 623997 - DNA, 25 bp, Rattus norvegicus
ctcgattaacccttcaaggggtgag

SEQ ID NO: 623998 - DNA, 25 bp, Rattus norvegicus
gggccagacgcacttcctcaatcct

SEQ ID NO: 623999 - DNA, 25 bp, Rattus norvegicus
gcaaccgcgggtcggcgacatcaga

SEQ ID NO: 624000 - DNA, 25 bp, Rattus norvegicus
gatctaggggtacgggcttctctcg

SEQ ID NO: 624001 - DNA, 25 bp, Rattus norvegicus
cgggcaaagcttggatctaggggta

SEQ ID NO: 624002 - DNA, 25 bp, Rattus norvegicus
agtgcaaggcgcaaagcaggcgacc

SEQ ID NO: 624003 - DNA, 25 bp, Rattus norvegicus
gatccagaagcccaccagagctgtg

SEQ ID NO: 624004 - DNA, 25 bp, Rattus norvegicus
tccaaccgtactctgcccagttatg

SEQ ID NO: 624005 - DNA, 25 bp, Rattus norvegicus
tgcccagttatgctctggccgccgg

SEQ ID NO: 624006 - DNA, 25 bp, Rattus norvegicus
tcgcggtgcagctcaaagaggcaac

SEQ ID NO: 624007 - DNA, 25 bp, Rattus norvegicus
ccgcctaattggctgcaggacggag

SEQ ID NO: 624008 - DNA, 25 bp, Rattus norvegicus
agggagctggctcatagcgatcaca

SEQ ID NO: 624009 - DNA, 25 bp, Rattus norvegicus
tagcgatcacagtaacaggcctctc

SEQ ID NO: 624010 - DNA, 25 bp, Rattus norvegicus
tctagttgccagaagcctaggctcc

SEQ ID NO: 624011 - DNA, 25 bp, Rattus norvegicus
ctgtctcgacttggggtctagttgc

SEQ ID NO: 624012 - DNA, 25 bp, Rattus norvegicus
tggccaccatgcgtgactgtctcga

SEQ ID NO: 624013 - DNA, 25 bp, Rattus norvegicus
cggatctaagcgttttgtggccacc

SEQ ID NO: 624014 - DNA, 25 bp, Rattus norvegicus
ctctctgaaacttcggcgggagtga

SEQ ID NO: 624015 - DNA, 25 bp, Rattus norvegicus
gctgtcctacagcaagcttagaggg

SEQ ID NO: 624016 - DNA, 25 bp, Rattus norvegicus
cagggtgacagctccgcgcctttat

SEQ ID NO: 624017 - DNA, 25 bp, Rattus norvegicus
atgactggttcgcactccctggtcc

SEQ ID NO: 624018 - DNA, 25 bp, Rattus norvegicus
aggcggtttcccatcaggctgtccg

SEQ ID NO: 624019 - DNA, 25 bp, Rattus norvegicus
aggcctctctcagggcaatcccgag

SEQ ID NO: 624020 - DNA, 25 bp, Rattus norvegicus
caggaattcgcaagggtcggacacc

SEQ ID NO: 624021 - DNA, 25 bp, Rattus norvegicus
tctgccacgtcgcatcgcttctgtg

SEQ ID NO: 624022 - DNA, 25 bp, Rattus norvegicus
gtgcctctcccagccaccatcatga

SEQ ID NO: 624023 - DNA, 25 bp, Rattus norvegicus
aacttcgtcgctctgccacgtcgca

SEQ ID NO: 624024 - DNA, 25 bp, Rattus norvegicus
tgtgcctctcccagccaccatcatg

SEQ ID NO: 624025 - DNA, 25 bp, Rattus norvegicus
catcgcttctgtgcctctcccagcc

SEQ ID NO: 624026 - DNA, 25 bp, Rattus norvegicus
gcatcgcttctgtgcctctcccagc

SEQ ID NO: 624027 - DNA, 25 bp, Rattus norvegicus
tcgcatcgcttctgtgcctctccca

SEQ ID NO: 624028 - DNA, 25 bp, Rattus norvegicus
cgtcgcatcgcttctgtgcctctcc

SEQ ID NO: 624029 - DNA, 25 bp, Rattus norvegicus
cacgtcgcatcgcttctgtgcctct

SEQ ID NO: 624030 - DNA, 25 bp, Rattus norvegicus
gccacgtcgcatcgcttctgtgcct

SEQ ID NO: 624031 - DNA, 25 bp, Rattus norvegicus
tgccacgtcgcatcgcttctgtgcc

SEQ ID NO: 624032 - DNA, 25 bp, Rattus norvegicus
cttcgtcgctctgccacgtcgcatc

SEQ ID NO: 624033 - DNA, 25 bp, Rattus norvegicus
acgtcgcatcgcttctgtgcctctc

SEQ ID NO: 624034 - DNA, 25 bp, Rattus norvegicus
gcaacttcgtcgctctgccacgtcg

SEQ ID NO: 624035 - DNA, 25 bp, Rattus norvegicus
cgccagaactaccaccaggactcgg

SEQ ID NO: 624036 - DNA, 25 bp, Rattus norvegicus
cctgcttcaacagtgcttgaacgga

SEQ ID NO: 624037 - DNA, 25 bp, Rattus norvegicus
gccgctttgagcctgagccctttgc

SEQ ID NO: 624038 - DNA, 25 bp, Rattus norvegicus
cgctttgagcctgagccctttgcaa

SEQ ID NO: 624039 - DNA, 25 bp, Rattus norvegicus
ctttgagcctgagccctttgcaact

SEQ ID NO: 624040 - DNA, 25 bp, Rattus norvegicus
tgagcctgagccctttgcaacttcg

SEQ ID NO: 624041 - DNA, 25 bp, Rattus norvegicus
gcctgagccctttgcaacttcgtcg

SEQ ID NO: 624042 - DNA, 25 bp, Rattus norvegicus
tgagccctttgcaacttcgtcgctc

SEQ ID NO: 624043 - DNA, 25 bp, Rattus norvegicus
aagtgcgccagaactaccaccagga

SEQ ID NO: 624044 - DNA, 25 bp, Rattus norvegicus
ttcctgcttcaacagtgcttgaacg

SEQ ID NO: 624045 - DNA, 25 bp, Rattus norvegicus
gcaagtgcgccagaactaccaccag

SEQ ID NO: 624046 - DNA, 25 bp, Rattus norvegicus
ggtttcctgcttcaacagtgcttga

SEQ ID NO: 624047 - DNA, 25 bp, Rattus norvegicus
ctccctcgcaagtgcgccagaacta

SEQ ID NO: 624048 - DNA, 25 bp, Rattus norvegicus
gtgcgccagaactaccaccaggact

SEQ ID NO: 624049 - DNA, 25 bp, Rattus norvegicus
tcctgatcctcctcagtgcttcacg

SEQ ID NO: 624050 - DNA, 25 bp, Rattus norvegicus
tcctcagtgcttcacggccccagcc

SEQ ID NO: 624051 - DNA, 25 bp, Rattus norvegicus
gatcctcctcagtgcttcacggccc

SEQ ID NO: 624052 - DNA, 25 bp, Rattus norvegicus
tgatcctcctcagtgcttcacggcc

SEQ ID NO: 624053 - DNA, 25 bp, Rattus norvegicus
ctgatcctcctcagtgcttcacggc

SEQ ID NO: 624054 - DNA, 25 bp, Rattus norvegicus
cctgatcctcctcagtgcttcacgg

SEQ ID NO: 624055 - DNA, 25 bp, Rattus norvegicus
ttcctgatcctcctcagtgcttcac

SEQ ID NO: 624056 - DNA, 25 bp, Rattus norvegicus
gttcctgatcctcctcagtgcttca

SEQ ID NO: 624057 - DNA, 25 bp, Rattus norvegicus
tgttcctgatcctcctcagtgcttc

SEQ ID NO: 624058 - DNA, 25 bp, Rattus norvegicus
cctcagtgcttcacggccccagccc

SEQ ID NO: 624059 - DNA, 25 bp, Rattus norvegicus
tcctcctcagtgcttcacggcccca

SEQ ID NO: 624060 - DNA, 25 bp, Rattus norvegicus
cgtgttcctgatcctcctcagtgct

SEQ ID NO: 624061 - DNA, 25 bp, Rattus norvegicus
accgtgttcctgatcctcctcagtg

SEQ ID NO: 624062 - DNA, 25 bp, Rattus norvegicus
gtgttcctgatcctcctcagtgctt

SEQ ID NO: 624063 - DNA, 25 bp, Rattus norvegicus
cgccgggccggaggctttcagctac

SEQ ID NO: 624064 - DNA, 25 bp, Rattus norvegicus
ccaatcgtaccaggtccgaagtgtc

SEQ ID NO: 624065 - DNA, 25 bp, Rattus norvegicus
tggggacagagagacaccaatcgta

SEQ ID NO: 624066 - DNA, 25 bp, Rattus norvegicus
ctaccgagggactcaagaggtctgg

SEQ ID NO: 624067 - DNA, 25 bp, Rattus norvegicus
aggctttcagctaccgagggactca

SEQ ID NO: 624068 - DNA, 25 bp, Rattus norvegicus
cagaccaagggtctgctgcgcgccg

SEQ ID NO: 624069 - DNA, 25 bp, Rattus norvegicus
tccaggggctcagaccaagggtctg

SEQ ID NO: 624070 - DNA, 25 bp, Rattus norvegicus
agtcccggtccaggggctcagacca

SEQ ID NO: 624071 - DNA, 25 bp, Rattus norvegicus
gcggtcttggcctcggagcagcctc

SEQ ID NO: 624072 - DNA, 25 bp, Rattus norvegicus
atccagatagtcgatcaggctgggg

SEQ ID NO: 624073 - DNA, 25 bp, Rattus norvegicus
tgagcatccagatagtcgatcaggc

SEQ ID NO: 624074 - DNA, 25 bp, Rattus norvegicus
ccggtgagcatccagatagtcgatc

SEQ ID NO: 624075 - DNA, 25 bp, Rattus norvegicus
ccagcccggtgagcatccagatagt

SEQ ID NO: 624076 - DNA, 25 bp, Rattus norvegicus
ttcagctaccgagggactcaagagg

SEQ ID NO: 624077 - DNA, 25 bp, Rattus norvegicus
ccggatggcagccaggtaaccctga

SEQ ID NO: 624078 - DNA, 25 bp, Rattus norvegicus
tttcctgccaggatagcgaccctcg

SEQ ID NO: 624079 - DNA, 25 bp, Rattus norvegicus
atcgccaggcgggttctagggcttt

SEQ ID NO: 624080 - DNA, 25 bp, Rattus norvegicus
agcacgctctttgggatcgccaggc

SEQ ID NO: 624081 - DNA, 25 bp, Rattus norvegicus
acttgcgagagagcacgctctttgg

SEQ ID NO: 624082 - DNA, 25 bp, Rattus norvegicus
tgcgcctcgcccaacttgcgagaga

SEQ ID NO: 624083 - DNA, 25 bp, Rattus norvegicus
ggttagcctccaggctgtctgcgcc

SEQ ID NO: 624084 - DNA, 25 bp, Rattus norvegicus
ctctgagacccggttagcctccagg

SEQ ID NO: 624085 - DNA, 25 bp, Rattus norvegicus
tggtgcatctgtcggtctctgagac

SEQ ID NO: 624086 - DNA, 25 bp, Rattus norvegicus
ttcttggaagcgtgtggtgcatctg

SEQ ID NO: 624087 - DNA, 25 bp, Rattus norvegicus
caggttgagcagtgggcaaagcgac

SEQ ID NO: 624088 - DNA, 25 bp, Rattus norvegicus
gttctagggctttcctgccaggata

SEQ ID NO: 624089 - DNA, 25 bp, Rattus norvegicus
gccaggtaaccctgagcccaggttg

SEQ ID NO: 624090 - DNA, 25 bp, Rattus norvegicus
ccctgagcccaggttgagctgggta

SEQ ID NO: 624091 - DNA, 25 bp, Rattus norvegicus
acggctgtgcgatacccacggagcc

SEQ ID NO: 624092 - DNA, 25 bp, Rattus norvegicus
cctgctctgccgctacggtcttggg

SEQ ID NO: 624093 - DNA, 25 bp, Rattus norvegicus
gctgtgcttctactccggacaagtc

SEQ ID NO: 624094 - DNA, 25 bp, Rattus norvegicus
tatacctgcagctgcgtcgcgacct

SEQ ID NO: 624095 - DNA, 25 bp, Rattus norvegicus
ctgctggtcccgagtaccatgtgtg

SEQ ID NO: 624096 - DNA, 25 bp, Rattus norvegicus
ggcgaccgcgagcatctccaggcga

SEQ ID NO: 624097 - DNA, 25 bp, Rattus norvegicus
gtaccatgtgtgacggcaccctgct

SEQ ID NO: 624098 - DNA, 25 bp, Rattus norvegicus
atcgagtggcttcgccggcttagag

SEQ ID NO: 624099 - DNA, 25 bp, Rattus norvegicus
ggccggagaactggcctctggttcc

SEQ ID NO: 624100 - DNA, 25 bp, Rattus norvegicus
ctgggtggactgctgacagcatccc

SEQ ID NO: 624101 - DNA, 25 bp, Rattus norvegicus
ggtgccttcccgaagcatcctggcg

SEQ ID NO: 624102 - DNA, 25 bp, Rattus norvegicus
gttcttaactaatgcggccaccttc

SEQ ID NO: 624103 - DNA, 25 bp, Rattus norvegicus
gacccgggcacaggtagtgttctta

SEQ ID NO: 624104 - DNA, 25 bp, Rattus norvegicus
cctttgggcgagacctatacctgca

SEQ ID NO: 624105 - DNA, 25 bp, Rattus norvegicus
ctcctggaagggagactggtcactt

SEQ ID NO: 624106 - DNA, 25 bp, Rattus norvegicus
cctgaagggtttgtcatgggcaaga

SEQ ID NO: 624107 - DNA, 25 bp, Rattus norvegicus
catgaggggcggactatgtttttcc

SEQ ID NO: 624108 - DNA, 25 bp, Rattus norvegicus
tctcgagctctccttttagggtata

SEQ ID NO: 624109 - DNA, 25 bp, Rattus norvegicus
ctttaagtgcgaccacagggccgga

SEQ ID NO: 624110 - DNA, 25 bp, Rattus norvegicus
ggcgacagatcacccggcacaggaa

SEQ ID NO: 624111 - DNA, 25 bp, Rattus norvegicus
cagctagcgctattccacaaggaca

SEQ ID NO: 624112 - DNA, 25 bp, Rattus norvegicus
gagagccgcgccttctgaacagcta

SEQ ID NO: 624113 - DNA, 25 bp, Rattus norvegicus
gtatatttctgctctcggtgggtcc

SEQ ID NO: 624114 - DNA, 25 bp, Rattus norvegicus
ctatttttaggagtcaggcctcggc

SEQ ID NO: 624115 - DNA, 25 bp, Rattus norvegicus
tgggaactccgtcaactttcatgga

SEQ ID NO: 624116 - DNA, 25 bp, Rattus norvegicus
ccgaggttcgcgatgctggatgaac

SEQ ID NO: 624117 - DNA, 25 bp, Rattus norvegicus
gtactgactgtctaccgaacgggga

SEQ ID NO: 624118 - DNA, 25 bp, Rattus norvegicus
ttccctctgaaggaccgtgttctcc

SEQ ID NO: 624119 - DNA, 25 bp, Rattus norvegicus
agcttagtcctgacccttcgaacct

SEQ ID NO: 624120 - DNA, 25 bp, Rattus norvegicus
gagcttagtcctgacccttcgaacc

SEQ ID NO: 624121 - DNA, 25 bp, Rattus norvegicus
ggagcttagtcctgacccttcgaac

SEQ ID NO: 624122 - DNA, 25 bp, Rattus norvegicus
tggagcttagtcctgacccttcgaa

SEQ ID NO: 624123 - DNA, 25 bp, Rattus norvegicus
ctggagcttagtcctgacccttcga

SEQ ID NO: 624124 - DNA, 25 bp, Rattus norvegicus
tctggagcttagtcctgacccttcg

SEQ ID NO: 624125 - DNA, 25 bp, Rattus norvegicus
tcccccagccgaggcagggaagagt

SEQ ID NO: 624126 - DNA, 25 bp, Rattus norvegicus
ttctggagcttagtcctgacccttc

SEQ ID NO: 624127 - DNA, 25 bp, Rattus norvegicus
cgggatcgagtttctggagcttagt

SEQ ID NO: 624128 - DNA, 25 bp, Rattus norvegicus
agcgggatcgagtttctggagctta

SEQ ID NO: 624129 - DNA, 25 bp, Rattus norvegicus
cagcgggatcgagtttctggagctt

SEQ ID NO: 624130 - DNA, 25 bp, Rattus norvegicus
aggcagggaagagtgcagcgggatc

SEQ ID NO: 624131 - DNA, 25 bp, Rattus norvegicus
cccagccgaggcagggaagagtgca

SEQ ID NO: 624132 - DNA, 25 bp, Rattus norvegicus
tagtcctgacccttcgaaccttcga

SEQ ID NO: 624133 - DNA, 25 bp, Rattus norvegicus
agttagacactcacctaggcgcccg

SEQ ID NO: 624134 - DNA, 25 bp, Rattus norvegicus
ttcgacccgtgagcctggaaagtta

SEQ ID NO: 624135 - DNA, 25 bp, Rattus norvegicus
tcctgctgccaacaataaaactcga

SEQ ID NO: 624136 - DNA, 25 bp, Rattus norvegicus
tgaccagctctcagcggctcatgct

SEQ ID NO: 624137 - DNA, 25 bp, Rattus norvegicus
ctcatgctgcgctggaaggcagtcc

SEQ ID NO: 624138 - DNA, 25 bp, Rattus norvegicus
gcccggagaatgaaacctcgcgata

SEQ ID NO: 624139 - DNA, 25 bp, Rattus norvegicus
cctcgcgatagttcgtctcagtttc

SEQ ID NO: 624140 - DNA, 25 bp, Rattus norvegicus
aaaacctggcgcttattggctgaga

SEQ ID NO: 624141 - DNA, 25 bp, Rattus norvegicus
tgagagcgcgacttcctccagcgtc

SEQ ID NO: 624142 - DNA, 25 bp, Rattus norvegicus
tccggcttggagctcagtgttaaga

SEQ ID NO: 624143 - DNA, 25 bp, Rattus norvegicus
tttagctgtcgccagcctcagggtc

SEQ ID NO: 624144 - DNA, 25 bp, Rattus norvegicus
agggtcgccagtaactagccagttc

SEQ ID NO: 624145 - DNA, 25 bp, Rattus norvegicus
aactcgacgcggagcgattaaatcg

SEQ ID NO: 624146 - DNA, 25 bp, Rattus norvegicus
cgttgtcttacgataggtgaaatga

SEQ ID NO: 624147 - DNA, 25 bp, Rattus norvegicus
gccttttcggagctggtctgcagcc

SEQ ID NO: 624148 - DNA, 25 bp, Rattus norvegicus
cgtagctgtcgtgcacgtcccgcag

SEQ ID NO: 624149 - DNA, 25 bp, Rattus norvegicus
cgtagctctcgcacttggcgctcgt

SEQ ID NO: 624150 - DNA, 25 bp, Rattus norvegicus
ttctagctcggcatccaggcggccg

SEQ ID NO: 624151 - DNA, 25 bp, Rattus norvegicus
ccgtggaccagctcagttcgtcgag

SEQ ID NO: 624152 - DNA, 25 bp, Rattus norvegicus
agttcgtcgagctgctgtcgcaagc

SEQ ID NO: 624153 - DNA, 25 bp, Rattus norvegicus
ctcctcggcgtagagcgcttgatct

SEQ ID NO: 624154 - DNA, 25 bp, Rattus norvegicus
tagagcgcttgatcttcggcccagc

SEQ ID NO: 624155 - DNA, 25 bp, Rattus norvegicus
agcagcaggttctcgcgctccagct

SEQ ID NO: 624156 - DNA, 25 bp, Rattus norvegicus
aggtccacggactggcgcaccgact

SEQ ID NO: 624157 - DNA, 25 bp, Rattus norvegicus
taaagccgggcattgagctcctgga

SEQ ID NO: 624158 - DNA, 25 bp, Rattus norvegicus
tcgtcctcgtacagctgcatgctct

SEQ ID NO: 624159 - DNA, 25 bp, Rattus norvegicus
tctgcagccgccaggacagcatctt

SEQ ID NO: 624160 - DNA, 25 bp, Rattus norvegicus
gcacccggcacacgtactcataaag

SEQ ID NO: 624161 - DNA, 25 bp, Rattus norvegicus
ccggctcttggcgactgccgaatcg

SEQ ID NO: 624162 - DNA, 25 bp, Rattus norvegicus
tttgcaaatggaggccgacgacacc

SEQ ID NO: 624163 - DNA, 25 bp, Rattus norvegicus
cctcttctgcatctctgggtttgca

SEQ ID NO: 624164 - DNA, 25 bp, Rattus norvegicus
gtacagttttcctccctcttctgca

SEQ ID NO: 624165 - DNA, 25 bp, Rattus norvegicus
tgggctttgctcctctttctgtaca

SEQ ID NO: 624166 - DNA, 25 bp, Rattus norvegicus
agtctcgccaactgcgtcgggctct

SEQ ID NO: 624167 - DNA, 25 bp, Rattus norvegicus
cgggacttcggaccagtctcgccaa

SEQ ID NO: 624168 - DNA, 25 bp, Rattus norvegicus
ggggaaccgctcattcatttccact

SEQ ID NO: 624169 - DNA, 25 bp, Rattus norvegicus
ccgccgctttgtgtgtcctggattt

SEQ ID NO: 624170 - DNA, 25 bp, Rattus norvegicus
gctttgaccttcagcgagccggagc

SEQ ID NO: 624171 - DNA, 25 bp, Rattus norvegicus
agggaagccgccagcgagcctatcc

SEQ ID NO: 624172 - DNA, 25 bp, Rattus norvegicus
ctgaggttcttgtttaccagcatta

SEQ ID NO: 624173 - DNA, 25 bp, Rattus norvegicus
tgcgatcccgaactccggctcttgg

SEQ ID NO: 624174 - DNA, 25 bp, Rattus norvegicus
accagcattaactccgctgagcgga

SEQ ID NO: 624175 - DNA, 25 bp, Rattus norvegicus
ggctgtacgtgaccacttagtcatt

SEQ ID NO: 624176 - DNA, 25 bp, Rattus norvegicus
gcccacagagcttgtccattggcca

SEQ ID NO: 624177 - DNA, 25 bp, Rattus norvegicus
tgtccattggccagtcgcgaaacct

SEQ ID NO: 624178 - DNA, 25 bp, Rattus norvegicus
agcgggctccgcgacgctgctgtca

SEQ ID NO: 624179 - DNA, 25 bp, Rattus norvegicus
ggccagtcgcgaaacctgcttcttt

SEQ ID NO: 624180 - DNA, 25 bp, Rattus norvegicus
agcagcccttgctctcatcttcgaa

SEQ ID NO: 624181 - DNA, 25 bp, Rattus norvegicus
cccattggctgtacgtgaccactta

SEQ ID NO: 624182 - DNA, 25 bp, Rattus norvegicus
gccgcttgagtagcagcccttgctc

SEQ ID NO: 624183 - DNA, 25 bp, Rattus norvegicus
ccacttagtcatttcattggcgccc

SEQ ID NO: 624184 - DNA, 25 bp, Rattus norvegicus
cggccactgtctcgccgcttgagta

SEQ ID NO: 624185 - DNA, 25 bp, Rattus norvegicus
ggctctgtcaccaagacccgcagtg

SEQ ID NO: 624186 - DNA, 25 bp, Rattus norvegicus
cccgccaggcgatggggctctgtca

SEQ ID NO: 624187 - DNA, 25 bp, Rattus norvegicus
ttgctctcatcttcgaacactaacc

SEQ ID NO: 624188 - DNA, 25 bp, Rattus norvegicus
aaacctgcttctttcccattggctg

SEQ ID NO: 624189 - DNA, 25 bp, Rattus norvegicus
tcctctgctgctggaagaactaccg

SEQ ID NO: 624190 - DNA, 25 bp, Rattus norvegicus
tcagcaaaaagagcctaggcgggtt

SEQ ID NO: 624191 - DNA, 25 bp, Rattus norvegicus
gaggcgatggcagctgtcagcaaaa

SEQ ID NO: 624192 - DNA, 25 bp, Rattus norvegicus
agtttacgaccctagtcctgctccg

SEQ ID NO: 624193 - DNA, 25 bp, Rattus norvegicus
ctgcaaatagcctgccgggacggtt

SEQ ID NO: 624194 - DNA, 25 bp, Rattus norvegicus
gagagttcgcacagcgctgcaaata

SEQ ID NO: 624195 - DNA, 25 bp, Rattus norvegicus
ttccagactgagaaaaggctgcgct

SEQ ID NO: 624196 - DNA, 25 bp, Rattus norvegicus
cgatttccaaaaggccgggtctgct

SEQ ID NO: 624197 - DNA, 25 bp, Rattus norvegicus
tgacggccacgtttgcctgcgcgca

SEQ ID NO: 624198 - DNA, 25 bp, Rattus norvegicus
tcgcatcacaaggtgttgacggcca

SEQ ID NO: 624199 - DNA, 25 bp, Rattus norvegicus
gtcgcctaccactcaattctggatc

SEQ ID NO: 624200 - DNA, 25 bp, Rattus norvegicus
gccggtagaaataactcgcatcaca

SEQ ID NO: 624201 - DNA, 25 bp, Rattus norvegicus
ttctggatcgttcccagccggtaga

SEQ ID NO: 624202 - DNA, 25 bp, Rattus norvegicus
tggcggctccaaggcctaaactctg

SEQ ID NO: 624203 - DNA, 25 bp, Rattus norvegicus
ttccactcgccgctacttcttattg

SEQ ID NO: 624204 - DNA, 25 bp, Rattus norvegicus
actcgccgctacttcttattgagtt

SEQ ID NO: 624205 - DNA, 25 bp, Rattus norvegicus
ggttgcaaggccacgaaaggctcaa

SEQ ID NO: 624206 - DNA, 25 bp, Rattus norvegicus
gccacgaaaggctcaagatgcgttc

SEQ ID NO: 624207 - DNA, 25 bp, Rattus norvegicus
gctcaagatgcgttctgatcctccg

SEQ ID NO: 624208 - DNA, 25 bp, Rattus norvegicus
atgcgttctgatcctccgcagcggg

SEQ ID NO: 624209 - DNA, 25 bp, Rattus norvegicus
tgatcctccgcagcgggcagtgtct

SEQ ID NO: 624210 - DNA, 25 bp, Rattus norvegicus
gaatctcgctcacacctatcatttg

SEQ ID NO: 624211 - DNA, 25 bp, Rattus norvegicus
acctatcatttggagccatcttcgc

SEQ ID NO: 624212 - DNA, 25 bp, Rattus norvegicus
ttggagccatcttcgctcagtcttc

SEQ ID NO: 624213 - DNA, 25 bp, Rattus norvegicus
cgttttttgattccactcgccgcta

SEQ ID NO: 624214 - DNA, 25 bp, Rattus norvegicus
cagtcttccaaacattccgagcgtt

SEQ ID NO: 624215 - DNA, 25 bp, Rattus norvegicus
tcttcgctcagtcttccaaacattc

SEQ ID NO: 624216 - DNA, 25 bp, Rattus norvegicus
cattccgagcgttttttgattccac

SEQ ID NO: 624217 - DNA, 25 bp, Rattus norvegicus
ccgctgacttcgctctcataaacag

SEQ ID NO: 624218 - DNA, 25 bp, Rattus norvegicus
acgctggactcggtgtcacgttacg

SEQ ID NO: 624219 - DNA, 25 bp, Rattus norvegicus
actcggtgtcacgttacggcttctg

SEQ ID NO: 624220 - DNA, 25 bp, Rattus norvegicus
cggtgtcacgttacggcttctgctg

SEQ ID NO: 624221 - DNA, 25 bp, Rattus norvegicus
tcacgttacggcttctgctggggcg

SEQ ID NO: 624222 - DNA, 25 bp, Rattus norvegicus
ggccgaggatcagcaacaaggaaga

SEQ ID NO: 624223 - DNA, 25 bp, Rattus norvegicus
gatcagcaacaaggaagaaagtttc

SEQ ID NO: 624224 - DNA, 25 bp, Rattus norvegicus
ctgggtgtgtggtttgtcgtctccc

SEQ ID NO: 624225 - DNA, 25 bp, Rattus norvegicus
tccgttctctacaatccggtctcgg

SEQ ID NO: 624226 - DNA, 25 bp, Rattus norvegicus
gttctctacaatccggtctcggttc

SEQ ID NO: 624227 - DNA, 25 bp, Rattus norvegicus
aatccggtctcggttcctgcgctac

SEQ ID NO: 624228 - DNA, 25 bp, Rattus norvegicus
tgcgctaccagcgacctcttggggc

SEQ ID NO: 624229 - DNA, 25 bp, Rattus norvegicus
acttcgctctcataaacagtcgccg

SEQ ID NO: 624230 - DNA, 25 bp, Rattus norvegicus
gtctcggttcctgcgctaccagcga

SEQ ID NO: 624231 - DNA, 25 bp, Rattus norvegicus
gcacaaaggtaaaggcggccacagc

SEQ ID NO: 624232 - DNA, 25 bp, Rattus norvegicus
ggcttgctccatccctttgagagga

SEQ ID NO: 624233 - DNA, 25 bp, Rattus norvegicus
cccggtgaatcctcaggcgggtcgc

SEQ ID NO: 624234 - DNA, 25 bp, Rattus norvegicus
tcctgctgacagaggcgggctgtcc

SEQ ID NO: 624235 - DNA, 25 bp, Rattus norvegicus
ttcctgtctcgaaggcgaaaatggc

SEQ ID NO: 624236 - DNA, 25 bp, Rattus norvegicus
gaaccaccgcttgggcgcacaaagg

SEQ ID NO: 624237 - DNA, 25 bp, Rattus norvegicus
acccagcggctgcactggaacagtc

SEQ ID NO: 624238 - DNA, 25 bp, Rattus norvegicus
tcttttagcagcagagggctcagca

SEQ ID NO: 624239 - DNA, 25 bp, Rattus norvegicus
tgagccggatcctcttttagcagca

SEQ ID NO: 624240 - DNA, 25 bp, Rattus norvegicus
taatcaagagttgggctgagccgga

SEQ ID NO: 624241 - DNA, 25 bp, Rattus norvegicus
gagctctcttctgggataatcaaga

SEQ ID NO: 624242 - DNA, 25 bp, Rattus norvegicus
acaacgcttacgtcgctaggagctc

SEQ ID NO: 624243 - DNA, 25 bp, Rattus norvegicus
cttgcgcgagcgcttacaacgctta

SEQ ID NO: 624244 - DNA, 25 bp, Rattus norvegicus
atcagaggtcctagctctgccggtc

SEQ ID NO: 624245 - DNA, 25 bp, Rattus norvegicus
acgctgccttcaggcatgagaagga

SEQ ID NO: 624246 - DNA, 25 bp, Rattus norvegicus
tgaaagtcttccgatactgcaccgg

SEQ ID NO: 624247 - DNA, 25 bp, Rattus norvegicus
gttccaaacgctgccttcaggcatg

SEQ ID NO: 624248 - DNA, 25 bp, Rattus norvegicus
ttcaggcatgagaaggaaacacttg

SEQ ID NO: 624249 - DNA, 25 bp, Rattus norvegicus
catgagaaggaaacacttggggacg

SEQ ID NO: 624250 - DNA, 25 bp, Rattus norvegicus
gacgagttttgaaagtcttccgata

SEQ ID NO: 624251 - DNA, 25 bp, Rattus norvegicus
gttttgaaagtcttccgatactgca

SEQ ID NO: 624252 - DNA, 25 bp, Rattus norvegicus
ttccgatactgcaccgggtgaaggg

SEQ ID NO: 624253 - DNA, 25 bp, Rattus norvegicus
gggagttaattaacgccaggcttgc

SEQ ID NO: 624254 - DNA, 25 bp, Rattus norvegicus
ttaattaacgccaggcttgctcagc

SEQ ID NO: 624255 - DNA, 25 bp, Rattus norvegicus
taacgccaggcttgctcagcgagtg

SEQ ID NO: 624256 - DNA, 25 bp, Rattus norvegicus
ccaggtcgcatgctgaggtgcgcgc

SEQ ID NO: 624257 - DNA, 25 bp, Rattus norvegicus
ggtcgttccaaacgctgccttcagg

SEQ ID NO: 624258 - DNA, 25 bp, Rattus norvegicus
gtcttccgatactgcaccgggtgaa

SEQ ID NO: 624259 - DNA, 25 bp, Rattus norvegicus
ccagtataaagccaacccaggtgcc

SEQ ID NO: 624260 - DNA, 25 bp, Rattus norvegicus
caggaggctccgagcatcgcatcgc

SEQ ID NO: 624261 - DNA, 25 bp, Rattus norvegicus
aacgcacggcgacagtctccttctg

SEQ ID NO: 624262 - DNA, 25 bp, Rattus norvegicus
ttcctggccgccataaagcaggagg

SEQ ID NO: 624263 - DNA, 25 bp, Rattus norvegicus
atcaagcgcggcagccaagttcctg

SEQ ID NO: 624264 - DNA, 25 bp, Rattus norvegicus
cctgcgatttggtccgggatcaagc

SEQ ID NO: 624265 - DNA, 25 bp, Rattus norvegicus
ctgcaggcggagagccgtaaaaatc

SEQ ID NO: 624266 - DNA, 25 bp, Rattus norvegicus
ccctcgggcaacagcatcaagaaga

SEQ ID NO: 624267 - DNA, 25 bp, Rattus norvegicus
ttgccgagagctcctaaacgcacgg

SEQ ID NO: 624268 - DNA, 25 bp, Rattus norvegicus
ccgtggtggctttcccagtataaag

SEQ ID NO: 624269 - DNA, 25 bp, Rattus norvegicus
cccattgtcctctgttatccgtgac

SEQ ID NO: 624270 - DNA, 25 bp, Rattus norvegicus
ctgttatccgtgacccgtggtggct

SEQ ID NO: 624271 - DNA, 25 bp, Rattus norvegicus
ccgtaaaaatccacgtgagctgccc

SEQ ID NO: 624272 - DNA, 25 bp, Rattus norvegicus
agcatcaagaagaagggaagagccc

SEQ ID NO: 624273 - DNA, 25 bp, Rattus norvegicus
ttcttggaggcatgagaacgaagga

SEQ ID NO: 624274 - DNA, 25 bp, Rattus norvegicus
ggtaaccggactgatgggtccatca

SEQ ID NO: 624275 - DNA, 25 bp, Rattus norvegicus
gccgtaatcgtggtaaccggactga

SEQ ID NO: 624276 - DNA, 25 bp, Rattus norvegicus
ccagagacgtaatcgcagccgccgc

SEQ ID NO: 624277 - DNA, 25 bp, Rattus norvegicus
tttactccacagaagatgaatcaag

SEQ ID NO: 624278 - DNA, 25 bp, Rattus norvegicus
gtttgatttttctttactccacaga

SEQ ID NO: 624279 - DNA, 25 bp, Rattus norvegicus
ggtaggtgcatgtttgatttttctt

SEQ ID NO: 624280 - DNA, 25 bp, Rattus norvegicus
aggcctggagtctgacggtcctaac

SEQ ID NO: 624281 - DNA, 25 bp, Rattus norvegicus
ggagtctgacggtcctaacgtgaca

SEQ ID NO: 624282 - DNA, 25 bp, Rattus norvegicus
tcctaacgtgacagagaatggcctg

SEQ ID NO: 624283 - DNA, 25 bp, Rattus norvegicus
tcgtactgatgaagacaggactgtc

SEQ ID NO: 624284 - DNA, 25 bp, Rattus norvegicus
cgccgccgtcgtactgatgaagaca

SEQ ID NO: 624285 - DNA, 25 bp, Rattus norvegicus
ttcccgccgccgtcgtactgatgaa

SEQ ID NO: 624286 - DNA, 25 bp, Rattus norvegicus
acaggactgtcatggacggaggcct

SEQ ID NO: 624287 - DNA, 25 bp, Rattus norvegicus
ggacatcgcccgctaactttgagcc

SEQ ID NO: 624288 - DNA, 25 bp, Rattus norvegicus
ccgaggtagggcaaccgtgagccaa

SEQ ID NO: 624289 - DNA, 25 bp, Rattus norvegicus
ggctcagctcataggaccaagtcaa

SEQ ID NO: 624290 - DNA, 25 bp, Rattus norvegicus
agcaggcttacaggcagagttttca

SEQ ID NO: 624291 - DNA, 25 bp, Rattus norvegicus
ttacaggcagagttttcacacgctc

SEQ ID NO: 624292 - DNA, 25 bp, Rattus norvegicus
agagttttcacacgctcaagctccc

SEQ ID NO: 624293 - DNA, 25 bp, Rattus norvegicus
ggccaggcactttcccgcagccgct

SEQ ID NO: 624294 - DNA, 25 bp, Rattus norvegicus
ctcgcggtgcattgggagacgccat

SEQ ID NO: 624295 - DNA, 25 bp, Rattus norvegicus
gccactgacccagctccggacatcg

SEQ ID NO: 624296 - DNA, 25 bp, Rattus norvegicus
agacgccatgttggctcagctcata

SEQ ID NO: 624297 - DNA, 25 bp, Rattus norvegicus
cgggccaggccaagcactacgtgaa

SEQ ID NO: 624298 - DNA, 25 bp, Rattus norvegicus
gccaagcactacgtgaaaggccgag

SEQ ID NO: 624299 - DNA, 25 bp, Rattus norvegicus
ccgcccgatgctacaccaggccatc

SEQ ID NO: 624300 - DNA, 25 bp, Rattus norvegicus
ccaagtcaaaagcaggcttacaggc

SEQ ID NO: 624301 - DNA, 25 bp, Rattus norvegicus
gagggccacctggtccgtgatctgc

SEQ ID NO: 624302 - DNA, 25 bp, Rattus norvegicus
ggagcactgtgctgcattcaacacg

SEQ ID NO: 624303 - DNA, 25 bp, Rattus norvegicus
gcagggaaatatatccggacaggta

SEQ ID NO: 624304 - DNA, 25 bp, Rattus norvegicus
taaaggcgaccacccggtcggctga

SEQ ID NO: 624305 - DNA, 25 bp, Rattus norvegicus
tccgtatgtggtccataaaggcgac

SEQ ID NO: 624306 - DNA, 25 bp, Rattus norvegicus
ctgcattcaacacgaacagctcgct

SEQ ID NO: 624307 - DNA, 25 bp, Rattus norvegicus
tccgtgatctgcaggtcagggaaga

SEQ ID NO: 624308 - DNA, 25 bp, Rattus norvegicus
gaaggggatgttccgggcccactca

SEQ ID NO: 624309 - DNA, 25 bp, Rattus norvegicus
actcaacggcgctgaagagcatccg

SEQ ID NO: 624310 - DNA, 25 bp, Rattus norvegicus
gtgcggccagttcgcaaatgttctc

SEQ ID NO: 624311 - DNA, 25 bp, Rattus norvegicus
ttaggctgcatgcactgactgccga

SEQ ID NO: 624312 - DNA, 25 bp, Rattus norvegicus
cactgactgccgaagcgcgacgtgg

SEQ ID NO: 624313 - DNA, 25 bp, Rattus norvegicus
tgagcttctccacttgctcttggaa

SEQ ID NO: 624314 - DNA, 25 bp, Rattus norvegicus
cttgctcttggaagatccgtatgtg

SEQ ID NO: 624315 - DNA, 25 bp, Rattus norvegicus
cacgtgtagctcaggttcctccgca

SEQ ID NO: 624316 - DNA, 25 bp, Rattus norvegicus
ccacgtgctgactaccattgccata

SEQ ID NO: 624317 - DNA, 25 bp, Rattus norvegicus
gccttttgtgtgtgcgagggtgcaa

SEQ ID NO: 624318 - DNA, 25 bp, Rattus norvegicus
tgccatatctatgggggccgcgtcc

SEQ ID NO: 624319 - DNA, 25 bp, Rattus norvegicus
gtcgcgccacgtgctgactaccatt

SEQ ID NO: 624320 - DNA, 25 bp, Rattus norvegicus
tggctgccctgagagccgggcacct

SEQ ID NO: 624321 - DNA, 25 bp, Rattus norvegicus
cttgcagccctcgcacgtgaactgg

SEQ ID NO: 624322 - DNA, 25 bp, Rattus norvegicus
gtagctcaggttcctccgcacgctg

SEQ ID NO: 624323 - DNA, 25 bp, Rattus norvegicus
cgcggcacgtgtagctcaggttcct

SEQ ID NO: 624324 - DNA, 25 bp, Rattus norvegicus
gaagccgataccttcccgtctcatg

SEQ ID NO: 624325 - DNA, 25 bp, Rattus norvegicus
ggaagaaatgagaagccgatacctt

SEQ ID NO: 624326 - DNA, 25 bp, Rattus norvegicus
gctgctgtttgtcgctgcctgggcc

SEQ ID NO: 624327 - DNA, 25 bp, Rattus norvegicus
ccgcacgctgcgcttgaagaagctc

SEQ ID NO: 624328 - DNA, 25 bp, Rattus norvegicus
cacgctgcgcttgaagaagctcttg

SEQ ID NO: 624329 - DNA, 25 bp, Rattus norvegicus
aatgcgatttataggcgccggggct

SEQ ID NO: 624330 - DNA, 25 bp, Rattus norvegicus
atgcctctaaatgcgcagctcgccg

SEQ ID NO: 624331 - DNA, 25 bp, Rattus norvegicus
ctcaacttggcgatgcctctaaatg

SEQ ID NO: 624332 - DNA, 25 bp, Rattus norvegicus
agacttagtctctctcaacttggcg

SEQ ID NO: 624333 - DNA, 25 bp, Rattus norvegicus
tgaggatggagccaaagacttagtc

SEQ ID NO: 624334 - DNA, 25 bp, Rattus norvegicus
ctcttaaaggctccgcgaggggttg

SEQ ID NO: 624335 - DNA, 25 bp, Rattus norvegicus
gcgcacacagtacgcctcttaaagg

SEQ ID NO: 624336 - DNA, 25 bp, Rattus norvegicus
gcagagggaacagcccggtcctagc

SEQ ID NO: 624337 - DNA, 25 bp, Rattus norvegicus
cgccttataaggcagccgccggggt

SEQ ID NO: 624338 - DNA, 25 bp, Rattus norvegicus
aacttagcgcacgttgccatggcga

SEQ ID NO: 624339 - DNA, 25 bp, Rattus norvegicus
gacacgactgctgcaacttagcgca

SEQ ID NO: 624340 - DNA, 25 bp, Rattus norvegicus
tagtgaactttgacacgactgctgc

SEQ ID NO: 624341 - DNA, 25 bp, Rattus norvegicus
agctcactgagctctctatatagtg

SEQ ID NO: 624342 - DNA, 25 bp, Rattus norvegicus
ggcttctccgcgatcagctcactga

SEQ ID NO: 624343 - DNA, 25 bp, Rattus norvegicus
gggaagtcaccgaatgtcaaaagta

SEQ ID NO: 624344 - DNA, 25 bp, Rattus norvegicus
gggccctgcatcgatccgaagccta

SEQ ID NO: 624345 - DNA, 25 bp, Rattus norvegicus
ccggtggccaggacactagaagtcc

SEQ ID NO: 624346 - DNA, 25 bp, Rattus norvegicus
gctgaggatgtcaccgcactaaata

SEQ ID NO: 624347 - DNA, 25 bp, Rattus norvegicus
agccagagctcgaacgattttcctc

SEQ ID NO: 624348 - DNA, 25 bp, Rattus norvegicus
gcgcagagagcagggtaaatcattt

SEQ ID NO: 624349 - DNA, 25 bp, Rattus norvegicus
gtggataaagcccagagcacactcc

SEQ ID NO: 624350 - DNA, 25 bp, Rattus norvegicus
atcgataccgagtgattagaagccc

SEQ ID NO: 624351 - DNA, 25 bp, Rattus norvegicus
accaccgccagggagcttaagcgca

SEQ ID NO: 624352 - DNA, 25 bp, Rattus norvegicus
cgtccctctgtcttcgacggaaaag

SEQ ID NO: 624353 - DNA, 25 bp, Rattus norvegicus
cgcctggcttcgcagatagagctga

SEQ ID NO: 624354 - DNA, 25 bp, Rattus norvegicus
cttgggagccatccgctgtacatca

SEQ ID NO: 624355 - DNA, 25 bp, Rattus norvegicus
caccggagttgatggctttgctcgc

SEQ ID NO: 624356 - DNA, 25 bp, Rattus norvegicus
ctccgggctggagtgttttaagatg

SEQ ID NO: 624357 - DNA, 25 bp, Rattus norvegicus
ctgaaggcgaggaccgcaagcatta

SEQ ID NO: 624358 - DNA, 25 bp, Rattus norvegicus
caggatgcactctccctgggcgcgt

SEQ ID NO: 624359 - DNA, 25 bp, Rattus norvegicus
tgcactctccctgggcgcgtgtggc

SEQ ID NO: 624360 - DNA, 25 bp, Rattus norvegicus
gctttccggactctcggccgcacac

SEQ ID NO: 624361 - DNA, 25 bp, Rattus norvegicus
ggccgcacacatcccgcctttgttt

SEQ ID NO: 624362 - DNA, 25 bp, Rattus norvegicus
gacgcgccgtcccaccaagcgtttc

SEQ ID NO: 624363 - DNA, 25 bp, Rattus norvegicus
caccaagcgtttccggccgtccgcg

SEQ ID NO: 624364 - DNA, 25 bp, Rattus norvegicus
gccccaggccgtgaggtcgaccaga

SEQ ID NO: 624365 - DNA, 25 bp, Rattus norvegicus
caagcattaccgctcgcactgatcg

SEQ ID NO: 624366 - DNA, 25 bp, Rattus norvegicus
tctgctagcagccctgaaggcgagg

SEQ ID NO: 624367 - DNA, 25 bp, Rattus norvegicus
gcgaggaccgcaagcattaccgctc

SEQ ID NO: 624368 - DNA, 25 bp, Rattus norvegicus
gcagccagcgcaggcgggcatctca

SEQ ID NO: 624369 - DNA, 25 bp, Rattus norvegicus
gggggaccattgtctgctagcagcc

SEQ ID NO: 624370 - DNA, 25 bp, Rattus norvegicus
gcaggtcccggcaggatgcactctc

SEQ ID NO: 624371 - DNA, 25 bp, Rattus norvegicus
ttgctgtcccttgtggctgtactcg

SEQ ID NO: 624372 - DNA, 25 bp, Rattus norvegicus
tcccaggtgtgacaggaaggagttc

SEQ ID NO: 624373 - DNA, 25 bp, Rattus norvegicus
gtggctctcccaggtgtgacaggaa

SEQ ID NO: 624374 - DNA, 25 bp, Rattus norvegicus
agttccctgggctagctaggcgtgc

SEQ ID NO: 624375 - DNA, 25 bp, Rattus norvegicus
tctcagctagcgcagaggcagctgc

SEQ ID NO: 624376 - DNA, 25 bp, Rattus norvegicus
aagagccacgggacttcctcggcca

SEQ ID NO: 624377 - DNA, 25 bp, Rattus norvegicus
gctgtactcgctgctccggagaaca

SEQ ID NO: 624378 - DNA, 25 bp, Rattus norvegicus
ataggagcgtcccaagagccacggg

SEQ ID NO: 624379 - DNA, 25 bp, Rattus norvegicus
ctgatgcaaaggacataggagcgtc

SEQ ID NO: 624380 - DNA, 25 bp, Rattus norvegicus
aagcagccctgatgcaaaggacata

SEQ ID NO: 624381 - DNA, 25 bp, Rattus norvegicus
tcgctgctccggagaacaccaagca

SEQ ID NO: 624382 - DNA, 25 bp, Rattus norvegicus
ctcactttcctaggatccgccgttg

SEQ ID NO: 624383 - DNA, 25 bp, Rattus norvegicus
taggcgtgcggagagtgattattcc

SEQ ID NO: 624384 - DNA, 25 bp, Rattus norvegicus
aggatccgccgttgctgtcccttgt

SEQ ID NO: 624385 - DNA, 25 bp, Rattus norvegicus
tgtagttgcggttctaggcatcacc

SEQ ID NO: 624386 - DNA, 25 bp, Rattus norvegicus
caaaacgctgcatgcgtgcagcaag

SEQ ID NO: 624387 - DNA, 25 bp, Rattus norvegicus
ggcaggcggtcggacagcaggccac

SEQ ID NO: 624388 - DNA, 25 bp, Rattus norvegicus
gttgcggttctaggcatcacccatc

SEQ ID NO: 624389 - DNA, 25 bp, Rattus norvegicus
gcggttctaggcatcacccatcttg

SEQ ID NO: 624390 - DNA, 25 bp, Rattus norvegicus
ggataaacacaaaacgctgcatgcg

SEQ ID NO: 624391 - DNA, 25 bp, Rattus norvegicus
ggcatcacccatcttgccgatgctg

SEQ ID NO: 624392 - DNA, 25 bp, Rattus norvegicus
gcgcaggagtcgttcatgctgctta

SEQ ID NO: 624393 - DNA, 25 bp, Rattus norvegicus
ggagtcgttcatgctgcttaaagtc

SEQ ID NO: 624394 - DNA, 25 bp, Rattus norvegicus
agtcgttcatgctgcttaaagtcat

SEQ ID NO: 624395 - DNA, 25 bp, Rattus norvegicus
tactgtgccggtttgctggtggctt

SEQ ID NO: 624396 - DNA, 25 bp, Rattus norvegicus
tttgctggtggcttgtgccagctgc

SEQ ID NO: 624397 - DNA, 25 bp, Rattus norvegicus
ccggtcccagctgatgtgcaggcag

SEQ ID NO: 624398 - DNA, 25 bp, Rattus norvegicus
ctaggcatcacccatcttgccgatg

SEQ ID NO: 624399 - DNA, 25 bp, Rattus norvegicus
cgcagggaggtcctaatgcctgtca

SEQ ID NO: 624400 - DNA, 25 bp, Rattus norvegicus
cccgcgatctgattggataaagtgg

SEQ ID NO: 624401 - DNA, 25 bp, Rattus norvegicus
acttcccaggacattggcagtggca

SEQ ID NO: 624402 - DNA, 25 bp, Rattus norvegicus
ccaggacattggcagtggcagcccg

SEQ ID NO: 624403 - DNA, 25 bp, Rattus norvegicus
tctgcgtgtgcagcaagcgagtgaa

SEQ ID NO: 624404 - DNA, 25 bp, Rattus norvegicus
gcccgcggctctgcgtgtgcagcaa

SEQ ID NO: 624405 - DNA, 25 bp, Rattus norvegicus
tctttgcaaggggaagggcactgca

SEQ ID NO: 624406 - DNA, 25 bp, Rattus norvegicus
tcggctcatctttgcaaggggaagg

SEQ ID NO: 624407 - DNA, 25 bp, Rattus norvegicus
agcccagggcaggttcgcctgtcct

SEQ ID NO: 624408 - DNA, 25 bp, Rattus norvegicus
ggtcctaatgcctgtcacttcccag

SEQ ID NO: 624409 - DNA, 25 bp, Rattus norvegicus
aggaggatcggctcatctttgcaag

SEQ ID NO: 624410 - DNA, 25 bp, Rattus norvegicus
ctccgacccgatccctcgcagcatc

SEQ ID NO: 624411 - DNA, 25 bp, Rattus norvegicus
cctccgagaagttgtcgcccgggag

SEQ ID NO: 624412 - DNA, 25 bp, Rattus norvegicus
gccggtcacgacctccgagaagttg

SEQ ID NO: 624413 - DNA, 25 bp, Rattus norvegicus
gccctactctgcaggcttctcggaa

SEQ ID NO: 624414 - DNA, 25 bp, Rattus norvegicus
actctgcaggcttctcggaagtaca

SEQ ID NO: 624415 - DNA, 25 bp, Rattus norvegicus
ttctcggaagtacaagctgcgccgc

SEQ ID NO: 624416 - DNA, 25 bp, Rattus norvegicus
gaagtacaagctgcgccgcccgagc

SEQ ID NO: 624417 - DNA, 25 bp, Rattus norvegicus
gagcgaccgccctacacctggtctt

SEQ ID NO: 624418 - DNA, 25 bp, Rattus norvegicus
tccaggcgctcgcaggcatgcagcc

SEQ ID NO: 624419 - DNA, 25 bp, Rattus norvegicus
tacacctggtcttcgcgcgcagccc

SEQ ID NO: 624420 - DNA, 25 bp, Rattus norvegicus
ggggctcatgcagccgccaaggtaa

SEQ ID NO: 624421 - DNA, 25 bp, Rattus norvegicus
tcatgcagccgccaaggtaagcgtg

SEQ ID NO: 624422 - DNA, 25 bp, Rattus norvegicus
agccgccaaggtaagcgtggaccga

SEQ ID NO: 624423 - DNA, 25 bp, Rattus norvegicus
gtccccaaggcgctgcggacacttg

SEQ ID NO: 624424 - DNA, 25 bp, Rattus norvegicus
gggccgctactgagtccgcggagct

SEQ ID NO: 624425 - DNA, 25 bp, Rattus norvegicus
ctgaggggatcagctccagccgtgc

SEQ ID NO: 624426 - DNA, 25 bp, Rattus norvegicus
gcgcaaacgaacctcgcgacgccgc

SEQ ID NO: 624427 - DNA, 25 bp, Rattus norvegicus
aagctgctggacgatgaagagaaga

SEQ ID NO: 624428 - DNA, 25 bp, Rattus norvegicus
gatgcacaattctgagatctcgaag

SEQ ID NO: 624429 - DNA, 25 bp, Rattus norvegicus
gggcttccgctagagaaagtgaagc

SEQ ID NO: 624430 - DNA, 25 bp, Rattus norvegicus
aggctaagcgtcttcgtgcccgcca

SEQ ID NO: 624431 - DNA, 25 bp, Rattus norvegicus
cccaagatgcacaattctgagatct

SEQ ID NO: 624432 - DNA, 25 bp, Rattus norvegicus
tgcacaattctgagatctcgaagcg

SEQ ID NO: 624433 - DNA, 25 bp, Rattus norvegicus
ttctgagatctcgaagcgcttgggc

SEQ ID NO: 624434 - DNA, 25 bp, Rattus norvegicus
tgagatctcgaagcgcttgggcgct

SEQ ID NO: 624435 - DNA, 25 bp, Rattus norvegicus
tctcgaagcgcttgggcgctcagtg

SEQ ID NO: 624436 - DNA, 25 bp, Rattus norvegicus
ctcagtggaagctgctggacgatga

SEQ ID NO: 624437 - DNA, 25 bp, Rattus norvegicus
aggaggctaagcgtcttcgtgcccg

SEQ ID NO: 624438 - DNA, 25 bp, Rattus norvegicus
gtgcccgccacctccatgactaccc

SEQ ID NO: 624439 - DNA, 25 bp, Rattus norvegicus
cgctcagtggaagctgctggacgat

SEQ ID NO: 624440 - DNA, 25 bp, Rattus norvegicus
cttccgctagagaaagtgaagcggc

SEQ ID NO: 624441 - DNA, 25 bp, Rattus norvegicus
tagtcaacgccgtggaggaccgtga

SEQ ID NO: 624442 - DNA, 25 bp, Rattus norvegicus
tccgcctttgccgatggctccaaaa

SEQ ID NO: 624443 - DNA, 25 bp, Rattus norvegicus
ccgatggctccaaaaacggtggaga

SEQ ID NO: 624444 - DNA, 25 bp, Rattus norvegicus
aaacacggagccaacagcctgaaga

SEQ ID NO: 624445 - DNA, 25 bp, Rattus norvegicus
tcacagagaaggtgtcaggccagca

SEQ ID NO: 624446 - DNA, 25 bp, Rattus norvegicus
cgtggagatccaggccaagtacatc

SEQ ID NO: 624447 - DNA, 25 bp, Rattus norvegicus
aagtacatcggcaccaccatcgtgg

SEQ ID NO: 624448 - DNA, 25 bp, Rattus norvegicus
tccggatgcccgaggaggtagtcaa

SEQ ID NO: 624449 - DNA, 25 bp, Rattus norvegicus
atggacgagcttccgtccgcctttg

SEQ ID NO: 624450 - DNA, 25 bp, Rattus norvegicus
ggggctgcccgctcaaccagcagat

SEQ ID NO: 624451 - DNA, 25 bp, Rattus norvegicus
caaccagcagatcgacttccaggct

SEQ ID NO: 624452 - DNA, 25 bp, Rattus norvegicus
caggctttccgtgccaacgccgaga

SEQ ID NO: 624453 - DNA, 25 bp, Rattus norvegicus
gagagccctcgcaggccagcagctg

SEQ ID NO: 624454 - DNA, 25 bp, Rattus norvegicus
acaggtgggccgctacctgaccttc

SEQ ID NO: 624455 - DNA, 25 bp, Rattus norvegicus
gtggtgtctctccagtctcctcgct

SEQ ID NO: 624456 - DNA, 25 bp, Rattus norvegicus
gacgtcgagcttttcctcccaagga

SEQ ID NO: 624457 - DNA, 25 bp, Rattus norvegicus
gctgttgcctctccggccatcttgt

SEQ ID NO: 624458 - DNA, 25 bp, Rattus norvegicus
acacaacatggcctcttcgctgcgg

SEQ ID NO: 624459 - DNA, 25 bp, Rattus norvegicus
agcttcctgccatcgcttctcggag

SEQ ID NO: 624460 - DNA, 25 bp, Rattus norvegicus
agcggcctcacgcacttcgttggtg

SEQ ID NO: 624461 - DNA, 25 bp, Rattus norvegicus
gcagactcctgcacactattggtca

SEQ ID NO: 624462 - DNA, 25 bp, Rattus norvegicus
gttctgaacccaccgcttccatgtt

SEQ ID NO: 624463 - DNA, 25 bp, Rattus norvegicus
caccaataggactgattcgatgcca

SEQ ID NO: 624464 - DNA, 25 bp, Rattus norvegicus
tcgatgccaatcatagcccgtgggc

SEQ ID NO: 624465 - DNA, 25 bp, Rattus norvegicus
cgtttcagctgagaagtcccggcct

SEQ ID NO: 624466 - DNA, 25 bp, Rattus norvegicus
tcccggcctgcgattggcggataat

SEQ ID NO: 624467 - DNA, 25 bp, Rattus norvegicus
cttccatgttctcagcaccaatagg

SEQ ID NO: 624468 - DNA, 25 bp, Rattus norvegicus
cgcaggagccatcggcttgctcttc

SEQ ID NO: 624469 - DNA, 25 bp, Rattus norvegicus
cctatttgcgatacacagttcaccg

SEQ ID NO: 624470 - DNA, 25 bp, Rattus norvegicus
caagcggcggccgatctcgtgtgca

SEQ ID NO: 624471 - DNA, 25 bp, Rattus norvegicus
ttagcggtaactaggcaacggagga

SEQ ID NO: 624472 - DNA, 25 bp, Rattus norvegicus
gtaactaggcaacggaggagcgcaa

SEQ ID NO: 624473 - DNA, 25 bp, Rattus norvegicus
ggaggagcgcaagggaggcgcaccc

SEQ ID NO: 624474 - DNA, 25 bp, Rattus norvegicus
cgcagccgcagaccgcggcccgcga

SEQ ID NO: 624475 - DNA, 25 bp, Rattus norvegicus
tcctggtaaaggtccaagcggcggc

SEQ ID NO: 624476 - DNA, 25 bp, Rattus norvegicus
ccgatctcgtgtgcagcgtttgcaa

SEQ ID NO: 624477 - DNA, 25 bp, Rattus norvegicus
atctcgtgtgcagcgtttgcaaacc

SEQ ID NO: 624478 - DNA, 25 bp, Rattus norvegicus
ctcgtgtgcagcgtttgcaaaccta

SEQ ID NO: 624479 - DNA, 25 bp, Rattus norvegicus
cgtgtgcagcgtttgcaaacctatt

SEQ ID NO: 624480 - DNA, 25 bp, Rattus norvegicus
gtgcagcgtttgcaaacctatttgc

SEQ ID NO: 624481 - DNA, 25 bp, Rattus norvegicus
tgcaaacctatttgcgatacacagt

SEQ ID NO: 624482 - DNA, 25 bp, Rattus norvegicus
agcgtttgcaaacctatttgcgata

SEQ ID NO: 624483 - DNA, 25 bp, Rattus norvegicus
cgcagggtccgagatcagcctttct

SEQ ID NO: 624484 - DNA, 25 bp, Rattus norvegicus
cctggcagcgcatactggtgaaaac

SEQ ID NO: 624485 - DNA, 25 bp, Rattus norvegicus
tggtgaaaacgtcccgaagcgctct

SEQ ID NO: 624486 - DNA, 25 bp, Rattus norvegicus
ggttcgttccttaaccctgcagata

SEQ ID NO: 624487 - DNA, 25 bp, Rattus norvegicus
cagcctttctttagctctcagttgg

SEQ ID NO: 624488 - DNA, 25 bp, Rattus norvegicus
tctcagttggcctcgccctgatcta

SEQ ID NO: 624489 - DNA, 25 bp, Rattus norvegicus
gccctgatctaatcgctcctttgga

SEQ ID NO: 624490 - DNA, 25 bp, Rattus norvegicus
acgagcacgcacagaggagaaagac

SEQ ID NO: 624491 - DNA, 25 bp, Rattus norvegicus
ggctcaaagcgtgtcctggaccagg

SEQ ID NO: 624492 - DNA, 25 bp, Rattus norvegicus
acgcggccaccctaacaggcggaag

SEQ ID NO: 624493 - DNA, 25 bp, Rattus norvegicus
gcggcgccatcttgttgtttttcta

SEQ ID NO: 624494 - DNA, 25 bp, Rattus norvegicus
agcttccggctagaccggttccagc

SEQ ID NO: 624495 - DNA, 25 bp, Rattus norvegicus
cattctgctgttgcgccgcctttga

SEQ ID NO: 624496 - DNA, 25 bp, Rattus norvegicus
cgcttcccagcaggttcgttcctta

SEQ ID NO: 624497 - DNA, 25 bp, Rattus norvegicus
ccgtctgttcgtgcctctcaggagc

SEQ ID NO: 624498 - DNA, 25 bp, Rattus norvegicus
cccgcgctgcctctgagcccgcagc

SEQ ID NO: 624499 - DNA, 25 bp, Rattus norvegicus
ctccgtccgcctgttcaggccgccc

SEQ ID NO: 624500 - DNA, 25 bp, Rattus norvegicus
tcaggagctccgtccgcctgttcag

SEQ ID NO: 624501 - DNA, 25 bp, Rattus norvegicus
tctgttcgtgcctctcaggagctcc

SEQ ID NO: 624502 - DNA, 25 bp, Rattus norvegicus
gtcgccgtctgttcgtgcctctcag

SEQ ID NO: 624503 - DNA, 25 bp, Rattus norvegicus
cccttggttgctgtcgccgtctgtt

SEQ ID NO: 624504 - DNA, 25 bp, Rattus norvegicus
tcttgggcccttggttgctgtcgcc

SEQ ID NO: 624505 - DNA, 25 bp, Rattus norvegicus
gagtcttgggcccttggttgctgtc

SEQ ID NO: 624506 - DNA, 25 bp, Rattus norvegicus
ctcctcagctgtcccggggagtctt

SEQ ID NO: 624507 - DNA, 25 bp, Rattus norvegicus
ggcagtctgtcagcagcgtcgccgc

SEQ ID NO: 624508 - DNA, 25 bp, Rattus norvegicus
ttgctgtcgccgtctgttcgtgcct

SEQ ID NO: 624509 - DNA, 25 bp, Rattus norvegicus
gcccggcagtctgtcagcagcgtcg

SEQ ID NO: 624510 - DNA, 25 bp, Rattus norvegicus
gttcgtgcctctcaggagctccgtc

SEQ ID NO: 624511 - DNA, 25 bp, Rattus norvegicus
cctacccggagcagagtgagccaag

SEQ ID NO: 624512 - DNA, 25 bp, Rattus norvegicus
ctgcctgctgctgcgagtcttcagg

SEQ ID NO: 624513 - DNA, 25 bp, Rattus norvegicus
ctgcccaccctgaaggcgacggtga

SEQ ID NO: 624514 - DNA, 25 bp, Rattus norvegicus
cagggaatgccacccagctgggatc

SEQ ID NO: 624515 - DNA, 25 bp, Rattus norvegicus
gcctcctaggtgtaagcctcccgga

SEQ ID NO: 624516 - DNA, 25 bp, Rattus norvegicus
gggctctgcagcttcctgccgagca

SEQ ID NO: 624517 - DNA, 25 bp, Rattus norvegicus
aatgactctgtgcaacgtgttggtg

SEQ ID NO: 624518 - DNA, 25 bp, Rattus norvegicus
ggccgaagcccgtcgaatgactctg

SEQ ID NO: 624519 - DNA, 25 bp, Rattus norvegicus
tgagccaagcatttaggattcctcc

SEQ ID NO: 624520 - DNA, 25 bp, Rattus norvegicus
ggaggctccaacagcagcgtcgacg

SEQ ID NO: 624521 - DNA, 25 bp, Rattus norvegicus
gcacctctctgctcgatctgtcatg

SEQ ID NO: 624522 - DNA, 25 bp, Rattus norvegicus
cgtgaaccgctcatcatactgccta

SEQ ID NO: 624523 - DNA, 25 bp, Rattus norvegicus
cctccacggggtcttaggtcctgat

SEQ ID NO: 624524 - DNA, 25 bp, Rattus norvegicus
gagcacagcgcaccatgagcgcctt

SEQ ID NO: 624525 - DNA, 25 bp, Rattus norvegicus
ggaggcgttggagactttcctacaa

SEQ ID NO: 624526 - DNA, 25 bp, Rattus norvegicus
actatccctccagctgagcgacagg

SEQ ID NO: 624527 - DNA, 25 bp, Rattus norvegicus
gcacacacgccgaggaaagggacca

SEQ ID NO: 624528 - DNA, 25 bp, Rattus norvegicus
cggccgagctggagacaaagaaact

SEQ ID NO: 624529 - DNA, 25 bp, Rattus norvegicus
taccggtgtgtgcagggcacattcc

SEQ ID NO: 624530 - DNA, 25 bp, Rattus norvegicus
cagcggaaagcctgggtctccaacc

SEQ ID NO: 624531 - DNA, 25 bp, Rattus norvegicus
gcagagcactcaaagccagcggaaa

SEQ ID NO: 624532 - DNA, 25 bp, Rattus norvegicus
cactcagtaacctggggtcgcctgg

SEQ ID NO: 624533 - DNA, 25 bp, Rattus norvegicus
ctccgttgagagagcgcattccaag

SEQ ID NO: 624534 - DNA, 25 bp, Rattus norvegicus
tacaacctctcagggtcttggtgcc

SEQ ID NO: 624535 - DNA, 25 bp, Rattus norvegicus
cctctaaagagacaggggcaagctg

SEQ ID NO: 624536 - DNA, 25 bp, Rattus norvegicus
ccgatttcttcttcgatctctgaga

SEQ ID NO: 624537 - DNA, 25 bp, Rattus norvegicus
ggcaagctgagaaagcgcgctcctg

SEQ ID NO: 624538 - DNA, 25 bp, Rattus norvegicus
tcttggtgccggttgtgagcactca

SEQ ID NO: 624539 - DNA, 25 bp, Rattus norvegicus
caggtatctgtagaccacgttgtca

SEQ ID NO: 624540 - DNA, 25 bp, Rattus norvegicus
agaacagacaggtggagtcgatgcc

SEQ ID NO: 624541 - DNA, 25 bp, Rattus norvegicus
gaaggtgctccagaacagacaggtg

SEQ ID NO: 624542 - DNA, 25 bp, Rattus norvegicus
cccgcagaaggtgctccagaacaga

SEQ ID NO: 624543 - DNA, 25 bp, Rattus norvegicus
atagaggacacaggcgccctgttcc

SEQ ID NO: 624544 - DNA, 25 bp, Rattus norvegicus
ctgtagaccacgttgtcatagagga

SEQ ID NO: 624545 - DNA, 25 bp, Rattus norvegicus
cgatgctgacgtacaggtatctgta

SEQ ID NO: 624546 - DNA, 25 bp, Rattus norvegicus
tttgagtgcaatggcgatgctgacg

SEQ ID NO: 624547 - DNA, 25 bp, Rattus norvegicus
tgaaggcgaaggatttgagtgcaat

SEQ ID NO: 624548 - DNA, 25 bp, Rattus norvegicus
agcgtttatagtttttccgcaggca

SEQ ID NO: 624549 - DNA, 25 bp, Rattus norvegicus
cgtggtttttgatgtagcgtttata

SEQ ID NO: 624550 - DNA, 25 bp, Rattus norvegicus
gccctcgtggtttttgatgtagcgt

SEQ ID NO: 624551 - DNA, 25 bp, Rattus norvegicus
ttttccgcaggcactgccacgtggt

SEQ ID NO: 624552 - DNA, 25 bp, Rattus norvegicus
ttgtcatagaggacacaggcgccct

SEQ ID NO: 624553 - DNA, 25 bp, Rattus norvegicus
cgccaggttgccgatctcaaagctg

SEQ ID NO: 624554 - DNA, 25 bp, Rattus norvegicus
catcatgttcgtggctgtccggtta

SEQ ID NO: 624555 - DNA, 25 bp, Rattus norvegicus
acggcagattaagtccgggtcaggc

SEQ ID NO: 624556 - DNA, 25 bp, Rattus norvegicus
ctcatcgctgctggacccattggtg

SEQ ID NO: 624557 - DNA, 25 bp, Rattus norvegicus
tggtggcacaaacatcgcggccttc

SEQ ID NO: 624558 - DNA, 25 bp, Rattus norvegicus
gcctcatacttgtactggtgggtaa

SEQ ID NO: 624559 - DNA, 25 bp, Rattus norvegicus
gagagcagcgcacccaacgccatga

SEQ ID NO: 624560 - DNA, 25 bp, Rattus norvegicus
tctcaaagctgctggcgatcacacc

SEQ ID NO: 624561 - DNA, 25 bp, Rattus norvegicus
tcacgaagagaatcagcgccaggtt

SEQ ID NO: 624562 - DNA, 25 bp, Rattus norvegicus
tgcccacgtgctccgaagtagctca

SEQ ID NO: 624563 - DNA, 25 bp, Rattus norvegicus
cctatgtagagcgaggagtccttcc

SEQ ID NO: 624564 - DNA, 25 bp, Rattus norvegicus
ggggcagcgcctacctatgtagagc

SEQ ID NO: 624565 - DNA, 25 bp, Rattus norvegicus
tgacgattccaccacagccgatgag

SEQ ID NO: 624566 - DNA, 25 bp, Rattus norvegicus
tcctccgcacgtggtcgtcaatgta

SEQ ID NO: 624567 - DNA, 25 bp, Rattus norvegicus
tctgctctgtgtactgcgtggagag

SEQ ID NO: 624568 - DNA, 25 bp, Rattus norvegicus
ctcctcacgaccgaacggcggcggc

SEQ ID NO: 624569 - DNA, 25 bp, Rattus norvegicus
agagacccgggctgcgtggacgcga

SEQ ID NO: 624570 - DNA, 25 bp, Rattus norvegicus
ccggagcctgcgagcaaccgggccc

SEQ ID NO: 624571 - DNA, 25 bp, Rattus norvegicus
cccagagtctggaactacagctgga

SEQ ID NO: 624572 - DNA, 25 bp, Rattus norvegicus
cagagtctggaactacagctggagc

SEQ ID NO: 624573 - DNA, 25 bp, Rattus norvegicus
tctggaactacagctggagcgcgag

SEQ ID NO: 624574 - DNA, 25 bp, Rattus norvegicus
gctgctcctggacgtgctggcccag

SEQ ID NO: 624575 - DNA, 25 bp, Rattus norvegicus
agtccgcctgcctcctttccaagct

SEQ ID NO: 624576 - DNA, 25 bp, Rattus norvegicus
caagccgcaagtcctctgctctgtg

SEQ ID NO: 624577 - DNA, 25 bp, Rattus norvegicus
ctgtgtactgcgtggagagcgacct

SEQ ID NO: 624578 - DNA, 25 bp, Rattus norvegicus
actgcgtggagagcgacctgcccga

SEQ ID NO: 624579 - DNA, 25 bp, Rattus norvegicus
gccgattcccgccagtccgcctgcc

SEQ ID NO: 624580 - DNA, 25 bp, Rattus norvegicus
tcctggacgtgctggcccagcgaca

SEQ ID NO: 624581 - DNA, 25 bp, Rattus norvegicus
tcgcgagtggtaccgccagaattct

SEQ ID NO: 624582 - DNA, 25 bp, Rattus norvegicus
gggaatctctcaagcggccatgtgc

SEQ ID NO: 624583 - DNA, 25 bp, Rattus norvegicus
agtggacctgcccatccgcagtttg

SEQ ID NO: 624584 - DNA, 25 bp, Rattus norvegicus
tctgtcctggccgtcaagaaaacca

SEQ ID NO: 624585 - DNA, 25 bp, Rattus norvegicus
tttcccacgttatgtcgcgacctca

SEQ ID NO: 624586 - DNA, 25 bp, Rattus norvegicus
cctttcagtacccaagcttcgcgta

SEQ ID NO: 624587 - DNA, 25 bp, Rattus norvegicus
gtcctttcccgtatccacactggtg

SEQ ID NO: 624588 - DNA, 25 bp, Rattus norvegicus
gtgcgatgggtctctcaacttttcc

SEQ ID NO: 624589 - DNA, 25 bp, Rattus norvegicus
gctgcggggtaagtagccattaacc

SEQ ID NO: 624590 - DNA, 25 bp, Rattus norvegicus
ctgactcgcagacatgatccttaga

SEQ ID NO: 624591 - DNA, 25 bp, Rattus norvegicus
ggagtgcccgcctatcgacaactta

SEQ ID NO: 624592 - DNA, 25 bp, Rattus norvegicus
cagtttgccaattgcccggcttgtg

SEQ ID NO: 624593 - DNA, 25 bp, Rattus norvegicus
tccttagaatctagggcggagtgcc

SEQ ID NO: 624594 - DNA, 25 bp, Rattus norvegicus
tcgattctcccgcaacctggtaggt

SEQ ID NO: 624595 - DNA, 25 bp, Rattus norvegicus
gtgtgtgcctctgtgcctcttggtg

SEQ ID NO: 624596 - DNA, 25 bp, Rattus norvegicus
taggggagcttcttgcgcactctct

SEQ ID NO: 624597 - DNA, 25 bp, Rattus norvegicus
ttataggggagcttcttgcgcactc

SEQ ID NO: 624598 - DNA, 25 bp, Rattus norvegicus
tgacttataggggagcttcttgcgc

SEQ ID NO: 624599 - DNA, 25 bp, Rattus norvegicus
ccagagtgacttataggggagcttc

SEQ ID NO: 624600 - DNA, 25 bp, Rattus norvegicus
ccgcccttcccagagtgacttatag

SEQ ID NO: 624601 - DNA, 25 bp, Rattus norvegicus
tccttctctcgtgtacgtgcgccgc

SEQ ID NO: 624602 - DNA, 25 bp, Rattus norvegicus
ttttccatgcgatgtccctccttct

SEQ ID NO: 624603 - DNA, 25 bp, Rattus norvegicus
ttcctttttccatgcgatgtccctc

SEQ ID NO: 624604 - DNA, 25 bp, Rattus norvegicus
gctcttcctttttccatgcgatgtc

SEQ ID NO: 624605 - DNA, 25 bp, Rattus norvegicus
ctgcgctcttcctttttccatgcga

SEQ ID NO: 624606 - DNA, 25 bp, Rattus norvegicus
atcgcccccctggtagcgaggctgt

SEQ ID NO: 624607 - DNA, 25 bp, Rattus norvegicus
ccgccgccctccctgttgctggcgc

SEQ ID NO: 624608 - DNA, 25 bp, Rattus norvegicus
gcttcttgcgcactctctgtctctg

SEQ ID NO: 624609 - DNA, 25 bp, Rattus norvegicus
gaagcaggacaccttctttttcttc

SEQ ID NO: 624610 - DNA, 25 bp, Rattus norvegicus
tccgcggcagagttggcacccggac

SEQ ID NO: 624611 - DNA, 25 bp, Rattus norvegicus
agctgccggcatccacggtcccgcc

SEQ ID NO: 624612 - DNA, 25 bp, Rattus norvegicus
ggccgcctctgcaccagtcgccaac

SEQ ID NO: 624613 - DNA, 25 bp, Rattus norvegicus
agtcgccaacctccgtgcccggccg

SEQ ID NO: 624614 - DNA, 25 bp, Rattus norvegicus
gcggaaaacccgagaagcgccggca

SEQ ID NO: 624615 - DNA, 25 bp, Rattus norvegicus
gcagagttggcacccggactcacca

SEQ ID NO: 624616 - DNA, 25 bp, Rattus norvegicus
gactcaccaggtaggcgcccaccgt

SEQ ID NO: 624617 - DNA, 25 bp, Rattus norvegicus
gcgccagcatcaaggcgcactcaga

SEQ ID NO: 624618 - DNA, 25 bp, Rattus norvegicus
ggcgcactcagacaccaggaagatc

SEQ ID NO: 624619 - DNA, 25 bp, Rattus norvegicus
tgatgttggagaagcaggacacctt

SEQ ID NO: 624620 - DNA, 25 bp, Rattus norvegicus
cccggcttctttccctgcatccttc

SEQ ID NO: 624621 - DNA, 25 bp, Rattus norvegicus
tttcttcttcttgttcctctgcgcc

SEQ ID NO: 624622 - DNA, 25 bp, Rattus norvegicus
acaccaggaagatcttgatgttgga

SEQ ID NO: 624623 - DNA, 25 bp, Rattus norvegicus
aggcagtcgctctccctaaggcaca

SEQ ID NO: 624624 - DNA, 25 bp, Rattus norvegicus
agcgagcgattcagcggtagagcac

SEQ ID NO: 624625 - DNA, 25 bp, Rattus norvegicus
cccgtgcgagtctcggcatgccagg

SEQ ID NO: 624626 - DNA, 25 bp, Rattus norvegicus
gtctcggcatgccaggcctgggaac

SEQ ID NO: 624627 - DNA, 25 bp, Rattus norvegicus
cggtaccgcctcgaggatcaccgtt

SEQ ID NO: 624628 - DNA, 25 bp, Rattus norvegicus
tcgaggatcaccgttccctacctgg

SEQ ID NO: 624629 - DNA, 25 bp, Rattus norvegicus
gtggaaaatccgcagcgagcgattc

SEQ ID NO: 624630 - DNA, 25 bp, Rattus norvegicus
cggtagagcaccgttgatctgggta

SEQ ID NO: 624631 - DNA, 25 bp, Rattus norvegicus
caccgttgatctgggtagctcaagc

SEQ ID NO: 624632 - DNA, 25 bp, Rattus norvegicus
tctgggtagctcaagccaatgcggc

SEQ ID NO: 624633 - DNA, 25 bp, Rattus norvegicus
ccctggtgatcccaaccgaggcagt

SEQ ID NO: 624634 - DNA, 25 bp, Rattus norvegicus
tgatcccaaccgaggcagtcgctct

SEQ ID NO: 624635 - DNA, 25 bp, Rattus norvegicus
ctgtgcagagcctctgtgcagcgcg

SEQ ID NO: 624636 - DNA, 25 bp, Rattus norvegicus
gatcaccgttccctacctgggtgga

SEQ ID NO: 624637 - DNA, 25 bp, Rattus norvegicus
cttggtgcgactctggtctgagaga

SEQ ID NO: 624638 - DNA, 25 bp, Rattus norvegicus
ctgctaagcgcttgggatcggtcga

SEQ ID NO: 624639 - DNA, 25 bp, Rattus norvegicus
agacggccgtgcttgctccttgctc

SEQ ID NO: 624640 - DNA, 25 bp, Rattus norvegicus
ccgcacggtgagagcgcaacttagt

SEQ ID NO: 624641 - DNA, 25 bp, Rattus norvegicus
gcgggtggcggacccttctccacag

SEQ ID NO: 624642 - DNA, 25 bp, Rattus norvegicus
ctcctgtggcgcttggtgcgactct

SEQ ID NO: 624643 - DNA, 25 bp, Rattus norvegicus
ggcagtcgagcagggtaaacactgc

SEQ ID NO: 624644 - DNA, 25 bp, Rattus norvegicus
agcagggtaaacactgcgggtcccg

SEQ ID NO: 624645 - DNA, 25 bp, Rattus norvegicus
ccgagccctagttgcaagtactttg

SEQ ID NO: 624646 - DNA, 25 bp, Rattus norvegicus
tactttgagaactagcgaatcgctg

SEQ ID NO: 624647 - DNA, 25 bp, Rattus norvegicus
agcgaatcgctgcttttcgtaagta

SEQ ID NO: 624648 - DNA, 25 bp, Rattus norvegicus
tcgctgcttttcgtaagtaggctcg

SEQ ID NO: 624649 - DNA, 25 bp, Rattus norvegicus
actctggtctgagagacggctgctc

SEQ ID NO: 624650 - DNA, 25 bp, Rattus norvegicus
ttctccacagcatgggcagccaggg

SEQ ID NO: 624651 - DNA, 25 bp, Rattus norvegicus
tgtattacaggttagtcggcccatc

SEQ ID NO: 624652 - DNA, 25 bp, Rattus norvegicus
tgaattgttttccaaacggatgtta

SEQ ID NO: 624653 - DNA, 25 bp, Rattus norvegicus
ctcccgccaagggaatgaattgttt

SEQ ID NO: 624654 - DNA, 25 bp, Rattus norvegicus
ttatgttcagagctcccgccaaggg

SEQ ID NO: 624655 - DNA, 25 bp, Rattus norvegicus
cccgtactgttatgttcagagctcc

SEQ ID NO: 624656 - DNA, 25 bp, Rattus norvegicus
attgtcaccgggacagcgagcgacc

SEQ ID NO: 624657 - DNA, 25 bp, Rattus norvegicus
gtcgtcgggaattgtcaccgggaca

SEQ ID NO: 624658 - DNA, 25 bp, Rattus norvegicus
agaaactagtttgttggcggcgccg

SEQ ID NO: 624659 - DNA, 25 bp, Rattus norvegicus
tctatgattggttgttgggtttcgg

SEQ ID NO: 624660 - DNA, 25 bp, Rattus norvegicus
cagagacacggtctatgattggttg

SEQ ID NO: 624661 - DNA, 25 bp, Rattus norvegicus
ttagtcggcccatccgtcacagaga

SEQ ID NO: 624662 - DNA, 25 bp, Rattus norvegicus
ttctcacacggctgtattacaggtt

SEQ ID NO: 624663 - DNA, 25 bp, Rattus norvegicus
gtccctttcttctcacacggctgta

SEQ ID NO: 624664 - DNA, 25 bp, Rattus norvegicus
tccgtcacagagacacggtctatga

SEQ ID NO: 624665 - DNA, 25 bp, Rattus norvegicus
gagtcacctggaacacgcagcccta

SEQ ID NO: 624666 - DNA, 25 bp, Rattus norvegicus
tgaatcctgcccttccaggagggga

SEQ ID NO: 624667 - DNA, 25 bp, Rattus norvegicus
tcagtcttgctgcagacacaatttg

SEQ ID NO: 624668 - DNA, 25 bp, Rattus norvegicus
acggagcccacatagtccagccaga

SEQ ID NO: 624669 - DNA, 25 bp, Rattus norvegicus
ggccgccggcaattgatctcagtct

SEQ ID NO: 624670 - DNA, 25 bp, Rattus norvegicus
agcggccgcctgacttacatggaag

SEQ ID NO: 624671 - DNA, 25 bp, Rattus norvegicus
cacgcctggctatggctggagtcac

SEQ ID NO: 624672 - DNA, 25 bp, Rattus norvegicus
ctccgatcgctgcttctaaaaaaga

SEQ ID NO: 624673 - DNA, 25 bp, Rattus norvegicus
tcagtatcatcggatcacgcctggc

SEQ ID NO: 624674 - DNA, 25 bp, Rattus norvegicus
gatgctggcgttcccattgctgttc

SEQ ID NO: 624675 - DNA, 25 bp, Rattus norvegicus
cttgagatgtccgtgatgttgatgc

SEQ ID NO: 624676 - DNA, 25 bp, Rattus norvegicus
cagccagacgcttcccagcaagaaa

SEQ ID NO: 624677 - DNA, 25 bp, Rattus norvegicus
cttggctgggcaaagagagacatcc

SEQ ID NO: 624678 - DNA, 25 bp, Rattus norvegicus
cctgggagaggtacccatcagtatc

SEQ ID NO: 624679 - DNA, 25 bp, Rattus norvegicus
gggacaggagcgcacaggaacccaa

SEQ ID NO: 624680 - DNA, 25 bp, Rattus norvegicus
tggctgagccacacgaaaggcgttc

SEQ ID NO: 624681 - DNA, 25 bp, Rattus norvegicus
agccacacgaaaggcgttctccctt

SEQ ID NO: 624682 - DNA, 25 bp, Rattus norvegicus
cttccactttttggcccttgtgctg

SEQ ID NO: 624683 - DNA, 25 bp, Rattus norvegicus
tgctgcccggttttgctgcaatctc

SEQ ID NO: 624684 - DNA, 25 bp, Rattus norvegicus
cggccagagacatcggccgcagacg

SEQ ID NO: 624685 - DNA, 25 bp, Rattus norvegicus
ttgctgcaatctcctccgcgtgagg

SEQ ID NO: 624686 - DNA, 25 bp, Rattus norvegicus
atctcctccgcgtgaggaagcgaaa

SEQ ID NO: 624687 - DNA, 25 bp, Rattus norvegicus
aagagttggcaagctggctgagcca

SEQ ID NO: 624688 - DNA, 25 bp, Rattus norvegicus
ccgaggtgacctggggtgctcccca

SEQ ID NO: 624689 - DNA, 25 bp, Rattus norvegicus
actttttggcccttgtgctgcccgg

SEQ ID NO: 624690 - DNA, 25 bp, Rattus norvegicus
gaacccaagcgaggcggccagagac

SEQ ID NO: 624691 - DNA, 25 bp, Rattus norvegicus
ctccgcgtgaggaagcgaaatgagc

SEQ ID NO: 624692 - DNA, 25 bp, Rattus norvegicus
gttttgctgcaatctcctccgcgtg

SEQ ID NO: 624693 - DNA, 25 bp, Rattus norvegicus
cggctgcttgagggcgcagcctcaa

SEQ ID NO: 624694 - DNA, 25 bp, Rattus norvegicus
gtggccgctgcagacacaaggcgcc

SEQ ID NO: 624695 - DNA, 25 bp, Rattus norvegicus
tcccggcagggtcctcagccaaccc

SEQ ID NO: 624696 - DNA, 25 bp, Rattus norvegicus
gcgccatggagaccggctgcttgag

SEQ ID NO: 624697 - DNA, 25 bp, Rattus norvegicus
ctgcagacacaaggcgccggacaag

SEQ ID NO: 624698 - DNA, 25 bp, Rattus norvegicus
gcgcagcctcaagggacaggccacg

SEQ ID NO: 624699 - DNA, 25 bp, Rattus norvegicus
cctcaagggacaggccacgagaact

SEQ ID NO: 624700 - DNA, 25 bp, Rattus norvegicus
aggccacgagaactacctgcccaga

SEQ ID NO: 624701 - DNA, 25 bp, Rattus norvegicus
tacctgcccagagtctgtcaagctg

SEQ ID NO: 624702 - DNA, 25 bp, Rattus norvegicus
agagtctgtcaagctgccgccagcc

SEQ ID NO: 624703 - DNA, 25 bp, Rattus norvegicus
cctaaaagagtacgccctatgggcg

SEQ ID NO: 624704 - DNA, 25 bp, Rattus norvegicus
gagtacgccctatgggcgccgccat

SEQ ID NO: 624705 - DNA, 25 bp, Rattus norvegicus
gtcttcccacaaagtaccgcggctc

SEQ ID NO: 624706 - DNA, 25 bp, Rattus norvegicus
caaggcgccggacaagcgccatgga

SEQ ID NO: 624707 - DNA, 25 bp, Rattus norvegicus
tcctggacggcgtgatcatgatcgt

SEQ ID NO: 624708 - DNA, 25 bp, Rattus norvegicus
tgaaggccacgaggcgtcgcaccgt

SEQ ID NO: 624709 - DNA, 25 bp, Rattus norvegicus
caggcggctagcagcttttgcttta

SEQ ID NO: 624710 - DNA, 25 bp, Rattus norvegicus
agcttttgctttaacgtccactgag

SEQ ID NO: 624711 - DNA, 25 bp, Rattus norvegicus
aacgtccactgagcgaagcaggggc

SEQ ID NO: 624712 - DNA, 25 bp, Rattus norvegicus
tggcaaatggctcaaaggggtgaaa

SEQ ID NO: 624713 - DNA, 25 bp, Rattus norvegicus
tgactaggtgcagcagtgtcgcatg

SEQ ID NO: 624714 - DNA, 25 bp, Rattus norvegicus
cagcagtgtcgcatgtggaagttga

SEQ ID NO: 624715 - DNA, 25 bp, Rattus norvegicus
gtcgcatgtggaagttgacaacgta

SEQ ID NO: 624716 - DNA, 25 bp, Rattus norvegicus
gaagttgacaacgtactctgcgtta

SEQ ID NO: 624717 - DNA, 25 bp, Rattus norvegicus
acgtactctgcgttagtcctctgca

SEQ ID NO: 624718 - DNA, 25 bp, Rattus norvegicus
tgcgttagtcctctgcacagaaatg

SEQ ID NO: 624719 - DNA, 25 bp, Rattus norvegicus
tctgcacagaaatggcaaatggctc

SEQ ID NO: 624720 - DNA, 25 bp, Rattus norvegicus
tcatgatcgtaacggggtgactagg

SEQ ID NO: 624721 - DNA, 25 bp, Rattus norvegicus
ctagcctgctcggtgcacacctccc

SEQ ID NO: 624722 - DNA, 25 bp, Rattus norvegicus
ttccgcccgctaccggaagtgctgc

SEQ ID NO: 624723 - DNA, 25 bp, Rattus norvegicus
tgctgcgcagcgagaagggaagttc

SEQ ID NO: 624724 - DNA, 25 bp, Rattus norvegicus
caagggtcgccctagcctgctcggt

SEQ ID NO: 624725 - DNA, 25 bp, Rattus norvegicus
ccagcgcaccctggcgtccggagga

SEQ ID NO: 624726 - DNA, 25 bp, Rattus norvegicus
ctccgcagagttctcacgggccgaa

SEQ ID NO: 624727 - DNA, 25 bp, Rattus norvegicus
aagttcggaagacgagacgccatcc

SEQ ID NO: 624728 - DNA, 25 bp, Rattus norvegicus
cagggcaagggtcgccctagcctgc

SEQ ID NO: 624729 - DNA, 25 bp, Rattus norvegicus
ctgtcgagtcctggctcatggggcc

SEQ ID NO: 624730 - DNA, 25 bp, Rattus norvegicus
ctcacctgtcgagtcctggctcatg

SEQ ID NO: 624731 - DNA, 25 bp, Rattus norvegicus
tctcacgggccgaaaagggcaagtc

SEQ ID NO: 624732 - DNA, 25 bp, Rattus norvegicus
cgggctcctgagacccgggcatcat

SEQ ID NO: 624733 - DNA, 25 bp, Rattus norvegicus
acgagacgccatccagctgaggagc

SEQ ID NO: 624734 - DNA, 25 bp, Rattus norvegicus
agggcaagtcctcacctgtcgagtc

SEQ ID NO: 624735 - DNA, 25 bp, Rattus norvegicus
caaggcgggtgtctccgcctcaggc

SEQ ID NO: 624736 - DNA, 25 bp, Rattus norvegicus
gcctcaggctttccggctcatcttt

SEQ ID NO: 624737 - DNA, 25 bp, Rattus norvegicus
gctcatctttcggacggcggcgacc

SEQ ID NO: 624738 - DNA, 25 bp, Rattus norvegicus
gccgtttcaattcacgaagccaaag

SEQ ID NO: 624739 - DNA, 25 bp, Rattus norvegicus
ccgatggcggcgcacaattagtgcg

SEQ ID NO: 624740 - DNA, 25 bp, Rattus norvegicus
aattagtgcgtcacacccggcgagc

SEQ ID NO: 624741 - DNA, 25 bp, Rattus norvegicus
cgcacagtcgcctaggttgccgcgt

SEQ ID NO: 624742 - DNA, 25 bp, Rattus norvegicus
ctgctcgctcttttacgcctgcgtg

SEQ ID NO: 624743 - DNA, 25 bp, Rattus norvegicus
ttttacgcctgcgtgtcgcgtccag

SEQ ID NO: 624744 - DNA, 25 bp, Rattus norvegicus
tcacgctctacgtcgcagtcgtacg

SEQ ID NO: 624745 - DNA, 25 bp, Rattus norvegicus
agtcgtacggtactccctgctcttc

SEQ ID NO: 624746 - DNA, 25 bp, Rattus norvegicus
ctgctcttccgtggcctgagcttcg

SEQ ID NO: 624747 - DNA, 25 bp, Rattus norvegicus
tcagagaccctgcagggactggact

SEQ ID NO: 624748 - DNA, 25 bp, Rattus norvegicus
tcaggcggagccgtttcaattcacg

SEQ ID NO: 624749 - DNA, 25 bp, Rattus norvegicus
cccggacagacagggacatcctacg

SEQ ID NO: 624750 - DNA, 25 bp, Rattus norvegicus
agtcttccgagctcgggcaccgcta

SEQ ID NO: 624751 - DNA, 25 bp, Rattus norvegicus
ggcaccgctaccatctgctgctctg

SEQ ID NO: 624752 - DNA, 25 bp, Rattus norvegicus
ctctgcgaggagtccgtggattccc

SEQ ID NO: 624753 - DNA, 25 bp, Rattus norvegicus
ggccaccatggaggcgcaggcacaa

SEQ ID NO: 624754 - DNA, 25 bp, Rattus norvegicus
ccgaggtctggtcctcagaagccca

SEQ ID NO: 624755 - DNA, 25 bp, Rattus norvegicus
tcagaagcccagagagactctcttc

SEQ ID NO: 624756 - DNA, 25 bp, Rattus norvegicus
gagagactctcttcctttacctaac

SEQ ID NO: 624757 - DNA, 25 bp, Rattus norvegicus
cctaactttactcccggacagacag

SEQ ID NO: 624758 - DNA, 25 bp, Rattus norvegicus
ttctccgctgcgctgggtggaccag

SEQ ID NO: 624759 - DNA, 25 bp, Rattus norvegicus
aacctggcattctccgctgcgctgg

SEQ ID NO: 624760 - DNA, 25 bp, Rattus norvegicus
gcgtggctggcagtcttccgagctc

SEQ ID NO: 624761 - DNA, 25 bp, Rattus norvegicus
taggtggcgcccaacctggcattct

SEQ ID NO: 624762 - DNA, 25 bp, Rattus norvegicus
atcctacgcggatggaactcggagc

SEQ ID NO: 624763 - DNA, 25 bp, Rattus norvegicus
acgtcacagacgtccgcgtcgctga

SEQ ID NO: 624764 - DNA, 25 bp, Rattus norvegicus
gcgtcgctgacaggccacctgcaga

SEQ ID NO: 624765 - DNA, 25 bp, Rattus norvegicus
cctgcagactggtctcggctttaaa

SEQ ID NO: 624766 - DNA, 25 bp, Rattus norvegicus
tctcggctttaaaggagctgtgccc

SEQ ID NO: 624767 - DNA, 25 bp, Rattus norvegicus
gggtggctactgtccacgtctgaga

SEQ ID NO: 624768 - DNA, 25 bp, Rattus norvegicus
cacgtctgagagtgtgctgggactc

SEQ ID NO: 624769 - DNA, 25 bp, Rattus norvegicus
gatcttcctatctcctctcggcgtg

SEQ ID NO: 624770 - DNA, 25 bp, Rattus norvegicus
ctcctctcggcgtgaaggtagcggt

SEQ ID NO: 624771 - DNA, 25 bp, Rattus norvegicus
gtagcggtggacaggtcatactacc

SEQ ID NO: 624772 - DNA, 25 bp, Rattus norvegicus
tcatactaccggagacaggcaggta

SEQ ID NO: 624773 - DNA, 25 bp, Rattus norvegicus
acggaggattccaccacagagcatc

SEQ ID NO: 624774 - DNA, 25 bp, Rattus norvegicus
ttcctttcctcgctcgctttcagta

SEQ ID NO: 624775 - DNA, 25 bp, Rattus norvegicus
ctcgctttcagtatgacgtcacaga

SEQ ID NO: 624776 - DNA, 25 bp, Rattus norvegicus
ggcaggtacccacggaggattccac

SEQ ID NO: 624777 - DNA, 25 bp, Rattus norvegicus
tcttcaggtgagctaggggaccgcc

SEQ ID NO: 624778 - DNA, 25 bp, Rattus norvegicus
tcccaacttggagccggtgggcatc

SEQ ID NO: 624779 - DNA, 25 bp, Rattus norvegicus
gactggcacgcctactccaggagga

SEQ ID NO: 624780 - DNA, 25 bp, Rattus norvegicus
tcagccaatccgaggaggccttagg

SEQ ID NO: 624781 - DNA, 25 bp, Rattus norvegicus
taggcgggccctacggcccagcgaa

SEQ ID NO: 624782 - DNA, 25 bp, Rattus norvegicus
cccagcgaaccaatagacaggcagc

SEQ ID NO: 624783 - DNA, 25 bp, Rattus norvegicus
catgtccgggcaagcaactactgct

SEQ ID NO: 624784 - DNA, 25 bp, Rattus norvegicus
ctcacgcggtctttcccaacttgga

SEQ ID NO: 624785 - DNA, 25 bp, Rattus norvegicus
cttccacgtgaaagccgcaaagtgc

SEQ ID NO: 624786 - DNA, 25 bp, Rattus norvegicus
ggttcctgtcgccagcctcacgtgg

SEQ ID NO: 624787 - DNA, 25 bp, Rattus norvegicus
cggaacgcggcctcacgcggtcttt

SEQ ID NO: 624788 - DNA, 25 bp, Rattus norvegicus
ctgccgtcaaggcttccacgtgaaa

SEQ ID NO: 624789 - DNA, 25 bp, Rattus norvegicus
caagcaactactgctgccgtcaagg

SEQ ID NO: 624790 - DNA, 25 bp, Rattus norvegicus
agcctcacgtggctctcgggaccgg

SEQ ID NO: 624791 - DNA, 25 bp, Rattus norvegicus
cattctgacagcaggagtcgggtgc

SEQ ID NO: 624792 - DNA, 25 bp, Rattus norvegicus
aaggtccctcattctccgcgactag

SEQ ID NO: 624793 - DNA, 25 bp, Rattus norvegicus
tcaagacacctttctgtatcccttc

SEQ ID NO: 624794 - DNA, 25 bp, Rattus norvegicus
tgccgaaggaactcaagacaccttt

SEQ ID NO: 624795 - DNA, 25 bp, Rattus norvegicus
gcggagcttacgaccgcaatgcaga

SEQ ID NO: 624796 - DNA, 25 bp, Rattus norvegicus
tctgacacatgtgccgaaggaactc

SEQ ID NO: 624797 - DNA, 25 bp, Rattus norvegicus
ccgcgactagcatctgacacatgtg

SEQ ID NO: 624798 - DNA, 25 bp, Rattus norvegicus
gacgcgtgcagtaccgcccaaggtc

SEQ ID NO: 624799 - DNA, 25 bp, Rattus norvegicus
cctatgtatgtgtcaccgcgcacca

SEQ ID NO: 624800 - DNA, 25 bp, Rattus norvegicus
agagcgctccggacgtctctgcctt

SEQ ID NO: 624801 - DNA, 25 bp, Rattus norvegicus
tacgaccgcaatgcagacccgggtc

SEQ ID NO: 624802 - DNA, 25 bp, Rattus norvegicus
gcggccagggcctgtcattctgaca

SEQ ID NO: 624803 - DNA, 25 bp, Rattus norvegicus
gcctcctggactgcggagcttacga

SEQ ID NO: 624804 - DNA, 25 bp, Rattus norvegicus
gtgctttcggcactctgcgggcaca

SEQ ID NO: 624805 - DNA, 25 bp, Rattus norvegicus
gaccggagagttcctgcgtccgctc

SEQ ID NO: 624806 - DNA, 25 bp, Rattus norvegicus
tcacaggggaataaatcaggcgctc

SEQ ID NO: 624807 - DNA, 25 bp, Rattus norvegicus
gagaacttccgagcggcgggcagaa

SEQ ID NO: 624808 - DNA, 25 bp, Rattus norvegicus
aggccagagggactcaccggacgca

SEQ ID NO: 624809 - DNA, 25 bp, Rattus norvegicus
actcaccggacgcagcgaagaggcc

SEQ ID NO: 624810 - DNA, 25 bp, Rattus norvegicus
gaggcgcagagcagcacaccgcaca

SEQ ID NO: 624811 - DNA, 25 bp, Rattus norvegicus
acagcgcggccagcacacgggagaa

SEQ ID NO: 624812 - DNA, 25 bp, Rattus norvegicus
cacacgggagaactgcatgctgcgg

SEQ ID NO: 624813 - DNA, 25 bp, Rattus norvegicus
acgcgggaaatggtccacaagctcc

SEQ ID NO: 624814 - DNA, 25 bp, Rattus norvegicus
aatggtccacaagctccgatgctgg

SEQ ID NO: 624815 - DNA, 25 bp, Rattus norvegicus
caagctccgatgctgggaccggaga

SEQ ID NO: 624816 - DNA, 25 bp, Rattus norvegicus
cgctcctctcacaggggaataaatc

SEQ ID NO: 624817 - DNA, 25 bp, Rattus norvegicus
cgtccgctcctctcacaggggaata

SEQ ID NO: 624818 - DNA, 25 bp, Rattus norvegicus
ggggaataaatcaggcgctcagctc

SEQ ID NO: 624819 - DNA, 25 bp, Rattus norvegicus
ttccggctgtatttctatgagcgca

SEQ ID NO: 624820 - DNA, 25 bp, Rattus norvegicus
agagctccaccaagcagggatcgct

SEQ ID NO: 624821 - DNA, 25 bp, Rattus norvegicus
caccaagcagggatcgctccctgga

SEQ ID NO: 624822 - DNA, 25 bp, Rattus norvegicus
atcgctccctggaggcgtagggcca

SEQ ID NO: 624823 - DNA, 25 bp, Rattus norvegicus
ccatcgcaccggagcccgagtgctc

SEQ ID NO: 624824 - DNA, 25 bp, Rattus norvegicus
aggggttccggctgtatttctatga

SEQ ID NO: 624825 - DNA, 25 bp, Rattus norvegicus
gtatttctatgagcgcagccggcag

SEQ ID NO: 624826 - DNA, 25 bp, Rattus norvegicus
ccgcgggagtcaccgagcaaaggta

SEQ ID NO: 624827 - DNA, 25 bp, Rattus norvegicus
taagacgtcggctgggagagctcca

SEQ ID NO: 624828 - DNA, 25 bp, Rattus norvegicus
tcggctgggagagctccaccaagca

SEQ ID NO: 624829 - DNA, 25 bp, Rattus norvegicus
gggagagctccaccaagcagggatc

SEQ ID NO: 624830 - DNA, 25 bp, Rattus norvegicus
tccctggaggcgtagggccagaacc

SEQ ID NO: 624831 - DNA, 25 bp, Rattus norvegicus
cgtggcttggcccatcgcaccggag

SEQ ID NO: 624832 - DNA, 25 bp, Rattus norvegicus
ctggccaggggttccggctgtattt

SEQ ID NO: 624833 - DNA, 25 bp, Rattus norvegicus
ggacttgttgctctgggaaacggaa

SEQ ID NO: 624834 - DNA, 25 bp, Rattus norvegicus
agctttggcgggtttctccgaggca

SEQ ID NO: 624835 - DNA, 25 bp, Rattus norvegicus
ccgtacctggttcctgcgcatgggt

SEQ ID NO: 624836 - DNA, 25 bp, Rattus norvegicus
ttgaggtgattgtctagggcttacc

SEQ ID NO: 624837 - DNA, 25 bp, Rattus norvegicus
cccggaacgcgcatgctactctgag

SEQ ID NO: 624838 - DNA, 25 bp, Rattus norvegicus
attaggaagtcggaagtgcgccttg

SEQ ID NO: 624839 - DNA, 25 bp, Rattus norvegicus
tggtacgctccatcaaattaggaag

SEQ ID NO: 624840 - DNA, 25 bp, Rattus norvegicus
gtcatctaaaatggtacgctccatc

SEQ ID NO: 624841 - DNA, 25 bp, Rattus norvegicus
tctctcgcgaatttgggccatgatc

SEQ ID NO: 624842 - DNA, 25 bp, Rattus norvegicus
cctccaccctgaaagcgagtgggca

SEQ ID NO: 624843 - DNA, 25 bp, Rattus norvegicus
gcatgctactctgaggtctcccgtc

SEQ ID NO: 624844 - DNA, 25 bp, Rattus norvegicus
gcttaatcgttcatcccggaacgcg

SEQ ID NO: 624845 - DNA, 25 bp, Rattus norvegicus
tggaaggatccttcgctgaggttga

SEQ ID NO: 624846 - DNA, 25 bp, Rattus norvegicus
ctacgtggagttgagcgggaatttt

SEQ ID NO: 624847 - DNA, 25 bp, Rattus norvegicus
agagcccgtgcttccgcaggtgctc

SEQ ID NO: 624848 - DNA, 25 bp, Rattus norvegicus
gcaggcgcagctgcacgtctggcaa

SEQ ID NO: 624849 - DNA, 25 bp, Rattus norvegicus
cgcagctgcccattctctgaggagg

SEQ ID NO: 624850 - DNA, 25 bp, Rattus norvegicus
tccaagtacgggaggctctgcttct

SEQ ID NO: 624851 - DNA, 25 bp, Rattus norvegicus
gggcaattgggcctccgataacgag

SEQ ID NO: 624852 - DNA, 25 bp, Rattus norvegicus
caggtgctcgatgctgcgctgcacc

SEQ ID NO: 624853 - DNA, 25 bp, Rattus norvegicus
ctccgcacccgaagatttgctcgtg

SEQ ID NO: 624854 - DNA, 25 bp, Rattus norvegicus
agatttgctcgtgcaggcctctcga

SEQ ID NO: 624855 - DNA, 25 bp, Rattus norvegicus
tgcaggcctctcgacagcatctgga

SEQ ID NO: 624856 - DNA, 25 bp, Rattus norvegicus
acagcatctggatgtgcagagggtt

SEQ ID NO: 624857 - DNA, 25 bp, Rattus norvegicus
ggcatttgcgactgcggctgcccgt

SEQ ID NO: 624858 - DNA, 25 bp, Rattus norvegicus
gctggagacccagcgtcctgttgct

SEQ ID NO: 624859 - DNA, 25 bp, Rattus norvegicus
gtcctgttgctggtactggccctga

SEQ ID NO: 624860 - DNA, 25 bp, Rattus norvegicus
tactggccctgaggcgactttggcg

SEQ ID NO: 624861 - DNA, 25 bp, Rattus norvegicus
caaccgccgcgatgcgccctgagac

SEQ ID NO: 624862 - DNA, 25 bp, Rattus norvegicus
gcttcccgtcctgcggcagcccaca

SEQ ID NO: 624863 - DNA, 25 bp, Rattus norvegicus
cttcgaacccgccagtgagcaactg

SEQ ID NO: 624864 - DNA, 25 bp, Rattus norvegicus
cccgccagtgagcaactgcttcagg

SEQ ID NO: 624865 - DNA, 25 bp, Rattus norvegicus
gagcaactgcttcagggtccgcacc

SEQ ID NO: 624866 - DNA, 25 bp, Rattus norvegicus
ggtccgcacccacacccgagcgggc

SEQ ID NO: 624867 - DNA, 25 bp, Rattus norvegicus
ctactcgggagatcggcggcaaccc

SEQ ID NO: 624868 - DNA, 25 bp, Rattus norvegicus
gagcgggcccaggacgctctactcg

SEQ ID NO: 624869 - DNA, 25 bp, Rattus norvegicus
cccaggacgctctactcgggagatc

SEQ ID NO: 624870 - DNA, 25 bp, Rattus norvegicus
aggacgctctactcgggagatcggc

SEQ ID NO: 624871 - DNA, 25 bp, Rattus norvegicus
gcccacagccctggcaacgacgcgg

SEQ ID NO: 624872 - DNA, 25 bp, Rattus norvegicus
ccacgctccgggactggagagggag

SEQ ID NO: 624873 - DNA, 25 bp, Rattus norvegicus
gaaacctcggtctgttccgcgcttc

SEQ ID NO: 624874 - DNA, 25 bp, Rattus norvegicus
cgccctgcttccagccacgctccgg

SEQ ID NO: 624875 - DNA, 25 bp, Rattus norvegicus
ggatgtttctgctcccggctctccg

SEQ ID NO: 624876 - DNA, 25 bp, Rattus norvegicus
ctccttcagagatctgtcaatctcc

SEQ ID NO: 624877 - DNA, 25 bp, Rattus norvegicus
cctatcccgggcgatgatggtgatg

SEQ ID NO: 624878 - DNA, 25 bp, Rattus norvegicus
aatctccgggtccaccgcctgttgt

SEQ ID NO: 624879 - DNA, 25 bp, Rattus norvegicus
tcagagatctgtcaatctccgggtc

SEQ ID NO: 624880 - DNA, 25 bp, Rattus norvegicus
atctccgggtccaccgcctgttgtt

SEQ ID NO: 624881 - DNA, 25 bp, Rattus norvegicus
gcagctgaagcacgtcctccttcag

SEQ ID NO: 624882 - DNA, 25 bp, Rattus norvegicus
gtcgcagctgaagcacgtcctcctt

SEQ ID NO: 624883 - DNA, 25 bp, Rattus norvegicus
accggtcgcagctgaagcacgtcct

SEQ ID NO: 624884 - DNA, 25 bp, Rattus norvegicus
agtccgattgatcgcgcccaccggt

SEQ ID NO: 624885 - DNA, 25 bp, Rattus norvegicus
ttgagtccgattgatcgcgcccacc

SEQ ID NO: 624886 - DNA, 25 bp, Rattus norvegicus
gatgttgagtccgattgatcgcgcc

SEQ ID NO: 624887 - DNA, 25 bp, Rattus norvegicus
tggtgatgatgttgagtccgattga

SEQ ID NO: 624888 - DNA, 25 bp, Rattus norvegicus
gatctgtcaatctccgggtccaccg

SEQ ID NO: 624889 - DNA, 25 bp, Rattus norvegicus
agagggcgggccgacatcccaaacg

SEQ ID NO: 624890 - DNA, 25 bp, Rattus norvegicus
cggacaagcgctttcgcctggcgct

SEQ ID NO: 624891 - DNA, 25 bp, Rattus norvegicus
tacgccatgaactggagcgtgcggc

SEQ ID NO: 624892 - DNA, 25 bp, Rattus norvegicus
cgccctggactgtgtacgccatgaa

SEQ ID NO: 624893 - DNA, 25 bp, Rattus norvegicus
gatctacaaatatgaagcgccctgg

SEQ ID NO: 624894 - DNA, 25 bp, Rattus norvegicus
cacggcaaacggaaggagatctaca

SEQ ID NO: 624895 - DNA, 25 bp, Rattus norvegicus
accatgtccctgcacggcaaacgga

SEQ ID NO: 624896 - DNA, 25 bp, Rattus norvegicus
gagggctaggccgttcttgaccgcc

SEQ ID NO: 624897 - DNA, 25 bp, Rattus norvegicus
cccaaacggaaggtggtagtcgctg

SEQ ID NO: 624898 - DNA, 25 bp, Rattus norvegicus
ggtagccaacgctcgtcgccgctgt

SEQ ID NO: 624899 - DNA, 25 bp, Rattus norvegicus
tagaaaggacgtgcccggtagccaa

SEQ ID NO: 624900 - DNA, 25 bp, Rattus norvegicus
ctgtgtcgaccaatgaaaagaagga

SEQ ID NO: 624901 - DNA, 25 bp, Rattus norvegicus
ggcgctaccactgtgtcgaccaatg

SEQ ID NO: 624902 - DNA, 25 bp, Rattus norvegicus
tcgctgcccgagctggtttgaaact

SEQ ID NO: 624903 - DNA, 25 bp, Rattus norvegicus
aggcgcaaatctcgctacaaaaagc

SEQ ID NO: 624904 - DNA, 25 bp, Rattus norvegicus
gagattcgtcgactcccaaaaagga

SEQ ID NO: 624905 - DNA, 25 bp, Rattus norvegicus
taagtgctcagaacccgtccgggcg

SEQ ID NO: 624906 - DNA, 25 bp, Rattus norvegicus
ggcctccaggaaagacctcccagaa

SEQ ID NO: 624907 - DNA, 25 bp, Rattus norvegicus
cgccagagatgttgacgccagggct

SEQ ID NO: 624908 - DNA, 25 bp, Rattus norvegicus
tccctttccggagattcgtcgactc

SEQ ID NO: 624909 - DNA, 25 bp, Rattus norvegicus
gccgaactgcactctcttgatggtg

SEQ ID NO: 624910 - DNA, 25 bp, Rattus norvegicus
gacttcccgtacactcaagctgacg

SEQ ID NO: 624911 - DNA, 25 bp, Rattus norvegicus
gggtgttctttctgacgcgacagga

SEQ ID NO: 624912 - DNA, 25 bp, Rattus norvegicus
gacgccctttatagattcgcccttg

SEQ ID NO: 624913 - DNA, 25 bp, Rattus norvegicus
agtaaccgggatcctgaacggcaga

SEQ ID NO: 624914 - DNA, 25 bp, Rattus norvegicus
tctcggcgcttctgaggagagaact

SEQ ID NO: 624915 - DNA, 25 bp, Rattus norvegicus
cagaggttacggcagtttgtctctc

SEQ ID NO: 624916 - DNA, 25 bp, Rattus norvegicus
gagaatgtttctgagcctgccgccc

SEQ ID NO: 624917 - DNA, 25 bp, Rattus norvegicus
acccgagtagaaggcccagcagagg

SEQ ID NO: 624918 - DNA, 25 bp, Rattus norvegicus
ctacaaatccagaagcgagcgtgtc

SEQ ID NO: 624919 - DNA, 25 bp, Rattus norvegicus
atccagaagcgagcgtgtcaccgcc

SEQ ID NO: 624920 - DNA, 25 bp, Rattus norvegicus
gtgtcaccgcccactcttgttaagc

SEQ ID NO: 624921 - DNA, 25 bp, Rattus norvegicus
ccactcttgttaagcggagcctttc

SEQ ID NO: 624922 - DNA, 25 bp, Rattus norvegicus
tcttgttaagcggagcctttcccgc

SEQ ID NO: 624923 - DNA, 25 bp, Rattus norvegicus
cgcccggtcaggcttggtgcgcact

SEQ ID NO: 624924 - DNA, 25 bp, Rattus norvegicus
aggcttggtgcgcacttgcacccga

SEQ ID NO: 624925 - DNA, 25 bp, Rattus norvegicus
gtcaggacagcggaccacaggaccc

SEQ ID NO: 624926 - DNA, 25 bp, Rattus norvegicus
ttgcacccgagtagaaggcccagca

SEQ ID NO: 624927 - DNA, 25 bp, Rattus norvegicus
gtgccagagctgctaggtcaggaca

SEQ ID NO: 624928 - DNA, 25 bp, Rattus norvegicus
ccgcgtcagcgtgccagagctgcta

SEQ ID NO: 624929 - DNA, 25 bp, Rattus norvegicus
tgcgcacttgcacccgagtagaagg

SEQ ID NO: 624930 - DNA, 25 bp, Rattus norvegicus
tgctaggtcaggacagcggaccaca

SEQ ID NO: 624931 - DNA, 25 bp, Rattus norvegicus
ggaaggtctccactactcataagca

SEQ ID NO: 624932 - DNA, 25 bp, Rattus norvegicus
ctgaaacggtcatttccggaagtca

SEQ ID NO: 624933 - DNA, 25 bp, Rattus norvegicus
tcacggcgacagaggaaggtctcca

SEQ ID NO: 624934 - DNA, 25 bp, Rattus norvegicus
tgaaaccgaattactgaaacggtca

SEQ ID NO: 624935 - DNA, 25 bp, Rattus norvegicus
ctactcataagcaggggccacactc

SEQ ID NO: 624936 - DNA, 25 bp, Rattus norvegicus
taagcaggggccacactccggcctt

SEQ ID NO: 624937 - DNA, 25 bp, Rattus norvegicus
agcaccgcccatgacctgggctgtg

SEQ ID NO: 624938 - DNA, 25 bp, Rattus norvegicus
ccgcaaagaatcctcggctgggttc

SEQ ID NO: 624939 - DNA, 25 bp, Rattus norvegicus
ttcccggcacatccaggccgcacga

SEQ ID NO: 624940 - DNA, 25 bp, Rattus norvegicus
ggccgagcccactcgctcaccttga

SEQ ID NO: 624941 - DNA, 25 bp, Rattus norvegicus
gctcaccttgagctgcccgactaga

SEQ ID NO: 624942 - DNA, 25 bp, Rattus norvegicus
tgcccgactagacgcagaaaacgca

SEQ ID NO: 624943 - DNA, 25 bp, Rattus norvegicus
tagacgcagaaaacgcaacagcccg

SEQ ID NO: 624944 - DNA, 25 bp, Rattus norvegicus
gtcatttccggaagtcacggcgaca

SEQ ID NO: 624945 - DNA, 25 bp, Rattus norvegicus
agacgtccctcaagccctaggcttt

SEQ ID NO: 624946 - DNA, 25 bp, Rattus norvegicus
tgagccgctcagagccgagagaagc

SEQ ID NO: 624947 - DNA, 25 bp, Rattus norvegicus
cacttcccaggtggttggtggctct

SEQ ID NO: 624948 - DNA, 25 bp, Rattus norvegicus
cttggagctgcctgtgaggcttcca

SEQ ID NO: 624949 - DNA, 25 bp, Rattus norvegicus
tgggttccctcagccaacacttgtg

SEQ ID NO: 624950 - DNA, 25 bp, Rattus norvegicus
agggtccctttcgagctcgcattgg

SEQ ID NO: 624951 - DNA, 25 bp, Rattus norvegicus
tcctgcgagctaaagggtccctttc

SEQ ID NO: 624952 - DNA, 25 bp, Rattus norvegicus
ggctgtcaacgaaacacgttcctgc

SEQ ID NO: 624953 - DNA, 25 bp, Rattus norvegicus
tggaacacaacccaggctgtcaacg

SEQ ID NO: 624954 - DNA, 25 bp, Rattus norvegicus
ctctgggtctccgatgagcatgatc

SEQ ID NO: 624955 - DNA, 25 bp, Rattus norvegicus
ctgcggcccaaagagtttgcaagtg

SEQ ID NO: 624956 - DNA, 25 bp, Rattus norvegicus
ggaggtcggattcagcatttggaca

SEQ ID NO: 624957 - DNA, 25 bp, Rattus norvegicus
cggacaatgccgagcgcggtgcaac

SEQ ID NO: 624958 - DNA, 25 bp, Rattus norvegicus
aggcttccagccctctgtttgtcac

SEQ ID NO: 624959 - DNA, 25 bp, Rattus norvegicus
gccagaggagcccagagaagcccac

SEQ ID NO: 624960 - DNA, 25 bp, Rattus norvegicus
gccacagagccgtcataaagctaga

SEQ ID NO: 624961 - DNA, 25 bp, Rattus norvegicus
ggtatccgacctcggctctcctgtg

SEQ ID NO: 624962 - DNA, 25 bp, Rattus norvegicus
ggccacgccgggaccaggtatccga

SEQ ID NO: 624963 - DNA, 25 bp, Rattus norvegicus
aaatgactctaacaacttctgcgtg

SEQ ID NO: 624964 - DNA, 25 bp, Rattus norvegicus
aacaacttctgcgtgcgatggcccg

SEQ ID NO: 624965 - DNA, 25 bp, Rattus norvegicus
agaagccgtgaacgccgaggccatt

SEQ ID NO: 624966 - DNA, 25 bp, Rattus norvegicus
ctagctgtatgagtgccacagagcc

SEQ ID NO: 624967 - DNA, 25 bp, Rattus norvegicus
cggcgaatgggaggcccgtttctct

SEQ ID NO: 624968 - DNA, 25 bp, Rattus norvegicus
acgcactgaacagggaactggggtt

SEQ ID NO: 624969 - DNA, 25 bp, Rattus norvegicus
aagcgggccgcgcacgcactgaaca

SEQ ID NO: 624970 - DNA, 25 bp, Rattus norvegicus
gcttcccaagcgcagagcgccggtt

SEQ ID NO: 624971 - DNA, 25 bp, Rattus norvegicus
gaacgccgaggccattgtaaggctg

SEQ ID NO: 624972 - DNA, 25 bp, Rattus norvegicus
ggactccagctcgacggagcggcca

SEQ ID NO: 624973 - DNA, 25 bp, Rattus norvegicus
aggtcgcggcgccattttaatcgcc

SEQ ID NO: 624974 - DNA, 25 bp, Rattus norvegicus
agggtcggaattaggcgctcattta

SEQ ID NO: 624975 - DNA, 25 bp, Rattus norvegicus
cgaggtcagaggctggctctagact

SEQ ID NO: 624976 - DNA, 25 bp, Rattus norvegicus
gctctagactggttcgggagttctc

SEQ ID NO: 624977 - DNA, 25 bp, Rattus norvegicus
ccgctgtcggacctcccgggaaatg

SEQ ID NO: 624978 - DNA, 25 bp, Rattus norvegicus
ccgggaaatgggaacagagcacgta

SEQ ID NO: 624979 - DNA, 25 bp, Rattus norvegicus
cccaggacccagtgcgatgctgaaa

SEQ ID NO: 624980 - DNA, 25 bp, Rattus norvegicus
ggcgctcatttagcgagcgttacta

SEQ ID NO: 624981 - DNA, 25 bp, Rattus norvegicus
cgagcgttactaatccgaagttaca

SEQ ID NO: 624982 - DNA, 25 bp, Rattus norvegicus
ttacagcgctaattccctgatcccg

SEQ ID NO: 624983 - DNA, 25 bp, Rattus norvegicus
ggatcccgctaagcggtcgccgatg

SEQ ID NO: 624984 - DNA, 25 bp, Rattus norvegicus
agtcttgcccggactgatgcgcctt

SEQ ID NO: 624985 - DNA, 25 bp, Rattus norvegicus
tacaaccagaacagcctccttttgg

SEQ ID NO: 624986 - DNA, 25 bp, Rattus norvegicus
tcccaccggggtatctacaaccaga

SEQ ID NO: 624987 - DNA, 25 bp, Rattus norvegicus
agcagggccgctcaaccccatggaa

SEQ ID NO: 624988 - DNA, 25 bp, Rattus norvegicus
cgctctcggaaaccgcgtggtgaga

SEQ ID NO: 624989 - DNA, 25 bp, Rattus norvegicus
aaaccgcgtggtgagagcttaggca

SEQ ID NO: 624990 - DNA, 25 bp, Rattus norvegicus
agcttaggcagagactgactccctt

SEQ ID NO: 624991 - DNA, 25 bp, Rattus norvegicus
gcacgcacctcctgtcccaggccta

SEQ ID NO: 624992 - DNA, 25 bp, Rattus norvegicus
gcctacccgggcctatggaagcttc

SEQ ID NO: 624993 - DNA, 25 bp, Rattus norvegicus
gggcctatggaagcttccgcgcgaa

SEQ ID NO: 624994 - DNA, 25 bp, Rattus norvegicus
ctatggaagcttccgcgcgaagctg

SEQ ID NO: 624995 - DNA, 25 bp, Rattus norvegicus
ggaaggccctcagagcacgcgtaaa

SEQ ID NO: 624996 - DNA, 25 bp, Rattus norvegicus
aaggccctcagagcacgcgtaaacc

SEQ ID NO: 624997 - DNA, 25 bp, Rattus norvegicus
cgccgagaggagacccgaaggacca

SEQ ID NO: 624998 - DNA, 25 bp, Rattus norvegicus
aggagacccgaaggaccagccgcgt

SEQ ID NO: 624999 - DNA, 25 bp, Rattus norvegicus
attttgagagcgaacgcacggcggc

SEQ ID NO: 625000 - DNA, 25 bp, Rattus norvegicus
cgctcgctctcggaaaccgcgtggt

SEQ ID NO: 625001 - DNA, 25 bp, Rattus norvegicus
acgaaccactgaatgctgcaaaacc

SEQ ID NO: 625002 - DNA, 25 bp, Rattus norvegicus
ctggactcgcagcacgaaccactga

SEQ ID NO: 625003 - DNA, 25 bp, Rattus norvegicus
gcaaactgcgcttggtcggacggat

SEQ ID NO: 625004 - DNA, 25 bp, Rattus norvegicus
tgttctccgggataagcgctctcac

SEQ ID NO: 625005 - DNA, 25 bp, Rattus norvegicus
acaagttcaagttcaggggctggcc

SEQ ID NO: 625006 - DNA, 25 bp, Rattus norvegicus
cgccaccttccggacaaagtgtcaa

SEQ ID NO: 625007 - DNA, 25 bp, Rattus norvegicus
cagcggattacaggctctttgggtc

SEQ ID NO: 625008 - DNA, 25 bp, Rattus norvegicus
tccctaagggcctcagcggattaca

SEQ ID NO: 625009 - DNA, 25 bp, Rattus norvegicus
tcggagccttggagatcccgactcc

SEQ ID NO: 625010 - DNA, 25 bp, Rattus norvegicus
agagcccgagagcacctggcagttt

SEQ ID NO: 625011 - DNA, 25 bp, Rattus norvegicus
tgtggctcggaacccaaacacccag

SEQ ID NO: 625012 - DNA, 25 bp, Rattus norvegicus
ctgccgacgcgacgtgcagagaatc

SEQ ID NO: 625013 - DNA, 25 bp, Rattus norvegicus
cgcacctgccattaacgttcaatta

SEQ ID NO: 625014 - DNA, 25 bp, Rattus norvegicus
aattagcggctgaatagtggctgcc

SEQ ID NO: 625015 - DNA, 25 bp, Rattus norvegicus
tgagggcaagatcgggtttgtccca

SEQ ID NO: 625016 - DNA, 25 bp, Rattus norvegicus
ttcttagggattccgtagccgccgc

SEQ ID NO: 625017 - DNA, 25 bp, Rattus norvegicus
tctaaagcacggaggaggccgcact

SEQ ID NO: 625018 - DNA, 25 bp, Rattus norvegicus
aagcacggaggaggccgcactctgt

SEQ ID NO: 625019 - DNA, 25 bp, Rattus norvegicus
gccaagctctcactaccgagacgag

SEQ ID NO: 625020 - DNA, 25 bp, Rattus norvegicus
gtcccacgaccttggcgccagtaaa

SEQ ID NO: 625021 - DNA, 25 bp, Rattus norvegicus
gatgtcactaaagccggtggttctt

SEQ ID NO: 625022 - DNA, 25 bp, Rattus norvegicus
agatcgggtttgtcccacgaccttg

SEQ ID NO: 625023 - DNA, 25 bp, Rattus norvegicus
gaccttggcgccagtaaactggaga

SEQ ID NO: 625024 - DNA, 25 bp, Rattus norvegicus
gtaaactggagaatgagacagaccc

SEQ ID NO: 625025 - DNA, 25 bp, Rattus norvegicus
tggagttgaaacaaaacctgaaagc

SEQ ID NO: 625026 - DNA, 25 bp, Rattus norvegicus
acctgaaagcccgaggttgtccgca

SEQ ID NO: 625027 - DNA, 25 bp, Rattus norvegicus
cgaggttgtccgcaccgccagaggt

SEQ ID NO: 625028 - DNA, 25 bp, Rattus norvegicus
cactaccgagacgaggatgtcacta

SEQ ID NO: 625029 - DNA, 25 bp, Rattus norvegicus
ttcaatccggtgaagcaaactgtcc

SEQ ID NO: 625030 - DNA, 25 bp, Rattus norvegicus
ggcctccggcttccatctttgccga

SEQ ID NO: 625031 - DNA, 25 bp, Rattus norvegicus
tagagccggggcctccggcttccat

SEQ ID NO: 625032 - DNA, 25 bp, Rattus norvegicus
tgtccaattagagccggggcctccg

SEQ ID NO: 625033 - DNA, 25 bp, Rattus norvegicus
actgtccaattagagccggggcctc

SEQ ID NO: 625034 - DNA, 25 bp, Rattus norvegicus
agcaaactgtccaattagagccggg

SEQ ID NO: 625035 - DNA, 25 bp, Rattus norvegicus
tccggtgaagcaaactgtccaatta

SEQ ID NO: 625036 - DNA, 25 bp, Rattus norvegicus
acaatgtttttcaatccggtgaagc

SEQ ID NO: 625037 - DNA, 25 bp, Rattus norvegicus
tgtcacaatgtttttcaatccggtg

SEQ ID NO: 625038 - DNA, 25 bp, Rattus norvegicus
ctcctcctttgtcacaatgtttttc

SEQ ID NO: 625039 - DNA, 25 bp, Rattus norvegicus
gcacctcctcctttgtcacaatgtt

SEQ ID NO: 625040 - DNA, 25 bp, Rattus norvegicus
atcagctggaatcaaagccgccgcc

SEQ ID NO: 625041 - DNA, 25 bp, Rattus norvegicus
gctgatcagctggaatcaaagccgc

SEQ ID NO: 625042 - DNA, 25 bp, Rattus norvegicus
cggtgaagcaaactgtccaattaga

SEQ ID NO: 625043 - DNA, 25 bp, Rattus norvegicus
ccaatttctgcgcatcccgtcgata

SEQ ID NO: 625044 - DNA, 25 bp, Rattus norvegicus
tcgatacctggccttttccgctctg

SEQ ID NO: 625045 - DNA, 25 bp, Rattus norvegicus
taaaattcgttctccacatcgctgg

SEQ ID NO: 625046 - DNA, 25 bp, Rattus norvegicus
gctggagatgttcttgcgcttcttc

SEQ ID NO: 625047 - DNA, 25 bp, Rattus norvegicus
ttctccaaccaccagtgagcatcag

SEQ ID NO: 625048 - DNA, 25 bp, Rattus norvegicus
gcatcagcctggatgtcgtagcgca

SEQ ID NO: 625049 - DNA, 25 bp, Rattus norvegicus
tcgtagcgcacgaacacgccgaaga

SEQ ID NO: 625050 - DNA, 25 bp, Rattus norvegicus
cacgccgaagagaaccaccatggtc

SEQ ID NO: 625051 - DNA, 25 bp, Rattus norvegicus
ccatggtcacctgcaggatcaggca

SEQ ID NO: 625052 - DNA, 25 bp, Rattus norvegicus
gtgttccaggccatgctctgcactg

SEQ ID NO: 625053 - DNA, 25 bp, Rattus norvegicus
cgaggacagggcgacgcttataaga

SEQ ID NO: 625054 - DNA, 25 bp, Rattus norvegicus
cgcttataagactgggacattgggc

SEQ ID NO: 625055 - DNA, 25 bp, Rattus norvegicus
ccagggcgctatccaaccggcaaga

SEQ ID NO: 625056 - DNA, 25 bp, Rattus norvegicus
ctctgttccggagcattgagcgaga

SEQ ID NO: 625057 - DNA, 25 bp, Rattus norvegicus
ccctgaacgcgcacggcgctgggga

SEQ ID NO: 625058 - DNA, 25 bp, Rattus norvegicus
cttccaggttgatctaggggcgcag

SEQ ID NO: 625059 - DNA, 25 bp, Rattus norvegicus
ccttccaggttgatctaggggcgca

SEQ ID NO: 625060 - DNA, 25 bp, Rattus norvegicus
tctcctggggccgagaagagggtcg

SEQ ID NO: 625061 - DNA, 25 bp, Rattus norvegicus
aggatgcccctctcacgctgcccgg

SEQ ID NO: 625062 - DNA, 25 bp, Rattus norvegicus
gtatggcgtccagcgagccgcgact

SEQ ID NO: 625063 - DNA, 25 bp, Rattus norvegicus
ctggggagcaacttaagggcgccct

SEQ ID NO: 625064 - DNA, 25 bp, Rattus norvegicus
ggagcaacttaagggcgccctggta

SEQ ID NO: 625065 - DNA, 25 bp, Rattus norvegicus
cttaagggcgccctggtatggcgtc

SEQ ID NO: 625066 - DNA, 25 bp, Rattus norvegicus
taagggcgccctggtatggcgtcca

SEQ ID NO: 625067 - DNA, 25 bp, Rattus norvegicus
ccctggtatggcgtccagcgagccg

SEQ ID NO: 625068 - DNA, 25 bp, Rattus norvegicus
ggggcagggctaggagaggatgccc

SEQ ID NO: 625069 - DNA, 25 bp, Rattus norvegicus
actcggtctcctggggccgagaaga

SEQ ID NO: 625070 - DNA, 25 bp, Rattus norvegicus
ccgcgactgggggactcggtctcct

SEQ ID NO: 625071 - DNA, 25 bp, Rattus norvegicus
agggagctgcttcagttcgtgtccg

SEQ ID NO: 625072 - DNA, 25 bp, Rattus norvegicus
caatggcgctggttctctgaagaga

SEQ ID NO: 625073 - DNA, 25 bp, Rattus norvegicus
ccgagatggcctgctgtcacaaagt

SEQ ID NO: 625074 - DNA, 25 bp, Rattus norvegicus
ccaataggagcggagcttggaaacc

SEQ ID NO: 625075 - DNA, 25 bp, Rattus norvegicus
taacttacctgagctgccgcttcgg

SEQ ID NO: 625076 - DNA, 25 bp, Rattus norvegicus
ggtccactggaccttcaagttcttc

SEQ ID NO: 625077 - DNA, 25 bp, Rattus norvegicus
ccctgatggagacgctgctcgatta

SEQ ID NO: 625078 - DNA, 25 bp, Rattus norvegicus
tgctcgattaccagtgggaccggcc

SEQ ID NO: 625079 - DNA, 25 bp, Rattus norvegicus
tgtccgcactcacagagggagctgc

SEQ ID NO: 625080 - DNA, 25 bp, Rattus norvegicus
cgccttccagttaggcttaaaaatg

SEQ ID NO: 625081 - DNA, 25 bp, Rattus norvegicus
tccaccaatcaagcggaggctttcc

SEQ ID NO: 625082 - DNA, 25 bp, Rattus norvegicus
gtaacttacgttcagccggcagcca

SEQ ID NO: 625083 - DNA, 25 bp, Rattus norvegicus
gctcctccaatagcagcagttgtcg

SEQ ID NO: 625084 - DNA, 25 bp, Rattus norvegicus
cccactaagccgatcctgcgaagta

SEQ ID NO: 625085 - DNA, 25 bp, Rattus norvegicus
gtcccgcactttgcgggcagcagcg

SEQ ID NO: 625086 - DNA, 25 bp, Rattus norvegicus
ctttcgatgccgctgtcgggcccag

SEQ ID NO: 625087 - DNA, 25 bp, Rattus norvegicus
tttcgatgccgctgtcgggcccaga

SEQ ID NO: 625088 - DNA, 25 bp, Rattus norvegicus
agctcagggcgctgcgttcaccctc

SEQ ID NO: 625089 - DNA, 25 bp, Rattus norvegicus
ggcgctgcgttcaccctccaccgcg

SEQ ID NO: 625090 - DNA, 25 bp, Rattus norvegicus
agccagtcccgcactttgcgggcag

SEQ ID NO: 625091 - DNA, 25 bp, Rattus norvegicus
cagcagcgcccggtagcccaggctc

SEQ ID NO: 625092 - DNA, 25 bp, Rattus norvegicus
cgcccggtagcccaggctcggcctg

SEQ ID NO: 625093 - DNA, 25 bp, Rattus norvegicus
gcctgcagctctcgcaggaggctgt

SEQ ID NO: 625094 - DNA, 25 bp, Rattus norvegicus
ctgcagctctcgcaggaggctgtag

SEQ ID NO: 625095 - DNA, 25 bp, Rattus norvegicus
ctcgcaggaggctgtaggcggcgct

SEQ ID NO: 625096 - DNA, 25 bp, Rattus norvegicus
cccggagcgactgccgcggagccca

SEQ ID NO: 625097 - DNA, 25 bp, Rattus norvegicus
cctgggcagagcacgcgccggccac

SEQ ID NO: 625098 - DNA, 25 bp, Rattus norvegicus
ctccaccgcgcacagccagtcccgc

SEQ ID NO: 625099 - DNA, 25 bp, Rattus norvegicus
ccagttgactgtggcacgattgcgg

SEQ ID NO: 625100 - DNA, 25 bp, Rattus norvegicus
gcgccggccacggtggatgatgcgc

SEQ ID NO: 625101 - DNA, 25 bp, Rattus norvegicus
atgatgcgcgtctccgagcggtgtc

SEQ ID NO: 625102 - DNA, 25 bp, Rattus norvegicus
gcctgttcctcagggacacgctcgg

SEQ ID NO: 625103 - DNA, 25 bp, Rattus norvegicus
ttcctcagggacacgctcggcttct

SEQ ID NO: 625104 - DNA, 25 bp, Rattus norvegicus
acacgctcggcttctggacgccagt

SEQ ID NO: 625105 - DNA, 25 bp, Rattus norvegicus
tcggcttctggacgccagttgactg

SEQ ID NO: 625106 - DNA, 25 bp, Rattus norvegicus
actgtggcacgattgcggatgttct

SEQ ID NO: 625107 - DNA, 25 bp, Rattus norvegicus
cacgattgcggatgttctgggcacg

SEQ ID NO: 625108 - DNA, 25 bp, Rattus norvegicus
ttctgggcacggctggcgtagttta

SEQ ID NO: 625109 - DNA, 25 bp, Rattus norvegicus
tgttaagggtttcatcgaagtcgga

SEQ ID NO: 625110 - DNA, 25 bp, Rattus norvegicus
taagggtttcatcgaagtcggagga

SEQ ID NO: 625111 - DNA, 25 bp, Rattus norvegicus
acgccagttgactgtggcacgattg

SEQ ID NO: 625112 - DNA, 25 bp, Rattus norvegicus
cttctggacgccagttgactgtggc

SEQ ID NO: 625113 - DNA, 25 bp, Rattus norvegicus
cgcggcttgcacaggagagcccaaa

SEQ ID NO: 625114 - DNA, 25 bp, Rattus norvegicus
tgctcgtcgagctagagtcaggatg

SEQ ID NO: 625115 - DNA, 25 bp, Rattus norvegicus
ttactccgggtgagctcaaagaagc

SEQ ID NO: 625116 - DNA, 25 bp, Rattus norvegicus
acgtggggagcgagaacaattactc

SEQ ID NO: 625117 - DNA, 25 bp, Rattus norvegicus
ctagacgagaccatcgacgtgggga

SEQ ID NO: 625118 - DNA, 25 bp, Rattus norvegicus
cgacctctgaaagcgacctagacga

SEQ ID NO: 625119 - DNA, 25 bp, Rattus norvegicus
gcccttgcgaggagacgacctctga

SEQ ID NO: 625120 - DNA, 25 bp, Rattus norvegicus
tagctcttctttttcgccgcgatga

SEQ ID NO: 625121 - DNA, 25 bp, Rattus norvegicus
agctcagggtgtccgtagctcttct

SEQ ID NO: 625122 - DNA, 25 bp, Rattus norvegicus
tgagggcccgcctctccatattagc

SEQ ID NO: 625123 - DNA, 25 bp, Rattus norvegicus
ctcagccacacgctagcggttattc

SEQ ID NO: 625124 - DNA, 25 bp, Rattus norvegicus
acgcgactggaagggaactggacct

SEQ ID NO: 625125 - DNA, 25 bp, Rattus norvegicus
ttctcattaggcgtgggacgcgact

SEQ ID NO: 625126 - DNA, 25 bp, Rattus norvegicus
ttagccaatagaaagccagacgttc

SEQ ID NO: 625127 - DNA, 25 bp, Rattus norvegicus
agaaccctctcagagcctgccaggt

SEQ ID NO: 625128 - DNA, 25 bp, Rattus norvegicus
tcacagtgaagactgtgtgcgagcg

SEQ ID NO: 625129 - DNA, 25 bp, Rattus norvegicus
gctccagggtcacagtgaagactgt

SEQ ID NO: 625130 - DNA, 25 bp, Rattus norvegicus
ctctgctccagggtcacagtgaaga

SEQ ID NO: 625131 - DNA, 25 bp, Rattus norvegicus
gggtaggagcccgtcctctctgctc

SEQ ID NO: 625132 - DNA, 25 bp, Rattus norvegicus
gcaagcgggtaggagcccgtcctct

SEQ ID NO: 625133 - DNA, 25 bp, Rattus norvegicus
agagaccagcaggtggccagcgcca

SEQ ID NO: 625134 - DNA, 25 bp, Rattus norvegicus
gtcttcagaaccctctcagagcctg

SEQ ID NO: 625135 - DNA, 25 bp, Rattus norvegicus
tgccggtcttcagaaccctctcaga

SEQ ID NO: 625136 - DNA, 25 bp, Rattus norvegicus
agcctgccaggtccacgaagtggaa

SEQ ID NO: 625137 - DNA, 25 bp, Rattus norvegicus
tgccaggtccacgaagtggaattta

SEQ ID NO: 625138 - DNA, 25 bp, Rattus norvegicus
cacgaagtggaatttagagaccagc

SEQ ID NO: 625139 - DNA, 25 bp, Rattus norvegicus
atttagagaccagcaggtggccagc

SEQ ID NO: 625140 - DNA, 25 bp, Rattus norvegicus
ttgaagtgtgtggctcctgtgtgcc

SEQ ID NO: 625141 - DNA, 25 bp, Rattus norvegicus
gcgcgctccgatgccgtcatcggga

SEQ ID NO: 625142 - DNA, 25 bp, Rattus norvegicus
cgatccgacgctgggaacgggccct

SEQ ID NO: 625143 - DNA, 25 bp, Rattus norvegicus
cgggccctcccagaaagtttgcaga

SEQ ID NO: 625144 - DNA, 25 bp, Rattus norvegicus
ccctcccagaaagtttgcagaagtg

SEQ ID NO: 625145 - DNA, 25 bp, Rattus norvegicus
cccagaaagtttgcagaagtgatta

SEQ ID NO: 625146 - DNA, 25 bp, Rattus norvegicus
tttgcagaagtgattacagacgtgg

SEQ ID NO: 625147 - DNA, 25 bp, Rattus norvegicus
aagtgattacagacgtggaccctcc

SEQ ID NO: 625148 - DNA, 25 bp, Rattus norvegicus
tgattacagacgtggaccctcctgg

SEQ ID NO: 625149 - DNA, 25 bp, Rattus norvegicus
accctcctggcctagcgcgcgcagt

SEQ ID NO: 625150 - DNA, 25 bp, Rattus norvegicus
cgcagtcccgggacgcgtagaccag

SEQ ID NO: 625151 - DNA, 25 bp, Rattus norvegicus
atccctcccttcacccgcaactccg

SEQ ID NO: 625152 - DNA, 25 bp, Rattus norvegicus
cgcaactccgcctgccctggcgctc

SEQ ID NO: 625153 - DNA, 25 bp, Rattus norvegicus
cagtcagggcgcctccaagtcggtc

SEQ ID NO: 625154 - DNA, 25 bp, Rattus norvegicus
accgatggggggctactcagacgcc

SEQ ID NO: 625155 - DNA, 25 bp, Rattus norvegicus
taggggcgcaggctactcagctctt

SEQ ID NO: 625156 - DNA, 25 bp, Rattus norvegicus
cctctgctggaggattatcgatgtc

SEQ ID NO: 625157 - DNA, 25 bp, Rattus norvegicus
cgctccacctctgctggaggattat

SEQ ID NO: 625158 - DNA, 25 bp, Rattus norvegicus
cggttttgtcatccagatcggggca

SEQ ID NO: 625159 - DNA, 25 bp, Rattus norvegicus
acgcgctgatgtctcggttttgtca

SEQ ID NO: 625160 - DNA, 25 bp, Rattus norvegicus
ctctctgggcatagccaggaagcca

SEQ ID NO: 625161 - DNA, 25 bp, Rattus norvegicus
cgcgcaggcttctctctgggcatag

SEQ ID NO: 625162 - DNA, 25 bp, Rattus norvegicus
aagctgtcgctgaccctgcgcgcag

SEQ ID NO: 625163 - DNA, 25 bp, Rattus norvegicus
gccggaagaagctgtcgctgaccct

SEQ ID NO: 625164 - DNA, 25 bp, Rattus norvegicus
gctccatgacgctgggccggaagaa

SEQ ID NO: 625165 - DNA, 25 bp, Rattus norvegicus
tgcggcccaggatgggctccatgac

SEQ ID NO: 625166 - DNA, 25 bp, Rattus norvegicus
cttcttgcgcagctggctgtactgc

SEQ ID NO: 625167 - DNA, 25 bp, Rattus norvegicus
aggctactcagctcttcttgcgcag

SEQ ID NO: 625168 - DNA, 25 bp, Rattus norvegicus
atcgatgtcttggaattcgctctcg

SEQ ID NO: 625169 - DNA, 25 bp, Rattus norvegicus
ccgctccctcgtgggtcttctggga

SEQ ID NO: 625170 - DNA, 25 bp, Rattus norvegicus
ctaaggcgacgccaagccacaagac

SEQ ID NO: 625171 - DNA, 25 bp, Rattus norvegicus
gaccgcacctgactcacctgaaaag

SEQ ID NO: 625172 - DNA, 25 bp, Rattus norvegicus
gactcacctgaaaagtcggtcccga

SEQ ID NO: 625173 - DNA, 25 bp, Rattus norvegicus
ccgaccttggctttggttggcgact

SEQ ID NO: 625174 - DNA, 25 bp, Rattus norvegicus
ttggcgactcggatgaaggcgtcca

SEQ ID NO: 625175 - DNA, 25 bp, Rattus norvegicus
gatgaaggcgtccatggctcccacc

SEQ ID NO: 625176 - DNA, 25 bp, Rattus norvegicus
gtcttctgggacctcgctggtcccg

SEQ ID NO: 625177 - DNA, 25 bp, Rattus norvegicus
gggaccgcctatctccgcccacacg

SEQ ID NO: 625178 - DNA, 25 bp, Rattus norvegicus
ggcacaccttcggaagcgctgcttt

SEQ ID NO: 625179 - DNA, 25 bp, Rattus norvegicus
gcgctgctttttagagttccggttg

SEQ ID NO: 625180 - DNA, 25 bp, Rattus norvegicus
ccggaagtgatagttactaaggcga

SEQ ID NO: 625181 - DNA, 25 bp, Rattus norvegicus
gacagccgggatcagattagtcgcc

SEQ ID NO: 625182 - DNA, 25 bp, Rattus norvegicus
gatagttactaaggcgacgccaagc

SEQ ID NO: 625183 - DNA, 25 bp, Rattus norvegicus
tccagggatgctgtttcggtgtaca

SEQ ID NO: 625184 - DNA, 25 bp, Rattus norvegicus
tccatctcctgcctttccagggatg

SEQ ID NO: 625185 - DNA, 25 bp, Rattus norvegicus
attactaaccggagacgaggggctg

SEQ ID NO: 625186 - DNA, 25 bp, Rattus norvegicus
caacagtaggggacgccacctcgac

SEQ ID NO: 625187 - DNA, 25 bp, Rattus norvegicus
ctgtgtgtcgcgcaccaacagtagg

SEQ ID NO: 625188 - DNA, 25 bp, Rattus norvegicus
gtaatgcgtccttaatccctgcctg

SEQ ID NO: 625189 - DNA, 25 bp, Rattus norvegicus
atgatgggtcccacgattctgcggc

SEQ ID NO: 625190 - DNA, 25 bp, Rattus norvegicus
atgctcgcaagggagatccagcgtg

SEQ ID NO: 625191 - DNA, 25 bp, Rattus norvegicus
cttaaatggggaccgagagactgcg

SEQ ID NO: 625192 - DNA, 25 bp, Rattus norvegicus
ctggccgattggtgccactgaagga

SEQ ID NO: 625193 - DNA, 25 bp, Rattus norvegicus
cgagcgtgcgcatacgaagcttctc

SEQ ID NO: 625194 - DNA, 25 bp, Rattus norvegicus
tcccacgagtccgaggaccaggctg

SEQ ID NO: 625195 - DNA, 25 bp, Rattus norvegicus
ccgctgcaggcaaccgggcttaaat

SEQ ID NO: 625196 - DNA, 25 bp, Rattus norvegicus
cagcatggggaagggattactaacc

SEQ ID NO: 625197 - DNA, 25 bp, Rattus norvegicus
gtggcacctgccggccagagcctga

SEQ ID NO: 625198 - DNA, 25 bp, Rattus norvegicus
cagattcgtccggttcatgtccttg

SEQ ID NO: 625199 - DNA, 25 bp, Rattus norvegicus
tccggttcatgtccttgctacgcca

SEQ ID NO: 625200 - DNA, 25 bp, Rattus norvegicus
atgtccttgctacgccacccgcccg

SEQ ID NO: 625201 - DNA, 25 bp, Rattus norvegicus
cgcagcgcacgcaatacccaagtcg

SEQ ID NO: 625202 - DNA, 25 bp, Rattus norvegicus
gctgcgcatgcgcacactcgcccgc

SEQ ID NO: 625203 - DNA, 25 bp, Rattus norvegicus
cttcctgccgccgtcggtggcacct

SEQ ID NO: 625204 - DNA, 25 bp, Rattus norvegicus
attcgtccggttcatgtccttgcta

SEQ ID NO: 625205 - DNA, 25 bp, Rattus norvegicus
ctcagcgaggacagtctgcggcgca

SEQ ID NO: 625206 - DNA, 25 bp, Rattus norvegicus
acggagtgcggacgccgccttctct

SEQ ID NO: 625207 - DNA, 25 bp, Rattus norvegicus
gctgcaagaactgcgccgcttcctg

SEQ ID NO: 625208 - DNA, 25 bp, Rattus norvegicus
ggcctcttcctcagattcgtccggt

SEQ ID NO: 625209 - DNA, 25 bp, Rattus norvegicus
tccgactccacgtctccggcctctt

SEQ ID NO: 625210 - DNA, 25 bp, Rattus norvegicus
tcctcagattcgtccggttcatgtc

SEQ ID NO: 625211 - DNA, 25 bp, Rattus norvegicus
tacaaacacctagacgccacgagcc

SEQ ID NO: 625212 - DNA, 25 bp, Rattus norvegicus
cacagctctggaggctttccacaca

SEQ ID NO: 625213 - DNA, 25 bp, Rattus norvegicus
accacatctgggagacagctagagg

SEQ ID NO: 625214 - DNA, 25 bp, Rattus norvegicus
agggtctcgcccaccacatctggga

SEQ ID NO: 625215 - DNA, 25 bp, Rattus norvegicus
acttcacgccgctgtcccagggtct

SEQ ID NO: 625216 - DNA, 25 bp, Rattus norvegicus
tagcgcgctaagacccagacctctc

SEQ ID NO: 625217 - DNA, 25 bp, Rattus norvegicus
cccgcatgcctgcaaacagccgctc

SEQ ID NO: 625218 - DNA, 25 bp, Rattus norvegicus
cccgcacttgcctaggacagcgcgc

SEQ ID NO: 625219 - DNA, 25 bp, Rattus norvegicus
aaacgtccgcaactcatggctgcct

SEQ ID NO: 625220 - DNA, 25 bp, Rattus norvegicus
cccatctgagtaggggcaaggagct

SEQ ID NO: 625221 - DNA, 25 bp, Rattus norvegicus
tttacccatctgagtaggggcaagg

SEQ ID NO: 625222 - DNA, 25 bp, Rattus norvegicus
gggacccactccaacagcctcggca

SEQ ID NO: 625223 - DNA, 25 bp, Rattus norvegicus
tggagcttccctcggagccctacaa

SEQ ID NO: 625224 - DNA, 25 bp, Rattus norvegicus
cagctccaggccctcagtttaccca

SEQ ID NO: 625225 - DNA, 25 bp, Rattus norvegicus
ggactgtcttcggagccttgtctaa

SEQ ID NO: 625226 - DNA, 25 bp, Rattus norvegicus
aggcgcccaggaatgtgcacctgtt

SEQ ID NO: 625227 - DNA, 25 bp, Rattus norvegicus
ctgccgatttcgctcagtgggtttg

SEQ ID NO: 625228 - DNA, 25 bp, Rattus norvegicus
cctcttcggcgtccagactgactta

SEQ ID NO: 625229 - DNA, 25 bp, Rattus norvegicus
actgctgttcactgcctcttcggcg

SEQ ID NO: 625230 - DNA, 25 bp, Rattus norvegicus
gctggccgtgaccactgctgttcac

SEQ ID NO: 625231 - DNA, 25 bp, Rattus norvegicus
aagcactaagtgacgctccgagggc

SEQ ID NO: 625232 - DNA, 25 bp, Rattus norvegicus
cccgcgggctcctaatgaaggaaag

SEQ ID NO: 625233 - DNA, 25 bp, Rattus norvegicus
aagcagttggccttcggcttccgac

SEQ ID NO: 625234 - DNA, 25 bp, Rattus norvegicus
gcgccggccttactgagctatcata

SEQ ID NO: 625235 - DNA, 25 bp, Rattus norvegicus
ctcaccaggctgatgagttgcgcca

SEQ ID NO: 625236 - DNA, 25 bp, Rattus norvegicus
gcggtacctctctcaccaggctgat

SEQ ID NO: 625237 - DNA, 25 bp, Rattus norvegicus
tcggagccttgtctaaagccacgcc

SEQ ID NO: 625238 - DNA, 25 bp, Rattus norvegicus
gtcgcgcccggagcaattgcagtcg

SEQ ID NO: 625239 - DNA, 25 bp, Rattus norvegicus
tgtcgtggtagatgcggctcatttt

SEQ ID NO: 625240 - DNA, 25 bp, Rattus norvegicus
agtcgcacgctctgcaccgccttgt

SEQ ID NO: 625241 - DNA, 25 bp, Rattus norvegicus
tctgcaccgccttgttgcggagggc

SEQ ID NO: 625242 - DNA, 25 bp, Rattus norvegicus
tagatcccggaaccgtgctgctaac

SEQ ID NO: 625243 - DNA, 25 bp, Rattus norvegicus
cactgtcgtggtagatgcggctcat

SEQ ID NO: 625244 - DNA, 25 bp, Rattus norvegicus
gcggctcattttccccacgcggagg

SEQ ID NO: 625245 - DNA, 25 bp, Rattus norvegicus
cggggcacctcagggacaggagctt

SEQ ID NO: 625246 - DNA, 25 bp, Rattus norvegicus
cttggaggtcgctgcagcaccggct

SEQ ID NO: 625247 - DNA, 25 bp, Rattus norvegicus
gtcgctgcagcaccggctggctttc

SEQ ID NO: 625248 - DNA, 25 bp, Rattus norvegicus
tgcagcaccggctggctttcccggt

SEQ ID NO: 625249 - DNA, 25 bp, Rattus norvegicus
agcaccggctggctttcccggttag

SEQ ID NO: 625250 - DNA, 25 bp, Rattus norvegicus
gctggctttcccggttagtagatcc

SEQ ID NO: 625251 - DNA, 25 bp, Rattus norvegicus
agtagatcccggaaccgtgctgcta

SEQ ID NO: 625252 - DNA, 25 bp, Rattus norvegicus
caccgccttgttgcggagggcactg

SEQ ID NO: 625253 - DNA, 25 bp, Rattus norvegicus
aattgacccttggtggcgacactgc

SEQ ID NO: 625254 - DNA, 25 bp, Rattus norvegicus
cgaacagctgtttaaaggctcttta

SEQ ID NO: 625255 - DNA, 25 bp, Rattus norvegicus
ccagggctcagcgaacagctgttta

SEQ ID NO: 625256 - DNA, 25 bp, Rattus norvegicus
gtctgaccgtccagggctcagcgaa

SEQ ID NO: 625257 - DNA, 25 bp, Rattus norvegicus
gagccgttccctcgagtctgaccgt

SEQ ID NO: 625258 - DNA, 25 bp, Rattus norvegicus
cccgacgatagcagccggagccgtt

SEQ ID NO: 625259 - DNA, 25 bp, Rattus norvegicus
gggcccagaccttagcgaacgacca

SEQ ID NO: 625260 - DNA, 25 bp, Rattus norvegicus
gaggaggccaggctacgccgaaccc

SEQ ID NO: 625261 - DNA, 25 bp, Rattus norvegicus
agagctggtcttgggagcacgccca

SEQ ID NO: 625262 - DNA, 25 bp, Rattus norvegicus
gtacccgcccatgcgtcggagtaga

SEQ ID NO: 625263 - DNA, 25 bp, Rattus norvegicus
cccatgaataattgacccttggtgg

SEQ ID NO: 625264 - DNA, 25 bp, Rattus norvegicus
gctctttactgttcagggctctgcg

SEQ ID NO: 625265 - DNA, 25 bp, Rattus norvegicus
tgtccggcctgtcccagagttggga

SEQ ID NO: 625266 - DNA, 25 bp, Rattus norvegicus
agaagccgaagacagagctggtctt

SEQ ID NO: 625267 - DNA, 25 bp, Rattus norvegicus
ttccacattccctcatgccggagag

SEQ ID NO: 625268 - DNA, 25 bp, Rattus norvegicus
acattccctcatgccggagagctgg

SEQ ID NO: 625269 - DNA, 25 bp, Rattus norvegicus
ccctcatgccggagagctggagcga

SEQ ID NO: 625270 - DNA, 25 bp, Rattus norvegicus
caaacatgtcgtcttttcctttcac

SEQ ID NO: 625271 - DNA, 25 bp, Rattus norvegicus
gcgctgcaaacatgtcgtcttttcc

SEQ ID NO: 625272 - DNA, 25 bp, Rattus norvegicus
cgcgctgcaaacatgtcgtcttttc

SEQ ID NO: 625273 - DNA, 25 bp, Rattus norvegicus
gccgcgctgcaaacatgtcgtcttt

SEQ ID NO: 625274 - DNA, 25 bp, Rattus norvegicus
gcagccgcgctgcaaacatgtcgtc

SEQ ID NO: 625275 - DNA, 25 bp, Rattus norvegicus
gctgcggccgcggtcgaccctttcc

SEQ ID NO: 625276 - DNA, 25 bp, Rattus norvegicus
gtgagtgtcccgtgcggcccgcggc

SEQ ID NO: 625277 - DNA, 25 bp, Rattus norvegicus
gcgcgcagcagcaacccgggcggtg

SEQ ID NO: 625278 - DNA, 25 bp, Rattus norvegicus
tgtttagcatcccttcacgtcagcc

SEQ ID NO: 625279 - DNA, 25 bp, Rattus norvegicus
gctgtttagcatcccttcacgtcag

SEQ ID NO: 625280 - DNA, 25 bp, Rattus norvegicus
tgcaaacatgtcgtcttttcctttc

SEQ ID NO: 625281 - DNA, 25 bp, Rattus norvegicus
tgccttgaccgtgggtgccgctgct

SEQ ID NO: 625282 - DNA, 25 bp, Rattus norvegicus
gtttggggtggatccgagccacctc

SEQ ID NO: 625283 - DNA, 25 bp, Rattus norvegicus
tggatccgagccacctcggggcttc

SEQ ID NO: 625284 - DNA, 25 bp, Rattus norvegicus
tccagcctgcggctcggaggtcgca

SEQ ID NO: 625285 - DNA, 25 bp, Rattus norvegicus
cgctccgaggtgtgctaatggcgct

SEQ ID NO: 625286 - DNA, 25 bp, Rattus norvegicus
ccgccgcagcagaccagtgcagcgc

SEQ ID NO: 625287 - DNA, 25 bp, Rattus norvegicus
acctgggcgaggcttcgagcatccc

SEQ ID NO: 625288 - DNA, 25 bp, Rattus norvegicus
ccggccagatcagcgctccggaacc

SEQ ID NO: 625289 - DNA, 25 bp, Rattus norvegicus
ctctgcttggaacgttcgaggcgca

SEQ ID NO: 625290 - DNA, 25 bp, Rattus norvegicus
ctcccacacgggaggatgcgctccc

SEQ ID NO: 625291 - DNA, 25 bp, Rattus norvegicus
cagaggccacggctcccagaaatgc

SEQ ID NO: 625292 - DNA, 25 bp, Rattus norvegicus
agaaatgcgtgcgcccgagccactt

SEQ ID NO: 625293 - DNA, 25 bp, Rattus norvegicus
ctgccagccgcagccaaacttgccc

SEQ ID NO: 625294 - DNA, 25 bp, Rattus norvegicus
accgggcaggcaagatgccgctgct

SEQ ID NO: 625295 - DNA, 25 bp, Rattus norvegicus
tcaatgtgcagatcgatgactctta

SEQ ID NO: 625296 - DNA, 25 bp, Rattus norvegicus
acggaactcgtcaaaccagagcagg

SEQ ID NO: 625297 - DNA, 25 bp, Rattus norvegicus
gtcgcatgtgcgagaagtcctacac

SEQ ID NO: 625298 - DNA, 25 bp, Rattus norvegicus
agaaacgctggcagtgtcgcatgtg

SEQ ID NO: 625299 - DNA, 25 bp, Rattus norvegicus
caggcgaccgccagaaacgctggca

SEQ ID NO: 625300 - DNA, 25 bp, Rattus norvegicus
tcttacctagtggaggcaggcgacc

SEQ ID NO: 625301 - DNA, 25 bp, Rattus norvegicus
tcgatgactcttacctagtggaggc

SEQ ID NO: 625302 - DNA, 25 bp, Rattus norvegicus
cacaagaaggcacagctggaccggc

SEQ ID NO: 625303 - DNA, 25 bp, Rattus norvegicus
tggagcgccacaagaaggcacagct

SEQ ID NO: 625304 - DNA, 25 bp, Rattus norvegicus
ggctctacagtggagcgccacaaga

SEQ ID NO: 625305 - DNA, 25 bp, Rattus norvegicus
aggctgacacggcaggctctacagt

SEQ ID NO: 625306 - DNA, 25 bp, Rattus norvegicus
tcaaaccagagcagggcttcgtgtg

SEQ ID NO: 625307 - DNA, 25 bp, Rattus norvegicus
tggaccggctggacatcaatgtgca

SEQ ID NO: 625308 - DNA, 25 bp, Rattus norvegicus
agttcgaggctgacacggcaggctc

SEQ ID NO: 625309 - DNA, 25 bp, Rattus norvegicus
ccagctggggacattcagtgcagcc

SEQ ID NO: 625310 - DNA, 25 bp, Rattus norvegicus
atcccttgcgccctgtgcgtttagc

SEQ ID NO: 625311 - DNA, 25 bp, Rattus norvegicus
cagcggcggaaacgtcgccttaatc

SEQ ID NO: 625312 - DNA, 25 bp, Rattus norvegicus
cttctataagaatgtcagcggcgga

SEQ ID NO: 625313 - DNA, 25 bp, Rattus norvegicus
tggctgcaagactcacgcttctata

SEQ ID NO: 625314 - DNA, 25 bp, Rattus norvegicus
cgcgggagcttatggctgcaagact

SEQ ID NO: 625315 - DNA, 25 bp, Rattus norvegicus
tcaaagcagcagtaagacccatcgg

SEQ ID NO: 625316 - DNA, 25 bp, Rattus norvegicus
cccgcgctttctgggatcctctata

SEQ ID NO: 625317 - DNA, 25 bp, Rattus norvegicus
agccttgggcctttccagagcccgg

SEQ ID NO: 625318 - DNA, 25 bp, Rattus norvegicus
acgtcgcgagtaacgctccagggtc

SEQ ID NO: 625319 - DNA, 25 bp, Rattus norvegicus
cccgaggctctgcagagcgagctca

SEQ ID NO: 625320 - DNA, 25 bp, Rattus norvegicus
agtgcgacactcacagtggcgccgc

SEQ ID NO: 625321 - DNA, 25 bp, Rattus norvegicus
tgtgcgtttagctgacccaccgacc

SEQ ID NO: 625322 - DNA, 25 bp, Rattus norvegicus
cccattgggtctcacccggagaaag

SEQ ID NO: 625323 - DNA, 25 bp, Rattus norvegicus
aaacttcggggctgcgcagaggcag

SEQ ID NO: 625324 - DNA, 25 bp, Rattus norvegicus
gggtagcatcgtatccaaagctgct

SEQ ID NO: 625325 - DNA, 25 bp, Rattus norvegicus
cagccttgtcgtgggacgtaacttc

SEQ ID NO: 625326 - DNA, 25 bp, Rattus norvegicus
cgaacgaggtgggaaccaacgtctg

SEQ ID NO: 625327 - DNA, 25 bp, Rattus norvegicus
accaacgtctgggagtgattggaca

SEQ ID NO: 625328 - DNA, 25 bp, Rattus norvegicus
agtgattggacaggcccgggccttc

SEQ ID NO: 625329 - DNA, 25 bp, Rattus norvegicus
tgtcgtgggacgtaacttcttccag

SEQ ID NO: 625330 - DNA, 25 bp, Rattus norvegicus
acgtgggtagcatcgtatccaaagc

SEQ ID NO: 625331 - DNA, 25 bp, Rattus norvegicus
caaggagggcgcctgtggacaattc

SEQ ID NO: 625332 - DNA, 25 bp, Rattus norvegicus
gggcgcctgtggacaattcccgaaa

SEQ ID NO: 625333 - DNA, 25 bp, Rattus norvegicus
ctgctgcccagcatttccggggaca

SEQ ID NO: 625334 - DNA, 25 bp, Rattus norvegicus
caccgcacaggacgcagggtgttca

SEQ ID NO: 625335 - DNA, 25 bp, Rattus norvegicus
cagctggagtgagtcggtgaaactt

SEQ ID NO: 625336 - DNA, 25 bp, Rattus norvegicus
gacaattcccgaaacccgagcagcg

SEQ ID NO: 625337 - DNA, 25 bp, Rattus norvegicus
tcttcggtctccaggcttcggatcc

SEQ ID NO: 625338 - DNA, 25 bp, Rattus norvegicus
ggatcctactctgtggcgacccacg

SEQ ID NO: 625339 - DNA, 25 bp, Rattus norvegicus
caggactgggtagagggatcctact

SEQ ID NO: 625340 - DNA, 25 bp, Rattus norvegicus
aggactagctaggaggccggcctac

SEQ ID NO: 625341 - DNA, 25 bp, Rattus norvegicus
cctcgtactctagcgcccaggaagg

SEQ ID NO: 625342 - DNA, 25 bp, Rattus norvegicus
cccaagtcgggtgtcccgatctagc

SEQ ID NO: 625343 - DNA, 25 bp, Rattus norvegicus
tagcgtgctcttcggtctccaggct

SEQ ID NO: 625344 - DNA, 25 bp, Rattus norvegicus
cagcctgagactccacttgagcaac

SEQ ID NO: 625345 - DNA, 25 bp, Rattus norvegicus
cttgagcaacctgagccggaggacg

SEQ ID NO: 625346 - DNA, 25 bp, Rattus norvegicus
tgttgctactgctgcggacgacgac

SEQ ID NO: 625347 - DNA, 25 bp, Rattus norvegicus
gctcggcccacggatcagtgtgccg

SEQ ID NO: 625348 - DNA, 25 bp, Rattus norvegicus
atcagtgtgccgctgggtaagtgct

SEQ ID NO: 625349 - DNA, 25 bp, Rattus norvegicus
tgtggcgacccacgtgaccatcttc

SEQ ID NO: 625350 - DNA, 25 bp, Rattus norvegicus
gtccgagcggtctagcgtgctcttc

SEQ ID NO: 625351 - DNA, 25 bp, Rattus norvegicus
acgtgatgcagactgcgcttgcgtc

SEQ ID NO: 625352 - DNA, 25 bp, Rattus norvegicus
aaagccacggtcgacccgccacctg

SEQ ID NO: 625353 - DNA, 25 bp, Rattus norvegicus
gcagactgcgcttgcgtcgcggacc

SEQ ID NO: 625354 - DNA, 25 bp, Rattus norvegicus
cgcctcgcgcacgtgatgcagactg

SEQ ID NO: 625355 - DNA, 25 bp, Rattus norvegicus
ccaggcaccctcagcgccgctcagc

SEQ ID NO: 625356 - DNA, 25 bp, Rattus norvegicus
ttctcacttccgtcctcggggccgc

SEQ ID NO: 625357 - DNA, 25 bp, Rattus norvegicus
ggccagcagctccttagacaggcga

SEQ ID NO: 625358 - DNA, 25 bp, Rattus norvegicus
gcacgcgagctccgcgagatctagc

SEQ ID NO: 625359 - DNA, 25 bp, Rattus norvegicus
ccgcgcacctggtactcggccagca

SEQ ID NO: 625360 - DNA, 25 bp, Rattus norvegicus
cacaccttgctgagttccgggaccg

SEQ ID NO: 625361 - DNA, 25 bp, Rattus norvegicus
cgggacgccggcaactttctcactt

SEQ ID NO: 625362 - DNA, 25 bp, Rattus norvegicus
ttagacaggcgactgcccgaacctc

SEQ ID NO: 625363 - DNA, 25 bp, Rattus norvegicus
gtgcgcgcacagctcggccaactct

SEQ ID NO: 625364 - DNA, 25 bp, Rattus norvegicus
cccgaacctcccatcgccgcggtgc

SEQ ID NO: 625365 - DNA, 25 bp, Rattus norvegicus
cgtcggcttgcttaagaaggctccg

SEQ ID NO: 625366 - DNA, 25 bp, Rattus norvegicus
cccagaacgctactgcaataggggc

SEQ ID NO: 625367 - DNA, 25 bp, Rattus norvegicus
gacgcaccaggtaaacgcagacagc

SEQ ID NO: 625368 - DNA, 25 bp, Rattus norvegicus
taaacgcagacagccggggaccaag

SEQ ID NO: 625369 - DNA, 25 bp, Rattus norvegicus
tcttggccattcacgggttcccaga

SEQ ID NO: 625370 - DNA, 25 bp, Rattus norvegicus
gccggggaccaagatggcttctgct

SEQ ID NO: 625371 - DNA, 25 bp, Rattus norvegicus
atggcttctgctggcgccaaagtgg

SEQ ID NO: 625372 - DNA, 25 bp, Rattus norvegicus
aataggggccgccttcgtgtccata

SEQ ID NO: 625373 - DNA, 25 bp, Rattus norvegicus
cgacgtccagcaacgcccaggaaga

SEQ ID NO: 625374 - DNA, 25 bp, Rattus norvegicus
ggatctcggagctaggagttaaccc

SEQ ID NO: 625375 - DNA, 25 bp, Rattus norvegicus
gcttgcttaagaaggctccgccgcc

SEQ ID NO: 625376 - DNA, 25 bp, Rattus norvegicus
ccttcgtgtccatagcgacggtggc

SEQ ID NO: 625377 - DNA, 25 bp, Rattus norvegicus
ttcacgggttcccagacacgcggac

SEQ ID NO: 625378 - DNA, 25 bp, Rattus norvegicus
gccgccgccaggatctcggagctag

SEQ ID NO: 625379 - DNA, 25 bp, Rattus norvegicus
ggagattcggcattacaggcaaaga

SEQ ID NO: 625380 - DNA, 25 bp, Rattus norvegicus
tcggatcaggctactggccaacgcc

SEQ ID NO: 625381 - DNA, 25 bp, Rattus norvegicus
tgcagaaaccctcggggtgacccaa

SEQ ID NO: 625382 - DNA, 25 bp, Rattus norvegicus
cccgccacttcggatggaaagaatc

SEQ ID NO: 625383 - DNA, 25 bp, Rattus norvegicus
gcgagaacccgcacgtaggcgaaga

SEQ ID NO: 625384 - DNA, 25 bp, Rattus norvegicus
agctgaaaagcttggggcgcgactt

SEQ ID NO: 625385 - DNA, 25 bp, Rattus norvegicus
cctgccctcgaaagcaaggagattc

SEQ ID NO: 625386 - DNA, 25 bp, Rattus norvegicus
ctgaaggatagtcccgtacattttg

SEQ ID NO: 625387 - DNA, 25 bp, Rattus norvegicus
tcatcgggtttcattctccagggcc

SEQ ID NO: 625388 - DNA, 25 bp, Rattus norvegicus
tcaggcaggacttcagtccgggaga

SEQ ID NO: 625389 - DNA, 25 bp, Rattus norvegicus
cacagtcgcaccttggacagcagga

SEQ ID NO: 625390 - DNA, 25 bp, Rattus norvegicus
ctgcttctggcaaagtgacttggta

SEQ ID NO: 625391 - DNA, 25 bp, Rattus norvegicus
gtacattttgtcgttctggcccacc

SEQ ID NO: 625392 - DNA, 25 bp, Rattus norvegicus
gacctcccgcttctgtcggatcagg

SEQ ID NO: 625393 - DNA, 25 bp, Rattus norvegicus
agtggagaggtacctgcttcttggc

SEQ ID NO: 625394 - DNA, 25 bp, Rattus norvegicus
atcccgattccgactgggagccgga

SEQ ID NO: 625395 - DNA, 25 bp, Rattus norvegicus
aaggctcgtgataccgcctaacttc

SEQ ID NO: 625396 - DNA, 25 bp, Rattus norvegicus
gagccttttcttgggcggtcgtgtc

SEQ ID NO: 625397 - DNA, 25 bp, Rattus norvegicus
aatggcgctgtctctgagccttttc

SEQ ID NO: 625398 - DNA, 25 bp, Rattus norvegicus
agatcacctcctcgcatcgcaatgg

SEQ ID NO: 625399 - DNA, 25 bp, Rattus norvegicus
ggttcgcctacctgcttccggtgct

SEQ ID NO: 625400 - DNA, 25 bp, Rattus norvegicus
tccgggttctatcagccgcgagcca

SEQ ID NO: 625401 - DNA, 25 bp, Rattus norvegicus
gtagctccgggcatccggcagtcag

SEQ ID NO: 625402 - DNA, 25 bp, Rattus norvegicus
tcgctccttgcggtaccgggtagct

SEQ ID NO: 625403 - DNA, 25 bp, Rattus norvegicus
gaagctagacttcgcgccctgtcgc

SEQ ID NO: 625404 - DNA, 25 bp, Rattus norvegicus
gggccctcagcctgaagctagactt

SEQ ID NO: 625405 - DNA, 25 bp, Rattus norvegicus
cccagtaaactaaaggctcgtgata

SEQ ID NO: 625406 - DNA, 25 bp, Rattus norvegicus
ggtcgcgagctgtagatcacctcct

SEQ ID NO: 625407 - DNA, 25 bp, Rattus norvegicus
gccgtcttctcccagtgctctaagt

SEQ ID NO: 625408 - DNA, 25 bp, Rattus norvegicus
ggataccagcctgcggtgtcaccta

SEQ ID NO: 625409 - DNA, 25 bp, Rattus norvegicus
cagtaggtggtcattcatccgtcta

SEQ ID NO: 625410 - DNA, 25 bp, Rattus norvegicus
agtcactcgacgctgtggccgtctg

SEQ ID NO: 625411 - DNA, 25 bp, Rattus norvegicus
taggtcgccaaggagagtcactcga

SEQ ID NO: 625412 - DNA, 25 bp, Rattus norvegicus
accagtgactgtaggtcgccaagga

SEQ ID NO: 625413 - DNA, 25 bp, Rattus norvegicus
tggacccaggtaggaccagtgactg

SEQ ID NO: 625414 - DNA, 25 bp, Rattus norvegicus
tatagggaatcctgctgacaggctg

SEQ ID NO: 625415 - DNA, 25 bp, Rattus norvegicus
acgctgccgagtgtgcggatgttat

SEQ ID NO: 625416 - DNA, 25 bp, Rattus norvegicus
ggaagtcgcttttctctaggtagga

SEQ ID NO: 625417 - DNA, 25 bp, Rattus norvegicus
ttccgggatgtctaggaagtcgctt

SEQ ID NO: 625418 - DNA, 25 bp, Rattus norvegicus
catccgtctagtgcggcagacgagc

SEQ ID NO: 625419 - DNA, 25 bp, Rattus norvegicus
tgctgactaggggaaccggatttcc

SEQ ID NO: 625420 - DNA, 25 bp, Rattus norvegicus
tcccagtgctctaagtgctgactag

SEQ ID NO: 625421 - DNA, 25 bp, Rattus norvegicus
tactccagtccgcaggcttaggcag

SEQ ID NO: 625422 - DNA, 25 bp, Rattus norvegicus
cactattgaggtgcgggtctggtac

SEQ ID NO: 625423 - DNA, 25 bp, Rattus norvegicus
tctcttaggggagggagccactatt

SEQ ID NO: 625424 - DNA, 25 bp, Rattus norvegicus
agcatccgccatgaggagaaggtgc

SEQ ID NO: 625425 - DNA, 25 bp, Rattus norvegicus
ccgactgaaagttgaaggctgccgt

SEQ ID NO: 625426 - DNA, 25 bp, Rattus norvegicus
gctcgagagtggagaccgactgaaa

SEQ ID NO: 625427 - DNA, 25 bp, Rattus norvegicus
gacagcgcgggttgacacgcttcct

SEQ ID NO: 625428 - DNA, 25 bp, Rattus norvegicus
gtggcggacgcagtaaccaattgtc

SEQ ID NO: 625429 - DNA, 25 bp, Rattus norvegicus
gtctggtaccaggttcggcagcctg

SEQ ID NO: 625430 - DNA, 25 bp, Rattus norvegicus
tgcgcgttctctgtactccagtccg

SEQ ID NO: 625431 - DNA, 25 bp, Rattus norvegicus
cctcccttgagggatggtgtacgca

SEQ ID NO: 625432 - DNA, 25 bp, Rattus norvegicus
gggtgacatcattggccactcttta

SEQ ID NO: 625433 - DNA, 25 bp, Rattus norvegicus
ctcggcttcaggcacctgtgtctga

SEQ ID NO: 625434 - DNA, 25 bp, Rattus norvegicus
gcctccggctcggtttgaattccgc

SEQ ID NO: 625435 - DNA, 25 bp, Rattus norvegicus
gcatagtagcgcacagctccgaaca

SEQ ID NO: 625436 - DNA, 25 bp, Rattus norvegicus
ccgaagtctccgatgggcgccgaca

SEQ ID NO: 625437 - DNA, 25 bp, Rattus norvegicus
agccaattcgggctgctccggacag

SEQ ID NO: 625438 - DNA, 25 bp, Rattus norvegicus
ctgccctttgccaagccaattcggg

SEQ ID NO: 625439 - DNA, 25 bp, Rattus norvegicus
gccggattacctgccctttgccaag

SEQ ID NO: 625440 - DNA, 25 bp, Rattus norvegicus
acatgcgccggattacctgcccttt

SEQ ID NO: 625441 - DNA, 25 bp, Rattus norvegicus
tgacgtgcacacatgcgccggatta

SEQ ID NO: 625442 - DNA, 25 bp, Rattus norvegicus
ggggcccgcctgacgtgcacacatg

SEQ ID NO: 625443 - DNA, 25 bp, Rattus norvegicus
gcaggcacgagcgatgacgtcacca

SEQ ID NO: 625444 - DNA, 25 bp, Rattus norvegicus
ctgctccggacagtgtgccgaagtc

SEQ ID NO: 625445 - DNA, 25 bp, Rattus norvegicus
ttctgagccaatcgcaggcacgagc

SEQ ID NO: 625446 - DNA, 25 bp, Rattus norvegicus
atgcggcagcttttctgagccaatc

SEQ ID NO: 625447 - DNA, 25 bp, Rattus norvegicus
caaagcggtcattggatgcggcagc

SEQ ID NO: 625448 - DNA, 25 bp, Rattus norvegicus
acagctccgaacagaccggcggcgg

SEQ ID NO: 625449 - DNA, 25 bp, Rattus norvegicus
ttcccagtgtctgtccctgcgcgtg

SEQ ID NO: 625450 - DNA, 25 bp, Rattus norvegicus
tcaggaacccgaaactgaactctta

SEQ ID NO: 625451 - DNA, 25 bp, Rattus norvegicus
cgcgtgcgcagacttcgcattgcta

SEQ ID NO: 625452 - DNA, 25 bp, Rattus norvegicus
ggccttgagcagctcagctgatcct

SEQ ID NO: 625453 - DNA, 25 bp, Rattus norvegicus
agctgatcctcaggtcgcctctcgg

SEQ ID NO: 625454 - DNA, 25 bp, Rattus norvegicus
ggccgccatggctgaaaagcaagcg

SEQ ID NO: 625455 - DNA, 25 bp, Rattus norvegicus
gcttagctggagagccgaatcccga

SEQ ID NO: 625456 - DNA, 25 bp, Rattus norvegicus
cccgactgtacggtcactgccaaag

SEQ ID NO: 625457 - DNA, 25 bp, Rattus norvegicus
ctgccaaagcaggacctgaggtgtc

SEQ ID NO: 625458 - DNA, 25 bp, Rattus norvegicus
ctgaggtgtcctcgcctgggacctc

SEQ ID NO: 625459 - DNA, 25 bp, Rattus norvegicus
tgggacctcggagtccagggactat

SEQ ID NO: 625460 - DNA, 25 bp, Rattus norvegicus
gtccagggactatgacagtaactgc

SEQ ID NO: 625461 - DNA, 25 bp, Rattus norvegicus
cagtaactgcgtgttctgccgcgtc

SEQ ID NO: 625462 - DNA, 25 bp, Rattus norvegicus
actcttatactgtgaggtgggcggc

SEQ ID NO: 625463 - DNA, 25 bp, Rattus norvegicus
acggagtccaggtacgaaggcgcat

SEQ ID NO: 625464 - DNA, 25 bp, Rattus norvegicus
acagtcactggagctaaggtagccc

SEQ ID NO: 625465 - DNA, 25 bp, Rattus norvegicus
cgtcccggaccacggcagaagtgca

SEQ ID NO: 625466 - DNA, 25 bp, Rattus norvegicus
cgcgggagttttgcctttctctccg

SEQ ID NO: 625467 - DNA, 25 bp, Rattus norvegicus
gcgtcttagtctgttcccactggga

SEQ ID NO: 625468 - DNA, 25 bp, Rattus norvegicus
tgcttcccgagcgtcttagtctgtt

SEQ ID NO: 625469 - DNA, 25 bp, Rattus norvegicus
gcgcacggtcaaggatgcttcccga

SEQ ID NO: 625470 - DNA, 25 bp, Rattus norvegicus
ccagcaatgcgtcagggttacgcca

SEQ ID NO: 625471 - DNA, 25 bp, Rattus norvegicus
tgtcgcaggagaatcagtacgcacc

SEQ ID NO: 625472 - DNA, 25 bp, Rattus norvegicus
tccgggcagagtcccatatagggct

SEQ ID NO: 625473 - DNA, 25 bp, Rattus norvegicus
ctgagctggcctatggagagaaaga

SEQ ID NO: 625474 - DNA, 25 bp, Rattus norvegicus
tttgaacagctcgttgccctccttc

SEQ ID NO: 625475 - DNA, 25 bp, Rattus norvegicus
ttcggtgcaaaatagcctggtcctg

SEQ ID NO: 625476 - DNA, 25 bp, Rattus norvegicus
tcacagtcatcacgaagctgagctc

SEQ ID NO: 625477 - DNA, 25 bp, Rattus norvegicus
tgacttcgccgctcaaaaacaccga

SEQ ID NO: 625478 - DNA, 25 bp, Rattus norvegicus
tataggtgatccgttcgaactccga

SEQ ID NO: 625479 - DNA, 25 bp, Rattus norvegicus
gatccgttcgaactccgaagcttca

SEQ ID NO: 625480 - DNA, 25 bp, Rattus norvegicus
cagctcagctgctggaggctgctga

SEQ ID NO: 625481 - DNA, 25 bp, Rattus norvegicus
atcaatcaccccatcggtgggcgtg

SEQ ID NO: 625482 - DNA, 25 bp, Rattus norvegicus
ggctgctgacttcgccgctcaaaaa

SEQ ID NO: 625483 - DNA, 25 bp, Rattus norvegicus
cggcgctataggtgatccgttcgaa

SEQ ID NO: 625484 - DNA, 25 bp, Rattus norvegicus
ctcaaaaacaccgacagcagcgacg

SEQ ID NO: 625485 - DNA, 25 bp, Rattus norvegicus
cgacagcagcgacggaaagatcctg

SEQ ID NO: 625486 - DNA, 25 bp, Rattus norvegicus
ctccgaggcgccaggcggcgctata

SEQ ID NO: 625487 - DNA, 25 bp, Rattus norvegicus
cgacggaaagatcctgaagggactc

SEQ ID NO: 625488 - DNA, 25 bp, Rattus norvegicus
ggaaagatcctgaagggactcccta

SEQ ID NO: 625489 - DNA, 25 bp, Rattus norvegicus
gaagggactccctacatcaatcacc

SEQ ID NO: 625490 - DNA, 25 bp, Rattus norvegicus
tcagctgctggaggctgctgacttc

SEQ ID NO: 625491 - DNA, 25 bp, Rattus norvegicus
tctgcgcagccgttgacccgtcaga

SEQ ID NO: 625492 - DNA, 25 bp, Rattus norvegicus
tccactatggctgcggtgcggctct

SEQ ID NO: 625493 - DNA, 25 bp, Rattus norvegicus
gaggacgctagctcctgaacgcgcg

SEQ ID NO: 625494 - DNA, 25 bp, Rattus norvegicus
ggcagatgcgcaggctaagacagac

SEQ ID NO: 625495 - DNA, 25 bp, Rattus norvegicus
acggcctacaggctggagtcctcgc

SEQ ID NO: 625496 - DNA, 25 bp, Rattus norvegicus
ggcaatatttttagtccctggagat

SEQ ID NO: 625497 - DNA, 25 bp, Rattus norvegicus
cgctcaggagcctccgggcaatatt

SEQ ID NO: 625498 - DNA, 25 bp, Rattus norvegicus
taacgcgatctgattccgctcagga

SEQ ID NO: 625499 - DNA, 25 bp, Rattus norvegicus
agcctgcgtcctacttaacgcgatc

SEQ ID NO: 625500 - DNA, 25 bp, Rattus norvegicus
aaaagctctgtcacctcagcctgcg

SEQ ID NO: 625501 - DNA, 25 bp, Rattus norvegicus
ggccctggtgctgaaaagctctgtc

SEQ ID NO: 625502 - DNA, 25 bp, Rattus norvegicus
tggagtctgctcttccggccctggt

SEQ ID NO: 625503 - DNA, 25 bp, Rattus norvegicus
gggcaactcgagacgacccacagtg

SEQ ID NO: 625504 - DNA, 25 bp, Rattus norvegicus
ttgacccgtcagagcgcgcgcagca

SEQ ID NO: 625505 - DNA, 25 bp, Rattus norvegicus
cagcccagagcgagcctcctcaagc

SEQ ID NO: 625506 - DNA, 25 bp, Rattus norvegicus
ccaggcctcggcaggaggcagccca

SEQ ID NO: 625507 - DNA, 25 bp, Rattus norvegicus
gagcctcctcaagccggcctgtgcg

SEQ ID NO: 625508 - DNA, 25 bp, Rattus norvegicus
acaggtgtgcaagccggccgaggac

SEQ ID NO: 625509 - DNA, 25 bp, Rattus norvegicus
cccgtgccctaccaggagcgcgccc

SEQ ID NO: 625510 - DNA, 25 bp, Rattus norvegicus
ggcaggcgggagcacccagagcccg

SEQ ID NO: 625511 - DNA, 25 bp, Rattus norvegicus
cagagcccgaggaatgctctgccta

SEQ ID NO: 625512 - DNA, 25 bp, Rattus norvegicus
agcccgaggaatgctctgcctagcc

SEQ ID NO: 625513 - DNA, 25 bp, Rattus norvegicus
ccgccggcgcttcctgaggtcagag

SEQ ID NO: 625514 - DNA, 25 bp, Rattus norvegicus
cggcctcagcggaaaagtaccggcg

SEQ ID NO: 625515 - DNA, 25 bp, Rattus norvegicus
cctcagcggaaaagtaccggcgcgg

SEQ ID NO: 625516 - DNA, 25 bp, Rattus norvegicus
ccaagcccggcgctcaggtgggctg

SEQ ID NO: 625517 - DNA, 25 bp, Rattus norvegicus
tgcgcggctccggtccttccaccgc

SEQ ID NO: 625518 - DNA, 25 bp, Rattus norvegicus
ttccaccgcggcggcagagaatccg

SEQ ID NO: 625519 - DNA, 25 bp, Rattus norvegicus
tgaaaaagactactccacgccaaca

SEQ ID NO: 625520 - DNA, 25 bp, Rattus norvegicus
ttacgtatcactcggcttatcactc

SEQ ID NO: 625521 - DNA, 25 bp, Rattus norvegicus
gtttgggcctcactcggcttccacg

SEQ ID NO: 625522 - DNA, 25 bp, Rattus norvegicus
ggcttccacgcatcatttacacgtt

SEQ ID NO: 625523 - DNA, 25 bp, Rattus norvegicus
ttacacgttaagtccgcctctgctc

SEQ ID NO: 625524 - DNA, 25 bp, Rattus norvegicus
ccagcagcggtgaaaaagactactc

SEQ ID NO: 625525 - DNA, 25 bp, Rattus norvegicus
cgccaacaccattacggagtccaaa

SEQ ID NO: 625526 - DNA, 25 bp, Rattus norvegicus
cattacggagtccaaactcgggccg

SEQ ID NO: 625527 - DNA, 25 bp, Rattus norvegicus
cgggagatcccgtgacggcagtaaa

SEQ ID NO: 625528 - DNA, 25 bp, Rattus norvegicus
cggcagtaaatcatacgtggtctaa

SEQ ID NO: 625529 - DNA, 25 bp, Rattus norvegicus
cgtggtctaaggaacgtaatcaccg

SEQ ID NO: 625530 - DNA, 25 bp, Rattus norvegicus
aggaacgtaatcaccgcggcttacg

SEQ ID NO: 625531 - DNA, 25 bp, Rattus norvegicus
cgcggcttacgtatcactcggctta

SEQ ID NO: 625532 - DNA, 25 bp, Rattus norvegicus
ctctctcctagtttgccagcagcgg

SEQ ID NO: 625533 - DNA, 25 bp, Rattus norvegicus
ctgagacagctacaggacatcctta

SEQ ID NO: 625534 - DNA, 25 bp, Rattus norvegicus
cgattcgcgcaacggcaactgctga

SEQ ID NO: 625535 - DNA, 25 bp, Rattus norvegicus
ctatccaccgggtcggcgattcgcg

SEQ ID NO: 625536 - DNA, 25 bp, Rattus norvegicus
gccaaccaatcagtgcgcagtaaag

SEQ ID NO: 625537 - DNA, 25 bp, Rattus norvegicus
cgcagtaaagctaggttggtggtca

SEQ ID NO: 625538 - DNA, 25 bp, Rattus norvegicus
ccctgctgaagaatgagttaaggcg

SEQ ID NO: 625539 - DNA, 25 bp, Rattus norvegicus
gactggaagctgcagcccttggttt

SEQ ID NO: 625540 - DNA, 25 bp, Rattus norvegicus
gacatccttaaggtaactcaccggc

SEQ ID NO: 625541 - DNA, 25 bp, Rattus norvegicus
tgcacgccgtgctgagacagctaca

SEQ ID NO: 625542 - DNA, 25 bp, Rattus norvegicus
agtttcgctggttgctgcacgctga

SEQ ID NO: 625543 - DNA, 25 bp, Rattus norvegicus
gacccgataggtttgacgccgcgct

SEQ ID NO: 625544 - DNA, 25 bp, Rattus norvegicus
tcctgactcagagacagcgctcggc

SEQ ID NO: 625545 - DNA, 25 bp, Rattus norvegicus
ctgcgcgctgagctcctgactcaga

SEQ ID NO: 625546 - DNA, 25 bp, Rattus norvegicus
tgccggtttggaatcggtcacagga

SEQ ID NO: 625547 - DNA, 25 bp, Rattus norvegicus
tctcactgaacttccgcgggttggc

SEQ ID NO: 625548 - DNA, 25 bp, Rattus norvegicus
gggacgatgtgcgaccctcaagccc

SEQ ID NO: 625549 - DNA, 25 bp, Rattus norvegicus
gtgggaaagccaccgaattacatcg

SEQ ID NO: 625550 - DNA, 25 bp, Rattus norvegicus
attacatcgtggtaccaaggcccgc

SEQ ID NO: 625551 - DNA, 25 bp, Rattus norvegicus
ggccagccgtcgattcacttgtgag

SEQ ID NO: 625552 - DNA, 25 bp, Rattus norvegicus
tcacttgtgagtgcaccgagccttc

SEQ ID NO: 625553 - DNA, 25 bp, Rattus norvegicus
ggaccacgtaaagcacctccaagag

SEQ ID NO: 625554 - DNA, 25 bp, Rattus norvegicus
cgaggccttccacgcagagagccaa

SEQ ID NO: 625555 - DNA, 25 bp, Rattus norvegicus
tgggtgtccactgagaagccgcacc

SEQ ID NO: 625556 - DNA, 25 bp, Rattus norvegicus
gcgatttcctctcggggtcatcctc

SEQ ID NO: 625557 - DNA, 25 bp, Rattus norvegicus
gtccaccgagatcgcaagccgcatt

SEQ ID NO: 625558 - DNA, 25 bp, Rattus norvegicus
caagccgcatttggtgtcgccaggc

SEQ ID NO: 625559 - DNA, 25 bp, Rattus norvegicus
tcggtcatgagctgctcgaaggccc

SEQ ID NO: 625560 - DNA, 25 bp, Rattus norvegicus
tcgccaggccggcaagaactgaggc

SEQ ID NO: 625561 - DNA, 25 bp, Rattus norvegicus
gctagcttagctctccacttgcgga

SEQ ID NO: 625562 - DNA, 25 bp, Rattus norvegicus
cgcctgcctttccttgacagctgag

SEQ ID NO: 625563 - DNA, 25 bp, Rattus norvegicus
gccgccaatgtctacagctttgaaa

SEQ ID NO: 625564 - DNA, 25 bp, Rattus norvegicus
ggctcagactgaaaagccgccaatg

SEQ ID NO: 625565 - DNA, 25 bp, Rattus norvegicus
ttcaccctatctacggctcagactg

SEQ ID NO: 625566 - DNA, 25 bp, Rattus norvegicus
tctccacttgcggaagcgaagaggc

SEQ ID NO: 625567 - DNA, 25 bp, Rattus norvegicus
tcacagccatagtgcggccggacca

SEQ ID NO: 625568 - DNA, 25 bp, Rattus norvegicus
tagcagcagcaactcctgcccagtg

SEQ ID NO: 625569 - DNA, 25 bp, Rattus norvegicus
cagagaccttgaagacgcgggcgac

SEQ ID NO: 625570 - DNA, 25 bp, Rattus norvegicus
ctccggtgaggaagagcagagacct

SEQ ID NO: 625571 - DNA, 25 bp, Rattus norvegicus
gacagctgagttaacccgctctgta

SEQ ID NO: 625572 - DNA, 25 bp, Rattus norvegicus
tcgagagggctcagacgccaacctt

SEQ ID NO: 625573 - DNA, 25 bp, Rattus norvegicus
gcttggtcggttgtcccgacacttc

SEQ ID NO: 625574 - DNA, 25 bp, Rattus norvegicus
aaggctgaggcctccaggtttctac

SEQ ID NO: 625575 - DNA, 25 bp, Rattus norvegicus
gctccgtgtacgcaacctaggagcg

SEQ ID NO: 625576 - DNA, 25 bp, Rattus norvegicus
tagcgggaacaggacctggtccctg

SEQ ID NO: 625577 - DNA, 25 bp, Rattus norvegicus
agccagagagaggagcgagtaacgg

SEQ ID NO: 625578 - DNA, 25 bp, Rattus norvegicus
gagtaacgggcctggagccagctga

SEQ ID NO: 625579 - DNA, 25 bp, Rattus norvegicus
tcgcccggcaggctggacgctcagt

SEQ ID NO: 625580 - DNA, 25 bp, Rattus norvegicus
caggctggacgctcagttctgcgtc

SEQ ID NO: 625581 - DNA, 25 bp, Rattus norvegicus
gacgctcagttctgcgtcccggttc

SEQ ID NO: 625582 - DNA, 25 bp, Rattus norvegicus
tcagttctgcgtcccggttcctcgt

SEQ ID NO: 625583 - DNA, 25 bp, Rattus norvegicus
ctcgtggcccacagggttcggttca

SEQ ID NO: 625584 - DNA, 25 bp, Rattus norvegicus
ccacagggttcggttcacgccagag

SEQ ID NO: 625585 - DNA, 25 bp, Rattus norvegicus
agatagcgggaacaggacctggtcc

SEQ ID NO: 625586 - DNA, 25 bp, Rattus norvegicus
gccagagctccgtgtacgcaaccta

SEQ ID NO: 625587 - DNA, 25 bp, Rattus norvegicus
tgcttttgcgcgcagagagatagcg

SEQ ID NO: 625588 - DNA, 25 bp, Rattus norvegicus
tcggttcacgccagagctccgtgta

SEQ ID NO: 625589 - DNA, 25 bp, Rattus norvegicus
agcaactgtggcttccgtcgcttca

SEQ ID NO: 625590 - DNA, 25 bp, Rattus norvegicus
ccacgacccgatttacaagcgcaaa

SEQ ID NO: 625591 - DNA, 25 bp, Rattus norvegicus
tcttccgccttgctggttcgtgagc

SEQ ID NO: 625592 - DNA, 25 bp, Rattus norvegicus
agagggcgtggtcttccgccttgct

SEQ ID NO: 625593 - DNA, 25 bp, Rattus norvegicus
acttcctggataggcgcgcgttctc

SEQ ID NO: 625594 - DNA, 25 bp, Rattus norvegicus
cagacttcctggataggcgcgcgtt

SEQ ID NO: 625595 - DNA, 25 bp, Rattus norvegicus
ccttgctggttcgtgagcgctcaga

SEQ ID NO: 625596 - DNA, 25 bp, Rattus norvegicus
tgtggcttccgtcgcttcacttccg

SEQ ID NO: 625597 - DNA, 25 bp, Rattus norvegicus
ttacaagcgcaaagactccacgagc

SEQ ID NO: 625598 - DNA, 25 bp, Rattus norvegicus
tctgcgagctccatagcaactgtgg

SEQ ID NO: 625599 - DNA, 25 bp, Rattus norvegicus
gagccagtcctctgcgagctccata

SEQ ID NO: 625600 - DNA, 25 bp, Rattus norvegicus
aaagactccacgagccagtcctctg

SEQ ID NO: 625601 - DNA, 25 bp, Rattus norvegicus
cattgcccatcagacccgcccacga

SEQ ID NO: 625602 - DNA, 25 bp, Rattus norvegicus
ttccgccagccagacttcctggata

SEQ ID NO: 625603 - DNA, 25 bp, Rattus norvegicus
tctccgggtcttcacagtagccagt

SEQ ID NO: 625604 - DNA, 25 bp, Rattus norvegicus
cgatgctcaaggacgttgcagctgc

SEQ ID NO: 625605 - DNA, 25 bp, Rattus norvegicus
ctgcatcctcctttggtgccgaaga

SEQ ID NO: 625606 - DNA, 25 bp, Rattus norvegicus
cgcgggcgggagtctcagactctca

SEQ ID NO: 625607 - DNA, 25 bp, Rattus norvegicus
ccgaagatcgatgctcaaggacgtt

SEQ ID NO: 625608 - DNA, 25 bp, Rattus norvegicus
ctctcagggtcgcacccgggtgcgt

SEQ ID NO: 625609 - DNA, 25 bp, Rattus norvegicus
tgccacagggaccaagcacctgagt

SEQ ID NO: 625610 - DNA, 25 bp, Rattus norvegicus
ggaccaagcacctgagtccgactca

SEQ ID NO: 625611 - DNA, 25 bp, Rattus norvegicus
tgagtccgactcagcagggacttca

SEQ ID NO: 625612 - DNA, 25 bp, Rattus norvegicus
ttcagcccggagcacatctccgggt

SEQ ID NO: 625613 - DNA, 25 bp, Rattus norvegicus
gcacatctccgggtcttcacagtag

SEQ ID NO: 625614 - DNA, 25 bp, Rattus norvegicus
cttcacagtagccagtccgcgggcg

SEQ ID NO: 625615 - DNA, 25 bp, Rattus norvegicus
agtctcagactctcagggtcgcacc

SEQ ID NO: 625616 - DNA, 25 bp, Rattus norvegicus
cctttggtgccgaagatcgatgctc

SEQ ID NO: 625617 - DNA, 25 bp, Rattus norvegicus
gcgcaggcgtaccatagtagccgca

SEQ ID NO: 625618 - DNA, 25 bp, Rattus norvegicus
cccgactcgggacggagacatccat

SEQ ID NO: 625619 - DNA, 25 bp, Rattus norvegicus
cgcagtaaagcaggtgaaccggacc

SEQ ID NO: 625620 - DNA, 25 bp, Rattus norvegicus
cacgtgcgcctgacgccgcagtaaa

SEQ ID NO: 625621 - DNA, 25 bp, Rattus norvegicus
tttctccgggacagtgccctgccat

SEQ ID NO: 625622 - DNA, 25 bp, Rattus norvegicus
ccgggcagcctttctccgggacagt

SEQ ID NO: 625623 - DNA, 25 bp, Rattus norvegicus
tgaggccgctgtccgctctgagtcc

SEQ ID NO: 625624 - DNA, 25 bp, Rattus norvegicus
caggagcacctggagttccgcctgc

SEQ ID NO: 625625 - DNA, 25 bp, Rattus norvegicus
tcatggcacaggagcacctggagtt

SEQ ID NO: 625626 - DNA, 25 bp, Rattus norvegicus
atcgctatctgctgctcatggcaca

SEQ ID NO: 625627 - DNA, 25 bp, Rattus norvegicus
acggagacatccatggggtcgctcg

SEQ ID NO: 625628 - DNA, 25 bp, Rattus norvegicus
atagtagccgcaatggcgctgccgg

SEQ ID NO: 625629 - DNA, 25 bp, Rattus norvegicus
gaggctcggcggaaacttagctcca

SEQ ID NO: 625630 - DNA, 25 bp, Rattus norvegicus
tgccgggctccttgaatcgctatct

SEQ ID NO: 625631 - DNA, 25 bp, Rattus norvegicus
tttgctgaccggatcgcggctgcca

SEQ ID NO: 625632 - DNA, 25 bp, Rattus norvegicus
ctagccgcccgcgtttgcggactgt

SEQ ID NO: 625633 - DNA, 25 bp, Rattus norvegicus
cggtgcctcgaaggtgagcagtacc

SEQ ID NO: 625634 - DNA, 25 bp, Rattus norvegicus
tcgtggagcctcagcctcgcgacag

SEQ ID NO: 625635 - DNA, 25 bp, Rattus norvegicus
gagcatccacatttccgacaaccga

SEQ ID NO: 625636 - DNA, 25 bp, Rattus norvegicus
tcccgcctcaggaagggcatgttcg

SEQ ID NO: 625637 - DNA, 25 bp, Rattus norvegicus
gtggcgagagcgcaaatctcctccc

SEQ ID NO: 625638 - DNA, 25 bp, Rattus norvegicus
agcgcccgtttcctcgagagtcaga

SEQ ID NO: 625639 - DNA, 25 bp, Rattus norvegicus
ccgggctgaaaagcgggcaccgcca

SEQ ID NO: 625640 - DNA, 25 bp, Rattus norvegicus
gtagcccgactaggggtgctcaacc

SEQ ID NO: 625641 - DNA, 25 bp, Rattus norvegicus
agccgcttcggcgtttctcgacggc

SEQ ID NO: 625642 - DNA, 25 bp, Rattus norvegicus
gagcgggagcctcggacgctcaact

SEQ ID NO: 625643 - DNA, 25 bp, Rattus norvegicus
gcgagttgcccgcaaaacgcggtcc

SEQ ID NO: 625644 - DNA, 25 bp, Rattus norvegicus
ctgaggtctagacagcgatggtcga

SEQ ID NO: 625645 - DNA, 25 bp, Rattus norvegicus
caggcgcgtgtagtacttctcgatg

SEQ ID NO: 625646 - DNA, 25 bp, Rattus norvegicus
ggacctcgagcaaagggaacggcca

SEQ ID NO: 625647 - DNA, 25 bp, Rattus norvegicus
tcacccggctatcttgttccgaagg

SEQ ID NO: 625648 - DNA, 25 bp, Rattus norvegicus
tgatggcgatctcctcgcacacgcg

SEQ ID NO: 625649 - DNA, 25 bp, Rattus norvegicus
cggctgcgcgaagctcgcgagaata

SEQ ID NO: 625650 - DNA, 25 bp, Rattus norvegicus
gtgaaagtcattacccaggcgcgtg

SEQ ID NO: 625651 - DNA, 25 bp, Rattus norvegicus
tacttctcgatgatgacccgggccg

SEQ ID NO: 625652 - DNA, 25 bp, Rattus norvegicus
ggccgccttcttcacagtcttggtg

SEQ ID NO: 625653 - DNA, 25 bp, Rattus norvegicus
ggagcccgcaccttccatggaggaa

SEQ ID NO: 625654 - DNA, 25 bp, Rattus norvegicus
gcggattgaaaaggacagagcactc

SEQ ID NO: 625655 - DNA, 25 bp, Rattus norvegicus
tcagaggcaaacacctaccatgttg

SEQ ID NO: 625656 - DNA, 25 bp, Rattus norvegicus
cctaccatgttgacgggtctcggta

SEQ ID NO: 625657 - DNA, 25 bp, Rattus norvegicus
cctattaaagcgcaggccagaaagc

SEQ ID NO: 625658 - DNA, 25 bp, Rattus norvegicus
cacgcgcttgttggtgtgaaagtca

SEQ ID NO: 625659 - DNA, 25 bp, Rattus norvegicus
cgaacgtgtgaagccacgtgacttc

SEQ ID NO: 625660 - DNA, 25 bp, Rattus norvegicus
gcacctggccttgccggctgagaaa

SEQ ID NO: 625661 - DNA, 25 bp, Rattus norvegicus
tcagctttaaaggagccatgtcggc

SEQ ID NO: 625662 - DNA, 25 bp, Rattus norvegicus
tttaagcccaaaggcctgagtcacg

SEQ ID NO: 625663 - DNA, 25 bp, Rattus norvegicus
caccgagagtctgcaagcgcagctc

SEQ ID NO: 625664 - DNA, 25 bp, Rattus norvegicus
cgtatgttcgaagccaccgagagtc

SEQ ID NO: 625665 - DNA, 25 bp, Rattus norvegicus
agctccggtctggacgtatgttcga

SEQ ID NO: 625666 - DNA, 25 bp, Rattus norvegicus
ggacgccaaggcgactctcgagaga

SEQ ID NO: 625667 - DNA, 25 bp, Rattus norvegicus
gaggggcccgaatactcagctttaa

SEQ ID NO: 625668 - DNA, 25 bp, Rattus norvegicus
ggctccagaagcaatcgaacgtgtg

SEQ ID NO: 625669 - DNA, 25 bp, Rattus norvegicus
cctcgaggccacatgagtgcgtctc

SEQ ID NO: 625670 - DNA, 25 bp, Rattus norvegicus
ggaggccacgcgaacccatctgcaa

SEQ ID NO: 625671 - DNA, 25 bp, Rattus norvegicus
aacctgaggtcagagctggaggcca

SEQ ID NO: 625672 - DNA, 25 bp, Rattus norvegicus
caccctcagggctagggctccagaa

SEQ ID NO: 625673 - DNA, 25 bp, Rattus norvegicus
cggggctagttctgaagctcgaacc

SEQ ID NO: 625674 - DNA, 25 bp, Rattus norvegicus
cacacgtgggcactatttttgcagc

SEQ ID NO: 625675 - DNA, 25 bp, Rattus norvegicus
accgttagctgaggcggcagggaca

SEQ ID NO: 625676 - DNA, 25 bp, Rattus norvegicus
ccggcggctcttaccagagaaaaag

SEQ ID NO: 625677 - DNA, 25 bp, Rattus norvegicus
ctcttaccagagaaaaagccatggg

SEQ ID NO: 625678 - DNA, 25 bp, Rattus norvegicus
cagagaaaaagccatggggtccggc

SEQ ID NO: 625679 - DNA, 25 bp, Rattus norvegicus
gacgcgcacacacgtgggcactatt

SEQ ID NO: 625680 - DNA, 25 bp, Rattus norvegicus
cactatttttgcagcgagcggcgcg

SEQ ID NO: 625681 - DNA, 25 bp, Rattus norvegicus
gcacaccggcggcttataaagctcc

SEQ ID NO: 625682 - DNA, 25 bp, Rattus norvegicus
ggcggcttataaagctccgcggcgc

SEQ ID NO: 625683 - DNA, 25 bp, Rattus norvegicus
ctggcctgatgaggagcacctgtgt

SEQ ID NO: 625684 - DNA, 25 bp, Rattus norvegicus
tccgaaccggggctagttctgaagc

SEQ ID NO: 625685 - DNA, 25 bp, Rattus norvegicus
aagctcgaaccgatgcaggccaccg

SEQ ID NO: 625686 - DNA, 25 bp, Rattus norvegicus
gcgctccttcctgccgtccataccg

SEQ ID NO: 625687 - DNA, 25 bp, Rattus norvegicus
gcgggcgaagcacaactgccatcca

SEQ ID NO: 625688 - DNA, 25 bp, Rattus norvegicus
accaccgggatcaggtcgaagagca

SEQ ID NO: 625689 - DNA, 25 bp, Rattus norvegicus
ctgcccggcactaggtagaaagagg

SEQ ID NO: 625690 - DNA, 25 bp, Rattus norvegicus
actgccatccagaggtgccctgctg

SEQ ID NO: 625691 - DNA, 25 bp, Rattus norvegicus
tggcgagctgcatgaactagccgcg

SEQ ID NO: 625692 - DNA, 25 bp, Rattus norvegicus
ggacgattcagagaccagtggaccc

SEQ ID NO: 625693 - DNA, 25 bp, Rattus norvegicus
cccaaggcaacaagcgccggcattt

SEQ ID NO: 625694 - DNA, 25 bp, Rattus norvegicus
aaaataatgaggcagcgtcccggcc

SEQ ID NO: 625695 - DNA, 25 bp, Rattus norvegicus
gctttcggccgctcaaaaaataatg

SEQ ID NO: 625696 - DNA, 25 bp, Rattus norvegicus
gtctcccatacggagctttcggccg

SEQ ID NO: 625697 - DNA, 25 bp, Rattus norvegicus
cagagcagcagagccgtctcccata

SEQ ID NO: 625698 - DNA, 25 bp, Rattus norvegicus
ttgcgggcaaccttggcttcctcca

SEQ ID NO: 625699 - DNA, 25 bp, Rattus norvegicus
agcactcggctcagctcatccagta

SEQ ID NO: 625700 - DNA, 25 bp, Rattus norvegicus
tcgcaagcccagtagagcaaggtcc

SEQ ID NO: 625701 - DNA, 25 bp, Rattus norvegicus
tctccttttctagtgacctctccgg

SEQ ID NO: 625702 - DNA, 25 bp, Rattus norvegicus
ctagtgacctctccggtggaagccc

SEQ ID NO: 625703 - DNA, 25 bp, Rattus norvegicus
tcagaaaggcgtcatgggccagcca

SEQ ID NO: 625704 - DNA, 25 bp, Rattus norvegicus
gagctgagctgttgttcagaaaggc

SEQ ID NO: 625705 - DNA, 25 bp, Rattus norvegicus
aaaattcggggcaagagatcagggt

SEQ ID NO: 625706 - DNA, 25 bp, Rattus norvegicus
aggacgctttactgagaaaattcgg

SEQ ID NO: 625707 - DNA, 25 bp, Rattus norvegicus
cctccagataggataggacgcttta

SEQ ID NO: 625708 - DNA, 25 bp, Rattus norvegicus
tccgacgctccctccagataggata

SEQ ID NO: 625709 - DNA, 25 bp, Rattus norvegicus
tgatcctcttcggattgcagttccc

SEQ ID NO: 625710 - DNA, 25 bp, Rattus norvegicus
cagcagtgatcctcttcggattgca

SEQ ID NO: 625711 - DNA, 25 bp, Rattus norvegicus
agttccgatgacagcagtgatcctc

SEQ ID NO: 625712 - DNA, 25 bp, Rattus norvegicus
caagggattcgggaaagttccgatg

SEQ ID NO: 625713 - DNA, 25 bp, Rattus norvegicus
actgcatctggagcgagctggaact

SEQ ID NO: 625714 - DNA, 25 bp, Rattus norvegicus
ttcagaccgactgcaactgcatctg

SEQ ID NO: 625715 - DNA, 25 bp, Rattus norvegicus
gcagagcttccggtagtttttgtga

SEQ ID NO: 625716 - DNA, 25 bp, Rattus norvegicus
cctccacgtcgatgagcaggttgca

SEQ ID NO: 625717 - DNA, 25 bp, Rattus norvegicus
tgagcatgctgatgatcaccacctg

SEQ ID NO: 625718 - DNA, 25 bp, Rattus norvegicus
cgttcgtgcataacgcgtgagcatg

SEQ ID NO: 625719 - DNA, 25 bp, Rattus norvegicus
ggctcaggaactgcgttcgtgcata

SEQ ID NO: 625720 - DNA, 25 bp, Rattus norvegicus
cttacgttctgcgtagggctcagga

SEQ ID NO: 625721 - DNA, 25 bp, Rattus norvegicus
tacggccgagtgtgtgaacatcttc

SEQ ID NO: 625722 - DNA, 25 bp, Rattus norvegicus
ctcctgaaagagatacggccgagtg

SEQ ID NO: 625723 - DNA, 25 bp, Rattus norvegicus
agaaggccttctcaggattctcctc

SEQ ID NO: 625724 - DNA, 25 bp, Rattus norvegicus
gcttcctctgatccagggcctttgg

SEQ ID NO: 625725 - DNA, 25 bp, Rattus norvegicus
tacatagggcttccgagcaggcagc

SEQ ID NO: 625726 - DNA, 25 bp, Rattus norvegicus
gccggtgatctggatccattacata

SEQ ID NO: 625727 - DNA, 25 bp, Rattus norvegicus
tggaagtaaagctgtgccaccgcca

SEQ ID NO: 625728 - DNA, 25 bp, Rattus norvegicus
tttgtgaatcaggtcgatgcgttcc

SEQ ID NO: 625729 - DNA, 25 bp, Rattus norvegicus
cagaagacggaggaacagcgcctgc

SEQ ID NO: 625730 - DNA, 25 bp, Rattus norvegicus
cctttatagctaagggcgaagtggc

SEQ ID NO: 625731 - DNA, 25 bp, Rattus norvegicus
tgtccatggtgccaatgcgccaacc

SEQ ID NO: 625732 - DNA, 25 bp, Rattus norvegicus
agcgctcgctagctcaccgcttgta

SEQ ID NO: 625733 - DNA, 25 bp, Rattus norvegicus
caccgcttgtagtccgaggagaaga

SEQ ID NO: 625734 - DNA, 25 bp, Rattus norvegicus
gtccgaggagaagataccgccgctc

SEQ ID NO: 625735 - DNA, 25 bp, Rattus norvegicus
ctcgccggatcgtggccatattccg

SEQ ID NO: 625736 - DNA, 25 bp, Rattus norvegicus
ctgagccgcccttatcttcgctata

SEQ ID NO: 625737 - DNA, 25 bp, Rattus norvegicus
atcttcgctataggcgggagcggcc

SEQ ID NO: 625738 - DNA, 25 bp, Rattus norvegicus
agcggccgacatggatctgcgctga

SEQ ID NO: 625739 - DNA, 25 bp, Rattus norvegicus
cgcctagctctgctgagctgcaatc

SEQ ID NO: 625740 - DNA, 25 bp, Rattus norvegicus
aggcagcgcgcagattcagcaatct

SEQ ID NO: 625741 - DNA, 25 bp, Rattus norvegicus
tctcaggcgctgtccatggtgccaa

SEQ ID NO: 625742 - DNA, 25 bp, Rattus norvegicus
tgggccgagcgctaaggttcttaaa

SEQ ID NO: 625743 - DNA, 25 bp, Rattus norvegicus
tgcgcatagagaaccgacaagtcct

SEQ ID NO: 625744 - DNA, 25 bp, Rattus norvegicus
ggtccggagtctccaagcacccaat

SEQ ID NO: 625745 - DNA, 25 bp, Rattus norvegicus
cgaactcgctctgagcatgcgcata

SEQ ID NO: 625746 - DNA, 25 bp, Rattus norvegicus
gacaagtcctcatgcgctgcgcagt

SEQ ID NO: 625747 - DNA, 25 bp, Rattus norvegicus
ctgcgcagtgccagaggttgaactt

SEQ ID NO: 625748 - DNA, 25 bp, Rattus norvegicus
gccagaggttgaacttcctaccgga

SEQ ID NO: 625749 - DNA, 25 bp, Rattus norvegicus
tccaccggaaggaggctgaaattgc

SEQ ID NO: 625750 - DNA, 25 bp, Rattus norvegicus
ttgcggccgaaatcctgacacctga

SEQ ID NO: 625751 - DNA, 25 bp, Rattus norvegicus
aatcctgacacctgatgctggcggc

SEQ ID NO: 625752 - DNA, 25 bp, Rattus norvegicus
tgatgctggcggcttttgtttcgcg

SEQ ID NO: 625753 - DNA, 25 bp, Rattus norvegicus
tttcgcgaagttgggccagtatgtg

SEQ ID NO: 625754 - DNA, 25 bp, Rattus norvegicus
ccagtatgtggccacctttggcggc

SEQ ID NO: 625755 - DNA, 25 bp, Rattus norvegicus
taagtgactggcgtggcagacgtcc

SEQ ID NO: 625756 - DNA, 25 bp, Rattus norvegicus
atcgccaagcagcaaggcgccagca

SEQ ID NO: 625757 - DNA, 25 bp, Rattus norvegicus
tttcctggtggcctggaacgccgcc

SEQ ID NO: 625758 - DNA, 25 bp, Rattus norvegicus
catcagctgcgtttcctggtggcct

SEQ ID NO: 625759 - DNA, 25 bp, Rattus norvegicus
tggcgcacaccctgcatcgctggtg

SEQ ID NO: 625760 - DNA, 25 bp, Rattus norvegicus
gcctgcggagcactcgtggcgcaca

SEQ ID NO: 625761 - DNA, 25 bp, Rattus norvegicus
acggtcgcgcgactgcgccaggtaa

SEQ ID NO: 625762 - DNA, 25 bp, Rattus norvegicus
gacagctggagcactacctgggcct

SEQ ID NO: 625763 - DNA, 25 bp, Rattus norvegicus
cggcgctgcaggacctgtgccgaca

SEQ ID NO: 625764 - DNA, 25 bp, Rattus norvegicus
cgagggccagttcgccgtcacctgt

SEQ ID NO: 625765 - DNA, 25 bp, Rattus norvegicus
gcctggaccagacggtcgcgcgact

SEQ ID NO: 625766 - DNA, 25 bp, Rattus norvegicus
tcacctgtcacgaccgcacggcgca

SEQ ID NO: 625767 - DNA, 25 bp, Rattus norvegicus
cgagcgccatcagctgcgtttcctg

SEQ ID NO: 625768 - DNA, 25 bp, Rattus norvegicus
acagcgagcagcccgacagcctgga

SEQ ID NO: 625769 - DNA, 25 bp, Rattus norvegicus
acctgtgccgacagctggagcacta

SEQ ID NO: 625770 - DNA, 25 bp, Rattus norvegicus
gctgcgcgaggacctcttcccggag

SEQ ID NO: 625771 - DNA, 25 bp, Rattus norvegicus
ccatctccggcgctgctcctgtggc

SEQ ID NO: 625772 - DNA, 25 bp, Rattus norvegicus
tcccggcgcaaagtccgcgcccagg

SEQ ID NO: 625773 - DNA, 25 bp, Rattus norvegicus
ttgctcgcactaggggcaaggagac

SEQ ID NO: 625774 - DNA, 25 bp, Rattus norvegicus
ccctggagttgctcgcactaggggc

SEQ ID NO: 625775 - DNA, 25 bp, Rattus norvegicus
atcccaggccctggagttgctcgca

SEQ ID NO: 625776 - DNA, 25 bp, Rattus norvegicus
tgcagcggtgaagaacggcaaactg

SEQ ID NO: 625777 - DNA, 25 bp, Rattus norvegicus
tgcttttcacactcacaatcccagg

SEQ ID NO: 625778 - DNA, 25 bp, Rattus norvegicus
ctggctgtaaatgcagcggtgaaga

SEQ ID NO: 625779 - DNA, 25 bp, Rattus norvegicus
ttccaggaaaacttcgatttccatg

SEQ ID NO: 625780 - DNA, 25 bp, Rattus norvegicus
acttcgatttccatgtagctggctg

SEQ ID NO: 625781 - DNA, 25 bp, Rattus norvegicus
tttccatgtagctggctgtaaatgc

SEQ ID NO: 625782 - DNA, 25 bp, Rattus norvegicus
cggcaaactgcttttcacactcaca

SEQ ID NO: 625783 - DNA, 25 bp, Rattus norvegicus
tattgggtgtgtttcctttccagga

SEQ ID NO: 625784 - DNA, 25 bp, Rattus norvegicus
ggtgaagaacggcaaactgcttttc

SEQ ID NO: 625785 - DNA, 25 bp, Rattus norvegicus
ccgcggctcagtctggagaagcgct

SEQ ID NO: 625786 - DNA, 25 bp, Rattus norvegicus
gataaggcgcaaggcgccctgcgcc

SEQ ID NO: 625787 - DNA, 25 bp, Rattus norvegicus
ggccgctaagatggtgctctccacc

SEQ ID NO: 625788 - DNA, 25 bp, Rattus norvegicus
agcgcaccttaaagcagaagaagcc

SEQ ID NO: 625789 - DNA, 25 bp, Rattus norvegicus
caaatcaaccgctctggagtcccgg

SEQ ID NO: 625790 - DNA, 25 bp, Rattus norvegicus
gactggcggcagattcaaatcaacc

SEQ ID NO: 625791 - DNA, 25 bp, Rattus norvegicus
aagaagccgcggctcagtctggaga

SEQ ID NO: 625792 - DNA, 25 bp, Rattus norvegicus
caacctcatcaagacgccgagcgcc

SEQ ID NO: 625793 - DNA, 25 bp, Rattus norvegicus
gccgactggcggcagattcaaatca

SEQ ID NO: 625794 - DNA, 25 bp, Rattus norvegicus
gactgacgtcactgccgtgcgccga

SEQ ID NO: 625795 - DNA, 25 bp, Rattus norvegicus
ccctcattgcttcgggcaccagccg

SEQ ID NO: 625796 - DNA, 25 bp, Rattus norvegicus
ttcctcaagcgcaccttaaagcaga

SEQ ID NO: 625797 - DNA, 25 bp, Rattus norvegicus
accacagtctgtaggcggataaggc

SEQ ID NO: 625798 - DNA, 25 bp, Rattus norvegicus
ttccagcccgacagccacgacaggc

SEQ ID NO: 625799 - DNA, 25 bp, Rattus norvegicus
cccgcctgctggacttgaagtcgca

SEQ ID NO: 625800 - DNA, 25 bp, Rattus norvegicus
tgtgaccaaggtcccatattcagat

SEQ ID NO: 625801 - DNA, 25 bp, Rattus norvegicus
acttgaagtcgcagctggcagggac

SEQ ID NO: 625802 - DNA, 25 bp, Rattus norvegicus
ctggcagggactttttggccacctt

SEQ ID NO: 625803 - DNA, 25 bp, Rattus norvegicus
tggccacctttagtttgcagacaag

SEQ ID NO: 625804 - DNA, 25 bp, Rattus norvegicus
ccctcagggaggagaaatgatgtga

SEQ ID NO: 625805 - DNA, 25 bp, Rattus norvegicus
ctccacagtcgaccctgcacccgcg

SEQ ID NO: 625806 - DNA, 25 bp, Rattus norvegicus
cgcccgctccttacgtaacctcgtg

SEQ ID NO: 625807 - DNA, 25 bp, Rattus norvegicus
ggagaattagtgaaggacagaagta

SEQ ID NO: 625808 - DNA, 25 bp, Rattus norvegicus
cgttcacagtaagaaccagggatta

SEQ ID NO: 625809 - DNA, 25 bp, Rattus norvegicus
gagaaatgatgtgaccaaggtccca

SEQ ID NO: 625810 - DNA, 25 bp, Rattus norvegicus
tagaagaggggcgttcacagtaaga

SEQ ID NO: 625811 - DNA, 25 bp, Rattus norvegicus
atattcagattagagctcaggtccc

SEQ ID NO: 625812 - DNA, 25 bp, Rattus norvegicus
gtttgcagacaagggaaccgaagcc

SEQ ID NO: 625813 - DNA, 25 bp, Rattus norvegicus
agtcgctcgaccctaggaagcttcc

SEQ ID NO: 625814 - DNA, 25 bp, Rattus norvegicus
tctgcaaaggcatagaccgcgcggc

SEQ ID NO: 625815 - DNA, 25 bp, Rattus norvegicus
aggtctctccagtacgtcccgctga

SEQ ID NO: 625816 - DNA, 25 bp, Rattus norvegicus
cctgagcgtttggttaccctggaga

SEQ ID NO: 625817 - DNA, 25 bp, Rattus norvegicus
ggctttacaggcgactcagggctta

SEQ ID NO: 625818 - DNA, 25 bp, Rattus norvegicus
gggccgcgccaaagttcgaatgcga

SEQ ID NO: 625819 - DNA, 25 bp, Rattus norvegicus
gaattctagatatcgcgaggcttta

SEQ ID NO: 625820 - DNA, 25 bp, Rattus norvegicus
ggctggctgcgaaaagacttcactg

SEQ ID NO: 625821 - DNA, 25 bp, Rattus norvegicus
ccgtcttttttcgtaggctggctgc

SEQ ID NO: 625822 - DNA, 25 bp, Rattus norvegicus
gcactgccagttcgaggggttttac

SEQ ID NO: 625823 - DNA, 25 bp, Rattus norvegicus
ttctgggtctccattgacaagccgc

SEQ ID NO: 625824 - DNA, 25 bp, Rattus norvegicus
cgcccaagcagtgcagtcgcatctg

SEQ ID NO: 625825 - DNA, 25 bp, Rattus norvegicus
gagccgctttgtcgaagccgttgta

SEQ ID NO: 625826 - DNA, 25 bp, Rattus norvegicus
tactgccgaggcttgctaagaaccg

SEQ ID NO: 625827 - DNA, 25 bp, Rattus norvegicus
ttgccgagcacgaaacgcacatcgc

SEQ ID NO: 625828 - DNA, 25 bp, Rattus norvegicus
tgcaggggcaacaacggcccgagca

SEQ ID NO: 625829 - DNA, 25 bp, Rattus norvegicus
tggcctgccagttgtacagcggctc

SEQ ID NO: 625830 - DNA, 25 bp, Rattus norvegicus
tcagcgacgccttggtggcctgcca

SEQ ID NO: 625831 - DNA, 25 bp, Rattus norvegicus
ctcggctcaggcagtgagcaccagg

SEQ ID NO: 625832 - DNA, 25 bp, Rattus norvegicus
ctcagcagctccgagttgaagagga

SEQ ID NO: 625833 - DNA, 25 bp, Rattus norvegicus
ctgccggccgccagtacgaagcgat

SEQ ID NO: 625834 - DNA, 25 bp, Rattus norvegicus
aacatggcgtcgaagaccgcgctgc

SEQ ID NO: 625835 - DNA, 25 bp, Rattus norvegicus
ccgccgttgaacatggcgtcgaaga

SEQ ID NO: 625836 - DNA, 25 bp, Rattus norvegicus
acgtcgtggccatcccgccgttgaa

SEQ ID NO: 625837 - DNA, 25 bp, Rattus norvegicus
gcagctcgatctcggccgacgtcgt

SEQ ID NO: 625838 - DNA, 25 bp, Rattus norvegicus
gcacgctgcgcagtatcctcaggcg

SEQ ID NO: 625839 - DNA, 25 bp, Rattus norvegicus
tcttcctctttgctgggacccgagg

SEQ ID NO: 625840 - DNA, 25 bp, Rattus norvegicus
aggcgaagcgctccttcagcgacgc

SEQ ID NO: 625841 - DNA, 25 bp, Rattus norvegicus
gaagcggtcataggcccttgggccc

SEQ ID NO: 625842 - DNA, 25 bp, Rattus norvegicus
cccgcttgtagtagagggcggcaaa

SEQ ID NO: 625843 - DNA, 25 bp, Rattus norvegicus
agggaggcacccactgctacagtca

SEQ ID NO: 625844 - DNA, 25 bp, Rattus norvegicus
actgctacagtcacgcttagctccg

SEQ ID NO: 625845 - DNA, 25 bp, Rattus norvegicus
cagtcacgcttagctccgtggagta

SEQ ID NO: 625846 - DNA, 25 bp, Rattus norvegicus
ttagctccgtggagtagtccctcga

SEQ ID NO: 625847 - DNA, 25 bp, Rattus norvegicus
cccttgggcccaggtcaatatcaga

SEQ ID NO: 625848 - DNA, 25 bp, Rattus norvegicus
tgggcccaggtcaatatcagactca

SEQ ID NO: 625849 - DNA, 25 bp, Rattus norvegicus
caggtcaatatcagactcaggtggc

SEQ ID NO: 625850 - DNA, 25 bp, Rattus norvegicus
tatcagactcaggtggcagagtggc

SEQ ID NO: 625851 - DNA, 25 bp, Rattus norvegicus
tgccggaagtgccaggacccggtgt

SEQ ID NO: 625852 - DNA, 25 bp, Rattus norvegicus
tcctggcgccggtcccgcttgtagt

SEQ ID NO: 625853 - DNA, 25 bp, Rattus norvegicus
tagtccctcgagtcaccggggaagc

SEQ ID NO: 625854 - DNA, 25 bp, Rattus norvegicus
tccgtggagtagtccctcgagtcac

SEQ ID NO: 625855 - DNA, 25 bp, Rattus norvegicus
cgatgcggtgaaagagcgacccgaa

SEQ ID NO: 625856 - DNA, 25 bp, Rattus norvegicus
ccagctcggttccagctcgaggatg

SEQ ID NO: 625857 - DNA, 25 bp, Rattus norvegicus
aggatgcccagctccgttctgtgac

SEQ ID NO: 625858 - DNA, 25 bp, Rattus norvegicus
tgggtagcgtccagaaacgccacgc

SEQ ID NO: 625859 - DNA, 25 bp, Rattus norvegicus
ctttgggactgggtagcgtccagaa

SEQ ID NO: 625860 - DNA, 25 bp, Rattus norvegicus
cccgaaggtggcgatgagtgcctct

SEQ ID NO: 625861 - DNA, 25 bp, Rattus norvegicus
ctctggggatagtaccgcggcccta

SEQ ID NO: 625862 - DNA, 25 bp, Rattus norvegicus
ctgcgttcgttagcaggagcccggt

SEQ ID NO: 625863 - DNA, 25 bp, Rattus norvegicus
gttccagctcgaggatgcccagctc

SEQ ID NO: 625864 - DNA, 25 bp, Rattus norvegicus
ccgcttgtcttgtcgcggtggctgc

SEQ ID NO: 625865 - DNA, 25 bp, Rattus norvegicus
acctggcggcccagcacgagtgagt

SEQ ID NO: 625866 - DNA, 25 bp, Rattus norvegicus
tgcggagtccctgcgttcgttagca

SEQ ID NO: 625867 - DNA, 25 bp, Rattus norvegicus
ttctctcactaaagcaagggtcctg

SEQ ID NO: 625868 - DNA, 25 bp, Rattus norvegicus
ctaaagcaagggtcctgggccgctt

SEQ ID NO: 625869 - DNA, 25 bp, Rattus norvegicus
ggcttcctcagcagcagtccggctt

SEQ ID NO: 625870 - DNA, 25 bp, Rattus norvegicus
cggcttcctcagcagcagtccggct

SEQ ID NO: 625871 - DNA, 25 bp, Rattus norvegicus
agtccggcttcctcagcagcagtcc

SEQ ID NO: 625872 - DNA, 25 bp, Rattus norvegicus
cttcctcagcaccagtccggcttcc

SEQ ID NO: 625873 - DNA, 25 bp, Rattus norvegicus
ggcttcctcagcggcagtccggctt

SEQ ID NO: 625874 - DNA, 25 bp, Rattus norvegicus
ttcctcagcaccagtccggcttcct

SEQ ID NO: 625875 - DNA, 25 bp, Rattus norvegicus
gcagtccggcttcctcagcggcagt

SEQ ID NO: 625876 - DNA, 25 bp, Rattus norvegicus
ctcagcggcagtccggcttcctcag

SEQ ID NO: 625877 - DNA, 25 bp, Rattus norvegicus
cttcctcagcggcagtccggcttcc

SEQ ID NO: 625878 - DNA, 25 bp, Rattus norvegicus
gcttcctcagcaccagtccggcttc

SEQ ID NO: 625879 - DNA, 25 bp, Rattus norvegicus
agcagtccggcttcctcagcggcag

SEQ ID NO: 625880 - DNA, 25 bp, Rattus norvegicus
cttcctcagcagcagtccggcttcc

SEQ ID NO: 625881 - DNA, 25 bp, Rattus norvegicus
gcagtccggcttcctcagcagcagt

SEQ ID NO: 625882 - DNA, 25 bp, Rattus norvegicus
gcggcagtccggcttcctcagcacc

SEQ ID NO: 625883 - DNA, 25 bp, Rattus norvegicus
cacaaagccagccaggtagggaggc

SEQ ID NO: 625884 - DNA, 25 bp, Rattus norvegicus
atgctgccgcggctcgaccaatgag

SEQ ID NO: 625885 - DNA, 25 bp, Rattus norvegicus
tcgaccaatgagctgcgttggggcc

SEQ ID NO: 625886 - DNA, 25 bp, Rattus norvegicus
ttggggcctcgaaacaccgtgttgc

SEQ ID NO: 625887 - DNA, 25 bp, Rattus norvegicus
acaccgtgttgctatctgcgcgcgc

SEQ ID NO: 625888 - DNA, 25 bp, Rattus norvegicus
gggccatagactcggggtctccaca

SEQ ID NO: 625889 - DNA, 25 bp, Rattus norvegicus
gggtctccacagtcctctttcggtc

SEQ ID NO: 625890 - DNA, 25 bp, Rattus norvegicus
agtcctctttcggtctgggtttctg

SEQ ID NO: 625891 - DNA, 25 bp, Rattus norvegicus
tctgggtttctggtcgcctatgaag

SEQ ID NO: 625892 - DNA, 25 bp, Rattus norvegicus
ccgctgcgccctggcggttgtaaat

SEQ ID NO: 625893 - DNA, 25 bp, Rattus norvegicus
aatctgaccggttcggctggcaagg

SEQ ID NO: 625894 - DNA, 25 bp, Rattus norvegicus
cgccctggcggttgtaaatctgacc

SEQ ID NO: 625895 - DNA, 25 bp, Rattus norvegicus
gtcccagcagcttcatttgcatgct

SEQ ID NO: 625896 - DNA, 25 bp, Rattus norvegicus
caacaatgaagcgtgggcggtccca

SEQ ID NO: 625897 - DNA, 25 bp, Rattus norvegicus
cgcctggagcgcatagaaacgagta

SEQ ID NO: 625898 - DNA, 25 bp, Rattus norvegicus
agaagcgttccagcggagtctcgcc

SEQ ID NO: 625899 - DNA, 25 bp, Rattus norvegicus
tgagcactgccctaccgggcttagc

SEQ ID NO: 625900 - DNA, 25 bp, Rattus norvegicus
agggcttcacaacctgagcactgcc

SEQ ID NO: 625901 - DNA, 25 bp, Rattus norvegicus
gggtcttaacgctgatcacagggct

SEQ ID NO: 625902 - DNA, 25 bp, Rattus norvegicus
cccatttaactttggcggcggcgcg

SEQ ID NO: 625903 - DNA, 25 bp, Rattus norvegicus
cgccacttgcaagtagggtcttaac

SEQ ID NO: 625904 - DNA, 25 bp, Rattus norvegicus
tctctccgaggatggtaaggctagg

SEQ ID NO: 625905 - DNA, 25 bp, Rattus norvegicus
tcccggaatgttgggcagaaccttc

SEQ ID NO: 625906 - DNA, 25 bp, Rattus norvegicus
aggatccagggaccagtctctccga

SEQ ID NO: 625907 - DNA, 25 bp, Rattus norvegicus
ttgcactgacagacgctgcggcgac

SEQ ID NO: 625908 - DNA, 25 bp, Rattus norvegicus
gcgcacgctataggatcccggaatg

SEQ ID NO: 625909 - DNA, 25 bp, Rattus norvegicus
aggtgctgctcctcactgtcttaca

SEQ ID NO: 625910 - DNA, 25 bp, Rattus norvegicus
tgcccgtgttcttagcgtcccggag

SEQ ID NO: 625911 - DNA, 25 bp, Rattus norvegicus
aacttgctagggtcgccggcgacaa

SEQ ID NO: 625912 - DNA, 25 bp, Rattus norvegicus
ctcctgagccttagaagcataagtg

SEQ ID NO: 625913 - DNA, 25 bp, Rattus norvegicus
cggtctgagctactcctgagcctta

SEQ ID NO: 625914 - DNA, 25 bp, Rattus norvegicus
gactcctgcgacttccggtctgagc

SEQ ID NO: 625915 - DNA, 25 bp, Rattus norvegicus
tcagaggtcacaggctcataggccc

SEQ ID NO: 625916 - DNA, 25 bp, Rattus norvegicus
cctagtagaagggaatcaacgtggc

SEQ ID NO: 625917 - DNA, 25 bp, Rattus norvegicus
cgtcaaggcgactgcggaattccta

SEQ ID NO: 625918 - DNA, 25 bp, Rattus norvegicus
aggctgcagcgtctgccgtcgtcaa

SEQ ID NO: 625919 - DNA, 25 bp, Rattus norvegicus
ccttagggcttaagctggcacttca

SEQ ID NO: 625920 - DNA, 25 bp, Rattus norvegicus
gtgctccagcgtccttctccttagg

SEQ ID NO: 625921 - DNA, 25 bp, Rattus norvegicus
agacaccagttcctcatgctctgtg

SEQ ID NO: 625922 - DNA, 25 bp, Rattus norvegicus
tgctgactccacaccggacggacgt

SEQ ID NO: 625923 - DNA, 25 bp, Rattus norvegicus
cggacgtttcttacccgcaggtgca

SEQ ID NO: 625924 - DNA, 25 bp, Rattus norvegicus
gtcccgagctgctgcacctttttag

SEQ ID NO: 625925 - DNA, 25 bp, Rattus norvegicus
cgggatgcactttctcctgctaaaa

SEQ ID NO: 625926 - DNA, 25 bp, Rattus norvegicus
ggctatttattcctcgagcgtttcg

SEQ ID NO: 625927 - DNA, 25 bp, Rattus norvegicus
agggcgcctctctgtacgacagcga

SEQ ID NO: 625928 - DNA, 25 bp, Rattus norvegicus
cagctcgctgtttgcagacctggag

SEQ ID NO: 625929 - DNA, 25 bp, Rattus norvegicus
agtgcaggcaggctgtcttccacag

SEQ ID NO: 625930 - DNA, 25 bp, Rattus norvegicus
gctcgatcagctctccctgttggga

SEQ ID NO: 625931 - DNA, 25 bp, Rattus norvegicus
ctgccttctcctctagtgcttcaga

SEQ ID NO: 625932 - DNA, 25 bp, Rattus norvegicus
cttagtcctccagagcctagggatc

SEQ ID NO: 625933 - DNA, 25 bp, Rattus norvegicus
gtcttcaagggagtcaatgtgctca

SEQ ID NO: 625934 - DNA, 25 bp, Rattus norvegicus
gctggataccagaagcatctcccta

SEQ ID NO: 625935 - DNA, 25 bp, Rattus norvegicus
tttgcttgggacgactgcagtcacc

SEQ ID NO: 625936 - DNA, 25 bp, Rattus norvegicus
ggccaggcagccaatgggctattta

SEQ ID NO: 625937 - DNA, 25 bp, Rattus norvegicus
ggctgcaccttctagctgccgagca

SEQ ID NO: 625938 - DNA, 25 bp, Rattus norvegicus
ttccgaacacgtcgcggagatcgta

SEQ ID NO: 625939 - DNA, 25 bp, Rattus norvegicus
taatggatctgtcctgggccacgca

SEQ ID NO: 625940 - DNA, 25 bp, Rattus norvegicus
tgcaccgtggcataatggatctgtc

SEQ ID NO: 625941 - DNA, 25 bp, Rattus norvegicus
ctgggaccctgcaccgtggcataat

SEQ ID NO: 625942 - DNA, 25 bp, Rattus norvegicus
tccagcagaacctgtgcggcacagc

SEQ ID NO: 625943 - DNA, 25 bp, Rattus norvegicus
agttttccgtccagcagaacctgtg

SEQ ID NO: 625944 - DNA, 25 bp, Rattus norvegicus
gagcgcgaagaccaattctgaaaga

SEQ ID NO: 625945 - DNA, 25 bp, Rattus norvegicus
tttcaagaaagaacggaattgtctg

SEQ ID NO: 625946 - DNA, 25 bp, Rattus norvegicus
ccagacctgccaatttcaagaaaga

SEQ ID NO: 625947 - DNA, 25 bp, Rattus norvegicus
ggccggccctaatctccagacctgc

SEQ ID NO: 625948 - DNA, 25 bp, Rattus norvegicus
aaggcccagttttccgtccagcaga

SEQ ID NO: 625949 - DNA, 25 bp, Rattus norvegicus
gcccagagatgacgtttactgcgca

SEQ ID NO: 625950 - DNA, 25 bp, Rattus norvegicus
tgtcctgggccacgcaagagagtga

SEQ ID NO: 625951 - DNA, 25 bp, Rattus norvegicus
gtttactgcgcagggccggccctaa

SEQ ID NO: 625952 - DNA, 25 bp, Rattus norvegicus
cggaattgtctgagcgcgaagacca

SEQ ID NO: 625953 - DNA, 25 bp, Rattus norvegicus
atcgtatctcatctctagtcacacc

SEQ ID NO: 625954 - DNA, 25 bp, Rattus norvegicus
taagcacgacggaaatgagaccctc

SEQ ID NO: 625955 - DNA, 25 bp, Rattus norvegicus
gacggaaatgagaccctcggctttc

SEQ ID NO: 625956 - DNA, 25 bp, Rattus norvegicus
gtcccatcgtatctcatctctagtc

SEQ ID NO: 625957 - DNA, 25 bp, Rattus norvegicus
acaccctcgagtcctcctgcgcgaa

SEQ ID NO: 625958 - DNA, 25 bp, Rattus norvegicus
ctctccttatccacgggctgcttta

SEQ ID NO: 625959 - DNA, 25 bp, Rattus norvegicus
acgggctgctttacccttgcctttg

SEQ ID NO: 625960 - DNA, 25 bp, Rattus norvegicus
acccttgcctttggacggcttcgca

SEQ ID NO: 625961 - DNA, 25 bp, Rattus norvegicus
tttggacggcttcgcatcccacctg

SEQ ID NO: 625962 - DNA, 25 bp, Rattus norvegicus
tcgcagcgcgcggttttatccaaag

SEQ ID NO: 625963 - DNA, 25 bp, Rattus norvegicus
cggttttatccaaagccagcgcatc

SEQ ID NO: 625964 - DNA, 25 bp, Rattus norvegicus
gtgagaatattctaagcacgacgga

SEQ ID NO: 625965 - DNA, 25 bp, Rattus norvegicus
gtcgtctgtgagaatattctaagca

SEQ ID NO: 625966 - DNA, 25 bp, Rattus norvegicus
tcggctttcctgtcccatcgtatct

SEQ ID NO: 625967 - DNA, 25 bp, Rattus norvegicus
gtcgtggtacccactgtgtccgctc

SEQ ID NO: 625968 - DNA, 25 bp, Rattus norvegicus
aggctcctgcaaccttcgctcgtgg

SEQ ID NO: 625969 - DNA, 25 bp, Rattus norvegicus
aggaggctcctgcaaccttcgctcg

SEQ ID NO: 625970 - DNA, 25 bp, Rattus norvegicus
cgaggctaacctgcggccagccagg

SEQ ID NO: 625971 - DNA, 25 bp, Rattus norvegicus
tgcaaccgaggctaacctgcggcca

SEQ ID NO: 625972 - DNA, 25 bp, Rattus norvegicus
gctgtgcaaccgaggctaacctgcg

SEQ ID NO: 625973 - DNA, 25 bp, Rattus norvegicus
gccgctgtgcaaccgaggctaacct

SEQ ID NO: 625974 - DNA, 25 bp, Rattus norvegicus
catggtcgtggtacccactgtgtcc

SEQ ID NO: 625975 - DNA, 25 bp, Rattus norvegicus
tggccatggtcgtggtacccactgt

SEQ ID NO: 625976 - DNA, 25 bp, Rattus norvegicus
cccttggccatggtcgtggtaccca

SEQ ID NO: 625977 - DNA, 25 bp, Rattus norvegicus
acgccagaaacagctcggatctctc

SEQ ID NO: 625978 - DNA, 25 bp, Rattus norvegicus
ggaacgccagaaacagctcggatct

SEQ ID NO: 625979 - DNA, 25 bp, Rattus norvegicus
agcgctcccggggtccctgccactg

SEQ ID NO: 625980 - DNA, 25 bp, Rattus norvegicus
gccactgctcgcctggatcccgccc

SEQ ID NO: 625981 - DNA, 25 bp, Rattus norvegicus
actcctgccatgtttgtcaaccagc

SEQ ID NO: 625982 - DNA, 25 bp, Rattus norvegicus
gtcgtggagattccatctctgtttc

SEQ ID NO: 625983 - DNA, 25 bp, Rattus norvegicus
ttcacgagcctaccagtaaagtccc

SEQ ID NO: 625984 - DNA, 25 bp, Rattus norvegicus
gctgtcagccgctacgctgcggcga

SEQ ID NO: 625985 - DNA, 25 bp, Rattus norvegicus
gccaccggctgtcgtggagattcca

SEQ ID NO: 625986 - DNA, 25 bp, Rattus norvegicus
aaccgtgagccagggcaccgcagac

SEQ ID NO: 625987 - DNA, 25 bp, Rattus norvegicus
tgtagctcgcgggaaccgtgagcca

SEQ ID NO: 625988 - DNA, 25 bp, Rattus norvegicus
gagaagccgcctcgccagtgggctt

SEQ ID NO: 625989 - DNA, 25 bp, Rattus norvegicus
gccttcccgcctggcggttcagagt

SEQ ID NO: 625990 - DNA, 25 bp, Rattus norvegicus
gcccggactcctgccatgtttgtca

SEQ ID NO: 625991 - DNA, 25 bp, Rattus norvegicus
ccagaccgtactggctggcgacggc

SEQ ID NO: 625992 - DNA, 25 bp, Rattus norvegicus
gctcagcagcgcacgtgggcttcag

SEQ ID NO: 625993 - DNA, 25 bp, Rattus norvegicus
tacgctgcggcgatccggctcagca

SEQ ID NO: 625994 - DNA, 25 bp, Rattus norvegicus
atgccgctggggagtccgctaccac

SEQ ID NO: 625995 - DNA, 25 bp, Rattus norvegicus
tcctcagtgggcacgtagaggttga

SEQ ID NO: 625996 - DNA, 25 bp, Rattus norvegicus
ctgtgttcaccaccgggaagcgctc

SEQ ID NO: 625997 - DNA, 25 bp, Rattus norvegicus
gcactcgcccgtaggctgtgttcac

SEQ ID NO: 625998 - DNA, 25 bp, Rattus norvegicus
gatctcgttgttgagctcgcgccgc

SEQ ID NO: 625999 - DNA, 25 bp, Rattus norvegicus
ggcccaggatctcgttgttgagctc

SEQ ID NO: 626000 - DNA, 25 bp, Rattus norvegicus
agaactgcacgaccgggcccaggat

SEQ ID NO: 626001 - DNA, 25 bp, Rattus norvegicus
tcggtgaaccacacaggcagcatga

SEQ ID NO: 626002 - DNA, 25 bp, Rattus norvegicus
gcctccaagttgtcggtgaaccaca

SEQ ID NO: 626003 - DNA, 25 bp, Rattus norvegicus
cggccgcctccaagttgtcggtgaa

SEQ ID NO: 626004 - DNA, 25 bp, Rattus norvegicus
tagaggttgaggtacaggcagtcct

SEQ ID NO: 626005 - DNA, 25 bp, Rattus norvegicus
acagggtgcccggtcttgtgcccgt

SEQ ID NO: 626006 - DNA, 25 bp, Rattus norvegicus
gctgtgtccacagggtgcccggtct

SEQ ID NO: 626007 - DNA, 25 bp, Rattus norvegicus
tacaggcagtcctcgctctggttct

SEQ ID NO: 626008 - DNA, 25 bp, Rattus norvegicus
accgtcctcagtgggcacgtagagg

SEQ ID NO: 626009 - DNA, 25 bp, Rattus norvegicus
cagggtcgagtactggctttagttc

SEQ ID NO: 626010 - DNA, 25 bp, Rattus norvegicus
ccgcgattacaacgatgccgacatg

SEQ ID NO: 626011 - DNA, 25 bp, Rattus norvegicus
tcctgaagcctacgcgaccgatact

SEQ ID NO: 626012 - DNA, 25 bp, Rattus norvegicus
ttctgttgctctctcctcctgaagc

SEQ ID NO: 626013 - DNA, 25 bp, Rattus norvegicus
ctatgtgcctcggaccttctgttgc

SEQ ID NO: 626014 - DNA, 25 bp, Rattus norvegicus
cgcgcggttctcctgtttctatgtg

SEQ ID NO: 626015 - DNA, 25 bp, Rattus norvegicus
ggcagctaacatggcggcctccagc

SEQ ID NO: 626016 - DNA, 25 bp, Rattus norvegicus
agcccgttacactgggcagctaaca

SEQ ID NO: 626017 - DNA, 25 bp, Rattus norvegicus
cgcaggctcagtgtgtagcccgtta

SEQ ID NO: 626018 - DNA, 25 bp, Rattus norvegicus
tccggactggaggaaacagaacggc

SEQ ID NO: 626019 - DNA, 25 bp, Rattus norvegicus
ctttagttctgctcagagcgagcga

SEQ ID NO: 626020 - DNA, 25 bp, Rattus norvegicus
agccattggacctgtgtccgcgaga

SEQ ID NO: 626021 - DNA, 25 bp, Rattus norvegicus
ggccatcacacctccacggaaaaag

SEQ ID NO: 626022 - DNA, 25 bp, Rattus norvegicus
cgagactccgcacgctgtttgcgca

SEQ ID NO: 626023 - DNA, 25 bp, Rattus norvegicus
ccggtcctcttacctcaggttgatg

SEQ ID NO: 626024 - DNA, 25 bp, Rattus norvegicus
gagctgccagccgacgctttttata

SEQ ID NO: 626025 - DNA, 25 bp, Rattus norvegicus
tcactggcttagtagctccgagctg

SEQ ID NO: 626026 - DNA, 25 bp, Rattus norvegicus
actccgtgcgctcactggcttagta

SEQ ID NO: 626027 - DNA, 25 bp, Rattus norvegicus
tgaagattccgacctcactccggca

SEQ ID NO: 626028 - DNA, 25 bp, Rattus norvegicus
ctcctgagcgtaagcaagcgggaca

SEQ ID NO: 626029 - DNA, 25 bp, Rattus norvegicus
tgatcccacgcgttgagctcctgag

SEQ ID NO: 626030 - DNA, 25 bp, Rattus norvegicus
tcccggagtctggtatctgatccca

SEQ ID NO: 626031 - DNA, 25 bp, Rattus norvegicus
tgactgagatcctgccacgcctcgg

SEQ ID NO: 626032 - DNA, 25 bp, Rattus norvegicus
cgccgggacatgctgttgctaccag

SEQ ID NO: 626033 - DNA, 25 bp, Rattus norvegicus
ttttatagtcgccttccggggctga

SEQ ID NO: 626034 - DNA, 25 bp, Rattus norvegicus
agcctaggacgagcgctgcggacct

SEQ ID NO: 626035 - DNA, 25 bp, Rattus norvegicus
cctctgagggctatagtggaagcgc

SEQ ID NO: 626036 - DNA, 25 bp, Rattus norvegicus
gtctggagtacagcatcccggagtc

SEQ ID NO: 626037 - DNA, 25 bp, Rattus norvegicus
gccagcacagctcgccgagcgagaa

SEQ ID NO: 626038 - DNA, 25 bp, Rattus norvegicus
aacaatctgggagcacaagcccgca

SEQ ID NO: 626039 - DNA, 25 bp, Rattus norvegicus
gtcgatgtcggcgtagagattcttt

SEQ ID NO: 626040 - DNA, 25 bp, Rattus norvegicus
ggagcgaatgcaacaatctgggagc

SEQ ID NO: 626041 - DNA, 25 bp, Rattus norvegicus
gctcgccgagcgagaagccgttcat

SEQ ID NO: 626042 - DNA, 25 bp, Rattus norvegicus
gctcgctcaggtgcaggctgcacgc

SEQ ID NO: 626043 - DNA, 25 bp, Rattus norvegicus
agaagacctctacggcgtccagttc

SEQ ID NO: 626044 - DNA, 25 bp, Rattus norvegicus
ccgtgcgcgagaagaagacctctac

SEQ ID NO: 626045 - DNA, 25 bp, Rattus norvegicus
acagcgttgccgtgagagaagagca

SEQ ID NO: 626046 - DNA, 25 bp, Rattus norvegicus
aagtccacagcgttgccgtgagaga

SEQ ID NO: 626047 - DNA, 25 bp, Rattus norvegicus
acaccatagcccgaatagtcgtaag

SEQ ID NO: 626048 - DNA, 25 bp, Rattus norvegicus
ggcttgccggagctcacaccatagc

SEQ ID NO: 626049 - DNA, 25 bp, Rattus norvegicus
agattcttttcggagggcttgccgg

SEQ ID NO: 626050 - DNA, 25 bp, Rattus norvegicus
cgagaagccgttcatcctggggccg

SEQ ID NO: 626051 - DNA, 25 bp, Rattus norvegicus
tgccctgttgaatcccggctccaaa

SEQ ID NO: 626052 - DNA, 25 bp, Rattus norvegicus
gcgagcatcgactcacacgcagcag

SEQ ID NO: 626053 - DNA, 25 bp, Rattus norvegicus
tcagcgcgacacctggcatccactg

SEQ ID NO: 626054 - DNA, 25 bp, Rattus norvegicus
gcggggccgatagccgaaattgtcc

SEQ ID NO: 626055 - DNA, 25 bp, Rattus norvegicus
aggagttctgccctgttgaatcccg

SEQ ID NO: 626056 - DNA, 25 bp, Rattus norvegicus
gcgggcgagcatcgactcacacgca

SEQ ID NO: 626057 - DNA, 25 bp, Rattus norvegicus
gccgatagccgaaattgtcccagga

SEQ ID NO: 626058 - DNA, 25 bp, Rattus norvegicus
ccgtcaggaccaggtggagcaccat

SEQ ID NO: 626059 - DNA, 25 bp, Rattus norvegicus
caggtggagcaccattcgtgaatga

SEQ ID NO: 626060 - DNA, 25 bp, Rattus norvegicus
gcaccattcgtgaatgaggatgcca

SEQ ID NO: 626061 - DNA, 25 bp, Rattus norvegicus
gaggctcggcggctactcacccgga

SEQ ID NO: 626062 - DNA, 25 bp, Rattus norvegicus
ctactcacccggagggttgacggcg

SEQ ID NO: 626063 - DNA, 25 bp, Rattus norvegicus
ccgaaattgtcccaggagttctgcc

SEQ ID NO: 626064 - DNA, 25 bp, Rattus norvegicus
caaacttttctctcgctcagcgcga

SEQ ID NO: 626065 - DNA, 25 bp, Rattus norvegicus
agcgggtgagcaagcgacccatttg

SEQ ID NO: 626066 - DNA, 25 bp, Rattus norvegicus
ttagcatgccaaggccgcgccactg

SEQ ID NO: 626067 - DNA, 25 bp, Rattus norvegicus
ggcgtcccagtacagccacttagca

SEQ ID NO: 626068 - DNA, 25 bp, Rattus norvegicus
cctcagaaacaaaggcgtcccagta

SEQ ID NO: 626069 - DNA, 25 bp, Rattus norvegicus
aggacaaccggcctcagaaacaaag

SEQ ID NO: 626070 - DNA, 25 bp, Rattus norvegicus
acccatttggatgcagaggacaacc

SEQ ID NO: 626071 - DNA, 25 bp, Rattus norvegicus
acacatcgccgaggggcgctgtacc

SEQ ID NO: 626072 - DNA, 25 bp, Rattus norvegicus
ccaggtatcagggacacatcgccga

SEQ ID NO: 626073 - DNA, 25 bp, Rattus norvegicus
tgtgcactccctatccgccctagta

SEQ ID NO: 626074 - DNA, 25 bp, Rattus norvegicus
aggctagaggcctctgtgcactccc

SEQ ID NO: 626075 - DNA, 25 bp, Rattus norvegicus
agtacagccacttagcatgccaagg

SEQ ID NO: 626076 - DNA, 25 bp, Rattus norvegicus
ccgtagcaccgcgagacttggggca

SEQ ID NO: 626077 - DNA, 25 bp, Rattus norvegicus
tccgagccgtagcaccgcgagactt

SEQ ID NO: 626078 - DNA, 25 bp, Rattus norvegicus
aggtgcccaggctagaggcctctgt

SEQ ID NO: 626079 - DNA, 25 bp, Rattus norvegicus
gggaagcaccgcagcgcttgaacta

SEQ ID NO: 626080 - DNA, 25 bp, Rattus norvegicus
gaccgattaggtcccagagcgcatc

SEQ ID NO: 626081 - DNA, 25 bp, Rattus norvegicus
cgcacggagaccgtgcccggtgccc

SEQ ID NO: 626082 - DNA, 25 bp, Rattus norvegicus
agtccggctgcttcgccgagccgga

SEQ ID NO: 626083 - DNA, 25 bp, Rattus norvegicus
ccgggcgctgactcagccgcagtcc

SEQ ID NO: 626084 - DNA, 25 bp, Rattus norvegicus
gctctgctcacagccgctctcggcg

SEQ ID NO: 626085 - DNA, 25 bp, Rattus norvegicus
aaaatgccagggctgcctcggctct

SEQ ID NO: 626086 - DNA, 25 bp, Rattus norvegicus
cctttaaaatgccagggctgcctcg

SEQ ID NO: 626087 - DNA, 25 bp, Rattus norvegicus
tctcgcctttaaaatgccagggctg

SEQ ID NO: 626088 - DNA, 25 bp, Rattus norvegicus
gcgtccaagtctcgcctttaaaatg

SEQ ID NO: 626089 - DNA, 25 bp, Rattus norvegicus
cttgaacggcgtccaagtctcgcct

SEQ ID NO: 626090 - DNA, 25 bp, Rattus norvegicus
aagtttctccctgcgtttccgcttg

SEQ ID NO: 626091 - DNA, 25 bp, Rattus norvegicus
cgaagtttctccctgcgtttccgct

SEQ ID NO: 626092 - DNA, 25 bp, Rattus norvegicus
gcgcctggagccatccgggaagcac

SEQ ID NO: 626093 - DNA, 25 bp, Rattus norvegicus
ttcggttcggatatacaaagcaatc

SEQ ID NO: 626094 - DNA, 25 bp, Rattus norvegicus
tcttttccggcgaaatccacgaagc

SEQ ID NO: 626095 - DNA, 25 bp, Rattus norvegicus
tgtcccagaaccacccggcacccgc

SEQ ID NO: 626096 - DNA, 25 bp, Rattus norvegicus
ccgcatccttcgctggccagctcct

SEQ ID NO: 626097 - DNA, 25 bp, Rattus norvegicus
gaaatccacgaagccaagaccaccg

SEQ ID NO: 626098 - DNA, 25 bp, Rattus norvegicus
caagaccaccgcttcggttcggata

SEQ ID NO: 626099 - DNA, 25 bp, Rattus norvegicus
tccggcgaaatccacgaagccaaga

SEQ ID NO: 626100 - DNA, 25 bp, Rattus norvegicus
ccaccgcttcggttcggatatacaa

SEQ ID NO: 626101 - DNA, 25 bp, Rattus norvegicus
gaaagggcgtcttgtccacgcctcg

SEQ ID NO: 626102 - DNA, 25 bp, Rattus norvegicus
tcggatatacaaagcaatcttcctc

SEQ ID NO: 626103 - DNA, 25 bp, Rattus norvegicus
agcaatcttcctcatcaaccctaga

SEQ ID NO: 626104 - DNA, 25 bp, Rattus norvegicus
tcaaccctagatgtgcggaagccct

SEQ ID NO: 626105 - DNA, 25 bp, Rattus norvegicus
ctagatgtgcggaagccctgggatc

SEQ ID NO: 626106 - DNA, 25 bp, Rattus norvegicus
ctccgaaagggcgtcttgtccacgc

SEQ ID NO: 626107 - DNA, 25 bp, Rattus norvegicus
tttccgtcccaagcaccgagcggag

SEQ ID NO: 626108 - DNA, 25 bp, Rattus norvegicus
ggccacagctcgctcctttccgtcc

SEQ ID NO: 626109 - DNA, 25 bp, Rattus norvegicus
tctgctggcggctacccgggaaccg

SEQ ID NO: 626110 - DNA, 25 bp, Rattus norvegicus
cgccactgctctgctggcggctacc

SEQ ID NO: 626111 - DNA, 25 bp, Rattus norvegicus
actcggcccagcctttgaccctcgg

SEQ ID NO: 626112 - DNA, 25 bp, Rattus norvegicus
tgcctggcctctagactcggcccag

SEQ ID NO: 626113 - DNA, 25 bp, Rattus norvegicus
gggcggagatctcctgcctggcctc

SEQ ID NO: 626114 - DNA, 25 bp, Rattus norvegicus
caacaacaggctcgcgcgagacaaa

SEQ ID NO: 626115 - DNA, 25 bp, Rattus norvegicus
cacaacaacaggctcgcgcgagaca

SEQ ID NO: 626116 - DNA, 25 bp, Rattus norvegicus
aacggcggccacaacaacaggctcg

SEQ ID NO: 626117 - DNA, 25 bp, Rattus norvegicus
ctgaacggcggccacaacaacaggc

SEQ ID NO: 626118 - DNA, 25 bp, Rattus norvegicus
ggacatcctgaacggcggccacaac

SEQ ID NO: 626119 - DNA, 25 bp, Rattus norvegicus
gagccagggcggagatctcctgcct

SEQ ID NO: 626120 - DNA, 25 bp, Rattus norvegicus
gtcccaagcaccgagcggagcgcag

SEQ ID NO: 626121 - DNA, 25 bp, Rattus norvegicus
ctccgagctcaactccatgatgttg

SEQ ID NO: 626122 - DNA, 25 bp, Rattus norvegicus
acaggggtatcacctgcccaggaga

SEQ ID NO: 626123 - DNA, 25 bp, Rattus norvegicus
tgacgaccttcgcagagatccagcc

SEQ ID NO: 626124 - DNA, 25 bp, Rattus norvegicus
ctggtgctggtaacgcaggatgcac

SEQ ID NO: 626125 - DNA, 25 bp, Rattus norvegicus
caggatgcacagcaacaggtggccc

SEQ ID NO: 626126 - DNA, 25 bp, Rattus norvegicus
gacgccggtcccaaagcgctttatg

SEQ ID NO: 626127 - DNA, 25 bp, Rattus norvegicus
atcagcacgttgagccacctcgcag

SEQ ID NO: 626128 - DNA, 25 bp, Rattus norvegicus
acagatgatgatgcgccgtcgctgc

SEQ ID NO: 626129 - DNA, 25 bp, Rattus norvegicus
ctgcactctgagacagctgctcgca

SEQ ID NO: 626130 - DNA, 25 bp, Rattus norvegicus
ccagggctcgctcatggagcagatc

SEQ ID NO: 626131 - DNA, 25 bp, Rattus norvegicus
cagcagcgtagtgacgcgcttcaca

SEQ ID NO: 626132 - DNA, 25 bp, Rattus norvegicus
aggagacgcccacaggagctgaatc

SEQ ID NO: 626133 - DNA, 25 bp, Rattus norvegicus
actccatgatgttgtccaccgcggc

SEQ ID NO: 626134 - DNA, 25 bp, Rattus norvegicus
agagattcagctgcccacgaccatg

SEQ ID NO: 626135 - DNA, 25 bp, Rattus norvegicus
cccggtgctagctagtggtagagaa

SEQ ID NO: 626136 - DNA, 25 bp, Rattus norvegicus
gagctggcgcaacccggaccgtgac

SEQ ID NO: 626137 - DNA, 25 bp, Rattus norvegicus
ctagtggtagagaagctcagcgtgc

SEQ ID NO: 626138 - DNA, 25 bp, Rattus norvegicus
tagagaagctcagcgtgcggactgc

SEQ ID NO: 626139 - DNA, 25 bp, Rattus norvegicus
aacagcccggtgctagctagtggta

SEQ ID NO: 626140 - DNA, 25 bp, Rattus norvegicus
taggacagggacgcccttggccagc

SEQ ID NO: 626141 - DNA, 25 bp, Rattus norvegicus
cgacatgtacctccgccggttcgta

SEQ ID NO: 626142 - DNA, 25 bp, Rattus norvegicus
tccgaagcggaggagaaaagactgc

SEQ ID NO: 626143 - DNA, 25 bp, Rattus norvegicus
aaggccacaaggtacgccacgcaga

SEQ ID NO: 626144 - DNA, 25 bp, Rattus norvegicus
gccggttcgtaaccagaaggccaca

SEQ ID NO: 626145 - DNA, 25 bp, Rattus norvegicus
ttcgtaaccagaaggccacaaggta

SEQ ID NO: 626146 - DNA, 25 bp, Rattus norvegicus
caaggtacgccacgcagagagtgag

SEQ ID NO: 626147 - DNA, 25 bp, Rattus norvegicus
cccggccattactgcgcaggcaggc

SEQ ID NO: 626148 - DNA, 25 bp, Rattus norvegicus
cgtaagcgggctcgactgggcctca

SEQ ID NO: 626149 - DNA, 25 bp, Rattus norvegicus
cagctcgagagtgatgatccgccgg

SEQ ID NO: 626150 - DNA, 25 bp, Rattus norvegicus
aggagtccacggcaatccctagggg

SEQ ID NO: 626151 - DNA, 25 bp, Rattus norvegicus
tagcgaactggagcagggtaaagac

SEQ ID NO: 626152 - DNA, 25 bp, Rattus norvegicus
ccctgccgagagagcggcgcacacc

SEQ ID NO: 626153 - DNA, 25 bp, Rattus norvegicus
ccatcccagctcgagagtgatgatc

SEQ ID NO: 626154 - DNA, 25 bp, Rattus norvegicus
aggaggcccggactcctggctctgc

SEQ ID NO: 626155 - DNA, 25 bp, Rattus norvegicus
atgctcagtagccaggaggcccgga

SEQ ID NO: 626156 - DNA, 25 bp, Rattus norvegicus
ctttggggaatgctcagtagccagg

SEQ ID NO: 626157 - DNA, 25 bp, Rattus norvegicus
ggatctagtcgatcccgagggcggg

SEQ ID NO: 626158 - DNA, 25 bp, Rattus norvegicus
ggcagggatccagccggaatcctcg

SEQ ID NO: 626159 - DNA, 25 bp, Rattus norvegicus
cccggagcgcagaatccgcggtgca

SEQ ID NO: 626160 - DNA, 25 bp, Rattus norvegicus
cacggcaatccctaggggcccggag

SEQ ID NO: 626161 - DNA, 25 bp, Rattus norvegicus
tccaggcggaagatcctaagggatc

SEQ ID NO: 626162 - DNA, 25 bp, Rattus norvegicus
acgtagcgaactggagcagggtaaa

SEQ ID NO: 626163 - DNA, 25 bp, Rattus norvegicus
tgggtccgtggacccactccttgcg

SEQ ID NO: 626164 - DNA, 25 bp, Rattus norvegicus
cgccgtcaaccatgggtccgtggac

SEQ ID NO: 626165 - DNA, 25 bp, Rattus norvegicus
tctccgggcgccgtcaaccatgggt

SEQ ID NO: 626166 - DNA, 25 bp, Rattus norvegicus
ttttctctgccatctgctctccggg

SEQ ID NO: 626167 - DNA, 25 bp, Rattus norvegicus
tctagttgttgttttctctgccatc

SEQ ID NO: 626168 - DNA, 25 bp, Rattus norvegicus
ccatcgcgtagtgttctagttgttg

SEQ ID NO: 626169 - DNA, 25 bp, Rattus norvegicus
ctcccatcgcgtagtgttctagttg

SEQ ID NO: 626170 - DNA, 25 bp, Rattus norvegicus
gcctgactcccatcgcgtagtgttc

SEQ ID NO: 626171 - DNA, 25 bp, Rattus norvegicus
ggtcgcctgactcccatcgcgtagt

SEQ ID NO: 626172 - DNA, 25 bp, Rattus norvegicus
cgcgagccacaggggtcgcctgact

SEQ ID NO: 626173 - DNA, 25 bp, Rattus norvegicus
ttgggtattttagggcgcgagccac

SEQ ID NO: 626174 - DNA, 25 bp, Rattus norvegicus
ctcttgggtattttagggcgcgagc

SEQ ID NO: 626175 - DNA, 25 bp, Rattus norvegicus
gttctgttctcagcgtcctgtaacc

SEQ ID NO: 626176 - DNA, 25 bp, Rattus norvegicus
acctcgttctgttctcagcgtcctg

SEQ ID NO: 626177 - DNA, 25 bp, Rattus norvegicus
tccactgggacccagagacggtggt

SEQ ID NO: 626178 - DNA, 25 bp, Rattus norvegicus
ttagcgcccacatagagctccagtc

SEQ ID NO: 626179 - DNA, 25 bp, Rattus norvegicus
ccggctgtgcttcccagggcaagct

SEQ ID NO: 626180 - DNA, 25 bp, Rattus norvegicus
ctgggacatcgcaggtgagcactca

SEQ ID NO: 626181 - DNA, 25 bp, Rattus norvegicus
acttcgcgctgaaggtgctccactg

SEQ ID NO: 626182 - DNA, 25 bp, Rattus norvegicus
caccattggtgtggacttcgcgctg

SEQ ID NO: 626183 - DNA, 25 bp, Rattus norvegicus
ccactaccgggccaccattggtgtg

SEQ ID NO: 626184 - DNA, 25 bp, Rattus norvegicus
agcgctacgtgcaccaaaacttctc

SEQ ID NO: 626185 - DNA, 25 bp, Rattus norvegicus
agctgctggtaatcggcgacctagg

SEQ ID NO: 626186 - DNA, 25 bp, Rattus norvegicus
ggagcacctgtataagctgctggta

SEQ ID NO: 626187 - DNA, 25 bp, Rattus norvegicus
tgcagacaccgcacaaggagcacct

SEQ ID NO: 626188 - DNA, 25 bp, Rattus norvegicus
gcgggcctccaggatgcagacaccg

SEQ ID NO: 626189 - DNA, 25 bp, Rattus norvegicus
ggtgtaggcaagaccagcatcatca

SEQ ID NO: 626190 - DNA, 25 bp, Rattus norvegicus
gggcaagctccaggctccgcaagac

SEQ ID NO: 626191 - DNA, 25 bp, Rattus norvegicus
gaagcgagcgcctctgaatgcgagc

SEQ ID NO: 626192 - DNA, 25 bp, Rattus norvegicus
cagctgtgcgtggtcgtgggaacgc

SEQ ID NO: 626193 - DNA, 25 bp, Rattus norvegicus
gcagacacgcaacggcggggcagac

SEQ ID NO: 626194 - DNA, 25 bp, Rattus norvegicus
cttgcggggtgcgaaaaggtcacgg

SEQ ID NO: 626195 - DNA, 25 bp, Rattus norvegicus
tcacgggagcgggttattcaaggcc

SEQ ID NO: 626196 - DNA, 25 bp, Rattus norvegicus
tattcaaggccggagtcgtcggatg

SEQ ID NO: 626197 - DNA, 25 bp, Rattus norvegicus
ttcaaggccggagtcgtcggatgtt

SEQ ID NO: 626198 - DNA, 25 bp, Rattus norvegicus
gatgttggccggtccgcgtatagca

SEQ ID NO: 626199 - DNA, 25 bp, Rattus norvegicus
ccggtccgcgtatagcagcgcgagg

SEQ ID NO: 626200 - DNA, 25 bp, Rattus norvegicus
gcgcacaccagaggcggggagaaga

SEQ ID NO: 626201 - DNA, 25 bp, Rattus norvegicus
ggctccggaccgtcaaaggaagcga

SEQ ID NO: 626202 - DNA, 25 bp, Rattus norvegicus
cggaccgtcaaaggaagcgagcgcc

SEQ ID NO: 626203 - DNA, 25 bp, Rattus norvegicus
ccgtcaaaggaagcgagcgcctctg

SEQ ID NO: 626204 - DNA, 25 bp, Rattus norvegicus
caaaggaagcgagcgcctctgaatg

SEQ ID NO: 626205 - DNA, 25 bp, Rattus norvegicus
gaactcgcgctgtaccaggcaccag

SEQ ID NO: 626206 - DNA, 25 bp, Rattus norvegicus
ggctccggacgtctgatatcccgca

SEQ ID NO: 626207 - DNA, 25 bp, Rattus norvegicus
ggtctttcattggacactcgcgttg

SEQ ID NO: 626208 - DNA, 25 bp, Rattus norvegicus
ggcctgacccttacagcgggagatg

SEQ ID NO: 626209 - DNA, 25 bp, Rattus norvegicus
gctggctaggggtgaaaatttctgc

SEQ ID NO: 626210 - DNA, 25 bp, Rattus norvegicus
gtgggaacacgtctcacctggaaga

SEQ ID NO: 626211 - DNA, 25 bp, Rattus norvegicus
taccgcattccctatccggagctgg

SEQ ID NO: 626212 - DNA, 25 bp, Rattus norvegicus
ttgcttgatacagaggtggccattg

SEQ ID NO: 626213 - DNA, 25 bp, Rattus norvegicus
cacacagcgaggatttaaagccaca

SEQ ID NO: 626214 - DNA, 25 bp, Rattus norvegicus
cgagaggctgggcaatttgctcaag

SEQ ID NO: 626215 - DNA, 25 bp, Rattus norvegicus
ctttacggatgaggaacctgacgcc

SEQ ID NO: 626216 - DNA, 25 bp, Rattus norvegicus
aggctttatcgctaatcctcccaag

SEQ ID NO: 626217 - DNA, 25 bp, Rattus norvegicus
aggcaccagctctaagcctttcagg

SEQ ID NO: 626218 - DNA, 25 bp, Rattus norvegicus
cgcacagtctcctacagctgctgga

SEQ ID NO: 626219 - DNA, 25 bp, Rattus norvegicus
ggctctcgacaactcgacaactcga

SEQ ID NO: 626220 - DNA, 25 bp, Rattus norvegicus
ccctgtaccgggtccgatggacaga

SEQ ID NO: 626221 - DNA, 25 bp, Rattus norvegicus
acccagagtctgtgtagaggccaca

SEQ ID NO: 626222 - DNA, 25 bp, Rattus norvegicus
agatcctaccagtgactcttgcacc

SEQ ID NO: 626223 - DNA, 25 bp, Rattus norvegicus
gtccgatggacagatcctaccagtg

SEQ ID NO: 626224 - DNA, 25 bp, Rattus norvegicus
attcagagatcctggaccctccggc

SEQ ID NO: 626225 - DNA, 25 bp, Rattus norvegicus
cagcttcaccctgccattcagagat

SEQ ID NO: 626226 - DNA, 25 bp, Rattus norvegicus
gagtgcaagccagcggtccagcagc

SEQ ID NO: 626227 - DNA, 25 bp, Rattus norvegicus
agacccgccgagtgcaagccagcgg

SEQ ID NO: 626228 - DNA, 25 bp, Rattus norvegicus
cggctcccatgcctgcttcgcagac

SEQ ID NO: 626229 - DNA, 25 bp, Rattus norvegicus
cagcatactcctgggtccctcggac

SEQ ID NO: 626230 - DNA, 25 bp, Rattus norvegicus
ggccacagcgaattctccggtgtcc

SEQ ID NO: 626231 - DNA, 25 bp, Rattus norvegicus
tgtagaggccacagcgaattctccg

SEQ ID NO: 626232 - DNA, 25 bp, Rattus norvegicus
gactcttgcaccctccggctctcga

SEQ ID NO: 626233 - DNA, 25 bp, Rattus norvegicus
taacctccctacctcgcctagcctg

SEQ ID NO: 626234 - DNA, 25 bp, Rattus norvegicus
tcaggtcccgcgtcctactggagcg

SEQ ID NO: 626235 - DNA, 25 bp, Rattus norvegicus
ggtgaacatcgcaaccaagcacgga

SEQ ID NO: 626236 - DNA, 25 bp, Rattus norvegicus
ggggctagctccttgaatccattgg

SEQ ID NO: 626237 - DNA, 25 bp, Rattus norvegicus
agctccttgaatccattgggaaccc

SEQ ID NO: 626238 - DNA, 25 bp, Rattus norvegicus
cagggatgccactccaagtccggtc

SEQ ID NO: 626239 - DNA, 25 bp, Rattus norvegicus
ccagcctctccgagctcaggtcccg

SEQ ID NO: 626240 - DNA, 25 bp, Rattus norvegicus
cctactggagcgcaggacctggctt

SEQ ID NO: 626241 - DNA, 25 bp, Rattus norvegicus
gacctggcttggctagaggacaccc

SEQ ID NO: 626242 - DNA, 25 bp, Rattus norvegicus
tgaccttggtctcgccctggttcca

SEQ ID NO: 626243 - DNA, 25 bp, Rattus norvegicus
tggtctcgccctggttccaggtctg

SEQ ID NO: 626244 - DNA, 25 bp, Rattus norvegicus
tctgtgccaggaccatgggcgccgc

SEQ ID NO: 626245 - DNA, 25 bp, Rattus norvegicus
tagcctgcggcagccttcggcgtca

SEQ ID NO: 626246 - DNA, 25 bp, Rattus norvegicus
gttccaggtctgtgccaggaccatg

SEQ ID NO: 626247 - DNA, 25 bp, Rattus norvegicus
gttcctaacgtcgtgcaccgtgcca

SEQ ID NO: 626248 - DNA, 25 bp, Rattus norvegicus
acgcccagaagaatgaccaggtttc

SEQ ID NO: 626249 - DNA, 25 bp, Rattus norvegicus
cgccctcggcgcctctgctcggcca

SEQ ID NO: 626250 - DNA, 25 bp, Rattus norvegicus
gcccagaagaatgaccaggtttccc

SEQ ID NO: 626251 - DNA, 25 bp, Rattus norvegicus
cgcgttcctaacgtcgtgcaccgtg

SEQ ID NO: 626252 - DNA, 25 bp, Rattus norvegicus
aggcagccaaacatggcagcgccct

SEQ ID NO: 626253 - DNA, 25 bp, Rattus norvegicus
caccaggcagccaaacatggcagcg

SEQ ID NO: 626254 - DNA, 25 bp, Rattus norvegicus
cacctcaggccggacaccaggaatt

SEQ ID NO: 626255 - DNA, 25 bp, Rattus norvegicus
gtgcaccgtgccaccacccagctct

SEQ ID NO: 626256 - DNA, 25 bp, Rattus norvegicus
accacccagctctcagtcaccgacc

SEQ ID NO: 626257 - DNA, 25 bp, Rattus norvegicus
attcgcagtcgcacacgcccagaag

SEQ ID NO: 626258 - DNA, 25 bp, Rattus norvegicus
cgcagtcgcacacgcccagaagaat

SEQ ID NO: 626259 - DNA, 25 bp, Rattus norvegicus
cacgcccagaagaatgaccaggttt

SEQ ID NO: 626260 - DNA, 25 bp, Rattus norvegicus
ctcaggccggacaccaggaattccg

SEQ ID NO: 626261 - DNA, 25 bp, Rattus norvegicus
cgaccgcagttaccaaagaacctga

SEQ ID NO: 626262 - DNA, 25 bp, Rattus norvegicus
aacttctgcttcttggccgccggca

SEQ ID NO: 626263 - DNA, 25 bp, Rattus norvegicus
actttgcaccgaggcgtcggacctg

SEQ ID NO: 626264 - DNA, 25 bp, Rattus norvegicus
aggcggaactcaaagggctgctccc

SEQ ID NO: 626265 - DNA, 25 bp, Rattus norvegicus
tgcccagacgtttcgtccgcaattg

SEQ ID NO: 626266 - DNA, 25 bp, Rattus norvegicus
attggctcaaaccttcgatctccga

SEQ ID NO: 626267 - DNA, 25 bp, Rattus norvegicus
tgttctcgtcgctgctcaacttctg

SEQ ID NO: 626268 - DNA, 25 bp, Rattus norvegicus
tgaaacttctactccacagtcccgg

SEQ ID NO: 626269 - DNA, 25 bp, Rattus norvegicus
tgctatcagtcgcagttccacctcg

SEQ ID NO: 626270 - DNA, 25 bp, Rattus norvegicus
ctcgccaactttctgcttgctatca

SEQ ID NO: 626271 - DNA, 25 bp, Rattus norvegicus
tcgcagaccttcaggacctttaatc

SEQ ID NO: 626272 - DNA, 25 bp, Rattus norvegicus
atctgagcggacctcgcagaccttc

SEQ ID NO: 626273 - DNA, 25 bp, Rattus norvegicus
ggggctgcactcacattctcgtctc

SEQ ID NO: 626274 - DNA, 25 bp, Rattus norvegicus
gtcgacacttccctctcagacatat

SEQ ID NO: 626275 - DNA, 25 bp, Rattus norvegicus
ataactcccggggtaggcatccttg

SEQ ID NO: 626276 - DNA, 25 bp, Rattus norvegicus
cagtgtttctggctggctaacgtca

SEQ ID NO: 626277 - DNA, 25 bp, Rattus norvegicus
tgccacttcttgaggacactgtcca

SEQ ID NO: 626278 - DNA, 25 bp, Rattus norvegicus
tgagtctctccttgccacttcttga

SEQ ID NO: 626279 - DNA, 25 bp, Rattus norvegicus
tcagaatctgggtaggccagaggcc

SEQ ID NO: 626280 - DNA, 25 bp, Rattus norvegicus
ccagaggccggacattgtcatagta

SEQ ID NO: 626281 - DNA, 25 bp, Rattus norvegicus
ggaacctgaagtatcccacatgatg

SEQ ID NO: 626282 - DNA, 25 bp, Rattus norvegicus
agcagtcactctgcctctccatagt

SEQ ID NO: 626283 - DNA, 25 bp, Rattus norvegicus
ttgaggcacttctacaaagcttttc

SEQ ID NO: 626284 - DNA, 25 bp, Rattus norvegicus
aaagcttttcatactgccgcaccaa

SEQ ID NO: 626285 - DNA, 25 bp, Rattus norvegicus
cgcaccaactaacacactgacagtg

SEQ ID NO: 626286 - DNA, 25 bp, Rattus norvegicus
cagtgtatggcagtttcccttccta

SEQ ID NO: 626287 - DNA, 25 bp, Rattus norvegicus
ctcacagacactagtttttgccttc

SEQ ID NO: 626288 - DNA, 25 bp, Rattus norvegicus
cgtcaaagcacagcatcagaatctg

SEQ ID NO: 626289 - DNA, 25 bp, Rattus norvegicus
tacccggtcgggctccagctgacca

SEQ ID NO: 626290 - DNA, 25 bp, Rattus norvegicus
cccgctcttccctcgcccgagcgag

SEQ ID NO: 626291 - DNA, 25 bp, Rattus norvegicus
agctgcctgtccctcttacccggtc

SEQ ID NO: 626292 - DNA, 25 bp, Rattus norvegicus
cccggaaagctccgaggaggagcct

SEQ ID NO: 626293 - DNA, 25 bp, Rattus norvegicus
tgacacaggggcagcccggaaagct

SEQ ID NO: 626294 - DNA, 25 bp, Rattus norvegicus
cggaacccgagtcacgtgacacagg

SEQ ID NO: 626295 - DNA, 25 bp, Rattus norvegicus
ggcggaacccgagtcacgtgacaca

SEQ ID NO: 626296 - DNA, 25 bp, Rattus norvegicus
ctgcctcaggcgacctgttggcagg

SEQ ID NO: 626297 - DNA, 25 bp, Rattus norvegicus
ggcgtcagcctcagacacgaggacg

SEQ ID NO: 626298 - DNA, 25 bp, Rattus norvegicus
gggccctgcctcaggcgacctgttg

SEQ ID NO: 626299 - DNA, 25 bp, Rattus norvegicus
cctccgggtgaaagaggggtgcagc

SEQ ID NO: 626300 - DNA, 25 bp, Rattus norvegicus
agcctcagacacgaggacgtcctcg

SEQ ID NO: 626301 - DNA, 25 bp, Rattus norvegicus
gaacacgcgagccggggctctccga

SEQ ID NO: 626302 - DNA, 25 bp, Rattus norvegicus
acgaggacgtcctcgcctccgggtg

SEQ ID NO: 626303 - DNA, 25 bp, Rattus norvegicus
tcagcgaggcccgacccgcccttgg

SEQ ID NO: 626304 - DNA, 25 bp, Rattus norvegicus
atcaccctccgacagcccaggtctc

SEQ ID NO: 626305 - DNA, 25 bp, Rattus norvegicus
ggggtcagatctgggcccgcctcca

SEQ ID NO: 626306 - DNA, 25 bp, Rattus norvegicus
gaagcgcctgctttctgcgcagtcg

SEQ ID NO: 626307 - DNA, 25 bp, Rattus norvegicus
gcgcacaaggtccaaggtccgcggc

SEQ ID NO: 626308 - DNA, 25 bp, Rattus norvegicus
gcgaacgaggcgcacaaggtccaag

SEQ ID NO: 626309 - DNA, 25 bp, Rattus norvegicus
aggtctccacgcctctgcagtcgga

SEQ ID NO: 626310 - DNA, 25 bp, Rattus norvegicus
ggatagggccgcaatcaccctccga

SEQ ID NO: 626311 - DNA, 25 bp, Rattus norvegicus
ttgctggggatagggccgcaatcac

SEQ ID NO: 626312 - DNA, 25 bp, Rattus norvegicus
acccgctgaaaaggcgagggtcttg

SEQ ID NO: 626313 - DNA, 25 bp, Rattus norvegicus
gcagaaccgccacccgctgaaaagg

SEQ ID NO: 626314 - DNA, 25 bp, Rattus norvegicus
tggggaggcagaaccgccacccgct

SEQ ID NO: 626315 - DNA, 25 bp, Rattus norvegicus
aggatcccggggtccggagcagcca

SEQ ID NO: 626316 - DNA, 25 bp, Rattus norvegicus
tccaccagcgcctgtgagcccggga

SEQ ID NO: 626317 - DNA, 25 bp, Rattus norvegicus
ggtatgctcccggtcttcagccaac

SEQ ID NO: 626318 - DNA, 25 bp, Rattus norvegicus
cctgagttatccgaaggagctcccg

SEQ ID NO: 626319 - DNA, 25 bp, Rattus norvegicus
gtttccgctcctggtatgctcccgg

SEQ ID NO: 626320 - DNA, 25 bp, Rattus norvegicus
tgctgcgggcctgtttccgctcctg

SEQ ID NO: 626321 - DNA, 25 bp, Rattus norvegicus
gtgttctgagcccttctttccgcac

SEQ ID NO: 626322 - DNA, 25 bp, Rattus norvegicus
tttccgtgttctgagcccttctttc

SEQ ID NO: 626323 - DNA, 25 bp, Rattus norvegicus
atgtctttttccgtgttctgagccc

SEQ ID NO: 626324 - DNA, 25 bp, Rattus norvegicus
ggcgaagccttaccgccgccctata

SEQ ID NO: 626325 - DNA, 25 bp, Rattus norvegicus
tctgcggccttccactcgggcgaag

SEQ ID NO: 626326 - DNA, 25 bp, Rattus norvegicus
ccaatcacgccacatggctggggtg

SEQ ID NO: 626327 - DNA, 25 bp, Rattus norvegicus
ggattcgcccggaaaggcgctcctc

SEQ ID NO: 626328 - DNA, 25 bp, Rattus norvegicus
cctctgctcgggattcgcccggaaa

SEQ ID NO: 626329 - DNA, 25 bp, Rattus norvegicus
cagtgcgcccgagcggtgaaccgct

SEQ ID NO: 626330 - DNA, 25 bp, Rattus norvegicus
ttatccgaaggagctcccgcggtcc

SEQ ID NO: 626331 - DNA, 25 bp, Rattus norvegicus
gcccgacttaatcggctcaagaaga

SEQ ID NO: 626332 - DNA, 25 bp, Rattus norvegicus
ggctgtcctagccaacgagaccgga

SEQ ID NO: 626333 - DNA, 25 bp, Rattus norvegicus
ctgggcaaacgggtgcaagcactgc

SEQ ID NO: 626334 - DNA, 25 bp, Rattus norvegicus
cgactaagagtcctcggaaggcggc

SEQ ID NO: 626335 - DNA, 25 bp, Rattus norvegicus
ggcggtggcaccaacgacaacaacc

SEQ ID NO: 626336 - DNA, 25 bp, Rattus norvegicus
gcagaggctgttaaatggcatcgga

SEQ ID NO: 626337 - DNA, 25 bp, Rattus norvegicus
atgaggcacagcctgaccaagctgc

SEQ ID NO: 626338 - DNA, 25 bp, Rattus norvegicus
ccgcagagatgcagcgcttttctga

SEQ ID NO: 626339 - DNA, 25 bp, Rattus norvegicus
atctgctggaccctcggcaaccgga

SEQ ID NO: 626340 - DNA, 25 bp, Rattus norvegicus
ggacatggactttctctccgggctg

SEQ ID NO: 626341 - DNA, 25 bp, Rattus norvegicus
aggaggacgcgatcgctatggtccc

SEQ ID NO: 626342 - DNA, 25 bp, Rattus norvegicus
ctgaccgcgagcaacctcacgggga

SEQ ID NO: 626343 - DNA, 25 bp, Rattus norvegicus
cttttctgacttgctgcagaggctg

SEQ ID NO: 626344 - DNA, 25 bp, Rattus norvegicus
agtcgctacctacgggctgtcctag

SEQ ID NO: 626345 - DNA, 25 bp, Rattus norvegicus
ccacaaccttcgctagggttgcttg

SEQ ID NO: 626346 - DNA, 25 bp, Rattus norvegicus
ttcgctagggttgcttgggctccat

SEQ ID NO: 626347 - DNA, 25 bp, Rattus norvegicus
gcttgggctccatctttggttcaca

SEQ ID NO: 626348 - DNA, 25 bp, Rattus norvegicus
tctccgcctctgtttcctgtcccgg

SEQ ID NO: 626349 - DNA, 25 bp, Rattus norvegicus
ttggggtacaacctgcacaaacagc

SEQ ID NO: 626350 - DNA, 25 bp, Rattus norvegicus
tgcacaaacagccctccggcggtgg

SEQ ID NO: 626351 - DNA, 25 bp, Rattus norvegicus
tacttccgaggaccccaatgtggtg

SEQ ID NO: 626352 - DNA, 25 bp, Rattus norvegicus
gaatctaccacaaccttcgctaggg

SEQ ID NO: 626353 - DNA, 25 bp, Rattus norvegicus
ttggttcacacgtgactctccgcct

SEQ ID NO: 626354 - DNA, 25 bp, Rattus norvegicus
gggcacgcagccctacttccgagga

SEQ ID NO: 626355 - DNA, 25 bp, Rattus norvegicus
gagcttccggtccgggagacgctaa

SEQ ID NO: 626356 - DNA, 25 bp, Rattus norvegicus
atgacggcagcttatggccgcctcc

SEQ ID NO: 626357 - DNA, 25 bp, Rattus norvegicus
gggctccatctttggttcacacgtg

SEQ ID NO: 626358 - DNA, 25 bp, Rattus norvegicus
tccatctttggttcacacgtgactc

SEQ ID NO: 626359 - DNA, 25 bp, Rattus norvegicus
agccagccttgcttgtcctctgtca

SEQ ID NO: 626360 - DNA, 25 bp, Rattus norvegicus
ttccgcgcacgtgaaatgccctgca

SEQ ID NO: 626361 - DNA, 25 bp, Rattus norvegicus
tggaaagggtccagttagaaatctc

SEQ ID NO: 626362 - DNA, 25 bp, Rattus norvegicus
ttggctgacagctcgtacctttagc

SEQ ID NO: 626363 - DNA, 25 bp, Rattus norvegicus
gtacctttagctgagtccgcccgga

SEQ ID NO: 626364 - DNA, 25 bp, Rattus norvegicus
gtggcgtcccaaaagagcgatctct

SEQ ID NO: 626365 - DNA, 25 bp, Rattus norvegicus
ggcttcgaggaagactcagtaccca

SEQ ID NO: 626366 - DNA, 25 bp, Rattus norvegicus
tgtcaatttgtcagcctggccaacc

SEQ ID NO: 626367 - DNA, 25 bp, Rattus norvegicus
tgcgcgccttcttcttagggctgtt

SEQ ID NO: 626368 - DNA, 25 bp, Rattus norvegicus
cggtgtgttaaggttgtggcttctc

SEQ ID NO: 626369 - DNA, 25 bp, Rattus norvegicus
ggccacagcagcacgaactagcctg

SEQ ID NO: 626370 - DNA, 25 bp, Rattus norvegicus
tccagtcttcagttccctcatagtc

SEQ ID NO: 626371 - DNA, 25 bp, Rattus norvegicus
gcgggacttacagttggctgacagc

SEQ ID NO: 626372 - DNA, 25 bp, Rattus norvegicus
agcgatctctcattggcttcgagga

SEQ ID NO: 626373 - DNA, 25 bp, Rattus norvegicus
tggaatccgctggatttcaagtccc

SEQ ID NO: 626374 - DNA, 25 bp, Rattus norvegicus
aggcgtccgcgagagtgacacaccc

SEQ ID NO: 626375 - DNA, 25 bp, Rattus norvegicus
gcctctgcgagaatcaacaacattc

SEQ ID NO: 626376 - DNA, 25 bp, Rattus norvegicus
acaacattccgcttccctttgctga

SEQ ID NO: 626377 - DNA, 25 bp, Rattus norvegicus
ttgctgacccggagctccgagaata

SEQ ID NO: 626378 - DNA, 25 bp, Rattus norvegicus
tccgagaatatgaggaaccgctgga

SEQ ID NO: 626379 - DNA, 25 bp, Rattus norvegicus
aaccgctggatttggcggttcctgc

SEQ ID NO: 626380 - DNA, 25 bp, Rattus norvegicus
atttggcggttcctgcgtcccgagt

SEQ ID NO: 626381 - DNA, 25 bp, Rattus norvegicus
gcgaagactcgctcagggagaatgt

SEQ ID NO: 626382 - DNA, 25 bp, Rattus norvegicus
cgagtgcagtggaatccgctggatt

SEQ ID NO: 626383 - DNA, 25 bp, Rattus norvegicus
tctgtcacccgccctgcggagaggt

SEQ ID NO: 626384 - DNA, 25 bp, Rattus norvegicus
actcgctcagggagaatgttcgggc

SEQ ID NO: 626385 - DNA, 25 bp, Rattus norvegicus
tgtgcctgctcaggcgtccgcgaga

SEQ ID NO: 626386 - DNA, 25 bp, Rattus norvegicus
ctgcgtcccgagtgcagtggaatcc

SEQ ID NO: 626387 - DNA, 25 bp, Rattus norvegicus
ctacccatgggctgctctgcaggta

SEQ ID NO: 626388 - DNA, 25 bp, Rattus norvegicus
tcaagtcgcagggatgcaagccagc

SEQ ID NO: 626389 - DNA, 25 bp, Rattus norvegicus
aggtagccatcctgttccctaattc

SEQ ID NO: 626390 - DNA, 25 bp, Rattus norvegicus
tccacccaggcgtctttgttgacgg

SEQ ID NO: 626391 - DNA, 25 bp, Rattus norvegicus
ggccgtcactttggaaacgagtaca

SEQ ID NO: 626392 - DNA, 25 bp, Rattus norvegicus
ttgttgacggttgccctcaagtcgc

SEQ ID NO: 626393 - DNA, 25 bp, Rattus norvegicus
tgccttaggtcttcactgggtcttc

SEQ ID NO: 626394 - DNA, 25 bp, Rattus norvegicus
cgagtttcagggacgtccacccagg

SEQ ID NO: 626395 - DNA, 25 bp, Rattus norvegicus
ttccagagtctcagttcctgcaggc

SEQ ID NO: 626396 - DNA, 25 bp, Rattus norvegicus
cttccggtgttcagtcacttccgta

SEQ ID NO: 626397 - DNA, 25 bp, Rattus norvegicus
cttccgtatcctttatgaatgcgtc

SEQ ID NO: 626398 - DNA, 25 bp, Rattus norvegicus
ctgctcagagttgttttccagagtc

SEQ ID NO: 626399 - DNA, 25 bp, Rattus norvegicus
tgtggcaacagaatccctgcttttc

SEQ ID NO: 626400 - DNA, 25 bp, Rattus norvegicus
atcccggagtcactggttcggagcc

SEQ ID NO: 626401 - DNA, 25 bp, Rattus norvegicus
cgggcgtctgctctgacattgcgcc

SEQ ID NO: 626402 - DNA, 25 bp, Rattus norvegicus
gcgtctgctctgacattgcgccgcg

SEQ ID NO: 626403 - DNA, 25 bp, Rattus norvegicus
ataatcccgacaggcgtcctcccgg

SEQ ID NO: 626404 - DNA, 25 bp, Rattus norvegicus
actgataatcccgacaggcgtcctc

SEQ ID NO: 626405 - DNA, 25 bp, Rattus norvegicus
gacgactgataatcccgacaggcgt

SEQ ID NO: 626406 - DNA, 25 bp, Rattus norvegicus
gtctgctctgacattgcgccgcggc

SEQ ID NO: 626407 - DNA, 25 bp, Rattus norvegicus
tcaccacatgctgaccgcggagggg

SEQ ID NO: 626408 - DNA, 25 bp, Rattus norvegicus
cttcaccacatgctgaccgcggagg

SEQ ID NO: 626409 - DNA, 25 bp, Rattus norvegicus
ggcttcaccacatgctgaccgcgga

SEQ ID NO: 626410 - DNA, 25 bp, Rattus norvegicus
cctcccttccgacgcctcggcctcg

SEQ ID NO: 626411 - DNA, 25 bp, Rattus norvegicus
cggctgcggcttcaccacatgctga

SEQ ID NO: 626412 - DNA, 25 bp, Rattus norvegicus
cttccgacgcctcggcctcgctccc

SEQ ID NO: 626413 - DNA, 25 bp, Rattus norvegicus
ggctgcggcttcaccacatgctgac

SEQ ID NO: 626414 - DNA, 25 bp, Rattus norvegicus
cgccgaagctgaagccgctcgacac

SEQ ID NO: 626415 - DNA, 25 bp, Rattus norvegicus
gtggaccggcccaaccagtttatga

SEQ ID NO: 626416 - DNA, 25 bp, Rattus norvegicus
ggcccaaccagtttatgaaagctgc

SEQ ID NO: 626417 - DNA, 25 bp, Rattus norvegicus
cccatccagggaagccagtggagga

SEQ ID NO: 626418 - DNA, 25 bp, Rattus norvegicus
ttaccataacaacccatccagggaa

SEQ ID NO: 626419 - DNA, 25 bp, Rattus norvegicus
gactgttcggtcatttgttaccata

SEQ ID NO: 626420 - DNA, 25 bp, Rattus norvegicus
ggcggcctggtcaatcgtcttcctc

SEQ ID NO: 626421 - DNA, 25 bp, Rattus norvegicus
gtgaactggagcagcgaaggcctcc

SEQ ID NO: 626422 - DNA, 25 bp, Rattus norvegicus
cagcgaaggcctccagtcaaggcca

SEQ ID NO: 626423 - DNA, 25 bp, Rattus norvegicus
cagtcaaggccaggcgccgggtctc

SEQ ID NO: 626424 - DNA, 25 bp, Rattus norvegicus
gggtctcagatgctcccgggagcct

SEQ ID NO: 626425 - DNA, 25 bp, Rattus norvegicus
caattcgtaagggactgttcggtca

SEQ ID NO: 626426 - DNA, 25 bp, Rattus norvegicus
agctgtccctcaggcattaaggcgg

SEQ ID NO: 626427 - DNA, 25 bp, Rattus norvegicus
agtttatgaaagctgcaccaggccc

SEQ ID NO: 626428 - DNA, 25 bp, Rattus norvegicus
tcctccaaacactgggcggcctggt

SEQ ID NO: 626429 - DNA, 25 bp, Rattus norvegicus
tttctggcacgacagccctgccggt

SEQ ID NO: 626430 - DNA, 25 bp, Rattus norvegicus
gcagctccagggctccaatatggcg

SEQ ID NO: 626431 - DNA, 25 bp, Rattus norvegicus
agttctatatcctcgcctcaccatt

SEQ ID NO: 626432 - DNA, 25 bp, Rattus norvegicus
gatgcgcgaggctataagttctata

SEQ ID NO: 626433 - DNA, 25 bp, Rattus norvegicus
cgtctagtcctagccgatgcgcgag

SEQ ID NO: 626434 - DNA, 25 bp, Rattus norvegicus
ccagtgtagcctccgtctagtccta

SEQ ID NO: 626435 - DNA, 25 bp, Rattus norvegicus
gcaatccctgcgatgccatttctgg

SEQ ID NO: 626436 - DNA, 25 bp, Rattus norvegicus
tagcgaggccttgtgcaatccctgc

SEQ ID NO: 626437 - DNA, 25 bp, Rattus norvegicus
cagaggtaaaacgacgccctgtgtc

SEQ ID NO: 626438 - DNA, 25 bp, Rattus norvegicus
gggtcctacacgctcagaggtaaaa

SEQ ID NO: 626439 - DNA, 25 bp, Rattus norvegicus
ttgcccagatagtgcccaagaagtc

SEQ ID NO: 626440 - DNA, 25 bp, Rattus norvegicus
gtgcgagctggcttttcgtcctaca

SEQ ID NO: 626441 - DNA, 25 bp, Rattus norvegicus
gcttttcgtcctacaggggcgaagc

SEQ ID NO: 626442 - DNA, 25 bp, Rattus norvegicus
aaagacaccttttgcccagatagtg

SEQ ID NO: 626443 - DNA, 25 bp, Rattus norvegicus
ctcagcggccacagaaaggacgggt

SEQ ID NO: 626444 - DNA, 25 bp, Rattus norvegicus
ctccgcagggcgtgtcgcttataac

SEQ ID NO: 626445 - DNA, 25 bp, Rattus norvegicus
tccttgtcaagccaggggtagctgt

SEQ ID NO: 626446 - DNA, 25 bp, Rattus norvegicus
ctgtgggttttgagagacgttcttc

SEQ ID NO: 626447 - DNA, 25 bp, Rattus norvegicus
gacgttcttcttcgactggtggagc

SEQ ID NO: 626448 - DNA, 25 bp, Rattus norvegicus
ggagcggtagttctctcaacgaagt

SEQ ID NO: 626449 - DNA, 25 bp, Rattus norvegicus
ttgactacaacagggagtcgccatc

SEQ ID NO: 626450 - DNA, 25 bp, Rattus norvegicus
atcgcggagcctggatggattatcc

SEQ ID NO: 626451 - DNA, 25 bp, Rattus norvegicus
tgagggaatgtttggtctgcacgaa

SEQ ID NO: 626452 - DNA, 25 bp, Rattus norvegicus
gtctgcacgaaagactcagcggcca

SEQ ID NO: 626453 - DNA, 25 bp, Rattus norvegicus
tgacggtctttaaggagagccaatc

SEQ ID NO: 626454 - DNA, 25 bp, Rattus norvegicus
gccaatcagaaaatgctccgcaggg

SEQ ID NO: 626455 - DNA, 25 bp, Rattus norvegicus
gctctccaaacgctcgcaatcgaat

SEQ ID NO: 626456 - DNA, 25 bp, Rattus norvegicus
tcttccgccggaaatgtcgtcttga

SEQ ID NO: 626457 - DNA, 25 bp, Rattus norvegicus
gacacttctgggctgataccgctgc

SEQ ID NO: 626458 - DNA, 25 bp, Rattus norvegicus
ctacttctggacttcaagactggca

SEQ ID NO: 626459 - DNA, 25 bp, Rattus norvegicus
atgagtgacagattgcaaggcttgc

SEQ ID NO: 626460 - DNA, 25 bp, Rattus norvegicus
tcctcctggttattggctggcaatg

SEQ ID NO: 626461 - DNA, 25 bp, Rattus norvegicus
ggcgggagtatctgacttcctcctg

SEQ ID NO: 626462 - DNA, 25 bp, Rattus norvegicus
ccgccatcgccaccatgggtgagta

SEQ ID NO: 626463 - DNA, 25 bp, Rattus norvegicus
gtgctcagcgctctctctgtgattg

SEQ ID NO: 626464 - DNA, 25 bp, Rattus norvegicus
cgcccattggcatcctgtaagagta

SEQ ID NO: 626465 - DNA, 25 bp, Rattus norvegicus
ccgagagcgccagctagtgatgctc

SEQ ID NO: 626466 - DNA, 25 bp, Rattus norvegicus
ttggagcagattggccagagaagcc

SEQ ID NO: 626467 - DNA, 25 bp, Rattus norvegicus
ttcaagccggagctgtgattggagc

SEQ ID NO: 626468 - DNA, 25 bp, Rattus norvegicus
ccgagggttccgcaactgagtagag

SEQ ID NO: 626469 - DNA, 25 bp, Rattus norvegicus
aaatcgccttgacttcgcccattgg

SEQ ID NO: 626470 - DNA, 25 bp, Rattus norvegicus
agacagccctcggaaatcgccttga

SEQ ID NO: 626471 - DNA, 25 bp, Rattus norvegicus
agccattgcattcccgggatgcctt

SEQ ID NO: 626472 - DNA, 25 bp, Rattus norvegicus
caagtctcagggttggatcccggtc

SEQ ID NO: 626473 - DNA, 25 bp, Rattus norvegicus
ccagttcatccctctattctgaaaa

SEQ ID NO: 626474 - DNA, 25 bp, Rattus norvegicus
ggagtctccagttcatccctctatt

SEQ ID NO: 626475 - DNA, 25 bp, Rattus norvegicus
aacttggtcgggactggagtctcca

SEQ ID NO: 626476 - DNA, 25 bp, Rattus norvegicus
cctcactagtacaacttggtcggga

SEQ ID NO: 626477 - DNA, 25 bp, Rattus norvegicus
gctgagccattgcattcccgggatg

SEQ ID NO: 626478 - DNA, 25 bp, Rattus norvegicus
tgcatgacctcactagtacaacttg

SEQ ID NO: 626479 - DNA, 25 bp, Rattus norvegicus
ccttcaggtgtgcatgacctcacta

SEQ ID NO: 626480 - DNA, 25 bp, Rattus norvegicus
gctttgttgcggatgtggctacgac

SEQ ID NO: 626481 - DNA, 25 bp, Rattus norvegicus
ggatgccttcgggccatcccggcaa

SEQ ID NO: 626482 - DNA, 25 bp, Rattus norvegicus
tggaatgattcactggctttgttgc

SEQ ID NO: 626483 - DNA, 25 bp, Rattus norvegicus
ggcggatgctgagccattgcattcc

SEQ ID NO: 626484 - DNA, 25 bp, Rattus norvegicus
cccgttcccttcaggtgtgcatgac

SEQ ID NO: 626485 - DNA, 25 bp, Rattus norvegicus
ggcgccggacttcagcactggcaac

SEQ ID NO: 626486 - DNA, 25 bp, Rattus norvegicus
tcatacccttcggtttcggaggctc

SEQ ID NO: 626487 - DNA, 25 bp, Rattus norvegicus
cttcggaagtctggacaagggctgc

SEQ ID NO: 626488 - DNA, 25 bp, Rattus norvegicus
agggctgctgtttcgaagatgatga

SEQ ID NO: 626489 - DNA, 25 bp, Rattus norvegicus
gctcagcttcatagactcggcgtcc

SEQ ID NO: 626490 - DNA, 25 bp, Rattus norvegicus
ctcggcgtccagcaacatcaaactg

SEQ ID NO: 626491 - DNA, 25 bp, Rattus norvegicus
gccaggcaagtccaagcggaaagtg

SEQ ID NO: 626492 - DNA, 25 bp, Rattus norvegicus
ccgcaagtacttgcagaagcagatc

SEQ ID NO: 626493 - DNA, 25 bp, Rattus norvegicus
gatcaaacgttgcagtggcctcatg

SEQ ID NO: 626494 - DNA, 25 bp, Rattus norvegicus
cttcttcacggagccatcccgggtg

SEQ ID NO: 626495 - DNA, 25 bp, Rattus norvegicus
gaggccgttgagttctttgagttgc

SEQ ID NO: 626496 - DNA, 25 bp, Rattus norvegicus
gcgatggtggggaacctactatacc

SEQ ID NO: 626497 - DNA, 25 bp, Rattus norvegicus
gcttggctgcccttttcgactctct

SEQ ID NO: 626498 - DNA, 25 bp, Rattus norvegicus
cactggcaacgattcgggtgtcttg

SEQ ID NO: 626499 - DNA, 25 bp, Rattus norvegicus
ctgctgccgatctgagaagctcttg

SEQ ID NO: 626500 - DNA, 25 bp, Rattus norvegicus
gtacttgtacttgttgagctccgca

SEQ ID NO: 626501 - DNA, 25 bp, Rattus norvegicus
tggctcgcaaaaggcagaactgtac

SEQ ID NO: 626502 - DNA, 25 bp, Rattus norvegicus
ggtctcgtcttccaccagctgcagg

SEQ ID NO: 626503 - DNA, 25 bp, Rattus norvegicus
ggcgccgtgatcatccgcagacttg

SEQ ID NO: 626504 - DNA, 25 bp, Rattus norvegicus
cagctccttgcggaaggccttcatc

SEQ ID NO: 626505 - DNA, 25 bp, Rattus norvegicus
ggatgttccgcacctcctctgagtc

SEQ ID NO: 626506 - DNA, 25 bp, Rattus norvegicus
ggctgccacggatacccagatgtga

SEQ ID NO: 626507 - DNA, 25 bp, Rattus norvegicus
catgttggacatgagcacgcggttc

SEQ ID NO: 626508 - DNA, 25 bp, Rattus norvegicus
atgaccttgccgctcagctcgttga

SEQ ID NO: 626509 - DNA, 25 bp, Rattus norvegicus
atggccgctggacttgtacttgtac

SEQ ID NO: 626510 - DNA, 25 bp, Rattus norvegicus
cctccaggcggtcaatgaaggtctg

SEQ ID NO: 626511 - DNA, 25 bp, Rattus norvegicus
aggactcgctctgctccctcatgag

SEQ ID NO: 626512 - DNA, 25 bp, Rattus norvegicus
caggtcgtctagttccgccttcagg

SEQ ID NO: 626513 - DNA, 25 bp, Rattus norvegicus
tcagctctacggaaaaagcgccttg

SEQ ID NO: 626514 - DNA, 25 bp, Rattus norvegicus
attcaggttcgtgtgctactccggg

SEQ ID NO: 626515 - DNA, 25 bp, Rattus norvegicus
atggaggttagctcgattcaggttc

SEQ ID NO: 626516 - DNA, 25 bp, Rattus norvegicus
ggcgtcctggttgcccacaaggcaa

SEQ ID NO: 626517 - DNA, 25 bp, Rattus norvegicus
ctcaagcagcttgctgagggctccg

SEQ ID NO: 626518 - DNA, 25 bp, Rattus norvegicus
gctcgccctgtgtgtaagagaacga

SEQ ID NO: 626519 - DNA, 25 bp, Rattus norvegicus
cggtagcagcctgcagccacggtaa

SEQ ID NO: 626520 - DNA, 25 bp, Rattus norvegicus
tgggcgcctctatccaactcggaga

SEQ ID NO: 626521 - DNA, 25 bp, Rattus norvegicus
tcgccggagctgagctcagaaccca

SEQ ID NO: 626522 - DNA, 25 bp, Rattus norvegicus
gagctattgttggtctcgccggagc

SEQ ID NO: 626523 - DNA, 25 bp, Rattus norvegicus
gcctcgggattgcagctgttacatg

SEQ ID NO: 626524 - DNA, 25 bp, Rattus norvegicus
ggagggaagctattaaacacacaca

SEQ ID NO: 626525 - DNA, 25 bp, Rattus norvegicus
gcgagtgtgtctcgttcgctagctc

SEQ ID NO: 626526 - DNA, 25 bp, Rattus norvegicus
gagatgctagcctgcttccctgctc

SEQ ID NO: 626527 - DNA, 25 bp, Rattus norvegicus
cttctctggagatgatggctacgcc

SEQ ID NO: 626528 - DNA, 25 bp, Rattus norvegicus
tggctacgccaaggacgcaaagctg

SEQ ID NO: 626529 - DNA, 25 bp, Rattus norvegicus
tggaaacatccggatccggtttatc

SEQ ID NO: 626530 - DNA, 25 bp, Rattus norvegicus
cgaccttggaaacatccggatccgg

SEQ ID NO: 626531 - DNA, 25 bp, Rattus norvegicus
ggagctctacgtggccgaccttgga

SEQ ID NO: 626532 - DNA, 25 bp, Rattus norvegicus
cccatcttccttggccgtgtgtgca

SEQ ID NO: 626533 - DNA, 25 bp, Rattus norvegicus
aaacgacgccaactgcgactgcttc

SEQ ID NO: 626534 - DNA, 25 bp, Rattus norvegicus
gccaaggacgcaaagctgaacaccc

SEQ ID NO: 626535 - DNA, 25 bp, Rattus norvegicus
actgcgactgcttctctggagatga

SEQ ID NO: 626536 - DNA, 25 bp, Rattus norvegicus
gctgcgactgtaaaaacgacgccaa

SEQ ID NO: 626537 - DNA, 25 bp, Rattus norvegicus
cccagcggctgcgactgtaaaaacg

SEQ ID NO: 626538 - DNA, 25 bp, Rattus norvegicus
agtggtgagatctcactggttgctg

SEQ ID NO: 626539 - DNA, 25 bp, Rattus norvegicus
cacgacaagtggtgagatctcactg

SEQ ID NO: 626540 - DNA, 25 bp, Rattus norvegicus
ccgtatcaggcaggtcacgacaagt

SEQ ID NO: 626541 - DNA, 25 bp, Rattus norvegicus
cagaatgagggcttcacctgcacta

SEQ ID NO: 626542 - DNA, 25 bp, Rattus norvegicus
tgggcccctgatcgaccgtcagatc

SEQ ID NO: 626543 - DNA, 25 bp, Rattus norvegicus
ctaccgtcagattgggcccctgatc

SEQ ID NO: 626544 - DNA, 25 bp, Rattus norvegicus
tatccgctaccgtcagattgggccc

SEQ ID NO: 626545 - DNA, 25 bp, Rattus norvegicus
cactatccgctaccgtcagattggg

SEQ ID NO: 626546 - DNA, 25 bp, Rattus norvegicus
tgcactatccgctaccgtcagattg

SEQ ID NO: 626547 - DNA, 25 bp, Rattus norvegicus
atgagggcttcacctgcactatccg

SEQ ID NO: 626548 - DNA, 25 bp, Rattus norvegicus
acctacagaatgagggcttcacctg

SEQ ID NO: 626549 - DNA, 25 bp, Rattus norvegicus
ggtcaacctacagaatgagggcttc

SEQ ID NO: 626550 - DNA, 25 bp, Rattus norvegicus
agacggtcaacctacagaatgaggg

SEQ ID NO: 626551 - DNA, 25 bp, Rattus norvegicus
ctgaagacggtcaacctacagaatg

SEQ ID NO: 626552 - DNA, 25 bp, Rattus norvegicus
gcatgctgaagacggtcaacctaca

SEQ ID NO: 626553 - DNA, 25 bp, Rattus norvegicus
cgggcatgctgaagacggtcaacct

SEQ ID NO: 626554 - DNA, 25 bp, Rattus norvegicus
agggcttcacctgcactatccgcta

SEQ ID NO: 626555 - DNA, 25 bp, Rattus norvegicus
ggtcaatgcccgttttgattacaac

SEQ ID NO: 626556 - DNA, 25 bp, Rattus norvegicus
gcccgttttgattacaactatgaca

SEQ ID NO: 626557 - DNA, 25 bp, Rattus norvegicus
tacaactatgacaacagtttccgcg

SEQ ID NO: 626558 - DNA, 25 bp, Rattus norvegicus
atgcaggccgtgatcaacgagaccc

SEQ ID NO: 626559 - DNA, 25 bp, Rattus norvegicus
agcatgcaggccgtgatcaacgaga

SEQ ID NO: 626560 - DNA, 25 bp, Rattus norvegicus
tgaccagcatgcaggccgtgatcaa

SEQ ID NO: 626561 - DNA, 25 bp, Rattus norvegicus
tttccgcgtgaccagcatgcaggcc

SEQ ID NO: 626562 - DNA, 25 bp, Rattus norvegicus
tgacaacagtttccgcgtgaccagc

SEQ ID NO: 626563 - DNA, 25 bp, Rattus norvegicus
aaggcatggtcaatgcccgttttga

SEQ ID NO: 626564 - DNA, 25 bp, Rattus norvegicus
ttcactgaagaaggcatggtcaatg

SEQ ID NO: 626565 - DNA, 25 bp, Rattus norvegicus
ccgattcactgaagaaggcatggtc

SEQ ID NO: 626566 - DNA, 25 bp, Rattus norvegicus
gtcagatcttccgattcactgaaga

SEQ ID NO: 626567 - DNA, 25 bp, Rattus norvegicus
accgtcagatcttccgattcactga

SEQ ID NO: 626568 - DNA, 25 bp, Rattus norvegicus
acagtttccgcgtgaccagcatgca

SEQ ID NO: 626569 - DNA, 25 bp, Rattus norvegicus
tgtcaggtaccgctatgacggcctg

SEQ ID NO: 626570 - DNA, 25 bp, Rattus norvegicus
tcaggtaccgctatgacggcctggg

SEQ ID NO: 626571 - DNA, 25 bp, Rattus norvegicus
attcagccggcctgctcatcaaagc

SEQ ID NO: 626572 - DNA, 25 bp, Rattus norvegicus
ctgctcatcaaagcctacaaccggg

SEQ ID NO: 626573 - DNA, 25 bp, Rattus norvegicus
ctcatcaaagcctacaaccgggcta

SEQ ID NO: 626574 - DNA, 25 bp, Rattus norvegicus
atcaaagcctacaaccgggctagtg

SEQ ID NO: 626575 - DNA, 25 bp, Rattus norvegicus
tcaaagcctacaaccgggctagtgg

SEQ ID NO: 626576 - DNA, 25 bp, Rattus norvegicus
caaagcctacaaccgggctagtggg

SEQ ID NO: 626577 - DNA, 25 bp, Rattus norvegicus
ctacaaccgggctagtgggtggagt

SEQ ID NO: 626578 - DNA, 25 bp, Rattus norvegicus
gtggagtgtcaggtaccgctatgac

SEQ ID NO: 626579 - DNA, 25 bp, Rattus norvegicus
tggagtgtcaggtaccgctatgacg

SEQ ID NO: 626580 - DNA, 25 bp, Rattus norvegicus
gagtgtcaggtaccgctatgacggc

SEQ ID NO: 626581 - DNA, 25 bp, Rattus norvegicus
gtaccgctatgacggcctggggcgg

SEQ ID NO: 626582 - DNA, 25 bp, Rattus norvegicus
aattcagccggcctgctcatcaaag

SEQ ID NO: 626583 - DNA, 25 bp, Rattus norvegicus
gtcttcgagtacaattcagccggcc

SEQ ID NO: 626584 - DNA, 25 bp, Rattus norvegicus
ttgcggtacgacctccgagaccgca

SEQ ID NO: 626585 - DNA, 25 bp, Rattus norvegicus
ctccgagaccgcatcacgaggctgg

SEQ ID NO: 626586 - DNA, 25 bp, Rattus norvegicus
accgcatcacgaggctgggcgatgt

SEQ ID NO: 626587 - DNA, 25 bp, Rattus norvegicus
gcgatgtgcagtacaagatggatga

SEQ ID NO: 626588 - DNA, 25 bp, Rattus norvegicus
tgtgcagtacaagatggatgaagac

SEQ ID NO: 626589 - DNA, 25 bp, Rattus norvegicus
gtacaagatggatgaagacggcttc

SEQ ID NO: 626590 - DNA, 25 bp, Rattus norvegicus
tgaagacggcttcctaaggcagcga

SEQ ID NO: 626591 - DNA, 25 bp, Rattus norvegicus
agacggcttcctaaggcagcgaggc

SEQ ID NO: 626592 - DNA, 25 bp, Rattus norvegicus
ggctcacaccgttgcggtacgacct

SEQ ID NO: 626593 - DNA, 25 bp, Rattus norvegicus
cggggatgtcttcgagtacaattca

SEQ ID NO: 626594 - DNA, 25 bp, Rattus norvegicus
acaccgttgcggtacgacctccgag

SEQ ID NO: 626595 - DNA, 25 bp, Rattus norvegicus
ggatgtcttcgagtacaattcagcc

SEQ ID NO: 626596 - DNA, 25 bp, Rattus norvegicus
aggcggggatgtcttcgagtacaat

SEQ ID NO: 626597 - DNA, 25 bp, Rattus norvegicus
gagcgctgcgcctctgttcctctgt

SEQ ID NO: 626598 - DNA, 25 bp, Rattus norvegicus
ttggcccgcctagcaaactccggga

SEQ ID NO: 626599 - DNA, 25 bp, Rattus norvegicus
gatctctggccggtctcaccatgct

SEQ ID NO: 626600 - DNA, 25 bp, Rattus norvegicus
gaagaaagctgctctggcggactgc

SEQ ID NO: 626601 - DNA, 25 bp, Rattus norvegicus
agagcgacccgagagcctgacggca

SEQ ID NO: 626602 - DNA, 25 bp, Rattus norvegicus
aaccttctgtgctttcgggagctgg

SEQ ID NO: 626603 - DNA, 25 bp, Rattus norvegicus
tctccgtgttcggtgtagtagaacc

SEQ ID NO: 626604 - DNA, 25 bp, Rattus norvegicus
cactgtaacataggtctccgtgttc

SEQ ID NO: 626605 - DNA, 25 bp, Rattus norvegicus
ctggacccacctacactgtaacata

SEQ ID NO: 626606 - DNA, 25 bp, Rattus norvegicus
ctttaactctgggtatgggctctgg

SEQ ID NO: 626607 - DNA, 25 bp, Rattus norvegicus
cggagggacgtagctcagttgtaac

SEQ ID NO: 626608 - DNA, 25 bp, Rattus norvegicus
cgactccacctagcgtgatgacgta

SEQ ID NO: 626609 - DNA, 25 bp, Rattus norvegicus
tccgggacacaatcacgcatgctca

SEQ ID NO: 626610 - DNA, 25 bp, Rattus norvegicus
gactgccaaactgcgcgtgcgggac

SEQ ID NO: 626611 - DNA, 25 bp, Rattus norvegicus
ctccggaaaagaagttgaggcgcta

SEQ ID NO: 626612 - DNA, 25 bp, Rattus norvegicus
ccagtccgcggccactgcatcacgg

SEQ ID NO: 626613 - DNA, 25 bp, Rattus norvegicus
atcacgggcagcgtcagcggcatgt

SEQ ID NO: 626614 - DNA, 25 bp, Rattus norvegicus
ctgcatcacgggcagcgtcagcggc

SEQ ID NO: 626615 - DNA, 25 bp, Rattus norvegicus
ggtggctgccggcttccttccagtc

SEQ ID NO: 626616 - DNA, 25 bp, Rattus norvegicus
cccacaaagggcgaggcgccgcgcc

SEQ ID NO: 626617 - DNA, 25 bp, Rattus norvegicus
gaaaagaagttgaggcgctatgtga

SEQ ID NO: 626618 - DNA, 25 bp, Rattus norvegicus
ggctgaggaaatcgcctccggaaaa

SEQ ID NO: 626619 - DNA, 25 bp, Rattus norvegicus
ccggctggctgaggaaatcgcctcc

SEQ ID NO: 626620 - DNA, 25 bp, Rattus norvegicus
gctccagtcagcgggcgacatgagc

SEQ ID NO: 626621 - DNA, 25 bp, Rattus norvegicus
cgcccgcgcccttgtccgcgcgagc

SEQ ID NO: 626622 - DNA, 25 bp, Rattus norvegicus
accggcagccggctgacccagcagc

SEQ ID NO: 626623 - DNA, 25 bp, Rattus norvegicus
gagagcccgcttgctgaggcgccct

SEQ ID NO: 626624 - DNA, 25 bp, Rattus norvegicus
acctgtcacaggtgcgccgccgagg

SEQ ID NO: 626625 - DNA, 25 bp, Rattus norvegicus
cacctgtgcaggagatgaccgcgaa

SEQ ID NO: 626626 - DNA, 25 bp, Rattus norvegicus
ctcgcagggtaggacgaagtcacca

SEQ ID NO: 626627 - DNA, 25 bp, Rattus norvegicus
actctatcgcgtgcgcaccgagttc

SEQ ID NO: 626628 - DNA, 25 bp, Rattus norvegicus
agtcaccacggcctccaggatcttg

SEQ ID NO: 626629 - DNA, 25 bp, Rattus norvegicus
ccttgcttcacactcgcagggtagg

SEQ ID NO: 626630 - DNA, 25 bp, Rattus norvegicus
aagggctgccgtgcagcctccagca

SEQ ID NO: 626631 - DNA, 25 bp, Rattus norvegicus
cgctgaagaactcggcgaagacgtc

SEQ ID NO: 626632 - DNA, 25 bp, Rattus norvegicus
ctgcagcaggcgcaaaacgcggcgc

SEQ ID NO: 626633 - DNA, 25 bp, Rattus norvegicus
agtcctagctgcacgcaggccagcg

SEQ ID NO: 626634 - DNA, 25 bp, Rattus norvegicus
ctaggcagcgcaccagctgctggca

SEQ ID NO: 626635 - DNA, 25 bp, Rattus norvegicus
tgaccgcgaacagctccttgaggca

SEQ ID NO: 626636 - DNA, 25 bp, Rattus norvegicus
gggcagcacacccacctgtgcagga

SEQ ID NO: 626637 - DNA, 25 bp, Rattus norvegicus
tcgggcagcagctgcagtcctagct

SEQ ID NO: 626638 - DNA, 25 bp, Rattus norvegicus
ggcctccaggatcttgtccatgatg

SEQ ID NO: 626639 - DNA, 25 bp, Rattus norvegicus
acgcatacgggtctctcggggcagc

SEQ ID NO: 626640 - DNA, 25 bp, Rattus norvegicus
ggggctaccctgagagctcccagtc

SEQ ID NO: 626641 - DNA, 25 bp, Rattus norvegicus
taccctgagagctcccagtcgggct

SEQ ID NO: 626642 - DNA, 25 bp, Rattus norvegicus
ccctttaaggccagctgaccggagt

SEQ ID NO: 626643 - DNA, 25 bp, Rattus norvegicus
ccagtagtgggctggctctccgcgt

SEQ ID NO: 626644 - DNA, 25 bp, Rattus norvegicus
ctcgctgttctcatctgtgaagtgg

SEQ ID NO: 626645 - DNA, 25 bp, Rattus norvegicus
tctccgcgtagcctcctgggaggtg

SEQ ID NO: 626646 - DNA, 25 bp, Rattus norvegicus
atctgtctcagcctcgctgttctca

SEQ ID NO: 626647 - DNA, 25 bp, Rattus norvegicus
aggagcacggagtggactacaagtc

SEQ ID NO: 626648 - DNA, 25 bp, Rattus norvegicus
gttctggacccagcggacgcatacg

SEQ ID NO: 626649 - DNA, 25 bp, Rattus norvegicus
tcggggcagctgtcctgccgtgaaa

SEQ ID NO: 626650 - DNA, 25 bp, Rattus norvegicus
tctcatctgtgaagtggggtagccc

SEQ ID NO: 626651 - DNA, 25 bp, Rattus norvegicus
ctgccgtgaaaggtcatctgtctca

SEQ ID NO: 626652 - DNA, 25 bp, Rattus norvegicus
ccctagcgaagctgcgctggctgga

SEQ ID NO: 626653 - DNA, 25 bp, Rattus norvegicus
tcgtaaagtgtatctgggcgccagc

SEQ ID NO: 626654 - DNA, 25 bp, Rattus norvegicus
ccgcatcgaccgcaaggtgcaaagc

SEQ ID NO: 626655 - DNA, 25 bp, Rattus norvegicus
ttcgtcgcaaatacgcctgcggcgg

SEQ ID NO: 626656 - DNA, 25 bp, Rattus norvegicus
ttctagattctcttagccgctgtcg

SEQ ID NO: 626657 - DNA, 25 bp, Rattus norvegicus
cccgctgtgccgtaaagcaagtctc

SEQ ID NO: 626658 - DNA, 25 bp, Rattus norvegicus
cctcgtgatagaccttggttcctta

SEQ ID NO: 626659 - DNA, 25 bp, Rattus norvegicus
tagctctggatgcttcagtgccgta

SEQ ID NO: 626660 - DNA, 25 bp, Rattus norvegicus
tcagtgccgtaaagcatatcaggcc

SEQ ID NO: 626661 - DNA, 25 bp, Rattus norvegicus
cacccgcgcactgggcgcttggtaa

SEQ ID NO: 626662 - DNA, 25 bp, Rattus norvegicus
agcagccgggccaagagtttaacca

SEQ ID NO: 626663 - DNA, 25 bp, Rattus norvegicus
tttaaccacgggctggtgctgagcc

SEQ ID NO: 626664 - DNA, 25 bp, Rattus norvegicus
gcgggcgtttcttccattcactgtc

SEQ ID NO: 626665 - DNA, 25 bp, Rattus norvegicus
gacgcgtcttcactgtccgcatcga

SEQ ID NO: 626666 - DNA, 25 bp, Rattus norvegicus
agccgagaacccttgcgcgacggac

SEQ ID NO: 626667 - DNA, 25 bp, Rattus norvegicus
ggtttaaatgctggcgctctctcca

SEQ ID NO: 626668 - DNA, 25 bp, Rattus norvegicus
agtccttatccgcatgcgcagcgtc

SEQ ID NO: 626669 - DNA, 25 bp, Rattus norvegicus
agacagggcgcgaggtttaaatgct

SEQ ID NO: 626670 - DNA, 25 bp, Rattus norvegicus
gcgcaggcgcagataagtcctctct

SEQ ID NO: 626671 - DNA, 25 bp, Rattus norvegicus
gcgtccgggaagtgacgggactcca

SEQ ID NO: 626672 - DNA, 25 bp, Rattus norvegicus
cgggactccaggaatggcggcgttt

SEQ ID NO: 626673 - DNA, 25 bp, Rattus norvegicus
tctacagtccttatccgcatgcgca

SEQ ID NO: 626674 - DNA, 25 bp, Rattus norvegicus
gggcaccgcctctacagtccttatc

SEQ ID NO: 626675 - DNA, 25 bp, Rattus norvegicus
atgcgcacagctcacgggcaccgcc

SEQ ID NO: 626676 - DNA, 25 bp, Rattus norvegicus
ccagcgcccgagcagctggcgcatg

SEQ ID NO: 626677 - DNA, 25 bp, Rattus norvegicus
gcgaggtttaaatgctggcgctctc

SEQ ID NO: 626678 - DNA, 25 bp, Rattus norvegicus
ctctgtctgggagactacggagaca

SEQ ID NO: 626679 - DNA, 25 bp, Rattus norvegicus
tcctctctgtctgggagactacgga

SEQ ID NO: 626680 - DNA, 25 bp, Rattus norvegicus
agataagtcctctctgtctgggaga

SEQ ID NO: 626681 - DNA, 25 bp, Rattus norvegicus
cacgggcctgatggacaacatgatg

SEQ ID NO: 626682 - DNA, 25 bp, Rattus norvegicus
gcgcgagccacattaaagaaaccca

SEQ ID NO: 626683 - DNA, 25 bp, Rattus norvegicus
cgtctagagttttcagcgcgagcca

SEQ ID NO: 626684 - DNA, 25 bp, Rattus norvegicus
gtcagcctcccggatccgtgctttt

SEQ ID NO: 626685 - DNA, 25 bp, Rattus norvegicus
acagggttgtctactaaggtcagcc

SEQ ID NO: 626686 - DNA, 25 bp, Rattus norvegicus
tgcgaatgagacctgtgatgaaagc

SEQ ID NO: 626687 - DNA, 25 bp, Rattus norvegicus
tgcgccgcaactgggaattctaaac

SEQ ID NO: 626688 - DNA, 25 bp, Rattus norvegicus
gcggcttgtctacatcggcttcctg

SEQ ID NO: 626689 - DNA, 25 bp, Rattus norvegicus
ggccatgagcccttaagattcttgc

SEQ ID NO: 626690 - DNA, 25 bp, Rattus norvegicus
atcaatatgatgaacggccggccgg

SEQ ID NO: 626691 - DNA, 25 bp, Rattus norvegicus
acctcacgtggaacccgcatcaata

SEQ ID NO: 626692 - DNA, 25 bp, Rattus norvegicus
gctaaacggttgtgcgctccatttc

SEQ ID NO: 626693 - DNA, 25 bp, Rattus norvegicus
tccgtaaaggactcaagaggggctc

SEQ ID NO: 626694 - DNA, 25 bp, Rattus norvegicus
ggctcctcacagttcgcgcagtact

SEQ ID NO: 626695 - DNA, 25 bp, Rattus norvegicus
tgtcttgttaccctgctgttgctgc

SEQ ID NO: 626696 - DNA, 25 bp, Rattus norvegicus
cacagatggcaggagctccggcgac

SEQ ID NO: 626697 - DNA, 25 bp, Rattus norvegicus
cgccgccaccgtttttagtgtgcat

SEQ ID NO: 626698 - DNA, 25 bp, Rattus norvegicus
caggtgattgagctcgctgctgctt

SEQ ID NO: 626699 - DNA, 25 bp, Rattus norvegicus
ttgtccctaggcctagcaggtgatt

SEQ ID NO: 626700 - DNA, 25 bp, Rattus norvegicus
ggcctgtcggagagaattgtcccta

SEQ ID NO: 626701 - DNA, 25 bp, Rattus norvegicus
accaccaggggctcacagatggcag

SEQ ID NO: 626702 - DNA, 25 bp, Rattus norvegicus
ctgctgccgaacagaattgagttta

SEQ ID NO: 626703 - DNA, 25 bp, Rattus norvegicus
gcgcctcgaccggttgtcttgttac

SEQ ID NO: 626704 - DNA, 25 bp, Rattus norvegicus
ggtggctccacaggcagtccagacc

SEQ ID NO: 626705 - DNA, 25 bp, Rattus norvegicus
ccgattctatttcctggggtggctc

SEQ ID NO: 626706 - DNA, 25 bp, Rattus norvegicus
gctcccggagtttctgctgcccggg

SEQ ID NO: 626707 - DNA, 25 bp, Rattus norvegicus
atggaactggatgagctcagactgc

SEQ ID NO: 626708 - DNA, 25 bp, Rattus norvegicus
agcagcccgctccttcttgagatgg

SEQ ID NO: 626709 - DNA, 25 bp, Rattus norvegicus
cgatctaattccgtctcccagcaga

SEQ ID NO: 626710 - DNA, 25 bp, Rattus norvegicus
cggcagccaatcgactcactgggca

SEQ ID NO: 626711 - DNA, 25 bp, Rattus norvegicus
ccatggcggcccacctgaaaaagcg

SEQ ID NO: 626712 - DNA, 25 bp, Rattus norvegicus
tcactgggcagtcgagcttcaggaa

SEQ ID NO: 626713 - DNA, 25 bp, Rattus norvegicus
tctatccagctaccctagtgcattg

SEQ ID NO: 626714 - DNA, 25 bp, Rattus norvegicus
ccagctaccctagtgcattgtggga

SEQ ID NO: 626715 - DNA, 25 bp, Rattus norvegicus
ccctagtgcattgtgggattgcggc

SEQ ID NO: 626716 - DNA, 25 bp, Rattus norvegicus
agcagaagcggcagccaatcgactc

SEQ ID NO: 626717 - DNA, 25 bp, Rattus norvegicus
tcggtgctgtagaaaggtttacctc

SEQ ID NO: 626718 - DNA, 25 bp, Rattus norvegicus
ggtttacctccgcactcttggcaag

SEQ ID NO: 626719 - DNA, 25 bp, Rattus norvegicus
ctccgcactcttggcaagtacagta

SEQ ID NO: 626720 - DNA, 25 bp, Rattus norvegicus
gcaagtacagtagccgagaaggtcc

SEQ ID NO: 626721 - DNA, 25 bp, Rattus norvegicus
tacagtagccgagaaggtccggcgc

SEQ ID NO: 626722 - DNA, 25 bp, Rattus norvegicus
cgagcttcaggaagcggcctctcta

SEQ ID NO: 626723 - DNA, 25 bp, Rattus norvegicus
cccattggctatcgttctcagaaag

SEQ ID NO: 626724 - DNA, 25 bp, Rattus norvegicus
ctccacagataccttggggctctgc

SEQ ID NO: 626725 - DNA, 25 bp, Rattus norvegicus
ggcgcgctttagctctccacagata

SEQ ID NO: 626726 - DNA, 25 bp, Rattus norvegicus
gagaaggtaagcgatcggcccgtac

SEQ ID NO: 626727 - DNA, 25 bp, Rattus norvegicus
ccagacatcggccacggagaaggta

SEQ ID NO: 626728 - DNA, 25 bp, Rattus norvegicus
ccgagttgccgttcccagagctgga

SEQ ID NO: 626729 - DNA, 25 bp, Rattus norvegicus
ctccttcttggaacgctacgggccg

SEQ ID NO: 626730 - DNA, 25 bp, Rattus norvegicus
cgccgtagtctgctccttcttggaa

SEQ ID NO: 626731 - DNA, 25 bp, Rattus norvegicus
tccagttcaaaatggcgacggtggc

SEQ ID NO: 626732 - DNA, 25 bp, Rattus norvegicus
agagcgcctcctgtcgtccataagg

SEQ ID NO: 626733 - DNA, 25 bp, Rattus norvegicus
tcagttctcgactgctccgagccgg

SEQ ID NO: 626734 - DNA, 25 bp, Rattus norvegicus
tgaagggcccagagtgcctctctgt

SEQ ID NO: 626735 - DNA, 25 bp, Rattus norvegicus
ccctgtcacacgaggcagtagcaac

SEQ ID NO: 626736 - DNA, 25 bp, Rattus norvegicus
gccggtgttgcttccagttcttatc

SEQ ID NO: 626737 - DNA, 25 bp, Rattus norvegicus
gcagctccctgcgaaccgggattgc

SEQ ID NO: 626738 - DNA, 25 bp, Rattus norvegicus
cttgtgcctgtctcctgcaagcctg

SEQ ID NO: 626739 - DNA, 25 bp, Rattus norvegicus
gccggctcgctacagatctctgagt

SEQ ID NO: 626740 - DNA, 25 bp, Rattus norvegicus
tgagttgcctagaacatcccgtctc

SEQ ID NO: 626741 - DNA, 25 bp, Rattus norvegicus
tggtcaactgcacgcgaaattcctc

SEQ ID NO: 626742 - DNA, 25 bp, Rattus norvegicus
tcctcgatgagaaagttgttcttcc

SEQ ID NO: 626743 - DNA, 25 bp, Rattus norvegicus
tcttccggagtacggctactgcttc

SEQ ID NO: 626744 - DNA, 25 bp, Rattus norvegicus
gtgctctgctttcttggttcctgtg

SEQ ID NO: 626745 - DNA, 25 bp, Rattus norvegicus
gcccgcaatgagcttcctcaaaagc

SEQ ID NO: 626746 - DNA, 25 bp, Rattus norvegicus
ccagacaccgaagctgtgctgaacg

SEQ ID NO: 626747 - DNA, 25 bp, Rattus norvegicus
accggcacgctttacattgcggaga

SEQ ID NO: 626748 - DNA, 25 bp, Rattus norvegicus
agctcagctggctctgttctcatta

SEQ ID NO: 626749 - DNA, 25 bp, Rattus norvegicus
ggagcaatgctttcgcccgcaatga

SEQ ID NO: 626750 - DNA, 25 bp, Rattus norvegicus
tgttctcattaacgacttgtgcctg

SEQ ID NO: 626751 - DNA, 25 bp, Rattus norvegicus
gctgcgctgtgcagatgtgacctga

SEQ ID NO: 626752 - DNA, 25 bp, Rattus norvegicus
tgtgcagctgttgccgggcgatcac

SEQ ID NO: 626753 - DNA, 25 bp, Rattus norvegicus
agcacgaccaacagcattagtccca

SEQ ID NO: 626754 - DNA, 25 bp, Rattus norvegicus
caacagcattagtcccagcgagatg

SEQ ID NO: 626755 - DNA, 25 bp, Rattus norvegicus
ttagtcccagcgagatgcaggtgtc

SEQ ID NO: 626756 - DNA, 25 bp, Rattus norvegicus
gatgcaggtgtcctgcacctcgggc

SEQ ID NO: 626757 - DNA, 25 bp, Rattus norvegicus
cagtagcgcggacatggttccctca

SEQ ID NO: 626758 - DNA, 25 bp, Rattus norvegicus
ctcaccgctagggatggctgagagc

SEQ ID NO: 626759 - DNA, 25 bp, Rattus norvegicus
ggacaacggtcagcagagccccacg

SEQ ID NO: 626760 - DNA, 25 bp, Rattus norvegicus
ggctggacccggagtctaagaccgc

SEQ ID NO: 626761 - DNA, 25 bp, Rattus norvegicus
ctaagaccgcgccacgctgatgaca

SEQ ID NO: 626762 - DNA, 25 bp, Rattus norvegicus
acgctgatgacagcgcctgtggcgc

SEQ ID NO: 626763 - DNA, 25 bp, Rattus norvegicus
tggaccatgggcctgtgcagctgtt

SEQ ID NO: 626764 - DNA, 25 bp, Rattus norvegicus
ggacatggttccctcaccgctaggg

SEQ ID NO: 626765 - DNA, 25 bp, Rattus norvegicus
cgagccgggctgcatacaatagcaa

SEQ ID NO: 626766 - DNA, 25 bp, Rattus norvegicus
actgcacctctaggctgcgcggagt

SEQ ID NO: 626767 - DNA, 25 bp, Rattus norvegicus
acgtcacgtggcagccaggtgattc

SEQ ID NO: 626768 - DNA, 25 bp, Rattus norvegicus
ccaggtgattccctagcctctggcg

SEQ ID NO: 626769 - DNA, 25 bp, Rattus norvegicus
agcctctggcgtcaagtgctgatga

SEQ ID NO: 626770 - DNA, 25 bp, Rattus norvegicus
ggcgtcaagtgctgatgacgtcatc

SEQ ID NO: 626771 - DNA, 25 bp, Rattus norvegicus
cctggttcacgtgggtctgtccagc

SEQ ID NO: 626772 - DNA, 25 bp, Rattus norvegicus
atacaatagcaaggctgcgacccgg

SEQ ID NO: 626773 - DNA, 25 bp, Rattus norvegicus
tctcggctattaccggctctttgca

SEQ ID NO: 626774 - DNA, 25 bp, Rattus norvegicus
ctctctctgggtttggctgccgcca

SEQ ID NO: 626775 - DNA, 25 bp, Rattus norvegicus
cgcagaaggtgagagctggcctccc

SEQ ID NO: 626776 - DNA, 25 bp, Rattus norvegicus
tcccgcgacggtgctcggggcatca

SEQ ID NO: 626777 - DNA, 25 bp, Rattus norvegicus
cctggccgcgttggcctggttcacg

SEQ ID NO: 626778 - DNA, 25 bp, Rattus norvegicus
cgcggagtcctctcggctattaccg

SEQ ID NO: 626779 - DNA, 25 bp, Rattus norvegicus
atcacttttcgggttcattgccttg

SEQ ID NO: 626780 - DNA, 25 bp, Rattus norvegicus
tggtagtaaatgacttgtgctaccc

SEQ ID NO: 626781 - DNA, 25 bp, Rattus norvegicus
gcttgggaatcacttttcgggttca

SEQ ID NO: 626782 - DNA, 25 bp, Rattus norvegicus
cagactggtagtaaatgacttgtgc

SEQ ID NO: 626783 - DNA, 25 bp, Rattus norvegicus
cattgccttgaaaaacagactggta

SEQ ID NO: 626784 - DNA, 25 bp, Rattus norvegicus
ttcgggttcattgccttgaaaaaca

SEQ ID NO: 626785 - DNA, 25 bp, Rattus norvegicus
tgaagcagtgaggatttattctccg

SEQ ID NO: 626786 - DNA, 25 bp, Rattus norvegicus
aggatttattctccgtggtcagccc

SEQ ID NO: 626787 - DNA, 25 bp, Rattus norvegicus
tcctggtacgctaaaactggcccgc

SEQ ID NO: 626788 - DNA, 25 bp, Rattus norvegicus
acgcagatgctaagtgaagcagtga

SEQ ID NO: 626789 - DNA, 25 bp, Rattus norvegicus
aactggcccgcgacgcagatgctaa

SEQ ID NO: 626790 - DNA, 25 bp, Rattus norvegicus
cctgtgcgaccacgggttcccgaag

SEQ ID NO: 626791 - DNA, 25 bp, Rattus norvegicus
gccgaccgctcccttcgggccaaca

SEQ ID NO: 626792 - DNA, 25 bp, Rattus norvegicus
gcccgcgacgcagatgctaagtgaa

SEQ ID NO: 626793 - DNA, 25 bp, Rattus norvegicus
gcctggaactttattatgcgctgtc

SEQ ID NO: 626794 - DNA, 25 bp, Rattus norvegicus
agggcctgcaaccgcaggaagccaa

SEQ ID NO: 626795 - DNA, 25 bp, Rattus norvegicus
tactgtttgtgcagtttccgggagc

SEQ ID NO: 626796 - DNA, 25 bp, Rattus norvegicus
caggcggtactgtttgtgcagtttc

SEQ ID NO: 626797 - DNA, 25 bp, Rattus norvegicus
tatgcgctgtctggccaggcggtac

SEQ ID NO: 626798 - DNA, 25 bp, Rattus norvegicus
gaactttattatgcgctgtctggcc

SEQ ID NO: 626799 - DNA, 25 bp, Rattus norvegicus
cgggcctggaactttattatgcgct

SEQ ID NO: 626800 - DNA, 25 bp, Rattus norvegicus
gaaggccctgcgcaccaggtaggcc

SEQ ID NO: 626801 - DNA, 25 bp, Rattus norvegicus
ggcctgcacggtgatcacggcccag

SEQ ID NO: 626802 - DNA, 25 bp, Rattus norvegicus
cataggcctgcacggtgatcacggc

SEQ ID NO: 626803 - DNA, 25 bp, Rattus norvegicus
ccgggcataggcctgcacggtgatc

SEQ ID NO: 626804 - DNA, 25 bp, Rattus norvegicus
ggcgcgcaatcatgccccgggcata

SEQ ID NO: 626805 - DNA, 25 bp, Rattus norvegicus
cgccggtgtagccggcgcgcaatca

SEQ ID NO: 626806 - DNA, 25 bp, Rattus norvegicus
tttattatgcgctgtctggccaggc

SEQ ID NO: 626807 - DNA, 25 bp, Rattus norvegicus
gggtcgcagtacctctgagctccca

SEQ ID NO: 626808 - DNA, 25 bp, Rattus norvegicus
ggtggctctgctatctacgaacttg

SEQ ID NO: 626809 - DNA, 25 bp, Rattus norvegicus
acactcggcccagggtggctctgct

SEQ ID NO: 626810 - DNA, 25 bp, Rattus norvegicus
agcgggaggacagacactcggccca

SEQ ID NO: 626811 - DNA, 25 bp, Rattus norvegicus
acatcatgatggagcgggagcgcaa

SEQ ID NO: 626812 - DNA, 25 bp, Rattus norvegicus
gtccgaccgtcggatatgacgtaga

SEQ ID NO: 626813 - DNA, 25 bp, Rattus norvegicus
ttccaacgccatggccagggctctg

SEQ ID NO: 626814 - DNA, 25 bp, Rattus norvegicus
aatcagtgacagagtcgggtgccca

SEQ ID NO: 626815 - DNA, 25 bp, Rattus norvegicus
ctggtgcccgggacacgtgatcgaa

SEQ ID NO: 626816 - DNA, 25 bp, Rattus norvegicus
cccgcctgaggtctggcaatcagtg

SEQ ID NO: 626817 - DNA, 25 bp, Rattus norvegicus
cgctgagtcgtttcccgtcgtgact

SEQ ID NO: 626818 - DNA, 25 bp, Rattus norvegicus
ttcctttcgtccaatccgctgagtc

SEQ ID NO: 626819 - DNA, 25 bp, Rattus norvegicus
tcggatatgacgtagagaccaaggc

SEQ ID NO: 626820 - DNA, 25 bp, Rattus norvegicus
tgactccggaaggatttgtccgacc

SEQ ID NO: 626821 - DNA, 25 bp, Rattus norvegicus
gggcgcttctctgaaaccgcagccg

SEQ ID NO: 626822 - DNA, 25 bp, Rattus norvegicus
aagtttcgcaccagagcccacttgc

SEQ ID NO: 626823 - DNA, 25 bp, Rattus norvegicus
attcccagggcgcttctctgaaacc

SEQ ID NO: 626824 - DNA, 25 bp, Rattus norvegicus
agcgcttggttcaagtttcgcacca

SEQ ID NO: 626825 - DNA, 25 bp, Rattus norvegicus
tcaccggcaggaccgcgaaggtctt

SEQ ID NO: 626826 - DNA, 25 bp, Rattus norvegicus
cttcgcctaggtcagcagggctttt

SEQ ID NO: 626827 - DNA, 25 bp, Rattus norvegicus
cgctgggtctggtggcctcacgaca

SEQ ID NO: 626828 - DNA, 25 bp, Rattus norvegicus
tggcctcacgacaggacgcaggctc

SEQ ID NO: 626829 - DNA, 25 bp, Rattus norvegicus
ggacgcaggctcctaattcacctaa

SEQ ID NO: 626830 - DNA, 25 bp, Rattus norvegicus
gcgcaccaccctctcgggaacccta

SEQ ID NO: 626831 - DNA, 25 bp, Rattus norvegicus
ctaaacccagccatctgccaggggc

SEQ ID NO: 626832 - DNA, 25 bp, Rattus norvegicus
caacggcggcttaggtgacgcccgt

SEQ ID NO: 626833 - DNA, 25 bp, Rattus norvegicus
tcccactgagggaccttgacaaccc

SEQ ID NO: 626834 - DNA, 25 bp, Rattus norvegicus
cgaaggtcttgagcgcttggttcaa

SEQ ID NO: 626835 - DNA, 25 bp, Rattus norvegicus
ggactctgcggggaaacgctgcccc

SEQ ID NO: 626836 - DNA, 25 bp, Rattus norvegicus
gaggcacgcactggaccgcgctgca

SEQ ID NO: 626837 - DNA, 25 bp, Rattus norvegicus
gcacactaatgtgcgctcgcacacg

SEQ ID NO: 626838 - DNA, 25 bp, Rattus norvegicus
gcagcgcctcctacctgccgcgtcg

SEQ ID NO: 626839 - DNA, 25 bp, Rattus norvegicus
agccggactcctgagatgcagggca

SEQ ID NO: 626840 - DNA, 25 bp, Rattus norvegicus
ggaggttggatctgcccgcgccaca

SEQ ID NO: 626841 - DNA, 25 bp, Rattus norvegicus
gcccgcgccacagcctgggactctg

SEQ ID NO: 626842 - DNA, 25 bp, Rattus norvegicus
cgcctcgcagcctcctccgattgga

SEQ ID NO: 626843 - DNA, 25 bp, Rattus norvegicus
tcctccgattggaggccagaggcgt

SEQ ID NO: 626844 - DNA, 25 bp, Rattus norvegicus
catgcgaactggagaggccgttctc

SEQ ID NO: 626845 - DNA, 25 bp, Rattus norvegicus
gagaggccgttctcctcgaggccgc

SEQ ID NO: 626846 - DNA, 25 bp, Rattus norvegicus
gcgggacatacaacccctgctcgga

SEQ ID NO: 626847 - DNA, 25 bp, Rattus norvegicus
cgaggccgccccgatagtgctggct

SEQ ID NO: 626848 - DNA, 25 bp, Rattus norvegicus
ttcgtgcttccgaggcacgcactgg

SEQ ID NO: 626849 - DNA, 25 bp, Rattus norvegicus
tcgcagctgagcaggaagctcattc

SEQ ID NO: 626850 - DNA, 25 bp, Rattus norvegicus
agcagcatctcataaggcgcgaagc

SEQ ID NO: 626851 - DNA, 25 bp, Rattus norvegicus
cacatgcccatgtaggcgtcgtcga

SEQ ID NO: 626852 - DNA, 25 bp, Rattus norvegicus
gtacttgctccagctttcgcggatg

SEQ ID NO: 626853 - DNA, 25 bp, Rattus norvegicus
tgggcacagaaccagccataagctg

SEQ ID NO: 626854 - DNA, 25 bp, Rattus norvegicus
tagcgggcaactcctggaagccatc

SEQ ID NO: 626855 - DNA, 25 bp, Rattus norvegicus
atccaggaggtccacagagacgttg

SEQ ID NO: 626856 - DNA, 25 bp, Rattus norvegicus
tcctctgtccagtcgagcaggtgca

SEQ ID NO: 626857 - DNA, 25 bp, Rattus norvegicus
ttgaagtcccactgcagcacgtcgc

SEQ ID NO: 626858 - DNA, 25 bp, Rattus norvegicus
ggcgacgacttcactgccagcaaca

SEQ ID NO: 626859 - DNA, 25 bp, Rattus norvegicus
ccacgcatttgtgtggcgcgtccca

SEQ ID NO: 626860 - DNA, 25 bp, Rattus norvegicus
gcggtagcgcaggaaatcttggatc

SEQ ID NO: 626861 - DNA, 25 bp, Rattus norvegicus
tcgtgcagcgccttccacatgagca

SEQ ID NO: 626862 - DNA, 25 bp, Rattus norvegicus
ccgtgtgcacgaagacgtcgtcgtc

SEQ ID NO: 626863 - DNA, 25 bp, Rattus norvegicus
ttccacgaatagacaaagctccaca

SEQ ID NO: 626864 - DNA, 25 bp, Rattus norvegicus
tcagtcgatctcttctcgccgggct

SEQ ID NO: 626865 - DNA, 25 bp, Rattus norvegicus
tcccacaaacaaagggttcttgaga

SEQ ID NO: 626866 - DNA, 25 bp, Rattus norvegicus
ctttgttcactcactttaatgctca

SEQ ID NO: 626867 - DNA, 25 bp, Rattus norvegicus
tgctcagtcgatctcttctcgccgg

SEQ ID NO: 626868 - DNA, 25 bp, Rattus norvegicus
cgcgcttccgggacttctctttgtt

SEQ ID NO: 626869 - DNA, 25 bp, Rattus norvegicus
tcctggggtggcatttccacgaata

SEQ ID NO: 626870 - DNA, 25 bp, Rattus norvegicus
tggcatttccacgaatagacaaagc

SEQ ID NO: 626871 - DNA, 25 bp, Rattus norvegicus
ttccgggacttctctttgttcactc

SEQ ID NO: 626872 - DNA, 25 bp, Rattus norvegicus
gaatagacaaagctccacagacccg

SEQ ID NO: 626873 - DNA, 25 bp, Rattus norvegicus
caaagggttcttgagaagataccga

SEQ ID NO: 626874 - DNA, 25 bp, Rattus norvegicus
cttgagaagataccgagaaacgatt

SEQ ID NO: 626875 - DNA, 25 bp, Rattus norvegicus
agataccgagaaacgattaatttag

SEQ ID NO: 626876 - DNA, 25 bp, Rattus norvegicus
ctcactttaatgctcagtcgatctc

SEQ ID NO: 626877 - DNA, 25 bp, Rattus norvegicus
tcgggttagcgttcagggccctctc

SEQ ID NO: 626878 - DNA, 25 bp, Rattus norvegicus
agattctgtagctctcccgcctggg

SEQ ID NO: 626879 - DNA, 25 bp, Rattus norvegicus
cctgatggcctggagagattctgta

SEQ ID NO: 626880 - DNA, 25 bp, Rattus norvegicus
tagagccgtcactgaacctgcccag

SEQ ID NO: 626881 - DNA, 25 bp, Rattus norvegicus
ctcacaccagtccaatgtggaggtc

SEQ ID NO: 626882 - DNA, 25 bp, Rattus norvegicus
cagcgacgaacaaggtcaccacata

SEQ ID NO: 626883 - DNA, 25 bp, Rattus norvegicus
tcacagaactcagcgacgaacaagg

SEQ ID NO: 626884 - DNA, 25 bp, Rattus norvegicus
tggagcctaccctcgcggccaggtt

SEQ ID NO: 626885 - DNA, 25 bp, Rattus norvegicus
ctcacgctctcctctgaggtctagg

SEQ ID NO: 626886 - DNA, 25 bp, Rattus norvegicus
tattcacagcggagcgcctcacgct

SEQ ID NO: 626887 - DNA, 25 bp, Rattus norvegicus
ggtaagaactcctattcacagcgga

SEQ ID NO: 626888 - DNA, 25 bp, Rattus norvegicus
gcagccgcgctcaggtaagaactcc

SEQ ID NO: 626889 - DNA, 25 bp, Rattus norvegicus
tcctcagctccgacttcaaggcggg

SEQ ID NO: 626890 - DNA, 25 bp, Rattus norvegicus
ccgacctcgacgtgcggtggagcaa

SEQ ID NO: 626891 - DNA, 25 bp, Rattus norvegicus
ggatactcaacccagacacgtcgac

SEQ ID NO: 626892 - DNA, 25 bp, Rattus norvegicus
ccggaaaagttgaggggcctcagca

SEQ ID NO: 626893 - DNA, 25 bp, Rattus norvegicus
tcgcaccggcctgctcacaggatgg

SEQ ID NO: 626894 - DNA, 25 bp, Rattus norvegicus
atctcgctgcgcttcgggacagcac

SEQ ID NO: 626895 - DNA, 25 bp, Rattus norvegicus
tgggccagcgcttttctcggagccc

SEQ ID NO: 626896 - DNA, 25 bp, Rattus norvegicus
ttcttacaaagaccctggaggcgcc

SEQ ID NO: 626897 - DNA, 25 bp, Rattus norvegicus
gacccactaccgtgagatgcacgtg

SEQ ID NO: 626898 - DNA, 25 bp, Rattus norvegicus
gcagatgctagcttccgaacccaaa

SEQ ID NO: 626899 - DNA, 25 bp, Rattus norvegicus
cacacaaaggcacaggcagatgcta

SEQ ID NO: 626900 - DNA, 25 bp, Rattus norvegicus
caccggggcgagatagccatgcaaa

SEQ ID NO: 626901 - DNA, 25 bp, Rattus norvegicus
cgtcgacaagcctagaccacgtatg

SEQ ID NO: 626902 - DNA, 25 bp, Rattus norvegicus
gcagagcctttgtcttctgaaagcc

SEQ ID NO: 626903 - DNA, 25 bp, Rattus norvegicus
ctgtggctccgtgtcccggaaaagt

SEQ ID NO: 626904 - DNA, 25 bp, Rattus norvegicus
cgtatgcggacactaggagcgccca

SEQ ID NO: 626905 - DNA, 25 bp, Rattus norvegicus
atttcctccgcggacctgcggctcc

SEQ ID NO: 626906 - DNA, 25 bp, Rattus norvegicus
cccgctcagtttcctttgtgatcct

SEQ ID NO: 626907 - DNA, 25 bp, Rattus norvegicus
gcccacggctgcacgtgcgctgccc

SEQ ID NO: 626908 - DNA, 25 bp, Rattus norvegicus
ccttagtgcggtggcgccaggattt

SEQ ID NO: 626909 - DNA, 25 bp, Rattus norvegicus
tcagtttcctttgtgatccttctcc

SEQ ID NO: 626910 - DNA, 25 bp, Rattus norvegicus
tggcgccaggatttcctccgcggac

SEQ ID NO: 626911 - DNA, 25 bp, Rattus norvegicus
tgctatttaaaaggcgggagccgcc

SEQ ID NO: 626912 - DNA, 25 bp, Rattus norvegicus
atgttcggttcctaggtccgcgcaa

SEQ ID NO: 626913 - DNA, 25 bp, Rattus norvegicus
tgtgcgaacgatgttcggaggagtc

SEQ ID NO: 626914 - DNA, 25 bp, Rattus norvegicus
tggccgagaggggtgctatttaaaa

SEQ ID NO: 626915 - DNA, 25 bp, Rattus norvegicus
tttcggtttcaagtgccgccctggc

SEQ ID NO: 626916 - DNA, 25 bp, Rattus norvegicus
cctaggtccgcgcaactggcagggc

SEQ ID NO: 626917 - DNA, 25 bp, Rattus norvegicus
gagcagaggtgatgttcggttccta

SEQ ID NO: 626918 - DNA, 25 bp, Rattus norvegicus
cccagacctcgcatgcccacggctg

SEQ ID NO: 626919 - DNA, 25 bp, Rattus norvegicus
ctaccctggatagcctgccagcttt

SEQ ID NO: 626920 - DNA, 25 bp, Rattus norvegicus
aggctcctccgccaagactagggga

SEQ ID NO: 626921 - DNA, 25 bp, Rattus norvegicus
cggctcagagctggttccaatgtca

SEQ ID NO: 626922 - DNA, 25 bp, Rattus norvegicus
tgtcccatcaccaggcgtgccggag

SEQ ID NO: 626923 - DNA, 25 bp, Rattus norvegicus
cgcggacagatagccagacggtcca

SEQ ID NO: 626924 - DNA, 25 bp, Rattus norvegicus
aactggggtcgcaccgactatgtcc

SEQ ID NO: 626925 - DNA, 25 bp, Rattus norvegicus
agcctccattcgttcggtctcttca

SEQ ID NO: 626926 - DNA, 25 bp, Rattus norvegicus
cccgccttttgagaaacgagcactc

SEQ ID NO: 626927 - DNA, 25 bp, Rattus norvegicus
aattaggtttgtttgcggtgcctca

SEQ ID NO: 626928 - DNA, 25 bp, Rattus norvegicus
tcggggctcatctaaaaggctcctc

SEQ ID NO: 626929 - DNA, 25 bp, Rattus norvegicus
cacagcaatggaaagccgggcgaca

SEQ ID NO: 626930 - DNA, 25 bp, Rattus norvegicus
cttcagctccgcgttttgaaaggaa

SEQ ID NO: 626931 - DNA, 25 bp, Rattus norvegicus
gaatcaggcaccacgtcacggcatc

SEQ ID NO: 626932 - DNA, 25 bp, Rattus norvegicus
gggcgacagcaaccggagcatgctc

SEQ ID NO: 626933 - DNA, 25 bp, Rattus norvegicus
acgcagtctgacctggccttcttca

SEQ ID NO: 626934 - DNA, 25 bp, Rattus norvegicus
tagagacaccgcagccggccagacg

SEQ ID NO: 626935 - DNA, 25 bp, Rattus norvegicus
gggagactacatcgcatgcgcaatt

SEQ ID NO: 626936 - DNA, 25 bp, Rattus norvegicus
aattccttccttgcgcgggttgagt

SEQ ID NO: 626937 - DNA, 25 bp, Rattus norvegicus
cggccagacgctctcgggtgcgcat

SEQ ID NO: 626938 - DNA, 25 bp, Rattus norvegicus
ccgcgctgccctgacaaggcggtga

SEQ ID NO: 626939 - DNA, 25 bp, Rattus norvegicus
tgcacacggaagagcacgcagtctg

SEQ ID NO: 626940 - DNA, 25 bp, Rattus norvegicus
catcgcatgcgcaattccttccttg

SEQ ID NO: 626941 - DNA, 25 bp, Rattus norvegicus
tggccttcttcagattcccgcggga

SEQ ID NO: 626942 - DNA, 25 bp, Rattus norvegicus
agacttcggcacacgtgcgctcgcg

SEQ ID NO: 626943 - DNA, 25 bp, Rattus norvegicus
cgcaaaggcgaatgaagtgggcact

SEQ ID NO: 626944 - DNA, 25 bp, Rattus norvegicus
aagtgggcactcagcgccttcggtc

SEQ ID NO: 626945 - DNA, 25 bp, Rattus norvegicus
gccggaggaccatgccgaacttctg

SEQ ID NO: 626946 - DNA, 25 bp, Rattus norvegicus
tgcgcgtgcgcatagagacaccgca

SEQ ID NO: 626947 - DNA, 25 bp, Rattus norvegicus
gccaccagcgatactgggtagcagg

SEQ ID NO: 626948 - DNA, 25 bp, Rattus norvegicus
gggctgaggccaccctcctaggact

SEQ ID NO: 626949 - DNA, 25 bp, Rattus norvegicus
agtccgctgcctgacaatctgcgca

SEQ ID NO: 626950 - DNA, 25 bp, Rattus norvegicus
gggacacactgacttcacggcagtc

SEQ ID NO: 626951 - DNA, 25 bp, Rattus norvegicus
gtcgcctatagcacaccaggggaca

SEQ ID NO: 626952 - DNA, 25 bp, Rattus norvegicus
acccgtggactcgaagtcgcctata

SEQ ID NO: 626953 - DNA, 25 bp, Rattus norvegicus
aaagcaaactcctggtcacccgtgg

SEQ ID NO: 626954 - DNA, 25 bp, Rattus norvegicus
ctcttctgggaatgagcagggcaca

SEQ ID NO: 626955 - DNA, 25 bp, Rattus norvegicus
catctgctgcagaccgagaactaca

SEQ ID NO: 626956 - DNA, 25 bp, Rattus norvegicus
agcgccctgtgagtgtccatctgct

SEQ ID NO: 626957 - DNA, 25 bp, Rattus norvegicus
caagcgtaagctgtgtgcctggcta

SEQ ID NO: 626958 - DNA, 25 bp, Rattus norvegicus
cacggggctcgatgtagcgtgcaaa

SEQ ID NO: 626959 - DNA, 25 bp, Rattus norvegicus
tcctaggactctctcggtactctgc

SEQ ID NO: 626960 - DNA, 25 bp, Rattus norvegicus
aggcgtacgcgcatgctcatgtgcg

SEQ ID NO: 626961 - DNA, 25 bp, Rattus norvegicus
taaggaacacttccggtgctacggc

SEQ ID NO: 626962 - DNA, 25 bp, Rattus norvegicus
cgcaagcgtgttagatagatccacc

SEQ ID NO: 626963 - DNA, 25 bp, Rattus norvegicus
aagcgcttccaatcagtcggcaatg

SEQ ID NO: 626964 - DNA, 25 bp, Rattus norvegicus
caatgcgcaggcgtaccggtttttt

SEQ ID NO: 626965 - DNA, 25 bp, Rattus norvegicus
cccttgatggacagttcgagctaca

SEQ ID NO: 626966 - DNA, 25 bp, Rattus norvegicus
gggtaacccttgcagctgcgcaata

SEQ ID NO: 626967 - DNA, 25 bp, Rattus norvegicus
ccgctgctgcacacgggtcttagta

SEQ ID NO: 626968 - DNA, 25 bp, Rattus norvegicus
gcgaacgcactgactcgacctggtc

SEQ ID NO: 626969 - DNA, 25 bp, Rattus norvegicus
ctggcccaaaacgaggttacgcgca

SEQ ID NO: 626970 - DNA, 25 bp, Rattus norvegicus
gtagttccgtctctcgttcctggcc

SEQ ID NO: 626971 - DNA, 25 bp, Rattus norvegicus
tcaccgaacccgtgcggcgataatc

SEQ ID NO: 626972 - DNA, 25 bp, Rattus norvegicus
agcagccctatgacagccgcgcaag

SEQ ID NO: 626973 - DNA, 25 bp, Rattus norvegicus
agcgccggtcctcaacagttcagga

SEQ ID NO: 626974 - DNA, 25 bp, Rattus norvegicus
agttcaggagcctttgccctgtctg

SEQ ID NO: 626975 - DNA, 25 bp, Rattus norvegicus
ttataaagcgcttgggccggccggc

SEQ ID NO: 626976 - DNA, 25 bp, Rattus norvegicus
cgctggcacacaacaggcatgcttt

SEQ ID NO: 626977 - DNA, 25 bp, Rattus norvegicus
ggcatgctttcaacactagccgtgg

SEQ ID NO: 626978 - DNA, 25 bp, Rattus norvegicus
actctcaactcctgagggcggccgg

SEQ ID NO: 626979 - DNA, 25 bp, Rattus norvegicus
aagaagcaatccttggcgctcccgc

SEQ ID NO: 626980 - DNA, 25 bp, Rattus norvegicus
ccgcgtctggaagaagcaatccttg

SEQ ID NO: 626981 - DNA, 25 bp, Rattus norvegicus
gcgcaaccgacagcagctgcgtctg

SEQ ID NO: 626982 - DNA, 25 bp, Rattus norvegicus
cggtccgcgccttataaagcgcttg

SEQ ID NO: 626983 - DNA, 25 bp, Rattus norvegicus
caaagcggcggtccgcgccttataa

SEQ ID NO: 626984 - DNA, 25 bp, Rattus norvegicus
tacggcaatagggtgcaaagtgtcc

SEQ ID NO: 626985 - DNA, 25 bp, Rattus norvegicus
tggcgagcaaattcccttccgtacg

SEQ ID NO: 626986 - DNA, 25 bp, Rattus norvegicus
actagccgtggcgagcaaattccct

SEQ ID NO: 626987 - DNA, 25 bp, Rattus norvegicus
gctccctgctgtgccgcgtctggaa

SEQ ID NO: 626988 - DNA, 25 bp, Rattus norvegicus
ccttccgtacggcaatagggtgcaa

SEQ ID NO: 626989 - DNA, 25 bp, Rattus norvegicus
ggccgctctcggatctcacctaatc

SEQ ID NO: 626990 - DNA, 25 bp, Rattus norvegicus
tctcttcgccctggcgctccacacc

SEQ ID NO: 626991 - DNA, 25 bp, Rattus norvegicus
cgcaggtctgcgaggctcttctctt

SEQ ID NO: 626992 - DNA, 25 bp, Rattus norvegicus
cacgcgcgacgatgagggcgcggcc

SEQ ID NO: 626993 - DNA, 25 bp, Rattus norvegicus
gcgcggcttctgcagggtgcgaccc

SEQ ID NO: 626994 - DNA, 25 bp, Rattus norvegicus
ttctccgtgattgcaggcggcgtgc

SEQ ID NO: 626995 - DNA, 25 bp, Rattus norvegicus
cgcgccgccttaacccgccgccctg

SEQ ID NO: 626996 - DNA, 25 bp, Rattus norvegicus
taatttgaataaaacgcctcccagc

SEQ ID NO: 626997 - DNA, 25 bp, Rattus norvegicus
cttcttcgcacagcctcctcggccc

SEQ ID NO: 626998 - DNA, 25 bp, Rattus norvegicus
agagcgaacgccttcttcgcacagc

SEQ ID NO: 626999 - DNA, 25 bp, Rattus norvegicus
tctcggggagagagcgaacgccttc

SEQ ID NO: 627000 - DNA, 25 bp, Rattus norvegicus
tcacctaatccgagcccgacgccgg

SEQ ID NO: 627001 - DNA, 25 bp, Rattus norvegicus
gccctgttctccgtgattgcaggcg

SEQ ID NO: 627002 - DNA, 25 bp, Rattus norvegicus
tgcgaggctcttctcttcgccctgg

SEQ ID NO: 627003 - DNA, 25 bp, Rattus norvegicus
acggcgtcttgattaggtagagcgc

SEQ ID NO: 627004 - DNA, 25 bp, Rattus norvegicus
gcctcccgagctgtgattcgccgag

SEQ ID NO: 627005 - DNA, 25 bp, Rattus norvegicus
tacagcctagaaacgaggcacccgg

SEQ ID NO: 627006 - DNA, 25 bp, Rattus norvegicus
cgccgctagctaaggaagagccata

SEQ ID NO: 627007 - DNA, 25 bp, Rattus norvegicus
agagccatattaccgcagtgcaacc

SEQ ID NO: 627008 - DNA, 25 bp, Rattus norvegicus
gcgtcctcattggttccgtccctga

SEQ ID NO: 627009 - DNA, 25 bp, Rattus norvegicus
cagcggccaagggacgtactattgg

SEQ ID NO: 627010 - DNA, 25 bp, Rattus norvegicus
taggatggcctcaattgcgtctgtc

SEQ ID NO: 627011 - DNA, 25 bp, Rattus norvegicus
tgcgtctgtcaaaaccgggcgaaac

SEQ ID NO: 627012 - DNA, 25 bp, Rattus norvegicus
aggcgtaacttctctttggctcagc

SEQ ID NO: 627013 - DNA, 25 bp, Rattus norvegicus
ttggctcagcctaattggccctttc

SEQ ID NO: 627014 - DNA, 25 bp, Rattus norvegicus
tttcactattgaggggtggggtctc

SEQ ID NO: 627015 - DNA, 25 bp, Rattus norvegicus
agcgctgtcagttgtcggtgaaaca

SEQ ID NO: 627016 - DNA, 25 bp, Rattus norvegicus
gagcctcgtgggctattgctctaga

SEQ ID NO: 627017 - DNA, 25 bp, Rattus norvegicus
tcgagatccgaggtaggtagccgct

SEQ ID NO: 627018 - DNA, 25 bp, Rattus norvegicus
catgacgctatagggcggggcaaaa

SEQ ID NO: 627019 - DNA, 25 bp, Rattus norvegicus
acaacggggcgggtcatgacgctat

SEQ ID NO: 627020 - DNA, 25 bp, Rattus norvegicus
tataacctcacaacggggcgggtca

SEQ ID NO: 627021 - DNA, 25 bp, Rattus norvegicus
cgcgcgctttataacctcacaacgg

SEQ ID NO: 627022 - DNA, 25 bp, Rattus norvegicus
aaagctagcgaagcgcggccacggc

SEQ ID NO: 627023 - DNA, 25 bp, Rattus norvegicus
ggtagccgctgccaccctaggcaat

SEQ ID NO: 627024 - DNA, 25 bp, Rattus norvegicus
cttcgcgctgagctccgggagccga

SEQ ID NO: 627025 - DNA, 25 bp, Rattus norvegicus
cacgtcacggccgtgcaggaagccg

SEQ ID NO: 627026 - DNA, 25 bp, Rattus norvegicus
taggcagcgatgagggtcttcatgc

SEQ ID NO: 627027 - DNA, 25 bp, Rattus norvegicus
tttattcttgttctcgctgcgggca

SEQ ID NO: 627028 - DNA, 25 bp, Rattus norvegicus
cgcgtgacagggcagatcctttatt

SEQ ID NO: 627029 - DNA, 25 bp, Rattus norvegicus
cctaggcaatcagaaagctagcgaa

SEQ ID NO: 627030 - DNA, 25 bp, Rattus norvegicus
cttcatgctgaagccggtgcacgtc

SEQ ID NO: 627031 - DNA, 25 bp, Rattus norvegicus
agagccttccaagcgccacaccagc

SEQ ID NO: 627032 - DNA, 25 bp, Rattus norvegicus
cccgagttgaattggatctgggaag

SEQ ID NO: 627033 - DNA, 25 bp, Rattus norvegicus
tcccacccgagttgaattggatctg

SEQ ID NO: 627034 - DNA, 25 bp, Rattus norvegicus
cctgcgatcccacccgagttgaatt

SEQ ID NO: 627035 - DNA, 25 bp, Rattus norvegicus
gaatgcgtctaatcctgcgatccca

SEQ ID NO: 627036 - DNA, 25 bp, Rattus norvegicus
gcgggcaccaggaatgcgtctaatc

SEQ ID NO: 627037 - DNA, 25 bp, Rattus norvegicus
ttagtgccacggtatggcgggcacc

SEQ ID NO: 627038 - DNA, 25 bp, Rattus norvegicus
agtttcgagacttcttcgcgggcgg

SEQ ID NO: 627039 - DNA, 25 bp, Rattus norvegicus
ctcggtgcgcaagcgcagtctatcg

SEQ ID NO: 627040 - DNA, 25 bp, Rattus norvegicus
caccgttccggcgaaggtcatgacc

SEQ ID NO: 627041 - DNA, 25 bp, Rattus norvegicus
gcaccaccactcaggcgagccagga

SEQ ID NO: 627042 - DNA, 25 bp, Rattus norvegicus
gttggcgcagtttcgagacttcttc

SEQ ID NO: 627043 - DNA, 25 bp, Rattus norvegicus
agtctatcgctgaggcttgcgggaa

SEQ ID NO: 627044 - DNA, 25 bp, Rattus norvegicus
agcgcagtctatcgctgaggcttgc

SEQ ID NO: 627045 - DNA, 25 bp, Rattus norvegicus
tgactcgcaccgaagggcacgaaga

SEQ ID NO: 627046 - DNA, 25 bp, Rattus norvegicus
ccgaagggcacgaggagaagcctct

SEQ ID NO: 627047 - DNA, 25 bp, Rattus norvegicus
tcctgcagctggaaaggcgtccggt

SEQ ID NO: 627048 - DNA, 25 bp, Rattus norvegicus
tccggtgcagatcagcgtgacacac

SEQ ID NO: 627049 - DNA, 25 bp, Rattus norvegicus
gacccgcgtggatggtgactcgcac

SEQ ID NO: 627050 - DNA, 25 bp, Rattus norvegicus
caccgaagggcacgaggagaagcct

SEQ ID NO: 627051 - DNA, 25 bp, Rattus norvegicus
tcccagacccaggaaggcggtcctg

SEQ ID NO: 627052 - DNA, 25 bp, Rattus norvegicus
gtccggtgcagatcagcgtgacaca

SEQ ID NO: 627053 - DNA, 25 bp, Rattus norvegicus
tggtgactcgcaccgaagggcacga

SEQ ID NO: 627054 - DNA, 25 bp, Rattus norvegicus
ccagacccaggaaggcggtcctgca

SEQ ID NO: 627055 - DNA, 25 bp, Rattus norvegicus
aaaggcgtccggtgcagatcagcgt

SEQ ID NO: 627056 - DNA, 25 bp, Rattus norvegicus
atcagcgtgacacacgccggaaggc

SEQ ID NO: 627057 - DNA, 25 bp, Rattus norvegicus
gcgtccggtgcagatcagcgtgaca

SEQ ID NO: 627058 - DNA, 25 bp, Rattus norvegicus
gactcgcaccgaagggcacgaagag

SEQ ID NO: 627059 - DNA, 25 bp, Rattus norvegicus
aagcgagtaccagccgtccgacgcg

SEQ ID NO: 627060 - DNA, 25 bp, Rattus norvegicus
gcctgttctcgggatgcccaagcgt

SEQ ID NO: 627061 - DNA, 25 bp, Rattus norvegicus
gtgatgcgacaggactaccgtgcct

SEQ ID NO: 627062 - DNA, 25 bp, Rattus norvegicus
gactaccgtgcctggaaggtgcagc

SEQ ID NO: 627063 - DNA, 25 bp, Rattus norvegicus
taccagaaggacttccgcgcctggc

SEQ ID NO: 627064 - DNA, 25 bp, Rattus norvegicus
aagcccgtgcagatccctgcgactt

SEQ ID NO: 627065 - DNA, 25 bp, Rattus norvegicus
ggatgcccaagcgtcggcctcaaag

SEQ ID NO: 627066 - DNA, 25 bp, Rattus norvegicus
gtcggcctcaaagccaagagcgcgg

SEQ ID NO: 627067 - DNA, 25 bp, Rattus norvegicus
agcgcgggcccatacaactttctgc

SEQ ID NO: 627068 - DNA, 25 bp, Rattus norvegicus
ctttctgctgatgcccgggacccgg

SEQ ID NO: 627069 - DNA, 25 bp, Rattus norvegicus
tgcagaccagcgtgacacacgccgg

SEQ ID NO: 627070 - DNA, 25 bp, Rattus norvegicus
cacacgccggaaggcagggccagca

SEQ ID NO: 627071 - DNA, 25 bp, Rattus norvegicus
ggccagcatggatggtgactcgcac

SEQ ID NO: 627072 - DNA, 25 bp, Rattus norvegicus
agcgcgagacccagtaccagaagga

SEQ ID NO: 627073 - DNA, 25 bp, Rattus norvegicus
aagtcatcggcgaagctcacggagc

SEQ ID NO: 627074 - DNA, 25 bp, Rattus norvegicus
ctcggaagttgatcttggagtgttc

SEQ ID NO: 627075 - DNA, 25 bp, Rattus norvegicus
agttactgagggagcgcagcagctc

SEQ ID NO: 627076 - DNA, 25 bp, Rattus norvegicus
acattgcgcgcagtggagttactga

SEQ ID NO: 627077 - DNA, 25 bp, Rattus norvegicus
cgcagcttctcagcgctcagcactg

SEQ ID NO: 627078 - DNA, 25 bp, Rattus norvegicus
aagctcacggagctgggcccgtaca

SEQ ID NO: 627079 - DNA, 25 bp, Rattus norvegicus
tctgcgaggcccactcgttgatgga

SEQ ID NO: 627080 - DNA, 25 bp, Rattus norvegicus
ccactcgttgatggactgcagggcg

SEQ ID NO: 627081 - DNA, 25 bp, Rattus norvegicus
cgctgcgcttgtctcggaagttgat

SEQ ID NO: 627082 - DNA, 25 bp, Rattus norvegicus
ttgtagtgttgcttactgctgcgca

SEQ ID NO: 627083 - DNA, 25 bp, Rattus norvegicus
gtttccaggtcacattgcgcgcagt

SEQ ID NO: 627084 - DNA, 25 bp, Rattus norvegicus
tactgctgcgcacgaagtcatcggc

SEQ ID NO: 627085 - DNA, 25 bp, Rattus norvegicus
ggctgcccagtttccaggtcacatt

SEQ ID NO: 627086 - DNA, 25 bp, Rattus norvegicus
tcttggagtgttcacagttgtagtg

SEQ ID NO: 627087 - DNA, 25 bp, Rattus norvegicus
ccagctcccggaaaaccaaatcttg

SEQ ID NO: 627088 - DNA, 25 bp, Rattus norvegicus
ccggcggagagtcaactgttaagga

SEQ ID NO: 627089 - DNA, 25 bp, Rattus norvegicus
cacaggggtttctcctgccacagtc

SEQ ID NO: 627090 - DNA, 25 bp, Rattus norvegicus
gccacctttcttcgtcctaggcaaa

SEQ ID NO: 627091 - DNA, 25 bp, Rattus norvegicus
caggtccgcccagatttgcagagta

SEQ ID NO: 627092 - DNA, 25 bp, Rattus norvegicus
cagtctccagagagccgaggttgca

SEQ ID NO: 627093 - DNA, 25 bp, Rattus norvegicus
actgacccatctctgccggagtgtc

SEQ ID NO: 627094 - DNA, 25 bp, Rattus norvegicus
cccaagctggcaggacagtcgaact

SEQ ID NO: 627095 - DNA, 25 bp, Rattus norvegicus
gctgcgaaccgaagctgccaccttt

SEQ ID NO: 627096 - DNA, 25 bp, Rattus norvegicus
tgccttggaccgaactgcttgaaac

SEQ ID NO: 627097 - DNA, 25 bp, Rattus norvegicus
tgcttgaaactgtactggcgccgcc

SEQ ID NO: 627098 - DNA, 25 bp, Rattus norvegicus
ccgggctctcggacttgagtgtaaa

SEQ ID NO: 627099 - DNA, 25 bp, Rattus norvegicus
gcattccgcgcctgtactttctcag

SEQ ID NO: 627100 - DNA, 25 bp, Rattus norvegicus
acctgggcagacttcttcgtcttgc

SEQ ID NO: 627101 - DNA, 25 bp, Rattus norvegicus
gcctcctgattgcttgcattgcgcc

SEQ ID NO: 627102 - DNA, 25 bp, Rattus norvegicus
aatgtcgccgcttcataagacccgg

SEQ ID NO: 627103 - DNA, 25 bp, Rattus norvegicus
ctggttccttcactacccatcttga

SEQ ID NO: 627104 - DNA, 25 bp, Rattus norvegicus
gccgcggaggtatggcctcctgatt

SEQ ID NO: 627105 - DNA, 25 bp, Rattus norvegicus
tgaggcccgtgcctgcttcatcctg

SEQ ID NO: 627106 - DNA, 25 bp, Rattus norvegicus
gcgcccgcctacttcctggagaagg

SEQ ID NO: 627107 - DNA, 25 bp, Rattus norvegicus
gggcagcttcgtcgcctcctggagc

SEQ ID NO: 627108 - DNA, 25 bp, Rattus norvegicus
ccttcgtggaggtgacgcgccatgc

SEQ ID NO: 627109 - DNA, 25 bp, Rattus norvegicus
tggtgctcgactacgtgtacggcgc

SEQ ID NO: 627110 - DNA, 25 bp, Rattus norvegicus
cagcactggctgtggtgctcgacta

SEQ ID NO: 627111 - DNA, 25 bp, Rattus norvegicus
ggagcggcaccctcaccgacgtggt

SEQ ID NO: 627112 - DNA, 25 bp, Rattus norvegicus
gcatcctgcagacgctcaacgcgta

SEQ ID NO: 627113 - DNA, 25 bp, Rattus norvegicus
atgccgacttcttggagctcgcgcc

SEQ ID NO: 627114 - DNA, 25 bp, Rattus norvegicus
cccatcttgaaatgtcgccgcttca

SEQ ID NO: 627115 - DNA, 25 bp, Rattus norvegicus
ccgcgcgccgctgaaaggaaaggaa

SEQ ID NO: 627116 - DNA, 25 bp, Rattus norvegicus
ccgctgaaaggaaaggaagtggctc

SEQ ID NO: 627117 - DNA, 25 bp, Rattus norvegicus
gctccggcccagcacacaatctacg

SEQ ID NO: 627118 - DNA, 25 bp, Rattus norvegicus
atccgcggctcgcagagaccgcagg

SEQ ID NO: 627119 - DNA, 25 bp, Rattus norvegicus
cacctttagaacacgcggcggattc

SEQ ID NO: 627120 - DNA, 25 bp, Rattus norvegicus
ggcggattcccggacagaacccaga

SEQ ID NO: 627121 - DNA, 25 bp, Rattus norvegicus
gacgcccggtattcgtgtcggtcca

SEQ ID NO: 627122 - DNA, 25 bp, Rattus norvegicus
ttcccggacagaacccagacgctta

SEQ ID NO: 627123 - DNA, 25 bp, Rattus norvegicus
cttcttggaaatctgcaccgccatc

SEQ ID NO: 627124 - DNA, 25 bp, Rattus norvegicus
agcaatgacgcgacgctacgcgacg

SEQ ID NO: 627125 - DNA, 25 bp, Rattus norvegicus
agaactcgagtttgtgcctcccttc

SEQ ID NO: 627126 - DNA, 25 bp, Rattus norvegicus
cgtgtcggtccagaactcgagtttg

SEQ ID NO: 627127 - DNA, 25 bp, Rattus norvegicus
ggacagaacccagacgcttaccttc

SEQ ID NO: 627128 - DNA, 25 bp, Rattus norvegicus
cagacacactgcactcgcccggctc

SEQ ID NO: 627129 - DNA, 25 bp, Rattus norvegicus
ggagagtagagtccaggcaccgacc

SEQ ID NO: 627130 - DNA, 25 bp, Rattus norvegicus
agtccaggcaccgaccgtctgaaga

SEQ ID NO: 627131 - DNA, 25 bp, Rattus norvegicus
aggcaccgaccgtctgaagagtgga

SEQ ID NO: 627132 - DNA, 25 bp, Rattus norvegicus
ccgaccgtctgaagagtggaggtca

SEQ ID NO: 627133 - DNA, 25 bp, Rattus norvegicus
accgtctgaagagtggaggtcagcc

SEQ ID NO: 627134 - DNA, 25 bp, Rattus norvegicus
gcagaaccgcggctgctggccgcta

SEQ ID NO: 627135 - DNA, 25 bp, Rattus norvegicus
tcgtcaggggcaacctcggaggctc

SEQ ID NO: 627136 - DNA, 25 bp, Rattus norvegicus
tcaggggcaacctcggaggctcgcc

SEQ ID NO: 627137 - DNA, 25 bp, Rattus norvegicus
cgcgcagaagccaggtggccgttgg

SEQ ID NO: 627138 - DNA, 25 bp, Rattus norvegicus
ttggggcgccaccagccggtttgat

SEQ ID NO: 627139 - DNA, 25 bp, Rattus norvegicus
caccagccggtttgatttcccgcgg

SEQ ID NO: 627140 - DNA, 25 bp, Rattus norvegicus
cagccggtttgatttcccgcggccg

SEQ ID NO: 627141 - DNA, 25 bp, Rattus norvegicus
aggggaaatgagtcattagccaatg

SEQ ID NO: 627142 - DNA, 25 bp, Rattus norvegicus
tctgaagagtggaggtcagccgccc

SEQ ID NO: 627143 - DNA, 25 bp, Rattus norvegicus
ttttccagcctggacgctgacgccg

SEQ ID NO: 627144 - DNA, 25 bp, Rattus norvegicus
cggaggttccaatcagcgtcacccg

SEQ ID NO: 627145 - DNA, 25 bp, Rattus norvegicus
cacgggcggaggttccaatcagcgt

SEQ ID NO: 627146 - DNA, 25 bp, Rattus norvegicus
accatgggcgacaaagggacacggt

SEQ ID NO: 627147 - DNA, 25 bp, Rattus norvegicus
cggaccatgggcgacaaagggacac

SEQ ID NO: 627148 - DNA, 25 bp, Rattus norvegicus
ggattttccagcctggacgctgacg

SEQ ID NO: 627149 - DNA, 25 bp, Rattus norvegicus
tctcctggcggccggggattttcca

SEQ ID NO: 627150 - DNA, 25 bp, Rattus norvegicus
cgcacggagccacacacgcgcgctc

SEQ ID NO: 627151 - DNA, 25 bp, Rattus norvegicus
tctctgggcgcgcacacgcagagcg

SEQ ID NO: 627152 - DNA, 25 bp, Rattus norvegicus
tgcgtgcacgcactctcgtggacca

SEQ ID NO: 627153 - DNA, 25 bp, Rattus norvegicus
actggcacgcgcttgcgtgcacgca

SEQ ID NO: 627154 - DNA, 25 bp, Rattus norvegicus
accagcactggcacgcgcttgcgtg

SEQ ID NO: 627155 - DNA, 25 bp, Rattus norvegicus
gcacagccgtgcacacgcaccagca

SEQ ID NO: 627156 - DNA, 25 bp, Rattus norvegicus
ctgacgccgcggacctccctgcggc

SEQ ID NO: 627157 - DNA, 25 bp, Rattus norvegicus
agcagccctggcagcgggctccaga

SEQ ID NO: 627158 - DNA, 25 bp, Rattus norvegicus
taaagtccgaggagccttcactttg

SEQ ID NO: 627159 - DNA, 25 bp, Rattus norvegicus
cgtcctccggcttgtaaagtccgag

SEQ ID NO: 627160 - DNA, 25 bp, Rattus norvegicus
gctagaccttgacccggagcagctg

SEQ ID NO: 627161 - DNA, 25 bp, Rattus norvegicus
ggggactgccgaagcagtaacactg

SEQ ID NO: 627162 - DNA, 25 bp, Rattus norvegicus
gtcctctaccacctcgatgttgttg

SEQ ID NO: 627163 - DNA, 25 bp, Rattus norvegicus
ccagcgcgtgattgagcagtagtga

SEQ ID NO: 627164 - DNA, 25 bp, Rattus norvegicus
gtggcattgtgcagccaggccagca

SEQ ID NO: 627165 - DNA, 25 bp, Rattus norvegicus
agcggcgtccagtgcatccagcatc

SEQ ID NO: 627166 - DNA, 25 bp, Rattus norvegicus
tggccagcgcgttgacacgcgcatc

SEQ ID NO: 627167 - DNA, 25 bp, Rattus norvegicus
ggcaagtcgccatcacgctcgagag

SEQ ID NO: 627168 - DNA, 25 bp, Rattus norvegicus
tgcacccgcagctcagtgggttgtc

SEQ ID NO: 627169 - DNA, 25 bp, Rattus norvegicus
ttgtggcttaggtcgagtgccgcca

SEQ ID NO: 627170 - DNA, 25 bp, Rattus norvegicus
ggagcagctgacagtcccgaccagt

SEQ ID NO: 627171 - DNA, 25 bp, Rattus norvegicus
agctattcatgtgatgcgcaacgca

SEQ ID NO: 627172 - DNA, 25 bp, Rattus norvegicus
gcaggcgtgcactccgcctgacaga

SEQ ID NO: 627173 - DNA, 25 bp, Rattus norvegicus
acaccgtcgcggttactaaggagtg

SEQ ID NO: 627174 - DNA, 25 bp, Rattus norvegicus
agaatctgccgtcgccagttgccgc

SEQ ID NO: 627175 - DNA, 25 bp, Rattus norvegicus
acttgtagttagaatctgccgtcgc

SEQ ID NO: 627176 - DNA, 25 bp, Rattus norvegicus
cagtgtgcttacgagggctgaaagt

SEQ ID NO: 627177 - DNA, 25 bp, Rattus norvegicus
gggacccgtagttcagtgtgcttac

SEQ ID NO: 627178 - DNA, 25 bp, Rattus norvegicus
tgtgatgcgcaacgcagagcccatc

SEQ ID NO: 627179 - DNA, 25 bp, Rattus norvegicus
agccgattggctgaagctattcatg

SEQ ID NO: 627180 - DNA, 25 bp, Rattus norvegicus
gacttgtccgaagccgattggctga

SEQ ID NO: 627181 - DNA, 25 bp, Rattus norvegicus
tccgagattcccgtgaggctcgcag

SEQ ID NO: 627182 - DNA, 25 bp, Rattus norvegicus
ccaccgtggagcgactccgagattc

SEQ ID NO: 627183 - DNA, 25 bp, Rattus norvegicus
agagcccatcgggacccgtagttca

SEQ ID NO: 627184 - DNA, 25 bp, Rattus norvegicus
gttgctagccacaccgtcgcggtta

SEQ ID NO: 627185 - DNA, 25 bp, Rattus norvegicus
aaggggcttcggctccatttcgctc

SEQ ID NO: 627186 - DNA, 25 bp, Rattus norvegicus
ggcgctgtcctttctcatccctgta

SEQ ID NO: 627187 - DNA, 25 bp, Rattus norvegicus
ctcatccctgtaggcgctgtgttgc

SEQ ID NO: 627188 - DNA, 25 bp, Rattus norvegicus
ggacagcagcgactagtgaaccaga

SEQ ID NO: 627189 - DNA, 25 bp, Rattus norvegicus
aaccagaagcaataccgggaggcca

SEQ ID NO: 627190 - DNA, 25 bp, Rattus norvegicus
gccaagcggttgctcaaggagttcc

SEQ ID NO: 627191 - DNA, 25 bp, Rattus norvegicus
aggagttccgcgcacgctaccggca

SEQ ID NO: 627192 - DNA, 25 bp, Rattus norvegicus
gctaccggcagctggtgcgcagctc

SEQ ID NO: 627193 - DNA, 25 bp, Rattus norvegicus
cgctgcggactgtgttcacctccag

SEQ ID NO: 627194 - DNA, 25 bp, Rattus norvegicus
gccgcttcctcgagttcatggacga

SEQ ID NO: 627195 - DNA, 25 bp, Rattus norvegicus
atggacgagttctgccaggagccca

SEQ ID NO: 627196 - DNA, 25 bp, Rattus norvegicus
acggccggcgactcgaaagagtaga

SEQ ID NO: 627197 - DNA, 25 bp, Rattus norvegicus
cccagccctgaacagaaggggcttc

SEQ ID NO: 627198 - DNA, 25 bp, Rattus norvegicus
aaagagtagagctgggcaccgccct

SEQ ID NO: 627199 - DNA, 25 bp, Rattus norvegicus
ccatggtggtgcagcttcgaatcct

SEQ ID NO: 627200 - DNA, 25 bp, Rattus norvegicus
cgtgcgacgatgattgtgattgtac

SEQ ID NO: 627201 - DNA, 25 bp, Rattus norvegicus
tgttttggtccgtgacgaactcgtc

SEQ ID NO: 627202 - DNA, 25 bp, Rattus norvegicus
cccgccgaaggtccaggagtttcag

SEQ ID NO: 627203 - DNA, 25 bp, Rattus norvegicus
gtgattgtacacctgaggacttttc

SEQ ID NO: 627204 - DNA, 25 bp, Rattus norvegicus
gttgaatccagaccgaccagaagtg

SEQ ID NO: 627205 - DNA, 25 bp, Rattus norvegicus
gccaaacttgtgagcgaacagccaa

SEQ ID NO: 627206 - DNA, 25 bp, Rattus norvegicus
cgggaaacagcttcgctcactctca

SEQ ID NO: 627207 - DNA, 25 bp, Rattus norvegicus
gcttcgaatcctttgctcagaccgc

SEQ ID NO: 627208 - DNA, 25 bp, Rattus norvegicus
tagatacagctgttccgccatggtg

SEQ ID NO: 627209 - DNA, 25 bp, Rattus norvegicus
agctcctcacgatcttgttttggtc

SEQ ID NO: 627210 - DNA, 25 bp, Rattus norvegicus
aagccctaggcaccggaggtctaca

SEQ ID NO: 627211 - DNA, 25 bp, Rattus norvegicus
ccacaagtgcttagtggcgactagc

SEQ ID NO: 627212 - DNA, 25 bp, Rattus norvegicus
ggacttttcggtctctccgctgcca

SEQ ID NO: 627213 - DNA, 25 bp, Rattus norvegicus
ctctcttctgagctcacctgcggaa

SEQ ID NO: 627214 - DNA, 25 bp, Rattus norvegicus
gtcgatccaagtgaaagcgttcacc

SEQ ID NO: 627215 - DNA, 25 bp, Rattus norvegicus
agcgttcaccactttccattacagg

SEQ ID NO: 627216 - DNA, 25 bp, Rattus norvegicus
ccattacaggtggagacgttttgta

SEQ ID NO: 627217 - DNA, 25 bp, Rattus norvegicus
cgcggtgtgctctcttctgagctca

SEQ ID NO: 627218 - DNA, 25 bp, Rattus norvegicus
ccacgcctgccaagtgactcaaagg

SEQ ID NO: 627219 - DNA, 25 bp, Rattus norvegicus
acctgcggaagctccagggtgcgac

SEQ ID NO: 627220 - DNA, 25 bp, Rattus norvegicus
aagctccagggtgcgacacgtagga

SEQ ID NO: 627221 - DNA, 25 bp, Rattus norvegicus
acccaaggcgcctccggctgagtag

SEQ ID NO: 627222 - DNA, 25 bp, Rattus norvegicus
cccaaggtcctgtagacgttgcgtg

SEQ ID NO: 627223 - DNA, 25 bp, Rattus norvegicus
cctgtagacgttgcgtggcaactga

SEQ ID NO: 627224 - DNA, 25 bp, Rattus norvegicus
ggcaactgaccacgcctgccaagtg

SEQ ID NO: 627225 - DNA, 25 bp, Rattus norvegicus
aagtgactcaaaggcacgcgcttcc

SEQ ID NO: 627226 - DNA, 25 bp, Rattus norvegicus
acaggtggagacgttttgtaagctc

SEQ ID NO: 627227 - DNA, 25 bp, Rattus norvegicus
ttggctacggcagctacaggccgac

SEQ ID NO: 627228 - DNA, 25 bp, Rattus norvegicus
caagatctgcgctatcggtgagcgc

SEQ ID NO: 627229 - DNA, 25 bp, Rattus norvegicus
ctaggcgagcgcaagatctgcgcta

SEQ ID NO: 627230 - DNA, 25 bp, Rattus norvegicus
cctatactggcgtctggctaggcga

SEQ ID NO: 627231 - DNA, 25 bp, Rattus norvegicus
gccgccctatactggcgtctggcta

SEQ ID NO: 627232 - DNA, 25 bp, Rattus norvegicus
tgcgctgtgcgtctgtgcgagctcc

SEQ ID NO: 627233 - DNA, 25 bp, Rattus norvegicus
cttgacctgcggcttctaggcctgc

SEQ ID NO: 627234 - DNA, 25 bp, Rattus norvegicus
agctgctctgccacccggtgcttga

SEQ ID NO: 627235 - DNA, 25 bp, Rattus norvegicus
acacccgaggagactatgcggctga

SEQ ID NO: 627236 - DNA, 25 bp, Rattus norvegicus
accaaagcgggcgtgctcttggtct

SEQ ID NO: 627237 - DNA, 25 bp, Rattus norvegicus
agctgcaggagcattggctacggca

SEQ ID NO: 627238 - DNA, 25 bp, Rattus norvegicus
gcactactctgagttgctggagctg

SEQ ID NO: 627239 - DNA, 25 bp, Rattus norvegicus
ctttggctcgggagggtgcactact

SEQ ID NO: 627240 - DNA, 25 bp, Rattus norvegicus
ggcctgacacccgaggagactatgc

SEQ ID NO: 627241 - DNA, 25 bp, Rattus norvegicus
gcccgcctcagtcagttcgagctga

SEQ ID NO: 627242 - DNA, 25 bp, Rattus norvegicus
cggggactctcctagtgagtgcaga

SEQ ID NO: 627243 - DNA, 25 bp, Rattus norvegicus
ctgaagcaagacgaagccctgaggc

SEQ ID NO: 627244 - DNA, 25 bp, Rattus norvegicus
tcgccaggtggagacacgtgcaagt

SEQ ID NO: 627245 - DNA, 25 bp, Rattus norvegicus
ggaaagacagctgaagaacggcata

SEQ ID NO: 627246 - DNA, 25 bp, Rattus norvegicus
tgcaccgttgcctcagcggacagta

SEQ ID NO: 627247 - DNA, 25 bp, Rattus norvegicus
gcgcctcatgcctcgggcacttgga

SEQ ID NO: 627248 - DNA, 25 bp, Rattus norvegicus
ggactgttgttgttctctcgcctca

SEQ ID NO: 627249 - DNA, 25 bp, Rattus norvegicus
ctgagatccggagctagtctgctgg

SEQ ID NO: 627250 - DNA, 25 bp, Rattus norvegicus
gactgaacagctcgcggttggtctc

SEQ ID NO: 627251 - DNA, 25 bp, Rattus norvegicus
ggttggtctctcatgcccttcgtca

SEQ ID NO: 627252 - DNA, 25 bp, Rattus norvegicus
ttctggaccctggtgagcgcaccta

SEQ ID NO: 627253 - DNA, 25 bp, Rattus norvegicus
cccagattcggtatcttcgtctgcc

SEQ ID NO: 627254 - DNA, 25 bp, Rattus norvegicus
aaggcggcgacccagacatctggga

SEQ ID NO: 627255 - DNA, 25 bp, Rattus norvegicus
gggaggacacgttctccgctctgac

SEQ ID NO: 627256 - DNA, 25 bp, Rattus norvegicus
acctgaccaggtgagggcgtcaccg

SEQ ID NO: 627257 - DNA, 25 bp, Rattus norvegicus
ctggagctcggggtcggagaccctg

SEQ ID NO: 627258 - DNA, 25 bp, Rattus norvegicus
ggtcggagaccctgcggcggccgcg

SEQ ID NO: 627259 - DNA, 25 bp, Rattus norvegicus
cgggaggacacgttctccgctctga

SEQ ID NO: 627260 - DNA, 25 bp, Rattus norvegicus
gaggacacgttctccgctctgacca

SEQ ID NO: 627261 - DNA, 25 bp, Rattus norvegicus
aggacacgttctccgctctgaccag

SEQ ID NO: 627262 - DNA, 25 bp, Rattus norvegicus
ccgctctgaccagcgtggcgcgcgc

SEQ ID NO: 627263 - DNA, 25 bp, Rattus norvegicus
ctgctggggacactgaggcgctacc

SEQ ID NO: 627264 - DNA, 25 bp, Rattus norvegicus
ctggggacactgaggcgctacctgc

SEQ ID NO: 627265 - DNA, 25 bp, Rattus norvegicus
gacactgaggcgctacctgcgcggc

SEQ ID NO: 627266 - DNA, 25 bp, Rattus norvegicus
cactgaggcgctacctgcgcggcga

SEQ ID NO: 627267 - DNA, 25 bp, Rattus norvegicus
cgacctgaccaggtgagggcgtcac

SEQ ID NO: 627268 - DNA, 25 bp, Rattus norvegicus
ggcgggaggacacgttctccgctct

SEQ ID NO: 627269 - DNA, 25 bp, Rattus norvegicus
catgcttttttcaagggccgacatc

SEQ ID NO: 627270 - DNA, 25 bp, Rattus norvegicus
gcttaggagctagcaccagcgttga

SEQ ID NO: 627271 - DNA, 25 bp, Rattus norvegicus
agagtgtttcttcctgcgtcccagg

SEQ ID NO: 627272 - DNA, 25 bp, Rattus norvegicus
tggcgccttcttttggcacagcttt

SEQ ID NO: 627273 - DNA, 25 bp, Rattus norvegicus
catttgcagggactcttattggcgc

SEQ ID NO: 627274 - DNA, 25 bp, Rattus norvegicus
gtgtcctggtccaacctcgcaaagg

SEQ ID NO: 627275 - DNA, 25 bp, Rattus norvegicus
caaccctagcgggaagagtcctctt

SEQ ID NO: 627276 - DNA, 25 bp, Rattus norvegicus
gcggatccctcagactcctatcaga

SEQ ID NO: 627277 - DNA, 25 bp, Rattus norvegicus
tccaccggaagtgcgcaacagcctt

SEQ ID NO: 627278 - DNA, 25 bp, Rattus norvegicus
acgcccagtcgcctttggacagcaa

SEQ ID NO: 627279 - DNA, 25 bp, Rattus norvegicus
gcggtacaaccggtcacagctcact

SEQ ID NO: 627280 - DNA, 25 bp, Rattus norvegicus
caaggtccgtcccacgatacgtgcg

SEQ ID NO: 627281 - DNA, 25 bp, Rattus norvegicus
gggaggcctcacgtcgaaaacagtg

SEQ ID NO: 627282 - DNA, 25 bp, Rattus norvegicus
agggcccaggctcgacatgaaacaa

SEQ ID NO: 627283 - DNA, 25 bp, Rattus norvegicus
cctgagcccgggctaagcacagcta

SEQ ID NO: 627284 - DNA, 25 bp, Rattus norvegicus
acaagccggcctgtgttagagcaaa

SEQ ID NO: 627285 - DNA, 25 bp, Rattus norvegicus
cgcctctctgtctcaggattggctc

SEQ ID NO: 627286 - DNA, 25 bp, Rattus norvegicus
ctcctgagcaatgagcggtatctgc

SEQ ID NO: 627287 - DNA, 25 bp, Rattus norvegicus
tgccatctcattggctgctatggga

SEQ ID NO: 627288 - DNA, 25 bp, Rattus norvegicus
tgtcaataacagaacgcccgtcgcc

SEQ ID NO: 627289 - DNA, 25 bp, Rattus norvegicus
tgcgctgcccgacaattacttccgg

SEQ ID NO: 627290 - DNA, 25 bp, Rattus norvegicus
gccttgacggtcaaccctggcgctt

SEQ ID NO: 627291 - DNA, 25 bp, Rattus norvegicus
ctggcgcttgcctgtcacagggtct

SEQ ID NO: 627292 - DNA, 25 bp, Rattus norvegicus
cccggctccgtgttgctaaactgag

SEQ ID NO: 627293 - DNA, 25 bp, Rattus norvegicus
gaggtacctgccagactatacagtc

SEQ ID NO: 627294 - DNA, 25 bp, Rattus norvegicus
ctatacagtcacacgggagccagcg

SEQ ID NO: 627295 - DNA, 25 bp, Rattus norvegicus
gctgggaccaacacatggtcgcata

SEQ ID NO: 627296 - DNA, 25 bp, Rattus norvegicus
tcgcataggtttccgcggtctccta

SEQ ID NO: 627297 - DNA, 25 bp, Rattus norvegicus
tcaggcaaccacagatggaaacgcc

SEQ ID NO: 627298 - DNA, 25 bp, Rattus norvegicus
atcgcttgcttcttgggcagccacc

SEQ ID NO: 627299 - DNA, 25 bp, Rattus norvegicus
gcgcgggttcacagccactgtcagc

SEQ ID NO: 627300 - DNA, 25 bp, Rattus norvegicus
tattctcctgcggtccggtgagcgt

SEQ ID NO: 627301 - DNA, 25 bp, Rattus norvegicus
acctagccgtctgcactcctgtgtt

SEQ ID NO: 627302 - DNA, 25 bp, Rattus norvegicus
tccctcggtgccctgggatcgcttg

SEQ ID NO: 627303 - DNA, 25 bp, Rattus norvegicus
agatggaaacgcctcctcacccgga

SEQ ID NO: 627304 - DNA, 25 bp, Rattus norvegicus
gaagatctgagacagggagactcta

SEQ ID NO: 627305 - DNA, 25 bp, Rattus norvegicus
tccgtctggggaatagaagatctga

SEQ ID NO: 627306 - DNA, 25 bp, Rattus norvegicus
tggctgccctcacaaaaagactgtc

SEQ ID NO: 627307 - DNA, 25 bp, Rattus norvegicus
cagcgggccaaacaatctggctgcc

SEQ ID NO: 627308 - DNA, 25 bp, Rattus norvegicus
gtaggaagtcgcgaaccagagcagc

SEQ ID NO: 627309 - DNA, 25 bp, Rattus norvegicus
cagaaggcgggaacgccagccttgc

SEQ ID NO: 627310 - DNA, 25 bp, Rattus norvegicus
gtgttctcctgtgtattctcctgcg

SEQ ID NO: 627311 - DNA, 25 bp, Rattus norvegicus
gcgggctctacaaggagagttcgcc

SEQ ID NO: 627312 - DNA, 25 bp, Rattus norvegicus
ctacaaggagagttcgccaatgaga

SEQ ID NO: 627313 - DNA, 25 bp, Rattus norvegicus
cgccaatgagaattgcagagggttc

SEQ ID NO: 627314 - DNA, 25 bp, Rattus norvegicus
ctgttcttccgtgtgtgcgctccag

SEQ ID NO: 627315 - DNA, 25 bp, Rattus norvegicus
tgcgctccagttgggtccgcttcct

SEQ ID NO: 627316 - DNA, 25 bp, Rattus norvegicus
ggtctctattggtccgcttcttccg

SEQ ID NO: 627317 - DNA, 25 bp, Rattus norvegicus
ggggagaacttactgcctacagacc

SEQ ID NO: 627318 - DNA, 25 bp, Rattus norvegicus
gaaatccggtctctattggtccgct

SEQ ID NO: 627319 - DNA, 25 bp, Rattus norvegicus
tactgcctacagaccctggcgtttg

SEQ ID NO: 627320 - DNA, 25 bp, Rattus norvegicus
ggaacgcgcttgcacgctcttctgc

SEQ ID NO: 627321 - DNA, 25 bp, Rattus norvegicus
ttgcacgctcttctgcacctgcggg

SEQ ID NO: 627322 - DNA, 25 bp, Rattus norvegicus
gcacctgcgggtgagcactgcacac

SEQ ID NO: 627323 - DNA, 25 bp, Rattus norvegicus
ctacaccggatgcaacgcagggacc

SEQ ID NO: 627324 - DNA, 25 bp, Rattus norvegicus
ttgggtccgcttcctgcggagagaa

SEQ ID NO: 627325 - DNA, 25 bp, Rattus norvegicus
tgcttttttctgattggctcgactg

SEQ ID NO: 627326 - DNA, 25 bp, Rattus norvegicus
ctggcgaaaccaggaaggcattgga

SEQ ID NO: 627327 - DNA, 25 bp, Rattus norvegicus
gtgccagaggctcgcgcactcagcg

SEQ ID NO: 627328 - DNA, 25 bp, Rattus norvegicus
cgtgctaggtcctagacgcgtctgc

SEQ ID NO: 627329 - DNA, 25 bp, Rattus norvegicus
gctaggctagcgaagcccgagcgca

SEQ ID NO: 627330 - DNA, 25 bp, Rattus norvegicus
ctgtcagtgacgtcagcgttccttc

SEQ ID NO: 627331 - DNA, 25 bp, Rattus norvegicus
tctccagacgccagtcgaaacctga

SEQ ID NO: 627332 - DNA, 25 bp, Rattus norvegicus
ggtcggtggagtcactctcccttca

SEQ ID NO: 627333 - DNA, 25 bp, Rattus norvegicus
ccctcttcgtcagcgggttggagct

SEQ ID NO: 627334 - DNA, 25 bp, Rattus norvegicus
ctgcagcggtctggaagaggtcttt

SEQ ID NO: 627335 - DNA, 25 bp, Rattus norvegicus
agacttcgggaatccgctgaggaaa

SEQ ID NO: 627336 - DNA, 25 bp, Rattus norvegicus
gctgaggaaattcaagctggtgttc

SEQ ID NO: 627337 - DNA, 25 bp, Rattus norvegicus
ccagtgcagcccttctggtcgctga

SEQ ID NO: 627338 - DNA, 25 bp, Rattus norvegicus
gctccatcatgtccgcgggcggaga

SEQ ID NO: 627339 - DNA, 25 bp, Rattus norvegicus
attcagatccgagtagctgaagaga

SEQ ID NO: 627340 - DNA, 25 bp, Rattus norvegicus
cgtcgccgctgtagccttcagagaa

SEQ ID NO: 627341 - DNA, 25 bp, Rattus norvegicus
gaacgagagcgtcgccgctgtagcc

SEQ ID NO: 627342 - DNA, 25 bp, Rattus norvegicus
tgcagaggattcagatccgagtagc

SEQ ID NO: 627343 - DNA, 25 bp, Rattus norvegicus
ccgccgcggttttcgtctgcagcag

SEQ ID NO: 627344 - DNA, 25 bp, Rattus norvegicus
ttctccgcggctactgcagaggatt

SEQ ID NO: 627345 - DNA, 25 bp, Rattus norvegicus
ccactgtcgggtttctccgcggcta

SEQ ID NO: 627346 - DNA, 25 bp, Rattus norvegicus
ttcgtctgcagcagctcgccggtga

SEQ ID NO: 627347 - DNA, 25 bp, Rattus norvegicus
ctactggacacggacgagggaacga

SEQ ID NO: 627348 - DNA, 25 bp, Rattus norvegicus
ttcagagaagacaagggcatcgccg

SEQ ID NO: 627349 - DNA, 25 bp, Rattus norvegicus
aagacaagggcatcgccgcttctgc

SEQ ID NO: 627350 - DNA, 25 bp, Rattus norvegicus
gggagttgtagtccaagagctctga

SEQ ID NO: 627351 - DNA, 25 bp, Rattus norvegicus
cgcagcagagcacaccgggagttgt

SEQ ID NO: 627352 - DNA, 25 bp, Rattus norvegicus
gtagtccaagagctctgaggctgtg

SEQ ID NO: 627353 - DNA, 25 bp, Rattus norvegicus
gccggccttggtgtcagtccaagtt

SEQ ID NO: 627354 - DNA, 25 bp, Rattus norvegicus
atcgctagcctagccgggaagctgc

SEQ ID NO: 627355 - DNA, 25 bp, Rattus norvegicus
ctcagctggccaagggctcacgatt

SEQ ID NO: 627356 - DNA, 25 bp, Rattus norvegicus
taggctcggcgtcaccgcccagtgt

SEQ ID NO: 627357 - DNA, 25 bp, Rattus norvegicus
cacagtcacgggctgacaccgttca

SEQ ID NO: 627358 - DNA, 25 bp, Rattus norvegicus
tcacgggctgacaccgttcagaaca

SEQ ID NO: 627359 - DNA, 25 bp, Rattus norvegicus
gtcagtccaagtttcccgggctcca

SEQ ID NO: 627360 - DNA, 25 bp, Rattus norvegicus
accttctgacagactgcgcggcgcg

SEQ ID NO: 627361 - DNA, 25 bp, Rattus norvegicus
ctgacgcatccaccgcgcgggagaa

SEQ ID NO: 627362 - DNA, 25 bp, Rattus norvegicus
cgcgggagaacttcctcagagcagc

SEQ ID NO: 627363 - DNA, 25 bp, Rattus norvegicus
aacttcctcagagcagcggagcggg

SEQ ID NO: 627364 - DNA, 25 bp, Rattus norvegicus
accctgcgcgccttttgaatgaatc

SEQ ID NO: 627365 - DNA, 25 bp, Rattus norvegicus
ttgaatgaatcgctagcctagccgg

SEQ ID NO: 627366 - DNA, 25 bp, Rattus norvegicus
tggccaagggctcacgattctcccg

SEQ ID NO: 627367 - DNA, 25 bp, Rattus norvegicus
gagcaaacagcgatgcaggcctcca

SEQ ID NO: 627368 - DNA, 25 bp, Rattus norvegicus
aattcgggcggagcaaacagcgatg

SEQ ID NO: 627369 - DNA, 25 bp, Rattus norvegicus
cctatacagagaattcgggcggagc

SEQ ID NO: 627370 - DNA, 25 bp, Rattus norvegicus
gggcactgctcctatacagagaatt

SEQ ID NO: 627371 - DNA, 25 bp, Rattus norvegicus
ttgcaggccgggcactgctcctata

SEQ ID NO: 627372 - DNA, 25 bp, Rattus norvegicus
ccttaccgtgggcagcgtggttgca

SEQ ID NO: 627373 - DNA, 25 bp, Rattus norvegicus
atcaccacccggtcaacattcagtg

SEQ ID NO: 627374 - DNA, 25 bp, Rattus norvegicus
tgccaccagggccttaccgtgggca

SEQ ID NO: 627375 - DNA, 25 bp, Rattus norvegicus
tcttaggcttgccaccagggcctta

SEQ ID NO: 627376 - DNA, 25 bp, Rattus norvegicus
aaggctcccggcatcttaggcttgc

SEQ ID NO: 627377 - DNA, 25 bp, Rattus norvegicus
tgggccaaaggctcccggcatctta

SEQ ID NO: 627378 - DNA, 25 bp, Rattus norvegicus
tcagtgtgtactgggccaaaggctc

SEQ ID NO: 627379 - DNA, 25 bp, Rattus norvegicus
cccggtcaacattcagtgtgtactg

SEQ ID NO: 627380 - DNA, 25 bp, Rattus norvegicus
gatgcaggcctccacgtctggttcg

SEQ ID NO: 627381 - DNA, 25 bp, Rattus norvegicus
ggggcttcccttctctagtctgagg

SEQ ID NO: 627382 - DNA, 25 bp, Rattus norvegicus
gcgtggcaggcagggatcaggatgt

SEQ ID NO: 627383 - DNA, 25 bp, Rattus norvegicus
atcaggatgtgcgtgcgccccctgc

SEQ ID NO: 627384 - DNA, 25 bp, Rattus norvegicus
tgccgcttttgccttgcgtctgccg

SEQ ID NO: 627385 - DNA, 25 bp, Rattus norvegicus
cgcttttgccttgcgtctgccgcta

SEQ ID NO: 627386 - DNA, 25 bp, Rattus norvegicus
ttttgccttgcgtctgccgctacgg

SEQ ID NO: 627387 - DNA, 25 bp, Rattus norvegicus
ggtggggcttcccttctctagtctg

SEQ ID NO: 627388 - DNA, 25 bp, Rattus norvegicus
gcttcccttctctagtctgaggcca

SEQ ID NO: 627389 - DNA, 25 bp, Rattus norvegicus
tcccttctctagtctgaggccaggt

SEQ ID NO: 627390 - DNA, 25 bp, Rattus norvegicus
ctgaggccaggtcccagagatgaga

SEQ ID NO: 627391 - DNA, 25 bp, Rattus norvegicus
gccaggtcccagagatgagagagct

SEQ ID NO: 627392 - DNA, 25 bp, Rattus norvegicus
ccgcggctctctcagcgggcgcgcc

SEQ ID NO: 627393 - DNA, 25 bp, Rattus norvegicus
gcgggcgcgcccgatcttctgcgcc

SEQ ID NO: 627394 - DNA, 25 bp, Rattus norvegicus
tgccttgcgtctgccgctacgggcg

SEQ ID NO: 627395 - DNA, 25 bp, Rattus norvegicus
ccacccgcgttcctctggggcctca

SEQ ID NO: 627396 - DNA, 25 bp, Rattus norvegicus
ggacgcaagtcacacatacccgtgg

SEQ ID NO: 627397 - DNA, 25 bp, Rattus norvegicus
catctgaagcatgcggccgggctgc

SEQ ID NO: 627398 - DNA, 25 bp, Rattus norvegicus
tgaactgggccagggtcttcaccat

SEQ ID NO: 627399 - DNA, 25 bp, Rattus norvegicus
cgcatgtcttccagcgcgatggtga

SEQ ID NO: 627400 - DNA, 25 bp, Rattus norvegicus
cttccagcgcgatggtgaactgggc

SEQ ID NO: 627401 - DNA, 25 bp, Rattus norvegicus
caacaagcccagtgccgccggacct

SEQ ID NO: 627402 - DNA, 25 bp, Rattus norvegicus
cggcgttagtagcagcgtcggtgag

SEQ ID NO: 627403 - DNA, 25 bp, Rattus norvegicus
cgcctcaggacgcaagtcacacata

SEQ ID NO: 627404 - DNA, 25 bp, Rattus norvegicus
tgggccagggtcttcaccatctgaa

SEQ ID NO: 627405 - DNA, 25 bp, Rattus norvegicus
agggtcttcaccatctgaagcatgc

SEQ ID NO: 627406 - DNA, 25 bp, Rattus norvegicus
aagtcacacatacccgtggaccagg

SEQ ID NO: 627407 - DNA, 25 bp, Rattus norvegicus
acacatacccgtggaccaggacgcg

SEQ ID NO: 627408 - DNA, 25 bp, Rattus norvegicus
ttcaccatctgaagcatgcggccgg

SEQ ID NO: 627409 - DNA, 25 bp, Rattus norvegicus
cgaagatcaagtttctgcggctaca

SEQ ID NO: 627410 - DNA, 25 bp, Rattus norvegicus
ggctcggttcctgcactcaaattcc

SEQ ID NO: 627411 - DNA, 25 bp, Rattus norvegicus
aggtccaaccttagcctctgcggga

SEQ ID NO: 627412 - DNA, 25 bp, Rattus norvegicus
ggctacaggaggcaggagctccatc

SEQ ID NO: 627413 - DNA, 25 bp, Rattus norvegicus
agcagaggtttatcagtcgaagatc

SEQ ID NO: 627414 - DNA, 25 bp, Rattus norvegicus
gtccgagaatctgggtcctgcacca

SEQ ID NO: 627415 - DNA, 25 bp, Rattus norvegicus
gcagtttaaacgagacgctgcgata

SEQ ID NO: 627416 - DNA, 25 bp, Rattus norvegicus
gccgctccagtgttccagcagttta

SEQ ID NO: 627417 - DNA, 25 bp, Rattus norvegicus
agcaccagtggagtcgtcgtccaga

SEQ ID NO: 627418 - DNA, 25 bp, Rattus norvegicus
cggaccgccgaagagtttgcgcatc

SEQ ID NO: 627419 - DNA, 25 bp, Rattus norvegicus
ccatgaaactctgtcggggctggtc

SEQ ID NO: 627420 - DNA, 25 bp, Rattus norvegicus
ccttccgctgcttcttctgtggtga

SEQ ID NO: 627421 - DNA, 25 bp, Rattus norvegicus
acccagggcctcagagtctacactg

SEQ ID NO: 627422 - DNA, 25 bp, Rattus norvegicus
agtctacactgggtcgtctggagct

SEQ ID NO: 627423 - DNA, 25 bp, Rattus norvegicus
ctgctgggccatcctggcgacacag

SEQ ID NO: 627424 - DNA, 25 bp, Rattus norvegicus
tcaggtcgtagcagacagtgcggtt

SEQ ID NO: 627425 - DNA, 25 bp, Rattus norvegicus
tgagggccatgccatacggcaggta

SEQ ID NO: 627426 - DNA, 25 bp, Rattus norvegicus
agggaagcaagaagccgatgaccgt

SEQ ID NO: 627427 - DNA, 25 bp, Rattus norvegicus
ccatgcgacagtagcaggccagtaa

SEQ ID NO: 627428 - DNA, 25 bp, Rattus norvegicus
acgctcttgggccacaggacctgct

SEQ ID NO: 627429 - DNA, 25 bp, Rattus norvegicus
atacgggccgccttgctgcgacgct

SEQ ID NO: 627430 - DNA, 25 bp, Rattus norvegicus
gctgctaccacgacagccatacggg

SEQ ID NO: 627431 - DNA, 25 bp, Rattus norvegicus
aggcaggaagctgataacaaagaca

SEQ ID NO: 627432 - DNA, 25 bp, Rattus norvegicus
ccaagtaggctgtcttggtgatgtg

SEQ ID NO: 627433 - DNA, 25 bp, Rattus norvegicus
cgtggagcgcacagccaagtaggct

SEQ ID NO: 627434 - DNA, 25 bp, Rattus norvegicus
cgaaggtctccagtaccgggcaaga

SEQ ID NO: 627435 - DNA, 25 bp, Rattus norvegicus
ctttgtaggctgcagcgaaggtctc

SEQ ID NO: 627436 - DNA, 25 bp, Rattus norvegicus
ccagtaaggctgtgaagggaagcaa

SEQ ID NO: 627437 - DNA, 25 bp, Rattus norvegicus
taggcctggcccaaaggactaactg

SEQ ID NO: 627438 - DNA, 25 bp, Rattus norvegicus
aaaattgccgcaccttcatgagccg

SEQ ID NO: 627439 - DNA, 25 bp, Rattus norvegicus
cgcaccttcatgagccggagggccg

SEQ ID NO: 627440 - DNA, 25 bp, Rattus norvegicus
ttgccgcaccttcatgagccggagg

SEQ ID NO: 627441 - DNA, 25 bp, Rattus norvegicus
tggagggaaaaattgccgcaccttc

SEQ ID NO: 627442 - DNA, 25 bp, Rattus norvegicus
ttccgctggagggaaaaattgccgc

SEQ ID NO: 627443 - DNA, 25 bp, Rattus norvegicus
caaactattagtggattccgctgga

SEQ ID NO: 627444 - DNA, 25 bp, Rattus norvegicus
ggagctgccgaacaaactattagtg

SEQ ID NO: 627445 - DNA, 25 bp, Rattus norvegicus
ccgggagctgccgaacaaactatta

SEQ ID NO: 627446 - DNA, 25 bp, Rattus norvegicus
gcctggcccaaaggactaactggtc

SEQ ID NO: 627447 - DNA, 25 bp, Rattus norvegicus
gaaagccgaaggtaggcctggccca

SEQ ID NO: 627448 - DNA, 25 bp, Rattus norvegicus
gggcagcagggtttggaaagccgaa

SEQ ID NO: 627449 - DNA, 25 bp, Rattus norvegicus
cggcccggagtcaggcggacaagcc

SEQ ID NO: 627450 - DNA, 25 bp, Rattus norvegicus
aaggactaactggtccgggagctgc

SEQ ID NO: 627451 - DNA, 25 bp, Rattus norvegicus
acccgcttggagacgcggtcagtca

SEQ ID NO: 627452 - DNA, 25 bp, Rattus norvegicus
ctctcagggtcccacgtgcctggaa

SEQ ID NO: 627453 - DNA, 25 bp, Rattus norvegicus
tggctgagcagaggccacctgcttc

SEQ ID NO: 627454 - DNA, 25 bp, Rattus norvegicus
cgtgtccgcaacaggctgttgagca

SEQ ID NO: 627455 - DNA, 25 bp, Rattus norvegicus
gtccagtctgccacccgcttggaga

SEQ ID NO: 627456 - DNA, 25 bp, Rattus norvegicus
acccttccagacagatgcgtccagt

SEQ ID NO: 627457 - DNA, 25 bp, Rattus norvegicus
cagacgctgggcagacaccggagcc

SEQ ID NO: 627458 - DNA, 25 bp, Rattus norvegicus
gcggttcctggtgcccgagtcccat

SEQ ID NO: 627459 - DNA, 25 bp, Rattus norvegicus
ccctgtttggcgctgagtcgacagg

SEQ ID NO: 627460 - DNA, 25 bp, Rattus norvegicus
tcacgtaatgggctctccctgtttg

SEQ ID NO: 627461 - DNA, 25 bp, Rattus norvegicus
gccctcgggacagagtcacgtaatg

SEQ ID NO: 627462 - DNA, 25 bp, Rattus norvegicus
accgcccagttttgcgcagtacaag

SEQ ID NO: 627463 - DNA, 25 bp, Rattus norvegicus
aaggcgaccgtcctggctgagcaga

SEQ ID NO: 627464 - DNA, 25 bp, Rattus norvegicus
gagtcccatgccgagcctctcaggg

SEQ ID NO: 627465 - DNA, 25 bp, Rattus norvegicus
cactctagcctcttggcttgtcaga

SEQ ID NO: 627466 - DNA, 25 bp, Rattus norvegicus
atgtcccttcagcatcatgcagccg

SEQ ID NO: 627467 - DNA, 25 bp, Rattus norvegicus
gggtggtggtgcgtacaaagaacgc

SEQ ID NO: 627468 - DNA, 25 bp, Rattus norvegicus
ggcttgtcagagttgccgcccgctc

SEQ ID NO: 627469 - DNA, 25 bp, Rattus norvegicus
tacaaagaacgcggctggggcgacc

SEQ ID NO: 627470 - DNA, 25 bp, Rattus norvegicus
ccgcaaggggccaagaccactctag

SEQ ID NO: 627471 - DNA, 25 bp, Rattus norvegicus
aagaccactctagcctcttggcttg

SEQ ID NO: 627472 - DNA, 25 bp, Rattus norvegicus
ctcacagtcttttaaacgccgccgt

SEQ ID NO: 627473 - DNA, 25 bp, Rattus norvegicus
ctagcctcttggcttgtcagagttg

SEQ ID NO: 627474 - DNA, 25 bp, Rattus norvegicus
tcttggcttgtcagagttgccgccc

SEQ ID NO: 627475 - DNA, 25 bp, Rattus norvegicus
ggggccaagaccactctagcctctt

SEQ ID NO: 627476 - DNA, 25 bp, Rattus norvegicus
gcgccctgcagcttgctgggccgcc

SEQ ID NO: 627477 - DNA, 25 bp, Rattus norvegicus
ggcggaggattgatgtcccttcagc

SEQ ID NO: 627478 - DNA, 25 bp, Rattus norvegicus
ggaggattgatgtcccttcagcatc

SEQ ID NO: 627479 - DNA, 25 bp, Rattus norvegicus
caagtcgcgtgcctcttcctggagc

SEQ ID NO: 627480 - DNA, 25 bp, Rattus norvegicus
ggcttctctctgtgccgagttctcc

SEQ ID NO: 627481 - DNA, 25 bp, Rattus norvegicus
cgcagagtctcgtaggcttctctct

SEQ ID NO: 627482 - DNA, 25 bp, Rattus norvegicus
ctcgcgcagagtctcgtaggcttct

SEQ ID NO: 627483 - DNA, 25 bp, Rattus norvegicus
tgcgcagcttgctcgcgcagagtct

SEQ ID NO: 627484 - DNA, 25 bp, Rattus norvegicus
agtgccgcttcctggtgcgcagctt

SEQ ID NO: 627485 - DNA, 25 bp, Rattus norvegicus
tcttcctggagcctgcgcagtgccg

SEQ ID NO: 627486 - DNA, 25 bp, Rattus norvegicus
tgctccagcaagtcgcgtgcctctt

SEQ ID NO: 627487 - DNA, 25 bp, Rattus norvegicus
gctgcacaagttgctccagcaagtc

SEQ ID NO: 627488 - DNA, 25 bp, Rattus norvegicus
gccttacgctgcacaagttgctcca

SEQ ID NO: 627489 - DNA, 25 bp, Rattus norvegicus
gcgcgcgccttacgctgcacaagtt

SEQ ID NO: 627490 - DNA, 25 bp, Rattus norvegicus
gtgccgagttctccgcttgccgttc

SEQ ID NO: 627491 - DNA, 25 bp, Rattus norvegicus
ctcgttacgtagattgcgctcggcg

SEQ ID NO: 627492 - DNA, 25 bp, Rattus norvegicus
agcctgcgcagtgccgcttcctggt

SEQ ID NO: 627493 - DNA, 25 bp, Rattus norvegicus
agcagagatcgcagcctccctgacg

SEQ ID NO: 627494 - DNA, 25 bp, Rattus norvegicus
cccgggctaagcagcagagatcgca

SEQ ID NO: 627495 - DNA, 25 bp, Rattus norvegicus
tgctgcggccgaccaaaaccttcag

SEQ ID NO: 627496 - DNA, 25 bp, Rattus norvegicus
tctggacatctcaaagcagatgctg

SEQ ID NO: 627497 - DNA, 25 bp, Rattus norvegicus
ccggtctgtaccaagagcgtttgtc

SEQ ID NO: 627498 - DNA, 25 bp, Rattus norvegicus
ctcccggggactccatgacgtcagg

SEQ ID NO: 627499 - DNA, 25 bp, Rattus norvegicus
taacaggttcctggatgcaaggccc

SEQ ID NO: 627500 - DNA, 25 bp, Rattus norvegicus
cccgatgccgcagctgtcgcaggat

SEQ ID NO: 627501 - DNA, 25 bp, Rattus norvegicus
ctagctccaagaagagcgccttttg

SEQ ID NO: 627502 - DNA, 25 bp, Rattus norvegicus
ggacgcactcacaagccggcactag

SEQ ID NO: 627503 - DNA, 25 bp, Rattus norvegicus
gggacaagccctctctccaagcagg

SEQ ID NO: 627504 - DNA, 25 bp, Rattus norvegicus
gtcacaagtcgagccgcgggacaag

SEQ ID NO: 627505 - DNA, 25 bp, Rattus norvegicus
gccgctgtcctgagtcacaagtcga

SEQ ID NO: 627506 - DNA, 25 bp, Rattus norvegicus
atgcaaggccctcgggaactgagcc

SEQ ID NO: 627507 - DNA, 25 bp, Rattus norvegicus
tacctcaagttggacgctcggggtc

SEQ ID NO: 627508 - DNA, 25 bp, Rattus norvegicus
ggccacggtaagtcgaataagcttc

SEQ ID NO: 627509 - DNA, 25 bp, Rattus norvegicus
gtcgaataagcttcaccgggcaatg

SEQ ID NO: 627510 - DNA, 25 bp, Rattus norvegicus
gcttcaccgggcaatggcctctata

SEQ ID NO: 627511 - DNA, 25 bp, Rattus norvegicus
ccctcgctgctccaaggctgtggag

SEQ ID NO: 627512 - DNA, 25 bp, Rattus norvegicus
cgcagtggcagagcggccacaacca

SEQ ID NO: 627513 - DNA, 25 bp, Rattus norvegicus
gcagagcggccacaaccactagggg

SEQ ID NO: 627514 - DNA, 25 bp, Rattus norvegicus
cagggccgctgctagtccaaccgag

SEQ ID NO: 627515 - DNA, 25 bp, Rattus norvegicus
ctgctagtccaaccgagctcggggc

SEQ ID NO: 627516 - DNA, 25 bp, Rattus norvegicus
tccaaccgagctcggggcgtgctcg

SEQ ID NO: 627517 - DNA, 25 bp, Rattus norvegicus
gctcgctggaaagcgcacgcgcgaa

SEQ ID NO: 627518 - DNA, 25 bp, Rattus norvegicus
ggccttgcagcctgggtaaacacca

SEQ ID NO: 627519 - DNA, 25 bp, Rattus norvegicus
cgcctgcgcgatgagtacctcaagt

SEQ ID NO: 627520 - DNA, 25 bp, Rattus norvegicus
tgcagcctgggtaaacaccaaaaag

SEQ ID NO: 627521 - DNA, 25 bp, Rattus norvegicus
tcccaggaaggtggcgtcagcatct

SEQ ID NO: 627522 - DNA, 25 bp, Rattus norvegicus
cagcttgctgccgagttagttgtgc

SEQ ID NO: 627523 - DNA, 25 bp, Rattus norvegicus
accctactgccgctccagggaagta

SEQ ID NO: 627524 - DNA, 25 bp, Rattus norvegicus
ccagggaagtatgaggtcgctcctt

SEQ ID NO: 627525 - DNA, 25 bp, Rattus norvegicus
tgactgtcctgtgccggtgcacaac

SEQ ID NO: 627526 - DNA, 25 bp, Rattus norvegicus
gtgcacaaccgcctggggccagtac

SEQ ID NO: 627527 - DNA, 25 bp, Rattus norvegicus
gggccagtacctgcccttctaaagc

SEQ ID NO: 627528 - DNA, 25 bp, Rattus norvegicus
caaaccggtcttgcaggtcccagga

SEQ ID NO: 627529 - DNA, 25 bp, Rattus norvegicus
acccaggagagtcggactaggacca

SEQ ID NO: 627530 - DNA, 25 bp, Rattus norvegicus
tctctatggaaaagccagctgcttc

SEQ ID NO: 627531 - DNA, 25 bp, Rattus norvegicus
ccgtgaaagtgtccaggtgcccgat

SEQ ID NO: 627532 - DNA, 25 bp, Rattus norvegicus
cccgatgaccaggacttccgcagtt

SEQ ID NO: 627533 - DNA, 25 bp, Rattus norvegicus
ttccgcagttttcggtcagagtgtg

SEQ ID NO: 627534 - DNA, 25 bp, Rattus norvegicus
ttctaaagctgtccgctggtccggg

SEQ ID NO: 627535 - DNA, 25 bp, Rattus norvegicus
tactggctccattcctcagagggga

SEQ ID NO: 627536 - DNA, 25 bp, Rattus norvegicus
cccagagggtagactcactagaaca

SEQ ID NO: 627537 - DNA, 25 bp, Rattus norvegicus
cagttgtggccggtactggctccat

SEQ ID NO: 627538 - DNA, 25 bp, Rattus norvegicus
tgggacctcccaattgccagttgtg

SEQ ID NO: 627539 - DNA, 25 bp, Rattus norvegicus
tctcttcgctcaaaacaggtcagtg

SEQ ID NO: 627540 - DNA, 25 bp, Rattus norvegicus
cccgtggagttctcttcgctcaaaa

SEQ ID NO: 627541 - DNA, 25 bp, Rattus norvegicus
tctagggtactgagaatccggacaa

SEQ ID NO: 627542 - DNA, 25 bp, Rattus norvegicus
tcaaagcctcagtaagctaagggta

SEQ ID NO: 627543 - DNA, 25 bp, Rattus norvegicus
gggtagacctgagcttcaaagcctc

SEQ ID NO: 627544 - DNA, 25 bp, Rattus norvegicus
caaggatccatagagtctcagcagg

SEQ ID NO: 627545 - DNA, 25 bp, Rattus norvegicus
tcgagacaaggagactcaaggatcc

SEQ ID NO: 627546 - DNA, 25 bp, Rattus norvegicus
tcactagaacaagggtgtcgagaca

SEQ ID NO: 627547 - DNA, 25 bp, Rattus norvegicus
cctgtgtgtgttcccagagggtaga

SEQ ID NO: 627548 - DNA, 25 bp, Rattus norvegicus
aattttcccggggtcatctggtgcg

SEQ ID NO: 627549 - DNA, 25 bp, Rattus norvegicus
cacaacgccttccaggttacccagg

SEQ ID NO: 627550 - DNA, 25 bp, Rattus norvegicus
acagcatcggccgacgtttctggcg

SEQ ID NO: 627551 - DNA, 25 bp, Rattus norvegicus
gaagcgacattctctgctgtgggtc

SEQ ID NO: 627552 - DNA, 25 bp, Rattus norvegicus
gggccctcaactctggcacagtgta

SEQ ID NO: 627553 - DNA, 25 bp, Rattus norvegicus
tgacagctttgggtcaccgtgcggt

SEQ ID NO: 627554 - DNA, 25 bp, Rattus norvegicus
tctgctttgacagctttgggtcacc

SEQ ID NO: 627555 - DNA, 25 bp, Rattus norvegicus
atggtgaggaagctctgctttgaca

SEQ ID NO: 627556 - DNA, 25 bp, Rattus norvegicus
acggaactgaccacgctgcacactt

SEQ ID NO: 627557 - DNA, 25 bp, Rattus norvegicus
gccggaaacggaactgaccacgctg

SEQ ID NO: 627558 - DNA, 25 bp, Rattus norvegicus
caggtcccgtccttccgcccagacg

SEQ ID NO: 627559 - DNA, 25 bp, Rattus norvegicus
gaaagacgtccttcacaacgccttc

SEQ ID NO: 627560 - DNA, 25 bp, Rattus norvegicus
gcaaagaatctaccgaaagacgtcc

SEQ ID NO: 627561 - DNA, 25 bp, Rattus norvegicus
tttgtccttggcgagggacagcatc

SEQ ID NO: 627562 - DNA, 25 bp, Rattus norvegicus
gcccagacgccggaaacggaactga

SEQ ID NO: 627563 - DNA, 25 bp, Rattus norvegicus
gctttgaccctcttcagactcctgg

SEQ ID NO: 627564 - DNA, 25 bp, Rattus norvegicus
gtgttgcaccacatcctcatcgctg

SEQ ID NO: 627565 - DNA, 25 bp, Rattus norvegicus
ttcacagatctgctaccgcttcagg

SEQ ID NO: 627566 - DNA, 25 bp, Rattus norvegicus
agcaggtcttcctcaagccggacga

SEQ ID NO: 627567 - DNA, 25 bp, Rattus norvegicus
gtcccattttgaagcgacctctaaa

SEQ ID NO: 627568 - DNA, 25 bp, Rattus norvegicus
acctggtagccttagggacccattg

SEQ ID NO: 627569 - DNA, 25 bp, Rattus norvegicus
tcctctgccctctgcactggaaaga

SEQ ID NO: 627570 - DNA, 25 bp, Rattus norvegicus
ggaacccttatagtcgacccgctgc

SEQ ID NO: 627571 - DNA, 25 bp, Rattus norvegicus
ttgtccaattcctcaggcggggcca

SEQ ID NO: 627572 - DNA, 25 bp, Rattus norvegicus
tgctgtccctggtagcagagacgta

SEQ ID NO: 627573 - DNA, 25 bp, Rattus norvegicus
ggcgcacgtgtctccttcacagatc

SEQ ID NO: 627574 - DNA, 25 bp, Rattus norvegicus
ctcctggaacgctgatgcagaccta

SEQ ID NO: 627575 - DNA, 25 bp, Rattus norvegicus
acgagcatggtcctggtgttgcacc

SEQ ID NO: 627576 - DNA, 25 bp, Rattus norvegicus
accgcttcagggctcgtcccatttt

SEQ ID NO: 627577 - DNA, 25 bp, Rattus norvegicus
atccctgcggaccaaggcatcgcgg

SEQ ID NO: 627578 - DNA, 25 bp, Rattus norvegicus
gaacgagaaccaaggtgccgacctg

SEQ ID NO: 627579 - DNA, 25 bp, Rattus norvegicus
gcaacattctctgcttccctatcaa

SEQ ID NO: 627580 - DNA, 25 bp, Rattus norvegicus
caaggtgccgacctgtggccgccag

SEQ ID NO: 627581 - DNA, 25 bp, Rattus norvegicus
ctggcttccgcacgcgcaacattct

SEQ ID NO: 627582 - DNA, 25 bp, Rattus norvegicus
agacgacagcactggcttccgcacg

SEQ ID NO: 627583 - DNA, 25 bp, Rattus norvegicus
ttctatcgcggcgtagacgacagca

SEQ ID NO: 627584 - DNA, 25 bp, Rattus norvegicus
atccgcttttctatcgcggcgtaga

SEQ ID NO: 627585 - DNA, 25 bp, Rattus norvegicus
atgcatacgcccatccgcttttcta

SEQ ID NO: 627586 - DNA, 25 bp, Rattus norvegicus
tcctgaacatcccagatgcatacgc

SEQ ID NO: 627587 - DNA, 25 bp, Rattus norvegicus
gaccacgggccagatcctgaacatc

SEQ ID NO: 627588 - DNA, 25 bp, Rattus norvegicus
gccacgtggcgaccacgggccagat

SEQ ID NO: 627589 - DNA, 25 bp, Rattus norvegicus
cggaccaaggcatcgcgggccacgt

SEQ ID NO: 627590 - DNA, 25 bp, Rattus norvegicus
tgcttccctatcaagaacgagaacc

SEQ ID NO: 627591 - DNA, 25 bp, Rattus norvegicus
cccaatcgacgtaggttccgtagat

SEQ ID NO: 627592 - DNA, 25 bp, Rattus norvegicus
agcgacctagacgacggcgcccacc

SEQ ID NO: 627593 - DNA, 25 bp, Rattus norvegicus
actcggggcagcgacctagacgacg

SEQ ID NO: 627594 - DNA, 25 bp, Rattus norvegicus
acagaacctggcagcgaaggggaac

SEQ ID NO: 627595 - DNA, 25 bp, Rattus norvegicus
ccctcaggtgggacagaacctggca

SEQ ID NO: 627596 - DNA, 25 bp, Rattus norvegicus
gctccctcaggtgggacagaacctg

SEQ ID NO: 627597 - DNA, 25 bp, Rattus norvegicus
caccacccatggtggcagaggctcc

SEQ ID NO: 627598 - DNA, 25 bp, Rattus norvegicus
caatcgacgtaggttccgtagattc

SEQ ID NO: 627599 - DNA, 25 bp, Rattus norvegicus
cagaggctccctcaggtgggacaga

SEQ ID NO: 627600 - DNA, 25 bp, Rattus norvegicus
gacgtaggttccgtagattcattcc

SEQ ID NO: 627601 - DNA, 25 bp, Rattus norvegicus
cccttcttctatcgaaggcggtttg

SEQ ID NO: 627602 - DNA, 25 bp, Rattus norvegicus
gtagattcattcctcggcctcgccc

SEQ ID NO: 627603 - DNA, 25 bp, Rattus norvegicus
acggcgcccacctcccttcttctat

SEQ ID NO: 627604 - DNA, 25 bp, Rattus norvegicus
tcttctatcgaaggcggtttgtgcg

SEQ ID NO: 627605 - DNA, 25 bp, Rattus norvegicus
ttcggcgcctgcagccagcctggag

SEQ ID NO: 627606 - DNA, 25 bp, Rattus norvegicus
tactgcacttgcgttgcaccggggc

SEQ ID NO: 627607 - DNA, 25 bp, Rattus norvegicus
tctcgggcactcagagtgggtctca

SEQ ID NO: 627608 - DNA, 25 bp, Rattus norvegicus
cactcagagtgggtctcaggtcttc

SEQ ID NO: 627609 - DNA, 25 bp, Rattus norvegicus
accctactcggcaggtgagcgcagt

SEQ ID NO: 627610 - DNA, 25 bp, Rattus norvegicus
ctcaggtcttctgcgcctggagctc

SEQ ID NO: 627611 - DNA, 25 bp, Rattus norvegicus
ctggagctcgaatctccgtcccgaa

SEQ ID NO: 627612 - DNA, 25 bp, Rattus norvegicus
tcgggccgatggactactcctacct

SEQ ID NO: 627613 - DNA, 25 bp, Rattus norvegicus
tggactactcctacctcaattcgta

SEQ ID NO: 627614 - DNA, 25 bp, Rattus norvegicus
cctcaattcgtacgattcgtgcgtg

SEQ ID NO: 627615 - DNA, 25 bp, Rattus norvegicus
ctggcggtactgcacttgcgttgca

SEQ ID NO: 627616 - DNA, 25 bp, Rattus norvegicus
aggcgtccgcctacggtgacttcgg

SEQ ID NO: 627617 - DNA, 25 bp, Rattus norvegicus
agcctggaggcttccaatacagtcc

SEQ ID NO: 627618 - DNA, 25 bp, Rattus norvegicus
cgtacgattcgtgcgtggcggccat

SEQ ID NO: 627619 - DNA, 25 bp, Rattus norvegicus
ttacactcgcgaggaactggcgctc

SEQ ID NO: 627620 - DNA, 25 bp, Rattus norvegicus
tgcgtggatacacgtgctgtgcacg

SEQ ID NO: 627621 - DNA, 25 bp, Rattus norvegicus
ctcgcgtgcaggtgcgtggatacac

SEQ ID NO: 627622 - DNA, 25 bp, Rattus norvegicus
tcgacctcactgaggctcgcgtgca

SEQ ID NO: 627623 - DNA, 25 bp, Rattus norvegicus
ctcgcgaggaactggcgctcaagat

SEQ ID NO: 627624 - DNA, 25 bp, Rattus norvegicus
tacccggacatttacactcgcgagg

SEQ ID NO: 627625 - DNA, 25 bp, Rattus norvegicus
tggagcgcgtcttcgccgagaccca

SEQ ID NO: 627626 - DNA, 25 bp, Rattus norvegicus
gctcaaggagttggagcgcgtcttc

SEQ ID NO: 627627 - DNA, 25 bp, Rattus norvegicus
cacgagtgctcagctcaaggagttg

SEQ ID NO: 627628 - DNA, 25 bp, Rattus norvegicus
accacgttcacgagtgctcagctca

SEQ ID NO: 627629 - DNA, 25 bp, Rattus norvegicus
cctgcatgagaagcgcaagcagcgg

SEQ ID NO: 627630 - DNA, 25 bp, Rattus norvegicus
cttcccggagccgtccggcctgcat

SEQ ID NO: 627631 - DNA, 25 bp, Rattus norvegicus
tcccgcagttccctacaagttcttc

SEQ ID NO: 627632 - DNA, 25 bp, Rattus norvegicus
tggcgctcaagatcgacctcactga

SEQ ID NO: 627633 - DNA, 25 bp, Rattus norvegicus
ttccgcaaacaggagcgcgcggcca

SEQ ID NO: 627634 - DNA, 25 bp, Rattus norvegicus
acgcccgacagcaccgcgtcgctgc

SEQ ID NO: 627635 - DNA, 25 bp, Rattus norvegicus
gactccaaggagtccacgtgcagcc

SEQ ID NO: 627636 - DNA, 25 bp, Rattus norvegicus
ccgaggacgacgactccaaggagtc

SEQ ID NO: 627637 - DNA, 25 bp, Rattus norvegicus
ccaaaaagggcgaggcgcgttgctc

SEQ ID NO: 627638 - DNA, 25 bp, Rattus norvegicus
cccaacggcctggagcttaagtgtc

SEQ ID NO: 627639 - DNA, 25 bp, Rattus norvegicus
cgccgggctaagttccgcaaacagg

SEQ ID NO: 627640 - DNA, 25 bp, Rattus norvegicus
taactggtccctgtgcccacaggtc

SEQ ID NO: 627641 - DNA, 25 bp, Rattus norvegicus
tcctctgggctaactggtccctgtg

SEQ ID NO: 627642 - DNA, 25 bp, Rattus norvegicus
gcgaccgtcctctgggctaactggt

SEQ ID NO: 627643 - DNA, 25 bp, Rattus norvegicus
cttaagtgtcccgtgcgaccgtcct

SEQ ID NO: 627644 - DNA, 25 bp, Rattus norvegicus
ctggagcttaagtgtcccgtgcgac

SEQ ID NO: 627645 - DNA, 25 bp, Rattus norvegicus
agaccggtcccaacggcctggagct

SEQ ID NO: 627646 - DNA, 25 bp, Rattus norvegicus
cgcgttgctcgtccgaggacgacga

SEQ ID NO: 627647 - DNA, 25 bp, Rattus norvegicus
tctttaagcctttcacgcaccgatc

SEQ ID NO: 627648 - DNA, 25 bp, Rattus norvegicus
tactacacatttctgctactcggca

SEQ ID NO: 627649 - DNA, 25 bp, Rattus norvegicus
ggcgactctggtgactcctagcccg

SEQ ID NO: 627650 - DNA, 25 bp, Rattus norvegicus
cgcagagtgacctcgggccaatctt

SEQ ID NO: 627651 - DNA, 25 bp, Rattus norvegicus
acttgtgagtccgagttctccctgg

SEQ ID NO: 627652 - DNA, 25 bp, Rattus norvegicus
tccctatgcaagtctgattctacta

SEQ ID NO: 627653 - DNA, 25 bp, Rattus norvegicus
acccgctacgggacaacttgtgagt

SEQ ID NO: 627654 - DNA, 25 bp, Rattus norvegicus
atcgcggttcgcaaaggaaggctcc

SEQ ID NO: 627655 - DNA, 25 bp, Rattus norvegicus
gaaggctccaggatagacatccaca

SEQ ID NO: 627656 - DNA, 25 bp, Rattus norvegicus
cccatcatccaagagaacaagttct

SEQ ID NO: 627657 - DNA, 25 bp, Rattus norvegicus
ccgatccctgacacatctcataaga

SEQ ID NO: 627658 - DNA, 25 bp, Rattus norvegicus
cgcgcacgaggtccagtatctttaa

SEQ ID NO: 627659 - DNA, 25 bp, Rattus norvegicus
ggcccaggttttgcagtcccagact

SEQ ID NO: 627660 - DNA, 25 bp, Rattus norvegicus
ttctccctggtgaattcaacccttc

SEQ ID NO: 627661 - DNA, 25 bp, Rattus norvegicus
gtagacggagcaaataaatgtcctc

SEQ ID NO: 627662 - DNA, 25 bp, Rattus norvegicus
atgcgttagtgagtcccggattctg

SEQ ID NO: 627663 - DNA, 25 bp, Rattus norvegicus
tgtggtagttgaagcgggaaacaaa

SEQ ID NO: 627664 - DNA, 25 bp, Rattus norvegicus
ccggattctggtgggttcttccgct

SEQ ID NO: 627665 - DNA, 25 bp, Rattus norvegicus
ggttcttccgctcaggtctggggaa

SEQ ID NO: 627666 - DNA, 25 bp, Rattus norvegicus
cggaagacgcatgcgttagtgagtc

SEQ ID NO: 627667 - DNA, 25 bp, Rattus norvegicus
cttgaaactcaaggcggggccgata

SEQ ID NO: 627668 - DNA, 25 bp, Rattus norvegicus
gaaacaaaaggagacggaagacgca

SEQ ID NO: 627669 - DNA, 25 bp, Rattus norvegicus
agaggggctagcctgcagaaaccag

SEQ ID NO: 627670 - DNA, 25 bp, Rattus norvegicus
acatcacttccggtgtggtagttga

SEQ ID NO: 627671 - DNA, 25 bp, Rattus norvegicus
aggtacgtcaacatcacttccggtg

SEQ ID NO: 627672 - DNA, 25 bp, Rattus norvegicus
tgtacgtaactaaggtacgtcaaca

SEQ ID NO: 627673 - DNA, 25 bp, Rattus norvegicus
ggccgataggtagacggagcaaata

SEQ ID NO: 627674 - DNA, 25 bp, Rattus norvegicus
ctgcagaaaccaggcccttgaaact

SEQ ID NO: 627675 - DNA, 25 bp, Rattus norvegicus
tcctgtcacgtaggacgcacttttc

SEQ ID NO: 627676 - DNA, 25 bp, Rattus norvegicus
gctatagcagcgaaaacgaggactc

SEQ ID NO: 627677 - DNA, 25 bp, Rattus norvegicus
atgtgaccggaaaggctcctgacgg

SEQ ID NO: 627678 - DNA, 25 bp, Rattus norvegicus
cccgccatggggtgctgctatagca

SEQ ID NO: 627679 - DNA, 25 bp, Rattus norvegicus
gaaaggctcctgacggacgccgtcc

SEQ ID NO: 627680 - DNA, 25 bp, Rattus norvegicus
aaaacgaggactcggaccaggtgcg

SEQ ID NO: 627681 - DNA, 25 bp, Rattus norvegicus
ccagagcggctttaggacaggctaa

SEQ ID NO: 627682 - DNA, 25 bp, Rattus norvegicus
aaggcaagatttggctgtggcgcca

SEQ ID NO: 627683 - DNA, 25 bp, Rattus norvegicus
tccattggttggcagttgtcacgcg

SEQ ID NO: 627684 - DNA, 25 bp, Rattus norvegicus
tcacgtaggacgcacttttccattg

SEQ ID NO: 627685 - DNA, 25 bp, Rattus norvegicus
ccggtcctgtcacgtaggacgcact

SEQ ID NO: 627686 - DNA, 25 bp, Rattus norvegicus
cccgcctgccttcgggtcacgtgcc

SEQ ID NO: 627687 - DNA, 25 bp, Rattus norvegicus
ggacgcacttttccattggttggca

SEQ ID NO: 627688 - DNA, 25 bp, Rattus norvegicus
agcggctttaggacaggctaagcga

SEQ ID NO: 627689 - DNA, 25 bp, Rattus norvegicus
ctctcgggatggctaggcctagagt

SEQ ID NO: 627690 - DNA, 25 bp, Rattus norvegicus
ctcgtagtgcagtccggaacttgta

SEQ ID NO: 627691 - DNA, 25 bp, Rattus norvegicus
tagttcaaggcaagtccgggatccg

SEQ ID NO: 627692 - DNA, 25 bp, Rattus norvegicus
gtccgccagagtgcccggcgaacaa

SEQ ID NO: 627693 - DNA, 25 bp, Rattus norvegicus
aacaacagccgagtggggccaatga

SEQ ID NO: 627694 - DNA, 25 bp, Rattus norvegicus
ggcgggatcatagtttaaactaatc

SEQ ID NO: 627695 - DNA, 25 bp, Rattus norvegicus
aacttgtagttcatcagggctggac

SEQ ID NO: 627696 - DNA, 25 bp, Rattus norvegicus
ctgtgcgagagacaacttgaggtga

SEQ ID NO: 627697 - DNA, 25 bp, Rattus norvegicus
gccctagacggctcagttgaacgtg

SEQ ID NO: 627698 - DNA, 25 bp, Rattus norvegicus
ctcagttgaacgtgctcgtagtgca

SEQ ID NO: 627699 - DNA, 25 bp, Rattus norvegicus
gcctagagtggctgctgtttgatca

SEQ ID NO: 627700 - DNA, 25 bp, Rattus norvegicus
tgcgagaggaaggtctccttcgtaa

SEQ ID NO: 627701 - DNA, 25 bp, Rattus norvegicus
gctgtttgatcacgccggtgcgaga

SEQ ID NO: 627702 - DNA, 25 bp, Rattus norvegicus
ctaatcgtatcttcactgtgcgaga

SEQ ID NO: 627703 - DNA, 25 bp, Rattus norvegicus
tcctagggcagacagcgaggttgaa

SEQ ID NO: 627704 - DNA, 25 bp, Rattus norvegicus
gggctgaagagatttcccgcagaga

SEQ ID NO: 627705 - DNA, 25 bp, Rattus norvegicus
cccgccaggggctgcctgtaggttc

SEQ ID NO: 627706 - DNA, 25 bp, Rattus norvegicus
atttcccgcagagaacgggctaggg

SEQ ID NO: 627707 - DNA, 25 bp, Rattus norvegicus
gttgaaggcggcctgcgctttgtgt

SEQ ID NO: 627708 - DNA, 25 bp, Rattus norvegicus
cggcgttgtgtgtgcctgcagacac

SEQ ID NO: 627709 - DNA, 25 bp, Rattus norvegicus
cctgtaaaaggcctgcgttgtgcgg

SEQ ID NO: 627710 - DNA, 25 bp, Rattus norvegicus
aaaaggcctgcgttgtgcggctccc

SEQ ID NO: 627711 - DNA, 25 bp, Rattus norvegicus
ttccaggcttcttctgtgccgggcg

SEQ ID NO: 627712 - DNA, 25 bp, Rattus norvegicus
cggttcccgccaggggctgcctgta

SEQ ID NO: 627713 - DNA, 25 bp, Rattus norvegicus
cctgcgctttgtgtggtggagagct

SEQ ID NO: 627714 - DNA, 25 bp, Rattus norvegicus
gaaggtacgggctgaagagatttcc

SEQ ID NO: 627715 - DNA, 25 bp, Rattus norvegicus
ctgaagagatttcccgcagagaacg

SEQ ID NO: 627716 - DNA, 25 bp, Rattus norvegicus
cgttgtgtgtgcctgcagacacgcc

SEQ ID NO: 627717 - DNA, 25 bp, Rattus norvegicus
tcaaacgccgtgtccacatggcggc

SEQ ID NO: 627718 - DNA, 25 bp, Rattus norvegicus
gtgcctgccgaagagaccggaaata

SEQ ID NO: 627719 - DNA, 25 bp, Rattus norvegicus
ccataccggttgtgcctgccgaaga

SEQ ID NO: 627720 - DNA, 25 bp, Rattus norvegicus
aacggaaccataccggttgtgcctg

SEQ ID NO: 627721 - DNA, 25 bp, Rattus norvegicus
tgcaaaagcgcatacccaacggaac

SEQ ID NO: 627722 - DNA, 25 bp, Rattus norvegicus
gccgcagtgtaaaataccgaggccc

SEQ ID NO: 627723 - DNA, 25 bp, Rattus norvegicus
cagcaagcactggaggcgctgccgc

SEQ ID NO: 627724 - DNA, 25 bp, Rattus norvegicus
gtggacgtcctggactccaagtgta

SEQ ID NO: 627725 - DNA, 25 bp, Rattus norvegicus
cacatggcggcgaggagctatagat

SEQ ID NO: 627726 - DNA, 25 bp, Rattus norvegicus
tccaagtgtacggaactcaaacgcc

SEQ ID NO: 627727 - DNA, 25 bp, Rattus norvegicus
gcgctgccgcagtgtaaaataccga

SEQ ID NO: 627728 - DNA, 25 bp, Rattus norvegicus
ccgaagagaccggaaataagagtcg

SEQ ID NO: 627729 - DNA, 25 bp, Rattus norvegicus
ctatagatgtgtaagcagcgaagct

SEQ ID NO: 627730 - DNA, 25 bp, Rattus norvegicus
aagctgtgcgcagtgccctccagca

SEQ ID NO: 627731 - DNA, 25 bp, Rattus norvegicus
tctccgcttaggtgcaaactttgcg

SEQ ID NO: 627732 - DNA, 25 bp, Rattus norvegicus
ccgggaggctgcagcgtcctcccca

SEQ ID NO: 627733 - DNA, 25 bp, Rattus norvegicus
aggcaggcgactggcgccgtgcgga

SEQ ID NO: 627734 - DNA, 25 bp, Rattus norvegicus
cggagaggcagcgtccggatggccc

SEQ ID NO: 627735 - DNA, 25 bp, Rattus norvegicus
cggggctgcgggaactccgcgtctt

SEQ ID NO: 627736 - DNA, 25 bp, Rattus norvegicus
gggcgcccgtctccgcttaggtgca

SEQ ID NO: 627737 - DNA, 25 bp, Rattus norvegicus
gcccgtctccgcttaggtgcaaact

SEQ ID NO: 627738 - DNA, 25 bp, Rattus norvegicus
gtctccgcttaggtgcaaactttgc

SEQ ID NO: 627739 - DNA, 25 bp, Rattus norvegicus
ctccgcttaggtgcaaactttgcgg

SEQ ID NO: 627740 - DNA, 25 bp, Rattus norvegicus
ccgcttaggtgcaaactttgcggag

SEQ ID NO: 627741 - DNA, 25 bp, Rattus norvegicus
ctcccgtgcccgaggtcgcggggtg

SEQ ID NO: 627742 - DNA, 25 bp, Rattus norvegicus
gggaactcgcgagcgacgctccggg

SEQ ID NO: 627743 - DNA, 25 bp, Rattus norvegicus
ttcggcctcgttacggcgccgcgga

SEQ ID NO: 627744 - DNA, 25 bp, Rattus norvegicus
ccgtctccgcttaggtgcaaacttt

SEQ ID NO: 627745 - DNA, 25 bp, Rattus norvegicus
ctcgggcctgcaactactgggcttt

SEQ ID NO: 627746 - DNA, 25 bp, Rattus norvegicus
tgtcacgcagagtaccggcatgatg

SEQ ID NO: 627747 - DNA, 25 bp, Rattus norvegicus
gggcagcccttgacgaaacacttcc

SEQ ID NO: 627748 - DNA, 25 bp, Rattus norvegicus
ccggcatgatgagctgcaaaatgta

SEQ ID NO: 627749 - DNA, 25 bp, Rattus norvegicus
cgtatatatactcaggtgcgccgca

SEQ ID NO: 627750 - DNA, 25 bp, Rattus norvegicus
tcttggggaagtctcagagcacgcc

SEQ ID NO: 627751 - DNA, 25 bp, Rattus norvegicus
ggaccgcttttgtctggaaccagtc

SEQ ID NO: 627752 - DNA, 25 bp, Rattus norvegicus
gagcgaagccggttccctcagttgt

SEQ ID NO: 627753 - DNA, 25 bp, Rattus norvegicus
cctcagttgtgagagtgtcgcttca

SEQ ID NO: 627754 - DNA, 25 bp, Rattus norvegicus
caaaatttcttgtgtggctgctccc

SEQ ID NO: 627755 - DNA, 25 bp, Rattus norvegicus
ctgggcttttcaatggccatgcttg

SEQ ID NO: 627756 - DNA, 25 bp, Rattus norvegicus
tcccacagtggcagatgagctccta

SEQ ID NO: 627757 - DNA, 25 bp, Rattus norvegicus
gagctcctatgcaggcgacaacatc

SEQ ID NO: 627758 - DNA, 25 bp, Rattus norvegicus
ctcctctgggtgacttaaatctcta

SEQ ID NO: 627759 - DNA, 25 bp, Rattus norvegicus
gcggcgtgctctacctgagaacaaa

SEQ ID NO: 627760 - DNA, 25 bp, Rattus norvegicus
atcgcgccctctttgctgctaatta

SEQ ID NO: 627761 - DNA, 25 bp, Rattus norvegicus
ctcttggtgattgtatcgcgccctc

SEQ ID NO: 627762 - DNA, 25 bp, Rattus norvegicus
gcagcggttcctcttggtgattgta

SEQ ID NO: 627763 - DNA, 25 bp, Rattus norvegicus
tttgtccattctccgcaaagaaggg

SEQ ID NO: 627764 - DNA, 25 bp, Rattus norvegicus
ctaggaggctcacaagtcattcttt

SEQ ID NO: 627765 - DNA, 25 bp, Rattus norvegicus
gttaggtccgtccttgacgaggtca

SEQ ID NO: 627766 - DNA, 25 bp, Rattus norvegicus
aagcagctttcagccgattctcggg

SEQ ID NO: 627767 - DNA, 25 bp, Rattus norvegicus
aggctgagcagggaaagcagctttc

SEQ ID NO: 627768 - DNA, 25 bp, Rattus norvegicus
tagggtcaccgccttcgcaaacagc

SEQ ID NO: 627769 - DNA, 25 bp, Rattus norvegicus
tgtgggcctatctaacctagggtca

SEQ ID NO: 627770 - DNA, 25 bp, Rattus norvegicus
cttccgcatactgtgggcctatcta

SEQ ID NO: 627771 - DNA, 25 bp, Rattus norvegicus
aacagctaggcaacacgtcccgggc

SEQ ID NO: 627772 - DNA, 25 bp, Rattus norvegicus
aagacaccaacttcgcgctggcgca

SEQ ID NO: 627773 - DNA, 25 bp, Rattus norvegicus
ccggggaacaagacagaagatgctc

SEQ ID NO: 627774 - DNA, 25 bp, Rattus norvegicus
tacctcacgggagtggtagtccacg

SEQ ID NO: 627775 - DNA, 25 bp, Rattus norvegicus
ggactgcgcactacctcacgggagt

SEQ ID NO: 627776 - DNA, 25 bp, Rattus norvegicus
cccgtgctagccacgatcaacatgg

SEQ ID NO: 627777 - DNA, 25 bp, Rattus norvegicus
tgcttctaaaacctgctggtgccgg

SEQ ID NO: 627778 - DNA, 25 bp, Rattus norvegicus
gacaacatcatgacacctgcttcta

SEQ ID NO: 627779 - DNA, 25 bp, Rattus norvegicus
ctcaacaccgcggacaacatcatga

SEQ ID NO: 627780 - DNA, 25 bp, Rattus norvegicus
ttaaccctaggaagagccgaggcgc

SEQ ID NO: 627781 - DNA, 25 bp, Rattus norvegicus
cccggctttgaagagatggagattt

SEQ ID NO: 627782 - DNA, 25 bp, Rattus norvegicus
tacgctacggttgtaagcacctccc

SEQ ID NO: 627783 - DNA, 25 bp, Rattus norvegicus
cagaagatgctccagggcgcaccca

SEQ ID NO: 627784 - DNA, 25 bp, Rattus norvegicus
tatgggatctcggtgcgttctccac

SEQ ID NO: 627785 - DNA, 25 bp, Rattus norvegicus
ccgcgtccagacgaggcggcagtca

SEQ ID NO: 627786 - DNA, 25 bp, Rattus norvegicus
ccgcggtctccggtgattacgctac

SEQ ID NO: 627787 - DNA, 25 bp, Rattus norvegicus
tgggctaaccgctttctcgaaggta

SEQ ID NO: 627788 - DNA, 25 bp, Rattus norvegicus
caagagtggtctctccgcgactgta

SEQ ID NO: 627789 - DNA, 25 bp, Rattus norvegicus
aggtaggcaacacagaccgcgaatc

SEQ ID NO: 627790 - DNA, 25 bp, Rattus norvegicus
tgtgcgctcccagacactgtagctg

SEQ ID NO: 627791 - DNA, 25 bp, Rattus norvegicus
gatcaggcactcaacccggcgcttg

SEQ ID NO: 627792 - DNA, 25 bp, Rattus norvegicus
ccaggcgctggatttgaagaggaaa

SEQ ID NO: 627793 - DNA, 25 bp, Rattus norvegicus
ttaaagcccggctgtgcggattatc

SEQ ID NO: 627794 - DNA, 25 bp, Rattus norvegicus
tttctcctccgcagacagacagcag

SEQ ID NO: 627795 - DNA, 25 bp, Rattus norvegicus
cgctgatgcgctgcgactctttctc

SEQ ID NO: 627796 - DNA, 25 bp, Rattus norvegicus
ttgccgttcaatctccgcgctgatg

SEQ ID NO: 627797 - DNA, 25 bp, Rattus norvegicus
gcgtccttcttgtcgcggcgaagtt

SEQ ID NO: 627798 - DNA, 25 bp, Rattus norvegicus
aacaacagcttgagctcgcggcgcg

SEQ ID NO: 627799 - DNA, 25 bp, Rattus norvegicus
tgcgctggtaaaacgcggccactca

SEQ ID NO: 627800 - DNA, 25 bp, Rattus norvegicus
gctgtctccagaagatgtgcgctcc

SEQ ID NO: 627801 - DNA, 25 bp, Rattus norvegicus
cctgtgatgacgaaccggagaccta

SEQ ID NO: 627802 - DNA, 25 bp, Rattus norvegicus
tgtcctgccggcaggtccgtagcca

SEQ ID NO: 627803 - DNA, 25 bp, Rattus norvegicus
tccgtagccagaagattcagacata

SEQ ID NO: 627804 - DNA, 25 bp, Rattus norvegicus
cagacatatcggctggtcccggatg

SEQ ID NO: 627805 - DNA, 25 bp, Rattus norvegicus
cggatgcctgcttttcctcccagga

SEQ ID NO: 627806 - DNA, 25 bp, Rattus norvegicus
ctcccaggacctgtcggtcttcagg

SEQ ID NO: 627807 - DNA, 25 bp, Rattus norvegicus
tcggtcttcagggatgcacgatgcg

SEQ ID NO: 627808 - DNA, 25 bp, Rattus norvegicus
cacgatgcgtgctggtgctactgtc

SEQ ID NO: 627809 - DNA, 25 bp, Rattus norvegicus
ggaatgcttcgtccagccaggactg

SEQ ID NO: 627810 - DNA, 25 bp, Rattus norvegicus
ggactgctgcccgtgctccagcgtg

SEQ ID NO: 627811 - DNA, 25 bp, Rattus norvegicus
ccacagcgcgtggtgcgtctgctgt

SEQ ID NO: 627812 - DNA, 25 bp, Rattus norvegicus
agtgcagcccaacgatgaggacttc

SEQ ID NO: 627813 - DNA, 25 bp, Rattus norvegicus
tgggcccactggcaggaactgacct

SEQ ID NO: 627814 - DNA, 25 bp, Rattus norvegicus
tgaggacttccaggccttctttccc

SEQ ID NO: 627815 - DNA, 25 bp, Rattus norvegicus
ccttgccaagagaggtcggctgtgc

SEQ ID NO: 627816 - DNA, 25 bp, Rattus norvegicus
agcgcgctcgccctcacctcgggtc

SEQ ID NO: 627817 - DNA, 25 bp, Rattus norvegicus
ttcccttgccaagagaggtcggctg

SEQ ID NO: 627818 - DNA, 25 bp, Rattus norvegicus
ggccctgttcccttgccaagagagg

SEQ ID NO: 627819 - DNA, 25 bp, Rattus norvegicus
agacaaagtcagaggcaaagccagg

SEQ ID NO: 627820 - DNA, 25 bp, Rattus norvegicus
cgtccaacagacaaagtcagaggca

SEQ ID NO: 627821 - DNA, 25 bp, Rattus norvegicus
gctgcgtccaacagacaaagtcaga

SEQ ID NO: 627822 - DNA, 25 bp, Rattus norvegicus
caccagcgggtggacccatggctgc

SEQ ID NO: 627823 - DNA, 25 bp, Rattus norvegicus
ttccaccagcgggtggacccatggc

SEQ ID NO: 627824 - DNA, 25 bp, Rattus norvegicus
gcaaattcatttccaccagcgggtg

SEQ ID NO: 627825 - DNA, 25 bp, Rattus norvegicus
gctccgcgcgctacccgcaaattca

SEQ ID NO: 627826 - DNA, 25 bp, Rattus norvegicus
aacaaaagccagttctccgctgctc

SEQ ID NO: 627827 - DNA, 25 bp, Rattus norvegicus
ccgcttcccgccactcagcccaaca

SEQ ID NO: 627828 - DNA, 25 bp, Rattus norvegicus
gttgcgggtagttgctccgcttccc

SEQ ID NO: 627829 - DNA, 25 bp, Rattus norvegicus
tcgcggtagaggctagcctcgatcg

SEQ ID NO: 627830 - DNA, 25 bp, Rattus norvegicus
aacccctcggtcgtgcgtgaggaca

SEQ ID NO: 627831 - DNA, 25 bp, Rattus norvegicus
tgaggacagcgagggcctcccatcc

SEQ ID NO: 627832 - DNA, 25 bp, Rattus norvegicus
agcgcgacccagagcagcgccgtaa

SEQ ID NO: 627833 - DNA, 25 bp, Rattus norvegicus
gccctgagcactccgcaggcgaccg

SEQ ID NO: 627834 - DNA, 25 bp, Rattus norvegicus
gctgctagggacgtttagcgataca

SEQ ID NO: 627835 - DNA, 25 bp, Rattus norvegicus
tagggacgtttagcgatacacctcg

SEQ ID NO: 627836 - DNA, 25 bp, Rattus norvegicus
gatacacctcgctcaggctaggatc

SEQ ID NO: 627837 - DNA, 25 bp, Rattus norvegicus
tcgctcaggctaggatccagatccc

SEQ ID NO: 627838 - DNA, 25 bp, Rattus norvegicus
gcgctgccgccaacctagaaaacaa

SEQ ID NO: 627839 - DNA, 25 bp, Rattus norvegicus
agaaaacaacattctccgttgcgcg

SEQ ID NO: 627840 - DNA, 25 bp, Rattus norvegicus
acattctccgttgcgcgaattcttc

SEQ ID NO: 627841 - DNA, 25 bp, Rattus norvegicus
cagtgacagcgtcccggctgggcac

SEQ ID NO: 627842 - DNA, 25 bp, Rattus norvegicus
tgcgcgaattcttcgcggtagaggc

SEQ ID NO: 627843 - DNA, 25 bp, Rattus norvegicus
cacgcgcgcccacggttacccggca

SEQ ID NO: 627844 - DNA, 25 bp, Rattus norvegicus
cctgaagcggttcacacgctggaca

SEQ ID NO: 627845 - DNA, 25 bp, Rattus norvegicus
cggttcacacgctggacacagaaca

SEQ ID NO: 627846 - DNA, 25 bp, Rattus norvegicus
cgctggacacagaacactagagacc

SEQ ID NO: 627847 - DNA, 25 bp, Rattus norvegicus
tgcgtcctagcacagcacgcttgcg

SEQ ID NO: 627848 - DNA, 25 bp, Rattus norvegicus
aaacgaccggctgcgtcctagcaca

SEQ ID NO: 627849 - DNA, 25 bp, Rattus norvegicus
tagccgcaaaacgaccggctgcgtc

SEQ ID NO: 627850 - DNA, 25 bp, Rattus norvegicus
aaccagctgcgcgtagccgcaaaac

SEQ ID NO: 627851 - DNA, 25 bp, Rattus norvegicus
agccgtcaagcagcgcggccgcaaa

SEQ ID NO: 627852 - DNA, 25 bp, Rattus norvegicus
acccggcaacctggaggcggtactg

SEQ ID NO: 627853 - DNA, 25 bp, Rattus norvegicus
cagtcttaccttacccggccacgcg

SEQ ID NO: 627854 - DNA, 25 bp, Rattus norvegicus
cagacttcccgtcagtcttacctta

SEQ ID NO: 627855 - DNA, 25 bp, Rattus norvegicus
gaacactagagaccggccggctcca

SEQ ID NO: 627856 - DNA, 25 bp, Rattus norvegicus
ggcggtactgtagccgtcaagcagc

SEQ ID NO: 627857 - DNA, 25 bp, Rattus norvegicus
ttcttgagttcgatcgggagcggga

SEQ ID NO: 627858 - DNA, 25 bp, Rattus norvegicus
cttgagttcgatcgggagcgggagc

SEQ ID NO: 627859 - DNA, 25 bp, Rattus norvegicus
tcagcgcggccaacaccaagccccg

SEQ ID NO: 627860 - DNA, 25 bp, Rattus norvegicus
gcggccaacaccaagccccgctcca

SEQ ID NO: 627861 - DNA, 25 bp, Rattus norvegicus
gctccacaggcagcggcgccggtat

SEQ ID NO: 627862 - DNA, 25 bp, Rattus norvegicus
tccacaggcagcggcgccggtattg

SEQ ID NO: 627863 - DNA, 25 bp, Rattus norvegicus
agcggcgccggtattggccgcccgg

SEQ ID NO: 627864 - DNA, 25 bp, Rattus norvegicus
tattggccgcccgggcggtctcaca

SEQ ID NO: 627865 - DNA, 25 bp, Rattus norvegicus
attggccgcccgggcggtctcacat

SEQ ID NO: 627866 - DNA, 25 bp, Rattus norvegicus
gcggtctcacatccgcagcgcccag

SEQ ID NO: 627867 - DNA, 25 bp, Rattus norvegicus
gtctcacatccgcagcgcccagcgg

SEQ ID NO: 627868 - DNA, 25 bp, Rattus norvegicus
cccagcggcggggacgagaaggtca

SEQ ID NO: 627869 - DNA, 25 bp, Rattus norvegicus
cagcggcggggacgagaaggtcatc

SEQ ID NO: 627870 - DNA, 25 bp, Rattus norvegicus
tttcttgagttcgatcgggagcggg

SEQ ID NO: 627871 - DNA, 25 bp, Rattus norvegicus
accgcaaccatgagcagcgaggccg

SEQ ID NO: 627872 - DNA, 25 bp, Rattus norvegicus
aatggttcaatgtaaggaacggata

SEQ ID NO: 627873 - DNA, 25 bp, Rattus norvegicus
cagtaaaatggttcaatgtaaggaa

SEQ ID NO: 627874 - DNA, 25 bp, Rattus norvegicus
acagtaaaatggttcaatgtaagga

SEQ ID NO: 627875 - DNA, 25 bp, Rattus norvegicus
gggaacagtaaaatggttcaatgta

SEQ ID NO: 627876 - DNA, 25 bp, Rattus norvegicus
agcagcgaggccgagacccagcagc

SEQ ID NO: 627877 - DNA, 25 bp, Rattus norvegicus
catgagcagcgaggccgagacccag

SEQ ID NO: 627878 - DNA, 25 bp, Rattus norvegicus
ccatgagcagcgaggccgagaccca

SEQ ID NO: 627879 - DNA, 25 bp, Rattus norvegicus
accatgagcagcgaggccgagaccc

SEQ ID NO: 627880 - DNA, 25 bp, Rattus norvegicus
caaccatgagcagcgaggccgagac

SEQ ID NO: 627881 - DNA, 25 bp, Rattus norvegicus
gcaaccatgagcagcgaggccgaga

SEQ ID NO: 627882 - DNA, 25 bp, Rattus norvegicus
cgcaaccatgagcagcgaggccgag

SEQ ID NO: 627883 - DNA, 25 bp, Rattus norvegicus
ccgcaaccatgagcagcgaggccga

SEQ ID NO: 627884 - DNA, 25 bp, Rattus norvegicus
tggttcaatgtaaggaacggatacg

SEQ ID NO: 627885 - DNA, 25 bp, Rattus norvegicus
cggcggtgaagccttgaaggacaca

SEQ ID NO: 627886 - DNA, 25 bp, Rattus norvegicus
cggggatctgcaaactccctccggt

SEQ ID NO: 627887 - DNA, 25 bp, Rattus norvegicus
cttccgctgtgtctcgcatgcataa

SEQ ID NO: 627888 - DNA, 25 bp, Rattus norvegicus
agggccaaacaccaagtctctccga

SEQ ID NO: 627889 - DNA, 25 bp, Rattus norvegicus
ctccctccggtcaaagttctctgta

SEQ ID NO: 627890 - DNA, 25 bp, Rattus norvegicus
tccgctgtgtctcgcatgcataacg

SEQ ID NO: 627891 - DNA, 25 bp, Rattus norvegicus
atgggcggggatctgcaaactccct

SEQ ID NO: 627892 - DNA, 25 bp, Rattus norvegicus
aagagtttctcttcggcatgggcgg

SEQ ID NO: 627893 - DNA, 25 bp, Rattus norvegicus
ccacggaaagagtttctcttcggca

SEQ ID NO: 627894 - DNA, 25 bp, Rattus norvegicus
tctccgatcgttcccacggaaagag

SEQ ID NO: 627895 - DNA, 25 bp, Rattus norvegicus
aagtctctccgatcgttcccacgga

SEQ ID NO: 627896 - DNA, 25 bp, Rattus norvegicus
aggacacagggccaaacaccaagtc

SEQ ID NO: 627897 - DNA, 25 bp, Rattus norvegicus
attctgtccgcgatgcctgtggaac

SEQ ID NO: 627898 - DNA, 25 bp, Rattus norvegicus
agttctctgtacacagaagaagccc

SEQ ID NO: 627899 - DNA, 25 bp, Rattus norvegicus
cggggcattgaggattgcgtccaac

SEQ ID NO: 627900 - DNA, 25 bp, Rattus norvegicus
cggaggatcttctaggctcccgctc

SEQ ID NO: 627901 - DNA, 25 bp, Rattus norvegicus
tcccgctccttcagccaagcccaag

SEQ ID NO: 627902 - DNA, 25 bp, Rattus norvegicus
ccaaggctaccaccgcatgccttta

SEQ ID NO: 627903 - DNA, 25 bp, Rattus norvegicus
atgcctttatccctcacctcgaaga

SEQ ID NO: 627904 - DNA, 25 bp, Rattus norvegicus
tttatccctcacctcgaagaagcac

SEQ ID NO: 627905 - DNA, 25 bp, Rattus norvegicus
caaaccaccggtggccaacaacgag

SEQ ID NO: 627906 - DNA, 25 bp, Rattus norvegicus
tggccaacaacgagtccagcatctc

SEQ ID NO: 627907 - DNA, 25 bp, Rattus norvegicus
agtccagcatctctgacgcctcagg

SEQ ID NO: 627908 - DNA, 25 bp, Rattus norvegicus
tgacgcctcaggacgccttctgatg

SEQ ID NO: 627909 - DNA, 25 bp, Rattus norvegicus
aggacgccttctgatgtcgtcacca

SEQ ID NO: 627910 - DNA, 25 bp, Rattus norvegicus
ctgatgtcgtcaccactaaggaggc

SEQ ID NO: 627911 - DNA, 25 bp, Rattus norvegicus
gtcaccactaaggaggcggggcatt

SEQ ID NO: 627912 - DNA, 25 bp, Rattus norvegicus
ttgcgtccaaccttaaaggaccgca

SEQ ID NO: 627913 - DNA, 25 bp, Rattus norvegicus
tgcttccgtcctgacaggcctcagg

SEQ ID NO: 627914 - DNA, 25 bp, Rattus norvegicus
agcggtggcagtcgggcctcatccc

SEQ ID NO: 627915 - DNA, 25 bp, Rattus norvegicus
ctcctgacttccgagcggtggcagt

SEQ ID NO: 627916 - DNA, 25 bp, Rattus norvegicus
ggcccagaacgtgccaccgtacagg

SEQ ID NO: 627917 - DNA, 25 bp, Rattus norvegicus
tcgacctcctgacttccgagcggtg

SEQ ID NO: 627918 - DNA, 25 bp, Rattus norvegicus
gagtgcaggcgtcctacctcgacct

SEQ ID NO: 627919 - DNA, 25 bp, Rattus norvegicus
cagccggtgagtgcaggcgtcctac

SEQ ID NO: 627920 - DNA, 25 bp, Rattus norvegicus
gctcaacctctaacttccgcttccg

SEQ ID NO: 627921 - DNA, 25 bp, Rattus norvegicus
agcgccgcctctctccttcgctcaa

SEQ ID NO: 627922 - DNA, 25 bp, Rattus norvegicus
aagtgccttttgtgcagcgccgcct

SEQ ID NO: 627923 - DNA, 25 bp, Rattus norvegicus
gaccgcggaagtgccttttgtgcag

SEQ ID NO: 627924 - DNA, 25 bp, Rattus norvegicus
agagcccttccttgcgaccgcggaa

SEQ ID NO: 627925 - DNA, 25 bp, Rattus norvegicus
actcgaaccaatctcgaggaccacg

SEQ ID NO: 627926 - DNA, 25 bp, Rattus norvegicus
tcctcaggcccgagtccgggctttg

SEQ ID NO: 627927 - DNA, 25 bp, Rattus norvegicus
gcgctcaggtgagtgagtagctcta

SEQ ID NO: 627928 - DNA, 25 bp, Rattus norvegicus
cgcgccgaaccttttacacgtgctg

SEQ ID NO: 627929 - DNA, 25 bp, Rattus norvegicus
agtcgcggcggtcaaactcgacctt

SEQ ID NO: 627930 - DNA, 25 bp, Rattus norvegicus
acagatctgggtgcttgtcggtcca

SEQ ID NO: 627931 - DNA, 25 bp, Rattus norvegicus
cggccgcaggtcaacagatctgggt

SEQ ID NO: 627932 - DNA, 25 bp, Rattus norvegicus
tcaggggagaggcacccacccaaag

SEQ ID NO: 627933 - DNA, 25 bp, Rattus norvegicus
cccaaaggtcccgatgcaagcaggg

SEQ ID NO: 627934 - DNA, 25 bp, Rattus norvegicus
ctcaccggaagacatagaactcaga

SEQ ID NO: 627935 - DNA, 25 bp, Rattus norvegicus
aactcagaggcatccacggggcaca

SEQ ID NO: 627936 - DNA, 25 bp, Rattus norvegicus
tggaggcgacgctccacatcgaaga

SEQ ID NO: 627937 - DNA, 25 bp, Rattus norvegicus
cgcagaggtaattcgcgtagcggcc

SEQ ID NO: 627938 - DNA, 25 bp, Rattus norvegicus
atcaggcatctccatgtcgtcgttg

SEQ ID NO: 627939 - DNA, 25 bp, Rattus norvegicus
gaccagggcccttgtgccaaggacc

SEQ ID NO: 627940 - DNA, 25 bp, Rattus norvegicus
cggtccggtttcacatcaatgatga

SEQ ID NO: 627941 - DNA, 25 bp, Rattus norvegicus
cagcgcgggcgtaagagcagagctt

SEQ ID NO: 627942 - DNA, 25 bp, Rattus norvegicus
gggatgtcctccgtgtccgccggac

SEQ ID NO: 627943 - DNA, 25 bp, Rattus norvegicus
tatgctgcggtcgtgggatgtcctc

SEQ ID NO: 627944 - DNA, 25 bp, Rattus norvegicus
ttgcgcgggcggaacctaggcggtc

SEQ ID NO: 627945 - DNA, 25 bp, Rattus norvegicus
agcagagcttgcagggacaggcctt

SEQ ID NO: 627946 - DNA, 25 bp, Rattus norvegicus
cggggcttggctcttgctgggacct

SEQ ID NO: 627947 - DNA, 25 bp, Rattus norvegicus
ggactcgatgcccacccggacgtct

SEQ ID NO: 627948 - DNA, 25 bp, Rattus norvegicus
aacccaggcgctcgggactcgatgc

SEQ ID NO: 627949 - DNA, 25 bp, Rattus norvegicus
ggaacccaggcgctcgggactcgat

SEQ ID NO: 627950 - DNA, 25 bp, Rattus norvegicus
aagtggaggcgctggcggaacccag

SEQ ID NO: 627951 - DNA, 25 bp, Rattus norvegicus
ccgatgaacatgtggggaaagtgga

SEQ ID NO: 627952 - DNA, 25 bp, Rattus norvegicus
tgacccaggagcggccgatgaacat

SEQ ID NO: 627953 - DNA, 25 bp, Rattus norvegicus
ccacccggacgtctgcggcggttgc

SEQ ID NO: 627954 - DNA, 25 bp, Rattus norvegicus
gacaggccttggtgagtatgctgcg

SEQ ID NO: 627955 - DNA, 25 bp, Rattus norvegicus
cgtgtcgccctcgaaaagattattt

SEQ ID NO: 627956 - DNA, 25 bp, Rattus norvegicus
ctggtatcgagctcaagacgacttt

SEQ ID NO: 627957 - DNA, 25 bp, Rattus norvegicus
cggcaattcttgcattttacgtgag

SEQ ID NO: 627958 - DNA, 25 bp, Rattus norvegicus
gcggacaattttgtggcggcaattc

SEQ ID NO: 627959 - DNA, 25 bp, Rattus norvegicus
tcccgtcggacgaagacatcgtgtc

SEQ ID NO: 627960 - DNA, 25 bp, Rattus norvegicus
tggcccgcggtaaatgtcacttatc

SEQ ID NO: 627961 - DNA, 25 bp, Rattus norvegicus
gcagaccgcggtgaaaggatttcta

SEQ ID NO: 627962 - DNA, 25 bp, Rattus norvegicus
ttcccgtggagtcaactgttctttg

SEQ ID NO: 627963 - DNA, 25 bp, Rattus norvegicus
agacgacttttaccgctgacgcagc

SEQ ID NO: 627964 - DNA, 25 bp, Rattus norvegicus
ctcgagtcggggttatgcttttctc

SEQ ID NO: 627965 - DNA, 25 bp, Rattus norvegicus
atgcttttctcggtacgcagcgggc

SEQ ID NO: 627966 - DNA, 25 bp, Rattus norvegicus
gcgggcgccttagcttgtagcgaaa

SEQ ID NO: 627967 - DNA, 25 bp, Rattus norvegicus
tgacgcagcgcttttgcagaccgcg

SEQ ID NO: 627968 - DNA, 25 bp, Rattus norvegicus
cccgaattacttggacttgtgacga

SEQ ID NO: 627969 - DNA, 25 bp, Rattus norvegicus
atttttaaatggaagggcgagcgcg

SEQ ID NO: 627970 - DNA, 25 bp, Rattus norvegicus
gcgcagatattaatatgcaaagttt

SEQ ID NO: 627971 - DNA, 25 bp, Rattus norvegicus
ggtcagattatgcaaagcgcagata

SEQ ID NO: 627972 - DNA, 25 bp, Rattus norvegicus
aagcgcgggtcagattatgcaaagc

SEQ ID NO: 627973 - DNA, 25 bp, Rattus norvegicus
tcttgcaatcaataaagcgcgggtc

SEQ ID NO: 627974 - DNA, 25 bp, Rattus norvegicus
cggctgcattaagcttcttgcaatc

SEQ ID NO: 627975 - DNA, 25 bp, Rattus norvegicus
gccgagccggctgcattaagcttct

SEQ ID NO: 627976 - DNA, 25 bp, Rattus norvegicus
ccgcccggagagctctctgcaatag

SEQ ID NO: 627977 - DNA, 25 bp, Rattus norvegicus
atgcgcgtcagctgcacggctccga

SEQ ID NO: 627978 - DNA, 25 bp, Rattus norvegicus
ctctctgcaataggccgagccggct

SEQ ID NO: 627979 - DNA, 25 bp, Rattus norvegicus
cgccttgccttaccgctgctcccat

SEQ ID NO: 627980 - DNA, 25 bp, Rattus norvegicus
tgtcttcgccatgcgcgtcagctgc

SEQ ID NO: 627981 - DNA, 25 bp, Rattus norvegicus
tgctcccatcggtaggcgccgctgt

SEQ ID NO: 627982 - DNA, 25 bp, Rattus norvegicus
gtaggcgccgctgtcttcgccatgc

SEQ ID NO: 627983 - DNA, 25 bp, Rattus norvegicus
cacgtgtgtgtcaggcgagaaactt

SEQ ID NO: 627984 - DNA, 25 bp, Rattus norvegicus
ctcggggaccactggccaatcgcag

SEQ ID NO: 627985 - DNA, 25 bp, Rattus norvegicus
aatcgcaggccttcgcggggcttac

SEQ ID NO: 627986 - DNA, 25 bp, Rattus norvegicus
tactgattggctaggagccgtcgcc

SEQ ID NO: 627987 - DNA, 25 bp, Rattus norvegicus
cggtgatttcggcatctagtgaacc

SEQ ID NO: 627988 - DNA, 25 bp, Rattus norvegicus
ctcgccctagtacttcgcgtgttga

SEQ ID NO: 627989 - DNA, 25 bp, Rattus norvegicus
ggagcgcagcttaccgtacgccttg

SEQ ID NO: 627990 - DNA, 25 bp, Rattus norvegicus
tcgcgtgttgaaagaagcctaaaaa

SEQ ID NO: 627991 - DNA, 25 bp, Rattus norvegicus
ggtccgaatcccaaagctctctgta

SEQ ID NO: 627992 - DNA, 25 bp, Rattus norvegicus
gcgcttagagcgcagagactgaatt

SEQ ID NO: 627993 - DNA, 25 bp, Rattus norvegicus
agactgaattggagggttgttctca

SEQ ID NO: 627994 - DNA, 25 bp, Rattus norvegicus
tccctctgagcctgtgcacgtgtgt

SEQ ID NO: 627995 - DNA, 25 bp, Rattus norvegicus
cctgagacgcgcagccagaattcgg

SEQ ID NO: 627996 - DNA, 25 bp, Rattus norvegicus
cggggctaagcgagtctccttgaga

SEQ ID NO: 627997 - DNA, 25 bp, Rattus norvegicus
gctggccgcgcaacccagattctgt

SEQ ID NO: 627998 - DNA, 25 bp, Rattus norvegicus
gcatcagggcctgagcgcctggact

SEQ ID NO: 627999 - DNA, 25 bp, Rattus norvegicus
cgctcgaccactagggcggggctct

SEQ ID NO: 628000 - DNA, 25 bp, Rattus norvegicus
gctcggtgtcacctgtcccggagct

SEQ ID NO: 628001 - DNA, 25 bp, Rattus norvegicus
cctgcccgcctgtggttatccgatg

SEQ ID NO: 628002 - DNA, 25 bp, Rattus norvegicus
ccatccttgaaaccggaaaagcgca

SEQ ID NO: 628003 - DNA, 25 bp, Rattus norvegicus
cccagattctgtcccacggtgcgga

SEQ ID NO: 628004 - DNA, 25 bp, Rattus norvegicus
ggcctgcgggtatttgcatacgcga

SEQ ID NO: 628005 - DNA, 25 bp, Rattus norvegicus
actgggatccgcaggccagaggacc

SEQ ID NO: 628006 - DNA, 25 bp, Rattus norvegicus
gggttgcagctcatccgcaaacacg

SEQ ID NO: 628007 - DNA, 25 bp, Rattus norvegicus
agggcgcgaattgcaagtggcatca

SEQ ID NO: 628008 - DNA, 25 bp, Rattus norvegicus
aggcatgcatggtgccgtagcgctc

SEQ ID NO: 628009 - DNA, 25 bp, Rattus norvegicus
gcaaacacgatcttccggggcctcg

SEQ ID NO: 628010 - DNA, 25 bp, Rattus norvegicus
cgtgccgtcacgcaccagagtggct

SEQ ID NO: 628011 - DNA, 25 bp, Rattus norvegicus
gtctctgcttgcgttttcctccgca

SEQ ID NO: 628012 - DNA, 25 bp, Rattus norvegicus
tcccagtcttgtgctttggggtctg

SEQ ID NO: 628013 - DNA, 25 bp, Rattus norvegicus
cagctcccagtcttgtgctttgggg

SEQ ID NO: 628014 - DNA, 25 bp, Rattus norvegicus
ccgcagctcccagtcttgtgctttg

SEQ ID NO: 628015 - DNA, 25 bp, Rattus norvegicus
tccgggaagggtcatggtcggtggc

SEQ ID NO: 628016 - DNA, 25 bp, Rattus norvegicus
ttccagcgcaggtagggcagcccct

SEQ ID NO: 628017 - DNA, 25 bp, Rattus norvegicus
gcagacctccgagccgtgacttcca

SEQ ID NO: 628018 - DNA, 25 bp, Rattus norvegicus
cgttttcctccgcagacctccgagc

SEQ ID NO: 628019 - DNA, 25 bp, Rattus norvegicus
gacttggctacacccgggtctctaa

SEQ ID NO: 628020 - DNA, 25 bp, Rattus norvegicus
ggctacacccgggtctctaaagcgc

SEQ ID NO: 628021 - DNA, 25 bp, Rattus norvegicus
cgggtctctaaagcgccccgtgaga

SEQ ID NO: 628022 - DNA, 25 bp, Rattus norvegicus
gcagaaggaccgaggaggctgcacc

SEQ ID NO: 628023 - DNA, 25 bp, Rattus norvegicus
accgagtctctgcttgcgttttcct

SEQ ID NO: 628024 - DNA, 25 bp, Rattus norvegicus
gtcttgtgctttggggtctggcacc

SEQ ID NO: 628025 - DNA, 25 bp, Rattus norvegicus
ttctcggtaccaggagctggcagga

SEQ ID NO: 628026 - DNA, 25 bp, Rattus norvegicus
tggtgcagcgatgcattggcgccct

SEQ ID NO: 628027 - DNA, 25 bp, Rattus norvegicus
cattggcgccctgggcaccgctgta

SEQ ID NO: 628028 - DNA, 25 bp, Rattus norvegicus
cctgggcaccgctgtagcgcgcata

SEQ ID NO: 628029 - DNA, 25 bp, Rattus norvegicus
caaagcccgggttcaggccactaag

SEQ ID NO: 628030 - DNA, 25 bp, Rattus norvegicus
cagccgtacttcctggccaggcgga

SEQ ID NO: 628031 - DNA, 25 bp, Rattus norvegicus
ggccactaaggtcatcataggcgga

SEQ ID NO: 628032 - DNA, 25 bp, Rattus norvegicus
ggtgtcgtccgatgaacacctcgga

SEQ ID NO: 628033 - DNA, 25 bp, Rattus norvegicus
tcctgcggtgtcgtccgatgaacac

SEQ ID NO: 628034 - DNA, 25 bp, Rattus norvegicus
ctcgtgcacgtcctgcggtgtcgtc

SEQ ID NO: 628035 - DNA, 25 bp, Rattus norvegicus
gtcagctggtgctcgtgcacgtcct

SEQ ID NO: 628036 - DNA, 25 bp, Rattus norvegicus
cactaaggtcatcataggcggaact

SEQ ID NO: 628037 - DNA, 25 bp, Rattus norvegicus
ggccaggcggatgccggtctccctt

SEQ ID NO: 628038 - DNA, 25 bp, Rattus norvegicus
agctcgcccttctcggtaccaggag

SEQ ID NO: 628039 - DNA, 25 bp, Rattus norvegicus
agaagctgtgctcgcacgccagcag

SEQ ID NO: 628040 - DNA, 25 bp, Rattus norvegicus
gggctcggccagtttctcacgcagc

SEQ ID NO: 628041 - DNA, 25 bp, Rattus norvegicus
ggctgatgcgcacctccactgcaag

SEQ ID NO: 628042 - DNA, 25 bp, Rattus norvegicus
cctccactgcaagtcgcacgttaga

SEQ ID NO: 628043 - DNA, 25 bp, Rattus norvegicus
aagtcgcacgttagacctcaggctg

SEQ ID NO: 628044 - DNA, 25 bp, Rattus norvegicus
cgttagacctcaggctgcgtctggg

SEQ ID NO: 628045 - DNA, 25 bp, Rattus norvegicus
tgcgtctggggcacggctgaccaca

SEQ ID NO: 628046 - DNA, 25 bp, Rattus norvegicus
acgaacggcagaagctgtgctcgca

SEQ ID NO: 628047 - DNA, 25 bp, Rattus norvegicus
acgccagcaggactgggtcctcgaa

SEQ ID NO: 628048 - DNA, 25 bp, Rattus norvegicus
gcccagctcgggaacctccatggaa

SEQ ID NO: 628049 - DNA, 25 bp, Rattus norvegicus
cctccatggaaagcaggggtcccga

SEQ ID NO: 628050 - DNA, 25 bp, Rattus norvegicus
gggtcccgacgcaacctagttcgca

SEQ ID NO: 628051 - DNA, 25 bp, Rattus norvegicus
gagctcgcaagtggcggaccacgcc

SEQ ID NO: 628052 - DNA, 25 bp, Rattus norvegicus
cgcgccaagcacgaacggcagaagc

SEQ ID NO: 628053 - DNA, 25 bp, Rattus norvegicus
agcgcaacgcgtgaaccgccaggcg

SEQ ID NO: 628054 - DNA, 25 bp, Rattus norvegicus
cccgcaccaggcttagacgtccagc

SEQ ID NO: 628055 - DNA, 25 bp, Rattus norvegicus
ggctccggtctctgcgtgtgccttt

SEQ ID NO: 628056 - DNA, 25 bp, Rattus norvegicus
tggcgagcgcaacgcgtgaaccgcc

SEQ ID NO: 628057 - DNA, 25 bp, Rattus norvegicus
ggcttagacgtccagcccctggaca

SEQ ID NO: 628058 - DNA, 25 bp, Rattus norvegicus
gccggttaccgcctgacccgcgctc

SEQ ID NO: 628059 - DNA, 25 bp, Rattus norvegicus
cagaggtctgggccggttaccgcct

SEQ ID NO: 628060 - DNA, 25 bp, Rattus norvegicus
gtgaagggaggtcagcagaggtctg

SEQ ID NO: 628061 - DNA, 25 bp, Rattus norvegicus
tacaggcagagaccccgcctcgggt

SEQ ID NO: 628062 - DNA, 25 bp, Rattus norvegicus
tgtgcctttctacaggcagagaccc

SEQ ID NO: 628063 - DNA, 25 bp, Rattus norvegicus
gcgtgtgcctttctacaggcagaga

SEQ ID NO: 628064 - DNA, 25 bp, Rattus norvegicus
ctctgcgtgtgcctttctacaggca

SEQ ID NO: 628065 - DNA, 25 bp, Rattus norvegicus
ggtctctgcgtgtgcctttctacag

SEQ ID NO: 628066 - DNA, 25 bp, Rattus norvegicus
tcctggcgagcgcaacgcgtgaacc

SEQ ID NO: 628067 - DNA, 25 bp, Rattus norvegicus
tcgtgtacaaagaggagcatccgtt

SEQ ID NO: 628068 - DNA, 25 bp, Rattus norvegicus
cgacgctagcgtcgctgacgctgtc

SEQ ID NO: 628069 - DNA, 25 bp, Rattus norvegicus
taaggactagccagggccgacgcta

SEQ ID NO: 628070 - DNA, 25 bp, Rattus norvegicus
cgctctgagggcgagaaaatccgaa

SEQ ID NO: 628071 - DNA, 25 bp, Rattus norvegicus
tgtcatacgcgtaactcacaaattg

SEQ ID NO: 628072 - DNA, 25 bp, Rattus norvegicus
ctcgggagaatgaagttcgtgtaca

SEQ ID NO: 628073 - DNA, 25 bp, Rattus norvegicus
gttgcgctagcaagctgagctcgtg

SEQ ID NO: 628074 - DNA, 25 bp, Rattus norvegicus
agcatccgttcgagaagcgccgctc

SEQ ID NO: 628075 - DNA, 25 bp, Rattus norvegicus
ccaaagcagttacgctgaaggcgta

SEQ ID NO: 628076 - DNA, 25 bp, Rattus norvegicus
gtccagcccggttctcgggagaatg

SEQ ID NO: 628077 - DNA, 25 bp, Rattus norvegicus
caagctgagctcgtggtgtatgtca

SEQ ID NO: 628078 - DNA, 25 bp, Rattus norvegicus
gtgaatagggaagtggcgcaaattc

SEQ ID NO: 628079 - DNA, 25 bp, Rattus norvegicus
gcaaattcgtggatcgctccgctga

SEQ ID NO: 628080 - DNA, 25 bp, Rattus norvegicus
tccgctgagtctgttcgtcgaagcc

SEQ ID NO: 628081 - DNA, 25 bp, Rattus norvegicus
gcgggccaacctgggcatcgaccat

SEQ ID NO: 628082 - DNA, 25 bp, Rattus norvegicus
cactgccctgcggagcgggtaacag

SEQ ID NO: 628083 - DNA, 25 bp, Rattus norvegicus
tgcggagatccagagaacacatagc

SEQ ID NO: 628084 - DNA, 25 bp, Rattus norvegicus
ccatgcacaggtgcggagatccaga

SEQ ID NO: 628085 - DNA, 25 bp, Rattus norvegicus
ggcttcggatgcaggccatgcacag

SEQ ID NO: 628086 - DNA, 25 bp, Rattus norvegicus
aggcgctgagctccagtatcgagga

SEQ ID NO: 628087 - DNA, 25 bp, Rattus norvegicus
ggcccatcaagaccgggtgctcatc

SEQ ID NO: 628088 - DNA, 25 bp, Rattus norvegicus
ccgggaggagtacgaggcccatcaa

SEQ ID NO: 628089 - DNA, 25 bp, Rattus norvegicus
acacatagcctgtggggcttgtctg

SEQ ID NO: 628090 - DNA, 25 bp, Rattus norvegicus
tccaaaatctatcctagccgggagg

SEQ ID NO: 628091 - DNA, 25 bp, Rattus norvegicus
tcgacgccctgatctccaaaatcta

SEQ ID NO: 628092 - DNA, 25 bp, Rattus norvegicus
agctggtatccaagcggtccctacg

SEQ ID NO: 628093 - DNA, 25 bp, Rattus norvegicus
acctgccggaaaaagctggtatcca

SEQ ID NO: 628094 - DNA, 25 bp, Rattus norvegicus
ggcatcgaccatgggcgctgacctt

SEQ ID NO: 628095 - DNA, 25 bp, Rattus norvegicus
gaaaaacagtacaccatctacatag

SEQ ID NO: 628096 - DNA, 25 bp, Rattus norvegicus
aaggtgtcagcgaaaaacagtacac

SEQ ID NO: 628097 - DNA, 25 bp, Rattus norvegicus
accatctacatagctcctgggggcg

SEQ ID NO: 628098 - DNA, 25 bp, Rattus norvegicus
ctacatagctcctgggggcggagca

SEQ ID NO: 628099 - DNA, 25 bp, Rattus norvegicus
ggcggagcattcacggtgagcatcc

SEQ ID NO: 628100 - DNA, 25 bp, Rattus norvegicus
gagcattcacggtgagcatccgcta

SEQ ID NO: 628101 - DNA, 25 bp, Rattus norvegicus
cattcacggtgagcatccgctaata

SEQ ID NO: 628102 - DNA, 25 bp, Rattus norvegicus
cacggtgagcatccgctaatagtaa

SEQ ID NO: 628103 - DNA, 25 bp, Rattus norvegicus
ggtgagcatccgctaatagtaacag

SEQ ID NO: 628104 - DNA, 25 bp, Rattus norvegicus
gagcatccgctaatagtaacagaga

SEQ ID NO: 628105 - DNA, 25 bp, Rattus norvegicus
tccgctaatagtaacagagagcagg

SEQ ID NO: 628106 - DNA, 25 bp, Rattus norvegicus
gctaatagtaacagagagcagggtg

SEQ ID NO: 628107 - DNA, 25 bp, Rattus norvegicus
tgtgtgtccgtcctcctgtccgctg

SEQ ID NO: 628108 - DNA, 25 bp, Rattus norvegicus
cgctgccccgcgttcattgtccgtg

SEQ ID NO: 628109 - DNA, 25 bp, Rattus norvegicus
ttccaagggctgccgcgatccctgt

SEQ ID NO: 628110 - DNA, 25 bp, Rattus norvegicus
gtcccaagtccgaaattggggagca

SEQ ID NO: 628111 - DNA, 25 bp, Rattus norvegicus
gacagggaggtcatgcgcttcgaca

SEQ ID NO: 628112 - DNA, 25 bp, Rattus norvegicus
tgaaggcgtcggcttctggcccggc

SEQ ID NO: 628113 - DNA, 25 bp, Rattus norvegicus
acgacagggaggtcatgcgcttcga

SEQ ID NO: 628114 - DNA, 25 bp, Rattus norvegicus
gctacgtggacgacagggaggtcat

SEQ ID NO: 628115 - DNA, 25 bp, Rattus norvegicus
tcggccaggattataaagtccacgc

SEQ ID NO: 628116 - DNA, 25 bp, Rattus norvegicus
gcgtcggccaggattataaagtcca

SEQ ID NO: 628117 - DNA, 25 bp, Rattus norvegicus
aaccaatcagcgtcggccaggatta

SEQ ID NO: 628118 - DNA, 25 bp, Rattus norvegicus
ttggggagcagaatcgacgcgggcc

SEQ ID NO: 628119 - DNA, 25 bp, Rattus norvegicus
tctcacttccaagggctgccgcgat

SEQ ID NO: 628120 - DNA, 25 bp, Rattus norvegicus
attctcacttccaagggctgccgcg

SEQ ID NO: 628121 - DNA, 25 bp, Rattus norvegicus
tggcaattctcacttccaagggctg

SEQ ID NO: 628122 - DNA, 25 bp, Rattus norvegicus
cagcgtcggccaggattataaagtc

SEQ ID NO: 628123 - DNA, 25 bp, Rattus norvegicus
ccgcgggtattatcaggacgcttac

SEQ ID NO: 628124 - DNA, 25 bp, Rattus norvegicus
agatccgtcccggatctcacagggg

SEQ ID NO: 628125 - DNA, 25 bp, Rattus norvegicus
tcaggacgcttacgacggccgcgat

SEQ ID NO: 628126 - DNA, 25 bp, Rattus norvegicus
cgggtattatcaggacgcttacgac

SEQ ID NO: 628127 - DNA, 25 bp, Rattus norvegicus
actttgcggcacagatcacccggag

SEQ ID NO: 628128 - DNA, 25 bp, Rattus norvegicus
cctccgcgggtattatcaggacgct

SEQ ID NO: 628129 - DNA, 25 bp, Rattus norvegicus
ttgcggcacagatcacccggagcaa

SEQ ID NO: 628130 - DNA, 25 bp, Rattus norvegicus
ggagacccagaacgccaagagaaac

SEQ ID NO: 628131 - DNA, 25 bp, Rattus norvegicus
gagggagacccagaacgccaagaga

SEQ ID NO: 628132 - DNA, 25 bp, Rattus norvegicus
gaaacccggtccctgcgtcgcacac

SEQ ID NO: 628133 - DNA, 25 bp, Rattus norvegicus
gatggagccctgcactctgctcctg

SEQ ID NO: 628134 - DNA, 25 bp, Rattus norvegicus
gatgatggagccctgcactctgctc

SEQ ID NO: 628135 - DNA, 25 bp, Rattus norvegicus
tcccggatctcacagggggatgatg

SEQ ID NO: 628136 - DNA, 25 bp, Rattus norvegicus
ttatcaggacgcttacgacggccgc

SEQ ID NO: 628137 - DNA, 25 bp, Rattus norvegicus
gccctcgcagcctggcccacctctg

SEQ ID NO: 628138 - DNA, 25 bp, Rattus norvegicus
tctgggctcaaagttcaaggccgcc

SEQ ID NO: 628139 - DNA, 25 bp, Rattus norvegicus
cagccggcaacaacagaaagtgcgc

SEQ ID NO: 628140 - DNA, 25 bp, Rattus norvegicus
gcaggtgctcagacgaactggtgca

SEQ ID NO: 628141 - DNA, 25 bp, Rattus norvegicus
tcagacgaactggtgcagggacctg

SEQ ID NO: 628142 - DNA, 25 bp, Rattus norvegicus
tccaacccgaagtttggcctcgctg

SEQ ID NO: 628143 - DNA, 25 bp, Rattus norvegicus
agtttggcctcgctgttgccgccgt

SEQ ID NO: 628144 - DNA, 25 bp, Rattus norvegicus
ccgcgtggagatcggacaagccaaa

SEQ ID NO: 628145 - DNA, 25 bp, Rattus norvegicus
atcggacaagccaaacctgctcgcg

SEQ ID NO: 628146 - DNA, 25 bp, Rattus norvegicus
gccgccgccctcaatgcaagaaatg

SEQ ID NO: 628147 - DNA, 25 bp, Rattus norvegicus
ccgccctcaatgcaagaaatgtcca

SEQ ID NO: 628148 - DNA, 25 bp, Rattus norvegicus
cgccagccggcaacaacagaaagtg

SEQ ID NO: 628149 - DNA, 25 bp, Rattus norvegicus
ccattcactgtctactcgcatggcg

SEQ ID NO: 628150 - DNA, 25 bp, Rattus norvegicus
gaaatgtccattcactgtctactcg

SEQ ID NO: 628151 - DNA, 25 bp, Rattus norvegicus
tgcccggacactgacgacactatgg

SEQ ID NO: 628152 - DNA, 25 bp, Rattus norvegicus
cccggacactgacgacactatggca

SEQ ID NO: 628153 - DNA, 25 bp, Rattus norvegicus
ccggacactgacgacactatggcaa

SEQ ID NO: 628154 - DNA, 25 bp, Rattus norvegicus
cggacactgacgacactatggcaat

SEQ ID NO: 628155 - DNA, 25 bp, Rattus norvegicus
ggacactgacgacactatggcaatt

SEQ ID NO: 628156 - DNA, 25 bp, Rattus norvegicus
gacactgacgacactatggcaattc

SEQ ID NO: 628157 - DNA, 25 bp, Rattus norvegicus
actgacgacactatggcaattctca

SEQ ID NO: 628158 - DNA, 25 bp, Rattus norvegicus
cactgacgacactatggcaattctc

SEQ ID NO: 628159 - DNA, 25 bp, Rattus norvegicus
caaggaaggcgagcagactttccga

SEQ ID NO: 628160 - DNA, 25 bp, Rattus norvegicus
agagccaaggaaggcgagcagactt

SEQ ID NO: 628161 - DNA, 25 bp, Rattus norvegicus
actcagaccggtcccggatctcaga

SEQ ID NO: 628162 - DNA, 25 bp, Rattus norvegicus
tgacgacactatggcaattctcact

SEQ ID NO: 628163 - DNA, 25 bp, Rattus norvegicus
ttctgcccggacactgacgacacta

SEQ ID NO: 628164 - DNA, 25 bp, Rattus norvegicus
ctgcccggacactgacgacactatg

SEQ ID NO: 628165 - DNA, 25 bp, Rattus norvegicus
ctggaacgtcttctacggagcaaca

SEQ ID NO: 628166 - DNA, 25 bp, Rattus norvegicus
ctctgagagtccgtttcccgaagca

SEQ ID NO: 628167 - DNA, 25 bp, Rattus norvegicus
tcccgaagcaaagccacaagtcctg

SEQ ID NO: 628168 - DNA, 25 bp, Rattus norvegicus
ggcggccaacgttcaccctcaatgt

SEQ ID NO: 628169 - DNA, 25 bp, Rattus norvegicus
agctaacgtgattggctccagagtc

SEQ ID NO: 628170 - DNA, 25 bp, Rattus norvegicus
ccagagtcccgttaggctttgatca

SEQ ID NO: 628171 - DNA, 25 bp, Rattus norvegicus
gctttgatcacttcggtccggtgca

SEQ ID NO: 628172 - DNA, 25 bp, Rattus norvegicus
cctcaatgtcaaaggttgcgttttc

SEQ ID NO: 628173 - DNA, 25 bp, Rattus norvegicus
cggaagttatagctcctgtcctatg

SEQ ID NO: 628174 - DNA, 25 bp, Rattus norvegicus
atgcaaaccaactcctcccttaggg

SEQ ID NO: 628175 - DNA, 25 bp, Rattus norvegicus
ccgccgccatggtaagagcggaatc

SEQ ID NO: 628176 - DNA, 25 bp, Rattus norvegicus
agagttttccgtcagggctcagaga

SEQ ID NO: 628177 - DNA, 25 bp, Rattus norvegicus
acacaccaaagttgccaggagcttg

SEQ ID NO: 628178 - DNA, 25 bp, Rattus norvegicus
gtcttgaacacaaccctgctccgga

SEQ ID NO: 628179 - DNA, 25 bp, Rattus norvegicus
gtctgaagcctctggcgccatgttg

SEQ ID NO: 628180 - DNA, 25 bp, Rattus norvegicus
tcatcgccgtaagggcgtctgaagc

SEQ ID NO: 628181 - DNA, 25 bp, Rattus norvegicus
gagacttcatccaatcatcgccgta

SEQ ID NO: 628182 - DNA, 25 bp, Rattus norvegicus
ttcccaaggcctgcgaggaaacttc

SEQ ID NO: 628183 - DNA, 25 bp, Rattus norvegicus
gacgatccacgtgcaaaactccttt

SEQ ID NO: 628184 - DNA, 25 bp, Rattus norvegicus
ggctgtctccatcccgacgacggaa

SEQ ID NO: 628185 - DNA, 25 bp, Rattus norvegicus
gcttgtctttcttgggtgggtcacc

SEQ ID NO: 628186 - DNA, 25 bp, Rattus norvegicus
cagacagggtcctctgcggcttctt

SEQ ID NO: 628187 - DNA, 25 bp, Rattus norvegicus
agaggagaagccctcgcacgcgcag

SEQ ID NO: 628188 - DNA, 25 bp, Rattus norvegicus
ccagtctgaggcgttctttgggatc

SEQ ID NO: 628189 - DNA, 25 bp, Rattus norvegicus
gggcttcttggagaaccgaggcttc

SEQ ID NO: 628190 - DNA, 25 bp, Rattus norvegicus
cgccatgttgagagagggcacgccc

SEQ ID NO: 628191 - DNA, 25 bp, Rattus norvegicus
cctcttggcctgaggcttgtctttc

SEQ ID NO: 628192 - DNA, 25 bp, Rattus norvegicus
ctctgcggcttcttccagtctgagg

SEQ ID NO: 628193 - DNA, 25 bp, Rattus norvegicus
ggctagtgcgccacttccggtttta

SEQ ID NO: 628194 - DNA, 25 bp, Rattus norvegicus
cagcacgagtgcagcggagcaaatc

SEQ ID NO: 628195 - DNA, 25 bp, Rattus norvegicus
aactcccgagggaagcgccctagtg

SEQ ID NO: 628196 - DNA, 25 bp, Rattus norvegicus
ctctaacgagagcagtgagtgcagc

SEQ ID NO: 628197 - DNA, 25 bp, Rattus norvegicus
ggaggtcagggtcctgtctcaagcc

SEQ ID NO: 628198 - DNA, 25 bp, Rattus norvegicus
tactcggggattccgaagcccatgc

SEQ ID NO: 628199 - DNA, 25 bp, Rattus norvegicus
gtccgcccgacagcaggagccaaaa

SEQ ID NO: 628200 - DNA, 25 bp, Rattus norvegicus
ttgtcggtctctggccctctaccga

SEQ ID NO: 628201 - DNA, 25 bp, Rattus norvegicus
cccgggcctctgttcttgtcggtct

SEQ ID NO: 628202 - DNA, 25 bp, Rattus norvegicus
gggcataactactgcggaatgggca

SEQ ID NO: 628203 - DNA, 25 bp, Rattus norvegicus
ttcgtgtccaaaagcagccgcaggg

SEQ ID NO: 628204 - DNA, 25 bp, Rattus norvegicus
cggctccggaagctgctcaacacga

SEQ ID NO: 628205 - DNA, 25 bp, Rattus norvegicus
caaatccgcgccgagttttctgagc

SEQ ID NO: 628206 - DNA, 25 bp, Rattus norvegicus
cgagttttctgagccgcccttaagc

SEQ ID NO: 628207 - DNA, 25 bp, Rattus norvegicus
gcgacttagagagtatccaaactta

SEQ ID NO: 628208 - DNA, 25 bp, Rattus norvegicus
gcccgcaagggccaaacagagatcc

SEQ ID NO: 628209 - DNA, 25 bp, Rattus norvegicus
actggaaattccctgcgctggtcag

SEQ ID NO: 628210 - DNA, 25 bp, Rattus norvegicus
ccaatgtgtcctttcctaaacgaga

SEQ ID NO: 628211 - DNA, 25 bp, Rattus norvegicus
ttcagacccgcgatgggatcacctc

SEQ ID NO: 628212 - DNA, 25 bp, Rattus norvegicus
tgaccaggctgccacaaggtgtccg

SEQ ID NO: 628213 - DNA, 25 bp, Rattus norvegicus
actcaatcgtctgtggtccagccga

SEQ ID NO: 628214 - DNA, 25 bp, Rattus norvegicus
ggcaggtttcttggacaggccaccc

SEQ ID NO: 628215 - DNA, 25 bp, Rattus norvegicus
gcgcagtagcaatgtggcaggtttc

SEQ ID NO: 628216 - DNA, 25 bp, Rattus norvegicus
gacagacgcagctgagtcccgaaga

SEQ ID NO: 628217 - DNA, 25 bp, Rattus norvegicus
cggctggaaacgtgctgactgtaca

SEQ ID NO: 628218 - DNA, 25 bp, Rattus norvegicus
cgcctgaaggcagccaggagcattc

SEQ ID NO: 628219 - DNA, 25 bp, Rattus norvegicus
gcgcgccaactttgagcctttagca

SEQ ID NO: 628220 - DNA, 25 bp, Rattus norvegicus
tctgcggaaccgagaaggatgtagc

SEQ ID NO: 628221 - DNA, 25 bp, Rattus norvegicus
agcctaagggactcgctgagtacgg

SEQ ID NO: 628222 - DNA, 25 bp, Rattus norvegicus
ttaagaccggcaacttgcgcgggtg

SEQ ID NO: 628223 - DNA, 25 bp, Rattus norvegicus
ggttggtcggctagggcaagagctt

SEQ ID NO: 628224 - DNA, 25 bp, Rattus norvegicus
cggctagggcaagagcttgcgagtt

SEQ ID NO: 628225 - DNA, 25 bp, Rattus norvegicus
aagagcttgcgagttgtggagtgta

SEQ ID NO: 628226 - DNA, 25 bp, Rattus norvegicus
cttgcgagttgtggagtgtattggg

SEQ ID NO: 628227 - DNA, 25 bp, Rattus norvegicus
gccttctgtggagtggctggatggt

SEQ ID NO: 628228 - DNA, 25 bp, Rattus norvegicus
tctgtggagtggctggatggtgacc

SEQ ID NO: 628229 - DNA, 25 bp, Rattus norvegicus
ggtccgtagcctaagggactcgctg

SEQ ID NO: 628230 - DNA, 25 bp, Rattus norvegicus
gtccgtagcctaagggactcgctga

SEQ ID NO: 628231 - DNA, 25 bp, Rattus norvegicus
tccgtagcctaagggactcgctgag

SEQ ID NO: 628232 - DNA, 25 bp, Rattus norvegicus
cgtagcctaagggactcgctgagta

SEQ ID NO: 628233 - DNA, 25 bp, Rattus norvegicus
tagcctaagggactcgctgagtacg

SEQ ID NO: 628234 - DNA, 25 bp, Rattus norvegicus
gtagcctaagggactcgctgagtac

SEQ ID NO: 628235 - DNA, 25 bp, Rattus norvegicus
ctgcgacatggcagcgggcatccca

SEQ ID NO: 628236 - DNA, 25 bp, Rattus norvegicus
aactgacgcagtcaccgcgggtctg

SEQ ID NO: 628237 - DNA, 25 bp, Rattus norvegicus
cccgggtgaaactgacgcagtcacc

SEQ ID NO: 628238 - DNA, 25 bp, Rattus norvegicus
cgcttccggcgagtattgtgtgtcg

SEQ ID NO: 628239 - DNA, 25 bp, Rattus norvegicus
gccgtgcagctgtcttccatagccg

SEQ ID NO: 628240 - DNA, 25 bp, Rattus norvegicus
gtttcggcgtctcactatgcgcatg

SEQ ID NO: 628241 - DNA, 25 bp, Rattus norvegicus
gggctcgctgacacagccatggcgc

SEQ ID NO: 628242 - DNA, 25 bp, Rattus norvegicus
accgaggaccagcttgtgcctcggc

SEQ ID NO: 628243 - DNA, 25 bp, Rattus norvegicus
gaaagtgtggcccaaagcccacaac

SEQ ID NO: 628244 - DNA, 25 bp, Rattus norvegicus
aggtcagccacgtaatccaacgccg

SEQ ID NO: 628245 - DNA, 25 bp, Rattus norvegicus
tccctcacttagacacgcattcgtt

SEQ ID NO: 628246 - DNA, 25 bp, Rattus norvegicus
ttagacacgcattcgttcctccctg

SEQ ID NO: 628247 - DNA, 25 bp, Rattus norvegicus
gtgacgtgcaacacggcctctcagg

SEQ ID NO: 628248 - DNA, 25 bp, Rattus norvegicus
ggcctctcaggtcagccacgtaatc

SEQ ID NO: 628249 - DNA, 25 bp, Rattus norvegicus
actttgtgcacgctgggtggtgacc

SEQ ID NO: 628250 - DNA, 25 bp, Rattus norvegicus
ccactgcggaggactccctcttggg

SEQ ID NO: 628251 - DNA, 25 bp, Rattus norvegicus
tccaggtccaggtaccgatgcggcc

SEQ ID NO: 628252 - DNA, 25 bp, Rattus norvegicus
cccggtgacgcatgaaactgtcccg

SEQ ID NO: 628253 - DNA, 25 bp, Rattus norvegicus
aactgtcccgccacatgaacttctt

SEQ ID NO: 628254 - DNA, 25 bp, Rattus norvegicus
tcttggcgcagacactgcattcgta

SEQ ID NO: 628255 - DNA, 25 bp, Rattus norvegicus
gatgcatattcacgtgccggtcccg

SEQ ID NO: 628256 - DNA, 25 bp, Rattus norvegicus
gcttgaggcctgtgtgcgtcttcat

SEQ ID NO: 628257 - DNA, 25 bp, Rattus norvegicus
tgcgtcttcatgtgctcggtcaggt

SEQ ID NO: 628258 - DNA, 25 bp, Rattus norvegicus
caggtggtgtttcatcttgaacttc

SEQ ID NO: 628259 - DNA, 25 bp, Rattus norvegicus
cttcttgttgcacacggggcagtca

SEQ ID NO: 628260 - DNA, 25 bp, Rattus norvegicus
gggtcgcaggttgagatgcatattc

SEQ ID NO: 628261 - DNA, 25 bp, Rattus norvegicus
gtggtgaccagacacgcctattaga

SEQ ID NO: 628262 - DNA, 25 bp, Rattus norvegicus
tgtggccgaattcgcctcatcgcca

SEQ ID NO: 628263 - DNA, 25 bp, Rattus norvegicus
tgtgccgctggggaaaattcgaccg

SEQ ID NO: 628264 - DNA, 25 bp, Rattus norvegicus
gaccagcgaccttaaaggcgcagga

SEQ ID NO: 628265 - DNA, 25 bp, Rattus norvegicus
ttaaaggcgcaggacagcacccctc

SEQ ID NO: 628266 - DNA, 25 bp, Rattus norvegicus
gccccttcaggaccctccagggctc

SEQ ID NO: 628267 - DNA, 25 bp, Rattus norvegicus
cccaatcgcgtccttggactgtccc

SEQ ID NO: 628268 - DNA, 25 bp, Rattus norvegicus
tccttggactgtcccccggcctgag

SEQ ID NO: 628269 - DNA, 25 bp, Rattus norvegicus
ccatcttgtgccgactccctccgcc

SEQ ID NO: 628270 - DNA, 25 bp, Rattus norvegicus
ccgaccagcgaccttaaaggcgcag

SEQ ID NO: 628271 - DNA, 25 bp, Rattus norvegicus
agcgaccttaaaggcgcaggacagc

SEQ ID NO: 628272 - DNA, 25 bp, Rattus norvegicus
accttaaaggcgcaggacagcaccc

SEQ ID NO: 628273 - DNA, 25 bp, Rattus norvegicus
tcctgtgccgctggggaaaattcga

SEQ ID NO: 628274 - DNA, 25 bp, Rattus norvegicus
cctcctgtgccgctggggaaaattc

SEQ ID NO: 628275 - DNA, 25 bp, Rattus norvegicus
ctcctgtgccgctggggaaaattcg

SEQ ID NO: 628276 - DNA, 25 bp, Rattus norvegicus
ccagcgaccttaaaggcgcaggaca

SEQ ID NO: 628277 - DNA, 25 bp, Rattus norvegicus
ctatgaccctcccagtcagagaaga

SEQ ID NO: 628278 - DNA, 25 bp, Rattus norvegicus
aggcggatcagtttccgcttcaagc

SEQ ID NO: 628279 - DNA, 25 bp, Rattus norvegicus
cacagccgcccaaagaggcggatca

SEQ ID NO: 628280 - DNA, 25 bp, Rattus norvegicus
agagcagtccttcaactcgcacagc

SEQ ID NO: 628281 - DNA, 25 bp, Rattus norvegicus
agcacatctccatagtccggaaacg

SEQ ID NO: 628282 - DNA, 25 bp, Rattus norvegicus
aggaattcgctgctctatgaccctc

SEQ ID NO: 628283 - DNA, 25 bp, Rattus norvegicus
gccgccttctccaccgctctcagca

SEQ ID NO: 628284 - DNA, 25 bp, Rattus norvegicus
catagtccggaaacgtgtcaggccc

SEQ ID NO: 628285 - DNA, 25 bp, Rattus norvegicus
tgcctcggtaaggaattcgctgctc

SEQ ID NO: 628286 - DNA, 25 bp, Rattus norvegicus
cccggcttgttgatgagccgctcga

SEQ ID NO: 628287 - DNA, 25 bp, Rattus norvegicus
ttgatgagccgctcgatgcgcctgt

SEQ ID NO: 628288 - DNA, 25 bp, Rattus norvegicus
atgcgcctgttgacctctgggtatc

SEQ ID NO: 628289 - DNA, 25 bp, Rattus norvegicus
cctctgggtatcgagtgcctcggta

SEQ ID NO: 628290 - DNA, 25 bp, Rattus norvegicus
tcccagtcagagaagagcagtcctt

SEQ ID NO: 628291 - DNA, 25 bp, Rattus norvegicus
caacagaccggaaggcgcggagttt

SEQ ID NO: 628292 - DNA, 25 bp, Rattus norvegicus
ctccgggtgcactgacactcagggg

SEQ ID NO: 628293 - DNA, 25 bp, Rattus norvegicus
taggccgccgctccgggtgcactga

SEQ ID NO: 628294 - DNA, 25 bp, Rattus norvegicus
tgtacgggacctaggcttcttggga

SEQ ID NO: 628295 - DNA, 25 bp, Rattus norvegicus
attgctgtacgggacctaggcttct

SEQ ID NO: 628296 - DNA, 25 bp, Rattus norvegicus
cctgagggcggccatattgctgtac

SEQ ID NO: 628297 - DNA, 25 bp, Rattus norvegicus
cggagtttccgcctgcagcacctga

SEQ ID NO: 628298 - DNA, 25 bp, Rattus norvegicus
ccctacaacagaccggaaggcgcgg

SEQ ID NO: 628299 - DNA, 25 bp, Rattus norvegicus
gatcacaaatcctcgcaaagttccc

SEQ ID NO: 628300 - DNA, 25 bp, Rattus norvegicus
tcagcgcggatcacaaatcctcgca

SEQ ID NO: 628301 - DNA, 25 bp, Rattus norvegicus
tcagaaacggtctctcgaggctccc

SEQ ID NO: 628302 - DNA, 25 bp, Rattus norvegicus
tcgccttcgccaactcctgcgccgc

SEQ ID NO: 628303 - DNA, 25 bp, Rattus norvegicus
aggccgtgcggatccttcgccttcg

SEQ ID NO: 628304 - DNA, 25 bp, Rattus norvegicus
ctgcagcacctgagggcggccatat

SEQ ID NO: 628305 - DNA, 25 bp, Rattus norvegicus
tccaccgagggtcgtcttgactgta

SEQ ID NO: 628306 - DNA, 25 bp, Rattus norvegicus
agaggggaaaacaactgtgtgatgc

SEQ ID NO: 628307 - DNA, 25 bp, Rattus norvegicus
gcgctgggaaacgaatcgaggctca

SEQ ID NO: 628308 - DNA, 25 bp, Rattus norvegicus
tcgaggctcataaaatcacgcgggg

SEQ ID NO: 628309 - DNA, 25 bp, Rattus norvegicus
aaatcacgcggggtgtcttccttct

SEQ ID NO: 628310 - DNA, 25 bp, Rattus norvegicus
cttccttctcctggagagctgcgga

SEQ ID NO: 628311 - DNA, 25 bp, Rattus norvegicus
aaaacaactgtgtgatgccggccgg

SEQ ID NO: 628312 - DNA, 25 bp, Rattus norvegicus
ccctcaggtgtgctgacgaggaagc

SEQ ID NO: 628313 - DNA, 25 bp, Rattus norvegicus
tgctgacgaggaagcctgataagtc

SEQ ID NO: 628314 - DNA, 25 bp, Rattus norvegicus
taagtcaacacccttcgcgcggaga

SEQ ID NO: 628315 - DNA, 25 bp, Rattus norvegicus
aagccctgcaagctgccgctgggag

SEQ ID NO: 628316 - DNA, 25 bp, Rattus norvegicus
ggtcgtcttgactgtatggaaggca

SEQ ID NO: 628317 - DNA, 25 bp, Rattus norvegicus
ggcttggtgagaagccctgcaagct

SEQ ID NO: 628318 - DNA, 25 bp, Rattus norvegicus
cttcgcgcggagactgcatcaacgc

SEQ ID NO: 628319 - DNA, 25 bp, Rattus norvegicus
tgacgcaaccagaggcctcaggaag

SEQ ID NO: 628320 - DNA, 25 bp, Rattus norvegicus
aggcgcgacaatcccgcgtctcttg

SEQ ID NO: 628321 - DNA, 25 bp, Rattus norvegicus
tccctgtcgtgcaggcgcgacaatc

SEQ ID NO: 628322 - DNA, 25 bp, Rattus norvegicus
tgttcgcagcgacgctggtccacca

SEQ ID NO: 628323 - DNA, 25 bp, Rattus norvegicus
agtgcaggcgacacacacagagcga

SEQ ID NO: 628324 - DNA, 25 bp, Rattus norvegicus
acaggtcgggacaacccggcctgca

SEQ ID NO: 628325 - DNA, 25 bp, Rattus norvegicus
ggaccaccgtggacatgcaggcaca

SEQ ID NO: 628326 - DNA, 25 bp, Rattus norvegicus
tgctgcctttgcatcccgtcctgtg

SEQ ID NO: 628327 - DNA, 25 bp, Rattus norvegicus
acagcgcgacggttgaaattcaaaa

SEQ ID NO: 628328 - DNA, 25 bp, Rattus norvegicus
ttgagcggcgagtttacagcgcgac

SEQ ID NO: 628329 - DNA, 25 bp, Rattus norvegicus
gtctgacgacaagagtcccgactca

SEQ ID NO: 628330 - DNA, 25 bp, Rattus norvegicus
ccaaggagtctggttctcttgcttg

SEQ ID NO: 628331 - DNA, 25 bp, Rattus norvegicus
tccggaagtaggatccaaggagtct

SEQ ID NO: 628332 - DNA, 25 bp, Rattus norvegicus
ccagcacttcccatttcgaattttc

SEQ ID NO: 628333 - DNA, 25 bp, Rattus norvegicus
ctctggtcctttccctcctagagga

SEQ ID NO: 628334 - DNA, 25 bp, Rattus norvegicus
tgctttggctgctgcgtcatacgcc

SEQ ID NO: 628335 - DNA, 25 bp, Rattus norvegicus
ttcgaaccatggttcggtccgtgcc

SEQ ID NO: 628336 - DNA, 25 bp, Rattus norvegicus
atggttcggtccgtgccgcctagtg

SEQ ID NO: 628337 - DNA, 25 bp, Rattus norvegicus
ccgcctagtgcccattggctggtgt

SEQ ID NO: 628338 - DNA, 25 bp, Rattus norvegicus
cccagtactagttccaagtagcctc

SEQ ID NO: 628339 - DNA, 25 bp, Rattus norvegicus
actagttccaagtagcctctggtcc

SEQ ID NO: 628340 - DNA, 25 bp, Rattus norvegicus
ctcctagaggagcacggccatgcca

SEQ ID NO: 628341 - DNA, 25 bp, Rattus norvegicus
ggctagctgccaagaaggttatttc

SEQ ID NO: 628342 - DNA, 25 bp, Rattus norvegicus
aggttatttcctgctgccctcagag

SEQ ID NO: 628343 - DNA, 25 bp, Rattus norvegicus
agagcaagcctcctatccgaaaagg

SEQ ID NO: 628344 - DNA, 25 bp, Rattus norvegicus
ggctacagggatttcctcgtcctcc

SEQ ID NO: 628345 - DNA, 25 bp, Rattus norvegicus
tgacctgcaggctagctgccaagaa

SEQ ID NO: 628346 - DNA, 25 bp, Rattus norvegicus
tgagggaggtgctgcctacccgccc

SEQ ID NO: 628347 - DNA, 25 bp, Rattus norvegicus
agcggaggccaatctccggtcggcc

SEQ ID NO: 628348 - DNA, 25 bp, Rattus norvegicus
ctggccaatcggcagcttggtccga

SEQ ID NO: 628349 - DNA, 25 bp, Rattus norvegicus
gagtagtccgcccacttccgtgaag

SEQ ID NO: 628350 - DNA, 25 bp, Rattus norvegicus
cgtgatgaggcctgtcctttcagga

SEQ ID NO: 628351 - DNA, 25 bp, Rattus norvegicus
tgtcctttcaggaggcgccgcctca

SEQ ID NO: 628352 - DNA, 25 bp, Rattus norvegicus
tgacgagaaaacagtgcacaccacg

SEQ ID NO: 628353 - DNA, 25 bp, Rattus norvegicus
acctgcagaagccacgtgacgagaa

SEQ ID NO: 628354 - DNA, 25 bp, Rattus norvegicus
ccgctcatttcaccgaggaaggatc

SEQ ID NO: 628355 - DNA, 25 bp, Rattus norvegicus
atgcagcccgcgctggtagagaaaa

SEQ ID NO: 628356 - DNA, 25 bp, Rattus norvegicus
tgcacaccacgtgacaggagcagcc

SEQ ID NO: 628357 - DNA, 25 bp, Rattus norvegicus
cccggagtgtgcctagtaacagtcc

SEQ ID NO: 628358 - DNA, 25 bp, Rattus norvegicus
tcggccagacttcgagaccggaagg

SEQ ID NO: 628359 - DNA, 25 bp, Rattus norvegicus
ttcggcggatgaagctcggccagac

SEQ ID NO: 628360 - DNA, 25 bp, Rattus norvegicus
ggagagatcaaaggccgctcatttc

SEQ ID NO: 628361 - DNA, 25 bp, Rattus norvegicus
agagcagccgtgatcccgatcccga

SEQ ID NO: 628362 - DNA, 25 bp, Rattus norvegicus
gatcccgatcccgaggacagggcgc

SEQ ID NO: 628363 - DNA, 25 bp, Rattus norvegicus
agccgtgatcccgatcccgaggaca

SEQ ID NO: 628364 - DNA, 25 bp, Rattus norvegicus
agccgaaacaaactgctgagacgca

SEQ ID NO: 628365 - DNA, 25 bp, Rattus norvegicus
accggaggagcgagtccagccgaaa

SEQ ID NO: 628366 - DNA, 25 bp, Rattus norvegicus
ggagcgagtccagccgaaacaaact

SEQ ID NO: 628367 - DNA, 25 bp, Rattus norvegicus
cgagcaggctcgtgccccggacagt

SEQ ID NO: 628368 - DNA, 25 bp, Rattus norvegicus
gagtccagccgaaacaaactgctga

SEQ ID NO: 628369 - DNA, 25 bp, Rattus norvegicus
cggagagcagccgtgatcccgatcc

SEQ ID NO: 628370 - DNA, 25 bp, Rattus norvegicus
aaacaaactgctgagacgcaccgtc

SEQ ID NO: 628371 - DNA, 25 bp, Rattus norvegicus
actgctgagacgcaccgtctctgtg

SEQ ID NO: 628372 - DNA, 25 bp, Rattus norvegicus
gacgcaccgtctctgtgccagtgga

SEQ ID NO: 628373 - DNA, 25 bp, Rattus norvegicus
cgcaccgtctctgtgccagtggagg

SEQ ID NO: 628374 - DNA, 25 bp, Rattus norvegicus
ccacggcgagcatggtacggaggcc

SEQ ID NO: 628375 - DNA, 25 bp, Rattus norvegicus
tagtgtcgggagtgtgagcctgtgt

SEQ ID NO: 628376 - DNA, 25 bp, Rattus norvegicus
gaaggggagcgctatagcgaggccc

SEQ ID NO: 628377 - DNA, 25 bp, Rattus norvegicus
gccgagttgactggagaggctggga

SEQ ID NO: 628378 - DNA, 25 bp, Rattus norvegicus
cctcgtgttcgagtagaagcggccg

SEQ ID NO: 628379 - DNA, 25 bp, Rattus norvegicus
ccaagagagccgagttgactggaga

SEQ ID NO: 628380 - DNA, 25 bp, Rattus norvegicus
cggctaggaactctgggctccgggc

SEQ ID NO: 628381 - DNA, 25 bp, Rattus norvegicus
acgcgaagtagtgtcgggagtgtga

SEQ ID NO: 628382 - DNA, 25 bp, Rattus norvegicus
cggccggctaggaactctgggctcc

SEQ ID NO: 628383 - DNA, 25 bp, Rattus norvegicus
cccagggcagtggagcgcggccggc

SEQ ID NO: 628384 - DNA, 25 bp, Rattus norvegicus
ggcgtgtgcggtcttggagggccca

SEQ ID NO: 628385 - DNA, 25 bp, Rattus norvegicus
gggagcagttcagcgtggtcatcct

SEQ ID NO: 628386 - DNA, 25 bp, Rattus norvegicus
ccggcctcgtgttcgagtagaagcg

SEQ ID NO: 628387 - DNA, 25 bp, Rattus norvegicus
cgcccggcctcgtgttcgagtagaa

SEQ ID NO: 628388 - DNA, 25 bp, Rattus norvegicus
cccggcctcgtgttcgagtagaagc

SEQ ID NO: 628389 - DNA, 25 bp, Rattus norvegicus
gatcatagaagctcgagagctgccc

SEQ ID NO: 628390 - DNA, 25 bp, Rattus norvegicus
gtttaacaacctgcctgctgtccgg

SEQ ID NO: 628391 - DNA, 25 bp, Rattus norvegicus
gccgggtagataacgtgctgaaact

SEQ ID NO: 628392 - DNA, 25 bp, Rattus norvegicus
ctatggatcatagaagctcgagagc

SEQ ID NO: 628393 - DNA, 25 bp, Rattus norvegicus
cccaagaagcgatattactgcgagt

SEQ ID NO: 628394 - DNA, 25 bp, Rattus norvegicus
tactgcgagttatgcctggacgaca

SEQ ID NO: 628395 - DNA, 25 bp, Rattus norvegicus
tgcggctgcatctgtaccgtgactc

SEQ ID NO: 628396 - DNA, 25 bp, Rattus norvegicus
tatgcctggacgacatgctctatgc

SEQ ID NO: 628397 - DNA, 25 bp, Rattus norvegicus
tgtaccgtgactcggacaaaaagcg

SEQ ID NO: 628398 - DNA, 25 bp, Rattus norvegicus
atgctctatgcacggaccacttcca

SEQ ID NO: 628399 - DNA, 25 bp, Rattus norvegicus
gagacactgtcttttggggcgagca

SEQ ID NO: 628400 - DNA, 25 bp, Rattus norvegicus
tggggcgagcacttcgagtttaaca

SEQ ID NO: 628401 - DNA, 25 bp, Rattus norvegicus
cgagcacttcgagtttaacaacctg

SEQ ID NO: 628402 - DNA, 25 bp, Rattus norvegicus
taacgtgctgaaactatggatcata

SEQ ID NO: 628403 - DNA, 25 bp, Rattus norvegicus
gggctgcggtcctcgcactacagct

SEQ ID NO: 628404 - DNA, 25 bp, Rattus norvegicus
gagactcaacttcctttaccaggtg

SEQ ID NO: 628405 - DNA, 25 bp, Rattus norvegicus
ctccggccgaggaatgacccggatg

SEQ ID NO: 628406 - DNA, 25 bp, Rattus norvegicus
tgctccggccgaggaatgacccgga

SEQ ID NO: 628407 - DNA, 25 bp, Rattus norvegicus
taccaggtgagacagcgctcaggtg

SEQ ID NO: 628408 - DNA, 25 bp, Rattus norvegicus
cctttaccaggtgagacagcgctca

SEQ ID NO: 628409 - DNA, 25 bp, Rattus norvegicus
tcaacttcctttaccaggtgagaca

SEQ ID NO: 628410 - DNA, 25 bp, Rattus norvegicus
ccttccagagactcaacttccttta

SEQ ID NO: 628411 - DNA, 25 bp, Rattus norvegicus
tgaaagaccgggaggccttccagag

SEQ ID NO: 628412 - DNA, 25 bp, Rattus norvegicus
tcatggcgggccaagtgaaagaccg

SEQ ID NO: 628413 - DNA, 25 bp, Rattus norvegicus
ggcagacactcatggcgggccaagt

SEQ ID NO: 628414 - DNA, 25 bp, Rattus norvegicus
catccgtaaggaggggcagacactc

SEQ ID NO: 628415 - DNA, 25 bp, Rattus norvegicus
gctcccagcagaccttgcgcacgtc

SEQ ID NO: 628416 - DNA, 25 bp, Rattus norvegicus
cttgcgcacgtctggggccggacat

SEQ ID NO: 628417 - DNA, 25 bp, Rattus norvegicus
agcatgtgtgcgctccagacttctg

SEQ ID NO: 628418 - DNA, 25 bp, Rattus norvegicus
actcgacccaaaggcgctgaggctg

SEQ ID NO: 628419 - DNA, 25 bp, Rattus norvegicus
ttggctgcaaaccaggtccggccct

SEQ ID NO: 628420 - DNA, 25 bp, Rattus norvegicus
tctcccattggctgcaaaccaggtc

SEQ ID NO: 628421 - DNA, 25 bp, Rattus norvegicus
agaggtcttgtaggccgccgctctc

SEQ ID NO: 628422 - DNA, 25 bp, Rattus norvegicus
ccagccaatgaggagaggtcttgta

SEQ ID NO: 628423 - DNA, 25 bp, Rattus norvegicus
gggatacacacaccgcgctgcggag

SEQ ID NO: 628424 - DNA, 25 bp, Rattus norvegicus
gtgctcagcatgtgtgcgctccaga

SEQ ID NO: 628425 - DNA, 25 bp, Rattus norvegicus
cgcttgtctgcgaaatggaggaaag

SEQ ID NO: 628426 - DNA, 25 bp, Rattus norvegicus
tttaattgtgaggacgcttgtctgc

SEQ ID NO: 628427 - DNA, 25 bp, Rattus norvegicus
cctctcgacatagggtttaattgtg

SEQ ID NO: 628428 - DNA, 25 bp, Rattus norvegicus
aagtgcaaaaccctctcgacatagg

SEQ ID NO: 628429 - DNA, 25 bp, Rattus norvegicus
ttaacgcccgaaagactccaagtgc

SEQ ID NO: 628430 - DNA, 25 bp, Rattus norvegicus
tcggccgctcatcccggaaaacatt

SEQ ID NO: 628431 - DNA, 25 bp, Rattus norvegicus
tcgcttcccacttactattttcggc

SEQ ID NO: 628432 - DNA, 25 bp, Rattus norvegicus
gtgactcccagaacttcctgatggc

SEQ ID NO: 628433 - DNA, 25 bp, Rattus norvegicus
ttccctgtcattgccggcgcgctat

SEQ ID NO: 628434 - DNA, 25 bp, Rattus norvegicus
ggcgcgctattaatttcgcttccca

SEQ ID NO: 628435 - DNA, 25 bp, Rattus norvegicus
gaacttcctgatggcggagacaagg

SEQ ID NO: 628436 - DNA, 25 bp, Rattus norvegicus
cttgcgacggggatagaatgaaatg

SEQ ID NO: 628437 - DNA, 25 bp, Rattus norvegicus
tgaaatggcaagttcagctcactcc

SEQ ID NO: 628438 - DNA, 25 bp, Rattus norvegicus
ggcaagttcagctcactccgctcag

SEQ ID NO: 628439 - DNA, 25 bp, Rattus norvegicus
gcctggctcccaggcgttccaaggg

SEQ ID NO: 628440 - DNA, 25 bp, Rattus norvegicus
ggggatgtgattgtctacctctcca

SEQ ID NO: 628441 - DNA, 25 bp, Rattus norvegicus
gattgtctacctctccagatccgca

SEQ ID NO: 628442 - DNA, 25 bp, Rattus norvegicus
gatgttggaccggtgactcccagaa

SEQ ID NO: 628443 - DNA, 25 bp, Rattus norvegicus
acggcctcgttttccctgtcattgc

SEQ ID NO: 628444 - DNA, 25 bp, Rattus norvegicus
agatccgcacacacggcctcgtttt

SEQ ID NO: 628445 - DNA, 25 bp, Rattus norvegicus
tggtggatagccatctagagaacgc

SEQ ID NO: 628446 - DNA, 25 bp, Rattus norvegicus
cagggtgaccgtggccaaattcccg

SEQ ID NO: 628447 - DNA, 25 bp, Rattus norvegicus
aaattcccggtgtgctcagccacgc

SEQ ID NO: 628448 - DNA, 25 bp, Rattus norvegicus
tcagccacgcgtgggcagtaggcta

SEQ ID NO: 628449 - DNA, 25 bp, Rattus norvegicus
gggccatccggatcgtccaagtcgc

SEQ ID NO: 628450 - DNA, 25 bp, Rattus norvegicus
ccgaagtgtactctctgatggtgga

SEQ ID NO: 628451 - DNA, 25 bp, Rattus norvegicus
tgcagccgtgcacgcgcgcagtgta

SEQ ID NO: 628452 - DNA, 25 bp, Rattus norvegicus
cctcccaggcgggatttgcatgtgt

SEQ ID NO: 628453 - DNA, 25 bp, Rattus norvegicus
tgctccttcccagctacaggtacgg

SEQ ID NO: 628454 - DNA, 25 bp, Rattus norvegicus
aggcagagacgcaggcacctcctca

SEQ ID NO: 628455 - DNA, 25 bp, Rattus norvegicus
atccaggcgcaagacggttctcagc

SEQ ID NO: 628456 - DNA, 25 bp, Rattus norvegicus
ttctgggcgactttgccgcctcgag

SEQ ID NO: 628457 - DNA, 25 bp, Rattus norvegicus
agcctggcagctcgcttctgggcga

SEQ ID NO: 628458 - DNA, 25 bp, Rattus norvegicus
gcgccgtttagctctccagtggctg

SEQ ID NO: 628459 - DNA, 25 bp, Rattus norvegicus
acaaggaggcctttgccattgtgtc

SEQ ID NO: 628460 - DNA, 25 bp, Rattus norvegicus
ggctgtgtcctctcgcccaggaact

SEQ ID NO: 628461 - DNA, 25 bp, Rattus norvegicus
ggcacctctgtaccaacacctggat

SEQ ID NO: 628462 - DNA, 25 bp, Rattus norvegicus
acctggatccagagcacgaacgcgc

SEQ ID NO: 628463 - DNA, 25 bp, Rattus norvegicus
acgaacgcgcccatcgacgtggagg

SEQ ID NO: 628464 - DNA, 25 bp, Rattus norvegicus
gctcacccttgtctccgcagttggg

SEQ ID NO: 628465 - DNA, 25 bp, Rattus norvegicus
ccattgtgtcggttcccgtgtctga

SEQ ID NO: 628466 - DNA, 25 bp, Rattus norvegicus
ttcccgtgtctgagatccgcgacct

SEQ ID NO: 628467 - DNA, 25 bp, Rattus norvegicus
tccgcgacctggactttgccaacga

SEQ ID NO: 628468 - DNA, 25 bp, Rattus norvegicus
tgccaacgatgcaagctccatgctg

SEQ ID NO: 628469 - DNA, 25 bp, Rattus norvegicus
gaaactcaacgagggcttcatcagc

SEQ ID NO: 628470 - DNA, 25 bp, Rattus norvegicus
tcatcagccagaacgaccgcaggtg

SEQ ID NO: 628471 - DNA, 25 bp, Rattus norvegicus
ccaggaactcctacgtgcggctgcg

SEQ ID NO: 628472 - DNA, 25 bp, Rattus norvegicus
ggaacggcctatccggctcatggta

SEQ ID NO: 628473 - DNA, 25 bp, Rattus norvegicus
tcccgatattcgctgggccctggct

SEQ ID NO: 628474 - DNA, 25 bp, Rattus norvegicus
tgtcttccgcctcgcgggtgtgacc

SEQ ID NO: 628475 - DNA, 25 bp, Rattus norvegicus
cttgctgggactggtgtcttccgcc

SEQ ID NO: 628476 - DNA, 25 bp, Rattus norvegicus
actgctactgggcacggcttgctgg

SEQ ID NO: 628477 - DNA, 25 bp, Rattus norvegicus
tctgcatcccggactgctactgggc

SEQ ID NO: 628478 - DNA, 25 bp, Rattus norvegicus
ctgcaggtgagtgccttgcccgttc

SEQ ID NO: 628479 - DNA, 25 bp, Rattus norvegicus
aaccataaccgggacctgcaggtga

SEQ ID NO: 628480 - DNA, 25 bp, Rattus norvegicus
tgtgagaaccataaccgggacctgc

SEQ ID NO: 628481 - DNA, 25 bp, Rattus norvegicus
tgcagctgctgtgtgagaaccataa

SEQ ID NO: 628482 - DNA, 25 bp, Rattus norvegicus
ggtgctcatcatgcggcccatcctg

SEQ ID NO: 628483 - DNA, 25 bp, Rattus norvegicus
agatggggacctcggtgctcatcat

SEQ ID NO: 628484 - DNA, 25 bp, Rattus norvegicus
tgcgcagaacaacgagatggggacc

SEQ ID NO: 628485 - DNA, 25 bp, Rattus norvegicus
tgtgaccgtgctgtgtgtgccacac

SEQ ID NO: 628486 - DNA, 25 bp, Rattus norvegicus
acgtgagcgagcgtgcgcagaacaa

SEQ ID NO: 628487 - DNA, 25 bp, Rattus norvegicus
gcagggcagcaaagtgagcgacttc

SEQ ID NO: 628488 - DNA, 25 bp, Rattus norvegicus
aagtgagcgacttcttcgaccagtc

SEQ ID NO: 628489 - DNA, 25 bp, Rattus norvegicus
gtcctccttcctgcacaacgagatg

SEQ ID NO: 628490 - DNA, 25 bp, Rattus norvegicus
ttcctgcacaacgagatggagtggc

SEQ ID NO: 628491 - DNA, 25 bp, Rattus norvegicus
cacaacgagatggagtggcagcgcc

SEQ ID NO: 628492 - DNA, 25 bp, Rattus norvegicus
cgccggcttcgcagtgaggaccagc

SEQ ID NO: 628493 - DNA, 25 bp, Rattus norvegicus
ttgtggggacccacacgccacgctg

SEQ ID NO: 628494 - DNA, 25 bp, Rattus norvegicus
acgccacgctgtgtccttaggcatg

SEQ ID NO: 628495 - DNA, 25 bp, Rattus norvegicus
tgtgtccttaggcatgccgctcatc

SEQ ID NO: 628496 - DNA, 25 bp, Rattus norvegicus
aggcatgccgctcatctactggttc

SEQ ID NO: 628497 - DNA, 25 bp, Rattus norvegicus
atctactggttctcccgccgcatga

SEQ ID NO: 628498 - DNA, 25 bp, Rattus norvegicus
tcaccaccacggagcaggacgagca

SEQ ID NO: 628499 - DNA, 25 bp, Rattus norvegicus
tgagcgacttcttcgaccagtcctc

SEQ ID NO: 628500 - DNA, 25 bp, Rattus norvegicus
ggctcttcaccaccacggagcagga

SEQ ID NO: 628501 - DNA, 25 bp, Rattus norvegicus
aagatgggtacctagcacacgtgca

SEQ ID NO: 628502 - DNA, 25 bp, Rattus norvegicus
tagcacacgtgcagcctgtcaggga

SEQ ID NO: 628503 - DNA, 25 bp, Rattus norvegicus
cagcctgtcagggaggccgacgcat

SEQ ID NO: 628504 - DNA, 25 bp, Rattus norvegicus
cctccggtcacctgggtgttctctc

SEQ ID NO: 628505 - DNA, 25 bp, Rattus norvegicus
tctccctcccgaaaggcctgtgcta

SEQ ID NO: 628506 - DNA, 25 bp, Rattus norvegicus
ctgtgctacccgctgccgcaggtaa

SEQ ID NO: 628507 - DNA, 25 bp, Rattus norvegicus
gctgccgcaggtaagcgcccaagtc

SEQ ID NO: 628508 - DNA, 25 bp, Rattus norvegicus
tcgcacgtcgcagctagctggaaga

SEQ ID NO: 628509 - DNA, 25 bp, Rattus norvegicus
cgtttggtctcgtccactggccatt

SEQ ID NO: 628510 - DNA, 25 bp, Rattus norvegicus
cactggccattcctcacagagctta

SEQ ID NO: 628511 - DNA, 25 bp, Rattus norvegicus
tcctcacagagcttaagaaaacgcc

SEQ ID NO: 628512 - DNA, 25 bp, Rattus norvegicus
agagcttaagaaaacgccggtagcg

SEQ ID NO: 628513 - DNA, 25 bp, Rattus norvegicus
cgtgcgcactaaggcgcgctggcct

SEQ ID NO: 628514 - DNA, 25 bp, Rattus norvegicus
cagctagctggaagatgggtaccta

SEQ ID NO: 628515 - DNA, 25 bp, Rattus norvegicus
gcagggactcgtagaacttctgttc

SEQ ID NO: 628516 - DNA, 25 bp, Rattus norvegicus
ggaagggctccaacggcacgcctac

SEQ ID NO: 628517 - DNA, 25 bp, Rattus norvegicus
tcctgaaagataaggggcttgcata

SEQ ID NO: 628518 - DNA, 25 bp, Rattus norvegicus
tgtaggcgtcgtaccgcagcacgct

SEQ ID NO: 628519 - DNA, 25 bp, Rattus norvegicus
cgacctggtgcaggaagggctccaa

SEQ ID NO: 628520 - DNA, 25 bp, Rattus norvegicus
ttgcataccgtgtaggcgtcgtacc

SEQ ID NO: 628521 - DNA, 25 bp, Rattus norvegicus
agataaggggcttgcataccgtgta

SEQ ID NO: 628522 - DNA, 25 bp, Rattus norvegicus
cagcagccacgagtgcagctgagcc

SEQ ID NO: 628523 - DNA, 25 bp, Rattus norvegicus
acgctcacctttatactgcggagtg

SEQ ID NO: 628524 - DNA, 25 bp, Rattus norvegicus
tttatactgcggagtgaagcgtctc

SEQ ID NO: 628525 - DNA, 25 bp, Rattus norvegicus
cggagtgaagcgtctcatggccagt

SEQ ID NO: 628526 - DNA, 25 bp, Rattus norvegicus
gtctcatggccagtggcagggactc

SEQ ID NO: 628527 - DNA, 25 bp, Rattus norvegicus
cttctgttcctgaaagataaggggc

SEQ ID NO: 628528 - DNA, 25 bp, Rattus norvegicus
tcgtaccgcagcacgctcaggtggc

SEQ ID NO: 628529 - DNA, 25 bp, Rattus norvegicus
ggctcttctcgatcagaccgctgtt

SEQ ID NO: 628530 - DNA, 25 bp, Rattus norvegicus
tcggcgatttcaagagcgttttgca

SEQ ID NO: 628531 - DNA, 25 bp, Rattus norvegicus
agcgcatcacgctcggcgatttcaa

SEQ ID NO: 628532 - DNA, 25 bp, Rattus norvegicus
tacctggtgaagatccctgtcccgg

SEQ ID NO: 628533 - DNA, 25 bp, Rattus norvegicus
tccttggacacgtcttccgcactgg

SEQ ID NO: 628534 - DNA, 25 bp, Rattus norvegicus
tttgagtctcgccacacggctcttc

SEQ ID NO: 628535 - DNA, 25 bp, Rattus norvegicus
taccatctggatgaagaagagactc

SEQ ID NO: 628536 - DNA, 25 bp, Rattus norvegicus
tggggtctaggttttgagtctcgcc

SEQ ID NO: 628537 - DNA, 25 bp, Rattus norvegicus
cgtgaaggacagtccgctgcgcaaa

SEQ ID NO: 628538 - DNA, 25 bp, Rattus norvegicus
gtggagcttgtagtaacgtgacata

SEQ ID NO: 628539 - DNA, 25 bp, Rattus norvegicus
gttgctcaaggcagtggtcacgtga

SEQ ID NO: 628540 - DNA, 25 bp, Rattus norvegicus
cgtctagggctgaagaccgttgctc

SEQ ID NO: 628541 - DNA, 25 bp, Rattus norvegicus
gaagagactccttacctggtgaaga

SEQ ID NO: 628542 - DNA, 25 bp, Rattus norvegicus
ggcgagacgaaggtgatttaccatc

SEQ ID NO: 628543 - DNA, 25 bp, Rattus norvegicus
gccaaccagccaaacatctggctga

SEQ ID NO: 628544 - DNA, 25 bp, Rattus norvegicus
agcgagggctgaaataatgccaagg

SEQ ID NO: 628545 - DNA, 25 bp, Rattus norvegicus
ctctctgaaagcgagggctgaaata

SEQ ID NO: 628546 - DNA, 25 bp, Rattus norvegicus
tgccggcaggatctctctgaaagcg

SEQ ID NO: 628547 - DNA, 25 bp, Rattus norvegicus
cggtctttaacatgccggcaggatc

SEQ ID NO: 628548 - DNA, 25 bp, Rattus norvegicus
taatgagcgcggtctttaacatgcc

SEQ ID NO: 628549 - DNA, 25 bp, Rattus norvegicus
gcctggttaattaatgagcgcggtc

SEQ ID NO: 628550 - DNA, 25 bp, Rattus norvegicus
gactctcaatgaagcgcctggttaa

SEQ ID NO: 628551 - DNA, 25 bp, Rattus norvegicus
ttacgccgttgactctcaatgaagc

SEQ ID NO: 628552 - DNA, 25 bp, Rattus norvegicus
accgcgaacaacaattacgccgttg

SEQ ID NO: 628553 - DNA, 25 bp, Rattus norvegicus
caattagaatttatccaccgcgaac

SEQ ID NO: 628554 - DNA, 25 bp, Rattus norvegicus
ctgcacaaatatgctcttaatattc

SEQ ID NO: 628555 - DNA, 25 bp, Rattus norvegicus
catctggctgacagagggcacggct

SEQ ID NO: 628556 - DNA, 25 bp, Rattus norvegicus
acgcggctccttctgcacaaatatg

SEQ ID NO: 628557 - DNA, 25 bp, Rattus norvegicus
tcgttgtagcgcacaaacgtgacca

SEQ ID NO: 628558 - DNA, 25 bp, Rattus norvegicus
cggtaaatgcggttggtcttggtca

SEQ ID NO: 628559 - DNA, 25 bp, Rattus norvegicus
gtccggctctgcgatcatgaggaag

SEQ ID NO: 628560 - DNA, 25 bp, Rattus norvegicus
cgcgtagctgatgctcatgccgagc

SEQ ID NO: 628561 - DNA, 25 bp, Rattus norvegicus
gcgatgcccaccacggccaggaaga

SEQ ID NO: 628562 - DNA, 25 bp, Rattus norvegicus
ggcgagtcccactccaacttgacga

SEQ ID NO: 628563 - DNA, 25 bp, Rattus norvegicus
tgaccgaccgtttgccctgctcaaa

SEQ ID NO: 628564 - DNA, 25 bp, Rattus norvegicus
accacacgcagatgccgagcagctg

SEQ ID NO: 628565 - DNA, 25 bp, Rattus norvegicus
caagtgtccgttggtcctggaagtc

SEQ ID NO: 628566 - DNA, 25 bp, Rattus norvegicus
tccgagatgtcgcacttgagcacgc

SEQ ID NO: 628567 - DNA, 25 bp, Rattus norvegicus
agtacacgtgaccatcagcagcatg

SEQ ID NO: 628568 - DNA, 25 bp, Rattus norvegicus
gcctcgggtcttgatggcgtacaca

SEQ ID NO: 628569 - DNA, 25 bp, Rattus norvegicus
ccctgctcaaagatgcggtaaatgc

SEQ ID NO: 628570 - DNA, 25 bp, Rattus norvegicus
tcatgccgagccctaggaagatgcg

SEQ ID NO: 628571 - DNA, 25 bp, Rattus norvegicus
cacttagacgacctagatgaaccgg

SEQ ID NO: 628572 - DNA, 25 bp, Rattus norvegicus
ccacttagacgacctagatgaaccg

SEQ ID NO: 628573 - DNA, 25 bp, Rattus norvegicus
tccacttagacgacctagatgaacc

SEQ ID NO: 628574 - DNA, 25 bp, Rattus norvegicus
gtccacttagacgacctagatgaac

SEQ ID NO: 628575 - DNA, 25 bp, Rattus norvegicus
acttagacgacctagatgaaccggg

SEQ ID NO: 628576 - DNA, 25 bp, Rattus norvegicus
cttagacgacctagatgaaccgggg

SEQ ID NO: 628577 - DNA, 25 bp, Rattus norvegicus
ttagacgacctagatgaaccggggc

SEQ ID NO: 628578 - DNA, 25 bp, Rattus norvegicus
tagacgacctagatgaaccggggct

SEQ ID NO: 628579 - DNA, 25 bp, Rattus norvegicus
tgaggccgttgacgtagccgacaga

SEQ ID NO: 628580 - DNA, 25 bp, Rattus norvegicus
ccaggacacggccacagcgagtgtg

SEQ ID NO: 628581 - DNA, 25 bp, Rattus norvegicus
caggccaggacacggccacagcgag

SEQ ID NO: 628582 - DNA, 25 bp, Rattus norvegicus
caggacacggccacagcgagtgtga

SEQ ID NO: 628583 - DNA, 25 bp, Rattus norvegicus
gacacggccacagcgagtgtgagcc

SEQ ID NO: 628584 - DNA, 25 bp, Rattus norvegicus
gaggccgttgacgtagccgacagag

SEQ ID NO: 628585 - DNA, 25 bp, Rattus norvegicus
cttagctgctcgcactgccgggagc

SEQ ID NO: 628586 - DNA, 25 bp, Rattus norvegicus
ggggccaactccacctgtcatcagt

SEQ ID NO: 628587 - DNA, 25 bp, Rattus norvegicus
acagcctagcctctccgcagagggg

SEQ ID NO: 628588 - DNA, 25 bp, Rattus norvegicus
actcaccgcgcatcggcgaggtgaa

SEQ ID NO: 628589 - DNA, 25 bp, Rattus norvegicus
actagggagctcacggaggccacct

SEQ ID NO: 628590 - DNA, 25 bp, Rattus norvegicus
gggaagcctctttcctcgagtcctg

SEQ ID NO: 628591 - DNA, 25 bp, Rattus norvegicus
gaccacggggcaaaggctcacacca

SEQ ID NO: 628592 - DNA, 25 bp, Rattus norvegicus
tcctcccggaactagggagctcacg

SEQ ID NO: 628593 - DNA, 25 bp, Rattus norvegicus
cctctggccgaggaccacggggcaa

SEQ ID NO: 628594 - DNA, 25 bp, Rattus norvegicus
tcaacgcggagctggcgttgccctc

SEQ ID NO: 628595 - DNA, 25 bp, Rattus norvegicus
cccagacccgcagacagcagtgccc

SEQ ID NO: 628596 - DNA, 25 bp, Rattus norvegicus
tgtcatcagtgcagcaccgtcagag

SEQ ID NO: 628597 - DNA, 25 bp, Rattus norvegicus
ccacggtgcccgtgctgctgatgct

SEQ ID NO: 628598 - DNA, 25 bp, Rattus norvegicus
gggcaaaggctcacaccacgatccg

SEQ ID NO: 628599 - DNA, 25 bp, Rattus norvegicus
actggtgctcaatgcatacagctgg

SEQ ID NO: 628600 - DNA, 25 bp, Rattus norvegicus
gcgctcagcgcatacactggtgctc

SEQ ID NO: 628601 - DNA, 25 bp, Rattus norvegicus
cgtacactggtgctcagcgcataca

SEQ ID NO: 628602 - DNA, 25 bp, Rattus norvegicus
tcagcgcgtacactggtgctcaatg

SEQ ID NO: 628603 - DNA, 25 bp, Rattus norvegicus
tcaatgcatacagctggcgctcagc

SEQ ID NO: 628604 - DNA, 25 bp, Rattus norvegicus
agcgcgtacactggtgctcaatgca

SEQ ID NO: 628605 - DNA, 25 bp, Rattus norvegicus
ctcaatgcatacagctggcgctcag

SEQ ID NO: 628606 - DNA, 25 bp, Rattus norvegicus
catacactggtgctcagcgcataca

SEQ ID NO: 628607 - DNA, 25 bp, Rattus norvegicus
tggcgctcagcacatacactggtgc

SEQ ID NO: 628608 - DNA, 25 bp, Rattus norvegicus
gctcaatgcatacagctggcgctca

SEQ ID NO: 628609 - DNA, 25 bp, Rattus norvegicus
tacactggtgctcagcgcatacagc

SEQ ID NO: 628610 - DNA, 25 bp, Rattus norvegicus
tggcgctcagcgcatacactggtgc

SEQ ID NO: 628611 - DNA, 25 bp, Rattus norvegicus
cgcatacactggtgctcagcttgta

SEQ ID NO: 628612 - DNA, 25 bp, Rattus norvegicus
cgcatacactggtgctcagcgcata

SEQ ID NO: 628613 - DNA, 25 bp, Rattus norvegicus
aaccgtcggcgtttgccaagttgca

SEQ ID NO: 628614 - DNA, 25 bp, Rattus norvegicus
actgggcccgcattgcaattccctg

SEQ ID NO: 628615 - DNA, 25 bp, Rattus norvegicus
tctgcccgaggactctgagaaaccg

SEQ ID NO: 628616 - DNA, 25 bp, Rattus norvegicus
cggaggcctcttataggtgtgtccc

SEQ ID NO: 628617 - DNA, 25 bp, Rattus norvegicus
cctgctcggcgtcaaagggtaacta

SEQ ID NO: 628618 - DNA, 25 bp, Rattus norvegicus
cttgtgttttcacgcgccttgaggc

SEQ ID NO: 628619 - DNA, 25 bp, Rattus norvegicus
caagttgcacgtttggatttcccga

SEQ ID NO: 628620 - DNA, 25 bp, Rattus norvegicus
aatcctcgggttcatttgcatggcc

SEQ ID NO: 628621 - DNA, 25 bp, Rattus norvegicus
ctcctttgaagcctgcacctgggtg

SEQ ID NO: 628622 - DNA, 25 bp, Rattus norvegicus
tgcttcctgaacaccacgcagtagg

SEQ ID NO: 628623 - DNA, 25 bp, Rattus norvegicus
accaatgggacctcgtgcttcctga

SEQ ID NO: 628624 - DNA, 25 bp, Rattus norvegicus
ctcggtcccagcaacaagtcttttg

SEQ ID NO: 628625 - DNA, 25 bp, Rattus norvegicus
tcacaatcgtgtgtcactgggcccg

SEQ ID NO: 628626 - DNA, 25 bp, Rattus norvegicus
agtcttttgttgagccaggcacccg

SEQ ID NO: 628627 - DNA, 25 bp, Rattus norvegicus
gcgctttcctggctgcacacgggcg

SEQ ID NO: 628628 - DNA, 25 bp, Rattus norvegicus
tcactgcaggagctcggcgactgtc

SEQ ID NO: 628629 - DNA, 25 bp, Rattus norvegicus
agtcgagcataatggccaatccgga

SEQ ID NO: 628630 - DNA, 25 bp, Rattus norvegicus
gggccttagcgacccagtcgagcat

SEQ ID NO: 628631 - DNA, 25 bp, Rattus norvegicus
ggcgcgtgatcaaagaacccggaga

SEQ ID NO: 628632 - DNA, 25 bp, Rattus norvegicus
ccggaagagccctccggcgcgtgat

SEQ ID NO: 628633 - DNA, 25 bp, Rattus norvegicus
tgacagcaacacctccggttggctc

SEQ ID NO: 628634 - DNA, 25 bp, Rattus norvegicus
caggccgaggggacaagccagaaac

SEQ ID NO: 628635 - DNA, 25 bp, Rattus norvegicus
cgatgcccgcctgggtaccttggaa

SEQ ID NO: 628636 - DNA, 25 bp, Rattus norvegicus
taactgcgcccatatccgtaggtca

SEQ ID NO: 628637 - DNA, 25 bp, Rattus norvegicus
tccgtaggtcagttttgccagttcc

SEQ ID NO: 628638 - DNA, 25 bp, Rattus norvegicus
tttgccagttcccagtagcgagctc

SEQ ID NO: 628639 - DNA, 25 bp, Rattus norvegicus
cgcctcggcaggcagatggtcccaa

SEQ ID NO: 628640 - DNA, 25 bp, Rattus norvegicus
acggaaaggtatgaggccgctcgta

SEQ ID NO: 628641 - DNA, 25 bp, Rattus norvegicus
ctgctcaggagcacagcacggcctg

SEQ ID NO: 628642 - DNA, 25 bp, Rattus norvegicus
cgaggccagcacctgctcaggagca

SEQ ID NO: 628643 - DNA, 25 bp, Rattus norvegicus
gaggatccgcttgagtttagaaaca

SEQ ID NO: 628644 - DNA, 25 bp, Rattus norvegicus
aaacacgtctaattgttcggggatg

SEQ ID NO: 628645 - DNA, 25 bp, Rattus norvegicus
tcggggatgtgttctcacgtcagct

SEQ ID NO: 628646 - DNA, 25 bp, Rattus norvegicus
tctcacgtcagctaacgtcagcttc

SEQ ID NO: 628647 - DNA, 25 bp, Rattus norvegicus
gtgacaataagcacgtacacatacg

SEQ ID NO: 628648 - DNA, 25 bp, Rattus norvegicus
ggcagctcatgacttaccgatgttc

SEQ ID NO: 628649 - DNA, 25 bp, Rattus norvegicus
atgacttaccgatgttcaccgagtc

SEQ ID NO: 628650 - DNA, 25 bp, Rattus norvegicus
taacgtcagcttcagggcatgggtg

SEQ ID NO: 628651 - DNA, 25 bp, Rattus norvegicus
gggtgccgcgatcctcagcatggca

SEQ ID NO: 628652 - DNA, 25 bp, Rattus norvegicus
agcatggcactccactcgagcgtct

SEQ ID NO: 628653 - DNA, 25 bp, Rattus norvegicus
gtctccaccgggcagctcatgactt

SEQ ID NO: 628654 - DNA, 25 bp, Rattus norvegicus
gtcttccagcacctccgtgacaata

SEQ ID NO: 628655 - DNA, 25 bp, Rattus norvegicus
ctccgcggcgggatagcctcattgc

SEQ ID NO: 628656 - DNA, 25 bp, Rattus norvegicus
cttcttgtagccgtcgccgtcgtag

SEQ ID NO: 628657 - DNA, 25 bp, Rattus norvegicus
gtctggttcgacttgagcttcatca

SEQ ID NO: 628658 - DNA, 25 bp, Rattus norvegicus
ggagagtctgtatgtccgctacacg

SEQ ID NO: 628659 - DNA, 25 bp, Rattus norvegicus
tggcagcaccggtctgctgtgcctc

SEQ ID NO: 628660 - DNA, 25 bp, Rattus norvegicus
gacttgagcttcatcatcctccgga

SEQ ID NO: 628661 - DNA, 25 bp, Rattus norvegicus
ccgccattttggacgcgctgcgtca

SEQ ID NO: 628662 - DNA, 25 bp, Rattus norvegicus
cgtcagccttagctgccggggatca

SEQ ID NO: 628663 - DNA, 25 bp, Rattus norvegicus
ctcagatgaccaggagagtggcagc

SEQ ID NO: 628664 - DNA, 25 bp, Rattus norvegicus
atccaaggttgcgtggctcagatga

SEQ ID NO: 628665 - DNA, 25 bp, Rattus norvegicus
gagcggcccagcctgatccaaggtt

SEQ ID NO: 628666 - DNA, 25 bp, Rattus norvegicus
acgcacatagcgtagggctagggcc

SEQ ID NO: 628667 - DNA, 25 bp, Rattus norvegicus
cgcccggcgcaaaagagtgtgtgca

SEQ ID NO: 628668 - DNA, 25 bp, Rattus norvegicus
cgctgcgtcagctgcgtaagggcac

SEQ ID NO: 628669 - DNA, 25 bp, Rattus norvegicus
cgccgcctggggtggcctcggcagt

SEQ ID NO: 628670 - DNA, 25 bp, Rattus norvegicus
agaggcactcaccgcggcggctgca

SEQ ID NO: 628671 - DNA, 25 bp, Rattus norvegicus
atggcagtgccacggccgggatggc

SEQ ID NO: 628672 - DNA, 25 bp, Rattus norvegicus
gatggcggccgatggaacccggacc

SEQ ID NO: 628673 - DNA, 25 bp, Rattus norvegicus
cgatggaacccggaccccagaggca

SEQ ID NO: 628674 - DNA, 25 bp, Rattus norvegicus
cccagaggcactcaccgcggcggct

SEQ ID NO: 628675 - DNA, 25 bp, Rattus norvegicus
cgccatggcagtgccacggccggga

SEQ ID NO: 628676 - DNA, 25 bp, Rattus norvegicus
cgtgcgcggcgcagcgtctcttccg

SEQ ID NO: 628677 - DNA, 25 bp, Rattus norvegicus
gcgcagcgtctcttccgggctgcgt

SEQ ID NO: 628678 - DNA, 25 bp, Rattus norvegicus
cgcagcgtctcttccgggctgcgtg

SEQ ID NO: 628679 - DNA, 25 bp, Rattus norvegicus
cccgcacgccgcctggggtggcctc

SEQ ID NO: 628680 - DNA, 25 bp, Rattus norvegicus
ctcggcagtgcctgaagagcgcggt

SEQ ID NO: 628681 - DNA, 25 bp, Rattus norvegicus
agtgcctgaagagcgcggtcggagc

SEQ ID NO: 628682 - DNA, 25 bp, Rattus norvegicus
agcgtctcttccgggctgcgtggcc

SEQ ID NO: 628683 - DNA, 25 bp, Rattus norvegicus
ggaggacgagaacggcctccgcctc

SEQ ID NO: 628684 - DNA, 25 bp, Rattus norvegicus
tgcggcgaaaggaacacacgcaggc

SEQ ID NO: 628685 - DNA, 25 bp, Rattus norvegicus
ggcctgcggcgaaaggaacacacgc

SEQ ID NO: 628686 - DNA, 25 bp, Rattus norvegicus
cgcaggcgggcgctgaatcccgaac

SEQ ID NO: 628687 - DNA, 25 bp, Rattus norvegicus
aggcgggcgctgaatcccgaacccg

SEQ ID NO: 628688 - DNA, 25 bp, Rattus norvegicus
gctgaatcccgaacccgggcgcttc

SEQ ID NO: 628689 - DNA, 25 bp, Rattus norvegicus
gccacacgtggccttcaaactccgc

SEQ ID NO: 628690 - DNA, 25 bp, Rattus norvegicus
ggccttcaaactccgctcctccatc

SEQ ID NO: 628691 - DNA, 25 bp, Rattus norvegicus
tccatccgccgccatcgggacgccg

SEQ ID NO: 628692 - DNA, 25 bp, Rattus norvegicus
atcgggacgccggtgcccgtcagca

SEQ ID NO: 628693 - DNA, 25 bp, Rattus norvegicus
cctggcaatggtgcgaccagctgga

SEQ ID NO: 628694 - DNA, 25 bp, Rattus norvegicus
accagctggagtggaggacgagaac

SEQ ID NO: 628695 - DNA, 25 bp, Rattus norvegicus
tggaggacgagaacggcctccgcct

SEQ ID NO: 628696 - DNA, 25 bp, Rattus norvegicus
gcctgcggcgaaaggaacacacgca

SEQ ID NO: 628697 - DNA, 25 bp, Rattus norvegicus
gcctgcccggaaagcgcggagaaaa

SEQ ID NO: 628698 - DNA, 25 bp, Rattus norvegicus
ggcaaggattgcaacccggctcttc

SEQ ID NO: 628699 - DNA, 25 bp, Rattus norvegicus
cactttgaacgaagcgcccaggaca

SEQ ID NO: 628700 - DNA, 25 bp, Rattus norvegicus
ccgacctcgcggagcactttgaacg

SEQ ID NO: 628701 - DNA, 25 bp, Rattus norvegicus
cattcgccgtgaacgggctctccta

SEQ ID NO: 628702 - DNA, 25 bp, Rattus norvegicus
gcccaggcgtggagacttcattcac

SEQ ID NO: 628703 - DNA, 25 bp, Rattus norvegicus
agcggtccaagttgggctccatctc

SEQ ID NO: 628704 - DNA, 25 bp, Rattus norvegicus
ggacttctatccctaggcctggttc

SEQ ID NO: 628705 - DNA, 25 bp, Rattus norvegicus
cacagttccctatccagggctgggg

SEQ ID NO: 628706 - DNA, 25 bp, Rattus norvegicus
cctgtggtgatctctgtttaccgga

SEQ ID NO: 628707 - DNA, 25 bp, Rattus norvegicus
ctgtttaccggagagagcggtccaa

SEQ ID NO: 628708 - DNA, 25 bp, Rattus norvegicus
ggagaaaattcagccgaacccactc

SEQ ID NO: 628709 - DNA, 25 bp, Rattus norvegicus
ctggatctcagggacgtcagctccc

SEQ ID NO: 628710 - DNA, 25 bp, Rattus norvegicus
tgccctggctagctgctccgcagaa

SEQ ID NO: 628711 - DNA, 25 bp, Rattus norvegicus
acacagaggctcctaggacgagcca

SEQ ID NO: 628712 - DNA, 25 bp, Rattus norvegicus
atcgcccttcacacacctagaatag

SEQ ID NO: 628713 - DNA, 25 bp, Rattus norvegicus
cctaggacgagccatctgtgctgca

SEQ ID NO: 628714 - DNA, 25 bp, Rattus norvegicus
acgagccatctgtgctgcaaggccc

SEQ ID NO: 628715 - DNA, 25 bp, Rattus norvegicus
cccattaaagctcgcagcgccggag

SEQ ID NO: 628716 - DNA, 25 bp, Rattus norvegicus
ctcgcagcgccggagattgcggtaa

SEQ ID NO: 628717 - DNA, 25 bp, Rattus norvegicus
taagtgggtagacagagcctggtat

SEQ ID NO: 628718 - DNA, 25 bp, Rattus norvegicus
agagcctggtatgctcccgactcaa

SEQ ID NO: 628719 - DNA, 25 bp, Rattus norvegicus
ggtatgctcccgactcaagcgtgca

SEQ ID NO: 628720 - DNA, 25 bp, Rattus norvegicus
aagcgtgcacccacgcatgcttacg

SEQ ID NO: 628721 - DNA, 25 bp, Rattus norvegicus
cgcatgcttacgtcgcctgcatctg

SEQ ID NO: 628722 - DNA, 25 bp, Rattus norvegicus
ttacgtcgcctgcatctggtgcgtc

SEQ ID NO: 628723 - DNA, 25 bp, Rattus norvegicus
cacacctagaatagctcttcgagcc

SEQ ID NO: 628724 - DNA, 25 bp, Rattus norvegicus
aatagctcttcgagcctggagcgcg

SEQ ID NO: 628725 - DNA, 25 bp, Rattus norvegicus
cgcgccgccattggctcgcggagaa

SEQ ID NO: 628726 - DNA, 25 bp, Rattus norvegicus
ccagcgtgtgatggcgttggacaca

SEQ ID NO: 628727 - DNA, 25 bp, Rattus norvegicus
atggtgtccggtgctccggcaccca

SEQ ID NO: 628728 - DNA, 25 bp, Rattus norvegicus
aagccatccgggcttgaggctgggc

SEQ ID NO: 628729 - DNA, 25 bp, Rattus norvegicus
tggctcgcggagaagccgctctaat

SEQ ID NO: 628730 - DNA, 25 bp, Rattus norvegicus
cacactcgccgagctcgggaacagg

SEQ ID NO: 628731 - DNA, 25 bp, Rattus norvegicus
aggagcgcgcaggaaccacactcgc

SEQ ID NO: 628732 - DNA, 25 bp, Rattus norvegicus
attaggagcgcgcaggaaccacact

SEQ ID NO: 628733 - DNA, 25 bp, Rattus norvegicus
atcctgcgcgtacccctacatgaga

SEQ ID NO: 628734 - DNA, 25 bp, Rattus norvegicus
gagggtcatcgcaccaaaccgcaaa

SEQ ID NO: 628735 - DNA, 25 bp, Rattus norvegicus
tagaggagagggtcatcgcaccaaa

SEQ ID NO: 628736 - DNA, 25 bp, Rattus norvegicus
tccgtgcacacacaggtagaggaga

SEQ ID NO: 628737 - DNA, 25 bp, Rattus norvegicus
gcgtatccgtgcacacacaggtaga

SEQ ID NO: 628738 - DNA, 25 bp, Rattus norvegicus
tgcgctccgcggagtctctgacctt

SEQ ID NO: 628739 - DNA, 25 bp, Rattus norvegicus
cagcattgcccggttgccatagaaa

SEQ ID NO: 628740 - DNA, 25 bp, Rattus norvegicus
acgtctgtgcgcagcattgcccggt

SEQ ID NO: 628741 - DNA, 25 bp, Rattus norvegicus
tccgacaaacccgtgcgggtagcga

SEQ ID NO: 628742 - DNA, 25 bp, Rattus norvegicus
gtgcgggtagcgaaaattcaccaga

SEQ ID NO: 628743 - DNA, 25 bp, Rattus norvegicus
tcaccgcggtgtggtgcagaaagag

SEQ ID NO: 628744 - DNA, 25 bp, Rattus norvegicus
tgccgtccacccagagaggacgtct

SEQ ID NO: 628745 - DNA, 25 bp, Rattus norvegicus
ttgcccggttgccatagaaacgagc

SEQ ID NO: 628746 - DNA, 25 bp, Rattus norvegicus
cccggttgccatagaaacgagcagc

SEQ ID NO: 628747 - DNA, 25 bp, Rattus norvegicus
ttgccatagaaacgagcagcgggcg

SEQ ID NO: 628748 - DNA, 25 bp, Rattus norvegicus
tcctgcagttcgggcgctgtcgcct

SEQ ID NO: 628749 - DNA, 25 bp, Rattus norvegicus
ctgtcgcctcccgagccagagcgcg

SEQ ID NO: 628750 - DNA, 25 bp, Rattus norvegicus
ggaccgagtcccgagtcggacacca

SEQ ID NO: 628751 - DNA, 25 bp, Rattus norvegicus
gacaccaggcgcctcctcatcctgc

SEQ ID NO: 628752 - DNA, 25 bp, Rattus norvegicus
cacccagagaggacgtctgtgcgca

SEQ ID NO: 628753 - DNA, 25 bp, Rattus norvegicus
ggcttgtgcttctgtggcgaccaga

SEQ ID NO: 628754 - DNA, 25 bp, Rattus norvegicus
gcgactctctccacagtcacgtggg

SEQ ID NO: 628755 - DNA, 25 bp, Rattus norvegicus
cacgtgggcgacagcaaacactcca

SEQ ID NO: 628756 - DNA, 25 bp, Rattus norvegicus
cctgagctcccagagcaggcgtgaa

SEQ ID NO: 628757 - DNA, 25 bp, Rattus norvegicus
gctcccagagcaggcgtgaaagccc

SEQ ID NO: 628758 - DNA, 25 bp, Rattus norvegicus
tccgccacagcgcatgcgggtccgc

SEQ ID NO: 628759 - DNA, 25 bp, Rattus norvegicus
ggacgaaccgcgtgaccggccacag

SEQ ID NO: 628760 - DNA, 25 bp, Rattus norvegicus
tgaccggccacagcgcatgcgggtc

SEQ ID NO: 628761 - DNA, 25 bp, Rattus norvegicus
actagagctggatggatggctgcac

SEQ ID NO: 628762 - DNA, 25 bp, Rattus norvegicus
gcagcgcggcgcaagtggctgtcta

SEQ ID NO: 628763 - DNA, 25 bp, Rattus norvegicus
ttctgtggcgaccagagtccacttg

SEQ ID NO: 628764 - DNA, 25 bp, Rattus norvegicus
ggcgaccagagtccacttgcttctg

SEQ ID NO: 628765 - DNA, 25 bp, Rattus norvegicus
atggctgcaccggaccaatggtccg

SEQ ID NO: 628766 - DNA, 25 bp, Rattus norvegicus
ccacagtcacgtgggcgacagcaaa

SEQ ID NO: 628767 - DNA, 25 bp, Rattus norvegicus
cgccagctcatcgagaaaggtgccc

SEQ ID NO: 628768 - DNA, 25 bp, Rattus norvegicus
atcgacgatgggcaccgcttgtgca

SEQ ID NO: 628769 - DNA, 25 bp, Rattus norvegicus
cttttcgcggcagcgaggaggcttc

SEQ ID NO: 628770 - DNA, 25 bp, Rattus norvegicus
atgggcggagttctggaatctcgca

SEQ ID NO: 628771 - DNA, 25 bp, Rattus norvegicus
gagttctggaatctcgcaaggtgga

SEQ ID NO: 628772 - DNA, 25 bp, Rattus norvegicus
tccgacgccaggtggggaactacaa

SEQ ID NO: 628773 - DNA, 25 bp, Rattus norvegicus
gtgaagcgcatcgacgatgggcacc

SEQ ID NO: 628774 - DNA, 25 bp, Rattus norvegicus
gcaccgcttgtgcaacgacctcatg

SEQ ID NO: 628775 - DNA, 25 bp, Rattus norvegicus
acgacctcatgagctgcgtgcagga

SEQ ID NO: 628776 - DNA, 25 bp, Rattus norvegicus
agcgcgccaagatcgagaaggcata

SEQ ID NO: 628777 - DNA, 25 bp, Rattus norvegicus
tcgagaaggcatacgcgcagcagct

SEQ ID NO: 628778 - DNA, 25 bp, Rattus norvegicus
atacgcgcagcagctcaccgactgg

SEQ ID NO: 628779 - DNA, 25 bp, Rattus norvegicus
aagcgctggcgccagctcatcgaga

SEQ ID NO: 628780 - DNA, 25 bp, Rattus norvegicus
agctcaccgactgggccaagcgctg

SEQ ID NO: 628781 - DNA, 25 bp, Rattus norvegicus
tagccgctggaactcggagatgagc

SEQ ID NO: 628782 - DNA, 25 bp, Rattus norvegicus
cccaggcagctgaacttctgcatga

SEQ ID NO: 628783 - DNA, 25 bp, Rattus norvegicus
gttgagctgaaagccgagtagccgc

SEQ ID NO: 628784 - DNA, 25 bp, Rattus norvegicus
gggcccggacgcacatctttcaccg

SEQ ID NO: 628785 - DNA, 25 bp, Rattus norvegicus
aacttctgcatgagctcggggtcta

SEQ ID NO: 628786 - DNA, 25 bp, Rattus norvegicus
gagcacgtccttgtctgtggtgccc

SEQ ID NO: 628787 - DNA, 25 bp, Rattus norvegicus
ctcggagatgagcacgtccttgtct

SEQ ID NO: 628788 - DNA, 25 bp, Rattus norvegicus
ctgaaagccgagtagccgctggaac

SEQ ID NO: 628789 - DNA, 25 bp, Rattus norvegicus
accagttggtcatgtccaggaagaa

SEQ ID NO: 628790 - DNA, 25 bp, Rattus norvegicus
ggcaggctcaccagttggtcatgtc

SEQ ID NO: 628791 - DNA, 25 bp, Rattus norvegicus
ctccgcgtggggcaggctcaccagt

SEQ ID NO: 628792 - DNA, 25 bp, Rattus norvegicus
aagccgctgccagcagggctggctc

SEQ ID NO: 628793 - DNA, 25 bp, Rattus norvegicus
ccgtgaagccgctgccagcagggct

SEQ ID NO: 628794 - DNA, 25 bp, Rattus norvegicus
gggtctaggtccacgtccatgccct

SEQ ID NO: 628795 - DNA, 25 bp, Rattus norvegicus
caaagggcaccgcagagcgggctct

SEQ ID NO: 628796 - DNA, 25 bp, Rattus norvegicus
ctttagtgacgtcataactcggtga

SEQ ID NO: 628797 - DNA, 25 bp, Rattus norvegicus
tcataactcggtgacgtatctcgcg

SEQ ID NO: 628798 - DNA, 25 bp, Rattus norvegicus
cggtgacgtatctcgcgtgacctca

SEQ ID NO: 628799 - DNA, 25 bp, Rattus norvegicus
tgacctcaccgcgactgagaggagg

SEQ ID NO: 628800 - DNA, 25 bp, Rattus norvegicus
tgtcctcgcgggagtctccacgctg

SEQ ID NO: 628801 - DNA, 25 bp, Rattus norvegicus
ctccacgctgcgtgggaggagtcac

SEQ ID NO: 628802 - DNA, 25 bp, Rattus norvegicus
ccctcttcggattgggaaccagaag

SEQ ID NO: 628803 - DNA, 25 bp, Rattus norvegicus
ggaaccagaagtcgcctcggggaca

SEQ ID NO: 628804 - DNA, 25 bp, Rattus norvegicus
cggggacagagacccgtccaggtca

SEQ ID NO: 628805 - DNA, 25 bp, Rattus norvegicus
gaggaccaattcaaacgacactttc

SEQ ID NO: 628806 - DNA, 25 bp, Rattus norvegicus
ctccgctctcagaggaccaattcaa

SEQ ID NO: 628807 - DNA, 25 bp, Rattus norvegicus
aaagcccgcctttagtgacgtcata

SEQ ID NO: 628808 - DNA, 25 bp, Rattus norvegicus
cgtccaggtcaaagtgcaaagggca

SEQ ID NO: 628809 - DNA, 25 bp, Rattus norvegicus
gcgcagcctgtgtgcgtcagttcct

SEQ ID NO: 628810 - DNA, 25 bp, Rattus norvegicus
acttacggtgatccgtcggggcctg

SEQ ID NO: 628811 - DNA, 25 bp, Rattus norvegicus
tttggcggacttacggtgatccgtc

SEQ ID NO: 628812 - DNA, 25 bp, Rattus norvegicus
aacatgcccaagtgagtgtgccctg

SEQ ID NO: 628813 - DNA, 25 bp, Rattus norvegicus
acggcctgtggagcaacatgcccaa

SEQ ID NO: 628814 - DNA, 25 bp, Rattus norvegicus
accgggatagccaacggcctgtgga

SEQ ID NO: 628815 - DNA, 25 bp, Rattus norvegicus
ccgtcctcagtaaagaccggaagca

SEQ ID NO: 628816 - DNA, 25 bp, Rattus norvegicus
gtttgcatccctgcgtcggcgcagc

SEQ ID NO: 628817 - DNA, 25 bp, Rattus norvegicus
agtcctattcttcgcgtttgcatcc

SEQ ID NO: 628818 - DNA, 25 bp, Rattus norvegicus
gaccggaagcagaagtcctattctt

SEQ ID NO: 628819 - DNA, 25 bp, Rattus norvegicus
ttccgagagggaataaccaatcacg

SEQ ID NO: 628820 - DNA, 25 bp, Rattus norvegicus
ccaatcacgagtaagtgagcgcggg

SEQ ID NO: 628821 - DNA, 25 bp, Rattus norvegicus
gttgaacctccgaggcacccatagc

SEQ ID NO: 628822 - DNA, 25 bp, Rattus norvegicus
acttcctggccgtcctcagtaaaga

SEQ ID NO: 628823 - DNA, 25 bp, Rattus norvegicus
gaggacgcctctttaccacaactga

SEQ ID NO: 628824 - DNA, 25 bp, Rattus norvegicus
cagcgccgcttcctttctggctttg

SEQ ID NO: 628825 - DNA, 25 bp, Rattus norvegicus
gtatctcatagacccgcacggaacc

SEQ ID NO: 628826 - DNA, 25 bp, Rattus norvegicus
agccctttcctgtccgtatctcata

SEQ ID NO: 628827 - DNA, 25 bp, Rattus norvegicus
tctagcgggccgttgtcagcgctgc

SEQ ID NO: 628828 - DNA, 25 bp, Rattus norvegicus
gcgattcaactctagcgggccgttg

SEQ ID NO: 628829 - DNA, 25 bp, Rattus norvegicus
ccgggcagtcgcgattcaactctag

SEQ ID NO: 628830 - DNA, 25 bp, Rattus norvegicus
gcatctgtcccggtgagagcgccac

SEQ ID NO: 628831 - DNA, 25 bp, Rattus norvegicus
gatcttgaagcatctgtcccggtga

SEQ ID NO: 628832 - DNA, 25 bp, Rattus norvegicus
ccgggatcattaagaagcagatctt

SEQ ID NO: 628833 - DNA, 25 bp, Rattus norvegicus
ctttctggctttgccacccggtgct

SEQ ID NO: 628834 - DNA, 25 bp, Rattus norvegicus
cggctacagcatggccgggatcatt

SEQ ID NO: 628835 - DNA, 25 bp, Rattus norvegicus
cacccggtgctggattacccaggtc

SEQ ID NO: 628836 - DNA, 25 bp, Rattus norvegicus
cacaactgaggaggccaggacaacc

SEQ ID NO: 628837 - DNA, 25 bp, Rattus norvegicus
ggtcagaggcgatgacagtaccact

SEQ ID NO: 628838 - DNA, 25 bp, Rattus norvegicus
ctgcggcttctttcgagtccgcgtc

SEQ ID NO: 628839 - DNA, 25 bp, Rattus norvegicus
agtccgcgtctccaacctggtcggt

SEQ ID NO: 628840 - DNA, 25 bp, Rattus norvegicus
tgaaagagcgtacattcgtttaccg

SEQ ID NO: 628841 - DNA, 25 bp, Rattus norvegicus
cccaaggttgtccatcgcgatagaa

SEQ ID NO: 628842 - DNA, 25 bp, Rattus norvegicus
gagtgagggtcagcaatctgtgccc

SEQ ID NO: 628843 - DNA, 25 bp, Rattus norvegicus
cccagagctggtgcttaaggctttg

SEQ ID NO: 628844 - DNA, 25 bp, Rattus norvegicus
taaggctttgacgtcgcgccgcgat

SEQ ID NO: 628845 - DNA, 25 bp, Rattus norvegicus
ggggtcattttcagaagcgcgttca

SEQ ID NO: 628846 - DNA, 25 bp, Rattus norvegicus
aagcgcgttcatggctcaggggctt

SEQ ID NO: 628847 - DNA, 25 bp, Rattus norvegicus
aggggcttcacgtaaactgactttg

SEQ ID NO: 628848 - DNA, 25 bp, Rattus norvegicus
atgtattagtatagagcctcggctt

SEQ ID NO: 628849 - DNA, 25 bp, Rattus norvegicus
cctcggctttagagaagaagcgttt

SEQ ID NO: 628850 - DNA, 25 bp, Rattus norvegicus
attccctcagtgtcggcggacaccg

SEQ ID NO: 628851 - DNA, 25 bp, Rattus norvegicus
tagcaggtcggttaaaacgtgctcc

SEQ ID NO: 628852 - DNA, 25 bp, Rattus norvegicus
ggttaaaacgtgctccgcagacgga

SEQ ID NO: 628853 - DNA, 25 bp, Rattus norvegicus
tccagaatggatgcggctgtgtgtt

SEQ ID NO: 628854 - DNA, 25 bp, Rattus norvegicus
tctctccagaatggatgcggctgtg

SEQ ID NO: 628855 - DNA, 25 bp, Rattus norvegicus
cacacttgtacggtttctctccaga

SEQ ID NO: 628856 - DNA, 25 bp, Rattus norvegicus
gcgagccacaggtctcacacttgta

SEQ ID NO: 628857 - DNA, 25 bp, Rattus norvegicus
ttacctgaacaaaacgcgagccaca

SEQ ID NO: 628858 - DNA, 25 bp, Rattus norvegicus
cacttgcggtctagaccgctcctta

SEQ ID NO: 628859 - DNA, 25 bp, Rattus norvegicus
cagagccttgagatcgcctcgggga

SEQ ID NO: 628860 - DNA, 25 bp, Rattus norvegicus
tgtgctacctgaggggcagagcctt

SEQ ID NO: 628861 - DNA, 25 bp, Rattus norvegicus
acgtgtgcgcgtaggtgtgctacct

SEQ ID NO: 628862 - DNA, 25 bp, Rattus norvegicus
tctccagtgtggatgagcacgtgtg

SEQ ID NO: 628863 - DNA, 25 bp, Rattus norvegicus
tgggacacggatagggcttctctcc

SEQ ID NO: 628864 - DNA, 25 bp, Rattus norvegicus
ctagaccgctccttacctgaacaaa

SEQ ID NO: 628865 - DNA, 25 bp, Rattus norvegicus
agccacttcagagcagaccgaattc

SEQ ID NO: 628866 - DNA, 25 bp, Rattus norvegicus
ggtgccagctgtcgcttctcacaaa

SEQ ID NO: 628867 - DNA, 25 bp, Rattus norvegicus
accctgggtcacctgcaaggcggcg

SEQ ID NO: 628868 - DNA, 25 bp, Rattus norvegicus
cgtgacgccggatcccggaagtgac

SEQ ID NO: 628869 - DNA, 25 bp, Rattus norvegicus
agacggaaagtttaggagcctgagc

SEQ ID NO: 628870 - DNA, 25 bp, Rattus norvegicus
acctcccggccgtggagaagctgct

SEQ ID NO: 628871 - DNA, 25 bp, Rattus norvegicus
ggaagcggctctcctccggcttcgg

SEQ ID NO: 628872 - DNA, 25 bp, Rattus norvegicus
gcagaccgaattcgcggaatccctc

SEQ ID NO: 628873 - DNA, 25 bp, Rattus norvegicus
ggaatccctctcacatcctgcagga

SEQ ID NO: 628874 - DNA, 25 bp, Rattus norvegicus
gcacattctcgtttccttctcttag

SEQ ID NO: 628875 - DNA, 25 bp, Rattus norvegicus
aggaaccttccacccgggctgtgca

SEQ ID NO: 628876 - DNA, 25 bp, Rattus norvegicus
ggctgtgcagaacccggcttttgtt

SEQ ID NO: 628877 - DNA, 25 bp, Rattus norvegicus
taaaattgcttctgcgttgatcgcg

SEQ ID NO: 628878 - DNA, 25 bp, Rattus norvegicus
tctctccagtctgctgaggtgagtg

SEQ ID NO: 628879 - DNA, 25 bp, Rattus norvegicus
atcccacgggccaggtggtgtctga

SEQ ID NO: 628880 - DNA, 25 bp, Rattus norvegicus
gcgctctcgtttgccttccagacgg

SEQ ID NO: 628881 - DNA, 25 bp, Rattus norvegicus
ggcagtgctttgcatgaagctgctt

SEQ ID NO: 628882 - DNA, 25 bp, Rattus norvegicus
tgaagctgctttgttcggcaagacc

SEQ ID NO: 628883 - DNA, 25 bp, Rattus norvegicus
cggcaagaccgatgtggtgcaaatc

SEQ ID NO: 628884 - DNA, 25 bp, Rattus norvegicus
atgtggtgcaaatcctgctggctgc

SEQ ID NO: 628885 - DNA, 25 bp, Rattus norvegicus
gtgaggctggcagcgctgatcccac

SEQ ID NO: 628886 - DNA, 25 bp, Rattus norvegicus
cccgactgttgacagccggccgtga

SEQ ID NO: 628887 - DNA, 25 bp, Rattus norvegicus
tggtgtctgagacccgcgcacgcac

SEQ ID NO: 628888 - DNA, 25 bp, Rattus norvegicus
tgagacccgcgcacgcacgtgtgcg

SEQ ID NO: 628889 - DNA, 25 bp, Rattus norvegicus
cgggacacccgactgttgacagccg

SEQ ID NO: 628890 - DNA, 25 bp, Rattus norvegicus
aaatcctgctggctgcaggtgaggc

SEQ ID NO: 628891 - DNA, 25 bp, Rattus norvegicus
ttccagacggagatgggcagtgctt

SEQ ID NO: 628892 - DNA, 25 bp, Rattus norvegicus
cagccggccgtgagtgaagaatgct

SEQ ID NO: 628893 - DNA, 25 bp, Rattus norvegicus
tgtccagcgcttcctcgatctcgtt

SEQ ID NO: 628894 - DNA, 25 bp, Rattus norvegicus
tgttgaggatgtacttggacaggta

SEQ ID NO: 628895 - DNA, 25 bp, Rattus norvegicus
gcaagaccatcatgttgaggatgta

SEQ ID NO: 628896 - DNA, 25 bp, Rattus norvegicus
cggcgcacacagcaagaccatcatg

SEQ ID NO: 628897 - DNA, 25 bp, Rattus norvegicus
ggagacgttcaagtcgccacggtca

SEQ ID NO: 628898 - DNA, 25 bp, Rattus norvegicus
tcagcttgctgatggaggaactcca

SEQ ID NO: 628899 - DNA, 25 bp, Rattus norvegicus
ttcctcgatctcgttcctcaggcgg

SEQ ID NO: 628900 - DNA, 25 bp, Rattus norvegicus
cgggatccgaaatgttttcaagtct

SEQ ID NO: 628901 - DNA, 25 bp, Rattus norvegicus
gatctcgttcctcaggcggctctgc

SEQ ID NO: 628902 - DNA, 25 bp, Rattus norvegicus
cagcagcagggacagcaggatctgc

SEQ ID NO: 628903 - DNA, 25 bp, Rattus norvegicus
tggacaggtaggagacgttcaagtc

SEQ ID NO: 628904 - DNA, 25 bp, Rattus norvegicus
ttcaagtctctgcacagcttcgtcg

SEQ ID NO: 628905 - DNA, 25 bp, Rattus norvegicus
tctgcacagcttcgtcgcggaccgg

SEQ ID NO: 628906 - DNA, 25 bp, Rattus norvegicus
caagtcgccacggtcagcttgctga

SEQ ID NO: 628907 - DNA, 25 bp, Rattus norvegicus
cgcaggaaatccatggcaacgcttg

SEQ ID NO: 628908 - DNA, 25 bp, Rattus norvegicus
catggcaacgcttgcgcgggagcat

SEQ ID NO: 628909 - DNA, 25 bp, Rattus norvegicus
cttgcgcgggagcatttgaaccgag

SEQ ID NO: 628910 - DNA, 25 bp, Rattus norvegicus
gggtggtccagacctgcagtccccg

SEQ ID NO: 628911 - DNA, 25 bp, Rattus norvegicus
acttggggaccctgcctcaagcaga

SEQ ID NO: 628912 - DNA, 25 bp, Rattus norvegicus
tgcctcaagcagatacctagcctgt

SEQ ID NO: 628913 - DNA, 25 bp, Rattus norvegicus
aagcagatacctagcctgtgcgaga

SEQ ID NO: 628914 - DNA, 25 bp, Rattus norvegicus
atacctagcctgtgcgagatcgggg

SEQ ID NO: 628915 - DNA, 25 bp, Rattus norvegicus
cccacgcgtgaccgaggggagcttc

SEQ ID NO: 628916 - DNA, 25 bp, Rattus norvegicus
caccgggaggtcaagccggtccgca

SEQ ID NO: 628917 - DNA, 25 bp, Rattus norvegicus
ccgcagtcctccgtggcccacggga

SEQ ID NO: 628918 - DNA, 25 bp, Rattus norvegicus
ctcgagcgacggttgaacctacgcg

SEQ ID NO: 628919 - DNA, 25 bp, Rattus norvegicus
cggttgaacctacgcgatcggtgcc

SEQ ID NO: 628920 - DNA, 25 bp, Rattus norvegicus
gagcatcgcaggaaatccatggcaa

SEQ ID NO: 628921 - DNA, 25 bp, Rattus norvegicus
cctcccattgcctgagccgggccca

SEQ ID NO: 628922 - DNA, 25 bp, Rattus norvegicus
gcctgaggcgatttctgggactcct

SEQ ID NO: 628923 - DNA, 25 bp, Rattus norvegicus
tctccctctgtgctccgggcacttc

SEQ ID NO: 628924 - DNA, 25 bp, Rattus norvegicus
actgccacacgactgccaatgtggc

SEQ ID NO: 628925 - DNA, 25 bp, Rattus norvegicus
acactgccacacgactgccaatgtg

SEQ ID NO: 628926 - DNA, 25 bp, Rattus norvegicus
cttcttgcccgagcccacactgcca

SEQ ID NO: 628927 - DNA, 25 bp, Rattus norvegicus
aaccgcttcttcctgggcgagctgt

SEQ ID NO: 628928 - DNA, 25 bp, Rattus norvegicus
tgaaccgcttcttcctgggcgagct

SEQ ID NO: 628929 - DNA, 25 bp, Rattus norvegicus
cgggcccagaatgaaccgcttcttc

SEQ ID NO: 628930 - DNA, 25 bp, Rattus norvegicus
agccgggcccagaatgaaccgcttc

SEQ ID NO: 628931 - DNA, 25 bp, Rattus norvegicus
gcccgcggccctcccattgcctgag

SEQ ID NO: 628932 - DNA, 25 bp, Rattus norvegicus
gggcgagcctcggttctccgccctc

SEQ ID NO: 628933 - DNA, 25 bp, Rattus norvegicus
ctgaggcgatttctgggactcctgg

SEQ ID NO: 628934 - DNA, 25 bp, Rattus norvegicus
gaatgaaccgcttcttcctgggcga

SEQ ID NO: 628935 - DNA, 25 bp, Rattus norvegicus
ctcagggcaagactgagacggggcg

SEQ ID NO: 628936 - DNA, 25 bp, Rattus norvegicus
tataagacccaccacgaaccacctg

SEQ ID NO: 628937 - DNA, 25 bp, Rattus norvegicus
gacccaccacgaaccacctgccgct

SEQ ID NO: 628938 - DNA, 25 bp, Rattus norvegicus
acctgccgctactcagggcaagact

SEQ ID NO: 628939 - DNA, 25 bp, Rattus norvegicus
cctgccgctactcagggcaagactg

SEQ ID NO: 628940 - DNA, 25 bp, Rattus norvegicus
ctgccgctactcagggcaagactga

SEQ ID NO: 628941 - DNA, 25 bp, Rattus norvegicus
tgccgctactcagggcaagactgag

SEQ ID NO: 628942 - DNA, 25 bp, Rattus norvegicus
cgctactcagggcaagactgagacg

SEQ ID NO: 628943 - DNA, 25 bp, Rattus norvegicus
gcaagactgagacggggcggagacg

SEQ ID NO: 628944 - DNA, 25 bp, Rattus norvegicus
ctactcagggcaagactgagacggg

SEQ ID NO: 628945 - DNA, 25 bp, Rattus norvegicus
tctccagtataagacccaccacgaa

SEQ ID NO: 628946 - DNA, 25 bp, Rattus norvegicus
atgcgcctctccagtataagaccca

SEQ ID NO: 628947 - DNA, 25 bp, Rattus norvegicus
gctactcagggcaagactgagacgg

SEQ ID NO: 628948 - DNA, 25 bp, Rattus norvegicus
tccagtataagacccaccacgaacc

SEQ ID NO: 628949 - DNA, 25 bp, Rattus norvegicus
gtggtgtgggctcaaccacctagga

SEQ ID NO: 628950 - DNA, 25 bp, Rattus norvegicus
aacacggggcacatgcgcctctcca

SEQ ID NO: 628951 - DNA, 25 bp, Rattus norvegicus
cttaggtgtcctggcaacacggggc

SEQ ID NO: 628952 - DNA, 25 bp, Rattus norvegicus
cgcttaggtgtcctggcaacacggg

SEQ ID NO: 628953 - DNA, 25 bp, Rattus norvegicus
accgcttaggtgtcctggcaacacg

SEQ ID NO: 628954 - DNA, 25 bp, Rattus norvegicus
aaaccgcttaggtgtcctggcaaca

SEQ ID NO: 628955 - DNA, 25 bp, Rattus norvegicus
aacaaaccgcttaggtgtcctggca

SEQ ID NO: 628956 - DNA, 25 bp, Rattus norvegicus
ttgcaaaacaaaccgcttaggtgtc

SEQ ID NO: 628957 - DNA, 25 bp, Rattus norvegicus
cccaccctgtgaccggggcaggagt

SEQ ID NO: 628958 - DNA, 25 bp, Rattus norvegicus
tcgatgctgtcacacactccacacc

SEQ ID NO: 628959 - DNA, 25 bp, Rattus norvegicus
cccacgtcgatgctgtcacacactc

SEQ ID NO: 628960 - DNA, 25 bp, Rattus norvegicus
ctcaaccacctaggaggacggagcg

SEQ ID NO: 628961 - DNA, 25 bp, Rattus norvegicus
gtgtgggctcaaccacctaggagga

SEQ ID NO: 628962 - DNA, 25 bp, Rattus norvegicus
tgggctcaaccacctaggaggacgg

SEQ ID NO: 628963 - DNA, 25 bp, Rattus norvegicus
gcggacccgtcaaaagtggcttgtg

SEQ ID NO: 628964 - DNA, 25 bp, Rattus norvegicus
aaaatgcgtcatctcccgctcgcga

SEQ ID NO: 628965 - DNA, 25 bp, Rattus norvegicus
ggctgcagaaaaatgcgtcatctcc

SEQ ID NO: 628966 - DNA, 25 bp, Rattus norvegicus
cttgtggctgcagaaaaatgcgtca

SEQ ID NO: 628967 - DNA, 25 bp, Rattus norvegicus
caaaagtggcttgtggctgcagaaa

SEQ ID NO: 628968 - DNA, 25 bp, Rattus norvegicus
cccgtcaaaagtggcttgtggctgc

SEQ ID NO: 628969 - DNA, 25 bp, Rattus norvegicus
ccgcaaaaatcttccaaataagata

SEQ ID NO: 628970 - DNA, 25 bp, Rattus norvegicus
acgaggtttccgttgctccccgatg

SEQ ID NO: 628971 - DNA, 25 bp, Rattus norvegicus
ttatagacaaaagccgtgctgggtg

SEQ ID NO: 628972 - DNA, 25 bp, Rattus norvegicus
catgcgttatagacaaaagccgtgc

SEQ ID NO: 628973 - DNA, 25 bp, Rattus norvegicus
ccaaataagataaacatgcgttata

SEQ ID NO: 628974 - DNA, 25 bp, Rattus norvegicus
cctcagggcagtatgcgctggagaa

SEQ ID NO: 628975 - DNA, 25 bp, Rattus norvegicus
tgcgctggagaacccgcaaaaatct

SEQ ID NO: 628976 - DNA, 25 bp, Rattus norvegicus
ctggagaacccgcaaaaatcttcca

SEQ ID NO: 628977 - DNA, 25 bp, Rattus norvegicus
gtgcagagactttcgccgctcggcc

SEQ ID NO: 628978 - DNA, 25 bp, Rattus norvegicus
gaggacgttacttggcccggaatgc

SEQ ID NO: 628979 - DNA, 25 bp, Rattus norvegicus
ttacttggcccggaatgcgagccca

SEQ ID NO: 628980 - DNA, 25 bp, Rattus norvegicus
cccggaatgcgagcccatctcagtt

SEQ ID NO: 628981 - DNA, 25 bp, Rattus norvegicus
tgcgagcccatctcagttccgaggt

SEQ ID NO: 628982 - DNA, 25 bp, Rattus norvegicus
catctcagttccgaggtgcagccct

SEQ ID NO: 628983 - DNA, 25 bp, Rattus norvegicus
acacctcgcgccctctttgtctccc

SEQ ID NO: 628984 - DNA, 25 bp, Rattus norvegicus
tgcgcgtgcagagactttcgccgct

SEQ ID NO: 628985 - DNA, 25 bp, Rattus norvegicus
tgtaaattcctgcaggcagcggccc

SEQ ID NO: 628986 - DNA, 25 bp, Rattus norvegicus
cccagcgccggattgtaaattcctg

SEQ ID NO: 628987 - DNA, 25 bp, Rattus norvegicus
tgctcccggggaagccgtctccatg

SEQ ID NO: 628988 - DNA, 25 bp, Rattus norvegicus
tgattgtgcgcggtctgcgcctgac

SEQ ID NO: 628989 - DNA, 25 bp, Rattus norvegicus
ggggcttgcattgatccattgattg

SEQ ID NO: 628990 - DNA, 25 bp, Rattus norvegicus
gatccattgattgtgcgcggtctgc

SEQ ID NO: 628991 - DNA, 25 bp, Rattus norvegicus
accgcgatccggctacaggcagagg

SEQ ID NO: 628992 - DNA, 25 bp, Rattus norvegicus
aagcgctgcatgttttgtgtgaaga

SEQ ID NO: 628993 - DNA, 25 bp, Rattus norvegicus
atccagaccgcgatccggctacagg

SEQ ID NO: 628994 - DNA, 25 bp, Rattus norvegicus
ccgcgaaggaaagcgctgcatgttt

SEQ ID NO: 628995 - DNA, 25 bp, Rattus norvegicus
catgttttgtgtgaagactgccagc

SEQ ID NO: 628996 - DNA, 25 bp, Rattus norvegicus
ttttgtgtgaagactgccagccgca

SEQ ID NO: 628997 - DNA, 25 bp, Rattus norvegicus
actgccagccgcacgtacgagatga

SEQ ID NO: 628998 - DNA, 25 bp, Rattus norvegicus
gcacgtacgagatgagcgcctcaga

SEQ ID NO: 628999 - DNA, 25 bp, Rattus norvegicus
cgagatgagcgcctcagacacgcgc

SEQ ID NO: 629000 - DNA, 25 bp, Rattus norvegicus
agtacgggcctgagtctagctggcc

SEQ ID NO: 629001 - DNA, 25 bp, Rattus norvegicus
tctagctggccctgggtcgtttcac

SEQ ID NO: 629002 - DNA, 25 bp, Rattus norvegicus
gccctgggtcgtttcacccgagtga

SEQ ID NO: 629003 - DNA, 25 bp, Rattus norvegicus
tttcacccgagtgacccttggagcc

SEQ ID NO: 629004 - DNA, 25 bp, Rattus norvegicus
tgggtccgggctgactccgtcccac

SEQ ID NO: 629005 - DNA, 25 bp, Rattus norvegicus
ggctgcaggaagctttgcaactgga

SEQ ID NO: 629006 - DNA, 25 bp, Rattus norvegicus
aacctttcctgccagcgccaacgcg

SEQ ID NO: 629007 - DNA, 25 bp, Rattus norvegicus
caggtaggcacggtagccaagggaa

SEQ ID NO: 629008 - DNA, 25 bp, Rattus norvegicus
gtgcgcctcgcccagaccaggtagg

SEQ ID NO: 629009 - DNA, 25 bp, Rattus norvegicus
atgaggaggccgtgcgcctcgccca

SEQ ID NO: 629010 - DNA, 25 bp, Rattus norvegicus
tggaggtgaaagctaggcgagatga

SEQ ID NO: 629011 - DNA, 25 bp, Rattus norvegicus
gagcggctgcaggaagctttgcaac

SEQ ID NO: 629012 - DNA, 25 bp, Rattus norvegicus
aggaagctttgcaactggaggtgaa

SEQ ID NO: 629013 - DNA, 25 bp, Rattus norvegicus
ccgggcctctatgcaggctgagatg

SEQ ID NO: 629014 - DNA, 25 bp, Rattus norvegicus
cccggcaacggcagcgcatcgcgga

SEQ ID NO: 629015 - DNA, 25 bp, Rattus norvegicus
tctatgcaggctgagatggagctga

SEQ ID NO: 629016 - DNA, 25 bp, Rattus norvegicus
acaggcccgggcctctatgcaggct

SEQ ID NO: 629017 - DNA, 25 bp, Rattus norvegicus
gcatcccactgaccggctcggcgct

SEQ ID NO: 629018 - DNA, 25 bp, Rattus norvegicus
gagctgaagaaggaagaggcggccc

SEQ ID NO: 629019 - DNA, 25 bp, Rattus norvegicus
accacacggtgtggaccctcagtca

SEQ ID NO: 629020 - DNA, 25 bp, Rattus norvegicus
atcttgatgtgctccaggcccactg

SEQ ID NO: 629021 - DNA, 25 bp, Rattus norvegicus
atctgcttcagctccggaaccgtcg

SEQ ID NO: 629022 - DNA, 25 bp, Rattus norvegicus
aagcgcattgcttcctcccgactga

SEQ ID NO: 629023 - DNA, 25 bp, Rattus norvegicus
ggctcctcaccagtactgagaaacg

SEQ ID NO: 629024 - DNA, 25 bp, Rattus norvegicus
ggtccactgggtgtcccaagcgatc

SEQ ID NO: 629025 - DNA, 25 bp, Rattus norvegicus
atctgcatctgcaaggtaagcctgg

SEQ ID NO: 629026 - DNA, 25 bp, Rattus norvegicus
ggaaagcccagcagcccatcgaagc

SEQ ID NO: 629027 - DNA, 25 bp, Rattus norvegicus
ggttcaagccatcctccagtgacca

SEQ ID NO: 629028 - DNA, 25 bp, Rattus norvegicus
gagtgcacagcgctgatctccacag

SEQ ID NO: 629029 - DNA, 25 bp, Rattus norvegicus
cctcagtcaggtgtgaactcaggta

SEQ ID NO: 629030 - DNA, 25 bp, Rattus norvegicus
ccgtgcgtacaggtgtgccaccaca

SEQ ID NO: 629031 - DNA, 25 bp, Rattus norvegicus
ggaaccgtcgtggtcgacatcttga

SEQ ID NO: 629032 - DNA, 25 bp, Rattus norvegicus
ctcaggtagtcagcttcagtaaggc

SEQ ID NO: 629033 - DNA, 25 bp, Rattus norvegicus
tccaagctcggcctgcgcgcagagg

SEQ ID NO: 629034 - DNA, 25 bp, Rattus norvegicus
gcggagctggggattaatgggaaaa

SEQ ID NO: 629035 - DNA, 25 bp, Rattus norvegicus
cgatggcaatcaagggagtcgctcc

SEQ ID NO: 629036 - DNA, 25 bp, Rattus norvegicus
ggcaatcaagggagtcgctccagga

SEQ ID NO: 629037 - DNA, 25 bp, Rattus norvegicus
caatcaagggagtcgctccaggagg

SEQ ID NO: 629038 - DNA, 25 bp, Rattus norvegicus
aggcgcggcgattggatgctccccc

SEQ ID NO: 629039 - DNA, 25 bp, Rattus norvegicus
ttgggagcgtgtgacgccgcaggcc

SEQ ID NO: 629040 - DNA, 25 bp, Rattus norvegicus
agttttgacaggagctaggggattc

SEQ ID NO: 629041 - DNA, 25 bp, Rattus norvegicus
tttgacaggagctaggggattctgc

SEQ ID NO: 629042 - DNA, 25 bp, Rattus norvegicus
agctaggggattctgcggagcgtgc

SEQ ID NO: 629043 - DNA, 25 bp, Rattus norvegicus
agaggcggctggaacaggtccgttc

SEQ ID NO: 629044 - DNA, 25 bp, Rattus norvegicus
tccgagagccgcgttccgcgcggct

SEQ ID NO: 629045 - DNA, 25 bp, Rattus norvegicus
cggcctgcgcgcagaggcgacaccc

SEQ ID NO: 629046 - DNA, 25 bp, Rattus norvegicus
cgcggctgcggctcgtccaagctcg

SEQ ID NO: 629047 - DNA, 25 bp, Rattus norvegicus
tccttgattccgcagggcttcttcc

SEQ ID NO: 629048 - DNA, 25 bp, Rattus norvegicus
agtgcgatcggatctgcaagatcca

SEQ ID NO: 629049 - DNA, 25 bp, Rattus norvegicus
ggacaatccgcatgaagctcaagta

SEQ ID NO: 629050 - DNA, 25 bp, Rattus norvegicus
tgcacttgctgtcgatgatcgcttc

SEQ ID NO: 629051 - DNA, 25 bp, Rattus norvegicus
cacagatgagtgtgtgcacttgctg

SEQ ID NO: 629052 - DNA, 25 bp, Rattus norvegicus
cagcacctgcgcctggcacagatga

SEQ ID NO: 629053 - DNA, 25 bp, Rattus norvegicus
cccgctatcagagggagggcaccca

SEQ ID NO: 629054 - DNA, 25 bp, Rattus norvegicus
tcccacaacggtgagggcgcctgcg

SEQ ID NO: 629055 - DNA, 25 bp, Rattus norvegicus
ctcggcatgtcccacaacggtgagg

SEQ ID NO: 629056 - DNA, 25 bp, Rattus norvegicus
agtgtcagtactgccgcttccagaa

SEQ ID NO: 629057 - DNA, 25 bp, Rattus norvegicus
tccagaagaagaaccgcaacaagtg

SEQ ID NO: 629058 - DNA, 25 bp, Rattus norvegicus
agctcaagtacgagaagtgcgatcg

SEQ ID NO: 629059 - DNA, 25 bp, Rattus norvegicus
gcagggcttcttccgccggacaatc

SEQ ID NO: 629060 - DNA, 25 bp, Rattus norvegicus
gaaccgcaacaagtgtcagtactgc

SEQ ID NO: 629061 - DNA, 25 bp, Rattus norvegicus
ctctccgctggcgaggccagtgtcg

SEQ ID NO: 629062 - DNA, 25 bp, Rattus norvegicus
ccagatggccgcctggaactgtgag

SEQ ID NO: 629063 - DNA, 25 bp, Rattus norvegicus
tttcctgaacgctctcttacaggtc

SEQ ID NO: 629064 - DNA, 25 bp, Rattus norvegicus
cttgggatagcttcctggaggcgct

SEQ ID NO: 629065 - DNA, 25 bp, Rattus norvegicus
gcgctgagcacttcccttgggatag

SEQ ID NO: 629066 - DNA, 25 bp, Rattus norvegicus
tgccaggtttcttttcgcgggctga

SEQ ID NO: 629067 - DNA, 25 bp, Rattus norvegicus
cctcgttgccaggtttcttttcgcg

SEQ ID NO: 629068 - DNA, 25 bp, Rattus norvegicus
gactctactctaggtttgcgggtta

SEQ ID NO: 629069 - DNA, 25 bp, Rattus norvegicus
cccttcggactctactctaggtttg

SEQ ID NO: 629070 - DNA, 25 bp, Rattus norvegicus
tgctcgggtcccttcccgatgatca

SEQ ID NO: 629071 - DNA, 25 bp, Rattus norvegicus
tagttgctcgggtcccttcccgatg

SEQ ID NO: 629072 - DNA, 25 bp, Rattus norvegicus
cttacaggtctggttagttgctcgg

SEQ ID NO: 629073 - DNA, 25 bp, Rattus norvegicus
gaacgctctcttacaggtctggtta

SEQ ID NO: 629074 - DNA, 25 bp, Rattus norvegicus
acttcccttgggatagcttcctgga

SEQ ID NO: 629075 - DNA, 25 bp, Rattus norvegicus
agaagccaggctagtgtcgcacaga

SEQ ID NO: 629076 - DNA, 25 bp, Rattus norvegicus
cgcgagccttttcccggcatgctgt

SEQ ID NO: 629077 - DNA, 25 bp, Rattus norvegicus
agccggcggaacgagccattctcgc

SEQ ID NO: 629078 - DNA, 25 bp, Rattus norvegicus
cattctcgcgagagcacgagctcta

SEQ ID NO: 629079 - DNA, 25 bp, Rattus norvegicus
agctctatttgagcgcctgcgcgaa

SEQ ID NO: 629080 - DNA, 25 bp, Rattus norvegicus
cgcagccatgaggtaggtagttatt

SEQ ID NO: 629081 - DNA, 25 bp, Rattus norvegicus
cggctacccgtgtcgcgagcctttt

SEQ ID NO: 629082 - DNA, 25 bp, Rattus norvegicus
caccgtcaggttggcaccgctctga

SEQ ID NO: 629083 - DNA, 25 bp, Rattus norvegicus
agccctcagtgtcccggtgtggcct

SEQ ID NO: 629084 - DNA, 25 bp, Rattus norvegicus
ggacactgacgtgccagggtagttc

SEQ ID NO: 629085 - DNA, 25 bp, Rattus norvegicus
tcctgctacgggcaggctctctgga

SEQ ID NO: 629086 - DNA, 25 bp, Rattus norvegicus
tgtcgcacagacctccgggtaaggc

SEQ ID NO: 629087 - DNA, 25 bp, Rattus norvegicus
acacagcagcgcttctccgctttgg

SEQ ID NO: 629088 - DNA, 25 bp, Rattus norvegicus
ccagggtagttcaggagtcctgcta

SEQ ID NO: 629089 - DNA, 25 bp, Rattus norvegicus
gcaggcctgtttgcgaggtgcagtt

SEQ ID NO: 629090 - DNA, 25 bp, Rattus norvegicus
caggatgatcttgcgccggccacaa

SEQ ID NO: 629091 - DNA, 25 bp, Rattus norvegicus
tccgacaggatgatcttgcgccggc

SEQ ID NO: 629092 - DNA, 25 bp, Rattus norvegicus
gccctcatccgacaggatgatcttg

SEQ ID NO: 629093 - DNA, 25 bp, Rattus norvegicus
atcttgccctcatccgacaggatga

SEQ ID NO: 629094 - DNA, 25 bp, Rattus norvegicus
caatcgcacttaccgtacatcttgc

SEQ ID NO: 629095 - DNA, 25 bp, Rattus norvegicus
tgccaatcgcacttaccgtacatct

SEQ ID NO: 629096 - DNA, 25 bp, Rattus norvegicus
tctgccaatcgcacttaccgtacat

SEQ ID NO: 629097 - DNA, 25 bp, Rattus norvegicus
ccggtctggcaagggacagaaagca

SEQ ID NO: 629098 - DNA, 25 bp, Rattus norvegicus
cccagacacacgcagcccaagcctg

SEQ ID NO: 629099 - DNA, 25 bp, Rattus norvegicus
tgcagttggaggaggccccagacac

SEQ ID NO: 629100 - DNA, 25 bp, Rattus norvegicus
atgatcttgcgccggccacaaggcg

SEQ ID NO: 629101 - DNA, 25 bp, Rattus norvegicus
cccgccgggcaagccgccagggctc

SEQ ID NO: 629102 - DNA, 25 bp, Rattus norvegicus
aaccttcagccggcagggctaggga

SEQ ID NO: 629103 - DNA, 25 bp, Rattus norvegicus
tcccgcgagcttctctgtggtgcgc

SEQ ID NO: 629104 - DNA, 25 bp, Rattus norvegicus
tcaagccacagaggcaggatcctgg

SEQ ID NO: 629105 - DNA, 25 bp, Rattus norvegicus
ctcaagccacagaggcaggatcctg

SEQ ID NO: 629106 - DNA, 25 bp, Rattus norvegicus
ggcgcagtttgactcacccctcaag

SEQ ID NO: 629107 - DNA, 25 bp, Rattus norvegicus
aaggcggggcgcagtttgactcacc

SEQ ID NO: 629108 - DNA, 25 bp, Rattus norvegicus
tgtagcctcacgtcgctgggaaggc

SEQ ID NO: 629109 - DNA, 25 bp, Rattus norvegicus
tatgtagcctcacgtcgctgggaag

SEQ ID NO: 629110 - DNA, 25 bp, Rattus norvegicus
gttatgtagcctcacgtcgctggga

SEQ ID NO: 629111 - DNA, 25 bp, Rattus norvegicus
gagttatgtagcctcacgtcgctgg

SEQ ID NO: 629112 - DNA, 25 bp, Rattus norvegicus
cgggagttatgtagcctcacgtcgc

SEQ ID NO: 629113 - DNA, 25 bp, Rattus norvegicus
cgcgggagttatgtagcctcacgtc

SEQ ID NO: 629114 - DNA, 25 bp, Rattus norvegicus
tgcgcgcgggagttatgtagcctca

SEQ ID NO: 629115 - DNA, 25 bp, Rattus norvegicus
ccgcgagcttctctgtggtgcgcgc

SEQ ID NO: 629116 - DNA, 25 bp, Rattus norvegicus
gctcccgcgagcttctctgtggtgc

SEQ ID NO: 629117 - DNA, 25 bp, Rattus norvegicus
tgctcggacccggtttgtctggttc

SEQ ID NO: 629118 - DNA, 25 bp, Rattus norvegicus
cccgagtggcttgtttctcgaattt

SEQ ID NO: 629119 - DNA, 25 bp, Rattus norvegicus
tccctaatgccggagagtcgggtgc

SEQ ID NO: 629120 - DNA, 25 bp, Rattus norvegicus
gcgcaggcacctgagtctacacaca

SEQ ID NO: 629121 - DNA, 25 bp, Rattus norvegicus
ccaagaacgcccgtcgcggtggatt

SEQ ID NO: 629122 - DNA, 25 bp, Rattus norvegicus
tgagtctacacacacgaatccagga

SEQ ID NO: 629123 - DNA, 25 bp, Rattus norvegicus
ctgcgctctggacgaggttccatag

SEQ ID NO: 629124 - DNA, 25 bp, Rattus norvegicus
ttctactcgggtgcccggcagccga

SEQ ID NO: 629125 - DNA, 25 bp, Rattus norvegicus
aatcttgagtgatcaggcctggggc

SEQ ID NO: 629126 - DNA, 25 bp, Rattus norvegicus
acttctcgctcgtcatctcagagtc

SEQ ID NO: 629127 - DNA, 25 bp, Rattus norvegicus
atggccggaatgtacggaatgagcc

SEQ ID NO: 629128 - DNA, 25 bp, Rattus norvegicus
gggcttacctgctccgagctccggg

SEQ ID NO: 629129 - DNA, 25 bp, Rattus norvegicus
cgagcagtcacctctgcgcgcgagg

SEQ ID NO: 629130 - DNA, 25 bp, Rattus norvegicus
taggtacgcctctgaatcttgagtg

SEQ ID NO: 629131 - DNA, 25 bp, Rattus norvegicus
cggcgaggcgctccgttatccgcga

SEQ ID NO: 629132 - DNA, 25 bp, Rattus norvegicus
ttatccgcgaggctcgcagggctcc

SEQ ID NO: 629133 - DNA, 25 bp, Rattus norvegicus
gcagggctccggaaggccaagtttc

SEQ ID NO: 629134 - DNA, 25 bp, Rattus norvegicus
gctgcgcgggaaacaaaagccgcgc

SEQ ID NO: 629135 - DNA, 25 bp, Rattus norvegicus
tggcagcgcccgcaagccggctagt

SEQ ID NO: 629136 - DNA, 25 bp, Rattus norvegicus
accgctccgccggtcctgattggtg

SEQ ID NO: 629137 - DNA, 25 bp, Rattus norvegicus
cggtcctgattggtggccgcgcact

SEQ ID NO: 629138 - DNA, 25 bp, Rattus norvegicus
tggccgcgcactgtctatgcaaatg

SEQ ID NO: 629139 - DNA, 25 bp, Rattus norvegicus
tgtctatgcaaatgagcctccgccc

SEQ ID NO: 629140 - DNA, 25 bp, Rattus norvegicus
ggatggaggaagctgactgatacct

SEQ ID NO: 629141 - DNA, 25 bp, Rattus norvegicus
gctgactgatacctcttctcgtttg

SEQ ID NO: 629142 - DNA, 25 bp, Rattus norvegicus
gatacctcttctcgtttgcctccag

SEQ ID NO: 629143 - DNA, 25 bp, Rattus norvegicus
cagaatacggaccagacaagcgcct

SEQ ID NO: 629144 - DNA, 25 bp, Rattus norvegicus
cgtttgcctccagacagaatacgga

SEQ ID NO: 629145 - DNA, 25 bp, Rattus norvegicus
cacggttgggtacgaggcctcctcg

SEQ ID NO: 629146 - DNA, 25 bp, Rattus norvegicus
tgcagcctgcggtcagcagccggct

SEQ ID NO: 629147 - DNA, 25 bp, Rattus norvegicus
cacgggaggctgcgccacagcgcaa

SEQ ID NO: 629148 - DNA, 25 bp, Rattus norvegicus
ctccacacggttgggtacgaggcct

SEQ ID NO: 629149 - DNA, 25 bp, Rattus norvegicus
ggcgctgcaagacctccacacggtt

SEQ ID NO: 629150 - DNA, 25 bp, Rattus norvegicus
cagcctgactcagcagctgggtaag

SEQ ID NO: 629151 - DNA, 25 bp, Rattus norvegicus
agcgagaacagcctgactcagcagc

SEQ ID NO: 629152 - DNA, 25 bp, Rattus norvegicus
agcgcgagcgagaacagcctgactc

SEQ ID NO: 629153 - DNA, 25 bp, Rattus norvegicus
ggaacacaatgtcccgggcgagagc

SEQ ID NO: 629154 - DNA, 25 bp, Rattus norvegicus
ggctggaacacaatgtcccgggcga

SEQ ID NO: 629155 - DNA, 25 bp, Rattus norvegicus
cgctggggctggaacacaatgtccc

SEQ ID NO: 629156 - DNA, 25 bp, Rattus norvegicus
aagccgcgagcacaaacagggcgag

SEQ ID NO: 629157 - DNA, 25 bp, Rattus norvegicus
agcgcaagccgcgagcacaaacagg

SEQ ID NO: 629158 - DNA, 25 bp, Rattus norvegicus
tgcaagacctccacacggttgggta

SEQ ID NO: 629159 - DNA, 25 bp, Rattus norvegicus
aaagggttaagcaaggtgccagcgc

SEQ ID NO: 629160 - DNA, 25 bp, Rattus norvegicus
tttagcctaagatcgcgagagagcg

SEQ ID NO: 629161 - DNA, 25 bp, Rattus norvegicus
cgggaaccttccctggcgatctagg

SEQ ID NO: 629162 - DNA, 25 bp, Rattus norvegicus
gcttgctcttggcaatttagcctaa

SEQ ID NO: 629163 - DNA, 25 bp, Rattus norvegicus
tctggagactgcaggtttgggtccc

SEQ ID NO: 629164 - DNA, 25 bp, Rattus norvegicus
cctccaccctcgacgctgtccggga

SEQ ID NO: 629165 - DNA, 25 bp, Rattus norvegicus
tgcgcctacgcaggctctccagact

SEQ ID NO: 629166 - DNA, 25 bp, Rattus norvegicus
gggacccgagcgaaagaacatcctg

SEQ ID NO: 629167 - DNA, 25 bp, Rattus norvegicus
aaagaacatcctgtgccgccgccgg

SEQ ID NO: 629168 - DNA, 25 bp, Rattus norvegicus
gcgcttcttacggcttctcctggtc

SEQ ID NO: 629169 - DNA, 25 bp, Rattus norvegicus
acgccttcgcgggtcatgagctggc

SEQ ID NO: 629170 - DNA, 25 bp, Rattus norvegicus
gcacacaggtctgcgcccacgagag

SEQ ID NO: 629171 - DNA, 25 bp, Rattus norvegicus
cgcgttgcgcttgctcttggcaatt

SEQ ID NO: 629172 - DNA, 25 bp, Rattus norvegicus
ctgcgcccacgagagagcgcgcgtt

SEQ ID NO: 629173 - DNA, 25 bp, Rattus norvegicus
agcagcgtgacgtcagtgaggatcc

SEQ ID NO: 629174 - DNA, 25 bp, Rattus norvegicus
ctcttaggggttgcccgccaaccag

SEQ ID NO: 629175 - DNA, 25 bp, Rattus norvegicus
cgcgcaggcgcaactcattcagatt

SEQ ID NO: 629176 - DNA, 25 bp, Rattus norvegicus
cattcagattgctaagcacgtcgga

SEQ ID NO: 629177 - DNA, 25 bp, Rattus norvegicus
tgaactctcggacgtagcccagagc

SEQ ID NO: 629178 - DNA, 25 bp, Rattus norvegicus
tgtggaacccatagcgacccaggcc

SEQ ID NO: 629179 - DNA, 25 bp, Rattus norvegicus
ctgcgccagctactgaaaaagttag

SEQ ID NO: 629180 - DNA, 25 bp, Rattus norvegicus
aacgccattagatagcgggcccagc

SEQ ID NO: 629181 - DNA, 25 bp, Rattus norvegicus
gttcattctgccctcaacggtcgct

SEQ ID NO: 629182 - DNA, 25 bp, Rattus norvegicus
ttccctttgctagatcgcagagctc

SEQ ID NO: 629183 - DNA, 25 bp, Rattus norvegicus
cgcagagctcttggagcaagttaga

SEQ ID NO: 629184 - DNA, 25 bp, Rattus norvegicus
aattctcctacctccgcctgaaggg

SEQ ID NO: 629185 - DNA, 25 bp, Rattus norvegicus
gagcgtgaggaatcccgcactcccg

SEQ ID NO: 629186 - DNA, 25 bp, Rattus norvegicus
ccctcttctctgctgttttattcct

SEQ ID NO: 629187 - DNA, 25 bp, Rattus norvegicus
tgctgaaacgcgttcggtagagccg

SEQ ID NO: 629188 - DNA, 25 bp, Rattus norvegicus
aaacgcgttcggtagagccggccag

SEQ ID NO: 629189 - DNA, 25 bp, Rattus norvegicus
gaaggaacgtggcacgcggccccac

SEQ ID NO: 629190 - DNA, 25 bp, Rattus norvegicus
cccaccctctggaaggaagagaagg

SEQ ID NO: 629191 - DNA, 25 bp, Rattus norvegicus
gagaaggtgcgggtcccagatccct

SEQ ID NO: 629192 - DNA, 25 bp, Rattus norvegicus
agaaggtgcgggtcccagatccctt

SEQ ID NO: 629193 - DNA, 25 bp, Rattus norvegicus
gaaggtgcgggtcccagatcccttc

SEQ ID NO: 629194 - DNA, 25 bp, Rattus norvegicus
ccaccgctcccggtatatccctgcg

SEQ ID NO: 629195 - DNA, 25 bp, Rattus norvegicus
gctcccggtatatccctgcggccta

SEQ ID NO: 629196 - DNA, 25 bp, Rattus norvegicus
ccggtatatccctgcggcctacggc

SEQ ID NO: 629197 - DNA, 25 bp, Rattus norvegicus
ccgcggtgctgaaacgcgttcggta

SEQ ID NO: 629198 - DNA, 25 bp, Rattus norvegicus
gtgctgaaacgcgttcggtagagcc

SEQ ID NO: 629199 - DNA, 25 bp, Rattus norvegicus
gaaacgcgttcggtagagccggcca

SEQ ID NO: 629200 - DNA, 25 bp, Rattus norvegicus
ctgaaacgcgttcggtagagccggc

SEQ ID NO: 629201 - DNA, 25 bp, Rattus norvegicus
taatcaggcgcgaaggaagactgcc

SEQ ID NO: 629202 - DNA, 25 bp, Rattus norvegicus
tggggtacaagactcacttcctttg

SEQ ID NO: 629203 - DNA, 25 bp, Rattus norvegicus
cttcctttgggctttgtccttcttg

SEQ ID NO: 629204 - DNA, 25 bp, Rattus norvegicus
atcacacagcgactcagaagccatg

SEQ ID NO: 629205 - DNA, 25 bp, Rattus norvegicus
tggttcccggagagcgaatcacaca

SEQ ID NO: 629206 - DNA, 25 bp, Rattus norvegicus
gtaatgattaccagctccggccgcc

SEQ ID NO: 629207 - DNA, 25 bp, Rattus norvegicus
ggagttcacaggcaggtaatgatta

SEQ ID NO: 629208 - DNA, 25 bp, Rattus norvegicus
acagacgtaggaggcaaggttaaga

SEQ ID NO: 629209 - DNA, 25 bp, Rattus norvegicus
gaagcggcccgaacccagtgcgctt

SEQ ID NO: 629210 - DNA, 25 bp, Rattus norvegicus
ctctacccaggcaaacgtgtggttg

SEQ ID NO: 629211 - DNA, 25 bp, Rattus norvegicus
ccgcgcctcgaagacttaggaagta

SEQ ID NO: 629212 - DNA, 25 bp, Rattus norvegicus
tgcacaacccaaccgagaggacagc

SEQ ID NO: 629213 - DNA, 25 bp, Rattus norvegicus
accggtagtgcacaacgcagccagc

SEQ ID NO: 629214 - DNA, 25 bp, Rattus norvegicus
acaatttcctgatggcagagcgtgc

SEQ ID NO: 629215 - DNA, 25 bp, Rattus norvegicus
cctgcgtagtagacccggagcctac

SEQ ID NO: 629216 - DNA, 25 bp, Rattus norvegicus
tagtagacccggagcctaccacctg

SEQ ID NO: 629217 - DNA, 25 bp, Rattus norvegicus
gcgtcgcgcgcctgcgtagtagacc

SEQ ID NO: 629218 - DNA, 25 bp, Rattus norvegicus
agccacgccctgcacggcgtcgcgc

SEQ ID NO: 629219 - DNA, 25 bp, Rattus norvegicus
aatcccagctctccctcaccgcgcg

SEQ ID NO: 629220 - DNA, 25 bp, Rattus norvegicus
gagtgacgccgactcgggctcccgc

SEQ ID NO: 629221 - DNA, 25 bp, Rattus norvegicus
gcactcgagtgacgccgactcgggc

SEQ ID NO: 629222 - DNA, 25 bp, Rattus norvegicus
tgcgcactcgagtgacgccgactcg

SEQ ID NO: 629223 - DNA, 25 bp, Rattus norvegicus
gagaccggtaaccgccaggcgcctg

SEQ ID NO: 629224 - DNA, 25 bp, Rattus norvegicus
atggcgagaccggtaaccgccaggc

SEQ ID NO: 629225 - DNA, 25 bp, Rattus norvegicus
gctccatggcgagaccggtaaccgc

SEQ ID NO: 629226 - DNA, 25 bp, Rattus norvegicus
tttccgctccatggcgagaccggta

SEQ ID NO: 629227 - DNA, 25 bp, Rattus norvegicus
cccgcggggtctcctcgtggcggag

SEQ ID NO: 629228 - DNA, 25 bp, Rattus norvegicus
cctaccacctgcttcggggagtgcg

SEQ ID NO: 629229 - DNA, 25 bp, Rattus norvegicus
gcacgagaataggagttcccggtcc

SEQ ID NO: 629230 - DNA, 25 bp, Rattus norvegicus
cggcaggcagggctcacctggtttc

SEQ ID NO: 629231 - DNA, 25 bp, Rattus norvegicus
cagacgctggggacagactcggctc

SEQ ID NO: 629232 - DNA, 25 bp, Rattus norvegicus
gcagggctcacctggtttccggtga

SEQ ID NO: 629233 - DNA, 25 bp, Rattus norvegicus
acagactcggctccagcctggctgg

SEQ ID NO: 629234 - DNA, 25 bp, Rattus norvegicus
agaataggagttcccggtcctcctg

SEQ ID NO: 629235 - DNA, 25 bp, Rattus norvegicus
aacaggcacgagaataggagttccc

SEQ ID NO: 629236 - DNA, 25 bp, Rattus norvegicus
tcttccagaaacaggcacgagaata

SEQ ID NO: 629237 - DNA, 25 bp, Rattus norvegicus
ctccacagacctgggccgggaccct

SEQ ID NO: 629238 - DNA, 25 bp, Rattus norvegicus
ggggtctctggctgccctccacaga

SEQ ID NO: 629239 - DNA, 25 bp, Rattus norvegicus
agaaggggtctctggctgccctcca

SEQ ID NO: 629240 - DNA, 25 bp, Rattus norvegicus
gttgctgcagaacccgccggcgttc

SEQ ID NO: 629241 - DNA, 25 bp, Rattus norvegicus
agttcccgagccgttgctgcagaac

SEQ ID NO: 629242 - DNA, 25 bp, Rattus norvegicus
ctcacctggtttccggtgaccggca

SEQ ID NO: 629243 - DNA, 25 bp, Rattus norvegicus
ctgcatgcctgagcgccaggcctgt

SEQ ID NO: 629244 - DNA, 25 bp, Rattus norvegicus
atgctcgcaagatcgttcctcccgg

SEQ ID NO: 629245 - DNA, 25 bp, Rattus norvegicus
gggtaccgccacttggcacgcagga

SEQ ID NO: 629246 - DNA, 25 bp, Rattus norvegicus
tccatattgggtaagatctcggctc

SEQ ID NO: 629247 - DNA, 25 bp, Rattus norvegicus
agaggcccacgttctaccggcagga

SEQ ID NO: 629248 - DNA, 25 bp, Rattus norvegicus
aagatctcggctcgcggagctgttc

SEQ ID NO: 629249 - DNA, 25 bp, Rattus norvegicus
ctaccggcaggagctgaacaagacc

SEQ ID NO: 629250 - DNA, 25 bp, Rattus norvegicus
aacaagaccgtctgggaggtgcccg

SEQ ID NO: 629251 - DNA, 25 bp, Rattus norvegicus
tcgcgagagtcctgctagagcctcc

SEQ ID NO: 629252 - DNA, 25 bp, Rattus norvegicus
ccacgggcaggttccatattgggta

SEQ ID NO: 629253 - DNA, 25 bp, Rattus norvegicus
tgcgcccagcggcaggaattctcct

SEQ ID NO: 629254 - DNA, 25 bp, Rattus norvegicus
ctcgccctgcacactcaggtgggtg

SEQ ID NO: 629255 - DNA, 25 bp, Rattus norvegicus
ctgtgctctccatgctcgcaagatc

SEQ ID NO: 629256 - DNA, 25 bp, Rattus norvegicus
gtgcccgagcgataccagaacctgt

SEQ ID NO: 629257 - DNA, 25 bp, Rattus norvegicus
cccacactctgcgtccgggatgggg

SEQ ID NO: 629258 - DNA, 25 bp, Rattus norvegicus
gtgctctcctattggctagacccga

SEQ ID NO: 629259 - DNA, 25 bp, Rattus norvegicus
tcccgcacccgccatcttgtttctc

SEQ ID NO: 629260 - DNA, 25 bp, Rattus norvegicus
gtgacgcgcgagctctcccctggag

SEQ ID NO: 629261 - DNA, 25 bp, Rattus norvegicus
caaggagctgctcgctggtccggcc

SEQ ID NO: 629262 - DNA, 25 bp, Rattus norvegicus
cgcgcaaggagctgctcgctggtcc

SEQ ID NO: 629263 - DNA, 25 bp, Rattus norvegicus
gcgctttcgcgctcccgcttcgcgt

SEQ ID NO: 629264 - DNA, 25 bp, Rattus norvegicus
ccgagcagagttccgccctcaaggg

SEQ ID NO: 629265 - DNA, 25 bp, Rattus norvegicus
gtgggaaccccgactagatcagctc

SEQ ID NO: 629266 - DNA, 25 bp, Rattus norvegicus
gggaatagctctgcggattcagagt

SEQ ID NO: 629267 - DNA, 25 bp, Rattus norvegicus
cggttccacctcaggggtgagtgtc

SEQ ID NO: 629268 - DNA, 25 bp, Rattus norvegicus
tggctagacccgagcagagttccgc

SEQ ID NO: 629269 - DNA, 25 bp, Rattus norvegicus
tagctctgcggattcagagtgggaa

SEQ ID NO: 629270 - DNA, 25 bp, Rattus norvegicus
ctcctattggctagacccgagcaga

SEQ ID NO: 629271 - DNA, 25 bp, Rattus norvegicus
agcctccggaagatctggacgcaga

SEQ ID NO: 629272 - DNA, 25 bp, Rattus norvegicus
gggagaccttgacctacgcccaagc

SEQ ID NO: 629273 - DNA, 25 bp, Rattus norvegicus
tggaagtcgatatggacggccgcct

SEQ ID NO: 629274 - DNA, 25 bp, Rattus norvegicus
gtcactgatcgacgaggacgccttc

SEQ ID NO: 629275 - DNA, 25 bp, Rattus norvegicus
ccggcttgagaaggagtcgtacctg

SEQ ID NO: 629276 - DNA, 25 bp, Rattus norvegicus
tggcctggctcgacatggtcaatga

SEQ ID NO: 629277 - DNA, 25 bp, Rattus norvegicus
cgctgcttactaccgctacatcgag

SEQ ID NO: 629278 - DNA, 25 bp, Rattus norvegicus
gcccagctttcgagtggtggacaca

SEQ ID NO: 629279 - DNA, 25 bp, Rattus norvegicus
gaaggagtcctgttccaagcatgca

SEQ ID NO: 629280 - DNA, 25 bp, Rattus norvegicus
tgacggctcaggatatcaccgaatg

SEQ ID NO: 629281 - DNA, 25 bp, Rattus norvegicus
atcaccgaggatgagctgacggctc

SEQ ID NO: 629282 - DNA, 25 bp, Rattus norvegicus
gcctgcaccgtatcagcatttatga

SEQ ID NO: 629283 - DNA, 25 bp, Rattus norvegicus
tgacccgcttaagatcatcaccgag

SEQ ID NO: 629284 - DNA, 25 bp, Rattus norvegicus
tggtcaatgagaagcgccgagcaga

SEQ ID NO: 629285 - DNA, 25 bp, Rattus norvegicus
ctcttgttttgaagggccgcgtgac

SEQ ID NO: 629286 - DNA, 25 bp, Rattus norvegicus
gcaagcgaccaggtcgcgcattaca

SEQ ID NO: 629287 - DNA, 25 bp, Rattus norvegicus
accaggtcgcgcattacagggccgc

SEQ ID NO: 629288 - DNA, 25 bp, Rattus norvegicus
ggcgtgcacgcaaccttcccggcgt

SEQ ID NO: 629289 - DNA, 25 bp, Rattus norvegicus
ttggtcgcgcttgaccccgaagctc

SEQ ID NO: 629290 - DNA, 25 bp, Rattus norvegicus
agggccgcgtgactcagccacctat

SEQ ID NO: 629291 - DNA, 25 bp, Rattus norvegicus
gcgtgactcagccacctatccgggg

SEQ ID NO: 629292 - DNA, 25 bp, Rattus norvegicus
tctggggctcggcaactgacagcgc

SEQ ID NO: 629293 - DNA, 25 bp, Rattus norvegicus
tcctcccgggccagaggagaaagga

SEQ ID NO: 629294 - DNA, 25 bp, Rattus norvegicus
gaaccttctgtcgagtctgtcgccc

SEQ ID NO: 629295 - DNA, 25 bp, Rattus norvegicus
ctggaaccttctgtcgagtctgtcg

SEQ ID NO: 629296 - DNA, 25 bp, Rattus norvegicus
cccgaagctctggaaccttctgtcg

SEQ ID NO: 629297 - DNA, 25 bp, Rattus norvegicus
aagctcggcgagcgggccaaccgac

SEQ ID NO: 629298 - DNA, 25 bp, Rattus norvegicus
tcccgccaacccagtaggcgaggcc

SEQ ID NO: 629299 - DNA, 25 bp, Rattus norvegicus
tgcacagatgcggacggacgagaca

SEQ ID NO: 629300 - DNA, 25 bp, Rattus norvegicus
ctcgaatcccaaggtgcagagcagc

SEQ ID NO: 629301 - DNA, 25 bp, Rattus norvegicus
tcccaaggtgcagagcagcgctgac

SEQ ID NO: 629302 - DNA, 25 bp, Rattus norvegicus
gagcagcgctgaccgaggtcccaga

SEQ ID NO: 629303 - DNA, 25 bp, Rattus norvegicus
ggcacacaaagctggcgacaaggga

SEQ ID NO: 629304 - DNA, 25 bp, Rattus norvegicus
tctggggactacagagagaacgctg

SEQ ID NO: 629305 - DNA, 25 bp, Rattus norvegicus
acagagagaacgctgacaggagccc

SEQ ID NO: 629306 - DNA, 25 bp, Rattus norvegicus
gacgggagaggacaacaggaagaac

SEQ ID NO: 629307 - DNA, 25 bp, Rattus norvegicus
cccaactgccggaaaagacggcagc

SEQ ID NO: 629308 - DNA, 25 bp, Rattus norvegicus
gttaccccctcagactgtggagaga

SEQ ID NO: 629309 - DNA, 25 bp, Rattus norvegicus
gttgcggccgacactgcgcatgcgc

SEQ ID NO: 629310 - DNA, 25 bp, Rattus norvegicus
cctcacccggctgcgcctagcccag

SEQ ID NO: 629311 - DNA, 25 bp, Rattus norvegicus
gtcgggttctcgaatcccaaggtgc

SEQ ID NO: 629312 - DNA, 25 bp, Rattus norvegicus
ggcgacggccgcgagacactcacca

SEQ ID NO: 629313 - DNA, 25 bp, Rattus norvegicus
tagtctggtctcacgtacccggcag

SEQ ID NO: 629314 - DNA, 25 bp, Rattus norvegicus
gtcgcttcatttccggctggcttca

SEQ ID NO: 629315 - DNA, 25 bp, Rattus norvegicus
gctggcttcattccacttccgtcga

SEQ ID NO: 629316 - DNA, 25 bp, Rattus norvegicus
gctgattggctgagacacgacctct

SEQ ID NO: 629317 - DNA, 25 bp, Rattus norvegicus
gaaaccacggagagcccggcagccg

SEQ ID NO: 629318 - DNA, 25 bp, Rattus norvegicus
caccacgcgagctggaaaccacgga

SEQ ID NO: 629319 - DNA, 25 bp, Rattus norvegicus
aaccttggtggacgctgacgtcatg

SEQ ID NO: 629320 - DNA, 25 bp, Rattus norvegicus
cagtccgcgagggaggtcgaacctt

SEQ ID NO: 629321 - DNA, 25 bp, Rattus norvegicus
ccggccgcggaaaagatctctccaa

SEQ ID NO: 629322 - DNA, 25 bp, Rattus norvegicus
tctgctctcggcgtccaagtcttag

SEQ ID NO: 629323 - DNA, 25 bp, Rattus norvegicus
cccggcaggggaagagtccgatact

SEQ ID NO: 629324 - DNA, 25 bp, Rattus norvegicus
ccaagtcttagtctggtctcacgta

SEQ ID NO: 629325 - DNA, 25 bp, Rattus norvegicus
aggtggaagacgtcgcttcatttcc

SEQ ID NO: 629326 - DNA, 25 bp, Rattus norvegicus
gtccgatactggatgcagctgcatc

SEQ ID NO: 629327 - DNA, 25 bp, Rattus norvegicus
accgcggtttctcgcagcgtttgta

SEQ ID NO: 629328 - DNA, 25 bp, Rattus norvegicus
tacggcctcacgaagtcgcatttgc

SEQ ID NO: 629329 - DNA, 25 bp, Rattus norvegicus
ttgggctaactttgcaggctctaca

SEQ ID NO: 629330 - DNA, 25 bp, Rattus norvegicus
gactcttaggctcgttggtctgcga

SEQ ID NO: 629331 - DNA, 25 bp, Rattus norvegicus
cgtttcactctgatccgagcctagg

SEQ ID NO: 629332 - DNA, 25 bp, Rattus norvegicus
caaggcccgcgcagctttatacagc

SEQ ID NO: 629333 - DNA, 25 bp, Rattus norvegicus
tttgtagcccttacgtcacggtctg

SEQ ID NO: 629334 - DNA, 25 bp, Rattus norvegicus
tcacgtgacagaacagggcgctata

SEQ ID NO: 629335 - DNA, 25 bp, Rattus norvegicus
cctgtcggagcgttaggatttgagc

SEQ ID NO: 629336 - DNA, 25 bp, Rattus norvegicus
gccgccattttgtgacgttcggtcc

SEQ ID NO: 629337 - DNA, 25 bp, Rattus norvegicus
ccggtcaatgccaaagatgcttcca

SEQ ID NO: 629338 - DNA, 25 bp, Rattus norvegicus
tccaggcttataaatccggcactta

SEQ ID NO: 629339 - DNA, 25 bp, Rattus norvegicus
cggcacttatcatttgtccactgga

SEQ ID NO: 629340 - DNA, 25 bp, Rattus norvegicus
ccgcagtcgcaaacgctagagagta

SEQ ID NO: 629341 - DNA, 25 bp, Rattus norvegicus
aggtgccttgtttcgcggtagccac

SEQ ID NO: 629342 - DNA, 25 bp, Rattus norvegicus
acgtcgcacttcagagaggatactc

SEQ ID NO: 629343 - DNA, 25 bp, Rattus norvegicus
accgagagctcgcttctggttgcca

SEQ ID NO: 629344 - DNA, 25 bp, Rattus norvegicus
tgccagggcttcttgggatttcagg

SEQ ID NO: 629345 - DNA, 25 bp, Rattus norvegicus
tggcggtgacaaacttcggcaagtc

SEQ ID NO: 629346 - DNA, 25 bp, Rattus norvegicus
tcggcaagtctatctagagtccagc

SEQ ID NO: 629347 - DNA, 25 bp, Rattus norvegicus
agcgcagagcggttctccgattcca

SEQ ID NO: 629348 - DNA, 25 bp, Rattus norvegicus
tcgcgccacaactggggatggatca

SEQ ID NO: 629349 - DNA, 25 bp, Rattus norvegicus
gggcacagtatgttcccagggaacc

SEQ ID NO: 629350 - DNA, 25 bp, Rattus norvegicus
cccgcactgtagagcggccagtatc

SEQ ID NO: 629351 - DNA, 25 bp, Rattus norvegicus
ttacggggtgccgtacatcagacgc

SEQ ID NO: 629352 - DNA, 25 bp, Rattus norvegicus
ctgagtgtacccactagggcgcatc

SEQ ID NO: 629353 - DNA, 25 bp, Rattus norvegicus
cacagtgacctatttggcgggcaca

SEQ ID NO: 629354 - DNA, 25 bp, Rattus norvegicus
agggcgcatccattccactaggaac

SEQ ID NO: 629355 - DNA, 25 bp, Rattus norvegicus
gacgccactggagggcaactacgtc

SEQ ID NO: 629356 - DNA, 25 bp, Rattus norvegicus
cgatgcgctcatggcgagctgtctc

SEQ ID NO: 629357 - DNA, 25 bp, Rattus norvegicus
gagctgtctccaggaggcccgagaa

SEQ ID NO: 629358 - DNA, 25 bp, Rattus norvegicus
gaacggtggaactttgacttcgcca

SEQ ID NO: 629359 - DNA, 25 bp, Rattus norvegicus
tgacttcgccactgagacgccactg

SEQ ID NO: 629360 - DNA, 25 bp, Rattus norvegicus
aactacgtctgggagcgtgttcgga

SEQ ID NO: 629361 - DNA, 25 bp, Rattus norvegicus
tcgtctgttcggtcccgtggacagt

SEQ ID NO: 629362 - DNA, 25 bp, Rattus norvegicus
ccaagatctacctgagccctgggtc

SEQ ID NO: 629363 - DNA, 25 bp, Rattus norvegicus
ggacaagaggcccagtacctcctcg

SEQ ID NO: 629364 - DNA, 25 bp, Rattus norvegicus
gaccacgtggccttgtcgctgtctt

SEQ ID NO: 629365 - DNA, 25 bp, Rattus norvegicus
gtcgctgtcttgcactctggtgtct

SEQ ID NO: 629366 - DNA, 25 bp, Rattus norvegicus
gaccgggacatctcagggccgaaaa

SEQ ID NO: 629367 - DNA, 25 bp, Rattus norvegicus
gacagtgagcagttgagccgcgatt

SEQ ID NO: 629368 - DNA, 25 bp, Rattus norvegicus
ggagcccagggctgcccaagatcta

SEQ ID NO: 629369 - DNA, 25 bp, Rattus norvegicus
agtcaatattcctgcgcgattcacg

SEQ ID NO: 629370 - DNA, 25 bp, Rattus norvegicus
ctggaagctatagagaaagagggac

SEQ ID NO: 629371 - DNA, 25 bp, Rattus norvegicus
gcagggtcgctaagcaaaagctgga

SEQ ID NO: 629372 - DNA, 25 bp, Rattus norvegicus
tgagaaccctgaaaagcagggtcgc

SEQ ID NO: 629373 - DNA, 25 bp, Rattus norvegicus
cgggagatgagaaccctgaaaagca

SEQ ID NO: 629374 - DNA, 25 bp, Rattus norvegicus
acctgcaggacacggtgatctccac

SEQ ID NO: 629375 - DNA, 25 bp, Rattus norvegicus
ggacacggtgatctccaccttggta

SEQ ID NO: 629376 - DNA, 25 bp, Rattus norvegicus
ctccaccttggtagccgggatgctg

SEQ ID NO: 629377 - DNA, 25 bp, Rattus norvegicus
atgctgcccgccaaggagtcgaact

SEQ ID NO: 629378 - DNA, 25 bp, Rattus norvegicus
cccgccaaggagtcgaactcgctga

SEQ ID NO: 629379 - DNA, 25 bp, Rattus norvegicus
cgaactcgctgagcgacgccatgtc

SEQ ID NO: 629380 - DNA, 25 bp, Rattus norvegicus
ctatagagaaagagggactctggtc

SEQ ID NO: 629381 - DNA, 25 bp, Rattus norvegicus
ccaaattagtcaatattcctgcgcg

SEQ ID NO: 629382 - DNA, 25 bp, Rattus norvegicus
acgccatgtcctcgggctgatccat

SEQ ID NO: 629383 - DNA, 25 bp, Rattus norvegicus
tcacctagtctccaggtagacgttg

SEQ ID NO: 629384 - DNA, 25 bp, Rattus norvegicus
acccgttcacctggatgcacacttg

SEQ ID NO: 629385 - DNA, 25 bp, Rattus norvegicus
agttcacgtgggacccgttcacctg

SEQ ID NO: 629386 - DNA, 25 bp, Rattus norvegicus
gcaatcactacttccggcggagttc

SEQ ID NO: 629387 - DNA, 25 bp, Rattus norvegicus
gggaattccctagcaatcactactt

SEQ ID NO: 629388 - DNA, 25 bp, Rattus norvegicus
gccatgctgagcgaagggaattccc

SEQ ID NO: 629389 - DNA, 25 bp, Rattus norvegicus
ctttcttaacctggccgctgcggca

SEQ ID NO: 629390 - DNA, 25 bp, Rattus norvegicus
aacctgcgagtcaggctggcctttc

SEQ ID NO: 629391 - DNA, 25 bp, Rattus norvegicus
ggggctccttcagagcccacaggta

SEQ ID NO: 629392 - DNA, 25 bp, Rattus norvegicus
tggatgcacacttgccggttcccgc

SEQ ID NO: 629393 - DNA, 25 bp, Rattus norvegicus
gcaggcagaagtagccgaagtctcc

SEQ ID NO: 629394 - DNA, 25 bp, Rattus norvegicus
gtagccgaagtctcccacgacgttg

SEQ ID NO: 629395 - DNA, 25 bp, Rattus norvegicus
ctcccacgacgttggaggggctcct

SEQ ID NO: 629396 - DNA, 25 bp, Rattus norvegicus
cgtgggaaaagaacagcaggcagaa

SEQ ID NO: 629397 - DNA, 25 bp, Rattus norvegicus
tctgttttggaacctggggcgcgaa

SEQ ID NO: 629398 - DNA, 25 bp, Rattus norvegicus
gcggtcgtgtccgaaagccctgacc

SEQ ID NO: 629399 - DNA, 25 bp, Rattus norvegicus
cgcagtagcgcgatacggacgccag

SEQ ID NO: 629400 - DNA, 25 bp, Rattus norvegicus
caagagcatgcgcttttcagatacc

SEQ ID NO: 629401 - DNA, 25 bp, Rattus norvegicus
gcaacctcgccggatctgttttgga

SEQ ID NO: 629402 - DNA, 25 bp, Rattus norvegicus
gcgagaatcgcttccgggtcgcgct

SEQ ID NO: 629403 - DNA, 25 bp, Rattus norvegicus
gaagttgttggccaatcctcctcgc

SEQ ID NO: 629404 - DNA, 25 bp, Rattus norvegicus
ctctgcgagagcctccagcgttctg

SEQ ID NO: 629405 - DNA, 25 bp, Rattus norvegicus
cagcgttctgctgactgacaacatc

SEQ ID NO: 629406 - DNA, 25 bp, Rattus norvegicus
gggtagactcccttcagacatcgtt

SEQ ID NO: 629407 - DNA, 25 bp, Rattus norvegicus
ttcagacatcgttcggaggctccgc

SEQ ID NO: 629408 - DNA, 25 bp, Rattus norvegicus
ggactctgctcgaacttagttcgca

SEQ ID NO: 629409 - DNA, 25 bp, Rattus norvegicus
aacttagttcgcagacgtggcggtc

SEQ ID NO: 629410 - DNA, 25 bp, Rattus norvegicus
tcagataccgcgagagttgccctgc

SEQ ID NO: 629411 - DNA, 25 bp, Rattus norvegicus
cacgaggagcatgaatattacaatc

SEQ ID NO: 629412 - DNA, 25 bp, Rattus norvegicus
attacaatctcagcacagccacctg

SEQ ID NO: 629413 - DNA, 25 bp, Rattus norvegicus
gagctccggtgtgaggcctcccgat

SEQ ID NO: 629414 - DNA, 25 bp, Rattus norvegicus
actcaggtgacagtctagggaggcc

SEQ ID NO: 629415 - DNA, 25 bp, Rattus norvegicus
gccactacactcaggtgacagtcta

SEQ ID NO: 629416 - DNA, 25 bp, Rattus norvegicus
atgtgcggccactacactcaggtga

SEQ ID NO: 629417 - DNA, 25 bp, Rattus norvegicus
ggaactggcacgaggagcatgaata

SEQ ID NO: 629418 - DNA, 25 bp, Rattus norvegicus
catcacggacgagggcatggatgta

SEQ ID NO: 629419 - DNA, 25 bp, Rattus norvegicus
gaacctgtttgccatcacggacgag

SEQ ID NO: 629420 - DNA, 25 bp, Rattus norvegicus
cagaagtgcgtgtggggacacaaca

SEQ ID NO: 629421 - DNA, 25 bp, Rattus norvegicus
gggaatcttggcgttggactcaccc

SEQ ID NO: 629422 - DNA, 25 bp, Rattus norvegicus
tcgccaaggcctacgctcagaagtg

SEQ ID NO: 629423 - DNA, 25 bp, Rattus norvegicus
gcctcccgatgctgcctgagggctg

SEQ ID NO: 629424 - DNA, 25 bp, Rattus norvegicus
acagccacctgtgatccgggccaga

SEQ ID NO: 629425 - DNA, 25 bp, Rattus norvegicus
ttcttctcgcgcatgtcccctgaca

SEQ ID NO: 629426 - DNA, 25 bp, Rattus norvegicus
acgcagtggacttggcccagacctg

SEQ ID NO: 629427 - DNA, 25 bp, Rattus norvegicus
gagatcttcttctcgcgcatgtccc

SEQ ID NO: 629428 - DNA, 25 bp, Rattus norvegicus
ttctcacaccgcaacgcagtggact

SEQ ID NO: 629429 - DNA, 25 bp, Rattus norvegicus
cacctgagcagtactcgcagcacga

SEQ ID NO: 629430 - DNA, 25 bp, Rattus norvegicus
ccagacagccgctcttctcacaccg

SEQ ID NO: 629431 - DNA, 25 bp, Rattus norvegicus
tctgcacctgagcagtactcgcagc

SEQ ID NO: 629432 - DNA, 25 bp, Rattus norvegicus
gatctgcacctgagcagtactcgca

SEQ ID NO: 629433 - DNA, 25 bp, Rattus norvegicus
ctgcacctgagcagtactcgcagca

SEQ ID NO: 629434 - DNA, 25 bp, Rattus norvegicus
acctgagcagtactcgcagcacgaa

SEQ ID NO: 629435 - DNA, 25 bp, Rattus norvegicus
cctgagcagtactcgcagcacgaac

SEQ ID NO: 629436 - DNA, 25 bp, Rattus norvegicus
ctgagcagtactcgcagcacgaact

SEQ ID NO: 629437 - DNA, 25 bp, Rattus norvegicus
tgagcagtactcgcagcacgaactg

SEQ ID NO: 629438 - DNA, 25 bp, Rattus norvegicus
agagatcttcttctcgcgcatgtcc

SEQ ID NO: 629439 - DNA, 25 bp, Rattus norvegicus
cggggtctcgtttgcagcactaatg

SEQ ID NO: 629440 - DNA, 25 bp, Rattus norvegicus
cagcactaatgcttggccttgccaa

SEQ ID NO: 629441 - DNA, 25 bp, Rattus norvegicus
ccaaacgaagcttggacaaggcggc

SEQ ID NO: 629442 - DNA, 25 bp, Rattus norvegicus
tatacagtctaccaaacgaagcttg

SEQ ID NO: 629443 - DNA, 25 bp, Rattus norvegicus
gtggggcctgctatacagtctacca

SEQ ID NO: 629444 - DNA, 25 bp, Rattus norvegicus
tcttttatcgaatgggtggggcctg

SEQ ID NO: 629445 - DNA, 25 bp, Rattus norvegicus
atgcttggccttgccaaacagagcc

SEQ ID NO: 629446 - DNA, 25 bp, Rattus norvegicus
tggaagagttagtgtgtcaatgaca

SEQ ID NO: 629447 - DNA, 25 bp, Rattus norvegicus
tttatggctcgcgtatcccagtggg

SEQ ID NO: 629448 - DNA, 25 bp, Rattus norvegicus
cccgctgcagaggagtttatggctc

SEQ ID NO: 629449 - DNA, 25 bp, Rattus norvegicus
cgcacacccgctgcagaggagttta

SEQ ID NO: 629450 - DNA, 25 bp, Rattus norvegicus
tggtgggcgtggtcttttatcgaat

SEQ ID NO: 629451 - DNA, 25 bp, Rattus norvegicus
gtcaatgacaagaagttacaatacc

SEQ ID NO: 629452 - DNA, 25 bp, Rattus norvegicus
ttacaataccagaggcgcacacccg

SEQ ID NO: 629453 - DNA, 25 bp, Rattus norvegicus
cacaaacagcgcctcggtggtcggg

SEQ ID NO: 629454 - DNA, 25 bp, Rattus norvegicus
agctcctgcaccagctccggctccc

SEQ ID NO: 629455 - DNA, 25 bp, Rattus norvegicus
agcgccacaaacagcgcctcggtgg

SEQ ID NO: 629456 - DNA, 25 bp, Rattus norvegicus
agcagcttcacgtagagcagcgggt

SEQ ID NO: 629457 - DNA, 25 bp, Rattus norvegicus
acctggatcagcagcttcacgtaga

SEQ ID NO: 629458 - DNA, 25 bp, Rattus norvegicus
cccggagcccaaggcgccacttccg

SEQ ID NO: 629459 - DNA, 25 bp, Rattus norvegicus
ccagaccagtcatcgcagtggtgcc

SEQ ID NO: 629460 - DNA, 25 bp, Rattus norvegicus
accactcacgccgcggggcaaaggg

SEQ ID NO: 629461 - DNA, 25 bp, Rattus norvegicus
gtgcctaccggtcggtctctgcggc

SEQ ID NO: 629462 - DNA, 25 bp, Rattus norvegicus
agtcatcgcagtggtgcctaccggt

SEQ ID NO: 629463 - DNA, 25 bp, Rattus norvegicus
ctcctggccaggagctggttctctg

SEQ ID NO: 629464 - DNA, 25 bp, Rattus norvegicus
gagctggttctctgcagctcgggac

SEQ ID NO: 629465 - DNA, 25 bp, Rattus norvegicus
cctttgcggaccagaccagtcatcg

SEQ ID NO: 629466 - DNA, 25 bp, Rattus norvegicus
cccgtcacgtgggttatgaccacgc

SEQ ID NO: 629467 - DNA, 25 bp, Rattus norvegicus
cttaggcccacagcacaggagcgac

SEQ ID NO: 629468 - DNA, 25 bp, Rattus norvegicus
gctccgattctcgcaggttagtccc

SEQ ID NO: 629469 - DNA, 25 bp, Rattus norvegicus
ggttagtcccctcaccaacatgatc

SEQ ID NO: 629470 - DNA, 25 bp, Rattus norvegicus
aacatgatcactccccaggcgctga

SEQ ID NO: 629471 - DNA, 25 bp, Rattus norvegicus
cccaggcgctgaggacgatgccaca

SEQ ID NO: 629472 - DNA, 25 bp, Rattus norvegicus
tttggggacttgagcggcgcagagc

SEQ ID NO: 629473 - DNA, 25 bp, Rattus norvegicus
aggcggccagcttaggcccacagca

SEQ ID NO: 629474 - DNA, 25 bp, Rattus norvegicus
cagcttaggcccacagcacaggagc

SEQ ID NO: 629475 - DNA, 25 bp, Rattus norvegicus
aggaagggagggatcgctagagact

SEQ ID NO: 629476 - DNA, 25 bp, Rattus norvegicus
atcgctagagactgtgcggagtgcg

SEQ ID NO: 629477 - DNA, 25 bp, Rattus norvegicus
cggagtgcggcgtagaagcagcaaa

SEQ ID NO: 629478 - DNA, 25 bp, Rattus norvegicus
tagaagcagcaaaagggaaccctgg

SEQ ID NO: 629479 - DNA, 25 bp, Rattus norvegicus
gacgatgccacaggcggccagctta

SEQ ID NO: 629480 - DNA, 25 bp, Rattus norvegicus
cacagcacaggagcgacgccatgga

SEQ ID NO: 629481 - DNA, 25 bp, Rattus norvegicus
tcggggaatggtctgttttggcaac

SEQ ID NO: 629482 - DNA, 25 bp, Rattus norvegicus
tttccaggcgactgttctcggggaa

SEQ ID NO: 629483 - DNA, 25 bp, Rattus norvegicus
gtctgttttggcaaccagagggccc

SEQ ID NO: 629484 - DNA, 25 bp, Rattus norvegicus
aactctgcgacatgcgacagccggg

SEQ ID NO: 629485 - DNA, 25 bp, Rattus norvegicus
tcagctcccgcagccctgtcacagc

SEQ ID NO: 629486 - DNA, 25 bp, Rattus norvegicus
gtaccatttgcatagcaacctcctc

SEQ ID NO: 629487 - DNA, 25 bp, Rattus norvegicus
taggccgtaccatttgcatagcaac

SEQ ID NO: 629488 - DNA, 25 bp, Rattus norvegicus
cgaggctgctatgacagcgcccgtt

SEQ ID NO: 629489 - DNA, 25 bp, Rattus norvegicus
gctgctatgacagcgcccgtttcca

SEQ ID NO: 629490 - DNA, 25 bp, Rattus norvegicus
ctccgtaggccgtaccatttgcata

SEQ ID NO: 629491 - DNA, 25 bp, Rattus norvegicus
ggaatggtctgttttggcaaccaga

SEQ ID NO: 629492 - DNA, 25 bp, Rattus norvegicus
agcgcccgtttccaggcgactgttc

SEQ ID NO: 629493 - DNA, 25 bp, Rattus norvegicus
acgagcaactctgcgacatgcgaca

SEQ ID NO: 629494 - DNA, 25 bp, Rattus norvegicus
actgttctcggggaatggtctgttt

SEQ ID NO: 629495 - DNA, 25 bp, Rattus norvegicus
cccattcccgcagtttcccttctcg

SEQ ID NO: 629496 - DNA, 25 bp, Rattus norvegicus
aggtcaggcgcaaatacaatccata

SEQ ID NO: 629497 - DNA, 25 bp, Rattus norvegicus
accacagaggtcaggcgcaaataca

SEQ ID NO: 629498 - DNA, 25 bp, Rattus norvegicus
acatggctacggctctcgggtcacg

SEQ ID NO: 629499 - DNA, 25 bp, Rattus norvegicus
ggcgcaaatacaatccatacatggc

SEQ ID NO: 629500 - DNA, 25 bp, Rattus norvegicus
ctcgctctctgcataccacagaggt

SEQ ID NO: 629501 - DNA, 25 bp, Rattus norvegicus
tggaatcccacacccacgctgcagc

SEQ ID NO: 629502 - DNA, 25 bp, Rattus norvegicus
cacaaagcaggcctggaatcccaca

SEQ ID NO: 629503 - DNA, 25 bp, Rattus norvegicus
agcgacacccgaaacacaaagcagg

SEQ ID NO: 629504 - DNA, 25 bp, Rattus norvegicus
acagatcgttcagggacaggacgcc

SEQ ID NO: 629505 - DNA, 25 bp, Rattus norvegicus
aaggtagaagagaaacagatcgttc

SEQ ID NO: 629506 - DNA, 25 bp, Rattus norvegicus
tggcgcaccgttaaggtagaagaga

SEQ ID NO: 629507 - DNA, 25 bp, Rattus norvegicus
tctggagtcagtggcgcaccgttaa

SEQ ID NO: 629508 - DNA, 25 bp, Rattus norvegicus
tccatacatggctacggctctcggg

SEQ ID NO: 629509 - DNA, 25 bp, Rattus norvegicus
agccgcaacaccacccgcagtctga

SEQ ID NO: 629510 - DNA, 25 bp, Rattus norvegicus
gcctctctcccaggcaaagagaagg

SEQ ID NO: 629511 - DNA, 25 bp, Rattus norvegicus
agtcgcagtaccaggtgggcccgct

SEQ ID NO: 629512 - DNA, 25 bp, Rattus norvegicus
cagcggtggcttcggctcggtctac

SEQ ID NO: 629513 - DNA, 25 bp, Rattus norvegicus
gctcggtctactcgggcatccgcgt

SEQ ID NO: 629514 - DNA, 25 bp, Rattus norvegicus
gtcgccgacaacttgccggtgagtg

SEQ ID NO: 629515 - DNA, 25 bp, Rattus norvegicus
caacttgccggtgagtgggcaaccc

SEQ ID NO: 629516 - DNA, 25 bp, Rattus norvegicus
cctccaggtggccatcaagcacgtg

SEQ ID NO: 629517 - DNA, 25 bp, Rattus norvegicus
tggccatcaagcacgtggagaagga

SEQ ID NO: 629518 - DNA, 25 bp, Rattus norvegicus
ttgcaacgacctgcacgccaacaag

SEQ ID NO: 629519 - DNA, 25 bp, Rattus norvegicus
tggggatgctcctgtccaagatcaa

SEQ ID NO: 629520 - DNA, 25 bp, Rattus norvegicus
agtcgtcctccgactcgccctcggc

SEQ ID NO: 629521 - DNA, 25 bp, Rattus norvegicus
acgccaacaagctggcgccgggtga

SEQ ID NO: 629522 - DNA, 25 bp, Rattus norvegicus
gatgctcctgtccaagatcaactcc

SEQ ID NO: 629523 - DNA, 25 bp, Rattus norvegicus
ccacctcagggcttggagggacccg

SEQ ID NO: 629524 - DNA, 25 bp, Rattus norvegicus
accgcgagtggctacagctggaggc

SEQ ID NO: 629525 - DNA, 25 bp, Rattus norvegicus
gctggagtttggctggttactgaaa

SEQ ID NO: 629526 - DNA, 25 bp, Rattus norvegicus
tttggctggttactgaaagttgccc

SEQ ID NO: 629527 - DNA, 25 bp, Rattus norvegicus
cgctgtaacggacgcgggcctgcca

SEQ ID NO: 629528 - DNA, 25 bp, Rattus norvegicus
gctccaggccacctcagggcttgga

SEQ ID NO: 629529 - DNA, 25 bp, Rattus norvegicus
ccgcgcacatccgatccggcctgcc

SEQ ID NO: 629530 - DNA, 25 bp, Rattus norvegicus
tttcggactcaatacctgcgctctc

SEQ ID NO: 629531 - DNA, 25 bp, Rattus norvegicus
cgcacgcgcaatgcctgccttccta

SEQ ID NO: 629532 - DNA, 25 bp, Rattus norvegicus
gatctccgggcgattgcttctgtct

SEQ ID NO: 629533 - DNA, 25 bp, Rattus norvegicus
attgcttctgtctggtgtttaggta

SEQ ID NO: 629534 - DNA, 25 bp, Rattus norvegicus
tctgtctggtgtttaggtatggtgc

SEQ ID NO: 629535 - DNA, 25 bp, Rattus norvegicus
cgcctcggaagcgatcggagcccag

SEQ ID NO: 629536 - DNA, 25 bp, Rattus norvegicus
cccaggctggagtttggctggttac

SEQ ID NO: 629537 - DNA, 25 bp, Rattus norvegicus
aggaggttacaaggccagcggcgac

SEQ ID NO: 629538 - DNA, 25 bp, Rattus norvegicus
ggctgacggctcgtgacgttatcaa

SEQ ID NO: 629539 - DNA, 25 bp, Rattus norvegicus
cggccctgcgaggaaacgaaagtga

SEQ ID NO: 629540 - DNA, 25 bp, Rattus norvegicus
ctcgagtcctgagcgctgtgtgacc

SEQ ID NO: 629541 - DNA, 25 bp, Rattus norvegicus
ttcccaggggccgagcttgaaccca

SEQ ID NO: 629542 - DNA, 25 bp, Rattus norvegicus
ctcgtgacgttatcaagcggcgccg

SEQ ID NO: 629543 - DNA, 25 bp, Rattus norvegicus
tgacgttatcaagcggcgccgcccg

SEQ ID NO: 629544 - DNA, 25 bp, Rattus norvegicus
gatccgagcgcgaccgcgtagccag

SEQ ID NO: 629545 - DNA, 25 bp, Rattus norvegicus
ccagccggccctgcgaggaaacgaa

SEQ ID NO: 629546 - DNA, 25 bp, Rattus norvegicus
cgacactggacagtggcggcctgat

SEQ ID NO: 629547 - DNA, 25 bp, Rattus norvegicus
cctgcgaggaaacgaaagtgagaga

SEQ ID NO: 629548 - DNA, 25 bp, Rattus norvegicus
gtggcggcctgatccctcgtttccg

SEQ ID NO: 629549 - DNA, 25 bp, Rattus norvegicus
attctttcgaggtcgcccttccgcg

SEQ ID NO: 629550 - DNA, 25 bp, Rattus norvegicus
gcgcaagcgcctcgagtcctgagcg

SEQ ID NO: 629551 - DNA, 25 bp, Rattus norvegicus
cccttgccgaggaaatgagaggatt

SEQ ID NO: 629552 - DNA, 25 bp, Rattus norvegicus
cttggaagtgcctggtcacagcgcg

SEQ ID NO: 629553 - DNA, 25 bp, Rattus norvegicus
tgctgctggtcgctgctcacacagt

SEQ ID NO: 629554 - DNA, 25 bp, Rattus norvegicus
gtcacagcgcgtctgccattgtagg

SEQ ID NO: 629555 - DNA, 25 bp, Rattus norvegicus
gtctgccattgtaggtcactcgata

SEQ ID NO: 629556 - DNA, 25 bp, Rattus norvegicus
ggattccctgcgaggccccaatcga

SEQ ID NO: 629557 - DNA, 25 bp, Rattus norvegicus
agccggggagatggcgttcccttct

SEQ ID NO: 629558 - DNA, 25 bp, Rattus norvegicus
ctctgcatacgggtagccgcgcttg

SEQ ID NO: 629559 - DNA, 25 bp, Rattus norvegicus
tgagaggattggcttggattccctg

SEQ ID NO: 629560 - DNA, 25 bp, Rattus norvegicus
ttccaaacgagaagctcagccgggg

SEQ ID NO: 629561 - DNA, 25 bp, Rattus norvegicus
ctgagatttccaaacgagaagctca

SEQ ID NO: 629562 - DNA, 25 bp, Rattus norvegicus
cacagtctcaacacctgagatttcc

SEQ ID NO: 629563 - DNA, 25 bp, Rattus norvegicus
ggtcgctgctcacacagtctcaaca

SEQ ID NO: 629564 - DNA, 25 bp, Rattus norvegicus
ggtcactcgatagccctttggcctt

SEQ ID NO: 629565 - DNA, 25 bp, Rattus norvegicus
ctcgcttcttccctgtggtcctcga

SEQ ID NO: 629566 - DNA, 25 bp, Rattus norvegicus
ccatcttgttgaggggcgcgcccat

SEQ ID NO: 629567 - DNA, 25 bp, Rattus norvegicus
agattctcccgcttctttttagtca

SEQ ID NO: 629568 - DNA, 25 bp, Rattus norvegicus
ccctgcgtcggaacacagcgactaa

SEQ ID NO: 629569 - DNA, 25 bp, Rattus norvegicus
ggggctactgaaggcgccatcttgt

SEQ ID NO: 629570 - DNA, 25 bp, Rattus norvegicus
cctcccgagcgacgccaagattctc

SEQ ID NO: 629571 - DNA, 25 bp, Rattus norvegicus
ctcctttttcattggctggtgcggc

SEQ ID NO: 629572 - DNA, 25 bp, Rattus norvegicus
ctcccgcttctttttagtcatattg

SEQ ID NO: 629573 - DNA, 25 bp, Rattus norvegicus
ttagtcatattgcttgctgtgtccc

SEQ ID NO: 629574 - DNA, 25 bp, Rattus norvegicus
cgtgctggaccagcccactgagtcg

SEQ ID NO: 629575 - DNA, 25 bp, Rattus norvegicus
agcccactgagtcgcactgcgcaga

SEQ ID NO: 629576 - DNA, 25 bp, Rattus norvegicus
gcactgcgcagacgtaggtcctcgt

SEQ ID NO: 629577 - DNA, 25 bp, Rattus norvegicus
aggtcctcgtgctcctttttcattg

SEQ ID NO: 629578 - DNA, 25 bp, Rattus norvegicus
acagcgactaaccacgtgatcccga

SEQ ID NO: 629579 - DNA, 25 bp, Rattus norvegicus
agcagctgtcctttgaagcgccaca

SEQ ID NO: 629580 - DNA, 25 bp, Rattus norvegicus
tgaagcgccacacggccgaggcgat

SEQ ID NO: 629581 - DNA, 25 bp, Rattus norvegicus
agctgtcctttgaagcgccacacgg

SEQ ID NO: 629582 - DNA, 25 bp, Rattus norvegicus
cgccacacggccgaggcgatgcgct

SEQ ID NO: 629583 - DNA, 25 bp, Rattus norvegicus
cgatgcgctggggactgccacgcag

SEQ ID NO: 629584 - DNA, 25 bp, Rattus norvegicus
gactgccacgcaggagcgagcagcg

SEQ ID NO: 629585 - DNA, 25 bp, Rattus norvegicus
gcagcagctgtcctttgaagcgcca

SEQ ID NO: 629586 - DNA, 25 bp, Rattus norvegicus
gtagttaccgctgctgtcacgggtc

SEQ ID NO: 629587 - DNA, 25 bp, Rattus norvegicus
agttaccgctgctgtcacgggtcag

SEQ ID NO: 629588 - DNA, 25 bp, Rattus norvegicus
ttaccgctgctgtcacgggtcaggg

SEQ ID NO: 629589 - DNA, 25 bp, Rattus norvegicus
ggtcaggggcgtccaggcgcagctc

SEQ ID NO: 629590 - DNA, 25 bp, Rattus norvegicus
gggcagcagctgtcctttgaagcgc

SEQ ID NO: 629591 - DNA, 25 bp, Rattus norvegicus
gctgtcctttgaagcgccacacggc

SEQ ID NO: 629592 - DNA, 25 bp, Rattus norvegicus
cctttgaagcgccacacggccgagg

SEQ ID NO: 629593 - DNA, 25 bp, Rattus norvegicus
ttctcaggcttgctcctactgcagg

SEQ ID NO: 629594 - DNA, 25 bp, Rattus norvegicus
cggaaggtccagacaagtccggagc

SEQ ID NO: 629595 - DNA, 25 bp, Rattus norvegicus
gaattaaggtttgcttgcgcctccg

SEQ ID NO: 629596 - DNA, 25 bp, Rattus norvegicus
tactgcagggaccagaattaaggtt

SEQ ID NO: 629597 - DNA, 25 bp, Rattus norvegicus
aggcttgctcctactgcagggacca

SEQ ID NO: 629598 - DNA, 25 bp, Rattus norvegicus
cattgcgttctcaggcttgctccta

SEQ ID NO: 629599 - DNA, 25 bp, Rattus norvegicus
cggagcattgcgttctcaggcttgc

SEQ ID NO: 629600 - DNA, 25 bp, Rattus norvegicus
ctcaggcggagcattgcgttctcag

SEQ ID NO: 629601 - DNA, 25 bp, Rattus norvegicus
ttgcttgcgcctccgcgactgccac

SEQ ID NO: 629602 - DNA, 25 bp, Rattus norvegicus
ccccccgaggtatgtggaggatcgt

SEQ ID NO: 629603 - DNA, 25 bp, Rattus norvegicus
agaccctggccaaggggctgaccgt

SEQ ID NO: 629604 - DNA, 25 bp, Rattus norvegicus
tgagctgggcccagaccctggccaa

SEQ ID NO: 629605 - DNA, 25 bp, Rattus norvegicus
aaggtccagacaagtccggagcagg

SEQ ID NO: 629606 - DNA, 25 bp, Rattus norvegicus
gctcctactgcagggaccagaatta

SEQ ID NO: 629607 - DNA, 25 bp, Rattus norvegicus
tcctggaacttgtcggatgcgctgc

SEQ ID NO: 629608 - DNA, 25 bp, Rattus norvegicus
tccagagcctcgagggacctcaact

SEQ ID NO: 629609 - DNA, 25 bp, Rattus norvegicus
gaacaccgaagtctcctggaacttg

SEQ ID NO: 629610 - DNA, 25 bp, Rattus norvegicus
tttcattgaacaccgaagtctcctg

SEQ ID NO: 629611 - DNA, 25 bp, Rattus norvegicus
tcgatccgcagagtttcattgaaca

SEQ ID NO: 629612 - DNA, 25 bp, Rattus norvegicus
cgatgcgctcgatccgcagagtttc

SEQ ID NO: 629613 - DNA, 25 bp, Rattus norvegicus
cttgcagtagtagcggcctccctgc

SEQ ID NO: 629614 - DNA, 25 bp, Rattus norvegicus
ggcccgtcagagtccagagcctcga

SEQ ID NO: 629615 - DNA, 25 bp, Rattus norvegicus
tctccgccttgcagtagtagcggcc

SEQ ID NO: 629616 - DNA, 25 bp, Rattus norvegicus
gatggacttgatggccggcacgccc

SEQ ID NO: 629617 - DNA, 25 bp, Rattus norvegicus
tccacgcggatggacttgatggccg

SEQ ID NO: 629618 - DNA, 25 bp, Rattus norvegicus
tcacactgcacgtccacgcggatgg

SEQ ID NO: 629619 - DNA, 25 bp, Rattus norvegicus
atgcgctgcccgcagttttggtcca

SEQ ID NO: 629620 - DNA, 25 bp, Rattus norvegicus
agggacctcaactcacactgcacgt

SEQ ID NO: 629621 - DNA, 25 bp, Rattus norvegicus
agatgagttcggtctacggtcgcca

SEQ ID NO: 629622 - DNA, 25 bp, Rattus norvegicus
gcatatctcgggaggagatgagttc

SEQ ID NO: 629623 - DNA, 25 bp, Rattus norvegicus
ttagccattgtgaacgccgagtccc

SEQ ID NO: 629624 - DNA, 25 bp, Rattus norvegicus
tcggtttacccgttagccattgtga

SEQ ID NO: 629625 - DNA, 25 bp, Rattus norvegicus
ctgggcctttcactgcctcggttta

SEQ ID NO: 629626 - DNA, 25 bp, Rattus norvegicus
ccttctgaaatggtctgggcctttc

SEQ ID NO: 629627 - DNA, 25 bp, Rattus norvegicus
ccgaatcgcatatctcgggaggaga

SEQ ID NO: 629628 - DNA, 25 bp, Rattus norvegicus
acggcggggaccgaatcgcatatct

SEQ ID NO: 629629 - DNA, 25 bp, Rattus norvegicus
tacggctcgtggagaagggacaaac

SEQ ID NO: 629630 - DNA, 25 bp, Rattus norvegicus
caacctcctctacggctcgtggaga

SEQ ID NO: 629631 - DNA, 25 bp, Rattus norvegicus
tgctttgtctttcccttgctcgccg

SEQ ID NO: 629632 - DNA, 25 bp, Rattus norvegicus
ccttctgtgctttgtctttcccttg

SEQ ID NO: 629633 - DNA, 25 bp, Rattus norvegicus
tgtgaacgccgagtcccactagctc

SEQ ID NO: 629634 - DNA, 25 bp, Rattus norvegicus
gcacggaccttctgaaatggtctgg

SEQ ID NO: 629635 - DNA, 25 bp, Rattus norvegicus
tacttggagtctccggtggagacgc

SEQ ID NO: 629636 - DNA, 25 bp, Rattus norvegicus
gatttttctgactttgcccaccgct

SEQ ID NO: 629637 - DNA, 25 bp, Rattus norvegicus
gagcgctcaccgaatgcctcttgca

SEQ ID NO: 629638 - DNA, 25 bp, Rattus norvegicus
accctttccgctttccgtgactgtg

SEQ ID NO: 629639 - DNA, 25 bp, Rattus norvegicus
cgctttccgtgactgtgagcgcctc

SEQ ID NO: 629640 - DNA, 25 bp, Rattus norvegicus
tgagcgcctccctcggagctaaggg

SEQ ID NO: 629641 - DNA, 25 bp, Rattus norvegicus
ccgcaccagggctcctaaggatttt

SEQ ID NO: 629642 - DNA, 25 bp, Rattus norvegicus
ctgtgcagcttaccgagtcccgaca

SEQ ID NO: 629643 - DNA, 25 bp, Rattus norvegicus
gtcccgacagggtcgtagcagcttc

SEQ ID NO: 629644 - DNA, 25 bp, Rattus norvegicus
tcgtagcagcttcccgagagatgcc

SEQ ID NO: 629645 - DNA, 25 bp, Rattus norvegicus
agagatgcctctccatgctgtccaa

SEQ ID NO: 629646 - DNA, 25 bp, Rattus norvegicus
tgctgtccaaccaaccacaggtaga

SEQ ID NO: 629647 - DNA, 25 bp, Rattus norvegicus
tggagcccgcgtacttggagtctcc

SEQ ID NO: 629648 - DNA, 25 bp, Rattus norvegicus
cacaggtagacctcgttgttggagc

SEQ ID NO: 629649 - DNA, 25 bp, Rattus norvegicus
ccggtcctctgaagcgccggagcag

SEQ ID NO: 629650 - DNA, 25 bp, Rattus norvegicus
gccaattaaaggcagcccagctcgc

SEQ ID NO: 629651 - DNA, 25 bp, Rattus norvegicus
gtcgctcgctctcctgtttgattcc

SEQ ID NO: 629652 - DNA, 25 bp, Rattus norvegicus
tctggtccctccgagcggttcaaac

SEQ ID NO: 629653 - DNA, 25 bp, Rattus norvegicus
ttcgctgtgctgctttctggtccct

SEQ ID NO: 629654 - DNA, 25 bp, Rattus norvegicus
ctcgctcggcaacttgggcttcgct

SEQ ID NO: 629655 - DNA, 25 bp, Rattus norvegicus
aataattcgcgctcttgcggaggcc

SEQ ID NO: 629656 - DNA, 25 bp, Rattus norvegicus
tgagtcctttgaaaataattcgcgc

SEQ ID NO: 629657 - DNA, 25 bp, Rattus norvegicus
ggcaccacagccagcaagggaaaga

SEQ ID NO: 629658 - DNA, 25 bp, Rattus norvegicus
tccggagaacgtttccaaagcaaga

SEQ ID NO: 629659 - DNA, 25 bp, Rattus norvegicus
agtccgcgaagttagccgagccgcc

SEQ ID NO: 629660 - DNA, 25 bp, Rattus norvegicus
ccgcgtctccgagtccgcgaagtta

SEQ ID NO: 629661 - DNA, 25 bp, Rattus norvegicus
cctctctctctaaagatcaagagta

SEQ ID NO: 629662 - DNA, 25 bp, Rattus norvegicus
agcagcgaggactggcttccgccgc

SEQ ID NO: 629663 - DNA, 25 bp, Rattus norvegicus
tcagcctggagcacaagccagctct

SEQ ID NO: 629664 - DNA, 25 bp, Rattus norvegicus
aggaactcagccgagcacgaaccgc

SEQ ID NO: 629665 - DNA, 25 bp, Rattus norvegicus
ccgagctgtcctctgtgggactcgc

SEQ ID NO: 629666 - DNA, 25 bp, Rattus norvegicus
gccattgtccggtcagcgccgtcta

SEQ ID NO: 629667 - DNA, 25 bp, Rattus norvegicus
cagcggtggacactggacacctaca

SEQ ID NO: 629668 - DNA, 25 bp, Rattus norvegicus
cccagcctcggaggcgctgaacaaa

SEQ ID NO: 629669 - DNA, 25 bp, Rattus norvegicus
gcagcatggatcaggaacgcgagca

SEQ ID NO: 629670 - DNA, 25 bp, Rattus norvegicus
actaatccggtctccggcctgcttg

SEQ ID NO: 629671 - DNA, 25 bp, Rattus norvegicus
gacgacaaggtctccaggcgcatgc

SEQ ID NO: 629672 - DNA, 25 bp, Rattus norvegicus
acccacctctggatggacgacaagg

SEQ ID NO: 629673 - DNA, 25 bp, Rattus norvegicus
ctggacacctacacgacttccgggt

SEQ ID NO: 629674 - DNA, 25 bp, Rattus norvegicus
aacgcgagcagtggccttgaagacc

SEQ ID NO: 629675 - DNA, 25 bp, Rattus norvegicus
cctgcttggggcgtaccatttgttt

SEQ ID NO: 629676 - DNA, 25 bp, Rattus norvegicus
gccagctctcgtaaaagttctagga

SEQ ID NO: 629677 - DNA, 25 bp, Rattus norvegicus
atccaggacttcagggcctcagttc

SEQ ID NO: 629678 - DNA, 25 bp, Rattus norvegicus
cgctggcgtcacttagcaacggatc

SEQ ID NO: 629679 - DNA, 25 bp, Rattus norvegicus
acgatgttcctcagcgacctagacg

SEQ ID NO: 629680 - DNA, 25 bp, Rattus norvegicus
aatctagtcacttgtccctcggcac

SEQ ID NO: 629681 - DNA, 25 bp, Rattus norvegicus
gcttgggattcctccgtgttaggga

SEQ ID NO: 629682 - DNA, 25 bp, Rattus norvegicus
gaggaacacgggcttctcccgcttg

SEQ ID NO: 629683 - DNA, 25 bp, Rattus norvegicus
caggtttgcacagtcgcgtctcagt

SEQ ID NO: 629684 - DNA, 25 bp, Rattus norvegicus
cgtttccgcgtctgtcaggtttgca

SEQ ID NO: 629685 - DNA, 25 bp, Rattus norvegicus
tcgcggataacccaaaactttgcga

SEQ ID NO: 629686 - DNA, 25 bp, Rattus norvegicus
cacgcaggcacaggttctaactctc

SEQ ID NO: 629687 - DNA, 25 bp, Rattus norvegicus
aaggcttgtcatcgcacgtcactga

SEQ ID NO: 629688 - DNA, 25 bp, Rattus norvegicus
actgaatagcgtcatcggtcgcgtc

SEQ ID NO: 629689 - DNA, 25 bp, Rattus norvegicus
tgtgaccgcactgcggacacctggc

SEQ ID NO: 629690 - DNA, 25 bp, Rattus norvegicus
agacccgccagagtagagccaacga

SEQ ID NO: 629691 - DNA, 25 bp, Rattus norvegicus
gggcggcctcatcagtaagaccact

SEQ ID NO: 629692 - DNA, 25 bp, Rattus norvegicus
atcgctgcaagcaaacaagccggcg

SEQ ID NO: 629693 - DNA, 25 bp, Rattus norvegicus
ctggctgtggctctgccatggctgc

SEQ ID NO: 629694 - DNA, 25 bp, Rattus norvegicus
cttcagccagcggtcctgcaagcag

SEQ ID NO: 629695 - DNA, 25 bp, Rattus norvegicus
accgggttaggattacgccagcgag

SEQ ID NO: 629696 - DNA, 25 bp, Rattus norvegicus
attacgccagcgagggccagagccc

SEQ ID NO: 629697 - DNA, 25 bp, Rattus norvegicus
tgccacccaccttggtgcttggatc

SEQ ID NO: 629698 - DNA, 25 bp, Rattus norvegicus
caccttggtgcttggatccgggtca

SEQ ID NO: 629699 - DNA, 25 bp, Rattus norvegicus
ggatccgggtcagagcagcaactga

SEQ ID NO: 629700 - DNA, 25 bp, Rattus norvegicus
agcagcaactgagggcggcctcatc

SEQ ID NO: 629701 - DNA, 25 bp, Rattus norvegicus
tggctgccctggagaatcgctgcaa

SEQ ID NO: 629702 - DNA, 25 bp, Rattus norvegicus
acaagccggcgacacgctccgaaag

SEQ ID NO: 629703 - DNA, 25 bp, Rattus norvegicus
gacacgctccgaaaggaccgtgggc

SEQ ID NO: 629704 - DNA, 25 bp, Rattus norvegicus
gtaagaccactggacgctggctgtg

SEQ ID NO: 629705 - DNA, 25 bp, Rattus norvegicus
ctcagcgttcggaagactgaggagt

SEQ ID NO: 629706 - DNA, 25 bp, Rattus norvegicus
tttggatgcgcgaatcacggacacg

SEQ ID NO: 629707 - DNA, 25 bp, Rattus norvegicus
cggacacggcaaatgaatcgaagga

SEQ ID NO: 629708 - DNA, 25 bp, Rattus norvegicus
atcgaaggacaacgtgcgctacttg

SEQ ID NO: 629709 - DNA, 25 bp, Rattus norvegicus
gcgctacttgtacaccctggagaaa

SEQ ID NO: 629710 - DNA, 25 bp, Rattus norvegicus
cgtgctcctcaaggtgggctttcta

SEQ ID NO: 629711 - DNA, 25 bp, Rattus norvegicus
agcaaaccggggtaacgagtgcgca

SEQ ID NO: 629712 - DNA, 25 bp, Rattus norvegicus
ctgaggagtgcggttcctaacgcta

SEQ ID NO: 629713 - DNA, 25 bp, Rattus norvegicus
cctaacgctagcttgcatgattaaa

SEQ ID NO: 629714 - DNA, 25 bp, Rattus norvegicus
attaaagcacttggtcgcggcgctc

SEQ ID NO: 629715 - DNA, 25 bp, Rattus norvegicus
gcggcgctcgagagcagcagccctt

SEQ ID NO: 629716 - DNA, 25 bp, Rattus norvegicus
gcagcagcccttggaagcaaaccgg

SEQ ID NO: 629717 - DNA, 25 bp, Rattus norvegicus
aacgagtgcgcaggaatttacttcc

SEQ ID NO: 629718 - DNA, 25 bp, Rattus norvegicus
tacgacctggtgagcgtgctcctca

SEQ ID NO: 629719 - DNA, 25 bp, Rattus norvegicus
agacgctgctgtgtgaaatttcaga

SEQ ID NO: 629720 - DNA, 25 bp, Rattus norvegicus
cagctcatagctgccatgattcacc

SEQ ID NO: 629721 - DNA, 25 bp, Rattus norvegicus
caccaccattgtggacgtgcagctc

SEQ ID NO: 629722 - DNA, 25 bp, Rattus norvegicus
caaaatctttggtacgggtgctccg

SEQ ID NO: 629723 - DNA, 25 bp, Rattus norvegicus
tgccctccaatacgtctatcgacaa

SEQ ID NO: 629724 - DNA, 25 bp, Rattus norvegicus
gttcactgtgttcaactgcacgctg

SEQ ID NO: 629725 - DNA, 25 bp, Rattus norvegicus
cagcgcttaaaaagacagttcactg

SEQ ID NO: 629726 - DNA, 25 bp, Rattus norvegicus
ccggagacttcaccaccattgtgga

SEQ ID NO: 629727 - DNA, 25 bp, Rattus norvegicus
cagcctggacaaacccggagacttc

SEQ ID NO: 629728 - DNA, 25 bp, Rattus norvegicus
atggagggaatgtacagcctggaca

SEQ ID NO: 629729 - DNA, 25 bp, Rattus norvegicus
acgagatcgtgcgtcagatgatgga

SEQ ID NO: 629730 - DNA, 25 bp, Rattus norvegicus
tttcagatcaccaacgagatcgtgc

SEQ ID NO: 629731 - DNA, 25 bp, Rattus norvegicus
gaggccacgcctgcgtctaaagacg

SEQ ID NO: 629732 - DNA, 25 bp, Rattus norvegicus
gcggaacgacatcccacagcgctta

SEQ ID NO: 629733 - DNA, 25 bp, Rattus norvegicus
tcggtgaaacttagcaacgcgtctg

SEQ ID NO: 629734 - DNA, 25 bp, Rattus norvegicus
ccagatcgacgcgttggccaagaaa

SEQ ID NO: 629735 - DNA, 25 bp, Rattus norvegicus
gcctctgatctgtttcctgtccatg

SEQ ID NO: 629736 - DNA, 25 bp, Rattus norvegicus
ctcggaatatcatctttcacgggcg

SEQ ID NO: 629737 - DNA, 25 bp, Rattus norvegicus
aacgcgtctgtttgctcggaatatc

SEQ ID NO: 629738 - DNA, 25 bp, Rattus norvegicus
ggaaagtgacacacacacgcctctg

SEQ ID NO: 629739 - DNA, 25 bp, Rattus norvegicus
cctaaacctggagaagacctgggag

SEQ ID NO: 629740 - DNA, 25 bp, Rattus norvegicus
cacggagccggttatcctaaacctg

SEQ ID NO: 629741 - DNA, 25 bp, Rattus norvegicus
gccgactctctcgaggagaagtaca

SEQ ID NO: 629742 - DNA, 25 bp, Rattus norvegicus
gcgagaaagtacatcgccgactctc

SEQ ID NO: 629743 - DNA, 25 bp, Rattus norvegicus
ccgcactgttttccaagcgagaaag

SEQ ID NO: 629744 - DNA, 25 bp, Rattus norvegicus
gtggtgcccagaccgcactgttttc

SEQ ID NO: 629745 - DNA, 25 bp, Rattus norvegicus
gcggaccatctgtcggtgaaactta

SEQ ID NO: 629746 - DNA, 25 bp, Rattus norvegicus
aactgaagctgggtatggcggacca

SEQ ID NO: 629747 - DNA, 25 bp, Rattus norvegicus
ctcctaaacctgagtagcgcccgtg

SEQ ID NO: 629748 - DNA, 25 bp, Rattus norvegicus
cgacctcctgaaacccaggcggaag

SEQ ID NO: 629749 - DNA, 25 bp, Rattus norvegicus
taaacctgagtagcgcccgtgggga

SEQ ID NO: 629750 - DNA, 25 bp, Rattus norvegicus
gggagcgcagcaccgagcatctcct

SEQ ID NO: 629751 - DNA, 25 bp, Rattus norvegicus
caccgagcatctcctggcccgggac

SEQ ID NO: 629752 - DNA, 25 bp, Rattus norvegicus
tcctgaaacccaggcggaagaggcc

SEQ ID NO: 629753 - DNA, 25 bp, Rattus norvegicus
gcgcacgcaccacgggcgctcagag

SEQ ID NO: 629754 - DNA, 25 bp, Rattus norvegicus
cggttccgcaggtggcagctatgac

SEQ ID NO: 629755 - DNA, 25 bp, Rattus norvegicus
gcagctatgacccagtcctgagcgc

SEQ ID NO: 629756 - DNA, 25 bp, Rattus norvegicus
gacgctgcggtgttctgcaggcgcc

SEQ ID NO: 629757 - DNA, 25 bp, Rattus norvegicus
ctcctgcggctcctaaacctgagta

SEQ ID NO: 629758 - DNA, 25 bp, Rattus norvegicus
cccaatggtcgcagcgagctggcca

SEQ ID NO: 629759 - DNA, 25 bp, Rattus norvegicus
ctgcggctcctaaacctgagtagcg

SEQ ID NO: 629760 - DNA, 25 bp, Rattus norvegicus
cagcccggcagggatcagtcgcgcc

SEQ ID NO: 629761 - DNA, 25 bp, Rattus norvegicus
agcgcagcctcgttcctgcaacctc

SEQ ID NO: 629762 - DNA, 25 bp, Rattus norvegicus
agccgcctctgagcgcatcctccgg

SEQ ID NO: 629763 - DNA, 25 bp, Rattus norvegicus
cagtcggaacccgtgcagagcgcgc

SEQ ID NO: 629764 - DNA, 25 bp, Rattus norvegicus
ggcctgtctgatggccgctttctcg

SEQ ID NO: 629765 - DNA, 25 bp, Rattus norvegicus
ctgatggccgctttctcggtcggca

SEQ ID NO: 629766 - DNA, 25 bp, Rattus norvegicus
tttctcggtcggcaccgccatggtg

SEQ ID NO: 629767 - DNA, 25 bp, Rattus norvegicus
ccgccatggtgagtcgcacatcttt

SEQ ID NO: 629768 - DNA, 25 bp, Rattus norvegicus
catggtgagtcgcacatcttttgca

SEQ ID NO: 629769 - DNA, 25 bp, Rattus norvegicus
cacatcttttgcactcggggctggc

SEQ ID NO: 629770 - DNA, 25 bp, Rattus norvegicus
actcggggctggcttttatcttcta

SEQ ID NO: 629771 - DNA, 25 bp, Rattus norvegicus
ggctggcttttatcttctaaggaaa

SEQ ID NO: 629772 - DNA, 25 bp, Rattus norvegicus
tatcttctaaggaaacaggaaatcc

SEQ ID NO: 629773 - DNA, 25 bp, Rattus norvegicus
acaggaaatccaaagcccggctggc

SEQ ID NO: 629774 - DNA, 25 bp, Rattus norvegicus
tggttcccacaccagccgcctctga

SEQ ID NO: 629775 - DNA, 25 bp, Rattus norvegicus
accactagtgtggtgccaccgctgc

SEQ ID NO: 629776 - DNA, 25 bp, Rattus norvegicus
gcgggaagttcgtctcgctcttcta

SEQ ID NO: 629777 - DNA, 25 bp, Rattus norvegicus
catagttacaaccagggccgcggga

SEQ ID NO: 629778 - DNA, 25 bp, Rattus norvegicus
tggttcagccacctacacttatctg

SEQ ID NO: 629779 - DNA, 25 bp, Rattus norvegicus
cacttgaccgccgtctgcctatttt

SEQ ID NO: 629780 - DNA, 25 bp, Rattus norvegicus
gcgagcacatgtggctctcacttga

SEQ ID NO: 629781 - DNA, 25 bp, Rattus norvegicus
ggctgccgtatgcaaccctctacgt

SEQ ID NO: 629782 - DNA, 25 bp, Rattus norvegicus
gctctagtggatgtgggcttcacca

SEQ ID NO: 629783 - DNA, 25 bp, Rattus norvegicus
atgtactacttcctctgccacttgg

SEQ ID NO: 629784 - DNA, 25 bp, Rattus norvegicus
tacctactaacgctgaccggcaacg

SEQ ID NO: 629785 - DNA, 25 bp, Rattus norvegicus
tctgcagccggtcttcttcgttctg

SEQ ID NO: 629786 - DNA, 25 bp, Rattus norvegicus
gtctcgctcttctacacggtggtga

SEQ ID NO: 629787 - DNA, 25 bp, Rattus norvegicus
gaccattttatctgcgagctgcccg

SEQ ID NO: 629788 - DNA, 25 bp, Rattus norvegicus
tgggtttcaccgactggccctctct

SEQ ID NO: 629789 - DNA, 25 bp, Rattus norvegicus
ggtgggcccactaagaacggctgcc

SEQ ID NO: 629790 - DNA, 25 bp, Rattus norvegicus
tctgaatgaatgaggactgacgccc

SEQ ID NO: 629791 - DNA, 25 bp, Rattus norvegicus
actgacgcccttgtggcaagagaga

SEQ ID NO: 629792 - DNA, 25 bp, Rattus norvegicus
tggcaagagagagcatgcgcaatgt

SEQ ID NO: 629793 - DNA, 25 bp, Rattus norvegicus
cgcgggagtccgaaagctttcagtc

SEQ ID NO: 629794 - DNA, 25 bp, Rattus norvegicus
ttcagtccagcgtggcttctggtca

SEQ ID NO: 629795 - DNA, 25 bp, Rattus norvegicus
ataagtgcgacgcacgccgctcggg

SEQ ID NO: 629796 - DNA, 25 bp, Rattus norvegicus
ctgcggcctgactctgaatgaatga

SEQ ID NO: 629797 - DNA, 25 bp, Rattus norvegicus
agcagacgcaaacgcggaccggatc

SEQ ID NO: 629798 - DNA, 25 bp, Rattus norvegicus
gccatcttcacaggctcgagcaatg

SEQ ID NO: 629799 - DNA, 25 bp, Rattus norvegicus
cagaaacgctctccaacagcagcag

SEQ ID NO: 629800 - DNA, 25 bp, Rattus norvegicus
caatggcgtggcgtgatgacgcaac

SEQ ID NO: 629801 - DNA, 25 bp, Rattus norvegicus
gcgtgatgacgcaacataagtgcga

SEQ ID NO: 629802 - DNA, 25 bp, Rattus norvegicus
tgcgaccctgttcgcggttgcaaca

SEQ ID NO: 629803 - DNA, 25 bp, Rattus norvegicus
cctcccgcccatacacgctgctctt

SEQ ID NO: 629804 - DNA, 25 bp, Rattus norvegicus
aatgtgaccttgtcgccgcccgaac

SEQ ID NO: 629805 - DNA, 25 bp, Rattus norvegicus
gtgtgcagcctgcacatgagcgatc

SEQ ID NO: 629806 - DNA, 25 bp, Rattus norvegicus
agcctgcacatgagcgatcgcgcca

SEQ ID NO: 629807 - DNA, 25 bp, Rattus norvegicus
aactagcagtactccgctgcgcgtc

SEQ ID NO: 629808 - DNA, 25 bp, Rattus norvegicus
gcgtctcgctcatggtcactgcagt

SEQ ID NO: 629809 - DNA, 25 bp, Rattus norvegicus
actgcagtctcgctcatggtcactg

SEQ ID NO: 629810 - DNA, 25 bp, Rattus norvegicus
cagtctcgctcatggtcactgtagt

SEQ ID NO: 629811 - DNA, 25 bp, Rattus norvegicus
actgtagtctcactcatggtcacta

SEQ ID NO: 629812 - DNA, 25 bp, Rattus norvegicus
aaccgtctgggtggaatgttcctgc

SEQ ID NO: 629813 - DNA, 25 bp, Rattus norvegicus
tcactgccgccaatgtgaccttgtc

SEQ ID NO: 629814 - DNA, 25 bp, Rattus norvegicus
tcacaccgcaacacaggcgacttgg

SEQ ID NO: 629815 - DNA, 25 bp, Rattus norvegicus
caacacaggcgacttgggccagatg

SEQ ID NO: 629816 - DNA, 25 bp, Rattus norvegicus
tcatggtcactaacaaccgtctggg

SEQ ID NO: 629817 - DNA, 25 bp, Rattus norvegicus
cgtggatgagcttgagacagatctg

SEQ ID NO: 629818 - DNA, 25 bp, Rattus norvegicus
aatgacggaacccaagtccgtgtgc

SEQ ID NO: 629819 - DNA, 25 bp, Rattus norvegicus
aacccaagtccgtgtgcgtgtcggt

SEQ ID NO: 629820 - DNA, 25 bp, Rattus norvegicus
tgtccagcaacgtggatgagcttga

SEQ ID NO: 629821 - DNA, 25 bp, Rattus norvegicus
cgtgaatatcgaattcaaggacctt

SEQ ID NO: 629822 - DNA, 25 bp, Rattus norvegicus
gagacagatctgcttaatgggcacc

SEQ ID NO: 629823 - DNA, 25 bp, Rattus norvegicus
gatctgcttaatgggcacctgaaga

SEQ ID NO: 629824 - DNA, 25 bp, Rattus norvegicus
aatgggcacctgaagaaggtggaca

SEQ ID NO: 629825 - DNA, 25 bp, Rattus norvegicus
aaggtggacaacaacttcacggagg

SEQ ID NO: 629826 - DNA, 25 bp, Rattus norvegicus
acaacttcacggaggcccagcgctt

SEQ ID NO: 629827 - DNA, 25 bp, Rattus norvegicus
ttcacggaggcccagcgcttttcct

SEQ ID NO: 629828 - DNA, 25 bp, Rattus norvegicus
cttttcctccctgccgcggagggca

SEQ ID NO: 629829 - DNA, 25 bp, Rattus norvegicus
gagggcagccgtgaatatcgaattc

SEQ ID NO: 629830 - DNA, 25 bp, Rattus norvegicus
tggacgaggtcgtgtccagcaacgt

SEQ ID NO: 629831 - DNA, 25 bp, Rattus norvegicus
tgtacgacctgggaggagtccgctc

SEQ ID NO: 629832 - DNA, 25 bp, Rattus norvegicus
gccggggactagtcaagtgcttttc

SEQ ID NO: 629833 - DNA, 25 bp, Rattus norvegicus
agtgcttttcctagaatgggacctc

SEQ ID NO: 629834 - DNA, 25 bp, Rattus norvegicus
tgggacctctttgaagtaaaggctc

SEQ ID NO: 629835 - DNA, 25 bp, Rattus norvegicus
aggctcctagagtggccttgagcga

SEQ ID NO: 629836 - DNA, 25 bp, Rattus norvegicus
ggcgatcccatgctgcctatgctga

SEQ ID NO: 629837 - DNA, 25 bp, Rattus norvegicus
tcgcctcgctgtgatgctggatccc

SEQ ID NO: 629838 - DNA, 25 bp, Rattus norvegicus
gtgacagctgtgagaagacgcctgc

SEQ ID NO: 629839 - DNA, 25 bp, Rattus norvegicus
agacccagcgctttgtctgcagccg

SEQ ID NO: 629840 - DNA, 25 bp, Rattus norvegicus
ctccaggaagtcgacggcaggaagc

SEQ ID NO: 629841 - DNA, 25 bp, Rattus norvegicus
accaccgggccaagcggctgtacga

SEQ ID NO: 629842 - DNA, 25 bp, Rattus norvegicus
tgcctatgctgagttcccagggaaa

SEQ ID NO: 629843 - DNA, 25 bp, Rattus norvegicus
tgggcgtgcctgtagccttcaccac

SEQ ID NO: 629844 - DNA, 25 bp, Rattus norvegicus
aggccgccagtgacagctgtgagaa

SEQ ID NO: 629845 - DNA, 25 bp, Rattus norvegicus
tacctgctcgcggtggagaaggcta

SEQ ID NO: 629846 - DNA, 25 bp, Rattus norvegicus
ggaatccgggaagacacggaacatg

SEQ ID NO: 629847 - DNA, 25 bp, Rattus norvegicus
agaaggctaggaaccggctgcctcc

SEQ ID NO: 629848 - DNA, 25 bp, Rattus norvegicus
gagcctcttacctgctcgcggtgga

SEQ ID NO: 629849 - DNA, 25 bp, Rattus norvegicus
agacacggaacatggccgctccggc

SEQ ID NO: 629850 - DNA, 25 bp, Rattus norvegicus
cgcaggcgccacaaagtccggaagt

SEQ ID NO: 629851 - DNA, 25 bp, Rattus norvegicus
cccggacctgccgtgcagattatgg

SEQ ID NO: 629852 - DNA, 25 bp, Rattus norvegicus
tcgcatttgaatacctcggaggtgc

SEQ ID NO: 629853 - DNA, 25 bp, Rattus norvegicus
tcggaggtgctgatgctatagattc

SEQ ID NO: 629854 - DNA, 25 bp, Rattus norvegicus
cccgcgtgcctttcgcgttgattga

SEQ ID NO: 629855 - DNA, 25 bp, Rattus norvegicus
cgtgcagattatggggctataggtc

SEQ ID NO: 629856 - DNA, 25 bp, Rattus norvegicus
tcgcgttgattgacttttccgcccg

SEQ ID NO: 629857 - DNA, 25 bp, Rattus norvegicus
cacagggagaggtcgcatttgaata

SEQ ID NO: 629858 - DNA, 25 bp, Rattus norvegicus
accaccagcgtctgggcgcacagtg

SEQ ID NO: 629859 - DNA, 25 bp, Rattus norvegicus
ctcaggttacgtacctaggtgcgac

SEQ ID NO: 629860 - DNA, 25 bp, Rattus norvegicus
gcccttagctgcacgcgtgggctcg

SEQ ID NO: 629861 - DNA, 25 bp, Rattus norvegicus
tctgggagcccgcccagaatgcgcg

SEQ ID NO: 629862 - DNA, 25 bp, Rattus norvegicus
cccagaatgcgcgcgcaagcgcttg

SEQ ID NO: 629863 - DNA, 25 bp, Rattus norvegicus
cccaccctggtgtacgattggcgaa

SEQ ID NO: 629864 - DNA, 25 bp, Rattus norvegicus
ctggtgtacgattggcgaacgtgac

SEQ ID NO: 629865 - DNA, 25 bp, Rattus norvegicus
ttgtgcgggtgcacgctcaggttac

SEQ ID NO: 629866 - DNA, 25 bp, Rattus norvegicus
ggtgcacgctcaggttacgtaccta

SEQ ID NO: 629867 - DNA, 25 bp, Rattus norvegicus
ttacgtacctaggtgcgacctcggc

SEQ ID NO: 629868 - DNA, 25 bp, Rattus norvegicus
ggcgtctgtaccatggcggtctctc

SEQ ID NO: 629869 - DNA, 25 bp, Rattus norvegicus
agagacctacccggtccttagtctg

SEQ ID NO: 629870 - DNA, 25 bp, Rattus norvegicus
ggtccttagtctggcccttagctgc

SEQ ID NO: 629871 - DNA, 25 bp, Rattus norvegicus
cgacctcggcgctgggcgtctgtac

SEQ ID NO: 629872 - DNA, 25 bp, Rattus norvegicus
cttagtctggcccttagctgcacgc

SEQ ID NO: 629873 - DNA, 25 bp, Rattus norvegicus
tgtccaccgcccgttgggaagagct

SEQ ID NO: 629874 - DNA, 25 bp, Rattus norvegicus
gtgacagcgtgtcgcgcgtgtccac

SEQ ID NO: 629875 - DNA, 25 bp, Rattus norvegicus
gcgacgtcgcggcttcaggctccgg

SEQ ID NO: 629876 - DNA, 25 bp, Rattus norvegicus
ctaggagcaccgagccgggcgacgt

SEQ ID NO: 629877 - DNA, 25 bp, Rattus norvegicus
gaagctgtgcagctaggagcaccga

SEQ ID NO: 629878 - DNA, 25 bp, Rattus norvegicus
tttctgtaaagggaagctgtgcagc

SEQ ID NO: 629879 - DNA, 25 bp, Rattus norvegicus
tccgtgtgtttctgtaaagggaagc

SEQ ID NO: 629880 - DNA, 25 bp, Rattus norvegicus
tcccgctgtgcctgctccgtgtgtt

SEQ ID NO: 629881 - DNA, 25 bp, Rattus norvegicus
gtgtttgtcccgctgtgcctgctcc

SEQ ID NO: 629882 - DNA, 25 bp, Rattus norvegicus
cttctcggggagtgtttgtcccgct

SEQ ID NO: 629883 - DNA, 25 bp, Rattus norvegicus
gagcttctcggggagtgtttgtccc

SEQ ID NO: 629884 - DNA, 25 bp, Rattus norvegicus
accgcccgttgggaagagcttctcg

SEQ ID NO: 629885 - DNA, 25 bp, Rattus norvegicus
ccaccgcccgttgggaagagcttct

SEQ ID NO: 629886 - DNA, 25 bp, Rattus norvegicus
ggcccgagccggtgtgaggcttccc

SEQ ID NO: 629887 - DNA, 25 bp, Rattus norvegicus
gaaggcagccggtttagcaccgacc

SEQ ID NO: 629888 - DNA, 25 bp, Rattus norvegicus
acaatttgcgaaacagcggtctcca

SEQ ID NO: 629889 - DNA, 25 bp, Rattus norvegicus
agcggtctccatccaaaacagggga

SEQ ID NO: 629890 - DNA, 25 bp, Rattus norvegicus
caggggaaatcgatgaccggtaccg

SEQ ID NO: 629891 - DNA, 25 bp, Rattus norvegicus
cccacaacaggctcaggtgattggc

SEQ ID NO: 629892 - DNA, 25 bp, Rattus norvegicus
gatcacagctcagataggggacctg

SEQ ID NO: 629893 - DNA, 25 bp, Rattus norvegicus
cgcgctcggacaggatcacagctca

SEQ ID NO: 629894 - DNA, 25 bp, Rattus norvegicus
acctagactcagacgcgggaaaacg

SEQ ID NO: 629895 - DNA, 25 bp, Rattus norvegicus
tcagtgcagcccgagctcacctaga

SEQ ID NO: 629896 - DNA, 25 bp, Rattus norvegicus
gaagccaattccgtgcccagggatg

SEQ ID NO: 629897 - DNA, 25 bp, Rattus norvegicus
cgtctaggtgcagctgaagccaatt

SEQ ID NO: 629898 - DNA, 25 bp, Rattus norvegicus
gagctggcactgctctgcgcgtcta

SEQ ID NO: 629899 - DNA, 25 bp, Rattus norvegicus
ggaccttagcgagccgggacaccga

SEQ ID NO: 629900 - DNA, 25 bp, Rattus norvegicus
ccgcacaaagtggaggacctgcctt

SEQ ID NO: 629901 - DNA, 25 bp, Rattus norvegicus
cgttccactcgaggacgtgcctcgt

SEQ ID NO: 629902 - DNA, 25 bp, Rattus norvegicus
cgctgctctgaacggcaggagcctg

SEQ ID NO: 629903 - DNA, 25 bp, Rattus norvegicus
ccgctgctctgaacggcaggagcct

SEQ ID NO: 629904 - DNA, 25 bp, Rattus norvegicus
acccgctgctctgaacggcaggagc

SEQ ID NO: 629905 - DNA, 25 bp, Rattus norvegicus
gcacccgctgctctgaacggcagga

SEQ ID NO: 629906 - DNA, 25 bp, Rattus norvegicus
gtggtcgagtcacgcacccgctgct

SEQ ID NO: 629907 - DNA, 25 bp, Rattus norvegicus
gcgtggtcgagtcacgcacccgctg

SEQ ID NO: 629908 - DNA, 25 bp, Rattus norvegicus
tggcgtggtcgagtcacgcacccgc

SEQ ID NO: 629909 - DNA, 25 bp, Rattus norvegicus
cttggcgtggtcgagtcacgcaccc

SEQ ID NO: 629910 - DNA, 25 bp, Rattus norvegicus
tcctggcttggcgtggtcgagtcac

SEQ ID NO: 629911 - DNA, 25 bp, Rattus norvegicus
acgtgcctcgtggggcttcctggct

SEQ ID NO: 629912 - DNA, 25 bp, Rattus norvegicus
tccactcgaggacgtgcctcgtggg

SEQ ID NO: 629913 - DNA, 25 bp, Rattus norvegicus
gttccactcgaggacgtgcctcgtg

SEQ ID NO: 629914 - DNA, 25 bp, Rattus norvegicus
tgctctgaacggcaggagcctgacg

SEQ ID NO: 629915 - DNA, 25 bp, Rattus norvegicus
ggagctgtgctcgaaaagtttgaaa

SEQ ID NO: 629916 - DNA, 25 bp, Rattus norvegicus
gtgtgtcagggagcctcgtttccca

SEQ ID NO: 629917 - DNA, 25 bp, Rattus norvegicus
cggcctccacaacggagtgtctgct

SEQ ID NO: 629918 - DNA, 25 bp, Rattus norvegicus
tccacaacggagtgtctgcttgctc

SEQ ID NO: 629919 - DNA, 25 bp, Rattus norvegicus
acaacggagtgtctgcttgctcttt

SEQ ID NO: 629920 - DNA, 25 bp, Rattus norvegicus
ctctttgagaattcagggagctgtg

SEQ ID NO: 629921 - DNA, 25 bp, Rattus norvegicus
tcagggagctgtgctcgaaaagttt

SEQ ID NO: 629922 - DNA, 25 bp, Rattus norvegicus
tgtgctcgaaaagtttgaaaggctc

SEQ ID NO: 629923 - DNA, 25 bp, Rattus norvegicus
ggctctgccgtctaacaaacgtttg

SEQ ID NO: 629924 - DNA, 25 bp, Rattus norvegicus
gccgtctaacaaacgtttgtcgtga

SEQ ID NO: 629925 - DNA, 25 bp, Rattus norvegicus
tctgtgcccaaaggtctgcaccctg

SEQ ID NO: 629926 - DNA, 25 bp, Rattus norvegicus
caaaggtctgcaccctgcggcacag

SEQ ID NO: 629927 - DNA, 25 bp, Rattus norvegicus
ttgaaaggctctgccgtctaacaaa

SEQ ID NO: 629928 - DNA, 25 bp, Rattus norvegicus
tgcggcacagcctggccaagtgtgt

SEQ ID NO: 629929 - DNA, 25 bp, Rattus norvegicus
acacacgggcgcgagccacggtacg

SEQ ID NO: 629930 - DNA, 25 bp, Rattus norvegicus
tcctctgtatgacgcgggggaaaat

SEQ ID NO: 629931 - DNA, 25 bp, Rattus norvegicus
ccctaggctgatgcttggctattct

SEQ ID NO: 629932 - DNA, 25 bp, Rattus norvegicus
ctgatgcttggctattctgaaacgc

SEQ ID NO: 629933 - DNA, 25 bp, Rattus norvegicus
ggctattctgaaacgcacacggaga

SEQ ID NO: 629934 - DNA, 25 bp, Rattus norvegicus
cgcacacggagagcagcaacttcgg

SEQ ID NO: 629935 - DNA, 25 bp, Rattus norvegicus
ttctgaaacgcacacggagagcagc

SEQ ID NO: 629936 - DNA, 25 bp, Rattus norvegicus
atgcgaggcggtcctctgtatgacg

SEQ ID NO: 629937 - DNA, 25 bp, Rattus norvegicus
agcaacttcggagcgtttcggaggt

SEQ ID NO: 629938 - DNA, 25 bp, Rattus norvegicus
ggagctctgtgaagccaaacccaaa

SEQ ID NO: 629939 - DNA, 25 bp, Rattus norvegicus
aacgatgccgaccaacacacacggg

SEQ ID NO: 629940 - DNA, 25 bp, Rattus norvegicus
cctccagggacgtccaagcgcttgt

SEQ ID NO: 629941 - DNA, 25 bp, Rattus norvegicus
cgtccaagcgcttgtcacgtgacgg

SEQ ID NO: 629942 - DNA, 25 bp, Rattus norvegicus
gagagcagcaacttcggagcgtttc

SEQ ID NO: 629943 - DNA, 25 bp, Rattus norvegicus
ctggactaaagtctccacgcacgca

SEQ ID NO: 629944 - DNA, 25 bp, Rattus norvegicus
tcgttttgacgccagagcgacgcgc

SEQ ID NO: 629945 - DNA, 25 bp, Rattus norvegicus
tgcgggcctcggagacccgaactcg

SEQ ID NO: 629946 - DNA, 25 bp, Rattus norvegicus
tcgatcccaggttccctcagtgcga

SEQ ID NO: 629947 - DNA, 25 bp, Rattus norvegicus
gacaggcttctcaaccgggcgctca

SEQ ID NO: 629948 - DNA, 25 bp, Rattus norvegicus
ggcgtgcgtcctcgaccctgtgttc

SEQ ID NO: 629949 - DNA, 25 bp, Rattus norvegicus
tcagtcccttaggacaggcttctca

SEQ ID NO: 629950 - DNA, 25 bp, Rattus norvegicus
agagccagcgctcagtcccttagga

SEQ ID NO: 629951 - DNA, 25 bp, Rattus norvegicus
gcacagcccattgacgtcgttttga

SEQ ID NO: 629952 - DNA, 25 bp, Rattus norvegicus
ctcgctcattccttgacactgtgtc

SEQ ID NO: 629953 - DNA, 25 bp, Rattus norvegicus
ccgaattccctagtcagagccctag

SEQ ID NO: 629954 - DNA, 25 bp, Rattus norvegicus
agagccctaggatcctaggctccca

SEQ ID NO: 629955 - DNA, 25 bp, Rattus norvegicus
tttcaccgtgctcccgtccgttaga

SEQ ID NO: 629956 - DNA, 25 bp, Rattus norvegicus
ccgtccgttagagccagcgctcagt

SEQ ID NO: 629957 - DNA, 25 bp, Rattus norvegicus
agccagctcgaagagggcgggctgc

SEQ ID NO: 629958 - DNA, 25 bp, Rattus norvegicus
ctcgcggagtgtgccaggttgatcc

SEQ ID NO: 629959 - DNA, 25 bp, Rattus norvegicus
aaagagtgaggacgcgcgtgcgcag

SEQ ID NO: 629960 - DNA, 25 bp, Rattus norvegicus
acctggcagcgggtgagaaggctgc

SEQ ID NO: 629961 - DNA, 25 bp, Rattus norvegicus
cgcgcgcgcaccatgggtgaaaaac

SEQ ID NO: 629962 - DNA, 25 bp, Rattus norvegicus
cgcgcaccatgggtgaaaaacccgg

SEQ ID NO: 629963 - DNA, 25 bp, Rattus norvegicus
acgcctgggtccctagagggtagct

SEQ ID NO: 629964 - DNA, 25 bp, Rattus norvegicus
gtgccaggttgatccacagacaagg

SEQ ID NO: 629965 - DNA, 25 bp, Rattus norvegicus
ccaggttgatccacagacaaggaca

SEQ ID NO: 629966 - DNA, 25 bp, Rattus norvegicus
ttgatccacagacaaggacaccggg

SEQ ID NO: 629967 - DNA, 25 bp, Rattus norvegicus
cacagacaaggacaccggggaagaa

SEQ ID NO: 629968 - DNA, 25 bp, Rattus norvegicus
ctgggtccctagagggtagctgtcc

SEQ ID NO: 629969 - DNA, 25 bp, Rattus norvegicus
gagatcgagagtagggacggcgcga

SEQ ID NO: 629970 - DNA, 25 bp, Rattus norvegicus
ggagtgtgccaggttgatccacaga

SEQ ID NO: 629971 - DNA, 25 bp, Rattus norvegicus
agcgctagtcacagtgggcttcatg

SEQ ID NO: 629972 - DNA, 25 bp, Rattus norvegicus
gaggcagagcttttgaggtcccgat

SEQ ID NO: 629973 - DNA, 25 bp, Rattus norvegicus
cccgtcatctgagtgactcgatact

SEQ ID NO: 629974 - DNA, 25 bp, Rattus norvegicus
ctaaccgcgagcgtcttctgaggtg

SEQ ID NO: 629975 - DNA, 25 bp, Rattus norvegicus
gtcgcggcacatgcgcgacagtgtc

SEQ ID NO: 629976 - DNA, 25 bp, Rattus norvegicus
cgtgatgaaggaagaaggtgtttat

SEQ ID NO: 629977 - DNA, 25 bp, Rattus norvegicus
tggctccatggaccgattccgaggt

SEQ ID NO: 629978 - DNA, 25 bp, Rattus norvegicus
agctgtgatctgtcgacggctgtga

SEQ ID NO: 629979 - DNA, 25 bp, Rattus norvegicus
gggcttcatgccacgagctgtgatc

SEQ ID NO: 629980 - DNA, 25 bp, Rattus norvegicus
actcgatactgggtgagaagcgcta

SEQ ID NO: 629981 - DNA, 25 bp, Rattus norvegicus
aatcgcagggcagcgagaaagagcc

SEQ ID NO: 629982 - DNA, 25 bp, Rattus norvegicus
agaagctgtactgtgggtaatcgca

SEQ ID NO: 629983 - DNA, 25 bp, Rattus norvegicus
tctctgtctcggagtagaagctgta

SEQ ID NO: 629984 - DNA, 25 bp, Rattus norvegicus
ttgtctttacctaaccgcgagcgtc

SEQ ID NO: 629985 - DNA, 25 bp, Rattus norvegicus
agtcgcgtcgcgactaggccggtaa

SEQ ID NO: 629986 - DNA, 25 bp, Rattus norvegicus
cgactaggccggtaaggcagggcga

SEQ ID NO: 629987 - DNA, 25 bp, Rattus norvegicus
cagcggcctgatctggttggagacc

SEQ ID NO: 629988 - DNA, 25 bp, Rattus norvegicus
cctgatctggttggagaccctggcc

SEQ ID NO: 629989 - DNA, 25 bp, Rattus norvegicus
tgatctggttggagaccctggccgt

SEQ ID NO: 629990 - DNA, 25 bp, Rattus norvegicus
cgcaggtggagcatccctttagaga

SEQ ID NO: 629991 - DNA, 25 bp, Rattus norvegicus
gcatccctttagagagtctggcttg

SEQ ID NO: 629992 - DNA, 25 bp, Rattus norvegicus
gtctggcttgctgctactgcaagga

SEQ ID NO: 629993 - DNA, 25 bp, Rattus norvegicus
cgcaaggcgagtcgcgtcgcgacta

SEQ ID NO: 629994 - DNA, 25 bp, Rattus norvegicus
tgctactgcaaggaccagaataagg

SEQ ID NO: 629995 - DNA, 25 bp, Rattus norvegicus
gtggagcatccctttagagagtctg

SEQ ID NO: 629996 - DNA, 25 bp, Rattus norvegicus
ctgcaaggaccagaataaggtttgc

SEQ ID NO: 629997 - DNA, 25 bp, Rattus norvegicus
tgctgctactgcaaggaccagaata

SEQ ID NO: 629998 - DNA, 25 bp, Rattus norvegicus
atccctttagagagtctggcttgct

SEQ ID NO: 629999 - DNA, 25 bp, Rattus norvegicus
cctccagtgagaagggcgtccgcga

SEQ ID NO: 630000 - DNA, 25 bp, Rattus norvegicus
aatccagatcgctcggcggctagcc

SEQ ID NO: 630001 - DNA, 25 bp, Rattus norvegicus
ggtgcgatggctcccgccatgcagt

SEQ ID NO: 630002 - DNA, 25 bp, Rattus norvegicus
gccatgcagtctaccgagctccagt

SEQ ID NO: 630003 - DNA, 25 bp, Rattus norvegicus
taccgagctccagttcgcacagcgg

SEQ ID NO: 630004 - DNA, 25 bp, Rattus norvegicus
tcgcacagcggctggcctccagtga

SEQ ID NO: 630005 - DNA, 25 bp, Rattus norvegicus
ggggctacgtatctactcgcacagg

SEQ ID NO: 630006 - DNA, 25 bp, Rattus norvegicus
gcgcaggcgcaatccagatcgctcg

SEQ ID NO: 630007 - DNA, 25 bp, Rattus norvegicus
gcaagcggcgcaccggtgacgccat

SEQ ID NO: 630008 - DNA, 25 bp, Rattus norvegicus
gccgtgaggaaactgcggcagtatc

SEQ ID NO: 630009 - DNA, 25 bp, Rattus norvegicus
cggcagtatctcagcgcaaggacgc

SEQ ID NO: 630010 - DNA, 25 bp, Rattus norvegicus
caaggacgcagagcgacacaggtgc

SEQ ID NO: 630011 - DNA, 25 bp, Rattus norvegicus
gcggcagagctcctgaccgctagtc

SEQ ID NO: 630012 - DNA, 25 bp, Rattus norvegicus
tatctactcgcacaggggccacgcg

SEQ ID NO: 630013 - DNA, 25 bp, Rattus norvegicus
ttggagttacggctccggctgtcca

SEQ ID NO: 630014 - DNA, 25 bp, Rattus norvegicus
tcatcggtcggggaggccacgccac

SEQ ID NO: 630015 - DNA, 25 bp, Rattus norvegicus
agagatttcaagtccggctccgcta

SEQ ID NO: 630016 - DNA, 25 bp, Rattus norvegicus
ggacctcagcgaactaagagatttc

SEQ ID NO: 630017 - DNA, 25 bp, Rattus norvegicus
cgtagtgcctggacctcagcgaact

SEQ ID NO: 630018 - DNA, 25 bp, Rattus norvegicus
ttcttccgcgcaggcgtagtgcctg

SEQ ID NO: 630019 - DNA, 25 bp, Rattus norvegicus
ctgtccagggcactggctcaggatc

SEQ ID NO: 630020 - DNA, 25 bp, Rattus norvegicus
ttgctggggacacagttggagttac

SEQ ID NO: 630021 - DNA, 25 bp, Rattus norvegicus
gctctgaatagagagcacccggcac

SEQ ID NO: 630022 - DNA, 25 bp, Rattus norvegicus
gccacggactacatggctctgaata

SEQ ID NO: 630023 - DNA, 25 bp, Rattus norvegicus
cggttgcccacgtagccacggacta

SEQ ID NO: 630024 - DNA, 25 bp, Rattus norvegicus
ctagcagcccgcctgggttatataa

SEQ ID NO: 630025 - DNA, 25 bp, Rattus norvegicus
tgtacactagcagcccgcctgggtt

SEQ ID NO: 630026 - DNA, 25 bp, Rattus norvegicus
gctcaggatccgctcgccggttctt

SEQ ID NO: 630027 - DNA, 25 bp, Rattus norvegicus
cgtggagtgccctgtattgcttaca

SEQ ID NO: 630028 - DNA, 25 bp, Rattus norvegicus
gcgacacgtgtctctctattcaggg

SEQ ID NO: 630029 - DNA, 25 bp, Rattus norvegicus
gatcagatgcctgtgcgcgctactg

SEQ ID NO: 630030 - DNA, 25 bp, Rattus norvegicus
ggggtcctactgatctctgagtgtc

SEQ ID NO: 630031 - DNA, 25 bp, Rattus norvegicus
cagtgggaactctttggacagcagc

SEQ ID NO: 630032 - DNA, 25 bp, Rattus norvegicus
agagcaatccggcagtctgagcagc

SEQ ID NO: 630033 - DNA, 25 bp, Rattus norvegicus
agcccttgacacgacctggactacg

SEQ ID NO: 630034 - DNA, 25 bp, Rattus norvegicus
gccactacggtcttcccggcatgga

SEQ ID NO: 630035 - DNA, 25 bp, Rattus norvegicus
tccagagccatgttgtccgcggcta

SEQ ID NO: 630036 - DNA, 25 bp, Rattus norvegicus
aggtacgcgcttcactgcttatgta

SEQ ID NO: 630037 - DNA, 25 bp, Rattus norvegicus
gtaacccgtccaggctgctctcttg

SEQ ID NO: 630038 - DNA, 25 bp, Rattus norvegicus
cggacagatcctagtgcacgcaggc

SEQ ID NO: 630039 - DNA, 25 bp, Rattus norvegicus
gcacacggtagtctctgagggtctc

SEQ ID NO: 630040 - DNA, 25 bp, Rattus norvegicus
tccgattaatgaccttggccctctg

SEQ ID NO: 630041 - DNA, 25 bp, Rattus norvegicus
tacggagagagccaactaggagacc

SEQ ID NO: 630042 - DNA, 25 bp, Rattus norvegicus
gtagcacctgaaaccggctgcagga

SEQ ID NO: 630043 - DNA, 25 bp, Rattus norvegicus
accttgtcggcgatctcctgcgtct

SEQ ID NO: 630044 - DNA, 25 bp, Rattus norvegicus
acccgtggcacgtgacagagcgaag

SEQ ID NO: 630045 - DNA, 25 bp, Rattus norvegicus
ccctggacccgtggcacgtgacaga

SEQ ID NO: 630046 - DNA, 25 bp, Rattus norvegicus
ctggaccctagaaaaacctggctcg

SEQ ID NO: 630047 - DNA, 25 bp, Rattus norvegicus
cctgcgtctcggtcgtggccggcat

SEQ ID NO: 630048 - DNA, 25 bp, Rattus norvegicus
gagacctgggtgtctggaccctaga

SEQ ID NO: 630049 - DNA, 25 bp, Rattus norvegicus
tcacagagaagctacggagagagcc

SEQ ID NO: 630050 - DNA, 25 bp, Rattus norvegicus
actggttagaatatcacagagaagc

SEQ ID NO: 630051 - DNA, 25 bp, Rattus norvegicus
ggcaagcactggttagaatatcaca

SEQ ID NO: 630052 - DNA, 25 bp, Rattus norvegicus
ccacacatcatcttggcaagcactg

SEQ ID NO: 630053 - DNA, 25 bp, Rattus norvegicus
ggatggcgcgccacacatcatcttg

SEQ ID NO: 630054 - DNA, 25 bp, Rattus norvegicus
tgtctggaccctagaaaaacctggc

SEQ ID NO: 630055 - DNA, 25 bp, Rattus norvegicus
cgtggtctcagggtcctgctcacca

SEQ ID NO: 630056 - DNA, 25 bp, Rattus norvegicus
gccggcatcgtccagaacgcttgac

SEQ ID NO: 630057 - DNA, 25 bp, Rattus norvegicus
cgcttgacgtttcgcgtgttgtgtc

SEQ ID NO: 630058 - DNA, 25 bp, Rattus norvegicus
tgttgtgtcgcgtcaatgtgacgtc

SEQ ID NO: 630059 - DNA, 25 bp, Rattus norvegicus
acgcacacgtgtcgtcactcgagcg

SEQ ID NO: 630060 - DNA, 25 bp, Rattus norvegicus
tgctcaccatggttcccggagtgcc

SEQ ID NO: 630061 - DNA, 25 bp, Rattus norvegicus
gcgcgttacggaagctgcagaagta

SEQ ID NO: 630062 - DNA, 25 bp, Rattus norvegicus
cagaagtacatcgtggccaggagtc

SEQ ID NO: 630063 - DNA, 25 bp, Rattus norvegicus
ttggctcagactgacccggtcggac

SEQ ID NO: 630064 - DNA, 25 bp, Rattus norvegicus
ctcctcctgtagcttgctgatgctc

SEQ ID NO: 630065 - DNA, 25 bp, Rattus norvegicus
tgctgatgctcttcaccggcccata

SEQ ID NO: 630066 - DNA, 25 bp, Rattus norvegicus
ctttcccgggacgtgcattttgcta

SEQ ID NO: 630067 - DNA, 25 bp, Rattus norvegicus
cttcgtctgcgattctcttggctca

SEQ ID NO: 630068 - DNA, 25 bp, Rattus norvegicus
atgtgacgtcgcaatggtgtcgcgc

SEQ ID NO: 630069 - DNA, 25 bp, Rattus norvegicus
gggaaccttgctcggctcctggctt

SEQ ID NO: 630070 - DNA, 25 bp, Rattus norvegicus
gactctgggaggaccgcaggcggct

SEQ ID NO: 630071 - DNA, 25 bp, Rattus norvegicus
cccgcccgctgtccgttggccgagg

SEQ ID NO: 630072 - DNA, 25 bp, Rattus norvegicus
accttgctcggctcctggcttctcg

SEQ ID NO: 630073 - DNA, 25 bp, Rattus norvegicus
cggaactgtgggatcgccgcgcaca

SEQ ID NO: 630074 - DNA, 25 bp, Rattus norvegicus
ccgcgcacaggaagtggcggcggcg

SEQ ID NO: 630075 - DNA, 25 bp, Rattus norvegicus
aaccgcgaccagcaggtggagtgca

SEQ ID NO: 630076 - DNA, 25 bp, Rattus norvegicus
gagtgcaggtgagcggcgccgagcc

SEQ ID NO: 630077 - DNA, 25 bp, Rattus norvegicus
tcctgtgcggcctgcccggctcgcc

SEQ ID NO: 630078 - DNA, 25 bp, Rattus norvegicus
atgccgggcccggtgagagggcctg

SEQ ID NO: 630079 - DNA, 25 bp, Rattus norvegicus
cgatcggggagacatggggatgccg

SEQ ID NO: 630080 - DNA, 25 bp, Rattus norvegicus
tgggtctaggaacaccccgctggtc

SEQ ID NO: 630081 - DNA, 25 bp, Rattus norvegicus
cccgcccggctcctgtgcggcctgc

SEQ ID NO: 630082 - DNA, 25 bp, Rattus norvegicus
ccgcgcatccgtccgcgcgtgtccc

SEQ ID NO: 630083 - DNA, 25 bp, Rattus norvegicus
tgggcaactcccacctacgctgaca

SEQ ID NO: 630084 - DNA, 25 bp, Rattus norvegicus
acgctgagctttgggtcctgccctg

SEQ ID NO: 630085 - DNA, 25 bp, Rattus norvegicus
cagccgacgctgagctttgggtcct

SEQ ID NO: 630086 - DNA, 25 bp, Rattus norvegicus
gacccgctgtgcagccgacgctgag

SEQ ID NO: 630087 - DNA, 25 bp, Rattus norvegicus
tgacctccgacctttccgccggtga

SEQ ID NO: 630088 - DNA, 25 bp, Rattus norvegicus
gctgacacagctgacctccgacctt

SEQ ID NO: 630089 - DNA, 25 bp, Rattus norvegicus
atcgtcacctgtaagtgcggccggg

SEQ ID NO: 630090 - DNA, 25 bp, Rattus norvegicus
acaagcctatcgtcacctgtaagtg

SEQ ID NO: 630091 - DNA, 25 bp, Rattus norvegicus
tggagaacaagcctatcgtcacctg

SEQ ID NO: 630092 - DNA, 25 bp, Rattus norvegicus
ctacaccatggagaacaagcctatc

SEQ ID NO: 630093 - DNA, 25 bp, Rattus norvegicus
ccggtggtctacaccatggagaaca

SEQ ID NO: 630094 - DNA, 25 bp, Rattus norvegicus
cctgaggagccacagccaccggtgg

SEQ ID NO: 630095 - DNA, 25 bp, Rattus norvegicus
ttgctgtgtgctgtcagagctgcta

SEQ ID NO: 630096 - DNA, 25 bp, Rattus norvegicus
acagccaccggtggtctacaccatg

SEQ ID NO: 630097 - DNA, 25 bp, Rattus norvegicus
ggctccgggatgaaattcgcttatc

SEQ ID NO: 630098 - DNA, 25 bp, Rattus norvegicus
gggtcggcccatcgcaagctgtcgc

SEQ ID NO: 630099 - DNA, 25 bp, Rattus norvegicus
gaaagcactggtgggtcggcccatc

SEQ ID NO: 630100 - DNA, 25 bp, Rattus norvegicus
ctcggctgcccacggaaagcactgg

SEQ ID NO: 630101 - DNA, 25 bp, Rattus norvegicus
aggtcgttggcatctcggctgccca

SEQ ID NO: 630102 - DNA, 25 bp, Rattus norvegicus
aagagaccgaggtcgttggcatctc

SEQ ID NO: 630103 - DNA, 25 bp, Rattus norvegicus
ttccgcacgtgtggctccgggatga

SEQ ID NO: 630104 - DNA, 25 bp, Rattus norvegicus
aaattcgcttatcgggtgagccgcg

SEQ ID NO: 630105 - DNA, 25 bp, Rattus norvegicus
tcgtattccggaagtggctggagca

SEQ ID NO: 630106 - DNA, 25 bp, Rattus norvegicus
gagcgccggagatagttcgtattcc

SEQ ID NO: 630107 - DNA, 25 bp, Rattus norvegicus
ttacgcattttgagcgccggagata

SEQ ID NO: 630108 - DNA, 25 bp, Rattus norvegicus
cccggaattacgcattttgagcgcc

SEQ ID NO: 630109 - DNA, 25 bp, Rattus norvegicus
tcctggaacactatggttgaggccc

SEQ ID NO: 630110 - DNA, 25 bp, Rattus norvegicus
gggcgggacttcctggaacactatg

SEQ ID NO: 630111 - DNA, 25 bp, Rattus norvegicus
cggagctaagtctccagcctgagtc

SEQ ID NO: 630112 - DNA, 25 bp, Rattus norvegicus
tagtgttcgctacagtggcctctgc

SEQ ID NO: 630113 - DNA, 25 bp, Rattus norvegicus
tggcgccgcacctcgcaaaagacag

SEQ ID NO: 630114 - DNA, 25 bp, Rattus norvegicus
caaaagacagcctgcggggctttcc

SEQ ID NO: 630115 - DNA, 25 bp, Rattus norvegicus
tccactggaacgatggctacctaca

SEQ ID NO: 630116 - DNA, 25 bp, Rattus norvegicus
tacctacagcctggcgaacgagcgg

SEQ ID NO: 630117 - DNA, 25 bp, Rattus norvegicus
acactgaatgctggccttagggcgg

SEQ ID NO: 630118 - DNA, 25 bp, Rattus norvegicus
aagcgcgttgagcatcctgggaatt

SEQ ID NO: 630119 - DNA, 25 bp, Rattus norvegicus
agcctgagtctaataccgccctcta

SEQ ID NO: 630120 - DNA, 25 bp, Rattus norvegicus
cgaacgagcgtctcctagaccggca

SEQ ID NO: 630121 - DNA, 25 bp, Rattus norvegicus
gcgccatcctccagaacgcaggttt

SEQ ID NO: 630122 - DNA, 25 bp, Rattus norvegicus
cttcaccgcttctgtgcagcacgtg

SEQ ID NO: 630123 - DNA, 25 bp, Rattus norvegicus
cgcaggcgcacaataacaggcattt

SEQ ID NO: 630124 - DNA, 25 bp, Rattus norvegicus
gaggcagagctgtccgctcagatcc

SEQ ID NO: 630125 - DNA, 25 bp, Rattus norvegicus
ggccgtggaacaagggcatcacatc

SEQ ID NO: 630126 - DNA, 25 bp, Rattus norvegicus
agggcatcacatcgggtcagggtca

SEQ ID NO: 630127 - DNA, 25 bp, Rattus norvegicus
gcctggcaatcatcgtcgacgaagg

SEQ ID NO: 630128 - DNA, 25 bp, Rattus norvegicus
atcgtcgacgaaggtaatggatgtg

SEQ ID NO: 630129 - DNA, 25 bp, Rattus norvegicus
actggggcggccctgcatcttctgg

SEQ ID NO: 630130 - DNA, 25 bp, Rattus norvegicus
ccctgcatcttctgggccgtggaac

SEQ ID NO: 630131 - DNA, 25 bp, Rattus norvegicus
atcttctgggccgtggaacaagggc

SEQ ID NO: 630132 - DNA, 25 bp, Rattus norvegicus
tcagggtcagcctcatagcacgggt

SEQ ID NO: 630133 - DNA, 25 bp, Rattus norvegicus
gtcagcctcatagcacgggtccagg

SEQ ID NO: 630134 - DNA, 25 bp, Rattus norvegicus
tcatagcacgggtccaggcagtccg

SEQ ID NO: 630135 - DNA, 25 bp, Rattus norvegicus
acgggtccaggcagtccgtgtcgca

SEQ ID NO: 630136 - DNA, 25 bp, Rattus norvegicus
ggtcgggtggccaccgtctcactct

SEQ ID NO: 630137 - DNA, 25 bp, Rattus norvegicus
gtctcactctctcgcaggaggcgcc

SEQ ID NO: 630138 - DNA, 25 bp, Rattus norvegicus
tggaacaagggcatcacatcgggtc

SEQ ID NO: 630139 - DNA, 25 bp, Rattus norvegicus
gctgcggagtctatgacggaaccga

SEQ ID NO: 630140 - DNA, 25 bp, Rattus norvegicus
tggggttcccattcacagtcgttca

SEQ ID NO: 630141 - DNA, 25 bp, Rattus norvegicus
ttgtccgctctggaaaatggttctg

SEQ ID NO: 630142 - DNA, 25 bp, Rattus norvegicus
ggcctcagcgtaagtcctcagagtt

SEQ ID NO: 630143 - DNA, 25 bp, Rattus norvegicus
ttcaggaaagggctcactgcgcgct

SEQ ID NO: 630144 - DNA, 25 bp, Rattus norvegicus
tactgtcgctgtctgcccttcgcga

SEQ ID NO: 630145 - DNA, 25 bp, Rattus norvegicus
aggttggcttctgcgctcctaccgc

SEQ ID NO: 630146 - DNA, 25 bp, Rattus norvegicus
tcgtcagtgcctctcttcctgcagg

SEQ ID NO: 630147 - DNA, 25 bp, Rattus norvegicus
cgttggtgagtacagggtcagactc

SEQ ID NO: 630148 - DNA, 25 bp, Rattus norvegicus
tcacagtcgttcactgcgcaagcgc

SEQ ID NO: 630149 - DNA, 25 bp, Rattus norvegicus
cagaaatggccagagcgtcgtaacc

SEQ ID NO: 630150 - DNA, 25 bp, Rattus norvegicus
cggaaccgagatccacgaggcctca

SEQ ID NO: 630151 - DNA, 25 bp, Rattus norvegicus
ggtcgatcacctgtccgcccaaggt

SEQ ID NO: 630152 - DNA, 25 bp, Rattus norvegicus
ggtcagactcccaggccatgtgcct

SEQ ID NO: 630153 - DNA, 25 bp, Rattus norvegicus
ggcagtactcgcagccagtactcga

SEQ ID NO: 630154 - DNA, 25 bp, Rattus norvegicus
caacgccgccgtggacttgggccag

SEQ ID NO: 630155 - DNA, 25 bp, Rattus norvegicus
ttctgacactgcaacgccgccgtgg

SEQ ID NO: 630156 - DNA, 25 bp, Rattus norvegicus
acgctgctcttctgacactgcaacg

SEQ ID NO: 630157 - DNA, 25 bp, Rattus norvegicus
agccagtactcgaactggacgcatt

SEQ ID NO: 630158 - DNA, 25 bp, Rattus norvegicus
gatctgcacctgagcgatcgcgcca

SEQ ID NO: 630159 - DNA, 25 bp, Rattus norvegicus
tttgcggtggggagtcttcagtccc

SEQ ID NO: 630160 - DNA, 25 bp, Rattus norvegicus
cactttccgcaggtcggttgccaga

SEQ ID NO: 630161 - DNA, 25 bp, Rattus norvegicus
tccctgcactttccgcaggtcggtt

SEQ ID NO: 630162 - DNA, 25 bp, Rattus norvegicus
ggcgccttgagctaagtagcctcaa

SEQ ID NO: 630163 - DNA, 25 bp, Rattus norvegicus
taaccgcaccgcgtcgcgtttgcgg

SEQ ID NO: 630164 - DNA, 25 bp, Rattus norvegicus
gctctccagaccctacacgctgctc

SEQ ID NO: 630165 - DNA, 25 bp, Rattus norvegicus
gccctttccctctgagctccctgca

SEQ ID NO: 630166 - DNA, 25 bp, Rattus norvegicus
tctgcctggcgccttgagctaagta

SEQ ID NO: 630167 - DNA, 25 bp, Rattus norvegicus
tacgggacacaaccgagagcggact

SEQ ID NO: 630168 - DNA, 25 bp, Rattus norvegicus
gtcctcggagcccacggagaatttg

SEQ ID NO: 630169 - DNA, 25 bp, Rattus norvegicus
tgcagcaggttagcactgcgccgcc

SEQ ID NO: 630170 - DNA, 25 bp, Rattus norvegicus
cggcgtctaagccagtgcccagggc

SEQ ID NO: 630171 - DNA, 25 bp, Rattus norvegicus
acaggctgtaactgcgctcgcaagc

SEQ ID NO: 630172 - DNA, 25 bp, Rattus norvegicus
gcctccgctcttcgagtcgggaacg

SEQ ID NO: 630173 - DNA, 25 bp, Rattus norvegicus
ggctgctgtgcgtcttcaccttcag

SEQ ID NO: 630174 - DNA, 25 bp, Rattus norvegicus
cccgttctcttcctagggtgcagca

SEQ ID NO: 630175 - DNA, 25 bp, Rattus norvegicus
ctctcagccctagttcgggtgggtc

SEQ ID NO: 630176 - DNA, 25 bp, Rattus norvegicus
agagcggactcactttagctgcata

SEQ ID NO: 630177 - DNA, 25 bp, Rattus norvegicus
cgcgcctggccaattgggcacaatc

SEQ ID NO: 630178 - DNA, 25 bp, Rattus norvegicus
cttcaaggatttggggcgcggaaat

SEQ ID NO: 630179 - DNA, 25 bp, Rattus norvegicus
aaatctggggttgttgaggcttcgc

SEQ ID NO: 630180 - DNA, 25 bp, Rattus norvegicus
gctgcatagtgcgagagcagacttc

SEQ ID NO: 630181 - DNA, 25 bp, Rattus norvegicus
cacccaagggagaagggaacgcaag

SEQ ID NO: 630182 - DNA, 25 bp, Rattus norvegicus
cgccgaagcgcagaccctgtctgga

SEQ ID NO: 630183 - DNA, 25 bp, Rattus norvegicus
tgctgcatgctctggccgaccacga

SEQ ID NO: 630184 - DNA, 25 bp, Rattus norvegicus
gacagcgcctttccgctgctgcatg

SEQ ID NO: 630185 - DNA, 25 bp, Rattus norvegicus
gtggccatagacagcgcctttccgc

SEQ ID NO: 630186 - DNA, 25 bp, Rattus norvegicus
tcgcagtggccatagacagcgcctt

SEQ ID NO: 630187 - DNA, 25 bp, Rattus norvegicus
accgagatcgcagtggccatagaca

SEQ ID NO: 630188 - DNA, 25 bp, Rattus norvegicus
ctgcaccgcaccgagatcgcagtgg

SEQ ID NO: 630189 - DNA, 25 bp, Rattus norvegicus
aggtgcctgcctctcccgatagcac

SEQ ID NO: 630190 - DNA, 25 bp, Rattus norvegicus
cgcagaccctgtctggaggatggct

SEQ ID NO: 630191 - DNA, 25 bp, Rattus norvegicus
ctttccgcggctggggagtaagtat

SEQ ID NO: 630192 - DNA, 25 bp, Rattus norvegicus
cgatagcacctagacacccaaggga

SEQ ID NO: 630193 - DNA, 25 bp, Rattus norvegicus
gtataaacgctcacaggtgcctgcc

SEQ ID NO: 630194 - DNA, 25 bp, Rattus norvegicus
cggctggggagtaagtataaacgct

SEQ ID NO: 630195 - DNA, 25 bp, Rattus norvegicus
acacacctcgaaggttctccgagtc

SEQ ID NO: 630196 - DNA, 25 bp, Rattus norvegicus
tgtgcggcgactccaccgacgtgct

SEQ ID NO: 630197 - DNA, 25 bp, Rattus norvegicus
agaaccgactcccacgccaggcgtg

SEQ ID NO: 630198 - DNA, 25 bp, Rattus norvegicus
tgcaagtcctgctcggcagaaccga

SEQ ID NO: 630199 - DNA, 25 bp, Rattus norvegicus
caggcgaggctgtgcccaccgctgt

SEQ ID NO: 630200 - DNA, 25 bp, Rattus norvegicus
acaggaccaatctccgctgcaagtc

SEQ ID NO: 630201 - DNA, 25 bp, Rattus norvegicus
gtcagcaagctttcctcattccact

SEQ ID NO: 630202 - DNA, 25 bp, Rattus norvegicus
aggttctccgagtcagcaagctttc

SEQ ID NO: 630203 - DNA, 25 bp, Rattus norvegicus
ttcccgatggctgctgtccggccag

SEQ ID NO: 630204 - DNA, 25 bp, Rattus norvegicus
tggcgctgccacttcccgatggctg

SEQ ID NO: 630205 - DNA, 25 bp, Rattus norvegicus
gtgccgctgcctttcactggcgctg

SEQ ID NO: 630206 - DNA, 25 bp, Rattus norvegicus
cgacgtgctgcggtgcgcacactgt

SEQ ID NO: 630207 - DNA, 25 bp, Rattus norvegicus
ggtgcgcacactgtgccgctgcctt

SEQ ID NO: 630208 - DNA, 25 bp, Rattus norvegicus
agagagtagccggtgaccccacaca

SEQ ID NO: 630209 - DNA, 25 bp, Rattus norvegicus
ctggcaaggccatcggagtgctgac

SEQ ID NO: 630210 - DNA, 25 bp, Rattus norvegicus
gatggatctggggtttctgcctatc

SEQ ID NO: 630211 - DNA, 25 bp, Rattus norvegicus
tcatggctaccgtggacctggagaa

SEQ ID NO: 630212 - DNA, 25 bp, Rattus norvegicus
aaggccatcggagtgctgacaagcg

SEQ ID NO: 630213 - DNA, 25 bp, Rattus norvegicus
ctaccgtggacctggagaagttgcg

SEQ ID NO: 630214 - DNA, 25 bp, Rattus norvegicus
ggggtttctgcctatctttaggatc

SEQ ID NO: 630215 - DNA, 25 bp, Rattus norvegicus
atctttaggatctttcgagctcgtc

SEQ ID NO: 630216 - DNA, 25 bp, Rattus norvegicus
ggatctttcgagctcgtccactgcc

SEQ ID NO: 630217 - DNA, 25 bp, Rattus norvegicus
ctagggacctgggtatacgtggcca

SEQ ID NO: 630218 - DNA, 25 bp, Rattus norvegicus
acctgggtatacgtggccagccaac

SEQ ID NO: 630219 - DNA, 25 bp, Rattus norvegicus
gtatacgtggccagccaacctcctg

SEQ ID NO: 630220 - DNA, 25 bp, Rattus norvegicus
gtgtccgcgcagcacgcagacttag

SEQ ID NO: 630221 - DNA, 25 bp, Rattus norvegicus
gcagcacgcagacttagggcacacg

SEQ ID NO: 630222 - DNA, 25 bp, Rattus norvegicus
ctcgaaggcgtgtttagggatggat

SEQ ID NO: 630223 - DNA, 25 bp, Rattus norvegicus
accagcagttgagcttccgcacgct

SEQ ID NO: 630224 - DNA, 25 bp, Rattus norvegicus
ttccgggatcgagaatccgcctcgc

SEQ ID NO: 630225 - DNA, 25 bp, Rattus norvegicus
tccgcacgctgtgcagctctgaagc

SEQ ID NO: 630226 - DNA, 25 bp, Rattus norvegicus
cctggctggcctcaccagcagttga

SEQ ID NO: 630227 - DNA, 25 bp, Rattus norvegicus
tgattccgcctgcatcttgtgtgcg

SEQ ID NO: 630228 - DNA, 25 bp, Rattus norvegicus
gcgagactccgggttttgctgcctg

SEQ ID NO: 630229 - DNA, 25 bp, Rattus norvegicus
acggcctgacttccgggatcgagaa

SEQ ID NO: 630230 - DNA, 25 bp, Rattus norvegicus
tgcgatcccattggcagccaggaga

SEQ ID NO: 630231 - DNA, 25 bp, Rattus norvegicus
tctaggggaggagcctgcgatccca

SEQ ID NO: 630232 - DNA, 25 bp, Rattus norvegicus
tcagctgtacactccactggcggga

SEQ ID NO: 630233 - DNA, 25 bp, Rattus norvegicus
tctttcgtgtcagcttcatggtggc

SEQ ID NO: 630234 - DNA, 25 bp, Rattus norvegicus
gctcgggacagaaccatctttcgtg

SEQ ID NO: 630235 - DNA, 25 bp, Rattus norvegicus
agctctgaagccttggctcgggaca

SEQ ID NO: 630236 - DNA, 25 bp, Rattus norvegicus
gggacctctgattccgcctgcatct

SEQ ID NO: 630237 - DNA, 25 bp, Rattus norvegicus
cgcagactcccgcggcgctaggaag

SEQ ID NO: 630238 - DNA, 25 bp, Rattus norvegicus
tggagaacgcagactcccgcggcgc

SEQ ID NO: 630239 - DNA, 25 bp, Rattus norvegicus
ggagaacgcagactcccgcggcgct

SEQ ID NO: 630240 - DNA, 25 bp, Rattus norvegicus
gagaacgcagactcccgcggcgcta

SEQ ID NO: 630241 - DNA, 25 bp, Rattus norvegicus
aacgcagactcccgcggcgctagga

SEQ ID NO: 630242 - DNA, 25 bp, Rattus norvegicus
agactcccgcggcgctaggaaggca

SEQ ID NO: 630243 - DNA, 25 bp, Rattus norvegicus
ctcccgcggcgctaggaaggcaggt

SEQ ID NO: 630244 - DNA, 25 bp, Rattus norvegicus
cgcggcgctaggaaggcaggtgaca

SEQ ID NO: 630245 - DNA, 25 bp, Rattus norvegicus
caaagggagactggggtcctcctga

SEQ ID NO: 630246 - DNA, 25 bp, Rattus norvegicus
agaacgcagactcccgcggcgctag

SEQ ID NO: 630247 - DNA, 25 bp, Rattus norvegicus
acaaagggagactggggtcctcctg

SEQ ID NO: 630248 - DNA, 25 bp, Rattus norvegicus
agactggggtcctcctgaggtcggt

SEQ ID NO: 630249 - DNA, 25 bp, Rattus norvegicus
actggggtcctcctgaggtcggtgg

SEQ ID NO: 630250 - DNA, 25 bp, Rattus norvegicus
tgacaaagggagactggggtcctcc

SEQ ID NO: 630251 - DNA, 25 bp, Rattus norvegicus
tccgaccttagacctgagacttggg

SEQ ID NO: 630252 - DNA, 25 bp, Rattus norvegicus
ccagtgcagtttacacatcaggccc

SEQ ID NO: 630253 - DNA, 25 bp, Rattus norvegicus
ttccaggctgaggattaggtcccgc

SEQ ID NO: 630254 - DNA, 25 bp, Rattus norvegicus
tcctgaggtcggtggtgataggttc

SEQ ID NO: 630255 - DNA, 25 bp, Rattus norvegicus
gtgataggttccaggctgaggatta

SEQ ID NO: 630256 - DNA, 25 bp, Rattus norvegicus
cccatttgcctttctagggtgctcc

SEQ ID NO: 630257 - DNA, 25 bp, Rattus norvegicus
gggtgctccgaccttagacctgaga

SEQ ID NO: 630258 - DNA, 25 bp, Rattus norvegicus
ccttagacctgagacttggggtgag

SEQ ID NO: 630259 - DNA, 25 bp, Rattus norvegicus
ggggcttagccacgtggcacgccca

SEQ ID NO: 630260 - DNA, 25 bp, Rattus norvegicus
ggcacgcccacggacacttccctta

SEQ ID NO: 630261 - DNA, 25 bp, Rattus norvegicus
ttcccttaccaatgccctagaaagc

SEQ ID NO: 630262 - DNA, 25 bp, Rattus norvegicus
cccagccagtgcagtttacacatca

SEQ ID NO: 630263 - DNA, 25 bp, Rattus norvegicus
tgaggattaggtcccgcgtcgacgc

SEQ ID NO: 630264 - DNA, 25 bp, Rattus norvegicus
gcctttctagggtgctccgacctta

SEQ ID NO: 630265 - DNA, 25 bp, Rattus norvegicus
cgacctggctcgcacatttccggag

SEQ ID NO: 630266 - DNA, 25 bp, Rattus norvegicus
ggacaaactagcgaacgcggccacc

SEQ ID NO: 630267 - DNA, 25 bp, Rattus norvegicus
ctctgggaagctccgaaggcacaca

SEQ ID NO: 630268 - DNA, 25 bp, Rattus norvegicus
gctccgaaggcacacagcagccgtg

SEQ ID NO: 630269 - DNA, 25 bp, Rattus norvegicus
tggccgctcaggtaaagctcccatc

SEQ ID NO: 630270 - DNA, 25 bp, Rattus norvegicus
gggctgcttttcctcttcggtgtct

SEQ ID NO: 630271 - DNA, 25 bp, Rattus norvegicus
ttttcctcttcggtgtctccagcgc

SEQ ID NO: 630272 - DNA, 25 bp, Rattus norvegicus
gcgcacggcgagctctatagatgac

SEQ ID NO: 630273 - DNA, 25 bp, Rattus norvegicus
gctctatagatgaccgcaatcttta

SEQ ID NO: 630274 - DNA, 25 bp, Rattus norvegicus
cgcaatctttaaggtgtcacaggta

SEQ ID NO: 630275 - DNA, 25 bp, Rattus norvegicus
agtgcttggggacaaactagcgaac

SEQ ID NO: 630276 - DNA, 25 bp, Rattus norvegicus
gtggcttaccagccgccctctttta

SEQ ID NO: 630277 - DNA, 25 bp, Rattus norvegicus
aggtgtcacaggtagccgagtgctt

SEQ ID NO: 630278 - DNA, 25 bp, Rattus norvegicus
gctcgcacatttccggagggaagcc

SEQ ID NO: 630279 - DNA, 25 bp, Rattus norvegicus
taccatccatggcttatccgtcagg

SEQ ID NO: 630280 - DNA, 25 bp, Rattus norvegicus
tgcttcacattatacatcgctggtg

SEQ ID NO: 630281 - DNA, 25 bp, Rattus norvegicus
catcgctggtgactatggcgacgtg

SEQ ID NO: 630282 - DNA, 25 bp, Rattus norvegicus
cggcgagcagtattgctagagcgtc

SEQ ID NO: 630283 - DNA, 25 bp, Rattus norvegicus
ttgctagagcgtccggggaccacac

SEQ ID NO: 630284 - DNA, 25 bp, Rattus norvegicus
ctccggctctcaaacgctgcttttg

SEQ ID NO: 630285 - DNA, 25 bp, Rattus norvegicus
tgcacggccctgatgcttcacatta

SEQ ID NO: 630286 - DNA, 25 bp, Rattus norvegicus
gagccgcagtcgcttgctccagctg

SEQ ID NO: 630287 - DNA, 25 bp, Rattus norvegicus
ctccagctggcgtgtcctggaaccg

SEQ ID NO: 630288 - DNA, 25 bp, Rattus norvegicus
cgcgtcctggaggatgtgtacaatc

SEQ ID NO: 630289 - DNA, 25 bp, Rattus norvegicus
tgtgtacaatcgtacccagggcctc

SEQ ID NO: 630290 - DNA, 25 bp, Rattus norvegicus
acggcctgcttcagctggcttgata

SEQ ID NO: 630291 - DNA, 25 bp, Rattus norvegicus
tggtcccagctctgcctccataggg

SEQ ID NO: 630292 - DNA, 25 bp, Rattus norvegicus
aaacgctgcttttgctgcaccgcgc

SEQ ID NO: 630293 - DNA, 25 bp, Rattus norvegicus
agctcggggtcctagaactttgtcg

SEQ ID NO: 630294 - DNA, 25 bp, Rattus norvegicus
cggagcccgtgtctgagaaactttg

SEQ ID NO: 630295 - DNA, 25 bp, Rattus norvegicus
aactcgcacctgcagcgtggccgga

SEQ ID NO: 630296 - DNA, 25 bp, Rattus norvegicus
gccggaggctcgagttgttattttg

SEQ ID NO: 630297 - DNA, 25 bp, Rattus norvegicus
tagacctcacgatcaccttacaggg

SEQ ID NO: 630298 - DNA, 25 bp, Rattus norvegicus
ttacagggattacccggcactcgcc

SEQ ID NO: 630299 - DNA, 25 bp, Rattus norvegicus
cagcatcaactgtccggagggcgat

SEQ ID NO: 630300 - DNA, 25 bp, Rattus norvegicus
taggtgacagcgacagcccagcctt

SEQ ID NO: 630301 - DNA, 25 bp, Rattus norvegicus
gccgcctgactcacgcttatattcg

SEQ ID NO: 630302 - DNA, 25 bp, Rattus norvegicus
cctgcagccgcaagtgtatccggga

SEQ ID NO: 630303 - DNA, 25 bp, Rattus norvegicus
ctagaactttgtcggccggcctcac

SEQ ID NO: 630304 - DNA, 25 bp, Rattus norvegicus
gccggcctcaccctcagaattggag

SEQ ID NO: 630305 - DNA, 25 bp, Rattus norvegicus
agaattggagccttcctacgccgcg

SEQ ID NO: 630306 - DNA, 25 bp, Rattus norvegicus
tattcggccatcagcctcttcaacg

SEQ ID NO: 630307 - DNA, 25 bp, Rattus norvegicus
ggggagccctgtgaaccaagaacca

SEQ ID NO: 630308 - DNA, 25 bp, Rattus norvegicus
gctttggtccaaccggcagccactt

SEQ ID NO: 630309 - DNA, 25 bp, Rattus norvegicus
cagaaggcagaggaacgctttggtc

SEQ ID NO: 630310 - DNA, 25 bp, Rattus norvegicus
ggcacgagtgctaagtcagaaggca

SEQ ID NO: 630311 - DNA, 25 bp, Rattus norvegicus
cgaacattggaagctcggagcggcc

SEQ ID NO: 630312 - DNA, 25 bp, Rattus norvegicus
caaaagacagccgtgtccggagtga

SEQ ID NO: 630313 - DNA, 25 bp, Rattus norvegicus
ccgcgattccggacggttgcaaatg

SEQ ID NO: 630314 - DNA, 25 bp, Rattus norvegicus
tgaaccaagaaccagcacccaagtt

SEQ ID NO: 630315 - DNA, 25 bp, Rattus norvegicus
cgcggaatctgctgcgtcttgcgta

SEQ ID NO: 630316 - DNA, 25 bp, Rattus norvegicus
tgcgtcttgcgtaccgggcttacct

SEQ ID NO: 630317 - DNA, 25 bp, Rattus norvegicus
taccttgggcttctcttccgacatg

SEQ ID NO: 630318 - DNA, 25 bp, Rattus norvegicus
tcttccgacatggttgcgcggcgac

SEQ ID NO: 630319 - DNA, 25 bp, Rattus norvegicus
gagcgggcgagtcacgctctctgcc

SEQ ID NO: 630320 - DNA, 25 bp, Rattus norvegicus
cctcgcgcacggcatgcaaaagaca

SEQ ID NO: 630321 - DNA, 25 bp, Rattus norvegicus
cagcccaaggacagcagacgccatg

SEQ ID NO: 630322 - DNA, 25 bp, Rattus norvegicus
ggctcgcttatgtacgttaaaactg

SEQ ID NO: 630323 - DNA, 25 bp, Rattus norvegicus
ccagtcctggtgattcgctcccaga

SEQ ID NO: 630324 - DNA, 25 bp, Rattus norvegicus
agggacctcagactacaccgagcta

SEQ ID NO: 630325 - DNA, 25 bp, Rattus norvegicus
cagcagcacggcactgaggaacatc

SEQ ID NO: 630326 - DNA, 25 bp, Rattus norvegicus
acaccgagctaggttgtttccactg

SEQ ID NO: 630327 - DNA, 25 bp, Rattus norvegicus
gctcagcctctgtaagcgaaccgga

SEQ ID NO: 630328 - DNA, 25 bp, Rattus norvegicus
actaggctgagctacggtccgcaaa

SEQ ID NO: 630329 - DNA, 25 bp, Rattus norvegicus
ctttgccaggtagagctcttgcgcc

SEQ ID NO: 630330 - DNA, 25 bp, Rattus norvegicus
taaggctcagttgctctgcccaaca

SEQ ID NO: 630331 - DNA, 25 bp, Rattus norvegicus
tgaggaacatcacccagcgcagcgt

SEQ ID NO: 630332 - DNA, 25 bp, Rattus norvegicus
ggcaactctgccctcgctcagtagg

SEQ ID NO: 630333 - DNA, 25 bp, Rattus norvegicus
cctataacgtgagcgtcagaccagc

SEQ ID NO: 630334 - DNA, 25 bp, Rattus norvegicus
tggtcgtcaactctcggcaactctg

SEQ ID NO: 630335 - DNA, 25 bp, Rattus norvegicus
tgaccgtctgcagagtgggaccgac

SEQ ID NO: 630336 - DNA, 25 bp, Rattus norvegicus
accacaacgcttgaccgtctgcaga

SEQ ID NO: 630337 - DNA, 25 bp, Rattus norvegicus
aagggacaggccgtagcccaggcaa

SEQ ID NO: 630338 - DNA, 25 bp, Rattus norvegicus
aggaccgaccacaacgcttgaccgt

SEQ ID NO: 630339 - DNA, 25 bp, Rattus norvegicus
aatgagcactgctcgggaccggccg

SEQ ID NO: 630340 - DNA, 25 bp, Rattus norvegicus
acgcttgaccgtctgcagagtggga

SEQ ID NO: 630341 - DNA, 25 bp, Rattus norvegicus
cgggtccgcagagccggactgcaca

SEQ ID NO: 630342 - DNA, 25 bp, Rattus norvegicus
agggtgggacatgacgagctccgca

SEQ ID NO: 630343 - DNA, 25 bp, Rattus norvegicus
gggatccaccgcagcgcatgccgga

SEQ ID NO: 630344 - DNA, 25 bp, Rattus norvegicus
agccggactgcacaagagtcagatg

SEQ ID NO: 630345 - DNA, 25 bp, Rattus norvegicus
tgcacaagagtcagatggaccgcta

SEQ ID NO: 630346 - DNA, 25 bp, Rattus norvegicus
cagatggaccgctagctgcaaggga

SEQ ID NO: 630347 - DNA, 25 bp, Rattus norvegicus
gaccgctagctgcaagggacaggcc

SEQ ID NO: 630348 - DNA, 25 bp, Rattus norvegicus
ctcggaatgagcactgctcgggacc

SEQ ID NO: 630349 - DNA, 25 bp, Rattus norvegicus
gcacttccgggaggcacttcctcta

SEQ ID NO: 630350 - DNA, 25 bp, Rattus norvegicus
atgcaccctacgcttctatcgttta

SEQ ID NO: 630351 - DNA, 25 bp, Rattus norvegicus
aacgcgatgctgcacacagagaccc

SEQ ID NO: 630352 - DNA, 25 bp, Rattus norvegicus
taaaaccggcctgaacctgtctctc

SEQ ID NO: 630353 - DNA, 25 bp, Rattus norvegicus
tcgtttatttccctggctctatgca

SEQ ID NO: 630354 - DNA, 25 bp, Rattus norvegicus
caaaggttctccagcggccacagta

SEQ ID NO: 630355 - DNA, 25 bp, Rattus norvegicus
tagcgctcggcgtaagcaccgcaac

SEQ ID NO: 630356 - DNA, 25 bp, Rattus norvegicus
gcggctctatttccggtcctcagtg

SEQ ID NO: 630357 - DNA, 25 bp, Rattus norvegicus
acttcctctagtgtgtcggcgttgc

SEQ ID NO: 630358 - DNA, 25 bp, Rattus norvegicus
tcggcgttgctagcaggcagaaacc

SEQ ID NO: 630359 - DNA, 25 bp, Rattus norvegicus
agggaggctacacccagcgctgtac

SEQ ID NO: 630360 - DNA, 25 bp, Rattus norvegicus
ctctatgcaagagcaaaggttctcc

SEQ ID NO: 630361 - DNA, 25 bp, Rattus norvegicus
gggatcgccgaaagccgctctacgc

SEQ ID NO: 630362 - DNA, 25 bp, Rattus norvegicus
gcgcatatctaacacgctagcggta

SEQ ID NO: 630363 - DNA, 25 bp, Rattus norvegicus
ctctccgacaggaggttgtgctcgc

SEQ ID NO: 630364 - DNA, 25 bp, Rattus norvegicus
gcctccgtcgatcttctcagtacgt

SEQ ID NO: 630365 - DNA, 25 bp, Rattus norvegicus
gtcgatcttctcagtacgtgtcgga

SEQ ID NO: 630366 - DNA, 25 bp, Rattus norvegicus
ctcaggcctcctcagtgcggagttc

SEQ ID NO: 630367 - DNA, 25 bp, Rattus norvegicus
ttcgagtctccctagcgacgcacga

SEQ ID NO: 630368 - DNA, 25 bp, Rattus norvegicus
ttctcagtacgtgtcggaggcggct

SEQ ID NO: 630369 - DNA, 25 bp, Rattus norvegicus
accgtgcgcctctccgacaggaggt

SEQ ID NO: 630370 - DNA, 25 bp, Rattus norvegicus
caggacggctcgtccgctcctggag

SEQ ID NO: 630371 - DNA, 25 bp, Rattus norvegicus
ggtccacttggatgcgctgcgctgc

SEQ ID NO: 630372 - DNA, 25 bp, Rattus norvegicus
gccgcggtccacttggatgcgctgc

SEQ ID NO: 630373 - DNA, 25 bp, Rattus norvegicus
cccagaccctatcgagcccggctcg

SEQ ID NO: 630374 - DNA, 25 bp, Rattus norvegicus
gcgtttatgtaagcgcggggcaggt

SEQ ID NO: 630375 - DNA, 25 bp, Rattus norvegicus
tccctagcgacgcacgacctgtttt

SEQ ID NO: 630376 - DNA, 25 bp, Rattus norvegicus
tcctcagtgcggagttcgagaaccc

SEQ ID NO: 630377 - DNA, 25 bp, Rattus norvegicus
tccgggaccttctggtagagatctc

SEQ ID NO: 630378 - DNA, 25 bp, Rattus norvegicus
tctctcaggagtagacagccagctc

SEQ ID NO: 630379 - DNA, 25 bp, Rattus norvegicus
tcagaccaaggccaggacgaccttc

SEQ ID NO: 630380 - DNA, 25 bp, Rattus norvegicus
ttcattcctatagcctgcgcgcgca

SEQ ID NO: 630381 - DNA, 25 bp, Rattus norvegicus
cgaacttctgactcgctaggactta

SEQ ID NO: 630382 - DNA, 25 bp, Rattus norvegicus
cggagctggcagtagataatggttc

SEQ ID NO: 630383 - DNA, 25 bp, Rattus norvegicus
gtggactctcttaccgtctgcggga

SEQ ID NO: 630384 - DNA, 25 bp, Rattus norvegicus
ggagcgcgtctccagtaactacggc

SEQ ID NO: 630385 - DNA, 25 bp, Rattus norvegicus
cgcgcctcacatggtccggagcatt

SEQ ID NO: 630386 - DNA, 25 bp, Rattus norvegicus
ctagttgtactttccgctgcgagtg

SEQ ID NO: 630387 - DNA, 25 bp, Rattus norvegicus
cattcatgttgctgggcgttgtacg

SEQ ID NO: 630388 - DNA, 25 bp, Rattus norvegicus
ctgagcagcagcactccaggcattc

SEQ ID NO: 630389 - DNA, 25 bp, Rattus norvegicus
tacgctaggtgagcgaccttccatg

SEQ ID NO: 630390 - DNA, 25 bp, Rattus norvegicus
gaactctcttgggtttcatccggga

SEQ ID NO: 630391 - DNA, 25 bp, Rattus norvegicus
ggccagacttaagcagctctgcgga

SEQ ID NO: 630392 - DNA, 25 bp, Rattus norvegicus
aagcccatggaatcgtcgccttcta

SEQ ID NO: 630393 - DNA, 25 bp, Rattus norvegicus
ggcaacaatgctcctaagcccatgg

SEQ ID NO: 630394 - DNA, 25 bp, Rattus norvegicus
agcagcagtcaaaccggcaacaatg

SEQ ID NO: 630395 - DNA, 25 bp, Rattus norvegicus
cctttgatgctgatgagcgccaagc

SEQ ID NO: 630396 - DNA, 25 bp, Rattus norvegicus
ggctagtctttgtgtgctgctgcag

SEQ ID NO: 630397 - DNA, 25 bp, Rattus norvegicus
aaaactgcgcgtgtttgcccgaggc

SEQ ID NO: 630398 - DNA, 25 bp, Rattus norvegicus
ttccaacctgttgaggcaaaactgc

SEQ ID NO: 630399 - DNA, 25 bp, Rattus norvegicus
agatcgttaagtgcatggcgtcatc

SEQ ID NO: 630400 - DNA, 25 bp, Rattus norvegicus
tggcctcattctcggcaacgcttga

SEQ ID NO: 630401 - DNA, 25 bp, Rattus norvegicus
gagctgtccgtgtttggagtccctt

SEQ ID NO: 630402 - DNA, 25 bp, Rattus norvegicus
tctagactttgagcgtcctgggttc

SEQ ID NO: 630403 - DNA, 25 bp, Rattus norvegicus
agcgctgtgctgcttatgatagcca

SEQ ID NO: 630404 - DNA, 25 bp, Rattus norvegicus
gtcgccttctatgctgcccggtaag

SEQ ID NO: 630405 - DNA, 25 bp, Rattus norvegicus
ttttcgctgctgttcgaagtccggc

SEQ ID NO: 630406 - DNA, 25 bp, Rattus norvegicus
tcgaagtccggccaaccacagaggc

SEQ ID NO: 630407 - DNA, 25 bp, Rattus norvegicus
caggggtgctgtttgctatcacaga

SEQ ID NO: 630408 - DNA, 25 bp, Rattus norvegicus
ctaggcgtgaagctctcagaggtcc

SEQ ID NO: 630409 - DNA, 25 bp, Rattus norvegicus
ggtccgagatggacaacagaacatc

SEQ ID NO: 630410 - DNA, 25 bp, Rattus norvegicus
tcattgctctacacggagcccgggg

SEQ ID NO: 630411 - DNA, 25 bp, Rattus norvegicus
gccagacccagacgggagccagctt

SEQ ID NO: 630412 - DNA, 25 bp, Rattus norvegicus
agcttccgcctacctgcgtttgttg

SEQ ID NO: 630413 - DNA, 25 bp, Rattus norvegicus
acctgcgtttgttggccagtggaca

SEQ ID NO: 630414 - DNA, 25 bp, Rattus norvegicus
agtggacacacttcgcgctcagcgt

SEQ ID NO: 630415 - DNA, 25 bp, Rattus norvegicus
cgctcagcgtggatggaagctccgt

SEQ ID NO: 630416 - DNA, 25 bp, Rattus norvegicus
gaagctccgtggctctctacgtaga

SEQ ID NO: 630417 - DNA, 25 bp, Rattus norvegicus
cccacacggtctggagctagagcgt

SEQ ID NO: 630418 - DNA, 25 bp, Rattus norvegicus
agagttccagagagtgccgttcgct

SEQ ID NO: 630419 - DNA, 25 bp, Rattus norvegicus
agcagactgccggatctgaccgagc

SEQ ID NO: 630420 - DNA, 25 bp, Rattus norvegicus
cgcagccgtggaactttcaaggggc

SEQ ID NO: 630421 - DNA, 25 bp, Rattus norvegicus
tgcagctacgcccaccagggattcg

SEQ ID NO: 630422 - DNA, 25 bp, Rattus norvegicus
agggattcgtgcatgcgccctccac

SEQ ID NO: 630423 - DNA, 25 bp, Rattus norvegicus
tatctcccgggtcacatggttcacg

SEQ ID NO: 630424 - DNA, 25 bp, Rattus norvegicus
tgccagcctgttccctgagacgcta

SEQ ID NO: 630425 - DNA, 25 bp, Rattus norvegicus
agacgctacatctccagactctagg

SEQ ID NO: 630426 - DNA, 25 bp, Rattus norvegicus
ccttcagtacgatcgccctgtgttc

SEQ ID NO: 630427 - DNA, 25 bp, Rattus norvegicus
tggaccaggtctcagctcacagcag

SEQ ID NO: 630428 - DNA, 25 bp, Rattus norvegicus
aggcccgtacctagttcaaccagca

SEQ ID NO: 630429 - DNA, 25 bp, Rattus norvegicus
ctgaccgagcacagaggtgaccgcc

SEQ ID NO: 630430 - DNA, 25 bp, Rattus norvegicus
ccctgctggcctgcagaagtctgcg

SEQ ID NO: 630431 - DNA, 25 bp, Rattus norvegicus
tccgtccggctcctcttaagacgag

SEQ ID NO: 630432 - DNA, 25 bp, Rattus norvegicus
tctgtccgcctttctaataagttcc

SEQ ID NO: 630433 - DNA, 25 bp, Rattus norvegicus
ggggagcgcgtaacttcctcattcc

SEQ ID NO: 630434 - DNA, 25 bp, Rattus norvegicus
cccggacgtagtgccgctgaggtcc

SEQ ID NO: 630435 - DNA, 25 bp, Rattus norvegicus
cacgcgcagtagaggaatgtgcgct

SEQ ID NO: 630436 - DNA, 25 bp, Rattus norvegicus
tcaggatttctcttctgggcgggga

SEQ ID NO: 630437 - DNA, 25 bp, Rattus norvegicus
gactcagccgctcatccagatttca

SEQ ID NO: 630438 - DNA, 25 bp, Rattus norvegicus
gagttctgctccctctgcttccgaa

SEQ ID NO: 630439 - DNA, 25 bp, Rattus norvegicus
gtaggctccttgctgagttctgctc

SEQ ID NO: 630440 - DNA, 25 bp, Rattus norvegicus
cccaggtcctctagggtgtaggctc

SEQ ID NO: 630441 - DNA, 25 bp, Rattus norvegicus
cgggacccagctgacgcgacagctg

SEQ ID NO: 630442 - DNA, 25 bp, Rattus norvegicus
ctgggcccgggcgtctctaacgcag

SEQ ID NO: 630443 - DNA, 25 bp, Rattus norvegicus
tgctggacctagccagccaggtgcc

SEQ ID NO: 630444 - DNA, 25 bp, Rattus norvegicus
cacactgcggggtgctggacctagc

SEQ ID NO: 630445 - DNA, 25 bp, Rattus norvegicus
aatgtgcgctgcgtggctcgcacac

SEQ ID NO: 630446 - DNA, 25 bp, Rattus norvegicus
catccagatttcaggatttctcttc

SEQ ID NO: 630447 - DNA, 25 bp, Rattus norvegicus
ttccgcagttcgattggctcccggc

SEQ ID NO: 630448 - DNA, 25 bp, Rattus norvegicus
gccagagctcgaggcgctgcttacc

SEQ ID NO: 630449 - DNA, 25 bp, Rattus norvegicus
gcttaccgtcgcctgagctaggaga

SEQ ID NO: 630450 - DNA, 25 bp, Rattus norvegicus
cgcagtcagaaaacttcatccgagc

SEQ ID NO: 630451 - DNA, 25 bp, Rattus norvegicus
gaggaccggacagttcgcagtcaga

SEQ ID NO: 630452 - DNA, 25 bp, Rattus norvegicus
atgccgtgtcccaggccggccgaga

SEQ ID NO: 630453 - DNA, 25 bp, Rattus norvegicus
tccagcacggaggtagcccgcatgc

SEQ ID NO: 630454 - DNA, 25 bp, Rattus norvegicus
agcacaggctctacctagtccgcgg

SEQ ID NO: 630455 - DNA, 25 bp, Rattus norvegicus
cgatcggcagcacaggctctaccta

SEQ ID NO: 630456 - DNA, 25 bp, Rattus norvegicus
ttggtcaccgttccgcagttcgatt

SEQ ID NO: 630457 - DNA, 25 bp, Rattus norvegicus
ctctaattggccgtgttggtcaccg

SEQ ID NO: 630458 - DNA, 25 bp, Rattus norvegicus
gagcttcccgcgctctaattggccg

SEQ ID NO: 630459 - DNA, 25 bp, Rattus norvegicus
aaacggcttctagccggagagcttc

SEQ ID NO: 630460 - DNA, 25 bp, Rattus norvegicus
gcccttcgacgctaaacggcttcta

SEQ ID NO: 630461 - DNA, 25 bp, Rattus norvegicus
gaccgacatcaccattctgctagac

SEQ ID NO: 630462 - DNA, 25 bp, Rattus norvegicus
agggaagatcccacccaggtcgtgc

SEQ ID NO: 630463 - DNA, 25 bp, Rattus norvegicus
tctgctagacagctcggccagtgtc

SEQ ID NO: 630464 - DNA, 25 bp, Rattus norvegicus
tgtcggcagccacaacttcgaaacc

SEQ ID NO: 630465 - DNA, 25 bp, Rattus norvegicus
aggtcttcgccaagcgcctagccga

SEQ ID NO: 630466 - DNA, 25 bp, Rattus norvegicus
cctagccgagcggttcctgtcagcg

SEQ ID NO: 630467 - DNA, 25 bp, Rattus norvegicus
tacagtatagtggtcaaggccagca

SEQ ID NO: 630468 - DNA, 25 bp, Rattus norvegicus
gcaacagccaggtcgagcgtctctt

SEQ ID NO: 630469 - DNA, 25 bp, Rattus norvegicus
agcgtctcttcagttccagcagaac

SEQ ID NO: 630470 - DNA, 25 bp, Rattus norvegicus
aactacacggtactggccagctctg

SEQ ID NO: 630471 - DNA, 25 bp, Rattus norvegicus
cagatgtcaacgacgctctgagcta

SEQ ID NO: 630472 - DNA, 25 bp, Rattus norvegicus
ctctgtggacagcatggatttcatc

SEQ ID NO: 630473 - DNA, 25 bp, Rattus norvegicus
ctctgagctatgtaactcgtttcta

SEQ ID NO: 630474 - DNA, 25 bp, Rattus norvegicus
tggatttcatcaacgacgccacaga

SEQ ID NO: 630475 - DNA, 25 bp, Rattus norvegicus
ccctcctgcccactcggcgcccgca

SEQ ID NO: 630476 - DNA, 25 bp, Rattus norvegicus
gacccgagctgtcctcggaagtacc

SEQ ID NO: 630477 - DNA, 25 bp, Rattus norvegicus
cggtcgtgttttccaggcatccgcc

SEQ ID NO: 630478 - DNA, 25 bp, Rattus norvegicus
gtcgtgttttccaggcatccgcccg

SEQ ID NO: 630479 - DNA, 25 bp, Rattus norvegicus
cagagttaaagtgggaggtccctag

SEQ ID NO: 630480 - DNA, 25 bp, Rattus norvegicus
gcgcccgcacctcgggccgtcagga

SEQ ID NO: 630481 - DNA, 25 bp, Rattus norvegicus
ctcgggccgtcaggacccgagctgt

SEQ ID NO: 630482 - DNA, 25 bp, Rattus norvegicus
gggccgtcaggacccgagctgtcct

SEQ ID NO: 630483 - DNA, 25 bp, Rattus norvegicus
agctgtcctcggaagtacccagacg

SEQ ID NO: 630484 - DNA, 25 bp, Rattus norvegicus
cgtcaggacccgagctgtcctcgga

SEQ ID NO: 630485 - DNA, 25 bp, Rattus norvegicus
aggacccgagctgtcctcggaagta

SEQ ID NO: 630486 - DNA, 25 bp, Rattus norvegicus
cccagcggtcgtgttttccaggcat

SEQ ID NO: 630487 - DNA, 25 bp, Rattus norvegicus
agcggtcgtgttttccaggcatccg

SEQ ID NO: 630488 - DNA, 25 bp, Rattus norvegicus
gtgttttccaggcatccgcccgccc

SEQ ID NO: 630489 - DNA, 25 bp, Rattus norvegicus
gacctcaatcttcgggcactgtgtg

SEQ ID NO: 630490 - DNA, 25 bp, Rattus norvegicus
catgacgctgttctctgacctggtg

SEQ ID NO: 630491 - DNA, 25 bp, Rattus norvegicus
aaaccttgagtggattgccggcggc

SEQ ID NO: 630492 - DNA, 25 bp, Rattus norvegicus
ctcatcaaagagagccggcgccaga

SEQ ID NO: 630493 - DNA, 25 bp, Rattus norvegicus
tgttcgcagtggtcatcacagatgg

SEQ ID NO: 630494 - DNA, 25 bp, Rattus norvegicus
ggcgccatgaccctcgagatgatga

SEQ ID NO: 630495 - DNA, 25 bp, Rattus norvegicus
gacgtcaccgtgacagccatcggca

SEQ ID NO: 630496 - DNA, 25 bp, Rattus norvegicus
ccatcggcatcggtgacatgttcca

SEQ ID NO: 630497 - DNA, 25 bp, Rattus norvegicus
agaacctctactccatcgcctgtga

SEQ ID NO: 630498 - DNA, 25 bp, Rattus norvegicus
acctggtggccgagaaattcatcga

SEQ ID NO: 630499 - DNA, 25 bp, Rattus norvegicus
catcgatgacatggaagacgtcctt

SEQ ID NO: 630500 - DNA, 25 bp, Rattus norvegicus
agcgggtcaactccctgtccagttt

SEQ ID NO: 630501 - DNA, 25 bp, Rattus norvegicus
gtccagtttcaaggaggccgtcaaa

SEQ ID NO: 630502 - DNA, 25 bp, Rattus norvegicus
tgttccacgagacccacgagagcga

SEQ ID NO: 630503 - DNA, 25 bp, Rattus norvegicus
tgctgttcagctcgtccgcatcacg

SEQ ID NO: 630504 - DNA, 25 bp, Rattus norvegicus
tataaacgtgcagaactgccgtggg

SEQ ID NO: 630505 - DNA, 25 bp, Rattus norvegicus
gtcctatataaacgtgcagaactgc

SEQ ID NO: 630506 - DNA, 25 bp, Rattus norvegicus
tgtagctgtagccatcacggtcgcg

SEQ ID NO: 630507 - DNA, 25 bp, Rattus norvegicus
caggcgtcctatataaacgtgcaga

SEQ ID NO: 630508 - DNA, 25 bp, Rattus norvegicus
tggctcaggcgtcctatataaacgt

SEQ ID NO: 630509 - DNA, 25 bp, Rattus norvegicus
gcgctgaaaaagcactgggtgtcct

SEQ ID NO: 630510 - DNA, 25 bp, Rattus norvegicus
gaccatcacgaaccggccgcacagc

SEQ ID NO: 630511 - DNA, 25 bp, Rattus norvegicus
aggcgctgaaaaagcactgggtgtc

SEQ ID NO: 630512 - DNA, 25 bp, Rattus norvegicus
cgttttctaggtcgatttccaggag

SEQ ID NO: 630513 - DNA, 25 bp, Rattus norvegicus
ttctaggtcgatttccaggaggcgc

SEQ ID NO: 630514 - DNA, 25 bp, Rattus norvegicus
ggcgtctgtagctgtagccatcacg

SEQ ID NO: 630515 - DNA, 25 bp, Rattus norvegicus
tccaggaggcgctgaaaaagcactg

SEQ ID NO: 630516 - DNA, 25 bp, Rattus norvegicus
ggagcgcgcgaccatcacgaaccgg

SEQ ID NO: 630517 - DNA, 25 bp, Rattus norvegicus
gtggccttcccgttgacctacaatg

SEQ ID NO: 630518 - DNA, 25 bp, Rattus norvegicus
acttctacaaggcacggcgcttcgt

SEQ ID NO: 630519 - DNA, 25 bp, Rattus norvegicus
ggctgggcgagcagaacttctacaa

SEQ ID NO: 630520 - DNA, 25 bp, Rattus norvegicus
aagggatgacgacccactcaatgcc

SEQ ID NO: 630521 - DNA, 25 bp, Rattus norvegicus
tggaagccagaaccagcaacaggtg

SEQ ID NO: 630522 - DNA, 25 bp, Rattus norvegicus
gcctgactctggcacgaagggatga

SEQ ID NO: 630523 - DNA, 25 bp, Rattus norvegicus
tggagagaaccacctacctcaattc

SEQ ID NO: 630524 - DNA, 25 bp, Rattus norvegicus
ctcaattctttctcgcacgtgggca

SEQ ID NO: 630525 - DNA, 25 bp, Rattus norvegicus
cgtgcacgccatcaacaacgtggtg

SEQ ID NO: 630526 - DNA, 25 bp, Rattus norvegicus
agctgtccttcgtcttcctcacgga

SEQ ID NO: 630527 - DNA, 25 bp, Rattus norvegicus
caacgacagcctggaggagtccgta

SEQ ID NO: 630528 - DNA, 25 bp, Rattus norvegicus
agtccgtacactccatgcgtaagca

SEQ ID NO: 630529 - DNA, 25 bp, Rattus norvegicus
gcgtaagcagaatgtggtgcccacc

SEQ ID NO: 630530 - DNA, 25 bp, Rattus norvegicus
ccgcatggccctgttgcagtatgga

SEQ ID NO: 630531 - DNA, 25 bp, Rattus norvegicus
tgccctcggtcatgacagcacagct

SEQ ID NO: 630532 - DNA, 25 bp, Rattus norvegicus
cggccaatcagagcatcaccaggtg

SEQ ID NO: 630533 - DNA, 25 bp, Rattus norvegicus
tcaccaggtgggcacaaaagacgca

SEQ ID NO: 630534 - DNA, 25 bp, Rattus norvegicus
acctgactgacagcctagcgcactg

SEQ ID NO: 630535 - DNA, 25 bp, Rattus norvegicus
tgacagcacagctctggaccaccgg

SEQ ID NO: 630536 - DNA, 25 bp, Rattus norvegicus
gaggcccagggtccgcgactcacgt

SEQ ID NO: 630537 - DNA, 25 bp, Rattus norvegicus
aatccaggcacgcagagacaccagc

SEQ ID NO: 630538 - DNA, 25 bp, Rattus norvegicus
aggttgggtgccagcaatccaggca

SEQ ID NO: 630539 - DNA, 25 bp, Rattus norvegicus
aggaagcagccttcgttaggctccg

SEQ ID NO: 630540 - DNA, 25 bp, Rattus norvegicus
tggcgggctcagttttatagggtcc

SEQ ID NO: 630541 - DNA, 25 bp, Rattus norvegicus
ctcggccgaccggaacaactgggtg

SEQ ID NO: 630542 - DNA, 25 bp, Rattus norvegicus
aagacgcaccgcgaccgcagtggtt

SEQ ID NO: 630543 - DNA, 25 bp, Rattus norvegicus
acgccgcagacacctgaggggacca

SEQ ID NO: 630544 - DNA, 25 bp, Rattus norvegicus
ggccagccctttacctgactgacag

SEQ ID NO: 630545 - DNA, 25 bp, Rattus norvegicus
gcccagagtctgcattcggccgcta

SEQ ID NO: 630546 - DNA, 25 bp, Rattus norvegicus
acgggaaaccggtcgctagctatca

SEQ ID NO: 630547 - DNA, 25 bp, Rattus norvegicus
gctatcagatgccttcgagcgaaga

SEQ ID NO: 630548 - DNA, 25 bp, Rattus norvegicus
gtgaagccaggccttcagcaactcg

SEQ ID NO: 630549 - DNA, 25 bp, Rattus norvegicus
cagcaactcggccagaacacaaaga

SEQ ID NO: 630550 - DNA, 25 bp, Rattus norvegicus
tgtgctgctgttgagcttccggcag

SEQ ID NO: 630551 - DNA, 25 bp, Rattus norvegicus
caagcgcttatgctcgcccagagtc

SEQ ID NO: 630552 - DNA, 25 bp, Rattus norvegicus
ctcttagttgtgtgttacggacgtc

SEQ ID NO: 630553 - DNA, 25 bp, Rattus norvegicus
tacggacgtcaaattcgtaggacca

SEQ ID NO: 630554 - DNA, 25 bp, Rattus norvegicus
cggtcttctgcatccggcttccggt

SEQ ID NO: 630555 - DNA, 25 bp, Rattus norvegicus
agtgcccgagagacgctggacccac

SEQ ID NO: 630556 - DNA, 25 bp, Rattus norvegicus
tgcgtggatcctcccacctgagtgc

SEQ ID NO: 630557 - DNA, 25 bp, Rattus norvegicus
agcgcctagttcgtgcgtggatcct

SEQ ID NO: 630558 - DNA, 25 bp, Rattus norvegicus
ggtccgccagatatcgccactgtcg

SEQ ID NO: 630559 - DNA, 25 bp, Rattus norvegicus
gcgtctcgctcattggtgttgctga

SEQ ID NO: 630560 - DNA, 25 bp, Rattus norvegicus
tgccaagtcccgcaggagaagagtg

SEQ ID NO: 630561 - DNA, 25 bp, Rattus norvegicus
ggtgctcatactgccgcttgacaaa

SEQ ID NO: 630562 - DNA, 25 bp, Rattus norvegicus
catcgcgacagaaaaccgacttctg

SEQ ID NO: 630563 - DNA, 25 bp, Rattus norvegicus
ggaattcacttcctaggcgccgcca

SEQ ID NO: 630564 - DNA, 25 bp, Rattus norvegicus
agccaatcagcgtctgagacccacg

SEQ ID NO: 630565 - DNA, 25 bp, Rattus norvegicus
cgaagttggtttcaaggccgtcctg

SEQ ID NO: 630566 - DNA, 25 bp, Rattus norvegicus
ctgtcgcctctgagcaattctcgag

SEQ ID NO: 630567 - DNA, 25 bp, Rattus norvegicus
tcttaaggaggttccggtgctcata

SEQ ID NO: 630568 - DNA, 25 bp, Rattus norvegicus
cccagacggagatggaagacgagca

SEQ ID NO: 630569 - DNA, 25 bp, Rattus norvegicus
ggttagaccgtagcatccttctctc

SEQ ID NO: 630570 - DNA, 25 bp, Rattus norvegicus
tctccgcccttggagcgtcactgga

SEQ ID NO: 630571 - DNA, 25 bp, Rattus norvegicus
ctccgcttcgctgtggggagaaatc

SEQ ID NO: 630572 - DNA, 25 bp, Rattus norvegicus
gcaattctcgaggagcccagacgga

SEQ ID NO: 630573 - DNA, 25 bp, Rattus norvegicus
tggcccaggagaaaggccagctctc

SEQ ID NO: 630574 - DNA, 25 bp, Rattus norvegicus
agaaggagctgcagattgaggcctc

SEQ ID NO: 630575 - DNA, 25 bp, Rattus norvegicus
ttactgcgcaagctgaaggcagaga

SEQ ID NO: 630576 - DNA, 25 bp, Rattus norvegicus
cgccaagatacccaagcgcagcatg

SEQ ID NO: 630577 - DNA, 25 bp, Rattus norvegicus
gccttacagcatgagcggctcttga

SEQ ID NO: 630578 - DNA, 25 bp, Rattus norvegicus
caggaggcctgtgcccgccaagata

SEQ ID NO: 630579 - DNA, 25 bp, Rattus norvegicus
gctctccgagctgcggaagagccta

SEQ ID NO: 630580 - DNA, 25 bp, Rattus norvegicus
tcgcgctgcgaagcgttgctggccc

SEQ ID NO: 630581 - DNA, 25 bp, Rattus norvegicus
ggagccgctcgctggagctctctga

SEQ ID NO: 630582 - DNA, 25 bp, Rattus norvegicus
ggagctctctgaggccttacagcat

SEQ ID NO: 630583 - DNA, 25 bp, Rattus norvegicus
gcagattgaggcctcgcgctgcgaa

SEQ ID NO: 630584 - DNA, 25 bp, Rattus norvegicus
gggcggccaaggacaacctgcagaa

SEQ ID NO: 630585 - DNA, 25 bp, Rattus norvegicus
cggctcttgacggagcagctgagcc

SEQ ID NO: 630586 - DNA, 25 bp, Rattus norvegicus
gcagcatgctttactgcgcaagctg

SEQ ID NO: 630587 - DNA, 25 bp, Rattus norvegicus
tgggcgcactccttccaagccaggt

SEQ ID NO: 630588 - DNA, 25 bp, Rattus norvegicus
gtgccctccgccagctctcctgcgc

SEQ ID NO: 630589 - DNA, 25 bp, Rattus norvegicus
ctctggagattctggaagccggttc

SEQ ID NO: 630590 - DNA, 25 bp, Rattus norvegicus
cgcctgcgcgcaggtgtcggcaccc

SEQ ID NO: 630591 - DNA, 25 bp, Rattus norvegicus
gttcgcgtcacggtccgctccgcgc

SEQ ID NO: 630592 - DNA, 25 bp, Rattus norvegicus
tcagagcgcctgtcagccgctgggt

SEQ ID NO: 630593 - DNA, 25 bp, Rattus norvegicus
gcctgtcagccgctgggtcggtcct

SEQ ID NO: 630594 - DNA, 25 bp, Rattus norvegicus
agcttggacgacatcgacctgtctg

SEQ ID NO: 630595 - DNA, 25 bp, Rattus norvegicus
gacgacatcgacctgtctgccctga

SEQ ID NO: 630596 - DNA, 25 bp, Rattus norvegicus
atcgacctgtctgccctgagggtga

SEQ ID NO: 630597 - DNA, 25 bp, Rattus norvegicus
gccgcccaggctttcgccctctgga

SEQ ID NO: 630598 - DNA, 25 bp, Rattus norvegicus
gccctctggagattctggaagccgg

SEQ ID NO: 630599 - DNA, 25 bp, Rattus norvegicus
cgcccgaagcttggacgacatcgac

SEQ ID NO: 630600 - DNA, 25 bp, Rattus norvegicus
cttccaagccaggttccagcgaggc

SEQ ID NO: 630601 - DNA, 25 bp, Rattus norvegicus
agcgagcctttaaagttgctgggcg

SEQ ID NO: 630602 - DNA, 25 bp, Rattus norvegicus
gggcttccagagtctgccttgcagc

SEQ ID NO: 630603 - DNA, 25 bp, Rattus norvegicus
ttcagaagcgtcaaggccacggtcc

SEQ ID NO: 630604 - DNA, 25 bp, Rattus norvegicus
ctgcccgagcgtggtctgggcttca

SEQ ID NO: 630605 - DNA, 25 bp, Rattus norvegicus
ccagcttctgcagtctggcgggtgc

SEQ ID NO: 630606 - DNA, 25 bp, Rattus norvegicus
cagctcacagaggtggtcgcacgta

SEQ ID NO: 630607 - DNA, 25 bp, Rattus norvegicus
ggggaacgcctgagccaccggccat

SEQ ID NO: 630608 - DNA, 25 bp, Rattus norvegicus
tctccgacgtggctcattggccaat

SEQ ID NO: 630609 - DNA, 25 bp, Rattus norvegicus
gaaagctccaggtttctccgacgtg

SEQ ID NO: 630610 - DNA, 25 bp, Rattus norvegicus
tggtcgcacgtatcccgaggcgcct

SEQ ID NO: 630611 - DNA, 25 bp, Rattus norvegicus
cttgcagcctgtcggccggcaggaa

SEQ ID NO: 630612 - DNA, 25 bp, Rattus norvegicus
cccggaacctgctgggtactcgcat

SEQ ID NO: 630613 - DNA, 25 bp, Rattus norvegicus
cctgggcgacattgaagccagctca

SEQ ID NO: 630614 - DNA, 25 bp, Rattus norvegicus
ttggccaatgggagcgagcctttaa

SEQ ID NO: 630615 - DNA, 25 bp, Rattus norvegicus
cggccaacacggtgccatgtcagtg

SEQ ID NO: 630616 - DNA, 25 bp, Rattus norvegicus
tgcggaacacatcccacagtgcact

SEQ ID NO: 630617 - DNA, 25 bp, Rattus norvegicus
tccagctccagttacggacagatgc

SEQ ID NO: 630618 - DNA, 25 bp, Rattus norvegicus
gtacgcttggctcgcgtcactgttg

SEQ ID NO: 630619 - DNA, 25 bp, Rattus norvegicus
gcctgttcatgcttgggtacgcttg

SEQ ID NO: 630620 - DNA, 25 bp, Rattus norvegicus
ggtgcgcatctcgttttctctttca

SEQ ID NO: 630621 - DNA, 25 bp, Rattus norvegicus
cacagtgcacttcagcgtttctttc

SEQ ID NO: 630622 - DNA, 25 bp, Rattus norvegicus
ccatgtcagtgggtacacgattaga

SEQ ID NO: 630623 - DNA, 25 bp, Rattus norvegicus
tgtgcttttttctccacggccaaca

SEQ ID NO: 630624 - DNA, 25 bp, Rattus norvegicus
attctcttacggttcgctgctctgg

SEQ ID NO: 630625 - DNA, 25 bp, Rattus norvegicus
tttgcggctttgtcgttatggcagc

SEQ ID NO: 630626 - DNA, 25 bp, Rattus norvegicus
ggcccgaccttcagcattttccttg

SEQ ID NO: 630627 - DNA, 25 bp, Rattus norvegicus
gcgtttctttctggagtctcgttca

SEQ ID NO: 630628 - DNA, 25 bp, Rattus norvegicus
atggcgcttacatggcgtcctcctc

SEQ ID NO: 630629 - DNA, 25 bp, Rattus norvegicus
ttcaagatgttcgagttggctggct

SEQ ID NO: 630630 - DNA, 25 bp, Rattus norvegicus
aagacgatcgctgcctctgatgtgg

SEQ ID NO: 630631 - DNA, 25 bp, Rattus norvegicus
agtagtggtctctctaagtcggtca

SEQ ID NO: 630632 - DNA, 25 bp, Rattus norvegicus
cccggggtgactctgttcaagatgt

SEQ ID NO: 630633 - DNA, 25 bp, Rattus norvegicus
accacgtacggctgctccatttcta

SEQ ID NO: 630634 - DNA, 25 bp, Rattus norvegicus
ctggctgtgaggttgaagtcacgcc

SEQ ID NO: 630635 - DNA, 25 bp, Rattus norvegicus
agtcacgccgacaaagatgagctcg

SEQ ID NO: 630636 - DNA, 25 bp, Rattus norvegicus
agctcggcgtcctcctttacattct

SEQ ID NO: 630637 - DNA, 25 bp, Rattus norvegicus
tggagacaccggcaagacgatcgct

SEQ ID NO: 630638 - DNA, 25 bp, Rattus norvegicus
gtcctccgagtcgtcctcatcgagg

SEQ ID NO: 630639 - DNA, 25 bp, Rattus norvegicus
cctcatcgaggacttggatgggttc

SEQ ID NO: 630640 - DNA, 25 bp, Rattus norvegicus
tctgggtctgactcgtcatcgtcca

SEQ ID NO: 630641 - DNA, 25 bp, Rattus norvegicus
tccatttctactgtgcttcccgacg

SEQ ID NO: 630642 - DNA, 25 bp, Rattus norvegicus
ctaagtcggtcatgctttcttttta

SEQ ID NO: 630643 - DNA, 25 bp, Rattus norvegicus
tcctccctagtggtggcgacagatt

SEQ ID NO: 630644 - DNA, 25 bp, Rattus norvegicus
ggagcggtctcttactcgggcaccc

SEQ ID NO: 630645 - DNA, 25 bp, Rattus norvegicus
agcgccgatctgattggttcccaag

SEQ ID NO: 630646 - DNA, 25 bp, Rattus norvegicus
acgcagaaggccttcacccggtgtc

SEQ ID NO: 630647 - DNA, 25 bp, Rattus norvegicus
cccagggacacgcagaaggccttca

SEQ ID NO: 630648 - DNA, 25 bp, Rattus norvegicus
cctcggcgatgggaaaggcatttaa

SEQ ID NO: 630649 - DNA, 25 bp, Rattus norvegicus
aagcgccacagggtccctcggcgat

SEQ ID NO: 630650 - DNA, 25 bp, Rattus norvegicus
gactttaggtgagctaagcgccaca

SEQ ID NO: 630651 - DNA, 25 bp, Rattus norvegicus
tctgcagcctccaggactttaggtg

SEQ ID NO: 630652 - DNA, 25 bp, Rattus norvegicus
tggcgacagattccaggcaggcgtc

SEQ ID NO: 630653 - DNA, 25 bp, Rattus norvegicus
atgggtctcacgatgtggtcctccc

SEQ ID NO: 630654 - DNA, 25 bp, Rattus norvegicus
ctacttttttgaatgggtctcacga

SEQ ID NO: 630655 - DNA, 25 bp, Rattus norvegicus
gcgtccgtctgtctctacttttttg

SEQ ID NO: 630656 - DNA, 25 bp, Rattus norvegicus
cgagccctgtagcaggtctgcagcc

SEQ ID NO: 630657 - DNA, 25 bp, Rattus norvegicus
ctcgccttagattcgcgcttctgcg

SEQ ID NO: 630658 - DNA, 25 bp, Rattus norvegicus
ggtggatgccatctgagccataaga

SEQ ID NO: 630659 - DNA, 25 bp, Rattus norvegicus
cataagacccggctgtcccgaggtg

SEQ ID NO: 630660 - DNA, 25 bp, Rattus norvegicus
agcagggcgaccctcgccttagatt

SEQ ID NO: 630661 - DNA, 25 bp, Rattus norvegicus
taacgcggcagcgtcccgagagtca

SEQ ID NO: 630662 - DNA, 25 bp, Rattus norvegicus
gccaacatggcgcagcagactccaa

SEQ ID NO: 630663 - DNA, 25 bp, Rattus norvegicus
tccaaggtcattctgcggacgccct

SEQ ID NO: 630664 - DNA, 25 bp, Rattus norvegicus
tgcggacgcccttgggagagtaccc

SEQ ID NO: 630665 - DNA, 25 bp, Rattus norvegicus
tgcggagaactaacgcggcagcgtc

SEQ ID NO: 630666 - DNA, 25 bp, Rattus norvegicus
actgcggcttcctcgtggcatgaca

SEQ ID NO: 630667 - DNA, 25 bp, Rattus norvegicus
caagatggagatgagtaagaagcgt

SEQ ID NO: 630668 - DNA, 25 bp, Rattus norvegicus
cagacgctcggtgcggagaactaac

SEQ ID NO: 630669 - DNA, 25 bp, Rattus norvegicus
ggcgcagcagactccaaggtcattc

SEQ ID NO: 630670 - DNA, 25 bp, Rattus norvegicus
gagagaagcaaggttaatgctccgg

SEQ ID NO: 630671 - DNA, 25 bp, Rattus norvegicus
tcggacactgcagcacaaatagaaa

SEQ ID NO: 630672 - DNA, 25 bp, Rattus norvegicus
ctcccccgcggcagtacacatacaa

SEQ ID NO: 630673 - DNA, 25 bp, Rattus norvegicus
tacaaaatttacatcgccataaacg

SEQ ID NO: 630674 - DNA, 25 bp, Rattus norvegicus
tttacatcgccataaacgaagacct

SEQ ID NO: 630675 - DNA, 25 bp, Rattus norvegicus
ctgaaaacgtggacgacctcggaca

SEQ ID NO: 630676 - DNA, 25 bp, Rattus norvegicus
aaaacgtggacgacctcggacactg

SEQ ID NO: 630677 - DNA, 25 bp, Rattus norvegicus
aacgtggacgacctcggacactgca

SEQ ID NO: 630678 - DNA, 25 bp, Rattus norvegicus
tggacgacctcggacactgcagcac

SEQ ID NO: 630679 - DNA, 25 bp, Rattus norvegicus
acgacctcggacactgcagcacaaa

SEQ ID NO: 630680 - DNA, 25 bp, Rattus norvegicus
cctcggacactgcagcacaaataga

SEQ ID NO: 630681 - DNA, 25 bp, Rattus norvegicus
ggacactgcagcacaaatagaaata

SEQ ID NO: 630682 - DNA, 25 bp, Rattus norvegicus
tgcagcacaaatagaaatacagagc

SEQ ID NO: 630683 - DNA, 25 bp, Rattus norvegicus
caaatagaaatacagagcctacctg

SEQ ID NO: 630684 - DNA, 25 bp, Rattus norvegicus
gacctcggacactgcagcacaaata

SEQ ID NO: 630685 - DNA, 25 bp, Rattus norvegicus
cctgttgctgcttctcctgccgccg

SEQ ID NO: 630686 - DNA, 25 bp, Rattus norvegicus
tgccttctgggtctctctgaacatg

SEQ ID NO: 630687 - DNA, 25 bp, Rattus norvegicus
ctgggtctctctgaacatgctaatg

SEQ ID NO: 630688 - DNA, 25 bp, Rattus norvegicus
gaaatgccttctgggtctctctgaa

SEQ ID NO: 630689 - DNA, 25 bp, Rattus norvegicus
ctcagtgcagtcgatccccgaaatg

SEQ ID NO: 630690 - DNA, 25 bp, Rattus norvegicus
gcgccctgcacctcagtgcagtcga

SEQ ID NO: 630691 - DNA, 25 bp, Rattus norvegicus
tggctgagcttgacccaccgagcgc

SEQ ID NO: 630692 - DNA, 25 bp, Rattus norvegicus
ggccaccggtgagtgcccgccactc

SEQ ID NO: 630693 - DNA, 25 bp, Rattus norvegicus
cgcctgtctcctccgcgcgatctcg

SEQ ID NO: 630694 - DNA, 25 bp, Rattus norvegicus
ctctctgaacatgctaatgagcgtc

SEQ ID NO: 630695 - DNA, 25 bp, Rattus norvegicus
tgctaatgagcgtcccagtctctgg

SEQ ID NO: 630696 - DNA, 25 bp, Rattus norvegicus
cgtcccagtctctggcgatgtgcaa

SEQ ID NO: 630697 - DNA, 25 bp, Rattus norvegicus
cagtctctggcgatgtgcaagtggc

SEQ ID NO: 630698 - DNA, 25 bp, Rattus norvegicus
gggcccactggctgagcttgaccca

SEQ ID NO: 630699 - DNA, 25 bp, Rattus norvegicus
gcggcgcgcacgttagcgtcagcac

SEQ ID NO: 630700 - DNA, 25 bp, Rattus norvegicus
gggcagaagcccgtcaagtttcagc

SEQ ID NO: 630701 - DNA, 25 bp, Rattus norvegicus
ccgtcaagtttcagctggaggacga

SEQ ID NO: 630702 - DNA, 25 bp, Rattus norvegicus
gacgacggggagttctacatgatcg

SEQ ID NO: 630703 - DNA, 25 bp, Rattus norvegicus
tacatgatcggctccgaggtagccc

SEQ ID NO: 630704 - DNA, 25 bp, Rattus norvegicus
gcgttctcggcttcccgagcagcgg

SEQ ID NO: 630705 - DNA, 25 bp, Rattus norvegicus
ccattcatcgcggaggcgggctcgt

SEQ ID NO: 630706 - DNA, 25 bp, Rattus norvegicus
ttgagcaagaccttcgggcagaagc

SEQ ID NO: 630707 - DNA, 25 bp, Rattus norvegicus
gatgatgatggcgttgagcaagacc

SEQ ID NO: 630708 - DNA, 25 bp, Rattus norvegicus
tgacgcgagcgccttcccggtttgc

SEQ ID NO: 630709 - DNA, 25 bp, Rattus norvegicus
acctagtagtgacgcgagcgccttc

SEQ ID NO: 630710 - DNA, 25 bp, Rattus norvegicus
cggcttaagaacctagtagtgacgc

SEQ ID NO: 630711 - DNA, 25 bp, Rattus norvegicus
tgctcttcgcagagacggcttaaga

SEQ ID NO: 630712 - DNA, 25 bp, Rattus norvegicus
agggaggcctgctcttcgcagagac

SEQ ID NO: 630713 - DNA, 25 bp, Rattus norvegicus
ctgaggaccaatcagcgtcggagga

SEQ ID NO: 630714 - DNA, 25 bp, Rattus norvegicus
aagtcccacggtagagcacgtggcg

SEQ ID NO: 630715 - DNA, 25 bp, Rattus norvegicus
ccgcggtgtaggctcgtgtcaccgc

SEQ ID NO: 630716 - DNA, 25 bp, Rattus norvegicus
tgttgaggcggctagccaataagga

SEQ ID NO: 630717 - DNA, 25 bp, Rattus norvegicus
gcctcgctctctgaggaccaatcag

SEQ ID NO: 630718 - DNA, 25 bp, Rattus norvegicus
cgcgccggcaaacccgcgctcttta

SEQ ID NO: 630719 - DNA, 25 bp, Rattus norvegicus
tcgaaaaatcttcagcgcgcgcgcc

SEQ ID NO: 630720 - DNA, 25 bp, Rattus norvegicus
tctgcccagccatcgaaaaatcttc

SEQ ID NO: 630721 - DNA, 25 bp, Rattus norvegicus
gccaataaggaagtcccacggtaga

SEQ ID NO: 630722 - DNA, 25 bp, Rattus norvegicus
ccggaagcaggcgacatccctaacc

SEQ ID NO: 630723 - DNA, 25 bp, Rattus norvegicus
ggattgtaaccatggcgccgccacg

SEQ ID NO: 630724 - DNA, 25 bp, Rattus norvegicus
tgaccggccagggattgtaaccatg

SEQ ID NO: 630725 - DNA, 25 bp, Rattus norvegicus
cctctgaccggccagggattgtaac

SEQ ID NO: 630726 - DNA, 25 bp, Rattus norvegicus
tgtaggctcgtgtcaccgccggcac

SEQ ID NO: 630727 - DNA, 25 bp, Rattus norvegicus
agaccacgtgctttagctcagtaga

SEQ ID NO: 630728 - DNA, 25 bp, Rattus norvegicus
ctccgagaccacgtgctttagctca

SEQ ID NO: 630729 - DNA, 25 bp, Rattus norvegicus
cggcacgcagcacgccctccgagac

SEQ ID NO: 630730 - DNA, 25 bp, Rattus norvegicus
taaccgcgtgtctgtccctcccgct

SEQ ID NO: 630731 - DNA, 25 bp, Rattus norvegicus
agtagaccctttcattctctcaggg

SEQ ID NO: 630732 - DNA, 25 bp, Rattus norvegicus
gtgctttagctcagtagaccctttc

SEQ ID NO: 630733 - DNA, 25 bp, Rattus norvegicus
aacagcgcgctggagcgtagtcacc

SEQ ID NO: 630734 - DNA, 25 bp, Rattus norvegicus
cattctctcagggtctacatcaact

SEQ ID NO: 630735 - DNA, 25 bp, Rattus norvegicus
agacctgcggccctgtaaccacggg

SEQ ID NO: 630736 - DNA, 25 bp, Rattus norvegicus
gctttctgcaagacctgcggccctg

SEQ ID NO: 630737 - DNA, 25 bp, Rattus norvegicus
gcaagccggcacaggtttgcaggga

SEQ ID NO: 630738 - DNA, 25 bp, Rattus norvegicus
ccctttgggacgtggcctgacgtca

SEQ ID NO: 630739 - DNA, 25 bp, Rattus norvegicus
ccacgggcgggctaaccgcgtgtct

SEQ ID NO: 630740 - DNA, 25 bp, Rattus norvegicus
ttcgagtcttgctgcacgccccgtt

SEQ ID NO: 630741 - DNA, 25 bp, Rattus norvegicus
tgcgtactacgcttcccaggattgc

SEQ ID NO: 630742 - DNA, 25 bp, Rattus norvegicus
gcgcccttggaagctcaccggactt

SEQ ID NO: 630743 - DNA, 25 bp, Rattus norvegicus
gaagctcaccggacttcggagggta

SEQ ID NO: 630744 - DNA, 25 bp, Rattus norvegicus
taacgataggccgagttggcctgaa

SEQ ID NO: 630745 - DNA, 25 bp, Rattus norvegicus
cgagttggcctgaatgtcgatgtcc

SEQ ID NO: 630746 - DNA, 25 bp, Rattus norvegicus
tgaatgtcgatgtcctccacgcccg

SEQ ID NO: 630747 - DNA, 25 bp, Rattus norvegicus
ccatggtgcgggtttctgcggacca

SEQ ID NO: 630748 - DNA, 25 bp, Rattus norvegicus
ggctgcggcgtcctcacacggacat

SEQ ID NO: 630749 - DNA, 25 bp, Rattus norvegicus
tcacacggacatggctcagaccagg

SEQ ID NO: 630750 - DNA, 25 bp, Rattus norvegicus
ctccaggggaaatggagtccacgcc

SEQ ID NO: 630751 - DNA, 25 bp, Rattus norvegicus
gatgaaccaagaggcccggtctgcg

SEQ ID NO: 630752 - DNA, 25 bp, Rattus norvegicus
ccacggtgggatgaaccaagaggcc

SEQ ID NO: 630753 - DNA, 25 bp, Rattus norvegicus
gcctcaaactccacaggtaccggga

SEQ ID NO: 630754 - DNA, 25 bp, Rattus norvegicus
ggacatggctcagaccaggccgcac

SEQ ID NO: 630755 - DNA, 25 bp, Rattus norvegicus
ccggcagtcgcttggcagcataact

SEQ ID NO: 630756 - DNA, 25 bp, Rattus norvegicus
cagctttcgttttcgcaggcgcaca

SEQ ID NO: 630757 - DNA, 25 bp, Rattus norvegicus
cttgcaaagcgctggcaccatcttc

SEQ ID NO: 630758 - DNA, 25 bp, Rattus norvegicus
cccgcacaacagctatttttagcta

SEQ ID NO: 630759 - DNA, 25 bp, Rattus norvegicus
ttttagctagggaagcaccgcgccc

SEQ ID NO: 630760 - DNA, 25 bp, Rattus norvegicus
ggcaccgcgcagcttttcgtcagcg

SEQ ID NO: 630761 - DNA, 25 bp, Rattus norvegicus
tcagcgccttctgccgcgaagttgt

SEQ ID NO: 630762 - DNA, 25 bp, Rattus norvegicus
cgggcgcagtacagacttcaccagc

SEQ ID NO: 630763 - DNA, 25 bp, Rattus norvegicus
gtgccactacctaggccggtctggc

SEQ ID NO: 630764 - DNA, 25 bp, Rattus norvegicus
ctggcctcccacctgaggttcggta

SEQ ID NO: 630765 - DNA, 25 bp, Rattus norvegicus
ggttcggtagaaagccagcccagtc

SEQ ID NO: 630766 - DNA, 25 bp, Rattus norvegicus
accgtcggcgacttcctctgtagag

SEQ ID NO: 630767 - DNA, 25 bp, Rattus norvegicus
cataactgacttttgccggccaatc

SEQ ID NO: 630768 - DNA, 25 bp, Rattus norvegicus
cttagtgcagaaaagcagagagcca

SEQ ID NO: 630769 - DNA, 25 bp, Rattus norvegicus
ccctgcacggacctccgagccctca

SEQ ID NO: 630770 - DNA, 25 bp, Rattus norvegicus
tcctcgcgctcaccggagccctgca

SEQ ID NO: 630771 - DNA, 25 bp, Rattus norvegicus
tgagcgcgacggaccaacaaggaac

SEQ ID NO: 630772 - DNA, 25 bp, Rattus norvegicus
actcctgagcgcgacggaccaacaa

SEQ ID NO: 630773 - DNA, 25 bp, Rattus norvegicus
ggagcaccggactcctgagcgcgac

SEQ ID NO: 630774 - DNA, 25 bp, Rattus norvegicus
aacggccggagcaccggactcctga

SEQ ID NO: 630775 - DNA, 25 bp, Rattus norvegicus
gcgtgttcccacctcctcgcgctca

SEQ ID NO: 630776 - DNA, 25 bp, Rattus norvegicus
aactcttccggcgtctccagggcaa

SEQ ID NO: 630777 - DNA, 25 bp, Rattus norvegicus
tgcggtcccagtgacccaccctggg

SEQ ID NO: 630778 - DNA, 25 bp, Rattus norvegicus
ccaccgcgcccgtaatggagagcgg

SEQ ID NO: 630779 - DNA, 25 bp, Rattus norvegicus
tctcgagccaggcttcggcccaccg

SEQ ID NO: 630780 - DNA, 25 bp, Rattus norvegicus
agcgccttcgggtctcgagccaggc

SEQ ID NO: 630781 - DNA, 25 bp, Rattus norvegicus
aaggtccttgtcagcgccttcgggt

SEQ ID NO: 630782 - DNA, 25 bp, Rattus norvegicus
tggccagaaggtccttgtcagcgcc

SEQ ID NO: 630783 - DNA, 25 bp, Rattus norvegicus
ttttgcacaactagcctgaccggtc

SEQ ID NO: 630784 - DNA, 25 bp, Rattus norvegicus
ctgggtcttagtccttcagtgcttc

SEQ ID NO: 630785 - DNA, 25 bp, Rattus norvegicus
gcagaagcagctgcaacggcgagca

SEQ ID NO: 630786 - DNA, 25 bp, Rattus norvegicus
gaagtagccgctggcagacctcgga

SEQ ID NO: 630787 - DNA, 25 bp, Rattus norvegicus
tagagctccagacccatggcggagg

SEQ ID NO: 630788 - DNA, 25 bp, Rattus norvegicus
gacatcaggtccaggtagagctcca

SEQ ID NO: 630789 - DNA, 25 bp, Rattus norvegicus
ttcttggcgaagatgtagacggcac

SEQ ID NO: 630790 - DNA, 25 bp, Rattus norvegicus
aggggatgccgttcttcttggcgaa

SEQ ID NO: 630791 - DNA, 25 bp, Rattus norvegicus
tttaagcagctcgatggtacgcagc

SEQ ID NO: 630792 - DNA, 25 bp, Rattus norvegicus
ctgggcccacctttaagcagctcga

SEQ ID NO: 630793 - DNA, 25 bp, Rattus norvegicus
tacagaaggctgcagacttcccagc

SEQ ID NO: 630794 - DNA, 25 bp, Rattus norvegicus
tcggaggtgcacgatacagaaggct

SEQ ID NO: 630795 - DNA, 25 bp, Rattus norvegicus
tcacccaccggctgcagaggtcgga

SEQ ID NO: 630796 - DNA, 25 bp, Rattus norvegicus
tcagtgcttcttagcctcgatcgga

SEQ ID NO: 630797 - DNA, 25 bp, Rattus norvegicus
ccagcatgagcagaaggggcagtaa

SEQ ID NO: 630798 - DNA, 25 bp, Rattus norvegicus
gtcctcgaacagacaggtcacccgg

SEQ ID NO: 630799 - DNA, 25 bp, Rattus norvegicus
acgtgggttcggatgatcttccgga

SEQ ID NO: 630800 - DNA, 25 bp, Rattus norvegicus
tcttccggaaggtctggcggaactc

SEQ ID NO: 630801 - DNA, 25 bp, Rattus norvegicus
aactcccggatcctgtaggcgtaga

SEQ ID NO: 630802 - DNA, 25 bp, Rattus norvegicus
tgatggccaggtacatgagccacgg

SEQ ID NO: 630803 - DNA, 25 bp, Rattus norvegicus
ttgatgatgtgcagcggcaaccagc

SEQ ID NO: 630804 - DNA, 25 bp, Rattus norvegicus
ccagcacagagcaaagagcccgacg

SEQ ID NO: 630805 - DNA, 25 bp, Rattus norvegicus
gcccgacgatgatggccagggactt

SEQ ID NO: 630806 - DNA, 25 bp, Rattus norvegicus
gacctccttctgcagcgtggaccga

SEQ ID NO: 630807 - DNA, 25 bp, Rattus norvegicus
gggctggctctccatctgcttcagc

SEQ ID NO: 630808 - DNA, 25 bp, Rattus norvegicus
atccgtaggtagatggccagcatga

SEQ ID NO: 630809 - DNA, 25 bp, Rattus norvegicus
gtaattcatgggcaccacgtcctcg

SEQ ID NO: 630810 - DNA, 25 bp, Rattus norvegicus
aggggcagtaacacgaacgcaaaga

SEQ ID NO: 630811 - DNA, 25 bp, Rattus norvegicus
gcgagcacacccactgcaatgtcag

SEQ ID NO: 630812 - DNA, 25 bp, Rattus norvegicus
cgccgccagcgataccacaaagaag

SEQ ID NO: 630813 - DNA, 25 bp, Rattus norvegicus
atgtagcggtcgatggcgatagcca

SEQ ID NO: 630814 - DNA, 25 bp, Rattus norvegicus
tcgatggcgatagccaagaggctaa

SEQ ID NO: 630815 - DNA, 25 bp, Rattus norvegicus
aaagatggaactctgcgtgaggacc

SEQ ID NO: 630816 - DNA, 25 bp, Rattus norvegicus
ctctgcgtgaggaccaggacaaaac

SEQ ID NO: 630817 - DNA, 25 bp, Rattus norvegicus
ccacaaagaagttggtgacgttctg

SEQ ID NO: 630818 - DNA, 25 bp, Rattus norvegicus
ccaggacaaaacaggcgaagaagag

SEQ ID NO: 630819 - DNA, 25 bp, Rattus norvegicus
tggtgacgttctgcaggttactgtt

SEQ ID NO: 630820 - DNA, 25 bp, Rattus norvegicus
tgcaggttactgttgatccacacgg

SEQ ID NO: 630821 - DNA, 25 bp, Rattus norvegicus
tactgttgatccacacggcccagca

SEQ ID NO: 630822 - DNA, 25 bp, Rattus norvegicus
agcacgttgcccaggatggccagca

SEQ ID NO: 630823 - DNA, 25 bp, Rattus norvegicus
atggccagcacagcgatggccagct

SEQ ID NO: 630824 - DNA, 25 bp, Rattus norvegicus
atggccagctccaccgtgatgtaca

SEQ ID NO: 630825 - DNA, 25 bp, Rattus norvegicus
agctttggcagggacgcgccctaaa

SEQ ID NO: 630826 - DNA, 25 bp, Rattus norvegicus
gtcgcttcaagtccacgcgtcctga

SEQ ID NO: 630827 - DNA, 25 bp, Rattus norvegicus
atgggacccgcagcaaagcaccctt

SEQ ID NO: 630828 - DNA, 25 bp, Rattus norvegicus
ctaactaggtggtgatgggacccgc

SEQ ID NO: 630829 - DNA, 25 bp, Rattus norvegicus
gacttcgaaactagcgctgctcccg

SEQ ID NO: 630830 - DNA, 25 bp, Rattus norvegicus
gcgcaccctgcaggcgacttcgaaa

SEQ ID NO: 630831 - DNA, 25 bp, Rattus norvegicus
gctgacttgcctcttgctctggctc

SEQ ID NO: 630832 - DNA, 25 bp, Rattus norvegicus
ggatggccctggtccgctcagacct

SEQ ID NO: 630833 - DNA, 25 bp, Rattus norvegicus
ccttaggcaccttccggtcgctgag

SEQ ID NO: 630834 - DNA, 25 bp, Rattus norvegicus
tagatgactgtaaggcatcccgcca

SEQ ID NO: 630835 - DNA, 25 bp, Rattus norvegicus
cgcctgcgggtctagatgactgtaa

SEQ ID NO: 630836 - DNA, 25 bp, Rattus norvegicus
ccctaaagggacttgtgcgcttgca

SEQ ID NO: 630837 - DNA, 25 bp, Rattus norvegicus
ctcgacgtccgcagcctagctttgg

SEQ ID NO: 630838 - DNA, 25 bp, Rattus norvegicus
cttgtgcgcttgcaggttcagtcct

SEQ ID NO: 630839 - DNA, 25 bp, Rattus norvegicus
agttcgtgcgcttcaacagcgcagg

SEQ ID NO: 630840 - DNA, 25 bp, Rattus norvegicus
gagtgcgagatataagctacgtgcg

SEQ ID NO: 630841 - DNA, 25 bp, Rattus norvegicus
ggagagtgcgagatataagctacgt

SEQ ID NO: 630842 - DNA, 25 bp, Rattus norvegicus
tcgtgcgcttcaacagcgcagggga

SEQ ID NO: 630843 - DNA, 25 bp, Rattus norvegicus
acagttcgtgcgcttcaacagcgca

SEQ ID NO: 630844 - DNA, 25 bp, Rattus norvegicus
cctggtacatcgctgtgggctacgt

SEQ ID NO: 630845 - DNA, 25 bp, Rattus norvegicus
gtcctggtacatcgctgtgggctac

SEQ ID NO: 630846 - DNA, 25 bp, Rattus norvegicus
agtcctggtacatcgctgtgggcta

SEQ ID NO: 630847 - DNA, 25 bp, Rattus norvegicus
cggcgagtcctggtacatcgctgtg

SEQ ID NO: 630848 - DNA, 25 bp, Rattus norvegicus
acccggcgagtcctggtacatcgct

SEQ ID NO: 630849 - DNA, 25 bp, Rattus norvegicus
gcacccggcgagtcctggtacatcg

SEQ ID NO: 630850 - DNA, 25 bp, Rattus norvegicus
ctgcacccggcgagtcctggtacat

SEQ ID NO: 630851 - DNA, 25 bp, Rattus norvegicus
caccgccctgtcccgacctgcaccc

SEQ ID NO: 630852 - DNA, 25 bp, Rattus norvegicus
cttcaacagcgcaggggagagtgcg

SEQ ID NO: 630853 - DNA, 25 bp, Rattus norvegicus
ggcgccagctgtcacgcctcctctc

SEQ ID NO: 630854 - DNA, 25 bp, Rattus norvegicus
cctctcttcgcgctgggttctgggc

SEQ ID NO: 630855 - DNA, 25 bp, Rattus norvegicus
agtccggcctcagggcaacagccaa

SEQ ID NO: 630856 - DNA, 25 bp, Rattus norvegicus
aatgcaagcacgagggtcgcaccca

SEQ ID NO: 630857 - DNA, 25 bp, Rattus norvegicus
acccagcctctccgcagggatgaga

SEQ ID NO: 630858 - DNA, 25 bp, Rattus norvegicus
agccgggtagcaccacagcctgggt

SEQ ID NO: 630859 - DNA, 25 bp, Rattus norvegicus
tgcgcaagcgctgtgaccgtcgcct

SEQ ID NO: 630860 - DNA, 25 bp, Rattus norvegicus
aggagacgaacgtgcccgcggcaca

SEQ ID NO: 630861 - DNA, 25 bp, Rattus norvegicus
gacaccacagggaatgcaagcacga

SEQ ID NO: 630862 - DNA, 25 bp, Rattus norvegicus
ccggtccgttgagtccggcctcagg

SEQ ID NO: 630863 - DNA, 25 bp, Rattus norvegicus
cgagctagccgggtagcaccacagc

SEQ ID NO: 630864 - DNA, 25 bp, Rattus norvegicus
gtctctcccgacaccacagggaatg

SEQ ID NO: 630865 - DNA, 25 bp, Rattus norvegicus
gccctgtctcccttacggctcccgc

SEQ ID NO: 630866 - DNA, 25 bp, Rattus norvegicus
gcggcacaagcggagaagaccctgc

SEQ ID NO: 630867 - DNA, 25 bp, Rattus norvegicus
tggaggccttgcagcgctccagctc

SEQ ID NO: 630868 - DNA, 25 bp, Rattus norvegicus
tccagctcctgctcgatgtcaccca

SEQ ID NO: 630869 - DNA, 25 bp, Rattus norvegicus
tcccttgcggatcttctcgaagttg

SEQ ID NO: 630870 - DNA, 25 bp, Rattus norvegicus
tctcgaagttggatctgagcgccgc

SEQ ID NO: 630871 - DNA, 25 bp, Rattus norvegicus
agttggatctgagcgccgccacgct

SEQ ID NO: 630872 - DNA, 25 bp, Rattus norvegicus
cctaatggaggccttgcagcgctcc

SEQ ID NO: 630873 - DNA, 25 bp, Rattus norvegicus
tcgatgtcacccaccgagcgcagct

SEQ ID NO: 630874 - DNA, 25 bp, Rattus norvegicus
agtccgggaactgcgctctccaagc

SEQ ID NO: 630875 - DNA, 25 bp, Rattus norvegicus
gcgaagcccaccgagtccaccatgg

SEQ ID NO: 630876 - DNA, 25 bp, Rattus norvegicus
atgatcccgcggctacggcggcgaa

SEQ ID NO: 630877 - DNA, 25 bp, Rattus norvegicus
ggctacggcggcgaacaatgcccgc

SEQ ID NO: 630878 - DNA, 25 bp, Rattus norvegicus
ggttgcgcacgcctctattgtgtgc

SEQ ID NO: 630879 - DNA, 25 bp, Rattus norvegicus
tgggcaggtcccttgcggatcttct

SEQ ID NO: 630880 - DNA, 25 bp, Rattus norvegicus
acgcctctattgtgtgcggggctcc

SEQ ID NO: 630881 - DNA, 25 bp, Rattus norvegicus
ggacctcgagctctgcactgcttgc

SEQ ID NO: 630882 - DNA, 25 bp, Rattus norvegicus
acaaccaaggcgttgatgagcaggc

SEQ ID NO: 630883 - DNA, 25 bp, Rattus norvegicus
caccatgacaaccaaggcgttgatg

SEQ ID NO: 630884 - DNA, 25 bp, Rattus norvegicus
gagacttccggactccactgcagcg

SEQ ID NO: 630885 - DNA, 25 bp, Rattus norvegicus
gagctctgcactgcttgctcagaga

SEQ ID NO: 630886 - DNA, 25 bp, Rattus norvegicus
atagcaacgagagcctcctgggacc

SEQ ID NO: 630887 - DNA, 25 bp, Rattus norvegicus
ccgcgcggagtcatcaccatagcaa

SEQ ID NO: 630888 - DNA, 25 bp, Rattus norvegicus
ccagtccttggatgtggctggcaca

SEQ ID NO: 630889 - DNA, 25 bp, Rattus norvegicus
accctcctccagtccttggatgtgg

SEQ ID NO: 630890 - DNA, 25 bp, Rattus norvegicus
gcagctcccgaatcctgacgtcggg

SEQ ID NO: 630891 - DNA, 25 bp, Rattus norvegicus
cacagcaacagtggcctcgcgggac

SEQ ID NO: 630892 - DNA, 25 bp, Rattus norvegicus
aggccgctgcaaatcaccacagcaa

SEQ ID NO: 630893 - DNA, 25 bp, Rattus norvegicus
tcaccatagcaacgagagcctcctg

SEQ ID NO: 630894 - DNA, 25 bp, Rattus norvegicus
cttgctcagagacttccggactcca

SEQ ID NO: 630895 - DNA, 25 bp, Rattus norvegicus
ctgcaaccggggcagaaagaggttc

SEQ ID NO: 630896 - DNA, 25 bp, Rattus norvegicus
cgcaaagatacgttgagcacgatga

SEQ ID NO: 630897 - DNA, 25 bp, Rattus norvegicus
tgagtcgttggcgttcgcaaagata

SEQ ID NO: 630898 - DNA, 25 bp, Rattus norvegicus
tttcttcaaccagcgcttacctggc

SEQ ID NO: 630899 - DNA, 25 bp, Rattus norvegicus
cagtactttcttcaaccagcgctta

SEQ ID NO: 630900 - DNA, 25 bp, Rattus norvegicus
cagaaagaggttccaagtccgcttc

SEQ ID NO: 630901 - DNA, 25 bp, Rattus norvegicus
gaggcgcggcagtagctctaataaa

SEQ ID NO: 630902 - DNA, 25 bp, Rattus norvegicus
gcacgcctcgctggtgaggcagctc

SEQ ID NO: 630903 - DNA, 25 bp, Rattus norvegicus
atgcccacagatgaggcacgcctcg

SEQ ID NO: 630904 - DNA, 25 bp, Rattus norvegicus
tctaagcagaatgcccacagatgag

SEQ ID NO: 630905 - DNA, 25 bp, Rattus norvegicus
gagctcctccgctctaagcagaatg

SEQ ID NO: 630906 - DNA, 25 bp, Rattus norvegicus
ggctttttcaagatgagctcctccg

SEQ ID NO: 630907 - DNA, 25 bp, Rattus norvegicus
ttcgctccgcggctttttcaagatg

SEQ ID NO: 630908 - DNA, 25 bp, Rattus norvegicus
ctctaataaaatctgcaaccggggc

SEQ ID NO: 630909 - DNA, 25 bp, Rattus norvegicus
cccaacacgtgtactcggtgtcttc

SEQ ID NO: 630910 - DNA, 25 bp, Rattus norvegicus
agtaactccccctcggtctggactg

SEQ ID NO: 630911 - DNA, 25 bp, Rattus norvegicus
cacgtgattctacccggccctacca

SEQ ID NO: 630912 - DNA, 25 bp, Rattus norvegicus
ttcagtcccacgtgattctacccgg

SEQ ID NO: 630913 - DNA, 25 bp, Rattus norvegicus
ggtgtctttcagtcccacgtgattc

SEQ ID NO: 630914 - DNA, 25 bp, Rattus norvegicus
tcttcagaggtgtctttcagtccca

SEQ ID NO: 630915 - DNA, 25 bp, Rattus norvegicus
cccgtaatcttcagaggtgtctttc

SEQ ID NO: 630916 - DNA, 25 bp, Rattus norvegicus
cgagcccgtaatcttcagaggtgtc

SEQ ID NO: 630917 - DNA, 25 bp, Rattus norvegicus
acgtgtactcggtgtcttctctttc

SEQ ID NO: 630918 - DNA, 25 bp, Rattus norvegicus
gacacgcgtgcccacccaacacgtg

SEQ ID NO: 630919 - DNA, 25 bp, Rattus norvegicus
gtgttcccacccgacacgcgtgccc

SEQ ID NO: 630920 - DNA, 25 bp, Rattus norvegicus
tcggtctggactgcaggcctcctgc

SEQ ID NO: 630921 - DNA, 25 bp, Rattus norvegicus
agcctcgagcccgtaatcttcagag

SEQ ID NO: 630922 - DNA, 25 bp, Rattus norvegicus
cggccctaccacatctcagtaactc

SEQ ID NO: 630923 - DNA, 25 bp, Rattus norvegicus
tgcaggcctccaggttgaaaccacc

SEQ ID NO: 630924 - DNA, 25 bp, Rattus norvegicus
acatcccatggtccggcagcagcag

SEQ ID NO: 630925 - DNA, 25 bp, Rattus norvegicus
caggtggcggtcaattctcctcgac

SEQ ID NO: 630926 - DNA, 25 bp, Rattus norvegicus
aagtttgatctcacggcgctgccgc

SEQ ID NO: 630927 - DNA, 25 bp, Rattus norvegicus
tctgcttgacgatggtgctcttgcc

SEQ ID NO: 630928 - DNA, 25 bp, Rattus norvegicus
ggggcttgtactccttgcaggcctc

SEQ ID NO: 630929 - DNA, 25 bp, Rattus norvegicus
gaaatcaatcttcagggcagccagg

SEQ ID NO: 630930 - DNA, 25 bp, Rattus norvegicus
tcgggcgtgatctcacccttgctct

SEQ ID NO: 630931 - DNA, 25 bp, Rattus norvegicus
agagccgtcgcatgacacccagcag

SEQ ID NO: 630932 - DNA, 25 bp, Rattus norvegicus
ttgtcctccaggtggtactcgctgg

SEQ ID NO: 630933 - DNA, 25 bp, Rattus norvegicus
cattcaggtagtaagcggcgttgtc

SEQ ID NO: 630934 - DNA, 25 bp, Rattus norvegicus
tgtcctccaccgtggggatatagtc

SEQ ID NO: 630935 - DNA, 25 bp, Rattus norvegicus
acggtcagggttgtggaaatcaatc

SEQ ID NO: 630936 - DNA, 25 bp, Rattus norvegicus
tggtgcccagcaggagaagtttgat

SEQ ID NO: 630937 - DNA, 25 bp, Rattus norvegicus
gaccgtggcactgcactgcgccgat

SEQ ID NO: 630938 - DNA, 25 bp, Rattus norvegicus
cttcgtgcgtcggtcgagctgcacc

SEQ ID NO: 630939 - DNA, 25 bp, Rattus norvegicus
ctctggttctgcacgaagcgggtgc

SEQ ID NO: 630940 - DNA, 25 bp, Rattus norvegicus
gagcgcagtccgttgccaggccaac

SEQ ID NO: 630941 - DNA, 25 bp, Rattus norvegicus
actagctccggctcgttttccattg

SEQ ID NO: 630942 - DNA, 25 bp, Rattus norvegicus
ggctcgttttccattggccgataac

SEQ ID NO: 630943 - DNA, 25 bp, Rattus norvegicus
tggccgataacagccgacggacgtg

SEQ ID NO: 630944 - DNA, 25 bp, Rattus norvegicus
cgacggacgtgcgagtaatccaata

SEQ ID NO: 630945 - DNA, 25 bp, Rattus norvegicus
atccaataacgacagacaggggcgg

SEQ ID NO: 630946 - DNA, 25 bp, Rattus norvegicus
gctgctggctccagcgaccgtggca

SEQ ID NO: 630947 - DNA, 25 bp, Rattus norvegicus
ctcagggcgtgcagtggtcccacat

SEQ ID NO: 630948 - DNA, 25 bp, Rattus norvegicus
cagtggtcccacatcatcctcggta

SEQ ID NO: 630949 - DNA, 25 bp, Rattus norvegicus
tccaagggttactgggccaccgctc

SEQ ID NO: 630950 - DNA, 25 bp, Rattus norvegicus
tcccttaggcacctgtctgggccgt

SEQ ID NO: 630951 - DNA, 25 bp, Rattus norvegicus
gagcagcgcccagtctgcgtactgt

SEQ ID NO: 630952 - DNA, 25 bp, Rattus norvegicus
gcgaaccgatgtggcggtgccacca

SEQ ID NO: 630953 - DNA, 25 bp, Rattus norvegicus
gccttcactgggagatggcatgtgg

SEQ ID NO: 630954 - DNA, 25 bp, Rattus norvegicus
atggcgagcatgcaaacacccaagc

SEQ ID NO: 630955 - DNA, 25 bp, Rattus norvegicus
ctgtaacatggcgagcatgcaaaca

SEQ ID NO: 630956 - DNA, 25 bp, Rattus norvegicus
cccgtgctgtaacatggcgagcatg

SEQ ID NO: 630957 - DNA, 25 bp, Rattus norvegicus
aggtgcccgtgctgtaacatggcga

SEQ ID NO: 630958 - DNA, 25 bp, Rattus norvegicus
catcaggtgcccgtgctgtaacatg

SEQ ID NO: 630959 - DNA, 25 bp, Rattus norvegicus
gggccatcaggtgcccgtgctgtaa

SEQ ID NO: 630960 - DNA, 25 bp, Rattus norvegicus
tcacgcttccacattgtgaggcggg

SEQ ID NO: 630961 - DNA, 25 bp, Rattus norvegicus
gctcttctcacgcttccacattgtg

SEQ ID NO: 630962 - DNA, 25 bp, Rattus norvegicus
accgacccgcgaacggctcttctca

SEQ ID NO: 630963 - DNA, 25 bp, Rattus norvegicus
tactgtggtgtttgggtaggaccga

SEQ ID NO: 630964 - DNA, 25 bp, Rattus norvegicus
accgatgtggcggtgccaccacgcg

SEQ ID NO: 630965 - DNA, 25 bp, Rattus norvegicus
gcaaagcagctcttctgcgcgcttt

SEQ ID NO: 630966 - DNA, 25 bp, Rattus norvegicus
tgtacacgtgggcagcgcagcaaaa

SEQ ID NO: 630967 - DNA, 25 bp, Rattus norvegicus
ttgtgcagacgatgctcgctgggac

SEQ ID NO: 630968 - DNA, 25 bp, Rattus norvegicus
cgctgggacacgcagtactctgatc

SEQ ID NO: 630969 - DNA, 25 bp, Rattus norvegicus
tactctgatctctttgtggctcgga

SEQ ID NO: 630970 - DNA, 25 bp, Rattus norvegicus
ctcggagaacgttagcaaagcagct

SEQ ID NO: 630971 - DNA, 25 bp, Rattus norvegicus
tgcgcgctttcgtgcatccaatctc

SEQ ID NO: 630972 - DNA, 25 bp, Rattus norvegicus
tgcactcagagaaaggcgctggtaa

SEQ ID NO: 630973 - DNA, 25 bp, Rattus norvegicus
aattaaccaaacgatgcccgccttg

SEQ ID NO: 630974 - DNA, 25 bp, Rattus norvegicus
ctcgtccttacaactggtgcttaca

SEQ ID NO: 630975 - DNA, 25 bp, Rattus norvegicus
gcttacaagcaacgcttagcggctg

SEQ ID NO: 630976 - DNA, 25 bp, Rattus norvegicus
ctggaggctctttggtccgcaacaa

SEQ ID NO: 630977 - DNA, 25 bp, Rattus norvegicus
caatctcccaatcgatgcactcaga

SEQ ID NO: 630978 - DNA, 25 bp, Rattus norvegicus
tggtccgcaacaaactgtacacgtg

SEQ ID NO: 630979 - DNA, 25 bp, Rattus norvegicus
ttggcacgttacacgcgcagacaca

SEQ ID NO: 630980 - DNA, 25 bp, Rattus norvegicus
ctctgtccctttcttcccggatgga

SEQ ID NO: 630981 - DNA, 25 bp, Rattus norvegicus
ggtttcaaccgtgcgatctatggac

SEQ ID NO: 630982 - DNA, 25 bp, Rattus norvegicus
tcttcccggatggaaacgtcattcc

SEQ ID NO: 630983 - DNA, 25 bp, Rattus norvegicus
cccagaacataagcaggtgtgcaag

SEQ ID NO: 630984 - DNA, 25 bp, Rattus norvegicus
gtgtgcaagggcttccaccgcgcac

SEQ ID NO: 630985 - DNA, 25 bp, Rattus norvegicus
gtgaactcacaagccatcacctgtg

SEQ ID NO: 630986 - DNA, 25 bp, Rattus norvegicus
tcacctgtggccttttggcacgtta

SEQ ID NO: 630987 - DNA, 25 bp, Rattus norvegicus
cccaggcgcacctgtagatttaata

SEQ ID NO: 630988 - DNA, 25 bp, Rattus norvegicus
tagatttaataaaaccgcgccgatc

SEQ ID NO: 630989 - DNA, 25 bp, Rattus norvegicus
aaaaccgcgccgatcctcatggctt

SEQ ID NO: 630990 - DNA, 25 bp, Rattus norvegicus
ctagatcagctctggaagcctctcc

SEQ ID NO: 630991 - DNA, 25 bp, Rattus norvegicus
cgtgcgatctatggactagatcagc

SEQ ID NO: 630992 - DNA, 25 bp, Rattus norvegicus
tggaagcctctccacgtacggctcg

SEQ ID NO: 630993 - DNA, 25 bp, Rattus norvegicus
agagaaactttgatgccgccgctgc

SEQ ID NO: 630994 - DNA, 25 bp, Rattus norvegicus
cactaggtccgagtctcacgggtcc

SEQ ID NO: 630995 - DNA, 25 bp, Rattus norvegicus
tttaaaggcccgagaggacgtcagc

SEQ ID NO: 630996 - DNA, 25 bp, Rattus norvegicus
caaagtcgtgtctcttctgcgcggg

SEQ ID NO: 630997 - DNA, 25 bp, Rattus norvegicus
ccaacgcagcgcctaggaacaaagg

SEQ ID NO: 630998 - DNA, 25 bp, Rattus norvegicus
cggtgctgatgggacccagacccaa

SEQ ID NO: 630999 - DNA, 25 bp, Rattus norvegicus
gcctggagtccactgtcagacgcga

SEQ ID NO: 631000 - DNA, 25 bp, Rattus norvegicus
gcggtccttgatctgcgtgtgcaga

SEQ ID NO: 631001 - DNA, 25 bp, Rattus norvegicus
caagctgcgggagaggaaaccaaac

SEQ ID NO: 631002 - DNA, 25 bp, Rattus norvegicus
ccgagtagctaggtcgtcttcctga

SEQ ID NO: 631003 - DNA, 25 bp, Rattus norvegicus
aggcgattaacatccactgtgcggg

SEQ ID NO: 631004 - DNA, 25 bp, Rattus norvegicus
tgcactctccactagttcccaattg

SEQ ID NO: 631005 - DNA, 25 bp, Rattus norvegicus
tcacccagctgggttgcgccgcaaa

SEQ ID NO: 631006 - DNA, 25 bp, Rattus norvegicus
agccctggagacagctctgtgctcc

SEQ ID NO: 631007 - DNA, 25 bp, Rattus norvegicus
gccacggactctgcagcgcagatca

SEQ ID NO: 631008 - DNA, 25 bp, Rattus norvegicus
ggggagctccggttcattaccatcg

SEQ ID NO: 631009 - DNA, 25 bp, Rattus norvegicus
tgctcctgacgcttgcagcctcttt

SEQ ID NO: 631010 - DNA, 25 bp, Rattus norvegicus
acgcgcgaactggtggtaaagtgca

SEQ ID NO: 631011 - DNA, 25 bp, Rattus norvegicus
gcagacccagatcgtcagtggctaa

SEQ ID NO: 631012 - DNA, 25 bp, Rattus norvegicus
taagagcagatttacggagtgaacc

SEQ ID NO: 631013 - DNA, 25 bp, Rattus norvegicus
tccggaggaactcctgaaaagtgca

SEQ ID NO: 631014 - DNA, 25 bp, Rattus norvegicus
tcactttcagttgagggaattccta

SEQ ID NO: 631015 - DNA, 25 bp, Rattus norvegicus
ctagggccagaagccagatggatct

SEQ ID NO: 631016 - DNA, 25 bp, Rattus norvegicus
actggagattagtccgcgggtactg

SEQ ID NO: 631017 - DNA, 25 bp, Rattus norvegicus
tcacccgacgcaagtgggaacaggc

SEQ ID NO: 631018 - DNA, 25 bp, Rattus norvegicus
caggctgattttgcgaagtattaca

SEQ ID NO: 631019 - DNA, 25 bp, Rattus norvegicus
gagttcgtgggcttcgatagcgaca

SEQ ID NO: 631020 - DNA, 25 bp, Rattus norvegicus
ggatctgactatagcttcccgcagg

SEQ ID NO: 631021 - DNA, 25 bp, Rattus norvegicus
gcaccatggtgacctgcgtcgccaa

SEQ ID NO: 631022 - DNA, 25 bp, Rattus norvegicus
cctgcgtcgccaacgcgcaagcgca

SEQ ID NO: 631023 - DNA, 25 bp, Rattus norvegicus
gcgcaagcgcagatacaaatgggca

SEQ ID NO: 631024 - DNA, 25 bp, Rattus norvegicus
acaaatgggcatctagagcggggtc

SEQ ID NO: 631025 - DNA, 25 bp, Rattus norvegicus
tagagcggggtccaaatccagaagc

SEQ ID NO: 631026 - DNA, 25 bp, Rattus norvegicus
cggggtccaaatccagaagcaaatg

SEQ ID NO: 631027 - DNA, 25 bp, Rattus norvegicus
atccagaagcaaatgtccctgcctg

SEQ ID NO: 631028 - DNA, 25 bp, Rattus norvegicus
agcaaatgtccctgcctggtctccg

SEQ ID NO: 631029 - DNA, 25 bp, Rattus norvegicus
aatgtccctgcctggtctccggctg

SEQ ID NO: 631030 - DNA, 25 bp, Rattus norvegicus
tggcggtttcgggaactcgctacga

SEQ ID NO: 631031 - DNA, 25 bp, Rattus norvegicus
ccaagtcttacgtatagaagtgggg

SEQ ID NO: 631032 - DNA, 25 bp, Rattus norvegicus
agacactttttctcttaggtgcaga

SEQ ID NO: 631033 - DNA, 25 bp, Rattus norvegicus
actgaagcgagcgaacgcggtgtct

SEQ ID NO: 631034 - DNA, 25 bp, Rattus norvegicus
ttaggtgcagagaactgaagcgagc

SEQ ID NO: 631035 - DNA, 25 bp, Rattus norvegicus
acccactttgtccttgccgtacatg

SEQ ID NO: 631036 - DNA, 25 bp, Rattus norvegicus
gcaacagctactcgccgggatccgg

SEQ ID NO: 631037 - DNA, 25 bp, Rattus norvegicus
tgccgggacagagcaaagcgaggac

SEQ ID NO: 631038 - DNA, 25 bp, Rattus norvegicus
tccttgccgtacatgtggccagcca

SEQ ID NO: 631039 - DNA, 25 bp, Rattus norvegicus
acctgatgcgacagcggcacgcagc

SEQ ID NO: 631040 - DNA, 25 bp, Rattus norvegicus
caccggcgggctgtctccggtgctt

SEQ ID NO: 631041 - DNA, 25 bp, Rattus norvegicus
tgtctccggtgcttccaggcggccg

SEQ ID NO: 631042 - DNA, 25 bp, Rattus norvegicus
catcggggcggcgacactcagcgtc

SEQ ID NO: 631043 - DNA, 25 bp, Rattus norvegicus
gacactcagcgtcaggcgtcaggga

SEQ ID NO: 631044 - DNA, 25 bp, Rattus norvegicus
cggacccatgccgagaccgcgctgc

SEQ ID NO: 631045 - DNA, 25 bp, Rattus norvegicus
agcaccactctgagcatgcgcaaca

SEQ ID NO: 631046 - DNA, 25 bp, Rattus norvegicus
tctgagcatgcgcaacagctactcg

SEQ ID NO: 631047 - DNA, 25 bp, Rattus norvegicus
atgtggccagccacctgatgcgaca

SEQ ID NO: 631048 - DNA, 25 bp, Rattus norvegicus
tgcgcaacagctactcgccgggatc

SEQ ID NO: 631049 - DNA, 25 bp, Rattus norvegicus
tatcgcgagagcaagtgagtcagtc

SEQ ID NO: 631050 - DNA, 25 bp, Rattus norvegicus
gcaggcacgctctacgtgtcgaaca

SEQ ID NO: 631051 - DNA, 25 bp, Rattus norvegicus
aattagatcgtttgctgagcaccgg

SEQ ID NO: 631052 - DNA, 25 bp, Rattus norvegicus
aacaggtagctccaagatctcaggg

SEQ ID NO: 631053 - DNA, 25 bp, Rattus norvegicus
atacttgaacgtatcgcggcggcca

SEQ ID NO: 631054 - DNA, 25 bp, Rattus norvegicus
ctggtgagcattctcgcgatacttg

SEQ ID NO: 631055 - DNA, 25 bp, Rattus norvegicus
aggcctctcgcggtaatttccagcg

SEQ ID NO: 631056 - DNA, 25 bp, Rattus norvegicus
tgtcgaacatttctttcaaccggcc

SEQ ID NO: 631057 - DNA, 25 bp, Rattus norvegicus
tccgacaggcaaatctggctccagc

SEQ ID NO: 631058 - DNA, 25 bp, Rattus norvegicus
tccgtcctgagcgtccaatactgga

SEQ ID NO: 631059 - DNA, 25 bp, Rattus norvegicus
ggccgatttaggaagctaccctgta

SEQ ID NO: 631060 - DNA, 25 bp, Rattus norvegicus
tcgagttcgagctatgaggcctctc

SEQ ID NO: 631061 - DNA, 25 bp, Rattus norvegicus
ttggaccggaagtcctccgtcctga

SEQ ID NO: 631062 - DNA, 25 bp, Rattus norvegicus
caaggtgacaccagcgcgcaacagg

SEQ ID NO: 631063 - DNA, 25 bp, Rattus norvegicus
ccggactgtcaccttgactatcaca

SEQ ID NO: 631064 - DNA, 25 bp, Rattus norvegicus
gccagccacgctgtgagcaaccaga

SEQ ID NO: 631065 - DNA, 25 bp, Rattus norvegicus
tgagcaaccagactagcggggacgc

SEQ ID NO: 631066 - DNA, 25 bp, Rattus norvegicus
gcatccgggccctggactacttccc

SEQ ID NO: 631067 - DNA, 25 bp, Rattus norvegicus
gtgcccgcggttgtcaaatcctcac

SEQ ID NO: 631068 - DNA, 25 bp, Rattus norvegicus
acccttatccggactgtcaccttga

SEQ ID NO: 631069 - DNA, 25 bp, Rattus norvegicus
gccatgggcctcagctccgactccc

SEQ ID NO: 631070 - DNA, 25 bp, Rattus norvegicus
ccgcacacgcgctcccagattgccg

SEQ ID NO: 631071 - DNA, 25 bp, Rattus norvegicus
ccttgactatcacaagggcaggcgc

SEQ ID NO: 631072 - DNA, 25 bp, Rattus norvegicus
tgtcaaatcctcaccggtctgcggg

SEQ ID NO: 631073 - DNA, 25 bp, Rattus norvegicus
tcaccaccttggtgcccgcggttgt

SEQ ID NO: 631074 - DNA, 25 bp, Rattus norvegicus
cgcagacgcagtcaccaccttggtg

SEQ ID NO: 631075 - DNA, 25 bp, Rattus norvegicus
cagggcggcgcagacgcagtcacca

SEQ ID NO: 631076 - DNA, 25 bp, Rattus norvegicus
tgcgcatgcgcgactctaccggcgc

SEQ ID NO: 631077 - DNA, 25 bp, Rattus norvegicus
ctgctaggaccggcctgggtgtccc

SEQ ID NO: 631078 - DNA, 25 bp, Rattus norvegicus
cggcccgcacaggtgaggcgtgcat

SEQ ID NO: 631079 - DNA, 25 bp, Rattus norvegicus
ggagccctccttcctgtgttcgcac

SEQ ID NO: 631080 - DNA, 25 bp, Rattus norvegicus
atcacgccgtgcgtccttaccaggt

SEQ ID NO: 631081 - DNA, 25 bp, Rattus norvegicus
ggcctgcgtgccctatcacgccgtg

SEQ ID NO: 631082 - DNA, 25 bp, Rattus norvegicus
gattgccccggggtgtgtgcatccc

SEQ ID NO: 631083 - DNA, 25 bp, Rattus norvegicus
tcgtgtcctttccaggctgagccta

SEQ ID NO: 631084 - DNA, 25 bp, Rattus norvegicus
gcagcccgggacacgcggacctgcc

SEQ ID NO: 631085 - DNA, 25 bp, Rattus norvegicus
ccagaaagtgagtggctgctaggac

SEQ ID NO: 631086 - DNA, 25 bp, Rattus norvegicus
ggatccagaaagtgagtggctgcta

SEQ ID NO: 631087 - DNA, 25 bp, Rattus norvegicus
ctgaagcggatccagaaagtgagtg

SEQ ID NO: 631088 - DNA, 25 bp, Rattus norvegicus
gcgctgaagcggatccagaaagtga

SEQ ID NO: 631089 - DNA, 25 bp, Rattus norvegicus
cccatggcgctgaagcggatccaga

SEQ ID NO: 631090 - DNA, 25 bp, Rattus norvegicus
ccgatccggtcgtgtcctttccagg

SEQ ID NO: 631091 - DNA, 25 bp, Rattus norvegicus
gttcgtccatcatccgtttcctcgt

SEQ ID NO: 631092 - DNA, 25 bp, Rattus norvegicus
gccgggcctatagtcgtcggcccga

SEQ ID NO: 631093 - DNA, 25 bp, Rattus norvegicus
ataccctcgcctgtcaggtaggccg

SEQ ID NO: 631094 - DNA, 25 bp, Rattus norvegicus
tatggcgcggctcagcaacaccctt

SEQ ID NO: 631095 - DNA, 25 bp, Rattus norvegicus
aatgtggggcgtgctaagaacactg

SEQ ID NO: 631096 - DNA, 25 bp, Rattus norvegicus
tttcgtggctgtgtgtaggcacagt

SEQ ID NO: 631097 - DNA, 25 bp, Rattus norvegicus
gcgcggcgggcatgataacaagccc

SEQ ID NO: 631098 - DNA, 25 bp, Rattus norvegicus
gcctcctgctgcagaccggaagtct

SEQ ID NO: 631099 - DNA, 25 bp, Rattus norvegicus
gacacactccgcctcccgtttgccc

SEQ ID NO: 631100 - DNA, 25 bp, Rattus norvegicus
ccactgaacggtgggggacacactc

SEQ ID NO: 631101 - DNA, 25 bp, Rattus norvegicus
taaaccggctctgcctagccgcagg

SEQ ID NO: 631102 - DNA, 25 bp, Rattus norvegicus
tgccaaactaaaccggctctgccta

SEQ ID NO: 631103 - DNA, 25 bp, Rattus norvegicus
tcagcaacacccttgccaaactaaa

SEQ ID NO: 631104 - DNA, 25 bp, Rattus norvegicus
ggcaagggacgtcgttcgtccatca

SEQ ID NO: 631105 - DNA, 25 bp, Rattus norvegicus
tcgaacttgactggggtgtccggga

SEQ ID NO: 631106 - DNA, 25 bp, Rattus norvegicus
cagctctgggttcgaacttgactgg

SEQ ID NO: 631107 - DNA, 25 bp, Rattus norvegicus
gcagctctgggttcgaacttgactg

SEQ ID NO: 631108 - DNA, 25 bp, Rattus norvegicus
agcagctctgggttcgaacttgact

SEQ ID NO: 631109 - DNA, 25 bp, Rattus norvegicus
cagcagctctgggttcgaacttgac

SEQ ID NO: 631110 - DNA, 25 bp, Rattus norvegicus
ctctgggttcgaacttgactggggt

SEQ ID NO: 631111 - DNA, 25 bp, Rattus norvegicus
ccgggagcccgagggtccacgcgat

SEQ ID NO: 631112 - DNA, 25 bp, Rattus norvegicus
ggtccacgcgatgggtcaggcattc

SEQ ID NO: 631113 - DNA, 25 bp, Rattus norvegicus
tccacgcgatgggtcaggcattccg

SEQ ID NO: 631114 - DNA, 25 bp, Rattus norvegicus
ccacgcgatgggtcaggcattccgg

SEQ ID NO: 631115 - DNA, 25 bp, Rattus norvegicus
tgggtcaggcattccgggcggtgcc

SEQ ID NO: 631116 - DNA, 25 bp, Rattus norvegicus
cgcgcggcgtgtggacgtggtgcgt

SEQ ID NO: 631117 - DNA, 25 bp, Rattus norvegicus
acgtggtgcgtgtgagagggcgcag

SEQ ID NO: 631118 - DNA, 25 bp, Rattus norvegicus
agctctgggttcgaacttgactggg

SEQ ID NO: 631119 - DNA, 25 bp, Rattus norvegicus
cgctgcagatgtcaaggcttcaact

SEQ ID NO: 631120 - DNA, 25 bp, Rattus norvegicus
tcctgctctgggaccgcccagtgtg

SEQ ID NO: 631121 - DNA, 25 bp, Rattus norvegicus
tgggccgtagcagcctcctgctctg

SEQ ID NO: 631122 - DNA, 25 bp, Rattus norvegicus
gccgtagcagcctcctgctctggga

SEQ ID NO: 631123 - DNA, 25 bp, Rattus norvegicus
gtagcagcctcctgctctgggaccg

SEQ ID NO: 631124 - DNA, 25 bp, Rattus norvegicus
gaccgcccagtgtgcgggactctgc

SEQ ID NO: 631125 - DNA, 25 bp, Rattus norvegicus
gtgtgcgggactctgcccggcttcc

SEQ ID NO: 631126 - DNA, 25 bp, Rattus norvegicus
cctcgtcagtatccgcttcctccag

SEQ ID NO: 631127 - DNA, 25 bp, Rattus norvegicus
ttcctccagctagggcctgctctgg

SEQ ID NO: 631128 - DNA, 25 bp, Rattus norvegicus
gcctgctctggtcgcctggaaaaaa

SEQ ID NO: 631129 - DNA, 25 bp, Rattus norvegicus
aaaacgctgcagatgtcaaggcttc

SEQ ID NO: 631130 - DNA, 25 bp, Rattus norvegicus
tgcagatgtcaaggcttcaactggg

SEQ ID NO: 631131 - DNA, 25 bp, Rattus norvegicus
atgtcaaggcttcaactgggagccc

SEQ ID NO: 631132 - DNA, 25 bp, Rattus norvegicus
gcctggaaaaaacgctgcagatgtc

SEQ ID NO: 631133 - DNA, 25 bp, Rattus norvegicus
ccttgtaaggaacgtcggctgggct

SEQ ID NO: 631134 - DNA, 25 bp, Rattus norvegicus
aatcagcgcgcgcttgtctcgtcgc

SEQ ID NO: 631135 - DNA, 25 bp, Rattus norvegicus
cgcagagccgggaaagagaatctta

SEQ ID NO: 631136 - DNA, 25 bp, Rattus norvegicus
atcttaggcggttcgggcctcagtt

SEQ ID NO: 631137 - DNA, 25 bp, Rattus norvegicus
tcagtttcccaatgtgtggtcaaca

SEQ ID NO: 631138 - DNA, 25 bp, Rattus norvegicus
gtggtcaacaagcaatcaatcagcg

SEQ ID NO: 631139 - DNA, 25 bp, Rattus norvegicus
cctggcattgtgaatagagcctatc

SEQ ID NO: 631140 - DNA, 25 bp, Rattus norvegicus
gaatagagcctatccgccatcgccg

SEQ ID NO: 631141 - DNA, 25 bp, Rattus norvegicus
ttcttcgcttccagcgtgagaaggc

SEQ ID NO: 631142 - DNA, 25 bp, Rattus norvegicus
ccattggctgggcacagagccctca

SEQ ID NO: 631143 - DNA, 25 bp, Rattus norvegicus
acagagccctcatgagaagagcgga

SEQ ID NO: 631144 - DNA, 25 bp, Rattus norvegicus
agccgcgcactcgagggagcttctg

SEQ ID NO: 631145 - DNA, 25 bp, Rattus norvegicus
gcagtcctagctctgcctggcattg

SEQ ID NO: 631146 - DNA, 25 bp, Rattus norvegicus
gcgttcagtctacgagccgcgcact

SEQ ID NO: 631147 - DNA, 25 bp, Rattus norvegicus
ccttcgaccggtgcctggcaggaaa

SEQ ID NO: 631148 - DNA, 25 bp, Rattus norvegicus
gcttcagcaaggaattctgccaaca

SEQ ID NO: 631149 - DNA, 25 bp, Rattus norvegicus
gctccgtgcacttggccatcttctt

SEQ ID NO: 631150 - DNA, 25 bp, Rattus norvegicus
ttcttcctgggtggtcagaaacgcg

SEQ ID NO: 631151 - DNA, 25 bp, Rattus norvegicus
gagcagagacccgattcgagggctt

SEQ ID NO: 631152 - DNA, 25 bp, Rattus norvegicus
attcgagggcttggagcttcagcaa

SEQ ID NO: 631153 - DNA, 25 bp, Rattus norvegicus
gggtgcctaacacacagctccgcgg

SEQ ID NO: 631154 - DNA, 25 bp, Rattus norvegicus
aggaaaggggtctcggctaaatgct

SEQ ID NO: 631155 - DNA, 25 bp, Rattus norvegicus
tcggctaaatgctgctgcttcgggg

SEQ ID NO: 631156 - DNA, 25 bp, Rattus norvegicus
cccgagtcagatgcgcattggtcct

SEQ ID NO: 631157 - DNA, 25 bp, Rattus norvegicus
gtcctcatgcggcttcaatgtctgg

SEQ ID NO: 631158 - DNA, 25 bp, Rattus norvegicus
caatgtctggctcgttcgagtccta

SEQ ID NO: 631159 - DNA, 25 bp, Rattus norvegicus
gctcgttcgagtcctaacgtatata

SEQ ID NO: 631160 - DNA, 25 bp, Rattus norvegicus
atgaagccagctaagcgggtgccta

SEQ ID NO: 631161 - DNA, 25 bp, Rattus norvegicus
tggcgtgggccgtttaaacttgtca

SEQ ID NO: 631162 - DNA, 25 bp, Rattus norvegicus
ggtagataacctcagtgcaaacgca

SEQ ID NO: 631163 - DNA, 25 bp, Rattus norvegicus
tgcaaacgcatcagatccgagtacg

SEQ ID NO: 631164 - DNA, 25 bp, Rattus norvegicus
tcagatccgagtacgccgggaaaga

SEQ ID NO: 631165 - DNA, 25 bp, Rattus norvegicus
gaaagaagcctttggcgttgagacg

SEQ ID NO: 631166 - DNA, 25 bp, Rattus norvegicus
cgttgagacggtggctccatcagac

SEQ ID NO: 631167 - DNA, 25 bp, Rattus norvegicus
gctccatcagacgagtcccaactgg

SEQ ID NO: 631168 - DNA, 25 bp, Rattus norvegicus
ctaagctcatgcattaaggctggga

SEQ ID NO: 631169 - DNA, 25 bp, Rattus norvegicus
cacgacacaatgaggagggaaggta

SEQ ID NO: 631170 - DNA, 25 bp, Rattus norvegicus
aacttgtcagggctgctgcttctcc

SEQ ID NO: 631171 - DNA, 25 bp, Rattus norvegicus
tcccaactggagattctgactaagc

SEQ ID NO: 631172 - DNA, 25 bp, Rattus norvegicus
ggacccgcaatgttggctgcgtttc

SEQ ID NO: 631173 - DNA, 25 bp, Rattus norvegicus
agtcgtctggttagtgttgcggacc

SEQ ID NO: 631174 - DNA, 25 bp, Rattus norvegicus
gtttccgacggacattcacgacaca

SEQ ID NO: 631175 - DNA, 25 bp, Rattus norvegicus
ttatttcgccactgccatttcccgg

SEQ ID NO: 631176 - DNA, 25 bp, Rattus norvegicus
cgcaacccataaccgcgcaggtgag

SEQ ID NO: 631177 - DNA, 25 bp, Rattus norvegicus
aaccgcgcaggtgagtcaagggtaa

SEQ ID NO: 631178 - DNA, 25 bp, Rattus norvegicus
cgcgcaccagcccagggtccggaga

SEQ ID NO: 631179 - DNA, 25 bp, Rattus norvegicus
tccggagaggagttcgtggtctcac

SEQ ID NO: 631180 - DNA, 25 bp, Rattus norvegicus
gagaggagttcgtggtctcaccgct

SEQ ID NO: 631181 - DNA, 25 bp, Rattus norvegicus
ggtctcaccgcttggtgttcccagg

SEQ ID NO: 631182 - DNA, 25 bp, Rattus norvegicus
tcaccgcttggtgttcccaggctca

SEQ ID NO: 631183 - DNA, 25 bp, Rattus norvegicus
acactcgctgcgttatttcgccact

SEQ ID NO: 631184 - DNA, 25 bp, Rattus norvegicus
ctcggggagccacggttcaccgctg

SEQ ID NO: 631185 - DNA, 25 bp, Rattus norvegicus
cacggttcaccgctgtgggctacgt

SEQ ID NO: 631186 - DNA, 25 bp, Rattus norvegicus
gcggagaatccgagagcggagccga

SEQ ID NO: 631187 - DNA, 25 bp, Rattus norvegicus
cccataaccgcgcaggtgagtcaag

SEQ ID NO: 631188 - DNA, 25 bp, Rattus norvegicus
agccacggttcaccgctgtgggcta

SEQ ID NO: 631189 - DNA, 25 bp, Rattus norvegicus
gtgtgcaaatgtctacgtgtcacta

SEQ ID NO: 631190 - DNA, 25 bp, Rattus norvegicus
tcgggagagtcgatctccatggaga

SEQ ID NO: 631191 - DNA, 25 bp, Rattus norvegicus
tcatgttctcgggagagtcgatctc

SEQ ID NO: 631192 - DNA, 25 bp, Rattus norvegicus
gcctcatcatgttctcgggagagtc

SEQ ID NO: 631193 - DNA, 25 bp, Rattus norvegicus
gatatgcctcatcatgttctcggga

SEQ ID NO: 631194 - DNA, 25 bp, Rattus norvegicus
taggaaccggatatgcctcatcatg

SEQ ID NO: 631195 - DNA, 25 bp, Rattus norvegicus
tcgttctttaggaaccggatatgcc

SEQ ID NO: 631196 - DNA, 25 bp, Rattus norvegicus
aggcgctccacttcgttctttagga

SEQ ID NO: 631197 - DNA, 25 bp, Rattus norvegicus
agctgcttcttcaggcgctccactt

SEQ ID NO: 631198 - DNA, 25 bp, Rattus norvegicus
gggaggccacatacgctgtaactgg

SEQ ID NO: 631199 - DNA, 25 bp, Rattus norvegicus
agtccctcggtagagcatggggact

SEQ ID NO: 631200 - DNA, 25 bp, Rattus norvegicus
tagtgacgcagtgactacggggacc

SEQ ID NO: 631201 - DNA, 25 bp, Rattus norvegicus
tctacgtgtcactagtgacgcagtg

SEQ ID NO: 631202 - DNA, 25 bp, Rattus norvegicus
tccatggagatgtctctaggcgacg

SEQ ID NO: 631203 - DNA, 25 bp, Rattus norvegicus
tctccgccttaccaccgcccacgaa

SEQ ID NO: 631204 - DNA, 25 bp, Rattus norvegicus
aggaaccggccctgggagcgcacca

SEQ ID NO: 631205 - DNA, 25 bp, Rattus norvegicus
cgccacccggtacctggtctaggag

SEQ ID NO: 631206 - DNA, 25 bp, Rattus norvegicus
tctaggagtcagagcgcagtaccga

SEQ ID NO: 631207 - DNA, 25 bp, Rattus norvegicus
gagcgcagtaccgactccgtctcgg

SEQ ID NO: 631208 - DNA, 25 bp, Rattus norvegicus
cctcctcagttttgtggccgcgctg

SEQ ID NO: 631209 - DNA, 25 bp, Rattus norvegicus
ggcggtacgcaacgtgccatgcgca

SEQ ID NO: 631210 - DNA, 25 bp, Rattus norvegicus
tacgcaacgtgccatgcgcagtgga

SEQ ID NO: 631211 - DNA, 25 bp, Rattus norvegicus
gaaccagggagactggccgagcctc

SEQ ID NO: 631212 - DNA, 25 bp, Rattus norvegicus
ccttcacggaagatgctcctcctta

SEQ ID NO: 631213 - DNA, 25 bp, Rattus norvegicus
tactccgcttcacggaggaagtccc

SEQ ID NO: 631214 - DNA, 25 bp, Rattus norvegicus
ccatccaaataggaagctccgcctc

SEQ ID NO: 631215 - DNA, 25 bp, Rattus norvegicus
cctcctgcagaggaagtcctgcctt

SEQ ID NO: 631216 - DNA, 25 bp, Rattus norvegicus
gcctctcgcctcctgcagaggaagt

SEQ ID NO: 631217 - DNA, 25 bp, Rattus norvegicus
ctcgccctctctaacggagttggga

SEQ ID NO: 631218 - DNA, 25 bp, Rattus norvegicus
tcctgcagggcccaaggccacgcgc

SEQ ID NO: 631219 - DNA, 25 bp, Rattus norvegicus
ggggacttccgggattggcctcaca

SEQ ID NO: 631220 - DNA, 25 bp, Rattus norvegicus
ggcctcgccctctctaacggagttg

SEQ ID NO: 631221 - DNA, 25 bp, Rattus norvegicus
ggcagggtgctaccgaggtcctgca

SEQ ID NO: 631222 - DNA, 25 bp, Rattus norvegicus
cagaacttctcgcaaagttccccta

SEQ ID NO: 631223 - DNA, 25 bp, Rattus norvegicus
agccctgccggatggcgggaaggga

SEQ ID NO: 631224 - DNA, 25 bp, Rattus norvegicus
acttccgggattggcctcacaggaa

SEQ ID NO: 631225 - DNA, 25 bp, Rattus norvegicus
tccgggattggcctcacaggaatgt

SEQ ID NO: 631226 - DNA, 25 bp, Rattus norvegicus
gggattggcctcacaggaatgttga

SEQ ID NO: 631227 - DNA, 25 bp, Rattus norvegicus
ctcacaggaatgttgaggctaacgt

SEQ ID NO: 631228 - DNA, 25 bp, Rattus norvegicus
acaggaatgttgaggctaacgtgcc

SEQ ID NO: 631229 - DNA, 25 bp, Rattus norvegicus
tgttgaggctaacgtgccgaattgg

SEQ ID NO: 631230 - DNA, 25 bp, Rattus norvegicus
cgccctctctaacggagttgggagg

SEQ ID NO: 631231 - DNA, 25 bp, Rattus norvegicus
gcagcgccttgcacttgagtttgta

SEQ ID NO: 631232 - DNA, 25 bp, Rattus norvegicus
aaggccggctccttgtgccctcagg

SEQ ID NO: 631233 - DNA, 25 bp, Rattus norvegicus
tcacgctggctttgcgcaggtcgcg

SEQ ID NO: 631234 - DNA, 25 bp, Rattus norvegicus
gctaggcggttggtgagctcctcca

SEQ ID NO: 631235 - DNA, 25 bp, Rattus norvegicus
gcacttgagtttgtaggtctccagc

SEQ ID NO: 631236 - DNA, 25 bp, Rattus norvegicus
actcacgatggtcacgctggctttg

SEQ ID NO: 631237 - DNA, 25 bp, Rattus norvegicus
ttgtaggtctccagctcgatcttga

SEQ ID NO: 631238 - DNA, 25 bp, Rattus norvegicus
ttctcctgctgcagcgaggctaggc

SEQ ID NO: 631239 - DNA, 25 bp, Rattus norvegicus
tgagctcctccaggcggaacggcga

SEQ ID NO: 631240 - DNA, 25 bp, Rattus norvegicus
gcggaacggcgagatgacaatgccc

SEQ ID NO: 631241 - DNA, 25 bp, Rattus norvegicus
cccgaggtcgccgagcaggacgact

SEQ ID NO: 631242 - DNA, 25 bp, Rattus norvegicus
cgagcaggacgactgcatggctgcc

SEQ ID NO: 631243 - DNA, 25 bp, Rattus norvegicus
agctgctccgccagggaacagagac

SEQ ID NO: 631244 - DNA, 25 bp, Rattus norvegicus
cgatcttgagcaccttgttctcctg

SEQ ID NO: 631245 - DNA, 25 bp, Rattus norvegicus
gtctctcaggtctaagcactcggca

SEQ ID NO: 631246 - DNA, 25 bp, Rattus norvegicus
aagcacaacgaaactgtctctcagg

SEQ ID NO: 631247 - DNA, 25 bp, Rattus norvegicus
ctgtttcaaaactagagcggacgcc

SEQ ID NO: 631248 - DNA, 25 bp, Rattus norvegicus
gctgttacagctttgcgccgctttc

SEQ ID NO: 631249 - DNA, 25 bp, Rattus norvegicus
aaggcagaggcatgaggaacgcaca

SEQ ID NO: 631250 - DNA, 25 bp, Rattus norvegicus
tttcccgtggccaaaagcacaacga

SEQ ID NO: 631251 - DNA, 25 bp, Rattus norvegicus
gctggtgtaaaaccgaactgtttca

SEQ ID NO: 631252 - DNA, 25 bp, Rattus norvegicus
actcggcaagtaaaggcaaggcaga

SEQ ID NO: 631253 - DNA, 25 bp, Rattus norvegicus
catgaggaacgcacacgtgatctcc

SEQ ID NO: 631254 - DNA, 25 bp, Rattus norvegicus
cccgctctctggactggtgcagtca

SEQ ID NO: 631255 - DNA, 25 bp, Rattus norvegicus
acaggttccgtgttggcagatgatc

SEQ ID NO: 631256 - DNA, 25 bp, Rattus norvegicus
ccatcgtgccagctggtgtaaaacc

SEQ ID NO: 631257 - DNA, 25 bp, Rattus norvegicus
tctgcaaaggaacggagacggctcc

SEQ ID NO: 631258 - DNA, 25 bp, Rattus norvegicus
aacggagacggctcccatcgtgcca

SEQ ID NO: 631259 - DNA, 25 bp, Rattus norvegicus
gggtgcttcccgagacacagccata

SEQ ID NO: 631260 - DNA, 25 bp, Rattus norvegicus
gtcggtgctaaaactcgcctgctta

SEQ ID NO: 631261 - DNA, 25 bp, Rattus norvegicus
cgcctgcttacaaagcaagcacaga

SEQ ID NO: 631262 - DNA, 25 bp, Rattus norvegicus
caagcacagaatgccctcgggcttt

SEQ ID NO: 631263 - DNA, 25 bp, Rattus norvegicus
gacacagccatacctgtcgtccaga

SEQ ID NO: 631264 - DNA, 25 bp, Rattus norvegicus
gtcgtccagacggtccagtaaccca

SEQ ID NO: 631265 - DNA, 25 bp, Rattus norvegicus
acccaccggttattcttcgcgcttg

SEQ ID NO: 631266 - DNA, 25 bp, Rattus norvegicus
tgcgccggggactctaggcttccac

SEQ ID NO: 631267 - DNA, 25 bp, Rattus norvegicus
taggcttccacttggcgtctcgttc

SEQ ID NO: 631268 - DNA, 25 bp, Rattus norvegicus
agtgaagacattgccagttctgctc

SEQ ID NO: 631269 - DNA, 25 bp, Rattus norvegicus
ggcgtctcgttctgccaacctgcaa

SEQ ID NO: 631270 - DNA, 25 bp, Rattus norvegicus
ttgccagttctgctcgcggaacacg

SEQ ID NO: 631271 - DNA, 25 bp, Rattus norvegicus
tgccaacctgcaagtgaagacattg

SEQ ID NO: 631272 - DNA, 25 bp, Rattus norvegicus
ttattcttcgcgcttgcgccgggga

SEQ ID NO: 631273 - DNA, 25 bp, Rattus norvegicus
gacgtggctatgtccatctggttct

SEQ ID NO: 631274 - DNA, 25 bp, Rattus norvegicus
gttcgcatttctactgaggagcagc

SEQ ID NO: 631275 - DNA, 25 bp, Rattus norvegicus
tttctactgaggagcagcgacacca

SEQ ID NO: 631276 - DNA, 25 bp, Rattus norvegicus
ggagcagcgacaccatgtccacgtg

SEQ ID NO: 631277 - DNA, 25 bp, Rattus norvegicus
acgtgcccttcctgcgctgcaaggt

SEQ ID NO: 631278 - DNA, 25 bp, Rattus norvegicus
ctgcaaggtggacggacgcaatccc

SEQ ID NO: 631279 - DNA, 25 bp, Rattus norvegicus
gacggacgcaatcccttgccgggta

SEQ ID NO: 631280 - DNA, 25 bp, Rattus norvegicus
cttgccgggtaacggcgtttgcatc

SEQ ID NO: 631281 - DNA, 25 bp, Rattus norvegicus
ttctgtcaaaaccaatcactcggtc

SEQ ID NO: 631282 - DNA, 25 bp, Rattus norvegicus
cgtactccagcagggacgtggctat

SEQ ID NO: 631283 - DNA, 25 bp, Rattus norvegicus
atctggttcttcttggcggcgatgt

SEQ ID NO: 631284 - DNA, 25 bp, Rattus norvegicus
gcgatgtgcagtggcgtataaccgt

SEQ ID NO: 631285 - DNA, 25 bp, Rattus norvegicus
tggcgtataaccgttctgtcaaaac

SEQ ID NO: 631286 - DNA, 25 bp, Rattus norvegicus
gcgtttgcatcagctccgtactcca

SEQ ID NO: 631287 - DNA, 25 bp, Rattus norvegicus
cacaacggatgaccgggtatcagta

SEQ ID NO: 631288 - DNA, 25 bp, Rattus norvegicus
ggggtctttgacgatccagagaaca

SEQ ID NO: 631289 - DNA, 25 bp, Rattus norvegicus
tcaggatctttatccggcgtcacgc

SEQ ID NO: 631290 - DNA, 25 bp, Rattus norvegicus
ctatacgtggattgatgggcgcaga

SEQ ID NO: 631291 - DNA, 25 bp, Rattus norvegicus
cgcgcgcggataccactatacgtgg

SEQ ID NO: 631292 - DNA, 25 bp, Rattus norvegicus
ttttgatgaatcgatggcgcgcgcg

SEQ ID NO: 631293 - DNA, 25 bp, Rattus norvegicus
ggcctaatggctgatttcgacaatc

SEQ ID NO: 631294 - DNA, 25 bp, Rattus norvegicus
taacgacctgatatctcgggcgctg

SEQ ID NO: 631295 - DNA, 25 bp, Rattus norvegicus
ccgcgtgactgacgtagaggctaac

SEQ ID NO: 631296 - DNA, 25 bp, Rattus norvegicus
agcctggtgtcgttatccgcgtgac

SEQ ID NO: 631297 - DNA, 25 bp, Rattus norvegicus
tctgtgtctattgtcgagcctggtg

SEQ ID NO: 631298 - DNA, 25 bp, Rattus norvegicus
gccacgcgtaacgagtctgtgtcta

SEQ ID NO: 631299 - DNA, 25 bp, Rattus norvegicus
tcagtagaaacgctggtgaccttgc

SEQ ID NO: 631300 - DNA, 25 bp, Rattus norvegicus
gtgaccttgcacataaacgcgcttc

SEQ ID NO: 631301 - DNA, 25 bp, Rattus norvegicus
cggagcaaatgatcggaacagaagc

SEQ ID NO: 631302 - DNA, 25 bp, Rattus norvegicus
gcggatcatgtcttcaggcgagttc

SEQ ID NO: 631303 - DNA, 25 bp, Rattus norvegicus
ttcggcctggcggagaacacgaaac

SEQ ID NO: 631304 - DNA, 25 bp, Rattus norvegicus
gacgaagtgccggagctggccatac

SEQ ID NO: 631305 - DNA, 25 bp, Rattus norvegicus
ccgggttgcttttccggagcaaatg

SEQ ID NO: 631306 - DNA, 25 bp, Rattus norvegicus
agctcgcactcagggcgggtgccaa

SEQ ID NO: 631307 - DNA, 25 bp, Rattus norvegicus
cgggtgccaaactccggtccagtct

SEQ ID NO: 631308 - DNA, 25 bp, Rattus norvegicus
acccggcgacgagcagagtcaatgt

SEQ ID NO: 631309 - DNA, 25 bp, Rattus norvegicus
tcaggctcccattctgtaacacagg

SEQ ID NO: 631310 - DNA, 25 bp, Rattus norvegicus
taacacagggctcctgcaaggtccc

SEQ ID NO: 631311 - DNA, 25 bp, Rattus norvegicus
catcatcgccgcagagtttgggaga

SEQ ID NO: 631312 - DNA, 25 bp, Rattus norvegicus
gggcgctcacctgctcaagatcggg

SEQ ID NO: 631313 - DNA, 25 bp, Rattus norvegicus
ctcaacccgggatccggggactgca

SEQ ID NO: 631314 - DNA, 25 bp, Rattus norvegicus
acgaaacccgaagacgccagtcgca

SEQ ID NO: 631315 - DNA, 25 bp, Rattus norvegicus
ctgcacgtacagctaggtgagaata

SEQ ID NO: 631316 - DNA, 25 bp, Rattus norvegicus
tggcgccatgaccaacggctctaaa

SEQ ID NO: 631317 - DNA, 25 bp, Rattus norvegicus
ggaagctaatcaccgtggcgccatg

SEQ ID NO: 631318 - DNA, 25 bp, Rattus norvegicus
ccatctgtctcatcggaagctaatc

SEQ ID NO: 631319 - DNA, 25 bp, Rattus norvegicus
acagctaggtgagaatagatgcggc

SEQ ID NO: 631320 - DNA, 25 bp, Rattus norvegicus
aaaccaggattgctttctccgcctc

SEQ ID NO: 631321 - DNA, 25 bp, Rattus norvegicus
ctctctagggtagaagattctagta

SEQ ID NO: 631322 - DNA, 25 bp, Rattus norvegicus
ctgaaataagcgtctctctagggta

SEQ ID NO: 631323 - DNA, 25 bp, Rattus norvegicus
tgttgcgctacaccgctgaaataag

SEQ ID NO: 631324 - DNA, 25 bp, Rattus norvegicus
cacacagtcttgttgcgctacaccg

SEQ ID NO: 631325 - DNA, 25 bp, Rattus norvegicus
ccgagtcgttgaagtacacacagtc

SEQ ID NO: 631326 - DNA, 25 bp, Rattus norvegicus
tctccgcctccgagtcgttgaagta

SEQ ID NO: 631327 - DNA, 25 bp, Rattus norvegicus
gcggcgtgtttttccatctgtctca

SEQ ID NO: 631328 - DNA, 25 bp, Rattus norvegicus
ttctagtaacggtacgaaagctgca

SEQ ID NO: 631329 - DNA, 25 bp, Rattus norvegicus
ctcctgtaattcctccggccgcggt

SEQ ID NO: 631330 - DNA, 25 bp, Rattus norvegicus
tttccgctccctttcgcgctctgca

SEQ ID NO: 631331 - DNA, 25 bp, Rattus norvegicus
tttaccgcggtgagtttgaaactgc

SEQ ID NO: 631332 - DNA, 25 bp, Rattus norvegicus
gcagcccgggccgtagcttagctcg

SEQ ID NO: 631333 - DNA, 25 bp, Rattus norvegicus
ccgtagcttagctcggctctgattg

SEQ ID NO: 631334 - DNA, 25 bp, Rattus norvegicus
ctcggctctgattggctcctttgaa

SEQ ID NO: 631335 - DNA, 25 bp, Rattus norvegicus
gaacagagaggtatggcgtgagtcc

SEQ ID NO: 631336 - DNA, 25 bp, Rattus norvegicus
tggctcctttgaacgtctacgtgca

SEQ ID NO: 631337 - DNA, 25 bp, Rattus norvegicus
aacgtctacgtgcaatcggattggc

SEQ ID NO: 631338 - DNA, 25 bp, Rattus norvegicus
tacgtgcaatcggattggcggaccc

SEQ ID NO: 631339 - DNA, 25 bp, Rattus norvegicus
actcggcctctaagctcccggagtc

SEQ ID NO: 631340 - DNA, 25 bp, Rattus norvegicus
tgagtttgaaactgctggcactcgg

SEQ ID NO: 631341 - DNA, 25 bp, Rattus norvegicus
tgattggctcctttgaacgtctacg

SEQ ID NO: 631342 - DNA, 25 bp, Rattus norvegicus
cgtccgcgcagtccggaactgcggt

SEQ ID NO: 631343 - DNA, 25 bp, Rattus norvegicus
agaggcaagccctgcccgaactata

SEQ ID NO: 631344 - DNA, 25 bp, Rattus norvegicus
gccctgcccgaactatagttcgaga

SEQ ID NO: 631345 - DNA, 25 bp, Rattus norvegicus
atagttcgagactctacttcaaacg

SEQ ID NO: 631346 - DNA, 25 bp, Rattus norvegicus
gactctacttcaaacgaacttccga

SEQ ID NO: 631347 - DNA, 25 bp, Rattus norvegicus
gaacttccgatctaaaaccaaagca

SEQ ID NO: 631348 - DNA, 25 bp, Rattus norvegicus
agcaaaagacaagaggcaaatcgtt

SEQ ID NO: 631349 - DNA, 25 bp, Rattus norvegicus
aggcaaatcgttgacagaaaatgtc

SEQ ID NO: 631350 - DNA, 25 bp, Rattus norvegicus
aatgtcacagaagcacgcggccatt

SEQ ID NO: 631351 - DNA, 25 bp, Rattus norvegicus
cggccattacagagacagggtgaga

SEQ ID NO: 631352 - DNA, 25 bp, Rattus norvegicus
cagggtgagagaatcgtgtatgtca

SEQ ID NO: 631353 - DNA, 25 bp, Rattus norvegicus
agacagcagaggcaagccctgcccg

SEQ ID NO: 631354 - DNA, 25 bp, Rattus norvegicus
gtgtatgtcactcttgacgtccagc

SEQ ID NO: 631355 - DNA, 25 bp, Rattus norvegicus
aagcacgcggccattacagagacag

SEQ ID NO: 631356 - DNA, 25 bp, Rattus norvegicus
gaggtcccgtggcttatactcgtaa

SEQ ID NO: 631357 - DNA, 25 bp, Rattus norvegicus
ctctactttggacccattggggctt

SEQ ID NO: 631358 - DNA, 25 bp, Rattus norvegicus
gagcgcgtccctatattccagagga

SEQ ID NO: 631359 - DNA, 25 bp, Rattus norvegicus
gggactcatttttcaaggcggaaga

SEQ ID NO: 631360 - DNA, 25 bp, Rattus norvegicus
ccgggtgacaagacgggactcattt

SEQ ID NO: 631361 - DNA, 25 bp, Rattus norvegicus
ggtcacttgaataggggcgccagcc

SEQ ID NO: 631362 - DNA, 25 bp, Rattus norvegicus
tgcctgaaccctgactacagaggtc

SEQ ID NO: 631363 - DNA, 25 bp, Rattus norvegicus
aggaatcattcccttcgctggatcc

SEQ ID NO: 631364 - DNA, 25 bp, Rattus norvegicus
cgtggacgcacttgggttcattcga

SEQ ID NO: 631365 - DNA, 25 bp, Rattus norvegicus
gtactaaaggtctccaacaagggca

SEQ ID NO: 631366 - DNA, 25 bp, Rattus norvegicus
cctggcagaacagatttggaccttc

SEQ ID NO: 631367 - DNA, 25 bp, Rattus norvegicus
tcgtacgggatacaaaccactttgc

SEQ ID NO: 631368 - DNA, 25 bp, Rattus norvegicus
ttagggctcgctccaattcgtacgg

SEQ ID NO: 631369 - DNA, 25 bp, Rattus norvegicus
tgccaggccagatagcgaacttttg

SEQ ID NO: 631370 - DNA, 25 bp, Rattus norvegicus
ttgccgagttcgatggaaagccacg

SEQ ID NO: 631371 - DNA, 25 bp, Rattus norvegicus
cgcctgaagcagaggcttctggact

SEQ ID NO: 631372 - DNA, 25 bp, Rattus norvegicus
aatgcggtgcgcaaagatgtgctcc

SEQ ID NO: 631373 - DNA, 25 bp, Rattus norvegicus
tgctcctggtcgtggaggataaaga

SEQ ID NO: 631374 - DNA, 25 bp, Rattus norvegicus
aggataaagaggacgtcggcgcata

SEQ ID NO: 631375 - DNA, 25 bp, Rattus norvegicus
cgcataggggattgtccagtaaaca

SEQ ID NO: 631376 - DNA, 25 bp, Rattus norvegicus
cagtaaacaggctgcgtcgctcgtc

SEQ ID NO: 631377 - DNA, 25 bp, Rattus norvegicus
tcgctcgtcccggtggacggacact

SEQ ID NO: 631378 - DNA, 25 bp, Rattus norvegicus
ttcaagtgggatttccagaactgca

SEQ ID NO: 631379 - DNA, 25 bp, Rattus norvegicus
ggcattgtcgaacacgtccttgatg

SEQ ID NO: 631380 - DNA, 25 bp, Rattus norvegicus
tccttgatgccaaactggtcaaaca

SEQ ID NO: 631381 - DNA, 25 bp, Rattus norvegicus
actggtcaaacacgctggtctcata

SEQ ID NO: 631382 - DNA, 25 bp, Rattus norvegicus
acgggatgccaagttccttcgccac

SEQ ID NO: 631383 - DNA, 25 bp, Rattus norvegicus
gcttctggacttttttcaagtggga

SEQ ID NO: 631384 - DNA, 25 bp, Rattus norvegicus
cgctggtctcatagtacgggatgcc

SEQ ID NO: 631385 - DNA, 25 bp, Rattus norvegicus
cgtgagcagccttggcggctattta

SEQ ID NO: 631386 - DNA, 25 bp, Rattus norvegicus
gcggctatttataaccacacgattg

SEQ ID NO: 631387 - DNA, 25 bp, Rattus norvegicus
ccacacgattggatttcattcatga

SEQ ID NO: 631388 - DNA, 25 bp, Rattus norvegicus
accagggccttgtgtgtctgaactg

SEQ ID NO: 631389 - DNA, 25 bp, Rattus norvegicus
ttgggaccagcgtgtgtcccgcatc

SEQ ID NO: 631390 - DNA, 25 bp, Rattus norvegicus
cctaggaactgaccggtcgcggact

SEQ ID NO: 631391 - DNA, 25 bp, Rattus norvegicus
actccgagggaggacattggctttt

SEQ ID NO: 631392 - DNA, 25 bp, Rattus norvegicus
tcactcctccgtgaggggactgtcc

SEQ ID NO: 631393 - DNA, 25 bp, Rattus norvegicus
cgggtgctcctccacatctctttgg

SEQ ID NO: 631394 - DNA, 25 bp, Rattus norvegicus
ccactaaccggctgggcagcatagc

SEQ ID NO: 631395 - DNA, 25 bp, Rattus norvegicus
ctcagccgctacaagttaggggtgc

SEQ ID NO: 631396 - DNA, 25 bp, Rattus norvegicus
ctgttgtacgtgttctcagccgcta

SEQ ID NO: 631397 - DNA, 25 bp, Rattus norvegicus
ccggcctgctaaggtgcctgttgta

SEQ ID NO: 631398 - DNA, 25 bp, Rattus norvegicus
tcactcccgcaaacgtcggctgggg

SEQ ID NO: 631399 - DNA, 25 bp, Rattus norvegicus
cggcaaatgccagcggggaaaccac

SEQ ID NO: 631400 - DNA, 25 bp, Rattus norvegicus
gtgtccaaaaagatgcaccggtatc

SEQ ID NO: 631401 - DNA, 25 bp, Rattus norvegicus
ccactggcgtgtccaaaaagatgca

SEQ ID NO: 631402 - DNA, 25 bp, Rattus norvegicus
ggtaccactggcgtgtccaaaaaga

SEQ ID NO: 631403 - DNA, 25 bp, Rattus norvegicus
cgccggctaggaccatgacgaacaa

SEQ ID NO: 631404 - DNA, 25 bp, Rattus norvegicus
gcactctcaccatttgtagcctcgg

SEQ ID NO: 631405 - DNA, 25 bp, Rattus norvegicus
gctaggaccatgacgaacaatgccc

SEQ ID NO: 631406 - DNA, 25 bp, Rattus norvegicus
tccaaaaagatgcaccggtatccca

SEQ ID NO: 631407 - DNA, 25 bp, Rattus norvegicus
ggtatcccacgtgcccgccaaactc

SEQ ID NO: 631408 - DNA, 25 bp, Rattus norvegicus
ggaaaccacagacatcggagacccg

SEQ ID NO: 631409 - DNA, 25 bp, Rattus norvegicus
acatcggagacccgggctttggtgc

SEQ ID NO: 631410 - DNA, 25 bp, Rattus norvegicus
cagcgctgcgctgggaccccaggta

SEQ ID NO: 631411 - DNA, 25 bp, Rattus norvegicus
cccaggtaccactggcgtgtccaaa

SEQ ID NO: 631412 - DNA, 25 bp, Rattus norvegicus
aagatgcaccggtatcccacgtgcc

SEQ ID NO: 631413 - DNA, 25 bp, Rattus norvegicus
attaagaactatctcgcgcccactc

SEQ ID NO: 631414 - DNA, 25 bp, Rattus norvegicus
gggtgtgaccgcacctctaccggca

SEQ ID NO: 631415 - DNA, 25 bp, Rattus norvegicus
tctgcccgggcggatttcaaagcgg

SEQ ID NO: 631416 - DNA, 25 bp, Rattus norvegicus
gcggatttcaaagcggtcgtgtaac

SEQ ID NO: 631417 - DNA, 25 bp, Rattus norvegicus
agcggtcgtgtaaccggcacaaaca

SEQ ID NO: 631418 - DNA, 25 bp, Rattus norvegicus
tgtaaccggcacaaacacgttcggc

SEQ ID NO: 631419 - DNA, 25 bp, Rattus norvegicus
ggcacaaacacgttcggcattaaga

SEQ ID NO: 631420 - DNA, 25 bp, Rattus norvegicus
ttcggcattaagaactatctcgcgc

SEQ ID NO: 631421 - DNA, 25 bp, Rattus norvegicus
tcccggagccatttgatgttctggt

SEQ ID NO: 631422 - DNA, 25 bp, Rattus norvegicus
tttccagtgactccacgcgaagtgg

SEQ ID NO: 631423 - DNA, 25 bp, Rattus norvegicus
cacgcgaagtggacgtcttccagtg

SEQ ID NO: 631424 - DNA, 25 bp, Rattus norvegicus
tccctcgggctctgtcactgcgggt

SEQ ID NO: 631425 - DNA, 25 bp, Rattus norvegicus
ccatttgatgttctggtttccagtg

SEQ ID NO: 631426 - DNA, 25 bp, Rattus norvegicus
tcactgcgggtgtgaccgcacctct

SEQ ID NO: 631427 - DNA, 25 bp, Rattus norvegicus
aggctgcgaagacactgggagcaaa

SEQ ID NO: 631428 - DNA, 25 bp, Rattus norvegicus
acgagacccgaggactctgcacaga

SEQ ID NO: 631429 - DNA, 25 bp, Rattus norvegicus
ctctagaacagcacgagacccgagg

SEQ ID NO: 631430 - DNA, 25 bp, Rattus norvegicus
actagggtccgctccgtctctagaa

SEQ ID NO: 631431 - DNA, 25 bp, Rattus norvegicus
accaagtccgagctgcaggggaacc

SEQ ID NO: 631432 - DNA, 25 bp, Rattus norvegicus
tcggccgtaccaagtccgagctgca

SEQ ID NO: 631433 - DNA, 25 bp, Rattus norvegicus
caaccacgatttgaaaagcgcgccc

SEQ ID NO: 631434 - DNA, 25 bp, Rattus norvegicus
ttcggcgcacgtcaaccacgatttg

SEQ ID NO: 631435 - DNA, 25 bp, Rattus norvegicus
ggatctcggtccaggctgccactct

SEQ ID NO: 631436 - DNA, 25 bp, Rattus norvegicus
acaggcgtgcaacgccacggagctc

SEQ ID NO: 631437 - DNA, 25 bp, Rattus norvegicus
ctcctcgggtgcagcctacaggcgt

SEQ ID NO: 631438 - DNA, 25 bp, Rattus norvegicus
tgcaagcctaggaagacccgcaggt

SEQ ID NO: 631439 - DNA, 25 bp, Rattus norvegicus
tcacctcctctgcaagcctaggaag

SEQ ID NO: 631440 - DNA, 25 bp, Rattus norvegicus
ctacagccggccttaagcaagggcg

SEQ ID NO: 631441 - DNA, 25 bp, Rattus norvegicus
gctctgctgaaaaccgctcgcgcgg

SEQ ID NO: 631442 - DNA, 25 bp, Rattus norvegicus
atccacgcagtcaccagcgggagcg

SEQ ID NO: 631443 - DNA, 25 bp, Rattus norvegicus
agccactcgcacgaactcgcgtgag

SEQ ID NO: 631444 - DNA, 25 bp, Rattus norvegicus
gcacgaactcgcgtgagcacgaatc

SEQ ID NO: 631445 - DNA, 25 bp, Rattus norvegicus
gaactcgcgtgagcacgaatccacg

SEQ ID NO: 631446 - DNA, 25 bp, Rattus norvegicus
tgagcacgaatccacgcagtcacca

SEQ ID NO: 631447 - DNA, 25 bp, Rattus norvegicus
acaagtcgggtaagtggtctcggct

SEQ ID NO: 631448 - DNA, 25 bp, Rattus norvegicus
cagcggcagcaacaagtcgggtaag

SEQ ID NO: 631449 - DNA, 25 bp, Rattus norvegicus
ttacggctctgctgaaaaccgctcg

SEQ ID NO: 631450 - DNA, 25 bp, Rattus norvegicus
cctgatttacggctctgctgaaaac

SEQ ID NO: 631451 - DNA, 25 bp, Rattus norvegicus
ccgctccatggacacgcggggaggt

SEQ ID NO: 631452 - DNA, 25 bp, Rattus norvegicus
tggctcagcctgatttacggctctg

SEQ ID NO: 631453 - DNA, 25 bp, Rattus norvegicus
agccgacctggctcagcctgattta

SEQ ID NO: 631454 - DNA, 25 bp, Rattus norvegicus
gcagcaacaagtcgggtaagtggtc

SEQ ID NO: 631455 - DNA, 25 bp, Rattus norvegicus
gctcacgtccgagaaaagttcaatc

SEQ ID NO: 631456 - DNA, 25 bp, Rattus norvegicus
ttcaatcgcatggtagaggccgtgg

SEQ ID NO: 631457 - DNA, 25 bp, Rattus norvegicus
ctcaccaaagagttggcccagaaaa

SEQ ID NO: 631458 - DNA, 25 bp, Rattus norvegicus
aactgttggaagtccgggcagcctt

SEQ ID NO: 631459 - DNA, 25 bp, Rattus norvegicus
aggccgtggacaggaccatcgagaa

SEQ ID NO: 631460 - DNA, 25 bp, Rattus norvegicus
ccatcgagaagagaatcgacaaact

SEQ ID NO: 631461 - DNA, 25 bp, Rattus norvegicus
ctgaagcagcgcttgacggagtccg

SEQ ID NO: 631462 - DNA, 25 bp, Rattus norvegicus
gggcagcctttgtgcagctgactca

SEQ ID NO: 631463 - DNA, 25 bp, Rattus norvegicus
tgcagctgactcagaagaagcagga

SEQ ID NO: 631464 - DNA, 25 bp, Rattus norvegicus
aagcaggaagtccagaggcgagaac

SEQ ID NO: 631465 - DNA, 25 bp, Rattus norvegicus
cgagaacgcgccctgcacaaacagg

SEQ ID NO: 631466 - DNA, 25 bp, Rattus norvegicus
gaaatgatcgccgtgctgaagcagc

SEQ ID NO: 631467 - DNA, 25 bp, Rattus norvegicus
tcgacgtggctgtggaaatgatcgc

SEQ ID NO: 631468 - DNA, 25 bp, Rattus norvegicus
ctgcacaaacaggtcgacgtggctg

SEQ ID NO: 631469 - DNA, 25 bp, Rattus norvegicus
cgtgaatggatctccgcgcttgagg

SEQ ID NO: 631470 - DNA, 25 bp, Rattus norvegicus
accgggacaacctgcaccagattga

SEQ ID NO: 631471 - DNA, 25 bp, Rattus norvegicus
agccagtggtccctgcgtactcact

SEQ ID NO: 631472 - DNA, 25 bp, Rattus norvegicus
ccgggccgagtacaccgaagccagt

SEQ ID NO: 631473 - DNA, 25 bp, Rattus norvegicus
ggccgccgcctgaacagcagttcga

SEQ ID NO: 631474 - DNA, 25 bp, Rattus norvegicus
gcaaggtccgcatcagctgcatgga

SEQ ID NO: 631475 - DNA, 25 bp, Rattus norvegicus
ctcaaggtgctgtacggcaaggtcc

SEQ ID NO: 631476 - DNA, 25 bp, Rattus norvegicus
acccgggcatgcacggtatgctcaa

SEQ ID NO: 631477 - DNA, 25 bp, Rattus norvegicus
tgctcaagagcggtacgtgcatccc

SEQ ID NO: 631478 - DNA, 25 bp, Rattus norvegicus
cacatctacgagacggagggcttca

SEQ ID NO: 631479 - DNA, 25 bp, Rattus norvegicus
cgccggtcacttacatgcacatcta

SEQ ID NO: 631480 - DNA, 25 bp, Rattus norvegicus
ggttcgcgccgaagacctcaacatc

SEQ ID NO: 631481 - DNA, 25 bp, Rattus norvegicus
cccggagaacctgagccagctcaag

SEQ ID NO: 631482 - DNA, 25 bp, Rattus norvegicus
ccgggactgccactattaccgtgtg

SEQ ID NO: 631483 - DNA, 25 bp, Rattus norvegicus
aggtggtcacttcggctgaagtttc

SEQ ID NO: 631484 - DNA, 25 bp, Rattus norvegicus
caggggtacggcctttcgtgcactg

SEQ ID NO: 631485 - DNA, 25 bp, Rattus norvegicus
gcttcctttcgtcactccgggcaaa

SEQ ID NO: 631486 - DNA, 25 bp, Rattus norvegicus
gtcactccgggcaaacttacggcca

SEQ ID NO: 631487 - DNA, 25 bp, Rattus norvegicus
tccgggcaaacttacggccacaata

SEQ ID NO: 631488 - DNA, 25 bp, Rattus norvegicus
cttacggccacaatagtcacaggca

SEQ ID NO: 631489 - DNA, 25 bp, Rattus norvegicus
gccacaatagtcacaggcaaagggc

SEQ ID NO: 631490 - DNA, 25 bp, Rattus norvegicus
cttcggctgaagtttcgcatgcaga

SEQ ID NO: 631491 - DNA, 25 bp, Rattus norvegicus
ttcggatgtgcctggtcagctcatc

SEQ ID NO: 631492 - DNA, 25 bp, Rattus norvegicus
tgcctggtcagctcatcagagcgtg

SEQ ID NO: 631493 - DNA, 25 bp, Rattus norvegicus
catcagagcgtgagaacctcctgtc

SEQ ID NO: 631494 - DNA, 25 bp, Rattus norvegicus
agcgtgagaacctcctgtcgcaacc

SEQ ID NO: 631495 - DNA, 25 bp, Rattus norvegicus
ttgtgaccggtgtggattcggatgt

SEQ ID NO: 631496 - DNA, 25 bp, Rattus norvegicus
cctgtcgcaaccctctgctgggcag

SEQ ID NO: 631497 - DNA, 25 bp, Rattus norvegicus
tcctgctgatggacctgactcaaga

SEQ ID NO: 631498 - DNA, 25 bp, Rattus norvegicus
cttttggtgaccaggtgcatctgcc

SEQ ID NO: 631499 - DNA, 25 bp, Rattus norvegicus
ttagcctgactgctgaactttccca

SEQ ID NO: 631500 - DNA, 25 bp, Rattus norvegicus
ctcaagaaccaggagcgggtgatcc

SEQ ID NO: 631501 - DNA, 25 bp, Rattus norvegicus
cctatcccagaagcgcagagtcctg

SEQ ID NO: 631502 - DNA, 25 bp, Rattus norvegicus
ttagctctccagaggcgcagcttta

SEQ ID NO: 631503 - DNA, 25 bp, Rattus norvegicus
aagcgtaacgcgctcgttgagcctc

SEQ ID NO: 631504 - DNA, 25 bp, Rattus norvegicus
tggtgcctctcagccgcatcagaag

SEQ ID NO: 631505 - DNA, 25 bp, Rattus norvegicus
ttcactccggggctatgcgcaagtt

SEQ ID NO: 631506 - DNA, 25 bp, Rattus norvegicus
ctgttatttgccctgctccgtctgg

SEQ ID NO: 631507 - DNA, 25 bp, Rattus norvegicus
gcattgccaaggaacccggagcaca

SEQ ID NO: 631508 - DNA, 25 bp, Rattus norvegicus
ggaagacgactttacacagcattgc

SEQ ID NO: 631509 - DNA, 25 bp, Rattus norvegicus
taagagtctgggcttctaggaaggc

SEQ ID NO: 631510 - DNA, 25 bp, Rattus norvegicus
gggtgatccttcagccctgcgtcca

SEQ ID NO: 631511 - DNA, 25 bp, Rattus norvegicus
tagaaagtgctcgtggagccagccc

SEQ ID NO: 631512 - DNA, 25 bp, Rattus norvegicus
atacgcggctgtgaatttgggatcc

SEQ ID NO: 631513 - DNA, 25 bp, Rattus norvegicus
gaatttgggatcctcacctcgggcc

SEQ ID NO: 631514 - DNA, 25 bp, Rattus norvegicus
actctcctggtcaccgaggctcggt

SEQ ID NO: 631515 - DNA, 25 bp, Rattus norvegicus
gcttctccatggagctcaggatgga

SEQ ID NO: 631516 - DNA, 25 bp, Rattus norvegicus
ccgccatcttgggaatgagtgagaa

SEQ ID NO: 631517 - DNA, 25 bp, Rattus norvegicus
tcggaagcgaaaaatcgcgctgctc

SEQ ID NO: 631518 - DNA, 25 bp, Rattus norvegicus
cccgtttaaggcagcgagccgaggc

SEQ ID NO: 631519 - DNA, 25 bp, Rattus norvegicus
taagccggaggctaactggtgcaga

SEQ ID NO: 631520 - DNA, 25 bp, Rattus norvegicus
gtgcagagacgtttaatggcaattc

SEQ ID NO: 631521 - DNA, 25 bp, Rattus norvegicus
ccaagcccatgcacaagtagaaagt

SEQ ID NO: 631522 - DNA, 25 bp, Rattus norvegicus
gccgcgcagcgccttaaatagattc

SEQ ID NO: 631523 - DNA, 25 bp, Rattus norvegicus
gaccgaggcggatacattcatcaga

SEQ ID NO: 631524 - DNA, 25 bp, Rattus norvegicus
gcaattcgtataaaccaagcccatg

SEQ ID NO: 631525 - DNA, 25 bp, Rattus norvegicus
tctctgcggctgttaacgtcctcca

SEQ ID NO: 631526 - DNA, 25 bp, Rattus norvegicus
cagccgccatcaccagcagaagagg

SEQ ID NO: 631527 - DNA, 25 bp, Rattus norvegicus
tagtccggcaggatgtctctgcggc

SEQ ID NO: 631528 - DNA, 25 bp, Rattus norvegicus
caggatgtctctgcggctgttaacg

SEQ ID NO: 631529 - DNA, 25 bp, Rattus norvegicus
ggctgttaacgtcctccagcgccat

SEQ ID NO: 631530 - DNA, 25 bp, Rattus norvegicus
tccagcgccatctccaccgcgggct

SEQ ID NO: 631531 - DNA, 25 bp, Rattus norvegicus
tcatgggaaacagcgccccgatgta

SEQ ID NO: 631532 - DNA, 25 bp, Rattus norvegicus
cccgatgtatactgcacgccgttct

SEQ ID NO: 631533 - DNA, 25 bp, Rattus norvegicus
agtgagaggcccacaccggagccac

SEQ ID NO: 631534 - DNA, 25 bp, Rattus norvegicus
gccatcaccagcagaagaggcagcg

SEQ ID NO: 631535 - DNA, 25 bp, Rattus norvegicus
ggacacttcttctggggaaggcttc

SEQ ID NO: 631536 - DNA, 25 bp, Rattus norvegicus
aggtgtctccatccccggtctcatt

SEQ ID NO: 631537 - DNA, 25 bp, Rattus norvegicus
cttcttctggggaaggcttctggga

SEQ ID NO: 631538 - DNA, 25 bp, Rattus norvegicus
cgatgtatactgcacgccgttctga

SEQ ID NO: 631539 - DNA, 25 bp, Rattus norvegicus
cgcctacctagaaacccagacaaga

SEQ ID NO: 631540 - DNA, 25 bp, Rattus norvegicus
tctccttgaacgaggacctgcgctc

SEQ ID NO: 631541 - DNA, 25 bp, Rattus norvegicus
gacggccgggattatatctccttga

SEQ ID NO: 631542 - DNA, 25 bp, Rattus norvegicus
tccgcggttattgtcaggaggctta

SEQ ID NO: 631543 - DNA, 25 bp, Rattus norvegicus
tcacacgctgcagtggatgtacggc

SEQ ID NO: 631544 - DNA, 25 bp, Rattus norvegicus
tgaccggcgtttccctttcagaatc

SEQ ID NO: 631545 - DNA, 25 bp, Rattus norvegicus
tctggcatatctactgacagcgggc

SEQ ID NO: 631546 - DNA, 25 bp, Rattus norvegicus
gcagagttctgcttaggtttcggtt

SEQ ID NO: 631547 - DNA, 25 bp, Rattus norvegicus
tgacccggcgggtcaaagtttcatc

SEQ ID NO: 631548 - DNA, 25 bp, Rattus norvegicus
tgagactggcctgggtcatcttgac

SEQ ID NO: 631549 - DNA, 25 bp, Rattus norvegicus
tgcgggagggatcacaaacaggatc

SEQ ID NO: 631550 - DNA, 25 bp, Rattus norvegicus
ttcaaagtgaatctgaggaccctgc

SEQ ID NO: 631551 - DNA, 25 bp, Rattus norvegicus
gctatgacagcgatgtggagaatcc

SEQ ID NO: 631552 - DNA, 25 bp, Rattus norvegicus
cccaggttcattgtcgttggctacg

SEQ ID NO: 631553 - DNA, 25 bp, Rattus norvegicus
tttcttgacccacgctaccgggagc

SEQ ID NO: 631554 - DNA, 25 bp, Rattus norvegicus
ctgcccgcttggagtaccatggtca

SEQ ID NO: 631555 - DNA, 25 bp, Rattus norvegicus
ctccagctgctgcacaaagcgggcg

SEQ ID NO: 631556 - DNA, 25 bp, Rattus norvegicus
gccaggcgacagacaggatacccta

SEQ ID NO: 631557 - DNA, 25 bp, Rattus norvegicus
gataccctaggaagacactgcgctc

SEQ ID NO: 631558 - DNA, 25 bp, Rattus norvegicus
cctatgcgtacactttccaagggtg

SEQ ID NO: 631559 - DNA, 25 bp, Rattus norvegicus
cccttgcttagagcttgttcggcga

SEQ ID NO: 631560 - DNA, 25 bp, Rattus norvegicus
ttcggcgatgagtgacaacaaatga

SEQ ID NO: 631561 - DNA, 25 bp, Rattus norvegicus
caaatgacagtttcgggtcgccgtg

SEQ ID NO: 631562 - DNA, 25 bp, Rattus norvegicus
tgcccttccagtagaaatcttcctg

SEQ ID NO: 631563 - DNA, 25 bp, Rattus norvegicus
gagctaaaactgctggccctccgga

SEQ ID NO: 631564 - DNA, 25 bp, Rattus norvegicus
tccaaagtcccgcagcgaagggatc

SEQ ID NO: 631565 - DNA, 25 bp, Rattus norvegicus
cgaccagatggaagcttggacactc

SEQ ID NO: 631566 - DNA, 25 bp, Rattus norvegicus
cagcccgagctaggcagttctcttt

SEQ ID NO: 631567 - DNA, 25 bp, Rattus norvegicus
gagggaccttgaccctcggtgccca

SEQ ID NO: 631568 - DNA, 25 bp, Rattus norvegicus
ccggctccgggttctgcttggagcc

SEQ ID NO: 631569 - DNA, 25 bp, Rattus norvegicus
gttctgcttggagcctcctgccagc

SEQ ID NO: 631570 - DNA, 25 bp, Rattus norvegicus
gtctatggaagtgatggaaggaccc

SEQ ID NO: 631571 - DNA, 25 bp, Rattus norvegicus
ccctcaaccttgtgagtggtcgcgg

SEQ ID NO: 631572 - DNA, 25 bp, Rattus norvegicus
tcaaccttgtgagtggtcgcgggct

SEQ ID NO: 631573 - DNA, 25 bp, Rattus norvegicus
aactgtgagctcagagggaccttga

SEQ ID NO: 631574 - DNA, 25 bp, Rattus norvegicus
gctgcgccaacgaaggcccctttga

SEQ ID NO: 631575 - DNA, 25 bp, Rattus norvegicus
acccgtggcatctgccctgctggga

SEQ ID NO: 631576 - DNA, 25 bp, Rattus norvegicus
tggcatctgccctgctgggaccgcg

SEQ ID NO: 631577 - DNA, 25 bp, Rattus norvegicus
tgggaccgcgttccagcgccacgta

SEQ ID NO: 631578 - DNA, 25 bp, Rattus norvegicus
cctttgaaacagctggatcggaacc

SEQ ID NO: 631579 - DNA, 25 bp, Rattus norvegicus
cagcgccacgtagccgcctgcaggc

SEQ ID NO: 631580 - DNA, 25 bp, Rattus norvegicus
tgggctctcactgccggctccgggt

SEQ ID NO: 631581 - DNA, 25 bp, Rattus norvegicus
ggagctgttcggagatttacacctc

SEQ ID NO: 631582 - DNA, 25 bp, Rattus norvegicus
ttctgattccgtgttggagctgttc

SEQ ID NO: 631583 - DNA, 25 bp, Rattus norvegicus
tcctcccggtggcaattctgattcc

SEQ ID NO: 631584 - DNA, 25 bp, Rattus norvegicus
taaaccagcattcctcccggtggca

SEQ ID NO: 631585 - DNA, 25 bp, Rattus norvegicus
aggaaccgctttcccactagctcgg

SEQ ID NO: 631586 - DNA, 25 bp, Rattus norvegicus
cggccggcggctctaaaccagcatt

SEQ ID NO: 631587 - DNA, 25 bp, Rattus norvegicus
agcgccgtcgtcaaggagcccgaat

SEQ ID NO: 631588 - DNA, 25 bp, Rattus norvegicus
cgtgagaacacatagcgccgtcgtc

SEQ ID NO: 631589 - DNA, 25 bp, Rattus norvegicus
tccgcatgtcaggagcgacggccgt

SEQ ID NO: 631590 - DNA, 25 bp, Rattus norvegicus
agccaactccgggaggtccgcatgt

SEQ ID NO: 631591 - DNA, 25 bp, Rattus norvegicus
ggagatttacacctcctgccgcctt

SEQ ID NO: 631592 - DNA, 25 bp, Rattus norvegicus
gccgccttcttacaggaacgctaga

SEQ ID NO: 631593 - DNA, 25 bp, Rattus norvegicus
aaactgacaggaatgtgcgcgcggc

SEQ ID NO: 631594 - DNA, 25 bp, Rattus norvegicus
gcggcccacaggcaaactgacagga

SEQ ID NO: 631595 - DNA, 25 bp, Rattus norvegicus
caacccgggcctgtggtaggccctg

SEQ ID NO: 631596 - DNA, 25 bp, Rattus norvegicus
gatggtgtcctggatgatctcccga

SEQ ID NO: 631597 - DNA, 25 bp, Rattus norvegicus
gatgatctcccgagccgtgggttaa

SEQ ID NO: 631598 - DNA, 25 bp, Rattus norvegicus
tgcattgcaccacgagcctcgcggt

SEQ ID NO: 631599 - DNA, 25 bp, Rattus norvegicus
gcccgagcctttgtcaccaggtcta

SEQ ID NO: 631600 - DNA, 25 bp, Rattus norvegicus
tcaccaggtctaccgcgttgcggtg

SEQ ID NO: 631601 - DNA, 25 bp, Rattus norvegicus
gcacgccgcttggtcacgtgtagga

SEQ ID NO: 631602 - DNA, 25 bp, Rattus norvegicus
agagatccgtgtcagagcccaggct

SEQ ID NO: 631603 - DNA, 25 bp, Rattus norvegicus
cccaggctgcagagtcgtgctcagg

SEQ ID NO: 631604 - DNA, 25 bp, Rattus norvegicus
acccgcgaaggagcttgctctagaa

SEQ ID NO: 631605 - DNA, 25 bp, Rattus norvegicus
tgctctagaaaggtcggccaaaccc

SEQ ID NO: 631606 - DNA, 25 bp, Rattus norvegicus
aaaccctgaccaggagggccctgtg

SEQ ID NO: 631607 - DNA, 25 bp, Rattus norvegicus
tgtggtaggccctgactacccagcc

SEQ ID NO: 631608 - DNA, 25 bp, Rattus norvegicus
gcccagcggccgaaaagatggtgtc

SEQ ID NO: 631609 - DNA, 25 bp, Rattus norvegicus
cagcatcgctgggtgcatagtccca

SEQ ID NO: 631610 - DNA, 25 bp, Rattus norvegicus
taagccgcctctggatccgagagca

SEQ ID NO: 631611 - DNA, 25 bp, Rattus norvegicus
tgagcaaactttccagctggtcttc

SEQ ID NO: 631612 - DNA, 25 bp, Rattus norvegicus
agctggtcttcgtccgcgtaacttt

SEQ ID NO: 631613 - DNA, 25 bp, Rattus norvegicus
gcgggcctaggatggacacttacca

SEQ ID NO: 631614 - DNA, 25 bp, Rattus norvegicus
gtggggagctactccgcaaatgtcc

SEQ ID NO: 631615 - DNA, 25 bp, Rattus norvegicus
ccggggttgtacacaccagttgtag

SEQ ID NO: 631616 - DNA, 25 bp, Rattus norvegicus
tgcacagtgtcccacgagcgtagtg

SEQ ID NO: 631617 - DNA, 25 bp, Rattus norvegicus
gcggcgtctcccagtacagacctta

SEQ ID NO: 631618 - DNA, 25 bp, Rattus norvegicus
tagtcccagcccaggagagatccgc

SEQ ID NO: 631619 - DNA, 25 bp, Rattus norvegicus
tcagcctttgctggaccctgtaccg

SEQ ID NO: 631620 - DNA, 25 bp, Rattus norvegicus
ggatctttgttagccacccgccaca

SEQ ID NO: 631621 - DNA, 25 bp, Rattus norvegicus
gctaagctttctgcggattgctgta

SEQ ID NO: 631622 - DNA, 25 bp, Rattus norvegicus
tcgcacgagtcttcagccagcatcg

SEQ ID NO: 631623 - DNA, 25 bp, Rattus norvegicus
tgctctctaggcctggactcaactg

SEQ ID NO: 631624 - DNA, 25 bp, Rattus norvegicus
gggtgacgcccacttccgtcttgct

SEQ ID NO: 631625 - DNA, 25 bp, Rattus norvegicus
tgtcagagccggcaacagccatggt

SEQ ID NO: 631626 - DNA, 25 bp, Rattus norvegicus
cctagtgttttgtaagttggcagcg

SEQ ID NO: 631627 - DNA, 25 bp, Rattus norvegicus
ccgagacttctactggctgcgttcc

SEQ ID NO: 631628 - DNA, 25 bp, Rattus norvegicus
ctggctgcgttccttcttagccgga

SEQ ID NO: 631629 - DNA, 25 bp, Rattus norvegicus
tcttagccggaggtaggtgttcacc

SEQ ID NO: 631630 - DNA, 25 bp, Rattus norvegicus
gtgttcaccgctgggatcctggagt

SEQ ID NO: 631631 - DNA, 25 bp, Rattus norvegicus
tgaagccagccgcaggccagtcaga

SEQ ID NO: 631632 - DNA, 25 bp, Rattus norvegicus
gacagtcccgggcttctgctgcagc

SEQ ID NO: 631633 - DNA, 25 bp, Rattus norvegicus
gcgcccagccgggtctttacttcag

SEQ ID NO: 631634 - DNA, 25 bp, Rattus norvegicus
gggtctttacttcagccgctgcagc

SEQ ID NO: 631635 - DNA, 25 bp, Rattus norvegicus
acatcggaaccttgagcgtcccaga

SEQ ID NO: 631636 - DNA, 25 bp, Rattus norvegicus
cagccatggtgcttcctagtgtttt

SEQ ID NO: 631637 - DNA, 25 bp, Rattus norvegicus
cggcgagcgtaagcgtgacagctcc

SEQ ID NO: 631638 - DNA, 25 bp, Rattus norvegicus
cttcagcaggaatggagccgctgga

SEQ ID NO: 631639 - DNA, 25 bp, Rattus norvegicus
tcttcaggcgggcttcagcaggaat

SEQ ID NO: 631640 - DNA, 25 bp, Rattus norvegicus
ccagtgttaactgggacctgggcgt

SEQ ID NO: 631641 - DNA, 25 bp, Rattus norvegicus
ggcgatccttctcggccagtgttaa

SEQ ID NO: 631642 - DNA, 25 bp, Rattus norvegicus
agccgctggacgatctggacctgct

SEQ ID NO: 631643 - DNA, 25 bp, Rattus norvegicus
cgtaagcgtgacagctccgcaggtt

SEQ ID NO: 631644 - DNA, 25 bp, Rattus norvegicus
agctccgcaggttcactcaggaatc

SEQ ID NO: 631645 - DNA, 25 bp, Rattus norvegicus
gcaggttcactcaggaatccggtcc

SEQ ID NO: 631646 - DNA, 25 bp, Rattus norvegicus
aatccggtcctggaggcaagacggc

SEQ ID NO: 631647 - DNA, 25 bp, Rattus norvegicus
caagacggcgggaaagcgcctccgc

SEQ ID NO: 631648 - DNA, 25 bp, Rattus norvegicus
ctggctcgtcttagcggcgtgagtt

SEQ ID NO: 631649 - DNA, 25 bp, Rattus norvegicus
ttacgctgctgcctgctcttcaggc

SEQ ID NO: 631650 - DNA, 25 bp, Rattus norvegicus
gcagtcctcccaggcgatcgctggg

SEQ ID NO: 631651 - DNA, 25 bp, Rattus norvegicus
cggggtcaccattctcctcttggga

SEQ ID NO: 631652 - DNA, 25 bp, Rattus norvegicus
ctgacgctgtctgggttgtcaaatg

SEQ ID NO: 631653 - DNA, 25 bp, Rattus norvegicus
acagatctcggtcacgcctctttct

SEQ ID NO: 631654 - DNA, 25 bp, Rattus norvegicus
gcctctttctctgacgctgtctggg

SEQ ID NO: 631655 - DNA, 25 bp, Rattus norvegicus
ttgtcaaatgggagatgatcggccg

SEQ ID NO: 631656 - DNA, 25 bp, Rattus norvegicus
atgatcggccgggaccggtttcgca

SEQ ID NO: 631657 - DNA, 25 bp, Rattus norvegicus
gaccggtttcgcacggccatgacgt

SEQ ID NO: 631658 - DNA, 25 bp, Rattus norvegicus
tagtagccggggtcaccattctcct

SEQ ID NO: 631659 - DNA, 25 bp, Rattus norvegicus
ggatccacgttctcccatggggctg

SEQ ID NO: 631660 - DNA, 25 bp, Rattus norvegicus
ttctcctcttgggacgcgcagtcac

SEQ ID NO: 631661 - DNA, 25 bp, Rattus norvegicus
acgcgcagtcactcgggcatttggg

SEQ ID NO: 631662 - DNA, 25 bp, Rattus norvegicus
ggacaaggatggcttcccagtctcg

SEQ ID NO: 631663 - DNA, 25 bp, Rattus norvegicus
atggcttcccagtctcgcgagtggt

SEQ ID NO: 631664 - DNA, 25 bp, Rattus norvegicus
gagagctgctgacctgctccgcgca

SEQ ID NO: 631665 - DNA, 25 bp, Rattus norvegicus
ccagcgccacgctccatacccgggc

SEQ ID NO: 631666 - DNA, 25 bp, Rattus norvegicus
caatagcggtgaggaaccgggatcc

SEQ ID NO: 631667 - DNA, 25 bp, Rattus norvegicus
cgtccctaaagaggcaatagcggtg

SEQ ID NO: 631668 - DNA, 25 bp, Rattus norvegicus
ctggaccgtccctaaagaggcaata

SEQ ID NO: 631669 - DNA, 25 bp, Rattus norvegicus
ctgaaccgtgatggggccctgcgtc

SEQ ID NO: 631670 - DNA, 25 bp, Rattus norvegicus
ggctagaggccctggctcttacctc

SEQ ID NO: 631671 - DNA, 25 bp, Rattus norvegicus
ccctagcgccggctgacagtggcgt

SEQ ID NO: 631672 - DNA, 25 bp, Rattus norvegicus
agtggcgttcgacgtcagtgcgcac

SEQ ID NO: 631673 - DNA, 25 bp, Rattus norvegicus
agggaacctggggtcagcacacttg

SEQ ID NO: 631674 - DNA, 25 bp, Rattus norvegicus
ctggggtcagcacacttggggctct

SEQ ID NO: 631675 - DNA, 25 bp, Rattus norvegicus
cacttggggctctgggccagtctgt

SEQ ID NO: 631676 - DNA, 25 bp, Rattus norvegicus
ccagtctgtgagacgcgctgctgga

SEQ ID NO: 631677 - DNA, 25 bp, Rattus norvegicus
cgcgctgctggaccgtccctaaaga

SEQ ID NO: 631678 - DNA, 25 bp, Rattus norvegicus
gcactctctgaaccgtgatggggcc

SEQ ID NO: 631679 - DNA, 25 bp, Rattus norvegicus
ccgcgggacgccatttctatccgaa

SEQ ID NO: 631680 - DNA, 25 bp, Rattus norvegicus
gccgcctttgtcctgcatctggcag

SEQ ID NO: 631681 - DNA, 25 bp, Rattus norvegicus
gccagcccaggtgccttcgagagca

SEQ ID NO: 631682 - DNA, 25 bp, Rattus norvegicus
tccgcaagccagaggcgacaaagta

SEQ ID NO: 631683 - DNA, 25 bp, Rattus norvegicus
acttctacttcagataccctgtggg

SEQ ID NO: 631684 - DNA, 25 bp, Rattus norvegicus
ataccctgtggggtgctagcaacgc

SEQ ID NO: 631685 - DNA, 25 bp, Rattus norvegicus
tagcaacgctgactccgacggtcgc

SEQ ID NO: 631686 - DNA, 25 bp, Rattus norvegicus
gctcagcgctctccacaacggtttt

SEQ ID NO: 631687 - DNA, 25 bp, Rattus norvegicus
agctgcgcagcacagagactggcga

SEQ ID NO: 631688 - DNA, 25 bp, Rattus norvegicus
gctctcgcgagacttgattacagtg

SEQ ID NO: 631689 - DNA, 25 bp, Rattus norvegicus
gccaagggcacctacgcactcagga

SEQ ID NO: 631690 - DNA, 25 bp, Rattus norvegicus
ctcaggacctgcgtagtggcaaccg

SEQ ID NO: 631691 - DNA, 25 bp, Rattus norvegicus
tgcggactcggttatctcctggtta

SEQ ID NO: 631692 - DNA, 25 bp, Rattus norvegicus
ggagcgctcccatcgtcactggttt

SEQ ID NO: 631693 - DNA, 25 bp, Rattus norvegicus
cgcaatggggccaggacaagaagct

SEQ ID NO: 631694 - DNA, 25 bp, Rattus norvegicus
gcatgcaagggctgaacaccgcgtt

SEQ ID NO: 631695 - DNA, 25 bp, Rattus norvegicus
gcgctcagctacatcgtggcgctca

SEQ ID NO: 631696 - DNA, 25 bp, Rattus norvegicus
caagaagctgtccaagtacgagaca

SEQ ID NO: 631697 - DNA, 25 bp, Rattus norvegicus
ggcgctcacccgcatcctagccgaa

SEQ ID NO: 631698 - DNA, 25 bp, Rattus norvegicus
tgaacaccgcgttcgaccggctgcg

SEQ ID NO: 631699 - DNA, 25 bp, Rattus norvegicus
gtccaagtacgagacactgcagatg

SEQ ID NO: 631700 - DNA, 25 bp, Rattus norvegicus
cgctccgtctgtgtcttattcattc

SEQ ID NO: 631701 - DNA, 25 bp, Rattus norvegicus
gtgtcttattcattcccgggagccc

SEQ ID NO: 631702 - DNA, 25 bp, Rattus norvegicus
cccgcagagaggaagcgtggatgaa

SEQ ID NO: 631703 - DNA, 25 bp, Rattus norvegicus
cgtggatgaagtccgcctgcaaacc

SEQ ID NO: 631704 - DNA, 25 bp, Rattus norvegicus
agacactgcagatggcgctcagcta

SEQ ID NO: 631705 - DNA, 25 bp, Rattus norvegicus
gcgccgcatgcaagggctgaacacc

SEQ ID NO: 631706 - DNA, 25 bp, Rattus norvegicus
gcaggtcgctccgtctgtgtcttat

SEQ ID NO: 631707 - DNA, 25 bp, Rattus norvegicus
tgaggcgaccggacacagtaagaac

SEQ ID NO: 631708 - DNA, 25 bp, Rattus norvegicus
ggagcgaatcgccaaagcacatccc

SEQ ID NO: 631709 - DNA, 25 bp, Rattus norvegicus
gcagagctttccctacgcgcggcag

SEQ ID NO: 631710 - DNA, 25 bp, Rattus norvegicus
tttccacgtggggaggaattgcaca

SEQ ID NO: 631711 - DNA, 25 bp, Rattus norvegicus
gcagtgcggtggtgcttttccacgt

SEQ ID NO: 631712 - DNA, 25 bp, Rattus norvegicus
tccagtgtctcactgcagtgcggtg

SEQ ID NO: 631713 - DNA, 25 bp, Rattus norvegicus
aggtccgaagcctgtccagtgtctc

SEQ ID NO: 631714 - DNA, 25 bp, Rattus norvegicus
cgatcttaaggtgcgacaggcttca

SEQ ID NO: 631715 - DNA, 25 bp, Rattus norvegicus
gctgtaggtgttgccatagtaaccg

SEQ ID NO: 631716 - DNA, 25 bp, Rattus norvegicus
gaggcagacttacaggccacacgtg

SEQ ID NO: 631717 - DNA, 25 bp, Rattus norvegicus
cgtcaccggcgctaccaagtggcag

SEQ ID NO: 631718 - DNA, 25 bp, Rattus norvegicus
cttcacgctgaagggcttcttcctc

SEQ ID NO: 631719 - DNA, 25 bp, Rattus norvegicus
agccagcgggacaaggacttttgga

SEQ ID NO: 631720 - DNA, 25 bp, Rattus norvegicus
tgcttcttcttctgcttcacgctga

SEQ ID NO: 631721 - DNA, 25 bp, Rattus norvegicus
gcctcttggcttcccgctgttcaat

SEQ ID NO: 631722 - DNA, 25 bp, Rattus norvegicus
ccggtacttctctgctccgtaactt

SEQ ID NO: 631723 - DNA, 25 bp, Rattus norvegicus
caatggcatggttcagttcgttatc

SEQ ID NO: 631724 - DNA, 25 bp, Rattus norvegicus
ctccgtaacttttgtgtgaagcggg

SEQ ID NO: 631725 - DNA, 25 bp, Rattus norvegicus
agttcgttatccctgctatctgcag

SEQ ID NO: 631726 - DNA, 25 bp, Rattus norvegicus
ttcccgctgttcaatggcatggttc

SEQ ID NO: 631727 - DNA, 25 bp, Rattus norvegicus
ggaccgatgttctctcgcgcctttc

SEQ ID NO: 631728 - DNA, 25 bp, Rattus norvegicus
tgccagctcggcttcccgcctcttg

SEQ ID NO: 631729 - DNA, 25 bp, Rattus norvegicus
tctctgctccgtaacttttgtgtga

SEQ ID NO: 631730 - DNA, 25 bp, Rattus norvegicus
ggggtgctatctccagccgcagcct

SEQ ID NO: 631731 - DNA, 25 bp, Rattus norvegicus
agaacccggggtgctatctccagcc

SEQ ID NO: 631732 - DNA, 25 bp, Rattus norvegicus
tagtatagggacgaaggtgaagaac

SEQ ID NO: 631733 - DNA, 25 bp, Rattus norvegicus
ccagaggctcttcgtagtataggga

SEQ ID NO: 631734 - DNA, 25 bp, Rattus norvegicus
ggcttccttccggtacttctctgct

SEQ ID NO: 631735 - DNA, 25 bp, Rattus norvegicus
ctagggctctccctgtcgtgaggga

SEQ ID NO: 631736 - DNA, 25 bp, Rattus norvegicus
gtgcagaccattcctcttctccggg

SEQ ID NO: 631737 - DNA, 25 bp, Rattus norvegicus
cgaggatgagtgtgtgcagaccatt

SEQ ID NO: 631738 - DNA, 25 bp, Rattus norvegicus
ctccatccgggtcgctgacggctgt

SEQ ID NO: 631739 - DNA, 25 bp, Rattus norvegicus
ggtcgcgcatgtcccgcggttcact

SEQ ID NO: 631740 - DNA, 25 bp, Rattus norvegicus
aggcggcagcttctctctgaggaac

SEQ ID NO: 631741 - DNA, 25 bp, Rattus norvegicus
ctctgaggaacctgggaaagtttca

SEQ ID NO: 631742 - DNA, 25 bp, Rattus norvegicus
ctgggaaagtttcaccggagagccg

SEQ ID NO: 631743 - DNA, 25 bp, Rattus norvegicus
tttcaccggagagccgggcagcaga

SEQ ID NO: 631744 - DNA, 25 bp, Rattus norvegicus
agggagcggtcgtcctccatcgcct

SEQ ID NO: 631745 - DNA, 25 bp, Rattus norvegicus
ccagcgtcttcagcgtttcccggag

SEQ ID NO: 631746 - DNA, 25 bp, Rattus norvegicus
tttcccggagctggagtgttgcact

SEQ ID NO: 631747 - DNA, 25 bp, Rattus norvegicus
ttgcactgtcctaagggaaagggtc

SEQ ID NO: 631748 - DNA, 25 bp, Rattus norvegicus
attcgccagtagctggtcggtccgc

SEQ ID NO: 631749 - DNA, 25 bp, Rattus norvegicus
cgccaagagatagccgtgaaccata

SEQ ID NO: 631750 - DNA, 25 bp, Rattus norvegicus
caagccggtcggacggcagtcggaa

SEQ ID NO: 631751 - DNA, 25 bp, Rattus norvegicus
tcgttacggttcagcgcgaacgtgg

SEQ ID NO: 631752 - DNA, 25 bp, Rattus norvegicus
ctgcattcgttacggttcagcgcga

SEQ ID NO: 631753 - DNA, 25 bp, Rattus norvegicus
gttaggactgcattcgttacggttc

SEQ ID NO: 631754 - DNA, 25 bp, Rattus norvegicus
ggagcgttaggactgcattcgttac

SEQ ID NO: 631755 - DNA, 25 bp, Rattus norvegicus
ccactcggaagtgaggacagccgcg

SEQ ID NO: 631756 - DNA, 25 bp, Rattus norvegicus
ggcccgcccactcggaagtgaggac

SEQ ID NO: 631757 - DNA, 25 bp, Rattus norvegicus
actgcgtgtggagggcccgcccact

SEQ ID NO: 631758 - DNA, 25 bp, Rattus norvegicus
ctgtctcactgcgtgtggagggccc

SEQ ID NO: 631759 - DNA, 25 bp, Rattus norvegicus
ttctttttgtgcatggcctcgtggg

SEQ ID NO: 631760 - DNA, 25 bp, Rattus norvegicus
tagccgtgaaccatagggctgtctc

SEQ ID NO: 631761 - DNA, 25 bp, Rattus norvegicus
tcccagcggcgccaagagatagccg

SEQ ID NO: 631762 - DNA, 25 bp, Rattus norvegicus
aaccatagggctgtctcactgcgtg

SEQ ID NO: 631763 - DNA, 25 bp, Rattus norvegicus
agggttatgtcatccttccgcgccg

SEQ ID NO: 631764 - DNA, 25 bp, Rattus norvegicus
aaccggaacgcaaaggctgccgcga

SEQ ID NO: 631765 - DNA, 25 bp, Rattus norvegicus
ggattcgtagtcctgtggtgccgct

SEQ ID NO: 631766 - DNA, 25 bp, Rattus norvegicus
cgacgccaagagtcaccggtgagtg

SEQ ID NO: 631767 - DNA, 25 bp, Rattus norvegicus
cggctgtacccgacgccaagagtca

SEQ ID NO: 631768 - DNA, 25 bp, Rattus norvegicus
gctgtatcagcatcgccctcaaggc

SEQ ID NO: 631769 - DNA, 25 bp, Rattus norvegicus
tcgggttccgccatggaatccaaca

SEQ ID NO: 631770 - DNA, 25 bp, Rattus norvegicus
ccctcactcaaatcccgggaaggag

SEQ ID NO: 631771 - DNA, 25 bp, Rattus norvegicus
agacatacggtagggcttccgcccg

SEQ ID NO: 631772 - DNA, 25 bp, Rattus norvegicus
ccctttcttaggagacatacggtag

SEQ ID NO: 631773 - DNA, 25 bp, Rattus norvegicus
acttcagcattagcgctccaatagc

SEQ ID NO: 631774 - DNA, 25 bp, Rattus norvegicus
gcgcgcacactcaacttcagcatta

SEQ ID NO: 631775 - DNA, 25 bp, Rattus norvegicus
gccgcgaggaatgtgcgcgcacact

SEQ ID NO: 631776 - DNA, 25 bp, Rattus norvegicus
tgaagccgagcgctgtatcagcatc

SEQ ID NO: 631777 - DNA, 25 bp, Rattus norvegicus
gggagcccaagagccaaggacacta

SEQ ID NO: 631778 - DNA, 25 bp, Rattus norvegicus
tcagcccaatcgagacccgggagtg

SEQ ID NO: 631779 - DNA, 25 bp, Rattus norvegicus
agctagcgcggtcagcgaagattgc

SEQ ID NO: 631780 - DNA, 25 bp, Rattus norvegicus
ggacgagaaacgatcccaaaggcta

SEQ ID NO: 631781 - DNA, 25 bp, Rattus norvegicus
ctgcctctcgaagggtgagcgaact

SEQ ID NO: 631782 - DNA, 25 bp, Rattus norvegicus
tagcaccagcgagcagcagcctata

SEQ ID NO: 631783 - DNA, 25 bp, Rattus norvegicus
gcctataagggctctcccgacgaga

SEQ ID NO: 631784 - DNA, 25 bp, Rattus norvegicus
ggagtgtggcccacttcatccaata

SEQ ID NO: 631785 - DNA, 25 bp, Rattus norvegicus
tcatccaataggcaccgggcgcacg

SEQ ID NO: 631786 - DNA, 25 bp, Rattus norvegicus
caacgttctctcctgcctggtgaca

SEQ ID NO: 631787 - DNA, 25 bp, Rattus norvegicus
ctttcagcagctgccaaggtccctg

SEQ ID NO: 631788 - DNA, 25 bp, Rattus norvegicus
attgcggacaagagcgatctgcctc

SEQ ID NO: 631789 - DNA, 25 bp, Rattus norvegicus
gggacagcctacgactacactcgga

SEQ ID NO: 631790 - DNA, 25 bp, Rattus norvegicus
actaccgggcgcacaactggatgcc

SEQ ID NO: 631791 - DNA, 25 bp, Rattus norvegicus
acgtagacagcagcgtgcgcgtgcc

SEQ ID NO: 631792 - DNA, 25 bp, Rattus norvegicus
ccggagtgagctttccgagaacact

SEQ ID NO: 631793 - DNA, 25 bp, Rattus norvegicus
ggcctcgttcgccacgacgtagaca

SEQ ID NO: 631794 - DNA, 25 bp, Rattus norvegicus
ctggacgaagcagtgcggcctcgtt

SEQ ID NO: 631795 - DNA, 25 bp, Rattus norvegicus
agcagcctgtgcactttgactgaca

SEQ ID NO: 631796 - DNA, 25 bp, Rattus norvegicus
tacctcagcagcctgtgcactttga

SEQ ID NO: 631797 - DNA, 25 bp, Rattus norvegicus
agtcttggttacttacctcagcagc

SEQ ID NO: 631798 - DNA, 25 bp, Rattus norvegicus
gttagtcctggcaggtaggatcgta

SEQ ID NO: 631799 - DNA, 25 bp, Rattus norvegicus
cgcctgagctgtgggaattttatgg

SEQ ID NO: 631800 - DNA, 25 bp, Rattus norvegicus
cccacgcatgctcagtcggaggaaa

SEQ ID NO: 631801 - DNA, 25 bp, Rattus norvegicus
aattttatggcggtgtccctgtggc

SEQ ID NO: 631802 - DNA, 25 bp, Rattus norvegicus
tcggaggaaattgtctgcatacgcc

SEQ ID NO: 631803 - DNA, 25 bp, Rattus norvegicus
aaattgtctgcatacgcccggcgcg

SEQ ID NO: 631804 - DNA, 25 bp, Rattus norvegicus
ttctttccacccagttagtcctggc

SEQ ID NO: 631805 - DNA, 25 bp, Rattus norvegicus
aaccgcttccgagacgtgagcgtca

SEQ ID NO: 631806 - DNA, 25 bp, Rattus norvegicus
agcggacttaaccttgggcaaagct

SEQ ID NO: 631807 - DNA, 25 bp, Rattus norvegicus
ttttcctgaactaagctcggcggtg

SEQ ID NO: 631808 - DNA, 25 bp, Rattus norvegicus
tgcagactgcacacaccggtcttgg

SEQ ID NO: 631809 - DNA, 25 bp, Rattus norvegicus
gcacagtgaaaatgccggagccaga

SEQ ID NO: 631810 - DNA, 25 bp, Rattus norvegicus
tcatggaagacgagcaatggctgtc

SEQ ID NO: 631811 - DNA, 25 bp, Rattus norvegicus
gcagctctgtttacccgcacctgta

SEQ ID NO: 631812 - DNA, 25 bp, Rattus norvegicus
agcggcaagattaagcactggaacc

SEQ ID NO: 631813 - DNA, 25 bp, Rattus norvegicus
cggtggagctaggagacccatcctt

SEQ ID NO: 631814 - DNA, 25 bp, Rattus norvegicus
cggaatcagagaccctgcgcgtgct

SEQ ID NO: 631815 - DNA, 25 bp, Rattus norvegicus
tgcctggctaactgcgccaagagta

SEQ ID NO: 631816 - DNA, 25 bp, Rattus norvegicus
tccgggagagtcctagacgagaaca

SEQ ID NO: 631817 - DNA, 25 bp, Rattus norvegicus
ccctgccgggtgaatgctgcagact

SEQ ID NO: 631818 - DNA, 25 bp, Rattus norvegicus
tggctgtcgtccatctcgcagtaca

SEQ ID NO: 631819 - DNA, 25 bp, Rattus norvegicus
aggtctctccctagccggtcataga

SEQ ID NO: 631820 - DNA, 25 bp, Rattus norvegicus
cggtcatagacatcccagaaagttt

SEQ ID NO: 631821 - DNA, 25 bp, Rattus norvegicus
agtttgtccctttgctctctgccgg

SEQ ID NO: 631822 - DNA, 25 bp, Rattus norvegicus
cgcgagagctcggatcatgtgctat

SEQ ID NO: 631823 - DNA, 25 bp, Rattus norvegicus
catgtgctatttatcccgcggaggc

SEQ ID NO: 631824 - DNA, 25 bp, Rattus norvegicus
ccctttaactagagtggctcggata

SEQ ID NO: 631825 - DNA, 25 bp, Rattus norvegicus
ttccttgtctctgtccggtgagccc

SEQ ID NO: 631826 - DNA, 25 bp, Rattus norvegicus
gtgtccgcagctcagtttccttgtc

SEQ ID NO: 631827 - DNA, 25 bp, Rattus norvegicus
agcgaattctggaacctcaggtcgg

SEQ ID NO: 631828 - DNA, 25 bp, Rattus norvegicus
tcccacgttctgaggatttgctttc

SEQ ID NO: 631829 - DNA, 25 bp, Rattus norvegicus
caggagcgctacttttcccacgttc

SEQ ID NO: 631830 - DNA, 25 bp, Rattus norvegicus
tggctcggatagctctttcccggga

SEQ ID NO: 631831 - DNA, 25 bp, Rattus norvegicus
cctgaggcaactgtgaagcgaattc

SEQ ID NO: 631832 - DNA, 25 bp, Rattus norvegicus
gatttgctttccctgagtgtccgca

SEQ ID NO: 631833 - DNA, 25 bp, Rattus norvegicus
cagctctcatacttgcccgcaaagg

SEQ ID NO: 631834 - DNA, 25 bp, Rattus norvegicus
ctggcacctccctgctggaagaaca

SEQ ID NO: 631835 - DNA, 25 bp, Rattus norvegicus
tgcttgaggacatcgcggtagacca

SEQ ID NO: 631836 - DNA, 25 bp, Rattus norvegicus
agggctctagcacatacaggtcaca

SEQ ID NO: 631837 - DNA, 25 bp, Rattus norvegicus
cccggcgaaacaggaactgagtcaa

SEQ ID NO: 631838 - DNA, 25 bp, Rattus norvegicus
tgtgcacaccggatcctcgcagagc

SEQ ID NO: 631839 - DNA, 25 bp, Rattus norvegicus
cttcttgacgaagggtgtgcacacc

SEQ ID NO: 631840 - DNA, 25 bp, Rattus norvegicus
cctgcagtggtacttctcgaagacc

SEQ ID NO: 631841 - DNA, 25 bp, Rattus norvegicus
ggcccgcaatgacggttcctgcagt

SEQ ID NO: 631842 - DNA, 25 bp, Rattus norvegicus
cgcctgcgtgttcttctggatccag

SEQ ID NO: 631843 - DNA, 25 bp, Rattus norvegicus
tgcctgcgaagcgatacatctctcg

SEQ ID NO: 631844 - DNA, 25 bp, Rattus norvegicus
ctcgtagcgcaccagcatgtaccga

SEQ ID NO: 631845 - DNA, 25 bp, Rattus norvegicus
gctctgcagacaggcggatgttctc

SEQ ID NO: 631846 - DNA, 25 bp, Rattus norvegicus
tgccttgctggttgaagaactcgcc

SEQ ID NO: 631847 - DNA, 25 bp, Rattus norvegicus
ccaactgcgctctcggttcagaaga

SEQ ID NO: 631848 - DNA, 25 bp, Rattus norvegicus
agacacagccaaggcttcgggaacc

SEQ ID NO: 631849 - DNA, 25 bp, Rattus norvegicus
attccgatcccgctagcggctggag

SEQ ID NO: 631850 - DNA, 25 bp, Rattus norvegicus
gcaggggaacgatccgtcctaccca

SEQ ID NO: 631851 - DNA, 25 bp, Rattus norvegicus
tgtcccagctgcaggggaacgatcc

SEQ ID NO: 631852 - DNA, 25 bp, Rattus norvegicus
ctggtcccttcactgggcgggaagc

SEQ ID NO: 631853 - DNA, 25 bp, Rattus norvegicus
ttcagaagatgctggggccgcgctc

SEQ ID NO: 631854 - DNA, 25 bp, Rattus norvegicus
ctctaaaagtttggcgcgcgctccg

SEQ ID NO: 631855 - DNA, 25 bp, Rattus norvegicus
gccagtccacttctcctctaaaagt

SEQ ID NO: 631856 - DNA, 25 bp, Rattus norvegicus
tgagatcctcgcttgtggcttgtgc

SEQ ID NO: 631857 - DNA, 25 bp, Rattus norvegicus
caatttggcagcgtgggtctttccc

SEQ ID NO: 631858 - DNA, 25 bp, Rattus norvegicus
tggaggcggcctcctaagacacagc

SEQ ID NO: 631859 - DNA, 25 bp, Rattus norvegicus
tgggtaccaggcagatggcaatttg

SEQ ID NO: 631860 - DNA, 25 bp, Rattus norvegicus
acgcgcacccggcaacttggggacg

SEQ ID NO: 631861 - DNA, 25 bp, Rattus norvegicus
accggtgagcttcaaagggtgcttt

SEQ ID NO: 631862 - DNA, 25 bp, Rattus norvegicus
agacgggactcggtgacctctcccg

SEQ ID NO: 631863 - DNA, 25 bp, Rattus norvegicus
ggtgactacgcttctccctggaatg

SEQ ID NO: 631864 - DNA, 25 bp, Rattus norvegicus
ttgtgcaaggccttgcgggtgacta

SEQ ID NO: 631865 - DNA, 25 bp, Rattus norvegicus
ctgaaaacccgagtggggacaactg

SEQ ID NO: 631866 - DNA, 25 bp, Rattus norvegicus
ttcgctggatcccaggaaccgggca

SEQ ID NO: 631867 - DNA, 25 bp, Rattus norvegicus
aggacgctgttacgttcgctggatc

SEQ ID NO: 631868 - DNA, 25 bp, Rattus norvegicus
gaagcggcgccatgtatgctctcgc

SEQ ID NO: 631869 - DNA, 25 bp, Rattus norvegicus
atctgcattgcagcctgcggagtga

SEQ ID NO: 631870 - DNA, 25 bp, Rattus norvegicus
cctggtcagctgacgatctgcattg

SEQ ID NO: 631871 - DNA, 25 bp, Rattus norvegicus
ctagatttatatgcgcctggtcagc

SEQ ID NO: 631872 - DNA, 25 bp, Rattus norvegicus
tggcccagccagagaatttcacgaa

SEQ ID NO: 631873 - DNA, 25 bp, Rattus norvegicus
tgtgcccgattctctgaaaacccga

SEQ ID NO: 631874 - DNA, 25 bp, Rattus norvegicus
tcgccagccttctggtcaccggtga

SEQ ID NO: 631875 - DNA, 25 bp, Rattus norvegicus
cctaacgtgatggagaaccgccctc

SEQ ID NO: 631876 - DNA, 25 bp, Rattus norvegicus
ttggccacagtaaaagccgggtcgc

SEQ ID NO: 631877 - DNA, 25 bp, Rattus norvegicus
ttcggatcacctcggagccagcgcg

SEQ ID NO: 631878 - DNA, 25 bp, Rattus norvegicus
ggcaaacgtgtctcaccctcggttg

SEQ ID NO: 631879 - DNA, 25 bp, Rattus norvegicus
tctcaccctcggttggtcgaaacga

SEQ ID NO: 631880 - DNA, 25 bp, Rattus norvegicus
gtcgaaacgaccgtacgcatgcgca

SEQ ID NO: 631881 - DNA, 25 bp, Rattus norvegicus
atgcgcactgggagcaccttagtca

SEQ ID NO: 631882 - DNA, 25 bp, Rattus norvegicus
gagcaccttagtcaaaatcgcaatc

SEQ ID NO: 631883 - DNA, 25 bp, Rattus norvegicus
tttatgagccatcgtgactggtccg

SEQ ID NO: 631884 - DNA, 25 bp, Rattus norvegicus
accgccctcgtcgtgacacattgtg

SEQ ID NO: 631885 - DNA, 25 bp, Rattus norvegicus
gcccaacgcaccctaacgtgatgga

SEQ ID NO: 631886 - DNA, 25 bp, Rattus norvegicus
atttatgagccatcgtgactggtcc

SEQ ID NO: 631887 - DNA, 25 bp, Rattus norvegicus
gcgcactgggagcaccttagtcaaa

SEQ ID NO: 631888 - DNA, 25 bp, Rattus norvegicus
aggggaacgctgattggccacagta

SEQ ID NO: 631889 - DNA, 25 bp, Rattus norvegicus
atgcaacttgtgatcccggcagatg

SEQ ID NO: 631890 - DNA, 25 bp, Rattus norvegicus
tcctaagcacgtgagctgccgcttc

SEQ ID NO: 631891 - DNA, 25 bp, Rattus norvegicus
tggaatttatgagccatcgtgactg

SEQ ID NO: 631892 - DNA, 25 bp, Rattus norvegicus
tgtgggtacagggatacagaagact

SEQ ID NO: 631893 - DNA, 25 bp, Rattus norvegicus
agactgtgagacacttcagacaatc

SEQ ID NO: 631894 - DNA, 25 bp, Rattus norvegicus
gcactgtgcaagaggccacaaattc

SEQ ID NO: 631895 - DNA, 25 bp, Rattus norvegicus
ggggcaaggattcccagccacttta

SEQ ID NO: 631896 - DNA, 25 bp, Rattus norvegicus
agccactttatccttacgctgtggg

SEQ ID NO: 631897 - DNA, 25 bp, Rattus norvegicus
tggtatttatgagccatcgtgactg

SEQ ID NO: 631898 - DNA, 25 bp, Rattus norvegicus
ctagttcgattgtgacgcagtttaa

SEQ ID NO: 631899 - DNA, 25 bp, Rattus norvegicus
gcagtttaaattcgcgtaccttcgc

SEQ ID NO: 631900 - DNA, 25 bp, Rattus norvegicus
ttgacgcttccgtcctaagcacgtg

SEQ ID NO: 631901 - DNA, 25 bp, Rattus norvegicus
cagacaatctctttagcactgtgca

SEQ ID NO: 631902 - DNA, 25 bp, Rattus norvegicus
ggagaagcacccaaacttacctcta

SEQ ID NO: 631903 - DNA, 25 bp, Rattus norvegicus
tgtgtctgctcttgcccggctcgac

SEQ ID NO: 631904 - DNA, 25 bp, Rattus norvegicus
gggccctggagacgctgtaccgccc

SEQ ID NO: 631905 - DNA, 25 bp, Rattus norvegicus
ggggagctcgctcggccacccgcct

SEQ ID NO: 631906 - DNA, 25 bp, Rattus norvegicus
cctcgcagtgggctcagcattcact

SEQ ID NO: 631907 - DNA, 25 bp, Rattus norvegicus
cgcagtgggctcagcattcacttta

SEQ ID NO: 631908 - DNA, 25 bp, Rattus norvegicus
gggctcagcattcactttagcaagc

SEQ ID NO: 631909 - DNA, 25 bp, Rattus norvegicus
tcagcattcactttagcaagcggtg

SEQ ID NO: 631910 - DNA, 25 bp, Rattus norvegicus
cattcactttagcaagcggtgtgta

SEQ ID NO: 631911 - DNA, 25 bp, Rattus norvegicus
tcactttagcaagcggtgtgtacag

SEQ ID NO: 631912 - DNA, 25 bp, Rattus norvegicus
gtacagccggctggctccctgggct

SEQ ID NO: 631913 - DNA, 25 bp, Rattus norvegicus
gcagtctgtgtctgctcttgcccgg

SEQ ID NO: 631914 - DNA, 25 bp, Rattus norvegicus
tcttgcccggctcgacggcgacatg

SEQ ID NO: 631915 - DNA, 25 bp, Rattus norvegicus
tcgacggcgacatgggtgtccccac

SEQ ID NO: 631916 - DNA, 25 bp, Rattus norvegicus
cccagcagtctgtgtctgctcttgc

SEQ ID NO: 631917 - DNA, 25 bp, Rattus norvegicus
caacacacacaaggaactggagttc

SEQ ID NO: 631918 - DNA, 25 bp, Rattus norvegicus
cgggcgataagcttgggagaaggca

SEQ ID NO: 631919 - DNA, 25 bp, Rattus norvegicus
gctttgccagctgaggtcgcggccc

SEQ ID NO: 631920 - DNA, 25 bp, Rattus norvegicus
acaagtggctttgccagctgaggtc

SEQ ID NO: 631921 - DNA, 25 bp, Rattus norvegicus
gctccgggaacaagtggctttgcca

SEQ ID NO: 631922 - DNA, 25 bp, Rattus norvegicus
cgatcgctccgggaacaagtggctt

SEQ ID NO: 631923 - DNA, 25 bp, Rattus norvegicus
ctgcgcgacgatcgctccgggaaca

SEQ ID NO: 631924 - DNA, 25 bp, Rattus norvegicus
cacacaaggaactggagttcccggg

SEQ ID NO: 631925 - DNA, 25 bp, Rattus norvegicus
cttgcgaaggccaacacacacaagg

SEQ ID NO: 631926 - DNA, 25 bp, Rattus norvegicus
gcctgcgaatgtcgcggtcccgaaa

SEQ ID NO: 631927 - DNA, 25 bp, Rattus norvegicus
gcgaagagcgaagcctgcgaatgtc

SEQ ID NO: 631928 - DNA, 25 bp, Rattus norvegicus
gctacgcgaagagcgaagcctgcga

SEQ ID NO: 631929 - DNA, 25 bp, Rattus norvegicus
gcgcgtcttgcgaaggccaacacac

SEQ ID NO: 631930 - DNA, 25 bp, Rattus norvegicus
gggaattaaagttgccgcgcgtcca

SEQ ID NO: 631931 - DNA, 25 bp, Rattus norvegicus
caaagggctgggacccaaccacagc

SEQ ID NO: 631932 - DNA, 25 bp, Rattus norvegicus
cgcccagatgagaaggtgcccgcgc

SEQ ID NO: 631933 - DNA, 25 bp, Rattus norvegicus
cgccggccgcagatgccatggcatt

SEQ ID NO: 631934 - DNA, 25 bp, Rattus norvegicus
ccatggcattggctgctatggcaga

SEQ ID NO: 631935 - DNA, 25 bp, Rattus norvegicus
gcattggctgctatggcagaatccc

SEQ ID NO: 631936 - DNA, 25 bp, Rattus norvegicus
aaaacgagccttgggagcgtgcccg

SEQ ID NO: 631937 - DNA, 25 bp, Rattus norvegicus
cctgatctagcaaagggctgggacc

SEQ ID NO: 631938 - DNA, 25 bp, Rattus norvegicus
cctgaggctgcgacgctctcgggaa

SEQ ID NO: 631939 - DNA, 25 bp, Rattus norvegicus
ctgcgacgctctcgggaaggcgcac

SEQ ID NO: 631940 - DNA, 25 bp, Rattus norvegicus
aggccgcgccatctgttgtctttaa

SEQ ID NO: 631941 - DNA, 25 bp, Rattus norvegicus
ccgcgccatctgttgtctttaagcg

SEQ ID NO: 631942 - DNA, 25 bp, Rattus norvegicus
tcccggagtcgctgaaaggttcctc

SEQ ID NO: 631943 - DNA, 25 bp, Rattus norvegicus
tcgctgaaaggttcctccggtcttc

SEQ ID NO: 631944 - DNA, 25 bp, Rattus norvegicus
gcgtgcccgagccatgcctgatcta

SEQ ID NO: 631945 - DNA, 25 bp, Rattus norvegicus
ctgccgctgctaccttcaccgggtc

SEQ ID NO: 631946 - DNA, 25 bp, Rattus norvegicus
gcagcacccgcacttactgtcgctg

SEQ ID NO: 631947 - DNA, 25 bp, Rattus norvegicus
ctgctaccttcaccgggtcccaagc

SEQ ID NO: 631948 - DNA, 25 bp, Rattus norvegicus
aagcgccgggccacttcgaccagag

SEQ ID NO: 631949 - DNA, 25 bp, Rattus norvegicus
ccgggccacttcgaccagagttcag

SEQ ID NO: 631950 - DNA, 25 bp, Rattus norvegicus
gggccacttcgaccagagttcagcc

SEQ ID NO: 631951 - DNA, 25 bp, Rattus norvegicus
cttcgaccagagttcagccaggcgg

SEQ ID NO: 631952 - DNA, 25 bp, Rattus norvegicus
ccagagttcagccaggcggggctcc

SEQ ID NO: 631953 - DNA, 25 bp, Rattus norvegicus
ttccgggtttgctgactccgctcgc

SEQ ID NO: 631954 - DNA, 25 bp, Rattus norvegicus
ggtttgctgactccgctcgccgggc

SEQ ID NO: 631955 - DNA, 25 bp, Rattus norvegicus
cctccgcctggcgtacggcagtaat

SEQ ID NO: 631956 - DNA, 25 bp, Rattus norvegicus
ctggcgtacggcagtaattgctggc

SEQ ID NO: 631957 - DNA, 25 bp, Rattus norvegicus
ccacttcgaccagagttcagccagg

SEQ ID NO: 631958 - DNA, 25 bp, Rattus norvegicus
ccgcctggcgtacggcagtaattgc

SEQ ID NO: 631959 - DNA, 25 bp, Rattus norvegicus
gtgagggaaagctcagcagatcttc

SEQ ID NO: 631960 - DNA, 25 bp, Rattus norvegicus
tgttcacatcaaagagcgcagcctc

SEQ ID NO: 631961 - DNA, 25 bp, Rattus norvegicus
gcaagctcgcagaacacaaatctaa

SEQ ID NO: 631962 - DNA, 25 bp, Rattus norvegicus
acacaaatctaactccgcctcagga

SEQ ID NO: 631963 - DNA, 25 bp, Rattus norvegicus
gagcgcccgctcctcggaaagaatt

SEQ ID NO: 631964 - DNA, 25 bp, Rattus norvegicus
cggaaagaattcgacccaggaaatg

SEQ ID NO: 631965 - DNA, 25 bp, Rattus norvegicus
caggaaatgtgggtgttcacatcaa

SEQ ID NO: 631966 - DNA, 25 bp, Rattus norvegicus
gcagcctcgtccctatttacagata

SEQ ID NO: 631967 - DNA, 25 bp, Rattus norvegicus
cgtccctatttacagatacctcttc

SEQ ID NO: 631968 - DNA, 25 bp, Rattus norvegicus
ttacagatacctcttcctcgacaca

SEQ ID NO: 631969 - DNA, 25 bp, Rattus norvegicus
ccctttgcagcacgcgacggatagc

SEQ ID NO: 631970 - DNA, 25 bp, Rattus norvegicus
atcttctgaaagtcgcgtctgcgcc

SEQ ID NO: 631971 - DNA, 25 bp, Rattus norvegicus
cgacggatagcacttttgttttggg

SEQ ID NO: 631972 - DNA, 25 bp, Rattus norvegicus
gcacgcgacggatagcacttttgtt

SEQ ID NO: 631973 - DNA, 25 bp, Rattus norvegicus
agcttcgagcttacgtggcacccaa

SEQ ID NO: 631974 - DNA, 25 bp, Rattus norvegicus
tttcggtggcaatcaggggtcactt

SEQ ID NO: 631975 - DNA, 25 bp, Rattus norvegicus
gcgtccattgcgttctccgagcgca

SEQ ID NO: 631976 - DNA, 25 bp, Rattus norvegicus
gcgccgcaaagtctgtccaagtggg

SEQ ID NO: 631977 - DNA, 25 bp, Rattus norvegicus
tgctccgaagttgcgcgatcccagt

SEQ ID NO: 631978 - DNA, 25 bp, Rattus norvegicus
tacctgctaagctcggtgtcggatc

SEQ ID NO: 631979 - DNA, 25 bp, Rattus norvegicus
aacttgcagttggacgctgggacgc

SEQ ID NO: 631980 - DNA, 25 bp, Rattus norvegicus
ctgccttttaacttgggtgcgtcca

SEQ ID NO: 631981 - DNA, 25 bp, Rattus norvegicus
ctctggcagcgacagtttttcggtg

SEQ ID NO: 631982 - DNA, 25 bp, Rattus norvegicus
agcgaacgcacacctggctctggca

SEQ ID NO: 631983 - DNA, 25 bp, Rattus norvegicus
ctcagacttaagttgcaggcgaacc

SEQ ID NO: 631984 - DNA, 25 bp, Rattus norvegicus
cgagggagcgtgtactcagacttaa

SEQ ID NO: 631985 - DNA, 25 bp, Rattus norvegicus
cgtgacccgcagaatgctgctcgtg

SEQ ID NO: 631986 - DNA, 25 bp, Rattus norvegicus
agcgcagtgactccgccaagaacca

SEQ ID NO: 631987 - DNA, 25 bp, Rattus norvegicus
actggatgcagatggtgtcccaccc

SEQ ID NO: 631988 - DNA, 25 bp, Rattus norvegicus
acctccttggcgcatgcagtaggct

SEQ ID NO: 631989 - DNA, 25 bp, Rattus norvegicus
aatttcccggaacgttcaggagctg

SEQ ID NO: 631990 - DNA, 25 bp, Rattus norvegicus
ttcccggaacgttcaggagctgttc

SEQ ID NO: 631991 - DNA, 25 bp, Rattus norvegicus
acgttcaggagctgttccgtgttgc

SEQ ID NO: 631992 - DNA, 25 bp, Rattus norvegicus
tgttgcgcgacctccttggcgcatg

SEQ ID NO: 631993 - DNA, 25 bp, Rattus norvegicus
ggcgcatgcagtaggctccgcagat

SEQ ID NO: 631994 - DNA, 25 bp, Rattus norvegicus
cagtaggctccgcagatgaacagga

SEQ ID NO: 631995 - DNA, 25 bp, Rattus norvegicus
gatgaacaggagttccaaacggtaa

SEQ ID NO: 631996 - DNA, 25 bp, Rattus norvegicus
caaacggtaaccgccacggagactg

SEQ ID NO: 631997 - DNA, 25 bp, Rattus norvegicus
agagcagcactcaccggtggcgacg

SEQ ID NO: 631998 - DNA, 25 bp, Rattus norvegicus
agcactcaccggtggcgacgctagg

SEQ ID NO: 631999 - DNA, 25 bp, Rattus norvegicus
gagactggatgcagatggtgtccca

SEQ ID NO: 632000 - DNA, 25 bp, Rattus norvegicus
agctgttccgtgttgcgcgacctcc

SEQ ID NO: 632001 - DNA, 25 bp, Rattus norvegicus
cgcagcgccatcgagccaggctaga

SEQ ID NO: 632002 - DNA, 25 bp, Rattus norvegicus
cgggtcacgctgagcctcccgcagc

SEQ ID NO: 632003 - DNA, 25 bp, Rattus norvegicus
aagcggggactagggctccgatgct

SEQ ID NO: 632004 - DNA, 25 bp, Rattus norvegicus
ctggaagtctggtgaaccctgagag

SEQ ID NO: 632005 - DNA, 25 bp, Rattus norvegicus
taagcgctggaagtctggtgaaccc

SEQ ID NO: 632006 - DNA, 25 bp, Rattus norvegicus
ctggacatggtaagcgctggaagtc

SEQ ID NO: 632007 - DNA, 25 bp, Rattus norvegicus
gcactggacatggtaagcgctggaa

SEQ ID NO: 632008 - DNA, 25 bp, Rattus norvegicus
ttcccgcactggacatggtaagcgc

SEQ ID NO: 632009 - DNA, 25 bp, Rattus norvegicus
cctgcttcccgcactggacatggta

SEQ ID NO: 632010 - DNA, 25 bp, Rattus norvegicus
cctcgctgacgccacctgcttcccg

SEQ ID NO: 632011 - DNA, 25 bp, Rattus norvegicus
agccgctctccctcgctgacgccac

SEQ ID NO: 632012 - DNA, 25 bp, Rattus norvegicus
ggcctgctgcctgccagccgctctc

SEQ ID NO: 632013 - DNA, 25 bp, Rattus norvegicus
attacccgcggccaccggatctctg

SEQ ID NO: 632014 - DNA, 25 bp, Rattus norvegicus
gcgccatcgagccaggctagagtcg

SEQ ID NO: 632015 - DNA, 25 bp, Rattus norvegicus
gccgcccacctcacgcgcctcggtt

SEQ ID NO: 632016 - DNA, 25 bp, Rattus norvegicus
gtgtctaagccggatagggcgtata

SEQ ID NO: 632017 - DNA, 25 bp, Rattus norvegicus
accgaagttcggagcgccgagagca

SEQ ID NO: 632018 - DNA, 25 bp, Rattus norvegicus
cagaggctcggcaccgaagttcgga

SEQ ID NO: 632019 - DNA, 25 bp, Rattus norvegicus
cgccagggttcagaggctcggcacc

SEQ ID NO: 632020 - DNA, 25 bp, Rattus norvegicus
cggaatttgtggcaaggactgagta

SEQ ID NO: 632021 - DNA, 25 bp, Rattus norvegicus
gcctcggttctgcaagcgactcact

SEQ ID NO: 632022 - DNA, 25 bp, Rattus norvegicus
ctgagtcttggctgatggggaaccc

SEQ ID NO: 632023 - DNA, 25 bp, Rattus norvegicus
taaccctctgcccacagactgctga

SEQ ID NO: 632024 - DNA, 25 bp, Rattus norvegicus
tgctgcgctgggctcgccctgtaac

SEQ ID NO: 632025 - DNA, 25 bp, Rattus norvegicus
cgcagagattggagatgcaccgccc

SEQ ID NO: 632026 - DNA, 25 bp, Rattus norvegicus
ccgccgcagagattggagatgcacc

SEQ ID NO: 632027 - DNA, 25 bp, Rattus norvegicus
tctaagccggatagggcgtataagg

SEQ ID NO: 632028 - DNA, 25 bp, Rattus norvegicus
aagcgactcactcgccggtcgcagg

SEQ ID NO: 632029 - DNA, 25 bp, Rattus norvegicus
tggggccactctggccgccagcaac

SEQ ID NO: 632030 - DNA, 25 bp, Rattus norvegicus
tacggggtgatcgtcccttcagacg

SEQ ID NO: 632031 - DNA, 25 bp, Rattus norvegicus
tcgaactctccctggttggctcctg

SEQ ID NO: 632032 - DNA, 25 bp, Rattus norvegicus
gctcccgacgtacggggtgatcgtc

SEQ ID NO: 632033 - DNA, 25 bp, Rattus norvegicus
ctgttcggagccgcagggactcagc

SEQ ID NO: 632034 - DNA, 25 bp, Rattus norvegicus
ccctggttggctcctgcatcctggg

SEQ ID NO: 632035 - DNA, 25 bp, Rattus norvegicus
cgagtcctgggactgccagatcgca

SEQ ID NO: 632036 - DNA, 25 bp, Rattus norvegicus
tgggactgccagatcgcagaccagc

SEQ ID NO: 632037 - DNA, 25 bp, Rattus norvegicus
gcaccgcctgctacccgcctcgaac

SEQ ID NO: 632038 - DNA, 25 bp, Rattus norvegicus
cacgcacctggggtctgactgccgg

SEQ ID NO: 632039 - DNA, 25 bp, Rattus norvegicus
gcgcaaagcgcgcagtaccagggca

SEQ ID NO: 632040 - DNA, 25 bp, Rattus norvegicus
aaagcgcgcagtaccagggcagcag

SEQ ID NO: 632041 - DNA, 25 bp, Rattus norvegicus
cggcaggaacccgagtcctgggact

SEQ ID NO: 632042 - DNA, 25 bp, Rattus norvegicus
agatcgcagaccagcaggcagcctc

SEQ ID NO: 632043 - DNA, 25 bp, Rattus norvegicus
ggatgtgaaccctaaaccggaagca

SEQ ID NO: 632044 - DNA, 25 bp, Rattus norvegicus
tggcaatcgcccactggcggcctca

SEQ ID NO: 632045 - DNA, 25 bp, Rattus norvegicus
tgacgctatacagcgcctacccgtg

SEQ ID NO: 632046 - DNA, 25 bp, Rattus norvegicus
gccctgatgaatgacgctatacagc

SEQ ID NO: 632047 - DNA, 25 bp, Rattus norvegicus
cacggctcacactgccagcgtaatg

SEQ ID NO: 632048 - DNA, 25 bp, Rattus norvegicus
cctaaaccggaagcaaacgtgcatg

SEQ ID NO: 632049 - DNA, 25 bp, Rattus norvegicus
ctgccagcgtaatgtggccacaacc

SEQ ID NO: 632050 - DNA, 25 bp, Rattus norvegicus
atacagcgcctacccgtggcaatcg

SEQ ID NO: 632051 - DNA, 25 bp, Rattus norvegicus
tgtggccacaaccaaggtcagctcc

SEQ ID NO: 632052 - DNA, 25 bp, Rattus norvegicus
aggcggctgctaatatcaataacga

SEQ ID NO: 632053 - DNA, 25 bp, Rattus norvegicus
gctaatatcaataacgactggcgtg

SEQ ID NO: 632054 - DNA, 25 bp, Rattus norvegicus
tcaataacgactggcgtgcggggct

SEQ ID NO: 632055 - DNA, 25 bp, Rattus norvegicus
accggaagcaaacgtgcatgtgtcc

SEQ ID NO: 632056 - DNA, 25 bp, Rattus norvegicus
ggctggatgtgaaccctaaaccgga

SEQ ID NO: 632057 - DNA, 25 bp, Rattus norvegicus
acaatgggccatggagttcccgttc

SEQ ID NO: 632058 - DNA, 25 bp, Rattus norvegicus
atggagttcccgttcgatgtggatg

SEQ ID NO: 632059 - DNA, 25 bp, Rattus norvegicus
cgttcgatgtggatgcgctgttccc

SEQ ID NO: 632060 - DNA, 25 bp, Rattus norvegicus
cgctgttcccggagcggatcaccgt

SEQ ID NO: 632061 - DNA, 25 bp, Rattus norvegicus
gatcaccgtgctggaccagcacctg

SEQ ID NO: 632062 - DNA, 25 bp, Rattus norvegicus
caacgccggcccggtgacatttcaa

SEQ ID NO: 632063 - DNA, 25 bp, Rattus norvegicus
gtcctggaaataaagacttatcggc

SEQ ID NO: 632064 - DNA, 25 bp, Rattus norvegicus
ataaagacttatcggccctggtagc

SEQ ID NO: 632065 - DNA, 25 bp, Rattus norvegicus
gacttatcggccctggtagcggaag

SEQ ID NO: 632066 - DNA, 25 bp, Rattus norvegicus
cctggtagcggaagtgacgttttgt

SEQ ID NO: 632067 - DNA, 25 bp, Rattus norvegicus
gtccgatcccgcacaatgggccatg

SEQ ID NO: 632068 - DNA, 25 bp, Rattus norvegicus
atcccgcacaatgggccatggagtt

SEQ ID NO: 632069 - DNA, 25 bp, Rattus norvegicus
atgggccatggagttcccgttcgat

SEQ ID NO: 632070 - DNA, 25 bp, Rattus norvegicus
tcccgttcgatgtggatgcgctgtt

SEQ ID NO: 632071 - DNA, 25 bp, Rattus norvegicus
caccgcccgcactttggagggtgcg

SEQ ID NO: 632072 - DNA, 25 bp, Rattus norvegicus
ggcaagctgggctcaagccacgtaa

SEQ ID NO: 632073 - DNA, 25 bp, Rattus norvegicus
aagctgggctcaagccacgtaaaga

SEQ ID NO: 632074 - DNA, 25 bp, Rattus norvegicus
ctgggctcaagccacgtaaagagtg

SEQ ID NO: 632075 - DNA, 25 bp, Rattus norvegicus
ctcaagccacgtaaagagtggggac

SEQ ID NO: 632076 - DNA, 25 bp, Rattus norvegicus
aagccacgtaaagagtggggacaga

SEQ ID NO: 632077 - DNA, 25 bp, Rattus norvegicus
tgtgtgtccgccagggctacggcgg

SEQ ID NO: 632078 - DNA, 25 bp, Rattus norvegicus
ggcgccctcgctcggccgcacaggt

SEQ ID NO: 632079 - DNA, 25 bp, Rattus norvegicus
gccgcacaggtgtgccgggtgccat

SEQ ID NO: 632080 - DNA, 25 bp, Rattus norvegicus
cagagtccggcggaccgctgcgctg

SEQ ID NO: 632081 - DNA, 25 bp, Rattus norvegicus
accgctgcgctgtgagggcgctgca

SEQ ID NO: 632082 - DNA, 25 bp, Rattus norvegicus
ccctgcccgcctgcgagtgacgggt

SEQ ID NO: 632083 - DNA, 25 bp, Rattus norvegicus
tgcgagtgacgggtgaagcaggaac

SEQ ID NO: 632084 - DNA, 25 bp, Rattus norvegicus
gacagaggttggtgtgtgtccgcca

SEQ ID NO: 632085 - DNA, 25 bp, Rattus norvegicus
tcacccgagaggagcatcacttcat

SEQ ID NO: 632086 - DNA, 25 bp, Rattus norvegicus
tcatgctggatgctcgtaaccgctc

SEQ ID NO: 632087 - DNA, 25 bp, Rattus norvegicus
atcgtgcaccctttccgcgagaagc

SEQ ID NO: 632088 - DNA, 25 bp, Rattus norvegicus
ttcggaaggcgctgttcaccatcgc

SEQ ID NO: 632089 - DNA, 25 bp, Rattus norvegicus
ggcggtcactctgacagtcacccga

SEQ ID NO: 632090 - DNA, 25 bp, Rattus norvegicus
aagggcatgcgcaaggtctacaccg

SEQ ID NO: 632091 - DNA, 25 bp, Rattus norvegicus
gctcttcgcgcacatctacctggtg

SEQ ID NO: 632092 - DNA, 25 bp, Rattus norvegicus
cgctggcgctcatcgtagtgatgta

SEQ ID NO: 632093 - DNA, 25 bp, Rattus norvegicus
tcatggtggcgctcttcttcacgtt

SEQ ID NO: 632094 - DNA, 25 bp, Rattus norvegicus
gctgagcgagctgcaactgcacctg

SEQ ID NO: 632095 - DNA, 25 bp, Rattus norvegicus
tgctcatcatgtgtccctcggcggt

SEQ ID NO: 632096 - DNA, 25 bp, Rattus norvegicus
actccggcctgccatcagagtctgg

SEQ ID NO: 632097 - DNA, 25 bp, Rattus norvegicus
tcaacgagaacttccgccgcggctt

SEQ ID NO: 632098 - DNA, 25 bp, Rattus norvegicus
tacccgctctactcgtgctgggagg

SEQ ID NO: 632099 - DNA, 25 bp, Rattus norvegicus
gaataactagcgctctgtcccggtg

SEQ ID NO: 632100 - DNA, 25 bp, Rattus norvegicus
cccatgcgttaaaggcaaggcgccg

SEQ ID NO: 632101 - DNA, 25 bp, Rattus norvegicus
cggctgtcagcttccagagggcagc

SEQ ID NO: 632102 - DNA, 25 bp, Rattus norvegicus
aactagcgctctgtcccggtgtagc

SEQ ID NO: 632103 - DNA, 25 bp, Rattus norvegicus
ttcaccctggagtaccgcgtcttca

SEQ ID NO: 632104 - DNA, 25 bp, Rattus norvegicus
gcgagcctttggagaataactagcg

SEQ ID NO: 632105 - DNA, 25 bp, Rattus norvegicus
cggtgtagccaccaaccggctgtca

SEQ ID NO: 632106 - DNA, 25 bp, Rattus norvegicus
ggcgcgagcttcctccacggtacaa

SEQ ID NO: 632107 - DNA, 25 bp, Rattus norvegicus
gcacaggcacatctcggacaccatg

SEQ ID NO: 632108 - DNA, 25 bp, Rattus norvegicus
taccgcgtcttcatcagtgagtggc

SEQ ID NO: 632109 - DNA, 25 bp, Rattus norvegicus
acccattcattccagactctctgga

SEQ ID NO: 632110 - DNA, 25 bp, Rattus norvegicus
ccagactctctggagaagcaggcgg

SEQ ID NO: 632111 - DNA, 25 bp, Rattus norvegicus
tccacacattcgaacttgggccacg

SEQ ID NO: 632112 - DNA, 25 bp, Rattus norvegicus
gcgacggcggcacaggcacatctcg

SEQ ID NO: 632113 - DNA, 25 bp, Rattus norvegicus
ctcttcgcggcctgagtggctgtta

SEQ ID NO: 632114 - DNA, 25 bp, Rattus norvegicus
agcatacgtcacatcttgggcccgc

SEQ ID NO: 632115 - DNA, 25 bp, Rattus norvegicus
ggcctcactcggagcatacgtcaca

SEQ ID NO: 632116 - DNA, 25 bp, Rattus norvegicus
catccgggatgcgtctgaaaacgta

SEQ ID NO: 632117 - DNA, 25 bp, Rattus norvegicus
gcaggcccgaacagcgtgacgctta

SEQ ID NO: 632118 - DNA, 25 bp, Rattus norvegicus
tcttccgcagcaggagagcctactc

SEQ ID NO: 632119 - DNA, 25 bp, Rattus norvegicus
acaggcattgccacgtcttccgcag

SEQ ID NO: 632120 - DNA, 25 bp, Rattus norvegicus
agcacagaccgcctgacaggcattg

SEQ ID NO: 632121 - DNA, 25 bp, Rattus norvegicus
ttggggacagaagcacagaccgcct

SEQ ID NO: 632122 - DNA, 25 bp, Rattus norvegicus
gaagtagctgcttaagttggggaca

SEQ ID NO: 632123 - DNA, 25 bp, Rattus norvegicus
agcccgggctgaagtagctgcttaa

SEQ ID NO: 632124 - DNA, 25 bp, Rattus norvegicus
acgtactgagatcggaagcccgggc

SEQ ID NO: 632125 - DNA, 25 bp, Rattus norvegicus
tgcgtctgaaaacgtactgagatcg

SEQ ID NO: 632126 - DNA, 25 bp, Rattus norvegicus
cgtgacgtacatccggcgcgtagct

SEQ ID NO: 632127 - DNA, 25 bp, Rattus norvegicus
cagtcgccctgaggtgacagccatt

SEQ ID NO: 632128 - DNA, 25 bp, Rattus norvegicus
atgacctgcgcctccacgtgcagtg

SEQ ID NO: 632129 - DNA, 25 bp, Rattus norvegicus
cgcctctatgctggaaggcccgcga

SEQ ID NO: 632130 - DNA, 25 bp, Rattus norvegicus
tcttcctcaacacgctgagccgggg

SEQ ID NO: 632131 - DNA, 25 bp, Rattus norvegicus
aagcggcggatcaatggcacttcgt

SEQ ID NO: 632132 - DNA, 25 bp, Rattus norvegicus
gtgcacgcctcagtgcgcaagcctg

SEQ ID NO: 632133 - DNA, 25 bp, Rattus norvegicus
accaggaacttccagggctgtgcac

SEQ ID NO: 632134 - DNA, 25 bp, Rattus norvegicus
ggcgacagttgcagcgatgacctgc

SEQ ID NO: 632135 - DNA, 25 bp, Rattus norvegicus
tagcgcggctttgacccaaacggga

SEQ ID NO: 632136 - DNA, 25 bp, Rattus norvegicus
ctcagaactggtagcgcggctttga

SEQ ID NO: 632137 - DNA, 25 bp, Rattus norvegicus
gaccgtctttgagagtggcagagca

SEQ ID NO: 632138 - DNA, 25 bp, Rattus norvegicus
ccattgtgcgacgtcttggagaagc

SEQ ID NO: 632139 - DNA, 25 bp, Rattus norvegicus
cttgagtcagagtttgcgccagtcg

SEQ ID NO: 632140 - DNA, 25 bp, Rattus norvegicus
tcttggagaagccatgggacggcaa

SEQ ID NO: 632141 - DNA, 25 bp, Rattus norvegicus
ggtgcaccgggacattctcgtaagc

SEQ ID NO: 632142 - DNA, 25 bp, Rattus norvegicus
agagttgcggagcttcaagttttcc

SEQ ID NO: 632143 - DNA, 25 bp, Rattus norvegicus
agcttcaagttttccagcccacgga

SEQ ID NO: 632144 - DNA, 25 bp, Rattus norvegicus
gtgcattcccggagccgttctagga

SEQ ID NO: 632145 - DNA, 25 bp, Rattus norvegicus
acgcagtgggtttcgcaaggtgcac

SEQ ID NO: 632146 - DNA, 25 bp, Rattus norvegicus
gggacattctcgtaagccgaccacc

SEQ ID NO: 632147 - DNA, 25 bp, Rattus norvegicus
gcccggcgaagatgaagtgaattag

SEQ ID NO: 632148 - DNA, 25 bp, Rattus norvegicus
gtgtggacccgatggccacctgttc

SEQ ID NO: 632149 - DNA, 25 bp, Rattus norvegicus
ttcctcccgcgagtggggactctct

SEQ ID NO: 632150 - DNA, 25 bp, Rattus norvegicus
gggtcgcccgtgacaccagacgaca

SEQ ID NO: 632151 - DNA, 25 bp, Rattus norvegicus
ccagacgacagctgcggttctgtgc

SEQ ID NO: 632152 - DNA, 25 bp, Rattus norvegicus
tgaggcctctttggttccgtcatgc

SEQ ID NO: 632153 - DNA, 25 bp, Rattus norvegicus
ctctttggttccgtcatgcccgggg

SEQ ID NO: 632154 - DNA, 25 bp, Rattus norvegicus
aaaccgggaggaccctgtgcgtcag

SEQ ID NO: 632155 - DNA, 25 bp, Rattus norvegicus
tgagaaccgggttcctcgggatcca

SEQ ID NO: 632156 - DNA, 25 bp, Rattus norvegicus
acgacgtgtccgagtagggagcggc

SEQ ID NO: 632157 - DNA, 25 bp, Rattus norvegicus
ctcgggatccactgcgcttaaatca

SEQ ID NO: 632158 - DNA, 25 bp, Rattus norvegicus
ggatacctaacatcggccctgagaa

SEQ ID NO: 632159 - DNA, 25 bp, Rattus norvegicus
ctaggatacctaacatcggccctga

SEQ ID NO: 632160 - DNA, 25 bp, Rattus norvegicus
gttgcctaggatacctaacatcggc

SEQ ID NO: 632161 - DNA, 25 bp, Rattus norvegicus
gggccgttgcctaggatacctaaca

SEQ ID NO: 632162 - DNA, 25 bp, Rattus norvegicus
cggaccgctacaggtgaggtcgctg

SEQ ID NO: 632163 - DNA, 25 bp, Rattus norvegicus
aaaacgcgcggaccgctacaggtga

SEQ ID NO: 632164 - DNA, 25 bp, Rattus norvegicus
agcccgggacagtgatgggcacgcc

SEQ ID NO: 632165 - DNA, 25 bp, Rattus norvegicus
aaggtcagttccagggcagagaaag

SEQ ID NO: 632166 - DNA, 25 bp, Rattus norvegicus
gtcaaggtcagttccagggcagaga

SEQ ID NO: 632167 - DNA, 25 bp, Rattus norvegicus
ctggtaggcggtcaaggtcagttcc

SEQ ID NO: 632168 - DNA, 25 bp, Rattus norvegicus
gggcacgacaagggccgcagaatta

SEQ ID NO: 632169 - DNA, 25 bp, Rattus norvegicus
gcatttcggcatcctccctgcttgg

SEQ ID NO: 632170 - DNA, 25 bp, Rattus norvegicus
gatgagctattgtccttctgcagtg

SEQ ID NO: 632171 - DNA, 25 bp, Rattus norvegicus
ctttcgtggggcttgatgagctatt

SEQ ID NO: 632172 - DNA, 25 bp, Rattus norvegicus
tccacataaccacctctaggaggag

SEQ ID NO: 632173 - DNA, 25 bp, Rattus norvegicus
ttctgcagtggaaccaccgggcctg

SEQ ID NO: 632174 - DNA, 25 bp, Rattus norvegicus
gcctttcttggggttgtatctgtgc

SEQ ID NO: 632175 - DNA, 25 bp, Rattus norvegicus
tgccgggcaggaccctgcctttctt

SEQ ID NO: 632176 - DNA, 25 bp, Rattus norvegicus
cactgcccgggcaagagggttttgt

SEQ ID NO: 632177 - DNA, 25 bp, Rattus norvegicus
taggaggagtcgctcagcctcatcc

SEQ ID NO: 632178 - DNA, 25 bp, Rattus norvegicus
tttatctcccgaggaagcaagttgg

SEQ ID NO: 632179 - DNA, 25 bp, Rattus norvegicus
gtctctgcgttctcctccattgtca

SEQ ID NO: 632180 - DNA, 25 bp, Rattus norvegicus
ccatttgtcggtggaagcacggatc

SEQ ID NO: 632181 - DNA, 25 bp, Rattus norvegicus
gcaagttgggcagatcgatttatta

SEQ ID NO: 632182 - DNA, 25 bp, Rattus norvegicus
tatctgtgcgtgtcaatggcggcaa

SEQ ID NO: 632183 - DNA, 25 bp, Rattus norvegicus
gggcacaaacctcgtccagcagttg

SEQ ID NO: 632184 - DNA, 25 bp, Rattus norvegicus
tgtgcactggatctctggaagctca

SEQ ID NO: 632185 - DNA, 25 bp, Rattus norvegicus
acctgggcgaacgtgcaaaagagca

SEQ ID NO: 632186 - DNA, 25 bp, Rattus norvegicus
tccagcagttggttgactcgtccca

SEQ ID NO: 632187 - DNA, 25 bp, Rattus norvegicus
gttgactcgtcccaaaatagctttc

SEQ ID NO: 632188 - DNA, 25 bp, Rattus norvegicus
cgagcacaacgccagagccagcagt

SEQ ID NO: 632189 - DNA, 25 bp, Rattus norvegicus
tgctcgccaaaaaggaccaaaaatg

SEQ ID NO: 632190 - DNA, 25 bp, Rattus norvegicus
gtgatgcctgcccacagttctagta

SEQ ID NO: 632191 - DNA, 25 bp, Rattus norvegicus
gtccttctgggtgttttgtgtctcc

SEQ ID NO: 632192 - DNA, 25 bp, Rattus norvegicus
cgggcgctacttcccaaactaatct

SEQ ID NO: 632193 - DNA, 25 bp, Rattus norvegicus
gcagccaagagcaacagacgcgatc

SEQ ID NO: 632194 - DNA, 25 bp, Rattus norvegicus
gttccaagttcagggatctggctcc

SEQ ID NO: 632195 - DNA, 25 bp, Rattus norvegicus
gacgcgatcggggtacaccaaagta

SEQ ID NO: 632196 - DNA, 25 bp, Rattus norvegicus
attccggcgcctctgtaacttgaca

SEQ ID NO: 632197 - DNA, 25 bp, Rattus norvegicus
agcacctcggtcaggcgtggctcca

SEQ ID NO: 632198 - DNA, 25 bp, Rattus norvegicus
actttacaggaagcgcgcaccgcgg

SEQ ID NO: 632199 - DNA, 25 bp, Rattus norvegicus
ggcaggatccctctgccggctgccg

SEQ ID NO: 632200 - DNA, 25 bp, Rattus norvegicus
gctctccgggctcgacgtccaaggg

SEQ ID NO: 632201 - DNA, 25 bp, Rattus norvegicus
cctgcagcacctcggtcaggcgtgg

SEQ ID NO: 632202 - DNA, 25 bp, Rattus norvegicus
tccgcgcggcgtcatcccgcaggct

SEQ ID NO: 632203 - DNA, 25 bp, Rattus norvegicus
acccggcgccagtaccacccacctg

SEQ ID NO: 632204 - DNA, 25 bp, Rattus norvegicus
gccagtaccacccacctgcgcgcac

SEQ ID NO: 632205 - DNA, 25 bp, Rattus norvegicus
cacctgactttacaggaagcgcgca

SEQ ID NO: 632206 - DNA, 25 bp, Rattus norvegicus
ctcccacctgactttacaggaagcg

SEQ ID NO: 632207 - DNA, 25 bp, Rattus norvegicus
gcggccgcttcctcccacctgactt

SEQ ID NO: 632208 - DNA, 25 bp, Rattus norvegicus
tgactttacaggaagcgcgcaccgc

SEQ ID NO: 632209 - DNA, 25 bp, Rattus norvegicus
gctcgacgtccaagggcggccgctt

SEQ ID NO: 632210 - DNA, 25 bp, Rattus norvegicus
gagcgccagggtcgcggttccgcgc

SEQ ID NO: 632211 - DNA, 25 bp, Rattus norvegicus
ctccgagccagacgggactcttctg

SEQ ID NO: 632212 - DNA, 25 bp, Rattus norvegicus
cccgttgctgattggcccgtggcac

SEQ ID NO: 632213 - DNA, 25 bp, Rattus norvegicus
tccggaatccagctgtgctccgcgg

SEQ ID NO: 632214 - DNA, 25 bp, Rattus norvegicus
tttgtccggaatccagctgtgctcc

SEQ ID NO: 632215 - DNA, 25 bp, Rattus norvegicus
gccctttgtccggaatccagctgtg

SEQ ID NO: 632216 - DNA, 25 bp, Rattus norvegicus
aaccgagagttgctgggacagagcc

SEQ ID NO: 632217 - DNA, 25 bp, Rattus norvegicus
ggcgaggctctttgaggaaccgaga

SEQ ID NO: 632218 - DNA, 25 bp, Rattus norvegicus
ggccagctccgagccagacgggact

SEQ ID NO: 632219 - DNA, 25 bp, Rattus norvegicus
gagccagacgggactcttctggctg

SEQ ID NO: 632220 - DNA, 25 bp, Rattus norvegicus
cagctccgagccagacgggactctt

SEQ ID NO: 632221 - DNA, 25 bp, Rattus norvegicus
ctgattggcccgtggcacaggcagc

SEQ ID NO: 632222 - DNA, 25 bp, Rattus norvegicus
actcttctggctgggcgaggctctt

SEQ ID NO: 632223 - DNA, 25 bp, Rattus norvegicus
ttggcccgtggcacaggcagcagcc

SEQ ID NO: 632224 - DNA, 25 bp, Rattus norvegicus
agcgggctcgcgtggcgcagtccct

SEQ ID NO: 632225 - DNA, 25 bp, Rattus norvegicus
aaggcttgtccgctgcacccggtac

SEQ ID NO: 632226 - DNA, 25 bp, Rattus norvegicus
gcctgtggtgcacctgcagaacggt

SEQ ID NO: 632227 - DNA, 25 bp, Rattus norvegicus
cagaacggtcctgctcgcaaggctt

SEQ ID NO: 632228 - DNA, 25 bp, Rattus norvegicus
gcgcacttccgcgtagcggcgtctg

SEQ ID NO: 632229 - DNA, 25 bp, Rattus norvegicus
tgcacctgcagaacggtcctgctcg

SEQ ID NO: 632230 - DNA, 25 bp, Rattus norvegicus
ctaccgttcgctacctgtgcccgga

SEQ ID NO: 632231 - DNA, 25 bp, Rattus norvegicus
gcgtcccgtgtgaggcgcgtctcca

SEQ ID NO: 632232 - DNA, 25 bp, Rattus norvegicus
ctgtgagggctagtgtccccaatga

SEQ ID NO: 632233 - DNA, 25 bp, Rattus norvegicus
aagaccctcctcagagccgggcgag

SEQ ID NO: 632234 - DNA, 25 bp, Rattus norvegicus
gggtcgggcgaagaccctcctcaga

SEQ ID NO: 632235 - DNA, 25 bp, Rattus norvegicus
tgcctccgcgcctaccaggtgcgac

SEQ ID NO: 632236 - DNA, 25 bp, Rattus norvegicus
accatgtaccgtccgagcccgggag

SEQ ID NO: 632237 - DNA, 25 bp, Rattus norvegicus
aggcgcacggtgtctccgtttccct

SEQ ID NO: 632238 - DNA, 25 bp, Rattus norvegicus
tcctgctcgcaaggcttgtccgctg

SEQ ID NO: 632239 - DNA, 25 bp, Rattus norvegicus
agcgagttggcactgagcaagcagc

SEQ ID NO: 632240 - DNA, 25 bp, Rattus norvegicus
agcaagcagcgacgaagccggcgca

SEQ ID NO: 632241 - DNA, 25 bp, Rattus norvegicus
agccggcgcaagaaggccaacgacc

SEQ ID NO: 632242 - DNA, 25 bp, Rattus norvegicus
gcacaaccttaactccgcgctggat

SEQ ID NO: 632243 - DNA, 25 bp, Rattus norvegicus
atagcggaccacagcttctacggcc

SEQ ID NO: 632244 - DNA, 25 bp, Rattus norvegicus
cagacgctgcgcatagcggaccaca

SEQ ID NO: 632245 - DNA, 25 bp, Rattus norvegicus
ttaactccgcgctggatgcgctgcg

SEQ ID NO: 632246 - DNA, 25 bp, Rattus norvegicus
acatcgaggaagctccgtgcgcggc

SEQ ID NO: 632247 - DNA, 25 bp, Rattus norvegicus
actgccgagggacatcgaggaagct

SEQ ID NO: 632248 - DNA, 25 bp, Rattus norvegicus
cttcccggatgacgccaaacttaca

SEQ ID NO: 632249 - DNA, 25 bp, Rattus norvegicus
tacaaagatcgagaccctgcgcttc

SEQ ID NO: 632250 - DNA, 25 bp, Rattus norvegicus
cacaactacatttgggcactgactc

SEQ ID NO: 632251 - DNA, 25 bp, Rattus norvegicus
tacatttgggcactgactcagacgc

SEQ ID NO: 632252 - DNA, 25 bp, Rattus norvegicus
gcgcaacaggcccaagagcgagttg

SEQ ID NO: 632253 - DNA, 25 bp, Rattus norvegicus
ctgggcatcgagaagcgtcagagtc

SEQ ID NO: 632254 - DNA, 25 bp, Rattus norvegicus
cgagaagcgtcagagtctgggatta

SEQ ID NO: 632255 - DNA, 25 bp, Rattus norvegicus
cgcaaggtaggctgcaagcctggcc

SEQ ID NO: 632256 - DNA, 25 bp, Rattus norvegicus
tccctgtgggtaggatcagggcaca

SEQ ID NO: 632257 - DNA, 25 bp, Rattus norvegicus
cagagtctgggattaactgtgtttc

SEQ ID NO: 632258 - DNA, 25 bp, Rattus norvegicus
aagcctggccgggtcagcacccaag

SEQ ID NO: 632259 - DNA, 25 bp, Rattus norvegicus
cctccaggcgcaaggtaggctgcaa

SEQ ID NO: 632260 - DNA, 25 bp, Rattus norvegicus
atccgcagcctccaggcgcaaggta

SEQ ID NO: 632261 - DNA, 25 bp, Rattus norvegicus
tgcctcgggcggacatcatccgcag

SEQ ID NO: 632262 - DNA, 25 bp, Rattus norvegicus
gagaccctctgcctcgggcggacat

SEQ ID NO: 632263 - DNA, 25 bp, Rattus norvegicus
tacatgttgagcctctaccgagacc

SEQ ID NO: 632264 - DNA, 25 bp, Rattus norvegicus
ccctctggcgtacatgttgagcctc

SEQ ID NO: 632265 - DNA, 25 bp, Rattus norvegicus
cggccgctttgcctctgtggacacg

SEQ ID NO: 632266 - DNA, 25 bp, Rattus norvegicus
actgtgtttccctgtgggtaggatc

SEQ ID NO: 632267 - DNA, 25 bp, Rattus norvegicus
tgtgccacgcgccagcagtgatggc

SEQ ID NO: 632268 - DNA, 25 bp, Rattus norvegicus
gtcgctaatagccacggtgcgtgtc

SEQ ID NO: 632269 - DNA, 25 bp, Rattus norvegicus
agctgcgctgcgtcgctaatagcca

SEQ ID NO: 632270 - DNA, 25 bp, Rattus norvegicus
cagtagtcctgaggtagctgcgctg

SEQ ID NO: 632271 - DNA, 25 bp, Rattus norvegicus
ccggtgttgtggagaacagcgtccc

SEQ ID NO: 632272 - DNA, 25 bp, Rattus norvegicus
aatagccacggtgcgtgtcggaatg

SEQ ID NO: 632273 - DNA, 25 bp, Rattus norvegicus
tcacctcccggtgttgtggagaaca

SEQ ID NO: 632274 - DNA, 25 bp, Rattus norvegicus
actctagaggtaagctccgccgcgc

SEQ ID NO: 632275 - DNA, 25 bp, Rattus norvegicus
ttggtccagcgtgtagtgtgccacg

SEQ ID NO: 632276 - DNA, 25 bp, Rattus norvegicus
cagagtgcacggtctgcagcccact

SEQ ID NO: 632277 - DNA, 25 bp, Rattus norvegicus
actctaagcgcagccagaagtcatc

SEQ ID NO: 632278 - DNA, 25 bp, Rattus norvegicus
agaagtcatcttacgcttccgcgcc

SEQ ID NO: 632279 - DNA, 25 bp, Rattus norvegicus
tccctaatgcccgtaggacaactct

SEQ ID NO: 632280 - DNA, 25 bp, Rattus norvegicus
tgcccgtaggacaactctagaggta

SEQ ID NO: 632281 - DNA, 25 bp, Rattus norvegicus
ctcgggctcagaacttgcaccaggt

SEQ ID NO: 632282 - DNA, 25 bp, Rattus norvegicus
gtcgctattggctgagcgacagtgc

SEQ ID NO: 632283 - DNA, 25 bp, Rattus norvegicus
aacttgcaccaggtgccggcggtcg

SEQ ID NO: 632284 - DNA, 25 bp, Rattus norvegicus
gctctaggacgcgttgtcgccgtaa

SEQ ID NO: 632285 - DNA, 25 bp, Rattus norvegicus
ctgggtctcatcctggcgtcgctat

SEQ ID NO: 632286 - DNA, 25 bp, Rattus norvegicus
ctctgcgtaacggtggccaagaggc

SEQ ID NO: 632287 - DNA, 25 bp, Rattus norvegicus
gcttcgcgccgctctgcgtaacggt

SEQ ID NO: 632288 - DNA, 25 bp, Rattus norvegicus
cgtcctgggcttggccgcgttcctt

SEQ ID NO: 632289 - DNA, 25 bp, Rattus norvegicus
gtacaccaggtagcaccgagtcatg

SEQ ID NO: 632290 - DNA, 25 bp, Rattus norvegicus
ccaggtagcaccgagtcatggctcg

SEQ ID NO: 632291 - DNA, 25 bp, Rattus norvegicus
cccaggggtcgtggactcgccagct

SEQ ID NO: 632292 - DNA, 25 bp, Rattus norvegicus
tcgtggactcgccagctggagatcg

SEQ ID NO: 632293 - DNA, 25 bp, Rattus norvegicus
tcgccgtaagtgctgcctccagcgg

SEQ ID NO: 632294 - DNA, 25 bp, Rattus norvegicus
ggaaagcaccgtcctgggcttggcc

SEQ ID NO: 632295 - DNA, 25 bp, Rattus norvegicus
tgcgcactgcttatttcccgctgtc

SEQ ID NO: 632296 - DNA, 25 bp, Rattus norvegicus
taaggcgcccaccatggcgggcgcg

SEQ ID NO: 632297 - DNA, 25 bp, Rattus norvegicus
gcctgacggtaaggcgcccaccatg

SEQ ID NO: 632298 - DNA, 25 bp, Rattus norvegicus
agcctgacggtaaggcgcccaccat

SEQ ID NO: 632299 - DNA, 25 bp, Rattus norvegicus
caggccgcccactggccatggcgca

SEQ ID NO: 632300 - DNA, 25 bp, Rattus norvegicus
tccgccagctgagtccgccgcagcc

SEQ ID NO: 632301 - DNA, 25 bp, Rattus norvegicus
tcgacgcgttctccgccagctgagt

SEQ ID NO: 632302 - DNA, 25 bp, Rattus norvegicus
ggtcgacgcgttctccgccagctga

SEQ ID NO: 632303 - DNA, 25 bp, Rattus norvegicus
agcggctccagccttagcggttcct

SEQ ID NO: 632304 - DNA, 25 bp, Rattus norvegicus
cggtccgtctctgcccgaggctgtg

SEQ ID NO: 632305 - DNA, 25 bp, Rattus norvegicus
gaggtcggcgctccggtccgtctct

SEQ ID NO: 632306 - DNA, 25 bp, Rattus norvegicus
ttcccgctgtcaggatgaggaggcg

SEQ ID NO: 632307 - DNA, 25 bp, Rattus norvegicus
gcactgcttatttcccgctgtcagg

SEQ ID NO: 632308 - DNA, 25 bp, Rattus norvegicus
cgcggcctgtctggcgctgcgtcgt

SEQ ID NO: 632309 - DNA, 25 bp, Rattus norvegicus
ccgcccgtatggaaggccgttagcg

SEQ ID NO: 632310 - DNA, 25 bp, Rattus norvegicus
actctatcgagctcgggacgggcac

SEQ ID NO: 632311 - DNA, 25 bp, Rattus norvegicus
cacggtgagcaggtctcgccagagt

SEQ ID NO: 632312 - DNA, 25 bp, Rattus norvegicus
aggtctcgccagagtccggaactga

SEQ ID NO: 632313 - DNA, 25 bp, Rattus norvegicus
tccggaactgagagattgggcactg

SEQ ID NO: 632314 - DNA, 25 bp, Rattus norvegicus
attgggcactgacagtcctcggcta

SEQ ID NO: 632315 - DNA, 25 bp, Rattus norvegicus
agtcctcggctaccttggaaggcga

SEQ ID NO: 632316 - DNA, 25 bp, Rattus norvegicus
cacagccggtccaggaaggctggca

SEQ ID NO: 632317 - DNA, 25 bp, Rattus norvegicus
cagaggttccgacatggccaggaca

SEQ ID NO: 632318 - DNA, 25 bp, Rattus norvegicus
acatggccaggacagtgtcgccggc

SEQ ID NO: 632319 - DNA, 25 bp, Rattus norvegicus
cgccgcgcactcaccattgtcaccg

SEQ ID NO: 632320 - DNA, 25 bp, Rattus norvegicus
tccactcggctttcccttaggagaa

SEQ ID NO: 632321 - DNA, 25 bp, Rattus norvegicus
gaactcacagcctgggtgcctgcgc

SEQ ID NO: 632322 - DNA, 25 bp, Rattus norvegicus
cttaggagaactcacagcctgggtg

SEQ ID NO: 632323 - DNA, 25 bp, Rattus norvegicus
gacaggcacctgaccagatgctcct

SEQ ID NO: 632324 - DNA, 25 bp, Rattus norvegicus
tcgccggcagacagttcctcagtgt

SEQ ID NO: 632325 - DNA, 25 bp, Rattus norvegicus
acgacacgtcgtgactgtggagcac

SEQ ID NO: 632326 - DNA, 25 bp, Rattus norvegicus
cctcagtgtcgatgtggttcacgcc

SEQ ID NO: 632327 - DNA, 25 bp, Rattus norvegicus
gttcacgccaaggtggaactccacc

SEQ ID NO: 632328 - DNA, 25 bp, Rattus norvegicus
acttggacttgtacggctccttctc

SEQ ID NO: 632329 - DNA, 25 bp, Rattus norvegicus
ctccttctccgggttcttgtgcagc

SEQ ID NO: 632330 - DNA, 25 bp, Rattus norvegicus
ttgtgcagctccacccgcgacagag

SEQ ID NO: 632331 - DNA, 25 bp, Rattus norvegicus
ccgcgttgcgacacttcacttacga

SEQ ID NO: 632332 - DNA, 25 bp, Rattus norvegicus
cagcctggaacttctcgcggatctc

SEQ ID NO: 632333 - DNA, 25 bp, Rattus norvegicus
ctcctagcctgtggaccgtgggcta

SEQ ID NO: 632334 - DNA, 25 bp, Rattus norvegicus
tgctggtcgccacaacagccgtcgt

SEQ ID NO: 632335 - DNA, 25 bp, Rattus norvegicus
aggcgctctgtagcagccaatggga

SEQ ID NO: 632336 - DNA, 25 bp, Rattus norvegicus
ggagcacggaccaatgaagccagta

SEQ ID NO: 632337 - DNA, 25 bp, Rattus norvegicus
cacagcgtgtcagagggccgaccac

SEQ ID NO: 632338 - DNA, 25 bp, Rattus norvegicus
gctgcgattcgcatggctttggatg

SEQ ID NO: 632339 - DNA, 25 bp, Rattus norvegicus
agcgtacaccggtgtggctgcgatt

SEQ ID NO: 632340 - DNA, 25 bp, Rattus norvegicus
catccggcggaagtagcgtacaccg

SEQ ID NO: 632341 - DNA, 25 bp, Rattus norvegicus
ccgcgtgcaaaggaaagagagcgac

SEQ ID NO: 632342 - DNA, 25 bp, Rattus norvegicus
cggcttccacaaccgcgtgcaaagg

SEQ ID NO: 632343 - DNA, 25 bp, Rattus norvegicus
ttattcagcaggagcagctcaggcc

SEQ ID NO: 632344 - DNA, 25 bp, Rattus norvegicus
tttcccggcattattcagcaggagc

SEQ ID NO: 632345 - DNA, 25 bp, Rattus norvegicus
ctgcggagttttcccggcattattc

SEQ ID NO: 632346 - DNA, 25 bp, Rattus norvegicus
ccgacttggacgcactgcggagttt

SEQ ID NO: 632347 - DNA, 25 bp, Rattus norvegicus
cggtcccttctgactccgacttgga

SEQ ID NO: 632348 - DNA, 25 bp, Rattus norvegicus
ggcttctgcagcgtctccatactct

SEQ ID NO: 632349 - DNA, 25 bp, Rattus norvegicus
ggctcaccttctcgcttggcttctg

SEQ ID NO: 632350 - DNA, 25 bp, Rattus norvegicus
gctttggatgggatccgtctgtgca

SEQ ID NO: 632351 - DNA, 25 bp, Rattus norvegicus
aaacgtgactggctccgatgggccc

SEQ ID NO: 632352 - DNA, 25 bp, Rattus norvegicus
cccggcgcagcacgaagaattccaa

SEQ ID NO: 632353 - DNA, 25 bp, Rattus norvegicus
aaatgagcagattccacggcgatgg

SEQ ID NO: 632354 - DNA, 25 bp, Rattus norvegicus
gggagctcaagtctgcccatctctt

SEQ ID NO: 632355 - DNA, 25 bp, Rattus norvegicus
ctcttgggagagatccaggcgcaaa

SEQ ID NO: 632356 - DNA, 25 bp, Rattus norvegicus
ctaggtctgttctcctccaggtccg

SEQ ID NO: 632357 - DNA, 25 bp, Rattus norvegicus
tctcggactcttccaagggtgcctc

SEQ ID NO: 632358 - DNA, 25 bp, Rattus norvegicus
ggtgcctcgagctccatgatgtctc

SEQ ID NO: 632359 - DNA, 25 bp, Rattus norvegicus
ccagaggagtttcccgggcattact

SEQ ID NO: 632360 - DNA, 25 bp, Rattus norvegicus
tacggccaccgatagcgtgaaagga

SEQ ID NO: 632361 - DNA, 25 bp, Rattus norvegicus
ctctccgggaggaaactctcctaga

SEQ ID NO: 632362 - DNA, 25 bp, Rattus norvegicus
gcctccctcggccaatgaaaacgtg

SEQ ID NO: 632363 - DNA, 25 bp, Rattus norvegicus
cgatgcacgggccaatctccaggaa

SEQ ID NO: 632364 - DNA, 25 bp, Rattus norvegicus
gcccgcccgtgctctgaaatgacag

SEQ ID NO: 632365 - DNA, 25 bp, Rattus norvegicus
tgtgcccaactctgctgtcccggga

SEQ ID NO: 632366 - DNA, 25 bp, Rattus norvegicus
catcgcccaagggtaagacccggag

SEQ ID NO: 632367 - DNA, 25 bp, Rattus norvegicus
ggtggcatcgcccaagggtaagacc

SEQ ID NO: 632368 - DNA, 25 bp, Rattus norvegicus
gcaaccagaaaagccggtggcatcg

SEQ ID NO: 632369 - DNA, 25 bp, Rattus norvegicus
gagcgtccctgtcactccgggttac

SEQ ID NO: 632370 - DNA, 25 bp, Rattus norvegicus
ccaccgcggtgatgcggaaacctcg

SEQ ID NO: 632371 - DNA, 25 bp, Rattus norvegicus
gcttagtgtgcccaactctgctgtc

SEQ ID NO: 632372 - DNA, 25 bp, Rattus norvegicus
ggactcgcgcttagtgtgcccaact

SEQ ID NO: 632373 - DNA, 25 bp, Rattus norvegicus
cgcccgagggactcgcgcttagtgt

SEQ ID NO: 632374 - DNA, 25 bp, Rattus norvegicus
cgttccagaagcagcgcgcgttggc

SEQ ID NO: 632375 - DNA, 25 bp, Rattus norvegicus
cgccagccgtgcgttccagaagcag

SEQ ID NO: 632376 - DNA, 25 bp, Rattus norvegicus
gacgccacgcatcccgcagcacctg

SEQ ID NO: 632377 - DNA, 25 bp, Rattus norvegicus
gacctgtccctgtgacccgcgccac

SEQ ID NO: 632378 - DNA, 25 bp, Rattus norvegicus
cccagcaaccagaaaagccggtggc

SEQ ID NO: 632379 - DNA, 25 bp, Rattus norvegicus
gctccagagcaaaacactgaccaga

SEQ ID NO: 632380 - DNA, 25 bp, Rattus norvegicus
ggtaacgcggttcttccctgcaaga

SEQ ID NO: 632381 - DNA, 25 bp, Rattus norvegicus
cctccgtagagcacgggcagcggaa

SEQ ID NO: 632382 - DNA, 25 bp, Rattus norvegicus
cggaagatggaacccacgcctcagg

SEQ ID NO: 632383 - DNA, 25 bp, Rattus norvegicus
gccggtctgagagagcttccaagtc

SEQ ID NO: 632384 - DNA, 25 bp, Rattus norvegicus
gagcttccaagtcctgaaaacactc

SEQ ID NO: 632385 - DNA, 25 bp, Rattus norvegicus
gacccgccgcgaacaagcggagtca

SEQ ID NO: 632386 - DNA, 25 bp, Rattus norvegicus
cggggttaacagagaagccatttca

SEQ ID NO: 632387 - DNA, 25 bp, Rattus norvegicus
aaaacccgtcaagctcaggcgcatg

SEQ ID NO: 632388 - DNA, 25 bp, Rattus norvegicus
tgcgcgttcactaggcagccagagc

SEQ ID NO: 632389 - DNA, 25 bp, Rattus norvegicus
agccagagctagagcgcgccctcag

SEQ ID NO: 632390 - DNA, 25 bp, Rattus norvegicus
accttggcttcccttaacaatgagc

SEQ ID NO: 632391 - DNA, 25 bp, Rattus norvegicus
acaatgagccggctatctttgcgcc

SEQ ID NO: 632392 - DNA, 25 bp, Rattus norvegicus
cagaccttcacctgagtcgggccgg

SEQ ID NO: 632393 - DNA, 25 bp, Rattus norvegicus
cctcgcactggctgcggtatagaca

SEQ ID NO: 632394 - DNA, 25 bp, Rattus norvegicus
cggtatagacacctcgtccacagtg

SEQ ID NO: 632395 - DNA, 25 bp, Rattus norvegicus
cacagtgcaagattgggtagttcta

SEQ ID NO: 632396 - DNA, 25 bp, Rattus norvegicus
aagaggcctgaggtgccacggcctc

SEQ ID NO: 632397 - DNA, 25 bp, Rattus norvegicus
cgcgaaacccggaaggaatcgcatt

SEQ ID NO: 632398 - DNA, 25 bp, Rattus norvegicus
gtccagggtctctgtgtcacgcaag

SEQ ID NO: 632399 - DNA, 25 bp, Rattus norvegicus
aagcaaccgcggaacggccaggact

SEQ ID NO: 632400 - DNA, 25 bp, Rattus norvegicus
acgcgtctcgctctgggcaagcaac

SEQ ID NO: 632401 - DNA, 25 bp, Rattus norvegicus
ggaactgcgcgacgtgccgctcgct

SEQ ID NO: 632402 - DNA, 25 bp, Rattus norvegicus
ccgtgccgatcaggaactgcgcgac

SEQ ID NO: 632403 - DNA, 25 bp, Rattus norvegicus
agcgctgcacaaactcctcggcgga

SEQ ID NO: 632404 - DNA, 25 bp, Rattus norvegicus
gtctctgtgtcacgcaagcgctgca

SEQ ID NO: 632405 - DNA, 25 bp, Rattus norvegicus
gaatcgcattcttccggccagggct

SEQ ID NO: 632406 - DNA, 25 bp, Rattus norvegicus
ggtagttctacaccgtctcccagga

SEQ ID NO: 632407 - DNA, 25 bp, Rattus norvegicus
tgcagacccggatccacgcgtggac

SEQ ID NO: 632408 - DNA, 25 bp, Rattus norvegicus
tctgacaaagttctgcgccaacgtc

SEQ ID NO: 632409 - DNA, 25 bp, Rattus norvegicus
agtaccgcagtcacaacagctcttc

SEQ ID NO: 632410 - DNA, 25 bp, Rattus norvegicus
agctcttcctcactggcccgggagg

SEQ ID NO: 632411 - DNA, 25 bp, Rattus norvegicus
gaggggagagatcccagcatgctcc

SEQ ID NO: 632412 - DNA, 25 bp, Rattus norvegicus
atgctccgcagcagatctgagttgc

SEQ ID NO: 632413 - DNA, 25 bp, Rattus norvegicus
cattctgggacttgcgagggatttt

SEQ ID NO: 632414 - DNA, 25 bp, Rattus norvegicus
cgagggatttttgcaactttcgcta

SEQ ID NO: 632415 - DNA, 25 bp, Rattus norvegicus
caactttcgctagcgcgtcagagca

SEQ ID NO: 632416 - DNA, 25 bp, Rattus norvegicus
ggtcgcattttccactccagatttg

SEQ ID NO: 632417 - DNA, 25 bp, Rattus norvegicus
tccagatttgctaaaaccgtaactc

SEQ ID NO: 632418 - DNA, 25 bp, Rattus norvegicus
ccgtaactcggttctgagtacattt

SEQ ID NO: 632419 - DNA, 25 bp, Rattus norvegicus
atacgcctgatcctgcggcaaacgc

SEQ ID NO: 632420 - DNA, 25 bp, Rattus norvegicus
aaggcggcaaggtccgaatctgaca

SEQ ID NO: 632421 - DNA, 25 bp, Rattus norvegicus
tgagctgtccgcagccgaggccaca

SEQ ID NO: 632422 - DNA, 25 bp, Rattus norvegicus
ccgcctggccagcaagggcttctgg

SEQ ID NO: 632423 - DNA, 25 bp, Rattus norvegicus
cttagagtctgaggaaaggagcgct

SEQ ID NO: 632424 - DNA, 25 bp, Rattus norvegicus
agccgccatcttgggttgcttagct

SEQ ID NO: 632425 - DNA, 25 bp, Rattus norvegicus
agtcggagagtccaccctgagctgt

SEQ ID NO: 632426 - DNA, 25 bp, Rattus norvegicus
aggccacagcgggagactataagga

SEQ ID NO: 632427 - DNA, 25 bp, Rattus norvegicus
ccctctccctgagaaggcttcggga

SEQ ID NO: 632428 - DNA, 25 bp, Rattus norvegicus
ggacggagacgggagtctcacctcc

SEQ ID NO: 632429 - DNA, 25 bp, Rattus norvegicus
agtctcacctcccagagggccaaag

SEQ ID NO: 632430 - DNA, 25 bp, Rattus norvegicus
tagcgatgacattgcccagcccagc

SEQ ID NO: 632431 - DNA, 25 bp, Rattus norvegicus
cgtaggttttctggtcatcccggtg

SEQ ID NO: 632432 - DNA, 25 bp, Rattus norvegicus
tcccggtgtgctacgggatgccctc

SEQ ID NO: 632433 - DNA, 25 bp, Rattus norvegicus
ggatgccctccggattatctcagcg

SEQ ID NO: 632434 - DNA, 25 bp, Rattus norvegicus
ttgcttagctgctcgccggggacag

SEQ ID NO: 632435 - DNA, 25 bp, Rattus norvegicus
ggagcctgctcagccgccacaggtt

SEQ ID NO: 632436 - DNA, 25 bp, Rattus norvegicus
gaactggaggaaaccttcgtgcacg

SEQ ID NO: 632437 - DNA, 25 bp, Rattus norvegicus
ctccgtgtgattgacagccgacgtg

SEQ ID NO: 632438 - DNA, 25 bp, Rattus norvegicus
cagccgacgtggaagtgaactaact

SEQ ID NO: 632439 - DNA, 25 bp, Rattus norvegicus
aactaactgggaggaagcttctgcc

SEQ ID NO: 632440 - DNA, 25 bp, Rattus norvegicus
tgcccagacccggacacttggagaa

SEQ ID NO: 632441 - DNA, 25 bp, Rattus norvegicus
gccatctgtgcggtatctgtccacc

SEQ ID NO: 632442 - DNA, 25 bp, Rattus norvegicus
caggtgagtgctccattcgccctgc

SEQ ID NO: 632443 - DNA, 25 bp, Rattus norvegicus
ctgcaggttggagttaaatcaggtg

SEQ ID NO: 632444 - DNA, 25 bp, Rattus norvegicus
ctactccgaggagagcgcttacctg

SEQ ID NO: 632445 - DNA, 25 bp, Rattus norvegicus
tcggcaagggcttgctggtctactc

SEQ ID NO: 632446 - DNA, 25 bp, Rattus norvegicus
ttccctccgagatcgcggaggagtg

SEQ ID NO: 632447 - DNA, 25 bp, Rattus norvegicus
cccggacacttggagaaaagacagc

SEQ ID NO: 632448 - DNA, 25 bp, Rattus norvegicus
aaccttcgtgcacgagcagccttcg

SEQ ID NO: 632449 - DNA, 25 bp, Rattus norvegicus
ggcctgcgcttacttccttggggca

SEQ ID NO: 632450 - DNA, 25 bp, Rattus norvegicus
gacgtctaagtagcccgcagtctgc

SEQ ID NO: 632451 - DNA, 25 bp, Rattus norvegicus
ccttggggcaggatcagtataatga

SEQ ID NO: 632452 - DNA, 25 bp, Rattus norvegicus
tgctcgagttttctgacctaacgtc

SEQ ID NO: 632453 - DNA, 25 bp, Rattus norvegicus
cccggttggttctattcagcagggg

SEQ ID NO: 632454 - DNA, 25 bp, Rattus norvegicus
cgaggccagggagagcaaagaaccc

SEQ ID NO: 632455 - DNA, 25 bp, Rattus norvegicus
cagcttctgggcgactcttccgctt

SEQ ID NO: 632456 - DNA, 25 bp, Rattus norvegicus
cgacgtcaaccggaagcggcatgtg

SEQ ID NO: 632457 - DNA, 25 bp, Rattus norvegicus
ggccgccagctttgtttaccttata

SEQ ID NO: 632458 - DNA, 25 bp, Rattus norvegicus
cccattggtacagtcgcggcctcat

SEQ ID NO: 632459 - DNA, 25 bp, Rattus norvegicus
cctcattcaggtgacgtcaccggga

SEQ ID NO: 632460 - DNA, 25 bp, Rattus norvegicus
ccaacgtcactcagccggggaaaga

SEQ ID NO: 632461 - DNA, 25 bp, Rattus norvegicus
tcaccgggacagaaagatgcaaata

SEQ ID NO: 632462 - DNA, 25 bp, Rattus norvegicus
taaaccggggcattatgggactggc

SEQ ID NO: 632463 - DNA, 25 bp, Rattus norvegicus
ctaccaccaggtatgggtctgtccg

SEQ ID NO: 632464 - DNA, 25 bp, Rattus norvegicus
aacagacttgatgcggggaccgctc

SEQ ID NO: 632465 - DNA, 25 bp, Rattus norvegicus
acgcgcctggggcaacagacttgat

SEQ ID NO: 632466 - DNA, 25 bp, Rattus norvegicus
gggaaccggtgacacacgcgcgcac

SEQ ID NO: 632467 - DNA, 25 bp, Rattus norvegicus
agacctggtcgctgtcctttggtcc

SEQ ID NO: 632468 - DNA, 25 bp, Rattus norvegicus
actggaaccgtcacctgagcctcta

SEQ ID NO: 632469 - DNA, 25 bp, Rattus norvegicus
cgggaaactcttagacctggtcgct

SEQ ID NO: 632470 - DNA, 25 bp, Rattus norvegicus
tgttatgtaccaggtctacggtccc

SEQ ID NO: 632471 - DNA, 25 bp, Rattus norvegicus
cgggctgcgaggtttaaatgcgctc

SEQ ID NO: 632472 - DNA, 25 bp, Rattus norvegicus
taaatgcgctcttgtgggagccctg

SEQ ID NO: 632473 - DNA, 25 bp, Rattus norvegicus
tcgccgctacggcatccttgagctt

SEQ ID NO: 632474 - DNA, 25 bp, Rattus norvegicus
cttgagcttcaccaaaacagcgttg

SEQ ID NO: 632475 - DNA, 25 bp, Rattus norvegicus
gttgatgagaaaccactcagctgcc

SEQ ID NO: 632476 - DNA, 25 bp, Rattus norvegicus
ccatgagctgtctggatgttatgta

SEQ ID NO: 632477 - DNA, 25 bp, Rattus norvegicus
gaccgccctgacattcttctcttgc

SEQ ID NO: 632478 - DNA, 25 bp, Rattus norvegicus
actctgggctaagctccgggcgcgc

SEQ ID NO: 632479 - DNA, 25 bp, Rattus norvegicus
ggcactgtacccgactctgggctaa

SEQ ID NO: 632480 - DNA, 25 bp, Rattus norvegicus
gtctcagcgtggactcaggtaagcg

SEQ ID NO: 632481 - DNA, 25 bp, Rattus norvegicus
cccagagcctgggtctcagcgtgga

SEQ ID NO: 632482 - DNA, 25 bp, Rattus norvegicus
tccctgtgagctagccgccaagggc

SEQ ID NO: 632483 - DNA, 25 bp, Rattus norvegicus
tgataatgcccgcagcctctggccg

SEQ ID NO: 632484 - DNA, 25 bp, Rattus norvegicus
gacccgcgctatgggccgctgataa

SEQ ID NO: 632485 - DNA, 25 bp, Rattus norvegicus
agcagtgcacgaggtctacgcgccc

SEQ ID NO: 632486 - DNA, 25 bp, Rattus norvegicus
gcggccagcagtgcacgaggtctac

SEQ ID NO: 632487 - DNA, 25 bp, Rattus norvegicus
ggcgccctaggagcgcaagcctctg

SEQ ID NO: 632488 - DNA, 25 bp, Rattus norvegicus
gaacagcgcttaccaggcgcccgtg

SEQ ID NO: 632489 - DNA, 25 bp, Rattus norvegicus
agaaggcaccttcccgatgaaccag

SEQ ID NO: 632490 - DNA, 25 bp, Rattus norvegicus
tccttctggaacagcgcttaccagg

SEQ ID NO: 632491 - DNA, 25 bp, Rattus norvegicus
ttggctttctcagcgctaccgaatt

SEQ ID NO: 632492 - DNA, 25 bp, Rattus norvegicus
gcgcgccaggtgaacttttgatttt

SEQ ID NO: 632493 - DNA, 25 bp, Rattus norvegicus
tcggtcactgatctttggctttctc

SEQ ID NO: 632494 - DNA, 25 bp, Rattus norvegicus
caggctgcttttcctcggtcactga

SEQ ID NO: 632495 - DNA, 25 bp, Rattus norvegicus
aagggtatttgagcgagtcgactgc

SEQ ID NO: 632496 - DNA, 25 bp, Rattus norvegicus
cggctcaggtccctcaagggtattt

SEQ ID NO: 632497 - DNA, 25 bp, Rattus norvegicus
gctcctggtctctgcctgcaagtga

SEQ ID NO: 632498 - DNA, 25 bp, Rattus norvegicus
taaacgagcccggaagcttggcgcc

SEQ ID NO: 632499 - DNA, 25 bp, Rattus norvegicus
gaactcagcgggtgcgttctggatc

SEQ ID NO: 632500 - DNA, 25 bp, Rattus norvegicus
gacccggaattgactgaactcagcg

SEQ ID NO: 632501 - DNA, 25 bp, Rattus norvegicus
gcgttctccgccagacccggaattg

SEQ ID NO: 632502 - DNA, 25 bp, Rattus norvegicus
gggagacccgtggtaccactggtca

SEQ ID NO: 632503 - DNA, 25 bp, Rattus norvegicus
tcattttctcgtgaatctgggcagg

SEQ ID NO: 632504 - DNA, 25 bp, Rattus norvegicus
ggccacttagttcccagacttctcg

SEQ ID NO: 632505 - DNA, 25 bp, Rattus norvegicus
ccgcccgccgacatggcgccgtcca

SEQ ID NO: 632506 - DNA, 25 bp, Rattus norvegicus
ccgcgcatgcgtagcggagcccaga

SEQ ID NO: 632507 - DNA, 25 bp, Rattus norvegicus
acacacggaagacccgcccgcaagc

SEQ ID NO: 632508 - DNA, 25 bp, Rattus norvegicus
aacagcgaccgcgacacacggaaga

SEQ ID NO: 632509 - DNA, 25 bp, Rattus norvegicus
aggtagcgcggcagtaacagcgacc

SEQ ID NO: 632510 - DNA, 25 bp, Rattus norvegicus
gccgcaaaggtagcgcggcagtaac

SEQ ID NO: 632511 - DNA, 25 bp, Rattus norvegicus
gctccagagccgcaaaggtagcgcg

SEQ ID NO: 632512 - DNA, 25 bp, Rattus norvegicus
gcgtagctccagagccgcaaaggta

SEQ ID NO: 632513 - DNA, 25 bp, Rattus norvegicus
tcgcgccgccaacgccgacagcgta

SEQ ID NO: 632514 - DNA, 25 bp, Rattus norvegicus
gggaactgctagcaccgaggcgccc

SEQ ID NO: 632515 - DNA, 25 bp, Rattus norvegicus
cccgcgcgaggggaactgctagcac

SEQ ID NO: 632516 - DNA, 25 bp, Rattus norvegicus
gccgactgctgctcaccttggccgc

SEQ ID NO: 632517 - DNA, 25 bp, Rattus norvegicus
gccgtccagggcctcgccgactgct

SEQ ID NO: 632518 - DNA, 25 bp, Rattus norvegicus
cggagcccagagagggcgcagccca

SEQ ID NO: 632519 - DNA, 25 bp, Rattus norvegicus
cacaggccggtttgggaaagttgct

SEQ ID NO: 632520 - DNA, 25 bp, Rattus norvegicus
ctggctcttcttggtaaaccggacg

SEQ ID NO: 632521 - DNA, 25 bp, Rattus norvegicus
tggcttccgccagtttggcttcaca

SEQ ID NO: 632522 - DNA, 25 bp, Rattus norvegicus
ccgccagtttggcttcacagtgggc

SEQ ID NO: 632523 - DNA, 25 bp, Rattus norvegicus
ttggcttcacagtgggcgggaacca

SEQ ID NO: 632524 - DNA, 25 bp, Rattus norvegicus
cacagtgggcgggaaccagtccaca

SEQ ID NO: 632525 - DNA, 25 bp, Rattus norvegicus
gaaagttgctgctggggcgtcaaag

SEQ ID NO: 632526 - DNA, 25 bp, Rattus norvegicus
gtgcatgcgcaatagccacgttttc

SEQ ID NO: 632527 - DNA, 25 bp, Rattus norvegicus
tgcgcaatagccacgttttcctttc

SEQ ID NO: 632528 - DNA, 25 bp, Rattus norvegicus
gcaatagccacgttttcctttcgga

SEQ ID NO: 632529 - DNA, 25 bp, Rattus norvegicus
tcctttcggatttccagctcttgga

SEQ ID NO: 632530 - DNA, 25 bp, Rattus norvegicus
gtggacactggctcttcttggtaaa

SEQ ID NO: 632531 - DNA, 25 bp, Rattus norvegicus
gccgtgtgtgcatgcgcaatagcca

SEQ ID NO: 632532 - DNA, 25 bp, Rattus norvegicus
cactggctcttcttggtaaaccgga

SEQ ID NO: 632533 - DNA, 25 bp, Rattus norvegicus
agccacgactcccagccgcgtcaga

SEQ ID NO: 632534 - DNA, 25 bp, Rattus norvegicus
tcgcttcggcacatggaactggatc

SEQ ID NO: 632535 - DNA, 25 bp, Rattus norvegicus
tggctccgcgttcgcttcggcacat

SEQ ID NO: 632536 - DNA, 25 bp, Rattus norvegicus
tgctgttctgcctgtaccgcacgct

SEQ ID NO: 632537 - DNA, 25 bp, Rattus norvegicus
cgggtgctgcacttgctgttctgcc

SEQ ID NO: 632538 - DNA, 25 bp, Rattus norvegicus
ccacaggagtatgacggggctgtac

SEQ ID NO: 632539 - DNA, 25 bp, Rattus norvegicus
gcaggaaccggcgtcatcaccggca

SEQ ID NO: 632540 - DNA, 25 bp, Rattus norvegicus
acgctctctttagccgtgtcgtggc

SEQ ID NO: 632541 - DNA, 25 bp, Rattus norvegicus
gagactgtgcccgagcgccacagga

SEQ ID NO: 632542 - DNA, 25 bp, Rattus norvegicus
acatggaactggatctggcggcgct

SEQ ID NO: 632543 - DNA, 25 bp, Rattus norvegicus
gaactgtccatgtactagcaggggc

SEQ ID NO: 632544 - DNA, 25 bp, Rattus norvegicus
ttctcaagctcacgctctctttagc

SEQ ID NO: 632545 - DNA, 25 bp, Rattus norvegicus
ctttagccgtgtcgtggcggctcca

SEQ ID NO: 632546 - DNA, 25 bp, Rattus norvegicus
ccgtcggcaggaaccggcgtcatca

SEQ ID NO: 632547 - DNA, 25 bp, Rattus norvegicus
tgagcaaaatctgccgctgcggctt

SEQ ID NO: 632548 - DNA, 25 bp, Rattus norvegicus
cacaacccaaggcaagcgggccggg

SEQ ID NO: 632549 - DNA, 25 bp, Rattus norvegicus
aggctccggggctctgagcaaaatc

SEQ ID NO: 632550 - DNA, 25 bp, Rattus norvegicus
cttaacggctgctcagcgatggccc

SEQ ID NO: 632551 - DNA, 25 bp, Rattus norvegicus
gcggcttaacggctgctcagcgatg

SEQ ID NO: 632552 - DNA, 25 bp, Rattus norvegicus
cacctcggcttctgggcggaaactt

SEQ ID NO: 632553 - DNA, 25 bp, Rattus norvegicus
ttggggcccgcagtcacctcggctt

SEQ ID NO: 632554 - DNA, 25 bp, Rattus norvegicus
tgcggtcgacatcgcagcgaccttc

SEQ ID NO: 632555 - DNA, 25 bp, Rattus norvegicus
acagtcctccttacccgcagggaag

SEQ ID NO: 632556 - DNA, 25 bp, Rattus norvegicus
agggacaacaaagcccggccgagcg

SEQ ID NO: 632557 - DNA, 25 bp, Rattus norvegicus
acgcacaccacacgagggacaacaa

SEQ ID NO: 632558 - DNA, 25 bp, Rattus norvegicus
ccaagtcctcggcagcgtctctgga

SEQ ID NO: 632559 - DNA, 25 bp, Rattus norvegicus
tcctcggcagcgtctctggagcagc

SEQ ID NO: 632560 - DNA, 25 bp, Rattus norvegicus
cggggtctcagacgccgaccaagtc

SEQ ID NO: 632561 - DNA, 25 bp, Rattus norvegicus
gcgaagaggtcggacgagatgtgag

SEQ ID NO: 632562 - DNA, 25 bp, Rattus norvegicus
agagggttcagtcgagactgcttcc

SEQ ID NO: 632563 - DNA, 25 bp, Rattus norvegicus
gagggttcagtcgagactgcttccc

SEQ ID NO: 632564 - DNA, 25 bp, Rattus norvegicus
tcagtcgagactgcttccccggtac

SEQ ID NO: 632565 - DNA, 25 bp, Rattus norvegicus
tacccaggggagataaatgggaaga

SEQ ID NO: 632566 - DNA, 25 bp, Rattus norvegicus
agcagcaggcgaggggcgaagaggt

SEQ ID NO: 632567 - DNA, 25 bp, Rattus norvegicus
ccacttgcctatcccgcccccgagg

SEQ ID NO: 632568 - DNA, 25 bp, Rattus norvegicus
tcggacgagatgtgaggaggtgagg

SEQ ID NO: 632569 - DNA, 25 bp, Rattus norvegicus
gaggtgaggctagatgaggaggaca

SEQ ID NO: 632570 - DNA, 25 bp, Rattus norvegicus
gctagatgaggaggacagaggtcca

SEQ ID NO: 632571 - DNA, 25 bp, Rattus norvegicus
aggaggacagaggtccaggggagaa

SEQ ID NO: 632572 - DNA, 25 bp, Rattus norvegicus
gcctcggcaggtcccggctgccttc

SEQ ID NO: 632573 - DNA, 25 bp, Rattus norvegicus
cggggccgagaagtgagagggttca

SEQ ID NO: 632574 - DNA, 25 bp, Rattus norvegicus
aatgggaagagagaagcagcaggcg

SEQ ID NO: 632575 - DNA, 25 bp, Rattus norvegicus
acacgggcgcgacgaggacccgcat

SEQ ID NO: 632576 - DNA, 25 bp, Rattus norvegicus
cttttggtacccgagcaagtgtggc

SEQ ID NO: 632577 - DNA, 25 bp, Rattus norvegicus
tttggtacccgagcaagtgtggcag

SEQ ID NO: 632578 - DNA, 25 bp, Rattus norvegicus
gtacccgagcaagtgtggcagccta

SEQ ID NO: 632579 - DNA, 25 bp, Rattus norvegicus
ccgagcaagtgtggcagcctatgca

SEQ ID NO: 632580 - DNA, 25 bp, Rattus norvegicus
agcaagtgtggcagcctatgcattc

SEQ ID NO: 632581 - DNA, 25 bp, Rattus norvegicus
gtgtggcagcctatgcattcccaga

SEQ ID NO: 632582 - DNA, 25 bp, Rattus norvegicus
tggcagcctatgcattcccagaacc

SEQ ID NO: 632583 - DNA, 25 bp, Rattus norvegicus
agcctatgcattcccagaaccctgg

SEQ ID NO: 632584 - DNA, 25 bp, Rattus norvegicus
tatgcattcccagaaccctggcgtc

SEQ ID NO: 632585 - DNA, 25 bp, Rattus norvegicus
aaccctggcgtccacccgcgtccag

SEQ ID NO: 632586 - DNA, 25 bp, Rattus norvegicus
cccgcgtccagtccctacaatctcg

SEQ ID NO: 632587 - DNA, 25 bp, Rattus norvegicus
gccggcctctccaccagatgcgccc

SEQ ID NO: 632588 - DNA, 25 bp, Rattus norvegicus
gtccctacaatctcgccggcctctc

SEQ ID NO: 632589 - DNA, 25 bp, Rattus norvegicus
tgcatcgaggacctgtctgaaggtg

SEQ ID NO: 632590 - DNA, 25 bp, Rattus norvegicus
ggagccatcttacccggcggcacga

SEQ ID NO: 632591 - DNA, 25 bp, Rattus norvegicus
ttgtcagctttgtctgcagcgggcg

SEQ ID NO: 632592 - DNA, 25 bp, Rattus norvegicus
agggagccatgttgtcagctttgtc

SEQ ID NO: 632593 - DNA, 25 bp, Rattus norvegicus
acttgcgagcaacttgccgggcgga

SEQ ID NO: 632594 - DNA, 25 bp, Rattus norvegicus
ggccatgcgagggaaacttgaagtt

SEQ ID NO: 632595 - DNA, 25 bp, Rattus norvegicus
gagcgggagcccatcttgctcgccg

SEQ ID NO: 632596 - DNA, 25 bp, Rattus norvegicus
acccgttccagttcgagatcacctt

SEQ ID NO: 632597 - DNA, 25 bp, Rattus norvegicus
aggtggagccgcagtgaaagtttcc

SEQ ID NO: 632598 - DNA, 25 bp, Rattus norvegicus
ctggataacccgtcgcctttctaca

SEQ ID NO: 632599 - DNA, 25 bp, Rattus norvegicus
acaatgtagtggtgctggataaccc

SEQ ID NO: 632600 - DNA, 25 bp, Rattus norvegicus
ataggaaagctgcaaaacactgtgg

SEQ ID NO: 632601 - DNA, 25 bp, Rattus norvegicus
aaatatggcaaaggttcaggtgaac

SEQ ID NO: 632602 - DNA, 25 bp, Rattus norvegicus
cgcgccgcaacttgcgagcaacttg

SEQ ID NO: 632603 - DNA, 25 bp, Rattus norvegicus
tcacttacgggctcaacacgcactg

SEQ ID NO: 632604 - DNA, 25 bp, Rattus norvegicus
aggtggcgccaaaaagagcagtttg

SEQ ID NO: 632605 - DNA, 25 bp, Rattus norvegicus
cgccattcgcgggtgcgcgctcatt

SEQ ID NO: 632606 - DNA, 25 bp, Rattus norvegicus
cggcggagggatgctttccaaatcc

SEQ ID NO: 632607 - DNA, 25 bp, Rattus norvegicus
aaatccgcttctaatccacaggtgg

SEQ ID NO: 632608 - DNA, 25 bp, Rattus norvegicus
ccacaggtggttggctgtggcctcc

SEQ ID NO: 632609 - DNA, 25 bp, Rattus norvegicus
cgagacctgacgctaaccacgggag

SEQ ID NO: 632610 - DNA, 25 bp, Rattus norvegicus
acacgcactgtcttagtcgccgggg

SEQ ID NO: 632611 - DNA, 25 bp, Rattus norvegicus
gggccgcgttgctcccgtagtcaac

SEQ ID NO: 632612 - DNA, 25 bp, Rattus norvegicus
gcgcaggcctcttctagctgctttc

SEQ ID NO: 632613 - DNA, 25 bp, Rattus norvegicus
agctgctttcgtctggcctctgaag

SEQ ID NO: 632614 - DNA, 25 bp, Rattus norvegicus
ctggcctctgaaggacctgtgcttc

SEQ ID NO: 632615 - DNA, 25 bp, Rattus norvegicus
cgggagaaccctggtgacgtattag

SEQ ID NO: 632616 - DNA, 25 bp, Rattus norvegicus
tttagaaaccaaaggatgcgggcga

SEQ ID NO: 632617 - DNA, 25 bp, Rattus norvegicus
tctcgtcggcaaatgcggcggcaga

SEQ ID NO: 632618 - DNA, 25 bp, Rattus norvegicus
gggaaactcatgctgcgcgtagcca

SEQ ID NO: 632619 - DNA, 25 bp, Rattus norvegicus
ccaacagctctcgattgaggggcgg

SEQ ID NO: 632620 - DNA, 25 bp, Rattus norvegicus
gccatcttggaccaacagctctcga

SEQ ID NO: 632621 - DNA, 25 bp, Rattus norvegicus
cacgacgtggttaggaagccagctc

SEQ ID NO: 632622 - DNA, 25 bp, Rattus norvegicus
ttcgcggagtcgcaagaacacgacg

SEQ ID NO: 632623 - DNA, 25 bp, Rattus norvegicus
cttcggctggactctggtttttcag

SEQ ID NO: 632624 - DNA, 25 bp, Rattus norvegicus
gaggccgaagaccaggtttctcgtc

SEQ ID NO: 632625 - DNA, 25 bp, Rattus norvegicus
catgaaggtgaagtcgaagtcgctg

SEQ ID NO: 632626 - DNA, 25 bp, Rattus norvegicus
accaggtttctcgtcggcaaatgcg

SEQ ID NO: 632627 - DNA, 25 bp, Rattus norvegicus
cgtagccaatccgtggccagcattc

SEQ ID NO: 632628 - DNA, 25 bp, Rattus norvegicus
tggtttttcagaccttcgcggagtc

SEQ ID NO: 632629 - DNA, 25 bp, Rattus norvegicus
aagtcgaagtcgctggtttatccgc

SEQ ID NO: 632630 - DNA, 25 bp, Rattus norvegicus
tggtttatccgcttcggctggactc

SEQ ID NO: 632631 - DNA, 25 bp, Rattus norvegicus
tcagtagcatcgtgaagtacagagc

SEQ ID NO: 632632 - DNA, 25 bp, Rattus norvegicus
gccgccttgaatactaagaacgcca

SEQ ID NO: 632633 - DNA, 25 bp, Rattus norvegicus
ctggagtgctaatcagaggcagagc

SEQ ID NO: 632634 - DNA, 25 bp, Rattus norvegicus
gtgcgcgccgccttgaatactaaga

SEQ ID NO: 632635 - DNA, 25 bp, Rattus norvegicus
aggcagagccaagtgcgagcttcgc

SEQ ID NO: 632636 - DNA, 25 bp, Rattus norvegicus
ctggggcttggatactcgatctttc

SEQ ID NO: 632637 - DNA, 25 bp, Rattus norvegicus
cgtgaagtacagagctggagtgcta

SEQ ID NO: 632638 - DNA, 25 bp, Rattus norvegicus
ctttccggatgagacgctcaggttc

SEQ ID NO: 632639 - DNA, 25 bp, Rattus norvegicus
acgctcaggttcagtagcatcgtga

SEQ ID NO: 632640 - DNA, 25 bp, Rattus norvegicus
taagaacgccaaaaaacacagagac

SEQ ID NO: 632641 - DNA, 25 bp, Rattus norvegicus
ttagtatgcacgactttccggatga

SEQ ID NO: 632642 - DNA, 25 bp, Rattus norvegicus
tcccgagacgggtattagtatgcac

SEQ ID NO: 632643 - DNA, 25 bp, Rattus norvegicus
ggatactcgatctttcaaaccctta

SEQ ID NO: 632644 - DNA, 25 bp, Rattus norvegicus
agcttcgcatctcgctgcctgtgtg

SEQ ID NO: 632645 - DNA, 25 bp, Rattus norvegicus
tcctttggcaaacaggcacgcgcgg

SEQ ID NO: 632646 - DNA, 25 bp, Rattus norvegicus
tgccaacaaaccaggcaacgtgctg

SEQ ID NO: 632647 - DNA, 25 bp, Rattus norvegicus
cgacctgccggcgtgtgccaacaaa

SEQ ID NO: 632648 - DNA, 25 bp, Rattus norvegicus
cccgggacacgactcaggtgagcga

SEQ ID NO: 632649 - DNA, 25 bp, Rattus norvegicus
ggggctcgtcaacttctccagctgc

SEQ ID NO: 632650 - DNA, 25 bp, Rattus norvegicus
tcccgcgcacatctgggtcaggacg

SEQ ID NO: 632651 - DNA, 25 bp, Rattus norvegicus
gtgaagttttccagcctcggaggca

SEQ ID NO: 632652 - DNA, 25 bp, Rattus norvegicus
cctcggagcccactttggacttggg

SEQ ID NO: 632653 - DNA, 25 bp, Rattus norvegicus
gctgagaaagtttccagtgggtccc

SEQ ID NO: 632654 - DNA, 25 bp, Rattus norvegicus
agtttacgggaagagcagcctctcc

SEQ ID NO: 632655 - DNA, 25 bp, Rattus norvegicus
tgacagtctgtccaagcgtccggcg

SEQ ID NO: 632656 - DNA, 25 bp, Rattus norvegicus
catggctccggagattgcagccgca

SEQ ID NO: 632657 - DNA, 25 bp, Rattus norvegicus
tgcactaatagcactgccggtctcc

SEQ ID NO: 632658 - DNA, 25 bp, Rattus norvegicus
ccgcaggacagtatcccggcaggca

SEQ ID NO: 632659 - DNA, 25 bp, Rattus norvegicus
ccacacttggctgcgctcctaagga

SEQ ID NO: 632660 - DNA, 25 bp, Rattus norvegicus
ttgccagaccaatgtgggcgccatc

SEQ ID NO: 632661 - DNA, 25 bp, Rattus norvegicus
ccaccgaggaacgagcgagcgatgc

SEQ ID NO: 632662 - DNA, 25 bp, Rattus norvegicus
aggcccagtacgaaatggtcacttc

SEQ ID NO: 632663 - DNA, 25 bp, Rattus norvegicus
tgtaccctcaggaacaggcccagta

SEQ ID NO: 632664 - DNA, 25 bp, Rattus norvegicus
tacgtgcgccacttctcggcaagcg

SEQ ID NO: 632665 - DNA, 25 bp, Rattus norvegicus
ccttgagtgctacgtgcgccacttc

SEQ ID NO: 632666 - DNA, 25 bp, Rattus norvegicus
tgttactacatcaaccgcaggcggc

SEQ ID NO: 632667 - DNA, 25 bp, Rattus norvegicus
ggctggcggacgactgttactacat

SEQ ID NO: 632668 - DNA, 25 bp, Rattus norvegicus
atcccggaagtgctccagcagcggc

SEQ ID NO: 632669 - DNA, 25 bp, Rattus norvegicus
cacacgagacgggaagcggacgaac

SEQ ID NO: 632670 - DNA, 25 bp, Rattus norvegicus
ctcctaaggatgacggcgagggtaa

SEQ ID NO: 632671 - DNA, 25 bp, Rattus norvegicus
cggtgacgaccatggccacacttgg

SEQ ID NO: 632672 - DNA, 25 bp, Rattus norvegicus
agtgatcgaggcgatggcgacccaa

SEQ ID NO: 632673 - DNA, 25 bp, Rattus norvegicus
taggaaaccacagctagcgcctggg

SEQ ID NO: 632674 - DNA, 25 bp, Rattus norvegicus
ggaactacagacacctcaggatcta

SEQ ID NO: 632675 - DNA, 25 bp, Rattus norvegicus
atacgtgcagaactcaggcggaccc

SEQ ID NO: 632676 - DNA, 25 bp, Rattus norvegicus
cgttcgtccatacgtgcagaactca

SEQ ID NO: 632677 - DNA, 25 bp, Rattus norvegicus
gcgttgtgctggaagacccggctct

SEQ ID NO: 632678 - DNA, 25 bp, Rattus norvegicus
gtcgttccctaggaaaccacagcta

SEQ ID NO: 632679 - DNA, 25 bp, Rattus norvegicus
acgcgcagcgtcgttccctaggaaa

SEQ ID NO: 632680 - DNA, 25 bp, Rattus norvegicus
gggtcgccaccaacatagcgcactg

SEQ ID NO: 632681 - DNA, 25 bp, Rattus norvegicus
tcaaatctctgcaacctccacgggg

SEQ ID NO: 632682 - DNA, 25 bp, Rattus norvegicus
catgctgggcggcagtcaaatctct

SEQ ID NO: 632683 - DNA, 25 bp, Rattus norvegicus
tcctcgccggagaaatgggccatgc

SEQ ID NO: 632684 - DNA, 25 bp, Rattus norvegicus
ggagcatcgcctgcagcatcacttc

SEQ ID NO: 632685 - DNA, 25 bp, Rattus norvegicus
aacagctgccggagcatcgcctgca

SEQ ID NO: 632686 - DNA, 25 bp, Rattus norvegicus
gcgttagctgcttgacgttcgtcca

SEQ ID NO: 632687 - DNA, 25 bp, Rattus norvegicus
ctcagacctggatccggtggctgct

SEQ ID NO: 632688 - DNA, 25 bp, Rattus norvegicus
cgagccgacaagatggagacagctt

SEQ ID NO: 632689 - DNA, 25 bp, Rattus norvegicus
tgcgcagtgcatttgcccggaggaa

SEQ ID NO: 632690 - DNA, 25 bp, Rattus norvegicus
gcgtcacttccgctcagacctggat

SEQ ID NO: 632691 - DNA, 25 bp, Rattus norvegicus
cggtatcggggtgacagcaagaacc

SEQ ID NO: 632692 - DNA, 25 bp, Rattus norvegicus
tactgtctggcaggcacttccgacg

SEQ ID NO: 632693 - DNA, 25 bp, Rattus norvegicus
gacagcttcttccttgctttttcga

SEQ ID NO: 632694 - DNA, 25 bp, Rattus norvegicus
ccgcgaagtggagccgcacagaccg

SEQ ID NO: 632695 - DNA, 25 bp, Rattus norvegicus
ctcagtagactccagccgcgaagtg

SEQ ID NO: 632696 - DNA, 25 bp, Rattus norvegicus
gaaagccattgctcgggcgacgccc

SEQ ID NO: 632697 - DNA, 25 bp, Rattus norvegicus
ctcacaccagaaggaaagccattgc

SEQ ID NO: 632698 - DNA, 25 bp, Rattus norvegicus
ggcgacagccgaggctcacaccaga

SEQ ID NO: 632699 - DNA, 25 bp, Rattus norvegicus
tgacagcaagaaccgcgatacccgc

SEQ ID NO: 632700 - DNA, 25 bp, Rattus norvegicus
tttcgaggcttatttactgtctggc

SEQ ID NO: 632701 - DNA, 25 bp, Rattus norvegicus
cagcccagccgcatctcagagaagg

SEQ ID NO: 632702 - DNA, 25 bp, Rattus norvegicus
tctagcgcgcagctggtaagtaccg

SEQ ID NO: 632703 - DNA, 25 bp, Rattus norvegicus
ctagcgcgcagctggtaagtaccgg

SEQ ID NO: 632704 - DNA, 25 bp, Rattus norvegicus
ctcgcagccaccggctcagcccagc

SEQ ID NO: 632705 - DNA, 25 bp, Rattus norvegicus
gcgccgcaagcgtctctagcgcgca

SEQ ID NO: 632706 - DNA, 25 bp, Rattus norvegicus
gcccggcgccgcaagcgtctctagc

SEQ ID NO: 632707 - DNA, 25 bp, Rattus norvegicus
caccgcgagggacctggcccggcgc

SEQ ID NO: 632708 - DNA, 25 bp, Rattus norvegicus
agaggccggtggcaggcggcaccgc

SEQ ID NO: 632709 - DNA, 25 bp, Rattus norvegicus
gcgcgcagctggtaagtaccgggcg

SEQ ID NO: 632710 - DNA, 25 bp, Rattus norvegicus
agcccagccgcatctcagagaaggg

SEQ ID NO: 632711 - DNA, 25 bp, Rattus norvegicus
tcagcccagccgcatctcagagaag

SEQ ID NO: 632712 - DNA, 25 bp, Rattus norvegicus
gaaggggcggcagcgagctcccgcc

SEQ ID NO: 632713 - DNA, 25 bp, Rattus norvegicus
ccgcgtcgcagctcggtgccgcaga

SEQ ID NO: 632714 - DNA, 25 bp, Rattus norvegicus
agctcggtgccgcagagaggccggt

SEQ ID NO: 632715 - DNA, 25 bp, Rattus norvegicus
accactcggcgctccatggtgggtc

SEQ ID NO: 632716 - DNA, 25 bp, Rattus norvegicus
ctccacggagcaccttcccgctagg

SEQ ID NO: 632717 - DNA, 25 bp, Rattus norvegicus
gcgggcaaaacgtcaccaccgctga

SEQ ID NO: 632718 - DNA, 25 bp, Rattus norvegicus
tcccgctaggccgtagcggcttttg

SEQ ID NO: 632719 - DNA, 25 bp, Rattus norvegicus
acggccgcgtcagccgcgggcaaaa

SEQ ID NO: 632720 - DNA, 25 bp, Rattus norvegicus
gtggcttgaccactcggcgctccat

SEQ ID NO: 632721 - DNA, 25 bp, Rattus norvegicus
ttttgagccgctccactaccatatc

SEQ ID NO: 632722 - DNA, 25 bp, Rattus norvegicus
tagcggcttttgagccgctccacta

SEQ ID NO: 632723 - DNA, 25 bp, Rattus norvegicus
gcccaccacggcttccacccatctc

SEQ ID NO: 632724 - DNA, 25 bp, Rattus norvegicus
agctacctgtaggaagggcccgcgt

SEQ ID NO: 632725 - DNA, 25 bp, Rattus norvegicus
ctctctggtgagctacctgtaggaa

SEQ ID NO: 632726 - DNA, 25 bp, Rattus norvegicus
ggcgctctctggtgagctacctgta

SEQ ID NO: 632727 - DNA, 25 bp, Rattus norvegicus
cttctcggcggtttccctgagggag

SEQ ID NO: 632728 - DNA, 25 bp, Rattus norvegicus
gtcagccgcgggcaaaacgtcacca

SEQ ID NO: 632729 - DNA, 25 bp, Rattus norvegicus
ctccaggaggtgagcgccgaacacc

SEQ ID NO: 632730 - DNA, 25 bp, Rattus norvegicus
tgcctgctggacgtgtctcgcagag

SEQ ID NO: 632731 - DNA, 25 bp, Rattus norvegicus
agctatcccagagaccgaaggtgcc

SEQ ID NO: 632732 - DNA, 25 bp, Rattus norvegicus
cgcgacagggcctagctatcccaga

SEQ ID NO: 632733 - DNA, 25 bp, Rattus norvegicus
cgcgcccttacgaatgtggctgctc

SEQ ID NO: 632734 - DNA, 25 bp, Rattus norvegicus
tgtcatttgtgctgacgcgccctta

SEQ ID NO: 632735 - DNA, 25 bp, Rattus norvegicus
tgcccttgagaccacgtgaccatgt

SEQ ID NO: 632736 - DNA, 25 bp, Rattus norvegicus
tgccagcctggccagacttgcttac

SEQ ID NO: 632737 - DNA, 25 bp, Rattus norvegicus
aagagcaaacgttggcggccgcagt

SEQ ID NO: 632738 - DNA, 25 bp, Rattus norvegicus
cagtgcgtgcgacgtgcgtcatcac

SEQ ID NO: 632739 - DNA, 25 bp, Rattus norvegicus
cgtcatcactgtgcgcctcgttgca

SEQ ID NO: 632740 - DNA, 25 bp, Rattus norvegicus
ctcgttgcagtctgacgcgcctgct

SEQ ID NO: 632741 - DNA, 25 bp, Rattus norvegicus
agccctgcaccgaggcgatgtaccg

SEQ ID NO: 632742 - DNA, 25 bp, Rattus norvegicus
ccgcggaccgccatgaagagcaaac

SEQ ID NO: 632743 - DNA, 25 bp, Rattus norvegicus
agtgctccaataggccgacccgggg

SEQ ID NO: 632744 - DNA, 25 bp, Rattus norvegicus
tgctccaataggccgacccggggcg

SEQ ID NO: 632745 - DNA, 25 bp, Rattus norvegicus
agaccccagtgctccaataggccga

SEQ ID NO: 632746 - DNA, 25 bp, Rattus norvegicus
tgtctcctgagaccttcacccgctt

SEQ ID NO: 632747 - DNA, 25 bp, Rattus norvegicus
gtctcctgagaccttcacccgcttc

SEQ ID NO: 632748 - DNA, 25 bp, Rattus norvegicus
tcctgagaccttcacccgcttcctt

SEQ ID NO: 632749 - DNA, 25 bp, Rattus norvegicus
ctgagaccttcacccgcttccttcc

SEQ ID NO: 632750 - DNA, 25 bp, Rattus norvegicus
agagaagcggggtgtccagacccca

SEQ ID NO: 632751 - DNA, 25 bp, Rattus norvegicus
tagagaagcggggtgtccagacccc

SEQ ID NO: 632752 - DNA, 25 bp, Rattus norvegicus
ccttccttgcagccctagagaagcg

SEQ ID NO: 632753 - DNA, 25 bp, Rattus norvegicus
ttcacccgcttccttccttgcagcc

SEQ ID NO: 632754 - DNA, 25 bp, Rattus norvegicus
ccttcacccgcttccttccttgcag

SEQ ID NO: 632755 - DNA, 25 bp, Rattus norvegicus
gaccttcacccgcttccttccttgc

SEQ ID NO: 632756 - DNA, 25 bp, Rattus norvegicus
cagtgctccaataggccgacccggg

SEQ ID NO: 632757 - DNA, 25 bp, Rattus norvegicus
gcggcgaccgctttgtctacggaca

SEQ ID NO: 632758 - DNA, 25 bp, Rattus norvegicus
ggcggggcttcgctgccctccttcc

SEQ ID NO: 632759 - DNA, 25 bp, Rattus norvegicus
cggcgaccgctttgtctacggacaa

SEQ ID NO: 632760 - DNA, 25 bp, Rattus norvegicus
cgaccgctttgtctacggacaatgg

SEQ ID NO: 632761 - DNA, 25 bp, Rattus norvegicus
ccgctttgtctacggacaatggggc

SEQ ID NO: 632762 - DNA, 25 bp, Rattus norvegicus
ctttgtctacggacaatggggcgaa

SEQ ID NO: 632763 - DNA, 25 bp, Rattus norvegicus
tctacggacaatggggcgaaggaag

SEQ ID NO: 632764 - DNA, 25 bp, Rattus norvegicus
ctccttcccgcgtgggactctggtg

SEQ ID NO: 632765 - DNA, 25 bp, Rattus norvegicus
gactctggtgggacttctctcccgc

SEQ ID NO: 632766 - DNA, 25 bp, Rattus norvegicus
ctggtgggacttctctcccgccgta

SEQ ID NO: 632767 - DNA, 25 bp, Rattus norvegicus
tgggacttctctcccgccgtagcaa

SEQ ID NO: 632768 - DNA, 25 bp, Rattus norvegicus
ctttttctcggttgtctgtctcctg

SEQ ID NO: 632769 - DNA, 25 bp, Rattus norvegicus
tttctcggttgtctgtctcctgaga

SEQ ID NO: 632770 - DNA, 25 bp, Rattus norvegicus
ctcggttgtctgtctcctgagacct

SEQ ID NO: 632771 - DNA, 25 bp, Rattus norvegicus
acgccgggtcagtctgtgcctcagt

SEQ ID NO: 632772 - DNA, 25 bp, Rattus norvegicus
cctctcccgcctccggctagggcgg

SEQ ID NO: 632773 - DNA, 25 bp, Rattus norvegicus
cgcgcgcccgtacctgttggtcatt

SEQ ID NO: 632774 - DNA, 25 bp, Rattus norvegicus
tacctgttggtcattccggccgcca

SEQ ID NO: 632775 - DNA, 25 bp, Rattus norvegicus
agcatctccgcggtccacgccgggt

SEQ ID NO: 632776 - DNA, 25 bp, Rattus norvegicus
cctcttccctcgctgcggcggcgag

SEQ ID NO: 632777 - DNA, 25 bp, Rattus norvegicus
cggcagatttgagggccggtcctag

SEQ ID NO: 632778 - DNA, 25 bp, Rattus norvegicus
ggcccgcggccactagcctgtagtg

SEQ ID NO: 632779 - DNA, 25 bp, Rattus norvegicus
actagcctgtagtggcccgcaaatg

SEQ ID NO: 632780 - DNA, 25 bp, Rattus norvegicus
tggcccgcaaatggcggcgttgacc

SEQ ID NO: 632781 - DNA, 25 bp, Rattus norvegicus
gcaaatggcggcgttgaccacgccc

SEQ ID NO: 632782 - DNA, 25 bp, Rattus norvegicus
tgggaggcgtggctaaggacctcca

SEQ ID NO: 632783 - DNA, 25 bp, Rattus norvegicus
gcgaaattttgagagggcgtgggac

SEQ ID NO: 632784 - DNA, 25 bp, Rattus norvegicus
attccggccgccacgcccagcatct

SEQ ID NO: 632785 - DNA, 25 bp, Rattus norvegicus
tgcctttgtctggtttctgccttca

SEQ ID NO: 632786 - DNA, 25 bp, Rattus norvegicus
gtcacggtaccctactcttcacgta

SEQ ID NO: 632787 - DNA, 25 bp, Rattus norvegicus
gcaacttagtcaccgctgggcctgg

SEQ ID NO: 632788 - DNA, 25 bp, Rattus norvegicus
ccgtcacaccgactggaatgtcatg

SEQ ID NO: 632789 - DNA, 25 bp, Rattus norvegicus
ctggaatgtcatggcccgctaccta

SEQ ID NO: 632790 - DNA, 25 bp, Rattus norvegicus
cgctacctacctgcacccgaggcta

SEQ ID NO: 632791 - DNA, 25 bp, Rattus norvegicus
ggtaccctactcttcacgtagcttc

SEQ ID NO: 632792 - DNA, 25 bp, Rattus norvegicus
caggtagctcagtcacggtacccta

SEQ ID NO: 632793 - DNA, 25 bp, Rattus norvegicus
cagcccagagcaggtagctcagtca

SEQ ID NO: 632794 - DNA, 25 bp, Rattus norvegicus
ggtcactgaacagcccagagcaggt

SEQ ID NO: 632795 - DNA, 25 bp, Rattus norvegicus
ggccgcgaggtcactgaacagccca

SEQ ID NO: 632796 - DNA, 25 bp, Rattus norvegicus
tctgccttcaggtcgcaaagattta

SEQ ID NO: 632797 - DNA, 25 bp, Rattus norvegicus
cacccggcctgcctttgtctggttt

SEQ ID NO: 632798 - DNA, 25 bp, Rattus norvegicus
caaagatttatctgcgggccgcgag

SEQ ID NO: 632799 - DNA, 25 bp, Rattus norvegicus
cgcgggctgcagtaaatgccgaagc

SEQ ID NO: 632800 - DNA, 25 bp, Rattus norvegicus
cgagaaggggaacctgcgatcatga

SEQ ID NO: 632801 - DNA, 25 bp, Rattus norvegicus
ctgcgatcatgagggccagttccga

SEQ ID NO: 632802 - DNA, 25 bp, Rattus norvegicus
gccagttccgagctggatcgccgca

SEQ ID NO: 632803 - DNA, 25 bp, Rattus norvegicus
tggatcgccgcattccgactagggt

SEQ ID NO: 632804 - DNA, 25 bp, Rattus norvegicus
ttccgactagggtgcgtgaacctta

SEQ ID NO: 632805 - DNA, 25 bp, Rattus norvegicus
cgtacgctgagcaaaccgaagggcc

SEQ ID NO: 632806 - DNA, 25 bp, Rattus norvegicus
cacgcagcgcagcagagggagcatc

SEQ ID NO: 632807 - DNA, 25 bp, Rattus norvegicus
gacacgtgcaaagggaaggacgacc

SEQ ID NO: 632808 - DNA, 25 bp, Rattus norvegicus
acgaccgggccaagacaccgtgtga

SEQ ID NO: 632809 - DNA, 25 bp, Rattus norvegicus
aagacaccgtgtgacctcgcgagcc

SEQ ID NO: 632810 - DNA, 25 bp, Rattus norvegicus
cccgggaagcgctatccacgtcgga

SEQ ID NO: 632811 - DNA, 25 bp, Rattus norvegicus
atccacgtcggaggactgcagtacc

SEQ ID NO: 632812 - DNA, 25 bp, Rattus norvegicus
gtgaaccttaccttccgtgtgcaga

SEQ ID NO: 632813 - DNA, 25 bp, Rattus norvegicus
gagccagcaccaagttcaaagtcga

SEQ ID NO: 632814 - DNA, 25 bp, Rattus norvegicus
aaggctacgcagagcggcacttccg

SEQ ID NO: 632815 - DNA, 25 bp, Rattus norvegicus
gtctccaaggctacgcagagcggca

SEQ ID NO: 632816 - DNA, 25 bp, Rattus norvegicus
aggtcttgcaacgaggcgactacgc

SEQ ID NO: 632817 - DNA, 25 bp, Rattus norvegicus
gcgcgggtcaaaggtcttgcaacga

SEQ ID NO: 632818 - DNA, 25 bp, Rattus norvegicus
cgtcctaggtactccgcctctgagg

SEQ ID NO: 632819 - DNA, 25 bp, Rattus norvegicus
gccttttcaggcgtcctaggtactc

SEQ ID NO: 632820 - DNA, 25 bp, Rattus norvegicus
acctcggccttttcaggcgtcctag

SEQ ID NO: 632821 - DNA, 25 bp, Rattus norvegicus
accgttacctccatcgtggcagcga

SEQ ID NO: 632822 - DNA, 25 bp, Rattus norvegicus
agaggcgcgatacccaccgttacct

SEQ ID NO: 632823 - DNA, 25 bp, Rattus norvegicus
tcccactcctcgagaggcacggagg

SEQ ID NO: 632824 - DNA, 25 bp, Rattus norvegicus
caagttcaaagtcgagcgccgcagc

SEQ ID NO: 632825 - DNA, 25 bp, Rattus norvegicus
gtcgccgtagcaagagccagcacca

SEQ ID NO: 632826 - DNA, 25 bp, Rattus norvegicus
ggacagggtgcaggccgtaccctcc

SEQ ID NO: 632827 - DNA, 25 bp, Rattus norvegicus
ctgggtctcgctagaggaatttttc

SEQ ID NO: 632828 - DNA, 25 bp, Rattus norvegicus
acgaatggcccggactggacggact

SEQ ID NO: 632829 - DNA, 25 bp, Rattus norvegicus
tgatctcctatctgggtgcccagcc

SEQ ID NO: 632830 - DNA, 25 bp, Rattus norvegicus
tggctcggtgatctcctatctgggt

SEQ ID NO: 632831 - DNA, 25 bp, Rattus norvegicus
gatttcccggcggactgagcatccc

SEQ ID NO: 632832 - DNA, 25 bp, Rattus norvegicus
ctgcgcgtcgatttcccggcggact

SEQ ID NO: 632833 - DNA, 25 bp, Rattus norvegicus
ctcgatgggtcttcaccggaccggt

SEQ ID NO: 632834 - DNA, 25 bp, Rattus norvegicus
ttttcctcccgagactcgatgggtc

SEQ ID NO: 632835 - DNA, 25 bp, Rattus norvegicus
tctggggcagccgaggaaagctcca

SEQ ID NO: 632836 - DNA, 25 bp, Rattus norvegicus
aaagctccagcggaggtcctgatca

SEQ ID NO: 632837 - DNA, 25 bp, Rattus norvegicus
cgcgcgcgctaaggaacggactcca

SEQ ID NO: 632838 - DNA, 25 bp, Rattus norvegicus
gcacggagtttaggaacgaatggcc

SEQ ID NO: 632839 - DNA, 25 bp, Rattus norvegicus
cggactccaggggtccggagctcct

SEQ ID NO: 632840 - DNA, 25 bp, Rattus norvegicus
cccaaactgcagcacggagtttagg

SEQ ID NO: 632841 - DNA, 25 bp, Rattus norvegicus
cgcgtaaccgcaaccatccgagatt

SEQ ID NO: 632842 - DNA, 25 bp, Rattus norvegicus
caaagcgggccacgatgacagatta

SEQ ID NO: 632843 - DNA, 25 bp, Rattus norvegicus
cccgctcggcttacaagaatctgca

SEQ ID NO: 632844 - DNA, 25 bp, Rattus norvegicus
ctcggcggaggccatgaaattgatc

SEQ ID NO: 632845 - DNA, 25 bp, Rattus norvegicus
ttggaggctctggagtccatctacc

SEQ ID NO: 632846 - DNA, 25 bp, Rattus norvegicus
accaccagggtgtagcgctgatgca

SEQ ID NO: 632847 - DNA, 25 bp, Rattus norvegicus
tatttttcagcaagcctagccaggc

SEQ ID NO: 632848 - DNA, 25 bp, Rattus norvegicus
agcaggccctagctgtccatacgga

SEQ ID NO: 632849 - DNA, 25 bp, Rattus norvegicus
tttagaagcccgcaatacccgtagc

SEQ ID NO: 632850 - DNA, 25 bp, Rattus norvegicus
tcgtcgagcgcagaatgaagatgcc

SEQ ID NO: 632851 - DNA, 25 bp, Rattus norvegicus
tgtgccagacccagaccagactcgt

SEQ ID NO: 632852 - DNA, 25 bp, Rattus norvegicus
tccggtgcccacaagctgttcaagg

SEQ ID NO: 632853 - DNA, 25 bp, Rattus norvegicus
gcggccattgaatgtcccaagattc

SEQ ID NO: 632854 - DNA, 25 bp, Rattus norvegicus
cccgactccttcacaggtgactttg

SEQ ID NO: 632855 - DNA, 25 bp, Rattus norvegicus
cacggaagccaatcctcgctgagga

SEQ ID NO: 632856 - DNA, 25 bp, Rattus norvegicus
gcggcctctgcgatgctgacactat

SEQ ID NO: 632857 - DNA, 25 bp, Rattus norvegicus
cgtgaagattgaacgggccaccgtc

SEQ ID NO: 632858 - DNA, 25 bp, Rattus norvegicus
cccgggcccacgacgtgaagattga

SEQ ID NO: 632859 - DNA, 25 bp, Rattus norvegicus
cgaaagatgcggagaaggccctaga

SEQ ID NO: 632860 - DNA, 25 bp, Rattus norvegicus
agagactccgcctgttgtcgagggc

SEQ ID NO: 632861 - DNA, 25 bp, Rattus norvegicus
ccgcagctaggcaaggagagactcc

SEQ ID NO: 632862 - DNA, 25 bp, Rattus norvegicus
aaactgaggtctgtgcgaccggacc

SEQ ID NO: 632863 - DNA, 25 bp, Rattus norvegicus
tggaccctgagggtttgtaaactga

SEQ ID NO: 632864 - DNA, 25 bp, Rattus norvegicus
aaccaatcaggtgcgctgccggctc

SEQ ID NO: 632865 - DNA, 25 bp, Rattus norvegicus
ccgctacgtttacagaagccaaaca

SEQ ID NO: 632866 - DNA, 25 bp, Rattus norvegicus
cgtgacaatcgcaaaccgctacgtt

SEQ ID NO: 632867 - DNA, 25 bp, Rattus norvegicus
gatgcgggagacgtttccaaaagcc

SEQ ID NO: 632868 - DNA, 25 bp, Rattus norvegicus
cgtcaccgccctagaaacagcgagg

SEQ ID NO: 632869 - DNA, 25 bp, Rattus norvegicus
cagccgctcagcgaggaaactgaca

SEQ ID NO: 632870 - DNA, 25 bp, Rattus norvegicus
gggaacaacgagctccctctcgcta

SEQ ID NO: 632871 - DNA, 25 bp, Rattus norvegicus
ctgagaatggctgtgctgccgcagc

SEQ ID NO: 632872 - DNA, 25 bp, Rattus norvegicus
cctccgagtggctgagaatggctgt

SEQ ID NO: 632873 - DNA, 25 bp, Rattus norvegicus
agctctgcctccgagtggctgagaa

SEQ ID NO: 632874 - DNA, 25 bp, Rattus norvegicus
aaactgacacggtgcgggagatgga

SEQ ID NO: 632875 - DNA, 25 bp, Rattus norvegicus
ctcagcgaggaaactgacacggtgc

SEQ ID NO: 632876 - DNA, 25 bp, Rattus norvegicus
ggatctgaagcaagaccagccgctc

SEQ ID NO: 632877 - DNA, 25 bp, Rattus norvegicus
cccggaagatctggatctgaagcaa

SEQ ID NO: 632878 - DNA, 25 bp, Rattus norvegicus
cttgtcccggaagatctggatctga

SEQ ID NO: 632879 - DNA, 25 bp, Rattus norvegicus
gctaacacctcgacctccgcccttg

SEQ ID NO: 632880 - DNA, 25 bp, Rattus norvegicus
gcgtggaagggaacaacgagctccc

SEQ ID NO: 632881 - DNA, 25 bp, Rattus norvegicus
tgaagcaagaccagccgctcagcga

SEQ ID NO: 632882 - DNA, 25 bp, Rattus norvegicus
gcccttgtcccggaagatctggatc

SEQ ID NO: 632883 - DNA, 25 bp, Rattus norvegicus
cgagcagaagttgccaagacccgac

SEQ ID NO: 632884 - DNA, 25 bp, Rattus norvegicus
ttgccaagacccgacaagcgacact

SEQ ID NO: 632885 - DNA, 25 bp, Rattus norvegicus
acaagcgacactcgcagccaggatg

SEQ ID NO: 632886 - DNA, 25 bp, Rattus norvegicus
gtatccagaccggaaggccggtaga

SEQ ID NO: 632887 - DNA, 25 bp, Rattus norvegicus
tattggacccttgcgacagaagggc

SEQ ID NO: 632888 - DNA, 25 bp, Rattus norvegicus
ctctcggacaggttgtagcggcaca

SEQ ID NO: 632889 - DNA, 25 bp, Rattus norvegicus
cggggcttattggacccttgcgaca

SEQ ID NO: 632890 - DNA, 25 bp, Rattus norvegicus
ccattgaagagcagtggcgggtatc

SEQ ID NO: 632891 - DNA, 25 bp, Rattus norvegicus
gggagaaatgctgagccattgaaga

SEQ ID NO: 632892 - DNA, 25 bp, Rattus norvegicus
acagcgtgtggtcgagatcgaagcc

SEQ ID NO: 632893 - DNA, 25 bp, Rattus norvegicus
cgggacctacggacactctgcgcag

SEQ ID NO: 632894 - DNA, 25 bp, Rattus norvegicus
gacactctgcgcagccgcctttaga

SEQ ID NO: 632895 - DNA, 25 bp, Rattus norvegicus
tcaccgcggcgctctcggacaggtt

SEQ ID NO: 632896 - DNA, 25 bp, Rattus norvegicus
agatcgaagccgaccacgtcgcagg

SEQ ID NO: 632897 - DNA, 25 bp, Rattus norvegicus
agagatcctcttagacacacacgcg

SEQ ID NO: 632898 - DNA, 25 bp, Rattus norvegicus
tcctagggaagtgcgcgaaacgctc

SEQ ID NO: 632899 - DNA, 25 bp, Rattus norvegicus
ggtccctcccgcgagccgaagtgat

SEQ ID NO: 632900 - DNA, 25 bp, Rattus norvegicus
agggaagatctctgccgcgctgact

SEQ ID NO: 632901 - DNA, 25 bp, Rattus norvegicus
ttgaaggcatctcaaaggaccgagc

SEQ ID NO: 632902 - DNA, 25 bp, Rattus norvegicus
ccgcgctgactgttgctcttttgaa

SEQ ID NO: 632903 - DNA, 25 bp, Rattus norvegicus
ctataaccgcggacgccagaggctc

SEQ ID NO: 632904 - DNA, 25 bp, Rattus norvegicus
cgggctactgtgctgcttgtttgct

SEQ ID NO: 632905 - DNA, 25 bp, Rattus norvegicus
ctagccgagcatcccaaactactgg

SEQ ID NO: 632906 - DNA, 25 bp, Rattus norvegicus
ctactggacaactgccactgcgatc

SEQ ID NO: 632907 - DNA, 25 bp, Rattus norvegicus
tgccactgcgatcgcgggaaccact

SEQ ID NO: 632908 - DNA, 25 bp, Rattus norvegicus
gcgactggtctaggctttccgagcc

SEQ ID NO: 632909 - DNA, 25 bp, Rattus norvegicus
cccaggctgtcaccattagggacaa

SEQ ID NO: 632910 - DNA, 25 bp, Rattus norvegicus
ggaccgagcttcctgacactataac

SEQ ID NO: 632911 - DNA, 25 bp, Rattus norvegicus
tctgtgtagccgtccctccttggct

SEQ ID NO: 632912 - DNA, 25 bp, Rattus norvegicus
tgcatgccaccctccttagccgcga

SEQ ID NO: 632913 - DNA, 25 bp, Rattus norvegicus
atgccaccctccttagccgcgataa

SEQ ID NO: 632914 - DNA, 25 bp, Rattus norvegicus
ccaccctccttagccgcgataatcc

SEQ ID NO: 632915 - DNA, 25 bp, Rattus norvegicus
tccctccttggctctgcatgccacc

SEQ ID NO: 632916 - DNA, 25 bp, Rattus norvegicus
ggaagatttcgtgaaggccgcttca

SEQ ID NO: 632917 - DNA, 25 bp, Rattus norvegicus
gggaagatttcgtgaaggccgcttc

SEQ ID NO: 632918 - DNA, 25 bp, Rattus norvegicus
cgggaagatttcgtgaaggccgctt

SEQ ID NO: 632919 - DNA, 25 bp, Rattus norvegicus
tcgggaagatttcgtgaaggccgct

SEQ ID NO: 632920 - DNA, 25 bp, Rattus norvegicus
atcgggaagatttcgtgaaggccgc

SEQ ID NO: 632921 - DNA, 25 bp, Rattus norvegicus
catcgggaagatttcgtgaaggccg

SEQ ID NO: 632922 - DNA, 25 bp, Rattus norvegicus
gcatcgggaagatttcgtgaaggcc

SEQ ID NO: 632923 - DNA, 25 bp, Rattus norvegicus
cgcatcgggaagatttcgtgaaggc

SEQ ID NO: 632924 - DNA, 25 bp, Rattus norvegicus
ttggctctgcatgccaccctcctta

SEQ ID NO: 632925 - DNA, 25 bp, Rattus norvegicus
tccggactgtgtgtgtgataagaca

SEQ ID NO: 632926 - DNA, 25 bp, Rattus norvegicus
gcggcaagaagaaagtgtgctacta

SEQ ID NO: 632927 - DNA, 25 bp, Rattus norvegicus
ggcctgactgcacaaagccggcgtc

SEQ ID NO: 632928 - DNA, 25 bp, Rattus norvegicus
cacgcgtatgtttggggtgcactgc

SEQ ID NO: 632929 - DNA, 25 bp, Rattus norvegicus
cctccgctcgggcacgcgtatgttt

SEQ ID NO: 632930 - DNA, 25 bp, Rattus norvegicus
gctactattatgacggtaagtggcc

SEQ ID NO: 632931 - DNA, 25 bp, Rattus norvegicus
cgtacagtcaaggaggcggcaagaa

SEQ ID NO: 632932 - DNA, 25 bp, Rattus norvegicus
gccggagcccatggcgtacagtcaa

SEQ ID NO: 632933 - DNA, 25 bp, Rattus norvegicus
tgctgcagcctcgaccggtggcatc

SEQ ID NO: 632934 - DNA, 25 bp, Rattus norvegicus
tgataagacatacggagcactgctg

SEQ ID NO: 632935 - DNA, 25 bp, Rattus norvegicus
gcacctccggactgtgtgtgtgata

SEQ ID NO: 632936 - DNA, 25 bp, Rattus norvegicus
gccaaggtcggcttgtgcgcacctc

SEQ ID NO: 632937 - DNA, 25 bp, Rattus norvegicus
gatctgtcggcgctgcgcttccagc

SEQ ID NO: 632938 - DNA, 25 bp, Rattus norvegicus
atacggagcactgctgcagcctcga

SEQ ID NO: 632939 - DNA, 25 bp, Rattus norvegicus
agactccgggatccctccaagcagc

SEQ ID NO: 632940 - DNA, 25 bp, Rattus norvegicus
ggatctgcagctacccacgtgggtc

SEQ ID NO: 632941 - DNA, 25 bp, Rattus norvegicus
tcagggcagcggatctgcagctacc

SEQ ID NO: 632942 - DNA, 25 bp, Rattus norvegicus
gaatcccaggcgtcgtcagggcagc

SEQ ID NO: 632943 - DNA, 25 bp, Rattus norvegicus
cgcggagctttggaatcccaggcgt

SEQ ID NO: 632944 - DNA, 25 bp, Rattus norvegicus
cgggctcaaggttcccgcgactgct

SEQ ID NO: 632945 - DNA, 25 bp, Rattus norvegicus
gcaagggccgcaggaaccagcagca

SEQ ID NO: 632946 - DNA, 25 bp, Rattus norvegicus
ccaaaggccaggacgaaggaggcaa

SEQ ID NO: 632947 - DNA, 25 bp, Rattus norvegicus
cctcagggaggtgaagcgcacgaac

SEQ ID NO: 632948 - DNA, 25 bp, Rattus norvegicus
tctccgcttcagctcgccctggatc

SEQ ID NO: 632949 - DNA, 25 bp, Rattus norvegicus
agctttggcggtttccctgtcattt

SEQ ID NO: 632950 - DNA, 25 bp, Rattus norvegicus
cggcgcctcccagctttggcggttt

SEQ ID NO: 632951 - DNA, 25 bp, Rattus norvegicus
acccacgtgggtcgaatctctgggc

SEQ ID NO: 632952 - DNA, 25 bp, Rattus norvegicus
acgaactccactccggtgccaaagg

SEQ ID NO: 632953 - DNA, 25 bp, Rattus norvegicus
atgaggaccgcgttgtccaggtttc

SEQ ID NO: 632954 - DNA, 25 bp, Rattus norvegicus
cgacagctccgctcagctgtggact

SEQ ID NO: 632955 - DNA, 25 bp, Rattus norvegicus
gtcgggcgactacggatgacctcac

SEQ ID NO: 632956 - DNA, 25 bp, Rattus norvegicus
ctttctcgccacgtgcaggcgtgtc

SEQ ID NO: 632957 - DNA, 25 bp, Rattus norvegicus
tgtggactgcaagtgcgcaccgccc

SEQ ID NO: 632958 - DNA, 25 bp, Rattus norvegicus
ctcagctgtggactgcaagtgcgca

SEQ ID NO: 632959 - DNA, 25 bp, Rattus norvegicus
tccgctcagctgtggactgcaagtg

SEQ ID NO: 632960 - DNA, 25 bp, Rattus norvegicus
aaggaggtatcggcgccgacagctc

SEQ ID NO: 632961 - DNA, 25 bp, Rattus norvegicus
ttactactcgcctcccgggagggca

SEQ ID NO: 632962 - DNA, 25 bp, Rattus norvegicus
agcattactactcgcctcccgggag

SEQ ID NO: 632963 - DNA, 25 bp, Rattus norvegicus
ctgccagccgtcaacagcattacta

SEQ ID NO: 632964 - DNA, 25 bp, Rattus norvegicus
tccaggtttcggagctgtgccaata

SEQ ID NO: 632965 - DNA, 25 bp, Rattus norvegicus
gcgactacggatgacctcacagccg

SEQ ID NO: 632966 - DNA, 25 bp, Rattus norvegicus
tttcggagctgtgccaatagctgcc

SEQ ID NO: 632967 - DNA, 25 bp, Rattus norvegicus
gccattctcctacggggcagggaaa

SEQ ID NO: 632968 - DNA, 25 bp, Rattus norvegicus
attccgaggccttcggatgggagcc

SEQ ID NO: 632969 - DNA, 25 bp, Rattus norvegicus
ggggccgcggctgcctcatccttat

SEQ ID NO: 632970 - DNA, 25 bp, Rattus norvegicus
tgcagctgcggcctcgtccttggcg

SEQ ID NO: 632971 - DNA, 25 bp, Rattus norvegicus
tgggagcccatgctctgcatcaggc

SEQ ID NO: 632972 - DNA, 25 bp, Rattus norvegicus
gtggacagaagtcgcccacattccg

SEQ ID NO: 632973 - DNA, 25 bp, Rattus norvegicus
gtcactcggagtggccgacagtgcc

SEQ ID NO: 632974 - DNA, 25 bp, Rattus norvegicus
aaagaccggagcgtcactcggagtg

SEQ ID NO: 632975 - DNA, 25 bp, Rattus norvegicus
cgttcacttttacgtggccattctc

SEQ ID NO: 632976 - DNA, 25 bp, Rattus norvegicus
cttcttgaaggaaaagcgcttcttt

SEQ ID NO: 632977 - DNA, 25 bp, Rattus norvegicus
gccgctcagcttgaaggacttcttg

SEQ ID NO: 632978 - DNA, 25 bp, Rattus norvegicus
tcttgaaggagaagccgctcagctt

SEQ ID NO: 632979 - DNA, 25 bp, Rattus norvegicus
cctccttcttgctcttcttgaagga

SEQ ID NO: 632980 - DNA, 25 bp, Rattus norvegicus
tccagcaactcgagctctcggggct

SEQ ID NO: 632981 - DNA, 25 bp, Rattus norvegicus
ggagccaatccctccctgcagcagc

SEQ ID NO: 632982 - DNA, 25 bp, Rattus norvegicus
gcgagccaacgagagtaaacacgcg

SEQ ID NO: 632983 - DNA, 25 bp, Rattus norvegicus
agcgagccaacgagagtaaacacgc

SEQ ID NO: 632984 - DNA, 25 bp, Rattus norvegicus
gagcgagccaacgagagtaaacacg

SEQ ID NO: 632985 - DNA, 25 bp, Rattus norvegicus
cgggagcgagccaacgagagtaaac

SEQ ID NO: 632986 - DNA, 25 bp, Rattus norvegicus
cggagcccatgagcgtcaggggagc

SEQ ID NO: 632987 - DNA, 25 bp, Rattus norvegicus
atggccgtgtcgaggcggagcccat

SEQ ID NO: 632988 - DNA, 25 bp, Rattus norvegicus
ccacgccgagcagatggccgtgtcg

SEQ ID NO: 632989 - DNA, 25 bp, Rattus norvegicus
cacgccgagcagatggccgtgtcga

SEQ ID NO: 632990 - DNA, 25 bp, Rattus norvegicus
gggagcgagccaacgagagtaaaca

SEQ ID NO: 632991 - DNA, 25 bp, Rattus norvegicus
ggacccacgccgagcagatggccgt

SEQ ID NO: 632992 - DNA, 25 bp, Rattus norvegicus
gcaaccgcggggaagattcggagcc

SEQ ID NO: 632993 - DNA, 25 bp, Rattus norvegicus
acccacgccgagcagatggccgtgt

SEQ ID NO: 632994 - DNA, 25 bp, Rattus norvegicus
gggaagattcggagcccgaggcgcc

SEQ ID NO: 632995 - DNA, 25 bp, Rattus norvegicus
cagcttacccgcttctgggatacca

SEQ ID NO: 632996 - DNA, 25 bp, Rattus norvegicus
cttaccctctccttctatatgggtg

SEQ ID NO: 632997 - DNA, 25 bp, Rattus norvegicus
ccttaccctctccttctatatgggt

SEQ ID NO: 632998 - DNA, 25 bp, Rattus norvegicus
cataatcccttaccctctccttcta

SEQ ID NO: 632999 - DNA, 25 bp, Rattus norvegicus
gtttccagaccaacatccccataat

SEQ ID NO: 633000 - DNA, 25 bp, Rattus norvegicus
agtttccagaccaacatccccataa

SEQ ID NO: 633001 - DNA, 25 bp, Rattus norvegicus
aggagccattctcttatttacattt

SEQ ID NO: 633002 - DNA, 25 bp, Rattus norvegicus
gcagcttacccgcttctgggatacc

SEQ ID NO: 633003 - DNA, 25 bp, Rattus norvegicus
ctgcagcttacccgcttctgggata

SEQ ID NO: 633004 - DNA, 25 bp, Rattus norvegicus
actgcagcttacccgcttctgggat

SEQ ID NO: 633005 - DNA, 25 bp, Rattus norvegicus
aactgcagcttacccgcttctggga

SEQ ID NO: 633006 - DNA, 25 bp, Rattus norvegicus
aaactgcagcttacccgcttctggg

SEQ ID NO: 633007 - DNA, 25 bp, Rattus norvegicus
caaactgcagcttacccgcttctgg

SEQ ID NO: 633008 - DNA, 25 bp, Rattus norvegicus
ggagccattctcttatttacatttc

SEQ ID NO: 633009 - DNA, 25 bp, Rattus norvegicus
ggcctcgacccacgcccacggtctc

SEQ ID NO: 633010 - DNA, 25 bp, Rattus norvegicus
cgcccacagtctcgacccacgccca

SEQ ID NO: 633011 - DNA, 25 bp, Rattus norvegicus
tgcccacagcctcgacccacgccca

SEQ ID NO: 633012 - DNA, 25 bp, Rattus norvegicus
cggcctcgacccacgcccacggtct

SEQ ID NO: 633013 - DNA, 25 bp, Rattus norvegicus
ccacggtctcgacccacgcccacgg

SEQ ID NO: 633014 - DNA, 25 bp, Rattus norvegicus
ggtctcgacccacgctcacagcctc

SEQ ID NO: 633015 - DNA, 25 bp, Rattus norvegicus
acagtctcgacccatgcccacagcc

SEQ ID NO: 633016 - DNA, 25 bp, Rattus norvegicus
gacccatgcccacagcctcgaccca

SEQ ID NO: 633017 - DNA, 25 bp, Rattus norvegicus
ggtctcgacccacgcccacggtctc

SEQ ID NO: 633018 - DNA, 25 bp, Rattus norvegicus
acggtctcgacccacgctcacagcc

SEQ ID NO: 633019 - DNA, 25 bp, Rattus norvegicus
cggtctcgacccacgcccacggtct

SEQ ID NO: 633020 - DNA, 25 bp, Rattus norvegicus
agcctcgacccacgcccacggtctc

SEQ ID NO: 633021 - DNA, 25 bp, Rattus norvegicus
tcacagcctcgacccacgcccacgg

SEQ ID NO: 633022 - DNA, 25 bp, Rattus norvegicus
cggtctcgacccacgctcacagcct

SEQ ID NO: 633023 - DNA, 25 bp, Rattus norvegicus
cgagcgggaatgctcctgctagtcc

SEQ ID NO: 633024 - DNA, 25 bp, Rattus norvegicus
tacgacattggcgacttgcggcagc

SEQ ID NO: 633025 - DNA, 25 bp, Rattus norvegicus
gcgtcgtaaagaaacaagggcatta

SEQ ID NO: 633026 - DNA, 25 bp, Rattus norvegicus
aggaatcggacccactgccctggct

SEQ ID NO: 633027 - DNA, 25 bp, Rattus norvegicus
cggaatgacccagtcggtggtcgta

SEQ ID NO: 633028 - DNA, 25 bp, Rattus norvegicus
cttgcgcggaaaccctgcgtcgtaa

SEQ ID NO: 633029 - DNA, 25 bp, Rattus norvegicus
ctcgacattcgttttcggttagata

SEQ ID NO: 633030 - DNA, 25 bp, Rattus norvegicus
ggcccagtcgctatggtaacggcta

SEQ ID NO: 633031 - DNA, 25 bp, Rattus norvegicus
gctgcttagactgtgagcctctcaa

SEQ ID NO: 633032 - DNA, 25 bp, Rattus norvegicus
cagctaggatttacctgccggaggc

SEQ ID NO: 633033 - DNA, 25 bp, Rattus norvegicus
ctcaaggatgttgacagggcagcta

SEQ ID NO: 633034 - DNA, 25 bp, Rattus norvegicus
aagcccgcgatcaatgttaaagtcc

SEQ ID NO: 633035 - DNA, 25 bp, Rattus norvegicus
ggcctccggagctgcagatgctcaa

SEQ ID NO: 633036 - DNA, 25 bp, Rattus norvegicus
ataacgacactagcgggcaacagcc

SEQ ID NO: 633037 - DNA, 25 bp, Rattus norvegicus
ggatccggagcagcccgagcatcag

SEQ ID NO: 633038 - DNA, 25 bp, Rattus norvegicus
agcgccacgccacgcaggtaagcga

SEQ ID NO: 633039 - DNA, 25 bp, Rattus norvegicus
atgtgctccggaaccgagcgccacg

SEQ ID NO: 633040 - DNA, 25 bp, Rattus norvegicus
ccatgtgaatgtgctccggaaccga

SEQ ID NO: 633041 - DNA, 25 bp, Rattus norvegicus
gcctctagccggagcgctccgagga

SEQ ID NO: 633042 - DNA, 25 bp, Rattus norvegicus
cgctgatcaagagcgcagcgaggcc

SEQ ID NO: 633043 - DNA, 25 bp, Rattus norvegicus
gagacccgcccgctgatcaagagcg

SEQ ID NO: 633044 - DNA, 25 bp, Rattus norvegicus
gacgcgcgcaccaatggctgactgc

SEQ ID NO: 633045 - DNA, 25 bp, Rattus norvegicus
gcccgagcatcagcgagagtagctg

SEQ ID NO: 633046 - DNA, 25 bp, Rattus norvegicus
aactgacagtctcggggcgtgtccc

SEQ ID NO: 633047 - DNA, 25 bp, Rattus norvegicus
tagggcagaaggaactgacagtctc

SEQ ID NO: 633048 - DNA, 25 bp, Rattus norvegicus
agccctcagcggaccctttgatagg

SEQ ID NO: 633049 - DNA, 25 bp, Rattus norvegicus
cccgcgacgcaggacactgatgcgg

SEQ ID NO: 633050 - DNA, 25 bp, Rattus norvegicus
tgcagttgcgccatctgtcaggagc

SEQ ID NO: 633051 - DNA, 25 bp, Rattus norvegicus
gcgcagcttagtgaagcgatttgtt

SEQ ID NO: 633052 - DNA, 25 bp, Rattus norvegicus
tatcagggtgcagtttcagcaggga

SEQ ID NO: 633053 - DNA, 25 bp, Rattus norvegicus
tagttccgtatcagggtgcagtttc

SEQ ID NO: 633054 - DNA, 25 bp, Rattus norvegicus
tgcctcaaggcatcgtagttccgta

SEQ ID NO: 633055 - DNA, 25 bp, Rattus norvegicus
agcgccatcgaagtctgcctcaagg

SEQ ID NO: 633056 - DNA, 25 bp, Rattus norvegicus
tcaaaaccaggagcgagcgccatcg

SEQ ID NO: 633057 - DNA, 25 bp, Rattus norvegicus
tagtgcagagcttaaactgtgtccc

SEQ ID NO: 633058 - DNA, 25 bp, Rattus norvegicus
gttctccatcttagtgcagagctta

SEQ ID NO: 633059 - DNA, 25 bp, Rattus norvegicus
gcagtttccgttctccatcttagtg

SEQ ID NO: 633060 - DNA, 25 bp, Rattus norvegicus
agacgaaggaggatcgcagtttccg

SEQ ID NO: 633061 - DNA, 25 bp, Rattus norvegicus
cgtgcgctctgatttagacgaagga

SEQ ID NO: 633062 - DNA, 25 bp, Rattus norvegicus
tgtcgtttccgtgcgctctgattta

SEQ ID NO: 633063 - DNA, 25 bp, Rattus norvegicus
agcgatttgtttggtgtcgtttccg

SEQ ID NO: 633064 - DNA, 25 bp, Rattus norvegicus
tcggaggcgcatgggctcagttccc

SEQ ID NO: 633065 - DNA, 25 bp, Rattus norvegicus
tggcactgctaacgccttgcccgtt

SEQ ID NO: 633066 - DNA, 25 bp, Rattus norvegicus
caacggcgggtactacatcaccacg

SEQ ID NO: 633067 - DNA, 25 bp, Rattus norvegicus
taataagtattaatcagagtagtcc

SEQ ID NO: 633068 - DNA, 25 bp, Rattus norvegicus
tcagagtagtccagttaacgaggcc

SEQ ID NO: 633069 - DNA, 25 bp, Rattus norvegicus
ttaacgaggcctgcaggtcagaccg

SEQ ID NO: 633070 - DNA, 25 bp, Rattus norvegicus
ctgcaggtcagaccggcacccggtg

SEQ ID NO: 633071 - DNA, 25 bp, Rattus norvegicus
gcacccggtggctggcactgctaac

SEQ ID NO: 633072 - DNA, 25 bp, Rattus norvegicus
acgccttgcccgtttgcgcgtttgc

SEQ ID NO: 633073 - DNA, 25 bp, Rattus norvegicus
tccatccgagactgggacgacatga

SEQ ID NO: 633074 - DNA, 25 bp, Rattus norvegicus
acgacatgaagggagaccacgtcaa

SEQ ID NO: 633075 - DNA, 25 bp, Rattus norvegicus
gggagaccacgtcaaacattacaaa

SEQ ID NO: 633076 - DNA, 25 bp, Rattus norvegicus
acattacaaaatccgcaagcttgac

SEQ ID NO: 633077 - DNA, 25 bp, Rattus norvegicus
tgcgcgtttgccaggtgcctactcc

SEQ ID NO: 633078 - DNA, 25 bp, Rattus norvegicus
gcaagcttgacaacggcgggtacta

SEQ ID NO: 633079 - DNA, 25 bp, Rattus norvegicus
ccatggtggttgtcctagcgcgaga

SEQ ID NO: 633080 - DNA, 25 bp, Rattus norvegicus
tggccgggcgcagacactgcagcac

SEQ ID NO: 633081 - DNA, 25 bp, Rattus norvegicus
ggccgcgcgtgaataaatttcatta

SEQ ID NO: 633082 - DNA, 25 bp, Rattus norvegicus
tagtctttcggtgtactcgctcgtg

SEQ ID NO: 633083 - DNA, 25 bp, Rattus norvegicus
cagggccgcgcgtgaataaatttca

SEQ ID NO: 633084 - DNA, 25 bp, Rattus norvegicus
aggtgactagtctttcggtgtactc

SEQ ID NO: 633085 - DNA, 25 bp, Rattus norvegicus
tcggtgtactcgctcgtgccgagtg

SEQ ID NO: 633086 - DNA, 25 bp, Rattus norvegicus
atctgcccagcctgagcaaggaagg

SEQ ID NO: 633087 - DNA, 25 bp, Rattus norvegicus
acaccacggtgggaaatcccgtgct

SEQ ID NO: 633088 - DNA, 25 bp, Rattus norvegicus
atcccgtgctgtgtgtatctgccca

SEQ ID NO: 633089 - DNA, 25 bp, Rattus norvegicus
gcagacactgcagcaccgcagaaga

SEQ ID NO: 633090 - DNA, 25 bp, Rattus norvegicus
ctgtgtgtatctgcccagcctgagc

SEQ ID NO: 633091 - DNA, 25 bp, Rattus norvegicus
aaatttcattaagtggccgggcgca

SEQ ID NO: 633092 - DNA, 25 bp, Rattus norvegicus
ggaaacccatggtggttgtcctagc

SEQ ID NO: 633093 - DNA, 25 bp, Rattus norvegicus
ggagtcttccctcctctcggctttg

SEQ ID NO: 633094 - DNA, 25 bp, Rattus norvegicus
tcgccggtgaggacctcggtcactc

SEQ ID NO: 633095 - DNA, 25 bp, Rattus norvegicus
ggcgaacatgttttctgtgaggata

SEQ ID NO: 633096 - DNA, 25 bp, Rattus norvegicus
ctgtgaggatagtgactgccgacta

SEQ ID NO: 633097 - DNA, 25 bp, Rattus norvegicus
tgactgccgactactacatggccag

SEQ ID NO: 633098 - DNA, 25 bp, Rattus norvegicus
caaggacgagttcgcgggtccttag

SEQ ID NO: 633099 - DNA, 25 bp, Rattus norvegicus
ccatctctccgtgggtcgggtggct

SEQ ID NO: 633100 - DNA, 25 bp, Rattus norvegicus
gctggagtccatctctccgtgggtc

SEQ ID NO: 633101 - DNA, 25 bp, Rattus norvegicus
ggcgctcggtctctactctgcgagc

SEQ ID NO: 633102 - DNA, 25 bp, Rattus norvegicus
aaaaatgtgggttcgcgcgagcgct

SEQ ID NO: 633103 - DNA, 25 bp, Rattus norvegicus
ccgcgcgtgacaggaggcgcaaaaa

SEQ ID NO: 633104 - DNA, 25 bp, Rattus norvegicus
ccctgtcaagaaggtgccggtggta

SEQ ID NO: 633105 - DNA, 25 bp, Rattus norvegicus
tcacccagcaccctgtcaagaaggt

SEQ ID NO: 633106 - DNA, 25 bp, Rattus norvegicus
ccggggctggatatctgccaatccc

SEQ ID NO: 633107 - DNA, 25 bp, Rattus norvegicus
ccgccttattccaagcagctcagtg

SEQ ID NO: 633108 - DNA, 25 bp, Rattus norvegicus
ccggagactctggtacgccatcttt

SEQ ID NO: 633109 - DNA, 25 bp, Rattus norvegicus
gatctgcaggtactccagccggaga

SEQ ID NO: 633110 - DNA, 25 bp, Rattus norvegicus
cggtgtgtggcggactacatcaccc

SEQ ID NO: 633111 - DNA, 25 bp, Rattus norvegicus
caggtcgcagttgattctgaggagc

SEQ ID NO: 633112 - DNA, 25 bp, Rattus norvegicus
tcccgcctttgcgttcgttcgcaga

SEQ ID NO: 633113 - DNA, 25 bp, Rattus norvegicus
aggagtgcgatccatcccgcctttg

SEQ ID NO: 633114 - DNA, 25 bp, Rattus norvegicus
ttcgacccacggctagccaatcagg

SEQ ID NO: 633115 - DNA, 25 bp, Rattus norvegicus
gcagcggagtgttctttagggaatt

SEQ ID NO: 633116 - DNA, 25 bp, Rattus norvegicus
tccgcctaccaacgcagagagaaag

SEQ ID NO: 633117 - DNA, 25 bp, Rattus norvegicus
caatcaagagttgcgcctctgcgtc

SEQ ID NO: 633118 - DNA, 25 bp, Rattus norvegicus
tgtgtactcggacacccaccaatcg

SEQ ID NO: 633119 - DNA, 25 bp, Rattus norvegicus
actactgtccaatcagcgctgtgta

SEQ ID NO: 633120 - DNA, 25 bp, Rattus norvegicus
ggggcggactcaaaactggcctcca

SEQ ID NO: 633121 - DNA, 25 bp, Rattus norvegicus
tgcttcccgcgcagatttccaaacg

SEQ ID NO: 633122 - DNA, 25 bp, Rattus norvegicus
cagtaacggccgctacccgagtggc

SEQ ID NO: 633123 - DNA, 25 bp, Rattus norvegicus
ggttggctgattggctcctggaact

SEQ ID NO: 633124 - DNA, 25 bp, Rattus norvegicus
ctcctggaactgtcttttactactg

SEQ ID NO: 633125 - DNA, 25 bp, Rattus norvegicus
tttactactgaaagcgcgccgattg

SEQ ID NO: 633126 - DNA, 25 bp, Rattus norvegicus
cgccgattgattcaaagcccaagta

SEQ ID NO: 633127 - DNA, 25 bp, Rattus norvegicus
ttccaaacgcctaccagagagtctg

SEQ ID NO: 633128 - DNA, 25 bp, Rattus norvegicus
acagcttaaaagtgtggctaccggc

SEQ ID NO: 633129 - DNA, 25 bp, Rattus norvegicus
caggctgaaggaaacgccgacaatc

SEQ ID NO: 633130 - DNA, 25 bp, Rattus norvegicus
cgccgacaatcaaggggtgtggcct

SEQ ID NO: 633131 - DNA, 25 bp, Rattus norvegicus
ggcctgagaaccctgcgccgcgatt

SEQ ID NO: 633132 - DNA, 25 bp, Rattus norvegicus
ggcggccgaactcaccgactgaatc

SEQ ID NO: 633133 - DNA, 25 bp, Rattus norvegicus
gcgccctggaccaacggaatgcttc

SEQ ID NO: 633134 - DNA, 25 bp, Rattus norvegicus
taccagagagtctggcgccagttgc

SEQ ID NO: 633135 - DNA, 25 bp, Rattus norvegicus
cggaggccacagcttcggactcatt

SEQ ID NO: 633136 - DNA, 25 bp, Rattus norvegicus
gccacagcttcggactcattctctg

SEQ ID NO: 633137 - DNA, 25 bp, Rattus norvegicus
ttcggactcattctctgcgccgggg

SEQ ID NO: 633138 - DNA, 25 bp, Rattus norvegicus
gactcattctctgcgccggggccgg

SEQ ID NO: 633139 - DNA, 25 bp, Rattus norvegicus
agctccaactccagcgtggcggctc

SEQ ID NO: 633140 - DNA, 25 bp, Rattus norvegicus
cagcgcagcacgctctgggcactgc

SEQ ID NO: 633141 - DNA, 25 bp, Rattus norvegicus
agccgagctccgtgcaccgggcatc

SEQ ID NO: 633142 - DNA, 25 bp, Rattus norvegicus
agcccgcgcgagcagaacccgggaa

SEQ ID NO: 633143 - DNA, 25 bp, Rattus norvegicus
gaaggaagccttcccaccgcgcagg

SEQ ID NO: 633144 - DNA, 25 bp, Rattus norvegicus
tccaagttgccgagcgcctgcacag

SEQ ID NO: 633145 - DNA, 25 bp, Rattus norvegicus
gccgagcgcctgcacaggtcacgtt

SEQ ID NO: 633146 - DNA, 25 bp, Rattus norvegicus
ctgcacaggtcacgttccggaaata

SEQ ID NO: 633147 - DNA, 25 bp, Rattus norvegicus
tcacgttccggaaataaggccgctc

SEQ ID NO: 633148 - DNA, 25 bp, Rattus norvegicus
tgggcactgccactccgcacggagg

SEQ ID NO: 633149 - DNA, 25 bp, Rattus norvegicus
ccagcttggcggctacgaaaggctc

SEQ ID NO: 633150 - DNA, 25 bp, Rattus norvegicus
ttggtcgctgggacctcgggatcct

SEQ ID NO: 633151 - DNA, 25 bp, Rattus norvegicus
ctcaacctctcccagttgactaaga

SEQ ID NO: 633152 - DNA, 25 bp, Rattus norvegicus
gcgcaaaggcaacctcaccacgggg

SEQ ID NO: 633153 - DNA, 25 bp, Rattus norvegicus
ccacggggccacagaagaccagtga

SEQ ID NO: 633154 - DNA, 25 bp, Rattus norvegicus
acctcgggatcctgcaggagccgct

SEQ ID NO: 633155 - DNA, 25 bp, Rattus norvegicus
tgcaggagccgctgtccagtcgtcc

SEQ ID NO: 633156 - DNA, 25 bp, Rattus norvegicus
ggagctcctgttccagctccagctt

SEQ ID NO: 633157 - DNA, 25 bp, Rattus norvegicus
acgaaaggctctggactccctcaac

SEQ ID NO: 633158 - DNA, 25 bp, Rattus norvegicus
cgggcgagcgcaaaggcaacctcac

SEQ ID NO: 633159 - DNA, 25 bp, Rattus norvegicus
agttgactaagacctgggcgcagcc

SEQ ID NO: 633160 - DNA, 25 bp, Rattus norvegicus
gcggtgctcgcccagcctacataca

SEQ ID NO: 633161 - DNA, 25 bp, Rattus norvegicus
atacacctctgctgggctccacaga

SEQ ID NO: 633162 - DNA, 25 bp, Rattus norvegicus
tcccgctcgctgttggtcgctggga

SEQ ID NO: 633163 - DNA, 25 bp, Rattus norvegicus
cagcttggcgactccaggctaccgg

SEQ ID NO: 633164 - DNA, 25 bp, Rattus norvegicus
cgaaggcgagagtccagctgggaag

SEQ ID NO: 633165 - DNA, 25 bp, Rattus norvegicus
caggaaggcggcgtacaggaccgcg

SEQ ID NO: 633166 - DNA, 25 bp, Rattus norvegicus
tacaggaccgcggtggagaaccagc

SEQ ID NO: 633167 - DNA, 25 bp, Rattus norvegicus
cagcgcagcacgctcctggcccggc

SEQ ID NO: 633168 - DNA, 25 bp, Rattus norvegicus
cactccgccgggaggccaccgccct

SEQ ID NO: 633169 - DNA, 25 bp, Rattus norvegicus
cgccctctggtcattctgcgctggg

SEQ ID NO: 633170 - DNA, 25 bp, Rattus norvegicus
gcgactccaggctaccggttttgcc

SEQ ID NO: 633171 - DNA, 25 bp, Rattus norvegicus
aaggcgctgcccagcagccgctgcc

SEQ ID NO: 633172 - DNA, 25 bp, Rattus norvegicus
gaacatgcaggcagcgaaggcgaga

SEQ ID NO: 633173 - DNA, 25 bp, Rattus norvegicus
tccaggctaccggttttgccgctgc

SEQ ID NO: 633174 - DNA, 25 bp, Rattus norvegicus
caggctaccggttttgccgctgccg

SEQ ID NO: 633175 - DNA, 25 bp, Rattus norvegicus
tctggtcattctgcgctggggtctc

SEQ ID NO: 633176 - DNA, 25 bp, Rattus norvegicus
aggggcgcagcctcagctctcacca

SEQ ID NO: 633177 - DNA, 25 bp, Rattus norvegicus
ccttgaaggccatgttgtcatcgtc

SEQ ID NO: 633178 - DNA, 25 bp, Rattus norvegicus
tccagcatggacacgaagagcaccc

SEQ ID NO: 633179 - DNA, 25 bp, Rattus norvegicus
gcattagcttaatacgttctggcga

SEQ ID NO: 633180 - DNA, 25 bp, Rattus norvegicus
gtgacctcctctcagcattagctta

SEQ ID NO: 633181 - DNA, 25 bp, Rattus norvegicus
cccggtgtctgtgtccaggcataat

SEQ ID NO: 633182 - DNA, 25 bp, Rattus norvegicus
ggccaaattagctacccggtgtctg

SEQ ID NO: 633183 - DNA, 25 bp, Rattus norvegicus
cccacaggtgattgggcgttggcaa

SEQ ID NO: 633184 - DNA, 25 bp, Rattus norvegicus
gccagcggaggccttacaccctgag

SEQ ID NO: 633185 - DNA, 25 bp, Rattus norvegicus
agaggacttgacacaccggctgccc

SEQ ID NO: 633186 - DNA, 25 bp, Rattus norvegicus
gacgagcggcgcacaccgtagacac

SEQ ID NO: 633187 - DNA, 25 bp, Rattus norvegicus
tttctctacggacccgtcggagaca

SEQ ID NO: 633188 - DNA, 25 bp, Rattus norvegicus
tggttgcccgttgacctcgtcagct

SEQ ID NO: 633189 - DNA, 25 bp, Rattus norvegicus
tggatgccaaacacagacccattgc

SEQ ID NO: 633190 - DNA, 25 bp, Rattus norvegicus
gttctggcgagcgtctcctacatgt

SEQ ID NO: 633191 - DNA, 25 bp, Rattus norvegicus
tgagccggctccttcccaggaacga

SEQ ID NO: 633192 - DNA, 25 bp, Rattus norvegicus
ctcgcggtctgccatcaaggcttca

SEQ ID NO: 633193 - DNA, 25 bp, Rattus norvegicus
aagcgcgtccggaaaaagcaacagc

SEQ ID NO: 633194 - DNA, 25 bp, Rattus norvegicus
ccgcggcaggagtcacggatgactc

SEQ ID NO: 633195 - DNA, 25 bp, Rattus norvegicus
ccacacacttacaggactttgtcca

SEQ ID NO: 633196 - DNA, 25 bp, Rattus norvegicus
ccatcgctgctggatctcctagtga

SEQ ID NO: 633197 - DNA, 25 bp, Rattus norvegicus
cctagtgaatgcacgtgtaccgatc

SEQ ID NO: 633198 - DNA, 25 bp, Rattus norvegicus
gtgtaccgatcacttccgggaagcc

SEQ ID NO: 633199 - DNA, 25 bp, Rattus norvegicus
tgccggaaatgcgaaataccacttc

SEQ ID NO: 633200 - DNA, 25 bp, Rattus norvegicus
ccattttgggaaggcgtagcgttct

SEQ ID NO: 633201 - DNA, 25 bp, Rattus norvegicus
gtagcgttctgtctcccttggttac

SEQ ID NO: 633202 - DNA, 25 bp, Rattus norvegicus
cccttggttacggaacgctgattgg

SEQ ID NO: 633203 - DNA, 25 bp, Rattus norvegicus
ggtcataagccgatcacagctcccg

SEQ ID NO: 633204 - DNA, 25 bp, Rattus norvegicus
caggaacgacttaacaaagcgcgtc

SEQ ID NO: 633205 - DNA, 25 bp, Rattus norvegicus
agcgaggtcaccaacagctctccga

SEQ ID NO: 633206 - DNA, 25 bp, Rattus norvegicus
cccaggcttcctttgcttcggctta

SEQ ID NO: 633207 - DNA, 25 bp, Rattus norvegicus
gcttcggcttaaggcatcaaataaa

SEQ ID NO: 633208 - DNA, 25 bp, Rattus norvegicus
gagcggctcgtacctctggaaagca

SEQ ID NO: 633209 - DNA, 25 bp, Rattus norvegicus
cacccaccttgggatggtacgaagg

SEQ ID NO: 633210 - DNA, 25 bp, Rattus norvegicus
tcgcctccggaacaggttacacagc

SEQ ID NO: 633211 - DNA, 25 bp, Rattus norvegicus
tcggactgctgtctggagaaccaga

SEQ ID NO: 633212 - DNA, 25 bp, Rattus norvegicus
tccagcagtttctcggtcccttcga

SEQ ID NO: 633213 - DNA, 25 bp, Rattus norvegicus
cgcgcttctaagctcgattctcata

SEQ ID NO: 633214 - DNA, 25 bp, Rattus norvegicus
cggtcccttcgaaaaaatgtgcagc

SEQ ID NO: 633215 - DNA, 25 bp, Rattus norvegicus
aatgtgcagcttccatcaccgtgag

SEQ ID NO: 633216 - DNA, 25 bp, Rattus norvegicus
tcaccgtgagactagcgaacaacca

SEQ ID NO: 633217 - DNA, 25 bp, Rattus norvegicus
gggtccatgcatcctcggtgtcacc

SEQ ID NO: 633218 - DNA, 25 bp, Rattus norvegicus
gttacacagcccaaggtcaggagcc

SEQ ID NO: 633219 - DNA, 25 bp, Rattus norvegicus
cgagaggaacgcagccaaggcaata

SEQ ID NO: 633220 - DNA, 25 bp, Rattus norvegicus
tttttcacgtgtttcctcgagagga

SEQ ID NO: 633221 - DNA, 25 bp, Rattus norvegicus
tttcctcgagaggaacgcagccaag

SEQ ID NO: 633222 - DNA, 25 bp, Rattus norvegicus
gccaaggcaataaaattcagcgttt

SEQ ID NO: 633223 - DNA, 25 bp, Rattus norvegicus
ctcctttcagccgaggtgctttttt

SEQ ID NO: 633224 - DNA, 25 bp, Rattus norvegicus
tgtcagtgacgtacgtgttgcccgg

SEQ ID NO: 633225 - DNA, 25 bp, Rattus norvegicus
gtcccacgctacatacagctggtta

SEQ ID NO: 633226 - DNA, 25 bp, Rattus norvegicus
attcagcgtttgtcagtgacgtacg

SEQ ID NO: 633227 - DNA, 25 bp, Rattus norvegicus
ggctttgatcctgtgcagttcctcc

SEQ ID NO: 633228 - DNA, 25 bp, Rattus norvegicus
acgctacatacagctggttagcaga

SEQ ID NO: 633229 - DNA, 25 bp, Rattus norvegicus
gcgaggctgtcccacgctacataca

SEQ ID NO: 633230 - DNA, 25 bp, Rattus norvegicus
agataggcgaggctgtcccacgcta

SEQ ID NO: 633231 - DNA, 25 bp, Rattus norvegicus
tgtgcagttcctcctttcagccgag

SEQ ID NO: 633232 - DNA, 25 bp, Rattus norvegicus
ggttagcagagaacacgagggattc

SEQ ID NO: 633233 - DNA, 25 bp, Rattus norvegicus
ttatgatttcaaggcgaagctggcg

SEQ ID NO: 633234 - DNA, 25 bp, Rattus norvegicus
gatctgtttgagtacgaagggtgca

SEQ ID NO: 633235 - DNA, 25 bp, Rattus norvegicus
gactcaatgaactctgggaattgta

SEQ ID NO: 633236 - DNA, 25 bp, Rattus norvegicus
gaattgtattcttcgcgctcgaggg

SEQ ID NO: 633237 - DNA, 25 bp, Rattus norvegicus
ggggtagcacaactcaccaggcctc

SEQ ID NO: 633238 - DNA, 25 bp, Rattus norvegicus
tcaccaggcctcttgaactacactt

SEQ ID NO: 633239 - DNA, 25 bp, Rattus norvegicus
tcgttaatgagttcgagaaagccgc

SEQ ID NO: 633240 - DNA, 25 bp, Rattus norvegicus
cgaggagtcccttgctgaaggcaga

SEQ ID NO: 633241 - DNA, 25 bp, Rattus norvegicus
gcttggctgaagagttaccggtttg

SEQ ID NO: 633242 - DNA, 25 bp, Rattus norvegicus
cctggagtcactgttgcgagcttaa

SEQ ID NO: 633243 - DNA, 25 bp, Rattus norvegicus
ccaactcggaggcactggtgctgcc

SEQ ID NO: 633244 - DNA, 25 bp, Rattus norvegicus
tcctccactgctgagacccggaggg

SEQ ID NO: 633245 - DNA, 25 bp, Rattus norvegicus
gacgcggcacctacgggcacgtcta

SEQ ID NO: 633246 - DNA, 25 bp, Rattus norvegicus
aggcgaggccgaaaagactcaatga

SEQ ID NO: 633247 - DNA, 25 bp, Rattus norvegicus
caccctcattacgttgtcgacttta

SEQ ID NO: 633248 - DNA, 25 bp, Rattus norvegicus
cgttgtcgactttaactactgtgtc

SEQ ID NO: 633249 - DNA, 25 bp, Rattus norvegicus
actactgtgtccgtgtttatagaaa

SEQ ID NO: 633250 - DNA, 25 bp, Rattus norvegicus
tgtccgtgtttatagaaaaggtgtc

SEQ ID NO: 633251 - DNA, 25 bp, Rattus norvegicus
tgtcggaaaatgtaggtggcctgta

SEQ ID NO: 633252 - DNA, 25 bp, Rattus norvegicus
gtggcctgtagagtcgcccattctc

SEQ ID NO: 633253 - DNA, 25 bp, Rattus norvegicus
attctccacagcacgcagatcctgt

SEQ ID NO: 633254 - DNA, 25 bp, Rattus norvegicus
cgcagatcctgtcatcgtgcacgga

SEQ ID NO: 633255 - DNA, 25 bp, Rattus norvegicus
tcatcgtgcacggaggcatccgtta

SEQ ID NO: 633256 - DNA, 25 bp, Rattus norvegicus
ggcatccgttaaccagcctcacaga

SEQ ID NO: 633257 - DNA, 25 bp, Rattus norvegicus
agcctcacagacgttagctcactta

SEQ ID NO: 633258 - DNA, 25 bp, Rattus norvegicus
ttagctcacttacagtatgccaccg

SEQ ID NO: 633259 - DNA, 25 bp, Rattus norvegicus
agaccgggtgacgtccaacgtgtct

SEQ ID NO: 633260 - DNA, 25 bp, Rattus norvegicus
gacgtccaacgtgtcttcccttcaa

SEQ ID NO: 633261 - DNA, 25 bp, Rattus norvegicus
acaggccctcgtactcagggtcaga

SEQ ID NO: 633262 - DNA, 25 bp, Rattus norvegicus
ctgagacagacgaagaagctaagtc

SEQ ID NO: 633263 - DNA, 25 bp, Rattus norvegicus
cacgggccgataagctgctgagaca

SEQ ID NO: 633264 - DNA, 25 bp, Rattus norvegicus
ccatgagcgtagagcacgggccgat

SEQ ID NO: 633265 - DNA, 25 bp, Rattus norvegicus
aaagggacccttagccatgagcgta

SEQ ID NO: 633266 - DNA, 25 bp, Rattus norvegicus
gcttgcgcgaaaagggacccttagc

SEQ ID NO: 633267 - DNA, 25 bp, Rattus norvegicus
ctcagggtcagagtcgaaatacatc

SEQ ID NO: 633268 - DNA, 25 bp, Rattus norvegicus
aaggcttatcgaacaggccctcgta

SEQ ID NO: 633269 - DNA, 25 bp, Rattus norvegicus
ccctcctccagggaaggcttatcga

SEQ ID NO: 633270 - DNA, 25 bp, Rattus norvegicus
agatttcctgccagccgaggttgca

SEQ ID NO: 633271 - DNA, 25 bp, Rattus norvegicus
gagcgccgaccagatttcctgccag

SEQ ID NO: 633272 - DNA, 25 bp, Rattus norvegicus
ggtagcagccctcttccaccggagg

SEQ ID NO: 633273 - DNA, 25 bp, Rattus norvegicus
aagtggtcgaggtagcagccctctt

SEQ ID NO: 633274 - DNA, 25 bp, Rattus norvegicus
gtcgaaatacatctgctctggaccc

SEQ ID NO: 633275 - DNA, 25 bp, Rattus norvegicus
tgagaaagcagcgtgaagagacagc

SEQ ID NO: 633276 - DNA, 25 bp, Rattus norvegicus
ctgcagccagctggtaatggtggta

SEQ ID NO: 633277 - DNA, 25 bp, Rattus norvegicus
ccagctggtaatggtggtagccgac

SEQ ID NO: 633278 - DNA, 25 bp, Rattus norvegicus
agcagcttcgcgtctgtccctgtgt

SEQ ID NO: 633279 - DNA, 25 bp, Rattus norvegicus
ctgtccctgtgtgttttgttgtctc

SEQ ID NO: 633280 - DNA, 25 bp, Rattus norvegicus
tgtctctgggaccaaacgcggaaca

SEQ ID NO: 633281 - DNA, 25 bp, Rattus norvegicus
agtttgctcctagttgcgacccatc

SEQ ID NO: 633282 - DNA, 25 bp, Rattus norvegicus
tagttgcgacccatcgcgccaggga

SEQ ID NO: 633283 - DNA, 25 bp, Rattus norvegicus
agggcccagtagaacagagccgttc

SEQ ID NO: 633284 - DNA, 25 bp, Rattus norvegicus
agtaggcggcttccgcttcctgcag

SEQ ID NO: 633285 - DNA, 25 bp, Rattus norvegicus
tccacctctgtgagaaagcagcgtg

SEQ ID NO: 633286 - DNA, 25 bp, Rattus norvegicus
cagcgtcagagtaggcggcttccgc

SEQ ID NO: 633287 - DNA, 25 bp, Rattus norvegicus
gcgagatgcggcgtctaagcactcg

SEQ ID NO: 633288 - DNA, 25 bp, Rattus norvegicus
gagccgttctactccacctctgtga

SEQ ID NO: 633289 - DNA, 25 bp, Rattus norvegicus
caagaaacaggtaggagcggagggc

SEQ ID NO: 633290 - DNA, 25 bp, Rattus norvegicus
gaggagcgtggccaagcagggaaat

SEQ ID NO: 633291 - DNA, 25 bp, Rattus norvegicus
cagggaaatgggaggtagcgcgacc

SEQ ID NO: 633292 - DNA, 25 bp, Rattus norvegicus
tagcgcgacccgcggaaaaccgcga

SEQ ID NO: 633293 - DNA, 25 bp, Rattus norvegicus
ggaaaaccgcgatttggcggcaaga

SEQ ID NO: 633294 - DNA, 25 bp, Rattus norvegicus
atttggcggcaagaaacaggtagga

SEQ ID NO: 633295 - DNA, 25 bp, Rattus norvegicus
aagctgagtccgagaggagcgcgac

SEQ ID NO: 633296 - DNA, 25 bp, Rattus norvegicus
cgaggtctgaaggaaccccacgaag

SEQ ID NO: 633297 - DNA, 25 bp, Rattus norvegicus
tcgcgctcggaagctgagtccgaga

SEQ ID NO: 633298 - DNA, 25 bp, Rattus norvegicus
cttcgcgctcggaagctgagtccga

SEQ ID NO: 633299 - DNA, 25 bp, Rattus norvegicus
gcgatttggcggcaagaaacaggta

SEQ ID NO: 633300 - DNA, 25 bp, Rattus norvegicus
ccacgaaggagagatctgggatcct

SEQ ID NO: 633301 - DNA, 25 bp, Rattus norvegicus
tggcaggaataggtccccgaggtct

SEQ ID NO: 633302 - DNA, 25 bp, Rattus norvegicus
agaggagcgcgacccagaggagcgt

SEQ ID NO: 633303 - DNA, 25 bp, Rattus norvegicus
ggctttgtctgcaacccgaggcgcc

SEQ ID NO: 633304 - DNA, 25 bp, Rattus norvegicus
ggtcgtgctcgcatctctctgcagc

SEQ ID NO: 633305 - DNA, 25 bp, Rattus norvegicus
ttcctgcggtcgtgctcgcatctct

SEQ ID NO: 633306 - DNA, 25 bp, Rattus norvegicus
tagaaccttcctgcggtcgtgctcg

SEQ ID NO: 633307 - DNA, 25 bp, Rattus norvegicus
tcttctgcctcttagaaccttcctg

SEQ ID NO: 633308 - DNA, 25 bp, Rattus norvegicus
atcagcgactggttgggtaggcttt

SEQ ID NO: 633309 - DNA, 25 bp, Rattus norvegicus
cgctggtctaatcagcgactggttg

SEQ ID NO: 633310 - DNA, 25 bp, Rattus norvegicus
cacgtgatccgctggtctaatcagc

SEQ ID NO: 633311 - DNA, 25 bp, Rattus norvegicus
ctggcacgtgatccgctggtctaat

SEQ ID NO: 633312 - DNA, 25 bp, Rattus norvegicus
ccaatggccgtctggcacgtgatcc

SEQ ID NO: 633313 - DNA, 25 bp, Rattus norvegicus
tggctcagagaccaatggccgtctg

SEQ ID NO: 633314 - DNA, 25 bp, Rattus norvegicus
ctcttagaaccttcctgcggtcgtg

SEQ ID NO: 633315 - DNA, 25 bp, Rattus norvegicus
tgggtaggctttgtctgcaacccga

SEQ ID NO: 633316 - DNA, 25 bp, Rattus norvegicus
ctcgccactggctcagagaccaatg

SEQ ID NO: 633317 - DNA, 25 bp, Rattus norvegicus
ggggcctcctctgtcacagggaaga

SEQ ID NO: 633318 - DNA, 25 bp, Rattus norvegicus
cctgcggctctgcatggagttgcgc

SEQ ID NO: 633319 - DNA, 25 bp, Rattus norvegicus
ccagaaggaggcaggtgacctacgt

SEQ ID NO: 633320 - DNA, 25 bp, Rattus norvegicus
gacctacgtgcgcagtgggcgccga

SEQ ID NO: 633321 - DNA, 25 bp, Rattus norvegicus
acagccaagcctccgggtcgtggct

SEQ ID NO: 633322 - DNA, 25 bp, Rattus norvegicus
catgggcacagccaagcctccgggt

SEQ ID NO: 633323 - DNA, 25 bp, Rattus norvegicus
gagacgcttctctgcaggcggcccg

SEQ ID NO: 633324 - DNA, 25 bp, Rattus norvegicus
gcccgtgggagacgcttctctgcag

SEQ ID NO: 633325 - DNA, 25 bp, Rattus norvegicus
ctctgcatggagttgcgccacgcgg

SEQ ID NO: 633326 - DNA, 25 bp, Rattus norvegicus
tcctctgtcacagggaagaaggcgg

SEQ ID NO: 633327 - DNA, 25 bp, Rattus norvegicus
ctgggcaggataaggttacgccgcc

SEQ ID NO: 633328 - DNA, 25 bp, Rattus norvegicus
ttcctgcagcggctgggcaggataa

SEQ ID NO: 633329 - DNA, 25 bp, Rattus norvegicus
ccctgcgcggaaccagaaggaggca

SEQ ID NO: 633330 - DNA, 25 bp, Rattus norvegicus
agttgccacagttggcagcccgggc

SEQ ID NO: 633331 - DNA, 25 bp, Rattus norvegicus
ggccgtgggcatggctccagccaat

SEQ ID NO: 633332 - DNA, 25 bp, Rattus norvegicus
tacagggcaccaagccgcggcctag

SEQ ID NO: 633333 - DNA, 25 bp, Rattus norvegicus
tagtctcatagagcaccagcttctg

SEQ ID NO: 633334 - DNA, 25 bp, Rattus norvegicus
gaggagactccgcacgcagacccag

SEQ ID NO: 633335 - DNA, 25 bp, Rattus norvegicus
cggcctaggtcgtgacagtttcagg

SEQ ID NO: 633336 - DNA, 25 bp, Rattus norvegicus
acaccagatccacctgacgatgaca

SEQ ID NO: 633337 - DNA, 25 bp, Rattus norvegicus
gaggcctcactacagggcaccaagc

SEQ ID NO: 633338 - DNA, 25 bp, Rattus norvegicus
ccagccaatggaggcctcactacag

SEQ ID NO: 633339 - DNA, 25 bp, Rattus norvegicus
tgacgatgacaacgtcggaacccta

SEQ ID NO: 633340 - DNA, 25 bp, Rattus norvegicus
agcttctggaccgaactgatgatgg

SEQ ID NO: 633341 - DNA, 25 bp, Rattus norvegicus
ggatactcacagctctagtctcata

SEQ ID NO: 633342 - DNA, 25 bp, Rattus norvegicus
gccgctgcggatactcacagctcta

SEQ ID NO: 633343 - DNA, 25 bp, Rattus norvegicus
gggctacaagatcaaggcgtcgctg

SEQ ID NO: 633344 - DNA, 25 bp, Rattus norvegicus
cccggagacagaggagactccgcac

SEQ ID NO: 633345 - DNA, 25 bp, Rattus norvegicus
atcaagacatcttcgatcgcctcct

SEQ ID NO: 633346 - DNA, 25 bp, Rattus norvegicus
gtaccctgaggaggcccagtttctg

SEQ ID NO: 633347 - DNA, 25 bp, Rattus norvegicus
ctacgtgggtttctaagcagcgttc

SEQ ID NO: 633348 - DNA, 25 bp, Rattus norvegicus
gccgcagttataatacaagtcgatg

SEQ ID NO: 633349 - DNA, 25 bp, Rattus norvegicus
caagtcgatgatcaagacatcttcg

SEQ ID NO: 633350 - DNA, 25 bp, Rattus norvegicus
cccaagttcagaaatggaagacgaa

SEQ ID NO: 633351 - DNA, 25 bp, Rattus norvegicus
ggaagacgaaacaactcaagaaatc

SEQ ID NO: 633352 - DNA, 25 bp, Rattus norvegicus
gcgaaaatcaaggtttgcgggacga

SEQ ID NO: 633353 - DNA, 25 bp, Rattus norvegicus
gcagcgttcacaacaacgaggtttc

SEQ ID NO: 633354 - DNA, 25 bp, Rattus norvegicus
cggcttcccgcggtaccctgaggag

SEQ ID NO: 633355 - DNA, 25 bp, Rattus norvegicus
ggacgagggcctgctcatctcctac

SEQ ID NO: 633356 - DNA, 25 bp, Rattus norvegicus
gctcatctcctacgtgggtttctaa

SEQ ID NO: 633357 - DNA, 25 bp, Rattus norvegicus
cgaggtttcgaatccgaatgctgcc

SEQ ID NO: 633358 - DNA, 25 bp, Rattus norvegicus
ggatttttcccagacgccgcagtta

SEQ ID NO: 633359 - DNA, 25 bp, Rattus norvegicus
tttccggattccacagcaaagcccg

SEQ ID NO: 633360 - DNA, 25 bp, Rattus norvegicus
cagcccggtggactgactgtagtag

SEQ ID NO: 633361 - DNA, 25 bp, Rattus norvegicus
gcctctggacccgtgcgttatttca

SEQ ID NO: 633362 - DNA, 25 bp, Rattus norvegicus
cgctgctgctcagagcggggcctct

SEQ ID NO: 633363 - DNA, 25 bp, Rattus norvegicus
ggcctcgggccttgtgccttggaac

SEQ ID NO: 633364 - DNA, 25 bp, Rattus norvegicus
cggcttggtgtcctctgggcagccc

SEQ ID NO: 633365 - DNA, 25 bp, Rattus norvegicus
ggtaaacttccgcagatggacaggc

SEQ ID NO: 633366 - DNA, 25 bp, Rattus norvegicus
gttgaagccacctccgtctttaggc

SEQ ID NO: 633367 - DNA, 25 bp, Rattus norvegicus
ttctccaccgagagaccgcggtgta

SEQ ID NO: 633368 - DNA, 25 bp, Rattus norvegicus
ccgtctttaggctcgccatcgaatc

SEQ ID NO: 633369 - DNA, 25 bp, Rattus norvegicus
agcggatttggagtcgacagagttc

SEQ ID NO: 633370 - DNA, 25 bp, Rattus norvegicus
gctcgccatcgaatcagcggatttg

SEQ ID NO: 633371 - DNA, 25 bp, Rattus norvegicus
tgtgccttggaacgcccgcgggacc

SEQ ID NO: 633372 - DNA, 25 bp, Rattus norvegicus
gatggacaggcttccgcaccagacc

SEQ ID NO: 633373 - DNA, 25 bp, Rattus norvegicus
gggctttccgctagctctgccatgg

SEQ ID NO: 633374 - DNA, 25 bp, Rattus norvegicus
ccgacccaggaacgcgagctggttt

SEQ ID NO: 633375 - DNA, 25 bp, Rattus norvegicus
ctggaaagagacaggcgagcgttca

SEQ ID NO: 633376 - DNA, 25 bp, Rattus norvegicus
gttccacgttctgtcctcgggctgg

SEQ ID NO: 633377 - DNA, 25 bp, Rattus norvegicus
cccgagtgccaaacggagttgcctc

SEQ ID NO: 633378 - DNA, 25 bp, Rattus norvegicus
gcattatttgtgttccgggctttcc

SEQ ID NO: 633379 - DNA, 25 bp, Rattus norvegicus
gtggtggggctcttcaaaagctcca

SEQ ID NO: 633380 - DNA, 25 bp, Rattus norvegicus
ccgtgacgacttgcattatttgtgt

SEQ ID NO: 633381 - DNA, 25 bp, Rattus norvegicus
ccacctgaaaggagatcggccgcta

SEQ ID NO: 633382 - DNA, 25 bp, Rattus norvegicus
tcttagagccttcggtgggttctcc

SEQ ID NO: 633383 - DNA, 25 bp, Rattus norvegicus
taccgcggcctacaggttcctggct

SEQ ID NO: 633384 - DNA, 25 bp, Rattus norvegicus
caggctcaaagttgatgcgaggccc

SEQ ID NO: 633385 - DNA, 25 bp, Rattus norvegicus
cgactcctgcgttactgggacaaca

SEQ ID NO: 633386 - DNA, 25 bp, Rattus norvegicus
cggcttcgccagcaacaggctcaaa

SEQ ID NO: 633387 - DNA, 25 bp, Rattus norvegicus
ctctcaggacaagaaggaccgcttt

SEQ ID NO: 633388 - DNA, 25 bp, Rattus norvegicus
cagcaaagtggtcccgacgacgctc

SEQ ID NO: 633389 - DNA, 25 bp, Rattus norvegicus
gcggccgggaagaaactccttgatc

SEQ ID NO: 633390 - DNA, 25 bp, Rattus norvegicus
aggccgcgccaacagagccctaagg

SEQ ID NO: 633391 - DNA, 25 bp, Rattus norvegicus
cggtctcagactctacccggctaaa

SEQ ID NO: 633392 - DNA, 25 bp, Rattus norvegicus
gctaccgaaggggtcacgtgaccca

SEQ ID NO: 633393 - DNA, 25 bp, Rattus norvegicus
agagctccattgtgtcgcgcgtggc

SEQ ID NO: 633394 - DNA, 25 bp, Rattus norvegicus
ttgcgactcaaaggactgctgcctc

SEQ ID NO: 633395 - DNA, 25 bp, Rattus norvegicus
tgctgcctcagaggagcaacatggc

SEQ ID NO: 633396 - DNA, 25 bp, Rattus norvegicus
ggaacctggcttgccgcagcttttc

SEQ ID NO: 633397 - DNA, 25 bp, Rattus norvegicus
gcagcttttctcctggacgcctggg

SEQ ID NO: 633398 - DNA, 25 bp, Rattus norvegicus
ctgtcggccgcgcagagcaacagca

SEQ ID NO: 633399 - DNA, 25 bp, Rattus norvegicus
aacagcagcgcatctcccaacgtga

SEQ ID NO: 633400 - DNA, 25 bp, Rattus norvegicus
tgggcagttccatccttgccggcgc

SEQ ID NO: 633401 - DNA, 25 bp, Rattus norvegicus
acctactgtgtgtcgggcaagcagc

SEQ ID NO: 633402 - DNA, 25 bp, Rattus norvegicus
agcagcaggacctcaccgagtttca

SEQ ID NO: 633403 - DNA, 25 bp, Rattus norvegicus
gacatctaatcctgggctgtttacc

SEQ ID NO: 633404 - DNA, 25 bp, Rattus norvegicus
ggtaacacggataaagcacctactg

SEQ ID NO: 633405 - DNA, 25 bp, Rattus norvegicus
aacagccatctatttgtgggagggc

SEQ ID NO: 633406 - DNA, 25 bp, Rattus norvegicus
tcgttgagttcttcggtagtgttcc

SEQ ID NO: 633407 - DNA, 25 bp, Rattus norvegicus
cacagctttgaaacgaggacatcta

SEQ ID NO: 633408 - DNA, 25 bp, Rattus norvegicus
ctccctcgtggtgaactacagtatc

SEQ ID NO: 633409 - DNA, 25 bp, Rattus norvegicus
ctacagtatccagaaaaccggcgga

SEQ ID NO: 633410 - DNA, 25 bp, Rattus norvegicus
agggagtccttctgtccgtgaaatg

SEQ ID NO: 633411 - DNA, 25 bp, Rattus norvegicus
agctgcgcgtgcatagctgtaaata

SEQ ID NO: 633412 - DNA, 25 bp, Rattus norvegicus
agtgttcctactacgctgtgatttg

SEQ ID NO: 633413 - DNA, 25 bp, Rattus norvegicus
tgcattccagcgacagccaagagcc

SEQ ID NO: 633414 - DNA, 25 bp, Rattus norvegicus
tcctgcttggtttcggtacttcaca

SEQ ID NO: 633415 - DNA, 25 bp, Rattus norvegicus
aaaatggcttaagtgggactccgcg

SEQ ID NO: 633416 - DNA, 25 bp, Rattus norvegicus
acggagtgtgaagcccggcctccct

SEQ ID NO: 633417 - DNA, 25 bp, Rattus norvegicus
agcatctggcgctggctttcatttc

SEQ ID NO: 633418 - DNA, 25 bp, Rattus norvegicus
ttcagttcgctcaccagcatctggc

SEQ ID NO: 633419 - DNA, 25 bp, Rattus norvegicus
ttcaacgcaaagttgaaaatggctt

SEQ ID NO: 633420 - DNA, 25 bp, Rattus norvegicus
gacgctcccatttcaacgcaaagtt

SEQ ID NO: 633421 - DNA, 25 bp, Rattus norvegicus
tgcaggagctttcggcgcggctcac

SEQ ID NO: 633422 - DNA, 25 bp, Rattus norvegicus
ttactcattgcaggagctttcggcg

SEQ ID NO: 633423 - DNA, 25 bp, Rattus norvegicus
gctcgctctgcgacattactcattg

SEQ ID NO: 633424 - DNA, 25 bp, Rattus norvegicus
catttgttcttagtgctcgctctgc

SEQ ID NO: 633425 - DNA, 25 bp, Rattus norvegicus
gccttgcacaaaataattagcattc

SEQ ID NO: 633426 - DNA, 25 bp, Rattus norvegicus
cctgtttaaattcttcgcgtgtctc

SEQ ID NO: 633427 - DNA, 25 bp, Rattus norvegicus
gctctgtccacggagtgtgaagccc

SEQ ID NO: 633428 - DNA, 25 bp, Rattus norvegicus
cgcgtgtctcgccttgcacaaaata

SEQ ID NO: 633429 - DNA, 25 bp, Rattus norvegicus
ttttctgtcgcaaacagagcgcgtc

SEQ ID NO: 633430 - DNA, 25 bp, Rattus norvegicus
aagacgccctgcctactgaatctgg

SEQ ID NO: 633431 - DNA, 25 bp, Rattus norvegicus
tctgtcgccgctgacacagtgactg

SEQ ID NO: 633432 - DNA, 25 bp, Rattus norvegicus
agcgcctccaaacgtcgagaacgga

SEQ ID NO: 633433 - DNA, 25 bp, Rattus norvegicus
ttcccgaaagccaacgcaaagacgc

SEQ ID NO: 633434 - DNA, 25 bp, Rattus norvegicus
ggggcttggctgtcactaattttta

SEQ ID NO: 633435 - DNA, 25 bp, Rattus norvegicus
gacagacgctcccagttaaccacgg

SEQ ID NO: 633436 - DNA, 25 bp, Rattus norvegicus
gcatctgggagttgtattttctgtc

SEQ ID NO: 633437 - DNA, 25 bp, Rattus norvegicus
cacggcctccagaaccgttggttcg

SEQ ID NO: 633438 - DNA, 25 bp, Rattus norvegicus
gagcgcgtcggtagcattacaacta

SEQ ID NO: 633439 - DNA, 25 bp, Rattus norvegicus
cccagcagctaagggccagggtcta

SEQ ID NO: 633440 - DNA, 25 bp, Rattus norvegicus
gggctgcttccaatggctgcctttg

SEQ ID NO: 633441 - DNA, 25 bp, Rattus norvegicus
tcttgtgcgataaacatctcggggc

SEQ ID NO: 633442 - DNA, 25 bp, Rattus norvegicus
ctcggggcatccgtactccttaatt

SEQ ID NO: 633443 - DNA, 25 bp, Rattus norvegicus
ctgaagctgtgcagcgactgactgc

SEQ ID NO: 633444 - DNA, 25 bp, Rattus norvegicus
ggcttgtttgtcagagccgcctgcc

SEQ ID NO: 633445 - DNA, 25 bp, Rattus norvegicus
tgggaccaagcaccgccgacgctag

SEQ ID NO: 633446 - DNA, 25 bp, Rattus norvegicus
tcgtacgggtagcttcgcaaacgcc

SEQ ID NO: 633447 - DNA, 25 bp, Rattus norvegicus
cccagcgggcgacaagatcgcgtaa

SEQ ID NO: 633448 - DNA, 25 bp, Rattus norvegicus
tctccgaacagagtaaggactgcta

SEQ ID NO: 633449 - DNA, 25 bp, Rattus norvegicus
taaggactgctatgctgtgccggtg

SEQ ID NO: 633450 - DNA, 25 bp, Rattus norvegicus
agtctcagatcaaacagcctgtgga

SEQ ID NO: 633451 - DNA, 25 bp, Rattus norvegicus
agcctgtggattttctcctctctgg

SEQ ID NO: 633452 - DNA, 25 bp, Rattus norvegicus
ctggcgctcgggtcaaaacagattg

SEQ ID NO: 633453 - DNA, 25 bp, Rattus norvegicus
agattgttcagtcacccttcccttg

SEQ ID NO: 633454 - DNA, 25 bp, Rattus norvegicus
tgccgacgtgcacttagaaacagac

SEQ ID NO: 633455 - DNA, 25 bp, Rattus norvegicus
aaaaacgccgccaagccctgtggtg

SEQ ID NO: 633456 - DNA, 25 bp, Rattus norvegicus
tgcgcacagcagagccgaagtctca

SEQ ID NO: 633457 - DNA, 25 bp, Rattus norvegicus
gtggcagccaactgtcttaactacg

SEQ ID NO: 633458 - DNA, 25 bp, Rattus norvegicus
agaccctcgtggcagccaactgtct

SEQ ID NO: 633459 - DNA, 25 bp, Rattus norvegicus
gcagccaactgtcttaactacgggc

SEQ ID NO: 633460 - DNA, 25 bp, Rattus norvegicus
cgaagaccctcgtggcagccaactg

SEQ ID NO: 633461 - DNA, 25 bp, Rattus norvegicus
actacgggctcgaagaccctcgtgg

SEQ ID NO: 633462 - DNA, 25 bp, Rattus norvegicus
accctcgtggcagccaactgtctta

SEQ ID NO: 633463 - DNA, 25 bp, Rattus norvegicus
caactgtcttaactacgggctcgaa

SEQ ID NO: 633464 - DNA, 25 bp, Rattus norvegicus
ggcagccaactgtcttaactacggg

SEQ ID NO: 633465 - DNA, 25 bp, Rattus norvegicus
tcgtggcagccaactgtcttaacta

SEQ ID NO: 633466 - DNA, 25 bp, Rattus norvegicus
gctcgaagaccctcgtggcagccaa

SEQ ID NO: 633467 - DNA, 25 bp, Rattus norvegicus
ctacgggctcgaagaccctcgtggc

SEQ ID NO: 633468 - DNA, 25 bp, Rattus norvegicus
ccaactgtcttaactacgggctcga

SEQ ID NO: 633469 - DNA, 25 bp, Rattus norvegicus
cgggctcgaagaccctcgtggcagc

SEQ ID NO: 633470 - DNA, 25 bp, Rattus norvegicus
tcgaagaccctcgtggcagccaact

SEQ ID NO: 633471 - DNA, 25 bp, Rattus norvegicus
gcgcgcagggacaatgcggcccggg

SEQ ID NO: 633472 - DNA, 25 bp, Rattus norvegicus
ctgctcccgcctttgtggtttgctg

SEQ ID NO: 633473 - DNA, 25 bp, Rattus norvegicus
tacattgcagccgaagggtgggacc

SEQ ID NO: 633474 - DNA, 25 bp, Rattus norvegicus
cagccgaagggtgggaccctcttgg

SEQ ID NO: 633475 - DNA, 25 bp, Rattus norvegicus
cactgctcccgcctttgtggtttgc

SEQ ID NO: 633476 - DNA, 25 bp, Rattus norvegicus
actgctcccgcctttgtggtttgct

SEQ ID NO: 633477 - DNA, 25 bp, Rattus norvegicus
tggagcgcgtaaggggtgggcgact

SEQ ID NO: 633478 - DNA, 25 bp, Rattus norvegicus
accgcagtcacgtggagcgcgtaag

SEQ ID NO: 633479 - DNA, 25 bp, Rattus norvegicus
caccgcagtcacgtggagcgcgtaa

SEQ ID NO: 633480 - DNA, 25 bp, Rattus norvegicus
gtttgctggaggagcggcccgccac

SEQ ID NO: 633481 - DNA, 25 bp, Rattus norvegicus
cccgcctttgtggtttgctggagga

SEQ ID NO: 633482 - DNA, 25 bp, Rattus norvegicus
cagtcacgtggagcgcgtaaggggt

SEQ ID NO: 633483 - DNA, 25 bp, Rattus norvegicus
gctcccgcctttgtggtttgctgga

SEQ ID NO: 633484 - DNA, 25 bp, Rattus norvegicus
tcccgcctttgtggtttgctggagg

SEQ ID NO: 633485 - DNA, 25 bp, Rattus norvegicus
agctccacggtacacggcttgctta

SEQ ID NO: 633486 - DNA, 25 bp, Rattus norvegicus
tctcggccagcccatcgttcagatt

SEQ ID NO: 633487 - DNA, 25 bp, Rattus norvegicus
atccagctccgtgctcgccaagatg

SEQ ID NO: 633488 - DNA, 25 bp, Rattus norvegicus
tcgttcagattcatggtgcccgcca

SEQ ID NO: 633489 - DNA, 25 bp, Rattus norvegicus
acagcggtgctagcctgagacatca

SEQ ID NO: 633490 - DNA, 25 bp, Rattus norvegicus
catcaaggggtctgactgggtcatc

SEQ ID NO: 633491 - DNA, 25 bp, Rattus norvegicus
gtcatcatgacatcgctgtggctga

SEQ ID NO: 633492 - DNA, 25 bp, Rattus norvegicus
agcgagtccgaagtgagcaggtctt

SEQ ID NO: 633493 - DNA, 25 bp, Rattus norvegicus
aaaaggtggctggtctgttctcctg

SEQ ID NO: 633494 - DNA, 25 bp, Rattus norvegicus
cgcaggtccgaacacggtactgtta

SEQ ID NO: 633495 - DNA, 25 bp, Rattus norvegicus
gaagctggagctccgctgcataagc

SEQ ID NO: 633496 - DNA, 25 bp, Rattus norvegicus
gcgcgatgttatctagcaggtcatc

SEQ ID NO: 633497 - DNA, 25 bp, Rattus norvegicus
aggtcatccatgaggttctcggcca

SEQ ID NO: 633498 - DNA, 25 bp, Rattus norvegicus
ttgctgttgtccatggagacggccc

SEQ ID NO: 633499 - DNA, 25 bp, Rattus norvegicus
ccgggtcacacactctggaatcgca

SEQ ID NO: 633500 - DNA, 25 bp, Rattus norvegicus
ccagctcggaaacagatccggagtc

SEQ ID NO: 633501 - DNA, 25 bp, Rattus norvegicus
taacacccgagataagacgccagcc

SEQ ID NO: 633502 - DNA, 25 bp, Rattus norvegicus
cccagtattgggttcctcattagaa

SEQ ID NO: 633503 - DNA, 25 bp, Rattus norvegicus
tggaatcgcagcagcccacgctggc

SEQ ID NO: 633504 - DNA, 25 bp, Rattus norvegicus
ccgcggcagcagcacaaagttatag

SEQ ID NO: 633505 - DNA, 25 bp, Rattus norvegicus
atccggagtcactggaaaggcggcc

SEQ ID NO: 633506 - DNA, 25 bp, Rattus norvegicus
gaaaacccggaccagcacgttcatc

SEQ ID NO: 633507 - DNA, 25 bp, Rattus norvegicus
gcgccaaatctctcggactgcaaga

SEQ ID NO: 633508 - DNA, 25 bp, Rattus norvegicus
tcccgctgctgccatcttgacagtt

SEQ ID NO: 633509 - DNA, 25 bp, Rattus norvegicus
atctgaggtgtattttcgcggggac

SEQ ID NO: 633510 - DNA, 25 bp, Rattus norvegicus
ccgcaggacccgctaagaagatctg

SEQ ID NO: 633511 - DNA, 25 bp, Rattus norvegicus
cctttaaagacactagcgggagaga

SEQ ID NO: 633512 - DNA, 25 bp, Rattus norvegicus
caacaggtcgggaagcgccaaatct

SEQ ID NO: 633513 - DNA, 25 bp, Rattus norvegicus
gcggcttgcactccgggccctggcc

SEQ ID NO: 633514 - DNA, 25 bp, Rattus norvegicus
gaggtcggtaaggacccggctcagc

SEQ ID NO: 633515 - DNA, 25 bp, Rattus norvegicus
gggtaattacaacccctccgcagca

SEQ ID NO: 633516 - DNA, 25 bp, Rattus norvegicus
gcgttcggcgttgcggccaccgctt

SEQ ID NO: 633517 - DNA, 25 bp, Rattus norvegicus
aaagagtagcatgggaattcggacg

SEQ ID NO: 633518 - DNA, 25 bp, Rattus norvegicus
agcacctgcctatagagccaccagt

SEQ ID NO: 633519 - DNA, 25 bp, Rattus norvegicus
aattcggacggcgacaaaggctggc

SEQ ID NO: 633520 - DNA, 25 bp, Rattus norvegicus
tagcatgggaattcggacggcgaca

SEQ ID NO: 633521 - DNA, 25 bp, Rattus norvegicus
catgggaattcggacggcgacaaag

SEQ ID NO: 633522 - DNA, 25 bp, Rattus norvegicus
cgtcaaaaagagtagcatgggaatt

SEQ ID NO: 633523 - DNA, 25 bp, Rattus norvegicus
tgacccgtcaaaaagagtagcatgg

SEQ ID NO: 633524 - DNA, 25 bp, Rattus norvegicus
ccagtgacccgtcaaaaagagtagc

SEQ ID NO: 633525 - DNA, 25 bp, Rattus norvegicus
agccaccagtgacccgtcaaaaaga

SEQ ID NO: 633526 - DNA, 25 bp, Rattus norvegicus
acctgcctatagagccaccagtgac

SEQ ID NO: 633527 - DNA, 25 bp, Rattus norvegicus
tccagtagcgctctgacaggcagcc

SEQ ID NO: 633528 - DNA, 25 bp, Rattus norvegicus
cgctctcggagctgacgagttaaga

SEQ ID NO: 633529 - DNA, 25 bp, Rattus norvegicus
gacggagccgctcttgtaataaaaa

SEQ ID NO: 633530 - DNA, 25 bp, Rattus norvegicus
tgacggggctctctcaaaacgcttt

SEQ ID NO: 633531 - DNA, 25 bp, Rattus norvegicus
tctagagtgccagacagatagattc

SEQ ID NO: 633532 - DNA, 25 bp, Rattus norvegicus
tgatattaatgaacctccaagcggc

SEQ ID NO: 633533 - DNA, 25 bp, Rattus norvegicus
gttcattaccctgtgactttgtgcc

SEQ ID NO: 633534 - DNA, 25 bp, Rattus norvegicus
gggccgcgtctctggtaatatctcc

SEQ ID NO: 633535 - DNA, 25 bp, Rattus norvegicus
cgccgagacgggaaactagatggtt

SEQ ID NO: 633536 - DNA, 25 bp, Rattus norvegicus
cgcagtctcagaggcaaagaagctc

SEQ ID NO: 633537 - DNA, 25 bp, Rattus norvegicus
agaccgctgatcttctgtggaaaga

SEQ ID NO: 633538 - DNA, 25 bp, Rattus norvegicus
cacggaaatggtcttcctacggagc

SEQ ID NO: 633539 - DNA, 25 bp, Rattus norvegicus
ttcccggctctagcaaaactgcagc

SEQ ID NO: 633540 - DNA, 25 bp, Rattus norvegicus
ccagatccgagtttccggggacagc

SEQ ID NO: 633541 - DNA, 25 bp, Rattus norvegicus
ctggctggagctttggcccttggtt

SEQ ID NO: 633542 - DNA, 25 bp, Rattus norvegicus
tgcgctggacaaaacccgctgtttg

SEQ ID NO: 633543 - DNA, 25 bp, Rattus norvegicus
tccgctcgaactgcgctggacaaaa

SEQ ID NO: 633544 - DNA, 25 bp, Rattus norvegicus
agtgagaaacttccgctcgaactgc

SEQ ID NO: 633545 - DNA, 25 bp, Rattus norvegicus
gggcaaattgtcagtgagaaacttc

SEQ ID NO: 633546 - DNA, 25 bp, Rattus norvegicus
atctatctatttggggcaaattgtc

SEQ ID NO: 633547 - DNA, 25 bp, Rattus norvegicus
gtcgctgctgacaaatctatctatt

SEQ ID NO: 633548 - DNA, 25 bp, Rattus norvegicus
ccttcccgaaggtcgctgctgacaa

SEQ ID NO: 633549 - DNA, 25 bp, Rattus norvegicus
cagaccggtggctttttgcttcctt

SEQ ID NO: 633550 - DNA, 25 bp, Rattus norvegicus
tcacagatgcgtaaaagcgcggtgc

SEQ ID NO: 633551 - DNA, 25 bp, Rattus norvegicus
gcacactcggagcacgccagcccga

SEQ ID NO: 633552 - DNA, 25 bp, Rattus norvegicus
cgggccgcacaaagggcggattaat

SEQ ID NO: 633553 - DNA, 25 bp, Rattus norvegicus
cgacccacctttagggctgcggcaa

SEQ ID NO: 633554 - DNA, 25 bp, Rattus norvegicus
ccttcagaccggtggctttttgctt

SEQ ID NO: 633555 - DNA, 25 bp, Rattus norvegicus
cgccggctttgattctcaggctgcc

SEQ ID NO: 633556 - DNA, 25 bp, Rattus norvegicus
ggcgggaaggatgggtttcaggcgc

SEQ ID NO: 633557 - DNA, 25 bp, Rattus norvegicus
ttgcagcatgatgtaatcctcattg

SEQ ID NO: 633558 - DNA, 25 bp, Rattus norvegicus
tacttgcagcatgatgtaatcctca

SEQ ID NO: 633559 - DNA, 25 bp, Rattus norvegicus
cgcatacttgcagcatgatgtaatc

SEQ ID NO: 633560 - DNA, 25 bp, Rattus norvegicus
agcatgatgtaatcctcattgaacc

SEQ ID NO: 633561 - DNA, 25 bp, Rattus norvegicus
cccgcatacttgcagcatgatgtaa

SEQ ID NO: 633562 - DNA, 25 bp, Rattus norvegicus
gcagcatgatgtaatcctcattgaa

SEQ ID NO: 633563 - DNA, 25 bp, Rattus norvegicus
agcgccggctttgattctcaggctg

SEQ ID NO: 633564 - DNA, 25 bp, Rattus norvegicus
ccagcgccggctttgattctcaggc

SEQ ID NO: 633565 - DNA, 25 bp, Rattus norvegicus
ggggcagttaaccagccgcccagcg

SEQ ID NO: 633566 - DNA, 25 bp, Rattus norvegicus
gcggggcagttaaccagccgcccag

SEQ ID NO: 633567 - DNA, 25 bp, Rattus norvegicus
tcaggcgcggggcagttaaccagcc

SEQ ID NO: 633568 - DNA, 25 bp, Rattus norvegicus
ggccttcgcatcctcacgggctact

SEQ ID NO: 633569 - DNA, 25 bp, Rattus norvegicus
gtcacccgcggtgtatgcgttgtct

SEQ ID NO: 633570 - DNA, 25 bp, Rattus norvegicus
ccgcgcgagtgagcatgtgcagacc

SEQ ID NO: 633571 - DNA, 25 bp, Rattus norvegicus
agctgcgacccttcctgggagccta

SEQ ID NO: 633572 - DNA, 25 bp, Rattus norvegicus
agcatgtgcagaccgggcgcccgct

SEQ ID NO: 633573 - DNA, 25 bp, Rattus norvegicus
gctaagaagccaagctgcgaccctt

SEQ ID NO: 633574 - DNA, 25 bp, Rattus norvegicus
agtagtatgtgtcacccgcggtgta

SEQ ID NO: 633575 - DNA, 25 bp, Rattus norvegicus
gcgttgtctcgcaagatcacccaca

SEQ ID NO: 633576 - DNA, 25 bp, Rattus norvegicus
cctccggctaagaagccaagctgcg

SEQ ID NO: 633577 - DNA, 25 bp, Rattus norvegicus
agtttgtatagatgcgactgggagc

SEQ ID NO: 633578 - DNA, 25 bp, Rattus norvegicus
cgccgcgggcaaacaagtttgtata

SEQ ID NO: 633579 - DNA, 25 bp, Rattus norvegicus
cacaggctgcgagctggatctaccc

SEQ ID NO: 633580 - DNA, 25 bp, Rattus norvegicus
gccaggaccctagcacaggctgcga

SEQ ID NO: 633581 - DNA, 25 bp, Rattus norvegicus
tgatcccggggtgagtcctgtcttc

SEQ ID NO: 633582 - DNA, 25 bp, Rattus norvegicus
ttatcttggcggtggcgagtagtat

SEQ ID NO: 633583 - DNA, 25 bp, Rattus norvegicus
gccgcagctccctccagatttgtaa

SEQ ID NO: 633584 - DNA, 25 bp, Rattus norvegicus
tgctccctgctcctggtttaagtcg

SEQ ID NO: 633585 - DNA, 25 bp, Rattus norvegicus
tgtgcgagccatttagaagcatttg

SEQ ID NO: 633586 - DNA, 25 bp, Rattus norvegicus
acaggcctgaaatcacccaagggtg

SEQ ID NO: 633587 - DNA, 25 bp, Rattus norvegicus
taccttctgggttccacaggcctga

SEQ ID NO: 633588 - DNA, 25 bp, Rattus norvegicus
ttagaacaaactagcgtgcgccggc

SEQ ID NO: 633589 - DNA, 25 bp, Rattus norvegicus
gggtacttttcaatgcagcgccgca

SEQ ID NO: 633590 - DNA, 25 bp, Rattus norvegicus
tcccacggtgcaaaaatcaggcatg

SEQ ID NO: 633591 - DNA, 25 bp, Rattus norvegicus
ctgcgtgcggaagatcgtgttccca

SEQ ID NO: 633592 - DNA, 25 bp, Rattus norvegicus
ctgctgccgcccgaagatattttgc

SEQ ID NO: 633593 - DNA, 25 bp, Rattus norvegicus
agaagcatttggctcggtctgctgc

SEQ ID NO: 633594 - DNA, 25 bp, Rattus norvegicus
gtgctcgctaatgctccgtgggaga

SEQ ID NO: 633595 - DNA, 25 bp, Rattus norvegicus
gtcatcctacgtcgtggggctcagc

SEQ ID NO: 633596 - DNA, 25 bp, Rattus norvegicus
ttgtaatccgccaaaaagccgctga

SEQ ID NO: 633597 - DNA, 25 bp, Rattus norvegicus
cgcctccggtttgcagattcctgca

SEQ ID NO: 633598 - DNA, 25 bp, Rattus norvegicus
cacagtctaccggactggcctgctg

SEQ ID NO: 633599 - DNA, 25 bp, Rattus norvegicus
atcggcccacgatggtcctcagctt

SEQ ID NO: 633600 - DNA, 25 bp, Rattus norvegicus
gtttgcagattcctgcagggtctcc

SEQ ID NO: 633601 - DNA, 25 bp, Rattus norvegicus
agccagcaacctgccgacgcgtggt

SEQ ID NO: 633602 - DNA, 25 bp, Rattus norvegicus
agcaacctgccgacgcgtggtgaag

SEQ ID NO: 633603 - DNA, 25 bp, Rattus norvegicus
cccggagcggagagccatgcaaact

SEQ ID NO: 633604 - DNA, 25 bp, Rattus norvegicus
gcggagagccatgcaaactccaatc

SEQ ID NO: 633605 - DNA, 25 bp, Rattus norvegicus
atgcaaactccaatcctcgccaagg

SEQ ID NO: 633606 - DNA, 25 bp, Rattus norvegicus
caatcctcgccaaggccatggtcga

SEQ ID NO: 633607 - DNA, 25 bp, Rattus norvegicus
ccaaggccatggtcgaggcgccaag

SEQ ID NO: 633608 - DNA, 25 bp, Rattus norvegicus
aagggaagagttggaaatcgctagc

SEQ ID NO: 633609 - DNA, 25 bp, Rattus norvegicus
cctccgccagccctgatcggcccac

SEQ ID NO: 633610 - DNA, 25 bp, Rattus norvegicus
ggcgcaccctgctgtctacgctcct

SEQ ID NO: 633611 - DNA, 25 bp, Rattus norvegicus
gtatttccggcgaggttcacacctg

SEQ ID NO: 633612 - DNA, 25 bp, Rattus norvegicus
acgtggaggatgcagtgagtatttc

SEQ ID NO: 633613 - DNA, 25 bp, Rattus norvegicus
cgcacttgtgcatcgacgtggagga

SEQ ID NO: 633614 - DNA, 25 bp, Rattus norvegicus
atgcagaaaatgaacgggctggaga

SEQ ID NO: 633615 - DNA, 25 bp, Rattus norvegicus
gcctcctgtacagcgaaatgcagaa

SEQ ID NO: 633616 - DNA, 25 bp, Rattus norvegicus
acgtgcagggaagctgtgtccacta

SEQ ID NO: 633617 - DNA, 25 bp, Rattus norvegicus
agaactctgagcctcctgtacagcg

SEQ ID NO: 633618 - DNA, 25 bp, Rattus norvegicus
ctgtaaagaggcgtacagaactctg

SEQ ID NO: 633619 - DNA, 25 bp, Rattus norvegicus
ctcagaagtgtgcaagaactgtaaa

SEQ ID NO: 633620 - DNA, 25 bp, Rattus norvegicus
cccaccaaagaattactcagaagtg

SEQ ID NO: 633621 - DNA, 25 bp, Rattus norvegicus
tttgtcatttcaggggcgcacgtac

SEQ ID NO: 633622 - DNA, 25 bp, Rattus norvegicus
accgtgtgtcttacctttgtcattt

SEQ ID NO: 633623 - DNA, 25 bp, Rattus norvegicus
ctgtgtccactacgtaccgtgtgtc

SEQ ID NO: 633624 - DNA, 25 bp, Rattus norvegicus
cacctggcagccgttgaatgcactt

SEQ ID NO: 633625 - DNA, 25 bp, Rattus norvegicus
gcggggtccaacagagtttcttcgc

SEQ ID NO: 633626 - DNA, 25 bp, Rattus norvegicus
ggctcactactcaggagaccctggc

SEQ ID NO: 633627 - DNA, 25 bp, Rattus norvegicus
cactactcaggagaccctggcagga

SEQ ID NO: 633628 - DNA, 25 bp, Rattus norvegicus
ctcaggagaccctggcaggaaggct

SEQ ID NO: 633629 - DNA, 25 bp, Rattus norvegicus
ctccgggaatctggcgaagggtgcc

SEQ ID NO: 633630 - DNA, 25 bp, Rattus norvegicus
ccgggaaggaaagccgggcaagcag

SEQ ID NO: 633631 - DNA, 25 bp, Rattus norvegicus
aaatagagggcgtggcccgtggctc

SEQ ID NO: 633632 - DNA, 25 bp, Rattus norvegicus
gggtccaacagagtttcttcgctgc

SEQ ID NO: 633633 - DNA, 25 bp, Rattus norvegicus
tccaacagagtttcttcgctgcgcg

SEQ ID NO: 633634 - DNA, 25 bp, Rattus norvegicus
aacagagtttcttcgctgcgcgcgc

SEQ ID NO: 633635 - DNA, 25 bp, Rattus norvegicus
cacgtctccctctgcgagcgtgtgg

SEQ ID NO: 633636 - DNA, 25 bp, Rattus norvegicus
agccggcaggggagggaacagccgc

SEQ ID NO: 633637 - DNA, 25 bp, Rattus norvegicus
tggggcgggaactagctcctctcgc

SEQ ID NO: 633638 - DNA, 25 bp, Rattus norvegicus
cgggcctatggcaaatagagggcgt

SEQ ID NO: 633639 - DNA, 25 bp, Rattus norvegicus
atctgcttccgtacccttaagctca

SEQ ID NO: 633640 - DNA, 25 bp, Rattus norvegicus
gccaacctacggagacctgaaccat

SEQ ID NO: 633641 - DNA, 25 bp, Rattus norvegicus
ctgaacgccgaccttcggaagctgg

SEQ ID NO: 633642 - DNA, 25 bp, Rattus norvegicus
tcggaagctggctgtcaacatggtg

SEQ ID NO: 633643 - DNA, 25 bp, Rattus norvegicus
ctccacttctttatgcctggctttg

SEQ ID NO: 633644 - DNA, 25 bp, Rattus norvegicus
tcaccagccgtggaagccagcagta

SEQ ID NO: 633645 - DNA, 25 bp, Rattus norvegicus
gtaccgggccctcactgtgcctgaa

SEQ ID NO: 633646 - DNA, 25 bp, Rattus norvegicus
ggtacctcacggttgcggctgtctt

SEQ ID NO: 633647 - DNA, 25 bp, Rattus norvegicus
ccgcgaggcctcaagatggcagtca

SEQ ID NO: 633648 - DNA, 25 bp, Rattus norvegicus
cggctgtcttccgtggacggatgtc

SEQ ID NO: 633649 - DNA, 25 bp, Rattus norvegicus
gagcaaatgctcaacgtgcagaata

SEQ ID NO: 633650 - DNA, 25 bp, Rattus norvegicus
agcagctacttcgtggaatggatcc

SEQ ID NO: 633651 - DNA, 25 bp, Rattus norvegicus
ggctgtctgtgacatcccaccgcga

SEQ ID NO: 633652 - DNA, 25 bp, Rattus norvegicus
tggcagtcaccttcatcggaaacag

SEQ ID NO: 633653 - DNA, 25 bp, Rattus norvegicus
ccggcctcagcttttgttgggtgtt

SEQ ID NO: 633654 - DNA, 25 bp, Rattus norvegicus
acttccaagtgagctcaccagcagc

SEQ ID NO: 633655 - DNA, 25 bp, Rattus norvegicus
agtttggcttggaccggctccgcat

SEQ ID NO: 633656 - DNA, 25 bp, Rattus norvegicus
tcatttgttcaatcacgtcgcgggg

SEQ ID NO: 633657 - DNA, 25 bp, Rattus norvegicus
gaccggctccgcattgttctggatg

SEQ ID NO: 633658 - DNA, 25 bp, Rattus norvegicus
ctccgcattgttctggatgctcgtc

SEQ ID NO: 633659 - DNA, 25 bp, Rattus norvegicus
gatgctcgtcgcctgctgcctcttt

SEQ ID NO: 633660 - DNA, 25 bp, Rattus norvegicus
gaaaaggagcgtgcgggcaccactt

SEQ ID NO: 633661 - DNA, 25 bp, Rattus norvegicus
tgcgggcaccactttgcatccttcg

SEQ ID NO: 633662 - DNA, 25 bp, Rattus norvegicus
tgcatccttcgctcccgccacccat

SEQ ID NO: 633663 - DNA, 25 bp, Rattus norvegicus
ccgctgcagctgttgggacagatgt

SEQ ID NO: 633664 - DNA, 25 bp, Rattus norvegicus
cggcgtgtttgggacttccaagtga

SEQ ID NO: 633665 - DNA, 25 bp, Rattus norvegicus
tttgggacttccaagtgagctcacc

SEQ ID NO: 633666 - DNA, 25 bp, Rattus norvegicus
cattgttctggatgctcgtcgcctg

SEQ ID NO: 633667 - DNA, 25 bp, Rattus norvegicus
ccttctctgcgggttttggcacagg

SEQ ID NO: 633668 - DNA, 25 bp, Rattus norvegicus
catggcagccttctctgcgggtttt

SEQ ID NO: 633669 - DNA, 25 bp, Rattus norvegicus
tttggcacaggctggatcacgcagc

SEQ ID NO: 633670 - DNA, 25 bp, Rattus norvegicus
caggctggatcacgcagccggtctt

SEQ ID NO: 633671 - DNA, 25 bp, Rattus norvegicus
gtcttgggcagcatccgcagagcat

SEQ ID NO: 633672 - DNA, 25 bp, Rattus norvegicus
atccgcagagcataggcgtggtcct

SEQ ID NO: 633673 - DNA, 25 bp, Rattus norvegicus
taaggttcgggtctgacttgtcgcc

SEQ ID NO: 633674 - DNA, 25 bp, Rattus norvegicus
tggcagttggaagcgcagttgttct

SEQ ID NO: 633675 - DNA, 25 bp, Rattus norvegicus
aagcgcagttgttctccttgaccga

SEQ ID NO: 633676 - DNA, 25 bp, Rattus norvegicus
ttgttctccttgaccgactccagct

SEQ ID NO: 633677 - DNA, 25 bp, Rattus norvegicus
gctcctcgggcgacagcagcttttt

SEQ ID NO: 633678 - DNA, 25 bp, Rattus norvegicus
gggtgccgttcacgatgacgttgca

SEQ ID NO: 633679 - DNA, 25 bp, Rattus norvegicus
ctccgccttgacgtgagcgtgcagc

SEQ ID NO: 633680 - DNA, 25 bp, Rattus norvegicus
tgacgcacggcgtcatggcagcctt

SEQ ID NO: 633681 - DNA, 25 bp, Rattus norvegicus
actgcaatgggatacctccgtgccg

SEQ ID NO: 633682 - DNA, 25 bp, Rattus norvegicus
ggtgggacgctttcgtgctgtggga

SEQ ID NO: 633683 - DNA, 25 bp, Rattus norvegicus
tcctccgtgcggtgggacgctttcg

SEQ ID NO: 633684 - DNA, 25 bp, Rattus norvegicus
gaacgccttcgtgccgtgggacgcc

SEQ ID NO: 633685 - DNA, 25 bp, Rattus norvegicus
tacctccgtgccgtggaacgccttc

SEQ ID NO: 633686 - DNA, 25 bp, Rattus norvegicus
ggatacctccgtgccgtggaacgcc

SEQ ID NO: 633687 - DNA, 25 bp, Rattus norvegicus
aatgggatacctccgtgccgtggaa

SEQ ID NO: 633688 - DNA, 25 bp, Rattus norvegicus
tgcaatgggatacctccgtgccgtg

SEQ ID NO: 633689 - DNA, 25 bp, Rattus norvegicus
ccactgcaatgggatacctccgtgc

SEQ ID NO: 633690 - DNA, 25 bp, Rattus norvegicus
tcggcccactgcaatgggatacctc

SEQ ID NO: 633691 - DNA, 25 bp, Rattus norvegicus
ggcccactgcaatgggatacctccg

SEQ ID NO: 633692 - DNA, 25 bp, Rattus norvegicus
cttcggcccactgcaatgggatacc

SEQ ID NO: 633693 - DNA, 25 bp, Rattus norvegicus
gtcttcggcccactgcaatgggata

SEQ ID NO: 633694 - DNA, 25 bp, Rattus norvegicus
aggtcttcggcccactgcaatggga

SEQ ID NO: 633695 - DNA, 25 bp, Rattus norvegicus
cggacggaataaagagctcggtctc

SEQ ID NO: 633696 - DNA, 25 bp, Rattus norvegicus
cctcgggaaagcctctgtaccaagc

SEQ ID NO: 633697 - DNA, 25 bp, Rattus norvegicus
ctgccatgtttttgtgtctggtttc

SEQ ID NO: 633698 - DNA, 25 bp, Rattus norvegicus
gtgagctggtttccggctcctttta

SEQ ID NO: 633699 - DNA, 25 bp, Rattus norvegicus
tgtaccaagctcactcgccactggg

SEQ ID NO: 633700 - DNA, 25 bp, Rattus norvegicus
agccatcttcctgcgctctgtctgt

SEQ ID NO: 633701 - DNA, 25 bp, Rattus norvegicus
cccgagtccgaaaataccttcatct

SEQ ID NO: 633702 - DNA, 25 bp, Rattus norvegicus
gcagcctacacaacagcccgaaggg

SEQ ID NO: 633703 - DNA, 25 bp, Rattus norvegicus
ccagggacccggcagaaactgacaa

SEQ ID NO: 633704 - DNA, 25 bp, Rattus norvegicus
gtgagttggcttcggctttgcacct

SEQ ID NO: 633705 - DNA, 25 bp, Rattus norvegicus
cagatttcggagatgcagcccgtga

SEQ ID NO: 633706 - DNA, 25 bp, Rattus norvegicus
gcccggcaacatctgtgcggatcta

SEQ ID NO: 633707 - DNA, 25 bp, Rattus norvegicus
gcccgaaggagtcgtcagccatctt

SEQ ID NO: 633708 - DNA, 25 bp, Rattus norvegicus
tttccctcttcacagggtgagctgg

SEQ ID NO: 633709 - DNA, 25 bp, Rattus norvegicus
gccgcgactccatggcgttccggga

SEQ ID NO: 633710 - DNA, 25 bp, Rattus norvegicus
agcaactctcgtcccaggtgagtgc

SEQ ID NO: 633711 - DNA, 25 bp, Rattus norvegicus
tttgtgcccgctcggaacgccgcga

SEQ ID NO: 633712 - DNA, 25 bp, Rattus norvegicus
agcgccaccgccgagcgtcccaaaa

SEQ ID NO: 633713 - DNA, 25 bp, Rattus norvegicus
tcggaacgccgcgactccatggcgt

SEQ ID NO: 633714 - DNA, 25 bp, Rattus norvegicus
aaagtagcaactctcgtcccaggtg

SEQ ID NO: 633715 - DNA, 25 bp, Rattus norvegicus
cgctccgcaaagtagcaactctcgt

SEQ ID NO: 633716 - DNA, 25 bp, Rattus norvegicus
caaagagaggggaaaatacacggcg

SEQ ID NO: 633717 - DNA, 25 bp, Rattus norvegicus
ctttctcgtgggtgcgagccgccct

SEQ ID NO: 633718 - DNA, 25 bp, Rattus norvegicus
tctaaccgggagagcacgtagcgga

SEQ ID NO: 633719 - DNA, 25 bp, Rattus norvegicus
actgaggccacgctctaaccgggag

SEQ ID NO: 633720 - DNA, 25 bp, Rattus norvegicus
ccctggggtgagagagaaaagtaga

SEQ ID NO: 633721 - DNA, 25 bp, Rattus norvegicus
gcggaaaagacacgccgcgtcgcct

SEQ ID NO: 633722 - DNA, 25 bp, Rattus norvegicus
ggtcgctcgcgctagaccggcctgt

SEQ ID NO: 633723 - DNA, 25 bp, Rattus norvegicus
cccgtgcgcgcatatagtaggcctt

SEQ ID NO: 633724 - DNA, 25 bp, Rattus norvegicus
agtaggccttcacgatccctgaggg

SEQ ID NO: 633725 - DNA, 25 bp, Rattus norvegicus
gctttggcctcctcagcgttccata

SEQ ID NO: 633726 - DNA, 25 bp, Rattus norvegicus
gcgcgcatatagtaggccttcacga

SEQ ID NO: 633727 - DNA, 25 bp, Rattus norvegicus
ccgcgtgagcccgtgcgcgcatata

SEQ ID NO: 633728 - DNA, 25 bp, Rattus norvegicus
actttctccaggtccgctttggcct

SEQ ID NO: 633729 - DNA, 25 bp, Rattus norvegicus
ggatggctccaactccagcactttc

SEQ ID NO: 633730 - DNA, 25 bp, Rattus norvegicus
ccttgcgcatggatggctccaactc

SEQ ID NO: 633731 - DNA, 25 bp, Rattus norvegicus
accgccttgcgcatggatggctcca

SEQ ID NO: 633732 - DNA, 25 bp, Rattus norvegicus
ctcagttccctgagcaccgccttgc

SEQ ID NO: 633733 - DNA, 25 bp, Rattus norvegicus
tcctcctcctgcttgtccgccaggc

SEQ ID NO: 633734 - DNA, 25 bp, Rattus norvegicus
tcacgatccctgaggggaaaagcgc

SEQ ID NO: 633735 - DNA, 25 bp, Rattus norvegicus
tctccagcaatctcagttccctgag

SEQ ID NO: 633736 - DNA, 25 bp, Rattus norvegicus
tcagcgttccatacctccgcgtgag

SEQ ID NO: 633737 - DNA, 25 bp, Rattus norvegicus
gcgccttggatgaccacactgtcga

SEQ ID NO: 633738 - DNA, 25 bp, Rattus norvegicus
ccgaatctgtgtgtctgcaggcagc

SEQ ID NO: 633739 - DNA, 25 bp, Rattus norvegicus
tcctcagccgtgtaaccgctcgtta

SEQ ID NO: 633740 - DNA, 25 bp, Rattus norvegicus
cctggcctccagttggttaggacta

SEQ ID NO: 633741 - DNA, 25 bp, Rattus norvegicus
taggactacagctacgaaacccttc

SEQ ID NO: 633742 - DNA, 25 bp, Rattus norvegicus
cggaggcggacttctaataaagatc

SEQ ID NO: 633743 - DNA, 25 bp, Rattus norvegicus
ggtcaaaagaaactggacactccac

SEQ ID NO: 633744 - DNA, 25 bp, Rattus norvegicus
tgcaggcagctagctgcacccaagc

SEQ ID NO: 633745 - DNA, 25 bp, Rattus norvegicus
tgcacccaagccctgggacgcatag

SEQ ID NO: 633746 - DNA, 25 bp, Rattus norvegicus
gacgcatagcgtgggccagctcaat

SEQ ID NO: 633747 - DNA, 25 bp, Rattus norvegicus
ttcgaggggcaacccgaggcaagcc

SEQ ID NO: 633748 - DNA, 25 bp, Rattus norvegicus
gcaagcccgactctgcggaaccgga

SEQ ID NO: 633749 - DNA, 25 bp, Rattus norvegicus
atccgagtacggtggctccgtcaca

SEQ ID NO: 633750 - DNA, 25 bp, Rattus norvegicus
cggccaagcccacgcagaaagagtg

SEQ ID NO: 633751 - DNA, 25 bp, Rattus norvegicus
agggacctgccaagcctgcccagtt

SEQ ID NO: 633752 - DNA, 25 bp, Rattus norvegicus
tccacgcaccgagcatccagagagt

SEQ ID NO: 633753 - DNA, 25 bp, Rattus norvegicus
tggctgtcccggtatataaggtccc

SEQ ID NO: 633754 - DNA, 25 bp, Rattus norvegicus
tgttccctaggtccgggtggatgct

SEQ ID NO: 633755 - DNA, 25 bp, Rattus norvegicus
cacgtcacggctattgtggctgtcc

SEQ ID NO: 633756 - DNA, 25 bp, Rattus norvegicus
ggaaaccctagctgggtcacagccc

SEQ ID NO: 633757 - DNA, 25 bp, Rattus norvegicus
cgcggcttcgacttttcctgttggg

SEQ ID NO: 633758 - DNA, 25 bp, Rattus norvegicus
cctgcagcgggcacttgagaaaacc

SEQ ID NO: 633759 - DNA, 25 bp, Rattus norvegicus
gaccgaaactcagtccctctcagtg

SEQ ID NO: 633760 - DNA, 25 bp, Rattus norvegicus
ccgtgcgcagttggctgttccctag

SEQ ID NO: 633761 - DNA, 25 bp, Rattus norvegicus
gtgcgctctgctgaatgcagcacta

SEQ ID NO: 633762 - DNA, 25 bp, Rattus norvegicus
ccgagcatactcacggctggggtcc

SEQ ID NO: 633763 - DNA, 25 bp, Rattus norvegicus
cgtggagattatttggaccgaaact

SEQ ID NO: 633764 - DNA, 25 bp, Rattus norvegicus
tgcagcactagaccagctcaaaaca

SEQ ID NO: 633765 - DNA, 25 bp, Rattus norvegicus
gagcagagctgtcccagcacacgtg

SEQ ID NO: 633766 - DNA, 25 bp, Rattus norvegicus
gctgtcccagcacacgtgcagcagg

SEQ ID NO: 633767 - DNA, 25 bp, Rattus norvegicus
gagctgtcccagcacacgtgcagca

SEQ ID NO: 633768 - DNA, 25 bp, Rattus norvegicus
tcccagcacacgtgcagcaggatag

SEQ ID NO: 633769 - DNA, 25 bp, Rattus norvegicus
gtcccagcacacgtgcagcaggata

SEQ ID NO: 633770 - DNA, 25 bp, Rattus norvegicus
gcacacgtgcagcaggatagaccga

SEQ ID NO: 633771 - DNA, 25 bp, Rattus norvegicus
gtcccagcacacatgcagcaggata

SEQ ID NO: 633772 - DNA, 25 bp, Rattus norvegicus
acacgtgcagcaggatagaccgagc

SEQ ID NO: 633773 - DNA, 25 bp, Rattus norvegicus
tagaccgagcacagctgtcccagca

SEQ ID NO: 633774 - DNA, 25 bp, Rattus norvegicus
cgtgcagcaggatagaccgagcaca

SEQ ID NO: 633775 - DNA, 25 bp, Rattus norvegicus
gagcacagctgtcccagcacacgtg

SEQ ID NO: 633776 - DNA, 25 bp, Rattus norvegicus
cacgtgcagcaggatagacggagca

SEQ ID NO: 633777 - DNA, 25 bp, Rattus norvegicus
agagctgtcccagcacacgtgcagc

SEQ ID NO: 633778 - DNA, 25 bp, Rattus norvegicus
atagaccgagcagagctgtcccagc

SEQ ID NO: 633779 - DNA, 25 bp, Rattus norvegicus
ggtccctaagcgagcacagcagcga

SEQ ID NO: 633780 - DNA, 25 bp, Rattus norvegicus
cggaaatgatccctgcacacgattg

SEQ ID NO: 633781 - DNA, 25 bp, Rattus norvegicus
acgagcgcctcgattggtcgatttc

SEQ ID NO: 633782 - DNA, 25 bp, Rattus norvegicus
ggcgcagacatcttggatcctcacg

SEQ ID NO: 633783 - DNA, 25 bp, Rattus norvegicus
tcaccggcgttacatgggcgcagac

SEQ ID NO: 633784 - DNA, 25 bp, Rattus norvegicus
cagaggaagaagtcaacgtcggtca

SEQ ID NO: 633785 - DNA, 25 bp, Rattus norvegicus
cagtaccacaggatcccagagcaga

SEQ ID NO: 633786 - DNA, 25 bp, Rattus norvegicus
agtccggcccagcatagtcctctga

SEQ ID NO: 633787 - DNA, 25 bp, Rattus norvegicus
tcccactcaggaatgtaggcggcca

SEQ ID NO: 633788 - DNA, 25 bp, Rattus norvegicus
cgtaagagcctaggttcgaatccca

SEQ ID NO: 633789 - DNA, 25 bp, Rattus norvegicus
aatttctcttgacgtggctgactcc

SEQ ID NO: 633790 - DNA, 25 bp, Rattus norvegicus
tgcaattccactccacggctcgggg

SEQ ID NO: 633791 - DNA, 25 bp, Rattus norvegicus
tgagaaaccgttcccaaatcgcgcg

SEQ ID NO: 633792 - DNA, 25 bp, Rattus norvegicus
cttgaaatggcttgtctgagaaacc

SEQ ID NO: 633793 - DNA, 25 bp, Rattus norvegicus
acgatgctctgctcggtggacgcac

SEQ ID NO: 633794 - DNA, 25 bp, Rattus norvegicus
agagaagactttgtcctgcggcaga

SEQ ID NO: 633795 - DNA, 25 bp, Rattus norvegicus
ctgcggcagagaagaaagcatgctt

SEQ ID NO: 633796 - DNA, 25 bp, Rattus norvegicus
gcatgcttgagaaaagtgtgctttt

SEQ ID NO: 633797 - DNA, 25 bp, Rattus norvegicus
aaagtgtgcttttctccagccgcga

SEQ ID NO: 633798 - DNA, 25 bp, Rattus norvegicus
actccgccgctgttgatgtccctgt

SEQ ID NO: 633799 - DNA, 25 bp, Rattus norvegicus
cgctgttgatgtccctgttctcttt

SEQ ID NO: 633800 - DNA, 25 bp, Rattus norvegicus
agaagtgctaaacgatgtgctcatc

SEQ ID NO: 633801 - DNA, 25 bp, Rattus norvegicus
ctctttgtcgtttgcttctgaggtc

SEQ ID NO: 633802 - DNA, 25 bp, Rattus norvegicus
ttctgaggtcgtctgaggctcaccc

SEQ ID NO: 633803 - DNA, 25 bp, Rattus norvegicus
cttcccattaccgttagcgtgcagg

SEQ ID NO: 633804 - DNA, 25 bp, Rattus norvegicus
ttaccgttagcgtgcagggacttga

SEQ ID NO: 633805 - DNA, 25 bp, Rattus norvegicus
tgcagggacttgaagacgatgctct

SEQ ID NO: 633806 - DNA, 25 bp, Rattus norvegicus
tgctcatcgtgtggacggacgtcac

SEQ ID NO: 633807 - DNA, 25 bp, Rattus norvegicus
acagttctcggcagcctagagggga

SEQ ID NO: 633808 - DNA, 25 bp, Rattus norvegicus
gggttcctgaatacccgccgcctgc

SEQ ID NO: 633809 - DNA, 25 bp, Rattus norvegicus
ggccgcaccctgttgcagcaacaga

SEQ ID NO: 633810 - DNA, 25 bp, Rattus norvegicus
accctgttgcagcaacagacgcgac

SEQ ID NO: 633811 - DNA, 25 bp, Rattus norvegicus
ctcgggtccgcagcacagttctcgg

SEQ ID NO: 633812 - DNA, 25 bp, Rattus norvegicus
cgggtccgcagcacagttctcggca

SEQ ID NO: 633813 - DNA, 25 bp, Rattus norvegicus
ggtccgcagcacagttctcggcagc

SEQ ID NO: 633814 - DNA, 25 bp, Rattus norvegicus
gcagcacagttctcggcagcctaga

SEQ ID NO: 633815 - DNA, 25 bp, Rattus norvegicus
cagcacagttctcggcagcctagag

SEQ ID NO: 633816 - DNA, 25 bp, Rattus norvegicus
tctcggcagcctagaggggatgcca

SEQ ID NO: 633817 - DNA, 25 bp, Rattus norvegicus
cctagaggggatgccagacgttccc

SEQ ID NO: 633818 - DNA, 25 bp, Rattus norvegicus
ccaagcactggcctggtagccccgc

SEQ ID NO: 633819 - DNA, 25 bp, Rattus norvegicus
cagcctagaggggatgccagacgtt

SEQ ID NO: 633820 - DNA, 25 bp, Rattus norvegicus
acgccttccactcgggttcctgaat

SEQ ID NO: 633821 - DNA, 25 bp, Rattus norvegicus
ccctcttgtgctcaggcttgatctc

SEQ ID NO: 633822 - DNA, 25 bp, Rattus norvegicus
caggcttgatctcaggcagcagcga

SEQ ID NO: 633823 - DNA, 25 bp, Rattus norvegicus
cagcgagctgcttttgaccgtgagc

SEQ ID NO: 633824 - DNA, 25 bp, Rattus norvegicus
cgacccttccgcttggtgggcgact

SEQ ID NO: 633825 - DNA, 25 bp, Rattus norvegicus
ccgaggctgagcctccgtcgggaac

SEQ ID NO: 633826 - DNA, 25 bp, Rattus norvegicus
tcgggaaccgcttgaaccgatttca

SEQ ID NO: 633827 - DNA, 25 bp, Rattus norvegicus
ttcctttccgccgtgcagttctcag

SEQ ID NO: 633828 - DNA, 25 bp, Rattus norvegicus
cggccgcttgacctcttttccatgt

SEQ ID NO: 633829 - DNA, 25 bp, Rattus norvegicus
tttagcactttggtgggatgcgcgc

SEQ ID NO: 633830 - DNA, 25 bp, Rattus norvegicus
ttttccatgtcgtccgaatcctcgc

SEQ ID NO: 633831 - DNA, 25 bp, Rattus norvegicus
gaatcctcgcagcaatcgtctgtcc

SEQ ID NO: 633832 - DNA, 25 bp, Rattus norvegicus
cagtcttgctcaagtagatgtccaa

SEQ ID NO: 633833 - DNA, 25 bp, Rattus norvegicus
gtagatgtccaactttagcactttg

SEQ ID NO: 633834 - DNA, 25 bp, Rattus norvegicus
ggatttctgcgacttcctccgccga

SEQ ID NO: 633835 - DNA, 25 bp, Rattus norvegicus
ggcccagcctcgctggaagaactca

SEQ ID NO: 633836 - DNA, 25 bp, Rattus norvegicus
ggacgaattttgcaaaaccggctga

SEQ ID NO: 633837 - DNA, 25 bp, Rattus norvegicus
cctaccggacatctcgggaactgcg

SEQ ID NO: 633838 - DNA, 25 bp, Rattus norvegicus
ctggaagaactcacctgggcgctag

SEQ ID NO: 633839 - DNA, 25 bp, Rattus norvegicus
cagaagtgtccgagcctcaggtacc

SEQ ID NO: 633840 - DNA, 25 bp, Rattus norvegicus
gggctcaggtgctgtcctcccaggc

SEQ ID NO: 633841 - DNA, 25 bp, Rattus norvegicus
tctcgtgcctcttctgcgggctcag

SEQ ID NO: 633842 - DNA, 25 bp, Rattus norvegicus
gagacagcggcatctcctctcgtgc

SEQ ID NO: 633843 - DNA, 25 bp, Rattus norvegicus
cgatggtggagacagcggcatctcc

SEQ ID NO: 633844 - DNA, 25 bp, Rattus norvegicus
gactgcttcttcttggagcgccaga

SEQ ID NO: 633845 - DNA, 25 bp, Rattus norvegicus
agctggacgacggagactgcttctt

SEQ ID NO: 633846 - DNA, 25 bp, Rattus norvegicus
gaacacgcagcgcttacctgatctc

SEQ ID NO: 633847 - DNA, 25 bp, Rattus norvegicus
gggcgtccgaacacgcagcgcttac

SEQ ID NO: 633848 - DNA, 25 bp, Rattus norvegicus
aaccggctgaaccacggagcaggga

SEQ ID NO: 633849 - DNA, 25 bp, Rattus norvegicus
gagctcaggcgctccttgtctctgc

SEQ ID NO: 633850 - DNA, 25 bp, Rattus norvegicus
ctgttcttctacaactgacaaccgg

SEQ ID NO: 633851 - DNA, 25 bp, Rattus norvegicus
cgggaacaccaacgtacgcgttctg

SEQ ID NO: 633852 - DNA, 25 bp, Rattus norvegicus
acgtacgcgttctgttggtccaaga

SEQ ID NO: 633853 - DNA, 25 bp, Rattus norvegicus
cagcggactcaatgcgagctcaggc

SEQ ID NO: 633854 - DNA, 25 bp, Rattus norvegicus
cctcgggtaaagctcatgtgtgtgt

SEQ ID NO: 633855 - DNA, 25 bp, Rattus norvegicus
ttgtctctgcgcacgctcaggagca

SEQ ID NO: 633856 - DNA, 25 bp, Rattus norvegicus
ctcaggagcagctcgggtcttgccc

SEQ ID NO: 633857 - DNA, 25 bp, Rattus norvegicus
gaagtgcccgctgggctgttttctg

SEQ ID NO: 633858 - DNA, 25 bp, Rattus norvegicus
agcggacgtctcagggtcctttatt

SEQ ID NO: 633859 - DNA, 25 bp, Rattus norvegicus
tgtgatcccggtagacccaacccga

SEQ ID NO: 633860 - DNA, 25 bp, Rattus norvegicus
cagagccggcacctcgggtaaagct

SEQ ID NO: 633861 - DNA, 25 bp, Rattus norvegicus
agcggccggtgtaaagagcgcaccc

SEQ ID NO: 633862 - DNA, 25 bp, Rattus norvegicus
tccaagaaggaaaccagcggactca

SEQ ID NO: 633863 - DNA, 25 bp, Rattus norvegicus
tgctggcgagcgactgactgctctt

SEQ ID NO: 633864 - DNA, 25 bp, Rattus norvegicus
gctagcttcctgtcgcggcagaatg

SEQ ID NO: 633865 - DNA, 25 bp, Rattus norvegicus
agtcctccggatcgctagcttcctg

SEQ ID NO: 633866 - DNA, 25 bp, Rattus norvegicus
tgcgattgtattctaagtcctccgg

SEQ ID NO: 633867 - DNA, 25 bp, Rattus norvegicus
catgtttactcacactgcgattgta

SEQ ID NO: 633868 - DNA, 25 bp, Rattus norvegicus
ggcgcttgccctccatgtttactca

SEQ ID NO: 633869 - DNA, 25 bp, Rattus norvegicus
tcttacttcccttcgcaggcgcttg

SEQ ID NO: 633870 - DNA, 25 bp, Rattus norvegicus
cacggactgggaatcttcttacttc

SEQ ID NO: 633871 - DNA, 25 bp, Rattus norvegicus
tgcaaatggatttcaacacggactg

SEQ ID NO: 633872 - DNA, 25 bp, Rattus norvegicus
ccgcggcagcttcctctgtttgcaa

SEQ ID NO: 633873 - DNA, 25 bp, Rattus norvegicus
cttctttaccaactctgacggtctg

SEQ ID NO: 633874 - DNA, 25 bp, Rattus norvegicus
gctgctcttgcgtctcggcgacact

SEQ ID NO: 633875 - DNA, 25 bp, Rattus norvegicus
gctgagctgtactgacgcgcacctc

SEQ ID NO: 633876 - DNA, 25 bp, Rattus norvegicus
gacggtctgattcactcctaccagc

SEQ ID NO: 633877 - DNA, 25 bp, Rattus norvegicus
gtttcaaatccgctgtggtgggcta

SEQ ID NO: 633878 - DNA, 25 bp, Rattus norvegicus
gggccgcgcggagtttcaaatccgc

SEQ ID NO: 633879 - DNA, 25 bp, Rattus norvegicus
ccaatgggctgcaagtgccaggacg

SEQ ID NO: 633880 - DNA, 25 bp, Rattus norvegicus
ccgatagggccaatgggctgcaagt

SEQ ID NO: 633881 - DNA, 25 bp, Rattus norvegicus
caatcgaaatacaggggcagcggcg

SEQ ID NO: 633882 - DNA, 25 bp, Rattus norvegicus
gaaccaatcgaaatacaggggcagc

SEQ ID NO: 633883 - DNA, 25 bp, Rattus norvegicus
cagtcacgagagaaaagaaccaatc

SEQ ID NO: 633884 - DNA, 25 bp, Rattus norvegicus
agcaggatttacagtcacgagagaa

SEQ ID NO: 633885 - DNA, 25 bp, Rattus norvegicus
tcctaaagcaggatttacagtcacg

SEQ ID NO: 633886 - DNA, 25 bp, Rattus norvegicus
ggccaggccaatcctaaagcaggat

SEQ ID NO: 633887 - DNA, 25 bp, Rattus norvegicus
cccgaacgatgtgtgggcgtggcca

SEQ ID NO: 633888 - DNA, 25 bp, Rattus norvegicus
aggtggccatctggaccctcggccg

SEQ ID NO: 633889 - DNA, 25 bp, Rattus norvegicus
tggtcaggtggccatctggaccctc

SEQ ID NO: 633890 - DNA, 25 bp, Rattus norvegicus
tcaaatccgctgtggtgggctagga

SEQ ID NO: 633891 - DNA, 25 bp, Rattus norvegicus
ggggctgcaaaccactcggttctgg

SEQ ID NO: 633892 - DNA, 25 bp, Rattus norvegicus
cgcgggcgttccacggagcactgcg

SEQ ID NO: 633893 - DNA, 25 bp, Rattus norvegicus
cgtgaccagcacagggcgagctcgc

SEQ ID NO: 633894 - DNA, 25 bp, Rattus norvegicus
ccacgtgaccagcacagggcgagct

SEQ ID NO: 633895 - DNA, 25 bp, Rattus norvegicus
gattggacagcctcccgccacgtga

SEQ ID NO: 633896 - DNA, 25 bp, Rattus norvegicus
tctaggattggacagcctcccgcca

SEQ ID NO: 633897 - DNA, 25 bp, Rattus norvegicus
gacctctaggattggacagcctccc

SEQ ID NO: 633898 - DNA, 25 bp, Rattus norvegicus
caaggacctctaggattggacagcc

SEQ ID NO: 633899 - DNA, 25 bp, Rattus norvegicus
tcccaaccaaggacctctaggattg

SEQ ID NO: 633900 - DNA, 25 bp, Rattus norvegicus
ccgcttgccaggcttcggaggaccg

SEQ ID NO: 633901 - DNA, 25 bp, Rattus norvegicus
tacaacccgcttgccaggcttcgga

SEQ ID NO: 633902 - DNA, 25 bp, Rattus norvegicus
accagccgggccagctcgcctacaa

SEQ ID NO: 633903 - DNA, 25 bp, Rattus norvegicus
ccactcggttctggttcccgcagta

SEQ ID NO: 633904 - DNA, 25 bp, Rattus norvegicus
tctggttcccgcagtaccagccggg

SEQ ID NO: 633905 - DNA, 25 bp, Rattus norvegicus
cgcccgcgcggcgactccgctccct

SEQ ID NO: 633906 - DNA, 25 bp, Rattus norvegicus
ggcgtagccagcgtgctcctccgtg

SEQ ID NO: 633907 - DNA, 25 bp, Rattus norvegicus
ctagccgacagcgtcttcctgcttg

SEQ ID NO: 633908 - DNA, 25 bp, Rattus norvegicus
acagcgtcttcctgcttggcgcaca

SEQ ID NO: 633909 - DNA, 25 bp, Rattus norvegicus
acagccgcgccgtgagttcgcccgt

SEQ ID NO: 633910 - DNA, 25 bp, Rattus norvegicus
cccgccagctgtccgcctgctcgca

SEQ ID NO: 633911 - DNA, 25 bp, Rattus norvegicus
ccgtccgccgcagtccgcgcccagc

SEQ ID NO: 633912 - DNA, 25 bp, Rattus norvegicus
ccacgcccggctccggccatgctgt

SEQ ID NO: 633913 - DNA, 25 bp, Rattus norvegicus
atgctgtccttccagtaccctgacg

SEQ ID NO: 633914 - DNA, 25 bp, Rattus norvegicus
tgtccttccagtaccctgacgtgta

SEQ ID NO: 633915 - DNA, 25 bp, Rattus norvegicus
taccctgacgtgtaccgcgacgaga

SEQ ID NO: 633916 - DNA, 25 bp, Rattus norvegicus
acgtgtaccgcgacgagacctcagt

SEQ ID NO: 633917 - DNA, 25 bp, Rattus norvegicus
acgagacctcagtgagtaccccgct

SEQ ID NO: 633918 - DNA, 25 bp, Rattus norvegicus
gctcccgctctcaccgcgccacacg

SEQ ID NO: 633919 - DNA, 25 bp, Rattus norvegicus
gatgttcttagcctcgcccgatgga

SEQ ID NO: 633920 - DNA, 25 bp, Rattus norvegicus
tgtgctcgtcctcaaagacgcgcct

SEQ ID NO: 633921 - DNA, 25 bp, Rattus norvegicus
ccgaggtatggtgtgctcgtcctca

SEQ ID NO: 633922 - DNA, 25 bp, Rattus norvegicus
aagtgcgttctgttcctcaggcaca

SEQ ID NO: 633923 - DNA, 25 bp, Rattus norvegicus
cgcccgatggaggtaggcctcctta

SEQ ID NO: 633924 - DNA, 25 bp, Rattus norvegicus
caactgcgtttcagcaagtgcgttc

SEQ ID NO: 633925 - DNA, 25 bp, Rattus norvegicus
tcaggcacagagacgtccaccaatc

SEQ ID NO: 633926 - DNA, 25 bp, Rattus norvegicus
ccaatctccaccagaagctctgtta

SEQ ID NO: 633927 - DNA, 25 bp, Rattus norvegicus
agctctgttatcacgtcttggggac

SEQ ID NO: 633928 - DNA, 25 bp, Rattus norvegicus
gggacggatcagtcagaagacgttc

SEQ ID NO: 633929 - DNA, 25 bp, Rattus norvegicus
gaagacgttctgtgtgccgagttcc

SEQ ID NO: 633930 - DNA, 25 bp, Rattus norvegicus
cccgatgagcctaaatggatgggag

SEQ ID NO: 633931 - DNA, 25 bp, Rattus norvegicus
tgcaaccgtcttctcgacatccgag

SEQ ID NO: 633932 - DNA, 25 bp, Rattus norvegicus
ggcctccttaagattgtcaactgcg

SEQ ID NO: 633933 - DNA, 25 bp, Rattus norvegicus
ggggagacgggaaatctgacattca

SEQ ID NO: 633934 - DNA, 25 bp, Rattus norvegicus
tgaagggaatcgatgcgtctgatta

SEQ ID NO: 633935 - DNA, 25 bp, Rattus norvegicus
cgatgcgtctgattaccagactatc

SEQ ID NO: 633936 - DNA, 25 bp, Rattus norvegicus
attaccagactatccaggtatgggg

SEQ ID NO: 633937 - DNA, 25 bp, Rattus norvegicus
tctgacattcaggacgctatttacc

SEQ ID NO: 633938 - DNA, 25 bp, Rattus norvegicus
ggacgctatttaccttccacatggt

SEQ ID NO: 633939 - DNA, 25 bp, Rattus norvegicus
tccacatggtcagaagtcgcagagc

SEQ ID NO: 633940 - DNA, 25 bp, Rattus norvegicus
acacagagggcgaatgtttccggcg

SEQ ID NO: 633941 - DNA, 25 bp, Rattus norvegicus
ttctaggcactgagccgggcgctta

SEQ ID NO: 633942 - DNA, 25 bp, Rattus norvegicus
cgcttagggctctgcggtggtccct

SEQ ID NO: 633943 - DNA, 25 bp, Rattus norvegicus
ctgcggtggtccctgtagttacggc

SEQ ID NO: 633944 - DNA, 25 bp, Rattus norvegicus
agctaacgcttggtggtaacacaga

SEQ ID NO: 633945 - DNA, 25 bp, Rattus norvegicus
tcagaagtcgcagagctaacgcttg

SEQ ID NO: 633946 - DNA, 25 bp, Rattus norvegicus
ccctgctgtttctaggcactgagcc

SEQ ID NO: 633947 - DNA, 25 bp, Rattus norvegicus
gcctccgtgactgttctctgcagta

SEQ ID NO: 633948 - DNA, 25 bp, Rattus norvegicus
ctcggatatgtttgcgttcatagcg

SEQ ID NO: 633949 - DNA, 25 bp, Rattus norvegicus
caccgccaaggtgatagaagaagtc

SEQ ID NO: 633950 - DNA, 25 bp, Rattus norvegicus
tgctcatccacgtggacaccaaggc

SEQ ID NO: 633951 - DNA, 25 bp, Rattus norvegicus
ggccgcagccggaagcagagcaacc

SEQ ID NO: 633952 - DNA, 25 bp, Rattus norvegicus
gcttcagtacatcgtgggccgcagc

SEQ ID NO: 633953 - DNA, 25 bp, Rattus norvegicus
aagttcatcgccacgcttcagtaca

SEQ ID NO: 633954 - DNA, 25 bp, Rattus norvegicus
tggtcccgctgcactcgctcaagtt

SEQ ID NO: 633955 - DNA, 25 bp, Rattus norvegicus
ggatgacatccagtacccgtccatg

SEQ ID NO: 633956 - DNA, 25 bp, Rattus norvegicus
gaagcttccggaggcggatgacatc

SEQ ID NO: 633957 - DNA, 25 bp, Rattus norvegicus
tcgccgctgcacaacgtgaagcttc

SEQ ID NO: 633958 - DNA, 25 bp, Rattus norvegicus
ggtcttggtctccatcctcacggaa

SEQ ID NO: 633959 - DNA, 25 bp, Rattus norvegicus
ctctgcagtagctctggtcttggtc

SEQ ID NO: 633960 - DNA, 25 bp, Rattus norvegicus
ttcatagcgcggtgcctgaacatcg

SEQ ID NO: 633961 - DNA, 25 bp, Rattus norvegicus
ctagatacctggtgacccaaggaaa

SEQ ID NO: 633962 - DNA, 25 bp, Rattus norvegicus
gaccagtgctccagaaccttcgcgg

SEQ ID NO: 633963 - DNA, 25 bp, Rattus norvegicus
tgccagaccagtgctccagaacctt

SEQ ID NO: 633964 - DNA, 25 bp, Rattus norvegicus
ttccttacgaagctgccagaccagt

SEQ ID NO: 633965 - DNA, 25 bp, Rattus norvegicus
tctgcgcgcaccctgaaacccgtgc

SEQ ID NO: 633966 - DNA, 25 bp, Rattus norvegicus
ccggagacccgggagagaatcagac

SEQ ID NO: 633967 - DNA, 25 bp, Rattus norvegicus
agtggcagccctgcaacttcgcggg

SEQ ID NO: 633968 - DNA, 25 bp, Rattus norvegicus
ttctttgtgctccatcgggataggc

SEQ ID NO: 633969 - DNA, 25 bp, Rattus norvegicus
gcactcggccggaaagttctttgtg

SEQ ID NO: 633970 - DNA, 25 bp, Rattus norvegicus
tgggtttcgggctactagagccgcc

SEQ ID NO: 633971 - DNA, 25 bp, Rattus norvegicus
cttcgcggcgccctagatacctggt

SEQ ID NO: 633972 - DNA, 25 bp, Rattus norvegicus
tttcgagaggaaaagccgatgctgg

SEQ ID NO: 633973 - DNA, 25 bp, Rattus norvegicus
tgtgggtctcacctcgggcgattcg

SEQ ID NO: 633974 - DNA, 25 bp, Rattus norvegicus
ggcgcgagaggacgcatcccgaatc

SEQ ID NO: 633975 - DNA, 25 bp, Rattus norvegicus
caggtacccctggtgcctctttggg

SEQ ID NO: 633976 - DNA, 25 bp, Rattus norvegicus
gaagacctccgtccgtcaccagtga

SEQ ID NO: 633977 - DNA, 25 bp, Rattus norvegicus
agtgagcctagccaggacccacggt

SEQ ID NO: 633978 - DNA, 25 bp, Rattus norvegicus
tagccaggacccacggtgcctcggg

SEQ ID NO: 633979 - DNA, 25 bp, Rattus norvegicus
catcttggcggtagtgttctgagtt

SEQ ID NO: 633980 - DNA, 25 bp, Rattus norvegicus
agtgttctgagttagcgttgcctta

SEQ ID NO: 633981 - DNA, 25 bp, Rattus norvegicus
ctgagttagcgttgccttataagtc

SEQ ID NO: 633982 - DNA, 25 bp, Rattus norvegicus
acccatcgcgtttagaatgccgccg

SEQ ID NO: 633983 - DNA, 25 bp, Rattus norvegicus
tagcgttgccttataagtcccagtt

SEQ ID NO: 633984 - DNA, 25 bp, Rattus norvegicus
ggactgtgacccatcgcgtttagaa

SEQ ID NO: 633985 - DNA, 25 bp, Rattus norvegicus
ttgggatacgttcttgcgcaccagg

SEQ ID NO: 633986 - DNA, 25 bp, Rattus norvegicus
ttttttccggactgtgacccatcgc

SEQ ID NO: 633987 - DNA, 25 bp, Rattus norvegicus
gagaagacctccgtccgtcaccagt

SEQ ID NO: 633988 - DNA, 25 bp, Rattus norvegicus
cccagtttgggatacgttcttgcgc

SEQ ID NO: 633989 - DNA, 25 bp, Rattus norvegicus
tgaattccgattcacaaactgatgc

SEQ ID NO: 633990 - DNA, 25 bp, Rattus norvegicus
agcctgggcgctcgcacggcaggac

SEQ ID NO: 633991 - DNA, 25 bp, Rattus norvegicus
aatcctcgcagttaacgccgctgca

SEQ ID NO: 633992 - DNA, 25 bp, Rattus norvegicus
ccggtatctcttcacatcctgaatt

SEQ ID NO: 633993 - DNA, 25 bp, Rattus norvegicus
acagcccgagttctgggaaggctcc

SEQ ID NO: 633994 - DNA, 25 bp, Rattus norvegicus
tgatgccacccagacagcccgagtt

SEQ ID NO: 633995 - DNA, 25 bp, Rattus norvegicus
gattcacaaactgatgccacccaga

SEQ ID NO: 633996 - DNA, 25 bp, Rattus norvegicus
ttccgattcacaaactgatgccacc

SEQ ID NO: 633997 - DNA, 25 bp, Rattus norvegicus
ctcttcacatcctgaattccgattc

SEQ ID NO: 633998 - DNA, 25 bp, Rattus norvegicus
gacatctgttttcccccggtatctc

SEQ ID NO: 633999 - DNA, 25 bp, Rattus norvegicus
tttccaacaccaccgacatctgttt

SEQ ID NO: 634000 - DNA, 25 bp, Rattus norvegicus
tttatcttttccaacaccaccgaca

SEQ ID NO: 634001 - DNA, 25 bp, Rattus norvegicus
agttaacgccgctgcatttcttccc

SEQ ID NO: 634002 - DNA, 25 bp, Rattus norvegicus
cctcgcagttaacgccgctgcattt

SEQ ID NO: 634003 - DNA, 25 bp, Rattus norvegicus
gagaaaagtgcatctgaatcgggtg

SEQ ID NO: 634004 - DNA, 25 bp, Rattus norvegicus
tatcccatagcgagccgtgacgtcg

SEQ ID NO: 634005 - DNA, 25 bp, Rattus norvegicus
catctgaatcgggtgagctgcatcc

SEQ ID NO: 634006 - DNA, 25 bp, Rattus norvegicus
gtgagctgcatccaccgcgtcagaa

SEQ ID NO: 634007 - DNA, 25 bp, Rattus norvegicus
tcttaactgtgcagtttggggcagt

SEQ ID NO: 634008 - DNA, 25 bp, Rattus norvegicus
gagcatgtcttaactgtgcagtttg

SEQ ID NO: 634009 - DNA, 25 bp, Rattus norvegicus
ggcggcgagcatgtcttaactgtgc

SEQ ID NO: 634010 - DNA, 25 bp, Rattus norvegicus
catccaccgcgtcagaacttcgagg

SEQ ID NO: 634011 - DNA, 25 bp, Rattus norvegicus
ccgcgtcagaacttcgaggaacctg

SEQ ID NO: 634012 - DNA, 25 bp, Rattus norvegicus
gaacttcgaggaacctggcatccgc

SEQ ID NO: 634013 - DNA, 25 bp, Rattus norvegicus
cctggcatccgctgtgcctagtaaa

SEQ ID NO: 634014 - DNA, 25 bp, Rattus norvegicus
tccgctgtgcctagtaaaatgtata

SEQ ID NO: 634015 - DNA, 25 bp, Rattus norvegicus
tcggttagatttaataattatccca

SEQ ID NO: 634016 - DNA, 25 bp, Rattus norvegicus
aataattatcccatagcgagccgtg

SEQ ID NO: 634017 - DNA, 25 bp, Rattus norvegicus
gttcccagaaggcttcgcgagccca

SEQ ID NO: 634018 - DNA, 25 bp, Rattus norvegicus
atggcttagcatcctagcgttcccg

SEQ ID NO: 634019 - DNA, 25 bp, Rattus norvegicus
cttagcatcctagcgttcccgagcg

SEQ ID NO: 634020 - DNA, 25 bp, Rattus norvegicus
cggactcggcctgtgccgggatgta

SEQ ID NO: 634021 - DNA, 25 bp, Rattus norvegicus
agagcgatggagcagctcaaccgtc

SEQ ID NO: 634022 - DNA, 25 bp, Rattus norvegicus
gaaagggtgcggtggctcttcgcac

SEQ ID NO: 634023 - DNA, 25 bp, Rattus norvegicus
tggagcagctcaaccgtctgacgcg

SEQ ID NO: 634024 - DNA, 25 bp, Rattus norvegicus
tcaaccgtctgacgcgctcgctgcg

SEQ ID NO: 634025 - DNA, 25 bp, Rattus norvegicus
gagaacgcgcgctgcacttttcaga

SEQ ID NO: 634026 - DNA, 25 bp, Rattus norvegicus
cccagaaggcttcgcgagcccagga

SEQ ID NO: 634027 - DNA, 25 bp, Rattus norvegicus
ggtgccgcggatggcttagcatcct

SEQ ID NO: 634028 - DNA, 25 bp, Rattus norvegicus
gcccagccagctcggaactacagtt

SEQ ID NO: 634029 - DNA, 25 bp, Rattus norvegicus
ttcggtccgagcggaaatgcctgcg

SEQ ID NO: 634030 - DNA, 25 bp, Rattus norvegicus
gcgctgcacttttcagaggctggca

SEQ ID NO: 634031 - DNA, 25 bp, Rattus norvegicus
ttccctaacatcctccgtgagagtc

SEQ ID NO: 634032 - DNA, 25 bp, Rattus norvegicus
cctccgtgagagtctgcagcttctc

SEQ ID NO: 634033 - DNA, 25 bp, Rattus norvegicus
gttagtacctgaccctgtctcccga

SEQ ID NO: 634034 - DNA, 25 bp, Rattus norvegicus
ggaacgagcgctaggttagtacctg

SEQ ID NO: 634035 - DNA, 25 bp, Rattus norvegicus
cactcaggaactgtgaagggaacga

SEQ ID NO: 634036 - DNA, 25 bp, Rattus norvegicus
aggtgtgctgcgtagccttcactca

SEQ ID NO: 634037 - DNA, 25 bp, Rattus norvegicus
ttgttcttcttagggcgagagcggt

SEQ ID NO: 634038 - DNA, 25 bp, Rattus norvegicus
gatcatgcgcgagttgttcttctta

SEQ ID NO: 634039 - DNA, 25 bp, Rattus norvegicus
gctgcccttgcgcaggatcatgcgc

SEQ ID NO: 634040 - DNA, 25 bp, Rattus norvegicus
ctccggctgtgcgtgcagcccaaag

SEQ ID NO: 634041 - DNA, 25 bp, Rattus norvegicus
gcgcttgcgcagaaactccggctgt

SEQ ID NO: 634042 - DNA, 25 bp, Rattus norvegicus
tgctgcaccgacatggtcctgcgca

SEQ ID NO: 634043 - DNA, 25 bp, Rattus norvegicus
tccttgtcagactcgggctggctct

SEQ ID NO: 634044 - DNA, 25 bp, Rattus norvegicus
cttcagggcaccgactcgaacttgg

SEQ ID NO: 634045 - DNA, 25 bp, Rattus norvegicus
cagtagggacgtgtgcaagctctga

SEQ ID NO: 634046 - DNA, 25 bp, Rattus norvegicus
cgactcccagggacaaatcatttgc

SEQ ID NO: 634047 - DNA, 25 bp, Rattus norvegicus
gacaaatcatttgctcacctccgct

SEQ ID NO: 634048 - DNA, 25 bp, Rattus norvegicus
cggagcgcggtttgatctaagctgt

SEQ ID NO: 634049 - DNA, 25 bp, Rattus norvegicus
cgcatttacagtagggacgtgtgca

SEQ ID NO: 634050 - DNA, 25 bp, Rattus norvegicus
ctctgagagggtagctgaaatgcta

SEQ ID NO: 634051 - DNA, 25 bp, Rattus norvegicus
tgatctaagctgtttcgcatttaca

SEQ ID NO: 634052 - DNA, 25 bp, Rattus norvegicus
aagcggactccgagctctgcctctt

SEQ ID NO: 634053 - DNA, 25 bp, Rattus norvegicus
agctgaaatgctaagcggactccga

SEQ ID NO: 634054 - DNA, 25 bp, Rattus norvegicus
tctgcctcttctgaaacataccgtg

SEQ ID NO: 634055 - DNA, 25 bp, Rattus norvegicus
ctcttctgaaacataccgtggtgcg

SEQ ID NO: 634056 - DNA, 25 bp, Rattus norvegicus
ataccgtggtgcgtatggctcagaa

SEQ ID NO: 634057 - DNA, 25 bp, Rattus norvegicus
gtatggctcagaacaaataaccgtg

SEQ ID NO: 634058 - DNA, 25 bp, Rattus norvegicus
caaataaccgtgagcgttaaagccg

SEQ ID NO: 634059 - DNA, 25 bp, Rattus norvegicus
tccgatccacaataagcagagcagg

SEQ ID NO: 634060 - DNA, 25 bp, Rattus norvegicus
gacggtgccacccatcactgctatt

SEQ ID NO: 634061 - DNA, 25 bp, Rattus norvegicus
actgctattccagtggcgggctacg

SEQ ID NO: 634062 - DNA, 25 bp, Rattus norvegicus
gaggcgatgcatcccgctagtagta

SEQ ID NO: 634063 - DNA, 25 bp, Rattus norvegicus
ccgctagtagtacgatgcactggta

SEQ ID NO: 634064 - DNA, 25 bp, Rattus norvegicus
gccaggcagagagaccgcctgttta

SEQ ID NO: 634065 - DNA, 25 bp, Rattus norvegicus
gcctgtttacatccggcgcctcaga

SEQ ID NO: 634066 - DNA, 25 bp, Rattus norvegicus
acacatgtgtggttccttgcgaata

SEQ ID NO: 634067 - DNA, 25 bp, Rattus norvegicus
cagagcaggactttaatggagcgac

SEQ ID NO: 634068 - DNA, 25 bp, Rattus norvegicus
tggagcgactgaagactagattact

SEQ ID NO: 634069 - DNA, 25 bp, Rattus norvegicus
ttcatgatgtttccgtgcctgcgcg

SEQ ID NO: 634070 - DNA, 25 bp, Rattus norvegicus
cgatctagcgttaggctccgggctt

SEQ ID NO: 634071 - DNA, 25 bp, Rattus norvegicus
agtagtggccgcagacacaatcacg

SEQ ID NO: 634072 - DNA, 25 bp, Rattus norvegicus
atgcggggaatcttaccgaatctta

SEQ ID NO: 634073 - DNA, 25 bp, Rattus norvegicus
gacccacagcgaacgacccgggatg

SEQ ID NO: 634074 - DNA, 25 bp, Rattus norvegicus
agaattccgggtgctgaccgcctag

SEQ ID NO: 634075 - DNA, 25 bp, Rattus norvegicus
cggagaccaagaccgcggagccgca

SEQ ID NO: 634076 - DNA, 25 bp, Rattus norvegicus
agccgccagcgagagcgcaagtgac

SEQ ID NO: 634077 - DNA, 25 bp, Rattus norvegicus
gttcctcgcctcttgctttaaaggc

SEQ ID NO: 634078 - DNA, 25 bp, Rattus norvegicus
tccgctgctggcgagtgcttacctg

SEQ ID NO: 634079 - DNA, 25 bp, Rattus norvegicus
tggcgctggagacagacacgcctcc

SEQ ID NO: 634080 - DNA, 25 bp, Rattus norvegicus
cgaacgacccgggatggagctccag

SEQ ID NO: 634081 - DNA, 25 bp, Rattus norvegicus
acccgggagcacagcgaactcttta

SEQ ID NO: 634082 - DNA, 25 bp, Rattus norvegicus
ctccagggagagaattccgggtgct

SEQ ID NO: 634083 - DNA, 25 bp, Rattus norvegicus
cgcctagtgcttccggaacgctcgg

SEQ ID NO: 634084 - DNA, 25 bp, Rattus norvegicus
cttccggaacgctcggccctgattt

SEQ ID NO: 634085 - DNA, 25 bp, Rattus norvegicus
tcttgctttaaaggcgccgcgcttc

SEQ ID NO: 634086 - DNA, 25 bp, Rattus norvegicus
ctttatttcaagaactccagggaga

SEQ ID NO: 634087 - DNA, 25 bp, Rattus norvegicus
actccagcgtgattgcccacgtgta

SEQ ID NO: 634088 - DNA, 25 bp, Rattus norvegicus
atcggtgacagcgtgcgaccctcgc

SEQ ID NO: 634089 - DNA, 25 bp, Rattus norvegicus
tccgccacgccggagtgagaattgg

SEQ ID NO: 634090 - DNA, 25 bp, Rattus norvegicus
ccggagtgagaattggaagcaaatc

SEQ ID NO: 634091 - DNA, 25 bp, Rattus norvegicus
aattggaagcaaatctccaggaggc

SEQ ID NO: 634092 - DNA, 25 bp, Rattus norvegicus
cgggtctcagagtccggaagagcac

SEQ ID NO: 634093 - DNA, 25 bp, Rattus norvegicus
gtccggaagagcactggagaaccga

SEQ ID NO: 634094 - DNA, 25 bp, Rattus norvegicus
ctggagaaccgagctgtcatccctc

SEQ ID NO: 634095 - DNA, 25 bp, Rattus norvegicus
gagctgtcatccctcggctgcgcgt

SEQ ID NO: 634096 - DNA, 25 bp, Rattus norvegicus
gcgtgattgcccacgtgtatgaacg

SEQ ID NO: 634097 - DNA, 25 bp, Rattus norvegicus
gcgaaaactccagcgtgattgccca

SEQ ID NO: 634098 - DNA, 25 bp, Rattus norvegicus
gctaatcggtgacagcgtgcgaccc

SEQ ID NO: 634099 - DNA, 25 bp, Rattus norvegicus
agctctcgcgcgctaatcggtgaca

SEQ ID NO: 634100 - DNA, 25 bp, Rattus norvegicus
ttggggcgaaaactccagcgtgatt

SEQ ID NO: 634101 - DNA, 25 bp, Rattus norvegicus
gaagcattcgcgtcactcagctgga

SEQ ID NO: 634102 - DNA, 25 bp, Rattus norvegicus
gccgacttctccaagttttaaatgc

SEQ ID NO: 634103 - DNA, 25 bp, Rattus norvegicus
aggcgcactgtaggacccgagcctc

SEQ ID NO: 634104 - DNA, 25 bp, Rattus norvegicus
cttgggtgcctctggccaataggaa

SEQ ID NO: 634105 - DNA, 25 bp, Rattus norvegicus
cctgggagcgaagttgaagctaaac

SEQ ID NO: 634106 - DNA, 25 bp, Rattus norvegicus
tgggctcccaattaggaacagtacg

SEQ ID NO: 634107 - DNA, 25 bp, Rattus norvegicus
gaacagtacgggctcccaactacta

SEQ ID NO: 634108 - DNA, 25 bp, Rattus norvegicus
caactactacggaggattcggactc

SEQ ID NO: 634109 - DNA, 25 bp, Rattus norvegicus
caccaggtgatacccacgaggggct

SEQ ID NO: 634110 - DNA, 25 bp, Rattus norvegicus
gcgtaagccgctcttctcaaggaac

SEQ ID NO: 634111 - DNA, 25 bp, Rattus norvegicus
aggaattctgcacggcggaatcccg

SEQ ID NO: 634112 - DNA, 25 bp, Rattus norvegicus
cgacctctctgcagactcgcgttta

SEQ ID NO: 634113 - DNA, 25 bp, Rattus norvegicus
gactcgcgtttagccgtcggtgcta

SEQ ID NO: 634114 - DNA, 25 bp, Rattus norvegicus
gcctccgcggctctcgaggacttaa

SEQ ID NO: 634115 - DNA, 25 bp, Rattus norvegicus
ccggagccctcaggccagtcatggt

SEQ ID NO: 634116 - DNA, 25 bp, Rattus norvegicus
ggcaccactacttatagagccggga

SEQ ID NO: 634117 - DNA, 25 bp, Rattus norvegicus
ggtaaggcaccactacttatagagc

SEQ ID NO: 634118 - DNA, 25 bp, Rattus norvegicus
cccggtaaggcaccactacttatag

SEQ ID NO: 634119 - DNA, 25 bp, Rattus norvegicus
ctgtacagagggtacggaggagtgc

SEQ ID NO: 634120 - DNA, 25 bp, Rattus norvegicus
attcgcgcgctgtacagagggtacg

SEQ ID NO: 634121 - DNA, 25 bp, Rattus norvegicus
taattcgcgcgctgtacagagggta

SEQ ID NO: 634122 - DNA, 25 bp, Rattus norvegicus
tggcacataattcgcgcgctgtaca

SEQ ID NO: 634123 - DNA, 25 bp, Rattus norvegicus
agtggcacataattcgcgcgctgta

SEQ ID NO: 634124 - DNA, 25 bp, Rattus norvegicus
cgtgagtggcacataattcgcgcgc

SEQ ID NO: 634125 - DNA, 25 bp, Rattus norvegicus
tggttgcgtgagtggcacataattc

SEQ ID NO: 634126 - DNA, 25 bp, Rattus norvegicus
agatggttgcgtgagtggcacataa

SEQ ID NO: 634127 - DNA, 25 bp, Rattus norvegicus
gccctcaggccagtcatggtgtgga

SEQ ID NO: 634128 - DNA, 25 bp, Rattus norvegicus
cactacttatagagccgggaaactc

SEQ ID NO: 634129 - DNA, 25 bp, Rattus norvegicus
catctagttgttcccaaaggtaccg

SEQ ID NO: 634130 - DNA, 25 bp, Rattus norvegicus
tgttcggacgcacggcggacgctac

SEQ ID NO: 634131 - DNA, 25 bp, Rattus norvegicus
tgagcagagaaaagagggaaacgtc

SEQ ID NO: 634132 - DNA, 25 bp, Rattus norvegicus
aagagggaaacgtcagagcaaagtc

SEQ ID NO: 634133 - DNA, 25 bp, Rattus norvegicus
cgtcagagcaaagtccccgcatcta

SEQ ID NO: 634134 - DNA, 25 bp, Rattus norvegicus
cccgcatctagttgttcccaaaggt

SEQ ID NO: 634135 - DNA, 25 bp, Rattus norvegicus
gactcgacctcttgctgcccactcg

SEQ ID NO: 634136 - DNA, 25 bp, Rattus norvegicus
gggcgatactcaccactcgagggta

SEQ ID NO: 634137 - DNA, 25 bp, Rattus norvegicus
actcaccactcgagggtagagcacc

SEQ ID NO: 634138 - DNA, 25 bp, Rattus norvegicus
accactcgagggtagagcacccgtc

SEQ ID NO: 634139 - DNA, 25 bp, Rattus norvegicus
tagagcacccgtcggctgcgttttc

SEQ ID NO: 634140 - DNA, 25 bp, Rattus norvegicus
gctgcgttttcggtgcccgcgagaa

SEQ ID NO: 634141 - DNA, 25 bp, Rattus norvegicus
ttgctgcccactcgggcgatactca

SEQ ID NO: 634142 - DNA, 25 bp, Rattus norvegicus
gcccgcgagaagtgttcggacgcac

SEQ ID NO: 634143 - DNA, 25 bp, Rattus norvegicus
cgacagctgcttgcgggagccgcct

SEQ ID NO: 634144 - DNA, 25 bp, Rattus norvegicus
aggacaggtgcgcatatgtagccca

SEQ ID NO: 634145 - DNA, 25 bp, Rattus norvegicus
cccaagaggacaggtgcgcatatgt

SEQ ID NO: 634146 - DNA, 25 bp, Rattus norvegicus
ctctcttttcttgggcgaagggaga

SEQ ID NO: 634147 - DNA, 25 bp, Rattus norvegicus
gagagagaagacctctcttttcttg

SEQ ID NO: 634148 - DNA, 25 bp, Rattus norvegicus
ccgagaaagtatttcaaaaagagag

SEQ ID NO: 634149 - DNA, 25 bp, Rattus norvegicus
gcagagggccccgactttccgagaa

SEQ ID NO: 634150 - DNA, 25 bp, Rattus norvegicus
tgactcctcatccaaagcagagggc

SEQ ID NO: 634151 - DNA, 25 bp, Rattus norvegicus
gggattttgactcctcatccaaagc

SEQ ID NO: 634152 - DNA, 25 bp, Rattus norvegicus
gctgcctcgggattttgactcctca

SEQ ID NO: 634153 - DNA, 25 bp, Rattus norvegicus
cagttaagctcgctgcctcgggatt

SEQ ID NO: 634154 - DNA, 25 bp, Rattus norvegicus
aactccagttaagctcgctgcctcg

SEQ ID NO: 634155 - DNA, 25 bp, Rattus norvegicus
gtgcgcatatgtagcccactgagtc

SEQ ID NO: 634156 - DNA, 25 bp, Rattus norvegicus
gagccgcctcccgacacccgagccc

SEQ ID NO: 634157 - DNA, 25 bp, Rattus norvegicus
tcacggctccgtttcaaggagaagc

SEQ ID NO: 634158 - DNA, 25 bp, Rattus norvegicus
ggctgacattgtcaccctgcagggc

SEQ ID NO: 634159 - DNA, 25 bp, Rattus norvegicus
ctgacattgtcaccctgcagggcgt

SEQ ID NO: 634160 - DNA, 25 bp, Rattus norvegicus
cattgtcaccctgcagggcgtcaca

SEQ ID NO: 634161 - DNA, 25 bp, Rattus norvegicus
cccattacgccgaggctgacattgt

SEQ ID NO: 634162 - DNA, 25 bp, Rattus norvegicus
ttacgccgaggctgacattgtcacc

SEQ ID NO: 634163 - DNA, 25 bp, Rattus norvegicus
cgtcacagggggcaacacctacgct

SEQ ID NO: 634164 - DNA, 25 bp, Rattus norvegicus
cacctacgctgttcccgcactgccc

SEQ ID NO: 634165 - DNA, 25 bp, Rattus norvegicus
cccagagtggatttccctcggtcac

SEQ ID NO: 634166 - DNA, 25 bp, Rattus norvegicus
gagtggatttccctcggtcacggct

SEQ ID NO: 634167 - DNA, 25 bp, Rattus norvegicus
gtggatttccctcggtcacggctcc

SEQ ID NO: 634168 - DNA, 25 bp, Rattus norvegicus
ccgaggctgacattgtcaccctgca

SEQ ID NO: 634169 - DNA, 25 bp, Rattus norvegicus
ctcggtcacggctccgtttcaagga

SEQ ID NO: 634170 - DNA, 25 bp, Rattus norvegicus
tgtcaccctgcagggcgtcacaggg

SEQ ID NO: 634171 - DNA, 25 bp, Rattus norvegicus
gttcgcggtagattcgcgtggccca

SEQ ID NO: 634172 - DNA, 25 bp, Rattus norvegicus
ttgagacctgggtgtccctagtttc

SEQ ID NO: 634173 - DNA, 25 bp, Rattus norvegicus
ctcgtgttcgagaactcggccaagc

SEQ ID NO: 634174 - DNA, 25 bp, Rattus norvegicus
agcgagagtcttctgcgcatgcgta

SEQ ID NO: 634175 - DNA, 25 bp, Rattus norvegicus
ccggacgccctggtttcaatgactc

SEQ ID NO: 634176 - DNA, 25 bp, Rattus norvegicus
cccaaccttcgtgtcctggtgaggg

SEQ ID NO: 634177 - DNA, 25 bp, Rattus norvegicus
cggtgctcctatcgctcgggagttc

SEQ ID NO: 634178 - DNA, 25 bp, Rattus norvegicus
ccacttctacacaggagcgagagtc

SEQ ID NO: 634179 - DNA, 25 bp, Rattus norvegicus
ttccattccagctcggtgaaatcca

SEQ ID NO: 634180 - DNA, 25 bp, Rattus norvegicus
tgacgcctgccgacgttttccattc

SEQ ID NO: 634181 - DNA, 25 bp, Rattus norvegicus
aaagctatgcggctcctgacgcctg

SEQ ID NO: 634182 - DNA, 25 bp, Rattus norvegicus
ttttgtttacacatcgggacatttc

SEQ ID NO: 634183 - DNA, 25 bp, Rattus norvegicus
tggaagcggcagaagcacagctcct

SEQ ID NO: 634184 - DNA, 25 bp, Rattus norvegicus
cacagcgacgtcaagcgcttctgga

SEQ ID NO: 634185 - DNA, 25 bp, Rattus norvegicus
caaccagcagactttccaagtgaac

SEQ ID NO: 634186 - DNA, 25 bp, Rattus norvegicus
aagggcaaccagcagactttccaag

SEQ ID NO: 634187 - DNA, 25 bp, Rattus norvegicus
ggcaccgcggaagccgggtcaccgc

SEQ ID NO: 634188 - DNA, 25 bp, Rattus norvegicus
gggcaaccagcagactttccaagtg

SEQ ID NO: 634189 - DNA, 25 bp, Rattus norvegicus
gcaaccagcagactttccaagtgaa

SEQ ID NO: 634190 - DNA, 25 bp, Rattus norvegicus
agggcaaccagcagactttccaagt

SEQ ID NO: 634191 - DNA, 25 bp, Rattus norvegicus
gaagacctggacagcagcagacgtg

SEQ ID NO: 634192 - DNA, 25 bp, Rattus norvegicus
aagacctggacagcagcagacgtgg

SEQ ID NO: 634193 - DNA, 25 bp, Rattus norvegicus
agcagcagacgtggctgcgcagatc

SEQ ID NO: 634194 - DNA, 25 bp, Rattus norvegicus
cagcagacgtggctgcgcagatcac

SEQ ID NO: 634195 - DNA, 25 bp, Rattus norvegicus
agcagacgtggctgcgcagatcacc

SEQ ID NO: 634196 - DNA, 25 bp, Rattus norvegicus
gcagacgtggctgcgcagatcaccc

SEQ ID NO: 634197 - DNA, 25 bp, Rattus norvegicus
cagacgtggctgcgcagatcacccg

SEQ ID NO: 634198 - DNA, 25 bp, Rattus norvegicus
ggcaaccagcagactttccaagtga

SEQ ID NO: 634199 - DNA, 25 bp, Rattus norvegicus
gcgcacacgtacatgtggatttgta

SEQ ID NO: 634200 - DNA, 25 bp, Rattus norvegicus
tgagtcagagcgcacagtaaatatt

SEQ ID NO: 634201 - DNA, 25 bp, Rattus norvegicus
tgcggactcgaagcctggcccgagt

SEQ ID NO: 634202 - DNA, 25 bp, Rattus norvegicus
atatttgtattagccggggccggct

SEQ ID NO: 634203 - DNA, 25 bp, Rattus norvegicus
tgtatttacgcacgcaccgcgcttg

SEQ ID NO: 634204 - DNA, 25 bp, Rattus norvegicus
ggctttcggcgtgtgcgcacacgta

SEQ ID NO: 634205 - DNA, 25 bp, Rattus norvegicus
acagcggccgcctgtaagatgccca

SEQ ID NO: 634206 - DNA, 25 bp, Rattus norvegicus
ctcggtaacggctgaggacgaaaca

SEQ ID NO: 634207 - DNA, 25 bp, Rattus norvegicus
gagtcccggaaacccagcgatctgg

SEQ ID NO: 634208 - DNA, 25 bp, Rattus norvegicus
ggtttcactgatcgccaggcccgag

SEQ ID NO: 634209 - DNA, 25 bp, Rattus norvegicus
cgaccaggcgaagcaactgctgcag

SEQ ID NO: 634210 - DNA, 25 bp, Rattus norvegicus
catggacgagctcaaacaccaggtc

SEQ ID NO: 634211 - DNA, 25 bp, Rattus norvegicus
gcggcgccatgtccgtgaacatgga

SEQ ID NO: 634212 - DNA, 25 bp, Rattus norvegicus
gtcagcagggcacatcgaaggttgt

SEQ ID NO: 634213 - DNA, 25 bp, Rattus norvegicus
ccttctcgatcgctacccgcaaacc

SEQ ID NO: 634214 - DNA, 25 bp, Rattus norvegicus
ccgtggctagcgctagcccagctta

SEQ ID NO: 634215 - DNA, 25 bp, Rattus norvegicus
cctgggccagccgacggacaggtct

SEQ ID NO: 634216 - DNA, 25 bp, Rattus norvegicus
gacggacaggtctcgctccgcgagc

SEQ ID NO: 634217 - DNA, 25 bp, Rattus norvegicus
tccgcgagcctcacgggctccgacc

SEQ ID NO: 634218 - DNA, 25 bp, Rattus norvegicus
aatccaggctcctgcctggccgggg

SEQ ID NO: 634219 - DNA, 25 bp, Rattus norvegicus
gcatctgaggaaaagacagccgtga

SEQ ID NO: 634220 - DNA, 25 bp, Rattus norvegicus
ccagcttacccacgctctggggtcc

SEQ ID NO: 634221 - DNA, 25 bp, Rattus norvegicus
catcactcgccgctcgcacccgaac

SEQ ID NO: 634222 - DNA, 25 bp, Rattus norvegicus
cctgccctgcgtccaccggcctcct

SEQ ID NO: 634223 - DNA, 25 bp, Rattus norvegicus
gagggcgcctcccacaacccgagcc

SEQ ID NO: 634224 - DNA, 25 bp, Rattus norvegicus
gttcttcttccacaggaatccaggc

SEQ ID NO: 634225 - DNA, 25 bp, Rattus norvegicus
cgccggagaagggtgcaccttccga

SEQ ID NO: 634226 - DNA, 25 bp, Rattus norvegicus
gcctcctcaccaagcccgggtcctg

SEQ ID NO: 634227 - DNA, 25 bp, Rattus norvegicus
aacagaaagtgtgcgggctccgtac

SEQ ID NO: 634228 - DNA, 25 bp, Rattus norvegicus
agccacccttcgacgcccgccgcct

SEQ ID NO: 634229 - DNA, 25 bp, Rattus norvegicus
gtcggccaagcggaacctgactgcg

SEQ ID NO: 634230 - DNA, 25 bp, Rattus norvegicus
gaggtcggccaagcggaacctgact

SEQ ID NO: 634231 - DNA, 25 bp, Rattus norvegicus
tccgtacaggcgcttggacaggtgc

SEQ ID NO: 634232 - DNA, 25 bp, Rattus norvegicus
cagaatgggcgacaacagaaagtgt

SEQ ID NO: 634233 - DNA, 25 bp, Rattus norvegicus
ccctgagggacagaatgggcgacaa

SEQ ID NO: 634234 - DNA, 25 bp, Rattus norvegicus
tggggacggccatcattgccctgag

SEQ ID NO: 634235 - DNA, 25 bp, Rattus norvegicus
ctttgtctgggtgttgaactgcggc

SEQ ID NO: 634236 - DNA, 25 bp, Rattus norvegicus
ccctttgtctgggtgttgaactgcg

SEQ ID NO: 634237 - DNA, 25 bp, Rattus norvegicus
ccagtaagccacaccctttgtctgg

SEQ ID NO: 634238 - DNA, 25 bp, Rattus norvegicus
agtttgcggcctccagtaagccaca

SEQ ID NO: 634239 - DNA, 25 bp, Rattus norvegicus
ctgggcccagcactgtctgggctca

SEQ ID NO: 634240 - DNA, 25 bp, Rattus norvegicus
ctgccgggtccaggcctccgcctca

SEQ ID NO: 634241 - DNA, 25 bp, Rattus norvegicus
gcatccgcccgggttcccaggagga

SEQ ID NO: 634242 - DNA, 25 bp, Rattus norvegicus
gcagacgcttctggaatctcgtggc

SEQ ID NO: 634243 - DNA, 25 bp, Rattus norvegicus
acgcttctggaatctcgtggcggag

SEQ ID NO: 634244 - DNA, 25 bp, Rattus norvegicus
aggtggcgtgccacacgctgcccgt

SEQ ID NO: 634245 - DNA, 25 bp, Rattus norvegicus
cccacctggcctgcgcatccgcccg

SEQ ID NO: 634246 - DNA, 25 bp, Rattus norvegicus
tcccaggaggaggttcaggtctcac

SEQ ID NO: 634247 - DNA, 25 bp, Rattus norvegicus
ttggggagccccgtttcatcgctgt

SEQ ID NO: 634248 - DNA, 25 bp, Rattus norvegicus
acacggagaatccaggaaacggagc

SEQ ID NO: 634249 - DNA, 25 bp, Rattus norvegicus
atccaggaaacggagcagtggttcc

SEQ ID NO: 634250 - DNA, 25 bp, Rattus norvegicus
agcgaggacagtgagtgacccttcc

SEQ ID NO: 634251 - DNA, 25 bp, Rattus norvegicus
gacagtgagtgacccttccgagttc

SEQ ID NO: 634252 - DNA, 25 bp, Rattus norvegicus
tgagtgacccttccgagttcccaca

SEQ ID NO: 634253 - DNA, 25 bp, Rattus norvegicus
agttcccacaccacaggagacgtcc

SEQ ID NO: 634254 - DNA, 25 bp, Rattus norvegicus
tctgcatggcctcagagaagccggg

SEQ ID NO: 634255 - DNA, 25 bp, Rattus norvegicus
tgatgcagattattacaaggcctac

SEQ ID NO: 634256 - DNA, 25 bp, Rattus norvegicus
aagggcaaccagcagtggttccgag

SEQ ID NO: 634257 - DNA, 25 bp, Rattus norvegicus
ccacacagcaggaaacgtcccgggt

SEQ ID NO: 634258 - DNA, 25 bp, Rattus norvegicus
gtcccaagtccgagtttcaggagct

SEQ ID NO: 634259 - DNA, 25 bp, Rattus norvegicus
tggccggggaatgaccgccctgtcc

SEQ ID NO: 634260 - DNA, 25 bp, Rattus norvegicus
gaatgaccgccctgtcctgctggat

SEQ ID NO: 634261 - DNA, 25 bp, Rattus norvegicus
atgaccgccctgtcctgctggatca

SEQ ID NO: 634262 - DNA, 25 bp, Rattus norvegicus
tgctggatcacacaccttccaggtg

SEQ ID NO: 634263 - DNA, 25 bp, Rattus norvegicus
gctggatcacacaccttccaggtga

SEQ ID NO: 634264 - DNA, 25 bp, Rattus norvegicus
tggatcacacaccttccaggtgatg

SEQ ID NO: 634265 - DNA, 25 bp, Rattus norvegicus
atcaggctggtgatgcagattatta

SEQ ID NO: 634266 - DNA, 25 bp, Rattus norvegicus
aggctggtgatgcagattattacaa

SEQ ID NO: 634267 - DNA, 25 bp, Rattus norvegicus
ctggtgatgcagattattacaaggc

SEQ ID NO: 634268 - DNA, 25 bp, Rattus norvegicus
gtgatgcagattattacaaggccta

SEQ ID NO: 634269 - DNA, 25 bp, Rattus norvegicus
ctcaggagacacctggagcacggga

SEQ ID NO: 634270 - DNA, 25 bp, Rattus norvegicus
cacacggatcgtcaagggaaaggag

SEQ ID NO: 634271 - DNA, 25 bp, Rattus norvegicus
ggcggactttgaggcacagaagacc

SEQ ID NO: 634272 - DNA, 25 bp, Rattus norvegicus
aacacacggatcgtcaagggaaagg

SEQ ID NO: 634273 - DNA, 25 bp, Rattus norvegicus
ggactttgaggcacagaagacccgg

SEQ ID NO: 634274 - DNA, 25 bp, Rattus norvegicus
cacagcccggctcttcagggtccca

SEQ ID NO: 634275 - DNA, 25 bp, Rattus norvegicus
cggaacacacggatcgtcaagggaa

SEQ ID NO: 634276 - DNA, 25 bp, Rattus norvegicus
gcggaacacacggatcgtcaaggga

SEQ ID NO: 634277 - DNA, 25 bp, Rattus norvegicus
acggcctctggggtagggacggctg

SEQ ID NO: 634278 - DNA, 25 bp, Rattus norvegicus
tcagatggaggcgatggcacggccc

SEQ ID NO: 634279 - DNA, 25 bp, Rattus norvegicus
gcaagtgggagagggaaggtgttgc

SEQ ID NO: 634280 - DNA, 25 bp, Rattus norvegicus
agtgtgtgaagtggctcaggagaca

SEQ ID NO: 634281 - DNA, 25 bp, Rattus norvegicus
gaggcgatggcacggcccacgctgc

SEQ ID NO: 634282 - DNA, 25 bp, Rattus norvegicus
tcgtcaagggaaaggagcagatttt

SEQ ID NO: 634283 - DNA, 25 bp, Rattus norvegicus
tcttcaagcaggagagaccgatagc

SEQ ID NO: 634284 - DNA, 25 bp, Rattus norvegicus
ctagagtctaaggagttaagcatcc

SEQ ID NO: 634285 - DNA, 25 bp, Rattus norvegicus
ctccggggcattgtctaagcgggac

SEQ ID NO: 634286 - DNA, 25 bp, Rattus norvegicus
ttcgagcgacccagtacaaaccaga

SEQ ID NO: 634287 - DNA, 25 bp, Rattus norvegicus
aaccagacttagtcccggaggactg

SEQ ID NO: 634288 - DNA, 25 bp, Rattus norvegicus
ctgggagaggtcttaaacgaaatct

SEQ ID NO: 634289 - DNA, 25 bp, Rattus norvegicus
ccactccaggcttcagaactctgta

SEQ ID NO: 634290 - DNA, 25 bp, Rattus norvegicus
cttgtccgtcttctactaaagtcta

SEQ ID NO: 634291 - DNA, 25 bp, Rattus norvegicus
ctcttcgcccaagtgcaggtgattc

SEQ ID NO: 634292 - DNA, 25 bp, Rattus norvegicus
caggtgattcgcacactccgtccgg

SEQ ID NO: 634293 - DNA, 25 bp, Rattus norvegicus
actcctgcagccttgtgatttcggc

SEQ ID NO: 634294 - DNA, 25 bp, Rattus norvegicus
aagcctcgaacgctcgccggagaaa

SEQ ID NO: 634295 - DNA, 25 bp, Rattus norvegicus
ctccgtccggtgcaagctcatatgc

SEQ ID NO: 634296 - DNA, 25 bp, Rattus norvegicus
ctcgcagcaggagggacccaaagtc

SEQ ID NO: 634297 - DNA, 25 bp, Rattus norvegicus
agtgatctgtgctgccaagtccgca

SEQ ID NO: 634298 - DNA, 25 bp, Rattus norvegicus
gtaggccttgtaatagtctaattca

SEQ ID NO: 634299 - DNA, 25 bp, Rattus norvegicus
atagtctaattcaccagcctgatcc

SEQ ID NO: 634300 - DNA, 25 bp, Rattus norvegicus
cccacttgtttagagtgatctgtgc

SEQ ID NO: 634301 - DNA, 25 bp, Rattus norvegicus
agccgaccacgtcttcaggtcttcg

SEQ ID NO: 634302 - DNA, 25 bp, Rattus norvegicus
tgagaagccactccaggcatggacc

SEQ ID NO: 634303 - DNA, 25 bp, Rattus norvegicus
cacacgcggactcctttttccagga

SEQ ID NO: 634304 - DNA, 25 bp, Rattus norvegicus
caaaagaacagcagaccaggggaca

SEQ ID NO: 634305 - DNA, 25 bp, Rattus norvegicus
agcagaccaggggacaggacagaac

SEQ ID NO: 634306 - DNA, 25 bp, Rattus norvegicus
gacagaacgggcctgagatatgccc

SEQ ID NO: 634307 - DNA, 25 bp, Rattus norvegicus
cccggcaagcctgaaaagaaggtca

SEQ ID NO: 634308 - DNA, 25 bp, Rattus norvegicus
aaaagaaggtcatgggattgttcca

SEQ ID NO: 634309 - DNA, 25 bp, Rattus norvegicus
tccaggcatggaccctccaggtagg

SEQ ID NO: 634310 - DNA, 25 bp, Rattus norvegicus
gcgtattgctcatacccgcggcgca

SEQ ID NO: 634311 - DNA, 25 bp, Rattus norvegicus
ggaaactccattcgtgtcccttgac

SEQ ID NO: 634312 - DNA, 25 bp, Rattus norvegicus
aaactccattcgtgtcccttgacga

SEQ ID NO: 634313 - DNA, 25 bp, Rattus norvegicus
actccattcgtgtcccttgacgatc

SEQ ID NO: 634314 - DNA, 25 bp, Rattus norvegicus
ccattcgtgtcccttgacgatctgt

SEQ ID NO: 634315 - DNA, 25 bp, Rattus norvegicus
ttcgtgtcccttgacgatctgtgtc

SEQ ID NO: 634316 - DNA, 25 bp, Rattus norvegicus
cgtgtcccttgacgatctgtgtctg

SEQ ID NO: 634317 - DNA, 25 bp, Rattus norvegicus
ccttgacgatctgtgtctgctgctc

SEQ ID NO: 634318 - DNA, 25 bp, Rattus norvegicus
ttgacgatctgtgtctgctgctccc

SEQ ID NO: 634319 - DNA, 25 bp, Rattus norvegicus
catctaagatcccagaccgagctgt

SEQ ID NO: 634320 - DNA, 25 bp, Rattus norvegicus
ctaagatcccagaccgagctgtttc

SEQ ID NO: 634321 - DNA, 25 bp, Rattus norvegicus
agatcccagaccgagctgtttcccg

SEQ ID NO: 634322 - DNA, 25 bp, Rattus norvegicus
cagaccgagctgtttcccgcgtgct

SEQ ID NO: 634323 - DNA, 25 bp, Rattus norvegicus
accgagctgtttcccgcgtgctgcg

SEQ ID NO: 634324 - DNA, 25 bp, Rattus norvegicus
gtcccttgacgatctgtgtctgctg

SEQ ID NO: 634325 - DNA, 25 bp, Rattus norvegicus
ggcgatctgtgtctgcctctcccaa

SEQ ID NO: 634326 - DNA, 25 bp, Rattus norvegicus
catgcatcctctggtaggtgtgaga

SEQ ID NO: 634327 - DNA, 25 bp, Rattus norvegicus
ccatctcagattccggacgcttctg

SEQ ID NO: 634328 - DNA, 25 bp, Rattus norvegicus
gccgtcataggcgtactgcatatac

SEQ ID NO: 634329 - DNA, 25 bp, Rattus norvegicus
cggcgtgctgcgctgacattacaac

SEQ ID NO: 634330 - DNA, 25 bp, Rattus norvegicus
tgcgggacctcgtggtcagacccgc

SEQ ID NO: 634331 - DNA, 25 bp, Rattus norvegicus
gtcggttctgctccgagcctcggat

SEQ ID NO: 634332 - DNA, 25 bp, Rattus norvegicus
ccgagcctcggatttgggaccagga

SEQ ID NO: 634333 - DNA, 25 bp, Rattus norvegicus
ctggttatagtagcctcgcagggta

SEQ ID NO: 634334 - DNA, 25 bp, Rattus norvegicus
gtttctcttggcgatctgtgtctgc

SEQ ID NO: 634335 - DNA, 25 bp, Rattus norvegicus
cggccgcaacaagcaggagcagcgt

SEQ ID NO: 634336 - DNA, 25 bp, Rattus norvegicus
gctgacattacaaccagtgcctggg

SEQ ID NO: 634337 - DNA, 25 bp, Rattus norvegicus
cggacgcttctgagtccggcgtgct

SEQ ID NO: 634338 - DNA, 25 bp, Rattus norvegicus
ttgggaccaggaggtctccagtcgt

SEQ ID NO: 634339 - DNA, 25 bp, Rattus norvegicus
ggctctgtaatagtctgcaacacca

SEQ ID NO: 634340 - DNA, 25 bp, Rattus norvegicus
cgaggactcctcaaaactgaaagga

SEQ ID NO: 634341 - DNA, 25 bp, Rattus norvegicus
caggtaggctctgtaatagtctgca

SEQ ID NO: 634342 - DNA, 25 bp, Rattus norvegicus
agcctgaacccacttgctctgtgtc

SEQ ID NO: 634343 - DNA, 25 bp, Rattus norvegicus
tgctctgtgtcatccgtcctgttgt

SEQ ID NO: 634344 - DNA, 25 bp, Rattus norvegicus
gtcctgttgtgtccgccgctgtcca

SEQ ID NO: 634345 - DNA, 25 bp, Rattus norvegicus
gagcctgcaggcacccggctgtcag

SEQ ID NO: 634346 - DNA, 25 bp, Rattus norvegicus
ctcaggttcactcggtaccattgct

SEQ ID NO: 634347 - DNA, 25 bp, Rattus norvegicus
ggtaccattgctcttgtctcttcgc

SEQ ID NO: 634348 - DNA, 25 bp, Rattus norvegicus
gtctcttcgccatccgtgtgttctg

SEQ ID NO: 634349 - DNA, 25 bp, Rattus norvegicus
gcgtgcgacgctgggacccagcatc

SEQ ID NO: 634350 - DNA, 25 bp, Rattus norvegicus
ccgtccctatctgcagaggccattt

SEQ ID NO: 634351 - DNA, 25 bp, Rattus norvegicus
ctgcactcacctatgccggtctggg

SEQ ID NO: 634352 - DNA, 25 bp, Rattus norvegicus
gggacgtctccttccgtgtagcgaa

SEQ ID NO: 634353 - DNA, 25 bp, Rattus norvegicus
ctaaacgaggcccacttggcggctt

SEQ ID NO: 634354 - DNA, 25 bp, Rattus norvegicus
cgccgactgtagtagcaactgcgtc

SEQ ID NO: 634355 - DNA, 25 bp, Rattus norvegicus
cccacttggcggctttccggaggcg

SEQ ID NO: 634356 - DNA, 25 bp, Rattus norvegicus
gcacgtctaaacgaggcccacttgg

SEQ ID NO: 634357 - DNA, 25 bp, Rattus norvegicus
ctgctcatcgcacgtctaaacgagg

SEQ ID NO: 634358 - DNA, 25 bp, Rattus norvegicus
agctgcgttgccttcccacggccct

SEQ ID NO: 634359 - DNA, 25 bp, Rattus norvegicus
cttaacaaagaatcggcggagcctc

SEQ ID NO: 634360 - DNA, 25 bp, Rattus norvegicus
cctcggcctcgcttaacaaagaatc

SEQ ID NO: 634361 - DNA, 25 bp, Rattus norvegicus
gtaaagggctctccagacgcagcgc

SEQ ID NO: 634362 - DNA, 25 bp, Rattus norvegicus
gcaggtttgtgtaaagggctctcca

SEQ ID NO: 634363 - DNA, 25 bp, Rattus norvegicus
agccgcagcagcaggtttgtgtaaa

SEQ ID NO: 634364 - DNA, 25 bp, Rattus norvegicus
agcaactgcgtctgcagccgcagca

SEQ ID NO: 634365 - DNA, 25 bp, Rattus norvegicus
ttctttcgcgccgactgtagtagca

SEQ ID NO: 634366 - DNA, 25 bp, Rattus norvegicus
gcggaggaacctcggcctcgcttaa

SEQ ID NO: 634367 - DNA, 25 bp, Rattus norvegicus
cgccttcggccggagcggactctcc

SEQ ID NO: 634368 - DNA, 25 bp, Rattus norvegicus
ccctccagcggtgggaccagtaatc

SEQ ID NO: 634369 - DNA, 25 bp, Rattus norvegicus
cgctcccttaaaggagccgagcggc

SEQ ID NO: 634370 - DNA, 25 bp, Rattus norvegicus
gtctcctgacccagctggtggcagg

SEQ ID NO: 634371 - DNA, 25 bp, Rattus norvegicus
ggactgtcgcatccaggcagagtga

SEQ ID NO: 634372 - DNA, 25 bp, Rattus norvegicus
cgcatccaggcagagtgacaggaca

SEQ ID NO: 634373 - DNA, 25 bp, Rattus norvegicus
cggtggccacgggacatccccttgg

SEQ ID NO: 634374 - DNA, 25 bp, Rattus norvegicus
tgggttccggtgccgggatctactc

SEQ ID NO: 634375 - DNA, 25 bp, Rattus norvegicus
cagctcacaactgccgactggactg

SEQ ID NO: 634376 - DNA, 25 bp, Rattus norvegicus
gaccagtaatctgggtctcctgacc

SEQ ID NO: 634377 - DNA, 25 bp, Rattus norvegicus
ctgccgactggactgaggagccgca

SEQ ID NO: 634378 - DNA, 25 bp, Rattus norvegicus
ggggcggctccccaaccacagagta

SEQ ID NO: 634379 - DNA, 25 bp, Rattus norvegicus
gctcggccgcctccaccgcaaccgc

SEQ ID NO: 634380 - DNA, 25 bp, Rattus norvegicus
acaactgccgactggactgaggagc

SEQ ID NO: 634381 - DNA, 25 bp, Rattus norvegicus
tgcgtctctctgcataaccagtctg

SEQ ID NO: 634382 - DNA, 25 bp, Rattus norvegicus
tgcataaccagtctgatgccactgg

SEQ ID NO: 634383 - DNA, 25 bp, Rattus norvegicus
ctgcggccagaagcaagagcagcgt

SEQ ID NO: 634384 - DNA, 25 bp, Rattus norvegicus
gtaggcgtagtgatcatacccgcgt

SEQ ID NO: 634385 - DNA, 25 bp, Rattus norvegicus
gtagtgatcatacccgcgtaggagg

SEQ ID NO: 634386 - DNA, 25 bp, Rattus norvegicus
gcggattcctcaaaaccgattccga

SEQ ID NO: 634387 - DNA, 25 bp, Rattus norvegicus
accgattccgaaacttgctgggtcg

SEQ ID NO: 634388 - DNA, 25 bp, Rattus norvegicus
cctccgattagggatcctggacgtc

SEQ ID NO: 634389 - DNA, 25 bp, Rattus norvegicus
ttagggatcctggacgtctccatcc

SEQ ID NO: 634390 - DNA, 25 bp, Rattus norvegicus
caggtgcactcggaacctctgctca

SEQ ID NO: 634391 - DNA, 25 bp, Rattus norvegicus
tgcactcggaacctctgctcatttc

SEQ ID NO: 634392 - DNA, 25 bp, Rattus norvegicus
ggcgatccgtgtctcccgatcccaa

SEQ ID NO: 634393 - DNA, 25 bp, Rattus norvegicus
atgccactggttcagggtgatccgt

SEQ ID NO: 634394 - DNA, 25 bp, Rattus norvegicus
cgtccgccgccgtccaagtcttcag

SEQ ID NO: 634395 - DNA, 25 bp, Rattus norvegicus
cagaccagaaggcagcggcgtgaac

SEQ ID NO: 634396 - DNA, 25 bp, Rattus norvegicus
tctgaagaagcccaatgcccgcatg

SEQ ID NO: 634397 - DNA, 25 bp, Rattus norvegicus
gctgtctgccaaggtcagaaattta

SEQ ID NO: 634398 - DNA, 25 bp, Rattus norvegicus
acacacctcgagtggctgtctgcca

SEQ ID NO: 634399 - DNA, 25 bp, Rattus norvegicus
tccgcaggtaacacacctcgagtgg

SEQ ID NO: 634400 - DNA, 25 bp, Rattus norvegicus
cgagcccgaagtcaggaatccgcta

SEQ ID NO: 634401 - DNA, 25 bp, Rattus norvegicus
gggcgcgttccagcccagaccagaa

SEQ ID NO: 634402 - DNA, 25 bp, Rattus norvegicus
ttctgagccgttgcctcagaccaca

SEQ ID NO: 634403 - DNA, 25 bp, Rattus norvegicus
cccggtgctcgtcttctgagccgtt

SEQ ID NO: 634404 - DNA, 25 bp, Rattus norvegicus
ttcgacagccctactcggggctcgg

SEQ ID NO: 634405 - DNA, 25 bp, Rattus norvegicus
gccttcatggctccatcgcggggct

SEQ ID NO: 634406 - DNA, 25 bp, Rattus norvegicus
ccagcccaggtatcggccttcatgg

SEQ ID NO: 634407 - DNA, 25 bp, Rattus norvegicus
acgtgagcttttccaccgagggcca

SEQ ID NO: 634408 - DNA, 25 bp, Rattus norvegicus
aggaatccgctacttagtccctccg

SEQ ID NO: 634409 - DNA, 25 bp, Rattus norvegicus
atctctgtggggtcgctgaggggta

SEQ ID NO: 634410 - DNA, 25 bp, Rattus norvegicus
cggacgtctccgatctctgtggggt

SEQ ID NO: 634411 - DNA, 25 bp, Rattus norvegicus
ccggacgtctccgatctctgtgggg

SEQ ID NO: 634412 - DNA, 25 bp, Rattus norvegicus
tcccggacgtctccgatctctgtgg

SEQ ID NO: 634413 - DNA, 25 bp, Rattus norvegicus
atcccggacgtctccgatctctgtg

SEQ ID NO: 634414 - DNA, 25 bp, Rattus norvegicus
gatcccggacgtctccgatctctgt

SEQ ID NO: 634415 - DNA, 25 bp, Rattus norvegicus
ggatcccggacgtctccgatctctg

SEQ ID NO: 634416 - DNA, 25 bp, Rattus norvegicus
gggatcccggacgtctccgatctct

SEQ ID NO: 634417 - DNA, 25 bp, Rattus norvegicus
tgggatcccggacgtctccgatctc

SEQ ID NO: 634418 - DNA, 25 bp, Rattus norvegicus
ttgggatcccggacgtctccgatct

SEQ ID NO: 634419 - DNA, 25 bp, Rattus norvegicus
tttgggatcccggacgtctccgatc

SEQ ID NO: 634420 - DNA, 25 bp, Rattus norvegicus
tcagatttgggatcccggacgtctc

SEQ ID NO: 634421 - DNA, 25 bp, Rattus norvegicus
gacgtctccgatctctgtggggtcg

SEQ ID NO: 634422 - DNA, 25 bp, Rattus norvegicus
ctcagatttgggatcccggacgtct

SEQ ID NO: 634423 - DNA, 25 bp, Rattus norvegicus
cttgtttcgggtcatctgcgccacc

SEQ ID NO: 634424 - DNA, 25 bp, Rattus norvegicus
tgcgtttctctgcataacgagcccg

SEQ ID NO: 634425 - DNA, 25 bp, Rattus norvegicus
gcgtttctctgcataacgagcccgc

SEQ ID NO: 634426 - DNA, 25 bp, Rattus norvegicus
gtttctctgcataacgagcccgctc

SEQ ID NO: 634427 - DNA, 25 bp, Rattus norvegicus
ataacgagcccgctcccacttgttt

SEQ ID NO: 634428 - DNA, 25 bp, Rattus norvegicus
cgctcccacttgtttcgggtcatct

SEQ ID NO: 634429 - DNA, 25 bp, Rattus norvegicus
gctcccacttgtttcgggtcatctg

SEQ ID NO: 634430 - DNA, 25 bp, Rattus norvegicus
ctcccacttgtttcgggtcatctgc

SEQ ID NO: 634431 - DNA, 25 bp, Rattus norvegicus
cacttgtttcgggtcatctgcgcca

SEQ ID NO: 634432 - DNA, 25 bp, Rattus norvegicus
acttgtttcgggtcatctgcgccac

SEQ ID NO: 634433 - DNA, 25 bp, Rattus norvegicus
ttgtttcgggtcatctgcgccacca

SEQ ID NO: 634434 - DNA, 25 bp, Rattus norvegicus
tgtttcgggtcatctgcgccaccac

SEQ ID NO: 634435 - DNA, 25 bp, Rattus norvegicus
gtttcgggtcatctgcgccaccacg

SEQ ID NO: 634436 - DNA, 25 bp, Rattus norvegicus
cctgcgtttctctgcataacgagcc

SEQ ID NO: 634437 - DNA, 25 bp, Rattus norvegicus
catccctggcggactaagaaaaggc

SEQ ID NO: 634438 - DNA, 25 bp, Rattus norvegicus
cttacctaagcactgcgagcgtgta

SEQ ID NO: 634439 - DNA, 25 bp, Rattus norvegicus
gcgcagagcgctcacttcccaattg

SEQ ID NO: 634440 - DNA, 25 bp, Rattus norvegicus
cggatagtacacaaggccgagctta

SEQ ID NO: 634441 - DNA, 25 bp, Rattus norvegicus
ggtcaagcacggagatagccattta

SEQ ID NO: 634442 - DNA, 25 bp, Rattus norvegicus
ggaggcaagatccttcccatccctg

SEQ ID NO: 634443 - DNA, 25 bp, Rattus norvegicus
tactgcgccgacaccattggtcaag

SEQ ID NO: 634444 - DNA, 25 bp, Rattus norvegicus
gcagtgccctcggaagtttcccgga

SEQ ID NO: 634445 - DNA, 25 bp, Rattus norvegicus
cccagcgccgccacaattaatttta

SEQ ID NO: 634446 - DNA, 25 bp, Rattus norvegicus
ctggttcaatgaaggtgctcgctta

SEQ ID NO: 634447 - DNA, 25 bp, Rattus norvegicus
tgcaagggtacgaatggctccatta

SEQ ID NO: 634448 - DNA, 25 bp, Rattus norvegicus
ttgctcaggaacacccgagggccca

SEQ ID NO: 634449 - DNA, 25 bp, Rattus norvegicus
tgtggctgccgctattcacttgctc

SEQ ID NO: 634450 - DNA, 25 bp, Rattus norvegicus
cgatgcagcctttagagtggtctta

SEQ ID NO: 634451 - DNA, 25 bp, Rattus norvegicus
tcgcctctaatcttcggcttgcagg

SEQ ID NO: 634452 - DNA, 25 bp, Rattus norvegicus
tttccgcccgacacttgcgcgtgtg

SEQ ID NO: 634453 - DNA, 25 bp, Rattus norvegicus
ggatgggagccacacagttcatttc

SEQ ID NO: 634454 - DNA, 25 bp, Rattus norvegicus
aacaatttccgggatgggagccaca

SEQ ID NO: 634455 - DNA, 25 bp, Rattus norvegicus
gagtcacccagtcggggcggaacaa

SEQ ID NO: 634456 - DNA, 25 bp, Rattus norvegicus
taatcatgagtcacccagtcggggc

SEQ ID NO: 634457 - DNA, 25 bp, Rattus norvegicus
ccctccggaggcctaatcatgagtc

SEQ ID NO: 634458 - DNA, 25 bp, Rattus norvegicus
tatatcgcaaattgtcttgtttccc

SEQ ID NO: 634459 - DNA, 25 bp, Rattus norvegicus
tcggaacctcgcctctaatcttcgg

SEQ ID NO: 634460 - DNA, 25 bp, Rattus norvegicus
atcttcggcttgcaggtggaaccta

SEQ ID NO: 634461 - DNA, 25 bp, Rattus norvegicus
tctccgagcgtccttaaacccaggc

SEQ ID NO: 634462 - DNA, 25 bp, Rattus norvegicus
tgcgcgtgtgcctgcgccatttcct

SEQ ID NO: 634463 - DNA, 25 bp, Rattus norvegicus
ggtggaacctatatcgcaaattgtc

SEQ ID NO: 634464 - DNA, 25 bp, Rattus norvegicus
gggagccacacagttcatttccgcc

SEQ ID NO: 634465 - DNA, 25 bp, Rattus norvegicus
tgccctgtgcttgctgctgcgtctt

SEQ ID NO: 634466 - DNA, 25 bp, Rattus norvegicus
agcgacgcttcaggcggtacttgtc

SEQ ID NO: 634467 - DNA, 25 bp, Rattus norvegicus
cttcaggcggtacttgtctgcagga

SEQ ID NO: 634468 - DNA, 25 bp, Rattus norvegicus
ggcaccgccgagagcgacgcttcag

SEQ ID NO: 634469 - DNA, 25 bp, Rattus norvegicus
tacttgtctgcaggacggctggtgc

SEQ ID NO: 634470 - DNA, 25 bp, Rattus norvegicus
acggctggtgcgagcccaggctctc

SEQ ID NO: 634471 - DNA, 25 bp, Rattus norvegicus
aggctctcctccagcgacatcccgg

SEQ ID NO: 634472 - DNA, 25 bp, Rattus norvegicus
cgacatcccggccttgatgtggatg

SEQ ID NO: 634473 - DNA, 25 bp, Rattus norvegicus
tggcgccgaccctgcccaccaggac

SEQ ID NO: 634474 - DNA, 25 bp, Rattus norvegicus
caccaggaccgccatggggacacgg

SEQ ID NO: 634475 - DNA, 25 bp, Rattus norvegicus
ccgccatggggacacggcgctgcat

SEQ ID NO: 634476 - DNA, 25 bp, Rattus norvegicus
ggacacggcgctgcatgctgctgcc

SEQ ID NO: 634477 - DNA, 25 bp, Rattus norvegicus
ccacagggcctgtgcccgccacgat

SEQ ID NO: 634478 - DNA, 25 bp, Rattus norvegicus
ccttgatgtggatgctgggcagccc

SEQ ID NO: 634479 - DNA, 25 bp, Rattus norvegicus
tcgggatgactgatgttgacgtata

SEQ ID NO: 634480 - DNA, 25 bp, Rattus norvegicus
tcccgggccgctatctctactaggt

SEQ ID NO: 634481 - DNA, 25 bp, Rattus norvegicus
tgcgcaccgcttctcagaaacgctt

SEQ ID NO: 634482 - DNA, 25 bp, Rattus norvegicus
gcagtagagatagtagacgccgtcc

SEQ ID NO: 634483 - DNA, 25 bp, Rattus norvegicus
ccgatacccgacatggcagtagaga

SEQ ID NO: 634484 - DNA, 25 bp, Rattus norvegicus
tccacaacaggggtcacggtctccg

SEQ ID NO: 634485 - DNA, 25 bp, Rattus norvegicus
cgtacccgatgggatccacaacagg

SEQ ID NO: 634486 - DNA, 25 bp, Rattus norvegicus
cgcaccgtcagtagatcctccagga

SEQ ID NO: 634487 - DNA, 25 bp, Rattus norvegicus
cgctcgtgtaccacaaagacccgta

SEQ ID NO: 634488 - DNA, 25 bp, Rattus norvegicus
gttgacgtatatcctctcgccgctc

SEQ ID NO: 634489 - DNA, 25 bp, Rattus norvegicus
cctgtagtccaccatgtcgggatga

SEQ ID NO: 634490 - DNA, 25 bp, Rattus norvegicus
agaaggtcttccctctcctgtagtc

SEQ ID NO: 634491 - DNA, 25 bp, Rattus norvegicus
tcctccaggaatgcagttggctgtc

SEQ ID NO: 634492 - DNA, 25 bp, Rattus norvegicus
aggcttcttgactcgccagacatca

SEQ ID NO: 634493 - DNA, 25 bp, Rattus norvegicus
tttttctcccaccatccgtcgtgta

SEQ ID NO: 634494 - DNA, 25 bp, Rattus norvegicus
gggccgactgcagctgagcagccct

SEQ ID NO: 634495 - DNA, 25 bp, Rattus norvegicus
ttcccgtctcctccgctgagagtgg

SEQ ID NO: 634496 - DNA, 25 bp, Rattus norvegicus
ggggcctagcatccctttcctgcgt

SEQ ID NO: 634497 - DNA, 25 bp, Rattus norvegicus
attccgcggacgcaacacgcatgcg

SEQ ID NO: 634498 - DNA, 25 bp, Rattus norvegicus
cgcaacacgcatgcgcatccttttt

SEQ ID NO: 634499 - DNA, 25 bp, Rattus norvegicus
gggctacgcgtctcaactgccgacg

SEQ ID NO: 634500 - DNA, 25 bp, Rattus norvegicus
gtctcaactgccgacgccaaggcgt

SEQ ID NO: 634501 - DNA, 25 bp, Rattus norvegicus
aaccggcgtcctagcgtctgtaagt

SEQ ID NO: 634502 - DNA, 25 bp, Rattus norvegicus
ttatgcaaatatcatccacacactg

SEQ ID NO: 634503 - DNA, 25 bp, Rattus norvegicus
taaagtagggacagccctgaagagc

SEQ ID NO: 634504 - DNA, 25 bp, Rattus norvegicus
gagagaagctgccatcagccgccgc

SEQ ID NO: 634505 - DNA, 25 bp, Rattus norvegicus
catccgtcgtgtaaattctgcgccc

SEQ ID NO: 634506 - DNA, 25 bp, Rattus norvegicus
atgggccgttagtcggagcccagcc

SEQ ID NO: 634507 - DNA, 25 bp, Rattus norvegicus
gcgcccgagagatcgggaaatccta

SEQ ID NO: 634508 - DNA, 25 bp, Rattus norvegicus
ccgcgtacgcgtgcgcacactttaa

SEQ ID NO: 634509 - DNA, 25 bp, Rattus norvegicus
ggggcacgatgagaaagtccacagc

SEQ ID NO: 634510 - DNA, 25 bp, Rattus norvegicus
ccgatttactttcgtggggcacgat

SEQ ID NO: 634511 - DNA, 25 bp, Rattus norvegicus
atctcgaggcggtacttccggctcc

SEQ ID NO: 634512 - DNA, 25 bp, Rattus norvegicus
cccgatagtatttggggatctcgag

SEQ ID NO: 634513 - DNA, 25 bp, Rattus norvegicus
cggtattccagcaacacgacttaac

SEQ ID NO: 634514 - DNA, 25 bp, Rattus norvegicus
gcctccgtctttcgtcggtattcca

SEQ ID NO: 634515 - DNA, 25 bp, Rattus norvegicus
ccaccgacactcacgggaggctgga

SEQ ID NO: 634516 - DNA, 25 bp, Rattus norvegicus
tcgcgctagactcggcagagaaagt

SEQ ID NO: 634517 - DNA, 25 bp, Rattus norvegicus
ctgtgtgcgtttcttccctgctcgc

SEQ ID NO: 634518 - DNA, 25 bp, Rattus norvegicus
ggggaagcaagcacgagaccgatca

SEQ ID NO: 634519 - DNA, 25 bp, Rattus norvegicus
gaccgatcagagaccagtgtcatca

SEQ ID NO: 634520 - DNA, 25 bp, Rattus norvegicus
agagaaagtagcttcgcgcacgcgc

SEQ ID NO: 634521 - DNA, 25 bp, Rattus norvegicus
agctccgcaaccagagaggcggacc

SEQ ID NO: 634522 - DNA, 25 bp, Rattus norvegicus
tcgcagtcgcaagacacagtgcagg

SEQ ID NO: 634523 - DNA, 25 bp, Rattus norvegicus
gcggcctccgcaaggtcagaacaga

SEQ ID NO: 634524 - DNA, 25 bp, Rattus norvegicus
tccgcaaggtcagaacagagatgtc

SEQ ID NO: 634525 - DNA, 25 bp, Rattus norvegicus
cagaacagagatgtccttggagatc

SEQ ID NO: 634526 - DNA, 25 bp, Rattus norvegicus
agatgtccttggagatcgcagtcgc

SEQ ID NO: 634527 - DNA, 25 bp, Rattus norvegicus
ccttggagatcgcagtcgcaagaca

SEQ ID NO: 634528 - DNA, 25 bp, Rattus norvegicus
gcaagacacagtgcaggcctacctg

SEQ ID NO: 634529 - DNA, 25 bp, Rattus norvegicus
acagtgcaggcctacctgggagacc

SEQ ID NO: 634530 - DNA, 25 bp, Rattus norvegicus
aggcctacctgggagacccaggcgt

SEQ ID NO: 634531 - DNA, 25 bp, Rattus norvegicus
ctcccggagtcgtgagagcccggaa

SEQ ID NO: 634532 - DNA, 25 bp, Rattus norvegicus
agcccggaagcagctgtactgggtc

SEQ ID NO: 634533 - DNA, 25 bp, Rattus norvegicus
agaggcggacccgacagagcgacct

SEQ ID NO: 634534 - DNA, 25 bp, Rattus norvegicus
gtgagagcccggaagcagctgtact

SEQ ID NO: 634535 - DNA, 25 bp, Rattus norvegicus
ggcaggttctaacgtcttcccggca

SEQ ID NO: 634536 - DNA, 25 bp, Rattus norvegicus
cggagggcttctctgatttcaggtc

SEQ ID NO: 634537 - DNA, 25 bp, Rattus norvegicus
gagtcctgctgcctactctgatgta

SEQ ID NO: 634538 - DNA, 25 bp, Rattus norvegicus
gcgtgacgcagagcatgatccttgg

SEQ ID NO: 634539 - DNA, 25 bp, Rattus norvegicus
ccttgggcttctttgttcctcctga

SEQ ID NO: 634540 - DNA, 25 bp, Rattus norvegicus
ttcctcctgaccaaagtgtacgggc

SEQ ID NO: 634541 - DNA, 25 bp, Rattus norvegicus
cctcgcagtgcatggaaacgtcctc

SEQ ID NO: 634542 - DNA, 25 bp, Rattus norvegicus
aggaaacgtcatcccaccgcgtgga

SEQ ID NO: 634543 - DNA, 25 bp, Rattus norvegicus
gaggtgtcctcccagcacgtggaaa

SEQ ID NO: 634544 - DNA, 25 bp, Rattus norvegicus
aacgcacctgtctccatagcgacgg

SEQ ID NO: 634545 - DNA, 25 bp, Rattus norvegicus
ggcgaaggaccattcccgtgcaaaa

SEQ ID NO: 634546 - DNA, 25 bp, Rattus norvegicus
acccgccacaaggagacatcgactg

SEQ ID NO: 634547 - DNA, 25 bp, Rattus norvegicus
tccgccggtcccaactctaaggatg

SEQ ID NO: 634548 - DNA, 25 bp, Rattus norvegicus
cagcccggattggtgaaggagaatc

SEQ ID NO: 634549 - DNA, 25 bp, Rattus norvegicus
ggtctagattctcacgccgtatgca

SEQ ID NO: 634550 - DNA, 25 bp, Rattus norvegicus
cgtatgcacagctcagcgcgtccta

SEQ ID NO: 634551 - DNA, 25 bp, Rattus norvegicus
agcgcaacgccgagagagcaccgta

SEQ ID NO: 634552 - DNA, 25 bp, Rattus norvegicus
caggcgccaggaatatgcaggcacc

SEQ ID NO: 634553 - DNA, 25 bp, Rattus norvegicus
aatgaacttcgggagctttgggaca

SEQ ID NO: 634554 - DNA, 25 bp, Rattus norvegicus
aggccgattctgttgggtaaaatga

SEQ ID NO: 634555 - DNA, 25 bp, Rattus norvegicus
cggtctctgccgttccttggaagca

SEQ ID NO: 634556 - DNA, 25 bp, Rattus norvegicus
acatctcccggcgtccacggaggta

SEQ ID NO: 634557 - DNA, 25 bp, Rattus norvegicus
ttctctctcctgacgggactacatc

SEQ ID NO: 634558 - DNA, 25 bp, Rattus norvegicus
tggtagtttgccttcccttcatttc

SEQ ID NO: 634559 - DNA, 25 bp, Rattus norvegicus
gtcgagaagactccgtgctaggctt

SEQ ID NO: 634560 - DNA, 25 bp, Rattus norvegicus
ttcccaggcttcctggtcgagaaga

SEQ ID NO: 634561 - DNA, 25 bp, Rattus norvegicus
ccgtagtctagccagcctcctaaga

SEQ ID NO: 634562 - DNA, 25 bp, Rattus norvegicus
gagcaccgtagggatgacaatcacc

SEQ ID NO: 634563 - DNA, 25 bp, Rattus norvegicus
gtggatgccgcgtccacagaaggta

SEQ ID NO: 634564 - DNA, 25 bp, Rattus norvegicus
ttgcccgcgtcctcctctccagtcc

SEQ ID NO: 634565 - DNA, 25 bp, Rattus norvegicus
gctcgcagcgcatccactctaagga

SEQ ID NO: 634566 - DNA, 25 bp, Rattus norvegicus
tccacagaaggtagcgtgcttgccc

SEQ ID NO: 634567 - DNA, 25 bp, Rattus norvegicus
tgccgcgtccacagaaggtagcgtg

SEQ ID NO: 634568 - DNA, 25 bp, Rattus norvegicus
aaggtagcgtgcttgcccgcgtcct

SEQ ID NO: 634569 - DNA, 25 bp, Rattus norvegicus
cgctcagcagtggatgccgcgtcca

SEQ ID NO: 634570 - DNA, 25 bp, Rattus norvegicus
ccagcgcgccagtgggcgctcagca

SEQ ID NO: 634571 - DNA, 25 bp, Rattus norvegicus
ttgactggcagacacggcagggttt

SEQ ID NO: 634572 - DNA, 25 bp, Rattus norvegicus
caactgggttgttgactggcagaca

SEQ ID NO: 634573 - DNA, 25 bp, Rattus norvegicus
ccctgcaaacgcaactgggttgttg

SEQ ID NO: 634574 - DNA, 25 bp, Rattus norvegicus
tctaaggaggatgcatggttggccc

SEQ ID NO: 634575 - DNA, 25 bp, Rattus norvegicus
tccactctaaggaggatgcatggtt

SEQ ID NO: 634576 - DNA, 25 bp, Rattus norvegicus
cgcagcgcatccactctaaggagga

SEQ ID NO: 634577 - DNA, 25 bp, Rattus norvegicus
ccgaggacccgggaactcaggatcg

SEQ ID NO: 634578 - DNA, 25 bp, Rattus norvegicus
tcgggccaaacctcggagccgagga

SEQ ID NO: 634579 - DNA, 25 bp, Rattus norvegicus
tgagtcctgcaacctcgggccaaac

SEQ ID NO: 634580 - DNA, 25 bp, Rattus norvegicus
gtatttggaccaaaaactgtgcaca

SEQ ID NO: 634581 - DNA, 25 bp, Rattus norvegicus
ctatctccaggtatgtgcggagcga

SEQ ID NO: 634582 - DNA, 25 bp, Rattus norvegicus
aactgtgcacaaaacccggtcctgg

SEQ ID NO: 634583 - DNA, 25 bp, Rattus norvegicus
gcgtacctgctcctagcagagtctc

SEQ ID NO: 634584 - DNA, 25 bp, Rattus norvegicus
acactcgcccttcaggtaggttcgc

SEQ ID NO: 634585 - DNA, 25 bp, Rattus norvegicus
gtaggttcgcctttgctccgcgaca

SEQ ID NO: 634586 - DNA, 25 bp, Rattus norvegicus
ctgctgtgtcacctgccgtccagga

SEQ ID NO: 634587 - DNA, 25 bp, Rattus norvegicus
tccttgtttagagcgaggtagtcgc

SEQ ID NO: 634588 - DNA, 25 bp, Rattus norvegicus
tcgtatgcgtgctgctcgtgcccac

SEQ ID NO: 634589 - DNA, 25 bp, Rattus norvegicus
tgcccacggaggaagagtccatctg

SEQ ID NO: 634590 - DNA, 25 bp, Rattus norvegicus
ccgtccaggagtgcaggtccttgtt

SEQ ID NO: 634591 - DNA, 25 bp, Rattus norvegicus
gacgcagctcagcagcttcgccata

SEQ ID NO: 634592 - DNA, 25 bp, Rattus norvegicus
tccgtgtccctctcccggtagatct

SEQ ID NO: 634593 - DNA, 25 bp, Rattus norvegicus
gttctgaacggcgagagttcaaaaa

SEQ ID NO: 634594 - DNA, 25 bp, Rattus norvegicus
ggaccgtaccatgctctcagccagg

SEQ ID NO: 634595 - DNA, 25 bp, Rattus norvegicus
tgctctcagccagggggaactcaac

SEQ ID NO: 634596 - DNA, 25 bp, Rattus norvegicus
ggaactcaactcacccaggagctgg

SEQ ID NO: 634597 - DNA, 25 bp, Rattus norvegicus
cagcccagcgcggtttggaccgtac

SEQ ID NO: 634598 - DNA, 25 bp, Rattus norvegicus
gcagggtccggcttgactttctccc

SEQ ID NO: 634599 - DNA, 25 bp, Rattus norvegicus
cgcgagaggagtgttccgcacagat

SEQ ID NO: 634600 - DNA, 25 bp, Rattus norvegicus
gttccgcacagatgaacactccact

SEQ ID NO: 634601 - DNA, 25 bp, Rattus norvegicus
tccgccaccgtctgcaattagtcgg

SEQ ID NO: 634602 - DNA, 25 bp, Rattus norvegicus
cgtctgcaattagtcggagaggttc

SEQ ID NO: 634603 - DNA, 25 bp, Rattus norvegicus
attagtcggagaggttctgaacggc

SEQ ID NO: 634604 - DNA, 25 bp, Rattus norvegicus
actcacccaggagctggacgaggcg

SEQ ID NO: 634605 - DNA, 25 bp, Rattus norvegicus
tccagactcagagctgtcccttcgg

SEQ ID NO: 634606 - DNA, 25 bp, Rattus norvegicus
tcggcgcaacctaagtccgatcaga

SEQ ID NO: 634607 - DNA, 25 bp, Rattus norvegicus
agtccgatcagaccctttagttctc

SEQ ID NO: 634608 - DNA, 25 bp, Rattus norvegicus
agaccctttagttctctccaacgcg

SEQ ID NO: 634609 - DNA, 25 bp, Rattus norvegicus
gggagcagctgactcaccgaccggc

SEQ ID NO: 634610 - DNA, 25 bp, Rattus norvegicus
ttagttctctccaacgcggcttacc

SEQ ID NO: 634611 - DNA, 25 bp, Rattus norvegicus
gcggcttacccaccggctcagtgca

SEQ ID NO: 634612 - DNA, 25 bp, Rattus norvegicus
agctgctccacctcgttccctcccg

SEQ ID NO: 634613 - DNA, 25 bp, Rattus norvegicus
ttccctcccgtttagctcagggagc

SEQ ID NO: 634614 - DNA, 25 bp, Rattus norvegicus
ttagctcagggagcagctgactcac

SEQ ID NO: 634615 - DNA, 25 bp, Rattus norvegicus
gagctgtcccttcggcgcaacctaa

SEQ ID NO: 634616 - DNA, 25 bp, Rattus norvegicus
cgggtctcacggcccgggattctct

SEQ ID NO: 634617 - DNA, 25 bp, Rattus norvegicus
cgggattctctcctccagactcaga

SEQ ID NO: 634618 - DNA, 25 bp, Rattus norvegicus
cccgtttagctcagggagcagctga

SEQ ID NO: 634619 - DNA, 25 bp, Rattus norvegicus
cggcccagccacctgctgagatgtt

SEQ ID NO: 634620 - DNA, 25 bp, Rattus norvegicus
gagcccatggctttcagagcgaccc

SEQ ID NO: 634621 - DNA, 25 bp, Rattus norvegicus
caggctggctggtccttcccacagg

SEQ ID NO: 634622 - DNA, 25 bp, Rattus norvegicus
tcagcctgcaatggcggcgcctgga

SEQ ID NO: 634623 - DNA, 25 bp, Rattus norvegicus
atgtcctcagagtcgccgagcccat

SEQ ID NO: 634624 - DNA, 25 bp, Rattus norvegicus
cgaatgcccgcgcatcaccggccca

SEQ ID NO: 634625 - DNA, 25 bp, Rattus norvegicus
gcacggcttcgagtgacagaaatga

SEQ ID NO: 634626 - DNA, 25 bp, Rattus norvegicus
ttcagagcttccaaagcacggcttc

SEQ ID NO: 634627 - DNA, 25 bp, Rattus norvegicus
cgtgacagcgcgctctttcagagct

SEQ ID NO: 634628 - DNA, 25 bp, Rattus norvegicus
accgaagagcgcgctaaggctgtag

SEQ ID NO: 634629 - DNA, 25 bp, Rattus norvegicus
ctgctgagatgttgcttctgaaccc

SEQ ID NO: 634630 - DNA, 25 bp, Rattus norvegicus
ctcgtcgcggctgaggtgacgaaaa

SEQ ID NO: 634631 - DNA, 25 bp, Rattus norvegicus
ttcccacaggctcgcggcggttggt

SEQ ID NO: 634632 - DNA, 25 bp, Rattus norvegicus
agtcgccgagcccatggctttcaga

SEQ ID NO: 634633 - DNA, 25 bp, Rattus norvegicus
ctgctgtagggaataaaggttagta

SEQ ID NO: 634634 - DNA, 25 bp, Rattus norvegicus
tcaccgcagccagacgggtcaagga

SEQ ID NO: 634635 - DNA, 25 bp, Rattus norvegicus
gacctgaggagaaaccgggcagata

SEQ ID NO: 634636 - DNA, 25 bp, Rattus norvegicus
tgagcacgtgctgcaaggcacgcag

SEQ ID NO: 634637 - DNA, 25 bp, Rattus norvegicus
agttcgcgccgcgtgtacgtactga

SEQ ID NO: 634638 - DNA, 25 bp, Rattus norvegicus
gtacgtactgaaggcggcgatccca

SEQ ID NO: 634639 - DNA, 25 bp, Rattus norvegicus
tgaaggcggcgatcccacttggccg

SEQ ID NO: 634640 - DNA, 25 bp, Rattus norvegicus
cggagacgagcctgtgcctggatca

SEQ ID NO: 634641 - DNA, 25 bp, Rattus norvegicus
agcctgtgcctggatcaggcgccgc

SEQ ID NO: 634642 - DNA, 25 bp, Rattus norvegicus
tctggtgcgcgccagagtatgagct

SEQ ID NO: 634643 - DNA, 25 bp, Rattus norvegicus
cgccagagtatgagctggacgagtt

SEQ ID NO: 634644 - DNA, 25 bp, Rattus norvegicus
ggacgctgcaagcagtccctgtctg

SEQ ID NO: 634645 - DNA, 25 bp, Rattus norvegicus
ctgtctgccgggagttgctgctgta

SEQ ID NO: 634646 - DNA, 25 bp, Rattus norvegicus
cagtccctgtctgccgggagttgct

SEQ ID NO: 634647 - DNA, 25 bp, Rattus norvegicus
ctggcccttccaggtggtgaacgac

SEQ ID NO: 634648 - DNA, 25 bp, Rattus norvegicus
ctgctgcaggacttcttcaacgggc

SEQ ID NO: 634649 - DNA, 25 bp, Rattus norvegicus
aaggcgcagatccacgacctggtgc

SEQ ID NO: 634650 - DNA, 25 bp, Rattus norvegicus
tcgagggcatcgacttctacacgtc

SEQ ID NO: 634651 - DNA, 25 bp, Rattus norvegicus
ggccagcctggagatcgactctctg

SEQ ID NO: 634652 - DNA, 25 bp, Rattus norvegicus
agccacttcgtggaggagttcaaga

SEQ ID NO: 634653 - DNA, 25 bp, Rattus norvegicus
tcgacaaccggctggtgagccactt

SEQ ID NO: 634654 - DNA, 25 bp, Rattus norvegicus
tcctgacgatcgacgacggcatctt

SEQ ID NO: 634655 - DNA, 25 bp, Rattus norvegicus
acgttcgacgtgtccatcctgacga

SEQ ID NO: 634656 - DNA, 25 bp, Rattus norvegicus
gcgcaacgtgctcatcttcgacctg

SEQ ID NO: 634657 - DNA, 25 bp, Rattus norvegicus
tgcggatcatcaacgagcccacggc

SEQ ID NO: 634658 - DNA, 25 bp, Rattus norvegicus
ttctacccggaggagatctcgtcca

SEQ ID NO: 634659 - DNA, 25 bp, Rattus norvegicus
caagcccaaggtgcaggtgaactac

SEQ ID NO: 634660 - DNA, 25 bp, Rattus norvegicus
ttcaacgggcgcgacctgaacaaga

SEQ ID NO: 634661 - DNA, 25 bp, Rattus norvegicus
gcggtcagctgacctcgacccttta

SEQ ID NO: 634662 - DNA, 25 bp, Rattus norvegicus
catgttttaaagcaaccggcggcta

SEQ ID NO: 634663 - DNA, 25 bp, Rattus norvegicus
acaccaggagcaggaagatcgctgc

SEQ ID NO: 634664 - DNA, 25 bp, Rattus norvegicus
gcctgtccagtagctcggtggtccc

SEQ ID NO: 634665 - DNA, 25 bp, Rattus norvegicus
cccgtccacgaagtggtcaccggtg

SEQ ID NO: 634666 - DNA, 25 bp, Rattus norvegicus
tcaccggtggcaagcggtcagctga

SEQ ID NO: 634667 - DNA, 25 bp, Rattus norvegicus
ctgacctcgaccctttaaaagcgcg

SEQ ID NO: 634668 - DNA, 25 bp, Rattus norvegicus
aattagtccacccagctgtccgaca

SEQ ID NO: 634669 - DNA, 25 bp, Rattus norvegicus
cagctgtccgacatccgcatgtgac

SEQ ID NO: 634670 - DNA, 25 bp, Rattus norvegicus
atccgcatgtgacccagaggcggcc

SEQ ID NO: 634671 - DNA, 25 bp, Rattus norvegicus
cccagtctgtgtgagccttttgact

SEQ ID NO: 634672 - DNA, 25 bp, Rattus norvegicus
agccttttgactggctctgacacca

SEQ ID NO: 634673 - DNA, 25 bp, Rattus norvegicus
tctgacaccagcgacgcgacgaagg

SEQ ID NO: 634674 - DNA, 25 bp, Rattus norvegicus
gactccaattagtccacccagctgt

SEQ ID NO: 634675 - DNA, 25 bp, Rattus norvegicus
cgttgatgttggctcctgcctgtga

SEQ ID NO: 634676 - DNA, 25 bp, Rattus norvegicus
ccaggttgtcgactgcaggccgaga

SEQ ID NO: 634677 - DNA, 25 bp, Rattus norvegicus
ttgctctgctggtcgctctggaagt

SEQ ID NO: 634678 - DNA, 25 bp, Rattus norvegicus
gttctgcgaaagcttgtgagctgcg

SEQ ID NO: 634679 - DNA, 25 bp, Rattus norvegicus
acgaccgacctgtagcagcacgtga

SEQ ID NO: 634680 - DNA, 25 bp, Rattus norvegicus
gacgggacagccctacatctaggga

SEQ ID NO: 634681 - DNA, 25 bp, Rattus norvegicus
ctgctgcttatccacggcgttgatg

SEQ ID NO: 634682 - DNA, 25 bp, Rattus norvegicus
ggttgttcaccacggcctccatcag

SEQ ID NO: 634683 - DNA, 25 bp, Rattus norvegicus
cgagccacctccaggtggttgttca

SEQ ID NO: 634684 - DNA, 25 bp, Rattus norvegicus
agctgcaccatgtagcgagccacct

SEQ ID NO: 634685 - DNA, 25 bp, Rattus norvegicus
cactcagcctcggttctgcggttct

SEQ ID NO: 634686 - DNA, 25 bp, Rattus norvegicus
ctcaggactagaggagcactcagcc

SEQ ID NO: 634687 - DNA, 25 bp, Rattus norvegicus
caggccgagaggagacaaagcagta

SEQ ID NO: 634688 - DNA, 25 bp, Rattus norvegicus
agcacgtgacagatctccacggacc

SEQ ID NO: 634689 - DNA, 25 bp, Rattus norvegicus
ttattgcactgagcacccgggttcc

SEQ ID NO: 634690 - DNA, 25 bp, Rattus norvegicus
gaaatccgtgcgttccagctcagca

SEQ ID NO: 634691 - DNA, 25 bp, Rattus norvegicus
gctcagcacattcccgggttccatg

SEQ ID NO: 634692 - DNA, 25 bp, Rattus norvegicus
cgtgcagacaacctcgctagtgcta

SEQ ID NO: 634693 - DNA, 25 bp, Rattus norvegicus
tgcccagacacgcaactgaccttgt

SEQ ID NO: 634694 - DNA, 25 bp, Rattus norvegicus
tggtcacataagtcttcgccgaagc

SEQ ID NO: 634695 - DNA, 25 bp, Rattus norvegicus
ccatcgcgtgaaagggagacagact

SEQ ID NO: 634696 - DNA, 25 bp, Rattus norvegicus
ggctccggagtgtcccagatgaaaa

SEQ ID NO: 634697 - DNA, 25 bp, Rattus norvegicus
cccgatccaagaggggtgtctctta

SEQ ID NO: 634698 - DNA, 25 bp, Rattus norvegicus
tctcttaaaggcgatggccaagctc

SEQ ID NO: 634699 - DNA, 25 bp, Rattus norvegicus
tagcgttagcctgactctggacata

SEQ ID NO: 634700 - DNA, 25 bp, Rattus norvegicus
tgtcctcgcagtccgaacgactttc

SEQ ID NO: 634701 - DNA, 25 bp, Rattus norvegicus
ggcaccagccctctgtgaagactga

SEQ ID NO: 634702 - DNA, 25 bp, Rattus norvegicus
gccttcttcgctcctggcgctagta

SEQ ID NO: 634703 - DNA, 25 bp, Rattus norvegicus
gctccttggccctcggaggctctcg

SEQ ID NO: 634704 - DNA, 25 bp, Rattus norvegicus
tgcgcacatgcggtctacacagtca

SEQ ID NO: 634705 - DNA, 25 bp, Rattus norvegicus
tgcggtctacacagtcaacatgctc

SEQ ID NO: 634706 - DNA, 25 bp, Rattus norvegicus
caacatgctcgagcatccgagtgtg

SEQ ID NO: 634707 - DNA, 25 bp, Rattus norvegicus
agcatccgagtgtgtgctctctggg

SEQ ID NO: 634708 - DNA, 25 bp, Rattus norvegicus
tccgagtgtgtgctctctggggcca

SEQ ID NO: 634709 - DNA, 25 bp, Rattus norvegicus
gagcagaggggccttcttacctctg

SEQ ID NO: 634710 - DNA, 25 bp, Rattus norvegicus
ggccttcttacctctgggctccttg

SEQ ID NO: 634711 - DNA, 25 bp, Rattus norvegicus
ctcgcttccgccgtttcctggatgg

SEQ ID NO: 634712 - DNA, 25 bp, Rattus norvegicus
ttcctggatggcttcacccatgggc

SEQ ID NO: 634713 - DNA, 25 bp, Rattus norvegicus
tggcttcacccatgggctgtctttc

SEQ ID NO: 634714 - DNA, 25 bp, Rattus norvegicus
cccatgggctgtctttccgccattt

SEQ ID NO: 634715 - DNA, 25 bp, Rattus norvegicus
tgggctgtctttccgccatttcttc

SEQ ID NO: 634716 - DNA, 25 bp, Rattus norvegicus
tttccgccatttcttcttggccttg

SEQ ID NO: 634717 - DNA, 25 bp, Rattus norvegicus
acataaagatgaagtgttgtgcgcg

SEQ ID NO: 634718 - DNA, 25 bp, Rattus norvegicus
cgcagcgcgggcacataaagatgaa

SEQ ID NO: 634719 - DNA, 25 bp, Rattus norvegicus
tggttgaactgcttgccgcagcgcg

SEQ ID NO: 634720 - DNA, 25 bp, Rattus norvegicus
ttgaggttgctgctgtggttgaact

SEQ ID NO: 634721 - DNA, 25 bp, Rattus norvegicus
aacgccacggtggacgttcatgtgg

SEQ ID NO: 634722 - DNA, 25 bp, Rattus norvegicus
gaatgtgacttaacgccacggtgga

SEQ ID NO: 634723 - DNA, 25 bp, Rattus norvegicus
acttgccgcagatgccacaggaatg

SEQ ID NO: 634724 - DNA, 25 bp, Rattus norvegicus
tggacttctgagtgaagcacttgcc

SEQ ID NO: 634725 - DNA, 25 bp, Rattus norvegicus
tgatcgtgcagcgtggacttctgag

SEQ ID NO: 634726 - DNA, 25 bp, Rattus norvegicus
ctcccgagtgcaggttgaggtgatc

SEQ ID NO: 634727 - DNA, 25 bp, Rattus norvegicus
gcacatcacagtaggagcagcggta

SEQ ID NO: 634728 - DNA, 25 bp, Rattus norvegicus
tgggcaaagcgcacatcacagtagg

SEQ ID NO: 634729 - DNA, 25 bp, Rattus norvegicus
tgccacaggaatgtgacttaacgcc

SEQ ID NO: 634730 - DNA, 25 bp, Rattus norvegicus
cgggcttgtgggcaaagcgcacatc

SEQ ID NO: 634731 - DNA, 25 bp, Rattus norvegicus
agcaagaactggtcccggaggaacg

SEQ ID NO: 634732 - DNA, 25 bp, Rattus norvegicus
ccaattccaaggaggcgcggtccct

SEQ ID NO: 634733 - DNA, 25 bp, Rattus norvegicus
ggaggccaaggctccagatccctca

SEQ ID NO: 634734 - DNA, 25 bp, Rattus norvegicus
acaaaggtctctggctgtcggaggc

SEQ ID NO: 634735 - DNA, 25 bp, Rattus norvegicus
agctggttcatgttccgcaacgttg

SEQ ID NO: 634736 - DNA, 25 bp, Rattus norvegicus
cgctcctctgcacggagctggttca

SEQ ID NO: 634737 - DNA, 25 bp, Rattus norvegicus
ggctgtcagccacgatggtcacatc

SEQ ID NO: 634738 - DNA, 25 bp, Rattus norvegicus
ccaggatgaccttgtggccacggaa

SEQ ID NO: 634739 - DNA, 25 bp, Rattus norvegicus
acctgcagctcagaactggggttca

SEQ ID NO: 634740 - DNA, 25 bp, Rattus norvegicus
cgcgctgtgcatcagtgagacctgc

SEQ ID NO: 634741 - DNA, 25 bp, Rattus norvegicus
agtccgccacaatacgcgcgctgtg

SEQ ID NO: 634742 - DNA, 25 bp, Rattus norvegicus
ccgtgtagcaagagaggagcaagtc

SEQ ID NO: 634743 - DNA, 25 bp, Rattus norvegicus
gatgtccctgactgcgaactccagg

SEQ ID NO: 634744 - DNA, 25 bp, Rattus norvegicus
ccacggaatttgaggctgtcagcca

SEQ ID NO: 634745 - DNA, 25 bp, Rattus norvegicus
caccaggacccggaagacgctctag

SEQ ID NO: 634746 - DNA, 25 bp, Rattus norvegicus
gccttaacttggtcgacgtcatagt

SEQ ID NO: 634747 - DNA, 25 bp, Rattus norvegicus
aggacccggaagacgctctagcccg

SEQ ID NO: 634748 - DNA, 25 bp, Rattus norvegicus
cttgggatcggacgctctagcccgc

SEQ ID NO: 634749 - DNA, 25 bp, Rattus norvegicus
ttatgacgtcacgacccaacggcca

SEQ ID NO: 634750 - DNA, 25 bp, Rattus norvegicus
tgcgccattaattatgacgtcacga

SEQ ID NO: 634751 - DNA, 25 bp, Rattus norvegicus
agtacctgcgccattaattatgacg

SEQ ID NO: 634752 - DNA, 25 bp, Rattus norvegicus
gcctcgagtacctgcgccattaatt

SEQ ID NO: 634753 - DNA, 25 bp, Rattus norvegicus
tccttcccttaagcggcctcgagta

SEQ ID NO: 634754 - DNA, 25 bp, Rattus norvegicus
attcccttccgccagaggttcggct

SEQ ID NO: 634755 - DNA, 25 bp, Rattus norvegicus
gccgtatattcccttccgccagagg

SEQ ID NO: 634756 - DNA, 25 bp, Rattus norvegicus
cccagactgcgtgccgccgtatatt

SEQ ID NO: 634757 - DNA, 25 bp, Rattus norvegicus
tggtcgacgtcatagtcccagactg

SEQ ID NO: 634758 - DNA, 25 bp, Rattus norvegicus
ctggcgccttgggatcggacgctct

SEQ ID NO: 634759 - DNA, 25 bp, Rattus norvegicus
ggctgtcttcgtcatcaaactcaga

SEQ ID NO: 634760 - DNA, 25 bp, Rattus norvegicus
attctctgagtgctctccacccgga

SEQ ID NO: 634761 - DNA, 25 bp, Rattus norvegicus
gagtaaccatgacaacccaggcgtg

SEQ ID NO: 634762 - DNA, 25 bp, Rattus norvegicus
tctaagggcggaagcaggtaaccat

SEQ ID NO: 634763 - DNA, 25 bp, Rattus norvegicus
acgtctcctggcgtctgaggttttt

SEQ ID NO: 634764 - DNA, 25 bp, Rattus norvegicus
ctatgttcaggagttctttcccgga

SEQ ID NO: 634765 - DNA, 25 bp, Rattus norvegicus
ttctgcaccggaagacgctatgttc

SEQ ID NO: 634766 - DNA, 25 bp, Rattus norvegicus
ttgctcctgatgacgcaaccatccg

SEQ ID NO: 634767 - DNA, 25 bp, Rattus norvegicus
ctcagaagccggacagggatgcaaa

SEQ ID NO: 634768 - DNA, 25 bp, Rattus norvegicus
ccgaggctatagcatcagggcagca

SEQ ID NO: 634769 - DNA, 25 bp, Rattus norvegicus
tttggagcaaagaccaggttacctc

SEQ ID NO: 634770 - DNA, 25 bp, Rattus norvegicus
gttttagagccgaccaggaccgagc

SEQ ID NO: 634771 - DNA, 25 bp, Rattus norvegicus
agcgaccgcggtaatttgttccaag

SEQ ID NO: 634772 - DNA, 25 bp, Rattus norvegicus
cagcttttctcttggtccctctggg

SEQ ID NO: 634773 - DNA, 25 bp, Rattus norvegicus
tactcggaagaagtcatactgggcg

SEQ ID NO: 634774 - DNA, 25 bp, Rattus norvegicus
gagcaagttattggggtctcgatca

SEQ ID NO: 634775 - DNA, 25 bp, Rattus norvegicus
atactgggcgaacacggcttccttt

SEQ ID NO: 634776 - DNA, 25 bp, Rattus norvegicus
ttcgctgagtctactcggaagaagt

SEQ ID NO: 634777 - DNA, 25 bp, Rattus norvegicus
gttctccttcgctgagtctactcgg

SEQ ID NO: 634778 - DNA, 25 bp, Rattus norvegicus
gacgatagttctccttcgctgagtc

SEQ ID NO: 634779 - DNA, 25 bp, Rattus norvegicus
ccctaggtgtagacgatagttctcc

SEQ ID NO: 634780 - DNA, 25 bp, Rattus norvegicus
acggcgtggtgaggatcaccctcgt

SEQ ID NO: 634781 - DNA, 25 bp, Rattus norvegicus
ctcatagagtcacctgcagggcgtg

SEQ ID NO: 634782 - DNA, 25 bp, Rattus norvegicus
ccgctgtggtagctcatagagtcac

SEQ ID NO: 634783 - DNA, 25 bp, Rattus norvegicus
gacactgccgctgtggtagctcata

SEQ ID NO: 634784 - DNA, 25 bp, Rattus norvegicus
tcacgggccgaaaagacactgccgc

SEQ ID NO: 634785 - DNA, 25 bp, Rattus norvegicus
gggtctcgatcacgggccgaaaaga

SEQ ID NO: 634786 - DNA, 25 bp, Rattus norvegicus
cacttacccgcggtcccatggtagc

SEQ ID NO: 634787 - DNA, 25 bp, Rattus norvegicus
ccaggtcctgtactgtgccacggaa

SEQ ID NO: 634788 - DNA, 25 bp, Rattus norvegicus
cggagcccgtccagggacacaatca

SEQ ID NO: 634789 - DNA, 25 bp, Rattus norvegicus
tgcccagcacctccggtttcgggtg

SEQ ID NO: 634790 - DNA, 25 bp, Rattus norvegicus
tgcagtcaccgggtgtgcaccatag

SEQ ID NO: 634791 - DNA, 25 bp, Rattus norvegicus
tgcaccataggatgctgggcccaca

SEQ ID NO: 634792 - DNA, 25 bp, Rattus norvegicus
gcacccgctgtttgatggcgcttca

SEQ ID NO: 634793 - DNA, 25 bp, Rattus norvegicus
cgcttcaggaactcatggatgtggc

SEQ ID NO: 634794 - DNA, 25 bp, Rattus norvegicus
aggctcggccggagatgccactcct

SEQ ID NO: 634795 - DNA, 25 bp, Rattus norvegicus
gttcgcaagtgacgctccaggtcct

SEQ ID NO: 634796 - DNA, 25 bp, Rattus norvegicus
gcggcccagttcagccgtcaggtta

SEQ ID NO: 634797 - DNA, 25 bp, Rattus norvegicus
gcgcaacaccactcgttcgaactga

SEQ ID NO: 634798 - DNA, 25 bp, Rattus norvegicus
cgccaccgacgcgtaagtctggttg

SEQ ID NO: 634799 - DNA, 25 bp, Rattus norvegicus
gacacaatcagcgagccgtcggctg

SEQ ID NO: 634800 - DNA, 25 bp, Rattus norvegicus
gtgcgttccgaaccgtccacagtca

SEQ ID NO: 634801 - DNA, 25 bp, Rattus norvegicus
acccgagtagccttcgtcacataca

SEQ ID NO: 634802 - DNA, 25 bp, Rattus norvegicus
gtcctcgcagtgtccatgtcctcga

SEQ ID NO: 634803 - DNA, 25 bp, Rattus norvegicus
catgtcctcgacagtctccagggca

SEQ ID NO: 634804 - DNA, 25 bp, Rattus norvegicus
ggctcccacagtcttcgccagtaaa

SEQ ID NO: 634805 - DNA, 25 bp, Rattus norvegicus
cttcgccagtaaagcccggattgca

SEQ ID NO: 634806 - DNA, 25 bp, Rattus norvegicus
gcatgccacaatctcggcctgtgta

SEQ ID NO: 634807 - DNA, 25 bp, Rattus norvegicus
ttacgctacagtcctcacccgagta

SEQ ID NO: 634808 - DNA, 25 bp, Rattus norvegicus
gctatagcccggatcgcacacacag

SEQ ID NO: 634809 - DNA, 25 bp, Rattus norvegicus
tcgtcgccactgtagcctgggtcac

SEQ ID NO: 634810 - DNA, 25 bp, Rattus norvegicus
acgctgcagtcttcgccgctatagc

SEQ ID NO: 634811 - DNA, 25 bp, Rattus norvegicus
gcgtgctacaatcttcgcccgagta

SEQ ID NO: 634812 - DNA, 25 bp, Rattus norvegicus
tgcagtcgcgtggacacagtcttac

SEQ ID NO: 634813 - DNA, 25 bp, Rattus norvegicus
atggcacacgcacaagccatcctgg

SEQ ID NO: 634814 - DNA, 25 bp, Rattus norvegicus
ggcaggtgcgaatgctgcagtcttc

SEQ ID NO: 634815 - DNA, 25 bp, Rattus norvegicus
tgacacgaaggagcaatgactgtac

SEQ ID NO: 634816 - DNA, 25 bp, Rattus norvegicus
tccattcctcattggctcggccagg

SEQ ID NO: 634817 - DNA, 25 bp, Rattus norvegicus
ctccctcagagatgggctcggcgtc

SEQ ID NO: 634818 - DNA, 25 bp, Rattus norvegicus
tcctccggactcagcaggttgtcgg

SEQ ID NO: 634819 - DNA, 25 bp, Rattus norvegicus
tctcgctgaggagcatcagctccgc

SEQ ID NO: 634820 - DNA, 25 bp, Rattus norvegicus
tccgtgagctcgttgaggaaaaacc

SEQ ID NO: 634821 - DNA, 25 bp, Rattus norvegicus
gtgtcaggaggatctcacgccagcc

SEQ ID NO: 634822 - DNA, 25 bp, Rattus norvegicus
gttgctgaacacatgacacgaagga

SEQ ID NO: 634823 - DNA, 25 bp, Rattus norvegicus
ctcagcaggttgtcggtgaagaagc

SEQ ID NO: 634824 - DNA, 25 bp, Rattus norvegicus
aatgactgtacatgccgggccaatg

SEQ ID NO: 634825 - DNA, 25 bp, Rattus norvegicus
cgggccaatggaaacctgatcactt

SEQ ID NO: 634826 - DNA, 25 bp, Rattus norvegicus
cctgatcactttaccggggccagtc

SEQ ID NO: 634827 - DNA, 25 bp, Rattus norvegicus
tcccggaagtcttgctgaccagtca

SEQ ID NO: 634828 - DNA, 25 bp, Rattus norvegicus
ccgggcctcggcaaatccgtgagct

SEQ ID NO: 634829 - DNA, 25 bp, Rattus norvegicus
tacagtgaggatggtacaaagcacc

SEQ ID NO: 634830 - DNA, 25 bp, Rattus norvegicus
ctgggcggcaatgatgatgactaca

SEQ ID NO: 634831 - DNA, 25 bp, Rattus norvegicus
gatcccagtagttttcgtggtgctg

SEQ ID NO: 634832 - DNA, 25 bp, Rattus norvegicus
atgtctggaagtccagcggcgcctc

SEQ ID NO: 634833 - DNA, 25 bp, Rattus norvegicus
gcggagtttatgatgtctggaagtc

SEQ ID NO: 634834 - DNA, 25 bp, Rattus norvegicus
aactgagcgtactctctgggccaga

SEQ ID NO: 634835 - DNA, 25 bp, Rattus norvegicus
ttcctgaggaactgagcgtactctc

SEQ ID NO: 634836 - DNA, 25 bp, Rattus norvegicus
cgcggattccagtgccgctgaggat

SEQ ID NO: 634837 - DNA, 25 bp, Rattus norvegicus
gccagggagatgaaggagaaattcc

SEQ ID NO: 634838 - DNA, 25 bp, Rattus norvegicus
aattccgggcctcgcgcgaagcgat

SEQ ID NO: 634839 - DNA, 25 bp, Rattus norvegicus
gcgaagcgatctcggcggacaccaa

SEQ ID NO: 634840 - DNA, 25 bp, Rattus norvegicus
ggacaccaagtctccgcgggccaag

SEQ ID NO: 634841 - DNA, 25 bp, Rattus norvegicus
aagcaccatagctgcgatgcccacg

SEQ ID NO: 634842 - DNA, 25 bp, Rattus norvegicus
caaggccgtgcgcacctaccgggga

SEQ ID NO: 634843 - DNA, 25 bp, Rattus norvegicus
cgtcacaatagctgcggcggccttg

SEQ ID NO: 634844 - DNA, 25 bp, Rattus norvegicus
aggcacccacgcacccggagggcag

SEQ ID NO: 634845 - DNA, 25 bp, Rattus norvegicus
acgggtggcctgaggcacccacgca

SEQ ID NO: 634846 - DNA, 25 bp, Rattus norvegicus
taacgggtggcctgaggcacccacg

SEQ ID NO: 634847 - DNA, 25 bp, Rattus norvegicus
gcgtcacaatagctgcggcggcctt

SEQ ID NO: 634848 - DNA, 25 bp, Rattus norvegicus
gcgcagccgctaggcccgcgtggga

SEQ ID NO: 634849 - DNA, 25 bp, Rattus norvegicus
caatagctgcggcggccttggccta

SEQ ID NO: 634850 - DNA, 25 bp, Rattus norvegicus
tgctctcagagtcggcgtgggagca

SEQ ID NO: 634851 - DNA, 25 bp, Rattus norvegicus
cctgttgctctcagagtcggcgtgg

SEQ ID NO: 634852 - DNA, 25 bp, Rattus norvegicus
ccctgttgctctcagagtcggcgtg

SEQ ID NO: 634853 - DNA, 25 bp, Rattus norvegicus
aagcgcaggggacctcccctgttgc

SEQ ID NO: 634854 - DNA, 25 bp, Rattus norvegicus
ccttggcctaggcaagcgcagggga

SEQ ID NO: 634855 - DNA, 25 bp, Rattus norvegicus
gtcacaatagctgcggcggccttgg

SEQ ID NO: 634856 - DNA, 25 bp, Rattus norvegicus
ccgggcgcagcgagccggtaacggg

SEQ ID NO: 634857 - DNA, 25 bp, Rattus norvegicus
tgcccaccggatacaccgggacata

SEQ ID NO: 634858 - DNA, 25 bp, Rattus norvegicus
accgggacataagcggtgcacggct

SEQ ID NO: 634859 - DNA, 25 bp, Rattus norvegicus
ataagcggtgcacggctgcagctgc

SEQ ID NO: 634860 - DNA, 25 bp, Rattus norvegicus
agctgcagcgggtagcccggagcca

SEQ ID NO: 634861 - DNA, 25 bp, Rattus norvegicus
cccagcggcaacgtgcccaccgccc

SEQ ID NO: 634862 - DNA, 25 bp, Rattus norvegicus
cgcgtgcgtgggcaccacgaagcct

SEQ ID NO: 634863 - DNA, 25 bp, Rattus norvegicus
gaagtggaccctcgaagcgagtctc

SEQ ID NO: 634864 - DNA, 25 bp, Rattus norvegicus
tggaccctcgaagcgagtctcctgc

SEQ ID NO: 634865 - DNA, 25 bp, Rattus norvegicus
cctcgaagcgagtctcctgcagata

SEQ ID NO: 634866 - DNA, 25 bp, Rattus norvegicus
agcgagtctcctgcagataagggtc

SEQ ID NO: 634867 - DNA, 25 bp, Rattus norvegicus
agtctcctgcagataagggtcgggt

SEQ ID NO: 634868 - DNA, 25 bp, Rattus norvegicus
aggacgaaggaccacgttgagcgcc

SEQ ID NO: 634869 - DNA, 25 bp, Rattus norvegicus
cacgttgagcgccagccgcagcaga

SEQ ID NO: 634870 - DNA, 25 bp, Rattus norvegicus
cggatacaccgggacataagcggtg

SEQ ID NO: 634871 - DNA, 25 bp, Rattus norvegicus
ctatgatgggcagcgggccccgcca

SEQ ID NO: 634872 - DNA, 25 bp, Rattus norvegicus
tgcaccgtctagcttcgttcgcgtt

SEQ ID NO: 634873 - DNA, 25 bp, Rattus norvegicus
tgttcctctgcaccgtctagcttcg

SEQ ID NO: 634874 - DNA, 25 bp, Rattus norvegicus
tgctctgttcctctgcaccgtctag

SEQ ID NO: 634875 - DNA, 25 bp, Rattus norvegicus
ttcggcacctgctaccctgcctccc

SEQ ID NO: 634876 - DNA, 25 bp, Rattus norvegicus
gtccaccgggtttcggcacctgcta

SEQ ID NO: 634877 - DNA, 25 bp, Rattus norvegicus
agctacatcgctgggtccaccgggt

SEQ ID NO: 634878 - DNA, 25 bp, Rattus norvegicus
tcggccagctacatcgctgggtcca

SEQ ID NO: 634879 - DNA, 25 bp, Rattus norvegicus
gaggcctcggccagctacatcgctg

SEQ ID NO: 634880 - DNA, 25 bp, Rattus norvegicus
ggagctcagtggagctcgaggcctc

SEQ ID NO: 634881 - DNA, 25 bp, Rattus norvegicus
gccggggctactgccgccgctatct

SEQ ID NO: 634882 - DNA, 25 bp, Rattus norvegicus
cgccaatcgcctcttcggagacccg

SEQ ID NO: 634883 - DNA, 25 bp, Rattus norvegicus
cagcgcctgctgacttccggggctg

SEQ ID NO: 634884 - DNA, 25 bp, Rattus norvegicus
tcgcctcttcggagacccgcatctc

SEQ ID NO: 634885 - DNA, 25 bp, Rattus norvegicus
tccaaccgagagagtggggttaaca

SEQ ID NO: 634886 - DNA, 25 bp, Rattus norvegicus
ttttttccttccgagctctgcaccg

SEQ ID NO: 634887 - DNA, 25 bp, Rattus norvegicus
tgcgaccctggtacttctgctcttt

SEQ ID NO: 634888 - DNA, 25 bp, Rattus norvegicus
ttgccatggtgacgagatagagtga

SEQ ID NO: 634889 - DNA, 25 bp, Rattus norvegicus
gccggagccatcttgaaccctgcga

SEQ ID NO: 634890 - DNA, 25 bp, Rattus norvegicus
tgcgcatgctcatccttccgtgtcg

SEQ ID NO: 634891 - DNA, 25 bp, Rattus norvegicus
ttaacaccagcgctactggccgacg

SEQ ID NO: 634892 - DNA, 25 bp, Rattus norvegicus
ccgtgtcgtgccagccaatcatttg

SEQ ID NO: 634893 - DNA, 25 bp, Rattus norvegicus
ccgtccgctctaaagtccaatagga

SEQ ID NO: 634894 - DNA, 25 bp, Rattus norvegicus
ccgagccaaggcctttgaactgcaa

SEQ ID NO: 634895 - DNA, 25 bp, Rattus norvegicus
tcatttgatttggaaccgtccgctc

SEQ ID NO: 634896 - DNA, 25 bp, Rattus norvegicus
cccgccaatagcagaacggttgcca

SEQ ID NO: 634897 - DNA, 25 bp, Rattus norvegicus
ccgcccaatcaagaccagagagagt

SEQ ID NO: 634898 - DNA, 25 bp, Rattus norvegicus
ctctacgtcacccaaggaggccgga

SEQ ID NO: 634899 - DNA, 25 bp, Rattus norvegicus
cgagagcgggaaccatgcagttttt

SEQ ID NO: 634900 - DNA, 25 bp, Rattus norvegicus
tttttcagatgacccgaggggcacc

SEQ ID NO: 634901 - DNA, 25 bp, Rattus norvegicus
gagcgggaaccatgcagttttttca

SEQ ID NO: 634902 - DNA, 25 bp, Rattus norvegicus
ctcatctttgtgttggggagcccga

SEQ ID NO: 634903 - DNA, 25 bp, Rattus norvegicus
gtaaggcggcgggactcatctttgt

SEQ ID NO: 634904 - DNA, 25 bp, Rattus norvegicus
tctattggtgagaatccgaggcagg

SEQ ID NO: 634905 - DNA, 25 bp, Rattus norvegicus
gccacctctattggtgagaatccga

SEQ ID NO: 634906 - DNA, 25 bp, Rattus norvegicus
agcgtgtgtggccacctctattggt

SEQ ID NO: 634907 - DNA, 25 bp, Rattus norvegicus
cagctcgcgaagctgtggtcagcgt

SEQ ID NO: 634908 - DNA, 25 bp, Rattus norvegicus
tatgtttggagacagctcgcgaagc

SEQ ID NO: 634909 - DNA, 25 bp, Rattus norvegicus
taatatatgtttggagacagctcgc

SEQ ID NO: 634910 - DNA, 25 bp, Rattus norvegicus
cgcgaccttcgaatgtaatatatgt

SEQ ID NO: 634911 - DNA, 25 bp, Rattus norvegicus
gcgagcgcgaccttcgaatgtaata

SEQ ID NO: 634912 - DNA, 25 bp, Rattus norvegicus
tgcagttttttcagatgacccgagg

SEQ ID NO: 634913 - DNA, 25 bp, Rattus norvegicus
atagcctcggatgggcacagcttga

SEQ ID NO: 634914 - DNA, 25 bp, Rattus norvegicus
gctctggagccgtgagcgcccacaa

SEQ ID NO: 634915 - DNA, 25 bp, Rattus norvegicus
cagtccaagtccacgcgaatgcgct

SEQ ID NO: 634916 - DNA, 25 bp, Rattus norvegicus
gccacctagtagagtgggctctgga

SEQ ID NO: 634917 - DNA, 25 bp, Rattus norvegicus
tccacggcccatatagcctcggatg

SEQ ID NO: 634918 - DNA, 25 bp, Rattus norvegicus
cacagcttgatgaggcccttgcgcg

SEQ ID NO: 634919 - DNA, 25 bp, Rattus norvegicus
acagcgtagcagctctctcctgcgt

SEQ ID NO: 634920 - DNA, 25 bp, Rattus norvegicus
ctcatccttcgccagagagtctctg

SEQ ID NO: 634921 - DNA, 25 bp, Rattus norvegicus
agagtctctgaagcacgcgccttcc

SEQ ID NO: 634922 - DNA, 25 bp, Rattus norvegicus
cccagcagtggcgacctgacgcgaa

SEQ ID NO: 634923 - DNA, 25 bp, Rattus norvegicus
gagccagactcacgccgcggtagtc

SEQ ID NO: 634924 - DNA, 25 bp, Rattus norvegicus
tagtcagaggagatgagcagatcac

SEQ ID NO: 634925 - DNA, 25 bp, Rattus norvegicus
gcaagtccaatgagcggccatcata

SEQ ID NO: 634926 - DNA, 25 bp, Rattus norvegicus
agcagatcacgatgtgcagtgcgag

SEQ ID NO: 634927 - DNA, 25 bp, Rattus norvegicus
aacgggcctcctgcgtgatcggtcc

SEQ ID NO: 634928 - DNA, 25 bp, Rattus norvegicus
tcccgaggccagtcatcctgtgata

SEQ ID NO: 634929 - DNA, 25 bp, Rattus norvegicus
tcgtccacgggagtccgcggaaagc

SEQ ID NO: 634930 - DNA, 25 bp, Rattus norvegicus
gcatggaggggcctccagagcctcc

SEQ ID NO: 634931 - DNA, 25 bp, Rattus norvegicus
agagcctcctgatcggctccggcag

SEQ ID NO: 634932 - DNA, 25 bp, Rattus norvegicus
accaagtgcgagcttgcagacaagc

SEQ ID NO: 634933 - DNA, 25 bp, Rattus norvegicus
cagcgtcagcaggtcccaatgacta

SEQ ID NO: 634934 - DNA, 25 bp, Rattus norvegicus
ccaatgactacgctggcgggccaca

SEQ ID NO: 634935 - DNA, 25 bp, Rattus norvegicus
cagccaggaacagcggcgtctgctc

SEQ ID NO: 634936 - DNA, 25 bp, Rattus norvegicus
gtctgctcctgtcggggagacccaa

SEQ ID NO: 634937 - DNA, 25 bp, Rattus norvegicus
ctgtcggggagacccaaaagcttgg

SEQ ID NO: 634938 - DNA, 25 bp, Rattus norvegicus
gtcagggagtctccgcccaccggga

SEQ ID NO: 634939 - DNA, 25 bp, Rattus norvegicus
actgcaggcagagccgcaggcttcc

SEQ ID NO: 634940 - DNA, 25 bp, Rattus norvegicus
agtccaccgaccaagtgcgagcttg

SEQ ID NO: 634941 - DNA, 25 bp, Rattus norvegicus
aggatgagttttgttccctctgaca

SEQ ID NO: 634942 - DNA, 25 bp, Rattus norvegicus
cgtcactgtcctgggccgtcttgac

SEQ ID NO: 634943 - DNA, 25 bp, Rattus norvegicus
tgtactccttctgtttgttatagta

SEQ ID NO: 634944 - DNA, 25 bp, Rattus norvegicus
ctgggccgtcttgacttttctccgg

SEQ ID NO: 634945 - DNA, 25 bp, Rattus norvegicus
agcgcgcagaggatgagttttgttc

SEQ ID NO: 634946 - DNA, 25 bp, Rattus norvegicus
ttttgttccctctgacaagaggccg

SEQ ID NO: 634947 - DNA, 25 bp, Rattus norvegicus
agaggccgcctaaatcacctgtgtc

SEQ ID NO: 634948 - DNA, 25 bp, Rattus norvegicus
acctgtccgcggcacaaggaatcta

SEQ ID NO: 634949 - DNA, 25 bp, Rattus norvegicus
cgcggcacaaggaatctatcagaga

SEQ ID NO: 634950 - DNA, 25 bp, Rattus norvegicus
ctatcagagatctcgtagttgtgtc

SEQ ID NO: 634951 - DNA, 25 bp, Rattus norvegicus
tcccgctctatgtactccttctgtt

SEQ ID NO: 634952 - DNA, 25 bp, Rattus norvegicus
tgaccagaagccgtacgcgctgcgt

SEQ ID NO: 634953 - DNA, 25 bp, Rattus norvegicus
tgtagatgtatctgaccagaagccg

SEQ ID NO: 634954 - DNA, 25 bp, Rattus norvegicus
tgaccagcggttagcagcgcgcaga

SEQ ID NO: 634955 - DNA, 25 bp, Rattus norvegicus
tatagtactcggctgagggccgccc

SEQ ID NO: 634956 - DNA, 25 bp, Rattus norvegicus
gccttggcgcctcgggaccgacaga

SEQ ID NO: 634957 - DNA, 25 bp, Rattus norvegicus
acggacatcgtcagcccggggtaca

SEQ ID NO: 634958 - DNA, 25 bp, Rattus norvegicus
ggcccttgaactggaatacgaaatc

SEQ ID NO: 634959 - DNA, 25 bp, Rattus norvegicus
tggtgtagtagcacaggcccttgaa

SEQ ID NO: 634960 - DNA, 25 bp, Rattus norvegicus
tgcgtcccgttggtgtagtagcaca

SEQ ID NO: 634961 - DNA, 25 bp, Rattus norvegicus
tgtagatgtatctgatcacgagccg

SEQ ID NO: 634962 - DNA, 25 bp, Rattus norvegicus
ccgctccaggtactgtttgttatag

SEQ ID NO: 634963 - DNA, 25 bp, Rattus norvegicus
gtctgcagaccgtgtccagctcggc

SEQ ID NO: 634964 - DNA, 25 bp, Rattus norvegicus
ggacctccgtctcctcgtagttgtg

SEQ ID NO: 634965 - DNA, 25 bp, Rattus norvegicus
tcacgccggaactctgctccgtgtt

SEQ ID NO: 634966 - DNA, 25 bp, Rattus norvegicus
ggaaggaagccacggcagctcctca

SEQ ID NO: 634967 - DNA, 25 bp, Rattus norvegicus
ctcgctctgtgctgtgggactgacc

SEQ ID NO: 634968 - DNA, 25 bp, Rattus norvegicus
atcacgagccgtatgcgctgcgtcc

SEQ ID NO: 634969 - DNA, 25 bp, Rattus norvegicus
gctcgagctggtgtcgctaactaga

SEQ ID NO: 634970 - DNA, 25 bp, Rattus norvegicus
aggcatctaagcgactgttccagtg

SEQ ID NO: 634971 - DNA, 25 bp, Rattus norvegicus
tccagtggagcagtccagcgttgtc

SEQ ID NO: 634972 - DNA, 25 bp, Rattus norvegicus
cagctttcggaacgaggcaagtcca

SEQ ID NO: 634973 - DNA, 25 bp, Rattus norvegicus
tcgggaaccaacagggagaagattc

SEQ ID NO: 634974 - DNA, 25 bp, Rattus norvegicus
ctggctggcccaggctattctggaa

SEQ ID NO: 634975 - DNA, 25 bp, Rattus norvegicus
gaagtcggagttgttctgcctagca

SEQ ID NO: 634976 - DNA, 25 bp, Rattus norvegicus
ggcatgccatattcttctccaggac

SEQ ID NO: 634977 - DNA, 25 bp, Rattus norvegicus
ctgtcgtcacctgtctctgggcaga

SEQ ID NO: 634978 - DNA, 25 bp, Rattus norvegicus
gctcaagttagctctgggcgccaaa

SEQ ID NO: 634979 - DNA, 25 bp, Rattus norvegicus
ctgggcgccaaatgctcggtagaac

SEQ ID NO: 634980 - DNA, 25 bp, Rattus norvegicus
tggaaaccagagctccgcactgcta

SEQ ID NO: 634981 - DNA, 25 bp, Rattus norvegicus
ggcaatgcggccacataactgagaa

SEQ ID NO: 634982 - DNA, 25 bp, Rattus norvegicus
cgaaagcagccaccgaatcattaga

SEQ ID NO: 634983 - DNA, 25 bp, Rattus norvegicus
tgcgctagtcttgcggtccagaaga

SEQ ID NO: 634984 - DNA, 25 bp, Rattus norvegicus
ggcgagacagctcccaaaatggctc

SEQ ID NO: 634985 - DNA, 25 bp, Rattus norvegicus
agcggtgtttcgagagtcccaagac

SEQ ID NO: 634986 - DNA, 25 bp, Rattus norvegicus
gttggtcctacataagcggtgtttc

SEQ ID NO: 634987 - DNA, 25 bp, Rattus norvegicus
agttgctttagccatctgaccttga

SEQ ID NO: 634988 - DNA, 25 bp, Rattus norvegicus
agatgcttttactttcctacgaggg

SEQ ID NO: 634989 - DNA, 25 bp, Rattus norvegicus
gggcgagcaagaataccgtgtatta

SEQ ID NO: 634990 - DNA, 25 bp, Rattus norvegicus
agcttttagctttctcgcccagacg

SEQ ID NO: 634991 - DNA, 25 bp, Rattus norvegicus
accctgacgccggaataagtttgca

SEQ ID NO: 634992 - DNA, 25 bp, Rattus norvegicus
ccgccatgttaagtgcagtgaccca

SEQ ID NO: 634993 - DNA, 25 bp, Rattus norvegicus
ggcctctaaacttgctgtgtcattg

SEQ ID NO: 634994 - DNA, 25 bp, Rattus norvegicus
ggcccaggtgcagaaaatccagttt

SEQ ID NO: 634995 - DNA, 25 bp, Rattus norvegicus
ctctaaggcccagcagtttctcagc

SEQ ID NO: 634996 - DNA, 25 bp, Rattus norvegicus
tcgcctggttgcagtcctaggacct

SEQ ID NO: 634997 - DNA, 25 bp, Rattus norvegicus
aactacacacactgcgttccgcatg

SEQ ID NO: 634998 - DNA, 25 bp, Rattus norvegicus
gatggcccaggaccaccgaactaca

SEQ ID NO: 634999 - DNA, 25 bp, Rattus norvegicus
ttccgcatgtggtcgctggtccaaa

SEQ ID NO: 635000 - DNA, 25 bp, Rattus norvegicus
ttccgggtcccagagtttctgagtc

SEQ ID NO: 635001 - DNA, 25 bp, Rattus norvegicus
attgagtccctcagtgttccgggtc

SEQ ID NO: 635002 - DNA, 25 bp, Rattus norvegicus
cacgaagcaggagattgagtccctc

SEQ ID NO: 635003 - DNA, 25 bp, Rattus norvegicus
ccgaggtctgatcctgccggaaaaa

SEQ ID NO: 635004 - DNA, 25 bp, Rattus norvegicus
caagacaaagaaagtgggtggtccg

SEQ ID NO: 635005 - DNA, 25 bp, Rattus norvegicus
cctagatagaacactgcgcaagcgc

SEQ ID NO: 635006 - DNA, 25 bp, Rattus norvegicus
acgcaacgtcgtcctagatagaaca

SEQ ID NO: 635007 - DNA, 25 bp, Rattus norvegicus
gtcactatggcaaccggacgcaacg

SEQ ID NO: 635008 - DNA, 25 bp, Rattus norvegicus
accgagagggaaactgcggtcacta

SEQ ID NO: 635009 - DNA, 25 bp, Rattus norvegicus
tccacaggtgtaatgcgggttggtc

SEQ ID NO: 635010 - DNA, 25 bp, Rattus norvegicus
ggtgactggagcaaacaagacaaag

SEQ ID NO: 635011 - DNA, 25 bp, Rattus norvegicus
gaactgtccggaggcgtcgtaagac

SEQ ID NO: 635012 - DNA, 25 bp, Rattus norvegicus
aggagcccatgtggtcggctgtatc

SEQ ID NO: 635013 - DNA, 25 bp, Rattus norvegicus
tcgtaagactggtagaaggctggtc

SEQ ID NO: 635014 - DNA, 25 bp, Rattus norvegicus
ccgtcaaattcgtgtgtgaactgtc

SEQ ID NO: 635015 - DNA, 25 bp, Rattus norvegicus
cccttcttcagatccacagagaaaa

SEQ ID NO: 635016 - DNA, 25 bp, Rattus norvegicus
tgcaaactcgggcagacgccacacg

SEQ ID NO: 635017 - DNA, 25 bp, Rattus norvegicus
ctggttcggttggagcgttctacca

SEQ ID NO: 635018 - DNA, 25 bp, Rattus norvegicus
agcccgctctgaaagtccgagtacg

SEQ ID NO: 635019 - DNA, 25 bp, Rattus norvegicus
ggagatgctcatcagcccgctctga

SEQ ID NO: 635020 - DNA, 25 bp, Rattus norvegicus
agctctgatcatggagatgctcatc

SEQ ID NO: 635021 - DNA, 25 bp, Rattus norvegicus
tctaccaagacgtccagatgagctc

SEQ ID NO: 635022 - DNA, 25 bp, Rattus norvegicus
tccgagtacgcgaagtctgcaaact

SEQ ID NO: 635023 - DNA, 25 bp, Rattus norvegicus
aaggctggtccgtaggagcccatgt

SEQ ID NO: 635024 - DNA, 25 bp, Rattus norvegicus
taccactgacggctctggttcggtt

SEQ ID NO: 635025 - DNA, 25 bp, Rattus norvegicus
gacgacgcagcgattcatcatgaga

SEQ ID NO: 635026 - DNA, 25 bp, Rattus norvegicus
gcagcgattcatcatgagatgcatc

SEQ ID NO: 635027 - DNA, 25 bp, Rattus norvegicus
tgagatgcatcttcaaccgcgagga

SEQ ID NO: 635028 - DNA, 25 bp, Rattus norvegicus
aaccgcgaggagttcatgcgcttcg

SEQ ID NO: 635029 - DNA, 25 bp, Rattus norvegicus
gggccgagtcctggaacaagcagaa

SEQ ID NO: 635030 - DNA, 25 bp, Rattus norvegicus
aagcagaaggactacatggagcggc

SEQ ID NO: 635031 - DNA, 25 bp, Rattus norvegicus
gcttcacagtgaaacgccgaggtga

SEQ ID NO: 635032 - DNA, 25 bp, Rattus norvegicus
cagtgaaacgccgaggtgagatctc

SEQ ID NO: 635033 - DNA, 25 bp, Rattus norvegicus
tacgcggagaacaacgggacgacgc

SEQ ID NO: 635034 - DNA, 25 bp, Rattus norvegicus
tcctggaacaagcagaaggactaca

SEQ ID NO: 635035 - DNA, 25 bp, Rattus norvegicus
cgagctgagccagggcttcacagtg

SEQ ID NO: 635036 - DNA, 25 bp, Rattus norvegicus
ggcctctgtgccctcagaaaaccac

SEQ ID NO: 635037 - DNA, 25 bp, Rattus norvegicus
agacacaactacgagctgagccagg

SEQ ID NO: 635038 - DNA, 25 bp, Rattus norvegicus
tgcacgagtgctacgcggagaacaa

SEQ ID NO: 635039 - DNA, 25 bp, Rattus norvegicus
agtgccacgtcccagcaaaccgaga

SEQ ID NO: 635040 - DNA, 25 bp, Rattus norvegicus
gtgagaactccctgctgctccctta

SEQ ID NO: 635041 - DNA, 25 bp, Rattus norvegicus
gcaaaccgagaacggagaggatccc

SEQ ID NO: 635042 - DNA, 25 bp, Rattus norvegicus
agcttgaggcgcgagtgccacgtcc

SEQ ID NO: 635043 - DNA, 25 bp, Rattus norvegicus
aacttccggatctcgcgggagcttg

SEQ ID NO: 635044 - DNA, 25 bp, Rattus norvegicus
gcgccgccatgttggtaaaggtagc

SEQ ID NO: 635045 - DNA, 25 bp, Rattus norvegicus
agacgggaagtctcgcctcgagctc

SEQ ID NO: 635046 - DNA, 25 bp, Rattus norvegicus
ctcggcaccgaggtgacagcaccga

SEQ ID NO: 635047 - DNA, 25 bp, Rattus norvegicus
tccggcctgtggcagcgcgactcaa

SEQ ID NO: 635048 - DNA, 25 bp, Rattus norvegicus
cccaagacatgacgccggggccgag

SEQ ID NO: 635049 - DNA, 25 bp, Rattus norvegicus
gctccggctccagggtttgctgctc

SEQ ID NO: 635050 - DNA, 25 bp, Rattus norvegicus
ggagagggcgcgtgtttacaaacaa

SEQ ID NO: 635051 - DNA, 25 bp, Rattus norvegicus
ggccgccatctttgtatagacggga

SEQ ID NO: 635052 - DNA, 25 bp, Rattus norvegicus
atcccggagccggtgagaactccct

SEQ ID NO: 635053 - DNA, 25 bp, Rattus norvegicus
agtccctggccctgttgtctgagtt

SEQ ID NO: 635054 - DNA, 25 bp, Rattus norvegicus
gtggtctttggcgttagcctcctcc

SEQ ID NO: 635055 - DNA, 25 bp, Rattus norvegicus
caagtgcaggtgaaccgggctccgc

SEQ ID NO: 635056 - DNA, 25 bp, Rattus norvegicus
gcgcgggaagcacgctgccttccag

SEQ ID NO: 635057 - DNA, 25 bp, Rattus norvegicus
tgcgatcagcgtgcgcctagcggca

SEQ ID NO: 635058 - DNA, 25 bp, Rattus norvegicus
tagcggcatcggtcgtgcgatcagc

SEQ ID NO: 635059 - DNA, 25 bp, Rattus norvegicus
cccatctcaggtgcgggtagcggca

SEQ ID NO: 635060 - DNA, 25 bp, Rattus norvegicus
cggactctcccatctcaggtgcggg

SEQ ID NO: 635061 - DNA, 25 bp, Rattus norvegicus
tggccctgttgtctgagtttcagta

SEQ ID NO: 635062 - DNA, 25 bp, Rattus norvegicus
ataggcctgcttttttcgcccgcca

SEQ ID NO: 635063 - DNA, 25 bp, Rattus norvegicus
ctcagctcggccctttgtggtcttt

SEQ ID NO: 635064 - DNA, 25 bp, Rattus norvegicus
tctgagtttcagtaactttgcgccc

SEQ ID NO: 635065 - DNA, 25 bp, Rattus norvegicus
ctgctggagcaagtgcaggtgaacc

SEQ ID NO: 635066 - DNA, 25 bp, Rattus norvegicus
cccgccatctgtcgttgtgtcctgt

SEQ ID NO: 635067 - DNA, 25 bp, Rattus norvegicus
gccgcggctcctgattgtccaaacg

SEQ ID NO: 635068 - DNA, 25 bp, Rattus norvegicus
tccgaccttgggctctccacaagta

SEQ ID NO: 635069 - DNA, 25 bp, Rattus norvegicus
cgtcacggaggggagctccgacctt

SEQ ID NO: 635070 - DNA, 25 bp, Rattus norvegicus
tgtggctggctttccggggttccca

SEQ ID NO: 635071 - DNA, 25 bp, Rattus norvegicus
agccctaggacttcagggcgcgcgc

SEQ ID NO: 635072 - DNA, 25 bp, Rattus norvegicus
agagttgcgtctggacgtcccgagc

SEQ ID NO: 635073 - DNA, 25 bp, Rattus norvegicus
ttgggctctccacaagtaccagcac

SEQ ID NO: 635074 - DNA, 25 bp, Rattus norvegicus
caaacgcaattctcgagtctctggc

SEQ ID NO: 635075 - DNA, 25 bp, Rattus norvegicus
tggcagctacggaccgagcagacca

SEQ ID NO: 635076 - DNA, 25 bp, Rattus norvegicus
acgccagacattcactcgtgtattc

SEQ ID NO: 635077 - DNA, 25 bp, Rattus norvegicus
cggagtggctctgcctactttccca

SEQ ID NO: 635078 - DNA, 25 bp, Rattus norvegicus
ttccttcactccgagtcccggagtg

SEQ ID NO: 635079 - DNA, 25 bp, Rattus norvegicus
gggacgaacacccatcactgtctct

SEQ ID NO: 635080 - DNA, 25 bp, Rattus norvegicus
gagtctctggctccggccgagagtt

SEQ ID NO: 635081 - DNA, 25 bp, Rattus norvegicus
cgggttcacagcaccaaataggagt

SEQ ID NO: 635082 - DNA, 25 bp, Rattus norvegicus
tccctcggaacaactgctcgttttc

SEQ ID NO: 635083 - DNA, 25 bp, Rattus norvegicus
cctcggaacaactgctcgttttcct

SEQ ID NO: 635084 - DNA, 25 bp, Rattus norvegicus
gcccggatatggcggtgacgaaata

SEQ ID NO: 635085 - DNA, 25 bp, Rattus norvegicus
acactcacccgcgcgagtctgcgtc

SEQ ID NO: 635086 - DNA, 25 bp, Rattus norvegicus
cgcgggctgcgtggagtttacggac

SEQ ID NO: 635087 - DNA, 25 bp, Rattus norvegicus
agtttacggactagtgtctggggcg

SEQ ID NO: 635088 - DNA, 25 bp, Rattus norvegicus
tgggtcaccgggttcacagcaccaa

SEQ ID NO: 635089 - DNA, 25 bp, Rattus norvegicus
gggtcaccgggttcacagcaccaaa

SEQ ID NO: 635090 - DNA, 25 bp, Rattus norvegicus
gtcaccgggttcacagcaccaaata

SEQ ID NO: 635091 - DNA, 25 bp, Rattus norvegicus
accgggttcacagcaccaaatagga

SEQ ID NO: 635092 - DNA, 25 bp, Rattus norvegicus
tcctcaggttccctcggaacaactg

SEQ ID NO: 635093 - DNA, 25 bp, Rattus norvegicus
ctcaggttccctcggaacaactgct

SEQ ID NO: 635094 - DNA, 25 bp, Rattus norvegicus
aggttccctcggaacaactgctcgt

SEQ ID NO: 635095 - DNA, 25 bp, Rattus norvegicus
ggaaccactgctcctgtcccttgat

SEQ ID NO: 635096 - DNA, 25 bp, Rattus norvegicus
ggggtctgttctgctcccaaacctc

SEQ ID NO: 635097 - DNA, 25 bp, Rattus norvegicus
gaaggattgtgacctccgaaccagg

SEQ ID NO: 635098 - DNA, 25 bp, Rattus norvegicus
agatcctcaggctcattcggaacca

SEQ ID NO: 635099 - DNA, 25 bp, Rattus norvegicus
cacccgacgggaatgagaattgcca

SEQ ID NO: 635100 - DNA, 25 bp, Rattus norvegicus
gtcccttgattttccgtgtctcctc

SEQ ID NO: 635101 - DNA, 25 bp, Rattus norvegicus
cccaatgtctggagggacgctgatt

SEQ ID NO: 635102 - DNA, 25 bp, Rattus norvegicus
attgccagtgcgtcattcgtgtccg

SEQ ID NO: 635103 - DNA, 25 bp, Rattus norvegicus
ggttcacaggtatcgcagcacccga

SEQ ID NO: 635104 - DNA, 25 bp, Rattus norvegicus
tgtgcactttatacccaatgtctgg

SEQ ID NO: 635105 - DNA, 25 bp, Rattus norvegicus
agtccctcaggctctgtgcacttta

SEQ ID NO: 635106 - DNA, 25 bp, Rattus norvegicus
ctgagatccgggaatcggctgagtc

SEQ ID NO: 635107 - DNA, 25 bp, Rattus norvegicus
cggttttgaaacaccgcatcgaatg

SEQ ID NO: 635108 - DNA, 25 bp, Rattus norvegicus
tccacgtaggcgacagctatgaacc

SEQ ID NO: 635109 - DNA, 25 bp, Rattus norvegicus
ctgtggagtacagcgactcggaaga

SEQ ID NO: 635110 - DNA, 25 bp, Rattus norvegicus
acaggaagcaaagcatgagcggatt

SEQ ID NO: 635111 - DNA, 25 bp, Rattus norvegicus
cttcgcaaagtggaagagcagcgtg

SEQ ID NO: 635112 - DNA, 25 bp, Rattus norvegicus
gtcaggcattcagcttcgcaaagtg

SEQ ID NO: 635113 - DNA, 25 bp, Rattus norvegicus
gtctggctttgctccgtcaggcatt

SEQ ID NO: 635114 - DNA, 25 bp, Rattus norvegicus
ctgacttaaagcgatcggtctggct

SEQ ID NO: 635115 - DNA, 25 bp, Rattus norvegicus
cagcgtgaacaggaagcaaagcatg

SEQ ID NO: 635116 - DNA, 25 bp, Rattus norvegicus
tgagcggattgaaaacgacgtggcc

SEQ ID NO: 635117 - DNA, 25 bp, Rattus norvegicus
gtcacgccgcatcgctgtggagtac

SEQ ID NO: 635118 - DNA, 25 bp, Rattus norvegicus
cgactcggaagacgactcggagttc

SEQ ID NO: 635119 - DNA, 25 bp, Rattus norvegicus
agacgactcggagttcgatgaagta

SEQ ID NO: 635120 - DNA, 25 bp, Rattus norvegicus
ggacgactcggagttcgatgaagta

SEQ ID NO: 635121 - DNA, 25 bp, Rattus norvegicus
gcgcctagctttgcgatctgactta

SEQ ID NO: 635122 - DNA, 25 bp, Rattus norvegicus
aaacgacgtggccaccatcctgtca

SEQ ID NO: 635123 - DNA, 25 bp, Rattus norvegicus
gccttggccctgctggctaacgtct

SEQ ID NO: 635124 - DNA, 25 bp, Rattus norvegicus
tacgcaccgaggaaaggcaagggtc

SEQ ID NO: 635125 - DNA, 25 bp, Rattus norvegicus
ttctccaccggtccaggtcagggca

SEQ ID NO: 635126 - DNA, 25 bp, Rattus norvegicus
agggcagagcgcctcagcatcctca

SEQ ID NO: 635127 - DNA, 25 bp, Rattus norvegicus
tgctggctaacgtctccatggtaac

SEQ ID NO: 635128 - DNA, 25 bp, Rattus norvegicus
cgtctccatggtaaccgtacacaaa

SEQ ID NO: 635129 - DNA, 25 bp, Rattus norvegicus
acaaaccacctttcgctgcaggtcg

SEQ ID NO: 635130 - DNA, 25 bp, Rattus norvegicus
caggtcgggcggtcagcctccagat

SEQ ID NO: 635131 - DNA, 25 bp, Rattus norvegicus
ggtaaggggactccgggctcactca

SEQ ID NO: 635132 - DNA, 25 bp, Rattus norvegicus
tccgggctcactcaaaacgtctgtg

SEQ ID NO: 635133 - DNA, 25 bp, Rattus norvegicus
cgtctgtgactagcgctagacactc

SEQ ID NO: 635134 - DNA, 25 bp, Rattus norvegicus
agcccggcagagagcagactgcttt

SEQ ID NO: 635135 - DNA, 25 bp, Rattus norvegicus
cgtagcagcgtctaggcgtgacgaa

SEQ ID NO: 635136 - DNA, 25 bp, Rattus norvegicus
aaccacgcacgcgtagcagcgtcta

SEQ ID NO: 635137 - DNA, 25 bp, Rattus norvegicus
tgacctcagtttgggagagtccgcg

SEQ ID NO: 635138 - DNA, 25 bp, Rattus norvegicus
aactgacctcagtttgggagagtcc

SEQ ID NO: 635139 - DNA, 25 bp, Rattus norvegicus
cgggaacagaactgacctcagtttg

SEQ ID NO: 635140 - DNA, 25 bp, Rattus norvegicus
ttcgggaacagaactgacctcagtt

SEQ ID NO: 635141 - DNA, 25 bp, Rattus norvegicus
cgaggttcgggaacagaactgacct

SEQ ID NO: 635142 - DNA, 25 bp, Rattus norvegicus
ccgaatgggcctgaggaacctgcgc

SEQ ID NO: 635143 - DNA, 25 bp, Rattus norvegicus
tcccgaatgggcctgaggaacctgc

SEQ ID NO: 635144 - DNA, 25 bp, Rattus norvegicus
acgagcagtggtcccgaatgggcct

SEQ ID NO: 635145 - DNA, 25 bp, Rattus norvegicus
ggaaaacgagcagtggtcccgaatg

SEQ ID NO: 635146 - DNA, 25 bp, Rattus norvegicus
tggcacacaggaaacctggtccccg

SEQ ID NO: 635147 - DNA, 25 bp, Rattus norvegicus
accgcgttccggtactcagatgggg

SEQ ID NO: 635148 - DNA, 25 bp, Rattus norvegicus
aaccgcgttccggtactcagatggg

SEQ ID NO: 635149 - DNA, 25 bp, Rattus norvegicus
actcaaccgcgttccggtactcaga

SEQ ID NO: 635150 - DNA, 25 bp, Rattus norvegicus
ggactcaaccgcgttccggtactca

SEQ ID NO: 635151 - DNA, 25 bp, Rattus norvegicus
acagtgcgagccaaggggccagcca

SEQ ID NO: 635152 - DNA, 25 bp, Rattus norvegicus
cagcgcacgcactcggagctgatgg

SEQ ID NO: 635153 - DNA, 25 bp, Rattus norvegicus
ggctcaccgggcttcgaccggacag

SEQ ID NO: 635154 - DNA, 25 bp, Rattus norvegicus
gaccggacagcgagaatgtagcatg

SEQ ID NO: 635155 - DNA, 25 bp, Rattus norvegicus
atgtagcatgactggagaagcgcgc

SEQ ID NO: 635156 - DNA, 25 bp, Rattus norvegicus
tccacctggcgggtcaagcgttcga

SEQ ID NO: 635157 - DNA, 25 bp, Rattus norvegicus
tcaagcgttcgagctgcgcctgcaa

SEQ ID NO: 635158 - DNA, 25 bp, Rattus norvegicus
aacctctggttgtcccgctgcagct

SEQ ID NO: 635159 - DNA, 25 bp, Rattus norvegicus
tgcatgtcctcgtgcagcgcacgca

SEQ ID NO: 635160 - DNA, 25 bp, Rattus norvegicus
ccatggcggagcagagcgcacagat

SEQ ID NO: 635161 - DNA, 25 bp, Rattus norvegicus
cacagatcggacagccggcagaaca

SEQ ID NO: 635162 - DNA, 25 bp, Rattus norvegicus
gaacacgggagacgagagacctaca

SEQ ID NO: 635163 - DNA, 25 bp, Rattus norvegicus
gacctacagcttcttgcaaggactg

SEQ ID NO: 635164 - DNA, 25 bp, Rattus norvegicus
agctgcgcctgcaacctctggttgt

SEQ ID NO: 635165 - DNA, 25 bp, Rattus norvegicus
agatgacccgaaacaagtgggagcg

SEQ ID NO: 635166 - DNA, 25 bp, Rattus norvegicus
ggctcgttatgcagagaaacgcagg

SEQ ID NO: 635167 - DNA, 25 bp, Rattus norvegicus
cgggctcgttatgcagagaaacgca

SEQ ID NO: 635168 - DNA, 25 bp, Rattus norvegicus
gcgggctcgttatgcagagaaacgc

SEQ ID NO: 635169 - DNA, 25 bp, Rattus norvegicus
agcgggctcgttatgcagagaaacg

SEQ ID NO: 635170 - DNA, 25 bp, Rattus norvegicus
ggtggcgcagatgacccgaaacaag

SEQ ID NO: 635171 - DNA, 25 bp, Rattus norvegicus
aaacaagtgggagcgggctcgttat

SEQ ID NO: 635172 - DNA, 25 bp, Rattus norvegicus
cagatgacccgaaacaagtgggagc

SEQ ID NO: 635173 - DNA, 25 bp, Rattus norvegicus
gcagatgacccgaaacaagtgggag

SEQ ID NO: 635174 - DNA, 25 bp, Rattus norvegicus
tggcgcagatgacccgaaacaagtg

SEQ ID NO: 635175 - DNA, 25 bp, Rattus norvegicus
gtggcgcagatgacccgaaacaagt

SEQ ID NO: 635176 - DNA, 25 bp, Rattus norvegicus
tggtggcgcagatgacccgaaacaa

SEQ ID NO: 635177 - DNA, 25 bp, Rattus norvegicus
gagcgggctcgttatgcagagaaac

SEQ ID NO: 635178 - DNA, 25 bp, Rattus norvegicus
cgtggtggcgcagatgacccgaaac

SEQ ID NO: 635179 - DNA, 25 bp, Rattus norvegicus
aggtcggagacgttccagatcccaa

SEQ ID NO: 635180 - DNA, 25 bp, Rattus norvegicus
agacgttccagatcccaaatctgag

SEQ ID NO: 635181 - DNA, 25 bp, Rattus norvegicus
tcggagacgttccagatcccaaatc

SEQ ID NO: 635182 - DNA, 25 bp, Rattus norvegicus
gggccgagtctgactgccggatccc

SEQ ID NO: 635183 - DNA, 25 bp, Rattus norvegicus
ggtcggagacgttccagatcccaaa

SEQ ID NO: 635184 - DNA, 25 bp, Rattus norvegicus
gaggtcggagacgttccagatccca

SEQ ID NO: 635185 - DNA, 25 bp, Rattus norvegicus
agaggtcggagacgttccagatccc

SEQ ID NO: 635186 - DNA, 25 bp, Rattus norvegicus
cagaggtcggagacgttccagatcc

SEQ ID NO: 635187 - DNA, 25 bp, Rattus norvegicus
acagaggtcggagacgttccagatc

SEQ ID NO: 635188 - DNA, 25 bp, Rattus norvegicus
cccggtggatggagcagcaggggcc

SEQ ID NO: 635189 - DNA, 25 bp, Rattus norvegicus
tgactgccggatcccccagactctc

SEQ ID NO: 635190 - DNA, 25 bp, Rattus norvegicus
gagacgttccagatcccaaatctga

SEQ ID NO: 635191 - DNA, 25 bp, Rattus norvegicus
ccacagaggtcggagacgttccaga

SEQ ID NO: 635192 - DNA, 25 bp, Rattus norvegicus
gtcggagacgttccagatcccaaat

SEQ ID NO: 635193 - DNA, 25 bp, Rattus norvegicus
agttcatacacattgcgcttgcgca

SEQ ID NO: 635194 - DNA, 25 bp, Rattus norvegicus
ggtgggcatcatctgttcctttctg

SEQ ID NO: 635195 - DNA, 25 bp, Rattus norvegicus
ctgttcctttctgggctagcctaga

SEQ ID NO: 635196 - DNA, 25 bp, Rattus norvegicus
aggtcttccgtgtgcgtatctccaa

SEQ ID NO: 635197 - DNA, 25 bp, Rattus norvegicus
ggcatgctaggcacaaggtcttccg

SEQ ID NO: 635198 - DNA, 25 bp, Rattus norvegicus
cacggacagcttagacatctggatc

SEQ ID NO: 635199 - DNA, 25 bp, Rattus norvegicus
tagcctagaattcagcggagaaacg

SEQ ID NO: 635200 - DNA, 25 bp, Rattus norvegicus
cccggtctcaaggatgtgtacagca

SEQ ID NO: 635201 - DNA, 25 bp, Rattus norvegicus
cagggtcgtaaaatgcgcttgcgct

SEQ ID NO: 635202 - DNA, 25 bp, Rattus norvegicus
ttctggcagccttgaggcccaatgc

SEQ ID NO: 635203 - DNA, 25 bp, Rattus norvegicus
tcccggtgagccgatccttacactt

SEQ ID NO: 635204 - DNA, 25 bp, Rattus norvegicus
tgtggcctccgatccgaagttcagt

SEQ ID NO: 635205 - DNA, 25 bp, Rattus norvegicus
cgactgctgccctggttcgaatccg

SEQ ID NO: 635206 - DNA, 25 bp, Rattus norvegicus
tgaggtaggtttcttcacggacagc

SEQ ID NO: 635207 - DNA, 25 bp, Rattus norvegicus
cgccgggttcgcttagaaagctgcc

SEQ ID NO: 635208 - DNA, 25 bp, Rattus norvegicus
ttcgtcttcgctcccagtgcctagg

SEQ ID NO: 635209 - DNA, 25 bp, Rattus norvegicus
ccgggtttcgtcttcgctcccagtg

SEQ ID NO: 635210 - DNA, 25 bp, Rattus norvegicus
tgccaggtccactgcgaggaccgtg

SEQ ID NO: 635211 - DNA, 25 bp, Rattus norvegicus
acctggaggtgccaggtccactgcg

SEQ ID NO: 635212 - DNA, 25 bp, Rattus norvegicus
aagtcctggcacacccggccaagtg

SEQ ID NO: 635213 - DNA, 25 bp, Rattus norvegicus
gttgctacctagtcctggctgcaca

SEQ ID NO: 635214 - DNA, 25 bp, Rattus norvegicus
agtgctctcgggttgctacctagtc

SEQ ID NO: 635215 - DNA, 25 bp, Rattus norvegicus
ttcccagctcagtgctctcgggttg

SEQ ID NO: 635216 - DNA, 25 bp, Rattus norvegicus
gtgccgcttgcgaagcgacgaagca

SEQ ID NO: 635217 - DNA, 25 bp, Rattus norvegicus
gtgggtggctatcagaacgctgccc

SEQ ID NO: 635218 - DNA, 25 bp, Rattus norvegicus
caggttctcgatggtggtcaccaca

SEQ ID NO: 635219 - DNA, 25 bp, Rattus norvegicus
ctgccctcagctggcaggttctcga

SEQ ID NO: 635220 - DNA, 25 bp, Rattus norvegicus
cccagtgcctagggcttgtcctgct

SEQ ID NO: 635221 - DNA, 25 bp, Rattus norvegicus
tagaccagcatctaacccgagacga

SEQ ID NO: 635222 - DNA, 25 bp, Rattus norvegicus
acagagacacgaaggatcggaggta

SEQ ID NO: 635223 - DNA, 25 bp, Rattus norvegicus
acttccaatcgtcaaggaggaagtg

SEQ ID NO: 635224 - DNA, 25 bp, Rattus norvegicus
ctcagcgccgagatagaccagcatc

SEQ ID NO: 635225 - DNA, 25 bp, Rattus norvegicus
gcgccgagatagaccagcatctaac

SEQ ID NO: 635226 - DNA, 25 bp, Rattus norvegicus
tagttacttacttctcagcgccgag

SEQ ID NO: 635227 - DNA, 25 bp, Rattus norvegicus
ttcgtacttccaatcgtcaaggagg

SEQ ID NO: 635228 - DNA, 25 bp, Rattus norvegicus
atctaacccgagacgagctgaaagc

SEQ ID NO: 635229 - DNA, 25 bp, Rattus norvegicus
acccgagacgagctgaaagcaattc

SEQ ID NO: 635230 - DNA, 25 bp, Rattus norvegicus
gggctgcttcgtacttccaatcgtc

SEQ ID NO: 635231 - DNA, 25 bp, Rattus norvegicus
gtcgagggctgcttcgtacttccaa

SEQ ID NO: 635232 - DNA, 25 bp, Rattus norvegicus
cgagacgagctgaaagcaattccta

SEQ ID NO: 635233 - DNA, 25 bp, Rattus norvegicus
acgagctgaaagcaattcctaaact

SEQ ID NO: 635234 - DNA, 25 bp, Rattus norvegicus
tgggaagaggtgtaaacgctagtta

SEQ ID NO: 635235 - DNA, 25 bp, Rattus norvegicus
tgggcaataccacagagcctcagga

SEQ ID NO: 635236 - DNA, 25 bp, Rattus norvegicus
ccaaagtgcggattgggcaatacca

SEQ ID NO: 635237 - DNA, 25 bp, Rattus norvegicus
ctctagcccacggaccggtaagtgg

SEQ ID NO: 635238 - DNA, 25 bp, Rattus norvegicus
agtgggtggatgctcacttctccca

SEQ ID NO: 635239 - DNA, 25 bp, Rattus norvegicus
gtccgccctgcagaattcgaaggaa

SEQ ID NO: 635240 - DNA, 25 bp, Rattus norvegicus
attcgaaggaagaatgcgaattcta

SEQ ID NO: 635241 - DNA, 25 bp, Rattus norvegicus
tgcgaattctaagttcagagacctg

SEQ ID NO: 635242 - DNA, 25 bp, Rattus norvegicus
agttcagagacctgggacccgtctg

SEQ ID NO: 635243 - DNA, 25 bp, Rattus norvegicus
ccgacgctcccgaggggctcttggt

SEQ ID NO: 635244 - DNA, 25 bp, Rattus norvegicus
gcggcagccgccgaagcatgtagaa

SEQ ID NO: 635245 - DNA, 25 bp, Rattus norvegicus
ccgccgaagcatgtagaaggggtac

SEQ ID NO: 635246 - DNA, 25 bp, Rattus norvegicus
gggtcttgacgacgtaactgttctc

SEQ ID NO: 635247 - DNA, 25 bp, Rattus norvegicus
gtaactgttctccaccggccggagc

SEQ ID NO: 635248 - DNA, 25 bp, Rattus norvegicus
ctgcatgcagctagtggccgagcct

SEQ ID NO: 635249 - DNA, 25 bp, Rattus norvegicus
gctccgcccaacagggggtcagcgt

SEQ ID NO: 635250 - DNA, 25 bp, Rattus norvegicus
cgcttcgacagcgggcgtggggtgc

SEQ ID NO: 635251 - DNA, 25 bp, Rattus norvegicus
tccaccgtgatgttgcaccaaaact

SEQ ID NO: 635252 - DNA, 25 bp, Rattus norvegicus
ccaccgtgatgttgcaccaaaactg

SEQ ID NO: 635253 - DNA, 25 bp, Rattus norvegicus
caccgtgatgttgcaccaaaactgg

SEQ ID NO: 635254 - DNA, 25 bp, Rattus norvegicus
accgtgatgttgcaccaaaactggc

SEQ ID NO: 635255 - DNA, 25 bp, Rattus norvegicus
ccgtgatgttgcaccaaaactggct

SEQ ID NO: 635256 - DNA, 25 bp, Rattus norvegicus
cgtgatgttgcaccaaaactggcta

SEQ ID NO: 635257 - DNA, 25 bp, Rattus norvegicus
gtgatgttgcaccaaaactggctat

SEQ ID NO: 635258 - DNA, 25 bp, Rattus norvegicus
tgatgttgcaccaaaactggctatg

SEQ ID NO: 635259 - DNA, 25 bp, Rattus norvegicus
gatgttgcaccaaaactggctatgg

SEQ ID NO: 635260 - DNA, 25 bp, Rattus norvegicus
atgttgcaccaaaactggctatggg

SEQ ID NO: 635261 - DNA, 25 bp, Rattus norvegicus
ctccgcccaacagggggtcagcgtg

SEQ ID NO: 635262 - DNA, 25 bp, Rattus norvegicus
tccgcccaacagggggtcagcgtgc

SEQ ID NO: 635263 - DNA, 25 bp, Rattus norvegicus
ccgggtctgggaagagatcttatta

SEQ ID NO: 635264 - DNA, 25 bp, Rattus norvegicus
accggtgtctctgaaaggatcgcga

SEQ ID NO: 635265 - DNA, 25 bp, Rattus norvegicus
gagaccgtctgggatccacgcctaa

SEQ ID NO: 635266 - DNA, 25 bp, Rattus norvegicus
cagtcgcgagttcttggacttcttc

SEQ ID NO: 635267 - DNA, 25 bp, Rattus norvegicus
tattacggcggtctacagaaactcc

SEQ ID NO: 635268 - DNA, 25 bp, Rattus norvegicus
ctccgccagcgtaaaggatgagacc

SEQ ID NO: 635269 - DNA, 25 bp, Rattus norvegicus
tggacttcttctgggacatcgcgaa

SEQ ID NO: 635270 - DNA, 25 bp, Rattus norvegicus
ccgcagcctgttggagcacagtcgc

SEQ ID NO: 635271 - DNA, 25 bp, Rattus norvegicus
cctacgaaagctgagcctgcgtctc

SEQ ID NO: 635272 - DNA, 25 bp, Rattus norvegicus
agcccacgtgtttggttcagcatgg

SEQ ID NO: 635273 - DNA, 25 bp, Rattus norvegicus
agagactgtctttcgagcccacgtg

SEQ ID NO: 635274 - DNA, 25 bp, Rattus norvegicus
gaggcctgacctggaagagactgtc

SEQ ID NO: 635275 - DNA, 25 bp, Rattus norvegicus
aagctgcagtttctacacacgtgtg

SEQ ID NO: 635276 - DNA, 25 bp, Rattus norvegicus
acttgcgcacaaggccgagtgtatg

SEQ ID NO: 635277 - DNA, 25 bp, Rattus norvegicus
ggcgtccgctttgtctccgttcact

SEQ ID NO: 635278 - DNA, 25 bp, Rattus norvegicus
tcccactagcgagtctctttgcata

SEQ ID NO: 635279 - DNA, 25 bp, Rattus norvegicus
agcgagtctctttgcatacgcgccc

SEQ ID NO: 635280 - DNA, 25 bp, Rattus norvegicus
gcgcaacttatagcccggcgcacgg

SEQ ID NO: 635281 - DNA, 25 bp, Rattus norvegicus
tgcagagacccagagccgacgccag

SEQ ID NO: 635282 - DNA, 25 bp, Rattus norvegicus
ggcgccaggtccgtagctgctgatc

SEQ ID NO: 635283 - DNA, 25 bp, Rattus norvegicus
accgagatcagctgcctgccggagc

SEQ ID NO: 635284 - DNA, 25 bp, Rattus norvegicus
agagacgcctttcttcggctccctg

SEQ ID NO: 635285 - DNA, 25 bp, Rattus norvegicus
ctgcgggtgaccgaggcaagaaccc

SEQ ID NO: 635286 - DNA, 25 bp, Rattus norvegicus
tgcccgtagctgagctagggcgtcc

SEQ ID NO: 635287 - DNA, 25 bp, Rattus norvegicus
actactgtaagtttgccctgcaacc

SEQ ID NO: 635288 - DNA, 25 bp, Rattus norvegicus
gctgctgatcgggagaccgagatca

SEQ ID NO: 635289 - DNA, 25 bp, Rattus norvegicus
ggccagtcgccactactgtaagttt

SEQ ID NO: 635290 - DNA, 25 bp, Rattus norvegicus
cgcttcctggaacagagacgccttt

SEQ ID NO: 635291 - DNA, 25 bp, Rattus norvegicus
cactgcctcccttgtgcgcttcaca

SEQ ID NO: 635292 - DNA, 25 bp, Rattus norvegicus
ccaccagctctagaaggaaacctga

SEQ ID NO: 635293 - DNA, 25 bp, Rattus norvegicus
gcccgccaccagctctagaaggaaa

SEQ ID NO: 635294 - DNA, 25 bp, Rattus norvegicus
gctcgtcgccgcctcatcacatggc

SEQ ID NO: 635295 - DNA, 25 bp, Rattus norvegicus
cagcctttacctggagctgtggctc

SEQ ID NO: 635296 - DNA, 25 bp, Rattus norvegicus
ggatggctcccgcaatcagccttta

SEQ ID NO: 635297 - DNA, 25 bp, Rattus norvegicus
gacaagagggatggctcccgcaatc

SEQ ID NO: 635298 - DNA, 25 bp, Rattus norvegicus
aactcaggtgggcaaacttcgcccg

SEQ ID NO: 635299 - DNA, 25 bp, Rattus norvegicus
tgtgtcctcggggaccgtagagaaa

SEQ ID NO: 635300 - DNA, 25 bp, Rattus norvegicus
gcagccggcagagtgcaacctttcc

SEQ ID NO: 635301 - DNA, 25 bp, Rattus norvegicus
attcctccggctgggcagccggcag

SEQ ID NO: 635302 - DNA, 25 bp, Rattus norvegicus
taggtaccaggaggcggcgcccatt

SEQ ID NO: 635303 - DNA, 25 bp, Rattus norvegicus
aggaaacctgaagctgctgcggctc

SEQ ID NO: 635304 - DNA, 25 bp, Rattus norvegicus
ggcagcgccgtgcacttgttgccat

SEQ ID NO: 635305 - DNA, 25 bp, Rattus norvegicus
agaagcactcgctcaaaatcacgcg

SEQ ID NO: 635306 - DNA, 25 bp, Rattus norvegicus
acaagaaagcgtcctggtaggcgga

SEQ ID NO: 635307 - DNA, 25 bp, Rattus norvegicus
tacagcagaccactcagaagcactc

SEQ ID NO: 635308 - DNA, 25 bp, Rattus norvegicus
aaatcacgcggacactccaagagcc

SEQ ID NO: 635309 - DNA, 25 bp, Rattus norvegicus
ctccaagagccggaaacgcagaggc

SEQ ID NO: 635310 - DNA, 25 bp, Rattus norvegicus
aagatgacgcaacggcgcacgcgca

SEQ ID NO: 635311 - DNA, 25 bp, Rattus norvegicus
cgcaggagccgtacggacccaagaa

SEQ ID NO: 635312 - DNA, 25 bp, Rattus norvegicus
gagccgtacggacccaagaactaca

SEQ ID NO: 635313 - DNA, 25 bp, Rattus norvegicus
agaactacaagaaagcgtcctggta

SEQ ID NO: 635314 - DNA, 25 bp, Rattus norvegicus
accgttctctagtgacccggaactg

SEQ ID NO: 635315 - DNA, 25 bp, Rattus norvegicus
tgacccggaactgaggcgaccttta

SEQ ID NO: 635316 - DNA, 25 bp, Rattus norvegicus
ggacacctgtcgcttgtgagacgcc

SEQ ID NO: 635317 - DNA, 25 bp, Rattus norvegicus
acctgtcgcttgtgagacgcctttc

SEQ ID NO: 635318 - DNA, 25 bp, Rattus norvegicus
atcgggagctgtcatcgcctacctc

SEQ ID NO: 635319 - DNA, 25 bp, Rattus norvegicus
cccttccaggcccagactcgggtca

SEQ ID NO: 635320 - DNA, 25 bp, Rattus norvegicus
agcctttttgtaccttgtcggagtg

SEQ ID NO: 635321 - DNA, 25 bp, Rattus norvegicus
aggccggaagtaacgcgacgccact

SEQ ID NO: 635322 - DNA, 25 bp, Rattus norvegicus
ggaagtaacgcgacgccacttcctc

SEQ ID NO: 635323 - DNA, 25 bp, Rattus norvegicus
ccagaactcaggaaacggacttggc

SEQ ID NO: 635324 - DNA, 25 bp, Rattus norvegicus
ctcaggaaacggacttggcgtcgct

SEQ ID NO: 635325 - DNA, 25 bp, Rattus norvegicus
tccagtgggtggctggttctttcct

SEQ ID NO: 635326 - DNA, 25 bp, Rattus norvegicus
gagcgcctgtccgtcgcatcgcttt

SEQ ID NO: 635327 - DNA, 25 bp, Rattus norvegicus
agagtcagcctgagccggagcgcct

SEQ ID NO: 635328 - DNA, 25 bp, Rattus norvegicus
tgaggctcctgtcctcgggttccgc

SEQ ID NO: 635329 - DNA, 25 bp, Rattus norvegicus
cggtacctgaggctcctgtcctcgg

SEQ ID NO: 635330 - DNA, 25 bp, Rattus norvegicus
ctccggcgtccacagcctttttgta

SEQ ID NO: 635331 - DNA, 25 bp, Rattus norvegicus
gccactctccgcaggcctcgcggta

SEQ ID NO: 635332 - DNA, 25 bp, Rattus norvegicus
agcccggggagcacaagcactctcg

SEQ ID NO: 635333 - DNA, 25 bp, Rattus norvegicus
cggagtccgcagacatgttcgacaa

SEQ ID NO: 635334 - DNA, 25 bp, Rattus norvegicus
acgacgacgaagacctgctgctggc

SEQ ID NO: 635335 - DNA, 25 bp, Rattus norvegicus
ggcaccgcagcgctcgcacgctcgc

SEQ ID NO: 635336 - DNA, 25 bp, Rattus norvegicus
ggagctccaagaacccgctggtgaa

SEQ ID NO: 635337 - DNA, 25 bp, Rattus norvegicus
aagaacccgctggtgaagcctccct

SEQ ID NO: 635338 - DNA, 25 bp, Rattus norvegicus
tcgacccggagtccgcagacatgtt

SEQ ID NO: 635339 - DNA, 25 bp, Rattus norvegicus
gtcccagttgcccagctcggcccag

SEQ ID NO: 635340 - DNA, 25 bp, Rattus norvegicus
gcacgctcgcccttctccattgaga

SEQ ID NO: 635341 - DNA, 25 bp, Rattus norvegicus
gaccgcctgcggctatggagcctac

SEQ ID NO: 635342 - DNA, 25 bp, Rattus norvegicus
gctatggagcctacggctgcgccta

SEQ ID NO: 635343 - DNA, 25 bp, Rattus norvegicus
gcctacggcctgcagctgccgccct

SEQ ID NO: 635344 - DNA, 25 bp, Rattus norvegicus
gctgccgccttccacccgcactcac

SEQ ID NO: 635345 - DNA, 25 bp, Rattus norvegicus
agctggcgcggaccgccttcggcta

SEQ ID NO: 635346 - DNA, 25 bp, Rattus norvegicus
gcttcaagcgccagccgttgctcgc

SEQ ID NO: 635347 - DNA, 25 bp, Rattus norvegicus
ggcgaggaatttgctgcgctctcct

SEQ ID NO: 635348 - DNA, 25 bp, Rattus norvegicus
aagcgtgcgctgaattacttctcga

SEQ ID NO: 635349 - DNA, 25 bp, Rattus norvegicus
cgatcatctctattctaccgggtta

SEQ ID NO: 635350 - DNA, 25 bp, Rattus norvegicus
tggcggccttttctttccggagaga

SEQ ID NO: 635351 - DNA, 25 bp, Rattus norvegicus
cagcactccgcgctggcagaacgtg

SEQ ID NO: 635352 - DNA, 25 bp, Rattus norvegicus
ccctgggctgtttatttggttgtca

SEQ ID NO: 635353 - DNA, 25 bp, Rattus norvegicus
tgtcagcggactttggaaatgtttt

SEQ ID NO: 635354 - DNA, 25 bp, Rattus norvegicus
ccctcactccttggcctgatttata

SEQ ID NO: 635355 - DNA, 25 bp, Rattus norvegicus
cctaattaaaggctcggtgctctgc

SEQ ID NO: 635356 - DNA, 25 bp, Rattus norvegicus
ttccctccctgccaggaatgagcag

SEQ ID NO: 635357 - DNA, 25 bp, Rattus norvegicus
gcagccactactggggcgcttctgt

SEQ ID NO: 635358 - DNA, 25 bp, Rattus norvegicus
ggactagcctccgtcaggatgcaca

SEQ ID NO: 635359 - DNA, 25 bp, Rattus norvegicus
tcccggctgtttttacacctgcaca

SEQ ID NO: 635360 - DNA, 25 bp, Rattus norvegicus
ggacctcactcatggatccgcaagg

SEQ ID NO: 635361 - DNA, 25 bp, Rattus norvegicus
cacgcttcgcaacccgcggataggg

SEQ ID NO: 635362 - DNA, 25 bp, Rattus norvegicus
tatctgtacccgtggtcagctgcgc

SEQ ID NO: 635363 - DNA, 25 bp, Rattus norvegicus
tgccttaagctctttattaactccc

SEQ ID NO: 635364 - DNA, 25 bp, Rattus norvegicus
tgtggaaattaacctatctgtaccc

SEQ ID NO: 635365 - DNA, 25 bp, Rattus norvegicus
aacccgcggatagggtttctgcagc

SEQ ID NO: 635366 - DNA, 25 bp, Rattus norvegicus
tagggtttctgcagctccatgtgga

SEQ ID NO: 635367 - DNA, 25 bp, Rattus norvegicus
aacatgccttggctgacccacgctt

SEQ ID NO: 635368 - DNA, 25 bp, Rattus norvegicus
tgctaaacagattaacatgccttgg

SEQ ID NO: 635369 - DNA, 25 bp, Rattus norvegicus
ctgcagctccatgtggaaattaacc

SEQ ID NO: 635370 - DNA, 25 bp, Rattus norvegicus
tgcggcgcacatgctaaacagatta

SEQ ID NO: 635371 - DNA, 25 bp, Rattus norvegicus
tggtctggctcctccgtgcggcgca

SEQ ID NO: 635372 - DNA, 25 bp, Rattus norvegicus
ccgggctcgctgagcgcggttccta

SEQ ID NO: 635373 - DNA, 25 bp, Rattus norvegicus
ccgcgcgcaagctcgatacgtttac

SEQ ID NO: 635374 - DNA, 25 bp, Rattus norvegicus
ctcgatacgtttacttgccttaagc

SEQ ID NO: 635375 - DNA, 25 bp, Rattus norvegicus
ttcattttccactcggctgcttggc

SEQ ID NO: 635376 - DNA, 25 bp, Rattus norvegicus
agcgactggaaagctgggccacagc

SEQ ID NO: 635377 - DNA, 25 bp, Rattus norvegicus
gctcattaatttggcagcgactgga

SEQ ID NO: 635378 - DNA, 25 bp, Rattus norvegicus
ccaacctgacgtgggctcattaatt

SEQ ID NO: 635379 - DNA, 25 bp, Rattus norvegicus
tggctggggtgtaaacccaacctga

SEQ ID NO: 635380 - DNA, 25 bp, Rattus norvegicus
tgggccacagcgacacagccgggaa

SEQ ID NO: 635381 - DNA, 25 bp, Rattus norvegicus
gagctgcccagcgttcattttccac

SEQ ID NO: 635382 - DNA, 25 bp, Rattus norvegicus
gtgcaagagcctcgcgagctgccca

SEQ ID NO: 635383 - DNA, 25 bp, Rattus norvegicus
gcaaccgaaacatcgctgaaccctg

SEQ ID NO: 635384 - DNA, 25 bp, Rattus norvegicus
gctgctacccaggatggagccctga

SEQ ID NO: 635385 - DNA, 25 bp, Rattus norvegicus
gcatcgcctcagtgcgtcttccgga

SEQ ID NO: 635386 - DNA, 25 bp, Rattus norvegicus
acacagccgggaagcctttgtgggc

SEQ ID NO: 635387 - DNA, 25 bp, Rattus norvegicus
ggtcaggtcagagggcaaccgaaac

SEQ ID NO: 635388 - DNA, 25 bp, Rattus norvegicus
aggatggagccctgacctcctaccg

SEQ ID NO: 635389 - DNA, 25 bp, Rattus norvegicus
cgcctgaaggttcatttaaccgaga

SEQ ID NO: 635390 - DNA, 25 bp, Rattus norvegicus
gcaactaattgtaactccgcgatcc

SEQ ID NO: 635391 - DNA, 25 bp, Rattus norvegicus
tttgtcactccactgccagcgcggg

SEQ ID NO: 635392 - DNA, 25 bp, Rattus norvegicus
ctctagggttgcacagagcgtctcc

SEQ ID NO: 635393 - DNA, 25 bp, Rattus norvegicus
gtacctgtaagctgagcccggctca

SEQ ID NO: 635394 - DNA, 25 bp, Rattus norvegicus
cacattaaagctccgtgcccggtgc

SEQ ID NO: 635395 - DNA, 25 bp, Rattus norvegicus
cgcggctccagactggtcaagcaaa

SEQ ID NO: 635396 - DNA, 25 bp, Rattus norvegicus
cttttcgtttttgatggctggtcca

SEQ ID NO: 635397 - DNA, 25 bp, Rattus norvegicus
gcgacacaacgcctccaggtttctg

SEQ ID NO: 635398 - DNA, 25 bp, Rattus norvegicus
gtacagcctctgatctcttcgcaga

SEQ ID NO: 635399 - DNA, 25 bp, Rattus norvegicus
tccggaggattcaccacgaggaata

SEQ ID NO: 635400 - DNA, 25 bp, Rattus norvegicus
gcccggctcacatgcttcacattaa

SEQ ID NO: 635401 - DNA, 25 bp, Rattus norvegicus
aggtttctgacctgcctttcccaga

SEQ ID NO: 635402 - DNA, 25 bp, Rattus norvegicus
tcttcgcagagctcccagaatgggc

SEQ ID NO: 635403 - DNA, 25 bp, Rattus norvegicus
gcaaatgccctgtgcgtcgcagtct

SEQ ID NO: 635404 - DNA, 25 bp, Rattus norvegicus
gcgctagcactggatgatgggaacc

SEQ ID NO: 635405 - DNA, 25 bp, Rattus norvegicus
cgggtagagtccacgcacgacatcc

SEQ ID NO: 635406 - DNA, 25 bp, Rattus norvegicus
gcctgtcccgcgatcgcaaaaactg

SEQ ID NO: 635407 - DNA, 25 bp, Rattus norvegicus
aaactgcgagcgtcgttgtcctccg

SEQ ID NO: 635408 - DNA, 25 bp, Rattus norvegicus
tagcactgcgccaccaggcaaatgc

SEQ ID NO: 635409 - DNA, 25 bp, Rattus norvegicus
accctgggatgcaaaggtttcctgc

SEQ ID NO: 635410 - DNA, 25 bp, Rattus norvegicus
gcagaccctgcgattacactagaca

SEQ ID NO: 635411 - DNA, 25 bp, Rattus norvegicus
tagacaagttcacaggcccagcagc

SEQ ID NO: 635412 - DNA, 25 bp, Rattus norvegicus
cacatttggagacacccgaggcaca

SEQ ID NO: 635413 - DNA, 25 bp, Rattus norvegicus
ccacatctggatgcgttcttaaagc

SEQ ID NO: 635414 - DNA, 25 bp, Rattus norvegicus
ggaggcttctgttcgtgtctcggaa

SEQ ID NO: 635415 - DNA, 25 bp, Rattus norvegicus
agttagcgttctcccactacgcggg

SEQ ID NO: 635416 - DNA, 25 bp, Rattus norvegicus
actgcgacctgagaagcccgctgca

SEQ ID NO: 635417 - DNA, 25 bp, Rattus norvegicus
ccctcgaggatcaggaagcgattgc

SEQ ID NO: 635418 - DNA, 25 bp, Rattus norvegicus
tcggcttctgcgttcgggctccagc

SEQ ID NO: 635419 - DNA, 25 bp, Rattus norvegicus
tgccggacaacgtctgcacctcttc

SEQ ID NO: 635420 - DNA, 25 bp, Rattus norvegicus
tgcacctcttcgtccgcggacacga

SEQ ID NO: 635421 - DNA, 25 bp, Rattus norvegicus
gccgaggcgcattccaggcacatca

SEQ ID NO: 635422 - DNA, 25 bp, Rattus norvegicus
aggcgcattccaggcacatcatgcc

SEQ ID NO: 635423 - DNA, 25 bp, Rattus norvegicus
ctgcgctgctgctactgttcaatca

SEQ ID NO: 635424 - DNA, 25 bp, Rattus norvegicus
tgttcaatcagtgagacgggcggcc

SEQ ID NO: 635425 - DNA, 25 bp, Rattus norvegicus
aggctcgtgcccaatcacctccagg

SEQ ID NO: 635426 - DNA, 25 bp, Rattus norvegicus
caagtcacgcaggagcgatgaggcc

SEQ ID NO: 635427 - DNA, 25 bp, Rattus norvegicus
gccaccgaaccctcgaggatcagga

SEQ ID NO: 635428 - DNA, 25 bp, Rattus norvegicus
ccctcggcccaagctggcgggtttg

SEQ ID NO: 635429 - DNA, 25 bp, Rattus norvegicus
agcgatgaggccaccgaaccctcga

SEQ ID NO: 635430 - DNA, 25 bp, Rattus norvegicus
ggaccctcctcacgctgccggacaa

SEQ ID NO: 635431 - DNA, 25 bp, Rattus norvegicus
gtgcgggcccagcagcgactcttca

SEQ ID NO: 635432 - DNA, 25 bp, Rattus norvegicus
gccattcagggaaaaccgcgtggct

SEQ ID NO: 635433 - DNA, 25 bp, Rattus norvegicus
cggccattcagggaaaaccgcgtgg

SEQ ID NO: 635434 - DNA, 25 bp, Rattus norvegicus
cctcgcggccattcagggaaaaccg

SEQ ID NO: 635435 - DNA, 25 bp, Rattus norvegicus
ttgacgcgtggcctcgagcctcttt

SEQ ID NO: 635436 - DNA, 25 bp, Rattus norvegicus
ccaatctgcggctgggttgacgcgt

SEQ ID NO: 635437 - DNA, 25 bp, Rattus norvegicus
ctgctgcgccaatctgcggctgggt

SEQ ID NO: 635438 - DNA, 25 bp, Rattus norvegicus
cttcactgccctccgggaattcccg

SEQ ID NO: 635439 - DNA, 25 bp, Rattus norvegicus
ccggaccaattgcagggcggctggt

SEQ ID NO: 635440 - DNA, 25 bp, Rattus norvegicus
gccgcgccagcagaacccgggtccc

SEQ ID NO: 635441 - DNA, 25 bp, Rattus norvegicus
attccggtgtcaagtcgccgcgcca

SEQ ID NO: 635442 - DNA, 25 bp, Rattus norvegicus
acttgcgggattccggtgtcaagtc

SEQ ID NO: 635443 - DNA, 25 bp, Rattus norvegicus
atcacttgcgggattccggtgtcaa

SEQ ID NO: 635444 - DNA, 25 bp, Rattus norvegicus
ctgccacctcctggccgccagctct

SEQ ID NO: 635445 - DNA, 25 bp, Rattus norvegicus
cggccctgggaccagaggatttgtc

SEQ ID NO: 635446 - DNA, 25 bp, Rattus norvegicus
tacccactggcagccggggctgcgt

SEQ ID NO: 635447 - DNA, 25 bp, Rattus norvegicus
agattgtacccactggcagccgggg

SEQ ID NO: 635448 - DNA, 25 bp, Rattus norvegicus
cagcgagtccagattgtacccactg

SEQ ID NO: 635449 - DNA, 25 bp, Rattus norvegicus
tgggtaccagcgagtccagattgta

SEQ ID NO: 635450 - DNA, 25 bp, Rattus norvegicus
ccaagttgtgggtaccagcgagtcc

SEQ ID NO: 635451 - DNA, 25 bp, Rattus norvegicus
actagggtcaacttcgcggccctgg

SEQ ID NO: 635452 - DNA, 25 bp, Rattus norvegicus
agtgcggaactagggtcaacttcgc

SEQ ID NO: 635453 - DNA, 25 bp, Rattus norvegicus
cgctccactccggagtgcggaacta

SEQ ID NO: 635454 - DNA, 25 bp, Rattus norvegicus
cacgcacaccctctgcgcgtccggg

SEQ ID NO: 635455 - DNA, 25 bp, Rattus norvegicus
tacctgccttggtcctgggactctc

SEQ ID NO: 635456 - DNA, 25 bp, Rattus norvegicus
ggagcggcttacctgccttggtcct

SEQ ID NO: 635457 - DNA, 25 bp, Rattus norvegicus
aaggcagatgggctcgctccaccaa

SEQ ID NO: 635458 - DNA, 25 bp, Rattus norvegicus
atgggctcgctccaccaagttgtgg

SEQ ID NO: 635459 - DNA, 25 bp, Rattus norvegicus
acagagcttagtctccgcgatcctc

SEQ ID NO: 635460 - DNA, 25 bp, Rattus norvegicus
aggccgtggactctagctcggccgc

SEQ ID NO: 635461 - DNA, 25 bp, Rattus norvegicus
gctcacccagaaattctccacgaaa

SEQ ID NO: 635462 - DNA, 25 bp, Rattus norvegicus
gaaattctccacgaaatgcgccatg

SEQ ID NO: 635463 - DNA, 25 bp, Rattus norvegicus
gaaatgcgccatgaccatcgtgccg

SEQ ID NO: 635464 - DNA, 25 bp, Rattus norvegicus
cgccgctgtgtaaacacggaccggc

SEQ ID NO: 635465 - DNA, 25 bp, Rattus norvegicus
ttcttcccagagaccgcccgcgccc

SEQ ID NO: 635466 - DNA, 25 bp, Rattus norvegicus
tccagggcgcatgcgccacctagcg

SEQ ID NO: 635467 - DNA, 25 bp, Rattus norvegicus
ttcgctgggaatttaacagagctta

SEQ ID NO: 635468 - DNA, 25 bp, Rattus norvegicus
ttagtctccgcgatcctctggggct

SEQ ID NO: 635469 - DNA, 25 bp, Rattus norvegicus
cactcgcggccactgtccgggcctt

SEQ ID NO: 635470 - DNA, 25 bp, Rattus norvegicus
ccgtgcggccgtgcacggactctga

SEQ ID NO: 635471 - DNA, 25 bp, Rattus norvegicus
ccgagcgttcgctgggaatttaaca

SEQ ID NO: 635472 - DNA, 25 bp, Rattus norvegicus
tggactctagctcggccgcctgagg

SEQ ID NO: 635473 - DNA, 25 bp, Rattus norvegicus
ttgggcttagaaccgcgccgtcgcc

SEQ ID NO: 635474 - DNA, 25 bp, Rattus norvegicus
tggcgcccagcagcggttttcccaa

SEQ ID NO: 635475 - DNA, 25 bp, Rattus norvegicus
tcgccttggcaacgaagacggggct

SEQ ID NO: 635476 - DNA, 25 bp, Rattus norvegicus
cggcggtcgccttggcaacgaagac

SEQ ID NO: 635477 - DNA, 25 bp, Rattus norvegicus
tgcggaacaaagagaatccgggctc

SEQ ID NO: 635478 - DNA, 25 bp, Rattus norvegicus
gcctgaaatggctgcggaacaaaga

SEQ ID NO: 635479 - DNA, 25 bp, Rattus norvegicus
tgcctcccgtccggggcctgaaatg

SEQ ID NO: 635480 - DNA, 25 bp, Rattus norvegicus
accgtgcggcctgacaggcaacgca

SEQ ID NO: 635481 - DNA, 25 bp, Rattus norvegicus
ggtcccacaccatcccagaggcctc

SEQ ID NO: 635482 - DNA, 25 bp, Rattus norvegicus
acggcagctgttgggcttagaaccg

SEQ ID NO: 635483 - DNA, 25 bp, Rattus norvegicus
ggacatcgcttgtcccgtccgggtc

SEQ ID NO: 635484 - DNA, 25 bp, Rattus norvegicus
cagcagcggttttcccaagcggggt

SEQ ID NO: 635485 - DNA, 25 bp, Rattus norvegicus
tcgggcctttctgccgaagcggcgc

SEQ ID NO: 635486 - DNA, 25 bp, Rattus norvegicus
aacaaagagaatccgggctcgggcg

SEQ ID NO: 635487 - DNA, 25 bp, Rattus norvegicus
ccgcgggtacctccgagagtgcagc

SEQ ID NO: 635488 - DNA, 25 bp, Rattus norvegicus
catttggtacgctccaagatggcgg

SEQ ID NO: 635489 - DNA, 25 bp, Rattus norvegicus
gatgctcctggctcggggaatagct

SEQ ID NO: 635490 - DNA, 25 bp, Rattus norvegicus
ctggctcggggaatagctgcgtctc

SEQ ID NO: 635491 - DNA, 25 bp, Rattus norvegicus
gacttctccaaagagagagccgccc

SEQ ID NO: 635492 - DNA, 25 bp, Rattus norvegicus
gcaggcggagcctgagcctgtcacc

SEQ ID NO: 635493 - DNA, 25 bp, Rattus norvegicus
tgcagtgaacgatgcggtacccgca

SEQ ID NO: 635494 - DNA, 25 bp, Rattus norvegicus
tacccgcaggtgttccaagggccga

SEQ ID NO: 635495 - DNA, 25 bp, Rattus norvegicus
caagggccgaaataccgtagccata

SEQ ID NO: 635496 - DNA, 25 bp, Rattus norvegicus
taccgtagccatattgttccgggcc

SEQ ID NO: 635497 - DNA, 25 bp, Rattus norvegicus
agccatattgttccgggccgggctg

SEQ ID NO: 635498 - DNA, 25 bp, Rattus norvegicus
caaggtggtccgtccacttccggcg

SEQ ID NO: 635499 - DNA, 25 bp, Rattus norvegicus
cggcggtccatttggtacgctccaa

SEQ ID NO: 635500 - DNA, 25 bp, Rattus norvegicus
gcacgagacttctccaaagagagag

SEQ ID NO: 635501 - DNA, 25 bp, Rattus norvegicus
agcgcggtgattggatatcgctctg

SEQ ID NO: 635502 - DNA, 25 bp, Rattus norvegicus
ggtgtggcgttcttggctccgcccg

SEQ ID NO: 635503 - DNA, 25 bp, Rattus norvegicus
tcctgtggccctcattggcgccgct

SEQ ID NO: 635504 - DNA, 25 bp, Rattus norvegicus
atgaggcatttgctcctgtggccct

SEQ ID NO: 635505 - DNA, 25 bp, Rattus norvegicus
tatgaggcatttgctcctgtggccc

SEQ ID NO: 635506 - DNA, 25 bp, Rattus norvegicus
gccgatatgaggcatttgctcctgt

SEQ ID NO: 635507 - DNA, 25 bp, Rattus norvegicus
gagggccgatatgaggcatttgctc

SEQ ID NO: 635508 - DNA, 25 bp, Rattus norvegicus
ttggatatcgctctgggagtgctgt

SEQ ID NO: 635509 - DNA, 25 bp, Rattus norvegicus
cgtgcgctcatgtggagcgcggtga

SEQ ID NO: 635510 - DNA, 25 bp, Rattus norvegicus
cccttccgtctgtgctgaggcgcgg

SEQ ID NO: 635511 - DNA, 25 bp, Rattus norvegicus
aacgcccttccgtctgtgctgaggc

SEQ ID NO: 635512 - DNA, 25 bp, Rattus norvegicus
aaacgcccttccgtctgtgctgagg

SEQ ID NO: 635513 - DNA, 25 bp, Rattus norvegicus
gagaaacgcccttccgtctgtgctg

SEQ ID NO: 635514 - DNA, 25 bp, Rattus norvegicus
ctcgggtcgggttcgctgattggag

SEQ ID NO: 635515 - DNA, 25 bp, Rattus norvegicus
ccggttttcacgtccgtctcttctg

SEQ ID NO: 635516 - DNA, 25 bp, Rattus norvegicus
cggtaagcgtcacgaagagcagact

SEQ ID NO: 635517 - DNA, 25 bp, Rattus norvegicus
gaagagcagacttgctgaatttgtc

SEQ ID NO: 635518 - DNA, 25 bp, Rattus norvegicus
tgaatttgtcttcttccatggacga

SEQ ID NO: 635519 - DNA, 25 bp, Rattus norvegicus
ttccatggacgaaggtggtgatatg

SEQ ID NO: 635520 - DNA, 25 bp, Rattus norvegicus
ggaggcggaagcgttgtaatcccta

SEQ ID NO: 635521 - DNA, 25 bp, Rattus norvegicus
gcgttgtaatccctaccgtcagtgg

SEQ ID NO: 635522 - DNA, 25 bp, Rattus norvegicus
ccctaccgtcagtggcgtctgtctt

SEQ ID NO: 635523 - DNA, 25 bp, Rattus norvegicus
tggcgtctgtctttgacccgtctga

SEQ ID NO: 635524 - DNA, 25 bp, Rattus norvegicus
gacccgtctgacaatccattgaatg

SEQ ID NO: 635525 - DNA, 25 bp, Rattus norvegicus
ccacaggtttggagtactcctgaga

SEQ ID NO: 635526 - DNA, 25 bp, Rattus norvegicus
cagcgaagactcgtatttggtaatg

SEQ ID NO: 635527 - DNA, 25 bp, Rattus norvegicus
tccgtctcttctgggcggtaagcgt

SEQ ID NO: 635528 - DNA, 25 bp, Rattus norvegicus
ccattgaatgatgcaaccacaggtt

SEQ ID NO: 635529 - DNA, 25 bp, Rattus norvegicus
tgtacgtccgcctcagccttagcga

SEQ ID NO: 635530 - DNA, 25 bp, Rattus norvegicus
gtcatcgccgctggccacagactcc

SEQ ID NO: 635531 - DNA, 25 bp, Rattus norvegicus
ctcgaacttctcgatgtcatccacg

SEQ ID NO: 635532 - DNA, 25 bp, Rattus norvegicus
tctccttgatgtgtacgtccgcctc

SEQ ID NO: 635533 - DNA, 25 bp, Rattus norvegicus
gcctcagccttagcgatttcttcgt

SEQ ID NO: 635534 - DNA, 25 bp, Rattus norvegicus
agcgatttcttcgtcttctgtgggg

SEQ ID NO: 635535 - DNA, 25 bp, Rattus norvegicus
gaggcgctcccgctcacattgtctt

SEQ ID NO: 635536 - DNA, 25 bp, Rattus norvegicus
ttctgccttctcttcgtagtctccg

SEQ ID NO: 635537 - DNA, 25 bp, Rattus norvegicus
gtagtctccggcctctgaggattct

SEQ ID NO: 635538 - DNA, 25 bp, Rattus norvegicus
ccggcctctgaggattcttcaaaac

SEQ ID NO: 635539 - DNA, 25 bp, Rattus norvegicus
ggattcttcaaaaccagcgccttca

SEQ ID NO: 635540 - DNA, 25 bp, Rattus norvegicus
gccttcatcctcgaacttctcgatg

SEQ ID NO: 635541 - DNA, 25 bp, Rattus norvegicus
cagtttctgccttctcttcgtagtc

SEQ ID NO: 635542 - DNA, 25 bp, Rattus norvegicus
cagactccctcttctccttgatgtg

SEQ ID NO: 635543 - DNA, 25 bp, Rattus norvegicus
atggctcctgaagcagagacttttc

SEQ ID NO: 635544 - DNA, 25 bp, Rattus norvegicus
gccttggcacatggtgttttgaccc

SEQ ID NO: 635545 - DNA, 25 bp, Rattus norvegicus
ctagcctagtcattcccagtaaaga

SEQ ID NO: 635546 - DNA, 25 bp, Rattus norvegicus
aaacatagcgcagacgggttccgtg

SEQ ID NO: 635547 - DNA, 25 bp, Rattus norvegicus
aggcccggcttcgtctagaaacata

SEQ ID NO: 635548 - DNA, 25 bp, Rattus norvegicus
tgaaagcttcaaccaggacctcggg

SEQ ID NO: 635549 - DNA, 25 bp, Rattus norvegicus
atctccgcaacctggggtcccattg

SEQ ID NO: 635550 - DNA, 25 bp, Rattus norvegicus
tcccgggaaccgctattgccgcaga

SEQ ID NO: 635551 - DNA, 25 bp, Rattus norvegicus
gggtcccattgtcctttctgaaagc

SEQ ID NO: 635552 - DNA, 25 bp, Rattus norvegicus
tccgcctgcggttgcggttttatta

SEQ ID NO: 635553 - DNA, 25 bp, Rattus norvegicus
tgacacctgcatttcactgagcacg

SEQ ID NO: 635554 - DNA, 25 bp, Rattus norvegicus
tccctcagggctattataaagatcc

SEQ ID NO: 635555 - DNA, 25 bp, Rattus norvegicus
aaaggcattctccattctcagagga

SEQ ID NO: 635556 - DNA, 25 bp, Rattus norvegicus
agacgattcccatgcgggccttggc

SEQ ID NO: 635557 - DNA, 25 bp, Rattus norvegicus
actcgcataggcagcgaggtgcttc

SEQ ID NO: 635558 - DNA, 25 bp, Rattus norvegicus
tccgtggagttaggggagacaacaa

SEQ ID NO: 635559 - DNA, 25 bp, Rattus norvegicus
gaggcgcgccaaacttctggcccgg

SEQ ID NO: 635560 - DNA, 25 bp, Rattus norvegicus
ccgcgcgtctgcgagtccgagctgt

SEQ ID NO: 635561 - DNA, 25 bp, Rattus norvegicus
ccggcgacactgctggcctggctgt

SEQ ID NO: 635562 - DNA, 25 bp, Rattus norvegicus
gatcgcggactgacgagccactcgc

SEQ ID NO: 635563 - DNA, 25 bp, Rattus norvegicus
tactgcgaagacagctggcaggtga

SEQ ID NO: 635564 - DNA, 25 bp, Rattus norvegicus
tcggcactgctactgcgaagacagc

SEQ ID NO: 635565 - DNA, 25 bp, Rattus norvegicus
atgacggagctgcagtcggcactgc

SEQ ID NO: 635566 - DNA, 25 bp, Rattus norvegicus
cccttccgggcgtgagccgctgaga

SEQ ID NO: 635567 - DNA, 25 bp, Rattus norvegicus
gggttcctcaacacacctagcttca

SEQ ID NO: 635568 - DNA, 25 bp, Rattus norvegicus
aagccgagcggagcggactcgcata

SEQ ID NO: 635569 - DNA, 25 bp, Rattus norvegicus
gggagcgcgactccgctttgcctgc

SEQ ID NO: 635570 - DNA, 25 bp, Rattus norvegicus
gcttcagccaccgtcagagcttgtc

SEQ ID NO: 635571 - DNA, 25 bp, Rattus norvegicus
tttgacgtcaatgcccgccgggctc

SEQ ID NO: 635572 - DNA, 25 bp, Rattus norvegicus
ttatagccggttgaaatcgggtgcc

SEQ ID NO: 635573 - DNA, 25 bp, Rattus norvegicus
cccgaggcgagggaaatactgacca

SEQ ID NO: 635574 - DNA, 25 bp, Rattus norvegicus
gctccgctgccgtttgacgtcaatg

SEQ ID NO: 635575 - DNA, 25 bp, Rattus norvegicus
agaagagcccgggtcagccgtctgt

SEQ ID NO: 635576 - DNA, 25 bp, Rattus norvegicus
ctctccctcttcttatagccggttg

SEQ ID NO: 635577 - DNA, 25 bp, Rattus norvegicus
tggacttcctcgctgctcgggcact

SEQ ID NO: 635578 - DNA, 25 bp, Rattus norvegicus
ggagctctccatggtgctggacttc

SEQ ID NO: 635579 - DNA, 25 bp, Rattus norvegicus
ggcacccagcaaaggtagcagcagc

SEQ ID NO: 635580 - DNA, 25 bp, Rattus norvegicus
tgggcaccggcacccagcaaaggta

SEQ ID NO: 635581 - DNA, 25 bp, Rattus norvegicus
acggcagagtagatgtccagggctc

SEQ ID NO: 635582 - DNA, 25 bp, Rattus norvegicus
gggacgcatcatccacggcagagta

SEQ ID NO: 635583 - DNA, 25 bp, Rattus norvegicus
ctgaccagctccttctcatgggacg

SEQ ID NO: 635584 - DNA, 25 bp, Rattus norvegicus
tcagccgtctgtaggcagcgctccg

SEQ ID NO: 635585 - DNA, 25 bp, Rattus norvegicus
cgcagggtcgtggtagtacgctgca

SEQ ID NO: 635586 - DNA, 25 bp, Rattus norvegicus
ttgcgcccagcttcactttcacttt

SEQ ID NO: 635587 - DNA, 25 bp, Rattus norvegicus
cgcccttgcgcttgctctcttttag

SEQ ID NO: 635588 - DNA, 25 bp, Rattus norvegicus
gcgcttgctctcttttagcgcctta

SEQ ID NO: 635589 - DNA, 25 bp, Rattus norvegicus
tgctctcttttagcgccttagcagg

SEQ ID NO: 635590 - DNA, 25 bp, Rattus norvegicus
ttagcgccttagcaggtgatgacgc

SEQ ID NO: 635591 - DNA, 25 bp, Rattus norvegicus
ttagcaggtgatgacgcgcgcctgc

SEQ ID NO: 635592 - DNA, 25 bp, Rattus norvegicus
gcccagcttcactttcactttcgat

SEQ ID NO: 635593 - DNA, 25 bp, Rattus norvegicus
tcactttcactttcgatcccgggcg

SEQ ID NO: 635594 - DNA, 25 bp, Rattus norvegicus
ttcactttcgatcccgggcggctag

SEQ ID NO: 635595 - DNA, 25 bp, Rattus norvegicus
ctccgtccagcagggtggaatgcta

SEQ ID NO: 635596 - DNA, 25 bp, Rattus norvegicus
tccagcagggtggaatgctaggctc

SEQ ID NO: 635597 - DNA, 25 bp, Rattus norvegicus
tgggctctggcaaacgggccccagc

SEQ ID NO: 635598 - DNA, 25 bp, Rattus norvegicus
tggaatgctaggctcgcgcggtacc

SEQ ID NO: 635599 - DNA, 25 bp, Rattus norvegicus
caggaccttctttcaacctacctgg

SEQ ID NO: 635600 - DNA, 25 bp, Rattus norvegicus
ctgctgtcctgctgaagcgtttgtc

SEQ ID NO: 635601 - DNA, 25 bp, Rattus norvegicus
cgcatagctaagtggctgctgtcct

SEQ ID NO: 635602 - DNA, 25 bp, Rattus norvegicus
ctggtctgagaagagcgcatagcta

SEQ ID NO: 635603 - DNA, 25 bp, Rattus norvegicus
atcgcgagcccaggagcgctggtct

SEQ ID NO: 635604 - DNA, 25 bp, Rattus norvegicus
gcgagtccaggttccatcgcgagcc

SEQ ID NO: 635605 - DNA, 25 bp, Rattus norvegicus
cagaagagcagctgcgcgagtccag

SEQ ID NO: 635606 - DNA, 25 bp, Rattus norvegicus
ctcgactccgccaatgaggaacaga

SEQ ID NO: 635607 - DNA, 25 bp, Rattus norvegicus
acctctaattggtcggtgcagcgcg

SEQ ID NO: 635608 - DNA, 25 bp, Rattus norvegicus
atcgcgggccacctctaattggtcg

SEQ ID NO: 635609 - DNA, 25 bp, Rattus norvegicus
cggccctgcagctgagttttgcagc

SEQ ID NO: 635610 - DNA, 25 bp, Rattus norvegicus
cgatagcaagcacccaagagaaaga

SEQ ID NO: 635611 - DNA, 25 bp, Rattus norvegicus
ctgcagggccgcagaactgacctca

SEQ ID NO: 635612 - DNA, 25 bp, Rattus norvegicus
agcgtttgtcgcatgcatgcacacg

SEQ ID NO: 635613 - DNA, 25 bp, Rattus norvegicus
tggtgcctacaccaggcctgacatt

SEQ ID NO: 635614 - DNA, 25 bp, Rattus norvegicus
gatgactaacgtcagactccgggcg

SEQ ID NO: 635615 - DNA, 25 bp, Rattus norvegicus
ggaatcgaccgcaggcacatctgtg

SEQ ID NO: 635616 - DNA, 25 bp, Rattus norvegicus
ggctccgctggcttcggagcagacc

SEQ ID NO: 635617 - DNA, 25 bp, Rattus norvegicus
aggcctaggtgcctccggtccacgt

SEQ ID NO: 635618 - DNA, 25 bp, Rattus norvegicus
tgcctccggtccacgttggggattg

SEQ ID NO: 635619 - DNA, 25 bp, Rattus norvegicus
cctgacattcggcttcacgctaagg

SEQ ID NO: 635620 - DNA, 25 bp, Rattus norvegicus
tgccctgcggaacatggcggagcca

SEQ ID NO: 635621 - DNA, 25 bp, Rattus norvegicus
tgaccctgccacactaaaagctaag

SEQ ID NO: 635622 - DNA, 25 bp, Rattus norvegicus
tcccggctcgcgaaaggcgccggaa

SEQ ID NO: 635623 - DNA, 25 bp, Rattus norvegicus
ggcgccggaagtcattacgtaatca

SEQ ID NO: 635624 - DNA, 25 bp, Rattus norvegicus
tcattacgtaatcactcggcgccga

SEQ ID NO: 635625 - DNA, 25 bp, Rattus norvegicus
cacgctaaggcgtgccctgcggaac

SEQ ID NO: 635626 - DNA, 25 bp, Rattus norvegicus
cactcggcgccgatgactaacgtca

SEQ ID NO: 635627 - DNA, 25 bp, Rattus norvegicus
ccgttgcttctccaggtcgctgtct

SEQ ID NO: 635628 - DNA, 25 bp, Rattus norvegicus
gctgacagagcgaggcgtcgccaca

SEQ ID NO: 635629 - DNA, 25 bp, Rattus norvegicus
tcgctgtcttccagtctccggctag

SEQ ID NO: 635630 - DNA, 25 bp, Rattus norvegicus
cagtctccggctagtggtcagcatg

SEQ ID NO: 635631 - DNA, 25 bp, Rattus norvegicus
ctagtggtcagcatggcccgtgagt

SEQ ID NO: 635632 - DNA, 25 bp, Rattus norvegicus
ccgagcgtgcaagccgccgttgctt

SEQ ID NO: 635633 - DNA, 25 bp, Rattus norvegicus
tcagccttcctcagcgccgagcggc

SEQ ID NO: 635634 - DNA, 25 bp, Rattus norvegicus
tcgccacaccgagggccctctcagg

SEQ ID NO: 635635 - DNA, 25 bp, Rattus norvegicus
acagagcgaggcgtcgccacaccga

SEQ ID NO: 635636 - DNA, 25 bp, Rattus norvegicus
cgcgtgcgcggatgcctcgctgaca

SEQ ID NO: 635637 - DNA, 25 bp, Rattus norvegicus
cctcgctgacagaggacgctctttc

SEQ ID NO: 635638 - DNA, 25 bp, Rattus norvegicus
gaggacgctctttctcgcctcagcg

SEQ ID NO: 635639 - DNA, 25 bp, Rattus norvegicus
gacacgcacgcgcagtggctcaccg

SEQ ID NO: 635640 - DNA, 25 bp, Rattus norvegicus
ttctccaggtcgctgtcttccagtc

SEQ ID NO: 635641 - DNA, 25 bp, Rattus norvegicus
agaccgaggcagtgcgcgctcgctc

SEQ ID NO: 635642 - DNA, 25 bp, Rattus norvegicus
gccaccgtactcttccggtcccaga

SEQ ID NO: 635643 - DNA, 25 bp, Rattus norvegicus
ccctgacggaagtcgtcatttgggc

SEQ ID NO: 635644 - DNA, 25 bp, Rattus norvegicus
aagtcgtcatttgggcgagcccagc

SEQ ID NO: 635645 - DNA, 25 bp, Rattus norvegicus
gccccgtccgtggtagcaggccatg

SEQ ID NO: 635646 - DNA, 25 bp, Rattus norvegicus
gctctgagcaggaagacaccgtgct

SEQ ID NO: 635647 - DNA, 25 bp, Rattus norvegicus
tgagcaggaagacaccgtgctgttc

SEQ ID NO: 635648 - DNA, 25 bp, Rattus norvegicus
gaagacaccgtgctgttccggcgtg

SEQ ID NO: 635649 - DNA, 25 bp, Rattus norvegicus
acaccgtgctgttccggcgtggcac

SEQ ID NO: 635650 - DNA, 25 bp, Rattus norvegicus
tgctgttccggcgtggcaccggcca

SEQ ID NO: 635651 - DNA, 25 bp, Rattus norvegicus
ctaatgctcggagcgcggcccgaga

SEQ ID NO: 635652 - DNA, 25 bp, Rattus norvegicus
agtgcgcgctcgctcgggccacatg

SEQ ID NO: 635653 - DNA, 25 bp, Rattus norvegicus
gctcgggccacatgctgctaccaca

SEQ ID NO: 635654 - DNA, 25 bp, Rattus norvegicus
aggtcgcagccgggcgctaatgctc

SEQ ID NO: 635655 - DNA, 25 bp, Rattus norvegicus
tcacagatctccagcgccctagttg

SEQ ID NO: 635656 - DNA, 25 bp, Rattus norvegicus
ctccaccgcggtcgcctaaggaaag

SEQ ID NO: 635657 - DNA, 25 bp, Rattus norvegicus
ggcgaaactgccaccgaaactagct

SEQ ID NO: 635658 - DNA, 25 bp, Rattus norvegicus
acacgcgcttctccggtttccgtga

SEQ ID NO: 635659 - DNA, 25 bp, Rattus norvegicus
ttcgcccgcgagtccgagaaagaca

SEQ ID NO: 635660 - DNA, 25 bp, Rattus norvegicus
ctcccgcctgggtaaaagcataaag

SEQ ID NO: 635661 - DNA, 25 bp, Rattus norvegicus
ttacccaaaggagcggaaaccatga

SEQ ID NO: 635662 - DNA, 25 bp, Rattus norvegicus
ctcctctcctgggatgaattaccca

SEQ ID NO: 635663 - DNA, 25 bp, Rattus norvegicus
tactccaagtctccgaggacactgc

SEQ ID NO: 635664 - DNA, 25 bp, Rattus norvegicus
gctgaaatcaacaagggcgcacgca

SEQ ID NO: 635665 - DNA, 25 bp, Rattus norvegicus
agagcagcttccctcgaaatccagc

SEQ ID NO: 635666 - DNA, 25 bp, Rattus norvegicus
ccgcggtcacggatgagactcaatc

SEQ ID NO: 635667 - DNA, 25 bp, Rattus norvegicus
tcctctgcaaagtggacgcctgtgc

SEQ ID NO: 635668 - DNA, 25 bp, Rattus norvegicus
catttctggtggagaaggtttcgcc

SEQ ID NO: 635669 - DNA, 25 bp, Rattus norvegicus
cagccgcgagaggaccgacaaccat

SEQ ID NO: 635670 - DNA, 25 bp, Rattus norvegicus
tatgcacaggacgaaaggccctccc

SEQ ID NO: 635671 - DNA, 25 bp, Rattus norvegicus
tccggggatgtatgcacaggacgaa

SEQ ID NO: 635672 - DNA, 25 bp, Rattus norvegicus
agaggaccgacaaccatcattcccg

SEQ ID NO: 635673 - DNA, 25 bp, Rattus norvegicus
ttcccgccaggctcccacatctagc

SEQ ID NO: 635674 - DNA, 25 bp, Rattus norvegicus
agcagcgcgaccatacccacccggg

SEQ ID NO: 635675 - DNA, 25 bp, Rattus norvegicus
cccgccttcgccttcttctctggaa

SEQ ID NO: 635676 - DNA, 25 bp, Rattus norvegicus
tctctggaaaatccactcgggcttc

SEQ ID NO: 635677 - DNA, 25 bp, Rattus norvegicus
tggaaaatccactcgggcttccgcc

SEQ ID NO: 635678 - DNA, 25 bp, Rattus norvegicus
gcttccgccctaaggtggctgtcgt

SEQ ID NO: 635679 - DNA, 25 bp, Rattus norvegicus
gcgagaggaccgacaaccatcattc

SEQ ID NO: 635680 - DNA, 25 bp, Rattus norvegicus
actgcagcgaaacccgcccacgccg

SEQ ID NO: 635681 - DNA, 25 bp, Rattus norvegicus
cccgtcgccgcatcgcggcctcact

SEQ ID NO: 635682 - DNA, 25 bp, Rattus norvegicus
cgggcaccgaaactgggatcgagct

SEQ ID NO: 635683 - DNA, 25 bp, Rattus norvegicus
ctggctgcgtgtgaaggagtactat

SEQ ID NO: 635684 - DNA, 25 bp, Rattus norvegicus
ttccgaacatcctgctcaccggtta

SEQ ID NO: 635685 - DNA, 25 bp, Rattus norvegicus
cccgggagacacttagcctttgtca

SEQ ID NO: 635686 - DNA, 25 bp, Rattus norvegicus
atctggtatctttgcctggaggacc

SEQ ID NO: 635687 - DNA, 25 bp, Rattus norvegicus
aggaccggctgctgattctttgtcg

SEQ ID NO: 635688 - DNA, 25 bp, Rattus norvegicus
ccattcggtggaagtgtacctcccg

SEQ ID NO: 635689 - DNA, 25 bp, Rattus norvegicus
acagcccaggtaggcgtaaagacga

SEQ ID NO: 635690 - DNA, 25 bp, Rattus norvegicus
gtccagcgtactgcctgacccgaaa

SEQ ID NO: 635691 - DNA, 25 bp, Rattus norvegicus
gaccttccttactgcgggcgcttac

SEQ ID NO: 635692 - DNA, 25 bp, Rattus norvegicus
cagctcagccgcaggcttctagggc

SEQ ID NO: 635693 - DNA, 25 bp, Rattus norvegicus
gcgtcgtcgtccttactttctggga

SEQ ID NO: 635694 - DNA, 25 bp, Rattus norvegicus
tgacccgaaacgcaggccaggcttg

SEQ ID NO: 635695 - DNA, 25 bp, Rattus norvegicus
cgggtctcacgcctctaggacatta

SEQ ID NO: 635696 - DNA, 25 bp, Rattus norvegicus
taagaaaagcggaagcgtcgtcgtc

SEQ ID NO: 635697 - DNA, 25 bp, Rattus norvegicus
ccatacgagtgagaagccagcgtcc

SEQ ID NO: 635698 - DNA, 25 bp, Rattus norvegicus
ggactcagcacaaggcctcacctgt

SEQ ID NO: 635699 - DNA, 25 bp, Rattus norvegicus
tccctctccgaggaagtccagtttc

SEQ ID NO: 635700 - DNA, 25 bp, Rattus norvegicus
agtccagtttctcatagcgcttcgc

SEQ ID NO: 635701 - DNA, 25 bp, Rattus norvegicus
agcgcttcgctcgagatttcacgtc

SEQ ID NO: 635702 - DNA, 25 bp, Rattus norvegicus
tttcacgtccacagccatacgagtg

SEQ ID NO: 635703 - DNA, 25 bp, Rattus norvegicus
gccagcgtccagcagctaaactaag

SEQ ID NO: 635704 - DNA, 25 bp, Rattus norvegicus
cccgcaggaatttaaagcgtctgaa

SEQ ID NO: 635705 - DNA, 25 bp, Rattus norvegicus
agcgtctgaaagtttccaacagcta

SEQ ID NO: 635706 - DNA, 25 bp, Rattus norvegicus
ccaacagctacttccgttcactgga

SEQ ID NO: 635707 - DNA, 25 bp, Rattus norvegicus
gagaacagccgcacggccggactca

SEQ ID NO: 635708 - DNA, 25 bp, Rattus norvegicus
ctggacgcgcataacctactgactc

SEQ ID NO: 635709 - DNA, 25 bp, Rattus norvegicus
aacaggctgtgcctgcgcgagaaca

SEQ ID NO: 635710 - DNA, 25 bp, Rattus norvegicus
ccgttcactggacgcgcataaccta

SEQ ID NO: 635711 - DNA, 25 bp, Rattus norvegicus
cgcgagccttactgtatagcgtttt

SEQ ID NO: 635712 - DNA, 25 bp, Rattus norvegicus
ccgggcctggattctcaacaccgtt

SEQ ID NO: 635713 - DNA, 25 bp, Rattus norvegicus
tcgcacggggcgtcacgtgtctcgc

SEQ ID NO: 635714 - DNA, 25 bp, Rattus norvegicus
ccagttctcgcgaggcttgatgact

SEQ ID NO: 635715 - DNA, 25 bp, Rattus norvegicus
tggattctcaacaccgttcctatgg

SEQ ID NO: 635716 - DNA, 25 bp, Rattus norvegicus
tactgtatagcgttttggggctccc

SEQ ID NO: 635717 - DNA, 25 bp, Rattus norvegicus
cgtgtctcgcgagccttactgtata

SEQ ID NO: 635718 - DNA, 25 bp, Rattus norvegicus
gcggacctgtaggagcgacactgac

SEQ ID NO: 635719 - DNA, 25 bp, Rattus norvegicus
aaaatgcggacctgtaggagcgaca

SEQ ID NO: 635720 - DNA, 25 bp, Rattus norvegicus
agcacttctcgcgaggctgtaggca

SEQ ID NO: 635721 - DNA, 25 bp, Rattus norvegicus
cgccagcacttctcgcgaggctgta

SEQ ID NO: 635722 - DNA, 25 bp, Rattus norvegicus
tgatgacttcgttccgccagcactt

SEQ ID NO: 635723 - DNA, 25 bp, Rattus norvegicus
tcgcgaggcttgatgacttcgttcc

SEQ ID NO: 635724 - DNA, 25 bp, Rattus norvegicus
tctcaacaccgttcctatggcaacg

SEQ ID NO: 635725 - DNA, 25 bp, Rattus norvegicus
agtccgcagactactagagctaatg

SEQ ID NO: 635726 - DNA, 25 bp, Rattus norvegicus
gctagggccttcctccggattggct

SEQ ID NO: 635727 - DNA, 25 bp, Rattus norvegicus
gctggctggcgaacaacattaaacg

SEQ ID NO: 635728 - DNA, 25 bp, Rattus norvegicus
cctgtgtgatgtcactgaggagcta

SEQ ID NO: 635729 - DNA, 25 bp, Rattus norvegicus
gactgctggagcagcgtagtccgca

SEQ ID NO: 635730 - DNA, 25 bp, Rattus norvegicus
tcactgaggagctataagggccagc

SEQ ID NO: 635731 - DNA, 25 bp, Rattus norvegicus
ctactagagctaatgaggtgccggg

SEQ ID NO: 635732 - DNA, 25 bp, Rattus norvegicus
cacgagcagacactaccagaggcca

SEQ ID NO: 635733 - DNA, 25 bp, Rattus norvegicus
ggagccagagccgaagtttccattc

SEQ ID NO: 635734 - DNA, 25 bp, Rattus norvegicus
gccgaagtttccattctcagacaca

SEQ ID NO: 635735 - DNA, 25 bp, Rattus norvegicus
gggagcggcccaggttttacctgca

SEQ ID NO: 635736 - DNA, 25 bp, Rattus norvegicus
ttttacctgcacgaccctggtggcg

SEQ ID NO: 635737 - DNA, 25 bp, Rattus norvegicus
ggaagccatcttgctgcccatcatg

SEQ ID NO: 635738 - DNA, 25 bp, Rattus norvegicus
acattaaacggcgattggccggact

SEQ ID NO: 635739 - DNA, 25 bp, Rattus norvegicus
gccacgaaattgactcccggaagta

SEQ ID NO: 635740 - DNA, 25 bp, Rattus norvegicus
accttcttctcacgggcagcgggtt

SEQ ID NO: 635741 - DNA, 25 bp, Rattus norvegicus
gacttttgaccaacacacgcgagcg

SEQ ID NO: 635742 - DNA, 25 bp, Rattus norvegicus
ggcttctagttaggacttttgacca

SEQ ID NO: 635743 - DNA, 25 bp, Rattus norvegicus
tccttttctaggcttctagttagga

SEQ ID NO: 635744 - DNA, 25 bp, Rattus norvegicus
accgcgctgcgttccttttctaggc

SEQ ID NO: 635745 - DNA, 25 bp, Rattus norvegicus
tagttaccgcgctgcgttccttttc

SEQ ID NO: 635746 - DNA, 25 bp, Rattus norvegicus
gcagcagttcttcccgccacgaaat

SEQ ID NO: 635747 - DNA, 25 bp, Rattus norvegicus
cagaggagaaacaccgcagcagttc

SEQ ID NO: 635748 - DNA, 25 bp, Rattus norvegicus
tccatcgcagaggagaaacaccgca

SEQ ID NO: 635749 - DNA, 25 bp, Rattus norvegicus
gcagcggctccatcgcagaggagaa

SEQ ID NO: 635750 - DNA, 25 bp, Rattus norvegicus
tgatgcggtccatgatccgctcctc

SEQ ID NO: 635751 - DNA, 25 bp, Rattus norvegicus
caggctgatgcggtccatgatccgc

SEQ ID NO: 635752 - DNA, 25 bp, Rattus norvegicus
cagcgggttgccgtagttaccgcgc

SEQ ID NO: 635753 - DNA, 25 bp, Rattus norvegicus
ggcagcttttccgacccagccctga

SEQ ID NO: 635754 - DNA, 25 bp, Rattus norvegicus
tgcagcctctgggaaagcgcagaga

SEQ ID NO: 635755 - DNA, 25 bp, Rattus norvegicus
cagaactgctgcgaggcactcctgg

SEQ ID NO: 635756 - DNA, 25 bp, Rattus norvegicus
aaattgtacgggaggcccaggccag

SEQ ID NO: 635757 - DNA, 25 bp, Rattus norvegicus
acccagccctgagcccgggccagct

SEQ ID NO: 635758 - DNA, 25 bp, Rattus norvegicus
cgcagagaaattgtacgggaggccc

SEQ ID NO: 635759 - DNA, 25 bp, Rattus norvegicus
actgctgcgagtgcagcctctggga

SEQ ID NO: 635760 - DNA, 25 bp, Rattus norvegicus
tatttggtgaaactgctgcgagtgc

SEQ ID NO: 635761 - DNA, 25 bp, Rattus norvegicus
ccgggacattatttggtgaaactgc

SEQ ID NO: 635762 - DNA, 25 bp, Rattus norvegicus
ctcacctcctgggtgtggctagctg

SEQ ID NO: 635763 - DNA, 25 bp, Rattus norvegicus
gagtactactcacctcctgggtgtg

SEQ ID NO: 635764 - DNA, 25 bp, Rattus norvegicus
cggctcggttcggagtactactcac

SEQ ID NO: 635765 - DNA, 25 bp, Rattus norvegicus
tgcgaggcactcctggactacggcc

SEQ ID NO: 635766 - DNA, 25 bp, Rattus norvegicus
gaacggcgcagtgaggcagcttttc

SEQ ID NO: 635767 - DNA, 25 bp, Rattus norvegicus
actcgctctcttcccattggtgctg

SEQ ID NO: 635768 - DNA, 25 bp, Rattus norvegicus
cctcgtgaggtcaagctctgcgcct

SEQ ID NO: 635769 - DNA, 25 bp, Rattus norvegicus
atcccgcgatcccaagttcggcgag

SEQ ID NO: 635770 - DNA, 25 bp, Rattus norvegicus
tagaatgcgtttcctgggcgatccc

SEQ ID NO: 635771 - DNA, 25 bp, Rattus norvegicus
tcttcccattggtgctgcgggttcc

SEQ ID NO: 635772 - DNA, 25 bp, Rattus norvegicus
tggtcagttcatggcactcgctctc

SEQ ID NO: 635773 - DNA, 25 bp, Rattus norvegicus
cctcattggtcagttcatggcactc

SEQ ID NO: 635774 - DNA, 25 bp, Rattus norvegicus
ctggctgcccacacctaaacactaa

SEQ ID NO: 635775 - DNA, 25 bp, Rattus norvegicus
gagaagacaccctaacctctggctg

SEQ ID NO: 635776 - DNA, 25 bp, Rattus norvegicus
ttcgccgatctgagaagacacccta

SEQ ID NO: 635777 - DNA, 25 bp, Rattus norvegicus
ctcctgaagcagaggttcgccgatc

SEQ ID NO: 635778 - DNA, 25 bp, Rattus norvegicus
gcgccatggctcctcctgaagcaga

SEQ ID NO: 635779 - DNA, 25 bp, Rattus norvegicus
accctagtgaccctgagcgccatgg

SEQ ID NO: 635780 - DNA, 25 bp, Rattus norvegicus
ctgcgggttcccgtagaatgcgttt

SEQ ID NO: 635781 - DNA, 25 bp, Rattus norvegicus
acctaaggtccatctcggctacagc

SEQ ID NO: 635782 - DNA, 25 bp, Rattus norvegicus
tcaagccatggaccgtagaggtagc

SEQ ID NO: 635783 - DNA, 25 bp, Rattus norvegicus
tgaatccctccttaccgggcgctgg

SEQ ID NO: 635784 - DNA, 25 bp, Rattus norvegicus
gggctctcctcatgtcttgctgccg

SEQ ID NO: 635785 - DNA, 25 bp, Rattus norvegicus
atttcagtcgcgtcctctcaggctc

SEQ ID NO: 635786 - DNA, 25 bp, Rattus norvegicus
ctcggcaggtaggagcacgcacgtt

SEQ ID NO: 635787 - DNA, 25 bp, Rattus norvegicus
gcagggacgttaccgggccacgtca

SEQ ID NO: 635788 - DNA, 25 bp, Rattus norvegicus
ggagtgaccaatcctgcgcgtgcgc

SEQ ID NO: 635789 - DNA, 25 bp, Rattus norvegicus
ggacacgtgtctcctctcggctcag

SEQ ID NO: 635790 - DNA, 25 bp, Rattus norvegicus
tcccaccgcagagaaggctcggatc

SEQ ID NO: 635791 - DNA, 25 bp, Rattus norvegicus
ccgctcgcggatctcaagccatgga

SEQ ID NO: 635792 - DNA, 25 bp, Rattus norvegicus
tagagaagcaccttaccggtccctg

SEQ ID NO: 635793 - DNA, 25 bp, Rattus norvegicus
ggctacagcttgttctccttgcgcg

SEQ ID NO: 635794 - DNA, 25 bp, Rattus norvegicus
ccctactcgcgtcttctagagaagc

SEQ ID NO: 635795 - DNA, 25 bp, Rattus norvegicus
gcttgctttatcacgcgtcatggcc

SEQ ID NO: 635796 - DNA, 25 bp, Rattus norvegicus
gtttattaacgtagagcttgcttta

SEQ ID NO: 635797 - DNA, 25 bp, Rattus norvegicus
cccagcgtgtttattaacgtagagc

SEQ ID NO: 635798 - DNA, 25 bp, Rattus norvegicus
gcgtcatggccccagcgtgtttatt

SEQ ID NO: 635799 - DNA, 25 bp, Rattus norvegicus
taacgtagagcttgctttatcacgc

SEQ ID NO: 635800 - DNA, 25 bp, Rattus norvegicus
cgtgtttattaacgtagagcttgct

SEQ ID NO: 635801 - DNA, 25 bp, Rattus norvegicus
ccagcgtgtttattaacgtagagct

SEQ ID NO: 635802 - DNA, 25 bp, Rattus norvegicus
cgtcatggccccagcgtgtttatta

SEQ ID NO: 635803 - DNA, 25 bp, Rattus norvegicus
cttgctttatcacgcgtcatggccc

SEQ ID NO: 635804 - DNA, 25 bp, Rattus norvegicus
gagcttgctttatcacgcgtcatgg

SEQ ID NO: 635805 - DNA, 25 bp, Rattus norvegicus
cgtagagcttgctttatcacgcgtc

SEQ ID NO: 635806 - DNA, 25 bp, Rattus norvegicus
gtgtttattaacgtagagcttgctt

SEQ ID NO: 635807 - DNA, 25 bp, Rattus norvegicus
agcgtgtttattaacgtagagcttg

SEQ ID NO: 635808 - DNA, 25 bp, Rattus norvegicus
gcgtgtttattaacgtagagcttgc

SEQ ID NO: 635809 - DNA, 25 bp, Rattus norvegicus
ctcgactctgtctatgctgacgcta

SEQ ID NO: 635810 - DNA, 25 bp, Rattus norvegicus
gcggcccacagttgctttgcatggc

SEQ ID NO: 635811 - DNA, 25 bp, Rattus norvegicus
ttcttgtttgcgtttgcttagtgtc

SEQ ID NO: 635812 - DNA, 25 bp, Rattus norvegicus
ggcgaatattccactactccgcgca

SEQ ID NO: 635813 - DNA, 25 bp, Rattus norvegicus
tactccgcgcacctggcagtctgtt

SEQ ID NO: 635814 - DNA, 25 bp, Rattus norvegicus
cgcacctggcagtctgttcgagtcg

SEQ ID NO: 635815 - DNA, 25 bp, Rattus norvegicus
cagtctgttcgagtcgcggcccaca

SEQ ID NO: 635816 - DNA, 25 bp, Rattus norvegicus
gctttaacacgcgtcatggccccag

SEQ ID NO: 635817 - DNA, 25 bp, Rattus norvegicus
tagagcttgctttattgcgcgtagc

SEQ ID NO: 635818 - DNA, 25 bp, Rattus norvegicus
gcacttttcgcctcgactctgtcta

SEQ ID NO: 635819 - DNA, 25 bp, Rattus norvegicus
ggaccgtggcgaatattccactact

SEQ ID NO: 635820 - DNA, 25 bp, Rattus norvegicus
tctatgctgacgctaaagttgccgc

SEQ ID NO: 635821 - DNA, 25 bp, Rattus norvegicus
agttgccgcgttgatgtcttcttgt

SEQ ID NO: 635822 - DNA, 25 bp, Rattus norvegicus
ttgcgcgtagcacttttcgcctcga

SEQ ID NO: 635823 - DNA, 25 bp, Rattus norvegicus
cgcacgtctcgctcagataaagatc

SEQ ID NO: 635824 - DNA, 25 bp, Rattus norvegicus
gccggttcccctgggctaggctgca

SEQ ID NO: 635825 - DNA, 25 bp, Rattus norvegicus
agcagagctcccctgggtcgcgcta

SEQ ID NO: 635826 - DNA, 25 bp, Rattus norvegicus
cgcgcgactctcagcccggctgccg

SEQ ID NO: 635827 - DNA, 25 bp, Rattus norvegicus
agatcgcggcttcatgattaactcg

SEQ ID NO: 635828 - DNA, 25 bp, Rattus norvegicus
ctcagataaagatcgcggcttcatg

SEQ ID NO: 635829 - DNA, 25 bp, Rattus norvegicus
tcgcgctactgcaagggggaagaaa

SEQ ID NO: 635830 - DNA, 25 bp, Rattus norvegicus
cgtctcgctcagataaagatcgcgg

SEQ ID NO: 635831 - DNA, 25 bp, Rattus norvegicus
gcgctcgcacgtctcgctcagataa

SEQ ID NO: 635832 - DNA, 25 bp, Rattus norvegicus
tcgctcagataaagatcgcggcttc

SEQ ID NO: 635833 - DNA, 25 bp, Rattus norvegicus
cagtaaggaacctagctggcagtga

SEQ ID NO: 635834 - DNA, 25 bp, Rattus norvegicus
ccggcagtaaggaacctagctggca

SEQ ID NO: 635835 - DNA, 25 bp, Rattus norvegicus
gtaccggcagtaaggaacctagctg

SEQ ID NO: 635836 - DNA, 25 bp, Rattus norvegicus
aaggaacctagctggcagtgagcgc

SEQ ID NO: 635837 - DNA, 25 bp, Rattus norvegicus
ctacgaccggccgttgcttagctgt

SEQ ID NO: 635838 - DNA, 25 bp, Rattus norvegicus
gcaaaggcagcgttccaggcgccct

SEQ ID NO: 635839 - DNA, 25 bp, Rattus norvegicus
gctcccggcttcagaaacctgcagg

SEQ ID NO: 635840 - DNA, 25 bp, Rattus norvegicus
aacctgcagggcgatcggagaccct

SEQ ID NO: 635841 - DNA, 25 bp, Rattus norvegicus
gctacaagggtccagccgctacact

SEQ ID NO: 635842 - DNA, 25 bp, Rattus norvegicus
tggccgcgaccatacaagctggtta

SEQ ID NO: 635843 - DNA, 25 bp, Rattus norvegicus
ccttgagtggctcgccagcagaagt

SEQ ID NO: 635844 - DNA, 25 bp, Rattus norvegicus
gggtatgccgcgctaacgcaaaggc

SEQ ID NO: 635845 - DNA, 25 bp, Rattus norvegicus
ccaggttccttcgatccagctacga

SEQ ID NO: 635846 - DNA, 25 bp, Rattus norvegicus
gaccgctggcaactccgggacagaa

SEQ ID NO: 635847 - DNA, 25 bp, Rattus norvegicus
ctgtcccggttccttggctgcacag

SEQ ID NO: 635848 - DNA, 25 bp, Rattus norvegicus
aactcggctccagctgctagctact

SEQ ID NO: 635849 - DNA, 25 bp, Rattus norvegicus
gccagggcttcagcggcctctcaag

SEQ ID NO: 635850 - DNA, 25 bp, Rattus norvegicus
gttactggcccgagaaggcttccca

SEQ ID NO: 635851 - DNA, 25 bp, Rattus norvegicus
gctcggctgctgacatggactcccg

SEQ ID NO: 635852 - DNA, 25 bp, Rattus norvegicus
ttcctccgacagagtttccgagcca

SEQ ID NO: 635853 - DNA, 25 bp, Rattus norvegicus
tttccgagccagaggatgactccgc

SEQ ID NO: 635854 - DNA, 25 bp, Rattus norvegicus
atgactccgctgaggaagcgccctc

SEQ ID NO: 635855 - DNA, 25 bp, Rattus norvegicus
aagcccaggcagctccgctgtgtct

SEQ ID NO: 635856 - DNA, 25 bp, Rattus norvegicus
agggtaggaactccacgctccagca

SEQ ID NO: 635857 - DNA, 25 bp, Rattus norvegicus
cgcaggagcaagtcgccaagttcac

SEQ ID NO: 635858 - DNA, 25 bp, Rattus norvegicus
gggactgcggcttctcccgctaaac

SEQ ID NO: 635859 - DNA, 25 bp, Rattus norvegicus
aaccctggctgggactccgaactgg

SEQ ID NO: 635860 - DNA, 25 bp, Rattus norvegicus
tgggcacggggcaaacttcacgtga

SEQ ID NO: 635861 - DNA, 25 bp, Rattus norvegicus
cttcacgtgaaaaccgaagcgcacg

SEQ ID NO: 635862 - DNA, 25 bp, Rattus norvegicus
aagcgcacggccagtcacgcgcaaa

SEQ ID NO: 635863 - DNA, 25 bp, Rattus norvegicus
gcgactacatgacagcggccgggcc

SEQ ID NO: 635864 - DNA, 25 bp, Rattus norvegicus
gaccttggagaaccagactttaatc

SEQ ID NO: 635865 - DNA, 25 bp, Rattus norvegicus
tcgccgcttccagcaagctcggagg

SEQ ID NO: 635866 - DNA, 25 bp, Rattus norvegicus
tctttgcaccaattacgatcgtaca

SEQ ID NO: 635867 - DNA, 25 bp, Rattus norvegicus
ctgaacgactgcacgcccgaaagcg

SEQ ID NO: 635868 - DNA, 25 bp, Rattus norvegicus
gcgctcggagtgcatccaatgtttc

SEQ ID NO: 635869 - DNA, 25 bp, Rattus norvegicus
aggcaccgtcttgaggcaatttcgc

SEQ ID NO: 635870 - DNA, 25 bp, Rattus norvegicus
cggccgtggtttcctgcaacctgag

SEQ ID NO: 635871 - DNA, 25 bp, Rattus norvegicus
gcaacctgagcgtgccattagagga

SEQ ID NO: 635872 - DNA, 25 bp, Rattus norvegicus
ccattagaggatgtcggagtgctgc

SEQ ID NO: 635873 - DNA, 25 bp, Rattus norvegicus
cgtacaaagaaactcgatcggccgg

SEQ ID NO: 635874 - DNA, 25 bp, Rattus norvegicus
tgctgcggctgaaagagatacctgc

SEQ ID NO: 635875 - DNA, 25 bp, Rattus norvegicus
atacctgctgcctggaaatcggggc

SEQ ID NO: 635876 - DNA, 25 bp, Rattus norvegicus
tggaaatcggggctgcacttgaaca

SEQ ID NO: 635877 - DNA, 25 bp, Rattus norvegicus
gggctgcacttgaacaacctctttg

SEQ ID NO: 635878 - DNA, 25 bp, Rattus norvegicus
tgtttcctctaacaaaggcaccgtc

SEQ ID NO: 635879 - DNA, 25 bp, Rattus norvegicus
aggactactgtctcagcgaaatgtc

SEQ ID NO: 635880 - DNA, 25 bp, Rattus norvegicus
ggcctctcgtctccgtgttgagtcc

SEQ ID NO: 635881 - DNA, 25 bp, Rattus norvegicus
gctctgttccgcgatccgggacttt

SEQ ID NO: 635882 - DNA, 25 bp, Rattus norvegicus
cgggatcttctattccaagttcgca

SEQ ID NO: 635883 - DNA, 25 bp, Rattus norvegicus
aagttcttcccagcccagctttagg

SEQ ID NO: 635884 - DNA, 25 bp, Rattus norvegicus
tctgactccgctcctgccagggata

SEQ ID NO: 635885 - DNA, 25 bp, Rattus norvegicus
atccaggatgtgctgcaagcccgca

SEQ ID NO: 635886 - DNA, 25 bp, Rattus norvegicus
tttgatcgcgggagtccagttaccc

SEQ ID NO: 635887 - DNA, 25 bp, Rattus norvegicus
ccagaggcggttacgaactcccagc

SEQ ID NO: 635888 - DNA, 25 bp, Rattus norvegicus
cagcccaatcgagagtgcgtcttta

SEQ ID NO: 635889 - DNA, 25 bp, Rattus norvegicus
ttcgaaggtcacgtagggccgtcac

SEQ ID NO: 635890 - DNA, 25 bp, Rattus norvegicus
ttgccgcttactccggaggactact

SEQ ID NO: 635891 - DNA, 25 bp, Rattus norvegicus
tagccctccaaaacagtcaattccg

SEQ ID NO: 635892 - DNA, 25 bp, Rattus norvegicus
accatggttaggtgtttgccgctta

SEQ ID NO: 635893 - DNA, 25 bp, Rattus norvegicus
cggctgacgtcacccaagctcgtta

SEQ ID NO: 635894 - DNA, 25 bp, Rattus norvegicus
cccgccggtttgcagatctggactt

SEQ ID NO: 635895 - DNA, 25 bp, Rattus norvegicus
cgggtgattatctcgactttctgta

SEQ ID NO: 635896 - DNA, 25 bp, Rattus norvegicus
tatcagccagagaaggtccagccca

SEQ ID NO: 635897 - DNA, 25 bp, Rattus norvegicus
cgctacgcagaatcagggcagttga

SEQ ID NO: 635898 - DNA, 25 bp, Rattus norvegicus
ggtggagtccattccctctgaaacg

SEQ ID NO: 635899 - DNA, 25 bp, Rattus norvegicus
ctcaggctcctggattccgaggtaa

SEQ ID NO: 635900 - DNA, 25 bp, Rattus norvegicus
gggctggaccctttcagatttctga

SEQ ID NO: 635901 - DNA, 25 bp, Rattus norvegicus
aaattccagggtcctctccgtgcgg

SEQ ID NO: 635902 - DNA, 25 bp, Rattus norvegicus
gggtgcgccgaaggactacaaattc

SEQ ID NO: 635903 - DNA, 25 bp, Rattus norvegicus
cggtgagtcacctctgagtcttcca

SEQ ID NO: 635904 - DNA, 25 bp, Rattus norvegicus
aggagcttgggcctttctccaaagc

SEQ ID NO: 635905 - DNA, 25 bp, Rattus norvegicus
ctcgttatctgaggcgcgaagctcc

SEQ ID NO: 635906 - DNA, 25 bp, Rattus norvegicus
tctggacttggctttacgtggcgct

SEQ ID NO: 635907 - DNA, 25 bp, Rattus norvegicus
ctccgtctcccgctcgagtgaaggt

SEQ ID NO: 635908 - DNA, 25 bp, Rattus norvegicus
ttcacccaggcaggaagtgagtttc

SEQ ID NO: 635909 - DNA, 25 bp, Rattus norvegicus
agtgagtttcgcacggcaattccgg

SEQ ID NO: 635910 - DNA, 25 bp, Rattus norvegicus
ttccttcggcggagaacctagacga

SEQ ID NO: 635911 - DNA, 25 bp, Rattus norvegicus
acgaggctgggaaactcctgacaga

SEQ ID NO: 635912 - DNA, 25 bp, Rattus norvegicus
tgacagaagtcgcaagcaggaagcc

SEQ ID NO: 635913 - DNA, 25 bp, Rattus norvegicus
ctgaggaagggcaggaaaccatgtc

SEQ ID NO: 635914 - DNA, 25 bp, Rattus norvegicus
ggaaaccatgtcaagccgagcctcg

SEQ ID NO: 635915 - DNA, 25 bp, Rattus norvegicus
tgccctgagacacccggagaggtaa

SEQ ID NO: 635916 - DNA, 25 bp, Rattus norvegicus
ttacgggaagcgtccagccaagttc

SEQ ID NO: 635917 - DNA, 25 bp, Rattus norvegicus
tccagccaagttcgtgggccggaag

SEQ ID NO: 635918 - DNA, 25 bp, Rattus norvegicus
cggtactttagtctacctcgctctg

SEQ ID NO: 635919 - DNA, 25 bp, Rattus norvegicus
gcggccggcgcactcgagacaatac

SEQ ID NO: 635920 - DNA, 25 bp, Rattus norvegicus
ggcaccgagctggatcctgcttttc

SEQ ID NO: 635921 - DNA, 25 bp, Rattus norvegicus
cactgggagaatcgtggagaacgcc

SEQ ID NO: 635922 - DNA, 25 bp, Rattus norvegicus
ctcccaggactgtggttgatgcccg

SEQ ID NO: 635923 - DNA, 25 bp, Rattus norvegicus
ttaccctgtcgagctcccaggactg

SEQ ID NO: 635924 - DNA, 25 bp, Rattus norvegicus
cgcggggttcctgcaaaagactcag

SEQ ID NO: 635925 - DNA, 25 bp, Rattus norvegicus
gttgattaagctcctcgcggggttc

SEQ ID NO: 635926 - DNA, 25 bp, Rattus norvegicus
tccgcattggggtgttgttgattaa

SEQ ID NO: 635927 - DNA, 25 bp, Rattus norvegicus
cgcgcttacttaggcggccatgttt

SEQ ID NO: 635928 - DNA, 25 bp, Rattus norvegicus
tccttcctaggagaaatcgaggagc

SEQ ID NO: 635929 - DNA, 25 bp, Rattus norvegicus
gatgcggacgctcttttccttccta

SEQ ID NO: 635930 - DNA, 25 bp, Rattus norvegicus
tgacgaacctctcctcggcggtgac

SEQ ID NO: 635931 - DNA, 25 bp, Rattus norvegicus
gccttttccctacgacggtgattca

SEQ ID NO: 635932 - DNA, 25 bp, Rattus norvegicus
cctataacgtttttgcactgggaga

SEQ ID NO: 635933 - DNA, 25 bp, Rattus norvegicus
cccgaacttaagatggccgcaggtg

SEQ ID NO: 635934 - DNA, 25 bp, Rattus norvegicus
tggagaacgccagcaacgccaacgc

SEQ ID NO: 635935 - DNA, 25 bp, Rattus norvegicus
cccaccctgcccacgatcaagatta

SEQ ID NO: 635936 - DNA, 25 bp, Rattus norvegicus
tggtccgagagcctagcgagcagcc

SEQ ID NO: 635937 - DNA, 25 bp, Rattus norvegicus
atccagcaagccctgtggtccgaga

SEQ ID NO: 635938 - DNA, 25 bp, Rattus norvegicus
ctggggcggatccagcaagccctgt

SEQ ID NO: 635939 - DNA, 25 bp, Rattus norvegicus
cccacgtgcttcaggcccacgccta

SEQ ID NO: 635940 - DNA, 25 bp, Rattus norvegicus
acggaggccgtcagtcctgccagcg

SEQ ID NO: 635941 - DNA, 25 bp, Rattus norvegicus
accagatctcgagacggaggccgtc

SEQ ID NO: 635942 - DNA, 25 bp, Rattus norvegicus
ggccaagccgaggagaccagatctc

SEQ ID NO: 635943 - DNA, 25 bp, Rattus norvegicus
ctcccgcttgtaggtgcaggaggca

SEQ ID NO: 635944 - DNA, 25 bp, Rattus norvegicus
gtcgtcctcccgcttgtaggtgcag

SEQ ID NO: 635945 - DNA, 25 bp, Rattus norvegicus
aaaggcacagggtgatcatgggcac

SEQ ID NO: 635946 - DNA, 25 bp, Rattus norvegicus
ctcgcagagtcgaaaggcacagggt

SEQ ID NO: 635947 - DNA, 25 bp, Rattus norvegicus
agtacctgtggaggcctcgcagagt

SEQ ID NO: 635948 - DNA, 25 bp, Rattus norvegicus
gatcaagattaacccgcccactgga

SEQ ID NO: 635949 - DNA, 25 bp, Rattus norvegicus
aacggcggccactgagctttctgcc

SEQ ID NO: 635950 - DNA, 25 bp, Rattus norvegicus
taggcgtgagtgtacacggcgtacc

SEQ ID NO: 635951 - DNA, 25 bp, Rattus norvegicus
ctcagggactcggagacactggcac

SEQ ID NO: 635952 - DNA, 25 bp, Rattus norvegicus
acacgacttgtattctcagggactc

SEQ ID NO: 635953 - DNA, 25 bp, Rattus norvegicus
atccttgagcggtccgagttttcta

SEQ ID NO: 635954 - DNA, 25 bp, Rattus norvegicus
cgcgcgcagctaccagtgaagaagc

SEQ ID NO: 635955 - DNA, 25 bp, Rattus norvegicus
gttcccggagactagcagcgtacca

SEQ ID NO: 635956 - DNA, 25 bp, Rattus norvegicus
gttcctagcttgtttggtcccgaga

SEQ ID NO: 635957 - DNA, 25 bp, Rattus norvegicus
tgaagctcaccgagacggcgatccg

SEQ ID NO: 635958 - DNA, 25 bp, Rattus norvegicus
atcaccgtgctacatgtgaagctca

SEQ ID NO: 635959 - DNA, 25 bp, Rattus norvegicus
tgcgcgcagtatatgacagtacgtc

SEQ ID NO: 635960 - DNA, 25 bp, Rattus norvegicus
acccaaggtcttactgcgcgcagta

SEQ ID NO: 635961 - DNA, 25 bp, Rattus norvegicus
cggcagtcgtggaaacccaaggtct

SEQ ID NO: 635962 - DNA, 25 bp, Rattus norvegicus
accttgcactctcagggactctgtg

SEQ ID NO: 635963 - DNA, 25 bp, Rattus norvegicus
aacaagcccggagcaggagtagaca

SEQ ID NO: 635964 - DNA, 25 bp, Rattus norvegicus
tctggtgggcgttacaagactttcc

SEQ ID NO: 635965 - DNA, 25 bp, Rattus norvegicus
caatgactgacggagagaaaaggtc

SEQ ID NO: 635966 - DNA, 25 bp, Rattus norvegicus
ctcctctcagttaaaggctctactg

SEQ ID NO: 635967 - DNA, 25 bp, Rattus norvegicus
aaaggctctactgcagctgtgccgc

SEQ ID NO: 635968 - DNA, 25 bp, Rattus norvegicus
gatggctgccctcgctgtaaacaag

SEQ ID NO: 635969 - DNA, 25 bp, Rattus norvegicus
gcctcccttcggttcgtcctggaga

SEQ ID NO: 635970 - DNA, 25 bp, Rattus norvegicus
gtcctggagacctggccgcgactgt

SEQ ID NO: 635971 - DNA, 25 bp, Rattus norvegicus
cttgcccagcggagctgaagttgcc

SEQ ID NO: 635972 - DNA, 25 bp, Rattus norvegicus
gttgcctggtcttctaattcaagtg

SEQ ID NO: 635973 - DNA, 25 bp, Rattus norvegicus
aattcaagtgttaacgtcgtccgtg

SEQ ID NO: 635974 - DNA, 25 bp, Rattus norvegicus
tccgtggggctgtttgtgaaaagca

SEQ ID NO: 635975 - DNA, 25 bp, Rattus norvegicus
acttgcgtgctctgttctccacctg

SEQ ID NO: 635976 - DNA, 25 bp, Rattus norvegicus
cgcgcagaccgtacagccaatgact

SEQ ID NO: 635977 - DNA, 25 bp, Rattus norvegicus
acagatgcgacaaccgagtgaactc

SEQ ID NO: 635978 - DNA, 25 bp, Rattus norvegicus
gtcttcttctcttcagctgcgaatc

SEQ ID NO: 635979 - DNA, 25 bp, Rattus norvegicus
tgccgccatgctgtctgatacgtca

SEQ ID NO: 635980 - DNA, 25 bp, Rattus norvegicus
tgaactctgtttcccgatctgcggc

SEQ ID NO: 635981 - DNA, 25 bp, Rattus norvegicus
ctgcggcgcagtattttgttgtcac

SEQ ID NO: 635982 - DNA, 25 bp, Rattus norvegicus
cggctgggcgcatattctgatttgc

SEQ ID NO: 635983 - DNA, 25 bp, Rattus norvegicus
tctgtcaagggtaatggcagctcgc

SEQ ID NO: 635984 - DNA, 25 bp, Rattus norvegicus
gctgcgaatcgctaccaatctctgc

SEQ ID NO: 635985 - DNA, 25 bp, Rattus norvegicus
cccaaaatcggacgcttacggcctg

SEQ ID NO: 635986 - DNA, 25 bp, Rattus norvegicus
tattctgatttgctacggtgggccc

SEQ ID NO: 635987 - DNA, 25 bp, Rattus norvegicus
gctcgcttagttccgttttttctga

SEQ ID NO: 635988 - DNA, 25 bp, Rattus norvegicus
aagcagggcttccttacggttctag

SEQ ID NO: 635989 - DNA, 25 bp, Rattus norvegicus
tggaaccggctctgactggctaagc

SEQ ID NO: 635990 - DNA, 25 bp, Rattus norvegicus
ccaatcagcaaccagcgcgcgtaga

SEQ ID NO: 635991 - DNA, 25 bp, Rattus norvegicus
acgcgatctcgaaagctcaggactc

SEQ ID NO: 635992 - DNA, 25 bp, Rattus norvegicus
ctggatgtgcatccggccttctcct

SEQ ID NO: 635993 - DNA, 25 bp, Rattus norvegicus
ccaggtccggtgtttgcagatagca

SEQ ID NO: 635994 - DNA, 25 bp, Rattus norvegicus
agatagcactcacctccggaagctg

SEQ ID NO: 635995 - DNA, 25 bp, Rattus norvegicus
atggttcagaccacgtgtgctccgc

SEQ ID NO: 635996 - DNA, 25 bp, Rattus norvegicus
cctggaaactgggtccgcagcttct

SEQ ID NO: 635997 - DNA, 25 bp, Rattus norvegicus
gtccgcagcttcttagttccgccaa

SEQ ID NO: 635998 - DNA, 25 bp, Rattus norvegicus
ttagttccgccaaccctggatgtgc

SEQ ID NO: 635999 - DNA, 25 bp, Rattus norvegicus
ggccaatccgtaaatccgggtgctg

SEQ ID NO: 636000 - DNA, 25 bp, Rattus norvegicus
cggccttctcctgccctgtgaagtt

SEQ ID NO: 636001 - DNA, 25 bp, Rattus norvegicus
tgccctgtgaagttgtagtgaccgg

SEQ ID NO: 636002 - DNA, 25 bp, Rattus norvegicus
gagatccctctgctagtgcgttgtc

SEQ ID NO: 636003 - DNA, 25 bp, Rattus norvegicus
gtgcgttgtcctcgctaaggacctg

SEQ ID NO: 636004 - DNA, 25 bp, Rattus norvegicus
ctaaggacctgaacgaaacgcgatc

SEQ ID NO: 636005 - DNA, 25 bp, Rattus norvegicus
ctggggtctgagtgcttggcactca

SEQ ID NO: 636006 - DNA, 25 bp, Rattus norvegicus
tgggctctacttcccgctgtccacg

SEQ ID NO: 636007 - DNA, 25 bp, Rattus norvegicus
agcacctttgcgatctggggtctga

SEQ ID NO: 636008 - DNA, 25 bp, Rattus norvegicus
ggcgactctgagcacctttgcgatc

SEQ ID NO: 636009 - DNA, 25 bp, Rattus norvegicus
gctaggactgtgctcgtcccaagcc

SEQ ID NO: 636010 - DNA, 25 bp, Rattus norvegicus
ttgtgcgctaggactgtgctcgtcc

SEQ ID NO: 636011 - DNA, 25 bp, Rattus norvegicus
ggctgctctcgctcatcgctgcggg

SEQ ID NO: 636012 - DNA, 25 bp, Rattus norvegicus
ttgaggctgtagtagcctgagcaca

SEQ ID NO: 636013 - DNA, 25 bp, Rattus norvegicus
aagggctccacgaagctgcggttga

SEQ ID NO: 636014 - DNA, 25 bp, Rattus norvegicus
gcactggaagggctccacgaagctg

SEQ ID NO: 636015 - DNA, 25 bp, Rattus norvegicus
cgaagccgcagcagtagagcagcgc

SEQ ID NO: 636016 - DNA, 25 bp, Rattus norvegicus
agtacttgaggtctgcgaagccgca

SEQ ID NO: 636017 - DNA, 25 bp, Rattus norvegicus
ctcgctgcagcagtacttgaggtct

SEQ ID NO: 636018 - DNA, 25 bp, Rattus norvegicus
agcctgagcacaggcggctgctctc

SEQ ID NO: 636019 - DNA, 25 bp, Rattus norvegicus
agcggcgttcaaagcctgcgctgca

SEQ ID NO: 636020 - DNA, 25 bp, Rattus norvegicus
gttccgcagcaagcaattggcgcta

SEQ ID NO: 636021 - DNA, 25 bp, Rattus norvegicus
tgcatacacatccacgaagccgaag

SEQ ID NO: 636022 - DNA, 25 bp, Rattus norvegicus
gcgggtgggtaaccttcagcttgaa

SEQ ID NO: 636023 - DNA, 25 bp, Rattus norvegicus
gcctgtgcggtacagcatcgcttcc

SEQ ID NO: 636024 - DNA, 25 bp, Rattus norvegicus
tcgcttccgctagcagcgacggaga

SEQ ID NO: 636025 - DNA, 25 bp, Rattus norvegicus
aggcgcgatcaagttctgctcagca

SEQ ID NO: 636026 - DNA, 25 bp, Rattus norvegicus
tgctcagcagcattgccggccctgt

SEQ ID NO: 636027 - DNA, 25 bp, Rattus norvegicus
accgccttcctctcggcatggattg

SEQ ID NO: 636028 - DNA, 25 bp, Rattus norvegicus
gctcttgcttcggtgtcttcccgca

SEQ ID NO: 636029 - DNA, 25 bp, Rattus norvegicus
gcggctccgagtttccattcagatg

SEQ ID NO: 636030 - DNA, 25 bp, Rattus norvegicus
cgcccattcggtgcagaactcatgc

SEQ ID NO: 636031 - DNA, 25 bp, Rattus norvegicus
ttttgtgggcgctttcggagccact

SEQ ID NO: 636032 - DNA, 25 bp, Rattus norvegicus
ctcggcatggattgacaggctgagc

SEQ ID NO: 636033 - DNA, 25 bp, Rattus norvegicus
accatcagcaaggaccacggctaca

SEQ ID NO: 636034 - DNA, 25 bp, Rattus norvegicus
gctagacaggtactgggctatcacc

SEQ ID NO: 636035 - DNA, 25 bp, Rattus norvegicus
actgggctatcaccgaccctataga

SEQ ID NO: 636036 - DNA, 25 bp, Rattus norvegicus
tatcaccgaccctatagactatgtg

SEQ ID NO: 636037 - DNA, 25 bp, Rattus norvegicus
agactatgtgaacaagaggacgccc

SEQ ID NO: 636038 - DNA, 25 bp, Rattus norvegicus
tggctcattggctttctcatctcca

SEQ ID NO: 636039 - DNA, 25 bp, Rattus norvegicus
tcttcagagccgcacgcttccgaat

SEQ ID NO: 636040 - DNA, 25 bp, Rattus norvegicus
aaggaccacggctacaccatctact

SEQ ID NO: 636041 - DNA, 25 bp, Rattus norvegicus
tctactccactttcggcgctttcta

SEQ ID NO: 636042 - DNA, 25 bp, Rattus norvegicus
cggcgctttctatatcccgctgttg

SEQ ID NO: 636043 - DNA, 25 bp, Rattus norvegicus
atcccgctgttgctcatgctggttc

SEQ ID NO: 636044 - DNA, 25 bp, Rattus norvegicus
gccatcgcgctagacaggtactggg

SEQ ID NO: 636045 - DNA, 25 bp, Rattus norvegicus
catgctggttctctacgggcgcatc

SEQ ID NO: 636046 - DNA, 25 bp, Rattus norvegicus
tgatctcgctcacttggctcattgg

SEQ ID NO: 636047 - DNA, 25 bp, Rattus norvegicus
cagcagcgcgacactgtagacttta

SEQ ID NO: 636048 - DNA, 25 bp, Rattus norvegicus
cctccctgcgaatctctggtgtcga

SEQ ID NO: 636049 - DNA, 25 bp, Rattus norvegicus
ttccggccagaagacacgtcgtaga

SEQ ID NO: 636050 - DNA, 25 bp, Rattus norvegicus
gcagtgccaagtacagacccgggtc

SEQ ID NO: 636051 - DNA, 25 bp, Rattus norvegicus
ctcctcgggtacgaagaggcgaata

SEQ ID NO: 636052 - DNA, 25 bp, Rattus norvegicus
gccacctctcaagctacgactaaga

SEQ ID NO: 636053 - DNA, 25 bp, Rattus norvegicus
tggaacagtacgcaaaaccgtcctg

SEQ ID NO: 636054 - DNA, 25 bp, Rattus norvegicus
cttgggcctcacctagctgtcgtga

SEQ ID NO: 636055 - DNA, 25 bp, Rattus norvegicus
gctgtcgtgagcaaatagaatccgc

SEQ ID NO: 636056 - DNA, 25 bp, Rattus norvegicus
tagaatccgcttgacggctccgttg

SEQ ID NO: 636057 - DNA, 25 bp, Rattus norvegicus
ggctccgttgcgacatcaggcctag

SEQ ID NO: 636058 - DNA, 25 bp, Rattus norvegicus
atggggaacgctccgagtaacagta

SEQ ID NO: 636059 - DNA, 25 bp, Rattus norvegicus
accgtcctggcttacaacttatccg

SEQ ID NO: 636060 - DNA, 25 bp, Rattus norvegicus
cacatcaggattgggctgccgactc

SEQ ID NO: 636061 - DNA, 25 bp, Rattus norvegicus
tttccacttgttcacacgaagcggc

SEQ ID NO: 636062 - DNA, 25 bp, Rattus norvegicus
tgtcctgggaaaatcgatagtctgc

SEQ ID NO: 636063 - DNA, 25 bp, Rattus norvegicus
cctgtaactatggaaaccgtatgtc

SEQ ID NO: 636064 - DNA, 25 bp, Rattus norvegicus
tggcataggggaacctgtaactatg

SEQ ID NO: 636065 - DNA, 25 bp, Rattus norvegicus
agccaatagggctgtgtgcgcttgc

SEQ ID NO: 636066 - DNA, 25 bp, Rattus norvegicus
ttcgaacccaaaggcgcgcggcagc

SEQ ID NO: 636067 - DNA, 25 bp, Rattus norvegicus
ggaggagctcgtgttcgaacccaaa

SEQ ID NO: 636068 - DNA, 25 bp, Rattus norvegicus
ttacgtcacaggttcccagagcgca

SEQ ID NO: 636069 - DNA, 25 bp, Rattus norvegicus
gagggcgcgctaaaattacgtcaca

SEQ ID NO: 636070 - DNA, 25 bp, Rattus norvegicus
cactccaaacgacgagggcgcgcta

SEQ ID NO: 636071 - DNA, 25 bp, Rattus norvegicus
cggcttctaggaacgcgccatcttc

SEQ ID NO: 636072 - DNA, 25 bp, Rattus norvegicus
gtgccgcctactgatgccgaaaacg

SEQ ID NO: 636073 - DNA, 25 bp, Rattus norvegicus
acgaagcggcgttggttgcttccgc

SEQ ID NO: 636074 - DNA, 25 bp, Rattus norvegicus
taatccacacggtgccgcctactga

SEQ ID NO: 636075 - DNA, 25 bp, Rattus norvegicus
ctgcgcccttaaccgctctgagaag

SEQ ID NO: 636076 - DNA, 25 bp, Rattus norvegicus
ccgcagttttctcttgccctaggga

SEQ ID NO: 636077 - DNA, 25 bp, Rattus norvegicus
tttctcttgccctagggactcctcg

SEQ ID NO: 636078 - DNA, 25 bp, Rattus norvegicus
tgccctagggactcctcggagaaga

SEQ ID NO: 636079 - DNA, 25 bp, Rattus norvegicus
tcctcggagaagatgccgaaggcca

SEQ ID NO: 636080 - DNA, 25 bp, Rattus norvegicus
atgccgaaggccaagtccgcagcga

SEQ ID NO: 636081 - DNA, 25 bp, Rattus norvegicus
aagtccgcagcgagtagccgccggc

SEQ ID NO: 636082 - DNA, 25 bp, Rattus norvegicus
tggaggaagcttgggactgacccac

SEQ ID NO: 636083 - DNA, 25 bp, Rattus norvegicus
cccttaaccgctctgagaagggtgg

SEQ ID NO: 636084 - DNA, 25 bp, Rattus norvegicus
gagcgctactgtggcctgcgccctt

SEQ ID NO: 636085 - DNA, 25 bp, Rattus norvegicus
gcggtgcaccgcagttttctcttgc

SEQ ID NO: 636086 - DNA, 25 bp, Rattus norvegicus
ttccacgcggtgcaccgcagttttc

SEQ ID NO: 636087 - DNA, 25 bp, Rattus norvegicus
tgctggcggcctcttccacgcggtg

SEQ ID NO: 636088 - DNA, 25 bp, Rattus norvegicus
aagcttgggactgacccacggcagg

SEQ ID NO: 636089 - DNA, 25 bp, Rattus norvegicus
gcctctggctgccagtcgggtctct

SEQ ID NO: 636090 - DNA, 25 bp, Rattus norvegicus
ccacaacccgtagagcaatcaaagg

SEQ ID NO: 636091 - DNA, 25 bp, Rattus norvegicus
gccaccgatgcagagacccgcaaaa

SEQ ID NO: 636092 - DNA, 25 bp, Rattus norvegicus
accatcgctgcgcttgatttccacg

SEQ ID NO: 636093 - DNA, 25 bp, Rattus norvegicus
gatttccacgtaaatcccgatctgg

SEQ ID NO: 636094 - DNA, 25 bp, Rattus norvegicus
cccgatctggatcttgccgaagtta

SEQ ID NO: 636095 - DNA, 25 bp, Rattus norvegicus
ttgccgaagttagccgttgccatca

SEQ ID NO: 636096 - DNA, 25 bp, Rattus norvegicus
gttgccatcacctcatccggagcgg

SEQ ID NO: 636097 - DNA, 25 bp, Rattus norvegicus
tacgaactcgcctcgggtttgattc

SEQ ID NO: 636098 - DNA, 25 bp, Rattus norvegicus
gtttgattccacacggcctacgagg

SEQ ID NO: 636099 - DNA, 25 bp, Rattus norvegicus
aagcgactcgcgattcccttcctga

SEQ ID NO: 636100 - DNA, 25 bp, Rattus norvegicus
cgcctggacgcttgccgcaggaatg

SEQ ID NO: 636101 - DNA, 25 bp, Rattus norvegicus
agggccgagtaatgtcaaggctttc

SEQ ID NO: 636102 - DNA, 25 bp, Rattus norvegicus
gcacggtcagccctaacggagtctc

SEQ ID NO: 636103 - DNA, 25 bp, Rattus norvegicus
atcaaaccgttgcagctgccgagcc

SEQ ID NO: 636104 - DNA, 25 bp, Rattus norvegicus
cggggtctcatctagaccgagaatc

SEQ ID NO: 636105 - DNA, 25 bp, Rattus norvegicus
gtcactcggggaccttctctctgca

SEQ ID NO: 636106 - DNA, 25 bp, Rattus norvegicus
tcttggccagcctaggatctcggac

SEQ ID NO: 636107 - DNA, 25 bp, Rattus norvegicus
ggacctcggatcctccatctctttg

SEQ ID NO: 636108 - DNA, 25 bp, Rattus norvegicus
catctctttgaagggctgctctgtg

SEQ ID NO: 636109 - DNA, 25 bp, Rattus norvegicus
agcccgctaagccttggcgtttggg

SEQ ID NO: 636110 - DNA, 25 bp, Rattus norvegicus
agactgtgcccggagtttccactgc

SEQ ID NO: 636111 - DNA, 25 bp, Rattus norvegicus
acgccgcgagcataaggttcagtga

SEQ ID NO: 636112 - DNA, 25 bp, Rattus norvegicus
gttcagtgatctcagtgtcccggca

SEQ ID NO: 636113 - DNA, 25 bp, Rattus norvegicus
cgccgccattgagaagatgcgcaac

SEQ ID NO: 636114 - DNA, 25 bp, Rattus norvegicus
ctgactccttactcggggaaccgag

SEQ ID NO: 636115 - DNA, 25 bp, Rattus norvegicus
cccgcctgaggtcttgacactgggg

SEQ ID NO: 636116 - DNA, 25 bp, Rattus norvegicus
tgaccgtcccgcgatcaaaccgttg

SEQ ID NO: 636117 - DNA, 25 bp, Rattus norvegicus
tgctcaactcggaaggctgaaatcc

SEQ ID NO: 636118 - DNA, 25 bp, Rattus norvegicus
gcactaccagcttgacgttcccgaa

SEQ ID NO: 636119 - DNA, 25 bp, Rattus norvegicus
gttcccgaacgcactggcctggtac

SEQ ID NO: 636120 - DNA, 25 bp, Rattus norvegicus
tggcggcgttcagcaacaagctact

SEQ ID NO: 636121 - DNA, 25 bp, Rattus norvegicus
ttgtcctggtggaaagtgtcgccct

SEQ ID NO: 636122 - DNA, 25 bp, Rattus norvegicus
gccacgatgtggatagacctgcgga

SEQ ID NO: 636123 - DNA, 25 bp, Rattus norvegicus
cagagtgagcgagtgggcacaacca

SEQ ID NO: 636124 - DNA, 25 bp, Rattus norvegicus
cacaaccagggtgcgtggcacgtcc

SEQ ID NO: 636125 - DNA, 25 bp, Rattus norvegicus
acggcgacgcatacgtacatgattg

SEQ ID NO: 636126 - DNA, 25 bp, Rattus norvegicus
cggagcgacgctttcactgcagtca

SEQ ID NO: 636127 - DNA, 25 bp, Rattus norvegicus
ctgccactgcagaacagagcgggcc

SEQ ID NO: 636128 - DNA, 25 bp, Rattus norvegicus
cacgtgtcgcccttagagtccggcg

SEQ ID NO: 636129 - DNA, 25 bp, Rattus norvegicus
tgccaatccgcctgcagcaagtttg

SEQ ID NO: 636130 - DNA, 25 bp, Rattus norvegicus
acccagacgggacagtcgtgcacta

SEQ ID NO: 636131 - DNA, 25 bp, Rattus norvegicus
tacctcacgggatggagaagcgcga

SEQ ID NO: 636132 - DNA, 25 bp, Rattus norvegicus
cgcggagctagtcgcagacacctta

SEQ ID NO: 636133 - DNA, 25 bp, Rattus norvegicus
gcagacaccttaagcagctggagta

SEQ ID NO: 636134 - DNA, 25 bp, Rattus norvegicus
taagcagctggagtatacgggacgc

SEQ ID NO: 636135 - DNA, 25 bp, Rattus norvegicus
cgccaagaagaaaggacgcgagccg

SEQ ID NO: 636136 - DNA, 25 bp, Rattus norvegicus
gtcgctcccgacagaggttgctcgg

SEQ ID NO: 636137 - DNA, 25 bp, Rattus norvegicus
acaccggcgctcaagctgcgggaca

SEQ ID NO: 636138 - DNA, 25 bp, Rattus norvegicus
ctcaagctgcgggacagacgaccgg

SEQ ID NO: 636139 - DNA, 25 bp, Rattus norvegicus
tgattcatttcccactcgcgctagc

SEQ ID NO: 636140 - DNA, 25 bp, Rattus norvegicus
caggaggacagaccgaaggaccgac

SEQ ID NO: 636141 - DNA, 25 bp, Rattus norvegicus
tgactcaccgacttgcaggacgttg

SEQ ID NO: 636142 - DNA, 25 bp, Rattus norvegicus
caggacgttgtctacgcagccactc

SEQ ID NO: 636143 - DNA, 25 bp, Rattus norvegicus
gcgcgtcctgctgattcatttccca

SEQ ID NO: 636144 - DNA, 25 bp, Rattus norvegicus
cgaagtcgggcagcccggtacctca

SEQ ID NO: 636145 - DNA, 25 bp, Rattus norvegicus
ttctaacccgacagcggaagtgccg

SEQ ID NO: 636146 - DNA, 25 bp, Rattus norvegicus
ctccagcccggtgacaggccaggaa

SEQ ID NO: 636147 - DNA, 25 bp, Rattus norvegicus
acttcactttttgccgacccaggtg

SEQ ID NO: 636148 - DNA, 25 bp, Rattus norvegicus
gcggaggaggcgctttcaaaacaaa

SEQ ID NO: 636149 - DNA, 25 bp, Rattus norvegicus
aggatggaccgactgctcgatgccc

SEQ ID NO: 636150 - DNA, 25 bp, Rattus norvegicus
ttccggactaaatggaggatggacc

SEQ ID NO: 636151 - DNA, 25 bp, Rattus norvegicus
gcctcccttttgatgtccgccaagt

SEQ ID NO: 636152 - DNA, 25 bp, Rattus norvegicus
ctgtgagaatgtcaggctgctgtga

SEQ ID NO: 636153 - DNA, 25 bp, Rattus norvegicus
taaatagagcgctccgtggacacgg

SEQ ID NO: 636154 - DNA, 25 bp, Rattus norvegicus
tcactgggctgaaacataaatagag

SEQ ID NO: 636155 - DNA, 25 bp, Rattus norvegicus
cggggcctatgcaaatcactgggct

SEQ ID NO: 636156 - DNA, 25 bp, Rattus norvegicus
tggcctatacggtgacgacgtcgcc

SEQ ID NO: 636157 - DNA, 25 bp, Rattus norvegicus
acggcacaaggaagcgcgacacgca

SEQ ID NO: 636158 - DNA, 25 bp, Rattus norvegicus
acacgcagagcgctcggatgctgcc

SEQ ID NO: 636159 - DNA, 25 bp, Rattus norvegicus
ctagcagtagcctaggctgagcgtg

SEQ ID NO: 636160 - DNA, 25 bp, Rattus norvegicus
gccgcgagaaggctctaaaaagtct

SEQ ID NO: 636161 - DNA, 25 bp, Rattus norvegicus
cactttcctgccttgcggtgagtgg

SEQ ID NO: 636162 - DNA, 25 bp, Rattus norvegicus
acggagcggcttccgctttccactt

SEQ ID NO: 636163 - DNA, 25 bp, Rattus norvegicus
gacctgaacggagcggcttccgctt

SEQ ID NO: 636164 - DNA, 25 bp, Rattus norvegicus
gtgcgggtatcacctgccgcggacc

SEQ ID NO: 636165 - DNA, 25 bp, Rattus norvegicus
cacgaagcagcgtgcgggtatcacc

SEQ ID NO: 636166 - DNA, 25 bp, Rattus norvegicus
ttgtacgaattcctcactcactccg

SEQ ID NO: 636167 - DNA, 25 bp, Rattus norvegicus
gttgagagtcccttgtacgaattcc

SEQ ID NO: 636168 - DNA, 25 bp, Rattus norvegicus
tctctgcggttgagagtcccttgta

SEQ ID NO: 636169 - DNA, 25 bp, Rattus norvegicus
ttcctacggctctctgcggttgaga

SEQ ID NO: 636170 - DNA, 25 bp, Rattus norvegicus
tcatttcttcctacggctctctgcg

SEQ ID NO: 636171 - DNA, 25 bp, Rattus norvegicus
ggctctaaaaagtctgcgggttcca

SEQ ID NO: 636172 - DNA, 25 bp, Rattus norvegicus
ggcgtccttagcctttgaggccgac

SEQ ID NO: 636173 - DNA, 25 bp, Rattus norvegicus
actctgcgcacaaccggcgtctgaa

SEQ ID NO: 636174 - DNA, 25 bp, Rattus norvegicus
accgagatgttgagctttttgtccg

SEQ ID NO: 636175 - DNA, 25 bp, Rattus norvegicus
ttccaagctctgtcatggcggcatc

SEQ ID NO: 636176 - DNA, 25 bp, Rattus norvegicus
gcccgtgttgttgcatccgttccaa

SEQ ID NO: 636177 - DNA, 25 bp, Rattus norvegicus
tggtcacgtcacatcgctaattggc

SEQ ID NO: 636178 - DNA, 25 bp, Rattus norvegicus
gtaacgccgctctcctttggtcacg

SEQ ID NO: 636179 - DNA, 25 bp, Rattus norvegicus
cttcgcttgcgtagagcgcagtcta

SEQ ID NO: 636180 - DNA, 25 bp, Rattus norvegicus
aaggtcctagggctctcccactacg

SEQ ID NO: 636181 - DNA, 25 bp, Rattus norvegicus
cagctcatgctagcgcgcagctcaa

SEQ ID NO: 636182 - DNA, 25 bp, Rattus norvegicus
ctcggcgacgtagtagtatttgttc

SEQ ID NO: 636183 - DNA, 25 bp, Rattus norvegicus
ggtccagacttcgtagcccaaggta

SEQ ID NO: 636184 - DNA, 25 bp, Rattus norvegicus
agaccctctggcagctcttggaaga

SEQ ID NO: 636185 - DNA, 25 bp, Rattus norvegicus
tttgtccgctcgacagtcagggttg

SEQ ID NO: 636186 - DNA, 25 bp, Rattus norvegicus
accaaggctaggcactgactcaaag

SEQ ID NO: 636187 - DNA, 25 bp, Rattus norvegicus
tggaacgcggaggtcactttcccga

SEQ ID NO: 636188 - DNA, 25 bp, Rattus norvegicus
ctccggatgcagcaaggcacataaa

SEQ ID NO: 636189 - DNA, 25 bp, Rattus norvegicus
gcttgctgtgcacccagctccggat

SEQ ID NO: 636190 - DNA, 25 bp, Rattus norvegicus
aagaagtgcctttggggactacatg

SEQ ID NO: 636191 - DNA, 25 bp, Rattus norvegicus
cttatcggattcaaagaagtgcctt

SEQ ID NO: 636192 - DNA, 25 bp, Rattus norvegicus
agcctttgctgattcaaacttatcg

SEQ ID NO: 636193 - DNA, 25 bp, Rattus norvegicus
gacgaagcttgtcgtttatcgctta

SEQ ID NO: 636194 - DNA, 25 bp, Rattus norvegicus
ttccggagacggagtgacgaagctt

SEQ ID NO: 636195 - DNA, 25 bp, Rattus norvegicus
tgatgaggtcctacgggagagactc

SEQ ID NO: 636196 - DNA, 25 bp, Rattus norvegicus
tttggctccggaacagcatcccgtc

SEQ ID NO: 636197 - DNA, 25 bp, Rattus norvegicus
ccgctgtgagaaccgcgctcgcagt

SEQ ID NO: 636198 - DNA, 25 bp, Rattus norvegicus
gacttgctcgaccttggaacgcgga

SEQ ID NO: 636199 - DNA, 25 bp, Rattus norvegicus
cgcagagacccgcaattgcctacta

SEQ ID NO: 636200 - DNA, 25 bp, Rattus norvegicus
ccgcggctgtggaacaggtcgttcc

SEQ ID NO: 636201 - DNA, 25 bp, Rattus norvegicus
gctccggagtgcacagcatctactt

SEQ ID NO: 636202 - DNA, 25 bp, Rattus norvegicus
tctacttcgcgacagactcggggtc

SEQ ID NO: 636203 - DNA, 25 bp, Rattus norvegicus
actcggggtcctgctatgtagaggt

SEQ ID NO: 636204 - DNA, 25 bp, Rattus norvegicus
tggggtgccaccaaaccgacatctg

SEQ ID NO: 636205 - DNA, 25 bp, Rattus norvegicus
tcctaggacacagggaggcagcgaa

SEQ ID NO: 636206 - DNA, 25 bp, Rattus norvegicus
gcagcgaattggcaccgtacgttcc

SEQ ID NO: 636207 - DNA, 25 bp, Rattus norvegicus
ctgcagaccgggttcgagactccct

SEQ ID NO: 636208 - DNA, 25 bp, Rattus norvegicus
agactccctggttgcaccttcggta

SEQ ID NO: 636209 - DNA, 25 bp, Rattus norvegicus
aggacaggagggaagcatactcgtc

SEQ ID NO: 636210 - DNA, 25 bp, Rattus norvegicus
cagcatggaggaggcgcacctgctc

SEQ ID NO: 636211 - DNA, 25 bp, Rattus norvegicus
gcagcattctgcacagtagcccgga

SEQ ID NO: 636212 - DNA, 25 bp, Rattus norvegicus
agcggttgtctcactcctgactcgg

SEQ ID NO: 636213 - DNA, 25 bp, Rattus norvegicus
tgccacagccactgccgtcggggaa

SEQ ID NO: 636214 - DNA, 25 bp, Rattus norvegicus
tgcgtcgcttctcggtgacagccga

SEQ ID NO: 636215 - DNA, 25 bp, Rattus norvegicus
aatggagcaccgcatagtgggaccc

SEQ ID NO: 636216 - DNA, 25 bp, Rattus norvegicus
ccgtaccgagccaccaggctggtga

SEQ ID NO: 636217 - DNA, 25 bp, Rattus norvegicus
ctcgggtaatgaaatccaggacacc

SEQ ID NO: 636218 - DNA, 25 bp, Rattus norvegicus
ctgcgagaggctcaacctcgggtaa

SEQ ID NO: 636219 - DNA, 25 bp, Rattus norvegicus
agtgtctttctcttctagctgcgag

SEQ ID NO: 636220 - DNA, 25 bp, Rattus norvegicus
accagtcacctctgcgagcgtctga

SEQ ID NO: 636221 - DNA, 25 bp, Rattus norvegicus
agctcccggcttgtgattcaaactg

SEQ ID NO: 636222 - DNA, 25 bp, Rattus norvegicus
ggtcctgtgttcactttgccctgta

SEQ ID NO: 636223 - DNA, 25 bp, Rattus norvegicus
aatgggaaccgaacgtcaggagatc

SEQ ID NO: 636224 - DNA, 25 bp, Rattus norvegicus
gacgccttcagccttaatgggaacc

SEQ ID NO: 636225 - DNA, 25 bp, Rattus norvegicus
ttctcggctgtagacgacgccttca

SEQ ID NO: 636226 - DNA, 25 bp, Rattus norvegicus
catgaacttcatctgccgccggtgg

SEQ ID NO: 636227 - DNA, 25 bp, Rattus norvegicus
ccaccaaggtggcatgaacttcatc

SEQ ID NO: 636228 - DNA, 25 bp, Rattus norvegicus
ccctctggcgaggaggaagtgtctt

SEQ ID NO: 636229 - DNA, 25 bp, Rattus norvegicus
ctctcggtggccaggagcctctggc

SEQ ID NO: 636230 - DNA, 25 bp, Rattus norvegicus
atccctgtggcgttctgtgatcctt

SEQ ID NO: 636231 - DNA, 25 bp, Rattus norvegicus
agcctctggccgctacaagtcggaa

SEQ ID NO: 636232 - DNA, 25 bp, Rattus norvegicus
cgctacaagtcggaagctgagccca

SEQ ID NO: 636233 - DNA, 25 bp, Rattus norvegicus
agcatctctggaggcacgagcagca

SEQ ID NO: 636234 - DNA, 25 bp, Rattus norvegicus
ggagctacccgtggtcgctacgcct

SEQ ID NO: 636235 - DNA, 25 bp, Rattus norvegicus
tggtcgctacgcctcaagcggggct

SEQ ID NO: 636236 - DNA, 25 bp, Rattus norvegicus
tactcggacacggagcgctacctgt

SEQ ID NO: 636237 - DNA, 25 bp, Rattus norvegicus
gctacctgtactgccgtgccatgga

SEQ ID NO: 636238 - DNA, 25 bp, Rattus norvegicus
ctgtactgccgtgccatggaccgca

SEQ ID NO: 636239 - DNA, 25 bp, Rattus norvegicus
atggaccgcacctcctacgcggtgg

SEQ ID NO: 636240 - DNA, 25 bp, Rattus norvegicus
cctcctacgcggtggagactggtca

SEQ ID NO: 636241 - DNA, 25 bp, Rattus norvegicus
tttctgcctctgctaccgaccaggg

SEQ ID NO: 636242 - DNA, 25 bp, Rattus norvegicus
tctgctaccgaccagggatccctgt

SEQ ID NO: 636243 - DNA, 25 bp, Rattus norvegicus
ccgcgacgtcaagctggagcatctc

SEQ ID NO: 636244 - DNA, 25 bp, Rattus norvegicus
caggtgtgcgatcacagccgcctgc

SEQ ID NO: 636245 - DNA, 25 bp, Rattus norvegicus
ggttttccgctgctctggtgcaaga

SEQ ID NO: 636246 - DNA, 25 bp, Rattus norvegicus
tctggtgcaagacagctccacagca

SEQ ID NO: 636247 - DNA, 25 bp, Rattus norvegicus
ctcccggctgcgcttcaaagcagtg

SEQ ID NO: 636248 - DNA, 25 bp, Rattus norvegicus
ggcggtccggacagcatattgcaac

SEQ ID NO: 636249 - DNA, 25 bp, Rattus norvegicus
tattgcaactcggaaccctttcgta

SEQ ID NO: 636250 - DNA, 25 bp, Rattus norvegicus
tgttcccggaaagccagcatggagc

SEQ ID NO: 636251 - DNA, 25 bp, Rattus norvegicus
gcccgcggacttgagcgacaaaaca

SEQ ID NO: 636252 - DNA, 25 bp, Rattus norvegicus
ggccgcggctgattcattcgcttcg

SEQ ID NO: 636253 - DNA, 25 bp, Rattus norvegicus
agctggagcatctcggccagcctga

SEQ ID NO: 636254 - DNA, 25 bp, Rattus norvegicus
aggggcagcatccaagctcagggaa

SEQ ID NO: 636255 - DNA, 25 bp, Rattus norvegicus
agttggccttgcagcactttgcgcc

SEQ ID NO: 636256 - DNA, 25 bp, Rattus norvegicus
cagagggcccaggactccactgtgc

SEQ ID NO: 636257 - DNA, 25 bp, Rattus norvegicus
gctgctggctctcgctcgcagaaga

SEQ ID NO: 636258 - DNA, 25 bp, Rattus norvegicus
acgatggagctcctgcggactatca

SEQ ID NO: 636259 - DNA, 25 bp, Rattus norvegicus
tccacggggtcctagactggagtct

SEQ ID NO: 636260 - DNA, 25 bp, Rattus norvegicus
atccacagtgcgcactccagggcgg

SEQ ID NO: 636261 - DNA, 25 bp, Rattus norvegicus
ccgccggcaccaagatgtgcgagca

SEQ ID NO: 636262 - DNA, 25 bp, Rattus norvegicus
cggacccgagatctcgcggattata

SEQ ID NO: 636263 - DNA, 25 bp, Rattus norvegicus
ccagcaggcgcgtatttaaagcttc

SEQ ID NO: 636264 - DNA, 25 bp, Rattus norvegicus
aagccaggccaaagcccgcgatagc

SEQ ID NO: 636265 - DNA, 25 bp, Rattus norvegicus
gcactcgacgaaacgcgggagcttt

SEQ ID NO: 636266 - DNA, 25 bp, Rattus norvegicus
ttctacgcccaaagtaagggcactc

SEQ ID NO: 636267 - DNA, 25 bp, Rattus norvegicus
cgcccttgagtttctgttttctacg

SEQ ID NO: 636268 - DNA, 25 bp, Rattus norvegicus
ccagaaccgagacagggcgttcgcc

SEQ ID NO: 636269 - DNA, 25 bp, Rattus norvegicus
cgtgtctccctgtgcagccacgagt

SEQ ID NO: 636270 - DNA, 25 bp, Rattus norvegicus
agccttctgaagacgggcagtccca

SEQ ID NO: 636271 - DNA, 25 bp, Rattus norvegicus
gcagccgtgcaaacgaacccactgg

SEQ ID NO: 636272 - DNA, 25 bp, Rattus norvegicus
agtctcagtcccaaaatggcgccga

SEQ ID NO: 636273 - DNA, 25 bp, Rattus norvegicus
tccgcaatgttctgggccaagtctc

SEQ ID NO: 636274 - DNA, 25 bp, Rattus norvegicus
ccaagtctcgcgagatcgtggaagg

SEQ ID NO: 636275 - DNA, 25 bp, Rattus norvegicus
aaagggtgtagaagcagccgtgcaa

SEQ ID NO: 636276 - DNA, 25 bp, Rattus norvegicus
caaacgaacccactgggcggggcag

SEQ ID NO: 636277 - DNA, 25 bp, Rattus norvegicus
caggaggagggcctccaccacagaa

SEQ ID NO: 636278 - DNA, 25 bp, Rattus norvegicus
ctgacgtgaggacggtgaacaatcc

SEQ ID NO: 636279 - DNA, 25 bp, Rattus norvegicus
tgaacaatccggaacgttcggtgga

SEQ ID NO: 636280 - DNA, 25 bp, Rattus norvegicus
gttccctgaggagcgcctctttgca

SEQ ID NO: 636281 - DNA, 25 bp, Rattus norvegicus
cccaggggactgtgttaccttctgc

SEQ ID NO: 636282 - DNA, 25 bp, Rattus norvegicus
attcccggccgttccctgaggagcg

SEQ ID NO: 636283 - DNA, 25 bp, Rattus norvegicus
tggcgccgacccgatccgcaatgtt

SEQ ID NO: 636284 - DNA, 25 bp, Rattus norvegicus
ccgagctgagtcaacgcccgagggc

SEQ ID NO: 636285 - DNA, 25 bp, Rattus norvegicus
caacttacagtgctggggttctcgc

SEQ ID NO: 636286 - DNA, 25 bp, Rattus norvegicus
gcgagggaccaaacgctcccagctc

SEQ ID NO: 636287 - DNA, 25 bp, Rattus norvegicus
aggccgagccattacggaacacctc

SEQ ID NO: 636288 - DNA, 25 bp, Rattus norvegicus
acttacagtgctggggttctcgccc

SEQ ID NO: 636289 - DNA, 25 bp, Rattus norvegicus
gcaccgcgagaactcaacttacagt

SEQ ID NO: 636290 - DNA, 25 bp, Rattus norvegicus
agcagcatactaggaagctccgccc

SEQ ID NO: 636291 - DNA, 25 bp, Rattus norvegicus
ccggaagcagcatactaggaagctc

SEQ ID NO: 636292 - DNA, 25 bp, Rattus norvegicus
ccgtaccaccggaagcagcatacta

SEQ ID NO: 636293 - DNA, 25 bp, Rattus norvegicus
ggatgaagtccaggcccggcctccg

SEQ ID NO: 636294 - DNA, 25 bp, Rattus norvegicus
cgacagccggatgaagtccaggccc

SEQ ID NO: 636295 - DNA, 25 bp, Rattus norvegicus
cgaactgcgccgacagccggatgaa

SEQ ID NO: 636296 - DNA, 25 bp, Rattus norvegicus
cgaagacaccgaactgcgccgacag

SEQ ID NO: 636297 - DNA, 25 bp, Rattus norvegicus
tcagacacccgaagacaccgaactg

SEQ ID NO: 636298 - DNA, 25 bp, Rattus norvegicus
ctatcttctgcgtcgtgcgcctgcg

SEQ ID NO: 636299 - DNA, 25 bp, Rattus norvegicus
ccagtgaacgccgatgcgcattcca

SEQ ID NO: 636300 - DNA, 25 bp, Rattus norvegicus
ggaactttactccagccggggcaga

SEQ ID NO: 636301 - DNA, 25 bp, Rattus norvegicus
gccctaaaggtaccaatatggcgga

SEQ ID NO: 636302 - DNA, 25 bp, Rattus norvegicus
gcgctgctcgttcgccctaaaggta

SEQ ID NO: 636303 - DNA, 25 bp, Rattus norvegicus
ataaggggccgagccgcctctgcct

SEQ ID NO: 636304 - DNA, 25 bp, Rattus norvegicus
gccggcctgccctataaggggccga

SEQ ID NO: 636305 - DNA, 25 bp, Rattus norvegicus
cgcccgcagttcagctggaacttta

SEQ ID NO: 636306 - DNA, 25 bp, Rattus norvegicus
ttcgagaagtccgtcgagccctcct

SEQ ID NO: 636307 - DNA, 25 bp, Rattus norvegicus
atcgcgtactcttctcacttcgaga

SEQ ID NO: 636308 - DNA, 25 bp, Rattus norvegicus
tttttggccatcaggcgctcgctca

SEQ ID NO: 636309 - DNA, 25 bp, Rattus norvegicus
gggtctccctttttggccatcaggc

SEQ ID NO: 636310 - DNA, 25 bp, Rattus norvegicus
cctagtcgtcctgcttcctgtcggg

SEQ ID NO: 636311 - DNA, 25 bp, Rattus norvegicus
gatgcgcattccattcctgcaggtg

SEQ ID NO: 636312 - DNA, 25 bp, Rattus norvegicus
ccattcctgcaggtgcctagtcgtc

SEQ ID NO: 636313 - DNA, 25 bp, Rattus norvegicus
gaggaaccggctcatcccagactca

SEQ ID NO: 636314 - DNA, 25 bp, Rattus norvegicus
ctatgcttggggcagtagacaaatc

SEQ ID NO: 636315 - DNA, 25 bp, Rattus norvegicus
ctctctcgctttggtttggggacca

SEQ ID NO: 636316 - DNA, 25 bp, Rattus norvegicus
ggagcgaagctacgtcttgcacttt

SEQ ID NO: 636317 - DNA, 25 bp, Rattus norvegicus
agcgaccctagctgccgggctatct

SEQ ID NO: 636318 - DNA, 25 bp, Rattus norvegicus
caaagggcaggctgtgtatctcaga

SEQ ID NO: 636319 - DNA, 25 bp, Rattus norvegicus
gtgaactcctcagatgcccgggatg

SEQ ID NO: 636320 - DNA, 25 bp, Rattus norvegicus
ccgggatgaaggactgatgctacga

SEQ ID NO: 636321 - DNA, 25 bp, Rattus norvegicus
ctacgagccgactagctctggtttc

SEQ ID NO: 636322 - DNA, 25 bp, Rattus norvegicus
tcggcttcccggctttgtaacttgc

SEQ ID NO: 636323 - DNA, 25 bp, Rattus norvegicus
gtaacttgccgagctccaaaccgtg

SEQ ID NO: 636324 - DNA, 25 bp, Rattus norvegicus
cgtggcttggagttgcccgttccaa

SEQ ID NO: 636325 - DNA, 25 bp, Rattus norvegicus
gccatcgtcccgagtctgcgagttt

SEQ ID NO: 636326 - DNA, 25 bp, Rattus norvegicus
ctgcgagtttgtacactggggactt

SEQ ID NO: 636327 - DNA, 25 bp, Rattus norvegicus
ttccgcccgctcagttaaaggagga

SEQ ID NO: 636328 - DNA, 25 bp, Rattus norvegicus
tgctcgctctctcagaacgctttcg

SEQ ID NO: 636329 - DNA, 25 bp, Rattus norvegicus
tggagcagcgcgatgctcgctctct

SEQ ID NO: 636330 - DNA, 25 bp, Rattus norvegicus
tgcagaactggagcagcgcgatgct

SEQ ID NO: 636331 - DNA, 25 bp, Rattus norvegicus
cctggacgtgcagaactggagcagc

SEQ ID NO: 636332 - DNA, 25 bp, Rattus norvegicus
ttctggccgcctggacgtgcagaac

SEQ ID NO: 636333 - DNA, 25 bp, Rattus norvegicus
cactgtcccgtcctccgggcctcca

SEQ ID NO: 636334 - DNA, 25 bp, Rattus norvegicus
atgaagcggcgccatcgctgaccca

SEQ ID NO: 636335 - DNA, 25 bp, Rattus norvegicus
cccgctcagttaaaggaggagccgg

SEQ ID NO: 636336 - DNA, 25 bp, Rattus norvegicus
atcttccgcccgctcagttaaagga

SEQ ID NO: 636337 - DNA, 25 bp, Rattus norvegicus
gagtcgaatcttccgcccgctcagt

SEQ ID NO: 636338 - DNA, 25 bp, Rattus norvegicus
gaagaggcgagtcgaatcttccgcc

SEQ ID NO: 636339 - DNA, 25 bp, Rattus norvegicus
cagcgacgaggaaggcaaggaagag

SEQ ID NO: 636340 - DNA, 25 bp, Rattus norvegicus
gagccgggttgcactgtcccgtcct

SEQ ID NO: 636341 - DNA, 25 bp, Rattus norvegicus
cacacgatagacaggacgctgcagc

SEQ ID NO: 636342 - DNA, 25 bp, Rattus norvegicus
gctgccgcctccagaagttccagtg

SEQ ID NO: 636343 - DNA, 25 bp, Rattus norvegicus
cccgctaacatcgtgggaaaggcgc

SEQ ID NO: 636344 - DNA, 25 bp, Rattus norvegicus
ctaacatcgtgggaaaggcgcctaa

SEQ ID NO: 636345 - DNA, 25 bp, Rattus norvegicus
tgggaaaggcgcctaagggccatct

SEQ ID NO: 636346 - DNA, 25 bp, Rattus norvegicus
agggccatctcccttacgttccagt

SEQ ID NO: 636347 - DNA, 25 bp, Rattus norvegicus
tcccttacgttccagtttctagaga

SEQ ID NO: 636348 - DNA, 25 bp, Rattus norvegicus
tctagagaataagcagccaacgagc

SEQ ID NO: 636349 - DNA, 25 bp, Rattus norvegicus
agccaacgagctccattccgaatgc

SEQ ID NO: 636350 - DNA, 25 bp, Rattus norvegicus
tccattccgaatgcctgaatcgagc

SEQ ID NO: 636351 - DNA, 25 bp, Rattus norvegicus
cctgaatcgagcaaacacaagtgtg

SEQ ID NO: 636352 - DNA, 25 bp, Rattus norvegicus
caagtgtggagaagtaagcgaccca

SEQ ID NO: 636353 - DNA, 25 bp, Rattus norvegicus
ggcggcgccagcacttaggctgcct

SEQ ID NO: 636354 - DNA, 25 bp, Rattus norvegicus
gtaagcgacccacgctgtattaacg

SEQ ID NO: 636355 - DNA, 25 bp, Rattus norvegicus
gctgcgcggcacagccaatgatcgc

SEQ ID NO: 636356 - DNA, 25 bp, Rattus norvegicus
gagaaaaccatcgaacgcgccaggc

SEQ ID NO: 636357 - DNA, 25 bp, Rattus norvegicus
tgtccgcgggactgcataggaaccc

SEQ ID NO: 636358 - DNA, 25 bp, Rattus norvegicus
tctaagccaactatgcgggtgaccg

SEQ ID NO: 636359 - DNA, 25 bp, Rattus norvegicus
ccgagcctgcatctgtctaagccaa

SEQ ID NO: 636360 - DNA, 25 bp, Rattus norvegicus
ctgtgtctgcagagccaggtccttg

SEQ ID NO: 636361 - DNA, 25 bp, Rattus norvegicus
ccaccgcagagactgtcgcctggtg

SEQ ID NO: 636362 - DNA, 25 bp, Rattus norvegicus
accggactctgattggacatctctg

SEQ ID NO: 636363 - DNA, 25 bp, Rattus norvegicus
acgggtacacccacgtgtggatctc

SEQ ID NO: 636364 - DNA, 25 bp, Rattus norvegicus
tcccgtgagtcttccgtggagagct

SEQ ID NO: 636365 - DNA, 25 bp, Rattus norvegicus
acggatgcggctagcgacttcagct

SEQ ID NO: 636366 - DNA, 25 bp, Rattus norvegicus
gacttcagctgctgcgcagtcgtcc

SEQ ID NO: 636367 - DNA, 25 bp, Rattus norvegicus
attggtgttccgagggtgcacacgt

SEQ ID NO: 636368 - DNA, 25 bp, Rattus norvegicus
ccctgtgtagccagcgtgctttaga

SEQ ID NO: 636369 - DNA, 25 bp, Rattus norvegicus
cgcctggggagcgtcgcataagccc

SEQ ID NO: 636370 - DNA, 25 bp, Rattus norvegicus
ggcccaggggctctatcctgtcaca

SEQ ID NO: 636371 - DNA, 25 bp, Rattus norvegicus
agcgtcgcataagcccggcccggta

SEQ ID NO: 636372 - DNA, 25 bp, Rattus norvegicus
tatcctgtcacagggcgcagaccca

SEQ ID NO: 636373 - DNA, 25 bp, Rattus norvegicus
ccgcggtttgcacgcctgtcacatg

SEQ ID NO: 636374 - DNA, 25 bp, Rattus norvegicus
gcctgtcacatgtccgcaaacaata

SEQ ID NO: 636375 - DNA, 25 bp, Rattus norvegicus
catgtccgcaaacaataacaaactc

SEQ ID NO: 636376 - DNA, 25 bp, Rattus norvegicus
gcgctccgtcctcgcttcattcatt

SEQ ID NO: 636377 - DNA, 25 bp, Rattus norvegicus
actcctcactttgcgcagctgctgc

SEQ ID NO: 636378 - DNA, 25 bp, Rattus norvegicus
aatcccgacgacgaggcgcgatcgc

SEQ ID NO: 636379 - DNA, 25 bp, Rattus norvegicus
cgccattttctctcgcgggctacat

SEQ ID NO: 636380 - DNA, 25 bp, Rattus norvegicus
tctctcgcgggctacattcgctcgt

SEQ ID NO: 636381 - DNA, 25 bp, Rattus norvegicus
gctacattcgctcgtgcctgcgggg

SEQ ID NO: 636382 - DNA, 25 bp, Rattus norvegicus
cgtctcctgtctcgggagcacggag

SEQ ID NO: 636383 - DNA, 25 bp, Rattus norvegicus
gaacaagtctatgtgcgtttaactg

SEQ ID NO: 636384 - DNA, 25 bp, Rattus norvegicus
caaagacgcagaggacagagatggc

SEQ ID NO: 636385 - DNA, 25 bp, Rattus norvegicus
tgtaaccagaagaggtcagaagtgc

SEQ ID NO: 636386 - DNA, 25 bp, Rattus norvegicus
tggcgcttcgcggtaagaacaagtc

SEQ ID NO: 636387 - DNA, 25 bp, Rattus norvegicus
tgagatagaaaagcccgacttacgg

SEQ ID NO: 636388 - DNA, 25 bp, Rattus norvegicus
ggcggagaggcagccactgaactca

SEQ ID NO: 636389 - DNA, 25 bp, Rattus norvegicus
agaggcagccactgaactcacgcac

SEQ ID NO: 636390 - DNA, 25 bp, Rattus norvegicus
caccgggccagttggtagtcttcaa

SEQ ID NO: 636391 - DNA, 25 bp, Rattus norvegicus
cgggccagttggtagtcttcaaaga

SEQ ID NO: 636392 - DNA, 25 bp, Rattus norvegicus
agtcttcaaagacgcagaggacaga

SEQ ID NO: 636393 - DNA, 25 bp, Rattus norvegicus
cagagatggcggctgcagttagtac

SEQ ID NO: 636394 - DNA, 25 bp, Rattus norvegicus
gcggctgcagttagtacgcagtccg

SEQ ID NO: 636395 - DNA, 25 bp, Rattus norvegicus
ctatgtgcgtttaactgagatagaa

SEQ ID NO: 636396 - DNA, 25 bp, Rattus norvegicus
ccagttggtagtcttcaaagacgca

SEQ ID NO: 636397 - DNA, 25 bp, Rattus norvegicus
aaagtccttcgggatcgcgcgtcct

SEQ ID NO: 636398 - DNA, 25 bp, Rattus norvegicus
tctagtctaggagaggcgaccaggc

SEQ ID NO: 636399 - DNA, 25 bp, Rattus norvegicus
ggaaccgcgttacgggaatcgcaga

SEQ ID NO: 636400 - DNA, 25 bp, Rattus norvegicus
gccgcgcgctccgagactgatcaga

SEQ ID NO: 636401 - DNA, 25 bp, Rattus norvegicus
ctccgagactgatcagagccaatga

SEQ ID NO: 636402 - DNA, 25 bp, Rattus norvegicus
tcagagccaatgagctcccggtctc

SEQ ID NO: 636403 - DNA, 25 bp, Rattus norvegicus
tcaggaggccagagcttcgagcgat

SEQ ID NO: 636404 - DNA, 25 bp, Rattus norvegicus
ttcgagcgatccaggctgcggctcc

SEQ ID NO: 636405 - DNA, 25 bp, Rattus norvegicus
cggggaagccttcgatctagtctag

SEQ ID NO: 636406 - DNA, 25 bp, Rattus norvegicus
gttcctgacgctcagttccggagcc

SEQ ID NO: 636407 - DNA, 25 bp, Rattus norvegicus
gcgaccaggctcaatctccggaatc

SEQ ID NO: 636408 - DNA, 25 bp, Rattus norvegicus
atcgcgcgtcctgggtgaccgcgtc

SEQ ID NO: 636409 - DNA, 25 bp, Rattus norvegicus
ccgaacgcgttcctgacgctcagtt

SEQ ID NO: 636410 - DNA, 25 bp, Rattus norvegicus
acgggaatcgcagaggcctgcagtc

SEQ ID NO: 636411 - DNA, 25 bp, Rattus norvegicus
ccgtacgtggtcctcgatgtgattt

SEQ ID NO: 636412 - DNA, 25 bp, Rattus norvegicus
catgttcgacaagacgcggctgccg

SEQ ID NO: 636413 - DNA, 25 bp, Rattus norvegicus
cagcccgtgaccatgttcgacaaga

SEQ ID NO: 636414 - DNA, 25 bp, Rattus norvegicus
ggtagtgacatcgtccagcccgtga

SEQ ID NO: 636415 - DNA, 25 bp, Rattus norvegicus
cgcccgcacctggtagtgacatcgt

SEQ ID NO: 636416 - DNA, 25 bp, Rattus norvegicus
ctcctgggaattgggtatctggacc

SEQ ID NO: 636417 - DNA, 25 bp, Rattus norvegicus
gctttcagtctaggaggcgtacggt

SEQ ID NO: 636418 - DNA, 25 bp, Rattus norvegicus
caggtcgctgctgctttcagtctag

SEQ ID NO: 636419 - DNA, 25 bp, Rattus norvegicus
ggccgagtccaaactgcccaggtcg

SEQ ID NO: 636420 - DNA, 25 bp, Rattus norvegicus
ccagcactgagagcaggcgcctgag

SEQ ID NO: 636421 - DNA, 25 bp, Rattus norvegicus
tttggccgcggctagccagcactga

SEQ ID NO: 636422 - DNA, 25 bp, Rattus norvegicus
tccttaaagctggagtctgctcgcc

SEQ ID NO: 636423 - DNA, 25 bp, Rattus norvegicus
tgatttgcgtgttgctgggtacgta

SEQ ID NO: 636424 - DNA, 25 bp, Rattus norvegicus
gcttccagattctgggcgcgctccg

SEQ ID NO: 636425 - DNA, 25 bp, Rattus norvegicus
gctgcagtggtcgaatcatcctcga

SEQ ID NO: 636426 - DNA, 25 bp, Rattus norvegicus
cgggatcgcacctacagtgacgcca

SEQ ID NO: 636427 - DNA, 25 bp, Rattus norvegicus
tgacgccaaatagggactctacggt

SEQ ID NO: 636428 - DNA, 25 bp, Rattus norvegicus
tggcccgcaggaatcaaaagtgagc

SEQ ID NO: 636429 - DNA, 25 bp, Rattus norvegicus
tctccttctcgtctgcgtcttgttc

SEQ ID NO: 636430 - DNA, 25 bp, Rattus norvegicus
ttttctttttagaccactgcgagtc

SEQ ID NO: 636431 - DNA, 25 bp, Rattus norvegicus
tgcgagtccggcagttcaatgacta

SEQ ID NO: 636432 - DNA, 25 bp, Rattus norvegicus
ttagcgacaagtggcgcacgacggc

SEQ ID NO: 636433 - DNA, 25 bp, Rattus norvegicus
cggagtctgatgaaagggaccaatt

SEQ ID NO: 636434 - DNA, 25 bp, Rattus norvegicus
gggaccaattgagcctgagcgccag

SEQ ID NO: 636435 - DNA, 25 bp, Rattus norvegicus
agccggcaaacgtgaagagctctcc

SEQ ID NO: 636436 - DNA, 25 bp, Rattus norvegicus
cgggatctggatctggaagactact

SEQ ID NO: 636437 - DNA, 25 bp, Rattus norvegicus
tccaacagctgaaatatgggcggca

SEQ ID NO: 636438 - DNA, 25 bp, Rattus norvegicus
tccgccatctttcggaactctaaga

SEQ ID NO: 636439 - DNA, 25 bp, Rattus norvegicus
agcgctggcaagagctagcctctcg

SEQ ID NO: 636440 - DNA, 25 bp, Rattus norvegicus
cttttccacccacgggagtcgctgg

SEQ ID NO: 636441 - DNA, 25 bp, Rattus norvegicus
gccagagctgctacgacttccgaaa

SEQ ID NO: 636442 - DNA, 25 bp, Rattus norvegicus
cttccgagaatatggccagagctgc

SEQ ID NO: 636443 - DNA, 25 bp, Rattus norvegicus
acaggtcgggtacttagagctgcgc

SEQ ID NO: 636444 - DNA, 25 bp, Rattus norvegicus
agcgctagatctccagaccttccga

SEQ ID NO: 636445 - DNA, 25 bp, Rattus norvegicus
tgcccagcccttgacagcgctagat

SEQ ID NO: 636446 - DNA, 25 bp, Rattus norvegicus
tgcgggactgcagctccctactcag

SEQ ID NO: 636447 - DNA, 25 bp, Rattus norvegicus
agttccagctcggacggtgccgaca

SEQ ID NO: 636448 - DNA, 25 bp, Rattus norvegicus
gcgggagttgttgcaacgcctcctc

SEQ ID NO: 636449 - DNA, 25 bp, Rattus norvegicus
cccagtgaagaagagcagacgcccg

SEQ ID NO: 636450 - DNA, 25 bp, Rattus norvegicus
cgggaggcaggacaaccatcagaac

SEQ ID NO: 636451 - DNA, 25 bp, Rattus norvegicus
ctagggcggctactcgattgtaaca

SEQ ID NO: 636452 - DNA, 25 bp, Rattus norvegicus
ggcgtctgtgaccttttcgagtccc

SEQ ID NO: 636453 - DNA, 25 bp, Rattus norvegicus
gcacgcagcacagaactcctatacg

SEQ ID NO: 636454 - DNA, 25 bp, Rattus norvegicus
cggcagtcacccgtctggaagaaaa

SEQ ID NO: 636455 - DNA, 25 bp, Rattus norvegicus
attgacagcgctgttggccacctct

SEQ ID NO: 636456 - DNA, 25 bp, Rattus norvegicus
cagcccacgaagagcagtgccagtg

SEQ ID NO: 636457 - DNA, 25 bp, Rattus norvegicus
tccatcttgcgacgcttgggaccca

SEQ ID NO: 636458 - DNA, 25 bp, Rattus norvegicus
tagcctcgtagagcgcgtagacctg

SEQ ID NO: 636459 - DNA, 25 bp, Rattus norvegicus
tgcgagctggcgctccaaagcaatg

SEQ ID NO: 636460 - DNA, 25 bp, Rattus norvegicus
ccaaagcaatgagcgccaccaggtg

SEQ ID NO: 636461 - DNA, 25 bp, Rattus norvegicus
agccaagttgcccagagcaggtcgc

SEQ ID NO: 636462 - DNA, 25 bp, Rattus norvegicus
ggtgcctccactcgcgtacaggtca

SEQ ID NO: 636463 - DNA, 25 bp, Rattus norvegicus
gctgcaccagcaggaagtccatctt

SEQ ID NO: 636464 - DNA, 25 bp, Rattus norvegicus
cagagcactgtggtgttgccagcta

SEQ ID NO: 636465 - DNA, 25 bp, Rattus norvegicus
catactggcggaccagggcatccca

SEQ ID NO: 636466 - DNA, 25 bp, Rattus norvegicus
gcgaagcccacgatagcctcgtaga

SEQ ID NO: 636467 - DNA, 25 bp, Rattus norvegicus
gggcgcgcccaccatcaacttcttc

SEQ ID NO: 636468 - DNA, 25 bp, Rattus norvegicus
cggagctgagcctgaccgattatgc

SEQ ID NO: 636469 - DNA, 25 bp, Rattus norvegicus
agctcaaaccttggcccggggagtg

SEQ ID NO: 636470 - DNA, 25 bp, Rattus norvegicus
ttagcagctcaaaccttggcccggg

SEQ ID NO: 636471 - DNA, 25 bp, Rattus norvegicus
aggtcacggaagctttagcagctca

SEQ ID NO: 636472 - DNA, 25 bp, Rattus norvegicus
tcaggttgaggtcacggaagcttta

SEQ ID NO: 636473 - DNA, 25 bp, Rattus norvegicus
gcggggctttctcccggcagcagct

SEQ ID NO: 636474 - DNA, 25 bp, Rattus norvegicus
agctgcacttcagcttgggcgcgcc

SEQ ID NO: 636475 - DNA, 25 bp, Rattus norvegicus
cgtgctacacaagctgcacttcagc

SEQ ID NO: 636476 - DNA, 25 bp, Rattus norvegicus
ctcgagtgcatcgtgctacacaagc

SEQ ID NO: 636477 - DNA, 25 bp, Rattus norvegicus
cagctgtgtaacctcgagtgcatcg

SEQ ID NO: 636478 - DNA, 25 bp, Rattus norvegicus
cccggcagcagctgtgtaacctcga

SEQ ID NO: 636479 - DNA, 25 bp, Rattus norvegicus
acttcacacattcgcgcgtggaggc

SEQ ID NO: 636480 - DNA, 25 bp, Rattus norvegicus
tggagcacttcacacattcgcgcgt

SEQ ID NO: 636481 - DNA, 25 bp, Rattus norvegicus
ccctggttccgaggtcctcattgaa

SEQ ID NO: 636482 - DNA, 25 bp, Rattus norvegicus
tgcagactgcacctcgctactcgga

SEQ ID NO: 636483 - DNA, 25 bp, Rattus norvegicus
accaccatagacctgcaggaccttg

SEQ ID NO: 636484 - DNA, 25 bp, Rattus norvegicus
cctcattgaaggtcctggcagcgac

SEQ ID NO: 636485 - DNA, 25 bp, Rattus norvegicus
gaagcacctgcacaacccgattatc

SEQ ID NO: 636486 - DNA, 25 bp, Rattus norvegicus
gtggaagtccttcccaggatgcggc

SEQ ID NO: 636487 - DNA, 25 bp, Rattus norvegicus
cggctagttcgttcctccgtggaag

SEQ ID NO: 636488 - DNA, 25 bp, Rattus norvegicus
tgggagagtctaccagcccagcttc

SEQ ID NO: 636489 - DNA, 25 bp, Rattus norvegicus
ccgaataggatgctggacctgtctc

SEQ ID NO: 636490 - DNA, 25 bp, Rattus norvegicus
cgggccttcgacagcatctgtccga

SEQ ID NO: 636491 - DNA, 25 bp, Rattus norvegicus
ttcatcccaggatgcacgcgtgcga

SEQ ID NO: 636492 - DNA, 25 bp, Rattus norvegicus
cccaacaggtgcagcggcactggct

SEQ ID NO: 636493 - DNA, 25 bp, Rattus norvegicus
ttgccaggttggttaacgcctccgc

SEQ ID NO: 636494 - DNA, 25 bp, Rattus norvegicus
gcgacctgacagaggcttagggttc

SEQ ID NO: 636495 - DNA, 25 bp, Rattus norvegicus
agtggacgccatcctcagggacatc

SEQ ID NO: 636496 - DNA, 25 bp, Rattus norvegicus
tcactcagggagaggaacgtacagc

SEQ ID NO: 636497 - DNA, 25 bp, Rattus norvegicus
tcaaagaactcgcttgccggacccg

SEQ ID NO: 636498 - DNA, 25 bp, Rattus norvegicus
ctcagtgctggatgtaagtggacca

SEQ ID NO: 636499 - DNA, 25 bp, Rattus norvegicus
cacggttggaactgtgacggtgacc

SEQ ID NO: 636500 - DNA, 25 bp, Rattus norvegicus
tgtctcttgtgtagcgcgcacctga

SEQ ID NO: 636501 - DNA, 25 bp, Rattus norvegicus
ccatctttcacagaagctgatgatc

SEQ ID NO: 636502 - DNA, 25 bp, Rattus norvegicus
tgatgatcacgcagtctccggccga

SEQ ID NO: 636503 - DNA, 25 bp, Rattus norvegicus
caggaacctccatggtgtcttccga

SEQ ID NO: 636504 - DNA, 25 bp, Rattus norvegicus
gagctgttctctgccacggggcaag

SEQ ID NO: 636505 - DNA, 25 bp, Rattus norvegicus
ggacatctcccagcgctgcgaggaa

SEQ ID NO: 636506 - DNA, 25 bp, Rattus norvegicus
caacaggagcccgacagcaaggatt

SEQ ID NO: 636507 - DNA, 25 bp, Rattus norvegicus
caaggattgcagcaccaggaacctc

SEQ ID NO: 636508 - DNA, 25 bp, Rattus norvegicus
tccagctcaaggcaacgacgaaaag

SEQ ID NO: 636509 - DNA, 25 bp, Rattus norvegicus
acgctctaggtgacagaggtgcttc

SEQ ID NO: 636510 - DNA, 25 bp, Rattus norvegicus
tcggctgaagataaaagggagtcgc

SEQ ID NO: 636511 - DNA, 25 bp, Rattus norvegicus
cccggaaatgggtgcagagaacgct

SEQ ID NO: 636512 - DNA, 25 bp, Rattus norvegicus
tgcggcgctccctaaaggaactgct

SEQ ID NO: 636513 - DNA, 25 bp, Rattus norvegicus
aagaaggcgagctggaaatcgtgcc

SEQ ID NO: 636514 - DNA, 25 bp, Rattus norvegicus
cgagccggaacccatggaggttgaa

SEQ ID NO: 636515 - DNA, 25 bp, Rattus norvegicus
cctgaaaggaagtgttaggtgccgc

SEQ ID NO: 636516 - DNA, 25 bp, Rattus norvegicus
gaggtgcttctctgtggtcatcagc

SEQ ID NO: 636517 - DNA, 25 bp, Rattus norvegicus
ggcgggaacagaaccggatcagtcc

SEQ ID NO: 636518 - DNA, 25 bp, Rattus norvegicus
tctctggtagaaacggacgacgctc

SEQ ID NO: 636519 - DNA, 25 bp, Rattus norvegicus
ggcgccagagataaggacggctctc

SEQ ID NO: 636520 - DNA, 25 bp, Rattus norvegicus
ggtcatcagcgacggcgctctaggc

SEQ ID NO: 636521 - DNA, 25 bp, Rattus norvegicus
ccgtggcccggaacgaatgaactga

SEQ ID NO: 636522 - DNA, 25 bp, Rattus norvegicus
cgtccaggtctcctggtgggtccta

SEQ ID NO: 636523 - DNA, 25 bp, Rattus norvegicus
gggaagccctcccatacttgacgtc

SEQ ID NO: 636524 - DNA, 25 bp, Rattus norvegicus
aagggtgagattacggcacgcgccc

SEQ ID NO: 636525 - DNA, 25 bp, Rattus norvegicus
ttatcactagcagtaaagagaaggg

SEQ ID NO: 636526 - DNA, 25 bp, Rattus norvegicus
tcacgatcgattatcactagcagta

SEQ ID NO: 636527 - DNA, 25 bp, Rattus norvegicus
tcaggaattttcacgatcgattatc

SEQ ID NO: 636528 - DNA, 25 bp, Rattus norvegicus
cttgacgtcatcgaagcgctggcct

SEQ ID NO: 636529 - DNA, 25 bp, Rattus norvegicus
caaagcttggcgctgcagtgcgcgc

SEQ ID NO: 636530 - DNA, 25 bp, Rattus norvegicus
gctcgcggcaaagcttggcgctgca

SEQ ID NO: 636531 - DNA, 25 bp, Rattus norvegicus
caggaggctcagacccgccagggct

SEQ ID NO: 636532 - DNA, 25 bp, Rattus norvegicus
gcgaactccgcaccgcctgtggtgg

SEQ ID NO: 636533 - DNA, 25 bp, Rattus norvegicus
tgaaaacggaagcgacggtgaactc

SEQ ID NO: 636534 - DNA, 25 bp, Rattus norvegicus
gattagagtccgttaggacgaagtg

SEQ ID NO: 636535 - DNA, 25 bp, Rattus norvegicus
acggcacgcgcccaaattttatagg

SEQ ID NO: 636536 - DNA, 25 bp, Rattus norvegicus
aggaggttcccgctttgattgccgc

SEQ ID NO: 636537 - DNA, 25 bp, Rattus norvegicus
gccctctggccctcctgcgcgctca

SEQ ID NO: 636538 - DNA, 25 bp, Rattus norvegicus
ctgtgcacaggcttctctgcggccg

SEQ ID NO: 636539 - DNA, 25 bp, Rattus norvegicus
gggccctgtgcacaggcttctctgc

SEQ ID NO: 636540 - DNA, 25 bp, Rattus norvegicus
agctgggcggaacggaggatgtagc

SEQ ID NO: 636541 - DNA, 25 bp, Rattus norvegicus
cctctccaaactcccgggcgcgcag

SEQ ID NO: 636542 - DNA, 25 bp, Rattus norvegicus
tagcggggccctgtgcacaggcttc

SEQ ID NO: 636543 - DNA, 25 bp, Rattus norvegicus
cagggcaagtgggacgcgcggccct

SEQ ID NO: 636544 - DNA, 25 bp, Rattus norvegicus
cccgtcgggactcgcacggcaccgc

SEQ ID NO: 636545 - DNA, 25 bp, Rattus norvegicus
gacaccgggccgcacaggtagagct

SEQ ID NO: 636546 - DNA, 25 bp, Rattus norvegicus
cgggccgcacaggtagagctccgca

SEQ ID NO: 636547 - DNA, 25 bp, Rattus norvegicus
gccgcacaggtagagctccgcacgg

SEQ ID NO: 636548 - DNA, 25 bp, Rattus norvegicus
gcacaggtagagctccgcacgggcc

SEQ ID NO: 636549 - DNA, 25 bp, Rattus norvegicus
cgggccgagccaagtgacgctacgc

SEQ ID NO: 636550 - DNA, 25 bp, Rattus norvegicus
cgagccaagtgacgctacgcggaga

SEQ ID NO: 636551 - DNA, 25 bp, Rattus norvegicus
acctgcacgtacgaagccgggaaga

SEQ ID NO: 636552 - DNA, 25 bp, Rattus norvegicus
ctcttggctccagacgcttgatgcg

SEQ ID NO: 636553 - DNA, 25 bp, Rattus norvegicus
cgctgaggacgaaccgtcgaggtcc

SEQ ID NO: 636554 - DNA, 25 bp, Rattus norvegicus
tgccactgtggagctgtcgtcccac

SEQ ID NO: 636555 - DNA, 25 bp, Rattus norvegicus
ccgacttgacgaaggtggagaaccg

SEQ ID NO: 636556 - DNA, 25 bp, Rattus norvegicus
tccggcgcacggataacctgcacgt

SEQ ID NO: 636557 - DNA, 25 bp, Rattus norvegicus
gaaccgattgaggttgcggctcacc

SEQ ID NO: 636558 - DNA, 25 bp, Rattus norvegicus
cgcggctgttgatcccttcaagcca

SEQ ID NO: 636559 - DNA, 25 bp, Rattus norvegicus
atgtcctgctcgctgcacaagctca

SEQ ID NO: 636560 - DNA, 25 bp, Rattus norvegicus
ctcgtgctcccgcagggagatctca

SEQ ID NO: 636561 - DNA, 25 bp, Rattus norvegicus
gctcaccgcagcgactgcagcttgg

SEQ ID NO: 636562 - DNA, 25 bp, Rattus norvegicus
gatctcaccggggttctcggaccta

SEQ ID NO: 636563 - DNA, 25 bp, Rattus norvegicus
tcggacctaaagtcgtagagcgccc

SEQ ID NO: 636564 - DNA, 25 bp, Rattus norvegicus
ctggtaagcaccgtagagctgctgg

SEQ ID NO: 636565 - DNA, 25 bp, Rattus norvegicus
cgcgcgctcacgcaggcgcagtaaa

SEQ ID NO: 636566 - DNA, 25 bp, Rattus norvegicus
ctagattgtaggtgtgccacatgtc

SEQ ID NO: 636567 - DNA, 25 bp, Rattus norvegicus
gtcgatggcctccacgcaaagagtg

SEQ ID NO: 636568 - DNA, 25 bp, Rattus norvegicus
tggaggactcggtctggaccttacg

SEQ ID NO: 636569 - DNA, 25 bp, Rattus norvegicus
atgtcaaagtaagcgcctctggccg

SEQ ID NO: 636570 - DNA, 25 bp, Rattus norvegicus
tgtcgcccacctgcactagattgta

SEQ ID NO: 636571 - DNA, 25 bp, Rattus norvegicus
tgtcaccgaccctaccagagaggcg

SEQ ID NO: 636572 - DNA, 25 bp, Rattus norvegicus
ggcccgcattgtccttctcgatatc

SEQ ID NO: 636573 - DNA, 25 bp, Rattus norvegicus
tcacaagcttcatgaccgcggcagg

SEQ ID NO: 636574 - DNA, 25 bp, Rattus norvegicus
ctcacttcagaataggaggcgcttg

SEQ ID NO: 636575 - DNA, 25 bp, Rattus norvegicus
gaccggaaggaaacactacctctga

SEQ ID NO: 636576 - DNA, 25 bp, Rattus norvegicus
tacctctgactcctgtagcccggga

SEQ ID NO: 636577 - DNA, 25 bp, Rattus norvegicus
ctcagcacagacaactcaggacttc

SEQ ID NO: 636578 - DNA, 25 bp, Rattus norvegicus
aactcaggacttccagtcgcgggcc

SEQ ID NO: 636579 - DNA, 25 bp, Rattus norvegicus
aaacgccaggatgggagtacggatc

SEQ ID NO: 636580 - DNA, 25 bp, Rattus norvegicus
ccaaagtggagcgacctgggaatcc

SEQ ID NO: 636581 - DNA, 25 bp, Rattus norvegicus
tccttcgttctcaaagcagtgcggc

SEQ ID NO: 636582 - DNA, 25 bp, Rattus norvegicus
ccgctagggactcacttccttcgtt

SEQ ID NO: 636583 - DNA, 25 bp, Rattus norvegicus
ctgacattgagaccgccgccatctt

SEQ ID NO: 636584 - DNA, 25 bp, Rattus norvegicus
gcctgtctcagcgacactgacattg

SEQ ID NO: 636585 - DNA, 25 bp, Rattus norvegicus
ccgcagctgtagctactgccctttg

SEQ ID NO: 636586 - DNA, 25 bp, Rattus norvegicus
ctctgcagacggaaaccgcagctgt

SEQ ID NO: 636587 - DNA, 25 bp, Rattus norvegicus
tgttacctggatggaactctgcaga

SEQ ID NO: 636588 - DNA, 25 bp, Rattus norvegicus
gctcgactaggctgacaattatgtt

SEQ ID NO: 636589 - DNA, 25 bp, Rattus norvegicus
tttgcctcaacaacgcctgtctcag

SEQ ID NO: 636590 - DNA, 25 bp, Rattus norvegicus
aacccgaggctccataggcgccttg

SEQ ID NO: 636591 - DNA, 25 bp, Rattus norvegicus
cccgcatcccgaggaagggtcagag

SEQ ID NO: 636592 - DNA, 25 bp, Rattus norvegicus
cctgggaatcctgaatgaatagctc

SEQ ID NO: 636593 - DNA, 25 bp, Rattus norvegicus
gttgcccagcctagtgtcgggcaga

SEQ ID NO: 636594 - DNA, 25 bp, Rattus norvegicus
ccagcctagtgtcgggcagacggct

SEQ ID NO: 636595 - DNA, 25 bp, Rattus norvegicus
tcgaaatctccgagggctgctttcc

SEQ ID NO: 636596 - DNA, 25 bp, Rattus norvegicus
cctggcgcccacgtccgggcaccca

SEQ ID NO: 636597 - DNA, 25 bp, Rattus norvegicus
tcagaaaggcgggttgcccagccta

SEQ ID NO: 636598 - DNA, 25 bp, Rattus norvegicus
caccacggtctttcgaaatctccga

SEQ ID NO: 636599 - DNA, 25 bp, Rattus norvegicus
gtctttcgaaatctccgagggctgc

SEQ ID NO: 636600 - DNA, 25 bp, Rattus norvegicus
ccctatcagaaaggcgggttgccca

SEQ ID NO: 636601 - DNA, 25 bp, Rattus norvegicus
cagctcggagcacgcccgcagccac

SEQ ID NO: 636602 - DNA, 25 bp, Rattus norvegicus
ttgcaatccgccagctcggagcacg

SEQ ID NO: 636603 - DNA, 25 bp, Rattus norvegicus
ccgttttgcaatccgccagctcgga

SEQ ID NO: 636604 - DNA, 25 bp, Rattus norvegicus
gacgggcccgttttgcaatccgcca

SEQ ID NO: 636605 - DNA, 25 bp, Rattus norvegicus
gcagccaccacggtctttcgaaatc

SEQ ID NO: 636606 - DNA, 25 bp, Rattus norvegicus
atctccgagggctgctttccctggc

SEQ ID NO: 636607 - DNA, 25 bp, Rattus norvegicus
ttatctgtcggaggtgcccgaaatc

SEQ ID NO: 636608 - DNA, 25 bp, Rattus norvegicus
agacgttttatgtcccgaggtctca

SEQ ID NO: 636609 - DNA, 25 bp, Rattus norvegicus
ggcgcagccgcgctttaaatctaga

SEQ ID NO: 636610 - DNA, 25 bp, Rattus norvegicus
cccgcgcgattcaatggacgtcaga

SEQ ID NO: 636611 - DNA, 25 bp, Rattus norvegicus
ggtctccacaagtcagaggcaaaca

SEQ ID NO: 636612 - DNA, 25 bp, Rattus norvegicus
tgtgtcttactttgcggccaccctg

SEQ ID NO: 636613 - DNA, 25 bp, Rattus norvegicus
gcagtttcaggatccttcccgcaga

SEQ ID NO: 636614 - DNA, 25 bp, Rattus norvegicus
ggatcccggagctgctgaaatgccc

SEQ ID NO: 636615 - DNA, 25 bp, Rattus norvegicus
ttgtgcaacacaccgcaggatcccg

SEQ ID NO: 636616 - DNA, 25 bp, Rattus norvegicus
cgctcgggagagacttgtgcaacac

SEQ ID NO: 636617 - DNA, 25 bp, Rattus norvegicus
tggggaggaacatccacttcagtcc

SEQ ID NO: 636618 - DNA, 25 bp, Rattus norvegicus
ccgagttcttatttgcgtaggagcg

SEQ ID NO: 636619 - DNA, 25 bp, Rattus norvegicus
tcagtgtgaatcaggtgacatttcc

SEQ ID NO: 636620 - DNA, 25 bp, Rattus norvegicus
cccacagcctgcagtaggttgctaa

SEQ ID NO: 636621 - DNA, 25 bp, Rattus norvegicus
tgtgccaccaaaagagctcctctct

SEQ ID NO: 636622 - DNA, 25 bp, Rattus norvegicus
tgcccagcttggaggatggagcctc

SEQ ID NO: 636623 - DNA, 25 bp, Rattus norvegicus
cccagtgcagctgggagtctgtgcc

SEQ ID NO: 636624 - DNA, 25 bp, Rattus norvegicus
ccgcggagttcagtgctcaaaactt

SEQ ID NO: 636625 - DNA, 25 bp, Rattus norvegicus
gctcaaaactttgcagacgccgggg

SEQ ID NO: 636626 - DNA, 25 bp, Rattus norvegicus
tccgcagccgctttgctctgagctg

SEQ ID NO: 636627 - DNA, 25 bp, Rattus norvegicus
ctcagcccgagagggaagagaagca

SEQ ID NO: 636628 - DNA, 25 bp, Rattus norvegicus
ccggctctggaagaacctgcagctg

SEQ ID NO: 636629 - DNA, 25 bp, Rattus norvegicus
gagtgttctcttcctcgcagcccaa

SEQ ID NO: 636630 - DNA, 25 bp, Rattus norvegicus
ggaacatctgctgccggtggctaaa

SEQ ID NO: 636631 - DNA, 25 bp, Rattus norvegicus
gctaaagggtcctctacagccgcgg

SEQ ID NO: 636632 - DNA, 25 bp, Rattus norvegicus
aggcggacgctctccggactcagct

SEQ ID NO: 636633 - DNA, 25 bp, Rattus norvegicus
ctgaggcgcacctgtgccaccaaaa

SEQ ID NO: 636634 - DNA, 25 bp, Rattus norvegicus
accgcatccgagatgagggcacacg

SEQ ID NO: 636635 - DNA, 25 bp, Rattus norvegicus
agcaccgcccggaaggtggagcatc

SEQ ID NO: 636636 - DNA, 25 bp, Rattus norvegicus
tgctcgctgaatgtcaagtcctgtc

SEQ ID NO: 636637 - DNA, 25 bp, Rattus norvegicus
gctgcaccgggatcgaaaccgagtg

SEQ ID NO: 636638 - DNA, 25 bp, Rattus norvegicus
ccgggcggagcgaaatgtacacaag

SEQ ID NO: 636639 - DNA, 25 bp, Rattus norvegicus
ccggaactctggtgttcaggtcatg

SEQ ID NO: 636640 - DNA, 25 bp, Rattus norvegicus
gagccttactcctgctgctcgctga

SEQ ID NO: 636641 - DNA, 25 bp, Rattus norvegicus
ggttacacgcggacaagctagcctg

SEQ ID NO: 636642 - DNA, 25 bp, Rattus norvegicus
ggtaagatctggttacacgcggaca

SEQ ID NO: 636643 - DNA, 25 bp, Rattus norvegicus
ggttcctaggtgtcaggtaagatct

SEQ ID NO: 636644 - DNA, 25 bp, Rattus norvegicus
tggtgaactggctcccggcagtgta

SEQ ID NO: 636645 - DNA, 25 bp, Rattus norvegicus
ctgagtcaccggctccgacggggtt

SEQ ID NO: 636646 - DNA, 25 bp, Rattus norvegicus
tgtacacaagcgcagtgtccacacg

SEQ ID NO: 636647 - DNA, 25 bp, Rattus norvegicus
ccgagtgaactttcctggatgccga

SEQ ID NO: 636648 - DNA, 25 bp, Rattus norvegicus
aggtcatggcctgcacgaccgattc

SEQ ID NO: 636649 - DNA, 25 bp, Rattus norvegicus
aggtgtgcagctgcttttcgttgag

SEQ ID NO: 636650 - DNA, 25 bp, Rattus norvegicus
ggccggtcatctccactagttgctc

SEQ ID NO: 636651 - DNA, 25 bp, Rattus norvegicus
gcagagctggctgcctagcggagat

SEQ ID NO: 636652 - DNA, 25 bp, Rattus norvegicus
gtccgcactcgggtggtcttctcgg

SEQ ID NO: 636653 - DNA, 25 bp, Rattus norvegicus
ccgcaaggtgtgcagctgcttttcg

SEQ ID NO: 636654 - DNA, 25 bp, Rattus norvegicus
caaagggagtccgtgagcaagcaaa

SEQ ID NO: 636655 - DNA, 25 bp, Rattus norvegicus
tggctgcgtagcaggtccgcaaggt

SEQ ID NO: 636656 - DNA, 25 bp, Rattus norvegicus
tcatgagcgcatctggccgagggtt

SEQ ID NO: 636657 - DNA, 25 bp, Rattus norvegicus
ccttcatgagcgcatctggccgagg

SEQ ID NO: 636658 - DNA, 25 bp, Rattus norvegicus
atctccactagttgctccttcatga

SEQ ID NO: 636659 - DNA, 25 bp, Rattus norvegicus
gtccgtgagcaagcaaagccactcc

SEQ ID NO: 636660 - DNA, 25 bp, Rattus norvegicus
tgaggccggtcatctccactagttg

SEQ ID NO: 636661 - DNA, 25 bp, Rattus norvegicus
actcggggactgaggccggtcatct

SEQ ID NO: 636662 - DNA, 25 bp, Rattus norvegicus
gtcttctcgggctgtttgtggacgt

SEQ ID NO: 636663 - DNA, 25 bp, Rattus norvegicus
ctccgcagagagtgctttccctggg

SEQ ID NO: 636664 - DNA, 25 bp, Rattus norvegicus
ccgcagagagtgctttccctgggac

SEQ ID NO: 636665 - DNA, 25 bp, Rattus norvegicus
agagtgctttccctgggaccggctc

SEQ ID NO: 636666 - DNA, 25 bp, Rattus norvegicus
cgcagagagtgctttccctgggact

SEQ ID NO: 636667 - DNA, 25 bp, Rattus norvegicus
gagcagcaccggctccgcagagagt

SEQ ID NO: 636668 - DNA, 25 bp, Rattus norvegicus
accggctccgcagagagtgctttcc

SEQ ID NO: 636669 - DNA, 25 bp, Rattus norvegicus
gctccgcagagagtgctttccctgg

SEQ ID NO: 636670 - DNA, 25 bp, Rattus norvegicus
agtgctttccctgggaccggctccg

SEQ ID NO: 636671 - DNA, 25 bp, Rattus norvegicus
gaccggctccgcagagagtgctttc

SEQ ID NO: 636672 - DNA, 25 bp, Rattus norvegicus
agagagtgctttccctgggaccggc

SEQ ID NO: 636673 - DNA, 25 bp, Rattus norvegicus
ggaccggctccgcagagagtgcttt

SEQ ID NO: 636674 - DNA, 25 bp, Rattus norvegicus
cgcagagagtgctttccctgggacc

SEQ ID NO: 636675 - DNA, 25 bp, Rattus norvegicus
gagtgctttccctgggaccggctcc

SEQ ID NO: 636676 - DNA, 25 bp, Rattus norvegicus
caccggctccgcagagagtgctttc

SEQ ID NO: 636677 - DNA, 25 bp, Rattus norvegicus
aagggtgcatctcctggagctagca

SEQ ID NO: 636678 - DNA, 25 bp, Rattus norvegicus
atcgccattggtctgacgcagcgcg

SEQ ID NO: 636679 - DNA, 25 bp, Rattus norvegicus
ctcgcggatctaggagtccgattta

SEQ ID NO: 636680 - DNA, 25 bp, Rattus norvegicus
agtccgatttaagccggcggagttg

SEQ ID NO: 636681 - DNA, 25 bp, Rattus norvegicus
gggcacctctcttccttatctctta

SEQ ID NO: 636682 - DNA, 25 bp, Rattus norvegicus
actcagctccatcgccattggtctg

SEQ ID NO: 636683 - DNA, 25 bp, Rattus norvegicus
cgcggcgcagctgttctgattatca

SEQ ID NO: 636684 - DNA, 25 bp, Rattus norvegicus
agcccgcaggagaggattaagcctc

SEQ ID NO: 636685 - DNA, 25 bp, Rattus norvegicus
gaggattaagcctcccgaggccaca

SEQ ID NO: 636686 - DNA, 25 bp, Rattus norvegicus
cggtcctctgactgcgctgagctag

SEQ ID NO: 636687 - DNA, 25 bp, Rattus norvegicus
ccttttctgcctccgatggcgagta

SEQ ID NO: 636688 - DNA, 25 bp, Rattus norvegicus
ctggtgggtaggttcttcctgtgaa

SEQ ID NO: 636689 - DNA, 25 bp, Rattus norvegicus
ggccaacttcgctgcctgcgggaag

SEQ ID NO: 636690 - DNA, 25 bp, Rattus norvegicus
tgtgaaccggatccttcccgggctc

SEQ ID NO: 636691 - DNA, 25 bp, Rattus norvegicus
tgaaagcgcgctttctcaatttcca

SEQ ID NO: 636692 - DNA, 25 bp, Rattus norvegicus
cgatgcacaaatgaaagcgcgcttt

SEQ ID NO: 636693 - DNA, 25 bp, Rattus norvegicus
agctctaaatgtagagaaacgcgca

SEQ ID NO: 636694 - DNA, 25 bp, Rattus norvegicus
gaaacgcgcaattatcctgggacca

SEQ ID NO: 636695 - DNA, 25 bp, Rattus norvegicus
atcctgggaccagatggagagagca

SEQ ID NO: 636696 - DNA, 25 bp, Rattus norvegicus
agttaaaggcaatcgggtctctgtt

SEQ ID NO: 636697 - DNA, 25 bp, Rattus norvegicus
tctctgttggagaaaagctggcgct

SEQ ID NO: 636698 - DNA, 25 bp, Rattus norvegicus
ggctgaacttccagaggccgcctga

SEQ ID NO: 636699 - DNA, 25 bp, Rattus norvegicus
tgagcatcaggagggaacccggcct

SEQ ID NO: 636700 - DNA, 25 bp, Rattus norvegicus
ggaacccggccttgcaagtgcgcca

SEQ ID NO: 636701 - DNA, 25 bp, Rattus norvegicus
aagtgcgccactgcgctcagcattc

SEQ ID NO: 636702 - DNA, 25 bp, Rattus norvegicus
tcagcattccgagctgcgtggtccc

SEQ ID NO: 636703 - DNA, 25 bp, Rattus norvegicus
cccgcaggcgtccaaggaaaggcac

SEQ ID NO: 636704 - DNA, 25 bp, Rattus norvegicus
gggctgtcggcagacgatgcacaaa

SEQ ID NO: 636705 - DNA, 25 bp, Rattus norvegicus
gctcgccgctgctggattccaattt

SEQ ID NO: 636706 - DNA, 25 bp, Rattus norvegicus
gctgtttccaaatgcacccggaacg

SEQ ID NO: 636707 - DNA, 25 bp, Rattus norvegicus
gctcatgccgctgcagctgtttcca

SEQ ID NO: 636708 - DNA, 25 bp, Rattus norvegicus
caccaccgatggctggaatccagcg

SEQ ID NO: 636709 - DNA, 25 bp, Rattus norvegicus
cgggctttagcctgctctgttcagc

SEQ ID NO: 636710 - DNA, 25 bp, Rattus norvegicus
ggtgatgacaccgagtctcactttc

SEQ ID NO: 636711 - DNA, 25 bp, Rattus norvegicus
ggattccaatttcctcccgttctga

SEQ ID NO: 636712 - DNA, 25 bp, Rattus norvegicus
ggtcggctttgcattcccagatgtg

SEQ ID NO: 636713 - DNA, 25 bp, Rattus norvegicus
ctgctctggacttcttggatcacga

SEQ ID NO: 636714 - DNA, 25 bp, Rattus norvegicus
acaggcagtctttctctgctctgga

SEQ ID NO: 636715 - DNA, 25 bp, Rattus norvegicus
ccaggatccgagaggcaagaactca

SEQ ID NO: 636716 - DNA, 25 bp, Rattus norvegicus
acacgcgtctcggtcagaaatctgg

SEQ ID NO: 636717 - DNA, 25 bp, Rattus norvegicus
gagactggctccaggtcccaggatc

SEQ ID NO: 636718 - DNA, 25 bp, Rattus norvegicus
cccgttctgacaatggatggtgatg

SEQ ID NO: 636719 - DNA, 25 bp, Rattus norvegicus
aaacggagaccgatcgcagcaggct

SEQ ID NO: 636720 - DNA, 25 bp, Rattus norvegicus
cataattgatggagggttggcgcaa

SEQ ID NO: 636721 - DNA, 25 bp, Rattus norvegicus
agccgaggtggcctttcattggctg

SEQ ID NO: 636722 - DNA, 25 bp, Rattus norvegicus
actctgctttttctcgcgcgtcctg

SEQ ID NO: 636723 - DNA, 25 bp, Rattus norvegicus
gcccggttaccagcaagtgtacata

SEQ ID NO: 636724 - DNA, 25 bp, Rattus norvegicus
ccggggttgcacagcacatccgggc

SEQ ID NO: 636725 - DNA, 25 bp, Rattus norvegicus
tgtacatagggacaaacggagaccg

SEQ ID NO: 636726 - DNA, 25 bp, Rattus norvegicus
gtgcagtaacgacctcctggaccga

SEQ ID NO: 636727 - DNA, 25 bp, Rattus norvegicus
ctcgcacactggcttgagggcgctt

SEQ ID NO: 636728 - DNA, 25 bp, Rattus norvegicus
ggttgctcgctcctccttctatatc

SEQ ID NO: 636729 - DNA, 25 bp, Rattus norvegicus
ttctatatcttctggcggcgacgcg

SEQ ID NO: 636730 - DNA, 25 bp, Rattus norvegicus
cgatcccgcaggtgcctggggttca

SEQ ID NO: 636731 - DNA, 25 bp, Rattus norvegicus
tggcggcgatcctccagccggacga

SEQ ID NO: 636732 - DNA, 25 bp, Rattus norvegicus
ctttcattggctgggcgcaggttac

SEQ ID NO: 636733 - DNA, 25 bp, Rattus norvegicus
ctccgtgtgcttcaaggtggacggc

SEQ ID NO: 636734 - DNA, 25 bp, Rattus norvegicus
ggcgagtctggagccctcgccgtcg

SEQ ID NO: 636735 - DNA, 25 bp, Rattus norvegicus
cggcaactccgtgtgcttcaaggtg

SEQ ID NO: 636736 - DNA, 25 bp, Rattus norvegicus
cgggaaggaacacggcaactccgtg

SEQ ID NO: 636737 - DNA, 25 bp, Rattus norvegicus
ggcggccgacaagcgcctggggacc

SEQ ID NO: 636738 - DNA, 25 bp, Rattus norvegicus
caactccgtgtgcttcaaggtggac

SEQ ID NO: 636739 - DNA, 25 bp, Rattus norvegicus
tggcaacagcgtttacccctccaag

SEQ ID NO: 636740 - DNA, 25 bp, Rattus norvegicus
gcgacgatggcaacagcgtttaccc

SEQ ID NO: 636741 - DNA, 25 bp, Rattus norvegicus
agccgcgacgatggcaacagcgttt

SEQ ID NO: 636742 - DNA, 25 bp, Rattus norvegicus
tccaacagccgcgacgatggcaaca

SEQ ID NO: 636743 - DNA, 25 bp, Rattus norvegicus
agcccaactccgcttccaacagccg

SEQ ID NO: 636744 - DNA, 25 bp, Rattus norvegicus
ccggtcgcgtccttcgggcatggaa

SEQ ID NO: 636745 - DNA, 25 bp, Rattus norvegicus
cagcttcgaggatgccgaggggccc

SEQ ID NO: 636746 - DNA, 25 bp, Rattus norvegicus
gaaggcggcggcaagcccaactccg

SEQ ID NO: 636747 - DNA, 25 bp, Rattus norvegicus
ctggtaccagcggtcggcattcaag

SEQ ID NO: 636748 - DNA, 25 bp, Rattus norvegicus
ggacgccttagcagcggcattctga

SEQ ID NO: 636749 - DNA, 25 bp, Rattus norvegicus
gaattgttcctgttcgcctgccgta

SEQ ID NO: 636750 - DNA, 25 bp, Rattus norvegicus
ttcgtatcttctcgtccactgacgg

SEQ ID NO: 636751 - DNA, 25 bp, Rattus norvegicus
caccttggtgaggattcgtatcttc

SEQ ID NO: 636752 - DNA, 25 bp, Rattus norvegicus
ctgaggatggactacgtacttcttg

SEQ ID NO: 636753 - DNA, 25 bp, Rattus norvegicus
acacggtcttggtgaagccctggta

SEQ ID NO: 636754 - DNA, 25 bp, Rattus norvegicus
gcgggcggcagacccgatacaaaca

SEQ ID NO: 636755 - DNA, 25 bp, Rattus norvegicus
ggcgccgcacatagacatgctcctg

SEQ ID NO: 636756 - DNA, 25 bp, Rattus norvegicus
gtacttcttgaactgcaccttggtg

SEQ ID NO: 636757 - DNA, 25 bp, Rattus norvegicus
acccggaacttgaggtcaactgtca

SEQ ID NO: 636758 - DNA, 25 bp, Rattus norvegicus
catggaagctacgatcggcgggtac

SEQ ID NO: 636759 - DNA, 25 bp, Rattus norvegicus
gcctgccgtagagaccaatcgcttc

SEQ ID NO: 636760 - DNA, 25 bp, Rattus norvegicus
gcggggcaccagcttccaatacctg

SEQ ID NO: 636761 - DNA, 25 bp, Rattus norvegicus
gcgcactcctctggcccaggctccc

SEQ ID NO: 636762 - DNA, 25 bp, Rattus norvegicus
cggagggcagcaaaattcggaaagc

SEQ ID NO: 636763 - DNA, 25 bp, Rattus norvegicus
gcaaaattcggaaagcacgcggaca

SEQ ID NO: 636764 - DNA, 25 bp, Rattus norvegicus
attcggaaagcacgcggacagctcg

SEQ ID NO: 636765 - DNA, 25 bp, Rattus norvegicus
aaagcacgcggacagctcgcgctgg

SEQ ID NO: 636766 - DNA, 25 bp, Rattus norvegicus
acagctcgcgctggtggccagcgct

SEQ ID NO: 636767 - DNA, 25 bp, Rattus norvegicus
gccagcgctgcgagcacaggacgct

SEQ ID NO: 636768 - DNA, 25 bp, Rattus norvegicus
agcacaggacgctggagccgcaatt

SEQ ID NO: 636769 - DNA, 25 bp, Rattus norvegicus
caggacgctggagccgcaattagca

SEQ ID NO: 636770 - DNA, 25 bp, Rattus norvegicus
tggagccgcaattagcaggagctgc

SEQ ID NO: 636771 - DNA, 25 bp, Rattus norvegicus
gcaattagcaggagctgcaggctgc

SEQ ID NO: 636772 - DNA, 25 bp, Rattus norvegicus
cagctcagagcaaaggcatcgcgca

SEQ ID NO: 636773 - DNA, 25 bp, Rattus norvegicus
gagcaaaggcatcgcgcactcctct

SEQ ID NO: 636774 - DNA, 25 bp, Rattus norvegicus
tcagagcaaaggcatcgcgcactcc

SEQ ID NO: 636775 - DNA, 25 bp, Rattus norvegicus
ctcacctggacaggcaggcgggaca

SEQ ID NO: 636776 - DNA, 25 bp, Rattus norvegicus
gtcggttggctcacctggacaggca

SEQ ID NO: 636777 - DNA, 25 bp, Rattus norvegicus
gagcaaacgccacgccgcgttggca

SEQ ID NO: 636778 - DNA, 25 bp, Rattus norvegicus
acgccgcgttggcagacccgggctt

SEQ ID NO: 636779 - DNA, 25 bp, Rattus norvegicus
gctgtgcctccaacccggaagaaca

SEQ ID NO: 636780 - DNA, 25 bp, Rattus norvegicus
gacgaccacgtgacacagcactgct

SEQ ID NO: 636781 - DNA, 25 bp, Rattus norvegicus
tgacacagcactgctcagacccaga

SEQ ID NO: 636782 - DNA, 25 bp, Rattus norvegicus
cgcccgatcgccagtgtgcaaaaga

SEQ ID NO: 636783 - DNA, 25 bp, Rattus norvegicus
tgcaaaagagaaagcgactccacca

SEQ ID NO: 636784 - DNA, 25 bp, Rattus norvegicus
aagcgactccaccaatgcaacctta

SEQ ID NO: 636785 - DNA, 25 bp, Rattus norvegicus
tgcaaccttacagcgcagcagctgg

SEQ ID NO: 636786 - DNA, 25 bp, Rattus norvegicus
agcgcagcagctggtccgagacaaa

SEQ ID NO: 636787 - DNA, 25 bp, Rattus norvegicus
gctggtccgagacaaagggtccttc

SEQ ID NO: 636788 - DNA, 25 bp, Rattus norvegicus
cgagacaaagggtccttcctctccg

SEQ ID NO: 636789 - DNA, 25 bp, Rattus norvegicus
gggcctcgagttcgccatgaaggaa

SEQ ID NO: 636790 - DNA, 25 bp, Rattus norvegicus
ccaataatctgggttctaggaaata

SEQ ID NO: 636791 - DNA, 25 bp, Rattus norvegicus
ctacttccgggtggttgtcagtgac

SEQ ID NO: 636792 - DNA, 25 bp, Rattus norvegicus
ctgagctgtggactgctggattcta

SEQ ID NO: 636793 - DNA, 25 bp, Rattus norvegicus
ctggattctagccagcgcgtgaggc

SEQ ID NO: 636794 - DNA, 25 bp, Rattus norvegicus
caggatccgcgccacagagagaaac

SEQ ID NO: 636795 - DNA, 25 bp, Rattus norvegicus
gaggcgctttaccttcccggctgaa

SEQ ID NO: 636796 - DNA, 25 bp, Rattus norvegicus
ccagctaggatgtcagaggcgctgc

SEQ ID NO: 636797 - DNA, 25 bp, Rattus norvegicus
tcaccagggacctgtctgcgggatc

SEQ ID NO: 636798 - DNA, 25 bp, Rattus norvegicus
tagggcgaagactaccacggtagta

SEQ ID NO: 636799 - DNA, 25 bp, Rattus norvegicus
taaatggcgtcttccgagctgaggc

SEQ ID NO: 636800 - DNA, 25 bp, Rattus norvegicus
ttcagggctgttttcttcgtgtggc

SEQ ID NO: 636801 - DNA, 25 bp, Rattus norvegicus
cacggtagtactcacagctccaata

SEQ ID NO: 636802 - DNA, 25 bp, Rattus norvegicus
cgctgcccgagaacgtggtaaatgg

SEQ ID NO: 636803 - DNA, 25 bp, Rattus norvegicus
atccgcgaacgcgagcgaccgtcgc

SEQ ID NO: 636804 - DNA, 25 bp, Rattus norvegicus
ggcctcctccatgaggcctgagtga

SEQ ID NO: 636805 - DNA, 25 bp, Rattus norvegicus
taagggagagcgtccgccagccgaa

SEQ ID NO: 636806 - DNA, 25 bp, Rattus norvegicus
tgcggagcggtcgcagcaccagcca

SEQ ID NO: 636807 - DNA, 25 bp, Rattus norvegicus
gcttaagggagagcgtccgccagcc

SEQ ID NO: 636808 - DNA, 25 bp, Rattus norvegicus
ctccatgaggcctgagtgaggcaca

SEQ ID NO: 636809 - DNA, 25 bp, Rattus norvegicus
cgcgcgtcctattcggagcagcggc

SEQ ID NO: 636810 - DNA, 25 bp, Rattus norvegicus
cccgttggagagcaaggagcatgtc

SEQ ID NO: 636811 - DNA, 25 bp, Rattus norvegicus
agagcaaggagcatgtcggacagtt

SEQ ID NO: 636812 - DNA, 25 bp, Rattus norvegicus
aggagcatgtcggacagtttcgatc

SEQ ID NO: 636813 - DNA, 25 bp, Rattus norvegicus
gtcggacagtttcgatcgggctcca

SEQ ID NO: 636814 - DNA, 25 bp, Rattus norvegicus
ggacagtttcgatcgggctccaggt

SEQ ID NO: 636815 - DNA, 25 bp, Rattus norvegicus
ttcgatcgggctccaggtgctggtc

SEQ ID NO: 636816 - DNA, 25 bp, Rattus norvegicus
tggcccggacgtcgctcgtccaagc

SEQ ID NO: 636817 - DNA, 25 bp, Rattus norvegicus
gcgtctgctctctccagctcatgcc

SEQ ID NO: 636818 - DNA, 25 bp, Rattus norvegicus
cacacagagtgctcggttggctgca

SEQ ID NO: 636819 - DNA, 25 bp, Rattus norvegicus
ggcagcgcacacagagtgctcggtt

SEQ ID NO: 636820 - DNA, 25 bp, Rattus norvegicus
actgcggcagcgcacacagagtgct

SEQ ID NO: 636821 - DNA, 25 bp, Rattus norvegicus
ccgggactgcggcagcgcacacaga

SEQ ID NO: 636822 - DNA, 25 bp, Rattus norvegicus
cgtccgcgcgtccttagaagccagt

SEQ ID NO: 636823 - DNA, 25 bp, Rattus norvegicus
agctcatgccctttggagccgcgcg

SEQ ID NO: 636824 - DNA, 25 bp, Rattus norvegicus
cgcgcgtccttagaagccagtggct

SEQ ID NO: 636825 - DNA, 25 bp, Rattus norvegicus
gggtctgcgcgtctgctctctccag

SEQ ID NO: 636826 - DNA, 25 bp, Rattus norvegicus
tccagttctcctcggcagtgggatc

SEQ ID NO: 636827 - DNA, 25 bp, Rattus norvegicus
gcagtccagttctcctcggcagtgg

SEQ ID NO: 636828 - DNA, 25 bp, Rattus norvegicus
aggcggccgcatcccaggctaggcg

SEQ ID NO: 636829 - DNA, 25 bp, Rattus norvegicus
ctcagacgggtggtgtcgcctgtgt

SEQ ID NO: 636830 - DNA, 25 bp, Rattus norvegicus
gcgtccttagaagccagtggctgga

SEQ ID NO: 636831 - DNA, 25 bp, Rattus norvegicus
cgcactaagcaaagaaaccgacagg

SEQ ID NO: 636832 - DNA, 25 bp, Rattus norvegicus
tcgtctctctatggtgcggccaagg

SEQ ID NO: 636833 - DNA, 25 bp, Rattus norvegicus
gagacaggctcacggtcgataagga

SEQ ID NO: 636834 - DNA, 25 bp, Rattus norvegicus
ctcaagtcctgggtcagggctgaga

SEQ ID NO: 636835 - DNA, 25 bp, Rattus norvegicus
agggtgcggcgaagcctcaagtcct

SEQ ID NO: 636836 - DNA, 25 bp, Rattus norvegicus
accgatggaccgtggtgcgtccaga

SEQ ID NO: 636837 - DNA, 25 bp, Rattus norvegicus
tgggaaagactgagctgcagcaagc

SEQ ID NO: 636838 - DNA, 25 bp, Rattus norvegicus
agccagcactcgtctctctatggtg

SEQ ID NO: 636839 - DNA, 25 bp, Rattus norvegicus
agaggatcccgcgtctttgcgtctg

SEQ ID NO: 636840 - DNA, 25 bp, Rattus norvegicus
aggaccagcgctgcttcgagaggat

SEQ ID NO: 636841 - DNA, 25 bp, Rattus norvegicus
agccatcagctcatccggtgaagga

SEQ ID NO: 636842 - DNA, 25 bp, Rattus norvegicus
accgacaggacattttccacctttg

SEQ ID NO: 636843 - DNA, 25 bp, Rattus norvegicus
taggtgattcgatgcgcactaagca

SEQ ID NO: 636844 - DNA, 25 bp, Rattus norvegicus
gcgggtagaactcacagcagccatc

SEQ ID NO: 636845 - DNA, 25 bp, Rattus norvegicus
agtaacgagcggcaccgttcctagt

SEQ ID NO: 636846 - DNA, 25 bp, Rattus norvegicus
agtttacgaagctgctactgccctc

SEQ ID NO: 636847 - DNA, 25 bp, Rattus norvegicus
caacgtgtgtgggtcgtgcagaata

SEQ ID NO: 636848 - DNA, 25 bp, Rattus norvegicus
actcctgggtagctctgcggctgct

SEQ ID NO: 636849 - DNA, 25 bp, Rattus norvegicus
gcacgacagacagccgtaaagcgtc

SEQ ID NO: 636850 - DNA, 25 bp, Rattus norvegicus
aacctgagcagcacgacagaggtga

SEQ ID NO: 636851 - DNA, 25 bp, Rattus norvegicus
ttcagctctgagtttacgaagctgc

SEQ ID NO: 636852 - DNA, 25 bp, Rattus norvegicus
tccgactgtcctgtcctctgggttt

SEQ ID NO: 636853 - DNA, 25 bp, Rattus norvegicus
tcctagttgctgacatccgactgtc

SEQ ID NO: 636854 - DNA, 25 bp, Rattus norvegicus
gcggcaccgttcctagttgctgaca

SEQ ID NO: 636855 - DNA, 25 bp, Rattus norvegicus
tgcggctgctttgcgcgggcttccc

SEQ ID NO: 636856 - DNA, 25 bp, Rattus norvegicus
caccttagagccactcctgggtagc

SEQ ID NO: 636857 - DNA, 25 bp, Rattus norvegicus
atgggagtgcacgtgcgcatctcca

SEQ ID NO: 636858 - DNA, 25 bp, Rattus norvegicus
cgacagaggtgaagccagcacgaca

SEQ ID NO: 636859 - DNA, 25 bp, Rattus norvegicus
gggcactgccgagcgactctgagtc

SEQ ID NO: 636860 - DNA, 25 bp, Rattus norvegicus
gcgggaggcacagtctactgtcctc

SEQ ID NO: 636861 - DNA, 25 bp, Rattus norvegicus
actaggccggaaggcactgcgctct

SEQ ID NO: 636862 - DNA, 25 bp, Rattus norvegicus
aggcagtgtccttgactaggccgga

SEQ ID NO: 636863 - DNA, 25 bp, Rattus norvegicus
tctactcccagggtccgatcgcgtt

SEQ ID NO: 636864 - DNA, 25 bp, Rattus norvegicus
tttgctccgttctactcccagggtc

SEQ ID NO: 636865 - DNA, 25 bp, Rattus norvegicus
attggtccctagctcctctcactga

SEQ ID NO: 636866 - DNA, 25 bp, Rattus norvegicus
ttttcctcccattggcagagagtgg

SEQ ID NO: 636867 - DNA, 25 bp, Rattus norvegicus
cagcgagggaaaaccctagcgagtc

SEQ ID NO: 636868 - DNA, 25 bp, Rattus norvegicus
tcccgtcattggcaggcttgttctc

SEQ ID NO: 636869 - DNA, 25 bp, Rattus norvegicus
ccttcaattggtcggagaacctctc

SEQ ID NO: 636870 - DNA, 25 bp, Rattus norvegicus
gctcctctcactgaccttcaattgg

SEQ ID NO: 636871 - DNA, 25 bp, Rattus norvegicus
ctgagtccggtgattggctgagata

SEQ ID NO: 636872 - DNA, 25 bp, Rattus norvegicus
agatagctgctgtcctgccctctgt

SEQ ID NO: 636873 - DNA, 25 bp, Rattus norvegicus
tgggcagcagacctgacccacaggg

SEQ ID NO: 636874 - DNA, 25 bp, Rattus norvegicus
caaggcacgcagagtggcaggcact

SEQ ID NO: 636875 - DNA, 25 bp, Rattus norvegicus
acgcagagtggcaggcactggcaca

SEQ ID NO: 636876 - DNA, 25 bp, Rattus norvegicus
actggcacaggctcgtgagtgtctt

SEQ ID NO: 636877 - DNA, 25 bp, Rattus norvegicus
gcgcagacgtctgggtcgttcctat

SEQ ID NO: 636878 - DNA, 25 bp, Rattus norvegicus
tgggtcgttcctatggctctgctaa

SEQ ID NO: 636879 - DNA, 25 bp, Rattus norvegicus
tcctatggctctgctaactggggtg

SEQ ID NO: 636880 - DNA, 25 bp, Rattus norvegicus
gtctgcttctggctccgccaccaga

SEQ ID NO: 636881 - DNA, 25 bp, Rattus norvegicus
cgagtgcctcgcagcgtcctaaaca

SEQ ID NO: 636882 - DNA, 25 bp, Rattus norvegicus
cgcagcgtcctaaacaggaccaatc

SEQ ID NO: 636883 - DNA, 25 bp, Rattus norvegicus
aaaggagactggatggtcaccgcga

SEQ ID NO: 636884 - DNA, 25 bp, Rattus norvegicus
atggtcaccgcgacgcgaaaccggc

SEQ ID NO: 636885 - DNA, 25 bp, Rattus norvegicus
agccctgcttacctcggtccggagg

SEQ ID NO: 636886 - DNA, 25 bp, Rattus norvegicus
accagagccgagtgcctcgcagcgt

SEQ ID NO: 636887 - DNA, 25 bp, Rattus norvegicus
tcctagaaaactggctcggcagccg

SEQ ID NO: 636888 - DNA, 25 bp, Rattus norvegicus
ggcagcacgtgtctacggattcaga

SEQ ID NO: 636889 - DNA, 25 bp, Rattus norvegicus
aaggtccgccctacggtggcagcac

SEQ ID NO: 636890 - DNA, 25 bp, Rattus norvegicus
aggtgctccggtacccaggcagctc

SEQ ID NO: 636891 - DNA, 25 bp, Rattus norvegicus
ccggcactcactcagggaaggagga

SEQ ID NO: 636892 - DNA, 25 bp, Rattus norvegicus
tcggcagccggagaagcttatattc

SEQ ID NO: 636893 - DNA, 25 bp, Rattus norvegicus
ccgaccgcgaactcctagaaaactg

SEQ ID NO: 636894 - DNA, 25 bp, Rattus norvegicus
gctttagctgcacttccgaccgcga

SEQ ID NO: 636895 - DNA, 25 bp, Rattus norvegicus
gggcagtctcagcactggaaaaact

SEQ ID NO: 636896 - DNA, 25 bp, Rattus norvegicus
ggctgctgcagcttctctcgataga

SEQ ID NO: 636897 - DNA, 25 bp, Rattus norvegicus
acttacgtcgacgtgctgcgtcacc

SEQ ID NO: 636898 - DNA, 25 bp, Rattus norvegicus
ggcctgcgcgtcacttacgtcgacg

SEQ ID NO: 636899 - DNA, 25 bp, Rattus norvegicus
ttctctcgatagagcagggcagtct

SEQ ID NO: 636900 - DNA, 25 bp, Rattus norvegicus
acctagctggcttcggctccacgtg

SEQ ID NO: 636901 - DNA, 25 bp, Rattus norvegicus
acgcacaggcttcgaatatttgttc

SEQ ID NO: 636902 - DNA, 25 bp, Rattus norvegicus
gctcagcggactacaggcgaaatca

SEQ ID NO: 636903 - DNA, 25 bp, Rattus norvegicus
aaatcagccctgatttcaaaccgct

SEQ ID NO: 636904 - DNA, 25 bp, Rattus norvegicus
tttgttccttggtgatttccttctg

SEQ ID NO: 636905 - DNA, 25 bp, Rattus norvegicus
cttggtgatttccttctgctgcacg

SEQ ID NO: 636906 - DNA, 25 bp, Rattus norvegicus
cttctgctgcacgaatcaggctcca

SEQ ID NO: 636907 - DNA, 25 bp, Rattus norvegicus
gaaaaatttctcagttcatccgacc

SEQ ID NO: 636908 - DNA, 25 bp, Rattus norvegicus
ggctccaacgcacaggcttcgaata

SEQ ID NO: 636909 - DNA, 25 bp, Rattus norvegicus
ttgttcgatttctttcgttcaccga

SEQ ID NO: 636910 - DNA, 25 bp, Rattus norvegicus
ctttcgttcaccgatttcactggga

SEQ ID NO: 636911 - DNA, 25 bp, Rattus norvegicus
ctacaggcgaaatcagccctgattt

SEQ ID NO: 636912 - DNA, 25 bp, Rattus norvegicus
caccgatttcactgggaggttcgtc

SEQ ID NO: 636913 - DNA, 25 bp, Rattus norvegicus
tttcactgggaggttcgtcatgcgt

SEQ ID NO: 636914 - DNA, 25 bp, Rattus norvegicus
atcaggctccaacgcacaggcttcg

SEQ ID NO: 636915 - DNA, 25 bp, Rattus norvegicus
ctgaactttactgatgactgactgc

SEQ ID NO: 636916 - DNA, 25 bp, Rattus norvegicus
tgcacgaatccactttacaggtgta

SEQ ID NO: 636917 - DNA, 25 bp, Rattus norvegicus
cggcattggccaattaactgaatta

SEQ ID NO: 636918 - DNA, 25 bp, Rattus norvegicus
actgtgactttgctggacggaactc

SEQ ID NO: 636919 - DNA, 25 bp, Rattus norvegicus
tggaaaagttcccttgctgaaactg

SEQ ID NO: 636920 - DNA, 25 bp, Rattus norvegicus
ttgcacggaccagaaaggcgacttc

SEQ ID NO: 636921 - DNA, 25 bp, Rattus norvegicus
ctggaagcctatgttcgtcttggtc

SEQ ID NO: 636922 - DNA, 25 bp, Rattus norvegicus
gcacgaattcggctttggactctta

SEQ ID NO: 636923 - DNA, 25 bp, Rattus norvegicus
agccaacggcacgaaatcggttttg

SEQ ID NO: 636924 - DNA, 25 bp, Rattus norvegicus
cggaactccgaatgaaaccgtagct

SEQ ID NO: 636925 - DNA, 25 bp, Rattus norvegicus
taccaggagaagcagaccgttgacg

SEQ ID NO: 636926 - DNA, 25 bp, Rattus norvegicus
tcacgcaatccggaatgctgggctc

SEQ ID NO: 636927 - DNA, 25 bp, Rattus norvegicus
tgcccaactgcacgaaatccgctta

SEQ ID NO: 636928 - DNA, 25 bp, Rattus norvegicus
ctaggacaaactgcacgaaatcggc

SEQ ID NO: 636929 - DNA, 25 bp, Rattus norvegicus
cacagtttcagcaagggaacttttc

SEQ ID NO: 636930 - DNA, 25 bp, Rattus norvegicus
gagcccagcattccggattgcgtga

SEQ ID NO: 636931 - DNA, 25 bp, Rattus norvegicus
gggaatctacgcacggaccgcttct

SEQ ID NO: 636932 - DNA, 25 bp, Rattus norvegicus
gcttccagtttggatgggtgacttc

SEQ ID NO: 636933 - DNA, 25 bp, Rattus norvegicus
aagtcgcctttctggtccgtgcaag

SEQ ID NO: 636934 - DNA, 25 bp, Rattus norvegicus
ttccgtccagcaaagtcacagtttc

SEQ ID NO: 636935 - DNA, 25 bp, Rattus norvegicus
agctacggtttcattcggagttccg

SEQ ID NO: 636936 - DNA, 25 bp, Rattus norvegicus
gccgatttcgtgcagtttgtcctag

SEQ ID NO: 636937 - DNA, 25 bp, Rattus norvegicus
aaccgatttcgtgccgttggctgtc

SEQ ID NO: 636938 - DNA, 25 bp, Rattus norvegicus
gccgaattcgtgcagtcagtcatca

SEQ ID NO: 636939 - DNA, 25 bp, Rattus norvegicus
cggatttcgtgcagttgggcatcaa

SEQ ID NO: 636940 - DNA, 25 bp, Rattus norvegicus
cggtctgcttctcctggtattttta

SEQ ID NO: 636941 - DNA, 25 bp, Rattus norvegicus
tacgtgtccaaaaccgatttcgtgc

SEQ ID NO: 636942 - DNA, 25 bp, Rattus norvegicus
gtgaccaagacgaacataggcttcc

SEQ ID NO: 636943 - DNA, 25 bp, Rattus norvegicus
agctcttcgcttctaccgggtcctt

SEQ ID NO: 636944 - DNA, 25 bp, Rattus norvegicus
ggtggatgaggaacagtcagagaaa

SEQ ID NO: 636945 - DNA, 25 bp, Rattus norvegicus
gcaggcctgggattctgtccctctg

SEQ ID NO: 636946 - DNA, 25 bp, Rattus norvegicus
aggcctgggattctgtccctctgga

SEQ ID NO: 636947 - DNA, 25 bp, Rattus norvegicus
cctgggattctgtccctctggagca

SEQ ID NO: 636948 - DNA, 25 bp, Rattus norvegicus
gggattctgtccctctggagcaaga

SEQ ID NO: 636949 - DNA, 25 bp, Rattus norvegicus
gattctgtccctctggagcaagacg

SEQ ID NO: 636950 - DNA, 25 bp, Rattus norvegicus
ttctgtccctctggagcaagacgcc

SEQ ID NO: 636951 - DNA, 25 bp, Rattus norvegicus
gcttctcggaagacagccatccctg

SEQ ID NO: 636952 - DNA, 25 bp, Rattus norvegicus
ctgagctcttcgcttctaccgggtc

SEQ ID NO: 636953 - DNA, 25 bp, Rattus norvegicus
tcttcgcttctaccgggtccttggc

SEQ ID NO: 636954 - DNA, 25 bp, Rattus norvegicus
cgcttctaccgggtccttggcctgt

SEQ ID NO: 636955 - DNA, 25 bp, Rattus norvegicus
gagtgaggtggatgaggaacagtca

SEQ ID NO: 636956 - DNA, 25 bp, Rattus norvegicus
tctcggaagacagccatccctgagc

SEQ ID NO: 636957 - DNA, 25 bp, Rattus norvegicus
gggatcatcagcacagcgaacgtgc

SEQ ID NO: 636958 - DNA, 25 bp, Rattus norvegicus
ttccgcagggatcatcagcacagcg

SEQ ID NO: 636959 - DNA, 25 bp, Rattus norvegicus
tccgcagggatcatcagcacagcga

SEQ ID NO: 636960 - DNA, 25 bp, Rattus norvegicus
ccgcagggatcatcagcacagcgaa

SEQ ID NO: 636961 - DNA, 25 bp, Rattus norvegicus
cgcagggatcatcagcacagcgaac

SEQ ID NO: 636962 - DNA, 25 bp, Rattus norvegicus
gcagggatcatcagcacagcgaacg

SEQ ID NO: 636963 - DNA, 25 bp, Rattus norvegicus
agggatcatcagcacagcgaacgtg

SEQ ID NO: 636964 - DNA, 25 bp, Rattus norvegicus
ggatcatcagcacagcgaacgtgcg

SEQ ID NO: 636965 - DNA, 25 bp, Rattus norvegicus
cagggatcatcagcacagcgaacgt

SEQ ID NO: 636966 - DNA, 25 bp, Rattus norvegicus
gttacctggaatgtagcggcacgca

SEQ ID NO: 636967 - DNA, 25 bp, Rattus norvegicus
gtgctgcagccttctctagcttgga

SEQ ID NO: 636968 - DNA, 25 bp, Rattus norvegicus
ctgcgtgtatcttggtggctgtttc

SEQ ID NO: 636969 - DNA, 25 bp, Rattus norvegicus
tcgcagagcggcaaactgacatcta

SEQ ID NO: 636970 - DNA, 25 bp, Rattus norvegicus
gcggactccttctccttttggctca

SEQ ID NO: 636971 - DNA, 25 bp, Rattus norvegicus
gaaatgtcctacatcccgggccagc

SEQ ID NO: 636972 - DNA, 25 bp, Rattus norvegicus
gggcgctgtctccttgtcagatttc

SEQ ID NO: 636973 - DNA, 25 bp, Rattus norvegicus
atgctgattggctagagtcttctta

SEQ ID NO: 636974 - DNA, 25 bp, Rattus norvegicus
acgcagtccctcgtgttccgtcaga

SEQ ID NO: 636975 - DNA, 25 bp, Rattus norvegicus
gccgtcgggtggataccttttagca

SEQ ID NO: 636976 - DNA, 25 bp, Rattus norvegicus
acgcccaacaggctcgcagagttac

SEQ ID NO: 636977 - DNA, 25 bp, Rattus norvegicus
tgacctccactgcacgtcgaagctg

SEQ ID NO: 636978 - DNA, 25 bp, Rattus norvegicus
ctctgacaacgtgcctggggcctct

SEQ ID NO: 636979 - DNA, 25 bp, Rattus norvegicus
ggaaagcccagcagcgctccagatg

SEQ ID NO: 636980 - DNA, 25 bp, Rattus norvegicus
caaccataaacagtccagggccaga

SEQ ID NO: 636981 - DNA, 25 bp, Rattus norvegicus
gcagcctcatccgtgaacaacgcaa

SEQ ID NO: 636982 - DNA, 25 bp, Rattus norvegicus
ctcatccgtgaacaacgcaacaatg

SEQ ID NO: 636983 - DNA, 25 bp, Rattus norvegicus
gaacaacgcaacaatggccaagatt

SEQ ID NO: 636984 - DNA, 25 bp, Rattus norvegicus
tggccaagattaaggatctggacct

SEQ ID NO: 636985 - DNA, 25 bp, Rattus norvegicus
gctgtgaaacaactggatggtctga

SEQ ID NO: 636986 - DNA, 25 bp, Rattus norvegicus
ccaagcgtgaagagaagccgaagac

SEQ ID NO: 636987 - DNA, 25 bp, Rattus norvegicus
gcgtgaagagaagccgaagaccaag

SEQ ID NO: 636988 - DNA, 25 bp, Rattus norvegicus
gagaagccgaagaccaagaagtagc

SEQ ID NO: 636989 - DNA, 25 bp, Rattus norvegicus
ccaagaagtagcagaaggagcggct

SEQ ID NO: 636990 - DNA, 25 bp, Rattus norvegicus
tcaaggcctgagacggcggcaatga

SEQ ID NO: 636991 - DNA, 25 bp, Rattus norvegicus
ctgagacggcggcaatgacaataaa

SEQ ID NO: 636992 - DNA, 25 bp, Rattus norvegicus
aacctcccaacactctcgaaccagg

SEQ ID NO: 636993 - DNA, 25 bp, Rattus norvegicus
cggcggcaatgacaataaagtccaa

SEQ ID NO: 636994 - DNA, 25 bp, Rattus norvegicus
gagaacctggctccgaagaaccgac

SEQ ID NO: 636995 - DNA, 25 bp, Rattus norvegicus
ctctggagaacctggctccgaagaa

SEQ ID NO: 636996 - DNA, 25 bp, Rattus norvegicus
tgcccgggcatttgccgagggcatt

SEQ ID NO: 636997 - DNA, 25 bp, Rattus norvegicus
cgctgatgatccggaagagccgtga

SEQ ID NO: 636998 - DNA, 25 bp, Rattus norvegicus
gtccgggtttagtccgattctgctg

SEQ ID NO: 636999 - DNA, 25 bp, Rattus norvegicus
cgcacgaaatccgcaaaaaatcgga

SEQ ID NO: 637000 - DNA, 25 bp, Rattus norvegicus
acaccggatcctgggctctcaccga

SEQ ID NO: 637001 - DNA, 25 bp, Rattus norvegicus
tcatggtccgggtttagtccgattc

SEQ ID NO: 637002 - DNA, 25 bp, Rattus norvegicus
ctggtagctgactggaacttgattc

SEQ ID NO: 637003 - DNA, 25 bp, Rattus norvegicus
cgggtttagtccgattctgctggta

SEQ ID NO: 637004 - DNA, 25 bp, Rattus norvegicus
ctgctggtagctgactggaacttga

SEQ ID NO: 637005 - DNA, 25 bp, Rattus norvegicus
ttagtccgattctgctggtagctga

SEQ ID NO: 637006 - DNA, 25 bp, Rattus norvegicus
ccgattctgctggtagctgactgga

SEQ ID NO: 637007 - DNA, 25 bp, Rattus norvegicus
gatcctgggctctcaccgaatccca

SEQ ID NO: 637008 - DNA, 25 bp, Rattus norvegicus
tctgaaacaggactcggactgcatc

SEQ ID NO: 637009 - DNA, 25 bp, Rattus norvegicus
gccacaagtctcagcgtcatgtgtg

SEQ ID NO: 637010 - DNA, 25 bp, Rattus norvegicus
ctcagcgtcatgtgtgtcgtcgcca

SEQ ID NO: 637011 - DNA, 25 bp, Rattus norvegicus
gggcgctctgaaacaggactcggac

SEQ ID NO: 637012 - DNA, 25 bp, Rattus norvegicus
aggactcggactgcatcgccactgt

SEQ ID NO: 637013 - DNA, 25 bp, Rattus norvegicus
gcatcgccactgtgaaaggttcttc

SEQ ID NO: 637014 - DNA, 25 bp, Rattus norvegicus
cgccactgtgaaaggttcttctgca

SEQ ID NO: 637015 - DNA, 25 bp, Rattus norvegicus
tgcagcttccttccgggttcccgga

SEQ ID NO: 637016 - DNA, 25 bp, Rattus norvegicus
ctctggctgttcctccttgttggcg

SEQ ID NO: 637017 - DNA, 25 bp, Rattus norvegicus
ttcctccttgttggcgcgtacggag

SEQ ID NO: 637018 - DNA, 25 bp, Rattus norvegicus
tacggagtcaggaatgctgggctcc

SEQ ID NO: 637019 - DNA, 25 bp, Rattus norvegicus
ctctgaatcccgcaaaggtcggtcc

SEQ ID NO: 637020 - DNA, 25 bp, Rattus norvegicus
ctgaatcccgcaaaggtcggtcccg

SEQ ID NO: 637021 - DNA, 25 bp, Rattus norvegicus
cgtcatgtgtgtcgtcgccacggtg

SEQ ID NO: 637022 - DNA, 25 bp, Rattus norvegicus
aggaataaaatcagggacgctattt

SEQ ID NO: 637023 - DNA, 25 bp, Rattus norvegicus
gagcccggatttaagcacaaaaaga

SEQ ID NO: 637024 - DNA, 25 bp, Rattus norvegicus
tggaggagcccggatttaagcacaa

SEQ ID NO: 637025 - DNA, 25 bp, Rattus norvegicus
ccacctcagtttgcctggaggagcc

SEQ ID NO: 637026 - DNA, 25 bp, Rattus norvegicus
gatgctttaggaaatattgcggggc

SEQ ID NO: 637027 - DNA, 25 bp, Rattus norvegicus
cgaatcccacctcagtttgcctgga

SEQ ID NO: 637028 - DNA, 25 bp, Rattus norvegicus
tcagggacgctatttaaaatcatgg

SEQ ID NO: 637029 - DNA, 25 bp, Rattus norvegicus
aggagagagtgtgcaaaagcaaacc

SEQ ID NO: 637030 - DNA, 25 bp, Rattus norvegicus
gtcctggccgcctgtcagtcacact

SEQ ID NO: 637031 - DNA, 25 bp, Rattus norvegicus
gtgtgcaaaagcaaaccgaaaccgc

SEQ ID NO: 637032 - DNA, 25 bp, Rattus norvegicus
gctttaggaaatattgcggggctta

SEQ ID NO: 637033 - DNA, 25 bp, Rattus norvegicus
tttgccgagggcattccgcacgaaa

SEQ ID NO: 637034 - DNA, 25 bp, Rattus norvegicus
tgccgagggcattccgcacgaaatc

SEQ ID NO: 637035 - DNA, 25 bp, Rattus norvegicus
tgggttaggctgacaccggatcctg

SEQ ID NO: 637036 - DNA, 25 bp, Rattus norvegicus
tggggtcggatgaactgagaaattt

SEQ ID NO: 637037 - DNA, 25 bp, Rattus norvegicus
tcagggctgatttcgcctgtagtcc

SEQ ID NO: 637038 - DNA, 25 bp, Rattus norvegicus
agcggtttgaaatcagggctgattt

SEQ ID NO: 637039 - DNA, 25 bp, Rattus norvegicus
tgcagcagaaggaaatcaccaagga

SEQ ID NO: 637040 - DNA, 25 bp, Rattus norvegicus
ttggagcctgattcgtgcagcagaa

SEQ ID NO: 637041 - DNA, 25 bp, Rattus norvegicus
aagcctgtgcgttggagcctgattc

SEQ ID NO: 637042 - DNA, 25 bp, Rattus norvegicus
tattcgaagcctgtgcgttggagcc

SEQ ID NO: 637043 - DNA, 25 bp, Rattus norvegicus
tcgaacaaatattcgaagcctgtgc

SEQ ID NO: 637044 - DNA, 25 bp, Rattus norvegicus
atcggtgaacgaaagaaatcgaaca

SEQ ID NO: 637045 - DNA, 25 bp, Rattus norvegicus
cctcccagtgaaatcggtgaacgaa

SEQ ID NO: 637046 - DNA, 25 bp, Rattus norvegicus
gacgaacctcccagtgaaatcggtg

SEQ ID NO: 637047 - DNA, 25 bp, Rattus norvegicus
gacgcatgacgaacctcccagtgaa

SEQ ID NO: 637048 - DNA, 25 bp, Rattus norvegicus
tgatttcgcctgtagtccgctgagc

SEQ ID NO: 637049 - DNA, 25 bp, Rattus norvegicus
tcggatgaactgagaaatttttctc

SEQ ID NO: 637050 - DNA, 25 bp, Rattus norvegicus
ggggctcgcttccagccatggctgc

SEQ ID NO: 637051 - DNA, 25 bp, Rattus norvegicus
gtcagcgcgctcgtctcctccgcct

SEQ ID NO: 637052 - DNA, 25 bp, Rattus norvegicus
cttgcccaccgaattccagaaggtc

SEQ ID NO: 637053 - DNA, 25 bp, Rattus norvegicus
accgaattccagaaggtcctccagc

SEQ ID NO: 637054 - DNA, 25 bp, Rattus norvegicus
gaaggtcctccagccgctcaggata

SEQ ID NO: 637055 - DNA, 25 bp, Rattus norvegicus
agccgctcaggatagcagcctccag

SEQ ID NO: 637056 - DNA, 25 bp, Rattus norvegicus
ctcaggatagcagcctccaggcggc

SEQ ID NO: 637057 - DNA, 25 bp, Rattus norvegicus
ctgggacgagccaggctggtctgct

SEQ ID NO: 637058 - DNA, 25 bp, Rattus norvegicus
ggaatgactcatcccggttagcaca

SEQ ID NO: 637059 - DNA, 25 bp, Rattus norvegicus
tcatcccggttagcacaaacccttg

SEQ ID NO: 637060 - DNA, 25 bp, Rattus norvegicus
ttagcacaaacccttggccgaatga

SEQ ID NO: 637061 - DNA, 25 bp, Rattus norvegicus
gcacaaacccttggccgaatgaccg

SEQ ID NO: 637062 - DNA, 25 bp, Rattus norvegicus
tgcgacctcggctcaccggcagccg

SEQ ID NO: 637063 - DNA, 25 bp, Rattus norvegicus
cgaggtggcccggaatgactcatcc

SEQ ID NO: 637064 - DNA, 25 bp, Rattus norvegicus
gagacataggctccgggctacgacc

SEQ ID NO: 637065 - DNA, 25 bp, Rattus norvegicus
aaggccgcgccttctagctacggag

SEQ ID NO: 637066 - DNA, 25 bp, Rattus norvegicus
cggcttcgctaaggtgctgtatgtg

SEQ ID NO: 637067 - DNA, 25 bp, Rattus norvegicus
ctgtatgtgagcctgagccaggtcc

SEQ ID NO: 637068 - DNA, 25 bp, Rattus norvegicus
ccacgcgggcaggagatcacctgac

SEQ ID NO: 637069 - DNA, 25 bp, Rattus norvegicus
ccaccctgatggtgggcggagacat

SEQ ID NO: 637070 - DNA, 25 bp, Rattus norvegicus
cgggtattgagttcctcccagtggc

SEQ ID NO: 637071 - DNA, 25 bp, Rattus norvegicus
ccacaatcctgtgctgagagggacc

SEQ ID NO: 637072 - DNA, 25 bp, Rattus norvegicus
gtgatgtaagggcacacctctctcc

SEQ ID NO: 637073 - DNA, 25 bp, Rattus norvegicus
ttcaaccaatcggaagccgaccatg

SEQ ID NO: 637074 - DNA, 25 bp, Rattus norvegicus
tgctccgggctgaaccaataggacg

SEQ ID NO: 637075 - DNA, 25 bp, Rattus norvegicus
accaataggacgtcggctctctccg

SEQ ID NO: 637076 - DNA, 25 bp, Rattus norvegicus
cgcaaaggtcgttccgggtattgag

SEQ ID NO: 637077 - DNA, 25 bp, Rattus norvegicus
cacctgacggcctggatggcggaat

SEQ ID NO: 637078 - DNA, 25 bp, Rattus norvegicus
acgtcactgacgtgcggtcgagcct

SEQ ID NO: 637079 - DNA, 25 bp, Rattus norvegicus
cccttccctatatggcggtagaaag

SEQ ID NO: 637080 - DNA, 25 bp, Rattus norvegicus
ttaaccgctctgctggctcaagttc

SEQ ID NO: 637081 - DNA, 25 bp, Rattus norvegicus
cagctacactgcaacgccttaggga

SEQ ID NO: 637082 - DNA, 25 bp, Rattus norvegicus
caagctgtgcttgcagcgctggaga

SEQ ID NO: 637083 - DNA, 25 bp, Rattus norvegicus
cccgatggaggcgagatgaagtcaa

SEQ ID NO: 637084 - DNA, 25 bp, Rattus norvegicus
gggatctggcatctgtagctccgtg

SEQ ID NO: 637085 - DNA, 25 bp, Rattus norvegicus
gggcgccctgcacaaggtaaattga

SEQ ID NO: 637086 - DNA, 25 bp, Rattus norvegicus
aactcttgtcctccgggcttcggct

SEQ ID NO: 637087 - DNA, 25 bp, Rattus norvegicus
ccttctctctttagcgggtgacgcc

SEQ ID NO: 637088 - DNA, 25 bp, Rattus norvegicus
tctgaggtcccgaggacgtcactga

SEQ ID NO: 637089 - DNA, 25 bp, Rattus norvegicus
tcctagctgtgcagcgcttccattc

SEQ ID NO: 637090 - DNA, 25 bp, Rattus norvegicus
agatggcggctcttaaactcttgtc

SEQ ID NO: 637091 - DNA, 25 bp, Rattus norvegicus
ctgtctagcttcttgacaagccagc

SEQ ID NO: 637092 - DNA, 25 bp, Rattus norvegicus
cgcctcctatcggtgtcacagtcaa

SEQ ID NO: 637093 - DNA, 25 bp, Rattus norvegicus
taggcgtactttctcttccggtctc

SEQ ID NO: 637094 - DNA, 25 bp, Rattus norvegicus
ccacaggaagtggtaggcgtacttt

SEQ ID NO: 637095 - DNA, 25 bp, Rattus norvegicus
ttgactgggcggaagcttatccaca

SEQ ID NO: 637096 - DNA, 25 bp, Rattus norvegicus
cactcaccggaagtagttgactggg

SEQ ID NO: 637097 - DNA, 25 bp, Rattus norvegicus
tgatagtgctgcaccgcactcaccg

SEQ ID NO: 637098 - DNA, 25 bp, Rattus norvegicus
cagtcaaattggttccctggctctc

SEQ ID NO: 637099 - DNA, 25 bp, Rattus norvegicus
tcctaacctaggagtttctggcgcc

SEQ ID NO: 637100 - DNA, 25 bp, Rattus norvegicus
gcgaacttctgcgaaaagcctccta

SEQ ID NO: 637101 - DNA, 25 bp, Rattus norvegicus
ctccggagaccgaaagctcaacaga

SEQ ID NO: 637102 - DNA, 25 bp, Rattus norvegicus
tactacagcggagcgagacggctcc

SEQ ID NO: 637103 - DNA, 25 bp, Rattus norvegicus
agaccagaattcagacccgactgca

SEQ ID NO: 637104 - DNA, 25 bp, Rattus norvegicus
acagggtgtccgacttccctcgagc

SEQ ID NO: 637105 - DNA, 25 bp, Rattus norvegicus
accactgcgccggaggcctgatagt

SEQ ID NO: 637106 - DNA, 25 bp, Rattus norvegicus
gatggctctgggtgcaactttccca

SEQ ID NO: 637107 - DNA, 25 bp, Rattus norvegicus
tgtctgggctccgtattcccgatcc

SEQ ID NO: 637108 - DNA, 25 bp, Rattus norvegicus
accgcgccttttcgcactccgcatc

SEQ ID NO: 637109 - DNA, 25 bp, Rattus norvegicus
cctgtgcgccctcggcgcagagcca

SEQ ID NO: 637110 - DNA, 25 bp, Rattus norvegicus
cgagagggtctcttcttcggatccc

SEQ ID NO: 637111 - DNA, 25 bp, Rattus norvegicus
gcgcggacgagagggtctcttcttc

SEQ ID NO: 637112 - DNA, 25 bp, Rattus norvegicus
ctgggtgcaactttcccaggcgagg

SEQ ID NO: 637113 - DNA, 25 bp, Rattus norvegicus
ctgcagagctatggggtccgtcgcg

SEQ ID NO: 637114 - DNA, 25 bp, Rattus norvegicus
attcccgatcccggcggcgctggga

SEQ ID NO: 637115 - DNA, 25 bp, Rattus norvegicus
cgccctggcggtccttggagttgtc

SEQ ID NO: 637116 - DNA, 25 bp, Rattus norvegicus
gcagagccagcccatcgcgccctgg

SEQ ID NO: 637117 - DNA, 25 bp, Rattus norvegicus
gcgggtgaagatcggccactacatc

SEQ ID NO: 637118 - DNA, 25 bp, Rattus norvegicus
gaagatcggccactacatcctgggg

SEQ ID NO: 637119 - DNA, 25 bp, Rattus norvegicus
cccaggcgagggagttggacactgc

SEQ ID NO: 637120 - DNA, 25 bp, Rattus norvegicus
tcgacttgggcaccacgtccgtaaa

SEQ ID NO: 637121 - DNA, 25 bp, Rattus norvegicus
actctcggtatcgacttgggcacca

SEQ ID NO: 637122 - DNA, 25 bp, Rattus norvegicus
aggcagcggcctggaaccgctaccc

SEQ ID NO: 637123 - DNA, 25 bp, Rattus norvegicus
cacccatccgggttcgtggtgctgg

SEQ ID NO: 637124 - DNA, 25 bp, Rattus norvegicus
aaggccgccctcttggaggctgcac

SEQ ID NO: 637125 - DNA, 25 bp, Rattus norvegicus
tgggcaccacgtccgtaaaggccgc

SEQ ID NO: 637126 - DNA, 25 bp, Rattus norvegicus
tgtcaccgctgccatgacttcgcga

SEQ ID NO: 637127 - DNA, 25 bp, Rattus norvegicus
agttgtgctgtcaccgctgccatga

SEQ ID NO: 637128 - DNA, 25 bp, Rattus norvegicus
aagccgcctgagttgtgctgtcacc

SEQ ID NO: 637129 - DNA, 25 bp, Rattus norvegicus
gcctgcggttcaagccgcctgagtt

SEQ ID NO: 637130 - DNA, 25 bp, Rattus norvegicus
agttccttagcctgcggttcaagcc

SEQ ID NO: 637131 - DNA, 25 bp, Rattus norvegicus
ggtgtagttccttagcctgcggttc

SEQ ID NO: 637132 - DNA, 25 bp, Rattus norvegicus
gacccgtcactctcggtatcgactt

SEQ ID NO: 637133 - DNA, 25 bp, Rattus norvegicus
gtaaaggccgccctcttggaggctg

SEQ ID NO: 637134 - DNA, 25 bp, Rattus norvegicus
gttctgtgtgctggccctgcggcct

SEQ ID NO: 637135 - DNA, 25 bp, Rattus norvegicus
ccacggagtggctttcaggtaaccg

SEQ ID NO: 637136 - DNA, 25 bp, Rattus norvegicus
cggagtggctttcaggtaaccggct

SEQ ID NO: 637137 - DNA, 25 bp, Rattus norvegicus
agtggctttcaggtaaccggctacg

SEQ ID NO: 637138 - DNA, 25 bp, Rattus norvegicus
gaaacaaggggtgagggtgctgcac

SEQ ID NO: 637139 - DNA, 25 bp, Rattus norvegicus
gtccgcagagccctcaggggtgcct

SEQ ID NO: 637140 - DNA, 25 bp, Rattus norvegicus
gcagagccctcaggggtgcctctgt

SEQ ID NO: 637141 - DNA, 25 bp, Rattus norvegicus
ctcaggggtgcctctgtcctgggca

SEQ ID NO: 637142 - DNA, 25 bp, Rattus norvegicus
ggaccacggagtggctttcaggtaa

SEQ ID NO: 637143 - DNA, 25 bp, Rattus norvegicus
aggtgctgttatagcgggcgcttat

SEQ ID NO: 637144 - DNA, 25 bp, Rattus norvegicus
atagcgggcgcttatttttagtgca

SEQ ID NO: 637145 - DNA, 25 bp, Rattus norvegicus
gcgggcgcttatttttagtgcagcc

SEQ ID NO: 637146 - DNA, 25 bp, Rattus norvegicus
gcgcttatttttagtgcagccgacg

SEQ ID NO: 637147 - DNA, 25 bp, Rattus norvegicus
agccctcaggggtgcctctgtcctg

SEQ ID NO: 637148 - DNA, 25 bp, Rattus norvegicus
tctagatgagtgcaactgtcaaagc

SEQ ID NO: 637149 - DNA, 25 bp, Rattus norvegicus
agctcgctagtgcactcgccctgga

SEQ ID NO: 637150 - DNA, 25 bp, Rattus norvegicus
gcctcagaagccaagagcagctcgc

SEQ ID NO: 637151 - DNA, 25 bp, Rattus norvegicus
cagggcctggcgctcctattgccag

SEQ ID NO: 637152 - DNA, 25 bp, Rattus norvegicus
agcaatatggcttcggtggccgcgc

SEQ ID NO: 637153 - DNA, 25 bp, Rattus norvegicus
tccgtctaaatagcgttttgcatta

SEQ ID NO: 637154 - DNA, 25 bp, Rattus norvegicus
gggtcgtgatgtgtccgtctaaata

SEQ ID NO: 637155 - DNA, 25 bp, Rattus norvegicus
gattgctttcttcctccagcgcagg

SEQ ID NO: 637156 - DNA, 25 bp, Rattus norvegicus
tcgcaccggatcaagcacgaggagc

SEQ ID NO: 637157 - DNA, 25 bp, Rattus norvegicus
agcagctcgcagaagccgaccctga

SEQ ID NO: 637158 - DNA, 25 bp, Rattus norvegicus
gctcacttcgtggaagagcttcccg

SEQ ID NO: 637159 - DNA, 25 bp, Rattus norvegicus
gagcttcccgtccatcttcaagttc

SEQ ID NO: 637160 - DNA, 25 bp, Rattus norvegicus
cttcaagttcttcgcggaagcctca

SEQ ID NO: 637161 - DNA, 25 bp, Rattus norvegicus
acccaggcagacgaccgaggcagac

SEQ ID NO: 637162 - DNA, 25 bp, Rattus norvegicus
cgtacatgtaagagaaggcggcgta

SEQ ID NO: 637163 - DNA, 25 bp, Rattus norvegicus
catagacggcgaagagcgtgagacc

SEQ ID NO: 637164 - DNA, 25 bp, Rattus norvegicus
tccagtcgatgaagcaccaggtccc

SEQ ID NO: 637165 - DNA, 25 bp, Rattus norvegicus
tcggacctacccaggcccatgttgg

SEQ ID NO: 637166 - DNA, 25 bp, Rattus norvegicus
cccatgttgggcagtgcgcagaaga

SEQ ID NO: 637167 - DNA, 25 bp, Rattus norvegicus
cgcagaagagcacgttagatgcata

SEQ ID NO: 637168 - DNA, 25 bp, Rattus norvegicus
acgttagatgcatagacggcgaaga

SEQ ID NO: 637169 - DNA, 25 bp, Rattus norvegicus
gtgagaccggccagccgcttgtcca

SEQ ID NO: 637170 - DNA, 25 bp, Rattus norvegicus
ccgttacgttggtggtccagtcgat

SEQ ID NO: 637171 - DNA, 25 bp, Rattus norvegicus
tcctgcggcggcgaaagtcactgag

SEQ ID NO: 637172 - DNA, 25 bp, Rattus norvegicus
cggcgaaagtcactgaggcgctgca

SEQ ID NO: 637173 - DNA, 25 bp, Rattus norvegicus
gcgccgcacaccagcacattgcaga

SEQ ID NO: 637174 - DNA, 25 bp, Rattus norvegicus
ctgaagcccgcgtacatgtaagaga

SEQ ID NO: 637175 - DNA, 25 bp, Rattus norvegicus
gaaggaactgaagcccgcgtacatg

SEQ ID NO: 637176 - DNA, 25 bp, Rattus norvegicus
agacttcctctagcaccgcccggga

SEQ ID NO: 637177 - DNA, 25 bp, Rattus norvegicus
ctgaggccgctccttgtgctctggg

SEQ ID NO: 637178 - DNA, 25 bp, Rattus norvegicus
gtctagcgcgggaggtcagcgtcca

SEQ ID NO: 637179 - DNA, 25 bp, Rattus norvegicus
gtgtcgccacgcgtgcaggtggaac

SEQ ID NO: 637180 - DNA, 25 bp, Rattus norvegicus
caggtggaacggagcgtaggtcccg

SEQ ID NO: 637181 - DNA, 25 bp, Rattus norvegicus
gcgggcagaacggacagctaccgga

SEQ ID NO: 637182 - DNA, 25 bp, Rattus norvegicus
ggctaccgctgaggccgctccttgt

SEQ ID NO: 637183 - DNA, 25 bp, Rattus norvegicus
gcctggggctctgacctggagctgt

SEQ ID NO: 637184 - DNA, 25 bp, Rattus norvegicus
tctcccgctgccgggtttcgagctt

SEQ ID NO: 637185 - DNA, 25 bp, Rattus norvegicus
tttcgagcttcgctctccgcgtttc

SEQ ID NO: 637186 - DNA, 25 bp, Rattus norvegicus
tccgcgtttccagcctctgaacaaa

SEQ ID NO: 637187 - DNA, 25 bp, Rattus norvegicus
ttctccacccgcaagtttccctgga

SEQ ID NO: 637188 - DNA, 25 bp, Rattus norvegicus
gcggagcgagacttcctctagcacc

SEQ ID NO: 637189 - DNA, 25 bp, Rattus norvegicus
ggcccgggcttccattggctgacat

SEQ ID NO: 637190 - DNA, 25 bp, Rattus norvegicus
gccagcatctgattagaaccatatc

SEQ ID NO: 637191 - DNA, 25 bp, Rattus norvegicus
gggctgtgtgctcgctcctttctcc

SEQ ID NO: 637192 - DNA, 25 bp, Rattus norvegicus
ctcccggccggcagctatttaagcg

SEQ ID NO: 637193 - DNA, 25 bp, Rattus norvegicus
agaaccatatctctacccgggagtg

SEQ ID NO: 637194 - DNA, 25 bp, Rattus norvegicus
gcagctatttaagcggggctgtccg

SEQ ID NO: 637195 - DNA, 25 bp, Rattus norvegicus
tggagagtcctcagagccagcatct

SEQ ID NO: 637196 - DNA, 25 bp, Rattus norvegicus
cagacacgttgagggggagttacca

SEQ ID NO: 637197 - DNA, 25 bp, Rattus norvegicus
taagttttgaagactccgcagacac

SEQ ID NO: 637198 - DNA, 25 bp, Rattus norvegicus
acagttaagttttgaagactccgca

SEQ ID NO: 637199 - DNA, 25 bp, Rattus norvegicus
ctcaagctcgagttaataaacagtt

SEQ ID NO: 637200 - DNA, 25 bp, Rattus norvegicus
cggtctctgactcaagctcgagtta

SEQ ID NO: 637201 - DNA, 25 bp, Rattus norvegicus
gcgccggtctctgactcaagctcga

SEQ ID NO: 637202 - DNA, 25 bp, Rattus norvegicus
tcctttctccgggtctctgcgatcg

SEQ ID NO: 637203 - DNA, 25 bp, Rattus norvegicus
accatatctctacccgggagtggcc

SEQ ID NO: 637204 - DNA, 25 bp, Rattus norvegicus
ctgggaaaggatcaaagccacattc

SEQ ID NO: 637205 - DNA, 25 bp, Rattus norvegicus
tggatctgccggcttcttgctgact

SEQ ID NO: 637206 - DNA, 25 bp, Rattus norvegicus
tgggaagagcgaccacatcctgccc

SEQ ID NO: 637207 - DNA, 25 bp, Rattus norvegicus
gcggacctaggtgcacccaaggacc

SEQ ID NO: 637208 - DNA, 25 bp, Rattus norvegicus
atctgacccgaggtaacgcggggca

SEQ ID NO: 637209 - DNA, 25 bp, Rattus norvegicus
agaacgtcccgctggatctgacccg

SEQ ID NO: 637210 - DNA, 25 bp, Rattus norvegicus
aatgacagcggcgaggagaacgtcc

SEQ ID NO: 637211 - DNA, 25 bp, Rattus norvegicus
tgtctgtttcgcacagggcggaatg

SEQ ID NO: 637212 - DNA, 25 bp, Rattus norvegicus
tcctactggggctgtgtgtctgttt

SEQ ID NO: 637213 - DNA, 25 bp, Rattus norvegicus
gggtcgctacctaattgctccgcgc

SEQ ID NO: 637214 - DNA, 25 bp, Rattus norvegicus
cgtgggtatactgcgcctccctatc

SEQ ID NO: 637215 - DNA, 25 bp, Rattus norvegicus
ggcccgagccacatcaatgggaatc

SEQ ID NO: 637216 - DNA, 25 bp, Rattus norvegicus
ccgatgagtaacgaagcgggcttta

SEQ ID NO: 637217 - DNA, 25 bp, Rattus norvegicus
tgactgcgtgactgctcttctctgc

SEQ ID NO: 637218 - DNA, 25 bp, Rattus norvegicus
ctatgaatcagctgcggggcaagtg

SEQ ID NO: 637219 - DNA, 25 bp, Rattus norvegicus
ggaacgatcgggaccctgcgaccga

SEQ ID NO: 637220 - DNA, 25 bp, Rattus norvegicus
cgctgggcgcataggttctatactc

SEQ ID NO: 637221 - DNA, 25 bp, Rattus norvegicus
ggttctatactcaccgacctggcga

SEQ ID NO: 637222 - DNA, 25 bp, Rattus norvegicus
acctggcgacctgctccgagcccgt

SEQ ID NO: 637223 - DNA, 25 bp, Rattus norvegicus
ccggctatgaatcagctgcggggca

SEQ ID NO: 637224 - DNA, 25 bp, Rattus norvegicus
ccgaggggccagtactgttgcaatt

SEQ ID NO: 637225 - DNA, 25 bp, Rattus norvegicus
ctgttgcaatttcccgtctcgctga

SEQ ID NO: 637226 - DNA, 25 bp, Rattus norvegicus
tttcccgtctcgctgagcacttttg

SEQ ID NO: 637227 - DNA, 25 bp, Rattus norvegicus
agcacttttggcactcctgggaccc

SEQ ID NO: 637228 - DNA, 25 bp, Rattus norvegicus
ttttggcactcctgggacccacagg

SEQ ID NO: 637229 - DNA, 25 bp, Rattus norvegicus
ctgggacccacaggaatttgcctcc

SEQ ID NO: 637230 - DNA, 25 bp, Rattus norvegicus
gccagtactgttgcaatttcccgtc

SEQ ID NO: 637231 - DNA, 25 bp, Rattus norvegicus
aggaatttgcctcctggtcccaaag

SEQ ID NO: 637232 - DNA, 25 bp, Rattus norvegicus
agtctcagcagaggcacctccctgg

SEQ ID NO: 637233 - DNA, 25 bp, Rattus norvegicus
agaagctttacaccggcagggccgc

SEQ ID NO: 637234 - DNA, 25 bp, Rattus norvegicus
gccagccgagggtcaaccctacagt

SEQ ID NO: 637235 - DNA, 25 bp, Rattus norvegicus
ccgctccgtgaccttgcaaggctgg

SEQ ID NO: 637236 - DNA, 25 bp, Rattus norvegicus
gcccatagaccgtggccgctagagc

SEQ ID NO: 637237 - DNA, 25 bp, Rattus norvegicus
ctgcaccgcgcgaaacttgtgcggc

SEQ ID NO: 637238 - DNA, 25 bp, Rattus norvegicus
tccgctggcctttccagaagcttta

SEQ ID NO: 637239 - DNA, 25 bp, Rattus norvegicus
agtccgcgcctgagcgtctcggctg

SEQ ID NO: 637240 - DNA, 25 bp, Rattus norvegicus
tccgttgctgcagggtcccgtctgc

SEQ ID NO: 637241 - DNA, 25 bp, Rattus norvegicus
tcttcccgactgcagtccgttgctg

SEQ ID NO: 637242 - DNA, 25 bp, Rattus norvegicus
tggactgcttcttcccgactgcagt

SEQ ID NO: 637243 - DNA, 25 bp, Rattus norvegicus
cgttatcgtcgcctggcgctgcggt

SEQ ID NO: 637244 - DNA, 25 bp, Rattus norvegicus
cgtggccgctagagccggcctgcaa

SEQ ID NO: 637245 - DNA, 25 bp, Rattus norvegicus
cgcgacccgagtctcagcagaggca

SEQ ID NO: 637246 - DNA, 25 bp, Rattus norvegicus
ggtgggaccgacttcaacactccgc

SEQ ID NO: 637247 - DNA, 25 bp, Rattus norvegicus
ctgcaggccaggagcaagaaatgga

SEQ ID NO: 637248 - DNA, 25 bp, Rattus norvegicus
agtctctagcctcggctgagctctg

SEQ ID NO: 637249 - DNA, 25 bp, Rattus norvegicus
agtgaagctgcctgctctgagaacc

SEQ ID NO: 637250 - DNA, 25 bp, Rattus norvegicus
ccaaaggccgggaccgaagtgctca

SEQ ID NO: 637251 - DNA, 25 bp, Rattus norvegicus
aagtgctcagggcaccatggctccg

SEQ ID NO: 637252 - DNA, 25 bp, Rattus norvegicus
cctgattttcgcagagcggttcgga

SEQ ID NO: 637253 - DNA, 25 bp, Rattus norvegicus
gaggggcagggtctgaatcaattca

SEQ ID NO: 637254 - DNA, 25 bp, Rattus norvegicus
tcaccgaccgtgtctgcaaagtttc

SEQ ID NO: 637255 - DNA, 25 bp, Rattus norvegicus
tgcaaagtttcaccaagtcccgggc

SEQ ID NO: 637256 - DNA, 25 bp, Rattus norvegicus
gaactgaaccaggagccactcggga

SEQ ID NO: 637257 - DNA, 25 bp, Rattus norvegicus
gctcgacccgcaggagatggaatta

SEQ ID NO: 637258 - DNA, 25 bp, Rattus norvegicus
ctgagctctgcgcatagccttggcg

SEQ ID NO: 637259 - DNA, 25 bp, Rattus norvegicus
cgcactgagcgctttacctgatttt

SEQ ID NO: 637260 - DNA, 25 bp, Rattus norvegicus
gcagtctcttctctagtcctctaga

SEQ ID NO: 637261 - DNA, 25 bp, Rattus norvegicus
gtccgcgcggccagcgtattgccct

SEQ ID NO: 637262 - DNA, 25 bp, Rattus norvegicus
gtactacgggtcctgagcgtcgcgc

SEQ ID NO: 637263 - DNA, 25 bp, Rattus norvegicus
caccgtgcagctgcaggacaccggg

SEQ ID NO: 637264 - DNA, 25 bp, Rattus norvegicus
tctctagtcctctagatcctgcgct

SEQ ID NO: 637265 - DNA, 25 bp, Rattus norvegicus
gcgcacacgcagtctcttctctagt

SEQ ID NO: 637266 - DNA, 25 bp, Rattus norvegicus
ggagcgcgcacacgcagtctcttct

SEQ ID NO: 637267 - DNA, 25 bp, Rattus norvegicus
cgccacaaagctgcgccgggccgct

SEQ ID NO: 637268 - DNA, 25 bp, Rattus norvegicus
cacacgcgcacaccggccgccacaa

SEQ ID NO: 637269 - DNA, 25 bp, Rattus norvegicus
gtccacgactctccatcaggactga

SEQ ID NO: 637270 - DNA, 25 bp, Rattus norvegicus
tgccggctcacccaacgggcgcgct

SEQ ID NO: 637271 - DNA, 25 bp, Rattus norvegicus
gtcaatagtcagtcctgccggctca

SEQ ID NO: 637272 - DNA, 25 bp, Rattus norvegicus
gacgtggacggaatgtcaatagtca

SEQ ID NO: 637273 - DNA, 25 bp, Rattus norvegicus
ctgttcggagctgggtaccagcagc

SEQ ID NO: 637274 - DNA, 25 bp, Rattus norvegicus
aggcaggggaagctgctcagactta

SEQ ID NO: 637275 - DNA, 25 bp, Rattus norvegicus
cccgaggtagcctccagcagacaga

SEQ ID NO: 637276 - DNA, 25 bp, Rattus norvegicus
ttcgggccacttggagttaatgtcc

SEQ ID NO: 637277 - DNA, 25 bp, Rattus norvegicus
ggacgccgtcaccaagttgcgattg

SEQ ID NO: 637278 - DNA, 25 bp, Rattus norvegicus
tctcctggatgggattcgggccact

SEQ ID NO: 637279 - DNA, 25 bp, Rattus norvegicus
gattgcgtgctcttgctcccgacct

SEQ ID NO: 637280 - DNA, 25 bp, Rattus norvegicus
cagacttagtcttcttgggatccaa

SEQ ID NO: 637281 - DNA, 25 bp, Rattus norvegicus
cggatctccaggcaagacttcggca

SEQ ID NO: 637282 - DNA, 25 bp, Rattus norvegicus
acgtggtgtctcgttcggatctcca

SEQ ID NO: 637283 - DNA, 25 bp, Rattus norvegicus
tcatgtcttcaagggactgccggcg

SEQ ID NO: 637284 - DNA, 25 bp, Rattus norvegicus
tcctggcgccctcatgtcttcaagg

SEQ ID NO: 637285 - DNA, 25 bp, Rattus norvegicus
gagaggctcacggagtcacccactc

SEQ ID NO: 637286 - DNA, 25 bp, Rattus norvegicus
tccgcgcgcgttcctgtggatctac

SEQ ID NO: 637287 - DNA, 25 bp, Rattus norvegicus
agacttcggcatccgcagacaggcc

SEQ ID NO: 637288 - DNA, 25 bp, Rattus norvegicus
gaggctcgcctcgtccaattttaaa

SEQ ID NO: 637289 - DNA, 25 bp, Rattus norvegicus
ccggccgacgcattggtgtataaaa

SEQ ID NO: 637290 - DNA, 25 bp, Rattus norvegicus
gagccagaggcgtcttttttccgtc

SEQ ID NO: 637291 - DNA, 25 bp, Rattus norvegicus
taaaagccttccgtgagccaaactg

SEQ ID NO: 637292 - DNA, 25 bp, Rattus norvegicus
agcgtcgccacacttctgatcgagg

SEQ ID NO: 637293 - DNA, 25 bp, Rattus norvegicus
agcccgatgctacccgcctagaata

SEQ ID NO: 637294 - DNA, 25 bp, Rattus norvegicus
gggccggtgccttaagctatttgca

SEQ ID NO: 637295 - DNA, 25 bp, Rattus norvegicus
atctcggggtgaaagcttgatcgcc

SEQ ID NO: 637296 - DNA, 25 bp, Rattus norvegicus
cggggctcacttagcagagtcaatc

SEQ ID NO: 637297 - DNA, 25 bp, Rattus norvegicus
cagaggcggagtagaactagctttc

SEQ ID NO: 637298 - DNA, 25 bp, Rattus norvegicus
ctgctccgctgggatgagttgatcc

SEQ ID NO: 637299 - DNA, 25 bp, Rattus norvegicus
tgcccaagtgcgcagagcgatccct

SEQ ID NO: 637300 - DNA, 25 bp, Rattus norvegicus
ggcggctttcctgagcatcctttaa

SEQ ID NO: 637301 - DNA, 25 bp, Rattus norvegicus
ccagtgttttcctcttttgccagcg

SEQ ID NO: 637302 - DNA, 25 bp, Rattus norvegicus
cccggcagttctttttatgtcaaga

SEQ ID NO: 637303 - DNA, 25 bp, Rattus norvegicus
cccttgcagggtcttggtccgagcg

SEQ ID NO: 637304 - DNA, 25 bp, Rattus norvegicus
cagggccctttgttaagcacctccg

SEQ ID NO: 637305 - DNA, 25 bp, Rattus norvegicus
agtgggcctgtcacgtggccgcgcc

SEQ ID NO: 637306 - DNA, 25 bp, Rattus norvegicus
cgacgctgcgctcagtgggcctgtc

SEQ ID NO: 637307 - DNA, 25 bp, Rattus norvegicus
ttgcgggacagcgacgctgcgctca

SEQ ID NO: 637308 - DNA, 25 bp, Rattus norvegicus
aagaagacaccaggcaccctggctg

SEQ ID NO: 637309 - DNA, 25 bp, Rattus norvegicus
tcaagaagacaccaggcaccctggc

SEQ ID NO: 637310 - DNA, 25 bp, Rattus norvegicus
tgtcaagaagacaccaggcaccctg

SEQ ID NO: 637311 - DNA, 25 bp, Rattus norvegicus
ggcagttctttttatgtcaagaaga

SEQ ID NO: 637312 - DNA, 25 bp, Rattus norvegicus
agcccggcagttctttttatgtcaa

SEQ ID NO: 637313 - DNA, 25 bp, Rattus norvegicus
agagcccggcagttctttttatgtc

SEQ ID NO: 637314 - DNA, 25 bp, Rattus norvegicus
ggagagcccggcagttctttttatg

SEQ ID NO: 637315 - DNA, 25 bp, Rattus norvegicus
tttttatgtcaagaagacaccaggc

SEQ ID NO: 637316 - DNA, 25 bp, Rattus norvegicus
cagtgactggtaagaaccgttccct

SEQ ID NO: 637317 - DNA, 25 bp, Rattus norvegicus
ctgtctgcctggtgttgctccacac

SEQ ID NO: 637318 - DNA, 25 bp, Rattus norvegicus
agaggctgccctgcagtcagcgcca

SEQ ID NO: 637319 - DNA, 25 bp, Rattus norvegicus
gtaagacgcttctcgaagcgcccgc

SEQ ID NO: 637320 - DNA, 25 bp, Rattus norvegicus
ccttcgcgctgaccagtgactggta

SEQ ID NO: 637321 - DNA, 25 bp, Rattus norvegicus
tggtgttgctccacaccgcgtctgc

SEQ ID NO: 637322 - DNA, 25 bp, Rattus norvegicus
tatgggatgtcgtggctgtctgcct

SEQ ID NO: 637323 - DNA, 25 bp, Rattus norvegicus
ctctaagatgaagttatgggatgtc

SEQ ID NO: 637324 - DNA, 25 bp, Rattus norvegicus
ccggacgggactctaagatgaagtt

SEQ ID NO: 637325 - DNA, 25 bp, Rattus norvegicus
tggtgcggttctcttcccggctgcc

SEQ ID NO: 637326 - DNA, 25 bp, Rattus norvegicus
ctaacttgcctggtgcggttctctt

SEQ ID NO: 637327 - DNA, 25 bp, Rattus norvegicus
atccgagcctaacttgcctggtgcg

SEQ ID NO: 637328 - DNA, 25 bp, Rattus norvegicus
ggtcctgggcatccgagcctaactt

SEQ ID NO: 637329 - DNA, 25 bp, Rattus norvegicus
ccgccggtaagacgcttctcgaagc

SEQ ID NO: 637330 - DNA, 25 bp, Rattus norvegicus
gaaagcaggctttcagaccttcgcc

SEQ ID NO: 637331 - DNA, 25 bp, Rattus norvegicus
gagctgtcactcaccgaatcctgtg

SEQ ID NO: 637332 - DNA, 25 bp, Rattus norvegicus
ggcgccgctcaaaagtggcagctcc

SEQ ID NO: 637333 - DNA, 25 bp, Rattus norvegicus
atccactcgtaagccctctgcaaag

SEQ ID NO: 637334 - DNA, 25 bp, Rattus norvegicus
ctctgcaaagttaggctgggctctg

SEQ ID NO: 637335 - DNA, 25 bp, Rattus norvegicus
tgcccagagctgtcactcaccgaat

SEQ ID NO: 637336 - DNA, 25 bp, Rattus norvegicus
ccgaatcctgtgaagcccatggtga

SEQ ID NO: 637337 - DNA, 25 bp, Rattus norvegicus
aagcccatggtgaccgccagctgag

SEQ ID NO: 637338 - DNA, 25 bp, Rattus norvegicus
agaaaagacagaccgcccgtcagcg

SEQ ID NO: 637339 - DNA, 25 bp, Rattus norvegicus
agcaattcggatttggcacggcgga

SEQ ID NO: 637340 - DNA, 25 bp, Rattus norvegicus
accgagaccgcgtcgccaagagcgg

SEQ ID NO: 637341 - DNA, 25 bp, Rattus norvegicus
gtcagcgcctgtcactgtagcaaga

SEQ ID NO: 637342 - DNA, 25 bp, Rattus norvegicus
gacaggaagtgtcgtcaccgagacc

SEQ ID NO: 637343 - DNA, 25 bp, Rattus norvegicus
cgactgccggcaagcctgacaggaa

SEQ ID NO: 637344 - DNA, 25 bp, Rattus norvegicus
ttttgtaacgcggtgacgacgattg

SEQ ID NO: 637345 - DNA, 25 bp, Rattus norvegicus
tttccgtccctgaaacggcgtctca

SEQ ID NO: 637346 - DNA, 25 bp, Rattus norvegicus
tgaaacggcgtctcagggacgaacc

SEQ ID NO: 637347 - DNA, 25 bp, Rattus norvegicus
atctggcgcccagttattcgtttgg

SEQ ID NO: 637348 - DNA, 25 bp, Rattus norvegicus
tccgagaggaggattttgggttctc

SEQ ID NO: 637349 - DNA, 25 bp, Rattus norvegicus
ttggtttttctcacggctcttcgcg

SEQ ID NO: 637350 - DNA, 25 bp, Rattus norvegicus
tcgcggctttggagtatttttgtaa

SEQ ID NO: 637351 - DNA, 25 bp, Rattus norvegicus
atgccatctatgctgggctcgatga

SEQ ID NO: 637352 - DNA, 25 bp, Rattus norvegicus
atgatggtggcctctacgtcggccc

SEQ ID NO: 637353 - DNA, 25 bp, Rattus norvegicus
ccctccctgcaagaagctttggaaa

SEQ ID NO: 637354 - DNA, 25 bp, Rattus norvegicus
gaaaatgcggggaggcttatcgacc

SEQ ID NO: 637355 - DNA, 25 bp, Rattus norvegicus
gttgcaagaagaccgcatgtacccg

SEQ ID NO: 637356 - DNA, 25 bp, Rattus norvegicus
acgacgattgtcgacatgccatcta

SEQ ID NO: 637357 - DNA, 25 bp, Rattus norvegicus
ggcttatcgaccgacagttgcaaga

SEQ ID NO: 637358 - DNA, 25 bp, Rattus norvegicus
aatggacgcgggttcctagcatcct

SEQ ID NO: 637359 - DNA, 25 bp, Rattus norvegicus
ggcctcattgcctttctccttgtcg

SEQ ID NO: 637360 - DNA, 25 bp, Rattus norvegicus
tctccttgtcgctacgttttcgccg

SEQ ID NO: 637361 - DNA, 25 bp, Rattus norvegicus
gttttcgccgctctgactgcctcag

SEQ ID NO: 637362 - DNA, 25 bp, Rattus norvegicus
ctgcctcagcgggaggtaacggctt

SEQ ID NO: 637363 - DNA, 25 bp, Rattus norvegicus
tggctgtgggtacctccgtcttcct

SEQ ID NO: 637364 - DNA, 25 bp, Rattus norvegicus
caggtccacgggagaccttcggaca

SEQ ID NO: 637365 - DNA, 25 bp, Rattus norvegicus
gagaccttcggacagggctcttcgg

SEQ ID NO: 637366 - DNA, 25 bp, Rattus norvegicus
ggctcttcggccacagtcacgagga

SEQ ID NO: 637367 - DNA, 25 bp, Rattus norvegicus
cacgaggaaacttgtcagcagaccc

SEQ ID NO: 637368 - DNA, 25 bp, Rattus norvegicus
tcctagcatcctccgtggcagaaac

SEQ ID NO: 637369 - DNA, 25 bp, Rattus norvegicus
cccaggacggcagtgattttcttga

SEQ ID NO: 637370 - DNA, 25 bp, Rattus norvegicus
gtgattttcttgaaaatgcacgccc

SEQ ID NO: 637371 - DNA, 25 bp, Rattus norvegicus
tcggccacagtcacgaggaaacttg

SEQ ID NO: 637372 - DNA, 25 bp, Rattus norvegicus
catcgagcaggctcgtgagaagatg

SEQ ID NO: 637373 - DNA, 25 bp, Rattus norvegicus
agatgcggcgacagcaggaagaaat

SEQ ID NO: 637374 - DNA, 25 bp, Rattus norvegicus
atgaggcaggatttgatgagacgtc

SEQ ID NO: 637375 - DNA, 25 bp, Rattus norvegicus
gaactcaggcaggaagaggaacgca

SEQ ID NO: 637376 - DNA, 25 bp, Rattus norvegicus
agcggttagaactcaggcaggaaga

SEQ ID NO: 637377 - DNA, 25 bp, Rattus norvegicus
tcagaagcgatagcggttagaactc

SEQ ID NO: 637378 - DNA, 25 bp, Rattus norvegicus
gcataaccaagaggttcagaagcga

SEQ ID NO: 637379 - DNA, 25 bp, Rattus norvegicus
cttcgaagaacggaggagctgcata

SEQ ID NO: 637380 - DNA, 25 bp, Rattus norvegicus
caagaagagcttcgaagaacggagg

SEQ ID NO: 637381 - DNA, 25 bp, Rattus norvegicus
ttgatgagacgtcaagaagagcttc

SEQ ID NO: 637382 - DNA, 25 bp, Rattus norvegicus
atggaggcagcacgcgtgagcacca

SEQ ID NO: 637383 - DNA, 25 bp, Rattus norvegicus
cacgcgtgagcaccaggttatgcta

SEQ ID NO: 637384 - DNA, 25 bp, Rattus norvegicus
caccaggttatgctaatgaggcagg

SEQ ID NO: 637385 - DNA, 25 bp, Rattus norvegicus
gaggagctgcataaccaagaggttc

SEQ ID NO: 637386 - DNA, 25 bp, Rattus norvegicus
ggtggctacggctcctcttccgtct

SEQ ID NO: 637387 - DNA, 25 bp, Rattus norvegicus
tgaggccgggatctccctctctcag

SEQ ID NO: 637388 - DNA, 25 bp, Rattus norvegicus
attttttcctggaggcgacagcagc

SEQ ID NO: 637389 - DNA, 25 bp, Rattus norvegicus
ggatactgcctgtggtgtcgctcct

SEQ ID NO: 637390 - DNA, 25 bp, Rattus norvegicus
agcggcggttcttctcagtgccctt

SEQ ID NO: 637391 - DNA, 25 bp, Rattus norvegicus
aatgccgaccggaagtgcagctgca

SEQ ID NO: 637392 - DNA, 25 bp, Rattus norvegicus
cgtctctccctctcagaacaaaatg

SEQ ID NO: 637393 - DNA, 25 bp, Rattus norvegicus
aggaaccaatcctcctgtcggcggg

SEQ ID NO: 637394 - DNA, 25 bp, Rattus norvegicus
atttacctgggcgaatcggcgtctg

SEQ ID NO: 637395 - DNA, 25 bp, Rattus norvegicus
gtctcctcagtgcagggaacatgta

SEQ ID NO: 637396 - DNA, 25 bp, Rattus norvegicus
ccgctgtggcgagagactataatcc

SEQ ID NO: 637397 - DNA, 25 bp, Rattus norvegicus
tggatgccgacggtgcacctttcaa

SEQ ID NO: 637398 - DNA, 25 bp, Rattus norvegicus
gggagaccagccgagaagacaaatc

SEQ ID NO: 637399 - DNA, 25 bp, Rattus norvegicus
gccgccgaaataaagagcaggaatt

SEQ ID NO: 637400 - DNA, 25 bp, Rattus norvegicus
caactgctttcctgcccagctggga

SEQ ID NO: 637401 - DNA, 25 bp, Rattus norvegicus
cgctccagttggatgagtgcgcaac

SEQ ID NO: 637402 - DNA, 25 bp, Rattus norvegicus
agcagcgtgccgagcactgtctcca

SEQ ID NO: 637403 - DNA, 25 bp, Rattus norvegicus
tccagtgacggctgcgaaactgttc

SEQ ID NO: 637404 - DNA, 25 bp, Rattus norvegicus
gccactgacgtgttttaagaaacgc

SEQ ID NO: 637405 - DNA, 25 bp, Rattus norvegicus
acagccctcgtggaaccgtttcaag

SEQ ID NO: 637406 - DNA, 25 bp, Rattus norvegicus
tctcccgttggagagcaggcagacc

SEQ ID NO: 637407 - DNA, 25 bp, Rattus norvegicus
cggttctacttgtcttggtcggatg

SEQ ID NO: 637408 - DNA, 25 bp, Rattus norvegicus
gtgcgcaaccaaaacagaccgactg

SEQ ID NO: 637409 - DNA, 25 bp, Rattus norvegicus
cggggctcgtgttacactccctttg

SEQ ID NO: 637410 - DNA, 25 bp, Rattus norvegicus
actccctttgccagttagcgtcgtg

SEQ ID NO: 637411 - DNA, 25 bp, Rattus norvegicus
cccgaagctagctgaaagcgagtgc

SEQ ID NO: 637412 - DNA, 25 bp, Rattus norvegicus
cctgcggttagcatcgcgcttgcta

SEQ ID NO: 637413 - DNA, 25 bp, Rattus norvegicus
tgggcgtttgttgctgtgttaatta

SEQ ID NO: 637414 - DNA, 25 bp, Rattus norvegicus
ccggacccggaggattatgagcgaa

SEQ ID NO: 637415 - DNA, 25 bp, Rattus norvegicus
gtgcctgccgctctgacccacgccc

SEQ ID NO: 637416 - DNA, 25 bp, Rattus norvegicus
cccggaggattatgagcgaaccatg

SEQ ID NO: 637417 - DNA, 25 bp, Rattus norvegicus
tatgagcgaaccatgaggcggctgc

SEQ ID NO: 637418 - DNA, 25 bp, Rattus norvegicus
gcgatcgcggctctgctgctgttgc

SEQ ID NO: 637419 - DNA, 25 bp, Rattus norvegicus
tgggcttttgcagcggttactgctg

SEQ ID NO: 637420 - DNA, 25 bp, Rattus norvegicus
cagcggttactgctgcagccacatt

SEQ ID NO: 637421 - DNA, 25 bp, Rattus norvegicus
gccacattttcctgcagtgctccga

SEQ ID NO: 637422 - DNA, 25 bp, Rattus norvegicus
ttcctgcagtgctccgagtgacagc

SEQ ID NO: 637423 - DNA, 25 bp, Rattus norvegicus
tgctccgagtgacagccggtcccga

SEQ ID NO: 637424 - DNA, 25 bp, Rattus norvegicus
agagaagggaaggtgcttccaccca

SEQ ID NO: 637425 - DNA, 25 bp, Rattus norvegicus
gggaaggtgcttccacccacctgtc

SEQ ID NO: 637426 - DNA, 25 bp, Rattus norvegicus
ccacccacctgtccggatccggccg

SEQ ID NO: 637427 - DNA, 25 bp, Rattus norvegicus
atccggccggcctacggcggccatc

SEQ ID NO: 637428 - DNA, 25 bp, Rattus norvegicus
cgatgcctgactctttcttgacgta

SEQ ID NO: 637429 - DNA, 25 bp, Rattus norvegicus
gaacagcagcgtccggatgcccttg

SEQ ID NO: 637430 - DNA, 25 bp, Rattus norvegicus
gcgaacagcagcgtccggatgccct

SEQ ID NO: 637431 - DNA, 25 bp, Rattus norvegicus
ttagacatgccgaagatcgagtaga

SEQ ID NO: 637432 - DNA, 25 bp, Rattus norvegicus
cgaagttagacatgccgaagatcga

SEQ ID NO: 637433 - DNA, 25 bp, Rattus norvegicus
cgtaggcgaagttagacatgccgaa

SEQ ID NO: 637434 - DNA, 25 bp, Rattus norvegicus
cttgacgtaggcgaagttagacatg

SEQ ID NO: 637435 - DNA, 25 bp, Rattus norvegicus
tgcctgactctttcttgacgtaggc

SEQ ID NO: 637436 - DNA, 25 bp, Rattus norvegicus
gtcgatgcctgactctttcttgacg

SEQ ID NO: 637437 - DNA, 25 bp, Rattus norvegicus
cggatcagacgcaggacacgcccga

SEQ ID NO: 637438 - DNA, 25 bp, Rattus norvegicus
agacgcaggacacgcccgatccgag

SEQ ID NO: 637439 - DNA, 25 bp, Rattus norvegicus
aggacacgcccgatccgagccaagc

SEQ ID NO: 637440 - DNA, 25 bp, Rattus norvegicus
cgagccaagcggatcacacggaaca

SEQ ID NO: 637441 - DNA, 25 bp, Rattus norvegicus
gccaagcggatcacacggaacagcg

SEQ ID NO: 637442 - DNA, 25 bp, Rattus norvegicus
tgcagtaggaccagtgcccagcgcg

SEQ ID NO: 637443 - DNA, 25 bp, Rattus norvegicus
cttctctgcagcagcatgcggaccg

SEQ ID NO: 637444 - DNA, 25 bp, Rattus norvegicus
gcgcttctctgcagcagcatgcgga

SEQ ID NO: 637445 - DNA, 25 bp, Rattus norvegicus
gggtcaccgcgcttctctgcagcag

SEQ ID NO: 637446 - DNA, 25 bp, Rattus norvegicus
ccctcagccgatcctccgggtcacc

SEQ ID NO: 637447 - DNA, 25 bp, Rattus norvegicus
tggtggcactcatcctccgggcggc

SEQ ID NO: 637448 - DNA, 25 bp, Rattus norvegicus
acaccgcgggacctggtggcactca

SEQ ID NO: 637449 - DNA, 25 bp, Rattus norvegicus
agctgcagtaggaccagtgcccagc

SEQ ID NO: 637450 - DNA, 25 bp, Rattus norvegicus
gccatgccttgtccggccgctccct

SEQ ID NO: 637451 - DNA, 25 bp, Rattus norvegicus
ccggcggcccgccatgccttgtccg

SEQ ID NO: 637452 - DNA, 25 bp, Rattus norvegicus
agcgcaccagctgccagcggttctc

SEQ ID NO: 637453 - DNA, 25 bp, Rattus norvegicus
cggagcccactcaccagcgcaccag

SEQ ID NO: 637454 - DNA, 25 bp, Rattus norvegicus
atgcctctccgaccgaccggaaaga

SEQ ID NO: 637455 - DNA, 25 bp, Rattus norvegicus
ggacctggtggcactcatcctccgg

SEQ ID NO: 637456 - DNA, 25 bp, Rattus norvegicus
cgcaggcgccgaaggaaacgaataa

SEQ ID NO: 637457 - DNA, 25 bp, Rattus norvegicus
agctctccgaggaggacctgaagca

SEQ ID NO: 637458 - DNA, 25 bp, Rattus norvegicus
agcggtaccgctatgcggagctctc

SEQ ID NO: 637459 - DNA, 25 bp, Rattus norvegicus
ccacccgctatgagttcgagcagca

SEQ ID NO: 637460 - DNA, 25 bp, Rattus norvegicus
ttgtggtggcgaaaaccacccgcta

SEQ ID NO: 637461 - DNA, 25 bp, Rattus norvegicus
ctctagtggcgcgttccacgcacgt

SEQ ID NO: 637462 - DNA, 25 bp, Rattus norvegicus
accgagaggctattgcgcaggcgcc

SEQ ID NO: 637463 - DNA, 25 bp, Rattus norvegicus
ggcgggttcaaagcgacctctgtga

SEQ ID NO: 637464 - DNA, 25 bp, Rattus norvegicus
tgattagctgacagatcgggcctgg

SEQ ID NO: 637465 - DNA, 25 bp, Rattus norvegicus
accttccggacctctgattagctga

SEQ ID NO: 637466 - DNA, 25 bp, Rattus norvegicus
cgtcaaatagaattcctgccctttc

SEQ ID NO: 637467 - DNA, 25 bp, Rattus norvegicus
cttcaggcagctcaaacgtcaaata

SEQ ID NO: 637468 - DNA, 25 bp, Rattus norvegicus
ggttccagctggatttcttcaggca

SEQ ID NO: 637469 - DNA, 25 bp, Rattus norvegicus
gaccatgacttgctaccggggcttc

SEQ ID NO: 637470 - DNA, 25 bp, Rattus norvegicus
tctagggcgctgcttacaatgatcc

SEQ ID NO: 637471 - DNA, 25 bp, Rattus norvegicus
tggagctccgactgactgggaaatg

SEQ ID NO: 637472 - DNA, 25 bp, Rattus norvegicus
cgattgactgggagcgggttttcct

SEQ ID NO: 637473 - DNA, 25 bp, Rattus norvegicus
gagcccacaggccttcgggtgacca

SEQ ID NO: 637474 - DNA, 25 bp, Rattus norvegicus
cgcccgagactgaaggatccctgac

SEQ ID NO: 637475 - DNA, 25 bp, Rattus norvegicus
cagactacggcggacgcgaagcttc

SEQ ID NO: 637476 - DNA, 25 bp, Rattus norvegicus
gaagcttccgagttccttccagacg

SEQ ID NO: 637477 - DNA, 25 bp, Rattus norvegicus
ccagacgctgtctggcgaggtctga

SEQ ID NO: 637478 - DNA, 25 bp, Rattus norvegicus
ccggcccagtctggcggagatagac

SEQ ID NO: 637479 - DNA, 25 bp, Rattus norvegicus
gttccagattccgagtggccgcctc

SEQ ID NO: 637480 - DNA, 25 bp, Rattus norvegicus
cgcgatccctgcctcacgtataaag

SEQ ID NO: 637481 - DNA, 25 bp, Rattus norvegicus
aagtaggcttgaggacgacgcacac

SEQ ID NO: 637482 - DNA, 25 bp, Rattus norvegicus
gctggacccgcgaactagcaacgtt

SEQ ID NO: 637483 - DNA, 25 bp, Rattus norvegicus
cctggctcgtagtccgtctctatct

SEQ ID NO: 637484 - DNA, 25 bp, Rattus norvegicus
agccgaacagttggctgcagtcgcg

SEQ ID NO: 637485 - DNA, 25 bp, Rattus norvegicus
caagcgcgcccttgcgatcgagttt

SEQ ID NO: 637486 - DNA, 25 bp, Rattus norvegicus
ttaaaataaaccctgcaagcgcgcc

SEQ ID NO: 637487 - DNA, 25 bp, Rattus norvegicus
tttaaaactgctctcggccggcgta

SEQ ID NO: 637488 - DNA, 25 bp, Rattus norvegicus
tatgccaaggtactggccacccaac

SEQ ID NO: 637489 - DNA, 25 bp, Rattus norvegicus
agctaaatatatgccaaggtactgg

SEQ ID NO: 637490 - DNA, 25 bp, Rattus norvegicus
tgtccctctccagaaaagctaaata

SEQ ID NO: 637491 - DNA, 25 bp, Rattus norvegicus
caaaccttaatgtccctctccagaa

SEQ ID NO: 637492 - DNA, 25 bp, Rattus norvegicus
tgagagcgtacctaaagccaaacct

SEQ ID NO: 637493 - DNA, 25 bp, Rattus norvegicus
ccatcccgtgctgagagcgtaccta

SEQ ID NO: 637494 - DNA, 25 bp, Rattus norvegicus
ggcgcgaggaaatcccatcccgtgc

SEQ ID NO: 637495 - DNA, 25 bp, Rattus norvegicus
ttgggaaaacgccaaccagcagcca

SEQ ID NO: 637496 - DNA, 25 bp, Rattus norvegicus
gcccttgcgatcgagtttcggcggc

SEQ ID NO: 637497 - DNA, 25 bp, Rattus norvegicus
gcagtcgcggacagtttgggaaaac

SEQ ID NO: 637498 - DNA, 25 bp, Rattus norvegicus
gcatcctcacctgacgtgaacagca

SEQ ID NO: 637499 - DNA, 25 bp, Rattus norvegicus
gacatccacgtaccggggctgcaga

SEQ ID NO: 637500 - DNA, 25 bp, Rattus norvegicus
ctgacgtgaacagcacgatggcttt

SEQ ID NO: 637501 - DNA, 25 bp, Rattus norvegicus
cacgatggctttgaggcagctgtac

SEQ ID NO: 637502 - DNA, 25 bp, Rattus norvegicus
tgagcttctccacctgttcctgaaa

SEQ ID NO: 637503 - DNA, 25 bp, Rattus norvegicus
ttcctgaaagatgcggatgtggtcc

SEQ ID NO: 637504 - DNA, 25 bp, Rattus norvegicus
atgaaggccacgacccggtccgcgg

SEQ ID NO: 637505 - DNA, 25 bp, Rattus norvegicus
cactgggccgcgttgagcacgaaca

SEQ ID NO: 637506 - DNA, 25 bp, Rattus norvegicus
tagcagggacacctggtcggtgatc

SEQ ID NO: 637507 - DNA, 25 bp, Rattus norvegicus
cacctggtcggtgatctgcagatcc

SEQ ID NO: 637508 - DNA, 25 bp, Rattus norvegicus
tgatctgcagatccgggaagaacgg

SEQ ID NO: 637509 - DNA, 25 bp, Rattus norvegicus
gggcggccaactcgcagatgttctc

SEQ ID NO: 637510 - DNA, 25 bp, Rattus norvegicus
ggctgcatgcactggctgccataac

SEQ ID NO: 637511 - DNA, 25 bp, Rattus norvegicus
agtccaggccatccatcaggccagg

SEQ ID NO: 637512 - DNA, 25 bp, Rattus norvegicus
cgggcgcgagcaggcctgtttaaaa

SEQ ID NO: 637513 - DNA, 25 bp, Rattus norvegicus
gtgacacttcatggcggggctcgac

SEQ ID NO: 637514 - DNA, 25 bp, Rattus norvegicus
gtagtgacacttcatggcggggctc

SEQ ID NO: 637515 - DNA, 25 bp, Rattus norvegicus
agtgcctcgtagtgacacttcatgg

SEQ ID NO: 637516 - DNA, 25 bp, Rattus norvegicus
cccagtgcctcgtagtgacacttca

SEQ ID NO: 637517 - DNA, 25 bp, Rattus norvegicus
ctcctcgctggcgtcgcgccgcacc

SEQ ID NO: 637518 - DNA, 25 bp, Rattus norvegicus
gtgccacctcaaggccagcttccga

SEQ ID NO: 637519 - DNA, 25 bp, Rattus norvegicus
gcaggcctgtttaaaagccagtccc

SEQ ID NO: 637520 - DNA, 25 bp, Rattus norvegicus
tgcacgccgactccgcttctcctcg

SEQ ID NO: 637521 - DNA, 25 bp, Rattus norvegicus
tctgcgggagcctgggaactccgaa

SEQ ID NO: 637522 - DNA, 25 bp, Rattus norvegicus
cgtgggaaactcgtgtcctttgcgg

SEQ ID NO: 637523 - DNA, 25 bp, Rattus norvegicus
gccgtgggaaactcgtgtcctttgc

SEQ ID NO: 637524 - DNA, 25 bp, Rattus norvegicus
ttgccggtcacctacccgggtgcca

SEQ ID NO: 637525 - DNA, 25 bp, Rattus norvegicus
cgcgagcaggcctgtttaaaagcca

SEQ ID NO: 637526 - DNA, 25 bp, Rattus norvegicus
ggatcggacgtcacctcaaaggcag

SEQ ID NO: 637527 - DNA, 25 bp, Rattus norvegicus
cgcgccaattagaactacccagtga

SEQ ID NO: 637528 - DNA, 25 bp, Rattus norvegicus
cctgttagcactgatcgcggggttt

SEQ ID NO: 637529 - DNA, 25 bp, Rattus norvegicus
gtagactatctaggcacccggcggc

SEQ ID NO: 637530 - DNA, 25 bp, Rattus norvegicus
aggcttgctggcttctggattctca

SEQ ID NO: 637531 - DNA, 25 bp, Rattus norvegicus
tgacaagggctttacgggatcggac

SEQ ID NO: 637532 - DNA, 25 bp, Rattus norvegicus
cgctttcttccggtcttgtggtaga

SEQ ID NO: 637533 - DNA, 25 bp, Rattus norvegicus
ctcgtgctcttgttaccctgtagga

SEQ ID NO: 637534 - DNA, 25 bp, Rattus norvegicus
cacgctgagccctgagttagtcatc

SEQ ID NO: 637535 - DNA, 25 bp, Rattus norvegicus
tccggctgtatcagacaaggaaacc

SEQ ID NO: 637536 - DNA, 25 bp, Rattus norvegicus
gttgagatcgccagtcctgttagca

SEQ ID NO: 637537 - DNA, 25 bp, Rattus norvegicus
tccgtgtctcaggttttcggagatc

SEQ ID NO: 637538 - DNA, 25 bp, Rattus norvegicus
gccgcgttagttgctgtccacactt

SEQ ID NO: 637539 - DNA, 25 bp, Rattus norvegicus
cgatctctatggtagtgcacgctga

SEQ ID NO: 637540 - DNA, 25 bp, Rattus norvegicus
caccagaccgccagaggaggcgagc

SEQ ID NO: 637541 - DNA, 25 bp, Rattus norvegicus
aggacgtccacgctcgcttttgatt

SEQ ID NO: 637542 - DNA, 25 bp, Rattus norvegicus
gctcccttgagtccgtaaaggaaca

SEQ ID NO: 637543 - DNA, 25 bp, Rattus norvegicus
gggcaacggcagcaccaccacgtgg

SEQ ID NO: 637544 - DNA, 25 bp, Rattus norvegicus
tcggcgcagtcccagacacaaaggc

SEQ ID NO: 637545 - DNA, 25 bp, Rattus norvegicus
cggccaaagctgtgtccagaccata

SEQ ID NO: 637546 - DNA, 25 bp, Rattus norvegicus
cgctcgcttttgatttctgtggaac

SEQ ID NO: 637547 - DNA, 25 bp, Rattus norvegicus
aagtcggacctctctttctgccaga

SEQ ID NO: 637548 - DNA, 25 bp, Rattus norvegicus
gttctcccgaatccggtcattcatt

SEQ ID NO: 637549 - DNA, 25 bp, Rattus norvegicus
gggcgcagacacatcgttctcccga

SEQ ID NO: 637550 - DNA, 25 bp, Rattus norvegicus
tccaagttcagccaagaggtgggtc

SEQ ID NO: 637551 - DNA, 25 bp, Rattus norvegicus
tccgtcttctgcttttccaagttca

SEQ ID NO: 637552 - DNA, 25 bp, Rattus norvegicus
caatagcggactgtgggtctctaga

SEQ ID NO: 637553 - DNA, 25 bp, Rattus norvegicus
tcttccgtggacagtgggcggccaa

SEQ ID NO: 637554 - DNA, 25 bp, Rattus norvegicus
tggcgctggacctgaagcggtctcc

SEQ ID NO: 637555 - DNA, 25 bp, Rattus norvegicus
gacgtgttgctggagcccttccgtt

SEQ ID NO: 637556 - DNA, 25 bp, Rattus norvegicus
gcaagcgctcgctggcgctggacct

SEQ ID NO: 637557 - DNA, 25 bp, Rattus norvegicus
gacagactgggctccgtgaaccacc

SEQ ID NO: 637558 - DNA, 25 bp, Rattus norvegicus
tgctcgtggacagactgggctccgt

SEQ ID NO: 637559 - DNA, 25 bp, Rattus norvegicus
atgatcctggcggacttcggcgccg

SEQ ID NO: 637560 - DNA, 25 bp, Rattus norvegicus
cagggccgttctgcgggatgatcct

SEQ ID NO: 637561 - DNA, 25 bp, Rattus norvegicus
tcaccgtagggttggccatggcgct

SEQ ID NO: 637562 - DNA, 25 bp, Rattus norvegicus
tcagatgtcaccgtagggttggcca

SEQ ID NO: 637563 - DNA, 25 bp, Rattus norvegicus
gccgggccgctcagatgtcaccgta

SEQ ID NO: 637564 - DNA, 25 bp, Rattus norvegicus
caataaactgcggtcccgcgccggg

SEQ ID NO: 637565 - DNA, 25 bp, Rattus norvegicus
tgtgtacaataaactgcggtcccgc

SEQ ID NO: 637566 - DNA, 25 bp, Rattus norvegicus
cggcggggtgtgtacaataaactgc

SEQ ID NO: 637567 - DNA, 25 bp, Rattus norvegicus
gagcccttccgttgcggtgagccct

SEQ ID NO: 637568 - DNA, 25 bp, Rattus norvegicus
tctgcaagcccgagagtcagcgctt

SEQ ID NO: 637569 - DNA, 25 bp, Rattus norvegicus
tgtcggcactcagcatccgttttga

SEQ ID NO: 637570 - DNA, 25 bp, Rattus norvegicus
ttctaagaaggctgaagaccgctcc

SEQ ID NO: 637571 - DNA, 25 bp, Rattus norvegicus
agaccgctcctggaaactggacgct

SEQ ID NO: 637572 - DNA, 25 bp, Rattus norvegicus
caggtgcccgagctttctaagaagg

SEQ ID NO: 637573 - DNA, 25 bp, Rattus norvegicus
tgcgctttgggcatgttctgcaagc

SEQ ID NO: 637574 - DNA, 25 bp, Rattus norvegicus
ccacttgcatgctcaggtgcgcttt

SEQ ID NO: 637575 - DNA, 25 bp, Rattus norvegicus
acccgcagctgccttactcatgggg

SEQ ID NO: 637576 - DNA, 25 bp, Rattus norvegicus
cgaagaatccggagagctcatcacc

SEQ ID NO: 637577 - DNA, 25 bp, Rattus norvegicus
aagtctgggatcaggccgaagaatc

SEQ ID NO: 637578 - DNA, 25 bp, Rattus norvegicus
ctgttggcaacctccagcaagtctg

SEQ ID NO: 637579 - DNA, 25 bp, Rattus norvegicus
cagcgacgcattgctgctcctgttg

SEQ ID NO: 637580 - DNA, 25 bp, Rattus norvegicus
accacaagtcctgaagctgcagcga

SEQ ID NO: 637581 - DNA, 25 bp, Rattus norvegicus
aggatccgtaccctggcctctgtgt

SEQ ID NO: 637582 - DNA, 25 bp, Rattus norvegicus
gaagggctgctagccttctcctccg

SEQ ID NO: 637583 - DNA, 25 bp, Rattus norvegicus
aggccaatgaaccacgccgagaggc

SEQ ID NO: 637584 - DNA, 25 bp, Rattus norvegicus
gctcccaggacaaaaccacactgtg

SEQ ID NO: 637585 - DNA, 25 bp, Rattus norvegicus
tcctccgacatagaaggaccgctga

SEQ ID NO: 637586 - DNA, 25 bp, Rattus norvegicus
gaccgctgagagacaaaatccaaga

SEQ ID NO: 637587 - DNA, 25 bp, Rattus norvegicus
tccaagaactacacggcacaaaaga

SEQ ID NO: 637588 - DNA, 25 bp, Rattus norvegicus
tacacggcacaaaagaccctaaagc

SEQ ID NO: 637589 - DNA, 25 bp, Rattus norvegicus
gcagtgccggctcccaggacaaaac

SEQ ID NO: 637590 - DNA, 25 bp, Rattus norvegicus
acttgcaattctgcactgcgcgtgc

SEQ ID NO: 637591 - DNA, 25 bp, Rattus norvegicus
tggcccaggcggaaccagctaacca

SEQ ID NO: 637592 - DNA, 25 bp, Rattus norvegicus
ggcggaaccagctaaccagctgatg

SEQ ID NO: 637593 - DNA, 25 bp, Rattus norvegicus
aaccagctgatgcaacgggacgcca

SEQ ID NO: 637594 - DNA, 25 bp, Rattus norvegicus
gcccggcatggacacaaggccaatg

SEQ ID NO: 637595 - DNA, 25 bp, Rattus norvegicus
ggggaagacttgcaattctgcactg

SEQ ID NO: 637596 - DNA, 25 bp, Rattus norvegicus
ttcgaagaaggcctccgccaggtta

SEQ ID NO: 637597 - DNA, 25 bp, Rattus norvegicus
cgatgtccgcagtttcgggctcacc

SEQ ID NO: 637598 - DNA, 25 bp, Rattus norvegicus
tgtccgcagtttcgggctcacctga

SEQ ID NO: 637599 - DNA, 25 bp, Rattus norvegicus
ctcacctgacgctcaaggcccgctc

SEQ ID NO: 637600 - DNA, 25 bp, Rattus norvegicus
cgcttcagcccgcttccggccagcc

SEQ ID NO: 637601 - DNA, 25 bp, Rattus norvegicus
ctgagggcgagtcaccgagagaaag

SEQ ID NO: 637602 - DNA, 25 bp, Rattus norvegicus
agcagaactttcgaagaaggcctcc

SEQ ID NO: 637603 - DNA, 25 bp, Rattus norvegicus
gaccgagcgggccactcaccctcag

SEQ ID NO: 637604 - DNA, 25 bp, Rattus norvegicus
cctcagccgctctgtaggtcagtca

SEQ ID NO: 637605 - DNA, 25 bp, Rattus norvegicus
ctgtaggtcagtcagtctccgcgtc

SEQ ID NO: 637606 - DNA, 25 bp, Rattus norvegicus
gtcagtcagtctccgcgtcagcgac

SEQ ID NO: 637607 - DNA, 25 bp, Rattus norvegicus
gtcagcgactccctccgcaccgtcg

SEQ ID NO: 637608 - DNA, 25 bp, Rattus norvegicus
ggcggagccataggccacgcctcca

SEQ ID NO: 637609 - DNA, 25 bp, Rattus norvegicus
cgagagaaagccgagcagaactttc

SEQ ID NO: 637610 - DNA, 25 bp, Rattus norvegicus
tgcgagtactccgtgtccttgtgct

SEQ ID NO: 637611 - DNA, 25 bp, Rattus norvegicus
agcacctcgatcttttgagccgcca

SEQ ID NO: 637612 - DNA, 25 bp, Rattus norvegicus
ttggtatttggccacacctgtcata

SEQ ID NO: 637613 - DNA, 25 bp, Rattus norvegicus
gtgtgcaagccctcctcctggaaaa

SEQ ID NO: 637614 - DNA, 25 bp, Rattus norvegicus
ccgggccagcgagaacaagtacgaa

SEQ ID NO: 637615 - DNA, 25 bp, Rattus norvegicus
ccaaactgaagagcgcgcggttgcc

SEQ ID NO: 637616 - DNA, 25 bp, Rattus norvegicus
tggcggaacagagcgagcatcatct

SEQ ID NO: 637617 - DNA, 25 bp, Rattus norvegicus
ccctcgagagtgaagtagcagtttc

SEQ ID NO: 637618 - DNA, 25 bp, Rattus norvegicus
tcccggggcaatagcacaagcacct

SEQ ID NO: 637619 - DNA, 25 bp, Rattus norvegicus
accttcccgggactgtctaggcaca

SEQ ID NO: 637620 - DNA, 25 bp, Rattus norvegicus
ctgggtcaggcagctcacacttgaa

SEQ ID NO: 637621 - DNA, 25 bp, Rattus norvegicus
tgccctggatgtagcgcactatgtc

SEQ ID NO: 637622 - DNA, 25 bp, Rattus norvegicus
tatgtcgtccaggtccaagtctttg

SEQ ID NO: 637623 - DNA, 25 bp, Rattus norvegicus
gcggttgccacagtcagagtcttca

SEQ ID NO: 637624 - DNA, 25 bp, Rattus norvegicus
gagcttctatttctcccggcaagga

SEQ ID NO: 637625 - DNA, 25 bp, Rattus norvegicus
gggccttgcgccagcgccattttat

SEQ ID NO: 637626 - DNA, 25 bp, Rattus norvegicus
ggaggaccttaagagcttctatttc

SEQ ID NO: 637627 - DNA, 25 bp, Rattus norvegicus
cgcggacaagagtggaggaccttaa

SEQ ID NO: 637628 - DNA, 25 bp, Rattus norvegicus
tagcgcagcctcaaggcagaccgcg

SEQ ID NO: 637629 - DNA, 25 bp, Rattus norvegicus
ctagagcccagccatgttcgccgag

SEQ ID NO: 637630 - DNA, 25 bp, Rattus norvegicus
ctggggctacgaccggtctcaggaa

SEQ ID NO: 637631 - DNA, 25 bp, Rattus norvegicus
tcgcggccaggaagctacagaaagc

SEQ ID NO: 637632 - DNA, 25 bp, Rattus norvegicus
aattggcctagggtcccgcgcactc

SEQ ID NO: 637633 - DNA, 25 bp, Rattus norvegicus
ttgctccggactgacagagagccgg

SEQ ID NO: 637634 - DNA, 25 bp, Rattus norvegicus
gagagccggaagtgacggcaactta

SEQ ID NO: 637635 - DNA, 25 bp, Rattus norvegicus
tggctccgcccaatggcacgaagga

SEQ ID NO: 637636 - DNA, 25 bp, Rattus norvegicus
gctgcagcctcgaggaattggccta

SEQ ID NO: 637637 - DNA, 25 bp, Rattus norvegicus
acggcaacttagaggctctggctcc

SEQ ID NO: 637638 - DNA, 25 bp, Rattus norvegicus
tctcccaggatgcatcgcactagcg

SEQ ID NO: 637639 - DNA, 25 bp, Rattus norvegicus
agcccgagcccatgattcccatatg

SEQ ID NO: 637640 - DNA, 25 bp, Rattus norvegicus
tgaaacagagaacaaacgcagacgc

SEQ ID NO: 637641 - DNA, 25 bp, Rattus norvegicus
cgtagtcccacgagggaactccaca

SEQ ID NO: 637642 - DNA, 25 bp, Rattus norvegicus
cctatggtgagtctaatgtggcccg

SEQ ID NO: 637643 - DNA, 25 bp, Rattus norvegicus
tgattcccatatgccctgtagtttc

SEQ ID NO: 637644 - DNA, 25 bp, Rattus norvegicus
cactagcgcgcttgcgctgtgcggc

SEQ ID NO: 637645 - DNA, 25 bp, Rattus norvegicus
cgtggggcgtgaggactacatctcc

SEQ ID NO: 637646 - DNA, 25 bp, Rattus norvegicus
tttggataaggctgggcccgtagtc

SEQ ID NO: 637647 - DNA, 25 bp, Rattus norvegicus
gtgcgagtcaccatcgctttggata

SEQ ID NO: 637648 - DNA, 25 bp, Rattus norvegicus
gaggcgctcttcctccgccttgtag

SEQ ID NO: 637649 - DNA, 25 bp, Rattus norvegicus
ggccagcagacgtcactctctctgg

SEQ ID NO: 637650 - DNA, 25 bp, Rattus norvegicus
taaggcggcgaaaaggccagcagac

SEQ ID NO: 637651 - DNA, 25 bp, Rattus norvegicus
ctgtagtttctttcacctatggtga

SEQ ID NO: 637652 - DNA, 25 bp, Rattus norvegicus
gctcaacggcctctacgcgacgccc

SEQ ID NO: 637653 - DNA, 25 bp, Rattus norvegicus
gagtctcaggctcaacggcctctac

SEQ ID NO: 637654 - DNA, 25 bp, Rattus norvegicus
caacggcctctacgcgacgcccccg

SEQ ID NO: 637655 - DNA, 25 bp, Rattus norvegicus
aggctcaacggcctctacgcgacgc

SEQ ID NO: 637656 - DNA, 25 bp, Rattus norvegicus
agtctcaggctcaacggcctctacg

SEQ ID NO: 637657 - DNA, 25 bp, Rattus norvegicus
ggagtctcaggctcaacggcctcta

SEQ ID NO: 637658 - DNA, 25 bp, Rattus norvegicus
cggagtctcaggctcaacggcctct

SEQ ID NO: 637659 - DNA, 25 bp, Rattus norvegicus
cctcgcaccgggtgcggagtctcag

SEQ ID NO: 637660 - DNA, 25 bp, Rattus norvegicus
acctcgcaccgggtgcggagtctca

SEQ ID NO: 637661 - DNA, 25 bp, Rattus norvegicus
gtgagcgaaggggacctcgcaccgg

SEQ ID NO: 637662 - DNA, 25 bp, Rattus norvegicus
agagtgagcgaaggggacctcgcac

SEQ ID NO: 637663 - DNA, 25 bp, Rattus norvegicus
agagagtgagcgaaggggacctcgc

SEQ ID NO: 637664 - DNA, 25 bp, Rattus norvegicus
tggagagagtgagcgaaggggacct

SEQ ID NO: 637665 - DNA, 25 bp, Rattus norvegicus
tctcaggctcaacggcctctacgcg

SEQ ID NO: 637666 - DNA, 25 bp, Rattus norvegicus
atcttcctttggctccgggaatgga

SEQ ID NO: 637667 - DNA, 25 bp, Rattus norvegicus
taaaatggcctcccgcggacttgga

SEQ ID NO: 637668 - DNA, 25 bp, Rattus norvegicus
cttcctttggctccgggaatggaga

SEQ ID NO: 637669 - DNA, 25 bp, Rattus norvegicus
ttatcttcctttggctccgggaatg

SEQ ID NO: 637670 - DNA, 25 bp, Rattus norvegicus
ctcttatcttcctttggctccggga

SEQ ID NO: 637671 - DNA, 25 bp, Rattus norvegicus
acctcttatcttcctttggctccgg

SEQ ID NO: 637672 - DNA, 25 bp, Rattus norvegicus
tcccgcggacttggagcggagccga

SEQ ID NO: 637673 - DNA, 25 bp, Rattus norvegicus
gccactgaggtaaaatggcctcccg

SEQ ID NO: 637674 - DNA, 25 bp, Rattus norvegicus
tccacggccactgaggtaaaatggc

SEQ ID NO: 637675 - DNA, 25 bp, Rattus norvegicus
cttccacggccactgaggtaaaatg

SEQ ID NO: 637676 - DNA, 25 bp, Rattus norvegicus
gccttccacggccactgaggtaaaa

SEQ ID NO: 637677 - DNA, 25 bp, Rattus norvegicus
gctggggccttccacggccactgag

SEQ ID NO: 637678 - DNA, 25 bp, Rattus norvegicus
ccggcatcagggagaggtccccaga

SEQ ID NO: 637679 - DNA, 25 bp, Rattus norvegicus
ctgaggtaaaatggcctcccgcgga

SEQ ID NO: 637680 - DNA, 25 bp, Rattus norvegicus
gacgctcctcttgaagaaacttttg

SEQ ID NO: 637681 - DNA, 25 bp, Rattus norvegicus
gtcgtcctgcggatctcgccagctg

SEQ ID NO: 637682 - DNA, 25 bp, Rattus norvegicus
ctggcccggggtctgcggcgtgtgc

SEQ ID NO: 637683 - DNA, 25 bp, Rattus norvegicus
gttgcccccggccacgtcgtcctgc

SEQ ID NO: 637684 - DNA, 25 bp, Rattus norvegicus
cggggtcgccggagccaagcccgag

SEQ ID NO: 637685 - DNA, 25 bp, Rattus norvegicus
ccagctgctaactaccattgccata

SEQ ID NO: 637686 - DNA, 25 bp, Rattus norvegicus
gccagctgctaactaccattgccat

SEQ ID NO: 637687 - DNA, 25 bp, Rattus norvegicus
tctcgccagctgctaactaccattg

SEQ ID NO: 637688 - DNA, 25 bp, Rattus norvegicus
gatctcgccagctgctaactaccat

SEQ ID NO: 637689 - DNA, 25 bp, Rattus norvegicus
ggatctcgccagctgctaactacca

SEQ ID NO: 637690 - DNA, 25 bp, Rattus norvegicus
gcggatctcgccagctgctaactac

SEQ ID NO: 637691 - DNA, 25 bp, Rattus norvegicus
tgcggatctcgccagctgctaacta

SEQ ID NO: 637692 - DNA, 25 bp, Rattus norvegicus
tcctgcggatctcgccagctgctaa

SEQ ID NO: 637693 - DNA, 25 bp, Rattus norvegicus
tgctgctggctctggcccgaacccg

SEQ ID NO: 637694 - DNA, 25 bp, Rattus norvegicus
cgcgggtggtgcactgctttccgtc

SEQ ID NO: 637695 - DNA, 25 bp, Rattus norvegicus
tgagtctttagagctcgcctgccgc

SEQ ID NO: 637696 - DNA, 25 bp, Rattus norvegicus
tcgttgcttcgcaaggcggcggaat

SEQ ID NO: 637697 - DNA, 25 bp, Rattus norvegicus
cctggactttcttcgtgagtcttta

SEQ ID NO: 637698 - DNA, 25 bp, Rattus norvegicus
gtatgctctgccctggactttcttc

SEQ ID NO: 637699 - DNA, 25 bp, Rattus norvegicus
ctcgcagcttggtgtgtatgctctg

SEQ ID NO: 637700 - DNA, 25 bp, Rattus norvegicus
gtttcccggcagctcgcagcttggt

SEQ ID NO: 637701 - DNA, 25 bp, Rattus norvegicus
tagcagaaagcttgggtggttgaaa

SEQ ID NO: 637702 - DNA, 25 bp, Rattus norvegicus
tatccgggaaggtagcagaaagctt

SEQ ID NO: 637703 - DNA, 25 bp, Rattus norvegicus
cccagcgccttaggtatccgggaag

SEQ ID NO: 637704 - DNA, 25 bp, Rattus norvegicus
agggcagggccctgtcgttcaccac

SEQ ID NO: 637705 - DNA, 25 bp, Rattus norvegicus
acaggggcgcttcctgcccgagtgc

SEQ ID NO: 637706 - DNA, 25 bp, Rattus norvegicus
ccttcgtgtcgtacgtgcgccctga

SEQ ID NO: 637707 - DNA, 25 bp, Rattus norvegicus
actgctttccgtccgcgctgctgta

SEQ ID NO: 637708 - DNA, 25 bp, Rattus norvegicus
cgacgacgacaagggcgactccaag

SEQ ID NO: 637709 - DNA, 25 bp, Rattus norvegicus
ccgcgacgagcaggacgacgacgac

SEQ ID NO: 637710 - DNA, 25 bp, Rattus norvegicus
cctcgcggaacgctgccgacaagga

SEQ ID NO: 637711 - DNA, 25 bp, Rattus norvegicus
atgacctcgctgacccagcggagct

SEQ ID NO: 637712 - DNA, 25 bp, Rattus norvegicus
gctcttcggctggagccatgacctc

SEQ ID NO: 637713 - DNA, 25 bp, Rattus norvegicus
tgacgtcaacgcgcgccgccatatt

SEQ ID NO: 637714 - DNA, 25 bp, Rattus norvegicus
tccctgtcggtctggcgcggctctt

SEQ ID NO: 637715 - DNA, 25 bp, Rattus norvegicus
attaacacggaagctcctggggccg

SEQ ID NO: 637716 - DNA, 25 bp, Rattus norvegicus
cccagctccgagaattaacacggaa

SEQ ID NO: 637717 - DNA, 25 bp, Rattus norvegicus
tgtgtatcccatcgacgcctggcgc

SEQ ID NO: 637718 - DNA, 25 bp, Rattus norvegicus
ggctcccttgtgtatcccatcgacg

SEQ ID NO: 637719 - DNA, 25 bp, Rattus norvegicus
gcgggctgaaggctcccttgtgtat

SEQ ID NO: 637720 - DNA, 25 bp, Rattus norvegicus
ccgccatattgggaagtgccaccgc

SEQ ID NO: 637721 - DNA, 25 bp, Rattus norvegicus
cgacaagggcgactccaaggaaacg

SEQ ID NO: 637722 - DNA, 25 bp, Rattus norvegicus
ttcacctgttcgtggatcggcggag

SEQ ID NO: 637723 - DNA, 25 bp, Rattus norvegicus
gcgcaatcccgagcgtcttgagatc

SEQ ID NO: 637724 - DNA, 25 bp, Rattus norvegicus
gccgcgtcccactgcccgccgccag

SEQ ID NO: 637725 - DNA, 25 bp, Rattus norvegicus
atcccgagcgtcttgagatcggtcg

SEQ ID NO: 637726 - DNA, 25 bp, Rattus norvegicus
aggcgcaatcccgagcgtcttgaga

SEQ ID NO: 637727 - DNA, 25 bp, Rattus norvegicus
ccgcggtaggcgcaatcccgagcgt

SEQ ID NO: 637728 - DNA, 25 bp, Rattus norvegicus
gcggtgcccgcgcagctaccgccgc

SEQ ID NO: 637729 - DNA, 25 bp, Rattus norvegicus
atcggcggaggctcgagccgctcct

SEQ ID NO: 637730 - DNA, 25 bp, Rattus norvegicus
caccaggtctcttcacctgttcgtg

SEQ ID NO: 637731 - DNA, 25 bp, Rattus norvegicus
gtagcaccaggtctcttcacctgtt

SEQ ID NO: 637732 - DNA, 25 bp, Rattus norvegicus
ggcgaccgtagcaccaggtctcttc

SEQ ID NO: 637733 - DNA, 25 bp, Rattus norvegicus
ccgtggcgaccgtagcaccaggtct

SEQ ID NO: 637734 - DNA, 25 bp, Rattus norvegicus
tcctggggttacgagctccgctacc

SEQ ID NO: 637735 - DNA, 25 bp, Rattus norvegicus
cgctcctggcgcgtccagactcagg

SEQ ID NO: 637736 - DNA, 25 bp, Rattus norvegicus
ctggcgggagatgcaaactagacta

SEQ ID NO: 637737 - DNA, 25 bp, Rattus norvegicus
gcagatctgcctccagggcgaaaga

SEQ ID NO: 637738 - DNA, 25 bp, Rattus norvegicus
tgctggtcaagtctctgcaggctgc

SEQ ID NO: 637739 - DNA, 25 bp, Rattus norvegicus
ccacggtccattagcggcggaaacg

SEQ ID NO: 637740 - DNA, 25 bp, Rattus norvegicus
tgcgcttccggattggaggacaaca

SEQ ID NO: 637741 - DNA, 25 bp, Rattus norvegicus
ggcgtgtgtgagacctgtagacatt

SEQ ID NO: 637742 - DNA, 25 bp, Rattus norvegicus
gacgtccgtcactctctctgatcta

SEQ ID NO: 637743 - DNA, 25 bp, Rattus norvegicus
ggcccagctttctcggctttgcttt

SEQ ID NO: 637744 - DNA, 25 bp, Rattus norvegicus
agtccgggactgagcgaaacgatcc

SEQ ID NO: 637745 - DNA, 25 bp, Rattus norvegicus
acagatcccgttgatgtggagcagc

SEQ ID NO: 637746 - DNA, 25 bp, Rattus norvegicus
gcctttcatctatttgtggagcaca

SEQ ID NO: 637747 - DNA, 25 bp, Rattus norvegicus
gagtcccggagtctggcacttaacc

SEQ ID NO: 637748 - DNA, 25 bp, Rattus norvegicus
agttgctcatcgtcctgcaggaggc

SEQ ID NO: 637749 - DNA, 25 bp, Rattus norvegicus
ctgccgtggaggctgttatagtaac

SEQ ID NO: 637750 - DNA, 25 bp, Rattus norvegicus
cccacagcctcgcagcagttgatgg

SEQ ID NO: 637751 - DNA, 25 bp, Rattus norvegicus
gtgatgaagagagcgcccgagctcc

SEQ ID NO: 637752 - DNA, 25 bp, Rattus norvegicus
cgggcgctgcctcacttagagaggc

SEQ ID NO: 637753 - DNA, 25 bp, Rattus norvegicus
tgcggatccatgagagcagctaacg

SEQ ID NO: 637754 - DNA, 25 bp, Rattus norvegicus
tccggtcacgttgctgggtgtttac

SEQ ID NO: 637755 - DNA, 25 bp, Rattus norvegicus
agctcgttcgccagttccggtcacg

SEQ ID NO: 637756 - DNA, 25 bp, Rattus norvegicus
gccagacctgaggattcggctgccc

SEQ ID NO: 637757 - DNA, 25 bp, Rattus norvegicus
agctaccagtcaaggccagacctga

SEQ ID NO: 637758 - DNA, 25 bp, Rattus norvegicus
gttccctcctaagctaccagtcaag

SEQ ID NO: 637759 - DNA, 25 bp, Rattus norvegicus
gctctctcgggtccgcaggtgagca

SEQ ID NO: 637760 - DNA, 25 bp, Rattus norvegicus
agagctcttcccgagacccagcgag

SEQ ID NO: 637761 - DNA, 25 bp, Rattus norvegicus
agctaacgcgggagaagagctcttc

SEQ ID NO: 637762 - DNA, 25 bp, Rattus norvegicus
ctgcggtgtctcagttccctcctaa

SEQ ID NO: 637763 - DNA, 25 bp, Rattus norvegicus
tggcagaagttgtcctccgccgcca

SEQ ID NO: 637764 - DNA, 25 bp, Rattus norvegicus
ccctaggcggctcggtcttaccagg

SEQ ID NO: 637765 - DNA, 25 bp, Rattus norvegicus
agagaccgaacccacctctgtttgc

SEQ ID NO: 637766 - DNA, 25 bp, Rattus norvegicus
acgtcggcaggcagctttccctcgt

SEQ ID NO: 637767 - DNA, 25 bp, Rattus norvegicus
cagcagcgccaccaatgcaaccgga

SEQ ID NO: 637768 - DNA, 25 bp, Rattus norvegicus
gctgagcatccctcccaactccgtg

SEQ ID NO: 637769 - DNA, 25 bp, Rattus norvegicus
cggcgcagaggaccgctctctttct

SEQ ID NO: 637770 - DNA, 25 bp, Rattus norvegicus
ccgcattggcaacagagaccgaacc

SEQ ID NO: 637771 - DNA, 25 bp, Rattus norvegicus
ggcttccatcaacgctacggaatta

SEQ ID NO: 637772 - DNA, 25 bp, Rattus norvegicus
tcaacgctacggaattaaaataata

SEQ ID NO: 637773 - DNA, 25 bp, Rattus norvegicus
catgtataaagaggaaagagaagga

SEQ ID NO: 637774 - DNA, 25 bp, Rattus norvegicus
aaggaagagaggaaacgcacgcaca

SEQ ID NO: 637775 - DNA, 25 bp, Rattus norvegicus
gagaggaaacgcacgcacaagctcc

SEQ ID NO: 637776 - DNA, 25 bp, Rattus norvegicus
cacaagctcccgcattggcaacaga

SEQ ID NO: 637777 - DNA, 25 bp, Rattus norvegicus
tctctttctctgattggcttccatc

SEQ ID NO: 637778 - DNA, 25 bp, Rattus norvegicus
cgcgtcgcttttcgcttcggggccg

SEQ ID NO: 637779 - DNA, 25 bp, Rattus norvegicus
cgtcggttctggctaggctgtcccg

SEQ ID NO: 637780 - DNA, 25 bp, Rattus norvegicus
ttctggctaggctgtcccggttact

SEQ ID NO: 637781 - DNA, 25 bp, Rattus norvegicus
aggctgtcccggttactctttgacg

SEQ ID NO: 637782 - DNA, 25 bp, Rattus norvegicus
tgtcccggttactctttgacggcca

SEQ ID NO: 637783 - DNA, 25 bp, Rattus norvegicus
cggttactctttgacggccacgctt

SEQ ID NO: 637784 - DNA, 25 bp, Rattus norvegicus
gttactctttgacggccacgctttg

SEQ ID NO: 637785 - DNA, 25 bp, Rattus norvegicus
ccacgctttgctcggagctggcgac

SEQ ID NO: 637786 - DNA, 25 bp, Rattus norvegicus
tccgccgcgtccttgggcttctcct

SEQ ID NO: 637787 - DNA, 25 bp, Rattus norvegicus
tgggcttctcctccgcgctctcctt

SEQ ID NO: 637788 - DNA, 25 bp, Rattus norvegicus
gctctccttgacctcggtggcgtcg

SEQ ID NO: 637789 - DNA, 25 bp, Rattus norvegicus
tctccttgacctcggtggcgtcggc

SEQ ID NO: 637790 - DNA, 25 bp, Rattus norvegicus
ctggggttcgctctccttctgggtc

SEQ ID NO: 637791 - DNA, 25 bp, Rattus norvegicus
ctttgacggccacgctttgctcgga

SEQ ID NO: 637792 - DNA, 25 bp, Rattus norvegicus
tgttggcgatgtccacaggttagtg

SEQ ID NO: 637793 - DNA, 25 bp, Rattus norvegicus
cctccttaccggctttgggtgcctg

SEQ ID NO: 637794 - DNA, 25 bp, Rattus norvegicus
cggttcccagccacgcattgtgtgc

SEQ ID NO: 637795 - DNA, 25 bp, Rattus norvegicus
ggcccgttttctgagcgcaaggctc

SEQ ID NO: 637796 - DNA, 25 bp, Rattus norvegicus
cgcagaccgagctagggctttgatc

SEQ ID NO: 637797 - DNA, 25 bp, Rattus norvegicus
ccttccgatcagaccagattccgtg

SEQ ID NO: 637798 - DNA, 25 bp, Rattus norvegicus
tgcccgttccgctgacagaagactg

SEQ ID NO: 637799 - DNA, 25 bp, Rattus norvegicus
gccaggggattcgatgccttgaaaa

SEQ ID NO: 637800 - DNA, 25 bp, Rattus norvegicus
cgcattcggtatttcccggtcacca

SEQ ID NO: 637801 - DNA, 25 bp, Rattus norvegicus
gcgacagagcccacttagaggaatc

SEQ ID NO: 637802 - DNA, 25 bp, Rattus norvegicus
ttagaggaatcccacgcccactgtg

SEQ ID NO: 637803 - DNA, 25 bp, Rattus norvegicus
cgcacccagtctgcaccgttggaga

SEQ ID NO: 637804 - DNA, 25 bp, Rattus norvegicus
caccgttggagaaccctaggcttca

SEQ ID NO: 637805 - DNA, 25 bp, Rattus norvegicus
cattgtgtgccatcggatccaggga

SEQ ID NO: 637806 - DNA, 25 bp, Rattus norvegicus
ctacagtgggcgtaaccaggcgcca

SEQ ID NO: 637807 - DNA, 25 bp, Rattus norvegicus
gacagcttctttcccgaggtgagtg

SEQ ID NO: 637808 - DNA, 25 bp, Rattus norvegicus
tttgagtttgtcctgcgctcgcatg

SEQ ID NO: 637809 - DNA, 25 bp, Rattus norvegicus
cccgagtctaggatgagtaagccta

SEQ ID NO: 637810 - DNA, 25 bp, Rattus norvegicus
gggaaactttgtgggagtctcctga

SEQ ID NO: 637811 - DNA, 25 bp, Rattus norvegicus
ctgcgcgtcccaggaggggaaactt

SEQ ID NO: 637812 - DNA, 25 bp, Rattus norvegicus
cgctgctctgacttccgcaactgga

SEQ ID NO: 637813 - DNA, 25 bp, Rattus norvegicus
gattcccgggatctgccgctgctct

SEQ ID NO: 637814 - DNA, 25 bp, Rattus norvegicus
gcgcaccgtgacacgcgtggattcc

SEQ ID NO: 637815 - DNA, 25 bp, Rattus norvegicus
cttcgcccagaagtgaggaacttgg

SEQ ID NO: 637816 - DNA, 25 bp, Rattus norvegicus
gaatgtgccaccagctgttctccgc

SEQ ID NO: 637817 - DNA, 25 bp, Rattus norvegicus
cttgctggtgatccgctgtcctcca

SEQ ID NO: 637818 - DNA, 25 bp, Rattus norvegicus
tgagagcaggcgctcagtctcctca

SEQ ID NO: 637819 - DNA, 25 bp, Rattus norvegicus
ccggagtgctcaccgttgttggctt

SEQ ID NO: 637820 - DNA, 25 bp, Rattus norvegicus
gcagcgtgacattctccaactccta

SEQ ID NO: 637821 - DNA, 25 bp, Rattus norvegicus
tggggacctacaacagttccggagc

SEQ ID NO: 637822 - DNA, 25 bp, Rattus norvegicus
gagtccacgtactgcatgccgcaga

SEQ ID NO: 637823 - DNA, 25 bp, Rattus norvegicus
ggatggcgccattacctcaggcagc

SEQ ID NO: 637824 - DNA, 25 bp, Rattus norvegicus
gagcgcagtcctccgtgagtatctg

SEQ ID NO: 637825 - DNA, 25 bp, Rattus norvegicus
gttccggagcgtaccggttcagctc

SEQ ID NO: 637826 - DNA, 25 bp, Rattus norvegicus
cagactataggtattccgtggggac

SEQ ID NO: 637827 - DNA, 25 bp, Rattus norvegicus
ttctccaactcctacgggagccagt

SEQ ID NO: 637828 - DNA, 25 bp, Rattus norvegicus
tacctcaggcagcagcgtgacattc

SEQ ID NO: 637829 - DNA, 25 bp, Rattus norvegicus
gacgattatgaggatggcgccatta

SEQ ID NO: 637830 - DNA, 25 bp, Rattus norvegicus
tatgactatgaccaggacgattatg

SEQ ID NO: 637831 - DNA, 25 bp, Rattus norvegicus
cccgatggcgactatgactatgacc

SEQ ID NO: 637832 - DNA, 25 bp, Rattus norvegicus
tgcatgccgcagaacaacggggacc

SEQ ID NO: 637833 - DNA, 25 bp, Rattus norvegicus
tcagctcagaaggagcgcagtcctc

SEQ ID NO: 637834 - DNA, 25 bp, Rattus norvegicus
ttcacgccagcgacgaattcacagc

SEQ ID NO: 637835 - DNA, 25 bp, Rattus norvegicus
gcgaggaagatcacacactttgctc

SEQ ID NO: 637836 - DNA, 25 bp, Rattus norvegicus
agggccggacgcagccagccattca

SEQ ID NO: 637837 - DNA, 25 bp, Rattus norvegicus
tacgagataattcacgccagcgacg

SEQ ID NO: 637838 - DNA, 25 bp, Rattus norvegicus
gccggcgaggaagatcacacacttt

SEQ ID NO: 637839 - DNA, 25 bp, Rattus norvegicus
acactttgctctttttgttgtgcgg

SEQ ID NO: 637840 - DNA, 25 bp, Rattus norvegicus
ctctttttgttgtgcgggtggcgcc

SEQ ID NO: 637841 - DNA, 25 bp, Rattus norvegicus
agccctcgcccggtttcaagagtgc

SEQ ID NO: 637842 - DNA, 25 bp, Rattus norvegicus
gccgggttctctctgccttcttctt

SEQ ID NO: 637843 - DNA, 25 bp, Rattus norvegicus
cgggctgagccgacatagaggaagc

SEQ ID NO: 637844 - DNA, 25 bp, Rattus norvegicus
ggggagaaaaatacgagataattca

SEQ ID NO: 637845 - DNA, 25 bp, Rattus norvegicus
cctcgcccggtttcaagagtgcggg

SEQ ID NO: 637846 - DNA, 25 bp, Rattus norvegicus
tgccttcttctttcgggaggtgacg

SEQ ID NO: 637847 - DNA, 25 bp, Rattus norvegicus
acgcagccagccattcaggaaggca

SEQ ID NO: 637848 - DNA, 25 bp, Rattus norvegicus
gtgaccgccgaaggcttccaggagc

SEQ ID NO: 637849 - DNA, 25 bp, Rattus norvegicus
ggctaggtcgtctcttccttccggc

SEQ ID NO: 637850 - DNA, 25 bp, Rattus norvegicus
tacaagaccgactggcaccgctaca

SEQ ID NO: 637851 - DNA, 25 bp, Rattus norvegicus
accgtgtgcagcaagaagttcgcca

SEQ ID NO: 637852 - DNA, 25 bp, Rattus norvegicus
agaagttcgccacgttcaacgccta

SEQ ID NO: 637853 - DNA, 25 bp, Rattus norvegicus
gccgccaagtggagatgatgaacga

SEQ ID NO: 637854 - DNA, 25 bp, Rattus norvegicus
cgtggacagtgtgaacaaggatgcc

SEQ ID NO: 637855 - DNA, 25 bp, Rattus norvegicus
caaggatgccatgaacgccgccatc

SEQ ID NO: 637856 - DNA, 25 bp, Rattus norvegicus
gtctcccaagaaagcgcccttcatg

SEQ ID NO: 637857 - DNA, 25 bp, Rattus norvegicus
atgcagcgggctcactacaagaccg

SEQ ID NO: 637858 - DNA, 25 bp, Rattus norvegicus
ttcatgcccacggacgaatccagga

SEQ ID NO: 637859 - DNA, 25 bp, Rattus norvegicus
tggcgacgtacacctgcatcacctg

SEQ ID NO: 637860 - DNA, 25 bp, Rattus norvegicus
cctgcatcacctgccgggtggcgtt

SEQ ID NO: 637861 - DNA, 25 bp, Rattus norvegicus
tccggcccgacaatggcgacgtaca

SEQ ID NO: 637862 - DNA, 25 bp, Rattus norvegicus
agttccagcagggtcctctcaacac

SEQ ID NO: 637863 - DNA, 25 bp, Rattus norvegicus
ttagcgctcctctggctgcagtccg

SEQ ID NO: 637864 - DNA, 25 bp, Rattus norvegicus
tagccgggcggacagcctcgaagct

SEQ ID NO: 637865 - DNA, 25 bp, Rattus norvegicus
tggagccgcagtgccgcgcgcttct

SEQ ID NO: 637866 - DNA, 25 bp, Rattus norvegicus
cgcgcttctgagaggggcaatccgc

SEQ ID NO: 637867 - DNA, 25 bp, Rattus norvegicus
gcgaaggtcctagacgccttccgga

SEQ ID NO: 637868 - DNA, 25 bp, Rattus norvegicus
accatgagcgacgagggcagcaaac

SEQ ID NO: 637869 - DNA, 25 bp, Rattus norvegicus
agaccagcctgagacacgctccgta

SEQ ID NO: 637870 - DNA, 25 bp, Rattus norvegicus
cctgagacacgctccgtatgtagca

SEQ ID NO: 637871 - DNA, 25 bp, Rattus norvegicus
ctccgtatgtagcagccgcagcagc

SEQ ID NO: 637872 - DNA, 25 bp, Rattus norvegicus
gcgaccagcgctcgggacatcagca

SEQ ID NO: 637873 - DNA, 25 bp, Rattus norvegicus
gggacatcagcaccagcaccatcag

SEQ ID NO: 637874 - DNA, 25 bp, Rattus norvegicus
ggcgactcctgcgaaggtcctagac

SEQ ID NO: 637875 - DNA, 25 bp, Rattus norvegicus
ccgcgcctctggagcgcatcgtagg

SEQ ID NO: 637876 - DNA, 25 bp, Rattus norvegicus
agcgggactccagtttagcaatctc

SEQ ID NO: 637877 - DNA, 25 bp, Rattus norvegicus
agcaatctcccgcaggccaaagtca

SEQ ID NO: 637878 - DNA, 25 bp, Rattus norvegicus
caaagtcactgacaaagcggcagtc

SEQ ID NO: 637879 - DNA, 25 bp, Rattus norvegicus
agcggcagtcgcttacacttagctc

SEQ ID NO: 637880 - DNA, 25 bp, Rattus norvegicus
ctccttgatggaagtgcagtagatc

SEQ ID NO: 637881 - DNA, 25 bp, Rattus norvegicus
agatcaccaggtagcggagaccctc

SEQ ID NO: 637882 - DNA, 25 bp, Rattus norvegicus
cggagaccctcatccgtgagacgga

SEQ ID NO: 637883 - DNA, 25 bp, Rattus norvegicus
gtgtgcaagccttcgtcctccagca

SEQ ID NO: 637884 - DNA, 25 bp, Rattus norvegicus
aatgggcgatgctgaggtacctcaa

SEQ ID NO: 637885 - DNA, 25 bp, Rattus norvegicus
ccacatccgtgatgcggccgcaatg

SEQ ID NO: 637886 - DNA, 25 bp, Rattus norvegicus
gtaacgaatgcccacatccgtgatg

SEQ ID NO: 637887 - DNA, 25 bp, Rattus norvegicus
tgctgcagtatttagccacgtaacg

SEQ ID NO: 637888 - DNA, 25 bp, Rattus norvegicus
cgaagcagtccgtcatatcaaggta

SEQ ID NO: 637889 - DNA, 25 bp, Rattus norvegicus
ccctcgcgttgaggtagcgcaattt

SEQ ID NO: 637890 - DNA, 25 bp, Rattus norvegicus
ctcactgccgtactgtttgccattg

SEQ ID NO: 637891 - DNA, 25 bp, Rattus norvegicus
tccctggacactgcatggctggggc

SEQ ID NO: 637892 - DNA, 25 bp, Rattus norvegicus
gtttgccattgttcgcgcccatcct

SEQ ID NO: 637893 - DNA, 25 bp, Rattus norvegicus
gaaagcaggcagcaacggaccgtta

SEQ ID NO: 637894 - DNA, 25 bp, Rattus norvegicus
gcaacggaccgttaactgcccaagc

SEQ ID NO: 637895 - DNA, 25 bp, Rattus norvegicus
cccttccgaggtgcgatctgggctt

SEQ ID NO: 637896 - DNA, 25 bp, Rattus norvegicus
ctaggtccgctgttgacactcccga

SEQ ID NO: 637897 - DNA, 25 bp, Rattus norvegicus
cacgctccgcgcgagtgggaacagc

SEQ ID NO: 637898 - DNA, 25 bp, Rattus norvegicus
tgggaacagcgcgacgcacagcccg

SEQ ID NO: 637899 - DNA, 25 bp, Rattus norvegicus
cgggccggacttttgttagcgccag

SEQ ID NO: 637900 - DNA, 25 bp, Rattus norvegicus
ttttgttagcgccaggcgcctcctc

SEQ ID NO: 637901 - DNA, 25 bp, Rattus norvegicus
cgcccagcgtcaatcacagctggag

SEQ ID NO: 637902 - DNA, 25 bp, Rattus norvegicus
cggcccggagatgcgcggcctttta

SEQ ID NO: 637903 - DNA, 25 bp, Rattus norvegicus
cgcggccttttaaaggggcagcacg

SEQ ID NO: 637904 - DNA, 25 bp, Rattus norvegicus
ccaagaaggcccacagcgagggacc

SEQ ID NO: 637905 - DNA, 25 bp, Rattus norvegicus
cagctcggccactcactagagccgc

SEQ ID NO: 637906 - DNA, 25 bp, Rattus norvegicus
gcaactgggaaagcaggccgggccg

SEQ ID NO: 637907 - DNA, 25 bp, Rattus norvegicus
acaggcagtggcaactgggaaagca

SEQ ID NO: 637908 - DNA, 25 bp, Rattus norvegicus
ctgaacaggcagtggcaactgggaa

SEQ ID NO: 637909 - DNA, 25 bp, Rattus norvegicus
taggcgctgaacaggcagtggcaac

SEQ ID NO: 637910 - DNA, 25 bp, Rattus norvegicus
cctgagtaggcgctgaacaggcagt

SEQ ID NO: 637911 - DNA, 25 bp, Rattus norvegicus
agcgccggtggccttcgccttcagt

SEQ ID NO: 637912 - DNA, 25 bp, Rattus norvegicus
aaggcccacagcgagggaccagcga

SEQ ID NO: 637913 - DNA, 25 bp, Rattus norvegicus
ccggtaccaagaaggcccacagcga

SEQ ID NO: 637914 - DNA, 25 bp, Rattus norvegicus
tcgccttcagttacgcccaggagct

SEQ ID NO: 637915 - DNA, 25 bp, Rattus norvegicus
ttcgccttcagttacgcccaggagc

SEQ ID NO: 637916 - DNA, 25 bp, Rattus norvegicus
ggtggccttcgccttcagttacgcc

SEQ ID NO: 637917 - DNA, 25 bp, Rattus norvegicus
agcgagagcccagccgccacgccca

SEQ ID NO: 637918 - DNA, 25 bp, Rattus norvegicus
tcgtgcgcgcggttatttatttata

SEQ ID NO: 637919 - DNA, 25 bp, Rattus norvegicus
agccatcgacttcggggagcaggta

SEQ ID NO: 637920 - DNA, 25 bp, Rattus norvegicus
tctgcgccgggttcccaactctgga

SEQ ID NO: 637921 - DNA, 25 bp, Rattus norvegicus
tcacccaggcggtgcggtcccgagt

SEQ ID NO: 637922 - DNA, 25 bp, Rattus norvegicus
cccagagcgtttataatggagccgc

SEQ ID NO: 637923 - DNA, 25 bp, Rattus norvegicus
gtttataatggagccgctgtcagca

SEQ ID NO: 637924 - DNA, 25 bp, Rattus norvegicus
cccggcagatctttgttgtgtggga

SEQ ID NO: 637925 - DNA, 25 bp, Rattus norvegicus
ttgagctcgcggctcttctgctaga

SEQ ID NO: 637926 - DNA, 25 bp, Rattus norvegicus
ttctgctagagcagccgcgcttgga

SEQ ID NO: 637927 - DNA, 25 bp, Rattus norvegicus
agcacagtgccctcgcggcggcaga

SEQ ID NO: 637928 - DNA, 25 bp, Rattus norvegicus
cccacggcggggactatggtgaaat

SEQ ID NO: 637929 - DNA, 25 bp, Rattus norvegicus
tatggtgaaattcccggcgctcacg

SEQ ID NO: 637930 - DNA, 25 bp, Rattus norvegicus
ttggcatcaccaacatagccatcga

SEQ ID NO: 637931 - DNA, 25 bp, Rattus norvegicus
ttcccaactctggagacggcgctca

SEQ ID NO: 637932 - DNA, 25 bp, Rattus norvegicus
gtctcctactgctcggggtcgccga

SEQ ID NO: 637933 - DNA, 25 bp, Rattus norvegicus
aatagagggagtacgcttgcgcaga

SEQ ID NO: 637934 - DNA, 25 bp, Rattus norvegicus
agggcggctcttcacccaggtttca

SEQ ID NO: 637935 - DNA, 25 bp, Rattus norvegicus
cgcatgtctgggctctgcttgcaag

SEQ ID NO: 637936 - DNA, 25 bp, Rattus norvegicus
gccatgtgcccactgcgcatgtctg

SEQ ID NO: 637937 - DNA, 25 bp, Rattus norvegicus
ctcagagcctggaaaagccgtcgcc

SEQ ID NO: 637938 - DNA, 25 bp, Rattus norvegicus
cagagcggagtgagcctcagagcct

SEQ ID NO: 637939 - DNA, 25 bp, Rattus norvegicus
tcttccgtaagcgtcactgtggccc

SEQ ID NO: 637940 - DNA, 25 bp, Rattus norvegicus
aggtccgcagagttcttccgtaagc

SEQ ID NO: 637941 - DNA, 25 bp, Rattus norvegicus
cgcacctcgcgaggtccgcagagtt

SEQ ID NO: 637942 - DNA, 25 bp, Rattus norvegicus
ccgtctggagccgtgattgctctgc

SEQ ID NO: 637943 - DNA, 25 bp, Rattus norvegicus
ccacgctccgggttggggcatgatt

SEQ ID NO: 637944 - DNA, 25 bp, Rattus norvegicus
tcgccgacctgagatagaggaaacc

SEQ ID NO: 637945 - DNA, 25 bp, Rattus norvegicus
gagatagaggaaacccacgcgaccc

SEQ ID NO: 637946 - DNA, 25 bp, Rattus norvegicus
catcttgttcggatcgggagtcttc

SEQ ID NO: 637947 - DNA, 25 bp, Rattus norvegicus
tccgtttgcccgaggctcaagtgca

SEQ ID NO: 637948 - DNA, 25 bp, Rattus norvegicus
gaggctcaagtgcaacccactcaca

SEQ ID NO: 637949 - DNA, 25 bp, Rattus norvegicus
cactcacagccaccggtgaggtgta

SEQ ID NO: 637950 - DNA, 25 bp, Rattus norvegicus
acacacctgaggtggtccgagagcg

SEQ ID NO: 637951 - DNA, 25 bp, Rattus norvegicus
tcgtcgccttcatgcgggctgcgca

SEQ ID NO: 637952 - DNA, 25 bp, Rattus norvegicus
gcagtcccgaactcagctaccgtga

SEQ ID NO: 637953 - DNA, 25 bp, Rattus norvegicus
tcagctaccgtgacagccgtctgtg

SEQ ID NO: 637954 - DNA, 25 bp, Rattus norvegicus
tgacgcgctgcgtagccactcagaa

SEQ ID NO: 637955 - DNA, 25 bp, Rattus norvegicus
ccactcagaagctggggcgtggtct

SEQ ID NO: 637956 - DNA, 25 bp, Rattus norvegicus
ccctcagcgctaggttttggtgaag

SEQ ID NO: 637957 - DNA, 25 bp, Rattus norvegicus
gctcggaagtctagtggactgctgc

SEQ ID NO: 637958 - DNA, 25 bp, Rattus norvegicus
gcttacaacctagttggttctctcc

SEQ ID NO: 637959 - DNA, 25 bp, Rattus norvegicus
ctcacccggggcgttccatcttgtt

SEQ ID NO: 637960 - DNA, 25 bp, Rattus norvegicus
gcacggacgcgagtgtacacacaga

SEQ ID NO: 637961 - DNA, 25 bp, Rattus norvegicus
ggccacggacgtgtctactcagaca

SEQ ID NO: 637962 - DNA, 25 bp, Rattus norvegicus
gtctactcagacaacgcacaggaga

SEQ ID NO: 637963 - DNA, 25 bp, Rattus norvegicus
gacaacgcacaggagagctggagaa

SEQ ID NO: 637964 - DNA, 25 bp, Rattus norvegicus
tggagaaggcgattactgctgcaca

SEQ ID NO: 637965 - DNA, 25 bp, Rattus norvegicus
ttagtacggaggtttagaagagctg

SEQ ID NO: 637966 - DNA, 25 bp, Rattus norvegicus
atgggcgcaggctccctggcactct

SEQ ID NO: 637967 - DNA, 25 bp, Rattus norvegicus
cccgttgctctgagtggactgcacg

SEQ ID NO: 637968 - DNA, 25 bp, Rattus norvegicus
ctctgagtggactgcacggactgct

SEQ ID NO: 637969 - DNA, 25 bp, Rattus norvegicus
actgcacggactgctcgctggccga

SEQ ID NO: 637970 - DNA, 25 bp, Rattus norvegicus
cgctggccgaggagcacgtgctcat

SEQ ID NO: 637971 - DNA, 25 bp, Rattus norvegicus
agcacgtgctcatgcggtccgtgtc

SEQ ID NO: 637972 - DNA, 25 bp, Rattus norvegicus
ctcatgcggtccgtgtccttgctgg

SEQ ID NO: 637973 - DNA, 25 bp, Rattus norvegicus
cacacagaggccacggacgtgtcta

SEQ ID NO: 637974 - DNA, 25 bp, Rattus norvegicus
tcggccctccagcaagaaacaaaga

SEQ ID NO: 637975 - DNA, 25 bp, Rattus norvegicus
ctagaaccaccacggtcccagatgt

SEQ ID NO: 637976 - DNA, 25 bp, Rattus norvegicus
cggtactcaccggatcgaaagaagg

SEQ ID NO: 637977 - DNA, 25 bp, Rattus norvegicus
cgtgggtaacctgacacgccggagt

SEQ ID NO: 637978 - DNA, 25 bp, Rattus norvegicus
tcagcggcccaaaagctatcacagg

SEQ ID NO: 637979 - DNA, 25 bp, Rattus norvegicus
ggggtccagctatcagcggcccaaa

SEQ ID NO: 637980 - DNA, 25 bp, Rattus norvegicus
caggacactcgctgataatgaggtc

SEQ ID NO: 637981 - DNA, 25 bp, Rattus norvegicus
ctagaagaccggagccaggacactc

SEQ ID NO: 637982 - DNA, 25 bp, Rattus norvegicus
cgccaaggctggatgacaggctaga

SEQ ID NO: 637983 - DNA, 25 bp, Rattus norvegicus
tcacagaactgtaccgccaaggctg

SEQ ID NO: 637984 - DNA, 25 bp, Rattus norvegicus
ggctgcccggtttcacagaactgta

SEQ ID NO: 637985 - DNA, 25 bp, Rattus norvegicus
caccttcctcggttcctgggctaag

SEQ ID NO: 637986 - DNA, 25 bp, Rattus norvegicus
agagacaatggctggacctgaccgc

SEQ ID NO: 637987 - DNA, 25 bp, Rattus norvegicus
cgcgtggggcaaccgcggtactcac

SEQ ID NO: 637988 - DNA, 25 bp, Rattus norvegicus
ccctctacctaggaggacacgtata

SEQ ID NO: 637989 - DNA, 25 bp, Rattus norvegicus
tcaggaccttgctctgaagccgggc

SEQ ID NO: 637990 - DNA, 25 bp, Rattus norvegicus
ctctctcggcggcactgggcatgct

SEQ ID NO: 637991 - DNA, 25 bp, Rattus norvegicus
ggcggacgctcgctcactagccagg

SEQ ID NO: 637992 - DNA, 25 bp, Rattus norvegicus
ggccgcgctccgacaacaaaagcgg

SEQ ID NO: 637993 - DNA, 25 bp, Rattus norvegicus
acaaaagcggaggatgctgcagctg

SEQ ID NO: 637994 - DNA, 25 bp, Rattus norvegicus
cagtgtctttcttggagcggttacc

SEQ ID NO: 637995 - DNA, 25 bp, Rattus norvegicus
cccggactgaggagctgtctttggc

SEQ ID NO: 637996 - DNA, 25 bp, Rattus norvegicus
tgcatgttcgccaggaagcagtcgg

SEQ ID NO: 637997 - DNA, 25 bp, Rattus norvegicus
ccgttcggtgagttgctttagctga

SEQ ID NO: 637998 - DNA, 25 bp, Rattus norvegicus
ctttagctgagctgcttgagccggg

SEQ ID NO: 637999 - DNA, 25 bp, Rattus norvegicus
gtcctcttgctcaccgccggtgggg

SEQ ID NO: 638000 - DNA, 25 bp, Rattus norvegicus
tatatagggcaacaccgactgctcc

SEQ ID NO: 638001 - DNA, 25 bp, Rattus norvegicus
ggaggaccacgatcctgccgggtcc

SEQ ID NO: 638002 - DNA, 25 bp, Rattus norvegicus
agaaattcagtcaaggccgcccagg

SEQ ID NO: 638003 - DNA, 25 bp, Rattus norvegicus
gcgaggtagtagagccagattccac

SEQ ID NO: 638004 - DNA, 25 bp, Rattus norvegicus
catcagcggttcttccaagcataga

SEQ ID NO: 638005 - DNA, 25 bp, Rattus norvegicus
tgggcgatagtgtcagcggattaaa

SEQ ID NO: 638006 - DNA, 25 bp, Rattus norvegicus
atcaagtttagcatcggcgcggcca

SEQ ID NO: 638007 - DNA, 25 bp, Rattus norvegicus
gggacccgagattgtatcaagttta

SEQ ID NO: 638008 - DNA, 25 bp, Rattus norvegicus
ccttgctgcagcacctccttggagg

SEQ ID NO: 638009 - DNA, 25 bp, Rattus norvegicus
gcctcggcagcctagaaattcagtc

SEQ ID NO: 638010 - DNA, 25 bp, Rattus norvegicus
ggacaattcttactcggcctcggca

SEQ ID NO: 638011 - DNA, 25 bp, Rattus norvegicus
ccttcgataacgtggccaggcagaa

SEQ ID NO: 638012 - DNA, 25 bp, Rattus norvegicus
aacttggggtctgtagccttcgata

SEQ ID NO: 638013 - DNA, 25 bp, Rattus norvegicus
caagccctgccgtaccaggcaagta

SEQ ID NO: 638014 - DNA, 25 bp, Rattus norvegicus
tctctcggactctggattgtacacg

SEQ ID NO: 638015 - DNA, 25 bp, Rattus norvegicus
gaggatccctgccagtccatcagtc

SEQ ID NO: 638016 - DNA, 25 bp, Rattus norvegicus
ggccaagtcctacagcaccagctcg

SEQ ID NO: 638017 - DNA, 25 bp, Rattus norvegicus
ctttccacgcgcgtagtctgggtgc

SEQ ID NO: 638018 - DNA, 25 bp, Rattus norvegicus
tagtctgggtgcagaagttgtcctc

SEQ ID NO: 638019 - DNA, 25 bp, Rattus norvegicus
cgtgcagtccaccatctcctcttcg

SEQ ID NO: 638020 - DNA, 25 bp, Rattus norvegicus
caccaagctgcagcgcggaggctcg

SEQ ID NO: 638021 - DNA, 25 bp, Rattus norvegicus
atcaacatcgtcgtgtcctcggccg

SEQ ID NO: 638022 - DNA, 25 bp, Rattus norvegicus
agctgagctccaccatcggcaccta

SEQ ID NO: 638023 - DNA, 25 bp, Rattus norvegicus
ctggtccacgcgtccgaacagtaca

SEQ ID NO: 638024 - DNA, 25 bp, Rattus norvegicus
gcgtccgaacagtacagcaagcatt

SEQ ID NO: 638025 - DNA, 25 bp, Rattus norvegicus
gtacagcaagcattcgcaggaactg

SEQ ID NO: 638026 - DNA, 25 bp, Rattus norvegicus
tcgcaggaactgtatgccaccgcca

SEQ ID NO: 638027 - DNA, 25 bp, Rattus norvegicus
gcggctgcttctccaacctctgagc

SEQ ID NO: 638028 - DNA, 25 bp, Rattus norvegicus
cgctgaccaccacgcaaggcggctc

SEQ ID NO: 638029 - DNA, 25 bp, Rattus norvegicus
agctcgcccatcaacatcgtcgtgt

SEQ ID NO: 638030 - DNA, 25 bp, Rattus norvegicus
gtcgcttccctcagtgacagctcgg

SEQ ID NO: 638031 - DNA, 25 bp, Rattus norvegicus
cctccagaaggaaagctagagacca

SEQ ID NO: 638032 - DNA, 25 bp, Rattus norvegicus
ataccagtgcgatgctcaggcgcgc

SEQ ID NO: 638033 - DNA, 25 bp, Rattus norvegicus
actggtttgcactttgtctccgggc

SEQ ID NO: 638034 - DNA, 25 bp, Rattus norvegicus
cgccggtactgactggtttgcactt

SEQ ID NO: 638035 - DNA, 25 bp, Rattus norvegicus
aaagctggacatccgcccgccggta

SEQ ID NO: 638036 - DNA, 25 bp, Rattus norvegicus
tagagaccaaagctggacatccgcc

SEQ ID NO: 638037 - DNA, 25 bp, Rattus norvegicus
ggcgccatgtcttcgcctccagaag

SEQ ID NO: 638038 - DNA, 25 bp, Rattus norvegicus
cctcagaaaaccagcggcgccatgt

SEQ ID NO: 638039 - DNA, 25 bp, Rattus norvegicus
cacacgaactgaccggccaaggcga

SEQ ID NO: 638040 - DNA, 25 bp, Rattus norvegicus
ccctctagcgctttaggagttgtac

SEQ ID NO: 638041 - DNA, 25 bp, Rattus norvegicus
cagcagaagtcgcttccctcagtga

SEQ ID NO: 638042 - DNA, 25 bp, Rattus norvegicus
ggggtctcgaaccaccagcagaagt

SEQ ID NO: 638043 - DNA, 25 bp, Rattus norvegicus
tacgtggcgctagccaccacgcatg

SEQ ID NO: 638044 - DNA, 25 bp, Rattus norvegicus
atggggtcccaatatcgcctcacgc

SEQ ID NO: 638045 - DNA, 25 bp, Rattus norvegicus
agaagtcttcgtactcctcgtagtc

SEQ ID NO: 638046 - DNA, 25 bp, Rattus norvegicus
gcgctcccggagcaaagtcactggc

SEQ ID NO: 638047 - DNA, 25 bp, Rattus norvegicus
cgttcacacaagagcaggagtccca

SEQ ID NO: 638048 - DNA, 25 bp, Rattus norvegicus
ttgcccgctgcgttcacacaagagc

SEQ ID NO: 638049 - DNA, 25 bp, Rattus norvegicus
ttagagggacaagtacacgaggcgc

SEQ ID NO: 638050 - DNA, 25 bp, Rattus norvegicus
gtcactggcgactggagaaaagccc

SEQ ID NO: 638051 - DNA, 25 bp, Rattus norvegicus
tgtccggcagactcgagaagtcttc

SEQ ID NO: 638052 - DNA, 25 bp, Rattus norvegicus
aaggaatcgtccgatgcgatgctgc

SEQ ID NO: 638053 - DNA, 25 bp, Rattus norvegicus
gtgcctcctcggaactaggtccgcg

SEQ ID NO: 638054 - DNA, 25 bp, Rattus norvegicus
ccacacaggaaggaagccgtgctct

SEQ ID NO: 638055 - DNA, 25 bp, Rattus norvegicus
ccgctccgcaaatggggtcccaata

SEQ ID NO: 638056 - DNA, 25 bp, Rattus norvegicus
aagccgggcaggactatcatccgcc

SEQ ID NO: 638057 - DNA, 25 bp, Rattus norvegicus
tctgagcggcagtagatctaggatt

SEQ ID NO: 638058 - DNA, 25 bp, Rattus norvegicus
agtgcttggtgttttgtccctcgtc

SEQ ID NO: 638059 - DNA, 25 bp, Rattus norvegicus
gggtcaaaggctaaagcgcgcacca

SEQ ID NO: 638060 - DNA, 25 bp, Rattus norvegicus
ccgtggactgactacagagtgcttg

SEQ ID NO: 638061 - DNA, 25 bp, Rattus norvegicus
aggctttcgaagagtcactgtatcc

SEQ ID NO: 638062 - DNA, 25 bp, Rattus norvegicus
agctccgacgcgttgcctttaaggc

SEQ ID NO: 638063 - DNA, 25 bp, Rattus norvegicus
tctctcctttgagctccgacgcgtt

SEQ ID NO: 638064 - DNA, 25 bp, Rattus norvegicus
tcattaagacggacgagttgccggc

SEQ ID NO: 638065 - DNA, 25 bp, Rattus norvegicus
gactcggtgggatcaactgtctttc

SEQ ID NO: 638066 - DNA, 25 bp, Rattus norvegicus
cgctcccgccatggtcattaagacg

SEQ ID NO: 638067 - DNA, 25 bp, Rattus norvegicus
actgtctttcctccgcgtcagtgtg

SEQ ID NO: 638068 - DNA, 25 bp, Rattus norvegicus
tgaaggtcaccttcactggcaccac

SEQ ID NO: 638069 - DNA, 25 bp, Rattus norvegicus
cacggcggacacacgcgcgcaagat

SEQ ID NO: 638070 - DNA, 25 bp, Rattus norvegicus
gccgccgccacagacggatggaatc

SEQ ID NO: 638071 - DNA, 25 bp, Rattus norvegicus
cacacgcggtttggtttcagggtgc

SEQ ID NO: 638072 - DNA, 25 bp, Rattus norvegicus
ttgtggcgtgcggtttccaggcaac

SEQ ID NO: 638073 - DNA, 25 bp, Rattus norvegicus
gctccgcttctaaccggctgctccg

SEQ ID NO: 638074 - DNA, 25 bp, Rattus norvegicus
ttccaggcaacctgagctgcgcagg

SEQ ID NO: 638075 - DNA, 25 bp, Rattus norvegicus
gcagcggcatcgctctgggcagacc

SEQ ID NO: 638076 - DNA, 25 bp, Rattus norvegicus
atgtggatctgctgcgcgcagaaca

SEQ ID NO: 638077 - DNA, 25 bp, Rattus norvegicus
ctgcttgaggatgtccggcagctcc

SEQ ID NO: 638078 - DNA, 25 bp, Rattus norvegicus
gtgaactgcttgaggatgtccggca

SEQ ID NO: 638079 - DNA, 25 bp, Rattus norvegicus
aactgaggcccaaccgcccacagca

SEQ ID NO: 638080 - DNA, 25 bp, Rattus norvegicus
cacagcacctggagcgcgcgattgt

SEQ ID NO: 638081 - DNA, 25 bp, Rattus norvegicus
cgtacggatggcagccttggtgaac

SEQ ID NO: 638082 - DNA, 25 bp, Rattus norvegicus
cacgtccgccggctgcgtacggatg

SEQ ID NO: 638083 - DNA, 25 bp, Rattus norvegicus
tgccgaccactgcagcacgtccgcc

SEQ ID NO: 638084 - DNA, 25 bp, Rattus norvegicus
tcccaggccggccttaccctgccga

SEQ ID NO: 638085 - DNA, 25 bp, Rattus norvegicus
ggatggcagccttggtgaactgctt

SEQ ID NO: 638086 - DNA, 25 bp, Rattus norvegicus
gtgcagcacgttccgggacaaagga

SEQ ID NO: 638087 - DNA, 25 bp, Rattus norvegicus
gtattaagcacaccacgtcgcgaca

SEQ ID NO: 638088 - DNA, 25 bp, Rattus norvegicus
gacaccgaagtcctggcacccagta

SEQ ID NO: 638089 - DNA, 25 bp, Rattus norvegicus
ggcacccagtatcccagtcgaggct

SEQ ID NO: 638090 - DNA, 25 bp, Rattus norvegicus
gcagaggatcggtcaccttccgatc

SEQ ID NO: 638091 - DNA, 25 bp, Rattus norvegicus
ttcctcggcggtgtccatcttgttt

SEQ ID NO: 638092 - DNA, 25 bp, Rattus norvegicus
cagcggctgacagaaagcgagcgcc

SEQ ID NO: 638093 - DNA, 25 bp, Rattus norvegicus
agtgctaagcgtcacatccggtgcg

SEQ ID NO: 638094 - DNA, 25 bp, Rattus norvegicus
ggactgaaagccgaggcagcacctc

SEQ ID NO: 638095 - DNA, 25 bp, Rattus norvegicus
cgcccagactggtgtgcgggacaaa

SEQ ID NO: 638096 - DNA, 25 bp, Rattus norvegicus
cactcccggggcattcagaatcggc

SEQ ID NO: 638097 - DNA, 25 bp, Rattus norvegicus
cttccgatccgagcccgctggagga

SEQ ID NO: 638098 - DNA, 25 bp, Rattus norvegicus
gcgttgcgaagaacggcctgatgcc

SEQ ID NO: 638099 - DNA, 25 bp, Rattus norvegicus
ggggcctcgatcttcttcaccgtca

SEQ ID NO: 638100 - DNA, 25 bp, Rattus norvegicus
tccagtcaccgattcaaggatttgg

SEQ ID NO: 638101 - DNA, 25 bp, Rattus norvegicus
aaaggggcgcccatactcatcgaag

SEQ ID NO: 638102 - DNA, 25 bp, Rattus norvegicus
cgagacttgcgatcttggtccttga

SEQ ID NO: 638103 - DNA, 25 bp, Rattus norvegicus
ggcctgttagaattctccctgtcgc

SEQ ID NO: 638104 - DNA, 25 bp, Rattus norvegicus
ccttctcgcgagaggacgcaaaatc

SEQ ID NO: 638105 - DNA, 25 bp, Rattus norvegicus
aagccgccgctattggaaacgtctg

SEQ ID NO: 638106 - DNA, 25 bp, Rattus norvegicus
tttacgccacagagtaccttctgga

SEQ ID NO: 638107 - DNA, 25 bp, Rattus norvegicus
tgttccaaacttagaaggcagcgtc

SEQ ID NO: 638108 - DNA, 25 bp, Rattus norvegicus
agcgctctccaataaccggcgggga

SEQ ID NO: 638109 - DNA, 25 bp, Rattus norvegicus
ttgcagcggggagctaatttcctta

SEQ ID NO: 638110 - DNA, 25 bp, Rattus norvegicus
ccgcctctgagacgttggtagattc

SEQ ID NO: 638111 - DNA, 25 bp, Rattus norvegicus
gtgcggaccgcgagatttacttttc

SEQ ID NO: 638112 - DNA, 25 bp, Rattus norvegicus
cgtgcatacgatcctaggcctgtta

SEQ ID NO: 638113 - DNA, 25 bp, Rattus norvegicus
gaaacgtctgtcctccttgaaccga

SEQ ID NO: 638114 - DNA, 25 bp, Rattus norvegicus
ccatctgtggttggtgtaggtttca

SEQ ID NO: 638115 - DNA, 25 bp, Rattus norvegicus
ccgtgctcaggatgttccaaggaac

SEQ ID NO: 638116 - DNA, 25 bp, Rattus norvegicus
tagggtaagcttcactcacggatcc

SEQ ID NO: 638117 - DNA, 25 bp, Rattus norvegicus
ggcgaagcttgggaactcatcagta

SEQ ID NO: 638118 - DNA, 25 bp, Rattus norvegicus
agggctcaacttcgccagggtattt

SEQ ID NO: 638119 - DNA, 25 bp, Rattus norvegicus
ctctgtacagggatttgcgatgctc

SEQ ID NO: 638120 - DNA, 25 bp, Rattus norvegicus
ttggtggttagaatcgcctaccttc

SEQ ID NO: 638121 - DNA, 25 bp, Rattus norvegicus
caggtacgcctggagatctgtgctc

SEQ ID NO: 638122 - DNA, 25 bp, Rattus norvegicus
gcaccggctggaagtttgtgtccta

SEQ ID NO: 638123 - DNA, 25 bp, Rattus norvegicus
ccctgggtttcatagctgagacctt

SEQ ID NO: 638124 - DNA, 25 bp, Rattus norvegicus
gactttcctcctggcgcactgaaga

SEQ ID NO: 638125 - DNA, 25 bp, Rattus norvegicus
gcgagcctgttcactcagctgcaca

SEQ ID NO: 638126 - DNA, 25 bp, Rattus norvegicus
cacgcgcggacctaaacagagggta

SEQ ID NO: 638127 - DNA, 25 bp, Rattus norvegicus
gtcctagcctttccctggatccgag

SEQ ID NO: 638128 - DNA, 25 bp, Rattus norvegicus
ttctgcgtccgatccgctgcagcag

SEQ ID NO: 638129 - DNA, 25 bp, Rattus norvegicus
ttgtgagcacagacctagccacccg

SEQ ID NO: 638130 - DNA, 25 bp, Rattus norvegicus
gcgggaagacgacccggccttgcca

SEQ ID NO: 638131 - DNA, 25 bp, Rattus norvegicus
catgcacgcggctgcggagtttgac

SEQ ID NO: 638132 - DNA, 25 bp, Rattus norvegicus
aggctcccgccaacttggtgttctg

SEQ ID NO: 638133 - DNA, 25 bp, Rattus norvegicus
gtccagcttttataggctcccgcca

SEQ ID NO: 638134 - DNA, 25 bp, Rattus norvegicus
cccggtcgcacggtccagcttttat

SEQ ID NO: 638135 - DNA, 25 bp, Rattus norvegicus
tcttgcagtatgtgtcccggtcgca

SEQ ID NO: 638136 - DNA, 25 bp, Rattus norvegicus
tcgtccgtctagtggtcttgcagta

SEQ ID NO: 638137 - DNA, 25 bp, Rattus norvegicus
cagagaagcagttgtcgtccgtcta

SEQ ID NO: 638138 - DNA, 25 bp, Rattus norvegicus
catagtcacgctggtgattggggca

SEQ ID NO: 638139 - DNA, 25 bp, Rattus norvegicus
cccagtggtgggacatagtcacgct

SEQ ID NO: 638140 - DNA, 25 bp, Rattus norvegicus
ccagggacatcccagagcggggacc

SEQ ID NO: 638141 - DNA, 25 bp, Rattus norvegicus
tgcactcaccgttgctcttgctgta

SEQ ID NO: 638142 - DNA, 25 bp, Rattus norvegicus
gcttaacctcgccatggtcctcgat

SEQ ID NO: 638143 - DNA, 25 bp, Rattus norvegicus
cccatcgggctctgagctctggcaa

SEQ ID NO: 638144 - DNA, 25 bp, Rattus norvegicus
cagcggtgagcttttccagtgaatg

SEQ ID NO: 638145 - DNA, 25 bp, Rattus norvegicus
tttccagtgaatgaacaccgcggtc

SEQ ID NO: 638146 - DNA, 25 bp, Rattus norvegicus
agtgaatgaacaccgcggtctaatc

SEQ ID NO: 638147 - DNA, 25 bp, Rattus norvegicus
caccgcggtctaatccgcagagatc

SEQ ID NO: 638148 - DNA, 25 bp, Rattus norvegicus
atccgcagagatccggcggggacca

SEQ ID NO: 638149 - DNA, 25 bp, Rattus norvegicus
tcgggctctgagctctggcaaaccc

SEQ ID NO: 638150 - DNA, 25 bp, Rattus norvegicus
cgctcaccgttgtgctcgtcgtatc

SEQ ID NO: 638151 - DNA, 25 bp, Rattus norvegicus
acctcgccatggtcctcgatggaga

SEQ ID NO: 638152 - DNA, 25 bp, Rattus norvegicus
ccatggtcctcgatggagagcctgt

SEQ ID NO: 638153 - DNA, 25 bp, Rattus norvegicus
cctgtggcagggacactgtggacct

SEQ ID NO: 638154 - DNA, 25 bp, Rattus norvegicus
ctgaaacccgagggctcggtcgtca

SEQ ID NO: 638155 - DNA, 25 bp, Rattus norvegicus
tggagcccgcgctcaccgttgtgct

SEQ ID NO: 638156 - DNA, 25 bp, Rattus norvegicus
agtctttctcgcctttcgtgggtca

SEQ ID NO: 638157 - DNA, 25 bp, Rattus norvegicus
ctttgaggacggctccttcagagtg

SEQ ID NO: 638158 - DNA, 25 bp, Rattus norvegicus
gacaccgcaggacccgcggcttgga

SEQ ID NO: 638159 - DNA, 25 bp, Rattus norvegicus
ttggacaggtgacaccaagcatctg

SEQ ID NO: 638160 - DNA, 25 bp, Rattus norvegicus
ccaagcatctgaggccggaaggtca

SEQ ID NO: 638161 - DNA, 25 bp, Rattus norvegicus
ccggaaggtcagacttctctggtga

SEQ ID NO: 638162 - DNA, 25 bp, Rattus norvegicus
ttctctggtgagaaggctttggcga

SEQ ID NO: 638163 - DNA, 25 bp, Rattus norvegicus
tggaacatgtgggaggcttcttccc

SEQ ID NO: 638164 - DNA, 25 bp, Rattus norvegicus
ggcttcttcccaagtaccagcttaa

SEQ ID NO: 638165 - DNA, 25 bp, Rattus norvegicus
cttaaacctgtggaaaacatcgagg

SEQ ID NO: 638166 - DNA, 25 bp, Rattus norvegicus
atctccgctgagttgattcctcctc

SEQ ID NO: 638167 - DNA, 25 bp, Rattus norvegicus
gctccgctctgaggacctattgtga

SEQ ID NO: 638168 - DNA, 25 bp, Rattus norvegicus
ccacttggtcaaaggcgctagatgc

SEQ ID NO: 638169 - DNA, 25 bp, Rattus norvegicus
gcgctagtaagcgaatctccgctga

SEQ ID NO: 638170 - DNA, 25 bp, Rattus norvegicus
cgctgcgactactcgggtcattctt

SEQ ID NO: 638171 - DNA, 25 bp, Rattus norvegicus
cggccggagtcctctgacagagata

SEQ ID NO: 638172 - DNA, 25 bp, Rattus norvegicus
acagagatacgcgtgctaggctgcc

SEQ ID NO: 638173 - DNA, 25 bp, Rattus norvegicus
tgccgcggagcattaagaggccatg

SEQ ID NO: 638174 - DNA, 25 bp, Rattus norvegicus
aggccatggtcttggtggtactgaa

SEQ ID NO: 638175 - DNA, 25 bp, Rattus norvegicus
cgacgggttagccttgcagtgacaa

SEQ ID NO: 638176 - DNA, 25 bp, Rattus norvegicus
tccgcagtttgagcaggggtattct

SEQ ID NO: 638177 - DNA, 25 bp, Rattus norvegicus
ttctggaaggaaacgaggccttgcc

SEQ ID NO: 638178 - DNA, 25 bp, Rattus norvegicus
ggtgcctgcgttaacgctgcgacta

SEQ ID NO: 638179 - DNA, 25 bp, Rattus norvegicus
ggtcattcttgcgaagcgcccggaa

SEQ ID NO: 638180 - DNA, 25 bp, Rattus norvegicus
gctccgagctccgtcatatttaaag

SEQ ID NO: 638181 - DNA, 25 bp, Rattus norvegicus
aaagatccgccatcggctgcaactg

SEQ ID NO: 638182 - DNA, 25 bp, Rattus norvegicus
aactgcttttgcgagtcattgcctg

SEQ ID NO: 638183 - DNA, 25 bp, Rattus norvegicus
acgctcctccaaaccggtgcgggtg

SEQ ID NO: 638184 - DNA, 25 bp, Rattus norvegicus
ggcagtcgcgttccctcgggcgagc

SEQ ID NO: 638185 - DNA, 25 bp, Rattus norvegicus
ctagtaacgtactctccgcggaggg

SEQ ID NO: 638186 - DNA, 25 bp, Rattus norvegicus
tgcctagtaacgtactctccgcgga

SEQ ID NO: 638187 - DNA, 25 bp, Rattus norvegicus
gttgcctagtaacgtactctccgcg

SEQ ID NO: 638188 - DNA, 25 bp, Rattus norvegicus
gcgttgcctagtaacgtactctccg

SEQ ID NO: 638189 - DNA, 25 bp, Rattus norvegicus
cggcgttgcctagtaacgtactctc

SEQ ID NO: 638190 - DNA, 25 bp, Rattus norvegicus
cgcggcgttgcctagtaacgtactc

SEQ ID NO: 638191 - DNA, 25 bp, Rattus norvegicus
ccgcgcggcgttgcctagtaacgta

SEQ ID NO: 638192 - DNA, 25 bp, Rattus norvegicus
taaatggcaggaagtgacgccgcgc

SEQ ID NO: 638193 - DNA, 25 bp, Rattus norvegicus
tttaaatggcaggaagtgacgccgc

SEQ ID NO: 638194 - DNA, 25 bp, Rattus norvegicus
tgggcctgagtttaaatggcaggaa

SEQ ID NO: 638195 - DNA, 25 bp, Rattus norvegicus
gcccaccgctcaccgctttgagatc

SEQ ID NO: 638196 - DNA, 25 bp, Rattus norvegicus
tccctcgggcgagcggtgctcagga

SEQ ID NO: 638197 - DNA, 25 bp, Rattus norvegicus
ctgagtttaaatggcaggaagtgac

SEQ ID NO: 638198 - DNA, 25 bp, Rattus norvegicus
agcgctgggtcccagcttgctcacg

SEQ ID NO: 638199 - DNA, 25 bp, Rattus norvegicus
cgaagcctgccaatccgaggtccga

SEQ ID NO: 638200 - DNA, 25 bp, Rattus norvegicus
gggctatcctaggtcgctgtttacg

SEQ ID NO: 638201 - DNA, 25 bp, Rattus norvegicus
gcttggaaagagtggggctatccta

SEQ ID NO: 638202 - DNA, 25 bp, Rattus norvegicus
tccatctgttggcttggaaagagtg

SEQ ID NO: 638203 - DNA, 25 bp, Rattus norvegicus
gccgctcaaagagggcttgactttt

SEQ ID NO: 638204 - DNA, 25 bp, Rattus norvegicus
ctgggaggatacgaggaatccgcta

SEQ ID NO: 638205 - DNA, 25 bp, Rattus norvegicus
gcaacacgaccgtgccgctcaaaga

SEQ ID NO: 638206 - DNA, 25 bp, Rattus norvegicus
gttcgatttccgtacatgccgccgc

SEQ ID NO: 638207 - DNA, 25 bp, Rattus norvegicus
cctttgtccatgaaacacacatcct

SEQ ID NO: 638208 - DNA, 25 bp, Rattus norvegicus
acctgtgcaggcctttgtccatgaa

SEQ ID NO: 638209 - DNA, 25 bp, Rattus norvegicus
accaggtggcggctgctacctgtgc

SEQ ID NO: 638210 - DNA, 25 bp, Rattus norvegicus
tgccaatccgaggtccgaccaggtg

SEQ ID NO: 638211 - DNA, 25 bp, Rattus norvegicus
tcgctgtttacgaacgttatttata

SEQ ID NO: 638212 - DNA, 25 bp, Rattus norvegicus
ccagtgggcaagcttgcgcccagtc

SEQ ID NO: 638213 - DNA, 25 bp, Rattus norvegicus
ttcttgctaagtcacggcggcagga

SEQ ID NO: 638214 - DNA, 25 bp, Rattus norvegicus
gcacgcccttctacgggttgatcta

SEQ ID NO: 638215 - DNA, 25 bp, Rattus norvegicus
gctccagctccgtctgtcacaggag

SEQ ID NO: 638216 - DNA, 25 bp, Rattus norvegicus
actctcgggtcgctgctcgttcgct

SEQ ID NO: 638217 - DNA, 25 bp, Rattus norvegicus
ggggctcgagccctagcccagcgtt

SEQ ID NO: 638218 - DNA, 25 bp, Rattus norvegicus
agggcgtagagcgtcgccgccttac

SEQ ID NO: 638219 - DNA, 25 bp, Rattus norvegicus
ccgcccgagcgcgatggaaaagaca

SEQ ID NO: 638220 - DNA, 25 bp, Rattus norvegicus
gggaccggcgcagccacatcgtcag

SEQ ID NO: 638221 - DNA, 25 bp, Rattus norvegicus
tggagcaagggcagcgccctcccag

SEQ ID NO: 638222 - DNA, 25 bp, Rattus norvegicus
gcccaagtagcctgctgccagggtc

SEQ ID NO: 638223 - DNA, 25 bp, Rattus norvegicus
ttgatctagaggttgtaccggagcc

SEQ ID NO: 638224 - DNA, 25 bp, Rattus norvegicus
cgccgagaggccacggtttgaagcc

SEQ ID NO: 638225 - DNA, 25 bp, Rattus norvegicus
gtttgaagcctcagcggcccaagta

SEQ ID NO: 638226 - DNA, 25 bp, Rattus norvegicus
tgctttgcgtggcagcaaagcaaca

SEQ ID NO: 638227 - DNA, 25 bp, Rattus norvegicus
gcctgcccgccgcactttcctgctt

SEQ ID NO: 638228 - DNA, 25 bp, Rattus norvegicus
cctgctttgcgtggcagcaaagcaa

SEQ ID NO: 638229 - DNA, 25 bp, Rattus norvegicus
tcctgctttgcgtggcagcaaagca

SEQ ID NO: 638230 - DNA, 25 bp, Rattus norvegicus
ttcctgctttgcgtggcagcaaagc

SEQ ID NO: 638231 - DNA, 25 bp, Rattus norvegicus
ctttcctgctttgcgtggcagcaaa

SEQ ID NO: 638232 - DNA, 25 bp, Rattus norvegicus
actttcctgctttgcgtggcagcaa

SEQ ID NO: 638233 - DNA, 25 bp, Rattus norvegicus
cactttcctgctttgcgtggcagca

SEQ ID NO: 638234 - DNA, 25 bp, Rattus norvegicus
gcactttcctgctttgcgtggcagc

SEQ ID NO: 638235 - DNA, 25 bp, Rattus norvegicus
cgcactttcctgctttgcgtggcag

SEQ ID NO: 638236 - DNA, 25 bp, Rattus norvegicus
ccgcactttcctgctttgcgtggca

SEQ ID NO: 638237 - DNA, 25 bp, Rattus norvegicus
gccgcactttcctgctttgcgtggc

SEQ ID NO: 638238 - DNA, 25 bp, Rattus norvegicus
cgccgcactttcctgctttgcgtgg

SEQ ID NO: 638239 - DNA, 25 bp, Rattus norvegicus
ctttgcgtggcagcaaagcaacacg

SEQ ID NO: 638240 - DNA, 25 bp, Rattus norvegicus
tgctgcgggtggttcaggctaactt

SEQ ID NO: 638241 - DNA, 25 bp, Rattus norvegicus
cccgagagcactttggttctggctc

SEQ ID NO: 638242 - DNA, 25 bp, Rattus norvegicus
acctctccatctcccgcgcccaaag

SEQ ID NO: 638243 - DNA, 25 bp, Rattus norvegicus
catgagggaaaccacaaggaagatg

SEQ ID NO: 638244 - DNA, 25 bp, Rattus norvegicus
cactttggttctggctcccggcgca

SEQ ID NO: 638245 - DNA, 25 bp, Rattus norvegicus
tgtgcatcttcataaccaacgcggc

SEQ ID NO: 638246 - DNA, 25 bp, Rattus norvegicus
ggggtgtgtgcatcttcataaccaa

SEQ ID NO: 638247 - DNA, 25 bp, Rattus norvegicus
ggttcaggctaacttgcccgaccgc

SEQ ID NO: 638248 - DNA, 25 bp, Rattus norvegicus
gccctcggattcctgtgctgcgggt

SEQ ID NO: 638249 - DNA, 25 bp, Rattus norvegicus
tcagggaccgctgccatcctagaca

SEQ ID NO: 638250 - DNA, 25 bp, Rattus norvegicus
ggaagaacccactgcactgctcccg

SEQ ID NO: 638251 - DNA, 25 bp, Rattus norvegicus
tgaaaccgccagagctagcggaggc

SEQ ID NO: 638252 - DNA, 25 bp, Rattus norvegicus
ggaagatgtgaaaccgccagagcta

SEQ ID NO: 638253 - DNA, 25 bp, Rattus norvegicus
tgcgggctcggacacagccaggaac

SEQ ID NO: 638254 - DNA, 25 bp, Rattus norvegicus
actgacacgtgattcggagccaggc

SEQ ID NO: 638255 - DNA, 25 bp, Rattus norvegicus
cgaagccctctgagcggcttgggca

SEQ ID NO: 638256 - DNA, 25 bp, Rattus norvegicus
cctcgaagccctctgagcggcttgg

SEQ ID NO: 638257 - DNA, 25 bp, Rattus norvegicus
ggagccctcgaagccctctgagcgg

SEQ ID NO: 638258 - DNA, 25 bp, Rattus norvegicus
tgggcgacctcggagccctcgaagc

SEQ ID NO: 638259 - DNA, 25 bp, Rattus norvegicus
gctgggcgacctcggagccctcgaa

SEQ ID NO: 638260 - DNA, 25 bp, Rattus norvegicus
acacgtgattcggagccaggcggac

SEQ ID NO: 638261 - DNA, 25 bp, Rattus norvegicus
cctccttggcgagccgggactagca

SEQ ID NO: 638262 - DNA, 25 bp, Rattus norvegicus
gcactgacacgtgattcggagccag

SEQ ID NO: 638263 - DNA, 25 bp, Rattus norvegicus
cgggcactgacacgtgattcggagc

SEQ ID NO: 638264 - DNA, 25 bp, Rattus norvegicus
cctcgggcactgacacgtgattcgg

SEQ ID NO: 638265 - DNA, 25 bp, Rattus norvegicus
cgcacacgcagacgggcagggcgcg

SEQ ID NO: 638266 - DNA, 25 bp, Rattus norvegicus
tgccgctcacgctgggctgagcgca

SEQ ID NO: 638267 - DNA, 25 bp, Rattus norvegicus
tgattcggagccaggcggacttgca

SEQ ID NO: 638268 - DNA, 25 bp, Rattus norvegicus
ttccctcaggtacgcgggaacctgc

SEQ ID NO: 638269 - DNA, 25 bp, Rattus norvegicus
tcctggggacagacgtcaggcgccc

SEQ ID NO: 638270 - DNA, 25 bp, Rattus norvegicus
gagcatcctcctggggacagacgtc

SEQ ID NO: 638271 - DNA, 25 bp, Rattus norvegicus
atctcacaggtagcgcgggagcatc

SEQ ID NO: 638272 - DNA, 25 bp, Rattus norvegicus
catgctgtcacccatctcacaggta

SEQ ID NO: 638273 - DNA, 25 bp, Rattus norvegicus
cctgcgttccaccaccatgctgtca

SEQ ID NO: 638274 - DNA, 25 bp, Rattus norvegicus
cgtagtcgaagaggagccgccttcc

SEQ ID NO: 638275 - DNA, 25 bp, Rattus norvegicus
caggacgggaccagccgtagtcgaa

SEQ ID NO: 638276 - DNA, 25 bp, Rattus norvegicus
tcgtctccagcggagggtcacgtga

SEQ ID NO: 638277 - DNA, 25 bp, Rattus norvegicus
cacagagtggctcgtctccagcgga

SEQ ID NO: 638278 - DNA, 25 bp, Rattus norvegicus
gaacctgcctgggtggctgtgccaa

SEQ ID NO: 638279 - DNA, 25 bp, Rattus norvegicus
acgtcacttcctggagcgacatacc

SEQ ID NO: 638280 - DNA, 25 bp, Rattus norvegicus
tgtgacgtcacttcctggagcgaca

SEQ ID NO: 638281 - DNA, 25 bp, Rattus norvegicus
gtgccaaggcacagagtggctcgtc

SEQ ID NO: 638282 - DNA, 25 bp, Rattus norvegicus
tcccgagacaggtgagccacactca

SEQ ID NO: 638283 - DNA, 25 bp, Rattus norvegicus
cagcgctcccgagacaggtgagcca

SEQ ID NO: 638284 - DNA, 25 bp, Rattus norvegicus
acttgctcatggctgagcagtggtg

SEQ ID NO: 638285 - DNA, 25 bp, Rattus norvegicus
ttgcccaacttgctcatggctgagc

SEQ ID NO: 638286 - DNA, 25 bp, Rattus norvegicus
gagcgagaccctttgaaaaacttgc

SEQ ID NO: 638287 - DNA, 25 bp, Rattus norvegicus
aggtgagccacactcagagccaaca

SEQ ID NO: 638288 - DNA, 25 bp, Rattus norvegicus
cccgagaagagcgagaccctttgaa

SEQ ID NO: 638289 - DNA, 25 bp, Rattus norvegicus
ctcagagccaacaaagctcctggga

SEQ ID NO: 638290 - DNA, 25 bp, Rattus norvegicus
gctcctgggaatcaacaagttgttt

SEQ ID NO: 638291 - DNA, 25 bp, Rattus norvegicus
aagttgtttcggcaggtgacaccca

SEQ ID NO: 638292 - DNA, 25 bp, Rattus norvegicus
ggtgacacccactccggggcatttc

SEQ ID NO: 638293 - DNA, 25 bp, Rattus norvegicus
ggggcatttcctggcccggctcagc

SEQ ID NO: 638294 - DNA, 25 bp, Rattus norvegicus
ctcgaatagccactcgggaaggggc

SEQ ID NO: 638295 - DNA, 25 bp, Rattus norvegicus
gaaaaacttgcccaacttgctcatg

SEQ ID NO: 638296 - DNA, 25 bp, Rattus norvegicus
gacattgggcagcactgccaggtgc

SEQ ID NO: 638297 - DNA, 25 bp, Rattus norvegicus
ggtcctcacccaggcccgcctctcc

SEQ ID NO: 638298 - DNA, 25 bp, Rattus norvegicus
aagcgcgctagcgtcatcacttccg

SEQ ID NO: 638299 - DNA, 25 bp, Rattus norvegicus
gcgcgctagcgtcatcacttccggt

SEQ ID NO: 638300 - DNA, 25 bp, Rattus norvegicus
tcatcacttccggtcctcacccagg

SEQ ID NO: 638301 - DNA, 25 bp, Rattus norvegicus
tgctgctccgggttgacgttcgcat

SEQ ID NO: 638302 - DNA, 25 bp, Rattus norvegicus
cgggttgacgttcgcatcgctgccc

SEQ ID NO: 638303 - DNA, 25 bp, Rattus norvegicus
cctgcccttgcggcggtggaaagat

SEQ ID NO: 638304 - DNA, 25 bp, Rattus norvegicus
gaattggacattgggcagcactgcc

SEQ ID NO: 638305 - DNA, 25 bp, Rattus norvegicus
ccaggtgcagcactgccggcagcga

SEQ ID NO: 638306 - DNA, 25 bp, Rattus norvegicus
gcactgccggcagcgaggtgacgct

SEQ ID NO: 638307 - DNA, 25 bp, Rattus norvegicus
gtgacgctggaagtcccattttcgt

SEQ ID NO: 638308 - DNA, 25 bp, Rattus norvegicus
cccattttcgtccgcgggagacctg

SEQ ID NO: 638309 - DNA, 25 bp, Rattus norvegicus
gcggaattggacattgggcagcact

SEQ ID NO: 638310 - DNA, 25 bp, Rattus norvegicus
cggcaagttcccaggctcacgaatt

SEQ ID NO: 638311 - DNA, 25 bp, Rattus norvegicus
gcggtcctcggtctctgaggttcta

SEQ ID NO: 638312 - DNA, 25 bp, Rattus norvegicus
atgagcccgactctgccaaagacct

SEQ ID NO: 638313 - DNA, 25 bp, Rattus norvegicus
gctcacgaatttacacggttaggga

SEQ ID NO: 638314 - DNA, 25 bp, Rattus norvegicus
gttctacgtcgcagaatgagcccga

SEQ ID NO: 638315 - DNA, 25 bp, Rattus norvegicus
cccgctcataggttttaatggggcg

SEQ ID NO: 638316 - DNA, 25 bp, Rattus norvegicus
tgctctccgtagtgctccggaaaca

SEQ ID NO: 638317 - DNA, 25 bp, Rattus norvegicus
acaagctgttcccatgctgagccgg

SEQ ID NO: 638318 - DNA, 25 bp, Rattus norvegicus
atttcgtgcagcgttattcggtgtc

SEQ ID NO: 638319 - DNA, 25 bp, Rattus norvegicus
gagtccgttctgtccctgcatttcg

SEQ ID NO: 638320 - DNA, 25 bp, Rattus norvegicus
cgccagcggttgagcatcgattgcg

SEQ ID NO: 638321 - DNA, 25 bp, Rattus norvegicus
tccggaagagccgaagaaccgagcc

SEQ ID NO: 638322 - DNA, 25 bp, Rattus norvegicus
gcgggacttcctgtcggagcaatcc

SEQ ID NO: 638323 - DNA, 25 bp, Rattus norvegicus
agacctcagggctctacacggcaag

SEQ ID NO: 638324 - DNA, 25 bp, Rattus norvegicus
ggacgtgaacacagggaaggaccca

SEQ ID NO: 638325 - DNA, 25 bp, Rattus norvegicus
agttagtgtggcttcgcaattcctc

SEQ ID NO: 638326 - DNA, 25 bp, Rattus norvegicus
ccatgtcaggagttagtgtggcttc

SEQ ID NO: 638327 - DNA, 25 bp, Rattus norvegicus
acgcacgcagccatgtcaggagtta

SEQ ID NO: 638328 - DNA, 25 bp, Rattus norvegicus
agatcactatcctgacgcacgcagc

SEQ ID NO: 638329 - DNA, 25 bp, Rattus norvegicus
cagggaaggacccagatcactatcc

SEQ ID NO: 638330 - DNA, 25 bp, Rattus norvegicus
ctgttgggaagaggacgtgaacaca

SEQ ID NO: 638331 - DNA, 25 bp, Rattus norvegicus
tcccgagaagccactgttgggaaga

SEQ ID NO: 638332 - DNA, 25 bp, Rattus norvegicus
tctcagtagatacggtttgtttccc

SEQ ID NO: 638333 - DNA, 25 bp, Rattus norvegicus
ttcctctgacgaagcgggacatttc

SEQ ID NO: 638334 - DNA, 25 bp, Rattus norvegicus
agcatggcttcatctgtcaggggcc

SEQ ID NO: 638335 - DNA, 25 bp, Rattus norvegicus
gcgggacatttctaagcatggcttc

SEQ ID NO: 638336 - DNA, 25 bp, Rattus norvegicus
tgttcacgcacgttctcagtagata

SEQ ID NO: 638337 - DNA, 25 bp, Rattus norvegicus
tcgcaattcctctgacgaagcggga

SEQ ID NO: 638338 - DNA, 25 bp, Rattus norvegicus
agtcgcgaacatgcgcactgaaccc

SEQ ID NO: 638339 - DNA, 25 bp, Rattus norvegicus
cgggagctccgagcacagctctcaa

SEQ ID NO: 638340 - DNA, 25 bp, Rattus norvegicus
tccctcagagctggagacaggcacc

SEQ ID NO: 638341 - DNA, 25 bp, Rattus norvegicus
gactctgtggtgtagcattccctca

SEQ ID NO: 638342 - DNA, 25 bp, Rattus norvegicus
ggagcctctcctgcggggactctgt

SEQ ID NO: 638343 - DNA, 25 bp, Rattus norvegicus
agctctgcagcgctctggagcctct

SEQ ID NO: 638344 - DNA, 25 bp, Rattus norvegicus
cgcgggtgctgtgactgctcctcca

SEQ ID NO: 638345 - DNA, 25 bp, Rattus norvegicus
tgacgtgccgcagcagtcgcgaaca

SEQ ID NO: 638346 - DNA, 25 bp, Rattus norvegicus
tggcggagttgcagcgcttcttagc

SEQ ID NO: 638347 - DNA, 25 bp, Rattus norvegicus
cacagctctcaagggctggcggcca

SEQ ID NO: 638348 - DNA, 25 bp, Rattus norvegicus
agggctgctgactggtagctctgca

SEQ ID NO: 638349 - DNA, 25 bp, Rattus norvegicus
gaccaagcgggtcctgcgccagcta

SEQ ID NO: 638350 - DNA, 25 bp, Rattus norvegicus
gccacgaaggcgtttgcttgggtcc

SEQ ID NO: 638351 - DNA, 25 bp, Rattus norvegicus
tgcagtccgagtctctgcggctgcc

SEQ ID NO: 638352 - DNA, 25 bp, Rattus norvegicus
atagagacgctactggaggcggccc

SEQ ID NO: 638353 - DNA, 25 bp, Rattus norvegicus
tttctgcgggtaccaccctagctgc

SEQ ID NO: 638354 - DNA, 25 bp, Rattus norvegicus
tcattaacatgcaaagagggaccca

SEQ ID NO: 638355 - DNA, 25 bp, Rattus norvegicus
cccacaagagctgccatccgggagg

SEQ ID NO: 638356 - DNA, 25 bp, Rattus norvegicus
tatggtgcgacctaaaaagccgggc

SEQ ID NO: 638357 - DNA, 25 bp, Rattus norvegicus
tcctggaatggcaagcgcagcaaca

SEQ ID NO: 638358 - DNA, 25 bp, Rattus norvegicus
cgccctcgctaccattgagaatgtg

SEQ ID NO: 638359 - DNA, 25 bp, Rattus norvegicus
ctctcggcgcgatgagcatagagac

SEQ ID NO: 638360 - DNA, 25 bp, Rattus norvegicus
gccagcctgacctgtgcttggctcg

SEQ ID NO: 638361 - DNA, 25 bp, Rattus norvegicus
ttctttcctgaggagtgcgctgctc

SEQ ID NO: 638362 - DNA, 25 bp, Rattus norvegicus
gcaaagccctttcttgtcggcggga

SEQ ID NO: 638363 - DNA, 25 bp, Rattus norvegicus
gtgcctcctcgccatcttgttgcaa

SEQ ID NO: 638364 - DNA, 25 bp, Rattus norvegicus
ggctccttcccttgttgtgtgtgtc

SEQ ID NO: 638365 - DNA, 25 bp, Rattus norvegicus
ttcactggaaatcccaggcaggccc

SEQ ID NO: 638366 - DNA, 25 bp, Rattus norvegicus
aggaaggaacgctactcccgggcag

SEQ ID NO: 638367 - DNA, 25 bp, Rattus norvegicus
gcgcgggcgggtagctgagaagccc

SEQ ID NO: 638368 - DNA, 25 bp, Rattus norvegicus
tggtggacggcgacgaggatgacga

SEQ ID NO: 638369 - DNA, 25 bp, Rattus norvegicus
atgacgaggactccgaggaacgctt

SEQ ID NO: 638370 - DNA, 25 bp, Rattus norvegicus
aggactccgaggaacgcttcgtgcc

SEQ ID NO: 638371 - DNA, 25 bp, Rattus norvegicus
gaggaacgcttcgtgcccctcggac

SEQ ID NO: 638372 - DNA, 25 bp, Rattus norvegicus
ctggacgaggttaggagccccgatc

SEQ ID NO: 638373 - DNA, 25 bp, Rattus norvegicus
tggccgtgcgcttcctaagggcccg

SEQ ID NO: 638374 - DNA, 25 bp, Rattus norvegicus
tgcgtgcgaggtaccagggttctgt

SEQ ID NO: 638375 - DNA, 25 bp, Rattus norvegicus
ggcggcctgtcgttgctcagaggtc

SEQ ID NO: 638376 - DNA, 25 bp, Rattus norvegicus
tggattggtagtcccgcgtgccggt

SEQ ID NO: 638377 - DNA, 25 bp, Rattus norvegicus
gcagcgcgcggaactgcggctcagc

SEQ ID NO: 638378 - DNA, 25 bp, Rattus norvegicus
gaaacttgggagctggacgaggtta

SEQ ID NO: 638379 - DNA, 25 bp, Rattus norvegicus
tcgttgctcagaggtcgggtggatt

SEQ ID NO: 638380 - DNA, 25 bp, Rattus norvegicus
tggtcctctgatttcctgtgccaga

SEQ ID NO: 638381 - DNA, 25 bp, Rattus norvegicus
tgctctcagcagtcgtctcacgccc

SEQ ID NO: 638382 - DNA, 25 bp, Rattus norvegicus
tcacgccctagtcccagtggcatgg

SEQ ID NO: 638383 - DNA, 25 bp, Rattus norvegicus
ccctagtcccagtggcatgggttct

SEQ ID NO: 638384 - DNA, 25 bp, Rattus norvegicus
tcccagtggcatgggttctggtcct

SEQ ID NO: 638385 - DNA, 25 bp, Rattus norvegicus
ccagtggcatgggttctggtcctct

SEQ ID NO: 638386 - DNA, 25 bp, Rattus norvegicus
gttctggtcctctgatttcctgtgc

SEQ ID NO: 638387 - DNA, 25 bp, Rattus norvegicus
cctctgatttcctgtgccagatgca

SEQ ID NO: 638388 - DNA, 25 bp, Rattus norvegicus
atttcctgtgccagatgcatctcta

SEQ ID NO: 638389 - DNA, 25 bp, Rattus norvegicus
tgtgccagatgcatctctaagcttc

SEQ ID NO: 638390 - DNA, 25 bp, Rattus norvegicus
gccagatgcatctctaagcttctcc

SEQ ID NO: 638391 - DNA, 25 bp, Rattus norvegicus
tgcatctctaagcttctccttcagg

SEQ ID NO: 638392 - DNA, 25 bp, Rattus norvegicus
ctccttcaggaagccttccttcctt

SEQ ID NO: 638393 - DNA, 25 bp, Rattus norvegicus
atctctaagcttctccttcaggaag

SEQ ID NO: 638394 - DNA, 25 bp, Rattus norvegicus
atttcactgaacgacatggcgcgcg

SEQ ID NO: 638395 - DNA, 25 bp, Rattus norvegicus
gcgactgctgccattgttgccgaga

SEQ ID NO: 638396 - DNA, 25 bp, Rattus norvegicus
cgggaagtgctggacagtctctcct

SEQ ID NO: 638397 - DNA, 25 bp, Rattus norvegicus
gtgctggacagtctctccttctcca

SEQ ID NO: 638398 - DNA, 25 bp, Rattus norvegicus
ctcctcctcggtgctgtagctcagg

SEQ ID NO: 638399 - DNA, 25 bp, Rattus norvegicus
agccctcgcccattgaaatgcctga

SEQ ID NO: 638400 - DNA, 25 bp, Rattus norvegicus
attgaaatgcctgaggggccacgcc

SEQ ID NO: 638401 - DNA, 25 bp, Rattus norvegicus
cagagtccgacggttcctttccgct

SEQ ID NO: 638402 - DNA, 25 bp, Rattus norvegicus
cgacggttcctttccgctagcaggg

SEQ ID NO: 638403 - DNA, 25 bp, Rattus norvegicus
cgtgtcctgagggagcagcaactcc

SEQ ID NO: 638404 - DNA, 25 bp, Rattus norvegicus
ggagcagcaactccttggcgtcctc

SEQ ID NO: 638405 - DNA, 25 bp, Rattus norvegicus
gctgaaactgcggaggccaagaaga

SEQ ID NO: 638406 - DNA, 25 bp, Rattus norvegicus
agcgtcctgcggctcatttcactga

SEQ ID NO: 638407 - DNA, 25 bp, Rattus norvegicus
ccagcgttattgttcgtggggccgc

SEQ ID NO: 638408 - DNA, 25 bp, Rattus norvegicus
cgtgcccgactctcgccacgacttc

SEQ ID NO: 638409 - DNA, 25 bp, Rattus norvegicus
aggacacctccttgggcgcattgtg

SEQ ID NO: 638410 - DNA, 25 bp, Rattus norvegicus
ggctcggccaggacaaacagctggc

SEQ ID NO: 638411 - DNA, 25 bp, Rattus norvegicus
ccaggacaaacagctggcgagtgtc

SEQ ID NO: 638412 - DNA, 25 bp, Rattus norvegicus
gggcagcacctctagcccagggcga

SEQ ID NO: 638413 - DNA, 25 bp, Rattus norvegicus
ttccttgacaaaagactggaccagg

SEQ ID NO: 638414 - DNA, 25 bp, Rattus norvegicus
ccacgacttcacctgggactcggga

SEQ ID NO: 638415 - DNA, 25 bp, Rattus norvegicus
agcccagggcgacgatcgtttcaca

SEQ ID NO: 638416 - DNA, 25 bp, Rattus norvegicus
gcgcattgtgtacgccgggcagcac

SEQ ID NO: 638417 - DNA, 25 bp, Rattus norvegicus
aagactggaccaggcggtgcctccc

SEQ ID NO: 638418 - DNA, 25 bp, Rattus norvegicus
agtgaacttattttgttccttgaca

SEQ ID NO: 638419 - DNA, 25 bp, Rattus norvegicus
ccgtgcccgaggaagtgaacttatt

SEQ ID NO: 638420 - DNA, 25 bp, Rattus norvegicus
taactgctgtgggagcgcgtcccag

SEQ ID NO: 638421 - DNA, 25 bp, Rattus norvegicus
cctgggactcgggagtaactgctgt

SEQ ID NO: 638422 - DNA, 25 bp, Rattus norvegicus
ctcagacatggaccgtggcgagcaa

SEQ ID NO: 638423 - DNA, 25 bp, Rattus norvegicus
ctaggatgcgcgcagggagggccac

SEQ ID NO: 638424 - DNA, 25 bp, Rattus norvegicus
tgtgctccggcgtgcccgagcgact

SEQ ID NO: 638425 - DNA, 25 bp, Rattus norvegicus
cccgagcgactgtgcgcggtcgcgt

SEQ ID NO: 638426 - DNA, 25 bp, Rattus norvegicus
gaggagaagggtggcgagaggccac

SEQ ID NO: 638427 - DNA, 25 bp, Rattus norvegicus
agaggccacggaggtgctaggatgc

SEQ ID NO: 638428 - DNA, 25 bp, Rattus norvegicus
agtctcttaccagcgcggagcggga

SEQ ID NO: 638429 - DNA, 25 bp, Rattus norvegicus
ccgagccgacgtggcggagcgcaca

SEQ ID NO: 638430 - DNA, 25 bp, Rattus norvegicus
cggagcgcacaggtcgcggtcaggt

SEQ ID NO: 638431 - DNA, 25 bp, Rattus norvegicus
tcaggtggtcggtgacgcccgggac

SEQ ID NO: 638432 - DNA, 25 bp, Rattus norvegicus
agccggggagtctcttaccagcgcg

SEQ ID NO: 638433 - DNA, 25 bp, Rattus norvegicus
gccgggagcgaggtggctcagacat

SEQ ID NO: 638434 - DNA, 25 bp, Rattus norvegicus
accgtggcgagcaaggtaggcggct

SEQ ID NO: 638435 - DNA, 25 bp, Rattus norvegicus
caacccggtccgcttcgtggcggag

SEQ ID NO: 638436 - DNA, 25 bp, Rattus norvegicus
ccctgaccggccagcgtgcggaaga

SEQ ID NO: 638437 - DNA, 25 bp, Rattus norvegicus
ctctggagcgacactcggagctgca

SEQ ID NO: 638438 - DNA, 25 bp, Rattus norvegicus
cgctcaggaggcttcgcgagcgctc

SEQ ID NO: 638439 - DNA, 25 bp, Rattus norvegicus
gaatgcgatccacgattcctccgct

SEQ ID NO: 638440 - DNA, 25 bp, Rattus norvegicus
ggcgccgagaatgcgatccacgatt

SEQ ID NO: 638441 - DNA, 25 bp, Rattus norvegicus
ttgcgaaatgcaagtacggagagtg

SEQ ID NO: 638442 - DNA, 25 bp, Rattus norvegicus
ttgtcttctccaagcctttgcgaaa

SEQ ID NO: 638443 - DNA, 25 bp, Rattus norvegicus
tcacacgccgggactgttgggagcc

SEQ ID NO: 638444 - DNA, 25 bp, Rattus norvegicus
tcgcccagtattagggcagtaggcg

SEQ ID NO: 638445 - DNA, 25 bp, Rattus norvegicus
gcctcgcaggctcgcccagtattag

SEQ ID NO: 638446 - DNA, 25 bp, Rattus norvegicus
ggcattaatctacgggcctcgcagg

SEQ ID NO: 638447 - DNA, 25 bp, Rattus norvegicus
gagagcggtcaattaggcattaatc

SEQ ID NO: 638448 - DNA, 25 bp, Rattus norvegicus
gaggcatgcgctctctccatggcgt

SEQ ID NO: 638449 - DNA, 25 bp, Rattus norvegicus
ccgtttcctgagagcgcttgtcttc

SEQ ID NO: 638450 - DNA, 25 bp, Rattus norvegicus
gcggctcccgctggcttttcatcgt

SEQ ID NO: 638451 - DNA, 25 bp, Rattus norvegicus
gctcccgctggcttttcatcgtccc

SEQ ID NO: 638452 - DNA, 25 bp, Rattus norvegicus
ctgcggcttgcttgcgggtgactgg

SEQ ID NO: 638453 - DNA, 25 bp, Rattus norvegicus
cttgcgggtgactggtgacagtcaa

SEQ ID NO: 638454 - DNA, 25 bp, Rattus norvegicus
tgcgggtgactggtgacagtcaagc

SEQ ID NO: 638455 - DNA, 25 bp, Rattus norvegicus
gactggtgacagtcaagcgggcggc

SEQ ID NO: 638456 - DNA, 25 bp, Rattus norvegicus
tgacagtcaagcgggcggcgcctca

SEQ ID NO: 638457 - DNA, 25 bp, Rattus norvegicus
tcagtggccccggtggcagggacag

SEQ ID NO: 638458 - DNA, 25 bp, Rattus norvegicus
gacagcctcccacctcgaaacgacc

SEQ ID NO: 638459 - DNA, 25 bp, Rattus norvegicus
acagcctcccacctcgaaacgacca

SEQ ID NO: 638460 - DNA, 25 bp, Rattus norvegicus
gcctcccacctcgaaacgaccacca

SEQ ID NO: 638461 - DNA, 25 bp, Rattus norvegicus
tcccacctcgaaacgaccaccacca

SEQ ID NO: 638462 - DNA, 25 bp, Rattus norvegicus
ggcttttcatcgtccccgcctgcgg

SEQ ID NO: 638463 - DNA, 25 bp, Rattus norvegicus
cacctcgaaacgaccaccaccacgc

SEQ ID NO: 638464 - DNA, 25 bp, Rattus norvegicus
aggggccgtgaaagagcctgatcca

SEQ ID NO: 638465 - DNA, 25 bp, Rattus norvegicus
ccggccaagttcacgtgcacactcg

SEQ ID NO: 638466 - DNA, 25 bp, Rattus norvegicus
cccggccaagttcacgtgcacactc

SEQ ID NO: 638467 - DNA, 25 bp, Rattus norvegicus
agagcctgatccagccccggccaag

SEQ ID NO: 638468 - DNA, 25 bp, Rattus norvegicus
tgaaagagcctgatccagccccggc

SEQ ID NO: 638469 - DNA, 25 bp, Rattus norvegicus
gccgtgaaagagcctgatccagccc

SEQ ID NO: 638470 - DNA, 25 bp, Rattus norvegicus
gggccgtgaaagagcctgatccagc

SEQ ID NO: 638471 - DNA, 25 bp, Rattus norvegicus
caggggccgtgaaagagcctgatcc

SEQ ID NO: 638472 - DNA, 25 bp, Rattus norvegicus
accgcgtgggaaagcccgccgcagg

SEQ ID NO: 638473 - DNA, 25 bp, Rattus norvegicus
tgaccgcgtgggaaagcccgccgca

SEQ ID NO: 638474 - DNA, 25 bp, Rattus norvegicus
atacatcacccggtcaccctgaccg

SEQ ID NO: 638475 - DNA, 25 bp, Rattus norvegicus
cggtcaccctgaccgcgtgggaaag

SEQ ID NO: 638476 - DNA, 25 bp, Rattus norvegicus
ggccgtgaaagagcctgatccagcc

SEQ ID NO: 638477 - DNA, 25 bp, Rattus norvegicus
gtcaccctgaccgcgtgggaaagcc

SEQ ID NO: 638478 - DNA, 25 bp, Rattus norvegicus
ctgcgttccccagtggctgcacgta

SEQ ID NO: 638479 - DNA, 25 bp, Rattus norvegicus
agtcggcgtcacttgtttgcagtta

SEQ ID NO: 638480 - DNA, 25 bp, Rattus norvegicus
tcggcgtcacttgtttgcagttagc

SEQ ID NO: 638481 - DNA, 25 bp, Rattus norvegicus
gtttgcagttagctcatggcgtggc

SEQ ID NO: 638482 - DNA, 25 bp, Rattus norvegicus
tgcacgtaggccggcggcttctaat

SEQ ID NO: 638483 - DNA, 25 bp, Rattus norvegicus
ttagctcatggcgtggcagatactg

SEQ ID NO: 638484 - DNA, 25 bp, Rattus norvegicus
tcctgagagagagagtcggcgtcac

SEQ ID NO: 638485 - DNA, 25 bp, Rattus norvegicus
gcgtcacttgtttgcagttagctca

SEQ ID NO: 638486 - DNA, 25 bp, Rattus norvegicus
cacttgtttgcagttagctcatggc

SEQ ID NO: 638487 - DNA, 25 bp, Rattus norvegicus
agagagtcggcgtcacttgtttgca

SEQ ID NO: 638488 - DNA, 25 bp, Rattus norvegicus
cgcgaggtggttgatgagtttttcc

SEQ ID NO: 638489 - DNA, 25 bp, Rattus norvegicus
gttgatgagtttttcctgagagaga

SEQ ID NO: 638490 - DNA, 25 bp, Rattus norvegicus
tttttcctgagagagagagtcggcg

SEQ ID NO: 638491 - DNA, 25 bp, Rattus norvegicus
cagttagctcatggcgtggcagata

SEQ ID NO: 638492 - DNA, 25 bp, Rattus norvegicus
ttgagttttaaccagaggctgagcg

SEQ ID NO: 638493 - DNA, 25 bp, Rattus norvegicus
ctggcacacggccaggccaatcggg

SEQ ID NO: 638494 - DNA, 25 bp, Rattus norvegicus
ccatgaagagagctcacccggacta

SEQ ID NO: 638495 - DNA, 25 bp, Rattus norvegicus
attacaggttcacaccaggagcccg

SEQ ID NO: 638496 - DNA, 25 bp, Rattus norvegicus
tccattcatgcggacgcccagagct

SEQ ID NO: 638497 - DNA, 25 bp, Rattus norvegicus
cgcccggactccgattacaggttca

SEQ ID NO: 638498 - DNA, 25 bp, Rattus norvegicus
tgagttagcggcgtccggccgatcc

SEQ ID NO: 638499 - DNA, 25 bp, Rattus norvegicus
accgacagcagtgccgagagccgga

SEQ ID NO: 638500 - DNA, 25 bp, Rattus norvegicus
cgctgggcaccgacagcagtgccga

SEQ ID NO: 638501 - DNA, 25 bp, Rattus norvegicus
gctccgccaccatgaagagagctca

SEQ ID NO: 638502 - DNA, 25 bp, Rattus norvegicus
acccggactacagctcctctgatag

SEQ ID NO: 638503 - DNA, 25 bp, Rattus norvegicus
gctcctctgatagtgagctggacga

SEQ ID NO: 638504 - DNA, 25 bp, Rattus norvegicus
atagtgagctggacgagaccatcga

SEQ ID NO: 638505 - DNA, 25 bp, Rattus norvegicus
gccaggctattcttctccattcatg

SEQ ID NO: 638506 - DNA, 25 bp, Rattus norvegicus
cgccttggccatgactaatggactc

SEQ ID NO: 638507 - DNA, 25 bp, Rattus norvegicus
actgcaacaggtgcagtggctgctg

SEQ ID NO: 638508 - DNA, 25 bp, Rattus norvegicus
cgccaaagggatgctgtcgcactcc

SEQ ID NO: 638509 - DNA, 25 bp, Rattus norvegicus
caagtcacatcttacctggctctga

SEQ ID NO: 638510 - DNA, 25 bp, Rattus norvegicus
tctgaggtcaccgacatctgcgtgc

SEQ ID NO: 638511 - DNA, 25 bp, Rattus norvegicus
taatggactcttccagcgcccaagc

SEQ ID NO: 638512 - DNA, 25 bp, Rattus norvegicus
tgccgggccttcctttcacacccag

SEQ ID NO: 638513 - DNA, 25 bp, Rattus norvegicus
gctctggcttcaacctactgcaaca

SEQ ID NO: 638514 - DNA, 25 bp, Rattus norvegicus
gccgctaatcctttcccgcactgtc

SEQ ID NO: 638515 - DNA, 25 bp, Rattus norvegicus
ctagcgctcctctgctccaatagga

SEQ ID NO: 638516 - DNA, 25 bp, Rattus norvegicus
tgctccaataggactctggcccggg

SEQ ID NO: 638517 - DNA, 25 bp, Rattus norvegicus
cgactgtcttggcagcaggcgtgat

SEQ ID NO: 638518 - DNA, 25 bp, Rattus norvegicus
aacgcagggcccacagtcccgggtg

SEQ ID NO: 638519 - DNA, 25 bp, Rattus norvegicus
ttggcagcaggcgtgatgaactccc

SEQ ID NO: 638520 - DNA, 25 bp, Rattus norvegicus
ctgcggtacatccaggtatggggaa

SEQ ID NO: 638521 - DNA, 25 bp, Rattus norvegicus
acgaagcgagtccagcaccttgctg

SEQ ID NO: 638522 - DNA, 25 bp, Rattus norvegicus
aatccagagggacggtgtgtttgct

SEQ ID NO: 638523 - DNA, 25 bp, Rattus norvegicus
cctggcagtgctcaggattactgtc

SEQ ID NO: 638524 - DNA, 25 bp, Rattus norvegicus
gcgcgaagccactgagccttaacta

SEQ ID NO: 638525 - DNA, 25 bp, Rattus norvegicus
attccgcgaatgctgagaaggggtc

SEQ ID NO: 638526 - DNA, 25 bp, Rattus norvegicus
ggctgtgtctcctctcttcttggac

SEQ ID NO: 638527 - DNA, 25 bp, Rattus norvegicus
tcttcttggacactggctgccctct

SEQ ID NO: 638528 - DNA, 25 bp, Rattus norvegicus
ccctctctgctgcagtgcgaagtta

SEQ ID NO: 638529 - DNA, 25 bp, Rattus norvegicus
gcgaagttactgtcgccctggaaac

SEQ ID NO: 638530 - DNA, 25 bp, Rattus norvegicus
cggctgcatcagagcttccgtggga

SEQ ID NO: 638531 - DNA, 25 bp, Rattus norvegicus
ttcggccgctaggtcacaacctgga

SEQ ID NO: 638532 - DNA, 25 bp, Rattus norvegicus
gccagcttcctcctgctaggggcag

SEQ ID NO: 638533 - DNA, 25 bp, Rattus norvegicus
taagcacatggcctggctgacgtca

SEQ ID NO: 638534 - DNA, 25 bp, Rattus norvegicus
cacgccctggctatggactatcgga

SEQ ID NO: 638535 - DNA, 25 bp, Rattus norvegicus
tgcctggctgaagttgcccgttatc

SEQ ID NO: 638536 - DNA, 25 bp, Rattus norvegicus
gcccgttatctgagcatcattgaag

SEQ ID NO: 638537 - DNA, 25 bp, Rattus norvegicus
ttgaaggactcgatgcctccgatcc

SEQ ID NO: 638538 - DNA, 25 bp, Rattus norvegicus
gtgttcgcctggtctcccatctcaa

SEQ ID NO: 638539 - DNA, 25 bp, Rattus norvegicus
acaactacgcatcccagcgggaagc

SEQ ID NO: 638540 - DNA, 25 bp, Rattus norvegicus
acattccttggggaagcgccttcgg

SEQ ID NO: 638541 - DNA, 25 bp, Rattus norvegicus
gggaagcgccttcggacatcaccca

SEQ ID NO: 638542 - DNA, 25 bp, Rattus norvegicus
aatggccacgggaacgctggcacta

SEQ ID NO: 638543 - DNA, 25 bp, Rattus norvegicus
tggcactacggcgtcacccacggag

SEQ ID NO: 638544 - DNA, 25 bp, Rattus norvegicus
acggagccgcatcaccagggcaggc

SEQ ID NO: 638545 - DNA, 25 bp, Rattus norvegicus
aggctggcctctgcccatcctgagg

SEQ ID NO: 638546 - DNA, 25 bp, Rattus norvegicus
accagtgttcccgtggtgctcagcc

SEQ ID NO: 638547 - DNA, 25 bp, Rattus norvegicus
tggtgctcagcctccaaactgtcgc

SEQ ID NO: 638548 - DNA, 25 bp, Rattus norvegicus
gcacaagtaggtgcgcctagcgcgc

SEQ ID NO: 638549 - DNA, 25 bp, Rattus norvegicus
cccagacccagagattcaaagcctg

SEQ ID NO: 638550 - DNA, 25 bp, Rattus norvegicus
cacctgggcgtacaaccctgggcgg

SEQ ID NO: 638551 - DNA, 25 bp, Rattus norvegicus
agccattggcacctgggcgtacaac

SEQ ID NO: 638552 - DNA, 25 bp, Rattus norvegicus
ctcggtggcccagagccattggcac

SEQ ID NO: 638553 - DNA, 25 bp, Rattus norvegicus
atggtcagccactacccgcgctgag

SEQ ID NO: 638554 - DNA, 25 bp, Rattus norvegicus
agagcacggcctctcccatggtcag

SEQ ID NO: 638555 - DNA, 25 bp, Rattus norvegicus
gctgctctctggtgcgcacaagtag

SEQ ID NO: 638556 - DNA, 25 bp, Rattus norvegicus
ttgcactttggaccggctgagagca

SEQ ID NO: 638557 - DNA, 25 bp, Rattus norvegicus
gaatagcccggccttgcactttgga

SEQ ID NO: 638558 - DNA, 25 bp, Rattus norvegicus
cacgtccgggaatagcccggccttg

SEQ ID NO: 638559 - DNA, 25 bp, Rattus norvegicus
tctgggacacttcagaacctgccac

SEQ ID NO: 638560 - DNA, 25 bp, Rattus norvegicus
gattcaaagcctgagcccgggacgc

SEQ ID NO: 638561 - DNA, 25 bp, Rattus norvegicus
cggggactctgggacacttcagaac

SEQ ID NO: 638562 - DNA, 25 bp, Rattus norvegicus
tagcccgtccatggcgcgccgcctc

SEQ ID NO: 638563 - DNA, 25 bp, Rattus norvegicus
cagcccgcggtcaccgctccggtaa

SEQ ID NO: 638564 - DNA, 25 bp, Rattus norvegicus
gctccggtaaggggacctccagctc

SEQ ID NO: 638565 - DNA, 25 bp, Rattus norvegicus
agcacggggacctcgctgcagagcc

SEQ ID NO: 638566 - DNA, 25 bp, Rattus norvegicus
agagccggcgggctgcacttttccc

SEQ ID NO: 638567 - DNA, 25 bp, Rattus norvegicus
cctggtcgctcgtgcccgctcgagc

SEQ ID NO: 638568 - DNA, 25 bp, Rattus norvegicus
gtctcaccttctagcccgtccatgg

SEQ ID NO: 638569 - DNA, 25 bp, Rattus norvegicus
ctcaggatcctcaggcagcacccgc

SEQ ID NO: 638570 - DNA, 25 bp, Rattus norvegicus
agctctggctgtagcaacccggccg

SEQ ID NO: 638571 - DNA, 25 bp, Rattus norvegicus
gccgcgcctcccacactctaacatt

SEQ ID NO: 638572 - DNA, 25 bp, Rattus norvegicus
tctaacattccggcctcccattggt

SEQ ID NO: 638573 - DNA, 25 bp, Rattus norvegicus
tcccattggtccgctctggcggggc

SEQ ID NO: 638574 - DNA, 25 bp, Rattus norvegicus
agtagccgaggaccgtgccccgcag

SEQ ID NO: 638575 - DNA, 25 bp, Rattus norvegicus
cgccgccgcccagctctggctgtag

SEQ ID NO: 638576 - DNA, 25 bp, Rattus norvegicus
cggtccattgaagtgcccgaaggca

SEQ ID NO: 638577 - DNA, 25 bp, Rattus norvegicus
gctcttgacagtgttatgcgcctcg

SEQ ID NO: 638578 - DNA, 25 bp, Rattus norvegicus
acgtggtttgctcttgacagtgtta

SEQ ID NO: 638579 - DNA, 25 bp, Rattus norvegicus
gggtacgtggtttgctcttgacagt

SEQ ID NO: 638580 - DNA, 25 bp, Rattus norvegicus
ctacctctctgacgttgaaaagggg

SEQ ID NO: 638581 - DNA, 25 bp, Rattus norvegicus
ctaatactctacctctctgacgttg

SEQ ID NO: 638582 - DNA, 25 bp, Rattus norvegicus
tgcccgaaggcaccctactaatact

SEQ ID NO: 638583 - DNA, 25 bp, Rattus norvegicus
cacgccctcttactcgctgccgggg

SEQ ID NO: 638584 - DNA, 25 bp, Rattus norvegicus
caacccggtccattgaagtgcccga

SEQ ID NO: 638585 - DNA, 25 bp, Rattus norvegicus
gggtcaacccggtccattgaagtgc

SEQ ID NO: 638586 - DNA, 25 bp, Rattus norvegicus
acagaggggtcaacccggtccattg

SEQ ID NO: 638587 - DNA, 25 bp, Rattus norvegicus
ctcccggatgacagaggggtcaacc

SEQ ID NO: 638588 - DNA, 25 bp, Rattus norvegicus
cctaacctcccggatgacagagggg

SEQ ID NO: 638589 - DNA, 25 bp, Rattus norvegicus
gaaggcaccctactaatactctacc

SEQ ID NO: 638590 - DNA, 25 bp, Rattus norvegicus
gccagccggagcagcacattgcttg

SEQ ID NO: 638591 - DNA, 25 bp, Rattus norvegicus
gaccgattttacacccgcggcatta

SEQ ID NO: 638592 - DNA, 25 bp, Rattus norvegicus
gtttgattttctctgaccgatttta

SEQ ID NO: 638593 - DNA, 25 bp, Rattus norvegicus
cccaggatggagtttgattttctct

SEQ ID NO: 638594 - DNA, 25 bp, Rattus norvegicus
gagtctgccagctgcacccgaaaga

SEQ ID NO: 638595 - DNA, 25 bp, Rattus norvegicus
cgcctctttggtttccaggaactga

SEQ ID NO: 638596 - DNA, 25 bp, Rattus norvegicus
agcacattgcttgcgatccgcgggg

SEQ ID NO: 638597 - DNA, 25 bp, Rattus norvegicus
tgcatgaagtcatcgccagccggag

SEQ ID NO: 638598 - DNA, 25 bp, Rattus norvegicus
tccaagccggctgcatgaagtcatc

SEQ ID NO: 638599 - DNA, 25 bp, Rattus norvegicus
ctggctactccaagccggctgcatg

SEQ ID NO: 638600 - DNA, 25 bp, Rattus norvegicus
gcagctgcagcctcggctggctact

SEQ ID NO: 638601 - DNA, 25 bp, Rattus norvegicus
cagcgacttaccttcgggatggaga

SEQ ID NO: 638602 - DNA, 25 bp, Rattus norvegicus
tccgatagcgcggaccagcgactta

SEQ ID NO: 638603 - DNA, 25 bp, Rattus norvegicus
gggagactcgcctctttggtttcca

SEQ ID NO: 638604 - DNA, 25 bp, Rattus norvegicus
ggagtgtcctcttcggcgtctcctt

SEQ ID NO: 638605 - DNA, 25 bp, Rattus norvegicus
gggatgtgacacgaaagcctcttca

SEQ ID NO: 638606 - DNA, 25 bp, Rattus norvegicus
tgaccgcttggtgactcttctgcca

SEQ ID NO: 638607 - DNA, 25 bp, Rattus norvegicus
ctttgcagaccaatcccagggcgtg

SEQ ID NO: 638608 - DNA, 25 bp, Rattus norvegicus
acccagaggtcccaacgggatgtga

SEQ ID NO: 638609 - DNA, 25 bp, Rattus norvegicus
attttccgccgttgggccgtatgca

SEQ ID NO: 638610 - DNA, 25 bp, Rattus norvegicus
gggccgtatgcagctttcctctaaa

SEQ ID NO: 638611 - DNA, 25 bp, Rattus norvegicus
taatttcccaggtttctttcagcca

SEQ ID NO: 638612 - DNA, 25 bp, Rattus norvegicus
ccgcgaattccggaagcgagggcta

SEQ ID NO: 638613 - DNA, 25 bp, Rattus norvegicus
gagggctacccagattcggctagga

SEQ ID NO: 638614 - DNA, 25 bp, Rattus norvegicus
ttcggctaggaaaagcccagcttgc

SEQ ID NO: 638615 - DNA, 25 bp, Rattus norvegicus
gcccagcttgccagagaatgtttga

SEQ ID NO: 638616 - DNA, 25 bp, Rattus norvegicus
tttgagaaaagtttgcgcggcgctg

SEQ ID NO: 638617 - DNA, 25 bp, Rattus norvegicus
ttctgccaatcagaggcagctttgc

SEQ ID NO: 638618 - DNA, 25 bp, Rattus norvegicus
cggaccggtgtctacctggagccca

SEQ ID NO: 638619 - DNA, 25 bp, Rattus norvegicus
gacccaggcccggagatcccgcctc

SEQ ID NO: 638620 - DNA, 25 bp, Rattus norvegicus
taacggacctgccaagtctgcggcg

SEQ ID NO: 638621 - DNA, 25 bp, Rattus norvegicus
aacggacctgccaagtctgcggcgc

SEQ ID NO: 638622 - DNA, 25 bp, Rattus norvegicus
acctgccaagtctgcggcgccggtg

SEQ ID NO: 638623 - DNA, 25 bp, Rattus norvegicus
cggcgacctagctccggggcgagca

SEQ ID NO: 638624 - DNA, 25 bp, Rattus norvegicus
ctccgcggaccggtgtctacctgga

SEQ ID NO: 638625 - DNA, 25 bp, Rattus norvegicus
gaccggtgtctacctggagcccagc

SEQ ID NO: 638626 - DNA, 25 bp, Rattus norvegicus
ccgcgctcgcccatcctcctgggcc

SEQ ID NO: 638627 - DNA, 25 bp, Rattus norvegicus
gcagcccccgcagtgagcgcccttc

SEQ ID NO: 638628 - DNA, 25 bp, Rattus norvegicus
agctccggggcgagcagcctccacc

SEQ ID NO: 638629 - DNA, 25 bp, Rattus norvegicus
tcctaacggacctgccaagtctgcg

SEQ ID NO: 638630 - DNA, 25 bp, Rattus norvegicus
gagatcccgcctcctaacggacctg

SEQ ID NO: 638631 - DNA, 25 bp, Rattus norvegicus
gtgcagcggtgagccgccctggcct

SEQ ID NO: 638632 - DNA, 25 bp, Rattus norvegicus
ccaacgtccaaactttcggagaatg

SEQ ID NO: 638633 - DNA, 25 bp, Rattus norvegicus
actttcggagaatgtgtgcctgtgc

SEQ ID NO: 638634 - DNA, 25 bp, Rattus norvegicus
tgcctgtgccgaggaagcatcatct

SEQ ID NO: 638635 - DNA, 25 bp, Rattus norvegicus
gtgccgaggaagcatcatctcaatg

SEQ ID NO: 638636 - DNA, 25 bp, Rattus norvegicus
catcatctcaatggggcgcaggctg

SEQ ID NO: 638637 - DNA, 25 bp, Rattus norvegicus
tccgagaacggttgccgagctgaca

SEQ ID NO: 638638 - DNA, 25 bp, Rattus norvegicus
cttcgcccggccaccagagtgtccc

SEQ ID NO: 638639 - DNA, 25 bp, Rattus norvegicus
ttgccgagctgacagcttcgcccgg

SEQ ID NO: 638640 - DNA, 25 bp, Rattus norvegicus
gaaaaagacagaactactcggccga

SEQ ID NO: 638641 - DNA, 25 bp, Rattus norvegicus
ctactcggccgaaagtcacttaatc

SEQ ID NO: 638642 - DNA, 25 bp, Rattus norvegicus
tcggccgaaagtcacttaatccaaa

SEQ ID NO: 638643 - DNA, 25 bp, Rattus norvegicus
caaaagttaaatcccgaaaatcatg

SEQ ID NO: 638644 - DNA, 25 bp, Rattus norvegicus
aacggttgccgagctgacagcttcg

SEQ ID NO: 638645 - DNA, 25 bp, Rattus norvegicus
ccggctcccagtgaaggcagaaccc

SEQ ID NO: 638646 - DNA, 25 bp, Rattus norvegicus
ctgtgagtgctctcggagaggccca

SEQ ID NO: 638647 - DNA, 25 bp, Rattus norvegicus
gcgcatgcgtctaaagtacagcttc

SEQ ID NO: 638648 - DNA, 25 bp, Rattus norvegicus
gtacagcttcgccttctcgtctcta

SEQ ID NO: 638649 - DNA, 25 bp, Rattus norvegicus
ttcagtctctggtgacgtgcaatgc

SEQ ID NO: 638650 - DNA, 25 bp, Rattus norvegicus
cgtcagactggatagcggaaggtca

SEQ ID NO: 638651 - DNA, 25 bp, Rattus norvegicus
ggctctggagcttgtccgccattgt

SEQ ID NO: 638652 - DNA, 25 bp, Rattus norvegicus
tgtccgccattgtgggcccgaggat

SEQ ID NO: 638653 - DNA, 25 bp, Rattus norvegicus
cgacagtcgactgctgtgagtgctc

SEQ ID NO: 638654 - DNA, 25 bp, Rattus norvegicus
tcctctcgggttacggtgaagaatg

SEQ ID NO: 638655 - DNA, 25 bp, Rattus norvegicus
tcagccactagcgtggatcaggtga

SEQ ID NO: 638656 - DNA, 25 bp, Rattus norvegicus
tagcggccgctagctccataacggc

SEQ ID NO: 638657 - DNA, 25 bp, Rattus norvegicus
cccgtgaccactgagggccggatgt

SEQ ID NO: 638658 - DNA, 25 bp, Rattus norvegicus
atctagtggggttcacacctacgcg

SEQ ID NO: 638659 - DNA, 25 bp, Rattus norvegicus
cttcctggagcctacaagagcggca

SEQ ID NO: 638660 - DNA, 25 bp, Rattus norvegicus
ctcccgcgtgatgtcttcggcttct

SEQ ID NO: 638661 - DNA, 25 bp, Rattus norvegicus
tccctgaacattgctaaagccgagg

SEQ ID NO: 638662 - DNA, 25 bp, Rattus norvegicus
tgggcttccacattttccctgaaca

SEQ ID NO: 638663 - DNA, 25 bp, Rattus norvegicus
agaccaggccataactcccaggaga

SEQ ID NO: 638664 - DNA, 25 bp, Rattus norvegicus
cttggacggctaactgtggcccaca

SEQ ID NO: 638665 - DNA, 25 bp, Rattus norvegicus
tgccttcctgcacgtgcaaacgagg

SEQ ID NO: 638666 - DNA, 25 bp, Rattus norvegicus
cttgttgcccaacacgaagtggcgg

SEQ ID NO: 638667 - DNA, 25 bp, Rattus norvegicus
gaaactggaccaggcctgctgcgac

SEQ ID NO: 638668 - DNA, 25 bp, Rattus norvegicus
gctgttgactttctgtcgtgggaca

SEQ ID NO: 638669 - DNA, 25 bp, Rattus norvegicus
gctctttcgcagctggcgcaggcaa

SEQ ID NO: 638670 - DNA, 25 bp, Rattus norvegicus
tgagacttccctctgtcgccgtgct

SEQ ID NO: 638671 - DNA, 25 bp, Rattus norvegicus
gtggtcagtttctccgctctcctag

SEQ ID NO: 638672 - DNA, 25 bp, Rattus norvegicus
gtgcgggcactgatactagagtctg

SEQ ID NO: 638673 - DNA, 25 bp, Rattus norvegicus
ccaggtttccttggtctgcctgtcc

SEQ ID NO: 638674 - DNA, 25 bp, Rattus norvegicus
gagcggcgtggaaaatctactttta

SEQ ID NO: 638675 - DNA, 25 bp, Rattus norvegicus
tgcccgagcacaagaggaagccttc

SEQ ID NO: 638676 - DNA, 25 bp, Rattus norvegicus
agaacccgaccacgagctacgaaga

SEQ ID NO: 638677 - DNA, 25 bp, Rattus norvegicus
tcgcaacgcttgcaggagaaaagca

SEQ ID NO: 638678 - DNA, 25 bp, Rattus norvegicus
ggcctgccagcagttcttagtcgca

SEQ ID NO: 638679 - DNA, 25 bp, Rattus norvegicus
gctctgggtcactgtggttcgaaca

SEQ ID NO: 638680 - DNA, 25 bp, Rattus norvegicus
gccactgcacaagcgggcagacttt

SEQ ID NO: 638681 - DNA, 25 bp, Rattus norvegicus
cgaacccgcattgtgagcgctggga

SEQ ID NO: 638682 - DNA, 25 bp, Rattus norvegicus
agcttttctttgactgcgtcctctg

SEQ ID NO: 638683 - DNA, 25 bp, Rattus norvegicus
ccacgtccggtttttgttcatcttg

SEQ ID NO: 638684 - DNA, 25 bp, Rattus norvegicus
ttttcacgttccacagcagcttttc

SEQ ID NO: 638685 - DNA, 25 bp, Rattus norvegicus
gtcccttctaagtgactcgcgttgg

SEQ ID NO: 638686 - DNA, 25 bp, Rattus norvegicus
ggaagccttcgctctccttcgggtc

SEQ ID NO: 638687 - DNA, 25 bp, Rattus norvegicus
ccatgtgatgtaactttagggtgca

SEQ ID NO: 638688 - DNA, 25 bp, Rattus norvegicus
agagccatggtagaggggcggcagg

SEQ ID NO: 638689 - DNA, 25 bp, Rattus norvegicus
gagccatggtagaggggcggcaggt

SEQ ID NO: 638690 - DNA, 25 bp, Rattus norvegicus
ggagagccatggtagaggggcggca

SEQ ID NO: 638691 - DNA, 25 bp, Rattus norvegicus
agccatggtagaggggcggcaggtg

SEQ ID NO: 638692 - DNA, 25 bp, Rattus norvegicus
gagagccatggtagaggggcggcag

SEQ ID NO: 638693 - DNA, 25 bp, Rattus norvegicus
tctgggcagctctttccgggccact

SEQ ID NO: 638694 - DNA, 25 bp, Rattus norvegicus
tctaacctcccggttctgggcagct

SEQ ID NO: 638695 - DNA, 25 bp, Rattus norvegicus
ccctgctagaagacaggtgacagtg

SEQ ID NO: 638696 - DNA, 25 bp, Rattus norvegicus
tggcgtacataaccgtgtcgccgcg

SEQ ID NO: 638697 - DNA, 25 bp, Rattus norvegicus
gctgtggtggcgtacataaccgtgt

SEQ ID NO: 638698 - DNA, 25 bp, Rattus norvegicus
gaccgggagtcggtcatgaacttcc

SEQ ID NO: 638699 - DNA, 25 bp, Rattus norvegicus
cccagacatccgaggaccgggagtc

SEQ ID NO: 638700 - DNA, 25 bp, Rattus norvegicus
gtggcagaagcggacccagacatcc

SEQ ID NO: 638701 - DNA, 25 bp, Rattus norvegicus
acgcgatgacgcaccgcaggtttgc

SEQ ID NO: 638702 - DNA, 25 bp, Rattus norvegicus
ggttggccgccagattctgggttcc

SEQ ID NO: 638703 - DNA, 25 bp, Rattus norvegicus
cgtcgcatcggtgcgcctgcgtgct

SEQ ID NO: 638704 - DNA, 25 bp, Rattus norvegicus
aggcagggctgactaaaggtcccgc

SEQ ID NO: 638705 - DNA, 25 bp, Rattus norvegicus
gcacaatcagcagcggtccaactcg

SEQ ID NO: 638706 - DNA, 25 bp, Rattus norvegicus
agcagcggtccaactcggctcggct

SEQ ID NO: 638707 - DNA, 25 bp, Rattus norvegicus
ggaaagaccggaccgctacgatcca

SEQ ID NO: 638708 - DNA, 25 bp, Rattus norvegicus
cgatcatttcgattttcaagcgaga

SEQ ID NO: 638709 - DNA, 25 bp, Rattus norvegicus
attctttatttcatcgatcatttcg

SEQ ID NO: 638710 - DNA, 25 bp, Rattus norvegicus
cgctatgcctatatgaaattcttta

SEQ ID NO: 638711 - DNA, 25 bp, Rattus norvegicus
cttcggatttctagcgctatgccta

SEQ ID NO: 638712 - DNA, 25 bp, Rattus norvegicus
cagctctttcgccttcggatttcta

SEQ ID NO: 638713 - DNA, 25 bp, Rattus norvegicus
agctagcagctctttcgccttcgga

SEQ ID NO: 638714 - DNA, 25 bp, Rattus norvegicus
cgggtttgagcagagctagcagctc

SEQ ID NO: 638715 - DNA, 25 bp, Rattus norvegicus
acgctttggtcctctgcgggtttga

SEQ ID NO: 638716 - DNA, 25 bp, Rattus norvegicus
gcagtcactgaaaacgctttggtcc

SEQ ID NO: 638717 - DNA, 25 bp, Rattus norvegicus
tcctccgagaacacacggagcagtc

SEQ ID NO: 638718 - DNA, 25 bp, Rattus norvegicus
gcggaaaccgctcagccttctcttt

SEQ ID NO: 638719 - DNA, 25 bp, Rattus norvegicus
ttagaccgcggaaaccgctcagcct

SEQ ID NO: 638720 - DNA, 25 bp, Rattus norvegicus
ttcgattttcaagcgagaactcttc

SEQ ID NO: 638721 - DNA, 25 bp, Rattus norvegicus
ctccctccgccgatcccagactcga

SEQ ID NO: 638722 - DNA, 25 bp, Rattus norvegicus
cattcttctttccatcttgccctcc

SEQ ID NO: 638723 - DNA, 25 bp, Rattus norvegicus
gatcccagactcgaatcttctcctg

SEQ ID NO: 638724 - DNA, 25 bp, Rattus norvegicus
ccgaactctgctcttcagagccgga

SEQ ID NO: 638725 - DNA, 25 bp, Rattus norvegicus
tgcccttaaatctacgcccggagcg

SEQ ID NO: 638726 - DNA, 25 bp, Rattus norvegicus
ctgctcttcagagccggaggaagcc

SEQ ID NO: 638727 - DNA, 25 bp, Rattus norvegicus
actcgaatcttctcctgactcccgc

SEQ ID NO: 638728 - DNA, 25 bp, Rattus norvegicus
tcagacccgaactctgctcttcaga

SEQ ID NO: 638729 - DNA, 25 bp, Rattus norvegicus
aatctacgcccggagcgggctcaga

SEQ ID NO: 638730 - DNA, 25 bp, Rattus norvegicus
atctgctgcgttgcccttaaatcta

SEQ ID NO: 638731 - DNA, 25 bp, Rattus norvegicus
gagcgcatctgctgcgttgccctta

SEQ ID NO: 638732 - DNA, 25 bp, Rattus norvegicus
tcagagagagcgcatctgctgcgtt

SEQ ID NO: 638733 - DNA, 25 bp, Rattus norvegicus
gccgcagtcagagagagcgcatctg

SEQ ID NO: 638734 - DNA, 25 bp, Rattus norvegicus
tgactcccgccgcagtcagagagag

SEQ ID NO: 638735 - DNA, 25 bp, Rattus norvegicus
ctctagatgagctgcgcgcggtcat

SEQ ID NO: 638736 - DNA, 25 bp, Rattus norvegicus
ctgccctgtgcctcaagtacggcga

SEQ ID NO: 638737 - DNA, 25 bp, Rattus norvegicus
tgtgcctcaagtacggcgagagcgc

SEQ ID NO: 638738 - DNA, 25 bp, Rattus norvegicus
aacgcccacttgcacggtggctcgg

SEQ ID NO: 638739 - DNA, 25 bp, Rattus norvegicus
gcccacaagtggcagcggcggcaac

SEQ ID NO: 638740 - DNA, 25 bp, Rattus norvegicus
gcggcagcagcaagaaatccaaaga

SEQ ID NO: 638741 - DNA, 25 bp, Rattus norvegicus
tccaaagagcagaaggcgctgcgcc

SEQ ID NO: 638742 - DNA, 25 bp, Rattus norvegicus
gagctgcgcgcggtcatcccttacg

SEQ ID NO: 638743 - DNA, 25 bp, Rattus norvegicus
cgacctgaacgacgctctagatgag

SEQ ID NO: 638744 - DNA, 25 bp, Rattus norvegicus
cgccaaacgcctggaggcggctttt

SEQ ID NO: 638745 - DNA, 25 bp, Rattus norvegicus
tcttcctgcacaagagcctgggcgc

SEQ ID NO: 638746 - DNA, 25 bp, Rattus norvegicus
aaggcgctgcgcctcaacatcaacg

SEQ ID NO: 638747 - DNA, 25 bp, Rattus norvegicus
agcgaagacgacctcttcctgcaca

SEQ ID NO: 638748 - DNA, 25 bp, Rattus norvegicus
tggaggcggcttttcgctccacgcc

SEQ ID NO: 638749 - DNA, 25 bp, Rattus norvegicus
catgcgtggccagcctaggcgctta

SEQ ID NO: 638750 - DNA, 25 bp, Rattus norvegicus
cgcggctctgatgcccacaaggtta

SEQ ID NO: 638751 - DNA, 25 bp, Rattus norvegicus
catccggacgctctggcggctctgt

SEQ ID NO: 638752 - DNA, 25 bp, Rattus norvegicus
ccacaaggttacgtggccgcgatcc

SEQ ID NO: 638753 - DNA, 25 bp, Rattus norvegicus
tggccgcgatcccacgcatgcgtgg

SEQ ID NO: 638754 - DNA, 25 bp, Rattus norvegicus
gctctgatgcccacaaggttacgtg

SEQ ID NO: 638755 - DNA, 25 bp, Rattus norvegicus
gtggccagcctaggcgcttaccttg

SEQ ID NO: 638756 - DNA, 25 bp, Rattus norvegicus
actgggagcagcaaggtgaccgcaa

SEQ ID NO: 638757 - DNA, 25 bp, Rattus norvegicus
gcaaggtgaccgcaaagagaaggcc

SEQ ID NO: 638758 - DNA, 25 bp, Rattus norvegicus
gtgaccgcaaagagaaggcctagta

SEQ ID NO: 638759 - DNA, 25 bp, Rattus norvegicus
ccgcaaagagaaggcctagtaggga

SEQ ID NO: 638760 - DNA, 25 bp, Rattus norvegicus
catctggggtcgtggctccctccat

SEQ ID NO: 638761 - DNA, 25 bp, Rattus norvegicus
acgctctggcggctctgtagtgagc

SEQ ID NO: 638762 - DNA, 25 bp, Rattus norvegicus
ttacgtggccgcgatcccacgcatg

SEQ ID NO: 638763 - DNA, 25 bp, Rattus norvegicus
gaagagcaagcgtccggaacctaca

SEQ ID NO: 638764 - DNA, 25 bp, Rattus norvegicus
gcgcagagagtagcagccattccgg

SEQ ID NO: 638765 - DNA, 25 bp, Rattus norvegicus
gagacgtggacagccgctatgatta

SEQ ID NO: 638766 - DNA, 25 bp, Rattus norvegicus
ccgctatgattagggccggctggct

SEQ ID NO: 638767 - DNA, 25 bp, Rattus norvegicus
tacagaaagaataccgagacgtgga

SEQ ID NO: 638768 - DNA, 25 bp, Rattus norvegicus
ttagggccggctggctggtcaaaat

SEQ ID NO: 638769 - DNA, 25 bp, Rattus norvegicus
caagcgtccggaacctacagaggca

SEQ ID NO: 638770 - DNA, 25 bp, Rattus norvegicus
acctacagaggcagcccgcgggatg

SEQ ID NO: 638771 - DNA, 25 bp, Rattus norvegicus
ggctacgtaccctccagagctccgg

SEQ ID NO: 638772 - DNA, 25 bp, Rattus norvegicus
ggagcctgccgcagcatcagagccg

SEQ ID NO: 638773 - DNA, 25 bp, Rattus norvegicus
ctgacccgcggcctgactcaaagaa

SEQ ID NO: 638774 - DNA, 25 bp, Rattus norvegicus
caaagaaccacagggctgagtcgct

SEQ ID NO: 638775 - DNA, 25 bp, Rattus norvegicus
cagccattccgggtatacagaaaga

SEQ ID NO: 638776 - DNA, 25 bp, Rattus norvegicus
ctgactcaaagaaccacagggctga

SEQ ID NO: 638777 - DNA, 25 bp, Rattus norvegicus
gggcgttcaacctgttccacctggc

SEQ ID NO: 638778 - DNA, 25 bp, Rattus norvegicus
gttcctgtcattttcggctcgcagc

SEQ ID NO: 638779 - DNA, 25 bp, Rattus norvegicus
tcggctcgcagctctgaacttttta

SEQ ID NO: 638780 - DNA, 25 bp, Rattus norvegicus
agcaagccgctcactggtcagtttg

SEQ ID NO: 638781 - DNA, 25 bp, Rattus norvegicus
ctttttagccgtgcgcagtttgcgt

SEQ ID NO: 638782 - DNA, 25 bp, Rattus norvegicus
cgcagtttgcgtgtagccagactac

SEQ ID NO: 638783 - DNA, 25 bp, Rattus norvegicus
gccgaagacaaagcgcagcacacga

SEQ ID NO: 638784 - DNA, 25 bp, Rattus norvegicus
tcccgggacagccaatctggaaggc

SEQ ID NO: 638785 - DNA, 25 bp, Rattus norvegicus
ttgcgccttcgctgggtcccagctg

SEQ ID NO: 638786 - DNA, 25 bp, Rattus norvegicus
agcgcagcacacgataaagcacatg

SEQ ID NO: 638787 - DNA, 25 bp, Rattus norvegicus
aaagcacatgcctccgactgggctc

SEQ ID NO: 638788 - DNA, 25 bp, Rattus norvegicus
ctgattggcataaggtcccgggaca

SEQ ID NO: 638789 - DNA, 25 bp, Rattus norvegicus
gaatggctaccacccggagctggac

SEQ ID NO: 638790 - DNA, 25 bp, Rattus norvegicus
cgagcggagaacagccctctggctc

SEQ ID NO: 638791 - DNA, 25 bp, Rattus norvegicus
gcaccgggcgcgtccactctgaatt

SEQ ID NO: 638792 - DNA, 25 bp, Rattus norvegicus
acagacccagaataccgggagcaca

SEQ ID NO: 638793 - DNA, 25 bp, Rattus norvegicus
cgcacgagagttacgcggggcatcc

SEQ ID NO: 638794 - DNA, 25 bp, Rattus norvegicus
gcctacagaggcaggaacaatggcc

SEQ ID NO: 638795 - DNA, 25 bp, Rattus norvegicus
gcgagcccggcgtaattcacacttt

SEQ ID NO: 638796 - DNA, 25 bp, Rattus norvegicus
tcttgcgtccgacagacccagaata

SEQ ID NO: 638797 - DNA, 25 bp, Rattus norvegicus
aggcaggaacaatggcccgagtccc

SEQ ID NO: 638798 - DNA, 25 bp, Rattus norvegicus
gtaattcacactttgcagccctaga

SEQ ID NO: 638799 - DNA, 25 bp, Rattus norvegicus
caggcagcgttaaaggggatcccgc

SEQ ID NO: 638800 - DNA, 25 bp, Rattus norvegicus
cattgaacacgtccgccttggaacc

SEQ ID NO: 638801 - DNA, 25 bp, Rattus norvegicus
gctggtagcatacttccattgaaca

SEQ ID NO: 638802 - DNA, 25 bp, Rattus norvegicus
gcaccggcagctggtagcatacttc

SEQ ID NO: 638803 - DNA, 25 bp, Rattus norvegicus
agctggagctgaagctgatggctcc

SEQ ID NO: 638804 - DNA, 25 bp, Rattus norvegicus
cccaaaagacaaaagcactgagctg

SEQ ID NO: 638805 - DNA, 25 bp, Rattus norvegicus
tcagcagggccctgcaaggcagaca

SEQ ID NO: 638806 - DNA, 25 bp, Rattus norvegicus
cccaggcggaggaagtattcttcac

SEQ ID NO: 638807 - DNA, 25 bp, Rattus norvegicus
tgctgcagcaacacgcggaaaaagt

SEQ ID NO: 638808 - DNA, 25 bp, Rattus norvegicus
cggaaaaagttagccgcagcctggt

SEQ ID NO: 638809 - DNA, 25 bp, Rattus norvegicus
gacagccgagcagcgggacttctgt

SEQ ID NO: 638810 - DNA, 25 bp, Rattus norvegicus
cagcgggacttctgttgaggttccc

SEQ ID NO: 638811 - DNA, 25 bp, Rattus norvegicus
ctggtggccaccgagggcatcctcg

SEQ ID NO: 638812 - DNA, 25 bp, Rattus norvegicus
gaagtattcttcacccatgcggatc

SEQ ID NO: 638813 - DNA, 25 bp, Rattus norvegicus
cacccatgcggatcagaatcggctg

SEQ ID NO: 638814 - DNA, 25 bp, Rattus norvegicus
caagaaattcaacggctgcggggcc

SEQ ID NO: 638815 - DNA, 25 bp, Rattus norvegicus
cctgcaaggcagacagggcgacaga

SEQ ID NO: 638816 - DNA, 25 bp, Rattus norvegicus
agacagggcgacagagccaccagca

SEQ ID NO: 638817 - DNA, 25 bp, Rattus norvegicus
cagccgcatgttaggggcgctctct

SEQ ID NO: 638818 - DNA, 25 bp, Rattus norvegicus
gggctgctccggttgcaagaaattc

SEQ ID NO: 638819 - DNA, 25 bp, Rattus norvegicus
tcccagcgttacacctctgcgcacg

SEQ ID NO: 638820 - DNA, 25 bp, Rattus norvegicus
agactagtcctcttgggcctttggg

SEQ ID NO: 638821 - DNA, 25 bp, Rattus norvegicus
ccggaggctgcgagactagtcctct

SEQ ID NO: 638822 - DNA, 25 bp, Rattus norvegicus
agttgcgccgcccagctgctgggct

SEQ ID NO: 638823 - DNA, 25 bp, Rattus norvegicus
agggatcctggccactctggctccg

SEQ ID NO: 638824 - DNA, 25 bp, Rattus norvegicus
aactgcgagggatcctggccactct

SEQ ID NO: 638825 - DNA, 25 bp, Rattus norvegicus
atctccgcgtcggaactgcgaggga

SEQ ID NO: 638826 - DNA, 25 bp, Rattus norvegicus
cgtgtgcggatctccgcgtcggaac

SEQ ID NO: 638827 - DNA, 25 bp, Rattus norvegicus
cccgtccgtcgtggtttcctggctg

SEQ ID NO: 638828 - DNA, 25 bp, Rattus norvegicus
tcccagtgcggccaccgtcgtttgg

SEQ ID NO: 638829 - DNA, 25 bp, Rattus norvegicus
tgaatgcttttgctcccagtgcggc

SEQ ID NO: 638830 - DNA, 25 bp, Rattus norvegicus
gcctagttgaacgtgctgaatgctt

SEQ ID NO: 638831 - DNA, 25 bp, Rattus norvegicus
caccagctcgcttgctctggcaagg

SEQ ID NO: 638832 - DNA, 25 bp, Rattus norvegicus
cttgctctggcaagggcctagttga

SEQ ID NO: 638833 - DNA, 25 bp, Rattus norvegicus
accgctgagcggcttccgcaagctt

SEQ ID NO: 638834 - DNA, 25 bp, Rattus norvegicus
ttcgctgtaggccatgcgcagaacc

SEQ ID NO: 638835 - DNA, 25 bp, Rattus norvegicus
ttccgcaagcttagagagttgctcc

SEQ ID NO: 638836 - DNA, 25 bp, Rattus norvegicus
gcagaaccctgcctagcgtggagaa

SEQ ID NO: 638837 - DNA, 25 bp, Rattus norvegicus
caaacgggtgcaggttgtacaaacg

SEQ ID NO: 638838 - DNA, 25 bp, Rattus norvegicus
ttgctccggatcacgtgagcgctgc

SEQ ID NO: 638839 - DNA, 25 bp, Rattus norvegicus
gttgtacaaacgcaccatcccggtg

SEQ ID NO: 638840 - DNA, 25 bp, Rattus norvegicus
caacctgctgcgacccaaacgggtg

SEQ ID NO: 638841 - DNA, 25 bp, Rattus norvegicus
ccgctggcaggggacaacctgctgc

SEQ ID NO: 638842 - DNA, 25 bp, Rattus norvegicus
ggaagccacgaacagcgcgtcgctc

SEQ ID NO: 638843 - DNA, 25 bp, Rattus norvegicus
agctctgcgccctgaacagcaaacg

SEQ ID NO: 638844 - DNA, 25 bp, Rattus norvegicus
aaggtgcatcgctgccggcttagct

SEQ ID NO: 638845 - DNA, 25 bp, Rattus norvegicus
cctagcgtggagaaggtgcatcgct

SEQ ID NO: 638846 - DNA, 25 bp, Rattus norvegicus
gtgagcgctgcgaccacgccctgag

SEQ ID NO: 638847 - DNA, 25 bp, Rattus norvegicus
cgcctgtaggtgaccgcggccagca

SEQ ID NO: 638848 - DNA, 25 bp, Rattus norvegicus
agaatacggcagttcgcgagctgcc

SEQ ID NO: 638849 - DNA, 25 bp, Rattus norvegicus
acacctgttggggactgctccgcgg

SEQ ID NO: 638850 - DNA, 25 bp, Rattus norvegicus
gcagctcttatagcggccgtcacgt

SEQ ID NO: 638851 - DNA, 25 bp, Rattus norvegicus
gcggacgtacctgtcatagtgtggc

SEQ ID NO: 638852 - DNA, 25 bp, Rattus norvegicus
cggttacgcggacgtacctgtcata

SEQ ID NO: 638853 - DNA, 25 bp, Rattus norvegicus
tctctgcagcgcgactcggtcagca

SEQ ID NO: 638854 - DNA, 25 bp, Rattus norvegicus
ccgcgcaagccggtgtttccgcagg

SEQ ID NO: 638855 - DNA, 25 bp, Rattus norvegicus
taggctcagtgtagaggctagtgta

SEQ ID NO: 638856 - DNA, 25 bp, Rattus norvegicus
ggcgctagccggttcccgactagca

SEQ ID NO: 638857 - DNA, 25 bp, Rattus norvegicus
cgccgctgaggcctaaaaataggct

SEQ ID NO: 638858 - DNA, 25 bp, Rattus norvegicus
cccgactagcagcacccgccgctga

SEQ ID NO: 638859 - DNA, 25 bp, Rattus norvegicus
cggtcagcagccagagaatacggca

SEQ ID NO: 638860 - DNA, 25 bp, Rattus norvegicus
ctgttgtgcccaggggacacctgtt

SEQ ID NO: 638861 - DNA, 25 bp, Rattus norvegicus
ccaggcaattccgagtgcaggcagt

SEQ ID NO: 638862 - DNA, 25 bp, Rattus norvegicus
cgggctctatcagttcgaccaggtg

SEQ ID NO: 638863 - DNA, 25 bp, Rattus norvegicus
gggacaactttgagaccgtgacctg

SEQ ID NO: 638864 - DNA, 25 bp, Rattus norvegicus
agtctttgcgctctgcggcttggac

SEQ ID NO: 638865 - DNA, 25 bp, Rattus norvegicus
cgtgacctggctctctgacagcgag

SEQ ID NO: 638866 - DNA, 25 bp, Rattus norvegicus
tgcactttgatcactccggcgggct

SEQ ID NO: 638867 - DNA, 25 bp, Rattus norvegicus
gtggccacccacgtgcactttgatc

SEQ ID NO: 638868 - DNA, 25 bp, Rattus norvegicus
gcctcttgcaggattgtggtgccaa

SEQ ID NO: 638869 - DNA, 25 bp, Rattus norvegicus
gttctacgagtcaggcaaccgggcc

SEQ ID NO: 638870 - DNA, 25 bp, Rattus norvegicus
cttctggattcaagaacggttctac

SEQ ID NO: 638871 - DNA, 25 bp, Rattus norvegicus
ccacaagtctctgggcgatggcatc

SEQ ID NO: 638872 - DNA, 25 bp, Rattus norvegicus
cactcgagtggtatgcccacaagtc

SEQ ID NO: 638873 - DNA, 25 bp, Rattus norvegicus
agagtagctcttcgctcactgcagc

SEQ ID NO: 638874 - DNA, 25 bp, Rattus norvegicus
accctcattctgcaggatggtaata

SEQ ID NO: 638875 - DNA, 25 bp, Rattus norvegicus
cgacctcgatcctccgtgaggctag

SEQ ID NO: 638876 - DNA, 25 bp, Rattus norvegicus
ccgctcactgcgctctagccggtct

SEQ ID NO: 638877 - DNA, 25 bp, Rattus norvegicus
acgatcaagtcggtccccacggtca

SEQ ID NO: 638878 - DNA, 25 bp, Rattus norvegicus
gttctggcacgatcaagtcggtccc

SEQ ID NO: 638879 - DNA, 25 bp, Rattus norvegicus
gtgttctggcacgatcaagtcggtc

SEQ ID NO: 638880 - DNA, 25 bp, Rattus norvegicus
caggtgttctggcacgatcaagtcg

SEQ ID NO: 638881 - DNA, 25 bp, Rattus norvegicus
cttctttgctaaaacttcgcttggt

SEQ ID NO: 638882 - DNA, 25 bp, Rattus norvegicus
ctccacttctttgctaaaacttcgc

SEQ ID NO: 638883 - DNA, 25 bp, Rattus norvegicus
gctcctccacttctttgctaaaact

SEQ ID NO: 638884 - DNA, 25 bp, Rattus norvegicus
tgggatggccgctctctactccgct

SEQ ID NO: 638885 - DNA, 25 bp, Rattus norvegicus
aggctagctgccttgcggagtccct

SEQ ID NO: 638886 - DNA, 25 bp, Rattus norvegicus
cctccgtgaggctagctgccttgcg

SEQ ID NO: 638887 - DNA, 25 bp, Rattus norvegicus
gatcctccgtgaggctagctgcctt

SEQ ID NO: 638888 - DNA, 25 bp, Rattus norvegicus
ctcgatcctccgtgaggctagctgc

SEQ ID NO: 638889 - DNA, 25 bp, Rattus norvegicus
gcttgcgctgccctcttagggtcac

SEQ ID NO: 638890 - DNA, 25 bp, Rattus norvegicus
tgccctcttagggtcacttgggccg

SEQ ID NO: 638891 - DNA, 25 bp, Rattus norvegicus
ccgggcttcggtcaagtcagactca

SEQ ID NO: 638892 - DNA, 25 bp, Rattus norvegicus
tcaagtcagactcaggctcaggtaa

SEQ ID NO: 638893 - DNA, 25 bp, Rattus norvegicus
cagactcaggctcaggtaatgcatc

SEQ ID NO: 638894 - DNA, 25 bp, Rattus norvegicus
ctcaggtaatgcatctggacggctg

SEQ ID NO: 638895 - DNA, 25 bp, Rattus norvegicus
agcctgcggccaccatggactgatt

SEQ ID NO: 638896 - DNA, 25 bp, Rattus norvegicus
gcggccaccatggactgattccgga

SEQ ID NO: 638897 - DNA, 25 bp, Rattus norvegicus
ggactgattccggagtctggcttca

SEQ ID NO: 638898 - DNA, 25 bp, Rattus norvegicus
tctggcttcagactaggtcagcgct

SEQ ID NO: 638899 - DNA, 25 bp, Rattus norvegicus
aggtcagcgcttttcacccaggaga

SEQ ID NO: 638900 - DNA, 25 bp, Rattus norvegicus
gcgcttttcacccaggagagccgca

SEQ ID NO: 638901 - DNA, 25 bp, Rattus norvegicus
tgtactgtccctcccacaccgctcg

SEQ ID NO: 638902 - DNA, 25 bp, Rattus norvegicus
gagccgcacccactgtactgtccct

SEQ ID NO: 638903 - DNA, 25 bp, Rattus norvegicus
tacaatccttggttcgacctgaata

SEQ ID NO: 638904 - DNA, 25 bp, Rattus norvegicus
taaagtgtgtgcatataaacccacc

SEQ ID NO: 638905 - DNA, 25 bp, Rattus norvegicus
tcgacctgaataaagtgtgtgcata

SEQ ID NO: 638906 - DNA, 25 bp, Rattus norvegicus
cttggttcgacctgaataaagtgtg

SEQ ID NO: 638907 - DNA, 25 bp, Rattus norvegicus
gaaatatacagaacctaagatcgtc

SEQ ID NO: 638908 - DNA, 25 bp, Rattus norvegicus
gaacctaagatcgtctcagagagtt

SEQ ID NO: 638909 - DNA, 25 bp, Rattus norvegicus
tcgtctcagagagttatttcgttga

SEQ ID NO: 638910 - DNA, 25 bp, Rattus norvegicus
cagagagttatttcgttgaagatca

SEQ ID NO: 638911 - DNA, 25 bp, Rattus norvegicus
gagttatttcgttgaagatcattga

SEQ ID NO: 638912 - DNA, 25 bp, Rattus norvegicus
agcttcgcgccctatgagcagcacg

SEQ ID NO: 638913 - DNA, 25 bp, Rattus norvegicus
tgctcaaagtgtccaagaacaagtg

SEQ ID NO: 638914 - DNA, 25 bp, Rattus norvegicus
agtgtccaagaacaagtgagcactc

SEQ ID NO: 638915 - DNA, 25 bp, Rattus norvegicus
gaggcagcggccaagaagcattgat

SEQ ID NO: 638916 - DNA, 25 bp, Rattus norvegicus
caaaactatacaatccttggttcga

SEQ ID NO: 638917 - DNA, 25 bp, Rattus norvegicus
agcacctttccaggtacgcttcgga

SEQ ID NO: 638918 - DNA, 25 bp, Rattus norvegicus
gctgccgccctatgcttgcatagcg

SEQ ID NO: 638919 - DNA, 25 bp, Rattus norvegicus
tgtggaacgactagccggccgccac

SEQ ID NO: 638920 - DNA, 25 bp, Rattus norvegicus
gaagccgagtgtggaacgactagcc

SEQ ID NO: 638921 - DNA, 25 bp, Rattus norvegicus
ctctggaacgaatgcgcggcgagcc

SEQ ID NO: 638922 - DNA, 25 bp, Rattus norvegicus
cttgcagaattgctccgggcgaagg

SEQ ID NO: 638923 - DNA, 25 bp, Rattus norvegicus
agcggcccgggcttgcagaattgct

SEQ ID NO: 638924 - DNA, 25 bp, Rattus norvegicus
cgtgtttacgcgcaccggagtgtgc

SEQ ID NO: 638925 - DNA, 25 bp, Rattus norvegicus
tgtgcgcgcttctccagcgcggtgc

SEQ ID NO: 638926 - DNA, 25 bp, Rattus norvegicus
gtacgcttcggaacaggcgtgttta

SEQ ID NO: 638927 - DNA, 25 bp, Rattus norvegicus
gctcacagtagacgaagcacctttc

SEQ ID NO: 638928 - DNA, 25 bp, Rattus norvegicus
tcctagaacttgctcacagtagacg

SEQ ID NO: 638929 - DNA, 25 bp, Rattus norvegicus
tccgggtcccatcctagaacttgct

SEQ ID NO: 638930 - DNA, 25 bp, Rattus norvegicus
aacaggcgtgtttacgcgcaccgga

SEQ ID NO: 638931 - DNA, 25 bp, Rattus norvegicus
tgacgcttggctcgaggtgctcgcc

SEQ ID NO: 638932 - DNA, 25 bp, Rattus norvegicus
cggcgccgctcaggtaacgcgagtc

SEQ ID NO: 638933 - DNA, 25 bp, Rattus norvegicus
ctctgcgcttgcgagtcccgggcga

SEQ ID NO: 638934 - DNA, 25 bp, Rattus norvegicus
gcccgcgctttacggctgccgaaaa

SEQ ID NO: 638935 - DNA, 25 bp, Rattus norvegicus
tgatctgcggcctctgcgcttgcga

SEQ ID NO: 638936 - DNA, 25 bp, Rattus norvegicus
tggccctggctgacacccgcgagga

SEQ ID NO: 638937 - DNA, 25 bp, Rattus norvegicus
agcggggctcctgtgactcagccgc

SEQ ID NO: 638938 - DNA, 25 bp, Rattus norvegicus
ccgctcaggtaacgcgagtcccggt

SEQ ID NO: 638939 - DNA, 25 bp, Rattus norvegicus
tgacacccgcgaggaggtgacgctt

SEQ ID NO: 638940 - DNA, 25 bp, Rattus norvegicus
cggccgtctcgcactagttagggcc

SEQ ID NO: 638941 - DNA, 25 bp, Rattus norvegicus
gtggccgtcgggtctgaagcatccc

SEQ ID NO: 638942 - DNA, 25 bp, Rattus norvegicus
tatgtcgctgtgctttccccgagtg

SEQ ID NO: 638943 - DNA, 25 bp, Rattus norvegicus
acctggtgtggggacaccagcagca

SEQ ID NO: 638944 - DNA, 25 bp, Rattus norvegicus
agcagaagcccgacggaccgggctt

SEQ ID NO: 638945 - DNA, 25 bp, Rattus norvegicus
cacagccgcgtcctgacactccgaa

SEQ ID NO: 638946 - DNA, 25 bp, Rattus norvegicus
cgcaggccgggatgaagggatgcca

SEQ ID NO: 638947 - DNA, 25 bp, Rattus norvegicus
gggatgcaccgggaagagcagaaga

SEQ ID NO: 638948 - DNA, 25 bp, Rattus norvegicus
aagagcagaagagcggccaaggcga

SEQ ID NO: 638949 - DNA, 25 bp, Rattus norvegicus
gtgcgcaagcgagcccccgagaaag

SEQ ID NO: 638950 - DNA, 25 bp, Rattus norvegicus
cgagaaagatgcgtgtgctcggcca

SEQ ID NO: 638951 - DNA, 25 bp, Rattus norvegicus
aaagatgcgtgtgctcggccaccgc

SEQ ID NO: 638952 - DNA, 25 bp, Rattus norvegicus
tcggccaccgcgctggaagaaggac

SEQ ID NO: 638953 - DNA, 25 bp, Rattus norvegicus
ccaccgcgctggaagaaggaccgag

SEQ ID NO: 638954 - DNA, 25 bp, Rattus norvegicus
tgcaacgtggagaacgcccaccgcg

SEQ ID NO: 638955 - DNA, 25 bp, Rattus norvegicus
caccgcgagggtgcgcaaaaccggc

SEQ ID NO: 638956 - DNA, 25 bp, Rattus norvegicus
tgacactccgaacccgcgcaggccg

SEQ ID NO: 638957 - DNA, 25 bp, Rattus norvegicus
aacgcccaccgcgagggtgcgcaaa

SEQ ID NO: 638958 - DNA, 25 bp, Rattus norvegicus
agggatgccagggtcagggatgcac

SEQ ID NO: 638959 - DNA, 25 bp, Rattus norvegicus
tgccgctgctacctgtagacacgca

SEQ ID NO: 638960 - DNA, 25 bp, Rattus norvegicus
agcgcctgcaaacgccaggggtttc

SEQ ID NO: 638961 - DNA, 25 bp, Rattus norvegicus
ttctaagccacttggagcggcgact

SEQ ID NO: 638962 - DNA, 25 bp, Rattus norvegicus
ggatccgtcagccaaatgagcaatc

SEQ ID NO: 638963 - DNA, 25 bp, Rattus norvegicus
aaaccctaggcggagaggtagctgc

SEQ ID NO: 638964 - DNA, 25 bp, Rattus norvegicus
ggtagccgaacctcctaggtccgca

SEQ ID NO: 638965 - DNA, 25 bp, Rattus norvegicus
cgcgcacacacattggcttcttctg

SEQ ID NO: 638966 - DNA, 25 bp, Rattus norvegicus
cgctgggagcaggagtctcaataca

SEQ ID NO: 638967 - DNA, 25 bp, Rattus norvegicus
cctcacgctggctttagagcacatc

SEQ ID NO: 638968 - DNA, 25 bp, Rattus norvegicus
cgtcacgtgtgatgtcttctaagcc

SEQ ID NO: 638969 - DNA, 25 bp, Rattus norvegicus
agcacatcgtcgctttccctggatc

SEQ ID NO: 638970 - DNA, 25 bp, Rattus norvegicus
ccctggatctcgtggaagccgtcac

SEQ ID NO: 638971 - DNA, 25 bp, Rattus norvegicus
ccgtcacagtggctgtctaggtgtt

SEQ ID NO: 638972 - DNA, 25 bp, Rattus norvegicus
tgagcaatcgcctcggaaaacccta

SEQ ID NO: 638973 - DNA, 25 bp, Rattus norvegicus
gcagcggcaccaacggctacgttca

SEQ ID NO: 638974 - DNA, 25 bp, Rattus norvegicus
agcgacctaatcctgacatcctgga

SEQ ID NO: 638975 - DNA, 25 bp, Rattus norvegicus
ggtgaagcgacctaatcctgacatc

SEQ ID NO: 638976 - DNA, 25 bp, Rattus norvegicus
ccctggtgaagcgacctaatcctga

SEQ ID NO: 638977 - DNA, 25 bp, Rattus norvegicus
ctgccctggtgaagcgacctaatcc

SEQ ID NO: 638978 - DNA, 25 bp, Rattus norvegicus
ggctgccctggtgaagcgacctaat

SEQ ID NO: 638979 - DNA, 25 bp, Rattus norvegicus
actacaagggagaggaggaactgcg

SEQ ID NO: 638980 - DNA, 25 bp, Rattus norvegicus
tggtgagcggcctgactacaaggga

SEQ ID NO: 638981 - DNA, 25 bp, Rattus norvegicus
agcgcaacctgtccctggttcgggg

SEQ ID NO: 638982 - DNA, 25 bp, Rattus norvegicus
ttcagcgcaacctgtccctggttcg

SEQ ID NO: 638983 - DNA, 25 bp, Rattus norvegicus
tacgttcagcgcaacctgtccctgg

SEQ ID NO: 638984 - DNA, 25 bp, Rattus norvegicus
acggctacgttcagcgcaacctgtc

SEQ ID NO: 638985 - DNA, 25 bp, Rattus norvegicus
taatcctgacatcctggaccacgag

SEQ ID NO: 638986 - DNA, 25 bp, Rattus norvegicus
ggcaccaacggctacgttcagcgca

SEQ ID NO: 638987 - DNA, 25 bp, Rattus norvegicus
cagtgtgtcttctcgtgctgcctca

SEQ ID NO: 638988 - DNA, 25 bp, Rattus norvegicus
ctttaggcccaagtggctgcgcata

SEQ ID NO: 638989 - DNA, 25 bp, Rattus norvegicus
cttctctcccgagtggatgcgcatg

SEQ ID NO: 638990 - DNA, 25 bp, Rattus norvegicus
ttccgcgttgcgtgaacttcttccc

SEQ ID NO: 638991 - DNA, 25 bp, Rattus norvegicus
agggcctcgtcagccagtgtgtctt

SEQ ID NO: 638992 - DNA, 25 bp, Rattus norvegicus
tgcgcatatggcgtgtcatggttcc

SEQ ID NO: 638993 - DNA, 25 bp, Rattus norvegicus
ccgggtccttgtagctcttgtcaca

SEQ ID NO: 638994 - DNA, 25 bp, Rattus norvegicus
cctccacgtgtgcattcagctgttc

SEQ ID NO: 638995 - DNA, 25 bp, Rattus norvegicus
ctttgccacatggaatgcacacgta

SEQ ID NO: 638996 - DNA, 25 bp, Rattus norvegicus
ggttgtcaccaaagctctcaggctc

SEQ ID NO: 638997 - DNA, 25 bp, Rattus norvegicus
ccggaccagttcgtcgccataacta

SEQ ID NO: 638998 - DNA, 25 bp, Rattus norvegicus
ggctcgtgcttcatccagcggtaga

SEQ ID NO: 638999 - DNA, 25 bp, Rattus norvegicus
gccacctacagcgtgcatcttcata

SEQ ID NO: 639000 - DNA, 25 bp, Rattus norvegicus
tcttcccgcagatggtacacggata

SEQ ID NO: 639001 - DNA, 25 bp, Rattus norvegicus
caagcaggaagccaaaatcgctgtc

SEQ ID NO: 639002 - DNA, 25 bp, Rattus norvegicus
gcagtcctcaccacgttcagatatt

SEQ ID NO: 639003 - DNA, 25 bp, Rattus norvegicus
tgcggcgcagtcctcgcttaacctt

SEQ ID NO: 639004 - DNA, 25 bp, Rattus norvegicus
aaacactgagtctcctcactggggc

SEQ ID NO: 639005 - DNA, 25 bp, Rattus norvegicus
ccgccatggctcgaaggaggctacc

SEQ ID NO: 639006 - DNA, 25 bp, Rattus norvegicus
gaggctaccgcctccgattcaaaaa

SEQ ID NO: 639007 - DNA, 25 bp, Rattus norvegicus
ctctctctcagagccatgctgattg

SEQ ID NO: 639008 - DNA, 25 bp, Rattus norvegicus
ggcgcgctttgtcaacctccttttg

SEQ ID NO: 639009 - DNA, 25 bp, Rattus norvegicus
cctccttttgataggctggagtctc

SEQ ID NO: 639010 - DNA, 25 bp, Rattus norvegicus
ctggcggactgcttattggtcaatc

SEQ ID NO: 639011 - DNA, 25 bp, Rattus norvegicus
gctgattggctatgcgtgtgtttca

SEQ ID NO: 639012 - DNA, 25 bp, Rattus norvegicus
gacgtcagcgaaatgcccggatgtg

SEQ ID NO: 639013 - DNA, 25 bp, Rattus norvegicus
gggcgcctgacagaagcagaataga

SEQ ID NO: 639014 - DNA, 25 bp, Rattus norvegicus
cggggccagaacagacgacaggaaa

SEQ ID NO: 639015 - DNA, 25 bp, Rattus norvegicus
ttcctcccgacgcagcttgtgattg

SEQ ID NO: 639016 - DNA, 25 bp, Rattus norvegicus
gaccaccggtgttcgcatccttgaa

SEQ ID NO: 639017 - DNA, 25 bp, Rattus norvegicus
acccatgttttttccgagtgcacgc

SEQ ID NO: 639018 - DNA, 25 bp, Rattus norvegicus
gggtgtcctgtttgcatccttgtaa

SEQ ID NO: 639019 - DNA, 25 bp, Rattus norvegicus
tcccgtgtttccgtgaatgcgcatc

SEQ ID NO: 639020 - DNA, 25 bp, Rattus norvegicus
tgtcctgcaatagggatatcccgtg

SEQ ID NO: 639021 - DNA, 25 bp, Rattus norvegicus
ggccctttgaggatgtcacatttgc

SEQ ID NO: 639022 - DNA, 25 bp, Rattus norvegicus
cctggaaactgatgctgctggatgc

SEQ ID NO: 639023 - DNA, 25 bp, Rattus norvegicus
gcgctagtcgcctactacgtgtaca

SEQ ID NO: 639024 - DNA, 25 bp, Rattus norvegicus
cctggggacaatgaggtcgtcatgc

SEQ ID NO: 639025 - DNA, 25 bp, Rattus norvegicus
gggtaccatcgcaccatactgcggt

SEQ ID NO: 639026 - DNA, 25 bp, Rattus norvegicus
ctggcagaaacttgctggtcgtctc

SEQ ID NO: 639027 - DNA, 25 bp, Rattus norvegicus
gagtctggaaacaggcgaagttctc

SEQ ID NO: 639028 - DNA, 25 bp, Rattus norvegicus
cgcagcctgaggaggaacacgtgaa

SEQ ID NO: 639029 - DNA, 25 bp, Rattus norvegicus
ggccttctcggatctgctcatcttc

SEQ ID NO: 639030 - DNA, 25 bp, Rattus norvegicus
cgcgtgaagctggtcatccttgtca

SEQ ID NO: 639031 - DNA, 25 bp, Rattus norvegicus
cttccagtttgtcagcgagagctgc

SEQ ID NO: 639032 - DNA, 25 bp, Rattus norvegicus
tcatcttcctgtgcatgccgctgga

SEQ ID NO: 639033 - DNA, 25 bp, Rattus norvegicus
acctgtccagcatggccttctcgga

SEQ ID NO: 639034 - DNA, 25 bp, Rattus norvegicus
aggcaacctgctcaccatgctggtg

SEQ ID NO: 639035 - DNA, 25 bp, Rattus norvegicus
gactcactgcctgacgaactgctgc

SEQ ID NO: 639036 - DNA, 25 bp, Rattus norvegicus
tcatccttgtcatctgggccgtggc

SEQ ID NO: 639037 - DNA, 25 bp, Rattus norvegicus
ctcaccgtcatggtgtgggtgtcca

SEQ ID NO: 639038 - DNA, 25 bp, Rattus norvegicus
tcacgttggacctggattgggacgc

SEQ ID NO: 639039 - DNA, 25 bp, Rattus norvegicus
agccggagcctaacgtcacgttgga

SEQ ID NO: 639040 - DNA, 25 bp, Rattus norvegicus
tgtgctctacagtctcatcgggagg

SEQ ID NO: 639041 - DNA, 25 bp, Rattus norvegicus
cctggcaacatgtggaacgcgaccc

SEQ ID NO: 639042 - DNA, 25 bp, Rattus norvegicus
cagcgtcttcttctttctaccggtc

SEQ ID NO: 639043 - DNA, 25 bp, Rattus norvegicus
tggccaatccaaggggtcagacaga

SEQ ID NO: 639044 - DNA, 25 bp, Rattus norvegicus
tgcacgcgtgctcggaactccagca

SEQ ID NO: 639045 - DNA, 25 bp, Rattus norvegicus
agcaccatgtcacccgtagagccta

SEQ ID NO: 639046 - DNA, 25 bp, Rattus norvegicus
cgcgcaaaggattcaggaaagcatc

SEQ ID NO: 639047 - DNA, 25 bp, Rattus norvegicus
gtagagcctagccttgcctgcctga

SEQ ID NO: 639048 - DNA, 25 bp, Rattus norvegicus
cagcagggcgaaatgtgtacttgac

SEQ ID NO: 639049 - DNA, 25 bp, Rattus norvegicus
tggaaacagaagacaatcgacgctt

SEQ ID NO: 639050 - DNA, 25 bp, Rattus norvegicus
gccggctgttggcaatttcggccaa

SEQ ID NO: 639051 - DNA, 25 bp, Rattus norvegicus
ttcggccaatcgcacccagaaactt

SEQ ID NO: 639052 - DNA, 25 bp, Rattus norvegicus
cccagaaacttctgtcaggtgggtg

SEQ ID NO: 639053 - DNA, 25 bp, Rattus norvegicus
tgagcggttctcgtggtaaagtcct

SEQ ID NO: 639054 - DNA, 25 bp, Rattus norvegicus
gtaaagtccttgagcggaacacctc

SEQ ID NO: 639055 - DNA, 25 bp, Rattus norvegicus
agcggaacacctctgtcggaagaga

SEQ ID NO: 639056 - DNA, 25 bp, Rattus norvegicus
cgtggtgacttaacaggcgcgcaaa

SEQ ID NO: 639057 - DNA, 25 bp, Rattus norvegicus
gggctgtctctttaagcgctccgga

SEQ ID NO: 639058 - DNA, 25 bp, Rattus norvegicus
ctgcaggaccgctggtctcactggt

SEQ ID NO: 639059 - DNA, 25 bp, Rattus norvegicus
gcagtgcaaggctgtgcagctcttg

SEQ ID NO: 639060 - DNA, 25 bp, Rattus norvegicus
gcagctcttgggctacagtgcccgg

SEQ ID NO: 639061 - DNA, 25 bp, Rattus norvegicus
tttggccggcctcttctagcacggc

SEQ ID NO: 639062 - DNA, 25 bp, Rattus norvegicus
gtcctcaagagcgagcccggcacta

SEQ ID NO: 639063 - DNA, 25 bp, Rattus norvegicus
gcccggcactagcaacttctgcttg

SEQ ID NO: 639064 - DNA, 25 bp, Rattus norvegicus
gcaacttctgcttggcgagcctaac

SEQ ID NO: 639065 - DNA, 25 bp, Rattus norvegicus
gcgagcctaacttctgcgcggggtt

SEQ ID NO: 639066 - DNA, 25 bp, Rattus norvegicus
tcggacttgacgatacccagccgtg

SEQ ID NO: 639067 - DNA, 25 bp, Rattus norvegicus
gacctcctggctgtgcttctggtgc

SEQ ID NO: 639068 - DNA, 25 bp, Rattus norvegicus
agcccggcatgtaagtccgccagct

SEQ ID NO: 639069 - DNA, 25 bp, Rattus norvegicus
acgcacggggacagcatctttggtc

SEQ ID NO: 639070 - DNA, 25 bp, Rattus norvegicus
gtaagtccgccagctccggaacgca

SEQ ID NO: 639071 - DNA, 25 bp, Rattus norvegicus
tgtctttgtaggacagcgctgtgcg

SEQ ID NO: 639072 - DNA, 25 bp, Rattus norvegicus
gtcagaagcagcaccgcgtgcgtta

SEQ ID NO: 639073 - DNA, 25 bp, Rattus norvegicus
cacatcttgatgtctttgtaggaca

SEQ ID NO: 639074 - DNA, 25 bp, Rattus norvegicus
agggtagacttcctccacatcttga

SEQ ID NO: 639075 - DNA, 25 bp, Rattus norvegicus
gacggctggagggtagacttcctcc

SEQ ID NO: 639076 - DNA, 25 bp, Rattus norvegicus
tcatttgccggggtcagtctggctt

SEQ ID NO: 639077 - DNA, 25 bp, Rattus norvegicus
gattattttcatttgccggggtcag

SEQ ID NO: 639078 - DNA, 25 bp, Rattus norvegicus
gcgcgcttctaattacttttgatta

SEQ ID NO: 639079 - DNA, 25 bp, Rattus norvegicus
ccagcgcgcttctaattacttttga

SEQ ID NO: 639080 - DNA, 25 bp, Rattus norvegicus
tcgtccagcgcgcttctaattactt

SEQ ID NO: 639081 - DNA, 25 bp, Rattus norvegicus
ctcggctctcggaggagtcgtccag

SEQ ID NO: 639082 - DNA, 25 bp, Rattus norvegicus
aggcgtgtttactctcccgctcggc

SEQ ID NO: 639083 - DNA, 25 bp, Rattus norvegicus
gaggattcaggcgtgtttactctcc

SEQ ID NO: 639084 - DNA, 25 bp, Rattus norvegicus
gcagcaccgcgtgcgttattgtccg

SEQ ID NO: 639085 - DNA, 25 bp, Rattus norvegicus
agaaccacagaccagcaccaacaga

SEQ ID NO: 639086 - DNA, 25 bp, Rattus norvegicus
gcaccaacagaatggaaatgtaaga

SEQ ID NO: 639087 - DNA, 25 bp, Rattus norvegicus
atgtaagacagaatcccagaatgga

SEQ ID NO: 639088 - DNA, 25 bp, Rattus norvegicus
cccagaatggaactatagaacattg

SEQ ID NO: 639089 - DNA, 25 bp, Rattus norvegicus
atagaacattggtgccacagaacgg

SEQ ID NO: 639090 - DNA, 25 bp, Rattus norvegicus
cagaacgggaccacagaacagcatc

SEQ ID NO: 639091 - DNA, 25 bp, Rattus norvegicus
aaaagtcagtatggaaatgatgccc

SEQ ID NO: 639092 - DNA, 25 bp, Rattus norvegicus
gggctatgtaagatactgtctcaaa

SEQ ID NO: 639093 - DNA, 25 bp, Rattus norvegicus
tcacatcgcataaccacagagcgta

SEQ ID NO: 639094 - DNA, 25 bp, Rattus norvegicus
acagagcgtaatagaagctggcctc

SEQ ID NO: 639095 - DNA, 25 bp, Rattus norvegicus
ctggcctcgggtacatagtgaaatt

SEQ ID NO: 639096 - DNA, 25 bp, Rattus norvegicus
tagtgaaattgaggtcgccatgggc

SEQ ID NO: 639097 - DNA, 25 bp, Rattus norvegicus
tcgccatgggctatgtaagatactg

SEQ ID NO: 639098 - DNA, 25 bp, Rattus norvegicus
agagaaggagccacagaaccacaga

SEQ ID NO: 639099 - DNA, 25 bp, Rattus norvegicus
acagggcgtcctcgacccttgtgct

SEQ ID NO: 639100 - DNA, 25 bp, Rattus norvegicus
gccagtcttggcgaattagatgtca

SEQ ID NO: 639101 - DNA, 25 bp, Rattus norvegicus
tgtcacgcacaaggactagaccggg

SEQ ID NO: 639102 - DNA, 25 bp, Rattus norvegicus
cttagtaagaacaacgctagcgtgc

SEQ ID NO: 639103 - DNA, 25 bp, Rattus norvegicus
ctccttagcactgtgggctgaccgg

SEQ ID NO: 639104 - DNA, 25 bp, Rattus norvegicus
actgcggctgagttaggaaacttgg

SEQ ID NO: 639105 - DNA, 25 bp, Rattus norvegicus
tcctagcggagcagatctcaacagc

SEQ ID NO: 639106 - DNA, 25 bp, Rattus norvegicus
ggagtccctcccatagtcttaattc

SEQ ID NO: 639107 - DNA, 25 bp, Rattus norvegicus
ctggcaagagcagcgcacactgacc

SEQ ID NO: 639108 - DNA, 25 bp, Rattus norvegicus
tcctcaagaccctgcagatccgggg

SEQ ID NO: 639109 - DNA, 25 bp, Rattus norvegicus
ggcgtcctctgcaggatgcattcca

SEQ ID NO: 639110 - DNA, 25 bp, Rattus norvegicus
cagtggatccgtacgctctcgctag

SEQ ID NO: 639111 - DNA, 25 bp, Rattus norvegicus
tcctgcaatgtctgcgctggcaaga

SEQ ID NO: 639112 - DNA, 25 bp, Rattus norvegicus
tagcgtgcgctccacggataactgc

SEQ ID NO: 639113 - DNA, 25 bp, Rattus norvegicus
catgaggacgcgagcgaaatagacc

SEQ ID NO: 639114 - DNA, 25 bp, Rattus norvegicus
gcccttagccgatcagggcgcgcag

SEQ ID NO: 639115 - DNA, 25 bp, Rattus norvegicus
atcccgcggatcgacgctctcggaa

SEQ ID NO: 639116 - DNA, 25 bp, Rattus norvegicus
gatcgacgctctcggaagatcggga

SEQ ID NO: 639117 - DNA, 25 bp, Rattus norvegicus
gaagatcgggatcggactcttgttg

SEQ ID NO: 639118 - DNA, 25 bp, Rattus norvegicus
gcctctctggcggacagccgcatga

SEQ ID NO: 639119 - DNA, 25 bp, Rattus norvegicus
cagccgcatgaggacgcgagcgaaa

SEQ ID NO: 639120 - DNA, 25 bp, Rattus norvegicus
cgaaatagaccagggtggaattgcc

SEQ ID NO: 639121 - DNA, 25 bp, Rattus norvegicus
gtggaattgccaaggaagacgcttc

SEQ ID NO: 639122 - DNA, 25 bp, Rattus norvegicus
tggttttggtccatttctcccgcga

SEQ ID NO: 639123 - DNA, 25 bp, Rattus norvegicus
tttctcccgcgaagagtcgacatgg

SEQ ID NO: 639124 - DNA, 25 bp, Rattus norvegicus
cccgcgaagagtcgacatggcgagc

SEQ ID NO: 639125 - DNA, 25 bp, Rattus norvegicus
cagctcgcagcctggatgaaatcga

SEQ ID NO: 639126 - DNA, 25 bp, Rattus norvegicus
agcctggatgaaatcgatctctccg

SEQ ID NO: 639127 - DNA, 25 bp, Rattus norvegicus
cgtgctagagcccagagcgagctac

SEQ ID NO: 639128 - DNA, 25 bp, Rattus norvegicus
gaaggtcgcggcacttcttgtgata

SEQ ID NO: 639129 - DNA, 25 bp, Rattus norvegicus
tgctcgtgtcccagtctttcccgga

SEQ ID NO: 639130 - DNA, 25 bp, Rattus norvegicus
gccactgggccgaaccgggatacca

SEQ ID NO: 639131 - DNA, 25 bp, Rattus norvegicus
cctatcccggaagtgtagccgcggc

SEQ ID NO: 639132 - DNA, 25 bp, Rattus norvegicus
acctcgagccaatggaagatctgga

SEQ ID NO: 639133 - DNA, 25 bp, Rattus norvegicus
ggcgggacctcagaaaacctcgagc

SEQ ID NO: 639134 - DNA, 25 bp, Rattus norvegicus
gcactaatccgcagcacgtggggtt

SEQ ID NO: 639135 - DNA, 25 bp, Rattus norvegicus
tctgcacgccggaagtgcactaatc

SEQ ID NO: 639136 - DNA, 25 bp, Rattus norvegicus
ttcaagcagtcgactgcaggcagct

SEQ ID NO: 639137 - DNA, 25 bp, Rattus norvegicus
gcccgggaactcagcgaagcttcaa

SEQ ID NO: 639138 - DNA, 25 bp, Rattus norvegicus
acataaggatgcatcccgcccggga

SEQ ID NO: 639139 - DNA, 25 bp, Rattus norvegicus
agcgagctacctggtcctaatggtc

SEQ ID NO: 639140 - DNA, 25 bp, Rattus norvegicus
actgggcccggaactgaacataagg

SEQ ID NO: 639141 - DNA, 25 bp, Rattus norvegicus
ggccggtgtagatgaagtccagcac

SEQ ID NO: 639142 - DNA, 25 bp, Rattus norvegicus
gcagtacttgccatgccgtttgagg

SEQ ID NO: 639143 - DNA, 25 bp, Rattus norvegicus
ttcttgcacagagccacgaggtcag

SEQ ID NO: 639144 - DNA, 25 bp, Rattus norvegicus
cgaggtcagggatctgcaggtaact

SEQ ID NO: 639145 - DNA, 25 bp, Rattus norvegicus
aacactgtcagtaaggcggccggtg

SEQ ID NO: 639146 - DNA, 25 bp, Rattus norvegicus
ccgtttgaggcgcttcttgcacaga

SEQ ID NO: 639147 - DNA, 25 bp, Rattus norvegicus
ggccgggctcaccatgtcatggtcc

SEQ ID NO: 639148 - DNA, 25 bp, Rattus norvegicus
ttgtcatgcaccaccagggacttga

SEQ ID NO: 639149 - DNA, 25 bp, Rattus norvegicus
ccagcacgttcttgtgagcgcggaa

SEQ ID NO: 639150 - DNA, 25 bp, Rattus norvegicus
agggcgttctgcaccacgatgatca

SEQ ID NO: 639151 - DNA, 25 bp, Rattus norvegicus
gatcacgtcgcacaagaagcccttg

SEQ ID NO: 639152 - DNA, 25 bp, Rattus norvegicus
aagaagcccttggtgcgctggttgt

SEQ ID NO: 639153 - DNA, 25 bp, Rattus norvegicus
catggtccaggtttagcaggttgtc

SEQ ID NO: 639154 - DNA, 25 bp, Rattus norvegicus
tgctgcggcctcaacactgtcagta

SEQ ID NO: 639155 - DNA, 25 bp, Rattus norvegicus
tcaaggctgctgctcatcatggcgc

SEQ ID NO: 639156 - DNA, 25 bp, Rattus norvegicus
gaggcccgtcctcttctcaaggctg

SEQ ID NO: 639157 - DNA, 25 bp, Rattus norvegicus
cgggcccgcgactagtttagtatcg

SEQ ID NO: 639158 - DNA, 25 bp, Rattus norvegicus
ccggggttctctactggtacaatag

SEQ ID NO: 639159 - DNA, 25 bp, Rattus norvegicus
tgataatagagtcgtcccggggttc

SEQ ID NO: 639160 - DNA, 25 bp, Rattus norvegicus
gtatacgtgcgcgtgcctttctagg

SEQ ID NO: 639161 - DNA, 25 bp, Rattus norvegicus
gacgcagcacgttcctatataaaag

SEQ ID NO: 639162 - DNA, 25 bp, Rattus norvegicus
cgcacgctctgcgtatgacgcagca

SEQ ID NO: 639163 - DNA, 25 bp, Rattus norvegicus
atatccggttccgagttgcgcagcg

SEQ ID NO: 639164 - DNA, 25 bp, Rattus norvegicus
acttgctgagcgctccgtggatatc

SEQ ID NO: 639165 - DNA, 25 bp, Rattus norvegicus
ggcggaagccaaacgcccaggcatc

SEQ ID NO: 639166 - DNA, 25 bp, Rattus norvegicus
ataaaagcgtgcgtacagcggaggc

SEQ ID NO: 639167 - DNA, 25 bp, Rattus norvegicus
acaaggtagctttttgctaggtcta

SEQ ID NO: 639168 - DNA, 25 bp, Rattus norvegicus
ctccgtttcctaggtgacttgctga

SEQ ID NO: 639169 - DNA, 25 bp, Rattus norvegicus
ctgtgatgaaccacggagctccaga

SEQ ID NO: 639170 - DNA, 25 bp, Rattus norvegicus
gagcagtgtggcctcccgggtctcc

SEQ ID NO: 639171 - DNA, 25 bp, Rattus norvegicus
ctaagatgctgggagcagtgtggcc

SEQ ID NO: 639172 - DNA, 25 bp, Rattus norvegicus
gcgggagctcgaggctaagatgctg

SEQ ID NO: 639173 - DNA, 25 bp, Rattus norvegicus
taacgtccgcgatgtagggacgcgc

SEQ ID NO: 639174 - DNA, 25 bp, Rattus norvegicus
aaagaaggagcgaggtcagggtcgc

SEQ ID NO: 639175 - DNA, 25 bp, Rattus norvegicus
ggcgcggaggttgagggcgacctac

SEQ ID NO: 639176 - DNA, 25 bp, Rattus norvegicus
gcaggaagcgggaacatggcgcgga

SEQ ID NO: 639177 - DNA, 25 bp, Rattus norvegicus
gatgaaccacggagctccagacacc

SEQ ID NO: 639178 - DNA, 25 bp, Rattus norvegicus
cgactgtgatgaaccacggagctcc

SEQ ID NO: 639179 - DNA, 25 bp, Rattus norvegicus
cgcgactgtgatgaaccacggagct

SEQ ID NO: 639180 - DNA, 25 bp, Rattus norvegicus
cccgcgactgtgatgaaccacggag

SEQ ID NO: 639181 - DNA, 25 bp, Rattus norvegicus
tggcctcccgggtctccgcagtcgc

SEQ ID NO: 639182 - DNA, 25 bp, Rattus norvegicus
gagctccagacacccgcaggcagga

SEQ ID NO: 639183 - DNA, 25 bp, Rattus norvegicus
ctcgcaagccgctggctccgggata

SEQ ID NO: 639184 - DNA, 25 bp, Rattus norvegicus
tcaggctctggtacagggtgtggaa

SEQ ID NO: 639185 - DNA, 25 bp, Rattus norvegicus
gcagctcgacccacacggactgtgc

SEQ ID NO: 639186 - DNA, 25 bp, Rattus norvegicus
gcggaccaatcgcgggtcaggctct

SEQ ID NO: 639187 - DNA, 25 bp, Rattus norvegicus
agagccttccctaggcttgctctct

SEQ ID NO: 639188 - DNA, 25 bp, Rattus norvegicus
aagccgctggctccgggatactccg

SEQ ID NO: 639189 - DNA, 25 bp, Rattus norvegicus
ctggctccgggatactccgagtgga

SEQ ID NO: 639190 - DNA, 25 bp, Rattus norvegicus
ttaaactccgtggacccggctggca

SEQ ID NO: 639191 - DNA, 25 bp, Rattus norvegicus
gtggacccggctggcaagcgccaat

SEQ ID NO: 639192 - DNA, 25 bp, Rattus norvegicus
gctggcaagcgccaatccgtgacag

SEQ ID NO: 639193 - DNA, 25 bp, Rattus norvegicus
agccgagcggaccaatcgcgggtca

SEQ ID NO: 639194 - DNA, 25 bp, Rattus norvegicus
cagcgacgtccacgcagctcgaccc

SEQ ID NO: 639195 - DNA, 25 bp, Rattus norvegicus
agcgctgctgcgacggcgtgcagcg

SEQ ID NO: 639196 - DNA, 25 bp, Rattus norvegicus
ctggacagagccttccctaggcttg

SEQ ID NO: 639197 - DNA, 25 bp, Rattus norvegicus
gcgatgaccggtgtccaggtctccc

SEQ ID NO: 639198 - DNA, 25 bp, Rattus norvegicus
tattgtggctcctcgcggtctgcgc

SEQ ID NO: 639199 - DNA, 25 bp, Rattus norvegicus
tctgccctattgtggctcctcgcgg

SEQ ID NO: 639200 - DNA, 25 bp, Rattus norvegicus
gtcactgcggagacacggcttcccg

SEQ ID NO: 639201 - DNA, 25 bp, Rattus norvegicus
cacgtcactgcggagacacggcttc

SEQ ID NO: 639202 - DNA, 25 bp, Rattus norvegicus
acagcctctgacgtcacccggcccg

SEQ ID NO: 639203 - DNA, 25 bp, Rattus norvegicus
acacatcgctacacacagcctctga

SEQ ID NO: 639204 - DNA, 25 bp, Rattus norvegicus
gcgaggcctgtacacccgtgggacc

SEQ ID NO: 639205 - DNA, 25 bp, Rattus norvegicus
ctagaatctgcgaggcctgtacacc

SEQ ID NO: 639206 - DNA, 25 bp, Rattus norvegicus
cggctcgggtcaagtgcaccgccat

SEQ ID NO: 639207 - DNA, 25 bp, Rattus norvegicus
acgctcagagatggggccagcccga

SEQ ID NO: 639208 - DNA, 25 bp, Rattus norvegicus
aagcccggaagcctgcgtcgctgga

SEQ ID NO: 639209 - DNA, 25 bp, Rattus norvegicus
aagcctgcgtcgctggacgctcaga

SEQ ID NO: 639210 - DNA, 25 bp, Rattus norvegicus
agccgacccgtcctagaatctgcga

SEQ ID NO: 639211 - DNA, 25 bp, Rattus norvegicus
gactcggcctcccttccacgccctc

SEQ ID NO: 639212 - DNA, 25 bp, Rattus norvegicus
gaccgccgaggtctgatgctcggca

SEQ ID NO: 639213 - DNA, 25 bp, Rattus norvegicus
gggcgcctttaagtgtagatggaca

SEQ ID NO: 639214 - DNA, 25 bp, Rattus norvegicus
ctttaagtgtagatggacagggtga

SEQ ID NO: 639215 - DNA, 25 bp, Rattus norvegicus
gagggtgtcacggaaacgagatcca

SEQ ID NO: 639216 - DNA, 25 bp, Rattus norvegicus
cgcgagacttcactcggggagcggc

SEQ ID NO: 639217 - DNA, 25 bp, Rattus norvegicus
cggaaacgagatccacccaggacgc

SEQ ID NO: 639218 - DNA, 25 bp, Rattus norvegicus
atccacccaggacgcccaaagcaca

SEQ ID NO: 639219 - DNA, 25 bp, Rattus norvegicus
ccaaagcacagcgtgccacgggacc

SEQ ID NO: 639220 - DNA, 25 bp, Rattus norvegicus
aaaggcgagctctcctgtgactttc

SEQ ID NO: 639221 - DNA, 25 bp, Rattus norvegicus
tcctgtgactttccggaggaagcag

SEQ ID NO: 639222 - DNA, 25 bp, Rattus norvegicus
gcccgaaacccgcagatgcgtgagg

SEQ ID NO: 639223 - DNA, 25 bp, Rattus norvegicus
cccgcagatgcgtgagggaaacctc

SEQ ID NO: 639224 - DNA, 25 bp, Rattus norvegicus
aggtctgatgctcggcactcctcgt

SEQ ID NO: 639225 - DNA, 25 bp, Rattus norvegicus
cccgtcatatttcgaaacaccaaga

SEQ ID NO: 639226 - DNA, 25 bp, Rattus norvegicus
aagcttcggcgacggcggtgctccc

SEQ ID NO: 639227 - DNA, 25 bp, Rattus norvegicus
agggaactcaagcttcggcgacggc

SEQ ID NO: 639228 - DNA, 25 bp, Rattus norvegicus
cgcagacttagggaactcaagcttc

SEQ ID NO: 639229 - DNA, 25 bp, Rattus norvegicus
gcactgcgcagacttagggaactca

SEQ ID NO: 639230 - DNA, 25 bp, Rattus norvegicus
cagcgagtagcactgcgcagactta

SEQ ID NO: 639231 - DNA, 25 bp, Rattus norvegicus
cccaccgcaggatcaggaactgaaa

SEQ ID NO: 639232 - DNA, 25 bp, Rattus norvegicus
agctagcccgtcatatttcgaaaca

SEQ ID NO: 639233 - DNA, 25 bp, Rattus norvegicus
ttcaactctgtgaagctagcccgtc

SEQ ID NO: 639234 - DNA, 25 bp, Rattus norvegicus
gatagctcgaatattcaactctgtg

SEQ ID NO: 639235 - DNA, 25 bp, Rattus norvegicus
acgtacccaggatagctcgaatatt

SEQ ID NO: 639236 - DNA, 25 bp, Rattus norvegicus
tcctagccaacgtacccaggatagc

SEQ ID NO: 639237 - DNA, 25 bp, Rattus norvegicus
tggatgaggggacttcctagccaac

SEQ ID NO: 639238 - DNA, 25 bp, Rattus norvegicus
aggaactgaaatagcgcagcgagta

SEQ ID NO: 639239 - DNA, 25 bp, Rattus norvegicus
cgagcgaagggtcgcttcgccgcca

SEQ ID NO: 639240 - DNA, 25 bp, Rattus norvegicus
accacgttcgctcctagggctgcat

SEQ ID NO: 639241 - DNA, 25 bp, Rattus norvegicus
gactcctgggcgacctacactcatt

SEQ ID NO: 639242 - DNA, 25 bp, Rattus norvegicus
gacctacactcattcgtcccgggtg

SEQ ID NO: 639243 - DNA, 25 bp, Rattus norvegicus
cactcacccgcggtagtaggctttc

SEQ ID NO: 639244 - DNA, 25 bp, Rattus norvegicus
agtaggctttcacccggacctggtg

SEQ ID NO: 639245 - DNA, 25 bp, Rattus norvegicus
ctttcacccggacctggtgggaatg

SEQ ID NO: 639246 - DNA, 25 bp, Rattus norvegicus
cgccgcacgcgaccgtgtgagacat

SEQ ID NO: 639247 - DNA, 25 bp, Rattus norvegicus
ccgtgtgagacatggtgctgctgtc

SEQ ID NO: 639248 - DNA, 25 bp, Rattus norvegicus
tgctgctgtccctctgggtcggcat

SEQ ID NO: 639249 - DNA, 25 bp, Rattus norvegicus
tcggcctcccgagcctgtcgggaag

SEQ ID NO: 639250 - DNA, 25 bp, Rattus norvegicus
ctcccgagcctgtcgggaagccgtg

SEQ ID NO: 639251 - DNA, 25 bp, Rattus norvegicus
gcctaacccgccagagcgagcgaag

SEQ ID NO: 639252 - DNA, 25 bp, Rattus norvegicus
ctcctagggctgcattccgcggcag

SEQ ID NO: 639253 - DNA, 25 bp, Rattus norvegicus
taagcgaactgctacccaggggacc

SEQ ID NO: 639254 - DNA, 25 bp, Rattus norvegicus
tatttccctgccaaggccgtgcact

SEQ ID NO: 639255 - DNA, 25 bp, Rattus norvegicus
gctgaacgcggcgagtatttccctg

SEQ ID NO: 639256 - DNA, 25 bp, Rattus norvegicus
cctctggcgtgtcagagctgaacgc

SEQ ID NO: 639257 - DNA, 25 bp, Rattus norvegicus
ccgagtaggcctctggcgtgtcaga

SEQ ID NO: 639258 - DNA, 25 bp, Rattus norvegicus
tgctcagttagcgacttgaaacttc

SEQ ID NO: 639259 - DNA, 25 bp, Rattus norvegicus
agcgctgtgatgctatgctcagtta

SEQ ID NO: 639260 - DNA, 25 bp, Rattus norvegicus
gccgcattcttgtgtagcgctgtga

SEQ ID NO: 639261 - DNA, 25 bp, Rattus norvegicus
cacgctggctcctgcgggtctgtct

SEQ ID NO: 639262 - DNA, 25 bp, Rattus norvegicus
ctgtcattccagtcgcgggccgggt

SEQ ID NO: 639263 - DNA, 25 bp, Rattus norvegicus
gctcgttcggggctgtcattccagt

SEQ ID NO: 639264 - DNA, 25 bp, Rattus norvegicus
gggctcttaccggacgcgagccctg

SEQ ID NO: 639265 - DNA, 25 bp, Rattus norvegicus
gctgcgtggtcctaagcgaactgct

SEQ ID NO: 639266 - DNA, 25 bp, Rattus norvegicus
cttgctggtgactgatgtcgtaacc

SEQ ID NO: 639267 - DNA, 25 bp, Rattus norvegicus
ctaggaagggaagcctcgtcgtgac

SEQ ID NO: 639268 - DNA, 25 bp, Rattus norvegicus
aagtcagcgaggaacgccacacacc

SEQ ID NO: 639269 - DNA, 25 bp, Rattus norvegicus
cggcatgtgccgagaaagtcagcga

SEQ ID NO: 639270 - DNA, 25 bp, Rattus norvegicus
ctgaccgggttcaacggctcggcat

SEQ ID NO: 639271 - DNA, 25 bp, Rattus norvegicus
cagaacaactgtgacccggggctcc

SEQ ID NO: 639272 - DNA, 25 bp, Rattus norvegicus
ggaaccgcctcgtggggacccagca

SEQ ID NO: 639273 - DNA, 25 bp, Rattus norvegicus
cgtcaccctgcgtcctaggaaggga

SEQ ID NO: 639274 - DNA, 25 bp, Rattus norvegicus
aacctccgtgactgactgaggggcg

SEQ ID NO: 639275 - DNA, 25 bp, Rattus norvegicus
cgtgacgcgacaggccagtggcctc

SEQ ID NO: 639276 - DNA, 25 bp, Rattus norvegicus
agtggcctccacaagtcgtgcgctc

SEQ ID NO: 639277 - DNA, 25 bp, Rattus norvegicus
ccgcgaagcacgagtggtctgaagc

SEQ ID NO: 639278 - DNA, 25 bp, Rattus norvegicus
tgaagccaccaacctccgtgactga

SEQ ID NO: 639279 - DNA, 25 bp, Rattus norvegicus
cagaagcaggctcggaaccgcctcg

SEQ ID NO: 639280 - DNA, 25 bp, Rattus norvegicus
caaccgccctgcagaacaactgtga

SEQ ID NO: 639281 - DNA, 25 bp, Rattus norvegicus
aacatctggaaggagccctcgggcc

SEQ ID NO: 639282 - DNA, 25 bp, Rattus norvegicus
ggttccttctgacgtggagcgagca

SEQ ID NO: 639283 - DNA, 25 bp, Rattus norvegicus
tcttgtgtcgcctgcgttccgccat

SEQ ID NO: 639284 - DNA, 25 bp, Rattus norvegicus
gccggcaagcttcaagccgactatt

SEQ ID NO: 639285 - DNA, 25 bp, Rattus norvegicus
gggcagacgccgcttaacatctgga

SEQ ID NO: 639286 - DNA, 25 bp, Rattus norvegicus
atcgcctggaagaaggccggcaagc

SEQ ID NO: 639287 - DNA, 25 bp, Rattus norvegicus
tctgtggtcttcgttcctgtccctg

SEQ ID NO: 639288 - DNA, 25 bp, Rattus norvegicus
cggagcgtccgtctggaagcacaaa

SEQ ID NO: 639289 - DNA, 25 bp, Rattus norvegicus
tctggaagcacaaagaaccggcggc

SEQ ID NO: 639290 - DNA, 25 bp, Rattus norvegicus
cccagttaccgtggcattaatatcc

SEQ ID NO: 639291 - DNA, 25 bp, Rattus norvegicus
cattaatatccggagcgccaggggc

SEQ ID NO: 639292 - DNA, 25 bp, Rattus norvegicus
caccgggtcgcttgggatgtctccc

SEQ ID NO: 639293 - DNA, 25 bp, Rattus norvegicus
cccgacctggatccgcttcttgtgt

SEQ ID NO: 639294 - DNA, 25 bp, Rattus norvegicus
tcaagccgactattcggttaaaaga

SEQ ID NO: 639295 - DNA, 25 bp, Rattus norvegicus
cgcagccattttggcccggggacac

SEQ ID NO: 639296 - DNA, 25 bp, Rattus norvegicus
gcgcttccgtctccgaacggtagaa

SEQ ID NO: 639297 - DNA, 25 bp, Rattus norvegicus
cgcagagcgtaagcattgcgcacgc

SEQ ID NO: 639298 - DNA, 25 bp, Rattus norvegicus
tgctgcacgcagagcgtaagcattg

SEQ ID NO: 639299 - DNA, 25 bp, Rattus norvegicus
aggcgaagcatctgctgcacgcaga

SEQ ID NO: 639300 - DNA, 25 bp, Rattus norvegicus
cgcgacttccggaggcgaagcatct

SEQ ID NO: 639301 - DNA, 25 bp, Rattus norvegicus
ggaacaccgcgcagccattttggcc

SEQ ID NO: 639302 - DNA, 25 bp, Rattus norvegicus
ctaaaccagcgtggggaacaccgcg

SEQ ID NO: 639303 - DNA, 25 bp, Rattus norvegicus
gacacagggatgctgccactacgcc

SEQ ID NO: 639304 - DNA, 25 bp, Rattus norvegicus
cgaacggtagaactctacgtcaacg

SEQ ID NO: 639305 - DNA, 25 bp, Rattus norvegicus
caccgggtctcaatgtcagcagcgc

SEQ ID NO: 639306 - DNA, 25 bp, Rattus norvegicus
agacacacagcttgcgacacaggga

SEQ ID NO: 639307 - DNA, 25 bp, Rattus norvegicus
tggaaagcccgaaggcagagacaca

SEQ ID NO: 639308 - DNA, 25 bp, Rattus norvegicus
cgtgagcgcccatggaaagcccgaa

SEQ ID NO: 639309 - DNA, 25 bp, Rattus norvegicus
gggtcacctccagagatctcgctct

SEQ ID NO: 639310 - DNA, 25 bp, Rattus norvegicus
tcgctacgtgcagcgcgcggtatga

SEQ ID NO: 639311 - DNA, 25 bp, Rattus norvegicus
gcgcggtatgagacggtaggacgat

SEQ ID NO: 639312 - DNA, 25 bp, Rattus norvegicus
cactcgctacgtgcagcgcgcggta

SEQ ID NO: 639313 - DNA, 25 bp, Rattus norvegicus
gacggtcgccctccggcactcgcta

SEQ ID NO: 639314 - DNA, 25 bp, Rattus norvegicus
ctctctcactctcgctcggacggtc

SEQ ID NO: 639315 - DNA, 25 bp, Rattus norvegicus
cctccagagatctcgctctctctct

SEQ ID NO: 639316 - DNA, 25 bp, Rattus norvegicus
tcgggtcacctccagagatctcgct

SEQ ID NO: 639317 - DNA, 25 bp, Rattus norvegicus
cttcgggtcacctccagagatctcg

SEQ ID NO: 639318 - DNA, 25 bp, Rattus norvegicus
ttttctcgtgattatgccctcgccc

SEQ ID NO: 639319 - DNA, 25 bp, Rattus norvegicus
ccttttctcgtgattatgccctcgc

SEQ ID NO: 639320 - DNA, 25 bp, Rattus norvegicus
ttccttttctcgtgattatgccctc

SEQ ID NO: 639321 - DNA, 25 bp, Rattus norvegicus
gtcttttccttttctcgtgattatg

SEQ ID NO: 639322 - DNA, 25 bp, Rattus norvegicus
agacggtaggacgatgggaaggccg

SEQ ID NO: 639323 - DNA, 25 bp, Rattus norvegicus
agctgggtctctgagccctgacttc

SEQ ID NO: 639324 - DNA, 25 bp, Rattus norvegicus
cacggcacgggccatgactatagcc

SEQ ID NO: 639325 - DNA, 25 bp, Rattus norvegicus
gctgacttacatcctgcgccagacg

SEQ ID NO: 639326 - DNA, 25 bp, Rattus norvegicus
ggcatgcccaggtctccggatcaca

SEQ ID NO: 639327 - DNA, 25 bp, Rattus norvegicus
cggagacccggctcaagtgcacagc

SEQ ID NO: 639328 - DNA, 25 bp, Rattus norvegicus
actctaggtgtccactagggccggc

SEQ ID NO: 639329 - DNA, 25 bp, Rattus norvegicus
tggggacaccggagataggactcta

SEQ ID NO: 639330 - DNA, 25 bp, Rattus norvegicus
cgtcacgtccggatgtgtggtccat

SEQ ID NO: 639331 - DNA, 25 bp, Rattus norvegicus
cgccatcttgggaggacgtcaccgc

SEQ ID NO: 639332 - DNA, 25 bp, Rattus norvegicus
gggaaacagtttcttcactctctca

SEQ ID NO: 639333 - DNA, 25 bp, Rattus norvegicus
tcccagaacggagggacgacaggcc

SEQ ID NO: 639334 - DNA, 25 bp, Rattus norvegicus
gcggaggttgcctctcccaggacac

SEQ ID NO: 639335 - DNA, 25 bp, Rattus norvegicus
atgactatagccaccgcggaggttg

SEQ ID NO: 639336 - DNA, 25 bp, Rattus norvegicus
cggatcacacctcactgctgactta

SEQ ID NO: 639337 - DNA, 25 bp, Rattus norvegicus
ccagttcgtctacccgaatattctg

SEQ ID NO: 639338 - DNA, 25 bp, Rattus norvegicus
agctgcgtgtgggtgatcaagcgca

SEQ ID NO: 639339 - DNA, 25 bp, Rattus norvegicus
ctgacagcaagcaggagctgcgtgt

SEQ ID NO: 639340 - DNA, 25 bp, Rattus norvegicus
acagccctgcggctgacagcaagca

SEQ ID NO: 639341 - DNA, 25 bp, Rattus norvegicus
tctgggccggaccaagaaccacagc

SEQ ID NO: 639342 - DNA, 25 bp, Rattus norvegicus
tacccgaatattctgggccggacca

SEQ ID NO: 639343 - DNA, 25 bp, Rattus norvegicus
gatcgacaacggctcgggaatgatc

SEQ ID NO: 639344 - DNA, 25 bp, Rattus norvegicus
caccagtggtgatcgacaacggctc

SEQ ID NO: 639345 - DNA, 25 bp, Rattus norvegicus
tgagcagctaccagccaccagtggt

SEQ ID NO: 639346 - DNA, 25 bp, Rattus norvegicus
gcaccggcagcatgagcagctacca

SEQ ID NO: 639347 - DNA, 25 bp, Rattus norvegicus
agatgcagcagcaccggcagcatga

SEQ ID NO: 639348 - DNA, 25 bp, Rattus norvegicus
ggtctcaggaggcaccgcgcgtcac

SEQ ID NO: 639349 - DNA, 25 bp, Rattus norvegicus
cagatggcgcggtcctctgtgacgc

SEQ ID NO: 639350 - DNA, 25 bp, Rattus norvegicus
ccagcacagccagcgaaggagcggt

SEQ ID NO: 639351 - DNA, 25 bp, Rattus norvegicus
aagttcagacctgcagcgggtcacc

SEQ ID NO: 639352 - DNA, 25 bp, Rattus norvegicus
tatttagggacaagggccgcgcgac

SEQ ID NO: 639353 - DNA, 25 bp, Rattus norvegicus
gcgacttctgcgtctaaccctattg

SEQ ID NO: 639354 - DNA, 25 bp, Rattus norvegicus
cctattgttatagctgtgggttctg

SEQ ID NO: 639355 - DNA, 25 bp, Rattus norvegicus
ttctgttcttttgttctccgcccgc

SEQ ID NO: 639356 - DNA, 25 bp, Rattus norvegicus
ttcagcgggcctggaaagttcagac

SEQ ID NO: 639357 - DNA, 25 bp, Rattus norvegicus
gtcaccgcgcattctggaacctcaa

SEQ ID NO: 639358 - DNA, 25 bp, Rattus norvegicus
tggaacctcaaaaaatgtcagcgta

SEQ ID NO: 639359 - DNA, 25 bp, Rattus norvegicus
aatgtcagcgtaggagctctggtgc

SEQ ID NO: 639360 - DNA, 25 bp, Rattus norvegicus
cggcctggggtcttagaactccgct

SEQ ID NO: 639361 - DNA, 25 bp, Rattus norvegicus
tgccgccgtgaagagctagtctctg

SEQ ID NO: 639362 - DNA, 25 bp, Rattus norvegicus
atcagcgcgagctgtcgggtattta

SEQ ID NO: 639363 - DNA, 25 bp, Rattus norvegicus
tagtctctgttagctacggggcacc

SEQ ID NO: 639364 - DNA, 25 bp, Rattus norvegicus
ccgctgtttttctcgctgactttca

SEQ ID NO: 639365 - DNA, 25 bp, Rattus norvegicus
ggctgcaaacccgagtgcctctaag

SEQ ID NO: 639366 - DNA, 25 bp, Rattus norvegicus
gtctcgagacccatcggatttgttc

SEQ ID NO: 639367 - DNA, 25 bp, Rattus norvegicus
cggtccgaggatgtcaaacagaatc

SEQ ID NO: 639368 - DNA, 25 bp, Rattus norvegicus
cgaaagtgtgcgtttctcggtccga

SEQ ID NO: 639369 - DNA, 25 bp, Rattus norvegicus
cgagacctggcccttgccgaaatca

SEQ ID NO: 639370 - DNA, 25 bp, Rattus norvegicus
cacctttgcctataaccggctgagg

SEQ ID NO: 639371 - DNA, 25 bp, Rattus norvegicus
ccggcggttgagagctaacaccttt

SEQ ID NO: 639372 - DNA, 25 bp, Rattus norvegicus
tctcgccttgcagaggtacgaagcc

SEQ ID NO: 639373 - DNA, 25 bp, Rattus norvegicus
cctgccagcagctttgcgcggtaaa

SEQ ID NO: 639374 - DNA, 25 bp, Rattus norvegicus
aaagcttccgtgttctgtctcgaga

SEQ ID NO: 639375 - DNA, 25 bp, Rattus norvegicus
atctagccttgtgtgctcgcccttg

SEQ ID NO: 639376 - DNA, 25 bp, Rattus norvegicus
ttcggattgatgcactgactattta

SEQ ID NO: 639377 - DNA, 25 bp, Rattus norvegicus
tattacctcgatcggtggcccttcg

SEQ ID NO: 639378 - DNA, 25 bp, Rattus norvegicus
tcacaccaaggaggcggcgtgtatt

SEQ ID NO: 639379 - DNA, 25 bp, Rattus norvegicus
caaggatgaggtggctactgcgaat

SEQ ID NO: 639380 - DNA, 25 bp, Rattus norvegicus
ggggagtcactagagcagctcttag

SEQ ID NO: 639381 - DNA, 25 bp, Rattus norvegicus
tggctactgcgaatccaaaggaggg

SEQ ID NO: 639382 - DNA, 25 bp, Rattus norvegicus
tccgagcgtcctctttagcaacagg

SEQ ID NO: 639383 - DNA, 25 bp, Rattus norvegicus
acatcctggatcgtggcttttacgc

SEQ ID NO: 639384 - DNA, 25 bp, Rattus norvegicus
gatcgaggcttgcagacatcctgga

SEQ ID NO: 639385 - DNA, 25 bp, Rattus norvegicus
cgctgggatcgaggcttgcagacat

SEQ ID NO: 639386 - DNA, 25 bp, Rattus norvegicus
cagctcttagggtcgcgctcctatt

SEQ ID NO: 639387 - DNA, 25 bp, Rattus norvegicus
tcagagggaagatctcgacttcaga

SEQ ID NO: 639388 - DNA, 25 bp, Rattus norvegicus
acttcagaaggactttcctgttagc

SEQ ID NO: 639389 - DNA, 25 bp, Rattus norvegicus
ggactttcctgttagctgccttgca

SEQ ID NO: 639390 - DNA, 25 bp, Rattus norvegicus
ttttacgcgtgagtaacggaggcgc

SEQ ID NO: 639391 - DNA, 25 bp, Rattus norvegicus
tagggtcgcgctcctattggtcaga

SEQ ID NO: 639392 - DNA, 25 bp, Rattus norvegicus
cgtcctctttagcaacagggagaga

SEQ ID NO: 639393 - DNA, 25 bp, Rattus norvegicus
gccagccgagaacgcagcaccataa

SEQ ID NO: 639394 - DNA, 25 bp, Rattus norvegicus
ccatgcctctcacacttggacttga

SEQ ID NO: 639395 - DNA, 25 bp, Rattus norvegicus
ccctcggatatcagagctgcttcga

SEQ ID NO: 639396 - DNA, 25 bp, Rattus norvegicus
cggcgagcagcctgcagtgtacttt

SEQ ID NO: 639397 - DNA, 25 bp, Rattus norvegicus
cgtctgtgctgggtttgttcaaatg

SEQ ID NO: 639398 - DNA, 25 bp, Rattus norvegicus
cgttgcttagcacggaccagcaggc

SEQ ID NO: 639399 - DNA, 25 bp, Rattus norvegicus
ttcagcgaaggcttgggtgacactc

SEQ ID NO: 639400 - DNA, 25 bp, Rattus norvegicus
ggcgcctttccgaagctctgtttgt

SEQ ID NO: 639401 - DNA, 25 bp, Rattus norvegicus
ggggcgcagttcagtctgccacttt

SEQ ID NO: 639402 - DNA, 25 bp, Rattus norvegicus
agctctcggcttcgcagagtcactg

SEQ ID NO: 639403 - DNA, 25 bp, Rattus norvegicus
tgcagtgtactttctccctcggata

SEQ ID NO: 639404 - DNA, 25 bp, Rattus norvegicus
cttggacttgaggaatctcgaactc

SEQ ID NO: 639405 - DNA, 25 bp, Rattus norvegicus
tgccactttctttctgggtgcagca

SEQ ID NO: 639406 - DNA, 25 bp, Rattus norvegicus
gttcaaatgcttccgcccagcgttg

SEQ ID NO: 639407 - DNA, 25 bp, Rattus norvegicus
ccgttgctggagattgattgtcaaa

SEQ ID NO: 639408 - DNA, 25 bp, Rattus norvegicus
gtagccggctgctcccgcagaaccc

SEQ ID NO: 639409 - DNA, 25 bp, Rattus norvegicus
cagctgcaggaagtgactgcggaac

SEQ ID NO: 639410 - DNA, 25 bp, Rattus norvegicus
gattgattgtcaaaagtcagtggga

SEQ ID NO: 639411 - DNA, 25 bp, Rattus norvegicus
ctccggcggcgctactgcgcatgtg

SEQ ID NO: 639412 - DNA, 25 bp, Rattus norvegicus
atcggccgctccgttgctggagatt

SEQ ID NO: 639413 - DNA, 25 bp, Rattus norvegicus
gcccgctccacgaccactttctgag

SEQ ID NO: 639414 - DNA, 25 bp, Rattus norvegicus
ggactcgaggaccgcactcaccgga

SEQ ID NO: 639415 - DNA, 25 bp, Rattus norvegicus
cgcgggcaaggctgacacgcgcaca

SEQ ID NO: 639416 - DNA, 25 bp, Rattus norvegicus
ccaatggctacaggatcgggatcgg

SEQ ID NO: 639417 - DNA, 25 bp, Rattus norvegicus
cgaggcggctgtgccaatggctaca

SEQ ID NO: 639418 - DNA, 25 bp, Rattus norvegicus
cgtgtgccatcccagggctgggcac

SEQ ID NO: 639419 - DNA, 25 bp, Rattus norvegicus
gcagcatcgccctcgcgtgtgccat

SEQ ID NO: 639420 - DNA, 25 bp, Rattus norvegicus
agcggagccacagggaaacagctgc

SEQ ID NO: 639421 - DNA, 25 bp, Rattus norvegicus
ctcggagatctgtttccggggcgtt

SEQ ID NO: 639422 - DNA, 25 bp, Rattus norvegicus
tgtagagcccaggtagcgtaggtct

SEQ ID NO: 639423 - DNA, 25 bp, Rattus norvegicus
ctgggaaaccggcttgtgtagagcc

SEQ ID NO: 639424 - DNA, 25 bp, Rattus norvegicus
cactgcgcctttgtgcacactcggg

SEQ ID NO: 639425 - DNA, 25 bp, Rattus norvegicus
cagagtagactgcagccctaagctg

SEQ ID NO: 639426 - DNA, 25 bp, Rattus norvegicus
cagcctccgctgtacgtgggtagat

SEQ ID NO: 639427 - DNA, 25 bp, Rattus norvegicus
tacacgatgtgagcggtaaagtagc

SEQ ID NO: 639428 - DNA, 25 bp, Rattus norvegicus
acctcatttccggtcctcggagatc

SEQ ID NO: 639429 - DNA, 25 bp, Rattus norvegicus
gaacttgcacattgcccggcctctt

SEQ ID NO: 639430 - DNA, 25 bp, Rattus norvegicus
agtgaatcactgttgccgaacttgc

SEQ ID NO: 639431 - DNA, 25 bp, Rattus norvegicus
tcgcactgctacttggggcggaaga

SEQ ID NO: 639432 - DNA, 25 bp, Rattus norvegicus
actgcagcgttgagtcgcactgcta

SEQ ID NO: 639433 - DNA, 25 bp, Rattus norvegicus
cgtcccaggatgacaccacagcttg

SEQ ID NO: 639434 - DNA, 25 bp, Rattus norvegicus
ccacagcttgagctactgcagcgtt

SEQ ID NO: 639435 - DNA, 25 bp, Rattus norvegicus
ctccgcgccgtcagttcaggattct

SEQ ID NO: 639436 - DNA, 25 bp, Rattus norvegicus
ctggagggagccaccctcctgatga

SEQ ID NO: 639437 - DNA, 25 bp, Rattus norvegicus
caatatatgcagttccggttgcgga

SEQ ID NO: 639438 - DNA, 25 bp, Rattus norvegicus
gaccttcgagctccggacaggcgca

SEQ ID NO: 639439 - DNA, 25 bp, Rattus norvegicus
cgtttgccggcattagtgtgtgatc

SEQ ID NO: 639440 - DNA, 25 bp, Rattus norvegicus
ctcctgatgacctcggcgctacgtt

SEQ ID NO: 639441 - DNA, 25 bp, Rattus norvegicus
gttcaggattctggagggagccacc

SEQ ID NO: 639442 - DNA, 25 bp, Rattus norvegicus
aggcctgtccaggtaggaatccagc

SEQ ID NO: 639443 - DNA, 25 bp, Rattus norvegicus
cgacgcccggggtgaccttcgagct

SEQ ID NO: 639444 - DNA, 25 bp, Rattus norvegicus
gctctccggcggacgagacagccag

SEQ ID NO: 639445 - DNA, 25 bp, Rattus norvegicus
agatccgaatcaccggaagtatccg

SEQ ID NO: 639446 - DNA, 25 bp, Rattus norvegicus
caacagccaataggagatccgaatc

SEQ ID NO: 639447 - DNA, 25 bp, Rattus norvegicus
tccggttgcggagcaacagccaata

SEQ ID NO: 639448 - DNA, 25 bp, Rattus norvegicus
ctcggcgctacgtttgccggcatta

SEQ ID NO: 639449 - DNA, 25 bp, Rattus norvegicus
cgggcagagcgcgaaggccgggccc

SEQ ID NO: 639450 - DNA, 25 bp, Rattus norvegicus
taggggaagtgataaggaagacagg

SEQ ID NO: 639451 - DNA, 25 bp, Rattus norvegicus
ggaagacaggagcacgatgcccatc

SEQ ID NO: 639452 - DNA, 25 bp, Rattus norvegicus
aagacaggagcacgatgcccatcca

SEQ ID NO: 639453 - DNA, 25 bp, Rattus norvegicus
gacaggagcacgatgcccatccagg

SEQ ID NO: 639454 - DNA, 25 bp, Rattus norvegicus
acaggagcacgatgcccatccaggc

SEQ ID NO: 639455 - DNA, 25 bp, Rattus norvegicus
caggagcacgatgcccatccaggcg

SEQ ID NO: 639456 - DNA, 25 bp, Rattus norvegicus
cgatgcccatccaggcgccgccctg

SEQ ID NO: 639457 - DNA, 25 bp, Rattus norvegicus
ggctgtcaggccttcgtttgggccc

SEQ ID NO: 639458 - DNA, 25 bp, Rattus norvegicus
tgtcaggccttcgtttgggcccgcc

SEQ ID NO: 639459 - DNA, 25 bp, Rattus norvegicus
tcaggccttcgtttgggcccgccgc

SEQ ID NO: 639460 - DNA, 25 bp, Rattus norvegicus
agcggagacagtggctgcggtggcg

SEQ ID NO: 639461 - DNA, 25 bp, Rattus norvegicus
cccggcacggggagcggagacagtg

SEQ ID NO: 639462 - DNA, 25 bp, Rattus norvegicus
ctgtcaggccttcgtttgggcccgc

SEQ ID NO: 639463 - DNA, 25 bp, Rattus norvegicus
gagcactggagagcccgcgtcctca

SEQ ID NO: 639464 - DNA, 25 bp, Rattus norvegicus
gcgcccagctatccgcatccacacg

SEQ ID NO: 639465 - DNA, 25 bp, Rattus norvegicus
cacctacctggagcctggccgccac

SEQ ID NO: 639466 - DNA, 25 bp, Rattus norvegicus
gcccgctcttgccacctacctggag

SEQ ID NO: 639467 - DNA, 25 bp, Rattus norvegicus
gccgcccgctcttgccacctacctg

SEQ ID NO: 639468 - DNA, 25 bp, Rattus norvegicus
catccacacggagacccgccgcccg

SEQ ID NO: 639469 - DNA, 25 bp, Rattus norvegicus
gcccagcgcccagctatccgcatcc

SEQ ID NO: 639470 - DNA, 25 bp, Rattus norvegicus
gcccgagtgcacacggagcccagcg

SEQ ID NO: 639471 - DNA, 25 bp, Rattus norvegicus
gagcccgagtgcacacggagcccag

SEQ ID NO: 639472 - DNA, 25 bp, Rattus norvegicus
acggagcccgagtgcacacggagcc

SEQ ID NO: 639473 - DNA, 25 bp, Rattus norvegicus
tcacggagcccgagtgcacacggag

SEQ ID NO: 639474 - DNA, 25 bp, Rattus norvegicus
actggagagcccgcgtcctcacgga

SEQ ID NO: 639475 - DNA, 25 bp, Rattus norvegicus
ggtcgcgaaccgctagtaggctccg

SEQ ID NO: 639476 - DNA, 25 bp, Rattus norvegicus
ctcacggagcccgagtgcacacgga

SEQ ID NO: 639477 - DNA, 25 bp, Rattus norvegicus
tggcagtttcgatttacccgtgtgc

SEQ ID NO: 639478 - DNA, 25 bp, Rattus norvegicus
cccggcaaggcgtgcagcttctgcg

SEQ ID NO: 639479 - DNA, 25 bp, Rattus norvegicus
caaggcgtgcagcttctgcgggttt

SEQ ID NO: 639480 - DNA, 25 bp, Rattus norvegicus
aggcgtgcagcttctgcgggttttt

SEQ ID NO: 639481 - DNA, 25 bp, Rattus norvegicus
cagcttctgcgggtttttgggagcg

SEQ ID NO: 639482 - DNA, 25 bp, Rattus norvegicus
ttttgggagcggaaagagcatcctt

SEQ ID NO: 639483 - DNA, 25 bp, Rattus norvegicus
tttgggagcggaaagagcatccttg

SEQ ID NO: 639484 - DNA, 25 bp, Rattus norvegicus
agcggaaagagcatccttggcagtt

SEQ ID NO: 639485 - DNA, 25 bp, Rattus norvegicus
gcggaaagagcatccttggcagttt

SEQ ID NO: 639486 - DNA, 25 bp, Rattus norvegicus
atccttggcagtttcgatttacccg

SEQ ID NO: 639487 - DNA, 25 bp, Rattus norvegicus
ccttggcagtttcgatttacccgtg

SEQ ID NO: 639488 - DNA, 25 bp, Rattus norvegicus
ttggcagtttcgatttacccgtgtg

SEQ ID NO: 639489 - DNA, 25 bp, Rattus norvegicus
gcagtttcgatttacccgtgtgccc

SEQ ID NO: 639490 - DNA, 25 bp, Rattus norvegicus
tcgatttacccgtgtgcccctggac

SEQ ID NO: 639491 - DNA, 25 bp, Rattus norvegicus
catggctgccttccattggtcaaga

SEQ ID NO: 639492 - DNA, 25 bp, Rattus norvegicus
aagacggctaaaccgcgcagggata

SEQ ID NO: 639493 - DNA, 25 bp, Rattus norvegicus
cgcagggatacagcagcaccacatt

SEQ ID NO: 639494 - DNA, 25 bp, Rattus norvegicus
ttggctaaagactaagccgggcctc

SEQ ID NO: 639495 - DNA, 25 bp, Rattus norvegicus
ccgggcctcttgtcattggctgaca

SEQ ID NO: 639496 - DNA, 25 bp, Rattus norvegicus
cgccgctgttatctttcgcccagta

SEQ ID NO: 639497 - DNA, 25 bp, Rattus norvegicus
ttcgcccagtagtcttcggccagtc

SEQ ID NO: 639498 - DNA, 25 bp, Rattus norvegicus
cgctcagtaggtttccggcttgtac

SEQ ID NO: 639499 - DNA, 25 bp, Rattus norvegicus
gcttgtactgttgctggttccgaga

SEQ ID NO: 639500 - DNA, 25 bp, Rattus norvegicus
ggcgtgtcttacacctggagctcca

SEQ ID NO: 639501 - DNA, 25 bp, Rattus norvegicus
gctggactctgttggcagtcacctg

SEQ ID NO: 639502 - DNA, 25 bp, Rattus norvegicus
ttgcggcttccgactggacatcgtt

SEQ ID NO: 639503 - DNA, 25 bp, Rattus norvegicus
ccatttgcgcgcgaagcacagttcg

SEQ ID NO: 639504 - DNA, 25 bp, Rattus norvegicus
cacaatcccgtctgcgtgtagaagc

SEQ ID NO: 639505 - DNA, 25 bp, Rattus norvegicus
tacaaagaccgtccgttccacagct

SEQ ID NO: 639506 - DNA, 25 bp, Rattus norvegicus
cgtccgttccacagctcaagactcc

SEQ ID NO: 639507 - DNA, 25 bp, Rattus norvegicus
ccgtccgttccacagctcaagactc

SEQ ID NO: 639508 - DNA, 25 bp, Rattus norvegicus
gaccgtccgttccacagctcaagac

SEQ ID NO: 639509 - DNA, 25 bp, Rattus norvegicus
agaccgtccgttccacagctcaaga

SEQ ID NO: 639510 - DNA, 25 bp, Rattus norvegicus
aaagaccgtccgttccacagctcaa

SEQ ID NO: 639511 - DNA, 25 bp, Rattus norvegicus
gtacaaagaccgtccgttccacagc

SEQ ID NO: 639512 - DNA, 25 bp, Rattus norvegicus
tctacgtcagaaccctacggtacaa

SEQ ID NO: 639513 - DNA, 25 bp, Rattus norvegicus
atctacgtcagaaccctacggtaca

SEQ ID NO: 639514 - DNA, 25 bp, Rattus norvegicus
caatctacgtcagaaccctacggta

SEQ ID NO: 639515 - DNA, 25 bp, Rattus norvegicus
acaatctacgtcagaaccctacggt

SEQ ID NO: 639516 - DNA, 25 bp, Rattus norvegicus
gacaatctacgtcagaaccctacgg

SEQ ID NO: 639517 - DNA, 25 bp, Rattus norvegicus
ggacaatctacgtcagaaccctacg

SEQ ID NO: 639518 - DNA, 25 bp, Rattus norvegicus
aagaccgtccgttccacagctcaag

SEQ ID NO: 639519 - DNA, 25 bp, Rattus norvegicus
cagggtagacgactccaaggtcacg

SEQ ID NO: 639520 - DNA, 25 bp, Rattus norvegicus
acagctcaagactcctcggaaacct

SEQ ID NO: 639521 - DNA, 25 bp, Rattus norvegicus
ttccaacctacccagtcccagtaca

SEQ ID NO: 639522 - DNA, 25 bp, Rattus norvegicus
gtcccagtacacgtctgtcccagta

SEQ ID NO: 639523 - DNA, 25 bp, Rattus norvegicus
cagtacacgtctgtcccagtaaaca

SEQ ID NO: 639524 - DNA, 25 bp, Rattus norvegicus
acacgtctgtcccagtaaacaccga

SEQ ID NO: 639525 - DNA, 25 bp, Rattus norvegicus
gtctgtcccagtaaacaccgacatc

SEQ ID NO: 639526 - DNA, 25 bp, Rattus norvegicus
tcccagtaaacaccgacatcctata

SEQ ID NO: 639527 - DNA, 25 bp, Rattus norvegicus
cgacatcctatactcccaccgcccg

SEQ ID NO: 639528 - DNA, 25 bp, Rattus norvegicus
cgcccgcggcaacagaacgctagag

SEQ ID NO: 639529 - DNA, 25 bp, Rattus norvegicus
ggcaacagaacgctagaggaagaac

SEQ ID NO: 639530 - DNA, 25 bp, Rattus norvegicus
cagaacgctagaggaagaacagggt

SEQ ID NO: 639531 - DNA, 25 bp, Rattus norvegicus
cgccagggtagacgactccaaggtc

SEQ ID NO: 639532 - DNA, 25 bp, Rattus norvegicus
ggtgcgccagggtagacgactccaa

SEQ ID NO: 639533 - DNA, 25 bp, Rattus norvegicus
cacactcttcgttattgagactggg

SEQ ID NO: 639534 - DNA, 25 bp, Rattus norvegicus
gtgcaagggcaactacacactcttc

SEQ ID NO: 639535 - DNA, 25 bp, Rattus norvegicus
ctgcccgcgtgtgcaagggcaacta

SEQ ID NO: 639536 - DNA, 25 bp, Rattus norvegicus
tgctcactcgcagccaggctagaca

SEQ ID NO: 639537 - DNA, 25 bp, Rattus norvegicus
agctcagcgtttgcgaagcgccttg

SEQ ID NO: 639538 - DNA, 25 bp, Rattus norvegicus
ctctagaggacacgccgcgctggct

SEQ ID NO: 639539 - DNA, 25 bp, Rattus norvegicus
tttccgaagactgtcggtgggtgcc

SEQ ID NO: 639540 - DNA, 25 bp, Rattus norvegicus
cggaagttttctcacacggagcttt

SEQ ID NO: 639541 - DNA, 25 bp, Rattus norvegicus
cactaggctcggagtcggaagtttt

SEQ ID NO: 639542 - DNA, 25 bp, Rattus norvegicus
tcggtcgccgctctgacagctctgt

SEQ ID NO: 639543 - DNA, 25 bp, Rattus norvegicus
agccatggcggctatgagcctgctg

SEQ ID NO: 639544 - DNA, 25 bp, Rattus norvegicus
tccttccgtggctgtagtagccatg

SEQ ID NO: 639545 - DNA, 25 bp, Rattus norvegicus
tcggatggccttgtttaagctcagc

SEQ ID NO: 639546 - DNA, 25 bp, Rattus norvegicus
ctgtggaagagctgctgtagaagtc

SEQ ID NO: 639547 - DNA, 25 bp, Rattus norvegicus
ctttggctcccaggcatcaagtgag

SEQ ID NO: 639548 - DNA, 25 bp, Rattus norvegicus
gggcccttcactccgttagcgtgcg

SEQ ID NO: 639549 - DNA, 25 bp, Rattus norvegicus
tctcctacgactctccggtaaggga

SEQ ID NO: 639550 - DNA, 25 bp, Rattus norvegicus
cgtctacaaaaacgagtgcgccttc

SEQ ID NO: 639551 - DNA, 25 bp, Rattus norvegicus
ctaggtcaggggaccgcgtctacaa

SEQ ID NO: 639552 - DNA, 25 bp, Rattus norvegicus
ccacgatccgcgtgcctaggtcagg

SEQ ID NO: 639553 - DNA, 25 bp, Rattus norvegicus
tgctggtgcctcacatgcccacgat

SEQ ID NO: 639554 - DNA, 25 bp, Rattus norvegicus
atcctgggcagttggggattacgtc

SEQ ID NO: 639555 - DNA, 25 bp, Rattus norvegicus
cgggcttcctaggacctgatcctgg

SEQ ID NO: 639556 - DNA, 25 bp, Rattus norvegicus
accgctgttttgtgcgggcttccta

SEQ ID NO: 639557 - DNA, 25 bp, Rattus norvegicus
gtagagctgcgcaccgctgttttgt

SEQ ID NO: 639558 - DNA, 25 bp, Rattus norvegicus
ccgatctacggggaagtagagctgc

SEQ ID NO: 639559 - DNA, 25 bp, Rattus norvegicus
agagcgaggctacacccgaatccca

SEQ ID NO: 639560 - DNA, 25 bp, Rattus norvegicus
gggccagcgactcgccattggatta

SEQ ID NO: 639561 - DNA, 25 bp, Rattus norvegicus
cggagacgcggacactgcggcctct

SEQ ID NO: 639562 - DNA, 25 bp, Rattus norvegicus
cccagtcgccgcgagcaggtcagga

SEQ ID NO: 639563 - DNA, 25 bp, Rattus norvegicus
agtcgccgcgagcaggtcaggaaaa

SEQ ID NO: 639564 - DNA, 25 bp, Rattus norvegicus
ccgcgagcaggtcaggaaaacaaag

SEQ ID NO: 639565 - DNA, 25 bp, Rattus norvegicus
gggactgcgcgctaggagcagccgc

SEQ ID NO: 639566 - DNA, 25 bp, Rattus norvegicus
cgccgcgagcaggtcaggaaaacaa

SEQ ID NO: 639567 - DNA, 25 bp, Rattus norvegicus
agacgcggacactgcggcctctggc

SEQ ID NO: 639568 - DNA, 25 bp, Rattus norvegicus
ttcgtgcccctaactttgcggtggc

SEQ ID NO: 639569 - DNA, 25 bp, Rattus norvegicus
taactttgcggtggcggaggaccaa

SEQ ID NO: 639570 - DNA, 25 bp, Rattus norvegicus
ttgcggtggcggaggaccaaccctc

SEQ ID NO: 639571 - DNA, 25 bp, Rattus norvegicus
gtggcggaggaccaaccctcgcagc

SEQ ID NO: 639572 - DNA, 25 bp, Rattus norvegicus
tcgcagccgggagccggtggcaagg

SEQ ID NO: 639573 - DNA, 25 bp, Rattus norvegicus
ggaaaacaaagctgggactgcgcgc

SEQ ID NO: 639574 - DNA, 25 bp, Rattus norvegicus
tcaggaaaacaaagctgggactgcg

SEQ ID NO: 639575 - DNA, 25 bp, Rattus norvegicus
cgcgctgcggagctgtcctccacgc

SEQ ID NO: 639576 - DNA, 25 bp, Rattus norvegicus
cctcccgcctccgtccggacgccag

SEQ ID NO: 639577 - DNA, 25 bp, Rattus norvegicus
tcgcctttcacgaggctgcagcgtc

SEQ ID NO: 639578 - DNA, 25 bp, Rattus norvegicus
tcctccacgcgggtgctgagcgcgc

SEQ ID NO: 639579 - DNA, 25 bp, Rattus norvegicus
ggttacagaagcaggcgggcgagag

SEQ ID NO: 639580 - DNA, 25 bp, Rattus norvegicus
cgccccggctgtgggttacagaagc

SEQ ID NO: 639581 - DNA, 25 bp, Rattus norvegicus
gctcccgaggccgatgactgctttc

SEQ ID NO: 639582 - DNA, 25 bp, Rattus norvegicus
ctcgccgcgcctctccaactcgccg

SEQ ID NO: 639583 - DNA, 25 bp, Rattus norvegicus
gtcagggctcccgaggccgatgact

SEQ ID NO: 639584 - DNA, 25 bp, Rattus norvegicus
ctcgtagggagttgcaggtcgggca

SEQ ID NO: 639585 - DNA, 25 bp, Rattus norvegicus
ggccgatgactgctttcccgagctg

SEQ ID NO: 639586 - DNA, 25 bp, Rattus norvegicus
gatgactgctttcccgagctggctc

SEQ ID NO: 639587 - DNA, 25 bp, Rattus norvegicus
gactgctttcccgagctggctcgta

SEQ ID NO: 639588 - DNA, 25 bp, Rattus norvegicus
ttcccgagctggctcgtagggagtt

SEQ ID NO: 639589 - DNA, 25 bp, Rattus norvegicus
acttccggagcctgctgggcacgac

SEQ ID NO: 639590 - DNA, 25 bp, Rattus norvegicus
tgagcagcaagacaacccgcacttc

SEQ ID NO: 639591 - DNA, 25 bp, Rattus norvegicus
ccatggaccgcgacttgctgcggca

SEQ ID NO: 639592 - DNA, 25 bp, Rattus norvegicus
cgtcgtgggtagcttccctcagctt

SEQ ID NO: 639593 - DNA, 25 bp, Rattus norvegicus
cgcttccgggaagttagcgcgtcgt

SEQ ID NO: 639594 - DNA, 25 bp, Rattus norvegicus
ctcgcgagactgaggcagctcgtcg

SEQ ID NO: 639595 - DNA, 25 bp, Rattus norvegicus
tgcgagttcccatagtcccgctggg

SEQ ID NO: 639596 - DNA, 25 bp, Rattus norvegicus
accggattcgcgctccctgcgagtt

SEQ ID NO: 639597 - DNA, 25 bp, Rattus norvegicus
tctgccctcagcgtcagaccggatt

SEQ ID NO: 639598 - DNA, 25 bp, Rattus norvegicus
ggcgtgattaatgcaagcgttccca

SEQ ID NO: 639599 - DNA, 25 bp, Rattus norvegicus
gacctgcatgcttgggcgtgattaa

SEQ ID NO: 639600 - DNA, 25 bp, Rattus norvegicus
gagactcgagctctggcccttccaa

SEQ ID NO: 639601 - DNA, 25 bp, Rattus norvegicus
ttgcaccactgaactcggcagcgcg

SEQ ID NO: 639602 - DNA, 25 bp, Rattus norvegicus
ctcgaaagccggaccctggcgggct

SEQ ID NO: 639603 - DNA, 25 bp, Rattus norvegicus
cgaggcccgtgaactgcgtagggac

SEQ ID NO: 639604 - DNA, 25 bp, Rattus norvegicus
ggcaaacgccgagccacagcggcgt

SEQ ID NO: 639605 - DNA, 25 bp, Rattus norvegicus
agcggcgttcccctggttcgtcctg

SEQ ID NO: 639606 - DNA, 25 bp, Rattus norvegicus
ctggttcgtcctgggaaaggctcct

SEQ ID NO: 639607 - DNA, 25 bp, Rattus norvegicus
gctccatgaggggagatttctgaga

SEQ ID NO: 639608 - DNA, 25 bp, Rattus norvegicus
atgaggggagatttctgagagcttc

SEQ ID NO: 639609 - DNA, 25 bp, Rattus norvegicus
gatttctgagagcttcggtcggcca

SEQ ID NO: 639610 - DNA, 25 bp, Rattus norvegicus
ttctgagagcttcggtcggccatgc

SEQ ID NO: 639611 - DNA, 25 bp, Rattus norvegicus
cttcggtcggccatgcgctctagaa

SEQ ID NO: 639612 - DNA, 25 bp, Rattus norvegicus
catgcgctctagaagagcctgagcg

SEQ ID NO: 639613 - DNA, 25 bp, Rattus norvegicus
ggaaggtcctgtagggagcgtcgcc

SEQ ID NO: 639614 - DNA, 25 bp, Rattus norvegicus
ccgcggctcatgacgggaaggtcct

SEQ ID NO: 639615 - DNA, 25 bp, Rattus norvegicus
gtcggccatgcgctctagaagagcc

SEQ ID NO: 639616 - DNA, 25 bp, Rattus norvegicus
ggccatgcgctctagaagagcctga

SEQ ID NO: 639617 - DNA, 25 bp, Rattus norvegicus
gacgtggctgcagtgcgctgccctc

SEQ ID NO: 639618 - DNA, 25 bp, Rattus norvegicus
ggcttccctccctgaggcggtggca

SEQ ID NO: 639619 - DNA, 25 bp, Rattus norvegicus
ccaatttcagcagcctggtggccgc

SEQ ID NO: 639620 - DNA, 25 bp, Rattus norvegicus
gctgagctggagatcttgaaggttc

SEQ ID NO: 639621 - DNA, 25 bp, Rattus norvegicus
acacctgggctggaggcttgcagat

SEQ ID NO: 639622 - DNA, 25 bp, Rattus norvegicus
gctgggctgcgacctctggcgcaca

SEQ ID NO: 639623 - DNA, 25 bp, Rattus norvegicus
ctgtgtacggctgggctgcgacctc

SEQ ID NO: 639624 - DNA, 25 bp, Rattus norvegicus
acactcttatctggagcggcccgaa

SEQ ID NO: 639625 - DNA, 25 bp, Rattus norvegicus
tcggtctgtcttgccggtccgtcct

SEQ ID NO: 639626 - DNA, 25 bp, Rattus norvegicus
cctctagggaagacacttagagccc

SEQ ID NO: 639627 - DNA, 25 bp, Rattus norvegicus
tcccgagtcctctagggaagacact

SEQ ID NO: 639628 - DNA, 25 bp, Rattus norvegicus
cgggccatcccgagtcctctaggga

SEQ ID NO: 639629 - DNA, 25 bp, Rattus norvegicus
ctgaggcggtggcagctcctagcct

SEQ ID NO: 639630 - DNA, 25 bp, Rattus norvegicus
cgcgcttttcgcacactcttatctg

SEQ ID NO: 639631 - DNA, 25 bp, Rattus norvegicus
gtagtggcggactccaaggcctccc

SEQ ID NO: 639632 - DNA, 25 bp, Rattus norvegicus
cccgcggcgtagtggcggactccaa

SEQ ID NO: 639633 - DNA, 25 bp, Rattus norvegicus
aggcgggcagctcactacgacccgg

SEQ ID NO: 639634 - DNA, 25 bp, Rattus norvegicus
acggaggcgggcagctcactacgac

SEQ ID NO: 639635 - DNA, 25 bp, Rattus norvegicus
ttctgccccggagcgtcctgggtcg

SEQ ID NO: 639636 - DNA, 25 bp, Rattus norvegicus
gcgggtgctggcttgccttctgccc

SEQ ID NO: 639637 - DNA, 25 bp, Rattus norvegicus
gggccctgcgaacccatggcgcccg

SEQ ID NO: 639638 - DNA, 25 bp, Rattus norvegicus
aggcctccccggtgttgtgctgctc

SEQ ID NO: 639639 - DNA, 25 bp, Rattus norvegicus
ctccgttatgtttggaaaggaggcg

SEQ ID NO: 639640 - DNA, 25 bp, Rattus norvegicus
caggtgggagggacgcgtttcttca

SEQ ID NO: 639641 - DNA, 25 bp, Rattus norvegicus
gttcaaaggtgaagcgaggccaggc

SEQ ID NO: 639642 - DNA, 25 bp, Rattus norvegicus
tggcgcccgcgtggaaacccggaca

SEQ ID NO: 639643 - DNA, 25 bp, Rattus norvegicus
cgaattctgaaggaagggttcaaag

SEQ ID NO: 639644 - DNA, 25 bp, Rattus norvegicus
aagcgaattctgaaggaagggttca

SEQ ID NO: 639645 - DNA, 25 bp, Rattus norvegicus
aacgatagggccgagccagcactgc

SEQ ID NO: 639646 - DNA, 25 bp, Rattus norvegicus
caccgccacagtacgcttgagtaga

SEQ ID NO: 639647 - DNA, 25 bp, Rattus norvegicus
agcaaaggtctgtctccgcatccgc

SEQ ID NO: 639648 - DNA, 25 bp, Rattus norvegicus
tccgcatccgcccaggccagacagc

SEQ ID NO: 639649 - DNA, 25 bp, Rattus norvegicus
cagacagcgccctttcggagcctgt

SEQ ID NO: 639650 - DNA, 25 bp, Rattus norvegicus
agcgccctttcggagcctgtcagcg

SEQ ID NO: 639651 - DNA, 25 bp, Rattus norvegicus
gcgccgtaaagtgcgtcggaactgt

SEQ ID NO: 639652 - DNA, 25 bp, Rattus norvegicus
tgtcagcgccgaccactcaccatga

SEQ ID NO: 639653 - DNA, 25 bp, Rattus norvegicus
atgactccacttcgcggctcggcac

SEQ ID NO: 639654 - DNA, 25 bp, Rattus norvegicus
tacgcttgagtagaacgatagggcc

SEQ ID NO: 639655 - DNA, 25 bp, Rattus norvegicus
caccgcgggctcatcccagcgcgag

SEQ ID NO: 639656 - DNA, 25 bp, Rattus norvegicus
cagcactgccgccacttccacagcg

SEQ ID NO: 639657 - DNA, 25 bp, Rattus norvegicus
cgcaacacggcaggggcgccgtaaa

SEQ ID NO: 639658 - DNA, 25 bp, Rattus norvegicus
gaggccggagcaaaggtctgtctcc

SEQ ID NO: 639659 - DNA, 25 bp, Rattus norvegicus
agggagtttgtgagcgcagcctaaa

SEQ ID NO: 639660 - DNA, 25 bp, Rattus norvegicus
cccatcctgggaacgctgcgtggga

SEQ ID NO: 639661 - DNA, 25 bp, Rattus norvegicus
aatcagcaggggcaatgcgggctgc

SEQ ID NO: 639662 - DNA, 25 bp, Rattus norvegicus
tgtgccaatcagcaggggcaatgcg

SEQ ID NO: 639663 - DNA, 25 bp, Rattus norvegicus
actgtgccaatcagcaggggcaatg

SEQ ID NO: 639664 - DNA, 25 bp, Rattus norvegicus
ccactgtgccaatcagcaggggcaa

SEQ ID NO: 639665 - DNA, 25 bp, Rattus norvegicus
taccactgtgccaatcagcaggggc

SEQ ID NO: 639666 - DNA, 25 bp, Rattus norvegicus
gactaccactgtgccaatcagcagg

SEQ ID NO: 639667 - DNA, 25 bp, Rattus norvegicus
gcgactaccactgtgccaatcagca

SEQ ID NO: 639668 - DNA, 25 bp, Rattus norvegicus
tcgcgactaccactgtgccaatcag

SEQ ID NO: 639669 - DNA, 25 bp, Rattus norvegicus
ttcgcgactaccactgtgccaatca

SEQ ID NO: 639670 - DNA, 25 bp, Rattus norvegicus
tctcggccgggccttcgcgactacc

SEQ ID NO: 639671 - DNA, 25 bp, Rattus norvegicus
acctgcacctctggaccccgcgcgt

SEQ ID NO: 639672 - DNA, 25 bp, Rattus norvegicus
ggccggccttccctctgcgcacgcc

SEQ ID NO: 639673 - DNA, 25 bp, Rattus norvegicus
taagtacacgcttcccggaggcttg

SEQ ID NO: 639674 - DNA, 25 bp, Rattus norvegicus
cctctttaagactagggctgggaga

SEQ ID NO: 639675 - DNA, 25 bp, Rattus norvegicus
gaccggcggcaaccagaagaacagc

SEQ ID NO: 639676 - DNA, 25 bp, Rattus norvegicus
agagaagtttggagcccgaggctta

SEQ ID NO: 639677 - DNA, 25 bp, Rattus norvegicus
taatcacaacaatcgcggcggcccg

SEQ ID NO: 639678 - DNA, 25 bp, Rattus norvegicus
cgcgcacatgaacggctggagcaac

SEQ ID NO: 639679 - DNA, 25 bp, Rattus norvegicus
gcccagcgcccgcatgtataacatg

SEQ ID NO: 639680 - DNA, 25 bp, Rattus norvegicus
tggaaacttttgtcggagaccgaga

SEQ ID NO: 639681 - DNA, 25 bp, Rattus norvegicus
cggattataaataccggccgcggcg

SEQ ID NO: 639682 - DNA, 25 bp, Rattus norvegicus
ccgcggcggaaaaccaagacgctca

SEQ ID NO: 639683 - DNA, 25 bp, Rattus norvegicus
cgctcatgaagaaggataagtacac

SEQ ID NO: 639684 - DNA, 25 bp, Rattus norvegicus
cgtgaaccagcgcatggacagctac

SEQ ID NO: 639685 - DNA, 25 bp, Rattus norvegicus
tggagcaacggcagctacagcatga

SEQ ID NO: 639686 - DNA, 25 bp, Rattus norvegicus
gagagcgactgttttttcatcccaa

SEQ ID NO: 639687 - DNA, 25 bp, Rattus norvegicus
gtagagaagacgcaggattcacgga

SEQ ID NO: 639688 - DNA, 25 bp, Rattus norvegicus
ctttgctcatcccacaggtactcga

SEQ ID NO: 639689 - DNA, 25 bp, Rattus norvegicus
gaaggatgctgtgggccttgcccac

SEQ ID NO: 639690 - DNA, 25 bp, Rattus norvegicus
tgggccttgcccacgtctggagtct

SEQ ID NO: 639691 - DNA, 25 bp, Rattus norvegicus
ttgcccacgtctggagtctgcctcg

SEQ ID NO: 639692 - DNA, 25 bp, Rattus norvegicus
tctggagtctgcctcgggttgcagc

SEQ ID NO: 639693 - DNA, 25 bp, Rattus norvegicus
tgcctcgggttgcagctggagctat

SEQ ID NO: 639694 - DNA, 25 bp, Rattus norvegicus
ctatggggaaggcagtgagcatccc

SEQ ID NO: 639695 - DNA, 25 bp, Rattus norvegicus
gccacgcgcagcgttctcgagtgca

SEQ ID NO: 639696 - DNA, 25 bp, Rattus norvegicus
cagcgttctcgagtgcacctgcatc

SEQ ID NO: 639697 - DNA, 25 bp, Rattus norvegicus
gttctcgagtgcacctgcatcccgg

SEQ ID NO: 639698 - DNA, 25 bp, Rattus norvegicus
ggcctctttgctcatcccacaggta

SEQ ID NO: 639699 - DNA, 25 bp, Rattus norvegicus
tttgagtagagaagacgcaggattc

SEQ ID NO: 639700 - DNA, 25 bp, Rattus norvegicus
gctcatcccacaggtactcgaggcg

SEQ ID NO: 639701 - DNA, 25 bp, Rattus norvegicus
cacgtgctgcgccttcgaaaggtga

SEQ ID NO: 639702 - DNA, 25 bp, Rattus norvegicus
gactgcgcagccttcctccaagagg

SEQ ID NO: 639703 - DNA, 25 bp, Rattus norvegicus
cagccgttagaagtaccatttttgc

SEQ ID NO: 639704 - DNA, 25 bp, Rattus norvegicus
ggccttacactaaagcctggctttg

SEQ ID NO: 639705 - DNA, 25 bp, Rattus norvegicus
ttgaggacctagatacagtgctgta

SEQ ID NO: 639706 - DNA, 25 bp, Rattus norvegicus
ccgcgcgctcacgattttatttaga

SEQ ID NO: 639707 - DNA, 25 bp, Rattus norvegicus
ggcaccacctcgtcttttgttaata

SEQ ID NO: 639708 - DNA, 25 bp, Rattus norvegicus
gttaatatctcaacctcgggctctg

SEQ ID NO: 639709 - DNA, 25 bp, Rattus norvegicus
tgacgctaagcaggcctccaccttg

SEQ ID NO: 639710 - DNA, 25 bp, Rattus norvegicus
tgccaatttttgtctcacccgagcc

SEQ ID NO: 639711 - DNA, 25 bp, Rattus norvegicus
acaatgcaatctcgcgctgggagta

SEQ ID NO: 639712 - DNA, 25 bp, Rattus norvegicus
cacccagggccattgcagaagaacc

SEQ ID NO: 639713 - DNA, 25 bp, Rattus norvegicus
tcagcgctgagtggagagaattatc

SEQ ID NO: 639714 - DNA, 25 bp, Rattus norvegicus
ccagagactcgggaacattcttttc

SEQ ID NO: 639715 - DNA, 25 bp, Rattus norvegicus
gaagctcaccctgggcctaggagga

SEQ ID NO: 639716 - DNA, 25 bp, Rattus norvegicus
gcgccggaaaggtcctcaccgcaga

SEQ ID NO: 639717 - DNA, 25 bp, Rattus norvegicus
tgcttcgggtgacaacggtcagaga

SEQ ID NO: 639718 - DNA, 25 bp, Rattus norvegicus
ttctgggcctcccagcggaagctca

SEQ ID NO: 639719 - DNA, 25 bp, Rattus norvegicus
ctccggaggaggtctgggtccttct

SEQ ID NO: 639720 - DNA, 25 bp, Rattus norvegicus
cccggactccgaactaggctcgtgg

SEQ ID NO: 639721 - DNA, 25 bp, Rattus norvegicus
cctgatccgcacagcgcggggatgt

SEQ ID NO: 639722 - DNA, 25 bp, Rattus norvegicus
cagcggcagagagcggaacttaagt

SEQ ID NO: 639723 - DNA, 25 bp, Rattus norvegicus
gccaggctgcgcctgtaggacctcg

SEQ ID NO: 639724 - DNA, 25 bp, Rattus norvegicus
acaacggtcagagatgaaggtggcc

SEQ ID NO: 639725 - DNA, 25 bp, Rattus norvegicus
cgtgacagcgctcacgctttcgtga

SEQ ID NO: 639726 - DNA, 25 bp, Rattus norvegicus
gctttcgtgacacaccgcccggaaa

SEQ ID NO: 639727 - DNA, 25 bp, Rattus norvegicus
caagccctcccggacacatggaagg

SEQ ID NO: 639728 - DNA, 25 bp, Rattus norvegicus
agagttagcgtagctggctggtcca

SEQ ID NO: 639729 - DNA, 25 bp, Rattus norvegicus
ggggctccgccactgaaaatacagc

SEQ ID NO: 639730 - DNA, 25 bp, Rattus norvegicus
gacgtcagctccctgtctccctcta

SEQ ID NO: 639731 - DNA, 25 bp, Rattus norvegicus
gtccattgacgtcagctccctgtct

SEQ ID NO: 639732 - DNA, 25 bp, Rattus norvegicus
aggtcacgtccattgacgtcagctc

SEQ ID NO: 639733 - DNA, 25 bp, Rattus norvegicus
gtttagctgcgaggtcacgtccatt

SEQ ID NO: 639734 - DNA, 25 bp, Rattus norvegicus
ttcacgttcaaggtttagctgcgag

SEQ ID NO: 639735 - DNA, 25 bp, Rattus norvegicus
ccggcttcacgttcaaggtttagct

SEQ ID NO: 639736 - DNA, 25 bp, Rattus norvegicus
ccatcccggcttcacgttcaaggtt

SEQ ID NO: 639737 - DNA, 25 bp, Rattus norvegicus
caccggctgccgctccgtgttttcc

SEQ ID NO: 639738 - DNA, 25 bp, Rattus norvegicus
gggcagaaaccaggcagccgctcgt

SEQ ID NO: 639739 - DNA, 25 bp, Rattus norvegicus
gccactgaaaatacagccacacagg

SEQ ID NO: 639740 - DNA, 25 bp, Rattus norvegicus
ctggggctccgccactgaaaataca

SEQ ID NO: 639741 - DNA, 25 bp, Rattus norvegicus
actgccgcggggcagaaaccaggca

SEQ ID NO: 639742 - DNA, 25 bp, Rattus norvegicus
tacagccacacaggctttcgggctc

SEQ ID NO: 639743 - DNA, 25 bp, Rattus norvegicus
tcctaatagctccacgtcagagttc

SEQ ID NO: 639744 - DNA, 25 bp, Rattus norvegicus
atgttggtgtcctccggacctctcc

SEQ ID NO: 639745 - DNA, 25 bp, Rattus norvegicus
tcggaaggcagcaggtctcgggtcc

SEQ ID NO: 639746 - DNA, 25 bp, Rattus norvegicus
cggggaccgagcctcagccaagccg

SEQ ID NO: 639747 - DNA, 25 bp, Rattus norvegicus
cagggccgccagcacccaggggccc

SEQ ID NO: 639748 - DNA, 25 bp, Rattus norvegicus
gcgccgcggtgcctcaccatgttgg

SEQ ID NO: 639749 - DNA, 25 bp, Rattus norvegicus
tcaccatgttggtgtcctccggacc

SEQ ID NO: 639750 - DNA, 25 bp, Rattus norvegicus
ctccggctccgcagcgaatggacgg

SEQ ID NO: 639751 - DNA, 25 bp, Rattus norvegicus
ccgggctcccgctcatgcgcagtgc

SEQ ID NO: 639752 - DNA, 25 bp, Rattus norvegicus
tgcggacacgcgctgagacctgcgc

SEQ ID NO: 639753 - DNA, 25 bp, Rattus norvegicus
actccgggcgccctcgtcacggccg

SEQ ID NO: 639754 - DNA, 25 bp, Rattus norvegicus
gtgcgctcctaatagctccacgtca

SEQ ID NO: 639755 - DNA, 25 bp, Rattus norvegicus
taatagctccacgtcagagttcccg

SEQ ID NO: 639756 - DNA, 25 bp, Rattus norvegicus
gcgtcccgtcctccgtgcgctccta

SEQ ID NO: 639757 - DNA, 25 bp, Rattus norvegicus
gtccaccgcagccaacagagccgcc

SEQ ID NO: 639758 - DNA, 25 bp, Rattus norvegicus
cgcatagatcggcaatctgtacaca

SEQ ID NO: 639759 - DNA, 25 bp, Rattus norvegicus
cttgttggccgccaaaaactgcttg

SEQ ID NO: 639760 - DNA, 25 bp, Rattus norvegicus
cctccaaagagcaagtgggcgtctc

SEQ ID NO: 639761 - DNA, 25 bp, Rattus norvegicus
tgcgcaagcctcttgttccctgtcg

SEQ ID NO: 639762 - DNA, 25 bp, Rattus norvegicus
tgaaagcgttcctccctgcgcaagc

SEQ ID NO: 639763 - DNA, 25 bp, Rattus norvegicus
tggctaactcgtgaaagcgttcctc

SEQ ID NO: 639764 - DNA, 25 bp, Rattus norvegicus
caaaaactgcttggctaactcgtga

SEQ ID NO: 639765 - DNA, 25 bp, Rattus norvegicus
cgcactgccttgttggccgccaaaa

SEQ ID NO: 639766 - DNA, 25 bp, Rattus norvegicus
ccgcaactggttcctgtccaccgca

SEQ ID NO: 639767 - DNA, 25 bp, Rattus norvegicus
agcaggatcgggacccgccgcaact

SEQ ID NO: 639768 - DNA, 25 bp, Rattus norvegicus
ctgcagcagcaggatcgggacccgc

SEQ ID NO: 639769 - DNA, 25 bp, Rattus norvegicus
cccacgagtcacctcggctgcagca

SEQ ID NO: 639770 - DNA, 25 bp, Rattus norvegicus
ggcaatctgtacacaggcccgttgc

SEQ ID NO: 639771 - DNA, 25 bp, Rattus norvegicus
accgcccacagcttcttattggctg

SEQ ID NO: 639772 - DNA, 25 bp, Rattus norvegicus
ccgtgcaccagctcttgggtgctca

SEQ ID NO: 639773 - DNA, 25 bp, Rattus norvegicus
gtgtgctccggctccatctaatcca

SEQ ID NO: 639774 - DNA, 25 bp, Rattus norvegicus
ggaggcacaagcaccgttacaggca

SEQ ID NO: 639775 - DNA, 25 bp, Rattus norvegicus
taaccaatgaggttccggggatctc

SEQ ID NO: 639776 - DNA, 25 bp, Rattus norvegicus
gggatctcatctctcagaggccttg

SEQ ID NO: 639777 - DNA, 25 bp, Rattus norvegicus
agaggccttggagagcttagcaacc

SEQ ID NO: 639778 - DNA, 25 bp, Rattus norvegicus
ccgcttgaggtagtggctgagtcac

SEQ ID NO: 639779 - DNA, 25 bp, Rattus norvegicus
gcctggcctctagctgtaccagtga

SEQ ID NO: 639780 - DNA, 25 bp, Rattus norvegicus
gtaccagtgagacaccaaggtcttg

SEQ ID NO: 639781 - DNA, 25 bp, Rattus norvegicus
cctagaggctgcgtttctttggccg

SEQ ID NO: 639782 - DNA, 25 bp, Rattus norvegicus
caggcctaggcttctggttcgaaga

SEQ ID NO: 639783 - DNA, 25 bp, Rattus norvegicus
gtcctcaagactcaccaggctttcg

SEQ ID NO: 639784 - DNA, 25 bp, Rattus norvegicus
tgctcaccggaaatgtccctgcata

SEQ ID NO: 639785 - DNA, 25 bp, Rattus norvegicus
agtctgaagtcaagaatagcaagca

SEQ ID NO: 639786 - DNA, 25 bp, Rattus norvegicus
cttcccgcgtgctgagggtcttcac

SEQ ID NO: 639787 - DNA, 25 bp, Rattus norvegicus
ggtcttcacggagaggcgccgcaca

SEQ ID NO: 639788 - DNA, 25 bp, Rattus norvegicus
agcaagcatgtctggctatgtactg

SEQ ID NO: 639789 - DNA, 25 bp, Rattus norvegicus
ttccagtgacttgaagtctgaagtc

SEQ ID NO: 639790 - DNA, 25 bp, Rattus norvegicus
cggcggtgcttccagtgacttgaag

SEQ ID NO: 639791 - DNA, 25 bp, Rattus norvegicus
acgcgggtgatttgcgtcattagga

SEQ ID NO: 639792 - DNA, 25 bp, Rattus norvegicus
gtacccggctggctgaggactcctg

SEQ ID NO: 639793 - DNA, 25 bp, Rattus norvegicus
agctagcttccggttgcggagctcc

SEQ ID NO: 639794 - DNA, 25 bp, Rattus norvegicus
tcatcaggaagtgcgagctagcttc

SEQ ID NO: 639795 - DNA, 25 bp, Rattus norvegicus
gaggcgccgcacattgcacaccagt

SEQ ID NO: 639796 - DNA, 25 bp, Rattus norvegicus
gcagcaggccgtgcgtcatcaggaa

SEQ ID NO: 639797 - DNA, 25 bp, Rattus norvegicus
tggctatgtactgttctcgcgtggg

SEQ ID NO: 639798 - DNA, 25 bp, Rattus norvegicus
gcacaccagtctgcagagctgctcg

SEQ ID NO: 639799 - DNA, 25 bp, Rattus norvegicus
ccataatggtgagtatgcgtggtgc

SEQ ID NO: 639800 - DNA, 25 bp, Rattus norvegicus
aggctgtcgcttggccctgtggcat

SEQ ID NO: 639801 - DNA, 25 bp, Rattus norvegicus
tggccctgtggcatccgtttgccct

SEQ ID NO: 639802 - DNA, 25 bp, Rattus norvegicus
catccgtttgccctgcgtctggcgg

SEQ ID NO: 639803 - DNA, 25 bp, Rattus norvegicus
atccactggaggacgcggacgccgc

SEQ ID NO: 639804 - DNA, 25 bp, Rattus norvegicus
cgcggtagtcaagccataatggtga

SEQ ID NO: 639805 - DNA, 25 bp, Rattus norvegicus
tgtggcatccgtttgccctgcgtct

SEQ ID NO: 639806 - DNA, 25 bp, Rattus norvegicus
aggacagagggcattgcagatgtct

SEQ ID NO: 639807 - DNA, 25 bp, Rattus norvegicus
cattgcagatgtctgctggtgtgtg

SEQ ID NO: 639808 - DNA, 25 bp, Rattus norvegicus
cgggatcggccagcttgaggttccc

SEQ ID NO: 639809 - DNA, 25 bp, Rattus norvegicus
tgggccgtgtgtcaccgcgcagcct

SEQ ID NO: 639810 - DNA, 25 bp, Rattus norvegicus
tcaccgcgcagcctgtgctggagac

SEQ ID NO: 639811 - DNA, 25 bp, Rattus norvegicus
acgccgcggtagtcaagccataatg

SEQ ID NO: 639812 - DNA, 25 bp, Rattus norvegicus
tgccgggccatccactggaggacgc

SEQ ID NO: 639813 - DNA, 25 bp, Rattus norvegicus
ctgcacacagagtccgtagccgcga

SEQ ID NO: 639814 - DNA, 25 bp, Rattus norvegicus
tttcaggcctggaaacggtttgtgc

SEQ ID NO: 639815 - DNA, 25 bp, Rattus norvegicus
tgctagctcgctcccagttcagagg

SEQ ID NO: 639816 - DNA, 25 bp, Rattus norvegicus
cctcattgactatgctgcgtcgctc

SEQ ID NO: 639817 - DNA, 25 bp, Rattus norvegicus
tttgtgccagacaccagcgaggacc

SEQ ID NO: 639818 - DNA, 25 bp, Rattus norvegicus
caatcttgtttgcaggcggtgggaa

SEQ ID NO: 639819 - DNA, 25 bp, Rattus norvegicus
ccagcgtgctttactacgatcggtc

SEQ ID NO: 639820 - DNA, 25 bp, Rattus norvegicus
gattacctcaggagccgcgacccga

SEQ ID NO: 639821 - DNA, 25 bp, Rattus norvegicus
ccagcgttgactgcgtcgaagttcc

SEQ ID NO: 639822 - DNA, 25 bp, Rattus norvegicus
cacaggccttgactaccagcgttga

SEQ ID NO: 639823 - DNA, 25 bp, Rattus norvegicus
ccgtctgtcaaaacgcgaggccctg

SEQ ID NO: 639824 - DNA, 25 bp, Rattus norvegicus
acgaggcgtactccaaaatggcggc

SEQ ID NO: 639825 - DNA, 25 bp, Rattus norvegicus
agaaatgaatgaccgcgcctcggcg

SEQ ID NO: 639826 - DNA, 25 bp, Rattus norvegicus
gatcggtctagccttgtcacgtgaa

SEQ ID NO: 639827 - DNA, 25 bp, Rattus norvegicus
ggcttccaccacttcctggggctgc

SEQ ID NO: 639828 - DNA, 25 bp, Rattus norvegicus
gcactgtctccgacctctgccacca

SEQ ID NO: 639829 - DNA, 25 bp, Rattus norvegicus
ggcgcgctatgactgcttcctcatg

SEQ ID NO: 639830 - DNA, 25 bp, Rattus norvegicus
tatgactgcttcctcatgcgcaacg

SEQ ID NO: 639831 - DNA, 25 bp, Rattus norvegicus
cctggcagcagtggccgttgccatt

SEQ ID NO: 639832 - DNA, 25 bp, Rattus norvegicus
ctttgaagcagggtcgtatgtggta

SEQ ID NO: 639833 - DNA, 25 bp, Rattus norvegicus
ttgccattgcagcactggcctgggg

SEQ ID NO: 639834 - DNA, 25 bp, Rattus norvegicus
tgcgcaacgccaccgtcacccagca

SEQ ID NO: 639835 - DNA, 25 bp, Rattus norvegicus
gcagctcgaccatgtcacacctctg

SEQ ID NO: 639836 - DNA, 25 bp, Rattus norvegicus
ctgccgctcggcatgatgggagact

SEQ ID NO: 639837 - DNA, 25 bp, Rattus norvegicus
ggctccttgggcagctattgccctg

SEQ ID NO: 639838 - DNA, 25 bp, Rattus norvegicus
cagctattgccctgggtgcagtggc

SEQ ID NO: 639839 - DNA, 25 bp, Rattus norvegicus
cggccatctttgaagcagggtcgta

SEQ ID NO: 639840 - DNA, 25 bp, Rattus norvegicus
cctgctgggctccttgggcagctat

SEQ ID NO: 639841 - DNA, 25 bp, Rattus norvegicus
ggtcgaggagcacgaccctccgctg

SEQ ID NO: 639842 - DNA, 25 bp, Rattus norvegicus
cagccgtgtgcccatgcgtgggcaa

SEQ ID NO: 639843 - DNA, 25 bp, Rattus norvegicus
ggcaaggtcgaggagcacgaccctc

SEQ ID NO: 639844 - DNA, 25 bp, Rattus norvegicus
cgctgctcttcgagctgacctcgga

SEQ ID NO: 639845 - DNA, 25 bp, Rattus norvegicus
tcttcgagctgacctcggaccctgg

SEQ ID NO: 639846 - DNA, 25 bp, Rattus norvegicus
agctgacctcggaccctggcgaggt

SEQ ID NO: 639847 - DNA, 25 bp, Rattus norvegicus
cgcgcacccgccaagatgtcggagg

SEQ ID NO: 639848 - DNA, 25 bp, Rattus norvegicus
ggcaggagtatgacatgctgcgccc

SEQ ID NO: 639849 - DNA, 25 bp, Rattus norvegicus
ccaagatgtcggaggcgccgaactt

SEQ ID NO: 639850 - DNA, 25 bp, Rattus norvegicus
cgccgaacttgacggcggccataac

SEQ ID NO: 639851 - DNA, 25 bp, Rattus norvegicus
tgacggcggccataacgtcagaggc

SEQ ID NO: 639852 - DNA, 25 bp, Rattus norvegicus
cggcggccataacgtcagaggcagt

SEQ ID NO: 639853 - DNA, 25 bp, Rattus norvegicus
gtgacggcagccatggcaacggcgg

SEQ ID NO: 639854 - DNA, 25 bp, Rattus norvegicus
cccgccaagatgtcggaggcgccga

SEQ ID NO: 639855 - DNA, 25 bp, Rattus norvegicus
tgaccagagagttgccgaagagcgc

SEQ ID NO: 639856 - DNA, 25 bp, Rattus norvegicus
tcagcagccgggagaactgctccgc

SEQ ID NO: 639857 - DNA, 25 bp, Rattus norvegicus
ggcaaaaatgagtgctcctgccagc

SEQ ID NO: 639858 - DNA, 25 bp, Rattus norvegicus
tcctgccagcgcaaaggccacttta

SEQ ID NO: 639859 - DNA, 25 bp, Rattus norvegicus
caaaggccactttagcacgcgcggg

SEQ ID NO: 639860 - DNA, 25 bp, Rattus norvegicus
gccactttagcacgcgcgggcagct

SEQ ID NO: 639861 - DNA, 25 bp, Rattus norvegicus
cagctccggagtgtagaccagcggt

SEQ ID NO: 639862 - DNA, 25 bp, Rattus norvegicus
tcccgagtcaggttgtgcgcgctca

SEQ ID NO: 639863 - DNA, 25 bp, Rattus norvegicus
gcccatagcgatgaatgaactgctc

SEQ ID NO: 639864 - DNA, 25 bp, Rattus norvegicus
tgaactgctcccgagtcaggttgtg

SEQ ID NO: 639865 - DNA, 25 bp, Rattus norvegicus
cttgctgcgggtcaccacatagatg

SEQ ID NO: 639866 - DNA, 25 bp, Rattus norvegicus
ccacatagatgaccagagagttgcc

SEQ ID NO: 639867 - DNA, 25 bp, Rattus norvegicus
gaccagcggtctcagcccatagcga

SEQ ID NO: 639868 - DNA, 25 bp, Rattus norvegicus
agcgccagggcaaaaatgagtgctc

SEQ ID NO: 639869 - DNA, 25 bp, Rattus norvegicus
tctccaggctcttgcgcctgcgtgg

SEQ ID NO: 639870 - DNA, 25 bp, Rattus norvegicus
aggacacatcctgccacgtcctagt

SEQ ID NO: 639871 - DNA, 25 bp, Rattus norvegicus
ctattaggacacatcctgccacgtc

SEQ ID NO: 639872 - DNA, 25 bp, Rattus norvegicus
ccatgaacacgtccctaacttaagt

SEQ ID NO: 639873 - DNA, 25 bp, Rattus norvegicus
tgactaggtcctcaaacaggccacg

SEQ ID NO: 639874 - DNA, 25 bp, Rattus norvegicus
cccttagctaccaaactttcgctga

SEQ ID NO: 639875 - DNA, 25 bp, Rattus norvegicus
cacgctcaatctccgctgtgctgga

SEQ ID NO: 639876 - DNA, 25 bp, Rattus norvegicus
ccggcacccgccacacccttagcta

SEQ ID NO: 639877 - DNA, 25 bp, Rattus norvegicus
gtactctccgtgcaacggaaacgcc

SEQ ID NO: 639878 - DNA, 25 bp, Rattus norvegicus
caggcagtactctccgtgcaacgga

SEQ ID NO: 639879 - DNA, 25 bp, Rattus norvegicus
acacgccgagagacaggcagtactc

SEQ ID NO: 639880 - DNA, 25 bp, Rattus norvegicus
ggacagatgcacacgccgagagaca

SEQ ID NO: 639881 - DNA, 25 bp, Rattus norvegicus
actttcgctgagtgactaggtcctc

SEQ ID NO: 639882 - DNA, 25 bp, Rattus norvegicus
ggcgcggctgttccacgctcaatct

SEQ ID NO: 639883 - DNA, 25 bp, Rattus norvegicus
ctctcttggaatcaggcttactcta

SEQ ID NO: 639884 - DNA, 25 bp, Rattus norvegicus
gccaccgagttcttcagctgcttga

SEQ ID NO: 639885 - DNA, 25 bp, Rattus norvegicus
agcgctaagtagagcagcagattca

SEQ ID NO: 639886 - DNA, 25 bp, Rattus norvegicus
gattcagcttccactccatgctggg

SEQ ID NO: 639887 - DNA, 25 bp, Rattus norvegicus
ggtgcacgctgtttcgcctggaaag

SEQ ID NO: 639888 - DNA, 25 bp, Rattus norvegicus
acactgcttgctcgttattgaaacc

SEQ ID NO: 639889 - DNA, 25 bp, Rattus norvegicus
gcgcgtctccgctctcttggaatca

SEQ ID NO: 639890 - DNA, 25 bp, Rattus norvegicus
tactctagaagaactcggatccggg

SEQ ID NO: 639891 - DNA, 25 bp, Rattus norvegicus
tcggatccgggactagactccggtc

SEQ ID NO: 639892 - DNA, 25 bp, Rattus norvegicus
ccctgcactgtagcgggtccagaga

SEQ ID NO: 639893 - DNA, 25 bp, Rattus norvegicus
ctagaggggtggtatacctgaatcc

SEQ ID NO: 639894 - DNA, 25 bp, Rattus norvegicus
cctgaatccctttggagctgagacc

SEQ ID NO: 639895 - DNA, 25 bp, Rattus norvegicus
tcccggctgtattggccaccgagtt

SEQ ID NO: 639896 - DNA, 25 bp, Rattus norvegicus
cggttctcagctccgctgttgtcca

SEQ ID NO: 639897 - DNA, 25 bp, Rattus norvegicus
aaggtggctatccaccgccttcacg

SEQ ID NO: 639898 - DNA, 25 bp, Rattus norvegicus
taccgccctagccagagcggctgcg

SEQ ID NO: 639899 - DNA, 25 bp, Rattus norvegicus
caccctggcgctctaccgccctagc

SEQ ID NO: 639900 - DNA, 25 bp, Rattus norvegicus
cccgcagggcatcctcaccctctca

SEQ ID NO: 639901 - DNA, 25 bp, Rattus norvegicus
tgtcagagtagtgcggaagcccgca

SEQ ID NO: 639902 - DNA, 25 bp, Rattus norvegicus
caccggagcctagccattctgtttg

SEQ ID NO: 639903 - DNA, 25 bp, Rattus norvegicus
tgcacgggcaaggtggctatccacc

SEQ ID NO: 639904 - DNA, 25 bp, Rattus norvegicus
agacagcctccgtgcacgggcaagg

SEQ ID NO: 639905 - DNA, 25 bp, Rattus norvegicus
gtccatccagccctcgaggccgctt

SEQ ID NO: 639906 - DNA, 25 bp, Rattus norvegicus
agggcttccacccagtccatccagc

SEQ ID NO: 639907 - DNA, 25 bp, Rattus norvegicus
tacaaaagctagagccgtaggaccc

SEQ ID NO: 639908 - DNA, 25 bp, Rattus norvegicus
gggcggtacaaaagctagagccgta

SEQ ID NO: 639909 - DNA, 25 bp, Rattus norvegicus
gcgtcagctccggactggcctaggc

SEQ ID NO: 639910 - DNA, 25 bp, Rattus norvegicus
agccattctgtttggtgtcagagta

SEQ ID NO: 639911 - DNA, 25 bp, Rattus norvegicus
gccactatgaaggaaacgccgcttt

SEQ ID NO: 639912 - DNA, 25 bp, Rattus norvegicus
tgccgcgatcaacccgggaaattct

SEQ ID NO: 639913 - DNA, 25 bp, Rattus norvegicus
gaaattctcctagattagctaccgc

SEQ ID NO: 639914 - DNA, 25 bp, Rattus norvegicus
ctcctagattagctaccgcagctga

SEQ ID NO: 639915 - DNA, 25 bp, Rattus norvegicus
ccgggatgatgacgtcggttttccg

SEQ ID NO: 639916 - DNA, 25 bp, Rattus norvegicus
gaaacgccgctttccaactgcgagc

SEQ ID NO: 639917 - DNA, 25 bp, Rattus norvegicus
tgacgtcggttttccgcgccgtgaa

SEQ ID NO: 639918 - DNA, 25 bp, Rattus norvegicus
gccgcttcctgctccgtgcaattga

SEQ ID NO: 639919 - DNA, 25 bp, Rattus norvegicus
gatttgtctcggtgcggttcttcct

SEQ ID NO: 639920 - DNA, 25 bp, Rattus norvegicus
tggctttgggagtagactcgggtta

SEQ ID NO: 639921 - DNA, 25 bp, Rattus norvegicus
tgcgtgtcccgccactatgaaggaa

SEQ ID NO: 639922 - DNA, 25 bp, Rattus norvegicus
agaagccggtgtgtggatttgtctc

SEQ ID NO: 639923 - DNA, 25 bp, Rattus norvegicus
tccgtgcaattgaggagaagaaggt

SEQ ID NO: 639924 - DNA, 25 bp, Rattus norvegicus
taccgcagctgacccgatctctagt

SEQ ID NO: 639925 - DNA, 25 bp, Rattus norvegicus
ccactgggacatctttgacgtcaca

SEQ ID NO: 639926 - DNA, 25 bp, Rattus norvegicus
acgaaggttcctttcagcttggtgg

SEQ ID NO: 639927 - DNA, 25 bp, Rattus norvegicus
tgccgagcacccaaatgcagacgca

SEQ ID NO: 639928 - DNA, 25 bp, Rattus norvegicus
atgcagacgcagacactctggagaa

SEQ ID NO: 639929 - DNA, 25 bp, Rattus norvegicus
ctggagaagcatcaagcggagaacc

SEQ ID NO: 639930 - DNA, 25 bp, Rattus norvegicus
cgcagagcggtgactcagcctagat

SEQ ID NO: 639931 - DNA, 25 bp, Rattus norvegicus
tccgactgtcccactgagctcagga

SEQ ID NO: 639932 - DNA, 25 bp, Rattus norvegicus
tcagtaacagtctccagtcacggcc

SEQ ID NO: 639933 - DNA, 25 bp, Rattus norvegicus
gctctagactgcttactgcccgggc

SEQ ID NO: 639934 - DNA, 25 bp, Rattus norvegicus
cggcaccttggctctagactgctta

SEQ ID NO: 639935 - DNA, 25 bp, Rattus norvegicus
catcactctcaactgcgggcgacgg

SEQ ID NO: 639936 - DNA, 25 bp, Rattus norvegicus
gacaggtaaggacccacggtcagtc

SEQ ID NO: 639937 - DNA, 25 bp, Rattus norvegicus
gggacctgagaagcagcatcactct

SEQ ID NO: 639938 - DNA, 25 bp, Rattus norvegicus
tcacaggactctgacgtcacggtcg

SEQ ID NO: 639939 - DNA, 25 bp, Rattus norvegicus
ttttacccgccgagtcttgagcctc

SEQ ID NO: 639940 - DNA, 25 bp, Rattus norvegicus
ccgcgactattgaaatggaccaatg

SEQ ID NO: 639941 - DNA, 25 bp, Rattus norvegicus
ttgtagttcaagtagcccgcgacta

SEQ ID NO: 639942 - DNA, 25 bp, Rattus norvegicus
ccgccggctgttcttgtagttcaag

SEQ ID NO: 639943 - DNA, 25 bp, Rattus norvegicus
ctgtctcgagttgcccggcattgcg

SEQ ID NO: 639944 - DNA, 25 bp, Rattus norvegicus
tggcgccactttttcggggttgaca

SEQ ID NO: 639945 - DNA, 25 bp, Rattus norvegicus
tggccctctgggctggtaaacccaa

SEQ ID NO: 639946 - DNA, 25 bp, Rattus norvegicus
gctcagcatgctttttggccctctg

SEQ ID NO: 639947 - DNA, 25 bp, Rattus norvegicus
gaccgcaaaggctgcagcccgacta

SEQ ID NO: 639948 - DNA, 25 bp, Rattus norvegicus
gctcgtggggctatttggtactaaa

SEQ ID NO: 639949 - DNA, 25 bp, Rattus norvegicus
ctgaagggcagtatacacgggtccg

SEQ ID NO: 639950 - DNA, 25 bp, Rattus norvegicus
aggaagaccgctccactagtgctga

SEQ ID NO: 639951 - DNA, 25 bp, Rattus norvegicus
cggggcactgcttggtatgacccta

SEQ ID NO: 639952 - DNA, 25 bp, Rattus norvegicus
cggggttgacattctcctggtcttc

SEQ ID NO: 639953 - DNA, 25 bp, Rattus norvegicus
aagctaggcggagggaacagtccac

SEQ ID NO: 639954 - DNA, 25 bp, Rattus norvegicus
gcaactccggttccacacgtgatca

SEQ ID NO: 639955 - DNA, 25 bp, Rattus norvegicus
ttccacacgtgatcagtcttcgctc

SEQ ID NO: 639956 - DNA, 25 bp, Rattus norvegicus
ccacaggctacagccggtttccagg

SEQ ID NO: 639957 - DNA, 25 bp, Rattus norvegicus
agggaacagtccacaggctacagcc

SEQ ID NO: 639958 - DNA, 25 bp, Rattus norvegicus
tcagtcttcgctccaccgtgaagtc

SEQ ID NO: 639959 - DNA, 25 bp, Rattus norvegicus
gcagcggcgctcagcaactccggtt

SEQ ID NO: 639960 - DNA, 25 bp, Rattus norvegicus
gacctaggactaggcgctagtgttg

SEQ ID NO: 639961 - DNA, 25 bp, Rattus norvegicus
ggagagcccaccactagacctagga

SEQ ID NO: 639962 - DNA, 25 bp, Rattus norvegicus
gccggacccgcttgctaaagaggaa

SEQ ID NO: 639963 - DNA, 25 bp, Rattus norvegicus
cgtcagatccatggcgaccgcaagg

SEQ ID NO: 639964 - DNA, 25 bp, Rattus norvegicus
tgctcggcttaacgtcagatccatg

SEQ ID NO: 639965 - DNA, 25 bp, Rattus norvegicus
cctggagatagtctgctcggcttaa

SEQ ID NO: 639966 - DNA, 25 bp, Rattus norvegicus
cgccgaccggtttacctggagatag

SEQ ID NO: 639967 - DNA, 25 bp, Rattus norvegicus
gcatcaccgatacgcgccaggttct

SEQ ID NO: 639968 - DNA, 25 bp, Rattus norvegicus
atagcctttgctgatggcgagcagc

SEQ ID NO: 639969 - DNA, 25 bp, Rattus norvegicus
tcgatgcgtgcacccttgagtagca

SEQ ID NO: 639970 - DNA, 25 bp, Rattus norvegicus
aggtgcaccacctcgtatttatggc

SEQ ID NO: 639971 - DNA, 25 bp, Rattus norvegicus
atcgcgcagttcttgctcgcaaggg

SEQ ID NO: 639972 - DNA, 25 bp, Rattus norvegicus
gtggcctaggatggcctccacgatg

SEQ ID NO: 639973 - DNA, 25 bp, Rattus norvegicus
ttcttcagcagcagctcggtcacct

SEQ ID NO: 639974 - DNA, 25 bp, Rattus norvegicus
tcggtcacctccagatgctcattgc

SEQ ID NO: 639975 - DNA, 25 bp, Rattus norvegicus
tgacattgagcgtgcgagactcctc

SEQ ID NO: 639976 - DNA, 25 bp, Rattus norvegicus
atcttgcgcaccacagggatgttgc

SEQ ID NO: 639977 - DNA, 25 bp, Rattus norvegicus
ttgccgtactctgcagcgtccagga

SEQ ID NO: 639978 - DNA, 25 bp, Rattus norvegicus
tgggcccacgagcaccgaacatgaa

SEQ ID NO: 639979 - DNA, 25 bp, Rattus norvegicus
tgccctccgacgacctgatcagtgg

SEQ ID NO: 639980 - DNA, 25 bp, Rattus norvegicus
ctccacgatgcgcacatagcctttg

SEQ ID NO: 639981 - DNA, 25 bp, Rattus norvegicus
agggacgccttcgtccgactctgca

SEQ ID NO: 639982 - DNA, 25 bp, Rattus norvegicus
agccgctctgagtcaagcacccggg

SEQ ID NO: 639983 - DNA, 25 bp, Rattus norvegicus
agtcagcagcccagccgctctgagt

SEQ ID NO: 639984 - DNA, 25 bp, Rattus norvegicus
gacatagcggccgagctccttgccg

SEQ ID NO: 639985 - DNA, 25 bp, Rattus norvegicus
cggcacttcttgaccttggtggaca

SEQ ID NO: 639986 - DNA, 25 bp, Rattus norvegicus
gcgcttagctggtcccgatcccggt

SEQ ID NO: 639987 - DNA, 25 bp, Rattus norvegicus
tcctcctgggaagaggagagccgcc

SEQ ID NO: 639988 - DNA, 25 bp, Rattus norvegicus
tgcggagcctgaatcctcctgggaa

SEQ ID NO: 639989 - DNA, 25 bp, Rattus norvegicus
gcagtgcgtgctcatgagcccggct

SEQ ID NO: 639990 - DNA, 25 bp, Rattus norvegicus
atcctagccctggtggcctcgctat

SEQ ID NO: 639991 - DNA, 25 bp, Rattus norvegicus
gttcgagtccggagatcctagccct

SEQ ID NO: 639992 - DNA, 25 bp, Rattus norvegicus
cagcagctcccggttcgagtccgga

SEQ ID NO: 639993 - DNA, 25 bp, Rattus norvegicus
gcggcgggtcctgtgcacacagtca

SEQ ID NO: 639994 - DNA, 25 bp, Rattus norvegicus
cggtccgacagcatcgcggcgagac

SEQ ID NO: 639995 - DNA, 25 bp, Rattus norvegicus
taggcatcagcggaggtccggacta

SEQ ID NO: 639996 - DNA, 25 bp, Rattus norvegicus
cctctccgtccctgctccgtgccag

SEQ ID NO: 639997 - DNA, 25 bp, Rattus norvegicus
ccgcgctgtcaggtgagaggagctc

SEQ ID NO: 639998 - DNA, 25 bp, Rattus norvegicus
tctgacagccaagtgccagggttgc

SEQ ID NO: 639999 - DNA, 25 bp, Rattus norvegicus
cctagcaggctctgacagccaagtg

SEQ ID NO: 640000 - DNA, 25 bp, Rattus norvegicus
tggaggcctagcaggctctgacagc

SEQ ID NO: 640001 - DNA, 25 bp, Rattus norvegicus
agcgcctttccgggtgagactggaa

SEQ ID NO: 640002 - DNA, 25 bp, Rattus norvegicus
tccggactagggtctgccgcgctgt

SEQ ID NO: 640003 - DNA, 25 bp, Rattus norvegicus
cggttctgctcctccgccctatggg

SEQ ID NO: 640004 - DNA, 25 bp, Rattus norvegicus
gacgcagctgcagtgccgctggcct

SEQ ID NO: 640005 - DNA, 25 bp, Rattus norvegicus
cgctgccggttgacgcagctgcagt

SEQ ID NO: 640006 - DNA, 25 bp, Rattus norvegicus
acgtggtacgctgccggttgacgca

SEQ ID NO: 640007 - DNA, 25 bp, Rattus norvegicus
cgctggcgccctgacgtggtacgct

SEQ ID NO: 640008 - DNA, 25 bp, Rattus norvegicus
ccagagtggcgtaccctgaggcgct

SEQ ID NO: 640009 - DNA, 25 bp, Rattus norvegicus
gccagagcgaaggtccttgctgatt

SEQ ID NO: 640010 - DNA, 25 bp, Rattus norvegicus
cgaaggtccttgctgattggtcgag

SEQ ID NO: 640011 - DNA, 25 bp, Rattus norvegicus
tcgatagagacgaggcctggaacct

SEQ ID NO: 640012 - DNA, 25 bp, Rattus norvegicus
agacgaggcctggaacctgcgcgcc

SEQ ID NO: 640013 - DNA, 25 bp, Rattus norvegicus
gaacctgcgcgccattcaccgtgac

SEQ ID NO: 640014 - DNA, 25 bp, Rattus norvegicus
gactaagctacgcacgtatcccacg

SEQ ID NO: 640015 - DNA, 25 bp, Rattus norvegicus
tgccgctcacctgcctgcgagcctg

SEQ ID NO: 640016 - DNA, 25 bp, Rattus norvegicus
ctcctcagggtctgctcgaggggcc

SEQ ID NO: 640017 - DNA, 25 bp, Rattus norvegicus
acgcacgtatcccacgcgggcaggg

SEQ ID NO: 640018 - DNA, 25 bp, Rattus norvegicus
tgctcgaggggccttttgaaagacg

SEQ ID NO: 640019 - DNA, 25 bp, Rattus norvegicus
ccttttgaaagacgcgactggctgc

SEQ ID NO: 640020 - DNA, 25 bp, Rattus norvegicus
cagaggcctgagacgagaggtcgac

SEQ ID NO: 640021 - DNA, 25 bp, Rattus norvegicus
acggtggcagcgcagcaatggcgac

SEQ ID NO: 640022 - DNA, 25 bp, Rattus norvegicus
ggctcggcctgcctcttgccgctca

SEQ ID NO: 640023 - DNA, 25 bp, Rattus norvegicus
ttgacggccattgcgcccaatggaa

SEQ ID NO: 640024 - DNA, 25 bp, Rattus norvegicus
ccaatggaaaggcaagactgctctg

SEQ ID NO: 640025 - DNA, 25 bp, Rattus norvegicus
aaggcaagactgctctgaccgcgcg

SEQ ID NO: 640026 - DNA, 25 bp, Rattus norvegicus
ccttagagccgctcgagggcacgcg

SEQ ID NO: 640027 - DNA, 25 bp, Rattus norvegicus
cttccggccttagagccgctcgagg

SEQ ID NO: 640028 - DNA, 25 bp, Rattus norvegicus
ccagctcccgtgattgacggccatt

SEQ ID NO: 640029 - DNA, 25 bp, Rattus norvegicus
tccacacaccgaacaaccgtcctgc

SEQ ID NO: 640030 - DNA, 25 bp, Rattus norvegicus
gagccgcactaagagcgcaagcccg

SEQ ID NO: 640031 - DNA, 25 bp, Rattus norvegicus
agactgctctgaccgcgcgcaagta

SEQ ID NO: 640032 - DNA, 25 bp, Rattus norvegicus
gtcctgcggccttccggccttagag

SEQ ID NO: 640033 - DNA, 25 bp, Rattus norvegicus
ggcggttgctagagccgcactaaga

SEQ ID NO: 640034 - DNA, 25 bp, Rattus norvegicus
aacggcagccttgccttcagccggg

SEQ ID NO: 640035 - DNA, 25 bp, Rattus norvegicus
cccgcgtgtccctagactctccaca

SEQ ID NO: 640036 - DNA, 25 bp, Rattus norvegicus
tcccgtgattgacggccattgcgcc

SEQ ID NO: 640037 - DNA, 25 bp, Rattus norvegicus
gctctactgcaagaacggcggcttc

SEQ ID NO: 640038 - DNA, 25 bp, Rattus norvegicus
agaagagcgacccacacggtgagtc

SEQ ID NO: 640039 - DNA, 25 bp, Rattus norvegicus
gcatccatccagacggccgcgtgga

SEQ ID NO: 640040 - DNA, 25 bp, Rattus norvegicus
gcggcttcttcctgcgcatccatcc

SEQ ID NO: 640041 - DNA, 25 bp, Rattus norvegicus
ctactgcaagaacggcggcttcttc

SEQ ID NO: 640042 - DNA, 25 bp, Rattus norvegicus
cccaagcggctctactgcaagaacg

SEQ ID NO: 640043 - DNA, 25 bp, Rattus norvegicus
ttcaaggatcccaagcggctctact

SEQ ID NO: 640044 - DNA, 25 bp, Rattus norvegicus
cggccacttcaaggatcccaagcgg

SEQ ID NO: 640045 - DNA, 25 bp, Rattus norvegicus
ccacccgtgcgcatggtctaccaca

SEQ ID NO: 640046 - DNA, 25 bp, Rattus norvegicus
tggctgccggcagcatcacttcgct

SEQ ID NO: 640047 - DNA, 25 bp, Rattus norvegicus
gtgagtcgccaccttccacccgtgc

SEQ ID NO: 640048 - DNA, 25 bp, Rattus norvegicus
gtctctcggcttcaggcggagtccg

SEQ ID NO: 640049 - DNA, 25 bp, Rattus norvegicus
atcacttcgcttcccgcactgccgg

SEQ ID NO: 640050 - DNA, 25 bp, Rattus norvegicus
cgtccgggagaagagcgacccacac

SEQ ID NO: 640051 - DNA, 25 bp, Rattus norvegicus
aaatctgtccagctcgccttgtagc

SEQ ID NO: 640052 - DNA, 25 bp, Rattus norvegicus
caacggtgttttgcgagaccctcgc

SEQ ID NO: 640053 - DNA, 25 bp, Rattus norvegicus
aaacggcggttcctatgcctaggcg

SEQ ID NO: 640054 - DNA, 25 bp, Rattus norvegicus
tccaagggctcataacgtaaacggc

SEQ ID NO: 640055 - DNA, 25 bp, Rattus norvegicus
ccgacccatatttgcttcgagagta

SEQ ID NO: 640056 - DNA, 25 bp, Rattus norvegicus
cactaagtttgagctggaatttcca

SEQ ID NO: 640057 - DNA, 25 bp, Rattus norvegicus
agggctgaccgtaaactctcgaaga

SEQ ID NO: 640058 - DNA, 25 bp, Rattus norvegicus
tgccgcgacaagtgcaccgagatgc

SEQ ID NO: 640059 - DNA, 25 bp, Rattus norvegicus
tctcgtcgcgaacaacctcaggggt

SEQ ID NO: 640060 - DNA, 25 bp, Rattus norvegicus
acatcgtctgacgtggccttgtctc

SEQ ID NO: 640061 - DNA, 25 bp, Rattus norvegicus
tgcaccttgcctttcagacgctcga

SEQ ID NO: 640062 - DNA, 25 bp, Rattus norvegicus
cagcctgcggtcatgtcttccaaga

SEQ ID NO: 640063 - DNA, 25 bp, Rattus norvegicus
cgcccacgtcgagcaaagccgagaa

SEQ ID NO: 640064 - DNA, 25 bp, Rattus norvegicus
agccgagaacaaccatcgcgctctg

SEQ ID NO: 640065 - DNA, 25 bp, Rattus norvegicus
ctcgcaccctgtcgccgggaggttg

SEQ ID NO: 640066 - DNA, 25 bp, Rattus norvegicus
tcacaaggccgtcggcgctggccaa

SEQ ID NO: 640067 - DNA, 25 bp, Rattus norvegicus
gccaacagcctaagtcctccctact

SEQ ID NO: 640068 - DNA, 25 bp, Rattus norvegicus
ccctactcgcggcgggcgacagaaa

SEQ ID NO: 640069 - DNA, 25 bp, Rattus norvegicus
cttcctctgccgagcgggctgagag

SEQ ID NO: 640070 - DNA, 25 bp, Rattus norvegicus
gggcagtgcagtccaggctgccctt

SEQ ID NO: 640071 - DNA, 25 bp, Rattus norvegicus
gacctcgccgggcagtgcagtccag

SEQ ID NO: 640072 - DNA, 25 bp, Rattus norvegicus
cggagctctggtgctcgcaccctgt

SEQ ID NO: 640073 - DNA, 25 bp, Rattus norvegicus
ccttattttgcggagctctggtgct

SEQ ID NO: 640074 - DNA, 25 bp, Rattus norvegicus
gggaggcctccttattttgcggagc

SEQ ID NO: 640075 - DNA, 25 bp, Rattus norvegicus
ccctagctgcaggagctagtgcgcc

SEQ ID NO: 640076 - DNA, 25 bp, Rattus norvegicus
tctgattggtgtttcccgggagacc

SEQ ID NO: 640077 - DNA, 25 bp, Rattus norvegicus
aagcgagcgtctgattggtgtttcc

SEQ ID NO: 640078 - DNA, 25 bp, Rattus norvegicus
gcgacagaaagcgagcgtctgattg

SEQ ID NO: 640079 - DNA, 25 bp, Rattus norvegicus
gtgccgccatgctgcagaaccggaa

SEQ ID NO: 640080 - DNA, 25 bp, Rattus norvegicus
gagaaggcggggcactccgaaaaca

SEQ ID NO: 640081 - DNA, 25 bp, Rattus norvegicus
tcggaagccgctgcctcggttaccg

SEQ ID NO: 640082 - DNA, 25 bp, Rattus norvegicus
tgtggcccgctgaggcacacgagct

SEQ ID NO: 640083 - DNA, 25 bp, Rattus norvegicus
tgaggcacacgagctctgcgtgacc

SEQ ID NO: 640084 - DNA, 25 bp, Rattus norvegicus
tagcgccccagtcttctcacggaag

SEQ ID NO: 640085 - DNA, 25 bp, Rattus norvegicus
ggaagccccgttcgctctgccggaa

SEQ ID NO: 640086 - DNA, 25 bp, Rattus norvegicus
cgaggcacagtactctcagggtctg

SEQ ID NO: 640087 - DNA, 25 bp, Rattus norvegicus
acagtactctcagggtctgccgtgc

SEQ ID NO: 640088 - DNA, 25 bp, Rattus norvegicus
tcagggtctgccgtgccgccatgct

SEQ ID NO: 640089 - DNA, 25 bp, Rattus norvegicus
gctgcagaaccggaagcatgtcttc

SEQ ID NO: 640090 - DNA, 25 bp, Rattus norvegicus
ttcccaagcggaagtagaacctgca

SEQ ID NO: 640091 - DNA, 25 bp, Rattus norvegicus
caagcggaagtagaacctgcaaggg

SEQ ID NO: 640092 - DNA, 25 bp, Rattus norvegicus
ccggaagcatgtcttcccaagcgga

SEQ ID NO: 640093 - DNA, 25 bp, Rattus norvegicus
tctgtctctgctcgtctgcagccgg

SEQ ID NO: 640094 - DNA, 25 bp, Rattus norvegicus
tctaccacggcgagcaggacagcgt

SEQ ID NO: 640095 - DNA, 25 bp, Rattus norvegicus
tccggagctcgtggctgtctaccac

SEQ ID NO: 640096 - DNA, 25 bp, Rattus norvegicus
gcaaaacgtgcacggccgcgtgtgt

SEQ ID NO: 640097 - DNA, 25 bp, Rattus norvegicus
acgcgtcgttgggacgcgcttttga

SEQ ID NO: 640098 - DNA, 25 bp, Rattus norvegicus
gcttgcctctcgcagacgcgtcgtt

SEQ ID NO: 640099 - DNA, 25 bp, Rattus norvegicus
gggcgctcgtgccagacctgacttt

SEQ ID NO: 640100 - DNA, 25 bp, Rattus norvegicus
gcacccgcgtgtctgtgcgcattgt

SEQ ID NO: 640101 - DNA, 25 bp, Rattus norvegicus
cagcgagttccgtgtgtgcgaacgc

SEQ ID NO: 640102 - DNA, 25 bp, Rattus norvegicus
cggccctgaagcgagttccgtagcc

SEQ ID NO: 640103 - DNA, 25 bp, Rattus norvegicus
ctggacgttttctgagctggctcta

SEQ ID NO: 640104 - DNA, 25 bp, Rattus norvegicus
cgagatcaggtgagaatggtgcttt

SEQ ID NO: 640105 - DNA, 25 bp, Rattus norvegicus
ctctgcactaggtaagagccttccc

SEQ ID NO: 640106 - DNA, 25 bp, Rattus norvegicus
cgagggactcacgtgtttctgtctc

SEQ ID NO: 640107 - DNA, 25 bp, Rattus norvegicus
ctgcgctcacattcttgctgatagc

SEQ ID NO: 640108 - DNA, 25 bp, Rattus norvegicus
catgcatttatacagcttggtggga

SEQ ID NO: 640109 - DNA, 25 bp, Rattus norvegicus
tccacaggggactggcatgcattta

SEQ ID NO: 640110 - DNA, 25 bp, Rattus norvegicus
agactagttctgtttccacagggga

SEQ ID NO: 640111 - DNA, 25 bp, Rattus norvegicus
gcagacatttagaatagactagttc

SEQ ID NO: 640112 - DNA, 25 bp, Rattus norvegicus
tccatgggtgcagacatttagaata

SEQ ID NO: 640113 - DNA, 25 bp, Rattus norvegicus
cagttttaaattccatgggtgcaga

SEQ ID NO: 640114 - DNA, 25 bp, Rattus norvegicus
tgatagcatcttccgtcacccagtc

SEQ ID NO: 640115 - DNA, 25 bp, Rattus norvegicus
gcccttgtttaggtggaagtagcca

SEQ ID NO: 640116 - DNA, 25 bp, Rattus norvegicus
acctgtgcgtaagtggcccttgttt

SEQ ID NO: 640117 - DNA, 25 bp, Rattus norvegicus
actgcatttgacctgtgcgtaagtg

SEQ ID NO: 640118 - DNA, 25 bp, Rattus norvegicus
actattattctatatgccatccatc

SEQ ID NO: 640119 - DNA, 25 bp, Rattus norvegicus
gccatccatctagtactgcatttga

SEQ ID NO: 640120 - DNA, 25 bp, Rattus norvegicus
cagcgcttcacagggcacagtttta

SEQ ID NO: 640121 - DNA, 25 bp, Rattus norvegicus
ttattggctcgcctttcgcaggtcc

SEQ ID NO: 640122 - DNA, 25 bp, Rattus norvegicus
aaaggctccgaacgaggtgctgccc

SEQ ID NO: 640123 - DNA, 25 bp, Rattus norvegicus
tcccgggaatccagtgagggtctga

SEQ ID NO: 640124 - DNA, 25 bp, Rattus norvegicus
cgccgttacctcagtcctttcagtt

SEQ ID NO: 640125 - DNA, 25 bp, Rattus norvegicus
gccggcgcaaagactgtctcagcca

SEQ ID NO: 640126 - DNA, 25 bp, Rattus norvegicus
tgcacgcagaccacgcctctaaagg

SEQ ID NO: 640127 - DNA, 25 bp, Rattus norvegicus
tcctataggtcacgtcccgcataga

SEQ ID NO: 640128 - DNA, 25 bp, Rattus norvegicus
gcaggtcctgcccaatcgttctttt

SEQ ID NO: 640129 - DNA, 25 bp, Rattus norvegicus
gccgctttgtgcaactggtccttga

SEQ ID NO: 640130 - DNA, 25 bp, Rattus norvegicus
actggtccttgagctttcccgagaa

SEQ ID NO: 640131 - DNA, 25 bp, Rattus norvegicus
ttcccgagaaagctaaactgcgagg

SEQ ID NO: 640132 - DNA, 25 bp, Rattus norvegicus
cgaggggctctgtgcctaactagaa

SEQ ID NO: 640133 - DNA, 25 bp, Rattus norvegicus
cccggctcagctgacagacaaaggc

SEQ ID NO: 640134 - DNA, 25 bp, Rattus norvegicus
acccgcgtagaacctggtcgctgtg

SEQ ID NO: 640135 - DNA, 25 bp, Rattus norvegicus
cgcctagcacgcgtgagtaatgggc

SEQ ID NO: 640136 - DNA, 25 bp, Rattus norvegicus
gatcgtaggtgagcgcgcgccaact

SEQ ID NO: 640137 - DNA, 25 bp, Rattus norvegicus
agtaatgggccgaagggtgatcgta

SEQ ID NO: 640138 - DNA, 25 bp, Rattus norvegicus
tcggggctcgactagagtcgcgcga

SEQ ID NO: 640139 - DNA, 25 bp, Rattus norvegicus
agagagtactcggtgggccggcaat

SEQ ID NO: 640140 - DNA, 25 bp, Rattus norvegicus
cgctggcgtaccgagagagtactcg

SEQ ID NO: 640141 - DNA, 25 bp, Rattus norvegicus
aaagctgcagtttgtggcccgcgct

SEQ ID NO: 640142 - DNA, 25 bp, Rattus norvegicus
gtactgccacggttttggagagaaa

SEQ ID NO: 640143 - DNA, 25 bp, Rattus norvegicus
tgctgtactgccacggttttggaga

SEQ ID NO: 640144 - DNA, 25 bp, Rattus norvegicus
cggcgtgctgtactgccacggtttt

SEQ ID NO: 640145 - DNA, 25 bp, Rattus norvegicus
aagtggcggcgtgctgtactgccac

SEQ ID NO: 640146 - DNA, 25 bp, Rattus norvegicus
aggggcctctgggttatgaagtggc

SEQ ID NO: 640147 - DNA, 25 bp, Rattus norvegicus
actccatcgcgggagagccctggcg

SEQ ID NO: 640148 - DNA, 25 bp, Rattus norvegicus
gttttggagagaaagctgcagtttg

SEQ ID NO: 640149 - DNA, 25 bp, Rattus norvegicus
agccacgccctgttcgctattaaca

SEQ ID NO: 640150 - DNA, 25 bp, Rattus norvegicus
tgttcgtgcagtaagcgactcctca

SEQ ID NO: 640151 - DNA, 25 bp, Rattus norvegicus
tggtgcgtgacctcaacgacaatgc

SEQ ID NO: 640152 - DNA, 25 bp, Rattus norvegicus
tcaacctaagtgtctagaggcctgc

SEQ ID NO: 640153 - DNA, 25 bp, Rattus norvegicus
gaggcctgcaaactttcaccggaga

SEQ ID NO: 640154 - DNA, 25 bp, Rattus norvegicus
ctccggccaaactgaccttttactg

SEQ ID NO: 640155 - DNA, 25 bp, Rattus norvegicus
tgaccttttactggcgccactcaga

SEQ ID NO: 640156 - DNA, 25 bp, Rattus norvegicus
ttgattctcttctccaggttactgg

SEQ ID NO: 640157 - DNA, 25 bp, Rattus norvegicus
aggaccatgaacttggccgcaaacc

SEQ ID NO: 640158 - DNA, 25 bp, Rattus norvegicus
cctgcccagcgatgtggtcaacctg

SEQ ID NO: 640159 - DNA, 25 bp, Rattus norvegicus
aacgcgtcctggcttcacctatcgg

SEQ ID NO: 640160 - DNA, 25 bp, Rattus norvegicus
cagcagcactggagcgttgtacacc

SEQ ID NO: 640161 - DNA, 25 bp, Rattus norvegicus
ttcacagctagcttgggatctcctg

SEQ ID NO: 640162 - DNA, 25 bp, Rattus norvegicus
ctctgggccagcttctgagagtctg

SEQ ID NO: 640163 - DNA, 25 bp, Rattus norvegicus
acccacggtgtcacccggacatttg

SEQ ID NO: 640164 - DNA, 25 bp, Rattus norvegicus
cgggcacagacaggggcctccgtta

SEQ ID NO: 640165 - DNA, 25 bp, Rattus norvegicus
tgatcccggcatacggacccacggt

SEQ ID NO: 640166 - DNA, 25 bp, Rattus norvegicus
cggtgtcacccggacatttgtgtcc

SEQ ID NO: 640167 - DNA, 25 bp, Rattus norvegicus
gacatttgtgtcctccatcagatcc

SEQ ID NO: 640168 - DNA, 25 bp, Rattus norvegicus
catcagatcctcacccgagctgggg

SEQ ID NO: 640169 - DNA, 25 bp, Rattus norvegicus
acccgagctggggacccgctgacac

SEQ ID NO: 640170 - DNA, 25 bp, Rattus norvegicus
cgctgacacccgctgccgcccggag

SEQ ID NO: 640171 - DNA, 25 bp, Rattus norvegicus
cctcgaggcggctccctacgggaat

SEQ ID NO: 640172 - DNA, 25 bp, Rattus norvegicus
ggcggctccctacgggaatgtttca

SEQ ID NO: 640173 - DNA, 25 bp, Rattus norvegicus
caacctggaggacctagactccgtg

SEQ ID NO: 640174 - DNA, 25 bp, Rattus norvegicus
gaggacctagactccgtgcagcgcg

SEQ ID NO: 640175 - DNA, 25 bp, Rattus norvegicus
agcgatcggttccgcgggtgatccc

SEQ ID NO: 640176 - DNA, 25 bp, Rattus norvegicus
cacctgccaggacggagcgatcggt

SEQ ID NO: 640177 - DNA, 25 bp, Rattus norvegicus
acgtgacccggcctggcaaaatggc

SEQ ID NO: 640178 - DNA, 25 bp, Rattus norvegicus
tcgcagctgagtaccagggtcacgt

SEQ ID NO: 640179 - DNA, 25 bp, Rattus norvegicus
acccggcctggcaaaatggcggagc

SEQ ID NO: 640180 - DNA, 25 bp, Rattus norvegicus
ggcgggctctagagtctgatttttc

SEQ ID NO: 640181 - DNA, 25 bp, Rattus norvegicus
ggctctagagtctgatttttctccc

SEQ ID NO: 640182 - DNA, 25 bp, Rattus norvegicus
agccaatcgcagctgagtaccaggg

SEQ ID NO: 640183 - DNA, 25 bp, Rattus norvegicus
cccgggagctctcgcgaccgaaagg

SEQ ID NO: 640184 - DNA, 25 bp, Rattus norvegicus
agaagcttccctgtctcccgggcaa

SEQ ID NO: 640185 - DNA, 25 bp, Rattus norvegicus
ctgtaccgagaagcttccctgtctc

SEQ ID NO: 640186 - DNA, 25 bp, Rattus norvegicus
ctctcgcgaccgaaaggatggcgga

SEQ ID NO: 640187 - DNA, 25 bp, Rattus norvegicus
cgaccgaaaggatggcggaccctgc

SEQ ID NO: 640188 - DNA, 25 bp, Rattus norvegicus
tccctggagacctgtcctcacagga

SEQ ID NO: 640189 - DNA, 25 bp, Rattus norvegicus
ctgagtaccagggtcacgtgacccg

SEQ ID NO: 640190 - DNA, 25 bp, Rattus norvegicus
aagaggaggaaagcgactccgacgc

SEQ ID NO: 640191 - DNA, 25 bp, Rattus norvegicus
tgccggatgcgctgttctcacagta

SEQ ID NO: 640192 - DNA, 25 bp, Rattus norvegicus
gctgttctcacagtatcctcatcgc

SEQ ID NO: 640193 - DNA, 25 bp, Rattus norvegicus
tttcccgccaggataaagctgaagc

SEQ ID NO: 640194 - DNA, 25 bp, Rattus norvegicus
ccaggataaagctgaagcggttttc

SEQ ID NO: 640195 - DNA, 25 bp, Rattus norvegicus
ggttctcctccggtttgtcgcttga

SEQ ID NO: 640196 - DNA, 25 bp, Rattus norvegicus
tccggtttgtcgcttgagtgttggt

SEQ ID NO: 640197 - DNA, 25 bp, Rattus norvegicus
agacagctgtggcacccatcgagcg

SEQ ID NO: 640198 - DNA, 25 bp, Rattus norvegicus
ggttgtgcgtcctttgtccagcatg

SEQ ID NO: 640199 - DNA, 25 bp, Rattus norvegicus
tgtccagcatgtcgaacaattcctc

SEQ ID NO: 640200 - DNA, 25 bp, Rattus norvegicus
gtcgaacaattcctccaagaagcag

SEQ ID NO: 640201 - DNA, 25 bp, Rattus norvegicus
tcttcaaagaagacgttgttcgacc

SEQ ID NO: 640202 - DNA, 25 bp, Rattus norvegicus
cgtgtctttcgcaaaggacctgctg

SEQ ID NO: 640203 - DNA, 25 bp, Rattus norvegicus
gtcgaagacagctgtggcacccatc

SEQ ID NO: 640204 - DNA, 25 bp, Rattus norvegicus
ctctgcagcttttgggttgtgcgtc

SEQ ID NO: 640205 - DNA, 25 bp, Rattus norvegicus
agggcaggggctcgccaactctgct

SEQ ID NO: 640206 - DNA, 25 bp, Rattus norvegicus
cctcagcgttgctcggagacagcct

SEQ ID NO: 640207 - DNA, 25 bp, Rattus norvegicus
tcgccaacgagtacagcgacaggtg

SEQ ID NO: 640208 - DNA, 25 bp, Rattus norvegicus
ctgctacatcgctgtggcgaggagc

SEQ ID NO: 640209 - DNA, 25 bp, Rattus norvegicus
ggcttcctcaactgctacatcgctg

SEQ ID NO: 640210 - DNA, 25 bp, Rattus norvegicus
tgggcattgacctcggcttcctcaa

SEQ ID NO: 640211 - DNA, 25 bp, Rattus norvegicus
cccgtgacaggtgcagcgtcttcag

SEQ ID NO: 640212 - DNA, 25 bp, Rattus norvegicus
gggtcctctcctttgcttctcgcag

SEQ ID NO: 640213 - DNA, 25 bp, Rattus norvegicus
attttctgacagagagtgggtcctc

SEQ ID NO: 640214 - DNA, 25 bp, Rattus norvegicus
cggcgaaccgcagtggagactaagc

SEQ ID NO: 640215 - DNA, 25 bp, Rattus norvegicus
aggcgcagaccgcagtaactgccgg

SEQ ID NO: 640216 - DNA, 25 bp, Rattus norvegicus
cagcgagccgttgccgagcgctgac

SEQ ID NO: 640217 - DNA, 25 bp, Rattus norvegicus
gcttaggagagcgtccgcaggccac

SEQ ID NO: 640218 - DNA, 25 bp, Rattus norvegicus
gcgacaggtgcacgccgtaagtgcc

SEQ ID NO: 640219 - DNA, 25 bp, Rattus norvegicus
tgacacaggtaatgcggtgttccgc

SEQ ID NO: 640220 - DNA, 25 bp, Rattus norvegicus
aacatccactgttagcgtccgcgtt

SEQ ID NO: 640221 - DNA, 25 bp, Rattus norvegicus
taccgcttggtacaaacaccggagc

SEQ ID NO: 640222 - DNA, 25 bp, Rattus norvegicus
gaccgactaagctgaggtgcaccga

SEQ ID NO: 640223 - DNA, 25 bp, Rattus norvegicus
ccgagtgaggcggactctgatattc

SEQ ID NO: 640224 - DNA, 25 bp, Rattus norvegicus
ccaagacctgctggcttctcggagc

SEQ ID NO: 640225 - DNA, 25 bp, Rattus norvegicus
aagcatcctgatgggcgccaagacc

SEQ ID NO: 640226 - DNA, 25 bp, Rattus norvegicus
cggcggcatagagaaagcatcctga

SEQ ID NO: 640227 - DNA, 25 bp, Rattus norvegicus
tctggaggtaccgagataaactttc

SEQ ID NO: 640228 - DNA, 25 bp, Rattus norvegicus
ttcaaaatgggagcatcgatgcgcc

SEQ ID NO: 640229 - DNA, 25 bp, Rattus norvegicus
gtcggtctcagcctctcagaagtgg

SEQ ID NO: 640230 - DNA, 25 bp, Rattus norvegicus
cgtccgcgttttggtcagtttcaca

SEQ ID NO: 640231 - DNA, 25 bp, Rattus norvegicus
cggctctgaaactgcgtcgtccttc

SEQ ID NO: 640232 - DNA, 25 bp, Rattus norvegicus
cctggtacccagcaagtgtgtcgcc

SEQ ID NO: 640233 - DNA, 25 bp, Rattus norvegicus
tacaacccgcgcttaggtgcaggca

SEQ ID NO: 640234 - DNA, 25 bp, Rattus norvegicus
tgctgcttcagcaccgagtacaacc

SEQ ID NO: 640235 - DNA, 25 bp, Rattus norvegicus
gcggatcgctcggtcctgcaaacgc

SEQ ID NO: 640236 - DNA, 25 bp, Rattus norvegicus
gagcgcccttttgcagcagccgctg

SEQ ID NO: 640237 - DNA, 25 bp, Rattus norvegicus
caaaaccgcctgcaaagtgtttggg

SEQ ID NO: 640238 - DNA, 25 bp, Rattus norvegicus
tcgacgcgctcggattagctgtagc

SEQ ID NO: 640239 - DNA, 25 bp, Rattus norvegicus
gtagctggcgcccagggatttgaat

SEQ ID NO: 640240 - DNA, 25 bp, Rattus norvegicus
cggccaacatgcttcgcaaaggtga

SEQ ID NO: 640241 - DNA, 25 bp, Rattus norvegicus
cccgctagctgactggcttttgtca

SEQ ID NO: 640242 - DNA, 25 bp, Rattus norvegicus
tgctgctagagctgagctcccgttg

SEQ ID NO: 640243 - DNA, 25 bp, Rattus norvegicus
gacacggggtttgttcatggatcga

SEQ ID NO: 640244 - DNA, 25 bp, Rattus norvegicus
ccaggcctcagggatctgtcttgag

SEQ ID NO: 640245 - DNA, 25 bp, Rattus norvegicus
ctgggacctttgcttcgccattata

SEQ ID NO: 640246 - DNA, 25 bp, Rattus norvegicus
agttttacacttgcaggctccatcc

SEQ ID NO: 640247 - DNA, 25 bp, Rattus norvegicus
tctgaccgaactattagagagaaag

SEQ ID NO: 640248 - DNA, 25 bp, Rattus norvegicus
gcggttgttccctcctcaaggctct

SEQ ID NO: 640249 - DNA, 25 bp, Rattus norvegicus
gaaggaaacaatatggcagtatatc

SEQ ID NO: 640250 - DNA, 25 bp, Rattus norvegicus
gtatatctgaccgaactattagaga

SEQ ID NO: 640251 - DNA, 25 bp, Rattus norvegicus
tgttccctcctcaaggctctgcggg

SEQ ID NO: 640252 - DNA, 25 bp, Rattus norvegicus
cggttgttccctcctcaaggctctg

SEQ ID NO: 640253 - DNA, 25 bp, Rattus norvegicus
gcggcggttgttccctcctcaaggc

SEQ ID NO: 640254 - DNA, 25 bp, Rattus norvegicus
ccgatagattacccgagcgggacct

SEQ ID NO: 640255 - DNA, 25 bp, Rattus norvegicus
gaccgaactattagagagaaagaga

SEQ ID NO: 640256 - DNA, 25 bp, Rattus norvegicus
atatctgaccgaactattagagaga

SEQ ID NO: 640257 - DNA, 25 bp, Rattus norvegicus
ggcagtatatctgaccgaactatta

SEQ ID NO: 640258 - DNA, 25 bp, Rattus norvegicus
tatggcagtatatctgaccgaacta

SEQ ID NO: 640259 - DNA, 25 bp, Rattus norvegicus
acaatatggcagtatatctgaccga

SEQ ID NO: 640260 - DNA, 25 bp, Rattus norvegicus
gttgttccctcctcaaggctctgcg

SEQ ID NO: 640261 - DNA, 25 bp, Rattus norvegicus
gaattcaggtgttggtgctattacc

SEQ ID NO: 640262 - DNA, 25 bp, Rattus norvegicus
tcgcttcccaggttcgccataatga

SEQ ID NO: 640263 - DNA, 25 bp, Rattus norvegicus
ttcaaagcggcatgagtgcagcagt

SEQ ID NO: 640264 - DNA, 25 bp, Rattus norvegicus
ccactggcttctgcggaggttcaaa

SEQ ID NO: 640265 - DNA, 25 bp, Rattus norvegicus
ctgtaagtaacaggccgtgcgccac

SEQ ID NO: 640266 - DNA, 25 bp, Rattus norvegicus
agagccttggcgaactccctttagg

SEQ ID NO: 640267 - DNA, 25 bp, Rattus norvegicus
tccagttcctagagcgtgaagagct

SEQ ID NO: 640268 - DNA, 25 bp, Rattus norvegicus
ttacctgaagcgaaagtccagttcc

SEQ ID NO: 640269 - DNA, 25 bp, Rattus norvegicus
tccttctgtttcttacctgagggaa

SEQ ID NO: 640270 - DNA, 25 bp, Rattus norvegicus
cctgtctgacgggtatccttctgtt

SEQ ID NO: 640271 - DNA, 25 bp, Rattus norvegicus
gaagcggatcagctgcctaggaaaa

SEQ ID NO: 640272 - DNA, 25 bp, Rattus norvegicus
gagctgtcgaaacactcggcaactg

SEQ ID NO: 640273 - DNA, 25 bp, Rattus norvegicus
cattggggacccttgagaacgaatc

SEQ ID NO: 640274 - DNA, 25 bp, Rattus norvegicus
atgacagcactcactaggcggcgcg

SEQ ID NO: 640275 - DNA, 25 bp, Rattus norvegicus
gccgctggcttctgcggacgtgcaa

SEQ ID NO: 640276 - DNA, 25 bp, Rattus norvegicus
acactcgagcaattgcgcgtgcgcg

SEQ ID NO: 640277 - DNA, 25 bp, Rattus norvegicus
cgcgctgcccacactcggtacacaa

SEQ ID NO: 640278 - DNA, 25 bp, Rattus norvegicus
agctgtcaaaacactcgagcaattg

SEQ ID NO: 640279 - DNA, 25 bp, Rattus norvegicus
cgtgcaaggcggcatgaatgcagca

SEQ ID NO: 640280 - DNA, 25 bp, Rattus norvegicus
tccttgcccgcttggctggcagcta

SEQ ID NO: 640281 - DNA, 25 bp, Rattus norvegicus
ctgtaagtaacagcgggtgcgccgc

SEQ ID NO: 640282 - DNA, 25 bp, Rattus norvegicus
ccatccgaactaaggcgaaagtccg

SEQ ID NO: 640283 - DNA, 25 bp, Rattus norvegicus
tcacctcttggccatccgaactaag

SEQ ID NO: 640284 - DNA, 25 bp, Rattus norvegicus
gggacctgaggaaattcacctcttg

SEQ ID NO: 640285 - DNA, 25 bp, Rattus norvegicus
agccatcttcttgggacctgaggaa

SEQ ID NO: 640286 - DNA, 25 bp, Rattus norvegicus
ctggcagctagccatcttcttggga

SEQ ID NO: 640287 - DNA, 25 bp, Rattus norvegicus
ctggcgtccagaaagcaggccggaa

SEQ ID NO: 640288 - DNA, 25 bp, Rattus norvegicus
tgaatgcagcagtgtcccgatccga

SEQ ID NO: 640289 - DNA, 25 bp, Rattus norvegicus
gggcggggccctcatcaaaccacgc

SEQ ID NO: 640290 - DNA, 25 bp, Rattus norvegicus
ccctcatcaaaccacgcccgccgca

SEQ ID NO: 640291 - DNA, 25 bp, Rattus norvegicus
tcgcgaagactcctcaggccgcggt

SEQ ID NO: 640292 - DNA, 25 bp, Rattus norvegicus
gtccttgggcacctcgcctaccgaa

SEQ ID NO: 640293 - DNA, 25 bp, Rattus norvegicus
cagcgtttagggatgccagtgagta

SEQ ID NO: 640294 - DNA, 25 bp, Rattus norvegicus
atgccagtgagtaggcatgtcactc

SEQ ID NO: 640295 - DNA, 25 bp, Rattus norvegicus
ctgactggccctcgccctggtcctt

SEQ ID NO: 640296 - DNA, 25 bp, Rattus norvegicus
ctaccctgcctcgtcctctacccgc

SEQ ID NO: 640297 - DNA, 25 bp, Rattus norvegicus
ggcatgtcactctccagggtgcccg

SEQ ID NO: 640298 - DNA, 25 bp, Rattus norvegicus
gtaggcatgtcactctccagggtgc

SEQ ID NO: 640299 - DNA, 25 bp, Rattus norvegicus
gtgagtaggcatgtcactctccagg

SEQ ID NO: 640300 - DNA, 25 bp, Rattus norvegicus
ccagtgagtaggcatgtcactctcc

SEQ ID NO: 640301 - DNA, 25 bp, Rattus norvegicus
ccgcagcgtttagggatgccagtga

SEQ ID NO: 640302 - DNA, 25 bp, Rattus norvegicus
tcgcccgcagcgtttagggatgcca

SEQ ID NO: 640303 - DNA, 25 bp, Rattus norvegicus
tcactgtgccgatttacataaatgg

SEQ ID NO: 640304 - DNA, 25 bp, Rattus norvegicus
aggtgtcattcactgtgccgattta

SEQ ID NO: 640305 - DNA, 25 bp, Rattus norvegicus
tgggctcgtgccttcacgtgtcggc

SEQ ID NO: 640306 - DNA, 25 bp, Rattus norvegicus
ccgtgttgggctcgtgccttcacgt

SEQ ID NO: 640307 - DNA, 25 bp, Rattus norvegicus
ctcaggttctccttgacgggtaggg

SEQ ID NO: 640308 - DNA, 25 bp, Rattus norvegicus
tttacataaatggacatgtgggaga

SEQ ID NO: 640309 - DNA, 25 bp, Rattus norvegicus
gaccaagaagctgcctcagcacctg

SEQ ID NO: 640310 - DNA, 25 bp, Rattus norvegicus
cgtggaccaagaagctgcctcagca

SEQ ID NO: 640311 - DNA, 25 bp, Rattus norvegicus
gggaacccgtggaccaagaagctgc

SEQ ID NO: 640312 - DNA, 25 bp, Rattus norvegicus
acgtccgtgaggacccagcggcagc

SEQ ID NO: 640313 - DNA, 25 bp, Rattus norvegicus
gccgccagcacctcgggacccaccg

SEQ ID NO: 640314 - DNA, 25 bp, Rattus norvegicus
tcgccggcgctcgtgctgggacaca

SEQ ID NO: 640315 - DNA, 25 bp, Rattus norvegicus
ggttcctaggtgtcattcactgtgc

SEQ ID NO: 640316 - DNA, 25 bp, Rattus norvegicus
aggtgggacctcaggttctccttga

SEQ ID NO: 640317 - DNA, 25 bp, Rattus norvegicus
cttctctggaagacggcaggttcgc

SEQ ID NO: 640318 - DNA, 25 bp, Rattus norvegicus
cggggccgtagaacttgctgccttt

SEQ ID NO: 640319 - DNA, 25 bp, Rattus norvegicus
tttggtcacgtcgaagactttccca

SEQ ID NO: 640320 - DNA, 25 bp, Rattus norvegicus
gactttcccattgaccgcgagcagg

SEQ ID NO: 640321 - DNA, 25 bp, Rattus norvegicus
tggcgcagctgctccaggctgaagt

SEQ ID NO: 640322 - DNA, 25 bp, Rattus norvegicus
tgaagtcccgcttcttcatgcgcgg

SEQ ID NO: 640323 - DNA, 25 bp, Rattus norvegicus
cggcgctcagccaatcacgtgagtg

SEQ ID NO: 640324 - DNA, 25 bp, Rattus norvegicus
tggcagcgccggctacttattggct

SEQ ID NO: 640325 - DNA, 25 bp, Rattus norvegicus
acttattggctgttggctgggtaac

SEQ ID NO: 640326 - DNA, 25 bp, Rattus norvegicus
tggcttcgctctcgtagctccagct

SEQ ID NO: 640327 - DNA, 25 bp, Rattus norvegicus
tactcgcggatatgggcggaacgcc

SEQ ID NO: 640328 - DNA, 25 bp, Rattus norvegicus
ggttcgcgtccgtgacgacgtaaga

SEQ ID NO: 640329 - DNA, 25 bp, Rattus norvegicus
acgacgtaagactgaggccgcaatg

SEQ ID NO: 640330 - DNA, 25 bp, Rattus norvegicus
ccaacgcttcggctaagggagtgta

SEQ ID NO: 640331 - DNA, 25 bp, Rattus norvegicus
cgcaggttcgcgtacatacatgttt

SEQ ID NO: 640332 - DNA, 25 bp, Rattus norvegicus
ttgtagcacatgcacacgcggtgtg

SEQ ID NO: 640333 - DNA, 25 bp, Rattus norvegicus
acggtcccatttgctggagaaattc

SEQ ID NO: 640334 - DNA, 25 bp, Rattus norvegicus
gtgcctcaacttccgcgggcgttta

SEQ ID NO: 640335 - DNA, 25 bp, Rattus norvegicus
aaccttcccgtgcacgtgtctggtg

SEQ ID NO: 640336 - DNA, 25 bp, Rattus norvegicus
gcgtttaaatagcagcggggctccc

SEQ ID NO: 640337 - DNA, 25 bp, Rattus norvegicus
tttggcaccatctgcaaattgtggg

SEQ ID NO: 640338 - DNA, 25 bp, Rattus norvegicus
cggactgcagattgcaacctttggc

SEQ ID NO: 640339 - DNA, 25 bp, Rattus norvegicus
catcggtgaaattgggaaggacttc

SEQ ID NO: 640340 - DNA, 25 bp, Rattus norvegicus
tgagaccttttacttccagcgagac

SEQ ID NO: 640341 - DNA, 25 bp, Rattus norvegicus
ctcggcttaggcttgcaaatgcggg

SEQ ID NO: 640342 - DNA, 25 bp, Rattus norvegicus
tacatctgtgtgaagtggccgcagc

SEQ ID NO: 640343 - DNA, 25 bp, Rattus norvegicus
agccctggttcttgtcaccgcgtca

SEQ ID NO: 640344 - DNA, 25 bp, Rattus norvegicus
accggtaataggtgacctggcgctc

SEQ ID NO: 640345 - DNA, 25 bp, Rattus norvegicus
ggtgaattgctgtgagcaaacaaca

SEQ ID NO: 640346 - DNA, 25 bp, Rattus norvegicus
acacccgacatcctcactctgaccg

SEQ ID NO: 640347 - DNA, 25 bp, Rattus norvegicus
atcctcactctgaccgcctctgcgg

SEQ ID NO: 640348 - DNA, 25 bp, Rattus norvegicus
ctgaccgcctctgcggcccacggct

SEQ ID NO: 640349 - DNA, 25 bp, Rattus norvegicus
gcccacggctttccgggctccgcat

SEQ ID NO: 640350 - DNA, 25 bp, Rattus norvegicus
ccgcttctggctcaggcttcacacc

SEQ ID NO: 640351 - DNA, 25 bp, Rattus norvegicus
gcactctccgcgctggtgaattgct

SEQ ID NO: 640352 - DNA, 25 bp, Rattus norvegicus
actctccgcgctggtgaattgctgt

SEQ ID NO: 640353 - DNA, 25 bp, Rattus norvegicus
ctccgcgctggtgaattgctgtgag

SEQ ID NO: 640354 - DNA, 25 bp, Rattus norvegicus
cgctggtgaattgctgtgagcaaac

SEQ ID NO: 640355 - DNA, 25 bp, Rattus norvegicus
gaattgctgtgagcaaacaacaaca

SEQ ID NO: 640356 - DNA, 25 bp, Rattus norvegicus
aagcgggcgatttaaatgtgccttc

SEQ ID NO: 640357 - DNA, 25 bp, Rattus norvegicus
cgcgctggtgaattgctgtgagcaa

SEQ ID NO: 640358 - DNA, 25 bp, Rattus norvegicus
cgggcgatttaaatgtgccttcgaa

SEQ ID NO: 640359 - DNA, 25 bp, Rattus norvegicus
acccagacggacagaaagggccgcg

SEQ ID NO: 640360 - DNA, 25 bp, Rattus norvegicus
gtttggcgccttccgcagtggcgca

SEQ ID NO: 640361 - DNA, 25 bp, Rattus norvegicus
ctgagtggattgtttggcgccttcc

SEQ ID NO: 640362 - DNA, 25 bp, Rattus norvegicus
caggtgattggctatctgtcaggcg

SEQ ID NO: 640363 - DNA, 25 bp, Rattus norvegicus
ccggctcctgcaggtgattggctat

SEQ ID NO: 640364 - DNA, 25 bp, Rattus norvegicus
gtcgccgtgcgtcatcgcgctgtct

SEQ ID NO: 640365 - DNA, 25 bp, Rattus norvegicus
ccgaacccaggcgacgcgagtcaga

SEQ ID NO: 640366 - DNA, 25 bp, Rattus norvegicus
ctcgaccggacccagacggacagaa

SEQ ID NO: 640367 - DNA, 25 bp, Rattus norvegicus
agggcgccgagttcccgtcagaccg

SEQ ID NO: 640368 - DNA, 25 bp, Rattus norvegicus
tcggcccgccctgcgactttgaaag

SEQ ID NO: 640369 - DNA, 25 bp, Rattus norvegicus
ccctgcgactttgaaagcagtgccc

SEQ ID NO: 640370 - DNA, 25 bp, Rattus norvegicus
ggcgcggaggcatcggcatcccact

SEQ ID NO: 640371 - DNA, 25 bp, Rattus norvegicus
ccgttccttggagacggtgacgccg

SEQ ID NO: 640372 - DNA, 25 bp, Rattus norvegicus
gacgcgagtcagacttcgctccgcg

SEQ ID NO: 640373 - DNA, 25 bp, Rattus norvegicus
ccttgtcgattggttggcagaatga

SEQ ID NO: 640374 - DNA, 25 bp, Rattus norvegicus
agctcagaaactgccagccgagatc

SEQ ID NO: 640375 - DNA, 25 bp, Rattus norvegicus
gcaaaaacagagaagccgagcgctc

SEQ ID NO: 640376 - DNA, 25 bp, Rattus norvegicus
agaatgagggcgctgcgcaaaaaca

SEQ ID NO: 640377 - DNA, 25 bp, Rattus norvegicus
tctctcggtgggtggtgctccttgt

SEQ ID NO: 640378 - DNA, 25 bp, Rattus norvegicus
ccaacgaacagtctctcggtgggtg

SEQ ID NO: 640379 - DNA, 25 bp, Rattus norvegicus
tgacggccactttacccaacgaaca

SEQ ID NO: 640380 - DNA, 25 bp, Rattus norvegicus
tgacgtaactacttgacggccactt

SEQ ID NO: 640381 - DNA, 25 bp, Rattus norvegicus
gcctggctgacgtgtgacgtaacta

SEQ ID NO: 640382 - DNA, 25 bp, Rattus norvegicus
ctcgggcagccaaagcgagagttct

SEQ ID NO: 640383 - DNA, 25 bp, Rattus norvegicus
gacctgcgggctgttcttgctctca

SEQ ID NO: 640384 - DNA, 25 bp, Rattus norvegicus
ggctgttcttgctctcacactcaca

SEQ ID NO: 640385 - DNA, 25 bp, Rattus norvegicus
gctccttgtcgattggttggcagaa

SEQ ID NO: 640386 - DNA, 25 bp, Rattus norvegicus
ccgagcgctcggagctcagaaactg

SEQ ID NO: 640387 - DNA, 25 bp, Rattus norvegicus
ttcgcggtacgcctgtgtctgcgcg

SEQ ID NO: 640388 - DNA, 25 bp, Rattus norvegicus
gggtcccgcgggctgctcaacgatt

SEQ ID NO: 640389 - DNA, 25 bp, Rattus norvegicus
ggctgctcaacgattggctaaagga

SEQ ID NO: 640390 - DNA, 25 bp, Rattus norvegicus
ctcaacgattggctaaaggaactgt

SEQ ID NO: 640391 - DNA, 25 bp, Rattus norvegicus
attggctaaaggaactgtgcgtgca

SEQ ID NO: 640392 - DNA, 25 bp, Rattus norvegicus
ctaaaggaactgtgcgtgcagctcc

SEQ ID NO: 640393 - DNA, 25 bp, Rattus norvegicus
aaggaactgtgcgtgcagctccgcc

SEQ ID NO: 640394 - DNA, 25 bp, Rattus norvegicus
cgaggggcgggcctagatgccgaca

SEQ ID NO: 640395 - DNA, 25 bp, Rattus norvegicus
atgccgacagccacctcattggcta

SEQ ID NO: 640396 - DNA, 25 bp, Rattus norvegicus
ccacctcattggctaccgcgcggcg

SEQ ID NO: 640397 - DNA, 25 bp, Rattus norvegicus
ccgaggccgggttcgaggcctagtg

SEQ ID NO: 640398 - DNA, 25 bp, Rattus norvegicus
cggggcaatgtttcgcggtacgcct

SEQ ID NO: 640399 - DNA, 25 bp, Rattus norvegicus
gcgggctgctcaacgattggctaaa

SEQ ID NO: 640400 - DNA, 25 bp, Rattus norvegicus
caatgtttcgcggtacgcctgtgtc

SEQ ID NO: 640401 - DNA, 25 bp, Rattus norvegicus
gagatctcagaaagcgccacgccag

SEQ ID NO: 640402 - DNA, 25 bp, Rattus norvegicus
gagaagccactggaccgagaacagc

SEQ ID NO: 640403 - DNA, 25 bp, Rattus norvegicus
cgcagagctggtcctggagaagcca

SEQ ID NO: 640404 - DNA, 25 bp, Rattus norvegicus
tggcaaccgattcgcagagctggtc

SEQ ID NO: 640405 - DNA, 25 bp, Rattus norvegicus
gacccagggagatggcaaccgattc

SEQ ID NO: 640406 - DNA, 25 bp, Rattus norvegicus
ccaaacagctacttctcactagacg

SEQ ID NO: 640407 - DNA, 25 bp, Rattus norvegicus
tggggactaactccttgcgagacta

SEQ ID NO: 640408 - DNA, 25 bp, Rattus norvegicus
gaccgagaacagcaagcggtgcacc

SEQ ID NO: 640409 - DNA, 25 bp, Rattus norvegicus
cttggagagcgccttcgacccagac

SEQ ID NO: 640410 - DNA, 25 bp, Rattus norvegicus
ctcactagacgtacagacccaggga

SEQ ID NO: 640411 - DNA, 25 bp, Rattus norvegicus
gacctgacggtggagatctcagaaa

SEQ ID NO: 640412 - DNA, 25 bp, Rattus norvegicus
tcgacccagacgtggggactaactc

SEQ ID NO: 640413 - DNA, 25 bp, Rattus norvegicus
agcggtgcaccgctacgtgctgacc

SEQ ID NO: 640414 - DNA, 25 bp, Rattus norvegicus
tccttgcgagactacgagataaccc

SEQ ID NO: 640415 - DNA, 25 bp, Rattus norvegicus
aggacatggccccacgaccgccgcc

SEQ ID NO: 640416 - DNA, 25 bp, Rattus norvegicus
gtgcccaggacatggccccacgacc

SEQ ID NO: 640417 - DNA, 25 bp, Rattus norvegicus
agagggtgcccaggacatggcccca

SEQ ID NO: 640418 - DNA, 25 bp, Rattus norvegicus
gagggtgcccaggacatggccccac

SEQ ID NO: 640419 - DNA, 25 bp, Rattus norvegicus
agggtgcccaggacatggccccacg

SEQ ID NO: 640420 - DNA, 25 bp, Rattus norvegicus
ggtgcccaggacatggccccacgac

SEQ ID NO: 640421 - DNA, 25 bp, Rattus norvegicus
tgcccaggacatggccccacgaccg

SEQ ID NO: 640422 - DNA, 25 bp, Rattus norvegicus
actgtctgactggccagtcaccgac

SEQ ID NO: 640423 - DNA, 25 bp, Rattus norvegicus
gggtgcccaggacatggccccacga

SEQ ID NO: 640424 - DNA, 25 bp, Rattus norvegicus
aacgctccagcaggctccattctag

SEQ ID NO: 640425 - DNA, 25 bp, Rattus norvegicus
ccaggttctgcaaaacggatctcca

SEQ ID NO: 640426 - DNA, 25 bp, Rattus norvegicus
agctacttccgtgggtgtgaggcta

SEQ ID NO: 640427 - DNA, 25 bp, Rattus norvegicus
gcaaggcgtcctttaaagctacttc

SEQ ID NO: 640428 - DNA, 25 bp, Rattus norvegicus
ggaggagacgcaaggcgtcctttaa

SEQ ID NO: 640429 - DNA, 25 bp, Rattus norvegicus
gcccgcacgggacaggaagttcctc

SEQ ID NO: 640430 - DNA, 25 bp, Rattus norvegicus
cggatctccagaaaacgcgagggaa

SEQ ID NO: 640431 - DNA, 25 bp, Rattus norvegicus
tctagagtccacagtacggtcccga

SEQ ID NO: 640432 - DNA, 25 bp, Rattus norvegicus
taacgcctatagacactctagagtc

SEQ ID NO: 640433 - DNA, 25 bp, Rattus norvegicus
gacgctcacaagactcaccataacg

SEQ ID NO: 640434 - DNA, 25 bp, Rattus norvegicus
gaaggttgtcactctgacgctcaca

SEQ ID NO: 640435 - DNA, 25 bp, Rattus norvegicus
tccattctagcaggggcaccaaccg

SEQ ID NO: 640436 - DNA, 25 bp, Rattus norvegicus
gggatcctgccagcggttcatccca

SEQ ID NO: 640437 - DNA, 25 bp, Rattus norvegicus
cgccctttcctcctgaaggttgtca

SEQ ID NO: 640438 - DNA, 25 bp, Rattus norvegicus
cggtgcctacatttacgcggtgagc

SEQ ID NO: 640439 - DNA, 25 bp, Rattus norvegicus
tgcggggcaacgaaatgaacctatt

SEQ ID NO: 640440 - DNA, 25 bp, Rattus norvegicus
ctacctgctcactcgtgtggctgca

SEQ ID NO: 640441 - DNA, 25 bp, Rattus norvegicus
cggcaacgccactgtcaacatcttg

SEQ ID NO: 640442 - DNA, 25 bp, Rattus norvegicus
acgccctgagatccttcgactatga

SEQ ID NO: 640443 - DNA, 25 bp, Rattus norvegicus
gagtgtcttcacctacgtgtccatc

SEQ ID NO: 640444 - DNA, 25 bp, Rattus norvegicus
cgacgaaggggccaatgcaaaatta

SEQ ID NO: 640445 - DNA, 25 bp, Rattus norvegicus
cagaaaacaatgtgcccggtgccta

SEQ ID NO: 640446 - DNA, 25 bp, Rattus norvegicus
agccagccagtctacgacgtgtacg

SEQ ID NO: 640447 - DNA, 25 bp, Rattus norvegicus
tgtgaatgacaatgcgccgcgcttc

SEQ ID NO: 640448 - DNA, 25 bp, Rattus norvegicus
tccaccagtaagtcgatccaggttc

SEQ ID NO: 640449 - DNA, 25 bp, Rattus norvegicus
tggggactcctataccctgactgtg

SEQ ID NO: 640450 - DNA, 25 bp, Rattus norvegicus
aacctattccgactggactggcgca

SEQ ID NO: 640451 - DNA, 25 bp, Rattus norvegicus
ctagagtgccagatccagggaatga

SEQ ID NO: 640452 - DNA, 25 bp, Rattus norvegicus
ttccaaatccgaagctgctggagtc

SEQ ID NO: 640453 - DNA, 25 bp, Rattus norvegicus
tgtgttgaatcgcttccagccaatc

SEQ ID NO: 640454 - DNA, 25 bp, Rattus norvegicus
gtgttgaatcgcttccagccaatca

SEQ ID NO: 640455 - DNA, 25 bp, Rattus norvegicus
ccaatcagcgagcttccaaatccga

SEQ ID NO: 640456 - DNA, 25 bp, Rattus norvegicus
caatcagcgagcttccaaatccgaa

SEQ ID NO: 640457 - DNA, 25 bp, Rattus norvegicus
atcagcgagcttccaaatccgaagc

SEQ ID NO: 640458 - DNA, 25 bp, Rattus norvegicus
cagcgagcttccaaatccgaagctg

SEQ ID NO: 640459 - DNA, 25 bp, Rattus norvegicus
gagcttccaaatccgaagctgctgg

SEQ ID NO: 640460 - DNA, 25 bp, Rattus norvegicus
tccaaatccgaagctgctggagtca

SEQ ID NO: 640461 - DNA, 25 bp, Rattus norvegicus
ccaaatccgaagctgctggagtcac

SEQ ID NO: 640462 - DNA, 25 bp, Rattus norvegicus
caaatccgaagctgctggagtcacc

SEQ ID NO: 640463 - DNA, 25 bp, Rattus norvegicus
aaatccgaagctgctggagtcaccg

SEQ ID NO: 640464 - DNA, 25 bp, Rattus norvegicus
atccactttctccaagcgtgccgcg

SEQ ID NO: 640465 - DNA, 25 bp, Rattus norvegicus
gcgagcttccaaatccgaagctgct

SEQ ID NO: 640466 - DNA, 25 bp, Rattus norvegicus
ccaccttcatgatctggatggagtg

SEQ ID NO: 640467 - DNA, 25 bp, Rattus norvegicus
tcatgatctggatggagtgcgcacc

SEQ ID NO: 640468 - DNA, 25 bp, Rattus norvegicus
tctggatggagtgcgcaccggcaca

SEQ ID NO: 640469 - DNA, 25 bp, Rattus norvegicus
accggcacagtgtccggcatccatg

SEQ ID NO: 640470 - DNA, 25 bp, Rattus norvegicus
cggcatccatgtcgtggtagcactc

SEQ ID NO: 640471 - DNA, 25 bp, Rattus norvegicus
tggtcaggttgggtattctcggtac

SEQ ID NO: 640472 - DNA, 25 bp, Rattus norvegicus
tcaggttgggtattctcggtacacg

SEQ ID NO: 640473 - DNA, 25 bp, Rattus norvegicus
gttgcagtctcttccaccttcatga

SEQ ID NO: 640474 - DNA, 25 bp, Rattus norvegicus
cggcactcgccggttgcagtctctt

SEQ ID NO: 640475 - DNA, 25 bp, Rattus norvegicus
tggccagcggcactcgccggttgca

SEQ ID NO: 640476 - DNA, 25 bp, Rattus norvegicus
cgtggaactgcttgacagctggcca

SEQ ID NO: 640477 - DNA, 25 bp, Rattus norvegicus
tttgatcttggagacgtggaactgc

SEQ ID NO: 640478 - DNA, 25 bp, Rattus norvegicus
ggcaatgggaatttgatcttggaga

SEQ ID NO: 640479 - DNA, 25 bp, Rattus norvegicus
tccatgtcgtggtagcactctgtga

SEQ ID NO: 640480 - DNA, 25 bp, Rattus norvegicus
tgcagccgcctcagaagtagtcagc

SEQ ID NO: 640481 - DNA, 25 bp, Rattus norvegicus
ctctagtccagagggttcattcccg

SEQ ID NO: 640482 - DNA, 25 bp, Rattus norvegicus
ccgtggacaatctactgtctctctc

SEQ ID NO: 640483 - DNA, 25 bp, Rattus norvegicus
taacgaattcctgcggcgttggcca

SEQ ID NO: 640484 - DNA, 25 bp, Rattus norvegicus
gggctcacggaacgcctctctaacg

SEQ ID NO: 640485 - DNA, 25 bp, Rattus norvegicus
ccagcctgtggacgcttccattgca

SEQ ID NO: 640486 - DNA, 25 bp, Rattus norvegicus
caacccgggattcccagcctgtgga

SEQ ID NO: 640487 - DNA, 25 bp, Rattus norvegicus
actcagcgctggaaccaacccggga

SEQ ID NO: 640488 - DNA, 25 bp, Rattus norvegicus
tccgaggacgttctcacagacacgc

SEQ ID NO: 640489 - DNA, 25 bp, Rattus norvegicus
ctgctgtcagtttccgcacctcgtg

SEQ ID NO: 640490 - DNA, 25 bp, Rattus norvegicus
agtagtcagcgcttcccggtagcta

SEQ ID NO: 640491 - DNA, 25 bp, Rattus norvegicus
cgcacctcgtgcttgggaagcggat

SEQ ID NO: 640492 - DNA, 25 bp, Rattus norvegicus
gcccggcatgtatcagagcccgcgg

SEQ ID NO: 640493 - DNA, 25 bp, Rattus norvegicus
agctaatctccattaccgccacgga

SEQ ID NO: 640494 - DNA, 25 bp, Rattus norvegicus
acttcctgatttgtcgcctccatta

SEQ ID NO: 640495 - DNA, 25 bp, Rattus norvegicus
tgcacggatgcaccggagaaagttc

SEQ ID NO: 640496 - DNA, 25 bp, Rattus norvegicus
ttgacttacaccctgagcagcggcg

SEQ ID NO: 640497 - DNA, 25 bp, Rattus norvegicus
ggaactgctgcttcacattgactta

SEQ ID NO: 640498 - DNA, 25 bp, Rattus norvegicus
tcgccatgtttatcccggggctgga

SEQ ID NO: 640499 - DNA, 25 bp, Rattus norvegicus
tgggtccctcatgcagagacgtcgc

SEQ ID NO: 640500 - DNA, 25 bp, Rattus norvegicus
cagcccggatccgaggcaggttact

SEQ ID NO: 640501 - DNA, 25 bp, Rattus norvegicus
ttaccggcccggatgagcagatcca

SEQ ID NO: 640502 - DNA, 25 bp, Rattus norvegicus
ggcaggttactctccaaggtgatca

SEQ ID NO: 640503 - DNA, 25 bp, Rattus norvegicus
gcggggacaacagctccgctcactt

SEQ ID NO: 640504 - DNA, 25 bp, Rattus norvegicus
ggaagtggcctcaggaccgttactc

SEQ ID NO: 640505 - DNA, 25 bp, Rattus norvegicus
ggctgcacggaatacacgcggtgtc

SEQ ID NO: 640506 - DNA, 25 bp, Rattus norvegicus
cgctcctcgctttcatctactgttg

SEQ ID NO: 640507 - DNA, 25 bp, Rattus norvegicus
agcagatccagctggttcgtgggtc

SEQ ID NO: 640508 - DNA, 25 bp, Rattus norvegicus
gcagcaccgcgcttaccgacccaag

SEQ ID NO: 640509 - DNA, 25 bp, Rattus norvegicus
cagcaccgcgcttaccgacccaagc

SEQ ID NO: 640510 - DNA, 25 bp, Rattus norvegicus
caaacaccgcgcagcaccgcgctta

SEQ ID NO: 640511 - DNA, 25 bp, Rattus norvegicus
gcttaccgacccaagcaaacaccgc

SEQ ID NO: 640512 - DNA, 25 bp, Rattus norvegicus
aaacaccgcgcagcaccgcgcttac

SEQ ID NO: 640513 - DNA, 25 bp, Rattus norvegicus
cgcgcttaccgacccaagcaaacac

SEQ ID NO: 640514 - DNA, 25 bp, Rattus norvegicus
acaccgcgcagcaccgcgcttaccg

SEQ ID NO: 640515 - DNA, 25 bp, Rattus norvegicus
cgcttaccgacccaagcaaacaccg

SEQ ID NO: 640516 - DNA, 25 bp, Rattus norvegicus
agcaaacaccgcgcagcaccgcgct

SEQ ID NO: 640517 - DNA, 25 bp, Rattus norvegicus
aacaccgcgcagcaccgcgcttacc

SEQ ID NO: 640518 - DNA, 25 bp, Rattus norvegicus
gcgcttaccgacccaagcaaacacc

SEQ ID NO: 640519 - DNA, 25 bp, Rattus norvegicus
gcaaacaccgcgcagcaccgcgctt

SEQ ID NO: 640520 - DNA, 25 bp, Rattus norvegicus
ccgcgcttaccgacccaagcaaaca

SEQ ID NO: 640521 - DNA, 25 bp, Rattus norvegicus
cgcagcaccgcgcttaccgacccaa

SEQ ID NO: 640522 - DNA, 25 bp, Rattus norvegicus
ccactctggggtctttgctgtcacc

SEQ ID NO: 640523 - DNA, 25 bp, Rattus norvegicus
tgcaaaataaaactcttgtcggccc

SEQ ID NO: 640524 - DNA, 25 bp, Rattus norvegicus
tgtcggcccgggtgttcagagtccc

SEQ ID NO: 640525 - DNA, 25 bp, Rattus norvegicus
ctctgcactcgaagactaggcgtta

SEQ ID NO: 640526 - DNA, 25 bp, Rattus norvegicus
gggaagtgagggattgcaaaataaa

SEQ ID NO: 640527 - DNA, 25 bp, Rattus norvegicus
tcacaggacctcaaaggaccactct

SEQ ID NO: 640528 - DNA, 25 bp, Rattus norvegicus
cactcgaagactaggcgttagggaa

SEQ ID NO: 640529 - DNA, 25 bp, Rattus norvegicus
cacctcttgggccactctggggtct

SEQ ID NO: 640530 - DNA, 25 bp, Rattus norvegicus
aggtggagacgctcgccactcgtcc

SEQ ID NO: 640531 - DNA, 25 bp, Rattus norvegicus
aacccgcctgctcaggtggagacgc

SEQ ID NO: 640532 - DNA, 25 bp, Rattus norvegicus
gcgcctgtcaaaccgggccggctat

SEQ ID NO: 640533 - DNA, 25 bp, Rattus norvegicus
aggcgacaccgccagtcaccgcagc

SEQ ID NO: 640534 - DNA, 25 bp, Rattus norvegicus
actggcgccgcgaggtaaacagcgc

SEQ ID NO: 640535 - DNA, 25 bp, Rattus norvegicus
caaaggaccactctgcactcgaaga

SEQ ID NO: 640536 - DNA, 25 bp, Rattus norvegicus
cgggaagcagtatccacacgctagc

SEQ ID NO: 640537 - DNA, 25 bp, Rattus norvegicus
ggacgggaaccaccggctccattgc

SEQ ID NO: 640538 - DNA, 25 bp, Rattus norvegicus
acaagtgacattgggctgaggccta

SEQ ID NO: 640539 - DNA, 25 bp, Rattus norvegicus
cggcgcactgaaaaccggggagata

SEQ ID NO: 640540 - DNA, 25 bp, Rattus norvegicus
cggcgcctcgcttgtttttctgcaa

SEQ ID NO: 640541 - DNA, 25 bp, Rattus norvegicus
cgcgaatctgtcagtggctgtcggc

SEQ ID NO: 640542 - DNA, 25 bp, Rattus norvegicus
cacgctagctgaagggaaacacttg

SEQ ID NO: 640543 - DNA, 25 bp, Rattus norvegicus
ctcggtgtagatcccgggaagcagt

SEQ ID NO: 640544 - DNA, 25 bp, Rattus norvegicus
cgggagagaccttcccttgcttggg

SEQ ID NO: 640545 - DNA, 25 bp, Rattus norvegicus
cccgcaaccgttggagcagcggagc

SEQ ID NO: 640546 - DNA, 25 bp, Rattus norvegicus
gcccgtcttcgggataccggcagct

SEQ ID NO: 640547 - DNA, 25 bp, Rattus norvegicus
ggcgtgcaacactggctggattaga

SEQ ID NO: 640548 - DNA, 25 bp, Rattus norvegicus
tttaacagccctgaccaatcgccgg

SEQ ID NO: 640549 - DNA, 25 bp, Rattus norvegicus
gtgcggttacttttgcgcgaatctg

SEQ ID NO: 640550 - DNA, 25 bp, Rattus norvegicus
gatctcccagacacggaaacaaccg

SEQ ID NO: 640551 - DNA, 25 bp, Rattus norvegicus
gggtaggacagtctccgtttccgca

SEQ ID NO: 640552 - DNA, 25 bp, Rattus norvegicus
agcctctgtaccgaacgttgcagta

SEQ ID NO: 640553 - DNA, 25 bp, Rattus norvegicus
cagtagagtcctgacttccgcttca

SEQ ID NO: 640554 - DNA, 25 bp, Rattus norvegicus
ggcgctcccggagactagctaacca

SEQ ID NO: 640555 - DNA, 25 bp, Rattus norvegicus
taaccaacgcgtggacactagggcc

SEQ ID NO: 640556 - DNA, 25 bp, Rattus norvegicus
tgccgggcatcgatgttcagatctc

SEQ ID NO: 640557 - DNA, 25 bp, Rattus norvegicus
gcagctcctccatgtcaggtcctga

SEQ ID NO: 640558 - DNA, 25 bp, Rattus norvegicus
gctgtaagaaccactttccgccttc

SEQ ID NO: 640559 - DNA, 25 bp, Rattus norvegicus
ctgggcgaaccagcgacaaaagaga

SEQ ID NO: 640560 - DNA, 25 bp, Rattus norvegicus
agtgctgagctccaccgtgacgagt

SEQ ID NO: 640561 - DNA, 25 bp, Rattus norvegicus
cgtgacgagtcagctgatacaggtc

SEQ ID NO: 640562 - DNA, 25 bp, Rattus norvegicus
gatacaggtcatgtgatctcccaga

SEQ ID NO: 640563 - DNA, 25 bp, Rattus norvegicus
caaccgcacgtgtctctaaagggcc

SEQ ID NO: 640564 - DNA, 25 bp, Rattus norvegicus
acccatggagaagagtggggcactc

SEQ ID NO: 640565 - DNA, 25 bp, Rattus norvegicus
cgccagagtcttagacacagccctg

SEQ ID NO: 640566 - DNA, 25 bp, Rattus norvegicus
ccagagtcttagacacagccctgcg

SEQ ID NO: 640567 - DNA, 25 bp, Rattus norvegicus
acagccctgcggagatacatcgccg

SEQ ID NO: 640568 - DNA, 25 bp, Rattus norvegicus
ccctgcggagatacatcgccggatg

SEQ ID NO: 640569 - DNA, 25 bp, Rattus norvegicus
tgcggagatacatcgccggatgcgc

SEQ ID NO: 640570 - DNA, 25 bp, Rattus norvegicus
tacatcgccggatgcgctgagatgc

SEQ ID NO: 640571 - DNA, 25 bp, Rattus norvegicus
atgcgctgagatgcggcagccgaac

SEQ ID NO: 640572 - DNA, 25 bp, Rattus norvegicus
ctgagatgcggcagccgaacaagca

SEQ ID NO: 640573 - DNA, 25 bp, Rattus norvegicus
gcggcagccgaacaagcaacccaga

SEQ ID NO: 640574 - DNA, 25 bp, Rattus norvegicus
ggcagccgaacaagcaacccagact

SEQ ID NO: 640575 - DNA, 25 bp, Rattus norvegicus
tgggactcgagatcccgtgcgtccc

SEQ ID NO: 640576 - DNA, 25 bp, Rattus norvegicus
agagtggggcactcaccgtccttcc

SEQ ID NO: 640577 - DNA, 25 bp, Rattus norvegicus
gggcagcgccagagtcttagacaca

SEQ ID NO: 640578 - DNA, 25 bp, Rattus norvegicus
gcgcatctccggcaggtaccgcaga

SEQ ID NO: 640579 - DNA, 25 bp, Rattus norvegicus
gccagcagccgcgaaaacgagcgca

SEQ ID NO: 640580 - DNA, 25 bp, Rattus norvegicus
cgaaaacgagcgcagtactacgggc

SEQ ID NO: 640581 - DNA, 25 bp, Rattus norvegicus
agcgcagtactacgggcggcgccat

SEQ ID NO: 640582 - DNA, 25 bp, Rattus norvegicus
ctcgcggacggtgaaggtcactgca

SEQ ID NO: 640583 - DNA, 25 bp, Rattus norvegicus
aaggtcactgcaggacggcctggac

SEQ ID NO: 640584 - DNA, 25 bp, Rattus norvegicus
gcgacctcctcctactacagagatt

SEQ ID NO: 640585 - DNA, 25 bp, Rattus norvegicus
acagagattccagtgtggctcatgc

SEQ ID NO: 640586 - DNA, 25 bp, Rattus norvegicus
tcatgctgggtgaggataggctaaa

SEQ ID NO: 640587 - DNA, 25 bp, Rattus norvegicus
gccgaatgggcctgaaaagacactc

SEQ ID NO: 640588 - DNA, 25 bp, Rattus norvegicus
gaaaagacactcacagcagctcggc

SEQ ID NO: 640589 - DNA, 25 bp, Rattus norvegicus
tcctcttctcgctttgctcgttttg

SEQ ID NO: 640590 - DNA, 25 bp, Rattus norvegicus
cggcgccatgttgcgcttcaggctc

SEQ ID NO: 640591 - DNA, 25 bp, Rattus norvegicus
ctttgctcgttttgccgagcgggca

SEQ ID NO: 640592 - DNA, 25 bp, Rattus norvegicus
aaagccctccgagtccgccattttg

SEQ ID NO: 640593 - DNA, 25 bp, Rattus norvegicus
cgcccaaggagaacgcgctcttcaa

SEQ ID NO: 640594 - DNA, 25 bp, Rattus norvegicus
tcaaggctgaagtgagctcggaaac

SEQ ID NO: 640595 - DNA, 25 bp, Rattus norvegicus
gtgaaccgccgacggagacccgtga

SEQ ID NO: 640596 - DNA, 25 bp, Rattus norvegicus
gtcggtcttttcagttaccacgtga

SEQ ID NO: 640597 - DNA, 25 bp, Rattus norvegicus
gtctcactggtagccgggcctgtca

SEQ ID NO: 640598 - DNA, 25 bp, Rattus norvegicus
attttggctgcctctgtcggtcttt

SEQ ID NO: 640599 - DNA, 25 bp, Rattus norvegicus
aactcataatctgccgctccgcaga

SEQ ID NO: 640600 - DNA, 25 bp, Rattus norvegicus
gcaggaccggcagagccaactcata

SEQ ID NO: 640601 - DNA, 25 bp, Rattus norvegicus
gcggagcgcattctttcgtctcgcc

SEQ ID NO: 640602 - DNA, 25 bp, Rattus norvegicus
gcgctcttcaagaggatcttggtga

SEQ ID NO: 640603 - DNA, 25 bp, Rattus norvegicus
ggctgaggcaggactcattcattgc

SEQ ID NO: 640604 - DNA, 25 bp, Rattus norvegicus
ttcattgcttgaacgcgcttctccc

SEQ ID NO: 640605 - DNA, 25 bp, Rattus norvegicus
tcctagaacgaagggaggagcagcc

SEQ ID NO: 640606 - DNA, 25 bp, Rattus norvegicus
ccttcgctagcgaggagcaactggc

SEQ ID NO: 640607 - DNA, 25 bp, Rattus norvegicus
gggaaccaggatcactgcagccgca

SEQ ID NO: 640608 - DNA, 25 bp, Rattus norvegicus
ctggccgtgtcagtgcagacagtga

SEQ ID NO: 640609 - DNA, 25 bp, Rattus norvegicus
tgtaccacaacagcagccagaagcg

SEQ ID NO: 640610 - DNA, 25 bp, Rattus norvegicus
cagaagcggcactggaccttcgcta

SEQ ID NO: 640611 - DNA, 25 bp, Rattus norvegicus
gagtgtcgctgtttctgtctcggcc

SEQ ID NO: 640612 - DNA, 25 bp, Rattus norvegicus
cgacagtcaagtcccgggcgagtaa

SEQ ID NO: 640613 - DNA, 25 bp, Rattus norvegicus
cttgtaaaccgctcacctggccgtg

SEQ ID NO: 640614 - DNA, 25 bp, Rattus norvegicus
cctgccggctggaagcttgtaaacc

SEQ ID NO: 640615 - DNA, 25 bp, Rattus norvegicus
aagccttgatagagtgcggatttta

SEQ ID NO: 640616 - DNA, 25 bp, Rattus norvegicus
gggaccctcctgaagtctcgctttg

SEQ ID NO: 640617 - DNA, 25 bp, Rattus norvegicus
ttcaagtgcaaagctgtggctaacg

SEQ ID NO: 640618 - DNA, 25 bp, Rattus norvegicus
gggccgacgccaaccgcaaattcaa

SEQ ID NO: 640619 - DNA, 25 bp, Rattus norvegicus
cgggcgagtaacatcctagggaata

SEQ ID NO: 640620 - DNA, 25 bp, Rattus norvegicus
cccactggaggaagcggtgagcaac

SEQ ID NO: 640621 - DNA, 25 bp, Rattus norvegicus
aggcgctgtctctaccgagggccac

SEQ ID NO: 640622 - DNA, 25 bp, Rattus norvegicus
cgagccgtggatatcgatggagaac

SEQ ID NO: 640623 - DNA, 25 bp, Rattus norvegicus
gacgtgcctgacttaccgcttctgc

SEQ ID NO: 640624 - DNA, 25 bp, Rattus norvegicus
atcggtgactcgaacgtgggcaaga

SEQ ID NO: 640625 - DNA, 25 bp, Rattus norvegicus
tcaggggcatctggatgtttgcctc

SEQ ID NO: 640626 - DNA, 25 bp, Rattus norvegicus
cttctcatccagctgtgcagtgtca

SEQ ID NO: 640627 - DNA, 25 bp, Rattus norvegicus
cgtcgctggaggtcagcttctcatc

SEQ ID NO: 640628 - DNA, 25 bp, Rattus norvegicus
agctgggcgttgtgtatcactgcca

SEQ ID NO: 640629 - DNA, 25 bp, Rattus norvegicus
gcgccggcaggcagagatctactgc

SEQ ID NO: 640630 - DNA, 25 bp, Rattus norvegicus
tctttccaggtacactgcgccggca

SEQ ID NO: 640631 - DNA, 25 bp, Rattus norvegicus
gatcgccgacgcatctttccaggta

SEQ ID NO: 640632 - DNA, 25 bp, Rattus norvegicus
cgcagtccagtcagggatcgccgac

SEQ ID NO: 640633 - DNA, 25 bp, Rattus norvegicus
gtgagcaacggagatacgcagaccc

SEQ ID NO: 640634 - DNA, 25 bp, Rattus norvegicus
tcactcttggtgctttcggcccagg

SEQ ID NO: 640635 - DNA, 25 bp, Rattus norvegicus
gtgctaggcagcgttgcaactccca

SEQ ID NO: 640636 - DNA, 25 bp, Rattus norvegicus
cgcaaggactaaggccaaggtgcta

SEQ ID NO: 640637 - DNA, 25 bp, Rattus norvegicus
gttcactgttcaccagccacgcggt

SEQ ID NO: 640638 - DNA, 25 bp, Rattus norvegicus
gccgagtcgcagaccatcactcttg

SEQ ID NO: 640639 - DNA, 25 bp, Rattus norvegicus
tggagaaaagcctgccgtaccttcc

SEQ ID NO: 640640 - DNA, 25 bp, Rattus norvegicus
acctcgtcgtcgctatccatggcag

SEQ ID NO: 640641 - DNA, 25 bp, Rattus norvegicus
agcgaacgcaggagctaagcccttc

SEQ ID NO: 640642 - DNA, 25 bp, Rattus norvegicus
cctctttgttatggagcagctgatc

SEQ ID NO: 640643 - DNA, 25 bp, Rattus norvegicus
tccctccctcgttgattgacagttc

SEQ ID NO: 640644 - DNA, 25 bp, Rattus norvegicus
ctttcccagaagtgaggctccttag

SEQ ID NO: 640645 - DNA, 25 bp, Rattus norvegicus
ccggctgcatttaccttttggcttg

SEQ ID NO: 640646 - DNA, 25 bp, Rattus norvegicus
cgaagtggttgaaacgcagctgctc

SEQ ID NO: 640647 - DNA, 25 bp, Rattus norvegicus
gagcgacccgccatccgcttaggga

SEQ ID NO: 640648 - DNA, 25 bp, Rattus norvegicus
acctgagcctgctagaagagagcga

SEQ ID NO: 640649 - DNA, 25 bp, Rattus norvegicus
cgacaccggtgacccagcgaagtta

SEQ ID NO: 640650 - DNA, 25 bp, Rattus norvegicus
gccctgtcatcaggagcgtggtgcc

SEQ ID NO: 640651 - DNA, 25 bp, Rattus norvegicus
ttcaacaggcagtagcgccgctgtc

SEQ ID NO: 640652 - DNA, 25 bp, Rattus norvegicus
gtggccgcgtctcctggtactctct

SEQ ID NO: 640653 - DNA, 25 bp, Rattus norvegicus
ctgcccaggccggagtttaaccagt

SEQ ID NO: 640654 - DNA, 25 bp, Rattus norvegicus
gcaagaccagttcgtcgcgccgcaa

SEQ ID NO: 640655 - DNA, 25 bp, Rattus norvegicus
tggggcaacctgtcgtacgccgacc

SEQ ID NO: 640656 - DNA, 25 bp, Rattus norvegicus
tcaccaaggccatcgagagctcggc

SEQ ID NO: 640657 - DNA, 25 bp, Rattus norvegicus
ggctcaccctgtcgcagatctacga

SEQ ID NO: 640658 - DNA, 25 bp, Rattus norvegicus
gatggtgaagagtgtgccctacttc

SEQ ID NO: 640659 - DNA, 25 bp, Rattus norvegicus
cgactttatgagcaacctgagcctg

SEQ ID NO: 640660 - DNA, 25 bp, Rattus norvegicus
gtccgctgtcagcaccgactttatg

SEQ ID NO: 640661 - DNA, 25 bp, Rattus norvegicus
cgaagttaagttctgggcgcgtccg

SEQ ID NO: 640662 - DNA, 25 bp, Rattus norvegicus
tgccttgcctgccaaagctggagcc

SEQ ID NO: 640663 - DNA, 25 bp, Rattus norvegicus
agacagtcttcggtgccgcgttgtc

SEQ ID NO: 640664 - DNA, 25 bp, Rattus norvegicus
tctccctggattctcagtgtgtctg

SEQ ID NO: 640665 - DNA, 25 bp, Rattus norvegicus
gaaagacagcaagttgtgctgcgcc

SEQ ID NO: 640666 - DNA, 25 bp, Rattus norvegicus
ggggagcaactttctccctggattc

SEQ ID NO: 640667 - DNA, 25 bp, Rattus norvegicus
tgccgcgttgtctccgccagggaaa

SEQ ID NO: 640668 - DNA, 25 bp, Rattus norvegicus
tgtcgaaggcgaaaaagacagtctt

SEQ ID NO: 640669 - DNA, 25 bp, Rattus norvegicus
atctccgtcgggatagtgtcgaagg

SEQ ID NO: 640670 - DNA, 25 bp, Rattus norvegicus
actcgccttgatctccgtcgggata

SEQ ID NO: 640671 - DNA, 25 bp, Rattus norvegicus
tcagactcgccttgatctccgtcgg

SEQ ID NO: 640672 - DNA, 25 bp, Rattus norvegicus
gctggagccggcatccacggtgctc

SEQ ID NO: 640673 - DNA, 25 bp, Rattus norvegicus
ctgccaaagctggagccggcatcca

SEQ ID NO: 640674 - DNA, 25 bp, Rattus norvegicus
ggcgcgtgccttgcctgccaaagct

SEQ ID NO: 640675 - DNA, 25 bp, Rattus norvegicus
tccgccagggaaagacagcaagttg

SEQ ID NO: 640676 - DNA, 25 bp, Rattus norvegicus
tggcggtgcataattgcgtcttgtg

SEQ ID NO: 640677 - DNA, 25 bp, Rattus norvegicus
ctccgaaaagtacattagttacatc

SEQ ID NO: 640678 - DNA, 25 bp, Rattus norvegicus
tagttacatccgtttcacaagcgtt

SEQ ID NO: 640679 - DNA, 25 bp, Rattus norvegicus
tttcacaagcgttcaggcgtctgcc

SEQ ID NO: 640680 - DNA, 25 bp, Rattus norvegicus
gttcaggcgtctgccgcggatgcct

SEQ ID NO: 640681 - DNA, 25 bp, Rattus norvegicus
cgcggatgcctatgttcccacacta

SEQ ID NO: 640682 - DNA, 25 bp, Rattus norvegicus
cccaactagtctttcgggcaatagc

SEQ ID NO: 640683 - DNA, 25 bp, Rattus norvegicus
taattgcgtcttgtgggcgcgacaa

SEQ ID NO: 640684 - DNA, 25 bp, Rattus norvegicus
ggcgcgacaagcactaccgaaggtc

SEQ ID NO: 640685 - DNA, 25 bp, Rattus norvegicus
gctgcggtgctcgagagccgccctt

SEQ ID NO: 640686 - DNA, 25 bp, Rattus norvegicus
agccgcccttcgtgaggctgtatcc

SEQ ID NO: 640687 - DNA, 25 bp, Rattus norvegicus
cacgtgtcccggatcgctgcggtga

SEQ ID NO: 640688 - DNA, 25 bp, Rattus norvegicus
gcgacttaaggtggcggtgcataat

SEQ ID NO: 640689 - DNA, 25 bp, Rattus norvegicus
tcgggcaatagcgacttaaggtggc

SEQ ID NO: 640690 - DNA, 25 bp, Rattus norvegicus
tagaccacttccagcgcgtccaggg

SEQ ID NO: 640691 - DNA, 25 bp, Rattus norvegicus
agccagtctttgcaggctcctccag

SEQ ID NO: 640692 - DNA, 25 bp, Rattus norvegicus
catggagctggaacccagggtacta

SEQ ID NO: 640693 - DNA, 25 bp, Rattus norvegicus
tcggcgagtatgcaaagccagtctt

SEQ ID NO: 640694 - DNA, 25 bp, Rattus norvegicus
caggcgttagagttccgacagttca

SEQ ID NO: 640695 - DNA, 25 bp, Rattus norvegicus
gggtccttgtagcatgcaggttgca

SEQ ID NO: 640696 - DNA, 25 bp, Rattus norvegicus
ctgggcgactgtgtgagtatagact

SEQ ID NO: 640697 - DNA, 25 bp, Rattus norvegicus
acccagggatagaaatgcagcgcca

SEQ ID NO: 640698 - DNA, 25 bp, Rattus norvegicus
cactatagcttcctcggtagggacc

SEQ ID NO: 640699 - DNA, 25 bp, Rattus norvegicus
gatccagccagacttcgcgaccgaa

SEQ ID NO: 640700 - DNA, 25 bp, Rattus norvegicus
gcagcaccaagtcacgcaacggatc

SEQ ID NO: 640701 - DNA, 25 bp, Rattus norvegicus
tcgttgtctagcacggccactgtgc

SEQ ID NO: 640702 - DNA, 25 bp, Rattus norvegicus
gccgtagtcgcacgcaaaacgcttg

SEQ ID NO: 640703 - DNA, 25 bp, Rattus norvegicus
acgcggcttaccagtgacaggagca

SEQ ID NO: 640704 - DNA, 25 bp, Rattus norvegicus
caattggggttttcgctaatccatc

SEQ ID NO: 640705 - DNA, 25 bp, Rattus norvegicus
tccatctttctcttctgggcccggg

SEQ ID NO: 640706 - DNA, 25 bp, Rattus norvegicus
ccgacgcgaattttaccgtcaattg

SEQ ID NO: 640707 - DNA, 25 bp, Rattus norvegicus
gaagcatctcgcctcctattgggtg

SEQ ID NO: 640708 - DNA, 25 bp, Rattus norvegicus
ctcctattgggtgagcttctgaacc

SEQ ID NO: 640709 - DNA, 25 bp, Rattus norvegicus
tctgaacctggttgcgcacttcctg

SEQ ID NO: 640710 - DNA, 25 bp, Rattus norvegicus
cacttcctggagttgggaacgcgga

SEQ ID NO: 640711 - DNA, 25 bp, Rattus norvegicus
ggacgtcgtctttccgccattgctc

SEQ ID NO: 640712 - DNA, 25 bp, Rattus norvegicus
cgagccctgccgctacctaagtgag

SEQ ID NO: 640713 - DNA, 25 bp, Rattus norvegicus
ggcacgccggacgtgttccatcttt

SEQ ID NO: 640714 - DNA, 25 bp, Rattus norvegicus
gctgattcgtattggcttgcctctc

SEQ ID NO: 640715 - DNA, 25 bp, Rattus norvegicus
catggccggagtgtttccttacaga

SEQ ID NO: 640716 - DNA, 25 bp, Rattus norvegicus
cgctgccggattacatgtcagagga

SEQ ID NO: 640717 - DNA, 25 bp, Rattus norvegicus
cctcgcagtgaaatccgcttttaga

SEQ ID NO: 640718 - DNA, 25 bp, Rattus norvegicus
atcacggacacatctgcaccacagc

SEQ ID NO: 640719 - DNA, 25 bp, Rattus norvegicus
agctcccgaatcacggatgcacctg

SEQ ID NO: 640720 - DNA, 25 bp, Rattus norvegicus
cacggatgcacctgcatcagagctc

SEQ ID NO: 640721 - DNA, 25 bp, Rattus norvegicus
agttcccgcatcacggatgcacctg

SEQ ID NO: 640722 - DNA, 25 bp, Rattus norvegicus
tcacggatgcacctgcaccagagtt

SEQ ID NO: 640723 - DNA, 25 bp, Rattus norvegicus
ctgcatcagagctcccgcatcacgg

SEQ ID NO: 640724 - DNA, 25 bp, Rattus norvegicus
gatgcacctgcaccacagctcccgc

SEQ ID NO: 640725 - DNA, 25 bp, Rattus norvegicus
accacagctcccgaatcacggatgc

SEQ ID NO: 640726 - DNA, 25 bp, Rattus norvegicus
gcatcacggacacatctgcaccaca

SEQ ID NO: 640727 - DNA, 25 bp, Rattus norvegicus
tgcatcagagctcccgcatcacgga

SEQ ID NO: 640728 - DNA, 25 bp, Rattus norvegicus
atcacggatgcacctgcatcagagc

SEQ ID NO: 640729 - DNA, 25 bp, Rattus norvegicus
tgcaccacagctcccgcatcacgga

SEQ ID NO: 640730 - DNA, 25 bp, Rattus norvegicus
gcatcacggatgcacctgcaccaca

SEQ ID NO: 640731 - DNA, 25 bp, Rattus norvegicus
tgcaccagagttcccgcatcacgga

SEQ ID NO: 640732 - DNA, 25 bp, Rattus norvegicus
gcatgtgcacccactcgcgcacgcg

SEQ ID NO: 640733 - DNA, 25 bp, Rattus norvegicus
tccggttaccttgtcattttcaagc

SEQ ID NO: 640734 - DNA, 25 bp, Rattus norvegicus
ccttgtcattttcaagccgcgtttc

SEQ ID NO: 640735 - DNA, 25 bp, Rattus norvegicus
ttttcaagccgcgtttccaggatct

SEQ ID NO: 640736 - DNA, 25 bp, Rattus norvegicus
agccgcgtttccaggatcttgtgca

SEQ ID NO: 640737 - DNA, 25 bp, Rattus norvegicus
gtttccaggatcttgtgcagcttgc

SEQ ID NO: 640738 - DNA, 25 bp, Rattus norvegicus
ggggtcgcgccagccccattgctga

SEQ ID NO: 640739 - DNA, 25 bp, Rattus norvegicus
attgctgaggccattggcggccccg

SEQ ID NO: 640740 - DNA, 25 bp, Rattus norvegicus
ccgctggtgtcagccatcgcggacg

SEQ ID NO: 640741 - DNA, 25 bp, Rattus norvegicus
agccatcgcggacggactggcgtaa

SEQ ID NO: 640742 - DNA, 25 bp, Rattus norvegicus
aacggaagcattgcgcatgtgcacc

SEQ ID NO: 640743 - DNA, 25 bp, Rattus norvegicus
gcatcgcgacccgacaggctttatt

SEQ ID NO: 640744 - DNA, 25 bp, Rattus norvegicus
tcgcgacccgacaggctttattcac

SEQ ID NO: 640745 - DNA, 25 bp, Rattus norvegicus
cggactggcgtaacggaagcattgc

SEQ ID NO: 640746 - DNA, 25 bp, Rattus norvegicus
gggtccgacgtcagcgtgattttaa

SEQ ID NO: 640747 - DNA, 25 bp, Rattus norvegicus
ggacaccttcgacctgtgggagaga

SEQ ID NO: 640748 - DNA, 25 bp, Rattus norvegicus
cagtggggtccttcgcggcccacgt

SEQ ID NO: 640749 - DNA, 25 bp, Rattus norvegicus
ctggtactcaaaccgcgaacagccg

SEQ ID NO: 640750 - DNA, 25 bp, Rattus norvegicus
cagcgtgattttaaaggacaccttc

SEQ ID NO: 640751 - DNA, 25 bp, Rattus norvegicus
cctgtgggagagaacaagaagtcat

SEQ ID NO: 640752 - DNA, 25 bp, Rattus norvegicus
agaagtcattactgtcgagttcggc

SEQ ID NO: 640753 - DNA, 25 bp, Rattus norvegicus
cccgcctagcttccttgatggcagg

SEQ ID NO: 640754 - DNA, 25 bp, Rattus norvegicus
cgagttcggccacggagtcaaggcc

SEQ ID NO: 640755 - DNA, 25 bp, Rattus norvegicus
acgcggggactgacacttacatggt

SEQ ID NO: 640756 - DNA, 25 bp, Rattus norvegicus
ctgacacttacatggtggaaccgcc

SEQ ID NO: 640757 - DNA, 25 bp, Rattus norvegicus
tggaaccgcctggtactcaaaccgc

SEQ ID NO: 640758 - DNA, 25 bp, Rattus norvegicus
ctccagcgcggctatctacagagcg

SEQ ID NO: 640759 - DNA, 25 bp, Rattus norvegicus
ctacagagcgcctgaaaattatgcc

SEQ ID NO: 640760 - DNA, 25 bp, Rattus norvegicus
taagagagggtgcagtctccgcgct

SEQ ID NO: 640761 - DNA, 25 bp, Rattus norvegicus
caaaaaactcggcagtgactacgga

SEQ ID NO: 640762 - DNA, 25 bp, Rattus norvegicus
agattgcaactttgcgggtaagaga

SEQ ID NO: 640763 - DNA, 25 bp, Rattus norvegicus
ccgcggtcacttcagccaccagatt

SEQ ID NO: 640764 - DNA, 25 bp, Rattus norvegicus
agcaccaggcacagcactggtgcca

SEQ ID NO: 640765 - DNA, 25 bp, Rattus norvegicus
tgcgctagcaccaggcacagcactg

SEQ ID NO: 640766 - DNA, 25 bp, Rattus norvegicus
gaactgaccagctgcgctagcacca

SEQ ID NO: 640767 - DNA, 25 bp, Rattus norvegicus
agggtgcagtctccgcgctccagac

SEQ ID NO: 640768 - DNA, 25 bp, Rattus norvegicus
cagtgactacggaaaccccatcgga

SEQ ID NO: 640769 - DNA, 25 bp, Rattus norvegicus
gctccaaaaaactcggcagtgacta

SEQ ID NO: 640770 - DNA, 25 bp, Rattus norvegicus
cccttggaatgctccaaaaaactcg

SEQ ID NO: 640771 - DNA, 25 bp, Rattus norvegicus
cagttctgtgccagctgcgtgggct

SEQ ID NO: 640772 - DNA, 25 bp, Rattus norvegicus
cgcccagttctgtgccagctgcgtg

SEQ ID NO: 640773 - DNA, 25 bp, Rattus norvegicus
ccatcggaactgaccagctgcgcta

SEQ ID NO: 640774 - DNA, 25 bp, Rattus norvegicus
actttacccggcacgctgctgtgta

SEQ ID NO: 640775 - DNA, 25 bp, Rattus norvegicus
cttgatgagagcgatgtctccggca

SEQ ID NO: 640776 - DNA, 25 bp, Rattus norvegicus
cgctaaagaggaagggaagcccgct

SEQ ID NO: 640777 - DNA, 25 bp, Rattus norvegicus
cgcctcggccgccatcatgttgaag

SEQ ID NO: 640778 - DNA, 25 bp, Rattus norvegicus
agctctccaggcagaggaaacaaca

SEQ ID NO: 640779 - DNA, 25 bp, Rattus norvegicus
aacaaaaggagagcgcccgccgccg

SEQ ID NO: 640780 - DNA, 25 bp, Rattus norvegicus
agctccgcagcgctggcttgcttac

SEQ ID NO: 640781 - DNA, 25 bp, Rattus norvegicus
aaagcccggcgcctgcagaaacgct

SEQ ID NO: 640782 - DNA, 25 bp, Rattus norvegicus
cctgcagaaacgctaggcgagtctc

SEQ ID NO: 640783 - DNA, 25 bp, Rattus norvegicus
cacacatgcacaggggcgccaaact

SEQ ID NO: 640784 - DNA, 25 bp, Rattus norvegicus
cgccaaacttcctggctacgctaaa

SEQ ID NO: 640785 - DNA, 25 bp, Rattus norvegicus
tacctgcggctctccggagcgaaac

SEQ ID NO: 640786 - DNA, 25 bp, Rattus norvegicus
gaacccgactcggtagcttgctacc

SEQ ID NO: 640787 - DNA, 25 bp, Rattus norvegicus
ctggcttgcttacgggaagcgacgc

SEQ ID NO: 640788 - DNA, 25 bp, Rattus norvegicus
ggtcttggcgaagccatgcaagttg

SEQ ID NO: 640789 - DNA, 25 bp, Rattus norvegicus
gtgcgcttcccagtccttcttcggg

SEQ ID NO: 640790 - DNA, 25 bp, Rattus norvegicus
tctcacagtccagggcgtagattcc

SEQ ID NO: 640791 - DNA, 25 bp, Rattus norvegicus
ccgtgtgtggtgtaggacatctcac

SEQ ID NO: 640792 - DNA, 25 bp, Rattus norvegicus
ggaaaccgtgtaccttgcgctgctc

SEQ ID NO: 640793 - DNA, 25 bp, Rattus norvegicus
tctccggatgcgcaaacgggaaacc

SEQ ID NO: 640794 - DNA, 25 bp, Rattus norvegicus
gcaagttgtccttcctgccgtcctg

SEQ ID NO: 640795 - DNA, 25 bp, Rattus norvegicus
accttgcagcctgtggctcccatgg

SEQ ID NO: 640796 - DNA, 25 bp, Rattus norvegicus
gcatgagtagcgcacctgccagcct

SEQ ID NO: 640797 - DNA, 25 bp, Rattus norvegicus
cccgaggatgacacgaggaacttgt

SEQ ID NO: 640798 - DNA, 25 bp, Rattus norvegicus
ggaacttgttgccacagcggcagca

SEQ ID NO: 640799 - DNA, 25 bp, Rattus norvegicus
tgctcaacggctgctctcgtgtgta

SEQ ID NO: 640800 - DNA, 25 bp, Rattus norvegicus
cacgtgttgcttggccaccttgcag

SEQ ID NO: 640801 - DNA, 25 bp, Rattus norvegicus
ctcgtgtgtagagcattgcggaccc

SEQ ID NO: 640802 - DNA, 25 bp, Rattus norvegicus
aaaccggccggacaacttgctccag

SEQ ID NO: 640803 - DNA, 25 bp, Rattus norvegicus
tgcttctcccaagttccgggtcttg

SEQ ID NO: 640804 - DNA, 25 bp, Rattus norvegicus
agtagaggtcgatctgcttctccca

SEQ ID NO: 640805 - DNA, 25 bp, Rattus norvegicus
gcccggatctgaagagacgagtaga

SEQ ID NO: 640806 - DNA, 25 bp, Rattus norvegicus
tctcagactgaaggtggtaggtgac

SEQ ID NO: 640807 - DNA, 25 bp, Rattus norvegicus
agcagcccttagttgagttctcaga

SEQ ID NO: 640808 - DNA, 25 bp, Rattus norvegicus
ttccactagcaacgcgccaatcgga

SEQ ID NO: 640809 - DNA, 25 bp, Rattus norvegicus
tgtcgggccttgcacggcctcaaca

SEQ ID NO: 640810 - DNA, 25 bp, Rattus norvegicus
gccggaactccctgttggagctgta

SEQ ID NO: 640811 - DNA, 25 bp, Rattus norvegicus
ccaatcagaactgcggcggccggaa

SEQ ID NO: 640812 - DNA, 25 bp, Rattus norvegicus
tctaagaccctggaaagcgggtgtc

SEQ ID NO: 640813 - DNA, 25 bp, Rattus norvegicus
gcctgctcctgaagctactctaaga

SEQ ID NO: 640814 - DNA, 25 bp, Rattus norvegicus
acttgctccagcgttgtgcctgctc

SEQ ID NO: 640815 - DNA, 25 bp, Rattus norvegicus
atcggcggccattctgcgcgaacga

SEQ ID NO: 640816 - DNA, 25 bp, Rattus norvegicus
acgccgcttccgcaagtgtggagct

SEQ ID NO: 640817 - DNA, 25 bp, Rattus norvegicus
gcacgcactcgcagacacgagttta

SEQ ID NO: 640818 - DNA, 25 bp, Rattus norvegicus
ggaccggtctgcaatcctcagcgga

SEQ ID NO: 640819 - DNA, 25 bp, Rattus norvegicus
ccgtagcttcgtcagttcgcacaga

SEQ ID NO: 640820 - DNA, 25 bp, Rattus norvegicus
cgcgaaatggaaaggggtgactcta

SEQ ID NO: 640821 - DNA, 25 bp, Rattus norvegicus
gcgcgctcgtgcacaaacatcctta

SEQ ID NO: 640822 - DNA, 25 bp, Rattus norvegicus
agccggggtcgatactgttcacaac

SEQ ID NO: 640823 - DNA, 25 bp, Rattus norvegicus
agcgtcccgctcgtacctagttaga

SEQ ID NO: 640824 - DNA, 25 bp, Rattus norvegicus
cctgggttaaacaagtgctgccgga

SEQ ID NO: 640825 - DNA, 25 bp, Rattus norvegicus
tggctccagcccagagcactgtttg

SEQ ID NO: 640826 - DNA, 25 bp, Rattus norvegicus
ttgcgcgcgctaccactcacttgaa

SEQ ID NO: 640827 - DNA, 25 bp, Rattus norvegicus
gtgctgtccctcagcgcctcaatgg

SEQ ID NO: 640828 - DNA, 25 bp, Rattus norvegicus
cagctttgggtctaatcagagcgcc

SEQ ID NO: 640829 - DNA, 25 bp, Rattus norvegicus
ctgccgcgctcattctggtgagacc

SEQ ID NO: 640830 - DNA, 25 bp, Rattus norvegicus
ctggaacacattgcaggacgcgtgg

SEQ ID NO: 640831 - DNA, 25 bp, Rattus norvegicus
ccctcctggctggagctgcgcgcac

SEQ ID NO: 640832 - DNA, 25 bp, Rattus norvegicus
tccagcgcggcgcactcacgcgggc

SEQ ID NO: 640833 - DNA, 25 bp, Rattus norvegicus
ccgaggaggaggctccagcctgact

SEQ ID NO: 640834 - DNA, 25 bp, Rattus norvegicus
tccagcctgactgacgcctctggag

SEQ ID NO: 640835 - DNA, 25 bp, Rattus norvegicus
actgacgcctctggagccgctgtct

SEQ ID NO: 640836 - DNA, 25 bp, Rattus norvegicus
tgcagctacccgcacaaccggagtg

SEQ ID NO: 640837 - DNA, 25 bp, Rattus norvegicus
cactgcgcggacaggtaagcgctgc

SEQ ID NO: 640838 - DNA, 25 bp, Rattus norvegicus
acaggtaagcgctgccatgccgcgg

SEQ ID NO: 640839 - DNA, 25 bp, Rattus norvegicus
ggcactcgggaagcccctgtggtcc

SEQ ID NO: 640840 - DNA, 25 bp, Rattus norvegicus
tggggcttggctctccatggagcct

SEQ ID NO: 640841 - DNA, 25 bp, Rattus norvegicus
tctccatggagcctgggtggtgtct

SEQ ID NO: 640842 - DNA, 25 bp, Rattus norvegicus
catcctggcacctggaacacattgc

SEQ ID NO: 640843 - DNA, 25 bp, Rattus norvegicus
acacattgcaggacgcgtggcccga

SEQ ID NO: 640844 - DNA, 25 bp, Rattus norvegicus
cccgctagcttccaggctgggagga

SEQ ID NO: 640845 - DNA, 25 bp, Rattus norvegicus
tgcaggtcttcgagcctcgtctgcg

SEQ ID NO: 640846 - DNA, 25 bp, Rattus norvegicus
gcagccctcgtaggtgcaggtcttc

SEQ ID NO: 640847 - DNA, 25 bp, Rattus norvegicus
caacagacagcagcaacgattgcgc

SEQ ID NO: 640848 - DNA, 25 bp, Rattus norvegicus
gcgccgcggctttccgcaaacgatt

SEQ ID NO: 640849 - DNA, 25 bp, Rattus norvegicus
ctagacctggcctcagagcgctgtc

SEQ ID NO: 640850 - DNA, 25 bp, Rattus norvegicus
cagctgtcttctcgccggcgagcga

SEQ ID NO: 640851 - DNA, 25 bp, Rattus norvegicus
aacgattgctgaacgctggcagacc

SEQ ID NO: 640852 - DNA, 25 bp, Rattus norvegicus
gtgcaggacagaaccgaatgcgcct

SEQ ID NO: 640853 - DNA, 25 bp, Rattus norvegicus
tgcgcaacagcggtctgagcgcctg

SEQ ID NO: 640854 - DNA, 25 bp, Rattus norvegicus
gggacttcacaagcgatccgccgta

SEQ ID NO: 640855 - DNA, 25 bp, Rattus norvegicus
cgcggcccgtcagcacttgaaaaac

SEQ ID NO: 640856 - DNA, 25 bp, Rattus norvegicus
tcggacacagcttgcgcctccgtga

SEQ ID NO: 640857 - DNA, 25 bp, Rattus norvegicus
gcatcaccagcaccgtcacgggagg

SEQ ID NO: 640858 - DNA, 25 bp, Rattus norvegicus
tctgagctgaggcacaagctggccg

SEQ ID NO: 640859 - DNA, 25 bp, Rattus norvegicus
tggccgcagtgcagacccaattgag

SEQ ID NO: 640860 - DNA, 25 bp, Rattus norvegicus
cacaaccgagatctgctgcgccgaa

SEQ ID NO: 640861 - DNA, 25 bp, Rattus norvegicus
tccagactgggtgagttaccgactc

SEQ ID NO: 640862 - DNA, 25 bp, Rattus norvegicus
agacagctcgggatcgttcccaaca

SEQ ID NO: 640863 - DNA, 25 bp, Rattus norvegicus
ctcctgctggtcaactctgagctga

SEQ ID NO: 640864 - DNA, 25 bp, Rattus norvegicus
aagaacagagcttggagcccgatgc

SEQ ID NO: 640865 - DNA, 25 bp, Rattus norvegicus
atgagcttcgggcacacaaccgaga

SEQ ID NO: 640866 - DNA, 25 bp, Rattus norvegicus
tccgacagctcaaggaggtgacaga

SEQ ID NO: 640867 - DNA, 25 bp, Rattus norvegicus
ccagagaccggtggtgctaaaaaca

SEQ ID NO: 640868 - DNA, 25 bp, Rattus norvegicus
caggtgtccacacagcaggctgaag

SEQ ID NO: 640869 - DNA, 25 bp, Rattus norvegicus
tggctccctcaactgcaggtgtcca

SEQ ID NO: 640870 - DNA, 25 bp, Rattus norvegicus
gagccggcaggcctaaccctgagac

SEQ ID NO: 640871 - DNA, 25 bp, Rattus norvegicus
ttcccaacagctggccaaagaacag

SEQ ID NO: 640872 - DNA, 25 bp, Rattus norvegicus
agcttacaccctggttggaggatga

SEQ ID NO: 640873 - DNA, 25 bp, Rattus norvegicus
gagcacacgagcaggcgagcgcaat

SEQ ID NO: 640874 - DNA, 25 bp, Rattus norvegicus
agctaggacagcaccgcgttctgac

SEQ ID NO: 640875 - DNA, 25 bp, Rattus norvegicus
ctggcagcctaagcgctcaggagct

SEQ ID NO: 640876 - DNA, 25 bp, Rattus norvegicus
catgcgaccaatggctgagagctgg

SEQ ID NO: 640877 - DNA, 25 bp, Rattus norvegicus
gccctctggggccatgcgaccaatg

SEQ ID NO: 640878 - DNA, 25 bp, Rattus norvegicus
ttctgacgagggtggagcttacacc

SEQ ID NO: 640879 - DNA, 25 bp, Rattus norvegicus
cccacggcggtcctagggaatgcac

SEQ ID NO: 640880 - DNA, 25 bp, Rattus norvegicus
tggccctttcttgacgacgtgagcc

SEQ ID NO: 640881 - DNA, 25 bp, Rattus norvegicus
actgatgtgcggatctggactccgg

SEQ ID NO: 640882 - DNA, 25 bp, Rattus norvegicus
tttgctctgtgaccggttcgtttta

SEQ ID NO: 640883 - DNA, 25 bp, Rattus norvegicus
tccggcggccaggtctacagaccag

SEQ ID NO: 640884 - DNA, 25 bp, Rattus norvegicus
gtgctcactgatgtgcggatctgga

SEQ ID NO: 640885 - DNA, 25 bp, Rattus norvegicus
actgcctttgctctgtgaccggttc

SEQ ID NO: 640886 - DNA, 25 bp, Rattus norvegicus
gcccgaagcctcatcgccctggcga

SEQ ID NO: 640887 - DNA, 25 bp, Rattus norvegicus
gggtgccaggcacaccgaaccgcaa

SEQ ID NO: 640888 - DNA, 25 bp, Rattus norvegicus
cgtctgttgaatcagccaatcagca

SEQ ID NO: 640889 - DNA, 25 bp, Rattus norvegicus
cccgagaaccctggctcgggagagc

SEQ ID NO: 640890 - DNA, 25 bp, Rattus norvegicus
atggcggcctgaccactgtggccgc

SEQ ID NO: 640891 - DNA, 25 bp, Rattus norvegicus
tccagcggccttgactagtgcgctc

SEQ ID NO: 640892 - DNA, 25 bp, Rattus norvegicus
caaagccaggggtgccaggcacacc

SEQ ID NO: 640893 - DNA, 25 bp, Rattus norvegicus
ctcctgagccgcaaagccaggggtg

SEQ ID NO: 640894 - DNA, 25 bp, Rattus norvegicus
agcccggggctcctgagccgcaaag

SEQ ID NO: 640895 - DNA, 25 bp, Rattus norvegicus
agcagagccgcttccatgccaaccg

SEQ ID NO: 640896 - DNA, 25 bp, Rattus norvegicus
acccagccgcgtctgttgaatcagc

SEQ ID NO: 640897 - DNA, 25 bp, Rattus norvegicus
actgaggactttcgacccagccgcg

SEQ ID NO: 640898 - DNA, 25 bp, Rattus norvegicus
tgactagtgcgctcgccactgagga

SEQ ID NO: 640899 - DNA, 25 bp, Rattus norvegicus
tggccgccctgaaagggactgttcc

SEQ ID NO: 640900 - DNA, 25 bp, Rattus norvegicus
acctgcagctgtgcgccttccgtgg

SEQ ID NO: 640901 - DNA, 25 bp, Rattus norvegicus
cgcctttggaaggtcagagtgggcc

SEQ ID NO: 640902 - DNA, 25 bp, Rattus norvegicus
cctccgtgcgcctttggaaggtcag

SEQ ID NO: 640903 - DNA, 25 bp, Rattus norvegicus
agcggacctccgtgcgcctttggaa

SEQ ID NO: 640904 - DNA, 25 bp, Rattus norvegicus
ttctcaggctcggagcggacctccg

SEQ ID NO: 640905 - DNA, 25 bp, Rattus norvegicus
ccttccgtgggttctcaggctcgga

SEQ ID NO: 640906 - DNA, 25 bp, Rattus norvegicus
ttcggacctgcagctgtgcgccttc

SEQ ID NO: 640907 - DNA, 25 bp, Rattus norvegicus
tgtttcggacctgcagctgtgcgcc

SEQ ID NO: 640908 - DNA, 25 bp, Rattus norvegicus
cgcaggcgcggtcctacgtggcctg

SEQ ID NO: 640909 - DNA, 25 bp, Rattus norvegicus
agtgggccgaagttcagctccgcgc

SEQ ID NO: 640910 - DNA, 25 bp, Rattus norvegicus
gccggacccagagggcgtcacgcgg

SEQ ID NO: 640911 - DNA, 25 bp, Rattus norvegicus
ccgaagttcagctccgcgccggtgt

SEQ ID NO: 640912 - DNA, 25 bp, Rattus norvegicus
cagggcggcccgtacggagtgcgca

SEQ ID NO: 640913 - DNA, 25 bp, Rattus norvegicus
tcagagtgggccgaagttcagctcc

SEQ ID NO: 640914 - DNA, 25 bp, Rattus norvegicus
gaaagcaaagctgctggcccaccca

SEQ ID NO: 640915 - DNA, 25 bp, Rattus norvegicus
gtctttcgcgcaggcatcaaacaaa

SEQ ID NO: 640916 - DNA, 25 bp, Rattus norvegicus
ttcgcgcaggcatcaaacaaatata

SEQ ID NO: 640917 - DNA, 25 bp, Rattus norvegicus
cgcgcaggcatcaaacaaatatatc

SEQ ID NO: 640918 - DNA, 25 bp, Rattus norvegicus
gcaggcatcaaacaaatatatctta

SEQ ID NO: 640919 - DNA, 25 bp, Rattus norvegicus
atatatcttatcagaggaacgcgcg

SEQ ID NO: 640920 - DNA, 25 bp, Rattus norvegicus
atcttatcagaggaacgcgcgcatc

SEQ ID NO: 640921 - DNA, 25 bp, Rattus norvegicus
cttatcagaggaacgcgcgcatctg

SEQ ID NO: 640922 - DNA, 25 bp, Rattus norvegicus
aggaacgcgcgcatctgtagaaagc

SEQ ID NO: 640923 - DNA, 25 bp, Rattus norvegicus
aacgcgcgcatctgtagaaagcaaa

SEQ ID NO: 640924 - DNA, 25 bp, Rattus norvegicus
cgcgcgcatctgtagaaagcaaagc

SEQ ID NO: 640925 - DNA, 25 bp, Rattus norvegicus
gcgcatctgtagaaagcaaagctgc

SEQ ID NO: 640926 - DNA, 25 bp, Rattus norvegicus
aagcaaagctgctggcccacccaag

SEQ ID NO: 640927 - DNA, 25 bp, Rattus norvegicus
gctgctggcccacccaagcgtctca

SEQ ID NO: 640928 - DNA, 25 bp, Rattus norvegicus
tgcccatgcgtagtcgagccttgca

SEQ ID NO: 640929 - DNA, 25 bp, Rattus norvegicus
ccatgcgtagtcgagccttgcaggc

SEQ ID NO: 640930 - DNA, 25 bp, Rattus norvegicus
cgtagtcgagccttgcaggccagcc

SEQ ID NO: 640931 - DNA, 25 bp, Rattus norvegicus
tcgagccttgcaggccagcccgagg

SEQ ID NO: 640932 - DNA, 25 bp, Rattus norvegicus
cgtgcctggggtgtccacgtcactc

SEQ ID NO: 640933 - DNA, 25 bp, Rattus norvegicus
ggtgtccacgtcactctgcccaggg

SEQ ID NO: 640934 - DNA, 25 bp, Rattus norvegicus
tcccacagtccctgggcgctccctg

SEQ ID NO: 640935 - DNA, 25 bp, Rattus norvegicus
cccgccaagaagctgcagagcagta

SEQ ID NO: 640936 - DNA, 25 bp, Rattus norvegicus
ctgcagagcagtagacgccatggcc

SEQ ID NO: 640937 - DNA, 25 bp, Rattus norvegicus
agtagacgccatggccgacaggatc

SEQ ID NO: 640938 - DNA, 25 bp, Rattus norvegicus
gccatggccgacaggatcagcactg

SEQ ID NO: 640939 - DNA, 25 bp, Rattus norvegicus
cgacaggatcagcactggggagcta

SEQ ID NO: 640940 - DNA, 25 bp, Rattus norvegicus
cgtctcagcacaccctctgcccatg

SEQ ID NO: 640941 - DNA, 25 bp, Rattus norvegicus
ctctgcccatgcgtagtcgagcctt

SEQ ID NO: 640942 - DNA, 25 bp, Rattus norvegicus
ggaacgcgcctttatctgcgtttat

SEQ ID NO: 640943 - DNA, 25 bp, Rattus norvegicus
gccgggtgacttatacccacgacgc

SEQ ID NO: 640944 - DNA, 25 bp, Rattus norvegicus
gctttcctgtccctgagttgttggc

SEQ ID NO: 640945 - DNA, 25 bp, Rattus norvegicus
tgttggcctcacgaagatggcgacc

SEQ ID NO: 640946 - DNA, 25 bp, Rattus norvegicus
atggcgacccaaagtggccttgctc

SEQ ID NO: 640947 - DNA, 25 bp, Rattus norvegicus
agtggccttgctcaaacaaagcccg

SEQ ID NO: 640948 - DNA, 25 bp, Rattus norvegicus
aacaaagcccgcctgccagtgtacg

SEQ ID NO: 640949 - DNA, 25 bp, Rattus norvegicus
cctgccagtgtacgcagtatccgta

SEQ ID NO: 640950 - DNA, 25 bp, Rattus norvegicus
ccgtaccctgcggatagaggactca

SEQ ID NO: 640951 - DNA, 25 bp, Rattus norvegicus
ggactcagaaacacacctcgactag

SEQ ID NO: 640952 - DNA, 25 bp, Rattus norvegicus
tcgactagacccttggtgacccacg

SEQ ID NO: 640953 - DNA, 25 bp, Rattus norvegicus
tgacccacggggtaactgtacaaga

SEQ ID NO: 640954 - DNA, 25 bp, Rattus norvegicus
aaagtggaaagtgaaccgcaggccg

SEQ ID NO: 640955 - DNA, 25 bp, Rattus norvegicus
tctgcgtttatttccggctttcctg

SEQ ID NO: 640956 - DNA, 25 bp, Rattus norvegicus
ctggacgcaatcaactggcgggctc

SEQ ID NO: 640957 - DNA, 25 bp, Rattus norvegicus
ggcgattctcagcagccaggcctca

SEQ ID NO: 640958 - DNA, 25 bp, Rattus norvegicus
cggaccctcctcatagtggctgcga

SEQ ID NO: 640959 - DNA, 25 bp, Rattus norvegicus
catagtggctgcgacgcaccacgga

SEQ ID NO: 640960 - DNA, 25 bp, Rattus norvegicus
gtgaacctccggatactctggccca

SEQ ID NO: 640961 - DNA, 25 bp, Rattus norvegicus
actctggcccaacatgctgctgctg

SEQ ID NO: 640962 - DNA, 25 bp, Rattus norvegicus
catgctgctgctggaagttctccga

SEQ ID NO: 640963 - DNA, 25 bp, Rattus norvegicus
ggaagttctccgagagtcgcagaga

SEQ ID NO: 640964 - DNA, 25 bp, Rattus norvegicus
tcgcagagacggaaggcagaagaaa

SEQ ID NO: 640965 - DNA, 25 bp, Rattus norvegicus
gcagaagaaatgaccgtaccacctc

SEQ ID NO: 640966 - DNA, 25 bp, Rattus norvegicus
tttcttcacgaccttgctatccgga

SEQ ID NO: 640967 - DNA, 25 bp, Rattus norvegicus
ccttgctatccggaacgagaagacc

SEQ ID NO: 640968 - DNA, 25 bp, Rattus norvegicus
agcacggacttcctggacgcaatca

SEQ ID NO: 640969 - DNA, 25 bp, Rattus norvegicus
agatgggaactacagcacggacttc

SEQ ID NO: 640970 - DNA, 25 bp, Rattus norvegicus
agcccggcgaggacagctccagcag

SEQ ID NO: 640971 - DNA, 25 bp, Rattus norvegicus
gtggtgccgtctgaccacagccctg

SEQ ID NO: 640972 - DNA, 25 bp, Rattus norvegicus
tgagcgagtgagacacaagaaaagc

SEQ ID NO: 640973 - DNA, 25 bp, Rattus norvegicus
cacaagaaaagcttgcgcgccaccg

SEQ ID NO: 640974 - DNA, 25 bp, Rattus norvegicus
tgaagctgagcggagaaccgcattt

SEQ ID NO: 640975 - DNA, 25 bp, Rattus norvegicus
gcggagaaccgcatttcaatgagga

SEQ ID NO: 640976 - DNA, 25 bp, Rattus norvegicus
tttcaatgaggaccagctccagcgc

SEQ ID NO: 640977 - DNA, 25 bp, Rattus norvegicus
ggaccagctccagcgcatcagtgca

SEQ ID NO: 640978 - DNA, 25 bp, Rattus norvegicus
tagcggccgcagattccagacgctc

SEQ ID NO: 640979 - DNA, 25 bp, Rattus norvegicus
actcgcaaccggtgcgtgcttagcc

SEQ ID NO: 640980 - DNA, 25 bp, Rattus norvegicus
gctggctagtttggtccgaccagga

SEQ ID NO: 640981 - DNA, 25 bp, Rattus norvegicus
ctcgaaagaaggctgccctgggctg

SEQ ID NO: 640982 - DNA, 25 bp, Rattus norvegicus
gcatcagtgcactagcggccgcaga

SEQ ID NO: 640983 - DNA, 25 bp, Rattus norvegicus
cgttcctcgaaagaaggctgccctg

SEQ ID NO: 640984 - DNA, 25 bp, Rattus norvegicus
tgcttcggtgtttagcttcgcctta

SEQ ID NO: 640985 - DNA, 25 bp, Rattus norvegicus
tccttctgtaggacacagggaacca

SEQ ID NO: 640986 - DNA, 25 bp, Rattus norvegicus
ggatcccgagtccttctgtaggaca

SEQ ID NO: 640987 - DNA, 25 bp, Rattus norvegicus
ttaacccaattaagccgcacagcga

SEQ ID NO: 640988 - DNA, 25 bp, Rattus norvegicus
tcaattagtttgcacagaatgcttc

SEQ ID NO: 640989 - DNA, 25 bp, Rattus norvegicus
ggcctctgttgcatcaattagtttg

SEQ ID NO: 640990 - DNA, 25 bp, Rattus norvegicus
ctcttgctccaagcgaaaatcgttc

SEQ ID NO: 640991 - DNA, 25 bp, Rattus norvegicus
acaccctagtttcgcagtcctcttg

SEQ ID NO: 640992 - DNA, 25 bp, Rattus norvegicus
acagggaaccaaggcctcgaagcta

SEQ ID NO: 640993 - DNA, 25 bp, Rattus norvegicus
tcgaagctacctcgagtcccacagt

SEQ ID NO: 640994 - DNA, 25 bp, Rattus norvegicus
tgctctgagtacagcgcacgcatgg

SEQ ID NO: 640995 - DNA, 25 bp, Rattus norvegicus
aatcgttcgggaaaggcctctgttg

SEQ ID NO: 640996 - DNA, 25 bp, Rattus norvegicus
cgagcccagaaagatgcgccacctg

SEQ ID NO: 640997 - DNA, 25 bp, Rattus norvegicus
ggccaagtattcctgggtgctctga

SEQ ID NO: 640998 - DNA, 25 bp, Rattus norvegicus
gtctgcaaagtggtctccgatgtcc

SEQ ID NO: 640999 - DNA, 25 bp, Rattus norvegicus
taacttcgtggatgacggctccctg

SEQ ID NO: 641000 - DNA, 25 bp, Rattus norvegicus
gtctctctcggacacggattcttta

SEQ ID NO: 641001 - DNA, 25 bp, Rattus norvegicus
gccaagctggtctatcacctgaata

SEQ ID NO: 641002 - DNA, 25 bp, Rattus norvegicus
tggaattcatcaccgcctctggcta

SEQ ID NO: 641003 - DNA, 25 bp, Rattus norvegicus
agcatgtccctctgggtggaattca

SEQ ID NO: 641004 - DNA, 25 bp, Rattus norvegicus
cgcgcaaaatccgttccaggtttca

SEQ ID NO: 641005 - DNA, 25 bp, Rattus norvegicus
catcgccaaaaccatccgtgaagtc

SEQ ID NO: 641006 - DNA, 25 bp, Rattus norvegicus
gcctattgcgagactccggtgtaca

SEQ ID NO: 641007 - DNA, 25 bp, Rattus norvegicus
gctagcagccgcattggatcccaca

SEQ ID NO: 641008 - DNA, 25 bp, Rattus norvegicus
tccaccgaagttggctccagcgcta

SEQ ID NO: 641009 - DNA, 25 bp, Rattus norvegicus
ccctgctgcagctagtcgagagaga

SEQ ID NO: 641010 - DNA, 25 bp, Rattus norvegicus
ctttaagacccgctaggctccatcg

SEQ ID NO: 641011 - DNA, 25 bp, Rattus norvegicus
gagagcgcagcctttcactttaaga

SEQ ID NO: 641012 - DNA, 25 bp, Rattus norvegicus
ggtcctctccgcatcctcttcggcg

SEQ ID NO: 641013 - DNA, 25 bp, Rattus norvegicus
ccctgcctgcggtagcggccactgc

SEQ ID NO: 641014 - DNA, 25 bp, Rattus norvegicus
acgccctgggatcggaccgacaggt

SEQ ID NO: 641015 - DNA, 25 bp, Rattus norvegicus
tcctgagaggaaggacacagcttgc

SEQ ID NO: 641016 - DNA, 25 bp, Rattus norvegicus
aggacacagcttgcgggtcctctcc

SEQ ID NO: 641017 - DNA, 25 bp, Rattus norvegicus
cggcgccgctgttgttgtgaagccc

SEQ ID NO: 641018 - DNA, 25 bp, Rattus norvegicus
atcctcttcggcgtcgccgagcggg

SEQ ID NO: 641019 - DNA, 25 bp, Rattus norvegicus
aaggcgcaatgtcgccgggctcttt

SEQ ID NO: 641020 - DNA, 25 bp, Rattus norvegicus
aatgtcgccgggctctttccactgc

SEQ ID NO: 641021 - DNA, 25 bp, Rattus norvegicus
gggctctttccactgcccggggaga

SEQ ID NO: 641022 - DNA, 25 bp, Rattus norvegicus
agaggctgacacctgcacgtacggg

SEQ ID NO: 641023 - DNA, 25 bp, Rattus norvegicus
ccaccggcgccgctgttgttgtgaa

SEQ ID NO: 641024 - DNA, 25 bp, Rattus norvegicus
gctgacacctgcacgtacgggcgcg

SEQ ID NO: 641025 - DNA, 25 bp, Rattus norvegicus
ccactgcccggggagaggctgacac

SEQ ID NO: 641026 - DNA, 25 bp, Rattus norvegicus
tgaagctatacggttgcagggaccc

SEQ ID NO: 641027 - DNA, 25 bp, Rattus norvegicus
aacgcttttggtacctctcggctga

SEQ ID NO: 641028 - DNA, 25 bp, Rattus norvegicus
tgcggcaggaacgtgaagctatacg

SEQ ID NO: 641029 - DNA, 25 bp, Rattus norvegicus
tgctcaacacgcagcctgccgagga

SEQ ID NO: 641030 - DNA, 25 bp, Rattus norvegicus
cagcaggtgctggaactgctcgaca

SEQ ID NO: 641031 - DNA, 25 bp, Rattus norvegicus
ctctgttggagtacgagaggcagca

SEQ ID NO: 641032 - DNA, 25 bp, Rattus norvegicus
acgccagagtatggcgcctctgttg

SEQ ID NO: 641033 - DNA, 25 bp, Rattus norvegicus
ggcgtttgcagccacctctgttcca

SEQ ID NO: 641034 - DNA, 25 bp, Rattus norvegicus
tactctcagagttggcgtttgcagc

SEQ ID NO: 641035 - DNA, 25 bp, Rattus norvegicus
cacatccggcctactctcagagttg

SEQ ID NO: 641036 - DNA, 25 bp, Rattus norvegicus
gtcctcttgaacttggctcccttcg

SEQ ID NO: 641037 - DNA, 25 bp, Rattus norvegicus
tcggcaggctgtcctcttgaacttg

SEQ ID NO: 641038 - DNA, 25 bp, Rattus norvegicus
ttcttcggctacaatcggcaggctg

SEQ ID NO: 641039 - DNA, 25 bp, Rattus norvegicus
tgagttcaactagatccgccctctg

SEQ ID NO: 641040 - DNA, 25 bp, Rattus norvegicus
agctaccacagcaccatgtcgtccc

SEQ ID NO: 641041 - DNA, 25 bp, Rattus norvegicus
cgtagaggcgaagattcttccaccg

SEQ ID NO: 641042 - DNA, 25 bp, Rattus norvegicus
tgaggaaagccgatcatctcccagt

SEQ ID NO: 641043 - DNA, 25 bp, Rattus norvegicus
cgaagtgaggaaagccgatcatctc

SEQ ID NO: 641044 - DNA, 25 bp, Rattus norvegicus
ttcgaagtgaggaaagccgatcatc

SEQ ID NO: 641045 - DNA, 25 bp, Rattus norvegicus
cgcggacgagtcaccccaacccagt

SEQ ID NO: 641046 - DNA, 25 bp, Rattus norvegicus
agacgtagaggcgaagattcttcca

SEQ ID NO: 641047 - DNA, 25 bp, Rattus norvegicus
atccaccccaagtcgccgcagcagc

SEQ ID NO: 641048 - DNA, 25 bp, Rattus norvegicus
gtcgcgcagctaccacagcaccatg

SEQ ID NO: 641049 - DNA, 25 bp, Rattus norvegicus
gatttctctagtcgcgcagctacca

SEQ ID NO: 641050 - DNA, 25 bp, Rattus norvegicus
agatttctctagtcgcgcagctacc

SEQ ID NO: 641051 - DNA, 25 bp, Rattus norvegicus
ccagatttctctagtcgcgcagcta

SEQ ID NO: 641052 - DNA, 25 bp, Rattus norvegicus
agccagatttctctagtcgcgcagc

SEQ ID NO: 641053 - DNA, 25 bp, Rattus norvegicus
agagccagatttctctagtcgcgca

SEQ ID NO: 641054 - DNA, 25 bp, Rattus norvegicus
tcgcaactttgcacctcttggctgg

SEQ ID NO: 641055 - DNA, 25 bp, Rattus norvegicus
agctgggcttgggattcatgacaga

SEQ ID NO: 641056 - DNA, 25 bp, Rattus norvegicus
gaggatctttttccgccacgagctg

SEQ ID NO: 641057 - DNA, 25 bp, Rattus norvegicus
caccgaggacggattcatctttcta

SEQ ID NO: 641058 - DNA, 25 bp, Rattus norvegicus
tcctgcgtgacgtggatgacttgtt

SEQ ID NO: 641059 - DNA, 25 bp, Rattus norvegicus
aagagtccggactgcggtcgtctaa

SEQ ID NO: 641060 - DNA, 25 bp, Rattus norvegicus
cgcctcccgaactgacgagctggaa

SEQ ID NO: 641061 - DNA, 25 bp, Rattus norvegicus
cggattcccagcagccgaaggcttt

SEQ ID NO: 641062 - DNA, 25 bp, Rattus norvegicus
agcgactgagaagacgtagactagc

SEQ ID NO: 641063 - DNA, 25 bp, Rattus norvegicus
tcatgacagagttgaagagggcttc

SEQ ID NO: 641064 - DNA, 25 bp, Rattus norvegicus
taaggaaatatctctggccagtggc

SEQ ID NO: 641065 - DNA, 25 bp, Rattus norvegicus
tggcctccgagattatgcaactttc

SEQ ID NO: 641066 - DNA, 25 bp, Rattus norvegicus
tcttggctggcgacagacttactta

SEQ ID NO: 641067 - DNA, 25 bp, Rattus norvegicus
gcagctcgtcggtcacgtcatagga

SEQ ID NO: 641068 - DNA, 25 bp, Rattus norvegicus
ggcaaaaagaggctcccgcgtgacg

SEQ ID NO: 641069 - DNA, 25 bp, Rattus norvegicus
tctgtgcaggcaaaaagaggctccc

SEQ ID NO: 641070 - DNA, 25 bp, Rattus norvegicus
cacttccgacctctgtgcaggcaaa

SEQ ID NO: 641071 - DNA, 25 bp, Rattus norvegicus
agtcttctgacttcgccactcggcg

SEQ ID NO: 641072 - DNA, 25 bp, Rattus norvegicus
agcagcatcttagcaagtcttctga

SEQ ID NO: 641073 - DNA, 25 bp, Rattus norvegicus
ctcggacaaatccagcagcatctta

SEQ ID NO: 641074 - DNA, 25 bp, Rattus norvegicus
gtgctccttgtgctcctcggacaaa

SEQ ID NO: 641075 - DNA, 25 bp, Rattus norvegicus
ccgcgctgtccacttgcggcaggaa

SEQ ID NO: 641076 - DNA, 25 bp, Rattus norvegicus
caacggaagtcagcaggccgtgagt

SEQ ID NO: 641077 - DNA, 25 bp, Rattus norvegicus
tcggcgaccactgcaacggaagtca

SEQ ID NO: 641078 - DNA, 25 bp, Rattus norvegicus
caaactcggcgaccactgcaacgga

SEQ ID NO: 641079 - DNA, 25 bp, Rattus norvegicus
ggcgccttcatagatcttcgggttt

SEQ ID NO: 641080 - DNA, 25 bp, Rattus norvegicus
cgtctgaggaactccacggcgatcc

SEQ ID NO: 641081 - DNA, 25 bp, Rattus norvegicus
ttcatagatcttcgggtttgatccc

SEQ ID NO: 641082 - DNA, 25 bp, Rattus norvegicus
cctggattccagtgcaaggcgtcgc

SEQ ID NO: 641083 - DNA, 25 bp, Rattus norvegicus
gcgcaggacatttggccgctcttcg

SEQ ID NO: 641084 - DNA, 25 bp, Rattus norvegicus
gcctcgaatcggtacgggccactca

SEQ ID NO: 641085 - DNA, 25 bp, Rattus norvegicus
tagggtctcgctctgcaagccaatc

SEQ ID NO: 641086 - DNA, 25 bp, Rattus norvegicus
gcacccagggtttccaaaagcgatc

SEQ ID NO: 641087 - DNA, 25 bp, Rattus norvegicus
atggatcacgcggttcagaacgaca

SEQ ID NO: 641088 - DNA, 25 bp, Rattus norvegicus
actgggcagttctcccgacacagcg

SEQ ID NO: 641089 - DNA, 25 bp, Rattus norvegicus
tagcgtctctttacctccgagtgtg

SEQ ID NO: 641090 - DNA, 25 bp, Rattus norvegicus
tgtggtcccttcaccgacttgcttg

SEQ ID NO: 641091 - DNA, 25 bp, Rattus norvegicus
ggctcagtgcggatactcagtcatg

SEQ ID NO: 641092 - DNA, 25 bp, Rattus norvegicus
ctcagtcatgaagtccgggtagcga

SEQ ID NO: 641093 - DNA, 25 bp, Rattus norvegicus
tgctgtgacagtataggcccgtgtc

SEQ ID NO: 641094 - DNA, 25 bp, Rattus norvegicus
ttcgtgcctaaacctccagcggcta

SEQ ID NO: 641095 - DNA, 25 bp, Rattus norvegicus
ggctagctctaacccgacctggatt

SEQ ID NO: 641096 - DNA, 25 bp, Rattus norvegicus
tgcgtgcgatccttccgcagcgcag

SEQ ID NO: 641097 - DNA, 25 bp, Rattus norvegicus
gataccgccggggacaatcacggcc

SEQ ID NO: 641098 - DNA, 25 bp, Rattus norvegicus
ccggccgtggctgcccagacgtatt

SEQ ID NO: 641099 - DNA, 25 bp, Rattus norvegicus
aatcacggcccacacgtgcggcagg

SEQ ID NO: 641100 - DNA, 25 bp, Rattus norvegicus
ttcaccgcaggctatgaggcgaggc

SEQ ID NO: 641101 - DNA, 25 bp, Rattus norvegicus
tctccgcggccagcgggacgtgtac

SEQ ID NO: 641102 - DNA, 25 bp, Rattus norvegicus
ttatccacgtagctctgccaaccgg

SEQ ID NO: 641103 - DNA, 25 bp, Rattus norvegicus
tcgcacatcaggttatccacgtagc

SEQ ID NO: 641104 - DNA, 25 bp, Rattus norvegicus
tggcagcagccatcgcacatcaggt

SEQ ID NO: 641105 - DNA, 25 bp, Rattus norvegicus
gtagccgacaatggcggcctcctgg

SEQ ID NO: 641106 - DNA, 25 bp, Rattus norvegicus
tttggcgtcgcagtagccgacaatg

SEQ ID NO: 641107 - DNA, 25 bp, Rattus norvegicus
cccagacgtatttggcgtcgcagta

SEQ ID NO: 641108 - DNA, 25 bp, Rattus norvegicus
ggcctcaccgtgatgctctggaaga

SEQ ID NO: 641109 - DNA, 25 bp, Rattus norvegicus
acgtgtacgcgcgtgcgtgcgatcc

SEQ ID NO: 641110 - DNA, 25 bp, Rattus norvegicus
gattcagatagtagcgtcctcagta

SEQ ID NO: 641111 - DNA, 25 bp, Rattus norvegicus
cactgacgggttgaattgaggcacc

SEQ ID NO: 641112 - DNA, 25 bp, Rattus norvegicus
caggcgcgaactcggactttgtctt

SEQ ID NO: 641113 - DNA, 25 bp, Rattus norvegicus
accatgtccaagatgccggccaaga

SEQ ID NO: 641114 - DNA, 25 bp, Rattus norvegicus
gtggccactagcatcaccgaggaca

SEQ ID NO: 641115 - DNA, 25 bp, Rattus norvegicus
aggacgtgtcctccgagatcttcga

SEQ ID NO: 641116 - DNA, 25 bp, Rattus norvegicus
atcttcgacgtttctcgggccacgg

SEQ ID NO: 641117 - DNA, 25 bp, Rattus norvegicus
tcctcggaagagacgctcaacaatg

SEQ ID NO: 641118 - DNA, 25 bp, Rattus norvegicus
acaatgtcggggatgcggaaactcc

SEQ ID NO: 641119 - DNA, 25 bp, Rattus norvegicus
tgccacttcagtgtctgctcctggg

SEQ ID NO: 641120 - DNA, 25 bp, Rattus norvegicus
ctcctgggccaagtagtgcaactcc

SEQ ID NO: 641121 - DNA, 25 bp, Rattus norvegicus
cggccgatggacgtgtatggaatac

SEQ ID NO: 641122 - DNA, 25 bp, Rattus norvegicus
tccggggattgcattagacacagca

SEQ ID NO: 641123 - DNA, 25 bp, Rattus norvegicus
tagttcccgtttccgcgtgatcaaa

SEQ ID NO: 641124 - DNA, 25 bp, Rattus norvegicus
agcgtgagccatagtcgctgctggc

SEQ ID NO: 641125 - DNA, 25 bp, Rattus norvegicus
ccacctccgcgcatcccagcgcaag

SEQ ID NO: 641126 - DNA, 25 bp, Rattus norvegicus
agcctatctcaagcgcacccacctc

SEQ ID NO: 641127 - DNA, 25 bp, Rattus norvegicus
gtgcctctgctaagacccacttgca

SEQ ID NO: 641128 - DNA, 25 bp, Rattus norvegicus
gctgtgcctctgctaagacccactt

SEQ ID NO: 641129 - DNA, 25 bp, Rattus norvegicus
tgcgcgcacgaaaatcggggagcca

SEQ ID NO: 641130 - DNA, 25 bp, Rattus norvegicus
agccatagtcgctgctggccgcttc

SEQ ID NO: 641131 - DNA, 25 bp, Rattus norvegicus
cggcagcagcgtgagccatagtcgc

SEQ ID NO: 641132 - DNA, 25 bp, Rattus norvegicus
cttcattgttctccaagtcagaagc

SEQ ID NO: 641133 - DNA, 25 bp, Rattus norvegicus
acgcttcattgttctccaagtcaga

SEQ ID NO: 641134 - DNA, 25 bp, Rattus norvegicus
cagctcacgcttcattgttctccaa

SEQ ID NO: 641135 - DNA, 25 bp, Rattus norvegicus
tgtttgtacacagtgcgctcttggc

SEQ ID NO: 641136 - DNA, 25 bp, Rattus norvegicus
gcgcgccgccactgtttgtacacag

SEQ ID NO: 641137 - DNA, 25 bp, Rattus norvegicus
atagtcgctgctggccgcttcgcct

SEQ ID NO: 641138 - DNA, 25 bp, Rattus norvegicus
ccgctgttgacaggtgagttccgaa

SEQ ID NO: 641139 - DNA, 25 bp, Rattus norvegicus
ggatcctctgcttggcgaccatctt

SEQ ID NO: 641140 - DNA, 25 bp, Rattus norvegicus
aagaacctctcggactcgctcgctt

SEQ ID NO: 641141 - DNA, 25 bp, Rattus norvegicus
acctccgatcacagcggtctgagca

SEQ ID NO: 641142 - DNA, 25 bp, Rattus norvegicus
gaaagagtccaaccacccgacagtg

SEQ ID NO: 641143 - DNA, 25 bp, Rattus norvegicus
tgcagccggcaacctcgaactagtt

SEQ ID NO: 641144 - DNA, 25 bp, Rattus norvegicus
gaactagttcgggttcggctgccaa

SEQ ID NO: 641145 - DNA, 25 bp, Rattus norvegicus
cgtgcgcactcggaaaccggaagtg

SEQ ID NO: 641146 - DNA, 25 bp, Rattus norvegicus
ggcgccggaaacaccaactcgcagt

SEQ ID NO: 641147 - DNA, 25 bp, Rattus norvegicus
gcatgggtttctctttccgggacaa

SEQ ID NO: 641148 - DNA, 25 bp, Rattus norvegicus
ttaccgaggtcttagcgacgttgcc

SEQ ID NO: 641149 - DNA, 25 bp, Rattus norvegicus
tctcgttggccatacggatcctctg

SEQ ID NO: 641150 - DNA, 25 bp, Rattus norvegicus
ttgccgcgctgagttatgttcttgc

SEQ ID NO: 641151 - DNA, 25 bp, Rattus norvegicus
gggttcggcctttattgaactctca

SEQ ID NO: 641152 - DNA, 25 bp, Rattus norvegicus
gagcggctgtctcaattaagatgag

SEQ ID NO: 641153 - DNA, 25 bp, Rattus norvegicus
gcagctccgctaggtttccgcggca

SEQ ID NO: 641154 - DNA, 25 bp, Rattus norvegicus
ttctcaggcggggttcctcatcgct

SEQ ID NO: 641155 - DNA, 25 bp, Rattus norvegicus
ttgctgcttgcttggctgagagcgc

SEQ ID NO: 641156 - DNA, 25 bp, Rattus norvegicus
atttggtgagtacgcgcgtcgaccc

SEQ ID NO: 641157 - DNA, 25 bp, Rattus norvegicus
gggccgctgctcaagtttcagattt

SEQ ID NO: 641158 - DNA, 25 bp, Rattus norvegicus
ttaaagatgcagtacgccacggggc

SEQ ID NO: 641159 - DNA, 25 bp, Rattus norvegicus
gcggcgtgcccagcaagagattaaa

SEQ ID NO: 641160 - DNA, 25 bp, Rattus norvegicus
tggtccgcagcgaggcctctgccaa

SEQ ID NO: 641161 - DNA, 25 bp, Rattus norvegicus
ttttgggctgcagtctcggtctgaa

SEQ ID NO: 641162 - DNA, 25 bp, Rattus norvegicus
gcttccctcgccgaccttggtggag

SEQ ID NO: 641163 - DNA, 25 bp, Rattus norvegicus
tgcgcaggcgcatttcggcttccct

SEQ ID NO: 641164 - DNA, 25 bp, Rattus norvegicus
aagatgaggctcttgctgcttctgc

SEQ ID NO: 641165 - DNA, 25 bp, Rattus norvegicus
tcggctctctctggagtgctggcgt

SEQ ID NO: 641166 - DNA, 25 bp, Rattus norvegicus
cacgtttcttttagggttgagtcat

SEQ ID NO: 641167 - DNA, 25 bp, Rattus norvegicus
ttgcgatcttgctgctcagcccgta

SEQ ID NO: 641168 - DNA, 25 bp, Rattus norvegicus
caagtcttccgactcttcccagggg

SEQ ID NO: 641169 - DNA, 25 bp, Rattus norvegicus
gggacctacaccgacgcgcacagga

SEQ ID NO: 641170 - DNA, 25 bp, Rattus norvegicus
gcacaggactccagccagaagggca

SEQ ID NO: 641171 - DNA, 25 bp, Rattus norvegicus
gagcccaccatggacctgcgggctt

SEQ ID NO: 641172 - DNA, 25 bp, Rattus norvegicus
tgctcagcccgtagcttgacacgcg

SEQ ID NO: 641173 - DNA, 25 bp, Rattus norvegicus
ttctggtgcgcaaagccctggccca

SEQ ID NO: 641174 - DNA, 25 bp, Rattus norvegicus
ttgagtcattgacgcgccggagaag

SEQ ID NO: 641175 - DNA, 25 bp, Rattus norvegicus
cgccggagaagcttgcgatcttgct

SEQ ID NO: 641176 - DNA, 25 bp, Rattus norvegicus
cgtgacgctaagacacgtgtgcggc

SEQ ID NO: 641177 - DNA, 25 bp, Rattus norvegicus
acccggcactctgggactggcagag

SEQ ID NO: 641178 - DNA, 25 bp, Rattus norvegicus
tttcccgctgggaacacttgactcg

SEQ ID NO: 641179 - DNA, 25 bp, Rattus norvegicus
ggagaggacgcagcccaagtcttcc

SEQ ID NO: 641180 - DNA, 25 bp, Rattus norvegicus
ttcaaggcgtccaagtttcggcata

SEQ ID NO: 641181 - DNA, 25 bp, Rattus norvegicus
ccaagtttcggcatatggaggcccg

SEQ ID NO: 641182 - DNA, 25 bp, Rattus norvegicus
gcttcagccggtcgcgccgaagaag

SEQ ID NO: 641183 - DNA, 25 bp, Rattus norvegicus
ctgattggttgtcatcacatagggg

SEQ ID NO: 641184 - DNA, 25 bp, Rattus norvegicus
tgtcatcacataggggagtgtcatc

SEQ ID NO: 641185 - DNA, 25 bp, Rattus norvegicus
cataggggagtgtcatcaagctgca

SEQ ID NO: 641186 - DNA, 25 bp, Rattus norvegicus
agtgtcatcaagctgcaagctgctg

SEQ ID NO: 641187 - DNA, 25 bp, Rattus norvegicus
caagctgcaagctgctgaggcggca

SEQ ID NO: 641188 - DNA, 25 bp, Rattus norvegicus
ctgcaagagtccagggcggcttctc

SEQ ID NO: 641189 - DNA, 25 bp, Rattus norvegicus
gggcggcttctcatcatttacctga

SEQ ID NO: 641190 - DNA, 25 bp, Rattus norvegicus
tcatcatttacctgagacccgacgc

SEQ ID NO: 641191 - DNA, 25 bp, Rattus norvegicus
gtcctcaagcctgcgctagctctgt

SEQ ID NO: 641192 - DNA, 25 bp, Rattus norvegicus
gccatgaaccgcttcaaggcgtcca

SEQ ID NO: 641193 - DNA, 25 bp, Rattus norvegicus
tttcggcatatggaggcccggccgt

SEQ ID NO: 641194 - DNA, 25 bp, Rattus norvegicus
agggagtctgtctgcaaagtgctgc

SEQ ID NO: 641195 - DNA, 25 bp, Rattus norvegicus
cattggtgaagaaagtcacacgttc

SEQ ID NO: 641196 - DNA, 25 bp, Rattus norvegicus
caaagtgctgctccctggtgctcag

SEQ ID NO: 641197 - DNA, 25 bp, Rattus norvegicus
acgcttagctctcggcgggcaccga

SEQ ID NO: 641198 - DNA, 25 bp, Rattus norvegicus
ctcgcgggcccgaggacgcttagct

SEQ ID NO: 641199 - DNA, 25 bp, Rattus norvegicus
actagctgagctcggaggaaccggc

SEQ ID NO: 641200 - DNA, 25 bp, Rattus norvegicus
cgcgcagctcgtgcactagctgagc

SEQ ID NO: 641201 - DNA, 25 bp, Rattus norvegicus
atgtgtccgtcggtgctcgcggcca

SEQ ID NO: 641202 - DNA, 25 bp, Rattus norvegicus
gagacgcccgcgctccggatgtgtc

SEQ ID NO: 641203 - DNA, 25 bp, Rattus norvegicus
tagctagggaccaacaggtaaactg

SEQ ID NO: 641204 - DNA, 25 bp, Rattus norvegicus
aagaaagtcacacgttcccatcagc

SEQ ID NO: 641205 - DNA, 25 bp, Rattus norvegicus
tccaactctcattcatttcgccggt

SEQ ID NO: 641206 - DNA, 25 bp, Rattus norvegicus
aacctgctttttctcctgcctgcag

SEQ ID NO: 641207 - DNA, 25 bp, Rattus norvegicus
tttcgccggttaacatgagagatca

SEQ ID NO: 641208 - DNA, 25 bp, Rattus norvegicus
tgcggttcttctgccgctgcaggcc

SEQ ID NO: 641209 - DNA, 25 bp, Rattus norvegicus
tcggtgacctctgccagggtcgatg

SEQ ID NO: 641210 - DNA, 25 bp, Rattus norvegicus
tgtgaactcggtgacctctgccagg

SEQ ID NO: 641211 - DNA, 25 bp, Rattus norvegicus
gtgcgtgaccgagtgctgtgaactc

SEQ ID NO: 641212 - DNA, 25 bp, Rattus norvegicus
ccgcgcattgttctgcgctgcgggc

SEQ ID NO: 641213 - DNA, 25 bp, Rattus norvegicus
tcccggagtagcgatcccacaatgc

SEQ ID NO: 641214 - DNA, 25 bp, Rattus norvegicus
cgggcatcccggagtagcgatccca

SEQ ID NO: 641215 - DNA, 25 bp, Rattus norvegicus
gctagccatgctccggtgacccgga

SEQ ID NO: 641216 - DNA, 25 bp, Rattus norvegicus
gtctctcaccgcagcccggaggagt

SEQ ID NO: 641217 - DNA, 25 bp, Rattus norvegicus
taagaggatgcacggcgacataccc

SEQ ID NO: 641218 - DNA, 25 bp, Rattus norvegicus
cgataagaggatgcacggcgacata

SEQ ID NO: 641219 - DNA, 25 bp, Rattus norvegicus
aaccttgcgggcctcgcagactggg

SEQ ID NO: 641220 - DNA, 25 bp, Rattus norvegicus
aggccgggccgctgactctaacctt

SEQ ID NO: 641221 - DNA, 25 bp, Rattus norvegicus
ttccaggttccaggcggtgcggttc

SEQ ID NO: 641222 - DNA, 25 bp, Rattus norvegicus
ccttcggccgctgagaaccgcggag

SEQ ID NO: 641223 - DNA, 25 bp, Rattus norvegicus
ggcgaatttcatggcccgcgacaaa

SEQ ID NO: 641224 - DNA, 25 bp, Rattus norvegicus
tccttcagcttggatcggtcgcagc

SEQ ID NO: 641225 - DNA, 25 bp, Rattus norvegicus
ccgccagctggaccgggaagttgcc

SEQ ID NO: 641226 - DNA, 25 bp, Rattus norvegicus
tgtaacctccgtgccgccagctgga

SEQ ID NO: 641227 - DNA, 25 bp, Rattus norvegicus
gcgcgtcctgttgtgtaacctccgt

SEQ ID NO: 641228 - DNA, 25 bp, Rattus norvegicus
cgggagcgcacttgcaaacttggtg

SEQ ID NO: 641229 - DNA, 25 bp, Rattus norvegicus
tttgagcagcgcctatctgtcgccc

SEQ ID NO: 641230 - DNA, 25 bp, Rattus norvegicus
gaaccgcggagctacttggacttga

SEQ ID NO: 641231 - DNA, 25 bp, Rattus norvegicus
tctcccaaggctgagtgcgggctga

SEQ ID NO: 641232 - DNA, 25 bp, Rattus norvegicus
cggccaagagctctcccaaggctga

SEQ ID NO: 641233 - DNA, 25 bp, Rattus norvegicus
tgctgacttcatggactgcgagcgg

SEQ ID NO: 641234 - DNA, 25 bp, Rattus norvegicus
tacttggacttgaccctactgcgcc

SEQ ID NO: 641235 - DNA, 25 bp, Rattus norvegicus
gcaccgaggagagctgctgacttca

SEQ ID NO: 641236 - DNA, 25 bp, Rattus norvegicus
ctattcgcagagatcgtgaggcaga

SEQ ID NO: 641237 - DNA, 25 bp, Rattus norvegicus
aggcagatgaactacgcggcacagc

SEQ ID NO: 641238 - DNA, 25 bp, Rattus norvegicus
agcctcagtggatgagctattcgca

SEQ ID NO: 641239 - DNA, 25 bp, Rattus norvegicus
tcctggtaggcaacaaggtggacct

SEQ ID NO: 641240 - DNA, 25 bp, Rattus norvegicus
cgagcgcgtacccatgatcctggta

SEQ ID NO: 641241 - DNA, 25 bp, Rattus norvegicus
atcatccgcgtgaaacggtacgagc

SEQ ID NO: 641242 - DNA, 25 bp, Rattus norvegicus
tgaagacttttaccgcaaggagatc

SEQ ID NO: 641243 - DNA, 25 bp, Rattus norvegicus
atcgagaagtacgacccaaccattg

SEQ ID NO: 641244 - DNA, 25 bp, Rattus norvegicus
cgctcaccgtgcagttcgtaacagg

SEQ ID NO: 641245 - DNA, 25 bp, Rattus norvegicus
agctccagccgttgtcttgctccga

SEQ ID NO: 641246 - DNA, 25 bp, Rattus norvegicus
tgtctcagccggacgcacaattagc

SEQ ID NO: 641247 - DNA, 25 bp, Rattus norvegicus
gggactcatgccacgcgtgtctcag

SEQ ID NO: 641248 - DNA, 25 bp, Rattus norvegicus
ccgacggagccatgagagagtacaa

SEQ ID NO: 641249 - DNA, 25 bp, Rattus norvegicus
acgcacgttccgtggggactcatgc

SEQ ID NO: 641250 - DNA, 25 bp, Rattus norvegicus
cagagctgcttctcctcgacttcga

SEQ ID NO: 641251 - DNA, 25 bp, Rattus norvegicus
ctagttgtccggaggcaaagttcct

SEQ ID NO: 641252 - DNA, 25 bp, Rattus norvegicus
gtgaccaatggtcgcacggtgtccc

SEQ ID NO: 641253 - DNA, 25 bp, Rattus norvegicus
ccagcgggctgctgatcactgactt

SEQ ID NO: 641254 - DNA, 25 bp, Rattus norvegicus
agccgcggccacagtcgtaccagag

SEQ ID NO: 641255 - DNA, 25 bp, Rattus norvegicus
ggatttttccagcaacggcgtcacc

SEQ ID NO: 641256 - DNA, 25 bp, Rattus norvegicus
cctcttagacaacctgagaagcttt

SEQ ID NO: 641257 - DNA, 25 bp, Rattus norvegicus
catctaatcggttgcggctcggatc

SEQ ID NO: 641258 - DNA, 25 bp, Rattus norvegicus
agctctctaggtgccaaccggcttg

SEQ ID NO: 641259 - DNA, 25 bp, Rattus norvegicus
gcggcaagctgtcccagccagctga

SEQ ID NO: 641260 - DNA, 25 bp, Rattus norvegicus
actctttggtccgtgctctggacgc

SEQ ID NO: 641261 - DNA, 25 bp, Rattus norvegicus
ctctgcgaagttgggttgtgcgctt

SEQ ID NO: 641262 - DNA, 25 bp, Rattus norvegicus
ttttggtgaggactcaggccaccca

SEQ ID NO: 641263 - DNA, 25 bp, Rattus norvegicus
ggatctcaatcctcggtcgcgcagc

SEQ ID NO: 641264 - DNA, 25 bp, Rattus norvegicus
cttttttgcgtaccataggcctatc

SEQ ID NO: 641265 - DNA, 25 bp, Rattus norvegicus
cagacatttccggtgacgtcacgaa

SEQ ID NO: 641266 - DNA, 25 bp, Rattus norvegicus
cgggccgttgagtgtcacaagcaga

SEQ ID NO: 641267 - DNA, 25 bp, Rattus norvegicus
cgggcgcacattaccctcagctttg

SEQ ID NO: 641268 - DNA, 25 bp, Rattus norvegicus
actcaaccgctgaaaatggcgccca

SEQ ID NO: 641269 - DNA, 25 bp, Rattus norvegicus
tccgagacgactacaggtaccacca

SEQ ID NO: 641270 - DNA, 25 bp, Rattus norvegicus
tagtcgtagctcattgtccgagacg

SEQ ID NO: 641271 - DNA, 25 bp, Rattus norvegicus
cgaacggcgccagaaagtgtgacct

SEQ ID NO: 641272 - DNA, 25 bp, Rattus norvegicus
ggcctatctcgcgacccttaaggtg

SEQ ID NO: 641273 - DNA, 25 bp, Rattus norvegicus
agagcaccgagcaaacgcgtcccta

SEQ ID NO: 641274 - DNA, 25 bp, Rattus norvegicus
tccagcaaacgccagggaagagtta

SEQ ID NO: 641275 - DNA, 25 bp, Rattus norvegicus
gggctcggcagacgttacatctagc

SEQ ID NO: 641276 - DNA, 25 bp, Rattus norvegicus
tgacctgcggtgaagttttttgtcc

SEQ ID NO: 641277 - DNA, 25 bp, Rattus norvegicus
cgcggctccagctctgatgatagtc

SEQ ID NO: 641278 - DNA, 25 bp, Rattus norvegicus
cccactctgcgcgttcggcgctcgg

SEQ ID NO: 641279 - DNA, 25 bp, Rattus norvegicus
gaagctggaccgagtgcaggcgcaa

SEQ ID NO: 641280 - DNA, 25 bp, Rattus norvegicus
tgcaggcgcaagctgctgagcggct

SEQ ID NO: 641281 - DNA, 25 bp, Rattus norvegicus
gggactctggcctcgtcccactctg

SEQ ID NO: 641282 - DNA, 25 bp, Rattus norvegicus
cggccatcctggtcgatgcgcttat

SEQ ID NO: 641283 - DNA, 25 bp, Rattus norvegicus
atcctggtcgatgcgcttattggtc

SEQ ID NO: 641284 - DNA, 25 bp, Rattus norvegicus
atgcgcttattggtcgggatgtgtc

SEQ ID NO: 641285 - DNA, 25 bp, Rattus norvegicus
ttattggtcgggatgtgtctgctca

SEQ ID NO: 641286 - DNA, 25 bp, Rattus norvegicus
ggatgtgtctgctcagtcgcctcca

SEQ ID NO: 641287 - DNA, 25 bp, Rattus norvegicus
gtgtctgctcagtcgcctccaactt

SEQ ID NO: 641288 - DNA, 25 bp, Rattus norvegicus
cccaatcacactggtgagtcaccgg

SEQ ID NO: 641289 - DNA, 25 bp, Rattus norvegicus
atcacactggtgagtcaccggagag

SEQ ID NO: 641290 - DNA, 25 bp, Rattus norvegicus
ccgggacgcacggagcaaggacaga

SEQ ID NO: 641291 - DNA, 25 bp, Rattus norvegicus
ggatgcgggcttcccggttgccctc

SEQ ID NO: 641292 - DNA, 25 bp, Rattus norvegicus
ccgagagcaaatagtttaggctatg

SEQ ID NO: 641293 - DNA, 25 bp, Rattus norvegicus
ctaggactctctcagccagggtgtc

SEQ ID NO: 641294 - DNA, 25 bp, Rattus norvegicus
tactcgtggcactaggactctctca

SEQ ID NO: 641295 - DNA, 25 bp, Rattus norvegicus
tctgcgggcattagagaagtctctg

SEQ ID NO: 641296 - DNA, 25 bp, Rattus norvegicus
acaaccgggatgtcccgggtctgcg

SEQ ID NO: 641297 - DNA, 25 bp, Rattus norvegicus
agaacaaaccgagacaaccgggatg

SEQ ID NO: 641298 - DNA, 25 bp, Rattus norvegicus
aggctatgacatgattttctttcca

SEQ ID NO: 641299 - DNA, 25 bp, Rattus norvegicus
gcgaacgtagttggatccgagagca

SEQ ID NO: 641300 - DNA, 25 bp, Rattus norvegicus
cccgagaacgcgcaggacatgcgga

SEQ ID NO: 641301 - DNA, 25 bp, Rattus norvegicus
ctccggatcccgagaacgcgcagga

SEQ ID NO: 641302 - DNA, 25 bp, Rattus norvegicus
agcggtacagccctacagcctcggg

SEQ ID NO: 641303 - DNA, 25 bp, Rattus norvegicus
cgggcgtacttgcagcggtacagcc

SEQ ID NO: 641304 - DNA, 25 bp, Rattus norvegicus
agcgagtctccactgcgggcgtact

SEQ ID NO: 641305 - DNA, 25 bp, Rattus norvegicus
acgcccattgacaccgagaacaaac

SEQ ID NO: 641306 - DNA, 25 bp, Rattus norvegicus
catgatgcagcaccggccgaagccg

SEQ ID NO: 641307 - DNA, 25 bp, Rattus norvegicus
aagcactccttcgtgtgcgcgtcga

SEQ ID NO: 641308 - DNA, 25 bp, Rattus norvegicus
gacgcagactgtggcctccagagcc

SEQ ID NO: 641309 - DNA, 25 bp, Rattus norvegicus
gtggcctccagagccgccgccacct

SEQ ID NO: 641310 - DNA, 25 bp, Rattus norvegicus
gccgggacgcagactgtggcctcca

SEQ ID NO: 641311 - DNA, 25 bp, Rattus norvegicus
accatgatgcagcaccggccgaagc

SEQ ID NO: 641312 - DNA, 25 bp, Rattus norvegicus
gtcaccatgatgcagcaccggccga

SEQ ID NO: 641313 - DNA, 25 bp, Rattus norvegicus
agcgtcaccatgatgcagcaccggc

SEQ ID NO: 641314 - DNA, 25 bp, Rattus norvegicus
actccttcgtgtgcgcgtcgatgct

SEQ ID NO: 641315 - DNA, 25 bp, Rattus norvegicus
tgaagaagcactccttcgtgtgcgc

SEQ ID NO: 641316 - DNA, 25 bp, Rattus norvegicus
gcttgaagaagcactccttcgtgtg

SEQ ID NO: 641317 - DNA, 25 bp, Rattus norvegicus
ccgcttgaagaagcactccttcgtg

SEQ ID NO: 641318 - DNA, 25 bp, Rattus norvegicus
acccgcttgaagaagcactccttcg

SEQ ID NO: 641319 - DNA, 25 bp, Rattus norvegicus
cagcgtcaccatgatgcagcaccgg

SEQ ID NO: 641320 - DNA, 25 bp, Rattus norvegicus
cggagcagcagtccggtctcctctt

SEQ ID NO: 641321 - DNA, 25 bp, Rattus norvegicus
ccgacccggtactgttgccatggta

SEQ ID NO: 641322 - DNA, 25 bp, Rattus norvegicus
tgctcagtactgattatcccgcgga

SEQ ID NO: 641323 - DNA, 25 bp, Rattus norvegicus
ttgctcaggcacaaaagctcacgcg

SEQ ID NO: 641324 - DNA, 25 bp, Rattus norvegicus
ggcgtcgctctggtaacccttgatt

SEQ ID NO: 641325 - DNA, 25 bp, Rattus norvegicus
ttatcccgcggatgaaggatcctcg

SEQ ID NO: 641326 - DNA, 25 bp, Rattus norvegicus
atcctcggagtttttgtcaccggcg

SEQ ID NO: 641327 - DNA, 25 bp, Rattus norvegicus
gcccacaagctactgcggtctactt

SEQ ID NO: 641328 - DNA, 25 bp, Rattus norvegicus
agaggttaggtcttgctcaggcaca

SEQ ID NO: 641329 - DNA, 25 bp, Rattus norvegicus
cagaattgctctcctggcggccaga

SEQ ID NO: 641330 - DNA, 25 bp, Rattus norvegicus
ctcgcttctagggaggcagaattgc

SEQ ID NO: 641331 - DNA, 25 bp, Rattus norvegicus
acgggcaactgaggactcgcttcta

SEQ ID NO: 641332 - DNA, 25 bp, Rattus norvegicus
cgcctaatgccctgagttttttgga

SEQ ID NO: 641333 - DNA, 25 bp, Rattus norvegicus
agtaaatccttctcgcgcctaatgc

SEQ ID NO: 641334 - DNA, 25 bp, Rattus norvegicus
ggcccgacacacactgtaggagctg

SEQ ID NO: 641335 - DNA, 25 bp, Rattus norvegicus
acgggcagcagtgtttttcatctta

SEQ ID NO: 641336 - DNA, 25 bp, Rattus norvegicus
tcccgccaatgaaagcgccgtgggc

SEQ ID NO: 641337 - DNA, 25 bp, Rattus norvegicus
tgtttgtctccaagtccggccggaa

SEQ ID NO: 641338 - DNA, 25 bp, Rattus norvegicus
ggcgcatgttatcagagggacttca

SEQ ID NO: 641339 - DNA, 25 bp, Rattus norvegicus
gtcgaggggcactccagtttaactg

SEQ ID NO: 641340 - DNA, 25 bp, Rattus norvegicus
gtacgggaacctgaagctgctcaca

SEQ ID NO: 641341 - DNA, 25 bp, Rattus norvegicus
ggacgggatccgcttctatggaaac

SEQ ID NO: 641342 - DNA, 25 bp, Rattus norvegicus
cttctatggaaacgggctaattgcc

SEQ ID NO: 641343 - DNA, 25 bp, Rattus norvegicus
gcggtagcgcctagcgacctaaaca

SEQ ID NO: 641344 - DNA, 25 bp, Rattus norvegicus
cctgaaacgctgacccagggacttg

SEQ ID NO: 641345 - DNA, 25 bp, Rattus norvegicus
cgctgtggaccaagactccctgaaa

SEQ ID NO: 641346 - DNA, 25 bp, Rattus norvegicus
acactaaccaatggcggggcagttc

SEQ ID NO: 641347 - DNA, 25 bp, Rattus norvegicus
attggccgatgcctgtttccagccc

SEQ ID NO: 641348 - DNA, 25 bp, Rattus norvegicus
tgcgacatccgcgttaccacgttgg

SEQ ID NO: 641349 - DNA, 25 bp, Rattus norvegicus
tccttccgctccagcgggtcctcta

SEQ ID NO: 641350 - DNA, 25 bp, Rattus norvegicus
aaagaggcgttgtcgcctccctggc

SEQ ID NO: 641351 - DNA, 25 bp, Rattus norvegicus
ggtcctctacgaggcctgccgcgat

SEQ ID NO: 641352 - DNA, 25 bp, Rattus norvegicus
cgatcaccgcgctcaggctagccca

SEQ ID NO: 641353 - DNA, 25 bp, Rattus norvegicus
ctgccgggccgtggcacctggacaa

SEQ ID NO: 641354 - DNA, 25 bp, Rattus norvegicus
gtggcacctggacaagacgcagatg

SEQ ID NO: 641355 - DNA, 25 bp, Rattus norvegicus
gcagatggttgtccgcccactgcga

SEQ ID NO: 641356 - DNA, 25 bp, Rattus norvegicus
catgttccggcgtccagcgggttcc

SEQ ID NO: 641357 - DNA, 25 bp, Rattus norvegicus
gacatccgcgttaccacgttggcct

SEQ ID NO: 641358 - DNA, 25 bp, Rattus norvegicus
tcgcggtcggaagcctgcgacccga

SEQ ID NO: 641359 - DNA, 25 bp, Rattus norvegicus
tcggaagcctgcgacccgaggctcg

SEQ ID NO: 641360 - DNA, 25 bp, Rattus norvegicus
agcggcgccatgttccggcgtccag

SEQ ID NO: 641361 - DNA, 25 bp, Rattus norvegicus
caagacgcagatggttgtccgccca

SEQ ID NO: 641362 - DNA, 25 bp, Rattus norvegicus
actagtcgatgttttgcagcaggga

SEQ ID NO: 641363 - DNA, 25 bp, Rattus norvegicus
atggaactcgtgtgcttcggccatt

SEQ ID NO: 641364 - DNA, 25 bp, Rattus norvegicus
cgtccaggaccgagcgcattaacta

SEQ ID NO: 641365 - DNA, 25 bp, Rattus norvegicus
ggcggcgaccgcaaacagagtttgc

SEQ ID NO: 641366 - DNA, 25 bp, Rattus norvegicus
aatcagaacaagctccggtggcggc

SEQ ID NO: 641367 - DNA, 25 bp, Rattus norvegicus
tcccgacgaagctagcgaatcagaa

SEQ ID NO: 641368 - DNA, 25 bp, Rattus norvegicus
cgggaagtggttccctgccaaaatg

SEQ ID NO: 641369 - DNA, 25 bp, Rattus norvegicus
ggataacttcctgcctcgcgcttcg

SEQ ID NO: 641370 - DNA, 25 bp, Rattus norvegicus
gtactctcagcagacaccaaaggta

SEQ ID NO: 641371 - DNA, 25 bp, Rattus norvegicus
gctgatactgcagcgggtactctca

SEQ ID NO: 641372 - DNA, 25 bp, Rattus norvegicus
tgccactagatctccgctgatactg

SEQ ID NO: 641373 - DNA, 25 bp, Rattus norvegicus
ctggctcgtaactgcggcaagtctc

SEQ ID NO: 641374 - DNA, 25 bp, Rattus norvegicus
ctgcccacaggagcgatttcaggga

SEQ ID NO: 641375 - DNA, 25 bp, Rattus norvegicus
cattgggccctcatcgccacgtgag

SEQ ID NO: 641376 - DNA, 25 bp, Rattus norvegicus
gccctcgctgccgaaagcgtcaagt

SEQ ID NO: 641377 - DNA, 25 bp, Rattus norvegicus
gttcagcgggattccgcatgtgcca

SEQ ID NO: 641378 - DNA, 25 bp, Rattus norvegicus
aggcgctttgttggctttgctagtg

SEQ ID NO: 641379 - DNA, 25 bp, Rattus norvegicus
aagcgtcaagttccagcgcagaggg

SEQ ID NO: 641380 - DNA, 25 bp, Rattus norvegicus
ggacccagccgtgggccgcgattct

SEQ ID NO: 641381 - DNA, 25 bp, Rattus norvegicus
cgattcttggggactcccaggccct

SEQ ID NO: 641382 - DNA, 25 bp, Rattus norvegicus
tccgcctcacttggcgggttcagcg

SEQ ID NO: 641383 - DNA, 25 bp, Rattus norvegicus
aacagcgcgcgcttctgtgttctga

SEQ ID NO: 641384 - DNA, 25 bp, Rattus norvegicus
ttgctgtgcctcacgcttcagccgg

SEQ ID NO: 641385 - DNA, 25 bp, Rattus norvegicus
tgttctgaggccgaggccaggttcc

SEQ ID NO: 641386 - DNA, 25 bp, Rattus norvegicus
tttccggcatcggaggcgctttgtt

SEQ ID NO: 641387 - DNA, 25 bp, Rattus norvegicus
gtcagtctgtgattggggtctctgc

SEQ ID NO: 641388 - DNA, 25 bp, Rattus norvegicus
cggagattccaaggtcagtctgtga

SEQ ID NO: 641389 - DNA, 25 bp, Rattus norvegicus
atggccctgtgcaacggagattcca

SEQ ID NO: 641390 - DNA, 25 bp, Rattus norvegicus
gctgcagcccagaagtttacaggct

SEQ ID NO: 641391 - DNA, 25 bp, Rattus norvegicus
aacccggagagcagttgcggctttc

SEQ ID NO: 641392 - DNA, 25 bp, Rattus norvegicus
cagcttgcctgaggtaaaagggctc

SEQ ID NO: 641393 - DNA, 25 bp, Rattus norvegicus
gcggatccatagactgcccgggaga

SEQ ID NO: 641394 - DNA, 25 bp, Rattus norvegicus
aggagaccggaagccacttaaagca

SEQ ID NO: 641395 - DNA, 25 bp, Rattus norvegicus
gtgtatagatggactggcgccgcac

SEQ ID NO: 641396 - DNA, 25 bp, Rattus norvegicus
ccacttaaagcagagctggagctga

SEQ ID NO: 641397 - DNA, 25 bp, Rattus norvegicus
acaggctgtgttcgagttaactttg

SEQ ID NO: 641398 - DNA, 25 bp, Rattus norvegicus
ttaactttgagtgcgcaccggtccc

SEQ ID NO: 641399 - DNA, 25 bp, Rattus norvegicus
cgcaagctcctggacggtcctcgga

SEQ ID NO: 641400 - DNA, 25 bp, Rattus norvegicus
gcagggccgagggaaatttcattgt

SEQ ID NO: 641401 - DNA, 25 bp, Rattus norvegicus
tttcattgtggactcaccgtgagtg

SEQ ID NO: 641402 - DNA, 25 bp, Rattus norvegicus
attgggttaagctctggtcgcccgg

SEQ ID NO: 641403 - DNA, 25 bp, Rattus norvegicus
gctttctgcgcccaagtccgcggaa

SEQ ID NO: 641404 - DNA, 25 bp, Rattus norvegicus
cccgacgctgtggttatgcaaactg

SEQ ID NO: 641405 - DNA, 25 bp, Rattus norvegicus
gatctcatcgctgttgctcacgaca

SEQ ID NO: 641406 - DNA, 25 bp, Rattus norvegicus
ctaagtctccgagcagcgagccaga

SEQ ID NO: 641407 - DNA, 25 bp, Rattus norvegicus
aggtagccacgacgtccctcgattc

SEQ ID NO: 641408 - DNA, 25 bp, Rattus norvegicus
ccctcgattccctttgtcagaagaa

SEQ ID NO: 641409 - DNA, 25 bp, Rattus norvegicus
tcagaagaagttaccgccatcccgc

SEQ ID NO: 641410 - DNA, 25 bp, Rattus norvegicus
tccgctggagctcctcaaggtttca

SEQ ID NO: 641411 - DNA, 25 bp, Rattus norvegicus
tcaaggtttcaggatccgtcctccc

SEQ ID NO: 641412 - DNA, 25 bp, Rattus norvegicus
tcgccgactggcttgtgccttgcaa

SEQ ID NO: 641413 - DNA, 25 bp, Rattus norvegicus
tgccttgcaacttccgagccggaaa

SEQ ID NO: 641414 - DNA, 25 bp, Rattus norvegicus
cctccggctagagaaggcgtccgga

SEQ ID NO: 641415 - DNA, 25 bp, Rattus norvegicus
aatgggattcctccgcggattacgc

SEQ ID NO: 641416 - DNA, 25 bp, Rattus norvegicus
ttacaaccctgggaccgcagtcacg

SEQ ID NO: 641417 - DNA, 25 bp, Rattus norvegicus
gccagagctgcaaataaacccgatc

SEQ ID NO: 641418 - DNA, 25 bp, Rattus norvegicus
tccgtcacagaaccgcgcgtaaatc

SEQ ID NO: 641419 - DNA, 25 bp, Rattus norvegicus
tctagctcgcttttgggacaagtga

SEQ ID NO: 641420 - DNA, 25 bp, Rattus norvegicus
tgcaaaggagctctgcttccgcgtc

SEQ ID NO: 641421 - DNA, 25 bp, Rattus norvegicus
tgcgctctgacgtcaggacaacgtg

SEQ ID NO: 641422 - DNA, 25 bp, Rattus norvegicus
agggtcatggcctttctcagttctc

SEQ ID NO: 641423 - DNA, 25 bp, Rattus norvegicus
tcagttctcagaggaccaggccggc

SEQ ID NO: 641424 - DNA, 25 bp, Rattus norvegicus
cgagtcgggcagttagtttcctgca

SEQ ID NO: 641425 - DNA, 25 bp, Rattus norvegicus
atcacggcccgggaatggtactaga

SEQ ID NO: 641426 - DNA, 25 bp, Rattus norvegicus
cctggaagcagaaccggagttaatg

SEQ ID NO: 641427 - DNA, 25 bp, Rattus norvegicus
caccaaggacgtttcggcatttaag

SEQ ID NO: 641428 - DNA, 25 bp, Rattus norvegicus
cggcatttaagaacacacacgtcta

SEQ ID NO: 641429 - DNA, 25 bp, Rattus norvegicus
ccagtgtcacagagaaggttcgtaa

SEQ ID NO: 641430 - DNA, 25 bp, Rattus norvegicus
ttcgtaaacttgcacgcagcagcgg

SEQ ID NO: 641431 - DNA, 25 bp, Rattus norvegicus
tgacctgccctcttgtgaatcacgg

SEQ ID NO: 641432 - DNA, 25 bp, Rattus norvegicus
ggcccggacgccatagttctagcga

SEQ ID NO: 641433 - DNA, 25 bp, Rattus norvegicus
ctcccttacctcgaaactgtgtttg

SEQ ID NO: 641434 - DNA, 25 bp, Rattus norvegicus
cggcacaggctctcgagaaacccgg

SEQ ID NO: 641435 - DNA, 25 bp, Rattus norvegicus
gcagcctaagatgcgcaggtccgtc

SEQ ID NO: 641436 - DNA, 25 bp, Rattus norvegicus
tcctccggaatcaccgagtggtcga

SEQ ID NO: 641437 - DNA, 25 bp, Rattus norvegicus
cgatggtaagcgacacctccgagta

SEQ ID NO: 641438 - DNA, 25 bp, Rattus norvegicus
ggtcgccaatcaggatccctccggt

SEQ ID NO: 641439 - DNA, 25 bp, Rattus norvegicus
gcttccggatgaagaaatcccttct

SEQ ID NO: 641440 - DNA, 25 bp, Rattus norvegicus
gcagccggaacccaaagcgagacta

SEQ ID NO: 641441 - DNA, 25 bp, Rattus norvegicus
tcctcggcgcgacggatattcccgt

SEQ ID NO: 641442 - DNA, 25 bp, Rattus norvegicus
cgcgacaccgatgcgtaacaaagtg

SEQ ID NO: 641443 - DNA, 25 bp, Rattus norvegicus
agtgactctgaactgggcagcttca

SEQ ID NO: 641444 - DNA, 25 bp, Rattus norvegicus
cagtttcagcgcatgggtttccgga

SEQ ID NO: 641445 - DNA, 25 bp, Rattus norvegicus
acctccgagtacaggcggtcgccaa

SEQ ID NO: 641446 - DNA, 25 bp, Rattus norvegicus
tcgccactggctacccgcaggtaag

SEQ ID NO: 641447 - DNA, 25 bp, Rattus norvegicus
gtatggcgaggccttgctcagccag

SEQ ID NO: 641448 - DNA, 25 bp, Rattus norvegicus
cagacgccaggctggcacaggcgct

SEQ ID NO: 641449 - DNA, 25 bp, Rattus norvegicus
caggagagccgcgacgcgaaccgca

SEQ ID NO: 641450 - DNA, 25 bp, Rattus norvegicus
accgcaggctggcacgcctggaaga

SEQ ID NO: 641451 - DNA, 25 bp, Rattus norvegicus
gcgacacgaggcgacagtgcctagc

SEQ ID NO: 641452 - DNA, 25 bp, Rattus norvegicus
aggcgacagtgcctagcctaggagc

SEQ ID NO: 641453 - DNA, 25 bp, Rattus norvegicus
cagtgcctagcctaggagcggtgct

SEQ ID NO: 641454 - DNA, 25 bp, Rattus norvegicus
gcgccgacctgagcgccatgcagag

SEQ ID NO: 641455 - DNA, 25 bp, Rattus norvegicus
atgcagagctgggtcgctcgccact

SEQ ID NO: 641456 - DNA, 25 bp, Rattus norvegicus
ttgctcagccagtggcccggcagac

SEQ ID NO: 641457 - DNA, 25 bp, Rattus norvegicus
ccgcaggtaagcacccggcgtagag

SEQ ID NO: 641458 - DNA, 25 bp, Rattus norvegicus
aagcacccggcgtagagcccacggt

SEQ ID NO: 641459 - DNA, 25 bp, Rattus norvegicus
acctgagcgccatgcagagctgggt

SEQ ID NO: 641460 - DNA, 25 bp, Rattus norvegicus
ccctcgcaaagaggccgacttgcta

SEQ ID NO: 641461 - DNA, 25 bp, Rattus norvegicus
ccaacagacctaggaagagcccggg

SEQ ID NO: 641462 - DNA, 25 bp, Rattus norvegicus
aggcactgcgataggcccaaccgga

SEQ ID NO: 641463 - DNA, 25 bp, Rattus norvegicus
ggtggtattccactaaaccgattgc

SEQ ID NO: 641464 - DNA, 25 bp, Rattus norvegicus
acttggagcatcaggccaacagacc

SEQ ID NO: 641465 - DNA, 25 bp, Rattus norvegicus
ggcccgggatgctcaacttggagca

SEQ ID NO: 641466 - DNA, 25 bp, Rattus norvegicus
tgcacagcccgggagtcatgcggcc

SEQ ID NO: 641467 - DNA, 25 bp, Rattus norvegicus
ctagtgtgattctcccgggacccga

SEQ ID NO: 641468 - DNA, 25 bp, Rattus norvegicus
gggagccctggctctagtgtgattc

SEQ ID NO: 641469 - DNA, 25 bp, Rattus norvegicus
cctggccgcggttgagtttctcgga

SEQ ID NO: 641470 - DNA, 25 bp, Rattus norvegicus
tggtaagaacatgcgctgcctggcc

SEQ ID NO: 641471 - DNA, 25 bp, Rattus norvegicus
ccggcctcactatggtaagaacatg

SEQ ID NO: 641472 - DNA, 25 bp, Rattus norvegicus
tgtggctggaccagcaccggcctca

SEQ ID NO: 641473 - DNA, 25 bp, Rattus norvegicus
ccgacttgctacgttgtttagtgga

SEQ ID NO: 641474 - DNA, 25 bp, Rattus norvegicus
ggtcgcgccgcatagaaggctccac

SEQ ID NO: 641475 - DNA, 25 bp, Rattus norvegicus
atccgcgatgctggagttcttgctg

SEQ ID NO: 641476 - DNA, 25 bp, Rattus norvegicus
cctagggatccagggtgcagaaaga

SEQ ID NO: 641477 - DNA, 25 bp, Rattus norvegicus
aacctgaaaggacaagggcgtcacg

SEQ ID NO: 641478 - DNA, 25 bp, Rattus norvegicus
tagaaggctccaccgaccgtggcgc

SEQ ID NO: 641479 - DNA, 25 bp, Rattus norvegicus
gcggccgcgtgctttttagctttca

SEQ ID NO: 641480 - DNA, 25 bp, Rattus norvegicus
gctttcagtctgagatccgcgatgc

SEQ ID NO: 641481 - DNA, 25 bp, Rattus norvegicus
tgctggagttcttgctggtggtctt

SEQ ID NO: 641482 - DNA, 25 bp, Rattus norvegicus
ggatcccgggtccagcgcagagtcc

SEQ ID NO: 641483 - DNA, 25 bp, Rattus norvegicus
ccagcgtggccagcggcagtccgaa

SEQ ID NO: 641484 - DNA, 25 bp, Rattus norvegicus
cggtgccgggaacatcatgtaaggc

SEQ ID NO: 641485 - DNA, 25 bp, Rattus norvegicus
cagagtcccgccctagggatccagg

SEQ ID NO: 641486 - DNA, 25 bp, Rattus norvegicus
tgcagctgcgcctgaacctgaaagg

SEQ ID NO: 641487 - DNA, 25 bp, Rattus norvegicus
gaacatcatgtaaggcgcgtgcgcg

SEQ ID NO: 641488 - DNA, 25 bp, Rattus norvegicus
ctcaaggaatagtgagtgtcgggtc

SEQ ID NO: 641489 - DNA, 25 bp, Rattus norvegicus
ctgaagtgggatcgaatacaccgga

SEQ ID NO: 641490 - DNA, 25 bp, Rattus norvegicus
cagcacctgaagtgggatcgaatac

SEQ ID NO: 641491 - DNA, 25 bp, Rattus norvegicus
gcccagggtgacagacagcacctga

SEQ ID NO: 641492 - DNA, 25 bp, Rattus norvegicus
ctcgaaggcaaatcgcctaccgggg

SEQ ID NO: 641493 - DNA, 25 bp, Rattus norvegicus
gggaagacggcctcgaaggcaaatc

SEQ ID NO: 641494 - DNA, 25 bp, Rattus norvegicus
gcgacatggtgctgctcaaggaata

SEQ ID NO: 641495 - DNA, 25 bp, Rattus norvegicus
ccgccgagccgcgaagcgacatggt

SEQ ID NO: 641496 - DNA, 25 bp, Rattus norvegicus
acagagcagaccacaacgaaggcgc

SEQ ID NO: 641497 - DNA, 25 bp, Rattus norvegicus
atacaccggagtggaggccgagaac

SEQ ID NO: 641498 - DNA, 25 bp, Rattus norvegicus
ccgcgtgaggtcagcgcgcactgct

SEQ ID NO: 641499 - DNA, 25 bp, Rattus norvegicus
gaccacaacgaaggcgcacaggcag

SEQ ID NO: 641500 - DNA, 25 bp, Rattus norvegicus
gcgcactgctgcgtctgacgctttg

SEQ ID NO: 641501 - DNA, 25 bp, Rattus norvegicus
ctgacgctttggttgccgcagagac

SEQ ID NO: 641502 - DNA, 25 bp, Rattus norvegicus
tcacagagcgcggtctcggttaaag

SEQ ID NO: 641503 - DNA, 25 bp, Rattus norvegicus
cgcggcaaggccacgcgatggcctc

SEQ ID NO: 641504 - DNA, 25 bp, Rattus norvegicus
atccccagagggctgttccgctgtc

SEQ ID NO: 641505 - DNA, 25 bp, Rattus norvegicus
gctgtcccgccagcctctgctgtct

SEQ ID NO: 641506 - DNA, 25 bp, Rattus norvegicus
ctttgcctcccgcaaacttgctggt

SEQ ID NO: 641507 - DNA, 25 bp, Rattus norvegicus
cccgcaaacttgctggtctaattta

SEQ ID NO: 641508 - DNA, 25 bp, Rattus norvegicus
gattctggtacagcgctgcgccgcc

SEQ ID NO: 641509 - DNA, 25 bp, Rattus norvegicus
cgagattctggtacagcgctgcgcc

SEQ ID NO: 641510 - DNA, 25 bp, Rattus norvegicus
tcacggaaatcaaaagcgctgcgcg

SEQ ID NO: 641511 - DNA, 25 bp, Rattus norvegicus
cagctggaaagcgagattctggtac

SEQ ID NO: 641512 - DNA, 25 bp, Rattus norvegicus
gcactcacggaaatcaaaagcgctg

SEQ ID NO: 641513 - DNA, 25 bp, Rattus norvegicus
cccgctgaagggtcgcagctggaaa

SEQ ID NO: 641514 - DNA, 25 bp, Rattus norvegicus
ctggtctaatttaggaacaactggg

SEQ ID NO: 641515 - DNA, 25 bp, Rattus norvegicus
gcgggcctctcacagagcgcggtct

SEQ ID NO: 641516 - DNA, 25 bp, Rattus norvegicus
caaacttcgtcgtcccgcagagcgg

SEQ ID NO: 641517 - DNA, 25 bp, Rattus norvegicus
cctcccgctcgcgaaaaaagcattt

SEQ ID NO: 641518 - DNA, 25 bp, Rattus norvegicus
atttcggtgcaaccggagcggcaga

SEQ ID NO: 641519 - DNA, 25 bp, Rattus norvegicus
ccatgtccagctcccggacgggaga

SEQ ID NO: 641520 - DNA, 25 bp, Rattus norvegicus
tctactagccctgtatctcccaaag

SEQ ID NO: 641521 - DNA, 25 bp, Rattus norvegicus
tcgcagcgggccacacaaacttcgt

SEQ ID NO: 641522 - DNA, 25 bp, Rattus norvegicus
gtatctcccaaagctggggtccagg

SEQ ID NO: 641523 - DNA, 25 bp, Rattus norvegicus
cgtaagttcttccatcgcggccgct

SEQ ID NO: 641524 - DNA, 25 bp, Rattus norvegicus
cttggagacgaacgccgtaagttct

SEQ ID NO: 641525 - DNA, 25 bp, Rattus norvegicus
gtcaaaagacttggagacgaacgcc

SEQ ID NO: 641526 - DNA, 25 bp, Rattus norvegicus
ctccttcactttctggtcaaaagac

SEQ ID NO: 641527 - DNA, 25 bp, Rattus norvegicus
gtacgtgatggcctccttcttctcc

SEQ ID NO: 641528 - DNA, 25 bp, Rattus norvegicus
agcacctcccggtacgtgatggcct

SEQ ID NO: 641529 - DNA, 25 bp, Rattus norvegicus
ctcgcgaaaaaagcatttcggtgca

SEQ ID NO: 641530 - DNA, 25 bp, Rattus norvegicus
gcactcgacagctcggctgacgctg

SEQ ID NO: 641531 - DNA, 25 bp, Rattus norvegicus
tgtggagcgttagctcccagcctgc

SEQ ID NO: 641532 - DNA, 25 bp, Rattus norvegicus
cttggcctacagtgtggagtcgatg

SEQ ID NO: 641533 - DNA, 25 bp, Rattus norvegicus
ctttgcgaaaccctgctccgcggga

SEQ ID NO: 641534 - DNA, 25 bp, Rattus norvegicus
cgcccgcgaaggaggctttgcgaaa

SEQ ID NO: 641535 - DNA, 25 bp, Rattus norvegicus
acccgaaggtcgacccaggtgatgc

SEQ ID NO: 641536 - DNA, 25 bp, Rattus norvegicus
ccacatcaagaggtgcgaacccgaa

SEQ ID NO: 641537 - DNA, 25 bp, Rattus norvegicus
tgaagcaagttctgaggacgccggt

SEQ ID NO: 641538 - DNA, 25 bp, Rattus norvegicus
tgacgctgcctggtgctggaaccag

SEQ ID NO: 641539 - DNA, 25 bp, Rattus norvegicus
gcggatcctcgatcgccgttcatcg

SEQ ID NO: 641540 - DNA, 25 bp, Rattus norvegicus
tagcagcctgcatcgacgcactcga

SEQ ID NO: 641541 - DNA, 25 bp, Rattus norvegicus
tcggctttcctaatggcctagcagc

SEQ ID NO: 641542 - DNA, 25 bp, Rattus norvegicus
ggcatgacaatccactcgctcggct

SEQ ID NO: 641543 - DNA, 25 bp, Rattus norvegicus
ccaggaaggcgctgagcttaaattg

SEQ ID NO: 641544 - DNA, 25 bp, Rattus norvegicus
tgttccggatgttgagcagcagctt

SEQ ID NO: 641545 - DNA, 25 bp, Rattus norvegicus
cgccctagttgagggcgcggctatt

SEQ ID NO: 641546 - DNA, 25 bp, Rattus norvegicus
gctattgccgcgagcagacgcgcga

SEQ ID NO: 641547 - DNA, 25 bp, Rattus norvegicus
tgccgcgagcagacgcgcgaatcta

SEQ ID NO: 641548 - DNA, 25 bp, Rattus norvegicus
agacgcgcgaatctagtgggaagca

SEQ ID NO: 641549 - DNA, 25 bp, Rattus norvegicus
gcgactgcgcccattccacccgcgg

SEQ ID NO: 641550 - DNA, 25 bp, Rattus norvegicus
cacgatgttccggatgttgagcagc

SEQ ID NO: 641551 - DNA, 25 bp, Rattus norvegicus
tccggatgttgagcagcagctttga

SEQ ID NO: 641552 - DNA, 25 bp, Rattus norvegicus
ctttgaggacgaccccttcttcgcg

SEQ ID NO: 641553 - DNA, 25 bp, Rattus norvegicus
cttcttcgcgtgagtgtcccagccg

SEQ ID NO: 641554 - DNA, 25 bp, Rattus norvegicus
gtgagtgtcccagccgcgctcgcta

SEQ ID NO: 641555 - DNA, 25 bp, Rattus norvegicus
tcccagccgcgctcgctaggagagg

SEQ ID NO: 641556 - DNA, 25 bp, Rattus norvegicus
cctcgcaagttgtgggggcaacacc

SEQ ID NO: 641557 - DNA, 25 bp, Rattus norvegicus
cgcctcagaaccacgatgttccgga

SEQ ID NO: 641558 - DNA, 25 bp, Rattus norvegicus
tacacactggaggaccgtgcgctat

SEQ ID NO: 641559 - DNA, 25 bp, Rattus norvegicus
actttacacactggaggaccgtgcg

SEQ ID NO: 641560 - DNA, 25 bp, Rattus norvegicus
aggaccgtgcgctattcactttaca

SEQ ID NO: 641561 - DNA, 25 bp, Rattus norvegicus
gaccgtgcgctattcgctttacaca

SEQ ID NO: 641562 - DNA, 25 bp, Rattus norvegicus
gtgcgctattcactttacacactgg

SEQ ID NO: 641563 - DNA, 25 bp, Rattus norvegicus
tgcgctattcgctttacacactgga

SEQ ID NO: 641564 - DNA, 25 bp, Rattus norvegicus
ttacacactggaggaccgtgcgcta

SEQ ID NO: 641565 - DNA, 25 bp, Rattus norvegicus
gtgcgctattcgctttacacactgg

SEQ ID NO: 641566 - DNA, 25 bp, Rattus norvegicus
tttacacactggaggaccgtgcgct

SEQ ID NO: 641567 - DNA, 25 bp, Rattus norvegicus
gcgctattcgctttacacactggag

SEQ ID NO: 641568 - DNA, 25 bp, Rattus norvegicus
cgctttacacactggaggaccgtgc

SEQ ID NO: 641569 - DNA, 25 bp, Rattus norvegicus
aggaccgtgcgctattcgctttaca

SEQ ID NO: 641570 - DNA, 25 bp, Rattus norvegicus
ttcgctttacacactggaggaccgt

SEQ ID NO: 641571 - DNA, 25 bp, Rattus norvegicus
tcactttacacactggaggaccgtg

SEQ ID NO: 641572 - DNA, 25 bp, Rattus norvegicus
cggaaataggccacggcggccactc

SEQ ID NO: 641573 - DNA, 25 bp, Rattus norvegicus
tctcgggcaacacaagctcgggcca

SEQ ID NO: 641574 - DNA, 25 bp, Rattus norvegicus
aggactccgtgcctctcgggcaaca

SEQ ID NO: 641575 - DNA, 25 bp, Rattus norvegicus
cagctgcaggatcccgcgtggcagc

SEQ ID NO: 641576 - DNA, 25 bp, Rattus norvegicus
agacgacggtgtactccggcttcac

SEQ ID NO: 641577 - DNA, 25 bp, Rattus norvegicus
ccagaggctcagtagcagcgccggc

SEQ ID NO: 641578 - DNA, 25 bp, Rattus norvegicus
atgcggaaagctgacgcggagctcc

SEQ ID NO: 641579 - DNA, 25 bp, Rattus norvegicus
ccggttcgcgatgctcgcggaaata

SEQ ID NO: 641580 - DNA, 25 bp, Rattus norvegicus
ggctgggccgatttcgcaaccctcg

SEQ ID NO: 641581 - DNA, 25 bp, Rattus norvegicus
ccctgtccaagcagaaggaccagaa

SEQ ID NO: 641582 - DNA, 25 bp, Rattus norvegicus
accagaaggcgcctcagggagagct

SEQ ID NO: 641583 - DNA, 25 bp, Rattus norvegicus
ctcccgctctgggaacttgccttgt

SEQ ID NO: 641584 - DNA, 25 bp, Rattus norvegicus
ggaacttgccttgtcgcctgcggct

SEQ ID NO: 641585 - DNA, 25 bp, Rattus norvegicus
ggagctccctgaacccggttcgcga

SEQ ID NO: 641586 - DNA, 25 bp, Rattus norvegicus
cccgagagagtcacgtgagcgtacg

SEQ ID NO: 641587 - DNA, 25 bp, Rattus norvegicus
ccctgtgctcgagtgtcagaacgtt

SEQ ID NO: 641588 - DNA, 25 bp, Rattus norvegicus
cgcagatgagtaggaatctcagatc

SEQ ID NO: 641589 - DNA, 25 bp, Rattus norvegicus
cctccatggggacgcagatgagtag

SEQ ID NO: 641590 - DNA, 25 bp, Rattus norvegicus
gtagcacagcatctcctccatgggg

SEQ ID NO: 641591 - DNA, 25 bp, Rattus norvegicus
gaggtgacttttgttcctgccaagc

SEQ ID NO: 641592 - DNA, 25 bp, Rattus norvegicus
ctttttccaagcgtcgcgagggagg

SEQ ID NO: 641593 - DNA, 25 bp, Rattus norvegicus
tgggagcccgctttttccaagcgtc

SEQ ID NO: 641594 - DNA, 25 bp, Rattus norvegicus
ttcgggtctccggatccgcgctgct

SEQ ID NO: 641595 - DNA, 25 bp, Rattus norvegicus
tgatgtgcctccttggcttcggtga

SEQ ID NO: 641596 - DNA, 25 bp, Rattus norvegicus
gtgcttttgctgatgtgcctccttg

SEQ ID NO: 641597 - DNA, 25 bp, Rattus norvegicus
caccggcttgtggtgcttttgctga

SEQ ID NO: 641598 - DNA, 25 bp, Rattus norvegicus
ttcctgctccattccggaccgatgg

SEQ ID NO: 641599 - DNA, 25 bp, Rattus norvegicus
tcagaacgttgctccggggaatttc

SEQ ID NO: 641600 - DNA, 25 bp, Rattus norvegicus
cgtgcccatctttcccgagaggggt

SEQ ID NO: 641601 - DNA, 25 bp, Rattus norvegicus
tctggaagactatgaagagcccttc

SEQ ID NO: 641602 - DNA, 25 bp, Rattus norvegicus
cctggacttggtgtctgctctggaa

SEQ ID NO: 641603 - DNA, 25 bp, Rattus norvegicus
agtgcaaatcctcatcgtcgccggg

SEQ ID NO: 641604 - DNA, 25 bp, Rattus norvegicus
atggatctaggcagtgacgccggca

SEQ ID NO: 641605 - DNA, 25 bp, Rattus norvegicus
ttaccgagaggatgggatggatcta

SEQ ID NO: 641606 - DNA, 25 bp, Rattus norvegicus
tcagggcaatcgcacctcacggctg

SEQ ID NO: 641607 - DNA, 25 bp, Rattus norvegicus
ggttaacacaaagtccgcgcgcgcc

SEQ ID NO: 641608 - DNA, 25 bp, Rattus norvegicus
gcgactactgcagttccttagaaag

SEQ ID NO: 641609 - DNA, 25 bp, Rattus norvegicus
aagtaaagctgagctcgcccggcgc

SEQ ID NO: 641610 - DNA, 25 bp, Rattus norvegicus
ccgcgaggtgcgaaatcagattcta

SEQ ID NO: 641611 - DNA, 25 bp, Rattus norvegicus
gcgcgcctggtgtaaaatggttaac

SEQ ID NO: 641612 - DNA, 25 bp, Rattus norvegicus
ccggtctaccagaagaaggtgattg

SEQ ID NO: 641613 - DNA, 25 bp, Rattus norvegicus
ctatgagggtgaaaagtgcgcgccc

SEQ ID NO: 641614 - DNA, 25 bp, Rattus norvegicus
gctcagcggaacagcatccatttta

SEQ ID NO: 641615 - DNA, 25 bp, Rattus norvegicus
gcggaacagcatccattttaatctg

SEQ ID NO: 641616 - DNA, 25 bp, Rattus norvegicus
ccactgcgcaggttgctcagcggaa

SEQ ID NO: 641617 - DNA, 25 bp, Rattus norvegicus
ttctcccgcgcctgtggatgctcag

SEQ ID NO: 641618 - DNA, 25 bp, Rattus norvegicus
atccattttaatctgcggggagccc

SEQ ID NO: 641619 - DNA, 25 bp, Rattus norvegicus
cgcgcctgtggatgctcagcgcttc

SEQ ID NO: 641620 - DNA, 25 bp, Rattus norvegicus
gcaggttgctcagcggaacagcatc

SEQ ID NO: 641621 - DNA, 25 bp, Rattus norvegicus
tgtggctgcgcgcttcccagcacag

SEQ ID NO: 641622 - DNA, 25 bp, Rattus norvegicus
aagctctgtggctgcgcgcttccca

SEQ ID NO: 641623 - DNA, 25 bp, Rattus norvegicus
gaggcttcagagcaagctctgtggc

SEQ ID NO: 641624 - DNA, 25 bp, Rattus norvegicus
ctcggaggcttcagagcaagctctg

SEQ ID NO: 641625 - DNA, 25 bp, Rattus norvegicus
agcagagcagctcggaggcttcaga

SEQ ID NO: 641626 - DNA, 25 bp, Rattus norvegicus
ccaggccggtcccagctcggctcag

SEQ ID NO: 641627 - DNA, 25 bp, Rattus norvegicus
tgcggggagcccctgcctaaccagg

SEQ ID NO: 641628 - DNA, 25 bp, Rattus norvegicus
gtgtgcatctctgaattagttaggg

SEQ ID NO: 641629 - DNA, 25 bp, Rattus norvegicus
cctacccaggttttgtgtgcatctc

SEQ ID NO: 641630 - DNA, 25 bp, Rattus norvegicus
gctccagacccattgcactagaaat

SEQ ID NO: 641631 - DNA, 25 bp, Rattus norvegicus
gtgcggatgagttcctgcggcctac

SEQ ID NO: 641632 - DNA, 25 bp, Rattus norvegicus
atacagcggggagcaggttgtatcc

SEQ ID NO: 641633 - DNA, 25 bp, Rattus norvegicus
cctagagctcgtagtacgggctgtc

SEQ ID NO: 641634 - DNA, 25 bp, Rattus norvegicus
tcgagggtaattgatccacgggcta

SEQ ID NO: 641635 - DNA, 25 bp, Rattus norvegicus
atccacgggctaagaggagacgcag

SEQ ID NO: 641636 - DNA, 25 bp, Rattus norvegicus
ggagacgcaggactcggacgtaaaa

SEQ ID NO: 641637 - DNA, 25 bp, Rattus norvegicus
tacctcctgccgaggatcgtgtgtg

SEQ ID NO: 641638 - DNA, 25 bp, Rattus norvegicus
agcgcgagttcgaagggtttacaga

SEQ ID NO: 641639 - DNA, 25 bp, Rattus norvegicus
caggtaagtgtcgtggtctccgtac

SEQ ID NO: 641640 - DNA, 25 bp, Rattus norvegicus
gtactgcccggaagctccgcagtca

SEQ ID NO: 641641 - DNA, 25 bp, Rattus norvegicus
tcccgcaatgccttgtgggtccttc

SEQ ID NO: 641642 - DNA, 25 bp, Rattus norvegicus
cgaaccagtccgagtccgggagcca

SEQ ID NO: 641643 - DNA, 25 bp, Rattus norvegicus
gccgaacagattacagtgagcctcc

SEQ ID NO: 641644 - DNA, 25 bp, Rattus norvegicus
cactcccggcttctgaaggtgggta

SEQ ID NO: 641645 - DNA, 25 bp, Rattus norvegicus
cctcgcgcaaagcagactgggagta

SEQ ID NO: 641646 - DNA, 25 bp, Rattus norvegicus
ggatgacacgttggacacgcctctg

SEQ ID NO: 641647 - DNA, 25 bp, Rattus norvegicus
cttcactccgcctctgggctataga

SEQ ID NO: 641648 - DNA, 25 bp, Rattus norvegicus
gggctatagagtcccgcctctgttc

SEQ ID NO: 641649 - DNA, 25 bp, Rattus norvegicus
acgactgcgagtctaaggaagccga

SEQ ID NO: 641650 - DNA, 25 bp, Rattus norvegicus
agaatccacctcctacggaagccga

SEQ ID NO: 641651 - DNA, 25 bp, Rattus norvegicus
cgaagcgcagtcagaatccggaaga

SEQ ID NO: 641652 - DNA, 25 bp, Rattus norvegicus
tgcagcgctgagacacgaacctaca

SEQ ID NO: 641653 - DNA, 25 bp, Rattus norvegicus
cgaacctacagcattaccacgaagg

SEQ ID NO: 641654 - DNA, 25 bp, Rattus norvegicus
accacgaaggaataatgacgactgc

SEQ ID NO: 641655 - DNA, 25 bp, Rattus norvegicus
cccaaagccctagacgttcagaatc

SEQ ID NO: 641656 - DNA, 25 bp, Rattus norvegicus
ggtgctcttcgccatcggctacttc

SEQ ID NO: 641657 - DNA, 25 bp, Rattus norvegicus
cggactccaggtcacaggttcccga

SEQ ID NO: 641658 - DNA, 25 bp, Rattus norvegicus
gacagcggtgagcagcagccgcctc

SEQ ID NO: 641659 - DNA, 25 bp, Rattus norvegicus
tccctctccagcgtggccaagtgag

SEQ ID NO: 641660 - DNA, 25 bp, Rattus norvegicus
ggccagacggagctccgagccttgc

SEQ ID NO: 641661 - DNA, 25 bp, Rattus norvegicus
caccgagggcctgtcggtggctcca

SEQ ID NO: 641662 - DNA, 25 bp, Rattus norvegicus
acaacgtgggctggttcgtccgcaa

SEQ ID NO: 641663 - DNA, 25 bp, Rattus norvegicus
ctgctcatcctgctggtgctcttcg

SEQ ID NO: 641664 - DNA, 25 bp, Rattus norvegicus
agctacgaggaggtcaagtaccttc

SEQ ID NO: 641665 - DNA, 25 bp, Rattus norvegicus
gtgtcaccggtctttctccagctgc

SEQ ID NO: 641666 - DNA, 25 bp, Rattus norvegicus
cccatccagcgtttcggagcacgaa

SEQ ID NO: 641667 - DNA, 25 bp, Rattus norvegicus
tcgcaggactcactgctggacagtg

SEQ ID NO: 641668 - DNA, 25 bp, Rattus norvegicus
gctacttcctgcagcgcatcatctg

SEQ ID NO: 641669 - DNA, 25 bp, Rattus norvegicus
tcgtccgcaagctctctgggctgct

SEQ ID NO: 641670 - DNA, 25 bp, Rattus norvegicus
cgacgctgccagagtccaattttgc

SEQ ID NO: 641671 - DNA, 25 bp, Rattus norvegicus
cggcaggagactgtcagcagatgtc

SEQ ID NO: 641672 - DNA, 25 bp, Rattus norvegicus
tggggacttggcatgacttatactg

SEQ ID NO: 641673 - DNA, 25 bp, Rattus norvegicus
gggccgacctgactccagattctct

SEQ ID NO: 641674 - DNA, 25 bp, Rattus norvegicus
gccgctgtgttcctagtagccactt

SEQ ID NO: 641675 - DNA, 25 bp, Rattus norvegicus
ctgccgacaaggtgaagtacttctt

SEQ ID NO: 641676 - DNA, 25 bp, Rattus norvegicus
cagcagatgtccttctcttgagaga

SEQ ID NO: 641677 - DNA, 25 bp, Rattus norvegicus
tttccgataccgagcgcattcactc

SEQ ID NO: 641678 - DNA, 25 bp, Rattus norvegicus
gctggtcgaacttctctttccgata

SEQ ID NO: 641679 - DNA, 25 bp, Rattus norvegicus
ctggagagtagtcacgcagacccga

SEQ ID NO: 641680 - DNA, 25 bp, Rattus norvegicus
tccaggactcaggacctaaatggcg

SEQ ID NO: 641681 - DNA, 25 bp, Rattus norvegicus
ttatactgtccatcgggactccgcc

SEQ ID NO: 641682 - DNA, 25 bp, Rattus norvegicus
cccgtctctcaaggggactgcagtc

SEQ ID NO: 641683 - DNA, 25 bp, Rattus norvegicus
gtggcctgagcgaattcctctgtcc

SEQ ID NO: 641684 - DNA, 25 bp, Rattus norvegicus
acaggttccttgctcaggccagtga

SEQ ID NO: 641685 - DNA, 25 bp, Rattus norvegicus
gcagagccggcttactcaccgcgag

SEQ ID NO: 641686 - DNA, 25 bp, Rattus norvegicus
agcgatggctcccaagcagcttggt

SEQ ID NO: 641687 - DNA, 25 bp, Rattus norvegicus
catcctctagttcgcggtgaacgcc

SEQ ID NO: 641688 - DNA, 25 bp, Rattus norvegicus
cagcttggtgcggacactgcaaagc

SEQ ID NO: 641689 - DNA, 25 bp, Rattus norvegicus
actgcaaagcgctcgccggagtcct

SEQ ID NO: 641690 - DNA, 25 bp, Rattus norvegicus
gcggcccgacattggctttcaactg

SEQ ID NO: 641691 - DNA, 25 bp, Rattus norvegicus
gcgcgggcgtcctttgaacgccaac

SEQ ID NO: 641692 - DNA, 25 bp, Rattus norvegicus
cggtccggactgatgatcctcagtg

SEQ ID NO: 641693 - DNA, 25 bp, Rattus norvegicus
gcgacgatgcacacagcgatggctc

SEQ ID NO: 641694 - DNA, 25 bp, Rattus norvegicus
agccttcttccattgttacctcaca

SEQ ID NO: 641695 - DNA, 25 bp, Rattus norvegicus
cagtgaagtcactggcgctcgtccg

SEQ ID NO: 641696 - DNA, 25 bp, Rattus norvegicus
ttaggcacgcctaagccgtcgtctg

SEQ ID NO: 641697 - DNA, 25 bp, Rattus norvegicus
tgcttattaggaccacgcccgcacg

SEQ ID NO: 641698 - DNA, 25 bp, Rattus norvegicus
ctccggcgtgcttggccaatcaaaa

SEQ ID NO: 641699 - DNA, 25 bp, Rattus norvegicus
cacagcagctctggcgaagacgact

SEQ ID NO: 641700 - DNA, 25 bp, Rattus norvegicus
tgagcccgggtaccacagcagctct

SEQ ID NO: 641701 - DNA, 25 bp, Rattus norvegicus
gtccaatttctcgttgtccgccatg

SEQ ID NO: 641702 - DNA, 25 bp, Rattus norvegicus
cttgagccgttggttgtccaatttc

SEQ ID NO: 641703 - DNA, 25 bp, Rattus norvegicus
taaaattcttgagccgttggttgtc

SEQ ID NO: 641704 - DNA, 25 bp, Rattus norvegicus
gtggaagcgtcttaggccctgagaa

SEQ ID NO: 641705 - DNA, 25 bp, Rattus norvegicus
gcctttgttcttaaaattcttgagc

SEQ ID NO: 641706 - DNA, 25 bp, Rattus norvegicus
tgtacctccaagtcgcggcctttgt

SEQ ID NO: 641707 - DNA, 25 bp, Rattus norvegicus
tggccggctcggcagaacaggccta

SEQ ID NO: 641708 - DNA, 25 bp, Rattus norvegicus
gcactcgtgtctggccggctcggca

SEQ ID NO: 641709 - DNA, 25 bp, Rattus norvegicus
aagttacgaggtcgccgctcgctcc

SEQ ID NO: 641710 - DNA, 25 bp, Rattus norvegicus
cttggccaatcaaaaggggcgatgg

SEQ ID NO: 641711 - DNA, 25 bp, Rattus norvegicus
ttaggccctgagaagttacgaggtc

SEQ ID NO: 641712 - DNA, 25 bp, Rattus norvegicus
agaccatcgtcaagtccagccggga

SEQ ID NO: 641713 - DNA, 25 bp, Rattus norvegicus
cagaacgatcgtcttggaggacttg

SEQ ID NO: 641714 - DNA, 25 bp, Rattus norvegicus
tggaggccgagttttccaagacctg

SEQ ID NO: 641715 - DNA, 25 bp, Rattus norvegicus
acctgggaattcaagagccataatg

SEQ ID NO: 641716 - DNA, 25 bp, Rattus norvegicus
agccataatgttgcggtgtactcca

SEQ ID NO: 641717 - DNA, 25 bp, Rattus norvegicus
ggtgtactccatccagggccggaga

SEQ ID NO: 641718 - DNA, 25 bp, Rattus norvegicus
cacatggaagatcgcttcgaagttc

SEQ ID NO: 641719 - DNA, 25 bp, Rattus norvegicus
ttcgaagttctaacggatctggcca

SEQ ID NO: 641720 - DNA, 25 bp, Rattus norvegicus
ggatctggccaacaagacgcacccg

SEQ ID NO: 641721 - DNA, 25 bp, Rattus norvegicus
agacgcacccgtccatcttcggaat

SEQ ID NO: 641722 - DNA, 25 bp, Rattus norvegicus
tcttcggaatctttgacggtcacgg

SEQ ID NO: 641723 - DNA, 25 bp, Rattus norvegicus
agttctctgggtttatgtgtgtgta

SEQ ID NO: 641724 - DNA, 25 bp, Rattus norvegicus
gtgtgtgtaaataaccaggcgtcta

SEQ ID NO: 641725 - DNA, 25 bp, Rattus norvegicus
gtggccgagattatgcagaacgatc

SEQ ID NO: 641726 - DNA, 25 bp, Rattus norvegicus
gtttgccgaccgtattctccgcttc

SEQ ID NO: 641727 - DNA, 25 bp, Rattus norvegicus
tccgactccggtttttgccttgtgc

SEQ ID NO: 641728 - DNA, 25 bp, Rattus norvegicus
ttcgcataagactccgactccggtt

SEQ ID NO: 641729 - DNA, 25 bp, Rattus norvegicus
aatgtgtgttcctccctccgggcct

SEQ ID NO: 641730 - DNA, 25 bp, Rattus norvegicus
gctgcaggtccaccggtttgccgac

SEQ ID NO: 641731 - DNA, 25 bp, Rattus norvegicus
ctttcccgcctggaatgtgtgttcc

SEQ ID NO: 641732 - DNA, 25 bp, Rattus norvegicus
ggatggattcctgcgtccgcgcata

SEQ ID NO: 641733 - DNA, 25 bp, Rattus norvegicus
tggtcccgagcctcaagaaccagct

SEQ ID NO: 641734 - DNA, 25 bp, Rattus norvegicus
tttttgccttgtgccgtcttagggc

SEQ ID NO: 641735 - DNA, 25 bp, Rattus norvegicus
ccggacccaggaacctagaaggctg

SEQ ID NO: 641736 - DNA, 25 bp, Rattus norvegicus
acctagaaggctgctccacgagagc

SEQ ID NO: 641737 - DNA, 25 bp, Rattus norvegicus
gcgctgttacagctgccagccactg

SEQ ID NO: 641738 - DNA, 25 bp, Rattus norvegicus
gcgccagcatcaccgtcgcaggttt

SEQ ID NO: 641739 - DNA, 25 bp, Rattus norvegicus
ccgtcgcaggtttcgcataagactc

SEQ ID NO: 641740 - DNA, 25 bp, Rattus norvegicus
tgtcttttgccctgtcacgtaagtg

SEQ ID NO: 641741 - DNA, 25 bp, Rattus norvegicus
gcactgtacctaggccgcgagctgc

SEQ ID NO: 641742 - DNA, 25 bp, Rattus norvegicus
agcgggtccgcactgtacctaggcc

SEQ ID NO: 641743 - DNA, 25 bp, Rattus norvegicus
gctcctgcgccagcagtggccagag

SEQ ID NO: 641744 - DNA, 25 bp, Rattus norvegicus
tcacgtaagtgctggtaggctctcg

SEQ ID NO: 641745 - DNA, 25 bp, Rattus norvegicus
ttgccctgtcacgtaagtgctggta

SEQ ID NO: 641746 - DNA, 25 bp, Rattus norvegicus
tcacggacccgggtcttgcgtgtcg

SEQ ID NO: 641747 - DNA, 25 bp, Rattus norvegicus
gctgttcgtgtcttttgccctgtca

SEQ ID NO: 641748 - DNA, 25 bp, Rattus norvegicus
ttgccggctgttcgtgtcttttgcc

SEQ ID NO: 641749 - DNA, 25 bp, Rattus norvegicus
tcccggccagcaggttgccggctgt

SEQ ID NO: 641750 - DNA, 25 bp, Rattus norvegicus
gctgtgggaactgaaggtgcgtccc

SEQ ID NO: 641751 - DNA, 25 bp, Rattus norvegicus
tcctatcgcgagatctccctggtgg

SEQ ID NO: 641752 - DNA, 25 bp, Rattus norvegicus
gggatttccggtcttcctatcgcga

SEQ ID NO: 641753 - DNA, 25 bp, Rattus norvegicus
tccggtcttcctatcgcgagatctc

SEQ ID NO: 641754 - DNA, 25 bp, Rattus norvegicus
gttacttaccgaacgtctgcctcta

SEQ ID NO: 641755 - DNA, 25 bp, Rattus norvegicus
gtctgcctctaaactgggagcgcca

SEQ ID NO: 641756 - DNA, 25 bp, Rattus norvegicus
tctaaactgggagcgccaggtcagg

SEQ ID NO: 641757 - DNA, 25 bp, Rattus norvegicus
tcagggactagaaggcaatacagaa

SEQ ID NO: 641758 - DNA, 25 bp, Rattus norvegicus
agaaggcaatacagaaacgcagggc

SEQ ID NO: 641759 - DNA, 25 bp, Rattus norvegicus
aacgcagggctggaaaccgaatgca

SEQ ID NO: 641760 - DNA, 25 bp, Rattus norvegicus
gctggaaaccgaatgcaaagccatc

SEQ ID NO: 641761 - DNA, 25 bp, Rattus norvegicus
aaccgaatgcaaagccatcagccgc

SEQ ID NO: 641762 - DNA, 25 bp, Rattus norvegicus
ccaaatcgcgcaccgagggagcggc

SEQ ID NO: 641763 - DNA, 25 bp, Rattus norvegicus
atcactggagcctccgccagcttgt

SEQ ID NO: 641764 - DNA, 25 bp, Rattus norvegicus
tcctccgcgccaactgtgtaaatca

SEQ ID NO: 641765 - DNA, 25 bp, Rattus norvegicus
ctgtgtaaatcagccgccgcagtcc

SEQ ID NO: 641766 - DNA, 25 bp, Rattus norvegicus
gccgcagtcctctcgccgcgcatcg

SEQ ID NO: 641767 - DNA, 25 bp, Rattus norvegicus
ccgaacgtctgcctctaaactggga

SEQ ID NO: 641768 - DNA, 25 bp, Rattus norvegicus
ccaggctaggcaagcggcatttaca

SEQ ID NO: 641769 - DNA, 25 bp, Rattus norvegicus
ggcatttacaaactagcttcacgca

SEQ ID NO: 641770 - DNA, 25 bp, Rattus norvegicus
gcttcacgcagctcacatagagacc

SEQ ID NO: 641771 - DNA, 25 bp, Rattus norvegicus
atagagacctcgctgacgcccagag

SEQ ID NO: 641772 - DNA, 25 bp, Rattus norvegicus
gagccgtgcggacccgaaccgagaa

SEQ ID NO: 641773 - DNA, 25 bp, Rattus norvegicus
agaaacctcgtcttaccagtaactg

SEQ ID NO: 641774 - DNA, 25 bp, Rattus norvegicus
taccagtaactgaggcacggacttc

SEQ ID NO: 641775 - DNA, 25 bp, Rattus norvegicus
gtaactgaggcacggacttcacttc

SEQ ID NO: 641776 - DNA, 25 bp, Rattus norvegicus
cggacttcacttcccacctttggag

SEQ ID NO: 641777 - DNA, 25 bp, Rattus norvegicus
gatcaattcactccggcgacgccgg

SEQ ID NO: 641778 - DNA, 25 bp, Rattus norvegicus
gaaccaggcgttgtccggaatcctg

SEQ ID NO: 641779 - DNA, 25 bp, Rattus norvegicus
tggagatccaggaggccgacctcac

SEQ ID NO: 641780 - DNA, 25 bp, Rattus norvegicus
ttgtccggaatcctgcccagcagga

SEQ ID NO: 641781 - DNA, 25 bp, Rattus norvegicus
cctgcccagcaggagtcgcgcaagg

SEQ ID NO: 641782 - DNA, 25 bp, Rattus norvegicus
ggagcacatcccgtttcccatagtc

SEQ ID NO: 641783 - DNA, 25 bp, Rattus norvegicus
aggaagccgaagaccaccgtgagta

SEQ ID NO: 641784 - DNA, 25 bp, Rattus norvegicus
gttccaagtagagcatcgcgccata

SEQ ID NO: 641785 - DNA, 25 bp, Rattus norvegicus
ggctccattggacgccagctttgtc

SEQ ID NO: 641786 - DNA, 25 bp, Rattus norvegicus
atccgcttctgctttcgggagcaca

SEQ ID NO: 641787 - DNA, 25 bp, Rattus norvegicus
ccaccgcgagaagtagccgaacaca

SEQ ID NO: 641788 - DNA, 25 bp, Rattus norvegicus
ccaaacttctgcgatgtccgatgtc

SEQ ID NO: 641789 - DNA, 25 bp, Rattus norvegicus
gcgtggagtccctttgcatacttta

SEQ ID NO: 641790 - DNA, 25 bp, Rattus norvegicus
gcatactttagagcccgctgccttc

SEQ ID NO: 641791 - DNA, 25 bp, Rattus norvegicus
cgcggctggactttgtcgctaccac

SEQ ID NO: 641792 - DNA, 25 bp, Rattus norvegicus
gacgcgcgcccaacaaaaggagctg

SEQ ID NO: 641793 - DNA, 25 bp, Rattus norvegicus
tggtgtcactgatctggcagctcca

SEQ ID NO: 641794 - DNA, 25 bp, Rattus norvegicus
cgctatcatggccaacgggattccg

SEQ ID NO: 641795 - DNA, 25 bp, Rattus norvegicus
cagcagcgtctggaagatccgcttc

SEQ ID NO: 641796 - DNA, 25 bp, Rattus norvegicus
cgagttaatagagaagtgcagcacc

SEQ ID NO: 641797 - DNA, 25 bp, Rattus norvegicus
cctgcgagccgagccatttgtgaaa

SEQ ID NO: 641798 - DNA, 25 bp, Rattus norvegicus
cgatcacccgaagaaccaagccggt

SEQ ID NO: 641799 - DNA, 25 bp, Rattus norvegicus
gacatagccacagagtcccagatgg

SEQ ID NO: 641800 - DNA, 25 bp, Rattus norvegicus
tgagcgtcttcagctagctgccaga

SEQ ID NO: 641801 - DNA, 25 bp, Rattus norvegicus
tggtcgtgctacctctagctgggta

SEQ ID NO: 641802 - DNA, 25 bp, Rattus norvegicus
ctgggtattgctgaggcaggattca

SEQ ID NO: 641803 - DNA, 25 bp, Rattus norvegicus
gggatccaggcactcggtgctccct

SEQ ID NO: 641804 - DNA, 25 bp, Rattus norvegicus
ctgactattacagggtcccaggacc

SEQ ID NO: 641805 - DNA, 25 bp, Rattus norvegicus
tggaggcactggagctcagtctctt

SEQ ID NO: 641806 - DNA, 25 bp, Rattus norvegicus
gcgtgcgcccgaatagaactgtgac

SEQ ID NO: 641807 - DNA, 25 bp, Rattus norvegicus
acgcgtctcgtcctgcgagttaata

SEQ ID NO: 641808 - DNA, 25 bp, Rattus norvegicus
aggcaggattcactcagcctgacta

SEQ ID NO: 641809 - DNA, 25 bp, Rattus norvegicus
agcaccaagccttgacgggcgctgg

SEQ ID NO: 641810 - DNA, 25 bp, Rattus norvegicus
cagaccagggcgaacccgagccagg

SEQ ID NO: 641811 - DNA, 25 bp, Rattus norvegicus
cgccgccgtggttaggtgtactcac

SEQ ID NO: 641812 - DNA, 25 bp, Rattus norvegicus
gcccggtgacgtcgcagcgagacct

SEQ ID NO: 641813 - DNA, 25 bp, Rattus norvegicus
gacgtcgcagcgagacctttctgca

SEQ ID NO: 641814 - DNA, 25 bp, Rattus norvegicus
agcgagacctttctgcaaccagttc

SEQ ID NO: 641815 - DNA, 25 bp, Rattus norvegicus
tttctgcaaccagttcgctcacatc

SEQ ID NO: 641816 - DNA, 25 bp, Rattus norvegicus
ctgtcggtgctctaggccagaccag

SEQ ID NO: 641817 - DNA, 25 bp, Rattus norvegicus
ttcccacgcacagtcatactagacg

SEQ ID NO: 641818 - DNA, 25 bp, Rattus norvegicus
cacagtcatactagacgcctaacta

SEQ ID NO: 641819 - DNA, 25 bp, Rattus norvegicus
cgcctaactacaaacaagcgacttg

SEQ ID NO: 641820 - DNA, 25 bp, Rattus norvegicus
caagcgacttgtgactagtagagtg

SEQ ID NO: 641821 - DNA, 25 bp, Rattus norvegicus
acttgtgactagtagagtgcgagca

SEQ ID NO: 641822 - DNA, 25 bp, Rattus norvegicus
gaacccgagccagggtacctgcgct

SEQ ID NO: 641823 - DNA, 25 bp, Rattus norvegicus
atcaccttccctgtcggtgctctag

SEQ ID NO: 641824 - DNA, 25 bp, Rattus norvegicus
ataaagtccgacaatgcccacgccg

SEQ ID NO: 641825 - DNA, 25 bp, Rattus norvegicus
tccacagtgtgtcggtgctgaacgc

SEQ ID NO: 641826 - DNA, 25 bp, Rattus norvegicus
ctgagactaactggacgtgagcgga

SEQ ID NO: 641827 - DNA, 25 bp, Rattus norvegicus
cagcttggttcagtgactgagacta

SEQ ID NO: 641828 - DNA, 25 bp, Rattus norvegicus
gaggcgcgagaatcagcttggttca

SEQ ID NO: 641829 - DNA, 25 bp, Rattus norvegicus
tgcaaaacagttacgtcagatgtgg

SEQ ID NO: 641830 - DNA, 25 bp, Rattus norvegicus
cacctcccggagagttaatatgcaa

SEQ ID NO: 641831 - DNA, 25 bp, Rattus norvegicus
tcagaagcccagtcaaggggccgcc

SEQ ID NO: 641832 - DNA, 25 bp, Rattus norvegicus
tgcggtggctgaacccatcagaagc

SEQ ID NO: 641833 - DNA, 25 bp, Rattus norvegicus
gccgccgattttaatccggaatctg

SEQ ID NO: 641834 - DNA, 25 bp, Rattus norvegicus
ctccgcgaatcgagcataaagtccg

SEQ ID NO: 641835 - DNA, 25 bp, Rattus norvegicus
tttagtttctgctgggctccgcgaa

SEQ ID NO: 641836 - DNA, 25 bp, Rattus norvegicus
agacacagccgcagcctttagtttc

SEQ ID NO: 641837 - DNA, 25 bp, Rattus norvegicus
atccggaatctggtcctcgggattg

SEQ ID NO: 641838 - DNA, 25 bp, Rattus norvegicus
ctgcagggccacgttgtaatccggg

SEQ ID NO: 641839 - DNA, 25 bp, Rattus norvegicus
cgctgcagggccacgttgtaatccg

SEQ ID NO: 641840 - DNA, 25 bp, Rattus norvegicus
ccgctgcagggccacgttgtaatcc

SEQ ID NO: 641841 - DNA, 25 bp, Rattus norvegicus
tgccaccatgcgggaccgctgcagg

SEQ ID NO: 641842 - DNA, 25 bp, Rattus norvegicus
gggcctcagtgggccgtgccaccat

SEQ ID NO: 641843 - DNA, 25 bp, Rattus norvegicus
ctggctgtggctgccggcggcgtct

SEQ ID NO: 641844 - DNA, 25 bp, Rattus norvegicus
gtcctcctccgctccggcgaagccc

SEQ ID NO: 641845 - DNA, 25 bp, Rattus norvegicus
actgcggtttgctgcccggccggct

SEQ ID NO: 641846 - DNA, 25 bp, Rattus norvegicus
gtgccactgcggtttgctgcccggc

SEQ ID NO: 641847 - DNA, 25 bp, Rattus norvegicus
tcgctgggcttgtgccactgcggtt

SEQ ID NO: 641848 - DNA, 25 bp, Rattus norvegicus
aggcgtgggtctgcgtcgctgggct

SEQ ID NO: 641849 - DNA, 25 bp, Rattus norvegicus
aagccctgcggctggaagggcgcga

SEQ ID NO: 641850 - DNA, 25 bp, Rattus norvegicus
ctccggcgaagccctgcggctggaa

SEQ ID NO: 641851 - DNA, 25 bp, Rattus norvegicus
cacgttgtaatccgggggcttcctg

SEQ ID NO: 641852 - DNA, 25 bp, Rattus norvegicus
cggctcaggtctgggcgccaccaag

SEQ ID NO: 641853 - DNA, 25 bp, Rattus norvegicus
acagcacgaagggtccgtgcagccc

SEQ ID NO: 641854 - DNA, 25 bp, Rattus norvegicus
tgccctccttctcgcggcttgttgt

SEQ ID NO: 641855 - DNA, 25 bp, Rattus norvegicus
tcgcggcttgttgtccgtagactca

SEQ ID NO: 641856 - DNA, 25 bp, Rattus norvegicus
cgtagactcagactcagagactgcc

SEQ ID NO: 641857 - DNA, 25 bp, Rattus norvegicus
agagactgcccagcagcgctccgga

SEQ ID NO: 641858 - DNA, 25 bp, Rattus norvegicus
ttatttttagggaggtgcaagcgac

SEQ ID NO: 641859 - DNA, 25 bp, Rattus norvegicus
cgcgctctaggcaactttgtgcgtc

SEQ ID NO: 641860 - DNA, 25 bp, Rattus norvegicus
gccaagcgtctgctgaacggcgacc

SEQ ID NO: 641861 - DNA, 25 bp, Rattus norvegicus
cggggcttgttgctttgtgctgcaa

SEQ ID NO: 641862 - DNA, 25 bp, Rattus norvegicus
ctttgtgctgcaaccatggtgagga

SEQ ID NO: 641863 - DNA, 25 bp, Rattus norvegicus
tgcaagccgcgttctgccgtggcca

SEQ ID NO: 641864 - DNA, 25 bp, Rattus norvegicus
aaacagcccggtctgttgcgaccgc

SEQ ID NO: 641865 - DNA, 25 bp, Rattus norvegicus
ctccggaacggtcgcggatcgcgct

SEQ ID NO: 641866 - DNA, 25 bp, Rattus norvegicus
cacgctccgggacccgacggctcag

SEQ ID NO: 641867 - DNA, 25 bp, Rattus norvegicus
ccgctggccggtcatatgacggagc

SEQ ID NO: 641868 - DNA, 25 bp, Rattus norvegicus
cgccggaccgctgcagcggacggaa

SEQ ID NO: 641869 - DNA, 25 bp, Rattus norvegicus
cccgacggctcagcgcgcagcccaa

SEQ ID NO: 641870 - DNA, 25 bp, Rattus norvegicus
tttgttgaagagcttctggagcagg

SEQ ID NO: 641871 - DNA, 25 bp, Rattus norvegicus
ccttttgttgaagagcttctggagc

SEQ ID NO: 641872 - DNA, 25 bp, Rattus norvegicus
gccgccgccccttttgttgaagagc

SEQ ID NO: 641873 - DNA, 25 bp, Rattus norvegicus
gaaggccggctcctccttgggcggc

SEQ ID NO: 641874 - DNA, 25 bp, Rattus norvegicus
cgcggggatccggtctccatgcagc

SEQ ID NO: 641875 - DNA, 25 bp, Rattus norvegicus
ccggtcatatgacggagccggcccg

SEQ ID NO: 641876 - DNA, 25 bp, Rattus norvegicus
gctcgcacgcgctcacctgaaggcc

SEQ ID NO: 641877 - DNA, 25 bp, Rattus norvegicus
ggggatccggtctccatgcagcccg

SEQ ID NO: 641878 - DNA, 25 bp, Rattus norvegicus
ctgacagctcgctcccgcgggagga

SEQ ID NO: 641879 - DNA, 25 bp, Rattus norvegicus
ggtctccatgcagcccgcctgcggc

SEQ ID NO: 641880 - DNA, 25 bp, Rattus norvegicus
cggctcagcccttctagcgcttggg

SEQ ID NO: 641881 - DNA, 25 bp, Rattus norvegicus
tgtccacccagcgatgcagcaaaga

SEQ ID NO: 641882 - DNA, 25 bp, Rattus norvegicus
atcgaccgtcactctagccactaga

SEQ ID NO: 641883 - DNA, 25 bp, Rattus norvegicus
cgcagattccggtcgtgcgcaggaa

SEQ ID NO: 641884 - DNA, 25 bp, Rattus norvegicus
tcaccggaaactagagcgcagattc

SEQ ID NO: 641885 - DNA, 25 bp, Rattus norvegicus
cgccgaggctaggatggtttctaaa

SEQ ID NO: 641886 - DNA, 25 bp, Rattus norvegicus
ttcttcttggcctgctggctgttcg

SEQ ID NO: 641887 - DNA, 25 bp, Rattus norvegicus
ccgcgagtcttctttgacgtggaca

SEQ ID NO: 641888 - DNA, 25 bp, Rattus norvegicus
gcaggcaagccctccaattccaaga

SEQ ID NO: 641889 - DNA, 25 bp, Rattus norvegicus
ttccagcgcctgcagtgaagatgtc

SEQ ID NO: 641890 - DNA, 25 bp, Rattus norvegicus
aggcacttgtgtcctgctttccagc

SEQ ID NO: 641891 - DNA, 25 bp, Rattus norvegicus
tagacgtgcggtagagtttgagccc

SEQ ID NO: 641892 - DNA, 25 bp, Rattus norvegicus
tcgccagcttataacgtagacgtgc

SEQ ID NO: 641893 - DNA, 25 bp, Rattus norvegicus
gtcttcagcgtgtcgccagcttata

SEQ ID NO: 641894 - DNA, 25 bp, Rattus norvegicus
gaggcccacacggtctcgcatgtgc

SEQ ID NO: 641895 - DNA, 25 bp, Rattus norvegicus
gccacagaggacacgatacccagta

SEQ ID NO: 641896 - DNA, 25 bp, Rattus norvegicus
tttccgggtcacgtacaagcgagga

SEQ ID NO: 641897 - DNA, 25 bp, Rattus norvegicus
ggcagaagactccatctcccagtca

SEQ ID NO: 641898 - DNA, 25 bp, Rattus norvegicus
acctagtgtacggaagaggcccaca

SEQ ID NO: 641899 - DNA, 25 bp, Rattus norvegicus
tgagtcgctcagcattctgggagtt

SEQ ID NO: 641900 - DNA, 25 bp, Rattus norvegicus
cgcaaggagtgcctgacttgatatc

SEQ ID NO: 641901 - DNA, 25 bp, Rattus norvegicus
atatctgattggctgtctgggaaaa

SEQ ID NO: 641902 - DNA, 25 bp, Rattus norvegicus
tgaaaagtacttgtggtccagggca

SEQ ID NO: 641903 - DNA, 25 bp, Rattus norvegicus
tggtccagggcagaaacaaacgaga

SEQ ID NO: 641904 - DNA, 25 bp, Rattus norvegicus
cccatggctgattctgaggagtttc

SEQ ID NO: 641905 - DNA, 25 bp, Rattus norvegicus
ttcatcgtccctcagcatgccagtg

SEQ ID NO: 641906 - DNA, 25 bp, Rattus norvegicus
tagtgttcagctccagtgtctcccg

SEQ ID NO: 641907 - DNA, 25 bp, Rattus norvegicus
gtcatcctcatccaggaacctagtg

SEQ ID NO: 641908 - DNA, 25 bp, Rattus norvegicus
tgcctcttagagacctccagtcttg

SEQ ID NO: 641909 - DNA, 25 bp, Rattus norvegicus
atccgattttagcaccgaggacagc

SEQ ID NO: 641910 - DNA, 25 bp, Rattus norvegicus
gcgcatccgattttagcaccgagga

SEQ ID NO: 641911 - DNA, 25 bp, Rattus norvegicus
cttgcgcatccgattttagcaccga

SEQ ID NO: 641912 - DNA, 25 bp, Rattus norvegicus
ccagtcttgcgcatccgattttagc

SEQ ID NO: 641913 - DNA, 25 bp, Rattus norvegicus
ttagagacctccagtcttgcgcatc

SEQ ID NO: 641914 - DNA, 25 bp, Rattus norvegicus
tggtgcctcttagagacctccagtc

SEQ ID NO: 641915 - DNA, 25 bp, Rattus norvegicus
cagcctggtgcctcttagagacctc

SEQ ID NO: 641916 - DNA, 25 bp, Rattus norvegicus
agaaagctcagctcagagccgggca

SEQ ID NO: 641917 - DNA, 25 bp, Rattus norvegicus
cggtgccgagaaagctcagctcaga

SEQ ID NO: 641918 - DNA, 25 bp, Rattus norvegicus
tgcacggtgccgagaaagctcagct

SEQ ID NO: 641919 - DNA, 25 bp, Rattus norvegicus
gcgcgcgtgcgcgactcaaggcagg

SEQ ID NO: 641920 - DNA, 25 bp, Rattus norvegicus
cctggcagcttctgcacggtgccga

SEQ ID NO: 641921 - DNA, 25 bp, Rattus norvegicus
gacctccagtcttgcgcatccgatt

SEQ ID NO: 641922 - DNA, 25 bp, Rattus norvegicus
agaggcagctgtgaccctcgagtcc

SEQ ID NO: 641923 - DNA, 25 bp, Rattus norvegicus
cgccgcggacaactgcggggaccac

SEQ ID NO: 641924 - DNA, 25 bp, Rattus norvegicus
actgcgtcttgcaccgagcccgcct

SEQ ID NO: 641925 - DNA, 25 bp, Rattus norvegicus
gtcttgcaccgagcccgcctcgggc

SEQ ID NO: 641926 - DNA, 25 bp, Rattus norvegicus
ccggagcccgcgctgtgctgagctc

SEQ ID NO: 641927 - DNA, 25 bp, Rattus norvegicus
gagctcgccgccaggccttaccgca

SEQ ID NO: 641928 - DNA, 25 bp, Rattus norvegicus
ccgccaggccttaccgcacgcgccc

SEQ ID NO: 641929 - DNA, 25 bp, Rattus norvegicus
gcgcagaggcagctgtgaccctcga

SEQ ID NO: 641930 - DNA, 25 bp, Rattus norvegicus
cagaggcagctgtgaccctcgagtc

SEQ ID NO: 641931 - DNA, 25 bp, Rattus norvegicus
gaggcagctgtgaccctcgagtccc

SEQ ID NO: 641932 - DNA, 25 bp, Rattus norvegicus
ctgtgaccctcgagtcccgccgccg

SEQ ID NO: 641933 - DNA, 25 bp, Rattus norvegicus
gccgccgagcttgacgcgtctgctc

SEQ ID NO: 641934 - DNA, 25 bp, Rattus norvegicus
aggcagctgtgaccctcgagtcccg

SEQ ID NO: 641935 - DNA, 25 bp, Rattus norvegicus
cgagcttgacgcgtctgctccgccc

SEQ ID NO: 641936 - DNA, 25 bp, Rattus norvegicus
tgatcccaaggtgctcgcctcgctg

SEQ ID NO: 641937 - DNA, 25 bp, Rattus norvegicus
ctcagctttgtcattgatcccaagg

SEQ ID NO: 641938 - DNA, 25 bp, Rattus norvegicus
ctttgtcattgatcccaaggtgctc

SEQ ID NO: 641939 - DNA, 25 bp, Rattus norvegicus
attgatcccaaggtgctcgcctcgc

SEQ ID NO: 641940 - DNA, 25 bp, Rattus norvegicus
cccgatcctcagctttgtcattgat

SEQ ID NO: 641941 - DNA, 25 bp, Rattus norvegicus
tgccgacctggcttccagtctggct

SEQ ID NO: 641942 - DNA, 25 bp, Rattus norvegicus
acctggcttccagtctggctcggcg

SEQ ID NO: 641943 - DNA, 25 bp, Rattus norvegicus
ttccagtctggctcggcgggatccc

SEQ ID NO: 641944 - DNA, 25 bp, Rattus norvegicus
gggatcccgagtcctcgcctgtgtc

SEQ ID NO: 641945 - DNA, 25 bp, Rattus norvegicus
ccaaactgacaggtgctcccagcta

SEQ ID NO: 641946 - DNA, 25 bp, Rattus norvegicus
actgacaggtgctcccagctagtcg

SEQ ID NO: 641947 - DNA, 25 bp, Rattus norvegicus
aggtgctcccagctagtcgccacga

SEQ ID NO: 641948 - DNA, 25 bp, Rattus norvegicus
tcgccacgactcatcgccgctcctc

SEQ ID NO: 641949 - DNA, 25 bp, Rattus norvegicus
tgtcattgatcccaaggtgctcgcc

SEQ ID NO: 641950 - DNA, 25 bp, Rattus norvegicus
gcgccagcgggcatcctaggaatgc

SEQ ID NO: 641951 - DNA, 25 bp, Rattus norvegicus
cggcggcgacacaccctccttccga

SEQ ID NO: 641952 - DNA, 25 bp, Rattus norvegicus
accctccttccgatgcggggcggtg

SEQ ID NO: 641953 - DNA, 25 bp, Rattus norvegicus
cgccagcgggcatcctaggaatgcg

SEQ ID NO: 641954 - DNA, 25 bp, Rattus norvegicus
ccagcgggcatcctaggaatgcggc

SEQ ID NO: 641955 - DNA, 25 bp, Rattus norvegicus
cagcgggcatcctaggaatgcggct

SEQ ID NO: 641956 - DNA, 25 bp, Rattus norvegicus
ggcatcctaggaatgcggctgcgcc

SEQ ID NO: 641957 - DNA, 25 bp, Rattus norvegicus
catcctaggaatgcggctgcgccgc

SEQ ID NO: 641958 - DNA, 25 bp, Rattus norvegicus
gccgctcgggatgggtgaagtccgc

SEQ ID NO: 641959 - DNA, 25 bp, Rattus norvegicus
cctccacgcgcggattctcctcatt

SEQ ID NO: 641960 - DNA, 25 bp, Rattus norvegicus
ggattctcctcattccagccgcttg

SEQ ID NO: 641961 - DNA, 25 bp, Rattus norvegicus
gattctcctcattccagccgcttga

SEQ ID NO: 641962 - DNA, 25 bp, Rattus norvegicus
gggcactgcggcctcgaagcccatc

SEQ ID NO: 641963 - DNA, 25 bp, Rattus norvegicus
gcactgcggcctcgaagcccatccc

SEQ ID NO: 641964 - DNA, 25 bp, Rattus norvegicus
cgcttccaccgcagcgcagcctttc

SEQ ID NO: 641965 - DNA, 25 bp, Rattus norvegicus
ctgtgcgttccgattggcattgtgc

SEQ ID NO: 641966 - DNA, 25 bp, Rattus norvegicus
cgacaaggagcagaacggtgagtct

SEQ ID NO: 641967 - DNA, 25 bp, Rattus norvegicus
ccagcgacaaggagcagaacggtga

SEQ ID NO: 641968 - DNA, 25 bp, Rattus norvegicus
agttgcagctctccagcgacaagga

SEQ ID NO: 641969 - DNA, 25 bp, Rattus norvegicus
gcagcaagttgcagctctccagcga

SEQ ID NO: 641970 - DNA, 25 bp, Rattus norvegicus
tccaacctgagcagcaagttgcagc

SEQ ID NO: 641971 - DNA, 25 bp, Rattus norvegicus
actcgggctgagtccaacctgagca

SEQ ID NO: 641972 - DNA, 25 bp, Rattus norvegicus
ctggccggccagagaaccgggactc

SEQ ID NO: 641973 - DNA, 25 bp, Rattus norvegicus
gacatctgccctggccggccagaga

SEQ ID NO: 641974 - DNA, 25 bp, Rattus norvegicus
agtcagccaaatgctcctcctcggc

SEQ ID NO: 641975 - DNA, 25 bp, Rattus norvegicus
cgcgtctctctgtgcgttccgattg

SEQ ID NO: 641976 - DNA, 25 bp, Rattus norvegicus
ttgagccttggagtcgtcgcttccc

SEQ ID NO: 641977 - DNA, 25 bp, Rattus norvegicus
agtgcccgccgtgagtgagccctcg

SEQ ID NO: 641978 - DNA, 25 bp, Rattus norvegicus
cgggatcggggcgacaccccagaca

SEQ ID NO: 641979 - DNA, 25 bp, Rattus norvegicus
ccaggcactccaggccgcactttcc

SEQ ID NO: 641980 - DNA, 25 bp, Rattus norvegicus
gttccgcagtcgctgccaggcactc

SEQ ID NO: 641981 - DNA, 25 bp, Rattus norvegicus
gctgccgcgactcccgttccgcagt

SEQ ID NO: 641982 - DNA, 25 bp, Rattus norvegicus
cgaagtctggggctgccgcgactcc

SEQ ID NO: 641983 - DNA, 25 bp, Rattus norvegicus
tctgtctgtggactcgccgggcgcc

SEQ ID NO: 641984 - DNA, 25 bp, Rattus norvegicus
ccgcgggtctgtctgtggactcgcc

SEQ ID NO: 641985 - DNA, 25 bp, Rattus norvegicus
ccagacaggagggatgagatcaacc

SEQ ID NO: 641986 - DNA, 25 bp, Rattus norvegicus
cctgctggccctccgggaacgggat

SEQ ID NO: 641987 - DNA, 25 bp, Rattus norvegicus
ccttgagccagaaggtcgagggttc

SEQ ID NO: 641988 - DNA, 25 bp, Rattus norvegicus
cgcccagtccttgagccagaaggtc

SEQ ID NO: 641989 - DNA, 25 bp, Rattus norvegicus
agagacggaggctcgcccagtcctt

SEQ ID NO: 641990 - DNA, 25 bp, Rattus norvegicus
atgggaggcaggcacagtgcctccc

SEQ ID NO: 641991 - DNA, 25 bp, Rattus norvegicus
agggatgagatcaaccgcggggaac

SEQ ID NO: 641992 - DNA, 25 bp, Rattus norvegicus
atgcgcaccacgaccctgctgggag

SEQ ID NO: 641993 - DNA, 25 bp, Rattus norvegicus
attgcggatcaccagcagctccagg

SEQ ID NO: 641994 - DNA, 25 bp, Rattus norvegicus
aggatgcgcaccacgaccctgctgg

SEQ ID NO: 641995 - DNA, 25 bp, Rattus norvegicus
taccctcctctcctggtccgggctc

SEQ ID NO: 641996 - DNA, 25 bp, Rattus norvegicus
gttcacaaaaccgtactgcagggca

SEQ ID NO: 641997 - DNA, 25 bp, Rattus norvegicus
gctccagggcatggttcacaaaacc

SEQ ID NO: 641998 - DNA, 25 bp, Rattus norvegicus
accgtaattgcggatcaccagcagc

SEQ ID NO: 641999 - DNA, 25 bp, Rattus norvegicus
ccacacctcgggaccgtaattgcgg

SEQ ID NO: 642000 - DNA, 25 bp, Rattus norvegicus
acttgatgtcttcccacacctcggg

SEQ ID NO: 642001 - DNA, 25 bp, Rattus norvegicus
gctgttcacttacttgatgtcttcc

SEQ ID NO: 642002 - DNA, 25 bp, Rattus norvegicus
ggagcgaagctgttcacttacttga

SEQ ID NO: 642003 - DNA, 25 bp, Rattus norvegicus
ccctgggagcgaagctgttcactta

SEQ ID NO: 642004 - DNA, 25 bp, Rattus norvegicus
aaccgtactgcagggcagagagaga

SEQ ID NO: 642005 - DNA, 25 bp, Rattus norvegicus
gggcatggttcacaaaaccgtactg

SEQ ID NO: 642006 - DNA, 25 bp, Rattus norvegicus
ctggtttcccagaccgtgaggcccg

SEQ ID NO: 642007 - DNA, 25 bp, Rattus norvegicus
gagaccagtcggttggaagtcactt

SEQ ID NO: 642008 - DNA, 25 bp, Rattus norvegicus
accatagccgctggattctcaggtg

SEQ ID NO: 642009 - DNA, 25 bp, Rattus norvegicus
ggggcgacacctatgctagaccata

SEQ ID NO: 642010 - DNA, 25 bp, Rattus norvegicus
tggccggagatccaaatgggcctcg

SEQ ID NO: 642011 - DNA, 25 bp, Rattus norvegicus
tgttgggtacccaagagaccagtcg

SEQ ID NO: 642012 - DNA, 25 bp, Rattus norvegicus
ttgtcccagcgacgcaggcggaaag

SEQ ID NO: 642013 - DNA, 25 bp, Rattus norvegicus
atccaaatgggcctcggacgtcgcg

SEQ ID NO: 642014 - DNA, 25 bp, Rattus norvegicus
cgatacctggtttcccagaccgtga

SEQ ID NO: 642015 - DNA, 25 bp, Rattus norvegicus
gcctccagcttattccgatacctgg

SEQ ID NO: 642016 - DNA, 25 bp, Rattus norvegicus
accgccttccgcctccatcttttgc

SEQ ID NO: 642017 - DNA, 25 bp, Rattus norvegicus
ccggggacgctgttgcctggcaacc

SEQ ID NO: 642018 - DNA, 25 bp, Rattus norvegicus
aagtcacttcctcccggggacgctg

SEQ ID NO: 642019 - DNA, 25 bp, Rattus norvegicus
atgctagaccatagccgctggattc

SEQ ID NO: 642020 - DNA, 25 bp, Rattus norvegicus
ccgccagagctttggatcagcgctg

SEQ ID NO: 642021 - DNA, 25 bp, Rattus norvegicus
ccaatcgggaggagaaaagcgagtc

SEQ ID NO: 642022 - DNA, 25 bp, Rattus norvegicus
ggagtagcatgctcgctggccaatc

SEQ ID NO: 642023 - DNA, 25 bp, Rattus norvegicus
cgcttgctacaggagaaagggactt

SEQ ID NO: 642024 - DNA, 25 bp, Rattus norvegicus
gaagcccgagaaggcgcttgctaca

SEQ ID NO: 642025 - DNA, 25 bp, Rattus norvegicus
tggagtgccctcacttcgaccaatc

SEQ ID NO: 642026 - DNA, 25 bp, Rattus norvegicus
agcctaccgtgcctcacgtggagtg

SEQ ID NO: 642027 - DNA, 25 bp, Rattus norvegicus
cctaaaatccctggaccaacgagca

SEQ ID NO: 642028 - DNA, 25 bp, Rattus norvegicus
gtcgggtcttcaaaggccagaccta

SEQ ID NO: 642029 - DNA, 25 bp, Rattus norvegicus
cgactgcggccgttaccagcggttt

SEQ ID NO: 642030 - DNA, 25 bp, Rattus norvegicus
taatttctatggaccgggcggccgc

SEQ ID NO: 642031 - DNA, 25 bp, Rattus norvegicus
ccgagggccctggagtaatttctat

SEQ ID NO: 642032 - DNA, 25 bp, Rattus norvegicus
cccaggctgcactgcgagcgttagc

SEQ ID NO: 642033 - DNA, 25 bp, Rattus norvegicus
gggcagttggctcccgacaaccact

SEQ ID NO: 642034 - DNA, 25 bp, Rattus norvegicus
tcacaggccggagaacacggattgg

SEQ ID NO: 642035 - DNA, 25 bp, Rattus norvegicus
gtcagccgcgggaacagaggcaccc

SEQ ID NO: 642036 - DNA, 25 bp, Rattus norvegicus
atcgccgcgctgcagcgctgctcac

SEQ ID NO: 642037 - DNA, 25 bp, Rattus norvegicus
ccgcagccgctcttatagaggtgca

SEQ ID NO: 642038 - DNA, 25 bp, Rattus norvegicus
ggtgcttcgagtgcgctctccgcag

SEQ ID NO: 642039 - DNA, 25 bp, Rattus norvegicus
ccgaatgcggtcacaggccggagaa

SEQ ID NO: 642040 - DNA, 25 bp, Rattus norvegicus
tcaaagagaggatgtagtgttggtc

SEQ ID NO: 642041 - DNA, 25 bp, Rattus norvegicus
cacccggtgcaggagatcaaagaga

SEQ ID NO: 642042 - DNA, 25 bp, Rattus norvegicus
gagaagccaaggaccacccggtgca

SEQ ID NO: 642043 - DNA, 25 bp, Rattus norvegicus
actagaggagaagccaaggaccacc

SEQ ID NO: 642044 - DNA, 25 bp, Rattus norvegicus
caggagagcaaaagactagaggaga

SEQ ID NO: 642045 - DNA, 25 bp, Rattus norvegicus
acagtacggggccaggagagcaaaa

SEQ ID NO: 642046 - DNA, 25 bp, Rattus norvegicus
cgctgctcacctgccgacggcactg

SEQ ID NO: 642047 - DNA, 25 bp, Rattus norvegicus
tctccgcagccgctcttatagaggt

SEQ ID NO: 642048 - DNA, 25 bp, Rattus norvegicus
cactcgggagtcgtttgtctttgga

SEQ ID NO: 642049 - DNA, 25 bp, Rattus norvegicus
atcccgaatccgaggttcagtcggc

SEQ ID NO: 642050 - DNA, 25 bp, Rattus norvegicus
gtttcttcgctgctgaacgggtaga

SEQ ID NO: 642051 - DNA, 25 bp, Rattus norvegicus
cgggtagactaaacggcggcgacat

SEQ ID NO: 642052 - DNA, 25 bp, Rattus norvegicus
cgacatggtggaggtaaagtaacgc

SEQ ID NO: 642053 - DNA, 25 bp, Rattus norvegicus
taaagtaacgctcgggcactcggga

SEQ ID NO: 642054 - DNA, 25 bp, Rattus norvegicus
tgtctttggagctttgcccacggaa

SEQ ID NO: 642055 - DNA, 25 bp, Rattus norvegicus
tgcccacggaagtaggatgaaagta

SEQ ID NO: 642056 - DNA, 25 bp, Rattus norvegicus
tactgggaatctggggaagcgaact

SEQ ID NO: 642057 - DNA, 25 bp, Rattus norvegicus
gcggcgatttctgcgtcgagcattt

SEQ ID NO: 642058 - DNA, 25 bp, Rattus norvegicus
aggaaggccgatgacatcccgaatc

SEQ ID NO: 642059 - DNA, 25 bp, Rattus norvegicus
gggttgccaatacgcatgcgcggtt

SEQ ID NO: 642060 - DNA, 25 bp, Rattus norvegicus
cgaactgtagccaaaactggtggtc

SEQ ID NO: 642061 - DNA, 25 bp, Rattus norvegicus
cgagcatttggagtttcttcgctgc

SEQ ID NO: 642062 - DNA, 25 bp, Rattus norvegicus
cctgtagcagcctgctgccggagcg

SEQ ID NO: 642063 - DNA, 25 bp, Rattus norvegicus
gacgccgcgtagtccccagcaccca

SEQ ID NO: 642064 - DNA, 25 bp, Rattus norvegicus
ccagtcggaggggacgccgcgtagt

SEQ ID NO: 642065 - DNA, 25 bp, Rattus norvegicus
actaaggagtaggaggcccagtcgg

SEQ ID NO: 642066 - DNA, 25 bp, Rattus norvegicus
tgcgagccgcatcacacacggggag

SEQ ID NO: 642067 - DNA, 25 bp, Rattus norvegicus
aattcaccgcggtgcgagccgcatc

SEQ ID NO: 642068 - DNA, 25 bp, Rattus norvegicus
cggtgcgagccgcatcacacacggg

SEQ ID NO: 642069 - DNA, 25 bp, Rattus norvegicus
attcaccgcggtgcgagccgcatca

SEQ ID NO: 642070 - DNA, 25 bp, Rattus norvegicus
gaggctcgcaggttggaattcaccg

SEQ ID NO: 642071 - DNA, 25 bp, Rattus norvegicus
ggctcgcaggttggaattcaccgcg

SEQ ID NO: 642072 - DNA, 25 bp, Rattus norvegicus
tcgcaggttggaattcaccgcggtg

SEQ ID NO: 642073 - DNA, 25 bp, Rattus norvegicus
gagaggccgcccctgtagcagcctg

SEQ ID NO: 642074 - DNA, 25 bp, Rattus norvegicus
caggttggaattcaccgcggtgcga

SEQ ID NO: 642075 - DNA, 25 bp, Rattus norvegicus
ccagcacccagagacgccaggggtg

SEQ ID NO: 642076 - DNA, 25 bp, Rattus norvegicus
gggctgttcagcatccagggctaca

SEQ ID NO: 642077 - DNA, 25 bp, Rattus norvegicus
accttgctgcaagcttcggacctgc

SEQ ID NO: 642078 - DNA, 25 bp, Rattus norvegicus
gacccttcttccaattgcgctacgg

SEQ ID NO: 642079 - DNA, 25 bp, Rattus norvegicus
tgagaacgataacccgccagttttc

SEQ ID NO: 642080 - DNA, 25 bp, Rattus norvegicus
ccagttttcgagcagggcgagtacc

SEQ ID NO: 642081 - DNA, 25 bp, Rattus norvegicus
caccgatcgcgacttgggacccaat

SEQ ID NO: 642082 - DNA, 25 bp, Rattus norvegicus
cccaatggcttggtacgctacagta

SEQ ID NO: 642083 - DNA, 25 bp, Rattus norvegicus
ccaccgggcgatccgggctatttct

SEQ ID NO: 642084 - DNA, 25 bp, Rattus norvegicus
ctttagaccgcgaggaacagtcctg

SEQ ID NO: 642085 - DNA, 25 bp, Rattus norvegicus
ccactgtgcgcgtgtccattgatgt

SEQ ID NO: 642086 - DNA, 25 bp, Rattus norvegicus
tgctggacgtgaatgacaacccgcc

SEQ ID NO: 642087 - DNA, 25 bp, Rattus norvegicus
ctgctctttctcaccgagggaggca

SEQ ID NO: 642088 - DNA, 25 bp, Rattus norvegicus
gcttctttctgtcggaggactccga

SEQ ID NO: 642089 - DNA, 25 bp, Rattus norvegicus
gcgtcaacgacgtgaacgaccattc

SEQ ID NO: 642090 - DNA, 25 bp, Rattus norvegicus
cgtgaggggcattcacaacgcagcc

SEQ ID NO: 642091 - DNA, 25 bp, Rattus norvegicus
ccagaaagtagtgaccggcctcctc

SEQ ID NO: 642092 - DNA, 25 bp, Rattus norvegicus
agcccgaatttcctgccagcgagcg

SEQ ID NO: 642093 - DNA, 25 bp, Rattus norvegicus
ggcctcctcagattactccgggttg

SEQ ID NO: 642094 - DNA, 25 bp, Rattus norvegicus
ccgcgcttgtctgcttgcaaggcaa

SEQ ID NO: 642095 - DNA, 25 bp, Rattus norvegicus
tgtgccacggcatcgagtaccagaa

SEQ ID NO: 642096 - DNA, 25 bp, Rattus norvegicus
agtaccagaacatgcggctgcccaa

SEQ ID NO: 642097 - DNA, 25 bp, Rattus norvegicus
cctggattccgctggtcatgaagca

SEQ ID NO: 642098 - DNA, 25 bp, Rattus norvegicus
gtgccacccggacaccaagaagttc

SEQ ID NO: 642099 - DNA, 25 bp, Rattus norvegicus
gctccatgcgtgtcctcaactttcg

SEQ ID NO: 642100 - DNA, 25 bp, Rattus norvegicus
ttccagcccagatccaactgcaagg

SEQ ID NO: 642101 - DNA, 25 bp, Rattus norvegicus
ctagacgagaccatccagccgtgtc

SEQ ID NO: 642102 - DNA, 25 bp, Rattus norvegicus
tgtcactcgctctgcgtgcaggtga

SEQ ID NO: 642103 - DNA, 25 bp, Rattus norvegicus
ctgtctgtctcgacgacctagacga

SEQ ID NO: 642104 - DNA, 25 bp, Rattus norvegicus
tgaagcactttattcagaggcttgg

SEQ ID NO: 642105 - DNA, 25 bp, Rattus norvegicus
cgattcgcatcacccggatcagcag

SEQ ID NO: 642106 - DNA, 25 bp, Rattus norvegicus
ccagttatgcgccagcaaaatgcta

SEQ ID NO: 642107 - DNA, 25 bp, Rattus norvegicus
tgtatggagtgtcatcatggccggc

SEQ ID NO: 642108 - DNA, 25 bp, Rattus norvegicus
acccggatcagcagtctaacgcgtg

SEQ ID NO: 642109 - DNA, 25 bp, Rattus norvegicus
gccgcagtcggctcagactccgatt

SEQ ID NO: 642110 - DNA, 25 bp, Rattus norvegicus
cggaatttggctgggcccgccacct

SEQ ID NO: 642111 - DNA, 25 bp, Rattus norvegicus
tcctgcgcagggcagacctgaaaga

SEQ ID NO: 642112 - DNA, 25 bp, Rattus norvegicus
gaagctcacgctatctgctgtcctg

SEQ ID NO: 642113 - DNA, 25 bp, Rattus norvegicus
gtgacacacacaagacaccagcaat

SEQ ID NO: 642114 - DNA, 25 bp, Rattus norvegicus
caccagcaatgttgttgaagcactt

SEQ ID NO: 642115 - DNA, 25 bp, Rattus norvegicus
agcgcgtcggcgacagtgacacaca

SEQ ID NO: 642116 - DNA, 25 bp, Rattus norvegicus
caaaatgctatagcgctgcagctta

SEQ ID NO: 642117 - DNA, 25 bp, Rattus norvegicus
taacgcgtgctttgtatggagtgtc

SEQ ID NO: 642118 - DNA, 25 bp, Rattus norvegicus
aagtgagttccggagcagtgtagac

SEQ ID NO: 642119 - DNA, 25 bp, Rattus norvegicus
ccctaagccaaagggcctgcaaggg

SEQ ID NO: 642120 - DNA, 25 bp, Rattus norvegicus
gatccaggggtcgagactccgatcc

SEQ ID NO: 642121 - DNA, 25 bp, Rattus norvegicus
ccaggccggctacagtgggatccag

SEQ ID NO: 642122 - DNA, 25 bp, Rattus norvegicus
ctcctggaaaacctgactcaggcgg

SEQ ID NO: 642123 - DNA, 25 bp, Rattus norvegicus
ggcgctggccgtatttggacatttt

SEQ ID NO: 642124 - DNA, 25 bp, Rattus norvegicus
tggaactaacaacgttcctcctgga

SEQ ID NO: 642125 - DNA, 25 bp, Rattus norvegicus
gacacgagcccggaagtgagttccg

SEQ ID NO: 642126 - DNA, 25 bp, Rattus norvegicus
gtctgggcccgtgttgtagacacga

SEQ ID NO: 642127 - DNA, 25 bp, Rattus norvegicus
cttcagccttggtttcgcgccgggt

SEQ ID NO: 642128 - DNA, 25 bp, Rattus norvegicus
tgacccacgggcttcagccttggtt

SEQ ID NO: 642129 - DNA, 25 bp, Rattus norvegicus
gaaatcctgcttcctcggtgaccca

SEQ ID NO: 642130 - DNA, 25 bp, Rattus norvegicus
ctgcgccggagcactgattaagcgg

SEQ ID NO: 642131 - DNA, 25 bp, Rattus norvegicus
caccaggtcggcaggatgcgctacc

SEQ ID NO: 642132 - DNA, 25 bp, Rattus norvegicus
ccatgatcatgttggtgcgtgcgca

SEQ ID NO: 642133 - DNA, 25 bp, Rattus norvegicus
aagtgcacggtacatgggttccgga

SEQ ID NO: 642134 - DNA, 25 bp, Rattus norvegicus
cgctagggttctgaggatgtggcct

SEQ ID NO: 642135 - DNA, 25 bp, Rattus norvegicus
acccatgatcatgttggtgcgtgcg

SEQ ID NO: 642136 - DNA, 25 bp, Rattus norvegicus
cgtccgacccatgatcatgttggtg

SEQ ID NO: 642137 - DNA, 25 bp, Rattus norvegicus
atccgtccgacccatgatcatgttg

SEQ ID NO: 642138 - DNA, 25 bp, Rattus norvegicus
gggatccgtccgacccatgatcatg

SEQ ID NO: 642139 - DNA, 25 bp, Rattus norvegicus
ttctgaggatgtggcctggaaggcg

SEQ ID NO: 642140 - DNA, 25 bp, Rattus norvegicus
ccgtggggatccgtccgacccatga

SEQ ID NO: 642141 - DNA, 25 bp, Rattus norvegicus
gtgctagaggcacccccgcagcagg

SEQ ID NO: 642142 - DNA, 25 bp, Rattus norvegicus
gctcccacacgtactctgccacact

SEQ ID NO: 642143 - DNA, 25 bp, Rattus norvegicus
ccgccagctcggctcccacacgtac

SEQ ID NO: 642144 - DNA, 25 bp, Rattus norvegicus
gaggaggcaccgcattgcacctcca

SEQ ID NO: 642145 - DNA, 25 bp, Rattus norvegicus
ttccggaggaggcaccgcattgcac

SEQ ID NO: 642146 - DNA, 25 bp, Rattus norvegicus
ccgtcgctccgaccctgcccaggga

SEQ ID NO: 642147 - DNA, 25 bp, Rattus norvegicus
ccacccacctacctggagacctcca

SEQ ID NO: 642148 - DNA, 25 bp, Rattus norvegicus
tgctcctgagtcctctggccatctg

SEQ ID NO: 642149 - DNA, 25 bp, Rattus norvegicus
cgcaggtgcttcttgttgggaacca

SEQ ID NO: 642150 - DNA, 25 bp, Rattus norvegicus
gagtcctctggccatctgggcacca

SEQ ID NO: 642151 - DNA, 25 bp, Rattus norvegicus
ccatctgggcaccagcccttgaaga

SEQ ID NO: 642152 - DNA, 25 bp, Rattus norvegicus
ccagcccttgaagatcgggaagtgc

SEQ ID NO: 642153 - DNA, 25 bp, Rattus norvegicus
ggacgaaacttcccggtcgctagca

SEQ ID NO: 642154 - DNA, 25 bp, Rattus norvegicus
ggtcgctagcaccacctctggtgcg

SEQ ID NO: 642155 - DNA, 25 bp, Rattus norvegicus
agcaccacctctggtgcgacaagcg

SEQ ID NO: 642156 - DNA, 25 bp, Rattus norvegicus
acaagcgccgcccacaggggtctgc

SEQ ID NO: 642157 - DNA, 25 bp, Rattus norvegicus
gactcagcagcgggaacgaaccacc

SEQ ID NO: 642158 - DNA, 25 bp, Rattus norvegicus
gtgcttcttgttgggaaccaggtcc

SEQ ID NO: 642159 - DNA, 25 bp, Rattus norvegicus
ccgccaacgcagaggcacagcgacc

SEQ ID NO: 642160 - DNA, 25 bp, Rattus norvegicus
tcctgcggacggacgaccaacgggc

SEQ ID NO: 642161 - DNA, 25 bp, Rattus norvegicus
cggacggacgaccaacgggctggag

SEQ ID NO: 642162 - DNA, 25 bp, Rattus norvegicus
gcggacggacgaccaacgggctgga

SEQ ID NO: 642163 - DNA, 25 bp, Rattus norvegicus
tgcggacggacgaccaacgggctgg

SEQ ID NO: 642164 - DNA, 25 bp, Rattus norvegicus
ctgcggacggacgaccaacgggctg

SEQ ID NO: 642165 - DNA, 25 bp, Rattus norvegicus
cctgcggacggacgaccaacgggct

SEQ ID NO: 642166 - DNA, 25 bp, Rattus norvegicus
cggaacggaaatgtgggacacacgg

SEQ ID NO: 642167 - DNA, 25 bp, Rattus norvegicus
tcggaacggaaatgtgggacacacg

SEQ ID NO: 642168 - DNA, 25 bp, Rattus norvegicus
gtcggaacggaaatgtgggacacac

SEQ ID NO: 642169 - DNA, 25 bp, Rattus norvegicus
atgggagtggcagtgccgagttccc

SEQ ID NO: 642170 - DNA, 25 bp, Rattus norvegicus
cggagcaggctagttggctgctatt

SEQ ID NO: 642171 - DNA, 25 bp, Rattus norvegicus
tgtaacggcgatttggttgttacta

SEQ ID NO: 642172 - DNA, 25 bp, Rattus norvegicus
cttgtgtacttgtaacggcgatttg

SEQ ID NO: 642173 - DNA, 25 bp, Rattus norvegicus
gttgttactaaaatgagagcgaata

SEQ ID NO: 642174 - DNA, 25 bp, Rattus norvegicus
agagcgaatagcgactgtgacaccg

SEQ ID NO: 642175 - DNA, 25 bp, Rattus norvegicus
gctagttggctgctattcttgtgta

SEQ ID NO: 642176 - DNA, 25 bp, Rattus norvegicus
gatacaggtggtaacttcggtggga

SEQ ID NO: 642177 - DNA, 25 bp, Rattus norvegicus
gatgctgggcgcaagccgctcgcct

SEQ ID NO: 642178 - DNA, 25 bp, Rattus norvegicus
gaactttttgagacttgccgtgtcc

SEQ ID NO: 642179 - DNA, 25 bp, Rattus norvegicus
cccagaactttttgagacttgccgt

SEQ ID NO: 642180 - DNA, 25 bp, Rattus norvegicus
ccgcgagagcttggcgctcctgtct

SEQ ID NO: 642181 - DNA, 25 bp, Rattus norvegicus
tggctgctattcttgtgtacttgta

SEQ ID NO: 642182 - DNA, 25 bp, Rattus norvegicus
tgtctctcgccacacaccggctcag

SEQ ID NO: 642183 - DNA, 25 bp, Rattus norvegicus
cagcttggtccggaccagaggatga

SEQ ID NO: 642184 - DNA, 25 bp, Rattus norvegicus
tgagaatgaatcgtagcccagcgct

SEQ ID NO: 642185 - DNA, 25 bp, Rattus norvegicus
tctttgttgatgacacccgggcctc

SEQ ID NO: 642186 - DNA, 25 bp, Rattus norvegicus
cgaggacaatgcgaacgctcacggc

SEQ ID NO: 642187 - DNA, 25 bp, Rattus norvegicus
gagcgcgtgtgctccgcagatagaa

SEQ ID NO: 642188 - DNA, 25 bp, Rattus norvegicus
cccgcagctgttggactgctgctca

SEQ ID NO: 642189 - DNA, 25 bp, Rattus norvegicus
aagacgcccagcagaaggttcacgg

SEQ ID NO: 642190 - DNA, 25 bp, Rattus norvegicus
tcgctcgcagcgatctcgttctcta

SEQ ID NO: 642191 - DNA, 25 bp, Rattus norvegicus
ttcctccgagaaccctcacagattt

SEQ ID NO: 642192 - DNA, 25 bp, Rattus norvegicus
tcgcagggctgcagtagctcgccat

SEQ ID NO: 642193 - DNA, 25 bp, Rattus norvegicus
tcctggcccagcttagagtcgccga

SEQ ID NO: 642194 - DNA, 25 bp, Rattus norvegicus
aacaaagctgcaggaagccgggcgc

SEQ ID NO: 642195 - DNA, 25 bp, Rattus norvegicus
cgatctcgttctctagcttgctggc

SEQ ID NO: 642196 - DNA, 25 bp, Rattus norvegicus
acgacgggctgaccttgtccctgag

SEQ ID NO: 642197 - DNA, 25 bp, Rattus norvegicus
tgccgggtttctggattcggttcta

SEQ ID NO: 642198 - DNA, 25 bp, Rattus norvegicus
tccctgtttgagtctggcgccaaca

SEQ ID NO: 642199 - DNA, 25 bp, Rattus norvegicus
gcagcggcctccctgtttgagtctg

SEQ ID NO: 642200 - DNA, 25 bp, Rattus norvegicus
tcttaccatggtgcgcgcagcggcc

SEQ ID NO: 642201 - DNA, 25 bp, Rattus norvegicus
tcgctcttaccatggtgcgcgcagc

SEQ ID NO: 642202 - DNA, 25 bp, Rattus norvegicus
gtccgggcctcgctcttaccatggt

SEQ ID NO: 642203 - DNA, 25 bp, Rattus norvegicus
tgagtctggcgccaacagccgcgtg

SEQ ID NO: 642204 - DNA, 25 bp, Rattus norvegicus
acacggggctaacctcgcagggcct

SEQ ID NO: 642205 - DNA, 25 bp, Rattus norvegicus
ttctggattcggttctagaacgctc

SEQ ID NO: 642206 - DNA, 25 bp, Rattus norvegicus
gccacttgccgggtttctggattcg

SEQ ID NO: 642207 - DNA, 25 bp, Rattus norvegicus
cggagcctcgccacttgccgggttt

SEQ ID NO: 642208 - DNA, 25 bp, Rattus norvegicus
gggctaacctcgcagggcctggcca

SEQ ID NO: 642209 - DNA, 25 bp, Rattus norvegicus
gattcggttctagaacgctccggtc

SEQ ID NO: 642210 - DNA, 25 bp, Rattus norvegicus
ccgccaccagggttcgggtgcagca

SEQ ID NO: 642211 - DNA, 25 bp, Rattus norvegicus
gcttaaacggactgcctcggatgtg

SEQ ID NO: 642212 - DNA, 25 bp, Rattus norvegicus
tcaagtcgtcctcgatggggttctc

SEQ ID NO: 642213 - DNA, 25 bp, Rattus norvegicus
gctggccggtctctttacagccttc

SEQ ID NO: 642214 - DNA, 25 bp, Rattus norvegicus
tacagccttctgcttgacgtgcccg

SEQ ID NO: 642215 - DNA, 25 bp, Rattus norvegicus
ccgagcggatgaccttgagcttaaa

SEQ ID NO: 642216 - DNA, 25 bp, Rattus norvegicus
ggtgccgttcttgttgtccaggatc

SEQ ID NO: 642217 - DNA, 25 bp, Rattus norvegicus
gaggtatgcgttgcctgtcttgcac

SEQ ID NO: 642218 - DNA, 25 bp, Rattus norvegicus
tgtcttgcacagctctccgtctttg

SEQ ID NO: 642219 - DNA, 25 bp, Rattus norvegicus
ttatagtaacggacatgggctgccc

SEQ ID NO: 642220 - DNA, 25 bp, Rattus norvegicus
cccaggttgtggatagactttttca

SEQ ID NO: 642221 - DNA, 25 bp, Rattus norvegicus
aatccagctgatcgttctcgcgcgg

SEQ ID NO: 642222 - DNA, 25 bp, Rattus norvegicus
tcttggtccgccagttcgttgagct

SEQ ID NO: 642223 - DNA, 25 bp, Rattus norvegicus
tacccactcggaagatcaagtcgtc

SEQ ID NO: 642224 - DNA, 25 bp, Rattus norvegicus
ctggggacttgactcgtcgcttcac

SEQ ID NO: 642225 - DNA, 25 bp, Rattus norvegicus
ctgggtcacttccattctgtgctca

SEQ ID NO: 642226 - DNA, 25 bp, Rattus norvegicus
tcgcgcagaggcaaatcctggatta

SEQ ID NO: 642227 - DNA, 25 bp, Rattus norvegicus
tcacacgactcgcttgcgggacgcg

SEQ ID NO: 642228 - DNA, 25 bp, Rattus norvegicus
ttccctccgtgtcgtcggtgccaaa

SEQ ID NO: 642229 - DNA, 25 bp, Rattus norvegicus
tctgtgctcagtcccagagcggcga

SEQ ID NO: 642230 - DNA, 25 bp, Rattus norvegicus
agagcggcgagacatctgttttcca

SEQ ID NO: 642231 - DNA, 25 bp, Rattus norvegicus
tgttttccataagcctcgcgcagag

SEQ ID NO: 642232 - DNA, 25 bp, Rattus norvegicus
accgcagctgatccgcgcacaaaga

SEQ ID NO: 642233 - DNA, 25 bp, Rattus norvegicus
gagccgcggacaaacacgcaagttg

SEQ ID NO: 642234 - DNA, 25 bp, Rattus norvegicus
acgcaagttggtgcccagttccaga

SEQ ID NO: 642235 - DNA, 25 bp, Rattus norvegicus
agttccagaacgactccgatgacta

SEQ ID NO: 642236 - DNA, 25 bp, Rattus norvegicus
tccgatgactaaggcggccgcagtt

SEQ ID NO: 642237 - DNA, 25 bp, Rattus norvegicus
gactcggcagagagaacggacgcca

SEQ ID NO: 642238 - DNA, 25 bp, Rattus norvegicus
ggattaaatgccagagcccacaccg

SEQ ID NO: 642239 - DNA, 25 bp, Rattus norvegicus
gggtcccagatctcagcggagttca

SEQ ID NO: 642240 - DNA, 25 bp, Rattus norvegicus
cgtcacacagagctccgggtccaaa

SEQ ID NO: 642241 - DNA, 25 bp, Rattus norvegicus
gtggcatgaaagctaaccaaacctc

SEQ ID NO: 642242 - DNA, 25 bp, Rattus norvegicus
tgcgcgacccgcataagtggcatga

SEQ ID NO: 642243 - DNA, 25 bp, Rattus norvegicus
acctcgttgagaggggctcctgtga

SEQ ID NO: 642244 - DNA, 25 bp, Rattus norvegicus
acttccagggaagggtgcagtcaaa

SEQ ID NO: 642245 - DNA, 25 bp, Rattus norvegicus
acgccacttcggaggtgaacttcca

SEQ ID NO: 642246 - DNA, 25 bp, Rattus norvegicus
tccgggaccatctgtgactgccagc

SEQ ID NO: 642247 - DNA, 25 bp, Rattus norvegicus
cactgcggctttgcaccaagggata

SEQ ID NO: 642248 - DNA, 25 bp, Rattus norvegicus
tcacgattctcggaacagtggccgc

SEQ ID NO: 642249 - DNA, 25 bp, Rattus norvegicus
gtcccggaccaattcagaggccatt

SEQ ID NO: 642250 - DNA, 25 bp, Rattus norvegicus
cgaaggatccctagcggagacagta

SEQ ID NO: 642251 - DNA, 25 bp, Rattus norvegicus
aaggatcgaccctccgcttccagga

SEQ ID NO: 642252 - DNA, 25 bp, Rattus norvegicus
gccagccgcttggactactgctacg

SEQ ID NO: 642253 - DNA, 25 bp, Rattus norvegicus
taggtgtctctctagttctccgcga

SEQ ID NO: 642254 - DNA, 25 bp, Rattus norvegicus
tgcggctgtcacaggctctggacaa

SEQ ID NO: 642255 - DNA, 25 bp, Rattus norvegicus
acgcactcgtaccaatctgtgcaga

SEQ ID NO: 642256 - DNA, 25 bp, Rattus norvegicus
cggtcctcgctttcctaggtgtctc

SEQ ID NO: 642257 - DNA, 25 bp, Rattus norvegicus
cgaagatgaatgtacacccgctgac

SEQ ID NO: 642258 - DNA, 25 bp, Rattus norvegicus
ccgaaagtttgtcagccacgggaga

SEQ ID NO: 642259 - DNA, 25 bp, Rattus norvegicus
tcaccaccgcgcagccgaaagtttg

SEQ ID NO: 642260 - DNA, 25 bp, Rattus norvegicus
cggcgtggagcagagtcactagttt

SEQ ID NO: 642261 - DNA, 25 bp, Rattus norvegicus
cgggccgcagccctgtgaactacat

SEQ ID NO: 642262 - DNA, 25 bp, Rattus norvegicus
ggacccgccacgtctctatggtgcg

SEQ ID NO: 642263 - DNA, 25 bp, Rattus norvegicus
cctctctctagaagccaagccggga

SEQ ID NO: 642264 - DNA, 25 bp, Rattus norvegicus
tctggacaaccaaccgccgaggaca

SEQ ID NO: 642265 - DNA, 25 bp, Rattus norvegicus
tgcaaagtgcaacccaccagccaga

SEQ ID NO: 642266 - DNA, 25 bp, Rattus norvegicus
ctgtgcagaaagaccggcatccgtg

SEQ ID NO: 642267 - DNA, 25 bp, Rattus norvegicus
gcggccatggcaggcaacttcgact

SEQ ID NO: 642268 - DNA, 25 bp, Rattus norvegicus
ctacatcatcaacagcagcggcccg

SEQ ID NO: 642269 - DNA, 25 bp, Rattus norvegicus
agcgtctccgaaaactcgcgcgtct

SEQ ID NO: 642270 - DNA, 25 bp, Rattus norvegicus
tgtgctcagcgtctccgaaaactcg

SEQ ID NO: 642271 - DNA, 25 bp, Rattus norvegicus
caggcaacttcgactcggaggagcg

SEQ ID NO: 642272 - DNA, 25 bp, Rattus norvegicus
gcttacaccggagccggtccgctgg

SEQ ID NO: 642273 - DNA, 25 bp, Rattus norvegicus
ctgctgggaggcttacaccggagcc

SEQ ID NO: 642274 - DNA, 25 bp, Rattus norvegicus
ctcgggtagagagcgcgtcatttcc

SEQ ID NO: 642275 - DNA, 25 bp, Rattus norvegicus
ccggcagcctccctcgggtagagag

SEQ ID NO: 642276 - DNA, 25 bp, Rattus norvegicus
ccttctcccaatggcgggcggcggt

SEQ ID NO: 642277 - DNA, 25 bp, Rattus norvegicus
acgcccatgaggacgcatgcgcact

SEQ ID NO: 642278 - DNA, 25 bp, Rattus norvegicus
cggcgacgcccatgaggacgcatgc

SEQ ID NO: 642279 - DNA, 25 bp, Rattus norvegicus
catcctccgccgttggggttctgga

SEQ ID NO: 642280 - DNA, 25 bp, Rattus norvegicus
cccggggactatgtgctcagcgtct

SEQ ID NO: 642281 - DNA, 25 bp, Rattus norvegicus
tccctttgtgcgtcatcagaacgcg

SEQ ID NO: 642282 - DNA, 25 bp, Rattus norvegicus
ccttttccctttgtgcgtcatcaga

SEQ ID NO: 642283 - DNA, 25 bp, Rattus norvegicus
ctcactcccagaggagcagttcgca

SEQ ID NO: 642284 - DNA, 25 bp, Rattus norvegicus
tcccagaggagcagttcgcacctgc

SEQ ID NO: 642285 - DNA, 25 bp, Rattus norvegicus
agggaacggctacggagctctctct

SEQ ID NO: 642286 - DNA, 25 bp, Rattus norvegicus
gaacggctacggagctctctctccg

SEQ ID NO: 642287 - DNA, 25 bp, Rattus norvegicus
tctccgcgccctagggtcaggggta

SEQ ID NO: 642288 - DNA, 25 bp, Rattus norvegicus
cgctcccagatctcgacttcctttt

SEQ ID NO: 642289 - DNA, 25 bp, Rattus norvegicus
tagcagcagcagtcccgcggcccga

SEQ ID NO: 642290 - DNA, 25 bp, Rattus norvegicus
cttcagttctgacgcggccgtagag

SEQ ID NO: 642291 - DNA, 25 bp, Rattus norvegicus
tctcttcagttctgacgcggccgta

SEQ ID NO: 642292 - DNA, 25 bp, Rattus norvegicus
cttcctctcttcagttctgacgcgg

SEQ ID NO: 642293 - DNA, 25 bp, Rattus norvegicus
taagattaggcggtagcttaggctc

SEQ ID NO: 642294 - DNA, 25 bp, Rattus norvegicus
cggtagcttaggctcgcctgggctc

SEQ ID NO: 642295 - DNA, 25 bp, Rattus norvegicus
gaagagacccgggtagctgctccgt

SEQ ID NO: 642296 - DNA, 25 bp, Rattus norvegicus
ctcctcggcgggactccaggagttc

SEQ ID NO: 642297 - DNA, 25 bp, Rattus norvegicus
gcgacgctagcaccgcttcttagtt

SEQ ID NO: 642298 - DNA, 25 bp, Rattus norvegicus
ctcgtctctgaagcgtgagtggacc

SEQ ID NO: 642299 - DNA, 25 bp, Rattus norvegicus
gccaccgctcgtctctgaagcgtga

SEQ ID NO: 642300 - DNA, 25 bp, Rattus norvegicus
aagggagccagccacattgtcagcg

SEQ ID NO: 642301 - DNA, 25 bp, Rattus norvegicus
gctagcaccgcttcttagttccgcg

SEQ ID NO: 642302 - DNA, 25 bp, Rattus norvegicus
gctgctccgtggagcgacgctagca

SEQ ID NO: 642303 - DNA, 25 bp, Rattus norvegicus
ttctatcccggcagcgcggaagaga

SEQ ID NO: 642304 - DNA, 25 bp, Rattus norvegicus
gcccaggacgggctgaagccacagc

SEQ ID NO: 642305 - DNA, 25 bp, Rattus norvegicus
tgtcccgggacaagtggcccaggac

SEQ ID NO: 642306 - DNA, 25 bp, Rattus norvegicus
gctttctgattgtgactgtcccggg

SEQ ID NO: 642307 - DNA, 25 bp, Rattus norvegicus
cagcctccgcccagaggaaacttta

SEQ ID NO: 642308 - DNA, 25 bp, Rattus norvegicus
caaacaaaatcttcgagctttctga

SEQ ID NO: 642309 - DNA, 25 bp, Rattus norvegicus
cgtgacactgtagagagcacgcccc

SEQ ID NO: 642310 - DNA, 25 bp, Rattus norvegicus
tagagagcacgccccccagtgacgt

SEQ ID NO: 642311 - DNA, 25 bp, Rattus norvegicus
ccagtgacgtgacactgtagagagc

SEQ ID NO: 642312 - DNA, 25 bp, Rattus norvegicus
tgacgtgacactgtagagagcacgc

SEQ ID NO: 642313 - DNA, 25 bp, Rattus norvegicus
agtgacgtgacactgtagagagcac

SEQ ID NO: 642314 - DNA, 25 bp, Rattus norvegicus
ctgtagagagcacgccccccagtga

SEQ ID NO: 642315 - DNA, 25 bp, Rattus norvegicus
cccagtgacgtgacactgtagagag

SEQ ID NO: 642316 - DNA, 25 bp, Rattus norvegicus
acactgtagagagcacgcccccagt

SEQ ID NO: 642317 - DNA, 25 bp, Rattus norvegicus
gtgacgtgacactgtagagagcacg

SEQ ID NO: 642318 - DNA, 25 bp, Rattus norvegicus
acgtgacactgtagagagcacgccc

SEQ ID NO: 642319 - DNA, 25 bp, Rattus norvegicus
actgtagagagcacgccccccagtg

SEQ ID NO: 642320 - DNA, 25 bp, Rattus norvegicus
gacgtgacactgtagagagcacgcc

SEQ ID NO: 642321 - DNA, 25 bp, Rattus norvegicus
actgtagagagcacgcccccagtga

SEQ ID NO: 642322 - DNA, 25 bp, Rattus norvegicus
gacactgtagagagcacgcccccag

SEQ ID NO: 642323 - DNA, 25 bp, Rattus norvegicus
tttccctggaagacgctgggcttta

SEQ ID NO: 642324 - DNA, 25 bp, Rattus norvegicus
ggcacccgtgctgcgttcgggtttc

SEQ ID NO: 642325 - DNA, 25 bp, Rattus norvegicus
gaatagtagtcttccggtccaggcc

SEQ ID NO: 642326 - DNA, 25 bp, Rattus norvegicus
ctgggctttagcgtggatagacgac

SEQ ID NO: 642327 - DNA, 25 bp, Rattus norvegicus
gtggatagacgactgttcccgcctc

SEQ ID NO: 642328 - DNA, 25 bp, Rattus norvegicus
tgacccggtcttcggcaatgcaatg

SEQ ID NO: 642329 - DNA, 25 bp, Rattus norvegicus
tgggtcacctgacccggtcttcggc

SEQ ID NO: 642330 - DNA, 25 bp, Rattus norvegicus
gcttcccagagagcctcgcggcgga

SEQ ID NO: 642331 - DNA, 25 bp, Rattus norvegicus
tggcgcattgccagaactacgcttc

SEQ ID NO: 642332 - DNA, 25 bp, Rattus norvegicus
tagtcttccggtccaggcctacaag

SEQ ID NO: 642333 - DNA, 25 bp, Rattus norvegicus
tcggcaatgcaatggcggcacccgt

SEQ ID NO: 642334 - DNA, 25 bp, Rattus norvegicus
ccgtcagcttttgagttgggttgcc

SEQ ID NO: 642335 - DNA, 25 bp, Rattus norvegicus
cccgtcagatttccgtcagcttttg

SEQ ID NO: 642336 - DNA, 25 bp, Rattus norvegicus
cctacaagggttgtggcgcattgcc

SEQ ID NO: 642337 - DNA, 25 bp, Rattus norvegicus
gagcgccgggcaactacttaagtgg

SEQ ID NO: 642338 - DNA, 25 bp, Rattus norvegicus
tccgggagaggctggcttcctccct

SEQ ID NO: 642339 - DNA, 25 bp, Rattus norvegicus
cctcgcgacagtcccggggtgactt

SEQ ID NO: 642340 - DNA, 25 bp, Rattus norvegicus
ggtgacttgtaggaccctgacctct

SEQ ID NO: 642341 - DNA, 25 bp, Rattus norvegicus
tcacctcctaagcacctggggcggg

SEQ ID NO: 642342 - DNA, 25 bp, Rattus norvegicus
cccaagggatatggatggcctgcca

SEQ ID NO: 642343 - DNA, 25 bp, Rattus norvegicus
atatggatggcctgccactggcgtc

SEQ ID NO: 642344 - DNA, 25 bp, Rattus norvegicus
gtccggagctggagctctctcagcc

SEQ ID NO: 642345 - DNA, 25 bp, Rattus norvegicus
tctcagccgggacgatggaaccgac

SEQ ID NO: 642346 - DNA, 25 bp, Rattus norvegicus
gtggatggacaccactgcctgcctg

SEQ ID NO: 642347 - DNA, 25 bp, Rattus norvegicus
ctcccggcgaggtgctcatgagcca

SEQ ID NO: 642348 - DNA, 25 bp, Rattus norvegicus
gcgatcctgttctgctccgggagag

SEQ ID NO: 642349 - DNA, 25 bp, Rattus norvegicus
caactacttaagtggatggacacca

SEQ ID NO: 642350 - DNA, 25 bp, Rattus norvegicus
aaccgacagtggctcccggcgaggt

SEQ ID NO: 642351 - DNA, 25 bp, Rattus norvegicus
ggggctcgcctctcgaatgaacttc

SEQ ID NO: 642352 - DNA, 25 bp, Rattus norvegicus
aggaagctacacaccgcgacgcttg

SEQ ID NO: 642353 - DNA, 25 bp, Rattus norvegicus
caccgaaacttgaactggagctctg

SEQ ID NO: 642354 - DNA, 25 bp, Rattus norvegicus
cggagcctctgcgagaaagtttcca

SEQ ID NO: 642355 - DNA, 25 bp, Rattus norvegicus
cactacagcgcgcacgggtttccta

SEQ ID NO: 642356 - DNA, 25 bp, Rattus norvegicus
agagactcgggttgcgtgcactaca

SEQ ID NO: 642357 - DNA, 25 bp, Rattus norvegicus
gcctctgccaggtgctccagagact

SEQ ID NO: 642358 - DNA, 25 bp, Rattus norvegicus
gggacaacttttctccagcgcgtca

SEQ ID NO: 642359 - DNA, 25 bp, Rattus norvegicus
gcctgaggacccgaggataaaatac

SEQ ID NO: 642360 - DNA, 25 bp, Rattus norvegicus
gtgcacagggcacaacagacaactg

SEQ ID NO: 642361 - DNA, 25 bp, Rattus norvegicus
gggaaacaaccgaaccggcagtgca

SEQ ID NO: 642362 - DNA, 25 bp, Rattus norvegicus
agtcagaaagtttgtgcggcggtcc

SEQ ID NO: 642363 - DNA, 25 bp, Rattus norvegicus
acgcggtgtctcctcgacagtcaga

SEQ ID NO: 642364 - DNA, 25 bp, Rattus norvegicus
caagcaggcacgcatgactggtttc

SEQ ID NO: 642365 - DNA, 25 bp, Rattus norvegicus
caggccgctggtgtctgcccagaag

SEQ ID NO: 642366 - DNA, 25 bp, Rattus norvegicus
acgctgcaggtggagcccttcttcc

SEQ ID NO: 642367 - DNA, 25 bp, Rattus norvegicus
gctgcaggccgctggtgtctgccca

SEQ ID NO: 642368 - DNA, 25 bp, Rattus norvegicus
acgggaagcgagctgccgagctgct

SEQ ID NO: 642369 - DNA, 25 bp, Rattus norvegicus
ccgatcccaggctggacctctgtgg

SEQ ID NO: 642370 - DNA, 25 bp, Rattus norvegicus
tgtctgcccagaaggcggggagctc

SEQ ID NO: 642371 - DNA, 25 bp, Rattus norvegicus
cccagctccgcacgctgcaggtgga

SEQ ID NO: 642372 - DNA, 25 bp, Rattus norvegicus
cgctggcgagggacacccgctgccc

SEQ ID NO: 642373 - DNA, 25 bp, Rattus norvegicus
gcggaggcacctcgcccatggctga

SEQ ID NO: 642374 - DNA, 25 bp, Rattus norvegicus
aggcacctcgcccatggctgagggc

SEQ ID NO: 642375 - DNA, 25 bp, Rattus norvegicus
aagagctgcgagagcgccgcgagct

SEQ ID NO: 642376 - DNA, 25 bp, Rattus norvegicus
ggccactcggctgcaggtgagacgc

SEQ ID NO: 642377 - DNA, 25 bp, Rattus norvegicus
tcgtgccttgcccagcacggccgca

SEQ ID NO: 642378 - DNA, 25 bp, Rattus norvegicus
gccctccgcgcctgctcgtgccttg

SEQ ID NO: 642379 - DNA, 25 bp, Rattus norvegicus
ggaggccacagttcgaaacacgcga

SEQ ID NO: 642380 - DNA, 25 bp, Rattus norvegicus
gcctttgataatctcgcgacacttc

SEQ ID NO: 642381 - DNA, 25 bp, Rattus norvegicus
agcgctgtctacgtgacccttgctc

SEQ ID NO: 642382 - DNA, 25 bp, Rattus norvegicus
ctcgcgcgagaacttaatgcgaacc

SEQ ID NO: 642383 - DNA, 25 bp, Rattus norvegicus
gccatggtgccgctctgagagccaa

SEQ ID NO: 642384 - DNA, 25 bp, Rattus norvegicus
tgccacctttcgtcaggcgcttgtt

SEQ ID NO: 642385 - DNA, 25 bp, Rattus norvegicus
agcaactactcgagacgcagggcgg

SEQ ID NO: 642386 - DNA, 25 bp, Rattus norvegicus
cggacttcaagcaacccaggaggcc

SEQ ID NO: 642387 - DNA, 25 bp, Rattus norvegicus
ggcgctaaaagtgcagcggacttca

SEQ ID NO: 642388 - DNA, 25 bp, Rattus norvegicus
cctcctgacgtagaaggggcgctaa

SEQ ID NO: 642389 - DNA, 25 bp, Rattus norvegicus
tcaaccagagtgactgccgagcctc

SEQ ID NO: 642390 - DNA, 25 bp, Rattus norvegicus
ccggcacgcaagtgacatggggtca

SEQ ID NO: 642391 - DNA, 25 bp, Rattus norvegicus
tgctatcacgagttcccacgaggtc

SEQ ID NO: 642392 - DNA, 25 bp, Rattus norvegicus
gggttcgcgaaatccgccacttaca

SEQ ID NO: 642393 - DNA, 25 bp, Rattus norvegicus
gacactaccttgcagacttctcgga

SEQ ID NO: 642394 - DNA, 25 bp, Rattus norvegicus
gggtgtttctcgcactcgtacagca

SEQ ID NO: 642395 - DNA, 25 bp, Rattus norvegicus
tcccatttggttgaggtagagtacc

SEQ ID NO: 642396 - DNA, 25 bp, Rattus norvegicus
cgcttccgcccatcgcttagtttga

SEQ ID NO: 642397 - DNA, 25 bp, Rattus norvegicus
cgctgtgatgaactcgacccaaaga

SEQ ID NO: 642398 - DNA, 25 bp, Rattus norvegicus
cttgcgtgcagagaggtaaccagac

SEQ ID NO: 642399 - DNA, 25 bp, Rattus norvegicus
cgcctgggctaccaatgtctggaaa

SEQ ID NO: 642400 - DNA, 25 bp, Rattus norvegicus
cgatcatcttgaccacgtcccggta

SEQ ID NO: 642401 - DNA, 25 bp, Rattus norvegicus
tgcgcaacttgacctcgctagtgtc

SEQ ID NO: 642402 - DNA, 25 bp, Rattus norvegicus
atttgcaccacgtagcgctccctga

SEQ ID NO: 642403 - DNA, 25 bp, Rattus norvegicus
agatcccggtgcacttgaacgctgg

SEQ ID NO: 642404 - DNA, 25 bp, Rattus norvegicus
cttcagcacggagaggcacttgttt

SEQ ID NO: 642405 - DNA, 25 bp, Rattus norvegicus
cagcagcgtcttcatgtggtagtta

SEQ ID NO: 642406 - DNA, 25 bp, Rattus norvegicus
ggcagcgctcggtgtagtatttatt

SEQ ID NO: 642407 - DNA, 25 bp, Rattus norvegicus
cttcacacttcctactgcagattcg

SEQ ID NO: 642408 - DNA, 25 bp, Rattus norvegicus
tgggccccctcaggaagagtgcagc

SEQ ID NO: 642409 - DNA, 25 bp, Rattus norvegicus
ctacaaaggaaggagactcaagggc

SEQ ID NO: 642410 - DNA, 25 bp, Rattus norvegicus
gagactcaagggcagcaagcacatc

SEQ ID NO: 642411 - DNA, 25 bp, Rattus norvegicus
gggcagcaagcacatccttatcctg

SEQ ID NO: 642412 - DNA, 25 bp, Rattus norvegicus
cacatccttatcctgcctcctgggg

SEQ ID NO: 642413 - DNA, 25 bp, Rattus norvegicus
accgaggccaacctagggcagaata

SEQ ID NO: 642414 - DNA, 25 bp, Rattus norvegicus
gggcagaatacaaaacatagcacta

SEQ ID NO: 642415 - DNA, 25 bp, Rattus norvegicus
catagcactaggtttggatgcaata

SEQ ID NO: 642416 - DNA, 25 bp, Rattus norvegicus
ggtttggatgcaatatttatttttc

SEQ ID NO: 642417 - DNA, 25 bp, Rattus norvegicus
atttttctttataacccgctgatgc

SEQ ID NO: 642418 - DNA, 25 bp, Rattus norvegicus
aacccgctgatgcattgtttaaata

SEQ ID NO: 642419 - DNA, 25 bp, Rattus norvegicus
gatgcattgtttaaataaaagaccc

SEQ ID NO: 642420 - DNA, 25 bp, Rattus norvegicus
ttcctactgcagattcgctaacaca

SEQ ID NO: 642421 - DNA, 25 bp, Rattus norvegicus
agctccggcgcctttcagggaaata

SEQ ID NO: 642422 - DNA, 25 bp, Rattus norvegicus
tctggtgtaccaggcgaagctggca

SEQ ID NO: 642423 - DNA, 25 bp, Rattus norvegicus
cggctgtggagcctcacaaaggaga

SEQ ID NO: 642424 - DNA, 25 bp, Rattus norvegicus
ggcggaatctaggagctgtagctcc

SEQ ID NO: 642425 - DNA, 25 bp, Rattus norvegicus
gccgctctctgtcgcagtcgcagtt

SEQ ID NO: 642426 - DNA, 25 bp, Rattus norvegicus
gaaatagcacgggtcactcgggaga

SEQ ID NO: 642427 - DNA, 25 bp, Rattus norvegicus
gagtctccgggcctaggaatttgac

SEQ ID NO: 642428 - DNA, 25 bp, Rattus norvegicus
ccgctgccgctatggatgatcggga

SEQ ID NO: 642429 - DNA, 25 bp, Rattus norvegicus
tatccgcttccatccgtcgtgcaga

SEQ ID NO: 642430 - DNA, 25 bp, Rattus norvegicus
agctgagagagtcggagacgctatc

SEQ ID NO: 642431 - DNA, 25 bp, Rattus norvegicus
tgaggcgccgccatttttactgctc

SEQ ID NO: 642432 - DNA, 25 bp, Rattus norvegicus
ttgccatagagctgagcagttgtcc

SEQ ID NO: 642433 - DNA, 25 bp, Rattus norvegicus
gtcgtgcaggttccagccttttctg

SEQ ID NO: 642434 - DNA, 25 bp, Rattus norvegicus
tccttaggttgcagacgctcgccag

SEQ ID NO: 642435 - DNA, 25 bp, Rattus norvegicus
acactcgcttgcctctctagccgcg

SEQ ID NO: 642436 - DNA, 25 bp, Rattus norvegicus
accttgtgagaaagtgttgaagaga

SEQ ID NO: 642437 - DNA, 25 bp, Rattus norvegicus
ctgacgtctgctctccctccgacgg

SEQ ID NO: 642438 - DNA, 25 bp, Rattus norvegicus
ggctttatctctccgggcctctctc

SEQ ID NO: 642439 - DNA, 25 bp, Rattus norvegicus
cctaataatttctgccctccggctt

SEQ ID NO: 642440 - DNA, 25 bp, Rattus norvegicus
ttgcacacaaggcgcacactcgctt

SEQ ID NO: 642441 - DNA, 25 bp, Rattus norvegicus
ggaagctcagcatgctgtccgcccg

SEQ ID NO: 642442 - DNA, 25 bp, Rattus norvegicus
agatgaggaagctcagcatgctgtc

SEQ ID NO: 642443 - DNA, 25 bp, Rattus norvegicus
agctcggcttttgcgacctaagttc

SEQ ID NO: 642444 - DNA, 25 bp, Rattus norvegicus
cggcttttgcgacctaagttctcag

SEQ ID NO: 642445 - DNA, 25 bp, Rattus norvegicus
agttctcccgcgcagccagaggaag

SEQ ID NO: 642446 - DNA, 25 bp, Rattus norvegicus
cgcttcaccaaaaactcctcggtgt

SEQ ID NO: 642447 - DNA, 25 bp, Rattus norvegicus
cggctggagcttaccttgtgagaaa

SEQ ID NO: 642448 - DNA, 25 bp, Rattus norvegicus
aatttctgccctccggctttatctc

SEQ ID NO: 642449 - DNA, 25 bp, Rattus norvegicus
ctggcccagagtggaagtgacgaaa

SEQ ID NO: 642450 - DNA, 25 bp, Rattus norvegicus
ccgaagcttctgtgctcccgtcaaa

SEQ ID NO: 642451 - DNA, 25 bp, Rattus norvegicus
tctgtgctcccgtcaaagcggaaga

SEQ ID NO: 642452 - DNA, 25 bp, Rattus norvegicus
gctcccgtcaaagcggaagagccct

SEQ ID NO: 642453 - DNA, 25 bp, Rattus norvegicus
tcctccttctgcatggggttccagc

SEQ ID NO: 642454 - DNA, 25 bp, Rattus norvegicus
gcaccggtaccttctgggcggaagc

SEQ ID NO: 642455 - DNA, 25 bp, Rattus norvegicus
caccctggcccagagtggaagtgac

SEQ ID NO: 642456 - DNA, 25 bp, Rattus norvegicus
tcgcacgtgcctccgaagcttctgt

SEQ ID NO: 642457 - DNA, 25 bp, Rattus norvegicus
aaagccgccgcggagtcacttcctt

SEQ ID NO: 642458 - DNA, 25 bp, Rattus norvegicus
gcggagtcacttccttctgggtgga

SEQ ID NO: 642459 - DNA, 25 bp, Rattus norvegicus
tcacttccttctgggtggatgagga

SEQ ID NO: 642460 - DNA, 25 bp, Rattus norvegicus
ctccgggagtcacgaacacctgcag

SEQ ID NO: 642461 - DNA, 25 bp, Rattus norvegicus
cgggagtcacgaacacctgcagacg

SEQ ID NO: 642462 - DNA, 25 bp, Rattus norvegicus
gcggaagcggtgccgctcacgacac

SEQ ID NO: 642463 - DNA, 25 bp, Rattus norvegicus
ccgcgcccaggcaggaagtccgcgc

SEQ ID NO: 642464 - DNA, 25 bp, Rattus norvegicus
ggcgggtcactcacctgcctcggag

SEQ ID NO: 642465 - DNA, 25 bp, Rattus norvegicus
gctccagagcccagggcgggtcact

SEQ ID NO: 642466 - DNA, 25 bp, Rattus norvegicus
cctgcctcggagctcgcagttcgga

SEQ ID NO: 642467 - DNA, 25 bp, Rattus norvegicus
ctcgcagttcggaggggaatggcgt

SEQ ID NO: 642468 - DNA, 25 bp, Rattus norvegicus
aatggcgtgtgcaccgacgggtccc

SEQ ID NO: 642469 - DNA, 25 bp, Rattus norvegicus
gtcccactgcccgacggagtccgct

SEQ ID NO: 642470 - DNA, 25 bp, Rattus norvegicus
cctccgcacgcctgtctgtgaagtg

SEQ ID NO: 642471 - DNA, 25 bp, Rattus norvegicus
cgcacgcctgtctgtgaagtggacc

SEQ ID NO: 642472 - DNA, 25 bp, Rattus norvegicus
cacgcctgtctgtgaagtggaccgg

SEQ ID NO: 642473 - DNA, 25 bp, Rattus norvegicus
tggaccgggagagccgcccaacctg

SEQ ID NO: 642474 - DNA, 25 bp, Rattus norvegicus
ggagagccgcccaacctgacaggct

SEQ ID NO: 642475 - DNA, 25 bp, Rattus norvegicus
aacctgacaggctctggaccagccc

SEQ ID NO: 642476 - DNA, 25 bp, Rattus norvegicus
gcgtgtgcaccgacgggtcccactg

SEQ ID NO: 642477 - DNA, 25 bp, Rattus norvegicus
ggacagcaggtctcacgacaggatg

SEQ ID NO: 642478 - DNA, 25 bp, Rattus norvegicus
gggcggtgttaaagactagccacca

SEQ ID NO: 642479 - DNA, 25 bp, Rattus norvegicus
gcccgtgccgctggcctcgcagcat

SEQ ID NO: 642480 - DNA, 25 bp, Rattus norvegicus
ccgggcgatgccaacccagctgccc

SEQ ID NO: 642481 - DNA, 25 bp, Rattus norvegicus
tcaacgaagtcaccagaccgcctag

SEQ ID NO: 642482 - DNA, 25 bp, Rattus norvegicus
agccagcatcaacgaagtcaccaga

SEQ ID NO: 642483 - DNA, 25 bp, Rattus norvegicus
ctcacgacaggatgcggcgcaagca

SEQ ID NO: 642484 - DNA, 25 bp, Rattus norvegicus
ttaaagactagccaccaggagaggg

SEQ ID NO: 642485 - DNA, 25 bp, Rattus norvegicus
ccacgggacagcaggtctcacgaca

SEQ ID NO: 642486 - DNA, 25 bp, Rattus norvegicus
gtccctgccctggtgcagcgcaacc

SEQ ID NO: 642487 - DNA, 25 bp, Rattus norvegicus
gcggagggtattcagggtccctgcc

SEQ ID NO: 642488 - DNA, 25 bp, Rattus norvegicus
acacactcacagctccgtcaggttc

SEQ ID NO: 642489 - DNA, 25 bp, Rattus norvegicus
cgccctcggggaagggctctgctct

SEQ ID NO: 642490 - DNA, 25 bp, Rattus norvegicus
gcggcgcaagcacaagccagcatca

SEQ ID NO: 642491 - DNA, 25 bp, Rattus norvegicus
cttcgaccgtgaagacccggcgctg

SEQ ID NO: 642492 - DNA, 25 bp, Rattus norvegicus
gccggtccagcgcaatggaaacatc

SEQ ID NO: 642493 - DNA, 25 bp, Rattus norvegicus
tggaaacatcacctattacctggtg

SEQ ID NO: 642494 - DNA, 25 bp, Rattus norvegicus
tattacctggtgttgtggcagcggc

SEQ ID NO: 642495 - DNA, 25 bp, Rattus norvegicus
cggctagcagaggacggtgacctct

SEQ ID NO: 642496 - DNA, 25 bp, Rattus norvegicus
acggtgacctctacatcaatgacta

SEQ ID NO: 642497 - DNA, 25 bp, Rattus norvegicus
tcaatgactactgccaccgcggtgc

SEQ ID NO: 642498 - DNA, 25 bp, Rattus norvegicus
agtggcggatggaccactgctctga

SEQ ID NO: 642499 - DNA, 25 bp, Rattus norvegicus
atggaccactgctctgacttctctc

SEQ ID NO: 642500 - DNA, 25 bp, Rattus norvegicus
aagccgccggtccagcgcaatggaa

SEQ ID NO: 642501 - DNA, 25 bp, Rattus norvegicus
ctgcaccgtggccacaggtctgcgg

SEQ ID NO: 642502 - DNA, 25 bp, Rattus norvegicus
gtggccacaggtctgcggctgccca

SEQ ID NO: 642503 - DNA, 25 bp, Rattus norvegicus
tgcccaccagcagccacgacacacg

SEQ ID NO: 642504 - DNA, 25 bp, Rattus norvegicus
acgacacacgcttcgaccgtgaaga

SEQ ID NO: 642505 - DNA, 25 bp, Rattus norvegicus
tcacttccggcgaagccagggaagc

SEQ ID NO: 642506 - DNA, 25 bp, Rattus norvegicus
gcgcggcatcgcttctctacattcg

SEQ ID NO: 642507 - DNA, 25 bp, Rattus norvegicus
ggcaccctagtaggcctgcgaggct

SEQ ID NO: 642508 - DNA, 25 bp, Rattus norvegicus
gcctgcgaggctcccaactgcggag

SEQ ID NO: 642509 - DNA, 25 bp, Rattus norvegicus
ggagccgggcgatccgactagctcc

SEQ ID NO: 642510 - DNA, 25 bp, Rattus norvegicus
tagctcccgggctctatcctcgtga

SEQ ID NO: 642511 - DNA, 25 bp, Rattus norvegicus
atcctcgtgagctcccgcaggagtc

SEQ ID NO: 642512 - DNA, 25 bp, Rattus norvegicus
tccagccggccaaagtagcacagcg

SEQ ID NO: 642513 - DNA, 25 bp, Rattus norvegicus
caccttaaccggtggtggccatgta

SEQ ID NO: 642514 - DNA, 25 bp, Rattus norvegicus
ccgtctgaatcctccagagcagctg

SEQ ID NO: 642515 - DNA, 25 bp, Rattus norvegicus
tccagagcagctgagacaacgagcc

SEQ ID NO: 642516 - DNA, 25 bp, Rattus norvegicus
acaacgagccagagaagcccagacc

SEQ ID NO: 642517 - DNA, 25 bp, Rattus norvegicus
catggagaccggaagtgcacctttc

SEQ ID NO: 642518 - DNA, 25 bp, Rattus norvegicus
gaagtgcacctttccctacgcgtca

SEQ ID NO: 642519 - DNA, 25 bp, Rattus norvegicus
gggaaccgaaaagcgctccttgctc

SEQ ID NO: 642520 - DNA, 25 bp, Rattus norvegicus
gctcactatcgtcgctgctggcata

SEQ ID NO: 642521 - DNA, 25 bp, Rattus norvegicus
gtcgctgctggcataagcaaccaga

SEQ ID NO: 642522 - DNA, 25 bp, Rattus norvegicus
taagcaaccagagacatggcgcctc

SEQ ID NO: 642523 - DNA, 25 bp, Rattus norvegicus
gcctcctaaagtgggcccggacata

SEQ ID NO: 642524 - DNA, 25 bp, Rattus norvegicus
ggcccggacataggagccgccacat

SEQ ID NO: 642525 - DNA, 25 bp, Rattus norvegicus
gacatggcgcctcccgcctttggga

SEQ ID NO: 642526 - DNA, 25 bp, Rattus norvegicus
ctttgggacgcccttgctggcagac

SEQ ID NO: 642527 - DNA, 25 bp, Rattus norvegicus
cttgctggcagactaggcctacttg

SEQ ID NO: 642528 - DNA, 25 bp, Rattus norvegicus
ggaagagaagcgaacaggcctccta

SEQ ID NO: 642529 - DNA, 25 bp, Rattus norvegicus
ctaggcctacttgagacccgggatg

SEQ ID NO: 642530 - DNA, 25 bp, Rattus norvegicus
ggcagcctagtaggccctaccagcg

SEQ ID NO: 642531 - DNA, 25 bp, Rattus norvegicus
agtaggccctaccagcgggcaaggc

SEQ ID NO: 642532 - DNA, 25 bp, Rattus norvegicus
atccggctcactatcgtcgctgctg

SEQ ID NO: 642533 - DNA, 25 bp, Rattus norvegicus
cagaaagagtacaagtgcggggacc

SEQ ID NO: 642534 - DNA, 25 bp, Rattus norvegicus
acgcgcaaacttgggctcgcgcttc

SEQ ID NO: 642535 - DNA, 25 bp, Rattus norvegicus
ttcaaacacaaacaaccgcacgagc

SEQ ID NO: 642536 - DNA, 25 bp, Rattus norvegicus
tcgtcaggcctgtgtctctgagctc

SEQ ID NO: 642537 - DNA, 25 bp, Rattus norvegicus
ggagggagcaattgaatttcaaaca

SEQ ID NO: 642538 - DNA, 25 bp, Rattus norvegicus
gccctggtgcgggtgcataacgctc

SEQ ID NO: 642539 - DNA, 25 bp, Rattus norvegicus
cgtccagtggctgcgcgcatcgaac

SEQ ID NO: 642540 - DNA, 25 bp, Rattus norvegicus
aggcctgctctctctggcgggagcc

SEQ ID NO: 642541 - DNA, 25 bp, Rattus norvegicus
ggcaggggttccaggcctgctctct

SEQ ID NO: 642542 - DNA, 25 bp, Rattus norvegicus
tgttcgcgaagatgaagggataccc

SEQ ID NO: 642543 - DNA, 25 bp, Rattus norvegicus
tgaagggatacccacattggccggc

SEQ ID NO: 642544 - DNA, 25 bp, Rattus norvegicus
accacttacataaccgaggcgacgg

SEQ ID NO: 642545 - DNA, 25 bp, Rattus norvegicus
tgtcgcgatccaaccggcagaaaga

SEQ ID NO: 642546 - DNA, 25 bp, Rattus norvegicus
gggcaacgccgcgtgctcagttcgc

SEQ ID NO: 642547 - DNA, 25 bp, Rattus norvegicus
cgaggcggtcaactgcaggtcccgc

SEQ ID NO: 642548 - DNA, 25 bp, Rattus norvegicus
cttcctcggcaatcgcgtccaatta

SEQ ID NO: 642549 - DNA, 25 bp, Rattus norvegicus
tcgcgtccaattacaagtctaaata

SEQ ID NO: 642550 - DNA, 25 bp, Rattus norvegicus
gtctaaataacgaagcgcatttggc

SEQ ID NO: 642551 - DNA, 25 bp, Rattus norvegicus
cgcatttggcaaacgtcacggtttc

SEQ ID NO: 642552 - DNA, 25 bp, Rattus norvegicus
cgtcacggtttccactgggcaaagc

SEQ ID NO: 642553 - DNA, 25 bp, Rattus norvegicus
ttccactgggcaaagccatttgcgc

SEQ ID NO: 642554 - DNA, 25 bp, Rattus norvegicus
gccatttgcgcagacgcagggtctc

SEQ ID NO: 642555 - DNA, 25 bp, Rattus norvegicus
gcagggtctcgatgacgtcacagaa

SEQ ID NO: 642556 - DNA, 25 bp, Rattus norvegicus
agcaccagcttactgcgaggcggtc

SEQ ID NO: 642557 - DNA, 25 bp, Rattus norvegicus
agtgggatcaccgttccggcgcgct

SEQ ID NO: 642558 - DNA, 25 bp, Rattus norvegicus
gttccggcgcgctctgttccgcttt

SEQ ID NO: 642559 - DNA, 25 bp, Rattus norvegicus
caccttcgagttgtacctccacggg

SEQ ID NO: 642560 - DNA, 25 bp, Rattus norvegicus
atgacgtcacagaagcgcgcccagc

SEQ ID NO: 642561 - DNA, 25 bp, Rattus norvegicus
tgacccgggtcaagacgctagaaga

SEQ ID NO: 642562 - DNA, 25 bp, Rattus norvegicus
agccgatgacgagctggcatccctg

SEQ ID NO: 642563 - DNA, 25 bp, Rattus norvegicus
atccctgcggatcctcgtcgatcag

SEQ ID NO: 642564 - DNA, 25 bp, Rattus norvegicus
tgcagcgcgacaaccttgcggaaga

SEQ ID NO: 642565 - DNA, 25 bp, Rattus norvegicus
agcgcgtggctcacatggaaagctc

SEQ ID NO: 642566 - DNA, 25 bp, Rattus norvegicus
tgtcgcttagaggtgcaacagctgc

SEQ ID NO: 642567 - DNA, 25 bp, Rattus norvegicus
ctggaacagagattggaaggccgct

SEQ ID NO: 642568 - DNA, 25 bp, Rattus norvegicus
tcttttcagatgtgggagctcaatc

SEQ ID NO: 642569 - DNA, 25 bp, Rattus norvegicus
gttgcgtcggggaagaatcttttca

SEQ ID NO: 642570 - DNA, 25 bp, Rattus norvegicus
ccagaccagcgacatggagggttgc

SEQ ID NO: 642571 - DNA, 25 bp, Rattus norvegicus
ttctctagtgctccacgtccgcttg

SEQ ID NO: 642572 - DNA, 25 bp, Rattus norvegicus
actgtcgccgctacttcttttcaac

SEQ ID NO: 642573 - DNA, 25 bp, Rattus norvegicus
agccggcgggagtatgaataccctc

SEQ ID NO: 642574 - DNA, 25 bp, Rattus norvegicus
tgttgcactgaacgctaaagggtta

SEQ ID NO: 642575 - DNA, 25 bp, Rattus norvegicus
gccgtcacgtggcagcaaaactgta

SEQ ID NO: 642576 - DNA, 25 bp, Rattus norvegicus
gtcagagggtcaccgcctcagggtt

SEQ ID NO: 642577 - DNA, 25 bp, Rattus norvegicus
cgcctcagggttggaagaccagccc

SEQ ID NO: 642578 - DNA, 25 bp, Rattus norvegicus
accagcccgttcagggattggctaa

SEQ ID NO: 642579 - DNA, 25 bp, Rattus norvegicus
gtgcagctcctcgtttttgccacta

SEQ ID NO: 642580 - DNA, 25 bp, Rattus norvegicus
tcacttggctggataaggacgaagg

SEQ ID NO: 642581 - DNA, 25 bp, Rattus norvegicus
atgggaggttcacttggctggataa

SEQ ID NO: 642582 - DNA, 25 bp, Rattus norvegicus
ccagagtccatgcaatgggaggttc

SEQ ID NO: 642583 - DNA, 25 bp, Rattus norvegicus
gtgtcgacgacagccagagtccatg

SEQ ID NO: 642584 - DNA, 25 bp, Rattus norvegicus
ttttgccactagaggtcagagggtc

SEQ ID NO: 642585 - DNA, 25 bp, Rattus norvegicus
actgtaagcagtgcacgagtccgtg

SEQ ID NO: 642586 - DNA, 25 bp, Rattus norvegicus
ggatgtattttgcagccgtcacgtg

SEQ ID NO: 642587 - DNA, 25 bp, Rattus norvegicus
ggcgctgcagtttgaggatgtattt

SEQ ID NO: 642588 - DNA, 25 bp, Rattus norvegicus
tgcacgagtccgtgtcgacgacagc

SEQ ID NO: 642589 - DNA, 25 bp, Rattus norvegicus
catgggatggccagggcaccgccca

SEQ ID NO: 642590 - DNA, 25 bp, Rattus norvegicus
ggcttcgtttaccttgacgcgcagc

SEQ ID NO: 642591 - DNA, 25 bp, Rattus norvegicus
cacgcggaaccgataggcttcgttt

SEQ ID NO: 642592 - DNA, 25 bp, Rattus norvegicus
caggcagcgccacgcggaaccgata

SEQ ID NO: 642593 - DNA, 25 bp, Rattus norvegicus
acacatctgtgagcgatgcggggta

SEQ ID NO: 642594 - DNA, 25 bp, Rattus norvegicus
tcgctcaatactaaagacacatctg

SEQ ID NO: 642595 - DNA, 25 bp, Rattus norvegicus
ccaagaccaacacgcctggggtgca

SEQ ID NO: 642596 - DNA, 25 bp, Rattus norvegicus
ggcaccgatgcgcacccgaaaggct

SEQ ID NO: 642597 - DNA, 25 bp, Rattus norvegicus
cccgaaaggctcgatcctctgtaga

SEQ ID NO: 642598 - DNA, 25 bp, Rattus norvegicus
cctctgtagacaggggtcaacgctg

SEQ ID NO: 642599 - DNA, 25 bp, Rattus norvegicus
gctgcagcccgacgcaggacgcagt

SEQ ID NO: 642600 - DNA, 25 bp, Rattus norvegicus
cccggaatcattgggccgcagttcg

SEQ ID NO: 642601 - DNA, 25 bp, Rattus norvegicus
accgtgctggacctcgcagcgatag

SEQ ID NO: 642602 - DNA, 25 bp, Rattus norvegicus
gccgcagttcgctcaatactaaaga

SEQ ID NO: 642603 - DNA, 25 bp, Rattus norvegicus
tggccagaccgaggacaagcgaagt

SEQ ID NO: 642604 - DNA, 25 bp, Rattus norvegicus
acgcccggatcctcaggctcagaga

SEQ ID NO: 642605 - DNA, 25 bp, Rattus norvegicus
gacaagcgaagtaggacaaggttgc

SEQ ID NO: 642606 - DNA, 25 bp, Rattus norvegicus
ttccgggcgacagtggccagaccga

SEQ ID NO: 642607 - DNA, 25 bp, Rattus norvegicus
cgcagccgagactgcggcgcaatgc

SEQ ID NO: 642608 - DNA, 25 bp, Rattus norvegicus
aggcctccgcactcaccttgtgagg

SEQ ID NO: 642609 - DNA, 25 bp, Rattus norvegicus
agcaagtaagcgacagacagggcca

SEQ ID NO: 642610 - DNA, 25 bp, Rattus norvegicus
ctcagagaggtcaagaaacttaccc

SEQ ID NO: 642611 - DNA, 25 bp, Rattus norvegicus
ccacagcatcctggcttgcggtcgg

SEQ ID NO: 642612 - DNA, 25 bp, Rattus norvegicus
cccagaaatctacagtgggtgactg

SEQ ID NO: 642613 - DNA, 25 bp, Rattus norvegicus
atgcctgcacagtgcgctatgcgcc

SEQ ID NO: 642614 - DNA, 25 bp, Rattus norvegicus
gctcagggtgcccatgcctgcacag

SEQ ID NO: 642615 - DNA, 25 bp, Rattus norvegicus
gcgccttgtggctcagggtgcccat

SEQ ID NO: 642616 - DNA, 25 bp, Rattus norvegicus
ggtcacacagcaagtaagcgacaga

SEQ ID NO: 642617 - DNA, 25 bp, Rattus norvegicus
acgaagaagacctggcctgggaatg

SEQ ID NO: 642618 - DNA, 25 bp, Rattus norvegicus
ccgcggagctccagaaatgacaaca

SEQ ID NO: 642619 - DNA, 25 bp, Rattus norvegicus
aaggttgtctaggacgcgatcgccc

SEQ ID NO: 642620 - DNA, 25 bp, Rattus norvegicus
acactgggagcaaactagaccctgc

SEQ ID NO: 642621 - DNA, 25 bp, Rattus norvegicus
aagtcgagcttctgccacctcctgg

SEQ ID NO: 642622 - DNA, 25 bp, Rattus norvegicus
ggagtcctctttcctggcccagaca

SEQ ID NO: 642623 - DNA, 25 bp, Rattus norvegicus
gccagcagttggctcacctgccagg

SEQ ID NO: 642624 - DNA, 25 bp, Rattus norvegicus
gtagcgcacggagccctcgagcaac

SEQ ID NO: 642625 - DNA, 25 bp, Rattus norvegicus
agtcaccggcgcaagccagactcta

SEQ ID NO: 642626 - DNA, 25 bp, Rattus norvegicus
gctcaccctggtagagttggctgta

SEQ ID NO: 642627 - DNA, 25 bp, Rattus norvegicus
cgcccgcttcgcctcgaagtaattg

SEQ ID NO: 642628 - DNA, 25 bp, Rattus norvegicus
cccatgcagctagggaacctcagtg

SEQ ID NO: 642629 - DNA, 25 bp, Rattus norvegicus
tacggaaacaccacacctagggagc

SEQ ID NO: 642630 - DNA, 25 bp, Rattus norvegicus
gaagtaattgaactggtagcggccc

SEQ ID NO: 642631 - DNA, 25 bp, Rattus norvegicus
cgagacccggcctcgggaaagctca

SEQ ID NO: 642632 - DNA, 25 bp, Rattus norvegicus
cctcgggaaagctcagtattggctc

SEQ ID NO: 642633 - DNA, 25 bp, Rattus norvegicus
ctcagtattggctcccggagggacc

SEQ ID NO: 642634 - DNA, 25 bp, Rattus norvegicus
cgaaaccgaggtgaactgcggaaag

SEQ ID NO: 642635 - DNA, 25 bp, Rattus norvegicus
gcggaaaggaaacttgcatcgagcc

SEQ ID NO: 642636 - DNA, 25 bp, Rattus norvegicus
gcatcgagcctgaactcagtttccg

SEQ ID NO: 642637 - DNA, 25 bp, Rattus norvegicus
cagtttccgtggcaactacccaggg

SEQ ID NO: 642638 - DNA, 25 bp, Rattus norvegicus
tggccactgtcaggacgtctctatg

SEQ ID NO: 642639 - DNA, 25 bp, Rattus norvegicus
tgtcaggacgtctctatggtttcta

SEQ ID NO: 642640 - DNA, 25 bp, Rattus norvegicus
tatggtttctacgtcctagaggggc

SEQ ID NO: 642641 - DNA, 25 bp, Rattus norvegicus
cctagaggggcttaagtgcacttcc

SEQ ID NO: 642642 - DNA, 25 bp, Rattus norvegicus
acttcctggaagatggcggcaccca

SEQ ID NO: 642643 - DNA, 25 bp, Rattus norvegicus
ggcggcacccaagtcgtgtatggca

SEQ ID NO: 642644 - DNA, 25 bp, Rattus norvegicus
gtcgtgtatggcacgtgcttccacg

SEQ ID NO: 642645 - DNA, 25 bp, Rattus norvegicus
cattcgacacacagagcgtcgcctg

SEQ ID NO: 642646 - DNA, 25 bp, Rattus norvegicus
gactatcacacgttccgcgcacctt

SEQ ID NO: 642647 - DNA, 25 bp, Rattus norvegicus
gtcggttcccagtcccagactatca

SEQ ID NO: 642648 - DNA, 25 bp, Rattus norvegicus
agagcgtcgcctgcacagcgcatgc

SEQ ID NO: 642649 - DNA, 25 bp, Rattus norvegicus
ccggacattcgacacacagagcgtc

SEQ ID NO: 642650 - DNA, 25 bp, Rattus norvegicus
gcagcccggacattcgacacacaga

SEQ ID NO: 642651 - DNA, 25 bp, Rattus norvegicus
caggcgcgagcctgcaactagcagc

SEQ ID NO: 642652 - DNA, 25 bp, Rattus norvegicus
ctctgccggcttgcgatccgtggca

SEQ ID NO: 642653 - DNA, 25 bp, Rattus norvegicus
ggcacacactctgccggcttgcgat

SEQ ID NO: 642654 - DNA, 25 bp, Rattus norvegicus
aaatgggccctgcacggcacacact

SEQ ID NO: 642655 - DNA, 25 bp, Rattus norvegicus
gccatggtctccgagctccggtgct

SEQ ID NO: 642656 - DNA, 25 bp, Rattus norvegicus
ttcaccgccgcactcgccatggtct

SEQ ID NO: 642657 - DNA, 25 bp, Rattus norvegicus
gtacctcaggtacttcaccgccgca

SEQ ID NO: 642658 - DNA, 25 bp, Rattus norvegicus
agcgccttttgccaggaaccgtcgg

SEQ ID NO: 642659 - DNA, 25 bp, Rattus norvegicus
ccaggctcggacagcctgtgagtgc

SEQ ID NO: 642660 - DNA, 25 bp, Rattus norvegicus
tcttgcacggcaggccaggctcgga

SEQ ID NO: 642661 - DNA, 25 bp, Rattus norvegicus
tgctgcccggagcacagttcgctgg

SEQ ID NO: 642662 - DNA, 25 bp, Rattus norvegicus
gaacgggaagcgtcccatcccagcg

SEQ ID NO: 642663 - DNA, 25 bp, Rattus norvegicus
ttcgccgaagtgtgcgcagggtaac

SEQ ID NO: 642664 - DNA, 25 bp, Rattus norvegicus
acatggagtcttgcacggcaggcca

SEQ ID NO: 642665 - DNA, 25 bp, Rattus norvegicus
aaggaacatggagtcttgcacggca

SEQ ID NO: 642666 - DNA, 25 bp, Rattus norvegicus
caaaactggcaggagaaggaacatg

SEQ ID NO: 642667 - DNA, 25 bp, Rattus norvegicus
cgggagattcaaaactggcaggaga

SEQ ID NO: 642668 - DNA, 25 bp, Rattus norvegicus
tcccagaggcgggagattcaaaact

SEQ ID NO: 642669 - DNA, 25 bp, Rattus norvegicus
catcccagcgtgaccgtagtgaggg

SEQ ID NO: 642670 - DNA, 25 bp, Rattus norvegicus
tcccatcccagcgtgaccgtagtga

SEQ ID NO: 642671 - DNA, 25 bp, Rattus norvegicus
gggaagcgtcccatcccagcgtgac

SEQ ID NO: 642672 - DNA, 25 bp, Rattus norvegicus
agttgctgcccggagcacagttcgc

SEQ ID NO: 642673 - DNA, 25 bp, Rattus norvegicus
ctcgttgtagcgcacacttttctgc

SEQ ID NO: 642674 - DNA, 25 bp, Rattus norvegicus
atcagcagtaatcggcttggagacc

SEQ ID NO: 642675 - DNA, 25 bp, Rattus norvegicus
aacgtcacgtgggagatcagcagta

SEQ ID NO: 642676 - DNA, 25 bp, Rattus norvegicus
tagaggactgtcctcgggcaacgcg

SEQ ID NO: 642677 - DNA, 25 bp, Rattus norvegicus
ggtgtcgctccacccgaagtgttgc

SEQ ID NO: 642678 - DNA, 25 bp, Rattus norvegicus
tcctatccaggctggggcacggtct

SEQ ID NO: 642679 - DNA, 25 bp, Rattus norvegicus
ctcggcagcctttttgctcaggaaa

SEQ ID NO: 642680 - DNA, 25 bp, Rattus norvegicus
agcgaaccacttctcgtgccagcgg

SEQ ID NO: 642681 - DNA, 25 bp, Rattus norvegicus
agcacattctgatagagagcgaacc

SEQ ID NO: 642682 - DNA, 25 bp, Rattus norvegicus
gccttcgaagtaaaagagcacattc

SEQ ID NO: 642683 - DNA, 25 bp, Rattus norvegicus
ggccgctctgttcgccttcgaagta

SEQ ID NO: 642684 - DNA, 25 bp, Rattus norvegicus
gccctctaggaggtacatgcccgct

SEQ ID NO: 642685 - DNA, 25 bp, Rattus norvegicus
gggtcatcgcagagtgccctctgaa

SEQ ID NO: 642686 - DNA, 25 bp, Rattus norvegicus
acacttttctgcatggcgagggcgc

SEQ ID NO: 642687 - DNA, 25 bp, Rattus norvegicus
ggaggaaggaagcaaaatatcaaca

SEQ ID NO: 642688 - DNA, 25 bp, Rattus norvegicus
ctgtgcctacgtcggcctcgagtct

SEQ ID NO: 642689 - DNA, 25 bp, Rattus norvegicus
tgcgtcccaggcctctcagccaggc

SEQ ID NO: 642690 - DNA, 25 bp, Rattus norvegicus
tggcgggctcaacgcacgtggctcc

SEQ ID NO: 642691 - DNA, 25 bp, Rattus norvegicus
cgccttggcgggctcaacgcacgtg

SEQ ID NO: 642692 - DNA, 25 bp, Rattus norvegicus
tctgctgtgacagccgcgcctggta

SEQ ID NO: 642693 - DNA, 25 bp, Rattus norvegicus
ctggcataagcgtcccgggccgagc

SEQ ID NO: 642694 - DNA, 25 bp, Rattus norvegicus
tgtacgggcgccctggcataagcgt

SEQ ID NO: 642695 - DNA, 25 bp, Rattus norvegicus
tcgcgcagccgaggattccgcggac

SEQ ID NO: 642696 - DNA, 25 bp, Rattus norvegicus
caacaaccgtcgaggcggcttgggc

SEQ ID NO: 642697 - DNA, 25 bp, Rattus norvegicus
tatcaacaaccgtcgaggcggcttg

SEQ ID NO: 642698 - DNA, 25 bp, Rattus norvegicus
ggaagcaaaatatcaacaaccgtcg

SEQ ID NO: 642699 - DNA, 25 bp, Rattus norvegicus
ctacgtcggcctcgagtctggggct

SEQ ID NO: 642700 - DNA, 25 bp, Rattus norvegicus
cccacgggctggtgagtcacgacgc

SEQ ID NO: 642701 - DNA, 25 bp, Rattus norvegicus
caccgcaagtggaacaaaggccttt

SEQ ID NO: 642702 - DNA, 25 bp, Rattus norvegicus
cgatgaattgcttccgggtttcaaa

SEQ ID NO: 642703 - DNA, 25 bp, Rattus norvegicus
taggccgtagagtggcctaacatcc

SEQ ID NO: 642704 - DNA, 25 bp, Rattus norvegicus
agagtggcctaacatccatttccgc

SEQ ID NO: 642705 - DNA, 25 bp, Rattus norvegicus
gtgtcgttgagcgattgactgcttc

SEQ ID NO: 642706 - DNA, 25 bp, Rattus norvegicus
tgactgcttctctcgggcttcacga

SEQ ID NO: 642707 - DNA, 25 bp, Rattus norvegicus
ctcgggcttcacgagtggcagaaca

SEQ ID NO: 642708 - DNA, 25 bp, Rattus norvegicus
ttcacgagtggcagaacatggtccc

SEQ ID NO: 642709 - DNA, 25 bp, Rattus norvegicus
tggaacaaaggcctttaagccacgc

SEQ ID NO: 642710 - DNA, 25 bp, Rattus norvegicus
ctctgacaacgttccaccgcaagtg

SEQ ID NO: 642711 - DNA, 25 bp, Rattus norvegicus
ggcttgttccggagaccgatgaatt

SEQ ID NO: 642712 - DNA, 25 bp, Rattus norvegicus
cgtagcccgcggcttgttccggaga

SEQ ID NO: 642713 - DNA, 25 bp, Rattus norvegicus
gaacatggtcccgagcctctgacaa

SEQ ID NO: 642714 - DNA, 25 bp, Rattus norvegicus
ttccggagaccgatgaattgcttcc

SEQ ID NO: 642715 - DNA, 25 bp, Rattus norvegicus
actcgcactagcatccaccgttttg

SEQ ID NO: 642716 - DNA, 25 bp, Rattus norvegicus
gttgctcaggtttcaaggaaaatga

SEQ ID NO: 642717 - DNA, 25 bp, Rattus norvegicus
ccacgcagccggctgagggttcaag

SEQ ID NO: 642718 - DNA, 25 bp, Rattus norvegicus
ctattagtgctcttcgtccgagcga

SEQ ID NO: 642719 - DNA, 25 bp, Rattus norvegicus
tcacccagccctaaccttgggatgg

SEQ ID NO: 642720 - DNA, 25 bp, Rattus norvegicus
gcaagctcgcagaaccagtcccagg

SEQ ID NO: 642721 - DNA, 25 bp, Rattus norvegicus
tgcagcgagcgagcaagcaactagg

SEQ ID NO: 642722 - DNA, 25 bp, Rattus norvegicus
aaatgacccaatactggagtccagg

SEQ ID NO: 642723 - DNA, 25 bp, Rattus norvegicus
tccgggagaacctagtcgctggaga

SEQ ID NO: 642724 - DNA, 25 bp, Rattus norvegicus
tcacccaacagcaaagacccggagg

SEQ ID NO: 642725 - DNA, 25 bp, Rattus norvegicus
attcattcctttcttccggtcaggg

SEQ ID NO: 642726 - DNA, 25 bp, Rattus norvegicus
ctggcccgcgagtcgcatttattca

SEQ ID NO: 642727 - DNA, 25 bp, Rattus norvegicus
tccaccgttttgacgaggtccagaa

SEQ ID NO: 642728 - DNA, 25 bp, Rattus norvegicus
ccagctcagggttggtcctatgtga

SEQ ID NO: 642729 - DNA, 25 bp, Rattus norvegicus
tcttggatgctgatggtcgccttct

SEQ ID NO: 642730 - DNA, 25 bp, Rattus norvegicus
atggccatatgctcttggatgctga

SEQ ID NO: 642731 - DNA, 25 bp, Rattus norvegicus
ccgggacacacgtcgatggccatat

SEQ ID NO: 642732 - DNA, 25 bp, Rattus norvegicus
atctgcttgataggccggatgggcc

SEQ ID NO: 642733 - DNA, 25 bp, Rattus norvegicus
gggaagtaatcggagatctgcttga

SEQ ID NO: 642734 - DNA, 25 bp, Rattus norvegicus
gtccacatcttcgtcgtcgtcgcgg

SEQ ID NO: 642735 - DNA, 25 bp, Rattus norvegicus
ggctccgaagagctggtccacatct

SEQ ID NO: 642736 - DNA, 25 bp, Rattus norvegicus
tggcaccgtaggctccgaagagctg

SEQ ID NO: 642737 - DNA, 25 bp, Rattus norvegicus
cagtcgtctgactcgtagccgtcgg

SEQ ID NO: 642738 - DNA, 25 bp, Rattus norvegicus
tgggaaacttactgcagtcgtctga

SEQ ID NO: 642739 - DNA, 25 bp, Rattus norvegicus
gccggcgactgggaaacttactgca

SEQ ID NO: 642740 - DNA, 25 bp, Rattus norvegicus
cccagctcttgtgtgcaggtgtact

SEQ ID NO: 642741 - DNA, 25 bp, Rattus norvegicus
ccgcagcaactggtgtctctccggg

SEQ ID NO: 642742 - DNA, 25 bp, Rattus norvegicus
cccggcagcaaccaagcggtgagtg

SEQ ID NO: 642743 - DNA, 25 bp, Rattus norvegicus
tgcgtgaggtccaggattccatctc

SEQ ID NO: 642744 - DNA, 25 bp, Rattus norvegicus
gtagcatcctttcctcgcctttttg

SEQ ID NO: 642745 - DNA, 25 bp, Rattus norvegicus
aaccctgcttctgcacggaggtgga

SEQ ID NO: 642746 - DNA, 25 bp, Rattus norvegicus
cacatccttgggtgattccggctgc

SEQ ID NO: 642747 - DNA, 25 bp, Rattus norvegicus
gcctttttgaggtctcgtcgtgcta

SEQ ID NO: 642748 - DNA, 25 bp, Rattus norvegicus
cctcagaactgtcggcggtagcatc

SEQ ID NO: 642749 - DNA, 25 bp, Rattus norvegicus
tgcagcttagattcccgacctcaga

SEQ ID NO: 642750 - DNA, 25 bp, Rattus norvegicus
ccctgtagtcggcagctcgaagcag

SEQ ID NO: 642751 - DNA, 25 bp, Rattus norvegicus
ttccggctgctttttgcacaaaacc

SEQ ID NO: 642752 - DNA, 25 bp, Rattus norvegicus
ctgggtaggaatgcgcctgaagacc

SEQ ID NO: 642753 - DNA, 25 bp, Rattus norvegicus
ttcagccacaaagggcatctctagc

SEQ ID NO: 642754 - DNA, 25 bp, Rattus norvegicus
accgggcatcctgggcttgatgtaa

SEQ ID NO: 642755 - DNA, 25 bp, Rattus norvegicus
tgcacggtccctggacctccaagtg

SEQ ID NO: 642756 - DNA, 25 bp, Rattus norvegicus
cctccaagtgggttcagtccagatc

SEQ ID NO: 642757 - DNA, 25 bp, Rattus norvegicus
cggcacagacaatggtgctctatcc

SEQ ID NO: 642758 - DNA, 25 bp, Rattus norvegicus
agctcgccagacaaagccgccgggg

SEQ ID NO: 642759 - DNA, 25 bp, Rattus norvegicus
gcgccgtgacgcgaatcccaatgct

SEQ ID NO: 642760 - DNA, 25 bp, Rattus norvegicus
gcgccgtgtctaattcctccaagga

SEQ ID NO: 642761 - DNA, 25 bp, Rattus norvegicus
ggatgccgcgccgtgtctaattcct

SEQ ID NO: 642762 - DNA, 25 bp, Rattus norvegicus
cttcttgccacggacggcacagaca

SEQ ID NO: 642763 - DNA, 25 bp, Rattus norvegicus
tgctctatcccaggagcacggctgc

SEQ ID NO: 642764 - DNA, 25 bp, Rattus norvegicus
cggccgaccctttcaaggctggaag

SEQ ID NO: 642765 - DNA, 25 bp, Rattus norvegicus
ccctttcaaggctggaagccggcgg

SEQ ID NO: 642766 - DNA, 25 bp, Rattus norvegicus
tggccgcctggagcatttgcatacg

SEQ ID NO: 642767 - DNA, 25 bp, Rattus norvegicus
agcatttgcatacggcccggggaca

SEQ ID NO: 642768 - DNA, 25 bp, Rattus norvegicus
cccggggacagtagcctgctttgtt

SEQ ID NO: 642769 - DNA, 25 bp, Rattus norvegicus
tagcctgctttgttggctgcgcacg

SEQ ID NO: 642770 - DNA, 25 bp, Rattus norvegicus
aagcccgtgcgggtcttcttgccac

SEQ ID NO: 642771 - DNA, 25 bp, Rattus norvegicus
ctgctctcggagtcgctagttttta

SEQ ID NO: 642772 - DNA, 25 bp, Rattus norvegicus
cccagctctggaaagtcggctcttc

SEQ ID NO: 642773 - DNA, 25 bp, Rattus norvegicus
catcccttaggagaggcgtgactta

SEQ ID NO: 642774 - DNA, 25 bp, Rattus norvegicus
ggccttgcttcgtatcctcggtcca

SEQ ID NO: 642775 - DNA, 25 bp, Rattus norvegicus
cccgtgtcctttacagcatgatttc

SEQ ID NO: 642776 - DNA, 25 bp, Rattus norvegicus
cgtgtgctttatcccatttgtgttc

SEQ ID NO: 642777 - DNA, 25 bp, Rattus norvegicus
tccagtgctcgtgctcagtgagttc

SEQ ID NO: 642778 - DNA, 25 bp, Rattus norvegicus
ctcaagcgctgtagcgagccagcta

SEQ ID NO: 642779 - DNA, 25 bp, Rattus norvegicus
ttggcgcttgcgcagacattctgcc

SEQ ID NO: 642780 - DNA, 25 bp, Rattus norvegicus
tccagtcgtcttttcgccttagaac

SEQ ID NO: 642781 - DNA, 25 bp, Rattus norvegicus
ggtacttcagaggttagcatgtttc

SEQ ID NO: 642782 - DNA, 25 bp, Rattus norvegicus
cctgtcgccctcttttgacaaaatg

SEQ ID NO: 642783 - DNA, 25 bp, Rattus norvegicus
ggggctaatacctacgattggccta

SEQ ID NO: 642784 - DNA, 25 bp, Rattus norvegicus
agctagcttgccgtgcctttcttgc

SEQ ID NO: 642785 - DNA, 25 bp, Rattus norvegicus
agctttgtcgcatgtgtggtaaccc

SEQ ID NO: 642786 - DNA, 25 bp, Rattus norvegicus
gctttaccggtgagagggccgcgat

SEQ ID NO: 642787 - DNA, 25 bp, Rattus norvegicus
cgagcaagactatagtgagggagca

SEQ ID NO: 642788 - DNA, 25 bp, Rattus norvegicus
gccgcgatgtgtgtgtgcacccgcg

SEQ ID NO: 642789 - DNA, 25 bp, Rattus norvegicus
caagactatagtgagggagcaaaaa

SEQ ID NO: 642790 - DNA, 25 bp, Rattus norvegicus
atagtgagggagcaaaaagaaagcg

SEQ ID NO: 642791 - DNA, 25 bp, Rattus norvegicus
aaagaaagcgggagagagggcaagc

SEQ ID NO: 642792 - DNA, 25 bp, Rattus norvegicus
ccgcgggcgagcaagactatagtga

SEQ ID NO: 642793 - DNA, 25 bp, Rattus norvegicus
tgtgagctttgtcgcatgtgtggta

SEQ ID NO: 642794 - DNA, 25 bp, Rattus norvegicus
cctgccgcgggcgagcaagactata

SEQ ID NO: 642795 - DNA, 25 bp, Rattus norvegicus
tttgtcgcatgtgtggtaacccttg

SEQ ID NO: 642796 - DNA, 25 bp, Rattus norvegicus
catgtgtggtaacccttgccgcgtt

SEQ ID NO: 642797 - DNA, 25 bp, Rattus norvegicus
gtggtaacccttgccgcgttgagcc

SEQ ID NO: 642798 - DNA, 25 bp, Rattus norvegicus
gctgagaagaattgggtgggtgtga

SEQ ID NO: 642799 - DNA, 25 bp, Rattus norvegicus
cgggcccagcgcctgagcaggtgtc

SEQ ID NO: 642800 - DNA, 25 bp, Rattus norvegicus
tgggcaggcacactgcgggcccagc

SEQ ID NO: 642801 - DNA, 25 bp, Rattus norvegicus
ccacctaccgctgctggtcttccta

SEQ ID NO: 642802 - DNA, 25 bp, Rattus norvegicus
ttagctccatgtcgcctcgcgctcg

SEQ ID NO: 642803 - DNA, 25 bp, Rattus norvegicus
tgcgcgcacacctttagctccatgt

SEQ ID NO: 642804 - DNA, 25 bp, Rattus norvegicus
ccctttgcatcctgctgcgcgcaca

SEQ ID NO: 642805 - DNA, 25 bp, Rattus norvegicus
ttcctgtggcgcctcctggcgttgg

SEQ ID NO: 642806 - DNA, 25 bp, Rattus norvegicus
ttcctactgcccacctgcctctatc

SEQ ID NO: 642807 - DNA, 25 bp, Rattus norvegicus
ggtgtctggcgcaggtacttcctgt

SEQ ID NO: 642808 - DNA, 25 bp, Rattus norvegicus
gagccgtaccacctaccgctgctgg

SEQ ID NO: 642809 - DNA, 25 bp, Rattus norvegicus
ggcttccacgcggagccgtaccacc

SEQ ID NO: 642810 - DNA, 25 bp, Rattus norvegicus
caggtacttcctgtggcgcctcctg

SEQ ID NO: 642811 - DNA, 25 bp, Rattus norvegicus
ctggcgcaggtacttcctgtggcgc

SEQ ID NO: 642812 - DNA, 25 bp, Rattus norvegicus
gcctctatccctttgcatcctgctg

SEQ ID NO: 642813 - DNA, 25 bp, Rattus norvegicus
cgtgccaaccgaggacagtgcgaaa

SEQ ID NO: 642814 - DNA, 25 bp, Rattus norvegicus
ctctgcaactcgtgccaaccgagga

SEQ ID NO: 642815 - DNA, 25 bp, Rattus norvegicus
gagttccgtgcctttcctctgcaac

SEQ ID NO: 642816 - DNA, 25 bp, Rattus norvegicus
tggagaagagagttccgtgcctttc

SEQ ID NO: 642817 - DNA, 25 bp, Rattus norvegicus
ctgttgcctcgagagaaggtggaga

SEQ ID NO: 642818 - DNA, 25 bp, Rattus norvegicus
tcagctgccctaaggctgccgaggg

SEQ ID NO: 642819 - DNA, 25 bp, Rattus norvegicus
ctccagcccacagtgctgtgttagg

SEQ ID NO: 642820 - DNA, 25 bp, Rattus norvegicus
cacagtgctgtgttaggcctaggta

SEQ ID NO: 642821 - DNA, 25 bp, Rattus norvegicus
gttaggcctaggtaaacagatgacc

SEQ ID NO: 642822 - DNA, 25 bp, Rattus norvegicus
ctaggtaaacagatgacctccggga

SEQ ID NO: 642823 - DNA, 25 bp, Rattus norvegicus
acctccgggaaaggacgtcagctgc

SEQ ID NO: 642824 - DNA, 25 bp, Rattus norvegicus
cgggaaaggacgtcagctgccctaa

SEQ ID NO: 642825 - DNA, 25 bp, Rattus norvegicus
aggacgtcagctgccctaaggctgc

SEQ ID NO: 642826 - DNA, 25 bp, Rattus norvegicus
cgaggacagtgcgaaaagcttggcc

SEQ ID NO: 642827 - DNA, 25 bp, Rattus norvegicus
tgcctcctcgacaagtcgatcctta

SEQ ID NO: 642828 - DNA, 25 bp, Rattus norvegicus
ttagccgcgtctgagactgggactc

SEQ ID NO: 642829 - DNA, 25 bp, Rattus norvegicus
gagatgcctcgagggacttgccttt

SEQ ID NO: 642830 - DNA, 25 bp, Rattus norvegicus
agactgggactcctagaccgcagca

SEQ ID NO: 642831 - DNA, 25 bp, Rattus norvegicus
ccttctcagactccggcggtttagc

SEQ ID NO: 642832 - DNA, 25 bp, Rattus norvegicus
caccgtggtcgcttaccttctcaga

SEQ ID NO: 642833 - DNA, 25 bp, Rattus norvegicus
ttcaaggcacccaagcaccgtggtc

SEQ ID NO: 642834 - DNA, 25 bp, Rattus norvegicus
gacttgcctttcgttgcccaaactg

SEQ ID NO: 642835 - DNA, 25 bp, Rattus norvegicus
cgacaagtcgatccttaggtaactc

SEQ ID NO: 642836 - DNA, 25 bp, Rattus norvegicus
agcggcttcccatggcgatgcagcc

SEQ ID NO: 642837 - DNA, 25 bp, Rattus norvegicus
ccgcagagcaaacagacaaccgctg

SEQ ID NO: 642838 - DNA, 25 bp, Rattus norvegicus
ttgcccaaactgcagagcggcttcc

SEQ ID NO: 642839 - DNA, 25 bp, Rattus norvegicus
taggtaactctgatccttcaaggca

SEQ ID NO: 642840 - DNA, 25 bp, Rattus norvegicus
gcatcttccttcatctcggctggga

SEQ ID NO: 642841 - DNA, 25 bp, Rattus norvegicus
tcgcgccaaacttgacggcactcta

SEQ ID NO: 642842 - DNA, 25 bp, Rattus norvegicus
cactctaagctggtggggtctgatc

SEQ ID NO: 642843 - DNA, 25 bp, Rattus norvegicus
atcgccgctgcagacatggttcgtc

SEQ ID NO: 642844 - DNA, 25 bp, Rattus norvegicus
ttcgtccgctgaactgcatcgtcgc

SEQ ID NO: 642845 - DNA, 25 bp, Rattus norvegicus
atcgtcgccgtgtcccaaaatatgg

SEQ ID NO: 642846 - DNA, 25 bp, Rattus norvegicus
gaacggagacttaccctggcctctg

SEQ ID NO: 642847 - DNA, 25 bp, Rattus norvegicus
gtggagccgtactctaccttctctg

SEQ ID NO: 642848 - DNA, 25 bp, Rattus norvegicus
gccttagctgccttagtggtactca

SEQ ID NO: 642849 - DNA, 25 bp, Rattus norvegicus
ggatcttaggcttcccgcagacttg

SEQ ID NO: 642850 - DNA, 25 bp, Rattus norvegicus
ctggcctctgctcaggtactaactg

SEQ ID NO: 642851 - DNA, 25 bp, Rattus norvegicus
cggggccttcgctatacaaatagga

SEQ ID NO: 642852 - DNA, 25 bp, Rattus norvegicus
cgcagacttgaagaaccggctcaga

SEQ ID NO: 642853 - DNA, 25 bp, Rattus norvegicus
cggggccttagctgcacaaatagga

SEQ ID NO: 642854 - DNA, 25 bp, Rattus norvegicus
gcattagagcctcccgacgcggatt

SEQ ID NO: 642855 - DNA, 25 bp, Rattus norvegicus
cctcagatccttcccgcactcacag

SEQ ID NO: 642856 - DNA, 25 bp, Rattus norvegicus
cagcgaactgtgctccgggcagcaa

SEQ ID NO: 642857 - DNA, 25 bp, Rattus norvegicus
ggcagcaactcccgcgaagaccaag

SEQ ID NO: 642858 - DNA, 25 bp, Rattus norvegicus
cctcactacggtcacgctgggatgg

SEQ ID NO: 642859 - DNA, 25 bp, Rattus norvegicus
gcactcacaggctgtccgagcctgg

SEQ ID NO: 642860 - DNA, 25 bp, Rattus norvegicus
tccgagcctggcctgccgtgcaaga

SEQ ID NO: 642861 - DNA, 25 bp, Rattus norvegicus
ggcctgccgtgcaagactccatgtt

SEQ ID NO: 642862 - DNA, 25 bp, Rattus norvegicus
ggttaccctgcgcacacttcggcga

SEQ ID NO: 642863 - DNA, 25 bp, Rattus norvegicus
gcaagactccatgttccttctcctg

SEQ ID NO: 642864 - DNA, 25 bp, Rattus norvegicus
gttccttctcctgccagttttgaat

SEQ ID NO: 642865 - DNA, 25 bp, Rattus norvegicus
tctcctgccagttttgaatctcccg

SEQ ID NO: 642866 - DNA, 25 bp, Rattus norvegicus
agttttgaatctcccgcctctggga

SEQ ID NO: 642867 - DNA, 25 bp, Rattus norvegicus
acgctgggatgggacgcttcccgtt

SEQ ID NO: 642868 - DNA, 25 bp, Rattus norvegicus
gccgtgcaagactccatgttccttc

SEQ ID NO: 642869 - DNA, 25 bp, Rattus norvegicus
ctccaccctgagactgggaggagtg

SEQ ID NO: 642870 - DNA, 25 bp, Rattus norvegicus
gcgctttttggtgacgctgcctcca

SEQ ID NO: 642871 - DNA, 25 bp, Rattus norvegicus
tccagcttgcgctttttggtgacgc

SEQ ID NO: 642872 - DNA, 25 bp, Rattus norvegicus
gaagactccagcttgcgctttttgg

SEQ ID NO: 642873 - DNA, 25 bp, Rattus norvegicus
ctcagaagactccagcttgcgcttt

SEQ ID NO: 642874 - DNA, 25 bp, Rattus norvegicus
agctgctccggctctcagaagactc

SEQ ID NO: 642875 - DNA, 25 bp, Rattus norvegicus
cgagcatgctgcgagaagctgctcc

SEQ ID NO: 642876 - DNA, 25 bp, Rattus norvegicus
ttgttgcgcagccgcacgaacttgc

SEQ ID NO: 642877 - DNA, 25 bp, Rattus norvegicus
gccacacggccgctagtgcgagcat

SEQ ID NO: 642878 - DNA, 25 bp, Rattus norvegicus
atctacttcctctacggccacacgg

SEQ ID NO: 642879 - DNA, 25 bp, Rattus norvegicus
acgaacttgccctcttcatctactt

SEQ ID NO: 642880 - DNA, 25 bp, Rattus norvegicus
gtggagacaagacgcggcgttagtc

SEQ ID NO: 642881 - DNA, 25 bp, Rattus norvegicus
tggtgacgctgcctccaccctgaga

SEQ ID NO: 642882 - DNA, 25 bp, Rattus norvegicus
ctagtgcgagcatgctgcgagaagc

SEQ ID NO: 642883 - DNA, 25 bp, Rattus norvegicus
tgatgaccgcggacccgagaactga

SEQ ID NO: 642884 - DNA, 25 bp, Rattus norvegicus
ttaaccgcgtttgacaattggctcg

SEQ ID NO: 642885 - DNA, 25 bp, Rattus norvegicus
gcctctggaaatgcgtcgcgtcctt

SEQ ID NO: 642886 - DNA, 25 bp, Rattus norvegicus
acccttgagctggtcccactgggtc

SEQ ID NO: 642887 - DNA, 25 bp, Rattus norvegicus
gggctccggttctgacgccatgagc

SEQ ID NO: 642888 - DNA, 25 bp, Rattus norvegicus
tcgttgtcgcctgggttgtgatgac

SEQ ID NO: 642889 - DNA, 25 bp, Rattus norvegicus
tgccgcgaaagccacgcctctggaa

SEQ ID NO: 642890 - DNA, 25 bp, Rattus norvegicus
agaactgaggctcggttggcagaca

SEQ ID NO: 642891 - DNA, 25 bp, Rattus norvegicus
tggcagacagctctcggccaagtcc

SEQ ID NO: 642892 - DNA, 25 bp, Rattus norvegicus
gcctgtgcgtttcctgccttggcat

SEQ ID NO: 642893 - DNA, 25 bp, Rattus norvegicus
tgccttggcatgcacgatccgctgt

SEQ ID NO: 642894 - DNA, 25 bp, Rattus norvegicus
acgattgttgactgggccggctcct

SEQ ID NO: 642895 - DNA, 25 bp, Rattus norvegicus
gcttggcttttaaccgcgtttgaca

SEQ ID NO: 642896 - DNA, 25 bp, Rattus norvegicus
tccctcataggaagcagggtctgta

SEQ ID NO: 642897 - DNA, 25 bp, Rattus norvegicus
atgtacacggccagacggtcattga

SEQ ID NO: 642898 - DNA, 25 bp, Rattus norvegicus
agctcggcctcgtaggccgccttga

SEQ ID NO: 642899 - DNA, 25 bp, Rattus norvegicus
gctgaccacctcttcagactcagtg

SEQ ID NO: 642900 - DNA, 25 bp, Rattus norvegicus
tcagactcagtgatgcgaaggcgca

SEQ ID NO: 642901 - DNA, 25 bp, Rattus norvegicus
gttctccgtctccagggagcgcacg

SEQ ID NO: 642902 - DNA, 25 bp, Rattus norvegicus
agcgcacgcgatcgatgtacacggc

SEQ ID NO: 642903 - DNA, 25 bp, Rattus norvegicus
taggccgccttgatgccggacacct

SEQ ID NO: 642904 - DNA, 25 bp, Rattus norvegicus
acggtcattgagctcctgcaggtcc

SEQ ID NO: 642905 - DNA, 25 bp, Rattus norvegicus
cattgagctcctgcaggtcctcctt

SEQ ID NO: 642906 - DNA, 25 bp, Rattus norvegicus
tctcctgcagccgtgtgatccgagt

SEQ ID NO: 642907 - DNA, 25 bp, Rattus norvegicus
cgcgccgctgagacggggtctccat

SEQ ID NO: 642908 - DNA, 25 bp, Rattus norvegicus
tcgctcctggcaggcgtggagatct

SEQ ID NO: 642909 - DNA, 25 bp, Rattus norvegicus
ttgatgccggacacctctcggctga

SEQ ID NO: 642910 - DNA, 25 bp, Rattus norvegicus
agccggcgaagctcgctcctggcag

SEQ ID NO: 642911 - DNA, 25 bp, Rattus norvegicus
gcgcagagacctgctcctcccactg

SEQ ID NO: 642912 - DNA, 25 bp, Rattus norvegicus
cccggccctcattaccataagaaag

SEQ ID NO: 642913 - DNA, 25 bp, Rattus norvegicus
ggcctaagcccgtggactccgcgat

SEQ ID NO: 642914 - DNA, 25 bp, Rattus norvegicus
gccactgagcgacgctccgggactg

SEQ ID NO: 642915 - DNA, 25 bp, Rattus norvegicus
tgctccatccagttcatttaaaaca

SEQ ID NO: 642916 - DNA, 25 bp, Rattus norvegicus
gtcagttccatgctgctccatccag

SEQ ID NO: 642917 - DNA, 25 bp, Rattus norvegicus
cttcttgcccgggttgaggaattcg

SEQ ID NO: 642918 - DNA, 25 bp, Rattus norvegicus
aaatttctccgaccacgactctcgg

SEQ ID NO: 642919 - DNA, 25 bp, Rattus norvegicus
gctcctgaaatttctccgaccacga

SEQ ID NO: 642920 - DNA, 25 bp, Rattus norvegicus
atgcccgctcccttcccacataccg

SEQ ID NO: 642921 - DNA, 25 bp, Rattus norvegicus
cattaccataagaaagaggcccggg

SEQ ID NO: 642922 - DNA, 25 bp, Rattus norvegicus
ggctttgtctgctccacgagctctc

SEQ ID NO: 642923 - DNA, 25 bp, Rattus norvegicus
acaaaagagtttgagcgctggaagg

SEQ ID NO: 642924 - DNA, 25 bp, Rattus norvegicus
aggagaaacgcctttccatgcccgc

SEQ ID NO: 642925 - DNA, 25 bp, Rattus norvegicus
aacactacggagtgcgttcccgtgc

SEQ ID NO: 642926 - DNA, 25 bp, Rattus norvegicus
cccggcgcggaaagttcatcgcttc

SEQ ID NO: 642927 - DNA, 25 bp, Rattus norvegicus
cgagatcgtgggcaggcaaggtaag

SEQ ID NO: 642928 - DNA, 25 bp, Rattus norvegicus
ctccgagcacgtggccgagatcgtg

SEQ ID NO: 642929 - DNA, 25 bp, Rattus norvegicus
tgcgcgctctacaaagaggccgagc

SEQ ID NO: 642930 - DNA, 25 bp, Rattus norvegicus
actacggagtgcgttcccgtgccca

SEQ ID NO: 642931 - DNA, 25 bp, Rattus norvegicus
gcgcggaaagttcatcgcttccttc

SEQ ID NO: 642932 - DNA, 25 bp, Rattus norvegicus
agttcatcgcttccttctttgcgcg

SEQ ID NO: 642933 - DNA, 25 bp, Rattus norvegicus
agcagcaacactacggagtgcgttc

SEQ ID NO: 642934 - DNA, 25 bp, Rattus norvegicus
agggcagcagcaacactacggagtg

SEQ ID NO: 642935 - DNA, 25 bp, Rattus norvegicus
aagctctgcgcgctctacaaagagg

SEQ ID NO: 642936 - DNA, 25 bp, Rattus norvegicus
agctgcgcctgaagggcagcagcaa

SEQ ID NO: 642937 - DNA, 25 bp, Rattus norvegicus
gctctacaaagaggccgagctgcgc

SEQ ID NO: 642938 - DNA, 25 bp, Rattus norvegicus
acctccgagcacgtggccgagatcg

SEQ ID NO: 642939 - DNA, 25 bp, Rattus norvegicus
accactgcagggtttctctaaactg

SEQ ID NO: 642940 - DNA, 25 bp, Rattus norvegicus
ggatatctgtttccgggctatggcg

SEQ ID NO: 642941 - DNA, 25 bp, Rattus norvegicus
aggagatcgagacgcacatcgctgt

SEQ ID NO: 642942 - DNA, 25 bp, Rattus norvegicus
gccagagcagctgactgggctccct

SEQ ID NO: 642943 - DNA, 25 bp, Rattus norvegicus
cgtgggcaagcaggacgtgtactat

SEQ ID NO: 642944 - DNA, 25 bp, Rattus norvegicus
tcggctacggcggatatctgtttcc

SEQ ID NO: 642945 - DNA, 25 bp, Rattus norvegicus
cttccggcaaaacagcctgggctgc

SEQ ID NO: 642946 - DNA, 25 bp, Rattus norvegicus
atgcgccaggctgtaagccactctc

SEQ ID NO: 642947 - DNA, 25 bp, Rattus norvegicus
actcagacgcctggcgggtgcatgc

SEQ ID NO: 642948 - DNA, 25 bp, Rattus norvegicus
tggacagccgctactcagacgcctg

SEQ ID NO: 642949 - DNA, 25 bp, Rattus norvegicus
aacagcgacggcgacttcctggctg

SEQ ID NO: 642950 - DNA, 25 bp, Rattus norvegicus
agattcttgagtacaacagcgacgg

SEQ ID NO: 642951 - DNA, 25 bp, Rattus norvegicus
tgtgcgcaccggcaagattcttgag

SEQ ID NO: 642952 - DNA, 25 bp, Rattus norvegicus
ttcttcagccaaggcacgagcgggt

SEQ ID NO: 642953 - DNA, 25 bp, Rattus norvegicus
ctaggcctggccgattctgcctttc

SEQ ID NO: 642954 - DNA, 25 bp, Rattus norvegicus
aacggagatgagacggcgacaccga

SEQ ID NO: 642955 - DNA, 25 bp, Rattus norvegicus
ggccgattctgcctttcaagaaaaa

SEQ ID NO: 642956 - DNA, 25 bp, Rattus norvegicus
tgagacggcgacaccgaaagtcctt

SEQ ID NO: 642957 - DNA, 25 bp, Rattus norvegicus
tgagccaggaacgaacctaggcctg

SEQ ID NO: 642958 - DNA, 25 bp, Rattus norvegicus
gccctgagccaggaacgaacctagg

SEQ ID NO: 642959 - DNA, 25 bp, Rattus norvegicus
ttaaggacgccctgagccaggaacg

SEQ ID NO: 642960 - DNA, 25 bp, Rattus norvegicus
aatctgcagaggttttaaggacgcc

SEQ ID NO: 642961 - DNA, 25 bp, Rattus norvegicus
ggtcacgactgttagaatctgcaga

SEQ ID NO: 642962 - DNA, 25 bp, Rattus norvegicus
tcccgggaggtcacgactgttagaa

SEQ ID NO: 642963 - DNA, 25 bp, Rattus norvegicus
ggccctgaatctcccgccctctgcg

SEQ ID NO: 642964 - DNA, 25 bp, Rattus norvegicus
ttacctcggggaacggagatgagac

SEQ ID NO: 642965 - DNA, 25 bp, Rattus norvegicus
gaggttttaaggacgccctgagcca

SEQ ID NO: 642966 - DNA, 25 bp, Rattus norvegicus
ggcgacaccgaaagtcctttgtcca

SEQ ID NO: 642967 - DNA, 25 bp, Rattus norvegicus
ccagatctgtttccggtcttttgga

SEQ ID NO: 642968 - DNA, 25 bp, Rattus norvegicus
tttcgggtactcacggtgagtctgg

SEQ ID NO: 642969 - DNA, 25 bp, Rattus norvegicus
gcgtttcgggtactcacggtgagtc

SEQ ID NO: 642970 - DNA, 25 bp, Rattus norvegicus
gttctgtggcccagggaggcgtttc

SEQ ID NO: 642971 - DNA, 25 bp, Rattus norvegicus
tgacgccgttttccggttctgtggc

SEQ ID NO: 642972 - DNA, 25 bp, Rattus norvegicus
atcacagcgcggtgcacactgccgt

SEQ ID NO: 642973 - DNA, 25 bp, Rattus norvegicus
tttccggtcttttggaggctgacgc

SEQ ID NO: 642974 - DNA, 25 bp, Rattus norvegicus
ggccagatctgtttccggtcttttg

SEQ ID NO: 642975 - DNA, 25 bp, Rattus norvegicus
aggctgacgccgttttccggttctg

SEQ ID NO: 642976 - DNA, 25 bp, Rattus norvegicus
agcgcggtgcacactgccgtggctt

SEQ ID NO: 642977 - DNA, 25 bp, Rattus norvegicus
acactgccgtggcttgggcggttct

SEQ ID NO: 642978 - DNA, 25 bp, Rattus norvegicus
agtgtggcgccgcacaggctgcccg

SEQ ID NO: 642979 - DNA, 25 bp, Rattus norvegicus
gtcctcggtgatacggcctgaatca

SEQ ID NO: 642980 - DNA, 25 bp, Rattus norvegicus
gcctgaatcacagcgcggtgcacac

SEQ ID NO: 642981 - DNA, 25 bp, Rattus norvegicus
ctcgcgcgcggatcgaccggagcaa

SEQ ID NO: 642982 - DNA, 25 bp, Rattus norvegicus
ttgggccgctcggaagaaagttgct

SEQ ID NO: 642983 - DNA, 25 bp, Rattus norvegicus
gcatcccgtccggtgctcgggtacc

SEQ ID NO: 642984 - DNA, 25 bp, Rattus norvegicus
cgctggattatgtctcggatcgaat

SEQ ID NO: 642985 - DNA, 25 bp, Rattus norvegicus
cgctcggaagaaagttgctctggta

SEQ ID NO: 642986 - DNA, 25 bp, Rattus norvegicus
ggctcacgctggattatgtctcgga

SEQ ID NO: 642987 - DNA, 25 bp, Rattus norvegicus
tcaccagtggttcggcaggaccgag

SEQ ID NO: 642988 - DNA, 25 bp, Rattus norvegicus
cacccgcgcagcttctgtgctggga

SEQ ID NO: 642989 - DNA, 25 bp, Rattus norvegicus
gacccgcgtctccagcacccgcgca

SEQ ID NO: 642990 - DNA, 25 bp, Rattus norvegicus
gaggaccgcaacgtgacccgcgtct

SEQ ID NO: 642991 - DNA, 25 bp, Rattus norvegicus
accaaggtgggctggctctgcgacc

SEQ ID NO: 642992 - DNA, 25 bp, Rattus norvegicus
tcccgcggctcacgctggattatgt

SEQ ID NO: 642993 - DNA, 25 bp, Rattus norvegicus
tgtctcggatcgaatccctcactcg

SEQ ID NO: 642994 - DNA, 25 bp, Rattus norvegicus
aagttgctctggtaagggaacgagc

SEQ ID NO: 642995 - DNA, 25 bp, Rattus norvegicus
gcggttgcttctgtaactcccgaga

SEQ ID NO: 642996 - DNA, 25 bp, Rattus norvegicus
agcgggcaactgaagctggcagcct

SEQ ID NO: 642997 - DNA, 25 bp, Rattus norvegicus
cacagcctgttgcaggaagagctgc

SEQ ID NO: 642998 - DNA, 25 bp, Rattus norvegicus
ctggcattactgcagaggcagcaca

SEQ ID NO: 642999 - DNA, 25 bp, Rattus norvegicus
cacggagctggcattactgcagagg

SEQ ID NO: 643000 - DNA, 25 bp, Rattus norvegicus
gcttctgtaactcccgagaagcagg

SEQ ID NO: 643001 - DNA, 25 bp, Rattus norvegicus
ccgggctgcggttgcttctgtaact

SEQ ID NO: 643002 - DNA, 25 bp, Rattus norvegicus
gccaactctcgggatggcgaagctg

SEQ ID NO: 643003 - DNA, 25 bp, Rattus norvegicus
aaacgagccactcccggcagaagca

SEQ ID NO: 643004 - DNA, 25 bp, Rattus norvegicus
agccttgggccaaaacgagccactc

SEQ ID NO: 643005 - DNA, 25 bp, Rattus norvegicus
gcagctagcagccttgggccaaaac

SEQ ID NO: 643006 - DNA, 25 bp, Rattus norvegicus
gcagaagcaccctgggctcgcaggc

SEQ ID NO: 643007 - DNA, 25 bp, Rattus norvegicus
agatccgccggcagctagcagcctt

SEQ ID NO: 643008 - DNA, 25 bp, Rattus norvegicus
ggctgaagagatccgccggcagcta

SEQ ID NO: 643009 - DNA, 25 bp, Rattus norvegicus
catttgacaccgcagctgccagggc

SEQ ID NO: 643010 - DNA, 25 bp, Rattus norvegicus
acatccttggcaccgggcatccaga

SEQ ID NO: 643011 - DNA, 25 bp, Rattus norvegicus
ataggctgtcccgtctctgcggctc

SEQ ID NO: 643012 - DNA, 25 bp, Rattus norvegicus
tgcaacctcgggctgcaagaacccg

SEQ ID NO: 643013 - DNA, 25 bp, Rattus norvegicus
cgctaccatggaccactgtgggcca

SEQ ID NO: 643014 - DNA, 25 bp, Rattus norvegicus
taggcacctgcctcacatttgacac

SEQ ID NO: 643015 - DNA, 25 bp, Rattus norvegicus
tgacagccgcgagactgaggcacca

SEQ ID NO: 643016 - DNA, 25 bp, Rattus norvegicus
gaaactttgggatgcggtgacagcc

SEQ ID NO: 643017 - DNA, 25 bp, Rattus norvegicus
cgcccgctgcacttggggaaacttt

SEQ ID NO: 643018 - DNA, 25 bp, Rattus norvegicus
atccgacagcgcgtcccaggtcagt

SEQ ID NO: 643019 - DNA, 25 bp, Rattus norvegicus
aggtgaaggaccactgccgatccga

SEQ ID NO: 643020 - DNA, 25 bp, Rattus norvegicus
atcgtcgacagtcacgcagctcgga

SEQ ID NO: 643021 - DNA, 25 bp, Rattus norvegicus
ctgagatcgaagtcaccgctgaatc

SEQ ID NO: 643022 - DNA, 25 bp, Rattus norvegicus
tttcaggggtctcccgagagactcc

SEQ ID NO: 643023 - DNA, 25 bp, Rattus norvegicus
ttcctacctgtaggcgccgcagcaa

SEQ ID NO: 643024 - DNA, 25 bp, Rattus norvegicus
cccaggtggagaagtcaccagcagc

SEQ ID NO: 643025 - DNA, 25 bp, Rattus norvegicus
ctggagagaatgttgagcaggcctc

SEQ ID NO: 643026 - DNA, 25 bp, Rattus norvegicus
tcagagtgttttagaagggcgagcc

SEQ ID NO: 643027 - DNA, 25 bp, Rattus norvegicus
ggggaatgtgccagagttttagata

SEQ ID NO: 643028 - DNA, 25 bp, Rattus norvegicus
cagcaaatgggatcagccggctcca

SEQ ID NO: 643029 - DNA, 25 bp, Rattus norvegicus
gccgtggccgccaagatcaatgcta

SEQ ID NO: 643030 - DNA, 25 bp, Rattus norvegicus
ccctcaagtaggctgtatccgtatg

SEQ ID NO: 643031 - DNA, 25 bp, Rattus norvegicus
tcaatgctatgctcatggccaaagg

SEQ ID NO: 643032 - DNA, 25 bp, Rattus norvegicus
tggccaaagggaagctgaaaccgtc

SEQ ID NO: 643033 - DNA, 25 bp, Rattus norvegicus
aaaccgtctcagaatgcggccgaga

SEQ ID NO: 643034 - DNA, 25 bp, Rattus norvegicus
ccgagaaggtattccgagcgctaga

SEQ ID NO: 643035 - DNA, 25 bp, Rattus norvegicus
tccttcaggagccttggatgccgcc

SEQ ID NO: 643036 - DNA, 25 bp, Rattus norvegicus
gaatccaagccgagctgaatctttg

SEQ ID NO: 643037 - DNA, 25 bp, Rattus norvegicus
tctgagctatagctccagggccatc

SEQ ID NO: 643038 - DNA, 25 bp, Rattus norvegicus
tttagctacacttacctggggcttc

SEQ ID NO: 643039 - DNA, 25 bp, Rattus norvegicus
agggccatcgcgtgcacgcgctctg

SEQ ID NO: 643040 - DNA, 25 bp, Rattus norvegicus
cacacccggggccaagcaaggtaca

SEQ ID NO: 643041 - DNA, 25 bp, Rattus norvegicus
ctgaacctcggccagcccgtttgaa

SEQ ID NO: 643042 - DNA, 25 bp, Rattus norvegicus
cgtttgaaccgagcgtccagggtca

SEQ ID NO: 643043 - DNA, 25 bp, Rattus norvegicus
atcaccgaaaacattggatcccgcc

SEQ ID NO: 643044 - DNA, 25 bp, Rattus norvegicus
gcttgctggactccgcacttgttga

SEQ ID NO: 643045 - DNA, 25 bp, Rattus norvegicus
cgcacttgttgactgactcgcgggc

SEQ ID NO: 643046 - DNA, 25 bp, Rattus norvegicus
aggttccaacatctccaggatctga

SEQ ID NO: 643047 - DNA, 25 bp, Rattus norvegicus
acagctcccgtgttgcccggagtct

SEQ ID NO: 643048 - DNA, 25 bp, Rattus norvegicus
cccggagtcttaggcaacggagaga

SEQ ID NO: 643049 - DNA, 25 bp, Rattus norvegicus
tccgctccgggctgtgggctaaacc

SEQ ID NO: 643050 - DNA, 25 bp, Rattus norvegicus
aagcaaggtacaccgtccgctccgg

SEQ ID NO: 643051 - DNA, 25 bp, Rattus norvegicus
ctgagggtactgcatagtgtgtgat

SEQ ID NO: 643052 - DNA, 25 bp, Rattus norvegicus
gcgttacttccgctggtgcagaagc

SEQ ID NO: 643053 - DNA, 25 bp, Rattus norvegicus
caatgtttggcgcatgctctttgac

SEQ ID NO: 643054 - DNA, 25 bp, Rattus norvegicus
cgcatgctctttgacgcgcaggtcc

SEQ ID NO: 643055 - DNA, 25 bp, Rattus norvegicus
catgctctttgacgcgcaggtcccg

SEQ ID NO: 643056 - DNA, 25 bp, Rattus norvegicus
tgcccaggatgaggggcatctgctt

SEQ ID NO: 643057 - DNA, 25 bp, Rattus norvegicus
ccgttgcgttacttccgctggtgca

SEQ ID NO: 643058 - DNA, 25 bp, Rattus norvegicus
acttgggctcgtgttgagcgctgag

SEQ ID NO: 643059 - DNA, 25 bp, Rattus norvegicus
agtttccgcgggatcaaggcggcct

SEQ ID NO: 643060 - DNA, 25 bp, Rattus norvegicus
tccgcgggatcaaggcggcctctga

SEQ ID NO: 643061 - DNA, 25 bp, Rattus norvegicus
gcctctgagggtactgcatagtgtg

SEQ ID NO: 643062 - DNA, 25 bp, Rattus norvegicus
gcgggaagaggcacgttagacgtgg

SEQ ID NO: 643063 - DNA, 25 bp, Rattus norvegicus
gcatctgcttcgaggctgggtgccc

SEQ ID NO: 643064 - DNA, 25 bp, Rattus norvegicus
cacgtcagccggtgccgttgcgtta

SEQ ID NO: 643065 - DNA, 25 bp, Rattus norvegicus
tcggtcgtgcgtcccaacgcagcat

SEQ ID NO: 643066 - DNA, 25 bp, Rattus norvegicus
gggtctgacctgctggttccaccag

SEQ ID NO: 643067 - DNA, 25 bp, Rattus norvegicus
tcctgcagggtttacaggactgagc

SEQ ID NO: 643068 - DNA, 25 bp, Rattus norvegicus
cttcctcctctagggccggaagctg

SEQ ID NO: 643069 - DNA, 25 bp, Rattus norvegicus
aagctgccgcgatccgctgtcgtca

SEQ ID NO: 643070 - DNA, 25 bp, Rattus norvegicus
ccgggctgccactaggggtctgacc

SEQ ID NO: 643071 - DNA, 25 bp, Rattus norvegicus
cgaaacccgcgaaatgtcccaactg

SEQ ID NO: 643072 - DNA, 25 bp, Rattus norvegicus
atgtcccaactgcagcgtgagcacc

SEQ ID NO: 643073 - DNA, 25 bp, Rattus norvegicus
cccgtgccctattggttcgcgagca

SEQ ID NO: 643074 - DNA, 25 bp, Rattus norvegicus
gagcacgtgccttcccgttggcatc

SEQ ID NO: 643075 - DNA, 25 bp, Rattus norvegicus
tcccgttggcatcccgattcgttag

SEQ ID NO: 643076 - DNA, 25 bp, Rattus norvegicus
ccgattcgttagtctcctgggcgct

SEQ ID NO: 643077 - DNA, 25 bp, Rattus norvegicus
aagacgtccgggcacagctcgcctg

SEQ ID NO: 643078 - DNA, 25 bp, Rattus norvegicus
ggccacttcgatacaagacgtccgg

SEQ ID NO: 643079 - DNA, 25 bp, Rattus norvegicus
caccgccagcggctggatccgaggc

SEQ ID NO: 643080 - DNA, 25 bp, Rattus norvegicus
cgtcctgcagctgtgaagcaagctc

SEQ ID NO: 643081 - DNA, 25 bp, Rattus norvegicus
cagctgtgaagcaagctcgggtcgt

SEQ ID NO: 643082 - DNA, 25 bp, Rattus norvegicus
gtcgtgtggcaggaagctacccaac

SEQ ID NO: 643083 - DNA, 25 bp, Rattus norvegicus
aagcgggtagcaagcctcggctttg

SEQ ID NO: 643084 - DNA, 25 bp, Rattus norvegicus
ggtgacccgcacacaccgccagcgg

SEQ ID NO: 643085 - DNA, 25 bp, Rattus norvegicus
ccaggaggtcggtgcctaggttcct

SEQ ID NO: 643086 - DNA, 25 bp, Rattus norvegicus
ggtgcctaggttccttagctctcta

SEQ ID NO: 643087 - DNA, 25 bp, Rattus norvegicus
ggcagccgcgcgcaatggaacgtcc

SEQ ID NO: 643088 - DNA, 25 bp, Rattus norvegicus
agagattcccgacccggtggcaagc

SEQ ID NO: 643089 - DNA, 25 bp, Rattus norvegicus
tactcaagagattcccgacccggtg

SEQ ID NO: 643090 - DNA, 25 bp, Rattus norvegicus
aggaagctacccaacgcgcagtcgc

SEQ ID NO: 643091 - DNA, 25 bp, Rattus norvegicus
cgcccgtcctgcagctgtgaagcaa

SEQ ID NO: 643092 - DNA, 25 bp, Rattus norvegicus
aggttccttagctctctactcaaga

SEQ ID NO: 643093 - DNA, 25 bp, Rattus norvegicus
ggcctttggcttctcctctttcgcg

SEQ ID NO: 643094 - DNA, 25 bp, Rattus norvegicus
ctggccgcctcctgacaagcgggag

SEQ ID NO: 643095 - DNA, 25 bp, Rattus norvegicus
cccagaggagccgaggcaccaggct

SEQ ID NO: 643096 - DNA, 25 bp, Rattus norvegicus
cgctctcggcctcacacggtgagta

SEQ ID NO: 643097 - DNA, 25 bp, Rattus norvegicus
tctcggcctcacacggtgagtagtg

SEQ ID NO: 643098 - DNA, 25 bp, Rattus norvegicus
ctcggcctcacacggtgagtagtgc

SEQ ID NO: 643099 - DNA, 25 bp, Rattus norvegicus
gctggccgcctcctgacaagcggga

SEQ ID NO: 643100 - DNA, 25 bp, Rattus norvegicus
tggacccagaggagccgaggcacca

SEQ ID NO: 643101 - DNA, 25 bp, Rattus norvegicus
cttctcctctttcgcgtttccgccg

SEQ ID NO: 643102 - DNA, 25 bp, Rattus norvegicus
cctcctgacaagcgggagggttacg

SEQ ID NO: 643103 - DNA, 25 bp, Rattus norvegicus
tggcttctcctctttcgcgtttccg

SEQ ID NO: 643104 - DNA, 25 bp, Rattus norvegicus
tttggcttctcctctttcgcgtttc

SEQ ID NO: 643105 - DNA, 25 bp, Rattus norvegicus
gcctttggcttctcctctttcgcgt

SEQ ID NO: 643106 - DNA, 25 bp, Rattus norvegicus
tccgccggtccgcttacccgctggc

SEQ ID NO: 643107 - DNA, 25 bp, Rattus norvegicus
agtcgattcttcttcctccgcggag

SEQ ID NO: 643108 - DNA, 25 bp, Rattus norvegicus
agactatgagccagtcgctgcgatc

SEQ ID NO: 643109 - DNA, 25 bp, Rattus norvegicus
tcagtgtcgggcgagaagactatga

SEQ ID NO: 643110 - DNA, 25 bp, Rattus norvegicus
gcttcgcgaccggagttccttgcaa

SEQ ID NO: 643111 - DNA, 25 bp, Rattus norvegicus
taggctgcagcccaagtcgattctt

SEQ ID NO: 643112 - DNA, 25 bp, Rattus norvegicus
ggcttctgcgggtccacgcttctta

SEQ ID NO: 643113 - DNA, 25 bp, Rattus norvegicus
cacttcgaagatccacccagttttc

SEQ ID NO: 643114 - DNA, 25 bp, Rattus norvegicus
tcagaggcgtaaagagcagggaccc

SEQ ID NO: 643115 - DNA, 25 bp, Rattus norvegicus
ggccacccggtcagaggcgtaaaga

SEQ ID NO: 643116 - DNA, 25 bp, Rattus norvegicus
gctcccactggggacaggcgcacag

SEQ ID NO: 643117 - DNA, 25 bp, Rattus norvegicus
agtcgctgcgatctttcttggcctg

SEQ ID NO: 643118 - DNA, 25 bp, Rattus norvegicus
cagttttccctctcccaggagcgtg

SEQ ID NO: 643119 - DNA, 25 bp, Rattus norvegicus
tccttgcaaggtggtgacttctcgg

SEQ ID NO: 643120 - DNA, 25 bp, Rattus norvegicus
tctttcttggcctgcggcacaaggg

SEQ ID NO: 643121 - DNA, 25 bp, Rattus norvegicus
gtctgtcagacactagttataaccg

SEQ ID NO: 643122 - DNA, 25 bp, Rattus norvegicus
gagttaaatacacaaaagcacaagc

SEQ ID NO: 643123 - DNA, 25 bp, Rattus norvegicus
cccgcgcagagttaaatacacaaaa

SEQ ID NO: 643124 - DNA, 25 bp, Rattus norvegicus
gacttgaggagcaaacccgcgcaga

SEQ ID NO: 643125 - DNA, 25 bp, Rattus norvegicus
ctctcggcctggagtacggcggact

SEQ ID NO: 643126 - DNA, 25 bp, Rattus norvegicus
ggagggctcacaagagtaaactctc

SEQ ID NO: 643127 - DNA, 25 bp, Rattus norvegicus
gcgtaggagggctcacaagagtaaa

SEQ ID NO: 643128 - DNA, 25 bp, Rattus norvegicus
cgcagccggcctctgagcaacaggt

SEQ ID NO: 643129 - DNA, 25 bp, Rattus norvegicus
agacactagttataaccgcagccgg

SEQ ID NO: 643130 - DNA, 25 bp, Rattus norvegicus
tgggctcgtcgtctgtcagacacta

SEQ ID NO: 643131 - DNA, 25 bp, Rattus norvegicus
agcacaagcaaaccgctccgtctgg

SEQ ID NO: 643132 - DNA, 25 bp, Rattus norvegicus
agtacggcggacttgaggagcaaac

SEQ ID NO: 643133 - DNA, 25 bp, Rattus norvegicus
agttataaccgcagccggcctctga

SEQ ID NO: 643134 - DNA, 25 bp, Rattus norvegicus
cacaagagtaaactctcggcctgga

SEQ ID NO: 643135 - DNA, 25 bp, Rattus norvegicus
ggggagcatgcagatcatagcactc

SEQ ID NO: 643136 - DNA, 25 bp, Rattus norvegicus
ggacccatctgaagtctaatcctcg

SEQ ID NO: 643137 - DNA, 25 bp, Rattus norvegicus
ggtcacagaggacccatctgaagtc

SEQ ID NO: 643138 - DNA, 25 bp, Rattus norvegicus
tgactatctcgggtcacagaggacc

SEQ ID NO: 643139 - DNA, 25 bp, Rattus norvegicus
tgcaacgtgcagttcgcgtgctacg

SEQ ID NO: 643140 - DNA, 25 bp, Rattus norvegicus
tgcagatcatagcactccgcgcaac

SEQ ID NO: 643141 - DNA, 25 bp, Rattus norvegicus
tctgaagtctaatcctcggcctcgc

SEQ ID NO: 643142 - DNA, 25 bp, Rattus norvegicus
cgcggctctctagcgctcctcacag

SEQ ID NO: 643143 - DNA, 25 bp, Rattus norvegicus
agcgactggggagcatgcagatcat

SEQ ID NO: 643144 - DNA, 25 bp, Rattus norvegicus
ggaacacatttcgaacacacccagc

SEQ ID NO: 643145 - DNA, 25 bp, Rattus norvegicus
ggcagcagagtgcaacgtgcagttc

SEQ ID NO: 643146 - DNA, 25 bp, Rattus norvegicus
cgcgtgctacgggaacacatttcga

SEQ ID NO: 643147 - DNA, 25 bp, Rattus norvegicus
gcagttcgcgtgctacgggaacaca

SEQ ID NO: 643148 - DNA, 25 bp, Rattus norvegicus
ccggagttgactatctcgggtcaca

SEQ ID NO: 643149 - DNA, 25 bp, Rattus norvegicus
ctgctgcccacacttcccgagaggg

SEQ ID NO: 643150 - DNA, 25 bp, Rattus norvegicus
gttgggcctctccaaccggtccatg

SEQ ID NO: 643151 - DNA, 25 bp, Rattus norvegicus
cctgctcgatttccaccgctttgtg

SEQ ID NO: 643152 - DNA, 25 bp, Rattus norvegicus
gggcggtcggccaaactgctgccca

SEQ ID NO: 643153 - DNA, 25 bp, Rattus norvegicus
tccaaccggtccatggccgtggcgg

SEQ ID NO: 643154 - DNA, 25 bp, Rattus norvegicus
tccatggctgccctcactcgttggg

SEQ ID NO: 643155 - DNA, 25 bp, Rattus norvegicus
tctcgcgtgcaggagtcgccgcttc

SEQ ID NO: 643156 - DNA, 25 bp, Rattus norvegicus
cgcctcttcggctcgggcgcagact

SEQ ID NO: 643157 - DNA, 25 bp, Rattus norvegicus
acttgttgacggtcggctgcagcag

SEQ ID NO: 643158 - DNA, 25 bp, Rattus norvegicus
agagaacttgttgacggtcggctgc

SEQ ID NO: 643159 - DNA, 25 bp, Rattus norvegicus
gacccggagagagaacttgttgacg

SEQ ID NO: 643160 - DNA, 25 bp, Rattus norvegicus
gccgaagacccggagagagaacttg

SEQ ID NO: 643161 - DNA, 25 bp, Rattus norvegicus
tccaccgctttgtggctgccgaaga

SEQ ID NO: 643162 - DNA, 25 bp, Rattus norvegicus
ggacagacgtgtaggcactgcgccc

SEQ ID NO: 643163 - DNA, 25 bp, Rattus norvegicus
gccgctctctcttctcacaccgctc

SEQ ID NO: 643164 - DNA, 25 bp, Rattus norvegicus
atctgacgtgttcccttccactgtc

SEQ ID NO: 643165 - DNA, 25 bp, Rattus norvegicus
tctcttctcacaccgctccgcctta

SEQ ID NO: 643166 - DNA, 25 bp, Rattus norvegicus
gctccgccttagcacatctgacgtg

SEQ ID NO: 643167 - DNA, 25 bp, Rattus norvegicus
ccgccttagcacatctgacgtgttc

SEQ ID NO: 643168 - DNA, 25 bp, Rattus norvegicus
ttagcacatctgacgtgttcccttc

SEQ ID NO: 643169 - DNA, 25 bp, Rattus norvegicus
agcacatctgacgtgttcccttcca

SEQ ID NO: 643170 - DNA, 25 bp, Rattus norvegicus
gggcgcctgtgaccggtgaccccta

SEQ ID NO: 643171 - DNA, 25 bp, Rattus norvegicus
cgatccgacacctggcttgctccga

SEQ ID NO: 643172 - DNA, 25 bp, Rattus norvegicus
agccaagagtgtagaggacgacgct

SEQ ID NO: 643173 - DNA, 25 bp, Rattus norvegicus
ccaagagtgtagaggacgacgctga

SEQ ID NO: 643174 - DNA, 25 bp, Rattus norvegicus
ggacgacgctgagggccacctcatc

SEQ ID NO: 643175 - DNA, 25 bp, Rattus norvegicus
gagggccacctcatctaccacgtcg

SEQ ID NO: 643176 - DNA, 25 bp, Rattus norvegicus
tagaggacgacgctgagggccacct

SEQ ID NO: 643177 - DNA, 25 bp, Rattus norvegicus
ctccgcccgcagtacgctgaggaga

SEQ ID NO: 643178 - DNA, 25 bp, Rattus norvegicus
atcctgcgctcggacgctgtccaaa

SEQ ID NO: 643179 - DNA, 25 bp, Rattus norvegicus
acagctcaactgacgcggcgctcgg

SEQ ID NO: 643180 - DNA, 25 bp, Rattus norvegicus
tttgcaccggccaaaaccagcggcg

SEQ ID NO: 643181 - DNA, 25 bp, Rattus norvegicus
ccagcggcggacactgtatttcacc

SEQ ID NO: 643182 - DNA, 25 bp, Rattus norvegicus
tccaaatgctgatccgcgcgcgagc

SEQ ID NO: 643183 - DNA, 25 bp, Rattus norvegicus
aacactggggcatccgtgagacgga

SEQ ID NO: 643184 - DNA, 25 bp, Rattus norvegicus
ataaccggtgcctgtgggactcccg

SEQ ID NO: 643185 - DNA, 25 bp, Rattus norvegicus
cgtgcagggtaacccggccacaaca

SEQ ID NO: 643186 - DNA, 25 bp, Rattus norvegicus
agccgacctaccacagaggggcgca

SEQ ID NO: 643187 - DNA, 25 bp, Rattus norvegicus
agagaatgcttctcgctgccacacc

SEQ ID NO: 643188 - DNA, 25 bp, Rattus norvegicus
aggagcctcatctctgcgcgtgcgt

SEQ ID NO: 643189 - DNA, 25 bp, Rattus norvegicus
taggacaacccgacgccgacacaga

SEQ ID NO: 643190 - DNA, 25 bp, Rattus norvegicus
ctgtccaaagaacgctctgctgctg

SEQ ID NO: 643191 - DNA, 25 bp, Rattus norvegicus
tgaccgtcgcatcgggctccagcgt

SEQ ID NO: 643192 - DNA, 25 bp, Rattus norvegicus
aggccgctttgggagcaaagcctcc

SEQ ID NO: 643193 - DNA, 25 bp, Rattus norvegicus
cccagcaggaatgtggtcgagccgc

SEQ ID NO: 643194 - DNA, 25 bp, Rattus norvegicus
ttggcgtgcaaaagagggccgcaca

SEQ ID NO: 643195 - DNA, 25 bp, Rattus norvegicus
ctgtccaggacgccgtctccttttt

SEQ ID NO: 643196 - DNA, 25 bp, Rattus norvegicus
cactggcaaggctgcgaggcttcgt

SEQ ID NO: 643197 - DNA, 25 bp, Rattus norvegicus
ggactacggaggtgaccgtcgcatc

SEQ ID NO: 643198 - DNA, 25 bp, Rattus norvegicus
cgaggcaactcaccgggactacgga

SEQ ID NO: 643199 - DNA, 25 bp, Rattus norvegicus
agaagtccgcgcacgaggcaactca

SEQ ID NO: 643200 - DNA, 25 bp, Rattus norvegicus
gcgatgacaattttccagccactgg

SEQ ID NO: 643201 - DNA, 25 bp, Rattus norvegicus
cgcctcccaggcgatgacaattttc

SEQ ID NO: 643202 - DNA, 25 bp, Rattus norvegicus
ccgccacctcgaagggaggagaccg

SEQ ID NO: 643203 - DNA, 25 bp, Rattus norvegicus
tggtcgagccgcagcctggcagcct

SEQ ID NO: 643204 - DNA, 25 bp, Rattus norvegicus
tctccttttttcttcgtgtccacga

SEQ ID NO: 643205 - DNA, 25 bp, Rattus norvegicus
ggcgagcttgacaatccctttcagg

SEQ ID NO: 643206 - DNA, 25 bp, Rattus norvegicus
aatccctttcaggtgatttgcgccg

SEQ ID NO: 643207 - DNA, 25 bp, Rattus norvegicus
gctgcgggaatcttcgcgactcttc

SEQ ID NO: 643208 - DNA, 25 bp, Rattus norvegicus
ccaagcacaccggagggagttcttt

SEQ ID NO: 643209 - DNA, 25 bp, Rattus norvegicus
gaggcccgggctcgcttgcaaacat

SEQ ID NO: 643210 - DNA, 25 bp, Rattus norvegicus
ggctcgcttgcaaacatggctcaga

SEQ ID NO: 643211 - DNA, 25 bp, Rattus norvegicus
gcttgcaaacatggctcagaacaga

SEQ ID NO: 643212 - DNA, 25 bp, Rattus norvegicus
ctcagaacagagacggcgggaatcc

SEQ ID NO: 643213 - DNA, 25 bp, Rattus norvegicus
ggaatccattccctgactccggcga

SEQ ID NO: 643214 - DNA, 25 bp, Rattus norvegicus
cctgactccggcgagcttgacaatc

SEQ ID NO: 643215 - DNA, 25 bp, Rattus norvegicus
gggaagcgagtggaccaagcacacc

SEQ ID NO: 643216 - DNA, 25 bp, Rattus norvegicus
ccaattggagcacagggaagcgagt

SEQ ID NO: 643217 - DNA, 25 bp, Rattus norvegicus
ttggttcaaccaattggagcacagg

SEQ ID NO: 643218 - DNA, 25 bp, Rattus norvegicus
gcgactcttccggttggttcaacca

SEQ ID NO: 643219 - DNA, 25 bp, Rattus norvegicus
tactgccttagcctggactgcggcc

SEQ ID NO: 643220 - DNA, 25 bp, Rattus norvegicus
gaggaggcagccgttcaactgcacc

SEQ ID NO: 643221 - DNA, 25 bp, Rattus norvegicus
gcgcaggctactgccttagcctgga

SEQ ID NO: 643222 - DNA, 25 bp, Rattus norvegicus
ccactgggtgctcccacagctgctc

SEQ ID NO: 643223 - DNA, 25 bp, Rattus norvegicus
tccgctccatccagcgcagccgcgc

SEQ ID NO: 643224 - DNA, 25 bp, Rattus norvegicus
gtcgattacgtgctcttccgctcca

SEQ ID NO: 643225 - DNA, 25 bp, Rattus norvegicus
gctccgtcgattacgtgctcttccg

SEQ ID NO: 643226 - DNA, 25 bp, Rattus norvegicus
ggctgcccgctcctattcctgctca

SEQ ID NO: 643227 - DNA, 25 bp, Rattus norvegicus
tattcctgctcagctcctgaagccc

SEQ ID NO: 643228 - DNA, 25 bp, Rattus norvegicus
ggtccctttgaagacagtcccttgc

SEQ ID NO: 643229 - DNA, 25 bp, Rattus norvegicus
gccgccctgggtgggaccttgcttc

SEQ ID NO: 643230 - DNA, 25 bp, Rattus norvegicus
ctcctgcccgagcaccagttcggcg

SEQ ID NO: 643231 - DNA, 25 bp, Rattus norvegicus
acagctgctcgcagttgccaccggt

SEQ ID NO: 643232 - DNA, 25 bp, Rattus norvegicus
ctgctcgcagttgccaccggttgga

SEQ ID NO: 643233 - DNA, 25 bp, Rattus norvegicus
ttcgcgctgcctgtcgccatggaaa

SEQ ID NO: 643234 - DNA, 25 bp, Rattus norvegicus
acagcgcgttatgtttggagccggc

SEQ ID NO: 643235 - DNA, 25 bp, Rattus norvegicus
catctggtgcggcttaacggccttt

SEQ ID NO: 643236 - DNA, 25 bp, Rattus norvegicus
gccgcatgttttccacagcgcgtta

SEQ ID NO: 643237 - DNA, 25 bp, Rattus norvegicus
ctctcaaatctctgcccggagcgga

SEQ ID NO: 643238 - DNA, 25 bp, Rattus norvegicus
tacaccgggacctctcaaatctctg

SEQ ID NO: 643239 - DNA, 25 bp, Rattus norvegicus
ggggctcttgccaaactgcacatgg

SEQ ID NO: 643240 - DNA, 25 bp, Rattus norvegicus
aaccgccggagacaagcagggcttg

SEQ ID NO: 643241 - DNA, 25 bp, Rattus norvegicus
gagcatagccacgaaccgccggaga

SEQ ID NO: 643242 - DNA, 25 bp, Rattus norvegicus
attcacggtgcctctgccgagcata

SEQ ID NO: 643243 - DNA, 25 bp, Rattus norvegicus
aggtggagcattgcccttctgagga

SEQ ID NO: 643244 - DNA, 25 bp, Rattus norvegicus
ccactcggagtttgaggtctaggga

SEQ ID NO: 643245 - DNA, 25 bp, Rattus norvegicus
gtctctgcctgtgtagccactcgga

SEQ ID NO: 643246 - DNA, 25 bp, Rattus norvegicus
gcacatggcctcgactacaccggga

SEQ ID NO: 643247 - DNA, 25 bp, Rattus norvegicus
cgtgcccgctgtccgggtcatatct

SEQ ID NO: 643248 - DNA, 25 bp, Rattus norvegicus
cctgtcagccctgcatttgaacttg

SEQ ID NO: 643249 - DNA, 25 bp, Rattus norvegicus
aaggcctccactgcggcgtcttctg

SEQ ID NO: 643250 - DNA, 25 bp, Rattus norvegicus
gagcccagcaggatcttgcccatgc

SEQ ID NO: 643251 - DNA, 25 bp, Rattus norvegicus
aggatcttgcccatgccgatggtca

SEQ ID NO: 643252 - DNA, 25 bp, Rattus norvegicus
ccatgccgatggtcaggaaagcgaa

SEQ ID NO: 643253 - DNA, 25 bp, Rattus norvegicus
gcatttgaacttgctccggagccca

SEQ ID NO: 643254 - DNA, 25 bp, Rattus norvegicus
tgtgcagctagctgccgggccgtct

SEQ ID NO: 643255 - DNA, 25 bp, Rattus norvegicus
ggcgtcttctgcaccgctgtcgtgc

SEQ ID NO: 643256 - DNA, 25 bp, Rattus norvegicus
tggcagaggcactgtgcagctagct

SEQ ID NO: 643257 - DNA, 25 bp, Rattus norvegicus
tcgtagtccaaacagatgcctaggc

SEQ ID NO: 643258 - DNA, 25 bp, Rattus norvegicus
ccgctcgtagtccaaacagatgcct

SEQ ID NO: 643259 - DNA, 25 bp, Rattus norvegicus
acagcatccaggaaggaaacccgcc

SEQ ID NO: 643260 - DNA, 25 bp, Rattus norvegicus
gcggaacgacacagcatccaggaag

SEQ ID NO: 643261 - DNA, 25 bp, Rattus norvegicus
cgacgcctgcgtacagacaaccggg

SEQ ID NO: 643262 - DNA, 25 bp, Rattus norvegicus
agggaactagcatttcctccggaca

SEQ ID NO: 643263 - DNA, 25 bp, Rattus norvegicus
cgctgcatccaaggcgcgtagagga

SEQ ID NO: 643264 - DNA, 25 bp, Rattus norvegicus
gaagtaaagcaagtccacgttggcc

SEQ ID NO: 643265 - DNA, 25 bp, Rattus norvegicus
catttcctccggacaggcgggaact

SEQ ID NO: 643266 - DNA, 25 bp, Rattus norvegicus
cctctttctccagaggcacggattg

SEQ ID NO: 643267 - DNA, 25 bp, Rattus norvegicus
agaggcacggattggacccacggac

SEQ ID NO: 643268 - DNA, 25 bp, Rattus norvegicus
atgggtaaccgcaccggccggatgc

SEQ ID NO: 643269 - DNA, 25 bp, Rattus norvegicus
tgggcatcggggtagccctcttttc

SEQ ID NO: 643270 - DNA, 25 bp, Rattus norvegicus
ttcccggtagcgttggtaaagctga

SEQ ID NO: 643271 - DNA, 25 bp, Rattus norvegicus
tagcgttggtaaagctgacgtgtcc

SEQ ID NO: 643272 - DNA, 25 bp, Rattus norvegicus
aagctgacgtgtcctgatttccagg

SEQ ID NO: 643273 - DNA, 25 bp, Rattus norvegicus
ctgatttccagggaactagcatttc

SEQ ID NO: 643274 - DNA, 25 bp, Rattus norvegicus
caaggcgcgtagaggaagaagtaaa

SEQ ID NO: 643275 - DNA, 25 bp, Rattus norvegicus
cagcttcctaggcttccaggccgtt

SEQ ID NO: 643276 - DNA, 25 bp, Rattus norvegicus
tttgcggctgcgcatcagagcaagc

SEQ ID NO: 643277 - DNA, 25 bp, Rattus norvegicus
gctgcgcatcagagcaagccgaaga

SEQ ID NO: 643278 - DNA, 25 bp, Rattus norvegicus
cgcatcagagcaagccgaagacccg

SEQ ID NO: 643279 - DNA, 25 bp, Rattus norvegicus
aagacccggggctctttgcagtgtc

SEQ ID NO: 643280 - DNA, 25 bp, Rattus norvegicus
gctctttgcagtgtccggcccagct

SEQ ID NO: 643281 - DNA, 25 bp, Rattus norvegicus
tcctaggcttccaggccgtttcatc

SEQ ID NO: 643282 - DNA, 25 bp, Rattus norvegicus
caggcttggcggcagaccctgtaat

SEQ ID NO: 643283 - DNA, 25 bp, Rattus norvegicus
cttggcggcagaccctgtaattaca

SEQ ID NO: 643284 - DNA, 25 bp, Rattus norvegicus
ggcggcagaccctgtaattacatcg

SEQ ID NO: 643285 - DNA, 25 bp, Rattus norvegicus
cctgtaattacatcgggccaagacg

SEQ ID NO: 643286 - DNA, 25 bp, Rattus norvegicus
atcgggccaagacgccgtggccagt

SEQ ID NO: 643287 - DNA, 25 bp, Rattus norvegicus
tggcgatgtgcctgtgtgcgttgca

SEQ ID NO: 643288 - DNA, 25 bp, Rattus norvegicus
ttacatcgggccaagacgccgtggc

SEQ ID NO: 643289 - DNA, 25 bp, Rattus norvegicus
atgtatagtacgtactgctccgccc

SEQ ID NO: 643290 - DNA, 25 bp, Rattus norvegicus
ccgccaggccctgagctgttgtagt

SEQ ID NO: 643291 - DNA, 25 bp, Rattus norvegicus
acgttcacttgcaccgtgtagccct

SEQ ID NO: 643292 - DNA, 25 bp, Rattus norvegicus
tagtcgttcacgttcacttgcaccg

SEQ ID NO: 643293 - DNA, 25 bp, Rattus norvegicus
aatatccagatagtcgttcacgttc

SEQ ID NO: 643294 - DNA, 25 bp, Rattus norvegicus
gaggacagtaaatatccagatagtc

SEQ ID NO: 643295 - DNA, 25 bp, Rattus norvegicus
gttgtagtgaggacagtaaatatcc

SEQ ID NO: 643296 - DNA, 25 bp, Rattus norvegicus
ggttcaccatgtatagtacgtactg

SEQ ID NO: 643297 - DNA, 25 bp, Rattus norvegicus
ccgctcaggttcaccatgtatagta

SEQ ID NO: 643298 - DNA, 25 bp, Rattus norvegicus
ggtagccgctcaggttcaccatgta

SEQ ID NO: 643299 - DNA, 25 bp, Rattus norvegicus
tgcggtagccgctcaggttcaccat

SEQ ID NO: 643300 - DNA, 25 bp, Rattus norvegicus
cttctcggagaacttgatggggctg

SEQ ID NO: 643301 - DNA, 25 bp, Rattus norvegicus
gctgtagcgctggaacttctcggag

SEQ ID NO: 643302 - DNA, 25 bp, Rattus norvegicus
gccctgagctgttgtagtgaggaca

SEQ ID NO: 643303 - DNA, 25 bp, Rattus norvegicus
atggaaagactctgccatatacaga

SEQ ID NO: 643304 - DNA, 25 bp, Rattus norvegicus
cagggcggcgcttgcacactgacac

SEQ ID NO: 643305 - DNA, 25 bp, Rattus norvegicus
aggcgaacacagacggattcgcccg

SEQ ID NO: 643306 - DNA, 25 bp, Rattus norvegicus
ccggcagctccggccttgaggagca

SEQ ID NO: 643307 - DNA, 25 bp, Rattus norvegicus
tcgaccctgcgacagtagcgacagc

SEQ ID NO: 643308 - DNA, 25 bp, Rattus norvegicus
cggcggaggtttattgatctgcagc

SEQ ID NO: 643309 - DNA, 25 bp, Rattus norvegicus
cggaggtttattgatctgcagcggc

SEQ ID NO: 643310 - DNA, 25 bp, Rattus norvegicus
agaagagcgaggacccgccgaaagc

SEQ ID NO: 643311 - DNA, 25 bp, Rattus norvegicus
ggacccgccgaaagcgagacacgca

SEQ ID NO: 643312 - DNA, 25 bp, Rattus norvegicus
cgagacacgcagagatggaaagact

SEQ ID NO: 643313 - DNA, 25 bp, Rattus norvegicus
gctccagcaggcgaggcccgaccac

SEQ ID NO: 643314 - DNA, 25 bp, Rattus norvegicus
actctgccatatacagaggggaggc

SEQ ID NO: 643315 - DNA, 25 bp, Rattus norvegicus
atatacagaggggaggcgaacacag

SEQ ID NO: 643316 - DNA, 25 bp, Rattus norvegicus
gccgaaagcgagacacgcagagatg

SEQ ID NO: 643317 - DNA, 25 bp, Rattus norvegicus
tcggcaccaagcctgtctcccagga

SEQ ID NO: 643318 - DNA, 25 bp, Rattus norvegicus
agcttctctcagacaccccgagttt

SEQ ID NO: 643319 - DNA, 25 bp, Rattus norvegicus
ttcacagacgcccacgtagtgcgtc

SEQ ID NO: 643320 - DNA, 25 bp, Rattus norvegicus
acggctagagcgctctttactatgc

SEQ ID NO: 643321 - DNA, 25 bp, Rattus norvegicus
tgtctcccaggactgccgccaggtt

SEQ ID NO: 643322 - DNA, 25 bp, Rattus norvegicus
ccctaggacttctcgggcccaccag

SEQ ID NO: 643323 - DNA, 25 bp, Rattus norvegicus
tcactgacgcgggacgcacgggttc

SEQ ID NO: 643324 - DNA, 25 bp, Rattus norvegicus
actgctggttggagctgttccagta

SEQ ID NO: 643325 - DNA, 25 bp, Rattus norvegicus
gctgttccagtataccgcatgccgg

SEQ ID NO: 643326 - DNA, 25 bp, Rattus norvegicus
agtataccgcatgccggtttcccag

SEQ ID NO: 643327 - DNA, 25 bp, Rattus norvegicus
cgctcccggcttctcagcttcccag

SEQ ID NO: 643328 - DNA, 25 bp, Rattus norvegicus
cgtgggcgacccatactgtgtagcc

SEQ ID NO: 643329 - DNA, 25 bp, Rattus norvegicus
tgtgtagcccctttaggaacaacgc

SEQ ID NO: 643330 - DNA, 25 bp, Rattus norvegicus
ccgagtttcacagacgcccacgtag

SEQ ID NO: 643331 - DNA, 25 bp, Rattus norvegicus
agcaggggcaacagccgcatcgccc

SEQ ID NO: 643332 - DNA, 25 bp, Rattus norvegicus
gagcacagtccgcagcaggggcaac

SEQ ID NO: 643333 - DNA, 25 bp, Rattus norvegicus
ggcccagagcacagtccgcagcagg

SEQ ID NO: 643334 - DNA, 25 bp, Rattus norvegicus
tccagtagatagagtggcggaggct

SEQ ID NO: 643335 - DNA, 25 bp, Rattus norvegicus
tagtggagttccagtagatagagtg

SEQ ID NO: 643336 - DNA, 25 bp, Rattus norvegicus
gctacctggggttagtggagttcca

SEQ ID NO: 643337 - DNA, 25 bp, Rattus norvegicus
ctccttcggccgtgctacctggggt

SEQ ID NO: 643338 - DNA, 25 bp, Rattus norvegicus
agcgggcacgcgcacagcctgggag

SEQ ID NO: 643339 - DNA, 25 bp, Rattus norvegicus
ctcagacagcgccttgcaaaaaggc

SEQ ID NO: 643340 - DNA, 25 bp, Rattus norvegicus
agggctcagacagcgccttgcaaaa

SEQ ID NO: 643341 - DNA, 25 bp, Rattus norvegicus
ctgggcagggctcagacagcgcctt

SEQ ID NO: 643342 - DNA, 25 bp, Rattus norvegicus
tcaaacaaaggagccccatcgcgcg

SEQ ID NO: 643343 - DNA, 25 bp, Rattus norvegicus
tccagtctggtctggcccggctggt

SEQ ID NO: 643344 - DNA, 25 bp, Rattus norvegicus
ccctggggtccagtctggtctggcc

SEQ ID NO: 643345 - DNA, 25 bp, Rattus norvegicus
gaaagccgctactcgctcgtctagc

SEQ ID NO: 643346 - DNA, 25 bp, Rattus norvegicus
cgcacgcggcgggttcttaagattg

SEQ ID NO: 643347 - DNA, 25 bp, Rattus norvegicus
tcgtgatctgtctatcaccaggacc

SEQ ID NO: 643348 - DNA, 25 bp, Rattus norvegicus
ccagaattgcaatcctccaggtaca

SEQ ID NO: 643349 - DNA, 25 bp, Rattus norvegicus
tcctccaggtacagggctcgagaaa

SEQ ID NO: 643350 - DNA, 25 bp, Rattus norvegicus
acagggctcgagaaagccgctactc

SEQ ID NO: 643351 - DNA, 25 bp, Rattus norvegicus
tctagcccggcacttccggagagtc

SEQ ID NO: 643352 - DNA, 25 bp, Rattus norvegicus
acttccggagagtcgggcacttccg

SEQ ID NO: 643353 - DNA, 25 bp, Rattus norvegicus
gatagcggaggactgacttcagcca

SEQ ID NO: 643354 - DNA, 25 bp, Rattus norvegicus
ttcagccatggcagtcaaatccctg

SEQ ID NO: 643355 - DNA, 25 bp, Rattus norvegicus
ctccaaccctgtcgtgatctgtcta

SEQ ID NO: 643356 - DNA, 25 bp, Rattus norvegicus
ctccagataacccttaaccacaggt

SEQ ID NO: 643357 - DNA, 25 bp, Rattus norvegicus
ccaccggcgccgtagtgtcgctgga

SEQ ID NO: 643358 - DNA, 25 bp, Rattus norvegicus
caaatccctggaaaatctccagata

SEQ ID NO: 643359 - DNA, 25 bp, Rattus norvegicus
ggccacggtacacagctctcagctg

SEQ ID NO: 643360 - DNA, 25 bp, Rattus norvegicus
gcgctcgggttcaggaaacactgta

SEQ ID NO: 643361 - DNA, 25 bp, Rattus norvegicus
ccagtttttattagtgaaggcaagc

SEQ ID NO: 643362 - DNA, 25 bp, Rattus norvegicus
tctttctctaggactccagttttta

SEQ ID NO: 643363 - DNA, 25 bp, Rattus norvegicus
agagtcgggagggagtctttctcta

SEQ ID NO: 643364 - DNA, 25 bp, Rattus norvegicus
cagtctggtatcagtggcgccttcg

SEQ ID NO: 643365 - DNA, 25 bp, Rattus norvegicus
cgtgaaacccggcaggtcgataaat

SEQ ID NO: 643366 - DNA, 25 bp, Rattus norvegicus
ggtcgataaatccaggggtcttgta

SEQ ID NO: 643367 - DNA, 25 bp, Rattus norvegicus
ggtcttgtaaaaatggcgttgcctc

SEQ ID NO: 643368 - DNA, 25 bp, Rattus norvegicus
agcgccagagaggaagaagcccact

SEQ ID NO: 643369 - DNA, 25 bp, Rattus norvegicus
gcggttgttttcaggccacggtaca

SEQ ID NO: 643370 - DNA, 25 bp, Rattus norvegicus
ccgggctgggaagctagaccagctt

SEQ ID NO: 643371 - DNA, 25 bp, Rattus norvegicus
gaccagcttcttctgacgcgcgctg

SEQ ID NO: 643372 - DNA, 25 bp, Rattus norvegicus
ctgctgcgcgggttatcagaaccgc

SEQ ID NO: 643373 - DNA, 25 bp, Rattus norvegicus
gcactgccgttgcatgtcgtcccag

SEQ ID NO: 643374 - DNA, 25 bp, Rattus norvegicus
ttgaaccctacaaggctcgctcgcg

SEQ ID NO: 643375 - DNA, 25 bp, Rattus norvegicus
tctccatcctgcgtccggtctgtgg

SEQ ID NO: 643376 - DNA, 25 bp, Rattus norvegicus
gtgcgggcccattcttccggatcac

SEQ ID NO: 643377 - DNA, 25 bp, Rattus norvegicus
tgagaagcaccagccacaggagcgt

SEQ ID NO: 643378 - DNA, 25 bp, Rattus norvegicus
caggagcgtgcatcacactttatta

SEQ ID NO: 643379 - DNA, 25 bp, Rattus norvegicus
tcgccgtatacagtgtcgtcgttgc

SEQ ID NO: 643380 - DNA, 25 bp, Rattus norvegicus
gggcgtctctagtgcctggcacacc

SEQ ID NO: 643381 - DNA, 25 bp, Rattus norvegicus
tgtcgtcccagcacgaccggcaata

SEQ ID NO: 643382 - DNA, 25 bp, Rattus norvegicus
accggcaatacagggccttgcagtc

SEQ ID NO: 643383 - DNA, 25 bp, Rattus norvegicus
ttgcagtccggcgtgggacacacgt

SEQ ID NO: 643384 - DNA, 25 bp, Rattus norvegicus
acacacgtaggactcgggcgtctct

SEQ ID NO: 643385 - DNA, 25 bp, Rattus norvegicus
tccggcaactacagggatcgacttg

SEQ ID NO: 643386 - DNA, 25 bp, Rattus norvegicus
gcagcatcccttcattcgccgtata

SEQ ID NO: 643387 - DNA, 25 bp, Rattus norvegicus
ccgaatagtccagccggtgactttc

SEQ ID NO: 643388 - DNA, 25 bp, Rattus norvegicus
cggtgcgcactaggtttcgaccaca

SEQ ID NO: 643389 - DNA, 25 bp, Rattus norvegicus
tttgaatggccaacctcagcccgcg

SEQ ID NO: 643390 - DNA, 25 bp, Rattus norvegicus
aaagctgggaatggaaagagcgccc

SEQ ID NO: 643391 - DNA, 25 bp, Rattus norvegicus
aggacacgtcgctctcttacttggg

SEQ ID NO: 643392 - DNA, 25 bp, Rattus norvegicus
ccactctgcttagggcaggtgcgcc

SEQ ID NO: 643393 - DNA, 25 bp, Rattus norvegicus
tctctccaaacactagcagggccgg

SEQ ID NO: 643394 - DNA, 25 bp, Rattus norvegicus
gtctcagccgccctttgatacatgg

SEQ ID NO: 643395 - DNA, 25 bp, Rattus norvegicus
accgctggtaggtcgagttcttatc

SEQ ID NO: 643396 - DNA, 25 bp, Rattus norvegicus
gtcgagttcttatcacccagccgcg

SEQ ID NO: 643397 - DNA, 25 bp, Rattus norvegicus
gccgcgcacaggagttgtaagagca

SEQ ID NO: 643398 - DNA, 25 bp, Rattus norvegicus
gggtcgttctgctgagccgtactac

SEQ ID NO: 643399 - DNA, 25 bp, Rattus norvegicus
ctgagccgtactaccactggagaga

SEQ ID NO: 643400 - DNA, 25 bp, Rattus norvegicus
ctctggaagcgcaagaaaccgaata

SEQ ID NO: 643401 - DNA, 25 bp, Rattus norvegicus
gctcgctgctcgttgctggggggct

SEQ ID NO: 643402 - DNA, 25 bp, Rattus norvegicus
tcagtggctcgctgctcgttgctgg

SEQ ID NO: 643403 - DNA, 25 bp, Rattus norvegicus
tcgctgctcgttgctggggggctcc

SEQ ID NO: 643404 - DNA, 25 bp, Rattus norvegicus
tgctgcccgcccccccttggccgcg

SEQ ID NO: 643405 - DNA, 25 bp, Rattus norvegicus
tccgccaccctttgcctcctcctgc

SEQ ID NO: 643406 - DNA, 25 bp, Rattus norvegicus
ctccgccaccctttgcctcctcctg

SEQ ID NO: 643407 - DNA, 25 bp, Rattus norvegicus
cctccgccaccctttgcctcctcct

SEQ ID NO: 643408 - DNA, 25 bp, Rattus norvegicus
tcgttgctggggggctcctcctccg

SEQ ID NO: 643409 - DNA, 25 bp, Rattus norvegicus
ctcgctgctcgttgctggggggctc

SEQ ID NO: 643410 - DNA, 25 bp, Rattus norvegicus
tggctcgctgctcgttgctgggggg

SEQ ID NO: 643411 - DNA, 25 bp, Rattus norvegicus
cagtggctcgctgctcgttgctggg

SEQ ID NO: 643412 - DNA, 25 bp, Rattus norvegicus
gtcagtggctcgctgctcgttgctg

SEQ ID NO: 643413 - DNA, 25 bp, Rattus norvegicus
cggtcagtggctcgctgctcgttgc

SEQ ID NO: 643414 - DNA, 25 bp, Rattus norvegicus
agtggctcgctgctcgttgctgggg

SEQ ID NO: 643415 - DNA, 25 bp, Rattus norvegicus
tcctggtcagaaggccgcggtcagt

SEQ ID NO: 643416 - DNA, 25 bp, Rattus norvegicus
ctccggtcctggtcagaaggccgcg

SEQ ID NO: 643417 - DNA, 25 bp, Rattus norvegicus
ctgctccggtcctggtcagaaggcc

SEQ ID NO: 643418 - DNA, 25 bp, Rattus norvegicus
cagaaggccgcggtcagtggctcgc

SEQ ID NO: 643419 - DNA, 25 bp, Rattus norvegicus
ccctgctccggtcctggtcagaagg

SEQ ID NO: 643420 - DNA, 25 bp, Rattus norvegicus
ggccctgctccggtcctggtcagaa

SEQ ID NO: 643421 - DNA, 25 bp, Rattus norvegicus
cttggggccctgctccggtcctggt

SEQ ID NO: 643422 - DNA, 25 bp, Rattus norvegicus
tgagtgtaggaagaaccgcgttccc

SEQ ID NO: 643423 - DNA, 25 bp, Rattus norvegicus
aggcactgagtgtaggaagaaccgc

SEQ ID NO: 643424 - DNA, 25 bp, Rattus norvegicus
ctgagtgtaggaagaaccgcgttcc

SEQ ID NO: 643425 - DNA, 25 bp, Rattus norvegicus
cagaggcactgagtgtaggaagaac

SEQ ID NO: 643426 - DNA, 25 bp, Rattus norvegicus
tccgctcgctggtgttgcagaggca

SEQ ID NO: 643427 - DNA, 25 bp, Rattus norvegicus
actgagtgtaggaagaaccgcgttc

SEQ ID NO: 643428 - DNA, 25 bp, Rattus norvegicus
cactgagtgtaggaagaaccgcgtt

SEQ ID NO: 643429 - DNA, 25 bp, Rattus norvegicus
cctgcgggtagcactatttataact

SEQ ID NO: 643430 - DNA, 25 bp, Rattus norvegicus
ctaatcgccgctgggatctctgcgc

SEQ ID NO: 643431 - DNA, 25 bp, Rattus norvegicus
gcccgctatgcgcagggctaatcgc

SEQ ID NO: 643432 - DNA, 25 bp, Rattus norvegicus
tggagcccgctatgcgcagggctaa

SEQ ID NO: 643433 - DNA, 25 bp, Rattus norvegicus
acacctgcgggtagcactatttata

SEQ ID NO: 643434 - DNA, 25 bp, Rattus norvegicus
tattctgggcctctcgactggagcc

SEQ ID NO: 643435 - DNA, 25 bp, Rattus norvegicus
taactgcgcgcctattctgggcctc

SEQ ID NO: 643436 - DNA, 25 bp, Rattus norvegicus
ctatgcgcagggctaatcgccgctg

SEQ ID NO: 643437 - DNA, 25 bp, Rattus norvegicus
actatttataactgcgcgcctattc

SEQ ID NO: 643438 - DNA, 25 bp, Rattus norvegicus
ccacacctgcgggtagcactattta

SEQ ID NO: 643439 - DNA, 25 bp, Rattus norvegicus
gcccaacccacctgaagaggcggtg

SEQ ID NO: 643440 - DNA, 25 bp, Rattus norvegicus
cccaggaaaccgctgggggcgctca

SEQ ID NO: 643441 - DNA, 25 bp, Rattus norvegicus
ggctgcctccgcttccctcgaaaaa

SEQ ID NO: 643442 - DNA, 25 bp, Rattus norvegicus
cctttcccgcggctgcctccgcttc

SEQ ID NO: 643443 - DNA, 25 bp, Rattus norvegicus
ggcgggacagctccattttgaagtc

SEQ ID NO: 643444 - DNA, 25 bp, Rattus norvegicus
gcgccagcactaaccggtactcgaa

SEQ ID NO: 643445 - DNA, 25 bp, Rattus norvegicus
agacatgactgctctgcccgaaggc

SEQ ID NO: 643446 - DNA, 25 bp, Rattus norvegicus
cgtcgtcgtatttgtccgaatagta

SEQ ID NO: 643447 - DNA, 25 bp, Rattus norvegicus
ggtactcgaattcctcgtcgtcgta

SEQ ID NO: 643448 - DNA, 25 bp, Rattus norvegicus
aagtcctcgattggcttgcactggc

SEQ ID NO: 643449 - DNA, 25 bp, Rattus norvegicus
cactggcgtctcttcaagtcgtaaa

SEQ ID NO: 643450 - DNA, 25 bp, Rattus norvegicus
gagctgggtcaaactaggattctta

SEQ ID NO: 643451 - DNA, 25 bp, Rattus norvegicus
gctcgcgcagtcattggccagcttt

SEQ ID NO: 643452 - DNA, 25 bp, Rattus norvegicus
ggcggtgacttaagcagacagttgc

SEQ ID NO: 643453 - DNA, 25 bp, Rattus norvegicus
caaggcgcacgacctggatgtagtc

SEQ ID NO: 643454 - DNA, 25 bp, Rattus norvegicus
tcctcgtgtgctctctttggtcaag

SEQ ID NO: 643455 - DNA, 25 bp, Rattus norvegicus
cacgcgccggttctacactgttttt

SEQ ID NO: 643456 - DNA, 25 bp, Rattus norvegicus
cggcctaggtatctaactcctcgtg

SEQ ID NO: 643457 - DNA, 25 bp, Rattus norvegicus
tggtggtggtaacccattggagttc

SEQ ID NO: 643458 - DNA, 25 bp, Rattus norvegicus
ctagggtggcgataagcggcacttc

SEQ ID NO: 643459 - DNA, 25 bp, Rattus norvegicus
gggtgcggcgtctggtcccttccca

SEQ ID NO: 643460 - DNA, 25 bp, Rattus norvegicus
ctttccctcctcacggtgcttggtg

SEQ ID NO: 643461 - DNA, 25 bp, Rattus norvegicus
acggtgcttggtggtggtaacccat

SEQ ID NO: 643462 - DNA, 25 bp, Rattus norvegicus
gtggtacgtctcacacaactacagc

SEQ ID NO: 643463 - DNA, 25 bp, Rattus norvegicus
tggtgcggcctgaggacgcctccat

SEQ ID NO: 643464 - DNA, 25 bp, Rattus norvegicus
caactacagccagctagggtggcga

SEQ ID NO: 643465 - DNA, 25 bp, Rattus norvegicus
caggcgcgcagttggtgctccagct

SEQ ID NO: 643466 - DNA, 25 bp, Rattus norvegicus
tggtgctccagctctgtgctttccc

SEQ ID NO: 643467 - DNA, 25 bp, Rattus norvegicus
ccctcggcgtgactagggcttgctg

SEQ ID NO: 643468 - DNA, 25 bp, Rattus norvegicus
cgtgactagggcttgctgctgctcg

SEQ ID NO: 643469 - DNA, 25 bp, Rattus norvegicus
ccctgactcccgtctgggcgatggt

SEQ ID NO: 643470 - DNA, 25 bp, Rattus norvegicus
ccctgttgagtggtacgtctcacac

SEQ ID NO: 643471 - DNA, 25 bp, Rattus norvegicus
cctctcggttcagggtgtcagccga

SEQ ID NO: 643472 - DNA, 25 bp, Rattus norvegicus
tcccttctgctcctactggggcgag

SEQ ID NO: 643473 - DNA, 25 bp, Rattus norvegicus
gccatgacgtcacacctgggcgggc

SEQ ID NO: 643474 - DNA, 25 bp, Rattus norvegicus
tagactgttctaagtgcgtgccgcg

SEQ ID NO: 643475 - DNA, 25 bp, Rattus norvegicus
gggagacttcttagataccaggctg

SEQ ID NO: 643476 - DNA, 25 bp, Rattus norvegicus
gataccaggctgcaaggctctttcc

SEQ ID NO: 643477 - DNA, 25 bp, Rattus norvegicus
ctgcaaggctctttcccttccggtt

SEQ ID NO: 643478 - DNA, 25 bp, Rattus norvegicus
tggtttcgacctgggctgtatagtg

SEQ ID NO: 643479 - DNA, 25 bp, Rattus norvegicus
tcctactggggcgagtccacttcgt

SEQ ID NO: 643480 - DNA, 25 bp, Rattus norvegicus
ccacttcgtgcctggctggagttca

SEQ ID NO: 643481 - DNA, 25 bp, Rattus norvegicus
gtccgaagtgtcagctgtaggcctg

SEQ ID NO: 643482 - DNA, 25 bp, Rattus norvegicus
cccgcgtctggtgttgctgtttagc

SEQ ID NO: 643483 - DNA, 25 bp, Rattus norvegicus
aggacttcgtgaccgagaggctgca

SEQ ID NO: 643484 - DNA, 25 bp, Rattus norvegicus
tttctctgcgcgctggtttcgacct

SEQ ID NO: 643485 - DNA, 25 bp, Rattus norvegicus
gtcacctgcctttccttagtctgta

SEQ ID NO: 643486 - DNA, 25 bp, Rattus norvegicus
tatggctcagttcttgggccctgcc

SEQ ID NO: 643487 - DNA, 25 bp, Rattus norvegicus
ctgcgccctaaccattgattcctga

SEQ ID NO: 643488 - DNA, 25 bp, Rattus norvegicus
agagggcaagcgtgcaatcagccga

SEQ ID NO: 643489 - DNA, 25 bp, Rattus norvegicus
cgttccgcgtcggtgaaactcggag

SEQ ID NO: 643490 - DNA, 25 bp, Rattus norvegicus
agtgatgtcaccaatctgcgcccta

SEQ ID NO: 643491 - DNA, 25 bp, Rattus norvegicus
tgcaatcagccgagggcagtcagcc

SEQ ID NO: 643492 - DNA, 25 bp, Rattus norvegicus
caggaggccttgttgcgtcacctgc

SEQ ID NO: 643493 - DNA, 25 bp, Rattus norvegicus
cagcaccctggagtagctggcacgg

SEQ ID NO: 643494 - DNA, 25 bp, Rattus norvegicus
ctccgcagcctgcagcgctggaaaa

SEQ ID NO: 643495 - DNA, 25 bp, Rattus norvegicus
ctcagccttgggctcacgagtgggt

SEQ ID NO: 643496 - DNA, 25 bp, Rattus norvegicus
accaaccgggtgagtcctgctcagc

SEQ ID NO: 643497 - DNA, 25 bp, Rattus norvegicus
attcctgactgaaggtggaggacta

SEQ ID NO: 643498 - DNA, 25 bp, Rattus norvegicus
tcggaggtgagcttttgaatgcgta

SEQ ID NO: 643499 - DNA, 25 bp, Rattus norvegicus
gcccgagtgacgctttccaaaatac

SEQ ID NO: 643500 - DNA, 25 bp, Rattus norvegicus
cgccctgctagcgaaggactggtga

SEQ ID NO: 643501 - DNA, 25 bp, Rattus norvegicus
gacgctttccaaaataccgtgaaca

SEQ ID NO: 643502 - DNA, 25 bp, Rattus norvegicus
taagctcgtcggtaaaatagattgc

SEQ ID NO: 643503 - DNA, 25 bp, Rattus norvegicus
taaaatagattgcatccaagctctc

SEQ ID NO: 643504 - DNA, 25 bp, Rattus norvegicus
tccaagctctcagataactcgtgta

SEQ ID NO: 643505 - DNA, 25 bp, Rattus norvegicus
agataactcgtgtagcgccctgcta

SEQ ID NO: 643506 - DNA, 25 bp, Rattus norvegicus
ggaacgctgtgggtctagactaccg

SEQ ID NO: 643507 - DNA, 25 bp, Rattus norvegicus
gggtctagactaccgcggcccagct

SEQ ID NO: 643508 - DNA, 25 bp, Rattus norvegicus
tgtgctcggctaccgggagcaaacc

SEQ ID NO: 643509 - DNA, 25 bp, Rattus norvegicus
tcaaggaaacgaaagtgaactctgg

SEQ ID NO: 643510 - DNA, 25 bp, Rattus norvegicus
ctctggggagccagccatcttacgc

SEQ ID NO: 643511 - DNA, 25 bp, Rattus norvegicus
gagtgcccgagtgacgctttccaaa

SEQ ID NO: 643512 - DNA, 25 bp, Rattus norvegicus
cgaaagtgaactctggggagccagc

SEQ ID NO: 643513 - DNA, 25 bp, Rattus norvegicus
acctcaggctagtgtcctccgtgca

SEQ ID NO: 643514 - DNA, 25 bp, Rattus norvegicus
gacggtcggcaccaggtatcccact

SEQ ID NO: 643515 - DNA, 25 bp, Rattus norvegicus
gacagacgacgactgcctgacggtc

SEQ ID NO: 643516 - DNA, 25 bp, Rattus norvegicus
ttcgcgctcagcaactgggcgctgc

SEQ ID NO: 643517 - DNA, 25 bp, Rattus norvegicus
aaatagggagagctggccaagccgc

SEQ ID NO: 643518 - DNA, 25 bp, Rattus norvegicus
ggaccaggcagcctcacggctagac

SEQ ID NO: 643519 - DNA, 25 bp, Rattus norvegicus
gctcatcgtgcacgtcctgcaggga

SEQ ID NO: 643520 - DNA, 25 bp, Rattus norvegicus
tgagctccgtgacgctcatcgtgca

SEQ ID NO: 643521 - DNA, 25 bp, Rattus norvegicus
gtccatcggccagagacctgagctc

SEQ ID NO: 643522 - DNA, 25 bp, Rattus norvegicus
acaatgttcggtgtacgaccggccg

SEQ ID NO: 643523 - DNA, 25 bp, Rattus norvegicus
ctccctttagaagcgacaatgttcg

SEQ ID NO: 643524 - DNA, 25 bp, Rattus norvegicus
agagtcgtgctttgtgctgccggta

SEQ ID NO: 643525 - DNA, 25 bp, Rattus norvegicus
agggagtgtgcctctcccgcctgct

SEQ ID NO: 643526 - DNA, 25 bp, Rattus norvegicus
gtagtcctggagtaagaacgctttc

SEQ ID NO: 643527 - DNA, 25 bp, Rattus norvegicus
gtcccggttgctcttccaaggaaca

SEQ ID NO: 643528 - DNA, 25 bp, Rattus norvegicus
tgaacgggcagttcctgcaacgagg

SEQ ID NO: 643529 - DNA, 25 bp, Rattus norvegicus
aaggaacacaactgggactgcgagg

SEQ ID NO: 643530 - DNA, 25 bp, Rattus norvegicus
ttccaaggaacacaactgggactgc

SEQ ID NO: 643531 - DNA, 25 bp, Rattus norvegicus
tgctcttccaaggaacacaactggg

SEQ ID NO: 643532 - DNA, 25 bp, Rattus norvegicus
cgcagcctctcggatactagggctg

SEQ ID NO: 643533 - DNA, 25 bp, Rattus norvegicus
gtctaaagtgctcactgaacgggca

SEQ ID NO: 643534 - DNA, 25 bp, Rattus norvegicus
gcttcttgccggtcccggttgctct

SEQ ID NO: 643535 - DNA, 25 bp, Rattus norvegicus
ctgaagccgcgcagccgcctgctcc

SEQ ID NO: 643536 - DNA, 25 bp, Rattus norvegicus
cgcggcctccaggtctaaagtgctc

SEQ ID NO: 643537 - DNA, 25 bp, Rattus norvegicus
gcctccaggtctaaagtgctcactg

SEQ ID NO: 643538 - DNA, 25 bp, Rattus norvegicus
cctctcggatactagggctgcgggt

SEQ ID NO: 643539 - DNA, 25 bp, Rattus norvegicus
cactgaacgggcagttcctgcaacg

SEQ ID NO: 643540 - DNA, 25 bp, Rattus norvegicus
gtgctcactgaacgggcagttcctg

SEQ ID NO: 643541 - DNA, 25 bp, Rattus norvegicus
gcgacagcgacagcctctgtgtggc

SEQ ID NO: 643542 - DNA, 25 bp, Rattus norvegicus
gtggggctagcatggtcactcttct

SEQ ID NO: 643543 - DNA, 25 bp, Rattus norvegicus
cccatttgccaggaagagcaggggc

SEQ ID NO: 643544 - DNA, 25 bp, Rattus norvegicus
ttatggtccagccacccggagcggg

SEQ ID NO: 643545 - DNA, 25 bp, Rattus norvegicus
cgctttatggtccagccacccggag

SEQ ID NO: 643546 - DNA, 25 bp, Rattus norvegicus
ccgcagcccgcgctttatggtccag

SEQ ID NO: 643547 - DNA, 25 bp, Rattus norvegicus
cctctgtgtggctctgccggggtag

SEQ ID NO: 643548 - DNA, 25 bp, Rattus norvegicus
tgtacaggcgacagcgacagcctct

SEQ ID NO: 643549 - DNA, 25 bp, Rattus norvegicus
cccgaaggctgtacaggcgacagcg

SEQ ID NO: 643550 - DNA, 25 bp, Rattus norvegicus
cacggctgcaggaccaggtgcagta

SEQ ID NO: 643551 - DNA, 25 bp, Rattus norvegicus
gctagcatggtcactcttctgctcc

SEQ ID NO: 643552 - DNA, 25 bp, Rattus norvegicus
tggtcactcttctgctccccgaagg

SEQ ID NO: 643553 - DNA, 25 bp, Rattus norvegicus
caggaccaggtgcagtaggaggaag

SEQ ID NO: 643554 - DNA, 25 bp, Rattus norvegicus
acaggcgacagcgacagcctctgtg

SEQ ID NO: 643555 - DNA, 25 bp, Rattus norvegicus
tacacgcacggaagcgcttcgagca

SEQ ID NO: 643556 - DNA, 25 bp, Rattus norvegicus
gctgaagctgctcgagtccatcttc

SEQ ID NO: 643557 - DNA, 25 bp, Rattus norvegicus
gtgctcgaaatcacaccatacaacc

SEQ ID NO: 643558 - DNA, 25 bp, Rattus norvegicus
gtcccttgtctggtgctcgaaatca

SEQ ID NO: 643559 - DNA, 25 bp, Rattus norvegicus
aggacctcgcttgcgccacgctggg

SEQ ID NO: 643560 - DNA, 25 bp, Rattus norvegicus
aacatcacggtgaggacctcgcttg

SEQ ID NO: 643561 - DNA, 25 bp, Rattus norvegicus
gcaaaggccctggtgcacagtcacg

SEQ ID NO: 643562 - DNA, 25 bp, Rattus norvegicus
accacgtgacaggagacgccggcca

SEQ ID NO: 643563 - DNA, 25 bp, Rattus norvegicus
cctgggaacacaggcgacgaccacg

SEQ ID NO: 643564 - DNA, 25 bp, Rattus norvegicus
caagcaggaagcaagagtcccgcgc

SEQ ID NO: 643565 - DNA, 25 bp, Rattus norvegicus
ccggccggacgcaagcaggaagcaa

SEQ ID NO: 643566 - DNA, 25 bp, Rattus norvegicus
tgcacagtcacgcacgacgcacgta

SEQ ID NO: 643567 - DNA, 25 bp, Rattus norvegicus
gatacaggacggacaccgctagcca

SEQ ID NO: 643568 - DNA, 25 bp, Rattus norvegicus
agcgcctgcctggacgagctgagct

SEQ ID NO: 643569 - DNA, 25 bp, Rattus norvegicus
ggcaagccgcgcaagaactcggaga

SEQ ID NO: 643570 - DNA, 25 bp, Rattus norvegicus
cccaagcggtagagcgcagaggaca

SEQ ID NO: 643571 - DNA, 25 bp, Rattus norvegicus
cgaagtggttcaaggagttcccgct

SEQ ID NO: 643572 - DNA, 25 bp, Rattus norvegicus
cgcttactctgaagaccgcgtcgga

SEQ ID NO: 643573 - DNA, 25 bp, Rattus norvegicus
gcgcgctgaagcgtctctgtacgga

SEQ ID NO: 643574 - DNA, 25 bp, Rattus norvegicus
agaggacacggcgatccggtcaccg

SEQ ID NO: 643575 - DNA, 25 bp, Rattus norvegicus
cggcagtcctgtgcgtccaccgttg

SEQ ID NO: 643576 - DNA, 25 bp, Rattus norvegicus
gcacccgtcccatctgcagtgagag

SEQ ID NO: 643577 - DNA, 25 bp, Rattus norvegicus
agtgcgactccaggctattctcccg

SEQ ID NO: 643578 - DNA, 25 bp, Rattus norvegicus
accattgtccttgagtgcgactcca

SEQ ID NO: 643579 - DNA, 25 bp, Rattus norvegicus
gggcgctcctgaccattgtccttga

SEQ ID NO: 643580 - DNA, 25 bp, Rattus norvegicus
ggtacctgcggatctccaaggcttc

SEQ ID NO: 643581 - DNA, 25 bp, Rattus norvegicus
aggtcggggccaccaagctcttcct

SEQ ID NO: 643582 - DNA, 25 bp, Rattus norvegicus
cgcccgtccagtttcgggctgagca

SEQ ID NO: 643583 - DNA, 25 bp, Rattus norvegicus
acgagccctgtcaggtgagcgtgca

SEQ ID NO: 643584 - DNA, 25 bp, Rattus norvegicus
cagaggtgaaggcacggccagcaga

SEQ ID NO: 643585 - DNA, 25 bp, Rattus norvegicus
gcagcgcctgacacccgccctagca

SEQ ID NO: 643586 - DNA, 25 bp, Rattus norvegicus
cagcagacggcaggctacctgagga

SEQ ID NO: 643587 - DNA, 25 bp, Rattus norvegicus
gctacctgaggaggatgaccggcct

SEQ ID NO: 643588 - DNA, 25 bp, Rattus norvegicus
cggcctgctgccgagtatgagcagc

SEQ ID NO: 643589 - DNA, 25 bp, Rattus norvegicus
ctgccgagtatgagcagccctggga

SEQ ID NO: 643590 - DNA, 25 bp, Rattus norvegicus
tatgagcagccctgggagtggaaga

SEQ ID NO: 643591 - DNA, 25 bp, Rattus norvegicus
aagagggagcagatcgcacgagccc

SEQ ID NO: 643592 - DNA, 25 bp, Rattus norvegicus
cgtacgagccttcggagggtgacct

SEQ ID NO: 643593 - DNA, 25 bp, Rattus norvegicus
atcgcacgagccctgtcaggtgagc

SEQ ID NO: 643594 - DNA, 25 bp, Rattus norvegicus
tacgagccttcggagggtgacctgc

SEQ ID NO: 643595 - DNA, 25 bp, Rattus norvegicus
agcagatcgcacgagccctgtcagg

SEQ ID NO: 643596 - DNA, 25 bp, Rattus norvegicus
acggccagcagacggcaggctacct

SEQ ID NO: 643597 - DNA, 25 bp, Rattus norvegicus
gctcagttctgtgtcggcgtgactt

SEQ ID NO: 643598 - DNA, 25 bp, Rattus norvegicus
cgaccgcgtcagcacaggtgggtca

SEQ ID NO: 643599 - DNA, 25 bp, Rattus norvegicus
tctgccgacggaaccagacagtgtc

SEQ ID NO: 643600 - DNA, 25 bp, Rattus norvegicus
gcagattggagtcgcgacagcagcc

SEQ ID NO: 643601 - DNA, 25 bp, Rattus norvegicus
taccgacggggttcactctgccgac

SEQ ID NO: 643602 - DNA, 25 bp, Rattus norvegicus
ggcgtgacttcccacttgcacgtga

SEQ ID NO: 643603 - DNA, 25 bp, Rattus norvegicus
acttgcacgtgacgcacagcagcgg

SEQ ID NO: 643604 - DNA, 25 bp, Rattus norvegicus
gcagtcctggcaacagcgaaacatt

SEQ ID NO: 643605 - DNA, 25 bp, Rattus norvegicus
cgaaacatttgaggaaccggtgctg

SEQ ID NO: 643606 - DNA, 25 bp, Rattus norvegicus
accggtgctgaagctcctcttggca

SEQ ID NO: 643607 - DNA, 25 bp, Rattus norvegicus
ggctcgcagttacgaaagcccagta

SEQ ID NO: 643608 - DNA, 25 bp, Rattus norvegicus
agcccagtaggatggcgcaatcacc

SEQ ID NO: 643609 - DNA, 25 bp, Rattus norvegicus
atggcgcaatcacccagggctccgt

SEQ ID NO: 643610 - DNA, 25 bp, Rattus norvegicus
cggccagcatggttccttctacgtg

SEQ ID NO: 643611 - DNA, 25 bp, Rattus norvegicus
tccgctcccgaacctcagattgagg

SEQ ID NO: 643612 - DNA, 25 bp, Rattus norvegicus
atctccttggggaccgtcatgatcc

SEQ ID NO: 643613 - DNA, 25 bp, Rattus norvegicus
cacttctccggcatctccttgggga

SEQ ID NO: 643614 - DNA, 25 bp, Rattus norvegicus
cttggggaccgtcatgatcccgttt

SEQ ID NO: 643615 - DNA, 25 bp, Rattus norvegicus
catgatcccgtttttaaaaggtgca

SEQ ID NO: 643616 - DNA, 25 bp, Rattus norvegicus
aaaggtgcattgactgtccttggcc

SEQ ID NO: 643617 - DNA, 25 bp, Rattus norvegicus
tgtccttggcctcagcgtcgcctat

SEQ ID NO: 643618 - DNA, 25 bp, Rattus norvegicus
acctcagattgaggcgagcttccga

SEQ ID NO: 643619 - DNA, 25 bp, Rattus norvegicus
tgaagcctgccagcgccgcgtaggc

SEQ ID NO: 643620 - DNA, 25 bp, Rattus norvegicus
ccagcgccgcgtaggcgaaagtcag

SEQ ID NO: 643621 - DNA, 25 bp, Rattus norvegicus
gtaggcgaaagtcagcgcacggccc

SEQ ID NO: 643622 - DNA, 25 bp, Rattus norvegicus
cccacagccaatgccggagagccga

SEQ ID NO: 643623 - DNA, 25 bp, Rattus norvegicus
cggacaacggatttcatcccacaca

SEQ ID NO: 643624 - DNA, 25 bp, Rattus norvegicus
gttgtcccggacaacggatttcatc

SEQ ID NO: 643625 - DNA, 25 bp, Rattus norvegicus
ctctgcttcctcttactggcgtagt

SEQ ID NO: 643626 - DNA, 25 bp, Rattus norvegicus
aaacactgctcctgagttccgcgcg

SEQ ID NO: 643627 - DNA, 25 bp, Rattus norvegicus
cgccacgaaacactgctcctgagtt

SEQ ID NO: 643628 - DNA, 25 bp, Rattus norvegicus
cacgtgacgcgaaagggccgcgcac

SEQ ID NO: 643629 - DNA, 25 bp, Rattus norvegicus
gtccctcagcacgtgacgcgaaagg

SEQ ID NO: 643630 - DNA, 25 bp, Rattus norvegicus
acgtgatataagattccctcctccc

SEQ ID NO: 643631 - DNA, 25 bp, Rattus norvegicus
ccctgtcacgtgatataagattccc

SEQ ID NO: 643632 - DNA, 25 bp, Rattus norvegicus
gctgcgctgccaactttacctcagt

SEQ ID NO: 643633 - DNA, 25 bp, Rattus norvegicus
gcctaccgcgggaagggaatacaga

SEQ ID NO: 643634 - DNA, 25 bp, Rattus norvegicus
tgtacagtggggaaacacaaacgtg

SEQ ID NO: 643635 - DNA, 25 bp, Rattus norvegicus
acaagactagaagggagggtgtaca

SEQ ID NO: 643636 - DNA, 25 bp, Rattus norvegicus
cttactggcgtagttccgtgtctcc

SEQ ID NO: 643637 - DNA, 25 bp, Rattus norvegicus
ggacgcccaggcttacaagactaga

SEQ ID NO: 643638 - DNA, 25 bp, Rattus norvegicus
ccagtaggccgcgaacccaactata

SEQ ID NO: 643639 - DNA, 25 bp, Rattus norvegicus
ggtaggaacctgatttccagaagca

SEQ ID NO: 643640 - DNA, 25 bp, Rattus norvegicus
tccagaagcagctgggtaggcacca

SEQ ID NO: 643641 - DNA, 25 bp, Rattus norvegicus
ggagcaccaccatcgaggcggtaaa

SEQ ID NO: 643642 - DNA, 25 bp, Rattus norvegicus
ttctgcagcagcaggctgatgatgc

SEQ ID NO: 643643 - DNA, 25 bp, Rattus norvegicus
tagcagggaagggatcagcactctg

SEQ ID NO: 643644 - DNA, 25 bp, Rattus norvegicus
tctgctgtgctcagctccatggagc

SEQ ID NO: 643645 - DNA, 25 bp, Rattus norvegicus
ctccatggagccctggaagccctga

SEQ ID NO: 643646 - DNA, 25 bp, Rattus norvegicus
actcgattacgatggcccggtaagc

SEQ ID NO: 643647 - DNA, 25 bp, Rattus norvegicus
cggctgcggaggaaactaagtgctt

SEQ ID NO: 643648 - DNA, 25 bp, Rattus norvegicus
cttgcgcgagcaggctagatagacc

SEQ ID NO: 643649 - DNA, 25 bp, Rattus norvegicus
tggaaaaaatcgagctccgcgcggc

SEQ ID NO: 643650 - DNA, 25 bp, Rattus norvegicus
ttcattcagtccctcggagccgggc

SEQ ID NO: 643651 - DNA, 25 bp, Rattus norvegicus
agttccggtatttcagggcggagca

SEQ ID NO: 643652 - DNA, 25 bp, Rattus norvegicus
tgaaaagcggctacaacgccgagcg

SEQ ID NO: 643653 - DNA, 25 bp, Rattus norvegicus
agtgcggacacaagaacgagttctc

SEQ ID NO: 643654 - DNA, 25 bp, Rattus norvegicus
aaggtctgtaaaggctcctcgtgtc

SEQ ID NO: 643655 - DNA, 25 bp, Rattus norvegicus
gcgcccgttgactgccatttttaga

SEQ ID NO: 643656 - DNA, 25 bp, Rattus norvegicus
gccgaatgcaatccggcgcccgttg

SEQ ID NO: 643657 - DNA, 25 bp, Rattus norvegicus
tcgccattttgggaaggtcctacag

SEQ ID NO: 643658 - DNA, 25 bp, Rattus norvegicus
cgcgcctgtgttgtttcgccatttt

SEQ ID NO: 643659 - DNA, 25 bp, Rattus norvegicus
cctgttccttatatccggtatggta

SEQ ID NO: 643660 - DNA, 25 bp, Rattus norvegicus
tagctgggccgccatcttatctcct

SEQ ID NO: 643661 - DNA, 25 bp, Rattus norvegicus
tgtggagacctggaccatggaactc

SEQ ID NO: 643662 - DNA, 25 bp, Rattus norvegicus
cgcaactagcgcgagtgaacagtgc

SEQ ID NO: 643663 - DNA, 25 bp, Rattus norvegicus
ttggaccctgtacgatccgcaacta

SEQ ID NO: 643664 - DNA, 25 bp, Rattus norvegicus
gacgcagagcgtaaatttggaccct

SEQ ID NO: 643665 - DNA, 25 bp, Rattus norvegicus
cggttgtggttactgtcctaagaga

SEQ ID NO: 643666 - DNA, 25 bp, Rattus norvegicus
catgttctcgtagggaggtcgtcac

SEQ ID NO: 643667 - DNA, 25 bp, Rattus norvegicus
caaggcacttatagggctggaaatg

SEQ ID NO: 643668 - DNA, 25 bp, Rattus norvegicus
aggacacccgaagccgtgagaagcg

SEQ ID NO: 643669 - DNA, 25 bp, Rattus norvegicus
tggccgcggaaggacacccgaagcc

SEQ ID NO: 643670 - DNA, 25 bp, Rattus norvegicus
gtctccacaggtgggcgcccgcact

SEQ ID NO: 643671 - DNA, 25 bp, Rattus norvegicus
agctgtctcccgaaggccgggccct

SEQ ID NO: 643672 - DNA, 25 bp, Rattus norvegicus
ggcgctgctgctattgccacccggt

SEQ ID NO: 643673 - DNA, 25 bp, Rattus norvegicus
catgccggcccggtggctgttgctc

SEQ ID NO: 643674 - DNA, 25 bp, Rattus norvegicus
agctccgtgtccaccgatcctccgc

SEQ ID NO: 643675 - DNA, 25 bp, Rattus norvegicus
cgggacacaaggcacttatagggct

SEQ ID NO: 643676 - DNA, 25 bp, Rattus norvegicus
gaagccgggacacaaggcacttata

SEQ ID NO: 643677 - DNA, 25 bp, Rattus norvegicus
cgaccggaagaagccgggacacaag

SEQ ID NO: 643678 - DNA, 25 bp, Rattus norvegicus
ccatccaggcagtgactccgccttc

SEQ ID NO: 643679 - DNA, 25 bp, Rattus norvegicus
tactacgcccataaaacaacgcagg

SEQ ID NO: 643680 - DNA, 25 bp, Rattus norvegicus
gcggtctccaacaccgatcggcggg

SEQ ID NO: 643681 - DNA, 25 bp, Rattus norvegicus
ccaaggctacattcgctcgcggttt

SEQ ID NO: 643682 - DNA, 25 bp, Rattus norvegicus
cgctcgcggtttcccactgagaaga

SEQ ID NO: 643683 - DNA, 25 bp, Rattus norvegicus
tgcatttccaggagaaccaaggcta

SEQ ID NO: 643684 - DNA, 25 bp, Rattus norvegicus
agcggactcgagagagcgccataga

SEQ ID NO: 643685 - DNA, 25 bp, Rattus norvegicus
aggaacccacctaggtccatggcgg

SEQ ID NO: 643686 - DNA, 25 bp, Rattus norvegicus
ttccaaggccgcgaacaaggcgcca

SEQ ID NO: 643687 - DNA, 25 bp, Rattus norvegicus
agagcgtctccgcttccgtgttgta

SEQ ID NO: 643688 - DNA, 25 bp, Rattus norvegicus
gtcccagagccgcatttccgaaaca

SEQ ID NO: 643689 - DNA, 25 bp, Rattus norvegicus
ttccgtgttgtactctgctatccgc

SEQ ID NO: 643690 - DNA, 25 bp, Rattus norvegicus
agggcgcacgcgtactcctttccaa

SEQ ID NO: 643691 - DNA, 25 bp, Rattus norvegicus
ctttccaacaagctcgcggcgtcga

SEQ ID NO: 643692 - DNA, 25 bp, Rattus norvegicus
tcggcgtaggctttccagccgtcta

SEQ ID NO: 643693 - DNA, 25 bp, Rattus norvegicus
agccgtctactcacaggtaccgttg

SEQ ID NO: 643694 - DNA, 25 bp, Rattus norvegicus
ttccgaaacacgtgcagtagccctg

SEQ ID NO: 643695 - DNA, 25 bp, Rattus norvegicus
ggacaggcctctccactagcgaaga

SEQ ID NO: 643696 - DNA, 25 bp, Rattus norvegicus
cagcgcccggactgctagagctgga

SEQ ID NO: 643697 - DNA, 25 bp, Rattus norvegicus
ctctccactagcgaagaggggtgga

SEQ ID NO: 643698 - DNA, 25 bp, Rattus norvegicus
gagcagggccgcctctcttcttttc

SEQ ID NO: 643699 - DNA, 25 bp, Rattus norvegicus
ttcctggctgggactctggcggttt

SEQ ID NO: 643700 - DNA, 25 bp, Rattus norvegicus
actctggcggtttctgcctgccaac

SEQ ID NO: 643701 - DNA, 25 bp, Rattus norvegicus
gtttctgcctgccaaccctccgatc

SEQ ID NO: 643702 - DNA, 25 bp, Rattus norvegicus
gactgctagagctggacaggcctct

SEQ ID NO: 643703 - DNA, 25 bp, Rattus norvegicus
ctccgatcccgcctaccagcgttgg

SEQ ID NO: 643704 - DNA, 25 bp, Rattus norvegicus
gcctaccagcgttggctcttcccga

SEQ ID NO: 643705 - DNA, 25 bp, Rattus norvegicus
cacctcttcaagttgctgctgatcg

SEQ ID NO: 643706 - DNA, 25 bp, Rattus norvegicus
cagtgtccgccatggccaaagccta

SEQ ID NO: 643707 - DNA, 25 bp, Rattus norvegicus
tggccaaagcctacgaccacctctt

SEQ ID NO: 643708 - DNA, 25 bp, Rattus norvegicus
gaccacctcttcaagttgctgctga

SEQ ID NO: 643709 - DNA, 25 bp, Rattus norvegicus
cgcccagctgaagagtcgcgtgatc

SEQ ID NO: 643710 - DNA, 25 bp, Rattus norvegicus
actcagtgagattcagttgccaccg

SEQ ID NO: 643711 - DNA, 25 bp, Rattus norvegicus
gttgccaccgagtccggaacgacta

SEQ ID NO: 643712 - DNA, 25 bp, Rattus norvegicus
ctcgcgcttctagccaagacatcta

SEQ ID NO: 643713 - DNA, 25 bp, Rattus norvegicus
acatggattattctcgccgtggtca

SEQ ID NO: 643714 - DNA, 25 bp, Rattus norvegicus
tcacgaggccgttccaatagagctc

SEQ ID NO: 643715 - DNA, 25 bp, Rattus norvegicus
atagagctctagttggcccagattg

SEQ ID NO: 643716 - DNA, 25 bp, Rattus norvegicus
gaactctggcatttggctgctctga

SEQ ID NO: 643717 - DNA, 25 bp, Rattus norvegicus
cggccacctctgttggttgctgtgc

SEQ ID NO: 643718 - DNA, 25 bp, Rattus norvegicus
ggttgctgtgcgctttcaccttaaa

SEQ ID NO: 643719 - DNA, 25 bp, Rattus norvegicus
ctgacgtcaaaagtgggtgtgccct

SEQ ID NO: 643720 - DNA, 25 bp, Rattus norvegicus
cctgttttcggcgagttcacccttg

SEQ ID NO: 643721 - DNA, 25 bp, Rattus norvegicus
tcgcgtgatcctgcgcaaactcagt

SEQ ID NO: 643722 - DNA, 25 bp, Rattus norvegicus
gccggctctgcaaacactacaagga

SEQ ID NO: 643723 - DNA, 25 bp, Rattus norvegicus
ccgcttgcaagcgtcaggtcctgtc

SEQ ID NO: 643724 - DNA, 25 bp, Rattus norvegicus
tgcagtccgtggtcccccgaagcgg

SEQ ID NO: 643725 - DNA, 25 bp, Rattus norvegicus
agagtgggcggtagtagtacttccg

SEQ ID NO: 643726 - DNA, 25 bp, Rattus norvegicus
tcaggccctccctcctgcagtccgt

SEQ ID NO: 643727 - DNA, 25 bp, Rattus norvegicus
gtcctgtcggcctggcagcgctgtc

SEQ ID NO: 643728 - DNA, 25 bp, Rattus norvegicus
tgcaagcgtcaggtcctgtcggcct

SEQ ID NO: 643729 - DNA, 25 bp, Rattus norvegicus
caccattccacgtgctgagagtggg

SEQ ID NO: 643730 - DNA, 25 bp, Rattus norvegicus
cccaccattccacgtgctgagagtg

SEQ ID NO: 643731 - DNA, 25 bp, Rattus norvegicus
acagcgagtccctggtggtgttggt

SEQ ID NO: 643732 - DNA, 25 bp, Rattus norvegicus
gggctcccttcggtccacagcgagt

SEQ ID NO: 643733 - DNA, 25 bp, Rattus norvegicus
gcggcccccatggagcttagctgct

SEQ ID NO: 643734 - DNA, 25 bp, Rattus norvegicus
tacttccgggtgacggaggtcagcc

SEQ ID NO: 643735 - DNA, 25 bp, Rattus norvegicus
tagtacttccgggtgacggaggtca

SEQ ID NO: 643736 - DNA, 25 bp, Rattus norvegicus
ccgaagcgggaagcctgcgcgtccc

SEQ ID NO: 643737 - DNA, 25 bp, Rattus norvegicus
gaggccggaaccgagccacagcgat

SEQ ID NO: 643738 - DNA, 25 bp, Rattus norvegicus
tcccggttttggcttcgtctcagct

SEQ ID NO: 643739 - DNA, 25 bp, Rattus norvegicus
tcctgttttcggattctaattgctc

SEQ ID NO: 643740 - DNA, 25 bp, Rattus norvegicus
ttctaattgctcctaacgcgcgtca

SEQ ID NO: 643741 - DNA, 25 bp, Rattus norvegicus
acgcgcgtcactctaggttaggctc

SEQ ID NO: 643742 - DNA, 25 bp, Rattus norvegicus
actgagcgcagtcattggcagtcgc

SEQ ID NO: 643743 - DNA, 25 bp, Rattus norvegicus
gccacagcgatggagtgagaccctc

SEQ ID NO: 643744 - DNA, 25 bp, Rattus norvegicus
ctcgctgggcatagagtcgaaggca

SEQ ID NO: 643745 - DNA, 25 bp, Rattus norvegicus
agcttctgaggcctcccaggcttgg

SEQ ID NO: 643746 - DNA, 25 bp, Rattus norvegicus
tggagctggggtctccgttttaaca

SEQ ID NO: 643747 - DNA, 25 bp, Rattus norvegicus
ggtctccgttttaacatttctctgc

SEQ ID NO: 643748 - DNA, 25 bp, Rattus norvegicus
gccgccctcagtgcggtcttagttc

SEQ ID NO: 643749 - DNA, 25 bp, Rattus norvegicus
atttctctgcttcctgcgacgctgg

SEQ ID NO: 643750 - DNA, 25 bp, Rattus norvegicus
ggttaggctcctcccactgagcgca

SEQ ID NO: 643751 - DNA, 25 bp, Rattus norvegicus
tccactcgggtaaggggtcatgctt

SEQ ID NO: 643752 - DNA, 25 bp, Rattus norvegicus
tttagtgaaaagatcgcgctgcaga

SEQ ID NO: 643753 - DNA, 25 bp, Rattus norvegicus
attgctgggaagtagagtccgcttc

SEQ ID NO: 643754 - DNA, 25 bp, Rattus norvegicus
tttcccagcttgctgcgcgccagga

SEQ ID NO: 643755 - DNA, 25 bp, Rattus norvegicus
ttcctgccttcgctgcgtggctgac

SEQ ID NO: 643756 - DNA, 25 bp, Rattus norvegicus
ctgacggcgtagaggaagtccgtaa

SEQ ID NO: 643757 - DNA, 25 bp, Rattus norvegicus
tcggcgtccaatccacgcaagttta

SEQ ID NO: 643758 - DNA, 25 bp, Rattus norvegicus
tccacgcaagtttagtgaaaagatc

SEQ ID NO: 643759 - DNA, 25 bp, Rattus norvegicus
gtgatgatggacatcggctccactc

SEQ ID NO: 643760 - DNA, 25 bp, Rattus norvegicus
gtcatgcttgggagcttgatcactg

SEQ ID NO: 643761 - DNA, 25 bp, Rattus norvegicus
agcttgatcactgaggagcggtcgc

SEQ ID NO: 643762 - DNA, 25 bp, Rattus norvegicus
cgtaggctcgggactgttatagaac

SEQ ID NO: 643763 - DNA, 25 bp, Rattus norvegicus
ttatagaactacctttcccagcttg

SEQ ID NO: 643764 - DNA, 25 bp, Rattus norvegicus
tcgcgctgcagaagcagcgtcaggc

SEQ ID NO: 643765 - DNA, 25 bp, Rattus norvegicus
gctgtgcatctggttccgcttcctc

SEQ ID NO: 643766 - DNA, 25 bp, Rattus norvegicus
ttcccgctagggtcacgcggctgct

SEQ ID NO: 643767 - DNA, 25 bp, Rattus norvegicus
gcgggcgatcaagccagaggcaccc

SEQ ID NO: 643768 - DNA, 25 bp, Rattus norvegicus
acaacctggagctcccgcgggcgat

SEQ ID NO: 643769 - DNA, 25 bp, Rattus norvegicus
cgcaacccggagctagctaactgtg

SEQ ID NO: 643770 - DNA, 25 bp, Rattus norvegicus
cccagctgttctgcgctgtgcatct

SEQ ID NO: 643771 - DNA, 25 bp, Rattus norvegicus
ccatgtccggggctggatagcagcc

SEQ ID NO: 643772 - DNA, 25 bp, Rattus norvegicus
gggaccgcccagatcttccactgtg

SEQ ID NO: 643773 - DNA, 25 bp, Rattus norvegicus
gagctagcggtgtagcagcagtccc

SEQ ID NO: 643774 - DNA, 25 bp, Rattus norvegicus
cctggtggtaggaatccgctcggtt

SEQ ID NO: 643775 - DNA, 25 bp, Rattus norvegicus
tgctttttccgcctggtggtaggaa

SEQ ID NO: 643776 - DNA, 25 bp, Rattus norvegicus
ccatctggggtcagtgtcttgcttt

SEQ ID NO: 643777 - DNA, 25 bp, Rattus norvegicus
gctcctaagtcgagtgcgccatgtc

SEQ ID NO: 643778 - DNA, 25 bp, Rattus norvegicus
tgtgctcgacatcctacaacctgga

SEQ ID NO: 643779 - DNA, 25 bp, Rattus norvegicus
cagttctatgaagcgttcccgaggg

SEQ ID NO: 643780 - DNA, 25 bp, Rattus norvegicus
tccgagccttcctcaccttccttta

SEQ ID NO: 643781 - DNA, 25 bp, Rattus norvegicus
tcccggccttccgagccttcctcac

SEQ ID NO: 643782 - DNA, 25 bp, Rattus norvegicus
attgctgtgctgtcccgctggcccg

SEQ ID NO: 643783 - DNA, 25 bp, Rattus norvegicus
agagccattgctgtgctgtcccgct

SEQ ID NO: 643784 - DNA, 25 bp, Rattus norvegicus
tcggagagccattgctgtgctgtcc

SEQ ID NO: 643785 - DNA, 25 bp, Rattus norvegicus
actgggcctcctgagtgccgtggaa

SEQ ID NO: 643786 - DNA, 25 bp, Rattus norvegicus
cgcagtcggagagccattgctgtgc

SEQ ID NO: 643787 - DNA, 25 bp, Rattus norvegicus
tctatgaagcgttcccgagggccag

SEQ ID NO: 643788 - DNA, 25 bp, Rattus norvegicus
ttgcagttctatgaagcgttcccga

SEQ ID NO: 643789 - DNA, 25 bp, Rattus norvegicus
gcgttgcagttctatgaagcgttcc

SEQ ID NO: 643790 - DNA, 25 bp, Rattus norvegicus
tttaccgctactccgtctcaggccc

SEQ ID NO: 643791 - DNA, 25 bp, Rattus norvegicus
gccaggctgtcagagaggcaggcac

SEQ ID NO: 643792 - DNA, 25 bp, Rattus norvegicus
caggcacgggcactgggcctcctga

SEQ ID NO: 643793 - DNA, 25 bp, Rattus norvegicus
ctggtgtcccttcgaatcttctttt

SEQ ID NO: 643794 - DNA, 25 bp, Rattus norvegicus
gcgcgccctggtctttcacttaggc

SEQ ID NO: 643795 - DNA, 25 bp, Rattus norvegicus
gccctggtctttcacttaggcctcg

SEQ ID NO: 643796 - DNA, 25 bp, Rattus norvegicus
ggctggtgtcccttcgaatcttctt

SEQ ID NO: 643797 - DNA, 25 bp, Rattus norvegicus
gaatcttctttttactctcgctccc

SEQ ID NO: 643798 - DNA, 25 bp, Rattus norvegicus
tactcaatacctcatgcccgccatg

SEQ ID NO: 643799 - DNA, 25 bp, Rattus norvegicus
tcttcggagcgtcctcctctctgtg

SEQ ID NO: 643800 - DNA, 25 bp, Rattus norvegicus
agcgtcctcctctctgtgtttttaa

SEQ ID NO: 643801 - DNA, 25 bp, Rattus norvegicus
cgtcctcctctctgtgtttttaact

SEQ ID NO: 643802 - DNA, 25 bp, Rattus norvegicus
cccagtagtgccctcggggtgcggg

SEQ ID NO: 643803 - DNA, 25 bp, Rattus norvegicus
cctgcactgagtctgtgtttgacgg

SEQ ID NO: 643804 - DNA, 25 bp, Rattus norvegicus
ctgagtctgtgtttgacggcggata

SEQ ID NO: 643805 - DNA, 25 bp, Rattus norvegicus
cggagcgtcctcctctctgtgtttt

SEQ ID NO: 643806 - DNA, 25 bp, Rattus norvegicus
ggtctttcacttaggcctcgcgcga

SEQ ID NO: 643807 - DNA, 25 bp, Rattus norvegicus
agcagctcacatacactccaggtgg

SEQ ID NO: 643808 - DNA, 25 bp, Rattus norvegicus
tgcgcgcaagaaggcacgagcaatt

SEQ ID NO: 643809 - DNA, 25 bp, Rattus norvegicus
gcaattcggttgctctcgctctccg

SEQ ID NO: 643810 - DNA, 25 bp, Rattus norvegicus
ctgaagcaccgtgcgccgtagatga

SEQ ID NO: 643811 - DNA, 25 bp, Rattus norvegicus
cgctagacgccaggccaggctgcat

SEQ ID NO: 643812 - DNA, 25 bp, Rattus norvegicus
ctcgaagggcccttttgcagcggag

SEQ ID NO: 643813 - DNA, 25 bp, Rattus norvegicus
aactgtgaaggccaggtctgcccgc

SEQ ID NO: 643814 - DNA, 25 bp, Rattus norvegicus
caacaagagtaagggcagcagcagc

SEQ ID NO: 643815 - DNA, 25 bp, Rattus norvegicus
actccaggtggtccttcctgaaaca

SEQ ID NO: 643816 - DNA, 25 bp, Rattus norvegicus
gccagctttggccagtccgaaccaa

SEQ ID NO: 643817 - DNA, 25 bp, Rattus norvegicus
ttcctgaaacactgagcccgccttg

SEQ ID NO: 643818 - DNA, 25 bp, Rattus norvegicus
cctcggcgtaaagcactgggcacga

SEQ ID NO: 643819 - DNA, 25 bp, Rattus norvegicus
ctgaggccagaggtctaacttgagc

SEQ ID NO: 643820 - DNA, 25 bp, Rattus norvegicus
aagccataggaattccgggcccgca

SEQ ID NO: 643821 - DNA, 25 bp, Rattus norvegicus
gggcgtccgccaatagcggcttccg

SEQ ID NO: 643822 - DNA, 25 bp, Rattus norvegicus
caatagcggcttccgcggtggcgcc

SEQ ID NO: 643823 - DNA, 25 bp, Rattus norvegicus
gtggcgccaggtctctaaggagtaa

SEQ ID NO: 643824 - DNA, 25 bp, Rattus norvegicus
tctaaggagtaagccgacgacgaca

SEQ ID NO: 643825 - DNA, 25 bp, Rattus norvegicus
ccgacgacgacagactggccttttc

SEQ ID NO: 643826 - DNA, 25 bp, Rattus norvegicus
acagactggccttttcccgggctgc

SEQ ID NO: 643827 - DNA, 25 bp, Rattus norvegicus
tcccgggctgccaattgtagggaga

SEQ ID NO: 643828 - DNA, 25 bp, Rattus norvegicus
gctgccaattgtagggagaagaatt

SEQ ID NO: 643829 - DNA, 25 bp, Rattus norvegicus
attgagtctggtctgacgggcaaca

SEQ ID NO: 643830 - DNA, 25 bp, Rattus norvegicus
tgacgggcaacaagtgtgcccaatc

SEQ ID NO: 643831 - DNA, 25 bp, Rattus norvegicus
ccttcctatgcatctggaggcggga

SEQ ID NO: 643832 - DNA, 25 bp, Rattus norvegicus
tgtgcccaatcgcatccttcctatg

SEQ ID NO: 643833 - DNA, 25 bp, Rattus norvegicus
gcgctacgggaggaccagcttctcc

SEQ ID NO: 643834 - DNA, 25 bp, Rattus norvegicus
agtgctgggcgatccggaaaaagcc

SEQ ID NO: 643835 - DNA, 25 bp, Rattus norvegicus
ctttgaaaacgaaatgcagagctcg

SEQ ID NO: 643836 - DNA, 25 bp, Rattus norvegicus
cggcgaagggcatgtggtattccct

SEQ ID NO: 643837 - DNA, 25 bp, Rattus norvegicus
gtattccctgggaccattgctgcgg

SEQ ID NO: 643838 - DNA, 25 bp, Rattus norvegicus
gtgacgtcactagcacgcgaccgcg

SEQ ID NO: 643839 - DNA, 25 bp, Rattus norvegicus
ccaggaagaccgtcgagtgacgtca

SEQ ID NO: 643840 - DNA, 25 bp, Rattus norvegicus
ccacgaaaaccgagtcccagacaga

SEQ ID NO: 643841 - DNA, 25 bp, Rattus norvegicus
gctcgacgagtgaccatgacttcca

SEQ ID NO: 643842 - DNA, 25 bp, Rattus norvegicus
aatgcaccgtctggaagcggttccc

SEQ ID NO: 643843 - DNA, 25 bp, Rattus norvegicus
cccaggacatctcgaaagaaatgca

SEQ ID NO: 643844 - DNA, 25 bp, Rattus norvegicus
ggccgcgcattgaagtctcgcgcca

SEQ ID NO: 643845 - DNA, 25 bp, Rattus norvegicus
gcaaaagctgaaaacgccggcgtag

SEQ ID NO: 643846 - DNA, 25 bp, Rattus norvegicus
gcgcactccgatgatacctccagag

SEQ ID NO: 643847 - DNA, 25 bp, Rattus norvegicus
ggaagcgtgctcctgataagcagcc

SEQ ID NO: 643848 - DNA, 25 bp, Rattus norvegicus
agcccggtgagagtgttgtttccct

SEQ ID NO: 643849 - DNA, 25 bp, Rattus norvegicus
aggtgttggtcagcggcagcaccac

SEQ ID NO: 643850 - DNA, 25 bp, Rattus norvegicus
agccgtcgatgcagcgccgtcacga

SEQ ID NO: 643851 - DNA, 25 bp, Rattus norvegicus
gccgtcacgaaatcgcccagcttga

SEQ ID NO: 643852 - DNA, 25 bp, Rattus norvegicus
ccagcttgacatggctgggtcctgt

SEQ ID NO: 643853 - DNA, 25 bp, Rattus norvegicus
gtggttagcgcatactcatccttga

SEQ ID NO: 643854 - DNA, 25 bp, Rattus norvegicus
acgcgcccaggaccacgggtacgag

SEQ ID NO: 643855 - DNA, 25 bp, Rattus norvegicus
cgctaaattgggagcgtccgagagc

SEQ ID NO: 643856 - DNA, 25 bp, Rattus norvegicus
ggcagcaccacagccacggtcaggt

SEQ ID NO: 643857 - DNA, 25 bp, Rattus norvegicus
cctcagcgagtgcagcgaccgggca

SEQ ID NO: 643858 - DNA, 25 bp, Rattus norvegicus
gtcgaacgtccagggcgcccgagtc

SEQ ID NO: 643859 - DNA, 25 bp, Rattus norvegicus
tctgcatagagcaccagcgcctggt

SEQ ID NO: 643860 - DNA, 25 bp, Rattus norvegicus
ccgtcgagcaggagcgctaaattgg

SEQ ID NO: 643861 - DNA, 25 bp, Rattus norvegicus
cttcagagcaggtgggagcaagcac

SEQ ID NO: 643862 - DNA, 25 bp, Rattus norvegicus
accgcggggctgtgctcccacttga

SEQ ID NO: 643863 - DNA, 25 bp, Rattus norvegicus
caggcgtttgttgggacacgccgac

SEQ ID NO: 643864 - DNA, 25 bp, Rattus norvegicus
aagaagggcctgtatctgggcggcc

SEQ ID NO: 643865 - DNA, 25 bp, Rattus norvegicus
aagttcctgccgtagcctcgaggga

SEQ ID NO: 643866 - DNA, 25 bp, Rattus norvegicus
gcttgaaagttcctgccgtagcctc

SEQ ID NO: 643867 - DNA, 25 bp, Rattus norvegicus
agtagacagggtgcttgaaagttcc

SEQ ID NO: 643868 - DNA, 25 bp, Rattus norvegicus
aagcgagccatgaggtaagtagaca

SEQ ID NO: 643869 - DNA, 25 bp, Rattus norvegicus
tcaggattaagcgagccatgaggta

SEQ ID NO: 643870 - DNA, 25 bp, Rattus norvegicus
ccattgttcaggattaagcgagcca

SEQ ID NO: 643871 - DNA, 25 bp, Rattus norvegicus
gagtggtctccattgttcaggatta

SEQ ID NO: 643872 - DNA, 25 bp, Rattus norvegicus
agcggttgagtggtctccattgttc

SEQ ID NO: 643873 - DNA, 25 bp, Rattus norvegicus
cttccaagcgaagagcggttgagtg

SEQ ID NO: 643874 - DNA, 25 bp, Rattus norvegicus
cccgacgtttctctgttaccttgat

SEQ ID NO: 643875 - DNA, 25 bp, Rattus norvegicus
gagcctatcgcgcaggcgtttgttg

SEQ ID NO: 643876 - DNA, 25 bp, Rattus norvegicus
ctgttaccttgattcttccaagcga

SEQ ID NO: 643877 - DNA, 25 bp, Rattus norvegicus
cctgacgccctcagcctgccgcgag

SEQ ID NO: 643878 - DNA, 25 bp, Rattus norvegicus
tcgcgaactgccctgacgccctcag

SEQ ID NO: 643879 - DNA, 25 bp, Rattus norvegicus
accagccgcggccatcgcgaactgc

SEQ ID NO: 643880 - DNA, 25 bp, Rattus norvegicus
cccagacacggcagcggaaccagcc

SEQ ID NO: 643881 - DNA, 25 bp, Rattus norvegicus
cctcggcaaagaggtcgcggcctgt

SEQ ID NO: 643882 - DNA, 25 bp, Rattus norvegicus
caggtcgcaggaactccaggagccc

SEQ ID NO: 643883 - DNA, 25 bp, Rattus norvegicus
tgcacagcaggtcgcaggaactcca

SEQ ID NO: 643884 - DNA, 25 bp, Rattus norvegicus
tcgagttgctgcacagcaggtcgca

SEQ ID NO: 643885 - DNA, 25 bp, Rattus norvegicus
tgagagtcgagttgctgcacagcag

SEQ ID NO: 643886 - DNA, 25 bp, Rattus norvegicus
cacgtgagagtcgagttgctgcaca

SEQ ID NO: 643887 - DNA, 25 bp, Rattus norvegicus
gcacctgaccgcgtgcacgtgagag

SEQ ID NO: 643888 - DNA, 25 bp, Rattus norvegicus
gtctggcacctgaccgcgtgcacgt

SEQ ID NO: 643889 - DNA, 25 bp, Rattus norvegicus
agtaacccggtctggcacctgaccg

SEQ ID NO: 643890 - DNA, 25 bp, Rattus norvegicus
gccgggaactataggccgccgctgt

SEQ ID NO: 643891 - DNA, 25 bp, Rattus norvegicus
tgcccaggggcgtcaaacgacccac

SEQ ID NO: 643892 - DNA, 25 bp, Rattus norvegicus
agtccgctgtcgctgctcgccatcg

SEQ ID NO: 643893 - DNA, 25 bp, Rattus norvegicus
tcgcccggtgttctccgtctgactg

SEQ ID NO: 643894 - DNA, 25 bp, Rattus norvegicus
cggtgttctccgtctgactgcactt

SEQ ID NO: 643895 - DNA, 25 bp, Rattus norvegicus
gttctccgtctgactgcactttgcc

SEQ ID NO: 643896 - DNA, 25 bp, Rattus norvegicus
tgactgcactttgcccggcccgcgc

SEQ ID NO: 643897 - DNA, 25 bp, Rattus norvegicus
gcgcccaagcctttaaatagaaggc

SEQ ID NO: 643898 - DNA, 25 bp, Rattus norvegicus
atagaaggcgtcaagaaagtttcgc

SEQ ID NO: 643899 - DNA, 25 bp, Rattus norvegicus
agaaagtttcgccacggagctttag

SEQ ID NO: 643900 - DNA, 25 bp, Rattus norvegicus
gtttcgccacggagctttagccgcc

SEQ ID NO: 643901 - DNA, 25 bp, Rattus norvegicus
cctggttcctgtcgcctgccaactt

SEQ ID NO: 643902 - DNA, 25 bp, Rattus norvegicus
cgcccgttttggcagaccttcggcg

SEQ ID NO: 643903 - DNA, 25 bp, Rattus norvegicus
atcgcgcctgtcctggccggagtcg

SEQ ID NO: 643904 - DNA, 25 bp, Rattus norvegicus
tttggcagaccttcggcggcctttg

SEQ ID NO: 643905 - DNA, 25 bp, Rattus norvegicus
agttacgtgtagtgctccgcccttg

SEQ ID NO: 643906 - DNA, 25 bp, Rattus norvegicus
ccacagaaactcaccgaaggagatg

SEQ ID NO: 643907 - DNA, 25 bp, Rattus norvegicus
cccgcttggtgtccaaaacaaaatg

SEQ ID NO: 643908 - DNA, 25 bp, Rattus norvegicus
caccagtgcagcgtgaccggctaaa

SEQ ID NO: 643909 - DNA, 25 bp, Rattus norvegicus
cagcgtgaccggctaaaatggcgcc

SEQ ID NO: 643910 - DNA, 25 bp, Rattus norvegicus
aaatggcgccgacgggcttgcgtca

SEQ ID NO: 643911 - DNA, 25 bp, Rattus norvegicus
gcttgcgtcattgcgcgcgcaacta

SEQ ID NO: 643912 - DNA, 25 bp, Rattus norvegicus
tcattgcgcgcgcaactaggggcgt

SEQ ID NO: 643913 - DNA, 25 bp, Rattus norvegicus
aaaaatgggccctttggcttgcgca

SEQ ID NO: 643914 - DNA, 25 bp, Rattus norvegicus
cttgcgcaggagtcgcaggcgtatc

SEQ ID NO: 643915 - DNA, 25 bp, Rattus norvegicus
tcgcaggcgtatccctacggacttt

SEQ ID NO: 643916 - DNA, 25 bp, Rattus norvegicus
atccctacggactttggcaaagatc

SEQ ID NO: 643917 - DNA, 25 bp, Rattus norvegicus
aagatcccttaagttacgtgtagtg

SEQ ID NO: 643918 - DNA, 25 bp, Rattus norvegicus
gctggccgcggttccggcttagcct

SEQ ID NO: 643919 - DNA, 25 bp, Rattus norvegicus
tgcagcatccgccatcacaacaaga

SEQ ID NO: 643920 - DNA, 25 bp, Rattus norvegicus
agacatctcggcgtttgtcaagacg

SEQ ID NO: 643921 - DNA, 25 bp, Rattus norvegicus
cagcagccgccagtgcgctgacggc

SEQ ID NO: 643922 - DNA, 25 bp, Rattus norvegicus
cggcgtctcctgggaaagcagcagc

SEQ ID NO: 643923 - DNA, 25 bp, Rattus norvegicus
cagcagccggtggaactggagccac

SEQ ID NO: 643924 - DNA, 25 bp, Rattus norvegicus
agccggtggaactggagccacagca

SEQ ID NO: 643925 - DNA, 25 bp, Rattus norvegicus
ggtggaactggagccacagcagcca

SEQ ID NO: 643926 - DNA, 25 bp, Rattus norvegicus
gcagccagagtcaccaccacaaccg

SEQ ID NO: 643927 - DNA, 25 bp, Rattus norvegicus
catccgccatcacaacaagatgagg

SEQ ID NO: 643928 - DNA, 25 bp, Rattus norvegicus
cacaacaagatgaggaggacgtagg

SEQ ID NO: 643929 - DNA, 25 bp, Rattus norvegicus
gagctctgggaagaccctttggaaa

SEQ ID NO: 643930 - DNA, 25 bp, Rattus norvegicus
gcctttggcgccctgctgagacatc

SEQ ID NO: 643931 - DNA, 25 bp, Rattus norvegicus
cgccatcacaacaagatgaggagga

SEQ ID NO: 643932 - DNA, 25 bp, Rattus norvegicus
ctgctgagacatctcggcgtttgtc

SEQ ID NO: 643933 - DNA, 25 bp, Rattus norvegicus
agcagtccgcccaacgacatgctga

SEQ ID NO: 643934 - DNA, 25 bp, Rattus norvegicus
gggcagctcgccatgaacaggaaag

SEQ ID NO: 643935 - DNA, 25 bp, Rattus norvegicus
gatccagccgtggacagcagtccgc

SEQ ID NO: 643936 - DNA, 25 bp, Rattus norvegicus
cagtctccagacactgctggccgga

SEQ ID NO: 643937 - DNA, 25 bp, Rattus norvegicus
agaggcactgcagccaccaggcaca

SEQ ID NO: 643938 - DNA, 25 bp, Rattus norvegicus
aggccggctcccacagtgagagcga

SEQ ID NO: 643939 - DNA, 25 bp, Rattus norvegicus
acgagcaggcaacagaccgctctgc

SEQ ID NO: 643940 - DNA, 25 bp, Rattus norvegicus
tccactgggagagcccacgaagacc

SEQ ID NO: 643941 - DNA, 25 bp, Rattus norvegicus
ggacgctcaggacactccactggga

SEQ ID NO: 643942 - DNA, 25 bp, Rattus norvegicus
tccagaaggagcgagaccatcagcc

SEQ ID NO: 643943 - DNA, 25 bp, Rattus norvegicus
tctgagcacgcccagtccagaagga

SEQ ID NO: 643944 - DNA, 25 bp, Rattus norvegicus
aggctgccagggacagctctgagca

SEQ ID NO: 643945 - DNA, 25 bp, Rattus norvegicus
agctccgctcgcacccaggaggaga

SEQ ID NO: 643946 - DNA, 25 bp, Rattus norvegicus
agcaccaggcaaaggggctctcacc

SEQ ID NO: 643947 - DNA, 25 bp, Rattus norvegicus
aacaagaacgccgccgggagcgtga

SEQ ID NO: 643948 - DNA, 25 bp, Rattus norvegicus
agcagctgagggacagaccattccg

SEQ ID NO: 643949 - DNA, 25 bp, Rattus norvegicus
acagaagattccgccgggaacaaga

SEQ ID NO: 643950 - DNA, 25 bp, Rattus norvegicus
cgccgggaacaagaacgccgccagg

SEQ ID NO: 643951 - DNA, 25 bp, Rattus norvegicus
cagctgcgggacagaaagttccgtc

SEQ ID NO: 643952 - DNA, 25 bp, Rattus norvegicus
aaccccgtcaggagcgcgaggaaga

SEQ ID NO: 643953 - DNA, 25 bp, Rattus norvegicus
cagctgcgggacagaaagttccgcc

SEQ ID NO: 643954 - DNA, 25 bp, Rattus norvegicus
gcagctgcgggacagaaagttccgc

SEQ ID NO: 643955 - DNA, 25 bp, Rattus norvegicus
cattccgccgggaacaagaacgccg

SEQ ID NO: 643956 - DNA, 25 bp, Rattus norvegicus
cgggaacaagaacgccgccaggagc

SEQ ID NO: 643957 - DNA, 25 bp, Rattus norvegicus
gagcagctgagggacagaaagttcc

SEQ ID NO: 643958 - DNA, 25 bp, Rattus norvegicus
agctgagggacagaaagttccgccg

SEQ ID NO: 643959 - DNA, 25 bp, Rattus norvegicus
gcagctgagggacagaaagttccgc

SEQ ID NO: 643960 - DNA, 25 bp, Rattus norvegicus
gagcagctgcgggacagaaagttcc

SEQ ID NO: 643961 - DNA, 25 bp, Rattus norvegicus
tttaagggtggaagagcaacttcgc

SEQ ID NO: 643962 - DNA, 25 bp, Rattus norvegicus
agcaacttcgccaggagcgcgagga

SEQ ID NO: 643963 - DNA, 25 bp, Rattus norvegicus
ggaacaagaacaacgccaggagact

SEQ ID NO: 643964 - DNA, 25 bp, Rattus norvegicus
caacgccaggagactgaggaagagc

SEQ ID NO: 643965 - DNA, 25 bp, Rattus norvegicus
gagcagctgcgggatagacctttcc

SEQ ID NO: 643966 - DNA, 25 bp, Rattus norvegicus
tgcgggatagacctttccgccggga

SEQ ID NO: 643967 - DNA, 25 bp, Rattus norvegicus
agcagttgagggataggccattcca

SEQ ID NO: 643968 - DNA, 25 bp, Rattus norvegicus
ggccattccaccgagaacaagaacg

SEQ ID NO: 643969 - DNA, 25 bp, Rattus norvegicus
caggaggagcgcgacagaccatccc

SEQ ID NO: 643970 - DNA, 25 bp, Rattus norvegicus
ctcagacgcgacagaaaactccgtg

SEQ ID NO: 643971 - DNA, 25 bp, Rattus norvegicus
actccgtgaggaagaagagcgccgc

SEQ ID NO: 643972 - DNA, 25 bp, Rattus norvegicus
cgtgaagaacaagagcgccgccagc

SEQ ID NO: 643973 - DNA, 25 bp, Rattus norvegicus
caggagcgtgacagaaaatcccgtg

SEQ ID NO: 643974 - DNA, 25 bp, Rattus norvegicus
gtggccaagagcgagaccgtttaag

SEQ ID NO: 643975 - DNA, 25 bp, Rattus norvegicus
gcccaggtgagtcccgcacttaata

SEQ ID NO: 643976 - DNA, 25 bp, Rattus norvegicus
ctggaggaagccaactcttgtctgc

SEQ ID NO: 643977 - DNA, 25 bp, Rattus norvegicus
cccagacccgctaggctggaggaag

SEQ ID NO: 643978 - DNA, 25 bp, Rattus norvegicus
cttccagctcgcaaactgcttcgga

SEQ ID NO: 643979 - DNA, 25 bp, Rattus norvegicus
agcggggtttcgctagtgcctcgcc

SEQ ID NO: 643980 - DNA, 25 bp, Rattus norvegicus
cttcagcctccagcggggtttcgct

SEQ ID NO: 643981 - DNA, 25 bp, Rattus norvegicus
aggtgagtcccgcacttaatatctg

SEQ ID NO: 643982 - DNA, 25 bp, Rattus norvegicus
aagccaactcttgtctgcagctacc

SEQ ID NO: 643983 - DNA, 25 bp, Rattus norvegicus
ctgcagcgcctcagggcccaggtga

SEQ ID NO: 643984 - DNA, 25 bp, Rattus norvegicus
cagctcttccaaagactgcagcgcc

SEQ ID NO: 643985 - DNA, 25 bp, Rattus norvegicus
cccatcgctgtgtgcccagctcttc

SEQ ID NO: 643986 - DNA, 25 bp, Rattus norvegicus
aagacgcgcgatcttcggcgccagc

SEQ ID NO: 643987 - DNA, 25 bp, Rattus norvegicus
ccgcgtacaaagacgcgcgatcttc

SEQ ID NO: 643988 - DNA, 25 bp, Rattus norvegicus
gagtcccgcacttaatatctgccct

SEQ ID NO: 643989 - DNA, 25 bp, Rattus norvegicus
ggaagccgattcctgtcaccgactc

SEQ ID NO: 643990 - DNA, 25 bp, Rattus norvegicus
tgtctatccgcgaggcacctccaga

SEQ ID NO: 643991 - DNA, 25 bp, Rattus norvegicus
agtcaggccagcgtgaccttcctcg

SEQ ID NO: 643992 - DNA, 25 bp, Rattus norvegicus
gtcaccgactctggccggctgagga

SEQ ID NO: 643993 - DNA, 25 bp, Rattus norvegicus
ctgtccgccatgttggaagccgatt

SEQ ID NO: 643994 - DNA, 25 bp, Rattus norvegicus
ctttagcatgggagaggcccagtca

SEQ ID NO: 643995 - DNA, 25 bp, Rattus norvegicus
ctgagttgaggaagcgtcctccctc

SEQ ID NO: 643996 - DNA, 25 bp, Rattus norvegicus
caagcccacctgtggccttggggtt

SEQ ID NO: 643997 - DNA, 25 bp, Rattus norvegicus
acctgtggccttggggtttgctgtc

SEQ ID NO: 643998 - DNA, 25 bp, Rattus norvegicus
ctcgggtcttttctatccctaaatg

SEQ ID NO: 643999 - DNA, 25 bp, Rattus norvegicus
tttctatccctaaatgcccatcttg

SEQ ID NO: 644000 - DNA, 25 bp, Rattus norvegicus
aaatgcccatcttgggctccggacc

SEQ ID NO: 644001 - DNA, 25 bp, Rattus norvegicus
gaatgttctcttctcctcgcggggc

SEQ ID NO: 644002 - DNA, 25 bp, Rattus norvegicus
ctccttccctttagcatgggagagg

SEQ ID NO: 644003 - DNA, 25 bp, Rattus norvegicus
cacgggatcttcagccctgagattc

SEQ ID NO: 644004 - DNA, 25 bp, Rattus norvegicus
tgcgggagttcgagttatcggtaac

SEQ ID NO: 644005 - DNA, 25 bp, Rattus norvegicus
ctgagagccggacgcaaagtctccc

SEQ ID NO: 644006 - DNA, 25 bp, Rattus norvegicus
tacacccgcctccacagttaatagt

SEQ ID NO: 644007 - DNA, 25 bp, Rattus norvegicus
ttaatagtccggaatccgcgtgccg

SEQ ID NO: 644008 - DNA, 25 bp, Rattus norvegicus
tctttctggttgagaggacattgca

SEQ ID NO: 644009 - DNA, 25 bp, Rattus norvegicus
ggacattgcagcgtcctgccctcgg

SEQ ID NO: 644010 - DNA, 25 bp, Rattus norvegicus
ctgccctcggcttgaacgatgttga

SEQ ID NO: 644011 - DNA, 25 bp, Rattus norvegicus
atgttgagaagctgcgctatgcgcc

SEQ ID NO: 644012 - DNA, 25 bp, Rattus norvegicus
cctgaagcaacgagggtgagtccca

SEQ ID NO: 644013 - DNA, 25 bp, Rattus norvegicus
ccgaccgaagctaaactaatacctg

SEQ ID NO: 644014 - DNA, 25 bp, Rattus norvegicus
ctaatacctgctccgggttgttacg

SEQ ID NO: 644015 - DNA, 25 bp, Rattus norvegicus
cctgagattcgaatcaggaggagcc

SEQ ID NO: 644016 - DNA, 25 bp, Rattus norvegicus
ttatcggtaacggtggctgagagcc

SEQ ID NO: 644017 - DNA, 25 bp, Rattus norvegicus
tctaagggccaaggtgctagacagg

SEQ ID NO: 644018 - DNA, 25 bp, Rattus norvegicus
ggaccgcatcccgcagttcttcata

SEQ ID NO: 644019 - DNA, 25 bp, Rattus norvegicus
ggctgggccttcctgcctgagagcc

SEQ ID NO: 644020 - DNA, 25 bp, Rattus norvegicus
cccgaagaggccagctcggcggaca

SEQ ID NO: 644021 - DNA, 25 bp, Rattus norvegicus
tcggcggacacgagtccgtacgcgc

SEQ ID NO: 644022 - DNA, 25 bp, Rattus norvegicus
tatagagtgcggaccgcagaggccc

SEQ ID NO: 644023 - DNA, 25 bp, Rattus norvegicus
cagctgcggccgaccaaggacagcg

SEQ ID NO: 644024 - DNA, 25 bp, Rattus norvegicus
accaaggacagcgtgctgcgcctgg

SEQ ID NO: 644025 - DNA, 25 bp, Rattus norvegicus
ggcagctgcgcctgtccaccgagta

SEQ ID NO: 644026 - DNA, 25 bp, Rattus norvegicus
gagcagctgtaacccaatcttcaac

SEQ ID NO: 644027 - DNA, 25 bp, Rattus norvegicus
cccaatcttcaacgaagacttcttc

SEQ ID NO: 644028 - DNA, 25 bp, Rattus norvegicus
cttcttcttcgaagggctgcgcccg

SEQ ID NO: 644029 - DNA, 25 bp, Rattus norvegicus
atctagccgcccgtagtctaagggc

SEQ ID NO: 644030 - DNA, 25 bp, Rattus norvegicus
cttgcgctgcaaccctaacgtcctc

SEQ ID NO: 644031 - DNA, 25 bp, Rattus norvegicus
gccggcttggactgtcatccgggta

SEQ ID NO: 644032 - DNA, 25 bp, Rattus norvegicus
cagaatggtggggacactggcaatt

SEQ ID NO: 644033 - DNA, 25 bp, Rattus norvegicus
taattggactttagcgtgtctcagc

SEQ ID NO: 644034 - DNA, 25 bp, Rattus norvegicus
tagcgtgtctcagccacgtcgctca

SEQ ID NO: 644035 - DNA, 25 bp, Rattus norvegicus
acgtcgctcacagcagcccgtagaa

SEQ ID NO: 644036 - DNA, 25 bp, Rattus norvegicus
tcacagcagcccgtagaaggattgg

SEQ ID NO: 644037 - DNA, 25 bp, Rattus norvegicus
aggagcgcgattggtcagacttcaa

SEQ ID NO: 644038 - DNA, 25 bp, Rattus norvegicus
cagacttcaaagagagcgttgattg

SEQ ID NO: 644039 - DNA, 25 bp, Rattus norvegicus
gcgttgattggtgagaacgtgctac

SEQ ID NO: 644040 - DNA, 25 bp, Rattus norvegicus
caagcggctaaaaagcggtccgcta

SEQ ID NO: 644041 - DNA, 25 bp, Rattus norvegicus
aggcgaagcgcgcagcgtgcaactc

SEQ ID NO: 644042 - DNA, 25 bp, Rattus norvegicus
cgtgcaactctggaggagcggtaaa

SEQ ID NO: 644043 - DNA, 25 bp, Rattus norvegicus
acactggcaattggaaggcagaagc

SEQ ID NO: 644044 - DNA, 25 bp, Rattus norvegicus
tcatccgggtaattggactttagcg

SEQ ID NO: 644045 - DNA, 25 bp, Rattus norvegicus
cggggaattactccagccacgaatt

SEQ ID NO: 644046 - DNA, 25 bp, Rattus norvegicus
tgtcagtccacgcaaagctctgtgg

SEQ ID NO: 644047 - DNA, 25 bp, Rattus norvegicus
cggcgtcaccgcgtgtataagttgg

SEQ ID NO: 644048 - DNA, 25 bp, Rattus norvegicus
gctggatgttctctgcggacactca

SEQ ID NO: 644049 - DNA, 25 bp, Rattus norvegicus
tttccttaggatgcaggtgacccgc

SEQ ID NO: 644050 - DNA, 25 bp, Rattus norvegicus
tgctgttcgtgccagactgagaccc

SEQ ID NO: 644051 - DNA, 25 bp, Rattus norvegicus
cgtggagtcctacaccgtggagaca

SEQ ID NO: 644052 - DNA, 25 bp, Rattus norvegicus
cgggccgtgacttcagtctctctca

SEQ ID NO: 644053 - DNA, 25 bp, Rattus norvegicus
tgcttggctgcgtcaaagaggcatc

SEQ ID NO: 644054 - DNA, 25 bp, Rattus norvegicus
tggctccgcgatgtagttctctgtt

SEQ ID NO: 644055 - DNA, 25 bp, Rattus norvegicus
ttccagcgcagcctgtatcaccagt

SEQ ID NO: 644056 - DNA, 25 bp, Rattus norvegicus
gcgctgtcctatcgtcttgtgcaag

SEQ ID NO: 644057 - DNA, 25 bp, Rattus norvegicus
atagtatgttttccgttgtcagtcc

SEQ ID NO: 644058 - DNA, 25 bp, Rattus norvegicus
ctctcattatcaggtgagggccggc

SEQ ID NO: 644059 - DNA, 25 bp, Rattus norvegicus
ccggattcggacttgacaatgcgca

SEQ ID NO: 644060 - DNA, 25 bp, Rattus norvegicus
ccgaccgcaggagctagtgggccac

SEQ ID NO: 644061 - DNA, 25 bp, Rattus norvegicus
catcttgcgagtaagcgagcggtcc

SEQ ID NO: 644062 - DNA, 25 bp, Rattus norvegicus
gtccgccatcttgcgagtaagcgag

SEQ ID NO: 644063 - DNA, 25 bp, Rattus norvegicus
cttgacaatgcgcacgacccgcggg

SEQ ID NO: 644064 - DNA, 25 bp, Rattus norvegicus
gccgtagccggattcggacttgaca

SEQ ID NO: 644065 - DNA, 25 bp, Rattus norvegicus
cccgcacgttgaagccgtagccgga

SEQ ID NO: 644066 - DNA, 25 bp, Rattus norvegicus
ttgatgctccgcagttgcccgccct

SEQ ID NO: 644067 - DNA, 25 bp, Rattus norvegicus
gcgcgtacagctccccgttgatgct

SEQ ID NO: 644068 - DNA, 25 bp, Rattus norvegicus
tcacatgctgcagcggcgcgtacag

SEQ ID NO: 644069 - DNA, 25 bp, Rattus norvegicus
agcacggcgctcacatgctgcagcg

SEQ ID NO: 644070 - DNA, 25 bp, Rattus norvegicus
atactcacacctccaggatgcggtc

SEQ ID NO: 644071 - DNA, 25 bp, Rattus norvegicus
cgtggcggtcgcgatactcacacct

SEQ ID NO: 644072 - DNA, 25 bp, Rattus norvegicus
gttcccggcgcagtggagcccagac

SEQ ID NO: 644073 - DNA, 25 bp, Rattus norvegicus
cccgacttgttccagcttgggagtc

SEQ ID NO: 644074 - DNA, 25 bp, Rattus norvegicus
acgccagtttcagaaaagtttcacg

SEQ ID NO: 644075 - DNA, 25 bp, Rattus norvegicus
tcagaaaagtttcacgcgcgcggcc

SEQ ID NO: 644076 - DNA, 25 bp, Rattus norvegicus
cggaaagtcgcgagcccaaggccag

SEQ ID NO: 644077 - DNA, 25 bp, Rattus norvegicus
aatcgccgaaaaggcggcgtagaca

SEQ ID NO: 644078 - DNA, 25 bp, Rattus norvegicus
aggcggcgtagacaaccctgtcaga

SEQ ID NO: 644079 - DNA, 25 bp, Rattus norvegicus
ccctgtcagagatacccggaagttc

SEQ ID NO: 644080 - DNA, 25 bp, Rattus norvegicus
gatacccggaagttcagcgtgaccc

SEQ ID NO: 644081 - DNA, 25 bp, Rattus norvegicus
aagggaatgtgcagcgagagccaaa

SEQ ID NO: 644082 - DNA, 25 bp, Rattus norvegicus
cagcgagagccaaaggtcagacttc

SEQ ID NO: 644083 - DNA, 25 bp, Rattus norvegicus
gcgcaaaacacaacgccagtttcag

SEQ ID NO: 644084 - DNA, 25 bp, Rattus norvegicus
gacttccggcagcagactctggaga

SEQ ID NO: 644085 - DNA, 25 bp, Rattus norvegicus
cttgttccagcttgggagtctgcgg

SEQ ID NO: 644086 - DNA, 25 bp, Rattus norvegicus
caaaggtcagacttccggcagcaga

SEQ ID NO: 644087 - DNA, 25 bp, Rattus norvegicus
cccgagcggtatttgtcaatgagcg

SEQ ID NO: 644088 - DNA, 25 bp, Rattus norvegicus
actgagtccggtgtcaggctacctc

SEQ ID NO: 644089 - DNA, 25 bp, Rattus norvegicus
gaactctgaggtccaggagcaactg

SEQ ID NO: 644090 - DNA, 25 bp, Rattus norvegicus
aggactcgcctacccgcgctatgga

SEQ ID NO: 644091 - DNA, 25 bp, Rattus norvegicus
gagcgtcttccacgacccaatctag

SEQ ID NO: 644092 - DNA, 25 bp, Rattus norvegicus
ctgagccggcacaccgtctgaaaca

SEQ ID NO: 644093 - DNA, 25 bp, Rattus norvegicus
taacatgacgacctaccgcggtctg

SEQ ID NO: 644094 - DNA, 25 bp, Rattus norvegicus
tctgaaacagcgctgggatccggtc

SEQ ID NO: 644095 - DNA, 25 bp, Rattus norvegicus
atctagctgcccacgagactcctga

SEQ ID NO: 644096 - DNA, 25 bp, Rattus norvegicus
agactcctgagtaacgctccctatc

SEQ ID NO: 644097 - DNA, 25 bp, Rattus norvegicus
ccgggtgcacgtccaccaaggtaca

SEQ ID NO: 644098 - DNA, 25 bp, Rattus norvegicus
ggctgcagtgtcctcgccaaagaca

SEQ ID NO: 644099 - DNA, 25 bp, Rattus norvegicus
tccacagtccgccacagggcaaagg

SEQ ID NO: 644100 - DNA, 25 bp, Rattus norvegicus
ctcagcgtgaggaactggaaagcca

SEQ ID NO: 644101 - DNA, 25 bp, Rattus norvegicus
ggcacacgactgagaaagtcccacc

SEQ ID NO: 644102 - DNA, 25 bp, Rattus norvegicus
caggaatgttacctccagccgatgc

SEQ ID NO: 644103 - DNA, 25 bp, Rattus norvegicus
ttctaaacctatggctgagtactga

SEQ ID NO: 644104 - DNA, 25 bp, Rattus norvegicus
tcgcagtgcacgagggcacacgact

SEQ ID NO: 644105 - DNA, 25 bp, Rattus norvegicus
gactgagaaagtcccaccaccacta

SEQ ID NO: 644106 - DNA, 25 bp, Rattus norvegicus
ggggcattctaaacctatggctgag

SEQ ID NO: 644107 - DNA, 25 bp, Rattus norvegicus
tccagccgatgcactttgtcccgaa

SEQ ID NO: 644108 - DNA, 25 bp, Rattus norvegicus
agccgatgcactttgtcccgaagcc

SEQ ID NO: 644109 - DNA, 25 bp, Rattus norvegicus
tcccgaagccgtgcctccaccgctt

SEQ ID NO: 644110 - DNA, 25 bp, Rattus norvegicus
cttccaccagacctcgggcctcctt

SEQ ID NO: 644111 - DNA, 25 bp, Rattus norvegicus
ccagaccgaggatgcgccttcgaaa

SEQ ID NO: 644112 - DNA, 25 bp, Rattus norvegicus
cttcagctgctgctccagaccgagg

SEQ ID NO: 644113 - DNA, 25 bp, Rattus norvegicus
ttacctccagccgatgcactttgtc

SEQ ID NO: 644114 - DNA, 25 bp, Rattus norvegicus
acctatggctgagtactgaggggtc

SEQ ID NO: 644115 - DNA, 25 bp, Rattus norvegicus
tctattggtcagtttcccgcaaggg

SEQ ID NO: 644116 - DNA, 25 bp, Rattus norvegicus
agcagacaccgcgggaacccagaac

SEQ ID NO: 644117 - DNA, 25 bp, Rattus norvegicus
cgcgctctgtcctcccgagctgcac

SEQ ID NO: 644118 - DNA, 25 bp, Rattus norvegicus
gcggagcagacaccgcgggaaccca

SEQ ID NO: 644119 - DNA, 25 bp, Rattus norvegicus
tattggtcagtttcccgcaaggggc

SEQ ID NO: 644120 - DNA, 25 bp, Rattus norvegicus
attggtcagtttcccgcaaggggcg

SEQ ID NO: 644121 - DNA, 25 bp, Rattus norvegicus
ctggctcggggcagattcactcacc

SEQ ID NO: 644122 - DNA, 25 bp, Rattus norvegicus
ttgatcggtactcccgggctcgcac

SEQ ID NO: 644123 - DNA, 25 bp, Rattus norvegicus
ggtcttgatcggtactcccgggctc

SEQ ID NO: 644124 - DNA, 25 bp, Rattus norvegicus
tcacccgggtcttgatcggtactcc

SEQ ID NO: 644125 - DNA, 25 bp, Rattus norvegicus
tcactcacccgggtcttgatcggta

SEQ ID NO: 644126 - DNA, 25 bp, Rattus norvegicus
gcagattcactcacccgggtcttga

SEQ ID NO: 644127 - DNA, 25 bp, Rattus norvegicus
gggcagattcactcacccgggtctt

SEQ ID NO: 644128 - DNA, 25 bp, Rattus norvegicus
cgcccaccaacctgttactcctcag

SEQ ID NO: 644129 - DNA, 25 bp, Rattus norvegicus
ccctcggggagaggagctttcaacg

SEQ ID NO: 644130 - DNA, 25 bp, Rattus norvegicus
cgcgcaccacggacgtccacaggca

SEQ ID NO: 644131 - DNA, 25 bp, Rattus norvegicus
aggcgttccgaagccagacaatgag

SEQ ID NO: 644132 - DNA, 25 bp, Rattus norvegicus
ccgaggcgttccgaagccagacaat

SEQ ID NO: 644133 - DNA, 25 bp, Rattus norvegicus
tatcttttcgctgggccgaggcgtt

SEQ ID NO: 644134 - DNA, 25 bp, Rattus norvegicus
ttccgttatcttttcgctgggccga

SEQ ID NO: 644135 - DNA, 25 bp, Rattus norvegicus
ctcgggtcagactaccggcggcgac

SEQ ID NO: 644136 - DNA, 25 bp, Rattus norvegicus
acggcaccttcctcgggtcagacta

SEQ ID NO: 644137 - DNA, 25 bp, Rattus norvegicus
gcaaggtccctttaaggcgacggca

SEQ ID NO: 644138 - DNA, 25 bp, Rattus norvegicus
gaggagctttcaacggttccctctc

SEQ ID NO: 644139 - DNA, 25 bp, Rattus norvegicus
caatcactcgaacccgagggagcct

SEQ ID NO: 644140 - DNA, 25 bp, Rattus norvegicus
cgtacacggagccacattccttggc

SEQ ID NO: 644141 - DNA, 25 bp, Rattus norvegicus
agtgacgagaggtatccctccgcgg

SEQ ID NO: 644142 - DNA, 25 bp, Rattus norvegicus
gcggaagtgacgagaggtatccctc

SEQ ID NO: 644143 - DNA, 25 bp, Rattus norvegicus
tggccttcggcttgggagggctgaa

SEQ ID NO: 644144 - DNA, 25 bp, Rattus norvegicus
gtgaggaaagcgagcacctccgccg

SEQ ID NO: 644145 - DNA, 25 bp, Rattus norvegicus
gaagacagtgaggaaagcgagcacc

SEQ ID NO: 644146 - DNA, 25 bp, Rattus norvegicus
ccggtgaagcactgaggaagacagt

SEQ ID NO: 644147 - DNA, 25 bp, Rattus norvegicus
agccggtgaagcactgaggaagaca

SEQ ID NO: 644148 - DNA, 25 bp, Rattus norvegicus
cccagatgaagcgagccggtgaagc

SEQ ID NO: 644149 - DNA, 25 bp, Rattus norvegicus
tgaaggtttagaggacccaggtggc

SEQ ID NO: 644150 - DNA, 25 bp, Rattus norvegicus
cggccgctggatgccgcttctccgc

SEQ ID NO: 644151 - DNA, 25 bp, Rattus norvegicus
gcggtattcggttcgctcggctcgc

SEQ ID NO: 644152 - DNA, 25 bp, Rattus norvegicus
cgtctatcccgccagccgccagcag

SEQ ID NO: 644153 - DNA, 25 bp, Rattus norvegicus
gcatcaggccggcgggcgtctatcc

SEQ ID NO: 644154 - DNA, 25 bp, Rattus norvegicus
ccatcgcggacagtgggcagcgcca

SEQ ID NO: 644155 - DNA, 25 bp, Rattus norvegicus
gtcctcggaggccatcgcggacagt

SEQ ID NO: 644156 - DNA, 25 bp, Rattus norvegicus
gcatcccggggctaggcccgagacc

SEQ ID NO: 644157 - DNA, 25 bp, Rattus norvegicus
aacgcttccatcttagtcaccactg

SEQ ID NO: 644158 - DNA, 25 bp, Rattus norvegicus
ggagcccagcatgtctgcagcaatc

SEQ ID NO: 644159 - DNA, 25 bp, Rattus norvegicus
gtcccagtcaccatggggttcctga

SEQ ID NO: 644160 - DNA, 25 bp, Rattus norvegicus
tcctgaagtatgaaaagggtctctg

SEQ ID NO: 644161 - DNA, 25 bp, Rattus norvegicus
ctgcgcggttagagcgcgactcact

SEQ ID NO: 644162 - DNA, 25 bp, Rattus norvegicus
agtggccagtccgtgactcccaaaa

SEQ ID NO: 644163 - DNA, 25 bp, Rattus norvegicus
atattgcggaaacgagccagggagc

SEQ ID NO: 644164 - DNA, 25 bp, Rattus norvegicus
tgccgaaaaaatgaaagcgctcccg

SEQ ID NO: 644165 - DNA, 25 bp, Rattus norvegicus
agcggaagtcgtcgtttgccacgcc

SEQ ID NO: 644166 - DNA, 25 bp, Rattus norvegicus
tgtctgccacttccttgcgcgaaga

SEQ ID NO: 644167 - DNA, 25 bp, Rattus norvegicus
tggggagtcttgatccagagtaacc

SEQ ID NO: 644168 - DNA, 25 bp, Rattus norvegicus
taaccgctaagactgatggaagtgc

SEQ ID NO: 644169 - DNA, 25 bp, Rattus norvegicus
atggaagtgcaacgtcgcgtcctcg

SEQ ID NO: 644170 - DNA, 25 bp, Rattus norvegicus
gcgcagacatcggatccatgaggca

SEQ ID NO: 644171 - DNA, 25 bp, Rattus norvegicus
gcggctggcacaaccattcagaaaa

SEQ ID NO: 644172 - DNA, 25 bp, Rattus norvegicus
gtgcccgaatctgggaccctgttcc

SEQ ID NO: 644173 - DNA, 25 bp, Rattus norvegicus
atcgcggctggcacaaccattcaga

SEQ ID NO: 644174 - DNA, 25 bp, Rattus norvegicus
tgcgtgtatccaggcagatcgcggc

SEQ ID NO: 644175 - DNA, 25 bp, Rattus norvegicus
ctggcacaaccattcagaaaaagga

SEQ ID NO: 644176 - DNA, 25 bp, Rattus norvegicus
taaaagcaacgcacgagcccgccgg

SEQ ID NO: 644177 - DNA, 25 bp, Rattus norvegicus
atctgcggtagccacggggtagttt

SEQ ID NO: 644178 - DNA, 25 bp, Rattus norvegicus
ctctttctctcttacctatctaatg

SEQ ID NO: 644179 - DNA, 25 bp, Rattus norvegicus
ttacctatctaatgtccgtgctgga

SEQ ID NO: 644180 - DNA, 25 bp, Rattus norvegicus
ctaatgtccgtgctggaaggcgacg

SEQ ID NO: 644181 - DNA, 25 bp, Rattus norvegicus
gactcgggagccagcaggaccaact

SEQ ID NO: 644182 - DNA, 25 bp, Rattus norvegicus
gcacgtgcccgaatctgggaccctg

SEQ ID NO: 644183 - DNA, 25 bp, Rattus norvegicus
cccgcagggtttcctgcgcccagtc

SEQ ID NO: 644184 - DNA, 25 bp, Rattus norvegicus
atccaggcagatcgcggctggcaca

SEQ ID NO: 644185 - DNA, 25 bp, Rattus norvegicus
aggtggcccggtacctcctgcagca

SEQ ID NO: 644186 - DNA, 25 bp, Rattus norvegicus
catgctcacgttctcaaggcagggg

SEQ ID NO: 644187 - DNA, 25 bp, Rattus norvegicus
cggtcggcacatgctcacgttctca

SEQ ID NO: 644188 - DNA, 25 bp, Rattus norvegicus
tgcagcagcacctcatctcagcccg

SEQ ID NO: 644189 - DNA, 25 bp, Rattus norvegicus
tcggcacatgctcacgttctcaagg

SEQ ID NO: 644190 - DNA, 25 bp, Rattus norvegicus
ttccatcgttcaggtggcccggtac

SEQ ID NO: 644191 - DNA, 25 bp, Rattus norvegicus
tccttcagttccatcgttcaggtgg

SEQ ID NO: 644192 - DNA, 25 bp, Rattus norvegicus
agcggtccttcagttccatcgttca

SEQ ID NO: 644193 - DNA, 25 bp, Rattus norvegicus
gagcggatcttgaagcggtccttca

SEQ ID NO: 644194 - DNA, 25 bp, Rattus norvegicus
cctgcgccctgacttgtgactgggc

SEQ ID NO: 644195 - DNA, 25 bp, Rattus norvegicus
gtggaagcggcctgcgccctgactt

SEQ ID NO: 644196 - DNA, 25 bp, Rattus norvegicus
cctgctcgcgtcacatctgcagccg

SEQ ID NO: 644197 - DNA, 25 bp, Rattus norvegicus
gtgcgtgctcctgctcgcgtcacat

SEQ ID NO: 644198 - DNA, 25 bp, Rattus norvegicus
gcacctcatctcagcccggtcggca

SEQ ID NO: 644199 - DNA, 25 bp, Rattus norvegicus
cctgcaagtggggtccggtccaact

SEQ ID NO: 644200 - DNA, 25 bp, Rattus norvegicus
cccatgagtcgcctttgcctgtggg

SEQ ID NO: 644201 - DNA, 25 bp, Rattus norvegicus
gggtccttctgccaccctgtcccgc

SEQ ID NO: 644202 - DNA, 25 bp, Rattus norvegicus
aagcgcaggcggccaatggaacccg

SEQ ID NO: 644203 - DNA, 25 bp, Rattus norvegicus
cggccgctgtcagggaagcgcaggc

SEQ ID NO: 644204 - DNA, 25 bp, Rattus norvegicus
ccaacttgaggtagcgtgaaggccc

SEQ ID NO: 644205 - DNA, 25 bp, Rattus norvegicus
gtccggtccaacttgaggtagcgtg

SEQ ID NO: 644206 - DNA, 25 bp, Rattus norvegicus
tattttgggtcctgcaagtggggtc

SEQ ID NO: 644207 - DNA, 25 bp, Rattus norvegicus
ggaattgttattttgggtcctgcaa

SEQ ID NO: 644208 - DNA, 25 bp, Rattus norvegicus
cgcaacccatcaaggaattgttatt

SEQ ID NO: 644209 - DNA, 25 bp, Rattus norvegicus
tacatcgcaacccatcaaggaattg

SEQ ID NO: 644210 - DNA, 25 bp, Rattus norvegicus
ggactcttacatcgcaacccatcaa

SEQ ID NO: 644211 - DNA, 25 bp, Rattus norvegicus
aaggctcgggcccagcggactctta

SEQ ID NO: 644212 - DNA, 25 bp, Rattus norvegicus
gggcccagcggactcttacatcgca

SEQ ID NO: 644213 - DNA, 25 bp, Rattus norvegicus
cgccgctgtcgcttagcaagaagtc

SEQ ID NO: 644214 - DNA, 25 bp, Rattus norvegicus
tgcccgctttcatactcgccattgg

SEQ ID NO: 644215 - DNA, 25 bp, Rattus norvegicus
acctgggtgttttaagtgttcatgc

SEQ ID NO: 644216 - DNA, 25 bp, Rattus norvegicus
ttctagctgtatggcgacgcgtcta

SEQ ID NO: 644217 - DNA, 25 bp, Rattus norvegicus
gtgttcatgccgtctcctcaggcta

SEQ ID NO: 644218 - DNA, 25 bp, Rattus norvegicus
tcgaagctggacactgcatcacgta

SEQ ID NO: 644219 - DNA, 25 bp, Rattus norvegicus
gccgttctctctattggtcgctcga

SEQ ID NO: 644220 - DNA, 25 bp, Rattus norvegicus
agtcagccttagtctccgctttggg

SEQ ID NO: 644221 - DNA, 25 bp, Rattus norvegicus
tctgcgcagtccgaaagccattggc

SEQ ID NO: 644222 - DNA, 25 bp, Rattus norvegicus
ttctcaccgcgattggacgaagggc

SEQ ID NO: 644223 - DNA, 25 bp, Rattus norvegicus
ctcgccattggctaatagacccgtc

SEQ ID NO: 644224 - DNA, 25 bp, Rattus norvegicus
ttgccgcgagcatgcttacttgttc

SEQ ID NO: 644225 - DNA, 25 bp, Rattus norvegicus
tcccagcgcttgtcctcgaagaaga

SEQ ID NO: 644226 - DNA, 25 bp, Rattus norvegicus
tagacccgtcattcaaccgtgagcc

SEQ ID NO: 644227 - DNA, 25 bp, Rattus norvegicus
accttctcggcgctcagtctagcta

SEQ ID NO: 644228 - DNA, 25 bp, Rattus norvegicus
gtctcttcacagaacccgcgttcgg

SEQ ID NO: 644229 - DNA, 25 bp, Rattus norvegicus
cgggcttctcacaggcgttgttcag

SEQ ID NO: 644230 - DNA, 25 bp, Rattus norvegicus
gttgttcaggctccaggacaagctc

SEQ ID NO: 644231 - DNA, 25 bp, Rattus norvegicus
ggacaagctcaggaccgcaccactt

SEQ ID NO: 644232 - DNA, 25 bp, Rattus norvegicus
gtctggcaccttcctagcaacttga

SEQ ID NO: 644233 - DNA, 25 bp, Rattus norvegicus
cttgaactgctctccgcaaaagcta

SEQ ID NO: 644234 - DNA, 25 bp, Rattus norvegicus
tctcactagacaggaacactcaagc

SEQ ID NO: 644235 - DNA, 25 bp, Rattus norvegicus
caactccacagcttcgttcagggtg

SEQ ID NO: 644236 - DNA, 25 bp, Rattus norvegicus
tagccggagagaagagaagccaatc

SEQ ID NO: 644237 - DNA, 25 bp, Rattus norvegicus
tgactccggatcacgtgacaaacgt

SEQ ID NO: 644238 - DNA, 25 bp, Rattus norvegicus
acggtgtaactatggtggctcggta

SEQ ID NO: 644239 - DNA, 25 bp, Rattus norvegicus
ctcggtaggccaatataggttcgta

SEQ ID NO: 644240 - DNA, 25 bp, Rattus norvegicus
ccgcgtctcggatagaacaaaccta

SEQ ID NO: 644241 - DNA, 25 bp, Rattus norvegicus
ggttgatcctcaccgccgggtccga

SEQ ID NO: 644242 - DNA, 25 bp, Rattus norvegicus
gagccgagcgtgttgtccgcccgct

SEQ ID NO: 644243 - DNA, 25 bp, Rattus norvegicus
ccagctagccgccagcctggaaatg

SEQ ID NO: 644244 - DNA, 25 bp, Rattus norvegicus
gggctgggttctctgattcattcat

SEQ ID NO: 644245 - DNA, 25 bp, Rattus norvegicus
agcctctcgcttcagcgcgcgaccg

SEQ ID NO: 644246 - DNA, 25 bp, Rattus norvegicus
cccgctctgtggagtcagaggcagc

SEQ ID NO: 644247 - DNA, 25 bp, Rattus norvegicus
gatggagacacagcgcgagcacctg

SEQ ID NO: 644248 - DNA, 25 bp, Rattus norvegicus
ccagctccttccctaatttagcagt

SEQ ID NO: 644249 - DNA, 25 bp, Rattus norvegicus
agctatttaaaggtcctcctgcggg

SEQ ID NO: 644250 - DNA, 25 bp, Rattus norvegicus
agcgcgctgacgtagctatttaaag

SEQ ID NO: 644251 - DNA, 25 bp, Rattus norvegicus
agtacttccggccgcgtgacatcat

SEQ ID NO: 644252 - DNA, 25 bp, Rattus norvegicus
cttccctaatttagcagtacttccg

SEQ ID NO: 644253 - DNA, 25 bp, Rattus norvegicus
aggtgggcaccgaacagctcgccca

SEQ ID NO: 644254 - DNA, 25 bp, Rattus norvegicus
gcgctcggttcggaacccgctctgt

SEQ ID NO: 644255 - DNA, 25 bp, Rattus norvegicus
cgacgctcgactgcttttgcttgca

SEQ ID NO: 644256 - DNA, 25 bp, Rattus norvegicus
aaaagaaaaggcgtcgagtgctcga

SEQ ID NO: 644257 - DNA, 25 bp, Rattus norvegicus
gagtgctcgacgctcgactgctttt

SEQ ID NO: 644258 - DNA, 25 bp, Rattus norvegicus
ttgcagacgccggacttccgtcatt

SEQ ID NO: 644259 - DNA, 25 bp, Rattus norvegicus
cgccggacttccgtcattggcggtc

SEQ ID NO: 644260 - DNA, 25 bp, Rattus norvegicus
ggacttccgtcattggcggtcgccc

SEQ ID NO: 644261 - DNA, 25 bp, Rattus norvegicus
gtcattggcggtcgcccgcaggaaa

SEQ ID NO: 644262 - DNA, 25 bp, Rattus norvegicus
cgcccgcaggaaatagtgtcgagtg

SEQ ID NO: 644263 - DNA, 25 bp, Rattus norvegicus
caggaaatagtgtcgagtgctgatc

SEQ ID NO: 644264 - DNA, 25 bp, Rattus norvegicus
aatagtgtcgagtgctgatcggcga

SEQ ID NO: 644265 - DNA, 25 bp, Rattus norvegicus
tcgagtgctgatcggcgagaacccg

SEQ ID NO: 644266 - DNA, 25 bp, Rattus norvegicus
cggcgcagtctctgtaagcggtatg

SEQ ID NO: 644267 - DNA, 25 bp, Rattus norvegicus
gcagtctctgtaagcggtatgagtt

SEQ ID NO: 644268 - DNA, 25 bp, Rattus norvegicus
tctgtaagcggtatgagtttggctg

SEQ ID NO: 644269 - DNA, 25 bp, Rattus norvegicus
atcacccgttgtgccttggaccggc

SEQ ID NO: 644270 - DNA, 25 bp, Rattus norvegicus
ccagggctaaagcagccactgcggt

SEQ ID NO: 644271 - DNA, 25 bp, Rattus norvegicus
aatcgtgtagccagagccagctccc

SEQ ID NO: 644272 - DNA, 25 bp, Rattus norvegicus
aaagcagccactgcggtgcagcacc

SEQ ID NO: 644273 - DNA, 25 bp, Rattus norvegicus
cagcttctggcgaaatcgtgtagcc

SEQ ID NO: 644274 - DNA, 25 bp, Rattus norvegicus
tgatgaggtctttgatcacccgttg

SEQ ID NO: 644275 - DNA, 25 bp, Rattus norvegicus
accggctgtgcgtgtattctttgga

SEQ ID NO: 644276 - DNA, 25 bp, Rattus norvegicus
tgccgcagcttctggcgaaatcgtg

SEQ ID NO: 644277 - DNA, 25 bp, Rattus norvegicus
attctttggagacgcggtaaagctc

SEQ ID NO: 644278 - DNA, 25 bp, Rattus norvegicus
gtaaagctcgtctagcacctcgctg

SEQ ID NO: 644279 - DNA, 25 bp, Rattus norvegicus
agcacctcgctgctagtctcatcga

SEQ ID NO: 644280 - DNA, 25 bp, Rattus norvegicus
tcgctgctagtctcatcgataaaga

SEQ ID NO: 644281 - DNA, 25 bp, Rattus norvegicus
tcgataaagagatgcgccacggacc

SEQ ID NO: 644282 - DNA, 25 bp, Rattus norvegicus
accgccaccttgacggccaccttga

SEQ ID NO: 644283 - DNA, 25 bp, Rattus norvegicus
cggtcgcattgttttcctccgccga

SEQ ID NO: 644284 - DNA, 25 bp, Rattus norvegicus
gccgcttagtatcccattgggcagc

SEQ ID NO: 644285 - DNA, 25 bp, Rattus norvegicus
cctccgccgatctgcggcgggaata

SEQ ID NO: 644286 - DNA, 25 bp, Rattus norvegicus
cgggaataggggcttctactcagac

SEQ ID NO: 644287 - DNA, 25 bp, Rattus norvegicus
ggcggtgcctatcccgccgcttagt

SEQ ID NO: 644288 - DNA, 25 bp, Rattus norvegicus
ccgcctttctgtagtattactggtg

SEQ ID NO: 644289 - DNA, 25 bp, Rattus norvegicus
tggagcctaaatctaagcacgattc

SEQ ID NO: 644290 - DNA, 25 bp, Rattus norvegicus
accacggattgcgaactctgcccga

SEQ ID NO: 644291 - DNA, 25 bp, Rattus norvegicus
attgcgaactctgcccgagctaggg

SEQ ID NO: 644292 - DNA, 25 bp, Rattus norvegicus
gacgctcgtcgcgtcttgccagagc

SEQ ID NO: 644293 - DNA, 25 bp, Rattus norvegicus
gcacgattcagacaggacgctcgtc

SEQ ID NO: 644294 - DNA, 25 bp, Rattus norvegicus
tctactcagacccaagactctcgta

SEQ ID NO: 644295 - DNA, 25 bp, Rattus norvegicus
tctcgtaacccgacagcgccttgga

SEQ ID NO: 644296 - DNA, 25 bp, Rattus norvegicus
gacagcgccttggagcctaaatcta

SEQ ID NO: 644297 - DNA, 25 bp, Rattus norvegicus
cagctttcagcctcgggagtgggat

SEQ ID NO: 644298 - DNA, 25 bp, Rattus norvegicus
acctggcagtgagtcacgcggcgct

SEQ ID NO: 644299 - DNA, 25 bp, Rattus norvegicus
gtcagcctgtgcgacccgcatggcg

SEQ ID NO: 644300 - DNA, 25 bp, Rattus norvegicus
agggccaggtcagcctgtgcgaccc

SEQ ID NO: 644301 - DNA, 25 bp, Rattus norvegicus
cgctgcggagctcagcagaaccggc

SEQ ID NO: 644302 - DNA, 25 bp, Rattus norvegicus
ctccgtgtgacctggcagtgagtca

SEQ ID NO: 644303 - DNA, 25 bp, Rattus norvegicus
gcccagataagctccgtgtgacctg

SEQ ID NO: 644304 - DNA, 25 bp, Rattus norvegicus
gcctgcacacctggagcccagataa

SEQ ID NO: 644305 - DNA, 25 bp, Rattus norvegicus
gtcatgtgagaagcctgcacacctg

SEQ ID NO: 644306 - DNA, 25 bp, Rattus norvegicus
gccggctgatgtcatgtgagaagcc

SEQ ID NO: 644307 - DNA, 25 bp, Rattus norvegicus
gggacgacaggcgaggaaacaccaa

SEQ ID NO: 644308 - DNA, 25 bp, Rattus norvegicus
cccgcagctttcagcctcgggagtg

SEQ ID NO: 644309 - DNA, 25 bp, Rattus norvegicus
caggcgaggaaacaccaagggccgc

SEQ ID NO: 644310 - DNA, 25 bp, Rattus norvegicus
tccgcagcagctggggagctgcaga

SEQ ID NO: 644311 - DNA, 25 bp, Rattus norvegicus
ttcccacttgatctgcgcctgcagg

SEQ ID NO: 644312 - DNA, 25 bp, Rattus norvegicus
acgcttcacctcattccgcccgggg

SEQ ID NO: 644313 - DNA, 25 bp, Rattus norvegicus
aaacccagatctcattcccacttga

SEQ ID NO: 644314 - DNA, 25 bp, Rattus norvegicus
ggggctttgttagactggtcaccca

SEQ ID NO: 644315 - DNA, 25 bp, Rattus norvegicus
tgttagactggtcacccacggagga

SEQ ID NO: 644316 - DNA, 25 bp, Rattus norvegicus
tcctcccgctaacgtggctctggga

SEQ ID NO: 644317 - DNA, 25 bp, Rattus norvegicus
gtcccggcccagacgctgctacccg

SEQ ID NO: 644318 - DNA, 25 bp, Rattus norvegicus
agccctgtttccctagtctgggaga

SEQ ID NO: 644319 - DNA, 25 bp, Rattus norvegicus
tagctcacttaccagctctgcgcgg

SEQ ID NO: 644320 - DNA, 25 bp, Rattus norvegicus
acttaccagctctgcgcgggcctaa

SEQ ID NO: 644321 - DNA, 25 bp, Rattus norvegicus
tgtttccctagtctgggagacccgc

SEQ ID NO: 644322 - DNA, 25 bp, Rattus norvegicus
gctattccagcctctagccctgttt

SEQ ID NO: 644323 - DNA, 25 bp, Rattus norvegicus
tggcgacagcatcatagctcactta

SEQ ID NO: 644324 - DNA, 25 bp, Rattus norvegicus
cggccctggcgacagcatcatagct

SEQ ID NO: 644325 - DNA, 25 bp, Rattus norvegicus
ccttgttcgtggactccagcccgat

SEQ ID NO: 644326 - DNA, 25 bp, Rattus norvegicus
gagcgccagcatttcaggggacctg

SEQ ID NO: 644327 - DNA, 25 bp, Rattus norvegicus
cccaaggatggtgatgcagcgcaaa

SEQ ID NO: 644328 - DNA, 25 bp, Rattus norvegicus
agaccacgcccgagctgccggtgaa

SEQ ID NO: 644329 - DNA, 25 bp, Rattus norvegicus
gcccaggaagggcagcgaacctctc

SEQ ID NO: 644330 - DNA, 25 bp, Rattus norvegicus
cagcggcagccgaagattgcccttc

SEQ ID NO: 644331 - DNA, 25 bp, Rattus norvegicus
cgtgaagtctccactgtcgcccaaa

SEQ ID NO: 644332 - DNA, 25 bp, Rattus norvegicus
cgcacggcagccattttaacttctg

SEQ ID NO: 644333 - DNA, 25 bp, Rattus norvegicus
ttctgacagaagctgctagcgcccg

SEQ ID NO: 644334 - DNA, 25 bp, Rattus norvegicus
tggccttcccggactccaagagtct

SEQ ID NO: 644335 - DNA, 25 bp, Rattus norvegicus
cgcctcggtttatttattgactgtc

SEQ ID NO: 644336 - DNA, 25 bp, Rattus norvegicus
tcctttggcgaggagctcgccgctc

SEQ ID NO: 644337 - DNA, 25 bp, Rattus norvegicus
agcccgatgcctcgtgattgcgtgc

SEQ ID NO: 644338 - DNA, 25 bp, Rattus norvegicus
cagaacgggaacaacgcttcggagg

SEQ ID NO: 644339 - DNA, 25 bp, Rattus norvegicus
agtggcggaaccgcctgcccgcagt

SEQ ID NO: 644340 - DNA, 25 bp, Rattus norvegicus
tgccgagcagcaagcccggggaccc

SEQ ID NO: 644341 - DNA, 25 bp, Rattus norvegicus
gattctccgccgtgccgagcagcaa

SEQ ID NO: 644342 - DNA, 25 bp, Rattus norvegicus
tgcccgccgcctcttgattctccgc

SEQ ID NO: 644343 - DNA, 25 bp, Rattus norvegicus
tcgtaatcgcgtcgccggcgtttcc

SEQ ID NO: 644344 - DNA, 25 bp, Rattus norvegicus
cctgggtttcgtaatcgcgtcgccg

SEQ ID NO: 644345 - DNA, 25 bp, Rattus norvegicus
tagtgcttgccgctgttcccgcggg

SEQ ID NO: 644346 - DNA, 25 bp, Rattus norvegicus
gggtgtcccatagcgtagtgcttgc

SEQ ID NO: 644347 - DNA, 25 bp, Rattus norvegicus
tgtcccatagcgtagtgcttgccgc

SEQ ID NO: 644348 - DNA, 25 bp, Rattus norvegicus
cccgggcggcacaagctacggaaag

SEQ ID NO: 644349 - DNA, 25 bp, Rattus norvegicus
acaagctacggaaaggcagggaagc

SEQ ID NO: 644350 - DNA, 25 bp, Rattus norvegicus
aggtgcgaagcgacaggggcttctc

SEQ ID NO: 644351 - DNA, 25 bp, Rattus norvegicus
gaggtcgcggtcacagtacacgccc

SEQ ID NO: 644352 - DNA, 25 bp, Rattus norvegicus
ggtcacagtacacgcccgggcggca

SEQ ID NO: 644353 - DNA, 25 bp, Rattus norvegicus
gtctcgaggtcgtttgaacggacca

SEQ ID NO: 644354 - DNA, 25 bp, Rattus norvegicus
ctcagcttccgggatatactggtcc

SEQ ID NO: 644355 - DNA, 25 bp, Rattus norvegicus
agtggccagggcatcattttcatcc

SEQ ID NO: 644356 - DNA, 25 bp, Rattus norvegicus
agggcatcattttcatcctccaggg

SEQ ID NO: 644357 - DNA, 25 bp, Rattus norvegicus
tttgaacggaccaggagggtgctca

SEQ ID NO: 644358 - DNA, 25 bp, Rattus norvegicus
cttccgggatatactggtccgggcg

SEQ ID NO: 644359 - DNA, 25 bp, Rattus norvegicus
cgagaggtaggcctaggctcctacc

SEQ ID NO: 644360 - DNA, 25 bp, Rattus norvegicus
gtgctcagaggcacgtggctcgccc

SEQ ID NO: 644361 - DNA, 25 bp, Rattus norvegicus
gtaggcctaggctcctaccttctct

SEQ ID NO: 644362 - DNA, 25 bp, Rattus norvegicus
agacttagcagcagggcccagagca

SEQ ID NO: 644363 - DNA, 25 bp, Rattus norvegicus
gcccgggactccagacttagcagca

SEQ ID NO: 644364 - DNA, 25 bp, Rattus norvegicus
catcctaaccgtggtagcggtcggg

SEQ ID NO: 644365 - DNA, 25 bp, Rattus norvegicus
gacccgctgcatcctaaccgtggta

SEQ ID NO: 644366 - DNA, 25 bp, Rattus norvegicus
cccaaagtggaagctgacccgctgc

SEQ ID NO: 644367 - DNA, 25 bp, Rattus norvegicus
ccctcagcgaggagaggtaactcgg

SEQ ID NO: 644368 - DNA, 25 bp, Rattus norvegicus
ttcggtcacggactgagacccgtta

SEQ ID NO: 644369 - DNA, 25 bp, Rattus norvegicus
ttaaggacccgactcaagcgaacga

SEQ ID NO: 644370 - DNA, 25 bp, Rattus norvegicus
gcgaacgaagattcctttctccagg

SEQ ID NO: 644371 - DNA, 25 bp, Rattus norvegicus
gaagggtttggtcctccagctctcc

SEQ ID NO: 644372 - DNA, 25 bp, Rattus norvegicus
acgctgcattcctttcggtcacgga

SEQ ID NO: 644373 - DNA, 25 bp, Rattus norvegicus
agaaggacagacacacctcgccggg

SEQ ID NO: 644374 - DNA, 25 bp, Rattus norvegicus
tgcgtaatccggcactccgggagtc

SEQ ID NO: 644375 - DNA, 25 bp, Rattus norvegicus
acccgttacctgcaaagcggctcga

SEQ ID NO: 644376 - DNA, 25 bp, Rattus norvegicus
ctgtcgcacaggtcccgcttaagga

SEQ ID NO: 644377 - DNA, 25 bp, Rattus norvegicus
tgcaagtagtcctccatggtgaagc

SEQ ID NO: 644378 - DNA, 25 bp, Rattus norvegicus
ctcagggtctagagccgagagtcaa

SEQ ID NO: 644379 - DNA, 25 bp, Rattus norvegicus
cgaacccaggaggaagtgcgtaatc

SEQ ID NO: 644380 - DNA, 25 bp, Rattus norvegicus
gcggctcgacagtcctgcaagtagt

SEQ ID NO: 644381 - DNA, 25 bp, Rattus norvegicus
gagtaaacccgtgtcaagccgtgta

SEQ ID NO: 644382 - DNA, 25 bp, Rattus norvegicus
agccgtgtaagctccggggctgaca

SEQ ID NO: 644383 - DNA, 25 bp, Rattus norvegicus
tctgaaagccgtgggggatcgccta

SEQ ID NO: 644384 - DNA, 25 bp, Rattus norvegicus
tgtcaagccgtgtaagctccggggc

SEQ ID NO: 644385 - DNA, 25 bp, Rattus norvegicus
tcttaaagactctgaaagccgtggg

SEQ ID NO: 644386 - DNA, 25 bp, Rattus norvegicus
gctcacttgggaatcttaaagactc

SEQ ID NO: 644387 - DNA, 25 bp, Rattus norvegicus
aacccgtgtcaagccgtgtaagctc

SEQ ID NO: 644388 - DNA, 25 bp, Rattus norvegicus
cgcgagagtaaacccgtgtcaagcc

SEQ ID NO: 644389 - DNA, 25 bp, Rattus norvegicus
cgccgcgagagtaaacccgtgtcaa

SEQ ID NO: 644390 - DNA, 25 bp, Rattus norvegicus
caccccgggtgttgagtgtgagtcc

SEQ ID NO: 644391 - DNA, 25 bp, Rattus norvegicus
tcgcctaggctgagctctgcttgtc

SEQ ID NO: 644392 - DNA, 25 bp, Rattus norvegicus
aggctcgctcacttgggaatcttaa

SEQ ID NO: 644393 - DNA, 25 bp, Rattus norvegicus
acccaggctggacgccgcgagagta

SEQ ID NO: 644394 - DNA, 25 bp, Rattus norvegicus
ggatcgcctaggctgagctctgctt

SEQ ID NO: 644395 - DNA, 25 bp, Rattus norvegicus
cactggccgccgagtgagtctgtgc

SEQ ID NO: 644396 - DNA, 25 bp, Rattus norvegicus
gacgcgggaattgtggccaccaacc

SEQ ID NO: 644397 - DNA, 25 bp, Rattus norvegicus
aaccaagggctgacagccgggccga

SEQ ID NO: 644398 - DNA, 25 bp, Rattus norvegicus
cgaggtcgccgaccacaccagggcc

SEQ ID NO: 644399 - DNA, 25 bp, Rattus norvegicus
ccaatgtccgggtggaggccacaac

SEQ ID NO: 644400 - DNA, 25 bp, Rattus norvegicus
cacaaccgcgccacccggagacccg

SEQ ID NO: 644401 - DNA, 25 bp, Rattus norvegicus
ctccaccggcgcagcgcagggttcc

SEQ ID NO: 644402 - DNA, 25 bp, Rattus norvegicus
cagctccgctacagggttcggccag

SEQ ID NO: 644403 - DNA, 25 bp, Rattus norvegicus
ccgctacagggttcggccagggctc

SEQ ID NO: 644404 - DNA, 25 bp, Rattus norvegicus
gaggacccggcccagtcagtgcgca

SEQ ID NO: 644405 - DNA, 25 bp, Rattus norvegicus
cgctagaagtgggacacggagcagc

SEQ ID NO: 644406 - DNA, 25 bp, Rattus norvegicus
agcggcgcccggaccggtcagcttt

SEQ ID NO: 644407 - DNA, 25 bp, Rattus norvegicus
cagctttgcactggccgccgagtga

SEQ ID NO: 644408 - DNA, 25 bp, Rattus norvegicus
gaccggtcagctttgcactggccgc

SEQ ID NO: 644409 - DNA, 25 bp, Rattus norvegicus
ctggacaggaagtgtgatgctgctt

SEQ ID NO: 644410 - DNA, 25 bp, Rattus norvegicus
agtgtgatgctgcttttaaaacgtc

SEQ ID NO: 644411 - DNA, 25 bp, Rattus norvegicus
acgtcaccagcgttggatgatgaca

SEQ ID NO: 644412 - DNA, 25 bp, Rattus norvegicus
agtcttgctttctgcgttgcgtttc

SEQ ID NO: 644413 - DNA, 25 bp, Rattus norvegicus
tgacaggaaccgtgtgctcacatca

SEQ ID NO: 644414 - DNA, 25 bp, Rattus norvegicus
agagttagtgatgctgctttctttc

SEQ ID NO: 644415 - DNA, 25 bp, Rattus norvegicus
tgcttttaaaacgtcaccagcgttg

SEQ ID NO: 644416 - DNA, 25 bp, Rattus norvegicus
atatagtcttgctttctgcgttgcg

SEQ ID NO: 644417 - DNA, 25 bp, Rattus norvegicus
ccagcgttggatgatgacaggaacc

SEQ ID NO: 644418 - DNA, 25 bp, Rattus norvegicus
gttgcgtttcccatgcctgccttta

SEQ ID NO: 644419 - DNA, 25 bp, Rattus norvegicus
tgtgacagagagttagtgatgctgc

SEQ ID NO: 644420 - DNA, 25 bp, Rattus norvegicus
gcctgcctttacaccgcagggtgtg

SEQ ID NO: 644421 - DNA, 25 bp, Rattus norvegicus
tttctgcgttgcgtttcccatgcct

SEQ ID NO: 644422 - DNA, 25 bp, Rattus norvegicus
cctttacaccgcagggtgtgacaga

SEQ ID NO: 644423 - DNA, 25 bp, Rattus norvegicus
ccttgcggttgggagccggagctgt

SEQ ID NO: 644424 - DNA, 25 bp, Rattus norvegicus
gccgtctctcccttcagtttgcgtg

SEQ ID NO: 644425 - DNA, 25 bp, Rattus norvegicus
tctctcccttcagtttgcgtgggtt

SEQ ID NO: 644426 - DNA, 25 bp, Rattus norvegicus
ctcccttcagtttgcgtgggttttg

SEQ ID NO: 644427 - DNA, 25 bp, Rattus norvegicus
cttcagtttgcgtgggttttggcga

SEQ ID NO: 644428 - DNA, 25 bp, Rattus norvegicus
aggcggagccctggagtaaaacctg

SEQ ID NO: 644429 - DNA, 25 bp, Rattus norvegicus
tgagacccggcccttgcggttggga

SEQ ID NO: 644430 - DNA, 25 bp, Rattus norvegicus
ctgactgaggtaggctgaggctgag

SEQ ID NO: 644431 - DNA, 25 bp, Rattus norvegicus
tttgcttgtaggaggttagggctgt

SEQ ID NO: 644432 - DNA, 25 bp, Rattus norvegicus
gctgtgtgtggaaacttggcgggag

SEQ ID NO: 644433 - DNA, 25 bp, Rattus norvegicus
gaggccgctgcgttcctcggttcct

SEQ ID NO: 644434 - DNA, 25 bp, Rattus norvegicus
tcaggcggccgagacccttgtgcgc

SEQ ID NO: 644435 - DNA, 25 bp, Rattus norvegicus
ccgagacccttgtgcgcgttattcg

SEQ ID NO: 644436 - DNA, 25 bp, Rattus norvegicus
tcggtgttgtgagacccggcccttg

SEQ ID NO: 644437 - DNA, 25 bp, Rattus norvegicus
gactgacaagtacggagagccaagc

SEQ ID NO: 644438 - DNA, 25 bp, Rattus norvegicus
gcagcggtaaggtgccgattctgta

SEQ ID NO: 644439 - DNA, 25 bp, Rattus norvegicus
taaggtgccgattctgtagagtgtc

SEQ ID NO: 644440 - DNA, 25 bp, Rattus norvegicus
gccgattctgtagagtgtctttccc

SEQ ID NO: 644441 - DNA, 25 bp, Rattus norvegicus
agcgacggtgccacctcgaccatgg

SEQ ID NO: 644442 - DNA, 25 bp, Rattus norvegicus
gaccatggcggcgactacagctaac

SEQ ID NO: 644443 - DNA, 25 bp, Rattus norvegicus
gccatcttggatttcgcggtagcgg

SEQ ID NO: 644444 - DNA, 25 bp, Rattus norvegicus
gacggtgccacctcgaccatggcgg

SEQ ID NO: 644445 - DNA, 25 bp, Rattus norvegicus
ggcggcgactacagctaacccaggt

SEQ ID NO: 644446 - DNA, 25 bp, Rattus norvegicus
gcgactacagctaacccaggtgaga

SEQ ID NO: 644447 - DNA, 25 bp, Rattus norvegicus
ctacagctaacccaggtgagactga

SEQ ID NO: 644448 - DNA, 25 bp, Rattus norvegicus
cccaggtgagactgaaaggactgac

SEQ ID NO: 644449 - DNA, 25 bp, Rattus norvegicus
tgagactgaaaggactgacaagtac

SEQ ID NO: 644450 - DNA, 25 bp, Rattus norvegicus
caagtacggagagccaagcagagct

SEQ ID NO: 644451 - DNA, 25 bp, Rattus norvegicus
gaaagcaggaccatcccggcgcctt

SEQ ID NO: 644452 - DNA, 25 bp, Rattus norvegicus
gctcctggctcacggtaagggaccc

SEQ ID NO: 644453 - DNA, 25 bp, Rattus norvegicus
cgtggtgctgattctgtcaggcgct

SEQ ID NO: 644454 - DNA, 25 bp, Rattus norvegicus
cccaggggtaggaaagcaggaccat

SEQ ID NO: 644455 - DNA, 25 bp, Rattus norvegicus
gggtccctcgtatcctcactgcaga

SEQ ID NO: 644456 - DNA, 25 bp, Rattus norvegicus
tttgccgcttattctgggtccctcg

SEQ ID NO: 644457 - DNA, 25 bp, Rattus norvegicus
aaacttcgctcgactttgccgctta

SEQ ID NO: 644458 - DNA, 25 bp, Rattus norvegicus
tcgctccactccaggcgtctagggg

SEQ ID NO: 644459 - DNA, 25 bp, Rattus norvegicus
gggatttctctgctgcaattcatca

SEQ ID NO: 644460 - DNA, 25 bp, Rattus norvegicus
cccggatctaatgggatttctctgc

SEQ ID NO: 644461 - DNA, 25 bp, Rattus norvegicus
cggccgagacctcgcctttaatcat

SEQ ID NO: 644462 - DNA, 25 bp, Rattus norvegicus
gtgcatcctgttgttcctcccaagc

SEQ ID NO: 644463 - DNA, 25 bp, Rattus norvegicus
gcgccttgctctgtgcatcctgttg

SEQ ID NO: 644464 - DNA, 25 bp, Rattus norvegicus
agtccggacggtccagctggcagcc

SEQ ID NO: 644465 - DNA, 25 bp, Rattus norvegicus
aggagcgccgcacttcgagcctctt

SEQ ID NO: 644466 - DNA, 25 bp, Rattus norvegicus
cttttggcgggaatagtggtctcac

SEQ ID NO: 644467 - DNA, 25 bp, Rattus norvegicus
tcacctgcggtcaaagggcgtgaca

SEQ ID NO: 644468 - DNA, 25 bp, Rattus norvegicus
cgtgacacgtgccagcgacagttaa

SEQ ID NO: 644469 - DNA, 25 bp, Rattus norvegicus
ttgagcacatgctgacaggagcgcc

SEQ ID NO: 644470 - DNA, 25 bp, Rattus norvegicus
ttgtgtgcttacatcccagccgcgg

SEQ ID NO: 644471 - DNA, 25 bp, Rattus norvegicus
gagcctcttccctgtcgctgctgga

SEQ ID NO: 644472 - DNA, 25 bp, Rattus norvegicus
tgctggacgcttctctcaggcgttg

SEQ ID NO: 644473 - DNA, 25 bp, Rattus norvegicus
tctctcaggcgttgtgtaaagtatg

SEQ ID NO: 644474 - DNA, 25 bp, Rattus norvegicus
gtttcttttctgtagcccttcgcca

SEQ ID NO: 644475 - DNA, 25 bp, Rattus norvegicus
tcgccatctcaggtttcttgcagtc

SEQ ID NO: 644476 - DNA, 25 bp, Rattus norvegicus
cttgcagtctgaacggaagacattt

SEQ ID NO: 644477 - DNA, 25 bp, Rattus norvegicus
gccggcggtcgccatagtgctaacg

SEQ ID NO: 644478 - DNA, 25 bp, Rattus norvegicus
aaggcgcatgcgcattgagcacatg

SEQ ID NO: 644479 - DNA, 25 bp, Rattus norvegicus
acgcgctaggctcttctggaggtag

SEQ ID NO: 644480 - DNA, 25 bp, Rattus norvegicus
agctggcgaacctacgacgttaata

SEQ ID NO: 644481 - DNA, 25 bp, Rattus norvegicus
cgcctgcgcgttagttgttcgcgta

SEQ ID NO: 644482 - DNA, 25 bp, Rattus norvegicus
ctacgtttatttgtgcgcctgcgcg

SEQ ID NO: 644483 - DNA, 25 bp, Rattus norvegicus
ggttggcgctgcaatctgaccaatc

SEQ ID NO: 644484 - DNA, 25 bp, Rattus norvegicus
ttttggcaacgcaatagcagcaatg

SEQ ID NO: 644485 - DNA, 25 bp, Rattus norvegicus
aaaggcccaaagctacctagtcaga

SEQ ID NO: 644486 - DNA, 25 bp, Rattus norvegicus
tcccttcggttgcagaaagcttttc

SEQ ID NO: 644487 - DNA, 25 bp, Rattus norvegicus
ggttttatcctctacggtcctctca

SEQ ID NO: 644488 - DNA, 25 bp, Rattus norvegicus
tgcccagcgccgaaaactaatggtt

SEQ ID NO: 644489 - DNA, 25 bp, Rattus norvegicus
tgcgagttgcgaaggtttgtcagta

SEQ ID NO: 644490 - DNA, 25 bp, Rattus norvegicus
gccatcttcccggtttgcacaagcg

SEQ ID NO: 644491 - DNA, 25 bp, Rattus norvegicus
ttttcgatccaacgaggactccagg

SEQ ID NO: 644492 - DNA, 25 bp, Rattus norvegicus
gacctgcgacgcctttcaaaatgcc

SEQ ID NO: 644493 - DNA, 25 bp, Rattus norvegicus
gccaacgttagtccagtcctgattg

SEQ ID NO: 644494 - DNA, 25 bp, Rattus norvegicus
gcggtccctataacacgtgacttga

SEQ ID NO: 644495 - DNA, 25 bp, Rattus norvegicus
tgtccagccgctcggaccgaaggct

SEQ ID NO: 644496 - DNA, 25 bp, Rattus norvegicus
accgaaggctatcctctcgggcgca

SEQ ID NO: 644497 - DNA, 25 bp, Rattus norvegicus
ggcgcagggccactactcacctcac

SEQ ID NO: 644498 - DNA, 25 bp, Rattus norvegicus
cctgagacggagcccgaacgttaca

SEQ ID NO: 644499 - DNA, 25 bp, Rattus norvegicus
acgctgcggtccctataacacgtga

SEQ ID NO: 644500 - DNA, 25 bp, Rattus norvegicus
acacgtgacttgagaaggcgggacc

SEQ ID NO: 644501 - DNA, 25 bp, Rattus norvegicus
cgcgcagccgcggtatcaaggtgcc

SEQ ID NO: 644502 - DNA, 25 bp, Rattus norvegicus
cgcggcgggatcctaaagcttaagt

SEQ ID NO: 644503 - DNA, 25 bp, Rattus norvegicus
cctaaagcttaagtccgctcgctga

SEQ ID NO: 644504 - DNA, 25 bp, Rattus norvegicus
agtccagtcctgattgccgggagca

SEQ ID NO: 644505 - DNA, 25 bp, Rattus norvegicus
ccgcggagcaaagccaacgttagtc

SEQ ID NO: 644506 - DNA, 25 bp, Rattus norvegicus
gctcgctgacttgccgcggagcaaa

SEQ ID NO: 644507 - DNA, 25 bp, Rattus norvegicus
ccgcttacagttgaccttgcaaagg

SEQ ID NO: 644508 - DNA, 25 bp, Rattus norvegicus
ggcctccgaattcggactccgatac

SEQ ID NO: 644509 - DNA, 25 bp, Rattus norvegicus
tctgagcgcaggctctggacttttc

SEQ ID NO: 644510 - DNA, 25 bp, Rattus norvegicus
tggtctgcgagaaggtcagcccgat

SEQ ID NO: 644511 - DNA, 25 bp, Rattus norvegicus
accttcctatggagtcgcggtcgtt

SEQ ID NO: 644512 - DNA, 25 bp, Rattus norvegicus
gtcctcaccttcctatggagtcgcg

SEQ ID NO: 644513 - DNA, 25 bp, Rattus norvegicus
cagtcaaagaaacagcgtcctcacc

SEQ ID NO: 644514 - DNA, 25 bp, Rattus norvegicus
ggacttttcgcctgacagtcaaaga

SEQ ID NO: 644515 - DNA, 25 bp, Rattus norvegicus
cttgcaaaggttcggttctgagcgc

SEQ ID NO: 644516 - DNA, 25 bp, Rattus norvegicus
agaccgctgcagagtaccgcttaca

SEQ ID NO: 644517 - DNA, 25 bp, Rattus norvegicus
tgcgctgaaaggctcagaccgctgc

SEQ ID NO: 644518 - DNA, 25 bp, Rattus norvegicus
aggaagctgcgctgaaaggctcaga

SEQ ID NO: 644519 - DNA, 25 bp, Rattus norvegicus
ccggaagcggaagctacggaatctc

SEQ ID NO: 644520 - DNA, 25 bp, Rattus norvegicus
ctccgtaccggaagcggaagctacg

SEQ ID NO: 644521 - DNA, 25 bp, Rattus norvegicus
agggtggagctcgtagccttaaata

SEQ ID NO: 644522 - DNA, 25 bp, Rattus norvegicus
tcccgatctgcggtcttaacaagcc

SEQ ID NO: 644523 - DNA, 25 bp, Rattus norvegicus
tcgtccgcttacctgggtctgtcag

SEQ ID NO: 644524 - DNA, 25 bp, Rattus norvegicus
ctccttcaccgtctgtgcgggtcta

SEQ ID NO: 644525 - DNA, 25 bp, Rattus norvegicus
acagaccttgtgctctcattggata

SEQ ID NO: 644526 - DNA, 25 bp, Rattus norvegicus
tgccggcaacacgtgactctagata

SEQ ID NO: 644527 - DNA, 25 bp, Rattus norvegicus
ggaagcagtccatgctccgcccgta

SEQ ID NO: 644528 - DNA, 25 bp, Rattus norvegicus
agtctatgatcgcacccgccaggtg

SEQ ID NO: 644529 - DNA, 25 bp, Rattus norvegicus
ccttaaataggacggcactgcgcgg

SEQ ID NO: 644530 - DNA, 25 bp, Rattus norvegicus
tcgtcttccggagaacgcttggctc

SEQ ID NO: 644531 - DNA, 25 bp, Rattus norvegicus
catgcggctcctcgggtgataaaaa

SEQ ID NO: 644532 - DNA, 25 bp, Rattus norvegicus
gcggcttctccagtcggttcttaca

SEQ ID NO: 644533 - DNA, 25 bp, Rattus norvegicus
gtcagcaactcgtgtccgcaacgtg

SEQ ID NO: 644534 - DNA, 25 bp, Rattus norvegicus
gtcctgtcggtatccagctccttca

SEQ ID NO: 644535 - DNA, 25 bp, Rattus norvegicus
ggatgcaccttcgtcgcgttcggcc

SEQ ID NO: 644536 - DNA, 25 bp, Rattus norvegicus
ggctgctgtgtttttcggatgcacc

SEQ ID NO: 644537 - DNA, 25 bp, Rattus norvegicus
tgtgtttttcggatgcaccttcgtc

SEQ ID NO: 644538 - DNA, 25 bp, Rattus norvegicus
ttttcggatgcaccttcgtcgcgtt

SEQ ID NO: 644539 - DNA, 25 bp, Rattus norvegicus
ctcccattcgcctcccttggccggg

SEQ ID NO: 644540 - DNA, 25 bp, Rattus norvegicus
tcttcgggttatcatcctggtggcg

SEQ ID NO: 644541 - DNA, 25 bp, Rattus norvegicus
cccagctgtccagtcatgggggctg

SEQ ID NO: 644542 - DNA, 25 bp, Rattus norvegicus
cctcggagcgctgctcccattcgcc

SEQ ID NO: 644543 - DNA, 25 bp, Rattus norvegicus
cgcccttttcctgattactgtagcc

SEQ ID NO: 644544 - DNA, 25 bp, Rattus norvegicus
ctgattactgtagccggagaccctc

SEQ ID NO: 644545 - DNA, 25 bp, Rattus norvegicus
ttactgtagccggagaccctcttcg

SEQ ID NO: 644546 - DNA, 25 bp, Rattus norvegicus
tccgggggtgacattgcaccgcgcc

SEQ ID NO: 644547 - DNA, 25 bp, Rattus norvegicus
gccggagaccctcttcgggttatca

SEQ ID NO: 644548 - DNA, 25 bp, Rattus norvegicus
gaccctcttcgggttatcatcctgg

SEQ ID NO: 644549 - DNA, 25 bp, Rattus norvegicus
cggttatcgtgcagagccaccggtc

SEQ ID NO: 644550 - DNA, 25 bp, Rattus norvegicus
gtccgcgctgtagtggtcccttgac

SEQ ID NO: 644551 - DNA, 25 bp, Rattus norvegicus
caccggtccttaagccctgttcatt

SEQ ID NO: 644552 - DNA, 25 bp, Rattus norvegicus
gtttcgggctcgctcgttcgcggcc

SEQ ID NO: 644553 - DNA, 25 bp, Rattus norvegicus
attcccttgcggttcacgccaggtc

SEQ ID NO: 644554 - DNA, 25 bp, Rattus norvegicus
agtggtcccttgacgcccgcgcaaa

SEQ ID NO: 644555 - DNA, 25 bp, Rattus norvegicus
ctgttcattttcgtggttggtgtgc

SEQ ID NO: 644556 - DNA, 25 bp, Rattus norvegicus
cgtcttcggattcccttgcggttca

SEQ ID NO: 644557 - DNA, 25 bp, Rattus norvegicus
aggttcctgtgagccgcgctgcgct

SEQ ID NO: 644558 - DNA, 25 bp, Rattus norvegicus
acgcaagcggcaggttcctgtgagc

SEQ ID NO: 644559 - DNA, 25 bp, Rattus norvegicus
cggacttctacgcaagcggcaggtt

SEQ ID NO: 644560 - DNA, 25 bp, Rattus norvegicus
gcgtggcgcgcggacttctacgcaa

SEQ ID NO: 644561 - DNA, 25 bp, Rattus norvegicus
tctgcccggccttcacggttatcgt

SEQ ID NO: 644562 - DNA, 25 bp, Rattus norvegicus
ttgacgcccgcgcaaaggcggccgt

SEQ ID NO: 644563 - DNA, 25 bp, Rattus norvegicus
tagcggtttttccaaatctccctga

SEQ ID NO: 644564 - DNA, 25 bp, Rattus norvegicus
gggcaatcggagaactagccgccgc

SEQ ID NO: 644565 - DNA, 25 bp, Rattus norvegicus
aatcggagaactagccgccgccgtg

SEQ ID NO: 644566 - DNA, 25 bp, Rattus norvegicus
accgcttcggcaagggcgcctacct

SEQ ID NO: 644567 - DNA, 25 bp, Rattus norvegicus
cctacctccttctcggagacgtaga

SEQ ID NO: 644568 - DNA, 25 bp, Rattus norvegicus
ccttctcggagacgtagagctggtc

SEQ ID NO: 644569 - DNA, 25 bp, Rattus norvegicus
gagacgtagagctggtcgcctttca

SEQ ID NO: 644570 - DNA, 25 bp, Rattus norvegicus
acgtagagctggtcgcctttcagca

SEQ ID NO: 644571 - DNA, 25 bp, Rattus norvegicus
ccacatagcggtttttccaaatctc

SEQ ID NO: 644572 - DNA, 25 bp, Rattus norvegicus
ctgaaaatccctttcccgcagaatt

SEQ ID NO: 644573 - DNA, 25 bp, Rattus norvegicus
ttcagcaccacatagcggtttttcc

SEQ ID NO: 644574 - DNA, 25 bp, Rattus norvegicus
ggtcgcctttcagcaccacatagcg

SEQ ID NO: 644575 - DNA, 25 bp, Rattus norvegicus
gcctttcagcaccacatagcggttt

SEQ ID NO: 644576 - DNA, 25 bp, Rattus norvegicus
gctggtcgcctttcagcaccacata

SEQ ID NO: 644577 - DNA, 25 bp, Rattus norvegicus
actcgtgggcctccggctggtgcca

SEQ ID NO: 644578 - DNA, 25 bp, Rattus norvegicus
ccttacggtttgtcaggtagctgaa

SEQ ID NO: 644579 - DNA, 25 bp, Rattus norvegicus
ttgtcaggtagctgaagcgggattc

SEQ ID NO: 644580 - DNA, 25 bp, Rattus norvegicus
tagctgaagcgggattcgaactctg

SEQ ID NO: 644581 - DNA, 25 bp, Rattus norvegicus
tcgaactctgcgaagaaaggaagaa

SEQ ID NO: 644582 - DNA, 25 bp, Rattus norvegicus
agaaaggaagaaggcagcttgactg

SEQ ID NO: 644583 - DNA, 25 bp, Rattus norvegicus
ggcagcttgactgaaactcaccttc

SEQ ID NO: 644584 - DNA, 25 bp, Rattus norvegicus
accttcttgactcgtgggcctccgg

SEQ ID NO: 644585 - DNA, 25 bp, Rattus norvegicus
tcgccgccactgtgcaagcgcgggt

SEQ ID NO: 644586 - DNA, 25 bp, Rattus norvegicus
cctaaggccgggatctgtttgtgct

SEQ ID NO: 644587 - DNA, 25 bp, Rattus norvegicus
ccgggatctgtttgtgctcggctgc

SEQ ID NO: 644588 - DNA, 25 bp, Rattus norvegicus
gtgctcggctgcaaccttgccatgc

SEQ ID NO: 644589 - DNA, 25 bp, Rattus norvegicus
ccgagagctaagaccttacggtttg

SEQ ID NO: 644590 - DNA, 25 bp, Rattus norvegicus
gaaactcaccttcttgactcgtggg

SEQ ID NO: 644591 - DNA, 25 bp, Rattus norvegicus
tctcgacctactccggggcagacgt

SEQ ID NO: 644592 - DNA, 25 bp, Rattus norvegicus
tccagacagcgagtccttctgagcc

SEQ ID NO: 644593 - DNA, 25 bp, Rattus norvegicus
gacgtccagacagcgagtccttctg

SEQ ID NO: 644594 - DNA, 25 bp, Rattus norvegicus
ccggaggacgtccagacagcgagtc

SEQ ID NO: 644595 - DNA, 25 bp, Rattus norvegicus
ctccggtaaacacgcgtgtagcggc

SEQ ID NO: 644596 - DNA, 25 bp, Rattus norvegicus
cgaggcctccggtaaacacgcgtgt

SEQ ID NO: 644597 - DNA, 25 bp, Rattus norvegicus
cttggtagtctccactctcgaccta

SEQ ID NO: 644598 - DNA, 25 bp, Rattus norvegicus
gagccttggtagtctccactctcga

SEQ ID NO: 644599 - DNA, 25 bp, Rattus norvegicus
gcggagccttggtagtctccactct

SEQ ID NO: 644600 - DNA, 25 bp, Rattus norvegicus
cgcagactccggctggcggagcctt

SEQ ID NO: 644601 - DNA, 25 bp, Rattus norvegicus
ggccgcctcggacccgcagactccg

SEQ ID NO: 644602 - DNA, 25 bp, Rattus norvegicus
ggctccgaatgaagggcggaccgcg

SEQ ID NO: 644603 - DNA, 25 bp, Rattus norvegicus
caccgccgctgacgtcgcgggctcc

SEQ ID NO: 644604 - DNA, 25 bp, Rattus norvegicus
ggcctccggtaaacacgcgtgtagc

SEQ ID NO: 644605 - DNA, 25 bp, Rattus norvegicus
ctcacaatggcccggagcgaggcgc

SEQ ID NO: 644606 - DNA, 25 bp, Rattus norvegicus
ccactgaagtttgcgaccgcccggg

SEQ ID NO: 644607 - DNA, 25 bp, Rattus norvegicus
gggcccggccacagttcagatcggc

SEQ ID NO: 644608 - DNA, 25 bp, Rattus norvegicus
agatcggcccccaaacagaaggagg

SEQ ID NO: 644609 - DNA, 25 bp, Rattus norvegicus
aagggagcgcgcaaaaccagcgagc

SEQ ID NO: 644610 - DNA, 25 bp, Rattus norvegicus
gcaaaaccagcgagcgcaggggcct

SEQ ID NO: 644611 - DNA, 25 bp, Rattus norvegicus
aggggcctcagcgagggctcacaat

SEQ ID NO: 644612 - DNA, 25 bp, Rattus norvegicus
cggccgctccgccacatctgcagca

SEQ ID NO: 644613 - DNA, 25 bp, Rattus norvegicus
ctcagcgagggctcacaatggcccg

SEQ ID NO: 644614 - DNA, 25 bp, Rattus norvegicus
ccacatctgcagcaccgggcaggga

SEQ ID NO: 644615 - DNA, 25 bp, Rattus norvegicus
gcagcaggcaagtccctggcccgat

SEQ ID NO: 644616 - DNA, 25 bp, Rattus norvegicus
ttcctacctcggctgccgggctgag

SEQ ID NO: 644617 - DNA, 25 bp, Rattus norvegicus
agcgcgaggctcacggggcacgagc

SEQ ID NO: 644618 - DNA, 25 bp, Rattus norvegicus
acatctgcagcaccgggcagggaag

SEQ ID NO: 644619 - DNA, 25 bp, Rattus norvegicus
ccgcgggagacagctgtctcggaca

SEQ ID NO: 644620 - DNA, 25 bp, Rattus norvegicus
ccgggtagcttcgatactgggaatt

SEQ ID NO: 644621 - DNA, 25 bp, Rattus norvegicus
aattgtagttcctctgtggagttgc

SEQ ID NO: 644622 - DNA, 25 bp, Rattus norvegicus
ttcctctgtggagttgcgaaaccag

SEQ ID NO: 644623 - DNA, 25 bp, Rattus norvegicus
gttgcgaaaccagactcagccgcta

SEQ ID NO: 644624 - DNA, 25 bp, Rattus norvegicus
ctcagccgctaagcgccggtgcatt

SEQ ID NO: 644625 - DNA, 25 bp, Rattus norvegicus
ctaagcgccggtgcatttcccgacg

SEQ ID NO: 644626 - DNA, 25 bp, Rattus norvegicus
catttcccgacgcacctcagttagg

SEQ ID NO: 644627 - DNA, 25 bp, Rattus norvegicus
tcagttagggagtggaaggtaacca

SEQ ID NO: 644628 - DNA, 25 bp, Rattus norvegicus
taaccagttccctcggacaagcctg

SEQ ID NO: 644629 - DNA, 25 bp, Rattus norvegicus
cctcggacaagcctgtgctggcttc

SEQ ID NO: 644630 - DNA, 25 bp, Rattus norvegicus
tctagtccttcgtagggagcgcttg

SEQ ID NO: 644631 - DNA, 25 bp, Rattus norvegicus
ctgtgctggcttctagtccttcgta

SEQ ID NO: 644632 - DNA, 25 bp, Rattus norvegicus
gctgtctcggacagaggaaccatcg

SEQ ID NO: 644633 - DNA, 25 bp, Rattus norvegicus
ttgccctgagagtcgcgagggtaac

SEQ ID NO: 644634 - DNA, 25 bp, Rattus norvegicus
ggtcagtcccggcttggctccagct

SEQ ID NO: 644635 - DNA, 25 bp, Rattus norvegicus
ggcggctagggtgtcaccgccaacc

SEQ ID NO: 644636 - DNA, 25 bp, Rattus norvegicus
ggacggccaaaagccaccgatcctg

SEQ ID NO: 644637 - DNA, 25 bp, Rattus norvegicus
tggctccagctccatctcctgtgga

SEQ ID NO: 644638 - DNA, 25 bp, Rattus norvegicus
tgaccagacttcacctgaagccatc

SEQ ID NO: 644639 - DNA, 25 bp, Rattus norvegicus
ccaaactctgcgtcgtcgagctcca

SEQ ID NO: 644640 - DNA, 25 bp, Rattus norvegicus
aaagccttgccctgagagtcgcgag

SEQ ID NO: 644641 - DNA, 25 bp, Rattus norvegicus
gcaacagccgcggtcgcagtgtccg

SEQ ID NO: 644642 - DNA, 25 bp, Rattus norvegicus
gaagaggccagctccggtcagtccc

SEQ ID NO: 644643 - DNA, 25 bp, Rattus norvegicus
aagccattgggaagaggccagctcc

SEQ ID NO: 644644 - DNA, 25 bp, Rattus norvegicus
ctgaaccagccgctggagtcggagt

SEQ ID NO: 644645 - DNA, 25 bp, Rattus norvegicus
accgatcctgaaccagccgctggag

SEQ ID NO: 644646 - DNA, 25 bp, Rattus norvegicus
ctctttctgaccagacttcacctga

SEQ ID NO: 644647 - DNA, 25 bp, Rattus norvegicus
aatttggcgcggatagcagcttcca

SEQ ID NO: 644648 - DNA, 25 bp, Rattus norvegicus
ctaaggcgatcgaaccgccagagcg

SEQ ID NO: 644649 - DNA, 25 bp, Rattus norvegicus
acgcggcttttacgccagcagcgga

SEQ ID NO: 644650 - DNA, 25 bp, Rattus norvegicus
ggacacgggactgagtccacacacc

SEQ ID NO: 644651 - DNA, 25 bp, Rattus norvegicus
gcgcacttagcatccgctgcggaga

SEQ ID NO: 644652 - DNA, 25 bp, Rattus norvegicus
acacacacgcgcgagtggccatgga

SEQ ID NO: 644653 - DNA, 25 bp, Rattus norvegicus
ctcagggcttgctccaatttggcgc

SEQ ID NO: 644654 - DNA, 25 bp, Rattus norvegicus
tccagtacctcagggctcagggctt

SEQ ID NO: 644655 - DNA, 25 bp, Rattus norvegicus
ccgctctcgttacgcagttccagta

SEQ ID NO: 644656 - DNA, 25 bp, Rattus norvegicus
caccgccacgcggaaatgcgtttcg

SEQ ID NO: 644657 - DNA, 25 bp, Rattus norvegicus
tggaccaaccggtgccgttgcaagg

SEQ ID NO: 644658 - DNA, 25 bp, Rattus norvegicus
agctcctccgacagtgcctcgtgga

SEQ ID NO: 644659 - DNA, 25 bp, Rattus norvegicus
aaatgcgtttcgctgcctgctggga

SEQ ID NO: 644660 - DNA, 25 bp, Rattus norvegicus
catggagaccatgcaccgggccaac

SEQ ID NO: 644661 - DNA, 25 bp, Rattus norvegicus
tgaagagctcaacaagttactagga

SEQ ID NO: 644662 - DNA, 25 bp, Rattus norvegicus
aagagccttttttggattagtgagt

SEQ ID NO: 644663 - DNA, 25 bp, Rattus norvegicus
tgaagatttggtggctctaaaaaga

SEQ ID NO: 644664 - DNA, 25 bp, Rattus norvegicus
gggctggtcacaaactagcgcgtta

SEQ ID NO: 644665 - DNA, 25 bp, Rattus norvegicus
cgccacctacagctagctgtaagga

SEQ ID NO: 644666 - DNA, 25 bp, Rattus norvegicus
cttttaagagccaccaaagtgtcaa

SEQ ID NO: 644667 - DNA, 25 bp, Rattus norvegicus
cggatagtcataagcctggaaagaa

SEQ ID NO: 644668 - DNA, 25 bp, Rattus norvegicus
gctgtaaggaacgatgaagagctca

SEQ ID NO: 644669 - DNA, 25 bp, Rattus norvegicus
ttactaggaggagtcaccattgccc

SEQ ID NO: 644670 - DNA, 25 bp, Rattus norvegicus
atccaggctgtcttactaccgaaga

SEQ ID NO: 644671 - DNA, 25 bp, Rattus norvegicus
tcacttgctcttagccttgtggctc

SEQ ID NO: 644672 - DNA, 25 bp, Rattus norvegicus
agcgcgttagctccttttatgaaga

SEQ ID NO: 644673 - DNA, 25 bp, Rattus norvegicus
ctaccgaagaaaacggatagtcata

SEQ ID NO: 644674 - DNA, 25 bp, Rattus norvegicus
caaagtgtcaaccaaagggctggtc

SEQ ID NO: 644675 - DNA, 25 bp, Rattus norvegicus
tacacaagcgccaagtagaggtctc

SEQ ID NO: 644676 - DNA, 25 bp, Rattus norvegicus
tcgagcgcatcgcaaacgaggcttc

SEQ ID NO: 644677 - DNA, 25 bp, Rattus norvegicus
agcgcatcgcaaacgaggcttctcg

SEQ ID NO: 644678 - DNA, 25 bp, Rattus norvegicus
aacgaggcttctcgcctggcgcatt

SEQ ID NO: 644679 - DNA, 25 bp, Rattus norvegicus
gcattacaacaagcggtctacaatc

SEQ ID NO: 644680 - DNA, 25 bp, Rattus norvegicus
cggtctacaatcacatcgcgggaga

SEQ ID NO: 644681 - DNA, 25 bp, Rattus norvegicus
ctacaatcacatcgcgggagatcca

SEQ ID NO: 644682 - DNA, 25 bp, Rattus norvegicus
ggtgcgtctcctactgcccggagaa

SEQ ID NO: 644683 - DNA, 25 bp, Rattus norvegicus
tcctactgcccggagaactggctaa

SEQ ID NO: 644684 - DNA, 25 bp, Rattus norvegicus
tgcccggagaactggctaagcacgc

SEQ ID NO: 644685 - DNA, 25 bp, Rattus norvegicus
tcaccaagtacacaagcgccaagta

SEQ ID NO: 644686 - DNA, 25 bp, Rattus norvegicus
cgccaagtagaggtctcctggatga

SEQ ID NO: 644687 - DNA, 25 bp, Rattus norvegicus
agaggtctcctggatgaagcgctcc

SEQ ID NO: 644688 - DNA, 25 bp, Rattus norvegicus
agaactggctaagcacgctgtgtcg

SEQ ID NO: 644689 - DNA, 25 bp, Rattus norvegicus
ggttaccgtgacacaactctttatc

SEQ ID NO: 644690 - DNA, 25 bp, Rattus norvegicus
gcggctgactgcgacttatatcggg

SEQ ID NO: 644691 - DNA, 25 bp, Rattus norvegicus
tcgccgtccaaagtcccagggcaga

SEQ ID NO: 644692 - DNA, 25 bp, Rattus norvegicus
cagggcagaactcagctactcagct

SEQ ID NO: 644693 - DNA, 25 bp, Rattus norvegicus
tcagctaatgtttcccaggcccagg

SEQ ID NO: 644694 - DNA, 25 bp, Rattus norvegicus
ctatcctcgagggacacgtcctaga

SEQ ID NO: 644695 - DNA, 25 bp, Rattus norvegicus
cacgtcctagacttggcccgaagaa

SEQ ID NO: 644696 - DNA, 25 bp, Rattus norvegicus
ttatatcgggactggcctagaccta

SEQ ID NO: 644697 - DNA, 25 bp, Rattus norvegicus
tagacctagtcgagttccggtcctg

SEQ ID NO: 644698 - DNA, 25 bp, Rattus norvegicus
agcagggttatagacggcgctaagc

SEQ ID NO: 644699 - DNA, 25 bp, Rattus norvegicus
tccgccgaggaaggataccaaagaa

SEQ ID NO: 644700 - DNA, 25 bp, Rattus norvegicus
ctttatctgattctgtgggtggctc

SEQ ID NO: 644701 - DNA, 25 bp, Rattus norvegicus
agggcacacgacattcttactgttg

SEQ ID NO: 644702 - DNA, 25 bp, Rattus norvegicus
caacaggcactaccagagggaccca

SEQ ID NO: 644703 - DNA, 25 bp, Rattus norvegicus
ttcttcgggccaagtctaggacgtg

SEQ ID NO: 644704 - DNA, 25 bp, Rattus norvegicus
cccgatataagtcgcagtcagccgc

SEQ ID NO: 644705 - DNA, 25 bp, Rattus norvegicus
cggccagctctaggaatcatgggga

SEQ ID NO: 644706 - DNA, 25 bp, Rattus norvegicus
agctgagtagctgagttctgccctg

SEQ ID NO: 644707 - DNA, 25 bp, Rattus norvegicus
gtctaggacgtgtccctcgaggata

SEQ ID NO: 644708 - DNA, 25 bp, Rattus norvegicus
ctaggtctaggccagtcccgatata

SEQ ID NO: 644709 - DNA, 25 bp, Rattus norvegicus
caggaccggaactcgactaggtcta

SEQ ID NO: 644710 - DNA, 25 bp, Rattus norvegicus
agcgccgtctataaccctgctacta

SEQ ID NO: 644711 - DNA, 25 bp, Rattus norvegicus
ttctttggtatccttcctcggcgga

SEQ ID NO: 644712 - DNA, 25 bp, Rattus norvegicus
tgcctgttgctgttctttggtatcc

SEQ ID NO: 644713 - DNA, 25 bp, Rattus norvegicus
cccaacagtaagaatgtcgtgtgcc

SEQ ID NO: 644714 - DNA, 25 bp, Rattus norvegicus
ttgtgtcacggtaacccgtctcttg

SEQ ID NO: 644715 - DNA, 25 bp, Rattus norvegicus
gagccacccacagaatcagataaag

SEQ ID NO: 644716 - DNA, 25 bp, Rattus norvegicus
gggcctgggaaacattagctgagta

SEQ ID NO: 644717 - DNA, 25 bp, Rattus norvegicus
ccctggatgttatcccgcaagacct

SEQ ID NO: 644718 - DNA, 25 bp, Rattus norvegicus
cttgagagcgtacaccacatccatg

SEQ ID NO: 644719 - DNA, 25 bp, Rattus norvegicus
agagcgtacaccacatccatggcgg

SEQ ID NO: 644720 - DNA, 25 bp, Rattus norvegicus
agcgtacaccacatccatggcggtg

SEQ ID NO: 644721 - DNA, 25 bp, Rattus norvegicus
gcggcgctgcctagcctccgaagcc

SEQ ID NO: 644722 - DNA, 25 bp, Rattus norvegicus
ccgcaagaccttgcggtgacgcttg

SEQ ID NO: 644723 - DNA, 25 bp, Rattus norvegicus
gatgttatcccgcaagaccttgcgg

SEQ ID NO: 644724 - DNA, 25 bp, Rattus norvegicus
caagaccttgcggtgacgcttggcg

SEQ ID NO: 644725 - DNA, 25 bp, Rattus norvegicus
tagcctccgaagccgtacagggttc

SEQ ID NO: 644726 - DNA, 25 bp, Rattus norvegicus
cctggatgttatcccgcaagacctt

SEQ ID NO: 644727 - DNA, 25 bp, Rattus norvegicus
cgccacgccgagctaggcgacggat

SEQ ID NO: 644728 - DNA, 25 bp, Rattus norvegicus
tacaccacgggtctcctcatagatg

SEQ ID NO: 644729 - DNA, 25 bp, Rattus norvegicus
agtacaccacgggtctcctcataga

SEQ ID NO: 644730 - DNA, 25 bp, Rattus norvegicus
ttcagtacaccacgggtctcctcat

SEQ ID NO: 644731 - DNA, 25 bp, Rattus norvegicus
tataagtaaggccactaggcggctg

SEQ ID NO: 644732 - DNA, 25 bp, Rattus norvegicus
gtagctgtgtgttgcacttgatttt

SEQ ID NO: 644733 - DNA, 25 bp, Rattus norvegicus
tagtgtaaccatcttgaaacccagc

SEQ ID NO: 644734 - DNA, 25 bp, Rattus norvegicus
ttgaaacccagcaaataggatcgta

SEQ ID NO: 644735 - DNA, 25 bp, Rattus norvegicus
gatcgtattctatccaatcagactg

SEQ ID NO: 644736 - DNA, 25 bp, Rattus norvegicus
cagactgcaaatccagaaactcttg

SEQ ID NO: 644737 - DNA, 25 bp, Rattus norvegicus
tggcccaatcaagacgaagataagt

SEQ ID NO: 644738 - DNA, 25 bp, Rattus norvegicus
cggctgcaagccgaagtcgcaaaaa

SEQ ID NO: 644739 - DNA, 25 bp, Rattus norvegicus
agtcgcaaaaaacatggcccgtaca

SEQ ID NO: 644740 - DNA, 25 bp, Rattus norvegicus
gcgcgcctaagctatctctggttca

SEQ ID NO: 644741 - DNA, 25 bp, Rattus norvegicus
tggttcatcccaacaaaggctcttt

SEQ ID NO: 644742 - DNA, 25 bp, Rattus norvegicus
ttcagagccacctacgttatcaata

SEQ ID NO: 644743 - DNA, 25 bp, Rattus norvegicus
cgttatcaataagagtagctgtgtg

SEQ ID NO: 644744 - DNA, 25 bp, Rattus norvegicus
gaaactcttgttttctggcccaatc

SEQ ID NO: 644745 - DNA, 25 bp, Rattus norvegicus
ccatgtggtcttcgtgctggcggac

SEQ ID NO: 644746 - DNA, 25 bp, Rattus norvegicus
ctgcctaaggcagccactgcgcatg

SEQ ID NO: 644747 - DNA, 25 bp, Rattus norvegicus
agggcttccacaggcgctgcctaag

SEQ ID NO: 644748 - DNA, 25 bp, Rattus norvegicus
ggcttagtcggacagcgctcgccac

SEQ ID NO: 644749 - DNA, 25 bp, Rattus norvegicus
ccgcgagttggcacccgcgggctta

SEQ ID NO: 644750 - DNA, 25 bp, Rattus norvegicus
tcaccggccgctatcaggtaccagg

SEQ ID NO: 644751 - DNA, 25 bp, Rattus norvegicus
aactactacgtgcagccgctgtgca

SEQ ID NO: 644752 - DNA, 25 bp, Rattus norvegicus
gtggtcctggacaactactacgtgc

SEQ ID NO: 644753 - DNA, 25 bp, Rattus norvegicus
acttgggtttccacggctcggtcat

SEQ ID NO: 644754 - DNA, 25 bp, Rattus norvegicus
ggccgcggctgccactgttgctgct

SEQ ID NO: 644755 - DNA, 25 bp, Rattus norvegicus
ctcaggctcctcaggctgctaagga

SEQ ID NO: 644756 - DNA, 25 bp, Rattus norvegicus
gggcgctcagttcccgattctgccg

SEQ ID NO: 644757 - DNA, 25 bp, Rattus norvegicus
cccgcctaggtgaatgtagtcttgc

SEQ ID NO: 644758 - DNA, 25 bp, Rattus norvegicus
aagcagccgctgagtttgcccgcgc

SEQ ID NO: 644759 - DNA, 25 bp, Rattus norvegicus
gtggcaatccaacacgcctgcgcgg

SEQ ID NO: 644760 - DNA, 25 bp, Rattus norvegicus
ccaggtacaatacgcctgcgcgtga

SEQ ID NO: 644761 - DNA, 25 bp, Rattus norvegicus
tccgccctttaatcgtagtacgctg

SEQ ID NO: 644762 - DNA, 25 bp, Rattus norvegicus
accagcggtcgccagagccagcttt

SEQ ID NO: 644763 - DNA, 25 bp, Rattus norvegicus
cgcacggcagaaaggcggtgcttct

SEQ ID NO: 644764 - DNA, 25 bp, Rattus norvegicus
gcttctgggctccaggcgaatgcca

SEQ ID NO: 644765 - DNA, 25 bp, Rattus norvegicus
ctcgcggtaagtttgcgccaagtgc

SEQ ID NO: 644766 - DNA, 25 bp, Rattus norvegicus
gtctgcacacaaacaccaatgggtg

SEQ ID NO: 644767 - DNA, 25 bp, Rattus norvegicus
gaccagagaccgtggtctgcacaca

SEQ ID NO: 644768 - DNA, 25 bp, Rattus norvegicus
agccgagatccactgtgcaaccagc

SEQ ID NO: 644769 - DNA, 25 bp, Rattus norvegicus
aaatggagaccaagacgatcgtgta

SEQ ID NO: 644770 - DNA, 25 bp, Rattus norvegicus
cgatcgtgtacgacttggacacgtc

SEQ ID NO: 644771 - DNA, 25 bp, Rattus norvegicus
gagccagctttagcctgtgggccta

SEQ ID NO: 644772 - DNA, 25 bp, Rattus norvegicus
agcgcctaagcgaggcctcaggttc

SEQ ID NO: 644773 - DNA, 25 bp, Rattus norvegicus
aagggctcgaagaaagctgtcacga

SEQ ID NO: 644774 - DNA, 25 bp, Rattus norvegicus
accagccgcgatgtaacagtccgta

SEQ ID NO: 644775 - DNA, 25 bp, Rattus norvegicus
acagtccgtagttgcctcgtccatc

SEQ ID NO: 644776 - DNA, 25 bp, Rattus norvegicus
tgcctcgtccatcttacggtgagtc

SEQ ID NO: 644777 - DNA, 25 bp, Rattus norvegicus
cttacggtgagtctctaaacgcgga

SEQ ID NO: 644778 - DNA, 25 bp, Rattus norvegicus
taaacgcggaggaaaatgccggatc

SEQ ID NO: 644779 - DNA, 25 bp, Rattus norvegicus
atgccggatccagccaagtctgctc

SEQ ID NO: 644780 - DNA, 25 bp, Rattus norvegicus
ctgctcctgctccaaagaagggctc

SEQ ID NO: 644781 - DNA, 25 bp, Rattus norvegicus
gtcacgaaagtccagaagaaagatg

SEQ ID NO: 644782 - DNA, 25 bp, Rattus norvegicus
gccgtaaggaaagctactctgtcta

SEQ ID NO: 644783 - DNA, 25 bp, Rattus norvegicus
ggccatgggtatcatgaattccttc

SEQ ID NO: 644784 - DNA, 25 bp, Rattus norvegicus
gtatcatgaattccttcgtgaacga

SEQ ID NO: 644785 - DNA, 25 bp, Rattus norvegicus
tgaggcctcccgtctggcgcattac

SEQ ID NO: 644786 - DNA, 25 bp, Rattus norvegicus
ccaagtctgctcctgctccaaagaa

SEQ ID NO: 644787 - DNA, 25 bp, Rattus norvegicus
taccagaggaaatcggacacgcacc

SEQ ID NO: 644788 - DNA, 25 bp, Rattus norvegicus
tgcttgcattgtgcgcaggtgacca

SEQ ID NO: 644789 - DNA, 25 bp, Rattus norvegicus
gacacgaccgcgtgctgcttgcatt

SEQ ID NO: 644790 - DNA, 25 bp, Rattus norvegicus
cccgagcattggcaaggatgacacg

SEQ ID NO: 644791 - DNA, 25 bp, Rattus norvegicus
tccgccgagaaggattcgtgtcacg

SEQ ID NO: 644792 - DNA, 25 bp, Rattus norvegicus
cacgctttatgctttcgcagaccca

SEQ ID NO: 644793 - DNA, 25 bp, Rattus norvegicus
cactcgcgaagactgagagcctctc

SEQ ID NO: 644794 - DNA, 25 bp, Rattus norvegicus
tggggcccttccctataccagagga

SEQ ID NO: 644795 - DNA, 25 bp, Rattus norvegicus
ccactattacggtgcgctttgaatg

SEQ ID NO: 644796 - DNA, 25 bp, Rattus norvegicus
ttaggcgggactttgaatctgctcc

SEQ ID NO: 644797 - DNA, 25 bp, Rattus norvegicus
tcaatccactcttgtcggctagggg

SEQ ID NO: 644798 - DNA, 25 bp, Rattus norvegicus
ggcgctcgagcgcactgatcagact

SEQ ID NO: 644799 - DNA, 25 bp, Rattus norvegicus
tgctctccagcagatgcgaaataaa

SEQ ID NO: 644800 - DNA, 25 bp, Rattus norvegicus
agcctctcgtgatgctgctctccag

SEQ ID NO: 644801 - DNA, 25 bp, Rattus norvegicus
cgcgagggatttcgcgcgcggcgtg

SEQ ID NO: 644802 - DNA, 25 bp, Rattus norvegicus
gttttctaggtgtgagcaaagtgcc

SEQ ID NO: 644803 - DNA, 25 bp, Rattus norvegicus
ctcacctgccgcggaaacgcgaggg

SEQ ID NO: 644804 - DNA, 25 bp, Rattus norvegicus
gtggtgtcaccgttgggtgcttggc

SEQ ID NO: 644805 - DNA, 25 bp, Rattus norvegicus
gcaaagtgccggaacggcgtataca

SEQ ID NO: 644806 - DNA, 25 bp, Rattus norvegicus
tatacatctctagggggccgcgatc

SEQ ID NO: 644807 - DNA, 25 bp, Rattus norvegicus
aaagtgccggaacggcgtatacatc

SEQ ID NO: 644808 - DNA, 25 bp, Rattus norvegicus
tgccggaacggcgtatacatctcta

SEQ ID NO: 644809 - DNA, 25 bp, Rattus norvegicus
ccggaacggcgtatacatctctagg

SEQ ID NO: 644810 - DNA, 25 bp, Rattus norvegicus
cggaacggcgtatacatctctaggg

SEQ ID NO: 644811 - DNA, 25 bp, Rattus norvegicus
ggaacggcgtatacatctctagggg

SEQ ID NO: 644812 - DNA, 25 bp, Rattus norvegicus
aacggcgtatacatctctagggggc

SEQ ID NO: 644813 - DNA, 25 bp, Rattus norvegicus
ctaggtgtgagcaaagtgccggaac

SEQ ID NO: 644814 - DNA, 25 bp, Rattus norvegicus
tttctaggtgtgagcaaagtgccgg

SEQ ID NO: 644815 - DNA, 25 bp, Rattus norvegicus
tgggcaaccagttagcggtaagaga

SEQ ID NO: 644816 - DNA, 25 bp, Rattus norvegicus
gcaaacgagaaagttcgacaggccc

SEQ ID NO: 644817 - DNA, 25 bp, Rattus norvegicus
atcgatcagtcacaaggatgctggg

SEQ ID NO: 644818 - DNA, 25 bp, Rattus norvegicus
ggacctagaggtgggcaaccagtta

SEQ ID NO: 644819 - DNA, 25 bp, Rattus norvegicus
cccaacacgatcgatcagtcacaag

SEQ ID NO: 644820 - DNA, 25 bp, Rattus norvegicus
ccagttagcggtaagagaggatgca

SEQ ID NO: 644821 - DNA, 25 bp, Rattus norvegicus
cggtaagagaggatgcaagatgatt

SEQ ID NO: 644822 - DNA, 25 bp, Rattus norvegicus
gtccatacccaacacgatcgatcag

SEQ ID NO: 644823 - DNA, 25 bp, Rattus norvegicus
atgcaagatgattcgtctctggtcc

SEQ ID NO: 644824 - DNA, 25 bp, Rattus norvegicus
agatgattcgtctctggtccttcaa

SEQ ID NO: 644825 - DNA, 25 bp, Rattus norvegicus
attcgtctctggtccttcaacgctc

SEQ ID NO: 644826 - DNA, 25 bp, Rattus norvegicus
ggtccttcaacgctccagcaccgcg

SEQ ID NO: 644827 - DNA, 25 bp, Rattus norvegicus
cagcaccgcgcaaacgagaaagttc

SEQ ID NO: 644828 - DNA, 25 bp, Rattus norvegicus
accgcgcaaacgagaaagttcgaca

SEQ ID NO: 644829 - DNA, 25 bp, Rattus norvegicus
ctcgcgtttccgcagagagcgcgga

SEQ ID NO: 644830 - DNA, 25 bp, Rattus norvegicus
taagctacacacgatcgccatacca

SEQ ID NO: 644831 - DNA, 25 bp, Rattus norvegicus
tgtctcattcgccatacctgtgctc

SEQ ID NO: 644832 - DNA, 25 bp, Rattus norvegicus
attcgccatacctgtgctcctctga

SEQ ID NO: 644833 - DNA, 25 bp, Rattus norvegicus
tgctcctctgacacccgcggacccg

SEQ ID NO: 644834 - DNA, 25 bp, Rattus norvegicus
ttcctcgccgcgacgaaatccctcg

SEQ ID NO: 644835 - DNA, 25 bp, Rattus norvegicus
agagagcgcggacccggcagaccct

SEQ ID NO: 644836 - DNA, 25 bp, Rattus norvegicus
taggccacgcccaggaccgtgactt

SEQ ID NO: 644837 - DNA, 25 bp, Rattus norvegicus
cccaggaccgtgacttcaaggatga

SEQ ID NO: 644838 - DNA, 25 bp, Rattus norvegicus
cgtgacttcaaggatgacgtctggt

SEQ ID NO: 644839 - DNA, 25 bp, Rattus norvegicus
tggtcatctatctttctgcgccttc

SEQ ID NO: 644840 - DNA, 25 bp, Rattus norvegicus
cgcacggtcactaagctacacacga

SEQ ID NO: 644841 - DNA, 25 bp, Rattus norvegicus
atctatctttctgcgccttcctggc

SEQ ID NO: 644842 - DNA, 25 bp, Rattus norvegicus
gacgtctggtcatctatctttctgc

SEQ ID NO: 644843 - DNA, 25 bp, Rattus norvegicus
ccaggaaggcgcagaaagatagatg

SEQ ID NO: 644844 - DNA, 25 bp, Rattus norvegicus
accagacgtcatccttgaagtcacg

SEQ ID NO: 644845 - DNA, 25 bp, Rattus norvegicus
gtcatccttgaagtcacggtcctgg

SEQ ID NO: 644846 - DNA, 25 bp, Rattus norvegicus
tccttgaagtcacggtcctgggcgt

SEQ ID NO: 644847 - DNA, 25 bp, Rattus norvegicus
agtcacggtcctgggcgtggcctat

SEQ ID NO: 644848 - DNA, 25 bp, Rattus norvegicus
agggtctgccgggtccgcgctctct

SEQ ID NO: 644849 - DNA, 25 bp, Rattus norvegicus
tcgtgtgtagcttagtgaccgtgcg

SEQ ID NO: 644850 - DNA, 25 bp, Rattus norvegicus
tccgcgctctctgcggaaacgcgag

SEQ ID NO: 644851 - DNA, 25 bp, Rattus norvegicus
acgcgagggatttcgtcgcggcgag

SEQ ID NO: 644852 - DNA, 25 bp, Rattus norvegicus
tcagaggagcacaggtatggcgaat

SEQ ID NO: 644853 - DNA, 25 bp, Rattus norvegicus
gagcacaggtatggcgaatgagaca

SEQ ID NO: 644854 - DNA, 25 bp, Rattus norvegicus
gcagaaagatagatgaccagacgtc

SEQ ID NO: 644855 - DNA, 25 bp, Rattus norvegicus
ggcgatcgtgtgtagcttagtgacc

SEQ ID NO: 644856 - DNA, 25 bp, Rattus norvegicus
tggtatggcgatcgtgtgtagctta

SEQ ID NO: 644857 - DNA, 25 bp, Rattus norvegicus
ccgacctctggatatcagcgggatc

SEQ ID NO: 644858 - DNA, 25 bp, Rattus norvegicus
actccagtgagcattgtggccagcc

SEQ ID NO: 644859 - DNA, 25 bp, Rattus norvegicus
ccaacggctgactccagtgagcatt

SEQ ID NO: 644860 - DNA, 25 bp, Rattus norvegicus
cgtgcggtctggtaattccagtttc

SEQ ID NO: 644861 - DNA, 25 bp, Rattus norvegicus
cagttcattgcggtcgcgcgagctc

SEQ ID NO: 644862 - DNA, 25 bp, Rattus norvegicus
gccagcagcacgtgcgcagttcatt

SEQ ID NO: 644863 - DNA, 25 bp, Rattus norvegicus
tatcagcgggatctcagcatcagga

SEQ ID NO: 644864 - DNA, 25 bp, Rattus norvegicus
tccgtggctccagcacacacttgga

SEQ ID NO: 644865 - DNA, 25 bp, Rattus norvegicus
gcttctttatctctgggcgcccagg

SEQ ID NO: 644866 - DNA, 25 bp, Rattus norvegicus
taccctttatagcacagtaggcttc

SEQ ID NO: 644867 - DNA, 25 bp, Rattus norvegicus
cttggggtctgcgaaagatcatacc

SEQ ID NO: 644868 - DNA, 25 bp, Rattus norvegicus
agctcctcgtcgtcggtacctgctt

SEQ ID NO: 644869 - DNA, 25 bp, Rattus norvegicus
acacacttggagtgaccagctcctc

SEQ ID NO: 644870 - DNA, 25 bp, Rattus norvegicus
ctcagcatcaggaggtgccagcagc

SEQ ID NO: 644871 - DNA, 25 bp, Rattus norvegicus
gctcccaacgcagtggggaccaatc

SEQ ID NO: 644872 - DNA, 25 bp, Rattus norvegicus
agacgctccgcggttcgcacaggat

SEQ ID NO: 644873 - DNA, 25 bp, Rattus norvegicus
cgcacaggatgctggcctaagcttc

SEQ ID NO: 644874 - DNA, 25 bp, Rattus norvegicus
ctggcctaagcttcaccagggcggg

SEQ ID NO: 644875 - DNA, 25 bp, Rattus norvegicus
tctgcgcccagcgaggagaaaacgc

SEQ ID NO: 644876 - DNA, 25 bp, Rattus norvegicus
aaacgcagagggcagcgcaagaccc

SEQ ID NO: 644877 - DNA, 25 bp, Rattus norvegicus
cgcaagacccgacggaactggattg

SEQ ID NO: 644878 - DNA, 25 bp, Rattus norvegicus
acccgacggaactggattgaggctc

SEQ ID NO: 644879 - DNA, 25 bp, Rattus norvegicus
ttgaggctcagccaacagcaccagg

SEQ ID NO: 644880 - DNA, 25 bp, Rattus norvegicus
gccaacagcaccaggaccgagcaag

SEQ ID NO: 644881 - DNA, 25 bp, Rattus norvegicus
ccaggaccgagcaagtgcatgaaga

SEQ ID NO: 644882 - DNA, 25 bp, Rattus norvegicus
tgcatgaagactcgtcgccgggcac

SEQ ID NO: 644883 - DNA, 25 bp, Rattus norvegicus
cttctgccggacgacaggcaggaca

SEQ ID NO: 644884 - DNA, 25 bp, Rattus norvegicus
gggaccaatcacttctgccggacga

SEQ ID NO: 644885 - DNA, 25 bp, Rattus norvegicus
tcaacgtcggttccttgttcaggcg

SEQ ID NO: 644886 - DNA, 25 bp, Rattus norvegicus
tcccatgggttttcgggactgagta

SEQ ID NO: 644887 - DNA, 25 bp, Rattus norvegicus
cagtgtcgcaaggtagagccaagtc

SEQ ID NO: 644888 - DNA, 25 bp, Rattus norvegicus
tttctcctcgcctgctagggtaagg

SEQ ID NO: 644889 - DNA, 25 bp, Rattus norvegicus
gccaagtccttgctcgcttaaagtc

SEQ ID NO: 644890 - DNA, 25 bp, Rattus norvegicus
ggaaggttcttctccttgcaaaaca

SEQ ID NO: 644891 - DNA, 25 bp, Rattus norvegicus
gcgacttgtcgatacttttctttta

SEQ ID NO: 644892 - DNA, 25 bp, Rattus norvegicus
ctagagcgtttacccgtgtttcaat

SEQ ID NO: 644893 - DNA, 25 bp, Rattus norvegicus
tggagcaacggtcccactagagcgt

SEQ ID NO: 644894 - DNA, 25 bp, Rattus norvegicus
tccacggagcaagccagtgtgtaaa

SEQ ID NO: 644895 - DNA, 25 bp, Rattus norvegicus
cagtaggagccctttagctgttttc

SEQ ID NO: 644896 - DNA, 25 bp, Rattus norvegicus
tcttccaggtttccgagtcacttta

SEQ ID NO: 644897 - DNA, 25 bp, Rattus norvegicus
cgaggccattctcgcaggcgcagta

SEQ ID NO: 644898 - DNA, 25 bp, Rattus norvegicus
ggccgcaaaaaagctgaccgacagt

SEQ ID NO: 644899 - DNA, 25 bp, Rattus norvegicus
acaagcgcccaacggtgacatcacg

SEQ ID NO: 644900 - DNA, 25 bp, Rattus norvegicus
tcgcgccgtccgatcgccggcctcc

SEQ ID NO: 644901 - DNA, 25 bp, Rattus norvegicus
atccctcgcgtttccccctgtggct

SEQ ID NO: 644902 - DNA, 25 bp, Rattus norvegicus
ccactgcgcggcgaaatccctcgcg

SEQ ID NO: 644903 - DNA, 25 bp, Rattus norvegicus
acccgtgctctctcccactgcgcgg

SEQ ID NO: 644904 - DNA, 25 bp, Rattus norvegicus
ggaacccgtgctctctcccactgcg

SEQ ID NO: 644905 - DNA, 25 bp, Rattus norvegicus
acttcgcgccgtccgatcgccggcc

SEQ ID NO: 644906 - DNA, 25 bp, Rattus norvegicus
cacacctgggaacccgtgctctctc

SEQ ID NO: 644907 - DNA, 25 bp, Rattus norvegicus
gctcacacctgggaacccgtgctct

SEQ ID NO: 644908 - DNA, 25 bp, Rattus norvegicus
tccgctcacacctgggaacccgtgc

SEQ ID NO: 644909 - DNA, 25 bp, Rattus norvegicus
gctccgctcacacctgggaacccgt

SEQ ID NO: 644910 - DNA, 25 bp, Rattus norvegicus
ccgcgctccgctcacacctgggaac

SEQ ID NO: 644911 - DNA, 25 bp, Rattus norvegicus
tcccacactcggttcccgcgctccg

SEQ ID NO: 644912 - DNA, 25 bp, Rattus norvegicus
gcgtcccacactcggttcccgcgct

SEQ ID NO: 644913 - DNA, 25 bp, Rattus norvegicus
tgcccgttgatgagccaggcgtcac

SEQ ID NO: 644914 - DNA, 25 bp, Rattus norvegicus
gatcgcccagttgctagttagtttg

SEQ ID NO: 644915 - DNA, 25 bp, Rattus norvegicus
accgattttgccaccgagacagtga

SEQ ID NO: 644916 - DNA, 25 bp, Rattus norvegicus
tttgactcaccgcaaagaagccgcg

SEQ ID NO: 644917 - DNA, 25 bp, Rattus norvegicus
ggccgccaccgactgttacacttaa

SEQ ID NO: 644918 - DNA, 25 bp, Rattus norvegicus
ggagcgatgacctttacctgtctga

SEQ ID NO: 644919 - DNA, 25 bp, Rattus norvegicus
gtccattgcagagcccgagcacgga

SEQ ID NO: 644920 - DNA, 25 bp, Rattus norvegicus
ctgcgaaggagtccaagtgcgcttt

SEQ ID NO: 644921 - DNA, 25 bp, Rattus norvegicus
caggcgtcaccagggttccacatct

SEQ ID NO: 644922 - DNA, 25 bp, Rattus norvegicus
accgcgggtagctgctctaaaggaa

SEQ ID NO: 644923 - DNA, 25 bp, Rattus norvegicus
acagagacaccgagctgcccgttga

SEQ ID NO: 644924 - DNA, 25 bp, Rattus norvegicus
cgcgtgatgcgctaaccgattttgc

SEQ ID NO: 644925 - DNA, 25 bp, Rattus norvegicus
aatttttcgaatcccaccacgcgtg

SEQ ID NO: 644926 - DNA, 25 bp, Rattus norvegicus
ttccacatctgggatgaccgcagga

SEQ ID NO: 644927 - DNA, 25 bp, Rattus norvegicus
ttcacaagactagagggcgctccca

SEQ ID NO: 644928 - DNA, 25 bp, Rattus norvegicus
gtctactacaacctggtgaaggccc

SEQ ID NO: 644929 - DNA, 25 bp, Rattus norvegicus
gtgcttgtctactacaacctggtga

SEQ ID NO: 644930 - DNA, 25 bp, Rattus norvegicus
agcactgccggcatggagacgctgc

SEQ ID NO: 644931 - DNA, 25 bp, Rattus norvegicus
ctccaaggtgtttcgcctaggcaga

SEQ ID NO: 644932 - DNA, 25 bp, Rattus norvegicus
ccgccaggtgagaccataggggaac

SEQ ID NO: 644933 - DNA, 25 bp, Rattus norvegicus
ggcgctcccacgactccaaggtgtt

SEQ ID NO: 644934 - DNA, 25 bp, Rattus norvegicus
ggcgcctacgtgcttgtctactaca

SEQ ID NO: 644935 - DNA, 25 bp, Rattus norvegicus
gttcccgggagttcacaagactaga

SEQ ID NO: 644936 - DNA, 25 bp, Rattus norvegicus
cctagcacgcgttcccgggagttca

SEQ ID NO: 644937 - DNA, 25 bp, Rattus norvegicus
tttccggtacataccctagcacgcg

SEQ ID NO: 644938 - DNA, 25 bp, Rattus norvegicus
tccacgcagatatttccggtacata

SEQ ID NO: 644939 - DNA, 25 bp, Rattus norvegicus
ccacgactccaaggtgtttcgccta

SEQ ID NO: 644940 - DNA, 25 bp, Rattus norvegicus
gtgtttcgcctaggcagaccgccag

SEQ ID NO: 644941 - DNA, 25 bp, Rattus norvegicus
ttcagcttgcggttctccttggccg

SEQ ID NO: 644942 - DNA, 25 bp, Rattus norvegicus
cagtcccagtccgtgccgcgtgtgt

SEQ ID NO: 644943 - DNA, 25 bp, Rattus norvegicus
agttgatcctggaagcgctttttcc

SEQ ID NO: 644944 - DNA, 25 bp, Rattus norvegicus
cgcagacgtggaagaagttgatcct

SEQ ID NO: 644945 - DNA, 25 bp, Rattus norvegicus
gccgaccctcgtctgctcccgccct

SEQ ID NO: 644946 - DNA, 25 bp, Rattus norvegicus
cacccacaccctcccgggccctgca

SEQ ID NO: 644947 - DNA, 25 bp, Rattus norvegicus
tcgcggggatctcgcgtcacccaca

SEQ ID NO: 644948 - DNA, 25 bp, Rattus norvegicus
gacaactcccccaaagtgcgtgagg

SEQ ID NO: 644949 - DNA, 25 bp, Rattus norvegicus
gcagcccactcttcagcttgcggtt

SEQ ID NO: 644950 - DNA, 25 bp, Rattus norvegicus
caccggctacgatccacgatccgca

SEQ ID NO: 644951 - DNA, 25 bp, Rattus norvegicus
agtccgtgccgcgtgtgtctcaccg

SEQ ID NO: 644952 - DNA, 25 bp, Rattus norvegicus
actcttcagcttgcggttctccttg

SEQ ID NO: 644953 - DNA, 25 bp, Rattus norvegicus
tccacgatccgcactcagacaactc

SEQ ID NO: 644954 - DNA, 25 bp, Rattus norvegicus
gctttaaaaacaccgcagcccactc

SEQ ID NO: 644955 - DNA, 25 bp, Rattus norvegicus
cctcaggtggcttgtgtcgcgccct

SEQ ID NO: 644956 - DNA, 25 bp, Rattus norvegicus
gccgagtacgtctcgtccactctga

SEQ ID NO: 644957 - DNA, 25 bp, Rattus norvegicus
gctgcaatgccgagtacgtctcgtc

SEQ ID NO: 644958 - DNA, 25 bp, Rattus norvegicus
ctcgtccactctgagccttcgggga

SEQ ID NO: 644959 - DNA, 25 bp, Rattus norvegicus
caccggacacgccacatggaggcgg

SEQ ID NO: 644960 - DNA, 25 bp, Rattus norvegicus
cccagatccctgtgactatgaagcc

SEQ ID NO: 644961 - DNA, 25 bp, Rattus norvegicus
tgcgctcctacgctctctgcacgcg

SEQ ID NO: 644962 - DNA, 25 bp, Rattus norvegicus
ggacctcgctttccactccgcggtg

SEQ ID NO: 644963 - DNA, 25 bp, Rattus norvegicus
cggtgcatggcatagaggacctgat

SEQ ID NO: 644964 - DNA, 25 bp, Rattus norvegicus
ggacctgatgatccagcacaactgc

SEQ ID NO: 644965 - DNA, 25 bp, Rattus norvegicus
tgatgatccagcacaactgctcacg

SEQ ID NO: 644966 - DNA, 25 bp, Rattus norvegicus
aactgctcacgccagggtcccacgg

SEQ ID NO: 644967 - DNA, 25 bp, Rattus norvegicus
ctgtgactatgaagcccggttttcc

SEQ ID NO: 644968 - DNA, 25 bp, Rattus norvegicus
gggctcaccggacacgccacatgga

SEQ ID NO: 644969 - DNA, 25 bp, Rattus norvegicus
ttagaggcctggtaaacaaggacca

SEQ ID NO: 644970 - DNA, 25 bp, Rattus norvegicus
tatataatgccgtttccggctcccg

SEQ ID NO: 644971 - DNA, 25 bp, Rattus norvegicus
gcaaggctgcgcacccgaacaacaa

SEQ ID NO: 644972 - DNA, 25 bp, Rattus norvegicus
tgcgcacccgaacaacaaccatttt

SEQ ID NO: 644973 - DNA, 25 bp, Rattus norvegicus
ccgctaagagcacactgtgtccacg

SEQ ID NO: 644974 - DNA, 25 bp, Rattus norvegicus
taagagcacactgtgtccacgcgcc

SEQ ID NO: 644975 - DNA, 25 bp, Rattus norvegicus
tctgcggcctcgctgattggttaga

SEQ ID NO: 644976 - DNA, 25 bp, Rattus norvegicus
gctgattggttagaggcctggtaaa

SEQ ID NO: 644977 - DNA, 25 bp, Rattus norvegicus
ccaagtagccaatgggagaactgtg

SEQ ID NO: 644978 - DNA, 25 bp, Rattus norvegicus
tgtgcacgagggatgcacgagcctc

SEQ ID NO: 644979 - DNA, 25 bp, Rattus norvegicus
ccagcactcgcgtggagcgtcaagc

SEQ ID NO: 644980 - DNA, 25 bp, Rattus norvegicus
gagcgtcaagccaggcggctatata

SEQ ID NO: 644981 - DNA, 25 bp, Rattus norvegicus
ccaggcggctatataatgccgtttc

SEQ ID NO: 644982 - DNA, 25 bp, Rattus norvegicus
gtaaacaaggaccaagtagccaatg

SEQ ID NO: 644983 - DNA, 25 bp, Rattus norvegicus
cgaccctcagaacaaggcgcgaatg

SEQ ID NO: 644984 - DNA, 25 bp, Rattus norvegicus
ggcgcgaatggtacgctatctcttg

SEQ ID NO: 644985 - DNA, 25 bp, Rattus norvegicus
gtctttctcggcgtcacagcactga

SEQ ID NO: 644986 - DNA, 25 bp, Rattus norvegicus
ggatcccaacatcgcagaccgttta

SEQ ID NO: 644987 - DNA, 25 bp, Rattus norvegicus
gtttaggacgcaccgcgctcatgca

SEQ ID NO: 644988 - DNA, 25 bp, Rattus norvegicus
gagacccttgccacactgctggacg

SEQ ID NO: 644989 - DNA, 25 bp, Rattus norvegicus
agggcacggaggtcatcatcataac

SEQ ID NO: 644990 - DNA, 25 bp, Rattus norvegicus
tcgggcaccaagaagaccaggcagt

SEQ ID NO: 644991 - DNA, 25 bp, Rattus norvegicus
gctcctcctagtccaggggtctgca

SEQ ID NO: 644992 - DNA, 25 bp, Rattus norvegicus
cgtctggccgctgaattcaatggct

SEQ ID NO: 644993 - DNA, 25 bp, Rattus norvegicus
ttcaatggcttgaccctgaccggta

SEQ ID NO: 644994 - DNA, 25 bp, Rattus norvegicus
tatctcttggagcaaggcgcggatc

SEQ ID NO: 644995 - DNA, 25 bp, Rattus norvegicus
ggagtctggtcttccttcagggcta

SEQ ID NO: 644996 - DNA, 25 bp, Rattus norvegicus
ctgaccggtagaccgcgtctttctc

SEQ ID NO: 644997 - DNA, 25 bp, Rattus norvegicus
gcactctacgagcactgaggccggg

SEQ ID NO: 644998 - DNA, 25 bp, Rattus norvegicus
ccggctcttgctcactggggtggct

SEQ ID NO: 644999 - DNA, 25 bp, Rattus norvegicus
gctgggaccgttagctcgccaggct

SEQ ID NO: 645000 - DNA, 25 bp, Rattus norvegicus
tagctcgccaggctggcaggctccg

SEQ ID NO: 645001 - DNA, 25 bp, Rattus norvegicus
ccagccgccgggatggagactatgc

SEQ ID NO: 645002 - DNA, 25 bp, Rattus norvegicus
ccgggatggagactatgcgagcaca

SEQ ID NO: 645003 - DNA, 25 bp, Rattus norvegicus
agactatgcgagcacagcggctgca

SEQ ID NO: 645004 - DNA, 25 bp, Rattus norvegicus
tatgcgagcacagcggctgcagccc

SEQ ID NO: 645005 - DNA, 25 bp, Rattus norvegicus
agaggcactctacgagcactgaggc

SEQ ID NO: 645006 - DNA, 25 bp, Rattus norvegicus
ttgactgacagctggatcccggcac

SEQ ID NO: 645007 - DNA, 25 bp, Rattus norvegicus
cctctcttgactgacagctggatcc

SEQ ID NO: 645008 - DNA, 25 bp, Rattus norvegicus
atctggctcgttcccgccctctctt

SEQ ID NO: 645009 - DNA, 25 bp, Rattus norvegicus
agtctcccggctcttgctcactggg

SEQ ID NO: 645010 - DNA, 25 bp, Rattus norvegicus
gcgggagaggcactctacgagcact

SEQ ID NO: 645011 - DNA, 25 bp, Rattus norvegicus
gtcttcctgccgtggtttgtccctc

SEQ ID NO: 645012 - DNA, 25 bp, Rattus norvegicus
gccgtggtttgtccctcgcgaagcc

SEQ ID NO: 645013 - DNA, 25 bp, Rattus norvegicus
cgggctgccgctgtcatggacgcct

SEQ ID NO: 645014 - DNA, 25 bp, Rattus norvegicus
ctccggctggttggtcttcctgccg

SEQ ID NO: 645015 - DNA, 25 bp, Rattus norvegicus
ccgctgtcatggacgcctgggtccg

SEQ ID NO: 645016 - DNA, 25 bp, Rattus norvegicus
attccgcttcaaggctggctccggc

SEQ ID NO: 645017 - DNA, 25 bp, Rattus norvegicus
ctgggtccgctttagtgctcagagc

SEQ ID NO: 645018 - DNA, 25 bp, Rattus norvegicus
gtccgctttagtgctcagagccaag

SEQ ID NO: 645019 - DNA, 25 bp, Rattus norvegicus
agtgctcagagccaagcccgggagc

SEQ ID NO: 645020 - DNA, 25 bp, Rattus norvegicus
ctacggggtccctaagggtcagctg

SEQ ID NO: 645021 - DNA, 25 bp, Rattus norvegicus
cacgatctcacttcgcgtcctgaaa

SEQ ID NO: 645022 - DNA, 25 bp, Rattus norvegicus
tcgcgtcctgaaattccgcttcaag

SEQ ID NO: 645023 - DNA, 25 bp, Rattus norvegicus
tccctaagggtcagctgtggctacg

SEQ ID NO: 645024 - DNA, 25 bp, Rattus norvegicus
gttgctcgcccaggaggcgtgactt

SEQ ID NO: 645025 - DNA, 25 bp, Rattus norvegicus
aacacagcctgtcgggaaatgactc

SEQ ID NO: 645026 - DNA, 25 bp, Rattus norvegicus
gaagaagtggccgagctgagagctc

SEQ ID NO: 645027 - DNA, 25 bp, Rattus norvegicus
gggaagcagccagcctgcgacagca

SEQ ID NO: 645028 - DNA, 25 bp, Rattus norvegicus
gccagcctgcgacagcacgagaaga

SEQ ID NO: 645029 - DNA, 25 bp, Rattus norvegicus
acagcacgagaagacgcgaggctca

SEQ ID NO: 645030 - DNA, 25 bp, Rattus norvegicus
agacgcgaggctcactggtggccca

SEQ ID NO: 645031 - DNA, 25 bp, Rattus norvegicus
tcactggtggcccaggcgcaggctt

SEQ ID NO: 645032 - DNA, 25 bp, Rattus norvegicus
gcttggggccaggagctcaaagtta

SEQ ID NO: 645033 - DNA, 25 bp, Rattus norvegicus
tggagaagtacaacacagcctgtcg

SEQ ID NO: 645034 - DNA, 25 bp, Rattus norvegicus
agcctgtcgggaaatgactcgattg

SEQ ID NO: 645035 - DNA, 25 bp, Rattus norvegicus
aaatgactcgattgcgggacaccgc

SEQ ID NO: 645036 - DNA, 25 bp, Rattus norvegicus
gacaccgcagcggaggaacgtcgcc

SEQ ID NO: 645037 - DNA, 25 bp, Rattus norvegicus
aacgtcgccgcagcgaggaactggc

SEQ ID NO: 645038 - DNA, 25 bp, Rattus norvegicus
ctcaaagttatgctggagaagtaca

SEQ ID NO: 645039 - DNA, 25 bp, Rattus norvegicus
tgcagcgtccagctgtcggaccgaa

SEQ ID NO: 645040 - DNA, 25 bp, Rattus norvegicus
cagaactctggggtttcgctaacta

SEQ ID NO: 645041 - DNA, 25 bp, Rattus norvegicus
aactctgcgggtaagtcctgctttc

SEQ ID NO: 645042 - DNA, 25 bp, Rattus norvegicus
ggcgcctgcgatgtctcaagatggc

SEQ ID NO: 645043 - DNA, 25 bp, Rattus norvegicus
aacttgccgagatctccggaggaca

SEQ ID NO: 645044 - DNA, 25 bp, Rattus norvegicus
cagagtgcattgctcccagagttga

SEQ ID NO: 645045 - DNA, 25 bp, Rattus norvegicus
gggaacagccgcctccaacagtttg

SEQ ID NO: 645046 - DNA, 25 bp, Rattus norvegicus
ctacgcttgtagttgctgtgtattc

SEQ ID NO: 645047 - DNA, 25 bp, Rattus norvegicus
ggcgctagcaggagctacgcttgta

SEQ ID NO: 645048 - DNA, 25 bp, Rattus norvegicus
tcaagcctcgagtcctgtggcgcta

SEQ ID NO: 645049 - DNA, 25 bp, Rattus norvegicus
aactttgttgcctgtcaagcctcga

SEQ ID NO: 645050 - DNA, 25 bp, Rattus norvegicus
ctgctttccgcacccaactttgttg

SEQ ID NO: 645051 - DNA, 25 bp, Rattus norvegicus
tcggaccgaactccagccgtgcaga

SEQ ID NO: 645052 - DNA, 25 bp, Rattus norvegicus
ggcagttccggatactttccctcca

SEQ ID NO: 645053 - DNA, 25 bp, Rattus norvegicus
tttcttctgccacttttgtaagggc

SEQ ID NO: 645054 - DNA, 25 bp, Rattus norvegicus
atcctccgcagaggcgaaaaatggc

SEQ ID NO: 645055 - DNA, 25 bp, Rattus norvegicus
atgcggaagggtcagagcacagacc

SEQ ID NO: 645056 - DNA, 25 bp, Rattus norvegicus
tcagagcacagaccgctctagccga

SEQ ID NO: 645057 - DNA, 25 bp, Rattus norvegicus
tctagccgaccgtgtcggtggtttc

SEQ ID NO: 645058 - DNA, 25 bp, Rattus norvegicus
ttccggagacgctctttctttcctc

SEQ ID NO: 645059 - DNA, 25 bp, Rattus norvegicus
actcacgtgacccttgcgggccttg

SEQ ID NO: 645060 - DNA, 25 bp, Rattus norvegicus
ttttgtaagggcgaggtcaatccca

SEQ ID NO: 645061 - DNA, 25 bp, Rattus norvegicus
tcaatcccaaactaccggtaagagc

SEQ ID NO: 645062 - DNA, 25 bp, Rattus norvegicus
gaaaccgggtcttaagctgcccgca

SEQ ID NO: 645063 - DNA, 25 bp, Rattus norvegicus
ttaagctgcccgcacacccgtgatt

SEQ ID NO: 645064 - DNA, 25 bp, Rattus norvegicus
acccgtgattcccttgacaccggtg

SEQ ID NO: 645065 - DNA, 25 bp, Rattus norvegicus
tgattcccttgacaccggtgtcctc

SEQ ID NO: 645066 - DNA, 25 bp, Rattus norvegicus
ctttcggacatcctccgcagaggcg

SEQ ID NO: 645067 - DNA, 25 bp, Rattus norvegicus
acttactggagctgaaaatggtgca

SEQ ID NO: 645068 - DNA, 25 bp, Rattus norvegicus
ccgctagagtcgcttgttctgagag

SEQ ID NO: 645069 - DNA, 25 bp, Rattus norvegicus
ttctgagagctggatgcacttgccc

SEQ ID NO: 645070 - DNA, 25 bp, Rattus norvegicus
agctggatgcacttgccctccagtc

SEQ ID NO: 645071 - DNA, 25 bp, Rattus norvegicus
ccgcgaacttctgagtagctgctga

SEQ ID NO: 645072 - DNA, 25 bp, Rattus norvegicus
cacagcctccagcatgcgcgtgtgg

SEQ ID NO: 645073 - DNA, 25 bp, Rattus norvegicus
gtgtcctggcttctctggcttactg

SEQ ID NO: 645074 - DNA, 25 bp, Rattus norvegicus
tggcttactgcttccaccagcggag

SEQ ID NO: 645075 - DNA, 25 bp, Rattus norvegicus
cggtggaccgcaacttactggagct

SEQ ID NO: 645076 - DNA, 25 bp, Rattus norvegicus
tcgggccttactgtcgccgggtcgc

SEQ ID NO: 645077 - DNA, 25 bp, Rattus norvegicus
aatggtgcaggtggtgtttcgacac

SEQ ID NO: 645078 - DNA, 25 bp, Rattus norvegicus
acacggggcacggagtccgctcaag

SEQ ID NO: 645079 - DNA, 25 bp, Rattus norvegicus
gaccaggtaagaggcggcccacgta

SEQ ID NO: 645080 - DNA, 25 bp, Rattus norvegicus
cttccaccagcggagggtggctctg

SEQ ID NO: 645081 - DNA, 25 bp, Rattus norvegicus
gtcctccggcccgatgggctgcttg

SEQ ID NO: 645082 - DNA, 25 bp, Rattus norvegicus
cacaggaggcgggtcacacatgccc

SEQ ID NO: 645083 - DNA, 25 bp, Rattus norvegicus
cgcccaccgtctggcttttccagcg

SEQ ID NO: 645084 - DNA, 25 bp, Rattus norvegicus
tcacgcccacaggaggcgggtcaca

SEQ ID NO: 645085 - DNA, 25 bp, Rattus norvegicus
gccgtcccgccttggtcacgcccac

SEQ ID NO: 645086 - DNA, 25 bp, Rattus norvegicus
gcggggccgcagatcctcgcccgct

SEQ ID NO: 645087 - DNA, 25 bp, Rattus norvegicus
ttcttcaccttcatggcctcgcggg

SEQ ID NO: 645088 - DNA, 25 bp, Rattus norvegicus
tgggctccacgctccggttcgaggc

SEQ ID NO: 645089 - DNA, 25 bp, Rattus norvegicus
gcgtgggctccacgctccggttcga

SEQ ID NO: 645090 - DNA, 25 bp, Rattus norvegicus
ggtggcgctccctcgccggtgctca

SEQ ID NO: 645091 - DNA, 25 bp, Rattus norvegicus
cgccggtgctcaccgccggtgatcc

SEQ ID NO: 645092 - DNA, 25 bp, Rattus norvegicus
ctccgactcggacccggactcggct

SEQ ID NO: 645093 - DNA, 25 bp, Rattus norvegicus
ccgatgggctgcttgccctgcagcg

SEQ ID NO: 645094 - DNA, 25 bp, Rattus norvegicus
acgcccacaggaggcgggtcacaca

SEQ ID NO: 645095 - DNA, 25 bp, Rattus norvegicus
tccggccacacatccccgcgtgctg

SEQ ID NO: 645096 - DNA, 25 bp, Rattus norvegicus
agtggaagcgcagctgctgacttcc

SEQ ID NO: 645097 - DNA, 25 bp, Rattus norvegicus
gcagctgctgacttccggccacaca

SEQ ID NO: 645098 - DNA, 25 bp, Rattus norvegicus
ccgcatgctgcagtgggagcgcggc

SEQ ID NO: 645099 - DNA, 25 bp, Rattus norvegicus
gagcgcggctgctgacttccggcca

SEQ ID NO: 645100 - DNA, 25 bp, Rattus norvegicus
gcggctgctgacttccggccacaca

SEQ ID NO: 645101 - DNA, 25 bp, Rattus norvegicus
acacatccccgcatgctgcagtggg

SEQ ID NO: 645102 - DNA, 25 bp, Rattus norvegicus
cgcatgctgcagtgggagcgcggct

SEQ ID NO: 645103 - DNA, 25 bp, Rattus norvegicus
ggctgctgacttccggccacacatc

SEQ ID NO: 645104 - DNA, 25 bp, Rattus norvegicus
agcgcagctgctgacttccggccac

SEQ ID NO: 645105 - DNA, 25 bp, Rattus norvegicus
agctgctgacttccggccacacatc

SEQ ID NO: 645106 - DNA, 25 bp, Rattus norvegicus
aagcgcagctgctgacttccggcca

SEQ ID NO: 645107 - DNA, 25 bp, Rattus norvegicus
cagtggaagcgcagctgctgacttc

SEQ ID NO: 645108 - DNA, 25 bp, Rattus norvegicus
gtggaagcgcagctgctgacttccg

SEQ ID NO: 645109 - DNA, 25 bp, Rattus norvegicus
gttgccttcatgagcgccgactggc

SEQ ID NO: 645110 - DNA, 25 bp, Rattus norvegicus
tggctcatcgggaaagccaagaccc

SEQ ID NO: 645111 - DNA, 25 bp, Rattus norvegicus
gcctttgctgaactcgttgccttca

SEQ ID NO: 645112 - DNA, 25 bp, Rattus norvegicus
cctcctgagtatcgtggtggccttt

SEQ ID NO: 645113 - DNA, 25 bp, Rattus norvegicus
tcgatgctctggaccctcctgagta

SEQ ID NO: 645114 - DNA, 25 bp, Rattus norvegicus
tgtcattgtcacctgccgctcgatg

SEQ ID NO: 645115 - DNA, 25 bp, Rattus norvegicus
cgctttcccaccgtgaacatcaata

SEQ ID NO: 645116 - DNA, 25 bp, Rattus norvegicus
cgccactcacagctgtctttctgga

SEQ ID NO: 645117 - DNA, 25 bp, Rattus norvegicus
gagacttccttctcggacttcctcg

SEQ ID NO: 645118 - DNA, 25 bp, Rattus norvegicus
gactgagcgaccctcgccgagactt

SEQ ID NO: 645119 - DNA, 25 bp, Rattus norvegicus
cgggatccagacctcactgcttctg

SEQ ID NO: 645120 - DNA, 25 bp, Rattus norvegicus
tatgaatgccgtcagcccgggatcc

SEQ ID NO: 645121 - DNA, 25 bp, Rattus norvegicus
tgggactcagcactccgtatgaatg

SEQ ID NO: 645122 - DNA, 25 bp, Rattus norvegicus
tttctggattgacaccgtggacttc

SEQ ID NO: 645123 - DNA, 25 bp, Rattus norvegicus
tagctttaagaagccgcaacaagtg

SEQ ID NO: 645124 - DNA, 25 bp, Rattus norvegicus
cgccagagggcacagttcgcgcgca

SEQ ID NO: 645125 - DNA, 25 bp, Rattus norvegicus
gagggcacagttcgcgcgcattcac

SEQ ID NO: 645126 - DNA, 25 bp, Rattus norvegicus
cacccgcgtccgcactggctcgggt

SEQ ID NO: 645127 - DNA, 25 bp, Rattus norvegicus
cactcctgtaagtcctgttcctgca

SEQ ID NO: 645128 - DNA, 25 bp, Rattus norvegicus
cccggccggctcaccagtcaagccc

SEQ ID NO: 645129 - DNA, 25 bp, Rattus norvegicus
tgcgccgccgcgcaccttcccggct

SEQ ID NO: 645130 - DNA, 25 bp, Rattus norvegicus
aagcttctggctgccgggctgtccc

SEQ ID NO: 645131 - DNA, 25 bp, Rattus norvegicus
ggagtaacccggaagcttctggctg

SEQ ID NO: 645132 - DNA, 25 bp, Rattus norvegicus
caacaagtgagtgcgcatgcccagt

SEQ ID NO: 645133 - DNA, 25 bp, Rattus norvegicus
cgcgaccagcgtagctttaagaagc

SEQ ID NO: 645134 - DNA, 25 bp, Rattus norvegicus
ggacaacgcgaccagcgtagcttta

SEQ ID NO: 645135 - DNA, 25 bp, Rattus norvegicus
gcccgcagcgcctgcaagaagcgcg

SEQ ID NO: 645136 - DNA, 25 bp, Rattus norvegicus
ggagctggagtaacccggaagcttc

SEQ ID NO: 645137 - DNA, 25 bp, Rattus norvegicus
ttctccgagcttaggcgtccgtgaa

SEQ ID NO: 645138 - DNA, 25 bp, Rattus norvegicus
gtgccacggatagacaaaatgctta

SEQ ID NO: 645139 - DNA, 25 bp, Rattus norvegicus
aatgcttaggaaggcaaggcgcgcc

SEQ ID NO: 645140 - DNA, 25 bp, Rattus norvegicus
ctatcacaacctaggcgggtcgttc

SEQ ID NO: 645141 - DNA, 25 bp, Rattus norvegicus
caccacagaggtggcctaagtgctg

SEQ ID NO: 645142 - DNA, 25 bp, Rattus norvegicus
cgccggccttgtagccattttagga

SEQ ID NO: 645143 - DNA, 25 bp, Rattus norvegicus
ttggtctccttgtacgccgaacagc

SEQ ID NO: 645144 - DNA, 25 bp, Rattus norvegicus
cttttctaataagcgcgtgtgccac

SEQ ID NO: 645145 - DNA, 25 bp, Rattus norvegicus
tcgagctgcagccatgggaaacacc

SEQ ID NO: 645146 - DNA, 25 bp, Rattus norvegicus
atgggaaacaccaccagtgagcggg

SEQ ID NO: 645147 - DNA, 25 bp, Rattus norvegicus
cccggcaaggagcacaagatcatgg

SEQ ID NO: 645148 - DNA, 25 bp, Rattus norvegicus
tcatggtgggaagcaccgacgaccc

SEQ ID NO: 645149 - DNA, 25 bp, Rattus norvegicus
cctgccggactccaaggtgaggtag

SEQ ID NO: 645150 - DNA, 25 bp, Rattus norvegicus
tggggcgcggcttcaatttcaataa

SEQ ID NO: 645151 - DNA, 25 bp, Rattus norvegicus
ccagctcgaaagaaacactgtactc

SEQ ID NO: 645152 - DNA, 25 bp, Rattus norvegicus
tgttctctctccgtacacgtgctga

SEQ ID NO: 645153 - DNA, 25 bp, Rattus norvegicus
tctccgtacacgtgctgatgtagcc

SEQ ID NO: 645154 - DNA, 25 bp, Rattus norvegicus
acacgtgctgatgtagccacgaggg

SEQ ID NO: 645155 - DNA, 25 bp, Rattus norvegicus
tgccaccagctcgaaagaaacactg

SEQ ID NO: 645156 - DNA, 25 bp, Rattus norvegicus
cactgtactcaagcacaatcttgca

SEQ ID NO: 645157 - DNA, 25 bp, Rattus norvegicus
caatcttgcagttccgggcgattca

SEQ ID NO: 645158 - DNA, 25 bp, Rattus norvegicus
gggcgattcagcgaagcgtcactga

SEQ ID NO: 645159 - DNA, 25 bp, Rattus norvegicus
agcgtcactgagaccctacctctga

SEQ ID NO: 645160 - DNA, 25 bp, Rattus norvegicus
actgagaccctacctctgactctgt

SEQ ID NO: 645161 - DNA, 25 bp, Rattus norvegicus
tgtcccgtactcaccttaggccagc

SEQ ID NO: 645162 - DNA, 25 bp, Rattus norvegicus
taggccagcgctgccctggctcgaa

SEQ ID NO: 645163 - DNA, 25 bp, Rattus norvegicus
gctcgaagggctgcccggatcgttt

SEQ ID NO: 645164 - DNA, 25 bp, Rattus norvegicus
ctgagaggagctgccaccagctcga

SEQ ID NO: 645165 - DNA, 25 bp, Rattus norvegicus
gcgaccctcaggtctgccatgtttt

SEQ ID NO: 645166 - DNA, 25 bp, Rattus norvegicus
gtaccacgtcctggcttcccgcaca

SEQ ID NO: 645167 - DNA, 25 bp, Rattus norvegicus
ccacacccgcgaggcagcgtaccac

SEQ ID NO: 645168 - DNA, 25 bp, Rattus norvegicus
tggggacgaaagatctcccacaccc

SEQ ID NO: 645169 - DNA, 25 bp, Rattus norvegicus
tctgccatgttttcaggtgacctgg

SEQ ID NO: 645170 - DNA, 25 bp, Rattus norvegicus
gggctcgctgccataccgcgactcc

SEQ ID NO: 645171 - DNA, 25 bp, Rattus norvegicus
ggatatcctgtcctctgcgaccggc

SEQ ID NO: 645172 - DNA, 25 bp, Rattus norvegicus
cacgacaccgcaataggatatcctg

SEQ ID NO: 645173 - DNA, 25 bp, Rattus norvegicus
tgcctgaacacgacaccgcaatagg

SEQ ID NO: 645174 - DNA, 25 bp, Rattus norvegicus
aatccacaccgtagctgcctgaaca

SEQ ID NO: 645175 - DNA, 25 bp, Rattus norvegicus
ttcagagacaccaatccacaccgta

SEQ ID NO: 645176 - DNA, 25 bp, Rattus norvegicus
cgtcctatctctccgttcagagaca

SEQ ID NO: 645177 - DNA, 25 bp, Rattus norvegicus
gcatttgcgtcctatctctccgttc

SEQ ID NO: 645178 - DNA, 25 bp, Rattus norvegicus
gtgacctggggacgaaagatctccc

SEQ ID NO: 645179 - DNA, 25 bp, Rattus norvegicus
cgggtgaaggaacaaggtctgctct

SEQ ID NO: 645180 - DNA, 25 bp, Rattus norvegicus
ctgagctgtcaaccgcgagtgagag

SEQ ID NO: 645181 - DNA, 25 bp, Rattus norvegicus
ccgcgggcgcacaagctcccaggct

SEQ ID NO: 645182 - DNA, 25 bp, Rattus norvegicus
gctgatcctcaccagctgagctgtc

SEQ ID NO: 645183 - DNA, 25 bp, Rattus norvegicus
acaaggtctgctctctgctttttga

SEQ ID NO: 645184 - DNA, 25 bp, Rattus norvegicus
ctcccaggctgagacgcgactggct

SEQ ID NO: 645185 - DNA, 25 bp, Rattus norvegicus
acaaggcaaggactgttctcgggag

SEQ ID NO: 645186 - DNA, 25 bp, Rattus norvegicus
tgggtacaaggcaaggactgttctc

SEQ ID NO: 645187 - DNA, 25 bp, Rattus norvegicus
ctaacggtgctatgggtacaaggca

SEQ ID NO: 645188 - DNA, 25 bp, Rattus norvegicus
ctcagctaacggtgctatgggtaca

SEQ ID NO: 645189 - DNA, 25 bp, Rattus norvegicus
cgcgccctcagctaacggtgctatg

SEQ ID NO: 645190 - DNA, 25 bp, Rattus norvegicus
gcaagctgatcggtcgcagccgcgc

SEQ ID NO: 645191 - DNA, 25 bp, Rattus norvegicus
tgaagagagcaagctgatcggtcgc

SEQ ID NO: 645192 - DNA, 25 bp, Rattus norvegicus
actggctggcacgagctgatcctca

SEQ ID NO: 645193 - DNA, 25 bp, Rattus norvegicus
gtcctctccgggaggaagagcatcc

SEQ ID NO: 645194 - DNA, 25 bp, Rattus norvegicus
cgtggtgacagatggacccgctgtc

SEQ ID NO: 645195 - DNA, 25 bp, Rattus norvegicus
gaggctgtctgccaagtgctccgcc

SEQ ID NO: 645196 - DNA, 25 bp, Rattus norvegicus
agatgcggccaggttcggcctcccg

SEQ ID NO: 645197 - DNA, 25 bp, Rattus norvegicus
gaggaagagcatccagcccagatgc

SEQ ID NO: 645198 - DNA, 25 bp, Rattus norvegicus
ggcctcccgtgaggctgtctgccaa

SEQ ID NO: 645199 - DNA, 25 bp, Rattus norvegicus
ggtttcaccggctgcccaggcgcgt

SEQ ID NO: 645200 - DNA, 25 bp, Rattus norvegicus
tagctatgatctctgcttggttccc

SEQ ID NO: 645201 - DNA, 25 bp, Rattus norvegicus
actgcgccctagctatgatctctgc

SEQ ID NO: 645202 - DNA, 25 bp, Rattus norvegicus
ggcctgggcactgcgccctagctat

SEQ ID NO: 645203 - DNA, 25 bp, Rattus norvegicus
cttcatggatccgaggcctgggcac

SEQ ID NO: 645204 - DNA, 25 bp, Rattus norvegicus
tgtccgtgcgcttcatggatccgag

SEQ ID NO: 645205 - DNA, 25 bp, Rattus norvegicus
atggacccgctgtccgtgcgcttca

SEQ ID NO: 645206 - DNA, 25 bp, Rattus norvegicus
ccagcccagatgctgcggctgtggc

SEQ ID NO: 645207 - DNA, 25 bp, Rattus norvegicus
caaaccctcgcgtttgatgttggtc

SEQ ID NO: 645208 - DNA, 25 bp, Rattus norvegicus
gccgcgcggctcagccagaaacttt

SEQ ID NO: 645209 - DNA, 25 bp, Rattus norvegicus
cccttatcggagctcacgggcgggc

SEQ ID NO: 645210 - DNA, 25 bp, Rattus norvegicus
ccgagtaccaagtgctgttcgctca

SEQ ID NO: 645211 - DNA, 25 bp, Rattus norvegicus
gaccggcgcttctttctgcgggaaa

SEQ ID NO: 645212 - DNA, 25 bp, Rattus norvegicus
cagaaactttcagccaaacttcggg

SEQ ID NO: 645213 - DNA, 25 bp, Rattus norvegicus
cccatgcggatctgctttggctgcg

SEQ ID NO: 645214 - DNA, 25 bp, Rattus norvegicus
tgcggcagtgaagatgcccgctctg

SEQ ID NO: 645215 - DNA, 25 bp, Rattus norvegicus
ggctgcgccttccaaactgcctggt

SEQ ID NO: 645216 - DNA, 25 bp, Rattus norvegicus
gcctcgagtcttggcaacgcgtagc

SEQ ID NO: 645217 - DNA, 25 bp, Rattus norvegicus
ttgcggcgttcccaacttttgacac

SEQ ID NO: 645218 - DNA, 25 bp, Rattus norvegicus
ttgacacccggatcggtcggtctgt

SEQ ID NO: 645219 - DNA, 25 bp, Rattus norvegicus
caacgcgtagcgtctcgggttccgc

SEQ ID NO: 645220 - DNA, 25 bp, Rattus norvegicus
tgatgttggtcgcttcagccaaccc

SEQ ID NO: 645221 - DNA, 25 bp, Rattus norvegicus
gtgcgagtccgctgccacaaatgcc

SEQ ID NO: 645222 - DNA, 25 bp, Rattus norvegicus
ccagatggagcagccgcactttgca

SEQ ID NO: 645223 - DNA, 25 bp, Rattus norvegicus
ctggcatcccgcagtaccagatgga

SEQ ID NO: 645224 - DNA, 25 bp, Rattus norvegicus
cattccggagaggttctggcatccc

SEQ ID NO: 645225 - DNA, 25 bp, Rattus norvegicus
aagctccggagaggctctggcattc

SEQ ID NO: 645226 - DNA, 25 bp, Rattus norvegicus
ccgccaggcgctaaagctccggaga

SEQ ID NO: 645227 - DNA, 25 bp, Rattus norvegicus
ccgcgtgtagcaccctgagctggga

SEQ ID NO: 645228 - DNA, 25 bp, Rattus norvegicus
ggtgcactcgtctccgcgtgtagca

SEQ ID NO: 645229 - DNA, 25 bp, Rattus norvegicus
gcaaggatgagttcctggtgcactc

SEQ ID NO: 645230 - DNA, 25 bp, Rattus norvegicus
agaaagggcgcctaggtcttgcatc

SEQ ID NO: 645231 - DNA, 25 bp, Rattus norvegicus
cgctgccacaaatgccacgggacgg

SEQ ID NO: 645232 - DNA, 25 bp, Rattus norvegicus
tcttgcatcagacaaaaggcggtgc

SEQ ID NO: 645233 - DNA, 25 bp, Rattus norvegicus
ttgcagcgccggcaagaaacacgcg

SEQ ID NO: 645234 - DNA, 25 bp, Rattus norvegicus
agcagcctgcactgggcaaggatga

SEQ ID NO: 645235 - DNA, 25 bp, Rattus norvegicus
tatccggacagccagcacctgcagg

SEQ ID NO: 645236 - DNA, 25 bp, Rattus norvegicus
ggcggaaatgaacgcgccgcagacc

SEQ ID NO: 645237 - DNA, 25 bp, Rattus norvegicus
accagcaccaaaagcctagggcgca

SEQ ID NO: 645238 - DNA, 25 bp, Rattus norvegicus
cgtgggaagccgtctctatcctaaa

SEQ ID NO: 645239 - DNA, 25 bp, Rattus norvegicus
aacaccggcgcctcacgtgggaagc

SEQ ID NO: 645240 - DNA, 25 bp, Rattus norvegicus
agtgcatcgcttccggactcgggaa

SEQ ID NO: 645241 - DNA, 25 bp, Rattus norvegicus
gtgggacccgcatatccggacagcc

SEQ ID NO: 645242 - DNA, 25 bp, Rattus norvegicus
gcgtcccatctgtgggacccgcata

SEQ ID NO: 645243 - DNA, 25 bp, Rattus norvegicus
gtccgtaggctgctgcgtcccatct

SEQ ID NO: 645244 - DNA, 25 bp, Rattus norvegicus
gccaatgcatgctcggggtccgtag

SEQ ID NO: 645245 - DNA, 25 bp, Rattus norvegicus
cggaagagcatcacccgctgctggg

SEQ ID NO: 645246 - DNA, 25 bp, Rattus norvegicus
aaagtgcctcctccggcagaggtct

SEQ ID NO: 645247 - DNA, 25 bp, Rattus norvegicus
tggcgttccgctgagaaagtgcctc

SEQ ID NO: 645248 - DNA, 25 bp, Rattus norvegicus
ctcaggagagcagccgtgctgagct

SEQ ID NO: 645249 - DNA, 25 bp, Rattus norvegicus
gaaatccaccgcacctaggtctgtg

SEQ ID NO: 645250 - DNA, 25 bp, Rattus norvegicus
gagcctgtgagcgagtatccatccg

SEQ ID NO: 645251 - DNA, 25 bp, Rattus norvegicus
cactgctgacgcacgcgagtgagca

SEQ ID NO: 645252 - DNA, 25 bp, Rattus norvegicus
tgccaatcccgagcgacactgctga

SEQ ID NO: 645253 - DNA, 25 bp, Rattus norvegicus
gctttcttcaatcggaaactccaga

SEQ ID NO: 645254 - DNA, 25 bp, Rattus norvegicus
ttccggctacccaggtcacctatgg

SEQ ID NO: 645255 - DNA, 25 bp, Rattus norvegicus
cgccacaccgagatcgcagagtgcg

SEQ ID NO: 645256 - DNA, 25 bp, Rattus norvegicus
ctaaggcacgggaaccggttcgatg

SEQ ID NO: 645257 - DNA, 25 bp, Rattus norvegicus
ctctgaggacacagaaggccgacta

SEQ ID NO: 645258 - DNA, 25 bp, Rattus norvegicus
gcttgcctcggaccacctctgagga

SEQ ID NO: 645259 - DNA, 25 bp, Rattus norvegicus
cagtcccagaaggatggccaccgcg

SEQ ID NO: 645260 - DNA, 25 bp, Rattus norvegicus
gtcgtcttccaccagagaggcagtc

SEQ ID NO: 645261 - DNA, 25 bp, Rattus norvegicus
cacggtaggtctccgtcgtcttcca

SEQ ID NO: 645262 - DNA, 25 bp, Rattus norvegicus
gcggggcttcgtgagctttcttcaa

SEQ ID NO: 645263 - DNA, 25 bp, Rattus norvegicus
atagcccggttgagctcttttggtc

SEQ ID NO: 645264 - DNA, 25 bp, Rattus norvegicus
tgtccttcgcacaccggaccgtggt

SEQ ID NO: 645265 - DNA, 25 bp, Rattus norvegicus
gagccctcgtgtcctatagcccggt

SEQ ID NO: 645266 - DNA, 25 bp, Rattus norvegicus
agagcgagtcggaccgtcccacaga

SEQ ID NO: 645267 - DNA, 25 bp, Rattus norvegicus
ccaccctgtgggctcaggaaccaag

SEQ ID NO: 645268 - DNA, 25 bp, Rattus norvegicus
gagctaccgcgcgaagctgtccttc

SEQ ID NO: 645269 - DNA, 25 bp, Rattus norvegicus
gacctgagctgatcacctcggggct

SEQ ID NO: 645270 - DNA, 25 bp, Rattus norvegicus
ccggtgaactacaaatcgaggcatg

SEQ ID NO: 645271 - DNA, 25 bp, Rattus norvegicus
ctgcagtagcaggaagtcccggtga

SEQ ID NO: 645272 - DNA, 25 bp, Rattus norvegicus
gtgtccagggatacagcgagtgccc

SEQ ID NO: 645273 - DNA, 25 bp, Rattus norvegicus
cgcgctgctacaaccggacagtgtc

SEQ ID NO: 645274 - DNA, 25 bp, Rattus norvegicus
gcgtctgcaggaccgcactctatca

SEQ ID NO: 645275 - DNA, 25 bp, Rattus norvegicus
tcgcactgtgtgcaccgggcagtaa

SEQ ID NO: 645276 - DNA, 25 bp, Rattus norvegicus
ccaggaaatgtcctttgtccagccc

SEQ ID NO: 645277 - DNA, 25 bp, Rattus norvegicus
tcggccgcaactcgcacctggttaa

SEQ ID NO: 645278 - DNA, 25 bp, Rattus norvegicus
caagagcttcagctggcgcgccgac

SEQ ID NO: 645279 - DNA, 25 bp, Rattus norvegicus
cgacagcctcatggccagcatcatg

SEQ ID NO: 645280 - DNA, 25 bp, Rattus norvegicus
accatctgtccggactgcggggaga

SEQ ID NO: 645281 - DNA, 25 bp, Rattus norvegicus
ctttagcccaggtgccgcattccta

SEQ ID NO: 645282 - DNA, 25 bp, Rattus norvegicus
agcccttcagctgcggccagtgcga

SEQ ID NO: 645283 - DNA, 25 bp, Rattus norvegicus
aggcttcagccgcaacacttacctg

SEQ ID NO: 645284 - DNA, 25 bp, Rattus norvegicus
gagtgcggcgaagccttcagcctca

SEQ ID NO: 645285 - DNA, 25 bp, Rattus norvegicus
ttcagcctcagttcgcacttgctca

SEQ ID NO: 645286 - DNA, 25 bp, Rattus norvegicus
gctcggacctggtgaagcaccaacg

SEQ ID NO: 645287 - DNA, 25 bp, Rattus norvegicus
agaagccctacatgtgctccgagtg

SEQ ID NO: 645288 - DNA, 25 bp, Rattus norvegicus
ttcagcgtgagctcgcacctcttca

SEQ ID NO: 645289 - DNA, 25 bp, Rattus norvegicus
acctggttaaccacttgcgcgtgca

SEQ ID NO: 645290 - DNA, 25 bp, Rattus norvegicus
cagcctggagcccttcggtttggct

SEQ ID NO: 645291 - DNA, 25 bp, Rattus norvegicus
aacgttcagtgcctttctcctccta

SEQ ID NO: 645292 - DNA, 25 bp, Rattus norvegicus
tgtggacccacctagcgcggctagg

SEQ ID NO: 645293 - DNA, 25 bp, Rattus norvegicus
acgggttgttgagatccggatccgc

SEQ ID NO: 645294 - DNA, 25 bp, Rattus norvegicus
ctgaggatccggagttgctccaaga

SEQ ID NO: 645295 - DNA, 25 bp, Rattus norvegicus
gccgcaggtgccaaagactccagac

SEQ ID NO: 645296 - DNA, 25 bp, Rattus norvegicus
tctccgaacccacgcataaaagatg

SEQ ID NO: 645297 - DNA, 25 bp, Rattus norvegicus
tcctaagtcacggaaagcggcttcg

SEQ ID NO: 645298 - DNA, 25 bp, Rattus norvegicus
ccgatcccaggttactcctaagtca

SEQ ID NO: 645299 - DNA, 25 bp, Rattus norvegicus
cggagcgggaaggaacactaaagca

SEQ ID NO: 645300 - DNA, 25 bp, Rattus norvegicus
cggcgctcaccttgaacgggttgtt

SEQ ID NO: 645301 - DNA, 25 bp, Rattus norvegicus
cccgatgcgagcctccaagctggtg

SEQ ID NO: 645302 - DNA, 25 bp, Rattus norvegicus
tccggatccgcaaaggggttgctgt

SEQ ID NO: 645303 - DNA, 25 bp, Rattus norvegicus
gggttgctgtcaaaatccgacattg

SEQ ID NO: 645304 - DNA, 25 bp, Rattus norvegicus
gctccaagaaaaggcaacgttcagt

SEQ ID NO: 645305 - DNA, 25 bp, Rattus norvegicus
gtgctgctgcaggaaagcatccgcc

SEQ ID NO: 645306 - DNA, 25 bp, Rattus norvegicus
gcgcatgcgcagtaagcacaacttc

SEQ ID NO: 645307 - DNA, 25 bp, Rattus norvegicus
tcgcctgcagacgtcatcctgagtc

SEQ ID NO: 645308 - DNA, 25 bp, Rattus norvegicus
tcaagatggcgctgttctccgtgcg

SEQ ID NO: 645309 - DNA, 25 bp, Rattus norvegicus
gcttcatccgggcacttcataaagg

SEQ ID NO: 645310 - DNA, 25 bp, Rattus norvegicus
tcataaaggacccacagctactgcg

SEQ ID NO: 645311 - DNA, 25 bp, Rattus norvegicus
acccgagccgaccttctgctttagg

SEQ ID NO: 645312 - DNA, 25 bp, Rattus norvegicus
tgcttcctgtaaagagccctccaca

SEQ ID NO: 645313 - DNA, 25 bp, Rattus norvegicus
gcagcaacgctgcacacacacgtga

SEQ ID NO: 645314 - DNA, 25 bp, Rattus norvegicus
aggcaacgcgggaagccatctggaa

SEQ ID NO: 645315 - DNA, 25 bp, Rattus norvegicus
catctggaaggagcgtgacgttatc

SEQ ID NO: 645316 - DNA, 25 bp, Rattus norvegicus
cggcagcccagaagacaagcgcatg

SEQ ID NO: 645317 - DNA, 25 bp, Rattus norvegicus
tcagaggcctaattgctttgcgacc

SEQ ID NO: 645318 - DNA, 25 bp, Rattus norvegicus
tccgaggtccattagcctgtgagtc

SEQ ID NO: 645319 - DNA, 25 bp, Rattus norvegicus
cgcttcctgcgaaggggagctcaag

SEQ ID NO: 645320 - DNA, 25 bp, Rattus norvegicus
aacaggatttcctcgcctctagggc

SEQ ID NO: 645321 - DNA, 25 bp, Rattus norvegicus
gggatggaagttccgcttcctgcga

SEQ ID NO: 645322 - DNA, 25 bp, Rattus norvegicus
gatttcctcgcctctagggcgcggc

SEQ ID NO: 645323 - DNA, 25 bp, Rattus norvegicus
acagcgggcagggccacacaaggcc

SEQ ID NO: 645324 - DNA, 25 bp, Rattus norvegicus
gggccgagctcctgagcagacctaa

SEQ ID NO: 645325 - DNA, 25 bp, Rattus norvegicus
ctcctgagcagacctaagtcgggga

SEQ ID NO: 645326 - DNA, 25 bp, Rattus norvegicus
gcagacctaagtcggggaaacaata

SEQ ID NO: 645327 - DNA, 25 bp, Rattus norvegicus
cggggaaacaatagttcaatgttgc

SEQ ID NO: 645328 - DNA, 25 bp, Rattus norvegicus
atagttcaatgttgcggcccgcctg

SEQ ID NO: 645329 - DNA, 25 bp, Rattus norvegicus
tggcgcttttttatagtcacaaata

SEQ ID NO: 645330 - DNA, 25 bp, Rattus norvegicus
tcacaaatataaaatcggggctttc

SEQ ID NO: 645331 - DNA, 25 bp, Rattus norvegicus
gagcctgagggaacaggatttcctc

SEQ ID NO: 645332 - DNA, 25 bp, Rattus norvegicus
ccgctgggtagctccaatcgtggag

SEQ ID NO: 645333 - DNA, 25 bp, Rattus norvegicus
ctcgttcctagaggctggggcagct

SEQ ID NO: 645334 - DNA, 25 bp, Rattus norvegicus
tgagtcccacaggcccactcggaga

SEQ ID NO: 645335 - DNA, 25 bp, Rattus norvegicus
acctgtccatggaggcgctgagtcc

SEQ ID NO: 645336 - DNA, 25 bp, Rattus norvegicus
taaaaagcggaaactgcgagactgg

SEQ ID NO: 645337 - DNA, 25 bp, Rattus norvegicus
cttgatcggctcaaataaaaagcgg

SEQ ID NO: 645338 - DNA, 25 bp, Rattus norvegicus
gccttctccgttgaagccttgatcg

SEQ ID NO: 645339 - DNA, 25 bp, Rattus norvegicus
tggactcagcgctcatgcagcgggc

SEQ ID NO: 645340 - DNA, 25 bp, Rattus norvegicus
aagatctgcagtcgccctgagctcc

SEQ ID NO: 645341 - DNA, 25 bp, Rattus norvegicus
gcggctaaaatgagtgaaaggagaa

SEQ ID NO: 645342 - DNA, 25 bp, Rattus norvegicus
gagacacagacgacccggcgacaca

SEQ ID NO: 645343 - DNA, 25 bp, Rattus norvegicus
gttgaagccttgatcggctcaaata

SEQ ID NO: 645344 - DNA, 25 bp, Rattus norvegicus
tgaaaggagaagatctgcagtcgcc

SEQ ID NO: 645345 - DNA, 25 bp, Rattus norvegicus
cccgcgctcgttcctagaggctggg

SEQ ID NO: 645346 - DNA, 25 bp, Rattus norvegicus
ccgagcacatgccttctccgttgaa

SEQ ID NO: 645347 - DNA, 25 bp, Rattus norvegicus
ttcggggaagtctctaggatttaga

SEQ ID NO: 645348 - DNA, 25 bp, Rattus norvegicus
ctggccggtggttaagcccaacaga

SEQ ID NO: 645349 - DNA, 25 bp, Rattus norvegicus
tcacccaggattggcggagcagctt

SEQ ID NO: 645350 - DNA, 25 bp, Rattus norvegicus
gggtgcggccttgaaactgtatttc

SEQ ID NO: 645351 - DNA, 25 bp, Rattus norvegicus
aaactgtatttcgagcgcgcggcgg

SEQ ID NO: 645352 - DNA, 25 bp, Rattus norvegicus
ccgcccgaatcttcagcgaagtatg

SEQ ID NO: 645353 - DNA, 25 bp, Rattus norvegicus
cggtctcctgcggagcgaaataatt

SEQ ID NO: 645354 - DNA, 25 bp, Rattus norvegicus
tgagcaggtacaggcaagcacattc

SEQ ID NO: 645355 - DNA, 25 bp, Rattus norvegicus
cacactcgggctaagcgaattgctt

SEQ ID NO: 645356 - DNA, 25 bp, Rattus norvegicus
gttttcgtttgcatccacgcgcgca

SEQ ID NO: 645357 - DNA, 25 bp, Rattus norvegicus
gcgcgcaaaccctcgtgaaaggaga

SEQ ID NO: 645358 - DNA, 25 bp, Rattus norvegicus
agcacttcgtttctagttaccgccg

SEQ ID NO: 645359 - DNA, 25 bp, Rattus norvegicus
tcgcgccctctgtctttcggggaag

SEQ ID NO: 645360 - DNA, 25 bp, Rattus norvegicus
cccatctctggtttggacatttccc

SEQ ID NO: 645361 - DNA, 25 bp, Rattus norvegicus
ttgcactctctagcccgggagcagc

SEQ ID NO: 645362 - DNA, 25 bp, Rattus norvegicus
tcgctaagctgtagggacgcaggtc

SEQ ID NO: 645363 - DNA, 25 bp, Rattus norvegicus
cccaggctttgggattcgcactccg

SEQ ID NO: 645364 - DNA, 25 bp, Rattus norvegicus
ctcccgacttctgctacggatctga

SEQ ID NO: 645365 - DNA, 25 bp, Rattus norvegicus
aaagtgtcagatgtcaccctcccga

SEQ ID NO: 645366 - DNA, 25 bp, Rattus norvegicus
tcagcctccgcctttggcaatcaaa

SEQ ID NO: 645367 - DNA, 25 bp, Rattus norvegicus
tctggagaccggctcgcttcagcct

SEQ ID NO: 645368 - DNA, 25 bp, Rattus norvegicus
tgtcagaacgctgtcgccagtcacc

SEQ ID NO: 645369 - DNA, 25 bp, Rattus norvegicus
aagcgggtacctttgctgtcagaac

SEQ ID NO: 645370 - DNA, 25 bp, Rattus norvegicus
cggaaatgacgacggagctctgtga

SEQ ID NO: 645371 - DNA, 25 bp, Rattus norvegicus
tcccttaccttctaggcggaaatga

SEQ ID NO: 645372 - DNA, 25 bp, Rattus norvegicus
ggaaccgcgtctcacgatccctaaa

SEQ ID NO: 645373 - DNA, 25 bp, Rattus norvegicus
tgcagacggctccagcaaagggact

SEQ ID NO: 645374 - DNA, 25 bp, Rattus norvegicus
gtcggccctgtgaacaccacagtgc

SEQ ID NO: 645375 - DNA, 25 bp, Rattus norvegicus
tcagcctacgcagtaagcgactttc

SEQ ID NO: 645376 - DNA, 25 bp, Rattus norvegicus
aaccaggtctcacagccgccgtatt

SEQ ID NO: 645377 - DNA, 25 bp, Rattus norvegicus
agccgccgtattctcgagaagtttc

SEQ ID NO: 645378 - DNA, 25 bp, Rattus norvegicus
aagtttccgagagacgcgcagcttc

SEQ ID NO: 645379 - DNA, 25 bp, Rattus norvegicus
gcgcagcttcgatcatttggccacg

SEQ ID NO: 645380 - DNA, 25 bp, Rattus norvegicus
cgcggtacccacagttccaaataga

SEQ ID NO: 645381 - DNA, 25 bp, Rattus norvegicus
tagagaaggatctcagccgccatcc

SEQ ID NO: 645382 - DNA, 25 bp, Rattus norvegicus
cagctcagagctagagtaccgacta

SEQ ID NO: 645383 - DNA, 25 bp, Rattus norvegicus
ccgagcgcagtctccgaaaagtttg

SEQ ID NO: 645384 - DNA, 25 bp, Rattus norvegicus
ttgcgctccttcacagaggtaagcc

SEQ ID NO: 645385 - DNA, 25 bp, Rattus norvegicus
gggtcctgacacctgtcggcatcta

SEQ ID NO: 645386 - DNA, 25 bp, Rattus norvegicus
cggcatctagcctccatcttcgggg

SEQ ID NO: 645387 - DNA, 25 bp, Rattus norvegicus
tcaactgactgactgcatggctttc

SEQ ID NO: 645388 - DNA, 25 bp, Rattus norvegicus
acagcaccgctatcagagtcaactg

SEQ ID NO: 645389 - DNA, 25 bp, Rattus norvegicus
gctctcagttcctcaccgggtgatc

SEQ ID NO: 645390 - DNA, 25 bp, Rattus norvegicus
gcaggtcggttccactcggtctcct

SEQ ID NO: 645391 - DNA, 25 bp, Rattus norvegicus
gatcgctgatttctgtccggtaaga

SEQ ID NO: 645392 - DNA, 25 bp, Rattus norvegicus
tcgccatttggctctcagttcctca

SEQ ID NO: 645393 - DNA, 25 bp, Rattus norvegicus
ggtgacctcccaagcgatcgctgat

SEQ ID NO: 645394 - DNA, 25 bp, Rattus norvegicus
ggtgatcgcgagtctcctcttcatt

SEQ ID NO: 645395 - DNA, 25 bp, Rattus norvegicus
tctcctcttcattcccgagagcgga

SEQ ID NO: 645396 - DNA, 25 bp, Rattus norvegicus
agcggaccgggcgaaacacactgca

SEQ ID NO: 645397 - DNA, 25 bp, Rattus norvegicus
cgggcgaaacacactgcagagaagc

SEQ ID NO: 645398 - DNA, 25 bp, Rattus norvegicus
ctgcaaggtgggttctgccatgccc

SEQ ID NO: 645399 - DNA, 25 bp, Rattus norvegicus
cccggcgcgatgctcagaggctgct

SEQ ID NO: 645400 - DNA, 25 bp, Rattus norvegicus
aagcctcgcgcggattccaagcagc

SEQ ID NO: 645401 - DNA, 25 bp, Rattus norvegicus
gagttgcagcaggtcggttccactc

SEQ ID NO: 645402 - DNA, 25 bp, Rattus norvegicus
tccggtaagatcttctcgccatttg

SEQ ID NO: 645403 - DNA, 25 bp, Rattus norvegicus
gccgagattcagtgttttcaccctc

SEQ ID NO: 645404 - DNA, 25 bp, Rattus norvegicus
ccggttaccgaatgagccgcacttc

SEQ ID NO: 645405 - DNA, 25 bp, Rattus norvegicus
gcggggtcaacactgcctctcgcta

SEQ ID NO: 645406 - DNA, 25 bp, Rattus norvegicus
cctccacttgagcatccggctggtg

SEQ ID NO: 645407 - DNA, 25 bp, Rattus norvegicus
ggctgggcgcttagcctaacgcctc

SEQ ID NO: 645408 - DNA, 25 bp, Rattus norvegicus
caatacgcgtttccggattggctgc

SEQ ID NO: 645409 - DNA, 25 bp, Rattus norvegicus
gccgcctctatttgaacccaatacg

SEQ ID NO: 645410 - DNA, 25 bp, Rattus norvegicus
ccagttcgttgggagccagacttca

SEQ ID NO: 645411 - DNA, 25 bp, Rattus norvegicus
aggtagcgccctgtccgcgaaaatt

SEQ ID NO: 645412 - DNA, 25 bp, Rattus norvegicus
ggcgaaggcgacaagccgagattca

SEQ ID NO: 645413 - DNA, 25 bp, Rattus norvegicus
ttagaccacttatctgaccaagtcg

SEQ ID NO: 645414 - DNA, 25 bp, Rattus norvegicus
tgaccaagtcgaaaacgccacattc

SEQ ID NO: 645415 - DNA, 25 bp, Rattus norvegicus
gaaaattctctcctcaccgattggg

SEQ ID NO: 645416 - DNA, 25 bp, Rattus norvegicus
ctggtgggtatgtcctccagagtca

SEQ ID NO: 645417 - DNA, 25 bp, Rattus norvegicus
tggcagctgacgtccgaacgttttc

SEQ ID NO: 645418 - DNA, 25 bp, Rattus norvegicus
aggagcatcgggacaagctgctacg

SEQ ID NO: 645419 - DNA, 25 bp, Rattus norvegicus
ccatcgaggagcatcgggacaagct

SEQ ID NO: 645420 - DNA, 25 bp, Rattus norvegicus
gccctggctcagatcaaaagttcga

SEQ ID NO: 645421 - DNA, 25 bp, Rattus norvegicus
ccgaacgttttctgagggctacatc

SEQ ID NO: 645422 - DNA, 25 bp, Rattus norvegicus
acaacgccctccaagagcgcgtgga

SEQ ID NO: 645423 - DNA, 25 bp, Rattus norvegicus
aagttcgaacaacgccctccaagag

SEQ ID NO: 645424 - DNA, 25 bp, Rattus norvegicus
tacatcagagccatcgaggagcatc

SEQ ID NO: 645425 - DNA, 25 bp, Rattus norvegicus
ctggctcagatcaaaagttcgaaca

SEQ ID NO: 645426 - DNA, 25 bp, Rattus norvegicus
gggagcaccgagagcacccctacga

SEQ ID NO: 645427 - DNA, 25 bp, Rattus norvegicus
ctacgacttcaccagcaacgtcatc

SEQ ID NO: 645428 - DNA, 25 bp, Rattus norvegicus
acgtcatccacaagcatggagattc

SEQ ID NO: 645429 - DNA, 25 bp, Rattus norvegicus
acaagcatggagattccgtgcggga

SEQ ID NO: 645430 - DNA, 25 bp, Rattus norvegicus
ttctgagggctacatcagagccatc

SEQ ID NO: 645431 - DNA, 25 bp, Rattus norvegicus
cccggcattgcagttctgtggggtc

SEQ ID NO: 645432 - DNA, 25 bp, Rattus norvegicus
gtccatgacggcgagaagctcgctg

SEQ ID NO: 645433 - DNA, 25 bp, Rattus norvegicus
gacggttcattctatagtaccacga

SEQ ID NO: 645434 - DNA, 25 bp, Rattus norvegicus
cattgcgacggttcattctatagta

SEQ ID NO: 645435 - DNA, 25 bp, Rattus norvegicus
gtcatcattgcgacggttcattcta

SEQ ID NO: 645436 - DNA, 25 bp, Rattus norvegicus
gctggccaccacgtcatcattgcga

SEQ ID NO: 645437 - DNA, 25 bp, Rattus norvegicus
gtttgcttctctccccgtatctcag

SEQ ID NO: 645438 - DNA, 25 bp, Rattus norvegicus
tcctgggcccgctgtttgcttctct

SEQ ID NO: 645439 - DNA, 25 bp, Rattus norvegicus
cacgacacagtaagtcggacaccgg

SEQ ID NO: 645440 - DNA, 25 bp, Rattus norvegicus
agtaagtcggacaccggcatccaca

SEQ ID NO: 645441 - DNA, 25 bp, Rattus norvegicus
ggcatccacacgcttcgtgtctatc

SEQ ID NO: 645442 - DNA, 25 bp, Rattus norvegicus
tatcacccggcattgcagttctgtg

SEQ ID NO: 645443 - DNA, 25 bp, Rattus norvegicus
ctatagtaccacgacacagtaagtc

SEQ ID NO: 645444 - DNA, 25 bp, Rattus norvegicus
gcttcgtgtctatcacccggcattg

SEQ ID NO: 645445 - DNA, 25 bp, Rattus norvegicus
caggtcctgggtgaaacctgccctc

SEQ ID NO: 645446 - DNA, 25 bp, Rattus norvegicus
cggtaggcatcgctgcccaccgtgt

SEQ ID NO: 645447 - DNA, 25 bp, Rattus norvegicus
gcccaccgtgtccaggcgtacatcc

SEQ ID NO: 645448 - DNA, 25 bp, Rattus norvegicus
cccactgtggtagcgctgttcatag

SEQ ID NO: 645449 - DNA, 25 bp, Rattus norvegicus
atacatcgaagttcaaagggctccc

SEQ ID NO: 645450 - DNA, 25 bp, Rattus norvegicus
agcgctgttcatagccaggtcctgg

SEQ ID NO: 645451 - DNA, 25 bp, Rattus norvegicus
aacctgccctcgtggcttagggcta

SEQ ID NO: 645452 - DNA, 25 bp, Rattus norvegicus
ttagggctaggatgcttcggtgcac

SEQ ID NO: 645453 - DNA, 25 bp, Rattus norvegicus
atgcttcggtgcactgggccacggt

SEQ ID NO: 645454 - DNA, 25 bp, Rattus norvegicus
gtgcagttcccaccgaagtgccagg

SEQ ID NO: 645455 - DNA, 25 bp, Rattus norvegicus
ccgaagtgccaggtgtgtgtgcaac

SEQ ID NO: 645456 - DNA, 25 bp, Rattus norvegicus
tgtgcaacggtgacgtagtagatgc

SEQ ID NO: 645457 - DNA, 25 bp, Rattus norvegicus
ggtgacgtagtagatgcgatacatc

SEQ ID NO: 645458 - DNA, 25 bp, Rattus norvegicus
tgggccacggtgcagttcccaccga

SEQ ID NO: 645459 - DNA, 25 bp, Rattus norvegicus
tcggcctcttcagcagcgattggaa

SEQ ID NO: 645460 - DNA, 25 bp, Rattus norvegicus
ccgccgcaatgtctagcaacagttt

SEQ ID NO: 645461 - DNA, 25 bp, Rattus norvegicus
gggtctgagatctcctccagcaaaa

SEQ ID NO: 645462 - DNA, 25 bp, Rattus norvegicus
ttccgggagcgatcagcggacaaca

SEQ ID NO: 645463 - DNA, 25 bp, Rattus norvegicus
cgtgaccaccgaagctaaattcgtc

SEQ ID NO: 645464 - DNA, 25 bp, Rattus norvegicus
ctgccctaaaggttgagaactcgtg

SEQ ID NO: 645465 - DNA, 25 bp, Rattus norvegicus
tttcaagtctagaacgtcagtggtc

SEQ ID NO: 645466 - DNA, 25 bp, Rattus norvegicus
caaagcttgcccgtggatgatcgcc

SEQ ID NO: 645467 - DNA, 25 bp, Rattus norvegicus
ccctccgcaccagaactagttttgt

SEQ ID NO: 645468 - DNA, 25 bp, Rattus norvegicus
gacgcacgcctagaactccaagtga

SEQ ID NO: 645469 - DNA, 25 bp, Rattus norvegicus
tttcgcctacaacgagcagtccgga

SEQ ID NO: 645470 - DNA, 25 bp, Rattus norvegicus
tcggtgcaaaaaccacagcttcctg

SEQ ID NO: 645471 - DNA, 25 bp, Rattus norvegicus
taccctccggcaaactcggtgcaaa

SEQ ID NO: 645472 - DNA, 25 bp, Rattus norvegicus
cccaggaatacttagccaaagcttg

SEQ ID NO: 645473 - DNA, 25 bp, Rattus norvegicus
tcacccagcgataggagcgccagca

SEQ ID NO: 645474 - DNA, 25 bp, Rattus norvegicus
ccagcgataggagcgccagcagcag

SEQ ID NO: 645475 - DNA, 25 bp, Rattus norvegicus
tggcgggacacagcaaaggctcaca

SEQ ID NO: 645476 - DNA, 25 bp, Rattus norvegicus
gggacacagcaaaggctcacatttc

SEQ ID NO: 645477 - DNA, 25 bp, Rattus norvegicus
agcaaaggctcacatttccgcccag

SEQ ID NO: 645478 - DNA, 25 bp, Rattus norvegicus
ggagttcaaggtgagcccggctccc

SEQ ID NO: 645479 - DNA, 25 bp, Rattus norvegicus
gctcccggtggccaacaggtagaga

SEQ ID NO: 645480 - DNA, 25 bp, Rattus norvegicus
cacacgtgagaacccggctcggtca

SEQ ID NO: 645481 - DNA, 25 bp, Rattus norvegicus
tccggatacccagagcgcgggccca

SEQ ID NO: 645482 - DNA, 25 bp, Rattus norvegicus
cccaggaggatgtgcaccgggctcc

SEQ ID NO: 645483 - DNA, 25 bp, Rattus norvegicus
cccaggctccaagcggcagccgcgc

SEQ ID NO: 645484 - DNA, 25 bp, Rattus norvegicus
gcgcactcacccagcgataggagcg

SEQ ID NO: 645485 - DNA, 25 bp, Rattus norvegicus
accggcctcagctatggcgggacac

SEQ ID NO: 645486 - DNA, 25 bp, Rattus norvegicus
gagtgaagaacgatcccgaccggcc

SEQ ID NO: 645487 - DNA, 25 bp, Rattus norvegicus
aggagcgctcctttccctgggcacg

SEQ ID NO: 645488 - DNA, 25 bp, Rattus norvegicus
gctcctttccctgggcacggtggga

SEQ ID NO: 645489 - DNA, 25 bp, Rattus norvegicus
aaggaagcgcaaggcgcgcggtgaa

SEQ ID NO: 645490 - DNA, 25 bp, Rattus norvegicus
tgaaggcgaccaaagggctcaggca

SEQ ID NO: 645491 - DNA, 25 bp, Rattus norvegicus
gggtgctactcctccagggccgctg

SEQ ID NO: 645492 - DNA, 25 bp, Rattus norvegicus
ggccgctgccggctctcagcacccg

SEQ ID NO: 645493 - DNA, 25 bp, Rattus norvegicus
ccctccattgcggagagccgggtct

SEQ ID NO: 645494 - DNA, 25 bp, Rattus norvegicus
ccattgcggagagccgggtctccaa

SEQ ID NO: 645495 - DNA, 25 bp, Rattus norvegicus
gagagccgggtctccaagccgcttc

SEQ ID NO: 645496 - DNA, 25 bp, Rattus norvegicus
gtggctggagactagaaagaggaga

SEQ ID NO: 645497 - DNA, 25 bp, Rattus norvegicus
aaagaggagagagcagctcccggct

SEQ ID NO: 645498 - DNA, 25 bp, Rattus norvegicus
agaggcgggaactagggctgccgcc

SEQ ID NO: 645499 - DNA, 25 bp, Rattus norvegicus
agcctcctggagaagggagtctcga

SEQ ID NO: 645500 - DNA, 25 bp, Rattus norvegicus
tcctggagaagggagtctcgacccg

SEQ ID NO: 645501 - DNA, 25 bp, Rattus norvegicus
gccctgcgctctcgcgccacacctg

SEQ ID NO: 645502 - DNA, 25 bp, Rattus norvegicus
tgacaggaatttttggcgagcggtt

SEQ ID NO: 645503 - DNA, 25 bp, Rattus norvegicus
gtcagaagtgacaggaatttttggc

SEQ ID NO: 645504 - DNA, 25 bp, Rattus norvegicus
cccgcttcctgtcagaagtgacagg

SEQ ID NO: 645505 - DNA, 25 bp, Rattus norvegicus
agatcgagcaacagagagacagagg

SEQ ID NO: 645506 - DNA, 25 bp, Rattus norvegicus
cgcggtggctgaagatcgagcaaca

SEQ ID NO: 645507 - DNA, 25 bp, Rattus norvegicus
ccatggcgggctcgcgcctgaagac

SEQ ID NO: 645508 - DNA, 25 bp, Rattus norvegicus
cccaccgcctggaacgcctcctcca

SEQ ID NO: 645509 - DNA, 25 bp, Rattus norvegicus
acatctgatagaggcccatctcgcc

SEQ ID NO: 645510 - DNA, 25 bp, Rattus norvegicus
caagtacatctgatagaggcccatc

SEQ ID NO: 645511 - DNA, 25 bp, Rattus norvegicus
gcaggaagcacaagtacatctgata

SEQ ID NO: 645512 - DNA, 25 bp, Rattus norvegicus
agcagcacggccagcaggaagcaca

SEQ ID NO: 645513 - DNA, 25 bp, Rattus norvegicus
gccacacctggggccaggctgagct

SEQ ID NO: 645514 - DNA, 25 bp, Rattus norvegicus
cccttcgcacaaagcggtggaatgc

SEQ ID NO: 645515 - DNA, 25 bp, Rattus norvegicus
ctaggttccaggatgaggttcgccc

SEQ ID NO: 645516 - DNA, 25 bp, Rattus norvegicus
tgctgagtccagaccaagccgcaga

SEQ ID NO: 645517 - DNA, 25 bp, Rattus norvegicus
cagtaccctgagctcgcgaacttca

SEQ ID NO: 645518 - DNA, 25 bp, Rattus norvegicus
ttcacccgcagagatgcagcttgtg

SEQ ID NO: 645519 - DNA, 25 bp, Rattus norvegicus
tgccgggcattgtgtgattcacgtc

SEQ ID NO: 645520 - DNA, 25 bp, Rattus norvegicus
cagtctgcgtgacagatggtgctcc

SEQ ID NO: 645521 - DNA, 25 bp, Rattus norvegicus
ggccgaggagtcaattttcttttga

SEQ ID NO: 645522 - DNA, 25 bp, Rattus norvegicus
ggaaagcatttctatcaccggccta

SEQ ID NO: 645523 - DNA, 25 bp, Rattus norvegicus
ccctcggatgggaagatcactctgc

SEQ ID NO: 645524 - DNA, 25 bp, Rattus norvegicus
ccttcgggatcattcgtgtctggga

SEQ ID NO: 645525 - DNA, 25 bp, Rattus norvegicus
ctggccagaggagacacaagatgtc

SEQ ID NO: 645526 - DNA, 25 bp, Rattus norvegicus
ctccctatttgcgtgggtctgatac

SEQ ID NO: 645527 - DNA, 25 bp, Rattus norvegicus
atccttcgggcatccatccttcggg

SEQ ID NO: 645528 - DNA, 25 bp, Rattus norvegicus
cctcctaggagtgcaggcttgctag

SEQ ID NO: 645529 - DNA, 25 bp, Rattus norvegicus
cggccgagctgagtaactccgttgc

SEQ ID NO: 645530 - DNA, 25 bp, Rattus norvegicus
ctctccacggctgtcgcggggagaa

SEQ ID NO: 645531 - DNA, 25 bp, Rattus norvegicus
agaggcggccgagctgagtaactcc

SEQ ID NO: 645532 - DNA, 25 bp, Rattus norvegicus
gttttaataagcgtcgcccatcaat

SEQ ID NO: 645533 - DNA, 25 bp, Rattus norvegicus
gtgttttaataagcgtcgcccatca

SEQ ID NO: 645534 - DNA, 25 bp, Rattus norvegicus
acgcttccactgtgttttaataagc

SEQ ID NO: 645535 - DNA, 25 bp, Rattus norvegicus
gaaacgcttccactgtgttttaata

SEQ ID NO: 645536 - DNA, 25 bp, Rattus norvegicus
cagtaaataacgctgcctcgtcagc

SEQ ID NO: 645537 - DNA, 25 bp, Rattus norvegicus
taacagtaaataacgctgcctcgtc

SEQ ID NO: 645538 - DNA, 25 bp, Rattus norvegicus
ccagggcgaacaataacagtaaata

SEQ ID NO: 645539 - DNA, 25 bp, Rattus norvegicus
ggccagggcgaacaataacagtaaa

SEQ ID NO: 645540 - DNA, 25 bp, Rattus norvegicus
cgggactggctgtaggtgagctccc

SEQ ID NO: 645541 - DNA, 25 bp, Rattus norvegicus
cggggagaaggggttctgagaatag

SEQ ID NO: 645542 - DNA, 25 bp, Rattus norvegicus
agctgagtaactccgttgccatggc

SEQ ID NO: 645543 - DNA, 25 bp, Rattus norvegicus
cgagtctcgagaagcacgacccgga

SEQ ID NO: 645544 - DNA, 25 bp, Rattus norvegicus
tcatcttcgcggtctgagcatcaca

SEQ ID NO: 645545 - DNA, 25 bp, Rattus norvegicus
tcacacccggtttggagacgagaaa

SEQ ID NO: 645546 - DNA, 25 bp, Rattus norvegicus
aaagcttcacacttctctgggcgcg

SEQ ID NO: 645547 - DNA, 25 bp, Rattus norvegicus
ctgcaggatggaataaggttctacc

SEQ ID NO: 645548 - DNA, 25 bp, Rattus norvegicus
ggttctaccggcgtcaaaggctgcc

SEQ ID NO: 645549 - DNA, 25 bp, Rattus norvegicus
acagggactcctcctttggctggga

SEQ ID NO: 645550 - DNA, 25 bp, Rattus norvegicus
taaactacctgcctgttgcgctccg

SEQ ID NO: 645551 - DNA, 25 bp, Rattus norvegicus
agccagctccgttcgtgtgcccgaa

SEQ ID NO: 645552 - DNA, 25 bp, Rattus norvegicus
tgttctgccctgcaaggcgagtcca

SEQ ID NO: 645553 - DNA, 25 bp, Rattus norvegicus
gagtccagccactggttgcctccga

SEQ ID NO: 645554 - DNA, 25 bp, Rattus norvegicus
aggggcgcactccaaaggccagaca

SEQ ID NO: 645555 - DNA, 25 bp, Rattus norvegicus
gcaaggatagaaggacccgagtctc

SEQ ID NO: 645556 - DNA, 25 bp, Rattus norvegicus
ggacacccgcagttgggcctgacct

SEQ ID NO: 645557 - DNA, 25 bp, Rattus norvegicus
ctgcgcagcacactgaagagcgctg

SEQ ID NO: 645558 - DNA, 25 bp, Rattus norvegicus
tccactgctgcttgcgcggaatgga

SEQ ID NO: 645559 - DNA, 25 bp, Rattus norvegicus
cctcctgctaccacctccgcctaag

SEQ ID NO: 645560 - DNA, 25 bp, Rattus norvegicus
tccgcctaaggagctcgaccaaccc

SEQ ID NO: 645561 - DNA, 25 bp, Rattus norvegicus
cgtgcgcgagcacagagggtccact

SEQ ID NO: 645562 - DNA, 25 bp, Rattus norvegicus
cactgaagagcgctgggttcgcgca

SEQ ID NO: 645563 - DNA, 25 bp, Rattus norvegicus
gcggatcgcgaacgcgctgacctgc

SEQ ID NO: 645564 - DNA, 25 bp, Rattus norvegicus
gcctaggaagagtgcgctaagcgca

SEQ ID NO: 645565 - DNA, 25 bp, Rattus norvegicus
gcgctaagcgcaaccagcagcaaga

SEQ ID NO: 645566 - DNA, 25 bp, Rattus norvegicus
agcagcaagaccaacagcgcggaga

SEQ ID NO: 645567 - DNA, 25 bp, Rattus norvegicus
gcgcggagacaaatagaggcattta

SEQ ID NO: 645568 - DNA, 25 bp, Rattus norvegicus
atagaggcatttaggtccgggtccg

SEQ ID NO: 645569 - DNA, 25 bp, Rattus norvegicus
agcacagagggtccactgctgcttg

SEQ ID NO: 645570 - DNA, 25 bp, Rattus norvegicus
ccctcaccggcctaggaagagtgcg

SEQ ID NO: 645571 - DNA, 25 bp, Rattus norvegicus
aacactggcgcctgcagaagctgca

SEQ ID NO: 645572 - DNA, 25 bp, Rattus norvegicus
cagcctgagctctcgggctagaagg

SEQ ID NO: 645573 - DNA, 25 bp, Rattus norvegicus
acagcgctcaagagagcctggagtg

SEQ ID NO: 645574 - DNA, 25 bp, Rattus norvegicus
cttggttctctgtctggcgagattt

SEQ ID NO: 645575 - DNA, 25 bp, Rattus norvegicus
ctcagagtcccgagagtgccacgct

SEQ ID NO: 645576 - DNA, 25 bp, Rattus norvegicus
aggagtcccaaagtcaacactggcg

SEQ ID NO: 645577 - DNA, 25 bp, Rattus norvegicus
tttgtaggtcgaaacgcacccttga

SEQ ID NO: 645578 - DNA, 25 bp, Rattus norvegicus
ccttgaaagaagtgtcccgagtaga

SEQ ID NO: 645579 - DNA, 25 bp, Rattus norvegicus
cccgagtagatgaaggaacacgaga

SEQ ID NO: 645580 - DNA, 25 bp, Rattus norvegicus
ggaacacgagatcgcgggcacgcaa

SEQ ID NO: 645581 - DNA, 25 bp, Rattus norvegicus
tgagggtctctctggtcgtgaaatt

SEQ ID NO: 645582 - DNA, 25 bp, Rattus norvegicus
ggtcgtgaaattccctgtcccagga

SEQ ID NO: 645583 - DNA, 25 bp, Rattus norvegicus
ccctaggtaagaggaccagtcgccg

SEQ ID NO: 645584 - DNA, 25 bp, Rattus norvegicus
tgtcccaggatgaccaggagtccca

SEQ ID NO: 645585 - DNA, 25 bp, Rattus norvegicus
ggcctgcggtgcatcaagtatttgc

SEQ ID NO: 645586 - DNA, 25 bp, Rattus norvegicus
tgttctgggtgagacccgaaccggc

SEQ ID NO: 645587 - DNA, 25 bp, Rattus norvegicus
acctgctgttctgggtgagacccga

SEQ ID NO: 645588 - DNA, 25 bp, Rattus norvegicus
tcaacctgctgttctgggtgagacc

SEQ ID NO: 645589 - DNA, 25 bp, Rattus norvegicus
gctcggcttcaacctgctgttctgg

SEQ ID NO: 645590 - DNA, 25 bp, Rattus norvegicus
ttgctgctcggcttcaacctgctgt

SEQ ID NO: 645591 - DNA, 25 bp, Rattus norvegicus
gtatttgctgctcggcttcaacctg

SEQ ID NO: 645592 - DNA, 25 bp, Rattus norvegicus
gcggtgcatcaagtatttgctgctc

SEQ ID NO: 645593 - DNA, 25 bp, Rattus norvegicus
tagctggctgctcgcgtccagatcc

SEQ ID NO: 645594 - DNA, 25 bp, Rattus norvegicus
ccgcccgcagaccacgcctacaggt

SEQ ID NO: 645595 - DNA, 25 bp, Rattus norvegicus
tggacgaaggcggtgctacctccaa

SEQ ID NO: 645596 - DNA, 25 bp, Rattus norvegicus
gaaggcggtgctacctccaagggtc

SEQ ID NO: 645597 - DNA, 25 bp, Rattus norvegicus
acagctagctggctgctcgcgtcca

SEQ ID NO: 645598 - DNA, 25 bp, Rattus norvegicus
catcaagtatttgctgctcggcttc

SEQ ID NO: 645599 - DNA, 25 bp, Rattus norvegicus
tcgtgcacacttctcgcgggatttc

SEQ ID NO: 645600 - DNA, 25 bp, Rattus norvegicus
atttaaccgttgatccagctggccg

SEQ ID NO: 645601 - DNA, 25 bp, Rattus norvegicus
gctgggctgtactggctaaatttaa

SEQ ID NO: 645602 - DNA, 25 bp, Rattus norvegicus
agaagcccgagaacacgcccgactg

SEQ ID NO: 645603 - DNA, 25 bp, Rattus norvegicus
ctcagaacctcctagaagcccgaga

SEQ ID NO: 645604 - DNA, 25 bp, Rattus norvegicus
aatggaactgagagcttctgcctca

SEQ ID NO: 645605 - DNA, 25 bp, Rattus norvegicus
gcccgcgagcgcttctttatgaaga

SEQ ID NO: 645606 - DNA, 25 bp, Rattus norvegicus
caagcacccggacatgcgtgacaga

SEQ ID NO: 645607 - DNA, 25 bp, Rattus norvegicus
acaggcccagccagaacctcgaagg

SEQ ID NO: 645608 - DNA, 25 bp, Rattus norvegicus
cacacggcttggtgagtaaggctga

SEQ ID NO: 645609 - DNA, 25 bp, Rattus norvegicus
ctcagtctcggtgggacgaacaacg

SEQ ID NO: 645610 - DNA, 25 bp, Rattus norvegicus
agccgacacttgactgctgctcagt

SEQ ID NO: 645611 - DNA, 25 bp, Rattus norvegicus
cgtgaagggcttctgcttctccatg

SEQ ID NO: 645612 - DNA, 25 bp, Rattus norvegicus
tgaggtttcacagccgacacttgac

SEQ ID NO: 645613 - DNA, 25 bp, Rattus norvegicus
ctgccaaggtgccttaaagcgtacc

SEQ ID NO: 645614 - DNA, 25 bp, Rattus norvegicus
tgccttaaagcgtacccggaagtga

SEQ ID NO: 645615 - DNA, 25 bp, Rattus norvegicus
ggctgagcgaatcgccgaggctagc

SEQ ID NO: 645616 - DNA, 25 bp, Rattus norvegicus
gcctcttcggccactatgagctgta

SEQ ID NO: 645617 - DNA, 25 bp, Rattus norvegicus
cggccactatgagctgtacgatcga

SEQ ID NO: 645618 - DNA, 25 bp, Rattus norvegicus
tatgagctgtacgatcgagaagatc

SEQ ID NO: 645619 - DNA, 25 bp, Rattus norvegicus
tcgagaagatcttgacggacgccaa

SEQ ID NO: 645620 - DNA, 25 bp, Rattus norvegicus
cttgacggacgccaagacgctgctg

SEQ ID NO: 645621 - DNA, 25 bp, Rattus norvegicus
acgccaagacgctgctggagcggct

SEQ ID NO: 645622 - DNA, 25 bp, Rattus norvegicus
aacacgatgcggcggccgagtcgct

SEQ ID NO: 645623 - DNA, 25 bp, Rattus norvegicus
ggtcccgcggcttgatttatcttgg

SEQ ID NO: 645624 - DNA, 25 bp, Rattus norvegicus
caggcgcagaccgagctgccaaggt

SEQ ID NO: 645625 - DNA, 25 bp, Rattus norvegicus
gaccgagctgccaaggtgccttaaa

SEQ ID NO: 645626 - DNA, 25 bp, Rattus norvegicus
tcccgcggcttgatttatcttggtc

SEQ ID NO: 645627 - DNA, 25 bp, Rattus norvegicus
tggtgggagatctgcaaggccagaa

SEQ ID NO: 645628 - DNA, 25 bp, Rattus norvegicus
ccggcttttgttgcgccgggtctct

SEQ ID NO: 645629 - DNA, 25 bp, Rattus norvegicus
gagaactctccagctcatttctctc

SEQ ID NO: 645630 - DNA, 25 bp, Rattus norvegicus
cgcagagaactctccagctcatttc

SEQ ID NO: 645631 - DNA, 25 bp, Rattus norvegicus
ggcgcagagaactctccagctcatt

SEQ ID NO: 645632 - DNA, 25 bp, Rattus norvegicus
ctgggcgcagagaactctccagctc

SEQ ID NO: 645633 - DNA, 25 bp, Rattus norvegicus
ccgcggcgcccaggagtcccttggc

SEQ ID NO: 645634 - DNA, 25 bp, Rattus norvegicus
tttgctggtttagggcgtgccggta

SEQ ID NO: 645635 - DNA, 25 bp, Rattus norvegicus
acacagggaccctagccttcccagc

SEQ ID NO: 645636 - DNA, 25 bp, Rattus norvegicus
tcactgagccgagccacacagggac

SEQ ID NO: 645637 - DNA, 25 bp, Rattus norvegicus
ggggacctcactgagccgagccaca

SEQ ID NO: 645638 - DNA, 25 bp, Rattus norvegicus
tctctggggacctcactgagccgag

SEQ ID NO: 645639 - DNA, 25 bp, Rattus norvegicus
gcgccgggtctctggggacctcact

SEQ ID NO: 645640 - DNA, 25 bp, Rattus norvegicus
cgtgccggtagtgtcggaggagaag

SEQ ID NO: 645641 - DNA, 25 bp, Rattus norvegicus
gttggcgtcactcagcccttgcgcg

SEQ ID NO: 645642 - DNA, 25 bp, Rattus norvegicus
tattcctacgtaccgggccgtgctg

SEQ ID NO: 645643 - DNA, 25 bp, Rattus norvegicus
gagaagcgagatttattcctacgta

SEQ ID NO: 645644 - DNA, 25 bp, Rattus norvegicus
ggagtctgcaactctcgcgagagaa

SEQ ID NO: 645645 - DNA, 25 bp, Rattus norvegicus
tgcgcgcaagcgtactaagagcacg

SEQ ID NO: 645646 - DNA, 25 bp, Rattus norvegicus
aacgctggtcactggttggcgtcac

SEQ ID NO: 645647 - DNA, 25 bp, Rattus norvegicus
tcttgtgtgtggataaacgctggtc

SEQ ID NO: 645648 - DNA, 25 bp, Rattus norvegicus
gaacaaagtcaccatcttgtgtgtg

SEQ ID NO: 645649 - DNA, 25 bp, Rattus norvegicus
tcaggggccagagtataaaagaaca

SEQ ID NO: 645650 - DNA, 25 bp, Rattus norvegicus
gccgagattgcttctggaggactca

SEQ ID NO: 645651 - DNA, 25 bp, Rattus norvegicus
gcagagtcagtaaacgccgagattg

SEQ ID NO: 645652 - DNA, 25 bp, Rattus norvegicus
agcggagacgcctaaagtcactttc

SEQ ID NO: 645653 - DNA, 25 bp, Rattus norvegicus
tccggaagagcggagacgcctaaag

SEQ ID NO: 645654 - DNA, 25 bp, Rattus norvegicus
ccgtgcacgcgctcggagtctgcaa

SEQ ID NO: 645655 - DNA, 25 bp, Rattus norvegicus
ttgaaatccaaaagcctcccgaggc

SEQ ID NO: 645656 - DNA, 25 bp, Rattus norvegicus
ggcggccgccagacttaggtcgtca

SEQ ID NO: 645657 - DNA, 25 bp, Rattus norvegicus
gccagacttaggtcgtcagcccacg

SEQ ID NO: 645658 - DNA, 25 bp, Rattus norvegicus
acttaggtcgtcagcccacgtggct

SEQ ID NO: 645659 - DNA, 25 bp, Rattus norvegicus
atttggacgccctgggcgctcagtg

SEQ ID NO: 645660 - DNA, 25 bp, Rattus norvegicus
cctgggcgctcagtgattacgtagc

SEQ ID NO: 645661 - DNA, 25 bp, Rattus norvegicus
ttcatggcggtttcggggtctccaa

SEQ ID NO: 645662 - DNA, 25 bp, Rattus norvegicus
tctcaggttgaaatccaaaagcctc

SEQ ID NO: 645663 - DNA, 25 bp, Rattus norvegicus
tctgcggagtttgaggtaaggctcc

SEQ ID NO: 645664 - DNA, 25 bp, Rattus norvegicus
tttgaggtaaggctccggcctgcct

SEQ ID NO: 645665 - DNA, 25 bp, Rattus norvegicus
ggcctgcctggcgtcggacttctca

SEQ ID NO: 645666 - DNA, 25 bp, Rattus norvegicus
cctggcgtcggacttctcagggtgt

SEQ ID NO: 645667 - DNA, 25 bp, Rattus norvegicus
acttctcagggtgtggacgcctggc

SEQ ID NO: 645668 - DNA, 25 bp, Rattus norvegicus
tccaacagcttctcaggttgaaatc

SEQ ID NO: 645669 - DNA, 25 bp, Rattus norvegicus
actcgagtctccgagcactgcgcga

SEQ ID NO: 645670 - DNA, 25 bp, Rattus norvegicus
agaggccgcggactcgagtctccga

SEQ ID NO: 645671 - DNA, 25 bp, Rattus norvegicus
gcaatgggacctccgccgcttagct

SEQ ID NO: 645672 - DNA, 25 bp, Rattus norvegicus
tccgccgcttagctgttggcatcgc

SEQ ID NO: 645673 - DNA, 25 bp, Rattus norvegicus
ccatggcgtctagtgtgtccgtggt

SEQ ID NO: 645674 - DNA, 25 bp, Rattus norvegicus
tggtcagccgagagctgggtacctc

SEQ ID NO: 645675 - DNA, 25 bp, Rattus norvegicus
caccgcgaggaaacgcgcctatcag

SEQ ID NO: 645676 - DNA, 25 bp, Rattus norvegicus
ggtcttgaacttggacgtgcccgga

SEQ ID NO: 645677 - DNA, 25 bp, Rattus norvegicus
cgtgcccggacggagcacttcaaac

SEQ ID NO: 645678 - DNA, 25 bp, Rattus norvegicus
gagcacttcaaaccagcggtaaatc

SEQ ID NO: 645679 - DNA, 25 bp, Rattus norvegicus
accagcggtaaatcgtgtgtgcacg

SEQ ID NO: 645680 - DNA, 25 bp, Rattus norvegicus
gtgcacgcgctttgcctcggaacaa

SEQ ID NO: 645681 - DNA, 25 bp, Rattus norvegicus
gcctcggaacaacggggcaagcacg

SEQ ID NO: 645682 - DNA, 25 bp, Rattus norvegicus
ggcagaacctactgggcgagctccg

SEQ ID NO: 645683 - DNA, 25 bp, Rattus norvegicus
tgggatggccctaccataacagagc

SEQ ID NO: 645684 - DNA, 25 bp, Rattus norvegicus
accggtgattgtagcgcagcatctg

SEQ ID NO: 645685 - DNA, 25 bp, Rattus norvegicus
tatcggagccgcgtctttctcgaga

SEQ ID NO: 645686 - DNA, 25 bp, Rattus norvegicus
actccgcgaacgctgtaacactatc

SEQ ID NO: 645687 - DNA, 25 bp, Rattus norvegicus
cggggtcggatagctcctacgataa

SEQ ID NO: 645688 - DNA, 25 bp, Rattus norvegicus
ggtcctcgcggaccctacaatgaca

SEQ ID NO: 645689 - DNA, 25 bp, Rattus norvegicus
tctgggagagccgacaatcacccta

SEQ ID NO: 645690 - DNA, 25 bp, Rattus norvegicus
ccgcgggccaagaggatgagacaat

SEQ ID NO: 645691 - DNA, 25 bp, Rattus norvegicus
ccttacccaacggaactagtgatgg

SEQ ID NO: 645692 - DNA, 25 bp, Rattus norvegicus
gacgtagttctggtgcctacctggg

SEQ ID NO: 645693 - DNA, 25 bp, Rattus norvegicus
atgttcatcttgtctgcggccttgc

SEQ ID NO: 645694 - DNA, 25 bp, Rattus norvegicus
cccggaaagactcagggtcctgatc

SEQ ID NO: 645695 - DNA, 25 bp, Rattus norvegicus
ctgggccttggagacgctacaacca

SEQ ID NO: 645696 - DNA, 25 bp, Rattus norvegicus
ggggctccagatgccctactctaca

SEQ ID NO: 645697 - DNA, 25 bp, Rattus norvegicus
ctaatcgagcctgcgcagactcaga

SEQ ID NO: 645698 - DNA, 25 bp, Rattus norvegicus
ccagaggcagcgtgacgtcattcca

SEQ ID NO: 645699 - DNA, 25 bp, Rattus norvegicus
ccggaagcgaaaagccagaggcagc

SEQ ID NO: 645700 - DNA, 25 bp, Rattus norvegicus
gcaggcgcagagaatctaatcgagc

SEQ ID NO: 645701 - DNA, 25 bp, Rattus norvegicus
ttctcgttcttaggctgcggccctg

SEQ ID NO: 645702 - DNA, 25 bp, Rattus norvegicus
cgcagactcagaaggcgctcttgga

SEQ ID NO: 645703 - DNA, 25 bp, Rattus norvegicus
ctcagaaggcgctcttggagtacag

SEQ ID NO: 645704 - DNA, 25 bp, Rattus norvegicus
tcttggagtacagtgccgcgcgatg

SEQ ID NO: 645705 - DNA, 25 bp, Rattus norvegicus
gatgcgctaccctactttgaccaag

SEQ ID NO: 645706 - DNA, 25 bp, Rattus norvegicus
cctactttgaccaaggctatgaagc

SEQ ID NO: 645707 - DNA, 25 bp, Rattus norvegicus
caaggctatgaagcgcctggcgtgc

SEQ ID NO: 645708 - DNA, 25 bp, Rattus norvegicus
cccggcctgttctcgttcttaggct

SEQ ID NO: 645709 - DNA, 25 bp, Rattus norvegicus
aggtggtagtggatgcgctacccta

SEQ ID NO: 645710 - DNA, 25 bp, Rattus norvegicus
tgacgtcattccaggcgcaggcgca

SEQ ID NO: 645711 - DNA, 25 bp, Rattus norvegicus
gcggcttcggcgctagcagccaatc

SEQ ID NO: 645712 - DNA, 25 bp, Rattus norvegicus
cggcgggttcaaagaggaaaacatg

SEQ ID NO: 645713 - DNA, 25 bp, Rattus norvegicus
gtgttcgctcgctcgctacttcgct

SEQ ID NO: 645714 - DNA, 25 bp, Rattus norvegicus
gcgcggagcagcaccgcggtctact

SEQ ID NO: 645715 - DNA, 25 bp, Rattus norvegicus
tctgtggcaacgaacgagaccgagg

SEQ ID NO: 645716 - DNA, 25 bp, Rattus norvegicus
cagaattccagctctgtggcaacga

SEQ ID NO: 645717 - DNA, 25 bp, Rattus norvegicus
gcagccaatcccacgtcatagagac

SEQ ID NO: 645718 - DNA, 25 bp, Rattus norvegicus
ccgctctcgctgtggctgcggctga

SEQ ID NO: 645719 - DNA, 25 bp, Rattus norvegicus
aacatggcggaaaacaaaggcggcg

SEQ ID NO: 645720 - DNA, 25 bp, Rattus norvegicus
gctcctaccgagctacagaattcca

SEQ ID NO: 645721 - DNA, 25 bp, Rattus norvegicus
cttctgcctgcgctgtctgccggag

SEQ ID NO: 645722 - DNA, 25 bp, Rattus norvegicus
cagcaacggtgacgtccagcaaggt

SEQ ID NO: 645723 - DNA, 25 bp, Rattus norvegicus
acacctgcgcggtgtgtcagcagag

SEQ ID NO: 645724 - DNA, 25 bp, Rattus norvegicus
gcgcgctctcgtgtgttcgctcgct

SEQ ID NO: 645725 - DNA, 25 bp, Rattus norvegicus
tcccgggtcactaattacgagagcc

SEQ ID NO: 645726 - DNA, 25 bp, Rattus norvegicus
ttgtcagagcttcgagctgcagccc

SEQ ID NO: 645727 - DNA, 25 bp, Rattus norvegicus
caccgactttgccaggcgggaacct

SEQ ID NO: 645728 - DNA, 25 bp, Rattus norvegicus
ccgactcaggtaccgggagacccag

SEQ ID NO: 645729 - DNA, 25 bp, Rattus norvegicus
actcctgggttttcatctgggtggc

SEQ ID NO: 645730 - DNA, 25 bp, Rattus norvegicus
cctcagaagtctagctcagagttcc

SEQ ID NO: 645731 - DNA, 25 bp, Rattus norvegicus
gggagagatcccaagaggacccttc

SEQ ID NO: 645732 - DNA, 25 bp, Rattus norvegicus
gcccagggtctagggaccatcagtg

SEQ ID NO: 645733 - DNA, 25 bp, Rattus norvegicus
accactgggcatgggaaaaacttgc

SEQ ID NO: 645734 - DNA, 25 bp, Rattus norvegicus
aaaacttgcgtctgcagctggcacg

SEQ ID NO: 645735 - DNA, 25 bp, Rattus norvegicus
gtgtccaggtctctcagcagcgagt

SEQ ID NO: 645736 - DNA, 25 bp, Rattus norvegicus
tcggtctctctctgactcactcgga

SEQ ID NO: 645737 - DNA, 25 bp, Rattus norvegicus
gtgttcaactgagccggtgcctctc

SEQ ID NO: 645738 - DNA, 25 bp, Rattus norvegicus
cttgtgtctctaggctcatcccagg

SEQ ID NO: 645739 - DNA, 25 bp, Rattus norvegicus
gccaggcagcaggacggggcgccca

SEQ ID NO: 645740 - DNA, 25 bp, Rattus norvegicus
tagttctcagcctcgagtcggggcc

SEQ ID NO: 645741 - DNA, 25 bp, Rattus norvegicus
gttctcagcctcgagtcggggccgc

SEQ ID NO: 645742 - DNA, 25 bp, Rattus norvegicus
tgtgtgtagttctcagcctcgagtc

SEQ ID NO: 645743 - DNA, 25 bp, Rattus norvegicus
cggtgtgtgtagttctcagcctcga

SEQ ID NO: 645744 - DNA, 25 bp, Rattus norvegicus
cgccggtgtgtgtagttctcagcct

SEQ ID NO: 645745 - DNA, 25 bp, Rattus norvegicus
caccgccggtgtgtgtagttctcag

SEQ ID NO: 645746 - DNA, 25 bp, Rattus norvegicus
actcaccgccggtgtgtgtagttct

SEQ ID NO: 645747 - DNA, 25 bp, Rattus norvegicus
gagccagactcaccgccggtgtgtg

SEQ ID NO: 645748 - DNA, 25 bp, Rattus norvegicus
tgtgtagttctcagcctcgagtcgg

SEQ ID NO: 645749 - DNA, 25 bp, Rattus norvegicus
aggcgccccgcgcaagccggctacc

SEQ ID NO: 645750 - DNA, 25 bp, Rattus norvegicus
ttgtccggccgctcgcggccaggca

SEQ ID NO: 645751 - DNA, 25 bp, Rattus norvegicus
ggcacgcagtcttgtccggccgctc

SEQ ID NO: 645752 - DNA, 25 bp, Rattus norvegicus
cgagccagactcaccgccggtgtgt

SEQ ID NO: 645753 - DNA, 25 bp, Rattus norvegicus
ggagggctgtgatcactgcatcttg

SEQ ID NO: 645754 - DNA, 25 bp, Rattus norvegicus
gatcactgcatcttgcggccggccg

SEQ ID NO: 645755 - DNA, 25 bp, Rattus norvegicus
ccatgacacctactgaggcggaagt

SEQ ID NO: 645756 - DNA, 25 bp, Rattus norvegicus
agtggaaccccgagcaactgccttc

SEQ ID NO: 645757 - DNA, 25 bp, Rattus norvegicus
cgcacagcagcctccgaggtggttt

SEQ ID NO: 645758 - DNA, 25 bp, Rattus norvegicus
cctccgttgggagccagcgtggaca

SEQ ID NO: 645759 - DNA, 25 bp, Rattus norvegicus
tgatcactgcatcttgcggccggcc

SEQ ID NO: 645760 - DNA, 25 bp, Rattus norvegicus
ggctgtgatcactgcatcttgcggc

SEQ ID NO: 645761 - DNA, 25 bp, Rattus norvegicus
atgacacctactgaggcggaagtgc

SEQ ID NO: 645762 - DNA, 25 bp, Rattus norvegicus
gcgccatgacacctactgaggcgga

SEQ ID NO: 645763 - DNA, 25 bp, Rattus norvegicus
cctagcgccatgacacctactgagg

SEQ ID NO: 645764 - DNA, 25 bp, Rattus norvegicus
gccggaaccattcagccacctagcg

SEQ ID NO: 645765 - DNA, 25 bp, Rattus norvegicus
cccgcctcgccggaaccattcagcc

SEQ ID NO: 645766 - DNA, 25 bp, Rattus norvegicus
gtttcccagtcctctccgcacagca

SEQ ID NO: 645767 - DNA, 25 bp, Rattus norvegicus
gtatagaatacgtaactgggcccag

SEQ ID NO: 645768 - DNA, 25 bp, Rattus norvegicus
gcccaacgcggaagaagcccggaga

SEQ ID NO: 645769 - DNA, 25 bp, Rattus norvegicus
cgggatttccgcaggaagctggcta

SEQ ID NO: 645770 - DNA, 25 bp, Rattus norvegicus
tttggcctttagctggtcgagtata

SEQ ID NO: 645771 - DNA, 25 bp, Rattus norvegicus
gactgtgctacgtctttggccttta

SEQ ID NO: 645772 - DNA, 25 bp, Rattus norvegicus
agattccggggagcagactgtgcta

SEQ ID NO: 645773 - DNA, 25 bp, Rattus norvegicus
ggcctcggccactaaaactagattc

SEQ ID NO: 645774 - DNA, 25 bp, Rattus norvegicus
agcgcctcggaatgtttcagggtga

SEQ ID NO: 645775 - DNA, 25 bp, Rattus norvegicus
cgctcggagcgactggaaagcgcct

SEQ ID NO: 645776 - DNA, 25 bp, Rattus norvegicus
tagctgatttccgatggctggccgc

SEQ ID NO: 645777 - DNA, 25 bp, Rattus norvegicus
cggggagacagactctagtagctga

SEQ ID NO: 645778 - DNA, 25 bp, Rattus norvegicus
agcttaggcccagtccgcaactttg

SEQ ID NO: 645779 - DNA, 25 bp, Rattus norvegicus
agcattactcacacccgtgcgcggg

SEQ ID NO: 645780 - DNA, 25 bp, Rattus norvegicus
ctgggcccagagatacttgaaaaga

SEQ ID NO: 645781 - DNA, 25 bp, Rattus norvegicus
atctagaagaacagagccggcattc

SEQ ID NO: 645782 - DNA, 25 bp, Rattus norvegicus
tcactgagagccctgcttgggactc

SEQ ID NO: 645783 - DNA, 25 bp, Rattus norvegicus
gtacgacggcaacgaaaggttatgc

SEQ ID NO: 645784 - DNA, 25 bp, Rattus norvegicus
tggcttctgagcgatatggcaaatg

SEQ ID NO: 645785 - DNA, 25 bp, Rattus norvegicus
ggctgaggcttttcactcactgaga

SEQ ID NO: 645786 - DNA, 25 bp, Rattus norvegicus
cattcgtcagggcaaacgggagctc

SEQ ID NO: 645787 - DNA, 25 bp, Rattus norvegicus
cagattggtacgagctttggcaaga

SEQ ID NO: 645788 - DNA, 25 bp, Rattus norvegicus
cgcagctactgtcaagtcgagttaa

SEQ ID NO: 645789 - DNA, 25 bp, Rattus norvegicus
taaacctagagtgatggcggcaata

SEQ ID NO: 645790 - DNA, 25 bp, Rattus norvegicus
agagaacgcgccatctgtatccaga

SEQ ID NO: 645791 - DNA, 25 bp, Rattus norvegicus
ctggacggcttcctcgggaaatcac

SEQ ID NO: 645792 - DNA, 25 bp, Rattus norvegicus
cgggaaatcactcattctgcgcgtc

SEQ ID NO: 645793 - DNA, 25 bp, Rattus norvegicus
gcgcgtcctgattttctgagaagta

SEQ ID NO: 645794 - DNA, 25 bp, Rattus norvegicus
atggcaaatgcgctagtcgggattc

SEQ ID NO: 645795 - DNA, 25 bp, Rattus norvegicus
gagagactccaatgcccagcgggcc

SEQ ID NO: 645796 - DNA, 25 bp, Rattus norvegicus
cgcgcccagggtgccttacaataga

SEQ ID NO: 645797 - DNA, 25 bp, Rattus norvegicus
caggcggttgccacagtttgaccta

SEQ ID NO: 645798 - DNA, 25 bp, Rattus norvegicus
cttacaatagaagctcggttggcga

SEQ ID NO: 645799 - DNA, 25 bp, Rattus norvegicus
ttccggcatgttcaggtctacgaga

SEQ ID NO: 645800 - DNA, 25 bp, Rattus norvegicus
tctacgagaacgaccgatcagtgga

SEQ ID NO: 645801 - DNA, 25 bp, Rattus norvegicus
cacaaggagaggcacaagcaccatc

SEQ ID NO: 645802 - DNA, 25 bp, Rattus norvegicus
ccgggcgatctcaagcacaaggaca

SEQ ID NO: 645803 - DNA, 25 bp, Rattus norvegicus
cccaagagaggtgagagcatgcgaa

SEQ ID NO: 645804 - DNA, 25 bp, Rattus norvegicus
ggctgtaggtctcagcgcccatatc

SEQ ID NO: 645805 - DNA, 25 bp, Rattus norvegicus
cccactgaagtggactccggattgc

SEQ ID NO: 645806 - DNA, 25 bp, Rattus norvegicus
cggtcgggccatttaaatgtgtgtt

SEQ ID NO: 645807 - DNA, 25 bp, Rattus norvegicus
tttaggactgaaaggcgccgctcta

SEQ ID NO: 645808 - DNA, 25 bp, Rattus norvegicus
cagtttgacctacttgaggcttctc

SEQ ID NO: 645809 - DNA, 25 bp, Rattus norvegicus
gctaaatgctacagacccgcacagg

SEQ ID NO: 645810 - DNA, 25 bp, Rattus norvegicus
ctgctcatttcccagttggctcctg

SEQ ID NO: 645811 - DNA, 25 bp, Rattus norvegicus
tctcgtcaagagcttgtggagccgc

SEQ ID NO: 645812 - DNA, 25 bp, Rattus norvegicus
cgaggggactgtcagcttctgcctc

SEQ ID NO: 645813 - DNA, 25 bp, Rattus norvegicus
ctgaggtggctttccgttaatcgtc

SEQ ID NO: 645814 - DNA, 25 bp, Rattus norvegicus
ccgcacaggaacctctggaacatcg

SEQ ID NO: 645815 - DNA, 25 bp, Rattus norvegicus
tggcttctctcatggccggttctga

SEQ ID NO: 645816 - DNA, 25 bp, Rattus norvegicus
tgaagtaaacaccacgctaaatgct

SEQ ID NO: 645817 - DNA, 25 bp, Rattus norvegicus
gctcgtccacccaaaggagacaaga

SEQ ID NO: 645818 - DNA, 25 bp, Rattus norvegicus
ccgcactagtttgtgagctcgtcca

SEQ ID NO: 645819 - DNA, 25 bp, Rattus norvegicus
tttgtccatccaacaagaacggaga

SEQ ID NO: 645820 - DNA, 25 bp, Rattus norvegicus
aggccgcgcaaattcaccatttgtc

SEQ ID NO: 645821 - DNA, 25 bp, Rattus norvegicus
gttcacgttccaggccgcgcaaatt

SEQ ID NO: 645822 - DNA, 25 bp, Rattus norvegicus
tggaacatcgagaccggcctcccgg

SEQ ID NO: 645823 - DNA, 25 bp, Rattus norvegicus
tgtcccggttggtgagcccactgac

SEQ ID NO: 645824 - DNA, 25 bp, Rattus norvegicus
ttcttcaacgtcttcgacatcccga

SEQ ID NO: 645825 - DNA, 25 bp, Rattus norvegicus
ccttgctgagccaatgcttcttctt

SEQ ID NO: 645826 - DNA, 25 bp, Rattus norvegicus
actcctgcaccttgctgagccaatg

SEQ ID NO: 645827 - DNA, 25 bp, Rattus norvegicus
cccaggtaagggaactcgccgcgct

SEQ ID NO: 645828 - DNA, 25 bp, Rattus norvegicus
cttgcccgagaccacgcagcaggtg

SEQ ID NO: 645829 - DNA, 25 bp, Rattus norvegicus
gagctcagttttacctgccgcaaaa

SEQ ID NO: 645830 - DNA, 25 bp, Rattus norvegicus
acatcgccaggactgggcgccttgc

SEQ ID NO: 645831 - DNA, 25 bp, Rattus norvegicus
cctggcttcacggtcttcagacgga

SEQ ID NO: 645832 - DNA, 25 bp, Rattus norvegicus
tgagcccactgacgggcgtcccgtt

SEQ ID NO: 645833 - DNA, 25 bp, Rattus norvegicus
tcttcagacggattggctcgcggaa

SEQ ID NO: 645834 - DNA, 25 bp, Rattus norvegicus
tccaacagcacatcgccaggactgg

SEQ ID NO: 645835 - DNA, 25 bp, Rattus norvegicus
gacagcacacctggcttcacggtct

SEQ ID NO: 645836 - DNA, 25 bp, Rattus norvegicus
gttcaccggagctcagttttacctg

SEQ ID NO: 645837 - DNA, 25 bp, Rattus norvegicus
cccactgcagtgtgtgaggatcgcg

SEQ ID NO: 645838 - DNA, 25 bp, Rattus norvegicus
gtcccgtgaagggtattgcaagtca

SEQ ID NO: 645839 - DNA, 25 bp, Rattus norvegicus
tggggttatacgcaccaacgcgatg

SEQ ID NO: 645840 - DNA, 25 bp, Rattus norvegicus
ggcgcaccgtgtcccaaaactataa

SEQ ID NO: 645841 - DNA, 25 bp, Rattus norvegicus
gagctacttaacatccacggagtgg

SEQ ID NO: 645842 - DNA, 25 bp, Rattus norvegicus
gcttttgactttcgggagctactta

SEQ ID NO: 645843 - DNA, 25 bp, Rattus norvegicus
catggggtgtttgttctgtagttac

SEQ ID NO: 645844 - DNA, 25 bp, Rattus norvegicus
attgcaagtcaacgcggctggcatc

SEQ ID NO: 645845 - DNA, 25 bp, Rattus norvegicus
aatgtgtcagctcggcctgggatac

SEQ ID NO: 645846 - DNA, 25 bp, Rattus norvegicus
gtagttactgtcacgatttaggccc

SEQ ID NO: 645847 - DNA, 25 bp, Rattus norvegicus
tactgctcggctaagtcatggggtg

SEQ ID NO: 645848 - DNA, 25 bp, Rattus norvegicus
ggactcacggggaagattactgctc

SEQ ID NO: 645849 - DNA, 25 bp, Rattus norvegicus
ctgggatacccgcagagcggactca

SEQ ID NO: 645850 - DNA, 25 bp, Rattus norvegicus
ccgccaccgatagccaagcttttga

SEQ ID NO: 645851 - DNA, 25 bp, Rattus norvegicus
cctctactcacaggctggagatgtc

SEQ ID NO: 645852 - DNA, 25 bp, Rattus norvegicus
gacgcaacgtcctcacgctcagaag

SEQ ID NO: 645853 - DNA, 25 bp, Rattus norvegicus
ggggcgtagagctgaaacactgaca

SEQ ID NO: 645854 - DNA, 25 bp, Rattus norvegicus
cgagaggaggaaacgacgtgaccac

SEQ ID NO: 645855 - DNA, 25 bp, Rattus norvegicus
ctgtcccttagagcaggcgagagga

SEQ ID NO: 645856 - DNA, 25 bp, Rattus norvegicus
gccgtcacctgtcccttagagcagg

SEQ ID NO: 645857 - DNA, 25 bp, Rattus norvegicus
gcagctagcacagagagtcggctga

SEQ ID NO: 645858 - DNA, 25 bp, Rattus norvegicus
acccgctcgaggacagcagctagca

SEQ ID NO: 645859 - DNA, 25 bp, Rattus norvegicus
ggtgcaaggggtcccaacctacagc

SEQ ID NO: 645860 - DNA, 25 bp, Rattus norvegicus
tgcgcaagcatgagcagcggtgcaa

SEQ ID NO: 645861 - DNA, 25 bp, Rattus norvegicus
gcagcgcctgcgcaagcatgagcag

SEQ ID NO: 645862 - DNA, 25 bp, Rattus norvegicus
cgactgcagtccagcaaaggaaggc

SEQ ID NO: 645863 - DNA, 25 bp, Rattus norvegicus
gccggcagcttcctgcgactgcagt

SEQ ID NO: 645864 - DNA, 25 bp, Rattus norvegicus
gggccctctactcacaggctggaga

SEQ ID NO: 645865 - DNA, 25 bp, Rattus norvegicus
tacttaggactcgtggcatacccgc

SEQ ID NO: 645866 - DNA, 25 bp, Rattus norvegicus
cagctagcccagagcgcgcggataa

SEQ ID NO: 645867 - DNA, 25 bp, Rattus norvegicus
ccgggcacgcgccaaaagcagctag

SEQ ID NO: 645868 - DNA, 25 bp, Rattus norvegicus
aggccggttcacgtggtgcactcct

SEQ ID NO: 645869 - DNA, 25 bp, Rattus norvegicus
gtacagcctactgtcggcgcctgga

SEQ ID NO: 645870 - DNA, 25 bp, Rattus norvegicus
ggggagacgcttccagtacagccta

SEQ ID NO: 645871 - DNA, 25 bp, Rattus norvegicus
gtcccgcgagcatgcggagactttc

SEQ ID NO: 645872 - DNA, 25 bp, Rattus norvegicus
cttctgctcggaggaaaggcactgg

SEQ ID NO: 645873 - DNA, 25 bp, Rattus norvegicus
gggtctgccaatcggtgtcccacct

SEQ ID NO: 645874 - DNA, 25 bp, Rattus norvegicus
cgccgcgagatacacataacggtta

SEQ ID NO: 645875 - DNA, 25 bp, Rattus norvegicus
cggctccgaagaattgcggcccgcg

SEQ ID NO: 645876 - DNA, 25 bp, Rattus norvegicus
cgggttataaggcagccgcgcctgc

SEQ ID NO: 645877 - DNA, 25 bp, Rattus norvegicus
tcccacctggtgacttgctagagtg

SEQ ID NO: 645878 - DNA, 25 bp, Rattus norvegicus
gctgcacggaatccgcggtgccctt

SEQ ID NO: 645879 - DNA, 25 bp, Rattus norvegicus
gatgatccgcgctcagctgcgatcc

SEQ ID NO: 645880 - DNA, 25 bp, Rattus norvegicus
gcgatcctcccatccaccgaccttg

SEQ ID NO: 645881 - DNA, 25 bp, Rattus norvegicus
ggcgtaggatgatccgcgctcagct

SEQ ID NO: 645882 - DNA, 25 bp, Rattus norvegicus
atgcttcgcctgctgtggaggcgta

SEQ ID NO: 645883 - DNA, 25 bp, Rattus norvegicus
aaccgagtatgcttcgcctgctgtg

SEQ ID NO: 645884 - DNA, 25 bp, Rattus norvegicus
ctctgcgcagaaccgagtatgcttc

SEQ ID NO: 645885 - DNA, 25 bp, Rattus norvegicus
gggtctagattgagctctgcgcaga

SEQ ID NO: 645886 - DNA, 25 bp, Rattus norvegicus
actcccggggtctagattgagctct

SEQ ID NO: 645887 - DNA, 25 bp, Rattus norvegicus
tgcgcgtccagactcccggggtcta

SEQ ID NO: 645888 - DNA, 25 bp, Rattus norvegicus
cacctggcctgtcctaacgcgaggg

SEQ ID NO: 645889 - DNA, 25 bp, Rattus norvegicus
attgcggcacctggcctgtcctaac

SEQ ID NO: 645890 - DNA, 25 bp, Rattus norvegicus
cccggcagttttgcgattgcggcac

SEQ ID NO: 645891 - DNA, 25 bp, Rattus norvegicus
accggcgcccggcagttttgcgatt

SEQ ID NO: 645892 - DNA, 25 bp, Rattus norvegicus
atccaccgaccttgcgccacgcgtc

SEQ ID NO: 645893 - DNA, 25 bp, Rattus norvegicus
gctcccagacgaggataggacttcc

SEQ ID NO: 645894 - DNA, 25 bp, Rattus norvegicus
tgtgcaaagccctccggacaccggt

SEQ ID NO: 645895 - DNA, 25 bp, Rattus norvegicus
ccgcggagactccagtgagcttctc

SEQ ID NO: 645896 - DNA, 25 bp, Rattus norvegicus
ccgggagccctagagacacctaaga

SEQ ID NO: 645897 - DNA, 25 bp, Rattus norvegicus
aaagctatctcaccgcctccgggag

SEQ ID NO: 645898 - DNA, 25 bp, Rattus norvegicus
gtctccagatctgcccaaagctatc

SEQ ID NO: 645899 - DNA, 25 bp, Rattus norvegicus
ggcagcatgctaaaccgggtgcgct

SEQ ID NO: 645900 - DNA, 25 bp, Rattus norvegicus
taggacttccattctcccaggagac

SEQ ID NO: 645901 - DNA, 25 bp, Rattus norvegicus
tgccttggagcacaggctatgccga

SEQ ID NO: 645902 - DNA, 25 bp, Rattus norvegicus
gacgctccgggaaccatcccaggaa

SEQ ID NO: 645903 - DNA, 25 bp, Rattus norvegicus
ggcccgctgttcacaggctaaggga

SEQ ID NO: 645904 - DNA, 25 bp, Rattus norvegicus
agtggaaagactcgctcacccgctt

SEQ ID NO: 645905 - DNA, 25 bp, Rattus norvegicus
atagcccgcgacaccagaaggcctg

SEQ ID NO: 645906 - DNA, 25 bp, Rattus norvegicus
acctggtgagctccagtggcacttc

SEQ ID NO: 645907 - DNA, 25 bp, Rattus norvegicus
cctgggagtcgctcaactttcccga

SEQ ID NO: 645908 - DNA, 25 bp, Rattus norvegicus
agggcagcagtggccctcgctgacc

SEQ ID NO: 645909 - DNA, 25 bp, Rattus norvegicus
tttctggacatggtccctccagctc

SEQ ID NO: 645910 - DNA, 25 bp, Rattus norvegicus
tcgctcaactttcccgaagcgggtc

SEQ ID NO: 645911 - DNA, 25 bp, Rattus norvegicus
tcatcacccagcaatccaaacattt

SEQ ID NO: 645912 - DNA, 25 bp, Rattus norvegicus
aggcgtcgtgggaactgacctcgga

SEQ ID NO: 645913 - DNA, 25 bp, Rattus norvegicus
tgacctcggaggagagcactttcct

SEQ ID NO: 645914 - DNA, 25 bp, Rattus norvegicus
ggagagcactttcctgcttcccgga

SEQ ID NO: 645915 - DNA, 25 bp, Rattus norvegicus
cctgcttcccggatcgctcggggaa

SEQ ID NO: 645916 - DNA, 25 bp, Rattus norvegicus
tccaaacatttctggacatggtccc

SEQ ID NO: 645917 - DNA, 25 bp, Rattus norvegicus
aggcgctctcgcctcctgagctctc

SEQ ID NO: 645918 - DNA, 25 bp, Rattus norvegicus
tcccggatcgctcggggaacggctc

SEQ ID NO: 645919 - DNA, 25 bp, Rattus norvegicus
gatactggaacgtcgagggctgctt

SEQ ID NO: 645920 - DNA, 25 bp, Rattus norvegicus
ggctcgggtcagtctcagcctccgg

SEQ ID NO: 645921 - DNA, 25 bp, Rattus norvegicus
tccgggaaatgaaactgaaagtcgc

SEQ ID NO: 645922 - DNA, 25 bp, Rattus norvegicus
aatgaaactgaaagtcgccgccgcg

SEQ ID NO: 645923 - DNA, 25 bp, Rattus norvegicus
cggagctttcggcagctgaacttgc

SEQ ID NO: 645924 - DNA, 25 bp, Rattus norvegicus
tctcccggagctttcggcagctgaa

SEQ ID NO: 645925 - DNA, 25 bp, Rattus norvegicus
tcgcgatctgtctccaggtccagtc

SEQ ID NO: 645926 - DNA, 25 bp, Rattus norvegicus
agccgctcgcgatctgtctccaggt

SEQ ID NO: 645927 - DNA, 25 bp, Rattus norvegicus
cgcggttgtaaatcgcccgcagccg

SEQ ID NO: 645928 - DNA, 25 bp, Rattus norvegicus
cttgaagtcgcggttgtaaatcgcc

SEQ ID NO: 645929 - DNA, 25 bp, Rattus norvegicus
cggcccgtacctgggcttgaagtcg

SEQ ID NO: 645930 - DNA, 25 bp, Rattus norvegicus
atcggcccggagatgcatccctgtg

SEQ ID NO: 645931 - DNA, 25 bp, Rattus norvegicus
cgaccggcctgatcggcccggagat

SEQ ID NO: 645932 - DNA, 25 bp, Rattus norvegicus
aggtctgccaggacccgaccggcct

SEQ ID NO: 645933 - DNA, 25 bp, Rattus norvegicus
tgcaggcagtcgtccctcaacaagg

SEQ ID NO: 645934 - DNA, 25 bp, Rattus norvegicus
tttcggcagctgaacttgctgggca

SEQ ID NO: 645935 - DNA, 25 bp, Rattus norvegicus
agagtaggccaccttccaggcgttc

SEQ ID NO: 645936 - DNA, 25 bp, Rattus norvegicus
gctccctctggtcaagtagcagttg

SEQ ID NO: 645937 - DNA, 25 bp, Rattus norvegicus
tcctgcagaataagtgccaccatcg

SEQ ID NO: 645938 - DNA, 25 bp, Rattus norvegicus
agcgccacattgagtccgtttcctg

SEQ ID NO: 645939 - DNA, 25 bp, Rattus norvegicus
agtacttttccaacgccggcacagg

SEQ ID NO: 645940 - DNA, 25 bp, Rattus norvegicus
tgctcggctctaggagacatcagta

SEQ ID NO: 645941 - DNA, 25 bp, Rattus norvegicus
gccgccgagtccagtgcactaagag

SEQ ID NO: 645942 - DNA, 25 bp, Rattus norvegicus
tcctgatcccgttggtctcgtaggc

SEQ ID NO: 645943 - DNA, 25 bp, Rattus norvegicus
gcagttgctacacctagaagttttc

SEQ ID NO: 645944 - DNA, 25 bp, Rattus norvegicus
cagtcactttcccattcgtcctgga

SEQ ID NO: 645945 - DNA, 25 bp, Rattus norvegicus
ggagcgctctaggaagtcgactttc

SEQ ID NO: 645946 - DNA, 25 bp, Rattus norvegicus
gaggccagcttcaagtccgccacta

SEQ ID NO: 645947 - DNA, 25 bp, Rattus norvegicus
ccctcagggttttgcagtcttaaca

SEQ ID NO: 645948 - DNA, 25 bp, Rattus norvegicus
ctgctttacgctctgagggtcccgc

SEQ ID NO: 645949 - DNA, 25 bp, Rattus norvegicus
ggtgcctggtgtcacgcaagcccag

SEQ ID NO: 645950 - DNA, 25 bp, Rattus norvegicus
cactacgcaggcacactctggcata

SEQ ID NO: 645951 - DNA, 25 bp, Rattus norvegicus
caggcacactctggcatacacgggg

SEQ ID NO: 645952 - DNA, 25 bp, Rattus norvegicus
gcaggcaggcgtgtctcgtacacac

SEQ ID NO: 645953 - DNA, 25 bp, Rattus norvegicus
aagtcacacgcctcaggcaggcagg

SEQ ID NO: 645954 - DNA, 25 bp, Rattus norvegicus
aggcgtgtctcgtacacacccacta

SEQ ID NO: 645955 - DNA, 25 bp, Rattus norvegicus
cggcgaatacttccgggtgaagcga

SEQ ID NO: 645956 - DNA, 25 bp, Rattus norvegicus
atacttccgggtgaagcgaaggaga

SEQ ID NO: 645957 - DNA, 25 bp, Rattus norvegicus
agagtcctaggaacgctctgacttc

SEQ ID NO: 645958 - DNA, 25 bp, Rattus norvegicus
aggaacgctctgacttctggaagtg

SEQ ID NO: 645959 - DNA, 25 bp, Rattus norvegicus
ctctgacttctggaagtgttcagcc

SEQ ID NO: 645960 - DNA, 25 bp, Rattus norvegicus
ccatgcacgtctgtgcaccggtgca

SEQ ID NO: 645961 - DNA, 25 bp, Rattus norvegicus
gctttgtttcagttaattgggtggc

SEQ ID NO: 645962 - DNA, 25 bp, Rattus norvegicus
gcgacagggtgtcgcgctcagccac

SEQ ID NO: 645963 - DNA, 25 bp, Rattus norvegicus
tcctcctctcggttctacggatgtc

SEQ ID NO: 645964 - DNA, 25 bp, Rattus norvegicus
ggtcctagcgcccttcactcggcaa

SEQ ID NO: 645965 - DNA, 25 bp, Rattus norvegicus
tgtccctaccgacgccacgccacgc

SEQ ID NO: 645966 - DNA, 25 bp, Rattus norvegicus
tcctctcggttctacggatgtccac

SEQ ID NO: 645967 - DNA, 25 bp, Rattus norvegicus
ttcactcggcaacgctgaccactgc

SEQ ID NO: 645968 - DNA, 25 bp, Rattus norvegicus
tccaatgcgccctaggtgtggcggc

SEQ ID NO: 645969 - DNA, 25 bp, Rattus norvegicus
ccgggtgctccaatgcgccctaggt

SEQ ID NO: 645970 - DNA, 25 bp, Rattus norvegicus
tgcggccgcagctctcattggacgg

SEQ ID NO: 645971 - DNA, 25 bp, Rattus norvegicus
agctgcagggccaggagactgacga

SEQ ID NO: 645972 - DNA, 25 bp, Rattus norvegicus
acctcaaggcacgtggagtccggga

SEQ ID NO: 645973 - DNA, 25 bp, Rattus norvegicus
caggaacctcaaggcacgtggagtc

SEQ ID NO: 645974 - DNA, 25 bp, Rattus norvegicus
tggacgggcactgtctgggcttcct

SEQ ID NO: 645975 - DNA, 25 bp, Rattus norvegicus
cggcttcagcatagctccgcgcaga

SEQ ID NO: 645976 - DNA, 25 bp, Rattus norvegicus
cgacggggctcttccctgcctgcag

SEQ ID NO: 645977 - DNA, 25 bp, Rattus norvegicus
gttctgggcgtcacaacgcgcggat

SEQ ID NO: 645978 - DNA, 25 bp, Rattus norvegicus
cccgcggctgtctgtgggaatgggc

SEQ ID NO: 645979 - DNA, 25 bp, Rattus norvegicus
actctcgctgcgatcgctctgttct

SEQ ID NO: 645980 - DNA, 25 bp, Rattus norvegicus
tctcgctgcgatcgctctgttctgg

SEQ ID NO: 645981 - DNA, 25 bp, Rattus norvegicus
atcgctctgttctgggcgtcacaac

SEQ ID NO: 645982 - DNA, 25 bp, Rattus norvegicus
tgaaagcccggaaccagagagaagg

SEQ ID NO: 645983 - DNA, 25 bp, Rattus norvegicus
tcacaacgcgcggatgtggcccaga

SEQ ID NO: 645984 - DNA, 25 bp, Rattus norvegicus
gtggcccagagagacgccgcagacc

SEQ ID NO: 645985 - DNA, 25 bp, Rattus norvegicus
cagacccaggggtgaggcaggtcgt

SEQ ID NO: 645986 - DNA, 25 bp, Rattus norvegicus
gttccgtggagacccgactgagcga

SEQ ID NO: 645987 - DNA, 25 bp, Rattus norvegicus
agacccgactgagcgagcccagacg

SEQ ID NO: 645988 - DNA, 25 bp, Rattus norvegicus
ccagccctctgcgacgctcgcggcc

SEQ ID NO: 645989 - DNA, 25 bp, Rattus norvegicus
ggctggaacgcaccccttgcgcagg

SEQ ID NO: 645990 - DNA, 25 bp, Rattus norvegicus
cgatcgctctgttctgggcgtcaca

SEQ ID NO: 645991 - DNA, 25 bp, Rattus norvegicus
cgaaagaccctacggccatctcgtt

SEQ ID NO: 645992 - DNA, 25 bp, Rattus norvegicus
gtctgttcgccttttaagccgtctc

SEQ ID NO: 645993 - DNA, 25 bp, Rattus norvegicus
taagccgtctccctcggcagttctg

SEQ ID NO: 645994 - DNA, 25 bp, Rattus norvegicus
tgccgtctgtctgttcgccttttaa

SEQ ID NO: 645995 - DNA, 25 bp, Rattus norvegicus
aggttgtgccaacgccaggtgcgca

SEQ ID NO: 645996 - DNA, 25 bp, Rattus norvegicus
agacgagtaggttgtgccaacgcca

SEQ ID NO: 645997 - DNA, 25 bp, Rattus norvegicus
ccctcggcagttctgggaagaccgt

SEQ ID NO: 645998 - DNA, 25 bp, Rattus norvegicus
cagagcccagatcccagatacaatg

SEQ ID NO: 645999 - DNA, 25 bp, Rattus norvegicus
gacatccgaaggcatcctcggctgc

SEQ ID NO: 646000 - DNA, 25 bp, Rattus norvegicus
tcccagatacaatggagtgtgtgaa

SEQ ID NO: 646001 - DNA, 25 bp, Rattus norvegicus
tggccagcgcgccacgatcgtttct

SEQ ID NO: 646002 - DNA, 25 bp, Rattus norvegicus
ggaacccgccgacttagagcgcgaa

SEQ ID NO: 646003 - DNA, 25 bp, Rattus norvegicus
acttagagcgcgaaggggctgtccc

SEQ ID NO: 646004 - DNA, 25 bp, Rattus norvegicus
gaagaccgtccagtctctggccagc

SEQ ID NO: 646005 - DNA, 25 bp, Rattus norvegicus
atgaacagtcgcgaggaccctggag

SEQ ID NO: 646006 - DNA, 25 bp, Rattus norvegicus
cctcctcggggaatcccgggatctg

SEQ ID NO: 646007 - DNA, 25 bp, Rattus norvegicus
agacaatgaacagtcgcgaggaccc

SEQ ID NO: 646008 - DNA, 25 bp, Rattus norvegicus
aacagtcgcgaggaccctggaggat

SEQ ID NO: 646009 - DNA, 25 bp, Rattus norvegicus
gaccctggaggatgccgcgacgcct

SEQ ID NO: 646010 - DNA, 25 bp, Rattus norvegicus
tcctcggggaatcccgggatctgga

SEQ ID NO: 646011 - DNA, 25 bp, Rattus norvegicus
cccgacagggactgctgctgaaagc

SEQ ID NO: 646012 - DNA, 25 bp, Rattus norvegicus
acagggactgctgctgaaagccata

SEQ ID NO: 646013 - DNA, 25 bp, Rattus norvegicus
aggctctctcggagacccggccacc

SEQ ID NO: 646014 - DNA, 25 bp, Rattus norvegicus
ggctggcgagagacaatgaacagtc

SEQ ID NO: 646015 - DNA, 25 bp, Rattus norvegicus
ctgctgctgaaagccatacacgctc

SEQ ID NO: 646016 - DNA, 25 bp, Rattus norvegicus
tgctgaaagccatacacgctccggg

SEQ ID NO: 646017 - DNA, 25 bp, Rattus norvegicus
gaaagccatacacgctccgggccgg

SEQ ID NO: 646018 - DNA, 25 bp, Rattus norvegicus
ggactgctgctgaaagccatacacg

SEQ ID NO: 646019 - DNA, 25 bp, Rattus norvegicus
ttcgcgatctccaggcccgggattc

SEQ ID NO: 646020 - DNA, 25 bp, Rattus norvegicus
cttcgcgatctccaggcccgggatt

SEQ ID NO: 646021 - DNA, 25 bp, Rattus norvegicus
gcttcgcgatctccaggcccgggat

SEQ ID NO: 646022 - DNA, 25 bp, Rattus norvegicus
tgcttcgcgatctccaggcccggga

SEQ ID NO: 646023 - DNA, 25 bp, Rattus norvegicus
attcccagcacccaggccggagaca

SEQ ID NO: 646024 - DNA, 25 bp, Rattus norvegicus
cgacagaggcacgaagcagcctgct

SEQ ID NO: 646025 - DNA, 25 bp, Rattus norvegicus
cgatctccaggcccgggattcccag

SEQ ID NO: 646026 - DNA, 25 bp, Rattus norvegicus
tcccgacagaggcacgaagcagcct

SEQ ID NO: 646027 - DNA, 25 bp, Rattus norvegicus
gacagaggcacgaagcagcctgctt

SEQ ID NO: 646028 - DNA, 25 bp, Rattus norvegicus
acagaggcacgaagcagcctgcttc

SEQ ID NO: 646029 - DNA, 25 bp, Rattus norvegicus
cagaggcacgaagcagcctgcttcg

SEQ ID NO: 646030 - DNA, 25 bp, Rattus norvegicus
agaggcacgaagcagcctgcttcgc

SEQ ID NO: 646031 - DNA, 25 bp, Rattus norvegicus
ccgacagaggcacgaagcagcctgc

SEQ ID NO: 646032 - DNA, 25 bp, Rattus norvegicus
cccgacagaggcacgaagcagcctg

SEQ ID NO: 646033 - DNA, 25 bp, Rattus norvegicus
ctgccgcggtggtcatggaactctc

SEQ ID NO: 646034 - DNA, 25 bp, Rattus norvegicus
tcggctgggcactacgcacccgtgg

SEQ ID NO: 646035 - DNA, 25 bp, Rattus norvegicus
agacacggagacacagggaaagccg

SEQ ID NO: 646036 - DNA, 25 bp, Rattus norvegicus
gcacccgtgggcctcccactcctca

SEQ ID NO: 646037 - DNA, 25 bp, Rattus norvegicus
tcatggaactctcggctgggcacta

SEQ ID NO: 646038 - DNA, 25 bp, Rattus norvegicus
cgcggtggtcatggaactctcggct

SEQ ID NO: 646039 - DNA, 25 bp, Rattus norvegicus
cacggagacacagggaaagccggcc

SEQ ID NO: 646040 - DNA, 25 bp, Rattus norvegicus
gctactcgtgctgccgcggtggtca

SEQ ID NO: 646041 - DNA, 25 bp, Rattus norvegicus
tgcgcgctactcgtgctgccgcggt

SEQ ID NO: 646042 - DNA, 25 bp, Rattus norvegicus
caggactgcgcgctactcgtgctgc

SEQ ID NO: 646043 - DNA, 25 bp, Rattus norvegicus
gtttggcttagcagccaggactgcg

SEQ ID NO: 646044 - DNA, 25 bp, Rattus norvegicus
aagccggccacggtttggcttagca

SEQ ID NO: 646045 - DNA, 25 bp, Rattus norvegicus
gaactctcggctgggcactacgcac

SEQ ID NO: 646046 - DNA, 25 bp, Rattus norvegicus
agacacagggaaagccggccacggt

SEQ ID NO: 646047 - DNA, 25 bp, Rattus norvegicus
aagcgaccgagccttccggagccag

SEQ ID NO: 646048 - DNA, 25 bp, Rattus norvegicus
gctgcctggccgctctgtgctctgg

SEQ ID NO: 646049 - DNA, 25 bp, Rattus norvegicus
taggattcctccactctcctgggga

SEQ ID NO: 646050 - DNA, 25 bp, Rattus norvegicus
cactctcctggggagacgcaccagg

SEQ ID NO: 646051 - DNA, 25 bp, Rattus norvegicus
tgttgctccggatgcccacgcggca

SEQ ID NO: 646052 - DNA, 25 bp, Rattus norvegicus
gcaagtgcgaggagcgctgctccca

SEQ ID NO: 646053 - DNA, 25 bp, Rattus norvegicus
taagagggaagcgaccgagccttcc

SEQ ID NO: 646054 - DNA, 25 bp, Rattus norvegicus
agacgcaccaggctctgcctagtct

SEQ ID NO: 646055 - DNA, 25 bp, Rattus norvegicus
cgcacgaaccgaccgagtgaaggag

SEQ ID NO: 646056 - DNA, 25 bp, Rattus norvegicus
gaccgacgcacgaaccgaccgagtg

SEQ ID NO: 646057 - DNA, 25 bp, Rattus norvegicus
cttccggagccagcaagtgcgagga

SEQ ID NO: 646058 - DNA, 25 bp, Rattus norvegicus
aagggacgctctgccaagcccgggc

SEQ ID NO: 646059 - DNA, 25 bp, Rattus norvegicus
aaccggagctcacgagccggagagc

SEQ ID NO: 646060 - DNA, 25 bp, Rattus norvegicus
cagggaacgagcgaaccggagctca

SEQ ID NO: 646061 - DNA, 25 bp, Rattus norvegicus
catccgcagtgtgatgagcatcatc

SEQ ID NO: 646062 - DNA, 25 bp, Rattus norvegicus
aactgccgtgtggagagcgctactc

SEQ ID NO: 646063 - DNA, 25 bp, Rattus norvegicus
tctcggtgatcaccaacgtggtgga

SEQ ID NO: 646064 - DNA, 25 bp, Rattus norvegicus
agcgctactccgtggctttcttctg

SEQ ID NO: 646065 - DNA, 25 bp, Rattus norvegicus
ctttcttctgcctggacactgcgtg

SEQ ID NO: 646066 - DNA, 25 bp, Rattus norvegicus
acactgcgtgtgtcatgatcttcac

SEQ ID NO: 646067 - DNA, 25 bp, Rattus norvegicus
ggtggagtacctcctccgactcttc

SEQ ID NO: 646068 - DNA, 25 bp, Rattus norvegicus
gcaggtaccgcttcatccgcagtgt

SEQ ID NO: 646069 - DNA, 25 bp, Rattus norvegicus
ggcatttgtcacactccgggtcttc

SEQ ID NO: 646070 - DNA, 25 bp, Rattus norvegicus
agcatcatcgacgtggtggccatca

SEQ ID NO: 646071 - DNA, 25 bp, Rattus norvegicus
gtggtggccatcatgccctattaca

SEQ ID NO: 646072 - DNA, 25 bp, Rattus norvegicus
ccctattacattggcctggtcatga

SEQ ID NO: 646073 - DNA, 25 bp, Rattus norvegicus
tcatgaccaacaacgaggacgtgtc

SEQ ID NO: 646074 - DNA, 25 bp, Rattus norvegicus
gactcttcgcggcacccagcaggta

SEQ ID NO: 646075 - DNA, 25 bp, Rattus norvegicus
gccgcgacagcagcaacgactcgaa

SEQ ID NO: 646076 - DNA, 25 bp, Rattus norvegicus
tggaagcctgaactggatgccaacc

SEQ ID NO: 646077 - DNA, 25 bp, Rattus norvegicus
cgtgaccggagtcgcctagtattta

SEQ ID NO: 646078 - DNA, 25 bp, Rattus norvegicus
ccagcacagccctgtcatgtaggtg

SEQ ID NO: 646079 - DNA, 25 bp, Rattus norvegicus
gacggcttttaccacgccagcacag

SEQ ID NO: 646080 - DNA, 25 bp, Rattus norvegicus
ctttctcatggtctctgtggtctca

SEQ ID NO: 646081 - DNA, 25 bp, Rattus norvegicus
gctcgactgtaagccaggccgtctt

SEQ ID NO: 646082 - DNA, 25 bp, Rattus norvegicus
cactaggtgctttgtgacgcagctc

SEQ ID NO: 646083 - DNA, 25 bp, Rattus norvegicus
ccagaatcgagcgtccactaggtgc

SEQ ID NO: 646084 - DNA, 25 bp, Rattus norvegicus
ttaggctaccagtgtgttgccgccc

SEQ ID NO: 646085 - DNA, 25 bp, Rattus norvegicus
acggaagtcggaggctgatactcta

SEQ ID NO: 646086 - DNA, 25 bp, Rattus norvegicus
gatatttacagttgaggcggggccc

SEQ ID NO: 646087 - DNA, 25 bp, Rattus norvegicus
ggtagagcttcaaacgccgccgcca

SEQ ID NO: 646088 - DNA, 25 bp, Rattus norvegicus
ttgatcgctcgctcgaaaccctagg

SEQ ID NO: 646089 - DNA, 25 bp, Rattus norvegicus
gttctcattggctgctgcacttttc

SEQ ID NO: 646090 - DNA, 25 bp, Rattus norvegicus
tctgagttctcattggctgctgcac

SEQ ID NO: 646091 - DNA, 25 bp, Rattus norvegicus
ctgagttctcattggctgctgcact

SEQ ID NO: 646092 - DNA, 25 bp, Rattus norvegicus
agttctcattggctgctgcactttt

SEQ ID NO: 646093 - DNA, 25 bp, Rattus norvegicus
ttctcattggctgctgcacttttcc

SEQ ID NO: 646094 - DNA, 25 bp, Rattus norvegicus
tctcattggctgctgcacttttcct

SEQ ID NO: 646095 - DNA, 25 bp, Rattus norvegicus
cccttctgagttctcattggctgct

SEQ ID NO: 646096 - DNA, 25 bp, Rattus norvegicus
cccgaccactcttcccattggccga

SEQ ID NO: 646097 - DNA, 25 bp, Rattus norvegicus
tgagttctcattggctgctgcactt

SEQ ID NO: 646098 - DNA, 25 bp, Rattus norvegicus
ttggccgaagataccccttctgagt

SEQ ID NO: 646099 - DNA, 25 bp, Rattus norvegicus
attggccgaagataccccttctgag

SEQ ID NO: 646100 - DNA, 25 bp, Rattus norvegicus
ccattggccgaagataccccttctg

SEQ ID NO: 646101 - DNA, 25 bp, Rattus norvegicus
cattggccgaagataccccttctga

SEQ ID NO: 646102 - DNA, 25 bp, Rattus norvegicus
tggccgaagataccccttctgagtt

SEQ ID NO: 646103 - DNA, 25 bp, Rattus norvegicus
cgttgctttaagtccccacgctgga

SEQ ID NO: 646104 - DNA, 25 bp, Rattus norvegicus
agggacatggactgctatctgcgtc

SEQ ID NO: 646105 - DNA, 25 bp, Rattus norvegicus
agcccggcaaatgggcgaatgaaga

SEQ ID NO: 646106 - DNA, 25 bp, Rattus norvegicus
cccgagcccggcaaatgggcgaatg

SEQ ID NO: 646107 - DNA, 25 bp, Rattus norvegicus
tgagaaccctactttcccgtgagcc

SEQ ID NO: 646108 - DNA, 25 bp, Rattus norvegicus
gagcgcactgagaaccctactttcc

SEQ ID NO: 646109 - DNA, 25 bp, Rattus norvegicus
ctcagcacagcacggataggggcgc

SEQ ID NO: 646110 - DNA, 25 bp, Rattus norvegicus
cacgctggagccgaggctcagcaca

SEQ ID NO: 646111 - DNA, 25 bp, Rattus norvegicus
ggactgctatctgcgtcgcctcaaa

SEQ ID NO: 646112 - DNA, 25 bp, Rattus norvegicus
tatctgcgtcgcctcaaacaggagc

SEQ ID NO: 646113 - DNA, 25 bp, Rattus norvegicus
tcaaacaggagctggtaagagcgga

SEQ ID NO: 646114 - DNA, 25 bp, Rattus norvegicus
gggaggactgctccacccagaccta

SEQ ID NO: 646115 - DNA, 25 bp, Rattus norvegicus
cagacctaggtacctggcttgggcc

SEQ ID NO: 646116 - DNA, 25 bp, Rattus norvegicus
ccgaggctcagcacagcacggatag

SEQ ID NO: 646117 - DNA, 25 bp, Rattus norvegicus
ggagccgcacttcaaagagtcagga

SEQ ID NO: 646118 - DNA, 25 bp, Rattus norvegicus
gccaacattgagatgaaaaaggaca

SEQ ID NO: 646119 - DNA, 25 bp, Rattus norvegicus
gaaaaagtgattaaggccaacattg

SEQ ID NO: 646120 - DNA, 25 bp, Rattus norvegicus
ggccttgcctttgaaaaagtgatta

SEQ ID NO: 646121 - DNA, 25 bp, Rattus norvegicus
cagacaggaactggggccttgcctt

SEQ ID NO: 646122 - DNA, 25 bp, Rattus norvegicus
ccgggactcgcgaaccgctaagaag

SEQ ID NO: 646123 - DNA, 25 bp, Rattus norvegicus
gaatagtgtgtgcagacaggaactg

SEQ ID NO: 646124 - DNA, 25 bp, Rattus norvegicus
gcacttcaaagagtcaggaggaata

SEQ ID NO: 646125 - DNA, 25 bp, Rattus norvegicus
atctatttaagggagccgcacttca

SEQ ID NO: 646126 - DNA, 25 bp, Rattus norvegicus
cggtcgtgtccggaatctatttaag

SEQ ID NO: 646127 - DNA, 25 bp, Rattus norvegicus
acgcacgcagcacgcaggtcccgcc

SEQ ID NO: 646128 - DNA, 25 bp, Rattus norvegicus
aaccgctaagaagcgggcaccgagg

SEQ ID NO: 646129 - DNA, 25 bp, Rattus norvegicus
cttcccggtcgtgtccggaatctat

SEQ ID NO: 646130 - DNA, 25 bp, Rattus norvegicus
tcaggaggaatagtgtgtgcagaca

SEQ ID NO: 646131 - DNA, 25 bp, Rattus norvegicus
ggcgaccagaggcttgtacctagcc

SEQ ID NO: 646132 - DNA, 25 bp, Rattus norvegicus
gaccagaggcttgtacctagcccta

SEQ ID NO: 646133 - DNA, 25 bp, Rattus norvegicus
accagaggcttgtacctagccctaa

SEQ ID NO: 646134 - DNA, 25 bp, Rattus norvegicus
cagaggcttgtacctagccctaacc

SEQ ID NO: 646135 - DNA, 25 bp, Rattus norvegicus
gaggcttgtacctagccctaaccta

SEQ ID NO: 646136 - DNA, 25 bp, Rattus norvegicus
ggcttgtacctagccctaacctagc

SEQ ID NO: 646137 - DNA, 25 bp, Rattus norvegicus
tgtacctagccctaacctagccgag

SEQ ID NO: 646138 - DNA, 25 bp, Rattus norvegicus
tacctagccctaacctagccgagga

SEQ ID NO: 646139 - DNA, 25 bp, Rattus norvegicus
ctagccctaacctagccgaggacgg

SEQ ID NO: 646140 - DNA, 25 bp, Rattus norvegicus
ccgaggacggcgctgtgggacccgg

SEQ ID NO: 646141 - DNA, 25 bp, Rattus norvegicus
ctgtgggacccggttagggcaggct

SEQ ID NO: 646142 - DNA, 25 bp, Rattus norvegicus
ttgtacctagccctaacctagccga

SEQ ID NO: 646143 - DNA, 25 bp, Rattus norvegicus
ccggttagggcaggctgcggaccca

SEQ ID NO: 646144 - DNA, 25 bp, Rattus norvegicus
gccaaggtggcggtagggtgcggat

SEQ ID NO: 646145 - DNA, 25 bp, Rattus norvegicus
ccgaagatcccgttgcgggtatagc

SEQ ID NO: 646146 - DNA, 25 bp, Rattus norvegicus
cgcagtcaggatctcgtctagtttg

SEQ ID NO: 646147 - DNA, 25 bp, Rattus norvegicus
gcggcagaaagtaccacccgggaca

SEQ ID NO: 646148 - DNA, 25 bp, Rattus norvegicus
ctgcgaagatccagacagcggtacc

SEQ ID NO: 646149 - DNA, 25 bp, Rattus norvegicus
cccgagacactcaggggcaggaaca

SEQ ID NO: 646150 - DNA, 25 bp, Rattus norvegicus
ggcaggaacaagatggccgctcaca

SEQ ID NO: 646151 - DNA, 25 bp, Rattus norvegicus
gccgctcacatatctcgcgagaaga

SEQ ID NO: 646152 - DNA, 25 bp, Rattus norvegicus
cgcgagaagagatctgcacactttc

SEQ ID NO: 646153 - DNA, 25 bp, Rattus norvegicus
ctttctctcggaagtgctgattttt

SEQ ID NO: 646154 - DNA, 25 bp, Rattus norvegicus
caccacgtgtggtgttcctccagcg

SEQ ID NO: 646155 - DNA, 25 bp, Rattus norvegicus
ctctcgcgagatgtagagcgaatcc

SEQ ID NO: 646156 - DNA, 25 bp, Rattus norvegicus
gaaggaaagcccacctccgctcgtg

SEQ ID NO: 646157 - DNA, 25 bp, Rattus norvegicus
aagctgcacggtaccgctctggtga

SEQ ID NO: 646158 - DNA, 25 bp, Rattus norvegicus
ccgcctgcatggaacggcagttgga

SEQ ID NO: 646159 - DNA, 25 bp, Rattus norvegicus
gcgagagcaccactatgggatgccc

SEQ ID NO: 646160 - DNA, 25 bp, Rattus norvegicus
ctcgaggagtccagaagcgtaactg

SEQ ID NO: 646161 - DNA, 25 bp, Rattus norvegicus
tttactgctagtaggaggagctccc

SEQ ID NO: 646162 - DNA, 25 bp, Rattus norvegicus
gctccgccctgcaatagttttactg

SEQ ID NO: 646163 - DNA, 25 bp, Rattus norvegicus
ctgctagtaggaggagctcccggat

SEQ ID NO: 646164 - DNA, 25 bp, Rattus norvegicus
gcacgcgccactcgaggagtccaga

SEQ ID NO: 646165 - DNA, 25 bp, Rattus norvegicus
ccctgcaatagttttactgctagta

SEQ ID NO: 646166 - DNA, 25 bp, Rattus norvegicus
ccagaagcgtaactgagaaatgaga

SEQ ID NO: 646167 - DNA, 25 bp, Rattus norvegicus
agaaatgagatggagaagtacgagc

SEQ ID NO: 646168 - DNA, 25 bp, Rattus norvegicus
cccaattctgaccaagaaatcgtgg

SEQ ID NO: 646169 - DNA, 25 bp, Rattus norvegicus
ccgaagcgagagcaccactatggga

SEQ ID NO: 646170 - DNA, 25 bp, Rattus norvegicus
cccaggcatccggtccttaggtcta

SEQ ID NO: 646171 - DNA, 25 bp, Rattus norvegicus
catccggtccttaggtctaggcggg

SEQ ID NO: 646172 - DNA, 25 bp, Rattus norvegicus
ccaagaaatcgtggcccggctggct

SEQ ID NO: 646173 - DNA, 25 bp, Rattus norvegicus
ctccgagccagcctgagactgaagc

SEQ ID NO: 646174 - DNA, 25 bp, Rattus norvegicus
acctccggaccataggcttggtgcg

SEQ ID NO: 646175 - DNA, 25 bp, Rattus norvegicus
ggacctccggaccataggcttggtg

SEQ ID NO: 646176 - DNA, 25 bp, Rattus norvegicus
accataggcttggtgcggcggcact

SEQ ID NO: 646177 - DNA, 25 bp, Rattus norvegicus
gtcaggaacgtggagcagtttgggc

SEQ ID NO: 646178 - DNA, 25 bp, Rattus norvegicus
accgcctccctcatgaaagtgaaag

SEQ ID NO: 646179 - DNA, 25 bp, Rattus norvegicus
cctccctcatgaaagtgaaagttgg

SEQ ID NO: 646180 - DNA, 25 bp, Rattus norvegicus
gcctccgagccagcctgagactgaa

SEQ ID NO: 646181 - DNA, 25 bp, Rattus norvegicus
ccagcctgagactgaagcgcggcca

SEQ ID NO: 646182 - DNA, 25 bp, Rattus norvegicus
agcctgagactgaagcgcggccagc

SEQ ID NO: 646183 - DNA, 25 bp, Rattus norvegicus
gccagcggggttagtgcgggccaca

SEQ ID NO: 646184 - DNA, 25 bp, Rattus norvegicus
cagaagaacggccagcccaggtgcg

SEQ ID NO: 646185 - DNA, 25 bp, Rattus norvegicus
gaagaacggccagcccaggtgcgcc

SEQ ID NO: 646186 - DNA, 25 bp, Rattus norvegicus
catgaaagtgaaagttggagggccc

SEQ ID NO: 646187 - DNA, 25 bp, Rattus norvegicus
ttgtctcgttgggtgctgtatcgaa

SEQ ID NO: 646188 - DNA, 25 bp, Rattus norvegicus
ttcacaagcttagagcgaaggcgca

SEQ ID NO: 646189 - DNA, 25 bp, Rattus norvegicus
gacttctactgtgggcctcttctgc

SEQ ID NO: 646190 - DNA, 25 bp, Rattus norvegicus
ccgatcaccggagttgacaactaga

SEQ ID NO: 646191 - DNA, 25 bp, Rattus norvegicus
cgtgagcttcttgatgcacaggatc

SEQ ID NO: 646192 - DNA, 25 bp, Rattus norvegicus
gactccagagccttcgggacagcca

SEQ ID NO: 646193 - DNA, 25 bp, Rattus norvegicus
ctgtatcgaagggtggttcacaagc

SEQ ID NO: 646194 - DNA, 25 bp, Rattus norvegicus
cttctgcactttgaggctggagctg

SEQ ID NO: 646195 - DNA, 25 bp, Rattus norvegicus
ctcagaaaaggctgcggcgcgcctc

SEQ ID NO: 646196 - DNA, 25 bp, Rattus norvegicus
gttcacgacactttcacgattgccg

SEQ ID NO: 646197 - DNA, 25 bp, Rattus norvegicus
tagcaactccgactccaggcgactg

SEQ ID NO: 646198 - DNA, 25 bp, Rattus norvegicus
tacccagttatgtccagcccagagc

SEQ ID NO: 646199 - DNA, 25 bp, Rattus norvegicus
gtcagtccgcagctacccagttatg

SEQ ID NO: 646200 - DNA, 25 bp, Rattus norvegicus
caggatctgagtcgccggtaagctc

SEQ ID NO: 646201 - DNA, 25 bp, Rattus norvegicus
gcgtgacgtcacaaccgaagctaca

SEQ ID NO: 646202 - DNA, 25 bp, Rattus norvegicus
tggtcgctagatccggagctcactc

SEQ ID NO: 646203 - DNA, 25 bp, Rattus norvegicus
tgcagcggtccttggtcgctagatc

SEQ ID NO: 646204 - DNA, 25 bp, Rattus norvegicus
actccatacgggagtgcagcggtcc

SEQ ID NO: 646205 - DNA, 25 bp, Rattus norvegicus
ctttgacttgggaactccatacggg

SEQ ID NO: 646206 - DNA, 25 bp, Rattus norvegicus
aaccgaagctacagtagctggcgca

SEQ ID NO: 646207 - DNA, 25 bp, Rattus norvegicus
tttccgggcgtgacgtcacaaccga

SEQ ID NO: 646208 - DNA, 25 bp, Rattus norvegicus
cagcggctatctcgcgggaaccgca

SEQ ID NO: 646209 - DNA, 25 bp, Rattus norvegicus
gcaaccgacttcagcggctatctcg

SEQ ID NO: 646210 - DNA, 25 bp, Rattus norvegicus
accaaagccctttgtattgcttggc

SEQ ID NO: 646211 - DNA, 25 bp, Rattus norvegicus
gcaaacaaggcgaagccggtgagta

SEQ ID NO: 646212 - DNA, 25 bp, Rattus norvegicus
ccctttgtattgcttggctgtcatg

SEQ ID NO: 646213 - DNA, 25 bp, Rattus norvegicus
tgttgcccaggcaaccgacttcagc

SEQ ID NO: 646214 - DNA, 25 bp, Rattus norvegicus
ggagctcactcaccaaagccctttg

SEQ ID NO: 646215 - DNA, 25 bp, Rattus norvegicus
gtcttgcgtcttccggcttctacag

SEQ ID NO: 646216 - DNA, 25 bp, Rattus norvegicus
gactacgtcataagggcggggccac

SEQ ID NO: 646217 - DNA, 25 bp, Rattus norvegicus
gtcccggtttgtgacgcagtaccta

SEQ ID NO: 646218 - DNA, 25 bp, Rattus norvegicus
ttgctggctctaggggctcatttta

SEQ ID NO: 646219 - DNA, 25 bp, Rattus norvegicus
tgatcggtcacgtagccagagactt

SEQ ID NO: 646220 - DNA, 25 bp, Rattus norvegicus
tcaaggccgagtcagctgttgtcca

SEQ ID NO: 646221 - DNA, 25 bp, Rattus norvegicus
ggggagccaccctcttgtctatctt

SEQ ID NO: 646222 - DNA, 25 bp, Rattus norvegicus
atacacttgtgttcgctcccgtcag

SEQ ID NO: 646223 - DNA, 25 bp, Rattus norvegicus
tcgcgctctgattcgcgcctacttg

SEQ ID NO: 646224 - DNA, 25 bp, Rattus norvegicus
gtcaggctcgcactggtaagtacca

SEQ ID NO: 646225 - DNA, 25 bp, Rattus norvegicus
gtaagtaccagttcccagcccttca

SEQ ID NO: 646226 - DNA, 25 bp, Rattus norvegicus
tcttctggattcaggcgtgcccgac

SEQ ID NO: 646227 - DNA, 25 bp, Rattus norvegicus
cctcggttacgacgcagttcgcttc

SEQ ID NO: 646228 - DNA, 25 bp, Rattus norvegicus
acgtccgctctgactggctgtgatc

SEQ ID NO: 646229 - DNA, 25 bp, Rattus norvegicus
ccaagcggcgcatgcgatacttcga

SEQ ID NO: 646230 - DNA, 25 bp, Rattus norvegicus
agttccctgagacgctgctaggcga

SEQ ID NO: 646231 - DNA, 25 bp, Rattus norvegicus
tcgaaggcgacccagtgacaaaaga

SEQ ID NO: 646232 - DNA, 25 bp, Rattus norvegicus
ctatggagaagttccgtgaggacga

SEQ ID NO: 646233 - DNA, 25 bp, Rattus norvegicus
ctaccaactgggtgaggaggctatg

SEQ ID NO: 646234 - DNA, 25 bp, Rattus norvegicus
ttctccgaggagatccgcttctacc

SEQ ID NO: 646235 - DNA, 25 bp, Rattus norvegicus
ggtcaacgtgcccatcgacatcttc

SEQ ID NO: 646236 - DNA, 25 bp, Rattus norvegicus
agggaaggagagcatcgccgcctcc

SEQ ID NO: 646237 - DNA, 25 bp, Rattus norvegicus
aagaccctctgccagttccctgaga

SEQ ID NO: 646238 - DNA, 25 bp, Rattus norvegicus
ttcgagacacagctcaagaccctct

SEQ ID NO: 646239 - DNA, 25 bp, Rattus norvegicus
ggggagcgcgtggtcatcaacatct

SEQ ID NO: 646240 - DNA, 25 bp, Rattus norvegicus
accacctgctggagccagaagcggc

SEQ ID NO: 646241 - DNA, 25 bp, Rattus norvegicus
acttcgacccgctccgcaatgagta

SEQ ID NO: 646242 - DNA, 25 bp, Rattus norvegicus
agctgccgccagacatgaccgtggt

SEQ ID NO: 646243 - DNA, 25 bp, Rattus norvegicus
aggcaccaactaggctgccctcggg

SEQ ID NO: 646244 - DNA, 25 bp, Rattus norvegicus
gctggacctcgcaggcaccaactag

SEQ ID NO: 646245 - DNA, 25 bp, Rattus norvegicus
gacctcgcaggcaccaactaggctg

SEQ ID NO: 646246 - DNA, 25 bp, Rattus norvegicus
aactaggctgccctcgggcccgcag

SEQ ID NO: 646247 - DNA, 25 bp, Rattus norvegicus
gcagcgggagcccaccgcactgcgc

SEQ ID NO: 646248 - DNA, 25 bp, Rattus norvegicus
cgcactgcgcgcaggaaggggttaa

SEQ ID NO: 646249 - DNA, 25 bp, Rattus norvegicus
ttaaggtggcacactctagcggtcc

SEQ ID NO: 646250 - DNA, 25 bp, Rattus norvegicus
taaggtggcacactctagcggtccg

SEQ ID NO: 646251 - DNA, 25 bp, Rattus norvegicus
tggcacactctagcggtccggcggc

SEQ ID NO: 646252 - DNA, 25 bp, Rattus norvegicus
tcggtggtccctcggctggacctcg

SEQ ID NO: 646253 - DNA, 25 bp, Rattus norvegicus
gtcagcggagcagattccggcggga

SEQ ID NO: 646254 - DNA, 25 bp, Rattus norvegicus
gcgcccggcggaatcccggctggag

SEQ ID NO: 646255 - DNA, 25 bp, Rattus norvegicus
gggcgatgggatagggcccagaccc

SEQ ID NO: 646256 - DNA, 25 bp, Rattus norvegicus
gaaggggttaaggtggcacactcta

SEQ ID NO: 646257 - DNA, 25 bp, Rattus norvegicus
acacgtgagtagtgcgtgcagcacg

SEQ ID NO: 646258 - DNA, 25 bp, Rattus norvegicus
tagtgcgtgcagcacgtcctgggct

SEQ ID NO: 646259 - DNA, 25 bp, Rattus norvegicus
caagccgcatggaccgcgagtgttt

SEQ ID NO: 646260 - DNA, 25 bp, Rattus norvegicus
aggcgactttggagcagcatttgga

SEQ ID NO: 646261 - DNA, 25 bp, Rattus norvegicus
cttgctgtgaaggaggaagtgtttt

SEQ ID NO: 646262 - DNA, 25 bp, Rattus norvegicus
tcacgtgaccgaggcttgctgtgaa

SEQ ID NO: 646263 - DNA, 25 bp, Rattus norvegicus
gtcaagtcacgtgaccgaggcttgc

SEQ ID NO: 646264 - DNA, 25 bp, Rattus norvegicus
atttgttccctctggagacgccgtc

SEQ ID NO: 646265 - DNA, 25 bp, Rattus norvegicus
gaccgcgagtgtttccggatgcctt

SEQ ID NO: 646266 - DNA, 25 bp, Rattus norvegicus
gcagcatttggaggacacgtgagta

SEQ ID NO: 646267 - DNA, 25 bp, Rattus norvegicus
gcggcgagcaggtgacttctgcaaa

SEQ ID NO: 646268 - DNA, 25 bp, Rattus norvegicus
cttctgcaaacaactgggccgctcg

SEQ ID NO: 646269 - DNA, 25 bp, Rattus norvegicus
gtaaagagtgcgaacgcggcgccac

SEQ ID NO: 646270 - DNA, 25 bp, Rattus norvegicus
acgcggcgccacgatgaatttgttc

SEQ ID NO: 646271 - DNA, 25 bp, Rattus norvegicus
tagtagagggaggactccttgccgc

SEQ ID NO: 646272 - DNA, 25 bp, Rattus norvegicus
acggcgatcccggagaaagccaagc

SEQ ID NO: 646273 - DNA, 25 bp, Rattus norvegicus
aatcgcgtgcttcctagccggactc

SEQ ID NO: 646274 - DNA, 25 bp, Rattus norvegicus
gattgagagcttcgctgccggctat

SEQ ID NO: 646275 - DNA, 25 bp, Rattus norvegicus
cggttcacaggcactgctcccagta

SEQ ID NO: 646276 - DNA, 25 bp, Rattus norvegicus
gctgccgcctgggtccagaatgagt

SEQ ID NO: 646277 - DNA, 25 bp, Rattus norvegicus
gaaagcgcacgtacagcctgggccc

SEQ ID NO: 646278 - DNA, 25 bp, Rattus norvegicus
ccggaaagcactggaacccacgtcg

SEQ ID NO: 646279 - DNA, 25 bp, Rattus norvegicus
gtccttccgaccgtgagttagtaga

SEQ ID NO: 646280 - DNA, 25 bp, Rattus norvegicus
gcgggaatcacgcaccctcgagggt

SEQ ID NO: 646281 - DNA, 25 bp, Rattus norvegicus
tccagaatgagtggcagcgggaccc

SEQ ID NO: 646282 - DNA, 25 bp, Rattus norvegicus
aaccaccgacgggattgagagcttc

SEQ ID NO: 646283 - DNA, 25 bp, Rattus norvegicus
tgctcccagtagcaatcgcgtgctt

SEQ ID NO: 646284 - DNA, 25 bp, Rattus norvegicus
tgccggctattggagcctcgctgcc

SEQ ID NO: 646285 - DNA, 25 bp, Rattus norvegicus
tggcggctgccagcctcgataagtg

SEQ ID NO: 646286 - DNA, 25 bp, Rattus norvegicus
ctcctaagattagaggccggaaacg

SEQ ID NO: 646287 - DNA, 25 bp, Rattus norvegicus
tgaggggctaacaatccagcagacc

SEQ ID NO: 646288 - DNA, 25 bp, Rattus norvegicus
agaccaccgactttgcatcccagga

SEQ ID NO: 646289 - DNA, 25 bp, Rattus norvegicus
tttgcatcccaggagggctgtgcct

SEQ ID NO: 646290 - DNA, 25 bp, Rattus norvegicus
agcagagtttgtgacacggctcccg

SEQ ID NO: 646291 - DNA, 25 bp, Rattus norvegicus
gatggcctccgtcaagcaactctcg

SEQ ID NO: 646292 - DNA, 25 bp, Rattus norvegicus
ctcgataagtgcacggttctcagtc

SEQ ID NO: 646293 - DNA, 25 bp, Rattus norvegicus
gttctcagtcaagtgacagctcgta

SEQ ID NO: 646294 - DNA, 25 bp, Rattus norvegicus
gctcaattcgcggatggcctccgtc

SEQ ID NO: 646295 - DNA, 25 bp, Rattus norvegicus
tgttcacaatcagagggccgggacc

SEQ ID NO: 646296 - DNA, 25 bp, Rattus norvegicus
tgtagctctgacctccgagtctttg

SEQ ID NO: 646297 - DNA, 25 bp, Rattus norvegicus
ctggggttgcttgttgttcacaatc

SEQ ID NO: 646298 - DNA, 25 bp, Rattus norvegicus
tctttgcgttggttgcggttgaact

SEQ ID NO: 646299 - DNA, 25 bp, Rattus norvegicus
gccagcgctattcactaaggcattg

SEQ ID NO: 646300 - DNA, 25 bp, Rattus norvegicus
aggtgcgcacccagccgtgcgcagt

SEQ ID NO: 646301 - DNA, 25 bp, Rattus norvegicus
tgcaggaaagggaccgcttcgctgg

SEQ ID NO: 646302 - DNA, 25 bp, Rattus norvegicus
tgtgcggaccgccagcgctattcac

SEQ ID NO: 646303 - DNA, 25 bp, Rattus norvegicus
tgcggaccgccagcgctattcacta

SEQ ID NO: 646304 - DNA, 25 bp, Rattus norvegicus
tcactaaggcattggcttcggctcg

SEQ ID NO: 646305 - DNA, 25 bp, Rattus norvegicus
accgccagcgctattcactaaggca

SEQ ID NO: 646306 - DNA, 25 bp, Rattus norvegicus
cattggcttcggctcgcccaggaca

SEQ ID NO: 646307 - DNA, 25 bp, Rattus norvegicus
ttggcttcggctcgcccaggacagc

SEQ ID NO: 646308 - DNA, 25 bp, Rattus norvegicus
gcacccagccgtgcgcagtgcagga

SEQ ID NO: 646309 - DNA, 25 bp, Rattus norvegicus
ctaaggcattggcttcggctcgccc

SEQ ID NO: 646310 - DNA, 25 bp, Rattus norvegicus
aaggcattggcttcggctcgcccag

SEQ ID NO: 646311 - DNA, 25 bp, Rattus norvegicus
ggaccgccagcgctattcactaagg

SEQ ID NO: 646312 - DNA, 25 bp, Rattus norvegicus
aaagggaccgcttcgctgggagcgc

SEQ ID NO: 646313 - DNA, 25 bp, Rattus norvegicus
aatgcctctctgaaggccctccttt

SEQ ID NO: 646314 - DNA, 25 bp, Rattus norvegicus
tccagctttgccttgtcttcagcct

SEQ ID NO: 646315 - DNA, 25 bp, Rattus norvegicus
ggccacgcttcactcctccagcttt

SEQ ID NO: 646316 - DNA, 25 bp, Rattus norvegicus
aggttcgaggccacgcttcactcct

SEQ ID NO: 646317 - DNA, 25 bp, Rattus norvegicus
atcccgacaggttcgaggccacgct

SEQ ID NO: 646318 - DNA, 25 bp, Rattus norvegicus
ttttcgatcccgacaggttcgaggc

SEQ ID NO: 646319 - DNA, 25 bp, Rattus norvegicus
ggcagaggccttttcgatcccgaca

SEQ ID NO: 646320 - DNA, 25 bp, Rattus norvegicus
cagcccgagggcagcgctaggacaa

SEQ ID NO: 646321 - DNA, 25 bp, Rattus norvegicus
ccagttccaggaacccgcaggcaga

SEQ ID NO: 646322 - DNA, 25 bp, Rattus norvegicus
ggtggtagaaatgcctctctgaagg

SEQ ID NO: 646323 - DNA, 25 bp, Rattus norvegicus
ccgcggaggtggtagaaatgcctct

SEQ ID NO: 646324 - DNA, 25 bp, Rattus norvegicus
cccacggctcttggcagccgcggag

SEQ ID NO: 646325 - DNA, 25 bp, Rattus norvegicus
ctcctgcggggtcaccttggccaga

SEQ ID NO: 646326 - DNA, 25 bp, Rattus norvegicus
aacccgcaggcagaggccttttcga

SEQ ID NO: 646327 - DNA, 25 bp, Rattus norvegicus
tgacggtggccatgaagagtacttc

SEQ ID NO: 646328 - DNA, 25 bp, Rattus norvegicus
agagtacttcttcgcgtcctcgatc

SEQ ID NO: 646329 - DNA, 25 bp, Rattus norvegicus
gagcttagcccgaagtcccgaacta

SEQ ID NO: 646330 - DNA, 25 bp, Rattus norvegicus
tcaggcatagacatcccaaggacgc

SEQ ID NO: 646331 - DNA, 25 bp, Rattus norvegicus
ccgacacagggcagcggcatcgcgt

SEQ ID NO: 646332 - DNA, 25 bp, Rattus norvegicus
cgaatttaaggcctggccctgtcgg

SEQ ID NO: 646333 - DNA, 25 bp, Rattus norvegicus
accttcttgggagccttggtgacgg

SEQ ID NO: 646334 - DNA, 25 bp, Rattus norvegicus
ccctttatcgtgtcaatggtcctga

SEQ ID NO: 646335 - DNA, 25 bp, Rattus norvegicus
tggctctagataggcccatcgccgc

SEQ ID NO: 646336 - DNA, 25 bp, Rattus norvegicus
agagcggcctctttggctctagata

SEQ ID NO: 646337 - DNA, 25 bp, Rattus norvegicus
cgagggacaaagaaaagcgaggtca

SEQ ID NO: 646338 - DNA, 25 bp, Rattus norvegicus
cttcagaaagatccaggaggactcc

SEQ ID NO: 646339 - DNA, 25 bp, Rattus norvegicus
ggccctgtcgggcttcagaaagatc

SEQ ID NO: 646340 - DNA, 25 bp, Rattus norvegicus
cggcatcgcgtcaggcatagacatc

SEQ ID NO: 646341 - DNA, 25 bp, Rattus norvegicus
tgagtgagccctcgcaagcccagac

SEQ ID NO: 646342 - DNA, 25 bp, Rattus norvegicus
tcccagaaggggctaagatctccca

SEQ ID NO: 646343 - DNA, 25 bp, Rattus norvegicus
ctcccaaaatgtcgtgctccaagtc

SEQ ID NO: 646344 - DNA, 25 bp, Rattus norvegicus
aggaggcagttcagtcgcgttgacc

SEQ ID NO: 646345 - DNA, 25 bp, Rattus norvegicus
gctccaagtctatggttctgggtta

SEQ ID NO: 646346 - DNA, 25 bp, Rattus norvegicus
cgcccacagcgtccagtataaagtt

SEQ ID NO: 646347 - DNA, 25 bp, Rattus norvegicus
ggctgcttaacgacaatttccctcg

SEQ ID NO: 646348 - DNA, 25 bp, Rattus norvegicus
ttctgggttactgggatatccgcgg

SEQ ID NO: 646349 - DNA, 25 bp, Rattus norvegicus
ctgcgcctgcgcaaggccaagtgac

SEQ ID NO: 646350 - DNA, 25 bp, Rattus norvegicus
acagtccatcgcgtatcccagaagg

SEQ ID NO: 646351 - DNA, 25 bp, Rattus norvegicus
ggtgtgagctaaagggctgcttaac

SEQ ID NO: 646352 - DNA, 25 bp, Rattus norvegicus
gttaaaagcaagtgggcactgcgca

SEQ ID NO: 646353 - DNA, 25 bp, Rattus norvegicus
tccctcgacaggatgcaggggcttg

SEQ ID NO: 646354 - DNA, 25 bp, Rattus norvegicus
agtataaagttagccgcccacagtc

SEQ ID NO: 646355 - DNA, 25 bp, Rattus norvegicus
cacacacttaccagaggccatactg

SEQ ID NO: 646356 - DNA, 25 bp, Rattus norvegicus
gctaccggggagtcacgcaacaggt

SEQ ID NO: 646357 - DNA, 25 bp, Rattus norvegicus
cccagggctttttcaccactttctg

SEQ ID NO: 646358 - DNA, 25 bp, Rattus norvegicus
ccaagcccgcactcaagaggaaaca

SEQ ID NO: 646359 - DNA, 25 bp, Rattus norvegicus
tcaattagggatccgactcccgtgg

SEQ ID NO: 646360 - DNA, 25 bp, Rattus norvegicus
ccactttctgggtatcaattaggga

SEQ ID NO: 646361 - DNA, 25 bp, Rattus norvegicus
ccaccgatttcagcggccagaatga

SEQ ID NO: 646362 - DNA, 25 bp, Rattus norvegicus
aggttttcaaaatggccagctggtc

SEQ ID NO: 646363 - DNA, 25 bp, Rattus norvegicus
aagctggaaggaaggcaggttttca

SEQ ID NO: 646364 - DNA, 25 bp, Rattus norvegicus
ctgcacccgcactgagaagctggaa

SEQ ID NO: 646365 - DNA, 25 bp, Rattus norvegicus
agagtctgcacagcgaggaagcccg

SEQ ID NO: 646366 - DNA, 25 bp, Rattus norvegicus
ggggcaccacgaaggctgcctacga

SEQ ID NO: 646367 - DNA, 25 bp, Rattus norvegicus
agaggccatactgcccgagtcccga

SEQ ID NO: 646368 - DNA, 25 bp, Rattus norvegicus
aagaggaaacagaccacgtgctccc

SEQ ID NO: 646369 - DNA, 25 bp, Rattus norvegicus
tttctctccgtcctcccgcaagttg

SEQ ID NO: 646370 - DNA, 25 bp, Rattus norvegicus
ccgcaagttgcggtcgatcatctta

SEQ ID NO: 646371 - DNA, 25 bp, Rattus norvegicus
tgcggtcgatcatcttactccgctc

SEQ ID NO: 646372 - DNA, 25 bp, Rattus norvegicus
tcggcgctcaacgtgcagcccatga

SEQ ID NO: 646373 - DNA, 25 bp, Rattus norvegicus
aacgtgcagcccatgacggcggccg

SEQ ID NO: 646374 - DNA, 25 bp, Rattus norvegicus
tggctcactcacacaccgcgggaac

SEQ ID NO: 646375 - DNA, 25 bp, Rattus norvegicus
gggaaccgcgacacaccggctgaga

SEQ ID NO: 646376 - DNA, 25 bp, Rattus norvegicus
caccggctgagacgcgtcttctgct

SEQ ID NO: 646377 - DNA, 25 bp, Rattus norvegicus
gggcggtggccttctccgtcagctc

SEQ ID NO: 646378 - DNA, 25 bp, Rattus norvegicus
ctagcgcccggaagaaccggatagc

SEQ ID NO: 646379 - DNA, 25 bp, Rattus norvegicus
aaccggatagctgctgtttacgaca

SEQ ID NO: 646380 - DNA, 25 bp, Rattus norvegicus
tgtttacgacacttccggcgacgcc

SEQ ID NO: 646381 - DNA, 25 bp, Rattus norvegicus
ttacaacttagagcgctgtggcagt

SEQ ID NO: 646382 - DNA, 25 bp, Rattus norvegicus
gcccagcggccgttacaacttagag

SEQ ID NO: 646383 - DNA, 25 bp, Rattus norvegicus
cgccgggagccggagacaaacacac

SEQ ID NO: 646384 - DNA, 25 bp, Rattus norvegicus
tccctcggctgggatcgcggcgtct

SEQ ID NO: 646385 - DNA, 25 bp, Rattus norvegicus
ctcgccgcactgctccacgcctggc

SEQ ID NO: 646386 - DNA, 25 bp, Rattus norvegicus
tggacagcgcggaacccagcaagtt

SEQ ID NO: 646387 - DNA, 25 bp, Rattus norvegicus
cccagcaagttcctcgcaggcgatg

SEQ ID NO: 646388 - DNA, 25 bp, Rattus norvegicus
caagttcctcgcaggcgatgtcgcc

SEQ ID NO: 646389 - DNA, 25 bp, Rattus norvegicus
ttcctcgcaggcgatgtcgccgggc

SEQ ID NO: 646390 - DNA, 25 bp, Rattus norvegicus
agctcccggactggccatgggctga

SEQ ID NO: 646391 - DNA, 25 bp, Rattus norvegicus
actggccatgggctgagccgcatcc

SEQ ID NO: 646392 - DNA, 25 bp, Rattus norvegicus
ggctgagccgcatcctcacggagca

SEQ ID NO: 646393 - DNA, 25 bp, Rattus norvegicus
agccgcatcctcacggagcaggtgc

SEQ ID NO: 646394 - DNA, 25 bp, Rattus norvegicus
tcctcacggagcaggtgcagtgacc

SEQ ID NO: 646395 - DNA, 25 bp, Rattus norvegicus
ttctggggagggaacctgcgccaca

SEQ ID NO: 646396 - DNA, 25 bp, Rattus norvegicus
gagccggagacaaacacacgcacgt

SEQ ID NO: 646397 - DNA, 25 bp, Rattus norvegicus
tcagtctcggttccctcgatggagc

SEQ ID NO: 646398 - DNA, 25 bp, Rattus norvegicus
ggcggctacaggagaggctcctccc

SEQ ID NO: 646399 - DNA, 25 bp, Rattus norvegicus
cttcttccgggtttgcgatcgcgga

SEQ ID NO: 646400 - DNA, 25 bp, Rattus norvegicus
gtacagctaccggaggcttcttccg

SEQ ID NO: 646401 - DNA, 25 bp, Rattus norvegicus
ctccatggaatgcatggcagtgcca

SEQ ID NO: 646402 - DNA, 25 bp, Rattus norvegicus
gggaaccagacctacctccatggaa

SEQ ID NO: 646403 - DNA, 25 bp, Rattus norvegicus
ttccctcgatggagcgggaaccaga

SEQ ID NO: 646404 - DNA, 25 bp, Rattus norvegicus
tatcaggtgcgccaagatcccactg

SEQ ID NO: 646405 - DNA, 25 bp, Rattus norvegicus
tggtgaagcccaaagctatcaggtg

SEQ ID NO: 646406 - DNA, 25 bp, Rattus norvegicus
ccgggacagcactgtcagaaagatg

SEQ ID NO: 646407 - DNA, 25 bp, Rattus norvegicus
gcccacagcgccctctgtagagtgg

SEQ ID NO: 646408 - DNA, 25 bp, Rattus norvegicus
cactcactggttccgggccgggaca

SEQ ID NO: 646409 - DNA, 25 bp, Rattus norvegicus
ttcctcagctgagggtccgggttta

SEQ ID NO: 646410 - DNA, 25 bp, Rattus norvegicus
ggtttagcgcgtctcccagtgcgcc

SEQ ID NO: 646411 - DNA, 25 bp, Rattus norvegicus
ttctaatgtgtctgtactcaccgtc

SEQ ID NO: 646412 - DNA, 25 bp, Rattus norvegicus
agtcatcgagactcggcactcgccg

SEQ ID NO: 646413 - DNA, 25 bp, Rattus norvegicus
cccgcgaagtcatcgagactcggca

SEQ ID NO: 646414 - DNA, 25 bp, Rattus norvegicus
tgtcccgcgaagtcatcgagactcg

SEQ ID NO: 646415 - DNA, 25 bp, Rattus norvegicus
gctctgtcccgcgaagtcatcgaga

SEQ ID NO: 646416 - DNA, 25 bp, Rattus norvegicus
gagctccagctctgtcccgcgaagt

SEQ ID NO: 646417 - DNA, 25 bp, Rattus norvegicus
gctccacccacgagctccagctctg

SEQ ID NO: 646418 - DNA, 25 bp, Rattus norvegicus
tgtgtctgtactcaccgtctgccgc

SEQ ID NO: 646419 - DNA, 25 bp, Rattus norvegicus
cccggattctaatgtgtctgtactc

SEQ ID NO: 646420 - DNA, 25 bp, Rattus norvegicus
atagtgatggggtccccggattcta

SEQ ID NO: 646421 - DNA, 25 bp, Rattus norvegicus
tagtcggcggctcccctcagctgga

SEQ ID NO: 646422 - DNA, 25 bp, Rattus norvegicus
aatgtggctgagcaggcgggcacta

SEQ ID NO: 646423 - DNA, 25 bp, Rattus norvegicus
acccggaggcgcgaatgtggctgag

SEQ ID NO: 646424 - DNA, 25 bp, Rattus norvegicus
caccgtctgccgcaggcaggtcggc

SEQ ID NO: 646425 - DNA, 25 bp, Rattus norvegicus
ttaggcactccaggcgtacctgctg

SEQ ID NO: 646426 - DNA, 25 bp, Rattus norvegicus
cacattgcttctggtccgcgtcaca

SEQ ID NO: 646427 - DNA, 25 bp, Rattus norvegicus
tctctcctttttccgcgggtagagc

SEQ ID NO: 646428 - DNA, 25 bp, Rattus norvegicus
ttcaaactcctgtcaaactcgctgg

SEQ ID NO: 646429 - DNA, 25 bp, Rattus norvegicus
ttaaagggacccatggagcctgcta

SEQ ID NO: 646430 - DNA, 25 bp, Rattus norvegicus
ctagcgagattccacgggttaggca

SEQ ID NO: 646431 - DNA, 25 bp, Rattus norvegicus
gaatcggacacacgcgggacaatta

SEQ ID NO: 646432 - DNA, 25 bp, Rattus norvegicus
tgcagagacaaagccagctgacggt

SEQ ID NO: 646433 - DNA, 25 bp, Rattus norvegicus
gaactttgatgaagcccagcggctc

SEQ ID NO: 646434 - DNA, 25 bp, Rattus norvegicus
ggccgactcacccactggagaactt

SEQ ID NO: 646435 - DNA, 25 bp, Rattus norvegicus
gcgtcacaatccaggctcccgaaat

SEQ ID NO: 646436 - DNA, 25 bp, Rattus norvegicus
agtgaaatgtgagcgccctgggcaa

SEQ ID NO: 646437 - DNA, 25 bp, Rattus norvegicus
ttgcacatagaaggtccgaatccgg

SEQ ID NO: 646438 - DNA, 25 bp, Rattus norvegicus
aaactcgctggcagacttggcagtc

SEQ ID NO: 646439 - DNA, 25 bp, Rattus norvegicus
cgctacttttgactccgcacggaag

SEQ ID NO: 646440 - DNA, 25 bp, Rattus norvegicus
ccagcgcccgtagcaaccaagggtg

SEQ ID NO: 646441 - DNA, 25 bp, Rattus norvegicus
gggaagcggaagtgcattctaattc

SEQ ID NO: 646442 - DNA, 25 bp, Rattus norvegicus
cgccctcccagttaatccaggtgag

SEQ ID NO: 646443 - DNA, 25 bp, Rattus norvegicus
aggaagcttgtcagcccaatcattg

SEQ ID NO: 646444 - DNA, 25 bp, Rattus norvegicus
tgctgctttcagtcgtgtggccttt

SEQ ID NO: 646445 - DNA, 25 bp, Rattus norvegicus
ccatgttcctcactcggtccgagta

SEQ ID NO: 646446 - DNA, 25 bp, Rattus norvegicus
cgacaggttcgtacagcgagaagca

SEQ ID NO: 646447 - DNA, 25 bp, Rattus norvegicus
cccggcgagattgcccaagctagac

SEQ ID NO: 646448 - DNA, 25 bp, Rattus norvegicus
ccagtcccagtcttgcagcagttca

SEQ ID NO: 646449 - DNA, 25 bp, Rattus norvegicus
ttgtgctaccgctgaatcaccgcta

SEQ ID NO: 646450 - DNA, 25 bp, Rattus norvegicus
ggcgagacttacgtcacgatcccta

SEQ ID NO: 646451 - DNA, 25 bp, Rattus norvegicus
agcggacccgttgcacttgtgctac

SEQ ID NO: 646452 - DNA, 25 bp, Rattus norvegicus
cgagcgcacacctctgcgaggttca

SEQ ID NO: 646453 - DNA, 25 bp, Rattus norvegicus
gacttcatcgccaagctgaccaaca

SEQ ID NO: 646454 - DNA, 25 bp, Rattus norvegicus
aagctaggaggctagcgcgagaccc

SEQ ID NO: 646455 - DNA, 25 bp, Rattus norvegicus
gctgaccaacaatacgcaccaggtg

SEQ ID NO: 646456 - DNA, 25 bp, Rattus norvegicus
cagaggatcaggactgcggccgcct

SEQ ID NO: 646457 - DNA, 25 bp, Rattus norvegicus
cgcgcctgcagaggatcaggactgc

SEQ ID NO: 646458 - DNA, 25 bp, Rattus norvegicus
ctgcggacggccttttgcgctggcc

SEQ ID NO: 646459 - DNA, 25 bp, Rattus norvegicus
gcgtatccaagcagcgccaggccga

SEQ ID NO: 646460 - DNA, 25 bp, Rattus norvegicus
gagaggcccggctgcgcgtatccaa

SEQ ID NO: 646461 - DNA, 25 bp, Rattus norvegicus
atcttggcatccgaatccaggaccc

SEQ ID NO: 646462 - DNA, 25 bp, Rattus norvegicus
atcagtcccgcatcttggcatccga

SEQ ID NO: 646463 - DNA, 25 bp, Rattus norvegicus
tggggaatgacctcagccgtccctg

SEQ ID NO: 646464 - DNA, 25 bp, Rattus norvegicus
tctcaggaggcgctgcgaactcgca

SEQ ID NO: 646465 - DNA, 25 bp, Rattus norvegicus
caatcttaaccggagggtctcagga

SEQ ID NO: 646466 - DNA, 25 bp, Rattus norvegicus
tccgctcccgctgcaagctaggagg

SEQ ID NO: 646467 - DNA, 25 bp, Rattus norvegicus
aaacccatgcgcgagcctgtgcagg

SEQ ID NO: 646468 - DNA, 25 bp, Rattus norvegicus
gcccagctccaggtaggaaaaattg

SEQ ID NO: 646469 - DNA, 25 bp, Rattus norvegicus
cccaagcgtaggatcctgggtccta

SEQ ID NO: 646470 - DNA, 25 bp, Rattus norvegicus
tggggaggaccttacgcacccaagc

SEQ ID NO: 646471 - DNA, 25 bp, Rattus norvegicus
aggagtgcccaccatgatgtcaagg

SEQ ID NO: 646472 - DNA, 25 bp, Rattus norvegicus
aggtgtccacttgcggccaccgctt

SEQ ID NO: 646473 - DNA, 25 bp, Rattus norvegicus
ctgtgcccactgtgcgggaaaccca

SEQ ID NO: 646474 - DNA, 25 bp, Rattus norvegicus
aactttcgaagcgagggcagagtcc

SEQ ID NO: 646475 - DNA, 25 bp, Rattus norvegicus
gccatgcccggcttcgactacaagt

SEQ ID NO: 646476 - DNA, 25 bp, Rattus norvegicus
tgcgacggcattctaagggcttgtg

SEQ ID NO: 646477 - DNA, 25 bp, Rattus norvegicus
cgggaaagagaagcctgatttaact

SEQ ID NO: 646478 - DNA, 25 bp, Rattus norvegicus
acgctcgcagttccagcgggaaaga

SEQ ID NO: 646479 - DNA, 25 bp, Rattus norvegicus
cccgcttctggaaggatctcagcca

SEQ ID NO: 646480 - DNA, 25 bp, Rattus norvegicus
ctgcaggagttcctcaggtgcgacc

SEQ ID NO: 646481 - DNA, 25 bp, Rattus norvegicus
cttccagctcctgcaagaccgggtt

SEQ ID NO: 646482 - DNA, 25 bp, Rattus norvegicus
agcgagcgtgcaccggtgcaagccc

SEQ ID NO: 646483 - DNA, 25 bp, Rattus norvegicus
aagctcccaagcgtgctgcggtcgc

SEQ ID NO: 646484 - DNA, 25 bp, Rattus norvegicus
aggctcctcctagagcgcatctctg

SEQ ID NO: 646485 - DNA, 25 bp, Rattus norvegicus
ctagagcgcatctctggcttccagc

SEQ ID NO: 646486 - DNA, 25 bp, Rattus norvegicus
gctcctgcaagaccgggttggtacc

SEQ ID NO: 646487 - DNA, 25 bp, Rattus norvegicus
ccgcagctccgccaggttccgagcg

SEQ ID NO: 646488 - DNA, 25 bp, Rattus norvegicus
gcggagtgagcggtctctggctctc

SEQ ID NO: 646489 - DNA, 25 bp, Rattus norvegicus
tctggctctccgagacacccgcgta

SEQ ID NO: 646490 - DNA, 25 bp, Rattus norvegicus
gtagccgagaccctgcactcacaag

SEQ ID NO: 646491 - DNA, 25 bp, Rattus norvegicus
gaccctgcactcacaagcgagcgtg

SEQ ID NO: 646492 - DNA, 25 bp, Rattus norvegicus
actcacaagcgagcgtgcaccggtg

SEQ ID NO: 646493 - DNA, 25 bp, Rattus norvegicus
tcctagagcgcatctctggcttcca

SEQ ID NO: 646494 - DNA, 25 bp, Rattus norvegicus
cacaagcgagcgtgcaccggtgcaa

SEQ ID NO: 646495 - DNA, 25 bp, Rattus norvegicus
cctgcgtaaaccttgaggcgaggtg

SEQ ID NO: 646496 - DNA, 25 bp, Rattus norvegicus
cctattcccgggaactaggagattg

SEQ ID NO: 646497 - DNA, 25 bp, Rattus norvegicus
ccgggaactaggagattgtagaaga

SEQ ID NO: 646498 - DNA, 25 bp, Rattus norvegicus
gcctaagaaattcgaacgaagctcc

SEQ ID NO: 646499 - DNA, 25 bp, Rattus norvegicus
gcttcctgcgtaaaccttgaggcga

SEQ ID NO: 646500 - DNA, 25 bp, Rattus norvegicus
cgtagacccgccaatcgctgtgcgt

SEQ ID NO: 646501 - DNA, 25 bp, Rattus norvegicus
atttctccgactgacgtcccgacag

SEQ ID NO: 646502 - DNA, 25 bp, Rattus norvegicus
gggacaaatttctccgactgacgtc

SEQ ID NO: 646503 - DNA, 25 bp, Rattus norvegicus
tgcgcttcgatccaagggacaaatt

SEQ ID NO: 646504 - DNA, 25 bp, Rattus norvegicus
cttttttgggaagtgcgcttcgatc

SEQ ID NO: 646505 - DNA, 25 bp, Rattus norvegicus
ccaggagtcttttttgggaagtgcg

SEQ ID NO: 646506 - DNA, 25 bp, Rattus norvegicus
ttgtagaagaaaagcttcctgcgta

SEQ ID NO: 646507 - DNA, 25 bp, Rattus norvegicus
ctcgcggctaaaaggaggcgctccc

SEQ ID NO: 646508 - DNA, 25 bp, Rattus norvegicus
ccgccaatcgctgtgcgttggtggc

SEQ ID NO: 646509 - DNA, 25 bp, Rattus norvegicus
agggttctcgcaggcaaatgttgtc

SEQ ID NO: 646510 - DNA, 25 bp, Rattus norvegicus
aagagcaccgaagaggaagcgataa

SEQ ID NO: 646511 - DNA, 25 bp, Rattus norvegicus
caccgaagaggaagcgataaagggc

SEQ ID NO: 646512 - DNA, 25 bp, Rattus norvegicus
cgataaagggcgcagaggagtcgaa

SEQ ID NO: 646513 - DNA, 25 bp, Rattus norvegicus
cgaagcgcagcacggacacacagcg

SEQ ID NO: 646514 - DNA, 25 bp, Rattus norvegicus
gcagcacggacacacagcgcatgta

SEQ ID NO: 646515 - DNA, 25 bp, Rattus norvegicus
gcacggacacacagcgcatgtaatt

SEQ ID NO: 646516 - DNA, 25 bp, Rattus norvegicus
ggacacacagcgcatgtaattctcg

SEQ ID NO: 646517 - DNA, 25 bp, Rattus norvegicus
gagcacgcgctgagctgagatggcg

SEQ ID NO: 646518 - DNA, 25 bp, Rattus norvegicus
aattctcgcagggttctcgcaggca

SEQ ID NO: 646519 - DNA, 25 bp, Rattus norvegicus
ttctcgcaggcaaatgttgtcgtcg

SEQ ID NO: 646520 - DNA, 25 bp, Rattus norvegicus
cgcaggcaaatgttgtcgtcgaagg

SEQ ID NO: 646521 - DNA, 25 bp, Rattus norvegicus
caaatgttgtcgtcgaaggggagca

SEQ ID NO: 646522 - DNA, 25 bp, Rattus norvegicus
cgcatgtaattctcgcagggttctc

SEQ ID NO: 646523 - DNA, 25 bp, Rattus norvegicus
cgagatccagcctgtgccgttgtta

SEQ ID NO: 646524 - DNA, 25 bp, Rattus norvegicus
ggctgacaccgtcaccacactggtg

SEQ ID NO: 646525 - DNA, 25 bp, Rattus norvegicus
gtacactctctaggaccgtggcctg

SEQ ID NO: 646526 - DNA, 25 bp, Rattus norvegicus
ggtcactcgcctccactatcaattt

SEQ ID NO: 646527 - DNA, 25 bp, Rattus norvegicus
ggggcgttgtcattatcatcttcca

SEQ ID NO: 646528 - DNA, 25 bp, Rattus norvegicus
cgttgccgctcatgatactatagtg

SEQ ID NO: 646529 - DNA, 25 bp, Rattus norvegicus
gtctcatagtcgagtgggctcacca

SEQ ID NO: 646530 - DNA, 25 bp, Rattus norvegicus
ggcccggatccgcagtgtatattct

SEQ ID NO: 646531 - DNA, 25 bp, Rattus norvegicus
ctccggcatcagcatcaatcgcttg

SEQ ID NO: 646532 - DNA, 25 bp, Rattus norvegicus
gtggtccctggcttctactccgaag

SEQ ID NO: 646533 - DNA, 25 bp, Rattus norvegicus
cgtgtactccggctgcgtaaaggtt

SEQ ID NO: 646534 - DNA, 25 bp, Rattus norvegicus
tgtgagcatctcgatccacggctga

SEQ ID NO: 646535 - DNA, 25 bp, Rattus norvegicus
tactgccgctcgagtttgtagtcca

SEQ ID NO: 646536 - DNA, 25 bp, Rattus norvegicus
ggatggttacactgacactggctga

SEQ ID NO: 646537 - DNA, 25 bp, Rattus norvegicus
ccagagaacgacagggccccacttg

SEQ ID NO: 646538 - DNA, 25 bp, Rattus norvegicus
ttgatctcccagtagtggcgacggc

SEQ ID NO: 646539 - DNA, 25 bp, Rattus norvegicus
gccgggctcccaccactctcgaagc

SEQ ID NO: 646540 - DNA, 25 bp, Rattus norvegicus
actgggcctgcacccaaatggctcg

SEQ ID NO: 646541 - DNA, 25 bp, Rattus norvegicus
ctgcacccaaatggctcggcggggc

SEQ ID NO: 646542 - DNA, 25 bp, Rattus norvegicus
agtcagcgcgaccactgcgggttca

SEQ ID NO: 646543 - DNA, 25 bp, Rattus norvegicus
actgcgggttcacactgcgcttcca

SEQ ID NO: 646544 - DNA, 25 bp, Rattus norvegicus
cccgagggccgcgaggatctctagc

SEQ ID NO: 646545 - DNA, 25 bp, Rattus norvegicus
gctcattaccatagacctgctcgcg

SEQ ID NO: 646546 - DNA, 25 bp, Rattus norvegicus
cgccgccgcggtcttaaagcggcga

SEQ ID NO: 646547 - DNA, 25 bp, Rattus norvegicus
gagatcgcccacctgcgtctgagga

SEQ ID NO: 646548 - DNA, 25 bp, Rattus norvegicus
aggatctctagctctgccgggtccc

SEQ ID NO: 646549 - DNA, 25 bp, Rattus norvegicus
tcttaaagcggcgacgcccaacgcg

SEQ ID NO: 646550 - DNA, 25 bp, Rattus norvegicus
cggcggcggctcattaccatagacc

SEQ ID NO: 646551 - DNA, 25 bp, Rattus norvegicus
tacagccagccagtcccgggagtat

SEQ ID NO: 646552 - DNA, 25 bp, Rattus norvegicus
gtgcgtgctgctccttcctaaggca

SEQ ID NO: 646553 - DNA, 25 bp, Rattus norvegicus
agtccggttcccagcttgttctaca

SEQ ID NO: 646554 - DNA, 25 bp, Rattus norvegicus
cttgttctacagacaggtggcgtta

SEQ ID NO: 646555 - DNA, 25 bp, Rattus norvegicus
agcccgccggaagccgcagtattag

SEQ ID NO: 646556 - DNA, 25 bp, Rattus norvegicus
aacactatgagtggactgtaccgca

SEQ ID NO: 646557 - DNA, 25 bp, Rattus norvegicus
ttctgcctcacgagttaacactatg

SEQ ID NO: 646558 - DNA, 25 bp, Rattus norvegicus
ttacatcgtcgccactcgctgtctg

SEQ ID NO: 646559 - DNA, 25 bp, Rattus norvegicus
cgaaacaagtccaggtccagcacca

SEQ ID NO: 646560 - DNA, 25 bp, Rattus norvegicus
taagttgtgacctctgaagcgatga

SEQ ID NO: 646561 - DNA, 25 bp, Rattus norvegicus
gggattcaagggataccgcgagctc

SEQ ID NO: 646562 - DNA, 25 bp, Rattus norvegicus
ccgggagtatctgacaaaggctgta

SEQ ID NO: 646563 - DNA, 25 bp, Rattus norvegicus
tcgctgtctgccttcaccagctggt

SEQ ID NO: 646564 - DNA, 25 bp, Rattus norvegicus
cgcttctcctgcgtctctcgaatga

SEQ ID NO: 646565 - DNA, 25 bp, Rattus norvegicus
cggctcatttcgcacctattactct

SEQ ID NO: 646566 - DNA, 25 bp, Rattus norvegicus
gcagcggctcatttcgcacctatta

SEQ ID NO: 646567 - DNA, 25 bp, Rattus norvegicus
ccttcaaaacatctgcagcggctca

SEQ ID NO: 646568 - DNA, 25 bp, Rattus norvegicus
gcacgcagtagaagaaccttcaaaa

SEQ ID NO: 646569 - DNA, 25 bp, Rattus norvegicus
cgtaaagcacgcagtagaagaacct

SEQ ID NO: 646570 - DNA, 25 bp, Rattus norvegicus
cttacgttacgtaaagcacgcagta

SEQ ID NO: 646571 - DNA, 25 bp, Rattus norvegicus
tgcaagtaaccgaataggcttacgt

SEQ ID NO: 646572 - DNA, 25 bp, Rattus norvegicus
ccagggtttgcaagtaaccgaatag

SEQ ID NO: 646573 - DNA, 25 bp, Rattus norvegicus
tgtgccgctcacctgccggtctcca

SEQ ID NO: 646574 - DNA, 25 bp, Rattus norvegicus
catcctcttcgctcagcgcgggtgg

SEQ ID NO: 646575 - DNA, 25 bp, Rattus norvegicus
tcgccttgacaaccgcatcctcttc

SEQ ID NO: 646576 - DNA, 25 bp, Rattus norvegicus
tatccatgtcgccttgacaaccgca

SEQ ID NO: 646577 - DNA, 25 bp, Rattus norvegicus
gtcctctcctcctcctatccatgtc

SEQ ID NO: 646578 - DNA, 25 bp, Rattus norvegicus
tttcgcacctattactcttccgggc

SEQ ID NO: 646579 - DNA, 25 bp, Rattus norvegicus
ctgcttttcatttcggggcggcccg

SEQ ID NO: 646580 - DNA, 25 bp, Rattus norvegicus
tcgcaggagggctgcttttcatttc

SEQ ID NO: 646581 - DNA, 25 bp, Rattus norvegicus
cgcaggaccgatccgggaacctcgg

SEQ ID NO: 646582 - DNA, 25 bp, Rattus norvegicus
cacacacggtgagaagaaaaactgc

SEQ ID NO: 646583 - DNA, 25 bp, Rattus norvegicus
tcaaataagatcaaggtgtaggcga

SEQ ID NO: 646584 - DNA, 25 bp, Rattus norvegicus
gggtcacgacccgatcaaataagat

SEQ ID NO: 646585 - DNA, 25 bp, Rattus norvegicus
attcatcacttctgagcgccgggcc

SEQ ID NO: 646586 - DNA, 25 bp, Rattus norvegicus
cccggcctcgtctatctgatcaatt

SEQ ID NO: 646587 - DNA, 25 bp, Rattus norvegicus
gaatcgcctcggtaatcagcggctg

SEQ ID NO: 646588 - DNA, 25 bp, Rattus norvegicus
gccgggctcagatcagaatcgcctc

SEQ ID NO: 646589 - DNA, 25 bp, Rattus norvegicus
aggctacagacctgaaccagggctc

SEQ ID NO: 646590 - DNA, 25 bp, Rattus norvegicus
cctctgcagcacacgaggctacaga

SEQ ID NO: 646591 - DNA, 25 bp, Rattus norvegicus
aagcctccatctacaagcggcggcg

SEQ ID NO: 646592 - DNA, 25 bp, Rattus norvegicus
aactgcagcggggacaaagcctcca

SEQ ID NO: 646593 - DNA, 25 bp, Rattus norvegicus
ttgacacttcccgatccgggccgtg

SEQ ID NO: 646594 - DNA, 25 bp, Rattus norvegicus
cgccgcactcagaccaaagtagctg

SEQ ID NO: 646595 - DNA, 25 bp, Rattus norvegicus
aacgagccgtagtacgcaagcgcga

SEQ ID NO: 646596 - DNA, 25 bp, Rattus norvegicus
tccctacgtacgtgacgagcgcgtg

SEQ ID NO: 646597 - DNA, 25 bp, Rattus norvegicus
gtagctgatcgttgagccaaggccc

SEQ ID NO: 646598 - DNA, 25 bp, Rattus norvegicus
gccgtggtgacaagaacgagccgta

SEQ ID NO: 646599 - DNA, 25 bp, Rattus norvegicus
gaacctggttcccacttgacacttc

SEQ ID NO: 646600 - DNA, 25 bp, Rattus norvegicus
tccgggttcagctgtagaggctgca

SEQ ID NO: 646601 - DNA, 25 bp, Rattus norvegicus
accgttcgtcatggcggtagtgccc

SEQ ID NO: 646602 - DNA, 25 bp, Rattus norvegicus
gcactcaccgttcgtcatggcggta

SEQ ID NO: 646603 - DNA, 25 bp, Rattus norvegicus
tggtcctggtcgtctaccgtcaacc

SEQ ID NO: 646604 - DNA, 25 bp, Rattus norvegicus
cgccacgattggtcctggtcgtcta

SEQ ID NO: 646605 - DNA, 25 bp, Rattus norvegicus
ggaaacggccacgtcagtctagccc

SEQ ID NO: 646606 - DNA, 25 bp, Rattus norvegicus
tgcgtaacgtctgcgtccctacgta

SEQ ID NO: 646607 - DNA, 25 bp, Rattus norvegicus
agtgagcgcccgtcacagcctgttt

SEQ ID NO: 646608 - DNA, 25 bp, Rattus norvegicus
agatcccaccgtgagtgagcgcccg

SEQ ID NO: 646609 - DNA, 25 bp, Rattus norvegicus
gcaactccggccaggccggaagtga

SEQ ID NO: 646610 - DNA, 25 bp, Rattus norvegicus
cggaagtgacgcacatatcttataa

SEQ ID NO: 646611 - DNA, 25 bp, Rattus norvegicus
tatcttataaatcttgcgagccgcc

SEQ ID NO: 646612 - DNA, 25 bp, Rattus norvegicus
taaatcttgcgagccgcccttgggc

SEQ ID NO: 646613 - DNA, 25 bp, Rattus norvegicus
gcgggctgctagcatggcagatgag

SEQ ID NO: 646614 - DNA, 25 bp, Rattus norvegicus
cagcctgtttcctcactccctctgg

SEQ ID NO: 646615 - DNA, 25 bp, Rattus norvegicus
cctctggctcactagcggaggcaga

SEQ ID NO: 646616 - DNA, 25 bp, Rattus norvegicus
ctcactagcggaggcagagtctgac

SEQ ID NO: 646617 - DNA, 25 bp, Rattus norvegicus
ctagcggaggcagagtctgaccctc

SEQ ID NO: 646618 - DNA, 25 bp, Rattus norvegicus
ggaggcagagtctgaccctcctgag

SEQ ID NO: 646619 - DNA, 25 bp, Rattus norvegicus
tgagccttagggaatcccgccgaga

SEQ ID NO: 646620 - DNA, 25 bp, Rattus norvegicus
gatgaggaggaagatcccaccgtga

SEQ ID NO: 646621 - DNA, 25 bp, Rattus norvegicus
gggaccgctcaccacacagtacatt

SEQ ID NO: 646622 - DNA, 25 bp, Rattus norvegicus
gcggatcccgtcctgaaggtagcag

SEQ ID NO: 646623 - DNA, 25 bp, Rattus norvegicus
caccgggagaactgtggcaaccaga

SEQ ID NO: 646624 - DNA, 25 bp, Rattus norvegicus
agctcggatacaatggcacccgcca

SEQ ID NO: 646625 - DNA, 25 bp, Rattus norvegicus
cgcagagagcgcagactggtccgcc

SEQ ID NO: 646626 - DNA, 25 bp, Rattus norvegicus
cagtacatttggcaccgcatcagca

SEQ ID NO: 646627 - DNA, 25 bp, Rattus norvegicus
gcagggaccagagcagctgttaaca

SEQ ID NO: 646628 - DNA, 25 bp, Rattus norvegicus
ctgttaacaccgagcgcggcacggg

SEQ ID NO: 646629 - DNA, 25 bp, Rattus norvegicus
actttgcgctggttctacagggacc

SEQ ID NO: 646630 - DNA, 25 bp, Rattus norvegicus
cctcgttttcctagccaactttgcg

SEQ ID NO: 646631 - DNA, 25 bp, Rattus norvegicus
tttaacagaaggagtcgaagcccgc

SEQ ID NO: 646632 - DNA, 25 bp, Rattus norvegicus
gcagctggttccgaggtgtcagccc

SEQ ID NO: 646633 - DNA, 25 bp, Rattus norvegicus
actggtccgcctctcgcagctggtt

SEQ ID NO: 646634 - DNA, 25 bp, Rattus norvegicus
accgcatcagcaccgagctcggata

SEQ ID NO: 646635 - DNA, 25 bp, Rattus norvegicus
tgagcgatgctcctctcggtcgtat

SEQ ID NO: 646636 - DNA, 25 bp, Rattus norvegicus
cggcgcttgacaaccgcagtctgtg

SEQ ID NO: 646637 - DNA, 25 bp, Rattus norvegicus
accggctgacgagctgatggattga

SEQ ID NO: 646638 - DNA, 25 bp, Rattus norvegicus
tcgcgctcgcgccttagcctggaat

SEQ ID NO: 646639 - DNA, 25 bp, Rattus norvegicus
cttagcctggaattggctgccttgg

SEQ ID NO: 646640 - DNA, 25 bp, Rattus norvegicus
cggagccctcaggtgagtggattcc

SEQ ID NO: 646641 - DNA, 25 bp, Rattus norvegicus
accgtgggttgccatggtcacccgt

SEQ ID NO: 646642 - DNA, 25 bp, Rattus norvegicus
cctgtcactagcctgatgagacgca

SEQ ID NO: 646643 - DNA, 25 bp, Rattus norvegicus
cccgggtgtatcagggacaggacct

SEQ ID NO: 646644 - DNA, 25 bp, Rattus norvegicus
ctccttgccagcctgattcgggcgg

SEQ ID NO: 646645 - DNA, 25 bp, Rattus norvegicus
agctccgttccagcggcgcttgaca

SEQ ID NO: 646646 - DNA, 25 bp, Rattus norvegicus
tcctctcggtcgtatggagtaccca

SEQ ID NO: 646647 - DNA, 25 bp, Rattus norvegicus
gtatggagtacccacctcgccgctg

SEQ ID NO: 646648 - DNA, 25 bp, Rattus norvegicus
cctgggactcaccagactgtctatc

SEQ ID NO: 646649 - DNA, 25 bp, Rattus norvegicus
actctacgggcgctgacatttgcag

SEQ ID NO: 646650 - DNA, 25 bp, Rattus norvegicus
cccagaggcccagggcgaggccaag

SEQ ID NO: 646651 - DNA, 25 bp, Rattus norvegicus
ccaaggtggccgctgctgctttagc

SEQ ID NO: 646652 - DNA, 25 bp, Rattus norvegicus
caaggtggccgctgctgctttagcg

SEQ ID NO: 646653 - DNA, 25 bp, Rattus norvegicus
ctggagctgcctgggctgcggccgc

SEQ ID NO: 646654 - DNA, 25 bp, Rattus norvegicus
ttgcaggctgccctcctgattggtc

SEQ ID NO: 646655 - DNA, 25 bp, Rattus norvegicus
tgcaggctgccctcctgattggtcc

SEQ ID NO: 646656 - DNA, 25 bp, Rattus norvegicus
catttgcaggctgccctcctgattg

SEQ ID NO: 646657 - DNA, 25 bp, Rattus norvegicus
ctgacatttgcaggctgccctcctg

SEQ ID NO: 646658 - DNA, 25 bp, Rattus norvegicus
gcgctgacatttgcaggctgccctc

SEQ ID NO: 646659 - DNA, 25 bp, Rattus norvegicus
acgggcgctgacatttgcaggctgc

SEQ ID NO: 646660 - DNA, 25 bp, Rattus norvegicus
ctacgggcgctgacatttgcaggct

SEQ ID NO: 646661 - DNA, 25 bp, Rattus norvegicus
ctctacgggcgctgacatttgcagg

SEQ ID NO: 646662 - DNA, 25 bp, Rattus norvegicus
ctgctttagcggctgctggaggctg

SEQ ID NO: 646663 - DNA, 25 bp, Rattus norvegicus
tcgatgagtgggctcaggacttctg

SEQ ID NO: 646664 - DNA, 25 bp, Rattus norvegicus
gtgcctatggcgatctcctgttctg

SEQ ID NO: 646665 - DNA, 25 bp, Rattus norvegicus
acgcacgcgggaaggccgcacagct

SEQ ID NO: 646666 - DNA, 25 bp, Rattus norvegicus
gcggtgcagccaatcagcgacgcac

SEQ ID NO: 646667 - DNA, 25 bp, Rattus norvegicus
tgtgctatgcgagccgatagcggcc

SEQ ID NO: 646668 - DNA, 25 bp, Rattus norvegicus
ggcgatctcctgttctgtgctatgc

SEQ ID NO: 646669 - DNA, 25 bp, Rattus norvegicus
gcctgtgcctatggcgatctcctgt

SEQ ID NO: 646670 - DNA, 25 bp, Rattus norvegicus
accctcgacgtgagtgggcgctctt

SEQ ID NO: 646671 - DNA, 25 bp, Rattus norvegicus
aagagcaggcaggaccctcgacgtg

SEQ ID NO: 646672 - DNA, 25 bp, Rattus norvegicus
tctgcgcgagcgcacgttgtctgag

SEQ ID NO: 646673 - DNA, 25 bp, Rattus norvegicus
ggacttctgcgcgagcgcacgttgt

SEQ ID NO: 646674 - DNA, 25 bp, Rattus norvegicus
cacagctgcggtccgagtgagtcga

SEQ ID NO: 646675 - DNA, 25 bp, Rattus norvegicus
agccaatcagcgacgcacgcgggaa

SEQ ID NO: 646676 - DNA, 25 bp, Rattus norvegicus
ctgttctgtgctatgcgagccgata

SEQ ID NO: 646677 - DNA, 25 bp, Rattus norvegicus
gcctccgaccgcagactggggatcg

SEQ ID NO: 646678 - DNA, 25 bp, Rattus norvegicus
ggctctcccattcaaactgacaacg

SEQ ID NO: 646679 - DNA, 25 bp, Rattus norvegicus
gctaggtctcctcagcgcctgagct

SEQ ID NO: 646680 - DNA, 25 bp, Rattus norvegicus
agggtctcaccgtcagctaggtctc

SEQ ID NO: 646681 - DNA, 25 bp, Rattus norvegicus
tcacgtgggccagagcttcggactc

SEQ ID NO: 646682 - DNA, 25 bp, Rattus norvegicus
agccgcttcagggatgagcgcctcc

SEQ ID NO: 646683 - DNA, 25 bp, Rattus norvegicus
tcacttagaggaccacagccgagcg

SEQ ID NO: 646684 - DNA, 25 bp, Rattus norvegicus
agcaaatatttccaaggtctgcaga

SEQ ID NO: 646685 - DNA, 25 bp, Rattus norvegicus
tgaagtcgctgcatcccagcaaata

SEQ ID NO: 646686 - DNA, 25 bp, Rattus norvegicus
ttacgctcggaaaacgcgtgaagtc

SEQ ID NO: 646687 - DNA, 25 bp, Rattus norvegicus
ccgcgtcttttggaccggccaatgg

SEQ ID NO: 646688 - DNA, 25 bp, Rattus norvegicus
ctgggattccgctttatccactgtc

SEQ ID NO: 646689 - DNA, 25 bp, Rattus norvegicus
ttatccactgtctgttacgctcgga

SEQ ID NO: 646690 - DNA, 25 bp, Rattus norvegicus
gggaccaacgacctgcctgggattc

SEQ ID NO: 646691 - DNA, 25 bp, Rattus norvegicus
agccggcccgagtcaggttgcccaa

SEQ ID NO: 646692 - DNA, 25 bp, Rattus norvegicus
ttatgcgcaacaacaagggcgcgtc

SEQ ID NO: 646693 - DNA, 25 bp, Rattus norvegicus
gccctccggtgacgttatgcgcaac

SEQ ID NO: 646694 - DNA, 25 bp, Rattus norvegicus
tcgcaacctactttggccctgaaag

SEQ ID NO: 646695 - DNA, 25 bp, Rattus norvegicus
cagcgggaaaacaagacccggcacg

SEQ ID NO: 646696 - DNA, 25 bp, Rattus norvegicus
aacaagtgcccgtgcagctcccgga

SEQ ID NO: 646697 - DNA, 25 bp, Rattus norvegicus
ggacctggtcccaaagcaacaagtg

SEQ ID NO: 646698 - DNA, 25 bp, Rattus norvegicus
acccgactctctgggctagccggaa

SEQ ID NO: 646699 - DNA, 25 bp, Rattus norvegicus
tgctggcatgaaacccgactctctg

SEQ ID NO: 646700 - DNA, 25 bp, Rattus norvegicus
cccatccctggtgctggcatgaaac

SEQ ID NO: 646701 - DNA, 25 bp, Rattus norvegicus
ccaaagccacggagaaggccgcgtc

SEQ ID NO: 646702 - DNA, 25 bp, Rattus norvegicus
ctcaccgcggtgagagttggccaaa

SEQ ID NO: 646703 - DNA, 25 bp, Rattus norvegicus
ccggaaggagtcaagccagggacct

SEQ ID NO: 646704 - DNA, 25 bp, Rattus norvegicus
ttttgccgaggagcctcaccgcggt

SEQ ID NO: 646705 - DNA, 25 bp, Rattus norvegicus
cgattccttttcctggttgcgcgag

SEQ ID NO: 646706 - DNA, 25 bp, Rattus norvegicus
cgaggcctagaggatgcgtacctta

SEQ ID NO: 646707 - DNA, 25 bp, Rattus norvegicus
cgtaccttaaagtagatctcgtcca

SEQ ID NO: 646708 - DNA, 25 bp, Rattus norvegicus
ccacctcgtggtaggtcttgagctc

SEQ ID NO: 646709 - DNA, 25 bp, Rattus norvegicus
tgcactttgaagtaaggcgacgaca

SEQ ID NO: 646710 - DNA, 25 bp, Rattus norvegicus
agcggcagcacattgccctgcttgc

SEQ ID NO: 646711 - DNA, 25 bp, Rattus norvegicus
gctgttgttagccatgttgccgcgg

SEQ ID NO: 646712 - DNA, 25 bp, Rattus norvegicus
agctcgatcgcgctcttcgggacaa

SEQ ID NO: 646713 - DNA, 25 bp, Rattus norvegicus
tggacctactccatggaaggccgtc

SEQ ID NO: 646714 - DNA, 25 bp, Rattus norvegicus
actgcaactgggacgccgacacaag

SEQ ID NO: 646715 - DNA, 25 bp, Rattus norvegicus
cggacaccaaacacaggctgcgaga

SEQ ID NO: 646716 - DNA, 25 bp, Rattus norvegicus
ggagctcgatctcttccgccaactg

SEQ ID NO: 646717 - DNA, 25 bp, Rattus norvegicus
acacgtcccggcgttcgagctaagt

SEQ ID NO: 646718 - DNA, 25 bp, Rattus norvegicus
cgagctaagtccgtgaccaatcaga

SEQ ID NO: 646719 - DNA, 25 bp, Rattus norvegicus
acggacctaacagccacagagcctg

SEQ ID NO: 646720 - DNA, 25 bp, Rattus norvegicus
tcttcggggcatgcgccacagcggc

SEQ ID NO: 646721 - DNA, 25 bp, Rattus norvegicus
ggaaaatgtcttcggggcatgcgcc

SEQ ID NO: 646722 - DNA, 25 bp, Rattus norvegicus
atgtccacgtctcttgcgcgcacga

SEQ ID NO: 646723 - DNA, 25 bp, Rattus norvegicus
ttctgaagatcggtgggaaaatgtc

SEQ ID NO: 646724 - DNA, 25 bp, Rattus norvegicus
cacagcggccgttaagtgacccaaa

SEQ ID NO: 646725 - DNA, 25 bp, Rattus norvegicus
gtacccaacagtcgcggcaggggca

SEQ ID NO: 646726 - DNA, 25 bp, Rattus norvegicus
ggagcatggccgagcttcgcacgcc

SEQ ID NO: 646727 - DNA, 25 bp, Rattus norvegicus
gtctggtccgtacccaacagtcgcg

SEQ ID NO: 646728 - DNA, 25 bp, Rattus norvegicus
agaagcctcgcacccggggctccac

SEQ ID NO: 646729 - DNA, 25 bp, Rattus norvegicus
gcccagcgaggaccctgagggctca

SEQ ID NO: 646730 - DNA, 25 bp, Rattus norvegicus
gagcctgtagcctggccgccggtct

SEQ ID NO: 646731 - DNA, 25 bp, Rattus norvegicus
taacagccacagagcctgtagcctg

SEQ ID NO: 646732 - DNA, 25 bp, Rattus norvegicus
tcttgcgcgcacgagaagcctcgca

SEQ ID NO: 646733 - DNA, 25 bp, Rattus norvegicus
ccgcccgtctgatcgcgaacaggga

SEQ ID NO: 646734 - DNA, 25 bp, Rattus norvegicus
agagcagctcccgtggctcgttacc

SEQ ID NO: 646735 - DNA, 25 bp, Rattus norvegicus
acacgcgacaacagcgagctcggca

SEQ ID NO: 646736 - DNA, 25 bp, Rattus norvegicus
gctaggagaacggtcgccgcctcct

SEQ ID NO: 646737 - DNA, 25 bp, Rattus norvegicus
agtgggcgccctttccgtactgccg

SEQ ID NO: 646738 - DNA, 25 bp, Rattus norvegicus
aggagcggtcgccttgcagctcgtc

SEQ ID NO: 646739 - DNA, 25 bp, Rattus norvegicus
agcaccggtagctgcagcgcggacc

SEQ ID NO: 646740 - DNA, 25 bp, Rattus norvegicus
ttcttcatcatcgtgagggtcaggc

SEQ ID NO: 646741 - DNA, 25 bp, Rattus norvegicus
cctcgagctcgaagtccaccttaaa

SEQ ID NO: 646742 - DNA, 25 bp, Rattus norvegicus
agccgcatcttgcagaagaggaccc

SEQ ID NO: 646743 - DNA, 25 bp, Rattus norvegicus
tccagcagccgcatcttgcagaaga

SEQ ID NO: 646744 - DNA, 25 bp, Rattus norvegicus
actccgcggtgaaggtgccgccgtc

SEQ ID NO: 646745 - DNA, 25 bp, Rattus norvegicus
ctcgttacctggaggactccgcggt

SEQ ID NO: 646746 - DNA, 25 bp, Rattus norvegicus
agctgggcaagctaacacgcgacaa

SEQ ID NO: 646747 - DNA, 25 bp, Rattus norvegicus
ggtgcacggtgccaggttccgtcct

SEQ ID NO: 646748 - DNA, 25 bp, Rattus norvegicus
tggcgcgcctcaggtgcagacctgt

SEQ ID NO: 646749 - DNA, 25 bp, Rattus norvegicus
tcgtagcggccgcaactgcggggcg

SEQ ID NO: 646750 - DNA, 25 bp, Rattus norvegicus
ctggacaaaagtggtgtggtccttg

SEQ ID NO: 646751 - DNA, 25 bp, Rattus norvegicus
cctgtggttctggacaaaagtggtg

SEQ ID NO: 646752 - DNA, 25 bp, Rattus norvegicus
tgcagacctgtggttctggacaaaa

SEQ ID NO: 646753 - DNA, 25 bp, Rattus norvegicus
cgcctcaggtgcagacctgtggttc

SEQ ID NO: 646754 - DNA, 25 bp, Rattus norvegicus
gctcgagtctcaggcagttggggct

SEQ ID NO: 646755 - DNA, 25 bp, Rattus norvegicus
aaccgcggggctcgagtctcaggca

SEQ ID NO: 646756 - DNA, 25 bp, Rattus norvegicus
ctcaaggttccgctggggaaccgcg

SEQ ID NO: 646757 - DNA, 25 bp, Rattus norvegicus
ctccggttctcaaggttccgctggg

SEQ ID NO: 646758 - DNA, 25 bp, Rattus norvegicus
agtgctccggttctcaaggttccgc

SEQ ID NO: 646759 - DNA, 25 bp, Rattus norvegicus
ttccgtcctggcagtgctccggttc

SEQ ID NO: 646760 - DNA, 25 bp, Rattus norvegicus
gccaggttccgtcctggcagtgctc

SEQ ID NO: 646761 - DNA, 25 bp, Rattus norvegicus
gctgcagagcctgggcatcccgctg

SEQ ID NO: 646762 - DNA, 25 bp, Rattus norvegicus
ccgagctcggttcctgtgagccaga

SEQ ID NO: 646763 - DNA, 25 bp, Rattus norvegicus
gttcctgtgagccagaagcctcgcc

SEQ ID NO: 646764 - DNA, 25 bp, Rattus norvegicus
gctcggaggccaccgcctcactcca

SEQ ID NO: 646765 - DNA, 25 bp, Rattus norvegicus
actccaccaggcctcagcactcgga

SEQ ID NO: 646766 - DNA, 25 bp, Rattus norvegicus
ccgggacacagccaagtcccgggag

SEQ ID NO: 646767 - DNA, 25 bp, Rattus norvegicus
agcactcggatcctgcctcgccagc

SEQ ID NO: 646768 - DNA, 25 bp, Rattus norvegicus
gcctcgccagctcgccgcgaattcc

SEQ ID NO: 646769 - DNA, 25 bp, Rattus norvegicus
tggctgcgggccttcgtgctgccca

SEQ ID NO: 646770 - DNA, 25 bp, Rattus norvegicus
tgcccaccgccgtctgccaggacgc

SEQ ID NO: 646771 - DNA, 25 bp, Rattus norvegicus
accctgtgccgagctcggttcctgt

SEQ ID NO: 646772 - DNA, 25 bp, Rattus norvegicus
ctcttccgggcgctggaccgcaatg

SEQ ID NO: 646773 - DNA, 25 bp, Rattus norvegicus
agagcctgggcatcccgctgggcca

SEQ ID NO: 646774 - DNA, 25 bp, Rattus norvegicus
acgcgctacgagacgctcttccggg

SEQ ID NO: 646775 - DNA, 25 bp, Rattus norvegicus
actcgacatggcgtcaatggttgcg

SEQ ID NO: 646776 - DNA, 25 bp, Rattus norvegicus
ccgtggccaaccagtcattaaaatg

SEQ ID NO: 646777 - DNA, 25 bp, Rattus norvegicus
agccatcctactgtctctacttgaa

SEQ ID NO: 646778 - DNA, 25 bp, Rattus norvegicus
actcgcttctcgactgggtgacacc

SEQ ID NO: 646779 - DNA, 25 bp, Rattus norvegicus
taggcgcccgtttattactcgcttc

SEQ ID NO: 646780 - DNA, 25 bp, Rattus norvegicus
tgggagccgctctatgacctaatca

SEQ ID NO: 646781 - DNA, 25 bp, Rattus norvegicus
caaacgacgccttgagccgactcta

SEQ ID NO: 646782 - DNA, 25 bp, Rattus norvegicus
tccgggcagccggttttatagtctg

SEQ ID NO: 646783 - DNA, 25 bp, Rattus norvegicus
gccgcggtctcggtcactagaataa

SEQ ID NO: 646784 - DNA, 25 bp, Rattus norvegicus
ccgccctgacaggtcccttgttata

SEQ ID NO: 646785 - DNA, 25 bp, Rattus norvegicus
tttagccggatgtcagagaaacgca

SEQ ID NO: 646786 - DNA, 25 bp, Rattus norvegicus
ccagttaccagaagcgtcgccttta

SEQ ID NO: 646787 - DNA, 25 bp, Rattus norvegicus
aggcgaggcgcttccctatctaaaa

SEQ ID NO: 646788 - DNA, 25 bp, Rattus norvegicus
gaccgcctcctcgtcgcaaaggatg

SEQ ID NO: 646789 - DNA, 25 bp, Rattus norvegicus
aggttcaagatcacgcctaggccga

SEQ ID NO: 646790 - DNA, 25 bp, Rattus norvegicus
ggcaccaatacagcaccgcgtcgag

SEQ ID NO: 646791 - DNA, 25 bp, Rattus norvegicus
cgacgaatcgagcaacagcaccagg

SEQ ID NO: 646792 - DNA, 25 bp, Rattus norvegicus
gctcgcgttccttcgacaggttcaa

SEQ ID NO: 646793 - DNA, 25 bp, Rattus norvegicus
tctcctccgagtgcttgaacatgtg

SEQ ID NO: 646794 - DNA, 25 bp, Rattus norvegicus
cagcaactcgtcctctttggagaaa

SEQ ID NO: 646795 - DNA, 25 bp, Rattus norvegicus
ggcaagcatgcagccgcagcaactc

SEQ ID NO: 646796 - DNA, 25 bp, Rattus norvegicus
tgttggtagccaacacggccaccgc

SEQ ID NO: 646797 - DNA, 25 bp, Rattus norvegicus
gacctcgcgttctacctccttgttg

SEQ ID NO: 646798 - DNA, 25 bp, Rattus norvegicus
acgagcgccaacgtgcctgagtgct

SEQ ID NO: 646799 - DNA, 25 bp, Rattus norvegicus
aagcggccaggatccagcgatgcca

SEQ ID NO: 646800 - DNA, 25 bp, Rattus norvegicus
tggcatccaccaggcaacgagcgaa

SEQ ID NO: 646801 - DNA, 25 bp, Rattus norvegicus
acgaccctggcttgtgtcactggca

SEQ ID NO: 646802 - DNA, 25 bp, Rattus norvegicus
tgaacatgtgctccaagatgcccgc

SEQ ID NO: 646803 - DNA, 25 bp, Rattus norvegicus
gactgcggcgccctcaccagaaagg

SEQ ID NO: 646804 - DNA, 25 bp, Rattus norvegicus
cgccgttgggctaatccctggacgc

SEQ ID NO: 646805 - DNA, 25 bp, Rattus norvegicus
actcgcggaccgcacagaccggcca

SEQ ID NO: 646806 - DNA, 25 bp, Rattus norvegicus
cgccaggctagcgagtcggaagcca

SEQ ID NO: 646807 - DNA, 25 bp, Rattus norvegicus
tagcgagtcggaagccagtgctcag

SEQ ID NO: 646808 - DNA, 25 bp, Rattus norvegicus
aggcgagttctacgccgcgtcccgg

SEQ ID NO: 646809 - DNA, 25 bp, Rattus norvegicus
cgccctcaccagaaaggcagagaga

SEQ ID NO: 646810 - DNA, 25 bp, Rattus norvegicus
cttcgcggcagccacctcggagtca

SEQ ID NO: 646811 - DNA, 25 bp, Rattus norvegicus
aagcagtgcgctcagtggctcatcc

SEQ ID NO: 646812 - DNA, 25 bp, Rattus norvegicus
gtggctcatccactgcaaagtgctg

SEQ ID NO: 646813 - DNA, 25 bp, Rattus norvegicus
tgctgcccgccaaccaccgggtgac

SEQ ID NO: 646814 - DNA, 25 bp, Rattus norvegicus
actcggcgcaggtgttcgacctggc

SEQ ID NO: 646815 - DNA, 25 bp, Rattus norvegicus
ggtgttcgacctggcgcagaccctc

SEQ ID NO: 646816 - DNA, 25 bp, Rattus norvegicus
ggacccgaggcgagttctacgccgc

SEQ ID NO: 646817 - DNA, 25 bp, Rattus norvegicus
cttcccgcaacagaacatgcatgtg

SEQ ID NO: 646818 - DNA, 25 bp, Rattus norvegicus
gtgtcgcacgccattaagatgaata

SEQ ID NO: 646819 - DNA, 25 bp, Rattus norvegicus
ttgctagtgacgaagcacggctctg

SEQ ID NO: 646820 - DNA, 25 bp, Rattus norvegicus
cacggccgtgatggattgctagtga

SEQ ID NO: 646821 - DNA, 25 bp, Rattus norvegicus
aagtacgtttatgcatggtggcacg

SEQ ID NO: 646822 - DNA, 25 bp, Rattus norvegicus
tctttacacgtgctggggtgtcgca

SEQ ID NO: 646823 - DNA, 25 bp, Rattus norvegicus
gctttgtagcagagcgtcgcagcca

SEQ ID NO: 646824 - DNA, 25 bp, Rattus norvegicus
gcagttccgtgaacgctcctctttc

SEQ ID NO: 646825 - DNA, 25 bp, Rattus norvegicus
tctaagttcagggacgcagttccgt

SEQ ID NO: 646826 - DNA, 25 bp, Rattus norvegicus
actatgttttccgttgcgggagagc

SEQ ID NO: 646827 - DNA, 25 bp, Rattus norvegicus
cgggagagcagagtaattagcgttc

SEQ ID NO: 646828 - DNA, 25 bp, Rattus norvegicus
tagcgttctcacacgtccctcaagg

SEQ ID NO: 646829 - DNA, 25 bp, Rattus norvegicus
tccctcaagggcgtctaagttcagg

SEQ ID NO: 646830 - DNA, 25 bp, Rattus norvegicus
cgcagccacgcgttcatggcgaaaa

SEQ ID NO: 646831 - DNA, 25 bp, Rattus norvegicus
gtgagcgccaaagacccagacaagc

SEQ ID NO: 646832 - DNA, 25 bp, Rattus norvegicus
accgaatcgcgagtgcaggtacacc

SEQ ID NO: 646833 - DNA, 25 bp, Rattus norvegicus
ctgcgtatcgggctgaccgaatcgc

SEQ ID NO: 646834 - DNA, 25 bp, Rattus norvegicus
cgacatctttatgcgtgaggagcta

SEQ ID NO: 646835 - DNA, 25 bp, Rattus norvegicus
ttggagaggagcttcgccaagactc

SEQ ID NO: 646836 - DNA, 25 bp, Rattus norvegicus
gcagcagggccaacagaaacagaag

SEQ ID NO: 646837 - DNA, 25 bp, Rattus norvegicus
cgacccagtcgaaggagccactctg

SEQ ID NO: 646838 - DNA, 25 bp, Rattus norvegicus
aaagatgccgccgagcttctgggcc

SEQ ID NO: 646839 - DNA, 25 bp, Rattus norvegicus
tccctcctcaggtatgaaagatgcc

SEQ ID NO: 646840 - DNA, 25 bp, Rattus norvegicus
gccaggacagtactgatcgagaccc

SEQ ID NO: 646841 - DNA, 25 bp, Rattus norvegicus
gcagaaccgctcagggaacacaccg

SEQ ID NO: 646842 - DNA, 25 bp, Rattus norvegicus
ggctcctcacgtcgccaggacagta

SEQ ID NO: 646843 - DNA, 25 bp, Rattus norvegicus
ccagcgcagctcaacgaattggaga

SEQ ID NO: 646844 - DNA, 25 bp, Rattus norvegicus
ctactcctgcttcgctggcggtgag

SEQ ID NO: 646845 - DNA, 25 bp, Rattus norvegicus
tcactgtacatagcgttgatggctg

SEQ ID NO: 646846 - DNA, 25 bp, Rattus norvegicus
agatgcttctggattgcggttcgcg

SEQ ID NO: 646847 - DNA, 25 bp, Rattus norvegicus
cgcgacgcacccaaagtccgtttga

SEQ ID NO: 646848 - DNA, 25 bp, Rattus norvegicus
gcgcattcctccactcaagtcagaa

SEQ ID NO: 646849 - DNA, 25 bp, Rattus norvegicus
agatcctcttgaagcaatttcgccc

SEQ ID NO: 646850 - DNA, 25 bp, Rattus norvegicus
gccttggcgccaagaagatcctctt

SEQ ID NO: 646851 - DNA, 25 bp, Rattus norvegicus
tcccgcttggcaccgctttcatttt

SEQ ID NO: 646852 - DNA, 25 bp, Rattus norvegicus
accttggtttcttgcctctggggca

SEQ ID NO: 646853 - DNA, 25 bp, Rattus norvegicus
atcccaggggatcagaaccagcggc

SEQ ID NO: 646854 - DNA, 25 bp, Rattus norvegicus
cccgttgacgtcctcttccaaaatg

SEQ ID NO: 646855 - DNA, 25 bp, Rattus norvegicus
ggtgcctctccctccaaaaatacag

SEQ ID NO: 646856 - DNA, 25 bp, Rattus norvegicus
gaggtctcggcagccttctctgctc

SEQ ID NO: 646857 - DNA, 25 bp, Rattus norvegicus
cctttcttttttgagccgcagaacg

SEQ ID NO: 646858 - DNA, 25 bp, Rattus norvegicus
aaatcgccgccttccgaggtctcgg

SEQ ID NO: 646859 - DNA, 25 bp, Rattus norvegicus
ccttcagccatttggtccgcgcgtg

SEQ ID NO: 646860 - DNA, 25 bp, Rattus norvegicus
tcagcgacatcttggtcccggcagc

SEQ ID NO: 646861 - DNA, 25 bp, Rattus norvegicus
gagctcagcatggactcgtgcagta

SEQ ID NO: 646862 - DNA, 25 bp, Rattus norvegicus
tgcagtagtccgtagcccatccact

SEQ ID NO: 646863 - DNA, 25 bp, Rattus norvegicus
actcgcttacgatggcgtccacttg

SEQ ID NO: 646864 - DNA, 25 bp, Rattus norvegicus
gcgatcatctcctcgtggaccgata

SEQ ID NO: 646865 - DNA, 25 bp, Rattus norvegicus
ccgatacgtcggagtagcactcgta

SEQ ID NO: 646866 - DNA, 25 bp, Rattus norvegicus
gccacgaagagctcagcggaatctg

SEQ ID NO: 646867 - DNA, 25 bp, Rattus norvegicus
gtgctgcttcacttggctccagaaa

SEQ ID NO: 646868 - DNA, 25 bp, Rattus norvegicus
actcgtagtacagctggtcccgctc

SEQ ID NO: 646869 - DNA, 25 bp, Rattus norvegicus
agcatctggtcgctaatcggggcca

SEQ ID NO: 646870 - DNA, 25 bp, Rattus norvegicus
ggcgaagctttccatgcagctcata

SEQ ID NO: 646871 - DNA, 25 bp, Rattus norvegicus
accacgatctccgaatggcccatga

SEQ ID NO: 646872 - DNA, 25 bp, Rattus norvegicus
tgcagctcatatccacgccatagtg

SEQ ID NO: 646873 - DNA, 25 bp, Rattus norvegicus
accaggcgtcccttatctgacagga

SEQ ID NO: 646874 - DNA, 25 bp, Rattus norvegicus
tagctgcgcacgcttaccaggcgtc

SEQ ID NO: 646875 - DNA, 25 bp, Rattus norvegicus
acagcgcttctgttcgcggattgcc

SEQ ID NO: 646876 - DNA, 25 bp, Rattus norvegicus
tggccttctggagaacagcgcttct

SEQ ID NO: 646877 - DNA, 25 bp, Rattus norvegicus
cggaaatcccgcgtgagttgatctc

SEQ ID NO: 646878 - DNA, 25 bp, Rattus norvegicus
gtcattttccgcttcgcgctaagca

SEQ ID NO: 646879 - DNA, 25 bp, Rattus norvegicus
tgccgcagagagagcttttagagcc

SEQ ID NO: 646880 - DNA, 25 bp, Rattus norvegicus
cacggagcctgagccgaagtcattt

SEQ ID NO: 646881 - DNA, 25 bp, Rattus norvegicus
ggagacagtccttccgcacaagctg

SEQ ID NO: 646882 - DNA, 25 bp, Rattus norvegicus
cacgcagaaccagccggagacagtc

SEQ ID NO: 646883 - DNA, 25 bp, Rattus norvegicus
ggcctcctcgcgacagtggcatcga

SEQ ID NO: 646884 - DNA, 25 bp, Rattus norvegicus
cttatctgacaggacgcgcacggac

SEQ ID NO: 646885 - DNA, 25 bp, Rattus norvegicus
agagagccggcctcttcccggttct

SEQ ID NO: 646886 - DNA, 25 bp, Rattus norvegicus
gcgctaagcattctggacgtacgga

SEQ ID NO: 646887 - DNA, 25 bp, Rattus norvegicus
tcgctcaagcgggacgaagctgcgt

SEQ ID NO: 646888 - DNA, 25 bp, Rattus norvegicus
ggagaccagcacactcacaaagttc

SEQ ID NO: 646889 - DNA, 25 bp, Rattus norvegicus
ctacctcgctcaagcgggacgaagc

SEQ ID NO: 646890 - DNA, 25 bp, Rattus norvegicus
ctgcaaggcgaagtctctgagcgcc

SEQ ID NO: 646891 - DNA, 25 bp, Rattus norvegicus
tcggcggtgcactccaatagccagc

SEQ ID NO: 646892 - DNA, 25 bp, Rattus norvegicus
actgacggagaccagcacactcaca

SEQ ID NO: 646893 - DNA, 25 bp, Rattus norvegicus
ggcgactgacggagaccagcacact

SEQ ID NO: 646894 - DNA, 25 bp, Rattus norvegicus
catcttgctgctgtcggcgactgac

SEQ ID NO: 646895 - DNA, 25 bp, Rattus norvegicus
atccgcatcttgctgctgtcggcga

SEQ ID NO: 646896 - DNA, 25 bp, Rattus norvegicus
cgcgcgatccgcatcttgctgctgt

SEQ ID NO: 646897 - DNA, 25 bp, Rattus norvegicus
gggctccgggtctacaccgcgcgat

SEQ ID NO: 646898 - DNA, 25 bp, Rattus norvegicus
caagcgggacgaagctgcgtccgcc

SEQ ID NO: 646899 - DNA, 25 bp, Rattus norvegicus
gcgccaaagcctgcgaggctcacaa

SEQ ID NO: 646900 - DNA, 25 bp, Rattus norvegicus
aatagccagccctgcctgagctgcc

SEQ ID NO: 646901 - DNA, 25 bp, Rattus norvegicus
cgcaatcctcctgccagtcgtaaag

SEQ ID NO: 646902 - DNA, 25 bp, Rattus norvegicus
agcgtgggcacgctgggtcctttcc

SEQ ID NO: 646903 - DNA, 25 bp, Rattus norvegicus
catctggaggacgtttgggagctac

SEQ ID NO: 646904 - DNA, 25 bp, Rattus norvegicus
gtttgggagctaccgtcatcgaccc

SEQ ID NO: 646905 - DNA, 25 bp, Rattus norvegicus
tcatcgacccggacgcccttgggga

SEQ ID NO: 646906 - DNA, 25 bp, Rattus norvegicus
gcccttggggatgtttgagccctgt

SEQ ID NO: 646907 - DNA, 25 bp, Rattus norvegicus
atgtttgagccctgtatcgccggga

SEQ ID NO: 646908 - DNA, 25 bp, Rattus norvegicus
agctggacccattcctgacccttga

SEQ ID NO: 646909 - DNA, 25 bp, Rattus norvegicus
ctgctctagcgtctgcaagtccggg

SEQ ID NO: 646910 - DNA, 25 bp, Rattus norvegicus
atcgctcgctgctggaaccgcaatc

SEQ ID NO: 646911 - DNA, 25 bp, Rattus norvegicus
cctgccagtcgtaaagtgctgtaaa

SEQ ID NO: 646912 - DNA, 25 bp, Rattus norvegicus
gctgtaaagggctctgcgctttacg

SEQ ID NO: 646913 - DNA, 25 bp, Rattus norvegicus
ggctctgcgctttacggcgccgtaa

SEQ ID NO: 646914 - DNA, 25 bp, Rattus norvegicus
ggacgcgatcgctcgctgctggaac

SEQ ID NO: 646915 - DNA, 25 bp, Rattus norvegicus
ggggtcctatcacctgaactcacga

SEQ ID NO: 646916 - DNA, 25 bp, Rattus norvegicus
ctgtccctctagaagtgactcggta

SEQ ID NO: 646917 - DNA, 25 bp, Rattus norvegicus
cggcagtgacagcagagacgattca

SEQ ID NO: 646918 - DNA, 25 bp, Rattus norvegicus
agacgattcagacgcggatcccaaa

SEQ ID NO: 646919 - DNA, 25 bp, Rattus norvegicus
atcccaaagcgcttgacggccgcgg

SEQ ID NO: 646920 - DNA, 25 bp, Rattus norvegicus
cacacacccgggaattcgaggactt

SEQ ID NO: 646921 - DNA, 25 bp, Rattus norvegicus
tggggatctatcactagctaagctg

SEQ ID NO: 646922 - DNA, 25 bp, Rattus norvegicus
tcacgaatgatatccctgctggctc

SEQ ID NO: 646923 - DNA, 25 bp, Rattus norvegicus
ctctgcagacgtgactgagtggttc

SEQ ID NO: 646924 - DNA, 25 bp, Rattus norvegicus
ccgctgtgccttaggcagcatcatt

SEQ ID NO: 646925 - DNA, 25 bp, Rattus norvegicus
gcatcattgaaaaacccaggcggcc

SEQ ID NO: 646926 - DNA, 25 bp, Rattus norvegicus
ggatggcttcacgaggtcaacgcta

SEQ ID NO: 646927 - DNA, 25 bp, Rattus norvegicus
acgctacccgcggaaaccgtgatgc

SEQ ID NO: 646928 - DNA, 25 bp, Rattus norvegicus
tcaacgctaagggagcccacgctac

SEQ ID NO: 646929 - DNA, 25 bp, Rattus norvegicus
cctggtgatgagcaagtagcggttc

SEQ ID NO: 646930 - DNA, 25 bp, Rattus norvegicus
gcccaaggcgggagcaacaacacca

SEQ ID NO: 646931 - DNA, 25 bp, Rattus norvegicus
cacgattcttcttcctcgcagagca

SEQ ID NO: 646932 - DNA, 25 bp, Rattus norvegicus
tacaggagagacaccgggatccgcc

SEQ ID NO: 646933 - DNA, 25 bp, Rattus norvegicus
tgaccataccgttggccagcgtgcc

SEQ ID NO: 646934 - DNA, 25 bp, Rattus norvegicus
ctgcagctttcggaaggacgacaca

SEQ ID NO: 646935 - DNA, 25 bp, Rattus norvegicus
gcgccgctggtacagcacctggtag

SEQ ID NO: 646936 - DNA, 25 bp, Rattus norvegicus
ccgcggcgcagccattcacaatgaa

SEQ ID NO: 646937 - DNA, 25 bp, Rattus norvegicus
ttcagagccacgaggcaatgggaca

SEQ ID NO: 646938 - DNA, 25 bp, Rattus norvegicus
gcggaactcctcgttcctccaagta

SEQ ID NO: 646939 - DNA, 25 bp, Rattus norvegicus
gagcagtctgtagctgcctccgcca

SEQ ID NO: 646940 - DNA, 25 bp, Rattus norvegicus
tcctccaagtatagagcagcgggtt

SEQ ID NO: 646941 - DNA, 25 bp, Rattus norvegicus
cacgatgcccaggtagcagtgcagc

SEQ ID NO: 646942 - DNA, 25 bp, Rattus norvegicus
aagttgagcacgctgacccgcttga

SEQ ID NO: 646943 - DNA, 25 bp, Rattus norvegicus
ctctgagtagcggagtcaaggacta

SEQ ID NO: 646944 - DNA, 25 bp, Rattus norvegicus
gacctggtaagagctctgggctata

SEQ ID NO: 646945 - DNA, 25 bp, Rattus norvegicus
tcaacagcaaccacgcctctgagta

SEQ ID NO: 646946 - DNA, 25 bp, Rattus norvegicus
cggagctgagatgctcaacagcaac

SEQ ID NO: 646947 - DNA, 25 bp, Rattus norvegicus
cagctccagtctcttgcacggcgga

SEQ ID NO: 646948 - DNA, 25 bp, Rattus norvegicus
ctcagcggcttagaaaggggatgca

SEQ ID NO: 646949 - DNA, 25 bp, Rattus norvegicus
ccgtgggcctgacatgatgaagaag

SEQ ID NO: 646950 - DNA, 25 bp, Rattus norvegicus
tccggtcccggtactgtcagccgat

SEQ ID NO: 646951 - DNA, 25 bp, Rattus norvegicus
cgtatagcatcgcacaaaccttggg

SEQ ID NO: 646952 - DNA, 25 bp, Rattus norvegicus
gtcgaggccaccgtccagacgtata

SEQ ID NO: 646953 - DNA, 25 bp, Rattus norvegicus
aagcagccgcaacagcaagtcgagg

SEQ ID NO: 646954 - DNA, 25 bp, Rattus norvegicus
tctctagctccggtgcctgaagcag

SEQ ID NO: 646955 - DNA, 25 bp, Rattus norvegicus
cggttctcagccaccaggatctgct

SEQ ID NO: 646956 - DNA, 25 bp, Rattus norvegicus
gcccggaacaaagcgcagctccagt

SEQ ID NO: 646957 - DNA, 25 bp, Rattus norvegicus
ccagctctcaaagccgggcaaagtc

SEQ ID NO: 646958 - DNA, 25 bp, Rattus norvegicus
cgaggatgcgaaaaagaagccggaa

SEQ ID NO: 646959 - DNA, 25 bp, Rattus norvegicus
ccgagacgcagtactgaaggacaca

SEQ ID NO: 646960 - DNA, 25 bp, Rattus norvegicus
gcggctgctcctcacctttcatgaa

SEQ ID NO: 646961 - DNA, 25 bp, Rattus norvegicus
tgactccgctgccatcttaagcgag

SEQ ID NO: 646962 - DNA, 25 bp, Rattus norvegicus
tcttaagcgagatccgcaccgggga

SEQ ID NO: 646963 - DNA, 25 bp, Rattus norvegicus
ggagctcgcggtcccaatcaccgag

SEQ ID NO: 646964 - DNA, 25 bp, Rattus norvegicus
atcaccgagcctgcctgagggaggc

SEQ ID NO: 646965 - DNA, 25 bp, Rattus norvegicus
tgtaaccgctgtgatccggactctg

SEQ ID NO: 646966 - DNA, 25 bp, Rattus norvegicus
gctgctcgagctgcagctccttctg

SEQ ID NO: 646967 - DNA, 25 bp, Rattus norvegicus
gtctccgccaaacctggatagcgca

SEQ ID NO: 646968 - DNA, 25 bp, Rattus norvegicus
ggatagcgcacaccagctctcaaag

SEQ ID NO: 646969 - DNA, 25 bp, Rattus norvegicus
cccggctcccaaagtgatcatggag

SEQ ID NO: 646970 - DNA, 25 bp, Rattus norvegicus
tcatggaggacaagacgtttggccc

SEQ ID NO: 646971 - DNA, 25 bp, Rattus norvegicus
ccctgcagagcaccggggtgaagaa

SEQ ID NO: 646972 - DNA, 25 bp, Rattus norvegicus
gcccagcgctcaaggaggctgcgca

SEQ ID NO: 646973 - DNA, 25 bp, Rattus norvegicus
gaacgaattcctatgtggacgggcc

SEQ ID NO: 646974 - DNA, 25 bp, Rattus norvegicus
ctgtagctgtgggaacgaattccta

SEQ ID NO: 646975 - DNA, 25 bp, Rattus norvegicus
ctcccgggaaactgtagctgtggga

SEQ ID NO: 646976 - DNA, 25 bp, Rattus norvegicus
agtactagagcctcccgggaaactg

SEQ ID NO: 646977 - DNA, 25 bp, Rattus norvegicus
ttcgccggaaggagaaagtactaga

SEQ ID NO: 646978 - DNA, 25 bp, Rattus norvegicus
ggaaaaagaccaggcgccggcaagc

SEQ ID NO: 646979 - DNA, 25 bp, Rattus norvegicus
tgctgcaacgggaaaaagaccaggc

SEQ ID NO: 646980 - DNA, 25 bp, Rattus norvegicus
tgagcctggcctgcagtagccacgc

SEQ ID NO: 646981 - DNA, 25 bp, Rattus norvegicus
gaaacaagagaggttaaatagaggc

SEQ ID NO: 646982 - DNA, 25 bp, Rattus norvegicus
tgcccggatcttctgcacgcgcaag

SEQ ID NO: 646983 - DNA, 25 bp, Rattus norvegicus
cacaacccaggctccgatctcggta

SEQ ID NO: 646984 - DNA, 25 bp, Rattus norvegicus
cattgccggcgcgtctgagcctggc

SEQ ID NO: 646985 - DNA, 25 bp, Rattus norvegicus
cgccggagctgagcgccaaactcaa

SEQ ID NO: 646986 - DNA, 25 bp, Rattus norvegicus
cacgggtctgtgtcggaccatcata

SEQ ID NO: 646987 - DNA, 25 bp, Rattus norvegicus
cagcggtccgacatgagtcaagttc

SEQ ID NO: 646988 - DNA, 25 bp, Rattus norvegicus
tcttttaagctggtaccgcgggcca

SEQ ID NO: 646989 - DNA, 25 bp, Rattus norvegicus
tccctcaaccggaagaaagtgatgg

SEQ ID NO: 646990 - DNA, 25 bp, Rattus norvegicus
ggtgggaccacggaaattacgcatc

SEQ ID NO: 646991 - DNA, 25 bp, Rattus norvegicus
tcccttaacaaacgtggccgcctga

SEQ ID NO: 646992 - DNA, 25 bp, Rattus norvegicus
aagttgtcaattccctctggtcccg

SEQ ID NO: 646993 - DNA, 25 bp, Rattus norvegicus
tggcctggctcaacccaaagttgtc

SEQ ID NO: 646994 - DNA, 25 bp, Rattus norvegicus
gcctccatcacgctgggtccttttg

SEQ ID NO: 646995 - DNA, 25 bp, Rattus norvegicus
tctaccgtcagttggaaaaccgatc

SEQ ID NO: 646996 - DNA, 25 bp, Rattus norvegicus
gaagcgcttcttcttttccacaaag

SEQ ID NO: 646997 - DNA, 25 bp, Rattus norvegicus
gccgatccagcgtgttcaccacaga

SEQ ID NO: 646998 - DNA, 25 bp, Rattus norvegicus
tactgggctttttcactcacgggtc

SEQ ID NO: 646999 - DNA, 25 bp, Rattus norvegicus
tgtcgagctcggagccgtcagttta

SEQ ID NO: 647000 - DNA, 25 bp, Rattus norvegicus
ccagcaggccatggcgcagtcgctg

SEQ ID NO: 647001 - DNA, 25 bp, Rattus norvegicus
cgcaaggcgctcgagcacacagtct

SEQ ID NO: 647002 - DNA, 25 bp, Rattus norvegicus
tgcagctctccggacagcagcgacg

SEQ ID NO: 647003 - DNA, 25 bp, Rattus norvegicus
gtttgtccaacagcctggcgggctc

SEQ ID NO: 647004 - DNA, 25 bp, Rattus norvegicus
caactccatgggtttgtccaacagc

SEQ ID NO: 647005 - DNA, 25 bp, Rattus norvegicus
atgagcttcacctaatgccgccgcg

SEQ ID NO: 647006 - DNA, 25 bp, Rattus norvegicus
agtcgctgtcccagtgcagcctggc

SEQ ID NO: 647007 - DNA, 25 bp, Rattus norvegicus
ggcgacagcctgtgctctttccacg

SEQ ID NO: 647008 - DNA, 25 bp, Rattus norvegicus
agcgcaagaagaccaccaacgtgtt

SEQ ID NO: 647009 - DNA, 25 bp, Rattus norvegicus
aatcgccgcgccaagtggaagaagc

SEQ ID NO: 647010 - DNA, 25 bp, Rattus norvegicus
ctcgctaacctcgtggggtcttgtc

SEQ ID NO: 647011 - DNA, 25 bp, Rattus norvegicus
agccgtcagtttagcctggggctga

SEQ ID NO: 647012 - DNA, 25 bp, Rattus norvegicus
gagcacacagtctccatgagcttca

SEQ ID NO: 647013 - DNA, 25 bp, Rattus norvegicus
ccctgggtcattttaccatcctcga

SEQ ID NO: 647014 - DNA, 25 bp, Rattus norvegicus
agtgcggtcccgcactactgccggg

SEQ ID NO: 647015 - DNA, 25 bp, Rattus norvegicus
cgcgtcacatcgtgcgatccgctga

SEQ ID NO: 647016 - DNA, 25 bp, Rattus norvegicus
tggccagcatgatactgcggttcgc

SEQ ID NO: 647017 - DNA, 25 bp, Rattus norvegicus
cttaatgatgatctttttggccagc

SEQ ID NO: 647018 - DNA, 25 bp, Rattus norvegicus
accgtgcctccgtccttaatgatga

SEQ ID NO: 647019 - DNA, 25 bp, Rattus norvegicus
tgcgagcggcctccaaaggagccag

SEQ ID NO: 647020 - DNA, 25 bp, Rattus norvegicus
aaggaacacacgtaccctggcccag

SEQ ID NO: 647021 - DNA, 25 bp, Rattus norvegicus
tggcgatcgcgaaggaacacacgta

SEQ ID NO: 647022 - DNA, 25 bp, Rattus norvegicus
cggaggagctaagagccgctgcacc

SEQ ID NO: 647023 - DNA, 25 bp, Rattus norvegicus
cctagactaggtagcggaggagcta

SEQ ID NO: 647024 - DNA, 25 bp, Rattus norvegicus
ggaggcgagcccatccctagactag

SEQ ID NO: 647025 - DNA, 25 bp, Rattus norvegicus
ccaactccgcattagcggaggactg

SEQ ID NO: 647026 - DNA, 25 bp, Rattus norvegicus
ccacagcatacggagcgcaaggctg

SEQ ID NO: 647027 - DNA, 25 bp, Rattus norvegicus
cccaatggggctgttcctcgcgcag

SEQ ID NO: 647028 - DNA, 25 bp, Rattus norvegicus
ggcgtctcgccagcgcctggtcagt

SEQ ID NO: 647029 - DNA, 25 bp, Rattus norvegicus
tggtcagtgccctccgctcacccgc

SEQ ID NO: 647030 - DNA, 25 bp, Rattus norvegicus
tgcggctcggccagctgcccgcact

SEQ ID NO: 647031 - DNA, 25 bp, Rattus norvegicus
actggagctccaggctccgcgacgc

SEQ ID NO: 647032 - DNA, 25 bp, Rattus norvegicus
ccaggctgctgagcccgccggctcc

SEQ ID NO: 647033 - DNA, 25 bp, Rattus norvegicus
ctctctgaggcccaggcgtttccgg

SEQ ID NO: 647034 - DNA, 25 bp, Rattus norvegicus
gtccgccaaaggatccggcttccgc

SEQ ID NO: 647035 - DNA, 25 bp, Rattus norvegicus
gcaaacgccgttccctgttcggctc

SEQ ID NO: 647036 - DNA, 25 bp, Rattus norvegicus
gcagctcccgtgacggtctcacggt

SEQ ID NO: 647037 - DNA, 25 bp, Rattus norvegicus
ttgccggccgcgtctctgaggcgac

SEQ ID NO: 647038 - DNA, 25 bp, Rattus norvegicus
atggggctgttcctcgcgcagctcc

SEQ ID NO: 647039 - DNA, 25 bp, Rattus norvegicus
gtggcccaggcaccttgtacctcaa

SEQ ID NO: 647040 - DNA, 25 bp, Rattus norvegicus
ccagcttcacgcttgccggccgcgt

SEQ ID NO: 647041 - DNA, 25 bp, Rattus norvegicus
cccaaattcgggtctgaagccacca

SEQ ID NO: 647042 - DNA, 25 bp, Rattus norvegicus
aaggacttgcgagctccgctgggcc

SEQ ID NO: 647043 - DNA, 25 bp, Rattus norvegicus
cccgcggccgaaggacttgcgagct

SEQ ID NO: 647044 - DNA, 25 bp, Rattus norvegicus
ggacccaggccaagagacagtgaca

SEQ ID NO: 647045 - DNA, 25 bp, Rattus norvegicus
cttacaagcgggatagacgtgcggc

SEQ ID NO: 647046 - DNA, 25 bp, Rattus norvegicus
gcattccagacacttacaagcggga

SEQ ID NO: 647047 - DNA, 25 bp, Rattus norvegicus
tccagagccggacgcattccagaca

SEQ ID NO: 647048 - DNA, 25 bp, Rattus norvegicus
gaaagaatgcgcgtccagagccgga

SEQ ID NO: 647049 - DNA, 25 bp, Rattus norvegicus
gctatagatagaaagaatgcgcgtc

SEQ ID NO: 647050 - DNA, 25 bp, Rattus norvegicus
gcgatgtacagagctgctatagata

SEQ ID NO: 647051 - DNA, 25 bp, Rattus norvegicus
cggcttgcgatgtacagagctgcta

SEQ ID NO: 647052 - DNA, 25 bp, Rattus norvegicus
ttcgagagggaagcagttgctgccc

SEQ ID NO: 647053 - DNA, 25 bp, Rattus norvegicus
ccaccaatagggaggtgattcgaga

SEQ ID NO: 647054 - DNA, 25 bp, Rattus norvegicus
tcccgctagcgcagacagctagtct

SEQ ID NO: 647055 - DNA, 25 bp, Rattus norvegicus
tgatcccgcaggtcttcttcagccg

SEQ ID NO: 647056 - DNA, 25 bp, Rattus norvegicus
tcctcccgtgggtgaggtgtgcact

SEQ ID NO: 647057 - DNA, 25 bp, Rattus norvegicus
gcaggtcttcttcagccgggtttta

SEQ ID NO: 647058 - DNA, 25 bp, Rattus norvegicus
cttctttgcagtaacccggcgcttc

SEQ ID NO: 647059 - DNA, 25 bp, Rattus norvegicus
caagcgcccggtgccgctgatgtca

SEQ ID NO: 647060 - DNA, 25 bp, Rattus norvegicus
tccttgatcactttgccctttggcc

SEQ ID NO: 647061 - DNA, 25 bp, Rattus norvegicus
gacgctgtccttgatcactttgccc

SEQ ID NO: 647062 - DNA, 25 bp, Rattus norvegicus
ggagggtgacgctgtccttgatcac

SEQ ID NO: 647063 - DNA, 25 bp, Rattus norvegicus
cctcaacgaaatagaaacagggcag

SEQ ID NO: 647064 - DNA, 25 bp, Rattus norvegicus
tgggccaactcacctcaacgaaata

SEQ ID NO: 647065 - DNA, 25 bp, Rattus norvegicus
agatctgcattacgccagggcgctg

SEQ ID NO: 647066 - DNA, 25 bp, Rattus norvegicus
agctgtccggaaagatctgcattac

SEQ ID NO: 647067 - DNA, 25 bp, Rattus norvegicus
gaattcgctccggagctgtccggaa

SEQ ID NO: 647068 - DNA, 25 bp, Rattus norvegicus
gctgatgtcacattccccgcgggca

SEQ ID NO: 647069 - DNA, 25 bp, Rattus norvegicus
gcgtcccggtgctcgtggtaagccc

SEQ ID NO: 647070 - DNA, 25 bp, Rattus norvegicus
ggacgaggtgccaccgacgccgctt

SEQ ID NO: 647071 - DNA, 25 bp, Rattus norvegicus
tacccgggcccagaggatagcagcg

SEQ ID NO: 647072 - DNA, 25 bp, Rattus norvegicus
gattcttctgccacgacagcgccta

SEQ ID NO: 647073 - DNA, 25 bp, Rattus norvegicus
tgaacgtgcagggattcttctgcca

SEQ ID NO: 647074 - DNA, 25 bp, Rattus norvegicus
gaatacaccgacacgttcactgtga

SEQ ID NO: 647075 - DNA, 25 bp, Rattus norvegicus
gctggcttactacttcgaatacacc

SEQ ID NO: 647076 - DNA, 25 bp, Rattus norvegicus
ggacggtgatgctggcttactactt

SEQ ID NO: 647077 - DNA, 25 bp, Rattus norvegicus
tccagatggtgatcatggcagggac

SEQ ID NO: 647078 - DNA, 25 bp, Rattus norvegicus
agcatgctttatttccagatggtga

SEQ ID NO: 647079 - DNA, 25 bp, Rattus norvegicus
cgctcatcagcagcatgctttattt

SEQ ID NO: 647080 - DNA, 25 bp, Rattus norvegicus
ctgcctgggcggctgtcagcctctg

SEQ ID NO: 647081 - DNA, 25 bp, Rattus norvegicus
ggatagtcgcctcctctgcatcctg

SEQ ID NO: 647082 - DNA, 25 bp, Rattus norvegicus
actcgtccggggatagtcgcctcct

SEQ ID NO: 647083 - DNA, 25 bp, Rattus norvegicus
gagcccgacgccaggcgctcgccgt

SEQ ID NO: 647084 - DNA, 25 bp, Rattus norvegicus
cgctcgccgtccatcccggcagtgc

SEQ ID NO: 647085 - DNA, 25 bp, Rattus norvegicus
accttactgaacacctccaggtcgt

SEQ ID NO: 647086 - DNA, 25 bp, Rattus norvegicus
ttactgaacacctccaggtcgtcct

SEQ ID NO: 647087 - DNA, 25 bp, Rattus norvegicus
aacacctccaggtcgtcctcttcct

SEQ ID NO: 647088 - DNA, 25 bp, Rattus norvegicus
ttcctcgtctagatccagcacatcg

SEQ ID NO: 647089 - DNA, 25 bp, Rattus norvegicus
cgtctagatccagcacatcggcctg

SEQ ID NO: 647090 - DNA, 25 bp, Rattus norvegicus
agatccagcacatcggcctgcagta

SEQ ID NO: 647091 - DNA, 25 bp, Rattus norvegicus
gcacatcggcctgcagtaggctgca

SEQ ID NO: 647092 - DNA, 25 bp, Rattus norvegicus
cctgcagtaggctgcaggagccgct

SEQ ID NO: 647093 - DNA, 25 bp, Rattus norvegicus
gtaggctgcaggagccgctgccact

SEQ ID NO: 647094 - DNA, 25 bp, Rattus norvegicus
gctgccactcgggatcggggcgccg

SEQ ID NO: 647095 - DNA, 25 bp, Rattus norvegicus
cccgaccgccagctcggaggagccc

SEQ ID NO: 647096 - DNA, 25 bp, Rattus norvegicus
gtccatcccggcagtgcgcgcccag

SEQ ID NO: 647097 - DNA, 25 bp, Rattus norvegicus
cggggcagctgctcccgttccagtt

SEQ ID NO: 647098 - DNA, 25 bp, Rattus norvegicus
tcaggtgatcccaaactcggacttc

SEQ ID NO: 647099 - DNA, 25 bp, Rattus norvegicus
atcagacggaaggaaaccaggcgcc

SEQ ID NO: 647100 - DNA, 25 bp, Rattus norvegicus
ggcgttatcactgcccgcgtgtttc

SEQ ID NO: 647101 - DNA, 25 bp, Rattus norvegicus
ctgtgtggcccgacgggccctagca

SEQ ID NO: 647102 - DNA, 25 bp, Rattus norvegicus
ccaccagcgccggatgtagctggag

SEQ ID NO: 647103 - DNA, 25 bp, Rattus norvegicus
cagccgctggtggtctccggtcact

SEQ ID NO: 647104 - DNA, 25 bp, Rattus norvegicus
tggctcacgctctgatcaggtgatc

SEQ ID NO: 647105 - DNA, 25 bp, Rattus norvegicus
gacgccatttctggctcacgctctg

SEQ ID NO: 647106 - DNA, 25 bp, Rattus norvegicus
ccagcaagcaaggaggacgccattt

SEQ ID NO: 647107 - DNA, 25 bp, Rattus norvegicus
gaacgagtcgttcgccagcaagcaa

SEQ ID NO: 647108 - DNA, 25 bp, Rattus norvegicus
ccaggatccaaagcgcgaacgagtc

SEQ ID NO: 647109 - DNA, 25 bp, Rattus norvegicus
cagcctcgagctgggcacgcagctt

SEQ ID NO: 647110 - DNA, 25 bp, Rattus norvegicus
tcgggccctgtgtcagcagccgagc

SEQ ID NO: 647111 - DNA, 25 bp, Rattus norvegicus
tgaggccagaaagcgttgccatggc

SEQ ID NO: 647112 - DNA, 25 bp, Rattus norvegicus
agactgaggccagaaagcgttgcca

SEQ ID NO: 647113 - DNA, 25 bp, Rattus norvegicus
tgaggcgtgccaagagcgttgtccc

SEQ ID NO: 647114 - DNA, 25 bp, Rattus norvegicus
ctgccatactgccttagctcgggca

SEQ ID NO: 647115 - DNA, 25 bp, Rattus norvegicus
ttagctcgggcagtcagtgcaccag

SEQ ID NO: 647116 - DNA, 25 bp, Rattus norvegicus
agtcagtgcaccagcgctagggcaa

SEQ ID NO: 647117 - DNA, 25 bp, Rattus norvegicus
cgctagggcaagctgaggcttccgt

SEQ ID NO: 647118 - DNA, 25 bp, Rattus norvegicus
tgccaagagcgttgtcccgccctgg

SEQ ID NO: 647119 - DNA, 25 bp, Rattus norvegicus
aaagctggagatccgctaagttttc

SEQ ID NO: 647120 - DNA, 25 bp, Rattus norvegicus
ccgggacaaagctggagatccgcta

SEQ ID NO: 647121 - DNA, 25 bp, Rattus norvegicus
agacgcccgggacaaagctggagat

SEQ ID NO: 647122 - DNA, 25 bp, Rattus norvegicus
catcgaggtaccgacagtggctccg

SEQ ID NO: 647123 - DNA, 25 bp, Rattus norvegicus
cgcgcctgacatcgaggtaccgaca

SEQ ID NO: 647124 - DNA, 25 bp, Rattus norvegicus
tgctgagcagggacgcgcctgacat

SEQ ID NO: 647125 - DNA, 25 bp, Rattus norvegicus
atccctaccatctggtgcttccttg

SEQ ID NO: 647126 - DNA, 25 bp, Rattus norvegicus
cttccttgaaggcatagacctttta

SEQ ID NO: 647127 - DNA, 25 bp, Rattus norvegicus
atagaccttttaatgtcgtggtgca

SEQ ID NO: 647128 - DNA, 25 bp, Rattus norvegicus
tgtcgtggtgcattatagatactta

SEQ ID NO: 647129 - DNA, 25 bp, Rattus norvegicus
atagatacttagttgcaagcctttc

SEQ ID NO: 647130 - DNA, 25 bp, Rattus norvegicus
tgcaagcctttctgccttgttaggc

SEQ ID NO: 647131 - DNA, 25 bp, Rattus norvegicus
gccttgttaggccatagtccgtctg

SEQ ID NO: 647132 - DNA, 25 bp, Rattus norvegicus
tccattgccgaaccggacaaagctt

SEQ ID NO: 647133 - DNA, 25 bp, Rattus norvegicus
gacaaagcttcgctcccaagaaccg

SEQ ID NO: 647134 - DNA, 25 bp, Rattus norvegicus
aagaaccgagccacgcagccagcga

SEQ ID NO: 647135 - DNA, 25 bp, Rattus norvegicus
ccagcgagccacacaagcggcgaga

SEQ ID NO: 647136 - DNA, 25 bp, Rattus norvegicus
gccagggcccgacggaaattgccga

SEQ ID NO: 647137 - DNA, 25 bp, Rattus norvegicus
aaattgccgaaggtgccggagcgca

SEQ ID NO: 647138 - DNA, 25 bp, Rattus norvegicus
atagtccgtctgttcctcacgccga

SEQ ID NO: 647139 - DNA, 25 bp, Rattus norvegicus
tgaccagaatccgaagccgcttccg

SEQ ID NO: 647140 - DNA, 25 bp, Rattus norvegicus
ggcccgcagaagatcgcggccagcg

SEQ ID NO: 647141 - DNA, 25 bp, Rattus norvegicus
gcgtggcgaatgtctgaaagctccg

SEQ ID NO: 647142 - DNA, 25 bp, Rattus norvegicus
agcgccgagagttcctgcctcatct

SEQ ID NO: 647143 - DNA, 25 bp, Rattus norvegicus
gaacctcacagcccggcaggctggg

SEQ ID NO: 647144 - DNA, 25 bp, Rattus norvegicus
cgtgaccagaatccgaagccgcttc

SEQ ID NO: 647145 - DNA, 25 bp, Rattus norvegicus
cgcgtgaccagaatccgaagccgct

SEQ ID NO: 647146 - DNA, 25 bp, Rattus norvegicus
tccgcgtgaccagaatccgaagccg

SEQ ID NO: 647147 - DNA, 25 bp, Rattus norvegicus
ttccgcgtgaccagaatccgaagcc

SEQ ID NO: 647148 - DNA, 25 bp, Rattus norvegicus
tttccgcgtgaccagaatccgaagc

SEQ ID NO: 647149 - DNA, 25 bp, Rattus norvegicus
catttccgcgtgaccagaatccgaa

SEQ ID NO: 647150 - DNA, 25 bp, Rattus norvegicus
gccatttccgcgtgaccagaatccg

SEQ ID NO: 647151 - DNA, 25 bp, Rattus norvegicus
cgccgagagttcctgcctcatctcc

SEQ ID NO: 647152 - DNA, 25 bp, Rattus norvegicus
gggcgtgtctatgggcgtggcgaat

SEQ ID NO: 647153 - DNA, 25 bp, Rattus norvegicus
tggaaccctgagagctcacacctcg

SEQ ID NO: 647154 - DNA, 25 bp, Rattus norvegicus
gtccaaacggcgtcacctgtgcccg

SEQ ID NO: 647155 - DNA, 25 bp, Rattus norvegicus
gcggggctcacaggcgcctgatcat

SEQ ID NO: 647156 - DNA, 25 bp, Rattus norvegicus
gcctgatcatccagccggcccgagg

SEQ ID NO: 647157 - DNA, 25 bp, Rattus norvegicus
cctgaaggagctgtcgccgaggctc

SEQ ID NO: 647158 - DNA, 25 bp, Rattus norvegicus
ggttaccgcagagcggctccttaaa

SEQ ID NO: 647159 - DNA, 25 bp, Rattus norvegicus
gagagctcacacctcggcccgggtg

SEQ ID NO: 647160 - DNA, 25 bp, Rattus norvegicus
cagtgtgcggttcgcgggctttccc

SEQ ID NO: 647161 - DNA, 25 bp, Rattus norvegicus
gcgggctttcccagcaagtcacaga

SEQ ID NO: 647162 - DNA, 25 bp, Rattus norvegicus
agcaagtcacagacctcacgagtgg

SEQ ID NO: 647163 - DNA, 25 bp, Rattus norvegicus
cagacctcacgagtggggagaagta

SEQ ID NO: 647164 - DNA, 25 bp, Rattus norvegicus
gagaagtatgtgagtccgcccccgc

SEQ ID NO: 647165 - DNA, 25 bp, Rattus norvegicus
actgcgatggaaccctgagagctca

SEQ ID NO: 647166 - DNA, 25 bp, Rattus norvegicus
cacctcccggcgctggaacttgggt

SEQ ID NO: 647167 - DNA, 25 bp, Rattus norvegicus
cagggtcgagcgctgacacgactct

SEQ ID NO: 647168 - DNA, 25 bp, Rattus norvegicus
cctcaaggcgcggtagaaattgctg

SEQ ID NO: 647169 - DNA, 25 bp, Rattus norvegicus
gttcagccacgtgctgcccggattt

SEQ ID NO: 647170 - DNA, 25 bp, Rattus norvegicus
tgacagctgacctcggagttagttc

SEQ ID NO: 647171 - DNA, 25 bp, Rattus norvegicus
gtccatgcttccaggtgacagctga

SEQ ID NO: 647172 - DNA, 25 bp, Rattus norvegicus
ggttttctcttaggagtccatgctt

SEQ ID NO: 647173 - DNA, 25 bp, Rattus norvegicus
ggcctgctctggttttctcttagga

SEQ ID NO: 647174 - DNA, 25 bp, Rattus norvegicus
gcgagctttccacgcgagctgagta

SEQ ID NO: 647175 - DNA, 25 bp, Rattus norvegicus
cacggcgtatcgctaggccgcgact

SEQ ID NO: 647176 - DNA, 25 bp, Rattus norvegicus
tgacagccgccacggcgtatcgcta

SEQ ID NO: 647177 - DNA, 25 bp, Rattus norvegicus
ccgcggttagaaagcctcagccttg

SEQ ID NO: 647178 - DNA, 25 bp, Rattus norvegicus
cacgactctcgggttcgtcgacgga

SEQ ID NO: 647179 - DNA, 25 bp, Rattus norvegicus
agtatcgcgaggctttgggcctagc

SEQ ID NO: 647180 - DNA, 25 bp, Rattus norvegicus
aaattgctgtttcttccggaccagg

SEQ ID NO: 647181 - DNA, 25 bp, Rattus norvegicus
agcggtcttgctaatagtgcgacta

SEQ ID NO: 647182 - DNA, 25 bp, Rattus norvegicus
ctttgaatggtgtgcgttctgactc

SEQ ID NO: 647183 - DNA, 25 bp, Rattus norvegicus
tacgcatgcgccgtcctttgaatgg

SEQ ID NO: 647184 - DNA, 25 bp, Rattus norvegicus
gcaaactttgctggcgccaggcata

SEQ ID NO: 647185 - DNA, 25 bp, Rattus norvegicus
tttagcgtcgtgctagcaaactttg

SEQ ID NO: 647186 - DNA, 25 bp, Rattus norvegicus
acatgcgtcgttctgcgttttccaa

SEQ ID NO: 647187 - DNA, 25 bp, Rattus norvegicus
tgctccacgattgctctttagcgtc

SEQ ID NO: 647188 - DNA, 25 bp, Rattus norvegicus
cccgcagagaggtgctttgctccac

SEQ ID NO: 647189 - DNA, 25 bp, Rattus norvegicus
acgcttctgaactttgaccgcccaa

SEQ ID NO: 647190 - DNA, 25 bp, Rattus norvegicus
cgttttccaatcagagccacgcttc

SEQ ID NO: 647191 - DNA, 25 bp, Rattus norvegicus
ctcttgatagtagctggatccggta

SEQ ID NO: 647192 - DNA, 25 bp, Rattus norvegicus
cgatgggcttgtgttagtcactaca

SEQ ID NO: 647193 - DNA, 25 bp, Rattus norvegicus
ccgacagtctctcggactcttgata

SEQ ID NO: 647194 - DNA, 25 bp, Rattus norvegicus
cggctcactgagacgcaagacatgc

SEQ ID NO: 647195 - DNA, 25 bp, Rattus norvegicus
ttctgcgccgcgcagagtagcgagc

SEQ ID NO: 647196 - DNA, 25 bp, Rattus norvegicus
gagagatagatgcttcccggctcgc

SEQ ID NO: 647197 - DNA, 25 bp, Rattus norvegicus
cgggactcgagtccgagcgaacctc

SEQ ID NO: 647198 - DNA, 25 bp, Rattus norvegicus
tcccacaagcgaagttgggcggtta

SEQ ID NO: 647199 - DNA, 25 bp, Rattus norvegicus
gttcctggacgcctggagtcccgca

SEQ ID NO: 647200 - DNA, 25 bp, Rattus norvegicus
ggcactccattggtccggctcgctg

SEQ ID NO: 647201 - DNA, 25 bp, Rattus norvegicus
ctccgccgaggtcaagaacaaggta

SEQ ID NO: 647202 - DNA, 25 bp, Rattus norvegicus
acagccatgacccacttcaacaagg

SEQ ID NO: 647203 - DNA, 25 bp, Rattus norvegicus
ccttcctgtggtccgaacagccatg

SEQ ID NO: 647204 - DNA, 25 bp, Rattus norvegicus
tagcgagcttgtgcatcacccgcgc

SEQ ID NO: 647205 - DNA, 25 bp, Rattus norvegicus
tcgaagcatcatccgcgtccgtctg

SEQ ID NO: 647206 - DNA, 25 bp, Rattus norvegicus
agctagcagggcagccggtcccact

SEQ ID NO: 647207 - DNA, 25 bp, Rattus norvegicus
ctggccaatccctagaggcccgggt

SEQ ID NO: 647208 - DNA, 25 bp, Rattus norvegicus
gctgggtctcagagagttgccgccc

SEQ ID NO: 647209 - DNA, 25 bp, Rattus norvegicus
atcgctcgtgtagcgtagcctccgc

SEQ ID NO: 647210 - DNA, 25 bp, Rattus norvegicus
aggctgctctggttccttgaggacg

SEQ ID NO: 647211 - DNA, 25 bp, Rattus norvegicus
caccgcccgcgggagacaaagaatg

SEQ ID NO: 647212 - DNA, 25 bp, Rattus norvegicus
gcattgatcctgagaagcccggggt

SEQ ID NO: 647213 - DNA, 25 bp, Rattus norvegicus
tctcggcttccttctccttcaggtg

SEQ ID NO: 647214 - DNA, 25 bp, Rattus norvegicus
agcagcccttggacatggctatccc

SEQ ID NO: 647215 - DNA, 25 bp, Rattus norvegicus
actcgctccgtctgatcgctcgtgt

SEQ ID NO: 647216 - DNA, 25 bp, Rattus norvegicus
gcccaccgcgaaagcgagtgaccgg

SEQ ID NO: 647217 - DNA, 25 bp, Rattus norvegicus
tggtgttgaatcacggttgagtcac

SEQ ID NO: 647218 - DNA, 25 bp, Rattus norvegicus
ccgtacctgtggattcggctgcgct

SEQ ID NO: 647219 - DNA, 25 bp, Rattus norvegicus
tcaatgaactcagggagggaaggta

SEQ ID NO: 647220 - DNA, 25 bp, Rattus norvegicus
gcgctagccttgagcgtttcaatga

SEQ ID NO: 647221 - DNA, 25 bp, Rattus norvegicus
ctgggtctccgcagtacctggatcc

SEQ ID NO: 647222 - DNA, 25 bp, Rattus norvegicus
cttgaggacgccaaggtgtcccgcc

SEQ ID NO: 647223 - DNA, 25 bp, Rattus norvegicus
gccgaactgaccgtccttatccaag

SEQ ID NO: 647224 - DNA, 25 bp, Rattus norvegicus
gccgtgagtgataggcgtccgggtc

SEQ ID NO: 647225 - DNA, 25 bp, Rattus norvegicus
ctcccgccgtgcctcggggctggca

SEQ ID NO: 647226 - DNA, 25 bp, Rattus norvegicus
gccgggtgctctgggcttgaaattc

SEQ ID NO: 647227 - DNA, 25 bp, Rattus norvegicus
ggtgctctgggcttgaaattccctc

SEQ ID NO: 647228 - DNA, 25 bp, Rattus norvegicus
gggcttgaaattccctccaccagtg

SEQ ID NO: 647229 - DNA, 25 bp, Rattus norvegicus
ttgaaattccctccaccagtgagag

SEQ ID NO: 647230 - DNA, 25 bp, Rattus norvegicus
ttccctccaccagtgagagtcagga

SEQ ID NO: 647231 - DNA, 25 bp, Rattus norvegicus
cctccaccagtgagagtcaggaggg

SEQ ID NO: 647232 - DNA, 25 bp, Rattus norvegicus
ggctcgccgaactgaccgtccttat

SEQ ID NO: 647233 - DNA, 25 bp, Rattus norvegicus
accgtccttatccaaggtctcgtca

SEQ ID NO: 647234 - DNA, 25 bp, Rattus norvegicus
ttatccaaggtctcgtcagcgggcg

SEQ ID NO: 647235 - DNA, 25 bp, Rattus norvegicus
aaggtctcgtcagcgggcgttcagc

SEQ ID NO: 647236 - DNA, 25 bp, Rattus norvegicus
tcgggcagcggctcgccgaactgac

SEQ ID NO: 647237 - DNA, 25 bp, Rattus norvegicus
gccgcctgcggaaaaagtgtccgtc

SEQ ID NO: 647238 - DNA, 25 bp, Rattus norvegicus
agtgtccgtccacgcacagcgagga

SEQ ID NO: 647239 - DNA, 25 bp, Rattus norvegicus
ggaacctgctcaactggggccgcct

SEQ ID NO: 647240 - DNA, 25 bp, Rattus norvegicus
ctgcagaccgggaacctgctcaact

SEQ ID NO: 647241 - DNA, 25 bp, Rattus norvegicus
ggcagctgccatgggcaccgacagc

SEQ ID NO: 647242 - DNA, 25 bp, Rattus norvegicus
gtggcctcaaaaaccgcagcgaccg

SEQ ID NO: 647243 - DNA, 25 bp, Rattus norvegicus
ctccctcttttcagcggcggctgga

SEQ ID NO: 647244 - DNA, 25 bp, Rattus norvegicus
gtcttccaggaaacagctccctctt

SEQ ID NO: 647245 - DNA, 25 bp, Rattus norvegicus
cggtttctgcttagtcattgtcttc

SEQ ID NO: 647246 - DNA, 25 bp, Rattus norvegicus
cactttctcgggtgcggtttctgct

SEQ ID NO: 647247 - DNA, 25 bp, Rattus norvegicus
cggttacgaagcactttctcgggtg

SEQ ID NO: 647248 - DNA, 25 bp, Rattus norvegicus
gggcgccgtcagctcttaccaggcg

SEQ ID NO: 647249 - DNA, 25 bp, Rattus norvegicus
ccagaaacgaagagcggcggccatt

SEQ ID NO: 647250 - DNA, 25 bp, Rattus norvegicus
cccggctgtccttagagataccgcg

SEQ ID NO: 647251 - DNA, 25 bp, Rattus norvegicus
agagaagcttctaccgacagtcgtc

SEQ ID NO: 647252 - DNA, 25 bp, Rattus norvegicus
agcgttgctccctcgaaatcaccgg

SEQ ID NO: 647253 - DNA, 25 bp, Rattus norvegicus
tcagctcagcccgagagcgttgctc

SEQ ID NO: 647254 - DNA, 25 bp, Rattus norvegicus
tttagggagcgggtttacactcagc

SEQ ID NO: 647255 - DNA, 25 bp, Rattus norvegicus
cagcgcgcgactggacattgaagta

SEQ ID NO: 647256 - DNA, 25 bp, Rattus norvegicus
tgcatattcgcaggcccgggtttaa

SEQ ID NO: 647257 - DNA, 25 bp, Rattus norvegicus
tttgcccaagactcggcagagccta

SEQ ID NO: 647258 - DNA, 25 bp, Rattus norvegicus
agccgccgattgcagttactgaaga

SEQ ID NO: 647259 - DNA, 25 bp, Rattus norvegicus
tctggacctagtggggagttatttc

SEQ ID NO: 647260 - DNA, 25 bp, Rattus norvegicus
caaccctgcatatcggggaaacaga

SEQ ID NO: 647261 - DNA, 25 bp, Rattus norvegicus
cgccgacttcggagttacagcccaa

SEQ ID NO: 647262 - DNA, 25 bp, Rattus norvegicus
gcctctggcctgtagctagctatct

SEQ ID NO: 647263 - DNA, 25 bp, Rattus norvegicus
agccaagtggcaagcgaactccgtg

SEQ ID NO: 647264 - DNA, 25 bp, Rattus norvegicus
ttataggtccagtatccgtggcagc

SEQ ID NO: 647265 - DNA, 25 bp, Rattus norvegicus
aaaggaacgattcttctgagccgcg

SEQ ID NO: 647266 - DNA, 25 bp, Rattus norvegicus
agctacgctgactgcggggaatacg

SEQ ID NO: 647267 - DNA, 25 bp, Rattus norvegicus
atacggagtcgcaaacatggtggtc

SEQ ID NO: 647268 - DNA, 25 bp, Rattus norvegicus
acatggtggtcactaggtctgggtc

SEQ ID NO: 647269 - DNA, 25 bp, Rattus norvegicus
ttcccaacggaaggtgagatgggtc

SEQ ID NO: 647270 - DNA, 25 bp, Rattus norvegicus
cgtcggaacagaggaagctacgctg

SEQ ID NO: 647271 - DNA, 25 bp, Rattus norvegicus
aggccctggtctgacgtacttccga

SEQ ID NO: 647272 - DNA, 25 bp, Rattus norvegicus
ctgggtccaggatccaagaaagttc

SEQ ID NO: 647273 - DNA, 25 bp, Rattus norvegicus
gagatgtctgtgtagaactgcagca

SEQ ID NO: 647274 - DNA, 25 bp, Rattus norvegicus
tctagccctacggtggagatgtctg

SEQ ID NO: 647275 - DNA, 25 bp, Rattus norvegicus
ctcaaaactagaagcggatcgggtc

SEQ ID NO: 647276 - DNA, 25 bp, Rattus norvegicus
cgcacagcggagacgctcaaaacta

SEQ ID NO: 647277 - DNA, 25 bp, Rattus norvegicus
aggaagacctctaccgctgcggtgc

SEQ ID NO: 647278 - DNA, 25 bp, Rattus norvegicus
tcctcgccagtaggcagagcagctc

SEQ ID NO: 647279 - DNA, 25 bp, Rattus norvegicus
ttccgtcgcacctgcgagcgagcgg

SEQ ID NO: 647280 - DNA, 25 bp, Rattus norvegicus
ccgaagccgagctaagggaactagc

SEQ ID NO: 647281 - DNA, 25 bp, Rattus norvegicus
aacccggttgctatgcaacggctgc

SEQ ID NO: 647282 - DNA, 25 bp, Rattus norvegicus
aggctgcaggcccagaccggccgtt

SEQ ID NO: 647283 - DNA, 25 bp, Rattus norvegicus
gccgcgcctaagatacctccaattg

SEQ ID NO: 647284 - DNA, 25 bp, Rattus norvegicus
gccgacgacgtctgtgtgcgtgctt

SEQ ID NO: 647285 - DNA, 25 bp, Rattus norvegicus
tgcgtgtttatctgcgcggtgcttc

SEQ ID NO: 647286 - DNA, 25 bp, Rattus norvegicus
cccagagccgaatttctgaggtatc

SEQ ID NO: 647287 - DNA, 25 bp, Rattus norvegicus
ccgaggcatcctcccgggagcttat

SEQ ID NO: 647288 - DNA, 25 bp, Rattus norvegicus
agcttatccgctacgccgccgagga

SEQ ID NO: 647289 - DNA, 25 bp, Rattus norvegicus
gcacctctttgctcagaagggcgga

SEQ ID NO: 647290 - DNA, 25 bp, Rattus norvegicus
agtcaccgtgaatccgagctgcggc

SEQ ID NO: 647291 - DNA, 25 bp, Rattus norvegicus
aaggagtgggtcctcagtttcctca

SEQ ID NO: 647292 - DNA, 25 bp, Rattus norvegicus
ctccaattgtaacggcgaggccggc

SEQ ID NO: 647293 - DNA, 25 bp, Rattus norvegicus
cacagtgccctgactgcatcgatca

SEQ ID NO: 647294 - DNA, 25 bp, Rattus norvegicus
gcatcgatcatacagtctaccgcca

SEQ ID NO: 647295 - DNA, 25 bp, Rattus norvegicus
ctccctgactgcatcgatcatacag

SEQ ID NO: 647296 - DNA, 25 bp, Rattus norvegicus
aatcatacagtctaccgccacagtg

SEQ ID NO: 647297 - DNA, 25 bp, Rattus norvegicus
gatcatacagtctaccgccacagtg

SEQ ID NO: 647298 - DNA, 25 bp, Rattus norvegicus
catcgatcatacagtctaccgcaac

SEQ ID NO: 647299 - DNA, 25 bp, Rattus norvegicus
gctccctgactgcatcgatcataca

SEQ ID NO: 647300 - DNA, 25 bp, Rattus norvegicus
tacagtctacgaccacagtgccctg

SEQ ID NO: 647301 - DNA, 25 bp, Rattus norvegicus
cagtgccctgactgcatcgatcata

SEQ ID NO: 647302 - DNA, 25 bp, Rattus norvegicus
gcgccctgactgcatcaatcataca

SEQ ID NO: 647303 - DNA, 25 bp, Rattus norvegicus
atcatacagtctaccgccacagtgc

SEQ ID NO: 647304 - DNA, 25 bp, Rattus norvegicus
gtgccctgactgcatcgatcataca

SEQ ID NO: 647305 - DNA, 25 bp, Rattus norvegicus
gatcatacagtctaccgcaaccgct

SEQ ID NO: 647306 - DNA, 25 bp, Rattus norvegicus
ccgcgccctgactgcatcaatcata

SEQ ID NO: 647307 - DNA, 25 bp, Rattus norvegicus
ctcctgggctccctcggtagtagcg

SEQ ID NO: 647308 - DNA, 25 bp, Rattus norvegicus
gagatccagacgaggtcaccgaatg

SEQ ID NO: 647309 - DNA, 25 bp, Rattus norvegicus
cgaggtcaccgaatgtaaatgtctc

SEQ ID NO: 647310 - DNA, 25 bp, Rattus norvegicus
tgtaaatgtctcaggggttcggctc

SEQ ID NO: 647311 - DNA, 25 bp, Rattus norvegicus
atgtctcaggggttcggctcagccc

SEQ ID NO: 647312 - DNA, 25 bp, Rattus norvegicus
ctcagcccggcgaatcggctgagcg

SEQ ID NO: 647313 - DNA, 25 bp, Rattus norvegicus
tggggccgcgaagccgcaaatcacc

SEQ ID NO: 647314 - DNA, 25 bp, Rattus norvegicus
cgcgaagccgcaaatcaccagttga

SEQ ID NO: 647315 - DNA, 25 bp, Rattus norvegicus
atcaccagttgagggccagagagcg

SEQ ID NO: 647316 - DNA, 25 bp, Rattus norvegicus
gctcagagctgagcctgcggcagcc

SEQ ID NO: 647317 - DNA, 25 bp, Rattus norvegicus
ccgcagaccatgagccgcccgagct

SEQ ID NO: 647318 - DNA, 25 bp, Rattus norvegicus
ggcagcccggcgctgaaccgcaaat

SEQ ID NO: 647319 - DNA, 25 bp, Rattus norvegicus
gcgttccggctcaggctcctgggct

SEQ ID NO: 647320 - DNA, 25 bp, Rattus norvegicus
agtgtgcccggtgcgttccggctca

SEQ ID NO: 647321 - DNA, 25 bp, Rattus norvegicus
agagcgaaggaggacgcccactgcc

SEQ ID NO: 647322 - DNA, 25 bp, Rattus norvegicus
cccagtgagtgagagagacacgact

SEQ ID NO: 647323 - DNA, 25 bp, Rattus norvegicus
ctcgatccctctacctaattcgggt

SEQ ID NO: 647324 - DNA, 25 bp, Rattus norvegicus
tcccactccaagatggagagcgaag

SEQ ID NO: 647325 - DNA, 25 bp, Rattus norvegicus
acgactgaagcgagctgccgccgcg

SEQ ID NO: 647326 - DNA, 25 bp, Rattus norvegicus
aagtgtctgcctcgaaagctgccgc

SEQ ID NO: 647327 - DNA, 25 bp, Rattus norvegicus
gctcatggcggaacctaaggcgact

SEQ ID NO: 647328 - DNA, 25 bp, Rattus norvegicus
tcgcggcacaaagaggcgcggaacc

SEQ ID NO: 647329 - DNA, 25 bp, Rattus norvegicus
agtcgagcgggctctcgcggcacaa

SEQ ID NO: 647330 - DNA, 25 bp, Rattus norvegicus
cccttggagggagtacagagcagcc

SEQ ID NO: 647331 - DNA, 25 bp, Rattus norvegicus
gcgcccgtctgcaaagtcaggcgga

SEQ ID NO: 647332 - DNA, 25 bp, Rattus norvegicus
cccaaagagcctgcaaccggagctg

SEQ ID NO: 647333 - DNA, 25 bp, Rattus norvegicus
acctaattcgggtcacaaatgcaga

SEQ ID NO: 647334 - DNA, 25 bp, Rattus norvegicus
gggctcagggaaagccgcactcaga

SEQ ID NO: 647335 - DNA, 25 bp, Rattus norvegicus
cctgccgtcacagtccctgttcctc

SEQ ID NO: 647336 - DNA, 25 bp, Rattus norvegicus
gtcctgccgtcacagtccctgttcc

SEQ ID NO: 647337 - DNA, 25 bp, Rattus norvegicus
cgtcctgccgtcacagtccctgttc

SEQ ID NO: 647338 - DNA, 25 bp, Rattus norvegicus
gcgtcctgccgtcacagtccctgtt

SEQ ID NO: 647339 - DNA, 25 bp, Rattus norvegicus
agcgtcctgccgtcacagtccctgt

SEQ ID NO: 647340 - DNA, 25 bp, Rattus norvegicus
aagcgtcctgccgtcacagtccctg

SEQ ID NO: 647341 - DNA, 25 bp, Rattus norvegicus
tgccgtcacagtccctgttcctccc

SEQ ID NO: 647342 - DNA, 25 bp, Rattus norvegicus
cccgatgctgcgctggctgatcgga

SEQ ID NO: 647343 - DNA, 25 bp, Rattus norvegicus
cacaggactcagacaagcgctggtc

SEQ ID NO: 647344 - DNA, 25 bp, Rattus norvegicus
gtgagatggcctcagcgcacgccca

SEQ ID NO: 647345 - DNA, 25 bp, Rattus norvegicus
gagctcttgcgccaaccgcgaggca

SEQ ID NO: 647346 - DNA, 25 bp, Rattus norvegicus
aaccgcgaggcacccacgcgcgtgc

SEQ ID NO: 647347 - DNA, 25 bp, Rattus norvegicus
tgctcgctggggacgcggaacctcc

SEQ ID NO: 647348 - DNA, 25 bp, Rattus norvegicus
ggccttctgtgagggctcccgaact

SEQ ID NO: 647349 - DNA, 25 bp, Rattus norvegicus
gctcccgaactagacttctgttttc

SEQ ID NO: 647350 - DNA, 25 bp, Rattus norvegicus
agacttctgttttctcgctgcctcg

SEQ ID NO: 647351 - DNA, 25 bp, Rattus norvegicus
ctgcacaggactcagacaagcgctg

SEQ ID NO: 647352 - DNA, 25 bp, Rattus norvegicus
ccggcccgatgctgcgctggctgat

SEQ ID NO: 647353 - DNA, 25 bp, Rattus norvegicus
ctcagacaagcgctggtcctggggt

SEQ ID NO: 647354 - DNA, 25 bp, Rattus norvegicus
cccagattcactcggccgcagcctc

SEQ ID NO: 647355 - DNA, 25 bp, Rattus norvegicus
cgagcgacctgagctcttgcgccaa

SEQ ID NO: 647356 - DNA, 25 bp, Rattus norvegicus
ctcggtctcagaacggactggagtc

SEQ ID NO: 647357 - DNA, 25 bp, Rattus norvegicus
tttaggatccgactgctgcacgggc

SEQ ID NO: 647358 - DNA, 25 bp, Rattus norvegicus
tctgggctgaactaacaagctctgc

SEQ ID NO: 647359 - DNA, 25 bp, Rattus norvegicus
aggagggagcctgtcctttaggatc

SEQ ID NO: 647360 - DNA, 25 bp, Rattus norvegicus
ccaccaggtaagaagaggagccaca

SEQ ID NO: 647361 - DNA, 25 bp, Rattus norvegicus
ccaggccttttgcttcggaagtaga

SEQ ID NO: 647362 - DNA, 25 bp, Rattus norvegicus
gctggatgatcaccgggactttacc

SEQ ID NO: 647363 - DNA, 25 bp, Rattus norvegicus
ctggagtcctcgacttaaagcgagc

SEQ ID NO: 647364 - DNA, 25 bp, Rattus norvegicus
cggattagaaacgacttgcccacga

SEQ ID NO: 647365 - DNA, 25 bp, Rattus norvegicus
cagcccgggaacaagattaatttca

SEQ ID NO: 647366 - DNA, 25 bp, Rattus norvegicus
agattaatttcacgcgcgctcacgg

SEQ ID NO: 647367 - DNA, 25 bp, Rattus norvegicus
gtttctctcccaaaccggcttagca

SEQ ID NO: 647368 - DNA, 25 bp, Rattus norvegicus
cagttcttcctggtcgcgagccaaa

SEQ ID NO: 647369 - DNA, 25 bp, Rattus norvegicus
tgagctggggctgatctcttttccc

SEQ ID NO: 647370 - DNA, 25 bp, Rattus norvegicus
tcgattgctaagacgagggcgcgca

SEQ ID NO: 647371 - DNA, 25 bp, Rattus norvegicus
ttcagtcggggatgaacgggattcc

SEQ ID NO: 647372 - DNA, 25 bp, Rattus norvegicus
ggagccaagatgagcccgttcagtc

SEQ ID NO: 647373 - DNA, 25 bp, Rattus norvegicus
tcgtccgcagctagaaggaggagcc

SEQ ID NO: 647374 - DNA, 25 bp, Rattus norvegicus
gtttagtctcaggtgcgcggaaagt

SEQ ID NO: 647375 - DNA, 25 bp, Rattus norvegicus
cgcagcggccttcaggtttagtctc

SEQ ID NO: 647376 - DNA, 25 bp, Rattus norvegicus
ggctgtccggaatcgattgctaaga

SEQ ID NO: 647377 - DNA, 25 bp, Rattus norvegicus
acagcgtgcggggagttcctagaaa

SEQ ID NO: 647378 - DNA, 25 bp, Rattus norvegicus
cgcgttcccggcgatgcggaacaca

SEQ ID NO: 647379 - DNA, 25 bp, Rattus norvegicus
tgcgccaagttcagcagccggacca

SEQ ID NO: 647380 - DNA, 25 bp, Rattus norvegicus
cctgtaccacagaagcaaccgacga

SEQ ID NO: 647381 - DNA, 25 bp, Rattus norvegicus
ctacgtgaggcagcgaacctgtacc

SEQ ID NO: 647382 - DNA, 25 bp, Rattus norvegicus
ccagaaaccggtagaaccagttgtg

SEQ ID NO: 647383 - DNA, 25 bp, Rattus norvegicus
accagttgtgcgctgtgcaaggcga

SEQ ID NO: 647384 - DNA, 25 bp, Rattus norvegicus
aggactcaggcttctcccgacgcga

SEQ ID NO: 647385 - DNA, 25 bp, Rattus norvegicus
ctgtagggttgaaccgtgagccgca

SEQ ID NO: 647386 - DNA, 25 bp, Rattus norvegicus
cacaacgtcgtgacagccaaaccga

SEQ ID NO: 647387 - DNA, 25 bp, Rattus norvegicus
gccagtctgggcagtgacacctgca

SEQ ID NO: 647388 - DNA, 25 bp, Rattus norvegicus
ctgcaatcaacaggtctctggaccc

SEQ ID NO: 647389 - DNA, 25 bp, Rattus norvegicus
tcccggctttcctgcgggtgatgct

SEQ ID NO: 647390 - DNA, 25 bp, Rattus norvegicus
gggtctgtgggttcgaccattgcta

SEQ ID NO: 647391 - DNA, 25 bp, Rattus norvegicus
cgagatcccgcgagagcaggactca

SEQ ID NO: 647392 - DNA, 25 bp, Rattus norvegicus
atcctcgagccgtgtagtaggcagg

SEQ ID NO: 647393 - DNA, 25 bp, Rattus norvegicus
caggggactgcggttcatttccaca

SEQ ID NO: 647394 - DNA, 25 bp, Rattus norvegicus
catttccacagcagacacggtcgtc

SEQ ID NO: 647395 - DNA, 25 bp, Rattus norvegicus
agacacggtcgtcctggtgttctcc

SEQ ID NO: 647396 - DNA, 25 bp, Rattus norvegicus
tccgccttggttttgcggctttgca

SEQ ID NO: 647397 - DNA, 25 bp, Rattus norvegicus
tgatgctccctttccgcgggcttct

SEQ ID NO: 647398 - DNA, 25 bp, Rattus norvegicus
ttctgttccgtattgggacccgcga

SEQ ID NO: 647399 - DNA, 25 bp, Rattus norvegicus
atgtgcgagacgaagtagaggccca

SEQ ID NO: 647400 - DNA, 25 bp, Rattus norvegicus
caacgcctgcgttaggagactgcga

SEQ ID NO: 647401 - DNA, 25 bp, Rattus norvegicus
gtcgaagtcaggcacggagccaaca

SEQ ID NO: 647402 - DNA, 25 bp, Rattus norvegicus
tcgacgcagcgcctggctgttacag

SEQ ID NO: 647403 - DNA, 25 bp, Rattus norvegicus
ttacctcccgtcagttgagacacga

SEQ ID NO: 647404 - DNA, 25 bp, Rattus norvegicus
tgagacacgaccaacaacgcctgcg

SEQ ID NO: 647405 - DNA, 25 bp, Rattus norvegicus
gagactgcgacgtggttagaagccc

SEQ ID NO: 647406 - DNA, 25 bp, Rattus norvegicus
tgacggcctacctgcggtttccatt

SEQ ID NO: 647407 - DNA, 25 bp, Rattus norvegicus
cccggcttacgtaggcagtgcctat

SEQ ID NO: 647408 - DNA, 25 bp, Rattus norvegicus
ttgtgttccctgtgtcctgtgtctt

SEQ ID NO: 647409 - DNA, 25 bp, Rattus norvegicus
cggctatagtttgagtgacggccta

SEQ ID NO: 647410 - DNA, 25 bp, Rattus norvegicus
cctattggtcgaggtggaggaaaca

SEQ ID NO: 647411 - DNA, 25 bp, Rattus norvegicus
gtttccattggctgctgggtggacc

SEQ ID NO: 647412 - DNA, 25 bp, Rattus norvegicus
agcgttcagcttcgggacatcattc

SEQ ID NO: 647413 - DNA, 25 bp, Rattus norvegicus
gcggagtgtccacacgcggctgcac

SEQ ID NO: 647414 - DNA, 25 bp, Rattus norvegicus
gattcgaggccggttcgtgccaagt

SEQ ID NO: 647415 - DNA, 25 bp, Rattus norvegicus
ggggaaatggcaactacagcgttca

SEQ ID NO: 647416 - DNA, 25 bp, Rattus norvegicus
atcaacttggctccctggttccctg

SEQ ID NO: 647417 - DNA, 25 bp, Rattus norvegicus
cggttcgtgccaagtggctctctgc

SEQ ID NO: 647418 - DNA, 25 bp, Rattus norvegicus
tcgagcgctcgaggtttggattcga

SEQ ID NO: 647419 - DNA, 25 bp, Rattus norvegicus
gtctttgtagaattcgagcgctcga

SEQ ID NO: 647420 - DNA, 25 bp, Rattus norvegicus
aagggtgtctttgtagaattcgagc

SEQ ID NO: 647421 - DNA, 25 bp, Rattus norvegicus
cattcgggagggaaacgcgaacttg

SEQ ID NO: 647422 - DNA, 25 bp, Rattus norvegicus
tcgggacatcattcgggagggaaac

SEQ ID NO: 647423 - DNA, 25 bp, Rattus norvegicus
ctacagcgttcagcttcgggacatc

SEQ ID NO: 647424 - DNA, 25 bp, Rattus norvegicus
ctggaaatatctgaggggaaatggc

SEQ ID NO: 647425 - DNA, 25 bp, Rattus norvegicus
caagtggctctctgccatgtcgccg

SEQ ID NO: 647426 - DNA, 25 bp, Rattus norvegicus
agaagctctcgagcacggtcatgtg

SEQ ID NO: 647427 - DNA, 25 bp, Rattus norvegicus
ctgggccgatagcagaagctctcga

SEQ ID NO: 647428 - DNA, 25 bp, Rattus norvegicus
cagaaacgtgtagcctgggccgata

SEQ ID NO: 647429 - DNA, 25 bp, Rattus norvegicus
ttcagcgtcagaaacgtgtagcctg

SEQ ID NO: 647430 - DNA, 25 bp, Rattus norvegicus
tgttcctaagaaattcagcgtcaga

SEQ ID NO: 647431 - DNA, 25 bp, Rattus norvegicus
gctgggcgctgttcctaagaaattc

SEQ ID NO: 647432 - DNA, 25 bp, Rattus norvegicus
tcctgccaatagtaagcgtggtccc

SEQ ID NO: 647433 - DNA, 25 bp, Rattus norvegicus
ctctcgagcacggtcatgtgctccg

SEQ ID NO: 647434 - DNA, 25 bp, Rattus norvegicus
ccagctcttcttctatccactgctc

SEQ ID NO: 647435 - DNA, 25 bp, Rattus norvegicus
gggcgtggctgactcccagctcttc

SEQ ID NO: 647436 - DNA, 25 bp, Rattus norvegicus
gaccatgggcgtggctgactcccag

SEQ ID NO: 647437 - DNA, 25 bp, Rattus norvegicus
ccaacggcagctggtgatgaccatg

SEQ ID NO: 647438 - DNA, 25 bp, Rattus norvegicus
acgagcgggcgtaccaacggcagct

SEQ ID NO: 647439 - DNA, 25 bp, Rattus norvegicus
tccactgctcctgccaatagtaagc

SEQ ID NO: 647440 - DNA, 25 bp, Rattus norvegicus
cagacaggaaatcccgcctctggga

SEQ ID NO: 647441 - DNA, 25 bp, Rattus norvegicus
attctgacccggagactttcacgtc

SEQ ID NO: 647442 - DNA, 25 bp, Rattus norvegicus
tccctcaggagggatttccggcgcg

SEQ ID NO: 647443 - DNA, 25 bp, Rattus norvegicus
aggaaatcccgcctctgggacgccg

SEQ ID NO: 647444 - DNA, 25 bp, Rattus norvegicus
gggacgccggctatatgacgtcata

SEQ ID NO: 647445 - DNA, 25 bp, Rattus norvegicus
gccggctatatgacgtcatatgacg

SEQ ID NO: 647446 - DNA, 25 bp, Rattus norvegicus
aggaaacagcgtcccaccgagattc

SEQ ID NO: 647447 - DNA, 25 bp, Rattus norvegicus
tcccggatctcctgcaggcggctgt

SEQ ID NO: 647448 - DNA, 25 bp, Rattus norvegicus
gtaacttctgccgttcccggatctc

SEQ ID NO: 647449 - DNA, 25 bp, Rattus norvegicus
agctgccgccgtaacttctgccgtt

SEQ ID NO: 647450 - DNA, 25 bp, Rattus norvegicus
cacctgctgagctaggagctgccgc

SEQ ID NO: 647451 - DNA, 25 bp, Rattus norvegicus
cggcctcacacctgctgagctagga

SEQ ID NO: 647452 - DNA, 25 bp, Rattus norvegicus
tcccaccgagattctgacccggaga

SEQ ID NO: 647453 - DNA, 25 bp, Rattus norvegicus
ggagactttcacgtccctcaggagg

SEQ ID NO: 647454 - DNA, 25 bp, Rattus norvegicus
gctgtgattttaggggtactgtccg

SEQ ID NO: 647455 - DNA, 25 bp, Rattus norvegicus
gcagccgcacaacttctgccggagt

SEQ ID NO: 647456 - DNA, 25 bp, Rattus norvegicus
gctgagctaagagggcagccgcaca

SEQ ID NO: 647457 - DNA, 25 bp, Rattus norvegicus
ctacactgggacgaggtgccgccct

SEQ ID NO: 647458 - DNA, 25 bp, Rattus norvegicus
tcggcgtcccgtgtctacactggga

SEQ ID NO: 647459 - DNA, 25 bp, Rattus norvegicus
ggggcaatgccaccaacctcggcgt

SEQ ID NO: 647460 - DNA, 25 bp, Rattus norvegicus
aagtggcccgcgctgatccggtctt

SEQ ID NO: 647461 - DNA, 25 bp, Rattus norvegicus
ccgctgcgtgctggctgtgatttta

SEQ ID NO: 647462 - DNA, 25 bp, Rattus norvegicus
cggtgtgattctccagccgccctag

SEQ ID NO: 647463 - DNA, 25 bp, Rattus norvegicus
cctttgcttcgaggggctgaccctt

SEQ ID NO: 647464 - DNA, 25 bp, Rattus norvegicus
agctcctgaatctcaacgcctctgg

SEQ ID NO: 647465 - DNA, 25 bp, Rattus norvegicus
ttggcactgagagcccgcgcctcag

SEQ ID NO: 647466 - DNA, 25 bp, Rattus norvegicus
tgtgccttttggcacgggcagccta

SEQ ID NO: 647467 - DNA, 25 bp, Rattus norvegicus
cccgacgatttcacgccggtgcggg

SEQ ID NO: 647468 - DNA, 25 bp, Rattus norvegicus
tatcgatttcacatggtggcccgcg

SEQ ID NO: 647469 - DNA, 25 bp, Rattus norvegicus
gcgcggcctcacatcgtatcgattt

SEQ ID NO: 647470 - DNA, 25 bp, Rattus norvegicus
cgcaaatgcccgttaagccgtagca

SEQ ID NO: 647471 - DNA, 25 bp, Rattus norvegicus
ggcccgcgagctagcctttactaca

SEQ ID NO: 647472 - DNA, 25 bp, Rattus norvegicus
cccgcatcttgatcgctcgcaaata

SEQ ID NO: 647473 - DNA, 25 bp, Rattus norvegicus
gctgcgcgcccgcttttataagccg

SEQ ID NO: 647474 - DNA, 25 bp, Rattus norvegicus
ttccggacctctcccgctttgattg

SEQ ID NO: 647475 - DNA, 25 bp, Rattus norvegicus
attctcgcgttgtctgaagtcttgc

SEQ ID NO: 647476 - DNA, 25 bp, Rattus norvegicus
gcggctaatgttatggcgcttcaca

SEQ ID NO: 647477 - DNA, 25 bp, Rattus norvegicus
ctcagcttgccctcttgatcggatc

SEQ ID NO: 647478 - DNA, 25 bp, Rattus norvegicus
ctcacttatttttgcgcgacacagc

SEQ ID NO: 647479 - DNA, 25 bp, Rattus norvegicus
acagcgcgctggtttctgtaaccca

SEQ ID NO: 647480 - DNA, 25 bp, Rattus norvegicus
ctttcccgaaggaggaatgcctgtc

SEQ ID NO: 647481 - DNA, 25 bp, Rattus norvegicus
tttggccacaactaggaagagctta

SEQ ID NO: 647482 - DNA, 25 bp, Rattus norvegicus
gtggagcgccggcatcctgcctcca

SEQ ID NO: 647483 - DNA, 25 bp, Rattus norvegicus
ccggcatcctgcctccaggtcctcc

SEQ ID NO: 647484 - DNA, 25 bp, Rattus norvegicus
gcgcgctcttggaccagcgctcgcc

SEQ ID NO: 647485 - DNA, 25 bp, Rattus norvegicus
ccaggtcctccgcttctctgcgctc

SEQ ID NO: 647486 - DNA, 25 bp, Rattus norvegicus
gcgcagtctcctgggtgcccgctgc

SEQ ID NO: 647487 - DNA, 25 bp, Rattus norvegicus
ccggcgcgcgatcgcctgagcgaga

SEQ ID NO: 647488 - DNA, 25 bp, Rattus norvegicus
atcgcctgagcgagaggaggcctga

SEQ ID NO: 647489 - DNA, 25 bp, Rattus norvegicus
agtcagggaggagccgagctacacc

SEQ ID NO: 647490 - DNA, 25 bp, Rattus norvegicus
cagggaggagccgagctacaccaca

SEQ ID NO: 647491 - DNA, 25 bp, Rattus norvegicus
ggagccgagctacaccacaggtgct

SEQ ID NO: 647492 - DNA, 25 bp, Rattus norvegicus
ccgagctacaccacaggtgctggtg

SEQ ID NO: 647493 - DNA, 25 bp, Rattus norvegicus
agctacaccacaggtgctggtgccc

SEQ ID NO: 647494 - DNA, 25 bp, Rattus norvegicus
agcatccgctcccaagccgagtggg

SEQ ID NO: 647495 - DNA, 25 bp, Rattus norvegicus
atccgctcccaagccgagtgggctg

SEQ ID NO: 647496 - DNA, 25 bp, Rattus norvegicus
tccgcaagaagaacgccaggaaccc

SEQ ID NO: 647497 - DNA, 25 bp, Rattus norvegicus
acttatgttcgagggcacggccgag

SEQ ID NO: 647498 - DNA, 25 bp, Rattus norvegicus
cacggccgagatgtcgatcgtgttc

SEQ ID NO: 647499 - DNA, 25 bp, Rattus norvegicus
ggcatgttcttcgtgctgggactta

SEQ ID NO: 647500 - DNA, 25 bp, Rattus norvegicus
ctgtgcgcatgctcggcctacgcgg

SEQ ID NO: 647501 - DNA, 25 bp, Rattus norvegicus
catggggctccgcaagaagaacgcc

SEQ ID NO: 647502 - DNA, 25 bp, Rattus norvegicus
atcggtgcggcaaatccgcgctcgc

SEQ ID NO: 647503 - DNA, 25 bp, Rattus norvegicus
tgtcgatcgtgttcctcaccctgca

SEQ ID NO: 647504 - DNA, 25 bp, Rattus norvegicus
ccggtgctgagccacgaattcatgg

SEQ ID NO: 647505 - DNA, 25 bp, Rattus norvegicus
gccacgaattcatggtgcagaacca

SEQ ID NO: 647506 - DNA, 25 bp, Rattus norvegicus
ggtgcagaaccacgcggatatggtc

SEQ ID NO: 647507 - DNA, 25 bp, Rattus norvegicus
tgcagcatggagtcgttgtcccagc

SEQ ID NO: 647508 - DNA, 25 bp, Rattus norvegicus
atatggtctcctgcgtgggcatgtt

SEQ ID NO: 647509 - DNA, 25 bp, Rattus norvegicus
ccagcctttgattgatcggtcggca

SEQ ID NO: 647510 - DNA, 25 bp, Rattus norvegicus
ctaattctctacacgttactctaaa

SEQ ID NO: 647511 - DNA, 25 bp, Rattus norvegicus
caaacgtgcagagccacggttaaga

SEQ ID NO: 647512 - DNA, 25 bp, Rattus norvegicus
ggttaagacgttttcagcatccctg

SEQ ID NO: 647513 - DNA, 25 bp, Rattus norvegicus
tttcagcatccctgcgctattattg

SEQ ID NO: 647514 - DNA, 25 bp, Rattus norvegicus
ccctgcgctattattgcaccgttta

SEQ ID NO: 647515 - DNA, 25 bp, Rattus norvegicus
gcgctattattgcaccgtttaaaaa

SEQ ID NO: 647516 - DNA, 25 bp, Rattus norvegicus
attccttaaactaattctctacacg

SEQ ID NO: 647517 - DNA, 25 bp, Rattus norvegicus
cccagacgcgcgaattgagcgctgt

SEQ ID NO: 647518 - DNA, 25 bp, Rattus norvegicus
cgaattgagcgctgtgtctttaagg

SEQ ID NO: 647519 - DNA, 25 bp, Rattus norvegicus
ccgtccgggacaaaatgtctgcgag

SEQ ID NO: 647520 - DNA, 25 bp, Rattus norvegicus
caaaatgtctgcgaggagcctggag

SEQ ID NO: 647521 - DNA, 25 bp, Rattus norvegicus
acgcctgtgaccgcggggacaacgc

SEQ ID NO: 647522 - DNA, 25 bp, Rattus norvegicus
cagagccacggttaagacgttttca

SEQ ID NO: 647523 - DNA, 25 bp, Rattus norvegicus
cctcccgggccggatggtttagcag

SEQ ID NO: 647524 - DNA, 25 bp, Rattus norvegicus
cacctcgggcggagaacaactgtgt

SEQ ID NO: 647525 - DNA, 25 bp, Rattus norvegicus
aggctgcacctgtcaccaaagtctc

SEQ ID NO: 647526 - DNA, 25 bp, Rattus norvegicus
gagatgctgcgaggctgcacctgtc

SEQ ID NO: 647527 - DNA, 25 bp, Rattus norvegicus
ctgccagcttaagacgggcgctcta

SEQ ID NO: 647528 - DNA, 25 bp, Rattus norvegicus
agaacaactgtgtcccggagccctc

SEQ ID NO: 647529 - DNA, 25 bp, Rattus norvegicus
cgcaaggtgacaagccctaactctc

SEQ ID NO: 647530 - DNA, 25 bp, Rattus norvegicus
caagtcaagtgcaaggtcccgcgtc

SEQ ID NO: 647531 - DNA, 25 bp, Rattus norvegicus
ccactactgcggtcaccaaaaggtc

SEQ ID NO: 647532 - DNA, 25 bp, Rattus norvegicus
tgctgtcttctgtccactactgcgg

SEQ ID NO: 647533 - DNA, 25 bp, Rattus norvegicus
ccatgagcgaccgtgctgtcttctg

SEQ ID NO: 647534 - DNA, 25 bp, Rattus norvegicus
cggctccttaggagcaggcgactgc

SEQ ID NO: 647535 - DNA, 25 bp, Rattus norvegicus
ccggccaagcggctccttaggagca

SEQ ID NO: 647536 - DNA, 25 bp, Rattus norvegicus
gcccatccttgcctcaagtcaagtg

SEQ ID NO: 647537 - DNA, 25 bp, Rattus norvegicus
ctgcagcgcgcctgccagcttaaga

SEQ ID NO: 647538 - DNA, 25 bp, Rattus norvegicus
cccttgggtgttcactcttggccac

SEQ ID NO: 647539 - DNA, 25 bp, Rattus norvegicus
tcgaggagctcggaaagtaagcgtc

SEQ ID NO: 647540 - DNA, 25 bp, Rattus norvegicus
ccgacgagtatcagctcttcgagga

SEQ ID NO: 647541 - DNA, 25 bp, Rattus norvegicus
tgcacccggttcaccgacgagtatc

SEQ ID NO: 647542 - DNA, 25 bp, Rattus norvegicus
aagccgcgtctgttcgcgtgtcgcc

SEQ ID NO: 647543 - DNA, 25 bp, Rattus norvegicus
ccagtcccgggaagccgcgtctgtt

SEQ ID NO: 647544 - DNA, 25 bp, Rattus norvegicus
ggcgagctactttcggacaaggaaa

SEQ ID NO: 647545 - DNA, 25 bp, Rattus norvegicus
tcgccggcgagctactttcggacaa

SEQ ID NO: 647546 - DNA, 25 bp, Rattus norvegicus
ggtgttcactcttggccactgccgc

SEQ ID NO: 647547 - DNA, 25 bp, Rattus norvegicus
ctgagccgagtgagcgcactctgtc

SEQ ID NO: 647548 - DNA, 25 bp, Rattus norvegicus
gagcgcactctgtcgcccgcaggtt

SEQ ID NO: 647549 - DNA, 25 bp, Rattus norvegicus
aagtaagcgtccctgcctggcacct

SEQ ID NO: 647550 - DNA, 25 bp, Rattus norvegicus
ctacgttgagctctccgtgcggcct

SEQ ID NO: 647551 - DNA, 25 bp, Rattus norvegicus
tgccagattcgcctgagccgagtga

SEQ ID NO: 647552 - DNA, 25 bp, Rattus norvegicus
caaagccggatagagcggagccagc

SEQ ID NO: 647553 - DNA, 25 bp, Rattus norvegicus
cagacaggcgcactgttcgaccagt

SEQ ID NO: 647554 - DNA, 25 bp, Rattus norvegicus
ccggaagcttcagacaggcgcactg

SEQ ID NO: 647555 - DNA, 25 bp, Rattus norvegicus
aatccctggccggaagcttcagaca

SEQ ID NO: 647556 - DNA, 25 bp, Rattus norvegicus
cctagccaatccacgcccacctgtc

SEQ ID NO: 647557 - DNA, 25 bp, Rattus norvegicus
gacacgcgcaaccagccgccgaggc

SEQ ID NO: 647558 - DNA, 25 bp, Rattus norvegicus
ttcgaccagtggcaaccaggtgtgg

SEQ ID NO: 647559 - DNA, 25 bp, Rattus norvegicus
ctagcaaagccggatagagcggagc

SEQ ID NO: 647560 - DNA, 25 bp, Rattus norvegicus
ccgctttctcttcagccgccgcctt

SEQ ID NO: 647561 - DNA, 25 bp, Rattus norvegicus
tccacagccgccgtgaccgctttct

SEQ ID NO: 647562 - DNA, 25 bp, Rattus norvegicus
ggcttccgtgcccacggttgctttc

SEQ ID NO: 647563 - DNA, 25 bp, Rattus norvegicus
acggtcggaagcaggctgactcctg

SEQ ID NO: 647564 - DNA, 25 bp, Rattus norvegicus
actcggacgcccagacacagggaac

SEQ ID NO: 647565 - DNA, 25 bp, Rattus norvegicus
gcctcacactgaccggctgccctag

SEQ ID NO: 647566 - DNA, 25 bp, Rattus norvegicus
gggtgaacccgaccacagatgtagg

SEQ ID NO: 647567 - DNA, 25 bp, Rattus norvegicus
taccagactgagaggagcttccacc

SEQ ID NO: 647568 - DNA, 25 bp, Rattus norvegicus
tgagaggatctacaggccacttgtg

SEQ ID NO: 647569 - DNA, 25 bp, Rattus norvegicus
gacttactccgtgcacgtcctcaga

SEQ ID NO: 647570 - DNA, 25 bp, Rattus norvegicus
tccacggtcagcgattgcgttcttc

SEQ ID NO: 647571 - DNA, 25 bp, Rattus norvegicus
ccgaccctagcaggcggcggaaatt

SEQ ID NO: 647572 - DNA, 25 bp, Rattus norvegicus
ggaaatttgcgtcatccgaccagcg

SEQ ID NO: 647573 - DNA, 25 bp, Rattus norvegicus
tcagcccactacagaaggccgggtc

SEQ ID NO: 647574 - DNA, 25 bp, Rattus norvegicus
ctgcgctcggatgcggaattccatt

SEQ ID NO: 647575 - DNA, 25 bp, Rattus norvegicus
cagccgcaacgtccctgcttgatga

SEQ ID NO: 647576 - DNA, 25 bp, Rattus norvegicus
tgatgacgtctctcaagttcgcggg

SEQ ID NO: 647577 - DNA, 25 bp, Rattus norvegicus
ggacgctgacttcgcctccacagaa

SEQ ID NO: 647578 - DNA, 25 bp, Rattus norvegicus
ccgcccacgagacgccgttagaatg

SEQ ID NO: 647579 - DNA, 25 bp, Rattus norvegicus
acaatccgaattgcaagggccgcca

SEQ ID NO: 647580 - DNA, 25 bp, Rattus norvegicus
ggtgttgtgttgtaaaagccttctc

SEQ ID NO: 647581 - DNA, 25 bp, Rattus norvegicus
cctgggcgccgtcgtactgccaagt

SEQ ID NO: 647582 - DNA, 25 bp, Rattus norvegicus
cgtcgtactgccaagtgccgccagg

SEQ ID NO: 647583 - DNA, 25 bp, Rattus norvegicus
tcgtactgccaagtgccgccagggg

SEQ ID NO: 647584 - DNA, 25 bp, Rattus norvegicus
ggagccgtgatctcgcctgcctgcc

SEQ ID NO: 647585 - DNA, 25 bp, Rattus norvegicus
ttccccaccgctgggcgctggagga

SEQ ID NO: 647586 - DNA, 25 bp, Rattus norvegicus
tgttgtgttgtaaaagccttctccg

SEQ ID NO: 647587 - DNA, 25 bp, Rattus norvegicus
tgtgttgtaaaagccttctccgccc

SEQ ID NO: 647588 - DNA, 25 bp, Rattus norvegicus
ttgtaaaagccttctccgcccggca

SEQ ID NO: 647589 - DNA, 25 bp, Rattus norvegicus
cccggcactgctcctaggcgtgaat

SEQ ID NO: 647590 - DNA, 25 bp, Rattus norvegicus
cggcactgctcctaggcgtgaatga

SEQ ID NO: 647591 - DNA, 25 bp, Rattus norvegicus
ctgctcctaggcgtgaatgagtgag

SEQ ID NO: 647592 - DNA, 25 bp, Rattus norvegicus
ggagccggagaaaagaggcgctggc

SEQ ID NO: 647593 - DNA, 25 bp, Rattus norvegicus
tcctgctgcggtcgcgagctgtcga

SEQ ID NO: 647594 - DNA, 25 bp, Rattus norvegicus
tgagaccggtgggacttgtatgcta

SEQ ID NO: 647595 - DNA, 25 bp, Rattus norvegicus
tcgggcccctaatgagctgctgaaa

SEQ ID NO: 647596 - DNA, 25 bp, Rattus norvegicus
tagcatccgggcaggggcagcccct

SEQ ID NO: 647597 - DNA, 25 bp, Rattus norvegicus
cttgtatgctagcatccgggcaggg

SEQ ID NO: 647598 - DNA, 25 bp, Rattus norvegicus
cggtgggacttgtatgctagcatcc

SEQ ID NO: 647599 - DNA, 25 bp, Rattus norvegicus
ctgctgaaagggagcgggctccggt

SEQ ID NO: 647600 - DNA, 25 bp, Rattus norvegicus
gcctcccggagtctcgggaacactg

SEQ ID NO: 647601 - DNA, 25 bp, Rattus norvegicus
ggacttgtatgctagcatccgggca

SEQ ID NO: 647602 - DNA, 25 bp, Rattus norvegicus
agtctcgggaacactgattggccag

SEQ ID NO: 647603 - DNA, 25 bp, Rattus norvegicus
gcctcgcgacctcctttcattaata

SEQ ID NO: 647604 - DNA, 25 bp, Rattus norvegicus
gcgacctcctttcattaataaatta

SEQ ID NO: 647605 - DNA, 25 bp, Rattus norvegicus
cattaataaattagcggcacgctcc

SEQ ID NO: 647606 - DNA, 25 bp, Rattus norvegicus
cctgctgcctcgaagaccagggcgg

SEQ ID NO: 647607 - DNA, 25 bp, Rattus norvegicus
ggagtctcgggaacactgattggcc

SEQ ID NO: 647608 - DNA, 25 bp, Rattus norvegicus
tcacgaagatcgagacgctccgctt

SEQ ID NO: 647609 - DNA, 25 bp, Rattus norvegicus
ccaccttcgtggatgcaccttgggg

SEQ ID NO: 647610 - DNA, 25 bp, Rattus norvegicus
ctgcggggacattcccagacacaca

SEQ ID NO: 647611 - DNA, 25 bp, Rattus norvegicus
agctgcaccgcgacacatctggagc

SEQ ID NO: 647612 - DNA, 25 bp, Rattus norvegicus
taactccatcgctctggacgcagtg

SEQ ID NO: 647613 - DNA, 25 bp, Rattus norvegicus
ttctgtgacccaaagtgaccgttca

SEQ ID NO: 647614 - DNA, 25 bp, Rattus norvegicus
accgttcagaaggtggctcgagcca

SEQ ID NO: 647615 - DNA, 25 bp, Rattus norvegicus
gacacttcgcccagttcctgtagta

SEQ ID NO: 647616 - DNA, 25 bp, Rattus norvegicus
ctcttctttcgcaggatgttcgtca

SEQ ID NO: 647617 - DNA, 25 bp, Rattus norvegicus
tgttcgtcaagtccgagactctgga

SEQ ID NO: 647618 - DNA, 25 bp, Rattus norvegicus
tgactccgatgtcctccagcgcgga

SEQ ID NO: 647619 - DNA, 25 bp, Rattus norvegicus
acaattacatctgggcgctcaccga

SEQ ID NO: 647620 - DNA, 25 bp, Rattus norvegicus
cccgaggacgccaagctcacgaaga

SEQ ID NO: 647621 - DNA, 25 bp, Rattus norvegicus
cgcatcaagaagacccgcaggctca

SEQ ID NO: 647622 - DNA, 25 bp, Rattus norvegicus
ttgtgcaagcctttggcgacctgca

SEQ ID NO: 647623 - DNA, 25 bp, Rattus norvegicus
gcctgtagaggtcaagtagccggga

SEQ ID NO: 647624 - DNA, 25 bp, Rattus norvegicus
tttcccgagacgtcgagtccgtaca

SEQ ID NO: 647625 - DNA, 25 bp, Rattus norvegicus
cctggacaaggatggaggctcgcaa

SEQ ID NO: 647626 - DNA, 25 bp, Rattus norvegicus
cggcagcgcagtcctggacaaggat

SEQ ID NO: 647627 - DNA, 25 bp, Rattus norvegicus
tcaagaagacaatagcggcggcggc

SEQ ID NO: 647628 - DNA, 25 bp, Rattus norvegicus
caggaaccggtccatcaagaagaca

SEQ ID NO: 647629 - DNA, 25 bp, Rattus norvegicus
agtccgtacaggaaccggtccatca

SEQ ID NO: 647630 - DNA, 25 bp, Rattus norvegicus
gcgacctgcaggagttttcccgaga

SEQ ID NO: 647631 - DNA, 25 bp, Rattus norvegicus
cgggctgcagcttgtgcaagccttt

SEQ ID NO: 647632 - DNA, 25 bp, Rattus norvegicus
agacccgggcttggcggatgaccac

SEQ ID NO: 647633 - DNA, 25 bp, Rattus norvegicus
cctgagttgacagagacccgggctt

SEQ ID NO: 647634 - DNA, 25 bp, Rattus norvegicus
gcgatggagcccacctgagttgaca

SEQ ID NO: 647635 - DNA, 25 bp, Rattus norvegicus
accagccggcgccaagcgatggagc

SEQ ID NO: 647636 - DNA, 25 bp, Rattus norvegicus
tccggagacctcagaaaggcgacag

SEQ ID NO: 647637 - DNA, 25 bp, Rattus norvegicus
ctgggcgactcaaacccggtcagtc

SEQ ID NO: 647638 - DNA, 25 bp, Rattus norvegicus
gactcaaacccggtcagtccggaga

SEQ ID NO: 647639 - DNA, 25 bp, Rattus norvegicus
ccggtcagtccggagacctcagaaa

SEQ ID NO: 647640 - DNA, 25 bp, Rattus norvegicus
tcagtccggagacctcagaaaggcg

SEQ ID NO: 647641 - DNA, 25 bp, Rattus norvegicus
ctccagcctggctctgcggggcttt

SEQ ID NO: 647642 - DNA, 25 bp, Rattus norvegicus
cgagggctttgctgaggtcactcgc

SEQ ID NO: 647643 - DNA, 25 bp, Rattus norvegicus
ctttgctgaggtcactcgcgcgagg

SEQ ID NO: 647644 - DNA, 25 bp, Rattus norvegicus
gtcactcgcgcgaggccgctcttgg

SEQ ID NO: 647645 - DNA, 25 bp, Rattus norvegicus
ctcgtacggcgctggtcgcgacgac

SEQ ID NO: 647646 - DNA, 25 bp, Rattus norvegicus
gtgctgggcgactcaaacccggtca

SEQ ID NO: 647647 - DNA, 25 bp, Rattus norvegicus
ccaccgaaggctccgcaaggctcac

SEQ ID NO: 647648 - DNA, 25 bp, Rattus norvegicus
acctgcgggttcggcgagctcgtac

SEQ ID NO: 647649 - DNA, 25 bp, Rattus norvegicus
cccgccgcttccaccgaaggctccg

SEQ ID NO: 647650 - DNA, 25 bp, Rattus norvegicus
atcggaatctgggattttcctattt

SEQ ID NO: 647651 - DNA, 25 bp, Rattus norvegicus
ttaaaagcgttgagctcgcctgtcg

SEQ ID NO: 647652 - DNA, 25 bp, Rattus norvegicus
gatgcacgaggctcttcctgaccca

SEQ ID NO: 647653 - DNA, 25 bp, Rattus norvegicus
tcctgacccatctccgggcttcagc

SEQ ID NO: 647654 - DNA, 25 bp, Rattus norvegicus
ggcttcagccgggtcacagaaaagc

SEQ ID NO: 647655 - DNA, 25 bp, Rattus norvegicus
cgggtcacagaaaagcccagcgtca

SEQ ID NO: 647656 - DNA, 25 bp, Rattus norvegicus
agcgtcatcggaatctgggattttc

SEQ ID NO: 647657 - DNA, 25 bp, Rattus norvegicus
tttccggaacattcagatccggtgg

SEQ ID NO: 647658 - DNA, 25 bp, Rattus norvegicus
cggaacattcagatccggtggctga

SEQ ID NO: 647659 - DNA, 25 bp, Rattus norvegicus
cattcagatccggtggctgagagag

SEQ ID NO: 647660 - DNA, 25 bp, Rattus norvegicus
aggccgagagttgcggtcgcttaaa

SEQ ID NO: 647661 - DNA, 25 bp, Rattus norvegicus
ccgagagttgcggtcgcttaaaagc

SEQ ID NO: 647662 - DNA, 25 bp, Rattus norvegicus
gcggtcgcttaaaagcgttgagctc

SEQ ID NO: 647663 - DNA, 25 bp, Rattus norvegicus
aaaagcccagcgtcatcggaatctg

SEQ ID NO: 647664 - DNA, 25 bp, Rattus norvegicus
tgtgcgtcatttccgctagcttccg

SEQ ID NO: 647665 - DNA, 25 bp, Rattus norvegicus
gacgcttcggcagtaagtcaaagta

SEQ ID NO: 647666 - DNA, 25 bp, Rattus norvegicus
tcaaagtagggtgtgtccagacggc

SEQ ID NO: 647667 - DNA, 25 bp, Rattus norvegicus
tcacaggagccgtgcctcccgaggt

SEQ ID NO: 647668 - DNA, 25 bp, Rattus norvegicus
gccgtgcctcccgaggtaagtctta

SEQ ID NO: 647669 - DNA, 25 bp, Rattus norvegicus
cccgaggtaagtcttaagggacatg

SEQ ID NO: 647670 - DNA, 25 bp, Rattus norvegicus
ttaagggacatggatcacgcacggg

SEQ ID NO: 647671 - DNA, 25 bp, Rattus norvegicus
agcagcccgaagcattgcgtccagc

SEQ ID NO: 647672 - DNA, 25 bp, Rattus norvegicus
gaagcattgcgtccagcagcagttc

SEQ ID NO: 647673 - DNA, 25 bp, Rattus norvegicus
tgtagggaacaaaggccgccgctag

SEQ ID NO: 647674 - DNA, 25 bp, Rattus norvegicus
gccgcttctgtgttcccattggaca

SEQ ID NO: 647675 - DNA, 25 bp, Rattus norvegicus
ccattggacacgcttctggcggctc

SEQ ID NO: 647676 - DNA, 25 bp, Rattus norvegicus
ctggcgtgtgcgtcatttccgctag

SEQ ID NO: 647677 - DNA, 25 bp, Rattus norvegicus
ggacacgcttctggcggctccgctt

SEQ ID NO: 647678 - DNA, 25 bp, Rattus norvegicus
gcactgtggcgacacctgagtgaca

SEQ ID NO: 647679 - DNA, 25 bp, Rattus norvegicus
aggcgcgcagccagctacaagcgga

SEQ ID NO: 647680 - DNA, 25 bp, Rattus norvegicus
acctgcgggcccatcatactcggag

SEQ ID NO: 647681 - DNA, 25 bp, Rattus norvegicus
agaagagcgctgctccgagcgtgaa

SEQ ID NO: 647682 - DNA, 25 bp, Rattus norvegicus
ggggctactttcacctggacccagc

SEQ ID NO: 647683 - DNA, 25 bp, Rattus norvegicus
cccagctcagcctaggcacagaatg

SEQ ID NO: 647684 - DNA, 25 bp, Rattus norvegicus
cacagaatgatgagcgcctgggcca

SEQ ID NO: 647685 - DNA, 25 bp, Rattus norvegicus
cagcttccagatgtggacgcgggca

SEQ ID NO: 647686 - DNA, 25 bp, Rattus norvegicus
acctgagtgacacgcacctgcggga

SEQ ID NO: 647687 - DNA, 25 bp, Rattus norvegicus
agcacagctccaccgtggctgctga

SEQ ID NO: 647688 - DNA, 25 bp, Rattus norvegicus
gactgggcacttctgttggagcaga

SEQ ID NO: 647689 - DNA, 25 bp, Rattus norvegicus
cggccctaaagcaggcggagctcga

SEQ ID NO: 647690 - DNA, 25 bp, Rattus norvegicus
agctcgagctggaacgcaggcacca

SEQ ID NO: 647691 - DNA, 25 bp, Rattus norvegicus
accctgcagaacaaggcggcccgtg

SEQ ID NO: 647692 - DNA, 25 bp, Rattus norvegicus
gccgccaccctgtggcccgtgctca

SEQ ID NO: 647693 - DNA, 25 bp, Rattus norvegicus
cgacgcagacgggaaccctagaagt

SEQ ID NO: 647694 - DNA, 25 bp, Rattus norvegicus
gccacaccgggactcccgacgcaga

SEQ ID NO: 647695 - DNA, 25 bp, Rattus norvegicus
ccgactctggccgtccgcacggctg

SEQ ID NO: 647696 - DNA, 25 bp, Rattus norvegicus
gagcacatcccaccgccgactctgg

SEQ ID NO: 647697 - DNA, 25 bp, Rattus norvegicus
cccgtgctcacctgctcgccctcgt

SEQ ID NO: 647698 - DNA, 25 bp, Rattus norvegicus
ccgtcaaccgctcgccgcgtgccca

SEQ ID NO: 647699 - DNA, 25 bp, Rattus norvegicus
cggagggcatttccacagagcccgg

SEQ ID NO: 647700 - DNA, 25 bp, Rattus norvegicus
ctccggagggcatttccacagagcc

SEQ ID NO: 647701 - DNA, 25 bp, Rattus norvegicus
cgtagcacaagttgccgggtgtttt

SEQ ID NO: 647702 - DNA, 25 bp, Rattus norvegicus
gcagggcccacgtagcacaagttgc

SEQ ID NO: 647703 - DNA, 25 bp, Rattus norvegicus
ctcagaatccgagagcagggcccac

SEQ ID NO: 647704 - DNA, 25 bp, Rattus norvegicus
agacaccgacccaggcttcccgaca

SEQ ID NO: 647705 - DNA, 25 bp, Rattus norvegicus
tcccgacactcagtgccggccggca

SEQ ID NO: 647706 - DNA, 25 bp, Rattus norvegicus
agtgttgctcctccactttgccggc

SEQ ID NO: 647707 - DNA, 25 bp, Rattus norvegicus
tagctcccagaagcgggaatccagc

SEQ ID NO: 647708 - DNA, 25 bp, Rattus norvegicus
tccaacggctcactgcccgggttaa

SEQ ID NO: 647709 - DNA, 25 bp, Rattus norvegicus
tgcccgggttaaagtacctgtgcga

SEQ ID NO: 647710 - DNA, 25 bp, Rattus norvegicus
cctgtgcgacacgttgatgatgtca

SEQ ID NO: 647711 - DNA, 25 bp, Rattus norvegicus
ccgagttactcggaagtgcgccctc

SEQ ID NO: 647712 - DNA, 25 bp, Rattus norvegicus
tgatgtcacgagtacgcaagtgttg

SEQ ID NO: 647713 - DNA, 25 bp, Rattus norvegicus
tccaggttaatctcgcagaagaatt

SEQ ID NO: 647714 - DNA, 25 bp, Rattus norvegicus
tatggtaaatggtgcacgcagtggc

SEQ ID NO: 647715 - DNA, 25 bp, Rattus norvegicus
tgacgcctgcttccatgataaaccg

SEQ ID NO: 647716 - DNA, 25 bp, Rattus norvegicus
ctgtccctctttcgcagctgtctgg

SEQ ID NO: 647717 - DNA, 25 bp, Rattus norvegicus
ctgtctggccgaacagcctccatga

SEQ ID NO: 647718 - DNA, 25 bp, Rattus norvegicus
gactgcatgcctagcttgacgcctg

SEQ ID NO: 647719 - DNA, 25 bp, Rattus norvegicus
gtagaggtcatacgcgtccaggtta

SEQ ID NO: 647720 - DNA, 25 bp, Rattus norvegicus
cactggagtttggtggaatctctgc

SEQ ID NO: 647721 - DNA, 25 bp, Rattus norvegicus
gacgtcacgacactccgcacacgga

SEQ ID NO: 647722 - DNA, 25 bp, Rattus norvegicus
gtttggtggaatctctgctgacgtc

SEQ ID NO: 647723 - DNA, 25 bp, Rattus norvegicus
ctgtgcactggagtttggtggaatc

SEQ ID NO: 647724 - DNA, 25 bp, Rattus norvegicus
gcgccactgtgcactggagtttggt

SEQ ID NO: 647725 - DNA, 25 bp, Rattus norvegicus
ccgcgcgccactgtgcactggagtt

SEQ ID NO: 647726 - DNA, 25 bp, Rattus norvegicus
ccttgatcgcccagcatacagcagg

SEQ ID NO: 647727 - DNA, 25 bp, Rattus norvegicus
aagcgctatgctcgccccttgatcg

SEQ ID NO: 647728 - DNA, 25 bp, Rattus norvegicus
tcagtggcccaagcgctatgctcgc

SEQ ID NO: 647729 - DNA, 25 bp, Rattus norvegicus
cgcttccagttctagtggttcccgg

SEQ ID NO: 647730 - DNA, 25 bp, Rattus norvegicus
accagggatctgtcccgggccgcag

SEQ ID NO: 647731 - DNA, 25 bp, Rattus norvegicus
ccgctgccttccaccagggatctgt

SEQ ID NO: 647732 - DNA, 25 bp, Rattus norvegicus
atcgcccagcatacagcaggctcgg

SEQ ID NO: 647733 - DNA, 25 bp, Rattus norvegicus
ggtggaatctctgctgacgtcacga

SEQ ID NO: 647734 - DNA, 25 bp, Rattus norvegicus
cgaagcagccgtcccagggacttta

SEQ ID NO: 647735 - DNA, 25 bp, Rattus norvegicus
acggccgctgcatctggtgtgcaaa

SEQ ID NO: 647736 - DNA, 25 bp, Rattus norvegicus
gcggccgttggatgtctcttctcca

SEQ ID NO: 647737 - DNA, 25 bp, Rattus norvegicus
ctctgaaatcaaaaaggtcgagttc

SEQ ID NO: 647738 - DNA, 25 bp, Rattus norvegicus
gtcgagttcacggactctcccgaga

SEQ ID NO: 647739 - DNA, 25 bp, Rattus norvegicus
gcagcaagctgttcccgcggcagca

SEQ ID NO: 647740 - DNA, 25 bp, Rattus norvegicus
tgcccgtgaagcacaggcaggcgaa

SEQ ID NO: 647741 - DNA, 25 bp, Rattus norvegicus
cccgctgcagaacttagactattgg

SEQ ID NO: 647742 - DNA, 25 bp, Rattus norvegicus
ttggcctctgggtagaacacgaagc

SEQ ID NO: 647743 - DNA, 25 bp, Rattus norvegicus
ttttctctctccctgtggtctgatc

SEQ ID NO: 647744 - DNA, 25 bp, Rattus norvegicus
cacaaattatactgcactcctgaga

SEQ ID NO: 647745 - DNA, 25 bp, Rattus norvegicus
agtggtccaacagcgacctctgtcg

SEQ ID NO: 647746 - DNA, 25 bp, Rattus norvegicus
ggaagtcgtgttgaaggctcgcttc

SEQ ID NO: 647747 - DNA, 25 bp, Rattus norvegicus
tttatcgcgccagacgaacgctggg

SEQ ID NO: 647748 - DNA, 25 bp, Rattus norvegicus
cttctgtcaccatacccaggcgtta

SEQ ID NO: 647749 - DNA, 25 bp, Rattus norvegicus
ctggaggtgcatacaatctccgata

SEQ ID NO: 647750 - DNA, 25 bp, Rattus norvegicus
ctggacgcctccaaacatagactgg

SEQ ID NO: 647751 - DNA, 25 bp, Rattus norvegicus
gcagagtgacgtcttgccaccagga

SEQ ID NO: 647752 - DNA, 25 bp, Rattus norvegicus
ggggatctaatatcagctacctgtc

SEQ ID NO: 647753 - DNA, 25 bp, Rattus norvegicus
agctacctgtccctgtcactcttga

SEQ ID NO: 647754 - DNA, 25 bp, Rattus norvegicus
ccgtgctgtccttattggaggggta

SEQ ID NO: 647755 - DNA, 25 bp, Rattus norvegicus
tctccgatacgtccagccctgaagt

SEQ ID NO: 647756 - DNA, 25 bp, Rattus norvegicus
agtcggctccctaaagacgcttgca

SEQ ID NO: 647757 - DNA, 25 bp, Rattus norvegicus
tttcggctgccgaactctgtttggc

SEQ ID NO: 647758 - DNA, 25 bp, Rattus norvegicus
ccctggctctacaagtctcggctaa

SEQ ID NO: 647759 - DNA, 25 bp, Rattus norvegicus
tctcggctaacacagggacacttgg

SEQ ID NO: 647760 - DNA, 25 bp, Rattus norvegicus
tagagcgctacccagaaccggcggc

SEQ ID NO: 647761 - DNA, 25 bp, Rattus norvegicus
agggtctttgcccattcttgtttcg

SEQ ID NO: 647762 - DNA, 25 bp, Rattus norvegicus
ctggttcccgggcagagctgccctg

SEQ ID NO: 647763 - DNA, 25 bp, Rattus norvegicus
ggtgggaagccactttagaagaaga

SEQ ID NO: 647764 - DNA, 25 bp, Rattus norvegicus
gagtgtgcccgaggttactgctcct

SEQ ID NO: 647765 - DNA, 25 bp, Rattus norvegicus
tcccaagctgagctgcgcgggcatt

SEQ ID NO: 647766 - DNA, 25 bp, Rattus norvegicus
cgggcattcctcagcaaagggcatt

SEQ ID NO: 647767 - DNA, 25 bp, Rattus norvegicus
aaagggcattgtgttcccggcttgc

SEQ ID NO: 647768 - DNA, 25 bp, Rattus norvegicus
gccgtcgccagacaagcgccgataa

SEQ ID NO: 647769 - DNA, 25 bp, Rattus norvegicus
tagcaagagttgctcgcaggtcttc

SEQ ID NO: 647770 - DNA, 25 bp, Rattus norvegicus
gaacaggctccaacctgtgcgccta

SEQ ID NO: 647771 - DNA, 25 bp, Rattus norvegicus
gtgcgcctagaacaagaaaaccctc

SEQ ID NO: 647772 - DNA, 25 bp, Rattus norvegicus
agaaaaccctccagaaacacgcaag

SEQ ID NO: 647773 - DNA, 25 bp, Rattus norvegicus
aaacacgcaagggttggcctcactg

SEQ ID NO: 647774 - DNA, 25 bp, Rattus norvegicus
agccttttctcccttgactagcaag

SEQ ID NO: 647775 - DNA, 25 bp, Rattus norvegicus
cccgccaggagctgtgaacaggctc

SEQ ID NO: 647776 - DNA, 25 bp, Rattus norvegicus
atgcagccgtacgatgacatgtacc

SEQ ID NO: 647777 - DNA, 25 bp, Rattus norvegicus
ctctgcccgagaaagactgagaatt

SEQ ID NO: 647778 - DNA, 25 bp, Rattus norvegicus
aagggcctcacgtcagcgtctctgt

SEQ ID NO: 647779 - DNA, 25 bp, Rattus norvegicus
tgagtatgtcgtccagcatggtgcc

SEQ ID NO: 647780 - DNA, 25 bp, Rattus norvegicus
ggctccagcctcaatagcctgaata

SEQ ID NO: 647781 - DNA, 25 bp, Rattus norvegicus
taacttgaacaacctgagcagcccg

SEQ ID NO: 647782 - DNA, 25 bp, Rattus norvegicus
agcagcccgtcgctgaattccgcgg

SEQ ID NO: 647783 - DNA, 25 bp, Rattus norvegicus
agcgcttgccagtatgcggtcgacc

SEQ ID NO: 647784 - DNA, 25 bp, Rattus norvegicus
tagggacacatgtaactcgagcctg

SEQ ID NO: 647785 - DNA, 25 bp, Rattus norvegicus
tcgagcctggccagtctgagactaa

SEQ ID NO: 647786 - DNA, 25 bp, Rattus norvegicus
ggccgagctgtgtaagaatggcttc

SEQ ID NO: 647787 - DNA, 25 bp, Rattus norvegicus
ggccgcagttcaatgggctcatgca

SEQ ID NO: 647788 - DNA, 25 bp, Rattus norvegicus
tcctccgtacgtttatagggacaca

SEQ ID NO: 647789 - DNA, 25 bp, Rattus norvegicus
cggctactcgtacaacaattgggct

SEQ ID NO: 647790 - DNA, 25 bp, Rattus norvegicus
agccaccttggtgcggtcgcccgcg

SEQ ID NO: 647791 - DNA, 25 bp, Rattus norvegicus
tgcgagggcgctcgcgacctgcctt

SEQ ID NO: 647792 - DNA, 25 bp, Rattus norvegicus
ttccctccctccattcatcaatggg

SEQ ID NO: 647793 - DNA, 25 bp, Rattus norvegicus
tcatcaatgggaaaccggagacgcc

SEQ ID NO: 647794 - DNA, 25 bp, Rattus norvegicus
atcaatgggaaaccggagacgccgg

SEQ ID NO: 647795 - DNA, 25 bp, Rattus norvegicus
acccttggccttcagcttgcgagtt

SEQ ID NO: 647796 - DNA, 25 bp, Rattus norvegicus
ggccttcagcttgcgagttgggccc

SEQ ID NO: 647797 - DNA, 25 bp, Rattus norvegicus
gcgaccgggcggagccaagactccg

SEQ ID NO: 647798 - DNA, 25 bp, Rattus norvegicus
ccaagactccggggcgcgcgagttt

SEQ ID NO: 647799 - DNA, 25 bp, Rattus norvegicus
atcgccctgtaagggggcggccatt

SEQ ID NO: 647800 - DNA, 25 bp, Rattus norvegicus
tagcatggcggctgcctgcctgaag

SEQ ID NO: 647801 - DNA, 25 bp, Rattus norvegicus
cccgcgtcctccaggaagccgaggc

SEQ ID NO: 647802 - DNA, 25 bp, Rattus norvegicus
acccgcggggagtctggatcgccct

SEQ ID NO: 647803 - DNA, 25 bp, Rattus norvegicus
cgcgagtttgggctgtagcatggcg

SEQ ID NO: 647804 - DNA, 25 bp, Rattus norvegicus
gctctctccggcctggtgaaataga

SEQ ID NO: 647805 - DNA, 25 bp, Rattus norvegicus
gccttcccgaagagagcatacagca

SEQ ID NO: 647806 - DNA, 25 bp, Rattus norvegicus
tccgcctcggaaagacatgctctct

SEQ ID NO: 647807 - DNA, 25 bp, Rattus norvegicus
tggtgaaatagacggccggctcctt

SEQ ID NO: 647808 - DNA, 25 bp, Rattus norvegicus
cgcctcgctcgaaacaccaaaaaga

SEQ ID NO: 647809 - DNA, 25 bp, Rattus norvegicus
ccttccagtcagtgcgggctgatca

SEQ ID NO: 647810 - DNA, 25 bp, Rattus norvegicus
tgcaggaagaggctgtcactactta

SEQ ID NO: 647811 - DNA, 25 bp, Rattus norvegicus
aaatagcagcgccttccgtactcga

SEQ ID NO: 647812 - DNA, 25 bp, Rattus norvegicus
ccgtactcgacgcttccggaagtgt

SEQ ID NO: 647813 - DNA, 25 bp, Rattus norvegicus
tcttcggctctaatcgctggtcagg

SEQ ID NO: 647814 - DNA, 25 bp, Rattus norvegicus
ctctgtcacttcttgggttgcgaga

SEQ ID NO: 647815 - DNA, 25 bp, Rattus norvegicus
ttgcgagaaggtcccgacttgactc

SEQ ID NO: 647816 - DNA, 25 bp, Rattus norvegicus
tctgctccacggagtgtggccactc

SEQ ID NO: 647817 - DNA, 25 bp, Rattus norvegicus
ggagcgatacttccggcgcgcttaa

SEQ ID NO: 647818 - DNA, 25 bp, Rattus norvegicus
gccagtacaagtgtagcgacggtga

SEQ ID NO: 647819 - DNA, 25 bp, Rattus norvegicus
gacgggctctgccagtacaagtgta

SEQ ID NO: 647820 - DNA, 25 bp, Rattus norvegicus
ctcgcggccaggaacaggaccagac

SEQ ID NO: 647821 - DNA, 25 bp, Rattus norvegicus
gatagacacgtacctcaacgccgcg

SEQ ID NO: 647822 - DNA, 25 bp, Rattus norvegicus
tccgaaacggcatccacaagataga

SEQ ID NO: 647823 - DNA, 25 bp, Rattus norvegicus
actggagggccaccctcaagaccat

SEQ ID NO: 647824 - DNA, 25 bp, Rattus norvegicus
gaacaggaccagaccaccgactgga

SEQ ID NO: 647825 - DNA, 25 bp, Rattus norvegicus
tgctcttgctggtcaccgctcgcgg

SEQ ID NO: 647826 - DNA, 25 bp, Rattus norvegicus
tgggcaaggaggtcgccagccctct

SEQ ID NO: 647827 - DNA, 25 bp, Rattus norvegicus
ggcgtttttacgactccacagaggc

SEQ ID NO: 647828 - DNA, 25 bp, Rattus norvegicus
cacagaggcaggacggaaagctacc

SEQ ID NO: 647829 - DNA, 25 bp, Rattus norvegicus
agcattccggagaccacgtgggcaa

SEQ ID NO: 647830 - DNA, 25 bp, Rattus norvegicus
gaaagctacccgagcattccggaga

SEQ ID NO: 647831 - DNA, 25 bp, Rattus norvegicus
gcatgcgcactgtgcaggacgcgcc

SEQ ID NO: 647832 - DNA, 25 bp, Rattus norvegicus
gggagcatcctcctgccggtccgag

SEQ ID NO: 647833 - DNA, 25 bp, Rattus norvegicus
cacgcagggaactgctcggctttca

SEQ ID NO: 647834 - DNA, 25 bp, Rattus norvegicus
tcggctttcactccctccaaagttg

SEQ ID NO: 647835 - DNA, 25 bp, Rattus norvegicus
agttgcccgacgcaaactttccatc

SEQ ID NO: 647836 - DNA, 25 bp, Rattus norvegicus
gcaaactttccatccgagactctcg

SEQ ID NO: 647837 - DNA, 25 bp, Rattus norvegicus
cgcgctgcctcttacctggggcgtg

SEQ ID NO: 647838 - DNA, 25 bp, Rattus norvegicus
ggtggcagagccctcggacaccagc

SEQ ID NO: 647839 - DNA, 25 bp, Rattus norvegicus
cgacccagacagagccggctcggga

SEQ ID NO: 647840 - DNA, 25 bp, Rattus norvegicus
gagctcctggcactagcgacgcatc

SEQ ID NO: 647841 - DNA, 25 bp, Rattus norvegicus
gcgacgcatcatccggccgctagag

SEQ ID NO: 647842 - DNA, 25 bp, Rattus norvegicus
gctttgacttcgcttggtgcacacc

SEQ ID NO: 647843 - DNA, 25 bp, Rattus norvegicus
tcctccgacgaaaaagaaagagcga

SEQ ID NO: 647844 - DNA, 25 bp, Rattus norvegicus
tacagacctcccgacacagcggtgg

SEQ ID NO: 647845 - DNA, 25 bp, Rattus norvegicus
gttcggatcggcatcagtcgccacc

SEQ ID NO: 647846 - DNA, 25 bp, Rattus norvegicus
ccctcctagtgacagcctcgaagaa

SEQ ID NO: 647847 - DNA, 25 bp, Rattus norvegicus
tacagccgctccgtgtgatgcagca

SEQ ID NO: 647848 - DNA, 25 bp, Rattus norvegicus
agccggaaacactgagccaggggta

SEQ ID NO: 647849 - DNA, 25 bp, Rattus norvegicus
cggaagcgctctagttccgggctga

SEQ ID NO: 647850 - DNA, 25 bp, Rattus norvegicus
ctaaggagaaccaagcggaagcgct

SEQ ID NO: 647851 - DNA, 25 bp, Rattus norvegicus
ccaagggatcagagaactaaggaga

SEQ ID NO: 647852 - DNA, 25 bp, Rattus norvegicus
cagcctcgaagaagccaagggatca

SEQ ID NO: 647853 - DNA, 25 bp, Rattus norvegicus
gccatgtcgtcccaaagtcggcggc

SEQ ID NO: 647854 - DNA, 25 bp, Rattus norvegicus
ctgcttaagacaacaccggtgcccg

SEQ ID NO: 647855 - DNA, 25 bp, Rattus norvegicus
acttctccacctttcgccttagttg

SEQ ID NO: 647856 - DNA, 25 bp, Rattus norvegicus
ggttattgctctcggcgttctggta

SEQ ID NO: 647857 - DNA, 25 bp, Rattus norvegicus
cgtgcggagttcctggttattgctc

SEQ ID NO: 647858 - DNA, 25 bp, Rattus norvegicus
tgcgagctaggggacaaagccaacc

SEQ ID NO: 647859 - DNA, 25 bp, Rattus norvegicus
tttcgccttagttgcgccagctccg

SEQ ID NO: 647860 - DNA, 25 bp, Rattus norvegicus
gatctgcgggcgctccaggctttcc

SEQ ID NO: 647861 - DNA, 25 bp, Rattus norvegicus
atgtgctgctggcatctgcactcgg

SEQ ID NO: 647862 - DNA, 25 bp, Rattus norvegicus
ttaggaagcccgcactcagtaggac

SEQ ID NO: 647863 - DNA, 25 bp, Rattus norvegicus
cgagtccctcgggtggcccacagag

SEQ ID NO: 647864 - DNA, 25 bp, Rattus norvegicus
caggcgcaatcgtgtcgctcgcggt

SEQ ID NO: 647865 - DNA, 25 bp, Rattus norvegicus
ctcgcggtgtctcgagttggcgtcc

SEQ ID NO: 647866 - DNA, 25 bp, Rattus norvegicus
ctggggattaccgaggcttcctgca

SEQ ID NO: 647867 - DNA, 25 bp, Rattus norvegicus
attaccgaggcttcctgcagtgctg

SEQ ID NO: 647868 - DNA, 25 bp, Rattus norvegicus
ccgaggcttcctgcagtgctgggat

SEQ ID NO: 647869 - DNA, 25 bp, Rattus norvegicus
cgagagccggcgacacctgtcgcag

SEQ ID NO: 647870 - DNA, 25 bp, Rattus norvegicus
gcagccatagttgcagtgccgcgga

SEQ ID NO: 647871 - DNA, 25 bp, Rattus norvegicus
cgacacctgtcgcagccatagttgc

SEQ ID NO: 647872 - DNA, 25 bp, Rattus norvegicus
aggtctccgccatgtgctgctggca

SEQ ID NO: 647873 - DNA, 25 bp, Rattus norvegicus
gccgggaactaggtctccgccatgt

SEQ ID NO: 647874 - DNA, 25 bp, Rattus norvegicus
aggcctggatggcagaccgccgaca

SEQ ID NO: 647875 - DNA, 25 bp, Rattus norvegicus
ggccagagactgctccgccgagctt

SEQ ID NO: 647876 - DNA, 25 bp, Rattus norvegicus
aagaggaaggaacgcgcccgcgtca

SEQ ID NO: 647877 - DNA, 25 bp, Rattus norvegicus
gtcacaggccgagtcactctcacta

SEQ ID NO: 647878 - DNA, 25 bp, Rattus norvegicus
agtcactctcactaaggaccgcggc

SEQ ID NO: 647879 - DNA, 25 bp, Rattus norvegicus
tgcaggccggagctggcgaccacct

SEQ ID NO: 647880 - DNA, 25 bp, Rattus norvegicus
ctgtggccgccgctacccggatgga

SEQ ID NO: 647881 - DNA, 25 bp, Rattus norvegicus
ctgcagggctgcagaacggtgaaaa

SEQ ID NO: 647882 - DNA, 25 bp, Rattus norvegicus
tccacgcggaatggcaggcctggat

SEQ ID NO: 647883 - DNA, 25 bp, Rattus norvegicus
cacggcctcggtccacgcggaatgg

SEQ ID NO: 647884 - DNA, 25 bp, Rattus norvegicus
cctaggtcggagctgactgtcctgc

SEQ ID NO: 647885 - DNA, 25 bp, Rattus norvegicus
gtcctgtgagctctcggcggtgaaa

SEQ ID NO: 647886 - DNA, 25 bp, Rattus norvegicus
tgcgatccaccaagtaccaaggctg

SEQ ID NO: 647887 - DNA, 25 bp, Rattus norvegicus
gggccggaaggatgcgatccaccaa

SEQ ID NO: 647888 - DNA, 25 bp, Rattus norvegicus
gcgacgccgagtgttcctccctaaa

SEQ ID NO: 647889 - DNA, 25 bp, Rattus norvegicus
tcacggggatcagatcagttaggtg

SEQ ID NO: 647890 - DNA, 25 bp, Rattus norvegicus
gccgagtgttcctccctaaacactg

SEQ ID NO: 647891 - DNA, 25 bp, Rattus norvegicus
cagttaggtgaaggaaagcgacgcc

SEQ ID NO: 647892 - DNA, 25 bp, Rattus norvegicus
acaagcagggccctacggagctgca

SEQ ID NO: 647893 - DNA, 25 bp, Rattus norvegicus
ccctgtgagcgggaagccacaagca

SEQ ID NO: 647894 - DNA, 25 bp, Rattus norvegicus
cacacttcgtccctgtgagcgggaa

SEQ ID NO: 647895 - DNA, 25 bp, Rattus norvegicus
tgggcagcacacttcgtccctgtga

SEQ ID NO: 647896 - DNA, 25 bp, Rattus norvegicus
tttaggcagccgtgggagtcacact

SEQ ID NO: 647897 - DNA, 25 bp, Rattus norvegicus
cgttggtccgttttaggcagccgtg

SEQ ID NO: 647898 - DNA, 25 bp, Rattus norvegicus
accgtgacggtatgtcggtcttcac

SEQ ID NO: 647899 - DNA, 25 bp, Rattus norvegicus
gagtcacactgtgggcagcacactt

SEQ ID NO: 647900 - DNA, 25 bp, Rattus norvegicus
ctaaacactgcggtccgttggtccg

SEQ ID NO: 647901 - DNA, 25 bp, Rattus norvegicus
tatgtcggtcttcacggggatcaga

SEQ ID NO: 647902 - DNA, 25 bp, Rattus norvegicus
cccggggtatttaaggctcacatgc

SEQ ID NO: 647903 - DNA, 25 bp, Rattus norvegicus
ctgggcgaaggtgaatatattatgc

SEQ ID NO: 647904 - DNA, 25 bp, Rattus norvegicus
caggcaggctcaacaggtcggagca

SEQ ID NO: 647905 - DNA, 25 bp, Rattus norvegicus
ccttgaactgatccaggtgggagac

SEQ ID NO: 647906 - DNA, 25 bp, Rattus norvegicus
cgctgggtctctgcatttccttttc

SEQ ID NO: 647907 - DNA, 25 bp, Rattus norvegicus
cggagatactttcggggcctcgcag

SEQ ID NO: 647908 - DNA, 25 bp, Rattus norvegicus
cactcgagagcatcccggggtattt

SEQ ID NO: 647909 - DNA, 25 bp, Rattus norvegicus
gcgcgcactgtctcactcgagagca

SEQ ID NO: 647910 - DNA, 25 bp, Rattus norvegicus
attatgctaataaggaggctcctgc

SEQ ID NO: 647911 - DNA, 25 bp, Rattus norvegicus
ctgccctggtgggtttcatttcagc

SEQ ID NO: 647912 - DNA, 25 bp, Rattus norvegicus
cttttcactcctagctggaagggga

SEQ ID NO: 647913 - DNA, 25 bp, Rattus norvegicus
tgccggagggtgcttttcactccta

SEQ ID NO: 647914 - DNA, 25 bp, Rattus norvegicus
aaggaatctggaggacggtccacgc

SEQ ID NO: 647915 - DNA, 25 bp, Rattus norvegicus
accactaaggaggtgtcggattttg

SEQ ID NO: 647916 - DNA, 25 bp, Rattus norvegicus
ttcagcttcaagttggggcattcga

SEQ ID NO: 647917 - DNA, 25 bp, Rattus norvegicus
aaagtaagataccaccaccagggcg

SEQ ID NO: 647918 - DNA, 25 bp, Rattus norvegicus
atagccgacggcatgtgcacccagg

SEQ ID NO: 647919 - DNA, 25 bp, Rattus norvegicus
gcacccagggcggtttcttcagctt

SEQ ID NO: 647920 - DNA, 25 bp, Rattus norvegicus
agggcggtttcttcagcttcaagtt

SEQ ID NO: 647921 - DNA, 25 bp, Rattus norvegicus
gcgtacaccgtcatagccgacggca

SEQ ID NO: 647922 - DNA, 25 bp, Rattus norvegicus
ttggggcattcgagcactaaaaacg

SEQ ID NO: 647923 - DNA, 25 bp, Rattus norvegicus
cattcgagcactaaaaacgggactc

SEQ ID NO: 647924 - DNA, 25 bp, Rattus norvegicus
aacgggactcggtacagagtctcca

SEQ ID NO: 647925 - DNA, 25 bp, Rattus norvegicus
actcggtacagagtctccatgtccc

SEQ ID NO: 647926 - DNA, 25 bp, Rattus norvegicus
agccgtaggaccagccttctggcct

SEQ ID NO: 647927 - DNA, 25 bp, Rattus norvegicus
gccttccctagctattgcgcatgcg

SEQ ID NO: 647928 - DNA, 25 bp, Rattus norvegicus
tattgcgcatgcgtgagccgaggac

SEQ ID NO: 647929 - DNA, 25 bp, Rattus norvegicus
catcacggccgagttacctccggta

SEQ ID NO: 647930 - DNA, 25 bp, Rattus norvegicus
gcgggcgagttcaaaggtcaaatgt

SEQ ID NO: 647931 - DNA, 25 bp, Rattus norvegicus
gctatcgcgtctcgctcgcttacta

SEQ ID NO: 647932 - DNA, 25 bp, Rattus norvegicus
ttcgatcgagggctttccgaaacta

SEQ ID NO: 647933 - DNA, 25 bp, Rattus norvegicus
cacagagccgaaacaggccaccata

SEQ ID NO: 647934 - DNA, 25 bp, Rattus norvegicus
tcaaatgtgactgcgtcggacagga

SEQ ID NO: 647935 - DNA, 25 bp, Rattus norvegicus
agtacgtcagagaaagcggcatgtc

SEQ ID NO: 647936 - DNA, 25 bp, Rattus norvegicus
gagtgcgccgccatgttgtacggaa

SEQ ID NO: 647937 - DNA, 25 bp, Rattus norvegicus
acttcaggtttgtagtgcggcttcc

SEQ ID NO: 647938 - DNA, 25 bp, Rattus norvegicus
cgggctcgttttccagccacacgta

SEQ ID NO: 647939 - DNA, 25 bp, Rattus norvegicus
tcgcttactagccaccatgacagac

SEQ ID NO: 647940 - DNA, 25 bp, Rattus norvegicus
catgacagacagcaacaggggagca

SEQ ID NO: 647941 - DNA, 25 bp, Rattus norvegicus
gtcgcttaagcgcttcacaaccacg

SEQ ID NO: 647942 - DNA, 25 bp, Rattus norvegicus
ggctccactgttccggtcgcttaag

SEQ ID NO: 647943 - DNA, 25 bp, Rattus norvegicus
tcctcggatgggtacggatcgtaaa

SEQ ID NO: 647944 - DNA, 25 bp, Rattus norvegicus
gtcgtttatatttttagcaagtgtc

SEQ ID NO: 647945 - DNA, 25 bp, Rattus norvegicus
ggctgcacgctggactcttgaaacg

SEQ ID NO: 647946 - DNA, 25 bp, Rattus norvegicus
ggactcttgaaacgctctctttggc

SEQ ID NO: 647947 - DNA, 25 bp, Rattus norvegicus
aaacgctctctttggcttcgtccta

SEQ ID NO: 647948 - DNA, 25 bp, Rattus norvegicus
taccgctccacaccgggtataggct

SEQ ID NO: 647949 - DNA, 25 bp, Rattus norvegicus
ttaagcagcttaggaaatcggattg

SEQ ID NO: 647950 - DNA, 25 bp, Rattus norvegicus
aaatcggattgcttgcgtaacttgc

SEQ ID NO: 647951 - DNA, 25 bp, Rattus norvegicus
cttgctccgggagtcgtttatattt

SEQ ID NO: 647952 - DNA, 25 bp, Rattus norvegicus
gtgtctttacacaatcgcggcagga

SEQ ID NO: 647953 - DNA, 25 bp, Rattus norvegicus
cgcggcaggaagcatgctcaaagtt

SEQ ID NO: 647954 - DNA, 25 bp, Rattus norvegicus
gcatgctcaaagttggcagcggaga

SEQ ID NO: 647955 - DNA, 25 bp, Rattus norvegicus
ggagaggcaatttccgcgtcctgtt

SEQ ID NO: 647956 - DNA, 25 bp, Rattus norvegicus
caatttccgcgtcctgtttacctgg

SEQ ID NO: 647957 - DNA, 25 bp, Rattus norvegicus
attgcttgcgtaacttgctccggga

SEQ ID NO: 647958 - DNA, 25 bp, Rattus norvegicus
agtcggtgcccacgccacaattgag

SEQ ID NO: 647959 - DNA, 25 bp, Rattus norvegicus
taaactagcggatcctcggctggca

SEQ ID NO: 647960 - DNA, 25 bp, Rattus norvegicus
aggggacgtgctttccacaagtcgg

SEQ ID NO: 647961 - DNA, 25 bp, Rattus norvegicus
tttctagtcctttctcggccgtctc

SEQ ID NO: 647962 - DNA, 25 bp, Rattus norvegicus
gctcacagatttagcatcctgcgga

SEQ ID NO: 647963 - DNA, 25 bp, Rattus norvegicus
tccgcgacgtcggttaaactgaaga

SEQ ID NO: 647964 - DNA, 25 bp, Rattus norvegicus
gtgctcgaatcacccgcccgggaga

SEQ ID NO: 647965 - DNA, 25 bp, Rattus norvegicus
agcagagtggatggtgctccctcca

SEQ ID NO: 647966 - DNA, 25 bp, Rattus norvegicus
cgccctccgccgataaaaggcgaga

SEQ ID NO: 647967 - DNA, 25 bp, Rattus norvegicus
gattattcgctggtctccaccactg

SEQ ID NO: 647968 - DNA, 25 bp, Rattus norvegicus
cttcccggtgcagagctggactcct

SEQ ID NO: 647969 - DNA, 25 bp, Rattus norvegicus
tgtcccgatgccacgcaggctcttt

SEQ ID NO: 647970 - DNA, 25 bp, Rattus norvegicus
cccagaaccgaagtccaagtgtggc

SEQ ID NO: 647971 - DNA, 25 bp, Rattus norvegicus
cctggggttgacatcccacggagca

SEQ ID NO: 647972 - DNA, 25 bp, Rattus norvegicus
cccagaaggagaagattttcgccga

SEQ ID NO: 647973 - DNA, 25 bp, Rattus norvegicus
ttactcagaaggaagtggacttttc

SEQ ID NO: 647974 - DNA, 25 bp, Rattus norvegicus
tgattttcctcgcacctccgcggag

SEQ ID NO: 647975 - DNA, 25 bp, Rattus norvegicus
gcaaacggagccttcttgaaccagc

SEQ ID NO: 647976 - DNA, 25 bp, Rattus norvegicus
caccgaaatcagcatccgaggaatc

SEQ ID NO: 647977 - DNA, 25 bp, Rattus norvegicus
cgggactctcgtttgcactttggaa

SEQ ID NO: 647978 - DNA, 25 bp, Rattus norvegicus
gaaccggtgtcctcggagcacagac

SEQ ID NO: 647979 - DNA, 25 bp, Rattus norvegicus
cagtctagcctagtgcacgcggagc

SEQ ID NO: 647980 - DNA, 25 bp, Rattus norvegicus
gagtccgaaatcatcccagccagca

SEQ ID NO: 647981 - DNA, 25 bp, Rattus norvegicus
agaggctcttgcagctgctccagtc

SEQ ID NO: 647982 - DNA, 25 bp, Rattus norvegicus
agtcatccttggtaaacgagtccga

SEQ ID NO: 647983 - DNA, 25 bp, Rattus norvegicus
gcagcgggcagggaaatttattcca

SEQ ID NO: 647984 - DNA, 25 bp, Rattus norvegicus
cgggtggctctttattgtttactca

SEQ ID NO: 647985 - DNA, 25 bp, Rattus norvegicus
ttctaagtgggaaagcgcggcaatc

SEQ ID NO: 647986 - DNA, 25 bp, Rattus norvegicus
gcctggtcacgaacgccatagctca

SEQ ID NO: 647987 - DNA, 25 bp, Rattus norvegicus
acagcgcgagaggtcccagagcttc

SEQ ID NO: 647988 - DNA, 25 bp, Rattus norvegicus
cgagaaacagcagccgggacagcgc

SEQ ID NO: 647989 - DNA, 25 bp, Rattus norvegicus
tggagcagccgagaaacagcagccg

SEQ ID NO: 647990 - DNA, 25 bp, Rattus norvegicus
cacgaacgccatagctcagtggagc

SEQ ID NO: 647991 - DNA, 25 bp, Rattus norvegicus
gaattgcctggtcacgaacgccata

SEQ ID NO: 647992 - DNA, 25 bp, Rattus norvegicus
agcgcacgaattgcctggtcacgaa

SEQ ID NO: 647993 - DNA, 25 bp, Rattus norvegicus
ggacatggagcgcacgaattgcctg

SEQ ID NO: 647994 - DNA, 25 bp, Rattus norvegicus
tgatcaggatcttcttggcggccgc

SEQ ID NO: 647995 - DNA, 25 bp, Rattus norvegicus
cgtcacatgcttgatcaggatcttc

SEQ ID NO: 647996 - DNA, 25 bp, Rattus norvegicus
gatgaccgtcacatgcttgatcagg

SEQ ID NO: 647997 - DNA, 25 bp, Rattus norvegicus
ccgccgatgaccgtcacatgcttga

SEQ ID NO: 647998 - DNA, 25 bp, Rattus norvegicus
agctcagtggagcagccgagaaaca

SEQ ID NO: 647999 - DNA, 25 bp, Rattus norvegicus
tcacctgcgcgatgccggcgcccat

SEQ ID NO: 648000 - DNA, 25 bp, Rattus norvegicus
ccgatgaagaagctgaagatgttgc

SEQ ID NO: 648001 - DNA, 25 bp, Rattus norvegicus
ctatgtggccgccagactctagctc

SEQ ID NO: 648002 - DNA, 25 bp, Rattus norvegicus
ggtcactgaacacttcggcctgctg

SEQ ID NO: 648003 - DNA, 25 bp, Rattus norvegicus
tcgctgaggaccaccaccagacggt

SEQ ID NO: 648004 - DNA, 25 bp, Rattus norvegicus
ctcacccttctccttggtcaagatg

SEQ ID NO: 648005 - DNA, 25 bp, Rattus norvegicus
gttgccatagacacgggccagcctg

SEQ ID NO: 648006 - DNA, 25 bp, Rattus norvegicus
ctccagtcagctgctcctgcgtagg

SEQ ID NO: 648007 - DNA, 25 bp, Rattus norvegicus
ggccagcctggccaggtacacatgc

SEQ ID NO: 648008 - DNA, 25 bp, Rattus norvegicus
cacatgccggcctactgtgtcggtc

SEQ ID NO: 648009 - DNA, 25 bp, Rattus norvegicus
agccagaagtgcagccgtaggaagc

SEQ ID NO: 648010 - DNA, 25 bp, Rattus norvegicus
cggcagcagcaagtacccgaagtta

SEQ ID NO: 648011 - DNA, 25 bp, Rattus norvegicus
tgcagccaaacccagtccagcagga

SEQ ID NO: 648012 - DNA, 25 bp, Rattus norvegicus
cccgatcgaggacatgctctatgtg

SEQ ID NO: 648013 - DNA, 25 bp, Rattus norvegicus
cacgctctggaagtcgctgaggacc

SEQ ID NO: 648014 - DNA, 25 bp, Rattus norvegicus
cagtccagttccaggaacccgcagg

SEQ ID NO: 648015 - DNA, 25 bp, Rattus norvegicus
ctcctgcggggtcaccttggccaga

SEQ ID NO: 648016 - DNA, 25 bp, Rattus norvegicus
cccacggctcttggcagccgcggag

SEQ ID NO: 648017 - DNA, 25 bp, Rattus norvegicus
ccgcggaggtggtagaaatgcctct

SEQ ID NO: 648018 - DNA, 25 bp, Rattus norvegicus
ttttcgatcccgacaggttcgaggc

SEQ ID NO: 648019 - DNA, 25 bp, Rattus norvegicus
ggtggtagaaatgcctctctgaagg

SEQ ID NO: 648020 - DNA, 25 bp, Rattus norvegicus
aatgcctctctgaaggccctccttt

SEQ ID NO: 648021 - DNA, 25 bp, Rattus norvegicus
cgatcccgacaggttcgaggccacg

SEQ ID NO: 648022 - DNA, 25 bp, Rattus norvegicus
ccagttccaggaacccgcaggcaga

SEQ ID NO: 648023 - DNA, 25 bp, Rattus norvegicus
agaggccttttcgatcccgacaggt

SEQ ID NO: 648024 - DNA, 25 bp, Rattus norvegicus
ggaacccgcaggcagaggccttttc

SEQ ID NO: 648025 - DNA, 25 bp, Rattus norvegicus
cccgcaggcagaggccttttcgatc

SEQ ID NO: 648026 - DNA, 25 bp, Rattus norvegicus
ggcagaggccttttcgatcccgaca

SEQ ID NO: 648027 - DNA, 25 bp, Rattus norvegicus
gcggggacccttgcctcctcctgcg

SEQ ID NO: 648028 - DNA, 25 bp, Rattus norvegicus
gaacggagcgttttgatcatgagca

SEQ ID NO: 648029 - DNA, 25 bp, Rattus norvegicus
ttgatcatgagcacgtaggcagacg

SEQ ID NO: 648030 - DNA, 25 bp, Rattus norvegicus
accgtgatgatgaggcggatagccc

SEQ ID NO: 648031 - DNA, 25 bp, Rattus norvegicus
atgaagtacatggacagcaccgtga

SEQ ID NO: 648032 - DNA, 25 bp, Rattus norvegicus
taatgcacgacgagcagcacgttgc

SEQ ID NO: 648033 - DNA, 25 bp, Rattus norvegicus
cttttgatgaggaaataatgcacga

SEQ ID NO: 648034 - DNA, 25 bp, Rattus norvegicus
ggctctgcctctggcttttgatgag

SEQ ID NO: 648035 - DNA, 25 bp, Rattus norvegicus
agggcgtagacgtggctctgcctct

SEQ ID NO: 648036 - DNA, 25 bp, Rattus norvegicus
tctatgcagctgttgagggtggaca

SEQ ID NO: 648037 - DNA, 25 bp, Rattus norvegicus
gacaaaggggtctatgcagctgttg

SEQ ID NO: 648038 - DNA, 25 bp, Rattus norvegicus
ctggcctggtccctgaaatctttcg

SEQ ID NO: 648039 - DNA, 25 bp, Rattus norvegicus
acgcttcggcagaggagcgcgtttc

SEQ ID NO: 648040 - DNA, 25 bp, Rattus norvegicus
atgcgtttcacggtgcggacgcttc

SEQ ID NO: 648041 - DNA, 25 bp, Rattus norvegicus
atatctgcatgcgtttcacggtgcg

SEQ ID NO: 648042 - DNA, 25 bp, Rattus norvegicus
gagtctctccggacgcctaaccgag

SEQ ID NO: 648043 - DNA, 25 bp, Rattus norvegicus
tgcgcgctcctgacatcattcattc

SEQ ID NO: 648044 - DNA, 25 bp, Rattus norvegicus
gacatcattcattctcgcactctcg

SEQ ID NO: 648045 - DNA, 25 bp, Rattus norvegicus
tccggacgcctaaccgagctcgaaa

SEQ ID NO: 648046 - DNA, 25 bp, Rattus norvegicus
gagctcgaaaaaccggtgcgacttc

SEQ ID NO: 648047 - DNA, 25 bp, Rattus norvegicus
gacttcttcggggaggcgatcccag

SEQ ID NO: 648048 - DNA, 25 bp, Rattus norvegicus
ctctgcggccctagaagatgcagcg

SEQ ID NO: 648049 - DNA, 25 bp, Rattus norvegicus
ggaaagttctctgggtgccgctccc

SEQ ID NO: 648050 - DNA, 25 bp, Rattus norvegicus
ggtgccgctcccagtaactttcagg

SEQ ID NO: 648051 - DNA, 25 bp, Rattus norvegicus
cgctcccagtaactttcaggggtgg

SEQ ID NO: 648052 - DNA, 25 bp, Rattus norvegicus
gcagggaagggataagccacctcca

SEQ ID NO: 648053 - DNA, 25 bp, Rattus norvegicus
tttcggaaactgcttcctaattgcg

SEQ ID NO: 648054 - DNA, 25 bp, Rattus norvegicus
ttcctaattgcgacgtgtgcgggcc

SEQ ID NO: 648055 - DNA, 25 bp, Rattus norvegicus
cggggatcaatctgggaaagttctc

SEQ ID NO: 648056 - DNA, 25 bp, Rattus norvegicus
acactgggtaccaagtgtggtcggt

SEQ ID NO: 648057 - DNA, 25 bp, Rattus norvegicus
gctctgtgggcactgggaaccacca

SEQ ID NO: 648058 - DNA, 25 bp, Rattus norvegicus
tgcggggttttctggttcgcccaga

SEQ ID NO: 648059 - DNA, 25 bp, Rattus norvegicus
cacacaaacacactgggtaccaagt

SEQ ID NO: 648060 - DNA, 25 bp, Rattus norvegicus
agctgaggctgcacccgctttcagc

SEQ ID NO: 648061 - DNA, 25 bp, Rattus norvegicus
ttctggttcgcccagagctgaggct

SEQ ID NO: 648062 - DNA, 25 bp, Rattus norvegicus
cacgttcaacagatgcggggttttc

SEQ ID NO: 648063 - DNA, 25 bp, Rattus norvegicus
cacgggcggagttgcacgttcaaca

SEQ ID NO: 648064 - DNA, 25 bp, Rattus norvegicus
ttcacgcgtgtcaaccacgggcgga

SEQ ID NO: 648065 - DNA, 25 bp, Rattus norvegicus
agcacatgcacctttcacgcgtgtc

SEQ ID NO: 648066 - DNA, 25 bp, Rattus norvegicus
tgtttgccaaaacagcacatgcacc

SEQ ID NO: 648067 - DNA, 25 bp, Rattus norvegicus
tgggcactgggaaccaccacagctc

SEQ ID NO: 648068 - DNA, 25 bp, Rattus norvegicus
agctccaccttccgcttcttttggg

SEQ ID NO: 648069 - DNA, 25 bp, Rattus norvegicus
ggggaagcctgtttgccaaaacagc

SEQ ID NO: 648070 - DNA, 25 bp, Rattus norvegicus
gctccggctgtcatcttccatgggc

SEQ ID NO: 648071 - DNA, 25 bp, Rattus norvegicus
tccatgggcggcctcttgtagacgc

SEQ ID NO: 648072 - DNA, 25 bp, Rattus norvegicus
tggggtcttccctcggcgttgcgtc

SEQ ID NO: 648073 - DNA, 25 bp, Rattus norvegicus
tcggcgttgcgtctcggagatataa

SEQ ID NO: 648074 - DNA, 25 bp, Rattus norvegicus
tgcgtctcggagatataacgtcatg

SEQ ID NO: 648075 - DNA, 25 bp, Rattus norvegicus
tctcggagatataacgtcatgatta

SEQ ID NO: 648076 - DNA, 25 bp, Rattus norvegicus
ataacgtcatgattagcggccgacc

SEQ ID NO: 648077 - DNA, 25 bp, Rattus norvegicus
acgtcatgattagcggccgaccgga

SEQ ID NO: 648078 - DNA, 25 bp, Rattus norvegicus
gcgcgctcacacacaagttctgagc

SEQ ID NO: 648079 - DNA, 25 bp, Rattus norvegicus
gctcacacacaagttctgagctgtg

SEQ ID NO: 648080 - DNA, 25 bp, Rattus norvegicus
tctgagctgtgaacctgttcggccc

SEQ ID NO: 648081 - DNA, 25 bp, Rattus norvegicus
tgtcgctccggctgtcatcttccat

SEQ ID NO: 648082 - DNA, 25 bp, Rattus norvegicus
tgtcatcttccatgggcggcctctt

SEQ ID NO: 648083 - DNA, 25 bp, Rattus norvegicus
tgtgaacctgttcggcccgcgcgga

SEQ ID NO: 648084 - DNA, 25 bp, Rattus norvegicus
gccactaggagcacagccatgccgg

SEQ ID NO: 648085 - DNA, 25 bp, Rattus norvegicus
ggacggacacacgaagcgcctcctt

SEQ ID NO: 648086 - DNA, 25 bp, Rattus norvegicus
catttgttcccgagacggtcctcgc

SEQ ID NO: 648087 - DNA, 25 bp, Rattus norvegicus
gcgcctccttccagtactcatgttg

SEQ ID NO: 648088 - DNA, 25 bp, Rattus norvegicus
gaggacgctagcaccgccactagga

SEQ ID NO: 648089 - DNA, 25 bp, Rattus norvegicus
actcatgttgagcttctgtacccac

SEQ ID NO: 648090 - DNA, 25 bp, Rattus norvegicus
ggagccctcaggtgccatttgttcc

SEQ ID NO: 648091 - DNA, 25 bp, Rattus norvegicus
ctttgtcgaacagccaggtcacctg

SEQ ID NO: 648092 - DNA, 25 bp, Rattus norvegicus
ggacacagtccaccctgatcactgg

SEQ ID NO: 648093 - DNA, 25 bp, Rattus norvegicus
cctgatcactggcttcgggctatag

SEQ ID NO: 648094 - DNA, 25 bp, Rattus norvegicus
agggacgctctacgcatcacctatg

SEQ ID NO: 648095 - DNA, 25 bp, Rattus norvegicus
cgttcagcacacacggggcacgagc

SEQ ID NO: 648096 - DNA, 25 bp, Rattus norvegicus
tgagcgactcaggtccctgcgggaa

SEQ ID NO: 648097 - DNA, 25 bp, Rattus norvegicus
cacctgcaggtagagcgaggacgct

SEQ ID NO: 648098 - DNA, 25 bp, Rattus norvegicus
cgagccgggattccgaagctacttc

SEQ ID NO: 648099 - DNA, 25 bp, Rattus norvegicus
catctgcaccaacgcgaaaagtctg

SEQ ID NO: 648100 - DNA, 25 bp, Rattus norvegicus
gaacggcgcgaagccttccatctgc

SEQ ID NO: 648101 - DNA, 25 bp, Rattus norvegicus
aatgtggggctggaaagactttcaa

SEQ ID NO: 648102 - DNA, 25 bp, Rattus norvegicus
agcgccctctttacctggtcgcagg

SEQ ID NO: 648103 - DNA, 25 bp, Rattus norvegicus
cctccgtactggagagtagacctca

SEQ ID NO: 648104 - DNA, 25 bp, Rattus norvegicus
agctacttctggaagccgcggcctg

SEQ ID NO: 648105 - DNA, 25 bp, Rattus norvegicus
gtcattcataatgcggcggaccgga

SEQ ID NO: 648106 - DNA, 25 bp, Rattus norvegicus
gttgtctacgtcacttcctgctgtc

SEQ ID NO: 648107 - DNA, 25 bp, Rattus norvegicus
cctgctgtctcactgggaaacgttc

SEQ ID NO: 648108 - DNA, 25 bp, Rattus norvegicus
ccgacctgttgctggaacctttgtt

SEQ ID NO: 648109 - DNA, 25 bp, Rattus norvegicus
tctctcttcttaggctggttagggc

SEQ ID NO: 648110 - DNA, 25 bp, Rattus norvegicus
acctcataatttgcgggtggttgcg

SEQ ID NO: 648111 - DNA, 25 bp, Rattus norvegicus
cctgccgacctctgagggcgaatgc

SEQ ID NO: 648112 - DNA, 25 bp, Rattus norvegicus
gtaagtcgttccactacttccgcgc

SEQ ID NO: 648113 - DNA, 25 bp, Rattus norvegicus
cgaccttgctgtcagcgcaggcgta

SEQ ID NO: 648114 - DNA, 25 bp, Rattus norvegicus
tatacagtccgccatgcgcgcgctg

SEQ ID NO: 648115 - DNA, 25 bp, Rattus norvegicus
gctgccactgctgagcgtcggccga

SEQ ID NO: 648116 - DNA, 25 bp, Rattus norvegicus
gcgtaatgtccctgtaccgcacgga

SEQ ID NO: 648117 - DNA, 25 bp, Rattus norvegicus
accgcacggaggagctgggccatcc

SEQ ID NO: 648118 - DNA, 25 bp, Rattus norvegicus
ccgctcgaaggattaccgcctgttc

SEQ ID NO: 648119 - DNA, 25 bp, Rattus norvegicus
ccgcctgttcttcagtaagtcgttc

SEQ ID NO: 648120 - DNA, 25 bp, Rattus norvegicus
gcctccgcacggacgcagaacttta

SEQ ID NO: 648121 - DNA, 25 bp, Rattus norvegicus
gcacggacgcagaactttagggacc

SEQ ID NO: 648122 - DNA, 25 bp, Rattus norvegicus
tagggaccggggtcttcgctctgaa

SEQ ID NO: 648123 - DNA, 25 bp, Rattus norvegicus
ttcgctctgaaacctcgtctgcctg

SEQ ID NO: 648124 - DNA, 25 bp, Rattus norvegicus
gaaacctcgtctgcctgcgaccttg

SEQ ID NO: 648125 - DNA, 25 bp, Rattus norvegicus
cgggtgctgctgaatccttccgcct

SEQ ID NO: 648126 - DNA, 25 bp, Rattus norvegicus
aactgcttcaggtgtcgctccatcg

SEQ ID NO: 648127 - DNA, 25 bp, Rattus norvegicus
gcgtgcttcattcggtatgttttca

SEQ ID NO: 648128 - DNA, 25 bp, Rattus norvegicus
acctgcatttttgcacgcttcgcaa

SEQ ID NO: 648129 - DNA, 25 bp, Rattus norvegicus
cgcttcgcaactgatatcctctaca

SEQ ID NO: 648130 - DNA, 25 bp, Rattus norvegicus
cctctacaggagtgtctgaatccga

SEQ ID NO: 648131 - DNA, 25 bp, Rattus norvegicus
aatccgaaggcgattctgaaacgtc

SEQ ID NO: 648132 - DNA, 25 bp, Rattus norvegicus
ctgaaacgtcggtgagaacagagtc

SEQ ID NO: 648133 - DNA, 25 bp, Rattus norvegicus
cggctgttcttttggttggcgtctt

SEQ ID NO: 648134 - DNA, 25 bp, Rattus norvegicus
tttctgaaagagacgcttgtggctc

SEQ ID NO: 648135 - DNA, 25 bp, Rattus norvegicus
gcatttgtagccgtttccacatccc

SEQ ID NO: 648136 - DNA, 25 bp, Rattus norvegicus
ccctgtctctgtgagttgagggtca

SEQ ID NO: 648137 - DNA, 25 bp, Rattus norvegicus
caggatcttatagtcgcagagcgcc

SEQ ID NO: 648138 - DNA, 25 bp, Rattus norvegicus
tcgtctcgatgatgctttccgtccg

SEQ ID NO: 648139 - DNA, 25 bp, Rattus norvegicus
agcgccttgagctggaactgcttca

SEQ ID NO: 648140 - DNA, 25 bp, Rattus norvegicus
caagccgctctccatttctccaagg

SEQ ID NO: 648141 - DNA, 25 bp, Rattus norvegicus
ttgcttccttctgctcctctacgaa

SEQ ID NO: 648142 - DNA, 25 bp, Rattus norvegicus
ttctgctcctctacgaaagcagcct

SEQ ID NO: 648143 - DNA, 25 bp, Rattus norvegicus
ctcgcctccgcatcaatattcataa

SEQ ID NO: 648144 - DNA, 25 bp, Rattus norvegicus
cgcatcaatattcataaggcagttt

SEQ ID NO: 648145 - DNA, 25 bp, Rattus norvegicus
aaggcagtttgacgtctgttctctg

SEQ ID NO: 648146 - DNA, 25 bp, Rattus norvegicus
ggccgcgtacgcacttggaaactct

SEQ ID NO: 648147 - DNA, 25 bp, Rattus norvegicus
ttctaacaaatcctacagggcagcc

SEQ ID NO: 648148 - DNA, 25 bp, Rattus norvegicus
cccgggtgttaaagactccacactg

SEQ ID NO: 648149 - DNA, 25 bp, Rattus norvegicus
tccacactgcagcaattcggcggcg

SEQ ID NO: 648150 - DNA, 25 bp, Rattus norvegicus
gcagccgggtctcctttctaacaaa

SEQ ID NO: 648151 - DNA, 25 bp, Rattus norvegicus
gcagcgctctgacctggttctggtc

SEQ ID NO: 648152 - DNA, 25 bp, Rattus norvegicus
caggcccaccttctgtttactttgg

SEQ ID NO: 648153 - DNA, 25 bp, Rattus norvegicus
taggggcctccttagctcggctccg

SEQ ID NO: 648154 - DNA, 25 bp, Rattus norvegicus
cctgcgtcctgctcacctcggcgcc

SEQ ID NO: 648155 - DNA, 25 bp, Rattus norvegicus
gtgcgcctcttgttcccggtgtaat

SEQ ID NO: 648156 - DNA, 25 bp, Rattus norvegicus
aaatcctccgccgagccgggggctg

SEQ ID NO: 648157 - DNA, 25 bp, Rattus norvegicus
gcgagccgggaaacgtggccgcgcc

SEQ ID NO: 648158 - DNA, 25 bp, Rattus norvegicus
cgccggcgagctggggatttgtgaa

SEQ ID NO: 648159 - DNA, 25 bp, Rattus norvegicus
atttgtgaaaaggagcgctggcccg

SEQ ID NO: 648160 - DNA, 25 bp, Rattus norvegicus
ggcgggaacgccctctcttccatcc

SEQ ID NO: 648161 - DNA, 25 bp, Rattus norvegicus
tcttgttcccggtgtaatttgcagc

SEQ ID NO: 648162 - DNA, 25 bp, Rattus norvegicus
ttcccggtgtaatttgcagccaatc

SEQ ID NO: 648163 - DNA, 25 bp, Rattus norvegicus
ccggtgtaatttgcagccaatcatc

SEQ ID NO: 648164 - DNA, 25 bp, Rattus norvegicus
gtaatttgcagccaatcatcgggag

SEQ ID NO: 648165 - DNA, 25 bp, Rattus norvegicus
ccaatcatcgggaggtgtccgcgcc

SEQ ID NO: 648166 - DNA, 25 bp, Rattus norvegicus
aatcatcgggaggtgtccgcgccct

SEQ ID NO: 648167 - DNA, 25 bp, Rattus norvegicus
tccaaacaattatctgccagagaga

SEQ ID NO: 648168 - DNA, 25 bp, Rattus norvegicus
tcctgcgcaggatctttggcccgaa

SEQ ID NO: 648169 - DNA, 25 bp, Rattus norvegicus
ccgcggcgataaagggacagcgtca

SEQ ID NO: 648170 - DNA, 25 bp, Rattus norvegicus
taaagggacagcgtcagcgaggagc

SEQ ID NO: 648171 - DNA, 25 bp, Rattus norvegicus
ctggcccagctatgcgcgagggtct

SEQ ID NO: 648172 - DNA, 25 bp, Rattus norvegicus
ccagctatgcgcgagggtctgagca

SEQ ID NO: 648173 - DNA, 25 bp, Rattus norvegicus
gtctgagcagcgcttgcgacgccgc

SEQ ID NO: 648174 - DNA, 25 bp, Rattus norvegicus
cttcctgcgcaggatctttggcccg

SEQ ID NO: 648175 - DNA, 25 bp, Rattus norvegicus
cactgaggggttccgcggcgataaa

SEQ ID NO: 648176 - DNA, 25 bp, Rattus norvegicus
gcgcaggatctttggcccgaaggtc

SEQ ID NO: 648177 - DNA, 25 bp, Rattus norvegicus
atctttggcccgaaggtcgccagtc

SEQ ID NO: 648178 - DNA, 25 bp, Rattus norvegicus
ttggcccgaaggtcgccagtcgcgt

SEQ ID NO: 648179 - DNA, 25 bp, Rattus norvegicus
ccagtcgcgtgggcccagccaggta

SEQ ID NO: 648180 - DNA, 25 bp, Rattus norvegicus
cccagccaggtacagcgcgcgcacg

SEQ ID NO: 648181 - DNA, 25 bp, Rattus norvegicus
gcggctctgtcgcttcctgcgcagg

SEQ ID NO: 648182 - DNA, 25 bp, Rattus norvegicus
cgcaggcagccaagatcgcgcgcat

SEQ ID NO: 648183 - DNA, 25 bp, Rattus norvegicus
ggctgctgcgcgcatcggcatgtcc

SEQ ID NO: 648184 - DNA, 25 bp, Rattus norvegicus
gagcgctatcgctcttttgccacct

SEQ ID NO: 648185 - DNA, 25 bp, Rattus norvegicus
cgggcttgcccaaggagagccacct

SEQ ID NO: 648186 - DNA, 25 bp, Rattus norvegicus
ccgtggaactgcgacaacgcggcca

SEQ ID NO: 648187 - DNA, 25 bp, Rattus norvegicus
aggcagccaagatcgcgcgcatcac

SEQ ID NO: 648188 - DNA, 25 bp, Rattus norvegicus
tcttttgccacctccttctacaaga

SEQ ID NO: 648189 - DNA, 25 bp, Rattus norvegicus
actctgagatggagcgctatcgctc

SEQ ID NO: 648190 - DNA, 25 bp, Rattus norvegicus
tacaactctgagatggagcgctatc

SEQ ID NO: 648191 - DNA, 25 bp, Rattus norvegicus
ccttgtggattacaactctgagatg

SEQ ID NO: 648192 - DNA, 25 bp, Rattus norvegicus
tgaacagccttgtggattacaactc

SEQ ID NO: 648193 - DNA, 25 bp, Rattus norvegicus
gggccctgaacagccttgtggatta

SEQ ID NO: 648194 - DNA, 25 bp, Rattus norvegicus
ccaaggagagccacctgcccgaggg

SEQ ID NO: 648195 - DNA, 25 bp, Rattus norvegicus
tggaactgcgacaacgcggccaccg

SEQ ID NO: 648196 - DNA, 25 bp, Rattus norvegicus
ccagccgaacggagttcacagggtc

SEQ ID NO: 648197 - DNA, 25 bp, Rattus norvegicus
cgtgagccatcaaattgctgtaatc

SEQ ID NO: 648198 - DNA, 25 bp, Rattus norvegicus
ccgaacggagttcacagggtccgcg

SEQ ID NO: 648199 - DNA, 25 bp, Rattus norvegicus
agcacccagccgaacggagttcaca

SEQ ID NO: 648200 - DNA, 25 bp, Rattus norvegicus
atccaggggtctggtagcacccagc

SEQ ID NO: 648201 - DNA, 25 bp, Rattus norvegicus
attgctgtaatccaggggtctggta

SEQ ID NO: 648202 - DNA, 25 bp, Rattus norvegicus
atcaaattgctgtaatccaggggtc

SEQ ID NO: 648203 - DNA, 25 bp, Rattus norvegicus
agggctcgggttcccactcactccg

SEQ ID NO: 648204 - DNA, 25 bp, Rattus norvegicus
gcgaggtgggaacttcccagggctc

SEQ ID NO: 648205 - DNA, 25 bp, Rattus norvegicus
cagtggatgggtgcgagtgcaaaac

SEQ ID NO: 648206 - DNA, 25 bp, Rattus norvegicus
cccaacgaaggggttcagtggatgg

SEQ ID NO: 648207 - DNA, 25 bp, Rattus norvegicus
atgccaggcaccgtagccccgagtg

SEQ ID NO: 648208 - DNA, 25 bp, Rattus norvegicus
ggtctcgaacactgtggttcaaccc

SEQ ID NO: 648209 - DNA, 25 bp, Rattus norvegicus
cgcccaaccgtgagccatcaaattg

SEQ ID NO: 648210 - DNA, 25 bp, Rattus norvegicus
tctccagctccgtgcatctcagttt

SEQ ID NO: 648211 - DNA, 25 bp, Rattus norvegicus
cgacgctgaggacattttaaactta

SEQ ID NO: 648212 - DNA, 25 bp, Rattus norvegicus
gagacctgcgctgtcccgggtcaca

SEQ ID NO: 648213 - DNA, 25 bp, Rattus norvegicus
ccctcaacagcaggtaggcggcctg

SEQ ID NO: 648214 - DNA, 25 bp, Rattus norvegicus
ggctgtctgtgttcgagtgcgaccc

SEQ ID NO: 648215 - DNA, 25 bp, Rattus norvegicus
ctgcagtggctgtctgtgttcgagt

SEQ ID NO: 648216 - DNA, 25 bp, Rattus norvegicus
gcattttccttcctgggcggcagca

SEQ ID NO: 648217 - DNA, 25 bp, Rattus norvegicus
cgctgcgacgctgaggacattttaa

SEQ ID NO: 648218 - DNA, 25 bp, Rattus norvegicus
agcccaatccgctgcgacgctgagg

SEQ ID NO: 648219 - DNA, 25 bp, Rattus norvegicus
cgtcatgacgctgcgcagcccaatc

SEQ ID NO: 648220 - DNA, 25 bp, Rattus norvegicus
gcacttggactgtcccgtgacgtca

SEQ ID NO: 648221 - DNA, 25 bp, Rattus norvegicus
gcgccgcacttggactgtcccgtga

SEQ ID NO: 648222 - DNA, 25 bp, Rattus norvegicus
cgtgcatctcagtttcggtatctct

SEQ ID NO: 648223 - DNA, 25 bp, Rattus norvegicus
tcagtttcggtatctctgagtctcc

SEQ ID NO: 648224 - DNA, 25 bp, Rattus norvegicus
gcaccttctcctgggctttaacctg

SEQ ID NO: 648225 - DNA, 25 bp, Rattus norvegicus
cgtgtgagctttctcaccggaaacc

SEQ ID NO: 648226 - DNA, 25 bp, Rattus norvegicus
tttaggcccttgacgtctgcggaag

SEQ ID NO: 648227 - DNA, 25 bp, Rattus norvegicus
gtgggctcccactttaggcccttga

SEQ ID NO: 648228 - DNA, 25 bp, Rattus norvegicus
agcctgccctcagctctggtgcgga

SEQ ID NO: 648229 - DNA, 25 bp, Rattus norvegicus
tgcgggccacgctgtccaggaccat

SEQ ID NO: 648230 - DNA, 25 bp, Rattus norvegicus
agctgcaccttcacgatgcgggcca

SEQ ID NO: 648231 - DNA, 25 bp, Rattus norvegicus
ggcgcctcagacagcaacgacttaa

SEQ ID NO: 648232 - DNA, 25 bp, Rattus norvegicus
ttaacctgctgggtcgcctgggaaa

SEQ ID NO: 648233 - DNA, 25 bp, Rattus norvegicus
ggaggaccgagacccactgctccta

SEQ ID NO: 648234 - DNA, 25 bp, Rattus norvegicus
cggaaaccgcctttcacaagtgaat

SEQ ID NO: 648235 - DNA, 25 bp, Rattus norvegicus
tgctttacagctgcacgcggcagta

SEQ ID NO: 648236 - DNA, 25 bp, Rattus norvegicus
acacaggccgcggatcacgtgctaa

SEQ ID NO: 648237 - DNA, 25 bp, Rattus norvegicus
cgcatggcgtgaaagcagtactccc

SEQ ID NO: 648238 - DNA, 25 bp, Rattus norvegicus
ggggacaacagcacacgcgagtcta

SEQ ID NO: 648239 - DNA, 25 bp, Rattus norvegicus
ttctctgagtctaagggtttccgcc

SEQ ID NO: 648240 - DNA, 25 bp, Rattus norvegicus
cacccggggctcttcctttcaagag

SEQ ID NO: 648241 - DNA, 25 bp, Rattus norvegicus
tccgatcggtttagtaagaaggtgc

SEQ ID NO: 648242 - DNA, 25 bp, Rattus norvegicus
cagtagttccgtcagagcggacatc

SEQ ID NO: 648243 - DNA, 25 bp, Rattus norvegicus
cggacatcttgtggctgtgccgtgc

SEQ ID NO: 648244 - DNA, 25 bp, Rattus norvegicus
agtgacgccggcctagcgccgacta

SEQ ID NO: 648245 - DNA, 25 bp, Rattus norvegicus
aacagctctagctgtggggacaaca

SEQ ID NO: 648246 - DNA, 25 bp, Rattus norvegicus
cttccggttctcgatgcttctctga

SEQ ID NO: 648247 - DNA, 25 bp, Rattus norvegicus
cacacgcgagtctaattgccttctg

SEQ ID NO: 648248 - DNA, 25 bp, Rattus norvegicus
taattgccttctgctggctcgccga

SEQ ID NO: 648249 - DNA, 25 bp, Rattus norvegicus
ggctcgccgaccctcgaagcagaaa

SEQ ID NO: 648250 - DNA, 25 bp, Rattus norvegicus
cccttgcctttctttgccctagtga

SEQ ID NO: 648251 - DNA, 25 bp, Rattus norvegicus
ggggcgacccagaacagctctagct

SEQ ID NO: 648252 - DNA, 25 bp, Rattus norvegicus
ctcgtcctctctcgctcactctctc

SEQ ID NO: 648253 - DNA, 25 bp, Rattus norvegicus
acgtcgagagagcagacagacggac

SEQ ID NO: 648254 - DNA, 25 bp, Rattus norvegicus
cccactgacgtcgagagagcagaca

SEQ ID NO: 648255 - DNA, 25 bp, Rattus norvegicus
tggaaattcccactgacgtcgagag

SEQ ID NO: 648256 - DNA, 25 bp, Rattus norvegicus
tcactctctcacttcctggctggaa

SEQ ID NO: 648257 - DNA, 25 bp, Rattus norvegicus
gctcgcctcggtacttctctctcgt

SEQ ID NO: 648258 - DNA, 25 bp, Rattus norvegicus
ggctgctcgggtggcgaaacctcct

SEQ ID NO: 648259 - DNA, 25 bp, Rattus norvegicus
ggagcccgagtaaggtcctggcgcc

SEQ ID NO: 648260 - DNA, 25 bp, Rattus norvegicus
tgcggagagctggtcgctctgttcc

SEQ ID NO: 648261 - DNA, 25 bp, Rattus norvegicus
agtcccaagccggtgggacccgctg

SEQ ID NO: 648262 - DNA, 25 bp, Rattus norvegicus
tgcggatgtgctctgtccccgcagc

SEQ ID NO: 648263 - DNA, 25 bp, Rattus norvegicus
tctttctaaaactttgcaagagttc

SEQ ID NO: 648264 - DNA, 25 bp, Rattus norvegicus
caggggctcgggtacatctttctaa

SEQ ID NO: 648265 - DNA, 25 bp, Rattus norvegicus
acttcctggctggaaattcccactg

SEQ ID NO: 648266 - DNA, 25 bp, Rattus norvegicus
ggggcaccgagcttctcgctaactg

SEQ ID NO: 648267 - DNA, 25 bp, Rattus norvegicus
tgctgagagtgttcggcgccaacca

SEQ ID NO: 648268 - DNA, 25 bp, Rattus norvegicus
agtgacgtgagaccggcggacctcc

SEQ ID NO: 648269 - DNA, 25 bp, Rattus norvegicus
ctaagggcaccgacacccgggcact

SEQ ID NO: 648270 - DNA, 25 bp, Rattus norvegicus
ggcactcgctcggatccctgcatcc

SEQ ID NO: 648271 - DNA, 25 bp, Rattus norvegicus
tgcatccgctagctccggagctgcg

SEQ ID NO: 648272 - DNA, 25 bp, Rattus norvegicus
ggagctgcgcgctccacgatggctc

SEQ ID NO: 648273 - DNA, 25 bp, Rattus norvegicus
ccgggctgctgctactggcggccac

SEQ ID NO: 648274 - DNA, 25 bp, Rattus norvegicus
gccggagctcgccttcactgaggat

SEQ ID NO: 648275 - DNA, 25 bp, Rattus norvegicus
gctcgccttcactgaggatgtgctg

SEQ ID NO: 648276 - DNA, 25 bp, Rattus norvegicus
ttctcgctaactggggcaggcagtg

SEQ ID NO: 648277 - DNA, 25 bp, Rattus norvegicus
cactgaggatgtgctgagagtgttc

SEQ ID NO: 648278 - DNA, 25 bp, Rattus norvegicus
ttcggcgccaaccagagcctgtcgg

SEQ ID NO: 648279 - DNA, 25 bp, Rattus norvegicus
cgccttcactgaggatgtgctgaga

SEQ ID NO: 648280 - DNA, 25 bp, Rattus norvegicus
cgcatccactcctgcttcgaatgtt

SEQ ID NO: 648281 - DNA, 25 bp, Rattus norvegicus
agcctgtaagccaccagatgcatga

SEQ ID NO: 648282 - DNA, 25 bp, Rattus norvegicus
gcgagaacaggctggaatgacagta

SEQ ID NO: 648283 - DNA, 25 bp, Rattus norvegicus
aatcagtgaaacgttcgcttgtcgg

SEQ ID NO: 648284 - DNA, 25 bp, Rattus norvegicus
ccatcatcacggcagacaaatctgc

SEQ ID NO: 648285 - DNA, 25 bp, Rattus norvegicus
gcatgacctgtcagtgaccctcgaa

SEQ ID NO: 648286 - DNA, 25 bp, Rattus norvegicus
tcgcttgtcggtttgaaaagacgtc

SEQ ID NO: 648287 - DNA, 25 bp, Rattus norvegicus
cctgttgcgagtgtcaagcctgtaa

SEQ ID NO: 648288 - DNA, 25 bp, Rattus norvegicus
cctgcttcgaatgttcctgttgcga

SEQ ID NO: 648289 - DNA, 25 bp, Rattus norvegicus
gacaaatctgcggtctccgcatcca

SEQ ID NO: 648290 - DNA, 25 bp, Rattus norvegicus
tctggtcgccgagttaggcaatccc

SEQ ID NO: 648291 - DNA, 25 bp, Rattus norvegicus
acaccgaagtgtctggtcgccgagt

SEQ ID NO: 648292 - DNA, 25 bp, Rattus norvegicus
tgacagtaaagggagagacaccgaa

SEQ ID NO: 648293 - DNA, 25 bp, Rattus norvegicus
gaccctcgaagggataaatcagtga

SEQ ID NO: 648294 - DNA, 25 bp, Rattus norvegicus
gtggtgacacgctgcagcccagttc

SEQ ID NO: 648295 - DNA, 25 bp, Rattus norvegicus
ctccagtgacacttgagcggccaca

SEQ ID NO: 648296 - DNA, 25 bp, Rattus norvegicus
accgccttagcgatgagggatgcgc

SEQ ID NO: 648297 - DNA, 25 bp, Rattus norvegicus
atgcgcgccacagccaatgagcttg

SEQ ID NO: 648298 - DNA, 25 bp, Rattus norvegicus
caatgagcttgcgatgtgcaacgtg

SEQ ID NO: 648299 - DNA, 25 bp, Rattus norvegicus
cgagctcagcggctctttcctgtgc

SEQ ID NO: 648300 - DNA, 25 bp, Rattus norvegicus
cccatgtgatcggtcttaatcccga

SEQ ID NO: 648301 - DNA, 25 bp, Rattus norvegicus
ccgggaggcgtgctcagaaaataaa

SEQ ID NO: 648302 - DNA, 25 bp, Rattus norvegicus
cgggaacccgcaagcgtggtgacac

SEQ ID NO: 648303 - DNA, 25 bp, Rattus norvegicus
gcagtaactttcgagccagcccaga

SEQ ID NO: 648304 - DNA, 25 bp, Rattus norvegicus
cggactgtgtccaccgagctcagcg

SEQ ID NO: 648305 - DNA, 25 bp, Rattus norvegicus
gagctccagccgagcggtttgcagc

SEQ ID NO: 648306 - DNA, 25 bp, Rattus norvegicus
taaataaccagcacacacgcgcagc

SEQ ID NO: 648307 - DNA, 25 bp, Rattus norvegicus
tctttcctgtgcgtggagaagcagc

SEQ ID NO: 648308 - DNA, 25 bp, Rattus norvegicus
atgagtgatgtgtcgcgacttggcc

SEQ ID NO: 648309 - DNA, 25 bp, Rattus norvegicus
ttggctagaacctcaaggacgtgtc

SEQ ID NO: 648310 - DNA, 25 bp, Rattus norvegicus
accaccgccgtgctaggctttggcg

SEQ ID NO: 648311 - DNA, 25 bp, Rattus norvegicus
tggcctacggagactgtgaatactg

SEQ ID NO: 648312 - DNA, 25 bp, Rattus norvegicus
ttggcgcgcacatcatctttctatc

SEQ ID NO: 648313 - DNA, 25 bp, Rattus norvegicus
gggtgttccatctttgcatgagtga

SEQ ID NO: 648314 - DNA, 25 bp, Rattus norvegicus
cccttgcttgtttgtcggcaccctg

SEQ ID NO: 648315 - DNA, 25 bp, Rattus norvegicus
gtgaccgggcctttatgtttgcacc

SEQ ID NO: 648316 - DNA, 25 bp, Rattus norvegicus
gcgcgccgccttggtaattctatct

SEQ ID NO: 648317 - DNA, 25 bp, Rattus norvegicus
aggtgttttgtgagcccggagctcc

SEQ ID NO: 648318 - DNA, 25 bp, Rattus norvegicus
tccgagatggtaacgtgagagtgac

SEQ ID NO: 648319 - DNA, 25 bp, Rattus norvegicus
ccggatgagggaacattctgcagta

SEQ ID NO: 648320 - DNA, 25 bp, Rattus norvegicus
cggcaaccattggtgggccgaacca

SEQ ID NO: 648321 - DNA, 25 bp, Rattus norvegicus
atcacatgtgttactgccagggcgc

SEQ ID NO: 648322 - DNA, 25 bp, Rattus norvegicus
tgtctgtccgtcctacattgctgcc

SEQ ID NO: 648323 - DNA, 25 bp, Rattus norvegicus
tgccgtacagtcacagatcacgctt

SEQ ID NO: 648324 - DNA, 25 bp, Rattus norvegicus
gcagcctctgccgtacagtcacaga

SEQ ID NO: 648325 - DNA, 25 bp, Rattus norvegicus
tgtcgcagcctctgccgtacagtca

SEQ ID NO: 648326 - DNA, 25 bp, Rattus norvegicus
cggtttccagctcttctgtcgcagc

SEQ ID NO: 648327 - DNA, 25 bp, Rattus norvegicus
gtacagtcacagatcacgctttacg

SEQ ID NO: 648328 - DNA, 25 bp, Rattus norvegicus
gccgtttgcggtttccagctcttct

SEQ ID NO: 648329 - DNA, 25 bp, Rattus norvegicus
gtccgtcctacattgctgccgtttg

SEQ ID NO: 648330 - DNA, 25 bp, Rattus norvegicus
ggacctgtctgtccgtcctacattg

SEQ ID NO: 648331 - DNA, 25 bp, Rattus norvegicus
ccctaggggagacacggaggaagca

SEQ ID NO: 648332 - DNA, 25 bp, Rattus norvegicus
tggcagtgtccctcgtcccctaggg

SEQ ID NO: 648333 - DNA, 25 bp, Rattus norvegicus
actgcaggagccttggagggtttgt

SEQ ID NO: 648334 - DNA, 25 bp, Rattus norvegicus
agcgcggtaccctggagtgcgctcc

SEQ ID NO: 648335 - DNA, 25 bp, Rattus norvegicus
acattgctgccgtttgcggtttcca

SEQ ID NO: 648336 - DNA, 25 bp, Rattus norvegicus
cctgacgcctagaaggggctgctct

SEQ ID NO: 648337 - DNA, 25 bp, Rattus norvegicus
ataggtcctcactctgccgcatcag

SEQ ID NO: 648338 - DNA, 25 bp, Rattus norvegicus
gaagactccaaacagcagacccggc

SEQ ID NO: 648339 - DNA, 25 bp, Rattus norvegicus
cagacccggctgcaggatgcaactc

SEQ ID NO: 648340 - DNA, 25 bp, Rattus norvegicus
ttacctctagggtccggatctcctg

SEQ ID NO: 648341 - DNA, 25 bp, Rattus norvegicus
tcgttggacactgagcacttggtgc

SEQ ID NO: 648342 - DNA, 25 bp, Rattus norvegicus
gcgcctgctccaattcgtgtgcgtc

SEQ ID NO: 648343 - DNA, 25 bp, Rattus norvegicus
gcgcagactgccgatggagatatca

SEQ ID NO: 648344 - DNA, 25 bp, Rattus norvegicus
ttttccaaagtgagcgccggtcata

SEQ ID NO: 648345 - DNA, 25 bp, Rattus norvegicus
gaagcctgcagtcccgagagcctgc

SEQ ID NO: 648346 - DNA, 25 bp, Rattus norvegicus
acgcggcggcaaagcgaaagcctcc

SEQ ID NO: 648347 - DNA, 25 bp, Rattus norvegicus
tgggacttgtagtgcgcatcttgca

SEQ ID NO: 648348 - DNA, 25 bp, Rattus norvegicus
gtgcgcatcttgcatctgccttctg

SEQ ID NO: 648349 - DNA, 25 bp, Rattus norvegicus
gcacgctggtcttcgagactcgatc

SEQ ID NO: 648350 - DNA, 25 bp, Rattus norvegicus
ccggcaaccgcgacaaggcccagcg

SEQ ID NO: 648351 - DNA, 25 bp, Rattus norvegicus
ctgtgctccgaaagcctgcggcctt

SEQ ID NO: 648352 - DNA, 25 bp, Rattus norvegicus
caaccgcgacgaggcggagaaatgc

SEQ ID NO: 648353 - DNA, 25 bp, Rattus norvegicus
gcggagaaatgcgtgcagatcgctc

SEQ ID NO: 648354 - DNA, 25 bp, Rattus norvegicus
aaatgcgtgcagatcgctcgcgagg

SEQ ID NO: 648355 - DNA, 25 bp, Rattus norvegicus
cgtgcagatcgctcgcgaggccctg

SEQ ID NO: 648356 - DNA, 25 bp, Rattus norvegicus
aaggcccagcgcttcctgcagaagg

SEQ ID NO: 648357 - DNA, 25 bp, Rattus norvegicus
cttcctgcagaaggccgagaagctg

SEQ ID NO: 648358 - DNA, 25 bp, Rattus norvegicus
tgcagaaggccgagaagctgtaccc

SEQ ID NO: 648359 - DNA, 25 bp, Rattus norvegicus
cgcgagccatggagggcaaccgcga

SEQ ID NO: 648360 - DNA, 25 bp, Rattus norvegicus
aggctcgaggccgcgcttgagttta

SEQ ID NO: 648361 - DNA, 25 bp, Rattus norvegicus
ttaccgcgtcggctgtaccgtcgcc

SEQ ID NO: 648362 - DNA, 25 bp, Rattus norvegicus
cgcctcgcctcctccacggcgggcc

SEQ ID NO: 648363 - DNA, 25 bp, Rattus norvegicus
cccggtgtctgtgctccgaaagcct

SEQ ID NO: 648364 - DNA, 25 bp, Rattus norvegicus
cggaagttccgaatcaccagtactg

SEQ ID NO: 648365 - DNA, 25 bp, Rattus norvegicus
gaagcgactgaactgcgggaacacc

SEQ ID NO: 648366 - DNA, 25 bp, Rattus norvegicus
caggcagcttcagagaagcgactga

SEQ ID NO: 648367 - DNA, 25 bp, Rattus norvegicus
cagcgacttgacaggcagcttcaga

SEQ ID NO: 648368 - DNA, 25 bp, Rattus norvegicus
cacgagtaatgtgacagcgacttga

SEQ ID NO: 648369 - DNA, 25 bp, Rattus norvegicus
tcgccacggaggtcacgagtaatgt

SEQ ID NO: 648370 - DNA, 25 bp, Rattus norvegicus
caagtgcttcctggatcgccacgga

SEQ ID NO: 648371 - DNA, 25 bp, Rattus norvegicus
tgcagcaagtgcttcctggatcgcc

SEQ ID NO: 648372 - DNA, 25 bp, Rattus norvegicus
tccgaatcaccagtactggagggtg

SEQ ID NO: 648373 - DNA, 25 bp, Rattus norvegicus
actgaactgcgggaacaccggggca

SEQ ID NO: 648374 - DNA, 25 bp, Rattus norvegicus
gcgcgcgcagtttccgctgggtctc

SEQ ID NO: 648375 - DNA, 25 bp, Rattus norvegicus
tcagacgcttgattagcggcttcgg

SEQ ID NO: 648376 - DNA, 25 bp, Rattus norvegicus
cagggacctcagacgcttgattagc

SEQ ID NO: 648377 - DNA, 25 bp, Rattus norvegicus
accagtactggagggtgcagcaagt

SEQ ID NO: 648378 - DNA, 25 bp, Rattus norvegicus
gttggccagcgtccacttggctgct

SEQ ID NO: 648379 - DNA, 25 bp, Rattus norvegicus
gtccacttggctgctggagtcgcct

SEQ ID NO: 648380 - DNA, 25 bp, Rattus norvegicus
cagcgtccacttggctgctggagtc

SEQ ID NO: 648381 - DNA, 25 bp, Rattus norvegicus
agtgaaaccggagcctctggacgca

SEQ ID NO: 648382 - DNA, 25 bp, Rattus norvegicus
ctccggtgtgttggccagcgtccac

SEQ ID NO: 648383 - DNA, 25 bp, Rattus norvegicus
tccgtagctccggtgtgttggccag

SEQ ID NO: 648384 - DNA, 25 bp, Rattus norvegicus
agcctgtccgtagctccggtgtgtt

SEQ ID NO: 648385 - DNA, 25 bp, Rattus norvegicus
aaaccggagcctctggacgcacctg

SEQ ID NO: 648386 - DNA, 25 bp, Rattus norvegicus
catccagcccggcacagcctgtccg

SEQ ID NO: 648387 - DNA, 25 bp, Rattus norvegicus
cgcacctgcgataggccacgcctcc

SEQ ID NO: 648388 - DNA, 25 bp, Rattus norvegicus
tctggacgcacctgcgataggccac

SEQ ID NO: 648389 - DNA, 25 bp, Rattus norvegicus
agcctctggacgcacctgcgatagg

SEQ ID NO: 648390 - DNA, 25 bp, Rattus norvegicus
cacagcctgtccgtagctccggtgt

SEQ ID NO: 648391 - DNA, 25 bp, Rattus norvegicus
cgtttcagtgaaaccggagcctctg

SEQ ID NO: 648392 - DNA, 25 bp, Rattus norvegicus
ttcctttaacaccagcctcactgag

SEQ ID NO: 648393 - DNA, 25 bp, Rattus norvegicus
ctcactgagccttcctggggcggga

SEQ ID NO: 648394 - DNA, 25 bp, Rattus norvegicus
acgggcgggcaatccgccaccagtg

SEQ ID NO: 648395 - DNA, 25 bp, Rattus norvegicus
caccagtggttcgaaactccgagcc

SEQ ID NO: 648396 - DNA, 25 bp, Rattus norvegicus
acccggtgcattcacggtccggttg

SEQ ID NO: 648397 - DNA, 25 bp, Rattus norvegicus
tgagacttcgcatccccggacgtgg

SEQ ID NO: 648398 - DNA, 25 bp, Rattus norvegicus
gccacgccaggctgagacttcgcat

SEQ ID NO: 648399 - DNA, 25 bp, Rattus norvegicus
cagcagccacgccaggctgagactt

SEQ ID NO: 648400 - DNA, 25 bp, Rattus norvegicus
agaagggtgatacctcccagcagcc

SEQ ID NO: 648401 - DNA, 25 bp, Rattus norvegicus
aggccgccagaagggtgatacctcc

SEQ ID NO: 648402 - DNA, 25 bp, Rattus norvegicus
attcacggtccggttgcaggaggcc

SEQ ID NO: 648403 - DNA, 25 bp, Rattus norvegicus
gccgctccaactcacccggtgcatt

SEQ ID NO: 648404 - DNA, 25 bp, Rattus norvegicus
gggcaatccgccaccagtggttcga

SEQ ID NO: 648405 - DNA, 25 bp, Rattus norvegicus
cgccaccagtggttcgaaactccga

SEQ ID NO: 648406 - DNA, 25 bp, Rattus norvegicus
ctgcaatcagggcttccggagtaga

SEQ ID NO: 648407 - DNA, 25 bp, Rattus norvegicus
caggcgaggcgttttccctgccttt

SEQ ID NO: 648408 - DNA, 25 bp, Rattus norvegicus
ttcccgcatcgtgattggtcagctg

SEQ ID NO: 648409 - DNA, 25 bp, Rattus norvegicus
aatgctgcgttatgcttagaggaca

SEQ ID NO: 648410 - DNA, 25 bp, Rattus norvegicus
tggagccgagagcatttcagaaagg

SEQ ID NO: 648411 - DNA, 25 bp, Rattus norvegicus
ttctgttgttcgtgggaatcctgcc

SEQ ID NO: 648412 - DNA, 25 bp, Rattus norvegicus
gtgaactatcctatcctccgctgca

SEQ ID NO: 648413 - DNA, 25 bp, Rattus norvegicus
tcggatgccaaaggagcgtgaacta

SEQ ID NO: 648414 - DNA, 25 bp, Rattus norvegicus
ccctgctctttagtattctttcgga

SEQ ID NO: 648415 - DNA, 25 bp, Rattus norvegicus
gaaaggctttctgaccgcatccctg

SEQ ID NO: 648416 - DNA, 25 bp, Rattus norvegicus
ttctgaaggaggactaacgcgtgga

SEQ ID NO: 648417 - DNA, 25 bp, Rattus norvegicus
agtgccgtaagcagacgtgcaacca

SEQ ID NO: 648418 - DNA, 25 bp, Rattus norvegicus
cacggcttggtaaatatggcactgc

SEQ ID NO: 648419 - DNA, 25 bp, Rattus norvegicus
gcagttcgatgacgcaagtgccgta

SEQ ID NO: 648420 - DNA, 25 bp, Rattus norvegicus
ccgaacttgcggacatggcgaacca

SEQ ID NO: 648421 - DNA, 25 bp, Rattus norvegicus
cacgacttggggagcagctttgctt

SEQ ID NO: 648422 - DNA, 25 bp, Rattus norvegicus
gtaagcccgcctacatcaagccacg

SEQ ID NO: 648423 - DNA, 25 bp, Rattus norvegicus
tcatacccggattccgctacacttt

SEQ ID NO: 648424 - DNA, 25 bp, Rattus norvegicus
cggattccgctacacttttgtacct

SEQ ID NO: 648425 - DNA, 25 bp, Rattus norvegicus
tttgtacctttacgctcgctcgatc

SEQ ID NO: 648426 - DNA, 25 bp, Rattus norvegicus
ttacgctcgctcgatcccgaacttg

SEQ ID NO: 648427 - DNA, 25 bp, Rattus norvegicus
gctttgctttctgctctgctccgcg

SEQ ID NO: 648428 - DNA, 25 bp, Rattus norvegicus
gtcccacggaatggagtaacttgct

SEQ ID NO: 648429 - DNA, 25 bp, Rattus norvegicus
gtaacttgctgggatcgcgcttgca

SEQ ID NO: 648430 - DNA, 25 bp, Rattus norvegicus
atcgcgcttgcaggatcagatctgg

SEQ ID NO: 648431 - DNA, 25 bp, Rattus norvegicus
cttgcaggatcagatctggagcgca

SEQ ID NO: 648432 - DNA, 25 bp, Rattus norvegicus
acttgcggacatggcgaaccaggta

SEQ ID NO: 648433 - DNA, 25 bp, Rattus norvegicus
ctgcgagggcaagaaggctttgttt

SEQ ID NO: 648434 - DNA, 25 bp, Rattus norvegicus
gcagaagtacgagccctggatgccc

SEQ ID NO: 648435 - DNA, 25 bp, Rattus norvegicus
aggtcgcttccgtctccgacaggga

SEQ ID NO: 648436 - DNA, 25 bp, Rattus norvegicus
tctccgacagggattgcacaggcac

SEQ ID NO: 648437 - DNA, 25 bp, Rattus norvegicus
attgcacaggcacgggagagaagcc

SEQ ID NO: 648438 - DNA, 25 bp, Rattus norvegicus
tacctgcgagcagaagtacgagccc

SEQ ID NO: 648439 - DNA, 25 bp, Rattus norvegicus
ctggatgcccagcttgatgcaggtg

SEQ ID NO: 648440 - DNA, 25 bp, Rattus norvegicus
gacactggagcttggcctcgctgct

SEQ ID NO: 648441 - DNA, 25 bp, Rattus norvegicus
gggaggaactcagattgtaggccta

SEQ ID NO: 648442 - DNA, 25 bp, Rattus norvegicus
agattgtaggcctaagcgccggacc

SEQ ID NO: 648443 - DNA, 25 bp, Rattus norvegicus
acaaagccttgcagcggtggcgatg

SEQ ID NO: 648444 - DNA, 25 bp, Rattus norvegicus
atgccacgtagggtccacggagacc

SEQ ID NO: 648445 - DNA, 25 bp, Rattus norvegicus
acttctgtccactgggcgcctcggg

SEQ ID NO: 648446 - DNA, 25 bp, Rattus norvegicus
gtccgtctcgcacacccgtgtctcc

SEQ ID NO: 648447 - DNA, 25 bp, Rattus norvegicus
ccgcgcgtccctacctgcgcacaca

SEQ ID NO: 648448 - DNA, 25 bp, Rattus norvegicus
ttcaggagcggttgtgcgatcagat

SEQ ID NO: 648449 - DNA, 25 bp, Rattus norvegicus
agacctgcatttcacacgcgccggg

SEQ ID NO: 648450 - DNA, 25 bp, Rattus norvegicus
gctggccgtagacctgcatttcaca

SEQ ID NO: 648451 - DNA, 25 bp, Rattus norvegicus
tacagttcgctccagcgggtcggct

SEQ ID NO: 648452 - DNA, 25 bp, Rattus norvegicus
cgaggcctacagttcgctccagcgg

SEQ ID NO: 648453 - DNA, 25 bp, Rattus norvegicus
gaaggtgatcacattgtcctggccc

SEQ ID NO: 648454 - DNA, 25 bp, Rattus norvegicus
ccggccgagaaggtgatcacattgt

SEQ ID NO: 648455 - DNA, 25 bp, Rattus norvegicus
gactgtccgcaggacggcgttcccg

SEQ ID NO: 648456 - DNA, 25 bp, Rattus norvegicus
tgcgatcagatcgatctaagatggc

SEQ ID NO: 648457 - DNA, 25 bp, Rattus norvegicus
cggccaatccggtttgaatctcatt

SEQ ID NO: 648458 - DNA, 25 bp, Rattus norvegicus
acgcgccgggcttccattcattcat

SEQ ID NO: 648459 - DNA, 25 bp, Rattus norvegicus
cctgaaagagtcagagggagcctga

SEQ ID NO: 648460 - DNA, 25 bp, Rattus norvegicus
ctaagatggcgactgtggaaccggt

SEQ ID NO: 648461 - DNA, 25 bp, Rattus norvegicus
gaaccggtgagtattgccttcggcc

SEQ ID NO: 648462 - DNA, 25 bp, Rattus norvegicus
agaaacagagggacacgcggaccgc

SEQ ID NO: 648463 - DNA, 25 bp, Rattus norvegicus
agctcccgagcacgagtcgagcgcg

SEQ ID NO: 648464 - DNA, 25 bp, Rattus norvegicus
ggttcgacgagcattcccggaggct

SEQ ID NO: 648465 - DNA, 25 bp, Rattus norvegicus
caagtgtcttcatgaacccagagga

SEQ ID NO: 648466 - DNA, 25 bp, Rattus norvegicus
cccagaggatgtccgggaagcacta

SEQ ID NO: 648467 - DNA, 25 bp, Rattus norvegicus
ccgggaagcactacaagggtcctga

SEQ ID NO: 648468 - DNA, 25 bp, Rattus norvegicus
tattttgggtaagttggagcgctcc

SEQ ID NO: 648469 - DNA, 25 bp, Rattus norvegicus
cagccaggccttagggtggcatttt

SEQ ID NO: 648470 - DNA, 25 bp, Rattus norvegicus
ggtcgctgcctttacttttcgccgc

SEQ ID NO: 648471 - DNA, 25 bp, Rattus norvegicus
gcgagaggcgtctaccttccgcctt

SEQ ID NO: 648472 - DNA, 25 bp, Rattus norvegicus
cgagcatgggagagaaaaacacttc

SEQ ID NO: 648473 - DNA, 25 bp, Rattus norvegicus
ttcatcctttccaggaccgggagga

SEQ ID NO: 648474 - DNA, 25 bp, Rattus norvegicus
aggacggctcggcagtttgagaaac

SEQ ID NO: 648475 - DNA, 25 bp, Rattus norvegicus
gtcctgaagtcagttgttgcatcaa

SEQ ID NO: 648476 - DNA, 25 bp, Rattus norvegicus
gccgtagtctcccaacactaattca

SEQ ID NO: 648477 - DNA, 25 bp, Rattus norvegicus
ttgcaggagaaatgcattgccaccc

SEQ ID NO: 648478 - DNA, 25 bp, Rattus norvegicus
agcggaactgtgcacgccgtagtct

SEQ ID NO: 648479 - DNA, 25 bp, Rattus norvegicus
taattcaacagctagcggctcccgc

SEQ ID NO: 648480 - DNA, 25 bp, Rattus norvegicus
gcgagtcgtcacctccaccttggaa

SEQ ID NO: 648481 - DNA, 25 bp, Rattus norvegicus
accttggaagctgtctgctccggca

SEQ ID NO: 648482 - DNA, 25 bp, Rattus norvegicus
cattcgcgcccacgggaaggaagtt

SEQ ID NO: 648483 - DNA, 25 bp, Rattus norvegicus
cccggcaactttgcaggagaaatgc

SEQ ID NO: 648484 - DNA, 25 bp, Rattus norvegicus
cctgcagcacgctgaggggagaaaa

SEQ ID NO: 648485 - DNA, 25 bp, Rattus norvegicus
aaatgtcaggcgatgacggctggca

SEQ ID NO: 648486 - DNA, 25 bp, Rattus norvegicus
acggctggcaggactcacccatgtt

SEQ ID NO: 648487 - DNA, 25 bp, Rattus norvegicus
acccatgttcctcccacagagtgag

SEQ ID NO: 648488 - DNA, 25 bp, Rattus norvegicus
ctcccacagagtgaggaccggcagg

SEQ ID NO: 648489 - DNA, 25 bp, Rattus norvegicus
aagttccgccaagtggtccggctcg

SEQ ID NO: 648490 - DNA, 25 bp, Rattus norvegicus
ctcagccagcgtgtttggcaccgca

SEQ ID NO: 648491 - DNA, 25 bp, Rattus norvegicus
gcggaggccaggctcaagtcactaa

SEQ ID NO: 648492 - DNA, 25 bp, Rattus norvegicus
caagtcactaagctgaagggccaga

SEQ ID NO: 648493 - DNA, 25 bp, Rattus norvegicus
ggccgagatgctcccgtcactggca

SEQ ID NO: 648494 - DNA, 25 bp, Rattus norvegicus
cccagggagggaagtctcagccagc

SEQ ID NO: 648495 - DNA, 25 bp, Rattus norvegicus
ggacctaattgtccgcgggcgtgtc

SEQ ID NO: 648496 - DNA, 25 bp, Rattus norvegicus
gtcaccctcagcgagtgcttgccta

SEQ ID NO: 648497 - DNA, 25 bp, Rattus norvegicus
gcgagtgcttgcctaaaacccttta

SEQ ID NO: 648498 - DNA, 25 bp, Rattus norvegicus
ggtagaccctcctggctgtgtccac

SEQ ID NO: 648499 - DNA, 25 bp, Rattus norvegicus
cactcccgctgtgccacggaagaga

SEQ ID NO: 648500 - DNA, 25 bp, Rattus norvegicus
ggaagagagaagtgcccagatcata

SEQ ID NO: 648501 - DNA, 25 bp, Rattus norvegicus
atattgaaagtccacctacgggccg

SEQ ID NO: 648502 - DNA, 25 bp, Rattus norvegicus
taacaaggtggagaatgagccaccc

SEQ ID NO: 648503 - DNA, 25 bp, Rattus norvegicus
agccacccggagactgtggccgaga

SEQ ID NO: 648504 - DNA, 25 bp, Rattus norvegicus
gtgagccctcaaagcgcaacctgcg

SEQ ID NO: 648505 - DNA, 25 bp, Rattus norvegicus
tgactgtctgagaccacggaccggc

SEQ ID NO: 648506 - DNA, 25 bp, Rattus norvegicus
tcccgacgcagggaacgtgactgtc

SEQ ID NO: 648507 - DNA, 25 bp, Rattus norvegicus
gtgtggtgaatgacgtcagtccatc

SEQ ID NO: 648508 - DNA, 25 bp, Rattus norvegicus
tcagacaaaagagccgacgcgcctt

SEQ ID NO: 648509 - DNA, 25 bp, Rattus norvegicus
gccaccggatcacactcagacaaaa

SEQ ID NO: 648510 - DNA, 25 bp, Rattus norvegicus
tcctgtagactgctccggggaaatc

SEQ ID NO: 648511 - DNA, 25 bp, Rattus norvegicus
ggaactcgattcaggcgcgacgaca

SEQ ID NO: 648512 - DNA, 25 bp, Rattus norvegicus
ccatctatggggcaccgtctgattc

SEQ ID NO: 648513 - DNA, 25 bp, Rattus norvegicus
ggcctcaccgatctctttctcgttg

SEQ ID NO: 648514 - DNA, 25 bp, Rattus norvegicus
ttctcgtgggccttggcattggact

SEQ ID NO: 648515 - DNA, 25 bp, Rattus norvegicus
ggcatcttgtcccacgcttctcgtg

SEQ ID NO: 648516 - DNA, 25 bp, Rattus norvegicus
tcaccggaatgcctggaaccaagcc

SEQ ID NO: 648517 - DNA, 25 bp, Rattus norvegicus
cttctccggagcctcggcatcttgt

SEQ ID NO: 648518 - DNA, 25 bp, Rattus norvegicus
atcgcctgtctggttttcggttccg

SEQ ID NO: 648519 - DNA, 25 bp, Rattus norvegicus
accggaaatgcacctagggagcgga

SEQ ID NO: 648520 - DNA, 25 bp, Rattus norvegicus
cccttccatggcttccggtaggcga

SEQ ID NO: 648521 - DNA, 25 bp, Rattus norvegicus
ggcggctcagcctcttctgtgaagt

SEQ ID NO: 648522 - DNA, 25 bp, Rattus norvegicus
ctgtcctctccactttacttctatg

SEQ ID NO: 648523 - DNA, 25 bp, Rattus norvegicus
tacttctatgccagaggacccgggg

SEQ ID NO: 648524 - DNA, 25 bp, Rattus norvegicus
tgctccgaggccagaaccggaaatg

SEQ ID NO: 648525 - DNA, 25 bp, Rattus norvegicus
tgtcaccactgagccagtcagcatg

SEQ ID NO: 648526 - DNA, 25 bp, Rattus norvegicus
ctcgacttagccaaccggggcagca

SEQ ID NO: 648527 - DNA, 25 bp, Rattus norvegicus
tctgagcgctcagccggaaatgctc

SEQ ID NO: 648528 - DNA, 25 bp, Rattus norvegicus
tcatcactatgtacgaccgtgctcc

SEQ ID NO: 648529 - DNA, 25 bp, Rattus norvegicus
tgtctagggacaacgcaggcctcct

SEQ ID NO: 648530 - DNA, 25 bp, Rattus norvegicus
cgcacactacctccgtgtctaggga

SEQ ID NO: 648531 - DNA, 25 bp, Rattus norvegicus
cagtcagcatgcagctcgcacacta

SEQ ID NO: 648532 - DNA, 25 bp, Rattus norvegicus
cgcagtggacgagggaccttcaaac

SEQ ID NO: 648533 - DNA, 25 bp, Rattus norvegicus
tcgctccatcctcgcttacataagg

SEQ ID NO: 648534 - DNA, 25 bp, Rattus norvegicus
cccactcctagaggcgacagtctgt

SEQ ID NO: 648535 - DNA, 25 bp, Rattus norvegicus
agccagggaatctctcccgcacaga

SEQ ID NO: 648536 - DNA, 25 bp, Rattus norvegicus
tcccgcacagaagcgcgaggatccg

SEQ ID NO: 648537 - DNA, 25 bp, Rattus norvegicus
agcaagtgagcccagtggactccac

SEQ ID NO: 648538 - DNA, 25 bp, Rattus norvegicus
gcgctccggctgctgttatttctca

SEQ ID NO: 648539 - DNA, 25 bp, Rattus norvegicus
tatttctcaggactgcctggcggtg

SEQ ID NO: 648540 - DNA, 25 bp, Rattus norvegicus
gctttctgctgtttgcgcgtctcct

SEQ ID NO: 648541 - DNA, 25 bp, Rattus norvegicus
ctctgccgacgatgaggaaaggtct

SEQ ID NO: 648542 - DNA, 25 bp, Rattus norvegicus
ggactaggatacttgctgcagatgc

SEQ ID NO: 648543 - DNA, 25 bp, Rattus norvegicus
ccaggtgtcccttgtcagcgctgga

SEQ ID NO: 648544 - DNA, 25 bp, Rattus norvegicus
ccctgcccttggagaaagtggagtg

SEQ ID NO: 648545 - DNA, 25 bp, Rattus norvegicus
agatgcttgtgttacctgccctggc

SEQ ID NO: 648546 - DNA, 25 bp, Rattus norvegicus
gccaagcacttagcgcaggagatta

SEQ ID NO: 648547 - DNA, 25 bp, Rattus norvegicus
gactccaaatggcagagcgcggtga

SEQ ID NO: 648548 - DNA, 25 bp, Rattus norvegicus
tgggaaggactccaaatggcagagc

SEQ ID NO: 648549 - DNA, 25 bp, Rattus norvegicus
gtgcgagctgggaaggactccaaat

SEQ ID NO: 648550 - DNA, 25 bp, Rattus norvegicus
ccagaaacaaaagcgcgtggaggca

SEQ ID NO: 648551 - DNA, 25 bp, Rattus norvegicus
ttcagcttccagaaacaaaagcgcg

SEQ ID NO: 648552 - DNA, 25 bp, Rattus norvegicus
gctggtccaaaagcctcgccacacg

SEQ ID NO: 648553 - DNA, 25 bp, Rattus norvegicus
tcctcagagcatccctggcgctgca

SEQ ID NO: 648554 - DNA, 25 bp, Rattus norvegicus
cttagcgcaggagattacgcggccc

SEQ ID NO: 648555 - DNA, 25 bp, Rattus norvegicus
tggcagagcgcggtgaacttcaact

SEQ ID NO: 648556 - DNA, 25 bp, Rattus norvegicus
ccaaatggcagagcgcggtgaactt

SEQ ID NO: 648557 - DNA, 25 bp, Rattus norvegicus
gccacctccagagccgtcctcagag

SEQ ID NO: 648558 - DNA, 25 bp, Rattus norvegicus
gtgaacttcaacttctccggggcca

SEQ ID NO: 648559 - DNA, 25 bp, Rattus norvegicus
aacttcaacttctccggggccagcg

SEQ ID NO: 648560 - DNA, 25 bp, Rattus norvegicus
tttaagtagactgccctgccctcga

SEQ ID NO: 648561 - DNA, 25 bp, Rattus norvegicus
gtggcgaagcgacacattccggacc

SEQ ID NO: 648562 - DNA, 25 bp, Rattus norvegicus
tgccggagaagtagtagctgatctt

SEQ ID NO: 648563 - DNA, 25 bp, Rattus norvegicus
atcttgaaggggagcacggacacga

SEQ ID NO: 648564 - DNA, 25 bp, Rattus norvegicus
acgaagaggacatcggccatggcca

SEQ ID NO: 648565 - DNA, 25 bp, Rattus norvegicus
gccatggccaggtgcagcatgtaca

SEQ ID NO: 648566 - DNA, 25 bp, Rattus norvegicus
gcatgtacaccacggccggcttctt

SEQ ID NO: 648567 - DNA, 25 bp, Rattus norvegicus
gccggcttcttgaccttcatccgaa

SEQ ID NO: 648568 - DNA, 25 bp, Rattus norvegicus
tccgaaagacaaacacagcgatggc

SEQ ID NO: 648569 - DNA, 25 bp, Rattus norvegicus
cacagcgatggccaggatgttcagg

SEQ ID NO: 648570 - DNA, 25 bp, Rattus norvegicus
ggctgactatgaacacaaacgtgta

SEQ ID NO: 648571 - DNA, 25 bp, Rattus norvegicus
tacacggagggtatgaagagcgtca

SEQ ID NO: 648572 - DNA, 25 bp, Rattus norvegicus
cgaactgccaatcggtgccggagaa

SEQ ID NO: 648573 - DNA, 25 bp, Rattus norvegicus
ctggtcagatatccggaggcgtcct

SEQ ID NO: 648574 - DNA, 25 bp, Rattus norvegicus
tcagcgctgtgacggggctcgaaca

SEQ ID NO: 648575 - DNA, 25 bp, Rattus norvegicus
tgctatgtacggtcagctctgtgac

SEQ ID NO: 648576 - DNA, 25 bp, Rattus norvegicus
acggggctcgaacatgctatgtacg

SEQ ID NO: 648577 - DNA, 25 bp, Rattus norvegicus
tacagtcagctctgtgacggggctc

SEQ ID NO: 648578 - DNA, 25 bp, Rattus norvegicus
cggggctcgaacacacctatgtaca

SEQ ID NO: 648579 - DNA, 25 bp, Rattus norvegicus
ggctcgaacacacctatgtacggtc

SEQ ID NO: 648580 - DNA, 25 bp, Rattus norvegicus
gacggggctcgaacacacctatgta

SEQ ID NO: 648581 - DNA, 25 bp, Rattus norvegicus
atgctatgtacggtcagctctgtga

SEQ ID NO: 648582 - DNA, 25 bp, Rattus norvegicus
gacggggctcgaacatgctatgtac

SEQ ID NO: 648583 - DNA, 25 bp, Rattus norvegicus
agtcagctctgtgacggggctcgaa

SEQ ID NO: 648584 - DNA, 25 bp, Rattus norvegicus
acacacctatgtacagtcagctctg

SEQ ID NO: 648585 - DNA, 25 bp, Rattus norvegicus
acggggctcgaacacacctatgtac

SEQ ID NO: 648586 - DNA, 25 bp, Rattus norvegicus
tcagctctgtgacggggctcgaaca

SEQ ID NO: 648587 - DNA, 25 bp, Rattus norvegicus
tgtgacggggctcgaacacacctat

SEQ ID NO: 648588 - DNA, 25 bp, Rattus norvegicus
cttcctgctttggacggagctgttg

SEQ ID NO: 648589 - DNA, 25 bp, Rattus norvegicus
gcgtcgtcatgcacccaacactttt

SEQ ID NO: 648590 - DNA, 25 bp, Rattus norvegicus
cgggcttgtccctgcggatcggcac

SEQ ID NO: 648591 - DNA, 25 bp, Rattus norvegicus
atgcacccaacactttttggccttc

SEQ ID NO: 648592 - DNA, 25 bp, Rattus norvegicus
tcccgacccgtagctgcgcggagtg

SEQ ID NO: 648593 - DNA, 25 bp, Rattus norvegicus
gcgcgagtgactcgcacataaaatc

SEQ ID NO: 648594 - DNA, 25 bp, Rattus norvegicus
tcgcacataaaatcccggctcgggg

SEQ ID NO: 648595 - DNA, 25 bp, Rattus norvegicus
agctgttggcggagccttgaagatg

SEQ ID NO: 648596 - DNA, 25 bp, Rattus norvegicus
cttgaagatggcgtcgaccagccgg

SEQ ID NO: 648597 - DNA, 25 bp, Rattus norvegicus
caacggcctccgagcgagtggagat

SEQ ID NO: 648598 - DNA, 25 bp, Rattus norvegicus
agaaggccgccacgggcgtcccttg

SEQ ID NO: 648599 - DNA, 25 bp, Rattus norvegicus
ggcgtcccttgtccgcctgagtcat

SEQ ID NO: 648600 - DNA, 25 bp, Rattus norvegicus
agccagtgctgcttcctgctttgga

SEQ ID NO: 648601 - DNA, 25 bp, Rattus norvegicus
ctcggggcgtctaagagccagtgct

SEQ ID NO: 648602 - DNA, 25 bp, Rattus norvegicus
tgcgcttaacggctccgcgcgaacg

SEQ ID NO: 648603 - DNA, 25 bp, Rattus norvegicus
cgcccacagcctgggagtcattcaa

SEQ ID NO: 648604 - DNA, 25 bp, Rattus norvegicus
cgcaaaagcagcctcacttggcggc

SEQ ID NO: 648605 - DNA, 25 bp, Rattus norvegicus
tggctgtcaccgtgtcgcaaaagca

SEQ ID NO: 648606 - DNA, 25 bp, Rattus norvegicus
tcctcctgtcgcaccatttggctgt

SEQ ID NO: 648607 - DNA, 25 bp, Rattus norvegicus
aaagcagcaactagggagtcatgga

SEQ ID NO: 648608 - DNA, 25 bp, Rattus norvegicus
aggaccggagagaaagcagcaacta

SEQ ID NO: 648609 - DNA, 25 bp, Rattus norvegicus
tcgggactccgcacctgaaagcggc

SEQ ID NO: 648610 - DNA, 25 bp, Rattus norvegicus
tgcagctccgtgaggaggatctccc

SEQ ID NO: 648611 - DNA, 25 bp, Rattus norvegicus
gcccttacctgcagctccgtgagga

SEQ ID NO: 648612 - DNA, 25 bp, Rattus norvegicus
agtttccacacctagcgggccaggg

SEQ ID NO: 648613 - DNA, 25 bp, Rattus norvegicus
aggagaagcggctccggcctgacaa

SEQ ID NO: 648614 - DNA, 25 bp, Rattus norvegicus
agtcattcaaaggagttcgggagcg

SEQ ID NO: 648615 - DNA, 25 bp, Rattus norvegicus
tccgcgcgaacgctaagtctggcct

SEQ ID NO: 648616 - DNA, 25 bp, Rattus norvegicus
tgcgagagcagattaatcagagagc

SEQ ID NO: 648617 - DNA, 25 bp, Rattus norvegicus
agcagcgaagcggttaagcagcagc

SEQ ID NO: 648618 - DNA, 25 bp, Rattus norvegicus
cgaagcggttaagcagcagccggcc

SEQ ID NO: 648619 - DNA, 25 bp, Rattus norvegicus
aagcggttaagcagcagccggcccg

SEQ ID NO: 648620 - DNA, 25 bp, Rattus norvegicus
cgcgcccagagacccgcagagaaag

SEQ ID NO: 648621 - DNA, 25 bp, Rattus norvegicus
cagagacccgcagagaaagggcagc

SEQ ID NO: 648622 - DNA, 25 bp, Rattus norvegicus
agacccgcagagaaagggcagcgcc

SEQ ID NO: 648623 - DNA, 25 bp, Rattus norvegicus
acccgcagagaaagggcagcgccgc

SEQ ID NO: 648624 - DNA, 25 bp, Rattus norvegicus
gcctcggcgcggttaatcacgcgct

SEQ ID NO: 648625 - DNA, 25 bp, Rattus norvegicus
ccctctcgctgctgatttgcgagag

SEQ ID NO: 648626 - DNA, 25 bp, Rattus norvegicus
ctcgctgctgatttgcgagagcaga

SEQ ID NO: 648627 - DNA, 25 bp, Rattus norvegicus
cgctgctgatttgcgagagcagatt

SEQ ID NO: 648628 - DNA, 25 bp, Rattus norvegicus
gctgatttgcgagagcagattaatc

SEQ ID NO: 648629 - DNA, 25 bp, Rattus norvegicus
gagagcagattaatcagagagcgcg

SEQ ID NO: 648630 - DNA, 25 bp, Rattus norvegicus
tcacacatgtgtaagcgccggcgaa

SEQ ID NO: 648631 - DNA, 25 bp, Rattus norvegicus
attgccaaacttgcagccgcgattg

SEQ ID NO: 648632 - DNA, 25 bp, Rattus norvegicus
agccgcgattgcagcagtggctgcc

SEQ ID NO: 648633 - DNA, 25 bp, Rattus norvegicus
agacttgacacttctgcgccgggcc

SEQ ID NO: 648634 - DNA, 25 bp, Rattus norvegicus
gccacttagcgtggggctccgtcta

SEQ ID NO: 648635 - DNA, 25 bp, Rattus norvegicus
tttcctgcttctgcgagaactccct

SEQ ID NO: 648636 - DNA, 25 bp, Rattus norvegicus
ccgcctctcgcagtgttgcaatata

SEQ ID NO: 648637 - DNA, 25 bp, Rattus norvegicus
tgcaatataggggagaaacaggtaa

SEQ ID NO: 648638 - DNA, 25 bp, Rattus norvegicus
gcgcgtacaaagtgaagccacattg

SEQ ID NO: 648639 - DNA, 25 bp, Rattus norvegicus
ggcaggttttattattccgctgaac

SEQ ID NO: 648640 - DNA, 25 bp, Rattus norvegicus
agtctcgtttcagtcaccctttgtc

SEQ ID NO: 648641 - DNA, 25 bp, Rattus norvegicus
ttattccgctgaacaatccggccgc

SEQ ID NO: 648642 - DNA, 25 bp, Rattus norvegicus
cttgggattcttgctctgtcagtca

SEQ ID NO: 648643 - DNA, 25 bp, Rattus norvegicus
agacccggggagcacttgggattct

SEQ ID NO: 648644 - DNA, 25 bp, Rattus norvegicus
gccaccgagcctagctctcagagtt

SEQ ID NO: 648645 - DNA, 25 bp, Rattus norvegicus
atcgcccgttttgtctttctctctc

SEQ ID NO: 648646 - DNA, 25 bp, Rattus norvegicus
ccagaccatggtgaatccgggcagc

SEQ ID NO: 648647 - DNA, 25 bp, Rattus norvegicus
tgctctatgccatggacagctactg

SEQ ID NO: 648648 - DNA, 25 bp, Rattus norvegicus
attgcggaccgctttctgctctatg

SEQ ID NO: 648649 - DNA, 25 bp, Rattus norvegicus
gacttctaacttttgcatcgcccgt

SEQ ID NO: 648650 - DNA, 25 bp, Rattus norvegicus
tggacagctactggcacagccgctg

SEQ ID NO: 648651 - DNA, 25 bp, Rattus norvegicus
aggcgcccagcgatcgacttctaac

SEQ ID NO: 648652 - DNA, 25 bp, Rattus norvegicus
ttgagaaaagtaaacaggcggctgc

SEQ ID NO: 648653 - DNA, 25 bp, Rattus norvegicus
cgctttggaaagttgagagcagctc

SEQ ID NO: 648654 - DNA, 25 bp, Rattus norvegicus
ctgaaattgtcagcggcgagcgctt

SEQ ID NO: 648655 - DNA, 25 bp, Rattus norvegicus
tagctctcagagttttgacagtccc

SEQ ID NO: 648656 - DNA, 25 bp, Rattus norvegicus
tgcctcaagtgctcctgctgccagg

SEQ ID NO: 648657 - DNA, 25 bp, Rattus norvegicus
ttctcctgcagccactccggggagg

SEQ ID NO: 648658 - DNA, 25 bp, Rattus norvegicus
gcgctctcaatctcgagctcgcttg

SEQ ID NO: 648659 - DNA, 25 bp, Rattus norvegicus
cgatgacaactgacgcaccggagtc

SEQ ID NO: 648660 - DNA, 25 bp, Rattus norvegicus
gcggtggcgatgacaactgacgcac

SEQ ID NO: 648661 - DNA, 25 bp, Rattus norvegicus
attctctggccagagccgggagcca

SEQ ID NO: 648662 - DNA, 25 bp, Rattus norvegicus
gggagcaatccaagcccggaggcca

SEQ ID NO: 648663 - DNA, 25 bp, Rattus norvegicus
ccggaggagttaggtgacgtcacct

SEQ ID NO: 648664 - DNA, 25 bp, Rattus norvegicus
aggtgacgtcacctccaggaggact

SEQ ID NO: 648665 - DNA, 25 bp, Rattus norvegicus
aggaggactcgctttttcattaatg

SEQ ID NO: 648666 - DNA, 25 bp, Rattus norvegicus
gcgctagtggggagagccacccaca

SEQ ID NO: 648667 - DNA, 25 bp, Rattus norvegicus
gtcagccgcttcgacgagcaggtaa

SEQ ID NO: 648668 - DNA, 25 bp, Rattus norvegicus
cccgagccgtggaaaggatcccact

SEQ ID NO: 648669 - DNA, 25 bp, Rattus norvegicus
cgtggaaaggatcccacttccggtg

SEQ ID NO: 648670 - DNA, 25 bp, Rattus norvegicus
caccggagtcggttcagattctctg

SEQ ID NO: 648671 - DNA, 25 bp, Rattus norvegicus
ttcattaatgaaaccggccagcgcg

SEQ ID NO: 648672 - DNA, 25 bp, Rattus norvegicus
acgagtagtagcttttgcaaactcc

SEQ ID NO: 648673 - DNA, 25 bp, Rattus norvegicus
gcagccgcagtgagctgagctgagc

SEQ ID NO: 648674 - DNA, 25 bp, Rattus norvegicus
cgtccgcaggcagccgcagtgagct

SEQ ID NO: 648675 - DNA, 25 bp, Rattus norvegicus
gttcacgtggcgtccgcaggcagcc

SEQ ID NO: 648676 - DNA, 25 bp, Rattus norvegicus
tccgctccggcggttcacgtggcgt

SEQ ID NO: 648677 - DNA, 25 bp, Rattus norvegicus
ccatatccactgtgcagggccgcga

SEQ ID NO: 648678 - DNA, 25 bp, Rattus norvegicus
gtggcgggccatatccactgtgcag

SEQ ID NO: 648679 - DNA, 25 bp, Rattus norvegicus
ctccggtcggagctggaaagtgggt

SEQ ID NO: 648680 - DNA, 25 bp, Rattus norvegicus
aaagtgcggccagaggaggaagttc

SEQ ID NO: 648681 - DNA, 25 bp, Rattus norvegicus
agtagcttttgcaaactccggttct

SEQ ID NO: 648682 - DNA, 25 bp, Rattus norvegicus
gagccaacgagtagtagcttttgca

SEQ ID NO: 648683 - DNA, 25 bp, Rattus norvegicus
cccaagagccaacgagtagtagctt

SEQ ID NO: 648684 - DNA, 25 bp, Rattus norvegicus
tacttcgggctgactggcgcggaaa

SEQ ID NO: 648685 - DNA, 25 bp, Rattus norvegicus
ctccacccaagagccaacgagtagt

SEQ ID NO: 648686 - DNA, 25 bp, Rattus norvegicus
tcactcggaggactcactcgggagg

SEQ ID NO: 648687 - DNA, 25 bp, Rattus norvegicus
gactcactcgggaggactcactcgg

SEQ ID NO: 648688 - DNA, 25 bp, Rattus norvegicus
tcactcgggaggactcactcgggag

SEQ ID NO: 648689 - DNA, 25 bp, Rattus norvegicus
ctcactcgggaggactcactcggga

SEQ ID NO: 648690 - DNA, 25 bp, Rattus norvegicus
ggactcactcgggaggactcactcg

SEQ ID NO: 648691 - DNA, 25 bp, Rattus norvegicus
aggactcactcggaggactcactcg

SEQ ID NO: 648692 - DNA, 25 bp, Rattus norvegicus
aggactcactcgggaggactcactc

SEQ ID NO: 648693 - DNA, 25 bp, Rattus norvegicus
actcactcggaggactcactcggga

SEQ ID NO: 648694 - DNA, 25 bp, Rattus norvegicus
actcggaggactcactcgggaggac

SEQ ID NO: 648695 - DNA, 25 bp, Rattus norvegicus
tcggaggactcactcgggaggactc

SEQ ID NO: 648696 - DNA, 25 bp, Rattus norvegicus
actcactcgggaggactcactcggg

SEQ ID NO: 648697 - DNA, 25 bp, Rattus norvegicus
ggaggactcactcgggaggactcac

SEQ ID NO: 648698 - DNA, 25 bp, Rattus norvegicus
gactcactcggaggactcactcggg

SEQ ID NO: 648699 - DNA, 25 bp, Rattus norvegicus
cggaggactcactcgggaggactca

SEQ ID NO: 648700 - DNA, 25 bp, Rattus norvegicus
aacttgggcggcatcataatcctga

SEQ ID NO: 648701 - DNA, 25 bp, Rattus norvegicus
gcccacttggctatacccggcaatg

SEQ ID NO: 648702 - DNA, 25 bp, Rattus norvegicus
ctcgcgatcaagacataccgcgggg

SEQ ID NO: 648703 - DNA, 25 bp, Rattus norvegicus
gcggcatcataatcctgaggagccc

SEQ ID NO: 648704 - DNA, 25 bp, Rattus norvegicus
cctctctccgtggagggccaacggg

SEQ ID NO: 648705 - DNA, 25 bp, Rattus norvegicus
agctcgacgtgcctgggtcccagct

SEQ ID NO: 648706 - DNA, 25 bp, Rattus norvegicus
ctcctccagcttctggatctggttc

SEQ ID NO: 648707 - DNA, 25 bp, Rattus norvegicus
ggtcccagctctcgggactcttcga

SEQ ID NO: 648708 - DNA, 25 bp, Rattus norvegicus
tccaagaagagcatcgccaccgcga

SEQ ID NO: 648709 - DNA, 25 bp, Rattus norvegicus
cagctgcaacttgggcggcatcata

SEQ ID NO: 648710 - DNA, 25 bp, Rattus norvegicus
tctggttctccaagaagagcatcgc

SEQ ID NO: 648711 - DNA, 25 bp, Rattus norvegicus
agcttctggatctggttctccaaga

SEQ ID NO: 648712 - DNA, 25 bp, Rattus norvegicus
agctcggctgcctcacctagcttcg

SEQ ID NO: 648713 - DNA, 25 bp, Rattus norvegicus
tgaaacccgccgctcgcgatcaaga

SEQ ID NO: 648714 - DNA, 25 bp, Rattus norvegicus
acaggcctcaagcaaggcgtttttc

SEQ ID NO: 648715 - DNA, 25 bp, Rattus norvegicus
tccttccgtacagtggcgttcattg

SEQ ID NO: 648716 - DNA, 25 bp, Rattus norvegicus
cattggtccgaagaacggccgctta

SEQ ID NO: 648717 - DNA, 25 bp, Rattus norvegicus
ctagtaatgaacgagctgggacttc

SEQ ID NO: 648718 - DNA, 25 bp, Rattus norvegicus
gacttcgtggatagccgctgtaatg

SEQ ID NO: 648719 - DNA, 25 bp, Rattus norvegicus
ggaaagcgcctgatttgaatcccta

SEQ ID NO: 648720 - DNA, 25 bp, Rattus norvegicus
cctgagggctgtttaatagccgatc

SEQ ID NO: 648721 - DNA, 25 bp, Rattus norvegicus
tatcgccgcttccatccggagtgaa

SEQ ID NO: 648722 - DNA, 25 bp, Rattus norvegicus
ggcttctgtagtcgactaactaaca

SEQ ID NO: 648723 - DNA, 25 bp, Rattus norvegicus
cttcgcatcaggcagtgcagtggac

SEQ ID NO: 648724 - DNA, 25 bp, Rattus norvegicus
cggcacaagggtcctcagactccta

SEQ ID NO: 648725 - DNA, 25 bp, Rattus norvegicus
tcctaaagattgacggcagaccgca

SEQ ID NO: 648726 - DNA, 25 bp, Rattus norvegicus
tactgctggcgactgcgtttcaagc

SEQ ID NO: 648727 - DNA, 25 bp, Rattus norvegicus
agccgatcactttcaggcttctgta

SEQ ID NO: 648728 - DNA, 25 bp, Rattus norvegicus
ccgggacgagaagccaacgttctgt

SEQ ID NO: 648729 - DNA, 25 bp, Rattus norvegicus
ccggctccgagtctatcctcataga

SEQ ID NO: 648730 - DNA, 25 bp, Rattus norvegicus
ggaaatacttcctagcgcacattta

SEQ ID NO: 648731 - DNA, 25 bp, Rattus norvegicus
agcgcacatttaggactctgaactc

SEQ ID NO: 648732 - DNA, 25 bp, Rattus norvegicus
taggactctgaactctgcacacggg

SEQ ID NO: 648733 - DNA, 25 bp, Rattus norvegicus
tgaactctgcacacggggccacgtg

SEQ ID NO: 648734 - DNA, 25 bp, Rattus norvegicus
cacgtggttggcgataatctggctc

SEQ ID NO: 648735 - DNA, 25 bp, Rattus norvegicus
ggcggctgggtaaccgacaccatcc

SEQ ID NO: 648736 - DNA, 25 bp, Rattus norvegicus
ggctccctcttgttagtcaaagcta

SEQ ID NO: 648737 - DNA, 25 bp, Rattus norvegicus
tagtcaaagctacctctttccgccg

SEQ ID NO: 648738 - DNA, 25 bp, Rattus norvegicus
ccatgcgtttgtcaacagggccaac

SEQ ID NO: 648739 - DNA, 25 bp, Rattus norvegicus
tcaacagggccaacccgggacgaga

SEQ ID NO: 648740 - DNA, 25 bp, Rattus norvegicus
gcgataatctggctccctcttgtta

SEQ ID NO: 648741 - DNA, 25 bp, Rattus norvegicus
agccaacgttctgtttgtgttaaag

SEQ ID NO: 648742 - DNA, 25 bp, Rattus norvegicus
cccggctgaggaaagtgcccgcgtc

SEQ ID NO: 648743 - DNA, 25 bp, Rattus norvegicus
agcgcgaccgcggtggaaaacagcc

SEQ ID NO: 648744 - DNA, 25 bp, Rattus norvegicus
gaggtcgcatccgaaggaacccacc

SEQ ID NO: 648745 - DNA, 25 bp, Rattus norvegicus
ccaccgggacggaggtcgcatccga

SEQ ID NO: 648746 - DNA, 25 bp, Rattus norvegicus
cagagcagctgcgagccaccgggac

SEQ ID NO: 648747 - DNA, 25 bp, Rattus norvegicus
tcgcgtcgcagagcagctgcgagcc

SEQ ID NO: 648748 - DNA, 25 bp, Rattus norvegicus
cccgcgcagctgtcgtttcctgagg

SEQ ID NO: 648749 - DNA, 25 bp, Rattus norvegicus
catgatgttcatgctgggcggcaac

SEQ ID NO: 648750 - DNA, 25 bp, Rattus norvegicus
cggccgccagcttcttcacgttgaa

SEQ ID NO: 648751 - DNA, 25 bp, Rattus norvegicus
cgcccatccgcaggcctgggtaccc

SEQ ID NO: 648752 - DNA, 25 bp, Rattus norvegicus
ttgcctcgccagctgggacaccgag

SEQ ID NO: 648753 - DNA, 25 bp, Rattus norvegicus
aaaggtgctcggcttgccttgcctc

SEQ ID NO: 648754 - DNA, 25 bp, Rattus norvegicus
tggcgcaaaggtgctcggcttgcct

SEQ ID NO: 648755 - DNA, 25 bp, Rattus norvegicus
cttcacgttgaaatccatgatgttc

SEQ ID NO: 648756 - DNA, 25 bp, Rattus norvegicus
aacgtttggctcctgggtagatgca

SEQ ID NO: 648757 - DNA, 25 bp, Rattus norvegicus
tacagccattgtaggtagtggcggc

SEQ ID NO: 648758 - DNA, 25 bp, Rattus norvegicus
cttagagagccctacagccattgta

SEQ ID NO: 648759 - DNA, 25 bp, Rattus norvegicus
ggcagaccttagagagccctacagc

SEQ ID NO: 648760 - DNA, 25 bp, Rattus norvegicus
tctggtgactcctcgacttctcgtc

SEQ ID NO: 648761 - DNA, 25 bp, Rattus norvegicus
tccgccgctgcctgttctggtgact

SEQ ID NO: 648762 - DNA, 25 bp, Rattus norvegicus
tcctgggtagatgcagtctgtccgc

SEQ ID NO: 648763 - DNA, 25 bp, Rattus norvegicus
gccggttactagcaacgtttggctc

SEQ ID NO: 648764 - DNA, 25 bp, Rattus norvegicus
gggcgtccgtttccagagaagccgc

SEQ ID NO: 648765 - DNA, 25 bp, Rattus norvegicus
cgagccaattagctgcgtcggagcg

SEQ ID NO: 648766 - DNA, 25 bp, Rattus norvegicus
tcgcgctctagagcccgagccaatt

SEQ ID NO: 648767 - DNA, 25 bp, Rattus norvegicus
cagagggaacggcactcgcgctcta

SEQ ID NO: 648768 - DNA, 25 bp, Rattus norvegicus
tgaccctgggcacccggaagtgaaa

SEQ ID NO: 648769 - DNA, 25 bp, Rattus norvegicus
tcgctcccaccaatcacagagggaa

SEQ ID NO: 648770 - DNA, 25 bp, Rattus norvegicus
gtgacattcagggaagggaaacttg

SEQ ID NO: 648771 - DNA, 25 bp, Rattus norvegicus
ggtgtgacagactcgggaatacctg

SEQ ID NO: 648772 - DNA, 25 bp, Rattus norvegicus
tgcctgcaagcacggaaactcttct

SEQ ID NO: 648773 - DNA, 25 bp, Rattus norvegicus
cacggaaactcttctcaggataatg

SEQ ID NO: 648774 - DNA, 25 bp, Rattus norvegicus
gataatgattaatgcgcacggtgga

SEQ ID NO: 648775 - DNA, 25 bp, Rattus norvegicus
gctcatggttgtcagaaaggtaaca

SEQ ID NO: 648776 - DNA, 25 bp, Rattus norvegicus
aaaggtaacacatggcctgacagga

SEQ ID NO: 648777 - DNA, 25 bp, Rattus norvegicus
gggctcactttccagtcattccaac

SEQ ID NO: 648778 - DNA, 25 bp, Rattus norvegicus
tggagccgtagatatttggaaagta

SEQ ID NO: 648779 - DNA, 25 bp, Rattus norvegicus
cagacaagtgggctgtgtgacattc

SEQ ID NO: 648780 - DNA, 25 bp, Rattus norvegicus
cctgacaggatgactgaggagcagc

SEQ ID NO: 648781 - DNA, 25 bp, Rattus norvegicus
ctcgggaatacctgggctcactttc

SEQ ID NO: 648782 - DNA, 25 bp, Rattus norvegicus
cagctgtgaagcagacaagtgggct

SEQ ID NO: 648783 - DNA, 25 bp, Rattus norvegicus
cccagagaaatgtacagtgcctgca

SEQ ID NO: 648784 - DNA, 25 bp, Rattus norvegicus
tggtagcgcctcagcgaagaacgga

SEQ ID NO: 648785 - DNA, 25 bp, Rattus norvegicus
gctgctttacggctacctcggcttc

SEQ ID NO: 648786 - DNA, 25 bp, Rattus norvegicus
ccgccgagccgtaaagaacgctata

SEQ ID NO: 648787 - DNA, 25 bp, Rattus norvegicus
cgtaaagaacgctataccggtcgtg

SEQ ID NO: 648788 - DNA, 25 bp, Rattus norvegicus
cagcttcggcctaggctcgtgagct

SEQ ID NO: 648789 - DNA, 25 bp, Rattus norvegicus
ggcacagctgctttacggctacctc

SEQ ID NO: 648790 - DNA, 25 bp, Rattus norvegicus
tgatggagtttgcagctgagaaaga

SEQ ID NO: 648791 - DNA, 25 bp, Rattus norvegicus
cttccagcgagcgtgcagggcttgc

SEQ ID NO: 648792 - DNA, 25 bp, Rattus norvegicus
ttgcggcttctggtttgctgcacgt

SEQ ID NO: 648793 - DNA, 25 bp, Rattus norvegicus
gcgctgtcggtgatttgtttggtaa

SEQ ID NO: 648794 - DNA, 25 bp, Rattus norvegicus
taatctcttgttggcgtggtagcgc

SEQ ID NO: 648795 - DNA, 25 bp, Rattus norvegicus
cctcagcgaagaacggagtggcagc

SEQ ID NO: 648796 - DNA, 25 bp, Rattus norvegicus
ctcgtgagctgatggagtttgcagc

SEQ ID NO: 648797 - DNA, 25 bp, Rattus norvegicus
tataccggtcgtgaagagtcgtggc

SEQ ID NO: 648798 - DNA, 25 bp, Rattus norvegicus
gaactggcgccgaaattgcattcca

SEQ ID NO: 648799 - DNA, 25 bp, Rattus norvegicus
tccctgctgtgaaagattagggccc

SEQ ID NO: 648800 - DNA, 25 bp, Rattus norvegicus
gttgcagtgacgtatgcgctgtctg

SEQ ID NO: 648801 - DNA, 25 bp, Rattus norvegicus
gggagcccgccctttataatgcctg

SEQ ID NO: 648802 - DNA, 25 bp, Rattus norvegicus
agattgcaggcgcttctctagggcg

SEQ ID NO: 648803 - DNA, 25 bp, Rattus norvegicus
cgtcttgatggtgctggagctcatt

SEQ ID NO: 648804 - DNA, 25 bp, Rattus norvegicus
caccagcctggtcaagtggagaagg

SEQ ID NO: 648805 - DNA, 25 bp, Rattus norvegicus
cgtcgtccgagcgtaaagcaacagc

SEQ ID NO: 648806 - DNA, 25 bp, Rattus norvegicus
ggagtgtctctatcccgtcccgaca

SEQ ID NO: 648807 - DNA, 25 bp, Rattus norvegicus
gctctctgttcaccaggagtgtctc

SEQ ID NO: 648808 - DNA, 25 bp, Rattus norvegicus
ttgctccgggaaggcacctaaacca

SEQ ID NO: 648809 - DNA, 25 bp, Rattus norvegicus
cgcgtgagactgctttgcattgctc

SEQ ID NO: 648810 - DNA, 25 bp, Rattus norvegicus
agttgcttcgcgcagaccttacagc

SEQ ID NO: 648811 - DNA, 25 bp, Rattus norvegicus
gctgcagtcctcgttgagttgcttc

SEQ ID NO: 648812 - DNA, 25 bp, Rattus norvegicus
tgccggccaccctgctctcgggtct

SEQ ID NO: 648813 - DNA, 25 bp, Rattus norvegicus
aagtcccttccacccagtcacgcag

SEQ ID NO: 648814 - DNA, 25 bp, Rattus norvegicus
ttccacccagtcacgcagcccttcc

SEQ ID NO: 648815 - DNA, 25 bp, Rattus norvegicus
cgcccgccaagcctctgtaattttc

SEQ ID NO: 648816 - DNA, 25 bp, Rattus norvegicus
tgaccggtccgatccgctgccaggg

SEQ ID NO: 648817 - DNA, 25 bp, Rattus norvegicus
tgccagggcttcctacggcgaagac

SEQ ID NO: 648818 - DNA, 25 bp, Rattus norvegicus
ccagggcttcctacggcgaagaccg

SEQ ID NO: 648819 - DNA, 25 bp, Rattus norvegicus
cagggcttcctacggcgaagaccgg

SEQ ID NO: 648820 - DNA, 25 bp, Rattus norvegicus
agtcgacagtctcaagtcccttcca

SEQ ID NO: 648821 - DNA, 25 bp, Rattus norvegicus
gtctcacgccggtcgcagagcagcg

SEQ ID NO: 648822 - DNA, 25 bp, Rattus norvegicus
cagagcagcgccctgcagcgggcct

SEQ ID NO: 648823 - DNA, 25 bp, Rattus norvegicus
gagtcgacagtctcaagtcccttcc

SEQ ID NO: 648824 - DNA, 25 bp, Rattus norvegicus
ctacggcgaagaccggcgccgggag

SEQ ID NO: 648825 - DNA, 25 bp, Rattus norvegicus
tctcgggtctcacgccggtcgcaga

SEQ ID NO: 648826 - DNA, 25 bp, Rattus norvegicus
agactccgtcatccggctccaaggg

SEQ ID NO: 648827 - DNA, 25 bp, Rattus norvegicus
cccggcgttcctgaaaagtgcatcc

SEQ ID NO: 648828 - DNA, 25 bp, Rattus norvegicus
gcaacgggccttggccaccaggcta

SEQ ID NO: 648829 - DNA, 25 bp, Rattus norvegicus
cacagggcgctacaaaaattatgtc

SEQ ID NO: 648830 - DNA, 25 bp, Rattus norvegicus
taaagcagaatccaggcctgcgctg

SEQ ID NO: 648831 - DNA, 25 bp, Rattus norvegicus
tccggccgcagtgccataaagcaga

SEQ ID NO: 648832 - DNA, 25 bp, Rattus norvegicus
agtcccgagtctgcagcgcctcaat

SEQ ID NO: 648833 - DNA, 25 bp, Rattus norvegicus
cgactcgaggtttccggcgactcac

SEQ ID NO: 648834 - DNA, 25 bp, Rattus norvegicus
ggtgaaagtctttcgagactccgtc

SEQ ID NO: 648835 - DNA, 25 bp, Rattus norvegicus
cctcggcccatatttggtgaaagtc

SEQ ID NO: 648836 - DNA, 25 bp, Rattus norvegicus
gacgtttccagcctcggcccatatt

SEQ ID NO: 648837 - DNA, 25 bp, Rattus norvegicus
ggcgactcactgcacaggacgtttc

SEQ ID NO: 648838 - DNA, 25 bp, Rattus norvegicus
ttcctgaaaagtgcatcccggccgc

SEQ ID NO: 648839 - DNA, 25 bp, Rattus norvegicus
tggccaccaggctaggatctgccgc

SEQ ID NO: 648840 - DNA, 25 bp, Rattus norvegicus
tcgcaggctcgcaggctcgcaggtt

SEQ ID NO: 648841 - DNA, 25 bp, Rattus norvegicus
gccgcaggaaggaggtaaagggcca

SEQ ID NO: 648842 - DNA, 25 bp, Rattus norvegicus
ccacccacgccgtggtgcgggctcc

SEQ ID NO: 648843 - DNA, 25 bp, Rattus norvegicus
ctcccagggcgaagaggtggatttc

SEQ ID NO: 648844 - DNA, 25 bp, Rattus norvegicus
cgaagaggtggatttcgctcgcgct

SEQ ID NO: 648845 - DNA, 25 bp, Rattus norvegicus
gtggatttcgctcgcgctgagcgcc

SEQ ID NO: 648846 - DNA, 25 bp, Rattus norvegicus
gcaccagctctacgtgggcgtgctg

SEQ ID NO: 648847 - DNA, 25 bp, Rattus norvegicus
cacattcatccgctgccaagaggag

SEQ ID NO: 648848 - DNA, 25 bp, Rattus norvegicus
tgccggccgacgagagcctgcctga

SEQ ID NO: 648849 - DNA, 25 bp, Rattus norvegicus
agagcctgcctgactgcgtgttcgt

SEQ ID NO: 648850 - DNA, 25 bp, Rattus norvegicus
tgtgcgaggagaccgccctcatcac

SEQ ID NO: 648851 - DNA, 25 bp, Rattus norvegicus
gcagcacattcatccgctgccaaga

SEQ ID NO: 648852 - DNA, 25 bp, Rattus norvegicus
agcgccagcaccagctctacgtggg

SEQ ID NO: 648853 - DNA, 25 bp, Rattus norvegicus
ctgctctcgggaagacccggccacc

SEQ ID NO: 648854 - DNA, 25 bp, Rattus norvegicus
ctatttcgcggcttacgggagcagc

SEQ ID NO: 648855 - DNA, 25 bp, Rattus norvegicus
cccagccgggcgacgactaacggtg

SEQ ID NO: 648856 - DNA, 25 bp, Rattus norvegicus
tacaacccgctcaacaagcagatcg

SEQ ID NO: 648857 - DNA, 25 bp, Rattus norvegicus
ggcgacgactaacggtggtgactcc

SEQ ID NO: 648858 - DNA, 25 bp, Rattus norvegicus
actcgtcggacgaggagaacagcga

SEQ ID NO: 648859 - DNA, 25 bp, Rattus norvegicus
acccgttgagctatttcgcggctta

SEQ ID NO: 648860 - DNA, 25 bp, Rattus norvegicus
agaaggacccgttgagctatttcgc

SEQ ID NO: 648861 - DNA, 25 bp, Rattus norvegicus
tcatggcagctgaagagaaggaccc

SEQ ID NO: 648862 - DNA, 25 bp, Rattus norvegicus
aacccgcagccgtcatggcagctga

SEQ ID NO: 648863 - DNA, 25 bp, Rattus norvegicus
ggggcgcaaaccgatcacttcccag

SEQ ID NO: 648864 - DNA, 25 bp, Rattus norvegicus
ttccctttgacgccgaagtgcctgc

SEQ ID NO: 648865 - DNA, 25 bp, Rattus norvegicus
cccgacgagctattccgcagcgtga

SEQ ID NO: 648866 - DNA, 25 bp, Rattus norvegicus
aaccgatcacttcccagcctagggg

SEQ ID NO: 648867 - DNA, 25 bp, Rattus norvegicus
ggagcagcagctccgactcgtcgga

SEQ ID NO: 648868 - DNA, 25 bp, Rattus norvegicus
gtctagagtgggacggcctcccagt

SEQ ID NO: 648869 - DNA, 25 bp, Rattus norvegicus
acccgccgctgcagagttatgccaa

SEQ ID NO: 648870 - DNA, 25 bp, Rattus norvegicus
gcagccgcctctgttccagcggtgg

SEQ ID NO: 648871 - DNA, 25 bp, Rattus norvegicus
agaagtctcgagagcctccgcgtga

SEQ ID NO: 648872 - DNA, 25 bp, Rattus norvegicus
gtcctcggatgcagctgtccagttg

SEQ ID NO: 648873 - DNA, 25 bp, Rattus norvegicus
ccggtcgtctccgacggagtctaga

SEQ ID NO: 648874 - DNA, 25 bp, Rattus norvegicus
atctgctgatccaggccatgcacga

SEQ ID NO: 648875 - DNA, 25 bp, Rattus norvegicus
cgagaggcctattatctgctgatcc

SEQ ID NO: 648876 - DNA, 25 bp, Rattus norvegicus
agacccagttgcgagaggcctatta

SEQ ID NO: 648877 - DNA, 25 bp, Rattus norvegicus
agacaggcaggctgcagacccagtt

SEQ ID NO: 648878 - DNA, 25 bp, Rattus norvegicus
tactacgagaacctgcccgcgggct

SEQ ID NO: 648879 - DNA, 25 bp, Rattus norvegicus
gggcgccgactactacgagaacctg

SEQ ID NO: 648880 - DNA, 25 bp, Rattus norvegicus
gttatgccaagtatgtgaggagctg

SEQ ID NO: 648881 - DNA, 25 bp, Rattus norvegicus
ctgtccagttgcagaagtctcgaga

SEQ ID NO: 648882 - DNA, 25 bp, Rattus norvegicus
gacgaaggagaaatatggtataacc

SEQ ID NO: 648883 - DNA, 25 bp, Rattus norvegicus
gctcttcagccttcagtgaggacga

SEQ ID NO: 648884 - DNA, 25 bp, Rattus norvegicus
aggcaaacgccgctgccctgaagct

SEQ ID NO: 648885 - DNA, 25 bp, Rattus norvegicus
tcttgagtctggaggaggcaaacgc

SEQ ID NO: 648886 - DNA, 25 bp, Rattus norvegicus
gggcatagcacacgtcttgagtctg

SEQ ID NO: 648887 - DNA, 25 bp, Rattus norvegicus
cgacagcctgggcatagcacacgtc

SEQ ID NO: 648888 - DNA, 25 bp, Rattus norvegicus
tcggctcccgcagcctttctgtaaa

SEQ ID NO: 648889 - DNA, 25 bp, Rattus norvegicus
cacagagaaccctgcatgcacgcgg

SEQ ID NO: 648890 - DNA, 25 bp, Rattus norvegicus
cgtcatccagaaacggctcttcagc

SEQ ID NO: 648891 - DNA, 25 bp, Rattus norvegicus
gccggttctccgtcatccagaaacg

SEQ ID NO: 648892 - DNA, 25 bp, Rattus norvegicus
cgcggtgtgtaacgccgccggttct

SEQ ID NO: 648893 - DNA, 25 bp, Rattus norvegicus
accctgcatgcacgcggtgtgtaac

SEQ ID NO: 648894 - DNA, 25 bp, Rattus norvegicus
cgacgccgatgacgaaggagaaata

SEQ ID NO: 648895 - DNA, 25 bp, Rattus norvegicus
agccttcagtgaggacgacgccgat

SEQ ID NO: 648896 - DNA, 25 bp, Rattus norvegicus
ccctactggtcgcaccgcgcagcgc

SEQ ID NO: 648897 - DNA, 25 bp, Rattus norvegicus
ccggcttctccgagctggccgaccc

SEQ ID NO: 648898 - DNA, 25 bp, Rattus norvegicus
cagaggaagcccgaacactcacagc

SEQ ID NO: 648899 - DNA, 25 bp, Rattus norvegicus
acactcacagccgtagcggggccgt

SEQ ID NO: 648900 - DNA, 25 bp, Rattus norvegicus
acggcagctcttcgtgcggcatcct

SEQ ID NO: 648901 - DNA, 25 bp, Rattus norvegicus
tcttcgtgcggcatcctgcgctgct

SEQ ID NO: 648902 - DNA, 25 bp, Rattus norvegicus
gcgctccgatcccacctctggctgc

SEQ ID NO: 648903 - DNA, 25 bp, Rattus norvegicus
ctccctcggtgctctttcgcccgcg

SEQ ID NO: 648904 - DNA, 25 bp, Rattus norvegicus
gcgtctcgctgacaccggggcaaaa

SEQ ID NO: 648905 - DNA, 25 bp, Rattus norvegicus
caccggggcaaaagtgaactctctc

SEQ ID NO: 648906 - DNA, 25 bp, Rattus norvegicus
ggcaaaagtgaactctctcctccct

SEQ ID NO: 648907 - DNA, 25 bp, Rattus norvegicus
agcgcctgcttgcaaggacccgcct

SEQ ID NO: 648908 - DNA, 25 bp, Rattus norvegicus
ttattcaccgcggtgggagcgcgcc

SEQ ID NO: 648909 - DNA, 25 bp, Rattus norvegicus
cgcccggagatcagaggaagcccga

SEQ ID NO: 648910 - DNA, 25 bp, Rattus norvegicus
ccgggcaccgaccatcaagaacgag

SEQ ID NO: 648911 - DNA, 25 bp, Rattus norvegicus
gacatgttttccacgttcgcgaaaa

SEQ ID NO: 648912 - DNA, 25 bp, Rattus norvegicus
tccacgttcgcgaaaatgcagcaga

SEQ ID NO: 648913 - DNA, 25 bp, Rattus norvegicus
tgttcagccgcgtctacctgtactc

SEQ ID NO: 648914 - DNA, 25 bp, Rattus norvegicus
cgcgtctacctgtactcgttcatca

SEQ ID NO: 648915 - DNA, 25 bp, Rattus norvegicus
gttcatcagcctcttcatctacatg

SEQ ID NO: 648916 - DNA, 25 bp, Rattus norvegicus
catctacatgatcttgagccttttc

SEQ ID NO: 648917 - DNA, 25 bp, Rattus norvegicus
gagccttttcatcgcgctcatcaca

SEQ ID NO: 648918 - DNA, 25 bp, Rattus norvegicus
gcgctcatcacagacacgtacgaaa

SEQ ID NO: 648919 - DNA, 25 bp, Rattus norvegicus
taggtttgtcagaagcccgggcacc

SEQ ID NO: 648920 - DNA, 25 bp, Rattus norvegicus
cgaccatcaagaacgagtgtggggc

SEQ ID NO: 648921 - DNA, 25 bp, Rattus norvegicus
ggggcggcacagtttagtactcaga

SEQ ID NO: 648922 - DNA, 25 bp, Rattus norvegicus
actcagaggacattaccggggcaga

SEQ ID NO: 648923 - DNA, 25 bp, Rattus norvegicus
ccattaaggtaggtttgtcagaagc

SEQ ID NO: 648924 - DNA, 25 bp, Rattus norvegicus
attgtccttcgtgacagcgccctgg

SEQ ID NO: 648925 - DNA, 25 bp, Rattus norvegicus
tcacagcagcctttccgggcgactt

SEQ ID NO: 648926 - DNA, 25 bp, Rattus norvegicus
tttataagggcgtccactccacctg

SEQ ID NO: 648927 - DNA, 25 bp, Rattus norvegicus
atccgggtgtccgaacagtggtgac

SEQ ID NO: 648928 - DNA, 25 bp, Rattus norvegicus
ctgagggaatctagggtcgcgccat

SEQ ID NO: 648929 - DNA, 25 bp, Rattus norvegicus
cccgaaggcgaagagacgctggacc

SEQ ID NO: 648930 - DNA, 25 bp, Rattus norvegicus
gcacaggtgggtactctcccaggca

SEQ ID NO: 648931 - DNA, 25 bp, Rattus norvegicus
tctcccaggcagcagacgtctggtc

SEQ ID NO: 648932 - DNA, 25 bp, Rattus norvegicus
acgtctggtcgccttctggattcca

SEQ ID NO: 648933 - DNA, 25 bp, Rattus norvegicus
ctcgcagccacgtagaattgtcctt

SEQ ID NO: 648934 - DNA, 25 bp, Rattus norvegicus
ggtcgcccagcactgaaggaagtca

SEQ ID NO: 648935 - DNA, 25 bp, Rattus norvegicus
acgtgtagcgaccagggcgcaccca

SEQ ID NO: 648936 - DNA, 25 bp, Rattus norvegicus
ccgcaaagtcccgtggctgagatta

SEQ ID NO: 648937 - DNA, 25 bp, Rattus norvegicus
ttctggattccagcgtcacctcctt

SEQ ID NO: 648938 - DNA, 25 bp, Rattus norvegicus
gatctacctgggctacacgttctgc

SEQ ID NO: 648939 - DNA, 25 bp, Rattus norvegicus
cacgttctgcggttggattgtctta

SEQ ID NO: 648940 - DNA, 25 bp, Rattus norvegicus
tggattgtcttagggccgtaccacg

SEQ ID NO: 648941 - DNA, 25 bp, Rattus norvegicus
ctgcccaaagtgctccggttcagcg

SEQ ID NO: 648942 - DNA, 25 bp, Rattus norvegicus
cattttaaccatgcaggcctccctg

SEQ ID NO: 648943 - DNA, 25 bp, Rattus norvegicus
ctctgtcttccaggcgctcatttta

SEQ ID NO: 648944 - DNA, 25 bp, Rattus norvegicus
ttctgctggatggtttccgacctcc

SEQ ID NO: 648945 - DNA, 25 bp, Rattus norvegicus
tcgtgattgacacgggctccgcctc

SEQ ID NO: 648946 - DNA, 25 bp, Rattus norvegicus
cccagaagcgccatcgtgattgaca

SEQ ID NO: 648947 - DNA, 25 bp, Rattus norvegicus
acgtacaatgtaagctcccagaagc

SEQ ID NO: 648948 - DNA, 25 bp, Rattus norvegicus
ctgggttactttcagacgtacaatg

SEQ ID NO: 648949 - DNA, 25 bp, Rattus norvegicus
tggagtcatccgatatctgggttac

SEQ ID NO: 648950 - DNA, 25 bp, Rattus norvegicus
acgctccttgtctgggttggagtca

SEQ ID NO: 648951 - DNA, 25 bp, Rattus norvegicus
gcgcttgcgccggtttgatctacct

SEQ ID NO: 648952 - DNA, 25 bp, Rattus norvegicus
acccagagcaggatgggggttccca

SEQ ID NO: 648953 - DNA, 25 bp, Rattus norvegicus
tcccgtgggaacttgcagcctcact

SEQ ID NO: 648954 - DNA, 25 bp, Rattus norvegicus
gcgcgctcccgtgggaacttgcagc

SEQ ID NO: 648955 - DNA, 25 bp, Rattus norvegicus
gcgggcgggaccaagccgccctcca

SEQ ID NO: 648956 - DNA, 25 bp, Rattus norvegicus
cctagcaaagttgcccgggactccg

SEQ ID NO: 648957 - DNA, 25 bp, Rattus norvegicus
actccgggagcgtcgccgccgacgc

SEQ ID NO: 648958 - DNA, 25 bp, Rattus norvegicus
acgctggagagcaggagctcagctc

SEQ ID NO: 648959 - DNA, 25 bp, Rattus norvegicus
ctctgcggcgccgatccgagcctgg

SEQ ID NO: 648960 - DNA, 25 bp, Rattus norvegicus
gggcatgcgacagcggcgggacgct

SEQ ID NO: 648961 - DNA, 25 bp, Rattus norvegicus
cgagcaacagcggtgagtgtcgtac

SEQ ID NO: 648962 - DNA, 25 bp, Rattus norvegicus
gcaacagcggtgagtgtcgtaccca

SEQ ID NO: 648963 - DNA, 25 bp, Rattus norvegicus
aacagcggtgagtgtcgtacccaga

SEQ ID NO: 648964 - DNA, 25 bp, Rattus norvegicus
gtgagtgtcgtacccagagcaggat

SEQ ID NO: 648965 - DNA, 25 bp, Rattus norvegicus
cgtgggaacttgcagcctcactggc

SEQ ID NO: 648966 - DNA, 25 bp, Rattus norvegicus
acattccgggcctctgtgtgtcaca

SEQ ID NO: 648967 - DNA, 25 bp, Rattus norvegicus
tgcgccgcctgcgcgaagtgttcga

SEQ ID NO: 648968 - DNA, 25 bp, Rattus norvegicus
aagtgttcgaggtgtgcggccgcga

SEQ ID NO: 648969 - DNA, 25 bp, Rattus norvegicus
cccgacggctttctacgcgtggagc

SEQ ID NO: 648970 - DNA, 25 bp, Rattus norvegicus
ctttctacgcgtggagcgcgtcgcg

SEQ ID NO: 648971 - DNA, 25 bp, Rattus norvegicus
tcggcctgcgcttcgggcaaggcga

SEQ ID NO: 648972 - DNA, 25 bp, Rattus norvegicus
gcgcaatcacattccgggcctctgt

SEQ ID NO: 648973 - DNA, 25 bp, Rattus norvegicus
cgggcctctgtgtgtcacatggcac

SEQ ID NO: 648974 - DNA, 25 bp, Rattus norvegicus
gcctctgtgtgtcacatggcacgcc

SEQ ID NO: 648975 - DNA, 25 bp, Rattus norvegicus
tctgtgtgtcacatggcacgcccgc

SEQ ID NO: 648976 - DNA, 25 bp, Rattus norvegicus
tgtcacatggcacgcccgcggtggc

SEQ ID NO: 648977 - DNA, 25 bp, Rattus norvegicus
ggtggccggcctgcccacctgccgt

SEQ ID NO: 648978 - DNA, 25 bp, Rattus norvegicus
cccacctgccgttccctctggtccg

SEQ ID NO: 648979 - DNA, 25 bp, Rattus norvegicus
gcaaggcgaggaggtaaggagctcg

SEQ ID NO: 648980 - DNA, 25 bp, Rattus norvegicus
tgggtgcttcatcgtggtccagccc

SEQ ID NO: 648981 - DNA, 25 bp, Rattus norvegicus
gtcgcctggcaaccggcggagccaa

SEQ ID NO: 648982 - DNA, 25 bp, Rattus norvegicus
gtccgccgtaggtgggtgcttcatc

SEQ ID NO: 648983 - DNA, 25 bp, Rattus norvegicus
gccgggctctaaagcggctaggacc

SEQ ID NO: 648984 - DNA, 25 bp, Rattus norvegicus
aagcggctaggaccctcctcttgtc

SEQ ID NO: 648985 - DNA, 25 bp, Rattus norvegicus
ttgtcgtaggctagtcctcgctgga

SEQ ID NO: 648986 - DNA, 25 bp, Rattus norvegicus
agtcctcgctggaccaatgcgggcc

SEQ ID NO: 648987 - DNA, 25 bp, Rattus norvegicus
ccgcggttgttcgtcgcctggcaac

SEQ ID NO: 648988 - DNA, 25 bp, Rattus norvegicus
cacccggttctccttgggagcgttg

SEQ ID NO: 648989 - DNA, 25 bp, Rattus norvegicus
taggacttagcgagtgaggtccgcc

SEQ ID NO: 648990 - DNA, 25 bp, Rattus norvegicus
gtctctccgatctggggagcgcacc

SEQ ID NO: 648991 - DNA, 25 bp, Rattus norvegicus
tggagagcgttgctgccagccgcct

SEQ ID NO: 648992 - DNA, 25 bp, Rattus norvegicus
tgggctcggcgatccctcagaggct

SEQ ID NO: 648993 - DNA, 25 bp, Rattus norvegicus
ccctcagaggctgccgtaggactta

SEQ ID NO: 648994 - DNA, 25 bp, Rattus norvegicus
ggttcttctagcgtcgccgccatga

SEQ ID NO: 648995 - DNA, 25 bp, Rattus norvegicus
gctcgccctagacttactcctagta

SEQ ID NO: 648996 - DNA, 25 bp, Rattus norvegicus
tcctagtactcgtcctttaaacaca

SEQ ID NO: 648997 - DNA, 25 bp, Rattus norvegicus
ctcaaccgcgtgaaggtgagcgtgt

SEQ ID NO: 648998 - DNA, 25 bp, Rattus norvegicus
ccgccatgaagaaggtggttcagca

SEQ ID NO: 648999 - DNA, 25 bp, Rattus norvegicus
ccgagcgccatgtcgggttcttcta

SEQ ID NO: 649000 - DNA, 25 bp, Rattus norvegicus
ccctactcggactgacaagttggcc

SEQ ID NO: 649001 - DNA, 25 bp, Rattus norvegicus
gcgcgcacagcaccggaaacttaga

SEQ ID NO: 649002 - DNA, 25 bp, Rattus norvegicus
cgaacgccagtcagcgctaacggga

SEQ ID NO: 649003 - DNA, 25 bp, Rattus norvegicus
caagcacgaagcaattacagacatc

SEQ ID NO: 649004 - DNA, 25 bp, Rattus norvegicus
ggacgccaagtctcgccaccgattt

SEQ ID NO: 649005 - DNA, 25 bp, Rattus norvegicus
gtcctttaaacacacacgagtcctc

SEQ ID NO: 649006 - DNA, 25 bp, Rattus norvegicus
cagacatcgaaagagcaaacgatcc

SEQ ID NO: 649007 - DNA, 25 bp, Rattus norvegicus
tggttcagcaactccggctggaggc

SEQ ID NO: 649008 - DNA, 25 bp, Rattus norvegicus
gccttgcgcttgtgcggcttcaaac

SEQ ID NO: 649009 - DNA, 25 bp, Rattus norvegicus
cacaaaactagggtgcggagccctc

SEQ ID NO: 649010 - DNA, 25 bp, Rattus norvegicus
tgggtcgtttgctctgggaccctcg

SEQ ID NO: 649011 - DNA, 25 bp, Rattus norvegicus
tccggaagaacgcaagggccggatc

SEQ ID NO: 649012 - DNA, 25 bp, Rattus norvegicus
tcccgcaaagggctgacgctacaga

SEQ ID NO: 649013 - DNA, 25 bp, Rattus norvegicus
tacagacccggcagcctagcgagtt

SEQ ID NO: 649014 - DNA, 25 bp, Rattus norvegicus
tgctgctgtttccaccgcgtgaaca

SEQ ID NO: 649015 - DNA, 25 bp, Rattus norvegicus
cgtgaacatcaagtgtcgccgctgt

SEQ ID NO: 649016 - DNA, 25 bp, Rattus norvegicus
gtcgccgctgtttgttcttaatctc

SEQ ID NO: 649017 - DNA, 25 bp, Rattus norvegicus
aaggcagccgctttcgcggactgta

SEQ ID NO: 649018 - DNA, 25 bp, Rattus norvegicus
cgaccgcagtttcttgaggctcttc

SEQ ID NO: 649019 - DNA, 25 bp, Rattus norvegicus
ttcagcgggcgctttcctcttcaag

SEQ ID NO: 649020 - DNA, 25 bp, Rattus norvegicus
gccggccttcgccatgttgtttgca

SEQ ID NO: 649021 - DNA, 25 bp, Rattus norvegicus
tttgcagctgtacggaaacggaagt

SEQ ID NO: 649022 - DNA, 25 bp, Rattus norvegicus
tctggttcctttcatcctggagagg

SEQ ID NO: 649023 - DNA, 25 bp, Rattus norvegicus
tgtgtggtgcagaccctagcaccta

SEQ ID NO: 649024 - DNA, 25 bp, Rattus norvegicus
tctgcagagattgtgagggagaaca

SEQ ID NO: 649025 - DNA, 25 bp, Rattus norvegicus
tgacagaggggaaagtttctgcaga

SEQ ID NO: 649026 - DNA, 25 bp, Rattus norvegicus
ccagcggtcggctaagcaactcggc

SEQ ID NO: 649027 - DNA, 25 bp, Rattus norvegicus
ctcctgggcaaaggacgggcgtcct

SEQ ID NO: 649028 - DNA, 25 bp, Rattus norvegicus
gtatgcgaaccgaagggcgtctcct

SEQ ID NO: 649029 - DNA, 25 bp, Rattus norvegicus
tacaggtgacaaagtgcacgtccgc

SEQ ID NO: 649030 - DNA, 25 bp, Rattus norvegicus
atcctatcctggtgttctctggttc

SEQ ID NO: 649031 - DNA, 25 bp, Rattus norvegicus
cgtgttcccaggacggcctgcgaac

SEQ ID NO: 649032 - DNA, 25 bp, Rattus norvegicus
gtcccgctccactacaggtgacaaa

SEQ ID NO: 649033 - DNA, 25 bp, Rattus norvegicus
ggacggcctgcgaacccatcactta

SEQ ID NO: 649034 - DNA, 25 bp, Rattus norvegicus
ggagttgtagtccaccgtggcaccg

SEQ ID NO: 649035 - DNA, 25 bp, Rattus norvegicus
ttttgtttttgatcctatcctggtg

SEQ ID NO: 649036 - DNA, 25 bp, Rattus norvegicus
agggccttcaactggactcaccgct

SEQ ID NO: 649037 - DNA, 25 bp, Rattus norvegicus
tgcaccgcagcctatccggcgggaa

SEQ ID NO: 649038 - DNA, 25 bp, Rattus norvegicus
gcgcgcgttccgcatacaaaggttg

SEQ ID NO: 649039 - DNA, 25 bp, Rattus norvegicus
acttcgctgcctttcttggcgatcg

SEQ ID NO: 649040 - DNA, 25 bp, Rattus norvegicus
cccatgacccgggagtccgtaagca

SEQ ID NO: 649041 - DNA, 25 bp, Rattus norvegicus
gcaactcctgcttttgtttgactcc

SEQ ID NO: 649042 - DNA, 25 bp, Rattus norvegicus
tttgactcccacagaccctggagcg

SEQ ID NO: 649043 - DNA, 25 bp, Rattus norvegicus
tctagaagagatgctgcgagctccc

SEQ ID NO: 649044 - DNA, 25 bp, Rattus norvegicus
ctctgtgtagcgctgaagtggtaaa

SEQ ID NO: 649045 - DNA, 25 bp, Rattus norvegicus
tccagagtggatgctgagcttgacc

SEQ ID NO: 649046 - DNA, 25 bp, Rattus norvegicus
gcttgacctcggaggctaatctcga

SEQ ID NO: 649047 - DNA, 25 bp, Rattus norvegicus
tggaaaccgttagcttggaagcacc

SEQ ID NO: 649048 - DNA, 25 bp, Rattus norvegicus
acaaaggttgctcactcggtggcta

SEQ ID NO: 649049 - DNA, 25 bp, Rattus norvegicus
ccctggaattgttagctgcggccgc

SEQ ID NO: 649050 - DNA, 25 bp, Rattus norvegicus
ggttctggtgctcgcacctccatgc

SEQ ID NO: 649051 - DNA, 25 bp, Rattus norvegicus
cgagctgaggtgatcccaggacgac

SEQ ID NO: 649052 - DNA, 25 bp, Rattus norvegicus
gagctctgaaccgtggctgccccgg

SEQ ID NO: 649053 - DNA, 25 bp, Rattus norvegicus
cgggtcgagcttctgagctctgaac

SEQ ID NO: 649054 - DNA, 25 bp, Rattus norvegicus
tggtcgggtcgagcttctgagctct

SEQ ID NO: 649055 - DNA, 25 bp, Rattus norvegicus
ttgggaacgacagctgctccagctg

SEQ ID NO: 649056 - DNA, 25 bp, Rattus norvegicus
cccttgggaacgacagctgctccag

SEQ ID NO: 649057 - DNA, 25 bp, Rattus norvegicus
ggtctggtccatcggtagcttccac

SEQ ID NO: 649058 - DNA, 25 bp, Rattus norvegicus
cgcagcgggcaaatggtctggtcca

SEQ ID NO: 649059 - DNA, 25 bp, Rattus norvegicus
tgaggtgatcccaggacgacccgtg

SEQ ID NO: 649060 - DNA, 25 bp, Rattus norvegicus
tcccgaggttctggtgctcgcacct

SEQ ID NO: 649061 - DNA, 25 bp, Rattus norvegicus
gcacctccatgcacgacgcgcaccc

SEQ ID NO: 649062 - DNA, 25 bp, Rattus norvegicus
aatggtctggtccatcggtagcttc

SEQ ID NO: 649063 - DNA, 25 bp, Rattus norvegicus
cgaggttctggtgctcgcacctcca

SEQ ID NO: 649064 - DNA, 25 bp, Rattus norvegicus
tgcgacgacgccttcgcagtgctac

SEQ ID NO: 649065 - DNA, 25 bp, Rattus norvegicus
agcctttgacgtacactcgcgcgct

SEQ ID NO: 649066 - DNA, 25 bp, Rattus norvegicus
ggagctctttgcctgcctgcagcct

SEQ ID NO: 649067 - DNA, 25 bp, Rattus norvegicus
cgcgtggcgactgaggttcccgcac

SEQ ID NO: 649068 - DNA, 25 bp, Rattus norvegicus
tccagagctggtgactcagctcctc

SEQ ID NO: 649069 - DNA, 25 bp, Rattus norvegicus
tggtccaggcggtacttccagagct

SEQ ID NO: 649070 - DNA, 25 bp, Rattus norvegicus
cccacacgtagagggtgacgcgagc

SEQ ID NO: 649071 - DNA, 25 bp, Rattus norvegicus
cctcgccgggctgtatttgcatcac

SEQ ID NO: 649072 - DNA, 25 bp, Rattus norvegicus
tcacccgggagcctttgacgtacac

SEQ ID NO: 649073 - DNA, 25 bp, Rattus norvegicus
agggcgcgccacagggcatccatca

SEQ ID NO: 649074 - DNA, 25 bp, Rattus norvegicus
actgctgtctgcacagggcgcgcca

SEQ ID NO: 649075 - DNA, 25 bp, Rattus norvegicus
tagagcctccagtcactgctgtctg

SEQ ID NO: 649076 - DNA, 25 bp, Rattus norvegicus
agtgctaccactgcggcgcactgcg

SEQ ID NO: 649077 - DNA, 25 bp, Rattus norvegicus
ttgcatcacgcccacacgtagaggg

SEQ ID NO: 649078 - DNA, 25 bp, Rattus norvegicus
cgcggtgtcgttcagacttagtcca

SEQ ID NO: 649079 - DNA, 25 bp, Rattus norvegicus
gccctgggttatcaccgtgcatcaa

SEQ ID NO: 649080 - DNA, 25 bp, Rattus norvegicus
tgcatcaaagatgaggcgtcggcca

SEQ ID NO: 649081 - DNA, 25 bp, Rattus norvegicus
ggccacgatcgcgtcatcttcgctg

SEQ ID NO: 649082 - DNA, 25 bp, Rattus norvegicus
ctgctgccgccaatcacgggtttaa

SEQ ID NO: 649083 - DNA, 25 bp, Rattus norvegicus
ggtttaaccgggagcttgagctcca

SEQ ID NO: 649084 - DNA, 25 bp, Rattus norvegicus
tccaagttgtgggttttgttgctac

SEQ ID NO: 649085 - DNA, 25 bp, Rattus norvegicus
tgatcattttctcaaacgcggtgtc

SEQ ID NO: 649086 - DNA, 25 bp, Rattus norvegicus
aacctgcacgccgtcgtggtagtcg

SEQ ID NO: 649087 - DNA, 25 bp, Rattus norvegicus
ggcggaattccagccctgggttatc

SEQ ID NO: 649088 - DNA, 25 bp, Rattus norvegicus
cctccagctctttgtggcggaattc

SEQ ID NO: 649089 - DNA, 25 bp, Rattus norvegicus
ctgtcggttgcctcgggtttcactt

SEQ ID NO: 649090 - DNA, 25 bp, Rattus norvegicus
ccgtcagctgggagacgtagctgtc

SEQ ID NO: 649091 - DNA, 25 bp, Rattus norvegicus
cccggaggttgttgtgcactaactc

SEQ ID NO: 649092 - DNA, 25 bp, Rattus norvegicus
cccggctcaaccttgtgttgtaaat

SEQ ID NO: 649093 - DNA, 25 bp, Rattus norvegicus
tatcatgaaagcattggacgccgca

SEQ ID NO: 649094 - DNA, 25 bp, Rattus norvegicus
ccttgtgttgtaaatgtagtcgatg

SEQ ID NO: 649095 - DNA, 25 bp, Rattus norvegicus
agtcgatgacgttcttgccagcttc

SEQ ID NO: 649096 - DNA, 25 bp, Rattus norvegicus
tgccagcttcgctttcattgtcttg

SEQ ID NO: 649097 - DNA, 25 bp, Rattus norvegicus
actgacctgaccacgtagaggaccc

SEQ ID NO: 649098 - DNA, 25 bp, Rattus norvegicus
ggacgccgcacgcttgtcatacgtc

SEQ ID NO: 649099 - DNA, 25 bp, Rattus norvegicus
ttgtcatacgtcgtctcccaggttg

SEQ ID NO: 649100 - DNA, 25 bp, Rattus norvegicus
cgtctcccaggttgcttcgaatcgg

SEQ ID NO: 649101 - DNA, 25 bp, Rattus norvegicus
tgcttcgaatcggagagtgtacgga

SEQ ID NO: 649102 - DNA, 25 bp, Rattus norvegicus
agtgtacggattgagctggctaatc

SEQ ID NO: 649103 - DNA, 25 bp, Rattus norvegicus
ctggctaatcacgatcattccgttg

SEQ ID NO: 649104 - DNA, 25 bp, Rattus norvegicus
cattccgttgttctgctcggtggcg

SEQ ID NO: 649105 - DNA, 25 bp, Rattus norvegicus
tcattgtcttggtacactgacctga

SEQ ID NO: 649106 - DNA, 25 bp, Rattus norvegicus
agcagcgcgcctcccggattgtttt

SEQ ID NO: 649107 - DNA, 25 bp, Rattus norvegicus
gtgatgtcacggcagctttgataca

SEQ ID NO: 649108 - DNA, 25 bp, Rattus norvegicus
accgaggcgccgaccgtgtggccat

SEQ ID NO: 649109 - DNA, 25 bp, Rattus norvegicus
gttcccaggccgctaagcctcagga

SEQ ID NO: 649110 - DNA, 25 bp, Rattus norvegicus
ggccggcttcttgttcatctgcagc

SEQ ID NO: 649111 - DNA, 25 bp, Rattus norvegicus
cggagtatctttgcaaaaccactga

SEQ ID NO: 649112 - DNA, 25 bp, Rattus norvegicus
tggccagggagatcggagtatcttt

SEQ ID NO: 649113 - DNA, 25 bp, Rattus norvegicus
agttcgcggattcgctttcaccctc

SEQ ID NO: 649114 - DNA, 25 bp, Rattus norvegicus
gggaagttcgcggattcgctttcac

SEQ ID NO: 649115 - DNA, 25 bp, Rattus norvegicus
ccgggcgcctcgtgatgtcacggca

SEQ ID NO: 649116 - DNA, 25 bp, Rattus norvegicus
gctcccggatgccaggtaagcggca

SEQ ID NO: 649117 - DNA, 25 bp, Rattus norvegicus
tttctgtgcacggtgctggctaggt

SEQ ID NO: 649118 - DNA, 25 bp, Rattus norvegicus
cgcctcccggattgttttctgtgca

SEQ ID NO: 649119 - DNA, 25 bp, Rattus norvegicus
ccgcgggacgcacttagcctgggct

SEQ ID NO: 649120 - DNA, 25 bp, Rattus norvegicus
acattgttggcgcttacctcggtgt

SEQ ID NO: 649121 - DNA, 25 bp, Rattus norvegicus
cctgattcccgagagcttgacaata

SEQ ID NO: 649122 - DNA, 25 bp, Rattus norvegicus
cagcagccagcctgattcccgagag

SEQ ID NO: 649123 - DNA, 25 bp, Rattus norvegicus
agcttgacaatagccgcacgcggcc

SEQ ID NO: 649124 - DNA, 25 bp, Rattus norvegicus
gggctgcaccgcacagagttctgcg

SEQ ID NO: 649125 - DNA, 25 bp, Rattus norvegicus
gcacagagttctgcggatcgatgtc

SEQ ID NO: 649126 - DNA, 25 bp, Rattus norvegicus
cccatcgggaggagcccagcaaaca

SEQ ID NO: 649127 - DNA, 25 bp, Rattus norvegicus
agccagccacagaggcacattgttg

SEQ ID NO: 649128 - DNA, 25 bp, Rattus norvegicus
ttcctcacatgtcgggtctccgggc

SEQ ID NO: 649129 - DNA, 25 bp, Rattus norvegicus
ggggctaagtcaacatcttcccgca

SEQ ID NO: 649130 - DNA, 25 bp, Rattus norvegicus
tgcacgctccttccggagccgaaaa

SEQ ID NO: 649131 - DNA, 25 bp, Rattus norvegicus
ttcaaaaccaaaagatgcggggatg

SEQ ID NO: 649132 - DNA, 25 bp, Rattus norvegicus
aggccaagtccgtcagtcggtcccg

SEQ ID NO: 649133 - DNA, 25 bp, Rattus norvegicus
aaacaggtctccgaagccagccaca

SEQ ID NO: 649134 - DNA, 25 bp, Rattus norvegicus
acgcactttccaaacatcgctttta

SEQ ID NO: 649135 - DNA, 25 bp, Rattus norvegicus
gctaaggcgtctttgatacctgaga

SEQ ID NO: 649136 - DNA, 25 bp, Rattus norvegicus
tctgttcgccgtggctgcctctgtc

SEQ ID NO: 649137 - DNA, 25 bp, Rattus norvegicus
tttgtgtgactgctggctggagaaa

SEQ ID NO: 649138 - DNA, 25 bp, Rattus norvegicus
agccctccttttgtgtgactgctgg

SEQ ID NO: 649139 - DNA, 25 bp, Rattus norvegicus
tccaggttttctctgctccgcgtgc

SEQ ID NO: 649140 - DNA, 25 bp, Rattus norvegicus
ctctggatgcgtgttttacccaccc

SEQ ID NO: 649141 - DNA, 25 bp, Rattus norvegicus
cggcgctctggatgcgtgttttacc

SEQ ID NO: 649142 - DNA, 25 bp, Rattus norvegicus
agaagctccctcccagctaggactg

SEQ ID NO: 649143 - DNA, 25 bp, Rattus norvegicus
gcttggggcctgcagcttgagaccc

SEQ ID NO: 649144 - DNA, 25 bp, Rattus norvegicus
agagctcgcattcaggccaccgggg

SEQ ID NO: 649145 - DNA, 25 bp, Rattus norvegicus
atccgggagagctcgcattcaggcc

SEQ ID NO: 649146 - DNA, 25 bp, Rattus norvegicus
catcgcttttatttcgggatcccgg

SEQ ID NO: 649147 - DNA, 25 bp, Rattus norvegicus
atacctgagatttccggcgcgctcg

SEQ ID NO: 649148 - DNA, 25 bp, Rattus norvegicus
cttgctgatgtagtgaccgctatcg

SEQ ID NO: 649149 - DNA, 25 bp, Rattus norvegicus
ttgctgatgtagtgaccgctatcgg

SEQ ID NO: 649150 - DNA, 25 bp, Rattus norvegicus
ccggacttgctgatgtagtgaccgc

SEQ ID NO: 649151 - DNA, 25 bp, Rattus norvegicus
gaccgctatcggagaccgagacctg

SEQ ID NO: 649152 - DNA, 25 bp, Rattus norvegicus
gaccgctatcggagactgagacctg

SEQ ID NO: 649153 - DNA, 25 bp, Rattus norvegicus
acttgctgatgtagtgaccgctatc

SEQ ID NO: 649154 - DNA, 25 bp, Rattus norvegicus
tgaccgctatcggagactgagacct

SEQ ID NO: 649155 - DNA, 25 bp, Rattus norvegicus
ctatcggagactgagacctgggccc

SEQ ID NO: 649156 - DNA, 25 bp, Rattus norvegicus
cccggacttgctgatgtagtgaccg

SEQ ID NO: 649157 - DNA, 25 bp, Rattus norvegicus
tgctgatgtagtgaccgctatcgga

SEQ ID NO: 649158 - DNA, 25 bp, Rattus norvegicus
accgctatcggagactgagacctgg

SEQ ID NO: 649159 - DNA, 25 bp, Rattus norvegicus
acctgggccccggacttgctgatgt

SEQ ID NO: 649160 - DNA, 25 bp, Rattus norvegicus
tgaccgctatcggagaccgagacct

SEQ ID NO: 649161 - DNA, 25 bp, Rattus norvegicus
ctatcggagaccgagacctgggccc

SEQ ID NO: 649162 - DNA, 25 bp, Rattus norvegicus
gtgtacactcatacggcgacctgga

SEQ ID NO: 649163 - DNA, 25 bp, Rattus norvegicus
cacatgttggatgccacggtgaact

SEQ ID NO: 649164 - DNA, 25 bp, Rattus norvegicus
cccgctccgcgctgcgtgtccggct

SEQ ID NO: 649165 - DNA, 25 bp, Rattus norvegicus
atgttggatgccacggtgaactcgc

SEQ ID NO: 649166 - DNA, 25 bp, Rattus norvegicus
ggatgccacggtgaactcgcccgct

SEQ ID NO: 649167 - DNA, 25 bp, Rattus norvegicus
tgaactcgcccgctcggaccctagg

SEQ ID NO: 649168 - DNA, 25 bp, Rattus norvegicus
tcccggcggagagtgtacactcata

SEQ ID NO: 649169 - DNA, 25 bp, Rattus norvegicus
ctcatacggcgacctggaaacactc

SEQ ID NO: 649170 - DNA, 25 bp, Rattus norvegicus
atacggcgacctggaaacactctcc

SEQ ID NO: 649171 - DNA, 25 bp, Rattus norvegicus
aaattcagcgcccagatgccggtgg

SEQ ID NO: 649172 - DNA, 25 bp, Rattus norvegicus
tcagcgcccagatgccggtggaaca

SEQ ID NO: 649173 - DNA, 25 bp, Rattus norvegicus
ccagatgccggtggaacagaagcgc

SEQ ID NO: 649174 - DNA, 25 bp, Rattus norvegicus
cagctcaggccggtcccgccgagcg

SEQ ID NO: 649175 - DNA, 25 bp, Rattus norvegicus
cagtggggcacatgttggatgccac

SEQ ID NO: 649176 - DNA, 25 bp, Rattus norvegicus
gcaggtcacaccacacagtaggctg

SEQ ID NO: 649177 - DNA, 25 bp, Rattus norvegicus
ctcttttccagaaggcaagttgtca

SEQ ID NO: 649178 - DNA, 25 bp, Rattus norvegicus
tgggaccagtaactcttttccagaa

SEQ ID NO: 649179 - DNA, 25 bp, Rattus norvegicus
accttgttggcagagcggttgtgct

SEQ ID NO: 649180 - DNA, 25 bp, Rattus norvegicus
gtcggtatcgcgagatctccggcct

SEQ ID NO: 649181 - DNA, 25 bp, Rattus norvegicus
ttgtcccagagcacgcccgcgagat

SEQ ID NO: 649182 - DNA, 25 bp, Rattus norvegicus
tcgccgccatgtttgtcccagagca

SEQ ID NO: 649183 - DNA, 25 bp, Rattus norvegicus
agttccgaagtagtgattatctccc

SEQ ID NO: 649184 - DNA, 25 bp, Rattus norvegicus
agtgcgaggacggagcatactttca

SEQ ID NO: 649185 - DNA, 25 bp, Rattus norvegicus
tctggggactcagaggaagcgtaca

SEQ ID NO: 649186 - DNA, 25 bp, Rattus norvegicus
tcggcggctcacgtgacggacacgt

SEQ ID NO: 649187 - DNA, 25 bp, Rattus norvegicus
ctcctgggagttagagcaggtcaca

SEQ ID NO: 649188 - DNA, 25 bp, Rattus norvegicus
cgggagactttgtgcgcgcgcctcc

SEQ ID NO: 649189 - DNA, 25 bp, Rattus norvegicus
agggcggctcagtttggcttccgcc

SEQ ID NO: 649190 - DNA, 25 bp, Rattus norvegicus
tgacgtaaatggttgtgctcgcctc

SEQ ID NO: 649191 - DNA, 25 bp, Rattus norvegicus
tgctcgcctccttgaaaaaatagtc

SEQ ID NO: 649192 - DNA, 25 bp, Rattus norvegicus
tgttgtacacgatcccgttcccgtc

SEQ ID NO: 649193 - DNA, 25 bp, Rattus norvegicus
ttcccgtccttcctcatgttgcgga

SEQ ID NO: 649194 - DNA, 25 bp, Rattus norvegicus
gcaggacgcacggtctatctcttcc

SEQ ID NO: 649195 - DNA, 25 bp, Rattus norvegicus
cgaccgtcttctttagcatgttgta

SEQ ID NO: 649196 - DNA, 25 bp, Rattus norvegicus
atccgctgctccgtggtcacgtaga

SEQ ID NO: 649197 - DNA, 25 bp, Rattus norvegicus
atagtccgggtttttcagcaagaga

SEQ ID NO: 649198 - DNA, 25 bp, Rattus norvegicus
acgctggtgtgtgacaccactcgga

SEQ ID NO: 649199 - DNA, 25 bp, Rattus norvegicus
ggaccatcgtcatgtagccgacatc

SEQ ID NO: 649200 - DNA, 25 bp, Rattus norvegicus
gacatcttcctcgaaacccttggtg

SEQ ID NO: 649201 - DNA, 25 bp, Rattus norvegicus
gttcattctccagatgcaggacgca

SEQ ID NO: 649202 - DNA, 25 bp, Rattus norvegicus
tcacgtagatctgcgcgtctgggta

SEQ ID NO: 649203 - DNA, 25 bp, Rattus norvegicus
tgtccaaccatctgacccgagttcg

SEQ ID NO: 649204 - DNA, 25 bp, Rattus norvegicus
agcgcaggcaaggagtctgtgccca

SEQ ID NO: 649205 - DNA, 25 bp, Rattus norvegicus
tagtcacgtgccctccgtgcagccc

SEQ ID NO: 649206 - DNA, 25 bp, Rattus norvegicus
ggatcgaccctgtggctcgctgcac

SEQ ID NO: 649207 - DNA, 25 bp, Rattus norvegicus
aggccatggcgctatggatcgaccc

SEQ ID NO: 649208 - DNA, 25 bp, Rattus norvegicus
ttaccttgaggatgcaggccatggc

SEQ ID NO: 649209 - DNA, 25 bp, Rattus norvegicus
gccgagcggttaccttgaggatgca

SEQ ID NO: 649210 - DNA, 25 bp, Rattus norvegicus
catgcggcccacagccgagcggtta

SEQ ID NO: 649211 - DNA, 25 bp, Rattus norvegicus
acccagcaggcggagctcgcatgcg

SEQ ID NO: 649212 - DNA, 25 bp, Rattus norvegicus
gtctcccacccagatgccttggcca

SEQ ID NO: 649213 - DNA, 25 bp, Rattus norvegicus
gcaaggagtctgtgcccaacgcaca

SEQ ID NO: 649214 - DNA, 25 bp, Rattus norvegicus
tatacccatcattcggcacgccgcc

SEQ ID NO: 649215 - DNA, 25 bp, Rattus norvegicus
tctgctccgcctgctatacccatca

SEQ ID NO: 649216 - DNA, 25 bp, Rattus norvegicus
gcgagccactccttttcagcccacg

SEQ ID NO: 649217 - DNA, 25 bp, Rattus norvegicus
tgtgcccaacgcacattgcagtctc

SEQ ID NO: 649218 - DNA, 25 bp, Rattus norvegicus
tggtacccagcgcaggcgccagagc

SEQ ID NO: 649219 - DNA, 25 bp, Rattus norvegicus
aggcgccagagccatgaggtgaccc

SEQ ID NO: 649220 - DNA, 25 bp, Rattus norvegicus
tgtcggccacggcaccttctgtgct

SEQ ID NO: 649221 - DNA, 25 bp, Rattus norvegicus
gcaccttctgtgctcggcctggacg

SEQ ID NO: 649222 - DNA, 25 bp, Rattus norvegicus
atggcgtccaccgtggggaactcga

SEQ ID NO: 649223 - DNA, 25 bp, Rattus norvegicus
gggaactcgagagcgaagtagcctc

SEQ ID NO: 649224 - DNA, 25 bp, Rattus norvegicus
cgagagcgaagtagcctcctgcctc

SEQ ID NO: 649225 - DNA, 25 bp, Rattus norvegicus
ctggcctttctgacactcgaggctc

SEQ ID NO: 649226 - DNA, 25 bp, Rattus norvegicus
ttctgacactcgaggctctgcgcgt

SEQ ID NO: 649227 - DNA, 25 bp, Rattus norvegicus
ctctgcgcgtgaggcctcgagtacc

SEQ ID NO: 649228 - DNA, 25 bp, Rattus norvegicus
aggccggaagccgtgccactgaaaa

SEQ ID NO: 649229 - DNA, 25 bp, Rattus norvegicus
gcatgtgcagtgctgccatcgcgca

SEQ ID NO: 649230 - DNA, 25 bp, Rattus norvegicus
ctgcacacggcgcaggcaggacact

SEQ ID NO: 649231 - DNA, 25 bp, Rattus norvegicus
cgcaagctgcacaagctgcacacgg

SEQ ID NO: 649232 - DNA, 25 bp, Rattus norvegicus
gccactctctcctgcagcgcgcgca

SEQ ID NO: 649233 - DNA, 25 bp, Rattus norvegicus
cgtggcgagagtacaagcgatgcgc

SEQ ID NO: 649234 - DNA, 25 bp, Rattus norvegicus
ctcagtctcccggtacagaagagga

SEQ ID NO: 649235 - DNA, 25 bp, Rattus norvegicus
cccggtacagaagaggaatctagca

SEQ ID NO: 649236 - DNA, 25 bp, Rattus norvegicus
aagaggaatctagcacggagcgagc

SEQ ID NO: 649237 - DNA, 25 bp, Rattus norvegicus
aatctagcacggagcgagctctccc

SEQ ID NO: 649238 - DNA, 25 bp, Rattus norvegicus
gggactccctactcaccgttccagc

SEQ ID NO: 649239 - DNA, 25 bp, Rattus norvegicus
gtttgcagcccgaggccgcttcggt

SEQ ID NO: 649240 - DNA, 25 bp, Rattus norvegicus
aggccgcttcggtctgccactctct

SEQ ID NO: 649241 - DNA, 25 bp, Rattus norvegicus
cgcgcagtggtgactcctttgagct

SEQ ID NO: 649242 - DNA, 25 bp, Rattus norvegicus
tcctttgagctggtctgaggcgaga

SEQ ID NO: 649243 - DNA, 25 bp, Rattus norvegicus
gaaagtggctcccggcggccacgct

SEQ ID NO: 649244 - DNA, 25 bp, Rattus norvegicus
tggtgactcctttgagctggtctga

SEQ ID NO: 649245 - DNA, 25 bp, Rattus norvegicus
tcctcccttcggtactgcagtggcg

SEQ ID NO: 649246 - DNA, 25 bp, Rattus norvegicus
tcctgcctgaaggactccgcggtca

SEQ ID NO: 649247 - DNA, 25 bp, Rattus norvegicus
gcgatgtcgctctcaccatgtccga

SEQ ID NO: 649248 - DNA, 25 bp, Rattus norvegicus
acttccgcgcaccaaagcgatgtcg

SEQ ID NO: 649249 - DNA, 25 bp, Rattus norvegicus
ccacgatgcggagcagcttgaccca

SEQ ID NO: 649250 - DNA, 25 bp, Rattus norvegicus
agaatgctagccttgcatgcccgcc

SEQ ID NO: 649251 - DNA, 25 bp, Rattus norvegicus
tgctgagagctcacaagaagaatgc

SEQ ID NO: 649252 - DNA, 25 bp, Rattus norvegicus
agcggtctaagaccggcctcagaag

SEQ ID NO: 649253 - DNA, 25 bp, Rattus norvegicus
ccattgctcaaggagcggtctaaga

SEQ ID NO: 649254 - DNA, 25 bp, Rattus norvegicus
tgcagaaaacgctgagccattgctc

SEQ ID NO: 649255 - DNA, 25 bp, Rattus norvegicus
catcacaaccctcgagaactgcaga

SEQ ID NO: 649256 - DNA, 25 bp, Rattus norvegicus
tacgggccgcggataacatcacaac

SEQ ID NO: 649257 - DNA, 25 bp, Rattus norvegicus
cacggaaagtcagggtctgcgcgcc

SEQ ID NO: 649258 - DNA, 25 bp, Rattus norvegicus
tccgaccgccgaaagactgaagagc

SEQ ID NO: 649259 - DNA, 25 bp, Rattus norvegicus
cggtcacgatttagccggccgcact

SEQ ID NO: 649260 - DNA, 25 bp, Rattus norvegicus
tttgcggcctctcccggctcagtga

SEQ ID NO: 649261 - DNA, 25 bp, Rattus norvegicus
acgcgtcagtcagagccgtttggtg

SEQ ID NO: 649262 - DNA, 25 bp, Rattus norvegicus
cgctatcctgatgccgagcggaagg

SEQ ID NO: 649263 - DNA, 25 bp, Rattus norvegicus
ggactacccgctatcctgatgccga

SEQ ID NO: 649264 - DNA, 25 bp, Rattus norvegicus
agagcccgaacaccagctatccgga

SEQ ID NO: 649265 - DNA, 25 bp, Rattus norvegicus
ttgctcgtcagagagcccgaacacc

SEQ ID NO: 649266 - DNA, 25 bp, Rattus norvegicus
gagaagaggatagttgctcgtcaga

SEQ ID NO: 649267 - DNA, 25 bp, Rattus norvegicus
tcagtgacacggacccagagcgagg

SEQ ID NO: 649268 - DNA, 25 bp, Rattus norvegicus
ccggctcagtgacacggacccagag

SEQ ID NO: 649269 - DNA, 25 bp, Rattus norvegicus
tctgggcctccattattcacccggg

SEQ ID NO: 649270 - DNA, 25 bp, Rattus norvegicus
aggaccggacgcgtcagtcagagcc

SEQ ID NO: 649271 - DNA, 25 bp, Rattus norvegicus
gggcacgcagacgttcacgctcatc

SEQ ID NO: 649272 - DNA, 25 bp, Rattus norvegicus
acgcagacgttcacgctcatctttg

SEQ ID NO: 649273 - DNA, 25 bp, Rattus norvegicus
gttcacgctcatctttgcggcctct

SEQ ID NO: 649274 - DNA, 25 bp, Rattus norvegicus
acagcgacaaagtctgggctcccaa

SEQ ID NO: 649275 - DNA, 25 bp, Rattus norvegicus
tggacccgaatccaggccagagggc

SEQ ID NO: 649276 - DNA, 25 bp, Rattus norvegicus
tggcacaggctaaaagctgtctacc

SEQ ID NO: 649277 - DNA, 25 bp, Rattus norvegicus
agcctgagctgctcgccttggcaca

SEQ ID NO: 649278 - DNA, 25 bp, Rattus norvegicus
tgacccgaccaagcagaagaccttg

SEQ ID NO: 649279 - DNA, 25 bp, Rattus norvegicus
tcaccttgtagcctctgcggagcgc

SEQ ID NO: 649280 - DNA, 25 bp, Rattus norvegicus
gggctcccaaattgacgtcagctga

SEQ ID NO: 649281 - DNA, 25 bp, Rattus norvegicus
ggggagtcccttctcacagcgacaa

SEQ ID NO: 649282 - DNA, 25 bp, Rattus norvegicus
aggggtctgcgagtcaaagtcctcg

SEQ ID NO: 649283 - DNA, 25 bp, Rattus norvegicus
ccttggacaaggtacaggggtctgc

SEQ ID NO: 649284 - DNA, 25 bp, Rattus norvegicus
cagaagctaagcgaactggggtccc

SEQ ID NO: 649285 - DNA, 25 bp, Rattus norvegicus
tccgaccaccacagggcagaagcta

SEQ ID NO: 649286 - DNA, 25 bp, Rattus norvegicus
gccatgatgccttcctgctctgttg

SEQ ID NO: 649287 - DNA, 25 bp, Rattus norvegicus
tgagagacaggcgaatgacccgacc

SEQ ID NO: 649288 - DNA, 25 bp, Rattus norvegicus
ccacaaagagctcgctgagcccagg

SEQ ID NO: 649289 - DNA, 25 bp, Rattus norvegicus
atgtctgtgccgtcggtatcgcagc

SEQ ID NO: 649290 - DNA, 25 bp, Rattus norvegicus
catatccatgtctgtgccgtcggta

SEQ ID NO: 649291 - DNA, 25 bp, Rattus norvegicus
gtcctaacctccatatccatgtctg

SEQ ID NO: 649292 - DNA, 25 bp, Rattus norvegicus
agccctcaagcagcccgggtgagtc

SEQ ID NO: 649293 - DNA, 25 bp, Rattus norvegicus
agaaagccctcaagcagcccgggtg

SEQ ID NO: 649294 - DNA, 25 bp, Rattus norvegicus
tggcccggaagagaaagccctcaag

SEQ ID NO: 649295 - DNA, 25 bp, Rattus norvegicus
ctgcgtggcataggaggttctgcgc

SEQ ID NO: 649296 - DNA, 25 bp, Rattus norvegicus
tcaccgccacaaagagctcgctgag

SEQ ID NO: 649297 - DNA, 25 bp, Rattus norvegicus
ggcttatgccatcaccgccacaaag

SEQ ID NO: 649298 - DNA, 25 bp, Rattus norvegicus
agtgtagcgcgcaacctgaccgccg

SEQ ID NO: 649299 - DNA, 25 bp, Rattus norvegicus
ccgagtggagtgtagcgcgcaacct

SEQ ID NO: 649300 - DNA, 25 bp, Rattus norvegicus
gccgcacagcagaggggaccaccgt

SEQ ID NO: 649301 - DNA, 25 bp, Rattus norvegicus
ggacccggcgctgcgccctctagca

SEQ ID NO: 649302 - DNA, 25 bp, Rattus norvegicus
atgtgtcttatccatggcgagaggc

SEQ ID NO: 649303 - DNA, 25 bp, Rattus norvegicus
gctaccgtcaggcaaacacgaagtc

SEQ ID NO: 649304 - DNA, 25 bp, Rattus norvegicus
tgttcactcgacacgcgacaaacgc

SEQ ID NO: 649305 - DNA, 25 bp, Rattus norvegicus
tccgatgaagctgttcttgtggccc

SEQ ID NO: 649306 - DNA, 25 bp, Rattus norvegicus
tgcccgtttcgtatttccgatgaag

SEQ ID NO: 649307 - DNA, 25 bp, Rattus norvegicus
tcaagctgcgaagtttgcccgtttc

SEQ ID NO: 649308 - DNA, 25 bp, Rattus norvegicus
tgacagcttgccaggttaggctcgc

SEQ ID NO: 649309 - DNA, 25 bp, Rattus norvegicus
cataaaatgcgagcacccacgggtc

SEQ ID NO: 649310 - DNA, 25 bp, Rattus norvegicus
gtactctcaaagcatccgggccgaa

SEQ ID NO: 649311 - DNA, 25 bp, Rattus norvegicus
tgggccgcgtcctagtactctcaaa

SEQ ID NO: 649312 - DNA, 25 bp, Rattus norvegicus
gttctgtaaacgaatgcaatctgtc

SEQ ID NO: 649313 - DNA, 25 bp, Rattus norvegicus
agccctggctgcactttcagttttg

SEQ ID NO: 649314 - DNA, 25 bp, Rattus norvegicus
acccaatgcgtgtcagaaggtttta

SEQ ID NO: 649315 - DNA, 25 bp, Rattus norvegicus
ttgcctccggagtaggtgacagctt

SEQ ID NO: 649316 - DNA, 25 bp, Rattus norvegicus
gcgcagccatattgccgccacggtg

SEQ ID NO: 649317 - DNA, 25 bp, Rattus norvegicus
cccgtctagaaggaggatgcggcct

SEQ ID NO: 649318 - DNA, 25 bp, Rattus norvegicus
aaccaggagcgaggtctgcgtcgca

SEQ ID NO: 649319 - DNA, 25 bp, Rattus norvegicus
cgcaggagctggtagtgaaaaactc

SEQ ID NO: 649320 - DNA, 25 bp, Rattus norvegicus
cacggtggccgtagaggaccaaact

SEQ ID NO: 649321 - DNA, 25 bp, Rattus norvegicus
tcgcctttttctccatgggcgcagc

SEQ ID NO: 649322 - DNA, 25 bp, Rattus norvegicus
ctctgctttggaattcgcctttttc

SEQ ID NO: 649323 - DNA, 25 bp, Rattus norvegicus
cgatctggaattggctctctgcttt

SEQ ID NO: 649324 - DNA, 25 bp, Rattus norvegicus
cggtccatgagcgagcgatctggaa

SEQ ID NO: 649325 - DNA, 25 bp, Rattus norvegicus
catcggccgaactctgcgctgcggt

SEQ ID NO: 649326 - DNA, 25 bp, Rattus norvegicus
ggtctgccttgctcagactctgcgc

SEQ ID NO: 649327 - DNA, 25 bp, Rattus norvegicus
gcccttccggctaaggtctgccttg

SEQ ID NO: 649328 - DNA, 25 bp, Rattus norvegicus
tcttcccgcgaattcaggagctcca

SEQ ID NO: 649329 - DNA, 25 bp, Rattus norvegicus
cccatttgcgcaaccaggagcgagg

SEQ ID NO: 649330 - DNA, 25 bp, Rattus norvegicus
ttccgggagcccacttagcacgcat

SEQ ID NO: 649331 - DNA, 25 bp, Rattus norvegicus
tttccgcagggtggcttcccggaga

SEQ ID NO: 649332 - DNA, 25 bp, Rattus norvegicus
ccggagagtctccatggccgacttc

SEQ ID NO: 649333 - DNA, 25 bp, Rattus norvegicus
ctctggaagcgccatgagacctgga

SEQ ID NO: 649334 - DNA, 25 bp, Rattus norvegicus
tgcgcaagcggcgtttcctaggcaa

SEQ ID NO: 649335 - DNA, 25 bp, Rattus norvegicus
ctaggcaacgctctgtggggcagat

SEQ ID NO: 649336 - DNA, 25 bp, Rattus norvegicus
tctcagctccgaaaatctgcgcagt

SEQ ID NO: 649337 - DNA, 25 bp, Rattus norvegicus
tgggttcccgctttaccacgtctga

SEQ ID NO: 649338 - DNA, 25 bp, Rattus norvegicus
tttaccacgtctgacagcccgtctg

SEQ ID NO: 649339 - DNA, 25 bp, Rattus norvegicus
aaatctgcgcagtttccgcagggtg

SEQ ID NO: 649340 - DNA, 25 bp, Rattus norvegicus
tccgtgcaagggagcagagaactca

SEQ ID NO: 649341 - DNA, 25 bp, Rattus norvegicus
tccttgcgaaggagccctccgtgca

SEQ ID NO: 649342 - DNA, 25 bp, Rattus norvegicus
atgccacgtcactgcggctctggaa

SEQ ID NO: 649343 - DNA, 25 bp, Rattus norvegicus
agagaactcagttccgccgcggtac

SEQ ID NO: 649344 - DNA, 25 bp, Rattus norvegicus
gcgttctccagttcgcacaggcgga

SEQ ID NO: 649345 - DNA, 25 bp, Rattus norvegicus
tgtacactgtctccctctcacaagt

SEQ ID NO: 649346 - DNA, 25 bp, Rattus norvegicus
gtgcacactctgtgctgacaccaca

SEQ ID NO: 649347 - DNA, 25 bp, Rattus norvegicus
ctcacacacactcatgcgcaagtta

SEQ ID NO: 649348 - DNA, 25 bp, Rattus norvegicus
ctcatgcgcaagttagaatcaagac

SEQ ID NO: 649349 - DNA, 25 bp, Rattus norvegicus
gcaagttagaatcaagacgcacaga

SEQ ID NO: 649350 - DNA, 25 bp, Rattus norvegicus
tcaagacgcacagagaagggcaggc

SEQ ID NO: 649351 - DNA, 25 bp, Rattus norvegicus
tctcacaagtgcacactctgtgctg

SEQ ID NO: 649352 - DNA, 25 bp, Rattus norvegicus
cacagagaagggcaggcgttctcca

SEQ ID NO: 649353 - DNA, 25 bp, Rattus norvegicus
tccagttcgcacaggcggactcaca

SEQ ID NO: 649354 - DNA, 25 bp, Rattus norvegicus
ggtccgcaggcctgaatagtgttcc

SEQ ID NO: 649355 - DNA, 25 bp, Rattus norvegicus
cacgcactagctttcggtccgcagg

SEQ ID NO: 649356 - DNA, 25 bp, Rattus norvegicus
ggcggactcacacacgcactagctt

SEQ ID NO: 649357 - DNA, 25 bp, Rattus norvegicus
gcctgaatagtgttcccgcagagcg

SEQ ID NO: 649358 - DNA, 25 bp, Rattus norvegicus
ccgtggacaacatgctggtgaggaa

SEQ ID NO: 649359 - DNA, 25 bp, Rattus norvegicus
gaaggcaagctgcagagaagcagaa

SEQ ID NO: 649360 - DNA, 25 bp, Rattus norvegicus
agggattagctacgctccggacgcg

SEQ ID NO: 649361 - DNA, 25 bp, Rattus norvegicus
tgtgcggccgccagggattagctac

SEQ ID NO: 649362 - DNA, 25 bp, Rattus norvegicus
tgctcgccgcctcgcaggacggtgt

SEQ ID NO: 649363 - DNA, 25 bp, Rattus norvegicus
aaacggccgcttggcaacgcgcgcg

SEQ ID NO: 649364 - DNA, 25 bp, Rattus norvegicus
aaaaaatctcgtgtggcgcgccgcc

SEQ ID NO: 649365 - DNA, 25 bp, Rattus norvegicus
ggcggtgcttctgagcctgtgctct

SEQ ID NO: 649366 - DNA, 25 bp, Rattus norvegicus
cgcttgttgctcgaaccagtggctg

SEQ ID NO: 649367 - DNA, 25 bp, Rattus norvegicus
ctggcaggcacggacatggtgctcc

SEQ ID NO: 649368 - DNA, 25 bp, Rattus norvegicus
ccctctttttgatgtatctctttcg

SEQ ID NO: 649369 - DNA, 25 bp, Rattus norvegicus
ttatcgggcagcctcgccagcagca

SEQ ID NO: 649370 - DNA, 25 bp, Rattus norvegicus
ttgctacggaaacggccgcttggca

SEQ ID NO: 649371 - DNA, 25 bp, Rattus norvegicus
tgtgctcttgcctcccggctgggca

SEQ ID NO: 649372 - DNA, 25 bp, Rattus norvegicus
aacgcctgctcaggaactccgtgag

SEQ ID NO: 649373 - DNA, 25 bp, Rattus norvegicus
atcgctcgcccgagtgaaccctagg

SEQ ID NO: 649374 - DNA, 25 bp, Rattus norvegicus
gtgaaccctaggcaacgcgcaagcc

SEQ ID NO: 649375 - DNA, 25 bp, Rattus norvegicus
gccgagcttctggaccagctgctga

SEQ ID NO: 649376 - DNA, 25 bp, Rattus norvegicus
aggagagctctgctacgatggctgc

SEQ ID NO: 649377 - DNA, 25 bp, Rattus norvegicus
ctgctggcgtccaagatgtcgacca

SEQ ID NO: 649378 - DNA, 25 bp, Rattus norvegicus
tgctccgcttttggccacggagatc

SEQ ID NO: 649379 - DNA, 25 bp, Rattus norvegicus
tgacttggcttttctcaccctcctg

SEQ ID NO: 649380 - DNA, 25 bp, Rattus norvegicus
cgactcagtagctttaccggggcta

SEQ ID NO: 649381 - DNA, 25 bp, Rattus norvegicus
tgccctgacaagaagtgagtgcgtc

SEQ ID NO: 649382 - DNA, 25 bp, Rattus norvegicus
ggggactggatctgccctgacaaga

SEQ ID NO: 649383 - DNA, 25 bp, Rattus norvegicus
tgtcgaccaagaatttccgagttag

SEQ ID NO: 649384 - DNA, 25 bp, Rattus norvegicus
agctgctgactctagggcgtcgtct

SEQ ID NO: 649385 - DNA, 25 bp, Rattus norvegicus
agtcacttccgcctctgagcactta

SEQ ID NO: 649386 - DNA, 25 bp, Rattus norvegicus
gtcatcctcgtgtacctgtcgcagc

SEQ ID NO: 649387 - DNA, 25 bp, Rattus norvegicus
tggtatgccagccacatgaagactc

SEQ ID NO: 649388 - DNA, 25 bp, Rattus norvegicus
cttcgggctgaccatgacagtgttc

SEQ ID NO: 649389 - DNA, 25 bp, Rattus norvegicus
cgcctgtgcaccttcttcgggctga

SEQ ID NO: 649390 - DNA, 25 bp, Rattus norvegicus
tgggagcaactcgacccatcggggc

SEQ ID NO: 649391 - DNA, 25 bp, Rattus norvegicus
cccggcacgtggtgcttcatcagca

SEQ ID NO: 649392 - DNA, 25 bp, Rattus norvegicus
aaaaagtctttcctgctgtgcattg

SEQ ID NO: 649393 - DNA, 25 bp, Rattus norvegicus
cgggagagcaaacgcaaaaagtctt

SEQ ID NO: 649394 - DNA, 25 bp, Rattus norvegicus
cgcagctatagacgccgggagagca

SEQ ID NO: 649395 - DNA, 25 bp, Rattus norvegicus
ccatgttgcttgtgtcgcgcagcta

SEQ ID NO: 649396 - DNA, 25 bp, Rattus norvegicus
ccggagcactcggttgaagcgcaca

SEQ ID NO: 649397 - DNA, 25 bp, Rattus norvegicus
tctggtggtgacctttgcctgcaac

SEQ ID NO: 649398 - DNA, 25 bp, Rattus norvegicus
tggcgaccatcaaagccctggtgtc

SEQ ID NO: 649399 - DNA, 25 bp, Rattus norvegicus
gcaaccagtcaagtgctgccgacgg

SEQ ID NO: 649400 - DNA, 25 bp, Rattus norvegicus
gccgctgacccgtctacactgtaga

SEQ ID NO: 649401 - DNA, 25 bp, Rattus norvegicus
ctgtagaaagtgaggccgctaaccc

SEQ ID NO: 649402 - DNA, 25 bp, Rattus norvegicus
ggccgctaacccgtctacactgtag

SEQ ID NO: 649403 - DNA, 25 bp, Rattus norvegicus
tacactgtagaaagtgaggccgcta

SEQ ID NO: 649404 - DNA, 25 bp, Rattus norvegicus
actgtagaaagtgaggccgctaacc

SEQ ID NO: 649405 - DNA, 25 bp, Rattus norvegicus
ctgtagaaagtgaggccgctgaccc

SEQ ID NO: 649406 - DNA, 25 bp, Rattus norvegicus
tacactgtagaaagtgaggccgctg

SEQ ID NO: 649407 - DNA, 25 bp, Rattus norvegicus
actgtagaaagtgaggccgctgacc

SEQ ID NO: 649408 - DNA, 25 bp, Rattus norvegicus
ccgctgacccgtctacactgtagaa

SEQ ID NO: 649409 - DNA, 25 bp, Rattus norvegicus
tctacactgtagaaagcgaggccgc

SEQ ID NO: 649410 - DNA, 25 bp, Rattus norvegicus
cgctgacccgtctacactgtagaaa

SEQ ID NO: 649411 - DNA, 25 bp, Rattus norvegicus
ctacactgtagaaagcgaggccgct

SEQ ID NO: 649412 - DNA, 25 bp, Rattus norvegicus
ggccgctgacccgtctacactgtag

SEQ ID NO: 649413 - DNA, 25 bp, Rattus norvegicus
gccgctaacccgtctacactgtaga

SEQ ID NO: 649414 - DNA, 25 bp, Rattus norvegicus
ggactctcggctgagagcgcacgaa

SEQ ID NO: 649415 - DNA, 25 bp, Rattus norvegicus
ccagatctcggagcaggtctggaga

SEQ ID NO: 649416 - DNA, 25 bp, Rattus norvegicus
acatatcctccacggcctggcgggg

SEQ ID NO: 649417 - DNA, 25 bp, Rattus norvegicus
ccgggaagtttctcggcatgcagcc

SEQ ID NO: 649418 - DNA, 25 bp, Rattus norvegicus
agcgcacgaaggtgcaggaacatcg

SEQ ID NO: 649419 - DNA, 25 bp, Rattus norvegicus
tttctcggcatgcagcccttgcgct

SEQ ID NO: 649420 - DNA, 25 bp, Rattus norvegicus
agtgcacatatcctccacggcctgg

SEQ ID NO: 649421 - DNA, 25 bp, Rattus norvegicus
gggtcccgcagcagtgcacatatcc

SEQ ID NO: 649422 - DNA, 25 bp, Rattus norvegicus
ccgcaactttcgaggggtcccgcag

SEQ ID NO: 649423 - DNA, 25 bp, Rattus norvegicus
ccgagagagcaagcgagaggaaccc

SEQ ID NO: 649424 - DNA, 25 bp, Rattus norvegicus
cacgtggagccagatcgcgccgaga

SEQ ID NO: 649425 - DNA, 25 bp, Rattus norvegicus
tgtcaccagcacgtggagccagatc

SEQ ID NO: 649426 - DNA, 25 bp, Rattus norvegicus
gcgcagccttcctgatgtgtcacca

SEQ ID NO: 649427 - DNA, 25 bp, Rattus norvegicus
ctggccttgtcggtcctccgggagc

SEQ ID NO: 649428 - DNA, 25 bp, Rattus norvegicus
tttgtccgatttctgtccactgggg

SEQ ID NO: 649429 - DNA, 25 bp, Rattus norvegicus
cttctctggctttgtccgatttctg

SEQ ID NO: 649430 - DNA, 25 bp, Rattus norvegicus
cggccttgggttcccggctcctgct

SEQ ID NO: 649431 - DNA, 25 bp, Rattus norvegicus
tccgatttctgtccactgggggttg

SEQ ID NO: 649432 - DNA, 25 bp, Rattus norvegicus
ctctggctttgtccgatttctgtcc

SEQ ID NO: 649433 - DNA, 25 bp, Rattus norvegicus
agcttctctggctttgtccgatttc

SEQ ID NO: 649434 - DNA, 25 bp, Rattus norvegicus
gagcttctctggctttgtccgattt

SEQ ID NO: 649435 - DNA, 25 bp, Rattus norvegicus
ggtgagcttctctggctttgtccga

SEQ ID NO: 649436 - DNA, 25 bp, Rattus norvegicus
acggtgagcttctctggctttgtcc

SEQ ID NO: 649437 - DNA, 25 bp, Rattus norvegicus
cacggtgagcttctctggctttgtc

SEQ ID NO: 649438 - DNA, 25 bp, Rattus norvegicus
atcacggtgagcttctctggctttg

SEQ ID NO: 649439 - DNA, 25 bp, Rattus norvegicus
ataatcacggtgagcttctctggct

SEQ ID NO: 649440 - DNA, 25 bp, Rattus norvegicus
gaaagataatcacggtgagcttctc

SEQ ID NO: 649441 - DNA, 25 bp, Rattus norvegicus
ggctttgtccgatttctgtccactg

SEQ ID NO: 649442 - DNA, 25 bp, Rattus norvegicus
tcgctctacccggtgcacgagtgcg

SEQ ID NO: 649443 - DNA, 25 bp, Rattus norvegicus
cagtaacccggttgtggtggctgac

SEQ ID NO: 649444 - DNA, 25 bp, Rattus norvegicus
cgggctcttgagctgcggctttcct

SEQ ID NO: 649445 - DNA, 25 bp, Rattus norvegicus
gagctgcggctttcctcgtctgaga

SEQ ID NO: 649446 - DNA, 25 bp, Rattus norvegicus
ggagttcatgctgcgtgcgaggctc

SEQ ID NO: 649447 - DNA, 25 bp, Rattus norvegicus
gccgccgctctaatcgcccggcgtc

SEQ ID NO: 649448 - DNA, 25 bp, Rattus norvegicus
accaccaccggctgcagctgaaggc

SEQ ID NO: 649449 - DNA, 25 bp, Rattus norvegicus
tacccggtgcacgagtgcgtcttta

SEQ ID NO: 649450 - DNA, 25 bp, Rattus norvegicus
ccggtgcacgagtgcgtctttaagg

SEQ ID NO: 649451 - DNA, 25 bp, Rattus norvegicus
gacgtgaggagactgtcctcgctta

SEQ ID NO: 649452 - DNA, 25 bp, Rattus norvegicus
aggagactgtcctcgcttatccgca

SEQ ID NO: 649453 - DNA, 25 bp, Rattus norvegicus
tcgcttatccgcacgcacaatatcg

SEQ ID NO: 649454 - DNA, 25 bp, Rattus norvegicus
gcacgcacaatatcggacagaaaga

SEQ ID NO: 649455 - DNA, 25 bp, Rattus norvegicus
ctgcctgggcagtaacccggttgtg

SEQ ID NO: 649456 - DNA, 25 bp, Rattus norvegicus
aagaggcgcagctcgtcgatcttgc

SEQ ID NO: 649457 - DNA, 25 bp, Rattus norvegicus
ccggaagtacgcgtccagttcgcgc

SEQ ID NO: 649458 - DNA, 25 bp, Rattus norvegicus
aacacaagacagagtgagagcgcgc

SEQ ID NO: 649459 - DNA, 25 bp, Rattus norvegicus
ccgcggattttacaagctgggctct

SEQ ID NO: 649460 - DNA, 25 bp, Rattus norvegicus
ctggtactcactccggcgggaagag

SEQ ID NO: 649461 - DNA, 25 bp, Rattus norvegicus
tacaagctgggctctgacagaccgc

SEQ ID NO: 649462 - DNA, 25 bp, Rattus norvegicus
tcgatcttgcccaggaagccgaaga

SEQ ID NO: 649463 - DNA, 25 bp, Rattus norvegicus
caggaagccgaagagcgtccgcatc

SEQ ID NO: 649464 - DNA, 25 bp, Rattus norvegicus
cgcatctgctctgagctggcgctcg

SEQ ID NO: 649465 - DNA, 25 bp, Rattus norvegicus
gcgctcggggacacgttggtcacct

SEQ ID NO: 649466 - DNA, 25 bp, Rattus norvegicus
ttggtcacctggatcacctcggtgc

SEQ ID NO: 649467 - DNA, 25 bp, Rattus norvegicus
accactgccgtgttgctcatggcgc

SEQ ID NO: 649468 - DNA, 25 bp, Rattus norvegicus
tcctgctcaacacatcaaacacaag

SEQ ID NO: 649469 - DNA, 25 bp, Rattus norvegicus
ggcccgtagcgctctggtactcact

SEQ ID NO: 649470 - DNA, 25 bp, Rattus norvegicus
gaggacctctcagcccgttagacta

SEQ ID NO: 649471 - DNA, 25 bp, Rattus norvegicus
ggcttcctgtctgagcttttgaata

SEQ ID NO: 649472 - DNA, 25 bp, Rattus norvegicus
cttttgaatatgtcgcgccagctga

SEQ ID NO: 649473 - DNA, 25 bp, Rattus norvegicus
tggcgccttaaacgtcactgcggtg

SEQ ID NO: 649474 - DNA, 25 bp, Rattus norvegicus
gggttatctagctgtggcgccttaa

SEQ ID NO: 649475 - DNA, 25 bp, Rattus norvegicus
cgcagcaatggcaaggcccggatta

SEQ ID NO: 649476 - DNA, 25 bp, Rattus norvegicus
gtgacgacatcagcgcgcgcagcaa

SEQ ID NO: 649477 - DNA, 25 bp, Rattus norvegicus
aaccgactcgctgaacccagaaatc

SEQ ID NO: 649478 - DNA, 25 bp, Rattus norvegicus
cctgtactccggtatcaactcaaga

SEQ ID NO: 649479 - DNA, 25 bp, Rattus norvegicus
gcttcgtgacactcgctatcctgta

SEQ ID NO: 649480 - DNA, 25 bp, Rattus norvegicus
cgggtgcgtacacatcgttaagatc

SEQ ID NO: 649481 - DNA, 25 bp, Rattus norvegicus
agcttttagctttcgggtgcgtaca

SEQ ID NO: 649482 - DNA, 25 bp, Rattus norvegicus
ggattcgaagtctaagctgctcgta

SEQ ID NO: 649483 - DNA, 25 bp, Rattus norvegicus
tgctcgtaatacaccacagctttta

SEQ ID NO: 649484 - DNA, 25 bp, Rattus norvegicus
cgcgggcgaatcgtgtacccaactc

SEQ ID NO: 649485 - DNA, 25 bp, Rattus norvegicus
gcagcctttagacagccatctgagc

SEQ ID NO: 649486 - DNA, 25 bp, Rattus norvegicus
tgggtgctcccacaccagttctgtg

SEQ ID NO: 649487 - DNA, 25 bp, Rattus norvegicus
ggaatccgccagcaccgcggctata

SEQ ID NO: 649488 - DNA, 25 bp, Rattus norvegicus
caaagcaggtgtcatcaggctcgca

SEQ ID NO: 649489 - DNA, 25 bp, Rattus norvegicus
aggtccctcagttgcctggagtaca

SEQ ID NO: 649490 - DNA, 25 bp, Rattus norvegicus
gttccgttatcacccgcagccttta

SEQ ID NO: 649491 - DNA, 25 bp, Rattus norvegicus
gttctagctttctctggttccgtta

SEQ ID NO: 649492 - DNA, 25 bp, Rattus norvegicus
agtcccgcggagaaatgaaatgttc

SEQ ID NO: 649493 - DNA, 25 bp, Rattus norvegicus
ggtgacctctacttggactcctgca

SEQ ID NO: 649494 - DNA, 25 bp, Rattus norvegicus
gggctcagaaaggatgaccaccttc

SEQ ID NO: 649495 - DNA, 25 bp, Rattus norvegicus
agctgcagctgcttcaaagtgtgaa

SEQ ID NO: 649496 - DNA, 25 bp, Rattus norvegicus
tcaaggagattttccagggctcaga

SEQ ID NO: 649497 - DNA, 25 bp, Rattus norvegicus
gccgctcctgctatctcagcaaaga

SEQ ID NO: 649498 - DNA, 25 bp, Rattus norvegicus
atgtgactcaatggcgccgccaatc

SEQ ID NO: 649499 - DNA, 25 bp, Rattus norvegicus
agttcctgctacagcgctgtttccg

SEQ ID NO: 649500 - DNA, 25 bp, Rattus norvegicus
cacagaagttcctgctacagcgctg

SEQ ID NO: 649501 - DNA, 25 bp, Rattus norvegicus
gcgcggcagttgttccgacaccaac

SEQ ID NO: 649502 - DNA, 25 bp, Rattus norvegicus
tattcaaatcagcagcgcggcagtt

SEQ ID NO: 649503 - DNA, 25 bp, Rattus norvegicus
cgccaatcagcttcgctccgagata

SEQ ID NO: 649504 - DNA, 25 bp, Rattus norvegicus
cctccgtgaagcatcatgtgactca

SEQ ID NO: 649505 - DNA, 25 bp, Rattus norvegicus
gccttctcctccgtgaagcatcatg

SEQ ID NO: 649506 - DNA, 25 bp, Rattus norvegicus
cagacaggctgcgtgcacgtcagag

SEQ ID NO: 649507 - DNA, 25 bp, Rattus norvegicus
gtaccacccagacaggctgcgtgca

SEQ ID NO: 649508 - DNA, 25 bp, Rattus norvegicus
tcgctttgcaatcccttcggatctg

SEQ ID NO: 649509 - DNA, 25 bp, Rattus norvegicus
cctgcggttcattcgctttgcaatc

SEQ ID NO: 649510 - DNA, 25 bp, Rattus norvegicus
agcttcgctccgagatattcaaatc

SEQ ID NO: 649511 - DNA, 25 bp, Rattus norvegicus
gtttctgctgtcctgcggttcattc

SEQ ID NO: 649512 - DNA, 25 bp, Rattus norvegicus
agcgggcactcttggctgtgccatc

SEQ ID NO: 649513 - DNA, 25 bp, Rattus norvegicus
gggccacggatccactgcctggact

SEQ ID NO: 649514 - DNA, 25 bp, Rattus norvegicus
agcccgtggggccacggatccactg

SEQ ID NO: 649515 - DNA, 25 bp, Rattus norvegicus
agcgctgcggagtcctcagcaaggt

SEQ ID NO: 649516 - DNA, 25 bp, Rattus norvegicus
atccggagacagagtccgggccgcc

SEQ ID NO: 649517 - DNA, 25 bp, Rattus norvegicus
accagagctggaactcgtcgggctc

SEQ ID NO: 649518 - DNA, 25 bp, Rattus norvegicus
tgtcggataaccagagctggaactc

SEQ ID NO: 649519 - DNA, 25 bp, Rattus norvegicus
cgcgtctccatgtcggataaccaga

SEQ ID NO: 649520 - DNA, 25 bp, Rattus norvegicus
gctggaagggcaggctttcttcgcc

SEQ ID NO: 649521 - DNA, 25 bp, Rattus norvegicus
taggcgcctgcactggcgcagctcg

SEQ ID NO: 649522 - DNA, 25 bp, Rattus norvegicus
ttccctggtccgctcggtgtcaggc

SEQ ID NO: 649523 - DNA, 25 bp, Rattus norvegicus
ctggactcacctgccgcgagacgag

SEQ ID NO: 649524 - DNA, 25 bp, Rattus norvegicus
gctgtcgcgtctccatgtcggataa

SEQ ID NO: 649525 - DNA, 25 bp, Rattus norvegicus
gggcaggctttcttcgccgctcgtc

SEQ ID NO: 649526 - DNA, 25 bp, Rattus norvegicus
aatggaggccaccaagccggccctg

SEQ ID NO: 649527 - DNA, 25 bp, Rattus norvegicus
agcatcgcggccttcctattggtcc

SEQ ID NO: 649528 - DNA, 25 bp, Rattus norvegicus
accaatggctagtcgggtcccagca

SEQ ID NO: 649529 - DNA, 25 bp, Rattus norvegicus
ggagaacgggcaccgcaccatctct

SEQ ID NO: 649530 - DNA, 25 bp, Rattus norvegicus
ctgacggcctacgtcacgaacggtc

SEQ ID NO: 649531 - DNA, 25 bp, Rattus norvegicus
cggccgccaataaggaaggatcgtc

SEQ ID NO: 649532 - DNA, 25 bp, Rattus norvegicus
tccagccaacggagaccagggcgga

SEQ ID NO: 649533 - DNA, 25 bp, Rattus norvegicus
cgctcacctccggatctcaatggag

SEQ ID NO: 649534 - DNA, 25 bp, Rattus norvegicus
ttcgcagccacctcgtggaaccagg

SEQ ID NO: 649535 - DNA, 25 bp, Rattus norvegicus
ctcaaggacgtgtcctcgtggtccc

SEQ ID NO: 649536 - DNA, 25 bp, Rattus norvegicus
acacagatgaccgtgaccgcccggt

SEQ ID NO: 649537 - DNA, 25 bp, Rattus norvegicus
ttctttaaggctccgcgaacatcgc

SEQ ID NO: 649538 - DNA, 25 bp, Rattus norvegicus
cgcctgggcgtgaacccttgttctt

SEQ ID NO: 649539 - DNA, 25 bp, Rattus norvegicus
gaactgcgcttacgcacgctccggg

SEQ ID NO: 649540 - DNA, 25 bp, Rattus norvegicus
gctccacgcgggatttctccaaaga

SEQ ID NO: 649541 - DNA, 25 bp, Rattus norvegicus
cgctgcatccgaccaacagtgagtc

SEQ ID NO: 649542 - DNA, 25 bp, Rattus norvegicus
aacagtgagtcctgctgcccgcaag

SEQ ID NO: 649543 - DNA, 25 bp, Rattus norvegicus
agcccggaatagcagacgtgagttg

SEQ ID NO: 649544 - DNA, 25 bp, Rattus norvegicus
cccttcgatgcctggttgtgtcttg

SEQ ID NO: 649545 - DNA, 25 bp, Rattus norvegicus
cctctcggggactttgggcaaatca

SEQ ID NO: 649546 - DNA, 25 bp, Rattus norvegicus
tcggtggaaacttgaactccgtgtc

SEQ ID NO: 649547 - DNA, 25 bp, Rattus norvegicus
ctgtctcacttctggccgggaaaga

SEQ ID NO: 649548 - DNA, 25 bp, Rattus norvegicus
ctactgtcgctttccctcggtggaa

SEQ ID NO: 649549 - DNA, 25 bp, Rattus norvegicus
gaactccgtgtctctgtagctatgg

SEQ ID NO: 649550 - DNA, 25 bp, Rattus norvegicus
ccggaactaattggatctaggcttc

SEQ ID NO: 649551 - DNA, 25 bp, Rattus norvegicus
ttcgcagctccacgcagtagccgag

SEQ ID NO: 649552 - DNA, 25 bp, Rattus norvegicus
atcaagtttcaggtcgcgtgtccca

SEQ ID NO: 649553 - DNA, 25 bp, Rattus norvegicus
taggtccgcttagccacgtaggcaa

SEQ ID NO: 649554 - DNA, 25 bp, Rattus norvegicus
gggcgtccccaggtttgcttgagca

SEQ ID NO: 649555 - DNA, 25 bp, Rattus norvegicus
gcggcttactcgcttctattccggg

SEQ ID NO: 649556 - DNA, 25 bp, Rattus norvegicus
caaggtcactctttaatacggcccg

SEQ ID NO: 649557 - DNA, 25 bp, Rattus norvegicus
taaaggagccggcttactcagcgcg

SEQ ID NO: 649558 - DNA, 25 bp, Rattus norvegicus
gaacttaaaggagccggcttactca

SEQ ID NO: 649559 - DNA, 25 bp, Rattus norvegicus
tgccgcgcatgtcgaacttaaagga

SEQ ID NO: 649560 - DNA, 25 bp, Rattus norvegicus
ggatgccgcgcatgtcgaacttaaa

SEQ ID NO: 649561 - DNA, 25 bp, Rattus norvegicus
gcccgaagcccgcagggccgcgcac

SEQ ID NO: 649562 - DNA, 25 bp, Rattus norvegicus
tgatatttccggaggaccacgccgg

SEQ ID NO: 649563 - DNA, 25 bp, Rattus norvegicus
cgggtgatatttccggaggaccacg

SEQ ID NO: 649564 - DNA, 25 bp, Rattus norvegicus
catctccttttcctcggggaggccg

SEQ ID NO: 649565 - DNA, 25 bp, Rattus norvegicus
tgcttgagcatctccttttcctcgg

SEQ ID NO: 649566 - DNA, 25 bp, Rattus norvegicus
aaggagccggcttactcagcgcgag

SEQ ID NO: 649567 - DNA, 25 bp, Rattus norvegicus
ttgagcatctccttttcctcgggga

SEQ ID NO: 649568 - DNA, 25 bp, Rattus norvegicus
gttcagggatctcagccgtccatca

SEQ ID NO: 649569 - DNA, 25 bp, Rattus norvegicus
cagccgtccatcacgcggagagctt

SEQ ID NO: 649570 - DNA, 25 bp, Rattus norvegicus
agttggccgcgcagcacctcccgct

SEQ ID NO: 649571 - DNA, 25 bp, Rattus norvegicus
tccatcacgcggagagcttggagag

SEQ ID NO: 649572 - DNA, 25 bp, Rattus norvegicus
cccggactagggcattgtatggagt

SEQ ID NO: 649573 - DNA, 25 bp, Rattus norvegicus
agggcattgtatggagtcctcgctc

SEQ ID NO: 649574 - DNA, 25 bp, Rattus norvegicus
ctcctctagaattcgggtcactgcc

SEQ ID NO: 649575 - DNA, 25 bp, Rattus norvegicus
ttctggttcagggatctcagccgtc

SEQ ID NO: 649576 - DNA, 25 bp, Rattus norvegicus
ctgccgttctggttcagggatctca

SEQ ID NO: 649577 - DNA, 25 bp, Rattus norvegicus
attcgggtcactgccgttctggttc

SEQ ID NO: 649578 - DNA, 25 bp, Rattus norvegicus
cctgtgccaccggagatgggaagat

SEQ ID NO: 649579 - DNA, 25 bp, Rattus norvegicus
tggagtcctcgctcctctagaattc

SEQ ID NO: 649580 - DNA, 25 bp, Rattus norvegicus
cctcgctcctctagaattcgggtca

SEQ ID NO: 649581 - DNA, 25 bp, Rattus norvegicus
ggatctcagccgtccatcacgcgga

SEQ ID NO: 649582 - DNA, 25 bp, Rattus norvegicus
atctgccagctgcaggtactcgcgg

SEQ ID NO: 649583 - DNA, 25 bp, Rattus norvegicus
ccagccctttgtacagcgattgcga

SEQ ID NO: 649584 - DNA, 25 bp, Rattus norvegicus
ttacatagctggaggagccgcactc

SEQ ID NO: 649585 - DNA, 25 bp, Rattus norvegicus
gcagcagagcggatcctgaaccctc

SEQ ID NO: 649586 - DNA, 25 bp, Rattus norvegicus
cgccgggtgtcggaagcgaatataa

SEQ ID NO: 649587 - DNA, 25 bp, Rattus norvegicus
tcacagcctccttgaggtcggacgg

SEQ ID NO: 649588 - DNA, 25 bp, Rattus norvegicus
atgaccgggtagtagccatgctcca

SEQ ID NO: 649589 - DNA, 25 bp, Rattus norvegicus
catgcattggggattaccagtagta

SEQ ID NO: 649590 - DNA, 25 bp, Rattus norvegicus
ccagtagtactggaggaaggctccc

SEQ ID NO: 649591 - DNA, 25 bp, Rattus norvegicus
ggtcctatgacccaatccagagcca

SEQ ID NO: 649592 - DNA, 25 bp, Rattus norvegicus
tagctcagggtcaggccctacaggc

SEQ ID NO: 649593 - DNA, 25 bp, Rattus norvegicus
ctgtcaagagtcctcccaagcggga

SEQ ID NO: 649594 - DNA, 25 bp, Rattus norvegicus
cggacggcttgcaaatgaggctgca

SEQ ID NO: 649595 - DNA, 25 bp, Rattus norvegicus
agacagccagttcgggtcgagctcc

SEQ ID NO: 649596 - DNA, 25 bp, Rattus norvegicus
gcgtagcttcttcctgcgggtatga

SEQ ID NO: 649597 - DNA, 25 bp, Rattus norvegicus
aggaggcctccttaccatgatgaca

SEQ ID NO: 649598 - DNA, 25 bp, Rattus norvegicus
ctgcttcactcaggccggaacggga

SEQ ID NO: 649599 - DNA, 25 bp, Rattus norvegicus
gtcctttaagtaggccgagtgaagc

SEQ ID NO: 649600 - DNA, 25 bp, Rattus norvegicus
ccgagtgaagctcaagcgccgcaca

SEQ ID NO: 649601 - DNA, 25 bp, Rattus norvegicus
ccgcacaggagttccgtgttgtctc

SEQ ID NO: 649602 - DNA, 25 bp, Rattus norvegicus
cgtgttgtctctccgttcttaggta

SEQ ID NO: 649603 - DNA, 25 bp, Rattus norvegicus
tttagctgacgtaccaccggaactg

SEQ ID NO: 649604 - DNA, 25 bp, Rattus norvegicus
ggctggtctttcactgctgaccttg

SEQ ID NO: 649605 - DNA, 25 bp, Rattus norvegicus
ttgaaatcgggatacgcgtagcttc

SEQ ID NO: 649606 - DNA, 25 bp, Rattus norvegicus
ggattttgtaacctgaggccgttgc

SEQ ID NO: 649607 - DNA, 25 bp, Rattus norvegicus
tgccagttttggagtggacggtttc

SEQ ID NO: 649608 - DNA, 25 bp, Rattus norvegicus
ggcgaatccgctagcataaccatgc

SEQ ID NO: 649609 - DNA, 25 bp, Rattus norvegicus
gaggctgcctatggcgcttgaaatc

SEQ ID NO: 649610 - DNA, 25 bp, Rattus norvegicus
attggcccggaaattgtgctggctc

SEQ ID NO: 649611 - DNA, 25 bp, Rattus norvegicus
gctgttgtcgatctggaagttctcc

SEQ ID NO: 649612 - DNA, 25 bp, Rattus norvegicus
cgagtcagatgaccgagctcccggc

SEQ ID NO: 649613 - DNA, 25 bp, Rattus norvegicus
gcccgggtcaccgagtcagatgacc

SEQ ID NO: 649614 - DNA, 25 bp, Rattus norvegicus
agaaagcatccgtgcccgggtcacc

SEQ ID NO: 649615 - DNA, 25 bp, Rattus norvegicus
tcgctgggaagaaagcatccgtgcc

SEQ ID NO: 649616 - DNA, 25 bp, Rattus norvegicus
accttcaagcctgggtcgctgggaa

SEQ ID NO: 649617 - DNA, 25 bp, Rattus norvegicus
tcggatcaaccttcaagcctgggtc

SEQ ID NO: 649618 - DNA, 25 bp, Rattus norvegicus
ccggggagagtcttcggatcaacct

SEQ ID NO: 649619 - DNA, 25 bp, Rattus norvegicus
ccggcatgactgctccgcgagtctg

SEQ ID NO: 649620 - DNA, 25 bp, Rattus norvegicus
ggaacacctgcaccgagcgcggcat

SEQ ID NO: 649621 - DNA, 25 bp, Rattus norvegicus
gagatgtacagcagccgcgggaaca

SEQ ID NO: 649622 - DNA, 25 bp, Rattus norvegicus
cccggaaattgtgctggctcggtga

SEQ ID NO: 649623 - DNA, 25 bp, Rattus norvegicus
gttctccggggagatgtacagcagc

SEQ ID NO: 649624 - DNA, 25 bp, Rattus norvegicus
atcggagattcctcttattccggcg

SEQ ID NO: 649625 - DNA, 25 bp, Rattus norvegicus
ttcctcagatcggagattcctctta

SEQ ID NO: 649626 - DNA, 25 bp, Rattus norvegicus
ccctggtgtttcctcagatcggaga

SEQ ID NO: 649627 - DNA, 25 bp, Rattus norvegicus
cgctttcatccctggtgtttcctca

SEQ ID NO: 649628 - DNA, 25 bp, Rattus norvegicus
ggctgacgctttcatccctggtgtt

SEQ ID NO: 649629 - DNA, 25 bp, Rattus norvegicus
agcctctggccgtgcagggcgaaac

SEQ ID NO: 649630 - DNA, 25 bp, Rattus norvegicus
ctcagcgctgagtcaggcgatcact

SEQ ID NO: 649631 - DNA, 25 bp, Rattus norvegicus
agtcaggcgatcactacgtgccggg

SEQ ID NO: 649632 - DNA, 25 bp, Rattus norvegicus
agggcttaggctgacgctttcatcc

SEQ ID NO: 649633 - DNA, 25 bp, Rattus norvegicus
tccaggatctgctgccggggatagc

SEQ ID NO: 649634 - DNA, 25 bp, Rattus norvegicus
tttccagggcttaggctgacgcttt

SEQ ID NO: 649635 - DNA, 25 bp, Rattus norvegicus
gctgagtcaggcgatcactacgtgc

SEQ ID NO: 649636 - DNA, 25 bp, Rattus norvegicus
ccagcgtgggtgacgtccaggatct

SEQ ID NO: 649637 - DNA, 25 bp, Rattus norvegicus
gggccactcactcgccgcacgcacg

SEQ ID NO: 649638 - DNA, 25 bp, Rattus norvegicus
cagtctcattgaggagtgctgcggc

SEQ ID NO: 649639 - DNA, 25 bp, Rattus norvegicus
ggctaacaaacgcagctccgcctat

SEQ ID NO: 649640 - DNA, 25 bp, Rattus norvegicus
aacgcctggcatcgccttagcaaca

SEQ ID NO: 649641 - DNA, 25 bp, Rattus norvegicus
ggagagacctttaccggcgcacgcc

SEQ ID NO: 649642 - DNA, 25 bp, Rattus norvegicus
ttgagcccagggcaatgaaacctgc

SEQ ID NO: 649643 - DNA, 25 bp, Rattus norvegicus
tgggatttttaaccgagcttgagcc

SEQ ID NO: 649644 - DNA, 25 bp, Rattus norvegicus
gaccggttcaatctggctcaggcca

SEQ ID NO: 649645 - DNA, 25 bp, Rattus norvegicus
gcggagccacagcaagccgagcttc

SEQ ID NO: 649646 - DNA, 25 bp, Rattus norvegicus
cgcccgagcagcctagaatgctggg

SEQ ID NO: 649647 - DNA, 25 bp, Rattus norvegicus
atacatacggcatacgtcgcgcggc

SEQ ID NO: 649648 - DNA, 25 bp, Rattus norvegicus
ctaaaccggcgctgagcagatccca

SEQ ID NO: 649649 - DNA, 25 bp, Rattus norvegicus
agagcaggagaggaccggcctaaac

SEQ ID NO: 649650 - DNA, 25 bp, Rattus norvegicus
ccgcgccgtggtaaacaagtgcctg

SEQ ID NO: 649651 - DNA, 25 bp, Rattus norvegicus
gtgcctggctgtcaatcaagaacta

SEQ ID NO: 649652 - DNA, 25 bp, Rattus norvegicus
cgagcttctgtgagtgccttcatta

SEQ ID NO: 649653 - DNA, 25 bp, Rattus norvegicus
aggaggaccacgaggccgacgccac

SEQ ID NO: 649654 - DNA, 25 bp, Rattus norvegicus
acgggcgcagccctcacttggatgc

SEQ ID NO: 649655 - DNA, 25 bp, Rattus norvegicus
ttcgttggtgttcatggctgtgcgc

SEQ ID NO: 649656 - DNA, 25 bp, Rattus norvegicus
ccttggcttcgttggtgttcatggc

SEQ ID NO: 649657 - DNA, 25 bp, Rattus norvegicus
caggtactccttggcttcgttggtg

SEQ ID NO: 649658 - DNA, 25 bp, Rattus norvegicus
gaggaatgtccctccgggccaggta

SEQ ID NO: 649659 - DNA, 25 bp, Rattus norvegicus
ttacctcgaaaagctgaggaatgtc

SEQ ID NO: 649660 - DNA, 25 bp, Rattus norvegicus
accaacctcttacctcgaaaagctg

SEQ ID NO: 649661 - DNA, 25 bp, Rattus norvegicus
acggtcactggggatctatcggcca

SEQ ID NO: 649662 - DNA, 25 bp, Rattus norvegicus
cacttggatgcgctcaggccagggt

SEQ ID NO: 649663 - DNA, 25 bp, Rattus norvegicus
gccttcattaggtactccgcactgg

SEQ ID NO: 649664 - DNA, 25 bp, Rattus norvegicus
gacccgcgcgaaaggctacttgaca

SEQ ID NO: 649665 - DNA, 25 bp, Rattus norvegicus
actccgcactggaaggtgcggccga

SEQ ID NO: 649666 - DNA, 25 bp, Rattus norvegicus
acggtcttgcgcacccgtcagggat

SEQ ID NO: 649667 - DNA, 25 bp, Rattus norvegicus
tgaccagtgcaaggttgagcgcgcc

SEQ ID NO: 649668 - DNA, 25 bp, Rattus norvegicus
agcccgcgtctcacagtggagggca

SEQ ID NO: 649669 - DNA, 25 bp, Rattus norvegicus
tcacagcccgcgtctcacagtggag

SEQ ID NO: 649670 - DNA, 25 bp, Rattus norvegicus
gggatgcatcgctgctcacagcccg

SEQ ID NO: 649671 - DNA, 25 bp, Rattus norvegicus
gcacccgtcagggatgcatcgctgc

SEQ ID NO: 649672 - DNA, 25 bp, Rattus norvegicus
ccagagagcagaggtgacacggtct

SEQ ID NO: 649673 - DNA, 25 bp, Rattus norvegicus
cccgcagccagagagcagaggtgac

SEQ ID NO: 649674 - DNA, 25 bp, Rattus norvegicus
accaagcacaggtccggagcatccg

SEQ ID NO: 649675 - DNA, 25 bp, Rattus norvegicus
ttattgacaccaagcacaggtccgg

SEQ ID NO: 649676 - DNA, 25 bp, Rattus norvegicus
ttgcgctccttattgacaccaagca

SEQ ID NO: 649677 - DNA, 25 bp, Rattus norvegicus
gggaagcttgcgctccttattgaca

SEQ ID NO: 649678 - DNA, 25 bp, Rattus norvegicus
cgggagacagagagagcagaagaca

SEQ ID NO: 649679 - DNA, 25 bp, Rattus norvegicus
tcagggatgcatcgctgctcacagc

SEQ ID NO: 649680 - DNA, 25 bp, Rattus norvegicus
aaactgagccggaccctccgagtct

SEQ ID NO: 649681 - DNA, 25 bp, Rattus norvegicus
gaattctcaggcaagcgcgtccgga

SEQ ID NO: 649682 - DNA, 25 bp, Rattus norvegicus
ctgctgttgcggagattagaggaga

SEQ ID NO: 649683 - DNA, 25 bp, Rattus norvegicus
tcagcgatccacacactgccgcctg

SEQ ID NO: 649684 - DNA, 25 bp, Rattus norvegicus
cctccgagtctcagcgatccacaca

SEQ ID NO: 649685 - DNA, 25 bp, Rattus norvegicus
ttagaggagaattaaaactgagccg

SEQ ID NO: 649686 - DNA, 25 bp, Rattus norvegicus
aagcgctgctgttgcggagattaga

SEQ ID NO: 649687 - DNA, 25 bp, Rattus norvegicus
ctcacctggcagtgagggcggctga

SEQ ID NO: 649688 - DNA, 25 bp, Rattus norvegicus
gcggaggctgctcagatgctcacct

SEQ ID NO: 649689 - DNA, 25 bp, Rattus norvegicus
ttttcttggaggttgtccatggcgg

SEQ ID NO: 649690 - DNA, 25 bp, Rattus norvegicus
gccactttttcttggaggttgtcca

SEQ ID NO: 649691 - DNA, 25 bp, Rattus norvegicus
cggagccactttttcttggaggttg

SEQ ID NO: 649692 - DNA, 25 bp, Rattus norvegicus
tcaggcaagcgcgtccggagccact

SEQ ID NO: 649693 - DNA, 25 bp, Rattus norvegicus
tcagatgctcacctggcagtgaggg

SEQ ID NO: 649694 - DNA, 25 bp, Rattus norvegicus
ggtctcagtctccgatagcggtcac

SEQ ID NO: 649695 - DNA, 25 bp, Rattus norvegicus
actacatcagcaagtccggggccca

SEQ ID NO: 649696 - DNA, 25 bp, Rattus norvegicus
acatcagcaagtccggggcccaggt

SEQ ID NO: 649697 - DNA, 25 bp, Rattus norvegicus
gcccaggtctcggtctccgatagcg

SEQ ID NO: 649698 - DNA, 25 bp, Rattus norvegicus
tctcggtctccgatagcggtcacta

SEQ ID NO: 649699 - DNA, 25 bp, Rattus norvegicus
ctccgatagcggtcactacatcagc

SEQ ID NO: 649700 - DNA, 25 bp, Rattus norvegicus
tagcggtcactacatcagcaagtcc

SEQ ID NO: 649701 - DNA, 25 bp, Rattus norvegicus
gggcccaggtctcggtctccgatag

SEQ ID NO: 649702 - DNA, 25 bp, Rattus norvegicus
atcagcaagtccggggcccaggtct

SEQ ID NO: 649703 - DNA, 25 bp, Rattus norvegicus
gtcactacatcagcaagtccggggc

SEQ ID NO: 649704 - DNA, 25 bp, Rattus norvegicus
gatagcggtcactacatcagcaagt

SEQ ID NO: 649705 - DNA, 25 bp, Rattus norvegicus
tacatcagcaagtccggggcccagg

SEQ ID NO: 649706 - DNA, 25 bp, Rattus norvegicus
tccgatagcggtcactacatcagca

SEQ ID NO: 649707 - DNA, 25 bp, Rattus norvegicus
tcggtctccgatagcggtcactaca

SEQ ID NO: 649708 - DNA, 25 bp, Rattus norvegicus
cgcgcctccctctcgtcgcgcgctc

SEQ ID NO: 649709 - DNA, 25 bp, Rattus norvegicus
tggagccggcgtccctgacttcggt

SEQ ID NO: 649710 - DNA, 25 bp, Rattus norvegicus
gccggcgtccctgacttcggtgcat

SEQ ID NO: 649711 - DNA, 25 bp, Rattus norvegicus
ctcccggtacagtaggtgtggagcc

SEQ ID NO: 649712 - DNA, 25 bp, Rattus norvegicus
cgcgcgctcccggtacagtaggtgt

SEQ ID NO: 649713 - DNA, 25 bp, Rattus norvegicus
ctgacttcggtgcatgggccgcagc

SEQ ID NO: 649714 - DNA, 25 bp, Rattus norvegicus
gcatgggccgcagcgattggccggc

SEQ ID NO: 649715 - DNA, 25 bp, Rattus norvegicus
cactccgcgcggctgcagcgccggc

SEQ ID NO: 649716 - DNA, 25 bp, Rattus norvegicus
cacgcgctccgcgagctaggtagag

SEQ ID NO: 649717 - DNA, 25 bp, Rattus norvegicus
ccaggccagggtgtgcgcccgtacc

SEQ ID NO: 649718 - DNA, 25 bp, Rattus norvegicus
tcgtcgcgcgctcccggtacagtag

SEQ ID NO: 649719 - DNA, 25 bp, Rattus norvegicus
cggacccgcaggacgtgcgagccgt

SEQ ID NO: 649720 - DNA, 25 bp, Rattus norvegicus
cgtccctgacttcggtgcatgggcc

SEQ ID NO: 649721 - DNA, 25 bp, Rattus norvegicus
tgtgcgcccgtaccgcggacccgca

SEQ ID NO: 649722 - DNA, 25 bp, Rattus norvegicus
cccttggagtcgtgactggcttctc

SEQ ID NO: 649723 - DNA, 25 bp, Rattus norvegicus
gctgcacctcactctggcactaaag

SEQ ID NO: 649724 - DNA, 25 bp, Rattus norvegicus
cacctgagcctgctgatacctgttc

SEQ ID NO: 649725 - DNA, 25 bp, Rattus norvegicus
gcggcgacagcgtttaccctaagaa

SEQ ID NO: 649726 - DNA, 25 bp, Rattus norvegicus
gcgagtcctcaccatgattagcgta

SEQ ID NO: 649727 - DNA, 25 bp, Rattus norvegicus
ggcgcccgatttcttggctctctgc

SEQ ID NO: 649728 - DNA, 25 bp, Rattus norvegicus
tgctcccggggcacactattttgga

SEQ ID NO: 649729 - DNA, 25 bp, Rattus norvegicus
ctgctcaggctgctgttgatacaga

SEQ ID NO: 649730 - DNA, 25 bp, Rattus norvegicus
gctattgggagtattcacgccgatc

SEQ ID NO: 649731 - DNA, 25 bp, Rattus norvegicus
gtgattgctactcggagccaccgga

SEQ ID NO: 649732 - DNA, 25 bp, Rattus norvegicus
acctgttctcgcagttgacgtggtg

SEQ ID NO: 649733 - DNA, 25 bp, Rattus norvegicus
ctctgctccagggtcctctgataga

SEQ ID NO: 649734 - DNA, 25 bp, Rattus norvegicus
tctgatagaggctcaccgtgtcccg

SEQ ID NO: 649735 - DNA, 25 bp, Rattus norvegicus
tcctgggttcactctcgttcgaatc

SEQ ID NO: 649736 - DNA, 25 bp, Rattus norvegicus
tgtgttctccagtgcctgtcgcggg

SEQ ID NO: 649737 - DNA, 25 bp, Rattus norvegicus
ccgtccgtaggtgtggcgaagcttt

SEQ ID NO: 649738 - DNA, 25 bp, Rattus norvegicus
cccggttcataaatatgaatgaggc

SEQ ID NO: 649739 - DNA, 25 bp, Rattus norvegicus
gtcgtgaccaagtggaaactccctc

SEQ ID NO: 649740 - DNA, 25 bp, Rattus norvegicus
gacacatttttgagtcgtgaccaag

SEQ ID NO: 649741 - DNA, 25 bp, Rattus norvegicus
ggccgcgacacatttttgagtcgtg

SEQ ID NO: 649742 - DNA, 25 bp, Rattus norvegicus
aagtgcaaagcgtcttccagccctg

SEQ ID NO: 649743 - DNA, 25 bp, Rattus norvegicus
gcaaagcgtcttccagccctgctgg

SEQ ID NO: 649744 - DNA, 25 bp, Rattus norvegicus
tggctccgcccacaccgagatggat

SEQ ID NO: 649745 - DNA, 25 bp, Rattus norvegicus
ccacaccgagatggatgtgcagctg

SEQ ID NO: 649746 - DNA, 25 bp, Rattus norvegicus
ccggaggtgacctcgtgtgtgttct

SEQ ID NO: 649747 - DNA, 25 bp, Rattus norvegicus
acctcgtgtgtgttctccagtgcct

SEQ ID NO: 649748 - DNA, 25 bp, Rattus norvegicus
tatgaatgaggccactcgccgcgga

SEQ ID NO: 649749 - DNA, 25 bp, Rattus norvegicus
gcgaagctttgtcccttggccctac

SEQ ID NO: 649750 - DNA, 25 bp, Rattus norvegicus
gcgccaagattcctattaagtcaca

SEQ ID NO: 649751 - DNA, 25 bp, Rattus norvegicus
gggctctgactgtcttagaacagta

SEQ ID NO: 649752 - DNA, 25 bp, Rattus norvegicus
cctattaagtcacatagtgaagttg

SEQ ID NO: 649753 - DNA, 25 bp, Rattus norvegicus
gcagtgtgactgcatgatctttagc

SEQ ID NO: 649754 - DNA, 25 bp, Rattus norvegicus
cgcctgggctctgactgtcttagaa

SEQ ID NO: 649755 - DNA, 25 bp, Rattus norvegicus
gaatggtgcctgcagtgtgactgca

SEQ ID NO: 649756 - DNA, 25 bp, Rattus norvegicus
cttagaacagtagaccctgaggcga

SEQ ID NO: 649757 - DNA, 25 bp, Rattus norvegicus
agaccctgaggcgaattcctgggga

SEQ ID NO: 649758 - DNA, 25 bp, Rattus norvegicus
ggtctggtctctgggactccaggtc

SEQ ID NO: 649759 - DNA, 25 bp, Rattus norvegicus
ataaccgggacctccctacgcgctg

SEQ ID NO: 649760 - DNA, 25 bp, Rattus norvegicus
gtctctgggactccaggtcccatca

SEQ ID NO: 649761 - DNA, 25 bp, Rattus norvegicus
atcacccgggcgagggcttgcgcca

SEQ ID NO: 649762 - DNA, 25 bp, Rattus norvegicus
agggcttgcgccaagattcctatta

SEQ ID NO: 649763 - DNA, 25 bp, Rattus norvegicus
atgatctttagctgtcccgggcgcc

SEQ ID NO: 649764 - DNA, 25 bp, Rattus norvegicus
gggaaggccgcgactccagactcga

SEQ ID NO: 649765 - DNA, 25 bp, Rattus norvegicus
tctcgcggttctgaggagtaccgtt

SEQ ID NO: 649766 - DNA, 25 bp, Rattus norvegicus
cttccggctgagtgctctcgcggtt

SEQ ID NO: 649767 - DNA, 25 bp, Rattus norvegicus
cactccgtggctcttccggctgagt

SEQ ID NO: 649768 - DNA, 25 bp, Rattus norvegicus
cgcaagcgaggacttcccgtaaaag

SEQ ID NO: 649769 - DNA, 25 bp, Rattus norvegicus
cttagggccgctctgacgcaagcga

SEQ ID NO: 649770 - DNA, 25 bp, Rattus norvegicus
ccagctcctcctcgggagacatgat

SEQ ID NO: 649771 - DNA, 25 bp, Rattus norvegicus
cgcgactccagactcgaggcaggcg

SEQ ID NO: 649772 - DNA, 25 bp, Rattus norvegicus
aggccaaacatggtgggacgccgca

SEQ ID NO: 649773 - DNA, 25 bp, Rattus norvegicus
cgcgtttctccgaaggccaaacatg

SEQ ID NO: 649774 - DNA, 25 bp, Rattus norvegicus
gattaccgcgtttctccgaaggcca

SEQ ID NO: 649775 - DNA, 25 bp, Rattus norvegicus
tagcgccgccgcagtacaggttcaa

SEQ ID NO: 649776 - DNA, 25 bp, Rattus norvegicus
tcctcctcgggagacatgatggcgg

SEQ ID NO: 649777 - DNA, 25 bp, Rattus norvegicus
gaggaaggttgtgccctgccaccgc

SEQ ID NO: 649778 - DNA, 25 bp, Rattus norvegicus
caggttacacaacggcaaatatttc

SEQ ID NO: 649779 - DNA, 25 bp, Rattus norvegicus
ccgcgaccgatctaagtggcctttc

SEQ ID NO: 649780 - DNA, 25 bp, Rattus norvegicus
agccgcggctctgaggaaacgcgca

SEQ ID NO: 649781 - DNA, 25 bp, Rattus norvegicus
ggctgtagccgcctcaaaaacaatt

SEQ ID NO: 649782 - DNA, 25 bp, Rattus norvegicus
tggctttgaaggcaatggagtctcc

SEQ ID NO: 649783 - DNA, 25 bp, Rattus norvegicus
ctctcaagccggtggggaacttccg

SEQ ID NO: 649784 - DNA, 25 bp, Rattus norvegicus
ccgtttctcccatcgcggaggagga

SEQ ID NO: 649785 - DNA, 25 bp, Rattus norvegicus
agagtcccggctctggacgctgacc

SEQ ID NO: 649786 - DNA, 25 bp, Rattus norvegicus
gctttcccgtgcaggcgcacattct

SEQ ID NO: 649787 - DNA, 25 bp, Rattus norvegicus
gcccgggagccagcaaacaaaatag

SEQ ID NO: 649788 - DNA, 25 bp, Rattus norvegicus
tcacggaggagaaaataaacgcttc

SEQ ID NO: 649789 - DNA, 25 bp, Rattus norvegicus
tagacgcaccgacctgtaaccctaa

SEQ ID NO: 649790 - DNA, 25 bp, Rattus norvegicus
tggcctttcattctagacgcaccga

SEQ ID NO: 649791 - DNA, 25 bp, Rattus norvegicus
tcagaccagcgctgacaagtggctc

SEQ ID NO: 649792 - DNA, 25 bp, Rattus norvegicus
gtgcgtcccacctgaggagctcaca

SEQ ID NO: 649793 - DNA, 25 bp, Rattus norvegicus
cgccatgtttgccggcttctcaagc

SEQ ID NO: 649794 - DNA, 25 bp, Rattus norvegicus
cagccactggcagggtaaagaagca

SEQ ID NO: 649795 - DNA, 25 bp, Rattus norvegicus
ggccaagacagccactggcagggta

SEQ ID NO: 649796 - DNA, 25 bp, Rattus norvegicus
agaacgccaaggtggccaagacagc

SEQ ID NO: 649797 - DNA, 25 bp, Rattus norvegicus
agctgccgagagacaagaacgccaa

SEQ ID NO: 649798 - DNA, 25 bp, Rattus norvegicus
ctacctcgatgtgactagcggcgga

SEQ ID NO: 649799 - DNA, 25 bp, Rattus norvegicus
agcgatgcctacctcgatgtgacta

SEQ ID NO: 649800 - DNA, 25 bp, Rattus norvegicus
agttctcaatagacagcgatgccta

SEQ ID NO: 649801 - DNA, 25 bp, Rattus norvegicus
cccggggatcagttctcaatagaca

SEQ ID NO: 649802 - DNA, 25 bp, Rattus norvegicus
gacacaccgtcttcccggggatcag

SEQ ID NO: 649803 - DNA, 25 bp, Rattus norvegicus
ctgaggagctcacagccacgacaca

SEQ ID NO: 649804 - DNA, 25 bp, Rattus norvegicus
caggagccgtgcgtcccacctgagg

SEQ ID NO: 649805 - DNA, 25 bp, Rattus norvegicus
tgtgccgtaaagcagcgcgctgccg

SEQ ID NO: 649806 - DNA, 25 bp, Rattus norvegicus
ctgaaagttttcatgcgagtaaagc

SEQ ID NO: 649807 - DNA, 25 bp, Rattus norvegicus
caagtcgggcgactgacacagaaaa

SEQ ID NO: 649808 - DNA, 25 bp, Rattus norvegicus
tcaggactgcgtagcctcgctcttc

SEQ ID NO: 649809 - DNA, 25 bp, Rattus norvegicus
gcctcgctcttctcaggactgcgta

SEQ ID NO: 649810 - DNA, 25 bp, Rattus norvegicus
tttcatgcgagtaaagcaggactgc

SEQ ID NO: 649811 - DNA, 25 bp, Rattus norvegicus
gaccgagccgctgaaagttttcatg

SEQ ID NO: 649812 - DNA, 25 bp, Rattus norvegicus
gacgtcgaccgagccgctgaaagtt

SEQ ID NO: 649813 - DNA, 25 bp, Rattus norvegicus
aggagcagctccagagacgtcgacc

SEQ ID NO: 649814 - DNA, 25 bp, Rattus norvegicus
gtcctcgctcagaaaggagcagctc

SEQ ID NO: 649815 - DNA, 25 bp, Rattus norvegicus
tggaaactaaagataaagtcctcgc

SEQ ID NO: 649816 - DNA, 25 bp, Rattus norvegicus
cggtgctgtgcagatggaaactaaa

SEQ ID NO: 649817 - DNA, 25 bp, Rattus norvegicus
cccttcacggtgctgtgcagatgga

SEQ ID NO: 649818 - DNA, 25 bp, Rattus norvegicus
cgggcgactgacacagaaaaggacc

SEQ ID NO: 649819 - DNA, 25 bp, Rattus norvegicus
aagcaggactgcgtagcctcgctct

SEQ ID NO: 649820 - DNA, 25 bp, Rattus norvegicus
agagtgaacaggtgagtgacacaca

SEQ ID NO: 649821 - DNA, 25 bp, Rattus norvegicus
ttctctatgagatctgtgaacgccg

SEQ ID NO: 649822 - DNA, 25 bp, Rattus norvegicus
ttccctgaggacagggtgcgagccc

SEQ ID NO: 649823 - DNA, 25 bp, Rattus norvegicus
tccaggtcgcttccctgaggacagg

SEQ ID NO: 649824 - DNA, 25 bp, Rattus norvegicus
caggtgagtgacacacacgtgtcca

SEQ ID NO: 649825 - DNA, 25 bp, Rattus norvegicus
acttggagaggacctcgactgtctc

SEQ ID NO: 649826 - DNA, 25 bp, Rattus norvegicus
ccggattgcgaacttggagaggacc

SEQ ID NO: 649827 - DNA, 25 bp, Rattus norvegicus
tctccacggccggattgcgaacttg

SEQ ID NO: 649828 - DNA, 25 bp, Rattus norvegicus
cgtgggagagcttcccggtctccac

SEQ ID NO: 649829 - DNA, 25 bp, Rattus norvegicus
ccgctgctagtctgagcgagtgcga

SEQ ID NO: 649830 - DNA, 25 bp, Rattus norvegicus
cagtctctccgctgctagtctgagc

SEQ ID NO: 649831 - DNA, 25 bp, Rattus norvegicus
tggctgaccggagctcgcgtcctgc

SEQ ID NO: 649832 - DNA, 25 bp, Rattus norvegicus
ctcactgcagcatcccggtggcgga

SEQ ID NO: 649833 - DNA, 25 bp, Rattus norvegicus
acacgtgtccaggtcgcttccctga

SEQ ID NO: 649834 - DNA, 25 bp, Rattus norvegicus
gcagtaagtagaagtagcttttacg

SEQ ID NO: 649835 - DNA, 25 bp, Rattus norvegicus
agcagtaagtagaagtagcttttac

SEQ ID NO: 649836 - DNA, 25 bp, Rattus norvegicus
cggcgaagctagcagtaagtagaag

SEQ ID NO: 649837 - DNA, 25 bp, Rattus norvegicus
gcggcgaagctagcagtaagtagaa

SEQ ID NO: 649838 - DNA, 25 bp, Rattus norvegicus
cagtaagtagaagtagcttttacgg

SEQ ID NO: 649839 - DNA, 25 bp, Rattus norvegicus
actccctcgctctgccgacctagaa

SEQ ID NO: 649840 - DNA, 25 bp, Rattus norvegicus
attgcaaccccataagaagagtacc

SEQ ID NO: 649841 - DNA, 25 bp, Rattus norvegicus
tggttgaaccattccccaaagatta

SEQ ID NO: 649842 - DNA, 25 bp, Rattus norvegicus
aaagctctctggttgaaccattccc

SEQ ID NO: 649843 - DNA, 25 bp, Rattus norvegicus
ccaaagctctctggttgaaccattc

SEQ ID NO: 649844 - DNA, 25 bp, Rattus norvegicus
caaccaaccaaagctctctggttga

SEQ ID NO: 649845 - DNA, 25 bp, Rattus norvegicus
ttgaaggagctgaaagggattgcaa

SEQ ID NO: 649846 - DNA, 25 bp, Rattus norvegicus
aattgaaggagctgaaagggattgc

SEQ ID NO: 649847 - DNA, 25 bp, Rattus norvegicus
tcttaaagaattgaaggagctgaaa

SEQ ID NO: 649848 - DNA, 25 bp, Rattus norvegicus
tgatcttaaagaattgaaggagctg

SEQ ID NO: 649849 - DNA, 25 bp, Rattus norvegicus
cccaaagattacacatagacagacc

SEQ ID NO: 649850 - DNA, 25 bp, Rattus norvegicus
caggagcgtggtggcggcgtatgca

SEQ ID NO: 649851 - DNA, 25 bp, Rattus norvegicus
accaaagctctctggttgaaccatt

SEQ ID NO: 649852 - DNA, 25 bp, Rattus norvegicus
ctcctttaatgatcttaaagaattg

SEQ ID NO: 649853 - DNA, 25 bp, Rattus norvegicus
cataagaagagtaccaaccaaccaa

SEQ ID NO: 649854 - DNA, 25 bp, Rattus norvegicus
cacgcgaacaaaagaccgctaattc

SEQ ID NO: 649855 - DNA, 25 bp, Rattus norvegicus
ctacttctgcgcctgcgtaagcatc

SEQ ID NO: 649856 - DNA, 25 bp, Rattus norvegicus
ctcgccgtggctgttgccatcatga

SEQ ID NO: 649857 - DNA, 25 bp, Rattus norvegicus
ccagctcgagattcgcttgggttcc

SEQ ID NO: 649858 - DNA, 25 bp, Rattus norvegicus
tttccttaaagatggtgccacgctc

SEQ ID NO: 649859 - DNA, 25 bp, Rattus norvegicus
gtcaccctgctgcagcggctttgtg

SEQ ID NO: 649860 - DNA, 25 bp, Rattus norvegicus
ttgggtccgcagacattcctctgtc

SEQ ID NO: 649861 - DNA, 25 bp, Rattus norvegicus
cccgccgctttagtgccatcggtga

SEQ ID NO: 649862 - DNA, 25 bp, Rattus norvegicus
aactatcccgcagaaagagccgagg

SEQ ID NO: 649863 - DNA, 25 bp, Rattus norvegicus
tttacgccgcaaaaaccaggaagca

SEQ ID NO: 649864 - DNA, 25 bp, Rattus norvegicus
ctctcgcccgggcataaggtttacg

SEQ ID NO: 649865 - DNA, 25 bp, Rattus norvegicus
caacactagtgcgttctgaggaccc

SEQ ID NO: 649866 - DNA, 25 bp, Rattus norvegicus
cttcggccctaggaatacaacacta

SEQ ID NO: 649867 - DNA, 25 bp, Rattus norvegicus
tgccatcggtgaagaaataaacttg

SEQ ID NO: 649868 - DNA, 25 bp, Rattus norvegicus
atcttcgttttgcaccacgcccggg

SEQ ID NO: 649869 - DNA, 25 bp, Rattus norvegicus
tctgtagcatcttatcttcgttttg

SEQ ID NO: 649870 - DNA, 25 bp, Rattus norvegicus
tggtcccgcccattcgatagatgta

SEQ ID NO: 649871 - DNA, 25 bp, Rattus norvegicus
gatagatgtagattcctttcccgcg

SEQ ID NO: 649872 - DNA, 25 bp, Rattus norvegicus
ggtcctggagtttcccagctcctta

SEQ ID NO: 649873 - DNA, 25 bp, Rattus norvegicus
caggtccacagggatggcggccttc

SEQ ID NO: 649874 - DNA, 25 bp, Rattus norvegicus
gccgcccagagtctgtagcatctta

SEQ ID NO: 649875 - DNA, 25 bp, Rattus norvegicus
tgttccgatcctctttacctttcgc

SEQ ID NO: 649876 - DNA, 25 bp, Rattus norvegicus
gttctcgccgcaggtccacagggat

SEQ ID NO: 649877 - DNA, 25 bp, Rattus norvegicus
gtccgctctcaaatggctcctctag

SEQ ID NO: 649878 - DNA, 25 bp, Rattus norvegicus
ggctcctctaggcttcacctcaatg

SEQ ID NO: 649879 - DNA, 25 bp, Rattus norvegicus
ttcacctcaatggttccgcgaagga

SEQ ID NO: 649880 - DNA, 25 bp, Rattus norvegicus
ccgcgaaggaattgttccgatcctc

SEQ ID NO: 649881 - DNA, 25 bp, Rattus norvegicus
agctccttactcgagagacgccttc

SEQ ID NO: 649882 - DNA, 25 bp, Rattus norvegicus
caagacgctattcccacatcgaacg

SEQ ID NO: 649883 - DNA, 25 bp, Rattus norvegicus
atgcccgagtaatactcccactgcg

SEQ ID NO: 649884 - DNA, 25 bp, Rattus norvegicus
attaattcgacaagacgctattccc

SEQ ID NO: 649885 - DNA, 25 bp, Rattus norvegicus
ggctggcgagagtaaagtaaagtta

SEQ ID NO: 649886 - DNA, 25 bp, Rattus norvegicus
actgcgcgccctaagaggctggcga

SEQ ID NO: 649887 - DNA, 25 bp, Rattus norvegicus
ggcagaatgcccgagtaatactccc

SEQ ID NO: 649888 - DNA, 25 bp, Rattus norvegicus
tgtgtccctacagggcagaatgccc

SEQ ID NO: 649889 - DNA, 25 bp, Rattus norvegicus
ccgagtccgaagaattaattcgaca

SEQ ID NO: 649890 - DNA, 25 bp, Rattus norvegicus
ctagctcactgaaagacagcctgtg

SEQ ID NO: 649891 - DNA, 25 bp, Rattus norvegicus
tgctgaccagctagctcactgaaag

SEQ ID NO: 649892 - DNA, 25 bp, Rattus norvegicus
aggggcctgctgaccagctagctca

SEQ ID NO: 649893 - DNA, 25 bp, Rattus norvegicus
ctccgtggcaccagaggggcctgct

SEQ ID NO: 649894 - DNA, 25 bp, Rattus norvegicus
atctctgaactccaccgcccggcgg

SEQ ID NO: 649895 - DNA, 25 bp, Rattus norvegicus
cactgaaagacagcctgtgtcccta

SEQ ID NO: 649896 - DNA, 25 bp, Rattus norvegicus
tgtgctctgatggttgcgcaaacgc

SEQ ID NO: 649897 - DNA, 25 bp, Rattus norvegicus
tatgaactatgaacggcctcgctgc

SEQ ID NO: 649898 - DNA, 25 bp, Rattus norvegicus
gccaggagatctttgggactaactt

SEQ ID NO: 649899 - DNA, 25 bp, Rattus norvegicus
ctggcccagctgaaatggttcctcc

SEQ ID NO: 649900 - DNA, 25 bp, Rattus norvegicus
ggtgggtctcctgagtcttcacgag

SEQ ID NO: 649901 - DNA, 25 bp, Rattus norvegicus
tcttcacgaggtaaggcgaccggct

SEQ ID NO: 649902 - DNA, 25 bp, Rattus norvegicus
ggctcctggtaaggtcttggccgaa

SEQ ID NO: 649903 - DNA, 25 bp, Rattus norvegicus
tggccgaaggatctcaaagcgcttt

SEQ ID NO: 649904 - DNA, 25 bp, Rattus norvegicus
ctttgtcctggaaagagtggcgcgt

SEQ ID NO: 649905 - DNA, 25 bp, Rattus norvegicus
attggtctgcgcctctacttctgga

SEQ ID NO: 649906 - DNA, 25 bp, Rattus norvegicus
ccttggacccacaggtggtggctga

SEQ ID NO: 649907 - DNA, 25 bp, Rattus norvegicus
tctgcctccacaggtaggaaccctg

SEQ ID NO: 649908 - DNA, 25 bp, Rattus norvegicus
ccgaggacgagaagggtatgaacta

SEQ ID NO: 649909 - DNA, 25 bp, Rattus norvegicus
ttccgggattccactcaggcgatac

SEQ ID NO: 649910 - DNA, 25 bp, Rattus norvegicus
cttgaagtctcagaaggtggatccc

SEQ ID NO: 649911 - DNA, 25 bp, Rattus norvegicus
ccgggaacgtatctggaagtaagca

SEQ ID NO: 649912 - DNA, 25 bp, Rattus norvegicus
gacttctcccgcgtcgtggagggaa

SEQ ID NO: 649913 - DNA, 25 bp, Rattus norvegicus
gaaggctctgctgatcagccgggaa

SEQ ID NO: 649914 - DNA, 25 bp, Rattus norvegicus
ctgatcagccgggaacgtatctgga

SEQ ID NO: 649915 - DNA, 25 bp, Rattus norvegicus
aagcaccgcggccaccagtaggagg

SEQ ID NO: 649916 - DNA, 25 bp, Rattus norvegicus
tcgcttggataacgagttctctggc

SEQ ID NO: 649917 - DNA, 25 bp, Rattus norvegicus
cccagagcgttactcgcttggataa

SEQ ID NO: 649918 - DNA, 25 bp, Rattus norvegicus
tcgtgcagattcgacttgaagtctc

SEQ ID NO: 649919 - DNA, 25 bp, Rattus norvegicus
atacatttgttcaccttcgtgcaga

SEQ ID NO: 649920 - DNA, 25 bp, Rattus norvegicus
gagggactcatacatttgttcacct

SEQ ID NO: 649921 - DNA, 25 bp, Rattus norvegicus
ttcaccttcgtgcagattcgacttg

SEQ ID NO: 649922 - DNA, 25 bp, Rattus norvegicus
accagtaggaggagccctagcgcca

SEQ ID NO: 649923 - DNA, 25 bp, Rattus norvegicus
tatctggaagtaagcaccgcggcca

SEQ ID NO: 649924 - DNA, 25 bp, Rattus norvegicus
ctccgctgacccagagtcccgccgg

SEQ ID NO: 649925 - DNA, 25 bp, Rattus norvegicus
caggttcacggtcacctcgctgccc

SEQ ID NO: 649926 - DNA, 25 bp, Rattus norvegicus
gagccgcaggttcacggtcacctcg

SEQ ID NO: 649927 - DNA, 25 bp, Rattus norvegicus
tgagccgcaggttcacggtcacctc

SEQ ID NO: 649928 - DNA, 25 bp, Rattus norvegicus
catgagccgcaggttcacggtcacc

SEQ ID NO: 649929 - DNA, 25 bp, Rattus norvegicus
gccacttgtgcgatcccgccgcccc

SEQ ID NO: 649930 - DNA, 25 bp, Rattus norvegicus
agtcccgccggcattcggtcgctga

SEQ ID NO: 649931 - DNA, 25 bp, Rattus norvegicus
gtcggcgccgggttgctctagtccc

SEQ ID NO: 649932 - DNA, 25 bp, Rattus norvegicus
gccatgagccgcaggttcacggtca

SEQ ID NO: 649933 - DNA, 25 bp, Rattus norvegicus
tctgtttcggcgtcggttgctctcc

SEQ ID NO: 649934 - DNA, 25 bp, Rattus norvegicus
ccgggttgctctagtcccggcgtcg

SEQ ID NO: 649935 - DNA, 25 bp, Rattus norvegicus
cgcccctctgcgtcttgctgcctcc

SEQ ID NO: 649936 - DNA, 25 bp, Rattus norvegicus
cggctcccgagggaagacgtcaaag

SEQ ID NO: 649937 - DNA, 25 bp, Rattus norvegicus
gaagacgtcaaaggtagaggccgcg

SEQ ID NO: 649938 - DNA, 25 bp, Rattus norvegicus
tcctgcatacgggatgaggtgagca

SEQ ID NO: 649939 - DNA, 25 bp, Rattus norvegicus
cacggttctggaatgcgccgcgctc

SEQ ID NO: 649940 - DNA, 25 bp, Rattus norvegicus
taggcgctgtccacggttctggaat

SEQ ID NO: 649941 - DNA, 25 bp, Rattus norvegicus
gagccaacccgggtaagcagtggtc

SEQ ID NO: 649942 - DNA, 25 bp, Rattus norvegicus
tgctcaacaacctgacggactgcga

SEQ ID NO: 649943 - DNA, 25 bp, Rattus norvegicus
gcgaagaggcgcagccatcccgagc

SEQ ID NO: 649944 - DNA, 25 bp, Rattus norvegicus
agcaagcgacagagctcgagcaagc

SEQ ID NO: 649945 - DNA, 25 bp, Rattus norvegicus
gcactgcagcttcttcctccgtgga

SEQ ID NO: 649946 - DNA, 25 bp, Rattus norvegicus
ctcacgcctcctgcatacgggatga

SEQ ID NO: 649947 - DNA, 25 bp, Rattus norvegicus
cgcgacctagttccctgccgttatt

SEQ ID NO: 649948 - DNA, 25 bp, Rattus norvegicus
gccgcttcctgcagagaagagcttg

SEQ ID NO: 649949 - DNA, 25 bp, Rattus norvegicus
cggggaagcttgctccattggaatg

SEQ ID NO: 649950 - DNA, 25 bp, Rattus norvegicus
ttcctccgtggagcggagagcaagc

SEQ ID NO: 649951 - DNA, 25 bp, Rattus norvegicus
ctccattggaatgcgctaggcgctg

SEQ ID NO: 649952 - DNA, 25 bp, Rattus norvegicus
tctggagcaaatccttgtgctgttc

SEQ ID NO: 649953 - DNA, 25 bp, Rattus norvegicus
agccatccatcaccgctgtcagctg

SEQ ID NO: 649954 - DNA, 25 bp, Rattus norvegicus
cccagcggtctcagccatccatcac

SEQ ID NO: 649955 - DNA, 25 bp, Rattus norvegicus
tgccgtttctctgccccgaggtctt

SEQ ID NO: 649956 - DNA, 25 bp, Rattus norvegicus
ggcatccttcactgccgtttctctg

SEQ ID NO: 649957 - DNA, 25 bp, Rattus norvegicus
tgttccggttctccggcatccttca

SEQ ID NO: 649958 - DNA, 25 bp, Rattus norvegicus
tgtgctgttccggttctccggcatc

SEQ ID NO: 649959 - DNA, 25 bp, Rattus norvegicus
gcaaatccttgtgctgttccggttc

SEQ ID NO: 649960 - DNA, 25 bp, Rattus norvegicus
ggggctctggagcaaatccttgtgc

SEQ ID NO: 649961 - DNA, 25 bp, Rattus norvegicus
agctgaggggctctggagcaaatcc

SEQ ID NO: 649962 - DNA, 25 bp, Rattus norvegicus
ggtgcagagacttgccaggagctga

SEQ ID NO: 649963 - DNA, 25 bp, Rattus norvegicus
tgtggcgacactgcggactcgctgc

SEQ ID NO: 649964 - DNA, 25 bp, Rattus norvegicus
gctgtggcgacactgcggactcgct

SEQ ID NO: 649965 - DNA, 25 bp, Rattus norvegicus
atccttgtgctgttccggttctccg

SEQ ID NO: 649966 - DNA, 25 bp, Rattus norvegicus
gtagtctggctaagcgttgcgcgcc

SEQ ID NO: 649967 - DNA, 25 bp, Rattus norvegicus
tcggtcctcgctgtcgccatggaaa

SEQ ID NO: 649968 - DNA, 25 bp, Rattus norvegicus
gccatggaaacaggcgccaggcctc

SEQ ID NO: 649969 - DNA, 25 bp, Rattus norvegicus
gacccagaacgagcctaccaagctg

SEQ ID NO: 649970 - DNA, 25 bp, Rattus norvegicus
ctctcctggccaggatcgggcctgt

SEQ ID NO: 649971 - DNA, 25 bp, Rattus norvegicus
cctgtagtctggctaagcgttgcgc

SEQ ID NO: 649972 - DNA, 25 bp, Rattus norvegicus
aggcgccaggcctcctagttacggg

SEQ ID NO: 649973 - DNA, 25 bp, Rattus norvegicus
gttgcgcgccgcgttacataagtgg

SEQ ID NO: 649974 - DNA, 25 bp, Rattus norvegicus
cgcgccgcgttacataagtggttgc

SEQ ID NO: 649975 - DNA, 25 bp, Rattus norvegicus
ccgcgttacataagtggttgcgggc

SEQ ID NO: 649976 - DNA, 25 bp, Rattus norvegicus
gctccggcgctgagctgtcggtcct

SEQ ID NO: 649977 - DNA, 25 bp, Rattus norvegicus
agctgtcggtcctcgctgtcgccat

SEQ ID NO: 649978 - DNA, 25 bp, Rattus norvegicus
ggcgggacccagaacgagcctacca

SEQ ID NO: 649979 - DNA, 25 bp, Rattus norvegicus
gatcgggcctgtagtctggctaagc

SEQ ID NO: 649980 - DNA, 25 bp, Rattus norvegicus
ccctgccggagtagacgttgcaata

SEQ ID NO: 649981 - DNA, 25 bp, Rattus norvegicus
aggcgtctctcctctgttggcttgc

SEQ ID NO: 649982 - DNA, 25 bp, Rattus norvegicus
gcttcggtggatgcgagcttcccag

SEQ ID NO: 649983 - DNA, 25 bp, Rattus norvegicus
tcttggcgaacacaggtgaggcgac

SEQ ID NO: 649984 - DNA, 25 bp, Rattus norvegicus
ccagttcttggcgaacacaggtgag

SEQ ID NO: 649985 - DNA, 25 bp, Rattus norvegicus
ccaagtgctttaaggccggcgctct

SEQ ID NO: 649986 - DNA, 25 bp, Rattus norvegicus
cccgagctgagagccaagtgcttta

SEQ ID NO: 649987 - DNA, 25 bp, Rattus norvegicus
tgcgctcccgagctgagagccaagt

SEQ ID NO: 649988 - DNA, 25 bp, Rattus norvegicus
actagaaacgcaacggactcctcgc

SEQ ID NO: 649989 - DNA, 25 bp, Rattus norvegicus
ctgtaaactagaaacgcaacggact

SEQ ID NO: 649990 - DNA, 25 bp, Rattus norvegicus
caggagacatcgagtgtatttttaa

SEQ ID NO: 649991 - DNA, 25 bp, Rattus norvegicus
ctatacatagtgtacaggagacatc

SEQ ID NO: 649992 - DNA, 25 bp, Rattus norvegicus
cgctcggctgcgctatacatagtgt

SEQ ID NO: 649993 - DNA, 25 bp, Rattus norvegicus
gtagacgttgcaataaaggtggcga

SEQ ID NO: 649994 - DNA, 25 bp, Rattus norvegicus
acaagttgacacctccagacagcgc

SEQ ID NO: 649995 - DNA, 25 bp, Rattus norvegicus
cggttgcctagtaacagggtctctg

SEQ ID NO: 649996 - DNA, 25 bp, Rattus norvegicus
ggcccgagttgaagcgtccatctcc

SEQ ID NO: 649997 - DNA, 25 bp, Rattus norvegicus
ggacaaaggcgccaccaaccgacta

SEQ ID NO: 649998 - DNA, 25 bp, Rattus norvegicus
cttgcccatcagtacaacgcttcgg

SEQ ID NO: 649999 - DNA, 25 bp, Rattus norvegicus
agctcacagacgctcgcctactggg

SEQ ID NO: 650000 - DNA, 25 bp, Rattus norvegicus
aagaagcctcggcagctgcgatcga

SEQ ID NO: 650001 - DNA, 25 bp, Rattus norvegicus
cagggcgtgctcgatcctacaaaga

SEQ ID NO: 650002 - DNA, 25 bp, Rattus norvegicus
ggttcgaatccctccagtgccactg

SEQ ID NO: 650003 - DNA, 25 bp, Rattus norvegicus
cagggtccgggtccatataatggtc

SEQ ID NO: 650004 - DNA, 25 bp, Rattus norvegicus
gcacaatttctctcgcctggttctc

SEQ ID NO: 650005 - DNA, 25 bp, Rattus norvegicus
ggaagagcccatgctaggaccctgg

SEQ ID NO: 650006 - DNA, 25 bp, Rattus norvegicus
cgcgcgagcgacttcacagactcga

SEQ ID NO: 650007 - DNA, 25 bp, Rattus norvegicus
gacgtggtcttaagcaaagcccatg

SEQ ID NO: 650008 - DNA, 25 bp, Rattus norvegicus
aggggctctatttcgcaaccgttag

SEQ ID NO: 650009 - DNA, 25 bp, Rattus norvegicus
cgcaaccgttaggacgcgctgcaca

SEQ ID NO: 650010 - DNA, 25 bp, Rattus norvegicus
cgcgctgcacaagatgaaagtcgtc

SEQ ID NO: 650011 - DNA, 25 bp, Rattus norvegicus
gtcgtcttgtgacccgcgagtgtaa

SEQ ID NO: 650012 - DNA, 25 bp, Rattus norvegicus
ttcagccgcattcagagcggcattc

SEQ ID NO: 650013 - DNA, 25 bp, Rattus norvegicus
cgcgcgtctcacctcgaagagtgta

SEQ ID NO: 650014 - DNA, 25 bp, Rattus norvegicus
aagccgaacaatggggccgtctgga

SEQ ID NO: 650015 - DNA, 25 bp, Rattus norvegicus
tagaggaattatctcagcgtgagta

SEQ ID NO: 650016 - DNA, 25 bp, Rattus norvegicus
gtgtatgaaaatacagcgctttgtc

SEQ ID NO: 650017 - DNA, 25 bp, Rattus norvegicus
ttctcagttcagaggtcaccggggc

SEQ ID NO: 650018 - DNA, 25 bp, Rattus norvegicus
gcggcattcagcttcttctcagttc

SEQ ID NO: 650019 - DNA, 25 bp, Rattus norvegicus
gccgtctggatgcaattctctattc

SEQ ID NO: 650020 - DNA, 25 bp, Rattus norvegicus
cgtgagtactgcgaggaagccgaac

SEQ ID NO: 650021 - DNA, 25 bp, Rattus norvegicus
agcgctttgtcacagttccgactgc

SEQ ID NO: 650022 - DNA, 25 bp, Rattus norvegicus
tcctttctcctgacattgctcgtca

SEQ ID NO: 650023 - DNA, 25 bp, Rattus norvegicus
ccgccgccttcgtcgttgtatttga

SEQ ID NO: 650024 - DNA, 25 bp, Rattus norvegicus
gccaccttgcggctgatgaagtccc

SEQ ID NO: 650025 - DNA, 25 bp, Rattus norvegicus
cccaggcgcgaagaaaggcgaagtc

SEQ ID NO: 650026 - DNA, 25 bp, Rattus norvegicus
acccagatccgtgcaggccgggttt

SEQ ID NO: 650027 - DNA, 25 bp, Rattus norvegicus
agaaaggcgaagtcctgctccgagc

SEQ ID NO: 650028 - DNA, 25 bp, Rattus norvegicus
tccgagccggtcgagccgctgtgca

SEQ ID NO: 650029 - DNA, 25 bp, Rattus norvegicus
gccctcgaacgcgtaggtctggaag

SEQ ID NO: 650030 - DNA, 25 bp, Rattus norvegicus
tgaagtccctgaacaccgagaagtc

SEQ ID NO: 650031 - DNA, 25 bp, Rattus norvegicus
acaccgagaagtccggctcggggct

SEQ ID NO: 650032 - DNA, 25 bp, Rattus norvegicus
cccgaaatcgtagaggctccgcagc

SEQ ID NO: 650033 - DNA, 25 bp, Rattus norvegicus
tcataagcctcggtgtcctgctcgc

SEQ ID NO: 650034 - DNA, 25 bp, Rattus norvegicus
cgttgtatttgatcacgttgtcccg

SEQ ID NO: 650035 - DNA, 25 bp, Rattus norvegicus
tccgcagcgctgacatgtcataagc

SEQ ID NO: 650036 - DNA, 25 bp, Rattus norvegicus
gcacgattgcctggtctcggaatgt

SEQ ID NO: 650037 - DNA, 25 bp, Rattus norvegicus
tcccgcgccgtcaccacgccgacca

SEQ ID NO: 650038 - DNA, 25 bp, Rattus norvegicus
attgcctggtctcggaatgtgccca

SEQ ID NO: 650039 - DNA, 25 bp, Rattus norvegicus
cgtcaccacgccgaccagggagccc

SEQ ID NO: 650040 - DNA, 25 bp, Rattus norvegicus
ggccacgcgcacgattgcctggtct

SEQ ID NO: 650041 - DNA, 25 bp, Rattus norvegicus
ctggtctcggaatgtgcccaggtcg

SEQ ID NO: 650042 - DNA, 25 bp, Rattus norvegicus
acgattgcctggtctcggaatgtgc

SEQ ID NO: 650043 - DNA, 25 bp, Rattus norvegicus
gcgcacgattgcctggtctcggaat

SEQ ID NO: 650044 - DNA, 25 bp, Rattus norvegicus
acggccacgcgcacgattgcctggt

SEQ ID NO: 650045 - DNA, 25 bp, Rattus norvegicus
atcggtcacggccacgcgcacgatt

SEQ ID NO: 650046 - DNA, 25 bp, Rattus norvegicus
ggggctcatccacatcggtcacggc

SEQ ID NO: 650047 - DNA, 25 bp, Rattus norvegicus
tcctgcacctccagtaggccggagg

SEQ ID NO: 650048 - DNA, 25 bp, Rattus norvegicus
ccacctgcgcgtcctcctgcacctc

SEQ ID NO: 650049 - DNA, 25 bp, Rattus norvegicus
cggaatgtgcccaggtcggcgaagc

SEQ ID NO: 650050 - DNA, 25 bp, Rattus norvegicus
catgtgagcagcaggtgcaagacgc

SEQ ID NO: 650051 - DNA, 25 bp, Rattus norvegicus
cgcttccgtctggatgccgagatgg

SEQ ID NO: 650052 - DNA, 25 bp, Rattus norvegicus
cggaccatgtgagcagcaggtgcaa

SEQ ID NO: 650053 - DNA, 25 bp, Rattus norvegicus
tgggaggcggttccccccatgtcca

SEQ ID NO: 650054 - DNA, 25 bp, Rattus norvegicus
cacgcggaccatgtgagcagcaggt

SEQ ID NO: 650055 - DNA, 25 bp, Rattus norvegicus
ggcgcttccgtctggatgccgagat

SEQ ID NO: 650056 - DNA, 25 bp, Rattus norvegicus
accaggctggcgcttccgtctggat

SEQ ID NO: 650057 - DNA, 25 bp, Rattus norvegicus
tgacacaccaggctggcgcttccgt

SEQ ID NO: 650058 - DNA, 25 bp, Rattus norvegicus
atgacacaaaccatactagcgccca

SEQ ID NO: 650059 - DNA, 25 bp, Rattus norvegicus
gggatgacacaaaccatactagcgc

SEQ ID NO: 650060 - DNA, 25 bp, Rattus norvegicus
ggcagggatgacacaaaccatacta

SEQ ID NO: 650061 - DNA, 25 bp, Rattus norvegicus
ggtggcagggatgacacaaaccata

SEQ ID NO: 650062 - DNA, 25 bp, Rattus norvegicus
accatgtgagcagcaggtgcaagac

SEQ ID NO: 650063 - DNA, 25 bp, Rattus norvegicus
tgtccaccggctccaacgcacagcg

SEQ ID NO: 650064 - DNA, 25 bp, Rattus norvegicus
tggacaatgaatgaaggcggcctgt

SEQ ID NO: 650065 - DNA, 25 bp, Rattus norvegicus
tccgaaggcatggatggctgcagct

SEQ ID NO: 650066 - DNA, 25 bp, Rattus norvegicus
tcgcggcccgagactcgacagaagc

SEQ ID NO: 650067 - DNA, 25 bp, Rattus norvegicus
cctggcagcgtgatctcaggttgca

SEQ ID NO: 650068 - DNA, 25 bp, Rattus norvegicus
ttccttgtgagcttttcggggcagc

SEQ ID NO: 650069 - DNA, 25 bp, Rattus norvegicus
cgccgttcaggacgctttacgccag

SEQ ID NO: 650070 - DNA, 25 bp, Rattus norvegicus
ccgggcagggactctttttcatagc

SEQ ID NO: 650071 - DNA, 25 bp, Rattus norvegicus
ctgaggctttggtcatctggcatta

SEQ ID NO: 650072 - DNA, 25 bp, Rattus norvegicus
tcttatctggagtgtctgaggcttt

SEQ ID NO: 650073 - DNA, 25 bp, Rattus norvegicus
tctcggccagcttgtatcgtcataa

SEQ ID NO: 650074 - DNA, 25 bp, Rattus norvegicus
acaagatctctcagtgggccaccac

SEQ ID NO: 650075 - DNA, 25 bp, Rattus norvegicus
cggcctcctttagagtcacaagatc

SEQ ID NO: 650076 - DNA, 25 bp, Rattus norvegicus
cggcacttgtttcggcctcctttag

SEQ ID NO: 650077 - DNA, 25 bp, Rattus norvegicus
tcatctggcattaagctcgggcgta

SEQ ID NO: 650078 - DNA, 25 bp, Rattus norvegicus
cgtggatgtcacctgtcagctcgtc

SEQ ID NO: 650079 - DNA, 25 bp, Rattus norvegicus
tagaaggttttctgctcccggtcca

SEQ ID NO: 650080 - DNA, 25 bp, Rattus norvegicus
cgtggagaaagcgtggttcactgtc

SEQ ID NO: 650081 - DNA, 25 bp, Rattus norvegicus
aagcgtggttcactgtcgttgatgt

SEQ ID NO: 650082 - DNA, 25 bp, Rattus norvegicus
tgtcctgcactttgatgatgaactc

SEQ ID NO: 650083 - DNA, 25 bp, Rattus norvegicus
ttgatgatgaactctgactccggct

SEQ ID NO: 650084 - DNA, 25 bp, Rattus norvegicus
tccagcagacggttggtggctcgat

SEQ ID NO: 650085 - DNA, 25 bp, Rattus norvegicus
cccggagtgtgtagaaggttttctg

SEQ ID NO: 650086 - DNA, 25 bp, Rattus norvegicus
tgtcagctcgtcgatcaggaagatg

SEQ ID NO: 650087 - DNA, 25 bp, Rattus norvegicus
accctcgcccgagatggtgtacttg

SEQ ID NO: 650088 - DNA, 25 bp, Rattus norvegicus
gtacttgatggtcccgtcgccttcg

SEQ ID NO: 650089 - DNA, 25 bp, Rattus norvegicus
atcaggaagatggtccctgcaccct

SEQ ID NO: 650090 - DNA, 25 bp, Rattus norvegicus
tggtcccgtcgccttcgtcagaatc

SEQ ID NO: 650091 - DNA, 25 bp, Rattus norvegicus
gccacactgccgatgtaggggccgt

SEQ ID NO: 650092 - DNA, 25 bp, Rattus norvegicus
agaggcaccgcagcggtactgcgtc

SEQ ID NO: 650093 - DNA, 25 bp, Rattus norvegicus
tgctggccgtggcctcatgcttggc

SEQ ID NO: 650094 - DNA, 25 bp, Rattus norvegicus
ccgtggcctcatgcttggcggcgcg

SEQ ID NO: 650095 - DNA, 25 bp, Rattus norvegicus
cccggagcatggaccagaggcaccg

SEQ ID NO: 650096 - DNA, 25 bp, Rattus norvegicus
ccagaggcaccgcagcggtactgcg

SEQ ID NO: 650097 - DNA, 25 bp, Rattus norvegicus
ggcaccgcagcggtactgcgtcaca

SEQ ID NO: 650098 - DNA, 25 bp, Rattus norvegicus
caccgcagcggtactgcgtcacatg

SEQ ID NO: 650099 - DNA, 25 bp, Rattus norvegicus
accgcagcggtactgcgtcacatgg

SEQ ID NO: 650100 - DNA, 25 bp, Rattus norvegicus
ccgcagcggtactgcgtcacatggt

SEQ ID NO: 650101 - DNA, 25 bp, Rattus norvegicus
tgacctcagcctcagggatgccggg

SEQ ID NO: 650102 - DNA, 25 bp, Rattus norvegicus
acctcagcctcagggatgccgggct

SEQ ID NO: 650103 - DNA, 25 bp, Rattus norvegicus
gccgcacccgggcatggacacccgg

SEQ ID NO: 650104 - DNA, 25 bp, Rattus norvegicus
cgggcatggacacccggtcctggcc

SEQ ID NO: 650105 - DNA, 25 bp, Rattus norvegicus
ccggagcatggaccagaggcaccgc

SEQ ID NO: 650106 - DNA, 25 bp, Rattus norvegicus
ccacataaatcaggcggctcccgag

SEQ ID NO: 650107 - DNA, 25 bp, Rattus norvegicus
aatcaggcggctcccgagtaccgaa

SEQ ID NO: 650108 - DNA, 25 bp, Rattus norvegicus
tttcatttcggtggccgctgtgctg

SEQ ID NO: 650109 - DNA, 25 bp, Rattus norvegicus
cgggatcgttattaatagcttttca

SEQ ID NO: 650110 - DNA, 25 bp, Rattus norvegicus
tgaagttccgggatcgttattaata

SEQ ID NO: 650111 - DNA, 25 bp, Rattus norvegicus
aacagctgatgggagtgaagttccg

SEQ ID NO: 650112 - DNA, 25 bp, Rattus norvegicus
gggcgcgttattgcccacataaatc

SEQ ID NO: 650113 - DNA, 25 bp, Rattus norvegicus
agacccgggcgcgttattgcccaca

SEQ ID NO: 650114 - DNA, 25 bp, Rattus norvegicus
ctgctttaaaaagcgcggggcagac

SEQ ID NO: 650115 - DNA, 25 bp, Rattus norvegicus
cgctgtgctgtgacatgccttccca

SEQ ID NO: 650116 - DNA, 25 bp, Rattus norvegicus
cccattagcactgctttaaaaagcg

SEQ ID NO: 650117 - DNA, 25 bp, Rattus norvegicus
gtgacatgccttcccagcagaagcc

SEQ ID NO: 650118 - DNA, 25 bp, Rattus norvegicus
acctttaaacaaacagctgatggga

SEQ ID NO: 650119 - DNA, 25 bp, Rattus norvegicus
aatagcttttcatttcggtggccgc

SEQ ID NO: 650120 - DNA, 25 bp, Rattus norvegicus
ggcggcgatcgtttatcctcccgcg

SEQ ID NO: 650121 - DNA, 25 bp, Rattus norvegicus
acccgcatgccgcacggtagcaagg

SEQ ID NO: 650122 - DNA, 25 bp, Rattus norvegicus
tggacgtgggaaagtccctgtcgcc

SEQ ID NO: 650123 - DNA, 25 bp, Rattus norvegicus
ggtccttgcagcctgtccagctcac

SEQ ID NO: 650124 - DNA, 25 bp, Rattus norvegicus
tggagcccggtccttcttcgtggta

SEQ ID NO: 650125 - DNA, 25 bp, Rattus norvegicus
cgcttgctttggacgtgagcctgtg

SEQ ID NO: 650126 - DNA, 25 bp, Rattus norvegicus
gcgatcgtttatcctcccgcgggcg

SEQ ID NO: 650127 - DNA, 25 bp, Rattus norvegicus
gccgcacggtagcaaggtccacgtc

SEQ ID NO: 650128 - DNA, 25 bp, Rattus norvegicus
tagtgtccaccgaaggtcccacaac

SEQ ID NO: 650129 - DNA, 25 bp, Rattus norvegicus
tagggatagtgtccaccgaaggtcc

SEQ ID NO: 650130 - DNA, 25 bp, Rattus norvegicus
gatgtggatagggatagtgtccacc

SEQ ID NO: 650131 - DNA, 25 bp, Rattus norvegicus
gccacaaaaaattggcgaggtcagg

SEQ ID NO: 650132 - DNA, 25 bp, Rattus norvegicus
cccatcaggccacaaaaaattggcg

SEQ ID NO: 650133 - DNA, 25 bp, Rattus norvegicus
cccaagtggcgcttgctttggacgt

SEQ ID NO: 650134 - DNA, 25 bp, Rattus norvegicus
accgcgtgacgaatgtgtttgctca

SEQ ID NO: 650135 - DNA, 25 bp, Rattus norvegicus
cttcccaccgcgtgacgaatgtgtt

SEQ ID NO: 650136 - DNA, 25 bp, Rattus norvegicus
actgtcccgctggaagcgagacttc

SEQ ID NO: 650137 - DNA, 25 bp, Rattus norvegicus
gcctgctcagcagtgtccatctgga

SEQ ID NO: 650138 - DNA, 25 bp, Rattus norvegicus
tcagcagtgtccatctggataaccc

SEQ ID NO: 650139 - DNA, 25 bp, Rattus norvegicus
ccctcgtaagaatttagcgaatgcc

SEQ ID NO: 650140 - DNA, 25 bp, Rattus norvegicus
tttagcgaatgccaggcgaacgggc

SEQ ID NO: 650141 - DNA, 25 bp, Rattus norvegicus
ggccagaatgcaggggaccgcccac

SEQ ID NO: 650142 - DNA, 25 bp, Rattus norvegicus
cacccaggttctcgccgggagattc

SEQ ID NO: 650143 - DNA, 25 bp, Rattus norvegicus
gccgggagattcctgccggaaactc

SEQ ID NO: 650144 - DNA, 25 bp, Rattus norvegicus
ttcctgccggaaactcgagatgggc

SEQ ID NO: 650145 - DNA, 25 bp, Rattus norvegicus
gaaactcgagatgggcactgtcccg

SEQ ID NO: 650146 - DNA, 25 bp, Rattus norvegicus
tggaagcgagacttccgccggaagc

SEQ ID NO: 650147 - DNA, 25 bp, Rattus norvegicus
atgccaggcgaacgggcacagagcc

SEQ ID NO: 650148 - DNA, 25 bp, Rattus norvegicus
ccactgggttgtttgtctgtcacta

SEQ ID NO: 650149 - DNA, 25 bp, Rattus norvegicus
gcaggaggatgaccgaatcggcacc

SEQ ID NO: 650150 - DNA, 25 bp, Rattus norvegicus
aatcggcaccgtgcccatgcttgga

SEQ ID NO: 650151 - DNA, 25 bp, Rattus norvegicus
tgcccatgcttggaggtcgagcaaa

SEQ ID NO: 650152 - DNA, 25 bp, Rattus norvegicus
aggtcgagcaaacgctgccctcggc

SEQ ID NO: 650153 - DNA, 25 bp, Rattus norvegicus
tcaatcccatcctcggtcccaggtc

SEQ ID NO: 650154 - DNA, 25 bp, Rattus norvegicus
ggtctcccaccctcaacactcagtc

SEQ ID NO: 650155 - DNA, 25 bp, Rattus norvegicus
ggcccgggcttctattgctccgctt

SEQ ID NO: 650156 - DNA, 25 bp, Rattus norvegicus
tattgctccgctttgccgtcaagcc

SEQ ID NO: 650157 - DNA, 25 bp, Rattus norvegicus
gaaaattctcacttccactgggttg

SEQ ID NO: 650158 - DNA, 25 bp, Rattus norvegicus
tctgtcactaaagaggaggcgggcc

SEQ ID NO: 650159 - DNA, 25 bp, Rattus norvegicus
cactaaagaggaggcgggcctaaca

SEQ ID NO: 650160 - DNA, 25 bp, Rattus norvegicus
taccgacggcaggaggatgaccgaa

SEQ ID NO: 650161 - DNA, 25 bp, Rattus norvegicus
ctttgccgtcaagccgaaaattctc

SEQ ID NO: 650162 - DNA, 25 bp, Rattus norvegicus
cacttgaagagtcgtgtctatacca

SEQ ID NO: 650163 - DNA, 25 bp, Rattus norvegicus
agcgcgaagcacacttagggacagt

SEQ ID NO: 650164 - DNA, 25 bp, Rattus norvegicus
gcctggcaatgcaaccctccaaatt

SEQ ID NO: 650165 - DNA, 25 bp, Rattus norvegicus
ccaaattggctctcacccgtaggcg

SEQ ID NO: 650166 - DNA, 25 bp, Rattus norvegicus
accctgaggatctgagggtttcctc

SEQ ID NO: 650167 - DNA, 25 bp, Rattus norvegicus
ctgagggtttcctccacgctcagcg

SEQ ID NO: 650168 - DNA, 25 bp, Rattus norvegicus
acgcgggagcgaacaatgaagaaga

SEQ ID NO: 650169 - DNA, 25 bp, Rattus norvegicus
tgaagaagaactgcacatgcgcagg

SEQ ID NO: 650170 - DNA, 25 bp, Rattus norvegicus
caggagagatgctagggactgttcc

SEQ ID NO: 650171 - DNA, 25 bp, Rattus norvegicus
cagagctcctgtctagcgggagagc

SEQ ID NO: 650172 - DNA, 25 bp, Rattus norvegicus
gagagcttgagccacctacggctgc

SEQ ID NO: 650173 - DNA, 25 bp, Rattus norvegicus
acggctgctgttgcctcagaggcaa

SEQ ID NO: 650174 - DNA, 25 bp, Rattus norvegicus
gacccgcgcaggtgttgacacgtaa

SEQ ID NO: 650175 - DNA, 25 bp, Rattus norvegicus
cctcagaggcaaaggcacttgaaga

SEQ ID NO: 650176 - DNA, 25 bp, Rattus norvegicus
atagaggctaggaaacggcgcatgc

SEQ ID NO: 650177 - DNA, 25 bp, Rattus norvegicus
tccgcaagactggtgggatccgatt

SEQ ID NO: 650178 - DNA, 25 bp, Rattus norvegicus
cggaaacgtatccatagaggctagg

SEQ ID NO: 650179 - DNA, 25 bp, Rattus norvegicus
gagcccagcgaaacggaaacgtatc

SEQ ID NO: 650180 - DNA, 25 bp, Rattus norvegicus
tggaagagcccagcgaaacggaaac

SEQ ID NO: 650181 - DNA, 25 bp, Rattus norvegicus
tcgagcctcgcctggaagagcccag

SEQ ID NO: 650182 - DNA, 25 bp, Rattus norvegicus
ttcttttgtagctcccagaaggccc

SEQ ID NO: 650183 - DNA, 25 bp, Rattus norvegicus
aaccttgcttcttttgtagctccca

SEQ ID NO: 650184 - DNA, 25 bp, Rattus norvegicus
ggagtcgccactccgttttcctctg

SEQ ID NO: 650185 - DNA, 25 bp, Rattus norvegicus
aggcgctggtctttctgatcctgcc

SEQ ID NO: 650186 - DNA, 25 bp, Rattus norvegicus
aggaaggcgctggtctttctgatcc

SEQ ID NO: 650187 - DNA, 25 bp, Rattus norvegicus
gggatgctctgttgcctcgcccgac

SEQ ID NO: 650188 - DNA, 25 bp, Rattus norvegicus
agcccggggatgctctgttgcctcg

SEQ ID NO: 650189 - DNA, 25 bp, Rattus norvegicus
gggatccgatttttgcacgcacaca

SEQ ID NO: 650190 - DNA, 25 bp, Rattus norvegicus
tgaagcgcaactcccactggaagga

SEQ ID NO: 650191 - DNA, 25 bp, Rattus norvegicus
ctcccactggaaggagcgctgcacg

SEQ ID NO: 650192 - DNA, 25 bp, Rattus norvegicus
ctgaccgggcttcctgggtcgccga

SEQ ID NO: 650193 - DNA, 25 bp, Rattus norvegicus
tgggtcgccgagtgcccacagtgtt

SEQ ID NO: 650194 - DNA, 25 bp, Rattus norvegicus
cccacagtgttggcgtgtctgtccg

SEQ ID NO: 650195 - DNA, 25 bp, Rattus norvegicus
tgtctgtccgggtgatcactctggt

SEQ ID NO: 650196 - DNA, 25 bp, Rattus norvegicus
atcactctggtcgtgtctcctccgg

SEQ ID NO: 650197 - DNA, 25 bp, Rattus norvegicus
ggtcgtgtctcctccggagccgagc

SEQ ID NO: 650198 - DNA, 25 bp, Rattus norvegicus
cgagcctgcaagtggctaagcctcc

SEQ ID NO: 650199 - DNA, 25 bp, Rattus norvegicus
aagtggctaagcctcctggcctcct

SEQ ID NO: 650200 - DNA, 25 bp, Rattus norvegicus
cgccaggcataggtctgcagtacca

SEQ ID NO: 650201 - DNA, 25 bp, Rattus norvegicus
tctgcagtaccaaggtggcaccagc

SEQ ID NO: 650202 - DNA, 25 bp, Rattus norvegicus
ttgtgggatgtgaagcgcaactccc

SEQ ID NO: 650203 - DNA, 25 bp, Rattus norvegicus
gctgcacggaggcaaacacgctctc

SEQ ID NO: 650204 - DNA, 25 bp, Rattus norvegicus
gggtctgcaaccgagacactcgcta

SEQ ID NO: 650205 - DNA, 25 bp, Rattus norvegicus
gactctcggtccagtaaccgcgaga

SEQ ID NO: 650206 - DNA, 25 bp, Rattus norvegicus
cactttccgattggggagtggtcca

SEQ ID NO: 650207 - DNA, 25 bp, Rattus norvegicus
ttgaccttcactttccgattgggga

SEQ ID NO: 650208 - DNA, 25 bp, Rattus norvegicus
cgctagcactttgaccttcactttc

SEQ ID NO: 650209 - DNA, 25 bp, Rattus norvegicus
gacactcgctagcactttgaccttc

SEQ ID NO: 650210 - DNA, 25 bp, Rattus norvegicus
ccgagacactcgctagcactttgac

SEQ ID NO: 650211 - DNA, 25 bp, Rattus norvegicus
gctccagcagggtctgcaaccgaga

SEQ ID NO: 650212 - DNA, 25 bp, Rattus norvegicus
cgagcctctcggagaaaggaagcct

SEQ ID NO: 650213 - DNA, 25 bp, Rattus norvegicus
ctctgtggccgagcctctcggagaa

SEQ ID NO: 650214 - DNA, 25 bp, Rattus norvegicus
gtccaggggactctcggtccagtaa

SEQ ID NO: 650215 - DNA, 25 bp, Rattus norvegicus
cccaggccgctcctgcaggaagcag

SEQ ID NO: 650216 - DNA, 25 bp, Rattus norvegicus
cagtaaccgcgagacggacgtggtg

SEQ ID NO: 650217 - DNA, 25 bp, Rattus norvegicus
caggaagcagcgaaagccctgccca

SEQ ID NO: 650218 - DNA, 25 bp, Rattus norvegicus
cccagtagcaccaagcaagcagtca

SEQ ID NO: 650219 - DNA, 25 bp, Rattus norvegicus
gcgcaaactttagaagtggggaaga

SEQ ID NO: 650220 - DNA, 25 bp, Rattus norvegicus
agaggcagaccagagagagtcaaga

SEQ ID NO: 650221 - DNA, 25 bp, Rattus norvegicus
ccagagagagtcaagaaagggagaa

SEQ ID NO: 650222 - DNA, 25 bp, Rattus norvegicus
cagtcagagcgcaaactttagaagt

SEQ ID NO: 650223 - DNA, 25 bp, Rattus norvegicus
cccagatggggctaaaggcctcagc

SEQ ID NO: 650224 - DNA, 25 bp, Rattus norvegicus
gggctaaaggcctcagcactgtcac

SEQ ID NO: 650225 - DNA, 25 bp, Rattus norvegicus
gcggccggccagcaaggacctaaac

SEQ ID NO: 650226 - DNA, 25 bp, Rattus norvegicus
tccagggcaaggagtagggaagccc

SEQ ID NO: 650227 - DNA, 25 bp, Rattus norvegicus
cactctggactcacgtgggatttga

SEQ ID NO: 650228 - DNA, 25 bp, Rattus norvegicus
ggactcacgtgggatttgaggcaaa

SEQ ID NO: 650229 - DNA, 25 bp, Rattus norvegicus
atttgaggcaaagcccagatggggc

SEQ ID NO: 650230 - DNA, 25 bp, Rattus norvegicus
gcaagcagtcagagcgcaaacttta

SEQ ID NO: 650231 - DNA, 25 bp, Rattus norvegicus
agcagagccagcggcaccagcagca

SEQ ID NO: 650232 - DNA, 25 bp, Rattus norvegicus
ctgctgcaggtcaggaacacggtgt

SEQ ID NO: 650233 - DNA, 25 bp, Rattus norvegicus
cctctgccctggagaaggagaacct

SEQ ID NO: 650234 - DNA, 25 bp, Rattus norvegicus
ttttgtgttgtagcccgaccggtgc

SEQ ID NO: 650235 - DNA, 25 bp, Rattus norvegicus
cacaggcgttctggggttttgtgtt

SEQ ID NO: 650236 - DNA, 25 bp, Rattus norvegicus
attgcgcagtggtcccacaggcgtt

SEQ ID NO: 650237 - DNA, 25 bp, Rattus norvegicus
cctcgggacgtctttgaatctctgc

SEQ ID NO: 650238 - DNA, 25 bp, Rattus norvegicus
cacggtgtatggaacccgggaccag

SEQ ID NO: 650239 - DNA, 25 bp, Rattus norvegicus
ggactcgccacagcagaggcgctca

SEQ ID NO: 650240 - DNA, 25 bp, Rattus norvegicus
gctcaccgatgacgcatagattggc

SEQ ID NO: 650241 - DNA, 25 bp, Rattus norvegicus
tggcgtcctagcaacgccgttacta

SEQ ID NO: 650242 - DNA, 25 bp, Rattus norvegicus
aaggagcggctcgttgtccgaaaca

SEQ ID NO: 650243 - DNA, 25 bp, Rattus norvegicus
tgtccgaaacatggatgctacctcg

SEQ ID NO: 650244 - DNA, 25 bp, Rattus norvegicus
agacgttcacacagggcggctcctc

SEQ ID NO: 650245 - DNA, 25 bp, Rattus norvegicus
cggcgtcctagagccattgcgcagt

SEQ ID NO: 650246 - DNA, 25 bp, Rattus norvegicus
gagcgttcggcaactttcggacaaa

SEQ ID NO: 650247 - DNA, 25 bp, Rattus norvegicus
ctccgtgagcgttcggcaactttcg

SEQ ID NO: 650248 - DNA, 25 bp, Rattus norvegicus
ccgaagacccggcagccatggtttc

SEQ ID NO: 650249 - DNA, 25 bp, Rattus norvegicus
cccgaagttcttcgtctatctccgt

SEQ ID NO: 650250 - DNA, 25 bp, Rattus norvegicus
gagcgctgcccttcccgaagttctt

SEQ ID NO: 650251 - DNA, 25 bp, Rattus norvegicus
tcttcacgttcaatagagcgctgcc

SEQ ID NO: 650252 - DNA, 25 bp, Rattus norvegicus
gaatggttccgcctcacaacctctt

SEQ ID NO: 650253 - DNA, 25 bp, Rattus norvegicus
tttattctgcaagaatggttccgcc

SEQ ID NO: 650254 - DNA, 25 bp, Rattus norvegicus
ccctcaacaactttattctgcaaga

SEQ ID NO: 650255 - DNA, 25 bp, Rattus norvegicus
gcctctttccgttatgaacatcgtc

SEQ ID NO: 650256 - DNA, 25 bp, Rattus norvegicus
aatcctccggcctctttccgttatg

SEQ ID NO: 650257 - DNA, 25 bp, Rattus norvegicus
tttcgagcagtttggcccgcgaccg

SEQ ID NO: 650258 - DNA, 25 bp, Rattus norvegicus
cggcagccatggtttcgagcagttt

SEQ ID NO: 650259 - DNA, 25 bp, Rattus norvegicus
tttcggacaaaagcttctcactctc

SEQ ID NO: 650260 - DNA, 25 bp, Rattus norvegicus
cagcgctactcgctagctatgggta

SEQ ID NO: 650261 - DNA, 25 bp, Rattus norvegicus
aagtttatccgccacggctacagcg

SEQ ID NO: 650262 - DNA, 25 bp, Rattus norvegicus
gtttatccgccacggctacagcggg

SEQ ID NO: 650263 - DNA, 25 bp, Rattus norvegicus
atccgccacggctacagcggggatt

SEQ ID NO: 650264 - DNA, 25 bp, Rattus norvegicus
atttgaccaggacgtgcagggccca

SEQ ID NO: 650265 - DNA, 25 bp, Rattus norvegicus
gcccagcgctactcgctagctatgg

SEQ ID NO: 650266 - DNA, 25 bp, Rattus norvegicus
gctactcgctagctatgggtaagtc

SEQ ID NO: 650267 - DNA, 25 bp, Rattus norvegicus
tactcgctagctatgggtaagtcgc

SEQ ID NO: 650268 - DNA, 25 bp, Rattus norvegicus
ctagctatgggtaagtcgcggccac

SEQ ID NO: 650269 - DNA, 25 bp, Rattus norvegicus
aagtcgcggccacggatctcgggcc

SEQ ID NO: 650270 - DNA, 25 bp, Rattus norvegicus
cgcaggccctagctctggggaaagt

SEQ ID NO: 650271 - DNA, 25 bp, Rattus norvegicus
ctctggggaaagtttatccgccacg

SEQ ID NO: 650272 - DNA, 25 bp, Rattus norvegicus
gcaggccctagctctggggaaagtt

SEQ ID NO: 650273 - DNA, 25 bp, Rattus norvegicus
ctatgggtaagtcgcggccacggat

SEQ ID NO: 650274 - DNA, 25 bp, Rattus norvegicus
aggttcgcacctgctggggacattt

SEQ ID NO: 650275 - DNA, 25 bp, Rattus norvegicus
aatcggcgcagtgttcgcaatgccc

SEQ ID NO: 650276 - DNA, 25 bp, Rattus norvegicus
gacgccgctgcggtaatgatcccgc

SEQ ID NO: 650277 - DNA, 25 bp, Rattus norvegicus
gcgacgccaggagtcattgaccttg

SEQ ID NO: 650278 - DNA, 25 bp, Rattus norvegicus
taatgatcccgcgacagctgcgctc

SEQ ID NO: 650279 - DNA, 25 bp, Rattus norvegicus
gcctccggagacaggttcgcacctg

SEQ ID NO: 650280 - DNA, 25 bp, Rattus norvegicus
tggggacatttctcatcaattagac

SEQ ID NO: 650281 - DNA, 25 bp, Rattus norvegicus
catcaattagaccttggcagcgctt

SEQ ID NO: 650282 - DNA, 25 bp, Rattus norvegicus
ccttggcagcgcttgaatggggccc

SEQ ID NO: 650283 - DNA, 25 bp, Rattus norvegicus
cgcggagtcacaatcggcgcagtgt

SEQ ID NO: 650284 - DNA, 25 bp, Rattus norvegicus
acacctgcgcggcacagatggtatc

SEQ ID NO: 650285 - DNA, 25 bp, Rattus norvegicus
cacagatggtatcgcccgcggcagc

SEQ ID NO: 650286 - DNA, 25 bp, Rattus norvegicus
cccactgaggacgcctaagcgggtg

SEQ ID NO: 650287 - DNA, 25 bp, Rattus norvegicus
cacctgctggggacatttctcatca

SEQ ID NO: 650288 - DNA, 25 bp, Rattus norvegicus
cgagatccctttgggtctcagggcc

SEQ ID NO: 650289 - DNA, 25 bp, Rattus norvegicus
gctcgggacgcctctgcactgagcg

SEQ ID NO: 650290 - DNA, 25 bp, Rattus norvegicus
gcctctgcactgagcgggtgagtac

SEQ ID NO: 650291 - DNA, 25 bp, Rattus norvegicus
cactgagcgggtgagtaccgcgctc

SEQ ID NO: 650292 - DNA, 25 bp, Rattus norvegicus
agacactagaggagcagagacccgg

SEQ ID NO: 650293 - DNA, 25 bp, Rattus norvegicus
agacccggccgctgaaggcagattc

SEQ ID NO: 650294 - DNA, 25 bp, Rattus norvegicus
ttcagtcccgagatccctttgggtc

SEQ ID NO: 650295 - DNA, 25 bp, Rattus norvegicus
gaggctgccgcaaccctgcgacatt

SEQ ID NO: 650296 - DNA, 25 bp, Rattus norvegicus
gcgcagcgactgaagttggcaactt

SEQ ID NO: 650297 - DNA, 25 bp, Rattus norvegicus
tggcaacttcagtgcgccggacaag

SEQ ID NO: 650298 - DNA, 25 bp, Rattus norvegicus
tcagtgcgccggacaagtgcaggac

SEQ ID NO: 650299 - DNA, 25 bp, Rattus norvegicus
acaagtgcaggacgccgcagagtcc

SEQ ID NO: 650300 - DNA, 25 bp, Rattus norvegicus
agtccctgcgtttggttcgttgcct

SEQ ID NO: 650301 - DNA, 25 bp, Rattus norvegicus
gaaggcagattcagtcccgagatcc

SEQ ID NO: 650302 - DNA, 25 bp, Rattus norvegicus
ggctagcaaatagctccttcatgga

SEQ ID NO: 650303 - DNA, 25 bp, Rattus norvegicus
acgaacgctcaggactctgaaagca

SEQ ID NO: 650304 - DNA, 25 bp, Rattus norvegicus
cgtgctgtgcaagccacgaacgctc

SEQ ID NO: 650305 - DNA, 25 bp, Rattus norvegicus
gacatacggggacataaaagcggcc

SEQ ID NO: 650306 - DNA, 25 bp, Rattus norvegicus
taaggcggacacatgaggacatacg

SEQ ID NO: 650307 - DNA, 25 bp, Rattus norvegicus
cgtcacagggagtaaggcggacaca

SEQ ID NO: 650308 - DNA, 25 bp, Rattus norvegicus
acatggcaccacgtcacagggagta

SEQ ID NO: 650309 - DNA, 25 bp, Rattus norvegicus
aaacagggtcgctggacatggcacc

SEQ ID NO: 650310 - DNA, 25 bp, Rattus norvegicus
tgaaagcaaaacgttctgaaccacg

SEQ ID NO: 650311 - DNA, 25 bp, Rattus norvegicus
cgcgtgtaaaccacaaacagggtcg

SEQ ID NO: 650312 - DNA, 25 bp, Rattus norvegicus
attggatgtgcttacaggcgaccgg

SEQ ID NO: 650313 - DNA, 25 bp, Rattus norvegicus
ggccactcgattggatgtgcttaca

SEQ ID NO: 650314 - DNA, 25 bp, Rattus norvegicus
ctccttcatggaggccactcgattg

SEQ ID NO: 650315 - DNA, 25 bp, Rattus norvegicus
cacggtcacggacgggctagcaaat

SEQ ID NO: 650316 - DNA, 25 bp, Rattus norvegicus
ccgtgacggtagacatcgtgctggt

SEQ ID NO: 650317 - DNA, 25 bp, Rattus norvegicus
gctgggacagtctccttcggtaaga

SEQ ID NO: 650318 - DNA, 25 bp, Rattus norvegicus
tgggacagtctccttcggtaagagc

SEQ ID NO: 650319 - DNA, 25 bp, Rattus norvegicus
cagtctccttcggtaagagcggcct

SEQ ID NO: 650320 - DNA, 25 bp, Rattus norvegicus
ggtaagagcggcctctgcttcttca

SEQ ID NO: 650321 - DNA, 25 bp, Rattus norvegicus
agagcggcctctgcttcttcactgg

SEQ ID NO: 650322 - DNA, 25 bp, Rattus norvegicus
ggcctctgcttcttcactgggcttc

SEQ ID NO: 650323 - DNA, 25 bp, Rattus norvegicus
ctgcttcttcactgggcttccggtg

SEQ ID NO: 650324 - DNA, 25 bp, Rattus norvegicus
ttcttcactgggcttccggtgacgg

SEQ ID NO: 650325 - DNA, 25 bp, Rattus norvegicus
tgaccgtgacggtagacatcgtgct

SEQ ID NO: 650326 - DNA, 25 bp, Rattus norvegicus
acgacccgctgcacggctgggacag

SEQ ID NO: 650327 - DNA, 25 bp, Rattus norvegicus
cccggccgcaggtgcttgcgtggct

SEQ ID NO: 650328 - DNA, 25 bp, Rattus norvegicus
tgagcgggtgagaaccggcgtctct

SEQ ID NO: 650329 - DNA, 25 bp, Rattus norvegicus
cgctgtgaccgtgacggtagacatc

SEQ ID NO: 650330 - DNA, 25 bp, Rattus norvegicus
acaatcgctgtggttctgaggactc

SEQ ID NO: 650331 - DNA, 25 bp, Rattus norvegicus
cacggcgcccgggagccatttatta

SEQ ID NO: 650332 - DNA, 25 bp, Rattus norvegicus
tgtgacgctctttccaccgagaagg

SEQ ID NO: 650333 - DNA, 25 bp, Rattus norvegicus
cactttagttgtgacgctctttcca

SEQ ID NO: 650334 - DNA, 25 bp, Rattus norvegicus
aggtgtttccaactcactttagttg

SEQ ID NO: 650335 - DNA, 25 bp, Rattus norvegicus
gcacgcgttcttactatatttttag

SEQ ID NO: 650336 - DNA, 25 bp, Rattus norvegicus
aagggagatgatttgcattctggac

SEQ ID NO: 650337 - DNA, 25 bp, Rattus norvegicus
ggacgcacgcgttcttactatattt

SEQ ID NO: 650338 - DNA, 25 bp, Rattus norvegicus
atttgcattctggacgcacgcgttc

SEQ ID NO: 650339 - DNA, 25 bp, Rattus norvegicus
tggttctgaggactcgctgtctgtg

SEQ ID NO: 650340 - DNA, 25 bp, Rattus norvegicus
ctcgaataaatacacacaatcgctg

SEQ ID NO: 650341 - DNA, 25 bp, Rattus norvegicus
tacggtagactcgaataaatacaca

SEQ ID NO: 650342 - DNA, 25 bp, Rattus norvegicus
ctttccaccgagaaggaagccctcg

SEQ ID NO: 650343 - DNA, 25 bp, Rattus norvegicus
cgggagccatttattacggtagact

SEQ ID NO: 650344 - DNA, 25 bp, Rattus norvegicus
tggctcctgagtctgccaggtgtgt

SEQ ID NO: 650345 - DNA, 25 bp, Rattus norvegicus
aggctctgctgtctgtatgggatga

SEQ ID NO: 650346 - DNA, 25 bp, Rattus norvegicus
agaagctcagcgtagcctcctcttc

SEQ ID NO: 650347 - DNA, 25 bp, Rattus norvegicus
aagctggtggcaacccaggccttgc

SEQ ID NO: 650348 - DNA, 25 bp, Rattus norvegicus
tctgctgtctgtatgggatgagtgt

SEQ ID NO: 650349 - DNA, 25 bp, Rattus norvegicus
tagcgtggatgcaggctctgctgtc

SEQ ID NO: 650350 - DNA, 25 bp, Rattus norvegicus
ggacacggagtctgctctgcgcgca

SEQ ID NO: 650351 - DNA, 25 bp, Rattus norvegicus
gtcggagaagctcagcgtagcctcc

SEQ ID NO: 650352 - DNA, 25 bp, Rattus norvegicus
gcgaatctcgggtcggagaagctca

SEQ ID NO: 650353 - DNA, 25 bp, Rattus norvegicus
ttccgatcgagaacagcgttgggga

SEQ ID NO: 650354 - DNA, 25 bp, Rattus norvegicus
ctgagctgtgagtttccgatcgaga

SEQ ID NO: 650355 - DNA, 25 bp, Rattus norvegicus
ctgcctcagctcctcagagcgccgg

SEQ ID NO: 650356 - DNA, 25 bp, Rattus norvegicus
ggtggcaacccaggccttgcgacca

SEQ ID NO: 650357 - DNA, 25 bp, Rattus norvegicus
cctctgtgcggcgtggatacgtgct

SEQ ID NO: 650358 - DNA, 25 bp, Rattus norvegicus
attaaatgtcgaggcagctgctggc

SEQ ID NO: 650359 - DNA, 25 bp, Rattus norvegicus
cggatcgacccccagctatggaatt

SEQ ID NO: 650360 - DNA, 25 bp, Rattus norvegicus
cgacctgggtttagcgtcggtagca

SEQ ID NO: 650361 - DNA, 25 bp, Rattus norvegicus
atttattaaatgtcgaggcagctgc

SEQ ID NO: 650362 - DNA, 25 bp, Rattus norvegicus
agcccaggagcagtggccgcccgtt

SEQ ID NO: 650363 - DNA, 25 bp, Rattus norvegicus
gcagcccggtcgcttggctgccttt

SEQ ID NO: 650364 - DNA, 25 bp, Rattus norvegicus
cggtcgcttggctgcctttgtttct

SEQ ID NO: 650365 - DNA, 25 bp, Rattus norvegicus
cgcttggctgcctttgtttcttcgc

SEQ ID NO: 650366 - DNA, 25 bp, Rattus norvegicus
tggctgcctttgtttcttcgctgtg

SEQ ID NO: 650367 - DNA, 25 bp, Rattus norvegicus
tgcctttgtttcttcgctgtgtggg

SEQ ID NO: 650368 - DNA, 25 bp, Rattus norvegicus
tttgtttcttcgctgtgtgggcgcg

SEQ ID NO: 650369 - DNA, 25 bp, Rattus norvegicus
tcttcgctgtgtgggcgcgtctcga

SEQ ID NO: 650370 - DNA, 25 bp, Rattus norvegicus
cgcgtctcgagcacgtggcagccag

SEQ ID NO: 650371 - DNA, 25 bp, Rattus norvegicus
cccagctatggaatttcatttatta

SEQ ID NO: 650372 - DNA, 25 bp, Rattus norvegicus
ttagctggacctaccaccgcgttca

SEQ ID NO: 650373 - DNA, 25 bp, Rattus norvegicus
accgcaccgggcctttacacttgtg

SEQ ID NO: 650374 - DNA, 25 bp, Rattus norvegicus
gtcacagctgcaggcctcgctgctt

SEQ ID NO: 650375 - DNA, 25 bp, Rattus norvegicus
ggcctcgctgctttggccgtcgtac

SEQ ID NO: 650376 - DNA, 25 bp, Rattus norvegicus
tttggccgtcgtacttgggcaccag

SEQ ID NO: 650377 - DNA, 25 bp, Rattus norvegicus
accaggttggagagggctctgtcac

SEQ ID NO: 650378 - DNA, 25 bp, Rattus norvegicus
tggagagggctctgtcaccaccgcc

SEQ ID NO: 650379 - DNA, 25 bp, Rattus norvegicus
ttacacttgtgcagcttcagcgccc

SEQ ID NO: 650380 - DNA, 25 bp, Rattus norvegicus
tctacacactgccacttctgtggga

SEQ ID NO: 650381 - DNA, 25 bp, Rattus norvegicus
ttctgtgggacacaacagggcttca

SEQ ID NO: 650382 - DNA, 25 bp, Rattus norvegicus
cacgctcggcttggcaaatgccgtc

SEQ ID NO: 650383 - DNA, 25 bp, Rattus norvegicus
ttggcaaatgccgtccatacccttg

SEQ ID NO: 650384 - DNA, 25 bp, Rattus norvegicus
tcgctcccgtccacacttagctgga

SEQ ID NO: 650385 - DNA, 25 bp, Rattus norvegicus
ttgccaactccaaatgcctgcttct

SEQ ID NO: 650386 - DNA, 25 bp, Rattus norvegicus
caggggctcgccctggtttgcaaac

SEQ ID NO: 650387 - DNA, 25 bp, Rattus norvegicus
tttatccgctttcacaggggctcgc

SEQ ID NO: 650388 - DNA, 25 bp, Rattus norvegicus
cctcgtaatgacacgttaataaatg

SEQ ID NO: 650389 - DNA, 25 bp, Rattus norvegicus
aagtgttccctgaggcgtgcgacag

SEQ ID NO: 650390 - DNA, 25 bp, Rattus norvegicus
ctcccagcagcgaggagccaagtgt

SEQ ID NO: 650391 - DNA, 25 bp, Rattus norvegicus
gaatccagcctctttccgctttttg

SEQ ID NO: 650392 - DNA, 25 bp, Rattus norvegicus
agtccaccaaacaccggcgcgaagt

SEQ ID NO: 650393 - DNA, 25 bp, Rattus norvegicus
tggtttgcaaacacccggcagcctt

SEQ ID NO: 650394 - DNA, 25 bp, Rattus norvegicus
cgcgccaggacctaggatctggctg

SEQ ID NO: 650395 - DNA, 25 bp, Rattus norvegicus
gggacccggcgattcagccatcgct

SEQ ID NO: 650396 - DNA, 25 bp, Rattus norvegicus
cagacggggtcaaatcggtcagccc

SEQ ID NO: 650397 - DNA, 25 bp, Rattus norvegicus
ccagccttgcagacggggtcaaatc

SEQ ID NO: 650398 - DNA, 25 bp, Rattus norvegicus
ggggcgcatctcttagtccaccaaa

SEQ ID NO: 650399 - DNA, 25 bp, Rattus norvegicus
acctgagccgtgctcgccctggaat

SEQ ID NO: 650400 - DNA, 25 bp, Rattus norvegicus
aactgcctgtctggaaagtgcgctc

SEQ ID NO: 650401 - DNA, 25 bp, Rattus norvegicus
gcactgatcaggattgggttcttca

SEQ ID NO: 650402 - DNA, 25 bp, Rattus norvegicus
ttcggacgcacccacaccaagatga

SEQ ID NO: 650403 - DNA, 25 bp, Rattus norvegicus
ggctacagcctgaagctctctccga

SEQ ID NO: 650404 - DNA, 25 bp, Rattus norvegicus
gctctgagctcggactttggctaca

SEQ ID NO: 650405 - DNA, 25 bp, Rattus norvegicus
tcttactctccacgtgctgctcggg

SEQ ID NO: 650406 - DNA, 25 bp, Rattus norvegicus
cgggcaacagctgcgaagaatctta

SEQ ID NO: 650407 - DNA, 25 bp, Rattus norvegicus
gggagcttcagcgagtcacttttcc

SEQ ID NO: 650408 - DNA, 25 bp, Rattus norvegicus
accctgctaggtggccgcagaactg

SEQ ID NO: 650409 - DNA, 25 bp, Rattus norvegicus
gttgctaggcaacgccaccctgcta

SEQ ID NO: 650410 - DNA, 25 bp, Rattus norvegicus
tcccgagcgccactgagccagaaag

SEQ ID NO: 650411 - DNA, 25 bp, Rattus norvegicus
tcacagcgtactgcagcttcacggc

SEQ ID NO: 650412 - DNA, 25 bp, Rattus norvegicus
cctgggttgtgcacatcgcagataa

SEQ ID NO: 650413 - DNA, 25 bp, Rattus norvegicus
tccgtgggtgactgaaatactgcga

SEQ ID NO: 650414 - DNA, 25 bp, Rattus norvegicus
tcccattcggccttgggcaggctca

SEQ ID NO: 650415 - DNA, 25 bp, Rattus norvegicus
ttcatgaggcggtagagctcgtcca

SEQ ID NO: 650416 - DNA, 25 bp, Rattus norvegicus
acgaaggacttcatgaggcggtaga

SEQ ID NO: 650417 - DNA, 25 bp, Rattus norvegicus
tttcgggtgcacgaaggacttcatg

SEQ ID NO: 650418 - DNA, 25 bp, Rattus norvegicus
accagctttcgggtgcacgaaggac

SEQ ID NO: 650419 - DNA, 25 bp, Rattus norvegicus
accagcaccagctttcgggtgcacg

SEQ ID NO: 650420 - DNA, 25 bp, Rattus norvegicus
aggccggcacctaggctcccaccag

SEQ ID NO: 650421 - DNA, 25 bp, Rattus norvegicus
ccagacggtagcagagctcagagga

SEQ ID NO: 650422 - DNA, 25 bp, Rattus norvegicus
gccacacatggtgatctgacacgcc

SEQ ID NO: 650423 - DNA, 25 bp, Rattus norvegicus
gccggtgccacacatggtgatctga

SEQ ID NO: 650424 - DNA, 25 bp, Rattus norvegicus
gctgcatgccggtgccacacatggt

SEQ ID NO: 650425 - DNA, 25 bp, Rattus norvegicus
tagagctcgtccagggcgttgatgg

SEQ ID NO: 650426 - DNA, 25 bp, Rattus norvegicus
ttcggccttgggcaggctcaccgct

SEQ ID NO: 650427 - DNA, 25 bp, Rattus norvegicus
tccgctatgtcccattcggccttgg

SEQ ID NO: 650428 - DNA, 25 bp, Rattus norvegicus
aagagctgttcgacgctcccaccga

SEQ ID NO: 650429 - DNA, 25 bp, Rattus norvegicus
ttgagtacgcacagacggaggcgca

SEQ ID NO: 650430 - DNA, 25 bp, Rattus norvegicus
gaccgcgagcatcgggatgcgcacc

SEQ ID NO: 650431 - DNA, 25 bp, Rattus norvegicus
ccatagcaaaatggggcggagcctt

SEQ ID NO: 650432 - DNA, 25 bp, Rattus norvegicus
gagcgtcagccaagagccggttcgt

SEQ ID NO: 650433 - DNA, 25 bp, Rattus norvegicus
tcctggctctgcttagtctataggc

SEQ ID NO: 650434 - DNA, 25 bp, Rattus norvegicus
tctataggccaagactcattgagta

SEQ ID NO: 650435 - DNA, 25 bp, Rattus norvegicus
cattgagtaggtctgcaagagcagc

SEQ ID NO: 650436 - DNA, 25 bp, Rattus norvegicus
acccacgcgtaggaagcgcccagtg

SEQ ID NO: 650437 - DNA, 25 bp, Rattus norvegicus
tgtaggggtcggatcagcgaccacc

SEQ ID NO: 650438 - DNA, 25 bp, Rattus norvegicus
tcgcctgacgcccagaagagctgtt

SEQ ID NO: 650439 - DNA, 25 bp, Rattus norvegicus
cgggagctcaccgactgcaggaaac

SEQ ID NO: 650440 - DNA, 25 bp, Rattus norvegicus
gcaggaaacgcaaggtgcccacgta

SEQ ID NO: 650441 - DNA, 25 bp, Rattus norvegicus
gccaggatctcgttgagtacgcaca

SEQ ID NO: 650442 - DNA, 25 bp, Rattus norvegicus
cagccgaaagcatggctggcgcgtc

SEQ ID NO: 650443 - DNA, 25 bp, Rattus norvegicus
gggtccaaaccagccgaaagcatgg

SEQ ID NO: 650444 - DNA, 25 bp, Rattus norvegicus
gtcagaacgggacagatggggctcc

SEQ ID NO: 650445 - DNA, 25 bp, Rattus norvegicus
ccgggttccaggagaccgataggat

SEQ ID NO: 650446 - DNA, 25 bp, Rattus norvegicus
tgggcttcgggagacgggtcagaac

SEQ ID NO: 650447 - DNA, 25 bp, Rattus norvegicus
cagtcggagttctgggagaccggta

SEQ ID NO: 650448 - DNA, 25 bp, Rattus norvegicus
cgaaagcatggctggcgcgtcttcg

SEQ ID NO: 650449 - DNA, 25 bp, Rattus norvegicus
atagcggaagaagccggaggatttc

SEQ ID NO: 650450 - DNA, 25 bp, Rattus norvegicus
gtcagatccgagaggctccgcagag

SEQ ID NO: 650451 - DNA, 25 bp, Rattus norvegicus
cggcggtgttcatagcggaagaagc

SEQ ID NO: 650452 - DNA, 25 bp, Rattus norvegicus
gtcgcgaggcggaaccactcttgca

SEQ ID NO: 650453 - DNA, 25 bp, Rattus norvegicus
aggctccgcagagcgcggaagggtc

SEQ ID NO: 650454 - DNA, 25 bp, Rattus norvegicus
tccgggtccaaaccagccgaaagca

SEQ ID NO: 650455 - DNA, 25 bp, Rattus norvegicus
tcgagtcaggacagtcggagttctg

SEQ ID NO: 650456 - DNA, 25 bp, Rattus norvegicus
ggcgtctcttcctgacagggcggca

SEQ ID NO: 650457 - DNA, 25 bp, Rattus norvegicus
tcctagctgacaaggaggtgaagcg

SEQ ID NO: 650458 - DNA, 25 bp, Rattus norvegicus
tggagaagatcctagctgacaagga

SEQ ID NO: 650459 - DNA, 25 bp, Rattus norvegicus
ccaagagcatgttcgtgtcccgggc

SEQ ID NO: 650460 - DNA, 25 bp, Rattus norvegicus
aagccagaccaagagcatgttcgtg

SEQ ID NO: 650461 - DNA, 25 bp, Rattus norvegicus
tctcttcctgacagggcggcacgca

SEQ ID NO: 650462 - DNA, 25 bp, Rattus norvegicus
agcactcccagctgcgtagggcctg

SEQ ID NO: 650463 - DNA, 25 bp, Rattus norvegicus
acgtgacgcgttgcaacatggcggc

SEQ ID NO: 650464 - DNA, 25 bp, Rattus norvegicus
cacgtggtcacgtgacgcgttgcaa

SEQ ID NO: 650465 - DNA, 25 bp, Rattus norvegicus
gacgtaggtacaccaccagtcacgt

SEQ ID NO: 650466 - DNA, 25 bp, Rattus norvegicus
gctcagtagacgtaggtacaccacc

SEQ ID NO: 650467 - DNA, 25 bp, Rattus norvegicus
ggtcgaccgacgctcagtagacgta

SEQ ID NO: 650468 - DNA, 25 bp, Rattus norvegicus
ggtcacagggtcgaccgacgctcag

SEQ ID NO: 650469 - DNA, 25 bp, Rattus norvegicus
cggggccatgcaggaaagccagacc

SEQ ID NO: 650470 - DNA, 25 bp, Rattus norvegicus
caacgtgagcggtgtaacgcgctga

SEQ ID NO: 650471 - DNA, 25 bp, Rattus norvegicus
ttctgaaagaggtcggagctcgccc

SEQ ID NO: 650472 - DNA, 25 bp, Rattus norvegicus
tcactctgattggtttcgccgccgc

SEQ ID NO: 650473 - DNA, 25 bp, Rattus norvegicus
gtcaccgcacaaccgagcagtggtt

SEQ ID NO: 650474 - DNA, 25 bp, Rattus norvegicus
ggtggggccaaaagcattcctggcc

SEQ ID NO: 650475 - DNA, 25 bp, Rattus norvegicus
ggcctcactcgcacatgcgctgtgg

SEQ ID NO: 650476 - DNA, 25 bp, Rattus norvegicus
ccgcgccattttgccagggtttgaa

SEQ ID NO: 650477 - DNA, 25 bp, Rattus norvegicus
ggcttgtagctctcgcttgggattc

SEQ ID NO: 650478 - DNA, 25 bp, Rattus norvegicus
cttgggattccctcctcggtctcgg

SEQ ID NO: 650479 - DNA, 25 bp, Rattus norvegicus
tcggcctcacgcgagcttcttgagc

SEQ ID NO: 650480 - DNA, 25 bp, Rattus norvegicus
cttcgttccgtagcgggtcgctgat

SEQ ID NO: 650481 - DNA, 25 bp, Rattus norvegicus
cgctgattggtcatacccgcgcgtc

SEQ ID NO: 650482 - DNA, 25 bp, Rattus norvegicus
cggtgtggtccctggttctgaaaga

SEQ ID NO: 650483 - DNA, 25 bp, Rattus norvegicus
ggccctgactgctccgggaaccgag

SEQ ID NO: 650484 - DNA, 25 bp, Rattus norvegicus
accgtggcaggaaccacaagtccca

SEQ ID NO: 650485 - DNA, 25 bp, Rattus norvegicus
ctctaggcacgtaagaccaacgggg

SEQ ID NO: 650486 - DNA, 25 bp, Rattus norvegicus
gttaactcccgcactgggcccacga

SEQ ID NO: 650487 - DNA, 25 bp, Rattus norvegicus
cgcaaacgctgaagagtggctcggc

SEQ ID NO: 650488 - DNA, 25 bp, Rattus norvegicus
gcatgcgctctctaggcacgtaaga

SEQ ID NO: 650489 - DNA, 25 bp, Rattus norvegicus
gtccagcatgcgctctctaggcacg

SEQ ID NO: 650490 - DNA, 25 bp, Rattus norvegicus
aacgctgaagagtggctcggcgcct

SEQ ID NO: 650491 - DNA, 25 bp, Rattus norvegicus
gcgacgacagccagcgcaaacgctg

SEQ ID NO: 650492 - DNA, 25 bp, Rattus norvegicus
gggagcgcacacagacgcgacgaca

SEQ ID NO: 650493 - DNA, 25 bp, Rattus norvegicus
agtggccgcaacactgtgcacagca

SEQ ID NO: 650494 - DNA, 25 bp, Rattus norvegicus
gcaccgaaacctggtggcctgccga

SEQ ID NO: 650495 - DNA, 25 bp, Rattus norvegicus
tgacgccgtgcctgcgtgggtcctt

SEQ ID NO: 650496 - DNA, 25 bp, Rattus norvegicus
gacccgagcgccttacctggctgct

SEQ ID NO: 650497 - DNA, 25 bp, Rattus norvegicus
ctgtgcacagcaccgaaacctggtg

SEQ ID NO: 650498 - DNA, 25 bp, Rattus norvegicus
ccgggaatgagctgcgagctaagct

SEQ ID NO: 650499 - DNA, 25 bp, Rattus norvegicus
ggtttcatcgggaccatcggcgaaa

SEQ ID NO: 650500 - DNA, 25 bp, Rattus norvegicus
gaaaatgacgaggtgccggttgaac

SEQ ID NO: 650501 - DNA, 25 bp, Rattus norvegicus
aaccacgctggcgaagcctcaaact

SEQ ID NO: 650502 - DNA, 25 bp, Rattus norvegicus
gctaagctgtgcgaactccgcaggc

SEQ ID NO: 650503 - DNA, 25 bp, Rattus norvegicus
ccatcggcgaaaatgacgaggtgcc

SEQ ID NO: 650504 - DNA, 25 bp, Rattus norvegicus
acatgctggcggagctcggtttcat

SEQ ID NO: 650505 - DNA, 25 bp, Rattus norvegicus
atcttcaacatgctggcggagctcg

SEQ ID NO: 650506 - DNA, 25 bp, Rattus norvegicus
agtggctgcatcttcaacatgctgg

SEQ ID NO: 650507 - DNA, 25 bp, Rattus norvegicus
cacttccggaagtggctgcatcttc

SEQ ID NO: 650508 - DNA, 25 bp, Rattus norvegicus
gcgccgcactcacttccggaagtgg

SEQ ID NO: 650509 - DNA, 25 bp, Rattus norvegicus
gaagtgacgtagcaacgcgcgcgac

SEQ ID NO: 650510 - DNA, 25 bp, Rattus norvegicus
aagcctcaaacttcccgagagcgga

SEQ ID NO: 650511 - DNA, 25 bp, Rattus norvegicus
ttgaacccgagtcggattccggaga

SEQ ID NO: 650512 - DNA, 25 bp, Rattus norvegicus
ttggcctggcctaccgggtcccaga

SEQ ID NO: 650513 - DNA, 25 bp, Rattus norvegicus
agccgcgccacgctagtgctccaag

SEQ ID NO: 650514 - DNA, 25 bp, Rattus norvegicus
agtgggttagagtgcccgcccacct

SEQ ID NO: 650515 - DNA, 25 bp, Rattus norvegicus
gttagtgggttagagtgcccgccca

SEQ ID NO: 650516 - DNA, 25 bp, Rattus norvegicus
ctcctgctcgcagggttagtgggtt

SEQ ID NO: 650517 - DNA, 25 bp, Rattus norvegicus
gggctcgctcctgctcgcagggtta

SEQ ID NO: 650518 - DNA, 25 bp, Rattus norvegicus
ccgtctgcggtgaagacggcccgca

SEQ ID NO: 650519 - DNA, 25 bp, Rattus norvegicus
agcagcttcccgtctgcggtgaaga

SEQ ID NO: 650520 - DNA, 25 bp, Rattus norvegicus
tgctgagcagcttcccgtctgcggt

SEQ ID NO: 650521 - DNA, 25 bp, Rattus norvegicus
ctgaagccggtgctgagcagcttcc

SEQ ID NO: 650522 - DNA, 25 bp, Rattus norvegicus
tcactcatcctgctgaagccggtgc

SEQ ID NO: 650523 - DNA, 25 bp, Rattus norvegicus
agttgccgctcactcatcctgctga

SEQ ID NO: 650524 - DNA, 25 bp, Rattus norvegicus
tcccagagtgcgagttgccgctcac

SEQ ID NO: 650525 - DNA, 25 bp, Rattus norvegicus
tgcgagttgccgctcactcatcctg

SEQ ID NO: 650526 - DNA, 25 bp, Rattus norvegicus
ctccgtgaggtgttctcgtggttac

SEQ ID NO: 650527 - DNA, 25 bp, Rattus norvegicus
acaaccattagagagctggggccgg

SEQ ID NO: 650528 - DNA, 25 bp, Rattus norvegicus
tagagctcagctctggccctggcag

SEQ ID NO: 650529 - DNA, 25 bp, Rattus norvegicus
acatggcgcggaagccgagaagccc

SEQ ID NO: 650530 - DNA, 25 bp, Rattus norvegicus
gggctagagactggctggacaacca

SEQ ID NO: 650531 - DNA, 25 bp, Rattus norvegicus
tcccaggacgccaagcggtcgggtc

SEQ ID NO: 650532 - DNA, 25 bp, Rattus norvegicus
acgacggactttgggctaagtgcgc

SEQ ID NO: 650533 - DNA, 25 bp, Rattus norvegicus
acgcgccgccgtggtctatataaag

SEQ ID NO: 650534 - DNA, 25 bp, Rattus norvegicus
gtctatataaagaaggttcgctccc

SEQ ID NO: 650535 - DNA, 25 bp, Rattus norvegicus
cgagatagggcggaggccactcacc

SEQ ID NO: 650536 - DNA, 25 bp, Rattus norvegicus
tcctgagtctccgtgaggtgttctc

SEQ ID NO: 650537 - DNA, 25 bp, Rattus norvegicus
tcctcggcagggctagagctcagct

SEQ ID NO: 650538 - DNA, 25 bp, Rattus norvegicus
tttcgtcctttgattcctgagtctc

SEQ ID NO: 650539 - DNA, 25 bp, Rattus norvegicus
tcgtgagtgccaagcgcgacatggc

SEQ ID NO: 650540 - DNA, 25 bp, Rattus norvegicus
cctcgttcatctgctccttcttttg

SEQ ID NO: 650541 - DNA, 25 bp, Rattus norvegicus
tcgtcgcacacctggagcagggagt

SEQ ID NO: 650542 - DNA, 25 bp, Rattus norvegicus
ccttcttttggtgatagcgggcctg

SEQ ID NO: 650543 - DNA, 25 bp, Rattus norvegicus
ctccaggtagatctcatcgatgccc

SEQ ID NO: 650544 - DNA, 25 bp, Rattus norvegicus
cccagtagtccagctcctggctgaa

SEQ ID NO: 650545 - DNA, 25 bp, Rattus norvegicus
ctccatcatgtgcagccggccggtg

SEQ ID NO: 650546 - DNA, 25 bp, Rattus norvegicus
aattgagaatggaggtaaaggcgcc

SEQ ID NO: 650547 - DNA, 25 bp, Rattus norvegicus
tcctcaaggctgtagtcgtcgcaca

SEQ ID NO: 650548 - DNA, 25 bp, Rattus norvegicus
gttgcagtcccgaagcttgcccagc

SEQ ID NO: 650549 - DNA, 25 bp, Rattus norvegicus
agagtgcgccacagcacctcgtgcg

SEQ ID NO: 650550 - DNA, 25 bp, Rattus norvegicus
gagcacgccttgctgcgcacgatct

SEQ ID NO: 650551 - DNA, 25 bp, Rattus norvegicus
tggagcgcgagccatgcttcgtcat

SEQ ID NO: 650552 - DNA, 25 bp, Rattus norvegicus
ctggcagcaggactccaggtagatc

SEQ ID NO: 650553 - DNA, 25 bp, Rattus norvegicus
gaagtactcgttgtcctcaaggctg

SEQ ID NO: 650554 - DNA, 25 bp, Rattus norvegicus
acaagtcgggctgagcttcggctcc

SEQ ID NO: 650555 - DNA, 25 bp, Rattus norvegicus
gcgcctactgcatgcaggcgctgca

SEQ ID NO: 650556 - DNA, 25 bp, Rattus norvegicus
cccacccgggctgctcgtctgggtc

SEQ ID NO: 650557 - DNA, 25 bp, Rattus norvegicus
ctactgcatgcaggcgctgcacgta

SEQ ID NO: 650558 - DNA, 25 bp, Rattus norvegicus
tgggtcccggccaccacgaggctga

SEQ ID NO: 650559 - DNA, 25 bp, Rattus norvegicus
ccaccacgaggctgagcgcctactg

SEQ ID NO: 650560 - DNA, 25 bp, Rattus norvegicus
gccgcggctgcctgcgcgagatcaa

SEQ ID NO: 650561 - DNA, 25 bp, Rattus norvegicus
cgccacctgcgggtcggaaacgcgc

SEQ ID NO: 650562 - DNA, 25 bp, Rattus norvegicus
tcccgcacttcggagcgcggcgagt

SEQ ID NO: 650563 - DNA, 25 bp, Rattus norvegicus
attctgtcccgcacttcggagcgcg

SEQ ID NO: 650564 - DNA, 25 bp, Rattus norvegicus
cgcgctcgccgcgattctgtcccgc

SEQ ID NO: 650565 - DNA, 25 bp, Rattus norvegicus
agatcaacaagtcgggctgagcttc

SEQ ID NO: 650566 - DNA, 25 bp, Rattus norvegicus
tgcgcgagatcaacaagtcgggctg

SEQ ID NO: 650567 - DNA, 25 bp, Rattus norvegicus
ctgcctgcgcgagatcaacaagtcg

SEQ ID NO: 650568 - DNA, 25 bp, Rattus norvegicus
ccgtgtggaagcgagacgaatcaga

SEQ ID NO: 650569 - DNA, 25 bp, Rattus norvegicus
cgcatatgtacatccggcgggtgtg

SEQ ID NO: 650570 - DNA, 25 bp, Rattus norvegicus
accctgtcccgcagaggcgcaagaa

SEQ ID NO: 650571 - DNA, 25 bp, Rattus norvegicus
agggaaactccgtacagcgctccca

SEQ ID NO: 650572 - DNA, 25 bp, Rattus norvegicus
cgggctcatgggtcacgaataaata

SEQ ID NO: 650573 - DNA, 25 bp, Rattus norvegicus
ttcacggacacggtcacgggctcat

SEQ ID NO: 650574 - DNA, 25 bp, Rattus norvegicus
ggcacaggccacagactcactgatt

SEQ ID NO: 650575 - DNA, 25 bp, Rattus norvegicus
gaacccaagagatctggctgtcctg

SEQ ID NO: 650576 - DNA, 25 bp, Rattus norvegicus
cgcctggtcatttgtaagaagttta

SEQ ID NO: 650577 - DNA, 25 bp, Rattus norvegicus
cgagagatgccggaagttatttatg

SEQ ID NO: 650578 - DNA, 25 bp, Rattus norvegicus
ggggagacaaaactacttcttgcga

SEQ ID NO: 650579 - DNA, 25 bp, Rattus norvegicus
catgactacagcacccaggaattgg

SEQ ID NO: 650580 - DNA, 25 bp, Rattus norvegicus
ggggtagcctcagtgaatttctttc

SEQ ID NO: 650581 - DNA, 25 bp, Rattus norvegicus
gtccagccgaggtctcctaaacatg

SEQ ID NO: 650582 - DNA, 25 bp, Rattus norvegicus
tagtaccaactctgtcccggtccca

SEQ ID NO: 650583 - DNA, 25 bp, Rattus norvegicus
tctaggagtctaggacatgggacac

SEQ ID NO: 650584 - DNA, 25 bp, Rattus norvegicus
agccaccgttaagtctaggagtcta

SEQ ID NO: 650585 - DNA, 25 bp, Rattus norvegicus
cgggatcgagccaccgttaagtcta

SEQ ID NO: 650586 - DNA, 25 bp, Rattus norvegicus
cacccgggatcgagccaccgttaag

SEQ ID NO: 650587 - DNA, 25 bp, Rattus norvegicus
aaccgcaggatcctcagctcagcca

SEQ ID NO: 650588 - DNA, 25 bp, Rattus norvegicus
cccggtcccacactgccgaccctca

SEQ ID NO: 650589 - DNA, 25 bp, Rattus norvegicus
caccctggcgggtcccggagatact

SEQ ID NO: 650590 - DNA, 25 bp, Rattus norvegicus
gggtcccggagatactcaccgcgcg

SEQ ID NO: 650591 - DNA, 25 bp, Rattus norvegicus
acagtaataacacggccagaaggcc

SEQ ID NO: 650592 - DNA, 25 bp, Rattus norvegicus
gccgggtggcaacaggtcaccgcca

SEQ ID NO: 650593 - DNA, 25 bp, Rattus norvegicus
ccgccaccaacaccgaaccgcagga

SEQ ID NO: 650594 - DNA, 25 bp, Rattus norvegicus
aggctgcagaatgggtagtaccaac

SEQ ID NO: 650595 - DNA, 25 bp, Rattus norvegicus
tcagtttcacctggcgtcctttccg

SEQ ID NO: 650596 - DNA, 25 bp, Rattus norvegicus
accgggcttgagatctgatggagaa

SEQ ID NO: 650597 - DNA, 25 bp, Rattus norvegicus
tagccgcaagatcctcgagcggccg

SEQ ID NO: 650598 - DNA, 25 bp, Rattus norvegicus
cgccgcccatgctggcaggaagcgt

SEQ ID NO: 650599 - DNA, 25 bp, Rattus norvegicus
ggcaggaagcgtctcgctagtacta

SEQ ID NO: 650600 - DNA, 25 bp, Rattus norvegicus
tcgctagtactagttggttcccgtg

SEQ ID NO: 650601 - DNA, 25 bp, Rattus norvegicus
tactagttggttcccgtgcgagcac

SEQ ID NO: 650602 - DNA, 25 bp, Rattus norvegicus
cggacaatgtgtgagtagccagtta

SEQ ID NO: 650603 - DNA, 25 bp, Rattus norvegicus
agtagccagttagcgggccgcttca

SEQ ID NO: 650604 - DNA, 25 bp, Rattus norvegicus
ctgaccaagcctgaaacctgacggg

SEQ ID NO: 650605 - DNA, 25 bp, Rattus norvegicus
ctacaggctggggaagcacatctct

SEQ ID NO: 650606 - DNA, 25 bp, Rattus norvegicus
agcctgagaagcacaccggccggga

SEQ ID NO: 650607 - DNA, 25 bp, Rattus norvegicus
acgaagtagagcagcgaggacgaca

SEQ ID NO: 650608 - DNA, 25 bp, Rattus norvegicus
ccgggcgccacatagacgaagtaga

SEQ ID NO: 650609 - DNA, 25 bp, Rattus norvegicus
gggccgcgagcataacaagcatttt

SEQ ID NO: 650610 - DNA, 25 bp, Rattus norvegicus
ggcctggccggaaaaagcctacaga

SEQ ID NO: 650611 - DNA, 25 bp, Rattus norvegicus
atccaattctccagccaccaaaagg

SEQ ID NO: 650612 - DNA, 25 bp, Rattus norvegicus
aaaaagtcgtactgtcctgagggca

SEQ ID NO: 650613 - DNA, 25 bp, Rattus norvegicus
ctgtcctgagggcagatcgtcgcct

SEQ ID NO: 650614 - DNA, 25 bp, Rattus norvegicus
atatcgatcaccacgcacaggcctg

SEQ ID NO: 650615 - DNA, 25 bp, Rattus norvegicus
tcgtcgcctggcctggccggaaaaa

SEQ ID NO: 650616 - DNA, 25 bp, Rattus norvegicus
cgcacaggcctgtagtatacgtagc

SEQ ID NO: 650617 - DNA, 25 bp, Rattus norvegicus
atacgtagcctggaagccacgaacg

SEQ ID NO: 650618 - DNA, 25 bp, Rattus norvegicus
cccggaggtctgatatcgatcacca

SEQ ID NO: 650619 - DNA, 25 bp, Rattus norvegicus
ggcctcccggaggtctgatatcgat

SEQ ID NO: 650620 - DNA, 25 bp, Rattus norvegicus
tagtctccgaagctcgcaggactgg

SEQ ID NO: 650621 - DNA, 25 bp, Rattus norvegicus
gcgccgaactctatagtctccgaag

SEQ ID NO: 650622 - DNA, 25 bp, Rattus norvegicus
tgcggcgccgaactctatagtctcc

SEQ ID NO: 650623 - DNA, 25 bp, Rattus norvegicus
cctgtagtatacgtagcctggaagc

SEQ ID NO: 650624 - DNA, 25 bp, Rattus norvegicus
cctctcggcagggaatgtaaacctg

SEQ ID NO: 650625 - DNA, 25 bp, Rattus norvegicus
caaggattctgaggcagagcgactc

SEQ ID NO: 650626 - DNA, 25 bp, Rattus norvegicus
atgtaaacctgtggcggctactccc

SEQ ID NO: 650627 - DNA, 25 bp, Rattus norvegicus
cagggcatcgcacacactgggcaag

SEQ ID NO: 650628 - DNA, 25 bp, Rattus norvegicus
tctgccaatgaaataccgggacctg

SEQ ID NO: 650629 - DNA, 25 bp, Rattus norvegicus
gacctgtcgttagatacctgctgca

SEQ ID NO: 650630 - DNA, 25 bp, Rattus norvegicus
accgtgcaacaaccgtgtcctcttt

SEQ ID NO: 650631 - DNA, 25 bp, Rattus norvegicus
gccaaggtcactcggtgagtccaaa

SEQ ID NO: 650632 - DNA, 25 bp, Rattus norvegicus
aaagcgagcgcctccaaagcacggg

SEQ ID NO: 650633 - DNA, 25 bp, Rattus norvegicus
ccgccggctccaagaaccgagaata

SEQ ID NO: 650634 - DNA, 25 bp, Rattus norvegicus
gtgcttctccgcgaaaccgaacttc

SEQ ID NO: 650635 - DNA, 25 bp, Rattus norvegicus
gaacttcactcctagggcccgtcga

SEQ ID NO: 650636 - DNA, 25 bp, Rattus norvegicus
gcagagcctctctcgcttccgaagg

SEQ ID NO: 650637 - DNA, 25 bp, Rattus norvegicus
atagtaccggagacagcctcagccc

SEQ ID NO: 650638 - DNA, 25 bp, Rattus norvegicus
ctgggctagcctggaacaaaaggga

SEQ ID NO: 650639 - DNA, 25 bp, Rattus norvegicus
gcgaagccggcgtccgaaactgacc

SEQ ID NO: 650640 - DNA, 25 bp, Rattus norvegicus
gtgactggggatgcccgaccacctt

SEQ ID NO: 650641 - DNA, 25 bp, Rattus norvegicus
tcagccgctttacgtgtcccgtgtg

SEQ ID NO: 650642 - DNA, 25 bp, Rattus norvegicus
cgcgacgctcctcagcggcaagatg

SEQ ID NO: 650643 - DNA, 25 bp, Rattus norvegicus
tgcctggaagtgttcgagaagcccg

SEQ ID NO: 650644 - DNA, 25 bp, Rattus norvegicus
gaaactgaccctctcagccgcttta

SEQ ID NO: 650645 - DNA, 25 bp, Rattus norvegicus
gcgtccttccctcggggtgaatgaa

SEQ ID NO: 650646 - DNA, 25 bp, Rattus norvegicus
tcggggtgaatgaagcccggtatta

SEQ ID NO: 650647 - DNA, 25 bp, Rattus norvegicus
cttccctaggtgctgtgaccgtgta

SEQ ID NO: 650648 - DNA, 25 bp, Rattus norvegicus
accgtgtagcgatatgtgaagtccg

SEQ ID NO: 650649 - DNA, 25 bp, Rattus norvegicus
gtgaagtccgttcttccacatttca

SEQ ID NO: 650650 - DNA, 25 bp, Rattus norvegicus
catttcaaacaccagtcagctgtga

SEQ ID NO: 650651 - DNA, 25 bp, Rattus norvegicus
accacctaggagtcggtcttcgtga

SEQ ID NO: 650652 - DNA, 25 bp, Rattus norvegicus
gctgacttctctgtccgatgaggac

SEQ ID NO: 650653 - DNA, 25 bp, Rattus norvegicus
gagaatcggctcagctgactccctg

SEQ ID NO: 650654 - DNA, 25 bp, Rattus norvegicus
aggctctgcgagtgaagacccgaag

SEQ ID NO: 650655 - DNA, 25 bp, Rattus norvegicus
tctggagctccaggtcttggcagtt

SEQ ID NO: 650656 - DNA, 25 bp, Rattus norvegicus
agcccaactatagcgagctgcagga

SEQ ID NO: 650657 - DNA, 25 bp, Rattus norvegicus
ctcatctgggactctctcctggtgc

SEQ ID NO: 650658 - DNA, 25 bp, Rattus norvegicus
gagttgtctaccgaccttgcgcgac

SEQ ID NO: 650659 - DNA, 25 bp, Rattus norvegicus
cccagctctggtacttaaaggaatt

SEQ ID NO: 650660 - DNA, 25 bp, Rattus norvegicus
gcaatcttgacaaaggggcgtgatc

SEQ ID NO: 650661 - DNA, 25 bp, Rattus norvegicus
agaggagcccaagcccaatctcagc

SEQ ID NO: 650662 - DNA, 25 bp, Rattus norvegicus
ccgatgaggacagtggcaaaagctc

SEQ ID NO: 650663 - DNA, 25 bp, Rattus norvegicus
ttcctggtcaggaagccgtccgacc

SEQ ID NO: 650664 - DNA, 25 bp, Rattus norvegicus
gccgtcagctattggcgcaatcttg

SEQ ID NO: 650665 - DNA, 25 bp, Rattus norvegicus
ggcctcgcgagcagagttgtctacc

SEQ ID NO: 650666 - DNA, 25 bp, Rattus norvegicus
ctcgcacacaggatcgggaggccca

SEQ ID NO: 650667 - DNA, 25 bp, Rattus norvegicus
tgcgttcgtgtgagactaggtgtct

SEQ ID NO: 650668 - DNA, 25 bp, Rattus norvegicus
gccgcaatcgcgcagctaatttagt

SEQ ID NO: 650669 - DNA, 25 bp, Rattus norvegicus
aggcccaggcgcttggtccaaagcg

SEQ ID NO: 650670 - DNA, 25 bp, Rattus norvegicus
ctaatttagtcgttcccagcgggcg

SEQ ID NO: 650671 - DNA, 25 bp, Rattus norvegicus
aagaacggcgtctcaactcggcggt

SEQ ID NO: 650672 - DNA, 25 bp, Rattus norvegicus
acgccttgtccagcgcgggaaagaa

SEQ ID NO: 650673 - DNA, 25 bp, Rattus norvegicus
agctgctgctgccatcaacctgagg

SEQ ID NO: 650674 - DNA, 25 bp, Rattus norvegicus
ttcaggccagcgagttccggccgct

SEQ ID NO: 650675 - DNA, 25 bp, Rattus norvegicus
aggtgctcacgatgcgactcctctg

SEQ ID NO: 650676 - DNA, 25 bp, Rattus norvegicus
ccgccctgccggactgaatttagag

SEQ ID NO: 650677 - DNA, 25 bp, Rattus norvegicus
gtccggccaaatatagacaccaagt

SEQ ID NO: 650678 - DNA, 25 bp, Rattus norvegicus
agactaggtgtctcctcgccagccg

SEQ ID NO: 650679 - DNA, 25 bp, Rattus norvegicus
agccaccgcgcgagatcaggtgcct

SEQ ID NO: 650680 - DNA, 25 bp, Rattus norvegicus
aggccgatcgatgcagggctcgcta

SEQ ID NO: 650681 - DNA, 25 bp, Rattus norvegicus
atgacgacgacagaaggacccacgg

SEQ ID NO: 650682 - DNA, 25 bp, Rattus norvegicus
gcactgacggcgatcctgcgtgcct

SEQ ID NO: 650683 - DNA, 25 bp, Rattus norvegicus
gggagagcccaaggcagcagctccc

SEQ ID NO: 650684 - DNA, 25 bp, Rattus norvegicus
atcaaaagcggctgtgaggaggccc

SEQ ID NO: 650685 - DNA, 25 bp, Rattus norvegicus
cgcacagaggggctttatcaaaagc

SEQ ID NO: 650686 - DNA, 25 bp, Rattus norvegicus
cccacgcacagaggggctttatcaa

SEQ ID NO: 650687 - DNA, 25 bp, Rattus norvegicus
tctgctggcctccagatgtgctctg

SEQ ID NO: 650688 - DNA, 25 bp, Rattus norvegicus
cgggtccgagaagaaaggcagcctt

SEQ ID NO: 650689 - DNA, 25 bp, Rattus norvegicus
ccctgtgcccgagaggaatgttcgc

SEQ ID NO: 650690 - DNA, 25 bp, Rattus norvegicus
tgagcggcctgttctgccctgtgcc

SEQ ID NO: 650691 - DNA, 25 bp, Rattus norvegicus
atttcagccagccttggggtgagcg

SEQ ID NO: 650692 - DNA, 25 bp, Rattus norvegicus
gcccaggcttcggatttcagccagc

SEQ ID NO: 650693 - DNA, 25 bp, Rattus norvegicus
cgatgcagggctcgctaggctgccc

SEQ ID NO: 650694 - DNA, 25 bp, Rattus norvegicus
agcacgagggcggagtaacctgcaa

SEQ ID NO: 650695 - DNA, 25 bp, Rattus norvegicus
agaagctttcccaacggcgacacgg

SEQ ID NO: 650696 - DNA, 25 bp, Rattus norvegicus
acagaccagggcttccgaggcacct

SEQ ID NO: 650697 - DNA, 25 bp, Rattus norvegicus
ctctcagcgcgccttctgaaatcta

SEQ ID NO: 650698 - DNA, 25 bp, Rattus norvegicus
tctgaaatctatccctggtctctgc

SEQ ID NO: 650699 - DNA, 25 bp, Rattus norvegicus
gggaagcgaccaccatgatgctctc

SEQ ID NO: 650700 - DNA, 25 bp, Rattus norvegicus
tgctccctagggttgcgcccgcgtt

SEQ ID NO: 650701 - DNA, 25 bp, Rattus norvegicus
agtcgctcaggccagctcccagtgg

SEQ ID NO: 650702 - DNA, 25 bp, Rattus norvegicus
ggccgctcagtgaaacgcagccact

SEQ ID NO: 650703 - DNA, 25 bp, Rattus norvegicus
ggccaagccagtatggcctccgcta

SEQ ID NO: 650704 - DNA, 25 bp, Rattus norvegicus
agcctgtggtggctgccatcttgcg

SEQ ID NO: 650705 - DNA, 25 bp, Rattus norvegicus
catcttgcgtcgctgtcgctcgaag

SEQ ID NO: 650706 - DNA, 25 bp, Rattus norvegicus
tgaaacgcagccactggcagagcgc

SEQ ID NO: 650707 - DNA, 25 bp, Rattus norvegicus
tgcccgagtcttcagtgagcgagca

SEQ ID NO: 650708 - DNA, 25 bp, Rattus norvegicus
agcacgcgcctgtgcaatagtctgc

SEQ ID NO: 650709 - DNA, 25 bp, Rattus norvegicus
gccttgactttggtgcgtaccgcga

SEQ ID NO: 650710 - DNA, 25 bp, Rattus norvegicus
ctgcgccttgactttggtgcgtacc

SEQ ID NO: 650711 - DNA, 25 bp, Rattus norvegicus
atagtctgcgccttgactttggtgc

SEQ ID NO: 650712 - DNA, 25 bp, Rattus norvegicus
atgcagctggacacggaagacagac

SEQ ID NO: 650713 - DNA, 25 bp, Rattus norvegicus
gcctgtgcaatagtctgcgccttga

SEQ ID NO: 650714 - DNA, 25 bp, Rattus norvegicus
tgactttggtgcgtaccgcgaagcg

SEQ ID NO: 650715 - DNA, 25 bp, Rattus norvegicus
ctttggtgcgtaccgcgaagcgcgt

SEQ ID NO: 650716 - DNA, 25 bp, Rattus norvegicus
aggagcacgcgcctgtgcaatagtc

SEQ ID NO: 650717 - DNA, 25 bp, Rattus norvegicus
agccgaggagcacgcgcctgtgcaa

SEQ ID NO: 650718 - DNA, 25 bp, Rattus norvegicus
cagctggatgcagctggacacggaa

SEQ ID NO: 650719 - DNA, 25 bp, Rattus norvegicus
acagacagggtggatgtgcgcgtcc

SEQ ID NO: 650720 - DNA, 25 bp, Rattus norvegicus
cagctggacacggaagacagacagg

SEQ ID NO: 650721 - DNA, 25 bp, Rattus norvegicus
gtgcaatagtctgcgccttgacttt

SEQ ID NO: 650722 - DNA, 25 bp, Rattus norvegicus
acctggagacgcagcacaaggtgct

SEQ ID NO: 650723 - DNA, 25 bp, Rattus norvegicus
ctgagcgacgagtacaagatgcggc

SEQ ID NO: 650724 - DNA, 25 bp, Rattus norvegicus
cgccgcctttagacccatggaagtg

SEQ ID NO: 650725 - DNA, 25 bp, Rattus norvegicus
ggccaagatgcgcaacctggagacg

SEQ ID NO: 650726 - DNA, 25 bp, Rattus norvegicus
gatgcggcgcgagcgcaacaacatc

SEQ ID NO: 650727 - DNA, 25 bp, Rattus norvegicus
ccaaggccaagaaggcggtggacaa

SEQ ID NO: 650728 - DNA, 25 bp, Rattus norvegicus
ggcagcctgtccacgtcgtcgtcgt

SEQ ID NO: 650729 - DNA, 25 bp, Rattus norvegicus
tacctgggctaccaggcgacgccga

SEQ ID NO: 650730 - DNA, 25 bp, Rattus norvegicus
ttcgaacccgcggactgcaagcgcg

SEQ ID NO: 650731 - DNA, 25 bp, Rattus norvegicus
gtccgactacggttacgtgagcctc

SEQ ID NO: 650732 - DNA, 25 bp, Rattus norvegicus
agccgagcaagaagccgtccgacta

SEQ ID NO: 650733 - DNA, 25 bp, Rattus norvegicus
cgactgcctggcctacggggccaag

SEQ ID NO: 650734 - DNA, 25 bp, Rattus norvegicus
aagtggccaacttctactacgagcc

SEQ ID NO: 650735 - DNA, 25 bp, Rattus norvegicus
cgcaagagccgcgacaaggccaaga

SEQ ID NO: 650736 - DNA, 25 bp, Rattus norvegicus
ttgacctgcgtgtcggtgaggttca

SEQ ID NO: 650737 - DNA, 25 bp, Rattus norvegicus
gactgtcccgagagctggagatttc

SEQ ID NO: 650738 - DNA, 25 bp, Rattus norvegicus
tcccgagagctggagatttcgcggt

SEQ ID NO: 650739 - DNA, 25 bp, Rattus norvegicus
tttgcgtggctttttcaggcgcacg

SEQ ID NO: 650740 - DNA, 25 bp, Rattus norvegicus
tgcgtgctttgcgtggctttttcag

SEQ ID NO: 650741 - DNA, 25 bp, Rattus norvegicus
ccagctgcgccagctgatggtcggt

SEQ ID NO: 650742 - DNA, 25 bp, Rattus norvegicus
tacgctccagctgcgccagctgatg

SEQ ID NO: 650743 - DNA, 25 bp, Rattus norvegicus
atttctgccgctcgaagctacgctc

SEQ ID NO: 650744 - DNA, 25 bp, Rattus norvegicus
ctcaggtatttctgccgctcgaagc

SEQ ID NO: 650745 - DNA, 25 bp, Rattus norvegicus
tttttcaggcgcacgggaggactgt

SEQ ID NO: 650746 - DNA, 25 bp, Rattus norvegicus
ggccagctccatgcggtcttgcaca

SEQ ID NO: 650747 - DNA, 25 bp, Rattus norvegicus
acctgcggttctggtaccaggtctt

SEQ ID NO: 650748 - DNA, 25 bp, Rattus norvegicus
ccaaagcgaaacctcacctgcggtt

SEQ ID NO: 650749 - DNA, 25 bp, Rattus norvegicus
gcggtcttgcacactcaggtatttc

SEQ ID NO: 650750 - DNA, 25 bp, Rattus norvegicus
tccggctcaggccttttccactaag

SEQ ID NO: 650751 - DNA, 25 bp, Rattus norvegicus
tcgacgcctgactcaaacggctggc

SEQ ID NO: 650752 - DNA, 25 bp, Rattus norvegicus
ctcggggctcgaaatcaagatacgc

SEQ ID NO: 650753 - DNA, 25 bp, Rattus norvegicus
ggaagtgccggcaagcctcttcgct

SEQ ID NO: 650754 - DNA, 25 bp, Rattus norvegicus
agcctcttcgctttctgactggtcc

SEQ ID NO: 650755 - DNA, 25 bp, Rattus norvegicus
tttctgactggtcctccggtgcaga

SEQ ID NO: 650756 - DNA, 25 bp, Rattus norvegicus
cgtacttccggctgccggcttgaca

SEQ ID NO: 650757 - DNA, 25 bp, Rattus norvegicus
gcttgacatgcagaagccgctgctg

SEQ ID NO: 650758 - DNA, 25 bp, Rattus norvegicus
ccgtcccgccatggaaatggagaag

SEQ ID NO: 650759 - DNA, 25 bp, Rattus norvegicus
aatggagaaggaattcgagcagatc

SEQ ID NO: 650760 - DNA, 25 bp, Rattus norvegicus
cgagcagatcgataaggctgggaac

SEQ ID NO: 650761 - DNA, 25 bp, Rattus norvegicus
aactgggcggctatttaccaggtgc

SEQ ID NO: 650762 - DNA, 25 bp, Rattus norvegicus
gccaatatctcaccgcggtccgtgt

SEQ ID NO: 650763 - DNA, 25 bp, Rattus norvegicus
tgactcaaacggctggctcggggct

SEQ ID NO: 650764 - DNA, 25 bp, Rattus norvegicus
agtcctctgaccaccgcggatgctg

SEQ ID NO: 650765 - DNA, 25 bp, Rattus norvegicus
tcactcgggattagatgcctgcctg

SEQ ID NO: 650766 - DNA, 25 bp, Rattus norvegicus
ggggacgcctgcaagtttctgttta

SEQ ID NO: 650767 - DNA, 25 bp, Rattus norvegicus
agtttctgtttactgcgctgcgcgg

SEQ ID NO: 650768 - DNA, 25 bp, Rattus norvegicus
cggctaatcactcgcaggcagggtc

SEQ ID NO: 650769 - DNA, 25 bp, Rattus norvegicus
gacgactcggattaatcactcggga

SEQ ID NO: 650770 - DNA, 25 bp, Rattus norvegicus
tggacctccgggaccgagctgcgct

SEQ ID NO: 650771 - DNA, 25 bp, Rattus norvegicus
gttctgggaatgcactcggtggccc

SEQ ID NO: 650772 - DNA, 25 bp, Rattus norvegicus
cccggctctggcctctgagatagag

SEQ ID NO: 650773 - DNA, 25 bp, Rattus norvegicus
gatagagcttatctgacgggtgtca

SEQ ID NO: 650774 - DNA, 25 bp, Rattus norvegicus
gtgtcactgcgctgctcggacactc

SEQ ID NO: 650775 - DNA, 25 bp, Rattus norvegicus
ccgtagctgcaggaggccacttcct

SEQ ID NO: 650776 - DNA, 25 bp, Rattus norvegicus
atctcggctgattccaagtccacgc

SEQ ID NO: 650777 - DNA, 25 bp, Rattus norvegicus
attccaagtccacgcaaggctcttg

SEQ ID NO: 650778 - DNA, 25 bp, Rattus norvegicus
caacgcagggccaatcgctaggctg

SEQ ID NO: 650779 - DNA, 25 bp, Rattus norvegicus
acgtcatcacaagggaacggccgta

SEQ ID NO: 650780 - DNA, 25 bp, Rattus norvegicus
ttctcggggcggaaactctacagcc

SEQ ID NO: 650781 - DNA, 25 bp, Rattus norvegicus
cggaaactctacagccagcgcatgc

SEQ ID NO: 650782 - DNA, 25 bp, Rattus norvegicus
gaacggccgtacacacattccaagc

SEQ ID NO: 650783 - DNA, 25 bp, Rattus norvegicus
ggcgaaaacgctcgcgcgcatgcgc

SEQ ID NO: 650784 - DNA, 25 bp, Rattus norvegicus
cattccaagccggtgactagggcgc

SEQ ID NO: 650785 - DNA, 25 bp, Rattus norvegicus
gcccagagtttcaggtgatcccgcc

SEQ ID NO: 650786 - DNA, 25 bp, Rattus norvegicus
ttaatccggagaggcccagagtttc

SEQ ID NO: 650787 - DNA, 25 bp, Rattus norvegicus
gcggggctttccagacacgaggccc

SEQ ID NO: 650788 - DNA, 25 bp, Rattus norvegicus
gtgggattgtgctccgccctctctt

SEQ ID NO: 650789 - DNA, 25 bp, Rattus norvegicus
cggaccttagcaggtgccgtgacga

SEQ ID NO: 650790 - DNA, 25 bp, Rattus norvegicus
gcgctcagcatgaaccgtggccaca

SEQ ID NO: 650791 - DNA, 25 bp, Rattus norvegicus
ggcgcgttaaagatacgggtgctcc

SEQ ID NO: 650792 - DNA, 25 bp, Rattus norvegicus
gactacagcgcctttggcacggaca

SEQ ID NO: 650793 - DNA, 25 bp, Rattus norvegicus
cgtcatcagcatgccgcaggacttc

SEQ ID NO: 650794 - DNA, 25 bp, Rattus norvegicus
gaagccgcacatcgtcatcagcatg

SEQ ID NO: 650795 - DNA, 25 bp, Rattus norvegicus
caaccacaggaagaagccgcacatc

SEQ ID NO: 650796 - DNA, 25 bp, Rattus norvegicus
gcctttggcacggacaccctgatca

SEQ ID NO: 650797 - DNA, 25 bp, Rattus norvegicus
gaagaagccgactacagcgcctttg

SEQ ID NO: 650798 - DNA, 25 bp, Rattus norvegicus
ccaagcagaagaagccgactacagc

SEQ ID NO: 650799 - DNA, 25 bp, Rattus norvegicus
gcgtttgttttctccaagcagaaga

SEQ ID NO: 650800 - DNA, 25 bp, Rattus norvegicus
tggtgggtctgtaaccgtcctgcgt

SEQ ID NO: 650801 - DNA, 25 bp, Rattus norvegicus
catgtttcttggtgggtctgtaacc

SEQ ID NO: 650802 - DNA, 25 bp, Rattus norvegicus
tcagctgcgggcaggcatgtttctt

SEQ ID NO: 650803 - DNA, 25 bp, Rattus norvegicus
tgatcttaggcgctgtctgccgggt

SEQ ID NO: 650804 - DNA, 25 bp, Rattus norvegicus
aggctgatcttaggcgctgtctgcc

SEQ ID NO: 650805 - DNA, 25 bp, Rattus norvegicus
ccctgatcaggaagaagaacgtgct

SEQ ID NO: 650806 - DNA, 25 bp, Rattus norvegicus
acaacgtggtgcgtaacagtcggac

SEQ ID NO: 650807 - DNA, 25 bp, Rattus norvegicus
cggcccgtgtcatccatcatcgatg

SEQ ID NO: 650808 - DNA, 25 bp, Rattus norvegicus
cgatgtggacatcctcccggagacg

SEQ ID NO: 650809 - DNA, 25 bp, Rattus norvegicus
ccgcagggtccgtctgtacaagtac

SEQ ID NO: 650810 - DNA, 25 bp, Rattus norvegicus
gtacaagtacggcacagagaagccc

SEQ ID NO: 650811 - DNA, 25 bp, Rattus norvegicus
tctacatccgggacggctccagcgt

SEQ ID NO: 650812 - DNA, 25 bp, Rattus norvegicus
tccagcgtccgtgtgacgccgcatg

SEQ ID NO: 650813 - DNA, 25 bp, Rattus norvegicus
acgccgcatggtttagagaaagttc

SEQ ID NO: 650814 - DNA, 25 bp, Rattus norvegicus
cgggatcttcatctccaggctcgtc

SEQ ID NO: 650815 - DNA, 25 bp, Rattus norvegicus
gctggctgtcaatgacgaagttcta

SEQ ID NO: 650816 - DNA, 25 bp, Rattus norvegicus
gtatagaagtgtcaggcaagagcct

SEQ ID NO: 650817 - DNA, 25 bp, Rattus norvegicus
agcctggaccaggtgactgacatga

SEQ ID NO: 650818 - DNA, 25 bp, Rattus norvegicus
gccggccaaccagaggaacaacgtg

SEQ ID NO: 650819 - DNA, 25 bp, Rattus norvegicus
tcatcatcacggtgcggccggccaa

SEQ ID NO: 650820 - DNA, 25 bp, Rattus norvegicus
aggacacgagcctggtggctgtccc

SEQ ID NO: 650821 - DNA, 25 bp, Rattus norvegicus
cggaacaatcataacgttgtgagtc

SEQ ID NO: 650822 - DNA, 25 bp, Rattus norvegicus
aggccctgagcctggagtccctgac

SEQ ID NO: 650823 - DNA, 25 bp, Rattus norvegicus
tggagtccctgacgcagatcgagct

SEQ ID NO: 650824 - DNA, 25 bp, Rattus norvegicus
cctgacgcagatcgagctcagcttc

SEQ ID NO: 650825 - DNA, 25 bp, Rattus norvegicus
cgcagatcgagctcagcttcgagtc

SEQ ID NO: 650826 - DNA, 25 bp, Rattus norvegicus
gctcagcttcgagtcggggcagaat

SEQ ID NO: 650827 - DNA, 25 bp, Rattus norvegicus
ggcagaatgggttctcccctctcca

SEQ ID NO: 650828 - DNA, 25 bp, Rattus norvegicus
cctctccaggacacgagcctggtgg

SEQ ID NO: 650829 - DNA, 25 bp, Rattus norvegicus
agcagcctggacaccgagtcggaaa

SEQ ID NO: 650830 - DNA, 25 bp, Rattus norvegicus
gccgagctccggatcagaaactctt

SEQ ID NO: 650831 - DNA, 25 bp, Rattus norvegicus
gctccggatcagaaactcttagagg

SEQ ID NO: 650832 - DNA, 25 bp, Rattus norvegicus
acaccgagtcggaaagccgagctcc

SEQ ID NO: 650833 - DNA, 25 bp, Rattus norvegicus
ctcttagaggaagacggaacaatca

SEQ ID NO: 650834 - DNA, 25 bp, Rattus norvegicus
ttcccaggccttggcactcaggctg

SEQ ID NO: 650835 - DNA, 25 bp, Rattus norvegicus
ccacactaaggacgagaatgccctg

SEQ ID NO: 650836 - DNA, 25 bp, Rattus norvegicus
gcttctgtcactgcggctccgcttt

SEQ ID NO: 650837 - DNA, 25 bp, Rattus norvegicus
ggcggcagctcccaagcttctgtca

SEQ ID NO: 650838 - DNA, 25 bp, Rattus norvegicus
tagatggctttggtcacggtccagc

SEQ ID NO: 650839 - DNA, 25 bp, Rattus norvegicus
acccagcagcacctagatggctttg

SEQ ID NO: 650840 - DNA, 25 bp, Rattus norvegicus
acgagaatgccctgcccggaacaac

SEQ ID NO: 650841 - DNA, 25 bp, Rattus norvegicus
gagccagaggccgttcccgcggctt

SEQ ID NO: 650842 - DNA, 25 bp, Rattus norvegicus
cctgcgcactgggagcgctcattgt

SEQ ID NO: 650843 - DNA, 25 bp, Rattus norvegicus
ttgctgacaggtggcgcctgcgcac

SEQ ID NO: 650844 - DNA, 25 bp, Rattus norvegicus
ggcaactcaagggttacgccgccgc

SEQ ID NO: 650845 - DNA, 25 bp, Rattus norvegicus
ggcaacaggcctcgagggctgaccc

SEQ ID NO: 650846 - DNA, 25 bp, Rattus norvegicus
tcgctcagccggaacagaccgagca

SEQ ID NO: 650847 - DNA, 25 bp, Rattus norvegicus
agaccgagcatcagcggcaacaggc

SEQ ID NO: 650848 - DNA, 25 bp, Rattus norvegicus
gacctcaacttcaccgcgccatcaa

SEQ ID NO: 650849 - DNA, 25 bp, Rattus norvegicus
atcagtttgagtcggagagcaatgg

SEQ ID NO: 650850 - DNA, 25 bp, Rattus norvegicus
tcctggacgccgatcagtttgagtc

SEQ ID NO: 650851 - DNA, 25 bp, Rattus norvegicus
aggacatcctcctggacgccgatca

SEQ ID NO: 650852 - DNA, 25 bp, Rattus norvegicus
cgggccggaacaggacatcctcctg

SEQ ID NO: 650853 - DNA, 25 bp, Rattus norvegicus
gccaggcggacctccgggttacagc

SEQ ID NO: 650854 - DNA, 25 bp, Rattus norvegicus
gtccggtcctgcgaccgcacctgct

SEQ ID NO: 650855 - DNA, 25 bp, Rattus norvegicus
gagcgctcggtctgcgtccggtcct

SEQ ID NO: 650856 - DNA, 25 bp, Rattus norvegicus
gctgcagagcttgccgctgccactg

SEQ ID NO: 650857 - DNA, 25 bp, Rattus norvegicus
catccgagctttgcgcgttgcggcc

SEQ ID NO: 650858 - DNA, 25 bp, Rattus norvegicus
agcgcggtctccagcttggggatca

SEQ ID NO: 650859 - DNA, 25 bp, Rattus norvegicus
ggtctccagcttggggatcacggcc

SEQ ID NO: 650860 - DNA, 25 bp, Rattus norvegicus
gctctccctgactccagagtctgag

SEQ ID NO: 650861 - DNA, 25 bp, Rattus norvegicus
aatggggcacgcgagttcgcgctct

SEQ ID NO: 650862 - DNA, 25 bp, Rattus norvegicus
cccgtggaagccatgacgaatctgc

SEQ ID NO: 650863 - DNA, 25 bp, Rattus norvegicus
ccggaagcggacttacgtcacctga

SEQ ID NO: 650864 - DNA, 25 bp, Rattus norvegicus
caggtcgattgtgaaggcttcccaa

SEQ ID NO: 650865 - DNA, 25 bp, Rattus norvegicus
tttcactttcaagccctagggagcg

SEQ ID NO: 650866 - DNA, 25 bp, Rattus norvegicus
tagggagcgttttagtcttcgagtc

SEQ ID NO: 650867 - DNA, 25 bp, Rattus norvegicus
tctaagcgatgggaagccggaaacg

SEQ ID NO: 650868 - DNA, 25 bp, Rattus norvegicus
tcactcctcagatgtttccggaaga

SEQ ID NO: 650869 - DNA, 25 bp, Rattus norvegicus
ttccggaagacgctgtcatggctgc

SEQ ID NO: 650870 - DNA, 25 bp, Rattus norvegicus
cccggaggacgtagcagccttacaa

SEQ ID NO: 650871 - DNA, 25 bp, Rattus norvegicus
ttacaagatgagattgcccggcgtg

SEQ ID NO: 650872 - DNA, 25 bp, Rattus norvegicus
tcgcgggacgagatcctacgctata

SEQ ID NO: 650873 - DNA, 25 bp, Rattus norvegicus
acgagcaatctagcccgtcaggtgc

SEQ ID NO: 650874 - DNA, 25 bp, Rattus norvegicus
cccacgcgctacctggtgaacgatg

SEQ ID NO: 650875 - DNA, 25 bp, Rattus norvegicus
accgaatacttgtcctgccgtgagg

SEQ ID NO: 650876 - DNA, 25 bp, Rattus norvegicus
ctccggggtaccatgtctccgtagc

SEQ ID NO: 650877 - DNA, 25 bp, Rattus norvegicus
ccgtagcccacggttgtcatggtga

SEQ ID NO: 650878 - DNA, 25 bp, Rattus norvegicus
gtgatgacagcccaccagtagcagg

SEQ ID NO: 650879 - DNA, 25 bp, Rattus norvegicus
catctcattctcgatgacgtagagc

SEQ ID NO: 650880 - DNA, 25 bp, Rattus norvegicus
gcaaagagagcgatggccacacaca

SEQ ID NO: 650881 - DNA, 25 bp, Rattus norvegicus
agaagcccgaattcacgcgtgcagc

SEQ ID NO: 650882 - DNA, 25 bp, Rattus norvegicus
gcccaaccttgtccaggtagctgtt

SEQ ID NO: 650883 - DNA, 25 bp, Rattus norvegicus
ccagcagtgtgacgtagtaaggcag

SEQ ID NO: 650884 - DNA, 25 bp, Rattus norvegicus
atggccaccagatcgatgagggtca

SEQ ID NO: 650885 - DNA, 25 bp, Rattus norvegicus
ggctccgcaggaaggcgaacttgct

SEQ ID NO: 650886 - DNA, 25 bp, Rattus norvegicus
cgaacttgctgggtgcctggatgaa

SEQ ID NO: 650887 - DNA, 25 bp, Rattus norvegicus
ctggatgaaccgcagcaggaactca

SEQ ID NO: 650888 - DNA, 25 bp, Rattus norvegicus
gcacaccgactctacgatgaagacg

SEQ ID NO: 650889 - DNA, 25 bp, Rattus norvegicus
tcaagggagaaccagcccacgcaca

SEQ ID NO: 650890 - DNA, 25 bp, Rattus norvegicus
tcctagtcagcgagtgccaggaccc

SEQ ID NO: 650891 - DNA, 25 bp, Rattus norvegicus
cgaggacacttcatgtgtggcagtc

SEQ ID NO: 650892 - DNA, 25 bp, Rattus norvegicus
gcactgcaggcataacgttcgagga

SEQ ID NO: 650893 - DNA, 25 bp, Rattus norvegicus
ttcgttaaactgtcacgggcactgc

SEQ ID NO: 650894 - DNA, 25 bp, Rattus norvegicus
gccaagtcgtggatccttcgttaaa

SEQ ID NO: 650895 - DNA, 25 bp, Rattus norvegicus
gagtctctatcgtgagaatgccaca

SEQ ID NO: 650896 - DNA, 25 bp, Rattus norvegicus
ctctccagttttcgaagaggtcgtg

SEQ ID NO: 650897 - DNA, 25 bp, Rattus norvegicus
gtgaccttttaagtcccagcgctgc

SEQ ID NO: 650898 - DNA, 25 bp, Rattus norvegicus
ggaatgcagcgccacactctcctta

SEQ ID NO: 650899 - DNA, 25 bp, Rattus norvegicus
ggctgctggcaaactttggccctcg

SEQ ID NO: 650900 - DNA, 25 bp, Rattus norvegicus
tgcagctcgcgaagttcccacctta

SEQ ID NO: 650901 - DNA, 25 bp, Rattus norvegicus
ttcgcggtcggaccaaactgaggcc

SEQ ID NO: 650902 - DNA, 25 bp, Rattus norvegicus
gcgtggcgctcttctatcctagtca

SEQ ID NO: 650903 - DNA, 25 bp, Rattus norvegicus
gaggtccaacctcacgccaagtcgt

SEQ ID NO: 650904 - DNA, 25 bp, Rattus norvegicus
ttggccgggctcagaaagttctgga

SEQ ID NO: 650905 - DNA, 25 bp, Rattus norvegicus
tgagctgatggccttatgtgcgatc

SEQ ID NO: 650906 - DNA, 25 bp, Rattus norvegicus
cgaatgcctccgcttggcaccgggt

SEQ ID NO: 650907 - DNA, 25 bp, Rattus norvegicus
aaccaaggcctctgcgcacgaatgc

SEQ ID NO: 650908 - DNA, 25 bp, Rattus norvegicus
aggctggttcgaggtgacattattg

SEQ ID NO: 650909 - DNA, 25 bp, Rattus norvegicus
tccaggacatcatccgggtatgcga

SEQ ID NO: 650910 - DNA, 25 bp, Rattus norvegicus
cagaaatgaagctggcagaggagcc

SEQ ID NO: 650911 - DNA, 25 bp, Rattus norvegicus
ggctcaagcaaagcggctcgcggta

SEQ ID NO: 650912 - DNA, 25 bp, Rattus norvegicus
tgatctcgatccgagggctcgggcc

SEQ ID NO: 650913 - DNA, 25 bp, Rattus norvegicus
agttctggaaccctatactatccga

SEQ ID NO: 650914 - DNA, 25 bp, Rattus norvegicus
tatactatccgactctccgaaccgg

SEQ ID NO: 650915 - DNA, 25 bp, Rattus norvegicus
gcttgaggccatagtccaggacatc

SEQ ID NO: 650916 - DNA, 25 bp, Rattus norvegicus
ttcgtgggatggagtgatctcgatc

SEQ ID NO: 650917 - DNA, 25 bp, Rattus norvegicus
tttgaaactggggacacaggtcgtc

SEQ ID NO: 650918 - DNA, 25 bp, Rattus norvegicus
ggagcgcacctggaggtctcagcac

SEQ ID NO: 650919 - DNA, 25 bp, Rattus norvegicus
gaatctgaataaagatcgtcttttg

SEQ ID NO: 650920 - DNA, 25 bp, Rattus norvegicus
gcgcgccaagttgggaagagccaaa

SEQ ID NO: 650921 - DNA, 25 bp, Rattus norvegicus
ccctttggcactgaagaaacgcgag

SEQ ID NO: 650922 - DNA, 25 bp, Rattus norvegicus
agctctcacctgtcctcggcgcgcg

SEQ ID NO: 650923 - DNA, 25 bp, Rattus norvegicus
acgcgaggctgatagaatctgaata

SEQ ID NO: 650924 - DNA, 25 bp, Rattus norvegicus
gtggacagctccctgccgctcccac

SEQ ID NO: 650925 - DNA, 25 bp, Rattus norvegicus
gcaaaatccaaacggcacgcttcct

SEQ ID NO: 650926 - DNA, 25 bp, Rattus norvegicus
acgcttcctccaggcaaacggtagc

SEQ ID NO: 650927 - DNA, 25 bp, Rattus norvegicus
tccaggcaaacggtagcccagggca

SEQ ID NO: 650928 - DNA, 25 bp, Rattus norvegicus
tcagcacggcggatagcagccggcc

SEQ ID NO: 650929 - DNA, 25 bp, Rattus norvegicus
gggccgcgttaccagcaggcagaac

SEQ ID NO: 650930 - DNA, 25 bp, Rattus norvegicus
taccagcaggcagaacggagcgcac

SEQ ID NO: 650931 - DNA, 25 bp, Rattus norvegicus
gcactgaagaaacgcgaggctgata

SEQ ID NO: 650932 - DNA, 25 bp, Rattus norvegicus
gcgtccatggctcggggcgttccgg

SEQ ID NO: 650933 - DNA, 25 bp, Rattus norvegicus
tgggtcctggatgcgtccggggagc

SEQ ID NO: 650934 - DNA, 25 bp, Rattus norvegicus
ctccggggcgtccatggctcggggc

SEQ ID NO: 650935 - DNA, 25 bp, Rattus norvegicus
atggctcacggcacactgggtcctg

SEQ ID NO: 650936 - DNA, 25 bp, Rattus norvegicus
gctcacggcacactgggtcctggat

SEQ ID NO: 650937 - DNA, 25 bp, Rattus norvegicus
tcacggcacactgggtcctggatgc

SEQ ID NO: 650938 - DNA, 25 bp, Rattus norvegicus
ggcgttccggctgcgggccgtgtag

SEQ ID NO: 650939 - DNA, 25 bp, Rattus norvegicus
gatggctcacggcacactgggtcct

SEQ ID NO: 650940 - DNA, 25 bp, Rattus norvegicus
ccgaggatggctcacggcacactgg

SEQ ID NO: 650941 - DNA, 25 bp, Rattus norvegicus
ggccgaggatggctcacggcacact

SEQ ID NO: 650942 - DNA, 25 bp, Rattus norvegicus
tcaccgtgtctgtggagcaagccgg

SEQ ID NO: 650943 - DNA, 25 bp, Rattus norvegicus
ggtcaccgtgtctgtggagcaagcc

SEQ ID NO: 650944 - DNA, 25 bp, Rattus norvegicus
gctggcgcagagcaggggtcaccgt

SEQ ID NO: 650945 - DNA, 25 bp, Rattus norvegicus
ccgtgtagggttgcggtgcccggag

SEQ ID NO: 650946 - DNA, 25 bp, Rattus norvegicus
ctatgcttctacctgcgagcgggga

SEQ ID NO: 650947 - DNA, 25 bp, Rattus norvegicus
tcccgctcctgtgctcctgctccgg

SEQ ID NO: 650948 - DNA, 25 bp, Rattus norvegicus
ggcgcggttacctcggtccgcagac

SEQ ID NO: 650949 - DNA, 25 bp, Rattus norvegicus
agggatgcaggcagggatgccaatg

SEQ ID NO: 650950 - DNA, 25 bp, Rattus norvegicus
gtaggcagcagagcgaggatgcgat

SEQ ID NO: 650951 - DNA, 25 bp, Rattus norvegicus
ttctacctgcgagcggggacagcgt

SEQ ID NO: 650952 - DNA, 25 bp, Rattus norvegicus
accgtgtgctgcgatctggcggagt

SEQ ID NO: 650953 - DNA, 25 bp, Rattus norvegicus
gccgcatctatgcttctacctgcga

SEQ ID NO: 650954 - DNA, 25 bp, Rattus norvegicus
ctgtttcgccgcatctatgcttcta

SEQ ID NO: 650955 - DNA, 25 bp, Rattus norvegicus
gctgcatctggaggcgccggactca

SEQ ID NO: 650956 - DNA, 25 bp, Rattus norvegicus
gcggtcgcttactccagcggcaacg

SEQ ID NO: 650957 - DNA, 25 bp, Rattus norvegicus
ctgcgcaatgcggagcgctgcatct

SEQ ID NO: 650958 - DNA, 25 bp, Rattus norvegicus
gtcgcttactccagcggcaacgcga

SEQ ID NO: 650959 - DNA, 25 bp, Rattus norvegicus
ctccagcggcaacgcgacttccttc

SEQ ID NO: 650960 - DNA, 25 bp, Rattus norvegicus
cggtcccggccctggaaggcacagt

SEQ ID NO: 650961 - DNA, 25 bp, Rattus norvegicus
aacaggagtagctacactcgggaca

SEQ ID NO: 650962 - DNA, 25 bp, Rattus norvegicus
actcgggacatttctcagggtggtc

SEQ ID NO: 650963 - DNA, 25 bp, Rattus norvegicus
acatttctcagggtggtcggcctga

SEQ ID NO: 650964 - DNA, 25 bp, Rattus norvegicus
tcggcctgatgcaggcgactgtgct

SEQ ID NO: 650965 - DNA, 25 bp, Rattus norvegicus
gcaggcgactgtgctccagcaggtc

SEQ ID NO: 650966 - DNA, 25 bp, Rattus norvegicus
ctgggctggaacaggagtagctaca

SEQ ID NO: 650967 - DNA, 25 bp, Rattus norvegicus
cctggaaggcacagtgcagacactt

SEQ ID NO: 650968 - DNA, 25 bp, Rattus norvegicus
cagacacttgaaggtgtgcttgatg

SEQ ID NO: 650969 - DNA, 25 bp, Rattus norvegicus
ttgaggttcgccttcatggtgcaac

SEQ ID NO: 650970 - DNA, 25 bp, Rattus norvegicus
ccttcatggtgcaacggacgtcaca

SEQ ID NO: 650971 - DNA, 25 bp, Rattus norvegicus
aaaggcttctctcccgaatgcacga

SEQ ID NO: 650972 - DNA, 25 bp, Rattus norvegicus
tctcccgaatgcacgatcatgtgcc

SEQ ID NO: 650973 - DNA, 25 bp, Rattus norvegicus
tgcaacggacgtcacagaactcgca

SEQ ID NO: 650974 - DNA, 25 bp, Rattus norvegicus
cacttgtgcggcttcacgctcgtgt

SEQ ID NO: 650975 - DNA, 25 bp, Rattus norvegicus
cgtaggggcacatctggcacttgta

SEQ ID NO: 650976 - DNA, 25 bp, Rattus norvegicus
tgcggcttcacgctcgtgtggcagc

SEQ ID NO: 650977 - DNA, 25 bp, Rattus norvegicus
ggtggcacttgtgcggcttcacgct

SEQ ID NO: 650978 - DNA, 25 bp, Rattus norvegicus
cacaggtggcacttgtgcggcttca

SEQ ID NO: 650979 - DNA, 25 bp, Rattus norvegicus
cgtagtcgcacaggtggcacttgtg

SEQ ID NO: 650980 - DNA, 25 bp, Rattus norvegicus
ccgcgtagtcgcacaggtggcactt

SEQ ID NO: 650981 - DNA, 25 bp, Rattus norvegicus
taggggcacatctggcacttgtagg

SEQ ID NO: 650982 - DNA, 25 bp, Rattus norvegicus
gcctctgggtgaggggcttacctgt

SEQ ID NO: 650983 - DNA, 25 bp, Rattus norvegicus
cgagtaataggaaaagtgaagcagc

SEQ ID NO: 650984 - DNA, 25 bp, Rattus norvegicus
tgtcctcagaaagcgcgggcgagta

SEQ ID NO: 650985 - DNA, 25 bp, Rattus norvegicus
ttgctcgtgtcctcagaaagcgcgg

SEQ ID NO: 650986 - DNA, 25 bp, Rattus norvegicus
ggttgctcgtgtcctcagaaagcgc

SEQ ID NO: 650987 - DNA, 25 bp, Rattus norvegicus
tccacggccgcgtagtcgcacaggt

SEQ ID NO: 650988 - DNA, 25 bp, Rattus norvegicus
tgctcagaaagtttgcttttccaaa

SEQ ID NO: 650989 - DNA, 25 bp, Rattus norvegicus
ttttccggacattctggggcgcgaa

SEQ ID NO: 650990 - DNA, 25 bp, Rattus norvegicus
tcgtgagtcggcttcatgaccctta

SEQ ID NO: 650991 - DNA, 25 bp, Rattus norvegicus
ctgtgagtccgcctctgcaaatgct

SEQ ID NO: 650992 - DNA, 25 bp, Rattus norvegicus
tcagctgccgggaaccagcgtctct

SEQ ID NO: 650993 - DNA, 25 bp, Rattus norvegicus
gaacgccatcaaccagctgtgagtc

SEQ ID NO: 650994 - DNA, 25 bp, Rattus norvegicus
gcggttatctcgcagaacgccatca

SEQ ID NO: 650995 - DNA, 25 bp, Rattus norvegicus
ccctacttctctgccaatgcggtta

SEQ ID NO: 650996 - DNA, 25 bp, Rattus norvegicus
tgacccttagcactttggccgacga

SEQ ID NO: 650997 - DNA, 25 bp, Rattus norvegicus
aggacgaaagcgcagcgtgcttgct

SEQ ID NO: 650998 - DNA, 25 bp, Rattus norvegicus
gcgtctctggctcgggtttttccaa

SEQ ID NO: 650999 - DNA, 25 bp, Rattus norvegicus
tttccaacgccggtccaggatgcgg

SEQ ID NO: 651000 - DNA, 25 bp, Rattus norvegicus
atgcggagctgttcatcgtgagtcg

SEQ ID NO: 651001 - DNA, 25 bp, Rattus norvegicus
cgcgaactagcgagcgaggacgaaa

SEQ ID NO: 651002 - DNA, 25 bp, Rattus norvegicus
tcaagtgtcctgacagccgcttggg

SEQ ID NO: 651003 - DNA, 25 bp, Rattus norvegicus
ctgacagccgcttgggcggcagcca

SEQ ID NO: 651004 - DNA, 25 bp, Rattus norvegicus
tccaggctcgttgcgctcgggctga

SEQ ID NO: 651005 - DNA, 25 bp, Rattus norvegicus
cttccgccgcgacatggctcccgga

SEQ ID NO: 651006 - DNA, 25 bp, Rattus norvegicus
cccaagagtggcctcctgaacagcg

SEQ ID NO: 651007 - DNA, 25 bp, Rattus norvegicus
tggcctcctgaacagcgcgcgtttc

SEQ ID NO: 651008 - DNA, 25 bp, Rattus norvegicus
tgaacagcgcgcgtttcccgacttt

SEQ ID NO: 651009 - DNA, 25 bp, Rattus norvegicus
cgcgtttcccgactttggaggcaca

SEQ ID NO: 651010 - DNA, 25 bp, Rattus norvegicus
ccacaccgggccgaatcgcgcatgt

SEQ ID NO: 651011 - DNA, 25 bp, Rattus norvegicus
cgaatcgcgcatgtcccagccctgc

SEQ ID NO: 651012 - DNA, 25 bp, Rattus norvegicus
cgtcagcccggtagggcgatttatc

SEQ ID NO: 651013 - DNA, 25 bp, Rattus norvegicus
ccggtagggcgatttatcaagtgtc

SEQ ID NO: 651014 - DNA, 25 bp, Rattus norvegicus
gggcgatttatcaagtgtcctgaca

SEQ ID NO: 651015 - DNA, 25 bp, Rattus norvegicus
cgcttgggcggcagccaggacctca

SEQ ID NO: 651016 - DNA, 25 bp, Rattus norvegicus
ttccgtagttccgtcctgaatcaga

SEQ ID NO: 651017 - DNA, 25 bp, Rattus norvegicus
tgctgtcacccaggaagtcgcagtg

SEQ ID NO: 651018 - DNA, 25 bp, Rattus norvegicus
tccgcagggtggatttgctgtcacc

SEQ ID NO: 651019 - DNA, 25 bp, Rattus norvegicus
gccgccttgctggaacacgagtagc

SEQ ID NO: 651020 - DNA, 25 bp, Rattus norvegicus
cgtgtctgcgtggaacttcttcatg

SEQ ID NO: 651021 - DNA, 25 bp, Rattus norvegicus
ccggagcctcattcttgagcgtgtc

SEQ ID NO: 651022 - DNA, 25 bp, Rattus norvegicus
cacagtggaacgtcttcttggcatc

SEQ ID NO: 651023 - DNA, 25 bp, Rattus norvegicus
gtggtactcactgtgctgccttttg

SEQ ID NO: 651024 - DNA, 25 bp, Rattus norvegicus
ctgggctcaaggtgaagctgtacta

SEQ ID NO: 651025 - DNA, 25 bp, Rattus norvegicus
cctcgttgaactgggacacctggct

SEQ ID NO: 651026 - DNA, 25 bp, Rattus norvegicus
cgaaggatctgtagccggccattcc

SEQ ID NO: 651027 - DNA, 25 bp, Rattus norvegicus
cccgccgtctgatcatgggtggtca

SEQ ID NO: 651028 - DNA, 25 bp, Rattus norvegicus
cgttaaggccttcgaagtccgtgca

SEQ ID NO: 651029 - DNA, 25 bp, Rattus norvegicus
tccgtgcacgtgatgccagaactgg

SEQ ID NO: 651030 - DNA, 25 bp, Rattus norvegicus
gtcgcacgtcttgcacttgtagggc

SEQ ID NO: 651031 - DNA, 25 bp, Rattus norvegicus
ccgcgtagtcgcacgtcttgcactt

SEQ ID NO: 651032 - DNA, 25 bp, Rattus norvegicus
tggcagcgcatgtgcgtcttcagct

SEQ ID NO: 651033 - DNA, 25 bp, Rattus norvegicus
acctcgcacttgtggggtttgtcac

SEQ ID NO: 651034 - DNA, 25 bp, Rattus norvegicus
ggaggcgcagcctgcttacctgtgt

SEQ ID NO: 651035 - DNA, 25 bp, Rattus norvegicus
gtttgtcacctttgggtgcgcgcgc

SEQ ID NO: 651036 - DNA, 25 bp, Rattus norvegicus
ggcgcagcctgcttacctgtgtgcg

SEQ ID NO: 651037 - DNA, 25 bp, Rattus norvegicus
catgtgcgtcttcagcttgtccttc

SEQ ID NO: 651038 - DNA, 25 bp, Rattus norvegicus
tgcgtcttcagcttgtccttccggc

SEQ ID NO: 651039 - DNA, 25 bp, Rattus norvegicus
ttgtccttccggctgaagcacttcc

SEQ ID NO: 651040 - DNA, 25 bp, Rattus norvegicus
ggcacttgaagggtcgctcatccga

SEQ ID NO: 651041 - DNA, 25 bp, Rattus norvegicus
aagggtcgctcatccgagtggatgc

SEQ ID NO: 651042 - DNA, 25 bp, Rattus norvegicus
tctggcacttgaagggtcgctcatc

SEQ ID NO: 651043 - DNA, 25 bp, Rattus norvegicus
cgcacttgtggggtttgtcaccttt

SEQ ID NO: 651044 - DNA, 25 bp, Rattus norvegicus
cacttccgctacctagagggcgctg

SEQ ID NO: 651045 - DNA, 25 bp, Rattus norvegicus
gggactgcaaggtgcgccgtcaccc

SEQ ID NO: 651046 - DNA, 25 bp, Rattus norvegicus
tgcaccgatccggagaagctttctc

SEQ ID NO: 651047 - DNA, 25 bp, Rattus norvegicus
cccacggcgtgctctacatgatgca

SEQ ID NO: 651048 - DNA, 25 bp, Rattus norvegicus
ctctacatgatgcaaagacttttcc

SEQ ID NO: 651049 - DNA, 25 bp, Rattus norvegicus
gatgcaaagacttttcccttgcatt

SEQ ID NO: 651050 - DNA, 25 bp, Rattus norvegicus
agcctgtcttctcctaactctgcga

SEQ ID NO: 651051 - DNA, 25 bp, Rattus norvegicus
tctcctaactctgcgaggcggggac

SEQ ID NO: 651052 - DNA, 25 bp, Rattus norvegicus
gatgtacagctagcgccacttccgc

SEQ ID NO: 651053 - DNA, 25 bp, Rattus norvegicus
tgtgctctcccggagaaccgggaag

SEQ ID NO: 651054 - DNA, 25 bp, Rattus norvegicus
caggagttcgagaaggctcccggcc

SEQ ID NO: 651055 - DNA, 25 bp, Rattus norvegicus
ggcacttactttgcaccgatccgga

SEQ ID NO: 651056 - DNA, 25 bp, Rattus norvegicus
ggacggatgtacagctagcgccact

SEQ ID NO: 651057 - DNA, 25 bp, Rattus norvegicus
tccggagaagctttctccatctcca

SEQ ID NO: 651058 - DNA, 25 bp, Rattus norvegicus
acaggttgctgagtgtcaggatgca

SEQ ID NO: 651059 - DNA, 25 bp, Rattus norvegicus
tgagtccgtaccgaacagccaggca

SEQ ID NO: 651060 - DNA, 25 bp, Rattus norvegicus
ttgagggaagaaaggtactgtttca

SEQ ID NO: 651061 - DNA, 25 bp, Rattus norvegicus
gtactgtttcattgttcagactttc

SEQ ID NO: 651062 - DNA, 25 bp, Rattus norvegicus
gttcagactttcttccttgagtttc

SEQ ID NO: 651063 - DNA, 25 bp, Rattus norvegicus
ttggtcgaggcgtgctgactctcgc

SEQ ID NO: 651064 - DNA, 25 bp, Rattus norvegicus
atgtgcgaagtgatgagtccgtacc

SEQ ID NO: 651065 - DNA, 25 bp, Rattus norvegicus
tctcgcgggtacatgtgaaaggctc

SEQ ID NO: 651066 - DNA, 25 bp, Rattus norvegicus
agccaggcaggaagctgatttattg

SEQ ID NO: 651067 - DNA, 25 bp, Rattus norvegicus
ttattgcttgggaagctttacgccg

SEQ ID NO: 651068 - DNA, 25 bp, Rattus norvegicus
ctttacgccgagaagacggcgccga

SEQ ID NO: 651069 - DNA, 25 bp, Rattus norvegicus
acggcgccgacaacaggttgctgag

SEQ ID NO: 651070 - DNA, 25 bp, Rattus norvegicus
tcaggatgcagtcgaggagatgctc

SEQ ID NO: 651071 - DNA, 25 bp, Rattus norvegicus
ccttgagtttcgttcattgattata

SEQ ID NO: 651072 - DNA, 25 bp, Rattus norvegicus
acaatcgatctcctcttccggtcag

SEQ ID NO: 651073 - DNA, 25 bp, Rattus norvegicus
gtagctcgtgggatcatctccgttc

SEQ ID NO: 651074 - DNA, 25 bp, Rattus norvegicus
atccactgctcaggtgtagctcgtg

SEQ ID NO: 651075 - DNA, 25 bp, Rattus norvegicus
tttccgcatccactgctcaggtgta

SEQ ID NO: 651076 - DNA, 25 bp, Rattus norvegicus
tgacctcatcgtcaagggaatgcga

SEQ ID NO: 651077 - DNA, 25 bp, Rattus norvegicus
ggaatgcgatggcaacggccctttc

SEQ ID NO: 651078 - DNA, 25 bp, Rattus norvegicus
cgaggctctgtgaatgtggccgtaa

SEQ ID NO: 651079 - DNA, 25 bp, Rattus norvegicus
gagcagacccgaggctctgtgaatg

SEQ ID NO: 651080 - DNA, 25 bp, Rattus norvegicus
tgtccggtgcccagagcagacccga

SEQ ID NO: 651081 - DNA, 25 bp, Rattus norvegicus
atcatctccgttctttgatttcacg

SEQ ID NO: 651082 - DNA, 25 bp, Rattus norvegicus
actctgcgcacatcctaacaaggca

SEQ ID NO: 651083 - DNA, 25 bp, Rattus norvegicus
ggctcctaaacaatcgatctcctct

SEQ ID NO: 651084 - DNA, 25 bp, Rattus norvegicus
taacaaggcagcgtgtgtccggtgc

SEQ ID NO: 651085 - DNA, 25 bp, Rattus norvegicus
atgtggccgtaaggttgacctcatc

SEQ ID NO: 651086 - DNA, 25 bp, Rattus norvegicus
cccgcgcactccctctgctctgacc

SEQ ID NO: 651087 - DNA, 25 bp, Rattus norvegicus
gctccgcgtccgaggccgcggtaaa

SEQ ID NO: 651088 - DNA, 25 bp, Rattus norvegicus
cggtaaaatcgttaagcgccgcagc

SEQ ID NO: 651089 - DNA, 25 bp, Rattus norvegicus
ggtcgagctcgactgcaagctgtcg

SEQ ID NO: 651090 - DNA, 25 bp, Rattus norvegicus
tgctctgaccggcagattggaagcg

SEQ ID NO: 651091 - DNA, 25 bp, Rattus norvegicus
gcagaacggaaactttgtcttctcc

SEQ ID NO: 651092 - DNA, 25 bp, Rattus norvegicus
gcgcgcagaacggaaactttgtctt

SEQ ID NO: 651093 - DNA, 25 bp, Rattus norvegicus
tcgcagcgcgcagaacggaaacttt

SEQ ID NO: 651094 - DNA, 25 bp, Rattus norvegicus
ctgcaaacgcgatctcgggccggga

SEQ ID NO: 651095 - DNA, 25 bp, Rattus norvegicus
cgcagcctgcaaacgcgatctcggg

SEQ ID NO: 651096 - DNA, 25 bp, Rattus norvegicus
ttaagcgccgcagcctgcaaacgcg

SEQ ID NO: 651097 - DNA, 25 bp, Rattus norvegicus
taaaatcgttaagcgccgcagcctg

SEQ ID NO: 651098 - DNA, 25 bp, Rattus norvegicus
tcgagctcgactgcaagctgtcggg

SEQ ID NO: 651099 - DNA, 25 bp, Rattus norvegicus
ctgaccggcagattggaagcggccc

SEQ ID NO: 651100 - DNA, 25 bp, Rattus norvegicus
tcctaggagccacagaaagacgagt

SEQ ID NO: 651101 - DNA, 25 bp, Rattus norvegicus
gtagagcgatgccaaggaggaaaca

SEQ ID NO: 651102 - DNA, 25 bp, Rattus norvegicus
cctggcgctttcaaaagggttagcg

SEQ ID NO: 651103 - DNA, 25 bp, Rattus norvegicus
ggcaggtaagagatggctccgctcc

SEQ ID NO: 651104 - DNA, 25 bp, Rattus norvegicus
acagcaggcacccaagcgggcggca

SEQ ID NO: 651105 - DNA, 25 bp, Rattus norvegicus
tgccaaggaggaaacagcaggcacc

SEQ ID NO: 651106 - DNA, 25 bp, Rattus norvegicus
ctggagctaagtagagcgatgccaa

SEQ ID NO: 651107 - DNA, 25 bp, Rattus norvegicus
gcgccagaagtgagactggagctaa

SEQ ID NO: 651108 - DNA, 25 bp, Rattus norvegicus
gccacagaaagacgagtgagactgc

SEQ ID NO: 651109 - DNA, 25 bp, Rattus norvegicus
ggcgccagccgcatatctgccaccc

SEQ ID NO: 651110 - DNA, 25 bp, Rattus norvegicus
cgagtgacgtcctaggagccacaga

SEQ ID NO: 651111 - DNA, 25 bp, Rattus norvegicus
atctgccacccagagagggggtctc

SEQ ID NO: 651112 - DNA, 25 bp, Rattus norvegicus
acagaggccgagtgacgtcctagga

SEQ ID NO: 651113 - DNA, 25 bp, Rattus norvegicus
agaaagacgagtgagactgcggccc

SEQ ID NO: 651114 - DNA, 25 bp, Rattus norvegicus
cccgctagcgtcgaggctaaactga

SEQ ID NO: 651115 - DNA, 25 bp, Rattus norvegicus
acaggacgcaactcggacaaggggc

SEQ ID NO: 651116 - DNA, 25 bp, Rattus norvegicus
ttcccgtgcgcccagggtctgaggc

SEQ ID NO: 651117 - DNA, 25 bp, Rattus norvegicus
gggcggttccagtgacaggtattct

SEQ ID NO: 651118 - DNA, 25 bp, Rattus norvegicus
ggcagaaagtgctcgcagcagctgt

SEQ ID NO: 651119 - DNA, 25 bp, Rattus norvegicus
cgcggcctttgtgcgtctgccgcta

SEQ ID NO: 651120 - DNA, 25 bp, Rattus norvegicus
ccgcgcctggcggaccattgtttcg

SEQ ID NO: 651121 - DNA, 25 bp, Rattus norvegicus
tccctggctgacaggacgcaactcg

SEQ ID NO: 651122 - DNA, 25 bp, Rattus norvegicus
tgaaaccgaacaccttccctggctg

SEQ ID NO: 651123 - DNA, 25 bp, Rattus norvegicus
cacgaacttcccacgggagtttgcg

SEQ ID NO: 651124 - DNA, 25 bp, Rattus norvegicus
cgtcgaggctaaactgaggcgcacg

SEQ ID NO: 651125 - DNA, 25 bp, Rattus norvegicus
aagaatgcgcttcccgtgcgcccag

SEQ ID NO: 651126 - DNA, 25 bp, Rattus norvegicus
actgtgcacccgctagcgtcgaggc

SEQ ID NO: 651127 - DNA, 25 bp, Rattus norvegicus
tggcggaccattgtttcggccgtcc

SEQ ID NO: 651128 - DNA, 25 bp, Rattus norvegicus
gaacgttggtctccacggccttggc

SEQ ID NO: 651129 - DNA, 25 bp, Rattus norvegicus
ggaggctcgtgtctcgctctgattt

SEQ ID NO: 651130 - DNA, 25 bp, Rattus norvegicus
cactcctgggcgaagtggaaactga

SEQ ID NO: 651131 - DNA, 25 bp, Rattus norvegicus
cgtttggtttcgtaataagcagcta

SEQ ID NO: 651132 - DNA, 25 bp, Rattus norvegicus
ctgaaaaatcgaacgttggtctcca

SEQ ID NO: 651133 - DNA, 25 bp, Rattus norvegicus
cacaggagaaccgaagggacgtttg

SEQ ID NO: 651134 - DNA, 25 bp, Rattus norvegicus
atcgaacgttggtctccacggcctt

SEQ ID NO: 651135 - DNA, 25 bp, Rattus norvegicus
gaaagtcacaggagaaccgaaggga

SEQ ID NO: 651136 - DNA, 25 bp, Rattus norvegicus
cacaattaaaagtcggaaagtcaca

SEQ ID NO: 651137 - DNA, 25 bp, Rattus norvegicus
gcgtgggtccttagacacaattaaa

SEQ ID NO: 651138 - DNA, 25 bp, Rattus norvegicus
gggaagcgtgggtccttagacacaa

SEQ ID NO: 651139 - DNA, 25 bp, Rattus norvegicus
ctctgatttgggaagcgtgggtcct

SEQ ID NO: 651140 - DNA, 25 bp, Rattus norvegicus
ctcgtgtctcgctctgatttgggaa

SEQ ID NO: 651141 - DNA, 25 bp, Rattus norvegicus
ttcgtaataagcagctaagaacgcc

SEQ ID NO: 651142 - DNA, 25 bp, Rattus norvegicus
aacacagcggtaggttccagggcga

SEQ ID NO: 651143 - DNA, 25 bp, Rattus norvegicus
gtccggattcatccggcgctcgagg

SEQ ID NO: 651144 - DNA, 25 bp, Rattus norvegicus
cgctcgaggttggatgtgattctaa

SEQ ID NO: 651145 - DNA, 25 bp, Rattus norvegicus
tgtgattctaatactatctccagtg

SEQ ID NO: 651146 - DNA, 25 bp, Rattus norvegicus
ctatctccagtgacgagcctctggc

SEQ ID NO: 651147 - DNA, 25 bp, Rattus norvegicus
agcctctggctcgaatttgcacgtc

SEQ ID NO: 651148 - DNA, 25 bp, Rattus norvegicus
gaatttgcacgtccgctctccgcgt

SEQ ID NO: 651149 - DNA, 25 bp, Rattus norvegicus
gctctccgcgtcgactacatgatca

SEQ ID NO: 651150 - DNA, 25 bp, Rattus norvegicus
ggatcctaatcaaaacacagcggta

SEQ ID NO: 651151 - DNA, 25 bp, Rattus norvegicus
caaccgctaagcgagttccggaccg

SEQ ID NO: 651152 - DNA, 25 bp, Rattus norvegicus
gcacgtcggcgttagcgtcacgtcc

SEQ ID NO: 651153 - DNA, 25 bp, Rattus norvegicus
tcgaccacgtccagcggagacggga

SEQ ID NO: 651154 - DNA, 25 bp, Rattus norvegicus
gagacgggaacaagatggcgattcc

SEQ ID NO: 651155 - DNA, 25 bp, Rattus norvegicus
cgcgtcgactacatgatcataaata

SEQ ID NO: 651156 - DNA, 25 bp, Rattus norvegicus
gaacagaatcagtccggacccaacc

SEQ ID NO: 651157 - DNA, 25 bp, Rattus norvegicus
cttgcagaaagatccggggaccctc

SEQ ID NO: 651158 - DNA, 25 bp, Rattus norvegicus
ccgcgacccggtgtcgtcttaggcg

SEQ ID NO: 651159 - DNA, 25 bp, Rattus norvegicus
cccgtgtgacttgcagaaagatccg

SEQ ID NO: 651160 - DNA, 25 bp, Rattus norvegicus
cccgagtgggaacagaatcagtccg

SEQ ID NO: 651161 - DNA, 25 bp, Rattus norvegicus
cccgcggacataaagtgtggttgtg

SEQ ID NO: 651162 - DNA, 25 bp, Rattus norvegicus
tggttgtgcgattttctcagtaaga

SEQ ID NO: 651163 - DNA, 25 bp, Rattus norvegicus
ctcagtaagatgacccgaggccagc

SEQ ID NO: 651164 - DNA, 25 bp, Rattus norvegicus
ccagcggcgtgtttgctgctcacac

SEQ ID NO: 651165 - DNA, 25 bp, Rattus norvegicus
ctgctcacacggagacggttttggt

SEQ ID NO: 651166 - DNA, 25 bp, Rattus norvegicus
cggttttggtgcatttgggttctct

SEQ ID NO: 651167 - DNA, 25 bp, Rattus norvegicus
ttgggttctctacagtcagcacttg

SEQ ID NO: 651168 - DNA, 25 bp, Rattus norvegicus
tacagtcagcacttgggcccgcgac

SEQ ID NO: 651169 - DNA, 25 bp, Rattus norvegicus
atccggggaccctctgcgaccttga

SEQ ID NO: 651170 - DNA, 25 bp, Rattus norvegicus
cgacggcgagtgtcgccaagtactc

SEQ ID NO: 651171 - DNA, 25 bp, Rattus norvegicus
acgcagagatagacccgcgccggtg

SEQ ID NO: 651172 - DNA, 25 bp, Rattus norvegicus
tttatagcgagcgttggagcagaaa

SEQ ID NO: 651173 - DNA, 25 bp, Rattus norvegicus
agcagaaaggctcggaggcaaagcc

SEQ ID NO: 651174 - DNA, 25 bp, Rattus norvegicus
ggcaaagccctgatccacttcctga

SEQ ID NO: 651175 - DNA, 25 bp, Rattus norvegicus
ctgatccacttcctgaacgcagaga

SEQ ID NO: 651176 - DNA, 25 bp, Rattus norvegicus
ttcctgaacgcagagatagacccgc

SEQ ID NO: 651177 - DNA, 25 bp, Rattus norvegicus
cgccggtgggtgtcgaattcaacgt

SEQ ID NO: 651178 - DNA, 25 bp, Rattus norvegicus
ggacgagcaaaagtcccgatccatc

SEQ ID NO: 651179 - DNA, 25 bp, Rattus norvegicus
ccgatccatcgggactcagagcaag

SEQ ID NO: 651180 - DNA, 25 bp, Rattus norvegicus
ggactcagagcaagtttctcagttc

SEQ ID NO: 651181 - DNA, 25 bp, Rattus norvegicus
caagtttctcagttcgcttacgatc

SEQ ID NO: 651182 - DNA, 25 bp, Rattus norvegicus
tcgcttacgatctgaaaagagaacc

SEQ ID NO: 651183 - DNA, 25 bp, Rattus norvegicus
aagagaaccaaggtctcgacggcga

SEQ ID NO: 651184 - DNA, 25 bp, Rattus norvegicus
ctaatcgagcacgtgcgcatgcgcg

SEQ ID NO: 651185 - DNA, 25 bp, Rattus norvegicus
accattgccatctccttactacagg

SEQ ID NO: 651186 - DNA, 25 bp, Rattus norvegicus
ggaatactagctcattcgattgcta

SEQ ID NO: 651187 - DNA, 25 bp, Rattus norvegicus
aaacaccgcgcgcatcgggtaaatc

SEQ ID NO: 651188 - DNA, 25 bp, Rattus norvegicus
ccttactacaggagggaatactagc

SEQ ID NO: 651189 - DNA, 25 bp, Rattus norvegicus
accgcactgttaacggtgaccagtg

SEQ ID NO: 651190 - DNA, 25 bp, Rattus norvegicus
accgtgttcgccaccgcactgttaa

SEQ ID NO: 651191 - DNA, 25 bp, Rattus norvegicus
catggctgccattcaccgtgttcgc

SEQ ID NO: 651192 - DNA, 25 bp, Rattus norvegicus
tccggcttttctatgccgccatggc

SEQ ID NO: 651193 - DNA, 25 bp, Rattus norvegicus
tgttacttaggctccggcttttcta

SEQ ID NO: 651194 - DNA, 25 bp, Rattus norvegicus
gggcctctgttacttaggctccggc

SEQ ID NO: 651195 - DNA, 25 bp, Rattus norvegicus
tagtattggtcggtcacgtgagtag

SEQ ID NO: 651196 - DNA, 25 bp, Rattus norvegicus
ccttcatggctagtattggtcggtc

SEQ ID NO: 651197 - DNA, 25 bp, Rattus norvegicus
cgattgctaatcgagcacgtgcgca

SEQ ID NO: 651198 - DNA, 25 bp, Rattus norvegicus
ttccgagcgggtgatcccttcgctc

SEQ ID NO: 651199 - DNA, 25 bp, Rattus norvegicus
tgagaactgcactgagaacccgggg

SEQ ID NO: 651200 - DNA, 25 bp, Rattus norvegicus
gacgcaaggctgaaccggcccgcag

SEQ ID NO: 651201 - DNA, 25 bp, Rattus norvegicus
cgcaggctgagttcacagtcactta

SEQ ID NO: 651202 - DNA, 25 bp, Rattus norvegicus
agtcacttacttggcagctggagtc

SEQ ID NO: 651203 - DNA, 25 bp, Rattus norvegicus
agctggagtctttcccgttactctc

SEQ ID NO: 651204 - DNA, 25 bp, Rattus norvegicus
ggcgtctgagaactgcactgagaac

SEQ ID NO: 651205 - DNA, 25 bp, Rattus norvegicus
tcatttaccgttgatattgaggatc

SEQ ID NO: 651206 - DNA, 25 bp, Rattus norvegicus
tgactacaacaacaaacagacagcg

SEQ ID NO: 651207 - DNA, 25 bp, Rattus norvegicus
gacagcgtcctctcagttaccacag

SEQ ID NO: 651208 - DNA, 25 bp, Rattus norvegicus
acagcacagcgaccgtgcgcaggcg

SEQ ID NO: 651209 - DNA, 25 bp, Rattus norvegicus
gcaggcgcacgcacttcttccaaaa

SEQ ID NO: 651210 - DNA, 25 bp, Rattus norvegicus
gcacttcttccaaaaccgacggcga

SEQ ID NO: 651211 - DNA, 25 bp, Rattus norvegicus
ccgttactctcttccgagcgggtga

SEQ ID NO: 651212 - DNA, 25 bp, Rattus norvegicus
taacgcagacttacacgcagtcccg

SEQ ID NO: 651213 - DNA, 25 bp, Rattus norvegicus
tctcgtgcttcctttgcaccctgat

SEQ ID NO: 651214 - DNA, 25 bp, Rattus norvegicus
ttgcaccctgattgcgtaccgcgtt

SEQ ID NO: 651215 - DNA, 25 bp, Rattus norvegicus
cctgattgcgtaccgcgtttcgctg

SEQ ID NO: 651216 - DNA, 25 bp, Rattus norvegicus
gcgtaccgcgtttcgctggggcctc

SEQ ID NO: 651217 - DNA, 25 bp, Rattus norvegicus
ggcctcctcatcacgctgtggaata

SEQ ID NO: 651218 - DNA, 25 bp, Rattus norvegicus
catcacgctgtggaatagaagcttc

SEQ ID NO: 651219 - DNA, 25 bp, Rattus norvegicus
cgctgtggaatagaagcttcgtgaa

SEQ ID NO: 651220 - DNA, 25 bp, Rattus norvegicus
aagcttcgtgaaggttctgtctact

SEQ ID NO: 651221 - DNA, 25 bp, Rattus norvegicus
ggttctgtctacttcggcttggtgc

SEQ ID NO: 651222 - DNA, 25 bp, Rattus norvegicus
tacggctctccgtcctctcgtgctt

SEQ ID NO: 651223 - DNA, 25 bp, Rattus norvegicus
acttcggcttggtgcgcggcccaca

SEQ ID NO: 651224 - DNA, 25 bp, Rattus norvegicus
gcggcccacaggaagtcacagctgc

SEQ ID NO: 651225 - DNA, 25 bp, Rattus norvegicus
cccttgaggattgtaacgcagactt

SEQ ID NO: 651226 - DNA, 25 bp, Rattus norvegicus
cagtgagctagggtctgtgcatgac

SEQ ID NO: 651227 - DNA, 25 bp, Rattus norvegicus
cccgtggcgtctgattgtcaggcag

SEQ ID NO: 651228 - DNA, 25 bp, Rattus norvegicus
tgtcaggcagcacgctctgaacttc

SEQ ID NO: 651229 - DNA, 25 bp, Rattus norvegicus
gctctgaacttcctgaaggagtctc

SEQ ID NO: 651230 - DNA, 25 bp, Rattus norvegicus
ctgaaggagtctccgttgcgcttga

SEQ ID NO: 651231 - DNA, 25 bp, Rattus norvegicus
ttgcgcttgaggattccgggataga

SEQ ID NO: 651232 - DNA, 25 bp, Rattus norvegicus
ccgggatagattgtagagaatccac

SEQ ID NO: 651233 - DNA, 25 bp, Rattus norvegicus
ccacatcaagctgttcgcggtctga

SEQ ID NO: 651234 - DNA, 25 bp, Rattus norvegicus
cgcggtctgaaaggcaacgggccac

SEQ ID NO: 651235 - DNA, 25 bp, Rattus norvegicus
cgggccacggatgagagtctgctca

SEQ ID NO: 651236 - DNA, 25 bp, Rattus norvegicus
gagtctgctcatgactggtctcaaa

SEQ ID NO: 651237 - DNA, 25 bp, Rattus norvegicus
ctggtctcaaaccagtgagctaggg

SEQ ID NO: 651238 - DNA, 25 bp, Rattus norvegicus
gtctgtgcatgaccggcctcaaacc

SEQ ID NO: 651239 - DNA, 25 bp, Rattus norvegicus
ctcaaaccgccgtcagtcaggcgaa

SEQ ID NO: 651240 - DNA, 25 bp, Rattus norvegicus
ccgtttgtcaatggggcagctcata

SEQ ID NO: 651241 - DNA, 25 bp, Rattus norvegicus
ctcgtatttatggaagcagggcatg

SEQ ID NO: 651242 - DNA, 25 bp, Rattus norvegicus
tgacggatcacctaagctcgccctg

SEQ ID NO: 651243 - DNA, 25 bp, Rattus norvegicus
tccaggcatagggacctcgtattta

SEQ ID NO: 651244 - DNA, 25 bp, Rattus norvegicus
gatgccgccaggtttgatgtacctc

SEQ ID NO: 651245 - DNA, 25 bp, Rattus norvegicus
ggtttctgccctgagctggccacag

SEQ ID NO: 651246 - DNA, 25 bp, Rattus norvegicus
agctcatagtagcaggcgacccgtg

SEQ ID NO: 651247 - DNA, 25 bp, Rattus norvegicus
cgcagtcggcgcagaaaagcgatca

SEQ ID NO: 651248 - DNA, 25 bp, Rattus norvegicus
aagcgctcgccttggatgtcaccga

SEQ ID NO: 651249 - DNA, 25 bp, Rattus norvegicus
tcgagtctcaccgtctgtcatcagc

SEQ ID NO: 651250 - DNA, 25 bp, Rattus norvegicus
tagactccctagcagtggccagttg

SEQ ID NO: 651251 - DNA, 25 bp, Rattus norvegicus
cgtgtcgtgctgtttcttcaggcca

SEQ ID NO: 651252 - DNA, 25 bp, Rattus norvegicus
caaactatttaccagcgtgtcgtgc

SEQ ID NO: 651253 - DNA, 25 bp, Rattus norvegicus
gggccaaatgccatcagcgcgcatc

SEQ ID NO: 651254 - DNA, 25 bp, Rattus norvegicus
ggatgtcgaccaccgtcagcggccg

SEQ ID NO: 651255 - DNA, 25 bp, Rattus norvegicus
agcgggttctgaaacatggagtcac

SEQ ID NO: 651256 - DNA, 25 bp, Rattus norvegicus
ccgtggcaaagcagactccggagca

SEQ ID NO: 651257 - DNA, 25 bp, Rattus norvegicus
cggtgcacgggctgcttcttcttct

SEQ ID NO: 651258 - DNA, 25 bp, Rattus norvegicus
agatctggctgaccgtgcggtgcac

SEQ ID NO: 651259 - DNA, 25 bp, Rattus norvegicus
catcgcgagaggtctttccggggtt

SEQ ID NO: 651260 - DNA, 25 bp, Rattus norvegicus
tccgggatcagaccctggctgcaaa

SEQ ID NO: 651261 - DNA, 25 bp, Rattus norvegicus
tggctgcaaagtccacagagttctg

SEQ ID NO: 651262 - DNA, 25 bp, Rattus norvegicus
cagagttctgcgctgtctgaggacc

SEQ ID NO: 651263 - DNA, 25 bp, Rattus norvegicus
atgcccgggcggatgtcgaccaccg

SEQ ID NO: 651264 - DNA, 25 bp, Rattus norvegicus
tgaaacatggagtcacgcacgaccc

SEQ ID NO: 651265 - DNA, 25 bp, Rattus norvegicus
tcaccttgacaatgagcgggttctg

SEQ ID NO: 651266 - DNA, 25 bp, Rattus norvegicus
gcggagcctccgtcgaacgcttaaa

SEQ ID NO: 651267 - DNA, 25 bp, Rattus norvegicus
ttcttccatcgcgagaggtctttcc

SEQ ID NO: 651268 - DNA, 25 bp, Rattus norvegicus
tgctgcctgcagatggctttggctc

SEQ ID NO: 651269 - DNA, 25 bp, Rattus norvegicus
ggcacccgcccgctatttataggag

SEQ ID NO: 651270 - DNA, 25 bp, Rattus norvegicus
gcacaactttgtgtctcagcgcgca

SEQ ID NO: 651271 - DNA, 25 bp, Rattus norvegicus
gtcgccaaaagcagttctaaggttc

SEQ ID NO: 651272 - DNA, 25 bp, Rattus norvegicus
gctcagctgaatgccggtcgccaaa

SEQ ID NO: 651273 - DNA, 25 bp, Rattus norvegicus
tccatgtccaggatgctagcgactc

SEQ ID NO: 651274 - DNA, 25 bp, Rattus norvegicus
cccgaaatctcactgtgtgtgcgca

SEQ ID NO: 651275 - DNA, 25 bp, Rattus norvegicus
gaacgccaggttgtgtccatgtcca

SEQ ID NO: 651276 - DNA, 25 bp, Rattus norvegicus
ctctggttggcgcaggaacaaatta

SEQ ID NO: 651277 - DNA, 25 bp, Rattus norvegicus
atctaaaaagtctcgaggccctctc

SEQ ID NO: 651278 - DNA, 25 bp, Rattus norvegicus
cagcgcctgtgtgacgttgaacgca

SEQ ID NO: 651279 - DNA, 25 bp, Rattus norvegicus
tagtggctagatcgactgcgctgca

SEQ ID NO: 651280 - DNA, 25 bp, Rattus norvegicus
tgaagtctcccttcgagctggctgg

SEQ ID NO: 651281 - DNA, 25 bp, Rattus norvegicus
gcgcgcactttcaccaattctctgg

SEQ ID NO: 651282 - DNA, 25 bp, Rattus norvegicus
gatctctagatagccgccgccaaag

SEQ ID NO: 651283 - DNA, 25 bp, Rattus norvegicus
agaactttgtttctccgtggccgca

SEQ ID NO: 651284 - DNA, 25 bp, Rattus norvegicus
cattcctgcgtacacaccagccagg

SEQ ID NO: 651285 - DNA, 25 bp, Rattus norvegicus
tccacgctccctgaccggtgggagg

SEQ ID NO: 651286 - DNA, 25 bp, Rattus norvegicus
ccgcagctcagctctagccggaggg

SEQ ID NO: 651287 - DNA, 25 bp, Rattus norvegicus
tggccgcagctcagctctagccgga

SEQ ID NO: 651288 - DNA, 25 bp, Rattus norvegicus
tttgtttctccgtggccgcagctca

SEQ ID NO: 651289 - DNA, 25 bp, Rattus norvegicus
gtcactttgagaccaaagaactttg

SEQ ID NO: 651290 - DNA, 25 bp, Rattus norvegicus
gaatttttgcgtcactttgagacca

SEQ ID NO: 651291 - DNA, 25 bp, Rattus norvegicus
gccgccaaagagctccgcaagaatt

SEQ ID NO: 651292 - DNA, 25 bp, Rattus norvegicus
atggtctgatctctagatagccgcc

SEQ ID NO: 651293 - DNA, 25 bp, Rattus norvegicus
cctcacatggtctgatctctagata

SEQ ID NO: 651294 - DNA, 25 bp, Rattus norvegicus
cgcccgccgcgctatttgtactcgc

SEQ ID NO: 651295 - DNA, 25 bp, Rattus norvegicus
ccgcaagaatttttgcgtcactttg

SEQ ID NO: 651296 - DNA, 25 bp, Rattus norvegicus
gcaggccgtgaaaacataaccaaaa

SEQ ID NO: 651297 - DNA, 25 bp, Rattus norvegicus
ttacaagctgcaggccgtgaaaaca

SEQ ID NO: 651298 - DNA, 25 bp, Rattus norvegicus
gattctcactgttggctctttcctg

SEQ ID NO: 651299 - DNA, 25 bp, Rattus norvegicus
ggaatacgcgtttcttagactcatg

SEQ ID NO: 651300 - DNA, 25 bp, Rattus norvegicus
tagactcatgattctcactgttggc

SEQ ID NO: 651301 - DNA, 25 bp, Rattus norvegicus
ggctctttcctgtcccaagtatata

SEQ ID NO: 651302 - DNA, 25 bp, Rattus norvegicus
tctgcatgatagcatgttgactcac

SEQ ID NO: 651303 - DNA, 25 bp, Rattus norvegicus
gttgactcacatataccctacgcag

SEQ ID NO: 651304 - DNA, 25 bp, Rattus norvegicus
atataccctacgcagagacctgacc

SEQ ID NO: 651305 - DNA, 25 bp, Rattus norvegicus
gacttggcaccacatctacgtgatg

SEQ ID NO: 651306 - DNA, 25 bp, Rattus norvegicus
ggcaccacatctacgtgatgaaatg

SEQ ID NO: 651307 - DNA, 25 bp, Rattus norvegicus
catctacgtgatgaaatgtaagcaa

SEQ ID NO: 651308 - DNA, 25 bp, Rattus norvegicus
tggcagtttacaagctgcaggccgt

SEQ ID NO: 651309 - DNA, 25 bp, Rattus norvegicus
gtcccaagtatatacaatctgcatg

SEQ ID NO: 651310 - DNA, 25 bp, Rattus norvegicus
cccaaaaaacctgagctctgccgta

SEQ ID NO: 651311 - DNA, 25 bp, Rattus norvegicus
tcctgtactccaccgctctgggccg

SEQ ID NO: 651312 - DNA, 25 bp, Rattus norvegicus
cctgggaaccgccacctcctgtact

SEQ ID NO: 651313 - DNA, 25 bp, Rattus norvegicus
catggccgggctcttggcgctgctt

SEQ ID NO: 651314 - DNA, 25 bp, Rattus norvegicus
ttcctgagtgggcaccgctcgcggc

SEQ ID NO: 651315 - DNA, 25 bp, Rattus norvegicus
accgctctgtgctggggctggttcc

SEQ ID NO: 651316 - DNA, 25 bp, Rattus norvegicus
tggagcccaaaaaacctgagctctg

SEQ ID NO: 651317 - DNA, 25 bp, Rattus norvegicus
tgggtggagcccaaaaaacctgagc

SEQ ID NO: 651318 - DNA, 25 bp, Rattus norvegicus
gagctgttgggtggagcccaaaaaa

SEQ ID NO: 651319 - DNA, 25 bp, Rattus norvegicus
ctcagggataggctgcttctgcaga

SEQ ID NO: 651320 - DNA, 25 bp, Rattus norvegicus
ccactcagggataggctgcttctgc

SEQ ID NO: 651321 - DNA, 25 bp, Rattus norvegicus
cgcccactcagggataggctgcttc

SEQ ID NO: 651322 - DNA, 25 bp, Rattus norvegicus
agagagcgggcgtctccagatgccc

SEQ ID NO: 651323 - DNA, 25 bp, Rattus norvegicus
aaacctgagctctgccgtagagccc

SEQ ID NO: 651324 - DNA, 25 bp, Rattus norvegicus
caaattactcggttagctggcggtc

SEQ ID NO: 651325 - DNA, 25 bp, Rattus norvegicus
gattggctcaccctgaacgcgacta

SEQ ID NO: 651326 - DNA, 25 bp, Rattus norvegicus
ttcgcgcctccatttttctagaaga

SEQ ID NO: 651327 - DNA, 25 bp, Rattus norvegicus
catgtccgtgtcctagagttgcccg

SEQ ID NO: 651328 - DNA, 25 bp, Rattus norvegicus
tgccctttgcacgtgcgcactgagt

SEQ ID NO: 651329 - DNA, 25 bp, Rattus norvegicus
agcgtctcgaacgtgccagtgagta

SEQ ID NO: 651330 - DNA, 25 bp, Rattus norvegicus
tttgccggtcactcacagtcctttg

SEQ ID NO: 651331 - DNA, 25 bp, Rattus norvegicus
tgctctccaaggatcgggcgtttgc

SEQ ID NO: 651332 - DNA, 25 bp, Rattus norvegicus
gcctgtccgatctacggccgttcta

SEQ ID NO: 651333 - DNA, 25 bp, Rattus norvegicus
gcgacgccgttctgtgattggctca

SEQ ID NO: 651334 - DNA, 25 bp, Rattus norvegicus
ctcctccgagagctgattggctata

SEQ ID NO: 651335 - DNA, 25 bp, Rattus norvegicus
cgaagtctccaagcgatcccggtag

SEQ ID NO: 651336 - DNA, 25 bp, Rattus norvegicus
cgcgtccaccatcagtttgcaaatt

SEQ ID NO: 651337 - DNA, 25 bp, Rattus norvegicus
tcccggtagctcagccgttacaatt

SEQ ID NO: 651338 - DNA, 25 bp, Rattus norvegicus
tttggccgcgcgctgtttgtgtcat

SEQ ID NO: 651339 - DNA, 25 bp, Rattus norvegicus
gtttgctaaggcttctgactattgc

SEQ ID NO: 651340 - DNA, 25 bp, Rattus norvegicus
tgtttgtgtcatcaaggagcgccgg

SEQ ID NO: 651341 - DNA, 25 bp, Rattus norvegicus
tgtgtcatcaaggagcgccggaagt

SEQ ID NO: 651342 - DNA, 25 bp, Rattus norvegicus
gaagtgggctcggtttctcccgaga

SEQ ID NO: 651343 - DNA, 25 bp, Rattus norvegicus
aagtgacggcttctagtgtttgcta

SEQ ID NO: 651344 - DNA, 25 bp, Rattus norvegicus
ggcttctagtgtttgctaaggcttc

SEQ ID NO: 651345 - DNA, 25 bp, Rattus norvegicus
taaggcttctgactattgctaaggc

SEQ ID NO: 651346 - DNA, 25 bp, Rattus norvegicus
cttctgactattgctaaggcttttg

SEQ ID NO: 651347 - DNA, 25 bp, Rattus norvegicus
tgctaaggcttttgactccggcttt

SEQ ID NO: 651348 - DNA, 25 bp, Rattus norvegicus
aggcttttgactccggctttgggat

SEQ ID NO: 651349 - DNA, 25 bp, Rattus norvegicus
tgggttgcgacggaggcacaatccc

SEQ ID NO: 651350 - DNA, 25 bp, Rattus norvegicus
gccgaagaaggtcgagaaggtcagt

SEQ ID NO: 651351 - DNA, 25 bp, Rattus norvegicus
cccaagaggcacgagctggtgaagg

SEQ ID NO: 651352 - DNA, 25 bp, Rattus norvegicus
tctgcctggaacctcttttcctggg

SEQ ID NO: 651353 - DNA, 25 bp, Rattus norvegicus
cctggaacctcttttcctgggcgag

SEQ ID NO: 651354 - DNA, 25 bp, Rattus norvegicus
gaacctcttttcctgggcgagttga

SEQ ID NO: 651355 - DNA, 25 bp, Rattus norvegicus
cttttcctgggcgagttgaggcttt

SEQ ID NO: 651356 - DNA, 25 bp, Rattus norvegicus
tgcagaaccggcactccgcagggct

SEQ ID NO: 651357 - DNA, 25 bp, Rattus norvegicus
accggcactccgcagggctgggcat

SEQ ID NO: 651358 - DNA, 25 bp, Rattus norvegicus
ctccgcagggctgggcatcgcagca

SEQ ID NO: 651359 - DNA, 25 bp, Rattus norvegicus
catcgcagcagggatgggcctgggc

SEQ ID NO: 651360 - DNA, 25 bp, Rattus norvegicus
aagctcgggtctcctccagccgcgg

SEQ ID NO: 651361 - DNA, 25 bp, Rattus norvegicus
ggccctcagccagatacagcttcgg

SEQ ID NO: 651362 - DNA, 25 bp, Rattus norvegicus
cctcagccagatacagcttcgggcg

SEQ ID NO: 651363 - DNA, 25 bp, Rattus norvegicus
cagccagatacagcttcgggcgaca

SEQ ID NO: 651364 - DNA, 25 bp, Rattus norvegicus
cgacagcggcggcacgcggttgtcc

SEQ ID NO: 651365 - DNA, 25 bp, Rattus norvegicus
cagatacagcttcgggcgacagcgg

SEQ ID NO: 651366 - DNA, 25 bp, Rattus norvegicus
ttaggaattaagtctgaccgccttg

SEQ ID NO: 651367 - DNA, 25 bp, Rattus norvegicus
gagcctctctggacgactttaccta

SEQ ID NO: 651368 - DNA, 25 bp, Rattus norvegicus
tcggacaggttgagctagagtttcg

SEQ ID NO: 651369 - DNA, 25 bp, Rattus norvegicus
attatccgcgccgactgttcttggc

SEQ ID NO: 651370 - DNA, 25 bp, Rattus norvegicus
tccgactctcaaacgtggctttttc

SEQ ID NO: 651371 - DNA, 25 bp, Rattus norvegicus
gccttaccttgggagtgtcacttcc

SEQ ID NO: 651372 - DNA, 25 bp, Rattus norvegicus
ctagcaaggatcacagctcccggtc

SEQ ID NO: 651373 - DNA, 25 bp, Rattus norvegicus
accgggatgtgtgagaaccttgacc

SEQ ID NO: 651374 - DNA, 25 bp, Rattus norvegicus
ccctgggactgatgaagacacatct

SEQ ID NO: 651375 - DNA, 25 bp, Rattus norvegicus
tgagcgctcgcgagtactctagcct

SEQ ID NO: 651376 - DNA, 25 bp, Rattus norvegicus
ctgcagcctggttttcaagagaagt

SEQ ID NO: 651377 - DNA, 25 bp, Rattus norvegicus
gccagcgacacctttgcggagtctc

SEQ ID NO: 651378 - DNA, 25 bp, Rattus norvegicus
ggctttttcccacgaagtctgtcca

SEQ ID NO: 651379 - DNA, 25 bp, Rattus norvegicus
ttcgtcggcgttgcgtattatccgc

SEQ ID NO: 651380 - DNA, 25 bp, Rattus norvegicus
cccagcatcggggtccaagtcctag

SEQ ID NO: 651381 - DNA, 25 bp, Rattus norvegicus
tggttttgcaagaatgttctagggg

SEQ ID NO: 651382 - DNA, 25 bp, Rattus norvegicus
tcggggtccaagtcctaggcgtcac

SEQ ID NO: 651383 - DNA, 25 bp, Rattus norvegicus
gtgaatctcagcttttccgactgcc

SEQ ID NO: 651384 - DNA, 25 bp, Rattus norvegicus
tcagcttttccgactgcctatgcgg

SEQ ID NO: 651385 - DNA, 25 bp, Rattus norvegicus
tccgactgcctatgcggaaaaagcg

SEQ ID NO: 651386 - DNA, 25 bp, Rattus norvegicus
cctatgcggaaaaagcgggcttctt

SEQ ID NO: 651387 - DNA, 25 bp, Rattus norvegicus
tccaaggtcaccaacgcggtctcta

SEQ ID NO: 651388 - DNA, 25 bp, Rattus norvegicus
gtcaccaacgcggtctctaaacaca

SEQ ID NO: 651389 - DNA, 25 bp, Rattus norvegicus
cggcacaaagaaccccgcatgctgg

SEQ ID NO: 651390 - DNA, 25 bp, Rattus norvegicus
cggcgtcccagcatcggggtccaag

SEQ ID NO: 651391 - DNA, 25 bp, Rattus norvegicus
ccctagatggttttgcaagaatgtt

SEQ ID NO: 651392 - DNA, 25 bp, Rattus norvegicus
taaacacacacccttcgcggcgtcc

SEQ ID NO: 651393 - DNA, 25 bp, Rattus norvegicus
gcgagttggtgaatctcagcttttc

SEQ ID NO: 651394 - DNA, 25 bp, Rattus norvegicus
agcggtccacgacccgaggtcactt

SEQ ID NO: 651395 - DNA, 25 bp, Rattus norvegicus
gttcagctcacatgacccagccggg

SEQ ID NO: 651396 - DNA, 25 bp, Rattus norvegicus
cccagccgggcgctttgaactaagc

SEQ ID NO: 651397 - DNA, 25 bp, Rattus norvegicus
cctccgagccggcaagactcaaaga

SEQ ID NO: 651398 - DNA, 25 bp, Rattus norvegicus
ggccggcactgatgctttgcaaatg

SEQ ID NO: 651399 - DNA, 25 bp, Rattus norvegicus
agtggttgaaagcaggcaccctctc

SEQ ID NO: 651400 - DNA, 25 bp, Rattus norvegicus
cctgtcccaaagtagccctggtctg

SEQ ID NO: 651401 - DNA, 25 bp, Rattus norvegicus
gccctggtctgagatatatcacctc

SEQ ID NO: 651402 - DNA, 25 bp, Rattus norvegicus
ccgccatggcgttgtacaggtccaa

SEQ ID NO: 651403 - DNA, 25 bp, Rattus norvegicus
ggcgccgaattatgttttccctgga

SEQ ID NO: 651404 - DNA, 25 bp, Rattus norvegicus
agtcctctactcagttctggcccgg

SEQ ID NO: 651405 - DNA, 25 bp, Rattus norvegicus
gcacctcgttgtccaggctgaagtc

SEQ ID NO: 651406 - DNA, 25 bp, Rattus norvegicus
ttgctgcagacgagcttcaccgtgg

SEQ ID NO: 651407 - DNA, 25 bp, Rattus norvegicus
tggacaggatttcccgctgcatctc

SEQ ID NO: 651408 - DNA, 25 bp, Rattus norvegicus
cttgttccaagcgaggccgcggcct

SEQ ID NO: 651409 - DNA, 25 bp, Rattus norvegicus
tgaaactgagcgctcctcgggaacc

SEQ ID NO: 651410 - DNA, 25 bp, Rattus norvegicus
tttccgctctttagttgaaactgag

SEQ ID NO: 651411 - DNA, 25 bp, Rattus norvegicus
cctgaggcggatcggcctgttcctc

SEQ ID NO: 651412 - DNA, 25 bp, Rattus norvegicus
ccggatgcgcagcaagacggaagtc

SEQ ID NO: 651413 - DNA, 25 bp, Rattus norvegicus
cgactgcgctgtggccttgttccaa

SEQ ID NO: 651414 - DNA, 25 bp, Rattus norvegicus
gacgagctttcattgaatttctgcc

SEQ ID NO: 651415 - DNA, 25 bp, Rattus norvegicus
tctcagggtaggttggacgagcttt

SEQ ID NO: 651416 - DNA, 25 bp, Rattus norvegicus
acgagtgctacactatctcagggta

SEQ ID NO: 651417 - DNA, 25 bp, Rattus norvegicus
ttccgggttgaaagacgagtgctac

SEQ ID NO: 651418 - DNA, 25 bp, Rattus norvegicus
cgcctcacaacacttccgggttgaa

SEQ ID NO: 651419 - DNA, 25 bp, Rattus norvegicus
ccatgttactatggcagccggatgc

SEQ ID NO: 651420 - DNA, 25 bp, Rattus norvegicus
gtcagtacagtatttccgcctcaca

SEQ ID NO: 651421 - DNA, 25 bp, Rattus norvegicus
agggataggtgatttccgctcttta

SEQ ID NO: 651422 - DNA, 25 bp, Rattus norvegicus
tcagcgtcagccgtcatggcgttag

SEQ ID NO: 651423 - DNA, 25 bp, Rattus norvegicus
gagtcctgaagtcggtgctccctaa

SEQ ID NO: 651424 - DNA, 25 bp, Rattus norvegicus
catgcgcatatgcagagcgcgggaa

SEQ ID NO: 651425 - DNA, 25 bp, Rattus norvegicus
gcctcgttcttcgacgccttggatc

SEQ ID NO: 651426 - DNA, 25 bp, Rattus norvegicus
cttcgacgccttggatcggcacagg

SEQ ID NO: 651427 - DNA, 25 bp, Rattus norvegicus
gaggccacgcccgagtcctgaagtc

SEQ ID NO: 651428 - DNA, 25 bp, Rattus norvegicus
agccgtcatggcgttagcgcctatg

SEQ ID NO: 651429 - DNA, 25 bp, Rattus norvegicus
gaggcctccgagcagctcagcgtca

SEQ ID NO: 651430 - DNA, 25 bp, Rattus norvegicus
atcggcacagggcttccctgttggc

SEQ ID NO: 651431 - DNA, 25 bp, Rattus norvegicus
tccctgttggccatggtgaagaaag

SEQ ID NO: 651432 - DNA, 25 bp, Rattus norvegicus
acccgtgtgccctctaggtacagca

SEQ ID NO: 651433 - DNA, 25 bp, Rattus norvegicus
cctatggggcccgaggcctcgttct

SEQ ID NO: 651434 - DNA, 25 bp, Rattus norvegicus
taggtacagcagtcagcaggccaca

SEQ ID NO: 651435 - DNA, 25 bp, Rattus norvegicus
tcagcaggccacagaaagccgggga

SEQ ID NO: 651436 - DNA, 25 bp, Rattus norvegicus
ctcagactttgtgcctcgtgctgcc

SEQ ID NO: 651437 - DNA, 25 bp, Rattus norvegicus
gcacagccggttcagacttccacga

SEQ ID NO: 651438 - DNA, 25 bp, Rattus norvegicus
tgggacgcagacacaggacatagga

SEQ ID NO: 651439 - DNA, 25 bp, Rattus norvegicus
tgcgttcattggtaggtttgaaaaa

SEQ ID NO: 651440 - DNA, 25 bp, Rattus norvegicus
ttgagcctaagctgtgcgttcattg

SEQ ID NO: 651441 - DNA, 25 bp, Rattus norvegicus
ccgattggctggtttgagcctaagc

SEQ ID NO: 651442 - DNA, 25 bp, Rattus norvegicus
cggtgacgccgcgttccgattggct

SEQ ID NO: 651443 - DNA, 25 bp, Rattus norvegicus
tgtcgaaacgtccactagccctcag

SEQ ID NO: 651444 - DNA, 25 bp, Rattus norvegicus
ttccacgaaagtcggtgcagggctc

SEQ ID NO: 651445 - DNA, 25 bp, Rattus norvegicus
gtcgttacagctcaggaccggccta

SEQ ID NO: 651446 - DNA, 25 bp, Rattus norvegicus
acagccctctgtccggtcgttacag

SEQ ID NO: 651447 - DNA, 25 bp, Rattus norvegicus
ccttaagcccagcatggcgaaacca

SEQ ID NO: 651448 - DNA, 25 bp, Rattus norvegicus
ggcggctgtcgaaacgtccactagc

SEQ ID NO: 651449 - DNA, 25 bp, Rattus norvegicus
tagccctcagccctcagactttgtg

SEQ ID NO: 651450 - DNA, 25 bp, Rattus norvegicus
atcttgcattctccggctgaccgcg

SEQ ID NO: 651451 - DNA, 25 bp, Rattus norvegicus
cgtgcgagaggacagctacaatgct

SEQ ID NO: 651452 - DNA, 25 bp, Rattus norvegicus
ggggcctatcgctatggagtatttc

SEQ ID NO: 651453 - DNA, 25 bp, Rattus norvegicus
tcatggtgcccactcagaaggtgcc

SEQ ID NO: 651454 - DNA, 25 bp, Rattus norvegicus
ggtgccctctttgcaacatttcagg

SEQ ID NO: 651455 - DNA, 25 bp, Rattus norvegicus
cgtggacccttagtcgccatgcttc

SEQ ID NO: 651456 - DNA, 25 bp, Rattus norvegicus
gctctgtaagtgtgtactgctcctc

SEQ ID NO: 651457 - DNA, 25 bp, Rattus norvegicus
gtccgccgcagtcttatgtgccctg

SEQ ID NO: 651458 - DNA, 25 bp, Rattus norvegicus
gctctggccacttttgtccgctgca

SEQ ID NO: 651459 - DNA, 25 bp, Rattus norvegicus
cgagtcgcgacgtttgtaaattgca

SEQ ID NO: 651460 - DNA, 25 bp, Rattus norvegicus
cagacccacgtggtgctgcagcagt

SEQ ID NO: 651461 - DNA, 25 bp, Rattus norvegicus
gctggtggctttcacccaacgcttc

SEQ ID NO: 651462 - DNA, 25 bp, Rattus norvegicus
cgcgctttctgggaaccctcttcta

SEQ ID NO: 651463 - DNA, 25 bp, Rattus norvegicus
ggcgctgccctttgattcggatttc

SEQ ID NO: 651464 - DNA, 25 bp, Rattus norvegicus
cccggaagtggcttgtagcgcatgc

SEQ ID NO: 651465 - DNA, 25 bp, Rattus norvegicus
catgtgcggccgccttgagacaggc

SEQ ID NO: 651466 - DNA, 25 bp, Rattus norvegicus
tgagacaggcggaacgtcgtcccct

SEQ ID NO: 651467 - DNA, 25 bp, Rattus norvegicus
ggactttccgcgtgcgcaccctgct

SEQ ID NO: 651468 - DNA, 25 bp, Rattus norvegicus
cctgctcaagccacgaagatgggga

SEQ ID NO: 651469 - DNA, 25 bp, Rattus norvegicus
gcaccctgctcaagccacgaagatg

SEQ ID NO: 651470 - DNA, 25 bp, Rattus norvegicus
cgctccgccaggtaggccgggactt

SEQ ID NO: 651471 - DNA, 25 bp, Rattus norvegicus
tgcagccggaccctgtgcgctccgc

SEQ ID NO: 651472 - DNA, 25 bp, Rattus norvegicus
cgcgtggggaaaactgagtccctct

SEQ ID NO: 651473 - DNA, 25 bp, Rattus norvegicus
cggtttaagacgactgcgaggtctg

SEQ ID NO: 651474 - DNA, 25 bp, Rattus norvegicus
tctgtggtaactgggcagtttccac

SEQ ID NO: 651475 - DNA, 25 bp, Rattus norvegicus
gcttctgtggtaactgggcagtttc

SEQ ID NO: 651476 - DNA, 25 bp, Rattus norvegicus
catgcgctgtgcttctgtggtaact

SEQ ID NO: 651477 - DNA, 25 bp, Rattus norvegicus
gcttgtagcgcatgcgctgtgcttc

SEQ ID NO: 651478 - DNA, 25 bp, Rattus norvegicus
agggaccgtcctccgacagccatag

SEQ ID NO: 651479 - DNA, 25 bp, Rattus norvegicus
ccatagtttcagattcgcaggctta

SEQ ID NO: 651480 - DNA, 25 bp, Rattus norvegicus
acagccatagtttcagattcgcagg

SEQ ID NO: 651481 - DNA, 25 bp, Rattus norvegicus
ctccgacagccatagtttcagattc

SEQ ID NO: 651482 - DNA, 25 bp, Rattus norvegicus
cgtcctccgacagccatagtttcag

SEQ ID NO: 651483 - DNA, 25 bp, Rattus norvegicus
gaccgtcctccgacagccatagttt

SEQ ID NO: 651484 - DNA, 25 bp, Rattus norvegicus
tagtttcagattcgcaggcttagcc

SEQ ID NO: 651485 - DNA, 25 bp, Rattus norvegicus
gcgcgccgcgttctcgcaggttctg

SEQ ID NO: 651486 - DNA, 25 bp, Rattus norvegicus
gcggcagcacgtgcccgcagcgtcc

SEQ ID NO: 651487 - DNA, 25 bp, Rattus norvegicus
gccgcgttctcgcaggttctgcgat

SEQ ID NO: 651488 - DNA, 25 bp, Rattus norvegicus
tttcagattcgcaggcttagccaga

SEQ ID NO: 651489 - DNA, 25 bp, Rattus norvegicus
ttagccagaccctaggggtcacgcc

SEQ ID NO: 651490 - DNA, 25 bp, Rattus norvegicus
cagattcgcaggcttagccagaccc

SEQ ID NO: 651491 - DNA, 25 bp, Rattus norvegicus
tcctcccgcccaggcggcagcacgt

SEQ ID NO: 651492 - DNA, 25 bp, Rattus norvegicus
cacgagggacgtgtttagaactaca

SEQ ID NO: 651493 - DNA, 25 bp, Rattus norvegicus
cgacgcatcgctcagaaagtacttc

SEQ ID NO: 651494 - DNA, 25 bp, Rattus norvegicus
agtacgtttgcacccttaggcgctc

SEQ ID NO: 651495 - DNA, 25 bp, Rattus norvegicus
ggggtaagccactgactcaagcacc

SEQ ID NO: 651496 - DNA, 25 bp, Rattus norvegicus
aagcaccgcttggagtccgccggac

SEQ ID NO: 651497 - DNA, 25 bp, Rattus norvegicus
cccgcgagatagacaagtagatacc

SEQ ID NO: 651498 - DNA, 25 bp, Rattus norvegicus
ataccggcgagcacgcaggagctaa

SEQ ID NO: 651499 - DNA, 25 bp, Rattus norvegicus
caggagctaagtgacctcgctcgcc

SEQ ID NO: 651500 - DNA, 25 bp, Rattus norvegicus
ctgaggcactccttcggacctttta

SEQ ID NO: 651501 - DNA, 25 bp, Rattus norvegicus
gccatgcacggctcacagaaggaca

SEQ ID NO: 651502 - DNA, 25 bp, Rattus norvegicus
aagtcccgcggctacggcttcgtga

SEQ ID NO: 651503 - DNA, 25 bp, Rattus norvegicus
gcgtaagctttagcgccagcgactt

SEQ ID NO: 651504 - DNA, 25 bp, Rattus norvegicus
cccgctttcaaaggcgtgtctgaaa

SEQ ID NO: 651505 - DNA, 25 bp, Rattus norvegicus
ggaactcggattcggcctgcgacac

SEQ ID NO: 651506 - DNA, 25 bp, Rattus norvegicus
cacttgtagggcctggtccctggaa

SEQ ID NO: 651507 - DNA, 25 bp, Rattus norvegicus
acttgaagggtttctcgtgcgtgtg

SEQ ID NO: 651508 - DNA, 25 bp, Rattus norvegicus
ccctggaacgatcgatgatctcacg

SEQ ID NO: 651509 - DNA, 25 bp, Rattus norvegicus
tcacctcgacgctggcgtacttgca

SEQ ID NO: 651510 - DNA, 25 bp, Rattus norvegicus
ctggcgtacttgcacagggagcact

SEQ ID NO: 651511 - DNA, 25 bp, Rattus norvegicus
cgtacttgcacagggagcacttgaa

SEQ ID NO: 651512 - DNA, 25 bp, Rattus norvegicus
cgtgtgtttgtaacgtctgtgcctg

SEQ ID NO: 651513 - DNA, 25 bp, Rattus norvegicus
acgtctgtgcctgacgagctctccg

SEQ ID NO: 651514 - DNA, 25 bp, Rattus norvegicus
agctctccgctggtgacaaacgcca

SEQ ID NO: 651515 - DNA, 25 bp, Rattus norvegicus
ctccgctggtgacaaacgccatgtc

SEQ ID NO: 651516 - DNA, 25 bp, Rattus norvegicus
gtgacaaacgccatgtcacagtccc

SEQ ID NO: 651517 - DNA, 25 bp, Rattus norvegicus
ctggtccctggaacgatcgatgatc

SEQ ID NO: 651518 - DNA, 25 bp, Rattus norvegicus
ttctcgtgcgtgtgtttgtaacgtc

SEQ ID NO: 651519 - DNA, 25 bp, Rattus norvegicus
cagcaggggagctcacctcgacgct

SEQ ID NO: 651520 - DNA, 25 bp, Rattus norvegicus
ggaggaccaggtcaacgccgacctc

SEQ ID NO: 651521 - DNA, 25 bp, Rattus norvegicus
ctggcccggatttggtgagaactcc

SEQ ID NO: 651522 - DNA, 25 bp, Rattus norvegicus
actcccgcgtgctggagtggatgtt

SEQ ID NO: 651523 - DNA, 25 bp, Rattus norvegicus
ttcggacgcatcgaaggggaagaca

SEQ ID NO: 651524 - DNA, 25 bp, Rattus norvegicus
aaggggaagacagcgccaagctcac

SEQ ID NO: 651525 - DNA, 25 bp, Rattus norvegicus
ccattggctacgtccctaaggaaga

SEQ ID NO: 651526 - DNA, 25 bp, Rattus norvegicus
aggaagacgccctgaacttgaaagg

SEQ ID NO: 651527 - DNA, 25 bp, Rattus norvegicus
gatcgacaagtatctggaggaccag

SEQ ID NO: 651528 - DNA, 25 bp, Rattus norvegicus
cgccgacctcccttacgaaatagag

SEQ ID NO: 651529 - DNA, 25 bp, Rattus norvegicus
cttacgaaatagagagggagctccg

SEQ ID NO: 651530 - DNA, 25 bp, Rattus norvegicus
gctccgagccctgaaacagagaatc

SEQ ID NO: 651531 - DNA, 25 bp, Rattus norvegicus
tcagccagatgtaatcccgatgggg

SEQ ID NO: 651532 - DNA, 25 bp, Rattus norvegicus
cggcaagttcctctggcccggattt

SEQ ID NO: 651533 - DNA, 25 bp, Rattus norvegicus
gctgttcggaatctctaaggaattc

SEQ ID NO: 651534 - DNA, 25 bp, Rattus norvegicus
cagttgcacgcgcaggagacattgg

SEQ ID NO: 651535 - DNA, 25 bp, Rattus norvegicus
ctccatgctggggaacaaagagcgc

SEQ ID NO: 651536 - DNA, 25 bp, Rattus norvegicus
ccgcccaaagttgataaagagccta

SEQ ID NO: 651537 - DNA, 25 bp, Rattus norvegicus
acagaccgcgactctgaaccagaca

SEQ ID NO: 651538 - DNA, 25 bp, Rattus norvegicus
aaacctgggacgcatcgccatggcc

SEQ ID NO: 651539 - DNA, 25 bp, Rattus norvegicus
tctgtatacgcacggaaacctggga

SEQ ID NO: 651540 - DNA, 25 bp, Rattus norvegicus
gacggaccagcgcactctgtatacg

SEQ ID NO: 651541 - DNA, 25 bp, Rattus norvegicus
cgccgagactcagacagacggacca

SEQ ID NO: 651542 - DNA, 25 bp, Rattus norvegicus
ccagacacctagagacgcgccgaga

SEQ ID NO: 651543 - DNA, 25 bp, Rattus norvegicus
tgagcccgggattcagacacctgaa

SEQ ID NO: 651544 - DNA, 25 bp, Rattus norvegicus
gacacctgaacacaaacggtcctta

SEQ ID NO: 651545 - DNA, 25 bp, Rattus norvegicus
cggtccttaaatctggctggattca

SEQ ID NO: 651546 - DNA, 25 bp, Rattus norvegicus
gacacactgcgatgcagggacactc

SEQ ID NO: 651547 - DNA, 25 bp, Rattus norvegicus
ggctcactcactgatctccatgctg

SEQ ID NO: 651548 - DNA, 25 bp, Rattus norvegicus
cggcagtttagtatgttgggccgcc

SEQ ID NO: 651549 - DNA, 25 bp, Rattus norvegicus
cgcagaggtcccagttgtgggcata

SEQ ID NO: 651550 - DNA, 25 bp, Rattus norvegicus
cagacgccgcagaggtcccagttgt

SEQ ID NO: 651551 - DNA, 25 bp, Rattus norvegicus
tgcgttcttgagcagacgccgcaga

SEQ ID NO: 651552 - DNA, 25 bp, Rattus norvegicus
gggattcatttactttgcgttcttg

SEQ ID NO: 651553 - DNA, 25 bp, Rattus norvegicus
ttccaggctgcagccggcacagcag

SEQ ID NO: 651554 - DNA, 25 bp, Rattus norvegicus
ttcagatagaactggatttccaggc

SEQ ID NO: 651555 - DNA, 25 bp, Rattus norvegicus
cagggcgagcattcagatagaactg

SEQ ID NO: 651556 - DNA, 25 bp, Rattus norvegicus
ccgccgggcgccttgtctagacagg

SEQ ID NO: 651557 - DNA, 25 bp, Rattus norvegicus
ccagttgtgggcatatcaccacgtc

SEQ ID NO: 651558 - DNA, 25 bp, Rattus norvegicus
acagagcgcggcagtttagtatgtt

SEQ ID NO: 651559 - DNA, 25 bp, Rattus norvegicus
cggctcccagctcgggggattcatt

SEQ ID NO: 651560 - DNA, 25 bp, Rattus norvegicus
ctagacagggcgagcattcagatag

SEQ ID NO: 651561 - DNA, 25 bp, Rattus norvegicus
ggatttccaggctgcagccggcaca

SEQ ID NO: 651562 - DNA, 25 bp, Rattus norvegicus
ttctcccgctctatctcaatctgtg

SEQ ID NO: 651563 - DNA, 25 bp, Rattus norvegicus
tgtaccgagcgctttgtaaaatagg

SEQ ID NO: 651564 - DNA, 25 bp, Rattus norvegicus
gctggggtcgtacagatgtaagatc

SEQ ID NO: 651565 - DNA, 25 bp, Rattus norvegicus
tgtaagatcagaatcagctgctgcc

SEQ ID NO: 651566 - DNA, 25 bp, Rattus norvegicus
cagctgctgcctgcaagcacaagca

SEQ ID NO: 651567 - DNA, 25 bp, Rattus norvegicus
gttagttatcaagcggttcccgctc

SEQ ID NO: 651568 - DNA, 25 bp, Rattus norvegicus
gaagccgccgtgtattgtgtaccga

SEQ ID NO: 651569 - DNA, 25 bp, Rattus norvegicus
cgtccggttatggttgaagcacaca

SEQ ID NO: 651570 - DNA, 25 bp, Rattus norvegicus
cgtcgttcttctattttgaccgcta

SEQ ID NO: 651571 - DNA, 25 bp, Rattus norvegicus
ctggctccttctcggcaggtttttt

SEQ ID NO: 651572 - DNA, 25 bp, Rattus norvegicus
cctggctccatctcgctaggttttc

SEQ ID NO: 651573 - DNA, 25 bp, Rattus norvegicus
tctcgctccttctcggcaggttttg

SEQ ID NO: 651574 - DNA, 25 bp, Rattus norvegicus
cttcgctctttctccgcaggttttt

SEQ ID NO: 651575 - DNA, 25 bp, Rattus norvegicus
acagaccgcgtaaaagccgccttgg

SEQ ID NO: 651576 - DNA, 25 bp, Rattus norvegicus
atcgcctttcctcgcgaggtcgttt

SEQ ID NO: 651577 - DNA, 25 bp, Rattus norvegicus
cgcggcgagaggcttcatatcgctc

SEQ ID NO: 651578 - DNA, 25 bp, Rattus norvegicus
ttccgcgataggtctttttcctcgc

SEQ ID NO: 651579 - DNA, 25 bp, Rattus norvegicus
ctttttcctcgctctttatcctcgg

SEQ ID NO: 651580 - DNA, 25 bp, Rattus norvegicus
gctctttatcctcgggttttcgcta

SEQ ID NO: 651581 - DNA, 25 bp, Rattus norvegicus
tcgctaggtttacccatcgcctttc

SEQ ID NO: 651582 - DNA, 25 bp, Rattus norvegicus
gctctttcttggtaggtctttttca

SEQ ID NO: 651583 - DNA, 25 bp, Rattus norvegicus
gtaggtctttttcactcgctctttc

SEQ ID NO: 651584 - DNA, 25 bp, Rattus norvegicus
tcgctctttcttggtgggttttctc

SEQ ID NO: 651585 - DNA, 25 bp, Rattus norvegicus
tttgcacgcgggcagaggaaatgaa

SEQ ID NO: 651586 - DNA, 25 bp, Rattus norvegicus
agaggcttcatatcgctcccgccgt

SEQ ID NO: 651587 - DNA, 25 bp, Rattus norvegicus
aatgaggccaatatcgcgccgcgcg

SEQ ID NO: 651588 - DNA, 25 bp, Rattus norvegicus
cgcgaggtcgtttccctagctcctt

SEQ ID NO: 651589 - DNA, 25 bp, Rattus norvegicus
tctctctaggacttttccctcgttc

SEQ ID NO: 651590 - DNA, 25 bp, Rattus norvegicus
tcacctgtaagcgaaagcgggttcc

SEQ ID NO: 651591 - DNA, 25 bp, Rattus norvegicus
gcttcccgaggagtagtgggcaatc

SEQ ID NO: 651592 - DNA, 25 bp, Rattus norvegicus
cttcctggagactgagaatccagtc

SEQ ID NO: 651593 - DNA, 25 bp, Rattus norvegicus
tcagagcccactgaccgcacggttt

SEQ ID NO: 651594 - DNA, 25 bp, Rattus norvegicus
cccaccgcaggtaagaacgcgtcta

SEQ ID NO: 651595 - DNA, 25 bp, Rattus norvegicus
gcggatctcgaagagctgcaccctc

SEQ ID NO: 651596 - DNA, 25 bp, Rattus norvegicus
cgcccattttcctagatttgcctca

SEQ ID NO: 651597 - DNA, 25 bp, Rattus norvegicus
tgcctcattgaacacaagcacctgg

SEQ ID NO: 651598 - DNA, 25 bp, Rattus norvegicus
acctggtcacaacaggccagtcatg

SEQ ID NO: 651599 - DNA, 25 bp, Rattus norvegicus
tgctcagggatgaggattgctcacc

SEQ ID NO: 651600 - DNA, 25 bp, Rattus norvegicus
ccgggcacccatgttcaacgctagg

SEQ ID NO: 651601 - DNA, 25 bp, Rattus norvegicus
ggccatcgtgctttgtgtaccgcga

SEQ ID NO: 651602 - DNA, 25 bp, Rattus norvegicus
tgtaccgcgaccttcatcaggcttc

SEQ ID NO: 651603 - DNA, 25 bp, Rattus norvegicus
cctaacgggatccttgagacctctg

SEQ ID NO: 651604 - DNA, 25 bp, Rattus norvegicus
cctcgcgttgctgagtcagcgccgt

SEQ ID NO: 651605 - DNA, 25 bp, Rattus norvegicus
gggttatactacaacccgctgccta

SEQ ID NO: 651606 - DNA, 25 bp, Rattus norvegicus
agctggccggacctggttctcgcac

SEQ ID NO: 651607 - DNA, 25 bp, Rattus norvegicus
cccgctcaatggtggccgagagaaa

SEQ ID NO: 651608 - DNA, 25 bp, Rattus norvegicus
ccggaagaaggaaacccgctcaatg

SEQ ID NO: 651609 - DNA, 25 bp, Rattus norvegicus
cctttctgacgctagggccagcact

SEQ ID NO: 651610 - DNA, 25 bp, Rattus norvegicus
aggatcccggaaagcactcgtggta

SEQ ID NO: 651611 - DNA, 25 bp, Rattus norvegicus
ctcgcacccaaagcgccggaagaag

SEQ ID NO: 651612 - DNA, 25 bp, Rattus norvegicus
ccaccgggcctcagggatctgcgga

SEQ ID NO: 651613 - DNA, 25 bp, Rattus norvegicus
ttttcagggtcctcaggtgagctcc

SEQ ID NO: 651614 - DNA, 25 bp, Rattus norvegicus
cactcgtggtacaagcagtgtctca

SEQ ID NO: 651615 - DNA, 25 bp, Rattus norvegicus
cctgcgttgttcatggtgcccaaac

SEQ ID NO: 651616 - DNA, 25 bp, Rattus norvegicus
tgcccaaactgcctcgtgggaaaac

SEQ ID NO: 651617 - DNA, 25 bp, Rattus norvegicus
agcagtgtctcacctgcgttgttca

SEQ ID NO: 651618 - DNA, 25 bp, Rattus norvegicus
ggagctcttaattggtcggacttgc

SEQ ID NO: 651619 - DNA, 25 bp, Rattus norvegicus
gggcaggctcctaggctaatttacc

SEQ ID NO: 651620 - DNA, 25 bp, Rattus norvegicus
agcgctgagaggaaacggtaagtta

SEQ ID NO: 651621 - DNA, 25 bp, Rattus norvegicus
tgcagtgttgatgacctcccgcacg

SEQ ID NO: 651622 - DNA, 25 bp, Rattus norvegicus
cgtgaccggcatcggacgttaggaa

SEQ ID NO: 651623 - DNA, 25 bp, Rattus norvegicus
agttaagcacccaactcgaagaggg

SEQ ID NO: 651624 - DNA, 25 bp, Rattus norvegicus
actatcccaggcgttgcagtgttga

SEQ ID NO: 651625 - DNA, 25 bp, Rattus norvegicus
ggaagtgacgccacgtatcctcctg

SEQ ID NO: 651626 - DNA, 25 bp, Rattus norvegicus
ccctgcggtttaggcaccagcacag

SEQ ID NO: 651627 - DNA, 25 bp, Rattus norvegicus
ggtgtttcctgctagccaggcccgc

SEQ ID NO: 651628 - DNA, 25 bp, Rattus norvegicus
atattgccgctgtaactcgtgcgcg

SEQ ID NO: 651629 - DNA, 25 bp, Rattus norvegicus
tgcaaccgggcctaaccgggtgaga

SEQ ID NO: 651630 - DNA, 25 bp, Rattus norvegicus
ggcataccataacaagcaggccatg

SEQ ID NO: 651631 - DNA, 25 bp, Rattus norvegicus
tatgggtccgactggatgctgccct

SEQ ID NO: 651632 - DNA, 25 bp, Rattus norvegicus
agaggtcacgcccattcgtcgcgct

SEQ ID NO: 651633 - DNA, 25 bp, Rattus norvegicus
tccctcctcaacttagggcggcggc

SEQ ID NO: 651634 - DNA, 25 bp, Rattus norvegicus
ctcacccgccatcttgggatgtgtt

SEQ ID NO: 651635 - DNA, 25 bp, Rattus norvegicus
ccatcttgggatgtgttagaaggcg

SEQ ID NO: 651636 - DNA, 25 bp, Rattus norvegicus
actcaccggccatcttgggacgggt

SEQ ID NO: 651637 - DNA, 25 bp, Rattus norvegicus
gcgtggtaacgccaagattaagccc

SEQ ID NO: 651638 - DNA, 25 bp, Rattus norvegicus
cgttcctcccattccttagagaaga

SEQ ID NO: 651639 - DNA, 25 bp, Rattus norvegicus
ctcccattccttagagaagatgggg

SEQ ID NO: 651640 - DNA, 25 bp, Rattus norvegicus
gacgctgaggctcctccctggtgct

SEQ ID NO: 651641 - DNA, 25 bp, Rattus norvegicus
ccgcctacccgcctgtgagccgcaa

SEQ ID NO: 651642 - DNA, 25 bp, Rattus norvegicus
tcaggtgacccagctggcgtcccaa

SEQ ID NO: 651643 - DNA, 25 bp, Rattus norvegicus
ggtgacccagctggcgtcccaagat

SEQ ID NO: 651644 - DNA, 25 bp, Rattus norvegicus
ctagaggcgtggtaacgccaagatt

SEQ ID NO: 651645 - DNA, 25 bp, Rattus norvegicus
ctgttgaggtgactccgcgggacaa

SEQ ID NO: 651646 - DNA, 25 bp, Rattus norvegicus
agcgcccttcccaggagcgtttgcg

SEQ ID NO: 651647 - DNA, 25 bp, Rattus norvegicus
gacccagtggccaccgaggcgcaga

SEQ ID NO: 651648 - DNA, 25 bp, Rattus norvegicus
gcgtaaccacaaatgtcagctcggt

SEQ ID NO: 651649 - DNA, 25 bp, Rattus norvegicus
caaatgtcagctcggtgccaccgtg

SEQ ID NO: 651650 - DNA, 25 bp, Rattus norvegicus
cagctcggtgccaccgtggactcta

SEQ ID NO: 651651 - DNA, 25 bp, Rattus norvegicus
ctccggagtagtggccagccgcaaa

SEQ ID NO: 651652 - DNA, 25 bp, Rattus norvegicus
gccagccgcaaacacggtgaaggta

SEQ ID NO: 651653 - DNA, 25 bp, Rattus norvegicus
agaaatggtggtagcgcccttccca

SEQ ID NO: 651654 - DNA, 25 bp, Rattus norvegicus
cccaggagcgtttgcggtcatcaaa

SEQ ID NO: 651655 - DNA, 25 bp, Rattus norvegicus
ttgcggtcatcaaagctgaaatgcc

SEQ ID NO: 651656 - DNA, 25 bp, Rattus norvegicus
agcaccgcaggccttgcctcgcagc

SEQ ID NO: 651657 - DNA, 25 bp, Rattus norvegicus
ctgaaatgccgagtgaggaacagca

SEQ ID NO: 651658 - DNA, 25 bp, Rattus norvegicus
cctcgcagcccacgctgacccagtg

SEQ ID NO: 651659 - DNA, 25 bp, Rattus norvegicus
ccgcaaacacggtgaaggtaggccg

SEQ ID NO: 651660 - DNA, 25 bp, Rattus norvegicus
agccgagtgcatggttctatggccc

SEQ ID NO: 651661 - DNA, 25 bp, Rattus norvegicus
actgagcgccatggcgttgaaagcc

SEQ ID NO: 651662 - DNA, 25 bp, Rattus norvegicus
gagcagccgagtgcatggttctatg

SEQ ID NO: 651663 - DNA, 25 bp, Rattus norvegicus
tcatttcgctccatgagataaaccc

SEQ ID NO: 651664 - DNA, 25 bp, Rattus norvegicus
gggttcctctcatttcgctccatga

SEQ ID NO: 651665 - DNA, 25 bp, Rattus norvegicus
gggtctgcacacagggttcctctca

SEQ ID NO: 651666 - DNA, 25 bp, Rattus norvegicus
gaactcttccctcgctacacaaata

SEQ ID NO: 651667 - DNA, 25 bp, Rattus norvegicus
gtgggctgccggaactcttccctcg

SEQ ID NO: 651668 - DNA, 25 bp, Rattus norvegicus
gctctcaccagcagggtgggctgcc

SEQ ID NO: 651669 - DNA, 25 bp, Rattus norvegicus
actggggtcagctctcaccagcagg

SEQ ID NO: 651670 - DNA, 25 bp, Rattus norvegicus
ttgccacgtgactggggtcagctct

SEQ ID NO: 651671 - DNA, 25 bp, Rattus norvegicus
cgccgccgtatgcacagaaaggaga

SEQ ID NO: 651672 - DNA, 25 bp, Rattus norvegicus
gttgtttactaacgccgccgtatgc

SEQ ID NO: 651673 - DNA, 25 bp, Rattus norvegicus
catggcgttgaaagcccgtcccaac

SEQ ID NO: 651674 - DNA, 25 bp, Rattus norvegicus
ttgcagaaggcccagtggtggcttt

SEQ ID NO: 651675 - DNA, 25 bp, Rattus norvegicus
cttgctgctgttgggccagctgcaa

SEQ ID NO: 651676 - DNA, 25 bp, Rattus norvegicus
tgttgggccagctgcaacacctgca

SEQ ID NO: 651677 - DNA, 25 bp, Rattus norvegicus
cctggagccacgtccgcgggaagct

SEQ ID NO: 651678 - DNA, 25 bp, Rattus norvegicus
cgcggccgccatgcgcccgctaagc

SEQ ID NO: 651679 - DNA, 25 bp, Rattus norvegicus
taagccctggccctgggacacaggc

SEQ ID NO: 651680 - DNA, 25 bp, Rattus norvegicus
aggcccgccataggcctggccgtct

SEQ ID NO: 651681 - DNA, 25 bp, Rattus norvegicus
tgtcccaaaggccctggttgcagcg

SEQ ID NO: 651682 - DNA, 25 bp, Rattus norvegicus
gaggccaggcctgtgtcgccagcct

SEQ ID NO: 651683 - DNA, 25 bp, Rattus norvegicus
tccgcgtggcctttggcctcgagac

SEQ ID NO: 651684 - DNA, 25 bp, Rattus norvegicus
caggccgggccttgcagaaggccca

SEQ ID NO: 651685 - DNA, 25 bp, Rattus norvegicus
ccagagccggcccttgctgctgttg

SEQ ID NO: 651686 - DNA, 25 bp, Rattus norvegicus
agtggtggctttccgcgtggccttt

SEQ ID NO: 651687 - DNA, 25 bp, Rattus norvegicus
tgtgtcgccagcctgcctgggccga

SEQ ID NO: 651688 - DNA, 25 bp, Rattus norvegicus
gagtcggggttgttcagtacagccc

SEQ ID NO: 651689 - DNA, 25 bp, Rattus norvegicus
ccgagtcggggctgttcagtacagc

SEQ ID NO: 651690 - DNA, 25 bp, Rattus norvegicus
tccctctcggagtcggggctgttca

SEQ ID NO: 651691 - DNA, 25 bp, Rattus norvegicus
tccctcccggagtcggggctgttca

SEQ ID NO: 651692 - DNA, 25 bp, Rattus norvegicus
ctcccggagtcggactgttcagtac

SEQ ID NO: 651693 - DNA, 25 bp, Rattus norvegicus
tcctcccggagtcggggctgttcag

SEQ ID NO: 651694 - DNA, 25 bp, Rattus norvegicus
gtccctcccggagtcggactgttca

SEQ ID NO: 651695 - DNA, 25 bp, Rattus norvegicus
tcccggagtcggactgttcagtaca

SEQ ID NO: 651696 - DNA, 25 bp, Rattus norvegicus
ccggagtcggactgttcagtacagc

SEQ ID NO: 651697 - DNA, 25 bp, Rattus norvegicus
cggagtcggactgttcagtacagcc

SEQ ID NO: 651698 - DNA, 25 bp, Rattus norvegicus
tgtcctcccggagtcggactgttca

SEQ ID NO: 651699 - DNA, 25 bp, Rattus norvegicus
ttgtcctcccggagtcggactgttc

SEQ ID NO: 651700 - DNA, 25 bp, Rattus norvegicus
ggagtcggactgttcagtacagccc

SEQ ID NO: 651701 - DNA, 25 bp, Rattus norvegicus
tccctcccggagtcggactgttcag

SEQ ID NO: 651702 - DNA, 25 bp, Rattus norvegicus
tggtgagcgcctaagagaatggatc

SEQ ID NO: 651703 - DNA, 25 bp, Rattus norvegicus
agcgtctgcacgctctgaagttgca

SEQ ID NO: 651704 - DNA, 25 bp, Rattus norvegicus
ctacaactgagcctgagaccgaacc

SEQ ID NO: 651705 - DNA, 25 bp, Rattus norvegicus
agaccgaattcgagaccgagcctga

SEQ ID NO: 651706 - DNA, 25 bp, Rattus norvegicus
cctgagtccgatatccagtccgaga

SEQ ID NO: 651707 - DNA, 25 bp, Rattus norvegicus
ccgattctgagaccgagcctgagtc

SEQ ID NO: 651708 - DNA, 25 bp, Rattus norvegicus
tacgagaccgagaccgattctgaga

SEQ ID NO: 651709 - DNA, 25 bp, Rattus norvegicus
tacgatcaggacgactacgagaccg

SEQ ID NO: 651710 - DNA, 25 bp, Rattus norvegicus
cccgagtgcctagagtacgatcagg

SEQ ID NO: 651711 - DNA, 25 bp, Rattus norvegicus
tccgaatctgatcacgagcacgagg

SEQ ID NO: 651712 - DNA, 25 bp, Rattus norvegicus
cccgagtcctctgaatccgaatctg

SEQ ID NO: 651713 - DNA, 25 bp, Rattus norvegicus
ataattacaacgacctgtgcccgcc

SEQ ID NO: 651714 - DNA, 25 bp, Rattus norvegicus
cgccgagctcgccataattacaacg

SEQ ID NO: 651715 - DNA, 25 bp, Rattus norvegicus
cgcgagcccttagacgaggatcctc

SEQ ID NO: 651716 - DNA, 25 bp, Rattus norvegicus
actcaggagcctaagtcgcacgtgg

SEQ ID NO: 651717 - DNA, 25 bp, Rattus norvegicus
gtagtcatagctaacaccgccctca

SEQ ID NO: 651718 - DNA, 25 bp, Rattus norvegicus
atcgggtaccggcatggccaatttg

SEQ ID NO: 651719 - DNA, 25 bp, Rattus norvegicus
aatgggcgcgcgcacctcttccgtg

SEQ ID NO: 651720 - DNA, 25 bp, Rattus norvegicus
catctctggagttacgagaagacca

SEQ ID NO: 651721 - DNA, 25 bp, Rattus norvegicus
cccacgccgtgcaagtagtcatagc

SEQ ID NO: 651722 - DNA, 25 bp, Rattus norvegicus
taagtcgcacgtggcattcagccgg

SEQ ID NO: 651723 - DNA, 25 bp, Rattus norvegicus
aaatgcgtttgggattggggactca

SEQ ID NO: 651724 - DNA, 25 bp, Rattus norvegicus
ttgcaatgcgcagaaagtaaaatgc

SEQ ID NO: 651725 - DNA, 25 bp, Rattus norvegicus
gcgccacagctacactattgcaatg

SEQ ID NO: 651726 - DNA, 25 bp, Rattus norvegicus
atccgagactgctgcgccacagcta

SEQ ID NO: 651727 - DNA, 25 bp, Rattus norvegicus
gccaactttggcgatccgagactgc

SEQ ID NO: 651728 - DNA, 25 bp, Rattus norvegicus
gtatggaggtgcacgcgccaacttt

SEQ ID NO: 651729 - DNA, 25 bp, Rattus norvegicus
accagagatcgtgaaatgggcgcgc

SEQ ID NO: 651730 - DNA, 25 bp, Rattus norvegicus
ttgactgctgcgcaccgctaggatg

SEQ ID NO: 651731 - DNA, 25 bp, Rattus norvegicus
cgagcctttcaaggcggcgccgccc

SEQ ID NO: 651732 - DNA, 25 bp, Rattus norvegicus
tggtactgcccttgactgctgcgca

SEQ ID NO: 651733 - DNA, 25 bp, Rattus norvegicus
atctaaggtccctgactcacgccgg

SEQ ID NO: 651734 - DNA, 25 bp, Rattus norvegicus
aaggagatctaaggtccctgactca

SEQ ID NO: 651735 - DNA, 25 bp, Rattus norvegicus
gcaaggtaagtgcaaaggagatcta

SEQ ID NO: 651736 - DNA, 25 bp, Rattus norvegicus
agacttggagcaaggtaagtgcaaa

SEQ ID NO: 651737 - DNA, 25 bp, Rattus norvegicus
gctcgctactgcgtgccttagggcc

SEQ ID NO: 651738 - DNA, 25 bp, Rattus norvegicus
tctgcgctcgctactgcgtgcctta

SEQ ID NO: 651739 - DNA, 25 bp, Rattus norvegicus
gcccgctggcccacacctctgcgct

SEQ ID NO: 651740 - DNA, 25 bp, Rattus norvegicus
agccttcagggagatgcgtggccaa

SEQ ID NO: 651741 - DNA, 25 bp, Rattus norvegicus
cacgggtctagccttcagggagatg

SEQ ID NO: 651742 - DNA, 25 bp, Rattus norvegicus
acgtagcccggagtcgcacgggtct

SEQ ID NO: 651743 - DNA, 25 bp, Rattus norvegicus
tgcgcaccgctaggatgccggctgc

SEQ ID NO: 651744 - DNA, 25 bp, Rattus norvegicus
agcttcctcagcgactcctcagcca

SEQ ID NO: 651745 - DNA, 25 bp, Rattus norvegicus
gaataaataacaaagcgaggccgcg

SEQ ID NO: 651746 - DNA, 25 bp, Rattus norvegicus
ataacaaagcgaggccgcgcaagcc

SEQ ID NO: 651747 - DNA, 25 bp, Rattus norvegicus
cgcgcaagccggtatgcgcctggct

SEQ ID NO: 651748 - DNA, 25 bp, Rattus norvegicus
gccggtatgcgcctggctgcagcct

SEQ ID NO: 651749 - DNA, 25 bp, Rattus norvegicus
ctgcagcctgcaaggcttttgtctc

SEQ ID NO: 651750 - DNA, 25 bp, Rattus norvegicus
agcctggcgtcctcctccgttcttt

SEQ ID NO: 651751 - DNA, 25 bp, Rattus norvegicus
accttggccgcctaggatgctctga

SEQ ID NO: 651752 - DNA, 25 bp, Rattus norvegicus
ccgcctaggatgctctgattccgca

SEQ ID NO: 651753 - DNA, 25 bp, Rattus norvegicus
ggatgctctgattccgcatctccct

SEQ ID NO: 651754 - DNA, 25 bp, Rattus norvegicus
ttcccatggccgcatccgaggacag

SEQ ID NO: 651755 - DNA, 25 bp, Rattus norvegicus
tggccgcatccgaggacagcagcag

SEQ ID NO: 651756 - DNA, 25 bp, Rattus norvegicus
acagcagcagctgccttgtgtcgcc

SEQ ID NO: 651757 - DNA, 25 bp, Rattus norvegicus
gccacctccacggacgccggggaga

SEQ ID NO: 651758 - DNA, 25 bp, Rattus norvegicus
agcttccctgaccagttcagcacgg

SEQ ID NO: 651759 - DNA, 25 bp, Rattus norvegicus
tgcccagcctgaatccggatggctt

SEQ ID NO: 651760 - DNA, 25 bp, Rattus norvegicus
cgacgtatatttgctgcccagcctg

SEQ ID NO: 651761 - DNA, 25 bp, Rattus norvegicus
ctgctcaacaccaccgacgtatatt

SEQ ID NO: 651762 - DNA, 25 bp, Rattus norvegicus
gtcgcgccaggtgttggtctacctg

SEQ ID NO: 651763 - DNA, 25 bp, Rattus norvegicus
tgggtaacatgcacggcgacgagac

SEQ ID NO: 651764 - DNA, 25 bp, Rattus norvegicus
cgtctcttcagcatcggcaattcgg

SEQ ID NO: 651765 - DNA, 25 bp, Rattus norvegicus
tcaagaaggctgaggcgaccacgac

SEQ ID NO: 651766 - DNA, 25 bp, Rattus norvegicus
ccgagggccagtttgaccactacta

SEQ ID NO: 651767 - DNA, 25 bp, Rattus norvegicus
ccaggcggcgcacatcaagaaggct

SEQ ID NO: 651768 - DNA, 25 bp, Rattus norvegicus
caccttccctggatgaggtgccaga

SEQ ID NO: 651769 - DNA, 25 bp, Rattus norvegicus
tagcgtgacgcccaaccattcaggg

SEQ ID NO: 651770 - DNA, 25 bp, Rattus norvegicus
accattcagggctacgattggatga

SEQ ID NO: 651771 - DNA, 25 bp, Rattus norvegicus
cactactaccacgaagcggcgctgg

SEQ ID NO: 651772 - DNA, 25 bp, Rattus norvegicus
gcaggactcgaaagctgtacccagt

SEQ ID NO: 651773 - DNA, 25 bp, Rattus norvegicus
tgagcaccaggttcaaaggcccggc

SEQ ID NO: 651774 - DNA, 25 bp, Rattus norvegicus
gggagccagaaaagcccgagccaca

SEQ ID NO: 651775 - DNA, 25 bp, Rattus norvegicus
atgggcagctcgctctgaaagttcg

SEQ ID NO: 651776 - DNA, 25 bp, Rattus norvegicus
tgaaagttcgtgaccgcctcagcca

SEQ ID NO: 651777 - DNA, 25 bp, Rattus norvegicus
tcagccaactaactctgagccctgg

SEQ ID NO: 651778 - DNA, 25 bp, Rattus norvegicus
tgagccctgggacgcccagttcagg

SEQ ID NO: 651779 - DNA, 25 bp, Rattus norvegicus
ctccacgcgggagtgcacacaaaag

SEQ ID NO: 651780 - DNA, 25 bp, Rattus norvegicus
gacctccgctgcaggtaagcaggag

SEQ ID NO: 651781 - DNA, 25 bp, Rattus norvegicus
gtggctccttctcgggctcacagtg

SEQ ID NO: 651782 - DNA, 25 bp, Rattus norvegicus
gctcccgcgcctgatcggggttcat

SEQ ID NO: 651783 - DNA, 25 bp, Rattus norvegicus
acccttttgcggtcacaagcggcca

SEQ ID NO: 651784 - DNA, 25 bp, Rattus norvegicus
tgtacccagtctcactacccttttg

SEQ ID NO: 651785 - DNA, 25 bp, Rattus norvegicus
cacacaaaaggaagccaggcgcggg

SEQ ID NO: 651786 - DNA, 25 bp, Rattus norvegicus
ccctaaaacgggctcagcaggtcag

SEQ ID NO: 651787 - DNA, 25 bp, Rattus norvegicus
ccgccgttctggcagagcagctggt

SEQ ID NO: 651788 - DNA, 25 bp, Rattus norvegicus
gtgccgccgttctggcagagcagct

SEQ ID NO: 651789 - DNA, 25 bp, Rattus norvegicus
aggcgcagcgctggttctgctggca

SEQ ID NO: 651790 - DNA, 25 bp, Rattus norvegicus
ctcgcagcgaatgccggcgtagcca

SEQ ID NO: 651791 - DNA, 25 bp, Rattus norvegicus
gctgctcgcagcgaatgccggcgta

SEQ ID NO: 651792 - DNA, 25 bp, Rattus norvegicus
tcacagcggggctgctcgcagcgaa

SEQ ID NO: 651793 - DNA, 25 bp, Rattus norvegicus
ccagcgtcgtcggcgaggtcacagc

SEQ ID NO: 651794 - DNA, 25 bp, Rattus norvegicus
cggtcacagtccgggccagcgtcgt

SEQ ID NO: 651795 - DNA, 25 bp, Rattus norvegicus
gtcgtcgtcgcacacattggctgcg

SEQ ID NO: 651796 - DNA, 25 bp, Rattus norvegicus
aaaacgggctcagcaggtcagacgg

SEQ ID NO: 651797 - DNA, 25 bp, Rattus norvegicus
gccgcacccgtatcgccgccgggcc

SEQ ID NO: 651798 - DNA, 25 bp, Rattus norvegicus
agcagctggtcgtcgtcgcacacat

SEQ ID NO: 651799 - DNA, 25 bp, Rattus norvegicus
gcagcagcaggcatccgagcagggt

SEQ ID NO: 651800 - DNA, 25 bp, Rattus norvegicus
cagtgtcacccacgccgccaagtgt

SEQ ID NO: 651801 - DNA, 25 bp, Rattus norvegicus
cttagcgcttctgggaaagagggcc

SEQ ID NO: 651802 - DNA, 25 bp, Rattus norvegicus
ggctggcgcagtcagtgtcacccac

SEQ ID NO: 651803 - DNA, 25 bp, Rattus norvegicus
gcaaacttagcgcttctgggaaaga

SEQ ID NO: 651804 - DNA, 25 bp, Rattus norvegicus
agtgtcctcaccacggtctcccgta

SEQ ID NO: 651805 - DNA, 25 bp, Rattus norvegicus
gtctcccgtagacctgcgccacctg

SEQ ID NO: 651806 - DNA, 25 bp, Rattus norvegicus
caggacacccgggacctggcgacca

SEQ ID NO: 651807 - DNA, 25 bp, Rattus norvegicus
gtcgagtgttatggcgcctcctcag

SEQ ID NO: 651808 - DNA, 25 bp, Rattus norvegicus
agtctcctgggagccaacggaaagc

SEQ ID NO: 651809 - DNA, 25 bp, Rattus norvegicus
agccaacggaaagcgggaagcgctc

SEQ ID NO: 651810 - DNA, 25 bp, Rattus norvegicus
cgggaagcgctcgtccaatcagcgc

SEQ ID NO: 651811 - DNA, 25 bp, Rattus norvegicus
agccactttccgctctaggagcaaa

SEQ ID NO: 651812 - DNA, 25 bp, Rattus norvegicus
gctctaggagcaaacttagcgcttc

SEQ ID NO: 651813 - DNA, 25 bp, Rattus norvegicus
tcctcagtctcctgggagccaacgg

SEQ ID NO: 651814 - DNA, 25 bp, Rattus norvegicus
tgaggcaccgcacccaacacggaga

SEQ ID NO: 651815 - DNA, 25 bp, Rattus norvegicus
ccagagaaggtgtagcgcaccgtca

SEQ ID NO: 651816 - DNA, 25 bp, Rattus norvegicus
gcgcactgtgccactgatgcctagg

SEQ ID NO: 651817 - DNA, 25 bp, Rattus norvegicus
tgacacgttccaggcatacgagctg

SEQ ID NO: 651818 - DNA, 25 bp, Rattus norvegicus
caggcactgcagtgtgaactccaga

SEQ ID NO: 651819 - DNA, 25 bp, Rattus norvegicus
ggctactgcagcacaaatccgagtt

SEQ ID NO: 651820 - DNA, 25 bp, Rattus norvegicus
acgggtcatcgcctgcgttaaacac

SEQ ID NO: 651821 - DNA, 25 bp, Rattus norvegicus
gttaaacaccttgacctgcgccagt

SEQ ID NO: 651822 - DNA, 25 bp, Rattus norvegicus
gggtctgcaggatcgtccatccatg

SEQ ID NO: 651823 - DNA, 25 bp, Rattus norvegicus
ctagacgctcagctgccggcaactt

SEQ ID NO: 651824 - DNA, 25 bp, Rattus norvegicus
cagcagggcagaatcagggcctttt

SEQ ID NO: 651825 - DNA, 25 bp, Rattus norvegicus
tggcgctcttcaaggcagcttcccg

SEQ ID NO: 651826 - DNA, 25 bp, Rattus norvegicus
gccggcaacttctctaagcgcaact

SEQ ID NO: 651827 - DNA, 25 bp, Rattus norvegicus
ccatccatgtccgagaggcagctga

SEQ ID NO: 651828 - DNA, 25 bp, Rattus norvegicus
cacttgtgtgggcttctgttgtgtg

SEQ ID NO: 651829 - DNA, 25 bp, Rattus norvegicus
ggctgagtgtgagaatttgagaagt

SEQ ID NO: 651830 - DNA, 25 bp, Rattus norvegicus
caccctcaaggtgacgcggatgggt

SEQ ID NO: 651831 - DNA, 25 bp, Rattus norvegicus
ctgcaccctcaaggtgacgcggatg

SEQ ID NO: 651832 - DNA, 25 bp, Rattus norvegicus
tctcgagcctgcaccctcaaggtga

SEQ ID NO: 651833 - DNA, 25 bp, Rattus norvegicus
agaaacttcataactctcgagcctg

SEQ ID NO: 651834 - DNA, 25 bp, Rattus norvegicus
agctctctgtggaaaagaaacttca

SEQ ID NO: 651835 - DNA, 25 bp, Rattus norvegicus
cccgagctctctgtggaaaagaaac

SEQ ID NO: 651836 - DNA, 25 bp, Rattus norvegicus
tgtgtgcagcgagctgcgcctcacc

SEQ ID NO: 651837 - DNA, 25 bp, Rattus norvegicus
gcttctgttgtgtgcagcgagctgc

SEQ ID NO: 651838 - DNA, 25 bp, Rattus norvegicus
acctccaagcccacttgtgtgggct

SEQ ID NO: 651839 - DNA, 25 bp, Rattus norvegicus
tgctcaccgcacctgcacctccaag

SEQ ID NO: 651840 - DNA, 25 bp, Rattus norvegicus
cacgagcgccacgatgctcaccgca

SEQ ID NO: 651841 - DNA, 25 bp, Rattus norvegicus
tctgttgtgtgcagcgagctgcgcc

SEQ ID NO: 651842 - DNA, 25 bp, Rattus norvegicus
gggacaacatcctgaagtacgacga

SEQ ID NO: 651843 - DNA, 25 bp, Rattus norvegicus
gacgacgtgagggacaacatcctga

SEQ ID NO: 651844 - DNA, 25 bp, Rattus norvegicus
catcctgaagtacgacgaggaaggc

SEQ ID NO: 651845 - DNA, 25 bp, Rattus norvegicus
tatgcccacaatacgcccggacttg

SEQ ID NO: 651846 - DNA, 25 bp, Rattus norvegicus
cacacacctgctgtgcagacgaaca

SEQ ID NO: 651847 - DNA, 25 bp, Rattus norvegicus
ctcatcgaccctgaggacgacgtga

SEQ ID NO: 651848 - DNA, 25 bp, Rattus norvegicus
atccaaccatcgtatgcccacaata

SEQ ID NO: 651849 - DNA, 25 bp, Rattus norvegicus
acgttcacacccgtgcgcacgtatg

SEQ ID NO: 651850 - DNA, 25 bp, Rattus norvegicus
acgtatgcacagacgcgcccgtgtg

SEQ ID NO: 651851 - DNA, 25 bp, Rattus norvegicus
gacgcgcccgtgtgtgcacacactg

SEQ ID NO: 651852 - DNA, 25 bp, Rattus norvegicus
tcctgctgttcgttgtgtggatgaa

SEQ ID NO: 651853 - DNA, 25 bp, Rattus norvegicus
aaaggagagacacacgaagcagctg

SEQ ID NO: 651854 - DNA, 25 bp, Rattus norvegicus
cgaagcagctgctcatcgaccctga

SEQ ID NO: 651855 - DNA, 25 bp, Rattus norvegicus
tgcagacgaacacagaacccacacg

SEQ ID NO: 651856 - DNA, 25 bp, Rattus norvegicus
cagcgtggcccggatagcgccggtg

SEQ ID NO: 651857 - DNA, 25 bp, Rattus norvegicus
ctcggcttcgcgtgccaccctgcca

SEQ ID NO: 651858 - DNA, 25 bp, Rattus norvegicus
aacacggtgggcgtcagcgtggccc

SEQ ID NO: 651859 - DNA, 25 bp, Rattus norvegicus
cgcggggccaacacggtgggcgtca

SEQ ID NO: 651860 - DNA, 25 bp, Rattus norvegicus
aagttctggatgttggtcgggttct

SEQ ID NO: 651861 - DNA, 25 bp, Rattus norvegicus
tcacctgggggcagctggaagttct

SEQ ID NO: 651862 - DNA, 25 bp, Rattus norvegicus
ccgcctggtgcacccgccctcgcct

SEQ ID NO: 651863 - DNA, 25 bp, Rattus norvegicus
tcctggaacgccagggccgcctggt

SEQ ID NO: 651864 - DNA, 25 bp, Rattus norvegicus
gaacttcctggaacgccagggccgc

SEQ ID NO: 651865 - DNA, 25 bp, Rattus norvegicus
ccagaacttcctggaacgccagggc

SEQ ID NO: 651866 - DNA, 25 bp, Rattus norvegicus
cagaatgcagcccagaacttcctgg

SEQ ID NO: 651867 - DNA, 25 bp, Rattus norvegicus
gtgccaccctgccaggacacagccc

SEQ ID NO: 651868 - DNA, 25 bp, Rattus norvegicus
tcgcgtgccaccctgccaggacaca

SEQ ID NO: 651869 - DNA, 25 bp, Rattus norvegicus
ggggtcccgggagcaggctccggca

SEQ ID NO: 651870 - DNA, 25 bp, Rattus norvegicus
gctgcggccggctcttaaaagacgc

SEQ ID NO: 651871 - DNA, 25 bp, Rattus norvegicus
cggctcttaaaagacgcggccaatg

SEQ ID NO: 651872 - DNA, 25 bp, Rattus norvegicus
aaagacgcggccaatggctgcgagc

SEQ ID NO: 651873 - DNA, 25 bp, Rattus norvegicus
ccaatggctgcgagcgccagaggcc

SEQ ID NO: 651874 - DNA, 25 bp, Rattus norvegicus
gcggggttcgccctttgtctgcacc

SEQ ID NO: 651875 - DNA, 25 bp, Rattus norvegicus
tgtctgcacccttccaaaatggctg

SEQ ID NO: 651876 - DNA, 25 bp, Rattus norvegicus
ctgcacccttccaaaatggctgcgg

SEQ ID NO: 651877 - DNA, 25 bp, Rattus norvegicus
gagtcctggcaagaaaacgctttcg

SEQ ID NO: 651878 - DNA, 25 bp, Rattus norvegicus
ctggcaagaaaacgctttcggggcg

SEQ ID NO: 651879 - DNA, 25 bp, Rattus norvegicus
gccacgggtcagctcctctgactta

SEQ ID NO: 651880 - DNA, 25 bp, Rattus norvegicus
ctcctctgacttacagcggttagta

SEQ ID NO: 651881 - DNA, 25 bp, Rattus norvegicus
cttacagcggttagtaagagggccg

SEQ ID NO: 651882 - DNA, 25 bp, Rattus norvegicus
cgtgcacaccgaagctggacatccg

SEQ ID NO: 651883 - DNA, 25 bp, Rattus norvegicus
taagagggccgtgcacaccgaagct

SEQ ID NO: 651884 - DNA, 25 bp, Rattus norvegicus
gtgcagcctccagccgagctagggc

SEQ ID NO: 651885 - DNA, 25 bp, Rattus norvegicus
ctttggtagccaccgcccgtcgagt

SEQ ID NO: 651886 - DNA, 25 bp, Rattus norvegicus
ggtcctgcgcgctctctttggaacc

SEQ ID NO: 651887 - DNA, 25 bp, Rattus norvegicus
ggcggctttgaagccgtagacctcc

SEQ ID NO: 651888 - DNA, 25 bp, Rattus norvegicus
tcgctaaaggtagcggccagtcgcc

SEQ ID NO: 651889 - DNA, 25 bp, Rattus norvegicus
tccaccgtggcgctcgctaaaggta

SEQ ID NO: 651890 - DNA, 25 bp, Rattus norvegicus
cccgagtttgcaaacagtggcctca

SEQ ID NO: 651891 - DNA, 25 bp, Rattus norvegicus
tcagactccggctaagcgcctcgtt

SEQ ID NO: 651892 - DNA, 25 bp, Rattus norvegicus
gcagccaggagccaatgggctacga

SEQ ID NO: 651893 - DNA, 25 bp, Rattus norvegicus
catatttaaagggagccggcagcca

SEQ ID NO: 651894 - DNA, 25 bp, Rattus norvegicus
cggcgcggccatatttaaagggagc

SEQ ID NO: 651895 - DNA, 25 bp, Rattus norvegicus
agcaggtcctggctggcagctccta

SEQ ID NO: 651896 - DNA, 25 bp, Rattus norvegicus
ctgggaagacccacagaagcaggtc

SEQ ID NO: 651897 - DNA, 25 bp, Rattus norvegicus
ggctgccctgctctgaacttgaact

SEQ ID NO: 651898 - DNA, 25 bp, Rattus norvegicus
caactttgccggaggcattggcagc

SEQ ID NO: 651899 - DNA, 25 bp, Rattus norvegicus
aatgatcacgggctgagtccgcacc

SEQ ID NO: 651900 - DNA, 25 bp, Rattus norvegicus
gacaggaacaaagccggggcacagc

SEQ ID NO: 651901 - DNA, 25 bp, Rattus norvegicus
accctgaagcacgtcgcgcggtgtc

SEQ ID NO: 651902 - DNA, 25 bp, Rattus norvegicus
gccagcagatagcacggcctccagg

SEQ ID NO: 651903 - DNA, 25 bp, Rattus norvegicus
aggggaggtcactcagcagaccatc

SEQ ID NO: 651904 - DNA, 25 bp, Rattus norvegicus
cccgcgctgcggagaatgggcacct

SEQ ID NO: 651905 - DNA, 25 bp, Rattus norvegicus
ctcgagcgcgcattggcgataggca

SEQ ID NO: 651906 - DNA, 25 bp, Rattus norvegicus
catcactgcggacgcgcgagctcaa

SEQ ID NO: 651907 - DNA, 25 bp, Rattus norvegicus
cgcggtcgtagctcatcactgcgga

SEQ ID NO: 651908 - DNA, 25 bp, Rattus norvegicus
ctccacttggaagaggtggccgtcg

SEQ ID NO: 651909 - DNA, 25 bp, Rattus norvegicus
tcctgcgcgtactccacttggaaga

SEQ ID NO: 651910 - DNA, 25 bp, Rattus norvegicus
tcaccgcggtggagcccttcttgac

SEQ ID NO: 651911 - DNA, 25 bp, Rattus norvegicus
ccctggaaagcctgcgccaactttg

SEQ ID NO: 651912 - DNA, 25 bp, Rattus norvegicus
tgagcgcagtgtgcctcttcatctg

SEQ ID NO: 651913 - DNA, 25 bp, Rattus norvegicus
cgcagtgtgcctcttcatctgcgca

SEQ ID NO: 651914 - DNA, 25 bp, Rattus norvegicus
agcgcagtgtgcctcttcatctgcg

SEQ ID NO: 651915 - DNA, 25 bp, Rattus norvegicus
cgcacgtgagcgcagtgtgcctctt

SEQ ID NO: 651916 - DNA, 25 bp, Rattus norvegicus
gcacgtgagcgcagtgtgcctcttc

SEQ ID NO: 651917 - DNA, 25 bp, Rattus norvegicus
ttcatctgcgcacgtgagcacagtg

SEQ ID NO: 651918 - DNA, 25 bp, Rattus norvegicus
catctgcgcacgtgagcgcagtgtg

SEQ ID NO: 651919 - DNA, 25 bp, Rattus norvegicus
cacagtgtgcctcttcatctgcgca

SEQ ID NO: 651920 - DNA, 25 bp, Rattus norvegicus
tcatctgcgcacgtgagcacagtgt

SEQ ID NO: 651921 - DNA, 25 bp, Rattus norvegicus
cagtgtgcctcttcatctgcgcacg

SEQ ID NO: 651922 - DNA, 25 bp, Rattus norvegicus
catctgcgcacgtgagcacagtgtg

SEQ ID NO: 651923 - DNA, 25 bp, Rattus norvegicus
gcacagtgtgcctcttcatctgcgc

SEQ ID NO: 651924 - DNA, 25 bp, Rattus norvegicus
agcacagtgtgcctcttcatctgcg

SEQ ID NO: 651925 - DNA, 25 bp, Rattus norvegicus
tctgcgcacgtgagcgcagtgtgcc

SEQ ID NO: 651926 - DNA, 25 bp, Rattus norvegicus
caagagcccgggctagagtccagga

SEQ ID NO: 651927 - DNA, 25 bp, Rattus norvegicus
aggtttctagagctcctctcccaag

SEQ ID NO: 651928 - DNA, 25 bp, Rattus norvegicus
tgcagcgagagcaaagccgagctcc

SEQ ID NO: 651929 - DNA, 25 bp, Rattus norvegicus
tcgaagcgctaagccctattgccca

SEQ ID NO: 651930 - DNA, 25 bp, Rattus norvegicus
tttacccacgaggaagtcggagatg

SEQ ID NO: 651931 - DNA, 25 bp, Rattus norvegicus
cggaggctcgaatccgccacgaagg

SEQ ID NO: 651932 - DNA, 25 bp, Rattus norvegicus
cgccacgaaggcgagcatgaccagc

SEQ ID NO: 651933 - DNA, 25 bp, Rattus norvegicus
ttgcccagtactgtggccacgatga

SEQ ID NO: 651934 - DNA, 25 bp, Rattus norvegicus
gtggccacgatgagcagcgccatga

SEQ ID NO: 651935 - DNA, 25 bp, Rattus norvegicus
tcgctgcaccttgcgccttgctgag

SEQ ID NO: 651936 - DNA, 25 bp, Rattus norvegicus
cgctcgtgagcctaatctttgccgg

SEQ ID NO: 651937 - DNA, 25 bp, Rattus norvegicus
cgcgcccaccattctaaggtttcta

SEQ ID NO: 651938 - DNA, 25 bp, Rattus norvegicus
ccagagtgcccgacgcgttcatcag

SEQ ID NO: 651939 - DNA, 25 bp, Rattus norvegicus
gaagccaccctaggtcgaagcgcta

SEQ ID NO: 651940 - DNA, 25 bp, Rattus norvegicus
ccgtgtgacacctaggccgcggcag

SEQ ID NO: 651941 - DNA, 25 bp, Rattus norvegicus
gagaacgtgatccgcatggctccgc

SEQ ID NO: 651942 - DNA, 25 bp, Rattus norvegicus
ccgcacttccgcttgggtgtcagag

SEQ ID NO: 651943 - DNA, 25 bp, Rattus norvegicus
tctcgggaaggcccgtgtgacacct

SEQ ID NO: 651944 - DNA, 25 bp, Rattus norvegicus
gagggactccggcattctcgcctcg

SEQ ID NO: 651945 - DNA, 25 bp, Rattus norvegicus
ggcattctcgcctcgctgggcgagc

SEQ ID NO: 651946 - DNA, 25 bp, Rattus norvegicus
cgagccgcgcatccctttggggcgc

SEQ ID NO: 651947 - DNA, 25 bp, Rattus norvegicus
ttggtgcccgcgtggcctcaggtcc

SEQ ID NO: 651948 - DNA, 25 bp, Rattus norvegicus
cctcaggtccgagggccacagcgga

SEQ ID NO: 651949 - DNA, 25 bp, Rattus norvegicus
ccacagcggagtcggagcgcgcctt

SEQ ID NO: 651950 - DNA, 25 bp, Rattus norvegicus
tcggagcgcgccttctgatcgctcg

SEQ ID NO: 651951 - DNA, 25 bp, Rattus norvegicus
cttctgatcgctcgcgccggcgagg

SEQ ID NO: 651952 - DNA, 25 bp, Rattus norvegicus
ccttgctcttccgagactctgcggc

SEQ ID NO: 651953 - DNA, 25 bp, Rattus norvegicus
acttccgcttgggtgtcagagggtt

SEQ ID NO: 651954 - DNA, 25 bp, Rattus norvegicus
cacgtaggtgccacccagcgcagga

SEQ ID NO: 651955 - DNA, 25 bp, Rattus norvegicus
caaagatggcgaagcggtcccttac

SEQ ID NO: 651956 - DNA, 25 bp, Rattus norvegicus
acttcgatattggagatggcgtaga

SEQ ID NO: 651957 - DNA, 25 bp, Rattus norvegicus
cagcgtgagtattcctcggtgcaga

SEQ ID NO: 651958 - DNA, 25 bp, Rattus norvegicus
ctttcttggaccctgcccagcgtga

SEQ ID NO: 651959 - DNA, 25 bp, Rattus norvegicus
agcgcacatgcttctctttcttgga

SEQ ID NO: 651960 - DNA, 25 bp, Rattus norvegicus
ggtcccttacctcaaagcgcacatg

SEQ ID NO: 651961 - DNA, 25 bp, Rattus norvegicus
gtccatgttacgcaggtcagggccg

SEQ ID NO: 651962 - DNA, 25 bp, Rattus norvegicus
cctcgtgtacaggttgtccatgtta

SEQ ID NO: 651963 - DNA, 25 bp, Rattus norvegicus
ttggcgctctccatcctcgtgtaca

SEQ ID NO: 651964 - DNA, 25 bp, Rattus norvegicus
caggtcagtgaaggtgaagaactcc

SEQ ID NO: 651965 - DNA, 25 bp, Rattus norvegicus
tagaggttctctcgctgcacgtagg

SEQ ID NO: 651966 - DNA, 25 bp, Rattus norvegicus
ggcgtagaaatacttgtagaggttc

SEQ ID NO: 651967 - DNA, 25 bp, Rattus norvegicus
aagaactccttgaggcccttggcgc

SEQ ID NO: 651968 - DNA, 25 bp, Rattus norvegicus
gcagccgcgggctgaccaagcgtat

SEQ ID NO: 651969 - DNA, 25 bp, Rattus norvegicus
atgacgacttcaggcgctctgttcc

SEQ ID NO: 651970 - DNA, 25 bp, Rattus norvegicus
ttttttcaggatgacgacttcaggc

SEQ ID NO: 651971 - DNA, 25 bp, Rattus norvegicus
cgggcctcgctctgttttttcagga

SEQ ID NO: 651972 - DNA, 25 bp, Rattus norvegicus
gggacattgcgcacgcgacgccaca

SEQ ID NO: 651973 - DNA, 25 bp, Rattus norvegicus
ttctgcctgtcgaggcggctaggac

SEQ ID NO: 651974 - DNA, 25 bp, Rattus norvegicus
cggagatccttctgcctgtcgaggc

SEQ ID NO: 651975 - DNA, 25 bp, Rattus norvegicus
aggcgctctgttcccgagcctggtt

SEQ ID NO: 651976 - DNA, 25 bp, Rattus norvegicus
gtcctgcgcacaccagctggctttg

SEQ ID NO: 651977 - DNA, 25 bp, Rattus norvegicus
gcagcacgcgggaccgagtcagtcc

SEQ ID NO: 651978 - DNA, 25 bp, Rattus norvegicus
acggaactcaatcggcggcgagagc

SEQ ID NO: 651979 - DNA, 25 bp, Rattus norvegicus
gccgcgcggctgacggaactcaatc

SEQ ID NO: 651980 - DNA, 25 bp, Rattus norvegicus
cacagcaacaataggggccgctctg

SEQ ID NO: 651981 - DNA, 25 bp, Rattus norvegicus
tgaccaagcgtatgggtgggacatt

SEQ ID NO: 651982 - DNA, 25 bp, Rattus norvegicus
aagagccgccgtaggctgcaggaca

SEQ ID NO: 651983 - DNA, 25 bp, Rattus norvegicus
tgttcagtcgtttgaggtccacgta

SEQ ID NO: 651984 - DNA, 25 bp, Rattus norvegicus
tagacctctccagtgatcggcgcca

SEQ ID NO: 651985 - DNA, 25 bp, Rattus norvegicus
atcggcgccacatcgggaagtgcca

SEQ ID NO: 651986 - DNA, 25 bp, Rattus norvegicus
ccgtggaaagtcatggtgcgtccca

SEQ ID NO: 651987 - DNA, 25 bp, Rattus norvegicus
tggtgcgtcccattagcaggtcagc

SEQ ID NO: 651988 - DNA, 25 bp, Rattus norvegicus
gtcccattagcaggtcagcggtgca

SEQ ID NO: 651989 - DNA, 25 bp, Rattus norvegicus
aagctgatgcccgtggtgttcagtc

SEQ ID NO: 651990 - DNA, 25 bp, Rattus norvegicus
tttgaggtccacgtacttgcccaga

SEQ ID NO: 651991 - DNA, 25 bp, Rattus norvegicus
cacgtacttgcccagagccttgata

SEQ ID NO: 651992 - DNA, 25 bp, Rattus norvegicus
agagccttgatacctttgatgcagc

SEQ ID NO: 651993 - DNA, 25 bp, Rattus norvegicus
tttgatgcagccacggacagagcct

SEQ ID NO: 651994 - DNA, 25 bp, Rattus norvegicus
acagagcctcccgaggggaagagcc

SEQ ID NO: 651995 - DNA, 25 bp, Rattus norvegicus
tcagcggtgcagctgaagctgatgc

SEQ ID NO: 651996 - DNA, 25 bp, Rattus norvegicus
gccgcgctcacctggattgtctggt

SEQ ID NO: 651997 - DNA, 25 bp, Rattus norvegicus
cagcgtcctggaaagggcacctgct

SEQ ID NO: 651998 - DNA, 25 bp, Rattus norvegicus
cagggatcccggacttacggctgcc

SEQ ID NO: 651999 - DNA, 25 bp, Rattus norvegicus
ggtccgcaacccaggcacttcattg

SEQ ID NO: 652000 - DNA, 25 bp, Rattus norvegicus
attggctcttccagaggcacgtgca

SEQ ID NO: 652001 - DNA, 25 bp, Rattus norvegicus
cgtcagggtccttctaagtccatca

SEQ ID NO: 652002 - DNA, 25 bp, Rattus norvegicus
tgggagagacagtccgtacttactt

SEQ ID NO: 652003 - DNA, 25 bp, Rattus norvegicus
atggtgtaactagctcctccgcgcc

SEQ ID NO: 652004 - DNA, 25 bp, Rattus norvegicus
gattgtctggttgggatctccgccc

SEQ ID NO: 652005 - DNA, 25 bp, Rattus norvegicus
caaccagcttgcagtagaggtcctc

SEQ ID NO: 652006 - DNA, 25 bp, Rattus norvegicus
agcgccctccgccaggttgaagtag

SEQ ID NO: 652007 - DNA, 25 bp, Rattus norvegicus
gcgcttcgccattttcctcctgggg

SEQ ID NO: 652008 - DNA, 25 bp, Rattus norvegicus
gcaggagcccggcaagtctagtttg

SEQ ID NO: 652009 - DNA, 25 bp, Rattus norvegicus
tacttactttcccagcaccggaagc

SEQ ID NO: 652010 - DNA, 25 bp, Rattus norvegicus
tgcccgggcttctttgcaccggaag

SEQ ID NO: 652011 - DNA, 25 bp, Rattus norvegicus
ctcgcgttggtgttttctaagatcg

SEQ ID NO: 652012 - DNA, 25 bp, Rattus norvegicus
cccttccaaggattgtgcttccgtc

SEQ ID NO: 652013 - DNA, 25 bp, Rattus norvegicus
tgatgtccgcgttccagcacaactg

SEQ ID NO: 652014 - DNA, 25 bp, Rattus norvegicus
ggacaagtgcaacccaactggacga

SEQ ID NO: 652015 - DNA, 25 bp, Rattus norvegicus
gcggagccaggaatctatgtgcttt

SEQ ID NO: 652016 - DNA, 25 bp, Rattus norvegicus
cagtcagcacgacccggaagcattt

SEQ ID NO: 652017 - DNA, 25 bp, Rattus norvegicus
tgcggcctgactagccttatgatcc

SEQ ID NO: 652018 - DNA, 25 bp, Rattus norvegicus
ttatgatccgcgtggtgactctgca

SEQ ID NO: 652019 - DNA, 25 bp, Rattus norvegicus
gagctgcggcatcatctttcctgtg

SEQ ID NO: 652020 - DNA, 25 bp, Rattus norvegicus
taagcctctgagtgcctggttctcg

SEQ ID NO: 652021 - DNA, 25 bp, Rattus norvegicus
ttttctttactcagctccgcgagca

SEQ ID NO: 652022 - DNA, 25 bp, Rattus norvegicus
ggctcgcaaataggcctccgggatg

SEQ ID NO: 652023 - DNA, 25 bp, Rattus norvegicus
gcggtccagctcatttgacgcgaca

SEQ ID NO: 652024 - DNA, 25 bp, Rattus norvegicus
ctcggtggccgtccatctagggaga

SEQ ID NO: 652025 - DNA, 25 bp, Rattus norvegicus
catctagggagatgttgttgagaaa

SEQ ID NO: 652026 - DNA, 25 bp, Rattus norvegicus
ggcttctcgcctcccggacccaggc

SEQ ID NO: 652027 - DNA, 25 bp, Rattus norvegicus
ctagggagatgttgttgagaaagaa

SEQ ID NO: 652028 - DNA, 25 bp, Rattus norvegicus
aggcagtggcttctcgcctcccgga

SEQ ID NO: 652029 - DNA, 25 bp, Rattus norvegicus
tccatctagggagatgttgttgaga

SEQ ID NO: 652030 - DNA, 25 bp, Rattus norvegicus
cgtccatctagggagatgttgttga

SEQ ID NO: 652031 - DNA, 25 bp, Rattus norvegicus
gccgtccatctagggagatgttgtt

SEQ ID NO: 652032 - DNA, 25 bp, Rattus norvegicus
ggccgtccatctagggagatgttgt

SEQ ID NO: 652033 - DNA, 25 bp, Rattus norvegicus
tggccgtccatctagggagatgttg

SEQ ID NO: 652034 - DNA, 25 bp, Rattus norvegicus
gtggccgtccatctagggagatgtt

SEQ ID NO: 652035 - DNA, 25 bp, Rattus norvegicus
tcggtggccgtccatctagggagat

SEQ ID NO: 652036 - DNA, 25 bp, Rattus norvegicus
gcctcccggacccaggctcggtggc

SEQ ID NO: 652037 - DNA, 25 bp, Rattus norvegicus
atgttgttgagaaagaagagggcgg

SEQ ID NO: 652038 - DNA, 25 bp, Rattus norvegicus
tttgagcccttccattggctagcga

SEQ ID NO: 652039 - DNA, 25 bp, Rattus norvegicus
ttccattggctagcgaggtgtgccg

SEQ ID NO: 652040 - DNA, 25 bp, Rattus norvegicus
ccttccattggctagcgaggtgtgc

SEQ ID NO: 652041 - DNA, 25 bp, Rattus norvegicus
cccttccattggctagcgaggtgtg

SEQ ID NO: 652042 - DNA, 25 bp, Rattus norvegicus
agcccttccattggctagcgaggtg

SEQ ID NO: 652043 - DNA, 25 bp, Rattus norvegicus
tgagcccttccattggctagcgagg

SEQ ID NO: 652044 - DNA, 25 bp, Rattus norvegicus
ttgagcccttccattggctagcgag

SEQ ID NO: 652045 - DNA, 25 bp, Rattus norvegicus
ctttgagcccttccattggctagcg

SEQ ID NO: 652046 - DNA, 25 bp, Rattus norvegicus
cctttgagcccttccattggctagc

SEQ ID NO: 652047 - DNA, 25 bp, Rattus norvegicus
ccctttgagcccttccattggctag

SEQ ID NO: 652048 - DNA, 25 bp, Rattus norvegicus
cttccattggctagcgaggtgtgcc

SEQ ID NO: 652049 - DNA, 25 bp, Rattus norvegicus
gccagcatgcaaatgagcccccttt

SEQ ID NO: 652050 - DNA, 25 bp, Rattus norvegicus
attggctagcgaggtgtgccgcgcc

SEQ ID NO: 652051 - DNA, 25 bp, Rattus norvegicus
gcatgcaaatgagccccctttgagc

SEQ ID NO: 652052 - DNA, 25 bp, Rattus norvegicus
gcgcgcctgcatgcaaatgaaaccc

SEQ ID NO: 652053 - DNA, 25 bp, Rattus norvegicus
agaggttcctgttcattggccgcgg

SEQ ID NO: 652054 - DNA, 25 bp, Rattus norvegicus
ttcagaggttcctgttcattggccg

SEQ ID NO: 652055 - DNA, 25 bp, Rattus norvegicus
tgcaaatataattcagaggttcctg

SEQ ID NO: 652056 - DNA, 25 bp, Rattus norvegicus
cgcccatatgcaaatataattcaga

SEQ ID NO: 652057 - DNA, 25 bp, Rattus norvegicus
ggcccgcccatatgcaaatataatt

SEQ ID NO: 652058 - DNA, 25 bp, Rattus norvegicus
cgcggcccgcccatatgcaaatata

SEQ ID NO: 652059 - DNA, 25 bp, Rattus norvegicus
gcaaatatagttccggggtctctgc

SEQ ID NO: 652060 - DNA, 25 bp, Rattus norvegicus
tatgcaaatatagttccggggtctc

SEQ ID NO: 652061 - DNA, 25 bp, Rattus norvegicus
gcgcgtctatatgcaaatatagttc

SEQ ID NO: 652062 - DNA, 25 bp, Rattus norvegicus
tgcggcgcgtctatatgcaaatata

SEQ ID NO: 652063 - DNA, 25 bp, Rattus norvegicus
gctgcggcgcgtctatatgcaaata

SEQ ID NO: 652064 - DNA, 25 bp, Rattus norvegicus
aggttcctgttcattggccgcggcg

SEQ ID NO: 652065 - DNA, 25 bp, Rattus norvegicus
tgcatgcaaatgaaaccccgtcact

SEQ ID NO: 652066 - DNA, 25 bp, Rattus norvegicus
tactcaccgaaggtggtcctgcggc

SEQ ID NO: 652067 - DNA, 25 bp, Rattus norvegicus
ctcacacgaaggcaggtacggcagc

SEQ ID NO: 652068 - DNA, 25 bp, Rattus norvegicus
ccggctcccgaagaatgcagaaagg

SEQ ID NO: 652069 - DNA, 25 bp, Rattus norvegicus
gcagaaagggtccagaatcggcgta

SEQ ID NO: 652070 - DNA, 25 bp, Rattus norvegicus
cagcgccaagctctggtacattttt

SEQ ID NO: 652071 - DNA, 25 bp, Rattus norvegicus
gtacatttttccctgagcgagcttg

SEQ ID NO: 652072 - DNA, 25 bp, Rattus norvegicus
gcgagcttgacctgcagagaagaaa

SEQ ID NO: 652073 - DNA, 25 bp, Rattus norvegicus
tccatcagctattgcgctcgccgtg

SEQ ID NO: 652074 - DNA, 25 bp, Rattus norvegicus
acttttctgagtcggttcaccggca

SEQ ID NO: 652075 - DNA, 25 bp, Rattus norvegicus
gaacacggtccttgcttcgagcaga

SEQ ID NO: 652076 - DNA, 25 bp, Rattus norvegicus
ttcgagcagagatcaccggccaaaa

SEQ ID NO: 652077 - DNA, 25 bp, Rattus norvegicus
aaccctcacaggaaagcgcggcgct

SEQ ID NO: 652078 - DNA, 25 bp, Rattus norvegicus
tcccgagcgcagtcggatactgttc

SEQ ID NO: 652079 - DNA, 25 bp, Rattus norvegicus
cggaaaccgcttgcgtccagctaga

SEQ ID NO: 652080 - DNA, 25 bp, Rattus norvegicus
tcttgccgcccaggtcgtgctgcag

SEQ ID NO: 652081 - DNA, 25 bp, Rattus norvegicus
gcgcgctaaactaggcgctgcagga

SEQ ID NO: 652082 - DNA, 25 bp, Rattus norvegicus
cgctgcaggagacagcacagacctc

SEQ ID NO: 652083 - DNA, 25 bp, Rattus norvegicus
gacagcacagacctcggaacactga

SEQ ID NO: 652084 - DNA, 25 bp, Rattus norvegicus
ctcggaacactgaagccggagtccc

SEQ ID NO: 652085 - DNA, 25 bp, Rattus norvegicus
ggctgcctggccatgacactccaga

SEQ ID NO: 652086 - DNA, 25 bp, Rattus norvegicus
atgacactccagatggccgcagggc

SEQ ID NO: 652087 - DNA, 25 bp, Rattus norvegicus
atggctctgcgcagcgtggcgatct

SEQ ID NO: 652088 - DNA, 25 bp, Rattus norvegicus
cagcgcccggcgcagagcattaaac

SEQ ID NO: 652089 - DNA, 25 bp, Rattus norvegicus
aacgcttcgttgtaatccaggatgc

SEQ ID NO: 652090 - DNA, 25 bp, Rattus norvegicus
tgtaatccaggatgcgcttgcgctc

SEQ ID NO: 652091 - DNA, 25 bp, Rattus norvegicus
gttggccgccatgcgccgagccttg

SEQ ID NO: 652092 - DNA, 25 bp, Rattus norvegicus
agccttggaccgtgcgggccgctca

SEQ ID NO: 652093 - DNA, 25 bp, Rattus norvegicus
ggcggtgtccctgcgcgctaaacta

SEQ ID NO: 652094 - DNA, 25 bp, Rattus norvegicus
ggcacgcttgggtccaaaactcgga

SEQ ID NO: 652095 - DNA, 25 bp, Rattus norvegicus
tcgcgtgtaaagcaccggctaggtc

SEQ ID NO: 652096 - DNA, 25 bp, Rattus norvegicus
gacggtgaggccactacgcccatct

SEQ ID NO: 652097 - DNA, 25 bp, Rattus norvegicus
gccgcacgagatgcctcctaggttt

SEQ ID NO: 652098 - DNA, 25 bp, Rattus norvegicus
ggtttgccagactcggaccttctga

SEQ ID NO: 652099 - DNA, 25 bp, Rattus norvegicus
ccgagggatccggatgcagaattca

SEQ ID NO: 652100 - DNA, 25 bp, Rattus norvegicus
tcactgccggctacacgtgagggaa

SEQ ID NO: 652101 - DNA, 25 bp, Rattus norvegicus
cccaggttaaaggtctgcgagtgta

SEQ ID NO: 652102 - DNA, 25 bp, Rattus norvegicus
tctggtgagtgacagatccagtgtc

SEQ ID NO: 652103 - DNA, 25 bp, Rattus norvegicus
ctgtggtgtctgttgctaagtctga

SEQ ID NO: 652104 - DNA, 25 bp, Rattus norvegicus
gtccctgaggctccgtaccttcatg

SEQ ID NO: 652105 - DNA, 25 bp, Rattus norvegicus
gtaccttcatgcagctctcgggcgc

SEQ ID NO: 652106 - DNA, 25 bp, Rattus norvegicus
ccttgctgcctgattggcacgcttg

SEQ ID NO: 652107 - DNA, 25 bp, Rattus norvegicus
gccgcttcgccagaaccagagggaa

SEQ ID NO: 652108 - DNA, 25 bp, Rattus norvegicus
attggctccttggtattcgctctgc

SEQ ID NO: 652109 - DNA, 25 bp, Rattus norvegicus
gtcatcacctccattgaacgtcgct

SEQ ID NO: 652110 - DNA, 25 bp, Rattus norvegicus
tgaacgtcgcttcgatctgcacagc

SEQ ID NO: 652111 - DNA, 25 bp, Rattus norvegicus
tctgcacagctaccagagcgggctc

SEQ ID NO: 652112 - DNA, 25 bp, Rattus norvegicus
attgccagctcctatgacatcgccg

SEQ ID NO: 652113 - DNA, 25 bp, Rattus norvegicus
cttaccttcgtcagctactttgggg

SEQ ID NO: 652114 - DNA, 25 bp, Rattus norvegicus
ggggcaacggacacaaaccgcgctg

SEQ ID NO: 652115 - DNA, 25 bp, Rattus norvegicus
ggctttatcaataccgtcatcacct

SEQ ID NO: 652116 - DNA, 25 bp, Rattus norvegicus
tgcgctggtcctaggaattggctcc

SEQ ID NO: 652117 - DNA, 25 bp, Rattus norvegicus
agagcgggctcattgccagctccta

SEQ ID NO: 652118 - DNA, 25 bp, Rattus norvegicus
catttcacggctggccgctacgagg

SEQ ID NO: 652119 - DNA, 25 bp, Rattus norvegicus
cgctacgaggtagagatagacgacg

SEQ ID NO: 652120 - DNA, 25 bp, Rattus norvegicus
aacggacacaaaccgcgctggctgg

SEQ ID NO: 652121 - DNA, 25 bp, Rattus norvegicus
gcctgtctttgccttaccttcgtca

SEQ ID NO: 652122 - DNA, 25 bp, Rattus norvegicus
ttccacgccatgctgggccacaagc

SEQ ID NO: 652123 - DNA, 25 bp, Rattus norvegicus
tgctgcaccggaagccagccttcgt

SEQ ID NO: 652124 - DNA, 25 bp, Rattus norvegicus
gaagccagccttcgttgcgcctgcg

SEQ ID NO: 652125 - DNA, 25 bp, Rattus norvegicus
cggcgttcccgagccctgcgagtgc

SEQ ID NO: 652126 - DNA, 25 bp, Rattus norvegicus
agtgcgcgccctccacaccaagtgc

SEQ ID NO: 652127 - DNA, 25 bp, Rattus norvegicus
cctgcgcggagcctgtagtagcctt

SEQ ID NO: 652128 - DNA, 25 bp, Rattus norvegicus
gcggagcctgtagtagcctttctcg

SEQ ID NO: 652129 - DNA, 25 bp, Rattus norvegicus
gcctgtagtagcctttctcgcgccg

SEQ ID NO: 652130 - DNA, 25 bp, Rattus norvegicus
agtagcctttctcgcgccgggcgct

SEQ ID NO: 652131 - DNA, 25 bp, Rattus norvegicus
cccaggcgataagggcccaggcgag

SEQ ID NO: 652132 - DNA, 25 bp, Rattus norvegicus
agccctgctgaggagacggtggtgt

SEQ ID NO: 652133 - DNA, 25 bp, Rattus norvegicus
agccctgaagtggaagtgtgcctct

SEQ ID NO: 652134 - DNA, 25 bp, Rattus norvegicus
ggaagtgtgcctcttccacgccatg

SEQ ID NO: 652135 - DNA, 25 bp, Rattus norvegicus
tgtgcctcttccacgccatgctggg

SEQ ID NO: 652136 - DNA, 25 bp, Rattus norvegicus
ggctcccgactgttcactaacaggt

SEQ ID NO: 652137 - DNA, 25 bp, Rattus norvegicus
tcccgactgttcactaacaggtagg

SEQ ID NO: 652138 - DNA, 25 bp, Rattus norvegicus
tggggaggcaaccaggccctgaggc

SEQ ID NO: 652139 - DNA, 25 bp, Rattus norvegicus
ttcactaacaggtagggcgctcctg

SEQ ID NO: 652140 - DNA, 25 bp, Rattus norvegicus
cactaacaggtagggcgctcctgac

SEQ ID NO: 652141 - DNA, 25 bp, Rattus norvegicus
cgctcctgacggctggggacgacca

SEQ ID NO: 652142 - DNA, 25 bp, Rattus norvegicus
ctcctgacggctggggacgaccaga

SEQ ID NO: 652143 - DNA, 25 bp, Rattus norvegicus
ctggggacgaccagagcgccaggct

SEQ ID NO: 652144 - DNA, 25 bp, Rattus norvegicus
tgcggctctcaaggcgggcccagct

SEQ ID NO: 652145 - DNA, 25 bp, Rattus norvegicus
tcaaggcgggcccagctgccggctt

SEQ ID NO: 652146 - DNA, 25 bp, Rattus norvegicus
ccagctgccggcttcatctgcaggg

SEQ ID NO: 652147 - DNA, 25 bp, Rattus norvegicus
ttcatctgcagggccagcggctgct

SEQ ID NO: 652148 - DNA, 25 bp, Rattus norvegicus
ctgggacagcgctggattccggccc

SEQ ID NO: 652149 - DNA, 25 bp, Rattus norvegicus
tgttcactaacaggtagggcgctcc

SEQ ID NO: 652150 - DNA, 25 bp, Rattus norvegicus
cctgcttgtcgagtatggacgaccc

SEQ ID NO: 652151 - DNA, 25 bp, Rattus norvegicus
tagctccaagcgtagctgccttttg

SEQ ID NO: 652152 - DNA, 25 bp, Rattus norvegicus
cagggcctcatcctgcgtaggtggc

SEQ ID NO: 652153 - DNA, 25 bp, Rattus norvegicus
tcgtctgtgggtgacgtcagaacgc

SEQ ID NO: 652154 - DNA, 25 bp, Rattus norvegicus
ccaggccgtgtctgaccgagcgctg

SEQ ID NO: 652155 - DNA, 25 bp, Rattus norvegicus
cgataggacgactccaggccgcgat

SEQ ID NO: 652156 - DNA, 25 bp, Rattus norvegicus
ccaagcctgttccaggtgcggcgca

SEQ ID NO: 652157 - DNA, 25 bp, Rattus norvegicus
tacgaccgatgaggacacgggcgac

SEQ ID NO: 652158 - DNA, 25 bp, Rattus norvegicus
gccaagcggatgatacgaccgatga

SEQ ID NO: 652159 - DNA, 25 bp, Rattus norvegicus
atggacgacccggactgcgattcca

SEQ ID NO: 652160 - DNA, 25 bp, Rattus norvegicus
gcgggtcctcctgcttgtcgagtat

SEQ ID NO: 652161 - DNA, 25 bp, Rattus norvegicus
tcctttccgcagaaagcgggtcctc

SEQ ID NO: 652162 - DNA, 25 bp, Rattus norvegicus
gactccgcgcaacggcggaaactga

SEQ ID NO: 652163 - DNA, 25 bp, Rattus norvegicus
actgcgattccacctgggaggagga

SEQ ID NO: 652164 - DNA, 25 bp, Rattus norvegicus
tcttcgtcgcctcgctccagttgac

SEQ ID NO: 652165 - DNA, 25 bp, Rattus norvegicus
cgctaaggaccctcgaggacatctg

SEQ ID NO: 652166 - DNA, 25 bp, Rattus norvegicus
atctgtggcagcctcttcgtcgcct

SEQ ID NO: 652167 - DNA, 25 bp, Rattus norvegicus
ggctcagagcgcctgccagccatga

SEQ ID NO: 652168 - DNA, 25 bp, Rattus norvegicus
agagcgcctgccagccatgaccgga

SEQ ID NO: 652169 - DNA, 25 bp, Rattus norvegicus
agccatgaccggagcgcctgcccta

SEQ ID NO: 652170 - DNA, 25 bp, Rattus norvegicus
atagggccggacgtcgaaccgtgca

SEQ ID NO: 652171 - DNA, 25 bp, Rattus norvegicus
tcgaaccgtgcagcctgggacagac

SEQ ID NO: 652172 - DNA, 25 bp, Rattus norvegicus
cgtgcagcctgggacagacaactca

SEQ ID NO: 652173 - DNA, 25 bp, Rattus norvegicus
agcctgggacagacaactcaagccc

SEQ ID NO: 652174 - DNA, 25 bp, Rattus norvegicus
caacccttgagtccggccgctaagg

SEQ ID NO: 652175 - DNA, 25 bp, Rattus norvegicus
agtccggccgctaaggaccctcgag

SEQ ID NO: 652176 - DNA, 25 bp, Rattus norvegicus
aggaccctcgaggacatctgtggca

SEQ ID NO: 652177 - DNA, 25 bp, Rattus norvegicus
cgaggacatctgtggcagcctcttc

SEQ ID NO: 652178 - DNA, 25 bp, Rattus norvegicus
ggcatactgttgaagcggtcctcca

SEQ ID NO: 652179 - DNA, 25 bp, Rattus norvegicus
gtcgtgaagctcagtcccggctctc

SEQ ID NO: 652180 - DNA, 25 bp, Rattus norvegicus
ctcaggtcggtggtcgtgaagctca

SEQ ID NO: 652181 - DNA, 25 bp, Rattus norvegicus
tgcgtgtactccacttccgtcatct

SEQ ID NO: 652182 - DNA, 25 bp, Rattus norvegicus
atgtgctgcagctgcgtgtactcca

SEQ ID NO: 652183 - DNA, 25 bp, Rattus norvegicus
ctccatgtgcgagtagaggatgtgc

SEQ ID NO: 652184 - DNA, 25 bp, Rattus norvegicus
tccgccgcctccatgtgcgagtaga

SEQ ID NO: 652185 - DNA, 25 bp, Rattus norvegicus
cgggcacagcactgggtacacaggc

SEQ ID NO: 652186 - DNA, 25 bp, Rattus norvegicus
tcgacgtggcccaagcacggcgcgt

SEQ ID NO: 652187 - DNA, 25 bp, Rattus norvegicus
ctcctggaagtcgacgtggcccaag

SEQ ID NO: 652188 - DNA, 25 bp, Rattus norvegicus
gtcctccaggcggacgcgtacggtc

SEQ ID NO: 652189 - DNA, 25 bp, Rattus norvegicus
cggctcggccggcatactgttgaag

SEQ ID NO: 652190 - DNA, 25 bp, Rattus norvegicus
agcagcatcatacgcagctcctgga

SEQ ID NO: 652191 - DNA, 25 bp, Rattus norvegicus
ttgttgagcgccacgcccgactcgg

SEQ ID NO: 652192 - DNA, 25 bp, Rattus norvegicus
agcctaatcggctgggcacgcttga

SEQ ID NO: 652193 - DNA, 25 bp, Rattus norvegicus
tgttctaccagtgttgaggacctgc

SEQ ID NO: 652194 - DNA, 25 bp, Rattus norvegicus
ccgaatcacaatcaagggctccaca

SEQ ID NO: 652195 - DNA, 25 bp, Rattus norvegicus
gccaaccagtgattagacagaaacc

SEQ ID NO: 652196 - DNA, 25 bp, Rattus norvegicus
agaaaccagacgcaggcaggccgcc

SEQ ID NO: 652197 - DNA, 25 bp, Rattus norvegicus
tgcaccgctcgccaggattaggctg

SEQ ID NO: 652198 - DNA, 25 bp, Rattus norvegicus
cccgatcctaaatgccgttcaggtc

SEQ ID NO: 652199 - DNA, 25 bp, Rattus norvegicus
cagggatcccgcagccatttccaga

SEQ ID NO: 652200 - DNA, 25 bp, Rattus norvegicus
taccactgatctagagcggagacca

SEQ ID NO: 652201 - DNA, 25 bp, Rattus norvegicus
ggagaccagcgagactaccgtccta

SEQ ID NO: 652202 - DNA, 25 bp, Rattus norvegicus
gcgcggcaagcggaagaaatcaacc

SEQ ID NO: 652203 - DNA, 25 bp, Rattus norvegicus
atcaaccggccaccgagacgtggtg

SEQ ID NO: 652204 - DNA, 25 bp, Rattus norvegicus
atcgcgtcctaccacgagtgttcta

SEQ ID NO: 652205 - DNA, 25 bp, Rattus norvegicus
ttcttacacgcatgcgccaccgggg

SEQ ID NO: 652206 - DNA, 25 bp, Rattus norvegicus
gatactagccttttgactctcgcgc

SEQ ID NO: 652207 - DNA, 25 bp, Rattus norvegicus
tccggaggccttgtctttgagacta

SEQ ID NO: 652208 - DNA, 25 bp, Rattus norvegicus
taaaggccgggaatgccctcatctc

SEQ ID NO: 652209 - DNA, 25 bp, Rattus norvegicus
agctgggaccttcatttcgaactca

SEQ ID NO: 652210 - DNA, 25 bp, Rattus norvegicus
gccatcttgcgcagaagcgatacta

SEQ ID NO: 652211 - DNA, 25 bp, Rattus norvegicus
tggcctctattacaacgttcccgga

SEQ ID NO: 652212 - DNA, 25 bp, Rattus norvegicus
gaccctagtatcctgtgaccgcctg

SEQ ID NO: 652213 - DNA, 25 bp, Rattus norvegicus
tgccagttcgcatctcgagatctta

SEQ ID NO: 652214 - DNA, 25 bp, Rattus norvegicus
ttacgatctcgcgataggtgtctgg

SEQ ID NO: 652215 - DNA, 25 bp, Rattus norvegicus
ggcagacgccggtgtatctacctcc

SEQ ID NO: 652216 - DNA, 25 bp, Rattus norvegicus
ctgccgggaccggaatagttattgc

SEQ ID NO: 652217 - DNA, 25 bp, Rattus norvegicus
cggaataaatcctaggagctcgctc

SEQ ID NO: 652218 - DNA, 25 bp, Rattus norvegicus
ttctgacgctgacctggcctctatt

SEQ ID NO: 652219 - DNA, 25 bp, Rattus norvegicus
gcccagcagattcgcgagaggattc

SEQ ID NO: 652220 - DNA, 25 bp, Rattus norvegicus
ttgagataggccaccaagcgccgca

SEQ ID NO: 652221 - DNA, 25 bp, Rattus norvegicus
tcagtcttgccttgttctgggtccc

SEQ ID NO: 652222 - DNA, 25 bp, Rattus norvegicus
gggtcatcttcccaaagctccggtc

SEQ ID NO: 652223 - DNA, 25 bp, Rattus norvegicus
actaccatctcttctttcctagggg

SEQ ID NO: 652224 - DNA, 25 bp, Rattus norvegicus
tgcatgcttcttggcgcttcaacta

SEQ ID NO: 652225 - DNA, 25 bp, Rattus norvegicus
ctacgcgtacccacaggcctgaagg

SEQ ID NO: 652226 - DNA, 25 bp, Rattus norvegicus
cttcgcgctgtccaatcagagggga

SEQ ID NO: 652227 - DNA, 25 bp, Rattus norvegicus
ctcccactcgtattggcttcgtttt

SEQ ID NO: 652228 - DNA, 25 bp, Rattus norvegicus
taacagtgcggcttactgccctgcg

SEQ ID NO: 652229 - DNA, 25 bp, Rattus norvegicus
cccgggagcctgctataacagtgcg

SEQ ID NO: 652230 - DNA, 25 bp, Rattus norvegicus
agcgacttgagctcggccatgaccc

SEQ ID NO: 652231 - DNA, 25 bp, Rattus norvegicus
gaggtcgccaccaggacccgatgca

SEQ ID NO: 652232 - DNA, 25 bp, Rattus norvegicus
cttggctagcagaagcgtggcgatt

SEQ ID NO: 652233 - DNA, 25 bp, Rattus norvegicus
cccatccgcaggatctaagcgctga

SEQ ID NO: 652234 - DNA, 25 bp, Rattus norvegicus
tgcttacgtcaggtaggcgaaaccc

SEQ ID NO: 652235 - DNA, 25 bp, Rattus norvegicus
cctccaggccctgaagcgagggaca

SEQ ID NO: 652236 - DNA, 25 bp, Rattus norvegicus
tcagccaactgaggcgcacagcagc

SEQ ID NO: 652237 - DNA, 25 bp, Rattus norvegicus
acccgcaggagtttgaacgccactg

SEQ ID NO: 652238 - DNA, 25 bp, Rattus norvegicus
aggctccagtcatgaagttggaatc

SEQ ID NO: 652239 - DNA, 25 bp, Rattus norvegicus
gcgagctcgagcgttgcaaactcaa

SEQ ID NO: 652240 - DNA, 25 bp, Rattus norvegicus
tcacaacaaggagggcgcatcgagc

SEQ ID NO: 652241 - DNA, 25 bp, Rattus norvegicus
ttcatgtgcctggaccttcctgcct

SEQ ID NO: 652242 - DNA, 25 bp, Rattus norvegicus
tgctcttcaggctccgagaggactg

SEQ ID NO: 652243 - DNA, 25 bp, Rattus norvegicus
tacccggagaccagcggtcctctga

SEQ ID NO: 652244 - DNA, 25 bp, Rattus norvegicus
aatgagaaattcgtcctcggccacc

SEQ ID NO: 652245 - DNA, 25 bp, Rattus norvegicus
ttgcaaactcaacctgaagcggctg

SEQ ID NO: 652246 - DNA, 25 bp, Rattus norvegicus
ctgcagtgaccacgacttcgagata

SEQ ID NO: 652247 - DNA, 25 bp, Rattus norvegicus
ccacgcttctggactcggaggtagc

SEQ ID NO: 652248 - DNA, 25 bp, Rattus norvegicus
atagaaacgagctctgggcaggcta

SEQ ID NO: 652249 - DNA, 25 bp, Rattus norvegicus
agcacctttgcggggcgaggatcca

SEQ ID NO: 652250 - DNA, 25 bp, Rattus norvegicus
aggatccaggttccgcggatggaaa

SEQ ID NO: 652251 - DNA, 25 bp, Rattus norvegicus
gtagcaagcgcgctcctaaacccaa

SEQ ID NO: 652252 - DNA, 25 bp, Rattus norvegicus
cgctcctaaacccaaggctctttgg

SEQ ID NO: 652253 - DNA, 25 bp, Rattus norvegicus
ccaaggctctttgggagtgccttcc

SEQ ID NO: 652254 - DNA, 25 bp, Rattus norvegicus
cgcgcatcctccgaatagaaacgag

SEQ ID NO: 652255 - DNA, 25 bp, Rattus norvegicus
tcctccgaatagaaacgagctctgg

SEQ ID NO: 652256 - DNA, 25 bp, Rattus norvegicus
acgagctctgggcaggctagaattg

SEQ ID NO: 652257 - DNA, 25 bp, Rattus norvegicus
gaattggagatgtcttagaccactg

SEQ ID NO: 652258 - DNA, 25 bp, Rattus norvegicus
tgtcttagaccactgcaaaagccga

SEQ ID NO: 652259 - DNA, 25 bp, Rattus norvegicus
tagaccactgcaaaagccgagggtg

SEQ ID NO: 652260 - DNA, 25 bp, Rattus norvegicus
gtctgctgtcctgggagcacctttg

SEQ ID NO: 652261 - DNA, 25 bp, Rattus norvegicus
gcaggctagaattggagatgtctta

SEQ ID NO: 652262 - DNA, 25 bp, Rattus norvegicus
ccgccgctcctttctcatggaaatg

SEQ ID NO: 652263 - DNA, 25 bp, Rattus norvegicus
agagactgcttttcatctcagaaca

SEQ ID NO: 652264 - DNA, 25 bp, Rattus norvegicus
gggagtcagactcccgcagtgccga

SEQ ID NO: 652265 - DNA, 25 bp, Rattus norvegicus
cgacccgggcctcaggaatttgcct

SEQ ID NO: 652266 - DNA, 25 bp, Rattus norvegicus
gaatttgcctggcttcctcggcgct

SEQ ID NO: 652267 - DNA, 25 bp, Rattus norvegicus
cttctcgccggccagaggcgtaaga

SEQ ID NO: 652268 - DNA, 25 bp, Rattus norvegicus
tcggcggcttgtaaaaagagactgc

SEQ ID NO: 652269 - DNA, 25 bp, Rattus norvegicus
ctttattttttcaccgcattcgcgc

SEQ ID NO: 652270 - DNA, 25 bp, Rattus norvegicus
agcgggctctgcacccgtcagaaga

SEQ ID NO: 652271 - DNA, 25 bp, Rattus norvegicus
ggaccagggcaacactgccagctta

SEQ ID NO: 652272 - DNA, 25 bp, Rattus norvegicus
cccgccgcgaagaagctggagcgtt

SEQ ID NO: 652273 - DNA, 25 bp, Rattus norvegicus
ttctcatggaaatggcccgggagcc

SEQ ID NO: 652274 - DNA, 25 bp, Rattus norvegicus
tctatacaattaaggcacgcggtga

SEQ ID NO: 652275 - DNA, 25 bp, Rattus norvegicus
tcacagcggaccttgatttaatgtc

SEQ ID NO: 652276 - DNA, 25 bp, Rattus norvegicus
ggtatgcagatcttcggccctgaga

SEQ ID NO: 652277 - DNA, 25 bp, Rattus norvegicus
ttcggccctgagatccaagccctga

SEQ ID NO: 652278 - DNA, 25 bp, Rattus norvegicus
gacccagaccgcaacctctgttttg

SEQ ID NO: 652279 - DNA, 25 bp, Rattus norvegicus
gatttcgcgcttgggactcagtctc

SEQ ID NO: 652280 - DNA, 25 bp, Rattus norvegicus
gcatcgtcgctccttgcccaggatt

SEQ ID NO: 652281 - DNA, 25 bp, Rattus norvegicus
gggagcgccgtcaagtcgccactac

SEQ ID NO: 652282 - DNA, 25 bp, Rattus norvegicus
atgcttcatgaacagcgcggcgcgg

SEQ ID NO: 652283 - DNA, 25 bp, Rattus norvegicus
ctggtggccgacatgcttcatgaac

SEQ ID NO: 652284 - DNA, 25 bp, Rattus norvegicus
tttgccttgtccacggtctggtctc

SEQ ID NO: 652285 - DNA, 25 bp, Rattus norvegicus
ccagcccggcctggtatgcagatct

SEQ ID NO: 652286 - DNA, 25 bp, Rattus norvegicus
tttgatcacagccaagccaagcgac

SEQ ID NO: 652287 - DNA, 25 bp, Rattus norvegicus
cggcctccagatctcccataatttg

SEQ ID NO: 652288 - DNA, 25 bp, Rattus norvegicus
aatgctacccggagggctttgcgac

SEQ ID NO: 652289 - DNA, 25 bp, Rattus norvegicus
ttactatgcgaagaatgctacccgg

SEQ ID NO: 652290 - DNA, 25 bp, Rattus norvegicus
cccgctggagcctttgctgccagag

SEQ ID NO: 652291 - DNA, 25 bp, Rattus norvegicus
tcgcacgcctggcagccagaaaatc

SEQ ID NO: 652292 - DNA, 25 bp, Rattus norvegicus
cctggcagccagaaaatcggccgca

SEQ ID NO: 652293 - DNA, 25 bp, Rattus norvegicus
gaaaatcggccgcagcagctaagtc

SEQ ID NO: 652294 - DNA, 25 bp, Rattus norvegicus
tcggccgcagcagctaagtccaagc

SEQ ID NO: 652295 - DNA, 25 bp, Rattus norvegicus
cgcagcagctaagtccaagccgtca

SEQ ID NO: 652296 - DNA, 25 bp, Rattus norvegicus
taagtccaagccgtcatcccatgag

SEQ ID NO: 652297 - DNA, 25 bp, Rattus norvegicus
catcccatgagccacccgaggctgg

SEQ ID NO: 652298 - DNA, 25 bp, Rattus norvegicus
caggtccggagagccacgcaggaca

SEQ ID NO: 652299 - DNA, 25 bp, Rattus norvegicus
ccacgcaggacacccggactcacca

SEQ ID NO: 652300 - DNA, 25 bp, Rattus norvegicus
ctgcagagcgcagagcgcaagaagt

SEQ ID NO: 652301 - DNA, 25 bp, Rattus norvegicus
ggccggagcaagagcccatggtatt

SEQ ID NO: 652302 - DNA, 25 bp, Rattus norvegicus
tggtattcacttcgcccgctggagc

SEQ ID NO: 652303 - DNA, 25 bp, Rattus norvegicus
gcaagagcccatggtattcacttcg

SEQ ID NO: 652304 - DNA, 25 bp, Rattus norvegicus
ttagagcccggaggcgactaaatta

SEQ ID NO: 652305 - DNA, 25 bp, Rattus norvegicus
ctggcaccgtcactgaagccttttc

SEQ ID NO: 652306 - DNA, 25 bp, Rattus norvegicus
ttctaaccggcctggccaagagttc

SEQ ID NO: 652307 - DNA, 25 bp, Rattus norvegicus
tccacagcaccgaaggaagtttcta

SEQ ID NO: 652308 - DNA, 25 bp, Rattus norvegicus
tgaaagcaccctggcgaaactgcgg

SEQ ID NO: 652309 - DNA, 25 bp, Rattus norvegicus
gataactttgcgtccgagcctcggc

SEQ ID NO: 652310 - DNA, 25 bp, Rattus norvegicus
tagcagtcgccaccagataactttg

SEQ ID NO: 652311 - DNA, 25 bp, Rattus norvegicus
gcggctccagtcctccttagtagca

SEQ ID NO: 652312 - DNA, 25 bp, Rattus norvegicus
tcttaaagatgctgcacccggcgcg

SEQ ID NO: 652313 - DNA, 25 bp, Rattus norvegicus
agcccagagagaagactagctactc

SEQ ID NO: 652314 - DNA, 25 bp, Rattus norvegicus
cacaggcgcacaggatagaaaaaga

SEQ ID NO: 652315 - DNA, 25 bp, Rattus norvegicus
agcagcgttattgcaacggcccatc

SEQ ID NO: 652316 - DNA, 25 bp, Rattus norvegicus
agagttctccttgcgcctttagagc

SEQ ID NO: 652317 - DNA, 25 bp, Rattus norvegicus
ggaggtcgctgctaacaagtgcaaa

SEQ ID NO: 652318 - DNA, 25 bp, Rattus norvegicus
tggcgcgtagccaaaggcccagaca

SEQ ID NO: 652319 - DNA, 25 bp, Rattus norvegicus
ggtaaccctgcaaaactggcgcgta

SEQ ID NO: 652320 - DNA, 25 bp, Rattus norvegicus
tgctgcatcgcccacgcagaggtaa

SEQ ID NO: 652321 - DNA, 25 bp, Rattus norvegicus
gatctacgtggcctttcagcgctca

SEQ ID NO: 652322 - DNA, 25 bp, Rattus norvegicus
ggaggcctcccatgagcccttgcaa

SEQ ID NO: 652323 - DNA, 25 bp, Rattus norvegicus
gcccttgcaaagagcgacgtagccg

SEQ ID NO: 652324 - DNA, 25 bp, Rattus norvegicus
ggatctgagtgcctagtccagcttg

SEQ ID NO: 652325 - DNA, 25 bp, Rattus norvegicus
gttccaggaccttccggttctcaga

SEQ ID NO: 652326 - DNA, 25 bp, Rattus norvegicus
atcctcgattctgcggccttaggcc

SEQ ID NO: 652327 - DNA, 25 bp, Rattus norvegicus
ggttctccagtccttcgacccgtga

SEQ ID NO: 652328 - DNA, 25 bp, Rattus norvegicus
ttgccgcccttcagcatagcggttg

SEQ ID NO: 652329 - DNA, 25 bp, Rattus norvegicus
cgcagcccggatgcagtatcagatc

SEQ ID NO: 652330 - DNA, 25 bp, Rattus norvegicus
gctcgctcacagaggcggaagtacg

SEQ ID NO: 652331 - DNA, 25 bp, Rattus norvegicus
gggatccatctgcactgccctgctg

SEQ ID NO: 652332 - DNA, 25 bp, Rattus norvegicus
cagtcattccatcaatctcggcgtc

SEQ ID NO: 652333 - DNA, 25 bp, Rattus norvegicus
atggcgcaccgagcgggctctagac

SEQ ID NO: 652334 - DNA, 25 bp, Rattus norvegicus
gccggtccctaggagcagcagcagc

SEQ ID NO: 652335 - DNA, 25 bp, Rattus norvegicus
ttaccaggcaagaggccggtcccta

SEQ ID NO: 652336 - DNA, 25 bp, Rattus norvegicus
ttcgcgtttcgaaacttaccaggca

SEQ ID NO: 652337 - DNA, 25 bp, Rattus norvegicus
acattcagggactgtgcccgcgagg

SEQ ID NO: 652338 - DNA, 25 bp, Rattus norvegicus
gactgcggtgcacattcagggactg

SEQ ID NO: 652339 - DNA, 25 bp, Rattus norvegicus
tctcggcgtcttttggaaatgagcc

SEQ ID NO: 652340 - DNA, 25 bp, Rattus norvegicus
gtgtcctcctgaggctcgcgacttg

SEQ ID NO: 652341 - DNA, 25 bp, Rattus norvegicus
tcctgttcggcactggctaactccg

SEQ ID NO: 652342 - DNA, 25 bp, Rattus norvegicus
taaagtttccgtgtcctcctgaggc

SEQ ID NO: 652343 - DNA, 25 bp, Rattus norvegicus
gacccgcgcgcacccaacttcatgc

SEQ ID NO: 652344 - DNA, 25 bp, Rattus norvegicus
gggctgtgtactccgcagtcattcc

SEQ ID NO: 652345 - DNA, 25 bp, Rattus norvegicus
tggtctccagccctaaccctgccgg

SEQ ID NO: 652346 - DNA, 25 bp, Rattus norvegicus
ctctagcacgttgtataggaaattc

SEQ ID NO: 652347 - DNA, 25 bp, Rattus norvegicus
ccacgaagcccaccttgagcttttt

SEQ ID NO: 652348 - DNA, 25 bp, Rattus norvegicus
tagatgaacgcccaaccgcggggcc

SEQ ID NO: 652349 - DNA, 25 bp, Rattus norvegicus
ggctgcggctctgcgttcctacctg

SEQ ID NO: 652350 - DNA, 25 bp, Rattus norvegicus
acatcgcgggccacttacacgtagg

SEQ ID NO: 652351 - DNA, 25 bp, Rattus norvegicus
gggtacacgccaccgttgcgcgact

SEQ ID NO: 652352 - DNA, 25 bp, Rattus norvegicus
agcccgcgatgagtagcgcgccgtc

SEQ ID NO: 652353 - DNA, 25 bp, Rattus norvegicus
tgctcaaaacgctgccgcgcttggg

SEQ ID NO: 652354 - DNA, 25 bp, Rattus norvegicus
cgtccgcggcttgctcaaaacgctg

SEQ ID NO: 652355 - DNA, 25 bp, Rattus norvegicus
cttgcggtagaaggcgttgcgcttt

SEQ ID NO: 652356 - DNA, 25 bp, Rattus norvegicus
ataggaaattctgcagcttgcggta

SEQ ID NO: 652357 - DNA, 25 bp, Rattus norvegicus
ggggccgctctagcacgttgtatag

SEQ ID NO: 652358 - DNA, 25 bp, Rattus norvegicus
acacgtaggcgtggtagatgaacgc

SEQ ID NO: 652359 - DNA, 25 bp, Rattus norvegicus
cgttgcgcgacttctgcaccatggt

SEQ ID NO: 652360 - DNA, 25 bp, Rattus norvegicus
catgtcgcgcacggcgaagcggcct

SEQ ID NO: 652361 - DNA, 25 bp, Rattus norvegicus
tgcgccttctgtgcggacttggtga

SEQ ID NO: 652362 - DNA, 25 bp, Rattus norvegicus
ggggagagatgcgtaaactgcgggg

SEQ ID NO: 652363 - DNA, 25 bp, Rattus norvegicus
ctgtgcggacttggtgaccttgccg

SEQ ID NO: 652364 - DNA, 25 bp, Rattus norvegicus
gacttggtgaccttgccggcgccgc

SEQ ID NO: 652365 - DNA, 25 bp, Rattus norvegicus
gctcttcttctccacgttcttgatg

SEQ ID NO: 652366 - DNA, 25 bp, Rattus norvegicus
ttctccacgttcttgatgacgccca

SEQ ID NO: 652367 - DNA, 25 bp, Rattus norvegicus
tccacgttcttgatgacgcccacgg

SEQ ID NO: 652368 - DNA, 25 bp, Rattus norvegicus
acgttcttgatgacgcccacggcca

SEQ ID NO: 652369 - DNA, 25 bp, Rattus norvegicus
gcgcccgcgcttcacttgcccgctt

SEQ ID NO: 652370 - DNA, 25 bp, Rattus norvegicus
acagtctgccgcatgtcgcgcacgg

SEQ ID NO: 652371 - DNA, 25 bp, Rattus norvegicus
ttgcccgctttctgcgccttctgtg

SEQ ID NO: 652372 - DNA, 25 bp, Rattus norvegicus
tgatgacgcccacggccacagtctg

SEQ ID NO: 652373 - DNA, 25 bp, Rattus norvegicus
ccttctgtgcggacttggtgacctt

SEQ ID NO: 652374 - DNA, 25 bp, Rattus norvegicus
acggtgccggcgcaatgcactgcgc

SEQ ID NO: 652375 - DNA, 25 bp, Rattus norvegicus
ccgagcgagggagagaaccaccgag

SEQ ID NO: 652376 - DNA, 25 bp, Rattus norvegicus
ttgtgcgtccttacccagagccgag

SEQ ID NO: 652377 - DNA, 25 bp, Rattus norvegicus
gtccttacccagagccgaggtctca

SEQ ID NO: 652378 - DNA, 25 bp, Rattus norvegicus
acccagagccgaggtctcagtcaga

SEQ ID NO: 652379 - DNA, 25 bp, Rattus norvegicus
cgccggcggttttatctctctagga

SEQ ID NO: 652380 - DNA, 25 bp, Rattus norvegicus
cggcggttttatctctctaggaggg

SEQ ID NO: 652381 - DNA, 25 bp, Rattus norvegicus
atctctctaggagggggtccaccta

SEQ ID NO: 652382 - DNA, 25 bp, Rattus norvegicus
tccacctattgacggtgccggcgca

SEQ ID NO: 652383 - DNA, 25 bp, Rattus norvegicus
cctgcagtacggcaatgcggtaccg

SEQ ID NO: 652384 - DNA, 25 bp, Rattus norvegicus
ccggcgtaacgaggatccgagagga

SEQ ID NO: 652385 - DNA, 25 bp, Rattus norvegicus
gacgcagctgcagagatgtacccga

SEQ ID NO: 652386 - DNA, 25 bp, Rattus norvegicus
cgcacccacggacgccggccggcgt

SEQ ID NO: 652387 - DNA, 25 bp, Rattus norvegicus
agctgcagagatgtacccgagcgag

SEQ ID NO: 652388 - DNA, 25 bp, Rattus norvegicus
cgcgggcatggagccgcttagccac

SEQ ID NO: 652389 - DNA, 25 bp, Rattus norvegicus
cctctgaggagcctgttgccctcgg

SEQ ID NO: 652390 - DNA, 25 bp, Rattus norvegicus
acagcagtacgtgtgcccatgggtc

SEQ ID NO: 652391 - DNA, 25 bp, Rattus norvegicus
tctcttggatcgacaccctctacag

SEQ ID NO: 652392 - DNA, 25 bp, Rattus norvegicus
gttgccctcggggtcccaggtgcac

SEQ ID NO: 652393 - DNA, 25 bp, Rattus norvegicus
accaaggagcctctgccgcacggag

SEQ ID NO: 652394 - DNA, 25 bp, Rattus norvegicus
ttcccatctgaccaaggagcctctg

SEQ ID NO: 652395 - DNA, 25 bp, Rattus norvegicus
atgagggtcgggtttcccatctgac

SEQ ID NO: 652396 - DNA, 25 bp, Rattus norvegicus
ccctccctcctttgttgtgcgatga

SEQ ID NO: 652397 - DNA, 25 bp, Rattus norvegicus
acagctcagcactgagctctcgggg

SEQ ID NO: 652398 - DNA, 25 bp, Rattus norvegicus
gttcgccgagactgccacagctcag

SEQ ID NO: 652399 - DNA, 25 bp, Rattus norvegicus
gatccgcagcgggttcgccgagact

SEQ ID NO: 652400 - DNA, 25 bp, Rattus norvegicus
tgcacccggtcacgggcgagtgtta

SEQ ID NO: 652401 - DNA, 25 bp, Rattus norvegicus
gacaccctctacagcagtacgtgtg

SEQ ID NO: 652402 - DNA, 25 bp, Rattus norvegicus
gtgcggttaccaggcccacattctg

SEQ ID NO: 652403 - DNA, 25 bp, Rattus norvegicus
tccagcaacagctccggcggaagtg

SEQ ID NO: 652404 - DNA, 25 bp, Rattus norvegicus
ccagaccgcagaaaggcagagttca

SEQ ID NO: 652405 - DNA, 25 bp, Rattus norvegicus
agcatggcagctatcccttccagcg

SEQ ID NO: 652406 - DNA, 25 bp, Rattus norvegicus
ttcgcgctaccaccgatctaatagg

SEQ ID NO: 652407 - DNA, 25 bp, Rattus norvegicus
ctcaaatatttcatgggtggcgccc

SEQ ID NO: 652408 - DNA, 25 bp, Rattus norvegicus
acagtgttgtgcctgttgccctgca

SEQ ID NO: 652409 - DNA, 25 bp, Rattus norvegicus
tgccctgcaggaaagcaactaagta

SEQ ID NO: 652410 - DNA, 25 bp, Rattus norvegicus
cataacgcgcgtgggtcctaaagta

SEQ ID NO: 652411 - DNA, 25 bp, Rattus norvegicus
tatccttgcaaatgggcaccgtggc

SEQ ID NO: 652412 - DNA, 25 bp, Rattus norvegicus
cgtaaccttgcaccgaaacctgcta

SEQ ID NO: 652413 - DNA, 25 bp, Rattus norvegicus
tcttagggccaggagcatacaaagc

SEQ ID NO: 652414 - DNA, 25 bp, Rattus norvegicus
caaagctcctttgtctcaccgtgca

SEQ ID NO: 652415 - DNA, 25 bp, Rattus norvegicus
cgctcgtggctacccatgactacta

SEQ ID NO: 652416 - DNA, 25 bp, Rattus norvegicus
gcgcgcgcttcctagtgacgcaaca

SEQ ID NO: 652417 - DNA, 25 bp, Rattus norvegicus
gcgcccagcgcggaagcgaacggcg

SEQ ID NO: 652418 - DNA, 25 bp, Rattus norvegicus
ggagacttatttggcgcccagcgcg

SEQ ID NO: 652419 - DNA, 25 bp, Rattus norvegicus
agtgacgcaacaccgaggccgcgca

SEQ ID NO: 652420 - DNA, 25 bp, Rattus norvegicus
gcgcttcctagtgacgcaacaccga

SEQ ID NO: 652421 - DNA, 25 bp, Rattus norvegicus
ttcgctccttgttggggattcggcg

SEQ ID NO: 652422 - DNA, 25 bp, Rattus norvegicus
agctttcgctccttgttggggattc

SEQ ID NO: 652423 - DNA, 25 bp, Rattus norvegicus
cgcagctttcgctccttgttgggga

SEQ ID NO: 652424 - DNA, 25 bp, Rattus norvegicus
ggccgcagctttcgctccttgttgg

SEQ ID NO: 652425 - DNA, 25 bp, Rattus norvegicus
cccacacgggcctgctccggcgccc

SEQ ID NO: 652426 - DNA, 25 bp, Rattus norvegicus
atgccgcttacctgggcccacacgg

SEQ ID NO: 652427 - DNA, 25 bp, Rattus norvegicus
gcgggcgcgccgatgccgcttacct

SEQ ID NO: 652428 - DNA, 25 bp, Rattus norvegicus
agcggcgcgagaagcctcgccgcgg

SEQ ID NO: 652429 - DNA, 25 bp, Rattus norvegicus
tcctagtgacgcaacaccgaggccg

SEQ ID NO: 652430 - DNA, 25 bp, Rattus norvegicus
cagcctcgcggtacacaaggtccga

SEQ ID NO: 652431 - DNA, 25 bp, Rattus norvegicus
ggcaagaatccgcagagccgctctg

SEQ ID NO: 652432 - DNA, 25 bp, Rattus norvegicus
gtccgatttcattcaaccctgccta

SEQ ID NO: 652433 - DNA, 25 bp, Rattus norvegicus
tcattcaaccctgcctagggcgcgg

SEQ ID NO: 652434 - DNA, 25 bp, Rattus norvegicus
ctaccagatacggtgctggccatgg

SEQ ID NO: 652435 - DNA, 25 bp, Rattus norvegicus
ctaggctccggagccctaccagata

SEQ ID NO: 652436 - DNA, 25 bp, Rattus norvegicus
tggtaagacccaccgcagtcccatg

SEQ ID NO: 652437 - DNA, 25 bp, Rattus norvegicus
atggcttctggtaagacccaccgca

SEQ ID NO: 652438 - DNA, 25 bp, Rattus norvegicus
cctctgcttagacaatggcttctgg

SEQ ID NO: 652439 - DNA, 25 bp, Rattus norvegicus
tcggcgaggcctctgcttagacaat

SEQ ID NO: 652440 - DNA, 25 bp, Rattus norvegicus
agtcagtaacttgctcccgcgtcgg

SEQ ID NO: 652441 - DNA, 25 bp, Rattus norvegicus
gcggtacacaaggtccgacacagga

SEQ ID NO: 652442 - DNA, 25 bp, Rattus norvegicus
cggcagtttctcctccgcacttgag

SEQ ID NO: 652443 - DNA, 25 bp, Rattus norvegicus
ccgacacaggaaaacggagtcagta

SEQ ID NO: 652444 - DNA, 25 bp, Rattus norvegicus
ggtacttccggcagcatcggctctc

SEQ ID NO: 652445 - DNA, 25 bp, Rattus norvegicus
cctcagcctttctagcggtttgggg

SEQ ID NO: 652446 - DNA, 25 bp, Rattus norvegicus
tgggtcctcctcagcctttctagcg

SEQ ID NO: 652447 - DNA, 25 bp, Rattus norvegicus
ttctagactgcgaccgcagtcagga

SEQ ID NO: 652448 - DNA, 25 bp, Rattus norvegicus
gaaacccttctagactgcgaccgca

SEQ ID NO: 652449 - DNA, 25 bp, Rattus norvegicus
aagccggaaacccttctagactgcg

SEQ ID NO: 652450 - DNA, 25 bp, Rattus norvegicus
agcatcggctctccggcggaagtgc

SEQ ID NO: 652451 - DNA, 25 bp, Rattus norvegicus
gcgccggtacttccggcagcatcgg

SEQ ID NO: 652452 - DNA, 25 bp, Rattus norvegicus
cagcacgggcggagtcgcatcccag

SEQ ID NO: 652453 - DNA, 25 bp, Rattus norvegicus
acgaggatcgacagacccagcacgg

SEQ ID NO: 652454 - DNA, 25 bp, Rattus norvegicus
tgacggaacgaggatcgacagaccc

SEQ ID NO: 652455 - DNA, 25 bp, Rattus norvegicus
gtgcctgacggaacgaggatcgaca

SEQ ID NO: 652456 - DNA, 25 bp, Rattus norvegicus
gaaggttagcgcgtgagctttgctg

SEQ ID NO: 652457 - DNA, 25 bp, Rattus norvegicus
ccctcacggtgcctgacggaacgag

SEQ ID NO: 652458 - DNA, 25 bp, Rattus norvegicus
cgacttgtagcggaccggattccct

SEQ ID NO: 652459 - DNA, 25 bp, Rattus norvegicus
cgttgacgcagcagaaattaccagc

SEQ ID NO: 652460 - DNA, 25 bp, Rattus norvegicus
gccaggcgttgacgcagcagaaatt

SEQ ID NO: 652461 - DNA, 25 bp, Rattus norvegicus
gcagttctgactcttggcaaactca

SEQ ID NO: 652462 - DNA, 25 bp, Rattus norvegicus
cacctcctgcagttctgactcttgg

SEQ ID NO: 652463 - DNA, 25 bp, Rattus norvegicus
ctagctcctggggagacaatgaccc

SEQ ID NO: 652464 - DNA, 25 bp, Rattus norvegicus
acaatcggcatctagctcctgggga

SEQ ID NO: 652465 - DNA, 25 bp, Rattus norvegicus
tggaaatctaaaacaatcggcatct

SEQ ID NO: 652466 - DNA, 25 bp, Rattus norvegicus
tgcaccccagttcggcccattatta

SEQ ID NO: 652467 - DNA, 25 bp, Rattus norvegicus
agcggaccggattcccttgcgcgct

SEQ ID NO: 652468 - DNA, 25 bp, Rattus norvegicus
gcagaaattaccagctggaaaaatc

SEQ ID NO: 652469 - DNA, 25 bp, Rattus norvegicus
cgtgcgctctgagcgccgcgtctta

SEQ ID NO: 652470 - DNA, 25 bp, Rattus norvegicus
tgcccactccatcgcaccgggaggg

SEQ ID NO: 652471 - DNA, 25 bp, Rattus norvegicus
tgagcgccgcgtcttatctgcgctg

SEQ ID NO: 652472 - DNA, 25 bp, Rattus norvegicus
caacatggcggatgtgctgagcgtt

SEQ ID NO: 652473 - DNA, 25 bp, Rattus norvegicus
ctggaggccttttcgcaggccatta

SEQ ID NO: 652474 - DNA, 25 bp, Rattus norvegicus
ttgcattccgtcaaccgggacctca

SEQ ID NO: 652475 - DNA, 25 bp, Rattus norvegicus
tcatgaagcgccgtgcgacgttcag

SEQ ID NO: 652476 - DNA, 25 bp, Rattus norvegicus
agcctcccaggacgacgtcatcatg

SEQ ID NO: 652477 - DNA, 25 bp, Rattus norvegicus
caggccattagtgccatccaggcgc

SEQ ID NO: 652478 - DNA, 25 bp, Rattus norvegicus
tttatccgcagtccgctgtcacttt

SEQ ID NO: 652479 - DNA, 25 bp, Rattus norvegicus
caagtaggtactggctgaagggatc

SEQ ID NO: 652480 - DNA, 25 bp, Rattus norvegicus
gcgcacttccaggacaacttgcatt

SEQ ID NO: 652481 - DNA, 25 bp, Rattus norvegicus
cgagaaggccttcatcgcgcacttc

SEQ ID NO: 652482 - DNA, 25 bp, Rattus norvegicus
cgcaacaaagagacgctagagggcc

SEQ ID NO: 652483 - DNA, 25 bp, Rattus norvegicus
ccttaaggatggcatgcgcaacaaa

SEQ ID NO: 652484 - DNA, 25 bp, Rattus norvegicus
cagggtgttcgactgccttaaggat

SEQ ID NO: 652485 - DNA, 25 bp, Rattus norvegicus
gggatcccgcgccagtcttcctagt

SEQ ID NO: 652486 - DNA, 25 bp, Rattus norvegicus
acttagcgacttccaggcgcgctga

SEQ ID NO: 652487 - DNA, 25 bp, Rattus norvegicus
caaccagagaccacctgatgggaga

SEQ ID NO: 652488 - DNA, 25 bp, Rattus norvegicus
ccctccagtgtcttcgatcggttga

SEQ ID NO: 652489 - DNA, 25 bp, Rattus norvegicus
atagccacggataggtctcttcacc

SEQ ID NO: 652490 - DNA, 25 bp, Rattus norvegicus
catctcgattttggtatagccacgg

SEQ ID NO: 652491 - DNA, 25 bp, Rattus norvegicus
cccagccagtgatggcatctcgatt

SEQ ID NO: 652492 - DNA, 25 bp, Rattus norvegicus
tgtggggctcagaaaagtggcactc

SEQ ID NO: 652493 - DNA, 25 bp, Rattus norvegicus
ttgtcatccaactgccggtgagggt

SEQ ID NO: 652494 - DNA, 25 bp, Rattus norvegicus
gccgcacgtcggtcttgtcatccaa

SEQ ID NO: 652495 - DNA, 25 bp, Rattus norvegicus
ccaactaggagcattggctgccgca

SEQ ID NO: 652496 - DNA, 25 bp, Rattus norvegicus
gcggaaagcgcgtctcccaaactta

SEQ ID NO: 652497 - DNA, 25 bp, Rattus norvegicus
gcgatgtctgcaagcgggactcata

SEQ ID NO: 652498 - DNA, 25 bp, Rattus norvegicus
tctgcgtaagggttaaaggccacca

SEQ ID NO: 652499 - DNA, 25 bp, Rattus norvegicus
atgtctgtgcactgtccctggggac

SEQ ID NO: 652500 - DNA, 25 bp, Rattus norvegicus
actggcacactcactgggccgctgg

SEQ ID NO: 652501 - DNA, 25 bp, Rattus norvegicus
gcctccacgtggagctcggagccaa

SEQ ID NO: 652502 - DNA, 25 bp, Rattus norvegicus
tcggagccaagtgcagtgcctcctc

SEQ ID NO: 652503 - DNA, 25 bp, Rattus norvegicus
agtgcctcctccagcagatccgtga

SEQ ID NO: 652504 - DNA, 25 bp, Rattus norvegicus
agctcgctagctatgcactggcaca

SEQ ID NO: 652505 - DNA, 25 bp, Rattus norvegicus
ctggcttgtatacccgggttctatg

SEQ ID NO: 652506 - DNA, 25 bp, Rattus norvegicus
ttctatgttcttgatgacgcgcgca

SEQ ID NO: 652507 - DNA, 25 bp, Rattus norvegicus
gacgcgcgcactattgcctctactg

SEQ ID NO: 652508 - DNA, 25 bp, Rattus norvegicus
cctctactgcagcagggccaggagc

SEQ ID NO: 652509 - DNA, 25 bp, Rattus norvegicus
gccaggagcgactagtggaccgcta

SEQ ID NO: 652510 - DNA, 25 bp, Rattus norvegicus
caagttggtggcctgcgatggcaat

SEQ ID NO: 652511 - DNA, 25 bp, Rattus norvegicus
ggcaatgagattgacaccatgttca

SEQ ID NO: 652512 - DNA, 25 bp, Rattus norvegicus
accatgttcatggatcgccggcagc

SEQ ID NO: 652513 - DNA, 25 bp, Rattus norvegicus
agcagatccgtgagctgcccagcca

SEQ ID NO: 652514 - DNA, 25 bp, Rattus norvegicus
gactgcggccctacagttccactgg

SEQ ID NO: 652515 - DNA, 25 bp, Rattus norvegicus
gattacgtaaacgactgcggcccta

SEQ ID NO: 652516 - DNA, 25 bp, Rattus norvegicus
tgctagccaaggtacccacagatgg

SEQ ID NO: 652517 - DNA, 25 bp, Rattus norvegicus
cagttccactggctcgtgtgtacca

SEQ ID NO: 652518 - DNA, 25 bp, Rattus norvegicus
ctcgtgtgtaccaagctgccagctt

SEQ ID NO: 652519 - DNA, 25 bp, Rattus norvegicus
tgccagcttgcagttctcggggctt

SEQ ID NO: 652520 - DNA, 25 bp, Rattus norvegicus
gcggcgcgtccctgattacgtaaac

SEQ ID NO: 652521 - DNA, 25 bp, Rattus norvegicus
gctcctgtagtacctgcgatcccag

SEQ ID NO: 652522 - DNA, 25 bp, Rattus norvegicus
agcaccgacgccagctacacccagc

SEQ ID NO: 652523 - DNA, 25 bp, Rattus norvegicus
cccagctgccgcctgaacatggatt

SEQ ID NO: 652524 - DNA, 25 bp, Rattus norvegicus
tgccgcctgaacatggattctgcta

SEQ ID NO: 652525 - DNA, 25 bp, Rattus norvegicus
catggattctgctagccaaggtacc

SEQ ID NO: 652526 - DNA, 25 bp, Rattus norvegicus
gccaaggtacccacagatgggcagg

SEQ ID NO: 652527 - DNA, 25 bp, Rattus norvegicus
cttggctcctgtagtacctgcgatc

SEQ ID NO: 652528 - DNA, 25 bp, Rattus norvegicus
tgctggctgtagcttccggcttagt

SEQ ID NO: 652529 - DNA, 25 bp, Rattus norvegicus
cccgggatcctcaggccgagcagta

SEQ ID NO: 652530 - DNA, 25 bp, Rattus norvegicus
gtcgagcagttttactcgcggagta

SEQ ID NO: 652531 - DNA, 25 bp, Rattus norvegicus
cgtgccgataggtgagcttcctctc

SEQ ID NO: 652532 - DNA, 25 bp, Rattus norvegicus
tctcgggcggccctcaaattaggtg

SEQ ID NO: 652533 - DNA, 25 bp, Rattus norvegicus
gcgttaggttctaggcgcttgcgca

SEQ ID NO: 652534 - DNA, 25 bp, Rattus norvegicus
ccctggcacagaggctccaactatg

SEQ ID NO: 652535 - DNA, 25 bp, Rattus norvegicus
ggaccaagttctaccggagcattcg

SEQ ID NO: 652536 - DNA, 25 bp, Rattus norvegicus
atcgtcgattaggacacggcctttc

SEQ ID NO: 652537 - DNA, 25 bp, Rattus norvegicus
tgccagaactcacgtctttttccgg

SEQ ID NO: 652538 - DNA, 25 bp, Rattus norvegicus
gcttagtggctgcaggctccaccca

SEQ ID NO: 652539 - DNA, 25 bp, Rattus norvegicus
ggagtacttctacttgcctgctttc

SEQ ID NO: 652540 - DNA, 25 bp, Rattus norvegicus
tcttgctgccgccagtgttgcttcc

SEQ ID NO: 652541 - DNA, 25 bp, Rattus norvegicus
tttaacccttcccattgatcgtcga

SEQ ID NO: 652542 - DNA, 25 bp, Rattus norvegicus
tgtccggcgttcatcccgcgagcgg

SEQ ID NO: 652543 - DNA, 25 bp, Rattus norvegicus
cagcatgctggtgtaggcctgccct

SEQ ID NO: 652544 - DNA, 25 bp, Rattus norvegicus
cgactccgcggaggccagcatgctg

SEQ ID NO: 652545 - DNA, 25 bp, Rattus norvegicus
gcctttcatcgcgagccggtggcca

SEQ ID NO: 652546 - DNA, 25 bp, Rattus norvegicus
taatggagcctttcatcgcgagccg

SEQ ID NO: 652547 - DNA, 25 bp, Rattus norvegicus
aagcggcagcaggaaaaggttcata

SEQ ID NO: 652548 - DNA, 25 bp, Rattus norvegicus
cgcccgcctggtgaccacagaagga

SEQ ID NO: 652549 - DNA, 25 bp, Rattus norvegicus
tgtgcatttggagcaatcgggcctc

SEQ ID NO: 652550 - DNA, 25 bp, Rattus norvegicus
gacgtgcgtttcctgtgcatttgga

SEQ ID NO: 652551 - DNA, 25 bp, Rattus norvegicus
cctcgcaagtcaagacgtgcgtttc

SEQ ID NO: 652552 - DNA, 25 bp, Rattus norvegicus
agcagctccacctcgcaagtcaaga

SEQ ID NO: 652553 - DNA, 25 bp, Rattus norvegicus
tgaccacagaaggaacgagcagctc

SEQ ID NO: 652554 - DNA, 25 bp, Rattus norvegicus
atttggagcaatcgggcctccgggt

SEQ ID NO: 652555 - DNA, 25 bp, Rattus norvegicus
gcaggaaaaggttcataatggagcc

SEQ ID NO: 652556 - DNA, 25 bp, Rattus norvegicus
ggccaggcacgtctggggtcacagt

SEQ ID NO: 652557 - DNA, 25 bp, Rattus norvegicus
taggaagggatgcaagccgtgcacc

SEQ ID NO: 652558 - DNA, 25 bp, Rattus norvegicus
gaagggatgcaagccgtgcaccgac

SEQ ID NO: 652559 - DNA, 25 bp, Rattus norvegicus
ccatggcgtcccgaacctggcggag

SEQ ID NO: 652560 - DNA, 25 bp, Rattus norvegicus
gtcacagtggattgcaggggcgaag

SEQ ID NO: 652561 - DNA, 25 bp, Rattus norvegicus
tttcattctgctcggccgggcggcc

SEQ ID NO: 652562 - DNA, 25 bp, Rattus norvegicus
gatgtttcattctgctcggccgggc

SEQ ID NO: 652563 - DNA, 25 bp, Rattus norvegicus
cggtcctcgcacgatgtttcattct

SEQ ID NO: 652564 - DNA, 25 bp, Rattus norvegicus
accggtcctcgcacgatgtttcatt

SEQ ID NO: 652565 - DNA, 25 bp, Rattus norvegicus
gcctaccggtcctcgcacgatgttt

SEQ ID NO: 652566 - DNA, 25 bp, Rattus norvegicus
cctgccttattcaggcccgcgccta

SEQ ID NO: 652567 - DNA, 25 bp, Rattus norvegicus
aagcgcggcccctgccttattcagg

SEQ ID NO: 652568 - DNA, 25 bp, Rattus norvegicus
ccctcccaagagacaagcgcggccc

SEQ ID NO: 652569 - DNA, 25 bp, Rattus norvegicus
gcgaaggggcagcacccgcggagcc

SEQ ID NO: 652570 - DNA, 25 bp, Rattus norvegicus
agatctgtcactcgcgcctagggca

SEQ ID NO: 652571 - DNA, 25 bp, Rattus norvegicus
ccggtctgccgctccacggagagat

SEQ ID NO: 652572 - DNA, 25 bp, Rattus norvegicus
ccgtgctgcgcacatgcgcgctccc

SEQ ID NO: 652573 - DNA, 25 bp, Rattus norvegicus
cctcctacctttgacagttttactg

SEQ ID NO: 652574 - DNA, 25 bp, Rattus norvegicus
cctttgacagttttactgcgcgggg

SEQ ID NO: 652575 - DNA, 25 bp, Rattus norvegicus
ggggcgaactctcgcggtattcacg

SEQ ID NO: 652576 - DNA, 25 bp, Rattus norvegicus
tcgcggtattcacgcggccggcgct

SEQ ID NO: 652577 - DNA, 25 bp, Rattus norvegicus
tccacggagagatccgtagactagg

SEQ ID NO: 652578 - DNA, 25 bp, Rattus norvegicus
atccgtagactaggtggtactcgcc

SEQ ID NO: 652579 - DNA, 25 bp, Rattus norvegicus
agactaggtggtactcgcctccagg

SEQ ID NO: 652580 - DNA, 25 bp, Rattus norvegicus
tggtactcgcctccagggccaagag

SEQ ID NO: 652581 - DNA, 25 bp, Rattus norvegicus
cgcctccagggccaagagatctgtc

SEQ ID NO: 652582 - DNA, 25 bp, Rattus norvegicus
tccagggccaagagatctgtcactc

SEQ ID NO: 652583 - DNA, 25 bp, Rattus norvegicus
ccaagagatctgtcactcgcgccta

SEQ ID NO: 652584 - DNA, 25 bp, Rattus norvegicus
caccaggcagccagagtggcccgtg

SEQ ID NO: 652585 - DNA, 25 bp, Rattus norvegicus
ctttgcagttggcaagcgaggtccc

SEQ ID NO: 652586 - DNA, 25 bp, Rattus norvegicus
tattcctgcgcctgggttcatccca

SEQ ID NO: 652587 - DNA, 25 bp, Rattus norvegicus
ttgaccgcagctcggtgaacatgga

SEQ ID NO: 652588 - DNA, 25 bp, Rattus norvegicus
gagtctgcgcggcaaagcacctgcc

SEQ ID NO: 652589 - DNA, 25 bp, Rattus norvegicus
tgctgaggatgtccgccagagcaaa

SEQ ID NO: 652590 - DNA, 25 bp, Rattus norvegicus
tccgccagagcaaaaggcgtccttg

SEQ ID NO: 652591 - DNA, 25 bp, Rattus norvegicus
tccttgcgcacctgggtaggactcc

SEQ ID NO: 652592 - DNA, 25 bp, Rattus norvegicus
aggactccgtggaccagcctctctt

SEQ ID NO: 652593 - DNA, 25 bp, Rattus norvegicus
gctgctcacgatattcctgcgcctg

SEQ ID NO: 652594 - DNA, 25 bp, Rattus norvegicus
tcttgcaacccgctggacggccttt

SEQ ID NO: 652595 - DNA, 25 bp, Rattus norvegicus
accctttgagtctagcccgggtgct

SEQ ID NO: 652596 - DNA, 25 bp, Rattus norvegicus
gctggacggcctttgcagttggcaa

SEQ ID NO: 652597 - DNA, 25 bp, Rattus norvegicus
gggctcagctttgaccgcagctcgg

SEQ ID NO: 652598 - DNA, 25 bp, Rattus norvegicus
ctgccttggccggaaacactttgca

SEQ ID NO: 652599 - DNA, 25 bp, Rattus norvegicus
aagactttgagctttctgccgcgta

SEQ ID NO: 652600 - DNA, 25 bp, Rattus norvegicus
aagaagccgttcctgggcatgcccg

SEQ ID NO: 652601 - DNA, 25 bp, Rattus norvegicus
cagcaccgccatgaacaagaagaag

SEQ ID NO: 652602 - DNA, 25 bp, Rattus norvegicus
gtttcggccaacagcaccgccatga

SEQ ID NO: 652603 - DNA, 25 bp, Rattus norvegicus
tttttctctgtttcggccaacagca

SEQ ID NO: 652604 - DNA, 25 bp, Rattus norvegicus
tttgagctttctgccgcgtacttgc

SEQ ID NO: 652605 - DNA, 25 bp, Rattus norvegicus
agctgcgacactgggaagactttga

SEQ ID NO: 652606 - DNA, 25 bp, Rattus norvegicus
gactgcatctcttccagctgcgaca

SEQ ID NO: 652607 - DNA, 25 bp, Rattus norvegicus
gcgccagtgacgtactgactgcatc

SEQ ID NO: 652608 - DNA, 25 bp, Rattus norvegicus
tctctacttccggtgcgccagtgac

SEQ ID NO: 652609 - DNA, 25 bp, Rattus norvegicus
cggaaacactttgcaaaactacatc

SEQ ID NO: 652610 - DNA, 25 bp, Rattus norvegicus
agcaaacacgtcacgctgccttggc

SEQ ID NO: 652611 - DNA, 25 bp, Rattus norvegicus
tacatctttgatttccgcccgagga

SEQ ID NO: 652612 - DNA, 25 bp, Rattus norvegicus
atggtcgcgcaagtgctgcacacgc

SEQ ID NO: 652613 - DNA, 25 bp, Rattus norvegicus
gaaagcccgcagagcgcagtcctcg

SEQ ID NO: 652614 - DNA, 25 bp, Rattus norvegicus
aagaaggaggcctcgccagactcca

SEQ ID NO: 652615 - DNA, 25 bp, Rattus norvegicus
accttgcgcgcctgttttttgcggc

SEQ ID NO: 652616 - DNA, 25 bp, Rattus norvegicus
agggcctcttctccgccgtgttcag

SEQ ID NO: 652617 - DNA, 25 bp, Rattus norvegicus
cgtgttcagctccttccacgctttg

SEQ ID NO: 652618 - DNA, 25 bp, Rattus norvegicus
ggaagcctgttagtggaccaacgtc

SEQ ID NO: 652619 - DNA, 25 bp, Rattus norvegicus
caacgtcgggcgcacgactagccaa

SEQ ID NO: 652620 - DNA, 25 bp, Rattus norvegicus
gttcgaggctctcacccagcatctt

SEQ ID NO: 652621 - DNA, 25 bp, Rattus norvegicus
cactgcgttgtggagatccggattt

SEQ ID NO: 652622 - DNA, 25 bp, Rattus norvegicus
tccggattttgttgcgccagtcgct

SEQ ID NO: 652623 - DNA, 25 bp, Rattus norvegicus
cgatctctgcattccagctgggcaa

SEQ ID NO: 652624 - DNA, 25 bp, Rattus norvegicus
ccacgctttgcctataggcgaagga

SEQ ID NO: 652625 - DNA, 25 bp, Rattus norvegicus
cacccagagtgggtagctcgcggaa

SEQ ID NO: 652626 - DNA, 25 bp, Rattus norvegicus
gtggacaccgtctgaatgaaaccta

SEQ ID NO: 652627 - DNA, 25 bp, Rattus norvegicus
ttccgggccatctgcgcagaggcaa

SEQ ID NO: 652628 - DNA, 25 bp, Rattus norvegicus
cccaaactcggcttggtaccaagtg

SEQ ID NO: 652629 - DNA, 25 bp, Rattus norvegicus
accaagtgaggtgagtgagtcgtcc

SEQ ID NO: 652630 - DNA, 25 bp, Rattus norvegicus
cgtctctgaagtggagtagatcagt

SEQ ID NO: 652631 - DNA, 25 bp, Rattus norvegicus
gctccgatgggttgaggtaaagacc

SEQ ID NO: 652632 - DNA, 25 bp, Rattus norvegicus
cggagcgcagcagggtagttctccc

SEQ ID NO: 652633 - DNA, 25 bp, Rattus norvegicus
cgcggaggaagctacggaactacct

SEQ ID NO: 652634 - DNA, 25 bp, Rattus norvegicus
tttaattgtattgcacgcggccgcc

SEQ ID NO: 652635 - DNA, 25 bp, Rattus norvegicus
ccgccaccgaggtagtgatgggcaa

SEQ ID NO: 652636 - DNA, 25 bp, Rattus norvegicus
ccggaggctggacaaaatggtgacc

SEQ ID NO: 652637 - DNA, 25 bp, Rattus norvegicus
tgaaacctagcccaggcagtcgaga

SEQ ID NO: 652638 - DNA, 25 bp, Rattus norvegicus
gcttcgctatggacgccacgctgac

SEQ ID NO: 652639 - DNA, 25 bp, Rattus norvegicus
agattgctcgtatcgcccggaggct

SEQ ID NO: 652640 - DNA, 25 bp, Rattus norvegicus
gcgaagagaccctgcagtcgagcta

SEQ ID NO: 652641 - DNA, 25 bp, Rattus norvegicus
cctcgttaagcatcagacggaactg

SEQ ID NO: 652642 - DNA, 25 bp, Rattus norvegicus
cggaactgatgcagaaccgtgggtc

SEQ ID NO: 652643 - DNA, 25 bp, Rattus norvegicus
ggcggccgaatactcacctttaagc

SEQ ID NO: 652644 - DNA, 25 bp, Rattus norvegicus
tttaagcagttgcaactccacggtc

SEQ ID NO: 652645 - DNA, 25 bp, Rattus norvegicus
ggtctcacgcacatgcagccatttc

SEQ ID NO: 652646 - DNA, 25 bp, Rattus norvegicus
cccggaggtttatagacagcgaaga

SEQ ID NO: 652647 - DNA, 25 bp, Rattus norvegicus
ccatggctggaactctgcagtacta

SEQ ID NO: 652648 - DNA, 25 bp, Rattus norvegicus
tgcagtactacatcatccagaagcg

SEQ ID NO: 652649 - DNA, 25 bp, Rattus norvegicus
atgcggacggaagttccacgtggtc

SEQ ID NO: 652650 - DNA, 25 bp, Rattus norvegicus
tccacgtggtcctttcccaaatgtg

SEQ ID NO: 652651 - DNA, 25 bp, Rattus norvegicus
cccaaatgtggtccctactgtaggc

SEQ ID NO: 652652 - DNA, 25 bp, Rattus norvegicus
gcagtcgagctaggccagaagaacc

SEQ ID NO: 652653 - DNA, 25 bp, Rattus norvegicus
gagtcacgtgacctcgttaagcatc

SEQ ID NO: 652654 - DNA, 25 bp, Rattus norvegicus
tcagacagcaagacgcactcccggg

SEQ ID NO: 652655 - DNA, 25 bp, Rattus norvegicus
ccacgtggaccggtcactgaagtcc

SEQ ID NO: 652656 - DNA, 25 bp, Rattus norvegicus
aaaaggggaaccttgctgcggctct

SEQ ID NO: 652657 - DNA, 25 bp, Rattus norvegicus
atcacttctcaacgctctgagctgg

SEQ ID NO: 652658 - DNA, 25 bp, Rattus norvegicus
gcaggagacacggaaacctgggttc

SEQ ID NO: 652659 - DNA, 25 bp, Rattus norvegicus
ctgactagcggacccaactcgaagg

SEQ ID NO: 652660 - DNA, 25 bp, Rattus norvegicus
tcgttcagagacagtggattgagcc

SEQ ID NO: 652661 - DNA, 25 bp, Rattus norvegicus
cactcgcgaggtagaaaggctcacg

SEQ ID NO: 652662 - DNA, 25 bp, Rattus norvegicus
tccgggaacagagccggcatctata

SEQ ID NO: 652663 - DNA, 25 bp, Rattus norvegicus
cagcgaggatttaagtcagacagca

SEQ ID NO: 652664 - DNA, 25 bp, Rattus norvegicus
cgtgctctaaagcagcgaggattta

SEQ ID NO: 652665 - DNA, 25 bp, Rattus norvegicus
actcaccagcgaccgaaaggcagat

SEQ ID NO: 652666 - DNA, 25 bp, Rattus norvegicus
taaggctcgccaggccaactgacta

SEQ ID NO: 652667 - DNA, 25 bp, Rattus norvegicus
ctactgcgacccaggtccacgtgga

SEQ ID NO: 652668 - DNA, 25 bp, Rattus norvegicus
ctctttagaagacgcgtactgggtc

SEQ ID NO: 652669 - DNA, 25 bp, Rattus norvegicus
gtcgggcatgcagtaagataactcc

SEQ ID NO: 652670 - DNA, 25 bp, Rattus norvegicus
acgctcagatggtagctctaatgcc

SEQ ID NO: 652671 - DNA, 25 bp, Rattus norvegicus
gcccagaagccgattttgacgctca

SEQ ID NO: 652672 - DNA, 25 bp, Rattus norvegicus
cgcggccttaaggatgcccagaagc

SEQ ID NO: 652673 - DNA, 25 bp, Rattus norvegicus
acccgcattcgggtgtagcgcaacc

SEQ ID NO: 652674 - DNA, 25 bp, Rattus norvegicus
ccctgcagggtgagccctctttaga

SEQ ID NO: 652675 - DNA, 25 bp, Rattus norvegicus
gcctgggaaccaagtttactaagca

SEQ ID NO: 652676 - DNA, 25 bp, Rattus norvegicus
tctggatcaggagagagatttcttc

SEQ ID NO: 652677 - DNA, 25 bp, Rattus norvegicus
cgcgcgcatctttgcttctggatca

SEQ ID NO: 652678 - DNA, 25 bp, Rattus norvegicus
atcagggatcttcgtgggcttcagt

SEQ ID NO: 652679 - DNA, 25 bp, Rattus norvegicus
ccgcacctcttgtcggtccaaagga

SEQ ID NO: 652680 - DNA, 25 bp, Rattus norvegicus
catcgcgggaagatgttgccatcta

SEQ ID NO: 652681 - DNA, 25 bp, Rattus norvegicus
tcttccaggattgtctcaacacgtc

SEQ ID NO: 652682 - DNA, 25 bp, Rattus norvegicus
tccgtgcgaagcgacagaagcgtcc

SEQ ID NO: 652683 - DNA, 25 bp, Rattus norvegicus
ggcgtctgtgtctcttaccatttcc

SEQ ID NO: 652684 - DNA, 25 bp, Rattus norvegicus
gggccacgctcctgcaggcaaaatg

SEQ ID NO: 652685 - DNA, 25 bp, Rattus norvegicus
taccatttccgagagtttcgagccc

SEQ ID NO: 652686 - DNA, 25 bp, Rattus norvegicus
gaagcgtccgaagaacccgaggcta

SEQ ID NO: 652687 - DNA, 25 bp, Rattus norvegicus
gctcagttcaggtacagcccgcgca

SEQ ID NO: 652688 - DNA, 25 bp, Rattus norvegicus
cagccgcgcatgctcagttcaggta

SEQ ID NO: 652689 - DNA, 25 bp, Rattus norvegicus
gcagggacacattcatccattcttc

SEQ ID NO: 652690 - DNA, 25 bp, Rattus norvegicus
cgaccactgaggcagggacacattc

SEQ ID NO: 652691 - DNA, 25 bp, Rattus norvegicus
tcggagaacacgtagcgaccactga

SEQ ID NO: 652692 - DNA, 25 bp, Rattus norvegicus
ctaggccggacatgctcggagaaca

SEQ ID NO: 652693 - DNA, 25 bp, Rattus norvegicus
gtcagcatcctctcatatcactagg

SEQ ID NO: 652694 - DNA, 25 bp, Rattus norvegicus
aggcaaaatgccgttctcccgccga

SEQ ID NO: 652695 - DNA, 25 bp, Rattus norvegicus
aggctaaacccgagggccgctgagc

SEQ ID NO: 652696 - DNA, 25 bp, Rattus norvegicus
gccagcctaacgacaacggcagatt

SEQ ID NO: 652697 - DNA, 25 bp, Rattus norvegicus
atcatcttctgctcctcgctcttgg

SEQ ID NO: 652698 - DNA, 25 bp, Rattus norvegicus
tcctttgaaagctcgtctgagaagc

SEQ ID NO: 652699 - DNA, 25 bp, Rattus norvegicus
cctgttaggctgcagttcgtcgaac

SEQ ID NO: 652700 - DNA, 25 bp, Rattus norvegicus
cgctggctttgctacttcctttgaa

SEQ ID NO: 652701 - DNA, 25 bp, Rattus norvegicus
atttcccagaaagccgtgcgcactc

SEQ ID NO: 652702 - DNA, 25 bp, Rattus norvegicus
agcgtcgaggaagctatcacgtttc

SEQ ID NO: 652703 - DNA, 25 bp, Rattus norvegicus
gagtcagcctttgcatcagcgtcga

SEQ ID NO: 652704 - DNA, 25 bp, Rattus norvegicus
ggcagattcgccacactgaggaagc

SEQ ID NO: 652705 - DNA, 25 bp, Rattus norvegicus
gtcgtatttcccacagccgattcca

SEQ ID NO: 652706 - DNA, 25 bp, Rattus norvegicus
gggctctagtacctttcacgtcgta

SEQ ID NO: 652707 - DNA, 25 bp, Rattus norvegicus
tactgcaacggagcttcggcggaac

SEQ ID NO: 652708 - DNA, 25 bp, Rattus norvegicus
gccgattccacatgctaaccgagga

SEQ ID NO: 652709 - DNA, 25 bp, Rattus norvegicus
cgccatgactgtacgggctctagta

SEQ ID NO: 652710 - DNA, 25 bp, Rattus norvegicus
cacgcagtgctgtcaggttcttccc

SEQ ID NO: 652711 - DNA, 25 bp, Rattus norvegicus
agacggcttcagattgggcgcctga

SEQ ID NO: 652712 - DNA, 25 bp, Rattus norvegicus
agctgagcaatgctgctgttctgcc

SEQ ID NO: 652713 - DNA, 25 bp, Rattus norvegicus
cacgcgcagaagctacacggacagc

SEQ ID NO: 652714 - DNA, 25 bp, Rattus norvegicus
acggacagcgagtgcagacagcatg

SEQ ID NO: 652715 - DNA, 25 bp, Rattus norvegicus
gcctaccgggaacgtgttgccgatc

SEQ ID NO: 652716 - DNA, 25 bp, Rattus norvegicus
gcccgagtcggtcttccctgaataa

SEQ ID NO: 652717 - DNA, 25 bp, Rattus norvegicus
ctgagaatcttcttgcacgcagtgc

SEQ ID NO: 652718 - DNA, 25 bp, Rattus norvegicus
ctttagttgctcgtttgctcccatc

SEQ ID NO: 652719 - DNA, 25 bp, Rattus norvegicus
tcaaatcctcgggttctttagttgc

SEQ ID NO: 652720 - DNA, 25 bp, Rattus norvegicus
ccgctgcccgctcagaaattgtgcg

SEQ ID NO: 652721 - DNA, 25 bp, Rattus norvegicus
tcacccgcaaggtgaggtccacagg

SEQ ID NO: 652722 - DNA, 25 bp, Rattus norvegicus
acgtgcccgtacgtccataacatca

SEQ ID NO: 652723 - DNA, 25 bp, Rattus norvegicus
gcagagtgacgcacttctcgttctc

SEQ ID NO: 652724 - DNA, 25 bp, Rattus norvegicus
catgacaggcactgatgcgccggct

SEQ ID NO: 652725 - DNA, 25 bp, Rattus norvegicus
ctctcagaagatgcgatgaaggacg

SEQ ID NO: 652726 - DNA, 25 bp, Rattus norvegicus
ttctctcagaagatgcgatgaagga

SEQ ID NO: 652727 - DNA, 25 bp, Rattus norvegicus
acatcagaaccaaacgcacgtcttc

SEQ ID NO: 652728 - DNA, 25 bp, Rattus norvegicus
cgtcttctctcagaagatgcgatga

SEQ ID NO: 652729 - DNA, 25 bp, Rattus norvegicus
aacgcacgtcttctctcagaagatg

SEQ ID NO: 652730 - DNA, 25 bp, Rattus norvegicus
ccaaacgcacgtcttctctcagaag

SEQ ID NO: 652731 - DNA, 25 bp, Rattus norvegicus
gcctgtgcgacatcagaaccaaacg

SEQ ID NO: 652732 - DNA, 25 bp, Rattus norvegicus
cgtgcctgtgcgacatcagaaccaa

SEQ ID NO: 652733 - DNA, 25 bp, Rattus norvegicus
gcccgtgcctgtgcgacatcagaac

SEQ ID NO: 652734 - DNA, 25 bp, Rattus norvegicus
acaggcactgatgcgccggctgccg

SEQ ID NO: 652735 - DNA, 25 bp, Rattus norvegicus
gacgccatgacaggcactgatgcgc

SEQ ID NO: 652736 - DNA, 25 bp, Rattus norvegicus
gatgcgccggctgccggtctatgtc

SEQ ID NO: 652737 - DNA, 25 bp, Rattus norvegicus
gcgacatcagaaccaaacgcacgtc

SEQ ID NO: 652738 - DNA, 25 bp, Rattus norvegicus
atgtgctcctcagggccgcgagcca

SEQ ID NO: 652739 - DNA, 25 bp, Rattus norvegicus
gttcactcctcggtctcgaaagctc

SEQ ID NO: 652740 - DNA, 25 bp, Rattus norvegicus
ggccgttcactcctcggtctcgaaa

SEQ ID NO: 652741 - DNA, 25 bp, Rattus norvegicus
atcgccacggtaaggccgttcactc

SEQ ID NO: 652742 - DNA, 25 bp, Rattus norvegicus
tacaatccctatcgccacggtaagg

SEQ ID NO: 652743 - DNA, 25 bp, Rattus norvegicus
cgggaatggcgctctacaatcccta

SEQ ID NO: 652744 - DNA, 25 bp, Rattus norvegicus
cctactacgccgctgcagaagatgc

SEQ ID NO: 652745 - DNA, 25 bp, Rattus norvegicus
gcgaccggaggaaccgagctcctct

SEQ ID NO: 652746 - DNA, 25 bp, Rattus norvegicus
tctgatccggtatccgtggcgaccg

SEQ ID NO: 652747 - DNA, 25 bp, Rattus norvegicus
gagcagctctgatccggtatccgtg

SEQ ID NO: 652748 - DNA, 25 bp, Rattus norvegicus
gccaactgtaggtgagcagctctga

SEQ ID NO: 652749 - DNA, 25 bp, Rattus norvegicus
accgtacgcggccaactgtaggtga

SEQ ID NO: 652750 - DNA, 25 bp, Rattus norvegicus
gatgtccgctgccatggcgaccctg

SEQ ID NO: 652751 - DNA, 25 bp, Rattus norvegicus
ccgctgcagaagatgctgctggccg

SEQ ID NO: 652752 - DNA, 25 bp, Rattus norvegicus
cagaggtacagaccctacaagggcg

SEQ ID NO: 652753 - DNA, 25 bp, Rattus norvegicus
cctctttcttccagcactgcgagcg

SEQ ID NO: 652754 - DNA, 25 bp, Rattus norvegicus
cagggaaaacgtgccaggccgagca

SEQ ID NO: 652755 - DNA, 25 bp, Rattus norvegicus
acagcggctttctgagcagggaaaa

SEQ ID NO: 652756 - DNA, 25 bp, Rattus norvegicus
agccgcagccaggtgagctaaggcg

SEQ ID NO: 652757 - DNA, 25 bp, Rattus norvegicus
aaccgggccgcatcctgacggggct

SEQ ID NO: 652758 - DNA, 25 bp, Rattus norvegicus
catcgcactccgctgccgcaaccgg

SEQ ID NO: 652759 - DNA, 25 bp, Rattus norvegicus
gccagacgcgccgaactcggctgtg

SEQ ID NO: 652760 - DNA, 25 bp, Rattus norvegicus
gagcgcgacagaggtacagacccta

SEQ ID NO: 652761 - DNA, 25 bp, Rattus norvegicus
ggctcagaagctcgccctctgcggg

SEQ ID NO: 652762 - DNA, 25 bp, Rattus norvegicus
tggaacacgggctcagaagctcgcc

SEQ ID NO: 652763 - DNA, 25 bp, Rattus norvegicus
tgcgctgtggaacacgggctcagaa

SEQ ID NO: 652764 - DNA, 25 bp, Rattus norvegicus
tgaggggcgcgccctctttcttcca

SEQ ID NO: 652765 - DNA, 25 bp, Rattus norvegicus
agctcggcctatcactcccagcagg

SEQ ID NO: 652766 - DNA, 25 bp, Rattus norvegicus
gaagcctgcgagaggcgcctcccag

SEQ ID NO: 652767 - DNA, 25 bp, Rattus norvegicus
taatcaaattctgggctcagccctc

SEQ ID NO: 652768 - DNA, 25 bp, Rattus norvegicus
caaaggggacctgaaagcttagcca

SEQ ID NO: 652769 - DNA, 25 bp, Rattus norvegicus
tctttggcggcagtttaacccgagc

SEQ ID NO: 652770 - DNA, 25 bp, Rattus norvegicus
gcgacccagtgactttcaaagggga

SEQ ID NO: 652771 - DNA, 25 bp, Rattus norvegicus
attagcacaagaatgggaggaggaa

SEQ ID NO: 652772 - DNA, 25 bp, Rattus norvegicus
ccagtgactttcaaaggggacctga

SEQ ID NO: 652773 - DNA, 25 bp, Rattus norvegicus
ttccttctggcctaatcaaattctg

SEQ ID NO: 652774 - DNA, 25 bp, Rattus norvegicus
tctggcctaatcaaattctgggctc

SEQ ID NO: 652775 - DNA, 25 bp, Rattus norvegicus
agccctcgtctttggcggcagttta

SEQ ID NO: 652776 - DNA, 25 bp, Rattus norvegicus
cgagccggggcggatttctttctca

SEQ ID NO: 652777 - DNA, 25 bp, Rattus norvegicus
ccggggcggatttctttctcactga

SEQ ID NO: 652778 - DNA, 25 bp, Rattus norvegicus
ctgatctcagcttgacacccaatta

SEQ ID NO: 652779 - DNA, 25 bp, Rattus norvegicus
ttgacacccaattagcacaagaatg

SEQ ID NO: 652780 - DNA, 25 bp, Rattus norvegicus
ccctgagtggccctttcaaaggcag

SEQ ID NO: 652781 - DNA, 25 bp, Rattus norvegicus
tttgcttttgaatccccgccggcgc

SEQ ID NO: 652782 - DNA, 25 bp, Rattus norvegicus
aagcagcctccagcaccagcgagaa

SEQ ID NO: 652783 - DNA, 25 bp, Rattus norvegicus
ttggggaaagcagcctccagcacca

SEQ ID NO: 652784 - DNA, 25 bp, Rattus norvegicus
cggcgcttggggaaagcagcctcca

SEQ ID NO: 652785 - DNA, 25 bp, Rattus norvegicus
tggcagccgtttgcttttgaatccc

SEQ ID NO: 652786 - DNA, 25 bp, Rattus norvegicus
caccggggagaagtgagtcgggact

SEQ ID NO: 652787 - DNA, 25 bp, Rattus norvegicus
ctgctctgtgcaaggactagcgggt

SEQ ID NO: 652788 - DNA, 25 bp, Rattus norvegicus
tcctgctctgtgcaaggactagcgg

SEQ ID NO: 652789 - DNA, 25 bp, Rattus norvegicus
ggcgcgttctcacggccgctgccca

SEQ ID NO: 652790 - DNA, 25 bp, Rattus norvegicus
agtggcagccgtttgcttttgaatc

SEQ ID NO: 652791 - DNA, 25 bp, Rattus norvegicus
tggccctttcaaaggcagtgacggg

SEQ ID NO: 652792 - DNA, 25 bp, Rattus norvegicus
cggcgccctgagtggccctttcaaa

SEQ ID NO: 652793 - DNA, 25 bp, Rattus norvegicus
ctttcccacgcctgcccgtccggcg

SEQ ID NO: 652794 - DNA, 25 bp, Rattus norvegicus
agttaaagggcgtgtcctgctagtt

SEQ ID NO: 652795 - DNA, 25 bp, Rattus norvegicus
atgtgttaggagtccctcgccttga

SEQ ID NO: 652796 - DNA, 25 bp, Rattus norvegicus
cacaccgttagggaaatgtgttagg

SEQ ID NO: 652797 - DNA, 25 bp, Rattus norvegicus
agaatagaggcgcacacaccgttag

SEQ ID NO: 652798 - DNA, 25 bp, Rattus norvegicus
ccgtgagtccaagaatagaggcgca

SEQ ID NO: 652799 - DNA, 25 bp, Rattus norvegicus
tgccgaggttactgtcgccctctga

SEQ ID NO: 652800 - DNA, 25 bp, Rattus norvegicus
agcgaagccgtaagacctgaaactc

SEQ ID NO: 652801 - DNA, 25 bp, Rattus norvegicus
gtgtcctgctagtttggcttcctca

SEQ ID NO: 652802 - DNA, 25 bp, Rattus norvegicus
ccctcgccttgatctgtgtctcgta

SEQ ID NO: 652803 - DNA, 25 bp, Rattus norvegicus
gtacgcgagcactccggaagttaaa

SEQ ID NO: 652804 - DNA, 25 bp, Rattus norvegicus
tacctagtggcgaccggaagtacgc

SEQ ID NO: 652805 - DNA, 25 bp, Rattus norvegicus
ctcttccgtttacgctacctagtgg

SEQ ID NO: 652806 - DNA, 25 bp, Rattus norvegicus
atctgtgtctcgtaggactcggagg

SEQ ID NO: 652807 - DNA, 25 bp, Rattus norvegicus
tttggcttcctcaacatggcggcgc

SEQ ID NO: 652808 - DNA, 25 bp, Rattus norvegicus
tttccttccatcgtggccaagggtc

SEQ ID NO: 652809 - DNA, 25 bp, Rattus norvegicus
gtccctagagtaacccgcgttgtgc

SEQ ID NO: 652810 - DNA, 25 bp, Rattus norvegicus
gctccaacaatacgggcctggcgca

SEQ ID NO: 652811 - DNA, 25 bp, Rattus norvegicus
ctccggagctgcgtattggaatacc

SEQ ID NO: 652812 - DNA, 25 bp, Rattus norvegicus
ccaggcatgatcgactggaggatcc

SEQ ID NO: 652813 - DNA, 25 bp, Rattus norvegicus
cccagcctggaggagatatcctgtc

SEQ ID NO: 652814 - DNA, 25 bp, Rattus norvegicus
tggaatacctcgcagaagctcagca

SEQ ID NO: 652815 - DNA, 25 bp, Rattus norvegicus
aaagcgcacaccagatctccggagc

SEQ ID NO: 652816 - DNA, 25 bp, Rattus norvegicus
ttctgcctggctccttaaaagcgca

SEQ ID NO: 652817 - DNA, 25 bp, Rattus norvegicus
tggccgcagactcgtacaagaattg

SEQ ID NO: 652818 - DNA, 25 bp, Rattus norvegicus
ccacaattctcggttggccgcagac

SEQ ID NO: 652819 - DNA, 25 bp, Rattus norvegicus
tgagaccggagctcaaccacagatg

SEQ ID NO: 652820 - DNA, 25 bp, Rattus norvegicus
ccactatgttggttctgggacctgc

SEQ ID NO: 652821 - DNA, 25 bp, Rattus norvegicus
gcgctctctgcttccttgtagctga

SEQ ID NO: 652822 - DNA, 25 bp, Rattus norvegicus
tgggccgcagcagttatatgcgctc

SEQ ID NO: 652823 - DNA, 25 bp, Rattus norvegicus
ccctagtagtcttcggcccgctatt

SEQ ID NO: 652824 - DNA, 25 bp, Rattus norvegicus
tagcagttctcaccttcttcgcacg

SEQ ID NO: 652825 - DNA, 25 bp, Rattus norvegicus
cccacttggggcctagcagttctca

SEQ ID NO: 652826 - DNA, 25 bp, Rattus norvegicus
tggtagctattctgccgggaacgcc

SEQ ID NO: 652827 - DNA, 25 bp, Rattus norvegicus
acctattggttctccctggtagcta

SEQ ID NO: 652828 - DNA, 25 bp, Rattus norvegicus
agggctgcgcccttctatgggcaga

SEQ ID NO: 652829 - DNA, 25 bp, Rattus norvegicus
cgtagagcgtctcgggttcaagccc

SEQ ID NO: 652830 - DNA, 25 bp, Rattus norvegicus
cgtgccgctcttggtgagaggccac

SEQ ID NO: 652831 - DNA, 25 bp, Rattus norvegicus
cgacttcataaggagacggttctgg

SEQ ID NO: 652832 - DNA, 25 bp, Rattus norvegicus
ggcctccgacttcaacgacttcata

SEQ ID NO: 652833 - DNA, 25 bp, Rattus norvegicus
agctgccgaccggttgtcggaaaag

SEQ ID NO: 652834 - DNA, 25 bp, Rattus norvegicus
ctaaatggcgaaacccgagaggctc

SEQ ID NO: 652835 - DNA, 25 bp, Rattus norvegicus
caactccggggatgcgggtgatcca

SEQ ID NO: 652836 - DNA, 25 bp, Rattus norvegicus
gcccgcgtttaacaggctccctaga

SEQ ID NO: 652837 - DNA, 25 bp, Rattus norvegicus
ggtttgttgtcagtagtatcagctg

SEQ ID NO: 652838 - DNA, 25 bp, Rattus norvegicus
agtagtatcagctggtggcctgcca

SEQ ID NO: 652839 - DNA, 25 bp, Rattus norvegicus
gtatcagctggtggcctgccatgcc

SEQ ID NO: 652840 - DNA, 25 bp, Rattus norvegicus
ctgccatgccgtctgatggtcgctg

SEQ ID NO: 652841 - DNA, 25 bp, Rattus norvegicus
ctgatggtcgctgctgggaaactct

SEQ ID NO: 652842 - DNA, 25 bp, Rattus norvegicus
ctgctgggaaactctgagggcgctc

SEQ ID NO: 652843 - DNA, 25 bp, Rattus norvegicus
gagggcgctccgcaattccagcaaa

SEQ ID NO: 652844 - DNA, 25 bp, Rattus norvegicus
gcaattccagcaaaggccgcctgcg

SEQ ID NO: 652845 - DNA, 25 bp, Rattus norvegicus
accgcgagtggttactgcgctacga

SEQ ID NO: 652846 - DNA, 25 bp, Rattus norvegicus
cggtgtctgcgaccgttacggacaa

SEQ ID NO: 652847 - DNA, 25 bp, Rattus norvegicus
aacaggctccctagagaccgcggtg

SEQ ID NO: 652848 - DNA, 25 bp, Rattus norvegicus
ttacggacaaggctgcgccggatgt

SEQ ID NO: 652849 - DNA, 25 bp, Rattus norvegicus
cctgcgctacgaccgcgagtggtta

SEQ ID NO: 652850 - DNA, 25 bp, Rattus norvegicus
tcctcggaccaagaccagcggcagt

SEQ ID NO: 652851 - DNA, 25 bp, Rattus norvegicus
ctcgggtccacgcaaagggaatcgc

SEQ ID NO: 652852 - DNA, 25 bp, Rattus norvegicus
gcggcaactcctgggtgcctgtacc

SEQ ID NO: 652853 - DNA, 25 bp, Rattus norvegicus
cccatccaggatcctgtcgggttgg

SEQ ID NO: 652854 - DNA, 25 bp, Rattus norvegicus
tggcgctgccctacaaggagaagca

SEQ ID NO: 652855 - DNA, 25 bp, Rattus norvegicus
caccgcctggagatcgtcttcgtgt

SEQ ID NO: 652856 - DNA, 25 bp, Rattus norvegicus
gctctacttcgggtgcagcctgagc

SEQ ID NO: 652857 - DNA, 25 bp, Rattus norvegicus
ccaggatgtcggtcttcttggagga

SEQ ID NO: 652858 - DNA, 25 bp, Rattus norvegicus
aagacgccagctgctacggacctgc

SEQ ID NO: 652859 - DNA, 25 bp, Rattus norvegicus
tcaggtttcttactttagccacgta

SEQ ID NO: 652860 - DNA, 25 bp, Rattus norvegicus
tgtagaactcgggtcaggtttctta

SEQ ID NO: 652861 - DNA, 25 bp, Rattus norvegicus
caggcattctggtcccggtgtagaa

SEQ ID NO: 652862 - DNA, 25 bp, Rattus norvegicus
tctccggccttaagtccaggcattc

SEQ ID NO: 652863 - DNA, 25 bp, Rattus norvegicus
cataggcctgccatctctatcttgg

SEQ ID NO: 652864 - DNA, 25 bp, Rattus norvegicus
gtcctttccgtactgcagtcgagca

SEQ ID NO: 652865 - DNA, 25 bp, Rattus norvegicus
acctggcgtgtcaaggtctgcggaa

SEQ ID NO: 652866 - DNA, 25 bp, Rattus norvegicus
gacagatgagctgccgagcctcgca

SEQ ID NO: 652867 - DNA, 25 bp, Rattus norvegicus
accggagcgatgcagacagatgagc

SEQ ID NO: 652868 - DNA, 25 bp, Rattus norvegicus
gcggcgcatctttttcctcagcagc

SEQ ID NO: 652869 - DNA, 25 bp, Rattus norvegicus
tcgccgtcaatatccgctgcggagc

SEQ ID NO: 652870 - DNA, 25 bp, Rattus norvegicus
gtgcgcgcgcgtcgccgtcaatatc

SEQ ID NO: 652871 - DNA, 25 bp, Rattus norvegicus
tgcagtcgagcatctagtcccgcct

SEQ ID NO: 652872 - DNA, 25 bp, Rattus norvegicus
gacgcgctcggtcctttccgtactg

SEQ ID NO: 652873 - DNA, 25 bp, Rattus norvegicus
cggggcagaattgctccggtcccac

SEQ ID NO: 652874 - DNA, 25 bp, Rattus norvegicus
cacagattctctgcagggcggactg

SEQ ID NO: 652875 - DNA, 25 bp, Rattus norvegicus
aggggtgcggcacagattctctgca

SEQ ID NO: 652876 - DNA, 25 bp, Rattus norvegicus
tctccgaagagctcccagggcggag

SEQ ID NO: 652877 - DNA, 25 bp, Rattus norvegicus
ttggaacctcgcaactgcagtgacg

SEQ ID NO: 652878 - DNA, 25 bp, Rattus norvegicus
tccgaaaagaggaagtgaagctgtc

SEQ ID NO: 652879 - DNA, 25 bp, Rattus norvegicus
taccgcaagcggaagtccgaaaaga

SEQ ID NO: 652880 - DNA, 25 bp, Rattus norvegicus
tgcgggtttcgctaccgcaagcgga

SEQ ID NO: 652881 - DNA, 25 bp, Rattus norvegicus
aacatgacctctgcgggtttcgcta

SEQ ID NO: 652882 - DNA, 25 bp, Rattus norvegicus
cctgcgctctgaaacatgacctctg

SEQ ID NO: 652883 - DNA, 25 bp, Rattus norvegicus
gatgcgctaattgccatggcgacgg

SEQ ID NO: 652884 - DNA, 25 bp, Rattus norvegicus
tctggcgcttccaacccgcggaaaa

SEQ ID NO: 652885 - DNA, 25 bp, Rattus norvegicus
aagaggaagtgaagctgtctgcgcc

SEQ ID NO: 652886 - DNA, 25 bp, Rattus norvegicus
cacccgtgagttagtttttgcacta

SEQ ID NO: 652887 - DNA, 25 bp, Rattus norvegicus
aaaggcctgggcgatgcgctaattg

SEQ ID NO: 652888 - DNA, 25 bp, Rattus norvegicus
tcatcctgcagaggcgcgggccgtc

SEQ ID NO: 652889 - DNA, 25 bp, Rattus norvegicus
cactcctccactgagacggcacaga

SEQ ID NO: 652890 - DNA, 25 bp, Rattus norvegicus
agccagcgcagcaactctggcgctt

SEQ ID NO: 652891 - DNA, 25 bp, Rattus norvegicus
acgcccagggtctcatcctgcagag

SEQ ID NO: 652892 - DNA, 25 bp, Rattus norvegicus
gaggccgacttaaatctccggcacc

SEQ ID NO: 652893 - DNA, 25 bp, Rattus norvegicus
tggaggacaagtcggcctctcccgg

SEQ ID NO: 652894 - DNA, 25 bp, Rattus norvegicus
aagctggaggacaagtcggcctctc

SEQ ID NO: 652895 - DNA, 25 bp, Rattus norvegicus
cagcccaagaaacccagacccgttg

SEQ ID NO: 652896 - DNA, 25 bp, Rattus norvegicus
gcggcaatctgcgatcctgcctcag

SEQ ID NO: 652897 - DNA, 25 bp, Rattus norvegicus
cccgaagcggcaatctgcgatcctg

SEQ ID NO: 652898 - DNA, 25 bp, Rattus norvegicus
gaacatcagtgctctggcctccgtc

SEQ ID NO: 652899 - DNA, 25 bp, Rattus norvegicus
ctactgtgaacatcagtgctctggc

SEQ ID NO: 652900 - DNA, 25 bp, Rattus norvegicus
tgcgagtttcctcctactgtgaaca

SEQ ID NO: 652901 - DNA, 25 bp, Rattus norvegicus
aggccgcctcagttcctgcgagttt

SEQ ID NO: 652902 - DNA, 25 bp, Rattus norvegicus
ggctgcgaggccgacttaaatctcc

SEQ ID NO: 652903 - DNA, 25 bp, Rattus norvegicus
tgtcccactgtcatgtaaatatccc

SEQ ID NO: 652904 - DNA, 25 bp, Rattus norvegicus
aaagaactttctgctgattggaggg

SEQ ID NO: 652905 - DNA, 25 bp, Rattus norvegicus
ctcagttcctgcgagtttcctccta

SEQ ID NO: 652906 - DNA, 25 bp, Rattus norvegicus
ttcgagtcgtggtgtggtgtttccc

SEQ ID NO: 652907 - DNA, 25 bp, Rattus norvegicus
cgtttcttacgcacagcttcgagtc

SEQ ID NO: 652908 - DNA, 25 bp, Rattus norvegicus
gggtagtcgctttccagtttctcgc

SEQ ID NO: 652909 - DNA, 25 bp, Rattus norvegicus
tacgcacagcttcgagtcgtggtgt

SEQ ID NO: 652910 - DNA, 25 bp, Rattus norvegicus
gaccgagaggtctgcgtttcttacg

SEQ ID NO: 652911 - DNA, 25 bp, Rattus norvegicus
ttcctctgttgaccgagaggtctgc

SEQ ID NO: 652912 - DNA, 25 bp, Rattus norvegicus
gtgcacttttcgctttcctctgttg

SEQ ID NO: 652913 - DNA, 25 bp, Rattus norvegicus
gttttcgtgccagcgtgcacttttc

SEQ ID NO: 652914 - DNA, 25 bp, Rattus norvegicus
ttctcgttttacgttcagatagtgg

SEQ ID NO: 652915 - DNA, 25 bp, Rattus norvegicus
ccatcctagcacttttctcgtttta

SEQ ID NO: 652916 - DNA, 25 bp, Rattus norvegicus
tccttatctgaagcgctgctggccg

SEQ ID NO: 652917 - DNA, 25 bp, Rattus norvegicus
gagcctaagcgctccttatctgaag

SEQ ID NO: 652918 - DNA, 25 bp, Rattus norvegicus
tcgctctgagcctaagcgctcctta

SEQ ID NO: 652919 - DNA, 25 bp, Rattus norvegicus
ttcagatagtggttttcgtgccagc

SEQ ID NO: 652920 - DNA, 25 bp, Rattus norvegicus
ccgccacatggtgcggccggacgca

SEQ ID NO: 652921 - DNA, 25 bp, Rattus norvegicus
ctcagggcaatcgagaagcgagccg

SEQ ID NO: 652922 - DNA, 25 bp, Rattus norvegicus
caatcgagaagcgagccggagcgca

SEQ ID NO: 652923 - DNA, 25 bp, Rattus norvegicus
ggctcgccacaacgcgcccgggcct

SEQ ID NO: 652924 - DNA, 25 bp, Rattus norvegicus
acggggccgacgagacctcaggtga

SEQ ID NO: 652925 - DNA, 25 bp, Rattus norvegicus
gccgccatctttcggaccgggccgc

SEQ ID NO: 652926 - DNA, 25 bp, Rattus norvegicus
aggccgcggactggcgcctttttgt

SEQ ID NO: 652927 - DNA, 25 bp, Rattus norvegicus
tcccgagaagcctctctttattgtg

SEQ ID NO: 652928 - DNA, 25 bp, Rattus norvegicus
ggcctctcgcgttgccctgcttccc

SEQ ID NO: 652929 - DNA, 25 bp, Rattus norvegicus
atgcctcgctcccatcagccgccgc

SEQ ID NO: 652930 - DNA, 25 bp, Rattus norvegicus
gccaatcgctgcacggcgcgagctt

SEQ ID NO: 652931 - DNA, 25 bp, Rattus norvegicus
cctctctttattgtgctccgccatg

SEQ ID NO: 652932 - DNA, 25 bp, Rattus norvegicus
ctttattgtgctccgccatgatgcc

SEQ ID NO: 652933 - DNA, 25 bp, Rattus norvegicus
ttgtgctccgccatgatgcctcgct

SEQ ID NO: 652934 - DNA, 25 bp, Rattus norvegicus
aaaggagcctcggatccgcggagct

SEQ ID NO: 652935 - DNA, 25 bp, Rattus norvegicus
gccaggtgaaccaagcgcgcgcagc

SEQ ID NO: 652936 - DNA, 25 bp, Rattus norvegicus
ggccgcgtttgcagctctgagcacc

SEQ ID NO: 652937 - DNA, 25 bp, Rattus norvegicus
gcttccggaaccatagtggaggaga

SEQ ID NO: 652938 - DNA, 25 bp, Rattus norvegicus
ccgggcttccggaaccatagtggag

SEQ ID NO: 652939 - DNA, 25 bp, Rattus norvegicus
gtttgaaagtcaggcgctgaggccc

SEQ ID NO: 652940 - DNA, 25 bp, Rattus norvegicus
ccatgcgggagcagagatggccctc

SEQ ID NO: 652941 - DNA, 25 bp, Rattus norvegicus
atccgcggagctgaactccggtgtg

SEQ ID NO: 652942 - DNA, 25 bp, Rattus norvegicus
caccgcgggaaaggagcctcggatc

SEQ ID NO: 652943 - DNA, 25 bp, Rattus norvegicus
aacagttgcggtgcaaagagtgagc

SEQ ID NO: 652944 - DNA, 25 bp, Rattus norvegicus
ctaggaagaacagttgcggtgcaaa

SEQ ID NO: 652945 - DNA, 25 bp, Rattus norvegicus
ggctttcctatctctaggaagaaca

SEQ ID NO: 652946 - DNA, 25 bp, Rattus norvegicus
atggccctcggctttcctatctcta

SEQ ID NO: 652947 - DNA, 25 bp, Rattus norvegicus
tttcaagtttgaaagtcaggcgctg

SEQ ID NO: 652948 - DNA, 25 bp, Rattus norvegicus
agacgcagcgcatcttccaggaagc

SEQ ID NO: 652949 - DNA, 25 bp, Rattus norvegicus
ttcggaatcccgagataccggatcc

SEQ ID NO: 652950 - DNA, 25 bp, Rattus norvegicus
agggcaacacacaggagcttcagtc

SEQ ID NO: 652951 - DNA, 25 bp, Rattus norvegicus
tcgctgctgcagaacatgactaact

SEQ ID NO: 652952 - DNA, 25 bp, Rattus norvegicus
agtcatcgacggcaacctggagctg

SEQ ID NO: 652953 - DNA, 25 bp, Rattus norvegicus
ggtgaagctgctagtcaaattcggc

SEQ ID NO: 652954 - DNA, 25 bp, Rattus norvegicus
ccaggacatcgtgctctatctcatc

SEQ ID NO: 652955 - DNA, 25 bp, Rattus norvegicus
taggtctctatgtccacggccacga

SEQ ID NO: 652956 - DNA, 25 bp, Rattus norvegicus
acgaccaaagtagcgcgtccgtggc

SEQ ID NO: 652957 - DNA, 25 bp, Rattus norvegicus
tagttcgagcctccgcaatagagcg

SEQ ID NO: 652958 - DNA, 25 bp, Rattus norvegicus
gcaggctccagtccattttgaaatt

SEQ ID NO: 652959 - DNA, 25 bp, Rattus norvegicus
tctcacaccgggagacttcggaatc

SEQ ID NO: 652960 - DNA, 25 bp, Rattus norvegicus
tccgcgtggaaatcgggctaggtct

SEQ ID NO: 652961 - DNA, 25 bp, Rattus norvegicus
gcgaagcctaacctcgaagggacca

SEQ ID NO: 652962 - DNA, 25 bp, Rattus norvegicus
gcgcatgcgcagacgtgcctatctt

SEQ ID NO: 652963 - DNA, 25 bp, Rattus norvegicus
ccggtgtcgtgcaggaagagcacca

SEQ ID NO: 652964 - DNA, 25 bp, Rattus norvegicus
cccaggtcagcacggtgtgcccagt

SEQ ID NO: 652965 - DNA, 25 bp, Rattus norvegicus
agttcgcaccagcatcccagagttg

SEQ ID NO: 652966 - DNA, 25 bp, Rattus norvegicus
gcatcccagagttgagcagcggcca

SEQ ID NO: 652967 - DNA, 25 bp, Rattus norvegicus
acgggcgactcaaggaagctgtcta

SEQ ID NO: 652968 - DNA, 25 bp, Rattus norvegicus
gtgtccggctcaccggtgtcgtgca

SEQ ID NO: 652969 - DNA, 25 bp, Rattus norvegicus
tccggtgggccaggtaactttgcaa

SEQ ID NO: 652970 - DNA, 25 bp, Rattus norvegicus
caggaagagcaccagcgtgattccc

SEQ ID NO: 652971 - DNA, 25 bp, Rattus norvegicus
gcagacgtgcctatctttgattccc

SEQ ID NO: 652972 - DNA, 25 bp, Rattus norvegicus
aggccacgcggtgcttgctcccaaa

SEQ ID NO: 652973 - DNA, 25 bp, Rattus norvegicus
cttgctcccaaagggtgatgggccg

SEQ ID NO: 652974 - DNA, 25 bp, Rattus norvegicus
ggaagctgtctattgggtgccacca

SEQ ID NO: 652975 - DNA, 25 bp, Rattus norvegicus
acggtgtgcccagttcgcaccagca

SEQ ID NO: 652976 - DNA, 25 bp, Rattus norvegicus
tcgcagcgacaatgcttagaccctg

SEQ ID NO: 652977 - DNA, 25 bp, Rattus norvegicus
caggatgcttcgcaggcttacaagc

SEQ ID NO: 652978 - DNA, 25 bp, Rattus norvegicus
cgggtgtgctgtcaacaaagcgtca

SEQ ID NO: 652979 - DNA, 25 bp, Rattus norvegicus
cgatcctgctccgacggcttggaga

SEQ ID NO: 652980 - DNA, 25 bp, Rattus norvegicus
aaagctgcgactagagcccggaacg

SEQ ID NO: 652981 - DNA, 25 bp, Rattus norvegicus
tcggatccgatctcggtccgggtca

SEQ ID NO: 652982 - DNA, 25 bp, Rattus norvegicus
ccaatgcgccgcaggaggtcggatc

SEQ ID NO: 652983 - DNA, 25 bp, Rattus norvegicus
ccctcaacggggagacaggatgctt

SEQ ID NO: 652984 - DNA, 25 bp, Rattus norvegicus
atgcaggtacgtctcttggctccgc

SEQ ID NO: 652985 - DNA, 25 bp, Rattus norvegicus
ggacctctgcaaggagtcgcagcga

SEQ ID NO: 652986 - DNA, 25 bp, Rattus norvegicus
tcaaggcaagatcctccgacctggg

SEQ ID NO: 652987 - DNA, 25 bp, Rattus norvegicus
gagagagctcaattttcaaggcaag

SEQ ID NO: 652988 - DNA, 25 bp, Rattus norvegicus
gcgtcgttctcaacgagagagctca

SEQ ID NO: 652989 - DNA, 25 bp, Rattus norvegicus
ggctccgcgtttaggacatacccta

SEQ ID NO: 652990 - DNA, 25 bp, Rattus norvegicus
ggaagtcaacaccatgtcgagtctg

SEQ ID NO: 652991 - DNA, 25 bp, Rattus norvegicus
ccgacagagctgctcagcgcatgtg

SEQ ID NO: 652992 - DNA, 25 bp, Rattus norvegicus
catcacgtgaaccttgggcggagcc

SEQ ID NO: 652993 - DNA, 25 bp, Rattus norvegicus
agcggaacgcgcacgctcgcggttt

SEQ ID NO: 652994 - DNA, 25 bp, Rattus norvegicus
ctcgcggttttgcttcccgccggag

SEQ ID NO: 652995 - DNA, 25 bp, Rattus norvegicus
aggcttttgcccagcgtcccggtgt

SEQ ID NO: 652996 - DNA, 25 bp, Rattus norvegicus
ccaggggtccggaagtcaacaccat

SEQ ID NO: 652997 - DNA, 25 bp, Rattus norvegicus
cacaagagccggtaaggagacccga

SEQ ID NO: 652998 - DNA, 25 bp, Rattus norvegicus
agacccgaggtcaagactgcaccca

SEQ ID NO: 652999 - DNA, 25 bp, Rattus norvegicus
acgggccatccggaagctcagcgga

SEQ ID NO: 653000 - DNA, 25 bp, Rattus norvegicus
ttctcaccgacagagctgctcagcg

SEQ ID NO: 653001 - DNA, 25 bp, Rattus norvegicus
ctcagcgcatgtgcggccaagaata

SEQ ID NO: 653002 - DNA, 25 bp, Rattus norvegicus
tgtcgagtctgcacaagagccggta

SEQ ID NO: 653003 - DNA, 25 bp, Rattus norvegicus
aagccgggccttctcaccgacagag

SEQ ID NO: 653004 - DNA, 25 bp, Rattus norvegicus
gctagcccggctctccacttttccc

SEQ ID NO: 653005 - DNA, 25 bp, Rattus norvegicus
gccatgtgcagcgacgggctctgct

SEQ ID NO: 653006 - DNA, 25 bp, Rattus norvegicus
acgacgccatgtgcagcgacgggct

SEQ ID NO: 653007 - DNA, 25 bp, Rattus norvegicus
gacgcacgacgccatgtgcagcgac

SEQ ID NO: 653008 - DNA, 25 bp, Rattus norvegicus
agaaatgcaccctgacgcacgacgc

SEQ ID NO: 653009 - DNA, 25 bp, Rattus norvegicus
tgctgcaagaaatgcaccctgacgc

SEQ ID NO: 653010 - DNA, 25 bp, Rattus norvegicus
ggggcaactgctgcaagaaatgcac

SEQ ID NO: 653011 - DNA, 25 bp, Rattus norvegicus
tgccaccctcaggaatgcagccgag

SEQ ID NO: 653012 - DNA, 25 bp, Rattus norvegicus
gggaagaggctagcccggctctcca

SEQ ID NO: 653013 - DNA, 25 bp, Rattus norvegicus
agtacagagtgggaagaggctagcc

SEQ ID NO: 653014 - DNA, 25 bp, Rattus norvegicus
cctccaggaagggagagtacagagt

SEQ ID NO: 653015 - DNA, 25 bp, Rattus norvegicus
aggactcgcgcgtggcctccaggaa

SEQ ID NO: 653016 - DNA, 25 bp, Rattus norvegicus
tgcagcgacgggctctgctgtcgcc

SEQ ID NO: 653017 - DNA, 25 bp, Rattus norvegicus
ccctcaggaatgcagccgagccggg

SEQ ID NO: 653018 - DNA, 25 bp, Rattus norvegicus
tcaaatcacgtaaggagagcgagtg

SEQ ID NO: 653019 - DNA, 25 bp, Rattus norvegicus
ggggctacgatgatcaaatcacgta

SEQ ID NO: 653020 - DNA, 25 bp, Rattus norvegicus
gggtggggctacgatgatcaaatca

SEQ ID NO: 653021 - DNA, 25 bp, Rattus norvegicus
aaagaacgcgaggttgcagcacgga

SEQ ID NO: 653022 - DNA, 25 bp, Rattus norvegicus
gcacacggcaaagaacgcgaggttg

SEQ ID NO: 653023 - DNA, 25 bp, Rattus norvegicus
ttcggcagcacacggcaaagaacgc

SEQ ID NO: 653024 - DNA, 25 bp, Rattus norvegicus
cccaaaaggatgactgcgccacgaa

SEQ ID NO: 653025 - DNA, 25 bp, Rattus norvegicus
agcgcattcggcagcacacggcaaa

SEQ ID NO: 653026 - DNA, 25 bp, Rattus norvegicus
agggcctgcgcaagcgcattcggca

SEQ ID NO: 653027 - DNA, 25 bp, Rattus norvegicus
cgcaggcgcagtaagattcgggcca

SEQ ID NO: 653028 - DNA, 25 bp, Rattus norvegicus
ctgtcctaacagacagtgaatctga

SEQ ID NO: 653029 - DNA, 25 bp, Rattus norvegicus
ccacgctgtctgtcctaacagacag

SEQ ID NO: 653030 - DNA, 25 bp, Rattus norvegicus
ggatgactgcgccacgaagaaaccc

SEQ ID NO: 653031 - DNA, 25 bp, Rattus norvegicus
agagcgagtgagaactcggatcccg

SEQ ID NO: 653032 - DNA, 25 bp, Rattus norvegicus
cgcttgattgacagacgccggaggt

SEQ ID NO: 653033 - DNA, 25 bp, Rattus norvegicus
tcctccggcctctgtgctgcgcccg

SEQ ID NO: 653034 - DNA, 25 bp, Rattus norvegicus
ctgcttcgccgctcgttcagctcct

SEQ ID NO: 653035 - DNA, 25 bp, Rattus norvegicus
ttgagtgagtgggagctgcttcgcc

SEQ ID NO: 653036 - DNA, 25 bp, Rattus norvegicus
taatggcgtcttggtttgagtgagt

SEQ ID NO: 653037 - DNA, 25 bp, Rattus norvegicus
ggggcacacgcgctaatggcgtctt

SEQ ID NO: 653038 - DNA, 25 bp, Rattus norvegicus
tgccgcttgattgacagacgccgga

SEQ ID NO: 653039 - DNA, 25 bp, Rattus norvegicus
cccgctgccgcttgattgacagacg

SEQ ID NO: 653040 - DNA, 25 bp, Rattus norvegicus
cccgagcggcctcgcacagcggaag

SEQ ID NO: 653041 - DNA, 25 bp, Rattus norvegicus
ccggattcccgactgcgcccggctc

SEQ ID NO: 653042 - DNA, 25 bp, Rattus norvegicus
tccatcgcgcccttcatctggccgc

SEQ ID NO: 653043 - DNA, 25 bp, Rattus norvegicus
cctccacgttctcccgggcttcctg

SEQ ID NO: 653044 - DNA, 25 bp, Rattus norvegicus
tagctcccgccggtagctctgcgcc

SEQ ID NO: 653045 - DNA, 25 bp, Rattus norvegicus
cgcgctaatggcgtcttggtttgag

SEQ ID NO: 653046 - DNA, 25 bp, Rattus norvegicus
cctgcgacttccacgaggacgattc

SEQ ID NO: 653047 - DNA, 25 bp, Rattus norvegicus
tcttaaaagggcagctgaagggcgt

SEQ ID NO: 653048 - DNA, 25 bp, Rattus norvegicus
ggagccagacgtggaacgaccaatg

SEQ ID NO: 653049 - DNA, 25 bp, Rattus norvegicus
cgcagcgcctagatcttactttaca

SEQ ID NO: 653050 - DNA, 25 bp, Rattus norvegicus
agcgcctcaggtagtccgggaccct

SEQ ID NO: 653051 - DNA, 25 bp, Rattus norvegicus
ttctacctgagcaacgtagcgcctc

SEQ ID NO: 653052 - DNA, 25 bp, Rattus norvegicus
ggccatggacgacaccttctacctg

SEQ ID NO: 653053 - DNA, 25 bp, Rattus norvegicus
gcagtggctttgaccgcggccactt

SEQ ID NO: 653054 - DNA, 25 bp, Rattus norvegicus
gacgattctgtgcacgcgtaccacc

SEQ ID NO: 653055 - DNA, 25 bp, Rattus norvegicus
gcgagtcctacgtgctgagctacga

SEQ ID NO: 653056 - DNA, 25 bp, Rattus norvegicus
cagcaccggagagttggccaagtac

SEQ ID NO: 653057 - DNA, 25 bp, Rattus norvegicus
tttttctttaggtagcgcgctggtc

SEQ ID NO: 653058 - DNA, 25 bp, Rattus norvegicus
cggcacaggctccttcgcatttttg

SEQ ID NO: 653059 - DNA, 25 bp, Rattus norvegicus
accaatgcggactaccgcggcagtg

SEQ ID NO: 653060 - DNA, 25 bp, Rattus norvegicus
tccgcagagctacccaatcagagac

SEQ ID NO: 653061 - DNA, 25 bp, Rattus norvegicus
aatagtcacgcctcttccggccaca

SEQ ID NO: 653062 - DNA, 25 bp, Rattus norvegicus
aaacacgcgcctgccaatagtcacg

SEQ ID NO: 653063 - DNA, 25 bp, Rattus norvegicus
tgttgccaggaaaaacacgcgcctg

SEQ ID NO: 653064 - DNA, 25 bp, Rattus norvegicus
gcgctccgccatgttgccaggaaaa

SEQ ID NO: 653065 - DNA, 25 bp, Rattus norvegicus
acaccactgtgagacgctgcagctc

SEQ ID NO: 653066 - DNA, 25 bp, Rattus norvegicus
gacccaggccgacaccactgtgaga

SEQ ID NO: 653067 - DNA, 25 bp, Rattus norvegicus
aggtagcagaagacccaggccgaca

SEQ ID NO: 653068 - DNA, 25 bp, Rattus norvegicus
acaagctcaggcctcggaccaggag

SEQ ID NO: 653069 - DNA, 25 bp, Rattus norvegicus
gaatgtagatcggatcaactaaccc

SEQ ID NO: 653070 - DNA, 25 bp, Rattus norvegicus
cctgcggatgaatgtagatcggatc

SEQ ID NO: 653071 - DNA, 25 bp, Rattus norvegicus
gtcgccctgcggatgaatgtagatc

SEQ ID NO: 653072 - DNA, 25 bp, Rattus norvegicus
tcagccgaacgtggggcgtatcctc

SEQ ID NO: 653073 - DNA, 25 bp, Rattus norvegicus
aatcagagactcagccgaacgtggg

SEQ ID NO: 653074 - DNA, 25 bp, Rattus norvegicus
aggttccaccctggcgttctctgga

SEQ ID NO: 653075 - DNA, 25 bp, Rattus norvegicus
tgcacttgtcctggcagatccgcgc

SEQ ID NO: 653076 - DNA, 25 bp, Rattus norvegicus
ccagaaacaggactagggctgcctg

SEQ ID NO: 653077 - DNA, 25 bp, Rattus norvegicus
ttcacttgagtttccgccacggtcc

SEQ ID NO: 653078 - DNA, 25 bp, Rattus norvegicus
cgtgcgtgcctttcacttgagtttc

SEQ ID NO: 653079 - DNA, 25 bp, Rattus norvegicus
tcgagtataaaaagggacgcgcgct

SEQ ID NO: 653080 - DNA, 25 bp, Rattus norvegicus
gccttgttgagtgggtcgagtataa

SEQ ID NO: 653081 - DNA, 25 bp, Rattus norvegicus
aaggcgccaaagacccacggcgcga

SEQ ID NO: 653082 - DNA, 25 bp, Rattus norvegicus
ccgtgacagacaaaacaaggcgcca

SEQ ID NO: 653083 - DNA, 25 bp, Rattus norvegicus
aagcggtaccgtgacagacaaaaca

SEQ ID NO: 653084 - DNA, 25 bp, Rattus norvegicus
cggagacctaagaagcggtaccgtg

SEQ ID NO: 653085 - DNA, 25 bp, Rattus norvegicus
ggtttgcgctcggtgatatcacttc

SEQ ID NO: 653086 - DNA, 25 bp, Rattus norvegicus
cgctcggtgatatcacttccggggc

SEQ ID NO: 653087 - DNA, 25 bp, Rattus norvegicus
ctgtgggtagccagaaacaggacta

SEQ ID NO: 653088 - DNA, 25 bp, Rattus norvegicus
tccgcagtcagcagagcagttacgt

SEQ ID NO: 653089 - DNA, 25 bp, Rattus norvegicus
ttccttcccgaagtgtctgggcgca

SEQ ID NO: 653090 - DNA, 25 bp, Rattus norvegicus
ccttaacagatatggcgacggccag

SEQ ID NO: 653091 - DNA, 25 bp, Rattus norvegicus
ggttgcagggatcctcgtcccttta

SEQ ID NO: 653092 - DNA, 25 bp, Rattus norvegicus
ggagtaccgagtcccttaggttgca

SEQ ID NO: 653093 - DNA, 25 bp, Rattus norvegicus
tcacttcgccgttcttcccggagta

SEQ ID NO: 653094 - DNA, 25 bp, Rattus norvegicus
ctggcccaatggagatcgaaacccg

SEQ ID NO: 653095 - DNA, 25 bp, Rattus norvegicus
ctaaaggtatgaggacgctggccca

SEQ ID NO: 653096 - DNA, 25 bp, Rattus norvegicus
tttaagagggctgacctccgctccg

SEQ ID NO: 653097 - DNA, 25 bp, Rattus norvegicus
gcagttacgtttgcgggcacctgta

SEQ ID NO: 653098 - DNA, 25 bp, Rattus norvegicus
ctcaagttctaggaggctctcgctg

SEQ ID NO: 653099 - DNA, 25 bp, Rattus norvegicus
ggacaaccgtcgcaagccggacatg

SEQ ID NO: 653100 - DNA, 25 bp, Rattus norvegicus
attatgcggcttttcagggacaacc

SEQ ID NO: 653101 - DNA, 25 bp, Rattus norvegicus
gggcacctgtatctttgggcagcta

SEQ ID NO: 653102 - DNA, 25 bp, Rattus norvegicus
cctggccttcctgcgagagaacctg

SEQ ID NO: 653103 - DNA, 25 bp, Rattus norvegicus
tcgatccgagaggagagcagctaca

SEQ ID NO: 653104 - DNA, 25 bp, Rattus norvegicus
ttcgccttcatgttgcacctcattg

SEQ ID NO: 653105 - DNA, 25 bp, Rattus norvegicus
tctgaggtgagtgagaacaagctgc

SEQ ID NO: 653106 - DNA, 25 bp, Rattus norvegicus
gtcagctgaacctcaacaacgagtg

SEQ ID NO: 653107 - DNA, 25 bp, Rattus norvegicus
aacaacgagtggacgctggacaagc

SEQ ID NO: 653108 - DNA, 25 bp, Rattus norvegicus
agcggctcaccaaaaacgcccagga

SEQ ID NO: 653109 - DNA, 25 bp, Rattus norvegicus
ctggagctgcacctcttcatgctga

SEQ ID NO: 653110 - DNA, 25 bp, Rattus norvegicus
tcttcatgctgagcggcatcccgga

SEQ ID NO: 653111 - DNA, 25 bp, Rattus norvegicus
caccgtgtttgacctgctggagtta

SEQ ID NO: 653112 - DNA, 25 bp, Rattus norvegicus
aggtcctgaagctggaactgatccc

SEQ ID NO: 653113 - DNA, 25 bp, Rattus norvegicus
ctcaaggagctctggctgtaccaca

SEQ ID NO: 653114 - DNA, 25 bp, Rattus norvegicus
tgtaccacacggcagccaagatcga

SEQ ID NO: 653115 - DNA, 25 bp, Rattus norvegicus
gcgacatcccagacgtcaagaatga

SEQ ID NO: 653116 - DNA, 25 bp, Rattus norvegicus
ccaccgcgatccctgccttgctgtc

SEQ ID NO: 653117 - DNA, 25 bp, Rattus norvegicus
ttgctgtccctgtgccctgcaccgc

SEQ ID NO: 653118 - DNA, 25 bp, Rattus norvegicus
gtgtgccttgcccacgccgcgagtt

SEQ ID NO: 653119 - DNA, 25 bp, Rattus norvegicus
acgcccaccaccacgtgattgaaaa

SEQ ID NO: 653120 - DNA, 25 bp, Rattus norvegicus
caccacgtgattgaaaacccaggcc

SEQ ID NO: 653121 - DNA, 25 bp, Rattus norvegicus
ctgaggacactttttggagcgggcc

SEQ ID NO: 653122 - DNA, 25 bp, Rattus norvegicus
ctctcctttcttcgtggtccctatg

SEQ ID NO: 653123 - DNA, 25 bp, Rattus norvegicus
actacgctccctgtaggcactgcgg

SEQ ID NO: 653124 - DNA, 25 bp, Rattus norvegicus
tcgtggtccctatgcctcctgtctt

SEQ ID NO: 653125 - DNA, 25 bp, Rattus norvegicus
ccctgtaggcactgcgggatatttc

SEQ ID NO: 653126 - DNA, 25 bp, Rattus norvegicus
atacacccacgcttcctgcactacg

SEQ ID NO: 653127 - DNA, 25 bp, Rattus norvegicus
actgcgggatatttcggggtcttct

SEQ ID NO: 653128 - DNA, 25 bp, Rattus norvegicus
gttcttcccgcgagcatccttagtt

SEQ ID NO: 653129 - DNA, 25 bp, Rattus norvegicus
cggactcgcctcacaccagggcagc

SEQ ID NO: 653130 - DNA, 25 bp, Rattus norvegicus
tgcccgggcgcgctccacatccggg

SEQ ID NO: 653131 - DNA, 25 bp, Rattus norvegicus
tccacatccggggaccgtgcgcggc

SEQ ID NO: 653132 - DNA, 25 bp, Rattus norvegicus
cgccagcttcttcatattgaagtcc

SEQ ID NO: 653133 - DNA, 25 bp, Rattus norvegicus
cgctgctgcagggaaggggctcctg

SEQ ID NO: 653134 - DNA, 25 bp, Rattus norvegicus
atgcccgcgtccgacgccagcttct

SEQ ID NO: 653135 - DNA, 25 bp, Rattus norvegicus
agtgaagaagatgcccgcgtccgac

SEQ ID NO: 653136 - DNA, 25 bp, Rattus norvegicus
ccgagtgaagaagatgcccgcgtcc

SEQ ID NO: 653137 - DNA, 25 bp, Rattus norvegicus
gcccgagtgaagaagatgcccgcgt

SEQ ID NO: 653138 - DNA, 25 bp, Rattus norvegicus
actgcccgagtgaagaagatgcccg

SEQ ID NO: 653139 - DNA, 25 bp, Rattus norvegicus
aggggctcctgctgcagggtgcccg

SEQ ID NO: 653140 - DNA, 25 bp, Rattus norvegicus
ctgcactgcccgagtgaagaagatg

SEQ ID NO: 653141 - DNA, 25 bp, Rattus norvegicus
ctcacctgcactgcccgagtgaaga

SEQ ID NO: 653142 - DNA, 25 bp, Rattus norvegicus
ggcgtcgcgccaggcctcacctgca

SEQ ID NO: 653143 - DNA, 25 bp, Rattus norvegicus
ttcatattgaagtccatggcgcgcc

SEQ ID NO: 653144 - DNA, 25 bp, Rattus norvegicus
cggcgcattcttctggttggatgtc

SEQ ID NO: 653145 - DNA, 25 bp, Rattus norvegicus
agctgtcgtctgctctaggtcacgg

SEQ ID NO: 653146 - DNA, 25 bp, Rattus norvegicus
gtgagagcagagaccagctgtcgtc

SEQ ID NO: 653147 - DNA, 25 bp, Rattus norvegicus
accggctgcccaagcacccactgcc

SEQ ID NO: 653148 - DNA, 25 bp, Rattus norvegicus
tcaaagccagcagggcggttcctgc

SEQ ID NO: 653149 - DNA, 25 bp, Rattus norvegicus
caaaggcagagtctttacattcaaa

SEQ ID NO: 653150 - DNA, 25 bp, Rattus norvegicus
agcactcacaaaggcagagtcttta

SEQ ID NO: 653151 - DNA, 25 bp, Rattus norvegicus
gcgggcaagcactcacaaaggcaga

SEQ ID NO: 653152 - DNA, 25 bp, Rattus norvegicus
tgctatgctaatgaggacggcggcc

SEQ ID NO: 653153 - DNA, 25 bp, Rattus norvegicus
tcggcgagcagctgctatgctaatg

SEQ ID NO: 653154 - DNA, 25 bp, Rattus norvegicus
tcctcgctcggcgagcagctgctat

SEQ ID NO: 653155 - DNA, 25 bp, Rattus norvegicus
ccattcattccggaggcctctgccc

SEQ ID NO: 653156 - DNA, 25 bp, Rattus norvegicus
tccgtctgtcggtctttcttctctc

SEQ ID NO: 653157 - DNA, 25 bp, Rattus norvegicus
ggttggatgtccttccgacagtccc

SEQ ID NO: 653158 - DNA, 25 bp, Rattus norvegicus
ccacggcgaagctgagcaatctggg

SEQ ID NO: 653159 - DNA, 25 bp, Rattus norvegicus
ggtctgcgtggtcacgtagttcatc

SEQ ID NO: 653160 - DNA, 25 bp, Rattus norvegicus
agcgaggcttgcagagcatggaacc

SEQ ID NO: 653161 - DNA, 25 bp, Rattus norvegicus
cccagcgatgggatcccgggtgagt

SEQ ID NO: 653162 - DNA, 25 bp, Rattus norvegicus
gtttggttgtgttgccgcctggaaa

SEQ ID NO: 653163 - DNA, 25 bp, Rattus norvegicus
gctcccagcggcctggtttggttgt

SEQ ID NO: 653164 - DNA, 25 bp, Rattus norvegicus
ttgcagagcatggaacccggccctc

SEQ ID NO: 653165 - DNA, 25 bp, Rattus norvegicus
ggggaccctcattggtcagagctgt

SEQ ID NO: 653166 - DNA, 25 bp, Rattus norvegicus
agccacggcgaagctgagcaatctg

SEQ ID NO: 653167 - DNA, 25 bp, Rattus norvegicus
ttggccaagagccacggcgaagctg

SEQ ID NO: 653168 - DNA, 25 bp, Rattus norvegicus
gtagttcatcccattggccaagagc

SEQ ID NO: 653169 - DNA, 25 bp, Rattus norvegicus
gtcacgtagttcatcccattggcca

SEQ ID NO: 653170 - DNA, 25 bp, Rattus norvegicus
gcgtggtcacgtagttcatcccatt

SEQ ID NO: 653171 - DNA, 25 bp, Rattus norvegicus
ctcattggtcagagctgtgtcggcc

SEQ ID NO: 653172 - DNA, 25 bp, Rattus norvegicus
tcacggcctgcacactgaatggctg

SEQ ID NO: 653173 - DNA, 25 bp, Rattus norvegicus
cccagttgcagggagtgtgcaagcc

SEQ ID NO: 653174 - DNA, 25 bp, Rattus norvegicus
tgctcgctggagaaagctcccagtt

SEQ ID NO: 653175 - DNA, 25 bp, Rattus norvegicus
atttccttcactgtgctgcgggctg

SEQ ID NO: 653176 - DNA, 25 bp, Rattus norvegicus
cgtgcagggagtgccaatttccttc

SEQ ID NO: 653177 - DNA, 25 bp, Rattus norvegicus
tgtgggcctggactttgtcccttgt

SEQ ID NO: 653178 - DNA, 25 bp, Rattus norvegicus
ttgtgagcagctcgctcgtacgctc

SEQ ID NO: 653179 - DNA, 25 bp, Rattus norvegicus
ctgtcaaacagcgagccttggaggg

SEQ ID NO: 653180 - DNA, 25 bp, Rattus norvegicus
aaccgcggtgggaactgtcaaacag

SEQ ID NO: 653181 - DNA, 25 bp, Rattus norvegicus
acccacgtcgaataccctgcaggta

SEQ ID NO: 653182 - DNA, 25 bp, Rattus norvegicus
acccggcgtgataggtcaggaccac

SEQ ID NO: 653183 - DNA, 25 bp, Rattus norvegicus
actacctgcaatcggcctcggattg

SEQ ID NO: 653184 - DNA, 25 bp, Rattus norvegicus
aatggctgcgccactacctgcaatc

SEQ ID NO: 653185 - DNA, 25 bp, Rattus norvegicus
ccaggccaggtttgggagaatttgc

SEQ ID NO: 653186 - DNA, 25 bp, Rattus norvegicus
cgtaatggctccccagggctggggc

SEQ ID NO: 653187 - DNA, 25 bp, Rattus norvegicus
cccagggctggggccacgtgctccg

SEQ ID NO: 653188 - DNA, 25 bp, Rattus norvegicus
agcgtaatggctccccagggctggg

SEQ ID NO: 653189 - DNA, 25 bp, Rattus norvegicus
gagcgtaatggctccccagggctgg

SEQ ID NO: 653190 - DNA, 25 bp, Rattus norvegicus
ggagcgtaatggctccccagggctg

SEQ ID NO: 653191 - DNA, 25 bp, Rattus norvegicus
aggagcgtaatggctccccagggct

SEQ ID NO: 653192 - DNA, 25 bp, Rattus norvegicus
taggagcgtaatggctccccagggc

SEQ ID NO: 653193 - DNA, 25 bp, Rattus norvegicus
ctaggagcgtaatggctccccaggg

SEQ ID NO: 653194 - DNA, 25 bp, Rattus norvegicus
tctaggagcgtaatggctccccagg

SEQ ID NO: 653195 - DNA, 25 bp, Rattus norvegicus
ctctaggagcgtaatggctccccag

SEQ ID NO: 653196 - DNA, 25 bp, Rattus norvegicus
actctaggagcgtaatggctcccca

SEQ ID NO: 653197 - DNA, 25 bp, Rattus norvegicus
tactctaggagcgtaatggctcccc

SEQ ID NO: 653198 - DNA, 25 bp, Rattus norvegicus
ctactctaggagcgtaatggctccc

SEQ ID NO: 653199 - DNA, 25 bp, Rattus norvegicus
gctactctaggagcgtaatggctcc

SEQ ID NO: 653200 - DNA, 25 bp, Rattus norvegicus
gttcattgaaccctacgagccggct

SEQ ID NO: 653201 - DNA, 25 bp, Rattus norvegicus
cgaccagtggccgaatctccctaaa

SEQ ID NO: 653202 - DNA, 25 bp, Rattus norvegicus
gtcctgtctggaattactgttgccg

SEQ ID NO: 653203 - DNA, 25 bp, Rattus norvegicus
ccggccgtggtatctgttcattgaa

SEQ ID NO: 653204 - DNA, 25 bp, Rattus norvegicus
cccttgttaaatggtcctgtctgga

SEQ ID NO: 653205 - DNA, 25 bp, Rattus norvegicus
ttgaaccctacgagccggctgggtc

SEQ ID NO: 653206 - DNA, 25 bp, Rattus norvegicus
ggtgcacgcaaggagaggtttctcc

SEQ ID NO: 653207 - DNA, 25 bp, Rattus norvegicus
agaggtttctccagcgcgcttaagt

SEQ ID NO: 653208 - DNA, 25 bp, Rattus norvegicus
ctccagcgcgcttaagtttgaaacc

SEQ ID NO: 653209 - DNA, 25 bp, Rattus norvegicus
gcgcttaagtttgaaaccgacgatc

SEQ ID NO: 653210 - DNA, 25 bp, Rattus norvegicus
ttgaaaccgacgatcccttttctgc

SEQ ID NO: 653211 - DNA, 25 bp, Rattus norvegicus
gacgatcccttttctgcctgccgcg

SEQ ID NO: 653212 - DNA, 25 bp, Rattus norvegicus
tgcctgccgcgctactctaggagcg

SEQ ID NO: 653213 - DNA, 25 bp, Rattus norvegicus
tggaattactgttgccggccgtggt

SEQ ID NO: 653214 - DNA, 25 bp, Rattus norvegicus
gagctttgatgggtcgcagtctcca

SEQ ID NO: 653215 - DNA, 25 bp, Rattus norvegicus
ccgctccggctcctgaaggagaaga

SEQ ID NO: 653216 - DNA, 25 bp, Rattus norvegicus
tctaggttcaaggtcgccgagtcac

SEQ ID NO: 653217 - DNA, 25 bp, Rattus norvegicus
cgagtcactgccgttagccagtaga

SEQ ID NO: 653218 - DNA, 25 bp, Rattus norvegicus
tggacctccagctcagcggttagca

SEQ ID NO: 653219 - DNA, 25 bp, Rattus norvegicus
cgtgtgtccaagtctgaccggtgtc

SEQ ID NO: 653220 - DNA, 25 bp, Rattus norvegicus
ccggtgtccttgaacgtcattctta

SEQ ID NO: 653221 - DNA, 25 bp, Rattus norvegicus
tgggttgaaccatgcacaaagatga

SEQ ID NO: 653222 - DNA, 25 bp, Rattus norvegicus
caggtggccttgctccacaaaaata

SEQ ID NO: 653223 - DNA, 25 bp, Rattus norvegicus
cccgcacaaatatggctgccagatc

SEQ ID NO: 653224 - DNA, 25 bp, Rattus norvegicus
gcagccgttagtgcgcatgctctct

SEQ ID NO: 653225 - DNA, 25 bp, Rattus norvegicus
gctgccgctttcacaggagtgtctg

SEQ ID NO: 653226 - DNA, 25 bp, Rattus norvegicus
tccgtcacggggtcacaacggtagc

SEQ ID NO: 653227 - DNA, 25 bp, Rattus norvegicus
cagcgctcatttccctgctggaagc

SEQ ID NO: 653228 - DNA, 25 bp, Rattus norvegicus
agagacattgcgagagatgctaccc

SEQ ID NO: 653229 - DNA, 25 bp, Rattus norvegicus
aggcagccagagacgagagacattg

SEQ ID NO: 653230 - DNA, 25 bp, Rattus norvegicus
cccgcattttggagtgtccccaaga

SEQ ID NO: 653231 - DNA, 25 bp, Rattus norvegicus
ccacgcgcgacagcgagatccagag

SEQ ID NO: 653232 - DNA, 25 bp, Rattus norvegicus
acagcgagatccagagccgagcagc

SEQ ID NO: 653233 - DNA, 25 bp, Rattus norvegicus
ccctgagagtgaatagcatccgcct

SEQ ID NO: 653234 - DNA, 25 bp, Rattus norvegicus
gagtgaatagcatccgcctctcgtc

SEQ ID NO: 653235 - DNA, 25 bp, Rattus norvegicus
agcatccgcctctcgtctaggcttg

SEQ ID NO: 653236 - DNA, 25 bp, Rattus norvegicus
gcctctcgtctaggcttggggcgct

SEQ ID NO: 653237 - DNA, 25 bp, Rattus norvegicus
tctcgcccagcgaggcttatggggt

SEQ ID NO: 653238 - DNA, 25 bp, Rattus norvegicus
cttttgcgcacagaaggggagcacg

SEQ ID NO: 653239 - DNA, 25 bp, Rattus norvegicus
ggctgccgttttatctcatccctac

SEQ ID NO: 653240 - DNA, 25 bp, Rattus norvegicus
agatctttagggaggcagccagaga

SEQ ID NO: 653241 - DNA, 25 bp, Rattus norvegicus
gcaaaggctgccgttttatctcatc

SEQ ID NO: 653242 - DNA, 25 bp, Rattus norvegicus
cgcacaaacacgacagctgaccagg

SEQ ID NO: 653243 - DNA, 25 bp, Rattus norvegicus
gcatgatgggagatgtagttcgccc

SEQ ID NO: 653244 - DNA, 25 bp, Rattus norvegicus
tttgttttgtgaggaccgcagtgct

SEQ ID NO: 653245 - DNA, 25 bp, Rattus norvegicus
cttttttgttttgtgaggaccgcag

SEQ ID NO: 653246 - DNA, 25 bp, Rattus norvegicus
caggtgaaggaatcgacttcctttt

SEQ ID NO: 653247 - DNA, 25 bp, Rattus norvegicus
gatccaggtgaaggaatcgacttcc

SEQ ID NO: 653248 - DNA, 25 bp, Rattus norvegicus
ccctctcccggggatccaggtgaag

SEQ ID NO: 653249 - DNA, 25 bp, Rattus norvegicus
gcgaaaagtctccagcgcagtcggc

SEQ ID NO: 653250 - DNA, 25 bp, Rattus norvegicus
taagcgaaaagtctccagcgcagtc

SEQ ID NO: 653251 - DNA, 25 bp, Rattus norvegicus
ctgaccaggagctaagcgaaaagtc

SEQ ID NO: 653252 - DNA, 25 bp, Rattus norvegicus
ctttcccaactgtgctaagagtgtc

SEQ ID NO: 653253 - DNA, 25 bp, Rattus norvegicus
ctgtgctaagagtgtcagagtgccc

SEQ ID NO: 653254 - DNA, 25 bp, Rattus norvegicus
gagaggaggggttctagacgcccaa

SEQ ID NO: 653255 - DNA, 25 bp, Rattus norvegicus
ggagatgtagttcgccctgctcgcc

SEQ ID NO: 653256 - DNA, 25 bp, Rattus norvegicus
agaagtcgccaccatgcgttgcgcg

SEQ ID NO: 653257 - DNA, 25 bp, Rattus norvegicus
ttctaccgtggtcaccacgtgagtg

SEQ ID NO: 653258 - DNA, 25 bp, Rattus norvegicus
tccaggtccagcacagtggtctggc

SEQ ID NO: 653259 - DNA, 25 bp, Rattus norvegicus
tctggctgctgcagtgtacgccgaa

SEQ ID NO: 653260 - DNA, 25 bp, Rattus norvegicus
cgccaccaagttggagcgggccgaa

SEQ ID NO: 653261 - DNA, 25 bp, Rattus norvegicus
tagagctcggcgtagcgctcgctca

SEQ ID NO: 653262 - DNA, 25 bp, Rattus norvegicus
tagcgctcgctcaggtagagctggc

SEQ ID NO: 653263 - DNA, 25 bp, Rattus norvegicus
gcgttgcggagcacgtaggacacca

SEQ ID NO: 653264 - DNA, 25 bp, Rattus norvegicus
taggacaccaggaggttcttgtgca

SEQ ID NO: 653265 - DNA, 25 bp, Rattus norvegicus
atcttgcgcagggagatgctgatca

SEQ ID NO: 653266 - DNA, 25 bp, Rattus norvegicus
gcaaccgcctctggtgctgcgaatg

SEQ ID NO: 653267 - DNA, 25 bp, Rattus norvegicus
aatgctgctgcttgcgtgtgtctcc

SEQ ID NO: 653268 - DNA, 25 bp, Rattus norvegicus
accacgtgagtgtccaggtccagca

SEQ ID NO: 653269 - DNA, 25 bp, Rattus norvegicus
ggtcggcgacactccgagagaagtc

SEQ ID NO: 653270 - DNA, 25 bp, Rattus norvegicus
ccatggcgacgtggccgcaaggaac

SEQ ID NO: 653271 - DNA, 25 bp, Rattus norvegicus
tggcagaggcaatgctttccaagca

SEQ ID NO: 653272 - DNA, 25 bp, Rattus norvegicus
gcttctggcagaggcaatgctttcc

SEQ ID NO: 653273 - DNA, 25 bp, Rattus norvegicus
agccgtctcgcttcggcttctggca

SEQ ID NO: 653274 - DNA, 25 bp, Rattus norvegicus
tctgctctgggagccgtctcgcttc

SEQ ID NO: 653275 - DNA, 25 bp, Rattus norvegicus
ctactcgagggtccggtgtctgctc

SEQ ID NO: 653276 - DNA, 25 bp, Rattus norvegicus
tggagaccagagctactcgagggtc

SEQ ID NO: 653277 - DNA, 25 bp, Rattus norvegicus
tggcccgtggagaccagagctactc

SEQ ID NO: 653278 - DNA, 25 bp, Rattus norvegicus
tacgacatgcgggtgggcctcgccc

SEQ ID NO: 653279 - DNA, 25 bp, Rattus norvegicus
cgcatgcgcagtacgacatgcgggt

SEQ ID NO: 653280 - DNA, 25 bp, Rattus norvegicus
tgctcagccgactggcgcatgcgca

SEQ ID NO: 653281 - DNA, 25 bp, Rattus norvegicus
cccgtgagcccgttgccacggcgac

SEQ ID NO: 653282 - DNA, 25 bp, Rattus norvegicus
acaggaagcggcagaaatagcagcc

SEQ ID NO: 653283 - DNA, 25 bp, Rattus norvegicus
ctttccaagcatgcagaaggacgtg

SEQ ID NO: 653284 - DNA, 25 bp, Rattus norvegicus
cccagcgagtcggtgccatttattt

SEQ ID NO: 653285 - DNA, 25 bp, Rattus norvegicus
acggaatttgaaatcccagcgagtc

SEQ ID NO: 653286 - DNA, 25 bp, Rattus norvegicus
cgtgagagccgctgataaacagccc

SEQ ID NO: 653287 - DNA, 25 bp, Rattus norvegicus
cgctgataaacagcccggagcggcg

SEQ ID NO: 653288 - DNA, 25 bp, Rattus norvegicus
tggcaggcgcgcaagaagctgtccc

SEQ ID NO: 653289 - DNA, 25 bp, Rattus norvegicus
ccagcgctatcagcccacggaggga

SEQ ID NO: 653290 - DNA, 25 bp, Rattus norvegicus
aaagtgtttgcttcagcccttaatc

SEQ ID NO: 653291 - DNA, 25 bp, Rattus norvegicus
gtgccatttattttcagagcctgtc

SEQ ID NO: 653292 - DNA, 25 bp, Rattus norvegicus
ttcagagcctgtcaaggctggtttc

SEQ ID NO: 653293 - DNA, 25 bp, Rattus norvegicus
caaggctggtttcggcgtttagaag

SEQ ID NO: 653294 - DNA, 25 bp, Rattus norvegicus
gaggctgagcgcatttacatctccg

SEQ ID NO: 653295 - DNA, 25 bp, Rattus norvegicus
tgagcgcatttacatctccggctcc

SEQ ID NO: 653296 - DNA, 25 bp, Rattus norvegicus
caccgcccttctggatccggtgggg

SEQ ID NO: 653297 - DNA, 25 bp, Rattus norvegicus
cttcagcccttaatcacggaatttg

SEQ ID NO: 653298 - DNA, 25 bp, Rattus norvegicus
ggaacgctgctgacagcctcgctcg

SEQ ID NO: 653299 - DNA, 25 bp, Rattus norvegicus
ccttggctctggcaggcccaggcat

SEQ ID NO: 653300 - DNA, 25 bp, Rattus norvegicus
cgctgacgagggaacgctgctgaca

SEQ ID NO: 653301 - DNA, 25 bp, Rattus norvegicus
gcccgaggcgatctttaagcgggga

SEQ ID NO: 653302 - DNA, 25 bp, Rattus norvegicus
cgtctttaagagagcgcccgaggcg

SEQ ID NO: 653303 - DNA, 25 bp, Rattus norvegicus
agcagcattcgcgtctttaagagag

SEQ ID NO: 653304 - DNA, 25 bp, Rattus norvegicus
gtcagcagcagcattcgcgtcttta

SEQ ID NO: 653305 - DNA, 25 bp, Rattus norvegicus
gatctcccaaatgtcagcagcagca

SEQ ID NO: 653306 - DNA, 25 bp, Rattus norvegicus
ccaggatctcccaaatgtcagcagc

SEQ ID NO: 653307 - DNA, 25 bp, Rattus norvegicus
atcggctgccaggatctcccaaatg

SEQ ID NO: 653308 - DNA, 25 bp, Rattus norvegicus
tttcagcttgggtttgatcggctgc

SEQ ID NO: 653309 - DNA, 25 bp, Rattus norvegicus
gctccgattttcagcttgggtttga

SEQ ID NO: 653310 - DNA, 25 bp, Rattus norvegicus
cccgcagctccgattttcagcttgg

SEQ ID NO: 653311 - DNA, 25 bp, Rattus norvegicus
ctggcaggcccaggcattcgggtcc

SEQ ID NO: 653312 - DNA, 25 bp, Rattus norvegicus
gagatggacgagtgtcgctcgccct

SEQ ID NO: 653313 - DNA, 25 bp, Rattus norvegicus
atggacgagtgtcgctcgccctgtc

SEQ ID NO: 653314 - DNA, 25 bp, Rattus norvegicus
cgcctctccctcttgcgctgctacc

SEQ ID NO: 653315 - DNA, 25 bp, Rattus norvegicus
tgctacccccatggtgctgctggag

SEQ ID NO: 653316 - DNA, 25 bp, Rattus norvegicus
cccgaagcagctttctcacatcagg

SEQ ID NO: 653317 - DNA, 25 bp, Rattus norvegicus
tctcacatcaggaccctggcgtggg

SEQ ID NO: 653318 - DNA, 25 bp, Rattus norvegicus
cacatcaggaccctggcgtggggac

SEQ ID NO: 653319 - DNA, 25 bp, Rattus norvegicus
tggcgtggggacgccttccgaccca

SEQ ID NO: 653320 - DNA, 25 bp, Rattus norvegicus
aagcgttctgggacccgttggctgc

SEQ ID NO: 653321 - DNA, 25 bp, Rattus norvegicus
gggacccgttggctgcacagtgccc

SEQ ID NO: 653322 - DNA, 25 bp, Rattus norvegicus
ccgccgtggccactgaacgattgtt

SEQ ID NO: 653323 - DNA, 25 bp, Rattus norvegicus
ccactgaacgattgttggggctgta

SEQ ID NO: 653324 - DNA, 25 bp, Rattus norvegicus
tgaacgattgttggggctgtataga

SEQ ID NO: 653325 - DNA, 25 bp, Rattus norvegicus
tgcgcgtgggtagaccgttccgcgc

SEQ ID NO: 653326 - DNA, 25 bp, Rattus norvegicus
tgaggtttccgggtagagcactacc

SEQ ID NO: 653327 - DNA, 25 bp, Rattus norvegicus
acgactctgccgctctgtacggggt

SEQ ID NO: 653328 - DNA, 25 bp, Rattus norvegicus
ctgtacggggtcgacacttccgtga

SEQ ID NO: 653329 - DNA, 25 bp, Rattus norvegicus
tggaaccctacaatggctacaagaa

SEQ ID NO: 653330 - DNA, 25 bp, Rattus norvegicus
cttctccagcccgtcgaggtcgtaa

SEQ ID NO: 653331 - DNA, 25 bp, Rattus norvegicus
atggcgttgagaacctggaacccta

SEQ ID NO: 653332 - DNA, 25 bp, Rattus norvegicus
gcaggcaacgctgcgcacgactctg

SEQ ID NO: 653333 - DNA, 25 bp, Rattus norvegicus
cgaggtcgtaacgttgtgcattatc

SEQ ID NO: 653334 - DNA, 25 bp, Rattus norvegicus
ctcttgcggggtgtcctagaagaca

SEQ ID NO: 653335 - DNA, 25 bp, Rattus norvegicus
ctagaagacagctccgtcaggctgt

SEQ ID NO: 653336 - DNA, 25 bp, Rattus norvegicus
caggctgtcgaaggtgaagaattta

SEQ ID NO: 653337 - DNA, 25 bp, Rattus norvegicus
ttaggttggtctaggtcagcacgca

SEQ ID NO: 653338 - DNA, 25 bp, Rattus norvegicus
agaggcgcctcttgcgcaagacgca

SEQ ID NO: 653339 - DNA, 25 bp, Rattus norvegicus
tcgtccagattctcaatggcgttga

SEQ ID NO: 653340 - DNA, 25 bp, Rattus norvegicus
ggggatgaagcccaagactcagcga

SEQ ID NO: 653341 - DNA, 25 bp, Rattus norvegicus
agggagctagagaagatcgcgcacc

SEQ ID NO: 653342 - DNA, 25 bp, Rattus norvegicus
ggccgcacagctgggacgatgccac

SEQ ID NO: 653343 - DNA, 25 bp, Rattus norvegicus
tttgtgcagaaccaggctccgctgg

SEQ ID NO: 653344 - DNA, 25 bp, Rattus norvegicus
ccgcgacgtgtttgtgcagaaccag

SEQ ID NO: 653345 - DNA, 25 bp, Rattus norvegicus
cagaggctcaaaactttccgcttcc

SEQ ID NO: 653346 - DNA, 25 bp, Rattus norvegicus
gatgtcagaggctcaaaactttccg

SEQ ID NO: 653347 - DNA, 25 bp, Rattus norvegicus
taaaatgcagggacgcagcaggatg

SEQ ID NO: 653348 - DNA, 25 bp, Rattus norvegicus
cggcggtaattaaaatgcagggacg

SEQ ID NO: 653349 - DNA, 25 bp, Rattus norvegicus
tcatgaatattaatgcggcggtaat

SEQ ID NO: 653350 - DNA, 25 bp, Rattus norvegicus
ccctcgagtcccggctcatgaatat

SEQ ID NO: 653351 - DNA, 25 bp, Rattus norvegicus
agcccaagactcagcgaggaagagg

SEQ ID NO: 653352 - DNA, 25 bp, Rattus norvegicus
ctgagcgccaactgttggctcgcgg

SEQ ID NO: 653353 - DNA, 25 bp, Rattus norvegicus
agctagagaagatcgcgcacctgcg

SEQ ID NO: 653354 - DNA, 25 bp, Rattus norvegicus
aggcattgtgtattgtccggccgcc

SEQ ID NO: 653355 - DNA, 25 bp, Rattus norvegicus
aagtagtttggccttcgcggctcac

SEQ ID NO: 653356 - DNA, 25 bp, Rattus norvegicus
tccggccggtggtctctaagagacc

SEQ ID NO: 653357 - DNA, 25 bp, Rattus norvegicus
gggctttcccgacatctctgtctga

SEQ ID NO: 653358 - DNA, 25 bp, Rattus norvegicus
gctcgagctcttagcctggagcatc

SEQ ID NO: 653359 - DNA, 25 bp, Rattus norvegicus
acctgcgttcggtgtgcggcttcca

SEQ ID NO: 653360 - DNA, 25 bp, Rattus norvegicus
cccactgtttgacctgcgttcggtg

SEQ ID NO: 653361 - DNA, 25 bp, Rattus norvegicus
attgacaagaactcccgccgaagcc

SEQ ID NO: 653362 - DNA, 25 bp, Rattus norvegicus
ggacggcgcgaaaacccaattgaca

SEQ ID NO: 653363 - DNA, 25 bp, Rattus norvegicus
cttgcgtgccggacggcgcgaaaac

SEQ ID NO: 653364 - DNA, 25 bp, Rattus norvegicus
tccaatagcggtcgtaggctccgcc

SEQ ID NO: 653365 - DNA, 25 bp, Rattus norvegicus
gtctgcgcagcctccaatagcggtc

SEQ ID NO: 653366 - DNA, 25 bp, Rattus norvegicus
cgcagattcgccaaaagaagtagtt

SEQ ID NO: 653367 - DNA, 25 bp, Rattus norvegicus
tcccgacatctctgtctgagcctgg

SEQ ID NO: 653368 - DNA, 25 bp, Rattus norvegicus
cgataactaatttcagcgccgcagc

SEQ ID NO: 653369 - DNA, 25 bp, Rattus norvegicus
cgtgttgaggatggccctgaggcct

SEQ ID NO: 653370 - DNA, 25 bp, Rattus norvegicus
gatcaattgacaccgccaccgggcg

SEQ ID NO: 653371 - DNA, 25 bp, Rattus norvegicus
gcgatcaattgacaccgccaccggg

SEQ ID NO: 653372 - DNA, 25 bp, Rattus norvegicus
ccgcccgcgcgcgatcaattgacac

SEQ ID NO: 653373 - DNA, 25 bp, Rattus norvegicus
ttcccgataattgcgcgccggcagc

SEQ ID NO: 653374 - DNA, 25 bp, Rattus norvegicus
taactaatttcagcgccgcagccgc

SEQ ID NO: 653375 - DNA, 25 bp, Rattus norvegicus
cgagggatcgataactaatttcagc

SEQ ID NO: 653376 - DNA, 25 bp, Rattus norvegicus
gccgagggatcgataactaatttca

SEQ ID NO: 653377 - DNA, 25 bp, Rattus norvegicus
cccgccgagggatcgataactaatt

SEQ ID NO: 653378 - DNA, 25 bp, Rattus norvegicus
gtctgcagccgtcagcgacgagcgc

SEQ ID NO: 653379 - DNA, 25 bp, Rattus norvegicus
ggcggtcaactgagcgccaatggac

SEQ ID NO: 653380 - DNA, 25 bp, Rattus norvegicus
caactgagcgccaatggaccgcggg

SEQ ID NO: 653381 - DNA, 25 bp, Rattus norvegicus
tttttcccgataattgcgcgccggc

SEQ ID NO: 653382 - DNA, 25 bp, Rattus norvegicus
ggggctgcgcggttcaccctttcaa

SEQ ID NO: 653383 - DNA, 25 bp, Rattus norvegicus
ggctgcgcggttcaccctttcaagt

SEQ ID NO: 653384 - DNA, 25 bp, Rattus norvegicus
gctgcgcggttcaccctttcaagtc

SEQ ID NO: 653385 - DNA, 25 bp, Rattus norvegicus
ctgcgcggttcaccctttcaagtcg

SEQ ID NO: 653386 - DNA, 25 bp, Rattus norvegicus
gcgcggttcaccctttcaagtcggc

SEQ ID NO: 653387 - DNA, 25 bp, Rattus norvegicus
cggttcaccctttcaagtcggcctg

SEQ ID NO: 653388 - DNA, 25 bp, Rattus norvegicus
ttcaccctttcaagtcggcctggga

SEQ ID NO: 653389 - DNA, 25 bp, Rattus norvegicus
caccctttcaagtcggcctgggagt

SEQ ID NO: 653390 - DNA, 25 bp, Rattus norvegicus
ccagcgagggctgggacatcaaagc

SEQ ID NO: 653391 - DNA, 25 bp, Rattus norvegicus
acatcaaagcggccgccgcgggatc

SEQ ID NO: 653392 - DNA, 25 bp, Rattus norvegicus
gccggccttggggaggtggctttgc

SEQ ID NO: 653393 - DNA, 25 bp, Rattus norvegicus
tggctttgcccggctcccttttatc

SEQ ID NO: 653394 - DNA, 25 bp, Rattus norvegicus
gctcccttttatcccggctgggagc

SEQ ID NO: 653395 - DNA, 25 bp, Rattus norvegicus
cggtcctgagaagccggggctgcgc

SEQ ID NO: 653396 - DNA, 25 bp, Rattus norvegicus
agaattccacgtcctgggtctcagc

SEQ ID NO: 653397 - DNA, 25 bp, Rattus norvegicus
gcggcgcaaagccaggccaacactg

SEQ ID NO: 653398 - DNA, 25 bp, Rattus norvegicus
aacagaggcagaacccgcacccgcg

SEQ ID NO: 653399 - DNA, 25 bp, Rattus norvegicus
ccgcggtgcgcagcactccagaatt

SEQ ID NO: 653400 - DNA, 25 bp, Rattus norvegicus
gcactccagaattccacgtcctggg

SEQ ID NO: 653401 - DNA, 25 bp, Rattus norvegicus
tccacgtcctgggtctcagcctgaa

SEQ ID NO: 653402 - DNA, 25 bp, Rattus norvegicus
atgacgttgacgcatcgcgtcgcat

SEQ ID NO: 653403 - DNA, 25 bp, Rattus norvegicus
ctcagcctgaaagcccagaaaggga

SEQ ID NO: 653404 - DNA, 25 bp, Rattus norvegicus
gcctgaaagcccagaaagggaccga

SEQ ID NO: 653405 - DNA, 25 bp, Rattus norvegicus
cagaaagggaccgaggcccgctcca

SEQ ID NO: 653406 - DNA, 25 bp, Rattus norvegicus
gcccagcgcagatgacgttgacgca

SEQ ID NO: 653407 - DNA, 25 bp, Rattus norvegicus
gcagatgacgttgacgcatcgcgtc

SEQ ID NO: 653408 - DNA, 25 bp, Rattus norvegicus
acgtcctgggtctcagcctgaaagc

SEQ ID NO: 653409 - DNA, 25 bp, Rattus norvegicus
tgcgcagcactccagaattccacgt

SEQ ID NO: 653410 - DNA, 25 bp, Rattus norvegicus
agcagaagccggctctggcaggacc

SEQ ID NO: 653411 - DNA, 25 bp, Rattus norvegicus
cccgcaggccatagcgccggtaagg

SEQ ID NO: 653412 - DNA, 25 bp, Rattus norvegicus
agatcgaatgccagcccgcaggcca

SEQ ID NO: 653413 - DNA, 25 bp, Rattus norvegicus
ggccgcaggaagatcgaatgccagc

SEQ ID NO: 653414 - DNA, 25 bp, Rattus norvegicus
agagctcagctcaggacaccttcgc

SEQ ID NO: 653415 - DNA, 25 bp, Rattus norvegicus
tggcgccggaacatcctgagtcaga

SEQ ID NO: 653416 - DNA, 25 bp, Rattus norvegicus
agcatctgtagctgctgaagggcgc

SEQ ID NO: 653417 - DNA, 25 bp, Rattus norvegicus
agcgtgggcagcagcatctgtagct

SEQ ID NO: 653418 - DNA, 25 bp, Rattus norvegicus
gtgctgggacttgcggtcccgccac

SEQ ID NO: 653419 - DNA, 25 bp, Rattus norvegicus
gcggaacttgttgggcagcagttcc

SEQ ID NO: 653420 - DNA, 25 bp, Rattus norvegicus
ctctgcgatcttggcgcgcagctgg

SEQ ID NO: 653421 - DNA, 25 bp, Rattus norvegicus
gtccgcctctggctctgcgatcttg

SEQ ID NO: 653422 - DNA, 25 bp, Rattus norvegicus
tggcaggaccctcgcctgctgtgtc

SEQ ID NO: 653423 - DNA, 25 bp, Rattus norvegicus
tcccgggtcaagctgctctgcagca

SEQ ID NO: 653424 - DNA, 25 bp, Rattus norvegicus
caactgcccgaagcggtgaggccct

SEQ ID NO: 653425 - DNA, 25 bp, Rattus norvegicus
catggaggttcaccgaccagacccg

SEQ ID NO: 653426 - DNA, 25 bp, Rattus norvegicus
acgtcccatggaggttcaccgacca

SEQ ID NO: 653427 - DNA, 25 bp, Rattus norvegicus
cccacgtgcacgtcccatggaggtt

SEQ ID NO: 653428 - DNA, 25 bp, Rattus norvegicus
gtgaggccctgtcgtcaagtgacct

SEQ ID NO: 653429 - DNA, 25 bp, Rattus norvegicus
gaggagggaggtgctcaccccaact

SEQ ID NO: 653430 - DNA, 25 bp, Rattus norvegicus
accacctaggtgagtagcacgaggc

SEQ ID NO: 653431 - DNA, 25 bp, Rattus norvegicus
cctggagccaccacctaggtgagta

SEQ ID NO: 653432 - DNA, 25 bp, Rattus norvegicus
cttgtctttcgagtccctggagcca

SEQ ID NO: 653433 - DNA, 25 bp, Rattus norvegicus
tcaacccgtccttgtctttcgagtc

SEQ ID NO: 653434 - DNA, 25 bp, Rattus norvegicus
gggctacggtctttgccagcctcct

SEQ ID NO: 653435 - DNA, 25 bp, Rattus norvegicus
cagccgtgggctacggtctttgcca

SEQ ID NO: 653436 - DNA, 25 bp, Rattus norvegicus
cctaccaggctcagggaagtgacgt

SEQ ID NO: 653437 - DNA, 25 bp, Rattus norvegicus
caagtgacctggctctggcccacgt

SEQ ID NO: 653438 - DNA, 25 bp, Rattus norvegicus
gaggacctcgcgactatcatcactg

SEQ ID NO: 653439 - DNA, 25 bp, Rattus norvegicus
gtggcacaagcactccgaaggcgta

SEQ ID NO: 653440 - DNA, 25 bp, Rattus norvegicus
gcgtagcgctcctagtacccaagga

SEQ ID NO: 653441 - DNA, 25 bp, Rattus norvegicus
agggcacacggaccacaccggcttg

SEQ ID NO: 653442 - DNA, 25 bp, Rattus norvegicus
gactctcgaagaggcctgctgtctg

SEQ ID NO: 653443 - DNA, 25 bp, Rattus norvegicus
ctgtctgcaaaaagcgctgtcggtc

SEQ ID NO: 653444 - DNA, 25 bp, Rattus norvegicus
gcatccatgcacagggagcggctcc

SEQ ID NO: 653445 - DNA, 25 bp, Rattus norvegicus
acaaccacaggggaccgcagcgact

SEQ ID NO: 653446 - DNA, 25 bp, Rattus norvegicus
gcagcgactcactcatccagaggct

SEQ ID NO: 653447 - DNA, 25 bp, Rattus norvegicus
caccaggggctggtactcgaagatg

SEQ ID NO: 653448 - DNA, 25 bp, Rattus norvegicus
cgaagatgatcctgcggaagccgtg

SEQ ID NO: 653449 - DNA, 25 bp, Rattus norvegicus
ttccgcaccggaagttatcctacca

SEQ ID NO: 653450 - DNA, 25 bp, Rattus norvegicus
cctgtgagggctcatgtgcattaca

SEQ ID NO: 653451 - DNA, 25 bp, Rattus norvegicus
tacttcctgtcctgagggcctgtga

SEQ ID NO: 653452 - DNA, 25 bp, Rattus norvegicus
gcccgcacccggtgactgcgcccag

SEQ ID NO: 653453 - DNA, 25 bp, Rattus norvegicus
cggcgccgcaggacggtgagtgcgc

SEQ ID NO: 653454 - DNA, 25 bp, Rattus norvegicus
gagccacctcctggacctggaggag

SEQ ID NO: 653455 - DNA, 25 bp, Rattus norvegicus
tgagccacctcctggacctggagga

SEQ ID NO: 653456 - DNA, 25 bp, Rattus norvegicus
ggtgagccacctcctggacctggag

SEQ ID NO: 653457 - DNA, 25 bp, Rattus norvegicus
tcggtgagccacctcctggacctgg

SEQ ID NO: 653458 - DNA, 25 bp, Rattus norvegicus
cgcaagaacttctcggtgagccacc

SEQ ID NO: 653459 - DNA, 25 bp, Rattus norvegicus
gcccggggcatggacagcgcggccg

SEQ ID NO: 653460 - DNA, 25 bp, Rattus norvegicus
accgactgacttgagagccggcgcg

SEQ ID NO: 653461 - DNA, 25 bp, Rattus norvegicus
cccgaccgactgacttgagagccgg

SEQ ID NO: 653462 - DNA, 25 bp, Rattus norvegicus
ccgctggctagcgagcggcccgccc

SEQ ID NO: 653463 - DNA, 25 bp, Rattus norvegicus
ccgacaaggggcgtgtggcctgggc

SEQ ID NO: 653464 - DNA, 25 bp, Rattus norvegicus
cgcctcctgccggacggcgcaggac

SEQ ID NO: 653465 - DNA, 25 bp, Rattus norvegicus
gcaagaacttctcggtgagccacct

SEQ ID NO: 653466 - DNA, 25 bp, Rattus norvegicus
gctgttaattttgtctcggccgcgg

SEQ ID NO: 653467 - DNA, 25 bp, Rattus norvegicus
aggctacaaccggtcctgctactcg

SEQ ID NO: 653468 - DNA, 25 bp, Rattus norvegicus
gggatggtgaccgtagtacccaaga

SEQ ID NO: 653469 - DNA, 25 bp, Rattus norvegicus
gaccgtagtacccaagatgcgacag

SEQ ID NO: 653470 - DNA, 25 bp, Rattus norvegicus
agtacccaagatgcgacagggcgtg

SEQ ID NO: 653471 - DNA, 25 bp, Rattus norvegicus
ggcgcgccaggctgttaattttgtc

SEQ ID NO: 653472 - DNA, 25 bp, Rattus norvegicus
cctggcgcgcacatggcaggcgtct

SEQ ID NO: 653473 - DNA, 25 bp, Rattus norvegicus
cccaggccgaagaggaaatgactga

SEQ ID NO: 653474 - DNA, 25 bp, Rattus norvegicus
cgaagaggaaatgactgaacccagg

SEQ ID NO: 653475 - DNA, 25 bp, Rattus norvegicus
tgaacccaggacctgctgacggaag

SEQ ID NO: 653476 - DNA, 25 bp, Rattus norvegicus
caggacctgctgacggaaggtgttt

SEQ ID NO: 653477 - DNA, 25 bp, Rattus norvegicus
tgacggaaggtgtttttttatgcca

SEQ ID NO: 653478 - DNA, 25 bp, Rattus norvegicus
ccgggatactgaggaccccaggccg

SEQ ID NO: 653479 - DNA, 25 bp, Rattus norvegicus
ttttatgccaggctacaaccggtcc

SEQ ID NO: 653480 - DNA, 25 bp, Rattus norvegicus
gcttcaccgagtgctgccatgagga

SEQ ID NO: 653481 - DNA, 25 bp, Rattus norvegicus
ttttctggctaagcggaagtgacgc

SEQ ID NO: 653482 - DNA, 25 bp, Rattus norvegicus
gaagtgacgcaccataccggaagtg

SEQ ID NO: 653483 - DNA, 25 bp, Rattus norvegicus
cataccggaagtggggtccgctgct

SEQ ID NO: 653484 - DNA, 25 bp, Rattus norvegicus
tggacttcgttgagtgcgatgagac

SEQ ID NO: 653485 - DNA, 25 bp, Rattus norvegicus
gtgtcagcgctcaccggctacctgt

SEQ ID NO: 653486 - DNA, 25 bp, Rattus norvegicus
gcgacttttactgccgcttcaccga

SEQ ID NO: 653487 - DNA, 25 bp, Rattus norvegicus
caacaaggcggttttctggctaagc

SEQ ID NO: 653488 - DNA, 25 bp, Rattus norvegicus
tcaacacgtcgggtatgtgcccgcg

SEQ ID NO: 653489 - DNA, 25 bp, Rattus norvegicus
tcggctctctctccagctggatgcg

SEQ ID NO: 653490 - DNA, 25 bp, Rattus norvegicus
gggaaacagacaccgctaggacctc

SEQ ID NO: 653491 - DNA, 25 bp, Rattus norvegicus
accttcgcagtccttcagatggccg

SEQ ID NO: 653492 - DNA, 25 bp, Rattus norvegicus
agatggccgccttgagaactgaacg

SEQ ID NO: 653493 - DNA, 25 bp, Rattus norvegicus
gctacctgtcctatagcgactttta

SEQ ID NO: 653494 - DNA, 25 bp, Rattus norvegicus
tccatctaagcatcgggagcgcacc

SEQ ID NO: 653495 - DNA, 25 bp, Rattus norvegicus
cgtacgcattttgcttggccgcagc

SEQ ID NO: 653496 - DNA, 25 bp, Rattus norvegicus
ttggccgcagccaaatcagcacggg

SEQ ID NO: 653497 - DNA, 25 bp, Rattus norvegicus
ctgagtaaacgggtccgccatggta

SEQ ID NO: 653498 - DNA, 25 bp, Rattus norvegicus
gcgggtccctagctcagaacctcta

SEQ ID NO: 653499 - DNA, 25 bp, Rattus norvegicus
accgaattgtgtcccgcttccctag

SEQ ID NO: 653500 - DNA, 25 bp, Rattus norvegicus
ggtcccttctgcctacctgaaattg

SEQ ID NO: 653501 - DNA, 25 bp, Rattus norvegicus
gtgcagttggttagggtctctttca

SEQ ID NO: 653502 - DNA, 25 bp, Rattus norvegicus
ggtctctttcaggtcctcgccattg

SEQ ID NO: 653503 - DNA, 25 bp, Rattus norvegicus
agacgtcctttccacggtgccacga

SEQ ID NO: 653504 - DNA, 25 bp, Rattus norvegicus
acttccgcccttgactgtctaggtc

SEQ ID NO: 653505 - DNA, 25 bp, Rattus norvegicus
tgtctaggtccagcagccaataggc

SEQ ID NO: 653506 - DNA, 25 bp, Rattus norvegicus
gtcgggattatcaagcaactctagc

SEQ ID NO: 653507 - DNA, 25 bp, Rattus norvegicus
ccgagagttactcagcgggtcccta

SEQ ID NO: 653508 - DNA, 25 bp, Rattus norvegicus
cccttccgtggtctcctgggtatcg

SEQ ID NO: 653509 - DNA, 25 bp, Rattus norvegicus
ctgctcctgaaacccgggaccttgg

SEQ ID NO: 653510 - DNA, 25 bp, Rattus norvegicus
accgaggaagcggttccctcactcg

SEQ ID NO: 653511 - DNA, 25 bp, Rattus norvegicus
ccactgccgcgcaaggaccgaggaa

SEQ ID NO: 653512 - DNA, 25 bp, Rattus norvegicus
ggtgccacctggagctctttgaccc

SEQ ID NO: 653513 - DNA, 25 bp, Rattus norvegicus
caacagatgcggtccatgccctggg

SEQ ID NO: 653514 - DNA, 25 bp, Rattus norvegicus
ttggtcctcgctccgcaacagatgc

SEQ ID NO: 653515 - DNA, 25 bp, Rattus norvegicus
cccagtccttctcgctggagagttt

SEQ ID NO: 653516 - DNA, 25 bp, Rattus norvegicus
actcagactcgctcctcgcttggga

SEQ ID NO: 653517 - DNA, 25 bp, Rattus norvegicus
ggagcccgttcacgcgcgactcaga

SEQ ID NO: 653518 - DNA, 25 bp, Rattus norvegicus
tgggcgaccgtgaacgcaacaagaa

SEQ ID NO: 653519 - DNA, 25 bp, Rattus norvegicus
ccatgagcgtccagaagcgggaacc

SEQ ID NO: 653520 - DNA, 25 bp, Rattus norvegicus
cggccagggaaacacaggaccatga

SEQ ID NO: 653521 - DNA, 25 bp, Rattus norvegicus
gatctgaatccttctccggcggcca

SEQ ID NO: 653522 - DNA, 25 bp, Rattus norvegicus
ttctggccgcagcactcggcgaaga

SEQ ID NO: 653523 - DNA, 25 bp, Rattus norvegicus
aggctgatgggctccaccgcacgaa

SEQ ID NO: 653524 - DNA, 25 bp, Rattus norvegicus
cccagactggtgtttccggttcctg

SEQ ID NO: 653525 - DNA, 25 bp, Rattus norvegicus
ggaaggaccctggtactgcgaactc

SEQ ID NO: 653526 - DNA, 25 bp, Rattus norvegicus
agtacgccggctagggccagaccca

SEQ ID NO: 653527 - DNA, 25 bp, Rattus norvegicus
ataggagatatagccggtgagtacg

SEQ ID NO: 653528 - DNA, 25 bp, Rattus norvegicus
cagcactcggcgaagaggcagtaga

SEQ ID NO: 653529 - DNA, 25 bp, Rattus norvegicus
aaagtctgtcctggccgcggcgtca

SEQ ID NO: 653530 - DNA, 25 bp, Rattus norvegicus
ctggcctctgaccaaagtctgtcct

SEQ ID NO: 653531 - DNA, 25 bp, Rattus norvegicus
gagctctgcgcagggctgacatcct

SEQ ID NO: 653532 - DNA, 25 bp, Rattus norvegicus
caaagctaagcggaagaggcgccgt

SEQ ID NO: 653533 - DNA, 25 bp, Rattus norvegicus
ctttcctaggggttggccttgagat

SEQ ID NO: 653534 - DNA, 25 bp, Rattus norvegicus
actgcgaactctgccctttcctagg

SEQ ID NO: 653535 - DNA, 25 bp, Rattus norvegicus
acggctgaggctccgcttctggccg

SEQ ID NO: 653536 - DNA, 25 bp, Rattus norvegicus
gctcttcgccagcaggacagcctta

SEQ ID NO: 653537 - DNA, 25 bp, Rattus norvegicus
tcacaaaagctgaccgccttgccgg

SEQ ID NO: 653538 - DNA, 25 bp, Rattus norvegicus
ctagcttttgagcaggccgcacgtc

SEQ ID NO: 653539 - DNA, 25 bp, Rattus norvegicus
caagactatgcgcatcgccgcggtg

SEQ ID NO: 653540 - DNA, 25 bp, Rattus norvegicus
cgcggcaggctttgccacaagacta

SEQ ID NO: 653541 - DNA, 25 bp, Rattus norvegicus
tctcccgattggacttctgacggtg

SEQ ID NO: 653542 - DNA, 25 bp, Rattus norvegicus
gtccctggcataggctctcccgatt

SEQ ID NO: 653543 - DNA, 25 bp, Rattus norvegicus
ccttgccggggttgaatatcagtcc

SEQ ID NO: 653544 - DNA, 25 bp, Rattus norvegicus
tactcccggcatgcttgggcactca

SEQ ID NO: 653545 - DNA, 25 bp, Rattus norvegicus
tccgagtctcagatatgcgcattta

SEQ ID NO: 653546 - DNA, 25 bp, Rattus norvegicus
cgcccgctcggaactcggaaaagag

SEQ ID NO: 653547 - DNA, 25 bp, Rattus norvegicus
tcttcccggtgatccgcatagcgga

SEQ ID NO: 653548 - DNA, 25 bp, Rattus norvegicus
ctctagtaggccgtgacctgtgaca

SEQ ID NO: 653549 - DNA, 25 bp, Rattus norvegicus
cagggattatcgtgccaccgctgga

SEQ ID NO: 653550 - DNA, 25 bp, Rattus norvegicus
aggggcgcgcgcaattacgcagccc

SEQ ID NO: 653551 - DNA, 25 bp, Rattus norvegicus
gcacccaactctcttgggaccggtg

SEQ ID NO: 653552 - DNA, 25 bp, Rattus norvegicus
tcgctctattgctgtctaccttcta

SEQ ID NO: 653553 - DNA, 25 bp, Rattus norvegicus
ccaggtcattgttattcggcagcca

SEQ ID NO: 653554 - DNA, 25 bp, Rattus norvegicus
caaaatggcccgaggaagcagcaga

SEQ ID NO: 653555 - DNA, 25 bp, Rattus norvegicus
tgttattcggcagccagcgcaccca

SEQ ID NO: 653556 - DNA, 25 bp, Rattus norvegicus
tcgctccgcgcggagcaaaatggcc

SEQ ID NO: 653557 - DNA, 25 bp, Rattus norvegicus
tgggaccggtgctctctgtcttcag

SEQ ID NO: 653558 - DNA, 25 bp, Rattus norvegicus
agaatgcggaaagcccgccgcttcc

SEQ ID NO: 653559 - DNA, 25 bp, Rattus norvegicus
tccggaccctgagaatgcggaaagc

SEQ ID NO: 653560 - DNA, 25 bp, Rattus norvegicus
gttccctctgctgggcgacgacgca

SEQ ID NO: 653561 - DNA, 25 bp, Rattus norvegicus
ttgccgctccgggagccagaaccta

SEQ ID NO: 653562 - DNA, 25 bp, Rattus norvegicus
tggccggtgatcacgtcgctctatt

SEQ ID NO: 653563 - DNA, 25 bp, Rattus norvegicus
ggaccggactgacagctcgtgcata

SEQ ID NO: 653564 - DNA, 25 bp, Rattus norvegicus
tggaataaatatggccgtccgggta

SEQ ID NO: 653565 - DNA, 25 bp, Rattus norvegicus
gggtctctaagttcggcccttgagc

SEQ ID NO: 653566 - DNA, 25 bp, Rattus norvegicus
ggatagtctgatccctgcgggtttg

SEQ ID NO: 653567 - DNA, 25 bp, Rattus norvegicus
tgagccaactttagccctgcggggt

SEQ ID NO: 653568 - DNA, 25 bp, Rattus norvegicus
ctggcgctcaaagtaaggcctggca

SEQ ID NO: 653569 - DNA, 25 bp, Rattus norvegicus
tgctaccactgctggcattgttgga

SEQ ID NO: 653570 - DNA, 25 bp, Rattus norvegicus
acgccgcactttgacccggaagtga

SEQ ID NO: 653571 - DNA, 25 bp, Rattus norvegicus
ttcccggaaaatgatctcaaggacc

SEQ ID NO: 653572 - DNA, 25 bp, Rattus norvegicus
gagaccagagttgcattttcccgga

SEQ ID NO: 653573 - DNA, 25 bp, Rattus norvegicus
ccgctcaggtccttcggagaccaga

SEQ ID NO: 653574 - DNA, 25 bp, Rattus norvegicus
ctgaacagtcaggaggtggtccgct

SEQ ID NO: 653575 - DNA, 25 bp, Rattus norvegicus
gtccgtgttggacttgctccgccat

SEQ ID NO: 653576 - DNA, 25 bp, Rattus norvegicus
cagccgcggcctaaatctccaaaga

SEQ ID NO: 653577 - DNA, 25 bp, Rattus norvegicus
tccgccctgggaagccaactgaaca

SEQ ID NO: 653578 - DNA, 25 bp, Rattus norvegicus
gagcatgtgctacgcagcccagtaa

SEQ ID NO: 653579 - DNA, 25 bp, Rattus norvegicus
ccagagcccaacacatccaagtgga

SEQ ID NO: 653580 - DNA, 25 bp, Rattus norvegicus
catccaagtggaatgaatgaatcgc

SEQ ID NO: 653581 - DNA, 25 bp, Rattus norvegicus
atgaatcgcgcctggcagggacttg

SEQ ID NO: 653582 - DNA, 25 bp, Rattus norvegicus
ctggcagggacttggcctcgttcat

SEQ ID NO: 653583 - DNA, 25 bp, Rattus norvegicus
ttggcctcgttcatgtccgattttc

SEQ ID NO: 653584 - DNA, 25 bp, Rattus norvegicus
ttcatgtccgattttccgggccctc

SEQ ID NO: 653585 - DNA, 25 bp, Rattus norvegicus
ctcaactcggagatcgcgcctgtcg

SEQ ID NO: 653586 - DNA, 25 bp, Rattus norvegicus
cgcagcggtagcgagcatgtgctac

SEQ ID NO: 653587 - DNA, 25 bp, Rattus norvegicus
tgctacgcagcccagtaaccaggga

SEQ ID NO: 653588 - DNA, 25 bp, Rattus norvegicus
ttgaaccgtcagctgcggtcgcgca

SEQ ID NO: 653589 - DNA, 25 bp, Rattus norvegicus
tggccgcttgcaccgcaaaggcctg

SEQ ID NO: 653590 - DNA, 25 bp, Rattus norvegicus
cagtaaccagggacgaccgcggcta

SEQ ID NO: 653591 - DNA, 25 bp, Rattus norvegicus
gctgagtggcggctccgagtccacc

SEQ ID NO: 653592 - DNA, 25 bp, Rattus norvegicus
acgcattctggagcgcagtctgagc

SEQ ID NO: 653593 - DNA, 25 bp, Rattus norvegicus
cacgttctgccttgcctggcgcaaa

SEQ ID NO: 653594 - DNA, 25 bp, Rattus norvegicus
ccctgcatcctcgaggtgttgtcct

SEQ ID NO: 653595 - DNA, 25 bp, Rattus norvegicus
cagccgggtcatcgccaactatgcg

SEQ ID NO: 653596 - DNA, 25 bp, Rattus norvegicus
gatcgacggcgcctcacgcattctg

SEQ ID NO: 653597 - DNA, 25 bp, Rattus norvegicus
gctccatgtgggacgatctgatgca

SEQ ID NO: 653598 - DNA, 25 bp, Rattus norvegicus
tcttcgatgtcaccggctccatgtg

SEQ ID NO: 653599 - DNA, 25 bp, Rattus norvegicus
accctggccttcgtcttcgatgtca

SEQ ID NO: 653600 - DNA, 25 bp, Rattus norvegicus
gtcacatctgatgagcccacgaaga

SEQ ID NO: 653601 - DNA, 25 bp, Rattus norvegicus
gctcctggcgacctacacagtagtg

SEQ ID NO: 653602 - DNA, 25 bp, Rattus norvegicus
gtcccattagggctgcagcctccgg

SEQ ID NO: 653603 - DNA, 25 bp, Rattus norvegicus
gctagagcgagactgcactgccatc

SEQ ID NO: 653604 - DNA, 25 bp, Rattus norvegicus
gaaagtttgagtcacgccgcagggc

SEQ ID NO: 653605 - DNA, 25 bp, Rattus norvegicus
actatgcgctggtgcctttccacga

SEQ ID NO: 653606 - DNA, 25 bp, Rattus norvegicus
tgctaattgcagtgtcgccctaccc

SEQ ID NO: 653607 - DNA, 25 bp, Rattus norvegicus
tggcatccctgccaaccgtacggag

SEQ ID NO: 653608 - DNA, 25 bp, Rattus norvegicus
accgtacggagctcaccgtgctgga

SEQ ID NO: 653609 - DNA, 25 bp, Rattus norvegicus
cgcgctggacaaggagcggtctaca

SEQ ID NO: 653610 - DNA, 25 bp, Rattus norvegicus
aggagcggtctacacccgcagagcg

SEQ ID NO: 653611 - DNA, 25 bp, Rattus norvegicus
agagcctctacgtcctgctaattgc

SEQ ID NO: 653612 - DNA, 25 bp, Rattus norvegicus
gtcgccctacccgtactgaagctgg

SEQ ID NO: 653613 - DNA, 25 bp, Rattus norvegicus
tacccgtactgaagctggcgaggcc

SEQ ID NO: 653614 - DNA, 25 bp, Rattus norvegicus
gaggccagagctgcagatccaccgt

SEQ ID NO: 653615 - DNA, 25 bp, Rattus norvegicus
agatccaccgtgacctcgcagagag

SEQ ID NO: 653616 - DNA, 25 bp, Rattus norvegicus
cgtgacacctacagtgacagagaac

SEQ ID NO: 653617 - DNA, 25 bp, Rattus norvegicus
gtcagcgagatcttcggtaaacact

SEQ ID NO: 653618 - DNA, 25 bp, Rattus norvegicus
tggccgccttctccgaggctggcat

SEQ ID NO: 653619 - DNA, 25 bp, Rattus norvegicus
gatcttcggtaaacactgctgtgcg

SEQ ID NO: 653620 - DNA, 25 bp, Rattus norvegicus
gctcactggtaagaagttccgggcc

SEQ ID NO: 653621 - DNA, 25 bp, Rattus norvegicus
atctggggacctaaactgcaagcgc

SEQ ID NO: 653622 - DNA, 25 bp, Rattus norvegicus
cctagaagcgctttcaagggtcctt

SEQ ID NO: 653623 - DNA, 25 bp, Rattus norvegicus
tcaagggtccttgcaagacgactgc

SEQ ID NO: 653624 - DNA, 25 bp, Rattus norvegicus
agacgactgcgatcagccttgctag

SEQ ID NO: 653625 - DNA, 25 bp, Rattus norvegicus
tctcgcttccgaggaatcgcagagg

SEQ ID NO: 653626 - DNA, 25 bp, Rattus norvegicus
gtcacgcgggttccaacctctgctg

SEQ ID NO: 653627 - DNA, 25 bp, Rattus norvegicus
gtgtcctggacgctgtgacgcacac

SEQ ID NO: 653628 - DNA, 25 bp, Rattus norvegicus
ccgcaggtggcctcgagttctgaga

SEQ ID NO: 653629 - DNA, 25 bp, Rattus norvegicus
ggccctgtgcttataaccctggatg

SEQ ID NO: 653630 - DNA, 25 bp, Rattus norvegicus
ttataaccctggatgcgcgcctctc

SEQ ID NO: 653631 - DNA, 25 bp, Rattus norvegicus
cgcctgggctcactggtaagaagtt

SEQ ID NO: 653632 - DNA, 25 bp, Rattus norvegicus
tactctctatccagggtctcgcttc

SEQ ID NO: 653633 - DNA, 25 bp, Rattus norvegicus
gccttgctagtcacgcgggttccaa

SEQ ID NO: 653634 - DNA, 25 bp, Rattus norvegicus
tggaggagccacgtccacgtttttc

SEQ ID NO: 653635 - DNA, 25 bp, Rattus norvegicus
tcacgccctggacgtggcttctgca

SEQ ID NO: 653636 - DNA, 25 bp, Rattus norvegicus
tcgggtgtagactccaggcatccat

SEQ ID NO: 653637 - DNA, 25 bp, Rattus norvegicus
ggggttcaaatctcggcagctcctg

SEQ ID NO: 653638 - DNA, 25 bp, Rattus norvegicus
ggaggaagccttagccgagcgctcc

SEQ ID NO: 653639 - DNA, 25 bp, Rattus norvegicus
cacaggcctactatccggggttcaa

SEQ ID NO: 653640 - DNA, 25 bp, Rattus norvegicus
acagcagtcatgtgctttgagaccc

SEQ ID NO: 653641 - DNA, 25 bp, Rattus norvegicus
cacttccggccggacagcagtcatg

SEQ ID NO: 653642 - DNA, 25 bp, Rattus norvegicus
tttgaccgacagctgcctgtgctcg

SEQ ID NO: 653643 - DNA, 25 bp, Rattus norvegicus
ggcttctgcagccttgggaaaccgc

SEQ ID NO: 653644 - DNA, 25 bp, Rattus norvegicus
acaacagggactacgtggtcgcacc

SEQ ID NO: 653645 - DNA, 25 bp, Rattus norvegicus
ctagtgcacctcgaccgcttgggtg

SEQ ID NO: 653646 - DNA, 25 bp, Rattus norvegicus
cgcaacctggcctttttgaccgaca

SEQ ID NO: 653647 - DNA, 25 bp, Rattus norvegicus
agacctatctctctctgagcgggca

SEQ ID NO: 653648 - DNA, 25 bp, Rattus norvegicus
atccgccgcattcttcgctttcttg

SEQ ID NO: 653649 - DNA, 25 bp, Rattus norvegicus
gtcgatcgatacctgcgcgggacct

SEQ ID NO: 653650 - DNA, 25 bp, Rattus norvegicus
cccgccgctaatatctttttaatga

SEQ ID NO: 653651 - DNA, 25 bp, Rattus norvegicus
ccagcaagatctgccctccagggtg

SEQ ID NO: 653652 - DNA, 25 bp, Rattus norvegicus
ccctagagatggttgggacgacaaa

SEQ ID NO: 653653 - DNA, 25 bp, Rattus norvegicus
accgatcgagttggccctgcctgac

SEQ ID NO: 653654 - DNA, 25 bp, Rattus norvegicus
gcgctggcattaaggattggaattc

SEQ ID NO: 653655 - DNA, 25 bp, Rattus norvegicus
cgctgctgtggtcccaatgacctaa

SEQ ID NO: 653656 - DNA, 25 bp, Rattus norvegicus
gctctctgccagaggcaacaagttg

SEQ ID NO: 653657 - DNA, 25 bp, Rattus norvegicus
aacaagttggaattagcccggcctg

SEQ ID NO: 653658 - DNA, 25 bp, Rattus norvegicus
accctcttggtgtaccttggtccag

SEQ ID NO: 653659 - DNA, 25 bp, Rattus norvegicus
tgtcctttctacatcccactcgggg

SEQ ID NO: 653660 - DNA, 25 bp, Rattus norvegicus
gctcggtctcattccggtcgatcga

SEQ ID NO: 653661 - DNA, 25 bp, Rattus norvegicus
cgattgattcgttccgcccagagtc

SEQ ID NO: 653662 - DNA, 25 bp, Rattus norvegicus
gacgttccgaaagcgcttgtccctc

SEQ ID NO: 653663 - DNA, 25 bp, Rattus norvegicus
tcgcaggccttgaccccttcagttt

SEQ ID NO: 653664 - DNA, 25 bp, Rattus norvegicus
tccatacatgagagcgttgacgttc

SEQ ID NO: 653665 - DNA, 25 bp, Rattus norvegicus
cgggttttgcgttaccgtcagtctg

SEQ ID NO: 653666 - DNA, 25 bp, Rattus norvegicus
gaccctctcgctgcgaaagctgtcg

SEQ ID NO: 653667 - DNA, 25 bp, Rattus norvegicus
ggagaacgtgagtccgcaccctgcc

SEQ ID NO: 653668 - DNA, 25 bp, Rattus norvegicus
cctccgacatgaagaaagacgtgcg

SEQ ID NO: 653669 - DNA, 25 bp, Rattus norvegicus
tgcgagcctccgacatgaagaaaga

SEQ ID NO: 653670 - DNA, 25 bp, Rattus norvegicus
cgttgacgttccgaaagcgcttgtc

SEQ ID NO: 653671 - DNA, 25 bp, Rattus norvegicus
ggggcgctgttccatacatgagagc

SEQ ID NO: 653672 - DNA, 25 bp, Rattus norvegicus
cctgcaggggcgctgttccatacat

SEQ ID NO: 653673 - DNA, 25 bp, Rattus norvegicus
ttaccgtcagtctgcctgcaggggc

SEQ ID NO: 653674 - DNA, 25 bp, Rattus norvegicus
tttgcgttaccgtcagtctgcctgc

SEQ ID NO: 653675 - DNA, 25 bp, Rattus norvegicus
gaaagctgtcgcctccctccgcctt

SEQ ID NO: 653676 - DNA, 25 bp, Rattus norvegicus
gtcgctatctccgtggtacgtgcca

SEQ ID NO: 653677 - DNA, 25 bp, Rattus norvegicus
gtacgccggtaaccaggacgcaatg

SEQ ID NO: 653678 - DNA, 25 bp, Rattus norvegicus
cgcagaaacttaacctcctaccttg

SEQ ID NO: 653679 - DNA, 25 bp, Rattus norvegicus
tgcccagcctgcaggtgcacgatct

SEQ ID NO: 653680 - DNA, 25 bp, Rattus norvegicus
ccgacgctctgccagcatttatata

SEQ ID NO: 653681 - DNA, 25 bp, Rattus norvegicus
gccagcccaggattggaccttcaga

SEQ ID NO: 653682 - DNA, 25 bp, Rattus norvegicus
gccaggaagtgcctttgtttcattg

SEQ ID NO: 653683 - DNA, 25 bp, Rattus norvegicus
gctcattattggtcagtcctgcctg

SEQ ID NO: 653684 - DNA, 25 bp, Rattus norvegicus
gcctggggttctccctatcacaatc

SEQ ID NO: 653685 - DNA, 25 bp, Rattus norvegicus
cgccgcagtgctcaatccattgggt

SEQ ID NO: 653686 - DNA, 25 bp, Rattus norvegicus
cactccgagagcctaacactattgg

SEQ ID NO: 653687 - DNA, 25 bp, Rattus norvegicus
ctattggctgcgttgttttggcgtc

SEQ ID NO: 653688 - DNA, 25 bp, Rattus norvegicus
tgccagtgggatcaatgccatgctc

SEQ ID NO: 653689 - DNA, 25 bp, Rattus norvegicus
gctcgtcgctgattacctcccagaa

SEQ ID NO: 653690 - DNA, 25 bp, Rattus norvegicus
atctcggagtgtccctcctgcaggg

SEQ ID NO: 653691 - DNA, 25 bp, Rattus norvegicus
tgggtgctaaccaggctgctttctt

SEQ ID NO: 653692 - DNA, 25 bp, Rattus norvegicus
gcaacctgcgctcgcacatgcgtat

SEQ ID NO: 653693 - DNA, 25 bp, Rattus norvegicus
gtatccacacgctggacaagccctt

SEQ ID NO: 653694 - DNA, 25 bp, Rattus norvegicus
agcccttcgtgtgccgcttctgcaa

SEQ ID NO: 653695 - DNA, 25 bp, Rattus norvegicus
gcgagcgtccctacaagtgccaggt

SEQ ID NO: 653696 - DNA, 25 bp, Rattus norvegicus
aggtgtgccagagcgcttattcgca

SEQ ID NO: 653697 - DNA, 25 bp, Rattus norvegicus
cctcggagctgtgtgtcttacgatc

SEQ ID NO: 653698 - DNA, 25 bp, Rattus norvegicus
cttattcgcagctggccggcctgcg

SEQ ID NO: 653699 - DNA, 25 bp, Rattus norvegicus
tcacctgccagccatggtgctgtga

SEQ ID NO: 653700 - DNA, 25 bp, Rattus norvegicus
tgatccatctcacagaggaggacgc

SEQ ID NO: 653701 - DNA, 25 bp, Rattus norvegicus
ggcgacgtcctctttgcctaggcca

SEQ ID NO: 653702 - DNA, 25 bp, Rattus norvegicus
tgtgtcttacgatctgcaggggagt

SEQ ID NO: 653703 - DNA, 25 bp, Rattus norvegicus
tgtcctctcttcttgggagccggtc

SEQ ID NO: 653704 - DNA, 25 bp, Rattus norvegicus
gctgcgcctgcgcaagtcattggcg

SEQ ID NO: 653705 - DNA, 25 bp, Rattus norvegicus
agggctcgcaaacctctcagtgaga

SEQ ID NO: 653706 - DNA, 25 bp, Rattus norvegicus
acctctcagtgagagcttgggccgc

SEQ ID NO: 653707 - DNA, 25 bp, Rattus norvegicus
gcttgggccgcgattctaaaaaaca

SEQ ID NO: 653708 - DNA, 25 bp, Rattus norvegicus
ctaaaaaacatttggtagtgccagg

SEQ ID NO: 653709 - DNA, 25 bp, Rattus norvegicus
tagtgccaggggacacgatcaccac

SEQ ID NO: 653710 - DNA, 25 bp, Rattus norvegicus
aggggacacgatcaccacggataca

SEQ ID NO: 653711 - DNA, 25 bp, Rattus norvegicus
acgatcaccacggatacaggcttca

SEQ ID NO: 653712 - DNA, 25 bp, Rattus norvegicus
atacaggcttcatgcggtacgtgag

SEQ ID NO: 653713 - DNA, 25 bp, Rattus norvegicus
cttcatgcggtacgtgaggatttgg

SEQ ID NO: 653714 - DNA, 25 bp, Rattus norvegicus
ggtcccaaggcctcaggagacggct

SEQ ID NO: 653715 - DNA, 25 bp, Rattus norvegicus
aggagacggctgcagagctctctgc

SEQ ID NO: 653716 - DNA, 25 bp, Rattus norvegicus
tgcgcaagtcattggcgccaagatg

SEQ ID NO: 653717 - DNA, 25 bp, Rattus norvegicus
cctagggctcgcaaacctctcagtg

SEQ ID NO: 653718 - DNA, 25 bp, Rattus norvegicus
cttactaaagcggtgaagaagtgcg

SEQ ID NO: 653719 - DNA, 25 bp, Rattus norvegicus
cgtaatccatcatggcggcctcggg

SEQ ID NO: 653720 - DNA, 25 bp, Rattus norvegicus
tgtggcgcggctcgtaatccatcat

SEQ ID NO: 653721 - DNA, 25 bp, Rattus norvegicus
attggacttcgctcgggagattccg

SEQ ID NO: 653722 - DNA, 25 bp, Rattus norvegicus
caccggtggcctattggacttcgct

SEQ ID NO: 653723 - DNA, 25 bp, Rattus norvegicus
aaacccgaaggtgcggcagcgtgta

SEQ ID NO: 653724 - DNA, 25 bp, Rattus norvegicus
caggcagtgaggctggaaacccgaa

SEQ ID NO: 653725 - DNA, 25 bp, Rattus norvegicus
ggcacacaccaccactggctggaga

SEQ ID NO: 653726 - DNA, 25 bp, Rattus norvegicus
tgagggacacactggttatcgaaga

SEQ ID NO: 653727 - DNA, 25 bp, Rattus norvegicus
gcgctcactggccaattggacggtg

SEQ ID NO: 653728 - DNA, 25 bp, Rattus norvegicus
acaagtcccagtattcctcctggca

SEQ ID NO: 653729 - DNA, 25 bp, Rattus norvegicus
gcttgggcctccgagagcagcctat

SEQ ID NO: 653730 - DNA, 25 bp, Rattus norvegicus
aagaagtgcgctgaccggagtccac

SEQ ID NO: 653731 - DNA, 25 bp, Rattus norvegicus
tctatccctgagaggcgccggagct

SEQ ID NO: 653732 - DNA, 25 bp, Rattus norvegicus
ctggacacgcggcaacaagggctgc

SEQ ID NO: 653733 - DNA, 25 bp, Rattus norvegicus
tgccttctgcctggaaggggttaag

SEQ ID NO: 653734 - DNA, 25 bp, Rattus norvegicus
ctgccttctgcctggaaggggttaa

SEQ ID NO: 653735 - DNA, 25 bp, Rattus norvegicus
cctgccttctgcctggaaggggtta

SEQ ID NO: 653736 - DNA, 25 bp, Rattus norvegicus
agcctgccttctgcctggaaggggt

SEQ ID NO: 653737 - DNA, 25 bp, Rattus norvegicus
tggagcctgccttctgcctggaagg

SEQ ID NO: 653738 - DNA, 25 bp, Rattus norvegicus
cgtggagcctgccttctgcctggaa

SEQ ID NO: 653739 - DNA, 25 bp, Rattus norvegicus
agggcgtggagcctgccttctgcct

SEQ ID NO: 653740 - DNA, 25 bp, Rattus norvegicus
aacaagggctgcgccaccctgggag

SEQ ID NO: 653741 - DNA, 25 bp, Rattus norvegicus
gcaacaagggctgcgccaccctggg

SEQ ID NO: 653742 - DNA, 25 bp, Rattus norvegicus
ggcaacaagggctgcgccaccctgg

SEQ ID NO: 653743 - DNA, 25 bp, Rattus norvegicus
acacgcggcaacaagggctgcgcca

SEQ ID NO: 653744 - DNA, 25 bp, Rattus norvegicus
cggtggggccttcgccgtggccgcg

SEQ ID NO: 653745 - DNA, 25 bp, Rattus norvegicus
gacacgcggcaacaagggctgcgcc

SEQ ID NO: 653746 - DNA, 25 bp, Rattus norvegicus
cacaggatgcgttgcacttgcagga

SEQ ID NO: 653747 - DNA, 25 bp, Rattus norvegicus
aacgagctgctgttgtgactccgac

SEQ ID NO: 653748 - DNA, 25 bp, Rattus norvegicus
ctcggactctcagggccttttattg

SEQ ID NO: 653749 - DNA, 25 bp, Rattus norvegicus
ggctctaagagtgactcccgctcca

SEQ ID NO: 653750 - DNA, 25 bp, Rattus norvegicus
cgcgcaaacttcctctagggcagga

SEQ ID NO: 653751 - DNA, 25 bp, Rattus norvegicus
gactcctctaagtcccaggtgtaga

SEQ ID NO: 653752 - DNA, 25 bp, Rattus norvegicus
gttccaggtcctgggcaagtatgca

SEQ ID NO: 653753 - DNA, 25 bp, Rattus norvegicus
caagtatgcacgtggccggctaatc

SEQ ID NO: 653754 - DNA, 25 bp, Rattus norvegicus
ggctaatctccagccctggggcctg

SEQ ID NO: 653755 - DNA, 25 bp, Rattus norvegicus
tggagctatcccaaccgctggagga

SEQ ID NO: 653756 - DNA, 25 bp, Rattus norvegicus
aaagcgtttaatccgcccgagcagc

SEQ ID NO: 653757 - DNA, 25 bp, Rattus norvegicus
cccgagcagccttcggaggtaattg

SEQ ID NO: 653758 - DNA, 25 bp, Rattus norvegicus
acaaagtccttaatctgcgcggtta

SEQ ID NO: 653759 - DNA, 25 bp, Rattus norvegicus
catcttcctgcaggacccgcaaggg

SEQ ID NO: 653760 - DNA, 25 bp, Rattus norvegicus
ttaaatcaggccttctgcccgcgtc

SEQ ID NO: 653761 - DNA, 25 bp, Rattus norvegicus
aggtgcagtattttccatgaggata

SEQ ID NO: 653762 - DNA, 25 bp, Rattus norvegicus
gtgtttactcctgcggtgtgcgtct

SEQ ID NO: 653763 - DNA, 25 bp, Rattus norvegicus
aaagacgcgggagatggcattagcc

SEQ ID NO: 653764 - DNA, 25 bp, Rattus norvegicus
tcggcttcagaatataaagacgcgg

SEQ ID NO: 653765 - DNA, 25 bp, Rattus norvegicus
cgcgtccagaacgatcggcttcaga

SEQ ID NO: 653766 - DNA, 25 bp, Rattus norvegicus
ttcccgtggtaattggatcaggtgc

SEQ ID NO: 653767 - DNA, 25 bp, Rattus norvegicus
tgctgactgtatcaaaattcccgtg

SEQ ID NO: 653768 - DNA, 25 bp, Rattus norvegicus
ggtgtgcgtctctgaatctttcatc

SEQ ID NO: 653769 - DNA, 25 bp, Rattus norvegicus
tgctgccgtgtctcaggacttccct

SEQ ID NO: 653770 - DNA, 25 bp, Rattus norvegicus
ctcaggacttccctgcgtgggagat

SEQ ID NO: 653771 - DNA, 25 bp, Rattus norvegicus
gggctgtgcaaccagcctccacgga

SEQ ID NO: 653772 - DNA, 25 bp, Rattus norvegicus
gagcctcctaagtcgtcccggagga

SEQ ID NO: 653773 - DNA, 25 bp, Rattus norvegicus
aattcggtctgtgtgtttactcctg

SEQ ID NO: 653774 - DNA, 25 bp, Rattus norvegicus
tgcgggcatgggctcttgctacgac

SEQ ID NO: 653775 - DNA, 25 bp, Rattus norvegicus
ccagaggacttctgtccgcacgtgg

SEQ ID NO: 653776 - DNA, 25 bp, Rattus norvegicus
gaggcctcgcacacgtgcggacagc

SEQ ID NO: 653777 - DNA, 25 bp, Rattus norvegicus
ctgtctgcctgagttcgagaacgcg

SEQ ID NO: 653778 - DNA, 25 bp, Rattus norvegicus
ctcttgctacgacggtgcgggacgc

SEQ ID NO: 653779 - DNA, 25 bp, Rattus norvegicus
tgatgctgaaggcgcactgcgcgac

SEQ ID NO: 653780 - DNA, 25 bp, Rattus norvegicus
cccgcctggcaacggtggtatgtgt

SEQ ID NO: 653781 - DNA, 25 bp, Rattus norvegicus
tgtgtccgggatcctgtcccgcctg

SEQ ID NO: 653782 - DNA, 25 bp, Rattus norvegicus
ccggccatggctgtgtccgggatcc

SEQ ID NO: 653783 - DNA, 25 bp, Rattus norvegicus
caagcgcagatcaaggcgcagagta

SEQ ID NO: 653784 - DNA, 25 bp, Rattus norvegicus
cgcagaggggccaagcgcagatcaa

SEQ ID NO: 653785 - DNA, 25 bp, Rattus norvegicus
ctcagatgccttcgggttccgcctg

SEQ ID NO: 653786 - DNA, 25 bp, Rattus norvegicus
cacagcgctgtctgcctgagttcga

SEQ ID NO: 653787 - DNA, 25 bp, Rattus norvegicus
gcctgcctgtgtcccgccctcagat

SEQ ID NO: 653788 - DNA, 25 bp, Rattus norvegicus
tcgggcgcataccatgtccgtcgca

SEQ ID NO: 653789 - DNA, 25 bp, Rattus norvegicus
tcactgcgcgggacaacgtgctgat

SEQ ID NO: 653790 - DNA, 25 bp, Rattus norvegicus
tcaaccgggtaagccgcgtcactgc

SEQ ID NO: 653791 - DNA, 25 bp, Rattus norvegicus
ccatcgccttgtccggagtcgggcg

SEQ ID NO: 653792 - DNA, 25 bp, Rattus norvegicus
tgtccgtcgcactcagcaacaggtt

SEQ ID NO: 653793 - DNA, 25 bp, Rattus norvegicus
agcaacaggttccaaggtaggcgcc

SEQ ID NO: 653794 - DNA, 25 bp, Rattus norvegicus
acacgccgccgaaggtctggaccag

SEQ ID NO: 653795 - DNA, 25 bp, Rattus norvegicus
caggacgtctctgggtcgccacctg

SEQ ID NO: 653796 - DNA, 25 bp, Rattus norvegicus
ctttgtctcccgcaggagggaaggc

SEQ ID NO: 653797 - DNA, 25 bp, Rattus norvegicus
gaaggcgttcggcttgctcaaagcc

SEQ ID NO: 653798 - DNA, 25 bp, Rattus norvegicus
tcaaagcccggcaggagaagagact

SEQ ID NO: 653799 - DNA, 25 bp, Rattus norvegicus
ctggaggagatcaaccgggtaagcc

SEQ ID NO: 653800 - DNA, 25 bp, Rattus norvegicus
gacaacgtgctgatcctttgcgccg

SEQ ID NO: 653801 - DNA, 25 bp, Rattus norvegicus
ggtctggaccagacgccttttcctc

SEQ ID NO: 653802 - DNA, 25 bp, Rattus norvegicus
tgctggtcgccttacgggtaacaac

SEQ ID NO: 653803 - DNA, 25 bp, Rattus norvegicus
cggcagcagcagctacttggacatc

SEQ ID NO: 653804 - DNA, 25 bp, Rattus norvegicus
cccggaactggccaatgggaccttg

SEQ ID NO: 653805 - DNA, 25 bp, Rattus norvegicus
accttgtggattggcaagcgcgcga

SEQ ID NO: 653806 - DNA, 25 bp, Rattus norvegicus
cgacttccgaggagcactctgctgc

SEQ ID NO: 653807 - DNA, 25 bp, Rattus norvegicus
gctgcctcggagcacattacaaacc

SEQ ID NO: 653808 - DNA, 25 bp, Rattus norvegicus
ttacaaaccggccttggtgacgtca

SEQ ID NO: 653809 - DNA, 25 bp, Rattus norvegicus
tacttggacatcctgaaggcggccc

SEQ ID NO: 653810 - DNA, 25 bp, Rattus norvegicus
tgccatgatccctgagcgggagatg

SEQ ID NO: 653811 - DNA, 25 bp, Rattus norvegicus
ctcctgcggtagtcttggagttgcc

SEQ ID NO: 653812 - DNA, 25 bp, Rattus norvegicus
gctccgacagtttgcagagttcaga

SEQ ID NO: 653813 - DNA, 25 bp, Rattus norvegicus
gagttcagattgctcgcctcataga

SEQ ID NO: 653814 - DNA, 25 bp, Rattus norvegicus
gagttctctccgagtgcgggtcacc

SEQ ID NO: 653815 - DNA, 25 bp, Rattus norvegicus
ggtgggtttgtccacgcctctttca

SEQ ID NO: 653816 - DNA, 25 bp, Rattus norvegicus
agtccctgaacagcgcagtccggtc

SEQ ID NO: 653817 - DNA, 25 bp, Rattus norvegicus
cgccgcgccagaagacgtgagtgcc

SEQ ID NO: 653818 - DNA, 25 bp, Rattus norvegicus
tcgggcccgtgacagaggccaagaa

SEQ ID NO: 653819 - DNA, 25 bp, Rattus norvegicus
aggcgcgcaactagctcctggagcg

SEQ ID NO: 653820 - DNA, 25 bp, Rattus norvegicus
cctgcgccgaggcagaacgcatcga

SEQ ID NO: 653821 - DNA, 25 bp, Rattus norvegicus
catcgaggagctggaacccgaggct

SEQ ID NO: 653822 - DNA, 25 bp, Rattus norvegicus
aacccgaggctgaagagcgactgcc

SEQ ID NO: 653823 - DNA, 25 bp, Rattus norvegicus
ttggaggcttcaaggttatgtcacc

SEQ ID NO: 653824 - DNA, 25 bp, Rattus norvegicus
ccgcggcttcactgcgggacacagt

SEQ ID NO: 653825 - DNA, 25 bp, Rattus norvegicus
tgcagtgcccgggacacggcgtttt

SEQ ID NO: 653826 - DNA, 25 bp, Rattus norvegicus
acacggcgttttcctgcagaggcgg

SEQ ID NO: 653827 - DNA, 25 bp, Rattus norvegicus
ggcggccgcgtcactgtagtgactc

SEQ ID NO: 653828 - DNA, 25 bp, Rattus norvegicus
ctgcggactctgcaagcccggggaa

SEQ ID NO: 653829 - DNA, 25 bp, Rattus norvegicus
cttcagcgacctgcggactctgcaa

SEQ ID NO: 653830 - DNA, 25 bp, Rattus norvegicus
cgagcgcctccttattttacgatca

SEQ ID NO: 653831 - DNA, 25 bp, Rattus norvegicus
gcgctcctctgctactgtcgctgta

SEQ ID NO: 653832 - DNA, 25 bp, Rattus norvegicus
tatcccttggcgcttgtctactagg

SEQ ID NO: 653833 - DNA, 25 bp, Rattus norvegicus
ctccgccgaggaactttagcagtca

SEQ ID NO: 653834 - DNA, 25 bp, Rattus norvegicus
atctcgagccgcagcatagtcaagc

SEQ ID NO: 653835 - DNA, 25 bp, Rattus norvegicus
ctcgacaccaagagggcgtgttgcc

SEQ ID NO: 653836 - DNA, 25 bp, Rattus norvegicus
cccttcgccagcagaggtggctcga

SEQ ID NO: 653837 - DNA, 25 bp, Rattus norvegicus
cccaggcaggtcctttatggcgtgc

SEQ ID NO: 653838 - DNA, 25 bp, Rattus norvegicus
tcactaggacctcccggttcggatg

SEQ ID NO: 653839 - DNA, 25 bp, Rattus norvegicus
ctgccaccgcagtgggtcactagga

SEQ ID NO: 653840 - DNA, 25 bp, Rattus norvegicus
gcgaataatcgcctcccgtgacatc

SEQ ID NO: 653841 - DNA, 25 bp, Rattus norvegicus
cgactgcgcgcaccagcgaataatc

SEQ ID NO: 653842 - DNA, 25 bp, Rattus norvegicus
ggcgtcaaagttgagccgaacttta

SEQ ID NO: 653843 - DNA, 25 bp, Rattus norvegicus
atcattatgagtgtgctgtcaccgc

SEQ ID NO: 653844 - DNA, 25 bp, Rattus norvegicus
agtgagtccggcctcggagagtata

SEQ ID NO: 653845 - DNA, 25 bp, Rattus norvegicus
agtccggcctcggagagtatactgg

SEQ ID NO: 653846 - DNA, 25 bp, Rattus norvegicus
acactctctctcacccgcagctcgg

SEQ ID NO: 653847 - DNA, 25 bp, Rattus norvegicus
cccgtgctgccctcacactctctct

SEQ ID NO: 653848 - DNA, 25 bp, Rattus norvegicus
gggcgccctatcctttgtgcaggat

SEQ ID NO: 653849 - DNA, 25 bp, Rattus norvegicus
cgggcgccctatcctttgtgcagga

SEQ ID NO: 653850 - DNA, 25 bp, Rattus norvegicus
aggtcgggcgccctatcctttgtgc

SEQ ID NO: 653851 - DNA, 25 bp, Rattus norvegicus
cccacggaagaagtcagggtcagag

SEQ ID NO: 653852 - DNA, 25 bp, Rattus norvegicus
ggatcccacggaagaagtcagggtc

SEQ ID NO: 653853 - DNA, 25 bp, Rattus norvegicus
gacttggatcccacggaagaagtca

SEQ ID NO: 653854 - DNA, 25 bp, Rattus norvegicus
tggagacttggatcccacggaagaa

SEQ ID NO: 653855 - DNA, 25 bp, Rattus norvegicus
gagttccgtggagacttggatccca

SEQ ID NO: 653856 - DNA, 25 bp, Rattus norvegicus
gcgttcagagttccgtggagacttg

SEQ ID NO: 653857 - DNA, 25 bp, Rattus norvegicus
gttgcgttcagagttccgtggagac

SEQ ID NO: 653858 - DNA, 25 bp, Rattus norvegicus
ctgggtccgcaaggctagataaagc

SEQ ID NO: 653859 - DNA, 25 bp, Rattus norvegicus
atgcctgtcagtgtgcacggtctcc

SEQ ID NO: 653860 - DNA, 25 bp, Rattus norvegicus
tgaaagctgcttcccgtggtgctgg

SEQ ID NO: 653861 - DNA, 25 bp, Rattus norvegicus
ccagggccctggaatacggcctcta

SEQ ID NO: 653862 - DNA, 25 bp, Rattus norvegicus
aatacggcctctatcgcccggctga

SEQ ID NO: 653863 - DNA, 25 bp, Rattus norvegicus
tgacgccaccctgcgtgtgcggagc

SEQ ID NO: 653864 - DNA, 25 bp, Rattus norvegicus
ccagcccagggtgagcggtgcccaa

SEQ ID NO: 653865 - DNA, 25 bp, Rattus norvegicus
atccggtgcggcactgagagttctc

SEQ ID NO: 653866 - DNA, 25 bp, Rattus norvegicus
gagagttctccaaggtgctaaaata

SEQ ID NO: 653867 - DNA, 25 bp, Rattus norvegicus
agcgaaggatcaggtttcccgacca

SEQ ID NO: 653868 - DNA, 25 bp, Rattus norvegicus
taacccagcagcagccttagaaatg

SEQ ID NO: 653869 - DNA, 25 bp, Rattus norvegicus
gcagccttagaaatgtgaaccggga

SEQ ID NO: 653870 - DNA, 25 bp, Rattus norvegicus
accgggaaagtgatccctggcgcgc

SEQ ID NO: 653871 - DNA, 25 bp, Rattus norvegicus
ataaagccttctggcagcggatgcc

SEQ ID NO: 653872 - DNA, 25 bp, Rattus norvegicus
gactacctcaccatggacatctacg

SEQ ID NO: 653873 - DNA, 25 bp, Rattus norvegicus
ggacatctacgcctttcctgctggc

SEQ ID NO: 653874 - DNA, 25 bp, Rattus norvegicus
tgccgccatggtgtccaagttcttc

SEQ ID NO: 653875 - DNA, 25 bp, Rattus norvegicus
atggtgtccaagttcttcctgagcc

SEQ ID NO: 653876 - DNA, 25 bp, Rattus norvegicus
ttcatcatcggctacttccagttcc

SEQ ID NO: 653877 - DNA, 25 bp, Rattus norvegicus
atgagactagccctgggctcctgga

SEQ ID NO: 653878 - DNA, 25 bp, Rattus norvegicus
gggctcctggactacctcaccatgg

SEQ ID NO: 653879 - DNA, 25 bp, Rattus norvegicus
ttcttcctgagccacttggtgctgg

SEQ ID NO: 653880 - DNA, 25 bp, Rattus norvegicus
ccgctacgagtgctgctggtgctct

SEQ ID NO: 653881 - DNA, 25 bp, Rattus norvegicus
tgggccttctgcgtgggtttgtctc

SEQ ID NO: 653882 - DNA, 25 bp, Rattus norvegicus
tttgtctcgggtgatgatcggacgc

SEQ ID NO: 653883 - DNA, 25 bp, Rattus norvegicus
tgatcggacgccaccacattacaga

SEQ ID NO: 653884 - DNA, 25 bp, Rattus norvegicus
gacgtcatctctggcttcatcatcg

SEQ ID NO: 653885 - DNA, 25 bp, Rattus norvegicus
cgcggcccgtatgagactagccctg

SEQ ID NO: 653886 - DNA, 25 bp, Rattus norvegicus
gaggtgttttcacggcacccggagc

SEQ ID NO: 653887 - DNA, 25 bp, Rattus norvegicus
gctttgtctccacggcggtgcgctg

SEQ ID NO: 653888 - DNA, 25 bp, Rattus norvegicus
gacgcagaccaggtgagccggggcc

SEQ ID NO: 653889 - DNA, 25 bp, Rattus norvegicus
ccggggttgcgctttgtctccacgg

SEQ ID NO: 653890 - DNA, 25 bp, Rattus norvegicus
ggttgcgctttgtctccacggcggt

SEQ ID NO: 653891 - DNA, 25 bp, Rattus norvegicus
ttgcgctttgtctccacggcggtgc

SEQ ID NO: 653892 - DNA, 25 bp, Rattus norvegicus
cgctttgtctccacggcggtgcgct

SEQ ID NO: 653893 - DNA, 25 bp, Rattus norvegicus
tcgccattgttgtgtcttggcggcc

SEQ ID NO: 653894 - DNA, 25 bp, Rattus norvegicus
cgccattgttgtgtcttggcggcca

SEQ ID NO: 653895 - DNA, 25 bp, Rattus norvegicus
ccattgttgtgtcttggcggccagg

SEQ ID NO: 653896 - DNA, 25 bp, Rattus norvegicus
gctggctgctgggatcgagcccgag

SEQ ID NO: 653897 - DNA, 25 bp, Rattus norvegicus
gatcgagcccgagggctctcctgcg

SEQ ID NO: 653898 - DNA, 25 bp, Rattus norvegicus
aggccgtccggaaccgcaggccgag

SEQ ID NO: 653899 - DNA, 25 bp, Rattus norvegicus
gagggctctcctgcgcccagggaca

SEQ ID NO: 653900 - DNA, 25 bp, Rattus norvegicus
tacaagtggtctttgtggcacaggc

SEQ ID NO: 653901 - DNA, 25 bp, Rattus norvegicus
ccctgaaggactcatggcgctccaa

SEQ ID NO: 653902 - DNA, 25 bp, Rattus norvegicus
ttcagagagttcaccttccggggcg

SEQ ID NO: 653903 - DNA, 25 bp, Rattus norvegicus
tggccgtggtttcagagagttcacc

SEQ ID NO: 653904 - DNA, 25 bp, Rattus norvegicus
ggcgctccaacaggacttacacaga

SEQ ID NO: 653905 - DNA, 25 bp, Rattus norvegicus
agccacgagggcatgctcacagaga

SEQ ID NO: 653906 - DNA, 25 bp, Rattus norvegicus
aagagctacccaagaggcgccggca

SEQ ID NO: 653907 - DNA, 25 bp, Rattus norvegicus
ggctccgagtacgaagagctaccca

SEQ ID NO: 653908 - DNA, 25 bp, Rattus norvegicus
agacccacagcgagggctccgagta

SEQ ID NO: 653909 - DNA, 25 bp, Rattus norvegicus
ggcgcattgccagcgagacccacag

SEQ ID NO: 653910 - DNA, 25 bp, Rattus norvegicus
gagccaagccaagacggcgcattgc

SEQ ID NO: 653911 - DNA, 25 bp, Rattus norvegicus
tctcgtggcatgtacagtggtggcc

SEQ ID NO: 653912 - DNA, 25 bp, Rattus norvegicus
ggccggcctacaagcagcagtacaa

SEQ ID NO: 653913 - DNA, 25 bp, Rattus norvegicus
ttacacagaggaccagggtagtcta

SEQ ID NO: 653914 - DNA, 25 bp, Rattus norvegicus
ccgctcaatgggacgcgaagatacg

SEQ ID NO: 653915 - DNA, 25 bp, Rattus norvegicus
atacgcttgtaggttttggagtgcc

SEQ ID NO: 653916 - DNA, 25 bp, Rattus norvegicus
gctccacatggggaaccgctcaatg

SEQ ID NO: 653917 - DNA, 25 bp, Rattus norvegicus
caacggtcgaaccagcttggcgggt

SEQ ID NO: 653918 - DNA, 25 bp, Rattus norvegicus
ctccggagtaatcgagcagcctctc

SEQ ID NO: 653919 - DNA, 25 bp, Rattus norvegicus
aggccgcgcaggcaaaattagttga

SEQ ID NO: 653920 - DNA, 25 bp, Rattus norvegicus
ccagctgccacattcaaggcggttg

SEQ ID NO: 653921 - DNA, 25 bp, Rattus norvegicus
taaggccaggacactcaccagctgc

SEQ ID NO: 653922 - DNA, 25 bp, Rattus norvegicus
aacttgtcgaaacgcactgtgcttt

SEQ ID NO: 653923 - DNA, 25 bp, Rattus norvegicus
gcgctccgaacatgtgaacaacttg

SEQ ID NO: 653924 - DNA, 25 bp, Rattus norvegicus
catggcctgaaacggagcgctccga

SEQ ID NO: 653925 - DNA, 25 bp, Rattus norvegicus
tcgctgaagtagacgcatggcctga

SEQ ID NO: 653926 - DNA, 25 bp, Rattus norvegicus
gctgcgtaacgaagtcgctgaagta

SEQ ID NO: 653927 - DNA, 25 bp, Rattus norvegicus
cagatgttccgatcctggccgagaa

SEQ ID NO: 653928 - DNA, 25 bp, Rattus norvegicus
cttccggggccataggcgcatgcgc

SEQ ID NO: 653929 - DNA, 25 bp, Rattus norvegicus
ggctgacatacatccaccgactctg

SEQ ID NO: 653930 - DNA, 25 bp, Rattus norvegicus
ccaacctgcggcctggcagtccctc

SEQ ID NO: 653931 - DNA, 25 bp, Rattus norvegicus
gggcgctcaccttgccgctagcagt

SEQ ID NO: 653932 - DNA, 25 bp, Rattus norvegicus
agtgccaccgctcacgccgatgaga

SEQ ID NO: 653933 - DNA, 25 bp, Rattus norvegicus
tcacgccgatgagaaacggccgcgg

SEQ ID NO: 653934 - DNA, 25 bp, Rattus norvegicus
ccgaagccatctccggagcggctga

SEQ ID NO: 653935 - DNA, 25 bp, Rattus norvegicus
agccatctccggagcggctgacata

SEQ ID NO: 653936 - DNA, 25 bp, Rattus norvegicus
atgcgcgcaggaggcaccgccctcc

SEQ ID NO: 653937 - DNA, 25 bp, Rattus norvegicus
cgtacgcatcgcttccggggccata

SEQ ID NO: 653938 - DNA, 25 bp, Rattus norvegicus
acctaggggcggacgccgtacgcat

SEQ ID NO: 653939 - DNA, 25 bp, Rattus norvegicus
cctgctcccgccaggacctaggggc

SEQ ID NO: 653940 - DNA, 25 bp, Rattus norvegicus
atccaccgactctgcctgctcccgc

SEQ ID NO: 653941 - DNA, 25 bp, Rattus norvegicus
ctccggagcggctgacatacatcca

SEQ ID NO: 653942 - DNA, 25 bp, Rattus norvegicus
gagcgtcctagtgaagctctgcacc

SEQ ID NO: 653943 - DNA, 25 bp, Rattus norvegicus
gctgcttttcaggtaaccagaaatc

SEQ ID NO: 653944 - DNA, 25 bp, Rattus norvegicus
tgcgcacgcaccaagctaaagctgt

SEQ ID NO: 653945 - DNA, 25 bp, Rattus norvegicus
ccctccctccgataggtggctgtga

SEQ ID NO: 653946 - DNA, 25 bp, Rattus norvegicus
gcgcgcagctttcgtcgttaactcc

SEQ ID NO: 653947 - DNA, 25 bp, Rattus norvegicus
tccctgtcagtcatcattctcatca

SEQ ID NO: 653948 - DNA, 25 bp, Rattus norvegicus
tcacgccgggtttccgagcgtccta

SEQ ID NO: 653949 - DNA, 25 bp, Rattus norvegicus
tccaggattggggttaaacggctgc

SEQ ID NO: 653950 - DNA, 25 bp, Rattus norvegicus
ctctggctcttgttgaggagtcgta

SEQ ID NO: 653951 - DNA, 25 bp, Rattus norvegicus
tcgtagctgccggaagcagtttcgc

SEQ ID NO: 653952 - DNA, 25 bp, Rattus norvegicus
ccgggatgtcggaagaaaccaggca

SEQ ID NO: 653953 - DNA, 25 bp, Rattus norvegicus
aaaccaggcagagcaaattggctgc

SEQ ID NO: 653954 - DNA, 25 bp, Rattus norvegicus
tggctgcggccaagaaaaaggtaaa

SEQ ID NO: 653955 - DNA, 25 bp, Rattus norvegicus
tcaaccaatgggcttggagaaggta

SEQ ID NO: 653956 - DNA, 25 bp, Rattus norvegicus
cctacgggcgacaagagcggaagaa

SEQ ID NO: 653957 - DNA, 25 bp, Rattus norvegicus
aggtcccttggccttgcaatgtgac

SEQ ID NO: 653958 - DNA, 25 bp, Rattus norvegicus
cgcctaagatggagagggtcgtttc

SEQ ID NO: 653959 - DNA, 25 bp, Rattus norvegicus
tcgtttctgctgctaggccgaggat

SEQ ID NO: 653960 - DNA, 25 bp, Rattus norvegicus
ctggcagcctttcccgtcgctttaa

SEQ ID NO: 653961 - DNA, 25 bp, Rattus norvegicus
gcccatagcgaccttagacagcgtg

SEQ ID NO: 653962 - DNA, 25 bp, Rattus norvegicus
gtggtcgtgttgatgtcgccgataa

SEQ ID NO: 653963 - DNA, 25 bp, Rattus norvegicus
tcgccgataatgctgagcgcctcct

SEQ ID NO: 653964 - DNA, 25 bp, Rattus norvegicus
cgcctccttcagtgcgtggtacata

SEQ ID NO: 653965 - DNA, 25 bp, Rattus norvegicus
gtggtacatacgcagcatctcgtcg

SEQ ID NO: 653966 - DNA, 25 bp, Rattus norvegicus
cgccgctgagcctgttcggccgatt

SEQ ID NO: 653967 - DNA, 25 bp, Rattus norvegicus
ttcggccgattcttccatcagcgtg

SEQ ID NO: 653968 - DNA, 25 bp, Rattus norvegicus
tcttccatcagcgtgttctggtccc

SEQ ID NO: 653969 - DNA, 25 bp, Rattus norvegicus
aggccgaggatctagaatccaactc

SEQ ID NO: 653970 - DNA, 25 bp, Rattus norvegicus
ccatccagcgattcctgcaaagacg

SEQ ID NO: 653971 - DNA, 25 bp, Rattus norvegicus
gcggtcctttgtgcgccggttcgac

SEQ ID NO: 653972 - DNA, 25 bp, Rattus norvegicus
ggcggcggctcgagtctccgctctt

SEQ ID NO: 653973 - DNA, 25 bp, Rattus norvegicus
gctgtacaggcagtagtggctgctg

SEQ ID NO: 653974 - DNA, 25 bp, Rattus norvegicus
ggtcctcgcacatctgagttccgca

SEQ ID NO: 653975 - DNA, 25 bp, Rattus norvegicus
gccctgtgttcctgtcaaaccgttc

SEQ ID NO: 653976 - DNA, 25 bp, Rattus norvegicus
tcgcggccctgtgttcctgtcaaac

SEQ ID NO: 653977 - DNA, 25 bp, Rattus norvegicus
atcgctgcagcctcctcgcggccct

SEQ ID NO: 653978 - DNA, 25 bp, Rattus norvegicus
agacgggagcatcgctgcagcctcc

SEQ ID NO: 653979 - DNA, 25 bp, Rattus norvegicus
gcaaagacgggagcatcgctgcagc

SEQ ID NO: 653980 - DNA, 25 bp, Rattus norvegicus
ttcctgcaaagacgggagcatcgct

SEQ ID NO: 653981 - DNA, 25 bp, Rattus norvegicus
cagcgattcctgcaaagacgggagc

SEQ ID NO: 653982 - DNA, 25 bp, Rattus norvegicus
cgctcttccgcggagccaccctctt

SEQ ID NO: 653983 - DNA, 25 bp, Rattus norvegicus
tcgcacatctgagttccgcagcttc

SEQ ID NO: 653984 - DNA, 25 bp, Rattus norvegicus
cgatctgcggcaagtcgaggtccgc

SEQ ID NO: 653985 - DNA, 25 bp, Rattus norvegicus
aggacagccctctgcaggggtcgcc

SEQ ID NO: 653986 - DNA, 25 bp, Rattus norvegicus
cttcgcggctgcagcggaatatccc

SEQ ID NO: 653987 - DNA, 25 bp, Rattus norvegicus
tcactatgcgcagacgcagcgctgg

SEQ ID NO: 653988 - DNA, 25 bp, Rattus norvegicus
ccctccgtgcgggtattggcgatca

SEQ ID NO: 653989 - DNA, 25 bp, Rattus norvegicus
ttggcgatcaaggacagccctctgc

SEQ ID NO: 653990 - DNA, 25 bp, Rattus norvegicus
actccactgatgtctgcgggctggc

SEQ ID NO: 653991 - DNA, 25 bp, Rattus norvegicus
gaaattctccagcaccgagctcttg

SEQ ID NO: 653992 - DNA, 25 bp, Rattus norvegicus
agcgggttccaagaagcccactgcc

SEQ ID NO: 653993 - DNA, 25 bp, Rattus norvegicus
cagagaaggcgtcctgtaaccggtt

SEQ ID NO: 653994 - DNA, 25 bp, Rattus norvegicus
ggaatatcccgactgcgtgcaccgc

SEQ ID NO: 653995 - DNA, 25 bp, Rattus norvegicus
ggatccgagcggagcgcttctccag

SEQ ID NO: 653996 - DNA, 25 bp, Rattus norvegicus
gggtttcgcggactgatcactatgc

SEQ ID NO: 653997 - DNA, 25 bp, Rattus norvegicus
ctgtcggctcccagcgaggacctga

SEQ ID NO: 653998 - DNA, 25 bp, Rattus norvegicus
gattgcagcagtagtgatttgtcca

SEQ ID NO: 653999 - DNA, 25 bp, Rattus norvegicus
caacaactgcgaagtgggtcccagg

SEQ ID NO: 654000 - DNA, 25 bp, Rattus norvegicus
cgtcccagcgtgctccggtcaggtt

SEQ ID NO: 654001 - DNA, 25 bp, Rattus norvegicus
ctccggtcaggttgagccgctttag

SEQ ID NO: 654002 - DNA, 25 bp, Rattus norvegicus
agccgctttagcgttgttaacgcca

SEQ ID NO: 654003 - DNA, 25 bp, Rattus norvegicus
tgttaacgccaacaactgcgaagtg

SEQ ID NO: 654004 - DNA, 25 bp, Rattus norvegicus
cagggggaaccgtccgcacctgagc

SEQ ID NO: 654005 - DNA, 25 bp, Rattus norvegicus
tgacaccagggcgagtcccgagcct

SEQ ID NO: 654006 - DNA, 25 bp, Rattus norvegicus
cccgagcctcgggttagcgcagtca

SEQ ID NO: 654007 - DNA, 25 bp, Rattus norvegicus
gcgcagtcacctgattgcagcagta

SEQ ID NO: 654008 - DNA, 25 bp, Rattus norvegicus
agtagtgatttgtccactgcgatcc

SEQ ID NO: 654009 - DNA, 25 bp, Rattus norvegicus
gtccactgcgatccctagcgccacc

SEQ ID NO: 654010 - DNA, 25 bp, Rattus norvegicus
agtcctcacagtcagcgctgggcgc

SEQ ID NO: 654011 - DNA, 25 bp, Rattus norvegicus
ctcgggttagcgcagtcacctgatt

SEQ ID NO: 654012 - DNA, 25 bp, Rattus norvegicus
gatattcgtgcacttgctggccctg

SEQ ID NO: 654013 - DNA, 25 bp, Rattus norvegicus
gttctccgtgttgttggcactgcga

SEQ ID NO: 654014 - DNA, 25 bp, Rattus norvegicus
gctatgttattctcgctgcgggaac

SEQ ID NO: 654015 - DNA, 25 bp, Rattus norvegicus
gccgacgggctcagtacctacttca

SEQ ID NO: 654016 - DNA, 25 bp, Rattus norvegicus
ctctcctggtggaacgtctttgtgc

SEQ ID NO: 654017 - DNA, 25 bp, Rattus norvegicus
gcattcaaacgtcctccgtccgagg

SEQ ID NO: 654018 - DNA, 25 bp, Rattus norvegicus
ggcttcgccacctttgagatattcg

SEQ ID NO: 654019 - DNA, 25 bp, Rattus norvegicus
cactggcggccggtattaaacaggc

SEQ ID NO: 654020 - DNA, 25 bp, Rattus norvegicus
ccgggaatagcatctggacgtcata

SEQ ID NO: 654021 - DNA, 25 bp, Rattus norvegicus
ccagaagctgtggaacctgcatccc

SEQ ID NO: 654022 - DNA, 25 bp, Rattus norvegicus
gtgccagtctggctaccgaaaagca

SEQ ID NO: 654023 - DNA, 25 bp, Rattus norvegicus
taagagtccaaagcttgcacgcggc

SEQ ID NO: 654024 - DNA, 25 bp, Rattus norvegicus
gcccgagcctcaccacggagtaaga

SEQ ID NO: 654025 - DNA, 25 bp, Rattus norvegicus
tttgtgccttttttcgctgccgacg

SEQ ID NO: 654026 - DNA, 25 bp, Rattus norvegicus
ctctagcgactgcagaacggtcatg

SEQ ID NO: 654027 - DNA, 25 bp, Rattus norvegicus
tactgtagtggacggaagcttttcc

SEQ ID NO: 654028 - DNA, 25 bp, Rattus norvegicus
tagcggctacttgcagagaggttac

SEQ ID NO: 654029 - DNA, 25 bp, Rattus norvegicus
cacgttttcggctttcgtggattgc

SEQ ID NO: 654030 - DNA, 25 bp, Rattus norvegicus
gtccgctcgtgactttcacgttttc

SEQ ID NO: 654031 - DNA, 25 bp, Rattus norvegicus
cgcgcgcgagacttgttcgcctagc

SEQ ID NO: 654032 - DNA, 25 bp, Rattus norvegicus
acggccgtgggaactcagaatcgcc

SEQ ID NO: 654033 - DNA, 25 bp, Rattus norvegicus
tccctgcgggataagcagacggccg

SEQ ID NO: 654034 - DNA, 25 bp, Rattus norvegicus
gttaagtcacgttggctatatctgc

SEQ ID NO: 654035 - DNA, 25 bp, Rattus norvegicus
tggaatctgactgtccgtccttctg

SEQ ID NO: 654036 - DNA, 25 bp, Rattus norvegicus
ggaggccacaggatcagttaagtca

SEQ ID NO: 654037 - DNA, 25 bp, Rattus norvegicus
ccggtcaaagcccaacgcaggcttg

SEQ ID NO: 654038 - DNA, 25 bp, Rattus norvegicus
tcacgtccgcttgctccggtcaaag

SEQ ID NO: 654039 - DNA, 25 bp, Rattus norvegicus
ctcggggaagtcagctggaatctga

SEQ ID NO: 654040 - DNA, 25 bp, Rattus norvegicus
cagagtaaaggtcgcccttagcaac

SEQ ID NO: 654041 - DNA, 25 bp, Rattus norvegicus
ctgcttcggcgctctatcacgccca

SEQ ID NO: 654042 - DNA, 25 bp, Rattus norvegicus
tccgcgctaccacgccctttgagct

SEQ ID NO: 654043 - DNA, 25 bp, Rattus norvegicus
cagcagcgcactcaggccgccctga

SEQ ID NO: 654044 - DNA, 25 bp, Rattus norvegicus
cagctgatggaacaccgggccggaa

SEQ ID NO: 654045 - DNA, 25 bp, Rattus norvegicus
cacgcgaagatggaactcggcgatc

SEQ ID NO: 654046 - DNA, 25 bp, Rattus norvegicus
cgcccgattccagatcttaaggcca

SEQ ID NO: 654047 - DNA, 25 bp, Rattus norvegicus
aagctgtcattctcgccttccgtgc

SEQ ID NO: 654048 - DNA, 25 bp, Rattus norvegicus
tatcacgcccacaaacatggctccg

SEQ ID NO: 654049 - DNA, 25 bp, Rattus norvegicus
cccgcagagtaaaggtcgcccttag

SEQ ID NO: 654050 - DNA, 25 bp, Rattus norvegicus
tccagatcttaaggccagtactccc

SEQ ID NO: 654051 - DNA, 25 bp, Rattus norvegicus
gaactcggcgatcgtcgcgcggaaa

SEQ ID NO: 654052 - DNA, 25 bp, Rattus norvegicus
gtgcccgcatccaccggcatgccta

SEQ ID NO: 654053 - DNA, 25 bp, Rattus norvegicus
ccgcagaggccacgcgaagatggaa

SEQ ID NO: 654054 - DNA, 25 bp, Rattus norvegicus
ccatttccgaagcacgtggttttca

SEQ ID NO: 654055 - DNA, 25 bp, Rattus norvegicus
ggaatcctagcaccttggccatttt

SEQ ID NO: 654056 - DNA, 25 bp, Rattus norvegicus
gccattttagttttgcgcgcccgcc

SEQ ID NO: 654057 - DNA, 25 bp, Rattus norvegicus
ctcggctgtgcaggtaagacttagc

SEQ ID NO: 654058 - DNA, 25 bp, Rattus norvegicus
agacttagctggatcggactgctga

SEQ ID NO: 654059 - DNA, 25 bp, Rattus norvegicus
ttagccctgaactcctgagaagccg

SEQ ID NO: 654060 - DNA, 25 bp, Rattus norvegicus
cctattggagacagcgttggacttt

SEQ ID NO: 654061 - DNA, 25 bp, Rattus norvegicus
tggttcgcgtcacaacagcagcgta

SEQ ID NO: 654062 - DNA, 25 bp, Rattus norvegicus
ccgctgggtttgagaaaagtttatg

SEQ ID NO: 654063 - DNA, 25 bp, Rattus norvegicus
cgttttccctgacatcgtagattca

SEQ ID NO: 654064 - DNA, 25 bp, Rattus norvegicus
cggcctctagtcctacttggcgtca

SEQ ID NO: 654065 - DNA, 25 bp, Rattus norvegicus
ggcgtcatcgttaccctaggcaaca

SEQ ID NO: 654066 - DNA, 25 bp, Rattus norvegicus
attcacgatgtggaaacgcccgacc

SEQ ID NO: 654067 - DNA, 25 bp, Rattus norvegicus
acgcccgaccacgagtcacaggtta

SEQ ID NO: 654068 - DNA, 25 bp, Rattus norvegicus
cgcgcagaaacagctgccaaggata

SEQ ID NO: 654069 - DNA, 25 bp, Rattus norvegicus
tgtcagtacgggaccgtttgcccga

SEQ ID NO: 654070 - DNA, 25 bp, Rattus norvegicus
tagagccgagcacaggtggctccgc

SEQ ID NO: 654071 - DNA, 25 bp, Rattus norvegicus
cagctgccaaggatagagccgagca

SEQ ID NO: 654072 - DNA, 25 bp, Rattus norvegicus
tccatcgttgcaccacgcgcagaaa

SEQ ID NO: 654073 - DNA, 25 bp, Rattus norvegicus
tgatactccatgctcggctcctgcg

SEQ ID NO: 654074 - DNA, 25 bp, Rattus norvegicus
tggccacgcgctcaaccaccgatac

SEQ ID NO: 654075 - DNA, 25 bp, Rattus norvegicus
ccgagggaaccgtcagaaacctgat

SEQ ID NO: 654076 - DNA, 25 bp, Rattus norvegicus
ccacgtgtcagtacgggaccgtttg

SEQ ID NO: 654077 - DNA, 25 bp, Rattus norvegicus
gtcctgcccacgtgtcagtacggga

SEQ ID NO: 654078 - DNA, 25 bp, Rattus norvegicus
gagcccaactttccggtccctgtca

SEQ ID NO: 654079 - DNA, 25 bp, Rattus norvegicus
gaattcccacatcgggccacctgag

SEQ ID NO: 654080 - DNA, 25 bp, Rattus norvegicus
gcgacacgcgctctcagaattccca

SEQ ID NO: 654081 - DNA, 25 bp, Rattus norvegicus
tcagaaacctgatactccatgctcg

SEQ ID NO: 654082 - DNA, 25 bp, Rattus norvegicus
ggccgatcttggcaagtttctcgta

SEQ ID NO: 654083 - DNA, 25 bp, Rattus norvegicus
agtcgtactgcttggccatggccgc

SEQ ID NO: 654084 - DNA, 25 bp, Rattus norvegicus
tagaagcttccgtaccacctcgggc

SEQ ID NO: 654085 - DNA, 25 bp, Rattus norvegicus
ccggccctgaacgacccgatatagg

SEQ ID NO: 654086 - DNA, 25 bp, Rattus norvegicus
cccgatataggccatggaaagtgca

SEQ ID NO: 654087 - DNA, 25 bp, Rattus norvegicus
tggaaagtgcaggtcctgggctacc

SEQ ID NO: 654088 - DNA, 25 bp, Rattus norvegicus
cgcggcctaatcttacccgaatgtg

SEQ ID NO: 654089 - DNA, 25 bp, Rattus norvegicus
cccgaatgtgccttggccgatcttg

SEQ ID NO: 654090 - DNA, 25 bp, Rattus norvegicus
gaccaggcaacaatcaaggaaatag

SEQ ID NO: 654091 - DNA, 25 bp, Rattus norvegicus
caagtttctcgtacttggtgacctc

SEQ ID NO: 654092 - DNA, 25 bp, Rattus norvegicus
acgggcattccactgagtcgtactg

SEQ ID NO: 654093 - DNA, 25 bp, Rattus norvegicus
tcgtggcggtgcgtcccgctgcatt

SEQ ID NO: 654094 - DNA, 25 bp, Rattus norvegicus
tgacctcatcgcaaaacgggcattc

SEQ ID NO: 654095 - DNA, 25 bp, Rattus norvegicus
ggcgcggcctagcaagaccaggcaa

SEQ ID NO: 654096 - DNA, 25 bp, Rattus norvegicus
ctgcttctaccgtggctcgctggta

SEQ ID NO: 654097 - DNA, 25 bp, Rattus norvegicus
ggcaagagattgagaccctgacaga

SEQ ID NO: 654098 - DNA, 25 bp, Rattus norvegicus
tctctgcggagcatcctctggggta

SEQ ID NO: 654099 - DNA, 25 bp, Rattus norvegicus
ccttcttgccatctgggtgagctca

SEQ ID NO: 654100 - DNA, 25 bp, Rattus norvegicus
accaggacctcaaggctgggagcta

SEQ ID NO: 654101 - DNA, 25 bp, Rattus norvegicus
tggctccctattgtaccaggacctc

SEQ ID NO: 654102 - DNA, 25 bp, Rattus norvegicus
ggccgcaccatgaccgagcgttgta

SEQ ID NO: 654103 - DNA, 25 bp, Rattus norvegicus
tggggaccgcagtccaagagcatgc

SEQ ID NO: 654104 - DNA, 25 bp, Rattus norvegicus
agtccaagagcatgcccgcagggtc

SEQ ID NO: 654105 - DNA, 25 bp, Rattus norvegicus
tcgtgcagtccggaccgccagtgac

SEQ ID NO: 654106 - DNA, 25 bp, Rattus norvegicus
cgatgaggtaatcgcgccgctgaga

SEQ ID NO: 654107 - DNA, 25 bp, Rattus norvegicus
ctctggactgactgcaggagacgtg

SEQ ID NO: 654108 - DNA, 25 bp, Rattus norvegicus
tggagtccctcctgtcagttctggg

SEQ ID NO: 654109 - DNA, 25 bp, Rattus norvegicus
tgacagaggttctccgcactctttc

SEQ ID NO: 654110 - DNA, 25 bp, Rattus norvegicus
ggtgcaatccggagaaccgcctcga

SEQ ID NO: 654111 - DNA, 25 bp, Rattus norvegicus
cccaggaggcctatttgcgctactg

SEQ ID NO: 654112 - DNA, 25 bp, Rattus norvegicus
atttgcgctactgctgccggacaac

SEQ ID NO: 654113 - DNA, 25 bp, Rattus norvegicus
ctgtagttcacaggttctggcagtg

SEQ ID NO: 654114 - DNA, 25 bp, Rattus norvegicus
gccgcctctgactgaaatagggcct

SEQ ID NO: 654115 - DNA, 25 bp, Rattus norvegicus
tgaaatagggcctcaaccggatggc

SEQ ID NO: 654116 - DNA, 25 bp, Rattus norvegicus
tgggacgtgtcttttctgcgatgca

SEQ ID NO: 654117 - DNA, 25 bp, Rattus norvegicus
ctgcgatgcagtttagggtccttct

SEQ ID NO: 654118 - DNA, 25 bp, Rattus norvegicus
gcgaatgtgacttctggcccgactt

SEQ ID NO: 654119 - DNA, 25 bp, Rattus norvegicus
aagtggggatccgagcgcctccact

SEQ ID NO: 654120 - DNA, 25 bp, Rattus norvegicus
aggcctcccttgtgcgggcttgtca

SEQ ID NO: 654121 - DNA, 25 bp, Rattus norvegicus
tgtcactccggggagaaacctgcgg

SEQ ID NO: 654122 - DNA, 25 bp, Rattus norvegicus
tgggctgaacctgtagacagctgtc

SEQ ID NO: 654123 - DNA, 25 bp, Rattus norvegicus
tagacagctgtcgagtactcggggc

SEQ ID NO: 654124 - DNA, 25 bp, Rattus norvegicus
ggactgacatttcccgccgttgtta

SEQ ID NO: 654125 - DNA, 25 bp, Rattus norvegicus
tctcttcagatggacgcgagatggc

SEQ ID NO: 654126 - DNA, 25 bp, Rattus norvegicus
agtctctactcagcactgaccggga

SEQ ID NO: 654127 - DNA, 25 bp, Rattus norvegicus
tgaccgggaggcctccatcgacatc

SEQ ID NO: 654128 - DNA, 25 bp, Rattus norvegicus
tccactccatcggtaaaggtcctgg

SEQ ID NO: 654129 - DNA, 25 bp, Rattus norvegicus
cgcgagcgcttctcttggagttttc

SEQ ID NO: 654130 - DNA, 25 bp, Rattus norvegicus
agccgactatggtgctgctgactca

SEQ ID NO: 654131 - DNA, 25 bp, Rattus norvegicus
cctatggcttccaatcgggcgggaa

SEQ ID NO: 654132 - DNA, 25 bp, Rattus norvegicus
ggctgctggttataaactggtcgta

SEQ ID NO: 654133 - DNA, 25 bp, Rattus norvegicus
ccgctccggagagaaactacaactc

SEQ ID NO: 654134 - DNA, 25 bp, Rattus norvegicus
agagttccagagagctcagtctcta

SEQ ID NO: 654135 - DNA, 25 bp, Rattus norvegicus
ggcgactgccgctcaggactgacat

SEQ ID NO: 654136 - DNA, 25 bp, Rattus norvegicus
ccgccgttgttatcagcacaggttg

SEQ ID NO: 654137 - DNA, 25 bp, Rattus norvegicus
tcgtagagtgtgttattggaagatc

SEQ ID NO: 654138 - DNA, 25 bp, Rattus norvegicus
tccggccttttttgccctgggatgc

SEQ ID NO: 654139 - DNA, 25 bp, Rattus norvegicus
ggcaggtttctgaggctcggttccc

SEQ ID NO: 654140 - DNA, 25 bp, Rattus norvegicus
accttgagccggcaggtttctgagg

SEQ ID NO: 654141 - DNA, 25 bp, Rattus norvegicus
gccttttttgccctgggatgcggcg

SEQ ID NO: 654142 - DNA, 25 bp, Rattus norvegicus
cgcatgttgaagtccggcctttttt

SEQ ID NO: 654143 - DNA, 25 bp, Rattus norvegicus
agctggggtccgcatgttgaagtcc

SEQ ID NO: 654144 - DNA, 25 bp, Rattus norvegicus
cattggcttagggatgcctgacgtc

SEQ ID NO: 654145 - DNA, 25 bp, Rattus norvegicus
gacatgtggagatgccattggctta

SEQ ID NO: 654146 - DNA, 25 bp, Rattus norvegicus
cgtcgctggacatgtggagatgcca

SEQ ID NO: 654147 - DNA, 25 bp, Rattus norvegicus
cggatgccgaacagggcctggattg

SEQ ID NO: 654148 - DNA, 25 bp, Rattus norvegicus
cccgcagagacaaggcggatgccga

SEQ ID NO: 654149 - DNA, 25 bp, Rattus norvegicus
gaagaatgcgcccagacactcaccg

SEQ ID NO: 654150 - DNA, 25 bp, Rattus norvegicus
acacggaagaatgcgcccagacact

SEQ ID NO: 654151 - DNA, 25 bp, Rattus norvegicus
agttggaccttgagccggcaggttt

SEQ ID NO: 654152 - DNA, 25 bp, Rattus norvegicus
gaccgtcatcgtcacccgcgcgctt

SEQ ID NO: 654153 - DNA, 25 bp, Rattus norvegicus
ccgccctccgggatgcggacgatct

SEQ ID NO: 654154 - DNA, 25 bp, Rattus norvegicus
gcggcgcctgaataacgggttttgc

SEQ ID NO: 654155 - DNA, 25 bp, Rattus norvegicus
tgcggacgatctccgggagcgccct

SEQ ID NO: 654156 - DNA, 25 bp, Rattus norvegicus
tgctcctcccgcgacaccgtagcct

SEQ ID NO: 654157 - DNA, 25 bp, Rattus norvegicus
ttccgccaatagaagcgcagcccgg

SEQ ID NO: 654158 - DNA, 25 bp, Rattus norvegicus
gcgcgcttccgccaatagaagcgca

SEQ ID NO: 654159 - DNA, 25 bp, Rattus norvegicus
cgggaccgactgacgcgcggactcc

SEQ ID NO: 654160 - DNA, 25 bp, Rattus norvegicus
gttcttcgagtctccgggctccgat

SEQ ID NO: 654161 - DNA, 25 bp, Rattus norvegicus
gggccatggcgttcttcgagtctcc

SEQ ID NO: 654162 - DNA, 25 bp, Rattus norvegicus
cgaccaccgccttgaggccaatggg

SEQ ID NO: 654163 - DNA, 25 bp, Rattus norvegicus
ggccacttactctctccgaccaccg

SEQ ID NO: 654164 - DNA, 25 bp, Rattus norvegicus
gggcagcacccggaggccacttact

SEQ ID NO: 654165 - DNA, 25 bp, Rattus norvegicus
agcgccctcccttgcgccttacgtg

SEQ ID NO: 654166 - DNA, 25 bp, Rattus norvegicus
cttccggggatcttctctttgtcta

SEQ ID NO: 654167 - DNA, 25 bp, Rattus norvegicus
ccctacattgtcctcggcgtgagaa

SEQ ID NO: 654168 - DNA, 25 bp, Rattus norvegicus
ttaggcaacagtcccaagggcgctc

SEQ ID NO: 654169 - DNA, 25 bp, Rattus norvegicus
caagggcgctccattttctgcgata

SEQ ID NO: 654170 - DNA, 25 bp, Rattus norvegicus
tcagcctattcttcgctgctatctg

SEQ ID NO: 654171 - DNA, 25 bp, Rattus norvegicus
cgctgctatctgaatgtggagcaca

SEQ ID NO: 654172 - DNA, 25 bp, Rattus norvegicus
gtggagcacaccaggctagtccgtc

SEQ ID NO: 654173 - DNA, 25 bp, Rattus norvegicus
agtctccctgctgtctggaggtccc

SEQ ID NO: 654174 - DNA, 25 bp, Rattus norvegicus
atctcggtaccagcgcagaggagcc

SEQ ID NO: 654175 - DNA, 25 bp, Rattus norvegicus
gcttcttctcgccatgggagacgta

SEQ ID NO: 654176 - DNA, 25 bp, Rattus norvegicus
gggagacgtactgtccacacacctg

SEQ ID NO: 654177 - DNA, 25 bp, Rattus norvegicus
aagcggagacgcttaggcaacagtc

SEQ ID NO: 654178 - DNA, 25 bp, Rattus norvegicus
cgcggcgccagaacatcgcaggtga

SEQ ID NO: 654179 - DNA, 25 bp, Rattus norvegicus
tgtccacacacctggatgacgcgcg

SEQ ID NO: 654180 - DNA, 25 bp, Rattus norvegicus
aggcgagctaaactggccgctctga

SEQ ID NO: 654181 - DNA, 25 bp, Rattus norvegicus
tagctgagagtcagtccgacgcgcg

SEQ ID NO: 654182 - DNA, 25 bp, Rattus norvegicus
gcgaaccgtgatgcccgcctggaaa

SEQ ID NO: 654183 - DNA, 25 bp, Rattus norvegicus
cccgcctggaaacgggagatacttg

SEQ ID NO: 654184 - DNA, 25 bp, Rattus norvegicus
ccagaacccgttcatgcgacttgaa

SEQ ID NO: 654185 - DNA, 25 bp, Rattus norvegicus
gcggaccattcgagccgacaacatc

SEQ ID NO: 654186 - DNA, 25 bp, Rattus norvegicus
tcatcatcgagtcagcgccagggtt

SEQ ID NO: 654187 - DNA, 25 bp, Rattus norvegicus
tagtggtgtacgaggagccacagcc

SEQ ID NO: 654188 - DNA, 25 bp, Rattus norvegicus
gccgcctgctagaaaagttcgactc

SEQ ID NO: 654189 - DNA, 25 bp, Rattus norvegicus
gcgcgctcctaccaatcggtcgttg

SEQ ID NO: 654190 - DNA, 25 bp, Rattus norvegicus
cggcgcagcgacttcctacaaaaga

SEQ ID NO: 654191 - DNA, 25 bp, Rattus norvegicus
aagaccggcagcaactccttcactg

SEQ ID NO: 654192 - DNA, 25 bp, Rattus norvegicus
cggagagtctgggtccactaagcca

SEQ ID NO: 654193 - DNA, 25 bp, Rattus norvegicus
cgcttgcccaattggcggctaccaa

SEQ ID NO: 654194 - DNA, 25 bp, Rattus norvegicus
cgatctggcagcctgcgtgccttag

SEQ ID NO: 654195 - DNA, 25 bp, Rattus norvegicus
ctgatgggagtcgtagacatgtaac

SEQ ID NO: 654196 - DNA, 25 bp, Rattus norvegicus
gtctggtaagtcgtggctactgatg

SEQ ID NO: 654197 - DNA, 25 bp, Rattus norvegicus
ccctaagatcggtcctctgggtctg

SEQ ID NO: 654198 - DNA, 25 bp, Rattus norvegicus
gcagaggttctgactttgctttttc

SEQ ID NO: 654199 - DNA, 25 bp, Rattus norvegicus
ccttgtcctcctcgtgtgtgagctg

SEQ ID NO: 654200 - DNA, 25 bp, Rattus norvegicus
tggaaccttttctgccgcgtgctgt

SEQ ID NO: 654201 - DNA, 25 bp, Rattus norvegicus
cgagatcaaagtcggtgcgtgccct

SEQ ID NO: 654202 - DNA, 25 bp, Rattus norvegicus
gaatccgggttcatccgacaccagc

SEQ ID NO: 654203 - DNA, 25 bp, Rattus norvegicus
ggcaacggtgcaactttcttcggtc

SEQ ID NO: 654204 - DNA, 25 bp, Rattus norvegicus
tgggcggagcaacatccgtcttttc

SEQ ID NO: 654205 - DNA, 25 bp, Rattus norvegicus
ttttcggcctatatccggcgtgggc

SEQ ID NO: 654206 - DNA, 25 bp, Rattus norvegicus
cgagagttgagcttttcggcctata

SEQ ID NO: 654207 - DNA, 25 bp, Rattus norvegicus
ctcagtgtacttgaggtgcaccgga

SEQ ID NO: 654208 - DNA, 25 bp, Rattus norvegicus
gcgatccgcacaccgcagcccactt

SEQ ID NO: 654209 - DNA, 25 bp, Rattus norvegicus
gctcagacctcgtgtggaaaaacgt

SEQ ID NO: 654210 - DNA, 25 bp, Rattus norvegicus
agacctcgtgtggaaaaacgttctg

SEQ ID NO: 654211 - DNA, 25 bp, Rattus norvegicus
tctggtccggggctactgcgcacat

SEQ ID NO: 654212 - DNA, 25 bp, Rattus norvegicus
ggctactgcgcacatctgggtaaca

SEQ ID NO: 654213 - DNA, 25 bp, Rattus norvegicus
actgcgcacatctgggtaacaactg

SEQ ID NO: 654214 - DNA, 25 bp, Rattus norvegicus
tgggtaacaactgcacagctcttcg

SEQ ID NO: 654215 - DNA, 25 bp, Rattus norvegicus
acagctcttcgcctcttctcgccca

SEQ ID NO: 654216 - DNA, 25 bp, Rattus norvegicus
ttctcgcccatcctgcaaacagggg

SEQ ID NO: 654217 - DNA, 25 bp, Rattus norvegicus
caaacaggggacaactggcaccgcc

SEQ ID NO: 654218 - DNA, 25 bp, Rattus norvegicus
tggcaccgccgccagaagttaccgg

SEQ ID NO: 654219 - DNA, 25 bp, Rattus norvegicus
ccgccagaagttaccgggacgtgtg

SEQ ID NO: 654220 - DNA, 25 bp, Rattus norvegicus
cacttccggccatgcgcgatccgca

SEQ ID NO: 654221 - DNA, 25 bp, Rattus norvegicus
cgggcgcgccaaaacggcgccactt

SEQ ID NO: 654222 - DNA, 25 bp, Rattus norvegicus
atgacagcaaaaccggtcacgaagg

SEQ ID NO: 654223 - DNA, 25 bp, Rattus norvegicus
agtgaccaatgggacgctagaatcc

SEQ ID NO: 654224 - DNA, 25 bp, Rattus norvegicus
ggcctccgcggcaggagtgaccaat

SEQ ID NO: 654225 - DNA, 25 bp, Rattus norvegicus
aacagggtctgacccgcgaactgtc

SEQ ID NO: 654226 - DNA, 25 bp, Rattus norvegicus
ctcgggcgacatgtcaacagggtct

SEQ ID NO: 654227 - DNA, 25 bp, Rattus norvegicus
gcgaccgcaacagcggctgtgtttc

SEQ ID NO: 654228 - DNA, 25 bp, Rattus norvegicus
agctgtagccaagcgcgaagccgaa

SEQ ID NO: 654229 - DNA, 25 bp, Rattus norvegicus
cccgaaccaggaggccgcagtgtct

SEQ ID NO: 654230 - DNA, 25 bp, Rattus norvegicus
ccgcagcctcagaggaaagagaatg

SEQ ID NO: 654231 - DNA, 25 bp, Rattus norvegicus
tgaagaggaggccaccagggaccat

SEQ ID NO: 654232 - DNA, 25 bp, Rattus norvegicus
agcttgcgccctgcacggtccagga

SEQ ID NO: 654233 - DNA, 25 bp, Rattus norvegicus
cagagcaggaggctcagcttgcgcc

SEQ ID NO: 654234 - DNA, 25 bp, Rattus norvegicus
gggccgcggtgatgacagcaaaacc

SEQ ID NO: 654235 - DNA, 25 bp, Rattus norvegicus
gtgccactaatgaggcgactccgca

SEQ ID NO: 654236 - DNA, 25 bp, Rattus norvegicus
agaggctcaccgagggaggctcacc

SEQ ID NO: 654237 - DNA, 25 bp, Rattus norvegicus
gctcaccgagggaggctcaccgaga

SEQ ID NO: 654238 - DNA, 25 bp, Rattus norvegicus
gctcaccgagggaggctcaccgagg

SEQ ID NO: 654239 - DNA, 25 bp, Rattus norvegicus
agaggctcaccgagagaggctcacc

SEQ ID NO: 654240 - DNA, 25 bp, Rattus norvegicus
ctcaccgagggaggctcaccgagag

SEQ ID NO: 654241 - DNA, 25 bp, Rattus norvegicus
aggctcaccgagagaggctcaccga

SEQ ID NO: 654242 - DNA, 25 bp, Rattus norvegicus
gaggctcaccgagagaggctcaccg

SEQ ID NO: 654243 - DNA, 25 bp, Rattus norvegicus
aggctcaccgagggaggctcaccga

SEQ ID NO: 654244 - DNA, 25 bp, Rattus norvegicus
gggaggctcaccgagggaggctcac

SEQ ID NO: 654245 - DNA, 25 bp, Rattus norvegicus
gaggctcaccgagggaggctcaccg

SEQ ID NO: 654246 - DNA, 25 bp, Rattus norvegicus
ggctcaccgagagaggctcaccgag

SEQ ID NO: 654247 - DNA, 25 bp, Rattus norvegicus
ctcaccgagagaggctcaccgagag

SEQ ID NO: 654248 - DNA, 25 bp, Rattus norvegicus
gagaggctcaccgagagaggctcac

SEQ ID NO: 654249 - DNA, 25 bp, Rattus norvegicus
gctcaccgagagaggctcaccgaga

SEQ ID NO: 654250 - DNA, 25 bp, Rattus norvegicus
tgttcggctggacgctcagctagcg

SEQ ID NO: 654251 - DNA, 25 bp, Rattus norvegicus
tgtgcggactccctcccacgccgcg

SEQ ID NO: 654252 - DNA, 25 bp, Rattus norvegicus
gaggcttcggacgtccacagcatct

SEQ ID NO: 654253 - DNA, 25 bp, Rattus norvegicus
ttcggacgtccacagcatctgctgg

SEQ ID NO: 654254 - DNA, 25 bp, Rattus norvegicus
cacagcatctgctggccggacacag

SEQ ID NO: 654255 - DNA, 25 bp, Rattus norvegicus
atctgctggccggacacaggttccc

SEQ ID NO: 654256 - DNA, 25 bp, Rattus norvegicus
tgggcactccctcagtgtggcccgg

SEQ ID NO: 654257 - DNA, 25 bp, Rattus norvegicus
ctagaggctgcacccctcggggcaa

SEQ ID NO: 654258 - DNA, 25 bp, Rattus norvegicus
ggcaacggtacctgggactctcaaa

SEQ ID NO: 654259 - DNA, 25 bp, Rattus norvegicus
acggtacctgggactctcaaagctg

SEQ ID NO: 654260 - DNA, 25 bp, Rattus norvegicus
gtacctgggactctcaaagctgcac

SEQ ID NO: 654261 - DNA, 25 bp, Rattus norvegicus
ctcttctgccgcaggagcgcagcgg

SEQ ID NO: 654262 - DNA, 25 bp, Rattus norvegicus
ccgccgggttcctgctccatcgccc

SEQ ID NO: 654263 - DNA, 25 bp, Rattus norvegicus
cggtgttcggctggacgctcagcta

SEQ ID NO: 654264 - DNA, 25 bp, Rattus norvegicus
tccaagaaggcgcagcccaacagca

SEQ ID NO: 654265 - DNA, 25 bp, Rattus norvegicus
gcaacatcgcgcacctcaacaatga

SEQ ID NO: 654266 - DNA, 25 bp, Rattus norvegicus
ctcggtactgccttggaagaggatc

SEQ ID NO: 654267 - DNA, 25 bp, Rattus norvegicus
gaagcggcactccatcatctcggta

SEQ ID NO: 654268 - DNA, 25 bp, Rattus norvegicus
tacacggccgtgcagaacagcaaga

SEQ ID NO: 654269 - DNA, 25 bp, Rattus norvegicus
ccacactgtttgaggatggcgcggc

SEQ ID NO: 654270 - DNA, 25 bp, Rattus norvegicus
ccagctatcgaaaggccacactgtt

SEQ ID NO: 654271 - DNA, 25 bp, Rattus norvegicus
gcggccgctacaggcttggtaagcc

SEQ ID NO: 654272 - DNA, 25 bp, Rattus norvegicus
agatccgcagggctacacgcgtcgt

SEQ ID NO: 654273 - DNA, 25 bp, Rattus norvegicus
ccggggctgagaaccatcttgtttt

SEQ ID NO: 654274 - DNA, 25 bp, Rattus norvegicus
ccttggacagaagctgagagccgcc

SEQ ID NO: 654275 - DNA, 25 bp, Rattus norvegicus
cgcgcgcaatctggagaggcagctt

SEQ ID NO: 654276 - DNA, 25 bp, Rattus norvegicus
aagaagtcgctgtcgtgtgccaacc

SEQ ID NO: 654277 - DNA, 25 bp, Rattus norvegicus
cggtgtcagcgaagaagaagaactc

SEQ ID NO: 654278 - DNA, 25 bp, Rattus norvegicus
ggaaccgtccactcctgggcctgaa

SEQ ID NO: 654279 - DNA, 25 bp, Rattus norvegicus
gccgctaacctacacagattctctt

SEQ ID NO: 654280 - DNA, 25 bp, Rattus norvegicus
ttctctttcttgtcccagggcccga

SEQ ID NO: 654281 - DNA, 25 bp, Rattus norvegicus
tctctcaccactgtagtccgggctg

SEQ ID NO: 654282 - DNA, 25 bp, Rattus norvegicus
tcaccttgacgagggccgcagtgac

SEQ ID NO: 654283 - DNA, 25 bp, Rattus norvegicus
cagcggcgccttcgttctgagaccg

SEQ ID NO: 654284 - DNA, 25 bp, Rattus norvegicus
gtgcccagccgcagtaggaaccgtc

SEQ ID NO: 654285 - DNA, 25 bp, Rattus norvegicus
aacggcggccggctcaaccaatcgg

SEQ ID NO: 654286 - DNA, 25 bp, Rattus norvegicus
gggactctccaaccagcttgtcgta

SEQ ID NO: 654287 - DNA, 25 bp, Rattus norvegicus
gacacgcaaatgaaccgactggttg

SEQ ID NO: 654288 - DNA, 25 bp, Rattus norvegicus
actggttgcaccagtgcgcagccgc

SEQ ID NO: 654289 - DNA, 25 bp, Rattus norvegicus
tagctaggatgctccgctgctctca

SEQ ID NO: 654290 - DNA, 25 bp, Rattus norvegicus
tctggcagacgctcaggctagctag

SEQ ID NO: 654291 - DNA, 25 bp, Rattus norvegicus
tgagccaggcgcaagcttgaaacgc

SEQ ID NO: 654292 - DNA, 25 bp, Rattus norvegicus
ccaagcttaacacgcgccgcctgtt

SEQ ID NO: 654293 - DNA, 25 bp, Rattus norvegicus
gggccaccctgaccctgccgcctcc

SEQ ID NO: 654294 - DNA, 25 bp, Rattus norvegicus
cccggcactgaccaggcagcctctc

SEQ ID NO: 654295 - DNA, 25 bp, Rattus norvegicus
ccggcaggtgccagggcctcaagac

SEQ ID NO: 654296 - DNA, 25 bp, Rattus norvegicus
cactgagacccctcggtacgggaga

SEQ ID NO: 654297 - DNA, 25 bp, Rattus norvegicus
ctccggggacaacggtcactgagac

SEQ ID NO: 654298 - DNA, 25 bp, Rattus norvegicus
tggctctccggggacaacggtcact

SEQ ID NO: 654299 - DNA, 25 bp, Rattus norvegicus
ggccagaggtagcagctcctgggca

SEQ ID NO: 654300 - DNA, 25 bp, Rattus norvegicus
gccgcctgtttacctggcgcaaggc

SEQ ID NO: 654301 - DNA, 25 bp, Rattus norvegicus
gccgcgcgccgcgttcacatcgccc

SEQ ID NO: 654302 - DNA, 25 bp, Rattus norvegicus
ccacccgggccaagcttaacacgcg

SEQ ID NO: 654303 - DNA, 25 bp, Rattus norvegicus
cagtggccacgcagaccacccgggc

SEQ ID NO: 654304 - DNA, 25 bp, Rattus norvegicus
agccctgcgtcagtggccacgcaga

SEQ ID NO: 654305 - DNA, 25 bp, Rattus norvegicus
tttacctggcgcaaggcggtggcca

SEQ ID NO: 654306 - DNA, 25 bp, Rattus norvegicus
gccgcaggactccaaaccggggagc

SEQ ID NO: 654307 - DNA, 25 bp, Rattus norvegicus
ggtctgacaaagaggcgaaactcag

SEQ ID NO: 654308 - DNA, 25 bp, Rattus norvegicus
actcagagcagcgaggttctccttc

SEQ ID NO: 654309 - DNA, 25 bp, Rattus norvegicus
aagctctcgagcctgcggtgcacct

SEQ ID NO: 654310 - DNA, 25 bp, Rattus norvegicus
cgcctgcgcaatggtttcgaagcta

SEQ ID NO: 654311 - DNA, 25 bp, Rattus norvegicus
gggcttcggaatcactcgcgccgtc

SEQ ID NO: 654312 - DNA, 25 bp, Rattus norvegicus
catcaccgccgtcggagggaacgca

SEQ ID NO: 654313 - DNA, 25 bp, Rattus norvegicus
agcgtccctgttgccgtacgaaggc

SEQ ID NO: 654314 - DNA, 25 bp, Rattus norvegicus
gtacgaaggccttattctccgccgc

SEQ ID NO: 654315 - DNA, 25 bp, Rattus norvegicus
cgaaactgccagtgcttccggaggc

SEQ ID NO: 654316 - DNA, 25 bp, Rattus norvegicus
tgtgcgtatgctccaggagtccttt

SEQ ID NO: 654317 - DNA, 25 bp, Rattus norvegicus
ccaggagtcctttctgggcgggtct

SEQ ID NO: 654318 - DNA, 25 bp, Rattus norvegicus
tcttcaggagagcacgctaggggct

SEQ ID NO: 654319 - DNA, 25 bp, Rattus norvegicus
gggcggattctccaagctctcgagc

SEQ ID NO: 654320 - DNA, 25 bp, Rattus norvegicus
aggtttctgcgaagtgtctctctca

SEQ ID NO: 654321 - DNA, 25 bp, Rattus norvegicus
gtacgttatgcgcagagggtcagtc

SEQ ID NO: 654322 - DNA, 25 bp, Rattus norvegicus
cagtcccatgcgtgtgcaagcctta

SEQ ID NO: 654323 - DNA, 25 bp, Rattus norvegicus
gcaagccttacggtcagacgtatgg

SEQ ID NO: 654324 - DNA, 25 bp, Rattus norvegicus
gggtctctctatcgctctctctgga

SEQ ID NO: 654325 - DNA, 25 bp, Rattus norvegicus
tctatcgctctctctggagtgtgtg

SEQ ID NO: 654326 - DNA, 25 bp, Rattus norvegicus
ggggtgctctgtcccatccatcaac

SEQ ID NO: 654327 - DNA, 25 bp, Rattus norvegicus
tccatcaaccagagcgcattgagcc

SEQ ID NO: 654328 - DNA, 25 bp, Rattus norvegicus
cggggcggacacctgagaaaagcac

SEQ ID NO: 654329 - DNA, 25 bp, Rattus norvegicus
gtctctctcacctctttaaatttta

SEQ ID NO: 654330 - DNA, 25 bp, Rattus norvegicus
cccgcgctgctgaggtttctgcgaa

SEQ ID NO: 654331 - DNA, 25 bp, Rattus norvegicus
agaaaagcacgggacgacacgtcgg

SEQ ID NO: 654332 - DNA, 25 bp, Rattus norvegicus
aattttatggcgcttggcccgtggc

SEQ ID NO: 654333 - DNA, 25 bp, Rattus norvegicus
cggctcgcagatcttatcctcttca

SEQ ID NO: 654334 - DNA, 25 bp, Rattus norvegicus
aggaagctgccagcgctaatcgccc

SEQ ID NO: 654335 - DNA, 25 bp, Rattus norvegicus
gctttcgattgggatccgggcatcg

SEQ ID NO: 654336 - DNA, 25 bp, Rattus norvegicus
gtgcgcacgctttcgattgggatcc

SEQ ID NO: 654337 - DNA, 25 bp, Rattus norvegicus
tttagcaccggctgtgcgtgcgcac

SEQ ID NO: 654338 - DNA, 25 bp, Rattus norvegicus
ccctctagcgtttagcaccggctgt

SEQ ID NO: 654339 - DNA, 25 bp, Rattus norvegicus
ttgacaattaaaaagcgcctagctt

SEQ ID NO: 654340 - DNA, 25 bp, Rattus norvegicus
gctaatcgcccgcagtcatttgaca

SEQ ID NO: 654341 - DNA, 25 bp, Rattus norvegicus
cgattattgaggaagctgccagcgc

SEQ ID NO: 654342 - DNA, 25 bp, Rattus norvegicus
tcccagcaggtacagagaagagcga

SEQ ID NO: 654343 - DNA, 25 bp, Rattus norvegicus
tgttttttaattaagctcccagcag

SEQ ID NO: 654344 - DNA, 25 bp, Rattus norvegicus
tggcctttaaattgagcctctttgt

SEQ ID NO: 654345 - DNA, 25 bp, Rattus norvegicus
catagtaatggcctttaaattgagc

SEQ ID NO: 654346 - DNA, 25 bp, Rattus norvegicus
cggctgcattagcatagtaatggcc

SEQ ID NO: 654347 - DNA, 25 bp, Rattus norvegicus
cgcccgcagtcatttgacaattaaa

SEQ ID NO: 654348 - DNA, 25 bp, Rattus norvegicus
tgacacaactcttcgatgcctaggg

SEQ ID NO: 654349 - DNA, 25 bp, Rattus norvegicus
cctggaatactgtgagcaccggtct

SEQ ID NO: 654350 - DNA, 25 bp, Rattus norvegicus
caggagctcgtggttgcctggaata

SEQ ID NO: 654351 - DNA, 25 bp, Rattus norvegicus
atgactgcgactctaggcctggaca

SEQ ID NO: 654352 - DNA, 25 bp, Rattus norvegicus
gacaattgtcgccacggatgactgc

SEQ ID NO: 654353 - DNA, 25 bp, Rattus norvegicus
gcgcttgcgtcatcaccgtgcgcta

SEQ ID NO: 654354 - DNA, 25 bp, Rattus norvegicus
gctcacacttgaccaactcgttgtt

SEQ ID NO: 654355 - DNA, 25 bp, Rattus norvegicus
ggcacagctcctctcgtttctgaca

SEQ ID NO: 654356 - DNA, 25 bp, Rattus norvegicus
tctgtagccgctgcttttcgtcctc

SEQ ID NO: 654357 - DNA, 25 bp, Rattus norvegicus
gagctgcctcacctcattctgtagc

SEQ ID NO: 654358 - DNA, 25 bp, Rattus norvegicus
gcgggccaatttctccgtgagctgc

SEQ ID NO: 654359 - DNA, 25 bp, Rattus norvegicus
aactcgttgcgagaggcgatcttgc

SEQ ID NO: 654360 - DNA, 25 bp, Rattus norvegicus
cgcaatggtccggtcaaactcgttg

SEQ ID NO: 654361 - DNA, 25 bp, Rattus norvegicus
cgcgagcaagcgaacgtcacgactg

SEQ ID NO: 654362 - DNA, 25 bp, Rattus norvegicus
gactgctaagcactggctgtctccc

SEQ ID NO: 654363 - DNA, 25 bp, Rattus norvegicus
atcgcagcgcgctccgaagagcaca

SEQ ID NO: 654364 - DNA, 25 bp, Rattus norvegicus
cgcgctccgaagagcacagctaata

SEQ ID NO: 654365 - DNA, 25 bp, Rattus norvegicus
gctccgaagagcacagctaataatg

SEQ ID NO: 654366 - DNA, 25 bp, Rattus norvegicus
gctaataatgggagctcggagccgc

SEQ ID NO: 654367 - DNA, 25 bp, Rattus norvegicus
aataatgggagctcggagccgccgc

SEQ ID NO: 654368 - DNA, 25 bp, Rattus norvegicus
tctgagcagactgctaagcactggc

SEQ ID NO: 654369 - DNA, 25 bp, Rattus norvegicus
atgattaaaaactgccaagcgagcc

SEQ ID NO: 654370 - DNA, 25 bp, Rattus norvegicus
ttaaaaactgccaagcgagcctggc

SEQ ID NO: 654371 - DNA, 25 bp, Rattus norvegicus
gccaagcgagcctggcaatcactcg

SEQ ID NO: 654372 - DNA, 25 bp, Rattus norvegicus
tggcaatcactcgctccgctgtcag

SEQ ID NO: 654373 - DNA, 25 bp, Rattus norvegicus
cgctgtcagcccgacacaagacaaa

SEQ ID NO: 654374 - DNA, 25 bp, Rattus norvegicus
gtcagcccgacacaagacaaatctc

SEQ ID NO: 654375 - DNA, 25 bp, Rattus norvegicus
cccgaggtctttctgagcagactgc

SEQ ID NO: 654376 - DNA, 25 bp, Rattus norvegicus
accgctgagaggaatgcctggaaca

SEQ ID NO: 654377 - DNA, 25 bp, Rattus norvegicus
agagaatcccggctcgaaccgctga

SEQ ID NO: 654378 - DNA, 25 bp, Rattus norvegicus
cctgctgcgtctacggaggagcccg

SEQ ID NO: 654379 - DNA, 25 bp, Rattus norvegicus
aggctgcgacgagccgccttgccag

SEQ ID NO: 654380 - DNA, 25 bp, Rattus norvegicus
acgagcctccgagcttccgaagatc

SEQ ID NO: 654381 - DNA, 25 bp, Rattus norvegicus
atgcctggaacactgcgcagaccca

SEQ ID NO: 654382 - DNA, 25 bp, Rattus norvegicus
tgaaattcatcaacctccgccaagg

SEQ ID NO: 654383 - DNA, 25 bp, Rattus norvegicus
ccctggtgacactgaaattcatcaa

SEQ ID NO: 654384 - DNA, 25 bp, Rattus norvegicus
tagagcgcgcggttcccaaatccag

SEQ ID NO: 654385 - DNA, 25 bp, Rattus norvegicus
accgtgtgcgcgtattagagcgcgc

SEQ ID NO: 654386 - DNA, 25 bp, Rattus norvegicus
tccttcataaatcagcggccgggtg

SEQ ID NO: 654387 - DNA, 25 bp, Rattus norvegicus
cgggatcggatcgaattccttcata

SEQ ID NO: 654388 - DNA, 25 bp, Rattus norvegicus
actgtgaaggaacccaaggtttgtg

SEQ ID NO: 654389 - DNA, 25 bp, Rattus norvegicus
tccgaagatcccttaactgtgaagg

SEQ ID NO: 654390 - DNA, 25 bp, Rattus norvegicus
tccgatcccggaagtagcagctggt

SEQ ID NO: 654391 - DNA, 25 bp, Rattus norvegicus
tcccgggctctaaggagacaacttg

SEQ ID NO: 654392 - DNA, 25 bp, Rattus norvegicus
cctgacctggactattcgggcattg

SEQ ID NO: 654393 - DNA, 25 bp, Rattus norvegicus
agctgtctaggtgtgcttgttgccc

SEQ ID NO: 654394 - DNA, 25 bp, Rattus norvegicus
gccctgtctaggtgacgtccctgaa

SEQ ID NO: 654395 - DNA, 25 bp, Rattus norvegicus
cccggtccagtgtagcagtactaga

SEQ ID NO: 654396 - DNA, 25 bp, Rattus norvegicus
tctgccctaagacccgcggtttgga

SEQ ID NO: 654397 - DNA, 25 bp, Rattus norvegicus
cccacgatgctgatggaaccttctg

SEQ ID NO: 654398 - DNA, 25 bp, Rattus norvegicus
tattaccaacgagaaggagctccgc

SEQ ID NO: 654399 - DNA, 25 bp, Rattus norvegicus
cccgcttgcggagatccagcgtatg

SEQ ID NO: 654400 - DNA, 25 bp, Rattus norvegicus
gcagccctagacagcacgttccttt

SEQ ID NO: 654401 - DNA, 25 bp, Rattus norvegicus
tgcaaacactcctcgtgccaggacg

SEQ ID NO: 654402 - DNA, 25 bp, Rattus norvegicus
tttgcagtacagtttccgatcccgg

SEQ ID NO: 654403 - DNA, 25 bp, Rattus norvegicus
gacgactcgttgactcgcatcagga

SEQ ID NO: 654404 - DNA, 25 bp, Rattus norvegicus
tctataagtgtgtctccgagttacc

SEQ ID NO: 654405 - DNA, 25 bp, Rattus norvegicus
gccaccgaggaaactagaagacatc

SEQ ID NO: 654406 - DNA, 25 bp, Rattus norvegicus
cccgcgcgagtttcatcgtggaata

SEQ ID NO: 654407 - DNA, 25 bp, Rattus norvegicus
cccagtgtgggaaatctaaggcctt

SEQ ID NO: 654408 - DNA, 25 bp, Rattus norvegicus
ccgagctcctgaattgttccgtgtc

SEQ ID NO: 654409 - DNA, 25 bp, Rattus norvegicus
ccctgtagcgcgtctggtagatttt

SEQ ID NO: 654410 - DNA, 25 bp, Rattus norvegicus
tgaagatgtctacgcctttgtacgc

SEQ ID NO: 654411 - DNA, 25 bp, Rattus norvegicus
gtcctcgtgtctgtcacagtgaaga

SEQ ID NO: 654412 - DNA, 25 bp, Rattus norvegicus
tgcggactcttctcgtgcttctatg

SEQ ID NO: 654413 - DNA, 25 bp, Rattus norvegicus
tgcgactttccaggcagtgaatgtc

SEQ ID NO: 654414 - DNA, 25 bp, Rattus norvegicus
cgtgttcctgtgcacatacattttg

SEQ ID NO: 654415 - DNA, 25 bp, Rattus norvegicus
attgagttcgtgtgcacccgtgttc

SEQ ID NO: 654416 - DNA, 25 bp, Rattus norvegicus
tcccggctcagaggctattgagttc

SEQ ID NO: 654417 - DNA, 25 bp, Rattus norvegicus
ctttgtgtttctgtatccgggagca

SEQ ID NO: 654418 - DNA, 25 bp, Rattus norvegicus
cgccgcactcactcgcgggagctgc

SEQ ID NO: 654419 - DNA, 25 bp, Rattus norvegicus
tcagcacgaagtccgccttgccaaa

SEQ ID NO: 654420 - DNA, 25 bp, Rattus norvegicus
cctctcgggaaacgtcggcatgact

SEQ ID NO: 654421 - DNA, 25 bp, Rattus norvegicus
ggaaacgtcggcatgactacccaga

SEQ ID NO: 654422 - DNA, 25 bp, Rattus norvegicus
ccgccctagcctcttgggctccgcc

SEQ ID NO: 654423 - DNA, 25 bp, Rattus norvegicus
ggctggtcctgcctcaagcctgagt

SEQ ID NO: 654424 - DNA, 25 bp, Rattus norvegicus
ggccggagatagacggccgccactc

SEQ ID NO: 654425 - DNA, 25 bp, Rattus norvegicus
gtccatcagcacgaagtccgccttg

SEQ ID NO: 654426 - DNA, 25 bp, Rattus norvegicus
agacggtgtccatcagcacgaagtc

SEQ ID NO: 654427 - DNA, 25 bp, Rattus norvegicus
aactcgggcatggagacggtgtcca

SEQ ID NO: 654428 - DNA, 25 bp, Rattus norvegicus
ctaaggttggccatgaactcgggca

SEQ ID NO: 654429 - DNA, 25 bp, Rattus norvegicus
tcacctgagcctaaggttggccatg

SEQ ID NO: 654430 - DNA, 25 bp, Rattus norvegicus
gtcggcatgactacccagacgcgct

SEQ ID NO: 654431 - DNA, 25 bp, Rattus norvegicus
tccggcccgcgtagctctgaacggg

SEQ ID NO: 654432 - DNA, 25 bp, Rattus norvegicus
tggtgacggatcactccagcgcacg

SEQ ID NO: 654433 - DNA, 25 bp, Rattus norvegicus
ttaggaccttgcaacctcactcggc

SEQ ID NO: 654434 - DNA, 25 bp, Rattus norvegicus
ggcctccgacgtctgctgcagaatc

SEQ ID NO: 654435 - DNA, 25 bp, Rattus norvegicus
ctgctgcagaatccgctcgggattg

SEQ ID NO: 654436 - DNA, 25 bp, Rattus norvegicus
ccacctgagcaaagacggagaaggc

SEQ ID NO: 654437 - DNA, 25 bp, Rattus norvegicus
gcacgccgtccaacgcgggatgctt

SEQ ID NO: 654438 - DNA, 25 bp, Rattus norvegicus
ctgccggcacagctggaatcggaaa

SEQ ID NO: 654439 - DNA, 25 bp, Rattus norvegicus
caaaacagggagagacccgggctct

SEQ ID NO: 654440 - DNA, 25 bp, Rattus norvegicus
ccgggctcttcttatcccagagata

SEQ ID NO: 654441 - DNA, 25 bp, Rattus norvegicus
tcccagagatatgcagctcctgagc

SEQ ID NO: 654442 - DNA, 25 bp, Rattus norvegicus
agctcctgagccctaacttggtttc

SEQ ID NO: 654443 - DNA, 25 bp, Rattus norvegicus
agccctaacttggtttctgactctt

SEQ ID NO: 654444 - DNA, 25 bp, Rattus norvegicus
cgacccgtctcgtgcgggcgtatga

SEQ ID NO: 654445 - DNA, 25 bp, Rattus norvegicus
tcgggattgtttccacctgagcaaa

SEQ ID NO: 654446 - DNA, 25 bp, Rattus norvegicus
cacgtgactgctgagagccagaccc

SEQ ID NO: 654447 - DNA, 25 bp, Rattus norvegicus
acccacgtgactgctgagagccaga

SEQ ID NO: 654448 - DNA, 25 bp, Rattus norvegicus
atccgcacccacgtgactgctgaga

SEQ ID NO: 654449 - DNA, 25 bp, Rattus norvegicus
gctgagagccagaccccaggccagg

SEQ ID NO: 654450 - DNA, 25 bp, Rattus norvegicus
cccaggccaggcgagtcaagggaac

SEQ ID NO: 654451 - DNA, 25 bp, Rattus norvegicus
ccaggcgagtcaagggaactgtccc

SEQ ID NO: 654452 - DNA, 25 bp, Rattus norvegicus
tcaagggaactgtccccagcgtgtg

SEQ ID NO: 654453 - DNA, 25 bp, Rattus norvegicus
gtgtgccccggtggagatcctcgcc

SEQ ID NO: 654454 - DNA, 25 bp, Rattus norvegicus
cctcggagggctgctgccactcgag

SEQ ID NO: 654455 - DNA, 25 bp, Rattus norvegicus
gcaaggccgagccggaacctcgaga

SEQ ID NO: 654456 - DNA, 25 bp, Rattus norvegicus
tcgctccagccgcaaggccgagccg

SEQ ID NO: 654457 - DNA, 25 bp, Rattus norvegicus
ctgggcccggctggctcctcccgta

SEQ ID NO: 654458 - DNA, 25 bp, Rattus norvegicus
cggagggctgctgccactcgagtcc

SEQ ID NO: 654459 - DNA, 25 bp, Rattus norvegicus
ccggaacctcgagagcccgcggcac

SEQ ID NO: 654460 - DNA, 25 bp, Rattus norvegicus
aacccgtctgtctgtacggcagcga

SEQ ID NO: 654461 - DNA, 25 bp, Rattus norvegicus
ggggcacagatcttcattagcgccc

SEQ ID NO: 654462 - DNA, 25 bp, Rattus norvegicus
cgcgctcctccaggatggaaggcga

SEQ ID NO: 654463 - DNA, 25 bp, Rattus norvegicus
ctcctccaggatggaaggcgacggc

SEQ ID NO: 654464 - DNA, 25 bp, Rattus norvegicus
aggcgacggcgccttgtcaaccaga

SEQ ID NO: 654465 - DNA, 25 bp, Rattus norvegicus
cgccttgtcaaccagacggtggatg

SEQ ID NO: 654466 - DNA, 25 bp, Rattus norvegicus
ggagccgaacccgtctgtctgtacg

SEQ ID NO: 654467 - DNA, 25 bp, Rattus norvegicus
cgccgttaattcacgtcacccttcg

SEQ ID NO: 654468 - DNA, 25 bp, Rattus norvegicus
cctccagcctgcgtggtaggaagag

SEQ ID NO: 654469 - DNA, 25 bp, Rattus norvegicus
aagagcgggcgccaattccctaata

SEQ ID NO: 654470 - DNA, 25 bp, Rattus norvegicus
gcgccaattccctaataaagacttg

SEQ ID NO: 654471 - DNA, 25 bp, Rattus norvegicus
taaagacttgttttgcaacgaggcc

SEQ ID NO: 654472 - DNA, 25 bp, Rattus norvegicus
tgttttgcaacgaggccgaataggg

SEQ ID NO: 654473 - DNA, 25 bp, Rattus norvegicus
ttcgcacctccagcctgcgtggtag

SEQ ID NO: 654474 - DNA, 25 bp, Rattus norvegicus
gcttaatgagacgacaccaactttg

SEQ ID NO: 654475 - DNA, 25 bp, Rattus norvegicus
ttcagcccgatagcagcgtgaccca

SEQ ID NO: 654476 - DNA, 25 bp, Rattus norvegicus
agtgacccgctcataaggctccgct

SEQ ID NO: 654477 - DNA, 25 bp, Rattus norvegicus
cagagtctgcagcatcctggattga

SEQ ID NO: 654478 - DNA, 25 bp, Rattus norvegicus
tgcttgcgcctcgtccaagctctgg

SEQ ID NO: 654479 - DNA, 25 bp, Rattus norvegicus
tgacccatctgctgggccgacagaa

SEQ ID NO: 654480 - DNA, 25 bp, Rattus norvegicus
ggctcccgtacacacacaaaagatg

SEQ ID NO: 654481 - DNA, 25 bp, Rattus norvegicus
tgatcgagtttgtcccgaacccggc

SEQ ID NO: 654482 - DNA, 25 bp, Rattus norvegicus
tggattgatcgtccatcccgccgcg

SEQ ID NO: 654483 - DNA, 25 bp, Rattus norvegicus
gcacggacgaagcactgatcgagtt

SEQ ID NO: 654484 - DNA, 25 bp, Rattus norvegicus
agaaagttgcacttcccggcggtgc

SEQ ID NO: 654485 - DNA, 25 bp, Rattus norvegicus
tcctagagaacttggcgctcccgca

SEQ ID NO: 654486 - DNA, 25 bp, Rattus norvegicus
gtgacccaagggaccagaccgacgc

SEQ ID NO: 654487 - DNA, 25 bp, Rattus norvegicus
gaggatgtcgccgatgtcctgcttc

SEQ ID NO: 654488 - DNA, 25 bp, Rattus norvegicus
gtcccaattggagcgttcgaaagtc

SEQ ID NO: 654489 - DNA, 25 bp, Rattus norvegicus
ggacagtgcctggtctactttccca

SEQ ID NO: 654490 - DNA, 25 bp, Rattus norvegicus
gcccatcccacggtcgctatggtaa

SEQ ID NO: 654491 - DNA, 25 bp, Rattus norvegicus
acagagccaagaaagggttgtccca

SEQ ID NO: 654492 - DNA, 25 bp, Rattus norvegicus
tccagggccaatcgcattacgctca

SEQ ID NO: 654493 - DNA, 25 bp, Rattus norvegicus
ctctgggcacaaggccgcaagtcca

SEQ ID NO: 654494 - DNA, 25 bp, Rattus norvegicus
cttcctgtcaagaggtggtaccctc

SEQ ID NO: 654495 - DNA, 25 bp, Rattus norvegicus
ttgcatgagatgagcttcacgcctc

SEQ ID NO: 654496 - DNA, 25 bp, Rattus norvegicus
tgtataggaccggataaagtctccc

SEQ ID NO: 654497 - DNA, 25 bp, Rattus norvegicus
cctattgttagcagttggggactta

SEQ ID NO: 654498 - DNA, 25 bp, Rattus norvegicus
ggacagcccagccagcaaagtgttg

SEQ ID NO: 654499 - DNA, 25 bp, Rattus norvegicus
gattgacaggctgccagtgccactc

SEQ ID NO: 654500 - DNA, 25 bp, Rattus norvegicus
ctatggtaacccgaagtcagggcta

SEQ ID NO: 654501 - DNA, 25 bp, Rattus norvegicus
agtcttctctcattgggctttgcgc

SEQ ID NO: 654502 - DNA, 25 bp, Rattus norvegicus
gcgtaggggagtcaggacctccctc

SEQ ID NO: 654503 - DNA, 25 bp, Rattus norvegicus
ccagggcttctcgttcctggctctg

SEQ ID NO: 654504 - DNA, 25 bp, Rattus norvegicus
ccagccaaaggcgtcttgccgatca

SEQ ID NO: 654505 - DNA, 25 bp, Rattus norvegicus
caaaggcgtcttgccgatcagggac

SEQ ID NO: 654506 - DNA, 25 bp, Rattus norvegicus
tcttgccgatcagggacttccggta

SEQ ID NO: 654507 - DNA, 25 bp, Rattus norvegicus
ccgatcagggacttccggtacgccg

SEQ ID NO: 654508 - DNA, 25 bp, Rattus norvegicus
tctgggtaacagggttgctgttgcc

SEQ ID NO: 654509 - DNA, 25 bp, Rattus norvegicus
tccctcagggacgtgtcctgggcga

SEQ ID NO: 654510 - DNA, 25 bp, Rattus norvegicus
cggcctgtagtgctggaagcagctt

SEQ ID NO: 654511 - DNA, 25 bp, Rattus norvegicus
gcctgtagtgctggaagcagcttca

SEQ ID NO: 654512 - DNA, 25 bp, Rattus norvegicus
aagcagcttcaggtaaaggttgccc

SEQ ID NO: 654513 - DNA, 25 bp, Rattus norvegicus
tcctcgctgtccagcggcgcccgtt

SEQ ID NO: 654514 - DNA, 25 bp, Rattus norvegicus
cttctcgttcctggctctggggctt

SEQ ID NO: 654515 - DNA, 25 bp, Rattus norvegicus
tcaggacctccctcagggacgtgtc

SEQ ID NO: 654516 - DNA, 25 bp, Rattus norvegicus
tcagcctgcaggacaattcactatc

SEQ ID NO: 654517 - DNA, 25 bp, Rattus norvegicus
gccggcctctttccttgccagttta

SEQ ID NO: 654518 - DNA, 25 bp, Rattus norvegicus
cgccttcaaacagtgcacgcagtca

SEQ ID NO: 654519 - DNA, 25 bp, Rattus norvegicus
ctactgacagactttccggacaacg

SEQ ID NO: 654520 - DNA, 25 bp, Rattus norvegicus
gtgtcccgcagaaactgagaccctg

SEQ ID NO: 654521 - DNA, 25 bp, Rattus norvegicus
tgttgccactgctgccatctgacgc

SEQ ID NO: 654522 - DNA, 25 bp, Rattus norvegicus
gtcccacttcaggtgagccatctgg

SEQ ID NO: 654523 - DNA, 25 bp, Rattus norvegicus
attgggctcggtactcactgcttgt

SEQ ID NO: 654524 - DNA, 25 bp, Rattus norvegicus
tgctgaatagcttgcctgccctcga

SEQ ID NO: 654525 - DNA, 25 bp, Rattus norvegicus
ggaaactctgtctcctggcaccttc

SEQ ID NO: 654526 - DNA, 25 bp, Rattus norvegicus
tggacctgagctccaaccagctgga

SEQ ID NO: 654527 - DNA, 25 bp, Rattus norvegicus
cgctcactgctgctggatcgcaatc

SEQ ID NO: 654528 - DNA, 25 bp, Rattus norvegicus
ctatacctagtcctgcgggagaacc

SEQ ID NO: 654529 - DNA, 25 bp, Rattus norvegicus
gcccgctttgcacctggctgcgtaa

SEQ ID NO: 654530 - DNA, 25 bp, Rattus norvegicus
tgcgggaaccaaagaggcagctcca

SEQ ID NO: 654531 - DNA, 25 bp, Rattus norvegicus
aggaacagccaggaccgaaccgcga

SEQ ID NO: 654532 - DNA, 25 bp, Rattus norvegicus
gatggggaccctgactccgacacac

SEQ ID NO: 654533 - DNA, 25 bp, Rattus norvegicus
caagctttctgccaagctggcacga

SEQ ID NO: 654534 - DNA, 25 bp, Rattus norvegicus
acggacacattcctcgcggggactg

SEQ ID NO: 654535 - DNA, 25 bp, Rattus norvegicus
ggaggcacaactgcagccctgtggc

SEQ ID NO: 654536 - DNA, 25 bp, Rattus norvegicus
cggactcagacgatagggatagcca

SEQ ID NO: 654537 - DNA, 25 bp, Rattus norvegicus
aactgactcgaggtgttggcggact

SEQ ID NO: 654538 - DNA, 25 bp, Rattus norvegicus
tggcagacctggtcgcaaccctggt

SEQ ID NO: 654539 - DNA, 25 bp, Rattus norvegicus
gcctttaacaccacggccctggaga

SEQ ID NO: 654540 - DNA, 25 bp, Rattus norvegicus
gtgccgcgcatatgcgcccaggata

SEQ ID NO: 654541 - DNA, 25 bp, Rattus norvegicus
ctcggcgcgggaacaaagaaagcac

SEQ ID NO: 654542 - DNA, 25 bp, Rattus norvegicus
gagaccttagcccttacagatgacg

SEQ ID NO: 654543 - DNA, 25 bp, Rattus norvegicus
cggcccagactaactcgcaagcttt

SEQ ID NO: 654544 - DNA, 25 bp, Rattus norvegicus
agcagaagaaggatcggccagcgca

SEQ ID NO: 654545 - DNA, 25 bp, Rattus norvegicus
gtcgttgcgctcaacacggcagcga

SEQ ID NO: 654546 - DNA, 25 bp, Rattus norvegicus
cagaagaaggatcggccagcgcatg

SEQ ID NO: 654547 - DNA, 25 bp, Rattus norvegicus
acacgcgcgtgggtgacacgagggc

SEQ ID NO: 654548 - DNA, 25 bp, Rattus norvegicus
tgacacgagggccctacgggtgctc

SEQ ID NO: 654549 - DNA, 25 bp, Rattus norvegicus
cctacgggtgctcgggaggtctcga

SEQ ID NO: 654550 - DNA, 25 bp, Rattus norvegicus
gaggtctcgagtgggctgcacagga

SEQ ID NO: 654551 - DNA, 25 bp, Rattus norvegicus
cacggacggcctgggtcccacggct

SEQ ID NO: 654552 - DNA, 25 bp, Rattus norvegicus
acggcttcccacctgctcatttcca

SEQ ID NO: 654553 - DNA, 25 bp, Rattus norvegicus
ggcagatgcgtcgttgcgctcaaca

SEQ ID NO: 654554 - DNA, 25 bp, Rattus norvegicus
ccacctggcacgggagcagaagaag

SEQ ID NO: 654555 - DNA, 25 bp, Rattus norvegicus
agatgcgtcgttgcgctcaacacgg

SEQ ID NO: 654556 - DNA, 25 bp, Rattus norvegicus
tgctcatttccatcaggcccacctg

SEQ ID NO: 654557 - DNA, 25 bp, Rattus norvegicus
caacacggcagcgaacacgcgcgtg

SEQ ID NO: 654558 - DNA, 25 bp, Rattus norvegicus
gtcctcgccggacggccactcagcc

SEQ ID NO: 654559 - DNA, 25 bp, Rattus norvegicus
gtcgccctcgctgcgaactgccacc

SEQ ID NO: 654560 - DNA, 25 bp, Rattus norvegicus
ggacgcgcactcaccggtgaggtca

SEQ ID NO: 654561 - DNA, 25 bp, Rattus norvegicus
cctttgcgggtgcacgacgtcgcca

SEQ ID NO: 654562 - DNA, 25 bp, Rattus norvegicus
gaaccgccttgctgggacctgtccg

SEQ ID NO: 654563 - DNA, 25 bp, Rattus norvegicus
gatcgccagtcggtttctctgcctc

SEQ ID NO: 654564 - DNA, 25 bp, Rattus norvegicus
cactcagcctcggagccgtcgccct

SEQ ID NO: 654565 - DNA, 25 bp, Rattus norvegicus
cactcaccggtgaggtcatgcggag

SEQ ID NO: 654566 - DNA, 25 bp, Rattus norvegicus
cgcttcccacccgagcgtcgcccgg

SEQ ID NO: 654567 - DNA, 25 bp, Rattus norvegicus
cccacagaggcgacccgcgccactg

SEQ ID NO: 654568 - DNA, 25 bp, Rattus norvegicus
ctccgggactcggttgcccacctgt

SEQ ID NO: 654569 - DNA, 25 bp, Rattus norvegicus
caagccattccgtccgctccgggcc

SEQ ID NO: 654570 - DNA, 25 bp, Rattus norvegicus
cggcacgtccctggcgacgctccca

SEQ ID NO: 654571 - DNA, 25 bp, Rattus norvegicus
gtcgcgaaccgccttgctgggacct

SEQ ID NO: 654572 - DNA, 25 bp, Rattus norvegicus
aaaatgacagctcgagccctctggc

SEQ ID NO: 654573 - DNA, 25 bp, Rattus norvegicus
tcccggtctgcgtgcgtgccagaga

SEQ ID NO: 654574 - DNA, 25 bp, Rattus norvegicus
ccctcggaaagagggcgagatcacc

SEQ ID NO: 654575 - DNA, 25 bp, Rattus norvegicus
accgccgctccgttttgtttcaatg

SEQ ID NO: 654576 - DNA, 25 bp, Rattus norvegicus
tttcaatggtctgtgcagccagcga

SEQ ID NO: 654577 - DNA, 25 bp, Rattus norvegicus
cgagccaaagccctcgctgcgtttt

SEQ ID NO: 654578 - DNA, 25 bp, Rattus norvegicus
tcgctgcgttttctagcccggggaa

SEQ ID NO: 654579 - DNA, 25 bp, Rattus norvegicus
tctagcccggggaaccctgtctaca

SEQ ID NO: 654580 - DNA, 25 bp, Rattus norvegicus
agccctctggcttctctgtttgatc

SEQ ID NO: 654581 - DNA, 25 bp, Rattus norvegicus
gcggaaagaaaaggtgaggtcatta

SEQ ID NO: 654582 - DNA, 25 bp, Rattus norvegicus
gtgaggtcattaaaatgcagcgccc

SEQ ID NO: 654583 - DNA, 25 bp, Rattus norvegicus
gggacaagccaagggtcagagcctc

SEQ ID NO: 654584 - DNA, 25 bp, Rattus norvegicus
ctctgtttgatcgtcggatggtccc

SEQ ID NO: 654585 - DNA, 25 bp, Rattus norvegicus
agagcctccgggacaggcgagtccc

SEQ ID NO: 654586 - DNA, 25 bp, Rattus norvegicus
tggcgaaccccggatcctcagttga

SEQ ID NO: 654587 - DNA, 25 bp, Rattus norvegicus
ccgctgcgggtagcactcggacttg

SEQ ID NO: 654588 - DNA, 25 bp, Rattus norvegicus
tgcgggtagcactcggacttggcct

SEQ ID NO: 654589 - DNA, 25 bp, Rattus norvegicus
acttgagcgcgcgtgtcagccttcc

SEQ ID NO: 654590 - DNA, 25 bp, Rattus norvegicus
ctgtgggctgccaggacattgcttt

SEQ ID NO: 654591 - DNA, 25 bp, Rattus norvegicus
ggaccaaacttgagcgcgcgtgtca

SEQ ID NO: 654592 - DNA, 25 bp, Rattus norvegicus
gctctctgtgggctgccaggacatt

SEQ ID NO: 654593 - DNA, 25 bp, Rattus norvegicus
acattgctttgttctgtccggcgga

SEQ ID NO: 654594 - DNA, 25 bp, Rattus norvegicus
tgctttgttctgtccggcggaaacg

SEQ ID NO: 654595 - DNA, 25 bp, Rattus norvegicus
ttctgtccggcggaaacggagcagc

SEQ ID NO: 654596 - DNA, 25 bp, Rattus norvegicus
agcagcgcgcaagttggggaccaaa

SEQ ID NO: 654597 - DNA, 25 bp, Rattus norvegicus
agcgcgcaagttggggaccaaactt

SEQ ID NO: 654598 - DNA, 25 bp, Rattus norvegicus
ttggggaccaaacttgagcgcgcgt

SEQ ID NO: 654599 - DNA, 25 bp, Rattus norvegicus
atcctcagttgaggtgggtgagcaa

SEQ ID NO: 654600 - DNA, 25 bp, Rattus norvegicus
ggcgatgcggccaagaaccaactca

SEQ ID NO: 654601 - DNA, 25 bp, Rattus norvegicus
cacttggccttttgcgggtttgaga

SEQ ID NO: 654602 - DNA, 25 bp, Rattus norvegicus
ccgtgcagcaggacatcaagttctt

SEQ ID NO: 654603 - DNA, 25 bp, Rattus norvegicus
gcggccgttaagaatgaccagtagc

SEQ ID NO: 654604 - DNA, 25 bp, Rattus norvegicus
cggcctccaacgagtagcgagttca

SEQ ID NO: 654605 - DNA, 25 bp, Rattus norvegicus
gcgctcgatactggctgtgactaca

SEQ ID NO: 654606 - DNA, 25 bp, Rattus norvegicus
ccctgattttggttcgtggctcctc

SEQ ID NO: 654607 - DNA, 25 bp, Rattus norvegicus
tgtcgccctcagatcagaaccgtcg

SEQ ID NO: 654608 - DNA, 25 bp, Rattus norvegicus
cagcctgttgctggactctgtgaga

SEQ ID NO: 654609 - DNA, 25 bp, Rattus norvegicus
ttggcatcgacttggggaccaccta

SEQ ID NO: 654610 - DNA, 25 bp, Rattus norvegicus
ctattcctggtaagtggcaatcgtc

SEQ ID NO: 654611 - DNA, 25 bp, Rattus norvegicus
agggcaaccgcatcacaccgtcgta

SEQ ID NO: 654612 - DNA, 25 bp, Rattus norvegicus
cgcctcatcggacgcacttggaatg

SEQ ID NO: 654613 - DNA, 25 bp, Rattus norvegicus
gggttttcccatcagcgtcggtgta

SEQ ID NO: 654614 - DNA, 25 bp, Rattus norvegicus
agtgcaagtaccttctcgtgaacaa

SEQ ID NO: 654615 - DNA, 25 bp, Rattus norvegicus
cttaagttcctgagaggtgggaagc

SEQ ID NO: 654616 - DNA, 25 bp, Rattus norvegicus
ggcccgtgtgtgcttaagttcctga

SEQ ID NO: 654617 - DNA, 25 bp, Rattus norvegicus
agcccagcggctagggtagtgctcc

SEQ ID NO: 654618 - DNA, 25 bp, Rattus norvegicus
ctcgtgaacaacctgaaggtgagcc

SEQ ID NO: 654619 - DNA, 25 bp, Rattus norvegicus
gccacagtcttttcttcctaaaatg

SEQ ID NO: 654620 - DNA, 25 bp, Rattus norvegicus
agcatgattccagcttcggcctccg

SEQ ID NO: 654621 - DNA, 25 bp, Rattus norvegicus
cggacgtgacgtaagcatgattcca

SEQ ID NO: 654622 - DNA, 25 bp, Rattus norvegicus
aacgtcattgcgcagacgccactca

SEQ ID NO: 654623 - DNA, 25 bp, Rattus norvegicus
agagggtcaggctttaacgtcattg

SEQ ID NO: 654624 - DNA, 25 bp, Rattus norvegicus
agttccgcccgacaggacgcgaggc

SEQ ID NO: 654625 - DNA, 25 bp, Rattus norvegicus
cctagcagcatcaccgccgggttgt

SEQ ID NO: 654626 - DNA, 25 bp, Rattus norvegicus
cccagttacgggtcctagcagcatc

SEQ ID NO: 654627 - DNA, 25 bp, Rattus norvegicus
gtgaggctccctacgggcgcccgat

SEQ ID NO: 654628 - DNA, 25 bp, Rattus norvegicus
ggcgcaggggatccctgcccagtcc

SEQ ID NO: 654629 - DNA, 25 bp, Rattus norvegicus
tcctggcgcccagcgtcgggcggaa

SEQ ID NO: 654630 - DNA, 25 bp, Rattus norvegicus
aatcgcaaatacagacctggacctg

SEQ ID NO: 654631 - DNA, 25 bp, Rattus norvegicus
ccggccaatcgcaaatacagacctg

SEQ ID NO: 654632 - DNA, 25 bp, Rattus norvegicus
cagcctcacaggggagcggcttccg

SEQ ID NO: 654633 - DNA, 25 bp, Rattus norvegicus
ggcttccggtgctgctacgtcatct

SEQ ID NO: 654634 - DNA, 25 bp, Rattus norvegicus
cgcctgcggggaaagggagaagaca

SEQ ID NO: 654635 - DNA, 25 bp, Rattus norvegicus
ggctcacaccgactaggcgcgctcg

SEQ ID NO: 654636 - DNA, 25 bp, Rattus norvegicus
ttccgcgcggcactgacctgagcga

SEQ ID NO: 654637 - DNA, 25 bp, Rattus norvegicus
agctcgttcgtgactcccttggtcc

SEQ ID NO: 654638 - DNA, 25 bp, Rattus norvegicus
agtcgctcagctcgttcgtgactcc

SEQ ID NO: 654639 - DNA, 25 bp, Rattus norvegicus
gtgctgctacgtcatctccgcgcgt

SEQ ID NO: 654640 - DNA, 25 bp, Rattus norvegicus
ggaagcagcactacttccggctcct

SEQ ID NO: 654641 - DNA, 25 bp, Rattus norvegicus
cggcccggccaatcgcaaatacaga

SEQ ID NO: 654642 - DNA, 25 bp, Rattus norvegicus
ttccaggttcctagagcgcgtcccg

SEQ ID NO: 654643 - DNA, 25 bp, Rattus norvegicus
ctgggaatcaagaggcctgtacatg

SEQ ID NO: 654644 - DNA, 25 bp, Rattus norvegicus
ccgataacttggacgtggggcaccg

SEQ ID NO: 654645 - DNA, 25 bp, Rattus norvegicus
tccaggtgggcgtcaacatgatccc

SEQ ID NO: 654646 - DNA, 25 bp, Rattus norvegicus
tgagtgaacccgaaacccagtccag

SEQ ID NO: 654647 - DNA, 25 bp, Rattus norvegicus
atgctctcttcgaaggcctccgtgg

SEQ ID NO: 654648 - DNA, 25 bp, Rattus norvegicus
tgatgatgagtacgccctgggaatc

SEQ ID NO: 654649 - DNA, 25 bp, Rattus norvegicus
cggccgggataactgatgatgagta

SEQ ID NO: 654650 - DNA, 25 bp, Rattus norvegicus
ccgaggtcttgcagttgccaggctt

SEQ ID NO: 654651 - DNA, 25 bp, Rattus norvegicus
ccctttgctttgaggaccgaggtct

SEQ ID NO: 654652 - DNA, 25 bp, Rattus norvegicus
tctcgcgagatccttgctcagagcg

SEQ ID NO: 654653 - DNA, 25 bp, Rattus norvegicus
tgagagagcgtagcctcccaacaga

SEQ ID NO: 654654 - DNA, 25 bp, Rattus norvegicus
cctcccgcaggagtgatacagcctg

SEQ ID NO: 654655 - DNA, 25 bp, Rattus norvegicus
acagatctgccaaagtctcgcgaga

SEQ ID NO: 654656 - DNA, 25 bp, Rattus norvegicus
cccactagctccgtgctggaggcgt

SEQ ID NO: 654657 - DNA, 25 bp, Rattus norvegicus
ggaggtatcccagcgtctccgcatc

SEQ ID NO: 654658 - DNA, 25 bp, Rattus norvegicus
aagagtttcggggtgtgtcactgtc

SEQ ID NO: 654659 - DNA, 25 bp, Rattus norvegicus
ggttgccgctaagaggaagagtttc

SEQ ID NO: 654660 - DNA, 25 bp, Rattus norvegicus
cttggaaggatgaggttgccgctaa

SEQ ID NO: 654661 - DNA, 25 bp, Rattus norvegicus
cgtccttcggcgtctggaccaagca

SEQ ID NO: 654662 - DNA, 25 bp, Rattus norvegicus
ccttggctgttccttccggtgctga

SEQ ID NO: 654663 - DNA, 25 bp, Rattus norvegicus
caaaatggctgcgatgccgccggtc

SEQ ID NO: 654664 - DNA, 25 bp, Rattus norvegicus
ccggcacaacacaacaaaatggctg

SEQ ID NO: 654665 - DNA, 25 bp, Rattus norvegicus
tcggcaaccggcacaacacaacaaa

SEQ ID NO: 654666 - DNA, 25 bp, Rattus norvegicus
ctggaggcgtggtgagaacaaaccc

SEQ ID NO: 654667 - DNA, 25 bp, Rattus norvegicus
cgcacccaaagctgagcgcgcaagg

SEQ ID NO: 654668 - DNA, 25 bp, Rattus norvegicus
ggaaacctcgcacccaaagctgagc

SEQ ID NO: 654669 - DNA, 25 bp, Rattus norvegicus
aagcgggacctctcggcaaccggca

SEQ ID NO: 654670 - DNA, 25 bp, Rattus norvegicus
cccacgcgcgagcatcgcgggagaa

SEQ ID NO: 654671 - DNA, 25 bp, Rattus norvegicus
ctttggctttcttctaggcgaccta

SEQ ID NO: 654672 - DNA, 25 bp, Rattus norvegicus
tcgccaggaaccagctgagcacaca

SEQ ID NO: 654673 - DNA, 25 bp, Rattus norvegicus
tccgaggtcggatgaacctggagct

SEQ ID NO: 654674 - DNA, 25 bp, Rattus norvegicus
ggagtggttctaccgccacgcctag

SEQ ID NO: 654675 - DNA, 25 bp, Rattus norvegicus
ttctaggcgacctaggactgcggcc

SEQ ID NO: 654676 - DNA, 25 bp, Rattus norvegicus
aggtgctcgctcaactttggctttc

SEQ ID NO: 654677 - DNA, 25 bp, Rattus norvegicus
gagaaaggaggtgctcgctcaactt

SEQ ID NO: 654678 - DNA, 25 bp, Rattus norvegicus
cggatgaacctggagctcggcccac

SEQ ID NO: 654679 - DNA, 25 bp, Rattus norvegicus
ctcccgtggccatccgaggtcggat

SEQ ID NO: 654680 - DNA, 25 bp, Rattus norvegicus
taggccgagctgaatttcctcttcc

SEQ ID NO: 654681 - DNA, 25 bp, Rattus norvegicus
gtcgtaggccgagctgaatttcctc

SEQ ID NO: 654682 - DNA, 25 bp, Rattus norvegicus
ccgctccgccacagcaggtagggag

SEQ ID NO: 654683 - DNA, 25 bp, Rattus norvegicus
agcgaagaggagtggttctaccgcc

SEQ ID NO: 654684 - DNA, 25 bp, Rattus norvegicus
tggctccgtattgctcctcgctgcg

SEQ ID NO: 654685 - DNA, 25 bp, Rattus norvegicus
cccaaagtcgggtgtctgagacgcg

SEQ ID NO: 654686 - DNA, 25 bp, Rattus norvegicus
atgcagccaccgcatcgcggggcag

SEQ ID NO: 654687 - DNA, 25 bp, Rattus norvegicus
cactgtcgccgtcccatgcagccac

SEQ ID NO: 654688 - DNA, 25 bp, Rattus norvegicus
gctgtgcgcactgtcgccgtcccat

SEQ ID NO: 654689 - DNA, 25 bp, Rattus norvegicus
tgcgctgctcgtcctggcgctgtgc

SEQ ID NO: 654690 - DNA, 25 bp, Rattus norvegicus
gtattgctcctcgctgcgctctgcg

SEQ ID NO: 654691 - DNA, 25 bp, Rattus norvegicus
catggctccgtattgctcctcgctg

SEQ ID NO: 654692 - DNA, 25 bp, Rattus norvegicus
gtcaccatggctccgtattgctcct

SEQ ID NO: 654693 - DNA, 25 bp, Rattus norvegicus
tcaccgtcaccatggctccgtattg

SEQ ID NO: 654694 - DNA, 25 bp, Rattus norvegicus
agtctgggtcctcaccgtcaccatg

SEQ ID NO: 654695 - DNA, 25 bp, Rattus norvegicus
cagctagggcgggatgggaccgccg

SEQ ID NO: 654696 - DNA, 25 bp, Rattus norvegicus
cccagcgggccgcaaggccctccct

SEQ ID NO: 654697 - DNA, 25 bp, Rattus norvegicus
tctgcgctgctcgtcctggcgctgt

SEQ ID NO: 654698 - DNA, 25 bp, Rattus norvegicus
tggttttgcaaagcgccgcgtccac

SEQ ID NO: 654699 - DNA, 25 bp, Rattus norvegicus
gaggctgggagtgctcctcccccga

SEQ ID NO: 654700 - DNA, 25 bp, Rattus norvegicus
ggccgctgtcccgtgcgtctgtctg

SEQ ID NO: 654701 - DNA, 25 bp, Rattus norvegicus
ggcggggcgtctcagctctccctat

SEQ ID NO: 654702 - DNA, 25 bp, Rattus norvegicus
gggcgtctcagctctccctatgacg

SEQ ID NO: 654703 - DNA, 25 bp, Rattus norvegicus
cgtctcagctctccctatgacggga

SEQ ID NO: 654704 - DNA, 25 bp, Rattus norvegicus
cagctctccctatgacgggaacaca

SEQ ID NO: 654705 - DNA, 25 bp, Rattus norvegicus
ctctccctatgacgggaacacagct

SEQ ID NO: 654706 - DNA, 25 bp, Rattus norvegicus
agctggccctcctccctctcaatag

SEQ ID NO: 654707 - DNA, 25 bp, Rattus norvegicus
tctcaatagcgcgtcgcggcagcac

SEQ ID NO: 654708 - DNA, 25 bp, Rattus norvegicus
tcaatagcgcgtcgcggcagcactg

SEQ ID NO: 654709 - DNA, 25 bp, Rattus norvegicus
cgtcgcggcagcactgtgtcttttt

SEQ ID NO: 654710 - DNA, 25 bp, Rattus norvegicus
gcggcagcactgtgtctttttggtt

SEQ ID NO: 654711 - DNA, 25 bp, Rattus norvegicus
tttggttttgcaaagcgccgcgtcc

SEQ ID NO: 654712 - DNA, 25 bp, Rattus norvegicus
cccggaatggaggagaagacacgcc

SEQ ID NO: 654713 - DNA, 25 bp, Rattus norvegicus
cagggtgcccggcaatggatacacg

SEQ ID NO: 654714 - DNA, 25 bp, Rattus norvegicus
tcttggctgccatgcaggttgcacc

SEQ ID NO: 654715 - DNA, 25 bp, Rattus norvegicus
tctatgagcccgagaacccaggagt

SEQ ID NO: 654716 - DNA, 25 bp, Rattus norvegicus
acggccctgcgaagagcacccagag

SEQ ID NO: 654717 - DNA, 25 bp, Rattus norvegicus
cgtgcacagcccgagataaagaaga

SEQ ID NO: 654718 - DNA, 25 bp, Rattus norvegicus
cacgcctttcggaaccttgcggtct

SEQ ID NO: 654719 - DNA, 25 bp, Rattus norvegicus
ctccggggttctcaccacaggcggt

SEQ ID NO: 654720 - DNA, 25 bp, Rattus norvegicus
ccggactggcgtttgtcagacatac

SEQ ID NO: 654721 - DNA, 25 bp, Rattus norvegicus
ttgtcagacatactgctggagtcgg

SEQ ID NO: 654722 - DNA, 25 bp, Rattus norvegicus
gagtcgctcttgacggcgtcagtcc

SEQ ID NO: 654723 - DNA, 25 bp, Rattus norvegicus
gccagagctttactgaaagccgtta

SEQ ID NO: 654724 - DNA, 25 bp, Rattus norvegicus
agctgacggcctgtccaataggtgc

SEQ ID NO: 654725 - DNA, 25 bp, Rattus norvegicus
tggcgataggcacctggcatctgaa

SEQ ID NO: 654726 - DNA, 25 bp, Rattus norvegicus
ctggccaggccctgtcgctgcaagt

SEQ ID NO: 654727 - DNA, 25 bp, Rattus norvegicus
gcgtcatccagtgtaccgagaggga

SEQ ID NO: 654728 - DNA, 25 bp, Rattus norvegicus
ctacggcaacgtgctggttctggat

SEQ ID NO: 654729 - DNA, 25 bp, Rattus norvegicus
cctacggcaacgtgctggttctgga

SEQ ID NO: 654730 - DNA, 25 bp, Rattus norvegicus
aacctacggcaacgtgctggttctg

SEQ ID NO: 654731 - DNA, 25 bp, Rattus norvegicus
cagtaaaacctacggcaacgtgctg

SEQ ID NO: 654732 - DNA, 25 bp, Rattus norvegicus
ccgcagtaaaacctacggcaacgtg

SEQ ID NO: 654733 - DNA, 25 bp, Rattus norvegicus
accaagacatcctcgtcttccgcag

SEQ ID NO: 654734 - DNA, 25 bp, Rattus norvegicus
gcggtaccaagacatcctcgtcttc

SEQ ID NO: 654735 - DNA, 25 bp, Rattus norvegicus
tcgcggtaccaagacatcctcgtct

SEQ ID NO: 654736 - DNA, 25 bp, Rattus norvegicus
gctcgcggtaccaagacatcctcgt

SEQ ID NO: 654737 - DNA, 25 bp, Rattus norvegicus
ggcgctcgcggtaccaagacatcct

SEQ ID NO: 654738 - DNA, 25 bp, Rattus norvegicus
caggccctgtcgctgcaagtggagc

SEQ ID NO: 654739 - DNA, 25 bp, Rattus norvegicus
gtcatccagtgtaccgagagggacg

SEQ ID NO: 654740 - DNA, 25 bp, Rattus norvegicus
aatttagtgcgactcagggacggcc

SEQ ID NO: 654741 - DNA, 25 bp, Rattus norvegicus
tagctctggcctctcctgagtgtcc

SEQ ID NO: 654742 - DNA, 25 bp, Rattus norvegicus
ttagcccagtggtgctgggacatgc

SEQ ID NO: 654743 - DNA, 25 bp, Rattus norvegicus
ctgctttccgctgagacgtccctag

SEQ ID NO: 654744 - DNA, 25 bp, Rattus norvegicus
tcacggctgccggaactgctttccg

SEQ ID NO: 654745 - DNA, 25 bp, Rattus norvegicus
agaggcgctccgtagctccaggctt

SEQ ID NO: 654746 - DNA, 25 bp, Rattus norvegicus
ccttggaagcctgcgcccgacagga

SEQ ID NO: 654747 - DNA, 25 bp, Rattus norvegicus
agtccagttcctgagtcccgcgggg

SEQ ID NO: 654748 - DNA, 25 bp, Rattus norvegicus
ccagtagtctggaccttagcccagt

SEQ ID NO: 654749 - DNA, 25 bp, Rattus norvegicus
caccatgcctggtttggccagtctc

SEQ ID NO: 654750 - DNA, 25 bp, Rattus norvegicus
cgctgatcctgagagagagaccact

SEQ ID NO: 654751 - DNA, 25 bp, Rattus norvegicus
tcttccagaaggacgagagtcactg

SEQ ID NO: 654752 - DNA, 25 bp, Rattus norvegicus
gccgcagcccgtgcaatttagtgcg

SEQ ID NO: 654753 - DNA, 25 bp, Rattus norvegicus
agtcactgggcactacctccgaagg

SEQ ID NO: 654754 - DNA, 25 bp, Rattus norvegicus
cgccctgcgctgcaggagaccgggt

SEQ ID NO: 654755 - DNA, 25 bp, Rattus norvegicus
ctcggaccacggagtgggagtctag

SEQ ID NO: 654756 - DNA, 25 bp, Rattus norvegicus
ggaacccacctgatctgcagaacca

SEQ ID NO: 654757 - DNA, 25 bp, Rattus norvegicus
ggtggaacccacctgatctgcagaa

SEQ ID NO: 654758 - DNA, 25 bp, Rattus norvegicus
agacgcccggtggaacccacctgat

SEQ ID NO: 654759 - DNA, 25 bp, Rattus norvegicus
ttcggtgtcagacgcccggtggaac

SEQ ID NO: 654760 - DNA, 25 bp, Rattus norvegicus
ggctcctggcttcggtgtcagacgc

SEQ ID NO: 654761 - DNA, 25 bp, Rattus norvegicus
atctgcagaaccaggcccggcgtgt

SEQ ID NO: 654762 - DNA, 25 bp, Rattus norvegicus
ccggccggatgcacgtgtgatgcat

SEQ ID NO: 654763 - DNA, 25 bp, Rattus norvegicus
ccgcgatggggacaggaccacgcac

SEQ ID NO: 654764 - DNA, 25 bp, Rattus norvegicus
cgggcgagtggcgagctcggaccac

SEQ ID NO: 654765 - DNA, 25 bp, Rattus norvegicus
aggagaccgggtcgctgctccgcct

SEQ ID NO: 654766 - DNA, 25 bp, Rattus norvegicus
ctgatctgcagaaccaggcccggcg

SEQ ID NO: 654767 - DNA, 25 bp, Rattus norvegicus
cgctcccgctcacccacacctcctc

SEQ ID NO: 654768 - DNA, 25 bp, Rattus norvegicus
ccaaaagatcgcaaaagccttcgtc

SEQ ID NO: 654769 - DNA, 25 bp, Rattus norvegicus
gtcgattgaccaaacaggtgcgccc

SEQ ID NO: 654770 - DNA, 25 bp, Rattus norvegicus
ccaagcctgaagttggagatgctgc

SEQ ID NO: 654771 - DNA, 25 bp, Rattus norvegicus
ttctcagactctggtaccttgcctc

SEQ ID NO: 654772 - DNA, 25 bp, Rattus norvegicus
tccctgggctacagcaaggaaggca

SEQ ID NO: 654773 - DNA, 25 bp, Rattus norvegicus
ctggtctcaatgtttccatcgcgga

SEQ ID NO: 654774 - DNA, 25 bp, Rattus norvegicus
agctggacccgactgagcagagcca

SEQ ID NO: 654775 - DNA, 25 bp, Rattus norvegicus
tgtcaactcacctgccaaaagatcg

SEQ ID NO: 654776 - DNA, 25 bp, Rattus norvegicus
gggacaggagccaaacgaactcttg

SEQ ID NO: 654777 - DNA, 25 bp, Rattus norvegicus
caggcatccacaggtttcggggaca

SEQ ID NO: 654778 - DNA, 25 bp, Rattus norvegicus
gggacacactctgcagccgaggtaa

SEQ ID NO: 654779 - DNA, 25 bp, Rattus norvegicus
gcgtgctcaacgctggcgccacagg

SEQ ID NO: 654780 - DNA, 25 bp, Rattus norvegicus
ggggtgctatggtccttttctcaga

SEQ ID NO: 654781 - DNA, 25 bp, Rattus norvegicus
ctgtcatctttctgtccctgggcta

SEQ ID NO: 654782 - DNA, 25 bp, Rattus norvegicus
tggtctcgcctgctactgcaccaga

SEQ ID NO: 654783 - DNA, 25 bp, Rattus norvegicus
cagccaggggtaggcgccaccctga

SEQ ID NO: 654784 - DNA, 25 bp, Rattus norvegicus
gctaccaccgtatcaccagcggatg

SEQ ID NO: 654785 - DNA, 25 bp, Rattus norvegicus
atcaccagcggatgcttttgaggcg

SEQ ID NO: 654786 - DNA, 25 bp, Rattus norvegicus
cgggaggccatcctactactaccgg

SEQ ID NO: 654787 - DNA, 25 bp, Rattus norvegicus
aagagcaccgggaggccatcctact

SEQ ID NO: 654788 - DNA, 25 bp, Rattus norvegicus
ccgatggggcccgtgtgagcaccca

SEQ ID NO: 654789 - DNA, 25 bp, Rattus norvegicus
atcctactactaccggctgctgcgg

SEQ ID NO: 654790 - DNA, 25 bp, Rattus norvegicus
ttgtaggacagccttggtctcgcct

SEQ ID NO: 654791 - DNA, 25 bp, Rattus norvegicus
ggagttggagctactttgtaggaca

SEQ ID NO: 654792 - DNA, 25 bp, Rattus norvegicus
caggccaggattttgcccgcactga

SEQ ID NO: 654793 - DNA, 25 bp, Rattus norvegicus
cccgacgactccaggccaggatttt

SEQ ID NO: 654794 - DNA, 25 bp, Rattus norvegicus
gctgcagcgacagaggagccgctcc

SEQ ID NO: 654795 - DNA, 25 bp, Rattus norvegicus
cggcggcaacgccaggaagagcacc

SEQ ID NO: 654796 - DNA, 25 bp, Rattus norvegicus
ggcattttcggctgggttttgccca

SEQ ID NO: 654797 - DNA, 25 bp, Rattus norvegicus
accgccgccgcggacaatgagaggt

SEQ ID NO: 654798 - DNA, 25 bp, Rattus norvegicus
ggtgtccgatacaaaaggcattttc

SEQ ID NO: 654799 - DNA, 25 bp, Rattus norvegicus
ccgagtccctcggtgtccgatacaa

SEQ ID NO: 654800 - DNA, 25 bp, Rattus norvegicus
ttgtttcccgggctgtgcggtgcct

SEQ ID NO: 654801 - DNA, 25 bp, Rattus norvegicus
atgtggggtcctgcctcgtctggcc

SEQ ID NO: 654802 - DNA, 25 bp, Rattus norvegicus
gttttgcccagagccggtagcgctc

SEQ ID NO: 654803 - DNA, 25 bp, Rattus norvegicus
gggctgcagccttcgttgccttcac

SEQ ID NO: 654804 - DNA, 25 bp, Rattus norvegicus
gcaccaagagccagcccaaactgga

SEQ ID NO: 654805 - DNA, 25 bp, Rattus norvegicus
aagggctccatcaagcgcaccaaga

SEQ ID NO: 654806 - DNA, 25 bp, Rattus norvegicus
actcggctcagtgtcgccatggcaa

SEQ ID NO: 654807 - DNA, 25 bp, Rattus norvegicus
cggtcggagacactcggctcagtgt

SEQ ID NO: 654808 - DNA, 25 bp, Rattus norvegicus
gcatcctcggccacggtcggagaca

SEQ ID NO: 654809 - DNA, 25 bp, Rattus norvegicus
cggcaagtgccctcttgggcatgtg

SEQ ID NO: 654810 - DNA, 25 bp, Rattus norvegicus
aagtgcgagccttggagctgtccac

SEQ ID NO: 654811 - DNA, 25 bp, Rattus norvegicus
ggctgatcttcagcgcgtccaggga

SEQ ID NO: 654812 - DNA, 25 bp, Rattus norvegicus
ggcccggcaagggacaatcgcctgc

SEQ ID NO: 654813 - DNA, 25 bp, Rattus norvegicus
tgtccacggtgaccggccgcactga

SEQ ID NO: 654814 - DNA, 25 bp, Rattus norvegicus
cactgagtccgcgttccgccgatag

SEQ ID NO: 654815 - DNA, 25 bp, Rattus norvegicus
acgagatggctcagggcccgtgcca

SEQ ID NO: 654816 - DNA, 25 bp, Rattus norvegicus
cagccggcggacgacgcggacatct

SEQ ID NO: 654817 - DNA, 25 bp, Rattus norvegicus
ctcgaaggctgctgcgccacatgac

SEQ ID NO: 654818 - DNA, 25 bp, Rattus norvegicus
gccacatgacgctcagggccggtgc

SEQ ID NO: 654819 - DNA, 25 bp, Rattus norvegicus
gagcccgttgccatgatctctcagg

SEQ ID NO: 654820 - DNA, 25 bp, Rattus norvegicus
ccatgatctctcaggctccggttga

SEQ ID NO: 654821 - DNA, 25 bp, Rattus norvegicus
ctccggttgacagggatagtcgccg

SEQ ID NO: 654822 - DNA, 25 bp, Rattus norvegicus
tgaccaggcctgtcacagaggtggc

SEQ ID NO: 654823 - DNA, 25 bp, Rattus norvegicus
ggccgctgactcctgctcgaaggct

SEQ ID NO: 654824 - DNA, 25 bp, Rattus norvegicus
aacaattttgtttctcggcactcga

SEQ ID NO: 654825 - DNA, 25 bp, Rattus norvegicus
cctgggactaaatttggcgttgcct

SEQ ID NO: 654826 - DNA, 25 bp, Rattus norvegicus
atttggcgttgcctttgcagggctc

SEQ ID NO: 654827 - DNA, 25 bp, Rattus norvegicus
cgcccgttcatctccatgcaaagga

SEQ ID NO: 654828 - DNA, 25 bp, Rattus norvegicus
tccatgcaaaggagagacgaaatga

SEQ ID NO: 654829 - DNA, 25 bp, Rattus norvegicus
cgaaatgaatatgcagcgcgggctg

SEQ ID NO: 654830 - DNA, 25 bp, Rattus norvegicus
ccgccgcactataattttccaaaca

SEQ ID NO: 654831 - DNA, 25 bp, Rattus norvegicus
ttccaaacaggatcttgcaatcagg

SEQ ID NO: 654832 - DNA, 25 bp, Rattus norvegicus
gggccttattcattagcgcataaac

SEQ ID NO: 654833 - DNA, 25 bp, Rattus norvegicus
agtgcggaacctgggactaaatttg

SEQ ID NO: 654834 - DNA, 25 bp, Rattus norvegicus
cggcactcgagcctgtcaatcaagc

SEQ ID NO: 654835 - DNA, 25 bp, Rattus norvegicus
gtcaatcaagccgagagggaacatc

SEQ ID NO: 654836 - DNA, 25 bp, Rattus norvegicus
ccgagagggaacatcttggccgaag

SEQ ID NO: 654837 - DNA, 25 bp, Rattus norvegicus
ggatcttgcaatcagggccttattc

SEQ ID NO: 654838 - DNA, 25 bp, Rattus norvegicus
tgaccaggtgccctcggcagtgtcg

SEQ ID NO: 654839 - DNA, 25 bp, Rattus norvegicus
cggagcttacgccattccaggaagt

SEQ ID NO: 654840 - DNA, 25 bp, Rattus norvegicus
gtaccacccgattcataagaggaga

SEQ ID NO: 654841 - DNA, 25 bp, Rattus norvegicus
tggctttctcagactgcccaatacc

SEQ ID NO: 654842 - DNA, 25 bp, Rattus norvegicus
tctcggtgcgcacaagaatgtctgg

SEQ ID NO: 654843 - DNA, 25 bp, Rattus norvegicus
cagaggccggaaccgagtatggccc

SEQ ID NO: 654844 - DNA, 25 bp, Rattus norvegicus
gtatggcccgcctgacagctgcaat

SEQ ID NO: 654845 - DNA, 25 bp, Rattus norvegicus
attccaggaagtctactggggccgc

SEQ ID NO: 654846 - DNA, 25 bp, Rattus norvegicus
tttcagctcttccagagttggcagc

SEQ ID NO: 654847 - DNA, 25 bp, Rattus norvegicus
tccagagttggcagctccactatcc

SEQ ID NO: 654848 - DNA, 25 bp, Rattus norvegicus
gcagtgtcgcccgtctccttcaatt

SEQ ID NO: 654849 - DNA, 25 bp, Rattus norvegicus
ataccatctgcgcatgcgtctccgg

SEQ ID NO: 654850 - DNA, 25 bp, Rattus norvegicus
catgcgcactgttctggagccgctc

SEQ ID NO: 654851 - DNA, 25 bp, Rattus norvegicus
ccgctcggaaagacggagcttacgc

SEQ ID NO: 654852 - DNA, 25 bp, Rattus norvegicus
aattgctctgccgtgaaggacgtcc

SEQ ID NO: 654853 - DNA, 25 bp, Rattus norvegicus
gcgacgccagaatccgcatcactta

SEQ ID NO: 654854 - DNA, 25 bp, Rattus norvegicus
cttgcccggggtacctgcaattgct

SEQ ID NO: 654855 - DNA, 25 bp, Rattus norvegicus
gcacaaggggcggagtcacaaatcc

SEQ ID NO: 654856 - DNA, 25 bp, Rattus norvegicus
tccgcccaatcagaagctcagggtc

SEQ ID NO: 654857 - DNA, 25 bp, Rattus norvegicus
gcgaactgagcctgcataacctgta

SEQ ID NO: 654858 - DNA, 25 bp, Rattus norvegicus
aggcccgtcatgtccgctagcttct

SEQ ID NO: 654859 - DNA, 25 bp, Rattus norvegicus
ccacctggatgaccctgcgactgag

SEQ ID NO: 654860 - DNA, 25 bp, Rattus norvegicus
aaggatcaacccgtgccaactgagg

SEQ ID NO: 654861 - DNA, 25 bp, Rattus norvegicus
ctggaacgacagtctctgcactctc

SEQ ID NO: 654862 - DNA, 25 bp, Rattus norvegicus
tgacgcgctcggcagttttgaaacc

SEQ ID NO: 654863 - DNA, 25 bp, Rattus norvegicus
tctgggctgctgaacggagaatagt

SEQ ID NO: 654864 - DNA, 25 bp, Rattus norvegicus
ttactctcgatgtagccgtgcaagg

SEQ ID NO: 654865 - DNA, 25 bp, Rattus norvegicus
ctgactgtcctgttccgagggcact

SEQ ID NO: 654866 - DNA, 25 bp, Rattus norvegicus
ggcacgtacctggagctcgcaaaca

SEQ ID NO: 654867 - DNA, 25 bp, Rattus norvegicus
tggggccagaaagcacccagtggct

SEQ ID NO: 654868 - DNA, 25 bp, Rattus norvegicus
agcacccagtggctgaggcaccgca

SEQ ID NO: 654869 - DNA, 25 bp, Rattus norvegicus
cgtgcacgtccatgcatatatacct

SEQ ID NO: 654870 - DNA, 25 bp, Rattus norvegicus
tgcatatataccttgggtccgcgct

SEQ ID NO: 654871 - DNA, 25 bp, Rattus norvegicus
ggtccgcgcttgttgtcataggaca

SEQ ID NO: 654872 - DNA, 25 bp, Rattus norvegicus
cataggacagttggtcgaggttttc

SEQ ID NO: 654873 - DNA, 25 bp, Rattus norvegicus
cagttggtcgaggttttcatagttc

SEQ ID NO: 654874 - DNA, 25 bp, Rattus norvegicus
tttactctgatgaataatgtgcaca

SEQ ID NO: 654875 - DNA, 25 bp, Rattus norvegicus
tgcagacacagaagaagattataaa

SEQ ID NO: 654876 - DNA, 25 bp, Rattus norvegicus
tataaacggttgaaaatgacggcgc

SEQ ID NO: 654877 - DNA, 25 bp, Rattus norvegicus
tgacggcgctaaagcaatcacacca

SEQ ID NO: 654878 - DNA, 25 bp, Rattus norvegicus
gcacgtctgcagacgggcacgtacc

SEQ ID NO: 654879 - DNA, 25 bp, Rattus norvegicus
tggagctcgcaaacaccgagacccg

SEQ ID NO: 654880 - DNA, 25 bp, Rattus norvegicus
gatagctggcgcttgcaggaaaagc

SEQ ID NO: 654881 - DNA, 25 bp, Rattus norvegicus
ttctcggcggccctcttgaggttct

SEQ ID NO: 654882 - DNA, 25 bp, Rattus norvegicus
cgcacccagtcactggcatagattt

SEQ ID NO: 654883 - DNA, 25 bp, Rattus norvegicus
tcttgaggttctcgatcatggtgtc

SEQ ID NO: 654884 - DNA, 25 bp, Rattus norvegicus
tcatggtgtcgtaatggatgcggca

SEQ ID NO: 654885 - DNA, 25 bp, Rattus norvegicus
ggatgcggcaaagcaccttctcctc

SEQ ID NO: 654886 - DNA, 25 bp, Rattus norvegicus
cgcaccgggcacacttggttccaaa

SEQ ID NO: 654887 - DNA, 25 bp, Rattus norvegicus
ggccgaattcctcgcccgtggatag

SEQ ID NO: 654888 - DNA, 25 bp, Rattus norvegicus
aaaagcaagcgaagcaggccaggtg

SEQ ID NO: 654889 - DNA, 25 bp, Rattus norvegicus
catagatttgtctgccgcaccgggc

SEQ ID NO: 654890 - DNA, 25 bp, Rattus norvegicus
ctcctgttctatcgctcagggcgca

SEQ ID NO: 654891 - DNA, 25 bp, Rattus norvegicus
tagaccgggccgtctttcatctttc

SEQ ID NO: 654892 - DNA, 25 bp, Rattus norvegicus
gctgcgggacaaaaggaacggataa

SEQ ID NO: 654893 - DNA, 25 bp, Rattus norvegicus
ttggttccaaatcggctgcgggaca

SEQ ID NO: 654894 - DNA, 25 bp, Rattus norvegicus
cgcccagcagtggtaggcggtctct

SEQ ID NO: 654895 - DNA, 25 bp, Rattus norvegicus
ttgttccgtgagctccaagccgacg

SEQ ID NO: 654896 - DNA, 25 bp, Rattus norvegicus
ctcttgagaaggctgtggaagccct

SEQ ID NO: 654897 - DNA, 25 bp, Rattus norvegicus
ctggccaacaggctgcggagttaaa

SEQ ID NO: 654898 - DNA, 25 bp, Rattus norvegicus
gccactttcagttggtcggatggtc

SEQ ID NO: 654899 - DNA, 25 bp, Rattus norvegicus
ggtcgtgctgggatgtctttacatg

SEQ ID NO: 654900 - DNA, 25 bp, Rattus norvegicus
tgcgactttaaaatgttccagagga

SEQ ID NO: 654901 - DNA, 25 bp, Rattus norvegicus
ccagaggatgccgtaaaacaacaga

SEQ ID NO: 654902 - DNA, 25 bp, Rattus norvegicus
aggtgacatttacgtactacactta

SEQ ID NO: 654903 - DNA, 25 bp, Rattus norvegicus
actacacttaattatgcctggaaca

SEQ ID NO: 654904 - DNA, 25 bp, Rattus norvegicus
tggaacattgtcacctcaggggatg

SEQ ID NO: 654905 - DNA, 25 bp, Rattus norvegicus
tcaggggatggataccttaggctcc

SEQ ID NO: 654906 - DNA, 25 bp, Rattus norvegicus
gcgcacactccagggcgtctagtgg

SEQ ID NO: 654907 - DNA, 25 bp, Rattus norvegicus
cttaggctccttcattgttccgtga

SEQ ID NO: 654908 - DNA, 25 bp, Rattus norvegicus
cgaacggcaagtggcctaggcacga

SEQ ID NO: 654909 - DNA, 25 bp, Rattus norvegicus
cgcagcctacctgaagtagtccatc

SEQ ID NO: 654910 - DNA, 25 bp, Rattus norvegicus
ctaggcacgagtgtgcaaggccttc

SEQ ID NO: 654911 - DNA, 25 bp, Rattus norvegicus
ttgtgcactccgaacggcaagtggc

SEQ ID NO: 654912 - DNA, 25 bp, Rattus norvegicus
gaaccacggttgtgcactccgaacg

SEQ ID NO: 654913 - DNA, 25 bp, Rattus norvegicus
tgtgcaaggccttcatgctccagca

SEQ ID NO: 654914 - DNA, 25 bp, Rattus norvegicus
agggccgggccagtacgctgaacca

SEQ ID NO: 654915 - DNA, 25 bp, Rattus norvegicus
ccttctgtgtaagacgtgcagagta

SEQ ID NO: 654916 - DNA, 25 bp, Rattus norvegicus
actggggctcccttctgtgtaagac

SEQ ID NO: 654917 - DNA, 25 bp, Rattus norvegicus
ggaacccgaggcagatcgcctgcca

SEQ ID NO: 654918 - DNA, 25 bp, Rattus norvegicus
agaccgcaggaacccgaggcagatc

SEQ ID NO: 654919 - DNA, 25 bp, Rattus norvegicus
gccagggcccgtcagaccgcaggaa

SEQ ID NO: 654920 - DNA, 25 bp, Rattus norvegicus
gccagtacgctgaaccacggttgtg

SEQ ID NO: 654921 - DNA, 25 bp, Rattus norvegicus
atgctccagcacttgtgggcccgac

SEQ ID NO: 654922 - DNA, 25 bp, Rattus norvegicus
ggttcctttgcgcaccgactgacaa

SEQ ID NO: 654923 - DNA, 25 bp, Rattus norvegicus
ctgactgagcctgaaatcggagaga

SEQ ID NO: 654924 - DNA, 25 bp, Rattus norvegicus
actgagcctgaaatcggagagagga

SEQ ID NO: 654925 - DNA, 25 bp, Rattus norvegicus
caacgaaatgtacccgggatgtcac

SEQ ID NO: 654926 - DNA, 25 bp, Rattus norvegicus
gcgcaccgactgacaacgaaatgta

SEQ ID NO: 654927 - DNA, 25 bp, Rattus norvegicus
cagatttggttcctttgcgcaccga

SEQ ID NO: 654928 - DNA, 25 bp, Rattus norvegicus
ttgccgtaaagacagatttggttcc

SEQ ID NO: 654929 - DNA, 25 bp, Rattus norvegicus
ctcaagagttgttgccgtaaagaca

SEQ ID NO: 654930 - DNA, 25 bp, Rattus norvegicus
ctggtactcaagagttgttgccgta

SEQ ID NO: 654931 - DNA, 25 bp, Rattus norvegicus
cgcttagcctggtactcaagagttg

SEQ ID NO: 654932 - DNA, 25 bp, Rattus norvegicus
gaagcgcttagcctggtactcaaga

SEQ ID NO: 654933 - DNA, 25 bp, Rattus norvegicus
cagcgaagcgcttagcctggtactc

SEQ ID NO: 654934 - DNA, 25 bp, Rattus norvegicus
gagaggaacagcgaagcgcttagcc

SEQ ID NO: 654935 - DNA, 25 bp, Rattus norvegicus
cgactgacaacgaaatgtacccggg

SEQ ID NO: 654936 - DNA, 25 bp, Rattus norvegicus
cttccagtacatgggcccgggaact

SEQ ID NO: 654937 - DNA, 25 bp, Rattus norvegicus
ttgacaccgattcaaacgcctttgg

SEQ ID NO: 654938 - DNA, 25 bp, Rattus norvegicus
ttggaaggccagtccaaggaaagcc

SEQ ID NO: 654939 - DNA, 25 bp, Rattus norvegicus
tcggtgagtgaaatgaggccaaaaa

SEQ ID NO: 654940 - DNA, 25 bp, Rattus norvegicus
ctccagactcttggagcgcccggga

SEQ ID NO: 654941 - DNA, 25 bp, Rattus norvegicus
gatcctcagcgttgcgccggcacaa

SEQ ID NO: 654942 - DNA, 25 bp, Rattus norvegicus
aacctctggcgcattggcgctatca

SEQ ID NO: 654943 - DNA, 25 bp, Rattus norvegicus
cgctatcagcgcctattcagacgga

SEQ ID NO: 654944 - DNA, 25 bp, Rattus norvegicus
agacggacaatactggcctcgcctc

SEQ ID NO: 654945 - DNA, 25 bp, Rattus norvegicus
tcgcctcctcttgattcgcctatgt

SEQ ID NO: 654946 - DNA, 25 bp, Rattus norvegicus
cgcctatgtctttgctaaatcgctt

SEQ ID NO: 654947 - DNA, 25 bp, Rattus norvegicus
gcataatgtgttcccgctttccgcg

SEQ ID NO: 654948 - DNA, 25 bp, Rattus norvegicus
ggcgctctcatgcttccagtacatg

SEQ ID NO: 654949 - DNA, 25 bp, Rattus norvegicus
actcgcttgcttgctcacctggtcg

SEQ ID NO: 654950 - DNA, 25 bp, Rattus norvegicus
ctataatcccggctgtagctggtga

SEQ ID NO: 654951 - DNA, 25 bp, Rattus norvegicus
ctccgtgactggttctgcagagttc

SEQ ID NO: 654952 - DNA, 25 bp, Rattus norvegicus
tgagggcagtcttcgccaaggtccc

SEQ ID NO: 654953 - DNA, 25 bp, Rattus norvegicus
acttctatgctctcaagggtggggc

SEQ ID NO: 654954 - DNA, 25 bp, Rattus norvegicus
tgcagagttcggctcgaccttaaaa

SEQ ID NO: 654955 - DNA, 25 bp, Rattus norvegicus
gtgaggttacctctgccgaaacacc

SEQ ID NO: 654956 - DNA, 25 bp, Rattus norvegicus
ggggctaaggatacctccgtgactg

SEQ ID NO: 654957 - DNA, 25 bp, Rattus norvegicus
gtgacactttttctaggacctcgga

SEQ ID NO: 654958 - DNA, 25 bp, Rattus norvegicus
gggatccagataccggtgacacttt

SEQ ID NO: 654959 - DNA, 25 bp, Rattus norvegicus
gctctcaagaagtgggcgggatcca

SEQ ID NO: 654960 - DNA, 25 bp, Rattus norvegicus
gtcccgcgtgtgtttctctataatc

SEQ ID NO: 654961 - DNA, 25 bp, Rattus norvegicus
aaagcagcttccgacgctggggtcc

SEQ ID NO: 654962 - DNA, 25 bp, Rattus norvegicus
atggtgctgagcttcgggtactcac

SEQ ID NO: 654963 - DNA, 25 bp, Rattus norvegicus
aaccaggggcgggacttctatgctc

SEQ ID NO: 654964 - DNA, 25 bp, Rattus norvegicus
ggttgctttgtgcactgaggcctca

SEQ ID NO: 654965 - DNA, 25 bp, Rattus norvegicus
tggccaggcgcttggcacccacaga

SEQ ID NO: 654966 - DNA, 25 bp, Rattus norvegicus
ctgaggcctcagctgattgtggcca

SEQ ID NO: 654967 - DNA, 25 bp, Rattus norvegicus
tgcactgaggcctcagctgattgtg

SEQ ID NO: 654968 - DNA, 25 bp, Rattus norvegicus
ctttgtgcactgaggcctcagctga

SEQ ID NO: 654969 - DNA, 25 bp, Rattus norvegicus
ttgctttgtgcactgaggcctcagc

SEQ ID NO: 654970 - DNA, 25 bp, Rattus norvegicus
tgtcactgggttctttctgcgtgga

SEQ ID NO: 654971 - DNA, 25 bp, Rattus norvegicus
agccgctgtcactgggttctttctg

SEQ ID NO: 654972 - DNA, 25 bp, Rattus norvegicus
acgcagccgctgtcactgggttctt

SEQ ID NO: 654973 - DNA, 25 bp, Rattus norvegicus
cacagaccgcgaccgccagggttta

SEQ ID NO: 654974 - DNA, 25 bp, Rattus norvegicus
aggcctcagctgattgtggccaggc

SEQ ID NO: 654975 - DNA, 25 bp, Rattus norvegicus
ctcaagccgctcttcgcacgcagcc

SEQ ID NO: 654976 - DNA, 25 bp, Rattus norvegicus
ggcgcggaaacctcaagccgctctt

SEQ ID NO: 654977 - DNA, 25 bp, Rattus norvegicus
cgcacgcagccgctgtcactgggtt

SEQ ID NO: 654978 - DNA, 25 bp, Rattus norvegicus
gactgaggctcaggcgctgagacac

SEQ ID NO: 654979 - DNA, 25 bp, Rattus norvegicus
attgttccctggctgaggccggagg

SEQ ID NO: 654980 - DNA, 25 bp, Rattus norvegicus
aggaagccgcgcattgttccctggc

SEQ ID NO: 654981 - DNA, 25 bp, Rattus norvegicus
cctcccggattactcctgcgcgctg

SEQ ID NO: 654982 - DNA, 25 bp, Rattus norvegicus
agcatccaggcaataacctggcctc

SEQ ID NO: 654983 - DNA, 25 bp, Rattus norvegicus
tgagcatccaggcaataacctggcc

SEQ ID NO: 654984 - DNA, 25 bp, Rattus norvegicus
gcaccgcggatgcactgagcatcca

SEQ ID NO: 654985 - DNA, 25 bp, Rattus norvegicus
tggcaccgcggatgcactgagcatc

SEQ ID NO: 654986 - DNA, 25 bp, Rattus norvegicus
accagtgcctggcaccgcggatgca

SEQ ID NO: 654987 - DNA, 25 bp, Rattus norvegicus
gagtaggaccagtgcctggcaccgc

SEQ ID NO: 654988 - DNA, 25 bp, Rattus norvegicus
ctccacccggggagtaggaccagtg

SEQ ID NO: 654989 - DNA, 25 bp, Rattus norvegicus
gacacagcgctccacccggggagta

SEQ ID NO: 654990 - DNA, 25 bp, Rattus norvegicus
tcaggcgctgagacacagcgctcca

SEQ ID NO: 654991 - DNA, 25 bp, Rattus norvegicus
agaggagagctgtgtccgcctgcaa

SEQ ID NO: 654992 - DNA, 25 bp, Rattus norvegicus
gttctgtgaacgacctgcttctctc

SEQ ID NO: 654993 - DNA, 25 bp, Rattus norvegicus
agataaggcgcacatgtacggggac

SEQ ID NO: 654994 - DNA, 25 bp, Rattus norvegicus
ctgccgtggctgttctgtgaacgac

SEQ ID NO: 654995 - DNA, 25 bp, Rattus norvegicus
ccgtggctgttctgtgaacgacctg

SEQ ID NO: 654996 - DNA, 25 bp, Rattus norvegicus
tggctgttctgtgaacgacctgctt

SEQ ID NO: 654997 - DNA, 25 bp, Rattus norvegicus
ctgttctgtgaacgacctgcttctc

SEQ ID NO: 654998 - DNA, 25 bp, Rattus norvegicus
tctgtgaacgacctgcttctctcta

SEQ ID NO: 654999 - DNA, 25 bp, Rattus norvegicus
gaacgacctgcttctctctacgagc

SEQ ID NO: 655000 - DNA, 25 bp, Rattus norvegicus
gacctgcttctctctacgagcagtt

SEQ ID NO: 655001 - DNA, 25 bp, Rattus norvegicus
cttctctctacgagcagttcctttc

SEQ ID NO: 655002 - DNA, 25 bp, Rattus norvegicus
acgagcagttcctttcccaccaatg

SEQ ID NO: 655003 - DNA, 25 bp, Rattus norvegicus
accaatgcgcgctcgcgcctgcagt

SEQ ID NO: 655004 - DNA, 25 bp, Rattus norvegicus
gtgaacgacctgcttctctctacga

SEQ ID NO: 655005 - DNA, 25 bp, Rattus norvegicus
ctgcgcgcgagggactaaggctcac

SEQ ID NO: 655006 - DNA, 25 bp, Rattus norvegicus
tcccgtagtctccagaccgtccatg

SEQ ID NO: 655007 - DNA, 25 bp, Rattus norvegicus
gttcgcgcagctcaagccggtgctg

SEQ ID NO: 655008 - DNA, 25 bp, Rattus norvegicus
acgagccagtgttcgcgcagctcaa

SEQ ID NO: 655009 - DNA, 25 bp, Rattus norvegicus
ccgcgcaggacgagccagtgttcgc

SEQ ID NO: 655010 - DNA, 25 bp, Rattus norvegicus
accgtccatgcccacgcgggtgctg

SEQ ID NO: 655011 - DNA, 25 bp, Rattus norvegicus
ggcgaggtgggaatcgcgatcgccc

SEQ ID NO: 655012 - DNA, 25 bp, Rattus norvegicus
agtcctccgtcctgtgccagcccgg

SEQ ID NO: 655013 - DNA, 25 bp, Rattus norvegicus
gcccgccttcttgagcgtctggctg

SEQ ID NO: 655014 - DNA, 25 bp, Rattus norvegicus
ttcgtgcccgccttcttgagcgtct

SEQ ID NO: 655015 - DNA, 25 bp, Rattus norvegicus
tcttagcttgctggtggagcttgga

SEQ ID NO: 655016 - DNA, 25 bp, Rattus norvegicus
aacccggtccgcgacgcggcgctct

SEQ ID NO: 655017 - DNA, 25 bp, Rattus norvegicus
acgcgccctcttagcttgctggtgg

SEQ ID NO: 655018 - DNA, 25 bp, Rattus norvegicus
cgccctcttagcttgctggtggagc

SEQ ID NO: 655019 - DNA, 25 bp, Rattus norvegicus
caggtacgcgccctcttagcttgct

SEQ ID NO: 655020 - DNA, 25 bp, Rattus norvegicus
ttctggactagcaactccggtcacc

SEQ ID NO: 655021 - DNA, 25 bp, Rattus norvegicus
ggactctgcggaccaatcactcggc

SEQ ID NO: 655022 - DNA, 25 bp, Rattus norvegicus
aacagagaaaagctgcagtggactc

SEQ ID NO: 655023 - DNA, 25 bp, Rattus norvegicus
tccggtcaccaacaaagaacgctcg

SEQ ID NO: 655024 - DNA, 25 bp, Rattus norvegicus
tcagtctgttccttctggactagca

SEQ ID NO: 655025 - DNA, 25 bp, Rattus norvegicus
tactgatgagggacgctcggagtct

SEQ ID NO: 655026 - DNA, 25 bp, Rattus norvegicus
ttagttacctcgctcactcagtctg

SEQ ID NO: 655027 - DNA, 25 bp, Rattus norvegicus
cgccgacgcctgtgcacttagttac

SEQ ID NO: 655028 - DNA, 25 bp, Rattus norvegicus
aagtagctcgcccaaggcgcgcaaa

SEQ ID NO: 655029 - DNA, 25 bp, Rattus norvegicus
gcccggaggcaaagtagctcgccca

SEQ ID NO: 655030 - DNA, 25 bp, Rattus norvegicus
gagacgcacgggagaaactggaatc

SEQ ID NO: 655031 - DNA, 25 bp, Rattus norvegicus
tctcgaagggagtttgagacgcacg

SEQ ID NO: 655032 - DNA, 25 bp, Rattus norvegicus
acgctcggagtctcgaagggagttt

SEQ ID NO: 655033 - DNA, 25 bp, Rattus norvegicus
ctcgcttagagaaagagaagtaacc

SEQ ID NO: 655034 - DNA, 25 bp, Rattus norvegicus
cagcagggactgacacgaaggagat

SEQ ID NO: 655035 - DNA, 25 bp, Rattus norvegicus
gaaggagatttcgactaatggcaaa

SEQ ID NO: 655036 - DNA, 25 bp, Rattus norvegicus
aagcaagtgaaatgagccgaggaca

SEQ ID NO: 655037 - DNA, 25 bp, Rattus norvegicus
ccagacgcagtggtactgagcatgc

SEQ ID NO: 655038 - DNA, 25 bp, Rattus norvegicus
gagagagtgttcacaaggagccaca

SEQ ID NO: 655039 - DNA, 25 bp, Rattus norvegicus
acagatatggcacggcccgcctgtt

SEQ ID NO: 655040 - DNA, 25 bp, Rattus norvegicus
cccgcctgttcctgctggacaagga

SEQ ID NO: 655041 - DNA, 25 bp, Rattus norvegicus
acaaggacctcttcagggctagggc

SEQ ID NO: 655042 - DNA, 25 bp, Rattus norvegicus
gggctagggcctcaccttggactcc

SEQ ID NO: 655043 - DNA, 25 bp, Rattus norvegicus
gtccctcgtggtcgtcgctgaccag

SEQ ID NO: 655044 - DNA, 25 bp, Rattus norvegicus
cgtcgctgaccagcaggatgatgtg

SEQ ID NO: 655045 - DNA, 25 bp, Rattus norvegicus
gcaggatgatgtggttccagttgta

SEQ ID NO: 655046 - DNA, 25 bp, Rattus norvegicus
gcatcatctcaaaccagacgctgga

SEQ ID NO: 655047 - DNA, 25 bp, Rattus norvegicus
tccagttgtagactcgcatcatctc

SEQ ID NO: 655048 - DNA, 25 bp, Rattus norvegicus
cttaaaacaagtcgctgagcagctc

SEQ ID NO: 655049 - DNA, 25 bp, Rattus norvegicus
ggggacagaattccaattgcgggcc

SEQ ID NO: 655050 - DNA, 25 bp, Rattus norvegicus
accctggccgctgcttctcgctggc

SEQ ID NO: 655051 - DNA, 25 bp, Rattus norvegicus
ctagcacgcttagcttcttccgggg

SEQ ID NO: 655052 - DNA, 25 bp, Rattus norvegicus
cctagcagctagcacgcttagcttc

SEQ ID NO: 655053 - DNA, 25 bp, Rattus norvegicus
cgcagcagcatcctagcagctagca

SEQ ID NO: 655054 - DNA, 25 bp, Rattus norvegicus
cggcgcagcagcatcctagcagcta

SEQ ID NO: 655055 - DNA, 25 bp, Rattus norvegicus
acagccacgctgatgcagtgcggtg

SEQ ID NO: 655056 - DNA, 25 bp, Rattus norvegicus
ggggatgtcagcacagccacgctga

SEQ ID NO: 655057 - DNA, 25 bp, Rattus norvegicus
gcctgttaaccagcgcataatgccc

SEQ ID NO: 655058 - DNA, 25 bp, Rattus norvegicus
ctcggagcctgttaaccagcgcata

SEQ ID NO: 655059 - DNA, 25 bp, Rattus norvegicus
agaattccaattgcgggccgcggct

SEQ ID NO: 655060 - DNA, 25 bp, Rattus norvegicus
tgagcagctcggagcctgttaacca

SEQ ID NO: 655061 - DNA, 25 bp, Rattus norvegicus
agcgagggagaaaatgcttaaaaca

SEQ ID NO: 655062 - DNA, 25 bp, Rattus norvegicus
agtgtcggtgcacgtgtttcagatc

SEQ ID NO: 655063 - DNA, 25 bp, Rattus norvegicus
gatacggggcgagagtgatttccac

SEQ ID NO: 655064 - DNA, 25 bp, Rattus norvegicus
tacagactaccggagcaggatacgg

SEQ ID NO: 655065 - DNA, 25 bp, Rattus norvegicus
tggagactacagactaccggagcag

SEQ ID NO: 655066 - DNA, 25 bp, Rattus norvegicus
catggacttatggtctggagactac

SEQ ID NO: 655067 - DNA, 25 bp, Rattus norvegicus
cagcagcctcgtggacatggactta

SEQ ID NO: 655068 - DNA, 25 bp, Rattus norvegicus
ctcatggtcagcagcctcgtggaca

SEQ ID NO: 655069 - DNA, 25 bp, Rattus norvegicus
cgtgaacgcgggctcctcctgcatg

SEQ ID NO: 655070 - DNA, 25 bp, Rattus norvegicus
ctggcaccggatggacagcagactc

SEQ ID NO: 655071 - DNA, 25 bp, Rattus norvegicus
tcaggaccaggttcgcgtgaacgcg

SEQ ID NO: 655072 - DNA, 25 bp, Rattus norvegicus
gagcgcttagttcaggaccaggttc

SEQ ID NO: 655073 - DNA, 25 bp, Rattus norvegicus
tctacagggcagagcgcttagttca

SEQ ID NO: 655074 - DNA, 25 bp, Rattus norvegicus
tttcagatcatctacagggcagagc

SEQ ID NO: 655075 - DNA, 25 bp, Rattus norvegicus
agagtgatttccaccgcccaggctg

SEQ ID NO: 655076 - DNA, 25 bp, Rattus norvegicus
ctcggcggcggtttcagggcctcaa

SEQ ID NO: 655077 - DNA, 25 bp, Rattus norvegicus
aactccatcgggagctacagggaca

SEQ ID NO: 655078 - DNA, 25 bp, Rattus norvegicus
ctccgctcgggtggactcctcagtg

SEQ ID NO: 655079 - DNA, 25 bp, Rattus norvegicus
ccatcgggagctacagggacagccc

SEQ ID NO: 655080 - DNA, 25 bp, Rattus norvegicus
tttcagggcctcaaactccatcggg

SEQ ID NO: 655081 - DNA, 25 bp, Rattus norvegicus
tcaaaaagccctaccagagcgaggg

SEQ ID NO: 655082 - DNA, 25 bp, Rattus norvegicus
ttcgcatcaaaaagccctaccagag

SEQ ID NO: 655083 - DNA, 25 bp, Rattus norvegicus
tgagcgtttcgcttcgcatcaaaaa

SEQ ID NO: 655084 - DNA, 25 bp, Rattus norvegicus
ggccatttgagcgtttcgcttcgca

SEQ ID NO: 655085 - DNA, 25 bp, Rattus norvegicus
aaaggtggccatttgagcgtttcgc

SEQ ID NO: 655086 - DNA, 25 bp, Rattus norvegicus
tcccttcagccggtgtcggagaaag

SEQ ID NO: 655087 - DNA, 25 bp, Rattus norvegicus
tgagaggcgtcccttcagccggtgt

SEQ ID NO: 655088 - DNA, 25 bp, Rattus norvegicus
cctcagtggtgagaggcgtcccttc

SEQ ID NO: 655089 - DNA, 25 bp, Rattus norvegicus
gggcctcaaactccatcgggagcta

SEQ ID NO: 655090 - DNA, 25 bp, Rattus norvegicus
cttaacggagattgtctggacgccc

SEQ ID NO: 655091 - DNA, 25 bp, Rattus norvegicus
gcaacggcagcccaggccggaagaa

SEQ ID NO: 655092 - DNA, 25 bp, Rattus norvegicus
cgccaggctagagctgaggccacag

SEQ ID NO: 655093 - DNA, 25 bp, Rattus norvegicus
ccggagtcaaccagctttattctta

SEQ ID NO: 655094 - DNA, 25 bp, Rattus norvegicus
ccaggccggaagaaggacttagcct

SEQ ID NO: 655095 - DNA, 25 bp, Rattus norvegicus
ccagctttattcttaacggagattg

SEQ ID NO: 655096 - DNA, 25 bp, Rattus norvegicus
gctttgaggcttccgcagcaacggc

SEQ ID NO: 655097 - DNA, 25 bp, Rattus norvegicus
cgactcgcaaaaatggctttgaggc

SEQ ID NO: 655098 - DNA, 25 bp, Rattus norvegicus
ttaccgactcgcaaaaatggctttg

SEQ ID NO: 655099 - DNA, 25 bp, Rattus norvegicus
gtcactttcacttaccgactcgcaa

SEQ ID NO: 655100 - DNA, 25 bp, Rattus norvegicus
ggcatgtctccgtcactttcactta

SEQ ID NO: 655101 - DNA, 25 bp, Rattus norvegicus
gggtgtactcccacgcagcgtcgtc

SEQ ID NO: 655102 - DNA, 25 bp, Rattus norvegicus
ggccacagcggggtgtactcccacg

SEQ ID NO: 655103 - DNA, 25 bp, Rattus norvegicus
acgcttccggagtcaaccagcttta

SEQ ID NO: 655104 - DNA, 25 bp, Rattus norvegicus
ccatggtcatctccgccaatcggaa

SEQ ID NO: 655105 - DNA, 25 bp, Rattus norvegicus
gaaaggccgccatccggatctggca

SEQ ID NO: 655106 - DNA, 25 bp, Rattus norvegicus
ccggatctggcaaagccaggagctc

SEQ ID NO: 655107 - DNA, 25 bp, Rattus norvegicus
aggggcagacaacctgagccaaagg

SEQ ID NO: 655108 - DNA, 25 bp, Rattus norvegicus
agccctggccggacaaagacaactt

SEQ ID NO: 655109 - DNA, 25 bp, Rattus norvegicus
agacaacttccaggtcccatggtca

SEQ ID NO: 655110 - DNA, 25 bp, Rattus norvegicus
ccaatcggaatgctcgcaggacgac

SEQ ID NO: 655111 - DNA, 25 bp, Rattus norvegicus
cccgagagggactttccgcattgtg

SEQ ID NO: 655112 - DNA, 25 bp, Rattus norvegicus
agtcggctctgtgagctccgcagtt

SEQ ID NO: 655113 - DNA, 25 bp, Rattus norvegicus
cgcagttgcggctcttctgtagcag

SEQ ID NO: 655114 - DNA, 25 bp, Rattus norvegicus
ggccagagctctgttcttcgcggct

SEQ ID NO: 655115 - DNA, 25 bp, Rattus norvegicus
tctcgggtcgcctccgaacttacaa

SEQ ID NO: 655116 - DNA, 25 bp, Rattus norvegicus
cttcgcggctgcagtcacgaagggc

SEQ ID NO: 655117 - DNA, 25 bp, Rattus norvegicus
gctcttctgtagcaggtgggccaga

SEQ ID NO: 655118 - DNA, 25 bp, Rattus norvegicus
cccggctagaatcccgctgccttct

SEQ ID NO: 655119 - DNA, 25 bp, Rattus norvegicus
taacctcccggacggcgcttggcga

SEQ ID NO: 655120 - DNA, 25 bp, Rattus norvegicus
cctccggcaggctccgagcccaggt

SEQ ID NO: 655121 - DNA, 25 bp, Rattus norvegicus
gcaagcgcggatcctccggcaggct

SEQ ID NO: 655122 - DNA, 25 bp, Rattus norvegicus
ctgcgggaaggaagctccgcctcgc

SEQ ID NO: 655123 - DNA, 25 bp, Rattus norvegicus
cggaaggagccgcttcacgtgagca

SEQ ID NO: 655124 - DNA, 25 bp, Rattus norvegicus
aaggagccgcttcacgtgagcagtg

SEQ ID NO: 655125 - DNA, 25 bp, Rattus norvegicus
cgcttggcgacagcaggtccggtac

SEQ ID NO: 655126 - DNA, 25 bp, Rattus norvegicus
gcgacagcaggtccggtacagtcac

SEQ ID NO: 655127 - DNA, 25 bp, Rattus norvegicus
ctggtctctactccggaggcccggg

SEQ ID NO: 655128 - DNA, 25 bp, Rattus norvegicus
gccgaggaatgcaggggtctccctc

SEQ ID NO: 655129 - DNA, 25 bp, Rattus norvegicus
aatgcaggggtctccctcgacgggc

SEQ ID NO: 655130 - DNA, 25 bp, Rattus norvegicus
gcaggtccggtacagtcacggttcc

SEQ ID NO: 655131 - DNA, 25 bp, Rattus norvegicus
ctcgacgggccgagccctgagggaa

SEQ ID NO: 655132 - DNA, 25 bp, Rattus norvegicus
gcgaacacgtgacgccgccgagtac

SEQ ID NO: 655133 - DNA, 25 bp, Rattus norvegicus
gcggcagcggccacaatactcaagc

SEQ ID NO: 655134 - DNA, 25 bp, Rattus norvegicus
agccgccaccgctggtaaggacgca

SEQ ID NO: 655135 - DNA, 25 bp, Rattus norvegicus
atccgagctcaggttcggcagcgac

SEQ ID NO: 655136 - DNA, 25 bp, Rattus norvegicus
agtactcccattggccgatccaggg

SEQ ID NO: 655137 - DNA, 25 bp, Rattus norvegicus
gctgctgaggaacggaaagcccgcc

SEQ ID NO: 655138 - DNA, 25 bp, Rattus norvegicus
cctgcgaggccgcttacgtaaactg

SEQ ID NO: 655139 - DNA, 25 bp, Rattus norvegicus
ggccaactgctgagaagaactaaga

SEQ ID NO: 655140 - DNA, 25 bp, Rattus norvegicus
tgcagaaacttcgtaactgcgggtt

SEQ ID NO: 655141 - DNA, 25 bp, Rattus norvegicus
taactgcgggttctaagagccgctc

SEQ ID NO: 655142 - DNA, 25 bp, Rattus norvegicus
ccagcctttacgctaacggagtaag

SEQ ID NO: 655143 - DNA, 25 bp, Rattus norvegicus
ctaacggagtaagcgccgcaatgcc

SEQ ID NO: 655144 - DNA, 25 bp, Rattus norvegicus
gcctgcgtcaactgcgcacctggga

SEQ ID NO: 655145 - DNA, 25 bp, Rattus norvegicus
gcacaacaaacaatgcggggcccgg

SEQ ID NO: 655146 - DNA, 25 bp, Rattus norvegicus
agtttccggtgcgactgtgcggaca

SEQ ID NO: 655147 - DNA, 25 bp, Rattus norvegicus
cctgcacggaggctcgtgcctggac

SEQ ID NO: 655148 - DNA, 25 bp, Rattus norvegicus
acggtgtgggctcctaccgctgtgt

SEQ ID NO: 655149 - DNA, 25 bp, Rattus norvegicus
taccgctgtgtgtgcgcacctggat

SEQ ID NO: 655150 - DNA, 25 bp, Rattus norvegicus
tgcgcacctggatacgccggcgcga

SEQ ID NO: 655151 - DNA, 25 bp, Rattus norvegicus
atacgccggcgcgagctgtcagctg

SEQ ID NO: 655152 - DNA, 25 bp, Rattus norvegicus
acgtggacgagtgccagagccagcc

SEQ ID NO: 655153 - DNA, 25 bp, Rattus norvegicus
ccagagccagccgtgcgagcacggt

SEQ ID NO: 655154 - DNA, 25 bp, Rattus norvegicus
tggcgtgtgtcacgacctggtcaac

SEQ ID NO: 655155 - DNA, 25 bp, Rattus norvegicus
acgacctggtcaacgggtgagccct

SEQ ID NO: 655156 - DNA, 25 bp, Rattus norvegicus
ctcacgccagtttccggtgcgactg

SEQ ID NO: 655157 - DNA, 25 bp, Rattus norvegicus
cgactgtgcggacacgggttacgaa

SEQ ID NO: 655158 - DNA, 25 bp, Rattus norvegicus
gcgtgcacaacgcatcctgcctcga

SEQ ID NO: 655159 - DNA, 25 bp, Rattus norvegicus
tgcgggatgggcacccgctcagctc

SEQ ID NO: 655160 - DNA, 25 bp, Rattus norvegicus
gccgagaacttcacgggctgcctgg

SEQ ID NO: 655161 - DNA, 25 bp, Rattus norvegicus
tcatcgccctgtgtccggggccaat

SEQ ID NO: 655162 - DNA, 25 bp, Rattus norvegicus
acgtctttgcttgttcctgcggccc

SEQ ID NO: 655163 - DNA, 25 bp, Rattus norvegicus
cacgcgagcacttcatggcttggcc

SEQ ID NO: 655164 - DNA, 25 bp, Rattus norvegicus
gctgcgagatccacgctgatccatg

SEQ ID NO: 655165 - DNA, 25 bp, Rattus norvegicus
tgcctctgctactggccgagaactt

SEQ ID NO: 655166 - DNA, 25 bp, Rattus norvegicus
gacacccgtggctttgcacggcttg

SEQ ID NO: 655167 - DNA, 25 bp, Rattus norvegicus
gcctagcccgggagtttccacaggc

SEQ ID NO: 655168 - DNA, 25 bp, Rattus norvegicus
cgcaatggcttgctggcagtagatg

SEQ ID NO: 655169 - DNA, 25 bp, Rattus norvegicus
ccaatatctggctggcggtgcgcaa

SEQ ID NO: 655170 - DNA, 25 bp, Rattus norvegicus
gggtgcccactccaatatctggctg

SEQ ID NO: 655171 - DNA, 25 bp, Rattus norvegicus
tgttcacaggccacaacgtgtcctc

SEQ ID NO: 655172 - DNA, 25 bp, Rattus norvegicus
agggccctcctgctgtgttcacagg

SEQ ID NO: 655173 - DNA, 25 bp, Rattus norvegicus
tgcctcgacctcttcgacgtctttg

SEQ ID NO: 655174 - DNA, 25 bp, Rattus norvegicus
gcccggaacttgcaagggcccgtca

SEQ ID NO: 655175 - DNA, 25 bp, Rattus norvegicus
gagccagcagctactccgatcgctg

SEQ ID NO: 655176 - DNA, 25 bp, Rattus norvegicus
gcaggtcgtcactgaagctgcggct

SEQ ID NO: 655177 - DNA, 25 bp, Rattus norvegicus
gctgaactgggccaccgtgggcacc

SEQ ID NO: 655178 - DNA, 25 bp, Rattus norvegicus
ctcaccaaggtaagaggcgccggga

SEQ ID NO: 655179 - DNA, 25 bp, Rattus norvegicus
cacccgctgccgagggctcaccaag

SEQ ID NO: 655180 - DNA, 25 bp, Rattus norvegicus
tactccgatcgctgtgctgcccggg

SEQ ID NO: 655181 - DNA, 25 bp, Rattus norvegicus
atttgtcagctcaggcgagccagca

SEQ ID NO: 655182 - DNA, 25 bp, Rattus norvegicus
ggaccctgattgatttgtcagctca

SEQ ID NO: 655183 - DNA, 25 bp, Rattus norvegicus
ggactccgcggaccctgattgattt

SEQ ID NO: 655184 - DNA, 25 bp, Rattus norvegicus
ccacagtcagggtggcaactcctgg

SEQ ID NO: 655185 - DNA, 25 bp, Rattus norvegicus
cgcgccacagtcagggtggcaactc

SEQ ID NO: 655186 - DNA, 25 bp, Rattus norvegicus
gcagcataatgaccgcggccggccg

SEQ ID NO: 655187 - DNA, 25 bp, Rattus norvegicus
cgtctgctggcagctcggggctcac

SEQ ID NO: 655188 - DNA, 25 bp, Rattus norvegicus
ggggatctgtaccttcgagcgagta

SEQ ID NO: 655189 - DNA, 25 bp, Rattus norvegicus
gacagcgacaccctacccgagagga

SEQ ID NO: 655190 - DNA, 25 bp, Rattus norvegicus
ctgcgctttgtatgtggggttacca

SEQ ID NO: 655191 - DNA, 25 bp, Rattus norvegicus
tttcccgactgctgcagggagcttg

SEQ ID NO: 655192 - DNA, 25 bp, Rattus norvegicus
gtcgcctgtcacatccctgcaagga

SEQ ID NO: 655193 - DNA, 25 bp, Rattus norvegicus
tggtcacccacctcaggcgtttcgt

SEQ ID NO: 655194 - DNA, 25 bp, Rattus norvegicus
gctgctgaggctgaccactccatct

SEQ ID NO: 655195 - DNA, 25 bp, Rattus norvegicus
cgctggagtccaagaccgagcactg

SEQ ID NO: 655196 - DNA, 25 bp, Rattus norvegicus
gcggatgtttagagctccacccttg

SEQ ID NO: 655197 - DNA, 25 bp, Rattus norvegicus
agctccatctccatggggcagcgga

SEQ ID NO: 655198 - DNA, 25 bp, Rattus norvegicus
gcttccgctccttcgctttttcaag

SEQ ID NO: 655199 - DNA, 25 bp, Rattus norvegicus
acgctccgggaagaaatggctcgaa

SEQ ID NO: 655200 - DNA, 25 bp, Rattus norvegicus
tcctacaacgcttacaggctggata

SEQ ID NO: 655201 - DNA, 25 bp, Rattus norvegicus
cgagcactgcgaagggacaaacatc

SEQ ID NO: 655202 - DNA, 25 bp, Rattus norvegicus
ctggtttactgcctcgcggaacatc

SEQ ID NO: 655203 - DNA, 25 bp, Rattus norvegicus
agtgcgacgacctcgcgatgtacga

SEQ ID NO: 655204 - DNA, 25 bp, Rattus norvegicus
aatgtcagcaggtgcatggtgctca

SEQ ID NO: 655205 - DNA, 25 bp, Rattus norvegicus
gtgtcgcttattggcctggtttact

SEQ ID NO: 655206 - DNA, 25 bp, Rattus norvegicus
gcaggaaaaaagcagggcgaatgtc

SEQ ID NO: 655207 - DNA, 25 bp, Rattus norvegicus
cgatgttgacgatcttggggtcgca

SEQ ID NO: 655208 - DNA, 25 bp, Rattus norvegicus
agcaccgcgccgatgttgacgatct

SEQ ID NO: 655209 - DNA, 25 bp, Rattus norvegicus
atggtgctcatgagctccgggcaca

SEQ ID NO: 655210 - DNA, 25 bp, Rattus norvegicus
atctgttcatgcttgcgcgtgctca

SEQ ID NO: 655211 - DNA, 25 bp, Rattus norvegicus
tgaagcgtgtttggcgctgctcgaa

SEQ ID NO: 655212 - DNA, 25 bp, Rattus norvegicus
gctgctcgaacacccgcgcggaaaa

SEQ ID NO: 655213 - DNA, 25 bp, Rattus norvegicus
atgagcgggacctacgcgttctacc

SEQ ID NO: 655214 - DNA, 25 bp, Rattus norvegicus
cccgcttcctgacgctgagtcgagt

SEQ ID NO: 655215 - DNA, 25 bp, Rattus norvegicus
cgcgcctgcgttggcgtgaatgctc

SEQ ID NO: 655216 - DNA, 25 bp, Rattus norvegicus
gttgcctgcagcgtcaattagttgg

SEQ ID NO: 655217 - DNA, 25 bp, Rattus norvegicus
caattagttggcgattccgagggta

SEQ ID NO: 655218 - DNA, 25 bp, Rattus norvegicus
attccgagggtatttgcgtggcccg

SEQ ID NO: 655219 - DNA, 25 bp, Rattus norvegicus
gcgcacaatgaaatagttgcctgca

SEQ ID NO: 655220 - DNA, 25 bp, Rattus norvegicus
tggcccggctttggccgctctaata

SEQ ID NO: 655221 - DNA, 25 bp, Rattus norvegicus
ttggccgctctaataacgggacaga

SEQ ID NO: 655222 - DNA, 25 bp, Rattus norvegicus
ataacgggacagagcgccgggaaca

SEQ ID NO: 655223 - DNA, 25 bp, Rattus norvegicus
ggaacagcgcgcagatcaatcaccc

SEQ ID NO: 655224 - DNA, 25 bp, Rattus norvegicus
gatcaatcaccctggttccgctgcg

SEQ ID NO: 655225 - DNA, 25 bp, Rattus norvegicus
tggcctcactttttccttggactgg

SEQ ID NO: 655226 - DNA, 25 bp, Rattus norvegicus
ttggactgggagcttcctccctccg

SEQ ID NO: 655227 - DNA, 25 bp, Rattus norvegicus
tctgagttagtcacggtggccggct

SEQ ID NO: 655228 - DNA, 25 bp, Rattus norvegicus
cggctggaggctgctacctcattat

SEQ ID NO: 655229 - DNA, 25 bp, Rattus norvegicus
ctacctcattatgcggcgggtctgc

SEQ ID NO: 655230 - DNA, 25 bp, Rattus norvegicus
cgccgcgatgctgttccacagtctg

SEQ ID NO: 655231 - DNA, 25 bp, Rattus norvegicus
acgggaccaaggctgagggatcctc

SEQ ID NO: 655232 - DNA, 25 bp, Rattus norvegicus
tcctccgagacgcacgggaccaagg

SEQ ID NO: 655233 - DNA, 25 bp, Rattus norvegicus
gaactttaggtagagtcctccgaga

SEQ ID NO: 655234 - DNA, 25 bp, Rattus norvegicus
accgcagggccaagagcgaggctcc

SEQ ID NO: 655235 - DNA, 25 bp, Rattus norvegicus
tcatcgacgagatggaccgcagggc

SEQ ID NO: 655236 - DNA, 25 bp, Rattus norvegicus
ttaaagccgggaacgccaggcagct

SEQ ID NO: 655237 - DNA, 25 bp, Rattus norvegicus
agccaccgctgcctggggcagagtt

SEQ ID NO: 655238 - DNA, 25 bp, Rattus norvegicus
gcacctagccgttcctgggtgaacc

SEQ ID NO: 655239 - DNA, 25 bp, Rattus norvegicus
aagagacgtccaggcatctgggccg

SEQ ID NO: 655240 - DNA, 25 bp, Rattus norvegicus
ccctactccagttcgcctttggttg

SEQ ID NO: 655241 - DNA, 25 bp, Rattus norvegicus
tcagctcgcaggcttcgcggagacc

SEQ ID NO: 655242 - DNA, 25 bp, Rattus norvegicus
cctcttcaattctcctggtggctcg

SEQ ID NO: 655243 - DNA, 25 bp, Rattus norvegicus
atgcctgcggcgtgaaagcacccac

SEQ ID NO: 655244 - DNA, 25 bp, Rattus norvegicus
acagcctggtctattgccgcttgca

SEQ ID NO: 655245 - DNA, 25 bp, Rattus norvegicus
ctacaacgccggtgagtgcaagatc

SEQ ID NO: 655246 - DNA, 25 bp, Rattus norvegicus
cggggcagatctggcagcctacaac

SEQ ID NO: 655247 - DNA, 25 bp, Rattus norvegicus
agaaagcgcaaaagtccaggacccg

SEQ ID NO: 655248 - DNA, 25 bp, Rattus norvegicus
ctgggtcttccctactacaacggcg

SEQ ID NO: 655249 - DNA, 25 bp, Rattus norvegicus
ccgcagcagctaagagtgcaggatt

SEQ ID NO: 655250 - DNA, 25 bp, Rattus norvegicus
ggcacactttaaccatgccgacgtg

SEQ ID NO: 655251 - DNA, 25 bp, Rattus norvegicus
gcttgcacttcgaggcactgctgca

SEQ ID NO: 655252 - DNA, 25 bp, Rattus norvegicus
ccggcgaccacttcggcatgaagga

SEQ ID NO: 655253 - DNA, 25 bp, Rattus norvegicus
acaagatgctgacgaccggcgacca

SEQ ID NO: 655254 - DNA, 25 bp, Rattus norvegicus
aactgcttcacatgcaccacgtgta

SEQ ID NO: 655255 - DNA, 25 bp, Rattus norvegicus
cgtgctcgggacttggtttatcacc

SEQ ID NO: 655256 - DNA, 25 bp, Rattus norvegicus
tctcggcctcagagatggtgatgcg

SEQ ID NO: 655257 - DNA, 25 bp, Rattus norvegicus
gcaaggcgaatacccggcacacttt

SEQ ID NO: 655258 - DNA, 25 bp, Rattus norvegicus
cggattgcgaggacaccagtttgct

SEQ ID NO: 655259 - DNA, 25 bp, Rattus norvegicus
gggcctagaccgacttccctagatc

SEQ ID NO: 655260 - DNA, 25 bp, Rattus norvegicus
cgccggcggaagagaaatggctaca

SEQ ID NO: 655261 - DNA, 25 bp, Rattus norvegicus
tggctacaatgtgggccttggagtt

SEQ ID NO: 655262 - DNA, 25 bp, Rattus norvegicus
tgctcttggaaggataacgcgttct

SEQ ID NO: 655263 - DNA, 25 bp, Rattus norvegicus
gacaaagttacttgccgggcctaga

SEQ ID NO: 655264 - DNA, 25 bp, Rattus norvegicus
tttgcttgtgtaagcgcccggtacc

SEQ ID NO: 655265 - DNA, 25 bp, Rattus norvegicus
gcccggtacctaggggccagacaca

SEQ ID NO: 655266 - DNA, 25 bp, Rattus norvegicus
gggccagacacagggacactttgca

SEQ ID NO: 655267 - DNA, 25 bp, Rattus norvegicus
acactttgcaaaccggcgcccgagg

SEQ ID NO: 655268 - DNA, 25 bp, Rattus norvegicus
agcggctcagttattcggggctccc

SEQ ID NO: 655269 - DNA, 25 bp, Rattus norvegicus
cccaaaactggagcggggcttcagg

SEQ ID NO: 655270 - DNA, 25 bp, Rattus norvegicus
gaacagcgctcaggcccacaggcag

SEQ ID NO: 655271 - DNA, 25 bp, Rattus norvegicus
acggaccctctctggtcttggcgtg

SEQ ID NO: 655272 - DNA, 25 bp, Rattus norvegicus
acctggggtcctgcctgggagcgtc

SEQ ID NO: 655273 - DNA, 25 bp, Rattus norvegicus
ctgcgggggcgactgccatcagaca

SEQ ID NO: 655274 - DNA, 25 bp, Rattus norvegicus
aagccggagccgaggtgggatccgg

SEQ ID NO: 655275 - DNA, 25 bp, Rattus norvegicus
ggtgcacctcggcattgccccgagt

SEQ ID NO: 655276 - DNA, 25 bp, Rattus norvegicus
agtgaagagcgtagacatcctgcgg

SEQ ID NO: 655277 - DNA, 25 bp, Rattus norvegicus
ggcattgccccgagtctccagttcg

SEQ ID NO: 655278 - DNA, 25 bp, Rattus norvegicus
catcagacaggccagctccctaggg

SEQ ID NO: 655279 - DNA, 25 bp, Rattus norvegicus
cagacaggccagctccctagggaga

SEQ ID NO: 655280 - DNA, 25 bp, Rattus norvegicus
aggccagctccctagggagactaga

SEQ ID NO: 655281 - DNA, 25 bp, Rattus norvegicus
gctccctagggagactagagccgca

SEQ ID NO: 655282 - DNA, 25 bp, Rattus norvegicus
ccctagggagactagagccgcaggc

SEQ ID NO: 655283 - DNA, 25 bp, Rattus norvegicus
gactagagccgcaggcgtcggaggt

SEQ ID NO: 655284 - DNA, 25 bp, Rattus norvegicus
agcgtctcagctgggcggagagcgc

SEQ ID NO: 655285 - DNA, 25 bp, Rattus norvegicus
gcggagtgaagagcgtagacatcct

SEQ ID NO: 655286 - DNA, 25 bp, Rattus norvegicus
acgttcccgagtgagtgtgtgcaca

SEQ ID NO: 655287 - DNA, 25 bp, Rattus norvegicus
ccgaggtatctgcggcgggctccat

SEQ ID NO: 655288 - DNA, 25 bp, Rattus norvegicus
ccgagtgagtgtgtgcacacgtgca

SEQ ID NO: 655289 - DNA, 25 bp, Rattus norvegicus
gtggactggcttcgcttcggtttat

SEQ ID NO: 655290 - DNA, 25 bp, Rattus norvegicus
cgtgtctgaacgttcccgagtgagt

SEQ ID NO: 655291 - DNA, 25 bp, Rattus norvegicus
ggatgccaaggagtacgtgtgccca

SEQ ID NO: 655292 - DNA, 25 bp, Rattus norvegicus
tactgtggatgccaaggagtacgtg

SEQ ID NO: 655293 - DNA, 25 bp, Rattus norvegicus
tcggtttatcgtgtgtttactgtgg

SEQ ID NO: 655294 - DNA, 25 bp, Rattus norvegicus
cgcttcggtttatcggtttatcgtg

SEQ ID NO: 655295 - DNA, 25 bp, Rattus norvegicus
ctggcttcgcttcggtttatcggtt

SEQ ID NO: 655296 - DNA, 25 bp, Rattus norvegicus
ctgaacccggcggactagctgcggc

SEQ ID NO: 655297 - DNA, 25 bp, Rattus norvegicus
gccaattcgcgtgcgactcgcgctt

SEQ ID NO: 655298 - DNA, 25 bp, Rattus norvegicus
cgtgtgcccacgtgtctgaacgttc

SEQ ID NO: 655299 - DNA, 25 bp, Rattus norvegicus
aattcgcgtgcgactcgcgcttgcc

SEQ ID NO: 655300 - DNA, 25 bp, Rattus norvegicus
gccgagggcggagcaaccaaaaaga

SEQ ID NO: 655301 - DNA, 25 bp, Rattus norvegicus
ccaagaaagtgcttccgggccgagg

SEQ ID NO: 655302 - DNA, 25 bp, Rattus norvegicus
cgccatcttcccaagaaagtgcttc

SEQ ID NO: 655303 - DNA, 25 bp, Rattus norvegicus
ggtgcctgaaacaccgacacagccg

SEQ ID NO: 655304 - DNA, 25 bp, Rattus norvegicus
gaaaagcctccgaccggtgcctgaa

SEQ ID NO: 655305 - DNA, 25 bp, Rattus norvegicus
ctgcggcaattatcaaaagaaaagc

SEQ ID NO: 655306 - DNA, 25 bp, Rattus norvegicus
agcatgaacatacctgcggcaatta

SEQ ID NO: 655307 - DNA, 25 bp, Rattus norvegicus
ccctgagcatgaacatacctgcggc

SEQ ID NO: 655308 - DNA, 25 bp, Rattus norvegicus
ggaactcctactcgcgtcccgatcg

SEQ ID NO: 655309 - DNA, 25 bp, Rattus norvegicus
taaggcctccgacctaggccgcagc

SEQ ID NO: 655310 - DNA, 25 bp, Rattus norvegicus
attccctgagtcactcggccgcggg

SEQ ID NO: 655311 - DNA, 25 bp, Rattus norvegicus
gggcccgattccctgagtcactcgg

SEQ ID NO: 655312 - DNA, 25 bp, Rattus norvegicus
aagcagcccacgctggggcccgatt

SEQ ID NO: 655313 - DNA, 25 bp, Rattus norvegicus
gcggagcaaccaaaaagaatttaca

SEQ ID NO: 655314 - DNA, 25 bp, Rattus norvegicus
ctccgtgcacgcagtgctagtggtg

SEQ ID NO: 655315 - DNA, 25 bp, Rattus norvegicus
ttcaacgctgtcttccgctctgaca

SEQ ID NO: 655316 - DNA, 25 bp, Rattus norvegicus
cggttgctggaggttctgcctgcac

SEQ ID NO: 655317 - DNA, 25 bp, Rattus norvegicus
aggttctgcctgcactggcggcgct

SEQ ID NO: 655318 - DNA, 25 bp, Rattus norvegicus
cgctcacggcttgcgcgcatgttca

SEQ ID NO: 655319 - DNA, 25 bp, Rattus norvegicus
cttgcgcgcatgttcagtgggacat

SEQ ID NO: 655320 - DNA, 25 bp, Rattus norvegicus
atgttcagtgggacatggcagcaac

SEQ ID NO: 655321 - DNA, 25 bp, Rattus norvegicus
atggcagcaacggaggtggccactc

SEQ ID NO: 655322 - DNA, 25 bp, Rattus norvegicus
ctgtcgccaacgctctgcagctgcg

SEQ ID NO: 655323 - DNA, 25 bp, Rattus norvegicus
tcttccgctctgacagctgctggca

SEQ ID NO: 655324 - DNA, 25 bp, Rattus norvegicus
agcccagaggctccgtgcacgcagt

SEQ ID NO: 655325 - DNA, 25 bp, Rattus norvegicus
ctgttcaccaataggaggcgatgcg

SEQ ID NO: 655326 - DNA, 25 bp, Rattus norvegicus
agctgctggcaccacgtgtgcgcca

SEQ ID NO: 655327 - DNA, 25 bp, Rattus norvegicus
gctgggcgctgttcaccaataggag

SEQ ID NO: 655328 - DNA, 25 bp, Rattus norvegicus
ccgaggcagcgagagtgacagaaac

SEQ ID NO: 655329 - DNA, 25 bp, Rattus norvegicus
cgggaccctcggattcgatgcattt

SEQ ID NO: 655330 - DNA, 25 bp, Rattus norvegicus
agggatgcttccttgccgcctctgc

SEQ ID NO: 655331 - DNA, 25 bp, Rattus norvegicus
atcccgattcgtttgtctgagaaca

SEQ ID NO: 655332 - DNA, 25 bp, Rattus norvegicus
gaaccagggcgaagtagggcacaca

SEQ ID NO: 655333 - DNA, 25 bp, Rattus norvegicus
gacctaaggcagagacgagtctaga

SEQ ID NO: 655334 - DNA, 25 bp, Rattus norvegicus
actgctcaacggagaggggatcctg

SEQ ID NO: 655335 - DNA, 25 bp, Rattus norvegicus
agacaccgagcaaggagagacaccc

SEQ ID NO: 655336 - DNA, 25 bp, Rattus norvegicus
cgaccctgagaagcagagaaccctg

SEQ ID NO: 655337 - DNA, 25 bp, Rattus norvegicus
ctgggtccgcagacaaagccacgca

SEQ ID NO: 655338 - DNA, 25 bp, Rattus norvegicus
gggatacaggctccggtagacctca

SEQ ID NO: 655339 - DNA, 25 bp, Rattus norvegicus
gtagacctcagacggggagtccaga

SEQ ID NO: 655340 - DNA, 25 bp, Rattus norvegicus
agtccagatcccgagagccgtggcc

SEQ ID NO: 655341 - DNA, 25 bp, Rattus norvegicus
ctaggagtgacaggcccaacgagaa

SEQ ID NO: 655342 - DNA, 25 bp, Rattus norvegicus
agccagcaggttgagctctactaca

SEQ ID NO: 655343 - DNA, 25 bp, Rattus norvegicus
ctttggccacctgcttggtgcgcgc

SEQ ID NO: 655344 - DNA, 25 bp, Rattus norvegicus
actgggacgactttggggtcactga

SEQ ID NO: 655345 - DNA, 25 bp, Rattus norvegicus
tcttctatgtggctggccgcgactg

SEQ ID NO: 655346 - DNA, 25 bp, Rattus norvegicus
gtcaactggaaagtgcgcgccttca

SEQ ID NO: 655347 - DNA, 25 bp, Rattus norvegicus
cccgagcgcttgacggtcaactgga

SEQ ID NO: 655348 - DNA, 25 bp, Rattus norvegicus
ctcgactggccttcttcctaaagga

SEQ ID NO: 655349 - DNA, 25 bp, Rattus norvegicus
ttcagcaccagccaggtggtagcgc

SEQ ID NO: 655350 - DNA, 25 bp, Rattus norvegicus
tcaacgtgtccctggggcccttcag

SEQ ID NO: 655351 - DNA, 25 bp, Rattus norvegicus
aggagttgccggtcctcaacgtgtc

SEQ ID NO: 655352 - DNA, 25 bp, Rattus norvegicus
tggtgttccaaaccaaggagttgcc

SEQ ID NO: 655353 - DNA, 25 bp, Rattus norvegicus
tcggagcccttcgtggtgttccaaa

SEQ ID NO: 655354 - DNA, 25 bp, Rattus norvegicus
cacggcgatgaacggctccctgcag

SEQ ID NO: 655355 - DNA, 25 bp, Rattus norvegicus
tgcgcatcggcagcatcagtctgtt

SEQ ID NO: 655356 - DNA, 25 bp, Rattus norvegicus
cttgccgcaacgagcaccctttgta

SEQ ID NO: 655357 - DNA, 25 bp, Rattus norvegicus
ggaccactaccggtctgcccagagg

SEQ ID NO: 655358 - DNA, 25 bp, Rattus norvegicus
ctccaggataggtgcagggtgcaaa

SEQ ID NO: 655359 - DNA, 25 bp, Rattus norvegicus
caccgaggtccgaggaggaccacta

SEQ ID NO: 655360 - DNA, 25 bp, Rattus norvegicus
tcgtcgcctacaaggagcctggata

SEQ ID NO: 655361 - DNA, 25 bp, Rattus norvegicus
tgagccagcagaaagtcgtcgccta

SEQ ID NO: 655362 - DNA, 25 bp, Rattus norvegicus
aggatcccgctagagacctgagcca

SEQ ID NO: 655363 - DNA, 25 bp, Rattus norvegicus
gcgcgagaagcgtccggcaaacacc

SEQ ID NO: 655364 - DNA, 25 bp, Rattus norvegicus
cgggccaggtgaggaattctcagca

SEQ ID NO: 655365 - DNA, 25 bp, Rattus norvegicus
ttccgctgcaaacaccgaagcgggg

SEQ ID NO: 655366 - DNA, 25 bp, Rattus norvegicus
ggcgctttccaagttcaaaagttca

SEQ ID NO: 655367 - DNA, 25 bp, Rattus norvegicus
gctaattgctccagggcgctttcca

SEQ ID NO: 655368 - DNA, 25 bp, Rattus norvegicus
ggggctatcgcctgcgctaattgct

SEQ ID NO: 655369 - DNA, 25 bp, Rattus norvegicus
accctttgtaatgcaggcctcccgg

SEQ ID NO: 655370 - DNA, 25 bp, Rattus norvegicus
tgtgtcgtttccagcttccagaagt

SEQ ID NO: 655371 - DNA, 25 bp, Rattus norvegicus
ctcagagcgcagagccaacccagga

SEQ ID NO: 655372 - DNA, 25 bp, Rattus norvegicus
tccggtcaggagttttgcgtttcac

SEQ ID NO: 655373 - DNA, 25 bp, Rattus norvegicus
cgtttcaccttcaggcacgctaggg

SEQ ID NO: 655374 - DNA, 25 bp, Rattus norvegicus
ggtccgcaactcaaagcagacgtta

SEQ ID NO: 655375 - DNA, 25 bp, Rattus norvegicus
gggcgggcatcctgacgcaaaccac

SEQ ID NO: 655376 - DNA, 25 bp, Rattus norvegicus
cgcggtgattagactagggttctgc

SEQ ID NO: 655377 - DNA, 25 bp, Rattus norvegicus
ctgcgcttgcgcaatacctgatgaa

SEQ ID NO: 655378 - DNA, 25 bp, Rattus norvegicus
gcggtctttctcagtcttgggcttc

SEQ ID NO: 655379 - DNA, 25 bp, Rattus norvegicus
tgggcttcctgacacctccagcaag

SEQ ID NO: 655380 - DNA, 25 bp, Rattus norvegicus
ttgggccagcttcgcagttatgtac

SEQ ID NO: 655381 - DNA, 25 bp, Rattus norvegicus
gaagtcttaccgagggaagtgccta

SEQ ID NO: 655382 - DNA, 25 bp, Rattus norvegicus
agtttctgtgctgcgtctggttctc

SEQ ID NO: 655383 - DNA, 25 bp, Rattus norvegicus
tgcggtcgttttaagcccgtcgcca

SEQ ID NO: 655384 - DNA, 25 bp, Rattus norvegicus
ccctcgtagtcgtcgtcctggtctt

SEQ ID NO: 655385 - DNA, 25 bp, Rattus norvegicus
taggtggccgttcgtcccgctccat

SEQ ID NO: 655386 - DNA, 25 bp, Rattus norvegicus
gttcgtcccgctccatgcggcggtg

SEQ ID NO: 655387 - DNA, 25 bp, Rattus norvegicus
tgctcagggccctcgctggcttcga

SEQ ID NO: 655388 - DNA, 25 bp, Rattus norvegicus
agggccctcgctggcttcgatgttc

SEQ ID NO: 655389 - DNA, 25 bp, Rattus norvegicus
cgctggcttcgatgttccgccatga

SEQ ID NO: 655390 - DNA, 25 bp, Rattus norvegicus
ggcttcgatgttccgccatgacctg

SEQ ID NO: 655391 - DNA, 25 bp, Rattus norvegicus
tgcgccctcgtagtcgtcgtcctgg

SEQ ID NO: 655392 - DNA, 25 bp, Rattus norvegicus
cgtagtcgtcgtcctggtcttccac

SEQ ID NO: 655393 - DNA, 25 bp, Rattus norvegicus
agtcgtcgtcctggtcttccaccgg

SEQ ID NO: 655394 - DNA, 25 bp, Rattus norvegicus
ccggcaggctctcggccgccgaaca

SEQ ID NO: 655395 - DNA, 25 bp, Rattus norvegicus
cagctccctcctctgacgtcacgcg

SEQ ID NO: 655396 - DNA, 25 bp, Rattus norvegicus
ctcggccgccgaacactctgggccc

SEQ ID NO: 655397 - DNA, 25 bp, Rattus norvegicus
atgacctgcgccctcgtagtcgtcg

SEQ ID NO: 655398 - DNA, 25 bp, Rattus norvegicus
gccagaggggctcccgatctggcca

SEQ ID NO: 655399 - DNA, 25 bp, Rattus norvegicus
attgtgcggcggtaaataggatcct

SEQ ID NO: 655400 - DNA, 25 bp, Rattus norvegicus
tgggtactatcacgcgctaggctct

SEQ ID NO: 655401 - DNA, 25 bp, Rattus norvegicus
acgcgctaggctctcacttgtttga

SEQ ID NO: 655402 - DNA, 25 bp, Rattus norvegicus
ggctctcacttgtttgatttaacta

SEQ ID NO: 655403 - DNA, 25 bp, Rattus norvegicus
ttgatttaactacggattgtgcggc

SEQ ID NO: 655404 - DNA, 25 bp, Rattus norvegicus
actacggattgtgcggcggtaaata

SEQ ID NO: 655405 - DNA, 25 bp, Rattus norvegicus
gtaaataggatcctgtcctgagaga

SEQ ID NO: 655406 - DNA, 25 bp, Rattus norvegicus
cctgtcctgagagaggaaggaatcc

SEQ ID NO: 655407 - DNA, 25 bp, Rattus norvegicus
ggcggtgctattgtagtctcagttc

SEQ ID NO: 655408 - DNA, 25 bp, Rattus norvegicus
ctattgtagtctcagttcgcggggc

SEQ ID NO: 655409 - DNA, 25 bp, Rattus norvegicus
ccctctagaggccattctgcttaga

SEQ ID NO: 655410 - DNA, 25 bp, Rattus norvegicus
ttagagtcttgctcgacggccagag

SEQ ID NO: 655411 - DNA, 25 bp, Rattus norvegicus
tctgcttagagtcttgctcgacggc

SEQ ID NO: 655412 - DNA, 25 bp, Rattus norvegicus
ctctaagcaacgcagctggggaaac

SEQ ID NO: 655413 - DNA, 25 bp, Rattus norvegicus
ctcctggctggctgaagatagcgcc

SEQ ID NO: 655414 - DNA, 25 bp, Rattus norvegicus
cttccggggaattctgcggtactga

SEQ ID NO: 655415 - DNA, 25 bp, Rattus norvegicus
agccttaatcttggcctgcatgaga

SEQ ID NO: 655416 - DNA, 25 bp, Rattus norvegicus
aggctgcagttcttccgttaacttg

SEQ ID NO: 655417 - DNA, 25 bp, Rattus norvegicus
tactgaggttggctggtctctaagc

SEQ ID NO: 655418 - DNA, 25 bp, Rattus norvegicus
gaggccctttctgcctgtgcgcagt

SEQ ID NO: 655419 - DNA, 25 bp, Rattus norvegicus
acttccgccactatagccactggtg

SEQ ID NO: 655420 - DNA, 25 bp, Rattus norvegicus
accattgctgcgctgttcgcggatg

SEQ ID NO: 655421 - DNA, 25 bp, Rattus norvegicus
gattccctttgcctcaccattgctg

SEQ ID NO: 655422 - DNA, 25 bp, Rattus norvegicus
atcatacagattcgcaggccctgcg

SEQ ID NO: 655423 - DNA, 25 bp, Rattus norvegicus
cccgaaccaggcacaatcatacaga

SEQ ID NO: 655424 - DNA, 25 bp, Rattus norvegicus
agaagcgtctctgtgggtcactgag

SEQ ID NO: 655425 - DNA, 25 bp, Rattus norvegicus
tgcattttcgggaagcctgaagttc

SEQ ID NO: 655426 - DNA, 25 bp, Rattus norvegicus
tccgtcgttggtggcctcacgcctt

SEQ ID NO: 655427 - DNA, 25 bp, Rattus norvegicus
ttggtggcctcacgccttctcagca

SEQ ID NO: 655428 - DNA, 25 bp, Rattus norvegicus
gcttggccttcgcaccctgatcacc

SEQ ID NO: 655429 - DNA, 25 bp, Rattus norvegicus
ggcaatatccttcccagcgtggcgg

SEQ ID NO: 655430 - DNA, 25 bp, Rattus norvegicus
tccggttccggtgcatcctggaagt

SEQ ID NO: 655431 - DNA, 25 bp, Rattus norvegicus
ctgcccacaagagtttccggttccg

SEQ ID NO: 655432 - DNA, 25 bp, Rattus norvegicus
agccctgcccacaagagtttccggt

SEQ ID NO: 655433 - DNA, 25 bp, Rattus norvegicus
cagctttccacagtcctgcagcgca

SEQ ID NO: 655434 - DNA, 25 bp, Rattus norvegicus
gagttacgcctgcaacctccgacag

SEQ ID NO: 655435 - DNA, 25 bp, Rattus norvegicus
tgggacgacagagttacgcctgcaa

SEQ ID NO: 655436 - DNA, 25 bp, Rattus norvegicus
actgcagtccggcttctgggacgac

SEQ ID NO: 655437 - DNA, 25 bp, Rattus norvegicus
cggaagatgtccttgcactgcagtc

SEQ ID NO: 655438 - DNA, 25 bp, Rattus norvegicus
acagaggcggaagatgtccttgcac

SEQ ID NO: 655439 - DNA, 25 bp, Rattus norvegicus
acggcccaggagctcgtctcactct

SEQ ID NO: 655440 - DNA, 25 bp, Rattus norvegicus
ttggaacggctacagagtacagaca

SEQ ID NO: 655441 - DNA, 25 bp, Rattus norvegicus
gcaggaccgcggactgcaacctggc

SEQ ID NO: 655442 - DNA, 25 bp, Rattus norvegicus
tgccacgtcagcgagcggcaggacc

SEQ ID NO: 655443 - DNA, 25 bp, Rattus norvegicus
ctctacctgtgttggccggccactg

SEQ ID NO: 655444 - DNA, 25 bp, Rattus norvegicus
gagtacagacacctctacctgtgtt

SEQ ID NO: 655445 - DNA, 25 bp, Rattus norvegicus
gcatgcgccagtgtgcggcccagca

SEQ ID NO: 655446 - DNA, 25 bp, Rattus norvegicus
tcggatgaggtttctgcgcgcgcat

SEQ ID NO: 655447 - DNA, 25 bp, Rattus norvegicus
ctcaggccgacgagccgaataccga

SEQ ID NO: 655448 - DNA, 25 bp, Rattus norvegicus
tgctgtctaagagcagccacgcctc

SEQ ID NO: 655449 - DNA, 25 bp, Rattus norvegicus
ccagtagagcacttgctgtctaaga

SEQ ID NO: 655450 - DNA, 25 bp, Rattus norvegicus
tcccttctgaagagggaggagtccc

SEQ ID NO: 655451 - DNA, 25 bp, Rattus norvegicus
gcctacttgcgtccagggactccag

SEQ ID NO: 655452 - DNA, 25 bp, Rattus norvegicus
tccagggactccagtagagcacttg

SEQ ID NO: 655453 - DNA, 25 bp, Rattus norvegicus
caccttgcggtagaccgccggaggc

SEQ ID NO: 655454 - DNA, 25 bp, Rattus norvegicus
acgtcccgcgcgctgaggtttggtt

SEQ ID NO: 655455 - DNA, 25 bp, Rattus norvegicus
gccagaaagggggacttacatctcc

SEQ ID NO: 655456 - DNA, 25 bp, Rattus norvegicus
ccgagcgcctccgtgtgccagaaag

SEQ ID NO: 655457 - DNA, 25 bp, Rattus norvegicus
tggcggcagaggtcccttaaagact

SEQ ID NO: 655458 - DNA, 25 bp, Rattus norvegicus
actgattgggcgcttgggccgtcac

SEQ ID NO: 655459 - DNA, 25 bp, Rattus norvegicus
gtcggcctcattgtctgcccagagc

SEQ ID NO: 655460 - DNA, 25 bp, Rattus norvegicus
agtccgaccactgattgggcgcttg

SEQ ID NO: 655461 - DNA, 25 bp, Rattus norvegicus
gggtacctgaaagtccgaccactga

SEQ ID NO: 655462 - DNA, 25 bp, Rattus norvegicus
attggacacaatggcagggtacctg

SEQ ID NO: 655463 - DNA, 25 bp, Rattus norvegicus
gggactgccgggctcctctgaccat

SEQ ID NO: 655464 - DNA, 25 bp, Rattus norvegicus
gggttcggcgcttcgacaccacggc

SEQ ID NO: 655465 - DNA, 25 bp, Rattus norvegicus
cccttcagggttcggcgcttcgaca

SEQ ID NO: 655466 - DNA, 25 bp, Rattus norvegicus
tcattgtctgcccagagccgcaggc

SEQ ID NO: 655467 - DNA, 25 bp, Rattus norvegicus
cttaaagactgctagcagagcggga

SEQ ID NO: 655468 - DNA, 25 bp, Rattus norvegicus
ggacccggtcctctcacaccactga

SEQ ID NO: 655469 - DNA, 25 bp, Rattus norvegicus
ctccaagagaacacggaggttcttc

SEQ ID NO: 655470 - DNA, 25 bp, Rattus norvegicus
cgggccgcggatctccaagagaaca

SEQ ID NO: 655471 - DNA, 25 bp, Rattus norvegicus
ctctcaggcggaattccgggccgcg

SEQ ID NO: 655472 - DNA, 25 bp, Rattus norvegicus
gcttctcttccgctccctctcaggc

SEQ ID NO: 655473 - DNA, 25 bp, Rattus norvegicus
aacctgacccgcttctcttccgctc

SEQ ID NO: 655474 - DNA, 25 bp, Rattus norvegicus
tgcgaagagacgtaaaaacctgacc

SEQ ID NO: 655475 - DNA, 25 bp, Rattus norvegicus
ggcgtctgcgaagagacgtaaaaac

SEQ ID NO: 655476 - DNA, 25 bp, Rattus norvegicus
ttaggaagaacaagccgcggcaaca

SEQ ID NO: 655477 - DNA, 25 bp, Rattus norvegicus
ccattttaggaagaacaagccgcgg

SEQ ID NO: 655478 - DNA, 25 bp, Rattus norvegicus
gctcaccttcaggtcgttttcggga

SEQ ID NO: 655479 - DNA, 25 bp, Rattus norvegicus
atcgggcgcacggtagggatcccgc

SEQ ID NO: 655480 - DNA, 25 bp, Rattus norvegicus
tcacaccactgagcgccctccgtcg

SEQ ID NO: 655481 - DNA, 25 bp, Rattus norvegicus
ctccgtcgcgccaggatcgggcgca

SEQ ID NO: 655482 - DNA, 25 bp, Rattus norvegicus
tgtctggacttttcgatgcagggta

SEQ ID NO: 655483 - DNA, 25 bp, Rattus norvegicus
tacatcacgcaagaggggcagaaag

SEQ ID NO: 655484 - DNA, 25 bp, Rattus norvegicus
tctgatcttacatcacgcaagaggg

SEQ ID NO: 655485 - DNA, 25 bp, Rattus norvegicus
gcagggtacgtctgatcttacatca

SEQ ID NO: 655486 - DNA, 25 bp, Rattus norvegicus
acttttcgatgcagggtacgtctga

SEQ ID NO: 655487 - DNA, 25 bp, Rattus norvegicus
cttgctctgccaggagcaggatgtg

SEQ ID NO: 655488 - DNA, 25 bp, Rattus norvegicus
agtccgccttgctctgccaggagca

SEQ ID NO: 655489 - DNA, 25 bp, Rattus norvegicus
gtcggtgggtccagccagtccgcct

SEQ ID NO: 655490 - DNA, 25 bp, Rattus norvegicus
gaaatccctggtcggtgggtccagc

SEQ ID NO: 655491 - DNA, 25 bp, Rattus norvegicus
caaatgtcactggaaatccctggtc

SEQ ID NO: 655492 - DNA, 25 bp, Rattus norvegicus
gccgcgtcatttacaaatgtcactg

SEQ ID NO: 655493 - DNA, 25 bp, Rattus norvegicus
aaccgagccgcgtcatttacaaatg

SEQ ID NO: 655494 - DNA, 25 bp, Rattus norvegicus
cagcctggaaccgagccgcgtcatt

SEQ ID NO: 655495 - DNA, 25 bp, Rattus norvegicus
tcgatgcagggtacgtctgatctta

SEQ ID NO: 655496 - DNA, 25 bp, Rattus norvegicus
tgattgcagccatggttcaaccgtc

SEQ ID NO: 655497 - DNA, 25 bp, Rattus norvegicus
accctagcggcatctcacattttta

SEQ ID NO: 655498 - DNA, 25 bp, Rattus norvegicus
tttagcgcgcccttaggacccaagc

SEQ ID NO: 655499 - DNA, 25 bp, Rattus norvegicus
taactcgcaactcggaaccctggcg

SEQ ID NO: 655500 - DNA, 25 bp, Rattus norvegicus
cccagggttggcgattttgattgca

SEQ ID NO: 655501 - DNA, 25 bp, Rattus norvegicus
gacccaagctgggacgcagcacatc

SEQ ID NO: 655502 - DNA, 25 bp, Rattus norvegicus
cgggcggcgcatatgttcacagcca

SEQ ID NO: 655503 - DNA, 25 bp, Rattus norvegicus
cgccataacaggaagtgacgctatc

SEQ ID NO: 655504 - DNA, 25 bp, Rattus norvegicus
tgacgctatcacacctcggaagcta

SEQ ID NO: 655505 - DNA, 25 bp, Rattus norvegicus
tcggaagctagaatctcctgagtgc

SEQ ID NO: 655506 - DNA, 25 bp, Rattus norvegicus
cagcgccttagcaccaaccggaaga

SEQ ID NO: 655507 - DNA, 25 bp, Rattus norvegicus
cgttcgccaagtacaaccgtctggg

SEQ ID NO: 655508 - DNA, 25 bp, Rattus norvegicus
ttgagctgcgcgctatgtaacaccc

SEQ ID NO: 655509 - DNA, 25 bp, Rattus norvegicus
ggagcttcaaccagtcggcgccata

SEQ ID NO: 655510 - DNA, 25 bp, Rattus norvegicus
atcagtactctctggccgggcatcc

SEQ ID NO: 655511 - DNA, 25 bp, Rattus norvegicus
tgtgcgcgtaagaagcagcagttct

SEQ ID NO: 655512 - DNA, 25 bp, Rattus norvegicus
aggcccgtacagcacagaggaccgc

SEQ ID NO: 655513 - DNA, 25 bp, Rattus norvegicus
ggggatgctctgctaccagcgaccc

SEQ ID NO: 655514 - DNA, 25 bp, Rattus norvegicus
agccatctgatcctcggggatgctc

SEQ ID NO: 655515 - DNA, 25 bp, Rattus norvegicus
gctgtcaagggcagaagccatctga

SEQ ID NO: 655516 - DNA, 25 bp, Rattus norvegicus
cctagtccttttgcgccgagctgag

SEQ ID NO: 655517 - DNA, 25 bp, Rattus norvegicus
aaggcgacgcttgccctagtccttt

SEQ ID NO: 655518 - DNA, 25 bp, Rattus norvegicus
cctttgagcgccaaggcgacgcttg

SEQ ID NO: 655519 - DNA, 25 bp, Rattus norvegicus
gaaactcttcggtgtcctgcctttg

SEQ ID NO: 655520 - DNA, 25 bp, Rattus norvegicus
atgctgaagccggagtcggcgtaac

SEQ ID NO: 655521 - DNA, 25 bp, Rattus norvegicus
cgcggcagtgctccatcagtactct

SEQ ID NO: 655522 - DNA, 25 bp, Rattus norvegicus
tgcatcttctgttcacgcgccaagg

SEQ ID NO: 655523 - DNA, 25 bp, Rattus norvegicus
gagcgtagccacctcagaacccggt

SEQ ID NO: 655524 - DNA, 25 bp, Rattus norvegicus
actgcggaaacgtaaggcctatgcc

SEQ ID NO: 655525 - DNA, 25 bp, Rattus norvegicus
actagccggcacctgtagtcccttt

SEQ ID NO: 655526 - DNA, 25 bp, Rattus norvegicus
aagcctcagggacgccgcttggcaa

SEQ ID NO: 655527 - DNA, 25 bp, Rattus norvegicus
agtgcacaccctcctgccggaattg

SEQ ID NO: 655528 - DNA, 25 bp, Rattus norvegicus
cggaattggtcttcacgcccgctct

SEQ ID NO: 655529 - DNA, 25 bp, Rattus norvegicus
tcctaagaagtctgtgggctgactc

SEQ ID NO: 655530 - DNA, 25 bp, Rattus norvegicus
ttcggcttttccgtactctctcaca

SEQ ID NO: 655531 - DNA, 25 bp, Rattus norvegicus
tcgtacgctttccagtcaagccagc

SEQ ID NO: 655532 - DNA, 25 bp, Rattus norvegicus
ggaactctccacagtggcggtgctc

SEQ ID NO: 655533 - DNA, 25 bp, Rattus norvegicus
taatccctgactcagaggccgctcg

SEQ ID NO: 655534 - DNA, 25 bp, Rattus norvegicus
ctgacggcttgctccacgcataatc

SEQ ID NO: 655535 - DNA, 25 bp, Rattus norvegicus
gtgttggttctcaccgcccgaaatg

SEQ ID NO: 655536 - DNA, 25 bp, Rattus norvegicus
cgcgttcttaggcaggtgactagcc

SEQ ID NO: 655537 - DNA, 25 bp, Rattus norvegicus
ggcctatgcctaatcctctaatggg

SEQ ID NO: 655538 - DNA, 25 bp, Rattus norvegicus
gcggatcgcgctacccaagcgttct

SEQ ID NO: 655539 - DNA, 25 bp, Rattus norvegicus
accgcaggcgtgtctcttggtcgca

SEQ ID NO: 655540 - DNA, 25 bp, Rattus norvegicus
tggcagtgctcacgcagcgcgtcag

SEQ ID NO: 655541 - DNA, 25 bp, Rattus norvegicus
agagctcagctagcagcgccgctcg

SEQ ID NO: 655542 - DNA, 25 bp, Rattus norvegicus
gcccagaagcgaaggaggtgatcct

SEQ ID NO: 655543 - DNA, 25 bp, Rattus norvegicus
tctccgaggccatagtgccactgca

SEQ ID NO: 655544 - DNA, 25 bp, Rattus norvegicus
tagtgccactgcagcagcaggctca

SEQ ID NO: 655545 - DNA, 25 bp, Rattus norvegicus
caggctcagcccgtactcgtgactt

SEQ ID NO: 655546 - DNA, 25 bp, Rattus norvegicus
actcgtgactttctgaccgatgtca

SEQ ID NO: 655547 - DNA, 25 bp, Rattus norvegicus
accgatgtcacgagaccaggccagc

SEQ ID NO: 655548 - DNA, 25 bp, Rattus norvegicus
ccaggccagctgcacggatcacagt

SEQ ID NO: 655549 - DNA, 25 bp, Rattus norvegicus
ggctccacttcggtcctctttggct

SEQ ID NO: 655550 - DNA, 25 bp, Rattus norvegicus
gtaggcactaactcttccggtcgca

SEQ ID NO: 655551 - DNA, 25 bp, Rattus norvegicus
agcgcgtcagcctccagtgaggaga

SEQ ID NO: 655552 - DNA, 25 bp, Rattus norvegicus
attggcttgtttgcgcctcttgcac

SEQ ID NO: 655553 - DNA, 25 bp, Rattus norvegicus
ttcctcctgggattggcttgtttgc

SEQ ID NO: 655554 - DNA, 25 bp, Rattus norvegicus
caagaaactttgaggctggcggaga

SEQ ID NO: 655555 - DNA, 25 bp, Rattus norvegicus
ccggcgactccagcaagaaactttg

SEQ ID NO: 655556 - DNA, 25 bp, Rattus norvegicus
cgcggaccgttacttggcgcacaga

SEQ ID NO: 655557 - DNA, 25 bp, Rattus norvegicus
tcccggccgtagaggagcaactacc

SEQ ID NO: 655558 - DNA, 25 bp, Rattus norvegicus
ggccatccgccatgatcggctgctt

SEQ ID NO: 655559 - DNA, 25 bp, Rattus norvegicus
gctgcttcattgataagagcggatc

SEQ ID NO: 655560 - DNA, 25 bp, Rattus norvegicus
agagcggatcagatggcagttagca

SEQ ID NO: 655561 - DNA, 25 bp, Rattus norvegicus
gcagttagcatggactcggcgccct

SEQ ID NO: 655562 - DNA, 25 bp, Rattus norvegicus
ctgcttcggcagcacgcaggctcga

SEQ ID NO: 655563 - DNA, 25 bp, Rattus norvegicus
gcaggctcgatctagcaaccaaaca

SEQ ID NO: 655564 - DNA, 25 bp, Rattus norvegicus
cagcgacaatgtgggcatcgtccgc

SEQ ID NO: 655565 - DNA, 25 bp, Rattus norvegicus
agcaactaccgggaaaagtctctgt

SEQ ID NO: 655566 - DNA, 25 bp, Rattus norvegicus
gtcaccagaaaacttgcagcaagtt

SEQ ID NO: 655567 - DNA, 25 bp, Rattus norvegicus
gtggagtcaccagaaaacttgcagc

SEQ ID NO: 655568 - DNA, 25 bp, Rattus norvegicus
aaaaggggctctggtggagtcacca

SEQ ID NO: 655569 - DNA, 25 bp, Rattus norvegicus
tccacgcgactgtcagtctcacaaa

SEQ ID NO: 655570 - DNA, 25 bp, Rattus norvegicus
gctgtgcctggaaaagcctcctcca

SEQ ID NO: 655571 - DNA, 25 bp, Rattus norvegicus
attatcatgagaaaggctgtgcctg

SEQ ID NO: 655572 - DNA, 25 bp, Rattus norvegicus
gggctgattatcatgagaaaggctg

SEQ ID NO: 655573 - DNA, 25 bp, Rattus norvegicus
cgcgaacttcgctcccaccgtcggt

SEQ ID NO: 655574 - DNA, 25 bp, Rattus norvegicus
atttattgatgcaaagcaggtctgc

SEQ ID NO: 655575 - DNA, 25 bp, Rattus norvegicus
ggactcaaatgagcatcttaattta

SEQ ID NO: 655576 - DNA, 25 bp, Rattus norvegicus
accagcaaacttcaggactcaaatg

SEQ ID NO: 655577 - DNA, 25 bp, Rattus norvegicus
ctactgacaggaaccagcaaacttc

SEQ ID NO: 655578 - DNA, 25 bp, Rattus norvegicus
tttgccaacgtctctactgacagga

SEQ ID NO: 655579 - DNA, 25 bp, Rattus norvegicus
tttggggtgtttgccaacgtctcta

SEQ ID NO: 655580 - DNA, 25 bp, Rattus norvegicus
cccaccgcaaggtttctggaactca

SEQ ID NO: 655581 - DNA, 25 bp, Rattus norvegicus
cgcgccactccctccctaccgcaca

SEQ ID NO: 655582 - DNA, 25 bp, Rattus norvegicus
gtcgctgcactagcccggtgctggc

SEQ ID NO: 655583 - DNA, 25 bp, Rattus norvegicus
cacacgcgggctgtcgctgcactag

SEQ ID NO: 655584 - DNA, 25 bp, Rattus norvegicus
atctcactcagaaggcacacgcggg

SEQ ID NO: 655585 - DNA, 25 bp, Rattus norvegicus
gtcaggccggttggatcccaggaaa

SEQ ID NO: 655586 - DNA, 25 bp, Rattus norvegicus
aggtttctggaactcagcgctgatg

SEQ ID NO: 655587 - DNA, 25 bp, Rattus norvegicus
aggtcctgcccaccgcaaggtttct

SEQ ID NO: 655588 - DNA, 25 bp, Rattus norvegicus
acatcaaccatcgagccaggtcctg

SEQ ID NO: 655589 - DNA, 25 bp, Rattus norvegicus
gcaaactgaacatcaaccatcgagc

SEQ ID NO: 655590 - DNA, 25 bp, Rattus norvegicus
gcacagagtcgcagcaaactgaaca

SEQ ID NO: 655591 - DNA, 25 bp, Rattus norvegicus
gttacgcgttaacgggcacagagtc

SEQ ID NO: 655592 - DNA, 25 bp, Rattus norvegicus
gcagttacgcgttaacgggcacaga

SEQ ID NO: 655593 - DNA, 25 bp, Rattus norvegicus
aactcagcgctgatggggtcaggcc

SEQ ID NO: 655594 - DNA, 25 bp, Rattus norvegicus
ggaccacacggccaatccgatgata

SEQ ID NO: 655595 - DNA, 25 bp, Rattus norvegicus
acgatcgaccgcacggaaccacgga

SEQ ID NO: 655596 - DNA, 25 bp, Rattus norvegicus
aacggactggaaccgatttccactg

SEQ ID NO: 655597 - DNA, 25 bp, Rattus norvegicus
atggacggatggatcgactggacac

SEQ ID NO: 655598 - DNA, 25 bp, Rattus norvegicus
actgacacgacgacatggacggatg

SEQ ID NO: 655599 - DNA, 25 bp, Rattus norvegicus
gcaaccgcaatgaactgacacgacg

SEQ ID NO: 655600 - DNA, 25 bp, Rattus norvegicus
cgcaaatctaaacgcaaccgcaatg

SEQ ID NO: 655601 - DNA, 25 bp, Rattus norvegicus
acggccaatccgatgataccgatcg

SEQ ID NO: 655602 - DNA, 25 bp, Rattus norvegicus
accaatccaatccaacgcaaatcta

SEQ ID NO: 655603 - DNA, 25 bp, Rattus norvegicus
cactgacggacgatacgacgaactc

SEQ ID NO: 655604 - DNA, 25 bp, Rattus norvegicus
cgacgaactcgcaacgaacaaccga

SEQ ID NO: 655605 - DNA, 25 bp, Rattus norvegicus
tcgactggacacgatcgaccgcacg

SEQ ID NO: 655606 - DNA, 25 bp, Rattus norvegicus
caacgaacaaccgaactcacacgga

SEQ ID NO: 655607 - DNA, 25 bp, Rattus norvegicus
aaccgatttccactgacggacgata

SEQ ID NO: 655608 - DNA, 25 bp, Rattus norvegicus
gttccctgggtcttcctcggagaca

SEQ ID NO: 655609 - DNA, 25 bp, Rattus norvegicus
tgtcaaaatcactgtcagctccgct

SEQ ID NO: 655610 - DNA, 25 bp, Rattus norvegicus
cgcctctcgcgtctcagtgaacaaa

SEQ ID NO: 655611 - DNA, 25 bp, Rattus norvegicus
cggccaagttctggtccaggctgtg

SEQ ID NO: 655612 - DNA, 25 bp, Rattus norvegicus
ctgcgggacccaagaccgagctgac

SEQ ID NO: 655613 - DNA, 25 bp, Rattus norvegicus
ggagcaaaaacgttcacagggtcga

SEQ ID NO: 655614 - DNA, 25 bp, Rattus norvegicus
tcctggtgtaaaatcaaccgtcata

SEQ ID NO: 655615 - DNA, 25 bp, Rattus norvegicus
gcgggttggaatcactgtcaaaatc

SEQ ID NO: 655616 - DNA, 25 bp, Rattus norvegicus
cctcggagacaaacctcctggtgta

SEQ ID NO: 655617 - DNA, 25 bp, Rattus norvegicus
tctcgctagatatccagttccctgg

SEQ ID NO: 655618 - DNA, 25 bp, Rattus norvegicus
agccgtaggaagttctcgctagata

SEQ ID NO: 655619 - DNA, 25 bp, Rattus norvegicus
tcccattttcccgaggcgccggaga

SEQ ID NO: 655620 - DNA, 25 bp, Rattus norvegicus
tttgcagcagctcccattttcccga

SEQ ID NO: 655621 - DNA, 25 bp, Rattus norvegicus
gacggcgaacgccaactttgcagca

SEQ ID NO: 655622 - DNA, 25 bp, Rattus norvegicus
cttacgctgccgtaaggggaccctg

SEQ ID NO: 655623 - DNA, 25 bp, Rattus norvegicus
ccgccatgttgttgcgtcccagtgt

SEQ ID NO: 655624 - DNA, 25 bp, Rattus norvegicus
aaggggcaccgggactcagctcgct

SEQ ID NO: 655625 - DNA, 25 bp, Rattus norvegicus
ccgctgtggtaatgtccgccatgtt

SEQ ID NO: 655626 - DNA, 25 bp, Rattus norvegicus
tcggtagggactcgagtgtttatta

SEQ ID NO: 655627 - DNA, 25 bp, Rattus norvegicus
cacagagcgctctacgctcgctgga

SEQ ID NO: 655628 - DNA, 25 bp, Rattus norvegicus
gcacttggcgtacggcctctgttta

SEQ ID NO: 655629 - DNA, 25 bp, Rattus norvegicus
gagtagcgtaaacctgtcggccggc

SEQ ID NO: 655630 - DNA, 25 bp, Rattus norvegicus
aggggtcttttgactaggcgatatt

SEQ ID NO: 655631 - DNA, 25 bp, Rattus norvegicus
tgcgtcccagtgttgtgattagctc

SEQ ID NO: 655632 - DNA, 25 bp, Rattus norvegicus
gtgattagctctcggcgccgcttac

SEQ ID NO: 655633 - DNA, 25 bp, Rattus norvegicus
cctgccgtaagcagcgaccgggaat

SEQ ID NO: 655634 - DNA, 25 bp, Rattus norvegicus
ggcctctgtttaccttgtagacatc

SEQ ID NO: 655635 - DNA, 25 bp, Rattus norvegicus
acgccggcggagtagcgtaaacctg

SEQ ID NO: 655636 - DNA, 25 bp, Rattus norvegicus
atcaaagtgatgtgccggttccggc

SEQ ID NO: 655637 - DNA, 25 bp, Rattus norvegicus
caccattgcttgagtggagatattc

SEQ ID NO: 655638 - DNA, 25 bp, Rattus norvegicus
ggagatattccggacgctacctcgg

SEQ ID NO: 655639 - DNA, 25 bp, Rattus norvegicus
cgctcacacccagggcgaggcggat

SEQ ID NO: 655640 - DNA, 25 bp, Rattus norvegicus
aggcggatctctgcagtgacgtcac

SEQ ID NO: 655641 - DNA, 25 bp, Rattus norvegicus
gcagtgacgtcaccgtaccgaggcg

SEQ ID NO: 655642 - DNA, 25 bp, Rattus norvegicus
gggattgctccctaagcatcgccta

SEQ ID NO: 655643 - DNA, 25 bp, Rattus norvegicus
cttgcgatgacctgctgagaagctg

SEQ ID NO: 655644 - DNA, 25 bp, Rattus norvegicus
tacgagagcccttggttggtgactc

SEQ ID NO: 655645 - DNA, 25 bp, Rattus norvegicus
ggatccagccgaatgcagcatcaaa

SEQ ID NO: 655646 - DNA, 25 bp, Rattus norvegicus
tcgggtgggcctattgttcccactc

SEQ ID NO: 655647 - DNA, 25 bp, Rattus norvegicus
cccaaattcaaaggcgaggagacgg

SEQ ID NO: 655648 - DNA, 25 bp, Rattus norvegicus
gcctctttggtggagctgcccagcc

SEQ ID NO: 655649 - DNA, 25 bp, Rattus norvegicus
ctcgcgggtgaaccgtacgagagcc

SEQ ID NO: 655650 - DNA, 25 bp, Rattus norvegicus
tcaaggacccgtatttaaagagaca

SEQ ID NO: 655651 - DNA, 25 bp, Rattus norvegicus
aagttgaactcctatccgcccggag

SEQ ID NO: 655652 - DNA, 25 bp, Rattus norvegicus
cccacaatactcagttcaaggcttc

SEQ ID NO: 655653 - DNA, 25 bp, Rattus norvegicus
tcagttcaaggcttccgggccggaa

SEQ ID NO: 655654 - DNA, 25 bp, Rattus norvegicus
cgggccggaacagaacagcgacaca

SEQ ID NO: 655655 - DNA, 25 bp, Rattus norvegicus
aacagcgacacacgtggcgaccgga

SEQ ID NO: 655656 - DNA, 25 bp, Rattus norvegicus
agcacaagtcggttactgcgcctgc

SEQ ID NO: 655657 - DNA, 25 bp, Rattus norvegicus
tgcgcactgcctccggttcaaggac

SEQ ID NO: 655658 - DNA, 25 bp, Rattus norvegicus
acaggaggtctagtcatcgtgcaag

SEQ ID NO: 655659 - DNA, 25 bp, Rattus norvegicus
cagagcggcgtgctgcttgctcttc

SEQ ID NO: 655660 - DNA, 25 bp, Rattus norvegicus
ccctgtagttagttgtcgtatcccg

SEQ ID NO: 655661 - DNA, 25 bp, Rattus norvegicus
tcgtatcccgggctggacgacacgg

SEQ ID NO: 655662 - DNA, 25 bp, Rattus norvegicus
gtcatcgtgcaaggcccgtggcctt

SEQ ID NO: 655663 - DNA, 25 bp, Rattus norvegicus
acccaccctaatctgcggaaagttg

SEQ ID NO: 655664 - DNA, 25 bp, Rattus norvegicus
ggtcacagtcatcgccagcccggag

SEQ ID NO: 655665 - DNA, 25 bp, Rattus norvegicus
cgactgtacggccaagtgcgagcca

SEQ ID NO: 655666 - DNA, 25 bp, Rattus norvegicus
cggggtagcgcagctgcccacatct

SEQ ID NO: 655667 - DNA, 25 bp, Rattus norvegicus
gctgcggcgagcactgcgaaacgcc

SEQ ID NO: 655668 - DNA, 25 bp, Rattus norvegicus
cagtgacgccgggattggaagctaa

SEQ ID NO: 655669 - DNA, 25 bp, Rattus norvegicus
accgcgtgcggagcccacagagcag

SEQ ID NO: 655670 - DNA, 25 bp, Rattus norvegicus
gtacggccaagtgcgagccagctcc

SEQ ID NO: 655671 - DNA, 25 bp, Rattus norvegicus
cccacgtgtggagctcacctgtcgg

SEQ ID NO: 655672 - DNA, 25 bp, Rattus norvegicus
gcttcgtgccactgggcgcaggacc

SEQ ID NO: 655673 - DNA, 25 bp, Rattus norvegicus
gcattcaccgggcttcgtgccactg

SEQ ID NO: 655674 - DNA, 25 bp, Rattus norvegicus
ggagcttgactttgttgttaaatca

SEQ ID NO: 655675 - DNA, 25 bp, Rattus norvegicus
gttaaatcactaaccagcacattgg

SEQ ID NO: 655676 - DNA, 25 bp, Rattus norvegicus
accagcacattggttagtttagtta

SEQ ID NO: 655677 - DNA, 25 bp, Rattus norvegicus
gcgctgcctggagcttgactttgtt

SEQ ID NO: 655678 - DNA, 25 bp, Rattus norvegicus
ctgagcaaacagatcgccgtggatg

SEQ ID NO: 655679 - DNA, 25 bp, Rattus norvegicus
ctccgcggagggatgcaaatgtcag

SEQ ID NO: 655680 - DNA, 25 bp, Rattus norvegicus
acgcgtagcatagctgctggccgaa

SEQ ID NO: 655681 - DNA, 25 bp, Rattus norvegicus
actcccgcaggagtgagttcccagg

SEQ ID NO: 655682 - DNA, 25 bp, Rattus norvegicus
gcaaatgtcaggagctgcaagttca

SEQ ID NO: 655683 - DNA, 25 bp, Rattus norvegicus
agctgcgcagctagcgctgagcaga

SEQ ID NO: 655684 - DNA, 25 bp, Rattus norvegicus
cactgcgttccgtacaaggcgaaga

SEQ ID NO: 655685 - DNA, 25 bp, Rattus norvegicus
cgctgattggtcctgcgaccctcga

SEQ ID NO: 655686 - DNA, 25 bp, Rattus norvegicus
ggctcctcctgtacacgctgattgg

SEQ ID NO: 655687 - DNA, 25 bp, Rattus norvegicus
caggccaatgaaggcgtcccgcaga

SEQ ID NO: 655688 - DNA, 25 bp, Rattus norvegicus
agtttccagacttggcctcagggcc

SEQ ID NO: 655689 - DNA, 25 bp, Rattus norvegicus
acggacctccgcctgagtttccaga

SEQ ID NO: 655690 - DNA, 25 bp, Rattus norvegicus
tgcgctcaggaagggacctgcaacc

SEQ ID NO: 655691 - DNA, 25 bp, Rattus norvegicus
tcaaggctagcgaagctttcctggc

SEQ ID NO: 655692 - DNA, 25 bp, Rattus norvegicus
gggtgggaaccatccgtaccagtca

SEQ ID NO: 655693 - DNA, 25 bp, Rattus norvegicus
tccgagcgcatcgatgctgtcggtc

SEQ ID NO: 655694 - DNA, 25 bp, Rattus norvegicus
gttgacgcccagacctgagtagttg

SEQ ID NO: 655695 - DNA, 25 bp, Rattus norvegicus
tccaggcaggcgctgttgacgccca

SEQ ID NO: 655696 - DNA, 25 bp, Rattus norvegicus
cactgtcaaaatggcggtccaggca

SEQ ID NO: 655697 - DNA, 25 bp, Rattus norvegicus
cctcaacacgtccactgtcaaaatg

SEQ ID NO: 655698 - DNA, 25 bp, Rattus norvegicus
cccgtgaaagtgcagaagagaccgc

SEQ ID NO: 655699 - DNA, 25 bp, Rattus norvegicus
cggtcacccgtgaaagtgcagaaga

SEQ ID NO: 655700 - DNA, 25 bp, Rattus norvegicus
ataccgacagcaggggcacggtcac

SEQ ID NO: 655701 - DNA, 25 bp, Rattus norvegicus
catcgatgctgtcggtcgatcttcg

SEQ ID NO: 655702 - DNA, 25 bp, Rattus norvegicus
acctgagtagttgcctccgagcgca

SEQ ID NO: 655703 - DNA, 25 bp, Rattus norvegicus
cgcgagcagaagaaccctgggcaga

SEQ ID NO: 655704 - DNA, 25 bp, Rattus norvegicus
gcgtcaccgagaacccgtgggaaca

SEQ ID NO: 655705 - DNA, 25 bp, Rattus norvegicus
tggaccggggcaataccgacagcag

SEQ ID NO: 655706 - DNA, 25 bp, Rattus norvegicus
acagcagctattgtcgccactgggc

SEQ ID NO: 655707 - DNA, 25 bp, Rattus norvegicus
ctggggaccagtcatccctgcagca

SEQ ID NO: 655708 - DNA, 25 bp, Rattus norvegicus
ccctactgcaggagaaatcaaactg

SEQ ID NO: 655709 - DNA, 25 bp, Rattus norvegicus
ttaatgaaaactgacgcggcggcga

SEQ ID NO: 655710 - DNA, 25 bp, Rattus norvegicus
tcctggagagaaagcctctgccttc

SEQ ID NO: 655711 - DNA, 25 bp, Rattus norvegicus
tggctacctgaccttcgagcgtttc

SEQ ID NO: 655712 - DNA, 25 bp, Rattus norvegicus
ctacgtgcacctgcgcgagatcgag

SEQ ID NO: 655713 - DNA, 25 bp, Rattus norvegicus
ttcgacatcctggacgaccggcagc

SEQ ID NO: 655714 - DNA, 25 bp, Rattus norvegicus
ttctgccctctggtcttgcgggtac

SEQ ID NO: 655715 - DNA, 25 bp, Rattus norvegicus
cgagcagtgctccattcaaaaacag

SEQ ID NO: 655716 - DNA, 25 bp, Rattus norvegicus
ccaatagccgcagtgaatgttaatg

SEQ ID NO: 655717 - DNA, 25 bp, Rattus norvegicus
gcagatgggccagcttcgaccaata

SEQ ID NO: 655718 - DNA, 25 bp, Rattus norvegicus
tcaaactgagactggtggctgccga

SEQ ID NO: 655719 - DNA, 25 bp, Rattus norvegicus
ccggaatcctgagctgttgtgtgtc

SEQ ID NO: 655720 - DNA, 25 bp, Rattus norvegicus
ttccacggtgctctgcatgctccag

SEQ ID NO: 655721 - DNA, 25 bp, Rattus norvegicus
tgcaacccgagggtttcgaggatct

SEQ ID NO: 655722 - DNA, 25 bp, Rattus norvegicus
caccaccagcgcattcctgagagta

SEQ ID NO: 655723 - DNA, 25 bp, Rattus norvegicus
cgcattcctgagagtaggcgtcacg

SEQ ID NO: 655724 - DNA, 25 bp, Rattus norvegicus
tggctccggccattcacccatctcc

SEQ ID NO: 655725 - DNA, 25 bp, Rattus norvegicus
ctgagccaccctggcggctcgctcc

SEQ ID NO: 655726 - DNA, 25 bp, Rattus norvegicus
cggaacccgcatgcaacccgagggt

SEQ ID NO: 655727 - DNA, 25 bp, Rattus norvegicus
cgagggtttcgaggatcttctccca

SEQ ID NO: 655728 - DNA, 25 bp, Rattus norvegicus
ttcgaggatcttctcccagctcagc

SEQ ID NO: 655729 - DNA, 25 bp, Rattus norvegicus
cccgagaccagatggctgataacac

SEQ ID NO: 655730 - DNA, 25 bp, Rattus norvegicus
atggctgataacacccacgaggggc

SEQ ID NO: 655731 - DNA, 25 bp, Rattus norvegicus
cggagggttccacggtgctctgcat

SEQ ID NO: 655732 - DNA, 25 bp, Rattus norvegicus
tgctctgcatgctccagcactgagc

SEQ ID NO: 655733 - DNA, 25 bp, Rattus norvegicus
ataacacccacgaggggcttcctgg

SEQ ID NO: 655734 - DNA, 25 bp, Rattus norvegicus
tgtctcccggagagcagacggacgc

SEQ ID NO: 655735 - DNA, 25 bp, Rattus norvegicus
ggacgcctacctaactctgaccagg

SEQ ID NO: 655736 - DNA, 25 bp, Rattus norvegicus
ttcagggtggccgacatgacggccc

SEQ ID NO: 655737 - DNA, 25 bp, Rattus norvegicus
ccatgcctacggagtgacgttgcgg

SEQ ID NO: 655738 - DNA, 25 bp, Rattus norvegicus
cgggcagcaggccatcgagcagccc

SEQ ID NO: 655739 - DNA, 25 bp, Rattus norvegicus
ctaactctgaccaggtgaggcgggc

SEQ ID NO: 655740 - DNA, 25 bp, Rattus norvegicus
gagagcagacggacgcctacctaac

SEQ ID NO: 655741 - DNA, 25 bp, Rattus norvegicus
ccgcttctggagacatgggaggacc

SEQ ID NO: 655742 - DNA, 25 bp, Rattus norvegicus
tcttccggcctcacttcagggtggc

SEQ ID NO: 655743 - DNA, 25 bp, Rattus norvegicus
gtcactggtgtcttccggcctcact

SEQ ID NO: 655744 - DNA, 25 bp, Rattus norvegicus
ctgtgccaccggtcactggtgtctt

SEQ ID NO: 655745 - DNA, 25 bp, Rattus norvegicus
ttggattggctcgagcctctcccgc

SEQ ID NO: 655746 - DNA, 25 bp, Rattus norvegicus
gccaccgcccgttggattggctcga

SEQ ID NO: 655747 - DNA, 25 bp, Rattus norvegicus
gcgcaccgggccatgcctacggagt

SEQ ID NO: 655748 - DNA, 25 bp, Rattus norvegicus
aattcccatcctcgggcagcggagc

SEQ ID NO: 655749 - DNA, 25 bp, Rattus norvegicus
accagacgagtccagcactagttcc

SEQ ID NO: 655750 - DNA, 25 bp, Rattus norvegicus
ttgtctgctcgagcctcgtgggcca

SEQ ID NO: 655751 - DNA, 25 bp, Rattus norvegicus
tccgcattctgcaaactgtgggctc

SEQ ID NO: 655752 - DNA, 25 bp, Rattus norvegicus
ccagctgttgtcagtgcggcccaaa

SEQ ID NO: 655753 - DNA, 25 bp, Rattus norvegicus
agtgcggcccaaacacaactgccgg

SEQ ID NO: 655754 - DNA, 25 bp, Rattus norvegicus
agcaggacacctttcgcgctcgcga

SEQ ID NO: 655755 - DNA, 25 bp, Rattus norvegicus
cgatcaaatcggagcaatgggtgta

SEQ ID NO: 655756 - DNA, 25 bp, Rattus norvegicus
ctcaccctggtgattgaacagtctc

SEQ ID NO: 655757 - DNA, 25 bp, Rattus norvegicus
accactattccgcagcgagggtctc

SEQ ID NO: 655758 - DNA, 25 bp, Rattus norvegicus
ccgggtgaagagaattcccatcctc

SEQ ID NO: 655759 - DNA, 25 bp, Rattus norvegicus
gagcctcccgaagcgaaccagacga

SEQ ID NO: 655760 - DNA, 25 bp, Rattus norvegicus
aacagtctccagatccgggtgaaga

SEQ ID NO: 655761 - DNA, 25 bp, Rattus norvegicus
gcactagttccagttttccgcattc

SEQ ID NO: 655762 - DNA, 25 bp, Rattus norvegicus
acgacatggttcagaggcgccgcat

SEQ ID NO: 655763 - DNA, 25 bp, Rattus norvegicus
ctacctgtctgaggatgaagctggt

SEQ ID NO: 655764 - DNA, 25 bp, Rattus norvegicus
gagctgggtggtcccgagcacccac

SEQ ID NO: 655765 - DNA, 25 bp, Rattus norvegicus
ggctggagtcctccttgggaaccgc

SEQ ID NO: 655766 - DNA, 25 bp, Rattus norvegicus
caaagaagccagtgaggaccgcagc

SEQ ID NO: 655767 - DNA, 25 bp, Rattus norvegicus
accggggccacaaagaagccagtga

SEQ ID NO: 655768 - DNA, 25 bp, Rattus norvegicus
tgaactcgacacaccggggccacaa

SEQ ID NO: 655769 - DNA, 25 bp, Rattus norvegicus
ggtgcctcgggccacctgaactcga

SEQ ID NO: 655770 - DNA, 25 bp, Rattus norvegicus
ctgcggacactgaagcccgagcgct

SEQ ID NO: 655771 - DNA, 25 bp, Rattus norvegicus
gagcgccgcaccttaaaggggccga

SEQ ID NO: 655772 - DNA, 25 bp, Rattus norvegicus
atccattaacaaagcgtcgcgggtg

SEQ ID NO: 655773 - DNA, 25 bp, Rattus norvegicus
cgagccttggggagaagtgctctcc

SEQ ID NO: 655774 - DNA, 25 bp, Rattus norvegicus
gatcttttcaacctgctcctccggg

SEQ ID NO: 655775 - DNA, 25 bp, Rattus norvegicus
agtggtgctgccatcggatcttttc

SEQ ID NO: 655776 - DNA, 25 bp, Rattus norvegicus
cgacaactgatcaggcacggcagcc

SEQ ID NO: 655777 - DNA, 25 bp, Rattus norvegicus
cgcggctctggaatgtcgtttcctc

SEQ ID NO: 655778 - DNA, 25 bp, Rattus norvegicus
ttatccgagtacttcctgggtgcca

SEQ ID NO: 655779 - DNA, 25 bp, Rattus norvegicus
gtgccaggtctggtcttgctactcc

SEQ ID NO: 655780 - DNA, 25 bp, Rattus norvegicus
cacagtcacctttccgcagtgagga

SEQ ID NO: 655781 - DNA, 25 bp, Rattus norvegicus
cacatcttgctcgaatgggttggca

SEQ ID NO: 655782 - DNA, 25 bp, Rattus norvegicus
ttggcagtgaacagaggcattgcgc

SEQ ID NO: 655783 - DNA, 25 bp, Rattus norvegicus
gccggcaacgggagctgaatcccga

SEQ ID NO: 655784 - DNA, 25 bp, Rattus norvegicus
ttcctagaccgcttggccgagccgt

SEQ ID NO: 655785 - DNA, 25 bp, Rattus norvegicus
cagaacgctccgctgagtgctagca

SEQ ID NO: 655786 - DNA, 25 bp, Rattus norvegicus
gtgctagcaccctgtaatggcctca

SEQ ID NO: 655787 - DNA, 25 bp, Rattus norvegicus
tggcctcactgctgttccaaggacg

SEQ ID NO: 655788 - DNA, 25 bp, Rattus norvegicus
tcgctctctgccgaggttcctaggc

SEQ ID NO: 655789 - DNA, 25 bp, Rattus norvegicus
ccggagagcctgcagatccagagaa

SEQ ID NO: 655790 - DNA, 25 bp, Rattus norvegicus
gatgacccggctcctcgggtacgga

SEQ ID NO: 655791 - DNA, 25 bp, Rattus norvegicus
tggacgcccagctcttggcctgcag

SEQ ID NO: 655792 - DNA, 25 bp, Rattus norvegicus
attgtgtcggccagccgtccgcgat

SEQ ID NO: 655793 - DNA, 25 bp, Rattus norvegicus
agcaccatgtggatcggcgcccagc

SEQ ID NO: 655794 - DNA, 25 bp, Rattus norvegicus
tccggcacgcaaccgacatgggcaa

SEQ ID NO: 655795 - DNA, 25 bp, Rattus norvegicus
catggactcgcagcagaccgatttc

SEQ ID NO: 655796 - DNA, 25 bp, Rattus norvegicus
tttcagggcgcacaacgtgccattg

SEQ ID NO: 655797 - DNA, 25 bp, Rattus norvegicus
tgccattgaagctgccgatgcccga

SEQ ID NO: 655798 - DNA, 25 bp, Rattus norvegicus
cgatgcccgagccaggtgaactgga

SEQ ID NO: 655799 - DNA, 25 bp, Rattus norvegicus
tttgccatcgtgctggtgagtacgc

SEQ ID NO: 655800 - DNA, 25 bp, Rattus norvegicus
tctctgcttgcactctccaggggtc

SEQ ID NO: 655801 - DNA, 25 bp, Rattus norvegicus
caggaacccattgtctggcggcagc

SEQ ID NO: 655802 - DNA, 25 bp, Rattus norvegicus
gaccctctgcgtagcatctcctgga

SEQ ID NO: 655803 - DNA, 25 bp, Rattus norvegicus
tgaactggaggagcgctttgccatc

SEQ ID NO: 655804 - DNA, 25 bp, Rattus norvegicus
ggagcgcagctggatcctcaaaccg

SEQ ID NO: 655805 - DNA, 25 bp, Rattus norvegicus
cggtctagagggcaagcctccgcga

SEQ ID NO: 655806 - DNA, 25 bp, Rattus norvegicus
caccatagagaggaatcgggtacgc

SEQ ID NO: 655807 - DNA, 25 bp, Rattus norvegicus
gcccgcgacaccatagagaggaatc

SEQ ID NO: 655808 - DNA, 25 bp, Rattus norvegicus
cgcgcccgcgacaccatagagagga

SEQ ID NO: 655809 - DNA, 25 bp, Rattus norvegicus
cccgtcctgcgtgcggccctgccct

SEQ ID NO: 655810 - DNA, 25 bp, Rattus norvegicus
ggtgccagcaccacatccttacggg

SEQ ID NO: 655811 - DNA, 25 bp, Rattus norvegicus
cggccgccgcaactccgcggctgag

SEQ ID NO: 655812 - DNA, 25 bp, Rattus norvegicus
cccactgcggccactcaggcagcgg

SEQ ID NO: 655813 - DNA, 25 bp, Rattus norvegicus
acctgggacggcaaagcccagatcc

SEQ ID NO: 655814 - DNA, 25 bp, Rattus norvegicus
cgggccacacctgggacggcaaagc

SEQ ID NO: 655815 - DNA, 25 bp, Rattus norvegicus
tggagcacccaatcctccggcccga

SEQ ID NO: 655816 - DNA, 25 bp, Rattus norvegicus
cggagcactgcctggagcacccaat

SEQ ID NO: 655817 - DNA, 25 bp, Rattus norvegicus
tagagggcaagcctccgcgagcgcc

SEQ ID NO: 655818 - DNA, 25 bp, Rattus norvegicus
ggccaaagggtaaaggctgccctga

SEQ ID NO: 655819 - DNA, 25 bp, Rattus norvegicus
ccgccatgtcctttgtggagagttg

SEQ ID NO: 655820 - DNA, 25 bp, Rattus norvegicus
ggtctctcagtctttcccgccatgt

SEQ ID NO: 655821 - DNA, 25 bp, Rattus norvegicus
agctgcctggaaacccgctggtgca

SEQ ID NO: 655822 - DNA, 25 bp, Rattus norvegicus
tcacacggcacatccgctagcggag

SEQ ID NO: 655823 - DNA, 25 bp, Rattus norvegicus
attaagcagtgcttctccgcgggcc

SEQ ID NO: 655824 - DNA, 25 bp, Rattus norvegicus
cggtgcgtgccaataggaccggaaa

SEQ ID NO: 655825 - DNA, 25 bp, Rattus norvegicus
ttgtagaggcggagatcactcgccc

SEQ ID NO: 655826 - DNA, 25 bp, Rattus norvegicus
tggcaatggcgtcgtgccaccttcg

SEQ ID NO: 655827 - DNA, 25 bp, Rattus norvegicus
aagtttctgcgtcgagtgctctgcc

SEQ ID NO: 655828 - DNA, 25 bp, Rattus norvegicus
agcgcgataccgacacgcagctctg

SEQ ID NO: 655829 - DNA, 25 bp, Rattus norvegicus
caggcttccctactgtccaatcaga

SEQ ID NO: 655830 - DNA, 25 bp, Rattus norvegicus
cggggccaataaactgacaggcttc

SEQ ID NO: 655831 - DNA, 25 bp, Rattus norvegicus
ggccctgtcactcggtctgtgtatt

SEQ ID NO: 655832 - DNA, 25 bp, Rattus norvegicus
tcggcgaagccatcgtcggtcacca

SEQ ID NO: 655833 - DNA, 25 bp, Rattus norvegicus
tcaaagtgccaagtccgtaagtgtc

SEQ ID NO: 655834 - DNA, 25 bp, Rattus norvegicus
gtgcattacgactggcggagtactg

SEQ ID NO: 655835 - DNA, 25 bp, Rattus norvegicus
gggcgacccgaaggccactcagtag

SEQ ID NO: 655836 - DNA, 25 bp, Rattus norvegicus
tctttagacggcctccggtccttca

SEQ ID NO: 655837 - DNA, 25 bp, Rattus norvegicus
ccggtccttcactaggaagttgatc

SEQ ID NO: 655838 - DNA, 25 bp, Rattus norvegicus
tgagcgagagcacacacattacagc

SEQ ID NO: 655839 - DNA, 25 bp, Rattus norvegicus
gcataatgtacaggctgcgctcgtc

SEQ ID NO: 655840 - DNA, 25 bp, Rattus norvegicus
ctcgactgggagctcttagaacttg

SEQ ID NO: 655841 - DNA, 25 bp, Rattus norvegicus
gcctcgctactgttggccaggaaca

SEQ ID NO: 655842 - DNA, 25 bp, Rattus norvegicus
ttcatcacgagagcaagcaggcgcc

SEQ ID NO: 655843 - DNA, 25 bp, Rattus norvegicus
gagcgctggcttgatcacttgtgcg

SEQ ID NO: 655844 - DNA, 25 bp, Rattus norvegicus
gctcctccgtctttctttcaaagtg

SEQ ID NO: 655845 - DNA, 25 bp, Rattus norvegicus
ctggttgcccagcactgaattcatc

SEQ ID NO: 655846 - DNA, 25 bp, Rattus norvegicus
ggccactgacccgtctggatctagg

SEQ ID NO: 655847 - DNA, 25 bp, Rattus norvegicus
ctctcctcttcttggtggcggtttg

SEQ ID NO: 655848 - DNA, 25 bp, Rattus norvegicus
ccctgtcggactgcaggagagtccg

SEQ ID NO: 655849 - DNA, 25 bp, Rattus norvegicus
cgcggagctctctccgagggatcaa

SEQ ID NO: 655850 - DNA, 25 bp, Rattus norvegicus
tttcccgctaccctctgagctgggg

SEQ ID NO: 655851 - DNA, 25 bp, Rattus norvegicus
tgcctgccaagtatcgcgggacttg

SEQ ID NO: 655852 - DNA, 25 bp, Rattus norvegicus
gccaccatagcaggtctcaatcttt

SEQ ID NO: 655853 - DNA, 25 bp, Rattus norvegicus
ccggggtgctggttacgtaaatgat

SEQ ID NO: 655854 - DNA, 25 bp, Rattus norvegicus
cgtaaatgatcctagcccagtgaca

SEQ ID NO: 655855 - DNA, 25 bp, Rattus norvegicus
ctctgccgaggtgacaatgtgctag

SEQ ID NO: 655856 - DNA, 25 bp, Rattus norvegicus
ccgagggatcaacagccaccatagc

SEQ ID NO: 655857 - DNA, 25 bp, Rattus norvegicus
ggatctcagagcagccggccactga

SEQ ID NO: 655858 - DNA, 25 bp, Rattus norvegicus
atctaggcagcatcccaagcgggga

SEQ ID NO: 655859 - DNA, 25 bp, Rattus norvegicus
ctctgctcgccgagaagtgtgaaga

SEQ ID NO: 655860 - DNA, 25 bp, Rattus norvegicus
caccgcaggagtacaggtctctgga

SEQ ID NO: 655861 - DNA, 25 bp, Rattus norvegicus
ccgcgcaccgcaggagtacaggtct

SEQ ID NO: 655862 - DNA, 25 bp, Rattus norvegicus
gtttccagcgctccgtggaaagcag

SEQ ID NO: 655863 - DNA, 25 bp, Rattus norvegicus
ttccagcgctccgtggaaagcaggg

SEQ ID NO: 655864 - DNA, 25 bp, Rattus norvegicus
ggaaagcaggggtggcttgacgccc

SEQ ID NO: 655865 - DNA, 25 bp, Rattus norvegicus
tggcacgcgtggaaactcggtcgcc

SEQ ID NO: 655866 - DNA, 25 bp, Rattus norvegicus
gcaggagtacaggtctctggagtcc

SEQ ID NO: 655867 - DNA, 25 bp, Rattus norvegicus
gcccgcgcaccgcaggagtacaggt

SEQ ID NO: 655868 - DNA, 25 bp, Rattus norvegicus
cactgcccagccgacatgcctctgg

SEQ ID NO: 655869 - DNA, 25 bp, Rattus norvegicus
cgcaccgcaggagtacaggtctctg

SEQ ID NO: 655870 - DNA, 25 bp, Rattus norvegicus
cgcaggagtacaggtctctggagtc

SEQ ID NO: 655871 - DNA, 25 bp, Rattus norvegicus
attcggagccagtagagcgtgggta

SEQ ID NO: 655872 - DNA, 25 bp, Rattus norvegicus
tagggggcgttgcaccactgcccag

SEQ ID NO: 655873 - DNA, 25 bp, Rattus norvegicus
acgcgtggaaactcggtcgcccgcg

SEQ ID NO: 655874 - DNA, 25 bp, Rattus norvegicus
agcagtacgtagaagtagcttctat

SEQ ID NO: 655875 - DNA, 25 bp, Rattus norvegicus
gcagtacgtagaagtagcttctatg

SEQ ID NO: 655876 - DNA, 25 bp, Rattus norvegicus
cagtacgtagaagtagcttctatgg

SEQ ID NO: 655877 - DNA, 25 bp, Rattus norvegicus
agtacgtagaagtagcttctatggt

SEQ ID NO: 655878 - DNA, 25 bp, Rattus norvegicus
acgtagaagtagcttctatggtgtc

SEQ ID NO: 655879 - DNA, 25 bp, Rattus norvegicus
gtacgtagaagtagcttctatggtg

SEQ ID NO: 655880 - DNA, 25 bp, Rattus norvegicus
cgtagaagtagcttctatggtgtcc

SEQ ID NO: 655881 - DNA, 25 bp, Rattus norvegicus
tgtgttctcccacgcgttctcatgg

SEQ ID NO: 655882 - DNA, 25 bp, Rattus norvegicus
cccacggcactggaagcaaagttcg

SEQ ID NO: 655883 - DNA, 25 bp, Rattus norvegicus
gccatttccgggcagcaccttgagc

SEQ ID NO: 655884 - DNA, 25 bp, Rattus norvegicus
tcttccctagctgtggcaagaaccc

SEQ ID NO: 655885 - DNA, 25 bp, Rattus norvegicus
gcggttcccatcttccctagctgtg

SEQ ID NO: 655886 - DNA, 25 bp, Rattus norvegicus
ggcagaggggctttcttcccgctcc

SEQ ID NO: 655887 - DNA, 25 bp, Rattus norvegicus
cctgttgcagcttcgcgatggagct

SEQ ID NO: 655888 - DNA, 25 bp, Rattus norvegicus
ctcacttcgttttactgggtccgcg

SEQ ID NO: 655889 - DNA, 25 bp, Rattus norvegicus
gctctcacaccagcgcgggactgtg

SEQ ID NO: 655890 - DNA, 25 bp, Rattus norvegicus
aaggtgcacgcgctcactgcggcgc

SEQ ID NO: 655891 - DNA, 25 bp, Rattus norvegicus
tgctactttgcgtccctacccaaga

SEQ ID NO: 655892 - DNA, 25 bp, Rattus norvegicus
tcgccggccttctgctactttgcgt

SEQ ID NO: 655893 - DNA, 25 bp, Rattus norvegicus
ttctcatggctggaaagttggtgtc

SEQ ID NO: 655894 - DNA, 25 bp, Rattus norvegicus
aaagttggtgtcactggtgccaccc

SEQ ID NO: 655895 - DNA, 25 bp, Rattus norvegicus
tcggctgcatgttcatcaagatgtc

SEQ ID NO: 655896 - DNA, 25 bp, Rattus norvegicus
aacagccacatggtctccgcgcaga

SEQ ID NO: 655897 - DNA, 25 bp, Rattus norvegicus
ctcactctcatgttccgggtgggca

SEQ ID NO: 655898 - DNA, 25 bp, Rattus norvegicus
gtttagcgagcatgcggttatttcc

SEQ ID NO: 655899 - DNA, 25 bp, Rattus norvegicus
agcgcgccgagaccctcatgtttag

SEQ ID NO: 655900 - DNA, 25 bp, Rattus norvegicus
tcaagatgtcccagcccaaaaagcg

SEQ ID NO: 655901 - DNA, 25 bp, Rattus norvegicus
ggacgctttcctcatcggctgcatg

SEQ ID NO: 655902 - DNA, 25 bp, Rattus norvegicus
tccttggctccatcgtggacgcttt

SEQ ID NO: 655903 - DNA, 25 bp, Rattus norvegicus
gctaccgctacatcaccgacaagtg

SEQ ID NO: 655904 - DNA, 25 bp, Rattus norvegicus
tccctgtgtggccaatgtctataac

SEQ ID NO: 655905 - DNA, 25 bp, Rattus norvegicus
tgtcggcaactacactccctgtgtg

SEQ ID NO: 655906 - DNA, 25 bp, Rattus norvegicus
actaccctggtggatctcaagtggc

SEQ ID NO: 655907 - DNA, 25 bp, Rattus norvegicus
caagtggcgttggaacctctttatc

SEQ ID NO: 655908 - DNA, 25 bp, Rattus norvegicus
catgtggtgggtgatcgcttatacc

SEQ ID NO: 655909 - DNA, 25 bp, Rattus norvegicus
aggtctgcccatccactacgtggtg

SEQ ID NO: 655910 - DNA, 25 bp, Rattus norvegicus
aagcccatggatgccggcttgcgaa

SEQ ID NO: 655911 - DNA, 25 bp, Rattus norvegicus
caccgtaatgctgacaggccgcgtt

SEQ ID NO: 655912 - DNA, 25 bp, Rattus norvegicus
aggccgcgttgtcaccgcaaacagc

SEQ ID NO: 655913 - DNA, 25 bp, Rattus norvegicus
acagcgcacagaccctcattggagg

SEQ ID NO: 655914 - DNA, 25 bp, Rattus norvegicus
agggcacctgcgtgtcaagcaactg

SEQ ID NO: 655915 - DNA, 25 bp, Rattus norvegicus
gcgcatctggcagctagacacagga

SEQ ID NO: 655916 - DNA, 25 bp, Rattus norvegicus
aagcaactgcgacgcgtggccgatc

SEQ ID NO: 655917 - DNA, 25 bp, Rattus norvegicus
agaggcccgtcaaagcgcatctggc

SEQ ID NO: 655918 - DNA, 25 bp, Rattus norvegicus
aggtgtcttcctctgctcgatcata

SEQ ID NO: 655919 - DNA, 25 bp, Rattus norvegicus
cgatcatatgcgtagtggccacgta

SEQ ID NO: 655920 - DNA, 25 bp, Rattus norvegicus
ccggatcgtcccacatcgggctatg

SEQ ID NO: 655921 - DNA, 25 bp, Rattus norvegicus
acatcgggctatgctgcacctggaa

SEQ ID NO: 655922 - DNA, 25 bp, Rattus norvegicus
gcgaagagggcttgtagtaaaccga

SEQ ID NO: 655923 - DNA, 25 bp, Rattus norvegicus
attcattcaactccgccgaagtgca

SEQ ID NO: 655924 - DNA, 25 bp, Rattus norvegicus
ggtatatttccgacctgacgtcacg

SEQ ID NO: 655925 - DNA, 25 bp, Rattus norvegicus
cctttgtttatgtggctcgcgctgc

SEQ ID NO: 655926 - DNA, 25 bp, Rattus norvegicus
aagtgcagttccctccgggagcaga

SEQ ID NO: 655927 - DNA, 25 bp, Rattus norvegicus
tgctgctgccaacatgcacctaaag

SEQ ID NO: 655928 - DNA, 25 bp, Rattus norvegicus
ttctccgctctcttcattcattcaa

SEQ ID NO: 655929 - DNA, 25 bp, Rattus norvegicus
gcacctaaagtctgcgcgcgtcagc

SEQ ID NO: 655930 - DNA, 25 bp, Rattus norvegicus
tgcagagaacccgttccgggtacgc

SEQ ID NO: 655931 - DNA, 25 bp, Rattus norvegicus
ggctccagcgcccacttgcagagaa

SEQ ID NO: 655932 - DNA, 25 bp, Rattus norvegicus
ttccagcaaaggctcggcggagctg

SEQ ID NO: 655933 - DNA, 25 bp, Rattus norvegicus
ccaccggagttccagcaaaggctcg

SEQ ID NO: 655934 - DNA, 25 bp, Rattus norvegicus
gctttacgctaccaccggagttcca

SEQ ID NO: 655935 - DNA, 25 bp, Rattus norvegicus
ccgcgctcgctttggtatatttccg

SEQ ID NO: 655936 - DNA, 25 bp, Rattus norvegicus
ctggccgccaatgtgcctttgttta

SEQ ID NO: 655937 - DNA, 25 bp, Rattus norvegicus
cgcgtctctccgaaccgagtgtgta

SEQ ID NO: 655938 - DNA, 25 bp, Rattus norvegicus
tgtgcatcagcctccgggaaaccta

SEQ ID NO: 655939 - DNA, 25 bp, Rattus norvegicus
ccgctatggctcagcagtgccctaa

SEQ ID NO: 655940 - DNA, 25 bp, Rattus norvegicus
aacttattagtgtgagctcggcagc

SEQ ID NO: 655941 - DNA, 25 bp, Rattus norvegicus
tgggcagaagcgattccacgcgaac

SEQ ID NO: 655942 - DNA, 25 bp, Rattus norvegicus
tcggtgatcctagcaccagcggaga

SEQ ID NO: 655943 - DNA, 25 bp, Rattus norvegicus
tcgggtttctctcgaggccaagaag

SEQ ID NO: 655944 - DNA, 25 bp, Rattus norvegicus
ctagacaggcctcttcgggtttctc

SEQ ID NO: 655945 - DNA, 25 bp, Rattus norvegicus
cctattcccagtacgcgggtgaagc

SEQ ID NO: 655946 - DNA, 25 bp, Rattus norvegicus
ttctccggagggctatacctattcc

SEQ ID NO: 655947 - DNA, 25 bp, Rattus norvegicus
gcaaaggaattgcagcttctccgga

SEQ ID NO: 655948 - DNA, 25 bp, Rattus norvegicus
cccaagcgcgtggatctttctagca

SEQ ID NO: 655949 - DNA, 25 bp, Rattus norvegicus
tggggttgctcattcctagcctgca

SEQ ID NO: 655950 - DNA, 25 bp, Rattus norvegicus
accgagtgtgtatgtgcccattgcc

SEQ ID NO: 655951 - DNA, 25 bp, Rattus norvegicus
tgcagcgccatctgctgaccacgag

SEQ ID NO: 655952 - DNA, 25 bp, Rattus norvegicus
aggcattcctcagttccacttaagg

SEQ ID NO: 655953 - DNA, 25 bp, Rattus norvegicus
cattcctcagttccacttaaggaaa

SEQ ID NO: 655954 - DNA, 25 bp, Rattus norvegicus
aggaaaaggtcctcccgtgctagcg

SEQ ID NO: 655955 - DNA, 25 bp, Rattus norvegicus
aaggtcctcccgtgctagcgaggga

SEQ ID NO: 655956 - DNA, 25 bp, Rattus norvegicus
tcctcccgtgctagcgagggacgag

SEQ ID NO: 655957 - DNA, 25 bp, Rattus norvegicus
gcgggaaaaggatgcaggtcgtggt

SEQ ID NO: 655958 - DNA, 25 bp, Rattus norvegicus
tggtgagggacaggaaccctttcca

SEQ ID NO: 655959 - DNA, 25 bp, Rattus norvegicus
tttccaactcctcggactccggcgc

SEQ ID NO: 655960 - DNA, 25 bp, Rattus norvegicus
tctgctgaccacgagggcaaacgcg

SEQ ID NO: 655961 - DNA, 25 bp, Rattus norvegicus
cgtctggagcgtcttttgtgggcca

SEQ ID NO: 655962 - DNA, 25 bp, Rattus norvegicus
tctaggcattcctcagttccactta

SEQ ID NO: 655963 - DNA, 25 bp, Rattus norvegicus
gccatctgctgaccacgagggcaaa

SEQ ID NO: 655964 - DNA, 25 bp, Rattus norvegicus
aggcttccgggttccgcgtctggag

SEQ ID NO: 655965 - DNA, 25 bp, Rattus norvegicus
cgcgcgcagcctgcgctataaataa

SEQ ID NO: 655966 - DNA, 25 bp, Rattus norvegicus
aggagcggccgaggaaacaatgacc

SEQ ID NO: 655967 - DNA, 25 bp, Rattus norvegicus
gccgaggaaacaatgacccgccgcg

SEQ ID NO: 655968 - DNA, 25 bp, Rattus norvegicus
gctcttcctgcagtccgggtgcgcg

SEQ ID NO: 655969 - DNA, 25 bp, Rattus norvegicus
agtggtcgagcagcccggctccagc

SEQ ID NO: 655970 - DNA, 25 bp, Rattus norvegicus
ttcagtacacgttacctgcccagcg

SEQ ID NO: 655971 - DNA, 25 bp, Rattus norvegicus
agcccggttcagtacacgttacctg

SEQ ID NO: 655972 - DNA, 25 bp, Rattus norvegicus
tggtcgcactgaagtttctctcccg

SEQ ID NO: 655973 - DNA, 25 bp, Rattus norvegicus
agcctgttgggactggtcgcactga

SEQ ID NO: 655974 - DNA, 25 bp, Rattus norvegicus
ccctgccagggcgacagtgaggctc

SEQ ID NO: 655975 - DNA, 25 bp, Rattus norvegicus
gcctccgcggtcaacaagtccctaa

SEQ ID NO: 655976 - DNA, 25 bp, Rattus norvegicus
aaggacagggctcaaggccggcctc

SEQ ID NO: 655977 - DNA, 25 bp, Rattus norvegicus
cacagcagccggaaggacagggctc

SEQ ID NO: 655978 - DNA, 25 bp, Rattus norvegicus
tgcgctataaataacccgccgccgg

SEQ ID NO: 655979 - DNA, 25 bp, Rattus norvegicus
ccctggcgtgtgacgaccgatctca

SEQ ID NO: 655980 - DNA, 25 bp, Rattus norvegicus
tgctaacattcaggcccggggtcta

SEQ ID NO: 655981 - DNA, 25 bp, Rattus norvegicus
ggtcccgcgtgctaacattcaggcc

SEQ ID NO: 655982 - DNA, 25 bp, Rattus norvegicus
accgatctcaggtgtgtgcgtcctg

SEQ ID NO: 655983 - DNA, 25 bp, Rattus norvegicus
tagacgcctttctaggcccagggaa

SEQ ID NO: 655984 - DNA, 25 bp, Rattus norvegicus
cgacgcgtgatcaggtaaggcaacc

SEQ ID NO: 655985 - DNA, 25 bp, Rattus norvegicus
ggaacgttctcctcccggacagatg

SEQ ID NO: 655986 - DNA, 25 bp, Rattus norvegicus
tggtcttttctccagctggcgagga

SEQ ID NO: 655987 - DNA, 25 bp, Rattus norvegicus
ccgcgagctcaaggccactctggtt

SEQ ID NO: 655988 - DNA, 25 bp, Rattus norvegicus
cactctggttctccgtgaggccgac

SEQ ID NO: 655989 - DNA, 25 bp, Rattus norvegicus
tgaggccgactgactccgttctagc

SEQ ID NO: 655990 - DNA, 25 bp, Rattus norvegicus
ctccgttctagctggaggttcctga

SEQ ID NO: 655991 - DNA, 25 bp, Rattus norvegicus
ggaggttcctgacttccctgctcgc

SEQ ID NO: 655992 - DNA, 25 bp, Rattus norvegicus
agggtcgaaaccctgggcatggcca

SEQ ID NO: 655993 - DNA, 25 bp, Rattus norvegicus
tagcacgagtgtgagctccagagtc

SEQ ID NO: 655994 - DNA, 25 bp, Rattus norvegicus
tcattccgcctttaacagttacgta

SEQ ID NO: 655995 - DNA, 25 bp, Rattus norvegicus
gtacggttacgtttcaaagcgcaca

SEQ ID NO: 655996 - DNA, 25 bp, Rattus norvegicus
ttacgtttcaaagcgcacacgtctg

SEQ ID NO: 655997 - DNA, 25 bp, Rattus norvegicus
cacacgtctgccaacgtctgcagta

SEQ ID NO: 655998 - DNA, 25 bp, Rattus norvegicus
caacgtctgcagtaaggcttccggc

SEQ ID NO: 655999 - DNA, 25 bp, Rattus norvegicus
gcagtaaggcttccggctttcccta

SEQ ID NO: 656000 - DNA, 25 bp, Rattus norvegicus
ggctttccctaaggcttaactctga

SEQ ID NO: 656001 - DNA, 25 bp, Rattus norvegicus
tcatcgcttcattccgcctttaaca

SEQ ID NO: 656002 - DNA, 25 bp, Rattus norvegicus
tgtcgctggtggtaatagcacgagt

SEQ ID NO: 656003 - DNA, 25 bp, Rattus norvegicus
gtgagctccagagtccgttcacgga

SEQ ID NO: 656004 - DNA, 25 bp, Rattus norvegicus
gagcatctcgagtctcaaagttccg

SEQ ID NO: 656005 - DNA, 25 bp, Rattus norvegicus
ccgttcacggagcatctcgagtctc

SEQ ID NO: 656006 - DNA, 25 bp, Rattus norvegicus
taactctgaggctatgtcgctggtg

SEQ ID NO: 656007 - DNA, 25 bp, Rattus norvegicus
ccctggatattccttgatagcataa

SEQ ID NO: 656008 - DNA, 25 bp, Rattus norvegicus
ccatgagaaacgatttgtcgggttg

SEQ ID NO: 656009 - DNA, 25 bp, Rattus norvegicus
gaaagtatgtttgttcccatgagaa

SEQ ID NO: 656010 - DNA, 25 bp, Rattus norvegicus
gctagctacaaaagaaagtatgttt

SEQ ID NO: 656011 - DNA, 25 bp, Rattus norvegicus
cagaaatgcaggctagctacaaaag

SEQ ID NO: 656012 - DNA, 25 bp, Rattus norvegicus
ctgttagaaacagaaatgcaggcta

SEQ ID NO: 656013 - DNA, 25 bp, Rattus norvegicus
caaaaaacatctctgttagaaacag

SEQ ID NO: 656014 - DNA, 25 bp, Rattus norvegicus
ccgggagtcaccaaaaaacatctct

SEQ ID NO: 656015 - DNA, 25 bp, Rattus norvegicus
gatcattaccgggagtcaccaaaaa

SEQ ID NO: 656016 - DNA, 25 bp, Rattus norvegicus
tcaagatcattaccgggagtcacca

SEQ ID NO: 656017 - DNA, 25 bp, Rattus norvegicus
agtgttctcaagatcattaccggga

SEQ ID NO: 656018 - DNA, 25 bp, Rattus norvegicus
ttgttcccatgagaaacgatttgtc

SEQ ID NO: 656019 - DNA, 25 bp, Rattus norvegicus
ccttgatagcataactatttctcta

SEQ ID NO: 656020 - DNA, 25 bp, Rattus norvegicus
tctctaagtgttctcaagatcatta

SEQ ID NO: 656021 - DNA, 25 bp, Rattus norvegicus
cagcgcgggccgctttgaagttccc

SEQ ID NO: 656022 - DNA, 25 bp, Rattus norvegicus
atacctgccgcaaggtcggaggcca

SEQ ID NO: 656023 - DNA, 25 bp, Rattus norvegicus
ccaccagcaggagggccaggctcag

SEQ ID NO: 656024 - DNA, 25 bp, Rattus norvegicus
caaggcttcggggtcccagagcgca

SEQ ID NO: 656025 - DNA, 25 bp, Rattus norvegicus
gcgctctcagcccactgcgtttccc

SEQ ID NO: 656026 - DNA, 25 bp, Rattus norvegicus
ccgcaaggtcggaggccagtgccac

SEQ ID NO: 656027 - DNA, 25 bp, Rattus norvegicus
aaagaaacacccacgatacctgccg

SEQ ID NO: 656028 - DNA, 25 bp, Rattus norvegicus
gctcgggaaagaaacacccacgata

SEQ ID NO: 656029 - DNA, 25 bp, Rattus norvegicus
cacgagctcgggaaagaaacaccca

SEQ ID NO: 656030 - DNA, 25 bp, Rattus norvegicus
gtcacctctgatcacccgcagaccg

SEQ ID NO: 656031 - DNA, 25 bp, Rattus norvegicus
gagtaccttctgtcacctctgatca

SEQ ID NO: 656032 - DNA, 25 bp, Rattus norvegicus
acctggcccagagtaccttctgtca

SEQ ID NO: 656033 - DNA, 25 bp, Rattus norvegicus
ccggacagccacctggcccagagta

SEQ ID NO: 656034 - DNA, 25 bp, Rattus norvegicus
tcggaggccagtgccaccagcagga

SEQ ID NO: 656035 - DNA, 25 bp, Rattus norvegicus
cgttcaatatgagggctgggccaat

SEQ ID NO: 656036 - DNA, 25 bp, Rattus norvegicus
cggcctccgagcagtctagagggct

SEQ ID NO: 656037 - DNA, 25 bp, Rattus norvegicus
cagcgtgctgacgttcccgggtgct

SEQ ID NO: 656038 - DNA, 25 bp, Rattus norvegicus
caatggggaggaccggccctctcct

SEQ ID NO: 656039 - DNA, 25 bp, Rattus norvegicus
ctcgttcaatatgagggctgggcca

SEQ ID NO: 656040 - DNA, 25 bp, Rattus norvegicus
ttggctcgttcaatatgagggctgg

SEQ ID NO: 656041 - DNA, 25 bp, Rattus norvegicus
ggctcctattggctcgttcaatatg

SEQ ID NO: 656042 - DNA, 25 bp, Rattus norvegicus
ccgcggctcctattggctcgttcaa

SEQ ID NO: 656043 - DNA, 25 bp, Rattus norvegicus
gaaaccgcggctcctattggctcgt

SEQ ID NO: 656044 - DNA, 25 bp, Rattus norvegicus
tctccatggcgacctgaaaccgcgg

SEQ ID NO: 656045 - DNA, 25 bp, Rattus norvegicus
ttaacagcatcggtctccatggcga

SEQ ID NO: 656046 - DNA, 25 bp, Rattus norvegicus
gctcttaacagcatcggtctccatg

SEQ ID NO: 656047 - DNA, 25 bp, Rattus norvegicus
ctccgagcagtctagagggctccgg

SEQ ID NO: 656048 - DNA, 25 bp, Rattus norvegicus
tctccttccgcccaatggggcgggc

SEQ ID NO: 656049 - DNA, 25 bp, Rattus norvegicus
ggctgctgctctccggccttattct

SEQ ID NO: 656050 - DNA, 25 bp, Rattus norvegicus
gagcggccctgaatggtgccaccgc

SEQ ID NO: 656051 - DNA, 25 bp, Rattus norvegicus
gcaggcgcacttcggacacttttct

SEQ ID NO: 656052 - DNA, 25 bp, Rattus norvegicus
tgagcgagcgctctaggcgcaggct

SEQ ID NO: 656053 - DNA, 25 bp, Rattus norvegicus
tctccggccttattctgggagcggc

SEQ ID NO: 656054 - DNA, 25 bp, Rattus norvegicus
atggcgacgcccgtccctccgcctt

SEQ ID NO: 656055 - DNA, 25 bp, Rattus norvegicus
gcgctgaagcatggcgacgcccgtc

SEQ ID NO: 656056 - DNA, 25 bp, Rattus norvegicus
tctccagtcgcggttcccggagtgg

SEQ ID NO: 656057 - DNA, 25 bp, Rattus norvegicus
ggcttctccagtcgcggttcccgga

SEQ ID NO: 656058 - DNA, 25 bp, Rattus norvegicus
attgccgcaacgtcagcgccgccgc

SEQ ID NO: 656059 - DNA, 25 bp, Rattus norvegicus
atcccggatccattgccgcaacgtc

SEQ ID NO: 656060 - DNA, 25 bp, Rattus norvegicus
ccgcgcctccatcccatcccggatc

SEQ ID NO: 656061 - DNA, 25 bp, Rattus norvegicus
cggacacttttctctggccgccgcg

SEQ ID NO: 656062 - DNA, 25 bp, Rattus norvegicus
gccttattctgggagcggccctgaa

SEQ ID NO: 656063 - DNA, 25 bp, Rattus norvegicus
tgtgctggaatgcaaggaatgcacc

SEQ ID NO: 656064 - DNA, 25 bp, Rattus norvegicus
agccttaaggctccgggctgccttc

SEQ ID NO: 656065 - DNA, 25 bp, Rattus norvegicus
cctcctcgcgctgccaggagttgga

SEQ ID NO: 656066 - DNA, 25 bp, Rattus norvegicus
gcgagcagcttcacccatcggagga

SEQ ID NO: 656067 - DNA, 25 bp, Rattus norvegicus
aggatcgtgggtccctgtcctccct

SEQ ID NO: 656068 - DNA, 25 bp, Rattus norvegicus
tccttgggaaacgagaggacgagca

SEQ ID NO: 656069 - DNA, 25 bp, Rattus norvegicus
ctggcgacagattgtgctggaatgc

SEQ ID NO: 656070 - DNA, 25 bp, Rattus norvegicus
ccagagcctcactggtgtgcgtggc

SEQ ID NO: 656071 - DNA, 25 bp, Rattus norvegicus
atgcaccagggacagagtccgcacg

SEQ ID NO: 656072 - DNA, 25 bp, Rattus norvegicus
gccctgttctcgctgtgtagccaga

SEQ ID NO: 656073 - DNA, 25 bp, Rattus norvegicus
agccagaggtcacggcgcatcttca

SEQ ID NO: 656074 - DNA, 25 bp, Rattus norvegicus
tcttcagagctggtaagcctcgttc

SEQ ID NO: 656075 - DNA, 25 bp, Rattus norvegicus
tggtaagcctcgttcactctcctgc

SEQ ID NO: 656076 - DNA, 25 bp, Rattus norvegicus
acgcgcgctgccagctagtagactg

SEQ ID NO: 656077 - DNA, 25 bp, Rattus norvegicus
ggggaaaatcacatcgcccaccgtg

SEQ ID NO: 656078 - DNA, 25 bp, Rattus norvegicus
cgcgccgaaagctggaaactttcct

SEQ ID NO: 656079 - DNA, 25 bp, Rattus norvegicus
cctcctcgatcccttggttagtcag

SEQ ID NO: 656080 - DNA, 25 bp, Rattus norvegicus
gagcgaacttaagcggggaaaatca

SEQ ID NO: 656081 - DNA, 25 bp, Rattus norvegicus
ctttcctggcaggtaactcccgctg

SEQ ID NO: 656082 - DNA, 25 bp, Rattus norvegicus
tcgcccaccgtgagctgaaagtgtg

SEQ ID NO: 656083 - DNA, 25 bp, Rattus norvegicus
tgaaagtgtgtgcttcgttccggca

SEQ ID NO: 656084 - DNA, 25 bp, Rattus norvegicus
gctcgcagatgcaagccaatttctt

SEQ ID NO: 656085 - DNA, 25 bp, Rattus norvegicus
ttgggattagaccttgaggattttc

SEQ ID NO: 656086 - DNA, 25 bp, Rattus norvegicus
tgccagctaaatgaagggtcctgtc

SEQ ID NO: 656087 - DNA, 25 bp, Rattus norvegicus
ccttgggcgacgagtagttactttg

SEQ ID NO: 656088 - DNA, 25 bp, Rattus norvegicus
ggcattatggggattcaggttcttc

SEQ ID NO: 656089 - DNA, 25 bp, Rattus norvegicus
tcttcctggaagacttttgggtgtg

SEQ ID NO: 656090 - DNA, 25 bp, Rattus norvegicus
gcgggtcgccaagttcccgagcgaa

SEQ ID NO: 656091 - DNA, 25 bp, Rattus norvegicus
ctgggcagctcactgggcagagtct

SEQ ID NO: 656092 - DNA, 25 bp, Rattus norvegicus
ctggcgagccgtcagaccagtgata

SEQ ID NO: 656093 - DNA, 25 bp, Rattus norvegicus
cacgtgttagagaactgaggtaggc

SEQ ID NO: 656094 - DNA, 25 bp, Rattus norvegicus
gctcactgggcagagtctggctcac

SEQ ID NO: 656095 - DNA, 25 bp, Rattus norvegicus
cagaccagtgatatgtgcgtgacca

SEQ ID NO: 656096 - DNA, 25 bp, Rattus norvegicus
ggtcacgaaggctgcacgactaccc

SEQ ID NO: 656097 - DNA, 25 bp, Rattus norvegicus
ttctgaggtcacgaaggctgcacga

SEQ ID NO: 656098 - DNA, 25 bp, Rattus norvegicus
gaaccgccgggttctgaggtcacga

SEQ ID NO: 656099 - DNA, 25 bp, Rattus norvegicus
cggactgacagtcccgcctccgggc

SEQ ID NO: 656100 - DNA, 25 bp, Rattus norvegicus
actcacttccctcgcacccggactg

SEQ ID NO: 656101 - DNA, 25 bp, Rattus norvegicus
tggcgcacagcccacactcacttcc

SEQ ID NO: 656102 - DNA, 25 bp, Rattus norvegicus
tgcgtgaccacagcccgctcggtgg

SEQ ID NO: 656103 - DNA, 25 bp, Rattus norvegicus
atatgtgcgtgaccacagcccgctc

SEQ ID NO: 656104 - DNA, 25 bp, Rattus norvegicus
ctcactggatcacgtgttagagaac

SEQ ID NO: 656105 - DNA, 25 bp, Rattus norvegicus
tcatcggcgatccaggtccagaaca

SEQ ID NO: 656106 - DNA, 25 bp, Rattus norvegicus
gcagctcgaggcaagcgatctttaa

SEQ ID NO: 656107 - DNA, 25 bp, Rattus norvegicus
cagccatccgtaggcggtctgcatc

SEQ ID NO: 656108 - DNA, 25 bp, Rattus norvegicus
agccgacgtcgatccagatctcgta

SEQ ID NO: 656109 - DNA, 25 bp, Rattus norvegicus
actcgtcgtcgttcaaggtccagga

SEQ ID NO: 656110 - DNA, 25 bp, Rattus norvegicus
gtctcgtacacctagggcagctcga

SEQ ID NO: 656111 - DNA, 25 bp, Rattus norvegicus
cagctccttggaagcgctctagatc

SEQ ID NO: 656112 - DNA, 25 bp, Rattus norvegicus
actcgccgtcgctctcgttctagaa

SEQ ID NO: 656113 - DNA, 25 bp, Rattus norvegicus
cagtgactcgcagaagatccagatc

SEQ ID NO: 656114 - DNA, 25 bp, Rattus norvegicus
ccaccagtaaccaggagacgatcta

SEQ ID NO: 656115 - DNA, 25 bp, Rattus norvegicus
tcgaacatctccagtcacccgtagg

SEQ ID NO: 656116 - DNA, 25 bp, Rattus norvegicus
cagccattcggagacgctctaggtc

SEQ ID NO: 656117 - DNA, 25 bp, Rattus norvegicus
tctaggtctcggacaccactgttgc

SEQ ID NO: 656118 - DNA, 25 bp, Rattus norvegicus
cctgaccagtcggaagcgatctcga

SEQ ID NO: 656119 - DNA, 25 bp, Rattus norvegicus
acagcgccctctcgtgttcggagga

SEQ ID NO: 656120 - DNA, 25 bp, Rattus norvegicus
aagacggagcgtcctgtccatgtcg

SEQ ID NO: 656121 - DNA, 25 bp, Rattus norvegicus
gtgcgcgtacagaaacctccacggc

SEQ ID NO: 656122 - DNA, 25 bp, Rattus norvegicus
gcctggagacccaaagcggagaccc

SEQ ID NO: 656123 - DNA, 25 bp, Rattus norvegicus
cctgcagaaacaagccgggaggctg

SEQ ID NO: 656124 - DNA, 25 bp, Rattus norvegicus
cacgagcagccgctgtacgtcgctt

SEQ ID NO: 656125 - DNA, 25 bp, Rattus norvegicus
ctcatcctggaactgcacgagcagc

SEQ ID NO: 656126 - DNA, 25 bp, Rattus norvegicus
acgtcgaacggggaacccagcagct

SEQ ID NO: 656127 - DNA, 25 bp, Rattus norvegicus
gcgtgatgtccaccggcacgtcgaa

SEQ ID NO: 656128 - DNA, 25 bp, Rattus norvegicus
cagcgcgttgcacacgagctgcagc

SEQ ID NO: 656129 - DNA, 25 bp, Rattus norvegicus
cgcggcttcgttttgggatgcccac

SEQ ID NO: 656130 - DNA, 25 bp, Rattus norvegicus
atactgtcggtgtgcagctgagtcc

SEQ ID NO: 656131 - DNA, 25 bp, Rattus norvegicus
ccacgccaccaatactgtcggtgtg

SEQ ID NO: 656132 - DNA, 25 bp, Rattus norvegicus
ttcggaggagtcaggccgcttcaga

SEQ ID NO: 656133 - DNA, 25 bp, Rattus norvegicus
ggttccagcccacagccgccgctct

SEQ ID NO: 656134 - DNA, 25 bp, Rattus norvegicus
gagatccgtgatcgcgaaagccctg

SEQ ID NO: 656135 - DNA, 25 bp, Rattus norvegicus
ctcttataatttctgcaagaaagtc

SEQ ID NO: 656136 - DNA, 25 bp, Rattus norvegicus
caccgcctccttatttctcttataa

SEQ ID NO: 656137 - DNA, 25 bp, Rattus norvegicus
ccttcactttcgaactgagttgcgg

SEQ ID NO: 656138 - DNA, 25 bp, Rattus norvegicus
caaactcaccttcactttcgaactg

SEQ ID NO: 656139 - DNA, 25 bp, Rattus norvegicus
gctctccgcccggaacccacctctc

SEQ ID NO: 656140 - DNA, 25 bp, Rattus norvegicus
caacaaagagacacaccgggcggcg

SEQ ID NO: 656141 - DNA, 25 bp, Rattus norvegicus
ccagagccaccgctgcgtcgcagcc

SEQ ID NO: 656142 - DNA, 25 bp, Rattus norvegicus
ccagcaaagtttccgttccgaggag

SEQ ID NO: 656143 - DNA, 25 bp, Rattus norvegicus
cccgcgcccgcactcccagcaaagt

SEQ ID NO: 656144 - DNA, 25 bp, Rattus norvegicus
ctgcaagaaagtctagggagttgga

SEQ ID NO: 656145 - DNA, 25 bp, Rattus norvegicus
gtgatcgcgaaagccctggctccct

SEQ ID NO: 656146 - DNA, 25 bp, Rattus norvegicus
caggcacaatggagggacgaggccc

SEQ ID NO: 656147 - DNA, 25 bp, Rattus norvegicus
ttcgtcgccgacttctctgctcgta

SEQ ID NO: 656148 - DNA, 25 bp, Rattus norvegicus
agtcggtgaaggtaggcctctccgt

SEQ ID NO: 656149 - DNA, 25 bp, Rattus norvegicus
gcagcgttgggctccattccgtaaa

SEQ ID NO: 656150 - DNA, 25 bp, Rattus norvegicus
ggctccattccgtaaacagtcactg

SEQ ID NO: 656151 - DNA, 25 bp, Rattus norvegicus
taaacagtcactgcgccacttgcca

SEQ ID NO: 656152 - DNA, 25 bp, Rattus norvegicus
tgccaagcgcagagaaaacaaaatc

SEQ ID NO: 656153 - DNA, 25 bp, Rattus norvegicus
aggcgggcgccgagtctctcgcact

SEQ ID NO: 656154 - DNA, 25 bp, Rattus norvegicus
aacggctgccgcagtcagagcacca

SEQ ID NO: 656155 - DNA, 25 bp, Rattus norvegicus
ccgctctcgcgagaagctggcgaga

SEQ ID NO: 656156 - DNA, 25 bp, Rattus norvegicus
cgccattgtgcttcgtcgccgactt

SEQ ID NO: 656157 - DNA, 25 bp, Rattus norvegicus
gacttctctgctcgtagcccgagga

SEQ ID NO: 656158 - DNA, 25 bp, Rattus norvegicus
gtagcccgaggaccgagcccagcga

SEQ ID NO: 656159 - DNA, 25 bp, Rattus norvegicus
actccctgcggagtgccaagtggaa

SEQ ID NO: 656160 - DNA, 25 bp, Rattus norvegicus
gcgagcgcgacactccctgcggagt

SEQ ID NO: 656161 - DNA, 25 bp, Rattus norvegicus
atggcagtggctaggctcagcagca

SEQ ID NO: 656162 - DNA, 25 bp, Rattus norvegicus
gcatgactgcgaggtgctgtgcgga

SEQ ID NO: 656163 - DNA, 25 bp, Rattus norvegicus
atagcgctgcgtggggcatgactgc

SEQ ID NO: 656164 - DNA, 25 bp, Rattus norvegicus
tcagcagcacgagcgaggatagcgc

SEQ ID NO: 656165 - DNA, 25 bp, Rattus norvegicus
aggctcagcagcacgagcgaggata

SEQ ID NO: 656166 - DNA, 25 bp, Rattus norvegicus
agcccagggtcgcactgcttggacg

SEQ ID NO: 656167 - DNA, 25 bp, Rattus norvegicus
cagtggctaggctcagcagcacgag

SEQ ID NO: 656168 - DNA, 25 bp, Rattus norvegicus
cagtcgcgacgcctcccactcgagg

SEQ ID NO: 656169 - DNA, 25 bp, Rattus norvegicus
taccagcgaagatggcagtggctag

SEQ ID NO: 656170 - DNA, 25 bp, Rattus norvegicus
cttaccagcgaagatggcagtggct

SEQ ID NO: 656171 - DNA, 25 bp, Rattus norvegicus
cggcttaccagcgaagatggcagtg

SEQ ID NO: 656172 - DNA, 25 bp, Rattus norvegicus
agctcccagctcagtcgcgacgcct

SEQ ID NO: 656173 - DNA, 25 bp, Rattus norvegicus
ccgcgcggagctcccagctcagtcg

SEQ ID NO: 656174 - DNA, 25 bp, Rattus norvegicus
tggctaggctcagcagcacgagcga

SEQ ID NO: 656175 - DNA, 25 bp, Rattus norvegicus
tctagggcaacctctggggtgcgca

SEQ ID NO: 656176 - DNA, 25 bp, Rattus norvegicus
tccccgcacgggctccaggggtgaa

SEQ ID NO: 656177 - DNA, 25 bp, Rattus norvegicus
cgccggtctcaagacgcctctaggg

SEQ ID NO: 656178 - DNA, 25 bp, Rattus norvegicus
ccctgaggaggcaaaagcccagagc

SEQ ID NO: 656179 - DNA, 25 bp, Rattus norvegicus
aagacgcctctagggcaacctctgg

SEQ ID NO: 656180 - DNA, 25 bp, Rattus norvegicus
catctccagtcccaagcctctgctc

SEQ ID NO: 656181 - DNA, 25 bp, Rattus norvegicus
gcaacagcacgagtagcccggtcgc

SEQ ID NO: 656182 - DNA, 25 bp, Rattus norvegicus
cagcaacagcacgagtagcccggtc

SEQ ID NO: 656183 - DNA, 25 bp, Rattus norvegicus
tcaaagcaccgcagcaacagcacga

SEQ ID NO: 656184 - DNA, 25 bp, Rattus norvegicus
aaggctccacaagctcaaagcaccg

SEQ ID NO: 656185 - DNA, 25 bp, Rattus norvegicus
cctgaaggctccacaagctcaaagc

SEQ ID NO: 656186 - DNA, 25 bp, Rattus norvegicus
cagcagcgtcgaggccgcccggttt

SEQ ID NO: 656187 - DNA, 25 bp, Rattus norvegicus
aggcaaaagcccagagcagcagcgt

SEQ ID NO: 656188 - DNA, 25 bp, Rattus norvegicus
ggccaatcagagctccgccttgcgt

SEQ ID NO: 656189 - DNA, 25 bp, Rattus norvegicus
tgacacacacgggaccacaaccgta

SEQ ID NO: 656190 - DNA, 25 bp, Rattus norvegicus
agagatgaactcgcctcccgtgtcg

SEQ ID NO: 656191 - DNA, 25 bp, Rattus norvegicus
tggagacacaaatagcggagttttc

SEQ ID NO: 656192 - DNA, 25 bp, Rattus norvegicus
ctctgggcgtggagacacaaatagc

SEQ ID NO: 656193 - DNA, 25 bp, Rattus norvegicus
tgtgtacacttgtggctctgggcgt

SEQ ID NO: 656194 - DNA, 25 bp, Rattus norvegicus
tgtcgccacagtgtgtacacttgtg

SEQ ID NO: 656195 - DNA, 25 bp, Rattus norvegicus
ctcccgtgtcgccacagtgtgtaca

SEQ ID NO: 656196 - DNA, 25 bp, Rattus norvegicus
cccggagccctagagatgaactcgc

SEQ ID NO: 656197 - DNA, 25 bp, Rattus norvegicus
actcttctcgaggaccacgctaccc

SEQ ID NO: 656198 - DNA, 25 bp, Rattus norvegicus
gaaaagcctccactcttctcgagga

SEQ ID NO: 656199 - DNA, 25 bp, Rattus norvegicus
ggcgcaggaggcaagaaaagcctcc

SEQ ID NO: 656200 - DNA, 25 bp, Rattus norvegicus
aaccgtatcccgtgctctggactgg

SEQ ID NO: 656201 - DNA, 25 bp, Rattus norvegicus
gctaggtgacacacacgggaccaca

SEQ ID NO: 656202 - DNA, 25 bp, Rattus norvegicus
atcccgtgctctggactggggcgca

SEQ ID NO: 656203 - DNA, 25 bp, Rattus norvegicus
cgccctgcgtgccatggaccggagt

SEQ ID NO: 656204 - DNA, 25 bp, Rattus norvegicus
cccaggccctttggcgaggcgtcgc

SEQ ID NO: 656205 - DNA, 25 bp, Rattus norvegicus
tgccgcacattcctgggagcagcca

SEQ ID NO: 656206 - DNA, 25 bp, Rattus norvegicus
cgcgtgccgcacattcctgggagca

SEQ ID NO: 656207 - DNA, 25 bp, Rattus norvegicus
cgcgcaatggttggctctggcgccc

SEQ ID NO: 656208 - DNA, 25 bp, Rattus norvegicus
ccatcccgcgcaatggttggctctg

SEQ ID NO: 656209 - DNA, 25 bp, Rattus norvegicus
ctgcgtgccatggaccggagttcgc

SEQ ID NO: 656210 - DNA, 25 bp, Rattus norvegicus
gccggcgactctcgagcagctccgg

SEQ ID NO: 656211 - DNA, 25 bp, Rattus norvegicus
cgccctaaaagtgcggcgcgacgcg

SEQ ID NO: 656212 - DNA, 25 bp, Rattus norvegicus
cctctctcgcccgtccgggacggcg

SEQ ID NO: 656213 - DNA, 25 bp, Rattus norvegicus
ctgccgctggggaagatcatctcgg

SEQ ID NO: 656214 - DNA, 25 bp, Rattus norvegicus
cctgcttgcggtagggcgtcctgca

SEQ ID NO: 656215 - DNA, 25 bp, Rattus norvegicus
ggcagcctcacctgcttgcggtagg

SEQ ID NO: 656216 - DNA, 25 bp, Rattus norvegicus
gcaccgcctagtgccgcgcccagcc

SEQ ID NO: 656217 - DNA, 25 bp, Rattus norvegicus
ggccagcggtcctttcctgtctagt

SEQ ID NO: 656218 - DNA, 25 bp, Rattus norvegicus
tctgtaacccgatcgccgcgatcgg

SEQ ID NO: 656219 - DNA, 25 bp, Rattus norvegicus
cccaggccagcgctatagttagcaa

SEQ ID NO: 656220 - DNA, 25 bp, Rattus norvegicus
tccttaccttggcttgcagatactg

SEQ ID NO: 656221 - DNA, 25 bp, Rattus norvegicus
ataggtggcgtactgagggtacatc

SEQ ID NO: 656222 - DNA, 25 bp, Rattus norvegicus
gggtacatctgttgtttccacactt

SEQ ID NO: 656223 - DNA, 25 bp, Rattus norvegicus
cccatgaagctggaaggaagcctgc

SEQ ID NO: 656224 - DNA, 25 bp, Rattus norvegicus
ccgtgcagggtcgaagacactttag

SEQ ID NO: 656225 - DNA, 25 bp, Rattus norvegicus
ctccttccaggcagacagaaagaca

SEQ ID NO: 656226 - DNA, 25 bp, Rattus norvegicus
acagggcgctcccaaggagtttcct

SEQ ID NO: 656227 - DNA, 25 bp, Rattus norvegicus
aggagtttcctctgggagcccgact

SEQ ID NO: 656228 - DNA, 25 bp, Rattus norvegicus
tgagcccagctacgagtgatcaata

SEQ ID NO: 656229 - DNA, 25 bp, Rattus norvegicus
caatacaagtggaaagtacggcggc

SEQ ID NO: 656230 - DNA, 25 bp, Rattus norvegicus
agaggtctgaaagccgtgccgccag

SEQ ID NO: 656231 - DNA, 25 bp, Rattus norvegicus
ctctgcccgtgaactagctgtcttc

SEQ ID NO: 656232 - DNA, 25 bp, Rattus norvegicus
gaactcacagcaccgggactacatc

SEQ ID NO: 656233 - DNA, 25 bp, Rattus norvegicus
ccgagaagttctggcgcaatgcact

SEQ ID NO: 656234 - DNA, 25 bp, Rattus norvegicus
tgctgggacctcctcggactaccta

SEQ ID NO: 656235 - DNA, 25 bp, Rattus norvegicus
cctacgaggctttcgtgccaccaga

SEQ ID NO: 656236 - DNA, 25 bp, Rattus norvegicus
ctaactgtctgctgcccactgtggc

SEQ ID NO: 656237 - DNA, 25 bp, Rattus norvegicus
gtagatgacttcagctctgcccgtg

SEQ ID NO: 656238 - DNA, 25 bp, Rattus norvegicus
ccttgtcagcatgaatgagagtcgc

SEQ ID NO: 656239 - DNA, 25 bp, Rattus norvegicus
agagtcgctatcgtggcttctttgc

SEQ ID NO: 656240 - DNA, 25 bp, Rattus norvegicus
gcttctttgcttggcgagaccggct

SEQ ID NO: 656241 - DNA, 25 bp, Rattus norvegicus
tcctgaatgactggagggagcgctt

SEQ ID NO: 656242 - DNA, 25 bp, Rattus norvegicus
gggagcgcttctgcaccatctgcgc

SEQ ID NO: 656243 - DNA, 25 bp, Rattus norvegicus
tctacctgtcctttgagaactcaca

SEQ ID NO: 656244 - DNA, 25 bp, Rattus norvegicus
gccaccagatgcctttatacacgta

SEQ ID NO: 656245 - DNA, 25 bp, Rattus norvegicus
ccgagctgaccctgtggggctttcc

SEQ ID NO: 656246 - DNA, 25 bp, Rattus norvegicus
agccagtttacagcgggattttgaa

SEQ ID NO: 656247 - DNA, 25 bp, Rattus norvegicus
ccctgaggatggaaggtgaaacgtt

SEQ ID NO: 656248 - DNA, 25 bp, Rattus norvegicus
cttcccggggcgagaaataagcgcg

SEQ ID NO: 656249 - DNA, 25 bp, Rattus norvegicus
tttgaaccacagaaagcgcgggtcc

SEQ ID NO: 656250 - DNA, 25 bp, Rattus norvegicus
gagcagcggccacagccagtttaca

SEQ ID NO: 656251 - DNA, 25 bp, Rattus norvegicus
gcgctgcatcgaagtctcctcggga

SEQ ID NO: 656252 - DNA, 25 bp, Rattus norvegicus
caactgtgagtaaaaacggagaccg

SEQ ID NO: 656253 - DNA, 25 bp, Rattus norvegicus
caccggcgacctgtagcgtgagagc

SEQ ID NO: 656254 - DNA, 25 bp, Rattus norvegicus
ccggctgcagtcgttctgccgggca

SEQ ID NO: 656255 - DNA, 25 bp, Rattus norvegicus
tggaacggaaagcaacttccggctg

SEQ ID NO: 656256 - DNA, 25 bp, Rattus norvegicus
gctgccctctgaactggaacggaaa

SEQ ID NO: 656257 - DNA, 25 bp, Rattus norvegicus
ttaatgactcagagcgcagtcgctg

SEQ ID NO: 656258 - DNA, 25 bp, Rattus norvegicus
cggcggaaaccctcaactgtgagta

SEQ ID NO: 656259 - DNA, 25 bp, Rattus norvegicus
agctgtcggcgtggtcaagccctcc

SEQ ID NO: 656260 - DNA, 25 bp, Rattus norvegicus
atccgtctcatttgagaagagcagc

SEQ ID NO: 656261 - DNA, 25 bp, Rattus norvegicus
agcagcatttgaggcagcagcgttc

SEQ ID NO: 656262 - DNA, 25 bp, Rattus norvegicus
tcgcctgctgaacggtgacagattg

SEQ ID NO: 656263 - DNA, 25 bp, Rattus norvegicus
tgttaaaacaatggagccgggcgcg

SEQ ID NO: 656264 - DNA, 25 bp, Rattus norvegicus
gcgagcgctgctgcatgctaatcag

SEQ ID NO: 656265 - DNA, 25 bp, Rattus norvegicus
agcgatcgagcgagctcagcccgca

SEQ ID NO: 656266 - DNA, 25 bp, Rattus norvegicus
aaccacgccagaggcccagggacaa

SEQ ID NO: 656267 - DNA, 25 bp, Rattus norvegicus
aggctgcgggctgtaaccctcgcat

SEQ ID NO: 656268 - DNA, 25 bp, Rattus norvegicus
ccacactggtttgagctgtcggcgt

SEQ ID NO: 656269 - DNA, 25 bp, Rattus norvegicus
cgtgcggggcaactaattatccgtc

SEQ ID NO: 656270 - DNA, 25 bp, Rattus norvegicus
aaacaaagccagatcgggccgagcc

SEQ ID NO: 656271 - DNA, 25 bp, Rattus norvegicus
agccggatctttcccgcacaggctt

SEQ ID NO: 656272 - DNA, 25 bp, Rattus norvegicus
agctgccgagccacactggtttgag

SEQ ID NO: 656273 - DNA, 25 bp, Rattus norvegicus
cctgacaccggttgccacgcgagat

SEQ ID NO: 656274 - DNA, 25 bp, Rattus norvegicus
caaggaacgtgtcgctcgagctgca

SEQ ID NO: 656275 - DNA, 25 bp, Rattus norvegicus
tactcgatcctctgtgcggagctgg

SEQ ID NO: 656276 - DNA, 25 bp, Rattus norvegicus
ttcgtggagggccatactcgatcct

SEQ ID NO: 656277 - DNA, 25 bp, Rattus norvegicus
cctggttaactctgagcgaaggttc

SEQ ID NO: 656278 - DNA, 25 bp, Rattus norvegicus
cgggaactctatgaccaactgggac

SEQ ID NO: 656279 - DNA, 25 bp, Rattus norvegicus
cctgagccggaactcgggaactcta

SEQ ID NO: 656280 - DNA, 25 bp, Rattus norvegicus
tagcatcgaatgtagccctgagccg

SEQ ID NO: 656281 - DNA, 25 bp, Rattus norvegicus
gacaggcgctctagcatcgaatgta

SEQ ID NO: 656282 - DNA, 25 bp, Rattus norvegicus
tcggctttgtgacagaaaccgtacc

SEQ ID NO: 656283 - DNA, 25 bp, Rattus norvegicus
acccgtgacgccacctgcgaaagga

SEQ ID NO: 656284 - DNA, 25 bp, Rattus norvegicus
gaagcgcccgtccttgcttgctgac

SEQ ID NO: 656285 - DNA, 25 bp, Rattus norvegicus
tcgagctgcagtcccagagctgcga

SEQ ID NO: 656286 - DNA, 25 bp, Rattus norvegicus
cacgcgagatcaagccaggtccttt

SEQ ID NO: 656287 - DNA, 25 bp, Rattus norvegicus
gcctcttttcctgcatttccttgtg

SEQ ID NO: 656288 - DNA, 25 bp, Rattus norvegicus
tctccacgaccagcgcagggcgaag

SEQ ID NO: 656289 - DNA, 25 bp, Rattus norvegicus
tccttgtgtagaaacgcgccattga

SEQ ID NO: 656290 - DNA, 25 bp, Rattus norvegicus
cgcgccattgagaactgaggggact

SEQ ID NO: 656291 - DNA, 25 bp, Rattus norvegicus
agttgacagctagggtcggccatcc

SEQ ID NO: 656292 - DNA, 25 bp, Rattus norvegicus
tctccggcctcgacttggatgagcc

SEQ ID NO: 656293 - DNA, 25 bp, Rattus norvegicus
ggggccaacattgcctgtcctcgga

SEQ ID NO: 656294 - DNA, 25 bp, Rattus norvegicus
ctcgtgctgtcaaggggaccagaaa

SEQ ID NO: 656295 - DNA, 25 bp, Rattus norvegicus
gcgcgtggctgcagatttacctcac

SEQ ID NO: 656296 - DNA, 25 bp, Rattus norvegicus
ctgactcagtccacacagcagatgg

SEQ ID NO: 656297 - DNA, 25 bp, Rattus norvegicus
agcagctaaggctcgtctttcagca

SEQ ID NO: 656298 - DNA, 25 bp, Rattus norvegicus
cgaggcgcttcgttcctgtgaaatc

SEQ ID NO: 656299 - DNA, 25 bp, Rattus norvegicus
tctctcctcggaggctaagggcttc

SEQ ID NO: 656300 - DNA, 25 bp, Rattus norvegicus
aagggcttcgcttacgcacttgaca

SEQ ID NO: 656301 - DNA, 25 bp, Rattus norvegicus
cagttcttctcgcagtcccgctggg

SEQ ID NO: 656302 - DNA, 25 bp, Rattus norvegicus
ggtcaagcggtccatgtcgcagccc

SEQ ID NO: 656303 - DNA, 25 bp, Rattus norvegicus
ctcacgaattgatcttgcaggaaag

SEQ ID NO: 656304 - DNA, 25 bp, Rattus norvegicus
gccttggcgtagttgctcacgaatt

SEQ ID NO: 656305 - DNA, 25 bp, Rattus norvegicus
agtccgtggccgtatcgtaggccga

SEQ ID NO: 656306 - DNA, 25 bp, Rattus norvegicus
tcctcgcctaagtaggggttggcgc

SEQ ID NO: 656307 - DNA, 25 bp, Rattus norvegicus
gcgtctcgatccagctggagtcgga

SEQ ID NO: 656308 - DNA, 25 bp, Rattus norvegicus
cagacggtcatcgagcgtcaagtga

SEQ ID NO: 656309 - DNA, 25 bp, Rattus norvegicus
ccagcacctcgctcttgagtgggga

SEQ ID NO: 656310 - DNA, 25 bp, Rattus norvegicus
gcctatgtccttggcgcagttcttc

SEQ ID NO: 656311 - DNA, 25 bp, Rattus norvegicus
agaagccatagtagccgcctatgtc

SEQ ID NO: 656312 - DNA, 25 bp, Rattus norvegicus
cctagctgtgcgagtagaagccata

SEQ ID NO: 656313 - DNA, 25 bp, Rattus norvegicus
cgtcaagtgaaagagcgagtgcgca

SEQ ID NO: 656314 - DNA, 25 bp, Rattus norvegicus
ggagagatccgcctccgcttggcct

SEQ ID NO: 656315 - DNA, 25 bp, Rattus norvegicus
agaaaggagagcgagcgctgttacc

SEQ ID NO: 656316 - DNA, 25 bp, Rattus norvegicus
gagcttccttacatcggtgttctga

SEQ ID NO: 656317 - DNA, 25 bp, Rattus norvegicus
agcgagcgctgttaccgcgcctgtt

SEQ ID NO: 656318 - DNA, 25 bp, Rattus norvegicus
aaccaccatctgtccggcgaagaga

SEQ ID NO: 656319 - DNA, 25 bp, Rattus norvegicus
tgcagggactgtaaaaccaccatct

SEQ ID NO: 656320 - DNA, 25 bp, Rattus norvegicus
gctggtacttgtgcagggactgtaa

SEQ ID NO: 656321 - DNA, 25 bp, Rattus norvegicus
accacgtgcagacggggctggtact

SEQ ID NO: 656322 - DNA, 25 bp, Rattus norvegicus
ttcacttccaccacgtgcagacggg

SEQ ID NO: 656323 - DNA, 25 bp, Rattus norvegicus
tggtgtcctctgtgccgtcctcatt

SEQ ID NO: 656324 - DNA, 25 bp, Rattus norvegicus
aaagtgaacgtctggacgcggcctg

SEQ ID NO: 656325 - DNA, 25 bp, Rattus norvegicus
ctgagtctctgggaaagtgaacgtc

SEQ ID NO: 656326 - DNA, 25 bp, Rattus norvegicus
cggtgacagcgatgaactgagtctc

SEQ ID NO: 656327 - DNA, 25 bp, Rattus norvegicus
atctgtccggcgaagagaaaggaga

SEQ ID NO: 656328 - DNA, 25 bp, Rattus norvegicus
atcggtgttctgataggcggtgaca

SEQ ID NO: 656329 - DNA, 25 bp, Rattus norvegicus
acaggtatacctgcgccttgccggg

SEQ ID NO: 656330 - DNA, 25 bp, Rattus norvegicus
gccaaagtggcctgttgcacaggta

SEQ ID NO: 656331 - DNA, 25 bp, Rattus norvegicus
tctccgtttgatgccgatgaaattt

SEQ ID NO: 656332 - DNA, 25 bp, Rattus norvegicus
ccttccctgtttagtgatgatcatc

SEQ ID NO: 656333 - DNA, 25 bp, Rattus norvegicus
gcggcagccaagaaaagtagcatta

SEQ ID NO: 656334 - DNA, 25 bp, Rattus norvegicus
aagcaaaacttgtcctcgccgcgtg

SEQ ID NO: 656335 - DNA, 25 bp, Rattus norvegicus
tcacgcctggaacagcggcagccaa

SEQ ID NO: 656336 - DNA, 25 bp, Rattus norvegicus
gtcacaacttgggtgcgttcgccca

SEQ ID NO: 656337 - DNA, 25 bp, Rattus norvegicus
tcaccacggtggttattatcccttc

SEQ ID NO: 656338 - DNA, 25 bp, Rattus norvegicus
gttctccgaccgcattggcacagca

SEQ ID NO: 656339 - DNA, 25 bp, Rattus norvegicus
tgagttgctctgaaagcctgttagc

SEQ ID NO: 656340 - DNA, 25 bp, Rattus norvegicus
acaggccagcttcgatgagttgctc

SEQ ID NO: 656341 - DNA, 25 bp, Rattus norvegicus
tcgccgcgtgtctgaacgaatgttt

SEQ ID NO: 656342 - DNA, 25 bp, Rattus norvegicus
ctgttgtaagctccgttggtgatga

SEQ ID NO: 656343 - DNA, 25 bp, Rattus norvegicus
ccagcgcggaaggactactaggcga

SEQ ID NO: 656344 - DNA, 25 bp, Rattus norvegicus
gcggggtgcactcaccttcatggtt

SEQ ID NO: 656345 - DNA, 25 bp, Rattus norvegicus
ttgggcggctccttgaaactgaact

SEQ ID NO: 656346 - DNA, 25 bp, Rattus norvegicus
cggctccttgaaactgaactctgaa

SEQ ID NO: 656347 - DNA, 25 bp, Rattus norvegicus
actctgaagcttgagcgcaggcaga

SEQ ID NO: 656348 - DNA, 25 bp, Rattus norvegicus
agcttgagcgcaggcagaagtcacc

SEQ ID NO: 656349 - DNA, 25 bp, Rattus norvegicus
gagacggacgtcctgcgcctctgct

SEQ ID NO: 656350 - DNA, 25 bp, Rattus norvegicus
ctgctctgcacacagtcaccctgag

SEQ ID NO: 656351 - DNA, 25 bp, Rattus norvegicus
tcaccctgagctcgccgccaagttt

SEQ ID NO: 656352 - DNA, 25 bp, Rattus norvegicus
gcccgagttaaacattagttagcgc

SEQ ID NO: 656353 - DNA, 25 bp, Rattus norvegicus
aaacattagttagcgccaggcgggc

SEQ ID NO: 656354 - DNA, 25 bp, Rattus norvegicus
attagttagcgccaggcgggcttcg

SEQ ID NO: 656355 - DNA, 25 bp, Rattus norvegicus
cgacccagcgcggaaggactactag

SEQ ID NO: 656356 - DNA, 25 bp, Rattus norvegicus
ctcaccttcatggttgggcggctcc

SEQ ID NO: 656357 - DNA, 25 bp, Rattus norvegicus
tttcgagaggctagaagaggcctgt

SEQ ID NO: 656358 - DNA, 25 bp, Rattus norvegicus
caggtaccgggtagcctctgagcac

SEQ ID NO: 656359 - DNA, 25 bp, Rattus norvegicus
ccagagaattagtttcgagaggcta

SEQ ID NO: 656360 - DNA, 25 bp, Rattus norvegicus
cttccgggccagagaattagtttcg

SEQ ID NO: 656361 - DNA, 25 bp, Rattus norvegicus
tacttacgtcaacttccgggccaga

SEQ ID NO: 656362 - DNA, 25 bp, Rattus norvegicus
cggtttctgtttcgattctcttctc

SEQ ID NO: 656363 - DNA, 25 bp, Rattus norvegicus
tgccacccacacatcggtttctgtt

SEQ ID NO: 656364 - DNA, 25 bp, Rattus norvegicus
agctttaagtattgcctgccaccca

SEQ ID NO: 656365 - DNA, 25 bp, Rattus norvegicus
cccagcagggagctttaagtattgc

SEQ ID NO: 656366 - DNA, 25 bp, Rattus norvegicus
cgctgcagcaggtggtcatagaccc

SEQ ID NO: 656367 - DNA, 25 bp, Rattus norvegicus
agacgagccaggaatgcgctgcagc

SEQ ID NO: 656368 - DNA, 25 bp, Rattus norvegicus
cacccggaaggtggcagacgagcca

SEQ ID NO: 656369 - DNA, 25 bp, Rattus norvegicus
ccggattgatcggtggcacccggaa

SEQ ID NO: 656370 - DNA, 25 bp, Rattus norvegicus
ctctgagcaccggattgatcggtgg

SEQ ID NO: 656371 - DNA, 25 bp, Rattus norvegicus
tgacgcgtgactttcgatctcctgg

SEQ ID NO: 656372 - DNA, 25 bp, Rattus norvegicus
cttctggtaccaggcgacgcccgga

SEQ ID NO: 656373 - DNA, 25 bp, Rattus norvegicus
tggccctggcagtgccttctggtac

SEQ ID NO: 656374 - DNA, 25 bp, Rattus norvegicus
cgtgcagagttcaccctgtggccct

SEQ ID NO: 656375 - DNA, 25 bp, Rattus norvegicus
acgggccgcatcaccgtgcagagtt

SEQ ID NO: 656376 - DNA, 25 bp, Rattus norvegicus
ggggcggtaagtcctcaccatctca

SEQ ID NO: 656377 - DNA, 25 bp, Rattus norvegicus
ctttcgatctcctggtcatggccta

SEQ ID NO: 656378 - DNA, 25 bp, Rattus norvegicus
gcccggactctctgaggtgctaaga

SEQ ID NO: 656379 - DNA, 25 bp, Rattus norvegicus
ccgacttactggtgacgcgtgactt

SEQ ID NO: 656380 - DNA, 25 bp, Rattus norvegicus
cagcagcgctgacgccgacttactg

SEQ ID NO: 656381 - DNA, 25 bp, Rattus norvegicus
ttgtgccttcctcacagcagcgctg

SEQ ID NO: 656382 - DNA, 25 bp, Rattus norvegicus
gtgcgcgatacagcgctcggacctt

SEQ ID NO: 656383 - DNA, 25 bp, Rattus norvegicus
actctaggaggaggtggctcgccca

SEQ ID NO: 656384 - DNA, 25 bp, Rattus norvegicus
ggtcatggcctacccgggatacgga

SEQ ID NO: 656385 - DNA, 25 bp, Rattus norvegicus
gacggacgccaagtggtctaccaaa

SEQ ID NO: 656386 - DNA, 25 bp, Rattus norvegicus
ctaccaaagccgaaagcgagcgaca

SEQ ID NO: 656387 - DNA, 25 bp, Rattus norvegicus
cgacaggagagaacaaacgaactta

SEQ ID NO: 656388 - DNA, 25 bp, Rattus norvegicus
acgaacttactctgcccttcaaatt

SEQ ID NO: 656389 - DNA, 25 bp, Rattus norvegicus
cttcaaatttccgtatgatggtccc

SEQ ID NO: 656390 - DNA, 25 bp, Rattus norvegicus
caggaaggtgttttgcggtgccaca

SEQ ID NO: 656391 - DNA, 25 bp, Rattus norvegicus
aacaggcatgttgcccgggtcttcg

SEQ ID NO: 656392 - DNA, 25 bp, Rattus norvegicus
ccgagcgctccgagctcggagttct

SEQ ID NO: 656393 - DNA, 25 bp, Rattus norvegicus
gctcggagttctcccgggatgtctc

SEQ ID NO: 656394 - DNA, 25 bp, Rattus norvegicus
atgtctcccgggctagagcccaggc

SEQ ID NO: 656395 - DNA, 25 bp, Rattus norvegicus
aagccgctctttgtggcagcgcatc

SEQ ID NO: 656396 - DNA, 25 bp, Rattus norvegicus
cagcgcatcttctttggggagcaga

SEQ ID NO: 656397 - DNA, 25 bp, Rattus norvegicus
tttccattagcaccacttcgagaca

SEQ ID NO: 656398 - DNA, 25 bp, Rattus norvegicus
ggggagcagaaatctctttccatta

SEQ ID NO: 656399 - DNA, 25 bp, Rattus norvegicus
cgcagcacacggctgagtcacgggc

SEQ ID NO: 656400 - DNA, 25 bp, Rattus norvegicus
taccggagcgccgagacacctttaa

SEQ ID NO: 656401 - DNA, 25 bp, Rattus norvegicus
gctgacactcgcagcacacggctga

SEQ ID NO: 656402 - DNA, 25 bp, Rattus norvegicus
agctgtgccctggtccgctgacact

SEQ ID NO: 656403 - DNA, 25 bp, Rattus norvegicus
cagagcgttcggctagctgtgccct

SEQ ID NO: 656404 - DNA, 25 bp, Rattus norvegicus
acaggagaccctgcaccgggccgga

SEQ ID NO: 656405 - DNA, 25 bp, Rattus norvegicus
cgcgttcacgtgcagtgcccaggcg

SEQ ID NO: 656406 - DNA, 25 bp, Rattus norvegicus
gcgcccaatttgttggtgcgctccc

SEQ ID NO: 656407 - DNA, 25 bp, Rattus norvegicus
aggccgcgcgcccaatttgttggtg

SEQ ID NO: 656408 - DNA, 25 bp, Rattus norvegicus
aacgtgacgctgaagcgccggagcc

SEQ ID NO: 656409 - DNA, 25 bp, Rattus norvegicus
ctgctctggaagaacgtgacgctga

SEQ ID NO: 656410 - DNA, 25 bp, Rattus norvegicus
cagctgctgctctggaagaacgtga

SEQ ID NO: 656411 - DNA, 25 bp, Rattus norvegicus
agcagcaggtccaggacgctcgagc

SEQ ID NO: 656412 - DNA, 25 bp, Rattus norvegicus
cgagacacctttaagcaggggcggc

SEQ ID NO: 656413 - DNA, 25 bp, Rattus norvegicus
aaaaccctaagtgtctaggtgtgcg

SEQ ID NO: 656414 - DNA, 25 bp, Rattus norvegicus
accctaagtgtctaggtgtgcggtc

SEQ ID NO: 656415 - DNA, 25 bp, Rattus norvegicus
cggccgccgggtcatgttacacggc

SEQ ID NO: 656416 - DNA, 25 bp, Rattus norvegicus
atgttacacggcccgggcctttgcg

SEQ ID NO: 656417 - DNA, 25 bp, Rattus norvegicus
aagcgagcccggctgtccacgagcg

SEQ ID NO: 656418 - DNA, 25 bp, Rattus norvegicus
tgtccacgagcgatcgcgcgtctct

SEQ ID NO: 656419 - DNA, 25 bp, Rattus norvegicus
ggtcaccaccgtagcccggccagcc

SEQ ID NO: 656420 - DNA, 25 bp, Rattus norvegicus
cccgcaccagtcagaaaatgacttt

SEQ ID NO: 656421 - DNA, 25 bp, Rattus norvegicus
gaaaatgactttatctgctagggaa

SEQ ID NO: 656422 - DNA, 25 bp, Rattus norvegicus
ctttatctgctagggaaaggcaagt

SEQ ID NO: 656423 - DNA, 25 bp, Rattus norvegicus
ttggggaggctgatcagcttgaacc

SEQ ID NO: 656424 - DNA, 25 bp, Rattus norvegicus
aggctgatcagcttgaacccacttc

SEQ ID NO: 656425 - DNA, 25 bp, Rattus norvegicus
tgatcagcttgaacccacttcgccg

SEQ ID NO: 656426 - DNA, 25 bp, Rattus norvegicus
taggtgtgcggtcccctctcgagct

SEQ ID NO: 656427 - DNA, 25 bp, Rattus norvegicus
gcccagggagaaccacctagatttc

SEQ ID NO: 656428 - DNA, 25 bp, Rattus norvegicus
acgtcaggcggcgagattctcttac

SEQ ID NO: 656429 - DNA, 25 bp, Rattus norvegicus
tgtgaccgttgtgagggaaaagctt

SEQ ID NO: 656430 - DNA, 25 bp, Rattus norvegicus
agtacctctttcgtagtgaccgtgg

SEQ ID NO: 656431 - DNA, 25 bp, Rattus norvegicus
agctccggtgtagcagcgatagttg

SEQ ID NO: 656432 - DNA, 25 bp, Rattus norvegicus
cccgtttggcatctgttcattgaga

SEQ ID NO: 656433 - DNA, 25 bp, Rattus norvegicus
gtccgtccagcacgcctagggagaa

SEQ ID NO: 656434 - DNA, 25 bp, Rattus norvegicus
attcccgcgaccgtttggtcactga

SEQ ID NO: 656435 - DNA, 25 bp, Rattus norvegicus
ttggtcactgaaacctccgttgtca

SEQ ID NO: 656436 - DNA, 25 bp, Rattus norvegicus
tcgtgacgggcaggaaaccattaca

SEQ ID NO: 656437 - DNA, 25 bp, Rattus norvegicus
tgggttttgcgcagtgtcttagatc

SEQ ID NO: 656438 - DNA, 25 bp, Rattus norvegicus
agaaagaagcttggacgtgtccgtc

SEQ ID NO: 656439 - DNA, 25 bp, Rattus norvegicus
ccatctttgtccctggcaaattggg

SEQ ID NO: 656440 - DNA, 25 bp, Rattus norvegicus
ttgcctccggtgagttcaaggcggc

SEQ ID NO: 656441 - DNA, 25 bp, Rattus norvegicus
aacttggtcgggctcgggcacacac

SEQ ID NO: 656442 - DNA, 25 bp, Rattus norvegicus
cggcgctctgcccatcttgcaggga

SEQ ID NO: 656443 - DNA, 25 bp, Rattus norvegicus
cttgcagggacgtggtcatgatcgt

SEQ ID NO: 656444 - DNA, 25 bp, Rattus norvegicus
acctgtccatggcaccgcggcgggt

SEQ ID NO: 656445 - DNA, 25 bp, Rattus norvegicus
tctagggagtcatcgaccgcgaggc

SEQ ID NO: 656446 - DNA, 25 bp, Rattus norvegicus
cgaccgcgaggcgaaagcgaagaaa

SEQ ID NO: 656447 - DNA, 25 bp, Rattus norvegicus
tgggcaacgcggcacacctgcactg

SEQ ID NO: 656448 - DNA, 25 bp, Rattus norvegicus
aggcggctccaagggaattgtcttc

SEQ ID NO: 656449 - DNA, 25 bp, Rattus norvegicus
ctccaagggaattgtcttcagacac

SEQ ID NO: 656450 - DNA, 25 bp, Rattus norvegicus
tcttcagacacttttccaaacttgg

SEQ ID NO: 656451 - DNA, 25 bp, Rattus norvegicus
ccaaagcgggttgctgacccggaca

SEQ ID NO: 656452 - DNA, 25 bp, Rattus norvegicus
gacccggacaccctcacgaagcttc

SEQ ID NO: 656453 - DNA, 25 bp, Rattus norvegicus
cgaagcttcctacctgtccatggca

SEQ ID NO: 656454 - DNA, 25 bp, Rattus norvegicus
tgggcgtctcccttgccctgggcaa

SEQ ID NO: 656455 - DNA, 25 bp, Rattus norvegicus
gctgcgcaccaacagaatcccgtgt

SEQ ID NO: 656456 - DNA, 25 bp, Rattus norvegicus
aagagcccgcctcgacccacggcag

SEQ ID NO: 656457 - DNA, 25 bp, Rattus norvegicus
tgagggcgccgcgatgccagccaca

SEQ ID NO: 656458 - DNA, 25 bp, Rattus norvegicus
cagttggtgcttgggctccagcagc

SEQ ID NO: 656459 - DNA, 25 bp, Rattus norvegicus
acctgcgggtcggtccctgcctgag

SEQ ID NO: 656460 - DNA, 25 bp, Rattus norvegicus
caccaacagaatcccgtgtaaactt

SEQ ID NO: 656461 - DNA, 25 bp, Rattus norvegicus
acttttccggaggtgctgcggacca

SEQ ID NO: 656462 - DNA, 25 bp, Rattus norvegicus
ccaaaccgctgcctgctttagggga

SEQ ID NO: 656463 - DNA, 25 bp, Rattus norvegicus
gctgcctgctttaggggacccggcc

SEQ ID NO: 656464 - DNA, 25 bp, Rattus norvegicus
gggcaactaccctacttaccctgca

SEQ ID NO: 656465 - DNA, 25 bp, Rattus norvegicus
ttaccctgcagagccggcagactgc

SEQ ID NO: 656466 - DNA, 25 bp, Rattus norvegicus
cgggatcccgggcactgcggtccat

SEQ ID NO: 656467 - DNA, 25 bp, Rattus norvegicus
gcactgcggtccatcgcgctgctgg

SEQ ID NO: 656468 - DNA, 25 bp, Rattus norvegicus
tcgccacgcccgcagttggtgcttg

SEQ ID NO: 656469 - DNA, 25 bp, Rattus norvegicus
gccatccgcctgtctcgggaggact

SEQ ID NO: 656470 - DNA, 25 bp, Rattus norvegicus
cacggaagtcgacgaatacttcttc

SEQ ID NO: 656471 - DNA, 25 bp, Rattus norvegicus
aggaagcgagcacactgaccgtgga

SEQ ID NO: 656472 - DNA, 25 bp, Rattus norvegicus
ctgaccgtggatgacatttccgatg

SEQ ID NO: 656473 - DNA, 25 bp, Rattus norvegicus
ccgtggatgacatttccgatgacga

SEQ ID NO: 656474 - DNA, 25 bp, Rattus norvegicus
tccgatgacgatatcgatttagaca

SEQ ID NO: 656475 - DNA, 25 bp, Rattus norvegicus
gatttagacaacacggaagtcgacg

SEQ ID NO: 656476 - DNA, 25 bp, Rattus norvegicus
tcgacgaatacttcttcctgcaacc

SEQ ID NO: 656477 - DNA, 25 bp, Rattus norvegicus
cctgcccacaaaaaaacggagagct

SEQ ID NO: 656478 - DNA, 25 bp, Rattus norvegicus
aacggagagctctgttgcgagcctc

SEQ ID NO: 656479 - DNA, 25 bp, Rattus norvegicus
ttgcgagcctctggggtgaagaaga

SEQ ID NO: 656480 - DNA, 25 bp, Rattus norvegicus
gtgaagaagatcgacgtggaagaaa

SEQ ID NO: 656481 - DNA, 25 bp, Rattus norvegicus
aaaacacgagctgcgggccatccgc

SEQ ID NO: 656482 - DNA, 25 bp, Rattus norvegicus
tcgacgtggaagaaaaacacgagct

SEQ ID NO: 656483 - DNA, 25 bp, Rattus norvegicus
gcggggaaagttgcccagcacagcc

SEQ ID NO: 656484 - DNA, 25 bp, Rattus norvegicus
gcaggcaacctgctagctcaagttg

SEQ ID NO: 656485 - DNA, 25 bp, Rattus norvegicus
ttggcaagccttgagcagcgcctcc

SEQ ID NO: 656486 - DNA, 25 bp, Rattus norvegicus
gccctcccgaggactaccagggaga

SEQ ID NO: 656487 - DNA, 25 bp, Rattus norvegicus
ctaccagggagaccaggaggacttt

SEQ ID NO: 656488 - DNA, 25 bp, Rattus norvegicus
accggcgacaggagtgatcggtatc

SEQ ID NO: 656489 - DNA, 25 bp, Rattus norvegicus
gggagcaactgaaacccgctctcga

SEQ ID NO: 656490 - DNA, 25 bp, Rattus norvegicus
ctggacgtcggcttacctggcaggt

SEQ ID NO: 656491 - DNA, 25 bp, Rattus norvegicus
cttcctctgcgagtctcccaggtga

SEQ ID NO: 656492 - DNA, 25 bp, Rattus norvegicus
cggtcctacctgagcgctccaggtg

SEQ ID NO: 656493 - DNA, 25 bp, Rattus norvegicus
cccacaggcggggaccctgagaaat

SEQ ID NO: 656494 - DNA, 25 bp, Rattus norvegicus
ccctgagaaatctgagccgtacttc

SEQ ID NO: 656495 - DNA, 25 bp, Rattus norvegicus
ggctcagcagctttgtcgccagtta

SEQ ID NO: 656496 - DNA, 25 bp, Rattus norvegicus
tgagaccgtgttgctttgctcccgg

SEQ ID NO: 656497 - DNA, 25 bp, Rattus norvegicus
ctcaccgtaagctgcccgtgccacc

SEQ ID NO: 656498 - DNA, 25 bp, Rattus norvegicus
ggcgcggcatcttggccaaggccgc

SEQ ID NO: 656499 - DNA, 25 bp, Rattus norvegicus
cggctgagtcgtgaggccacaagga

SEQ ID NO: 656500 - DNA, 25 bp, Rattus norvegicus
cgtgccacccggtacttcgcagtgt

SEQ ID NO: 656501 - DNA, 25 bp, Rattus norvegicus
tgcgccgcctgctcaccttcagccc

SEQ ID NO: 656502 - DNA, 25 bp, Rattus norvegicus
ctgggagtccatggccgccagctgc

SEQ ID NO: 656503 - DNA, 25 bp, Rattus norvegicus
ccaccactgcccactgtagggttag

SEQ ID NO: 656504 - DNA, 25 bp, Rattus norvegicus
cactgcccactgtagggttaggggt

SEQ ID NO: 656505 - DNA, 25 bp, Rattus norvegicus
agcggccggatctccattggctgcc

SEQ ID NO: 656506 - DNA, 25 bp, Rattus norvegicus
gccggatctccattggctgccagcg

SEQ ID NO: 656507 - DNA, 25 bp, Rattus norvegicus
cggagcctagttgtaggactgggaa

SEQ ID NO: 656508 - DNA, 25 bp, Rattus norvegicus
accgaggctggaatctgctgggcac

SEQ ID NO: 656509 - DNA, 25 bp, Rattus norvegicus
tgggcactgagtgcggctgagtcgt

SEQ ID NO: 656510 - DNA, 25 bp, Rattus norvegicus
gccaaggccgcaggccctcaccgta

SEQ ID NO: 656511 - DNA, 25 bp, Rattus norvegicus
ctacagtcgcaactggagcgcgggc

SEQ ID NO: 656512 - DNA, 25 bp, Rattus norvegicus
ctcccagccgggtagaccttgcagg

SEQ ID NO: 656513 - DNA, 25 bp, Rattus norvegicus
gggcaggaatgaaaaccctacagtc

SEQ ID NO: 656514 - DNA, 25 bp, Rattus norvegicus
gagtcgcgaatcgtggatacccagg

SEQ ID NO: 656515 - DNA, 25 bp, Rattus norvegicus
agcctctgtactgtgcgctagaaaa

SEQ ID NO: 656516 - DNA, 25 bp, Rattus norvegicus
cagccgcgtcgctaggcctccagga

SEQ ID NO: 656517 - DNA, 25 bp, Rattus norvegicus
tctgtttccagtctgctcaggatga

SEQ ID NO: 656518 - DNA, 25 bp, Rattus norvegicus
gcctgcacggagtctgtttccagtc

SEQ ID NO: 656519 - DNA, 25 bp, Rattus norvegicus
tgaaaaccctacagtcgcaactgga

SEQ ID NO: 656520 - DNA, 25 bp, Rattus norvegicus
tgcgcagtgggcaggaatgaaaacc

SEQ ID NO: 656521 - DNA, 25 bp, Rattus norvegicus
tagctcagcccagtctgcgcagtgg

SEQ ID NO: 656522 - DNA, 25 bp, Rattus norvegicus
gatacccaggctagctcagcccagt

SEQ ID NO: 656523 - DNA, 25 bp, Rattus norvegicus
cgtggatacccaggctagctcagcc

SEQ ID NO: 656524 - DNA, 25 bp, Rattus norvegicus
gtgggtcgcgcagcctcccacccac

SEQ ID NO: 656525 - DNA, 25 bp, Rattus norvegicus
caagatcctagtggccggagcatcc

SEQ ID NO: 656526 - DNA, 25 bp, Rattus norvegicus
agactttgacaacgcgtggatggca

SEQ ID NO: 656527 - DNA, 25 bp, Rattus norvegicus
ctcgcttaggcagtgacagactttg

SEQ ID NO: 656528 - DNA, 25 bp, Rattus norvegicus
gtgcggcttaagctcctgccttctc

SEQ ID NO: 656529 - DNA, 25 bp, Rattus norvegicus
tccggacaaggatgtttgggaccta

SEQ ID NO: 656530 - DNA, 25 bp, Rattus norvegicus
ccgctttgtgatcttgggatgctta

SEQ ID NO: 656531 - DNA, 25 bp, Rattus norvegicus
gcggcagcggagaataagcatcttc

SEQ ID NO: 656532 - DNA, 25 bp, Rattus norvegicus
aaaccttgggccttccgctctgatt

SEQ ID NO: 656533 - DNA, 25 bp, Rattus norvegicus
tctccgcgggtagtcagaaagcgct

SEQ ID NO: 656534 - DNA, 25 bp, Rattus norvegicus
tgaacctcccggtcaaggctctggg

SEQ ID NO: 656535 - DNA, 25 bp, Rattus norvegicus
ccaagacctctgcatagggatgcca

SEQ ID NO: 656536 - DNA, 25 bp, Rattus norvegicus
agccgcttcaactcgggtcccaaga

SEQ ID NO: 656537 - DNA, 25 bp, Rattus norvegicus
ccagggattcgctcttcggtagagc

SEQ ID NO: 656538 - DNA, 25 bp, Rattus norvegicus
tttgggacctagacagcgagttctg

SEQ ID NO: 656539 - DNA, 25 bp, Rattus norvegicus
atgcggcgttactgggttccagctc

SEQ ID NO: 656540 - DNA, 25 bp, Rattus norvegicus
gccggcggacgaccttccacttgaa

SEQ ID NO: 656541 - DNA, 25 bp, Rattus norvegicus
atgggccagccgaccgcctgagctg

SEQ ID NO: 656542 - DNA, 25 bp, Rattus norvegicus
cgtacgcgtccctgcagatgggcca

SEQ ID NO: 656543 - DNA, 25 bp, Rattus norvegicus
taacctcctggagctcgtacgcgtc

SEQ ID NO: 656544 - DNA, 25 bp, Rattus norvegicus
cgcactgaccgataacctcctggag

SEQ ID NO: 656545 - DNA, 25 bp, Rattus norvegicus
tgcaggcacacaggagaaccgcatc

SEQ ID NO: 656546 - DNA, 25 bp, Rattus norvegicus
ataaaataactgttgaagccggtag

SEQ ID NO: 656547 - DNA, 25 bp, Rattus norvegicus
tctgcagtgcgagtcacatccgccg

SEQ ID NO: 656548 - DNA, 25 bp, Rattus norvegicus
agcctgcagctcgtctgcagtgcga

SEQ ID NO: 656549 - DNA, 25 bp, Rattus norvegicus
ttgaaacttccctagcctcgtcgcc

SEQ ID NO: 656550 - DNA, 25 bp, Rattus norvegicus
ggcgatccgggagataaaagtttgc

SEQ ID NO: 656551 - DNA, 25 bp, Rattus norvegicus
gctatgcccgcagggtctcccagga

SEQ ID NO: 656552 - DNA, 25 bp, Rattus norvegicus
gagataaaagtttgcagcctgcagc

SEQ ID NO: 656553 - DNA, 25 bp, Rattus norvegicus
gcctcggtgcttgacaggaacacta

SEQ ID NO: 656554 - DNA, 25 bp, Rattus norvegicus
ctggcttcctcgtcccagagagggc

SEQ ID NO: 656555 - DNA, 25 bp, Rattus norvegicus
agagggtccaactcgaccgcggatt

SEQ ID NO: 656556 - DNA, 25 bp, Rattus norvegicus
cctcccaacctttgtgttcactgtg

SEQ ID NO: 656557 - DNA, 25 bp, Rattus norvegicus
gcggctcatcttcgagaggtaagaa

SEQ ID NO: 656558 - DNA, 25 bp, Rattus norvegicus
ctgcatcttcatggtgcggctcatc

SEQ ID NO: 656559 - DNA, 25 bp, Rattus norvegicus
cccttggccttctgcatcttcatgg

SEQ ID NO: 656560 - DNA, 25 bp, Rattus norvegicus
ctgaagaacacggaggaagccacct

SEQ ID NO: 656561 - DNA, 25 bp, Rattus norvegicus
tgtcacctgggcagacctgaagaac

SEQ ID NO: 656562 - DNA, 25 bp, Rattus norvegicus
cggttttggcttccgcacaatgtca

SEQ ID NO: 656563 - DNA, 25 bp, Rattus norvegicus
gggatcttagcctggttctggaatg

SEQ ID NO: 656564 - DNA, 25 bp, Rattus norvegicus
cagcgacacaggagtggacaaagca

SEQ ID NO: 656565 - DNA, 25 bp, Rattus norvegicus
actagccaatcaggacgtgcggcca

SEQ ID NO: 656566 - DNA, 25 bp, Rattus norvegicus
acccacctgacagcctggaacgatg

SEQ ID NO: 656567 - DNA, 25 bp, Rattus norvegicus
tgaccgtttccgactgcaccggtga

SEQ ID NO: 656568 - DNA, 25 bp, Rattus norvegicus
tgccacgcctggttcacgagccggt

SEQ ID NO: 656569 - DNA, 25 bp, Rattus norvegicus
cctgctcttcacctctgaccgtttc

SEQ ID NO: 656570 - DNA, 25 bp, Rattus norvegicus
acaatgtttccgagtacctgctctt

SEQ ID NO: 656571 - DNA, 25 bp, Rattus norvegicus
ggccacaatgtttccgagtacctgc

SEQ ID NO: 656572 - DNA, 25 bp, Rattus norvegicus
gacatcaccggccacaatgtttccg

SEQ ID NO: 656573 - DNA, 25 bp, Rattus norvegicus
ccgactgcaccggtgagttggcctg

SEQ ID NO: 656574 - DNA, 25 bp, Rattus norvegicus
ggggacatcctgactgacatcaccg

SEQ ID NO: 656575 - DNA, 25 bp, Rattus norvegicus
acgggcttctcgtgccccagcagtg

SEQ ID NO: 656576 - DNA, 25 bp, Rattus norvegicus
tctgcacagggcacgggcttctcgt

SEQ ID NO: 656577 - DNA, 25 bp, Rattus norvegicus
tacctgctctgcacagggcacgggc

SEQ ID NO: 656578 - DNA, 25 bp, Rattus norvegicus
gtccgctgtacctgctctgcacagg

SEQ ID NO: 656579 - DNA, 25 bp, Rattus norvegicus
cgtttccgactgcaccggtgagttg

SEQ ID NO: 656580 - DNA, 25 bp, Rattus norvegicus
gttcacgagccggtccgctgtacct

SEQ ID NO: 656581 - DNA, 25 bp, Rattus norvegicus
tctagtggacgcgaggtagttgcac

SEQ ID NO: 656582 - DNA, 25 bp, Rattus norvegicus
gcgcacagccgcatttgctccgtcg

SEQ ID NO: 656583 - DNA, 25 bp, Rattus norvegicus
ttgtatccgagatctagtggacgcg

SEQ ID NO: 656584 - DNA, 25 bp, Rattus norvegicus
agcccgagctttgtcttgtatccga

SEQ ID NO: 656585 - DNA, 25 bp, Rattus norvegicus
cctcgtgtccgagcccgagctttgt

SEQ ID NO: 656586 - DNA, 25 bp, Rattus norvegicus
tcggttgcaagatcccttcaactcc

SEQ ID NO: 656587 - DNA, 25 bp, Rattus norvegicus
ggcgttcggttgcaagatcccttca

SEQ ID NO: 656588 - DNA, 25 bp, Rattus norvegicus
aggctccactgagtctcgggtaggc

SEQ ID NO: 656589 - DNA, 25 bp, Rattus norvegicus
ggagcttcctggaggctccactgag

SEQ ID NO: 656590 - DNA, 25 bp, Rattus norvegicus
ctgcccgtgctgacagagcgcgtgc

SEQ ID NO: 656591 - DNA, 25 bp, Rattus norvegicus
ttgacactgcccgtgctgacagagc

SEQ ID NO: 656592 - DNA, 25 bp, Rattus norvegicus
taactcttgacactgcccgtgctga

SEQ ID NO: 656593 - DNA, 25 bp, Rattus norvegicus
ccctagcggctaactcttgacactg

SEQ ID NO: 656594 - DNA, 25 bp, Rattus norvegicus
acgcgaggtagttgcacgccagccc

SEQ ID NO: 656595 - DNA, 25 bp, Rattus norvegicus
caccctattggacccgctgtggaga

SEQ ID NO: 656596 - DNA, 25 bp, Rattus norvegicus
tctgattggctgacagcgcagactc

SEQ ID NO: 656597 - DNA, 25 bp, Rattus norvegicus
atgccggcaggctcagaccggcttc

SEQ ID NO: 656598 - DNA, 25 bp, Rattus norvegicus
gctgtggagaaaccagcccaccgct

SEQ ID NO: 656599 - DNA, 25 bp, Rattus norvegicus
ggtcgcgccgactttcaatttcaaa

SEQ ID NO: 656600 - DNA, 25 bp, Rattus norvegicus
tttcaaactccggagcgcctactta

SEQ ID NO: 656601 - DNA, 25 bp, Rattus norvegicus
cccgccagtcaactctgttttctga

SEQ ID NO: 656602 - DNA, 25 bp, Rattus norvegicus
ttgttgaaagccgtctgcggaattc

SEQ ID NO: 656603 - DNA, 25 bp, Rattus norvegicus
tctgcggaattctcgcggacaaata

SEQ ID NO: 656604 - DNA, 25 bp, Rattus norvegicus
cggacaaatatgaagcggggcattc

SEQ ID NO: 656605 - DNA, 25 bp, Rattus norvegicus
tctttgatgagacagagtcggactc

SEQ ID NO: 656606 - DNA, 25 bp, Rattus norvegicus
ccaagagactcggttttcggcattg

SEQ ID NO: 656607 - DNA, 25 bp, Rattus norvegicus
ctcggtctgtcgtggaatagcaaga

SEQ ID NO: 656608 - DNA, 25 bp, Rattus norvegicus
ctctccgtgcgaggagttgttgaaa

SEQ ID NO: 656609 - DNA, 25 bp, Rattus norvegicus
ctcgccctcttacagcacaggtgga

SEQ ID NO: 656610 - DNA, 25 bp, Rattus norvegicus
tgcggagtgtggtgtagccaaccaa

SEQ ID NO: 656611 - DNA, 25 bp, Rattus norvegicus
tggtgtagccaaccaaggcaatgtc

SEQ ID NO: 656612 - DNA, 25 bp, Rattus norvegicus
tacattcgaacatggcggctgggca

SEQ ID NO: 656613 - DNA, 25 bp, Rattus norvegicus
aggcaatgtccgctccacccgtccc

SEQ ID NO: 656614 - DNA, 25 bp, Rattus norvegicus
tcttacagcacaggtggatctcctc

SEQ ID NO: 656615 - DNA, 25 bp, Rattus norvegicus
agcacaggtggatctcctcatcgga

SEQ ID NO: 656616 - DNA, 25 bp, Rattus norvegicus
cggaaccgtcgacacagtcattttc

SEQ ID NO: 656617 - DNA, 25 bp, Rattus norvegicus
cccatcacatatccaaaacgactgg

SEQ ID NO: 656618 - DNA, 25 bp, Rattus norvegicus
tccaaaacgactggatgcacacgtg

SEQ ID NO: 656619 - DNA, 25 bp, Rattus norvegicus
cgactggatgcacacgtggttttta

SEQ ID NO: 656620 - DNA, 25 bp, Rattus norvegicus
cacacgtggtttttacattcgaaca

SEQ ID NO: 656621 - DNA, 25 bp, Rattus norvegicus
tggatctcctcatcggaaccgtcga

SEQ ID NO: 656622 - DNA, 25 bp, Rattus norvegicus
gtagccaaccaaggcaatgtccgct

SEQ ID NO: 656623 - DNA, 25 bp, Rattus norvegicus
cgctctgggagcacaaaactgcctc

SEQ ID NO: 656624 - DNA, 25 bp, Rattus norvegicus
gcgggacagagtttcgccactgatg

SEQ ID NO: 656625 - DNA, 25 bp, Rattus norvegicus
ttcccgtgggaacaaaggcacgatc

SEQ ID NO: 656626 - DNA, 25 bp, Rattus norvegicus
gagctgtcaccgaagcccttgcgac

SEQ ID NO: 656627 - DNA, 25 bp, Rattus norvegicus
gcgaccgcgtttcccaaccagtaga

SEQ ID NO: 656628 - DNA, 25 bp, Rattus norvegicus
ccagtagaagagtggcgctgcagtc

SEQ ID NO: 656629 - DNA, 25 bp, Rattus norvegicus
acccgactcctatcggcagcgagta

SEQ ID NO: 656630 - DNA, 25 bp, Rattus norvegicus
gcttaccttggctactgactggctc

SEQ ID NO: 656631 - DNA, 25 bp, Rattus norvegicus
aggcaggttactccgctccggaaca

SEQ ID NO: 656632 - DNA, 25 bp, Rattus norvegicus
agcactacccgctggctcctagagg

SEQ ID NO: 656633 - DNA, 25 bp, Rattus norvegicus
tgaggcatcccgttttctacccgcg

SEQ ID NO: 656634 - DNA, 25 bp, Rattus norvegicus
cctgcactttgcgactctgggagga

SEQ ID NO: 656635 - DNA, 25 bp, Rattus norvegicus
tgggcacttgaacacttgcacgata

SEQ ID NO: 656636 - DNA, 25 bp, Rattus norvegicus
gcacgctagtgcaggctctcatcca

SEQ ID NO: 656637 - DNA, 25 bp, Rattus norvegicus
tgggaaaaagagagcgcagtacctg

SEQ ID NO: 656638 - DNA, 25 bp, Rattus norvegicus
tgagtctctggacgcgctgggaccc

SEQ ID NO: 656639 - DNA, 25 bp, Rattus norvegicus
acgtgtcctcgcagtgagtctctgg

SEQ ID NO: 656640 - DNA, 25 bp, Rattus norvegicus
gtgcgcttcgacgtgtcctcgcagt

SEQ ID NO: 656641 - DNA, 25 bp, Rattus norvegicus
aggaccgcgacgtgcgcttcgacgt

SEQ ID NO: 656642 - DNA, 25 bp, Rattus norvegicus
cctcggtcaccatgtctgtgctgga

SEQ ID NO: 656643 - DNA, 25 bp, Rattus norvegicus
cactgtggattttaacggcgggctc

SEQ ID NO: 656644 - DNA, 25 bp, Rattus norvegicus
cacaggacggccactgtggatttta

SEQ ID NO: 656645 - DNA, 25 bp, Rattus norvegicus
ttggtgtccataagacgccacagga

SEQ ID NO: 656646 - DNA, 25 bp, Rattus norvegicus
cgatgcgttgccttggtgtccataa

SEQ ID NO: 656647 - DNA, 25 bp, Rattus norvegicus
tgtcgtgacaaagccgatgcgttgc

SEQ ID NO: 656648 - DNA, 25 bp, Rattus norvegicus
cgcccgccgtagatgtcgtgacaaa

SEQ ID NO: 656649 - DNA, 25 bp, Rattus norvegicus
cagtacctggtggaagcttgggcct

SEQ ID NO: 656650 - DNA, 25 bp, Rattus norvegicus
ctggctagcagcctatgcagcgcgc

SEQ ID NO: 656651 - DNA, 25 bp, Rattus norvegicus
aaccctgcgggctacggaaggcaga

SEQ ID NO: 656652 - DNA, 25 bp, Rattus norvegicus
caccagtagcgtccaagggtattta

SEQ ID NO: 656653 - DNA, 25 bp, Rattus norvegicus
gaaggcagagccactgaccaaccgg

SEQ ID NO: 656654 - DNA, 25 bp, Rattus norvegicus
ggctcagaaggcagggatcatccga

SEQ ID NO: 656655 - DNA, 25 bp, Rattus norvegicus
atcatccgaggcctggcagccgcag

SEQ ID NO: 656656 - DNA, 25 bp, Rattus norvegicus
ccgcagcggtaagctggtgtctctc

SEQ ID NO: 656657 - DNA, 25 bp, Rattus norvegicus
tggtgtctctcgctcaccagtagcg

SEQ ID NO: 656658 - DNA, 25 bp, Rattus norvegicus
caagggtatttagcctttcctggag

SEQ ID NO: 656659 - DNA, 25 bp, Rattus norvegicus
acttctcccggtaacagagcttgtc

SEQ ID NO: 656660 - DNA, 25 bp, Rattus norvegicus
gtaacagagcttgtcccagtgcgga

SEQ ID NO: 656661 - DNA, 25 bp, Rattus norvegicus
tcccagtgcggaaggaaaagcggtc

SEQ ID NO: 656662 - DNA, 25 bp, Rattus norvegicus
tgcaccaaggaagcgcgcactacat

SEQ ID NO: 656663 - DNA, 25 bp, Rattus norvegicus
agcgcgcactacatgttccagaagg

SEQ ID NO: 656664 - DNA, 25 bp, Rattus norvegicus
ttccagaaggcatcgcgagaggcat

SEQ ID NO: 656665 - DNA, 25 bp, Rattus norvegicus
accgtctttccgacgaggtctctga

SEQ ID NO: 656666 - DNA, 25 bp, Rattus norvegicus
gggagacggcgtcacccatccctga

SEQ ID NO: 656667 - DNA, 25 bp, Rattus norvegicus
cctgacgtacttccggcgcgacatt

SEQ ID NO: 656668 - DNA, 25 bp, Rattus norvegicus
attttccctccacgcctggactggg

SEQ ID NO: 656669 - DNA, 25 bp, Rattus norvegicus
tagtgggctttagcgcctttcccga

SEQ ID NO: 656670 - DNA, 25 bp, Rattus norvegicus
ttcccgacggcggtagatttgaagc

SEQ ID NO: 656671 - DNA, 25 bp, Rattus norvegicus
ttctgcagaccttgggtacgagagc

SEQ ID NO: 656672 - DNA, 25 bp, Rattus norvegicus
ctctgagctattcgcgctcggaagg

SEQ ID NO: 656673 - DNA, 25 bp, Rattus norvegicus
ttttgccgcacaagctgtaatatgg

SEQ ID NO: 656674 - DNA, 25 bp, Rattus norvegicus
tcggctctcgggagctaggttcttt

SEQ ID NO: 656675 - DNA, 25 bp, Rattus norvegicus
tggatgcttccaaaccgagagactg

SEQ ID NO: 656676 - DNA, 25 bp, Rattus norvegicus
ctcagagccagaatcaccgggaata

SEQ ID NO: 656677 - DNA, 25 bp, Rattus norvegicus
taaaatcgacaacgagctgtcctcc

SEQ ID NO: 656678 - DNA, 25 bp, Rattus norvegicus
cggcgtggcgtcattttctgcagac

SEQ ID NO: 656679 - DNA, 25 bp, Rattus norvegicus
accgagacatgaagcacgggtgtgc

SEQ ID NO: 656680 - DNA, 25 bp, Rattus norvegicus
ccaggctgggtttctacactgcgcc

SEQ ID NO: 656681 - DNA, 25 bp, Rattus norvegicus
acgctgcgctagtttggagccggcc

SEQ ID NO: 656682 - DNA, 25 bp, Rattus norvegicus
gtcggaagtgacgtagtcactatcc

SEQ ID NO: 656683 - DNA, 25 bp, Rattus norvegicus
cgccgcggctgaaccgagacatgaa

SEQ ID NO: 656684 - DNA, 25 bp, Rattus norvegicus
gccacggcgctagcagtccagcgtt

SEQ ID NO: 656685 - DNA, 25 bp, Rattus norvegicus
tccagcgtttacgtaaggcacgaga

SEQ ID NO: 656686 - DNA, 25 bp, Rattus norvegicus
aggcacgagaaccaaccggccgacg

SEQ ID NO: 656687 - DNA, 25 bp, Rattus norvegicus
accggccgacgctggaacggatgct

SEQ ID NO: 656688 - DNA, 25 bp, Rattus norvegicus
tggtgaccggctgcgacccaggcca

SEQ ID NO: 656689 - DNA, 25 bp, Rattus norvegicus
agtgaggagccctcggtcccgtcca

SEQ ID NO: 656690 - DNA, 25 bp, Rattus norvegicus
ccggttccgtttttctgagacgctg

SEQ ID NO: 656691 - DNA, 25 bp, Rattus norvegicus
ccgtttttctgagacgctgcgctag

SEQ ID NO: 656692 - DNA, 25 bp, Rattus norvegicus
cgtagtcactatcccggaacgagga

SEQ ID NO: 656693 - DNA, 25 bp, Rattus norvegicus
gccgctcttgcgctgtcagcaagcg

SEQ ID NO: 656694 - DNA, 25 bp, Rattus norvegicus
cgctaccaaagatggtcagagggtc

SEQ ID NO: 656695 - DNA, 25 bp, Rattus norvegicus
tgctgcacaagctagctcgggccca

SEQ ID NO: 656696 - DNA, 25 bp, Rattus norvegicus
ctagcgcgggctgctgcacaagcta

SEQ ID NO: 656697 - DNA, 25 bp, Rattus norvegicus
ggggcagtccacacctgcgcaacgg

SEQ ID NO: 656698 - DNA, 25 bp, Rattus norvegicus
caccagcgaggtaggtcggagccca

SEQ ID NO: 656699 - DNA, 25 bp, Rattus norvegicus
cgcgttccgtgccaccagcgaggta

SEQ ID NO: 656700 - DNA, 25 bp, Rattus norvegicus
cgccgcgcgctaccaaagatggtca

SEQ ID NO: 656701 - DNA, 25 bp, Rattus norvegicus
tagagctgtactcgcaggcggcctc

SEQ ID NO: 656702 - DNA, 25 bp, Rattus norvegicus
gctcgtgggctagagctgtactcgc

SEQ ID NO: 656703 - DNA, 25 bp, Rattus norvegicus
ggactcgggctttctccaggagcag

SEQ ID NO: 656704 - DNA, 25 bp, Rattus norvegicus
ctctacggcgttgaccggggactcg

SEQ ID NO: 656705 - DNA, 25 bp, Rattus norvegicus
cagagaaggtaagggtacacactcc

SEQ ID NO: 656706 - DNA, 25 bp, Rattus norvegicus
gggtacacactcctctacggcgttg

SEQ ID NO: 656707 - DNA, 25 bp, Rattus norvegicus
gctgccgtaacagcgcgtgcgcaga

SEQ ID NO: 656708 - DNA, 25 bp, Rattus norvegicus
caccttcccgcaaggactgctggga

SEQ ID NO: 656709 - DNA, 25 bp, Rattus norvegicus
atctttaagcgcgtttggctggccc

SEQ ID NO: 656710 - DNA, 25 bp, Rattus norvegicus
gctcggaagtagaggcgcttctgtc

SEQ ID NO: 656711 - DNA, 25 bp, Rattus norvegicus
aggcgcttctgtcgttgttcgtgaa

SEQ ID NO: 656712 - DNA, 25 bp, Rattus norvegicus
cgttgttcgtgaagccgtggtgact

SEQ ID NO: 656713 - DNA, 25 bp, Rattus norvegicus
tggtgactgcgggatcagaatcttt

SEQ ID NO: 656714 - DNA, 25 bp, Rattus norvegicus
tgagcttcttggagactgaggagaa

SEQ ID NO: 656715 - DNA, 25 bp, Rattus norvegicus
ctgaggagaaggtacaaaggattgt

SEQ ID NO: 656716 - DNA, 25 bp, Rattus norvegicus
aaggattgtgctttgcgcaggcctc

SEQ ID NO: 656717 - DNA, 25 bp, Rattus norvegicus
ctttccacgtggcagggatcccggc

SEQ ID NO: 656718 - DNA, 25 bp, Rattus norvegicus
ggctggccgcatcacggcgtccttt

SEQ ID NO: 656719 - DNA, 25 bp, Rattus norvegicus
gatcagaatctttgaggtgagcttc

SEQ ID NO: 656720 - DNA, 25 bp, Rattus norvegicus
cagaaatgcgggcacccggggcttt

SEQ ID NO: 656721 - DNA, 25 bp, Rattus norvegicus
accgcaacgccggaagtgctgacgc

SEQ ID NO: 656722 - DNA, 25 bp, Rattus norvegicus
ccgcatgggcgccatcggaagaagc

SEQ ID NO: 656723 - DNA, 25 bp, Rattus norvegicus
ttttttggtccgcatgggcgccatc

SEQ ID NO: 656724 - DNA, 25 bp, Rattus norvegicus
ccgacgaggacgagtgatttttttg

SEQ ID NO: 656725 - DNA, 25 bp, Rattus norvegicus
ggcgccgagctgcaacctctgtgga

SEQ ID NO: 656726 - DNA, 25 bp, Rattus norvegicus
gaagctgctagctggtcctcccggc

SEQ ID NO: 656727 - DNA, 25 bp, Rattus norvegicus
gaaagcacaccgaagctgctagctg

SEQ ID NO: 656728 - DNA, 25 bp, Rattus norvegicus
cctaggagcgccaagaaagcacacc

SEQ ID NO: 656729 - DNA, 25 bp, Rattus norvegicus
attgccgcccgtggaacctaggagc

SEQ ID NO: 656730 - DNA, 25 bp, Rattus norvegicus
aatcccatgggcctcgcggggattg

SEQ ID NO: 656731 - DNA, 25 bp, Rattus norvegicus
tcagcgagggaatcccatgggcctc

SEQ ID NO: 656732 - DNA, 25 bp, Rattus norvegicus
ctactaaggactcagcgagggaatc

SEQ ID NO: 656733 - DNA, 25 bp, Rattus norvegicus
tccgggacggactactaaggactca

SEQ ID NO: 656734 - DNA, 25 bp, Rattus norvegicus
agctgcaacctctgtggagctccgg

SEQ ID NO: 656735 - DNA, 25 bp, Rattus norvegicus
gtagggacacaccacccgaggatgt

SEQ ID NO: 656736 - DNA, 25 bp, Rattus norvegicus
ccaactcgtccaggctcgagtttca

SEQ ID NO: 656737 - DNA, 25 bp, Rattus norvegicus
aggctcgagtttcattctcccaggg

SEQ ID NO: 656738 - DNA, 25 bp, Rattus norvegicus
tcgagtttcattctcccaggggaga

SEQ ID NO: 656739 - DNA, 25 bp, Rattus norvegicus
ttcattctcccaggggagagtcgcg

SEQ ID NO: 656740 - DNA, 25 bp, Rattus norvegicus
gcgggaggaatgaaggttgagatta

SEQ ID NO: 656741 - DNA, 25 bp, Rattus norvegicus
tgaatccgtcgggctcggggaccca

SEQ ID NO: 656742 - DNA, 25 bp, Rattus norvegicus
cagggcgagcagctgagcgaccctc

SEQ ID NO: 656743 - DNA, 25 bp, Rattus norvegicus
gcagctgagcgaccctcggtgctgc

SEQ ID NO: 656744 - DNA, 25 bp, Rattus norvegicus
cctgccacggatcgggtcattggga

SEQ ID NO: 656745 - DNA, 25 bp, Rattus norvegicus
cgggtcattgggagcccggaatcca

SEQ ID NO: 656746 - DNA, 25 bp, Rattus norvegicus
ttgggagcccggaatccaccggcgc

SEQ ID NO: 656747 - DNA, 25 bp, Rattus norvegicus
cacccccatgcggacgtggtaggga

SEQ ID NO: 656748 - DNA, 25 bp, Rattus norvegicus
gacacaccacccgaggatgtacgac

SEQ ID NO: 656749 - DNA, 25 bp, Rattus norvegicus
tccggaatccagactggggtaccta

SEQ ID NO: 656750 - DNA, 25 bp, Rattus norvegicus
tcgccaggctgtcaggcgagaagca

SEQ ID NO: 656751 - DNA, 25 bp, Rattus norvegicus
cgagaagcaggtgctccagagctcc

SEQ ID NO: 656752 - DNA, 25 bp, Rattus norvegicus
ccactcactagaggttgaaatcgtc

SEQ ID NO: 656753 - DNA, 25 bp, Rattus norvegicus
gaaatcgtcgcggtcccagtctcca

SEQ ID NO: 656754 - DNA, 25 bp, Rattus norvegicus
cccggcggcagaatgcaaagcggca

SEQ ID NO: 656755 - DNA, 25 bp, Rattus norvegicus
gtctcgccgcaagagccaagccaga

SEQ ID NO: 656756 - DNA, 25 bp, Rattus norvegicus
cctgcgcagaagtatgaactcggtg

SEQ ID NO: 656757 - DNA, 25 bp, Rattus norvegicus
gaactcggtgactcgcaagctaaga

SEQ ID NO: 656758 - DNA, 25 bp, Rattus norvegicus
actcgcaagctaagacgtccgttca

SEQ ID NO: 656759 - DNA, 25 bp, Rattus norvegicus
cgtccgttcagaggcggaacttctg

SEQ ID NO: 656760 - DNA, 25 bp, Rattus norvegicus
cggaacttctggtgtctagagggac

SEQ ID NO: 656761 - DNA, 25 bp, Rattus norvegicus
gttgacgttgtttccggaatccaga

SEQ ID NO: 656762 - DNA, 25 bp, Rattus norvegicus
acggaaggacaagactgcagggacc

SEQ ID NO: 656763 - DNA, 25 bp, Rattus norvegicus
cgcgcaggggccgaccttagacaag

SEQ ID NO: 656764 - DNA, 25 bp, Rattus norvegicus
gggcgaccacactggacacgacttc

SEQ ID NO: 656765 - DNA, 25 bp, Rattus norvegicus
ggggccctggactctccaaattctg

SEQ ID NO: 656766 - DNA, 25 bp, Rattus norvegicus
atctgggagccgacccgcatctgtc

SEQ ID NO: 656767 - DNA, 25 bp, Rattus norvegicus
ttctgagctctcatcatggcggcgg

SEQ ID NO: 656768 - DNA, 25 bp, Rattus norvegicus
gacttcaacatgttccgcagccagg

SEQ ID NO: 656769 - DNA, 25 bp, Rattus norvegicus
ccctgcatgtcgctgtgcgcggagt

SEQ ID NO: 656770 - DNA, 25 bp, Rattus norvegicus
taccgctgccggacgtgcggcatct

SEQ ID NO: 656771 - DNA, 25 bp, Rattus norvegicus
tctggacggccaacttcgtggccta

SEQ ID NO: 656772 - DNA, 25 bp, Rattus norvegicus
cggctacgatgagttctgcgcggcc

SEQ ID NO: 656773 - DNA, 25 bp, Rattus norvegicus
atgccctggagtggtgtaagtgcct

SEQ ID NO: 656774 - DNA, 25 bp, Rattus norvegicus
ctcagccggccggataaccgtgcgg

SEQ ID NO: 656775 - DNA, 25 bp, Rattus norvegicus
gaccttagacaaggcggctaccgcc

SEQ ID NO: 656776 - DNA, 25 bp, Rattus norvegicus
gactgcggggacagcaacgtaatgc

SEQ ID NO: 656777 - DNA, 25 bp, Rattus norvegicus
ctgcccgcttggtctttgaagtctc

SEQ ID NO: 656778 - DNA, 25 bp, Rattus norvegicus
taggtcatctctcgcttctgctcgc

SEQ ID NO: 656779 - DNA, 25 bp, Rattus norvegicus
tgaagtctctttacattatggcaca

SEQ ID NO: 656780 - DNA, 25 bp, Rattus norvegicus
ctgccagcctgcgaagaaacttctc

SEQ ID NO: 656781 - DNA, 25 bp, Rattus norvegicus
ttctcagtctcgaaaccctgctgct

SEQ ID NO: 656782 - DNA, 25 bp, Rattus norvegicus
tgctccgggagcagtttggattact

SEQ ID NO: 656783 - DNA, 25 bp, Rattus norvegicus
gcccgcctggagagactagtattca

SEQ ID NO: 656784 - DNA, 25 bp, Rattus norvegicus
cgcggtgaaagtttgctcccacttc

SEQ ID NO: 656785 - DNA, 25 bp, Rattus norvegicus
cgtcaagaccgcgtaggagttcccg

SEQ ID NO: 656786 - DNA, 25 bp, Rattus norvegicus
tcagggccgccctttgcacaagtac

SEQ ID NO: 656787 - DNA, 25 bp, Rattus norvegicus
cccgcggatacctctttgaactgac

SEQ ID NO: 656788 - DNA, 25 bp, Rattus norvegicus
cacaagtaccggtgtaggtcatctc

SEQ ID NO: 656789 - DNA, 25 bp, Rattus norvegicus
tacactcatcaacaaaggaaagccc

SEQ ID NO: 656790 - DNA, 25 bp, Rattus norvegicus
cgggacgactcctgctgtctgccag

SEQ ID NO: 656791 - DNA, 25 bp, Rattus norvegicus
tggggctgacgccacagaaaacaca

SEQ ID NO: 656792 - DNA, 25 bp, Rattus norvegicus
ctgctgccctgcaacggggcctagt

SEQ ID NO: 656793 - DNA, 25 bp, Rattus norvegicus
tctgggttcaccctccaggcttttc

SEQ ID NO: 656794 - DNA, 25 bp, Rattus norvegicus
cttcccttaaaggatgcttagcatc

SEQ ID NO: 656795 - DNA, 25 bp, Rattus norvegicus
gggcccgtcggactttgcacagtac

SEQ ID NO: 656796 - DNA, 25 bp, Rattus norvegicus
cgtcaagatgctgccctcgagcatg

SEQ ID NO: 656797 - DNA, 25 bp, Rattus norvegicus
ccttacgagttctcgcccgtcaaga

SEQ ID NO: 656798 - DNA, 25 bp, Rattus norvegicus
tttccacccgtggactgccgacatg

SEQ ID NO: 656799 - DNA, 25 bp, Rattus norvegicus
ggcggcacccgacttccttcaggtg

SEQ ID NO: 656800 - DNA, 25 bp, Rattus norvegicus
ccgcgcttagaacgctaaccttttg

SEQ ID NO: 656801 - DNA, 25 bp, Rattus norvegicus
ctgaaagtttcctgggaccgctggg

SEQ ID NO: 656802 - DNA, 25 bp, Rattus norvegicus
tcaggtagcactggcgctgaaagtt

SEQ ID NO: 656803 - DNA, 25 bp, Rattus norvegicus
gcttagcatctctttgaaccaagta

SEQ ID NO: 656804 - DNA, 25 bp, Rattus norvegicus
tttgcacagtaccagagccagatcg

SEQ ID NO: 656805 - DNA, 25 bp, Rattus norvegicus
gcccttcacgtggttcctgcagctg

SEQ ID NO: 656806 - DNA, 25 bp, Rattus norvegicus
agcagcgcagtaatgaccgtgagta

SEQ ID NO: 656807 - DNA, 25 bp, Rattus norvegicus
gccagagggtaagcagcgcagtaat

SEQ ID NO: 656808 - DNA, 25 bp, Rattus norvegicus
gaaactccttggctgggcggccaga

SEQ ID NO: 656809 - DNA, 25 bp, Rattus norvegicus
cttcgcggaaactccttggctgggc

SEQ ID NO: 656810 - DNA, 25 bp, Rattus norvegicus
gtggtccagtcgctgggcagctccc

SEQ ID NO: 656811 - DNA, 25 bp, Rattus norvegicus
ctggccttcgcggaaactccttggc

SEQ ID NO: 656812 - DNA, 25 bp, Rattus norvegicus
gctggccttcctggtctggccttcg

SEQ ID NO: 656813 - DNA, 25 bp, Rattus norvegicus
tcggaacccagctcaagtgcggagc

SEQ ID NO: 656814 - DNA, 25 bp, Rattus norvegicus
tcgcggctcggaacccagctcaagt

SEQ ID NO: 656815 - DNA, 25 bp, Rattus norvegicus
cagtaatgaccgtgagtaacttccc

SEQ ID NO: 656816 - DNA, 25 bp, Rattus norvegicus
agtcgctgggcagctcccgtggttc

SEQ ID NO: 656817 - DNA, 25 bp, Rattus norvegicus
tggttcctgcagctggaacggctcc

SEQ ID NO: 656818 - DNA, 25 bp, Rattus norvegicus
tcctgtctccatggcgactcggcgt

SEQ ID NO: 656819 - DNA, 25 bp, Rattus norvegicus
gcgggtgctgccatcacaagagtta

SEQ ID NO: 656820 - DNA, 25 bp, Rattus norvegicus
gacgagtgtgaggacgggtcctagc

SEQ ID NO: 656821 - DNA, 25 bp, Rattus norvegicus
tgctgccatcacaagagttattttc

SEQ ID NO: 656822 - DNA, 25 bp, Rattus norvegicus
cacaagagttattttccagagtata

SEQ ID NO: 656823 - DNA, 25 bp, Rattus norvegicus
cttcggtgctgagttcaagcgttcc

SEQ ID NO: 656824 - DNA, 25 bp, Rattus norvegicus
gttattttccagagtatatgccatg

SEQ ID NO: 656825 - DNA, 25 bp, Rattus norvegicus
actccagcagcgagagcgaggtgga

SEQ ID NO: 656826 - DNA, 25 bp, Rattus norvegicus
cgtaactgtggcttcttcggtgctg

SEQ ID NO: 656827 - DNA, 25 bp, Rattus norvegicus
ccgcgtggcgtaactgtggcttctt

SEQ ID NO: 656828 - DNA, 25 bp, Rattus norvegicus
ataacgtagagagctgccgcgtggc

SEQ ID NO: 656829 - DNA, 25 bp, Rattus norvegicus
gccatgcaaatccaaatataacgta

SEQ ID NO: 656830 - DNA, 25 bp, Rattus norvegicus
tccaaatataacgtagagagctgcc

SEQ ID NO: 656831 - DNA, 25 bp, Rattus norvegicus
ttccagagtatatgccatgcaaatc

SEQ ID NO: 656832 - DNA, 25 bp, Rattus norvegicus
gtggcttcttcggtgctgagttcaa

SEQ ID NO: 656833 - DNA, 25 bp, Rattus norvegicus
gaattcgctcgatgagtgctcccta

SEQ ID NO: 656834 - DNA, 25 bp, Rattus norvegicus
gtgctccctagtgctcctagtccta

SEQ ID NO: 656835 - DNA, 25 bp, Rattus norvegicus
ggcggctttttcctctcaccttgtc

SEQ ID NO: 656836 - DNA, 25 bp, Rattus norvegicus
cagccttttggttgtctggagtgca

SEQ ID NO: 656837 - DNA, 25 bp, Rattus norvegicus
acgaggtgggactataatctgatta

SEQ ID NO: 656838 - DNA, 25 bp, Rattus norvegicus
ctctggctcagtgaaacgaactctg

SEQ ID NO: 656839 - DNA, 25 bp, Rattus norvegicus
gggagccgcgcactcttatacccga

SEQ ID NO: 656840 - DNA, 25 bp, Rattus norvegicus
tgtccacgaacaagcaccaaatagg

SEQ ID NO: 656841 - DNA, 25 bp, Rattus norvegicus
cgctctgcggggtcttagatttacc

SEQ ID NO: 656842 - DNA, 25 bp, Rattus norvegicus
ttcattcgagaggacacataggggc

SEQ ID NO: 656843 - DNA, 25 bp, Rattus norvegicus
tgcgaggagcgataacctgttactt

SEQ ID NO: 656844 - DNA, 25 bp, Rattus norvegicus
tgaagtgacaccagagccatttttg

SEQ ID NO: 656845 - DNA, 25 bp, Rattus norvegicus
gccatttttgcttgcgcttcgggga

SEQ ID NO: 656846 - DNA, 25 bp, Rattus norvegicus
tatacccgaggtctcttgcgccctg

SEQ ID NO: 656847 - DNA, 25 bp, Rattus norvegicus
cggcacagagggctaccacgtcctg

SEQ ID NO: 656848 - DNA, 25 bp, Rattus norvegicus
tagaaacgcgcctagatgagtcttg

SEQ ID NO: 656849 - DNA, 25 bp, Rattus norvegicus
agatgagtcttgtccgctccggagc

SEQ ID NO: 656850 - DNA, 25 bp, Rattus norvegicus
gcgcggcttcgccttcagagccgta

SEQ ID NO: 656851 - DNA, 25 bp, Rattus norvegicus
agagccgtatttccgctttcctgcg

SEQ ID NO: 656852 - DNA, 25 bp, Rattus norvegicus
tgcaagtgccacgtcccaagagcta

SEQ ID NO: 656853 - DNA, 25 bp, Rattus norvegicus
tgggctcctcgcagagcgtcgagat

SEQ ID NO: 656854 - DNA, 25 bp, Rattus norvegicus
tctgcacggcttcgatgcgccctga

SEQ ID NO: 656855 - DNA, 25 bp, Rattus norvegicus
tgcgccctgacctgagcttcagagt

SEQ ID NO: 656856 - DNA, 25 bp, Rattus norvegicus
cagaaggagccggaaaacgtacctg

SEQ ID NO: 656857 - DNA, 25 bp, Rattus norvegicus
tttcccaggggagagtgaccgagct

SEQ ID NO: 656858 - DNA, 25 bp, Rattus norvegicus
tgaccgagctacagcggagatgtca

SEQ ID NO: 656859 - DNA, 25 bp, Rattus norvegicus
ctaccacgtcctgcgggtaagggct

SEQ ID NO: 656860 - DNA, 25 bp, Rattus norvegicus
gtcccaagagctacgcggagtcgca

SEQ ID NO: 656861 - DNA, 25 bp, Rattus norvegicus
tgtgattcagcagggacctggccgc

SEQ ID NO: 656862 - DNA, 25 bp, Rattus norvegicus
caaacacgcaggagtcgatggcgaa

SEQ ID NO: 656863 - DNA, 25 bp, Rattus norvegicus
tggcgaaggaaggaaagttgcaacc

SEQ ID NO: 656864 - DNA, 25 bp, Rattus norvegicus
ggcacgagctgccttgcccacgagt

SEQ ID NO: 656865 - DNA, 25 bp, Rattus norvegicus
tcggtctgccgttgggatcgctcta

SEQ ID NO: 656866 - DNA, 25 bp, Rattus norvegicus
cgcgctggggatccgaatcggaccc

SEQ ID NO: 656867 - DNA, 25 bp, Rattus norvegicus
gagcataacgtacaaacacgcagga

SEQ ID NO: 656868 - DNA, 25 bp, Rattus norvegicus
ggctgcaccgcgagggcaatcccat

SEQ ID NO: 656869 - DNA, 25 bp, Rattus norvegicus
ttgcaaccatctggaggggtggcac

SEQ ID NO: 656870 - DNA, 25 bp, Rattus norvegicus
cttccactgctactttggacactca

SEQ ID NO: 656871 - DNA, 25 bp, Rattus norvegicus
tggacactcatcaagctactttctg

SEQ ID NO: 656872 - DNA, 25 bp, Rattus norvegicus
aagctactttctgggagcccgactc

SEQ ID NO: 656873 - DNA, 25 bp, Rattus norvegicus
cgaatcggacccgaggcagcccgga

SEQ ID NO: 656874 - DNA, 25 bp, Rattus norvegicus
cttgcccacgagtcggtctgccgtt

SEQ ID NO: 656875 - DNA, 25 bp, Rattus norvegicus
ttcccttgagactcgcaggtgtggc

SEQ ID NO: 656876 - DNA, 25 bp, Rattus norvegicus
tgcagaggacgaacctgggcatcct

SEQ ID NO: 656877 - DNA, 25 bp, Rattus norvegicus
gcgtacagcccggaagactacctta

SEQ ID NO: 656878 - DNA, 25 bp, Rattus norvegicus
ccggacccggaaggccaatgtgtgc

SEQ ID NO: 656879 - DNA, 25 bp, Rattus norvegicus
tacctcttggtctctgtcccgagtg

SEQ ID NO: 656880 - DNA, 25 bp, Rattus norvegicus
aaacccttgtggtgctacctcttgg

SEQ ID NO: 656881 - DNA, 25 bp, Rattus norvegicus
tcctttgctccaaacccttgtggtg

SEQ ID NO: 656882 - DNA, 25 bp, Rattus norvegicus
cgccgttggttctgttcctttgctc

SEQ ID NO: 656883 - DNA, 25 bp, Rattus norvegicus
gcggcaatcccgtgagcagaaggaa

SEQ ID NO: 656884 - DNA, 25 bp, Rattus norvegicus
ggactgcgtgttgcagcggcaatcc

SEQ ID NO: 656885 - DNA, 25 bp, Rattus norvegicus
ctcgctctgcctgacggaaattgta

SEQ ID NO: 656886 - DNA, 25 bp, Rattus norvegicus
gcgcagcctaataagggcccggaga

SEQ ID NO: 656887 - DNA, 25 bp, Rattus norvegicus
gaagactaccttacccactgcgcag

SEQ ID NO: 656888 - DNA, 25 bp, Rattus norvegicus
gtgctctgggcttctacacacgcga

SEQ ID NO: 656889 - DNA, 25 bp, Rattus norvegicus
atttctgcctcaacccgcagggtga

SEQ ID NO: 656890 - DNA, 25 bp, Rattus norvegicus
agggtgatcggcacctcggagacac

SEQ ID NO: 656891 - DNA, 25 bp, Rattus norvegicus
tgtcgcacttggtgcgcaagacctg

SEQ ID NO: 656892 - DNA, 25 bp, Rattus norvegicus
tcatcgtgggcaacaagcgcgacct

SEQ ID NO: 656893 - DNA, 25 bp, Rattus norvegicus
ctgctcttcagcgagctgctcaaga

SEQ ID NO: 656894 - DNA, 25 bp, Rattus norvegicus
aacgcggacgcgtgattccacgctg

SEQ ID NO: 656895 - DNA, 25 bp, Rattus norvegicus
ttccacgctggaacgtgtcgcactt

SEQ ID NO: 656896 - DNA, 25 bp, Rattus norvegicus
tcggagacacccatcatcatcgtgg

SEQ ID NO: 656897 - DNA, 25 bp, Rattus norvegicus
gggctgcgcccgctgcaaacacgtg

SEQ ID NO: 656898 - DNA, 25 bp, Rattus norvegicus
ggagtgctcggccaagtacaactgg

SEQ ID NO: 656899 - DNA, 25 bp, Rattus norvegicus
tgcacgctgccctgcgctttcaggg

SEQ ID NO: 656900 - DNA, 25 bp, Rattus norvegicus
gtacaactggcacatcctgctgctc

SEQ ID NO: 656901 - DNA, 25 bp, Rattus norvegicus
ctgcgccatcatgtgacgccgcgtg

SEQ ID NO: 656902 - DNA, 25 bp, Rattus norvegicus
gcagcagcactgtcccagcgaaagg

SEQ ID NO: 656903 - DNA, 25 bp, Rattus norvegicus
gagcccaagtctccgcgcagagcgt

SEQ ID NO: 656904 - DNA, 25 bp, Rattus norvegicus
gaacttgcttcaggtctcctaggga

SEQ ID NO: 656905 - DNA, 25 bp, Rattus norvegicus
cgaaaaccctgcttcggcgaggcct

SEQ ID NO: 656906 - DNA, 25 bp, Rattus norvegicus
ctgagcagtcaggatcgcgaaaacc

SEQ ID NO: 656907 - DNA, 25 bp, Rattus norvegicus
ctagggaagtttccttctgtgggca

SEQ ID NO: 656908 - DNA, 25 bp, Rattus norvegicus
ttccgaggaatccatgaaactaggg

SEQ ID NO: 656909 - DNA, 25 bp, Rattus norvegicus
ctcgagtttaactggcacccggtgc

SEQ ID NO: 656910 - DNA, 25 bp, Rattus norvegicus
cttcctgtcggtgatcttcgtgctc

SEQ ID NO: 656911 - DNA, 25 bp, Rattus norvegicus
ttgctgatggccatggaaggctacc

SEQ ID NO: 656912 - DNA, 25 bp, Rattus norvegicus
tctgtcctggagcatgggttgctga

SEQ ID NO: 656913 - DNA, 25 bp, Rattus norvegicus
ccaagttctccatcagtctgtcctg

SEQ ID NO: 656914 - DNA, 25 bp, Rattus norvegicus
aggccactgcagcaacgccaagttc

SEQ ID NO: 656915 - DNA, 25 bp, Rattus norvegicus
tcttcgtgctcatctgggtcctgca

SEQ ID NO: 656916 - DNA, 25 bp, Rattus norvegicus
ttcgtcttcatccagggcatcggta

SEQ ID NO: 656917 - DNA, 25 bp, Rattus norvegicus
tggctcctctataaagactcggagg

SEQ ID NO: 656918 - DNA, 25 bp, Rattus norvegicus
tcgggtacccaggagcgagtactgt

SEQ ID NO: 656919 - DNA, 25 bp, Rattus norvegicus
gcgagtactgttcctcgagccagaa

SEQ ID NO: 656920 - DNA, 25 bp, Rattus norvegicus
gttcctcgagccagaaagtaagagc

SEQ ID NO: 656921 - DNA, 25 bp, Rattus norvegicus
ccagaaagtaagagcgcacgcaggc

SEQ ID NO: 656922 - DNA, 25 bp, Rattus norvegicus
agacgcaggccgagagtcagagcct

SEQ ID NO: 656923 - DNA, 25 bp, Rattus norvegicus
cgcaggcgcaagagagggaaccatc

SEQ ID NO: 656924 - DNA, 25 bp, Rattus norvegicus
cgcaagagagggaaccatcgatgcc

SEQ ID NO: 656925 - DNA, 25 bp, Rattus norvegicus
gtcgagtctggctcctctataaaga

SEQ ID NO: 656926 - DNA, 25 bp, Rattus norvegicus
tgctcacctgtgtcatctgccctgt

SEQ ID NO: 656927 - DNA, 25 bp, Rattus norvegicus
cagtcctgcggtcaccagccttttg

SEQ ID NO: 656928 - DNA, 25 bp, Rattus norvegicus
gtcaccagccttttgccactttcgg

SEQ ID NO: 656929 - DNA, 25 bp, Rattus norvegicus
cttttgccactttcggtgtccctcg

SEQ ID NO: 656930 - DNA, 25 bp, Rattus norvegicus
aaccatcgatgcctcggggctctgg

SEQ ID NO: 656931 - DNA, 25 bp, Rattus norvegicus
cgcgctccctcctgtcgcagcgccg

SEQ ID NO: 656932 - DNA, 25 bp, Rattus norvegicus
gcgccgcgcccgtctatatgcaaat

SEQ ID NO: 656933 - DNA, 25 bp, Rattus norvegicus
gccgcgcccgtctatatgcaaatga

SEQ ID NO: 656934 - DNA, 25 bp, Rattus norvegicus
cgcccgtctatatgcaaatgaacta

SEQ ID NO: 656935 - DNA, 25 bp, Rattus norvegicus
tgcaaatgaactagagcgcggcggc

SEQ ID NO: 656936 - DNA, 25 bp, Rattus norvegicus
actggattccgacgcgcagcgccag

SEQ ID NO: 656937 - DNA, 25 bp, Rattus norvegicus
aaatgaactagagcgcggcggcagt

SEQ ID NO: 656938 - DNA, 25 bp, Rattus norvegicus
ccatgctgtgctcggaagccgggaa

SEQ ID NO: 656939 - DNA, 25 bp, Rattus norvegicus
cagtgcgcaccgagaggcctcggtc

SEQ ID NO: 656940 - DNA, 25 bp, Rattus norvegicus
accgagaggcctcggtctgtccatc

SEQ ID NO: 656941 - DNA, 25 bp, Rattus norvegicus
cggtctgtccatctgcggaccggcg

SEQ ID NO: 656942 - DNA, 25 bp, Rattus norvegicus
ggacacctgagctccggccactgga

SEQ ID NO: 656943 - DNA, 25 bp, Rattus norvegicus
tgagctccggccactggattccgac

SEQ ID NO: 656944 - DNA, 25 bp, Rattus norvegicus
aagccgggaacgagcgagtgagcga

SEQ ID NO: 656945 - DNA, 25 bp, Rattus norvegicus
agcgtgcaatttcgacttgtggagc

SEQ ID NO: 656946 - DNA, 25 bp, Rattus norvegicus
ctagccgaggttccagaaggccgct

SEQ ID NO: 656947 - DNA, 25 bp, Rattus norvegicus
cgctgaagctagtgagggtctccac

SEQ ID NO: 656948 - DNA, 25 bp, Rattus norvegicus
agctcgaggcagagcgtgcaatttc

SEQ ID NO: 656949 - DNA, 25 bp, Rattus norvegicus
cagaaggccgctcctttccgcgaag

SEQ ID NO: 656950 - DNA, 25 bp, Rattus norvegicus
tggaactttcgagctctagccgagg

SEQ ID NO: 656951 - DNA, 25 bp, Rattus norvegicus
gacagtggccgcctggaactttcga

SEQ ID NO: 656952 - DNA, 25 bp, Rattus norvegicus
ctcagagctcggaaatggcgggtaa

SEQ ID NO: 656953 - DNA, 25 bp, Rattus norvegicus
gcgggttgatttgtccttcctcagc

SEQ ID NO: 656954 - DNA, 25 bp, Rattus norvegicus
taagtcattgtggtcacttccggcc

SEQ ID NO: 656955 - DNA, 25 bp, Rattus norvegicus
tcattggttcatgcctcgccgagga

SEQ ID NO: 656956 - DNA, 25 bp, Rattus norvegicus
gtgcgcctggaacttcttcctctca

SEQ ID NO: 656957 - DNA, 25 bp, Rattus norvegicus
agggtctccacaccagccgtggcta

SEQ ID NO: 656958 - DNA, 25 bp, Rattus norvegicus
tcctttccgcgaagcactgagggtc

SEQ ID NO: 656959 - DNA, 25 bp, Rattus norvegicus
ttcgcgcccagagatacgtcggcgc

SEQ ID NO: 656960 - DNA, 25 bp, Rattus norvegicus
gatcggaatacgaccgctccagggc

SEQ ID NO: 656961 - DNA, 25 bp, Rattus norvegicus
ccgtggaggtaagcgatcggaatac

SEQ ID NO: 656962 - DNA, 25 bp, Rattus norvegicus
gtccacctgctcgtccgtggaggta

SEQ ID NO: 656963 - DNA, 25 bp, Rattus norvegicus
catggcggcgcccatcggcgtccac

SEQ ID NO: 656964 - DNA, 25 bp, Rattus norvegicus
ccacgtgaccggagccaacatggcg

SEQ ID NO: 656965 - DNA, 25 bp, Rattus norvegicus
ctacgaggcactctcccggccacgt

SEQ ID NO: 656966 - DNA, 25 bp, Rattus norvegicus
gccgggagagcgctgctactccagt

SEQ ID NO: 656967 - DNA, 25 bp, Rattus norvegicus
ctgcttctctgcttctgggccggga

SEQ ID NO: 656968 - DNA, 25 bp, Rattus norvegicus
ctgactgcttctctgcttctgggcc

SEQ ID NO: 656969 - DNA, 25 bp, Rattus norvegicus
cgcacgcgcactggcctctgactgc

SEQ ID NO: 656970 - DNA, 25 bp, Rattus norvegicus
agtcagtctcacttgcgcacgcgca

SEQ ID NO: 656971 - DNA, 25 bp, Rattus norvegicus
tgctggcctcggcaccggagccact

SEQ ID NO: 656972 - DNA, 25 bp, Rattus norvegicus
atacgtcggcgcgtggacttggtac

SEQ ID NO: 656973 - DNA, 25 bp, Rattus norvegicus
atccaagcggctccgttgggcgcac

SEQ ID NO: 656974 - DNA, 25 bp, Rattus norvegicus
cgatcacttacatgggcaaggcccg

SEQ ID NO: 656975 - DNA, 25 bp, Rattus norvegicus
caaagcctcaccgtgtggttcggcg

SEQ ID NO: 656976 - DNA, 25 bp, Rattus norvegicus
tggtgctacaaagcctcaccgtgtg

SEQ ID NO: 656977 - DNA, 25 bp, Rattus norvegicus
gcgttcttagttggttggtgctaca

SEQ ID NO: 656978 - DNA, 25 bp, Rattus norvegicus
accaggacgagcagagttggcgttc

SEQ ID NO: 656979 - DNA, 25 bp, Rattus norvegicus
acgaatacgacatgaagaccaggac

SEQ ID NO: 656980 - DNA, 25 bp, Rattus norvegicus
ggagcaattaaaatcacgaatacga

SEQ ID NO: 656981 - DNA, 25 bp, Rattus norvegicus
tgggcgcacaggacgacactccaca

SEQ ID NO: 656982 - DNA, 25 bp, Rattus norvegicus
agatggcatccaagcggctccgttg

SEQ ID NO: 656983 - DNA, 25 bp, Rattus norvegicus
agaccttcggttcagatggcatcca

SEQ ID NO: 656984 - DNA, 25 bp, Rattus norvegicus
ggcccgcaaggcgaagagaccttcg

SEQ ID NO: 656985 - DNA, 25 bp, Rattus norvegicus
gacgcacaaccgcagcgatcactta

SEQ ID NO: 656986 - DNA, 25 bp, Rattus norvegicus
aacaggcgctaaggaggagcaatta

SEQ ID NO: 656987 - DNA, 25 bp, Rattus norvegicus
gagccggagcttctcggaccaatcc

SEQ ID NO: 656988 - DNA, 25 bp, Rattus norvegicus
cgctgagctaggcacaggacgctca

SEQ ID NO: 656989 - DNA, 25 bp, Rattus norvegicus
tacggccgcctttcctgggtggaga

SEQ ID NO: 656990 - DNA, 25 bp, Rattus norvegicus
aagcgcgggttcctggctctccacg

SEQ ID NO: 656991 - DNA, 25 bp, Rattus norvegicus
ctccacgcgcactgctttgatcata

SEQ ID NO: 656992 - DNA, 25 bp, Rattus norvegicus
ttgatcatacccgtgcagcctcgag

SEQ ID NO: 656993 - DNA, 25 bp, Rattus norvegicus
gtgcagcctcgagctggagtgacca

SEQ ID NO: 656994 - DNA, 25 bp, Rattus norvegicus
acgctcagaaggaccgctggctgca

SEQ ID NO: 656995 - DNA, 25 bp, Rattus norvegicus
ctgcaggctacctgggttgtcgccc

SEQ ID NO: 656996 - DNA, 25 bp, Rattus norvegicus
cagtgcgcgactccgcgatccagag

SEQ ID NO: 656997 - DNA, 25 bp, Rattus norvegicus
gcgatccagagaccgcggccggact

SEQ ID NO: 656998 - DNA, 25 bp, Rattus norvegicus
gctccgcaccggactaggtgacctg

SEQ ID NO: 656999 - DNA, 25 bp, Rattus norvegicus
ccgctctagtccagcagagccggag

SEQ ID NO: 657000 - DNA, 25 bp, Rattus norvegicus
gccgggacgtgtggacccgactctc

SEQ ID NO: 657001 - DNA, 25 bp, Rattus norvegicus
gatgtgaggttatcagttcgcactc

SEQ ID NO: 657002 - DNA, 25 bp, Rattus norvegicus
aatggcagggccttgtctgccggct

SEQ ID NO: 657003 - DNA, 25 bp, Rattus norvegicus
taccacccggctggaatccgaattc

SEQ ID NO: 657004 - DNA, 25 bp, Rattus norvegicus
ggctggaatccgaattcctcctctg

SEQ ID NO: 657005 - DNA, 25 bp, Rattus norvegicus
cctcctctgggaagggctccggcag

SEQ ID NO: 657006 - DNA, 25 bp, Rattus norvegicus
ccggcagcagcgctggctcctacgt

SEQ ID NO: 657007 - DNA, 25 bp, Rattus norvegicus
ctacacgtcgtggtatccctcagcg

SEQ ID NO: 657008 - DNA, 25 bp, Rattus norvegicus
tggtatccctcagcgcaccaagaag

SEQ ID NO: 657009 - DNA, 25 bp, Rattus norvegicus
caccaagaagctatgcagcagcctc

SEQ ID NO: 657010 - DNA, 25 bp, Rattus norvegicus
cagcctcaactgatgtgaggttatc

SEQ ID NO: 657011 - DNA, 25 bp, Rattus norvegicus
gttatcagttcgcactcacccgctt

SEQ ID NO: 657012 - DNA, 25 bp, Rattus norvegicus
ttcctgcccatctcccttggcccgg

SEQ ID NO: 657013 - DNA, 25 bp, Rattus norvegicus
ccaggttcatccactcattcgcacg

SEQ ID NO: 657014 - DNA, 25 bp, Rattus norvegicus
ctatgcagcagcctcaactgatgtg

SEQ ID NO: 657015 - DNA, 25 bp, Rattus norvegicus
cggcgtaggcctcttaatcatcttg

SEQ ID NO: 657016 - DNA, 25 bp, Rattus norvegicus
tgcagatcctcgacaccagccaatt

SEQ ID NO: 657017 - DNA, 25 bp, Rattus norvegicus
ttgatcacagggcttggcgtctccg

SEQ ID NO: 657018 - DNA, 25 bp, Rattus norvegicus
ctggagactgtgagaaaggcttgcc

SEQ ID NO: 657019 - DNA, 25 bp, Rattus norvegicus
agaaaggcttgccaacgcgtcgccc

SEQ ID NO: 657020 - DNA, 25 bp, Rattus norvegicus
cctcacgtctagagcgcgggtgcaa

SEQ ID NO: 657021 - DNA, 25 bp, Rattus norvegicus
gcgggtgcaactcagcgacctcttt

SEQ ID NO: 657022 - DNA, 25 bp, Rattus norvegicus
tcagcgacctctttggcccttcttg

SEQ ID NO: 657023 - DNA, 25 bp, Rattus norvegicus
tggcccttcttgttcgcgggaacgc

SEQ ID NO: 657024 - DNA, 25 bp, Rattus norvegicus
tcctttgcccactgccgggcgaaag

SEQ ID NO: 657025 - DNA, 25 bp, Rattus norvegicus
ccgagtgccaggtttggtgactccg

SEQ ID NO: 657026 - DNA, 25 bp, Rattus norvegicus
gccaaggcctgttgcgtgattccaa

SEQ ID NO: 657027 - DNA, 25 bp, Rattus norvegicus
ttccaacttgggctgacattccctg

SEQ ID NO: 657028 - DNA, 25 bp, Rattus norvegicus
gtctttcccggctggtttcaggagc

SEQ ID NO: 657029 - DNA, 25 bp, Rattus norvegicus
tgtagcccaggtcgtagctgctttt

SEQ ID NO: 657030 - DNA, 25 bp, Rattus norvegicus
cgctgatggatgagccctaactatg

SEQ ID NO: 657031 - DNA, 25 bp, Rattus norvegicus
ggctagtttatgcttaccgggctcg

SEQ ID NO: 657032 - DNA, 25 bp, Rattus norvegicus
cttggtcaccctagaggctagttta

SEQ ID NO: 657033 - DNA, 25 bp, Rattus norvegicus
gcgctactcacaacacgccaattgg

SEQ ID NO: 657034 - DNA, 25 bp, Rattus norvegicus
aggaggccttcacaacttcagcacg

SEQ ID NO: 657035 - DNA, 25 bp, Rattus norvegicus
tcttaaagttcagagccagagcctg

SEQ ID NO: 657036 - DNA, 25 bp, Rattus norvegicus
gtcttccttgtctgcaacgaaaatg

SEQ ID NO: 657037 - DNA, 25 bp, Rattus norvegicus
caattcggatttcaggctcaaggtc

SEQ ID NO: 657038 - DNA, 25 bp, Rattus norvegicus
gactttctttggcttcccgttcaca

SEQ ID NO: 657039 - DNA, 25 bp, Rattus norvegicus
ctcacctgagtttgggtaaggccca

SEQ ID NO: 657040 - DNA, 25 bp, Rattus norvegicus
cgaacgtgcccgcttcctagctaaa

SEQ ID NO: 657041 - DNA, 25 bp, Rattus norvegicus
gtcagatttctgtccacccgggtca

SEQ ID NO: 657042 - DNA, 25 bp, Rattus norvegicus
caggccagttatgtcacccgcttta

SEQ ID NO: 657043 - DNA, 25 bp, Rattus norvegicus
ttccagatacaccagggagggcgct

SEQ ID NO: 657044 - DNA, 25 bp, Rattus norvegicus
gtagccgggcacctcaccatctggt

SEQ ID NO: 657045 - DNA, 25 bp, Rattus norvegicus
gggcacctcaccatctggtccaggt

SEQ ID NO: 657046 - DNA, 25 bp, Rattus norvegicus
acctcaccatctggtccaggttgtg

SEQ ID NO: 657047 - DNA, 25 bp, Rattus norvegicus
ccatctggtccaggttgtggaagtg

SEQ ID NO: 657048 - DNA, 25 bp, Rattus norvegicus
ccaggttgtggaagtggcaaggcct

SEQ ID NO: 657049 - DNA, 25 bp, Rattus norvegicus
atttcctcttccagatacaccaggg

SEQ ID NO: 657050 - DNA, 25 bp, Rattus norvegicus
cgacccagctccagtagacataata

SEQ ID NO: 657051 - DNA, 25 bp, Rattus norvegicus
ataccacgctcttgacgttcttgcg

SEQ ID NO: 657052 - DNA, 25 bp, Rattus norvegicus
cagctccagtagacataataccacg

SEQ ID NO: 657053 - DNA, 25 bp, Rattus norvegicus
cctgagggcgtagccgggcacctca

SEQ ID NO: 657054 - DNA, 25 bp, Rattus norvegicus
ggcgacccagctccagtagacataa

SEQ ID NO: 657055 - DNA, 25 bp, Rattus norvegicus
atacaccagggagggcgctgccacc

SEQ ID NO: 657056 - DNA, 25 bp, Rattus norvegicus
tagacataataccacgctcttgacg

SEQ ID NO: 657057 - DNA, 25 bp, Rattus norvegicus
ggcggctgtagcaaagcccgcttgt

SEQ ID NO: 657058 - DNA, 25 bp, Rattus norvegicus
ttcatccttagggaaacggctccga

SEQ ID NO: 657059 - DNA, 25 bp, Rattus norvegicus
tgtggcctcgggaaagagcccgacc

SEQ ID NO: 657060 - DNA, 25 bp, Rattus norvegicus
agcaaagcccgcttgtgcgaccgcg

SEQ ID NO: 657061 - DNA, 25 bp, Rattus norvegicus
ccgcttgtgcgaccgcgagtcagag

SEQ ID NO: 657062 - DNA, 25 bp, Rattus norvegicus
cgagtcagaggctgcaccgtgccac

SEQ ID NO: 657063 - DNA, 25 bp, Rattus norvegicus
acccactcgcttcatccttagggaa

SEQ ID NO: 657064 - DNA, 25 bp, Rattus norvegicus
cggctccgaggatcatgcgtagatc

SEQ ID NO: 657065 - DNA, 25 bp, Rattus norvegicus
gatcatgcgtagatcctggaagcgc

SEQ ID NO: 657066 - DNA, 25 bp, Rattus norvegicus
tgcgtagatcctggaagcgcatggt

SEQ ID NO: 657067 - DNA, 25 bp, Rattus norvegicus
ggtggtggcacactgctttccagag

SEQ ID NO: 657068 - DNA, 25 bp, Rattus norvegicus
tcgcactgtggcctcgggaaagagc

SEQ ID NO: 657069 - DNA, 25 bp, Rattus norvegicus
cactgctttccagagtgagcacgga

SEQ ID NO: 657070 - DNA, 25 bp, Rattus norvegicus
gaaacggctccgaggatcatgcgta

SEQ ID NO: 657071 - DNA, 25 bp, Rattus norvegicus
tctacctgtccgcagggcttctggc

SEQ ID NO: 657072 - DNA, 25 bp, Rattus norvegicus
ccgtcactcgataaaacgccggaga

SEQ ID NO: 657073 - DNA, 25 bp, Rattus norvegicus
gtctccagagaacaacgggctcatt

SEQ ID NO: 657074 - DNA, 25 bp, Rattus norvegicus
ctttctcaaactcttcggccgtctg

SEQ ID NO: 657075 - DNA, 25 bp, Rattus norvegicus
cggccagttgtgcttgctctacctg

SEQ ID NO: 657076 - DNA, 25 bp, Rattus norvegicus
tggcccggctgagcacagctttcaa

SEQ ID NO: 657077 - DNA, 25 bp, Rattus norvegicus
ctttcaacctggatacccgcgagga

SEQ ID NO: 657078 - DNA, 25 bp, Rattus norvegicus
gatcccgggagcctcttcggcttct

SEQ ID NO: 657079 - DNA, 25 bp, Rattus norvegicus
cgctcgccatgcactggcagttgca

SEQ ID NO: 657080 - DNA, 25 bp, Rattus norvegicus
caagacttttgagatccgggctcgc

SEQ ID NO: 657081 - DNA, 25 bp, Rattus norvegicus
ctccactccgggtttagtttgcagg

SEQ ID NO: 657082 - DNA, 25 bp, Rattus norvegicus
tggcacgctttgctgagcctcacgt

SEQ ID NO: 657083 - DNA, 25 bp, Rattus norvegicus
gcgaggacaacgtgatccggaaatc

SEQ ID NO: 657084 - DNA, 25 bp, Rattus norvegicus
tcattgagcggctgctagctaccgg

SEQ ID NO: 657085 - DNA, 25 bp, Rattus norvegicus
ccggaccgagatccgggcatagacc

SEQ ID NO: 657086 - DNA, 25 bp, Rattus norvegicus
tcagaagtgagcagagaaccgcaga

SEQ ID NO: 657087 - DNA, 25 bp, Rattus norvegicus
ggcatagaccgtaatgccgtgaccc

SEQ ID NO: 657088 - DNA, 25 bp, Rattus norvegicus
tgcggacgtcgcgaacttttccggc

SEQ ID NO: 657089 - DNA, 25 bp, Rattus norvegicus
ccggaactcagtgccggctgggacc

SEQ ID NO: 657090 - DNA, 25 bp, Rattus norvegicus
tctgacggacagacgccggagccta

SEQ ID NO: 657091 - DNA, 25 bp, Rattus norvegicus
gacgccggagcctaccaggagctca

SEQ ID NO: 657092 - DNA, 25 bp, Rattus norvegicus
ccaggagctcacagggagcagcagc

SEQ ID NO: 657093 - DNA, 25 bp, Rattus norvegicus
agcagcgggcgtcgatttgtcaaat

SEQ ID NO: 657094 - DNA, 25 bp, Rattus norvegicus
cgatttgtcaaataggccgccttga

SEQ ID NO: 657095 - DNA, 25 bp, Rattus norvegicus
gccttgaatcttgcccgctgacaga

SEQ ID NO: 657096 - DNA, 25 bp, Rattus norvegicus
ttgcccgctgacagactgaagcagg

SEQ ID NO: 657097 - DNA, 25 bp, Rattus norvegicus
caccgctgcggacgtcgcgaacttt

SEQ ID NO: 657098 - DNA, 25 bp, Rattus norvegicus
tgaagcaggaacctatcagaagtga

SEQ ID NO: 657099 - DNA, 25 bp, Rattus norvegicus
gcacagtctagcgtttttcggccga

SEQ ID NO: 657100 - DNA, 25 bp, Rattus norvegicus
taaccggggcatgggactatagtgt

SEQ ID NO: 657101 - DNA, 25 bp, Rattus norvegicus
ccctgtgtcttaggtgcttccttcc

SEQ ID NO: 657102 - DNA, 25 bp, Rattus norvegicus
gtcgccactctccatgaagcagttc

SEQ ID NO: 657103 - DNA, 25 bp, Rattus norvegicus
gtggacttctatgcgcgcttctcgc

SEQ ID NO: 657104 - DNA, 25 bp, Rattus norvegicus
gcgccagccgtagtctggcctcgga

SEQ ID NO: 657105 - DNA, 25 bp, Rattus norvegicus
agcgtcaggacgctctgtaccgtcc

SEQ ID NO: 657106 - DNA, 25 bp, Rattus norvegicus
ggtagcccggcgttgacagcactcc

SEQ ID NO: 657107 - DNA, 25 bp, Rattus norvegicus
ccttttgtccgcctccgagtagctg

SEQ ID NO: 657108 - DNA, 25 bp, Rattus norvegicus
cttccaggaaataagcaaagcttca

SEQ ID NO: 657109 - DNA, 25 bp, Rattus norvegicus
ctacgatccgggcttccaggaaata

SEQ ID NO: 657110 - DNA, 25 bp, Rattus norvegicus
caagctggaccctacgatccgggct

SEQ ID NO: 657111 - DNA, 25 bp, Rattus norvegicus
gggttgcgacacagcccaagctgga

SEQ ID NO: 657112 - DNA, 25 bp, Rattus norvegicus
caaccttgcgcgcacgtgcgtaggt

SEQ ID NO: 657113 - DNA, 25 bp, Rattus norvegicus
acctgcgggagagcattccacgtgc

SEQ ID NO: 657114 - DNA, 25 bp, Rattus norvegicus
cccgctgagactccacgctccactc

SEQ ID NO: 657115 - DNA, 25 bp, Rattus norvegicus
gggacaaggcgccagcctgccctgg

SEQ ID NO: 657116 - DNA, 25 bp, Rattus norvegicus
tgccaggaacagaatgcggcgctgt

SEQ ID NO: 657117 - DNA, 25 bp, Rattus norvegicus
gagagcattccacgtgccaggaaca

SEQ ID NO: 657118 - DNA, 25 bp, Rattus norvegicus
tgccacctgcgggagagcattccac

SEQ ID NO: 657119 - DNA, 25 bp, Rattus norvegicus
cgcctgcctggataaaaggtacggg

SEQ ID NO: 657120 - DNA, 25 bp, Rattus norvegicus
ggatcgcctgcctggataaaaggta

SEQ ID NO: 657121 - DNA, 25 bp, Rattus norvegicus
gagtggatcgcctgcctggataaaa

SEQ ID NO: 657122 - DNA, 25 bp, Rattus norvegicus
actctccgtcctcggccgagtggat

SEQ ID NO: 657123 - DNA, 25 bp, Rattus norvegicus
ggttgctgcgcacgctgcacactct

SEQ ID NO: 657124 - DNA, 25 bp, Rattus norvegicus
aacatggttgctgcgcacgctgcac

SEQ ID NO: 657125 - DNA, 25 bp, Rattus norvegicus
tgcccaacatggttgctgcgcacgc

SEQ ID NO: 657126 - DNA, 25 bp, Rattus norvegicus
ttccacgtgccaggaacagaatgcg

SEQ ID NO: 657127 - DNA, 25 bp, Rattus norvegicus
ccatacccggctgggctctgagtga

SEQ ID NO: 657128 - DNA, 25 bp, Rattus norvegicus
ctgttgcggcgacgtcttcctcatt

SEQ ID NO: 657129 - DNA, 25 bp, Rattus norvegicus
gtcttcctcattggcgccgcgcgga

SEQ ID NO: 657130 - DNA, 25 bp, Rattus norvegicus
cgcggagaggcggaatgttcaactc

SEQ ID NO: 657131 - DNA, 25 bp, Rattus norvegicus
aatgttcaactcctgactccggcgg

SEQ ID NO: 657132 - DNA, 25 bp, Rattus norvegicus
tcaactcctgactccggcggaagcg

SEQ ID NO: 657133 - DNA, 25 bp, Rattus norvegicus
ctgccgctgcgccaaggacggcttg

SEQ ID NO: 657134 - DNA, 25 bp, Rattus norvegicus
cgccaaggacggcttgggcatgtcc

SEQ ID NO: 657135 - DNA, 25 bp, Rattus norvegicus
ctcggtgcccggaagagttcggcct

SEQ ID NO: 657136 - DNA, 25 bp, Rattus norvegicus
gaagagttcggcctggcacagctcg

SEQ ID NO: 657137 - DNA, 25 bp, Rattus norvegicus
cgaccgccgggaacctgcgttggct

SEQ ID NO: 657138 - DNA, 25 bp, Rattus norvegicus
gggaacctgcgttggctgcccttcc

SEQ ID NO: 657139 - DNA, 25 bp, Rattus norvegicus
caggcgcggggatccatacccggct

SEQ ID NO: 657140 - DNA, 25 bp, Rattus norvegicus
caccctcgccttccgtgggagcaca

SEQ ID NO: 657141 - DNA, 25 bp, Rattus norvegicus
gtgcacacggagttgccagcgctcc

SEQ ID NO: 657142 - DNA, 25 bp, Rattus norvegicus
agctccggttgctccggctgtgagt

SEQ ID NO: 657143 - DNA, 25 bp, Rattus norvegicus
tgtccggcggtcgtgtcccagcctt

SEQ ID NO: 657144 - DNA, 25 bp, Rattus norvegicus
aaatctgcggtacgggcgctcgtgc

SEQ ID NO: 657145 - DNA, 25 bp, Rattus norvegicus
gccagcgctccggaaatctgcggta

SEQ ID NO: 657146 - DNA, 25 bp, Rattus norvegicus
aaggtgatgcgcctgccggtgcaca

SEQ ID NO: 657147 - DNA, 25 bp, Rattus norvegicus
ccaggataactcagggccaaggtga

SEQ ID NO: 657148 - DNA, 25 bp, Rattus norvegicus
ctgtccggttccgagtgcctgggta

SEQ ID NO: 657149 - DNA, 25 bp, Rattus norvegicus
gctgtgagtgctggtgtactccgac

SEQ ID NO: 657150 - DNA, 25 bp, Rattus norvegicus
tgtactccgacgagctgtccggttc

SEQ ID NO: 657151 - DNA, 25 bp, Rattus norvegicus
tttcttataatctctgcacccagga

SEQ ID NO: 657152 - DNA, 25 bp, Rattus norvegicus
cgcgctccagatcatcgccaggttg

SEQ ID NO: 657153 - DNA, 25 bp, Rattus norvegicus
cagatcatcgccaggttgcagggaa

SEQ ID NO: 657154 - DNA, 25 bp, Rattus norvegicus
cagggaatcacagatagattttctt

SEQ ID NO: 657155 - DNA, 25 bp, Rattus norvegicus
cccgccgccttacacatggtgagaa

SEQ ID NO: 657156 - DNA, 25 bp, Rattus norvegicus
cttgccaagctgtcggggagctgaa

SEQ ID NO: 657157 - DNA, 25 bp, Rattus norvegicus
aggcagcaagggttgctctctctcg

SEQ ID NO: 657158 - DNA, 25 bp, Rattus norvegicus
gggagtgcggctttctgcctccaca

SEQ ID NO: 657159 - DNA, 25 bp, Rattus norvegicus
ctctcggctttacgtaccggtcata

SEQ ID NO: 657160 - DNA, 25 bp, Rattus norvegicus
aaacacaaaaggtggagcctccagc

SEQ ID NO: 657161 - DNA, 25 bp, Rattus norvegicus
tgtttaggacacctcaggcggggct

SEQ ID NO: 657162 - DNA, 25 bp, Rattus norvegicus
ctccgtcagctgtgttcattggtcc

SEQ ID NO: 657163 - DNA, 25 bp, Rattus norvegicus
tggcccttcgtgcaggccttgccaa

SEQ ID NO: 657164 - DNA, 25 bp, Rattus norvegicus
aggcgcaagcctcttccactcgttg

SEQ ID NO: 657165 - DNA, 25 bp, Rattus norvegicus
tcatttgccgctgggctctccgtca

SEQ ID NO: 657166 - DNA, 25 bp, Rattus norvegicus
gtgtgccagcctcgttcctcggcta

SEQ ID NO: 657167 - DNA, 25 bp, Rattus norvegicus
tcattggtccggacgcctgtccgtc

SEQ ID NO: 657168 - DNA, 25 bp, Rattus norvegicus
ccggtcatagtgtgtttaggacacc

SEQ ID NO: 657169 - DNA, 25 bp, Rattus norvegicus
tccacatgcctcaagctgtctgctg

SEQ ID NO: 657170 - DNA, 25 bp, Rattus norvegicus
gactcaccgtgcaccgggctaaaga

SEQ ID NO: 657171 - DNA, 25 bp, Rattus norvegicus
gtagcccagtcgagcacgatgcccg

SEQ ID NO: 657172 - DNA, 25 bp, Rattus norvegicus
tggactctttcagggactcaccgtg

SEQ ID NO: 657173 - DNA, 25 bp, Rattus norvegicus
gctaaagatcgcacggggtcccaga

SEQ ID NO: 657174 - DNA, 25 bp, Rattus norvegicus
tcccagactgcaaagaccggtgtcg

SEQ ID NO: 657175 - DNA, 25 bp, Rattus norvegicus
gccgagccgcacgtacgacggcaga

SEQ ID NO: 657176 - DNA, 25 bp, Rattus norvegicus
ctgggtcacgcccattggcccggat

SEQ ID NO: 657177 - DNA, 25 bp, Rattus norvegicus
agcaccaggcttctgcgtctctcta

SEQ ID NO: 657178 - DNA, 25 bp, Rattus norvegicus
gtctctctacacgtgggcttcaacc

SEQ ID NO: 657179 - DNA, 25 bp, Rattus norvegicus
ttcaaccgagccaccaggttctctt

SEQ ID NO: 657180 - DNA, 25 bp, Rattus norvegicus
tccggactcccaagtttatctcgga

SEQ ID NO: 657181 - DNA, 25 bp, Rattus norvegicus
aagggcgcctcattcatccacatgc

SEQ ID NO: 657182 - DNA, 25 bp, Rattus norvegicus
ttatctcggaccctcttgtcccaga

SEQ ID NO: 657183 - DNA, 25 bp, Rattus norvegicus
cagcggcacttcaaagcgggtgctc

SEQ ID NO: 657184 - DNA, 25 bp, Rattus norvegicus
acttgactggcacgcgccaggagcc

SEQ ID NO: 657185 - DNA, 25 bp, Rattus norvegicus
cgcagacttgactggcacgcgccag

SEQ ID NO: 657186 - DNA, 25 bp, Rattus norvegicus
tgcggggcagctcccgtctgctctg

SEQ ID NO: 657187 - DNA, 25 bp, Rattus norvegicus
ctgcctgcgccctcattgggcgaga

SEQ ID NO: 657188 - DNA, 25 bp, Rattus norvegicus
ccgccgccaggcttaacaccgctcc

SEQ ID NO: 657189 - DNA, 25 bp, Rattus norvegicus
gaggcgcagccagcggcacttcaaa

SEQ ID NO: 657190 - DNA, 25 bp, Rattus norvegicus
tcaaagcgggtgctcctcgcactta

SEQ ID NO: 657191 - DNA, 25 bp, Rattus norvegicus
gctcctcgcacttaggctgagtttt

SEQ ID NO: 657192 - DNA, 25 bp, Rattus norvegicus
cacttaggctgagttttgccggcgg

SEQ ID NO: 657193 - DNA, 25 bp, Rattus norvegicus
agccgcgcgggacccgaattgtgat

SEQ ID NO: 657194 - DNA, 25 bp, Rattus norvegicus
cgcgggacccgaattgtgattccca

SEQ ID NO: 657195 - DNA, 25 bp, Rattus norvegicus
gacccgaattgtgattcccagccgc

SEQ ID NO: 657196 - DNA, 25 bp, Rattus norvegicus
cctcattgggcgagaggcgcagcca

SEQ ID NO: 657197 - DNA, 25 bp, Rattus norvegicus
tgccgggctctgagcactcatgtcc

SEQ ID NO: 657198 - DNA, 25 bp, Rattus norvegicus
agcaccctgacctgggtacggcgga

SEQ ID NO: 657199 - DNA, 25 bp, Rattus norvegicus
agcactgtatttttgagcaccctga

SEQ ID NO: 657200 - DNA, 25 bp, Rattus norvegicus
ccggcctacgtggagcactgtattt

SEQ ID NO: 657201 - DNA, 25 bp, Rattus norvegicus
tgtgcgcgctgtgagatccttttct

SEQ ID NO: 657202 - DNA, 25 bp, Rattus norvegicus
cggacaggtgagacaaaaaggacct

SEQ ID NO: 657203 - DNA, 25 bp, Rattus norvegicus
cgttcgctctgctaggtagcctggc

SEQ ID NO: 657204 - DNA, 25 bp, Rattus norvegicus
tcagcccgttcgctctgctaggtag

SEQ ID NO: 657205 - DNA, 25 bp, Rattus norvegicus
acagcagcttctggggctggctcag

SEQ ID NO: 657206 - DNA, 25 bp, Rattus norvegicus
ctgcgacgctcggacagcagcttct

SEQ ID NO: 657207 - DNA, 25 bp, Rattus norvegicus
tcctacagtccgctgcgccaggagt

SEQ ID NO: 657208 - DNA, 25 bp, Rattus norvegicus
gaggcccgctcggtgtcctacagtc

SEQ ID NO: 657209 - DNA, 25 bp, Rattus norvegicus
cagagagcgcgacaactggagagcc

SEQ ID NO: 657210 - DNA, 25 bp, Rattus norvegicus
ttctgcaagaaatgcaagaccctgc

SEQ ID NO: 657211 - DNA, 25 bp, Rattus norvegicus
ggccgccagcgctatgatctcaggc

SEQ ID NO: 657212 - DNA, 25 bp, Rattus norvegicus
ggcggccttttctccaactcggcag

SEQ ID NO: 657213 - DNA, 25 bp, Rattus norvegicus
cacccgtacgagtcgtggtacaagt

SEQ ID NO: 657214 - DNA, 25 bp, Rattus norvegicus
cttttctccaactcggcagcggcgg

SEQ ID NO: 657215 - DNA, 25 bp, Rattus norvegicus
caaggggctgcacagctgtcacatc

SEQ ID NO: 657216 - DNA, 25 bp, Rattus norvegicus
catctccaaggtgcatacgacggcg

SEQ ID NO: 657217 - DNA, 25 bp, Rattus norvegicus
gcaaacacattaagacgcacaacgg

SEQ ID NO: 657218 - DNA, 25 bp, Rattus norvegicus
agtcgtggtacaagtcgggcttcca

SEQ ID NO: 657219 - DNA, 25 bp, Rattus norvegicus
aagtcgggcttccactcgacgctgg

SEQ ID NO: 657220 - DNA, 25 bp, Rattus norvegicus
tgcactcgcagctgggcacctacaa

SEQ ID NO: 657221 - DNA, 25 bp, Rattus norvegicus
ggcccaggacggcttcaagccagtg

SEQ ID NO: 657222 - DNA, 25 bp, Rattus norvegicus
tactcggactccagcgccgcggtgg

SEQ ID NO: 657223 - DNA, 25 bp, Rattus norvegicus
agcctacgacgcaaggggctgcaca

SEQ ID NO: 657224 - DNA, 25 bp, Rattus norvegicus
gcgggcggccagtcggccttcatct

SEQ ID NO: 657225 - DNA, 25 bp, Rattus norvegicus
acagccacctttgtagcgggtactc

SEQ ID NO: 657226 - DNA, 25 bp, Rattus norvegicus
gggtgcccagctccctaaactcaag

SEQ ID NO: 657227 - DNA, 25 bp, Rattus norvegicus
cgctgtaagaaaggagacgaggctc

SEQ ID NO: 657228 - DNA, 25 bp, Rattus norvegicus
ggaaagaaatgcagtctcccgacgc

SEQ ID NO: 657229 - DNA, 25 bp, Rattus norvegicus
agacggcttgtagcgactttctccc

SEQ ID NO: 657230 - DNA, 25 bp, Rattus norvegicus
ccatccacgagctttagacggcttg

SEQ ID NO: 657231 - DNA, 25 bp, Rattus norvegicus
tttctcttctctgtgcatcgccctg

SEQ ID NO: 657232 - DNA, 25 bp, Rattus norvegicus
ctcaagtcagggaaatacagcgcgc

SEQ ID NO: 657233 - DNA, 25 bp, Rattus norvegicus
ctcgccttttcgaaacccaaatctg

SEQ ID NO: 657234 - DNA, 25 bp, Rattus norvegicus
tgcagtctcccgacgctgtaagaaa

SEQ ID NO: 657235 - DNA, 25 bp, Rattus norvegicus
gggcgttggccaattttctcttctc

SEQ ID NO: 657236 - DNA, 25 bp, Rattus norvegicus
cccttcagcagttattgtattttaa

SEQ ID NO: 657237 - DNA, 25 bp, Rattus norvegicus
tacagcgcgcttctgggaacgcaac

SEQ ID NO: 657238 - DNA, 25 bp, Rattus norvegicus
tctgggaacgcaacagccacctttg

SEQ ID NO: 657239 - DNA, 25 bp, Rattus norvegicus
ttaagcgagcatgggcgagaacttc

SEQ ID NO: 657240 - DNA, 25 bp, Rattus norvegicus
tggagatagttttacgccaaccgta

SEQ ID NO: 657241 - DNA, 25 bp, Rattus norvegicus
tgcggcgctgttcctatgtagataa

SEQ ID NO: 657242 - DNA, 25 bp, Rattus norvegicus
gtcgactccagttgcaaaatttttc

SEQ ID NO: 657243 - DNA, 25 bp, Rattus norvegicus
gcccagcactttctggcaacgtcga

SEQ ID NO: 657244 - DNA, 25 bp, Rattus norvegicus
ggtcttgaagttcgagcccagcact

SEQ ID NO: 657245 - DNA, 25 bp, Rattus norvegicus
acgtcccgaacaagcgaggtcttga

SEQ ID NO: 657246 - DNA, 25 bp, Rattus norvegicus
cagcatcgttctgagcgcagacgtc

SEQ ID NO: 657247 - DNA, 25 bp, Rattus norvegicus
cgcagcagaggtaagctcaggcgtc

SEQ ID NO: 657248 - DNA, 25 bp, Rattus norvegicus
cggtagttgcttctcgtcgctgtta

SEQ ID NO: 657249 - DNA, 25 bp, Rattus norvegicus
ctcctgctctcttccggtagttgct

SEQ ID NO: 657250 - DNA, 25 bp, Rattus norvegicus
cttccgaggtcggaggtgactactt

SEQ ID NO: 657251 - DNA, 25 bp, Rattus norvegicus
cgtcaccggaactgttaagcgagca

SEQ ID NO: 657252 - DNA, 25 bp, Rattus norvegicus
actacttccgtagattagcgttagg

SEQ ID NO: 657253 - DNA, 25 bp, Rattus norvegicus
acaccgtgacggtgctgcgcaagaa

SEQ ID NO: 657254 - DNA, 25 bp, Rattus norvegicus
ccgagagtgactgggacaccgtgac

SEQ ID NO: 657255 - DNA, 25 bp, Rattus norvegicus
gccgcacaggccaagtctaagcagg

SEQ ID NO: 657256 - DNA, 25 bp, Rattus norvegicus
cgggtctcgagcagctgccagagcc

SEQ ID NO: 657257 - DNA, 25 bp, Rattus norvegicus
agtctaagcaggtgcccagccagcg

SEQ ID NO: 657258 - DNA, 25 bp, Rattus norvegicus
ccgccgcgtcatggccgagagtgac

SEQ ID NO: 657259 - DNA, 25 bp, Rattus norvegicus
cggctcccggaaccaccggccaatg

SEQ ID NO: 657260 - DNA, 25 bp, Rattus norvegicus
gtctctagactagccgggagcggat

SEQ ID NO: 657261 - DNA, 25 bp, Rattus norvegicus
cccgtgggtctctagactagccggg

SEQ ID NO: 657262 - DNA, 25 bp, Rattus norvegicus
atccgtggcgacgaacaggcgtcgc

SEQ ID NO: 657263 - DNA, 25 bp, Rattus norvegicus
aagacgagatccgtggcgacgaaca

SEQ ID NO: 657264 - DNA, 25 bp, Rattus norvegicus
ccacaccgacagaagacgagatccg

SEQ ID NO: 657265 - DNA, 25 bp, Rattus norvegicus
ggcgcagccacaccgacagaagacg

SEQ ID NO: 657266 - DNA, 25 bp, Rattus norvegicus
tcatggccgagagtgactgggacac

SEQ ID NO: 657267 - DNA, 25 bp, Rattus norvegicus
ttgagccagcagcagatgcccaacc

SEQ ID NO: 657268 - DNA, 25 bp, Rattus norvegicus
gatgcccaaccacgttccgagaaaa

SEQ ID NO: 657269 - DNA, 25 bp, Rattus norvegicus
ccctagccagaaggtcggaatgcgg

SEQ ID NO: 657270 - DNA, 25 bp, Rattus norvegicus
gagtgatacactgcgctccgcccta

SEQ ID NO: 657271 - DNA, 25 bp, Rattus norvegicus
gaggtccgcgtttcgaatctccacc

SEQ ID NO: 657272 - DNA, 25 bp, Rattus norvegicus
cctccagcatggaggtccgcgtttc

SEQ ID NO: 657273 - DNA, 25 bp, Rattus norvegicus
aagcgggtctccactctgccgtgag

SEQ ID NO: 657274 - DNA, 25 bp, Rattus norvegicus
tcagctaccttaggcgtctgcggcc

SEQ ID NO: 657275 - DNA, 25 bp, Rattus norvegicus
ccggagccctcttctaaaggcttga

SEQ ID NO: 657276 - DNA, 25 bp, Rattus norvegicus
aggcagcgagcacactgccgtcatc

SEQ ID NO: 657277 - DNA, 25 bp, Rattus norvegicus
ctgctaggtttgcagctccggctgc

SEQ ID NO: 657278 - DNA, 25 bp, Rattus norvegicus
agggctcatctcacctgctaggttt

SEQ ID NO: 657279 - DNA, 25 bp, Rattus norvegicus
tggaacctggcgctacccactggtc

SEQ ID NO: 657280 - DNA, 25 bp, Rattus norvegicus
tgcgggcctgtcagctaccttaggc

SEQ ID NO: 657281 - DNA, 25 bp, Rattus norvegicus
acataggagccaagttctgggagcc

SEQ ID NO: 657282 - DNA, 25 bp, Rattus norvegicus
ggaaacttctctctgggtccgcagg

SEQ ID NO: 657283 - DNA, 25 bp, Rattus norvegicus
aacttcgccgagatgtgagccctcc

SEQ ID NO: 657284 - DNA, 25 bp, Rattus norvegicus
tggggcgcagctcccttaccgtgca

SEQ ID NO: 657285 - DNA, 25 bp, Rattus norvegicus
tagatcggtccgaaccaccagcggc

SEQ ID NO: 657286 - DNA, 25 bp, Rattus norvegicus
ttgcagatgcagctccggggcaacg

SEQ ID NO: 657287 - DNA, 25 bp, Rattus norvegicus
ccctcgctggagttgaggttgcaga

SEQ ID NO: 657288 - DNA, 25 bp, Rattus norvegicus
aaatcaaccgccctcgctggagttg

SEQ ID NO: 657289 - DNA, 25 bp, Rattus norvegicus
tctgggagccgcacgctccaaaatc

SEQ ID NO: 657290 - DNA, 25 bp, Rattus norvegicus
aggctgcgaccatccgggaacttcg

SEQ ID NO: 657291 - DNA, 25 bp, Rattus norvegicus
aggacgctgtccctagagactgccc

SEQ ID NO: 657292 - DNA, 25 bp, Rattus norvegicus
agggatacccaaccgaggacgctgt

SEQ ID NO: 657293 - DNA, 25 bp, Rattus norvegicus
gagccggacctggaagggataccca

SEQ ID NO: 657294 - DNA, 25 bp, Rattus norvegicus
aagctggcttttacaacggagtggc

SEQ ID NO: 657295 - DNA, 25 bp, Rattus norvegicus
cgcgagatccgactgacaagccttc

SEQ ID NO: 657296 - DNA, 25 bp, Rattus norvegicus
ggggacctcgcaagtgaccacacaa

SEQ ID NO: 657297 - DNA, 25 bp, Rattus norvegicus
ctgagaggagccgttattccttctc

SEQ ID NO: 657298 - DNA, 25 bp, Rattus norvegicus
tccttctcgctcacgcttgggaaag

SEQ ID NO: 657299 - DNA, 25 bp, Rattus norvegicus
gcgacgtcgccatgttagcaccttc

SEQ ID NO: 657300 - DNA, 25 bp, Rattus norvegicus
ttcatgttcctttcagccaccagcg

SEQ ID NO: 657301 - DNA, 25 bp, Rattus norvegicus
cggaggaaagggctgaatcgcactt

SEQ ID NO: 657302 - DNA, 25 bp, Rattus norvegicus
ctgatttcctccgaaggagcgcctg

SEQ ID NO: 657303 - DNA, 25 bp, Rattus norvegicus
aggcttccgtcctctctcgcgagat

SEQ ID NO: 657304 - DNA, 25 bp, Rattus norvegicus
gcaggtcaggtgactccgtcctaca

SEQ ID NO: 657305 - DNA, 25 bp, Rattus norvegicus
cagaaagctgtgattggcagccata

SEQ ID NO: 657306 - DNA, 25 bp, Rattus norvegicus
gtttccgtaaccagggaactgcaga

SEQ ID NO: 657307 - DNA, 25 bp, Rattus norvegicus
ggaaccaaagaacactcggacgcta

SEQ ID NO: 657308 - DNA, 25 bp, Rattus norvegicus
ctttaaaggccacgggctcccacag

SEQ ID NO: 657309 - DNA, 25 bp, Rattus norvegicus
ccgcgtgcccgggagtcacaagtct

SEQ ID NO: 657310 - DNA, 25 bp, Rattus norvegicus
tgcggctcttatccgtgccgcagca

SEQ ID NO: 657311 - DNA, 25 bp, Rattus norvegicus
tgcgcaagcgcggtgcggctcttat

SEQ ID NO: 657312 - DNA, 25 bp, Rattus norvegicus
gtctagtggacagggcccgaagacc

SEQ ID NO: 657313 - DNA, 25 bp, Rattus norvegicus
ccgggagtcacaagtctagtggaca

SEQ ID NO: 657314 - DNA, 25 bp, Rattus norvegicus
gaggcttaaggtcaagtgtccccca

SEQ ID NO: 657315 - DNA, 25 bp, Rattus norvegicus
ctctggggagcgaaaagaggcttaa

SEQ ID NO: 657316 - DNA, 25 bp, Rattus norvegicus
ctgcttcctctctggggagcgaaaa

SEQ ID NO: 657317 - DNA, 25 bp, Rattus norvegicus
gcgatgtgggctcctctcctgcttc

SEQ ID NO: 657318 - DNA, 25 bp, Rattus norvegicus
tgacaggcgatgtgggctcctctcc

SEQ ID NO: 657319 - DNA, 25 bp, Rattus norvegicus
tggcgcaggcgaacatctttcttcc

SEQ ID NO: 657320 - DNA, 25 bp, Rattus norvegicus
aggcccgggttacgcaccagagcag

SEQ ID NO: 657321 - DNA, 25 bp, Rattus norvegicus
tccctcggcgtgtacgctgggccga

SEQ ID NO: 657322 - DNA, 25 bp, Rattus norvegicus
cacaagtctagtggacagggcccga

SEQ ID NO: 657323 - DNA, 25 bp, Rattus norvegicus
agagccgagtctcgtgcactccgga

SEQ ID NO: 657324 - DNA, 25 bp, Rattus norvegicus
ctgtgaatcctctgcggctagtata

SEQ ID NO: 657325 - DNA, 25 bp, Rattus norvegicus
ggcccgaggatttaggctgtgaatc

SEQ ID NO: 657326 - DNA, 25 bp, Rattus norvegicus
tgatacagcactgggcccggccaat

SEQ ID NO: 657327 - DNA, 25 bp, Rattus norvegicus
ggcagcagcacccactgatacagca

SEQ ID NO: 657328 - DNA, 25 bp, Rattus norvegicus
tagagcttatgcagcaggcagcagc

SEQ ID NO: 657329 - DNA, 25 bp, Rattus norvegicus
gtcgccaccgcgtagagcttatgca

SEQ ID NO: 657330 - DNA, 25 bp, Rattus norvegicus
ttcaccgtcctacctgaggaaagcg

SEQ ID NO: 657331 - DNA, 25 bp, Rattus norvegicus
agttccgagcgcctctgtctacgcg

SEQ ID NO: 657332 - DNA, 25 bp, Rattus norvegicus
ctctaggccactaggcatgggcgga

SEQ ID NO: 657333 - DNA, 25 bp, Rattus norvegicus
ggctagtataggctgtccgtcctcg

SEQ ID NO: 657334 - DNA, 25 bp, Rattus norvegicus
atccacgagagaaggcggcaacagc

SEQ ID NO: 657335 - DNA, 25 bp, Rattus norvegicus
gcggaatccctgagaacatacccgg

SEQ ID NO: 657336 - DNA, 25 bp, Rattus norvegicus
cggcaacagcgtacagagggcagcc

SEQ ID NO: 657337 - DNA, 25 bp, Rattus norvegicus
gagcgcagtgcggagcagcccacct

SEQ ID NO: 657338 - DNA, 25 bp, Rattus norvegicus
tcgctgctcatgtcggcctcagcgg

SEQ ID NO: 657339 - DNA, 25 bp, Rattus norvegicus
gtcgctgctcatgtcggcctcagcg

SEQ ID NO: 657340 - DNA, 25 bp, Rattus norvegicus
acgtcgctgctcatgtcggcctcag

SEQ ID NO: 657341 - DNA, 25 bp, Rattus norvegicus
gcgcagtgcggagcagcccacctcc

SEQ ID NO: 657342 - DNA, 25 bp, Rattus norvegicus
tttccttgagctgcgcggcgcccag

SEQ ID NO: 657343 - DNA, 25 bp, Rattus norvegicus
ttttccttgagctgcgcggcgccca

SEQ ID NO: 657344 - DNA, 25 bp, Rattus norvegicus
tgttttccttgagctgcgcggcgcc

SEQ ID NO: 657345 - DNA, 25 bp, Rattus norvegicus
acctttggcattgttttccttgagc

SEQ ID NO: 657346 - DNA, 25 bp, Rattus norvegicus
gaggcccgcgagagagcccggagga

SEQ ID NO: 657347 - DNA, 25 bp, Rattus norvegicus
tcggagcagctaaggcgtggaaagg

SEQ ID NO: 657348 - DNA, 25 bp, Rattus norvegicus
ttaagagtcggagcagctaaggcgt

SEQ ID NO: 657349 - DNA, 25 bp, Rattus norvegicus
gtagttaagagtcggagcagctaag

SEQ ID NO: 657350 - DNA, 25 bp, Rattus norvegicus
gcccacctccacgtcgctgctcatg

SEQ ID NO: 657351 - DNA, 25 bp, Rattus norvegicus
cttggtcgaaatgcgcttcgcctcg

SEQ ID NO: 657352 - DNA, 25 bp, Rattus norvegicus
gtacaggttctgcaccgccagcaca

SEQ ID NO: 657353 - DNA, 25 bp, Rattus norvegicus
agcacatcgtcccagctgagcaagg

SEQ ID NO: 657354 - DNA, 25 bp, Rattus norvegicus
atcgtcccagctgagcaaggcgtca

SEQ ID NO: 657355 - DNA, 25 bp, Rattus norvegicus
agcaaggcgtcacggcccagcttct

SEQ ID NO: 657356 - DNA, 25 bp, Rattus norvegicus
cttcttgtagtagggcgccatgagc

SEQ ID NO: 657357 - DNA, 25 bp, Rattus norvegicus
tgagaccgagcgtgtggccgatctc

SEQ ID NO: 657358 - DNA, 25 bp, Rattus norvegicus
tggccgatctcgtgagccagcacca

SEQ ID NO: 657359 - DNA, 25 bp, Rattus norvegicus
gtgagccagcaccacgaacaggttg

SEQ ID NO: 657360 - DNA, 25 bp, Rattus norvegicus
cacgaacaggttgcgcccacggcgg

SEQ ID NO: 657361 - DNA, 25 bp, Rattus norvegicus
cacggcggcgactcagagaccaacg

SEQ ID NO: 657362 - DNA, 25 bp, Rattus norvegicus
gactcagagaccaacgctcgtcttg

SEQ ID NO: 657363 - DNA, 25 bp, Rattus norvegicus
gctcgtcttggtcgaaatgcgcttc

SEQ ID NO: 657364 - DNA, 25 bp, Rattus norvegicus
ccaacgctcgtcttggtcgaaatgc

SEQ ID NO: 657365 - DNA, 25 bp, Rattus norvegicus
aagccgcccgccctgagggcttgcg

SEQ ID NO: 657366 - DNA, 25 bp, Rattus norvegicus
acccgcgtctgcgagttgggtgaac

SEQ ID NO: 657367 - DNA, 25 bp, Rattus norvegicus
tctgcgagttgggtgaaccctgcct

SEQ ID NO: 657368 - DNA, 25 bp, Rattus norvegicus
gttgggtgaaccctgcctcctatgt

SEQ ID NO: 657369 - DNA, 25 bp, Rattus norvegicus
ggtgaaccctgcctcctatgtgttg

SEQ ID NO: 657370 - DNA, 25 bp, Rattus norvegicus
tgcctcctatgtgttgtttccctga

SEQ ID NO: 657371 - DNA, 25 bp, Rattus norvegicus
cctatgtgttgtttccctgacgaac

SEQ ID NO: 657372 - DNA, 25 bp, Rattus norvegicus
gtttccctgacgaacacagccggca

SEQ ID NO: 657373 - DNA, 25 bp, Rattus norvegicus
agccggcaccctcgtctggctttgt

SEQ ID NO: 657374 - DNA, 25 bp, Rattus norvegicus
accctcgtctggctttgtgacggca

SEQ ID NO: 657375 - DNA, 25 bp, Rattus norvegicus
tctggctttgtgacggcagtggaaa

SEQ ID NO: 657376 - DNA, 25 bp, Rattus norvegicus
tgacggcagtggaaagccgaacctg

SEQ ID NO: 657377 - DNA, 25 bp, Rattus norvegicus
gtgagtgagccgacagggctccctc

SEQ ID NO: 657378 - DNA, 25 bp, Rattus norvegicus
cagtggaaagccgaacctgggagcc

SEQ ID NO: 657379 - DNA, 25 bp, Rattus norvegicus
tccagaggacggatggatgtggcga

SEQ ID NO: 657380 - DNA, 25 bp, Rattus norvegicus
cacctgcggggacagccgcaccacc

SEQ ID NO: 657381 - DNA, 25 bp, Rattus norvegicus
tgcagagcaattccggccgcgagta

SEQ ID NO: 657382 - DNA, 25 bp, Rattus norvegicus
agcgcacggaaggtgtccagaggac

SEQ ID NO: 657383 - DNA, 25 bp, Rattus norvegicus
gaagctgcagagcaattccggccgc

SEQ ID NO: 657384 - DNA, 25 bp, Rattus norvegicus
gcgaagggcgaagacgccgccgccg

SEQ ID NO: 657385 - DNA, 25 bp, Rattus norvegicus
ccgtgacgcccacgtgcgggtagta

SEQ ID NO: 657386 - DNA, 25 bp, Rattus norvegicus
cgggtagtagtgcagcggcacgtgc

SEQ ID NO: 657387 - DNA, 25 bp, Rattus norvegicus
cggcacgtgcgagtggaaagggtag

SEQ ID NO: 657388 - DNA, 25 bp, Rattus norvegicus
ggtgtagaagctgggatccgctgga

SEQ ID NO: 657389 - DNA, 25 bp, Rattus norvegicus
gatccgctggatgaggccacgacat

SEQ ID NO: 657390 - DNA, 25 bp, Rattus norvegicus
gctggatgaggccacgacatggcca

SEQ ID NO: 657391 - DNA, 25 bp, Rattus norvegicus
tgaggccacgacatggccaggcgct

SEQ ID NO: 657392 - DNA, 25 bp, Rattus norvegicus
ccgcgagtagggatgtgagagcgca

SEQ ID NO: 657393 - DNA, 25 bp, Rattus norvegicus
gaactccttctccaggcgcgcgatc

SEQ ID NO: 657394 - DNA, 25 bp, Rattus norvegicus
aataccttgatggtggtttcgggca

SEQ ID NO: 657395 - DNA, 25 bp, Rattus norvegicus
gccgtaatcaataccttgatggtgg

SEQ ID NO: 657396 - DNA, 25 bp, Rattus norvegicus
agtgcagcggccagctcgcaacggc

SEQ ID NO: 657397 - DNA, 25 bp, Rattus norvegicus
gcggggccgagacacatagttctcc

SEQ ID NO: 657398 - DNA, 25 bp, Rattus norvegicus
gccgagacacatagttctccctgta

SEQ ID NO: 657399 - DNA, 25 bp, Rattus norvegicus
acacatagttctccctgtagaactc

SEQ ID NO: 657400 - DNA, 25 bp, Rattus norvegicus
ctccaggcgcgcgatctgttcgcgg

SEQ ID NO: 657401 - DNA, 25 bp, Rattus norvegicus
atctgttcgcgggtgaatgcggtac

SEQ ID NO: 657402 - DNA, 25 bp, Rattus norvegicus
tgcggtacggtatcgccgcacctga

SEQ ID NO: 657403 - DNA, 25 bp, Rattus norvegicus
acggtatcgccgcacctgatcggcg

SEQ ID NO: 657404 - DNA, 25 bp, Rattus norvegicus
ctgatcggcgccggaaccggagcca

SEQ ID NO: 657405 - DNA, 25 bp, Rattus norvegicus
gcagactgccaaggccggatccggt

SEQ ID NO: 657406 - DNA, 25 bp, Rattus norvegicus
ctccatgcagactgccaaggccgga

SEQ ID NO: 657407 - DNA, 25 bp, Rattus norvegicus
ttccagggcctcgagcacagcactg

SEQ ID NO: 657408 - DNA, 25 bp, Rattus norvegicus
cgatttcggaggagacggtgctttc

SEQ ID NO: 657409 - DNA, 25 bp, Rattus norvegicus
atgactaggcttcttgcggctctcg

SEQ ID NO: 657410 - DNA, 25 bp, Rattus norvegicus
attttccagggcctcgagcacagca

SEQ ID NO: 657411 - DNA, 25 bp, Rattus norvegicus
ctgcgaattttccagggcctcgagc

SEQ ID NO: 657412 - DNA, 25 bp, Rattus norvegicus
cgagccgggtgctgcgaattttcca

SEQ ID NO: 657413 - DNA, 25 bp, Rattus norvegicus
tctcccagagcaccgtgcagcgggg

SEQ ID NO: 657414 - DNA, 25 bp, Rattus norvegicus
acggtgctttcgctgctcgggtgct

SEQ ID NO: 657415 - DNA, 25 bp, Rattus norvegicus
ctatttcgaatttgcccttggcggg

SEQ ID NO: 657416 - DNA, 25 bp, Rattus norvegicus
agtgtctatttcgaatttgcccttg

SEQ ID NO: 657417 - DNA, 25 bp, Rattus norvegicus
gcaggttgaacaaagtgtctatttc

SEQ ID NO: 657418 - DNA, 25 bp, Rattus norvegicus
tgctgcaggttgaacaaagtgtcta

SEQ ID NO: 657419 - DNA, 25 bp, Rattus norvegicus
ctcgggtgctgcaggttgaacaaag

SEQ ID NO: 657420 - DNA, 25 bp, Rattus norvegicus
gaggtctcccagagcaccgtgcagc

SEQ ID NO: 657421 - DNA, 25 bp, Rattus norvegicus
gcactgggtctctgggcccacaatc

SEQ ID NO: 657422 - DNA, 25 bp, Rattus norvegicus
tgttcgccaaagcactgggtctctg

SEQ ID NO: 657423 - DNA, 25 bp, Rattus norvegicus
gaggtccgccgccatgttcgccaaa

SEQ ID NO: 657424 - DNA, 25 bp, Rattus norvegicus
atcaggaatctgaccgaggtccgcc

SEQ ID NO: 657425 - DNA, 25 bp, Rattus norvegicus
tgaatcaatgtccacatcaggaatc

SEQ ID NO: 657426 - DNA, 25 bp, Rattus norvegicus
gcacgtacttgaagataccatctga

SEQ ID NO: 657427 - DNA, 25 bp, Rattus norvegicus
gtggactcgaatcagcacgtacttg

SEQ ID NO: 657428 - DNA, 25 bp, Rattus norvegicus
ctcaccgtggtattcagcccatttg

SEQ ID NO: 657429 - DNA, 25 bp, Rattus norvegicus
tgtagccacgcacgatttccttgca

SEQ ID NO: 657430 - DNA, 25 bp, Rattus norvegicus
agcccatttgtagccacgcacgatt

SEQ ID NO: 657431 - DNA, 25 bp, Rattus norvegicus
ttggcagccgcgaccaatcccgtga

SEQ ID NO: 657432 - DNA, 25 bp, Rattus norvegicus
ccaatcccgtgagggaatgcttctc

SEQ ID NO: 657433 - DNA, 25 bp, Rattus norvegicus
cccggaaggctctgctaagtggact

SEQ ID NO: 657434 - DNA, 25 bp, Rattus norvegicus
cttactcaaccctgtgcgcgaagga

SEQ ID NO: 657435 - DNA, 25 bp, Rattus norvegicus
agcgtaccgaccaacgaggtgcccg

SEQ ID NO: 657436 - DNA, 25 bp, Rattus norvegicus
tttttataaacgtcccgcgatgagc

SEQ ID NO: 657437 - DNA, 25 bp, Rattus norvegicus
tcccagtggagaagtacatggacgt

SEQ ID NO: 657438 - DNA, 25 bp, Rattus norvegicus
cctctctcggaggtttcccagtgga

SEQ ID NO: 657439 - DNA, 25 bp, Rattus norvegicus
cgtgggcttacagcagaacgctctc

SEQ ID NO: 657440 - DNA, 25 bp, Rattus norvegicus
gctactacagctgccgcatgtcgca

SEQ ID NO: 657441 - DNA, 25 bp, Rattus norvegicus
ccatttcggcaacggctactacagc

SEQ ID NO: 657442 - DNA, 25 bp, Rattus norvegicus
cgcgttgggctatggctaccatttc

SEQ ID NO: 657443 - DNA, 25 bp, Rattus norvegicus
ctccagtggccaaagagtgtcccgc

SEQ ID NO: 657444 - DNA, 25 bp, Rattus norvegicus
gtcatcctcggctgtgatcgccact

SEQ ID NO: 657445 - DNA, 25 bp, Rattus norvegicus
acctctgagcgcacaggctcgtcgt

SEQ ID NO: 657446 - DNA, 25 bp, Rattus norvegicus
ttcgcgtacccagggacctctgagc

SEQ ID NO: 657447 - DNA, 25 bp, Rattus norvegicus
tcccgcgatgagctaacctgttgga

SEQ ID NO: 657448 - DNA, 25 bp, Rattus norvegicus
cccgcgcgagccaaggaagtgtcct

SEQ ID NO: 657449 - DNA, 25 bp, Rattus norvegicus
gcgatcttcgctgcccgacggtaaa

SEQ ID NO: 657450 - DNA, 25 bp, Rattus norvegicus
cctgcgcctccaacttcaaggaaga

SEQ ID NO: 657451 - DNA, 25 bp, Rattus norvegicus
tcggctctcaaaggcaccaagtacg

SEQ ID NO: 657452 - DNA, 25 bp, Rattus norvegicus
gcatctgaggaacgcagccggacta

SEQ ID NO: 657453 - DNA, 25 bp, Rattus norvegicus
aggtcaagttctatacgcctgatgc

SEQ ID NO: 657454 - DNA, 25 bp, Rattus norvegicus
gtacttgaccggctctgggcccatt

SEQ ID NO: 657455 - DNA, 25 bp, Rattus norvegicus
ggggcttctctcagccgtacttgac

SEQ ID NO: 657456 - DNA, 25 bp, Rattus norvegicus
acttttctaacctgcgacccaatgg

SEQ ID NO: 657457 - DNA, 25 bp, Rattus norvegicus
atgtgggctcgcttctgaatttaca

SEQ ID NO: 657458 - DNA, 25 bp, Rattus norvegicus
tgtgagcgcagtctctacagagctg

SEQ ID NO: 657459 - DNA, 25 bp, Rattus norvegicus
ttgctgagcacagccgaggcccttt

SEQ ID NO: 657460 - DNA, 25 bp, Rattus norvegicus
ggcgaagtttcgtccaatcctctga

SEQ ID NO: 657461 - DNA, 25 bp, Rattus norvegicus
ccgtcgaacattgcgggtgttatca

SEQ ID NO: 657462 - DNA, 25 bp, Rattus norvegicus
ccggctttgaagaacctgcaggcga

SEQ ID NO: 657463 - DNA, 25 bp, Rattus norvegicus
ctagcgcgccgctgcagatggcgca

SEQ ID NO: 657464 - DNA, 25 bp, Rattus norvegicus
gcatcgcgtctacgcgctgcgcaga

SEQ ID NO: 657465 - DNA, 25 bp, Rattus norvegicus
cacggtaggttctctagcggaacgc

SEQ ID NO: 657466 - DNA, 25 bp, Rattus norvegicus
ccaaagatgaatgctgtgggtgcta

SEQ ID NO: 657467 - DNA, 25 bp, Rattus norvegicus
ctaaagagcaaagcgggttgggcca

SEQ ID NO: 657468 - DNA, 25 bp, Rattus norvegicus
gtttttcggggtgatgaccaaagca

SEQ ID NO: 657469 - DNA, 25 bp, Rattus norvegicus
caggggctgtggattttcacggttt

SEQ ID NO: 657470 - DNA, 25 bp, Rattus norvegicus
cacaacgcccgggtcttcacggtag

SEQ ID NO: 657471 - DNA, 25 bp, Rattus norvegicus
cggcataagcaaggacaaggacaca

SEQ ID NO: 657472 - DNA, 25 bp, Rattus norvegicus
cctgtgtttcgagtaggacggcata

SEQ ID NO: 657473 - DNA, 25 bp, Rattus norvegicus
aaggccctgagtgctccctgtgttt

SEQ ID NO: 657474 - DNA, 25 bp, Rattus norvegicus
cgctgcgcagaaagctatcgttctc

SEQ ID NO: 657475 - DNA, 25 bp, Rattus norvegicus
ggcgactggcacactaaagcgtgga

SEQ ID NO: 657476 - DNA, 25 bp, Rattus norvegicus
tatcgttctcggagctgctggccga

SEQ ID NO: 657477 - DNA, 25 bp, Rattus norvegicus
ttctcagggcctaatctcggtttca

SEQ ID NO: 657478 - DNA, 25 bp, Rattus norvegicus
tgcccgtcttgctgccggtcggctt

SEQ ID NO: 657479 - DNA, 25 bp, Rattus norvegicus
ccggtcggctttgctcctgtaaagc

SEQ ID NO: 657480 - DNA, 25 bp, Rattus norvegicus
gtaaagcgacctttctcagggccta

SEQ ID NO: 657481 - DNA, 25 bp, Rattus norvegicus
agggcctaatctcggtttcagtata

SEQ ID NO: 657482 - DNA, 25 bp, Rattus norvegicus
tttcagtataatggggtgagacctc

SEQ ID NO: 657483 - DNA, 25 bp, Rattus norvegicus
tataatggggtgagacctccctccc

SEQ ID NO: 657484 - DNA, 25 bp, Rattus norvegicus
ccaaatgtcgttgtgttcctttgta

SEQ ID NO: 657485 - DNA, 25 bp, Rattus norvegicus
ttgtgttcctttgtaggcggctcca

SEQ ID NO: 657486 - DNA, 25 bp, Rattus norvegicus
tttgtaggcggctccatccaccgcg

SEQ ID NO: 657487 - DNA, 25 bp, Rattus norvegicus
atccaccgcgcatctggctgtgcgg

SEQ ID NO: 657488 - DNA, 25 bp, Rattus norvegicus
cgctgctgcacggtccacagtatca

SEQ ID NO: 657489 - DNA, 25 bp, Rattus norvegicus
tgcacggtccacagtatcattcctc

SEQ ID NO: 657490 - DNA, 25 bp, Rattus norvegicus
ctttgctcctgtaaagcgacctttc

SEQ ID NO: 657491 - DNA, 25 bp, Rattus norvegicus
agctctgggccggttgtctccagcg

SEQ ID NO: 657492 - DNA, 25 bp, Rattus norvegicus
cacaggcgcttagtagatgtcgctg

SEQ ID NO: 657493 - DNA, 25 bp, Rattus norvegicus
ggcaggcaggccggccaaacaagcc

SEQ ID NO: 657494 - DNA, 25 bp, Rattus norvegicus
tgttgtccgtgcttccgcggccggc

SEQ ID NO: 657495 - DNA, 25 bp, Rattus norvegicus
cgcttagtagatgtcgctgttgtcc

SEQ ID NO: 657496 - DNA, 25 bp, Rattus norvegicus
gctctcacttccctcagtgcgcgtg

SEQ ID NO: 657497 - DNA, 25 bp, Rattus norvegicus
ctatcacaggcgcttagtagatgtc

SEQ ID NO: 657498 - DNA, 25 bp, Rattus norvegicus
cgcgcactatcacaggcgcttagta

SEQ ID NO: 657499 - DNA, 25 bp, Rattus norvegicus
cagcgcgcactatcacaggcgctta

SEQ ID NO: 657500 - DNA, 25 bp, Rattus norvegicus
acaggctggccggcagcagagctct

SEQ ID NO: 657501 - DNA, 25 bp, Rattus norvegicus
tgaagcctttccttccgctggcggg

SEQ ID NO: 657502 - DNA, 25 bp, Rattus norvegicus
tcgaatgaagcctttccttccgctg

SEQ ID NO: 657503 - DNA, 25 bp, Rattus norvegicus
tcagtgcgcgtgtcctcccggaggc

SEQ ID NO: 657504 - DNA, 25 bp, Rattus norvegicus
tagtagatgtcgctgttgtccgtgc

SEQ ID NO: 657505 - DNA, 25 bp, Rattus norvegicus
gtacctctgcctcctggtgtagctc

SEQ ID NO: 657506 - DNA, 25 bp, Rattus norvegicus
gactcccatcgatgccagttcgtcg

SEQ ID NO: 657507 - DNA, 25 bp, Rattus norvegicus
tcttccgcccgcagtgtagcctcgc

SEQ ID NO: 657508 - DNA, 25 bp, Rattus norvegicus
gggctgccagccctagcctcttccg

SEQ ID NO: 657509 - DNA, 25 bp, Rattus norvegicus
ctgcctgtcagtcagccggaggacc

SEQ ID NO: 657510 - DNA, 25 bp, Rattus norvegicus
agttcgtcgcgacccgcgtgcggac

SEQ ID NO: 657511 - DNA, 25 bp, Rattus norvegicus
atcgatgccagttcgtcgcgacccg

SEQ ID NO: 657512 - DNA, 25 bp, Rattus norvegicus
gtggtcagctgtgcccgactcccat

SEQ ID NO: 657513 - DNA, 25 bp, Rattus norvegicus
agtcaccatcgtagcgagcggctgg

SEQ ID NO: 657514 - DNA, 25 bp, Rattus norvegicus
aagccagtcaccatcgtagcgagcg

SEQ ID NO: 657515 - DNA, 25 bp, Rattus norvegicus
gaggctcaagccagtcaccatcgta

SEQ ID NO: 657516 - DNA, 25 bp, Rattus norvegicus
cctcctggtgtagctccgggtgtcc

SEQ ID NO: 657517 - DNA, 25 bp, Rattus norvegicus
ccggtgatgtcctcctctctgccag

SEQ ID NO: 657518 - DNA, 25 bp, Rattus norvegicus
gacgcgcagcaggaggctcaagcca

SEQ ID NO: 657519 - DNA, 25 bp, Rattus norvegicus
aagatgaacgaaaccgcgagcggcc

SEQ ID NO: 657520 - DNA, 25 bp, Rattus norvegicus
cccgaagtgcaggagaaggaaagca

SEQ ID NO: 657521 - DNA, 25 bp, Rattus norvegicus
tgcctggctgaggtctccgtgtcca

SEQ ID NO: 657522 - DNA, 25 bp, Rattus norvegicus
ccaaaggcggccttccagaagagag

SEQ ID NO: 657523 - DNA, 25 bp, Rattus norvegicus
ggagcccactaaagtctcccaagtg

SEQ ID NO: 657524 - DNA, 25 bp, Rattus norvegicus
gagcggccaggagcccactaaagtc

SEQ ID NO: 657525 - DNA, 25 bp, Rattus norvegicus
ctgcagatggaaaagaagatgaacg

SEQ ID NO: 657526 - DNA, 25 bp, Rattus norvegicus
gcccagctgcagatggaaaagaaga

SEQ ID NO: 657527 - DNA, 25 bp, Rattus norvegicus
tcggctgcccagctgcagatggaaa

SEQ ID NO: 657528 - DNA, 25 bp, Rattus norvegicus
gtcggtatgaacagagttgccaccc

SEQ ID NO: 657529 - DNA, 25 bp, Rattus norvegicus
taaaacctcgaaatgggagcgctcg

SEQ ID NO: 657530 - DNA, 25 bp, Rattus norvegicus
gcgtgcagtccggtaaaacctcgaa

SEQ ID NO: 657531 - DNA, 25 bp, Rattus norvegicus
gcggccaagccgcagctctcggctg

SEQ ID NO: 657532 - DNA, 25 bp, Rattus norvegicus
aggaaagcaaaggtcggtatgaaca

SEQ ID NO: 657533 - DNA, 25 bp, Rattus norvegicus
taaatatgatcacgtgggccgcgcg

SEQ ID NO: 657534 - DNA, 25 bp, Rattus norvegicus
ccgctacgtacgctcctggatggag

SEQ ID NO: 657535 - DNA, 25 bp, Rattus norvegicus
tgggcccggcagctctaattgcaac

SEQ ID NO: 657536 - DNA, 25 bp, Rattus norvegicus
gcggactgatttactccgggtattg

SEQ ID NO: 657537 - DNA, 25 bp, Rattus norvegicus
tcgcctaggtgtgacttagaagccc

SEQ ID NO: 657538 - DNA, 25 bp, Rattus norvegicus
tggctgcagcctgcgaactagtcgg

SEQ ID NO: 657539 - DNA, 25 bp, Rattus norvegicus
cggtgcctcaacatgtcgtccagtg

SEQ ID NO: 657540 - DNA, 25 bp, Rattus norvegicus
gtggcaccctcagcaactactacgt

SEQ ID NO: 657541 - DNA, 25 bp, Rattus norvegicus
gtggactcgctcataggccatgagg

SEQ ID NO: 657542 - DNA, 25 bp, Rattus norvegicus
gccgagttcgcctcgtgtagttttg

SEQ ID NO: 657543 - DNA, 25 bp, Rattus norvegicus
aaatcgtccgtgttctccgcctcgt

SEQ ID NO: 657544 - DNA, 25 bp, Rattus norvegicus
actgctcccggctttggataatcgc

SEQ ID NO: 657545 - DNA, 25 bp, Rattus norvegicus
agcggcctgtaccacccgtacgtgt

SEQ ID NO: 657546 - DNA, 25 bp, Rattus norvegicus
acgctcctgttgatgatgatttttt

SEQ ID NO: 657547 - DNA, 25 bp, Rattus norvegicus
cagtgcggctttatgggcccccttt

SEQ ID NO: 657548 - DNA, 25 bp, Rattus norvegicus
cagaggctgggtgcgaaaatgcctc

SEQ ID NO: 657549 - DNA, 25 bp, Rattus norvegicus
ccgcgcggatatctcgcccccatct

SEQ ID NO: 657550 - DNA, 25 bp, Rattus norvegicus
tcccgcccggcgcagaggccgcttc

SEQ ID NO: 657551 - DNA, 25 bp, Rattus norvegicus
ctggcggaggcatcccggggccgac

SEQ ID NO: 657552 - DNA, 25 bp, Rattus norvegicus
cctttaaggctggcggaggcatccc

SEQ ID NO: 657553 - DNA, 25 bp, Rattus norvegicus
tgcgaaaatgcctcgccggcgcgca

SEQ ID NO: 657554 - DNA, 25 bp, Rattus norvegicus
agcccttggcagtgcggctttatgg

SEQ ID NO: 657555 - DNA, 25 bp, Rattus norvegicus
cgagcccttggcagtgcggctttat

SEQ ID NO: 657556 - DNA, 25 bp, Rattus norvegicus
tgccccaaggctaaggttcggccgc

SEQ ID NO: 657557 - DNA, 25 bp, Rattus norvegicus
ggagagatcgtctgctccgcagcct

SEQ ID NO: 657558 - DNA, 25 bp, Rattus norvegicus
aggctgggtgcgaaaatgcctcgcc

SEQ ID NO: 657559 - DNA, 25 bp, Rattus norvegicus
ctgggtgcgaaaatgcctcgccggc

SEQ ID NO: 657560 - DNA, 25 bp, Rattus norvegicus
ccgtctgccccaaggctaaggttcg

SEQ ID NO: 657561 - DNA, 25 bp, Rattus norvegicus
tcccgccgcgactccacggcacctc

SEQ ID NO: 657562 - DNA, 25 bp, Rattus norvegicus
agctccgcaccctccgggtaagagc

SEQ ID NO: 657563 - DNA, 25 bp, Rattus norvegicus
cgggccgaccgaccgcagctccgca

SEQ ID NO: 657564 - DNA, 25 bp, Rattus norvegicus
cccgcagcgccggatggatcccagc

SEQ ID NO: 657565 - DNA, 25 bp, Rattus norvegicus
gagcccaaacctgcggccgacggta

SEQ ID NO: 657566 - DNA, 25 bp, Rattus norvegicus
aacatgagcccaaacctgcggccga

SEQ ID NO: 657567 - DNA, 25 bp, Rattus norvegicus
cttcagcaacatgagcccaaacctg

SEQ ID NO: 657568 - DNA, 25 bp, Rattus norvegicus
ctgcttccacaaggcgacccgggcc

SEQ ID NO: 657569 - DNA, 25 bp, Rattus norvegicus
agagccgaccgcctgcttccacaag

SEQ ID NO: 657570 - DNA, 25 bp, Rattus norvegicus
gcagccgctcacactcctgcggaga

SEQ ID NO: 657571 - DNA, 25 bp, Rattus norvegicus
ctccgggtaagagccgccctactgg

SEQ ID NO: 657572 - DNA, 25 bp, Rattus norvegicus
tcgcgatcagggccgcctccggagt

SEQ ID NO: 657573 - DNA, 25 bp, Rattus norvegicus
ctgcgggatcgcgtggtccgcagcg

SEQ ID NO: 657574 - DNA, 25 bp, Rattus norvegicus
cccgggcgccgagccacccgcagcc

SEQ ID NO: 657575 - DNA, 25 bp, Rattus norvegicus
cgacttcggtgagcaacccttcgga

SEQ ID NO: 657576 - DNA, 25 bp, Rattus norvegicus
agtcactacagtgccccgggagagc

SEQ ID NO: 657577 - DNA, 25 bp, Rattus norvegicus
ggcccgggaagtcactacagtgccc

SEQ ID NO: 657578 - DNA, 25 bp, Rattus norvegicus
gagcggcccgggaagtcactacagt

SEQ ID NO: 657579 - DNA, 25 bp, Rattus norvegicus
ttcggtgagcaacccttcggaggcg

SEQ ID NO: 657580 - DNA, 25 bp, Rattus norvegicus
tacccacggcccgacttcggtgagc

SEQ ID NO: 657581 - DNA, 25 bp, Rattus norvegicus
ggtgcacagggctccgacttccagc

SEQ ID NO: 657582 - DNA, 25 bp, Rattus norvegicus
gactactacggcagcggtgcacagg

SEQ ID NO: 657583 - DNA, 25 bp, Rattus norvegicus
agccgactactacggcagcggtgca

SEQ ID NO: 657584 - DNA, 25 bp, Rattus norvegicus
aggcgagcagggagccgactactac

SEQ ID NO: 657585 - DNA, 25 bp, Rattus norvegicus
ctacctaggcgagcagggagccgac

SEQ ID NO: 657586 - DNA, 25 bp, Rattus norvegicus
tatttgcagggtggctacctaggcg

SEQ ID NO: 657587 - DNA, 25 bp, Rattus norvegicus
aatatttgcagggtggctacctagg

SEQ ID NO: 657588 - DNA, 25 bp, Rattus norvegicus
gtcacggacaggagccgagcggccc

SEQ ID NO: 657589 - DNA, 25 bp, Rattus norvegicus
tctgagaccgggaacttccggcggc

SEQ ID NO: 657590 - DNA, 25 bp, Rattus norvegicus
caaaccgggcgcgaaagagtgctcc

SEQ ID NO: 657591 - DNA, 25 bp, Rattus norvegicus
ccagcgccagccgatggccggaaca

SEQ ID NO: 657592 - DNA, 25 bp, Rattus norvegicus
gatggccggaacacctacccggaca

SEQ ID NO: 657593 - DNA, 25 bp, Rattus norvegicus
tcctcctggcctccctccttgttct

SEQ ID NO: 657594 - DNA, 25 bp, Rattus norvegicus
cctccttgttctcaccggatgctaa

SEQ ID NO: 657595 - DNA, 25 bp, Rattus norvegicus
tccttgttctcaccggatgctaaac

SEQ ID NO: 657596 - DNA, 25 bp, Rattus norvegicus
gcgcgaaagagtgctcctagcctga

SEQ ID NO: 657597 - DNA, 25 bp, Rattus norvegicus
gaaagagtgctcctagcctgagccc

SEQ ID NO: 657598 - DNA, 25 bp, Rattus norvegicus
aggctgtggcgtccagtttccgccc

SEQ ID NO: 657599 - DNA, 25 bp, Rattus norvegicus
gcgtgcgccaaggagcttttcctgc

SEQ ID NO: 657600 - DNA, 25 bp, Rattus norvegicus
cgccaaggagcttttcctgctctga

SEQ ID NO: 657601 - DNA, 25 bp, Rattus norvegicus
agcttttcctgctctgagaccggga

SEQ ID NO: 657602 - DNA, 25 bp, Rattus norvegicus
tcctgctctgagaccgggaacttcc

SEQ ID NO: 657603 - DNA, 25 bp, Rattus norvegicus
aggttctcatagctgcggccacgtc

SEQ ID NO: 657604 - DNA, 25 bp, Rattus norvegicus
ctctgctgagcgaaggtcgttgtct

SEQ ID NO: 657605 - DNA, 25 bp, Rattus norvegicus
ggtcgttgtctgtgatggtaatctc

SEQ ID NO: 657606 - DNA, 25 bp, Rattus norvegicus
cgtgacataccagttgcggcccagg

SEQ ID NO: 657607 - DNA, 25 bp, Rattus norvegicus
tgcggcctttctctgtcagcgacgt

SEQ ID NO: 657608 - DNA, 25 bp, Rattus norvegicus
aacttcgcgtcccaggaggttctca

SEQ ID NO: 657609 - DNA, 25 bp, Rattus norvegicus
gccacgtcctagagggtcttcacga

SEQ ID NO: 657610 - DNA, 25 bp, Rattus norvegicus
tcttcacgacgaggaccaggagcta

SEQ ID NO: 657611 - DNA, 25 bp, Rattus norvegicus
agctaggatgttgtcccaggatcga

SEQ ID NO: 657612 - DNA, 25 bp, Rattus norvegicus
gcggtacctcccaaagtcctctgtg

SEQ ID NO: 657613 - DNA, 25 bp, Rattus norvegicus
gggctcttctggaacataccgggga

SEQ ID NO: 657614 - DNA, 25 bp, Rattus norvegicus
aggcagaccataggctcgagttgtc

SEQ ID NO: 657615 - DNA, 25 bp, Rattus norvegicus
aggtgcgcacttcgccagcatagta

SEQ ID NO: 657616 - DNA, 25 bp, Rattus norvegicus
ttcactacgactggtggacgccttc

SEQ ID NO: 657617 - DNA, 25 bp, Rattus norvegicus
ggcgaaataattaattcagcacgtc

SEQ ID NO: 657618 - DNA, 25 bp, Rattus norvegicus
agggccgctcataacccggagaatt

SEQ ID NO: 657619 - DNA, 25 bp, Rattus norvegicus
ccggagaattttcaaagtgcgagga

SEQ ID NO: 657620 - DNA, 25 bp, Rattus norvegicus
gcgaggaagatgataagaatagatt

SEQ ID NO: 657621 - DNA, 25 bp, Rattus norvegicus
tagatttctacaagtcgcgaccacg

SEQ ID NO: 657622 - DNA, 25 bp, Rattus norvegicus
cgcgaccacgtgattggcgaaataa

SEQ ID NO: 657623 - DNA, 25 bp, Rattus norvegicus
tcccttaagaaacacggagtcgtca

SEQ ID NO: 657624 - DNA, 25 bp, Rattus norvegicus
ggagtcgtcattaatctgccacgca

SEQ ID NO: 657625 - DNA, 25 bp, Rattus norvegicus
aatctgccacgcaaagggctctctc

SEQ ID NO: 657626 - DNA, 25 bp, Rattus norvegicus
gcaaagggctctctccgacttggaa

SEQ ID NO: 657627 - DNA, 25 bp, Rattus norvegicus
ctccgacttggaaagtgcagggatc

SEQ ID NO: 657628 - DNA, 25 bp, Rattus norvegicus
tgcagggatcccgagaacacggccc

SEQ ID NO: 657629 - DNA, 25 bp, Rattus norvegicus
gaccctcggcagacggcgccatgtt

SEQ ID NO: 657630 - DNA, 25 bp, Rattus norvegicus
tcagcacgtcccttaagaaacacgg

SEQ ID NO: 657631 - DNA, 25 bp, Rattus norvegicus
tcctagagtccgagaccaggcgagc

SEQ ID NO: 657632 - DNA, 25 bp, Rattus norvegicus
actttatataatcccgcagctcgca

SEQ ID NO: 657633 - DNA, 25 bp, Rattus norvegicus
ctggcgccagccactttatataatc

SEQ ID NO: 657634 - DNA, 25 bp, Rattus norvegicus
aggctggcgccagccactttatata

SEQ ID NO: 657635 - DNA, 25 bp, Rattus norvegicus
acagctgctactaggccaggctggc

SEQ ID NO: 657636 - DNA, 25 bp, Rattus norvegicus
ctctttccaactcgggctgcggaac

SEQ ID NO: 657637 - DNA, 25 bp, Rattus norvegicus
gatcctctctttccaactcgggctg

SEQ ID NO: 657638 - DNA, 25 bp, Rattus norvegicus
caggtctgtgttcctcggccggccg

SEQ ID NO: 657639 - DNA, 25 bp, Rattus norvegicus
cagctcgcacgcagggtgtgtaaac

SEQ ID NO: 657640 - DNA, 25 bp, Rattus norvegicus
accaggcgagcagcaggtctgtgtt

SEQ ID NO: 657641 - DNA, 25 bp, Rattus norvegicus
tcgagcctcctagagtccgagacca

SEQ ID NO: 657642 - DNA, 25 bp, Rattus norvegicus
tggcatccatcgagcctcctagagt

SEQ ID NO: 657643 - DNA, 25 bp, Rattus norvegicus
gcgagcgaacgcctggcatccatcg

SEQ ID NO: 657644 - DNA, 25 bp, Rattus norvegicus
agcagcaggtctgtgttcctcggcc

SEQ ID NO: 657645 - DNA, 25 bp, Rattus norvegicus
tgacacatctgtagcggttgccgcc

SEQ ID NO: 657646 - DNA, 25 bp, Rattus norvegicus
tgcctgccgcagcagaagcgttacg

SEQ ID NO: 657647 - DNA, 25 bp, Rattus norvegicus
ggcgtacacgagtgctcagctggta

SEQ ID NO: 657648 - DNA, 25 bp, Rattus norvegicus
tggctaacctgctgaacctcaccga

SEQ ID NO: 657649 - DNA, 25 bp, Rattus norvegicus
aaggccaagggcatcctgcattctc

SEQ ID NO: 657650 - DNA, 25 bp, Rattus norvegicus
cctccctgatctggcctggcagatg

SEQ ID NO: 657651 - DNA, 25 bp, Rattus norvegicus
agcccaatatgtacggcctggccgc

SEQ ID NO: 657652 - DNA, 25 bp, Rattus norvegicus
ccacacgagtttcgggcttccagcg

SEQ ID NO: 657653 - DNA, 25 bp, Rattus norvegicus
cagcccggtgtacgtaggtggcaac

SEQ ID NO: 657654 - DNA, 25 bp, Rattus norvegicus
ggtggcaacttcgtcgactccatgg

SEQ ID NO: 657655 - DNA, 25 bp, Rattus norvegicus
gccggtcttcaatctgggtcacctc

SEQ ID NO: 657656 - DNA, 25 bp, Rattus norvegicus
ttcggccagcgtggactacagctgc

SEQ ID NO: 657657 - DNA, 25 bp, Rattus norvegicus
ggcctggcgcaattacctctctggt

SEQ ID NO: 657658 - DNA, 25 bp, Rattus norvegicus
gctttcgctaaatcgcagcccaata

SEQ ID NO: 657659 - DNA, 25 bp, Rattus norvegicus
cagccgtgaacggaatcgtgcacga

SEQ ID NO: 657660 - DNA, 25 bp, Rattus norvegicus
gcgtgcatatactagccctggactc

SEQ ID NO: 657661 - DNA, 25 bp, Rattus norvegicus
cgtcctggcgctagtggtaataatg

SEQ ID NO: 657662 - DNA, 25 bp, Rattus norvegicus
cctactgcgccagcgaattcggtga

SEQ ID NO: 657663 - DNA, 25 bp, Rattus norvegicus
tcctccagttgccataagccgtgtc

SEQ ID NO: 657664 - DNA, 25 bp, Rattus norvegicus
gacggttttttcttccgcgtgcata

SEQ ID NO: 657665 - DNA, 25 bp, Rattus norvegicus
gtctgtacatcactcccgacggttt

SEQ ID NO: 657666 - DNA, 25 bp, Rattus norvegicus
gcctgtacaagatgagccgtctgta

SEQ ID NO: 657667 - DNA, 25 bp, Rattus norvegicus
gaccctgacggcctgtacaagatga

SEQ ID NO: 657668 - DNA, 25 bp, Rattus norvegicus
tgactctactggtggaccctgacgg

SEQ ID NO: 657669 - DNA, 25 bp, Rattus norvegicus
cgggcatgcgcctggtgactctact

SEQ ID NO: 657670 - DNA, 25 bp, Rattus norvegicus
cctgtttttccaaagcagccgtgaa

SEQ ID NO: 657671 - DNA, 25 bp, Rattus norvegicus
tgagcgcgctgcatcctcccaggaa

SEQ ID NO: 657672 - DNA, 25 bp, Rattus norvegicus
tgccataagccgtgtccagaattta

SEQ ID NO: 657673 - DNA, 25 bp, Rattus norvegicus
ccgcggctgttagtcatgtcgggta

SEQ ID NO: 657674 - DNA, 25 bp, Rattus norvegicus
agccgagatctgagcatctgccaga

SEQ ID NO: 657675 - DNA, 25 bp, Rattus norvegicus
ctctcaataatggtacggtcgcgga

SEQ ID NO: 657676 - DNA, 25 bp, Rattus norvegicus
cccaagtggttcaagttctgcagca

SEQ ID NO: 657677 - DNA, 25 bp, Rattus norvegicus
tcagatctctcagcgaggcctccgg

SEQ ID NO: 657678 - DNA, 25 bp, Rattus norvegicus
ggaggcccgtctacgccatcgtaag

SEQ ID NO: 657679 - DNA, 25 bp, Rattus norvegicus
tttgatcctgcccttggaacctggg

SEQ ID NO: 657680 - DNA, 25 bp, Rattus norvegicus
gggtaggtgactccatcagcgagca

SEQ ID NO: 657681 - DNA, 25 bp, Rattus norvegicus
atctgggaggacactaaggctcggc

SEQ ID NO: 657682 - DNA, 25 bp, Rattus norvegicus
ccacgagagcattggtactttcctc

SEQ ID NO: 657683 - DNA, 25 bp, Rattus norvegicus
ggcgcctcctctttcgttcatagct

SEQ ID NO: 657684 - DNA, 25 bp, Rattus norvegicus
cgaccacaccattcccgattttaga

SEQ ID NO: 657685 - DNA, 25 bp, Rattus norvegicus
ttctgcagcaagagcctgagcgagg

SEQ ID NO: 657686 - DNA, 25 bp, Rattus norvegicus
ttttcccatccgagaagtggagctg

SEQ ID NO: 657687 - DNA, 25 bp, Rattus norvegicus
gcgggaacaatagcagccgcctgcc

SEQ ID NO: 657688 - DNA, 25 bp, Rattus norvegicus
caagcggaggagatgctggcactcc

SEQ ID NO: 657689 - DNA, 25 bp, Rattus norvegicus
tgggagccgaccagaaaccgcaagc

SEQ ID NO: 657690 - DNA, 25 bp, Rattus norvegicus
tcctcctactttggagcaagtctgg

SEQ ID NO: 657691 - DNA, 25 bp, Rattus norvegicus
gctcgacagcggttcctcctacttt

SEQ ID NO: 657692 - DNA, 25 bp, Rattus norvegicus
accggtgtgcacttttcgctcgaca

SEQ ID NO: 657693 - DNA, 25 bp, Rattus norvegicus
aggttagtcctattaagagttcatc

SEQ ID NO: 657694 - DNA, 25 bp, Rattus norvegicus
gagttaatcaccctaccggctggcg

SEQ ID NO: 657695 - DNA, 25 bp, Rattus norvegicus
gcgtccacctggaactctccgaaaa

SEQ ID NO: 657696 - DNA, 25 bp, Rattus norvegicus
gctctgaccaggctgcggtcactcg

SEQ ID NO: 657697 - DNA, 25 bp, Rattus norvegicus
cagcgacgacgataggctccaggca

SEQ ID NO: 657698 - DNA, 25 bp, Rattus norvegicus
gctctcggcacaaagcccgcttggt

SEQ ID NO: 657699 - DNA, 25 bp, Rattus norvegicus
cgcggctacaagactcgcgctctga

SEQ ID NO: 657700 - DNA, 25 bp, Rattus norvegicus
agagttcatcaatcaccggtgtgca

SEQ ID NO: 657701 - DNA, 25 bp, Rattus norvegicus
ctctgccgccgagtatggtttcttg

SEQ ID NO: 657702 - DNA, 25 bp, Rattus norvegicus
ccgcttgtctcaaggaacccgcaga

SEQ ID NO: 657703 - DNA, 25 bp, Rattus norvegicus
cggacgctttggctaagttggcagc

SEQ ID NO: 657704 - DNA, 25 bp, Rattus norvegicus
tggaaccgcactccagtcgggaccg

SEQ ID NO: 657705 - DNA, 25 bp, Rattus norvegicus
gccgccggtatatgaggccactatt

SEQ ID NO: 657706 - DNA, 25 bp, Rattus norvegicus
ggccactatttacctcgggctcgct

SEQ ID NO: 657707 - DNA, 25 bp, Rattus norvegicus
tctcgcggatcgagccatgagctcc

SEQ ID NO: 657708 - DNA, 25 bp, Rattus norvegicus
ctcctacctggagtacgtatcgtgc

SEQ ID NO: 657709 - DNA, 25 bp, Rattus norvegicus
tgctgggcttcgcacccaagttctg

SEQ ID NO: 657710 - DNA, 25 bp, Rattus norvegicus
ctgtaccctggaaggcgcctacgaa

SEQ ID NO: 657711 - DNA, 25 bp, Rattus norvegicus
actatgccacctcggcggtcttttc

SEQ ID NO: 657712 - DNA, 25 bp, Rattus norvegicus
cggtcttttccagcggaggatcatt

SEQ ID NO: 657713 - DNA, 25 bp, Rattus norvegicus
ggacttcgctgcctttgccgagcct

SEQ ID NO: 657714 - DNA, 25 bp, Rattus norvegicus
gaggatcattcctgctcagcggcca

SEQ ID NO: 657715 - DNA, 25 bp, Rattus norvegicus
ccgctactgctgaggtgagctcggc

SEQ ID NO: 657716 - DNA, 25 bp, Rattus norvegicus
ggaagcgttcgtctcccagatcgca

SEQ ID NO: 657717 - DNA, 25 bp, Rattus norvegicus
agccgacatgtctctggtggcggaa

SEQ ID NO: 657718 - DNA, 25 bp, Rattus norvegicus
gcagggcctcgcagccgacatgtct

SEQ ID NO: 657719 - DNA, 25 bp, Rattus norvegicus
aagctcgttacctgcggcgggccgc

SEQ ID NO: 657720 - DNA, 25 bp, Rattus norvegicus
ccagcgaagctcgttacctgcggcg

SEQ ID NO: 657721 - DNA, 25 bp, Rattus norvegicus
ctcggcgagtctgagcgttggccca

SEQ ID NO: 657722 - DNA, 25 bp, Rattus norvegicus
cgctgtcagcgacgccggaagtcct

SEQ ID NO: 657723 - DNA, 25 bp, Rattus norvegicus
aaccttgtgggcctggccgctactg

SEQ ID NO: 657724 - DNA, 25 bp, Rattus norvegicus
caggtaacccgtgtgggcgcagact

SEQ ID NO: 657725 - DNA, 25 bp, Rattus norvegicus
cctctgtcggcctggcggtaacctt

SEQ ID NO: 657726 - DNA, 25 bp, Rattus norvegicus
acgccggaagtcctctgtcggcctg

SEQ ID NO: 657727 - DNA, 25 bp, Rattus norvegicus
tctcccagatcgcaggtaacccgtg

SEQ ID NO: 657728 - DNA, 25 bp, Rattus norvegicus
gttggcccagcgaagctcgttacct

SEQ ID NO: 657729 - DNA, 25 bp, Rattus norvegicus
gggagaccttcgcactgtaaatatg

SEQ ID NO: 657730 - DNA, 25 bp, Rattus norvegicus
ccgaggcttagcatcacagtggaca

SEQ ID NO: 657731 - DNA, 25 bp, Rattus norvegicus
atgggctctgaggagactctctcca

SEQ ID NO: 657732 - DNA, 25 bp, Rattus norvegicus
ggagattcccggtctcacagcgcgc

SEQ ID NO: 657733 - DNA, 25 bp, Rattus norvegicus
ccacatccaggctcttgatccgaaa

SEQ ID NO: 657734 - DNA, 25 bp, Rattus norvegicus
ccgcggcaaagctcgacctacagtt

SEQ ID NO: 657735 - DNA, 25 bp, Rattus norvegicus
cctcgtggcatcttcggccttgctt

SEQ ID NO: 657736 - DNA, 25 bp, Rattus norvegicus
ctgagatgagctggacatcggcctc

SEQ ID NO: 657737 - DNA, 25 bp, Rattus norvegicus
ttctggagctgacgatgcacttgtc

SEQ ID NO: 657738 - DNA, 25 bp, Rattus norvegicus
ggtcactctgatctcccgggacagg

SEQ ID NO: 657739 - DNA, 25 bp, Rattus norvegicus
tgattggcccaaaacgacgacaggg

SEQ ID NO: 657740 - DNA, 25 bp, Rattus norvegicus
gtccatacctgtcccgggtggaatg

SEQ ID NO: 657741 - DNA, 25 bp, Rattus norvegicus
agactctctccatgagcctggccgg

SEQ ID NO: 657742 - DNA, 25 bp, Rattus norvegicus
cttccgatttggagaaaatgtcaca

SEQ ID NO: 657743 - DNA, 25 bp, Rattus norvegicus
cagcacaggcaatttggagaaaggc

SEQ ID NO: 657744 - DNA, 25 bp, Rattus norvegicus
gttgccctggctatccgtcactcgt

SEQ ID NO: 657745 - DNA, 25 bp, Rattus norvegicus
aggtgcacgcgtgcaggtaacccag

SEQ ID NO: 657746 - DNA, 25 bp, Rattus norvegicus
tcctaagcagaggtgcacgcgtgca

SEQ ID NO: 657747 - DNA, 25 bp, Rattus norvegicus
ccgggttgctcctaagcagaggtgc

SEQ ID NO: 657748 - DNA, 25 bp, Rattus norvegicus
cgtagaaccgggttgctcctaagca

SEQ ID NO: 657749 - DNA, 25 bp, Rattus norvegicus
ctcggataacccagcacaggcaatt

SEQ ID NO: 657750 - DNA, 25 bp, Rattus norvegicus
tttcagccagctcggataacccagc

SEQ ID NO: 657751 - DNA, 25 bp, Rattus norvegicus
ccgcggctttcagccagctcggata

SEQ ID NO: 657752 - DNA, 25 bp, Rattus norvegicus
ctatccgtcactcgtcctctcaaga

SEQ ID NO: 657753 - DNA, 25 bp, Rattus norvegicus
gcggggtctgtaactgcgttgccct

SEQ ID NO: 657754 - DNA, 25 bp, Rattus norvegicus
acactgcagggaaaaggcctcgctc

SEQ ID NO: 657755 - DNA, 25 bp, Rattus norvegicus
gctgcgctgagctacactgcaggga

SEQ ID NO: 657756 - DNA, 25 bp, Rattus norvegicus
agggaaaaggcctcgctctcccgcg

SEQ ID NO: 657757 - DNA, 25 bp, Rattus norvegicus
gcggcggccacattgacattgatct

SEQ ID NO: 657758 - DNA, 25 bp, Rattus norvegicus
ggaaaggcctttctctaagctgacg

SEQ ID NO: 657759 - DNA, 25 bp, Rattus norvegicus
gaggcgagtccggtctcaaaatgga

SEQ ID NO: 657760 - DNA, 25 bp, Rattus norvegicus
ccgggcagaaaatgccgcagatggc

SEQ ID NO: 657761 - DNA, 25 bp, Rattus norvegicus
tggctacgccgccaagaaggagtgc

SEQ ID NO: 657762 - DNA, 25 bp, Rattus norvegicus
ccgcgttacgaaatggcgcattggc

SEQ ID NO: 657763 - DNA, 25 bp, Rattus norvegicus
ttgacattgatctgccgccgcgtta

SEQ ID NO: 657764 - DNA, 25 bp, Rattus norvegicus
atcgtcccgcgctttgctctgaggg

SEQ ID NO: 657765 - DNA, 25 bp, Rattus norvegicus
gcgcggatagaacatcacgtggtta

SEQ ID NO: 657766 - DNA, 25 bp, Rattus norvegicus
agctgcagctgacgtaagcgtagct

SEQ ID NO: 657767 - DNA, 25 bp, Rattus norvegicus
cactcgctattggtcaagctgcagc

SEQ ID NO: 657768 - DNA, 25 bp, Rattus norvegicus
ttctcccgacgtgggcactcgctat

SEQ ID NO: 657769 - DNA, 25 bp, Rattus norvegicus
tctctaagctgacgcgcggtcacgc

SEQ ID NO: 657770 - DNA, 25 bp, Rattus norvegicus
tcggtcccatattgaactcgagttg

SEQ ID NO: 657771 - DNA, 25 bp, Rattus norvegicus
cgtcgtagtcctggctcatacagtc

SEQ ID NO: 657772 - DNA, 25 bp, Rattus norvegicus
cggacaagcgtgatcctacagacga

SEQ ID NO: 657773 - DNA, 25 bp, Rattus norvegicus
acgatcagctctccggctgaggcta

SEQ ID NO: 657774 - DNA, 25 bp, Rattus norvegicus
caccgcgtcgtaggatgagagttag

SEQ ID NO: 657775 - DNA, 25 bp, Rattus norvegicus
gccgacgccgaggagaaacctcagc

SEQ ID NO: 657776 - DNA, 25 bp, Rattus norvegicus
ggcacatttttaccggcaccgaatc

SEQ ID NO: 657777 - DNA, 25 bp, Rattus norvegicus
accgaatctgggaaactacgctgcc

SEQ ID NO: 657778 - DNA, 25 bp, Rattus norvegicus
ggcgccggtttagaccgccagcatc

SEQ ID NO: 657779 - DNA, 25 bp, Rattus norvegicus
attcttggcatagctgaggggcccg

SEQ ID NO: 657780 - DNA, 25 bp, Rattus norvegicus
agttcccaggccttgccgtcgtagt

SEQ ID NO: 657781 - DNA, 25 bp, Rattus norvegicus
atggggccgactcgaacctcgaagc

SEQ ID NO: 657782 - DNA, 25 bp, Rattus norvegicus
cccgcgagtcacgatactcagaaca

SEQ ID NO: 657783 - DNA, 25 bp, Rattus norvegicus
ccgcgaagccggagcttccttcata

SEQ ID NO: 657784 - DNA, 25 bp, Rattus norvegicus
agggctgggcttttctagatcaaga

SEQ ID NO: 657785 - DNA, 25 bp, Rattus norvegicus
cccagaccctcgtatgctgaatgga

SEQ ID NO: 657786 - DNA, 25 bp, Rattus norvegicus
cgcgcgcaccctcgggttatgtaat

SEQ ID NO: 657787 - DNA, 25 bp, Rattus norvegicus
acatgttcctgctggacgtgcgagc

SEQ ID NO: 657788 - DNA, 25 bp, Rattus norvegicus
accagcttcttcaacgcggagaaca

SEQ ID NO: 657789 - DNA, 25 bp, Rattus norvegicus
gcgacccgcactcactgttgtattg

SEQ ID NO: 657790 - DNA, 25 bp, Rattus norvegicus
ctactcagaactcagggacggggtc

SEQ ID NO: 657791 - DNA, 25 bp, Rattus norvegicus
tatgtaatggtctctctccgcaggg

SEQ ID NO: 657792 - DNA, 25 bp, Rattus norvegicus
ggctctcaaggaacgaccactactc

SEQ ID NO: 657793 - DNA, 25 bp, Rattus norvegicus
gtctcctgtcaggtgatggctctca

SEQ ID NO: 657794 - DNA, 25 bp, Rattus norvegicus
tgtagatgcacagctcttctctgga

SEQ ID NO: 657795 - DNA, 25 bp, Rattus norvegicus
ccgcatgcgtagagagcgagcacta

SEQ ID NO: 657796 - DNA, 25 bp, Rattus norvegicus
gggacacgtagacgccgcatgcgta

SEQ ID NO: 657797 - DNA, 25 bp, Rattus norvegicus
ctcagcttctatggctccgctcagg

SEQ ID NO: 657798 - DNA, 25 bp, Rattus norvegicus
agtgcctggttcatggactgcagcc

SEQ ID NO: 657799 - DNA, 25 bp, Rattus norvegicus
agaatcttgcccgctttatctcgcc

SEQ ID NO: 657800 - DNA, 25 bp, Rattus norvegicus
gatttggacccgcagaatcttgccc

SEQ ID NO: 657801 - DNA, 25 bp, Rattus norvegicus
gctgcgccttcctgatttggacccg

SEQ ID NO: 657802 - DNA, 25 bp, Rattus norvegicus
cgccttcctgatttggacccgcaga

SEQ ID NO: 657803 - DNA, 25 bp, Rattus norvegicus
cttcctgatttggacccgcagaatc

SEQ ID NO: 657804 - DNA, 25 bp, Rattus norvegicus
tcctgatttggacccgcagaatctt

SEQ ID NO: 657805 - DNA, 25 bp, Rattus norvegicus
tttggacccgcagaatcttgcccgc

SEQ ID NO: 657806 - DNA, 25 bp, Rattus norvegicus
tggacccgcagaatcttgcccgctt

SEQ ID NO: 657807 - DNA, 25 bp, Rattus norvegicus
ccgcagaatcttgcccgctttatct

SEQ ID NO: 657808 - DNA, 25 bp, Rattus norvegicus
accggctgactgtggcgccagtccg

SEQ ID NO: 657809 - DNA, 25 bp, Rattus norvegicus
gggcccctgcgctgctatcggagct

SEQ ID NO: 657810 - DNA, 25 bp, Rattus norvegicus
gctatcggagctgcgccttcctgat

SEQ ID NO: 657811 - DNA, 25 bp, Rattus norvegicus
ggagctgcgccttcctgatttggac

SEQ ID NO: 657812 - DNA, 25 bp, Rattus norvegicus
gacccgcagaatcttgcccgcttta

SEQ ID NO: 657813 - DNA, 25 bp, Rattus norvegicus
ggctctttgaagcagtttaaacagt

SEQ ID NO: 657814 - DNA, 25 bp, Rattus norvegicus
ttgaagcagtttaaacagttggagc

SEQ ID NO: 657815 - DNA, 25 bp, Rattus norvegicus
cactgttggccctcctctcgtggtt

SEQ ID NO: 657816 - DNA, 25 bp, Rattus norvegicus
tcgctctggccctggctctttgaag

SEQ ID NO: 657817 - DNA, 25 bp, Rattus norvegicus
ctgtttgccgaaggtcgctctggcc

SEQ ID NO: 657818 - DNA, 25 bp, Rattus norvegicus
ttagcagctgtttgccgaaggtcgc

SEQ ID NO: 657819 - DNA, 25 bp, Rattus norvegicus
ctagagattagcagctgtttgccga

SEQ ID NO: 657820 - DNA, 25 bp, Rattus norvegicus
cccttgctagagattagcagctgtt

SEQ ID NO: 657821 - DNA, 25 bp, Rattus norvegicus
tcgggaacagcacccccttgctaga

SEQ ID NO: 657822 - DNA, 25 bp, Rattus norvegicus
tggctccctagtcctctcgggaaca

SEQ ID NO: 657823 - DNA, 25 bp, Rattus norvegicus
agcaggaggccttggctccctagtc

SEQ ID NO: 657824 - DNA, 25 bp, Rattus norvegicus
ccctcctctcgtggttcggggcatg

SEQ ID NO: 657825 - DNA, 25 bp, Rattus norvegicus
acagttggagcaaacacaccgggag

SEQ ID NO: 657826 - DNA, 25 bp, Rattus norvegicus
cgcgttctcctggaccgcactgttg

SEQ ID NO: 657827 - DNA, 25 bp, Rattus norvegicus
gacccagacgcggtccgcgcgcgtc

SEQ ID NO: 657828 - DNA, 25 bp, Rattus norvegicus
tccaagtaccaatgagtgcaaagcg

SEQ ID NO: 657829 - DNA, 25 bp, Rattus norvegicus
caatgagtgcaaagcgcggagagcc

SEQ ID NO: 657830 - DNA, 25 bp, Rattus norvegicus
cggagtcgggcaccatccccaagaa

SEQ ID NO: 657831 - DNA, 25 bp, Rattus norvegicus
cccaagaagcggtgagtagcggccc

SEQ ID NO: 657832 - DNA, 25 bp, Rattus norvegicus
ggcggaaggcattccggtccctgcg

SEQ ID NO: 657833 - DNA, 25 bp, Rattus norvegicus
gttgaagctccaggcgcaaggcccc

SEQ ID NO: 657834 - DNA, 25 bp, Rattus norvegicus
ctgcgggttctgtcgggccatctgc

SEQ ID NO: 657835 - DNA, 25 bp, Rattus norvegicus
agtgacctttcacccgcgcccagcg

SEQ ID NO: 657836 - DNA, 25 bp, Rattus norvegicus
ggcgccgctctgagtgacctttcac

SEQ ID NO: 657837 - DNA, 25 bp, Rattus norvegicus
actgccgggatgcgctgcagcgaat

SEQ ID NO: 657838 - DNA, 25 bp, Rattus norvegicus
cctgccgccagtcgccgcggtgact

SEQ ID NO: 657839 - DNA, 25 bp, Rattus norvegicus
ttctgtcgggccatctgctgggccg

SEQ ID NO: 657840 - DNA, 25 bp, Rattus norvegicus
ggaggctccaagtaccaatgagtgc

SEQ ID NO: 657841 - DNA, 25 bp, Rattus norvegicus
gacagcactgtgtcccgcatggaga

SEQ ID NO: 657842 - DNA, 25 bp, Rattus norvegicus
ccgcgtcccggatgacttagttcca

SEQ ID NO: 657843 - DNA, 25 bp, Rattus norvegicus
caccctgccgggacaacggctggtt

SEQ ID NO: 657844 - DNA, 25 bp, Rattus norvegicus
ctccgagaactactgtgagggcggc

SEQ ID NO: 657845 - DNA, 25 bp, Rattus norvegicus
gcatggagatccacctgctcttcga

SEQ ID NO: 657846 - DNA, 25 bp, Rattus norvegicus
cgctgcagccggatgacagcactgt

SEQ ID NO: 657847 - DNA, 25 bp, Rattus norvegicus
tccctggagcagaacaatgggttcc

SEQ ID NO: 657848 - DNA, 25 bp, Rattus norvegicus
ctctcttccttgtgagcagccgcga

SEQ ID NO: 657849 - DNA, 25 bp, Rattus norvegicus
ctattcacgtaggaaaaatggcggc

SEQ ID NO: 657850 - DNA, 25 bp, Rattus norvegicus
ccggaagtatttcccaagctattca

SEQ ID NO: 657851 - DNA, 25 bp, Rattus norvegicus
tttccggaactagagcacgcgaggc

SEQ ID NO: 657852 - DNA, 25 bp, Rattus norvegicus
tgtagcgcaaataaaggctttccgg

SEQ ID NO: 657853 - DNA, 25 bp, Rattus norvegicus
ccgcctgcaacctgtagcgcaaata

SEQ ID NO: 657854 - DNA, 25 bp, Rattus norvegicus
tcgaccagctcatctccgagaacta

SEQ ID NO: 657855 - DNA, 25 bp, Rattus norvegicus
tagcactccgcagcgagctcgaact

SEQ ID NO: 657856 - DNA, 25 bp, Rattus norvegicus
caccaccgctgtgaactcaccgtcg

SEQ ID NO: 657857 - DNA, 25 bp, Rattus norvegicus
ctcgagttccggatgcatctggctc

SEQ ID NO: 657858 - DNA, 25 bp, Rattus norvegicus
ttccggatgcatctggctcagttgc

SEQ ID NO: 657859 - DNA, 25 bp, Rattus norvegicus
gatgcatctggctcagttgctcata

SEQ ID NO: 657860 - DNA, 25 bp, Rattus norvegicus
tctggctcagttgctcatagcactc

SEQ ID NO: 657861 - DNA, 25 bp, Rattus norvegicus
gtactgctcgagttccggatgcatc

SEQ ID NO: 657862 - DNA, 25 bp, Rattus norvegicus
gttgctcatagcactccgcagcgag

SEQ ID NO: 657863 - DNA, 25 bp, Rattus norvegicus
gcagtaggccagcagcgacagccct

SEQ ID NO: 657864 - DNA, 25 bp, Rattus norvegicus
agtaggccagcagcgacagccctgc

SEQ ID NO: 657865 - DNA, 25 bp, Rattus norvegicus
agtcgcggatgagcctgtacaccac

SEQ ID NO: 657866 - DNA, 25 bp, Rattus norvegicus
gatgagcctgtacaccaccgctgtg

SEQ ID NO: 657867 - DNA, 25 bp, Rattus norvegicus
agcctgtacaccaccgctgtgaact

SEQ ID NO: 657868 - DNA, 25 bp, Rattus norvegicus
gctcagttgctcatagcactccgca

SEQ ID NO: 657869 - DNA, 25 bp, Rattus norvegicus
acggaagttcatccaaggggcggcg

SEQ ID NO: 657870 - DNA, 25 bp, Rattus norvegicus
tcaccgtcgggaactttcgagctgc

SEQ ID NO: 657871 - DNA, 25 bp, Rattus norvegicus
ccgtcgggaactttcgagctgcttt

SEQ ID NO: 657872 - DNA, 25 bp, Rattus norvegicus
tcgggaactttcgagctgctttgcc

SEQ ID NO: 657873 - DNA, 25 bp, Rattus norvegicus
ggaactttcgagctgctttgccacg

SEQ ID NO: 657874 - DNA, 25 bp, Rattus norvegicus
tttcgagctgctttgccacgccata

SEQ ID NO: 657875 - DNA, 25 bp, Rattus norvegicus
gagctgctttgccacgccatagccg

SEQ ID NO: 657876 - DNA, 25 bp, Rattus norvegicus
tgccacgccatagccgccaaaattg

SEQ ID NO: 657877 - DNA, 25 bp, Rattus norvegicus
cgccatagccgccaaaattgtggcg

SEQ ID NO: 657878 - DNA, 25 bp, Rattus norvegicus
ccgccaaaattgtggcgcgtgctag

SEQ ID NO: 657879 - DNA, 25 bp, Rattus norvegicus
aaattgtggcgcgtgctagtttcca

SEQ ID NO: 657880 - DNA, 25 bp, Rattus norvegicus
tggcgcgtgctagtttccaaggcaa

SEQ ID NO: 657881 - DNA, 25 bp, Rattus norvegicus
gctagtttccaaggcaactaagtaa

SEQ ID NO: 657882 - DNA, 25 bp, Rattus norvegicus
cgcgtgctagtttccaaggcaacta

SEQ ID NO: 657883 - DNA, 25 bp, Rattus norvegicus
acctcactggggacgcacctgactt

SEQ ID NO: 657884 - DNA, 25 bp, Rattus norvegicus
acatctgggtagtgcgcgacaagca

SEQ ID NO: 657885 - DNA, 25 bp, Rattus norvegicus
ctgcgcaaccggtaggaaatgagtt

SEQ ID NO: 657886 - DNA, 25 bp, Rattus norvegicus
gaactctgcacgcaccgtgagtacg

SEQ ID NO: 657887 - DNA, 25 bp, Rattus norvegicus
ggacagtgccttggtcccaacgaca

SEQ ID NO: 657888 - DNA, 25 bp, Rattus norvegicus
gtcaagttcgcacgcagctcacagg

SEQ ID NO: 657889 - DNA, 25 bp, Rattus norvegicus
caagggcatcgccttcgtcaagttc

SEQ ID NO: 657890 - DNA, 25 bp, Rattus norvegicus
tgcacagcttgggatgtctgagata

SEQ ID NO: 657891 - DNA, 25 bp, Rattus norvegicus
tgcgcgacaagcacactaaggagtc

SEQ ID NO: 657892 - DNA, 25 bp, Rattus norvegicus
ccttcggagacatccaggacatctg

SEQ ID NO: 657893 - DNA, 25 bp, Rattus norvegicus
gggagcacttctcgcccttcggaga

SEQ ID NO: 657894 - DNA, 25 bp, Rattus norvegicus
tcagcaagtacacatcggaatcggt

SEQ ID NO: 657895 - DNA, 25 bp, Rattus norvegicus
gccgcatcttcctagtgatcagcaa

SEQ ID NO: 657896 - DNA, 25 bp, Rattus norvegicus
gacagtctggatgagccgcccaaca

SEQ ID NO: 657897 - DNA, 25 bp, Rattus norvegicus
ctcgccctgcaggtaagtgtctctc

SEQ ID NO: 657898 - DNA, 25 bp, Rattus norvegicus
tcctgatacacgcattactctctgc

SEQ ID NO: 657899 - DNA, 25 bp, Rattus norvegicus
aagcgcccgcgcctgcgagagctga

SEQ ID NO: 657900 - DNA, 25 bp, Rattus norvegicus
ctgatgtaattgtcggcggagaacc

SEQ ID NO: 657901 - DNA, 25 bp, Rattus norvegicus
gagctgacgcctacgctgcaccttt

SEQ ID NO: 657902 - DNA, 25 bp, Rattus norvegicus
caaggcatcgccgtctccggaggct

SEQ ID NO: 657903 - DNA, 25 bp, Rattus norvegicus
cgtgcactgcggactgtcctcgcga

SEQ ID NO: 657904 - DNA, 25 bp, Rattus norvegicus
gctgtccgcgctggagaccacagca

SEQ ID NO: 657905 - DNA, 25 bp, Rattus norvegicus
aacgatctggactggcgggtgttcc

SEQ ID NO: 657906 - DNA, 25 bp, Rattus norvegicus
tgtcctcgcgagcactcctggctaa

SEQ ID NO: 657907 - DNA, 25 bp, Rattus norvegicus
cggggaatccggcttcctgatacac

SEQ ID NO: 657908 - DNA, 25 bp, Rattus norvegicus
atcggatttggttgtgcgcgtgcac

SEQ ID NO: 657909 - DNA, 25 bp, Rattus norvegicus
gctgcacctttcagggaatccggga

SEQ ID NO: 657910 - DNA, 25 bp, Rattus norvegicus
gccgggcaagttgtgcatcggattt

SEQ ID NO: 657911 - DNA, 25 bp, Rattus norvegicus
catgcgggtcctggctcttccaaac

SEQ ID NO: 657912 - DNA, 25 bp, Rattus norvegicus
gcttgaacgctgcaggctcgatcaa

SEQ ID NO: 657913 - DNA, 25 bp, Rattus norvegicus
gccctaattgggctaccagagcttc

SEQ ID NO: 657914 - DNA, 25 bp, Rattus norvegicus
tccagctatggcctgcgccctaatt

SEQ ID NO: 657915 - DNA, 25 bp, Rattus norvegicus
gccaagtctgtcttttccagctatg

SEQ ID NO: 657916 - DNA, 25 bp, Rattus norvegicus
actttgccacagttctcggcccttt

SEQ ID NO: 657917 - DNA, 25 bp, Rattus norvegicus
tgcctgcttccctcctgcaaaagga

SEQ ID NO: 657918 - DNA, 25 bp, Rattus norvegicus
ccacgtcggccagttcccgagagga

SEQ ID NO: 657919 - DNA, 25 bp, Rattus norvegicus
gcagtgagaatctgggtcctccctc

SEQ ID NO: 657920 - DNA, 25 bp, Rattus norvegicus
acagcaatccggagcagtgagaatc

SEQ ID NO: 657921 - DNA, 25 bp, Rattus norvegicus
ggagagagctttacccagaatgctg

SEQ ID NO: 657922 - DNA, 25 bp, Rattus norvegicus
cctcccgatcggatagtagcctacg

SEQ ID NO: 657923 - DNA, 25 bp, Rattus norvegicus
ctgcgaggcacccttgttcaattcc

SEQ ID NO: 657924 - DNA, 25 bp, Rattus norvegicus
tcgatcaagtctacacccgggtctg

SEQ ID NO: 657925 - DNA, 25 bp, Rattus norvegicus
gacactctcagttccacgctcgatt

SEQ ID NO: 657926 - DNA, 25 bp, Rattus norvegicus
gcccgttccgggaggcttcgacagc

SEQ ID NO: 657927 - DNA, 25 bp, Rattus norvegicus
cagcctcgggcacgcggccgtcccg

SEQ ID NO: 657928 - DNA, 25 bp, Rattus norvegicus
tcatccaggaagtgaaagcgacgtc

SEQ ID NO: 657929 - DNA, 25 bp, Rattus norvegicus
atccaggaagtgaaagcgacgtcgg

SEQ ID NO: 657930 - DNA, 25 bp, Rattus norvegicus
tgaaagcgacgtcggggtcaatgaa

SEQ ID NO: 657931 - DNA, 25 bp, Rattus norvegicus
cgccgttcccgctggggatgtccgc

SEQ ID NO: 657932 - DNA, 25 bp, Rattus norvegicus
cggcgccgggctctgaagcatggag

SEQ ID NO: 657933 - DNA, 25 bp, Rattus norvegicus
caagtggaccaactatctcacaagt

SEQ ID NO: 657934 - DNA, 25 bp, Rattus norvegicus
ggaccaactatctcacaagtaccgg

SEQ ID NO: 657935 - DNA, 25 bp, Rattus norvegicus
actatctcacaagtaccgggcgggc

SEQ ID NO: 657936 - DNA, 25 bp, Rattus norvegicus
atctcacaagtaccgggcgggcggc

SEQ ID NO: 657937 - DNA, 25 bp, Rattus norvegicus
tgtcaagccgcgacactctcagttc

SEQ ID NO: 657938 - DNA, 25 bp, Rattus norvegicus
agcgagttcgaggccgcgcaccatc

SEQ ID NO: 657939 - DNA, 25 bp, Rattus norvegicus
tcgtcatgtaatggcagcggccgtc

SEQ ID NO: 657940 - DNA, 25 bp, Rattus norvegicus
cagtcagctctgtcggtcctttgta

SEQ ID NO: 657941 - DNA, 25 bp, Rattus norvegicus
ctttgtaccaggtgacgatggcatc

SEQ ID NO: 657942 - DNA, 25 bp, Rattus norvegicus
cgtcaaaggacacttcacactcaaa

SEQ ID NO: 657943 - DNA, 25 bp, Rattus norvegicus
tcaaaagtggccgactgatgctcgc

SEQ ID NO: 657944 - DNA, 25 bp, Rattus norvegicus
gatgctcgctcaccacgatgttctg

SEQ ID NO: 657945 - DNA, 25 bp, Rattus norvegicus
tttgtaaactgaatcggctcggctg

SEQ ID NO: 657946 - DNA, 25 bp, Rattus norvegicus
cggccgtcgttcctgaagttgtact

SEQ ID NO: 657947 - DNA, 25 bp, Rattus norvegicus
accttcgtcatctggggtcacattg

SEQ ID NO: 657948 - DNA, 25 bp, Rattus norvegicus
aagttgtacttctggctctcagtca

SEQ ID NO: 657949 - DNA, 25 bp, Rattus norvegicus
tgtccgtgcagttaccttcgtcatc

SEQ ID NO: 657950 - DNA, 25 bp, Rattus norvegicus
cccggcaaactgtccgtgcagttac

SEQ ID NO: 657951 - DNA, 25 bp, Rattus norvegicus
gggtcacattgtggatcgtcatgta

SEQ ID NO: 657952 - DNA, 25 bp, Rattus norvegicus
cgatgttctgtatgcgctttgtaaa

SEQ ID NO: 657953 - DNA, 25 bp, Rattus norvegicus
gcagcttctcccgagctacctgggt

SEQ ID NO: 657954 - DNA, 25 bp, Rattus norvegicus
cgtctccgaaccaggtggatcagta

SEQ ID NO: 657955 - DNA, 25 bp, Rattus norvegicus
atcagtacgttgtgtgtattaacgc

SEQ ID NO: 657956 - DNA, 25 bp, Rattus norvegicus
gacgtacttgcgcagcttctcccga

SEQ ID NO: 657957 - DNA, 25 bp, Rattus norvegicus
ccacagggatgcaagagatgggaac

SEQ ID NO: 657958 - DNA, 25 bp, Rattus norvegicus
gggaacgcgctttgccttccgccag

SEQ ID NO: 657959 - DNA, 25 bp, Rattus norvegicus
tccgccagcttcgtaacctttactg

SEQ ID NO: 657960 - DNA, 25 bp, Rattus norvegicus
ctgcctcgttacctccatagtactg

SEQ ID NO: 657961 - DNA, 25 bp, Rattus norvegicus
ctccatagtactgcggcagtgtgcc

SEQ ID NO: 657962 - DNA, 25 bp, Rattus norvegicus
agtgtgccagcctcatggacgtatc

SEQ ID NO: 657963 - DNA, 25 bp, Rattus norvegicus
tggacgtatccttcccgcaggcctt

SEQ ID NO: 657964 - DNA, 25 bp, Rattus norvegicus
ggccttggaggtggtccattgatca

SEQ ID NO: 657965 - DNA, 25 bp, Rattus norvegicus
ccattgatcatgctgtggagcggcg

SEQ ID NO: 657966 - DNA, 25 bp, Rattus norvegicus
ttaacgcggtcgaagacgtacttgc

SEQ ID NO: 657967 - DNA, 25 bp, Rattus norvegicus
aggctgacactcaaacctgttgctg

SEQ ID NO: 657968 - DNA, 25 bp, Rattus norvegicus
cacctcgggcgctttgtctgcggcg

SEQ ID NO: 657969 - DNA, 25 bp, Rattus norvegicus
agctcgggcccagaagcccgcgtcc

SEQ ID NO: 657970 - DNA, 25 bp, Rattus norvegicus
ctcctgagattgacgtctcctggtc

SEQ ID NO: 657971 - DNA, 25 bp, Rattus norvegicus
ggccgccctcacacccgcgccacgc

SEQ ID NO: 657972 - DNA, 25 bp, Rattus norvegicus
aggaggggaccccatgaatccaggc

SEQ ID NO: 657973 - DNA, 25 bp, Rattus norvegicus
gggctcgcacctcgggcgctttgtc

SEQ ID NO: 657974 - DNA, 25 bp, Rattus norvegicus
tgacactcaaacctgttgctggatt

SEQ ID NO: 657975 - DNA, 25 bp, Rattus norvegicus
gaatccaggctgacactcaaacctg

SEQ ID NO: 657976 - DNA, 25 bp, Rattus norvegicus
cttgcccgggatgctcgcacgcgga

SEQ ID NO: 657977 - DNA, 25 bp, Rattus norvegicus
cacacacaaaggagcgggccgggat

SEQ ID NO: 657978 - DNA, 25 bp, Rattus norvegicus
taccggcacacacaaaggagcgggc

SEQ ID NO: 657979 - DNA, 25 bp, Rattus norvegicus
ggcagctaccggcacacacaaagga

SEQ ID NO: 657980 - DNA, 25 bp, Rattus norvegicus
cggggctcctgagattgacgtctcc

SEQ ID NO: 657981 - DNA, 25 bp, Rattus norvegicus
ggtgcagactgctgtcccacaagcc

SEQ ID NO: 657982 - DNA, 25 bp, Rattus norvegicus
aatttcggggtgaagctggagacac

SEQ ID NO: 657983 - DNA, 25 bp, Rattus norvegicus
agcggggcggatctcgacaccaagc

SEQ ID NO: 657984 - DNA, 25 bp, Rattus norvegicus
ggatctcgacaccaagccggttttc

SEQ ID NO: 657985 - DNA, 25 bp, Rattus norvegicus
accaagccggttttccatactctca

SEQ ID NO: 657986 - DNA, 25 bp, Rattus norvegicus
cggttttccatactctcaccaatgg

SEQ ID NO: 657987 - DNA, 25 bp, Rattus norvegicus
tcaccaatggccacgccaagggccg

SEQ ID NO: 657988 - DNA, 25 bp, Rattus norvegicus
gacggcgacgactatgacactcctc

SEQ ID NO: 657989 - DNA, 25 bp, Rattus norvegicus
atcctcaaagagctccaggcgctca

SEQ ID NO: 657990 - DNA, 25 bp, Rattus norvegicus
aggcgctcaacaccgaggaggccgc

SEQ ID NO: 657991 - DNA, 25 bp, Rattus norvegicus
accggatgctcaggtaagcgagcga

SEQ ID NO: 657992 - DNA, 25 bp, Rattus norvegicus
ggagcccgcgcagtctctggagtcc

SEQ ID NO: 657993 - DNA, 25 bp, Rattus norvegicus
agccatgcggtgcagactgctgtcc

SEQ ID NO: 657994 - DNA, 25 bp, Rattus norvegicus
gtcccggccagagccatgcggtgca

SEQ ID NO: 657995 - DNA, 25 bp, Rattus norvegicus
tacctacagagtagcgagactgagc

SEQ ID NO: 657996 - DNA, 25 bp, Rattus norvegicus
aaaacctatcagtgcccattaagtg

SEQ ID NO: 657997 - DNA, 25 bp, Rattus norvegicus
cgtctaatgaaaacacgcagacatg

SEQ ID NO: 657998 - DNA, 25 bp, Rattus norvegicus
ctctgcggtgcgtctaatgaaaaca

SEQ ID NO: 657999 - DNA, 25 bp, Rattus norvegicus
agcgctctgcggtgcgtctaatgaa

SEQ ID NO: 658000 - DNA, 25 bp, Rattus norvegicus
agagtagcgagactgagcgctctgc

SEQ ID NO: 658001 - DNA, 25 bp, Rattus norvegicus
tggaacgctcactacctacagagta

SEQ ID NO: 658002 - DNA, 25 bp, Rattus norvegicus
tgaagaagctggaacgctcactacc

SEQ ID NO: 658003 - DNA, 25 bp, Rattus norvegicus
tcccgctcatgtgcgtgaagaagct

SEQ ID NO: 658004 - DNA, 25 bp, Rattus norvegicus
gcccattaagtggtgggtgataaaa

SEQ ID NO: 658005 - DNA, 25 bp, Rattus norvegicus
gcagacatgaaaagcaaaacctatc

SEQ ID NO: 658006 - DNA, 25 bp, Rattus norvegicus
catcgacatgttttagaaacccgtt

SEQ ID NO: 658007 - DNA, 25 bp, Rattus norvegicus
gcacatccacacacatcgacatgtt

SEQ ID NO: 658008 - DNA, 25 bp, Rattus norvegicus
gaaacccgtttctcccgctcatgtg

SEQ ID NO: 658009 - DNA, 25 bp, Rattus norvegicus
cgaggacctgcgaggctcttgcgca

SEQ ID NO: 658010 - DNA, 25 bp, Rattus norvegicus
ccggaactgtccgacccagcgggag

SEQ ID NO: 658011 - DNA, 25 bp, Rattus norvegicus
ctacgtcctactccttgactagaga

SEQ ID NO: 658012 - DNA, 25 bp, Rattus norvegicus
actccttgactagagaggttagggg

SEQ ID NO: 658013 - DNA, 25 bp, Rattus norvegicus
ggacgcccgcctctacaagtggggc

SEQ ID NO: 658014 - DNA, 25 bp, Rattus norvegicus
agggcgcagcgcaaactctgtccct

SEQ ID NO: 658015 - DNA, 25 bp, Rattus norvegicus
tgcgctggagctccgcgcagacgct

SEQ ID NO: 658016 - DNA, 25 bp, Rattus norvegicus
ctcggaagccgcctggtcaccgggt

SEQ ID NO: 658017 - DNA, 25 bp, Rattus norvegicus
taggcgggatgccaacctcgcgcgc

SEQ ID NO: 658018 - DNA, 25 bp, Rattus norvegicus
ggggccgacgtgtcacctattggcc

SEQ ID NO: 658019 - DNA, 25 bp, Rattus norvegicus
acgtgtcacctattggccgagcgga

SEQ ID NO: 658020 - DNA, 25 bp, Rattus norvegicus
gccgagcggactgaaactcttcttg

SEQ ID NO: 658021 - DNA, 25 bp, Rattus norvegicus
agtatgggctctgcccgctcatgca

SEQ ID NO: 658022 - DNA, 25 bp, Rattus norvegicus
tgaaactcttcttggagatgctccc

SEQ ID NO: 658023 - DNA, 25 bp, Rattus norvegicus
gtagcactgtccctccttacgaagt

SEQ ID NO: 658024 - DNA, 25 bp, Rattus norvegicus
cgcggacggaaataggtagtcgatt

SEQ ID NO: 658025 - DNA, 25 bp, Rattus norvegicus
caggagaggagttcacccacgttaa

SEQ ID NO: 658026 - DNA, 25 bp, Rattus norvegicus
tagtcgattgccgaagagagccgcg

SEQ ID NO: 658027 - DNA, 25 bp, Rattus norvegicus
taagcgcaagtgaactacaaagtcc

SEQ ID NO: 658028 - DNA, 25 bp, Rattus norvegicus
gtaccgtatagtaacaccagactca

SEQ ID NO: 658029 - DNA, 25 bp, Rattus norvegicus
tgtatcagttccctttcccgggtga

SEQ ID NO: 658030 - DNA, 25 bp, Rattus norvegicus
gcgccgccatcacaccggaagtgta

SEQ ID NO: 658031 - DNA, 25 bp, Rattus norvegicus
gtaattacctaaagctccaccgcgc

SEQ ID NO: 658032 - DNA, 25 bp, Rattus norvegicus
ccgagtcttcagagttccgtaatta

SEQ ID NO: 658033 - DNA, 25 bp, Rattus norvegicus
tggctcccagcatatcccgagtctt

SEQ ID NO: 658034 - DNA, 25 bp, Rattus norvegicus
aagcaaggtccaccaggcaagcgcc

SEQ ID NO: 658035 - DNA, 25 bp, Rattus norvegicus
cggcgcagccacgtgagaaaagcaa

SEQ ID NO: 658036 - DNA, 25 bp, Rattus norvegicus
tacaaagtccagcatgctccggcgg

SEQ ID NO: 658037 - DNA, 25 bp, Rattus norvegicus
actttcgatgttccacactcccggg

SEQ ID NO: 658038 - DNA, 25 bp, Rattus norvegicus
cccacaaaggaccgcggagctgcgt

SEQ ID NO: 658039 - DNA, 25 bp, Rattus norvegicus
gcccgctcggaacttgctgactgcg

SEQ ID NO: 658040 - DNA, 25 bp, Rattus norvegicus
acggccgcctgcgactttcgatgtt

SEQ ID NO: 658041 - DNA, 25 bp, Rattus norvegicus
ggcggcgccaatttgttgcacttct

SEQ ID NO: 658042 - DNA, 25 bp, Rattus norvegicus
agtcagccgcgctcgtcagtcagcg

SEQ ID NO: 658043 - DNA, 25 bp, Rattus norvegicus
aggaaggttcctcggcgctctccct

SEQ ID NO: 658044 - DNA, 25 bp, Rattus norvegicus
tcaaggaaggttcctcggcgctctc

SEQ ID NO: 658045 - DNA, 25 bp, Rattus norvegicus
gcctccatttcctcaaggaaggttc

SEQ ID NO: 658046 - DNA, 25 bp, Rattus norvegicus
caggctgcctccatttcctcaagga

SEQ ID NO: 658047 - DNA, 25 bp, Rattus norvegicus
ctgcgactttcgatgttccacactc

SEQ ID NO: 658048 - DNA, 25 bp, Rattus norvegicus
gaacttgctgactgcgcgaccggga

SEQ ID NO: 658049 - DNA, 25 bp, Rattus norvegicus
ctcggaacttgctgactgcgcgacc

SEQ ID NO: 658050 - DNA, 25 bp, Rattus norvegicus
gcgccaatttgttgcacttctgggg

SEQ ID NO: 658051 - DNA, 25 bp, Rattus norvegicus
acccggagagtgcactgctgtacca

SEQ ID NO: 658052 - DNA, 25 bp, Rattus norvegicus
tgcaactctggtcagtggccgtttt

SEQ ID NO: 658053 - DNA, 25 bp, Rattus norvegicus
acgctgctgcacttcatctcttggg

SEQ ID NO: 658054 - DNA, 25 bp, Rattus norvegicus
cacttcatctcttggggcgctcttc

SEQ ID NO: 658055 - DNA, 25 bp, Rattus norvegicus
ggcgctcttcgctttggccaaccgt

SEQ ID NO: 658056 - DNA, 25 bp, Rattus norvegicus
ggctactcggtggtgctgcacagcc

SEQ ID NO: 658057 - DNA, 25 bp, Rattus norvegicus
aaccgtcgcgtcctgtgcaactctg

SEQ ID NO: 658058 - DNA, 25 bp, Rattus norvegicus
tggccgttttgtgttgaatgttccc

SEQ ID NO: 658059 - DNA, 25 bp, Rattus norvegicus
cccaccaagagtgcatggctgcgga

SEQ ID NO: 658060 - DNA, 25 bp, Rattus norvegicus
agcggtgatgctgttgctgtacttc

SEQ ID NO: 658061 - DNA, 25 bp, Rattus norvegicus
ctgtacttcggggtacacttcaggg

SEQ ID NO: 658062 - DNA, 25 bp, Rattus norvegicus
tcctacaacctggacccggagagtg

SEQ ID NO: 658063 - DNA, 25 bp, Rattus norvegicus
ccggcacgctgtttggctactcggt

SEQ ID NO: 658064 - DNA, 25 bp, Rattus norvegicus
tcagggtaccaaccgggcactccta

SEQ ID NO: 658065 - DNA, 25 bp, Rattus norvegicus
ttgtcccacgctgccagggcaacga

SEQ ID NO: 658066 - DNA, 25 bp, Rattus norvegicus
aaagagtggctacagccaccgcctg

SEQ ID NO: 658067 - DNA, 25 bp, Rattus norvegicus
tgggccgaattaggaacccaccaga

SEQ ID NO: 658068 - DNA, 25 bp, Rattus norvegicus
tcccgagtctcctgcggagcatggt

SEQ ID NO: 658069 - DNA, 25 bp, Rattus norvegicus
agctgcctttgggagctccggacac

SEQ ID NO: 658070 - DNA, 25 bp, Rattus norvegicus
ttcagcagctgcctttgggagctcc

SEQ ID NO: 658071 - DNA, 25 bp, Rattus norvegicus
ggggccaccactcaccagctgggag

SEQ ID NO: 658072 - DNA, 25 bp, Rattus norvegicus
ctcgaagcagaacccgctcgggttc

SEQ ID NO: 658073 - DNA, 25 bp, Rattus norvegicus
tctcgaagatgcctcgaagcagaac

SEQ ID NO: 658074 - DNA, 25 bp, Rattus norvegicus
gctttccctcccgatctcgaagatg

SEQ ID NO: 658075 - DNA, 25 bp, Rattus norvegicus
tcgcccagcgccacatcgcagcttt

SEQ ID NO: 658076 - DNA, 25 bp, Rattus norvegicus
agctcgggccggatgcgttgccacc

SEQ ID NO: 658077 - DNA, 25 bp, Rattus norvegicus
accactcaccagctgggagctcggg

SEQ ID NO: 658078 - DNA, 25 bp, Rattus norvegicus
tgccagggcaacgacgctagcctga

SEQ ID NO: 658079 - DNA, 25 bp, Rattus norvegicus
cacgcgtaggcaacaaaagccgctt

SEQ ID NO: 658080 - DNA, 25 bp, Rattus norvegicus
tggccggctgtacagccctaacgcg

SEQ ID NO: 658081 - DNA, 25 bp, Rattus norvegicus
agccctaacgcgctggtagctctgt

SEQ ID NO: 658082 - DNA, 25 bp, Rattus norvegicus
aacgcgctggtagctctgttgggac

SEQ ID NO: 658083 - DNA, 25 bp, Rattus norvegicus
ctctgttgggacagtgggtatttcc

SEQ ID NO: 658084 - DNA, 25 bp, Rattus norvegicus
tgggtatttcccagttctctctgct

SEQ ID NO: 658085 - DNA, 25 bp, Rattus norvegicus
acgcgagctgcacgcgtaggcaaca

SEQ ID NO: 658086 - DNA, 25 bp, Rattus norvegicus
aaaagccgcttttcatgactcagtg

SEQ ID NO: 658087 - DNA, 25 bp, Rattus norvegicus
tttcatgactcagtgccctccagca

SEQ ID NO: 658088 - DNA, 25 bp, Rattus norvegicus
agtgccctccagcaatgccctaaat

SEQ ID NO: 658089 - DNA, 25 bp, Rattus norvegicus
gggccctagtctccagcgaggcact

SEQ ID NO: 658090 - DNA, 25 bp, Rattus norvegicus
tccagcgaggcactggacctgcgtc

SEQ ID NO: 658091 - DNA, 25 bp, Rattus norvegicus
ctggacctgcgtcggggccgttaca

SEQ ID NO: 658092 - DNA, 25 bp, Rattus norvegicus
ttctctctgcttgcctagcgggtga

SEQ ID NO: 658093 - DNA, 25 bp, Rattus norvegicus
cggagaccgaggatctgtccacaga

SEQ ID NO: 658094 - DNA, 25 bp, Rattus norvegicus
caaagactgccggtgagtaaagctg

SEQ ID NO: 658095 - DNA, 25 bp, Rattus norvegicus
atcgcgatatggctcaaagactgcc

SEQ ID NO: 658096 - DNA, 25 bp, Rattus norvegicus
tgcccaacgagaagatcgcgatatg

SEQ ID NO: 658097 - DNA, 25 bp, Rattus norvegicus
ttcgcaggaaacgtgcccaacgaga

SEQ ID NO: 658098 - DNA, 25 bp, Rattus norvegicus
gtcccttcgctctacttcgcaggaa

SEQ ID NO: 658099 - DNA, 25 bp, Rattus norvegicus
tatggggtccctaacgagctgtccc

SEQ ID NO: 658100 - DNA, 25 bp, Rattus norvegicus
cctgagcacttatgtatggggtccc

SEQ ID NO: 658101 - DNA, 25 bp, Rattus norvegicus
gcttcagcgccagcatgtgcacctg

SEQ ID NO: 658102 - DNA, 25 bp, Rattus norvegicus
tgtccacagagacgacgacacagga

SEQ ID NO: 658103 - DNA, 25 bp, Rattus norvegicus
gaagcgaggggttcgacctcttctc

SEQ ID NO: 658104 - DNA, 25 bp, Rattus norvegicus
ggcgcggccatgaaccgacccttgt

SEQ ID NO: 658105 - DNA, 25 bp, Rattus norvegicus
gggttcacgtgaagcgccagccctc

SEQ ID NO: 658106 - DNA, 25 bp, Rattus norvegicus
cggacctctaaatgcgcgcgtgagc

SEQ ID NO: 658107 - DNA, 25 bp, Rattus norvegicus
cttcttccgccagcggttgacgacg

SEQ ID NO: 658108 - DNA, 25 bp, Rattus norvegicus
tgacgacggccgcaaaatgtctgtg

SEQ ID NO: 658109 - DNA, 25 bp, Rattus norvegicus
cgcaaaatgtctgtgggccgcgctg

SEQ ID NO: 658110 - DNA, 25 bp, Rattus norvegicus
cgcgctgcgggattcttttctatct

SEQ ID NO: 658111 - DNA, 25 bp, Rattus norvegicus
ttttctatctctggctaggagcggg

SEQ ID NO: 658112 - DNA, 25 bp, Rattus norvegicus
ggcagccgcacagaaggccacgtca

SEQ ID NO: 658113 - DNA, 25 bp, Rattus norvegicus
aaggccacgtcagcctaagcggtcc

SEQ ID NO: 658114 - DNA, 25 bp, Rattus norvegicus
cggcagaattgcagctgcgcgcgtt

SEQ ID NO: 658115 - DNA, 25 bp, Rattus norvegicus
gcctaaggatgggacagtagctgaa

SEQ ID NO: 658116 - DNA, 25 bp, Rattus norvegicus
aaggcgctagatagaccgcatccca

SEQ ID NO: 658117 - DNA, 25 bp, Rattus norvegicus
ccattgtaccgggttctgactgccc

SEQ ID NO: 658118 - DNA, 25 bp, Rattus norvegicus
cgggttctgactgcccgcttctgct

SEQ ID NO: 658119 - DNA, 25 bp, Rattus norvegicus
gtccgatctgtgacctctgacgcac

SEQ ID NO: 658120 - DNA, 25 bp, Rattus norvegicus
tctctctccctggtccgatctgtga

SEQ ID NO: 658121 - DNA, 25 bp, Rattus norvegicus
tgatagcttctccaccgcagatctg

SEQ ID NO: 658122 - DNA, 25 bp, Rattus norvegicus
gaccttcgtgaagaacatcattctg

SEQ ID NO: 658123 - DNA, 25 bp, Rattus norvegicus
gttatacgcgagcacggaaaatgta

SEQ ID NO: 658124 - DNA, 25 bp, Rattus norvegicus
agccatacttcatgtgcgacgatga

SEQ ID NO: 658125 - DNA, 25 bp, Rattus norvegicus
ctccgccaagctggtgtccaagctg

SEQ ID NO: 658126 - DNA, 25 bp, Rattus norvegicus
gacccggacgacgagaccttcgtga

SEQ ID NO: 658127 - DNA, 25 bp, Rattus norvegicus
agcagagcttcgtctgcgacccgga

SEQ ID NO: 658128 - DNA, 25 bp, Rattus norvegicus
cagggatcacgacggtgatagcttc

SEQ ID NO: 658129 - DNA, 25 bp, Rattus norvegicus
cgactcggtgcagccatacttcatg

SEQ ID NO: 658130 - DNA, 25 bp, Rattus norvegicus
ggcaaccgcgacctggactacgact

SEQ ID NO: 658131 - DNA, 25 bp, Rattus norvegicus
cgcgctactttgagcgtggcgtctg

SEQ ID NO: 658132 - DNA, 25 bp, Rattus norvegicus
cctttccgtaaggtggcgcgctact

SEQ ID NO: 658133 - DNA, 25 bp, Rattus norvegicus
gaaaatgtatcctgtgcacgcacca

SEQ ID NO: 658134 - DNA, 25 bp, Rattus norvegicus
ctaccaggctgtgcgcaaagaaggc

SEQ ID NO: 658135 - DNA, 25 bp, Rattus norvegicus
ggagccaagcagctcccttagacta

SEQ ID NO: 658136 - DNA, 25 bp, Rattus norvegicus
caaagtttcagagttccggagtgac

SEQ ID NO: 658137 - DNA, 25 bp, Rattus norvegicus
tgcggcttcaaagtttcagagttcc

SEQ ID NO: 658138 - DNA, 25 bp, Rattus norvegicus
agccctgcggcttcaaagtttcaga

SEQ ID NO: 658139 - DNA, 25 bp, Rattus norvegicus
gcctcttgactcttaagccctgcgg

SEQ ID NO: 658140 - DNA, 25 bp, Rattus norvegicus
ctcgcgtggcctcttgactcttaag

SEQ ID NO: 658141 - DNA, 25 bp, Rattus norvegicus
ttggcttcagaaaggagcccctcgc

SEQ ID NO: 658142 - DNA, 25 bp, Rattus norvegicus
tagactacacgtcgctccggggcca

SEQ ID NO: 658143 - DNA, 25 bp, Rattus norvegicus
agcagctcccttagactacacgtcg

SEQ ID NO: 658144 - DNA, 25 bp, Rattus norvegicus
ttactaattatccaaggagccaagc

SEQ ID NO: 658145 - DNA, 25 bp, Rattus norvegicus
cgctttgacagctagttactaatta

SEQ ID NO: 658146 - DNA, 25 bp, Rattus norvegicus
cccgggcctacgctttgacagctag

SEQ ID NO: 658147 - DNA, 25 bp, Rattus norvegicus
ggctgcgatcacttgccggtcctct

SEQ ID NO: 658148 - DNA, 25 bp, Rattus norvegicus
ttccggagtgactgcggtggcctca

SEQ ID NO: 658149 - DNA, 25 bp, Rattus norvegicus
acgctccagggagaacacggcagac

SEQ ID NO: 658150 - DNA, 25 bp, Rattus norvegicus
gtcgttgaggatggtgagcttctcc

SEQ ID NO: 658151 - DNA, 25 bp, Rattus norvegicus
ggagccgggaaatagctcccgactg

SEQ ID NO: 658152 - DNA, 25 bp, Rattus norvegicus
cgggaaatagctcccgactgcgcgc

SEQ ID NO: 658153 - DNA, 25 bp, Rattus norvegicus
ggcccgtgcgcaccttcttgatgtt

SEQ ID NO: 658154 - DNA, 25 bp, Rattus norvegicus
agacgtgtgctctgcgcgaccggca

SEQ ID NO: 658155 - DNA, 25 bp, Rattus norvegicus
cttcttgatgttgtagaggcgcgtg

SEQ ID NO: 658156 - DNA, 25 bp, Rattus norvegicus
atggtgagcttctccgccagcttct

SEQ ID NO: 658157 - DNA, 25 bp, Rattus norvegicus
gccagcttctgctgactgggctgca

SEQ ID NO: 658158 - DNA, 25 bp, Rattus norvegicus
cccacccgcgccgtgacacagcagc

SEQ ID NO: 658159 - DNA, 25 bp, Rattus norvegicus
gaccggcgctcggtcacctgatcgg

SEQ ID NO: 658160 - DNA, 25 bp, Rattus norvegicus
aacacgcctagacagacgctccagg

SEQ ID NO: 658161 - DNA, 25 bp, Rattus norvegicus
aacacggcagacgtgtgctctgcgc

SEQ ID NO: 658162 - DNA, 25 bp, Rattus norvegicus
gaactgcggcccgagtcctgtgcgc

SEQ ID NO: 658163 - DNA, 25 bp, Rattus norvegicus
tcgatggtgcaaatgggtgcgtaca

SEQ ID NO: 658164 - DNA, 25 bp, Rattus norvegicus
cagagagcagccaggaccaacagcc

SEQ ID NO: 658165 - DNA, 25 bp, Rattus norvegicus
atgttccagggtagggacttgcaca

SEQ ID NO: 658166 - DNA, 25 bp, Rattus norvegicus
ccaggatggcgttagcctgggtact

SEQ ID NO: 658167 - DNA, 25 bp, Rattus norvegicus
tgcccagcagcccttcgaattgttc

SEQ ID NO: 658168 - DNA, 25 bp, Rattus norvegicus
ctcgtgctggaagtcgatggtgcaa

SEQ ID NO: 658169 - DNA, 25 bp, Rattus norvegicus
ctcacacacggacttgcagggcttg

SEQ ID NO: 658170 - DNA, 25 bp, Rattus norvegicus
tacttgatgaggatgggctcgcagc

SEQ ID NO: 658171 - DNA, 25 bp, Rattus norvegicus
tccggccacgagtggcggtacttga

SEQ ID NO: 658172 - DNA, 25 bp, Rattus norvegicus
ggcagctcttcgcaggccaagcttt

SEQ ID NO: 658173 - DNA, 25 bp, Rattus norvegicus
gagagatgcacacgccgcggtcgta

SEQ ID NO: 658174 - DNA, 25 bp, Rattus norvegicus
tctcctcagaggtcgggtaaagtcc

SEQ ID NO: 658175 - DNA, 25 bp, Rattus norvegicus
gcgagaggataaaggcaaacgacta

SEQ ID NO: 658176 - DNA, 25 bp, Rattus norvegicus
ttcgaattgttcgatggccaggatg

SEQ ID NO: 658177 - DNA, 25 bp, Rattus norvegicus
tctcaacgcaccacagagatgcaca

SEQ ID NO: 658178 - DNA, 25 bp, Rattus norvegicus
gcagctatttcctcccaggaaaccg

SEQ ID NO: 658179 - DNA, 25 bp, Rattus norvegicus
aagcgatctcaacgcaccacagaga

SEQ ID NO: 658180 - DNA, 25 bp, Rattus norvegicus
cccacgggagaagcgatctcaacgc

SEQ ID NO: 658181 - DNA, 25 bp, Rattus norvegicus
cagctccgtagacgaacccttggtc

SEQ ID NO: 658182 - DNA, 25 bp, Rattus norvegicus
tcctggctccagctccgtagacgaa

SEQ ID NO: 658183 - DNA, 25 bp, Rattus norvegicus
acaggagtcgcgcacttttcccacg

SEQ ID NO: 658184 - DNA, 25 bp, Rattus norvegicus
caggcagctcccgacaggagtcgcg

SEQ ID NO: 658185 - DNA, 25 bp, Rattus norvegicus
ctgtctagctgtgatgctgtagccc

SEQ ID NO: 658186 - DNA, 25 bp, Rattus norvegicus
gtgagaccctgtctagctgtgatgc

SEQ ID NO: 658187 - DNA, 25 bp, Rattus norvegicus
gaggactcgagtgtgagaccctgtc

SEQ ID NO: 658188 - DNA, 25 bp, Rattus norvegicus
aaggctgagttttcagaggactcga

SEQ ID NO: 658189 - DNA, 25 bp, Rattus norvegicus
cttccgagaaggctgagttttcaga

SEQ ID NO: 658190 - DNA, 25 bp, Rattus norvegicus
tttcctcccaggaaaccggagcgca

SEQ ID NO: 658191 - DNA, 25 bp, Rattus norvegicus
agtagccgggatccctgcactgcgc

SEQ ID NO: 658192 - DNA, 25 bp, Rattus norvegicus
ccgcaaagagcatggtcggaagtta

SEQ ID NO: 658193 - DNA, 25 bp, Rattus norvegicus
tcggaagttacgcaacccataaggc

SEQ ID NO: 658194 - DNA, 25 bp, Rattus norvegicus
gccgcgcggctcttacggtaagaag

SEQ ID NO: 658195 - DNA, 25 bp, Rattus norvegicus
gccatttttgaaaactgggaagatc

SEQ ID NO: 658196 - DNA, 25 bp, Rattus norvegicus
aactgggaagatccttgctggagtg

SEQ ID NO: 658197 - DNA, 25 bp, Rattus norvegicus
cgcccacgctgggtgagtgaaccgc

SEQ ID NO: 658198 - DNA, 25 bp, Rattus norvegicus
gcggcctctcccgtggcacaattag

SEQ ID NO: 658199 - DNA, 25 bp, Rattus norvegicus
acaattagtgcgctgtggacctgga

SEQ ID NO: 658200 - DNA, 25 bp, Rattus norvegicus
ccgatgacatctgggcggcagtagc

SEQ ID NO: 658201 - DNA, 25 bp, Rattus norvegicus
gcgctcggctctactgtggtcacct

SEQ ID NO: 658202 - DNA, 25 bp, Rattus norvegicus
cccgaaagcgaccacgaggatgggc

SEQ ID NO: 658203 - DNA, 25 bp, Rattus norvegicus
aacctctggtcgcagtggtatcagc

SEQ ID NO: 658204 - DNA, 25 bp, Rattus norvegicus
gcgaccgccacacgctacggaggga

SEQ ID NO: 658205 - DNA, 25 bp, Rattus norvegicus
taataacactcatgcctgccagcgg

SEQ ID NO: 658206 - DNA, 25 bp, Rattus norvegicus
ctttgtcccggttcctatctccagg

SEQ ID NO: 658207 - DNA, 25 bp, Rattus norvegicus
aacccgcagagcagaagccgcggtc

SEQ ID NO: 658208 - DNA, 25 bp, Rattus norvegicus
ctcagtgcgatggaccggcaacgcc

SEQ ID NO: 658209 - DNA, 25 bp, Rattus norvegicus
ggtcggccgattgccctgccgctat

SEQ ID NO: 658210 - DNA, 25 bp, Rattus norvegicus
tatctccaggcaagcactgcgccgg

SEQ ID NO: 658211 - DNA, 25 bp, Rattus norvegicus
agcccggtcccgcttgtggctgcat

SEQ ID NO: 658212 - DNA, 25 bp, Rattus norvegicus
ggcaacgccgcgcactataataaca

SEQ ID NO: 658213 - DNA, 25 bp, Rattus norvegicus
gtggctccctgccattggctcagtg

SEQ ID NO: 658214 - DNA, 25 bp, Rattus norvegicus
gctctcagtatcagcccagtggctc

SEQ ID NO: 658215 - DNA, 25 bp, Rattus norvegicus
tggcgggtgacagatgtactcctct

SEQ ID NO: 658216 - DNA, 25 bp, Rattus norvegicus
agtctcgcacttgtaaccggccgtc

SEQ ID NO: 658217 - DNA, 25 bp, Rattus norvegicus
gcacctctcaggagtctcgcacttg

SEQ ID NO: 658218 - DNA, 25 bp, Rattus norvegicus
cgcgcaccgcaaccgggcataagga

SEQ ID NO: 658219 - DNA, 25 bp, Rattus norvegicus
actgcggcgccgtcctgtcgcaaag

SEQ ID NO: 658220 - DNA, 25 bp, Rattus norvegicus
tagtgaggccgctgcgctctcaccg

SEQ ID NO: 658221 - DNA, 25 bp, Rattus norvegicus
ccttttcccgttcttatgtctcatc

SEQ ID NO: 658222 - DNA, 25 bp, Rattus norvegicus
gcgcagttccacttccgggcgcctc

SEQ ID NO: 658223 - DNA, 25 bp, Rattus norvegicus
ggaccgaacccagcaagtctcaaag

SEQ ID NO: 658224 - DNA, 25 bp, Rattus norvegicus
tcctgtcgcaaaggccacatccggg

SEQ ID NO: 658225 - DNA, 25 bp, Rattus norvegicus
cggcgaatgagcgagtcgctttccg

SEQ ID NO: 658226 - DNA, 25 bp, Rattus norvegicus
agcgagtcgctttccgtgcgctgcg

SEQ ID NO: 658227 - DNA, 25 bp, Rattus norvegicus
cgacggtagccatctgcgtcgcaga

SEQ ID NO: 658228 - DNA, 25 bp, Rattus norvegicus
catctgcgtcgcagacggctcggcg

SEQ ID NO: 658229 - DNA, 25 bp, Rattus norvegicus
aaggagaagatcatcgaggtgcgta

SEQ ID NO: 658230 - DNA, 25 bp, Rattus norvegicus
agatcatcgaggtgcgtaccctccc

SEQ ID NO: 658231 - DNA, 25 bp, Rattus norvegicus
ctcatcgctgtagtgaggccgctgc

SEQ ID NO: 658232 - DNA, 25 bp, Rattus norvegicus
tcccgttcttatgtctcatctacgc

SEQ ID NO: 658233 - DNA, 25 bp, Rattus norvegicus
tggttccaggtatgtctttgcagtc

SEQ ID NO: 658234 - DNA, 25 bp, Rattus norvegicus
cgaggctgtgcaccgcagacagcgc

SEQ ID NO: 658235 - DNA, 25 bp, Rattus norvegicus
gcgaaagcgggctcgccatcctctt

SEQ ID NO: 658236 - DNA, 25 bp, Rattus norvegicus
atgcctccgtggctctctggctctt

SEQ ID NO: 658237 - DNA, 25 bp, Rattus norvegicus
tctctggctcttcgccatggcgagg

SEQ ID NO: 658238 - DNA, 25 bp, Rattus norvegicus
tggctggggcatcctttactttggt

SEQ ID NO: 658239 - DNA, 25 bp, Rattus norvegicus
catcctttactttggtggttccagg

SEQ ID NO: 658240 - DNA, 25 bp, Rattus norvegicus
gtctttgcagtccagccctgtttta

SEQ ID NO: 658241 - DNA, 25 bp, Rattus norvegicus
cagccctgttttacatctgtgcgga

SEQ ID NO: 658242 - DNA, 25 bp, Rattus norvegicus
acatctgtgcggacgatcgcgtctg

SEQ ID NO: 658243 - DNA, 25 bp, Rattus norvegicus
ttcgcgggatccttagctccttcct

SEQ ID NO: 658244 - DNA, 25 bp, Rattus norvegicus
tccttcctcttcgttgcttagccta

SEQ ID NO: 658245 - DNA, 25 bp, Rattus norvegicus
gctggtttcaatccctccgcgtctt

SEQ ID NO: 658246 - DNA, 25 bp, Rattus norvegicus
gcttagcctatccttgctggtttca

SEQ ID NO: 658247 - DNA, 25 bp, Rattus norvegicus
gaaggaagtagtcaggaaccctcga

SEQ ID NO: 658248 - DNA, 25 bp, Rattus norvegicus
gccgcgtggcctcagaccctcgtcg

SEQ ID NO: 658249 - DNA, 25 bp, Rattus norvegicus
gcgcggtgtgtagcctgggccgcgt

SEQ ID NO: 658250 - DNA, 25 bp, Rattus norvegicus
ccggagcgcgaggatggcagcgcgc

SEQ ID NO: 658251 - DNA, 25 bp, Rattus norvegicus
aggaagtagtcaggaaccctcgacg

SEQ ID NO: 658252 - DNA, 25 bp, Rattus norvegicus
gcgcggaggtactgcgggcagagga

SEQ ID NO: 658253 - DNA, 25 bp, Rattus norvegicus
acgtattctggcgcgcggaggtact

SEQ ID NO: 658254 - DNA, 25 bp, Rattus norvegicus
caatggggatgacgtattctggcgc

SEQ ID NO: 658255 - DNA, 25 bp, Rattus norvegicus
tccaatggggatgacgtattctggc

SEQ ID NO: 658256 - DNA, 25 bp, Rattus norvegicus
ccgtccaatggggatgacgtattct

SEQ ID NO: 658257 - DNA, 25 bp, Rattus norvegicus
cggccgtccaatggggatgacgtat

SEQ ID NO: 658258 - DNA, 25 bp, Rattus norvegicus
ccagcagcggccgtccaatggggat

SEQ ID NO: 658259 - DNA, 25 bp, Rattus norvegicus
gatacttcgtctcccgccaaagcgc

SEQ ID NO: 658260 - DNA, 25 bp, Rattus norvegicus
gaagtagtcaggaaccctcgacgcc

SEQ ID NO: 658261 - DNA, 25 bp, Rattus norvegicus
gcggcctctactcacgactgttgtc

SEQ ID NO: 658262 - DNA, 25 bp, Rattus norvegicus
ggagggcccttcaatcacaaccacg

SEQ ID NO: 658263 - DNA, 25 bp, Rattus norvegicus
tcgtactgcagacacaagaggttgc

SEQ ID NO: 658264 - DNA, 25 bp, Rattus norvegicus
gccatggctcggatctccgaatgga

SEQ ID NO: 658265 - DNA, 25 bp, Rattus norvegicus
ccgaatggagcgttggaggaataaa

SEQ ID NO: 658266 - DNA, 25 bp, Rattus norvegicus
ggaggaataaagtggcgacgcaacc

SEQ ID NO: 658267 - DNA, 25 bp, Rattus norvegicus
cgacgcaacccgagagggagaaagc

SEQ ID NO: 658268 - DNA, 25 bp, Rattus norvegicus
gagaaagcagctgcccggaatcaca

SEQ ID NO: 658269 - DNA, 25 bp, Rattus norvegicus
gcccggaatcacagttgcaaagttc

SEQ ID NO: 658270 - DNA, 25 bp, Rattus norvegicus
gttgcaaagttcaaatctcgcagca

SEQ ID NO: 658271 - DNA, 25 bp, Rattus norvegicus
cacgtcagctcgtactgcagacaca

SEQ ID NO: 658272 - DNA, 25 bp, Rattus norvegicus
aacacgtgatctgaaggagggccct

SEQ ID NO: 658273 - DNA, 25 bp, Rattus norvegicus
caaccacgctgcctataagaaggga

SEQ ID NO: 658274 - DNA, 25 bp, Rattus norvegicus
tctcgcagcaaacgggaagtgcacg

SEQ ID NO: 658275 - DNA, 25 bp, Rattus norvegicus
atctggtggtagctgcagcagcagc

SEQ ID NO: 658276 - DNA, 25 bp, Rattus norvegicus
agcgcggtgatagaggcctcgcacc

SEQ ID NO: 658277 - DNA, 25 bp, Rattus norvegicus
gaggcctcgcacctgggctttcgct

SEQ ID NO: 658278 - DNA, 25 bp, Rattus norvegicus
aagagaagcagggtgtaagccacct

SEQ ID NO: 658279 - DNA, 25 bp, Rattus norvegicus
taagccacctggtgtccgcacgacg

SEQ ID NO: 658280 - DNA, 25 bp, Rattus norvegicus
ctggatcttccaggacgggatccgc

SEQ ID NO: 658281 - DNA, 25 bp, Rattus norvegicus
ctgtgtgcggcagcggcccgatctt

SEQ ID NO: 658282 - DNA, 25 bp, Rattus norvegicus
gatcttcccgggcagccttggcttg

SEQ ID NO: 658283 - DNA, 25 bp, Rattus norvegicus
gccttggcttggtaccaggcgcttt

SEQ ID NO: 658284 - DNA, 25 bp, Rattus norvegicus
taccaggcgctttgcttgcgcgctc

SEQ ID NO: 658285 - DNA, 25 bp, Rattus norvegicus
cgctcccacgctggaactgcagtga

SEQ ID NO: 658286 - DNA, 25 bp, Rattus norvegicus
aggtgcagcgccctggccgaagcca

SEQ ID NO: 658287 - DNA, 25 bp, Rattus norvegicus
gccgaagccactcgaccgggacatg

SEQ ID NO: 658288 - DNA, 25 bp, Rattus norvegicus
tccgcacgacggtacctggatcttc

SEQ ID NO: 658289 - DNA, 25 bp, Rattus norvegicus
actggctctgtatcccggtgcacac

SEQ ID NO: 658290 - DNA, 25 bp, Rattus norvegicus
gcccttgccgccacggtatagattc

SEQ ID NO: 658291 - DNA, 25 bp, Rattus norvegicus
gtatagattccgtgacctgctttta

SEQ ID NO: 658292 - DNA, 25 bp, Rattus norvegicus
cctgcttttaggagaccagacattc

SEQ ID NO: 658293 - DNA, 25 bp, Rattus norvegicus
aacgacgacaggtaagtgacggagc

SEQ ID NO: 658294 - DNA, 25 bp, Rattus norvegicus
acaagcgtgcgcatccttcattctc

SEQ ID NO: 658295 - DNA, 25 bp, Rattus norvegicus
gtcagaaccgcacgcactatggccg

SEQ ID NO: 658296 - DNA, 25 bp, Rattus norvegicus
cgccacagcaacgttcttcaacttt

SEQ ID NO: 658297 - DNA, 25 bp, Rattus norvegicus
tgccagccacacaatgaacgacctg

SEQ ID NO: 658298 - DNA, 25 bp, Rattus norvegicus
tgcagtcactgaggctctgccgcgc

SEQ ID NO: 658299 - DNA, 25 bp, Rattus norvegicus
gttcccaattctagcgctccactga

SEQ ID NO: 658300 - DNA, 25 bp, Rattus norvegicus
cctggacacagaggtactgcccttg

SEQ ID NO: 658301 - DNA, 25 bp, Rattus norvegicus
gctccactgatctgagaaccagtca

SEQ ID NO: 658302 - DNA, 25 bp, Rattus norvegicus
tcttcaactttctcggcttcccagg

SEQ ID NO: 658303 - DNA, 25 bp, Rattus norvegicus
ctgcgtggggagaccgttgcaaatc

SEQ ID NO: 658304 - DNA, 25 bp, Rattus norvegicus
cgttgcaaatcggcggcagcttcct

SEQ ID NO: 658305 - DNA, 25 bp, Rattus norvegicus
ggttgccatcttcgcgctgcgtggg

SEQ ID NO: 658306 - DNA, 25 bp, Rattus norvegicus
gccatcttcgcgctgcgtggggaga

SEQ ID NO: 658307 - DNA, 25 bp, Rattus norvegicus
gggttgccatcttcgcgctgcgtgg

SEQ ID NO: 658308 - DNA, 25 bp, Rattus norvegicus
tgcgtggggagaccgttgcaaatcg

SEQ ID NO: 658309 - DNA, 25 bp, Rattus norvegicus
cgtggggagaccgttgcaaatcggc

SEQ ID NO: 658310 - DNA, 25 bp, Rattus norvegicus
gtggggagaccgttgcaaatcggcg

SEQ ID NO: 658311 - DNA, 25 bp, Rattus norvegicus
gagaccgttgcaaatcggcggcagc

SEQ ID NO: 658312 - DNA, 25 bp, Rattus norvegicus
agaccgttgcaaatcggcggcagct

SEQ ID NO: 658313 - DNA, 25 bp, Rattus norvegicus
gaccgttgcaaatcggcggcagctt

SEQ ID NO: 658314 - DNA, 25 bp, Rattus norvegicus
accgttgcaaatcggcggcagcttc

SEQ ID NO: 658315 - DNA, 25 bp, Rattus norvegicus
ccgttgcaaatcggcggcagcttcc

SEQ ID NO: 658316 - DNA, 25 bp, Rattus norvegicus
ttgccatcttcgcgctgcgtgggga

SEQ ID NO: 658317 - DNA, 25 bp, Rattus norvegicus
agaaagccgcggcaccgagtacacc

SEQ ID NO: 658318 - DNA, 25 bp, Rattus norvegicus
tcttccctgcctacactcttgcagg

SEQ ID NO: 658319 - DNA, 25 bp, Rattus norvegicus
tacactcttgcaggctcactcccgc

SEQ ID NO: 658320 - DNA, 25 bp, Rattus norvegicus
ggcgcgaggacagccatcttccctg

SEQ ID NO: 658321 - DNA, 25 bp, Rattus norvegicus
aatcagaggcgcgaggacagccatc

SEQ ID NO: 658322 - DNA, 25 bp, Rattus norvegicus
accgagtacaccaaggcaatcagag

SEQ ID NO: 658323 - DNA, 25 bp, Rattus norvegicus
cggcaccgagtacaccaaggcaatc

SEQ ID NO: 658324 - DNA, 25 bp, Rattus norvegicus
tctggccagccatcgagaaagccgc

SEQ ID NO: 658325 - DNA, 25 bp, Rattus norvegicus
taaggtctggccagccatcgagaaa

SEQ ID NO: 658326 - DNA, 25 bp, Rattus norvegicus
aggcaataaggtctggccagccatc

SEQ ID NO: 658327 - DNA, 25 bp, Rattus norvegicus
cagggcagacagaaggcaataaggt

SEQ ID NO: 658328 - DNA, 25 bp, Rattus norvegicus
agcaatggaaagcagggcagacaga

SEQ ID NO: 658329 - DNA, 25 bp, Rattus norvegicus
cggcagcttcctcacgaggaggaaa

SEQ ID NO: 658330 - DNA, 25 bp, Rattus norvegicus
cctcacgaggaggaaagcaatggaa

SEQ ID NO: 658331 - DNA, 25 bp, Rattus norvegicus
cagccctgttcggagctcaaactga

SEQ ID NO: 658332 - DNA, 25 bp, Rattus norvegicus
gctccaccttcgaccgcgacctcgg

SEQ ID NO: 658333 - DNA, 25 bp, Rattus norvegicus
gtccaggcacggctccaccttcgac

SEQ ID NO: 658334 - DNA, 25 bp, Rattus norvegicus
cgggcctggaaagcctccgccgcca

SEQ ID NO: 658335 - DNA, 25 bp, Rattus norvegicus
caccaagcgcactagggttcgggcc

SEQ ID NO: 658336 - DNA, 25 bp, Rattus norvegicus
gccctgttcggagctcaaactgacc

SEQ ID NO: 658337 - DNA, 25 bp, Rattus norvegicus
ttcacagccctgttcggagctcaaa

SEQ ID NO: 658338 - DNA, 25 bp, Rattus norvegicus
ggagaacttcacagccctgttcgga

SEQ ID NO: 658339 - DNA, 25 bp, Rattus norvegicus
tgctatggagaacttcacagccctg

SEQ ID NO: 658340 - DNA, 25 bp, Rattus norvegicus
cgagtgctatggagaacttcacagc

SEQ ID NO: 658341 - DNA, 25 bp, Rattus norvegicus
agcggcgagtgctatggagaacttc

SEQ ID NO: 658342 - DNA, 25 bp, Rattus norvegicus
agatcccgggtaaccaagagcggcg

SEQ ID NO: 658343 - DNA, 25 bp, Rattus norvegicus
gccagatcccgggtaaccaagagcg

SEQ ID NO: 658344 - DNA, 25 bp, Rattus norvegicus
cgccaccaagcgcactagggttcgg

SEQ ID NO: 658345 - DNA, 25 bp, Rattus norvegicus
ttcttctcattcatgcggctcgcgc

SEQ ID NO: 658346 - DNA, 25 bp, Rattus norvegicus
ggggcatggcaaactgcgcagaatt

SEQ ID NO: 658347 - DNA, 25 bp, Rattus norvegicus
ggccgtggttctctagactctgcgg

SEQ ID NO: 658348 - DNA, 25 bp, Rattus norvegicus
cggcgccgcgaacacgtagtgatac

SEQ ID NO: 658349 - DNA, 25 bp, Rattus norvegicus
atgcctccctagaacgtgcgcgcga

SEQ ID NO: 658350 - DNA, 25 bp, Rattus norvegicus
ttcccattggctcccaggagcgggc

SEQ ID NO: 658351 - DNA, 25 bp, Rattus norvegicus
cctcgcggggcacgttcttctcatt

SEQ ID NO: 658352 - DNA, 25 bp, Rattus norvegicus
ctagggtctgtagccctcacggcgt

SEQ ID NO: 658353 - DNA, 25 bp, Rattus norvegicus
cagcagtgccgtctggcctctgaga

SEQ ID NO: 658354 - DNA, 25 bp, Rattus norvegicus
ccgtcgttgtcaccgccgtcgttgt

SEQ ID NO: 658355 - DNA, 25 bp, Rattus norvegicus
gcacttccggttccgcaggggccag

SEQ ID NO: 658356 - DNA, 25 bp, Rattus norvegicus
tttcgaggcccatacagactgagga

SEQ ID NO: 658357 - DNA, 25 bp, Rattus norvegicus
gggcgtccgtttcgaggcccataca

SEQ ID NO: 658358 - DNA, 25 bp, Rattus norvegicus
ggccgttgccctcagcctagggtct

SEQ ID NO: 658359 - DNA, 25 bp, Rattus norvegicus
aaaggagtcgttgctggttcgccca

SEQ ID NO: 658360 - DNA, 25 bp, Rattus norvegicus
ccgctcttgcgcggtagtaggagac

SEQ ID NO: 658361 - DNA, 25 bp, Rattus norvegicus
agacgcggtcgcgtgatgcattttg

SEQ ID NO: 658362 - DNA, 25 bp, Rattus norvegicus
accgcatggccctctgggaattata

SEQ ID NO: 658363 - DNA, 25 bp, Rattus norvegicus
atggccctctgggaattatagttta

SEQ ID NO: 658364 - DNA, 25 bp, Rattus norvegicus
ctctgggaattatagtttaaggatt

SEQ ID NO: 658365 - DNA, 25 bp, Rattus norvegicus
tttaaggattgttctgtgacgcgcg

SEQ ID NO: 658366 - DNA, 25 bp, Rattus norvegicus
taaggattgttctgtgacgcgcgga

SEQ ID NO: 658367 - DNA, 25 bp, Rattus norvegicus
agtcgttgctggttcgcccacgcgc

SEQ ID NO: 658368 - DNA, 25 bp, Rattus norvegicus
ccgtcactttgtgcgggaagaccgc

SEQ ID NO: 658369 - DNA, 25 bp, Rattus norvegicus
tcacctaaatactagccggaaagca

SEQ ID NO: 658370 - DNA, 25 bp, Rattus norvegicus
gacgctcacctaaatactagccgga

SEQ ID NO: 658371 - DNA, 25 bp, Rattus norvegicus
gcagcgccgtcactttgtgcgggaa

SEQ ID NO: 658372 - DNA, 25 bp, Rattus norvegicus
aaagcaaaggcggttccgctcttgc

SEQ ID NO: 658373 - DNA, 25 bp, Rattus norvegicus
tgagaaaacgatctggcgccagttg

SEQ ID NO: 658374 - DNA, 25 bp, Rattus norvegicus
cacggttgtcactatgggaagggtc

SEQ ID NO: 658375 - DNA, 25 bp, Rattus norvegicus
aacagctgtgggaggcaagtttgtc

SEQ ID NO: 658376 - DNA, 25 bp, Rattus norvegicus
gcagatccctgcgaagtgtccgtta

SEQ ID NO: 658377 - DNA, 25 bp, Rattus norvegicus
aagtgtccgttacccgagtctctgg

SEQ ID NO: 658378 - DNA, 25 bp, Rattus norvegicus
tgggcacattgttccctctgtccga

SEQ ID NO: 658379 - DNA, 25 bp, Rattus norvegicus
tccactccgtttagagccacggttg

SEQ ID NO: 658380 - DNA, 25 bp, Rattus norvegicus
ctcggggatccctgattcgaaagcc

SEQ ID NO: 658381 - DNA, 25 bp, Rattus norvegicus
tttcatagatgaggggctgggccac

SEQ ID NO: 658382 - DNA, 25 bp, Rattus norvegicus
agatcgcctcccttgttgaccgtgg

SEQ ID NO: 658383 - DNA, 25 bp, Rattus norvegicus
cgcctccttataaagtatgtcctta

SEQ ID NO: 658384 - DNA, 25 bp, Rattus norvegicus
ccctgggtgactttgagagactttg

SEQ ID NO: 658385 - DNA, 25 bp, Rattus norvegicus
cctcctgctcgcttctgagaaaacg

SEQ ID NO: 658386 - DNA, 25 bp, Rattus norvegicus
ccttataaagtctgcaggcaccgga

SEQ ID NO: 658387 - DNA, 25 bp, Rattus norvegicus
acgcctgagtctcccgggagaagtc

SEQ ID NO: 658388 - DNA, 25 bp, Rattus norvegicus
gaagcaagctagagccgtgtttgtc

SEQ ID NO: 658389 - DNA, 25 bp, Rattus norvegicus
atgaggaacgaggaatttcgacgcc

SEQ ID NO: 658390 - DNA, 25 bp, Rattus norvegicus
cgaggaatttcgacgcctgagtctc

SEQ ID NO: 658391 - DNA, 25 bp, Rattus norvegicus
aagcgcctgtcgttttccggaggag

SEQ ID NO: 658392 - DNA, 25 bp, Rattus norvegicus
tttgagcagtccaccgcccaggggt

SEQ ID NO: 658393 - DNA, 25 bp, Rattus norvegicus
caggctccttcggtgggtctgacta

SEQ ID NO: 658394 - DNA, 25 bp, Rattus norvegicus
cttcggtgggtctgactagaggccc

SEQ ID NO: 658395 - DNA, 25 bp, Rattus norvegicus
agccgattgggtctcaggggttaat

SEQ ID NO: 658396 - DNA, 25 bp, Rattus norvegicus
cgcggcgctgcctagaggaacagat

SEQ ID NO: 658397 - DNA, 25 bp, Rattus norvegicus
cgagttcagggatcgcaaacagctc

SEQ ID NO: 658398 - DNA, 25 bp, Rattus norvegicus
gatcgcaaacagctccggggaaacg

SEQ ID NO: 658399 - DNA, 25 bp, Rattus norvegicus
cgctgcctagaggaacagatggctg

SEQ ID NO: 658400 - DNA, 25 bp, Rattus norvegicus
ctagagccgtgtttgtcgcggcgct

SEQ ID NO: 658401 - DNA, 25 bp, Rattus norvegicus
gcgcgctggaaccaagcccagagcg

SEQ ID NO: 658402 - DNA, 25 bp, Rattus norvegicus
ccacgccgtacaggtggttggaaga

SEQ ID NO: 658403 - DNA, 25 bp, Rattus norvegicus
cacgcttggaaatcggtgtcgcgca

SEQ ID NO: 658404 - DNA, 25 bp, Rattus norvegicus
tcttccatcggagcaccgcagtcag

SEQ ID NO: 658405 - DNA, 25 bp, Rattus norvegicus
agaacgtggtctcttccatcggagc

SEQ ID NO: 658406 - DNA, 25 bp, Rattus norvegicus
aagccgcggaacacgtgctccgtga

SEQ ID NO: 658407 - DNA, 25 bp, Rattus norvegicus
cccagtagtcgtcctcagtgggcgc

SEQ ID NO: 658408 - DNA, 25 bp, Rattus norvegicus
aacaaggggcaagttcggagcctca

SEQ ID NO: 658409 - DNA, 25 bp, Rattus norvegicus
gttgagccgcaggaactcgagcgct

SEQ ID NO: 658410 - DNA, 25 bp, Rattus norvegicus
ttcggagcctcagctccgtggggca

SEQ ID NO: 658411 - DNA, 25 bp, Rattus norvegicus
aactcgagcgctggcaggtcagcca

SEQ ID NO: 658412 - DNA, 25 bp, Rattus norvegicus
agcgaggccaggctgttgttgaaca

SEQ ID NO: 658413 - DNA, 25 bp, Rattus norvegicus
aaggctgcgcggtgtacgccctgca

SEQ ID NO: 658414 - DNA, 25 bp, Rattus norvegicus
cggttcccgtgcagcagcagccggt

SEQ ID NO: 658415 - DNA, 25 bp, Rattus norvegicus
ctcccgagtttttcagagccacgtg

SEQ ID NO: 658416 - DNA, 25 bp, Rattus norvegicus
gttccattcgttcacaccacctccg

SEQ ID NO: 658417 - DNA, 25 bp, Rattus norvegicus
cctccgcgtttctcggtccttctca

SEQ ID NO: 658418 - DNA, 25 bp, Rattus norvegicus
ccgtgcggcggttcacgattacttt

SEQ ID NO: 658419 - DNA, 25 bp, Rattus norvegicus
gcggcggttcacgattacttttctc

SEQ ID NO: 658420 - DNA, 25 bp, Rattus norvegicus
tcccgagtttttcagagccacgtgg

SEQ ID NO: 658421 - DNA, 25 bp, Rattus norvegicus
cgagtttttcagagccacgtggggt

SEQ ID NO: 658422 - DNA, 25 bp, Rattus norvegicus
cacagcgcggctgttccattcgttc

SEQ ID NO: 658423 - DNA, 25 bp, Rattus norvegicus
cgtgcgtgtgtaggctgggtgtgat

SEQ ID NO: 658424 - DNA, 25 bp, Rattus norvegicus
gtgcggcggttcacgattacttttc

SEQ ID NO: 658425 - DNA, 25 bp, Rattus norvegicus
gatgtaatattcagtgacacagcgc

SEQ ID NO: 658426 - DNA, 25 bp, Rattus norvegicus
gcggtcctctgcgtgtgtgagtgcc

SEQ ID NO: 658427 - DNA, 25 bp, Rattus norvegicus
aatattcagtgacacagcgcggctg

SEQ ID NO: 658428 - DNA, 25 bp, Rattus norvegicus
attcagtgacacagcgcggctgttc

SEQ ID NO: 658429 - DNA, 25 bp, Rattus norvegicus
agtcctcagcgtcccccggagcagg

SEQ ID NO: 658430 - DNA, 25 bp, Rattus norvegicus
gagccgggacaacagaacctgagcc

SEQ ID NO: 658431 - DNA, 25 bp, Rattus norvegicus
ccagccggcccgagtcctcagcgtc

SEQ ID NO: 658432 - DNA, 25 bp, Rattus norvegicus
ctcttcctcctaaccagttcggtct

SEQ ID NO: 658433 - DNA, 25 bp, Rattus norvegicus
aggagttgctgagtcggcgcttccc

SEQ ID NO: 658434 - DNA, 25 bp, Rattus norvegicus
agccgggacaacagaacctgagcct

SEQ ID NO: 658435 - DNA, 25 bp, Rattus norvegicus
ggagccgggacaacagaacctgagc

SEQ ID NO: 658436 - DNA, 25 bp, Rattus norvegicus
tggagccgggacaacagaacctgag

SEQ ID NO: 658437 - DNA, 25 bp, Rattus norvegicus
gtggagccgggacaacagaacctga

SEQ ID NO: 658438 - DNA, 25 bp, Rattus norvegicus
aggtggagccgggacaacagaacct

SEQ ID NO: 658439 - DNA, 25 bp, Rattus norvegicus
agccggcccgagtcctcagcgtccc

SEQ ID NO: 658440 - DNA, 25 bp, Rattus norvegicus
gttgctgagtcggcgcttccccagc

SEQ ID NO: 658441 - DNA, 25 bp, Rattus norvegicus
gagttgctgagtcggcgcttcccca

SEQ ID NO: 658442 - DNA, 25 bp, Rattus norvegicus
tctcttcctcctaaccagttcggtc

SEQ ID NO: 658443 - DNA, 25 bp, Rattus norvegicus
cagcatcttgtctcgacgatcgggg

SEQ ID NO: 658444 - DNA, 25 bp, Rattus norvegicus
aggctctaagcccagtgccctcctg

SEQ ID NO: 658445 - DNA, 25 bp, Rattus norvegicus
gctcccgcgctaagcggttttttgc

SEQ ID NO: 658446 - DNA, 25 bp, Rattus norvegicus
gcgctaagcggttttttgctcctta

SEQ ID NO: 658447 - DNA, 25 bp, Rattus norvegicus
gagaggggcgcctctctctagtgtc

SEQ ID NO: 658448 - DNA, 25 bp, Rattus norvegicus
aggggcgcctctctctagtgtcctc

SEQ ID NO: 658449 - DNA, 25 bp, Rattus norvegicus
ggccggtgtccctaccttgcagcag

SEQ ID NO: 658450 - DNA, 25 bp, Rattus norvegicus
ggtgtccctaccttgcagcaggcgc

SEQ ID NO: 658451 - DNA, 25 bp, Rattus norvegicus
ctaccttgcagcaggcgccggagcc

SEQ ID NO: 658452 - DNA, 25 bp, Rattus norvegicus
taaccagttcggtctgccctccgcg

SEQ ID NO: 658453 - DNA, 25 bp, Rattus norvegicus
cgggcagcatcttgtctcgacgatc

SEQ ID NO: 658454 - DNA, 25 bp, Rattus norvegicus
cccgcacattcccgcaggctctaag

SEQ ID NO: 658455 - DNA, 25 bp, Rattus norvegicus
cggagcccgggcagcatcttgtctc

SEQ ID NO: 658456 - DNA, 25 bp, Rattus norvegicus
cagtgccctcctgcggctggcagct

SEQ ID NO: 658457 - DNA, 25 bp, Rattus norvegicus
atcggcaccaccaagctgctgtatg

SEQ ID NO: 658458 - DNA, 25 bp, Rattus norvegicus
ttacccgaagtgcacggacaatgga

SEQ ID NO: 658459 - DNA, 25 bp, Rattus norvegicus
gggcagatgaagacatacctttacc

SEQ ID NO: 658460 - DNA, 25 bp, Rattus norvegicus
cgactttgactaccgagggaccgtg

SEQ ID NO: 658461 - DNA, 25 bp, Rattus norvegicus
gacaccgtcaacatcgccagcagga

SEQ ID NO: 658462 - DNA, 25 bp, Rattus norvegicus
ctcacggcaggtgtcatcggcacca

SEQ ID NO: 658463 - DNA, 25 bp, Rattus norvegicus
tggttcaacttcaagctcagggtcg

SEQ ID NO: 658464 - DNA, 25 bp, Rattus norvegicus
cgcgtggtggatgacttcaacaaca

SEQ ID NO: 658465 - DNA, 25 bp, Rattus norvegicus
ttcgagttcgccaaggagatgatgc

SEQ ID NO: 658466 - DNA, 25 bp, Rattus norvegicus
ggagcacctgcgtatcctcttcgag

SEQ ID NO: 658467 - DNA, 25 bp, Rattus norvegicus
agatcaagaccatcggggccacgta

SEQ ID NO: 658468 - DNA, 25 bp, Rattus norvegicus
cggtgacttcgacgagctcttgagc

SEQ ID NO: 658469 - DNA, 25 bp, Rattus norvegicus
cctcaatgagctgatcggtgacttc

SEQ ID NO: 658470 - DNA, 25 bp, Rattus norvegicus
tgctgagcaagatgggttacgactt

SEQ ID NO: 658471 - DNA, 25 bp, Rattus norvegicus
ggagtagttctccatctagcccact

SEQ ID NO: 658472 - DNA, 25 bp, Rattus norvegicus
atcccttcttgctctctgtgtgtgt

SEQ ID NO: 658473 - DNA, 25 bp, Rattus norvegicus
gaaatcccttcttgctctctgtgtg

SEQ ID NO: 658474 - DNA, 25 bp, Rattus norvegicus
acgcctttagagaaatcccttcttg

SEQ ID NO: 658475 - DNA, 25 bp, Rattus norvegicus
gccacgcctttagagaaatcccttc

SEQ ID NO: 658476 - DNA, 25 bp, Rattus norvegicus
cggcgccacgcctttagagaaatcc

SEQ ID NO: 658477 - DNA, 25 bp, Rattus norvegicus
ggaaggctgtgttcccgtagcctcc

SEQ ID NO: 658478 - DNA, 25 bp, Rattus norvegicus
agatcgggaaggctgtgttcccgta

SEQ ID NO: 658479 - DNA, 25 bp, Rattus norvegicus
atctagcccactcagtctcgggccc

SEQ ID NO: 658480 - DNA, 25 bp, Rattus norvegicus
gcgggagtagttctccatctagccc

SEQ ID NO: 658481 - DNA, 25 bp, Rattus norvegicus
ggaggcgggagtagttctccatcta

SEQ ID NO: 658482 - DNA, 25 bp, Rattus norvegicus
actaggaggcgggagtagttctcca

SEQ ID NO: 658483 - DNA, 25 bp, Rattus norvegicus
accctttggtgactactaggaggcg

SEQ ID NO: 658484 - DNA, 25 bp, Rattus norvegicus
ccaaccttgggagatcgggaaggct

SEQ ID NO: 658485 - DNA, 25 bp, Rattus norvegicus
ttcgcattttgtttagcacgggctc

SEQ ID NO: 658486 - DNA, 25 bp, Rattus norvegicus
gcgccaagcgctcccgcaggatggc

SEQ ID NO: 658487 - DNA, 25 bp, Rattus norvegicus
cgcgggccaagctgccgcgctcacc

SEQ ID NO: 658488 - DNA, 25 bp, Rattus norvegicus
cgcgctcaccgtccgagggcaaggc

SEQ ID NO: 658489 - DNA, 25 bp, Rattus norvegicus
tgaggagccgcacggactcagcccg

SEQ ID NO: 658490 - DNA, 25 bp, Rattus norvegicus
gactcagcccgctactgcccacccg

SEQ ID NO: 658491 - DNA, 25 bp, Rattus norvegicus
acgtgggccagaggtagggacactt

SEQ ID NO: 658492 - DNA, 25 bp, Rattus norvegicus
gaggggcttcgcatccttcgcattt

SEQ ID NO: 658493 - DNA, 25 bp, Rattus norvegicus
cctgcgcctgccgttgcctgtagcc

SEQ ID NO: 658494 - DNA, 25 bp, Rattus norvegicus
cgcatccttcgcattttgtttagca

SEQ ID NO: 658495 - DNA, 25 bp, Rattus norvegicus
cgcattttgtttagcacgggctctg

SEQ ID NO: 658496 - DNA, 25 bp, Rattus norvegicus
ttttgtttagcacgggctctgcttc

SEQ ID NO: 658497 - DNA, 25 bp, Rattus norvegicus
ggctctgcttccctgcgcctgccgt

SEQ ID NO: 658498 - DNA, 25 bp, Rattus norvegicus
ggcttcgcatccttcgcattttgtt

SEQ ID NO: 658499 - DNA, 25 bp, Rattus norvegicus
aatgagccgcggcacaatctgtcgc

SEQ ID NO: 658500 - DNA, 25 bp, Rattus norvegicus
atatcacaagatgcggagacagacg

SEQ ID NO: 658501 - DNA, 25 bp, Rattus norvegicus
ggagcgaaatatcacaagatgcgga

SEQ ID NO: 658502 - DNA, 25 bp, Rattus norvegicus
ccggggagcgaaatatcacaagatg

SEQ ID NO: 658503 - DNA, 25 bp, Rattus norvegicus
tcccggggagcgaaatatcacaaga

SEQ ID NO: 658504 - DNA, 25 bp, Rattus norvegicus
ggctcccggggagcgaaatatcaca

SEQ ID NO: 658505 - DNA, 25 bp, Rattus norvegicus
ctgggtttgtttgccgagctgcctc

SEQ ID NO: 658506 - DNA, 25 bp, Rattus norvegicus
atctgtcgctgggtttgtttgccga

SEQ ID NO: 658507 - DNA, 25 bp, Rattus norvegicus
caatctgtcgctgggtttgtttgcc

SEQ ID NO: 658508 - DNA, 25 bp, Rattus norvegicus
cgcggcacaatctgtcgctgggttt

SEQ ID NO: 658509 - DNA, 25 bp, Rattus norvegicus
cacaagatgcggagacagacgctga

SEQ ID NO: 658510 - DNA, 25 bp, Rattus norvegicus
gatttggcgtccttccccggaatga

SEQ ID NO: 658511 - DNA, 25 bp, Rattus norvegicus
tagcagggtgggatttggcgtcctt

SEQ ID NO: 658512 - DNA, 25 bp, Rattus norvegicus
cggcacaatctgtcgctgggtttgt

SEQ ID NO: 658513 - DNA, 25 bp, Rattus norvegicus
gaaatcagcctcgtgggatcccgta

SEQ ID NO: 658514 - DNA, 25 bp, Rattus norvegicus
ggatcccgtagcaagaccctcgctt

SEQ ID NO: 658515 - DNA, 25 bp, Rattus norvegicus
ctcgctttagacgaccaggggcacc

SEQ ID NO: 658516 - DNA, 25 bp, Rattus norvegicus
ggcaccgacgctctaggcgacagtc

SEQ ID NO: 658517 - DNA, 25 bp, Rattus norvegicus
atggtgcctttctagccaggtcttc

SEQ ID NO: 658518 - DNA, 25 bp, Rattus norvegicus
ctctctatggtttgtgcgcgacttc

SEQ ID NO: 658519 - DNA, 25 bp, Rattus norvegicus
gccctcactgtgtcgtcgcgaggct

SEQ ID NO: 658520 - DNA, 25 bp, Rattus norvegicus
attgggatggatcgatccgcgttca

SEQ ID NO: 658521 - DNA, 25 bp, Rattus norvegicus
tccgcgttcaaattcgcgggcagtg

SEQ ID NO: 658522 - DNA, 25 bp, Rattus norvegicus
cgggcagtgggcgaatccattttaa
